United States Patent 8,969,254 (OLIGONUCLEOTIDE ARRAY FOR TISSUE TYPING) - sequence listing, part 12

SEQ ID NO: 265262 - DNA, 40 bp, Artificial Sequence
  Description of Artificial Sequence: Synthetic oligonucleotide
agccatgaagtcttcagtcatcatccacaaacaagttatg

SEQ ID NO: 265263 - DNA, 39 bp, Artificial Sequence
  Description of Artificial Sequence: Synthetic oligonucleotide
gccatgaagtcttcagtcatcatccacaaacaagttatg

SEQ ID NO: 265264 - DNA, 39 bp, Artificial Sequence
  Description of Artificial Sequence: Synthetic oligonucleotide
ccatgaagtcttcagtcatcatccacaaacaagttatgg

SEQ ID NO: 265265 - DNA, 40 bp, Artificial Sequence
  Description of Artificial Sequence: Synthetic oligonucleotide
catgaagtcttcagtcatcatccacaaacaagttatggag

SEQ ID NO: 265266 - DNA, 40 bp, Artificial Sequence
  Description of Artificial Sequence: Synthetic oligonucleotide
atgaagtcttcagtcatcatccacaaacaagttatggagg

SEQ ID NO: 265267 - DNA, 39 bp, Artificial Sequence
  Description of Artificial Sequence: Synthetic oligonucleotide
tgaagtcttcagtcatcatccacaaacaagttatggagg

SEQ ID NO: 265268 - DNA, 38 bp, Artificial Sequence
  Description of Artificial Sequence: Synthetic oligonucleotide
gaagtcttcagtcatcatccacaaacaagttatggagg

SEQ ID NO: 265269 - DNA, 39 bp, Artificial Sequence
  Description of Artificial Sequence: Synthetic oligonucleotide
aagtcttcagtcatcatccacaaacaagttatggaggag

SEQ ID NO: 265270 - DNA, 38 bp, Artificial Sequence
  Description of Artificial Sequence: Synthetic oligonucleotide
agtcttcagtcatcatccacaaacaagttatggaggag

SEQ ID NO: 265271 - DNA, 37 bp, Artificial Sequence
  Description of Artificial Sequence: Synthetic oligonucleotide
gtcttcagtcatcatccacaaacaagttatggaggag

SEQ ID NO: 265272 - DNA, 39 bp, Artificial Sequence
  Description of Artificial Sequence: Synthetic oligonucleotide
tcttcagtcatcatccacaaacaagttatggaggagtag

SEQ ID NO: 265273 - DNA, 38 bp, Artificial Sequence
  Description of Artificial Sequence: Synthetic oligonucleotide
cttcagtcatcatccacaaacaagttatggaggagtag

SEQ ID NO: 265274 - DNA, 38 bp, Artificial Sequence
  Description of Artificial Sequence: Synthetic oligonucleotide
ttcagtcatcatccacaaacaagttatggaggagtagc

SEQ ID NO: 265275 - DNA, 37 bp, Artificial Sequence
  Description of Artificial Sequence: Synthetic oligonucleotide
tcagtcatcatccacaaacaagttatggaggagtagc

SEQ ID NO: 265276 - DNA, 36 bp, Artificial Sequence
  Description of Artificial Sequence: Synthetic oligonucleotide
cagtcatcatccacaaacaagttatggaggagtagc

SEQ ID NO: 265277 - DNA, 37 bp, Artificial Sequence
  Description of Artificial Sequence: Synthetic oligonucleotide
agtcatcatccacaaacaagttatggaggagtagctg

SEQ ID NO: 265278 - DNA, 36 bp, Artificial Sequence
  Description of Artificial Sequence: Synthetic oligonucleotide
gtcatcatccacaaacaagttatggaggagtagctg

SEQ ID NO: 265279 - DNA, 39 bp, Artificial Sequence
  Description of Artificial Sequence: Synthetic oligonucleotide
tcatcatccacaaacaagttatggaggagtagctgaatg

SEQ ID NO: 265280 - DNA, 38 bp, Artificial Sequence
  Description of Artificial Sequence: Synthetic oligonucleotide
catcatccacaaacaagttatggaggagtagctgaatg

SEQ ID NO: 265281 - DNA, 38 bp, Artificial Sequence
  Description of Artificial Sequence: Synthetic oligonucleotide
atcatccacaaacaagttatggaggagtagctgaatgg

SEQ ID NO: 265282 - DNA, 37 bp, Artificial Sequence
  Description of Artificial Sequence: Synthetic oligonucleotide
tcatccacaaacaagttatggaggagtagctgaatgg

SEQ ID NO: 265283 - DNA, 36 bp, Artificial Sequence
  Description of Artificial Sequence: Synthetic oligonucleotide
catccacaaacaagttatggaggagtagctgaatgg

SEQ ID NO: 265284 - DNA, 38 bp, Artificial Sequence
  Description of Artificial Sequence: Synthetic oligonucleotide
atccacaaacaagttatggaggagtagctgaatggaac

SEQ ID NO: 265285 - DNA, 37 bp, Artificial Sequence
  Description of Artificial Sequence: Synthetic oligonucleotide
tccacaaacaagttatggaggagtagctgaatggaac

SEQ ID NO: 265286 - DNA, 36 bp, Artificial Sequence
  Description of Artificial Sequence: Synthetic oligonucleotide
ccacaaacaagttatggaggagtagctgaatggaac

SEQ ID NO: 265287 - DNA, 39 bp, Artificial Sequence
  Description of Artificial Sequence: Synthetic oligonucleotide
cacaaacaagttatggaggagtagctgaatggaacaaac

SEQ ID NO: 265288 - DNA, 42 bp, Artificial Sequence
  Description of Artificial Sequence: Synthetic oligonucleotide
acaaacaagttatggaggagtagctgaatggaacaaacatag

SEQ ID NO: 265289 - DNA, 41 bp, Artificial Sequence
  Description of Artificial Sequence: Synthetic oligonucleotide
caaacaagttatggaggagtagctgaatggaacaaacatag

SEQ ID NO: 265290 - DNA, 42 bp, Artificial Sequence
  Description of Artificial Sequence: Synthetic oligonucleotide
aaacaagttatggaggagtagctgaatggaacaaacatagag

SEQ ID NO: 265291 - DNA, 41 bp, Artificial Sequence
  Description of Artificial Sequence: Synthetic oligonucleotide
aacaagttatggaggagtagctgaatggaacaaacatagag

SEQ ID NO: 265292 - DNA, 40 bp, Artificial Sequence
  Description of Artificial Sequence: Synthetic oligonucleotide
acaagttatggaggagtagctgaatggaacaaacatagag

SEQ ID NO: 265293 - DNA, 39 bp, Artificial Sequence
  Description of Artificial Sequence: Synthetic oligonucleotide
caagttatggaggagtagctgaatggaacaaacatagag

SEQ ID NO: 265294 - DNA, 39 bp, Artificial Sequence
  Description of Artificial Sequence: Synthetic oligonucleotide
aagttatggaggagtagctgaatggaacaaacatagagc

SEQ ID NO: 265295 - DNA, 38 bp, Artificial Sequence
  Description of Artificial Sequence: Synthetic oligonucleotide
agttatggaggagtagctgaatggaacaaacatagagc

SEQ ID NO: 265296 - DNA, 37 bp, Artificial Sequence
  Description of Artificial Sequence: Synthetic oligonucleotide
gttatggaggagtagctgaatggaacaaacatagagc

SEQ ID NO: 265297 - DNA, 39 bp, Artificial Sequence
  Description of Artificial Sequence: Synthetic oligonucleotide
ttatggaggagtagctgaatggaacaaacatagagctag

SEQ ID NO: 265298 - DNA, 38 bp, Artificial Sequence
  Description of Artificial Sequence: Synthetic oligonucleotide
tatggaggagtagctgaatggaacaaacatagagctag

SEQ ID NO: 265299 - DNA, 37 bp, Artificial Sequence
  Description of Artificial Sequence: Synthetic oligonucleotide
atggaggagtagctgaatggaacaaacatagagctag

SEQ ID NO: 265300 - DNA, 36 bp, Artificial Sequence
  Description of Artificial Sequence: Synthetic oligonucleotide
tggaggagtagctgaatggaacaaacatagagctag

SEQ ID NO: 265301 - DNA, 35 bp, Artificial Sequence
  Description of Artificial Sequence: Synthetic oligonucleotide
ggaggagtagctgaatggaacaaacatagagctag

SEQ ID NO: 265302 - DNA, 35 bp, Artificial Sequence
  Description of Artificial Sequence: Synthetic oligonucleotide
gaggagtagctgaatggaacaaacatagagctagc

SEQ ID NO: 265303 - DNA, 35 bp, Artificial Sequence
  Description of Artificial Sequence: Synthetic oligonucleotide
aggagtagctgaatggaacaaacatagagctagcc

SEQ ID NO: 265304 - DNA, 34 bp, Artificial Sequence
  Description of Artificial Sequence: Synthetic oligonucleotide
ggagtagctgaatggaacaaacatagagctagcc

SEQ ID NO: 265305 - DNA, 35 bp, Artificial Sequence
  Description of Artificial Sequence: Synthetic oligonucleotide
gagtagctgaatggaacaaacatagagctagcctc

SEQ ID NO: 265306 - DNA, 36 bp, Artificial Sequence
  Description of Artificial Sequence: Synthetic oligonucleotide
agtagctgaatggaacaaacatagagctagcctcag

SEQ ID NO: 265307 - DNA, 35 bp, Artificial Sequence
  Description of Artificial Sequence: Synthetic oligonucleotide
gtagctgaatggaacaaacatagagctagcctcag

SEQ ID NO: 265308 - DNA, 36 bp, Artificial Sequence
  Description of Artificial Sequence: Synthetic oligonucleotide
tagctgaatggaacaaacatagagctagcctcagtg

SEQ ID NO: 265309 - DNA, 35 bp, Artificial Sequence
  Description of Artificial Sequence: Synthetic oligonucleotide
agctgaatggaacaaacatagagctagcctcagtg

SEQ ID NO: 265310 - DNA, 34 bp, Artificial Sequence
  Description of Artificial Sequence: Synthetic oligonucleotide
gctgaatggaacaaacatagagctagcctcagtg

SEQ ID NO: 265311 - DNA, 34 bp, Artificial Sequence
  Description of Artificial Sequence: Synthetic oligonucleotide
ctgaatggaacaaacatagagctagcctcagtgc

SEQ ID NO: 265312 - DNA, 35 bp, Artificial Sequence
  Description of Artificial Sequence: Synthetic oligonucleotide
tgaatggaacaaacatagagctagcctcagtgcag

SEQ ID NO: 265313 - DNA, 34 bp, Artificial Sequence
  Description of Artificial Sequence: Synthetic oligonucleotide
gaatggaacaaacatagagctagcctcagtgcag

SEQ ID NO: 265314 - DNA, 34 bp, Artificial Sequence
  Description of Artificial Sequence: Synthetic oligonucleotide
aatggaacaaacatagagctagcctcagtgcagc

SEQ ID NO: 265315 - DNA, 33 bp, Artificial Sequence
  Description of Artificial Sequence: Synthetic oligonucleotide
atggaacaaacatagagctagcctcagtgcagc

SEQ ID NO: 265316 - DNA, 32 bp, Artificial Sequence
  Description of Artificial Sequence: Synthetic oligonucleotide
tggaacaaacatagagctagcctcagtgcagc

SEQ ID NO: 265317 - DNA, 31 bp, Artificial Sequence
  Description of Artificial Sequence: Synthetic oligonucleotide
ggaacaaacatagagctagcctcagtgcagc

SEQ ID NO: 265318 - DNA, 31 bp, Artificial Sequence
  Description of Artificial Sequence: Synthetic oligonucleotide
gaacaaacatagagctagcctcagtgcagcg

SEQ ID NO: 265319 - DNA, 32 bp, Artificial Sequence
  Description of Artificial Sequence: Synthetic oligonucleotide
aacaaacatagagctagcctcagtgcagcgtg

SEQ ID NO: 265320 - DNA, 31 bp, Artificial Sequence
  Description of Artificial Sequence: Synthetic oligonucleotide
acaaacatagagctagcctcagtgcagcgtg

SEQ ID NO: 265321 - DNA, 30 bp, Artificial Sequence
  Description of Artificial Sequence: Synthetic oligonucleotide
caaacatagagctagcctcagtgcagcgtg

SEQ ID NO: 265322 - DNA, 30 bp, Artificial Sequence
  Description of Artificial Sequence: Synthetic oligonucleotide
aaacatagagctagcctcagtgcagcgtgg

SEQ ID NO: 265323 - DNA, 29 bp, Artificial Sequence
  Description of Artificial Sequence: Synthetic oligonucleotide
aacatagagctagcctcagtgcagcgtgg

SEQ ID NO: 265324 - DNA, 28 bp, Artificial Sequence
  Description of Artificial Sequence: Synthetic oligonucleotide
acatagagctagcctcagtgcagcgtgg

SEQ ID NO: 265325 - DNA, 27 bp, Artificial Sequence
  Description of Artificial Sequence: Synthetic oligonucleotide
catagagctagcctcagtgcagcgtgg

SEQ ID NO: 265326 - DNA, 27 bp, Artificial Sequence
  Description of Artificial Sequence: Synthetic oligonucleotide
atagagctagcctcagtgcagcgtggc

SEQ ID NO: 265327 - DNA, 26 bp, Artificial Sequence
  Description of Artificial Sequence: Synthetic oligonucleotide
tagagctagcctcagtgcagcgtggc

SEQ ID NO: 265328 - DNA, 25 bp, Artificial Sequence
  Description of Artificial Sequence: Synthetic oligonucleotide
agagctagcctcagtgcagcgtggc

SEQ ID NO: 265329 - DNA, 24 bp, Artificial Sequence
  Description of Artificial Sequence: Synthetic oligonucleotide
gagctagcctcagtgcagcgtggc

SEQ ID NO: 265330 - DNA, 25 bp, Artificial Sequence
  Description of Artificial Sequence: Synthetic oligonucleotide
agctagcctcagtgcagcgtggcca

SEQ ID NO: 265331 - DNA, 24 bp, Artificial Sequence
  Description of Artificial Sequence: Synthetic oligonucleotide
gctagcctcagtgcagcgtggcca

SEQ ID NO: 265332 - DNA, 27 bp, Artificial Sequence
  Description of Artificial Sequence: Synthetic oligonucleotide
ctagcctcagtgcagcgtggccagaaa

SEQ ID NO: 265333 - DNA, 29 bp, Artificial Sequence
  Description of Artificial Sequence: Synthetic oligonucleotide
tagcctcagtgcagcgtggccagaaattc

SEQ ID NO: 265334 - DNA, 28 bp, Artificial Sequence
  Description of Artificial Sequence: Synthetic oligonucleotide
agcctcagtgcagcgtggccagaaattc

SEQ ID NO: 265335 - DNA, 27 bp, Artificial Sequence
  Description of Artificial Sequence: Synthetic oligonucleotide
gcctcagtgcagcgtggccagaaattc

SEQ ID NO: 265336 - DNA, 27 bp, Artificial Sequence
  Description of Artificial Sequence: Synthetic oligonucleotide
cctcagtgcagcgtggccagaaattcc

SEQ ID NO: 265337 - DNA, 28 bp, Artificial Sequence
  Description of Artificial Sequence: Synthetic oligonucleotide
ctcagtgcagcgtggccagaaattccac

SEQ ID NO: 265338 - DNA, 30 bp, Artificial Sequence
  Description of Artificial Sequence: Synthetic oligonucleotide
tcagtgcagcgtggccagaaattccacatg

SEQ ID NO: 265339 - DNA, 29 bp, Artificial Sequence
  Description of Artificial Sequence: Synthetic oligonucleotide
cagtgcagcgtggccagaaattccacatg

SEQ ID NO: 265340 - DNA, 31 bp, Artificial Sequence
  Description of Artificial Sequence: Synthetic oligonucleotide
agtgcagcgtggccagaaattccacatgatc

SEQ ID NO: 265341 - DNA, 30 bp, Artificial Sequence
  Description of Artificial Sequence: Synthetic oligonucleotide
gtgcagcgtggccagaaattccacatgatc

SEQ ID NO: 265342 - DNA, 31 bp, Artificial Sequence
  Description of Artificial Sequence: Synthetic oligonucleotide
tgcagcgtggccagaaattccacatgatcac

SEQ ID NO: 265343 - DNA, 30 bp, Artificial Sequence
  Description of Artificial Sequence: Synthetic oligonucleotide
gcagcgtggccagaaattccacatgatcac

SEQ ID NO: 265344 - DNA, 33 bp, Artificial Sequence
  Description of Artificial Sequence: Synthetic oligonucleotide
cagcgtggccagaaattccacatgatcacaaag

SEQ ID NO: 265345 - DNA, 33 bp, Artificial Sequence
  Description of Artificial Sequence: Synthetic oligonucleotide
agcgtggccagaaattccacatgatcacaaagg

SEQ ID NO: 265346 - DNA, 32 bp, Artificial Sequence
  Description of Artificial Sequence: Synthetic oligonucleotide
gcgtggccagaaattccacatgatcacaaagg

SEQ ID NO: 265347 - DNA, 34 bp, Artificial Sequence
  Description of Artificial Sequence: Synthetic oligonucleotide
cgtggccagaaattccacatgatcacaaaggtag

SEQ ID NO: 265348 - DNA, 36 bp, Artificial Sequence
  Description of Artificial Sequence: Synthetic oligonucleotide
gtggccagaaattccacatgatcacaaaggtagaac

SEQ ID NO: 265349 - DNA, 38 bp, Artificial Sequence
  Description of Artificial Sequence: Synthetic oligonucleotide
tggccagaaattccacatgatcacaaaggtagaacttg

SEQ ID NO: 265350 - DNA, 37 bp, Artificial Sequence
  Description of Artificial Sequence: Synthetic oligonucleotide
ggccagaaattccacatgatcacaaaggtagaacttg

SEQ ID NO: 265351 - DNA, 39 bp, Artificial Sequence
  Description of Artificial Sequence: Synthetic oligonucleotide
gccagaaattccacatgatcacaaaggtagaacttgatg

SEQ ID NO: 265352 - DNA, 40 bp, Artificial Sequence
  Description of Artificial Sequence: Synthetic oligonucleotide
ccagaaattccacatgatcacaaaggtagaacttgatgag

SEQ ID NO: 265353 - DNA, 40 bp, Artificial Sequence
  Description of Artificial Sequence: Synthetic oligonucleotide
cagaaattccacatgatcacaaaggtagaacttgatgagg

SEQ ID NO: 265354 - DNA, 44 bp, Artificial Sequence
  Description of Artificial Sequence: Synthetic oligonucleotide
agaaattccacatgatcacaaaggtagaacttgatgaggttatc

SEQ ID NO: 265355 - DNA, 43 bp, Artificial Sequence
  Description of Artificial Sequence: Synthetic oligonucleotide
gaaattccacatgatcacaaaggtagaacttgatgaggttatc

SEQ ID NO: 265356 - DNA, 45 bp, Artificial Sequence
  Description of Artificial Sequence: Synthetic oligonucleotide
aaattccacatgatcacaaaggtagaacttgatgaggttatctag

SEQ ID NO: 265357 - DNA, 44 bp, Artificial Sequence
  Description of Artificial Sequence: Synthetic oligonucleotide
aattccacatgatcacaaaggtagaacttgatgaggttatctag

SEQ ID NO: 265358 - DNA, 43 bp, Artificial Sequence
  Description of Artificial Sequence: Synthetic oligonucleotide
attccacatgatcacaaaggtagaacttgatgaggttatctag

SEQ ID NO: 265359 - DNA, 42 bp, Artificial Sequence
  Description of Artificial Sequence: Synthetic oligonucleotide
ttccacatgatcacaaaggtagaacttgatgaggttatctag

SEQ ID NO: 265360 - DNA, 41 bp, Artificial Sequence
  Description of Artificial Sequence: Synthetic oligonucleotide
tccacatgatcacaaaggtagaacttgatgaggttatctag

SEQ ID NO: 265361 - DNA, 40 bp, Artificial Sequence
  Description of Artificial Sequence: Synthetic oligonucleotide
ccacatgatcacaaaggtagaacttgatgaggttatctag

SEQ ID NO: 265362 - DNA, 40 bp, Artificial Sequence
  Description of Artificial Sequence: Synthetic oligonucleotide
cacatgatcacaaaggtagaacttgatgaggttatctagg

SEQ ID NO: 265363 - DNA, 41 bp, Artificial Sequence
  Description of Artificial Sequence: Synthetic oligonucleotide
acatgatcacaaaggtagaacttgatgaggttatctaggac

SEQ ID NO: 265364 - DNA, 40 bp, Artificial Sequence
  Description of Artificial Sequence: Synthetic oligonucleotide
catgatcacaaaggtagaacttgatgaggttatctaggac

SEQ ID NO: 265365 - DNA, 27 bp, Artificial Sequence
  Description of Artificial Sequence: Synthetic oligonucleotide
ttgtcccgtgcttccagcgcgggtttt

SEQ ID NO: 265366 - DNA, 26 bp, Artificial Sequence
  Description of Artificial Sequence: Synthetic oligonucleotide
tgtcccgtgcttccagcgcgggtttt

SEQ ID NO: 265367 - DNA, 25 bp, Artificial Sequence
  Description of Artificial Sequence: Synthetic oligonucleotide
gtcccgtgcttccagcgcgggtttt

SEQ ID NO: 265368 - DNA, 26 bp, Artificial Sequence
  Description of Artificial Sequence: Synthetic oligonucleotide
tcccgtgcttccagcgcgggttttga

SEQ ID NO: 265369 - DNA, 25 bp, Artificial Sequence
  Description of Artificial Sequence: Synthetic oligonucleotide
cccgtgcttccagcgcgggttttga

SEQ ID NO: 265370 - DNA, 25 bp, Artificial Sequence
  Description of Artificial Sequence: Synthetic oligonucleotide
ccgtgcttccagcgcgggttttgac

SEQ ID NO: 265371 - DNA, 25 bp, Artificial Sequence
  Description of Artificial Sequence: Synthetic oligonucleotide
cgtgcttccagcgcgggttttgacg

SEQ ID NO: 265372 - DNA, 25 bp, Artificial Sequence
  Description of Artificial Sequence: Synthetic oligonucleotide
gtgcttccagcgcgggttttgacgg

SEQ ID NO: 265373 - DNA, 25 bp, Artificial Sequence
  Description of Artificial Sequence: Synthetic oligonucleotide
tgcttccagcgcgggttttgacggc

SEQ ID NO: 265374 - DNA, 24 bp, Artificial Sequence
  Description of Artificial Sequence: Synthetic oligonucleotide
gcttccagcgcgggttttgacggc

SEQ ID NO: 265375 - DNA, 25 bp, Artificial Sequence
  Description of Artificial Sequence: Synthetic oligonucleotide
cttccagcgcgggttttgacggcca

SEQ ID NO: 265376 - DNA, 27 bp, Artificial Sequence
  Description of Artificial Sequence: Synthetic oligonucleotide
ttccagcgcgggttttgacggccacat

SEQ ID NO: 265377 - DNA, 27 bp, Artificial Sequence
  Description of Artificial Sequence: Synthetic oligonucleotide
tccagcgcgggttttgacggccacatt

SEQ ID NO: 265378 - DNA, 27 bp, Artificial Sequence
  Description of Artificial Sequence: Synthetic oligonucleotide
ccagcgcgggttttgacggccacatta

SEQ ID NO: 265379 - DNA, 27 bp, Artificial Sequence
  Description of Artificial Sequence: Synthetic oligonucleotide
cagcgcgggttttgacggccacattag

SEQ ID NO: 265380 - DNA, 27 bp, Artificial Sequence
  Description of Artificial Sequence: Synthetic oligonucleotide
agcgcgggttttgacggccacattagc

SEQ ID NO: 265381 - DNA, 27 bp, Artificial Sequence
  Description of Artificial Sequence: Synthetic oligonucleotide
gcgcgggttttgacggccacattagca

SEQ ID NO: 265382 - DNA, 33 bp, Artificial Sequence
  Description of Artificial Sequence: Synthetic oligonucleotide
cgcgggttttgacggccacattagcattttttc

SEQ ID NO: 265383 - DNA, 34 bp, Artificial Sequence
  Description of Artificial Sequence: Synthetic oligonucleotide
gcgggttttgacggccacattagcattttttctc

SEQ ID NO: 265384 - DNA, 34 bp, Artificial Sequence
  Description of Artificial Sequence: Synthetic oligonucleotide
cgggttttgacggccacattagcattttttctcc

SEQ ID NO: 265385 - DNA, 34 bp, Artificial Sequence
  Description of Artificial Sequence: Synthetic oligonucleotide
gggttttgacggccacattagcattttttctccc

SEQ ID NO: 265386 - DNA, 34 bp, Artificial Sequence
  Description of Artificial Sequence: Synthetic oligonucleotide
ggttttgacggccacattagcattttttctcccg

SEQ ID NO: 265387 - DNA, 35 bp, Artificial Sequence
  Description of Artificial Sequence: Synthetic oligonucleotide
gttttgacggccacattagcattttttctcccgag

SEQ ID NO: 265388 - DNA, 35 bp, Artificial Sequence
  Description of Artificial Sequence: Synthetic oligonucleotide
ttttgacggccacattagcattttttctcccgagg

SEQ ID NO: 265389 - DNA, 34 bp, Artificial Sequence
  Description of Artificial Sequence: Synthetic oligonucleotide
tttgacggccacattagcattttttctcccgagg

SEQ ID NO: 265390 - DNA, 33 bp, Artificial Sequence
  Description of Artificial Sequence: Synthetic oligonucleotide
ttgacggccacattagcattttttctcccgagg

SEQ ID NO: 265391 - DNA, 32 bp, Artificial Sequence
  Description of Artificial Sequence: Synthetic oligonucleotide
tgacggccacattagcattttttctcccgagg

SEQ ID NO: 265392 - DNA, 31 bp, Artificial Sequence
  Description of Artificial Sequence: Synthetic oligonucleotide
gacggccacattagcattttttctcccgagg

SEQ ID NO: 265393 - DNA, 31 bp, Artificial Sequence
  Description of Artificial Sequence: Synthetic oligonucleotide
acggccacattagcattttttctcccgaggg

SEQ ID NO: 265394 - DNA, 30 bp, Artificial Sequence
  Description of Artificial Sequence: Synthetic oligonucleotide
cggccacattagcattttttctcccgaggg

SEQ ID NO: 265395 - DNA, 31 bp, Artificial Sequence
  Description of Artificial Sequence: Synthetic oligonucleotide
ggccacattagcattttttctcccgagggtg

SEQ ID NO: 265396 - DNA, 31 bp, Artificial Sequence
  Description of Artificial Sequence: Synthetic oligonucleotide
gccacattagcattttttctcccgagggtgg

SEQ ID NO: 265397 - DNA, 31 bp, Artificial Sequence
  Description of Artificial Sequence: Synthetic oligonucleotide
ccacattagcattttttctcccgagggtggg

SEQ ID NO: 265398 - DNA, 31 bp, Artificial Sequence
  Description of Artificial Sequence: Synthetic oligonucleotide
cacattagcattttttctcccgagggtgggc

SEQ ID NO: 265399 - DNA, 32 bp, Artificial Sequence
  Description of Artificial Sequence: Synthetic oligonucleotide
acattagcattttttctcccgagggtgggctc

SEQ ID NO: 265400 - DNA, 31 bp, Artificial Sequence
  Description of Artificial Sequence: Synthetic oligonucleotide
cattagcattttttctcccgagggtgggctc

SEQ ID NO: 265401 - DNA, 33 bp, Artificial Sequence
  Description of Artificial Sequence: Synthetic oligonucleotide
attagcattttttctcccgagggtgggctctac

SEQ ID NO: 265402 - DNA, 32 bp, Artificial Sequence
  Description of Artificial Sequence: Synthetic oligonucleotide
ttagcattttttctcccgagggtgggctctac

SEQ ID NO: 265403 - DNA, 31 bp, Artificial Sequence
  Description of Artificial Sequence: Synthetic oligonucleotide
tagcattttttctcccgagggtgggctctac

SEQ ID NO: 265404 - DNA, 30 bp, Artificial Sequence
  Description of Artificial Sequence: Synthetic oligonucleotide
agcattttttctcccgagggtgggctctac

SEQ ID NO: 265405 - DNA, 29 bp, Artificial Sequence
  Description of Artificial Sequence: Synthetic oligonucleotide
gcattttttctcccgagggtgggctctac

SEQ ID NO: 265406 - DNA, 29 bp, Artificial Sequence
  Description of Artificial Sequence: Synthetic oligonucleotide
cattttttctcccgagggtgggctctacc

SEQ ID NO: 265407 - DNA, 31 bp, Artificial Sequence
  Description of Artificial Sequence: Synthetic oligonucleotide
attttttctcccgagggtgggctctacctag

SEQ ID NO: 265408 - DNA, 30 bp, Artificial Sequence
  Description of Artificial Sequence: Synthetic oligonucleotide
ttttttctcccgagggtgggctctacctag

SEQ ID NO: 265409 - DNA, 29 bp, Artificial Sequence
  Description of Artificial Sequence: Synthetic oligonucleotide
tttttctcccgagggtgggctctacctag

SEQ ID NO: 265410 - DNA, 28 bp, Artificial Sequence
  Description of Artificial Sequence: Synthetic oligonucleotide
ttttctcccgagggtgggctctacctag

SEQ ID NO: 265411 - DNA, 27 bp, Artificial Sequence
  Description of Artificial Sequence: Synthetic oligonucleotide
tttctcccgagggtgggctctacctag

SEQ ID NO: 265412 - DNA, 27 bp, Artificial Sequence
  Description of Artificial Sequence: Synthetic oligonucleotide
ttctcccgagggtgggctctacctagt

SEQ ID NO: 265413 - DNA, 27 bp, Artificial Sequence
  Description of Artificial Sequence: Synthetic oligonucleotide
tctcccgagggtgggctctacctagta

SEQ ID NO: 265414 - DNA, 26 bp, Artificial Sequence
  Description of Artificial Sequence: Synthetic oligonucleotide
ctcccgagggtgggctctacctagta

SEQ ID NO: 265415 - DNA, 27 bp, Artificial Sequence
  Description of Artificial Sequence: Synthetic oligonucleotide
tcccgagggtgggctctacctagtaga

SEQ ID NO: 265416 - DNA, 27 bp, Artificial Sequence
  Description of Artificial Sequence: Synthetic oligonucleotide
cccgagggtgggctctacctagtagaa

SEQ ID NO: 265417 - DNA, 30 bp, Artificial Sequence
  Description of Artificial Sequence: Synthetic oligonucleotide
ccgagggtgggctctacctagtagaataag

SEQ ID NO: 265418 - DNA, 30 bp, Artificial Sequence
  Description of Artificial Sequence: Synthetic oligonucleotide
cgagggtgggctctacctagtagaataagc

SEQ ID NO: 265419 - DNA, 36 bp, Artificial Sequence
  Description of Artificial Sequence: Synthetic oligonucleotide
gagggtgggctctacctagtagaataagcttttaag

SEQ ID NO: 265420 - DNA, 36 bp, Artificial Sequence
  Description of Artificial Sequence: Synthetic oligonucleotide
agggtgggctctacctagtagaataagcttttaagc

SEQ ID NO: 265421 - DNA, 35 bp, Artificial Sequence
  Description of Artificial Sequence: Synthetic oligonucleotide
gggtgggctctacctagtagaataagcttttaagc

SEQ ID NO: 265422 - DNA, 35 bp, Artificial Sequence
  Description of Artificial Sequence: Synthetic oligonucleotide
ggtgggctctacctagtagaataagcttttaagcc

SEQ ID NO: 265423 - DNA, 41 bp, Artificial Sequence
  Description of Artificial Sequence: Synthetic oligonucleotide
gtgggctctacctagtagaataagcttttaagcctattaac

SEQ ID NO: 265424 - DNA, 41 bp, Artificial Sequence
  Description of Artificial Sequence: Synthetic oligonucleotide
tgggctctacctagtagaataagcttttaagcctattaacc

SEQ ID NO: 265425 - DNA, 40 bp, Artificial Sequence
  Description of Artificial Sequence: Synthetic oligonucleotide
gggctctacctagtagaataagcttttaagcctattaacc

SEQ ID NO: 265426 - DNA, 41 bp, Artificial Sequence
  Description of Artificial Sequence: Synthetic oligonucleotide
ggctctacctagtagaataagcttttaagcctattaacctg

SEQ ID NO: 265427 - DNA, 41 bp, Artificial Sequence
  Description of Artificial Sequence: Synthetic oligonucleotide
gctctacctagtagaataagcttttaagcctattaacctgg

SEQ ID NO: 265428 - DNA, 41 bp, Artificial Sequence
  Description of Artificial Sequence: Synthetic oligonucleotide
ctctacctagtagaataagcttttaagcctattaacctggg

SEQ ID NO: 265429 - DNA, 42 bp, Artificial Sequence
  Description of Artificial Sequence: Synthetic oligonucleotide
tctacctagtagaataagcttttaagcctattaacctgggtg

SEQ ID NO: 265430 - DNA, 41 bp, Artificial Sequence
  Description of Artificial Sequence: Synthetic oligonucleotide
ctacctagtagaataagcttttaagcctattaacctgggtg

SEQ ID NO: 265431 - DNA, 41 bp, Artificial Sequence
  Description of Artificial Sequence: Synthetic oligonucleotide
tacctagtagaataagcttttaagcctattaacctgggtgg

SEQ ID NO: 265432 - DNA, 40 bp, Artificial Sequence
  Description of Artificial Sequence: Synthetic oligonucleotide
acctagtagaataagcttttaagcctattaacctgggtgg

SEQ ID NO: 265433 - DNA, 39 bp, Artificial Sequence
  Description of Artificial Sequence: Synthetic oligonucleotide
cctagtagaataagcttttaagcctattaacctgggtgg

SEQ ID NO: 265434 - DNA, 39 bp, Artificial Sequence
  Description of Artificial Sequence: Synthetic oligonucleotide
ctagtagaataagcttttaagcctattaacctgggtggc

SEQ ID NO: 265435 - DNA, 39 bp, Artificial Sequence
  Description of Artificial Sequence: Synthetic oligonucleotide
tagtagaataagcttttaagcctattaacctgggtggcc

SEQ ID NO: 265436 - DNA, 38 bp, Artificial Sequence
  Description of Artificial Sequence: Synthetic oligonucleotide
agtagaataagcttttaagcctattaacctgggtggcc

SEQ ID NO: 265437 - DNA, 37 bp, Artificial Sequence
  Description of Artificial Sequence: Synthetic oligonucleotide
gtagaataagcttttaagcctattaacctgggtggcc

SEQ ID NO: 265438 - DNA, 40 bp, Artificial Sequence
  Description of Artificial Sequence: Synthetic oligonucleotide
tagaataagcttttaagcctattaacctgggtggcctaac

SEQ ID NO: 265439 - DNA, 39 bp, Artificial Sequence
  Description of Artificial Sequence: Synthetic oligonucleotide
agaataagcttttaagcctattaacctgggtggcctaac

SEQ ID NO: 265440 - DNA, 38 bp, Artificial Sequence
  Description of Artificial Sequence: Synthetic oligonucleotide
gaataagcttttaagcctattaacctgggtggcctaac

SEQ ID NO: 265441 - DNA, 40 bp, Artificial Sequence
  Description of Artificial Sequence: Synthetic oligonucleotide
aataagcttttaagcctattaacctgggtggcctaacatc

SEQ ID NO: 265442 - DNA, 39 bp, Artificial Sequence
  Description of Artificial Sequence: Synthetic oligonucleotide
ataagcttttaagcctattaacctgggtggcctaacatc

SEQ ID NO: 265443 - DNA, 38 bp, Artificial Sequence
  Description of Artificial Sequence: Synthetic oligonucleotide
taagcttttaagcctattaacctgggtggcctaacatc

SEQ ID NO: 265444 - DNA, 37 bp, Artificial Sequence
  Description of Artificial Sequence: Synthetic oligonucleotide
aagcttttaagcctattaacctgggtggcctaacatc

SEQ ID NO: 265445 - DNA, 36 bp, Artificial Sequence
  Description of Artificial Sequence: Synthetic oligonucleotide
agcttttaagcctattaacctgggtggcctaacatc

SEQ ID NO: 265446 - DNA, 35 bp, Artificial Sequence
  Description of Artificial Sequence: Synthetic oligonucleotide
gcttttaagcctattaacctgggtggcctaacatc

SEQ ID NO: 265447 - DNA, 36 bp, Artificial Sequence
  Description of Artificial Sequence: Synthetic oligonucleotide
cttttaagcctattaacctgggtggcctaacatcag

SEQ ID NO: 265448 - DNA, 38 bp, Artificial Sequence
  Description of Artificial Sequence: Synthetic oligonucleotide
ttttaagcctattaacctgggtggcctaacatcagtac

SEQ ID NO: 265449 - DNA, 37 bp, Artificial Sequence
  Description of Artificial Sequence: Synthetic oligonucleotide
tttaagcctattaacctgggtggcctaacatcagtac

SEQ ID NO: 265450 - DNA, 36 bp, Artificial Sequence
  Description of Artificial Sequence: Synthetic oligonucleotide
ttaagcctattaacctgggtggcctaacatcagtac

SEQ ID NO: 265451 - DNA, 35 bp, Artificial Sequence
  Description of Artificial Sequence: Synthetic oligonucleotide
taagcctattaacctgggtggcctaacatcagtac

SEQ ID NO: 265452 - DNA, 34 bp, Artificial Sequence
  Description of Artificial Sequence: Synthetic oligonucleotide
aagcctattaacctgggtggcctaacatcagtac

SEQ ID NO: 265453 - DNA, 33 bp, Artificial Sequence
  Description of Artificial Sequence: Synthetic oligonucleotide
agcctattaacctgggtggcctaacatcagtac

SEQ ID NO: 265454 - DNA, 32 bp, Artificial Sequence
  Description of Artificial Sequence: Synthetic oligonucleotide
gcctattaacctgggtggcctaacatcagtac

SEQ ID NO: 265455 - DNA, 32 bp, Artificial Sequence
  Description of Artificial Sequence: Synthetic oligonucleotide
cctattaacctgggtggcctaacatcagtacc

SEQ ID NO: 265456 - DNA, 33 bp, Artificial Sequence
  Description of Artificial Sequence: Synthetic oligonucleotide
ctattaacctgggtggcctaacatcagtacctg

SEQ ID NO: 265457 - DNA, 34 bp, Artificial Sequence
  Description of Artificial Sequence: Synthetic oligonucleotide
tattaacctgggtggcctaacatcagtacctgtc

SEQ ID NO: 265458 - DNA, 33 bp, Artificial Sequence
  Description of Artificial Sequence: Synthetic oligonucleotide
attaacctgggtggcctaacatcagtacctgtc

SEQ ID NO: 265459 - DNA, 32 bp, Artificial Sequence
  Description of Artificial Sequence: Synthetic oligonucleotide
ttaacctgggtggcctaacatcagtacctgtc

SEQ ID NO: 265460 - DNA, 31 bp, Artificial Sequence
  Description of Artificial Sequence: Synthetic oligonucleotide
taacctgggtggcctaacatcagtacctgtc

SEQ ID NO: 265461 - DNA, 30 bp, Artificial Sequence
  Description of Artificial Sequence: Synthetic oligonucleotide
aacctgggtggcctaacatcagtacctgtc

SEQ ID NO: 265462 - DNA, 29 bp, Artificial Sequence
  Description of Artificial Sequence: Synthetic oligonucleotide
acctgggtggcctaacatcagtacctgtc

SEQ ID NO: 265463 - DNA, 28 bp, Artificial Sequence
  Description of Artificial Sequence: Synthetic oligonucleotide
cctgggtggcctaacatcagtacctgtc

SEQ ID NO: 265464 - DNA, 29 bp, Artificial Sequence
  Description of Artificial Sequence: Synthetic oligonucleotide
ctgggtggcctaacatcagtacctgtcag

SEQ ID NO: 265465 - DNA, 30 bp, Artificial Sequence
  Description of Artificial Sequence: Synthetic oligonucleotide
tgggtggcctaacatcagtacctgtcagag

SEQ ID NO: 265466 - DNA, 29 bp, Artificial Sequence
  Description of Artificial Sequence: Synthetic oligonucleotide
gggtggcctaacatcagtacctgtcagag

SEQ ID NO: 265467 - DNA, 29 bp, Artificial Sequence
  Description of Artificial Sequence: Synthetic oligonucleotide
ggtggcctaacatcagtacctgtcagagc

SEQ ID NO: 265468 - DNA, 29 bp, Artificial Sequence
  Description of Artificial Sequence: Synthetic oligonucleotide
gtggcctaacatcagtacctgtcagagcg

SEQ ID NO: 265469 - DNA, 32 bp, Artificial Sequence
  Description of Artificial Sequence: Synthetic oligonucleotide
tggcctaacatcagtacctgtcagagcgaaag

SEQ ID NO: 265470 - DNA, 31 bp, Artificial Sequence
  Description of Artificial Sequence: Synthetic oligonucleotide
ggcctaacatcagtacctgtcagagcgaaag

SEQ ID NO: 265471 - DNA, 32 bp, Artificial Sequence
  Description of Artificial Sequence: Synthetic oligonucleotide
gcctaacatcagtacctgtcagagcgaaagac

SEQ ID NO: 265472 - DNA, 33 bp, Artificial Sequence
  Description of Artificial Sequence: Synthetic oligonucleotide
cctaacatcagtacctgtcagagcgaaagactg

SEQ ID NO: 265473 - DNA, 34 bp, Artificial Sequence
  Description of Artificial Sequence: Synthetic oligonucleotide
ctaacatcagtacctgtcagagcgaaagactgag

SEQ ID NO: 265474 - DNA, 34 bp, Artificial Sequence
  Description of Artificial Sequence: Synthetic oligonucleotide
taacatcagtacctgtcagagcgaaagactgagc

SEQ ID NO: 265475 - DNA, 33 bp, Artificial Sequence
  Description of Artificial Sequence: Synthetic oligonucleotide
aacatcagtacctgtcagagcgaaagactgagc

SEQ ID NO: 265476 - DNA, 32 bp, Artificial Sequence
  Description of Artificial Sequence: Synthetic oligonucleotide
acatcagtacctgtcagagcgaaagactgagc

SEQ ID NO: 265477 - DNA, 31 bp, Artificial Sequence
  Description of Artificial Sequence: Synthetic oligonucleotide
catcagtacctgtcagagcgaaagactgagc

SEQ ID NO: 265478 - DNA, 32 bp, Artificial Sequence
  Description of Artificial Sequence: Synthetic oligonucleotide
atcagtacctgtcagagcgaaagactgagcag

SEQ ID NO: 265479 - DNA, 31 bp, Artificial Sequence
  Description of Artificial Sequence: Synthetic oligonucleotide
tcagtacctgtcagagcgaaagactgagcag

SEQ ID NO: 265480 - DNA, 30 bp, Artificial Sequence
  Description of Artificial Sequence: Synthetic oligonucleotide
cagtacctgtcagagcgaaagactgagcag

SEQ ID NO: 265481 - DNA, 35 bp, Artificial Sequence
  Description of Artificial Sequence: Synthetic oligonucleotide
agtacctgtcagagcgaaagactgagcagtaattc

SEQ ID NO: 265482 - DNA, 34 bp, Artificial Sequence
  Description of Artificial Sequence: Synthetic oligonucleotide
gtacctgtcagagcgaaagactgagcagtaattc

SEQ ID NO: 265483 - DNA, 35 bp, Artificial Sequence
  Description of Artificial Sequence: Synthetic oligonucleotide
tacctgtcagagcgaaagactgagcagtaattctc

SEQ ID NO: 265484 - DNA, 34 bp, Artificial Sequence
  Description of Artificial Sequence: Synthetic oligonucleotide
acctgtcagagcgaaagactgagcagtaattctc

SEQ ID NO: 265485 - DNA, 33 bp, Artificial Sequence
  Description of Artificial Sequence: Synthetic oligonucleotide
cctgtcagagcgaaagactgagcagtaattctc

SEQ ID NO: 265486 - DNA, 34 bp, Artificial Sequence
  Description of Artificial Sequence: Synthetic oligonucleotide
ctgtcagagcgaaagactgagcagtaattctcac

SEQ ID NO: 265487 - DNA, 35 bp, Artificial Sequence
  Description of Artificial Sequence: Synthetic oligonucleotide
tgtcagagcgaaagactgagcagtaattctcacac

SEQ ID NO: 265488 - DNA, 34 bp, Artificial Sequence
  Description of Artificial Sequence: Synthetic oligonucleotide
gtcagagcgaaagactgagcagtaattctcacac

SEQ ID NO: 265489 - DNA, 35 bp, Artificial Sequence
  Description of Artificial Sequence: Synthetic oligonucleotide
tcagagcgaaagactgagcagtaattctcacacag

SEQ ID NO: 265490 - DNA, 34 bp, Artificial Sequence
  Description of Artificial Sequence: Synthetic oligonucleotide
cagagcgaaagactgagcagtaattctcacacag

SEQ ID NO: 265491 - DNA, 36 bp, Artificial Sequence
  Description of Artificial Sequence: Synthetic oligonucleotide
agagcgaaagactgagcagtaattctcacacagatg

SEQ ID NO: 265492 - DNA, 35 bp, Artificial Sequence
  Description of Artificial Sequence: Synthetic oligonucleotide
gagcgaaagactgagcagtaattctcacacagatg

SEQ ID NO: 265493 - DNA, 38 bp, Artificial Sequence
  Description of Artificial Sequence: Synthetic oligonucleotide
agcgaaagactgagcagtaattctcacacagatgaaag

SEQ ID NO: 265494 - DNA, 37 bp, Artificial Sequence
  Description of Artificial Sequence: Synthetic oligonucleotide
gcgaaagactgagcagtaattctcacacagatgaaag

SEQ ID NO: 265495 - DNA, 39 bp, Artificial Sequence
  Description of Artificial Sequence: Synthetic oligonucleotide
cgaaagactgagcagtaattctcacacagatgaaagtac

SEQ ID NO: 265496 - DNA, 39 bp, Artificial Sequence
  Description of Artificial Sequence: Synthetic oligonucleotide
gaaagactgagcagtaattctcacacagatgaaagtacc

SEQ ID NO: 265497 - DNA, 40 bp, Artificial Sequence
  Description of Artificial Sequence: Synthetic oligonucleotide
aaagactgagcagtaattctcacacagatgaaagtaccag

SEQ ID NO: 265498 - DNA, 39 bp, Artificial Sequence
  Description of Artificial Sequence: Synthetic oligonucleotide
aagactgagcagtaattctcacacagatgaaagtaccag

SEQ ID NO: 265499 - DNA, 38 bp, Artificial Sequence
  Description of Artificial Sequence: Synthetic oligonucleotide
agactgagcagtaattctcacacagatgaaagtaccag

SEQ ID NO: 265500 - DNA, 37 bp, Artificial Sequence
  Description of Artificial Sequence: Synthetic oligonucleotide
gactgagcagtaattctcacacagatgaaagtaccag

SEQ ID NO: 265501 - DNA, 38 bp, Artificial Sequence
  Description of Artificial Sequence: Synthetic oligonucleotide
actgagcagtaattctcacacagatgaaagtaccagac

SEQ ID NO: 265502 - DNA, 37 bp, Artificial Sequence
  Description of Artificial Sequence: Synthetic oligonucleotide
ctgagcagtaattctcacacagatgaaagtaccagac

SEQ ID NO: 265503 - DNA, 45 bp, Artificial Sequence
  Description of Artificial Sequence: Synthetic oligonucleotide
tgagcagtaattctcacacagatgaaagtaccagacaaattaatg

SEQ ID NO: 265504 - DNA, 44 bp, Artificial Sequence
  Description of Artificial Sequence: Synthetic oligonucleotide
gagcagtaattctcacacagatgaaagtaccagacaaattaatg

SEQ ID NO: 265505 - DNA, 44 bp, Artificial Sequence
  Description of Artificial Sequence: Synthetic oligonucleotide
agcagtaattctcacacagatgaaagtaccagacaaattaatgg

SEQ ID NO: 265506 - DNA, 43 bp, Artificial Sequence
  Description of Artificial Sequence: Synthetic oligonucleotide
gcagtaattctcacacagatgaaagtaccagacaaattaatgg

SEQ ID NO: 265507 - DNA, 46 bp, Artificial Sequence
  Description of Artificial Sequence: Synthetic oligonucleotide
cagtaattctcacacagatgaaagtaccagacaaattaatggattc

SEQ ID NO: 265508 - DNA, 46 bp, Artificial Sequence
  Description of Artificial Sequence: Synthetic oligonucleotide
agtaattctcacacagatgaaagtaccagacaaattaatggattcc

SEQ ID NO: 265509 - DNA, 45 bp, Artificial Sequence
  Description of Artificial Sequence: Synthetic oligonucleotide
gtaattctcacacagatgaaagtaccagacaaattaatggattcc

SEQ ID NO: 265510 - DNA, 46 bp, Artificial Sequence
  Description of Artificial Sequence: Synthetic oligonucleotide
taattctcacacagatgaaagtaccagacaaattaatggattccac

SEQ ID NO: 265511 - DNA, 45 bp, Artificial Sequence
  Description of Artificial Sequence: Synthetic oligonucleotide
aattctcacacagatgaaagtaccagacaaattaatggattccac

SEQ ID NO: 265512 - DNA, 44 bp, Artificial Sequence
  Description of Artificial Sequence: Synthetic oligonucleotide
attctcacacagatgaaagtaccagacaaattaatggattccac

SEQ ID NO: 265513 - DNA, 43 bp, Artificial Sequence
  Description of Artificial Sequence: Synthetic oligonucleotide
ttctcacacagatgaaagtaccagacaaattaatggattccac

SEQ ID NO: 265514 - DNA, 42 bp, Artificial Sequence
  Description of Artificial Sequence: Synthetic oligonucleotide
tctcacacagatgaaagtaccagacaaattaatggattccac

SEQ ID NO: 265515 - DNA, 41 bp, Artificial Sequence
  Description of Artificial Sequence: Synthetic oligonucleotide
ctcacacagatgaaagtaccagacaaattaatggattccac

SEQ ID NO: 265516 - DNA, 41 bp, Artificial Sequence
  Description of Artificial Sequence: Synthetic oligonucleotide
tcacacagatgaaagtaccagacaaattaatggattccacc

SEQ ID NO: 265517 - DNA, 40 bp, Artificial Sequence
  Description of Artificial Sequence: Synthetic oligonucleotide
cacacagatgaaagtaccagacaaattaatggattccacc

SEQ ID NO: 265518 - DNA, 41 bp, Artificial Sequence
  Description of Artificial Sequence: Synthetic oligonucleotide
acacagatgaaagtaccagacaaattaatggattccaccac

SEQ ID NO: 265519 - DNA, 40 bp, Artificial Sequence
  Description of Artificial Sequence: Synthetic oligonucleotide
cacagatgaaagtaccagacaaattaatggattccaccac

SEQ ID NO: 265520 - DNA, 41 bp, Artificial Sequence
  Description of Artificial Sequence: Synthetic oligonucleotide
acagatgaaagtaccagacaaattaatggattccaccacag

SEQ ID NO: 265521 - DNA, 40 bp, Artificial Sequence
  Description of Artificial Sequence: Synthetic oligonucleotide
cagatgaaagtaccagacaaattaatggattccaccacag

SEQ ID NO: 265522 - DNA, 41 bp, Artificial Sequence
  Description of Artificial Sequence: Synthetic oligonucleotide
agatgaaagtaccagacaaattaatggattccaccacagtg

SEQ ID NO: 265523 - DNA, 40 bp, Artificial Sequence
  Description of Artificial Sequence: Synthetic oligonucleotide
gatgaaagtaccagacaaattaatggattccaccacagtg

SEQ ID NO: 265524 - DNA, 41 bp, Artificial Sequence
  Description of Artificial Sequence: Synthetic oligonucleotide
atgaaagtaccagacaaattaatggattccaccacagtgac

SEQ ID NO: 265525 - DNA, 40 bp, Artificial Sequence
  Description of Artificial Sequence: Synthetic oligonucleotide
tgaaagtaccagacaaattaatggattccaccacagtgac

SEQ ID NO: 265526 - DNA, 39 bp, Artificial Sequence
  Description of Artificial Sequence: Synthetic oligonucleotide
gaaagtaccagacaaattaatggattccaccacagtgac

SEQ ID NO: 265527 - DNA, 40 bp, Artificial Sequence
  Description of Artificial Sequence: Synthetic oligonucleotide
aaagtaccagacaaattaatggattccaccacagtgacac

SEQ ID NO: 265528 - DNA, 39 bp, Artificial Sequence
  Description of Artificial Sequence: Synthetic oligonucleotide
aagtaccagacaaattaatggattccaccacagtgacac

SEQ ID NO: 265529 - DNA, 38 bp, Artificial Sequence
  Description of Artificial Sequence: Synthetic oligonucleotide
agtaccagacaaattaatggattccaccacagtgacac

SEQ ID NO: 265530 - DNA, 37 bp, Artificial Sequence
  Description of Artificial Sequence: Synthetic oligonucleotide
gtaccagacaaattaatggattccaccacagtgacac

SEQ ID NO: 265531 - DNA, 38 bp, Artificial Sequence
  Description of Artificial Sequence: Synthetic oligonucleotide
taccagacaaattaatggattccaccacagtgacacac

SEQ ID NO: 265532 - DNA, 37 bp, Artificial Sequence
  Description of Artificial Sequence: Synthetic oligonucleotide
accagacaaattaatggattccaccacagtgacacac

SEQ ID NO: 265533 - DNA, 36 bp, Artificial Sequence
  Description of Artificial Sequence: Synthetic oligonucleotide
ccagacaaattaatggattccaccacagtgacacac

SEQ ID NO: 265534 - DNA, 41 bp, Artificial Sequence
  Description of Artificial Sequence: Synthetic oligonucleotide
cagacaaattaatggattccaccacagtgacacacttattc

SEQ ID NO: 265535 - DNA, 43 bp, Artificial Sequence
  Description of Artificial Sequence: Synthetic oligonucleotide
agacaaattaatggattccaccacagtgacacacttattctag

SEQ ID NO: 265536 - DNA, 42 bp, Artificial Sequence
  Description of Artificial Sequence: Synthetic oligonucleotide
gacaaattaatggattccaccacagtgacacacttattctag

SEQ ID NO: 265537 - DNA, 46 bp, Artificial Sequence
  Description of Artificial Sequence: Synthetic oligonucleotide
acaaattaatggattccaccacagtgacacacttattctagataac

SEQ ID NO: 265538 - DNA, 45 bp, Artificial Sequence
  Description of Artificial Sequence: Synthetic oligonucleotide
caaattaatggattccaccacagtgacacacttattctagataac

SEQ ID NO: 265539 - DNA, 46 bp, Artificial Sequence
  Description of Artificial Sequence: Synthetic oligonucleotide
aaattaatggattccaccacagtgacacacttattctagataactg

SEQ ID NO: 265540 - DNA, 45 bp, Artificial Sequence
  Description of Artificial Sequence: Synthetic oligonucleotide
aattaatggattccaccacagtgacacacttattctagataactg

SEQ ID NO: 265541 - DNA, 44 bp, Artificial Sequence
  Description of Artificial Sequence: Synthetic oligonucleotide
attaatggattccaccacagtgacacacttattctagataactg

SEQ ID NO: 265542 - DNA, 43 bp, Artificial Sequence
  Description of Artificial Sequence: Synthetic oligonucleotide
ttaatggattccaccacagtgacacacttattctagataactg

SEQ ID NO: 265543 - DNA, 42 bp, Artificial Sequence
  Description of Artificial Sequence: Synthetic oligonucleotide
taatggattccaccacagtgacacacttattctagataactg

SEQ ID NO: 265544 - DNA, 41 bp, Artificial Sequence
  Description of Artificial Sequence: Synthetic oligonucleotide
aatggattccaccacagtgacacacttattctagataactg

SEQ ID NO: 265545 - DNA, 40 bp, Artificial Sequence
  Description of Artificial Sequence: Synthetic oligonucleotide
atggattccaccacagtgacacacttattctagataactg

SEQ ID NO: 265546 - DNA, 39 bp, Artificial Sequence
  Description of Artificial Sequence: Synthetic oligonucleotide
tggattccaccacagtgacacacttattctagataactg

SEQ ID NO: 265547 - DNA, 38 bp, Artificial Sequence
  Description of Artificial Sequence: Synthetic oligonucleotide
ggattccaccacagtgacacacttattctagataactg

SEQ ID NO: 265548 - DNA, 42 bp, Artificial Sequence
  Description of Artificial Sequence: Synthetic oligonucleotide
gattccaccacagtgacacacttattctagataactgtaaac

SEQ ID NO: 265549 - DNA, 45 bp, Artificial Sequence
  Description of Artificial Sequence: Synthetic oligonucleotide
attccaccacagtgacacacttattctagataactgtaaacattg

SEQ ID NO: 265550 - DNA, 44 bp, Artificial Sequence
  Description of Artificial Sequence: Synthetic oligonucleotide
ttccaccacagtgacacacttattctagataactgtaaacattg

SEQ ID NO: 265551 - DNA, 43 bp, Artificial Sequence
  Description of Artificial Sequence: Synthetic oligonucleotide
tccaccacagtgacacacttattctagataactgtaaacattg

SEQ ID NO: 265552 - DNA, 42 bp, Artificial Sequence
  Description of Artificial Sequence: Synthetic oligonucleotide
ccaccacagtgacacacttattctagataactgtaaacattg

SEQ ID NO: 265553 - DNA, 42 bp, Artificial Sequence
  Description of Artificial Sequence: Synthetic oligonucleotide
caccacagtgacacacttattctagataactgtaaacattgg

SEQ ID NO: 265554 - DNA, 44 bp, Artificial Sequence
  Description of Artificial Sequence: Synthetic oligonucleotide
accacagtgacacacttattctagataactgtaaacattggatg

SEQ ID NO: 265555 - DNA, 43 bp, Artificial Sequence
  Description of Artificial Sequence: Synthetic oligonucleotide
ccacagtgacacacttattctagataactgtaaacattggatg

SEQ ID NO: 265556 - DNA, 44 bp, Artificial Sequence
  Description of Artificial Sequence: Synthetic oligonucleotide
cacagtgacacacttattctagataactgtaaacattggatgtg

SEQ ID NO: 265557 - DNA, 45 bp, Artificial Sequence
  Description of Artificial Sequence: Synthetic oligonucleotide
acagtgacacacttattctagataactgtaaacattggatgtgtg

SEQ ID NO: 265558 - DNA, 44 bp, Artificial Sequence
  Description of Artificial Sequence: Synthetic oligonucleotide
cagtgacacacttattctagataactgtaaacattggatgtgtg

SEQ ID NO: 265559 - DNA, 46 bp, Artificial Sequence
  Description of Artificial Sequence: Synthetic oligonucleotide
agtgacacacttattctagataactgtaaacattggatgtgtgatg

SEQ ID NO: 265560 - DNA, 45 bp, Artificial Sequence
  Description of Artificial Sequence: Synthetic oligonucleotide
gtgacacacttattctagataactgtaaacattggatgtgtgatg

SEQ ID NO: 265561 - DNA, 46 bp, Artificial Sequence
  Description of Artificial Sequence: Synthetic oligonucleotide
tgacacacttattctagataactgtaaacattggatgtgtgatgtc

SEQ ID NO: 265562 - DNA, 45 bp, Artificial Sequence
  Description of Artificial Sequence: Synthetic oligonucleotide
gacacacttattctagataactgtaaacattggatgtgtgatgtc

SEQ ID NO: 265563 - DNA, 45 bp, Artificial Sequence
  Description of Artificial Sequence: Synthetic oligonucleotide
acacacttattctagataactgtaaacattggatgtgtgatgtcc

SEQ ID NO: 265564 - DNA, 44 bp, Artificial Sequence
  Description of Artificial Sequence: Synthetic oligonucleotide
cacacttattctagataactgtaaacattggatgtgtgatgtcc

SEQ ID NO: 265565 - DNA, 44 bp, Artificial Sequence
  Description of Artificial Sequence: Synthetic oligonucleotide
acacttattctagataactgtaaacattggatgtgtgatgtccg

SEQ ID NO: 265566 - DNA, 43 bp, Artificial Sequence
  Description of Artificial Sequence: Synthetic oligonucleotide
cacttattctagataactgtaaacattggatgtgtgatgtccg

SEQ ID NO: 265567 - DNA, 43 bp, Artificial Sequence
  Description of Artificial Sequence: Synthetic oligonucleotide
acttattctagataactgtaaacattggatgtgtgatgtccgg

SEQ ID NO: 265568 - DNA, 42 bp, Artificial Sequence
  Description of Artificial Sequence: Synthetic oligonucleotide
cttattctagataactgtaaacattggatgtgtgatgtccgg

SEQ ID NO: 265569 - DNA, 45 bp, Artificial Sequence
  Description of Artificial Sequence: Synthetic oligonucleotide
ttattctagataactgtaaacattggatgtgtgatgtccggaatg

SEQ ID NO: 265570 - DNA, 44 bp, Artificial Sequence
  Description of Artificial Sequence: Synthetic oligonucleotide
tattctagataactgtaaacattggatgtgtgatgtccggaatg

SEQ ID NO: 265571 - DNA, 43 bp, Artificial Sequence
  Description of Artificial Sequence: Synthetic oligonucleotide
attctagataactgtaaacattggatgtgtgatgtccggaatg

SEQ ID NO: 265572 - DNA, 42 bp, Artificial Sequence
  Description of Artificial Sequence: Synthetic oligonucleotide
ttctagataactgtaaacattggatgtgtgatgtccggaatg

SEQ ID NO: 265573 - DNA, 41 bp, Artificial Sequence
  Description of Artificial Sequence: Synthetic oligonucleotide
tctagataactgtaaacattggatgtgtgatgtccggaatg

SEQ ID NO: 265574 - DNA, 40 bp, Artificial Sequence
  Description of Artificial Sequence: Synthetic oligonucleotide
ctagataactgtaaacattggatgtgtgatgtccggaatg

SEQ ID NO: 265575 - DNA, 41 bp, Artificial Sequence
  Description of Artificial Sequence: Synthetic oligonucleotide
tagataactgtaaacattggatgtgtgatgtccggaatgag

SEQ ID NO: 265576 - DNA, 40 bp, Artificial Sequence
  Description of Artificial Sequence: Synthetic oligonucleotide
agataactgtaaacattggatgtgtgatgtccggaatgag

SEQ ID NO: 265577 - DNA, 39 bp, Artificial Sequence
  Description of Artificial Sequence: Synthetic oligonucleotide
gataactgtaaacattggatgtgtgatgtccggaatgag

SEQ ID NO: 265578 - DNA, 40 bp, Artificial Sequence
  Description of Artificial Sequence: Synthetic oligonucleotide
ataactgtaaacattggatgtgtgatgtccggaatgagag

SEQ ID NO: 265579 - DNA, 39 bp, Artificial Sequence
  Description of Artificial Sequence: Synthetic oligonucleotide
taactgtaaacattggatgtgtgatgtccggaatgagag

SEQ ID NO: 265580 - DNA, 38 bp, Artificial Sequence
  Description of Artificial Sequence: Synthetic oligonucleotide
aactgtaaacattggatgtgtgatgtccggaatgagag

SEQ ID NO: 265581 - DNA, 37 bp, Artificial Sequence
  Description of Artificial Sequence: Synthetic oligonucleotide
actgtaaacattggatgtgtgatgtccggaatgagag

SEQ ID NO: 265582 - DNA, 36 bp, Artificial Sequence
  Description of Artificial Sequence: Synthetic oligonucleotide
ctgtaaacattggatgtgtgatgtccggaatgagag

SEQ ID NO: 265583 - DNA, 36 bp, Artificial Sequence
  Description of Artificial Sequence: Synthetic oligonucleotide
tgtaaacattggatgtgtgatgtccggaatgagagc

SEQ ID NO: 265584 - DNA, 35 bp, Artificial Sequence
  Description of Artificial Sequence: Synthetic oligonucleotide
gtaaacattggatgtgtgatgtccggaatgagagc

SEQ ID NO: 265585 - DNA, 36 bp, Artificial Sequence
  Description of Artificial Sequence: Synthetic oligonucleotide
taaacattggatgtgtgatgtccggaatgagagctg

SEQ ID NO: 265586 - DNA, 35 bp, Artificial Sequence
  Description of Artificial Sequence: Synthetic oligonucleotide
aaacattggatgtgtgatgtccggaatgagagctg

SEQ ID NO: 265587 - DNA, 34 bp, Artificial Sequence
  Description of Artificial Sequence: Synthetic oligonucleotide
aacattggatgtgtgatgtccggaatgagagctg

SEQ ID NO: 265588 - DNA, 33 bp, Artificial Sequence
  Description of Artificial Sequence: Synthetic oligonucleotide
acattggatgtgtgatgtccggaatgagagctg

SEQ ID NO: 265589 - DNA, 32 bp, Artificial Sequence
  Description of Artificial Sequence: Synthetic oligonucleotide
cattggatgtgtgatgtccggaatgagagctg

SEQ ID NO: 265590 - DNA, 33 bp, Artificial Sequence
  Description of Artificial Sequence: Synthetic oligonucleotide
attggatgtgtgatgtccggaatgagagctgac

SEQ ID NO: 265591 - DNA, 32 bp, Artificial Sequence
  Description of Artificial Sequence: Synthetic oligonucleotide
ttggatgtgtgatgtccggaatgagagctgac

SEQ ID NO: 265592 - DNA, 31 bp, Artificial Sequence
  Description of Artificial Sequence: Synthetic oligonucleotide
tggatgtgtgatgtccggaatgagagctgac

SEQ ID NO: 265593 - DNA, 30 bp, Artificial Sequence
  Description of Artificial Sequence: Synthetic oligonucleotide
ggatgtgtgatgtccggaatgagagctgac

SEQ ID NO: 265594 - DNA, 31 bp, Artificial Sequence
  Description of Artificial Sequence: Synthetic oligonucleotide
gatgtgtgatgtccggaatgagagctgacag

SEQ ID NO: 265595 - DNA, 31 bp, Artificial Sequence
  Description of Artificial Sequence: Synthetic oligonucleotide
atgtgtgatgtccggaatgagagctgacagg

SEQ ID NO: 265596 - DNA, 30 bp, Artificial Sequence
  Description of Artificial Sequence: Synthetic oligonucleotide
tgtgtgatgtccggaatgagagctgacagg

SEQ ID NO: 265597 - DNA, 29 bp, Artificial Sequence
  Description of Artificial Sequence: Synthetic oligonucleotide
gtgtgatgtccggaatgagagctgacagg

SEQ ID NO: 265598 - DNA, 30 bp, Artificial Sequence
  Description of Artificial Sequence: Synthetic oligonucleotide
tgtgatgtccggaatgagagctgacaggag

SEQ ID NO: 265599 - DNA, 29 bp, Artificial Sequence
  Description of Artificial Sequence: Synthetic oligonucleotide
gtgatgtccggaatgagagctgacaggag

SEQ ID NO: 265600 - DNA, 31 bp, Artificial Sequence
  Description of Artificial Sequence: Synthetic oligonucleotide
tgatgtccggaatgagagctgacaggagatc

SEQ ID NO: 265601 - DNA, 30 bp, Artificial Sequence
  Description of Artificial Sequence: Synthetic oligonucleotide
gatgtccggaatgagagctgacaggagatc

SEQ ID NO: 265602 - DNA, 30 bp, Artificial Sequence
  Description of Artificial Sequence: Synthetic oligonucleotide
atgtccggaatgagagctgacaggagatcc

SEQ ID NO: 265603 - DNA, 29 bp, Artificial Sequence
  Description of Artificial Sequence: Synthetic oligonucleotide
tgtccggaatgagagctgacaggagatcc

SEQ ID NO: 265604 - DNA, 28 bp, Artificial Sequence
  Description of Artificial Sequence: Synthetic oligonucleotide
gtccggaatgagagctgacaggagatcc

SEQ ID NO: 265605 - DNA, 28 bp, Artificial Sequence
  Description of Artificial Sequence: Synthetic oligonucleotide
tccggaatgagagctgacaggagatccc

SEQ ID NO: 265606 - DNA, 27 bp, Artificial Sequence
  Description of Artificial Sequence: Synthetic oligonucleotide
ccggaatgagagctgacaggagatccc

SEQ ID NO: 265607 - DNA, 28 bp, Artificial Sequence
  Description of Artificial Sequence: Synthetic oligonucleotide
cggaatgagagctgacaggagatcccag

SEQ ID NO: 265608 - DNA, 28 bp, Artificial Sequence
  Description of Artificial Sequence: Synthetic oligonucleotide
ggaatgagagctgacaggagatcccagc

SEQ ID NO: 265609 - DNA, 30 bp, Artificial Sequence
  Description of Artificial Sequence: Synthetic oligonucleotide
gaatgagagctgacaggagatcccagctac

SEQ ID NO: 265610 - DNA, 31 bp, Artificial Sequence
  Description of Artificial Sequence: Synthetic oligonucleotide
aatgagagctgacaggagatcccagctacag

SEQ ID NO: 265611 - DNA, 30 bp, Artificial Sequence
  Description of Artificial Sequence: Synthetic oligonucleotide
atgagagctgacaggagatcccagctacag

SEQ ID NO: 265612 - DNA, 29 bp, Artificial Sequence
  Description of Artificial Sequence: Synthetic oligonucleotide
tgagagctgacaggagatcccagctacag

SEQ ID NO: 265613 - DNA, 28 bp, Artificial Sequence
  Description of Artificial Sequence: Synthetic oligonucleotide
gagagctgacaggagatcccagctacag

SEQ ID NO: 265614 - DNA, 29 bp, Artificial Sequence
  Description of Artificial Sequence: Synthetic oligonucleotide
agagctgacaggagatcccagctacagag

SEQ ID NO: 265615 - DNA, 28 bp, Artificial Sequence
  Description of Artificial Sequence: Synthetic oligonucleotide
gagctgacaggagatcccagctacagag

SEQ ID NO: 265616 - DNA, 28 bp, Artificial Sequence
  Description of Artificial Sequence: Synthetic oligonucleotide
agctgacaggagatcccagctacagagg

SEQ ID NO: 265617 - DNA, 27 bp, Artificial Sequence
  Description of Artificial Sequence: Synthetic oligonucleotide
gctgacaggagatcccagctacagagg

SEQ ID NO: 265618 - DNA, 27 bp, Artificial Sequence
  Description of Artificial Sequence: Synthetic oligonucleotide
ctgacaggagatcccagctacagaggg

SEQ ID NO: 265619 - DNA, 27 bp, Artificial Sequence
  Description of Artificial Sequence: Synthetic oligonucleotide
tgacaggagatcccagctacagagggg

SEQ ID NO: 265620 - DNA, 27 bp, Artificial Sequence
  Description of Artificial Sequence: Synthetic oligonucleotide
gacaggagatcccagctacagagggga

SEQ ID NO: 265621 - DNA, 27 bp, Artificial Sequence
  Description of Artificial Sequence: Synthetic oligonucleotide
acaggagatcccagctacagaggggac

SEQ ID NO: 265622 - DNA, 26 bp, Artificial Sequence
  Description of Artificial Sequence: Synthetic oligonucleotide
caggagatcccagctacagaggggac

SEQ ID NO: 265623 - DNA, 26 bp, Artificial Sequence
  Description of Artificial Sequence: Synthetic oligonucleotide
aggagatcccagctacagaggggacg

SEQ ID NO: 265624 - DNA, 25 bp, Artificial Sequence
  Description of Artificial Sequence: Synthetic oligonucleotide
ggagatcccagctacagaggggacg

SEQ ID NO: 265625 - DNA, 27 bp, Artificial Sequence
  Description of Artificial Sequence: Synthetic oligonucleotide
gagatcccagctacagaggggacgcta

SEQ ID NO: 265626 - DNA, 28 bp, Artificial Sequence
  Description of Artificial Sequence: Synthetic oligonucleotide
agatcccagctacagaggggacgctatg

SEQ ID NO: 265627 - DNA, 27 bp, Artificial Sequence
  Description of Artificial Sequence: Synthetic oligonucleotide
gatcccagctacagaggggacgctatg

SEQ ID NO: 265628 - DNA, 28 bp, Artificial Sequence
  Description of Artificial Sequence: Synthetic oligonucleotide
atcccagctacagaggggacgctatgac

SEQ ID NO: 265629 - DNA, 27 bp, Artificial Sequence
  Description of Artificial Sequence: Synthetic oligonucleotide
tcccagctacagaggggacgctatgac

SEQ ID NO: 265630 - DNA, 26 bp, Artificial Sequence
  Description of Artificial Sequence: Synthetic oligonucleotide
cccagctacagaggggacgctatgac

SEQ ID NO: 265631 - DNA, 26 bp, Artificial Sequence
  Description of Artificial Sequence: Synthetic oligonucleotide
ccagctacagaggggacgctatgacg

SEQ ID NO: 265632 - DNA, 27 bp, Artificial Sequence
  Description of Artificial Sequence: Synthetic oligonucleotide
cagctacagaggggacgctatgacgca

SEQ ID NO: 265633 - DNA, 27 bp, Artificial Sequence
  Description of Artificial Sequence: Synthetic oligonucleotide
agctacagaggggacgctatgacgcag

SEQ ID NO: 265634 - DNA, 26 bp, Artificial Sequence
  Description of Artificial Sequence: Synthetic oligonucleotide
gctacagaggggacgctatgacgcag

SEQ ID NO: 265635 - DNA, 27 bp, Artificial Sequence
  Description of Artificial Sequence: Synthetic oligonucleotide
ctacagaggggacgctatgacgcagct

SEQ ID NO: 265636 - DNA, 29 bp, Artificial Sequence
  Description of Artificial Sequence: Synthetic oligonucleotide
tacagaggggacgctatgacgcagctaac

SEQ ID NO: 265637 - DNA, 28 bp, Artificial Sequence
  Description of Artificial Sequence: Synthetic oligonucleotide
acagaggggacgctatgacgcagctaac

SEQ ID NO: 265638 - DNA, 27 bp, Artificial Sequence
  Description of Artificial Sequence: Synthetic oligonucleotide
cagaggggacgctatgacgcagctaac

SEQ ID NO: 265639 - DNA, 28 bp, Artificial Sequence
  Description of Artificial Sequence: Synthetic oligonucleotide
agaggggacgctatgacgcagctaacag

SEQ ID NO: 265640 - DNA, 27 bp, Artificial Sequence
  Description of Artificial Sequence: Synthetic oligonucleotide
gaggggacgctatgacgcagctaacag

SEQ ID NO: 265641 - DNA, 27 bp, Artificial Sequence
  Description of Artificial Sequence: Synthetic oligonucleotide
aggggacgctatgacgcagctaacagg

SEQ ID NO: 265642 - DNA, 27 bp, Artificial Sequence
  Description of Artificial Sequence: Synthetic oligonucleotide
ggggacgctatgacgcagctaacagga

SEQ ID NO: 265643 - DNA, 31 bp, Artificial Sequence
  Description of Artificial Sequence: Synthetic oligonucleotide
gggacgctatgacgcagctaacaggaaatac

SEQ ID NO: 265644 - DNA, 33 bp, Artificial Sequence
  Description of Artificial Sequence: Synthetic oligonucleotide
ggacgctatgacgcagctaacaggaaatacatg

SEQ ID NO: 265645 - DNA, 36 bp, Artificial Sequence
  Description of Artificial Sequence: Synthetic oligonucleotide
gacgctatgacgcagctaacaggaaatacatgtatg

SEQ ID NO: 265646 - DNA, 36 bp, Artificial Sequence
  Description of Artificial Sequence: Synthetic oligonucleotide
acgctatgacgcagctaacaggaaatacatgtatgg

SEQ ID NO: 265647 - DNA, 35 bp, Artificial Sequence
  Description of Artificial Sequence: Synthetic oligonucleotide
cgctatgacgcagctaacaggaaatacatgtatgg

SEQ ID NO: 265648 - DNA, 35 bp, Artificial Sequence
  Description of Artificial Sequence: Synthetic oligonucleotide
gctatgacgcagctaacaggaaatacatgtatggc

SEQ ID NO: 265649 - DNA, 38 bp, Artificial Sequence
  Description of Artificial Sequence: Synthetic oligonucleotide
ctatgacgcagctaacaggaaatacatgtatggctaag

SEQ ID NO: 265650 - DNA, 39 bp, Artificial Sequence
  Description of Artificial Sequence: Synthetic oligonucleotide
tatgacgcagctaacaggaaatacatgtatggctaagag

SEQ ID NO: 265651 - DNA, 38 bp, Artificial Sequence
  Description of Artificial Sequence: Synthetic oligonucleotide
atgacgcagctaacaggaaatacatgtatggctaagag

SEQ ID NO: 265652 - DNA, 37 bp, Artificial Sequence
  Description of Artificial Sequence: Synthetic oligonucleotide
tgacgcagctaacaggaaatacatgtatggctaagag

SEQ ID NO: 265653 - DNA, 36 bp, Artificial Sequence
  Description of Artificial Sequence: Synthetic oligonucleotide
gacgcagctaacaggaaatacatgtatggctaagag

SEQ ID NO: 265654 - DNA, 39 bp, Artificial Sequence
  Description of Artificial Sequence: Synthetic oligonucleotide
acgcagctaacaggaaatacatgtatggctaagagattc

SEQ ID NO: 265655 - DNA, 38 bp, Artificial Sequence
  Description of Artificial Sequence: Synthetic oligonucleotide
cgcagctaacaggaaatacatgtatggctaagagattc

SEQ ID NO: 265656 - DNA, 38 bp, Artificial Sequence
  Description of Artificial Sequence: Synthetic oligonucleotide
gcagctaacaggaaatacatgtatggctaagagattcc

SEQ ID NO: 265657 - DNA, 39 bp, Artificial Sequence
  Description of Artificial Sequence: Synthetic oligonucleotide
cagctaacaggaaatacatgtatggctaagagattcctc

SEQ ID NO: 265658 - DNA, 40 bp, Artificial Sequence
  Description of Artificial Sequence: Synthetic oligonucleotide
agctaacaggaaatacatgtatggctaagagattcctctg

SEQ ID NO: 265659 - DNA, 39 bp, Artificial Sequence
  Description of Artificial Sequence: Synthetic oligonucleotide
gctaacaggaaatacatgtatggctaagagattcctctg

SEQ ID NO: 265660 - DNA, 39 bp, Artificial Sequence
  Description of Artificial Sequence: Synthetic oligonucleotide
ctaacaggaaatacatgtatggctaagagattcctctgg

SEQ ID NO: 265661 - DNA, 40 bp, Artificial Sequence
  Description of Artificial Sequence: Synthetic oligonucleotide
taacaggaaatacatgtatggctaagagattcctctggac

SEQ ID NO: 265662 - DNA, 39 bp, Artificial Sequence
  Description of Artificial Sequence: Synthetic oligonucleotide
aacaggaaatacatgtatggctaagagattcctctggac

SEQ ID NO: 265663 - DNA, 38 bp, Artificial Sequence
  Description of Artificial Sequence: Synthetic oligonucleotide
acaggaaatacatgtatggctaagagattcctctggac

SEQ ID NO: 265664 - DNA, 37 bp, Artificial Sequence
  Description of Artificial Sequence: Synthetic oligonucleotide
caggaaatacatgtatggctaagagattcctctggac

SEQ ID NO: 265665 - DNA, 39 bp, Artificial Sequence
  Description of Artificial Sequence: Synthetic oligonucleotide
aggaaatacatgtatggctaagagattcctctggacatg

SEQ ID NO: 265666 - DNA, 38 bp, Artificial Sequence
  Description of Artificial Sequence: Synthetic oligonucleotide
ggaaatacatgtatggctaagagattcctctggacatg

SEQ ID NO: 265667 - DNA, 38 bp, Artificial Sequence
  Description of Artificial Sequence: Synthetic oligonucleotide
gaaatacatgtatggctaagagattcctctggacatgc

SEQ ID NO: 265668 - DNA, 39 bp, Artificial Sequence
  Description of Artificial Sequence: Synthetic oligonucleotide
aaatacatgtatggctaagagattcctctggacatgcag

SEQ ID NO: 265669 - DNA, 38 bp, Artificial Sequence
  Description of Artificial Sequence: Synthetic oligonucleotide
aatacatgtatggctaagagattcctctggacatgcag

SEQ ID NO: 265670 - DNA, 37 bp, Artificial Sequence
  Description of Artificial Sequence: Synthetic oligonucleotide
atacatgtatggctaagagattcctctggacatgcag

SEQ ID NO: 265671 - DNA, 36 bp, Artificial Sequence
  Description of Artificial Sequence: Synthetic oligonucleotide
tacatgtatggctaagagattcctctggacatgcag

SEQ ID NO: 265672 - DNA, 35 bp, Artificial Sequence
  Description of Artificial Sequence: Synthetic oligonucleotide
acatgtatggctaagagattcctctggacatgcag

SEQ ID NO: 265673 - DNA, 34 bp, Artificial Sequence
  Description of Artificial Sequence: Synthetic oligonucleotide
catgtatggctaagagattcctctggacatgcag

SEQ ID NO: 265674 - DNA, 35 bp, Artificial Sequence
  Description of Artificial Sequence: Synthetic oligonucleotide
atgtatggctaagagattcctctggacatgcagtg

SEQ ID NO: 265675 - DNA, 34 bp, Artificial Sequence
  Description of Artificial Sequence: Synthetic oligonucleotide
tgtatggctaagagattcctctggacatgcagtg

SEQ ID NO: 265676 - DNA, 33 bp, Artificial Sequence
  Description of Artificial Sequence: Synthetic oligonucleotide
gtatggctaagagattcctctggacatgcagtg

SEQ ID NO: 265677 - DNA, 38 bp, Artificial Sequence
  Description of Artificial Sequence: Synthetic oligonucleotide
tatggctaagagattcctctggacatgcagtgtaaaag

SEQ ID NO: 265678 - DNA, 37 bp, Artificial Sequence
  Description of Artificial Sequence: Synthetic oligonucleotide
atggctaagagattcctctggacatgcagtgtaaaag

SEQ ID NO: 265679 - DNA, 36 bp, Artificial Sequence
  Description of Artificial Sequence: Synthetic oligonucleotide
tggctaagagattcctctggacatgcagtgtaaaag

SEQ ID NO: 265680 - DNA, 35 bp, Artificial Sequence
  Description of Artificial Sequence: Synthetic oligonucleotide
ggctaagagattcctctggacatgcagtgtaaaag

SEQ ID NO: 265681 - DNA, 39 bp, Artificial Sequence
  Description of Artificial Sequence: Synthetic oligonucleotide
gctaagagattcctctggacatgcagtgtaaaagtattg

SEQ ID NO: 265682 - DNA, 39 bp, Artificial Sequence
  Description of Artificial Sequence: Synthetic oligonucleotide
ctaagagattcctctggacatgcagtgtaaaagtattgc

SEQ ID NO: 265683 - DNA, 39 bp, Artificial Sequence
  Description of Artificial Sequence: Synthetic oligonucleotide
taagagattcctctggacatgcagtgtaaaagtattgcc

SEQ ID NO: 265684 - DNA, 38 bp, Artificial Sequence
  Description of Artificial Sequence: Synthetic oligonucleotide
aagagattcctctggacatgcagtgtaaaagtattgcc

SEQ ID NO: 265685 - DNA, 37 bp, Artificial Sequence
  Description of Artificial Sequence: Synthetic oligonucleotide
agagattcctctggacatgcagtgtaaaagtattgcc

SEQ ID NO: 265686 - DNA, 36 bp, Artificial Sequence
  Description of Artificial Sequence: Synthetic oligonucleotide
gagattcctctggacatgcagtgtaaaagtattgcc

SEQ ID NO: 265687 - DNA, 36 bp, Artificial Sequence
  Description of Artificial Sequence: Synthetic oligonucleotide
agattcctctggacatgcagtgtaaaagtattgccg

SEQ ID NO: 265688 - DNA, 35 bp, Artificial Sequence
  Description of Artificial Sequence: Synthetic oligonucleotide
gattcctctggacatgcagtgtaaaagtattgccg

SEQ ID NO: 265689 - DNA, 41 bp, Artificial Sequence
  Description of Artificial Sequence: Synthetic oligonucleotide
attcctctggacatgcagtgtaaaagtattgccgatttttc

SEQ ID NO: 265690 - DNA, 40 bp, Artificial Sequence
  Description of Artificial Sequence: Synthetic oligonucleotide
ttcctctggacatgcagtgtaaaagtattgccgatttttc

SEQ ID NO: 265691 - DNA, 39 bp, Artificial Sequence
  Description of Artificial Sequence: Synthetic oligonucleotide
tcctctggacatgcagtgtaaaagtattgccgatttttc

SEQ ID NO: 265692 - DNA, 38 bp, Artificial Sequence
  Description of Artificial Sequence: Synthetic oligonucleotide
cctctggacatgcagtgtaaaagtattgccgatttttc

SEQ ID NO: 265693 - DNA, 39 bp, Artificial Sequence
  Description of Artificial Sequence: Synthetic oligonucleotide
ctctggacatgcagtgtaaaagtattgccgatttttctc

SEQ ID NO: 265694 - DNA, 40 bp, Artificial Sequence
  Description of Artificial Sequence: Synthetic oligonucleotide
tctggacatgcagtgtaaaagtattgccgatttttctcag

SEQ ID NO: 265695 - DNA, 39 bp, Artificial Sequence
  Description of Artificial Sequence: Synthetic oligonucleotide
ctggacatgcagtgtaaaagtattgccgatttttctcag

SEQ ID NO: 265696 - DNA, 39 bp, Artificial Sequence
  Description of Artificial Sequence: Synthetic oligonucleotide
tggacatgcagtgtaaaagtattgccgatttttctcagg

SEQ ID NO: 265697 - DNA, 38 bp, Artificial Sequence
  Description of Artificial Sequence: Synthetic oligonucleotide
ggacatgcagtgtaaaagtattgccgatttttctcagg

SEQ ID NO: 265698 - DNA, 39 bp, Artificial Sequence
  Description of Artificial Sequence: Synthetic oligonucleotide
gacatgcagtgtaaaagtattgccgatttttctcaggac

SEQ ID NO: 265699 - DNA, 41 bp, Artificial Sequence
  Description of Artificial Sequence: Synthetic oligonucleotide
acatgcagtgtaaaagtattgccgatttttctcaggactac

SEQ ID NO: 265700 - DNA, 40 bp, Artificial Sequence
  Description of Artificial Sequence: Synthetic oligonucleotide
catgcagtgtaaaagtattgccgatttttctcaggactac

SEQ ID NO: 265701 - DNA, 41 bp, Artificial Sequence
  Description of Artificial Sequence: Synthetic oligonucleotide
atgcagtgtaaaagtattgccgatttttctcaggactacac

SEQ ID NO: 265702 - DNA, 40 bp, Artificial Sequence
  Description of Artificial Sequence: Synthetic oligonucleotide
tgcagtgtaaaagtattgccgatttttctcaggactacac

SEQ ID NO: 265703 - DNA, 39 bp, Artificial Sequence
  Description of Artificial Sequence: Synthetic oligonucleotide
gcagtgtaaaagtattgccgatttttctcaggactacac

SEQ ID NO: 265704 - DNA, 40 bp, Artificial Sequence
  Description of Artificial Sequence: Synthetic oligonucleotide
cagtgtaaaagtattgccgatttttctcaggactacacac

SEQ ID NO: 265705 - DNA, 41 bp, Artificial Sequence
  Description of Artificial Sequence: Synthetic oligonucleotide
agtgtaaaagtattgccgatttttctcaggactacacacac

SEQ ID NO: 265706 - DNA, 40 bp, Artificial Sequence
  Description of Artificial Sequence: Synthetic oligonucleotide
gtgtaaaagtattgccgatttttctcaggactacacacac

SEQ ID NO: 265707 - DNA, 43 bp, Artificial Sequence
  Description of Artificial Sequence: Synthetic oligonucleotide
tgtaaaagtattgccgatttttctcaggactacacacacaatg

SEQ ID NO: 265708 - DNA, 42 bp, Artificial Sequence
  Description of Artificial Sequence: Synthetic oligonucleotide
gtaaaagtattgccgatttttctcaggactacacacacaatg

SEQ ID NO: 265709 - DNA, 42 bp, Artificial Sequence
  Description of Artificial Sequence: Synthetic oligonucleotide
taaaagtattgccgatttttctcaggactacacacacaatgc

SEQ ID NO: 265710 - DNA, 41 bp, Artificial Sequence
  Description of Artificial Sequence: Synthetic oligonucleotide
aaaagtattgccgatttttctcaggactacacacacaatgc

SEQ ID NO: 265711 - DNA, 40 bp, Artificial Sequence
  Description of Artificial Sequence: Synthetic oligonucleotide
aaagtattgccgatttttctcaggactacacacacaatgc

SEQ ID NO: 265712 - DNA, 39 bp, Artificial Sequence
  Description of Artificial Sequence: Synthetic oligonucleotide
aagtattgccgatttttctcaggactacacacacaatgc

SEQ ID NO: 265713 - DNA, 38 bp, Artificial Sequence
  Description of Artificial Sequence: Synthetic oligonucleotide
agtattgccgatttttctcaggactacacacacaatgc

SEQ ID NO: 265714 - DNA, 37 bp, Artificial Sequence
  Description of Artificial Sequence: Synthetic oligonucleotide
gtattgccgatttttctcaggactacacacacaatgc

SEQ ID NO: 265715 - DNA, 38 bp, Artificial Sequence
  Description of Artificial Sequence: Synthetic oligonucleotide
tattgccgatttttctcaggactacacacacaatgctg

SEQ ID NO: 265716 - DNA, 37 bp, Artificial Sequence
  Description of Artificial Sequence: Synthetic oligonucleotide
attgccgatttttctcaggactacacacacaatgctg

SEQ ID NO: 265717 - DNA, 36 bp, Artificial Sequence
  Description of Artificial Sequence: Synthetic oligonucleotide
ttgccgatttttctcaggactacacacacaatgctg

SEQ ID NO: 265718 - DNA, 35 bp, Artificial Sequence
  Description of Artificial Sequence: Synthetic oligonucleotide
tgccgatttttctcaggactacacacacaatgctg

SEQ ID NO: 265719 - DNA, 34 bp, Artificial Sequence
  Description of Artificial Sequence: Synthetic oligonucleotide
gccgatttttctcaggactacacacacaatgctg

SEQ ID NO: 265720 - DNA, 38 bp, Artificial Sequence
  Description of Artificial Sequence: Synthetic oligonucleotide
ccgatttttctcaggactacacacacaatgctgaattg

SEQ ID NO: 265721 - DNA, 39 bp, Artificial Sequence
  Description of Artificial Sequence: Synthetic oligonucleotide
cgatttttctcaggactacacacacaatgctgaattgag

SEQ ID NO: 265722 - DNA, 39 bp, Artificial Sequence
  Description of Artificial Sequence: Synthetic oligonucleotide
gatttttctcaggactacacacacaatgctgaattgagg

SEQ ID NO: 265723 - DNA, 39 bp, Artificial Sequence
  Description of Artificial Sequence: Synthetic oligonucleotide
atttttctcaggactacacacacaatgctgaattgaggc

SEQ ID NO: 265724 - DNA, 38 bp, Artificial Sequence
  Description of Artificial Sequence: Synthetic oligonucleotide
tttttctcaggactacacacacaatgctgaattgaggc

SEQ ID NO: 265725 - DNA, 37 bp, Artificial Sequence
  Description of Artificial Sequence: Synthetic oligonucleotide
ttttctcaggactacacacacaatgctgaattgaggc

SEQ ID NO: 265726 - DNA, 36 bp, Artificial Sequence
  Description of Artificial Sequence: Synthetic oligonucleotide
tttctcaggactacacacacaatgctgaattgaggc

SEQ ID NO: 265727 - DNA, 35 bp, Artificial Sequence
  Description of Artificial Sequence: Synthetic oligonucleotide
ttctcaggactacacacacaatgctgaattgaggc

SEQ ID NO: 265728 - DNA, 34 bp, Artificial Sequence
  Description of Artificial Sequence: Synthetic oligonucleotide
tctcaggactacacacacaatgctgaattgaggc

SEQ ID NO: 265729 - DNA, 33 bp, Artificial Sequence
  Description of Artificial Sequence: Synthetic oligonucleotide
ctcaggactacacacacaatgctgaattgaggc

SEQ ID NO: 265730 - DNA, 33 bp, Artificial Sequence
  Description of Artificial Sequence: Synthetic oligonucleotide
tcaggactacacacacaatgctgaattgaggcc

SEQ ID NO: 265731 - DNA, 32 bp, Artificial Sequence
  Description of Artificial Sequence: Synthetic oligonucleotide
caggactacacacacaatgctgaattgaggcc

SEQ ID NO: 265732 - DNA, 33 bp, Artificial Sequence
  Description of Artificial Sequence: Synthetic oligonucleotide
aggactacacacacaatgctgaattgaggcctc

SEQ ID NO: 265733 - DNA, 32 bp, Artificial Sequence
  Description of Artificial Sequence: Synthetic oligonucleotide
ggactacacacacaatgctgaattgaggcctc

SEQ ID NO: 265734 - DNA, 34 bp, Artificial Sequence
  Description of Artificial Sequence: Synthetic oligonucleotide
gactacacacacaatgctgaattgaggcctcatg

SEQ ID NO: 265735 - DNA, 34 bp, Artificial Sequence
  Description of Artificial Sequence: Synthetic oligonucleotide
actacacacacaatgctgaattgaggcctcatgg

SEQ ID NO: 265736 - DNA, 33 bp, Artificial Sequence
  Description of Artificial Sequence: Synthetic oligonucleotide
ctacacacacaatgctgaattgaggcctcatgg

SEQ ID NO: 265737 - DNA, 35 bp, Artificial Sequence
  Description of Artificial Sequence: Synthetic oligonucleotide
tacacacacaatgctgaattgaggcctcatggttg

SEQ ID NO: 265738 - DNA, 34 bp, Artificial Sequence
  Description of Artificial Sequence: Synthetic oligonucleotide
acacacacaatgctgaattgaggcctcatggttg

SEQ ID NO: 265739 - DNA, 33 bp, Artificial Sequence
  Description of Artificial Sequence: Synthetic oligonucleotide
cacacacaatgctgaattgaggcctcatggttg

SEQ ID NO: 265740 - DNA, 35 bp, Artificial Sequence
  Description of Artificial Sequence: Synthetic oligonucleotide
acacacaatgctgaattgaggcctcatggttgttg

SEQ ID NO: 265741 - DNA, 34 bp, Artificial Sequence
  Description of Artificial Sequence: Synthetic oligonucleotide
cacacaatgctgaattgaggcctcatggttgttg

SEQ ID NO: 265742 - DNA, 37 bp, Artificial Sequence
  Description of Artificial Sequence: Synthetic oligonucleotide
acacaatgctgaattgaggcctcatggttgttgaatg

SEQ ID NO: 265743 - DNA, 36 bp, Artificial Sequence
  Description of Artificial Sequence: Synthetic oligonucleotide
cacaatgctgaattgaggcctcatggttgttgaatg

SEQ ID NO: 265744 - DNA, 45 bp, Artificial Sequence
  Description of Artificial Sequence: Synthetic oligonucleotide
acaatgctgaattgaggcctcatggttgttgaatgattttatttg

SEQ ID NO: 265745 - DNA, 44 bp, Artificial Sequence
  Description of Artificial Sequence: Synthetic oligonucleotide
caatgctgaattgaggcctcatggttgttgaatgattttatttg

SEQ ID NO: 265746 - DNA, 44 bp, Artificial Sequence
  Description of Artificial Sequence: Synthetic oligonucleotide
aatgctgaattgaggcctcatggttgttgaatgattttatttgg

SEQ ID NO: 265747 - DNA, 43 bp, Artificial Sequence
  Description of Artificial Sequence: Synthetic oligonucleotide
atgctgaattgaggcctcatggttgttgaatgattttatttgg

SEQ ID NO: 265748 - DNA, 42 bp, Artificial Sequence
  Description of Artificial Sequence: Synthetic oligonucleotide
tgctgaattgaggcctcatggttgttgaatgattttatttgg

SEQ ID NO: 265749 - DNA, 41 bp, Artificial Sequence
  Description of Artificial Sequence: Synthetic oligonucleotide
gctgaattgaggcctcatggttgttgaatgattttatttgg

SEQ ID NO: 265750 - DNA, 45 bp, Artificial Sequence
  Description of Artificial Sequence: Synthetic oligonucleotide
ctgaattgaggcctcatggttgttgaatgattttatttggtatag

SEQ ID NO: 265751 - DNA, 47 bp, Artificial Sequence
  Description of Artificial Sequence: Synthetic oligonucleotide
tgaattgaggcctcatggttgttgaatgattttatttggtatagttg

SEQ ID NO: 265752 - DNA, 46 bp, Artificial Sequence
  Description of Artificial Sequence: Synthetic oligonucleotide
gaattgaggcctcatggttgttgaatgattttatttggtatagttg

SEQ ID NO: 265753 - DNA, 48 bp, Artificial Sequence
  Description of Artificial Sequence: Synthetic oligonucleotide
aattgaggcctcatggttgttgaatgattttatttggtatagttgaag

SEQ ID NO: 265754 - DNA, 47 bp, Artificial Sequence
  Description of Artificial Sequence: Synthetic oligonucleotide
attgaggcctcatggttgttgaatgattttatttggtatagttgaag

SEQ ID NO: 265755 - DNA, 46 bp, Artificial Sequence
  Description of Artificial Sequence: Synthetic oligonucleotide
ttgaggcctcatggttgttgaatgattttatttggtatagttgaag

SEQ ID NO: 265756 - DNA, 45 bp, Artificial Sequence
  Description of Artificial Sequence: Synthetic oligonucleotide
tgaggcctcatggttgttgaatgattttatttggtatagttgaag

SEQ ID NO: 265757 - DNA, 44 bp, Artificial Sequence
  Description of Artificial Sequence: Synthetic oligonucleotide
gaggcctcatggttgttgaatgattttatttggtatagttgaag

SEQ ID NO: 265758 - DNA, 45 bp, Artificial Sequence
  Description of Artificial Sequence: Synthetic oligonucleotide
aggcctcatggttgttgaatgattttatttggtatagttgaagag

SEQ ID NO: 265759 - DNA, 44 bp, Artificial Sequence
  Description of Artificial Sequence: Synthetic oligonucleotide
ggcctcatggttgttgaatgattttatttggtatagttgaagag

SEQ ID NO: 265760 - DNA, 44 bp, Artificial Sequence
  Description of Artificial Sequence: Synthetic oligonucleotide
gcctcatggttgttgaatgattttatttggtatagttgaagagc

SEQ ID NO: 265761 - DNA, 46 bp, Artificial Sequence
  Description of Artificial Sequence: Synthetic oligonucleotide
cctcatggttgttgaatgattttatttggtatagttgaagagcatg

SEQ ID NO: 265762 - DNA, 46 bp, Artificial Sequence
  Description of Artificial Sequence: Synthetic oligonucleotide
ctcatggttgttgaatgattttatttggtatagttgaagagcatgg

SEQ ID NO: 265763 - DNA, 46 bp, Artificial Sequence
  Description of Artificial Sequence: Synthetic oligonucleotide
tcatggttgttgaatgattttatttggtatagttgaagagcatggc

SEQ ID NO: 265764 - DNA, 45 bp, Artificial Sequence
  Description of Artificial Sequence: Synthetic oligonucleotide
catggttgttgaatgattttatttggtatagttgaagagcatggc

SEQ ID NO: 265765 - DNA, 45 bp, Artificial Sequence
  Description of Artificial Sequence: Synthetic oligonucleotide
atggttgttgaatgattttatttggtatagttgaagagcatggcc

SEQ ID NO: 265766 - DNA, 44 bp, Artificial Sequence
  Description of Artificial Sequence: Synthetic oligonucleotide
tggttgttgaatgattttatttggtatagttgaagagcatggcc

SEQ ID NO: 265767 - DNA, 43 bp, Artificial Sequence
  Description of Artificial Sequence: Synthetic oligonucleotide
ggttgttgaatgattttatttggtatagttgaagagcatggcc

SEQ ID NO: 265768 - DNA, 43 bp, Artificial Sequence
  Description of Artificial Sequence: Synthetic oligonucleotide
gttgttgaatgattttatttggtatagttgaagagcatggccc

SEQ ID NO: 265769 - DNA, 44 bp, Artificial Sequence
  Description of Artificial Sequence: Synthetic oligonucleotide
ttgttgaatgattttatttggtatagttgaagagcatggccctc

SEQ ID NO: 265770 - DNA, 43 bp, Artificial Sequence
  Description of Artificial Sequence: Synthetic oligonucleotide
tgttgaatgattttatttggtatagttgaagagcatggccctc

SEQ ID NO: 265771 - DNA, 42 bp, Artificial Sequence
  Description of Artificial Sequence: Synthetic oligonucleotide
gttgaatgattttatttggtatagttgaagagcatggccctc

SEQ ID NO: 265772 - DNA, 43 bp, Artificial Sequence
  Description of Artificial Sequence: Synthetic oligonucleotide
ttgaatgattttatttggtatagttgaagagcatggccctcag

SEQ ID NO: 265773 - DNA, 42 bp, Artificial Sequence
  Description of Artificial Sequence: Synthetic oligonucleotide
tgaatgattttatttggtatagttgaagagcatggccctcag

SEQ ID NO: 265774 - DNA, 41 bp, Artificial Sequence
  Description of Artificial Sequence: Synthetic oligonucleotide
gaatgattttatttggtatagttgaagagcatggccctcag

SEQ ID NO: 265775 - DNA, 41 bp, Artificial Sequence
  Description of Artificial Sequence: Synthetic oligonucleotide
aatgattttatttggtatagttgaagagcatggccctcagc

SEQ ID NO: 265776 - DNA, 40 bp, Artificial Sequence
  Description of Artificial Sequence: Synthetic oligonucleotide
atgattttatttggtatagttgaagagcatggccctcagc

SEQ ID NO: 265777 - DNA, 39 bp, Artificial Sequence
  Description of Artificial Sequence: Synthetic oligonucleotide
tgattttatttggtatagttgaagagcatggccctcagc

SEQ ID NO: 265778 - DNA, 38 bp, Artificial Sequence
  Description of Artificial Sequence: Synthetic oligonucleotide
gattttatttggtatagttgaagagcatggccctcagc

SEQ ID NO: 265779 - DNA, 45 bp, Artificial Sequence
  Description of Artificial Sequence: Synthetic oligonucleotide
attttatttggtatagttgaagagcatggccctcagctatataag

SEQ ID NO: 265780 - DNA, 44 bp, Artificial Sequence
  Description of Artificial Sequence: Synthetic oligonucleotide
ttttatttggtatagttgaagagcatggccctcagctatataag

SEQ ID NO: 265781 - DNA, 43 bp, Artificial Sequence
  Description of Artificial Sequence: Synthetic oligonucleotide
tttatttggtatagttgaagagcatggccctcagctatataag

SEQ ID NO: 265782 - DNA, 42 bp, Artificial Sequence
  Description of Artificial Sequence: Synthetic oligonucleotide
ttatttggtatagttgaagagcatggccctcagctatataag

SEQ ID NO: 265783 - DNA, 41 bp, Artificial Sequence
  Description of Artificial Sequence: Synthetic oligonucleotide
tatttggtatagttgaagagcatggccctcagctatataag

SEQ ID NO: 265784 - DNA, 40 bp, Artificial Sequence
  Description of Artificial Sequence: Synthetic oligonucleotide
atttggtatagttgaagagcatggccctcagctatataag

SEQ ID NO: 265785 - DNA, 39 bp, Artificial Sequence
  Description of Artificial Sequence: Synthetic oligonucleotide
tttggtatagttgaagagcatggccctcagctatataag

SEQ ID NO: 265786 - DNA, 38 bp, Artificial Sequence
  Description of Artificial Sequence: Synthetic oligonucleotide
ttggtatagttgaagagcatggccctcagctatataag

SEQ ID NO: 265787 - DNA, 37 bp, Artificial Sequence
  Description of Artificial Sequence: Synthetic oligonucleotide
tggtatagttgaagagcatggccctcagctatataag

SEQ ID NO: 265788 - DNA, 36 bp, Artificial Sequence
  Description of Artificial Sequence: Synthetic oligonucleotide
ggtatagttgaagagcatggccctcagctatataag

SEQ ID NO: 265789 - DNA, 37 bp, Artificial Sequence
  Description of Artificial Sequence: Synthetic oligonucleotide
gtatagttgaagagcatggccctcagctatataagtc

SEQ ID NO: 265790 - DNA, 38 bp, Artificial Sequence
  Description of Artificial Sequence: Synthetic oligonucleotide
tatagttgaagagcatggccctcagctatataagtctg

SEQ ID NO: 265791 - DNA, 37 bp, Artificial Sequence
  Description of Artificial Sequence: Synthetic oligonucleotide
atagttgaagagcatggccctcagctatataagtctg

SEQ ID NO: 265792 - DNA, 36 bp, Artificial Sequence
  Description of Artificial Sequence: Synthetic oligonucleotide
tagttgaagagcatggccctcagctatataagtctg

SEQ ID NO: 265793 - DNA, 35 bp, Artificial Sequence
  Description of Artificial Sequence: Synthetic oligonucleotide
agttgaagagcatggccctcagctatataagtctg

SEQ ID NO: 265794 - DNA, 34 bp, Artificial Sequence
  Description of Artificial Sequence: Synthetic oligonucleotide
gttgaagagcatggccctcagctatataagtctg

SEQ ID NO: 265795 - DNA, 36 bp, Artificial Sequence
  Description of Artificial Sequence: Synthetic oligonucleotide
ttgaagagcatggccctcagctatataagtctgatc

SEQ ID NO: 265796 - DNA, 35 bp, Artificial Sequence
  Description of Artificial Sequence: Synthetic oligonucleotide
tgaagagcatggccctcagctatataagtctgatc

SEQ ID NO: 265797 - DNA, 34 bp, Artificial Sequence
  Description of Artificial Sequence: Synthetic oligonucleotide
gaagagcatggccctcagctatataagtctgatc

SEQ ID NO: 265798 - DNA, 34 bp, Artificial Sequence
  Description of Artificial Sequence: Synthetic oligonucleotide
aagagcatggccctcagctatataagtctgatcc

SEQ ID NO: 265799 - DNA, 33 bp, Artificial Sequence
  Description of Artificial Sequence: Synthetic oligonucleotide
agagcatggccctcagctatataagtctgatcc

SEQ ID NO: 265800 - DNA, 32 bp, Artificial Sequence
  Description of Artificial Sequence: Synthetic oligonucleotide
gagcatggccctcagctatataagtctgatcc

SEQ ID NO: 265801 - DNA, 33 bp, Artificial Sequence
  Description of Artificial Sequence: Synthetic oligonucleotide
agcatggccctcagctatataagtctgatcctg

SEQ ID NO: 265802 - DNA, 32 bp, Artificial Sequence
  Description of Artificial Sequence: Synthetic oligonucleotide
gcatggccctcagctatataagtctgatcctg

SEQ ID NO: 265803 - DNA, 32 bp, Artificial Sequence
  Description of Artificial Sequence: Synthetic oligonucleotide
catggccctcagctatataagtctgatcctgc

SEQ ID NO: 265804 - DNA, 33 bp, Artificial Sequence
  Description of Artificial Sequence: Synthetic oligonucleotide
atggccctcagctatataagtctgatcctgctg

SEQ ID NO: 265805 - DNA, 32 bp, Artificial Sequence
  Description of Artificial Sequence: Synthetic oligonucleotide
tggccctcagctatataagtctgatcctgctg

SEQ ID NO: 265806 - DNA, 31 bp, Artificial Sequence
  Description of Artificial Sequence: Synthetic oligonucleotide
ggccctcagctatataagtctgatcctgctg

SEQ ID NO: 265807 - DNA, 31 bp, Artificial Sequence
  Description of Artificial Sequence: Synthetic oligonucleotide
gccctcagctatataagtctgatcctgctgg

SEQ ID NO: 265808 - DNA, 34 bp, Artificial Sequence
  Description of Artificial Sequence: Synthetic oligonucleotide
ccctcagctatataagtctgatcctgctggttac

SEQ ID NO: 265809 - DNA, 36 bp, Artificial Sequence
  Description of Artificial Sequence: Synthetic oligonucleotide
cctcagctatataagtctgatcctgctggttactac

SEQ ID NO: 265810 - DNA, 37 bp, Artificial Sequence
  Description of Artificial Sequence: Synthetic oligonucleotide
ctcagctatataagtctgatcctgctggttactacag

SEQ ID NO: 265811 - DNA, 38 bp, Artificial Sequence
  Description of Artificial Sequence: Synthetic oligonucleotide
tcagctatataagtctgatcctgctggttactacagtg

SEQ ID NO: 265812 - DNA, 37 bp, Artificial Sequence
  Description of Artificial Sequence: Synthetic oligonucleotide
cagctatataagtctgatcctgctggttactacagtg

SEQ ID NO: 265813 - DNA, 37 bp, Artificial Sequence
  Description of Artificial Sequence: Synthetic oligonucleotide
agctatataagtctgatcctgctggttactacagtgg

SEQ ID NO: 265814 - DNA, 36 bp, Artificial Sequence
  Description of Artificial Sequence: Synthetic oligonucleotide
gctatataagtctgatcctgctggttactacagtgg

SEQ ID NO: 265815 - DNA, 36 bp, Artificial Sequence
  Description of Artificial Sequence: Synthetic oligonucleotide
ctatataagtctgatcctgctggttactacagtggg

SEQ ID NO: 265816 - DNA, 42 bp, Artificial Sequence
  Description of Artificial Sequence: Synthetic oligonucleotide
tatataagtctgatcctgctggttactacagtgggtttatag

SEQ ID NO: 265817 - DNA, 41 bp, Artificial Sequence
  Description of Artificial Sequence: Synthetic oligonucleotide
atataagtctgatcctgctggttactacagtgggtttatag

SEQ ID NO: 265818 - DNA, 40 bp, Artificial Sequence
  Description of Artificial Sequence: Synthetic oligonucleotide
tataagtctgatcctgctggttactacagtgggtttatag

SEQ ID NO: 265819 - DNA, 39 bp, Artificial Sequence
  Description of Artificial Sequence: Synthetic oligonucleotide
ataagtctgatcctgctggttactacagtgggtttatag

SEQ ID NO: 265820 - DNA, 38 bp, Artificial Sequence
  Description of Artificial Sequence: Synthetic oligonucleotide
taagtctgatcctgctggttactacagtgggtttatag

SEQ ID NO: 265821 - DNA, 37 bp, Artificial Sequence
  Description of Artificial Sequence: Synthetic oligonucleotide
aagtctgatcctgctggttactacagtgggtttatag

SEQ ID NO: 265822 - DNA, 36 bp, Artificial Sequence
  Description of Artificial Sequence: Synthetic oligonucleotide
agtctgatcctgctggttactacagtgggtttatag

SEQ ID NO: 265823 - DNA, 35 bp, Artificial Sequence
  Description of Artificial Sequence: Synthetic oligonucleotide
gtctgatcctgctggttactacagtgggtttatag

SEQ ID NO: 265824 - DNA, 35 bp, Artificial Sequence
  Description of Artificial Sequence: Synthetic oligonucleotide
tctgatcctgctggttactacagtgggtttatagc

SEQ ID NO: 265825 - DNA, 34 bp, Artificial Sequence
  Description of Artificial Sequence: Synthetic oligonucleotide
ctgatcctgctggttactacagtgggtttatagc

SEQ ID NO: 265826 - DNA, 34 bp, Artificial Sequence
  Description of Artificial Sequence: Synthetic oligonucleotide
tgatcctgctggttactacagtgggtttatagcc

SEQ ID NO: 265827 - DNA, 33 bp, Artificial Sequence
  Description of Artificial Sequence: Synthetic oligonucleotide
gatcctgctggttactacagtgggtttatagcc

SEQ ID NO: 265828 - DNA, 34 bp, Artificial Sequence
  Description of Artificial Sequence: Synthetic oligonucleotide
atcctgctggttactacagtgggtttatagccac

SEQ ID NO: 265829 - DNA, 33 bp, Artificial Sequence
  Description of Artificial Sequence: Synthetic oligonucleotide
tcctgctggttactacagtgggtttatagccac

SEQ ID NO: 265830 - DNA, 32 bp, Artificial Sequence
  Description of Artificial Sequence: Synthetic oligonucleotide
cctgctggttactacagtgggtttatagccac

SEQ ID NO: 265831 - DNA, 33 bp, Artificial Sequence
  Description of Artificial Sequence: Synthetic oligonucleotide
ctgctggttactacagtgggtttatagccactg

SEQ ID NO: 265832 - DNA, 33 bp, Artificial Sequence
  Description of Artificial Sequence: Synthetic oligonucleotide
tgctggttactacagtgggtttatagccactgc

SEQ ID NO: 265833 - DNA, 32 bp, Artificial Sequence
  Description of Artificial Sequence: Synthetic oligonucleotide
gctggttactacagtgggtttatagccactgc

SEQ ID NO: 265834 - DNA, 33 bp, Artificial Sequence
  Description of Artificial Sequence: Synthetic oligonucleotide
ctggttactacagtgggtttatagccactgctg

SEQ ID NO: 265835 - DNA, 33 bp, Artificial Sequence
  Description of Artificial Sequence: Synthetic oligonucleotide
tggttactacagtgggtttatagccactgctgc

SEQ ID NO: 265836 - DNA, 32 bp, Artificial Sequence
  Description of Artificial Sequence: Synthetic oligonucleotide
ggttactacagtgggtttatagccactgctgc

SEQ ID NO: 265837 - DNA, 32 bp, Artificial Sequence
  Description of Artificial Sequence: Synthetic oligonucleotide
gttactacagtgggtttatagccactgctgcg

SEQ ID NO: 265838 - DNA, 32 bp, Artificial Sequence
  Description of Artificial Sequence: Synthetic oligonucleotide
ttactacagtgggtttatagccactgctgcgg

SEQ ID NO: 265839 - DNA, 31 bp, Artificial Sequence
  Description of Artificial Sequence: Synthetic oligonucleotide
tactacagtgggtttatagccactgctgcgg

SEQ ID NO: 265840 - DNA, 30 bp, Artificial Sequence
  Description of Artificial Sequence: Synthetic oligonucleotide
actacagtgggtttatagccactgctgcgg

SEQ ID NO: 265841 - DNA, 29 bp, Artificial Sequence
  Description of Artificial Sequence: Synthetic oligonucleotide
ctacagtgggtttatagccactgctgcgg

SEQ ID NO: 265842 - DNA, 29 bp, Artificial Sequence
  Description of Artificial Sequence: Synthetic oligonucleotide
tacagtgggtttatagccactgctgcggg

SEQ ID NO: 265843 - DNA, 28 bp, Artificial Sequence
  Description of Artificial Sequence: Synthetic oligonucleotide
acagtgggtttatagccactgctgcggg

SEQ ID NO: 265844 - DNA, 27 bp, Artificial Sequence
  Description of Artificial Sequence: Synthetic oligonucleotide
cagtgggtttatagccactgctgcggg

SEQ ID NO: 265845 - DNA, 28 bp, Artificial Sequence
  Description of Artificial Sequence: Synthetic oligonucleotide
agtgggtttatagccactgctgcgggag

SEQ ID NO: 265846 - DNA, 27 bp, Artificial Sequence
  Description of Artificial Sequence: Synthetic oligonucleotide
gtgggtttatagccactgctgcgggag

SEQ ID NO: 265847 - DNA, 32 bp, Artificial Sequence
  Description of Artificial Sequence: Synthetic oligonucleotide
tgggtttatagccactgctgcgggagtttaac

SEQ ID NO: 265848 - DNA, 31 bp, Artificial Sequence
  Description of Artificial Sequence: Synthetic oligonucleotide
gggtttatagccactgctgcgggagtttaac

SEQ ID NO: 265849 - DNA, 34 bp, Artificial Sequence
  Description of Artificial Sequence: Synthetic oligonucleotide
ggtttatagccactgctgcgggagtttaacaaac

SEQ ID NO: 265850 - DNA, 35 bp, Artificial Sequence
  Description of Artificial Sequence: Synthetic oligonucleotide
gtttatagccactgctgcgggagtttaacaaactg

SEQ ID NO: 265851 - DNA, 36 bp, Artificial Sequence
  Description of Artificial Sequence: Synthetic oligonucleotide
tttatagccactgctgcgggagtttaacaaactgtg

SEQ ID NO: 265852 - DNA, 35 bp, Artificial Sequence
  Description of Artificial Sequence: Synthetic oligonucleotide
ttatagccactgctgcgggagtttaacaaactgtg

SEQ ID NO: 265853 - DNA, 34 bp, Artificial Sequence
  Description of Artificial Sequence: Synthetic oligonucleotide
tatagccactgctgcgggagtttaacaaactgtg

SEQ ID NO: 265854 - DNA, 33 bp, Artificial Sequence
  Description of Artificial Sequence: Synthetic oligonucleotide
atagccactgctgcgggagtttaacaaactgtg

SEQ ID NO: 265855 - DNA, 32 bp, Artificial Sequence
  Description of Artificial Sequence: Synthetic oligonucleotide
tagccactgctgcgggagtttaacaaactgtg

SEQ ID NO: 265856 - DNA, 31 bp, Artificial Sequence
  Description of Artificial Sequence: Synthetic oligonucleotide
agccactgctgcgggagtttaacaaactgtg

SEQ ID NO: 265857 - DNA, 30 bp, Artificial Sequence
  Description of Artificial Sequence: Synthetic oligonucleotide
gccactgctgcgggagtttaacaaactgtg

SEQ ID NO: 265858 - DNA, 31 bp, Artificial Sequence
  Description of Artificial Sequence: Synthetic oligonucleotide
ccactgctgcgggagtttaacaaactgtgtc

SEQ ID NO: 265859 - DNA, 33 bp, Artificial Sequence
  Description of Artificial Sequence: Synthetic oligonucleotide
cactgctgcgggagtttaacaaactgtgtcaac

SEQ ID NO: 265860 - DNA, 33 bp, Artificial Sequence
  Description of Artificial Sequence: Synthetic oligonucleotide
actgctgcgggagtttaacaaactgtgtcaacc

SEQ ID NO: 265861 - DNA, 32 bp, Artificial Sequence
  Description of Artificial Sequence: Synthetic oligonucleotide
ctgctgcgggagtttaacaaactgtgtcaacc

SEQ ID NO: 265862 - DNA, 33 bp, Artificial Sequence
  Description of Artificial Sequence: Synthetic oligonucleotide
tgctgcgggagtttaacaaactgtgtcaaccag

SEQ ID NO: 265863 - DNA, 32 bp, Artificial Sequence
  Description of Artificial Sequence: Synthetic oligonucleotide
gctgcgggagtttaacaaactgtgtcaaccag

SEQ ID NO: 265864 - DNA, 32 bp, Artificial Sequence
  Description of Artificial Sequence: Synthetic oligonucleotide
ctgcgggagtttaacaaactgtgtcaaccagg

SEQ ID NO: 265865 - DNA, 34 bp, Artificial Sequence
  Description of Artificial Sequence: Synthetic oligonucleotide
tgcgggagtttaacaaactgtgtcaaccaggttc

SEQ ID NO: 265866 - DNA, 33 bp, Artificial Sequence
  Description of Artificial Sequence: Synthetic oligonucleotide
gcgggagtttaacaaactgtgtcaaccaggttc

SEQ ID NO: 265867 - DNA, 33 bp, Artificial Sequence
  Description of Artificial Sequence: Synthetic oligonucleotide
cgggagtttaacaaactgtgtcaaccaggttcc

SEQ ID NO: 265868 - DNA, 35 bp, Artificial Sequence
  Description of Artificial Sequence: Synthetic oligonucleotide
gggagtttaacaaactgtgtcaaccaggttccttg

SEQ ID NO: 265869 - DNA, 43 bp, Artificial Sequence
  Description of Artificial Sequence: Synthetic oligonucleotide
ggagtttaacaaactgtgtcaaccaggttccttgaataaaaag

SEQ ID NO: 265870 - DNA, 44 bp, Artificial Sequence
  Description of Artificial Sequence: Synthetic oligonucleotide
gagtttaacaaactgtgtcaaccaggttccttgaataaaaagtg

SEQ ID NO: 265871 - DNA, 46 bp, Artificial Sequence
  Description of Artificial Sequence: Synthetic oligonucleotide
agtttaacaaactgtgtcaaccaggttccttgaataaaaagtgatg

SEQ ID NO: 265872 - DNA, 45 bp, Artificial Sequence
  Description of Artificial Sequence: Synthetic oligonucleotide
gtttaacaaactgtgtcaaccaggttccttgaataaaaagtgatg

SEQ ID NO: 265873 - DNA, 47 bp, Artificial Sequence
  Description of Artificial Sequence: Synthetic oligonucleotide
tttaacaaactgtgtcaaccaggttccttgaataaaaagtgatgaag

SEQ ID NO: 265874 - DNA, 46 bp, Artificial Sequence
  Description of Artificial Sequence: Synthetic oligonucleotide
ttaacaaactgtgtcaaccaggttccttgaataaaaagtgatgaag

SEQ ID NO: 265875 - DNA, 45 bp, Artificial Sequence
  Description of Artificial Sequence: Synthetic oligonucleotide
taacaaactgtgtcaaccaggttccttgaataaaaagtgatgaag

SEQ ID NO: 265876 - DNA, 44 bp, Artificial Sequence
  Description of Artificial Sequence: Synthetic oligonucleotide
aacaaactgtgtcaaccaggttccttgaataaaaagtgatgaag

SEQ ID NO: 265877 - DNA, 43 bp, Artificial Sequence
  Description of Artificial Sequence: Synthetic oligonucleotide
acaaactgtgtcaaccaggttccttgaataaaaagtgatgaag

SEQ ID NO: 265878 - DNA, 42 bp, Artificial Sequence
  Description of Artificial Sequence: Synthetic oligonucleotide
caaactgtgtcaaccaggttccttgaataaaaagtgatgaag

SEQ ID NO: 265879 - DNA, 48 bp, Artificial Sequence
  Description of Artificial Sequence: Synthetic oligonucleotide
aaactgtgtcaaccaggttccttgaataaaaagtgatgaagaaattag

SEQ ID NO: 265880 - DNA, 47 bp, Artificial Sequence
  Description of Artificial Sequence: Synthetic oligonucleotide
aactgtgtcaaccaggttccttgaataaaaagtgatgaagaaattag

SEQ ID NO: 265881 - DNA, 46 bp, Artificial Sequence
  Description of Artificial Sequence: Synthetic oligonucleotide
actgtgtcaaccaggttccttgaataaaaagtgatgaagaaattag

SEQ ID NO: 265882 - DNA, 45 bp, Artificial Sequence
  Description of Artificial Sequence: Synthetic oligonucleotide
ctgtgtcaaccaggttccttgaataaaaagtgatgaagaaattag

SEQ ID NO: 265883 - DNA, 48 bp, Artificial Sequence
  Description of Artificial Sequence: Synthetic oligonucleotide
tgtgtcaaccaggttccttgaataaaaagtgatgaagaaattagattg

SEQ ID NO: 265884 - DNA, 47 bp, Artificial Sequence
  Description of Artificial Sequence: Synthetic oligonucleotide
gtgtcaaccaggttccttgaataaaaagtgatgaagaaattagattg

SEQ ID NO: 265885 - DNA, 47 bp, Artificial Sequence
  Description of Artificial Sequence: Synthetic oligonucleotide
tgtcaaccaggttccttgaataaaaagtgatgaagaaattagattgg

SEQ ID NO: 265886 - DNA, 46 bp, Artificial Sequence
  Description of Artificial Sequence: Synthetic oligonucleotide
gtcaaccaggttccttgaataaaaagtgatgaagaaattagattgg

SEQ ID NO: 265887 - DNA, 47 bp, Artificial Sequence
  Description of Artificial Sequence: Synthetic oligonucleotide
tcaaccaggttccttgaataaaaagtgatgaagaaattagattggac

SEQ ID NO: 265888 - DNA, 46 bp, Artificial Sequence
  Description of Artificial Sequence: Synthetic oligonucleotide
caaccaggttccttgaataaaaagtgatgaagaaattagattggac

SEQ ID NO: 265889 - DNA, 50 bp, Artificial Sequence
  Description of Artificial Sequence: Synthetic oligonucleotide
aaccaggttccttgaataaaaagtgatgaagaaattagattggacaattg

SEQ ID NO: 265890 - DNA, 49 bp, Artificial Sequence
  Description of Artificial Sequence: Synthetic oligonucleotide
accaggttccttgaataaaaagtgatgaagaaattagattggacaattg

SEQ ID NO: 265891 - DNA, 48 bp, Artificial Sequence
  Description of Artificial Sequence: Synthetic oligonucleotide
ccaggttccttgaataaaaagtgatgaagaaattagattggacaattg

SEQ ID NO: 265892 - DNA, 50 bp, Artificial Sequence
  Description of Artificial Sequence: Synthetic oligonucleotide
caggttccttgaataaaaagtgatgaagaaattagattggacaattgaac

SEQ ID NO: 265893 - DNA, 51 bp, Artificial Sequence
  Description of Artificial Sequence: Synthetic oligonucleotide
aggttccttgaataaaaagtgatgaagaaattagattggacaattgaacag

SEQ ID NO: 265894 - DNA, 50 bp, Artificial Sequence
  Description of Artificial Sequence: Synthetic oligonucleotide
ggttccttgaataaaaagtgatgaagaaattagattggacaattgaacag

SEQ ID NO: 265895 - DNA, 51 bp, Artificial Sequence
  Description of Artificial Sequence: Synthetic oligonucleotide
gttccttgaataaaaagtgatgaagaaattagattggacaattgaacagag

SEQ ID NO: 265896 - DNA, 52 bp, Artificial Sequence
  Description of Artificial Sequence: Synthetic oligonucleotide
ttccttgaataaaaagtgatgaagaaattagattggacaattgaacagagag

SEQ ID NO: 265897 - DNA, 51 bp, Artificial Sequence
  Description of Artificial Sequence: Synthetic oligonucleotide
tccttgaataaaaagtgatgaagaaattagattggacaattgaacagagag

SEQ ID NO: 265898 - DNA, 50 bp, Artificial Sequence
  Description of Artificial Sequence: Synthetic oligonucleotide
ccttgaataaaaagtgatgaagaaattagattggacaattgaacagagag

SEQ ID NO: 265899 - DNA, 51 bp, Artificial Sequence
  Description of Artificial Sequence: Synthetic oligonucleotide
cttgaataaaaagtgatgaagaaattagattggacaattgaacagagagtg

SEQ ID NO: 265900 - DNA, 51 bp, Artificial Sequence
  Description of Artificial Sequence: Synthetic oligonucleotide
ttgaataaaaagtgatgaagaaattagattggacaattgaacagagagtgg

SEQ ID NO: 265901 - DNA, 50 bp, Artificial Sequence
  Description of Artificial Sequence: Synthetic oligonucleotide
tgaataaaaagtgatgaagaaattagattggacaattgaacagagagtgg

SEQ ID NO: 265902 - DNA, 49 bp, Artificial Sequence
  Description of Artificial Sequence: Synthetic oligonucleotide
gaataaaaagtgatgaagaaattagattggacaattgaacagagagtgg

SEQ ID NO: 265903 - DNA, 52 bp, Artificial Sequence
  Description of Artificial Sequence: Synthetic oligonucleotide
aataaaaagtgatgaagaaattagattggacaattgaacagagagtggaaac

SEQ ID NO: 265904 - DNA, 51 bp, Artificial Sequence
  Description of Artificial Sequence: Synthetic oligonucleotide
ataaaaagtgatgaagaaattagattggacaattgaacagagagtggaaac

SEQ ID NO: 265905 - DNA, 50 bp, Artificial Sequence
  Description of Artificial Sequence: Synthetic oligonucleotide
taaaaagtgatgaagaaattagattggacaattgaacagagagtggaaac

SEQ ID NO: 265906 - DNA, 49 bp, Artificial Sequence
  Description of Artificial Sequence: Synthetic oligonucleotide
aaaaagtgatgaagaaattagattggacaattgaacagagagtggaaac

SEQ ID NO: 265907 - DNA, 48 bp, Artificial Sequence
  Description of Artificial Sequence: Synthetic oligonucleotide
aaaagtgatgaagaaattagattggacaattgaacagagagtggaaac

SEQ ID NO: 265908 - DNA, 47 bp, Artificial Sequence
  Description of Artificial Sequence: Synthetic oligonucleotide
aaagtgatgaagaaattagattggacaattgaacagagagtggaaac

SEQ ID NO: 265909 - DNA, 46 bp, Artificial Sequence
  Description of Artificial Sequence: Synthetic oligonucleotide
aagtgatgaagaaattagattggacaattgaacagagagtggaaac

SEQ ID NO: 265910 - DNA, 45 bp, Artificial Sequence
  Description of Artificial Sequence: Synthetic oligonucleotide
agtgatgaagaaattagattggacaattgaacagagagtggaaac

SEQ ID NO: 265911 - DNA, 44 bp, Artificial Sequence
  Description of Artificial Sequence: Synthetic oligonucleotide
gtgatgaagaaattagattggacaattgaacagagagtggaaac

SEQ ID NO: 265912 - DNA, 45 bp, Artificial Sequence
  Description of Artificial Sequence: Synthetic oligonucleotide
tgatgaagaaattagattggacaattgaacagagagtggaaacag

SEQ ID NO: 265913 - DNA, 44 bp, Artificial Sequence
  Description of Artificial Sequence: Synthetic oligonucleotide
gatgaagaaattagattggacaattgaacagagagtggaaacag

SEQ ID NO: 265914 - DNA, 44 bp, Artificial Sequence
  Description of Artificial Sequence: Synthetic oligonucleotide
atgaagaaattagattggacaattgaacagagagtggaaacagc

SEQ ID NO: 265915 - DNA, 43 bp, Artificial Sequence
  Description of Artificial Sequence: Synthetic oligonucleotide
tgaagaaattagattggacaattgaacagagagtggaaacagc

SEQ ID NO: 265916 - DNA, 42 bp, Artificial Sequence
  Description of Artificial Sequence: Synthetic oligonucleotide
gaagaaattagattggacaattgaacagagagtggaaacagc

SEQ ID NO: 265917 - DNA, 47 bp, Artificial Sequence
  Description of Artificial Sequence: Synthetic oligonucleotide
aagaaattagattggacaattgaacagagagtggaaacagcaattac

SEQ ID NO: 265918 - DNA, 46 bp, Artificial Sequence
  Description of Artificial Sequence: Synthetic oligonucleotide
agaaattagattggacaattgaacagagagtggaaacagcaattac

SEQ ID NO: 265919 - DNA, 45 bp, Artificial Sequence
  Description of Artificial Sequence: Synthetic oligonucleotide
gaaattagattggacaattgaacagagagtggaaacagcaattac

SEQ ID NO: 265920 - DNA, 47 bp, Artificial Sequence
  Description of Artificial Sequence: Synthetic oligonucleotide
aaattagattggacaattgaacagagagtggaaacagcaattacaag

SEQ ID NO: 265921 - DNA, 46 bp, Artificial Sequence
  Description of Artificial Sequence: Synthetic oligonucleotide
aattagattggacaattgaacagagagtggaaacagcaattacaag

SEQ ID NO: 265922 - DNA, 45 bp, Artificial Sequence
  Description of Artificial Sequence: Synthetic oligonucleotide
attagattggacaattgaacagagagtggaaacagcaattacaag

SEQ ID NO: 265923 - DNA, 44 bp, Artificial Sequence
  Description of Artificial Sequence: Synthetic oligonucleotide
ttagattggacaattgaacagagagtggaaacagcaattacaag

SEQ ID NO: 265924 - DNA, 43 bp, Artificial Sequence
  Description of Artificial Sequence: Synthetic oligonucleotide
tagattggacaattgaacagagagtggaaacagcaattacaag

SEQ ID NO: 265925 - DNA, 42 bp, Artificial Sequence
  Description of Artificial Sequence: Synthetic oligonucleotide
agattggacaattgaacagagagtggaaacagcaattacaag

SEQ ID NO: 265926 - DNA, 41 bp, Artificial Sequence
  Description of Artificial Sequence: Synthetic oligonucleotide
gattggacaattgaacagagagtggaaacagcaattacaag

SEQ ID NO: 265927 - DNA, 41 bp, Artificial Sequence
  Description of Artificial Sequence: Synthetic oligonucleotide
attggacaattgaacagagagtggaaacagcaattacaagc

SEQ ID NO: 265928 - DNA, 40 bp, Artificial Sequence
  Description of Artificial Sequence: Synthetic oligonucleotide
ttggacaattgaacagagagtggaaacagcaattacaagc

SEQ ID NO: 265929 - DNA, 39 bp, Artificial Sequence
  Description of Artificial Sequence: Synthetic oligonucleotide
tggacaattgaacagagagtggaaacagcaattacaagc

SEQ ID NO: 265930 - DNA, 38 bp, Artificial Sequence
  Description of Artificial Sequence: Synthetic oligonucleotide
ggacaattgaacagagagtggaaacagcaattacaagc

SEQ ID NO: 265931 - DNA, 38 bp, Artificial Sequence
  Description of Artificial Sequence: Synthetic oligonucleotide
gacaattgaacagagagtggaaacagcaattacaagcc

SEQ ID NO: 265932 - DNA, 39 bp, Artificial Sequence
  Description of Artificial Sequence: Synthetic oligonucleotide
acaattgaacagagagtggaaacagcaattacaagcctg

SEQ ID NO: 265933 - DNA, 38 bp, Artificial Sequence
  Description of Artificial Sequence: Synthetic oligonucleotide
caattgaacagagagtggaaacagcaattacaagcctg

SEQ ID NO: 265934 - DNA, 39 bp, Artificial Sequence
  Description of Artificial Sequence: Synthetic oligonucleotide
aattgaacagagagtggaaacagcaattacaagcctgtc

SEQ ID NO: 265935 - DNA, 38 bp, Artificial Sequence
  Description of Artificial Sequence: Synthetic oligonucleotide
attgaacagagagtggaaacagcaattacaagcctgtc

SEQ ID NO: 265936 - DNA, 37 bp, Artificial Sequence
  Description of Artificial Sequence: Synthetic oligonucleotide
ttgaacagagagtggaaacagcaattacaagcctgtc

SEQ ID NO: 265937 - DNA, 36 bp, Artificial Sequence
  Description of Artificial Sequence: Synthetic oligonucleotide
tgaacagagagtggaaacagcaattacaagcctgtc

SEQ ID NO: 265938 - DNA, 35 bp, Artificial Sequence
  Description of Artificial Sequence: Synthetic oligonucleotide
gaacagagagtggaaacagcaattacaagcctgtc

SEQ ID NO: 265939 - DNA, 37 bp, Artificial Sequence
  Description of Artificial Sequence: Synthetic oligonucleotide
aacagagagtggaaacagcaattacaagcctgtctag

SEQ ID NO: 265940 - DNA, 36 bp, Artificial Sequence
  Description of Artificial Sequence: Synthetic oligonucleotide
acagagagtggaaacagcaattacaagcctgtctag

SEQ ID NO: 265941 - DNA, 35 bp, Artificial Sequence
  Description of Artificial Sequence: Synthetic oligonucleotide
cagagagtggaaacagcaattacaagcctgtctag

SEQ ID NO: 265942 - DNA, 36 bp, Artificial Sequence
  Description of Artificial Sequence: Synthetic oligonucleotide
agagagtggaaacagcaattacaagcctgtctagtg

SEQ ID NO: 265943 - DNA, 35 bp, Artificial Sequence
  Description of Artificial Sequence: Synthetic oligonucleotide
gagagtggaaacagcaattacaagcctgtctagtg

SEQ ID NO: 265944 - DNA, 37 bp, Artificial Sequence
  Description of Artificial Sequence: Synthetic oligonucleotide
agagtggaaacagcaattacaagcctgtctagtgttc

SEQ ID NO: 265945 - DNA, 36 bp, Artificial Sequence
  Description of Artificial Sequence: Synthetic oligonucleotide
gagtggaaacagcaattacaagcctgtctagtgttc

SEQ ID NO: 265946 - DNA, 39 bp, Artificial Sequence
  Description of Artificial Sequence: Synthetic oligonucleotide
agtggaaacagcaattacaagcctgtctagtgttctatc

SEQ ID NO: 265947 - DNA, 38 bp, Artificial Sequence
  Description of Artificial Sequence: Synthetic oligonucleotide
gtggaaacagcaattacaagcctgtctagtgttctatc

SEQ ID NO: 265948 - DNA, 42 bp, Artificial Sequence
  Description of Artificial Sequence: Synthetic oligonucleotide
tggaaacagcaattacaagcctgtctagtgttctatctattg

SEQ ID NO: 265949 - DNA, 41 bp, Artificial Sequence
  Description of Artificial Sequence: Synthetic oligonucleotide
ggaaacagcaattacaagcctgtctagtgttctatctattg

SEQ ID NO: 265950 - DNA, 45 bp, Artificial Sequence
  Description of Artificial Sequence: Synthetic oligonucleotide
gaaacagcaattacaagcctgtctagtgttctatctattgatttc

SEQ ID NO: 265951 - DNA, 48 bp, Artificial Sequence
  Description of Artificial Sequence: Synthetic oligonucleotide
aaacagcaattacaagcctgtctagtgttctatctattgatttctaac

SEQ ID NO: 265952 - DNA, 47 bp, Artificial Sequence
  Description of Artificial Sequence: Synthetic oligonucleotide
aacagcaattacaagcctgtctagtgttctatctattgatttctaac

SEQ ID NO: 265953 - DNA, 46 bp, Artificial Sequence
  Description of Artificial Sequence: Synthetic oligonucleotide
acagcaattacaagcctgtctagtgttctatctattgatttctaac

SEQ ID NO: 265954 - DNA, 45 bp, Artificial Sequence
  Description of Artificial Sequence: Synthetic oligonucleotide
cagcaattacaagcctgtctagtgttctatctattgatttctaac

SEQ ID NO: 265955 - DNA, 45 bp, Artificial Sequence
  Description of Artificial Sequence: Synthetic oligonucleotide
agcaattacaagcctgtctagtgttctatctattgatttctaacc

SEQ ID NO: 265956 - DNA, 44 bp, Artificial Sequence
  Description of Artificial Sequence: Synthetic oligonucleotide
gcaattacaagcctgtctagtgttctatctattgatttctaacc

SEQ ID NO: 265957 - DNA, 46 bp, Artificial Sequence
  Description of Artificial Sequence: Synthetic oligonucleotide
caattacaagcctgtctagtgttctatctattgatttctaaccttc

SEQ ID NO: 265958 - DNA, 47 bp, Artificial Sequence
  Description of Artificial Sequence: Synthetic oligonucleotide
aattacaagcctgtctagtgttctatctattgatttctaaccttcag

SEQ ID NO: 265959 - DNA, 46 bp, Artificial Sequence
  Description of Artificial Sequence: Synthetic oligonucleotide
attacaagcctgtctagtgttctatctattgatttctaaccttcag

SEQ ID NO: 265960 - DNA, 45 bp, Artificial Sequence
  Description of Artificial Sequence: Synthetic oligonucleotide
ttacaagcctgtctagtgttctatctattgatttctaaccttcag

SEQ ID NO: 265961 - DNA, 44 bp, Artificial Sequence
  Description of Artificial Sequence: Synthetic oligonucleotide
tacaagcctgtctagtgttctatctattgatttctaaccttcag

SEQ ID NO: 265962 - DNA, 43 bp, Artificial Sequence
  Description of Artificial Sequence: Synthetic oligonucleotide
acaagcctgtctagtgttctatctattgatttctaaccttcag

SEQ ID NO: 265963 - DNA, 42 bp, Artificial Sequence
  Description of Artificial Sequence: Synthetic oligonucleotide
caagcctgtctagtgttctatctattgatttctaaccttcag

SEQ ID NO: 265964 - DNA, 47 bp, Artificial Sequence
  Description of Artificial Sequence: Synthetic oligonucleotide
aagcctgtctagtgttctatctattgatttctaaccttcagtaatag

SEQ ID NO: 265965 - DNA, 46 bp, Artificial Sequence
  Description of Artificial Sequence: Synthetic oligonucleotide
agcctgtctagtgttctatctattgatttctaaccttcagtaatag

SEQ ID NO: 265966 - DNA, 45 bp, Artificial Sequence
  Description of Artificial Sequence: Synthetic oligonucleotide
gcctgtctagtgttctatctattgatttctaaccttcagtaatag

SEQ ID NO: 265967 - DNA, 47 bp, Artificial Sequence
  Description of Artificial Sequence: Synthetic oligonucleotide
cctgtctagtgttctatctattgatttctaaccttcagtaatagaag

SEQ ID NO: 265968 - DNA, 49 bp, Artificial Sequence
  Description of Artificial Sequence: Synthetic oligonucleotide
ctgtctagtgttctatctattgatttctaaccttcagtaatagaagtag

SEQ ID NO: 265969 - DNA, 49 bp, Artificial Sequence
  Description of Artificial Sequence: Synthetic oligonucleotide
tgtctagtgttctatctattgatttctaaccttcagtaatagaagtagg

SEQ ID NO: 265970 - DNA, 48 bp, Artificial Sequence
  Description of Artificial Sequence: Synthetic oligonucleotide
gtctagtgttctatctattgatttctaaccttcagtaatagaagtagg

SEQ ID NO: 265971 - DNA, 49 bp, Artificial Sequence
  Description of Artificial Sequence: Synthetic oligonucleotide
tctagtgttctatctattgatttctaaccttcagtaatagaagtaggag

SEQ ID NO: 265972 - DNA, 48 bp, Artificial Sequence
  Description of Artificial Sequence: Synthetic oligonucleotide
ctagtgttctatctattgatttctaaccttcagtaatagaagtaggag

SEQ ID NO: 265973 - DNA, 50 bp, Artificial Sequence
  Description of Artificial Sequence: Synthetic oligonucleotide
tagtgttctatctattgatttctaaccttcagtaatagaagtaggagtag

SEQ ID NO: 265974 - DNA, 49 bp, Artificial Sequence
  Description of Artificial Sequence: Synthetic oligonucleotide
agtgttctatctattgatttctaaccttcagtaatagaagtaggagtag

SEQ ID NO: 265975 - DNA, 48 bp, Artificial Sequence
  Description of Artificial Sequence: Synthetic oligonucleotide
gtgttctatctattgatttctaaccttcagtaatagaagtaggagtag

SEQ ID NO: 265976 - DNA, 49 bp, Artificial Sequence
  Description of Artificial Sequence: Synthetic oligonucleotide
tgttctatctattgatttctaaccttcagtaatagaagtaggagtagtg

SEQ ID NO: 265977 - DNA, 48 bp, Artificial Sequence
  Description of Artificial Sequence: Synthetic oligonucleotide
gttctatctattgatttctaaccttcagtaatagaagtaggagtagtg

SEQ ID NO: 265978 - DNA, 49 bp, Artificial Sequence
  Description of Artificial Sequence: Synthetic oligonucleotide
ttctatctattgatttctaaccttcagtaatagaagtaggagtagtgtc

SEQ ID NO: 265979 - DNA, 48 bp, Artificial Sequence
  Description of Artificial Sequence: Synthetic oligonucleotide
tctatctattgatttctaaccttcagtaatagaagtaggagtagtgtc

SEQ ID NO: 265980 - DNA, 47 bp, Artificial Sequence
  Description of Artificial Sequence: Synthetic oligonucleotide
ctatctattgatttctaaccttcagtaatagaagtaggagtagtgtc

SEQ ID NO: 265981 - DNA, 48 bp, Artificial Sequence
  Description of Artificial Sequence: Synthetic oligonucleotide
tatctattgatttctaaccttcagtaatagaagtaggagtagtgtcag

SEQ ID NO: 265982 - DNA, 47 bp, Artificial Sequence
  Description of Artificial Sequence: Synthetic oligonucleotide
atctattgatttctaaccttcagtaatagaagtaggagtagtgtcag

SEQ ID NO: 265983 - DNA, 46 bp, Artificial Sequence
  Description of Artificial Sequence: Synthetic oligonucleotide
tctattgatttctaaccttcagtaatagaagtaggagtagtgtcag

SEQ ID NO: 265984 - DNA, 45 bp, Artificial Sequence
  Description of Artificial Sequence: Synthetic oligonucleotide
ctattgatttctaaccttcagtaatagaagtaggagtagtgtcag

SEQ ID NO: 265985 - DNA, 47 bp, Artificial Sequence
  Description of Artificial Sequence: Synthetic oligonucleotide
tattgatttctaaccttcagtaatagaagtaggagtagtgtcagttg

SEQ ID NO: 265986 - DNA, 46 bp, Artificial Sequence
  Description of Artificial Sequence: Synthetic oligonucleotide
attgatttctaaccttcagtaatagaagtaggagtagtgtcagttg

SEQ ID NO: 265987 - DNA, 45 bp, Artificial Sequence
  Description of Artificial Sequence: Synthetic oligonucleotide
ttgatttctaaccttcagtaatagaagtaggagtagtgtcagttg

SEQ ID NO: 265988 - DNA, 44 bp, Artificial Sequence
  Description of Artificial Sequence: Synthetic oligonucleotide
tgatttctaaccttcagtaatagaagtaggagtagtgtcagttg

SEQ ID NO: 265989 - DNA, 43 bp, Artificial Sequence
  Description of Artificial Sequence: Synthetic oligonucleotide
gatttctaaccttcagtaatagaagtaggagtagtgtcagttg

SEQ ID NO: 265990 - DNA, 48 bp, Artificial Sequence
  Description of Artificial Sequence: Synthetic oligonucleotide
atttctaaccttcagtaatagaagtaggagtagtgtcagttgaaattc

SEQ ID NO: 265991 - DNA, 47 bp, Artificial Sequence
  Description of Artificial Sequence: Synthetic oligonucleotide
tttctaaccttcagtaatagaagtaggagtagtgtcagttgaaattc

SEQ ID NO: 265992 - DNA, 46 bp, Artificial Sequence
  Description of Artificial Sequence: Synthetic oligonucleotide
ttctaaccttcagtaatagaagtaggagtagtgtcagttgaaattc

SEQ ID NO: 265993 - DNA, 45 bp, Artificial Sequence
  Description of Artificial Sequence: Synthetic oligonucleotide
tctaaccttcagtaatagaagtaggagtagtgtcagttgaaattc

SEQ ID NO: 265994 - DNA, 44 bp, Artificial Sequence
  Description of Artificial Sequence: Synthetic oligonucleotide
ctaaccttcagtaatagaagtaggagtagtgtcagttgaaattc

SEQ ID NO: 265995 - DNA, 44 bp, Artificial Sequence
  Description of Artificial Sequence: Synthetic oligonucleotide
taaccttcagtaatagaagtaggagtagtgtcagttgaaattcc

SEQ ID NO: 265996 - DNA, 43 bp, Artificial Sequence
  Description of Artificial Sequence: Synthetic oligonucleotide
aaccttcagtaatagaagtaggagtagtgtcagttgaaattcc

SEQ ID NO: 265997 - DNA, 42 bp, Artificial Sequence
  Description of Artificial Sequence: Synthetic oligonucleotide
accttcagtaatagaagtaggagtagtgtcagttgaaattcc

SEQ ID NO: 265998 - DNA, 41 bp, Artificial Sequence
  Description of Artificial Sequence: Synthetic oligonucleotide
ccttcagtaatagaagtaggagtagtgtcagttgaaattcc

SEQ ID NO: 265999 - DNA, 47 bp, Artificial Sequence
  Description of Artificial Sequence: Synthetic oligonucleotide
cttcagtaatagaagtaggagtagtgtcagttgaaattcctaaattg

SEQ ID NO: 266000 - DNA, 48 bp, Artificial Sequence
  Description of Artificial Sequence: Synthetic oligonucleotide
ttcagtaatagaagtaggagtagtgtcagttgaaattcctaaattgag

SEQ ID NO: 266001 - DNA, 47 bp, Artificial Sequence
  Description of Artificial Sequence: Synthetic oligonucleotide
tcagtaatagaagtaggagtagtgtcagttgaaattcctaaattgag

SEQ ID NO: 266002 - DNA, 46 bp, Artificial Sequence
  Description of Artificial Sequence: Synthetic oligonucleotide
cagtaatagaagtaggagtagtgtcagttgaaattcctaaattgag

SEQ ID NO: 266003 - DNA, 46 bp, Artificial Sequence
  Description of Artificial Sequence: Synthetic oligonucleotide
agtaatagaagtaggagtagtgtcagttgaaattcctaaattgagg

SEQ ID NO: 266004 - DNA, 45 bp, Artificial Sequence
  Description of Artificial Sequence: Synthetic oligonucleotide
gtaatagaagtaggagtagtgtcagttgaaattcctaaattgagg

SEQ ID NO: 266005 - DNA, 48 bp, Artificial Sequence
  Description of Artificial Sequence: Synthetic oligonucleotide
taatagaagtaggagtagtgtcagttgaaattcctaaattgaggattc

SEQ ID NO: 266006 - DNA, 47 bp, Artificial Sequence
  Description of Artificial Sequence: Synthetic oligonucleotide
aatagaagtaggagtagtgtcagttgaaattcctaaattgaggattc

SEQ ID NO: 266007 - DNA, 46 bp, Artificial Sequence
  Description of Artificial Sequence: Synthetic oligonucleotide
atagaagtaggagtagtgtcagttgaaattcctaaattgaggattc

SEQ ID NO: 266008 - DNA, 45 bp, Artificial Sequence
  Description of Artificial Sequence: Synthetic oligonucleotide
tagaagtaggagtagtgtcagttgaaattcctaaattgaggattc

SEQ ID NO: 266009 - DNA, 44 bp, Artificial Sequence
  Description of Artificial Sequence: Synthetic oligonucleotide
agaagtaggagtagtgtcagttgaaattcctaaattgaggattc

SEQ ID NO: 266010 - DNA, 43 bp, Artificial Sequence
  Description of Artificial Sequence: Synthetic oligonucleotide
gaagtaggagtagtgtcagttgaaattcctaaattgaggattc

SEQ ID NO: 266011 - DNA, 46 bp, Artificial Sequence
  Description of Artificial Sequence: Synthetic oligonucleotide
aagtaggagtagtgtcagttgaaattcctaaattgaggattctttc

SEQ ID NO: 266012 - DNA, 45 bp, Artificial Sequence
  Description of Artificial Sequence: Synthetic oligonucleotide
agtaggagtagtgtcagttgaaattcctaaattgaggattctttc

SEQ ID NO: 266013 - DNA, 44 bp, Artificial Sequence
  Description of Artificial Sequence: Synthetic oligonucleotide
gtaggagtagtgtcagttgaaattcctaaattgaggattctttc

SEQ ID NO: 266014 - DNA, 45 bp, Artificial Sequence
  Description of Artificial Sequence: Synthetic oligonucleotide
taggagtagtgtcagttgaaattcctaaattgaggattctttcag

SEQ ID NO: 266015 - DNA, 44 bp, Artificial Sequence
  Description of Artificial Sequence: Synthetic oligonucleotide
aggagtagtgtcagttgaaattcctaaattgaggattctttcag

SEQ ID NO: 266016 - DNA, 43 bp, Artificial Sequence
  Description of Artificial Sequence: Synthetic oligonucleotide
ggagtagtgtcagttgaaattcctaaattgaggattctttcag

SEQ ID NO: 266017 - DNA, 45 bp, Artificial Sequence
  Description of Artificial Sequence: Synthetic oligonucleotide
gagtagtgtcagttgaaattcctaaattgaggattctttcagaag

SEQ ID NO: 266018 - DNA, 45 bp, Artificial Sequence
  Description of Artificial Sequence: Synthetic oligonucleotide
agtagtgtcagttgaaattcctaaattgaggattctttcagaagc

SEQ ID NO: 266019 - DNA, 44 bp, Artificial Sequence
  Description of Artificial Sequence: Synthetic oligonucleotide
gtagtgtcagttgaaattcctaaattgaggattctttcagaagc

SEQ ID NO: 266020 - DNA, 45 bp, Artificial Sequence
  Description of Artificial Sequence: Synthetic oligonucleotide
tagtgtcagttgaaattcctaaattgaggattctttcagaagcag

SEQ ID NO: 266021 - DNA, 44 bp, Artificial Sequence
  Description of Artificial Sequence: Synthetic oligonucleotide
agtgtcagttgaaattcctaaattgaggattctttcagaagcag

SEQ ID NO: 266022 - DNA, 43 bp, Artificial Sequence
  Description of Artificial Sequence: Synthetic oligonucleotide
gtgtcagttgaaattcctaaattgaggattctttcagaagcag

SEQ ID NO: 266023 - DNA, 44 bp, Artificial Sequence
  Description of Artificial Sequence: Synthetic oligonucleotide
tgtcagttgaaattcctaaattgaggattctttcagaagcagtg

SEQ ID NO: 266024 - DNA, 43 bp, Artificial Sequence
  Description of Artificial Sequence: Synthetic oligonucleotide
gtcagttgaaattcctaaattgaggattctttcagaagcagtg

SEQ ID NO: 266025 - DNA, 46 bp, Artificial Sequence
  Description of Artificial Sequence: Synthetic oligonucleotide
tcagttgaaattcctaaattgaggattctttcagaagcagtgattg

SEQ ID NO: 266026 - DNA, 45 bp, Artificial Sequence
  Description of Artificial Sequence: Synthetic oligonucleotide
cagttgaaattcctaaattgaggattctttcagaagcagtgattg

SEQ ID NO: 266027 - DNA, 47 bp, Artificial Sequence
  Description of Artificial Sequence: Synthetic oligonucleotide
agttgaaattcctaaattgaggattctttcagaagcagtgattgatg

SEQ ID NO: 266028 - DNA, 46 bp, Artificial Sequence
  Description of Artificial Sequence: Synthetic oligonucleotide
gttgaaattcctaaattgaggattctttcagaagcagtgattgatg

SEQ ID NO: 266029 - DNA, 46 bp, Artificial Sequence
  Description of Artificial Sequence: Synthetic oligonucleotide
ttgaaattcctaaattgaggattctttcagaagcagtgattgatgc

SEQ ID NO: 266030 - DNA, 45 bp, Artificial Sequence
  Description of Artificial Sequence: Synthetic oligonucleotide
tgaaattcctaaattgaggattctttcagaagcagtgattgatgc

SEQ ID NO: 266031 - DNA, 44 bp, Artificial Sequence
  Description of Artificial Sequence: Synthetic oligonucleotide
gaaattcctaaattgaggattctttcagaagcagtgattgatgc

SEQ ID NO: 266032 - DNA, 45 bp, Artificial Sequence
  Description of Artificial Sequence: Synthetic oligonucleotide
aaattcctaaattgaggattctttcagaagcagtgattgatgcac

SEQ ID NO: 266033 - DNA, 44 bp, Artificial Sequence
  Description of Artificial Sequence: Synthetic oligonucleotide
aattcctaaattgaggattctttcagaagcagtgattgatgcac

SEQ ID NO: 266034 - DNA, 43 bp, Artificial Sequence
  Description of Artificial Sequence: Synthetic oligonucleotide
attcctaaattgaggattctttcagaagcagtgattgatgcac

SEQ ID NO: 266035 - DNA, 42 bp, Artificial Sequence
  Description of Artificial Sequence: Synthetic oligonucleotide
ttcctaaattgaggattctttcagaagcagtgattgatgcac

SEQ ID NO: 266036 - DNA, 41 bp, Artificial Sequence
  Description of Artificial Sequence: Synthetic oligonucleotide
tcctaaattgaggattctttcagaagcagtgattgatgcac

SEQ ID NO: 266037 - DNA, 40 bp, Artificial Sequence
  Description of Artificial Sequence: Synthetic oligonucleotide
cctaaattgaggattctttcagaagcagtgattgatgcac

SEQ ID NO: 266038 - DNA, 41 bp, Artificial Sequence
  Description of Artificial Sequence: Synthetic oligonucleotide
ctaaattgaggattctttcagaagcagtgattgatgcacac

SEQ ID NO: 266039 - DNA, 41 bp, Artificial Sequence
  Description of Artificial Sequence: Synthetic oligonucleotide
taaattgaggattctttcagaagcagtgattgatgcacacc

SEQ ID NO: 266040 - DNA, 40 bp, Artificial Sequence
  Description of Artificial Sequence: Synthetic oligonucleotide
aaattgaggattctttcagaagcagtgattgatgcacacc

SEQ ID NO: 266041 - DNA, 39 bp, Artificial Sequence
  Description of Artificial Sequence: Synthetic oligonucleotide
aattgaggattctttcagaagcagtgattgatgcacacc

SEQ ID NO: 266042 - DNA, 38 bp, Artificial Sequence
  Description of Artificial Sequence: Synthetic oligonucleotide
attgaggattctttcagaagcagtgattgatgcacacc

SEQ ID NO: 266043 - DNA, 37 bp, Artificial Sequence
  Description of Artificial Sequence: Synthetic oligonucleotide
ttgaggattctttcagaagcagtgattgatgcacacc

SEQ ID NO: 266044 - DNA, 36 bp, Artificial Sequence
  Description of Artificial Sequence: Synthetic oligonucleotide
tgaggattctttcagaagcagtgattgatgcacacc

SEQ ID NO: 266045 - DNA, 35 bp, Artificial Sequence
  Description of Artificial Sequence: Synthetic oligonucleotide
gaggattctttcagaagcagtgattgatgcacacc

SEQ ID NO: 266046 - DNA, 37 bp, Artificial Sequence
  Description of Artificial Sequence: Synthetic oligonucleotide
aggattctttcagaagcagtgattgatgcacaccttg

SEQ ID NO: 266047 - DNA, 36 bp, Artificial Sequence
  Description of Artificial Sequence: Synthetic oligonucleotide
ggattctttcagaagcagtgattgatgcacaccttg

SEQ ID NO: 266048 - DNA, 38 bp, Artificial Sequence
  Description of Artificial Sequence: Synthetic oligonucleotide
gattctttcagaagcagtgattgatgcacaccttgttc

SEQ ID NO: 266049 - DNA, 38 bp, Artificial Sequence
  Description of Artificial Sequence: Synthetic oligonucleotide
attctttcagaagcagtgattgatgcacaccttgttcc

SEQ ID NO: 266050 - DNA, 37 bp, Artificial Sequence
  Description of Artificial Sequence: Synthetic oligonucleotide
ttctttcagaagcagtgattgatgcacaccttgttcc

SEQ ID NO: 266051 - DNA, 36 bp, Artificial Sequence
  Description of Artificial Sequence: Synthetic oligonucleotide
tctttcagaagcagtgattgatgcacaccttgttcc

SEQ ID NO: 266052 - DNA, 35 bp, Artificial Sequence
  Description of Artificial Sequence: Synthetic oligonucleotide
ctttcagaagcagtgattgatgcacaccttgttcc

SEQ ID NO: 266053 - DNA, 36 bp, Artificial Sequence
  Description of Artificial Sequence: Synthetic oligonucleotide
tttcagaagcagtgattgatgcacaccttgttcctc

SEQ ID NO: 266054 - DNA, 35 bp, Artificial Sequence
  Description of Artificial Sequence: Synthetic oligonucleotide
ttcagaagcagtgattgatgcacaccttgttcctc

SEQ ID NO: 266055 - DNA, 34 bp, Artificial Sequence
  Description of Artificial Sequence: Synthetic oligonucleotide
tcagaagcagtgattgatgcacaccttgttcctc

SEQ ID NO: 266056 - DNA, 33 bp, Artificial Sequence
  Description of Artificial Sequence: Synthetic oligonucleotide
cagaagcagtgattgatgcacaccttgttcctc

SEQ ID NO: 266057 - DNA, 35 bp, Artificial Sequence
  Description of Artificial Sequence: Synthetic oligonucleotide
agaagcagtgattgatgcacaccttgttcctctag

SEQ ID NO: 266058 - DNA, 34 bp, Artificial Sequence
  Description of Artificial Sequence: Synthetic oligonucleotide
gaagcagtgattgatgcacaccttgttcctctag

SEQ ID NO: 266059 - DNA, 34 bp, Artificial Sequence
  Description of Artificial Sequence: Synthetic oligonucleotide
aagcagtgattgatgcacaccttgttcctctagc

SEQ ID NO: 266060 - DNA, 33 bp, Artificial Sequence
  Description of Artificial Sequence: Synthetic oligonucleotide
agcagtgattgatgcacaccttgttcctctagc

SEQ ID NO: 266061 - DNA, 32 bp, Artificial Sequence
  Description of Artificial Sequence: Synthetic oligonucleotide
gcagtgattgatgcacaccttgttcctctagc

SEQ ID NO: 266062 - DNA, 33 bp, Artificial Sequence
  Description of Artificial Sequence: Synthetic oligonucleotide
cagtgattgatgcacaccttgttcctctagcag

SEQ ID NO: 266063 - DNA, 34 bp, Artificial Sequence
  Description of Artificial Sequence: Synthetic oligonucleotide
agtgattgatgcacaccttgttcctctagcagtg

SEQ ID NO: 266064 - DNA, 33 bp, Artificial Sequence
  Description of Artificial Sequence: Synthetic oligonucleotide
gtgattgatgcacaccttgttcctctagcagtg

SEQ ID NO: 266065 - DNA, 34 bp, Artificial Sequence
  Description of Artificial Sequence: Synthetic oligonucleotide
tgattgatgcacaccttgttcctctagcagtgag

SEQ ID NO: 266066 - DNA, 33 bp, Artificial Sequence
  Description of Artificial Sequence: Synthetic oligonucleotide
gattgatgcacaccttgttcctctagcagtgag

SEQ ID NO: 266067 - DNA, 34 bp, Artificial Sequence
  Description of Artificial Sequence: Synthetic oligonucleotide
attgatgcacaccttgttcctctagcagtgagag

SEQ ID NO: 266068 - DNA, 33 bp, Artificial Sequence
  Description of Artificial Sequence: Synthetic oligonucleotide
ttgatgcacaccttgttcctctagcagtgagag

SEQ ID NO: 266069 - DNA, 32 bp, Artificial Sequence
  Description of Artificial Sequence: Synthetic oligonucleotide
tgatgcacaccttgttcctctagcagtgagag

SEQ ID NO: 266070 - DNA, 31 bp, Artificial Sequence
  Description of Artificial Sequence: Synthetic oligonucleotide
gatgcacaccttgttcctctagcagtgagag

SEQ ID NO: 266071 - DNA, 32 bp, Artificial Sequence
  Description of Artificial Sequence: Synthetic oligonucleotide
atgcacaccttgttcctctagcagtgagagac

SEQ ID NO: 266072 - DNA, 31 bp, Artificial Sequence
  Description of Artificial Sequence: Synthetic oligonucleotide
tgcacaccttgttcctctagcagtgagagac

SEQ ID NO: 266073 - DNA, 30 bp, Artificial Sequence
  Description of Artificial Sequence: Synthetic oligonucleotide
gcacaccttgttcctctagcagtgagagac

SEQ ID NO: 266074 - DNA, 26 bp, Artificial Sequence
  Description of Artificial Sequence: Synthetic oligonucleotide
atgacctacgaccgggccatcaccct

SEQ ID NO: 266075 - DNA, 25 bp, Artificial Sequence
  Description of Artificial Sequence: Synthetic oligonucleotide
tgacctacgaccgggccatcaccct

SEQ ID NO: 266076 - DNA, 24 bp, Artificial Sequence
  Description of Artificial Sequence: Synthetic oligonucleotide
gacctacgaccgggccatcaccct

SEQ ID NO: 266077 - DNA, 26 bp, Artificial Sequence
  Description of Artificial Sequence: Synthetic oligonucleotide
acctacgaccgggccatcaccctctt

SEQ ID NO: 266078 - DNA, 25 bp, Artificial Sequence
  Description of Artificial Sequence: Synthetic oligonucleotide
cctacgaccgggccatcaccctctt

SEQ ID NO: 266079 - DNA, 26 bp, Artificial Sequence
  Description of Artificial Sequence: Synthetic oligonucleotide
ctacgaccgggccatcaccctcttct

SEQ ID NO: 266080 - DNA, 26 bp, Artificial Sequence
  Description of Artificial Sequence: Synthetic oligonucleotide
tacgaccgggccatcaccctcttctc

SEQ ID NO: 266081 - DNA, 25 bp, Artificial Sequence
  Description of Artificial Sequence: Synthetic oligonucleotide
acgaccgggccatcaccctcttctc

SEQ ID NO: 266082 - DNA, 24 bp, Artificial Sequence
  Description of Artificial Sequence: Synthetic oligonucleotide
cgaccgggccatcaccctcttctc

SEQ ID NO: 266083 - DNA, 24 bp, Artificial Sequence
  Description of Artificial Sequence: Synthetic oligonucleotide
gaccgggccatcaccctcttctcg

SEQ ID NO: 266084 - DNA, 24 bp, Artificial Sequence
  Description of Artificial Sequence: Synthetic oligonucleotide
accgggccatcaccctcttctcgc

SEQ ID NO: 266085 - DNA, 23 bp, Artificial Sequence
  Description of Artificial Sequence: Synthetic oligonucleotide
ccgggccatcaccctcttctcgc

SEQ ID NO: 266086 - DNA, 23 bp, Artificial Sequence
  Description of Artificial Sequence: Synthetic oligonucleotide
cgggccatcaccctcttctcgcg

SEQ ID NO: 266087 - DNA, 23 bp, Artificial Sequence
  Description of Artificial Sequence: Synthetic oligonucleotide
gggccatcaccctcttctcgcgc

SEQ ID NO: 266088 - DNA, 24 bp, Artificial Sequence
  Description of Artificial Sequence: Synthetic oligonucleotide
ggccatcaccctcttctcgcgcga

SEQ ID NO: 266089 - DNA, 24 bp, Artificial Sequence
  Description of Artificial Sequence: Synthetic oligonucleotide
gccatcaccctcttctcgcgcgac

SEQ ID NO: 266090 - DNA, 24 bp, Artificial Sequence
  Description of Artificial Sequence: Synthetic oligonucleotide
ccatcaccctcttctcgcgcgacg

SEQ ID NO: 266091 - DNA, 24 bp, Artificial Sequence
  Description of Artificial Sequence: Synthetic oligonucleotide
catcaccctcttctcgcgcgacgg

SEQ ID NO: 266092 - DNA, 24 bp, Artificial Sequence
  Description of Artificial Sequence: Synthetic oligonucleotide
atcaccctcttctcgcgcgacggc

SEQ ID NO: 266093 - DNA, 23 bp, Artificial Sequence
  Description of Artificial Sequence: Synthetic oligonucleotide
tcaccctcttctcgcgcgacggc

SEQ ID NO: 266094 - DNA, 22 bp, Artificial Sequence
  Description of Artificial Sequence: Synthetic oligonucleotide
caccctcttctcgcgcgacggc

SEQ ID NO: 266095 - DNA, 23 bp, Artificial Sequence
  Description of Artificial Sequence: Synthetic oligonucleotide
accctcttctcgcgcgacggcca

SEQ ID NO: 266096 - DNA, 22 bp, Artificial Sequence
  Description of Artificial Sequence: Synthetic oligonucleotide
ccctcttctcgcgcgacggcca

SEQ ID NO: 266097 - DNA, 22 bp, Artificial Sequence
  Description of Artificial Sequence: Synthetic oligonucleotide
cctcttctcgcgcgacggccag

SEQ ID NO: 266098 - DNA, 23 bp, Artificial Sequence
  Description of Artificial Sequence: Synthetic oligonucleotide
ctcttctcgcgcgacggccagct

SEQ ID NO: 266099 - DNA, 25 bp, Artificial Sequence
  Description of Artificial Sequence: Synthetic oligonucleotide
tcttctcgcgcgacggccagctctt

SEQ ID NO: 266100 - DNA, 24 bp, Artificial Sequence
  Description of Artificial Sequence: Synthetic oligonucleotide
cttctcgcgcgacggccagctctt

SEQ ID NO: 266101 - DNA, 24 bp, Artificial Sequence
  Description of Artificial Sequence: Synthetic oligonucleotide
ttctcgcgcgacggccagctcttc

SEQ ID NO: 266102 - DNA, 23 bp, Artificial Sequence
  Description of Artificial Sequence: Synthetic oligonucleotide
tctcgcgcgacggccagctcttc

SEQ ID NO: 266103 - DNA, 22 bp, Artificial Sequence
  Description of Artificial Sequence: Synthetic oligonucleotide
ctcgcgcgacggccagctcttc

SEQ ID NO: 266104 - DNA, 24 bp, Artificial Sequence
  Description of Artificial Sequence: Synthetic oligonucleotide
tcgcgcgacggccagctcttccaa

SEQ ID NO: 266105 - DNA, 23 bp, Artificial Sequence
  Description of Artificial Sequence: Synthetic oligonucleotide
cgcgcgacggccagctcttccaa

SEQ ID NO: 266106 - DNA, 24 bp, Artificial Sequence
  Description of Artificial Sequence: Synthetic oligonucleotide
gcgcgacggccagctcttccaact

SEQ ID NO: 266107 - DNA, 24 bp, Artificial Sequence
  Description of Artificial Sequence: Synthetic oligonucleotide
cgcgacggccagctcttccaactg

SEQ ID NO: 266108 - DNA, 25 bp, Artificial Sequence
  Description of Artificial Sequence: Synthetic oligonucleotide
gcgacggccagctcttccaactgga

SEQ ID NO: 266109 - DNA, 27 bp, Artificial Sequence
  Description of Artificial Sequence: Synthetic oligonucleotide
cgacggccagctcttccaactggagta

SEQ ID NO: 266110 - DNA, 27 bp, Artificial Sequence
  Description of Artificial Sequence: Synthetic oligonucleotide
gacggccagctcttccaactggagtac

SEQ ID NO: 266111 - DNA, 27 bp, Artificial Sequence
  Description of Artificial Sequence: Synthetic oligonucleotide
acggccagctcttccaactggagtacg

SEQ ID NO: 266112 - DNA, 26 bp, Artificial Sequence
  Description of Artificial Sequence: Synthetic oligonucleotide
cggccagctcttccaactggagtacg

SEQ ID NO: 266113 - DNA, 26 bp, Artificial Sequence
  Description of Artificial Sequence: Synthetic oligonucleotide
ggccagctcttccaactggagtacgg

SEQ ID NO: 266114 - DNA, 26 bp, Artificial Sequence
  Description of Artificial Sequence: Synthetic oligonucleotide
gccagctcttccaactggagtacggg

SEQ ID NO: 266115 - DNA, 27 bp, Artificial Sequence
  Description of Artificial Sequence: Synthetic oligonucleotide
ccagctcttccaactggagtacgggca

SEQ ID NO: 266116 - DNA, 27 bp, Artificial Sequence
  Description of Artificial Sequence: Synthetic oligonucleotide
cagctcttccaactggagtacgggcag

SEQ ID NO: 266117 - DNA, 27 bp, Artificial Sequence
  Description of Artificial Sequence: Synthetic oligonucleotide
agctcttccaactggagtacgggcagg

SEQ ID NO: 266118 - DNA, 27 bp, Artificial Sequence
  Description of Artificial Sequence: Synthetic oligonucleotide
gctcttccaactggagtacgggcagga

SEQ ID NO: 266119 - DNA, 27 bp, Artificial Sequence
  Description of Artificial Sequence: Synthetic oligonucleotide
ctcttccaactggagtacgggcaggag

SEQ ID NO: 266120 - DNA, 27 bp, Artificial Sequence
  Description of Artificial Sequence: Synthetic oligonucleotide
tcttccaactggagtacgggcaggagg

SEQ ID NO: 266121 - DNA, 26 bp, Artificial Sequence
  Description of Artificial Sequence: Synthetic oligonucleotide
cttccaactggagtacgggcaggagg

SEQ ID NO: 266122 - DNA, 26 bp, Artificial Sequence
  Description of Artificial Sequence: Synthetic oligonucleotide
ttccaactggagtacgggcaggaggc

SEQ ID NO: 266123 - DNA, 25 bp, Artificial Sequence
  Description of Artificial Sequence: Synthetic oligonucleotide
tccaactggagtacgggcaggaggc

SEQ ID NO: 266124 - DNA, 24 bp, Artificial Sequence
  Description of Artificial Sequence: Synthetic oligonucleotide
ccaactggagtacgggcaggaggc

SEQ ID NO: 266125 - DNA, 24 bp, Artificial Sequence
  Description of Artificial Sequence: Synthetic oligonucleotide
caactggagtacgggcaggaggcg

SEQ ID NO: 266126 - DNA, 25 bp, Artificial Sequence
  Description of Artificial Sequence: Synthetic oligonucleotide
aactggagtacgggcaggaggcggt

SEQ ID NO: 266127 - DNA, 24 bp, Artificial Sequence
  Description of Artificial Sequence: Synthetic oligonucleotide
actggagtacgggcaggaggcggt

SEQ ID NO: 266128 - DNA, 23 bp, Artificial Sequence
  Description of Artificial Sequence: Synthetic oligonucleotide
ctggagtacgggcaggaggcggt

SEQ ID NO: 266129 - DNA, 25 bp, Artificial Sequence
  Description of Artificial Sequence: Synthetic oligonucleotide
tggagtacgggcaggaggcggtcaa

SEQ ID NO: 266130 - DNA, 24 bp, Artificial Sequence
  Description of Artificial Sequence: Synthetic oligonucleotide
ggagtacgggcaggaggcggtcaa

SEQ ID NO: 266131 - DNA, 26 bp, Artificial Sequence
  Description of Artificial Sequence: Synthetic oligonucleotide
gagtacgggcaggaggcggtcaagaa

SEQ ID NO: 266132 - DNA, 26 bp, Artificial Sequence
  Description of Artificial Sequence: Synthetic oligonucleotide
agtacgggcaggaggcggtcaagaag

SEQ ID NO: 266133 - DNA, 25 bp, Artificial Sequence
  Description of Artificial Sequence: Synthetic oligonucleotide
gtacgggcaggaggcggtcaagaag

SEQ ID NO: 266134 - DNA, 25 bp, Artificial Sequence
  Description of Artificial Sequence: Synthetic oligonucleotide
tacgggcaggaggcggtcaagaagc

SEQ ID NO: 266135 - DNA, 24 bp, Artificial Sequence
  Description of Artificial Sequence: Synthetic oligonucleotide
acgggcaggaggcggtcaagaagc

SEQ ID NO: 266136 - DNA, 23 bp, Artificial Sequence
  Description of Artificial Sequence: Synthetic oligonucleotide
cgggcaggaggcggtcaagaagc

SEQ ID NO: 266137 - DNA, 23 bp, Artificial Sequence
  Description of Artificial Sequence: Synthetic oligonucleotide
gggcaggaggcggtcaagaagcg

SEQ ID NO: 266138 - DNA, 24 bp, Artificial Sequence
  Description of Artificial Sequence: Synthetic oligonucleotide
ggcaggaggcggtcaagaagcgct

SEQ ID NO: 266139 - DNA, 24 bp, Artificial Sequence
  Description of Artificial Sequence: Synthetic oligonucleotide
gcaggaggcggtcaagaagcgctc

SEQ ID NO: 266140 - DNA, 25 bp, Artificial Sequence
  Description of Artificial Sequence: Synthetic oligonucleotide
caggaggcggtcaagaagcgctcga

SEQ ID NO: 266141 - DNA, 25 bp, Artificial Sequence
  Description of Artificial Sequence: Synthetic oligonucleotide
aggaggcggtcaagaagcgctcgac

SEQ ID NO: 266142 - DNA, 24 bp, Artificial Sequence
  Description of Artificial Sequence: Synthetic oligonucleotide
ggaggcggtcaagaagcgctcgac

SEQ ID NO: 266143 - DNA, 24 bp, Artificial Sequence
  Description of Artificial Sequence: Synthetic oligonucleotide
gaggcggtcaagaagcgctcgacc

SEQ ID NO: 266144 - DNA, 24 bp, Artificial Sequence
  Description of Artificial Sequence: Synthetic oligonucleotide
aggcggtcaagaagcgctcgaccg

SEQ ID NO: 266145 - DNA, 23 bp, Artificial Sequence
  Description of Artificial Sequence: Synthetic oligonucleotide
ggcggtcaagaagcgctcgaccg

SEQ ID NO: 266146 - DNA, 23 bp, Artificial Sequence
  Description of Artificial Sequence: Synthetic oligonucleotide
gcggtcaagaagcgctcgaccgg

SEQ ID NO: 266147 - DNA, 23 bp, Artificial Sequence
  Description of Artificial Sequence: Synthetic oligonucleotide
cggtcaagaagcgctcgaccggg

SEQ ID NO: 266148 - DNA, 25 bp, Artificial Sequence
  Description of Artificial Sequence: Synthetic oligonucleotide
ggtcaagaagcgctcgaccggggtt

SEQ ID NO: 266149 - DNA, 25 bp, Artificial Sequence
  Description of Artificial Sequence: Synthetic oligonucleotide
gtcaagaagcgctcgaccggggttg

SEQ ID NO: 266150 - DNA, 26 bp, Artificial Sequence
  Description of Artificial Sequence: Synthetic oligonucleotide
tcaagaagcgctcgaccggggttggt

SEQ ID NO: 266151 - DNA, 25 bp, Artificial Sequence
  Description of Artificial Sequence: Synthetic oligonucleotide
caagaagcgctcgaccggggttggt

SEQ ID NO: 266152 - DNA, 27 bp, Artificial Sequence
  Description of Artificial Sequence: Synthetic oligonucleotide
aagaagcgctcgaccggggttggtgta

SEQ ID NO: 266153 - DNA, 26 bp, Artificial Sequence
  Description of Artificial Sequence: Synthetic oligonucleotide
agaagcgctcgaccggggttggtgta

SEQ ID NO: 266154 - DNA, 25 bp, Artificial Sequence
  Description of Artificial Sequence: Synthetic oligonucleotide
gaagcgctcgaccggggttggtgta

SEQ ID NO: 266155 - DNA, 25 bp, Artificial Sequence
  Description of Artificial Sequence: Synthetic oligonucleotide
aagcgctcgaccggggttggtgtac

SEQ ID NO: 266156 - DNA, 24 bp, Artificial Sequence
  Description of Artificial Sequence: Synthetic oligonucleotide
agcgctcgaccggggttggtgtac

SEQ ID NO: 266157 - DNA, 23 bp, Artificial Sequence
  Description of Artificial Sequence: Synthetic oligonucleotide
gcgctcgaccggggttggtgtac

SEQ ID NO: 266158 - DNA, 24 bp, Artificial Sequence
  Description of Artificial Sequence: Synthetic oligonucleotide
cgctcgaccggggttggtgtacga

SEQ ID NO: 266159 - DNA, 24 bp, Artificial Sequence
  Description of Artificial Sequence: Synthetic oligonucleotide
gctcgaccggggttggtgtacgag

SEQ ID NO: 266160 - DNA, 26 bp, Artificial Sequence
  Description of Artificial Sequence: Synthetic oligonucleotide
ctcgaccggggttggtgtacgaggaa

SEQ ID NO: 266161 - DNA, 27 bp, Artificial Sequence
  Description of Artificial Sequence: Synthetic oligonucleotide
tcgaccggggttggtgtacgaggaaga

SEQ ID NO: 266162 - DNA, 26 bp, Artificial Sequence
  Description of Artificial Sequence: Synthetic oligonucleotide
cgaccggggttggtgtacgaggaaga

SEQ ID NO: 266163 - DNA, 27 bp, Artificial Sequence
  Description of Artificial Sequence: Synthetic oligonucleotide
gaccggggttggtgtacgaggaagaca

SEQ ID NO: 266164 - DNA, 27 bp, Artificial Sequence
  Description of Artificial Sequence: Synthetic oligonucleotide
accggggttggtgtacgaggaagacac

SEQ ID NO: 266165 - DNA, 27 bp, Artificial Sequence
  Description of Artificial Sequence: Synthetic oligonucleotide
ccggggttggtgtacgaggaagacaca

SEQ ID NO: 266166 - DNA, 29 bp, Artificial Sequence
  Description of Artificial Sequence: Synthetic oligonucleotide
cggggttggtgtacgaggaagacacattg

SEQ ID NO: 266167 - DNA, 31 bp, Artificial Sequence
  Description of Artificial Sequence: Synthetic oligonucleotide
ggggttggtgtacgaggaagacacattgttg

SEQ ID NO: 266168 - DNA, 33 bp, Artificial Sequence
  Description of Artificial Sequence: Synthetic oligonucleotide
gggttggtgtacgaggaagacacattgttgatc

SEQ ID NO: 266169 - DNA, 35 bp, Artificial Sequence
  Description of Artificial Sequence: Synthetic oligonucleotide
ggttggtgtacgaggaagacacattgttgatcttg

SEQ ID NO: 266170 - DNA, 35 bp, Artificial Sequence
  Description of Artificial Sequence: Synthetic oligonucleotide
gttggtgtacgaggaagacacattgttgatcttgg

SEQ ID NO: 266171 - DNA, 36 bp, Artificial Sequence
  Description of Artificial Sequence: Synthetic oligonucleotide
ttggtgtacgaggaagacacattgttgatcttggtg

SEQ ID NO: 266172 - DNA, 35 bp, Artificial Sequence
  Description of Artificial Sequence: Synthetic oligonucleotide
tggtgtacgaggaagacacattgttgatcttggtg

SEQ ID NO: 266173 - DNA, 34 bp, Artificial Sequence
  Description of Artificial Sequence: Synthetic oligonucleotide
ggtgtacgaggaagacacattgttgatcttggtg

SEQ ID NO: 266174 - DNA, 35 bp, Artificial Sequence
  Description of Artificial Sequence: Synthetic oligonucleotide
gtgtacgaggaagacacattgttgatcttggtgtc

SEQ ID NO: 266175 - DNA, 35 bp, Artificial Sequence
  Description of Artificial Sequence: Synthetic oligonucleotide
tgtacgaggaagacacattgttgatcttggtgtcg

SEQ ID NO: 266176 - DNA, 34 bp, Artificial Sequence
  Description of Artificial Sequence: Synthetic oligonucleotide
gtacgaggaagacacattgttgatcttggtgtcg

SEQ ID NO: 266177 - DNA, 35 bp, Artificial Sequence
  Description of Artificial Sequence: Synthetic oligonucleotide
tacgaggaagacacattgttgatcttggtgtcgag

SEQ ID NO: 266178 - DNA, 34 bp, Artificial Sequence
  Description of Artificial Sequence: Synthetic oligonucleotide
acgaggaagacacattgttgatcttggtgtcgag

SEQ ID NO: 266179 - DNA, 33 bp, Artificial Sequence
  Description of Artificial Sequence: Synthetic oligonucleotide
cgaggaagacacattgttgatcttggtgtcgag

SEQ ID NO: 266180 - DNA, 35 bp, Artificial Sequence
  Description of Artificial Sequence: Synthetic oligonucleotide
gaggaagacacattgttgatcttggtgtcgagaag

SEQ ID NO: 266181 - DNA, 37 bp, Artificial Sequence
  Description of Artificial Sequence: Synthetic oligonucleotide
aggaagacacattgttgatcttggtgtcgagaagaag

SEQ ID NO: 266182 - DNA, 36 bp, Artificial Sequence
  Description of Artificial Sequence: Synthetic oligonucleotide
ggaagacacattgttgatcttggtgtcgagaagaag

SEQ ID NO: 266183 - DNA, 37 bp, Artificial Sequence
  Description of Artificial Sequence: Synthetic oligonucleotide
gaagacacattgttgatcttggtgtcgagaagaagac

SEQ ID NO: 266184 - DNA, 38 bp, Artificial Sequence
  Description of Artificial Sequence: Synthetic oligonucleotide
aagacacattgttgatcttggtgtcgagaagaagacag

SEQ ID NO: 266185 - DNA, 37 bp, Artificial Sequence
  Description of Artificial Sequence: Synthetic oligonucleotide
agacacattgttgatcttggtgtcgagaagaagacag

SEQ ID NO: 266186 - DNA, 36 bp, Artificial Sequence
  Description of Artificial Sequence: Synthetic oligonucleotide
gacacattgttgatcttggtgtcgagaagaagacag

SEQ ID NO: 266187 - DNA, 37 bp, Artificial Sequence
  Description of Artificial Sequence: Synthetic oligonucleotide
acacattgttgatcttggtgtcgagaagaagacagtg

SEQ ID NO: 266188 - DNA, 36 bp, Artificial Sequence
  Description of Artificial Sequence: Synthetic oligonucleotide
cacattgttgatcttggtgtcgagaagaagacagtg

SEQ ID NO: 266189 - DNA, 36 bp, Artificial Sequence
  Description of Artificial Sequence: Synthetic oligonucleotide
acattgttgatcttggtgtcgagaagaagacagtgg

SEQ ID NO: 266190 - DNA, 35 bp, Artificial Sequence
  Description of Artificial Sequence: Synthetic oligonucleotide
cattgttgatcttggtgtcgagaagaagacagtgg

SEQ ID NO: 266191 - DNA, 35 bp, Artificial Sequence
  Description of Artificial Sequence: Synthetic oligonucleotide
attgttgatcttggtgtcgagaagaagacagtggc

SEQ ID NO: 266192 - DNA, 34 bp, Artificial Sequence
  Description of Artificial Sequence: Synthetic oligonucleotide
ttgttgatcttggtgtcgagaagaagacagtggc

SEQ ID NO: 266193 - DNA, 33 bp, Artificial Sequence
  Description of Artificial Sequence: Synthetic oligonucleotide
tgttgatcttggtgtcgagaagaagacagtggc

SEQ ID NO: 266194 - DNA, 32 bp, Artificial Sequence
  Description of Artificial Sequence: Synthetic oligonucleotide
gttgatcttggtgtcgagaagaagacagtggc

SEQ ID NO: 266195 - DNA, 32 bp, Artificial Sequence
  Description of Artificial Sequence: Synthetic oligonucleotide
ttgatcttggtgtcgagaagaagacagtggcc

SEQ ID NO: 266196 - DNA, 31 bp, Artificial Sequence
  Description of Artificial Sequence: Synthetic oligonucleotide
tgatcttggtgtcgagaagaagacagtggcc

SEQ ID NO: 266197 - DNA, 30 bp, Artificial Sequence
  Description of Artificial Sequence: Synthetic oligonucleotide
gatcttggtgtcgagaagaagacagtggcc

SEQ ID NO: 266198 - DNA, 33 bp, Artificial Sequence
  Description of Artificial Sequence: Synthetic oligonucleotide
atcttggtgtcgagaagaagacagtggccatac

SEQ ID NO: 266199 - DNA, 32 bp, Artificial Sequence
  Description of Artificial Sequence: Synthetic oligonucleotide
tcttggtgtcgagaagaagacagtggccatac

SEQ ID NO: 266200 - DNA, 31 bp, Artificial Sequence
  Description of Artificial Sequence: Synthetic oligonucleotide
cttggtgtcgagaagaagacagtggccatac

SEQ ID NO: 266201 - DNA, 32 bp, Artificial Sequence
  Description of Artificial Sequence: Synthetic oligonucleotide
ttggtgtcgagaagaagacagtggccatactg

SEQ ID NO: 266202 - DNA, 31 bp, Artificial Sequence
  Description of Artificial Sequence: Synthetic oligonucleotide
tggtgtcgagaagaagacagtggccatactg

SEQ ID NO: 266203 - DNA, 30 bp, Artificial Sequence
  Description of Artificial Sequence: Synthetic oligonucleotide
ggtgtcgagaagaagacagtggccatactg

SEQ ID NO: 266204 - DNA, 30 bp, Artificial Sequence
  Description of Artificial Sequence: Synthetic oligonucleotide
gtgtcgagaagaagacagtggccatactgc

SEQ ID NO: 266205 - DNA, 31 bp, Artificial Sequence
  Description of Artificial Sequence: Synthetic oligonucleotide
tgtcgagaagaagacagtggccatactgcag

SEQ ID NO: 266206 - DNA, 30 bp, Artificial Sequence
  Description of Artificial Sequence: Synthetic oligonucleotide
gtcgagaagaagacagtggccatactgcag

SEQ ID NO: 266207 - DNA, 30 bp, Artificial Sequence
  Description of Artificial Sequence: Synthetic oligonucleotide
tcgagaagaagacagtggccatactgcagg

SEQ ID NO: 266208 - DNA, 29 bp, Artificial Sequence
  Description of Artificial Sequence: Synthetic oligonucleotide
cgagaagaagacagtggccatactgcagg

SEQ ID NO: 266209 - DNA, 31 bp, Artificial Sequence
  Description of Artificial Sequence: Synthetic oligonucleotide
gagaagaagacagtggccatactgcaggaag

SEQ ID NO: 266210 - DNA, 34 bp, Artificial Sequence
  Description of Artificial Sequence: Synthetic oligonucleotide
agaagaagacagtggccatactgcaggaagaaag

SEQ ID NO: 266211 - DNA, 33 bp, Artificial Sequence
  Description of Artificial Sequence: Synthetic oligonucleotide
gaagaagacagtggccatactgcaggaagaaag

SEQ ID NO: 266212 - DNA, 35 bp, Artificial Sequence
  Description of Artificial Sequence: Synthetic oligonucleotide
aagaagacagtggccatactgcaggaagaaagaac

SEQ ID NO: 266213 - DNA, 34 bp, Artificial Sequence
  Description of Artificial Sequence: Synthetic oligonucleotide
agaagacagtggccatactgcaggaagaaagaac

SEQ ID NO: 266214 - DNA, 33 bp, Artificial Sequence
  Description of Artificial Sequence: Synthetic oligonucleotide
gaagacagtggccatactgcaggaagaaagaac

SEQ ID NO: 266215 - DNA, 34 bp, Artificial Sequence
  Description of Artificial Sequence: Synthetic oligonucleotide
aagacagtggccatactgcaggaagaaagaacac

SEQ ID NO: 266216 - DNA, 33 bp, Artificial Sequence
  Description of Artificial Sequence: Synthetic oligonucleotide
agacagtggccatactgcaggaagaaagaacac

SEQ ID NO: 266217 - DNA, 32 bp, Artificial Sequence
  Description of Artificial Sequence: Synthetic oligonucleotide
gacagtggccatactgcaggaagaaagaacac

SEQ ID NO: 266218 - DNA, 33 bp, Artificial Sequence
  Description of Artificial Sequence: Synthetic oligonucleotide
acagtggccatactgcaggaagaaagaacactg

SEQ ID NO: 266219 - DNA, 32 bp, Artificial Sequence
  Description of Artificial Sequence: Synthetic oligonucleotide
cagtggccatactgcaggaagaaagaacactg

SEQ ID NO: 266220 - DNA, 32 bp, Artificial Sequence
  Description of Artificial Sequence: Synthetic oligonucleotide
agtggccatactgcaggaagaaagaacactgc

SEQ ID NO: 266221 - DNA, 31 bp, Artificial Sequence
  Description of Artificial Sequence: Synthetic oligonucleotide
gtggccatactgcaggaagaaagaacactgc

SEQ ID NO: 266222 - DNA, 31 bp, Artificial Sequence
  Description of Artificial Sequence: Synthetic oligonucleotide
tggccatactgcaggaagaaagaacactgcg

SEQ ID NO: 266223 - DNA, 30 bp, Artificial Sequence
  Description of Artificial Sequence: Synthetic oligonucleotide
ggccatactgcaggaagaaagaacactgcg

SEQ ID NO: 266224 - DNA, 30 bp, Artificial Sequence
  Description of Artificial Sequence: Synthetic oligonucleotide
gccatactgcaggaagaaagaacactgcgg

SEQ ID NO: 266225 - DNA, 32 bp, Artificial Sequence
  Description of Artificial Sequence: Synthetic oligonucleotide
ccatactgcaggaagaaagaacactgcggaag

SEQ ID NO: 266226 - DNA, 34 bp, Artificial Sequence
  Description of Artificial Sequence: Synthetic oligonucleotide
catactgcaggaagaaagaacactgcggaagaac

SEQ ID NO: 266227 - DNA, 35 bp, Artificial Sequence
  Description of Artificial Sequence: Synthetic oligonucleotide
atactgcaggaagaaagaacactgcggaagaactg

SEQ ID NO: 266228 - DNA, 34 bp, Artificial Sequence
  Description of Artificial Sequence: Synthetic oligonucleotide
tactgcaggaagaaagaacactgcggaagaactg

SEQ ID NO: 266229 - DNA, 33 bp, Artificial Sequence
  Description of Artificial Sequence: Synthetic oligonucleotide
actgcaggaagaaagaacactgcggaagaactg

SEQ ID NO: 266230 - DNA, 32 bp, Artificial Sequence
  Description of Artificial Sequence: Synthetic oligonucleotide
ctgcaggaagaaagaacactgcggaagaactg

SEQ ID NO: 266231 - DNA, 33 bp, Artificial Sequence
  Description of Artificial Sequence: Synthetic oligonucleotide
tgcaggaagaaagaacactgcggaagaactgtg

SEQ ID NO: 266232 - DNA, 32 bp, Artificial Sequence
  Description of Artificial Sequence: Synthetic oligonucleotide
gcaggaagaaagaacactgcggaagaactgtg

SEQ ID NO: 266233 - DNA, 32 bp, Artificial Sequence
  Description of Artificial Sequence: Synthetic oligonucleotide
caggaagaaagaacactgcggaagaactgtgc

SEQ ID NO: 266234 - DNA, 35 bp, Artificial Sequence
  Description of Artificial Sequence: Synthetic oligonucleotide
aggaagaaagaacactgcggaagaactgtgctttc

SEQ ID NO: 266235 - DNA, 34 bp, Artificial Sequence
  Description of Artificial Sequence: Synthetic oligonucleotide
ggaagaaagaacactgcggaagaactgtgctttc

SEQ ID NO: 266236 - DNA, 34 bp, Artificial Sequence
  Description of Artificial Sequence: Synthetic oligonucleotide
gaagaaagaacactgcggaagaactgtgctttcg

SEQ ID NO: 266237 - DNA, 36 bp, Artificial Sequence
  Description of Artificial Sequence: Synthetic oligonucleotide
aagaaagaacactgcggaagaactgtgctttcgatg

SEQ ID NO: 266238 - DNA, 35 bp, Artificial Sequence
  Description of Artificial Sequence: Synthetic oligonucleotide
agaaagaacactgcggaagaactgtgctttcgatg

SEQ ID NO: 266239 - DNA, 34 bp, Artificial Sequence
  Description of Artificial Sequence: Synthetic oligonucleotide
gaaagaacactgcggaagaactgtgctttcgatg

SEQ ID NO: 266240 - DNA, 35 bp, Artificial Sequence
  Description of Artificial Sequence: Synthetic oligonucleotide
aaagaacactgcggaagaactgtgctttcgatgac

SEQ ID NO: 266241 - DNA, 34 bp, Artificial Sequence
  Description of Artificial Sequence: Synthetic oligonucleotide
aagaacactgcggaagaactgtgctttcgatgac

SEQ ID NO: 266242 - DNA, 33 bp, Artificial Sequence
  Description of Artificial Sequence: Synthetic oligonucleotide
agaacactgcggaagaactgtgctttcgatgac

SEQ ID NO: 266243 - DNA, 32 bp, Artificial Sequence
  Description of Artificial Sequence: Synthetic oligonucleotide
gaacactgcggaagaactgtgctttcgatgac

SEQ ID NO: 266244 - DNA, 34 bp, Artificial Sequence
  Description of Artificial Sequence: Synthetic oligonucleotide
aacactgcggaagaactgtgctttcgatgacaac

SEQ ID NO: 266245 - DNA, 33 bp, Artificial Sequence
  Description of Artificial Sequence: Synthetic oligonucleotide
acactgcggaagaactgtgctttcgatgacaac

SEQ ID NO: 266246 - DNA, 32 bp, Artificial Sequence
  Description of Artificial Sequence: Synthetic oligonucleotide
cactgcggaagaactgtgctttcgatgacaac

SEQ ID NO: 266247 - DNA, 32 bp, Artificial Sequence
  Description of Artificial Sequence: Synthetic oligonucleotide
actgcggaagaactgtgctttcgatgacaacc

SEQ ID NO: 266248 - DNA, 31 bp, Artificial Sequence
  Description of Artificial Sequence: Synthetic oligonucleotide
ctgcggaagaactgtgctttcgatgacaacc

SEQ ID NO: 266249 - DNA, 32 bp, Artificial Sequence
  Description of Artificial Sequence: Synthetic oligonucleotide
tgcggaagaactgtgctttcgatgacaacctc

SEQ ID NO: 266250 - DNA, 31 bp, Artificial Sequence
  Description of Artificial Sequence: Synthetic oligonucleotide
gcggaagaactgtgctttcgatgacaacctc

SEQ ID NO: 266251 - DNA, 32 bp, Artificial Sequence
  Description of Artificial Sequence: Synthetic oligonucleotide
cggaagaactgtgctttcgatgacaacctctg

SEQ ID NO: 266252 - DNA, 32 bp, Artificial Sequence
  Description of Artificial Sequence: Synthetic oligonucleotide
ggaagaactgtgctttcgatgacaacctctgc

SEQ ID NO: 266253 - DNA, 34 bp, Artificial Sequence
  Description of Artificial Sequence: Synthetic oligonucleotide
gaagaactgtgctttcgatgacaacctctgcatg

SEQ ID NO: 266254 - DNA, 34 bp, Artificial Sequence
  Description of Artificial Sequence: Synthetic oligonucleotide
aagaactgtgctttcgatgacaacctctgcatgg

SEQ ID NO: 266255 - DNA, 33 bp, Artificial Sequence
  Description of Artificial Sequence: Synthetic oligonucleotide
agaactgtgctttcgatgacaacctctgcatgg

SEQ ID NO: 266256 - DNA, 32 bp, Artificial Sequence
  Description of Artificial Sequence: Synthetic oligonucleotide
gaactgtgctttcgatgacaacctctgcatgg

SEQ ID NO: 266257 - DNA, 32 bp, Artificial Sequence
  Description of Artificial Sequence: Synthetic oligonucleotide
aactgtgctttcgatgacaacctctgcatggg

SEQ ID NO: 266258 - DNA, 31 bp, Artificial Sequence
  Description of Artificial Sequence: Synthetic oligonucleotide
actgtgctttcgatgacaacctctgcatggg

SEQ ID NO: 266259 - DNA, 30 bp, Artificial Sequence
  Description of Artificial Sequence: Synthetic oligonucleotide
ctgtgctttcgatgacaacctctgcatggg

SEQ ID NO: 266260 - DNA, 30 bp, Artificial Sequence
  Description of Artificial Sequence: Synthetic oligonucleotide
tgtgctttcgatgacaacctctgcatgggc

SEQ ID NO: 266261 - DNA, 29 bp, Artificial Sequence
  Description of Artificial Sequence: Synthetic oligonucleotide
gtgctttcgatgacaacctctgcatgggc

SEQ ID NO: 266262 - DNA, 32 bp, Artificial Sequence
  Description of Artificial Sequence: Synthetic oligonucleotide
tgctttcgatgacaacctctgcatgggctttg

SEQ ID NO: 266263 - DNA, 31 bp, Artificial Sequence
  Description of Artificial Sequence: Synthetic oligonucleotide
gctttcgatgacaacctctgcatgggctttg

SEQ ID NO: 266264 - DNA, 31 bp, Artificial Sequence
  Description of Artificial Sequence: Synthetic oligonucleotide
ctttcgatgacaacctctgcatgggctttgc

SEQ ID NO: 266265 - DNA, 32 bp, Artificial Sequence
  Description of Artificial Sequence: Synthetic oligonucleotide
tttcgatgacaacctctgcatgggctttgcag

SEQ ID NO: 266266 - DNA, 31 bp, Artificial Sequence
  Description of Artificial Sequence: Synthetic oligonucleotide
ttcgatgacaacctctgcatgggctttgcag

SEQ ID NO: 266267 - DNA, 30 bp, Artificial Sequence
  Description of Artificial Sequence: Synthetic oligonucleotide
tcgatgacaacctctgcatgggctttgcag

SEQ ID NO: 266268 - DNA, 29 bp, Artificial Sequence
  Description of Artificial Sequence: Synthetic oligonucleotide
cgatgacaacctctgcatgggctttgcag

SEQ ID NO: 266269 - DNA, 29 bp, Artificial Sequence
  Description of Artificial Sequence: Synthetic oligonucleotide
gatgacaacctctgcatgggctttgcagg

SEQ ID NO: 266270 - DNA, 29 bp, Artificial Sequence
  Description of Artificial Sequence: Synthetic oligonucleotide
atgacaacctctgcatgggctttgcaggg

SEQ ID NO: 266271 - DNA, 28 bp, Artificial Sequence
  Description of Artificial Sequence: Synthetic oligonucleotide
tgacaacctctgcatgggctttgcaggg

SEQ ID NO: 266272 - DNA, 27 bp, Artificial Sequence
  Description of Artificial Sequence: Synthetic oligonucleotide
gacaacctctgcatgggctttgcaggg

SEQ ID NO: 266273 - DNA, 27 bp, Artificial Sequence
  Description of Artificial Sequence: Synthetic oligonucleotide
acaacctctgcatgggctttgcagggc

SEQ ID NO: 266274 - DNA, 27 bp, Artificial Sequence
  Description of Artificial Sequence: Synthetic oligonucleotide
caacctctgcatgggctttgcagggct

SEQ ID NO: 266275 - DNA, 27 bp, Artificial Sequence
  Description of Artificial Sequence: Synthetic oligonucleotide
aacctctgcatgggctttgcagggctc

SEQ ID NO: 266276 - DNA, 27 bp, Artificial Sequence
  Description of Artificial Sequence: Synthetic oligonucleotide
acctctgcatgggctttgcagggctca

SEQ ID NO: 266277 - DNA, 26 bp, Artificial Sequence
  Description of Artificial Sequence: Synthetic oligonucleotide
cctctgcatgggctttgcagggctca

SEQ ID NO: 266278 - DNA, 26 bp, Artificial Sequence
  Description of Artificial Sequence: Synthetic oligonucleotide
ctctgcatgggctttgcagggctcac

SEQ ID NO: 266279 - DNA, 26 bp, Artificial Sequence
  Description of Artificial Sequence: Synthetic oligonucleotide
tctgcatgggctttgcagggctcacc

SEQ ID NO: 266280 - DNA, 25 bp, Artificial Sequence
  Description of Artificial Sequence: Synthetic oligonucleotide
ctgcatgggctttgcagggctcacc

SEQ ID NO: 266281 - DNA, 25 bp, Artificial Sequence
  Description of Artificial Sequence: Synthetic oligonucleotide
tgcatgggctttgcagggctcaccg

SEQ ID NO: 266282 - DNA, 24 bp, Artificial Sequence
  Description of Artificial Sequence: Synthetic oligonucleotide
gcatgggctttgcagggctcaccg

SEQ ID NO: 266283 - DNA, 24 bp, Artificial Sequence
  Description of Artificial Sequence: Synthetic oligonucleotide
catgggctttgcagggctcaccgc

SEQ ID NO: 266284 - DNA, 24 bp, Artificial Sequence
  Description of Artificial Sequence: Synthetic oligonucleotide
atgggctttgcagggctcaccgcc

SEQ ID NO: 266285 - DNA, 23 bp, Artificial Sequence
  Description of Artificial Sequence: Synthetic oligonucleotide
tgggctttgcagggctcaccgcc

SEQ ID NO: 266286 - DNA, 22 bp, Artificial Sequence
  Description of Artificial Sequence: Synthetic oligonucleotide
gggctttgcagggctcaccgcc

SEQ ID NO: 266287 - DNA, 24 bp, Artificial Sequence
  Description of Artificial Sequence: Synthetic oligonucleotide
ggctttgcagggctcaccgcccat

SEQ ID NO: 266288 - DNA, 24 bp, Artificial Sequence
  Description of Artificial Sequence: Synthetic oligonucleotide
gctttgcagggctcaccgcccatg

SEQ ID NO: 266289 - DNA, 26 bp, Artificial Sequence
  Description of Artificial Sequence: Synthetic oligonucleotide
ctttgcagggctcaccgcccatgcaa

SEQ ID NO: 266290 - DNA, 26 bp, Artificial Sequence
  Description of Artificial Sequence: Synthetic oligonucleotide
tttgcagggctcaccgcccatgcaag

SEQ ID NO: 266291 - DNA, 25 bp, Artificial Sequence
  Description of Artificial Sequence: Synthetic oligonucleotide
ttgcagggctcaccgcccatgcaag

SEQ ID NO: 266292 - DNA, 24 bp, Artificial Sequence
  Description of Artificial Sequence: Synthetic oligonucleotide
tgcagggctcaccgcccatgcaag

SEQ ID NO: 266293 - DNA, 23 bp, Artificial Sequence
  Description of Artificial Sequence: Synthetic oligonucleotide
gcagggctcaccgcccatgcaag

SEQ ID NO: 266294 - DNA, 26 bp, Artificial Sequence
  Description of Artificial Sequence: Synthetic oligonucleotide
cagggctcaccgcccatgcaaggaaa

SEQ ID NO: 266295 - DNA, 27 bp, Artificial Sequence
  Description of Artificial Sequence: Synthetic oligonucleotide
agggctcaccgcccatgcaaggaaagt

SEQ ID NO: 266296 - DNA, 26 bp, Artificial Sequence
  Description of Artificial Sequence: Synthetic oligonucleotide
gggctcaccgcccatgcaaggaaagt

SEQ ID NO: 266297 - DNA, 27 bp, Artificial Sequence
  Description of Artificial Sequence: Synthetic oligonucleotide
ggctcaccgcccatgcaaggaaagtca

SEQ ID NO: 266298 - DNA, 28 bp, Artificial Sequence
  Description of Artificial Sequence: Synthetic oligonucleotide
gctcaccgcccatgcaaggaaagtcatc

SEQ ID NO: 266299 - DNA, 30 bp, Artificial Sequence
  Description of Artificial Sequence: Synthetic oligonucleotide
ctcaccgcccatgcaaggaaagtcatcaag

SEQ ID NO: 266300 - DNA, 31 bp, Artificial Sequence
  Description of Artificial Sequence: Synthetic oligonucleotide
tcaccgcccatgcaaggaaagtcatcaagag

SEQ ID NO: 266301 - DNA, 30 bp, Artificial Sequence
  Description of Artificial Sequence: Synthetic oligonucleotide
caccgcccatgcaaggaaagtcatcaagag

SEQ ID NO: 266302 - DNA, 30 bp, Artificial Sequence
  Description of Artificial Sequence: Synthetic oligonucleotide
accgcccatgcaaggaaagtcatcaagagg

SEQ ID NO: 266303 - DNA, 29 bp, Artificial Sequence
  Description of Artificial Sequence: Synthetic oligonucleotide
ccgcccatgcaaggaaagtcatcaagagg

SEQ ID NO: 266304 - DNA, 29 bp, Artificial Sequence
  Description of Artificial Sequence: Synthetic oligonucleotide
cgcccatgcaaggaaagtcatcaagaggg

SEQ ID NO: 266305 - DNA, 29 bp, Artificial Sequence
  Description of Artificial Sequence: Synthetic oligonucleotide
gcccatgcaaggaaagtcatcaagagggc

SEQ ID NO: 266306 - DNA, 29 bp, Artificial Sequence
  Description of Artificial Sequence: Synthetic oligonucleotide
cccatgcaaggaaagtcatcaagagggcc

SEQ ID NO: 266307 - DNA, 29 bp, Artificial Sequence
  Description of Artificial Sequence: Synthetic oligonucleotide
ccatgcaaggaaagtcatcaagagggccc

SEQ ID NO: 266308 - DNA, 29 bp, Artificial Sequence
  Description of Artificial Sequence: Synthetic oligonucleotide
catgcaaggaaagtcatcaagagggcccg

SEQ ID NO: 266309 - DNA, 29 bp, Artificial Sequence
  Description of Artificial Sequence: Synthetic oligonucleotide
atgcaaggaaagtcatcaagagggcccgg

SEQ ID NO: 266310 - DNA, 28 bp, Artificial Sequence
  Description of Artificial Sequence: Synthetic oligonucleotide
tgcaaggaaagtcatcaagagggcccgg

SEQ ID NO: 266311 - DNA, 27 bp, Artificial Sequence
  Description of Artificial Sequence: Synthetic oligonucleotide
gcaaggaaagtcatcaagagggcccgg

SEQ ID NO: 266312 - DNA, 27 bp, Artificial Sequence
  Description of Artificial Sequence: Synthetic oligonucleotide
caaggaaagtcatcaagagggcccggc

SEQ ID NO: 266313 - DNA, 28 bp, Artificial Sequence
  Description of Artificial Sequence: Synthetic oligonucleotide
aaggaaagtcatcaagagggcccggctg

SEQ ID NO: 266314 - DNA, 27 bp, Artificial Sequence
  Description of Artificial Sequence: Synthetic oligonucleotide
aggaaagtcatcaagagggcccggctg

SEQ ID NO: 266315 - DNA, 26 bp, Artificial Sequence
  Description of Artificial Sequence: Synthetic oligonucleotide
ggaaagtcatcaagagggcccggctg

SEQ ID NO: 266316 - DNA, 27 bp, Artificial Sequence
  Description of Artificial Sequence: Synthetic oligonucleotide
gaaagtcatcaagagggcccggctgga

SEQ ID NO: 266317 - DNA, 27 bp, Artificial Sequence
  Description of Artificial Sequence: Synthetic oligonucleotide
aaagtcatcaagagggcccggctggag

SEQ ID NO: 266318 - DNA, 27 bp, Artificial Sequence
  Description of Artificial Sequence: Synthetic oligonucleotide
aagtcatcaagagggcccggctggagt

SEQ ID NO: 266319 - DNA, 26 bp, Artificial Sequence
  Description of Artificial Sequence: Synthetic oligonucleotide
agtcatcaagagggcccggctggagt

SEQ ID NO: 266320 - DNA, 25 bp, Artificial Sequence
  Description of Artificial Sequence: Synthetic oligonucleotide
gtcatcaagagggcccggctggagt

SEQ ID NO: 266321 - DNA, 25 bp, Artificial Sequence
  Description of Artificial Sequence: Synthetic oligonucleotide
tcatcaagagggcccggctggagtg

SEQ ID NO: 266322 - DNA, 24 bp, Artificial Sequence
  Description of Artificial Sequence: Synthetic oligonucleotide
catcaagagggcccggctggagtg

SEQ ID NO: 266323 - DNA, 24 bp, Artificial Sequence
  Description of Artificial Sequence: Synthetic oligonucleotide
atcaagagggcccggctggagtgc

SEQ ID NO: 266324 - DNA, 23 bp, Artificial Sequence
  Description of Artificial Sequence: Synthetic oligonucleotide
tcaagagggcccggctggagtgc

SEQ ID NO: 266325 - DNA, 22 bp, Artificial Sequence
  Description of Artificial Sequence: Synthetic oligonucleotide
caagagggcccggctggagtgc

SEQ ID NO: 266326 - DNA, 23 bp, Artificial Sequence
  Description of Artificial Sequence: Synthetic oligonucleotide
aagagggcccggctggagtgcct

SEQ ID NO: 266327 - DNA, 22 bp, Artificial Sequence
  Description of Artificial Sequence: Synthetic oligonucleotide
agagggcccggctggagtgcct

SEQ ID NO: 266328 - DNA, 21 bp, Artificial Sequence
  Description of Artificial Sequence: Synthetic oligonucleotide
gagggcccggctggagtgcct

SEQ ID NO: 266329 - DNA, 22 bp, Artificial Sequence
  Description of Artificial Sequence: Synthetic oligonucleotide
agggcccggctggagtgcctga

SEQ ID NO: 266330 - DNA, 21 bp, Artificial Sequence
  Description of Artificial Sequence: Synthetic oligonucleotide
gggcccggctggagtgcctga

SEQ ID NO: 266331 - DNA, 21 bp, Artificial Sequence
  Description of Artificial Sequence: Synthetic oligonucleotide
ggcccggctggagtgcctgag

SEQ ID NO: 266332 - DNA, 21 bp, Artificial Sequence
  Description of Artificial Sequence: Synthetic oligonucleotide
gcccggctggagtgcctgagc

SEQ ID NO: 266333 - DNA, 22 bp, Artificial Sequence
  Description of Artificial Sequence: Synthetic oligonucleotide
cccggctggagtgcctgagcca

SEQ ID NO: 266334 - DNA, 22 bp, Artificial Sequence
  Description of Artificial Sequence: Synthetic oligonucleotide
ccggctggagtgcctgagccac

SEQ ID NO: 266335 - DNA, 22 bp, Artificial Sequence
  Description of Artificial Sequence: Synthetic oligonucleotide
cggctggagtgcctgagccacc

SEQ ID NO: 266336 - DNA, 22 bp, Artificial Sequence
  Description of Artificial Sequence: Synthetic oligonucleotide
ggctggagtgcctgagccaccg

SEQ ID NO: 266337 - DNA, 22 bp, Artificial Sequence
  Description of Artificial Sequence: Synthetic oligonucleotide
gctggagtgcctgagccaccgc

SEQ ID NO: 266338 - DNA, 23 bp, Artificial Sequence
  Description of Artificial Sequence: Synthetic oligonucleotide
ctggagtgcctgagccaccgcct

SEQ ID NO: 266339 - DNA, 24 bp, Artificial Sequence
  Description of Artificial Sequence: Synthetic oligonucleotide
tggagtgcctgagccaccgcctga

SEQ ID NO: 266340 - DNA, 23 bp, Artificial Sequence
  Description of Artificial Sequence: Synthetic oligonucleotide
ggagtgcctgagccaccgcctga

SEQ ID NO: 266341 - DNA, 24 bp, Artificial Sequence
  Description of Artificial Sequence: Synthetic oligonucleotide
gagtgcctgagccaccgcctgact

SEQ ID NO: 266342 - DNA, 25 bp, Artificial Sequence
  Description of Artificial Sequence: Synthetic oligonucleotide
agtgcctgagccaccgcctgactgt

SEQ ID NO: 266343 - DNA, 24 bp, Artificial Sequence
  Description of Artificial Sequence: Synthetic oligonucleotide
gtgcctgagccaccgcctgactgt

SEQ ID NO: 266344 - DNA, 24 bp, Artificial Sequence
  Description of Artificial Sequence: Synthetic oligonucleotide
tgcctgagccaccgcctgactgtg

SEQ ID NO: 266345 - DNA, 23 bp, Artificial Sequence
  Description of Artificial Sequence: Synthetic oligonucleotide
gcctgagccaccgcctgactgtg

SEQ ID NO: 266346 - DNA, 24 bp, Artificial Sequence
  Description of Artificial Sequence: Synthetic oligonucleotide
cctgagccaccgcctgactgtgca

SEQ ID NO: 266347 - DNA, 24 bp, Artificial Sequence
  Description of Artificial Sequence: Synthetic oligonucleotide
ctgagccaccgcctgactgtgcag

SEQ ID NO: 266348 - DNA, 25 bp, Artificial Sequence
  Description of Artificial Sequence: Synthetic oligonucleotide
tgagccaccgcctgactgtgcagga

SEQ ID NO: 266349 - DNA, 24 bp, Artificial Sequence
  Description of Artificial Sequence: Synthetic oligonucleotide
gagccaccgcctgactgtgcagga

SEQ ID NO: 266350 - DNA, 24 bp, Artificial Sequence
  Description of Artificial Sequence: Synthetic oligonucleotide
agccaccgcctgactgtgcaggac

SEQ ID NO: 266351 - DNA, 23 bp, Artificial Sequence
  Description of Artificial Sequence: Synthetic oligonucleotide
gccaccgcctgactgtgcaggac

SEQ ID NO: 266352 - DNA, 23 bp, Artificial Sequence
  Description of Artificial Sequence: Synthetic oligonucleotide
ccaccgcctgactgtgcaggacc

SEQ ID NO: 266353 - DNA, 23 bp, Artificial Sequence
  Description of Artificial Sequence: Synthetic oligonucleotide
caccgcctgactgtgcaggaccc

SEQ ID NO: 266354 - DNA, 23 bp, Artificial Sequence
  Description of Artificial Sequence: Synthetic oligonucleotide
accgcctgactgtgcaggacccg

SEQ ID NO: 266355 - DNA, 22 bp, Artificial Sequence
  Description of Artificial Sequence: Synthetic oligonucleotide
ccgcctgactgtgcaggacccg

SEQ ID NO: 266356 - DNA, 23 bp, Artificial Sequence
  Description of Artificial Sequence: Synthetic oligonucleotide
cgcctgactgtgcaggacccgga

SEQ ID NO: 266357 - DNA, 24 bp, Artificial Sequence
  Description of Artificial Sequence: Synthetic oligonucleotide
gcctgactgtgcaggacccggaca

SEQ ID NO: 266358 - DNA, 25 bp, Artificial Sequence
  Description of Artificial Sequence: Synthetic oligonucleotide
cctgactgtgcaggacccggacact

SEQ ID NO: 266359 - DNA, 26 bp, Artificial Sequence
  Description of Artificial Sequence: Synthetic oligonucleotide
ctgactgtgcaggacccggacactgt

SEQ ID NO: 266360 - DNA, 26 bp, Artificial Sequence
  Description of Artificial Sequence: Synthetic oligonucleotide
tgactgtgcaggacccggacactgtg

SEQ ID NO: 266361 - DNA, 25 bp, Artificial Sequence
  Description of Artificial Sequence: Synthetic oligonucleotide
gactgtgcaggacccggacactgtg

SEQ ID NO: 266362 - DNA, 26 bp, Artificial Sequence
  Description of Artificial Sequence: Synthetic oligonucleotide
actgtgcaggacccggacactgtgga

SEQ ID NO: 266363 - DNA, 25 bp, Artificial Sequence
  Description of Artificial Sequence: Synthetic oligonucleotide
ctgtgcaggacccggacactgtgga

SEQ ID NO: 266364 - DNA, 27 bp, Artificial Sequence
  Description of Artificial Sequence: Synthetic oligonucleotide
tgtgcaggacccggacactgtggacta

SEQ ID NO: 266365 - DNA, 26 bp, Artificial Sequence
  Description of Artificial Sequence: Synthetic oligonucleotide
gtgcaggacccggacactgtggacta

SEQ ID NO: 266366 - DNA, 27 bp, Artificial Sequence
  Description of Artificial Sequence: Synthetic oligonucleotide
tgcaggacccggacactgtggactaca

SEQ ID NO: 266367 - DNA, 27 bp, Artificial Sequence
  Description of Artificial Sequence: Synthetic oligonucleotide
gcaggacccggacactgtggactacat

SEQ ID NO: 266368 - DNA, 27 bp, Artificial Sequence
  Description of Artificial Sequence: Synthetic oligonucleotide
caggacccggacactgtggactacatc

SEQ ID NO: 266369 - DNA, 28 bp, Artificial Sequence
  Description of Artificial Sequence: Synthetic oligonucleotide
aggacccggacactgtggactacatcac

SEQ ID NO: 266370 - DNA, 27 bp, Artificial Sequence
  Description of Artificial Sequence: Synthetic oligonucleotide
ggacccggacactgtggactacatcac

SEQ ID NO: 266371 - DNA, 27 bp, Artificial Sequence
  Description of Artificial Sequence: Synthetic oligonucleotide
gacccggacactgtggactacatcacc

SEQ ID NO: 266372 - DNA, 27 bp, Artificial Sequence
  Description of Artificial Sequence: Synthetic oligonucleotide
acccggacactgtggactacatcaccg

SEQ ID NO: 266373 - DNA, 26 bp, Artificial Sequence
  Description of Artificial Sequence: Synthetic oligonucleotide
cccggacactgtggactacatcaccg

SEQ ID NO: 266374 - DNA, 26 bp, Artificial Sequence
  Description of Artificial Sequence: Synthetic oligonucleotide
ccggacactgtggactacatcaccgg

SEQ ID NO: 266375 - DNA, 27 bp, Artificial Sequence
  Description of Artificial Sequence: Synthetic oligonucleotide
cggacactgtggactacatcaccggct

SEQ ID NO: 266376 - DNA, 28 bp, Artificial Sequence
  Description of Artificial Sequence: Synthetic oligonucleotide
ggacactgtggactacatcaccggctac

SEQ ID NO: 266377 - DNA, 30 bp, Artificial Sequence
  Description of Artificial Sequence: Synthetic oligonucleotide
gacactgtggactacatcaccggctacatc

SEQ ID NO: 266378 - DNA, 30 bp, Artificial Sequence
  Description of Artificial Sequence: Synthetic oligonucleotide
acactgtggactacatcaccggctacatcg

SEQ ID NO: 266379 - DNA, 29 bp, Artificial Sequence
  Description of Artificial Sequence: Synthetic oligonucleotide
cactgtggactacatcaccggctacatcg

SEQ ID NO: 266380 - DNA, 29 bp, Artificial Sequence
  Description of Artificial Sequence: Synthetic oligonucleotide
actgtggactacatcaccggctacatcgg

SEQ ID NO: 266381 - DNA, 28 bp, Artificial Sequence
  Description of Artificial Sequence: Synthetic oligonucleotide
ctgtggactacatcaccggctacatcgg

SEQ ID NO: 266382 - DNA, 28 bp, Artificial Sequence
  Description of Artificial Sequence: Synthetic oligonucleotide
tgtggactacatcaccggctacatcggc

SEQ ID NO: 266383 - DNA, 27 bp, Artificial Sequence
  Description of Artificial Sequence: Synthetic oligonucleotide
gtggactacatcaccggctacatcggc

SEQ ID NO: 266384 - DNA, 28 bp, Artificial Sequence
  Description of Artificial Sequence: Synthetic oligonucleotide
tggactacatcaccggctacatcggcag

SEQ ID NO: 266385 - DNA, 27 bp, Artificial Sequence
  Description of Artificial Sequence: Synthetic oligonucleotide
ggactacatcaccggctacatcggcag

SEQ ID NO: 266386 - DNA, 28 bp, Artificial Sequence
  Description of Artificial Sequence: Synthetic oligonucleotide
gactacatcaccggctacatcggcagtc

SEQ ID NO: 266387 - DNA, 29 bp, Artificial Sequence
  Description of Artificial Sequence: Synthetic oligonucleotide
actacatcaccggctacatcggcagtctg

SEQ ID NO: 266388 - DNA, 28 bp, Artificial Sequence
  Description of Artificial Sequence: Synthetic oligonucleotide
ctacatcaccggctacatcggcagtctg

SEQ ID NO: 266389 - DNA, 30 bp, Artificial Sequence
  Description of Artificial Sequence: Synthetic oligonucleotide
tacatcaccggctacatcggcagtctgaac

SEQ ID NO: 266390 - DNA, 29 bp, Artificial Sequence
  Description of Artificial Sequence: Synthetic oligonucleotide
acatcaccggctacatcggcagtctgaac

SEQ ID NO: 266391 - DNA, 28 bp, Artificial Sequence
  Description of Artificial Sequence: Synthetic oligonucleotide
catcaccggctacatcggcagtctgaac

SEQ ID NO: 266392 - DNA, 28 bp, Artificial Sequence
  Description of Artificial Sequence: Synthetic oligonucleotide
atcaccggctacatcggcagtctgaacc

SEQ ID NO: 266393 - DNA, 27 bp, Artificial Sequence
  Description of Artificial Sequence: Synthetic oligonucleotide
tcaccggctacatcggcagtctgaacc

SEQ ID NO: 266394 - DNA, 27 bp, Artificial Sequence
  Description of Artificial Sequence: Synthetic oligonucleotide
caccggctacatcggcagtctgaacca

SEQ ID NO: 266395 - DNA, 27 bp, Artificial Sequence
  Description of Artificial Sequence: Synthetic oligonucleotide
accggctacatcggcagtctgaaccag

SEQ ID NO: 266396 - DNA, 26 bp, Artificial Sequence
  Description of Artificial Sequence: Synthetic oligonucleotide
ccggctacatcggcagtctgaaccag

SEQ ID NO: 266397 - DNA, 26 bp, Artificial Sequence
  Description of Artificial Sequence: Synthetic oligonucleotide
cggctacatcggcagtctgaaccagc

SEQ ID NO: 266398 - DNA, 27 bp, Artificial Sequence
  Description of Artificial Sequence: Synthetic oligonucleotide
ggctacatcggcagtctgaaccagcgt

SEQ ID NO: 266399 - DNA, 31 bp, Artificial Sequence
  Description of Artificial Sequence: Synthetic oligonucleotide
gctacatcggcagtctgaaccagcgttattc

SEQ ID NO: 266400 - DNA, 31 bp, Artificial Sequence
  Description of Artificial Sequence: Synthetic oligonucleotide
ctacatcggcagtctgaaccagcgttattcg

SEQ ID NO: 266401 - DNA, 31 bp, Artificial Sequence
  Description of Artificial Sequence: Synthetic oligonucleotide
tacatcggcagtctgaaccagcgttattcgc

SEQ ID NO: 266402 - DNA, 30 bp, Artificial Sequence
  Description of Artificial Sequence: Synthetic oligonucleotide
acatcggcagtctgaaccagcgttattcgc

SEQ ID NO: 266403 - DNA, 29 bp, Artificial Sequence
  Description of Artificial Sequence: Synthetic oligonucleotide
catcggcagtctgaaccagcgttattcgc

SEQ ID NO: 266404 - DNA, 30 bp, Artificial Sequence
  Description of Artificial Sequence: Synthetic oligonucleotide
atcggcagtctgaaccagcgttattcgcag

SEQ ID NO: 266405 - DNA, 29 bp, Artificial Sequence
  Description of Artificial Sequence: Synthetic oligonucleotide
tcggcagtctgaaccagcgttattcgcag

SEQ ID NO: 266406 - DNA, 28 bp, Artificial Sequence
  Description of Artificial Sequence: Synthetic oligonucleotide
cggcagtctgaaccagcgttattcgcag

SEQ ID NO: 266407 - DNA, 29 bp, Artificial Sequence
  Description of Artificial Sequence: Synthetic oligonucleotide
ggcagtctgaaccagcgttattcgcagag

SEQ ID NO: 266408 - DNA, 29 bp, Artificial Sequence
  Description of Artificial Sequence: Synthetic oligonucleotide
gcagtctgaaccagcgttattcgcagagc

SEQ ID NO: 266409 - DNA, 32 bp, Artificial Sequence
  Description of Artificial Sequence: Synthetic oligonucleotide
cagtctgaaccagcgttattcgcagagcattg

SEQ ID NO: 266410 - DNA, 32 bp, Artificial Sequence
  Description of Artificial Sequence: Synthetic oligonucleotide
agtctgaaccagcgttattcgcagagcattgg

SEQ ID NO: 266411 - DNA, 31 bp, Artificial Sequence
  Description of Artificial Sequence: Synthetic oligonucleotide
gtctgaaccagcgttattcgcagagcattgg

SEQ ID NO: 266412 - DNA, 31 bp, Artificial Sequence
  Description of Artificial Sequence: Synthetic oligonucleotide
tctgaaccagcgttattcgcagagcattggg

SEQ ID NO: 266413 - DNA, 30 bp, Artificial Sequence
  Description of Artificial Sequence: Synthetic oligonucleotide
ctgaaccagcgttattcgcagagcattggg

SEQ ID NO: 266414 - DNA, 30 bp, Artificial Sequence
  Description of Artificial Sequence: Synthetic oligonucleotide
tgaaccagcgttattcgcagagcattgggc

SEQ ID NO: 266415 - DNA, 29 bp, Artificial Sequence
  Description of Artificial Sequence: Synthetic oligonucleotide
gaaccagcgttattcgcagagcattgggc

SEQ ID NO: 266416 - DNA, 29 bp, Artificial Sequence
  Description of Artificial Sequence: Synthetic oligonucleotide
aaccagcgttattcgcagagcattgggcg

SEQ ID NO: 266417 - DNA, 28 bp, Artificial Sequence
  Description of Artificial Sequence: Synthetic oligonucleotide
accagcgttattcgcagagcattgggcg

SEQ ID NO: 266418 - DNA, 27 bp, Artificial Sequence
  Description of Artificial Sequence: Synthetic oligonucleotide
ccagcgttattcgcagagcattgggcg

SEQ ID NO: 266419 - DNA, 27 bp, Artificial Sequence
  Description of Artificial Sequence: Synthetic oligonucleotide
cagcgttattcgcagagcattgggcgc

SEQ ID NO: 266420 - DNA, 28 bp, Artificial Sequence
  Description of Artificial Sequence: Synthetic oligonucleotide
agcgttattcgcagagcattgggcgcag

SEQ ID NO: 266421 - DNA, 27 bp, Artificial Sequence
  Description of Artificial Sequence: Synthetic oligonucleotide
gcgttattcgcagagcattgggcgcag

SEQ ID NO: 266422 - DNA, 27 bp, Artificial Sequence
  Description of Artificial Sequence: Synthetic oligonucleotide
cgttattcgcagagcattgggcgcagc

SEQ ID NO: 266423 - DNA, 27 bp, Artificial Sequence
  Description of Artificial Sequence: Synthetic oligonucleotide
gttattcgcagagcattgggcgcagcc

SEQ ID NO: 266424 - DNA, 27 bp, Artificial Sequence
  Description of Artificial Sequence: Synthetic oligonucleotide
ttattcgcagagcattgggcgcagccc

SEQ ID NO: 266425 - DNA, 26 bp, Artificial Sequence
  Description of Artificial Sequence: Synthetic oligonucleotide
tattcgcagagcattgggcgcagccc

SEQ ID NO: 266426 - DNA, 25 bp, Artificial Sequence
  Description of Artificial Sequence: Synthetic oligonucleotide
attcgcagagcattgggcgcagccc

SEQ ID NO: 266427 - DNA, 24 bp, Artificial Sequence
  Description of Artificial Sequence: Synthetic oligonucleotide
ttcgcagagcattgggcgcagccc

SEQ ID NO: 266428 - DNA, 23 bp, Artificial Sequence
  Description of Artificial Sequence: Synthetic oligonucleotide
tcgcagagcattgggcgcagccc

SEQ ID NO: 266429 - DNA, 22 bp, Artificial Sequence
  Description of Artificial Sequence: Synthetic oligonucleotide
cgcagagcattgggcgcagccc

SEQ ID NO: 266430 - DNA, 25 bp, Artificial Sequence
  Description of Artificial Sequence: Synthetic oligonucleotide
gcagagcattgggcgcagcccgttt

SEQ ID NO: 266431 - DNA, 25 bp, Artificial Sequence
  Description of Artificial Sequence: Synthetic oligonucleotide
cagagcattgggcgcagcccgtttg

SEQ ID NO: 266432 - DNA, 25 bp, Artificial Sequence
  Description of Artificial Sequence: Synthetic oligonucleotide
agagcattgggcgcagcccgtttgg

SEQ ID NO: 266433 - DNA, 24 bp, Artificial Sequence
  Description of Artificial Sequence: Synthetic oligonucleotide
gagcattgggcgcagcccgtttgg

SEQ ID NO: 266434 - DNA, 26 bp, Artificial Sequence
  Description of Artificial Sequence: Synthetic oligonucleotide
agcattgggcgcagcccgtttggctt

SEQ ID NO: 266435 - DNA, 25 bp, Artificial Sequence
  Description of Artificial Sequence: Synthetic oligonucleotide
gcattgggcgcagcccgtttggctt

SEQ ID NO: 266436 - DNA, 26 bp, Artificial Sequence
  Description of Artificial Sequence: Synthetic oligonucleotide
cattgggcgcagcccgtttggcttct

SEQ ID NO: 266437 - DNA, 27 bp, Artificial Sequence
  Description of Artificial Sequence: Synthetic oligonucleotide
attgggcgcagcccgtttggcttctct

SEQ ID NO: 266438 - DNA, 26 bp, Artificial Sequence
  Description of Artificial Sequence: Synthetic oligonucleotide
ttgggcgcagcccgtttggcttctct

SEQ ID NO: 266439 - DNA, 25 bp, Artificial Sequence
  Description of Artificial Sequence: Synthetic oligonucleotide
tgggcgcagcccgtttggcttctct

SEQ ID NO: 266440 - DNA, 24 bp, Artificial Sequence
  Description of Artificial Sequence: Synthetic oligonucleotide
gggcgcagcccgtttggcttctct

SEQ ID NO: 266441 - DNA, 24 bp, Artificial Sequence
  Description of Artificial Sequence: Synthetic oligonucleotide
ggcgcagcccgtttggcttctctg

SEQ ID NO: 266442 - DNA, 24 bp, Artificial Sequence
  Description of Artificial Sequence: Synthetic oligonucleotide
gcgcagcccgtttggcttctctgc

SEQ ID NO: 266443 - DNA, 24 bp, Artificial Sequence
  Description of Artificial Sequence: Synthetic oligonucleotide
cgcagcccgtttggcttctctgcc

SEQ ID NO: 266444 - DNA, 25 bp, Artificial Sequence
  Description of Artificial Sequence: Synthetic oligonucleotide
gcagcccgtttggcttctctgccca

SEQ ID NO: 266445 - DNA, 27 bp, Artificial Sequence
  Description of Artificial Sequence: Synthetic oligonucleotide
cagcccgtttggcttctctgcccacat

SEQ ID NO: 266446 - DNA, 27 bp, Artificial Sequence
  Description of Artificial Sequence: Synthetic oligonucleotide
agcccgtttggcttctctgcccacatc

SEQ ID NO: 266447 - DNA, 26 bp, Artificial Sequence
  Description of Artificial Sequence: Synthetic oligonucleotide
gcccgtttggcttctctgcccacatc

SEQ ID NO: 266448 - DNA, 27 bp, Artificial Sequence
  Description of Artificial Sequence: Synthetic oligonucleotide
cccgtttggcttctctgcccacatcgt

SEQ ID NO: 266449 - DNA, 27 bp, Artificial Sequence
  Description of Artificial Sequence: Synthetic oligonucleotide
ccgtttggcttctctgcccacatcgtg

SEQ ID NO: 266450 - DNA, 27 bp, Artificial Sequence
  Description of Artificial Sequence: Synthetic oligonucleotide
cgtttggcttctctgcccacatcgtgg

SEQ ID NO: 266451 - DNA, 27 bp, Artificial Sequence
  Description of Artificial Sequence: Synthetic oligonucleotide
gtttggcttctctgcccacatcgtggg

SEQ ID NO: 266452 - DNA, 30 bp, Artificial Sequence
  Description of Artificial Sequence: Synthetic oligonucleotide
tttggcttctctgcccacatcgtgggattc

SEQ ID NO: 266453 - DNA, 29 bp, Artificial Sequence
  Description of Artificial Sequence: Synthetic oligonucleotide
ttggcttctctgcccacatcgtgggattc

SEQ ID NO: 266454 - DNA, 28 bp, Artificial Sequence
  Description of Artificial Sequence: Synthetic oligonucleotide
tggcttctctgcccacatcgtgggattc

SEQ ID NO: 266455 - DNA, 27 bp, Artificial Sequence
  Description of Artificial Sequence: Synthetic oligonucleotide
ggcttctctgcccacatcgtgggattc

SEQ ID NO: 266456 - DNA, 27 bp, Artificial Sequence
  Description of Artificial Sequence: Synthetic oligonucleotide
gcttctctgcccacatcgtgggattcg

SEQ ID NO: 266457 - DNA, 28 bp, Artificial Sequence
  Description of Artificial Sequence: Synthetic oligonucleotide
cttctctgcccacatcgtgggattcgac

SEQ ID NO: 266458 - DNA, 31 bp, Artificial Sequence
  Description of Artificial Sequence: Synthetic oligonucleotide
ttctctgcccacatcgtgggattcgactttc

SEQ ID NO: 266459 - DNA, 30 bp, Artificial Sequence
  Description of Artificial Sequence: Synthetic oligonucleotide
tctctgcccacatcgtgggattcgactttc

SEQ ID NO: 266460 - DNA, 29 bp, Artificial Sequence
  Description of Artificial Sequence: Synthetic oligonucleotide
ctctgcccacatcgtgggattcgactttc

SEQ ID NO: 266461 - DNA, 31 bp, Artificial Sequence
  Description of Artificial Sequence: Synthetic oligonucleotide
tctgcccacatcgtgggattcgactttcatg

SEQ ID NO: 266462 - DNA, 30 bp, Artificial Sequence
  Description of Artificial Sequence: Synthetic oligonucleotide
ctgcccacatcgtgggattcgactttcatg

SEQ ID NO: 266463 - DNA, 30 bp, Artificial Sequence
  Description of Artificial Sequence: Synthetic oligonucleotide
tgcccacatcgtgggattcgactttcatgg

SEQ ID NO: 266464 - DNA, 29 bp, Artificial Sequence
  Description of Artificial Sequence: Synthetic oligonucleotide
gcccacatcgtgggattcgactttcatgg

SEQ ID NO: 266465 - DNA, 29 bp, Artificial Sequence
  Description of Artificial Sequence: Synthetic oligonucleotide
cccacatcgtgggattcgactttcatggc

SEQ ID NO: 266466 - DNA, 30 bp, Artificial Sequence
  Description of Artificial Sequence: Synthetic oligonucleotide
ccacatcgtgggattcgactttcatggcac

SEQ ID NO: 266467 - DNA, 31 bp, Artificial Sequence
  Description of Artificial Sequence: Synthetic oligonucleotide
cacatcgtgggattcgactttcatggcactc

SEQ ID NO: 266468 - DNA, 31 bp, Artificial Sequence
  Description of Artificial Sequence: Synthetic oligonucleotide
acatcgtgggattcgactttcatggcactcg

SEQ ID NO: 266469 - DNA, 30 bp, Artificial Sequence
  Description of Artificial Sequence: Synthetic oligonucleotide
catcgtgggattcgactttcatggcactcg

SEQ ID NO: 266470 - DNA, 32 bp, Artificial Sequence
  Description of Artificial Sequence: Synthetic oligonucleotide
atcgtgggattcgactttcatggcactcgtag

SEQ ID NO: 266471 - DNA, 31 bp, Artificial Sequence
  Description of Artificial Sequence: Synthetic oligonucleotide
tcgtgggattcgactttcatggcactcgtag

SEQ ID NO: 266472 - DNA, 30 bp, Artificial Sequence
  Description of Artificial Sequence: Synthetic oligonucleotide
cgtgggattcgactttcatggcactcgtag

SEQ ID NO: 266473 - DNA, 30 bp, Artificial Sequence
  Description of Artificial Sequence: Synthetic oligonucleotide
gtgggattcgactttcatggcactcgtagg

SEQ ID NO: 266474 - DNA, 30 bp, Artificial Sequence
  Description of Artificial Sequence: Synthetic oligonucleotide
tgggattcgactttcatggcactcgtaggc

SEQ ID NO: 266475 - DNA, 29 bp, Artificial Sequence
  Description of Artificial Sequence: Synthetic oligonucleotide
gggattcgactttcatggcactcgtaggc

SEQ ID NO: 266476 - DNA, 30 bp, Artificial Sequence
  Description of Artificial Sequence: Synthetic oligonucleotide
ggattcgactttcatggcactcgtaggctc

SEQ ID NO: 266477 - DNA, 33 bp, Artificial Sequence
  Description of Artificial Sequence: Synthetic oligonucleotide
gattcgactttcatggcactcgtaggctctaac

SEQ ID NO: 266478 - DNA, 34 bp, Artificial Sequence
  Description of Artificial Sequence: Synthetic oligonucleotide
attcgactttcatggcactcgtaggctctaacag

SEQ ID NO: 266479 - DNA, 33 bp, Artificial Sequence
  Description of Artificial Sequence: Synthetic oligonucleotide
ttcgactttcatggcactcgtaggctctaacag

SEQ ID NO: 266480 - DNA, 32 bp, Artificial Sequence
  Description of Artificial Sequence: Synthetic oligonucleotide
tcgactttcatggcactcgtaggctctaacag

SEQ ID NO: 266481 - DNA, 31 bp, Artificial Sequence
  Description of Artificial Sequence: Synthetic oligonucleotide
cgactttcatggcactcgtaggctctaacag

SEQ ID NO: 266482 - DNA, 32 bp, Artificial Sequence
  Description of Artificial Sequence: Synthetic oligonucleotide
gactttcatggcactcgtaggctctaacagac

SEQ ID NO: 266483 - DNA, 33 bp, Artificial Sequence
  Description of Artificial Sequence: Synthetic oligonucleotide
actttcatggcactcgtaggctctaacagactg

SEQ ID NO: 266484 - DNA, 32 bp, Artificial Sequence
  Description of Artificial Sequence: Synthetic oligonucleotide
ctttcatggcactcgtaggctctaacagactg

SEQ ID NO: 266485 - DNA, 33 bp, Artificial Sequence
  Description of Artificial Sequence: Synthetic oligonucleotide
tttcatggcactcgtaggctctaacagactgac

SEQ ID NO: 266486 - DNA, 32 bp, Artificial Sequence
  Description of Artificial Sequence: Synthetic oligonucleotide
ttcatggcactcgtaggctctaacagactgac

SEQ ID NO: 266487 - DNA, 31 bp, Artificial Sequence
  Description of Artificial Sequence: Synthetic oligonucleotide
tcatggcactcgtaggctctaacagactgac

SEQ ID NO: 266488 - DNA, 30 bp, Artificial Sequence
  Description of Artificial Sequence: Synthetic oligonucleotide
catggcactcgtaggctctaacagactgac

SEQ ID NO: 266489 - DNA, 30 bp, Artificial Sequence
  Description of Artificial Sequence: Synthetic oligonucleotide
atggcactcgtaggctctaacagactgacg

SEQ ID NO: 266490 - DNA, 29 bp, Artificial Sequence
  Description of Artificial Sequence: Synthetic oligonucleotide
tggcactcgtaggctctaacagactgacg

SEQ ID NO: 266491 - DNA, 28 bp, Artificial Sequence
  Description of Artificial Sequence: Synthetic oligonucleotide
ggcactcgtaggctctaacagactgacg

SEQ ID NO: 266492 - DNA, 28 bp, Artificial Sequence
  Description of Artificial Sequence: Synthetic oligonucleotide
gcactcgtaggctctaacagactgacgc

SEQ ID NO: 266493 - DNA, 28 bp, Artificial Sequence
  Description of Artificial Sequence: Synthetic oligonucleotide
cactcgtaggctctaacagactgacgcc

SEQ ID NO: 266494 - DNA, 29 bp, Artificial Sequence
  Description of Artificial Sequence: Synthetic oligonucleotide
actcgtaggctctaacagactgacgcctc

SEQ ID NO: 266495 - DNA, 28 bp, Artificial Sequence
  Description of Artificial Sequence: Synthetic oligonucleotide
ctcgtaggctctaacagactgacgcctc

SEQ ID NO: 266496 - DNA, 28 bp, Artificial Sequence
  Description of Artificial Sequence: Synthetic oligonucleotide
tcgtaggctctaacagactgacgcctcg

SEQ ID NO: 266497 - DNA, 27 bp, Artificial Sequence
  Description of Artificial Sequence: Synthetic oligonucleotide
cgtaggctctaacagactgacgcctcg

SEQ ID NO: 266498 - DNA, 27 bp, Artificial Sequence
  Description of Artificial Sequence: Synthetic oligonucleotide
gtaggctctaacagactgacgcctcgg

SEQ ID NO: 266499 - DNA, 27 bp, Artificial Sequence
  Description of Artificial Sequence: Synthetic oligonucleotide
taggctctaacagactgacgcctcggg

SEQ ID NO: 266500 - DNA, 26 bp, Artificial Sequence
  Description of Artificial Sequence: Synthetic oligonucleotide
aggctctaacagactgacgcctcggg

SEQ ID NO: 266501 - DNA, 25 bp, Artificial Sequence
  Description of Artificial Sequence: Synthetic oligonucleotide
ggctctaacagactgacgcctcggg

SEQ ID NO: 266502 - DNA, 26 bp, Artificial Sequence
  Description of Artificial Sequence: Synthetic oligonucleotide
gctctaacagactgacgcctcgggca

SEQ ID NO: 266503 - DNA, 27 bp, Artificial Sequence
  Description of Artificial Sequence: Synthetic oligonucleotide
ctctaacagactgacgcctcgggcaga

SEQ ID NO: 266504 - DNA, 29 bp, Artificial Sequence
  Description of Artificial Sequence: Synthetic oligonucleotide
tctaacagactgacgcctcgggcagatac

SEQ ID NO: 266505 - DNA, 28 bp, Artificial Sequence
  Description of Artificial Sequence: Synthetic oligonucleotide
ctaacagactgacgcctcgggcagatac

SEQ ID NO: 266506 - DNA, 28 bp, Artificial Sequence
  Description of Artificial Sequence: Synthetic oligonucleotide
taacagactgacgcctcgggcagatacc

SEQ ID NO: 266507 - DNA, 27 bp, Artificial Sequence
  Description of Artificial Sequence: Synthetic oligonucleotide
aacagactgacgcctcgggcagatacc

SEQ ID NO: 266508 - DNA, 27 bp, Artificial Sequence
  Description of Artificial Sequence: Synthetic oligonucleotide
acagactgacgcctcgggcagatacca

SEQ ID NO: 266509 - DNA, 27 bp, Artificial Sequence
  Description of Artificial Sequence: Synthetic oligonucleotide
cagactgacgcctcgggcagataccat

SEQ ID NO: 266510 - DNA, 27 bp, Artificial Sequence
  Description of Artificial Sequence: Synthetic oligonucleotide
agactgacgcctcgggcagataccatg

SEQ ID NO: 266511 - DNA, 26 bp, Artificial Sequence
  Description of Artificial Sequence: Synthetic oligonucleotide
gactgacgcctcgggcagataccatg

SEQ ID NO: 266512 - DNA, 26 bp, Artificial Sequence
  Description of Artificial Sequence: Synthetic oligonucleotide
actgacgcctcgggcagataccatgc

SEQ ID NO: 266513 - DNA, 25 bp, Artificial Sequence
  Description of Artificial Sequence: Synthetic oligonucleotide
ctgacgcctcgggcagataccatgc

SEQ ID NO: 266514 - DNA, 26 bp, Artificial Sequence
  Description of Artificial Sequence: Synthetic oligonucleotide
tgacgcctcgggcagataccatgcgt

SEQ ID NO: 266515 - DNA, 25 bp, Artificial Sequence
  Description of Artificial Sequence: Synthetic oligonucleotide
gacgcctcgggcagataccatgcgt

SEQ ID NO: 266516 - DNA, 25 bp, Artificial Sequence
  Description of Artificial Sequence: Synthetic oligonucleotide
acgcctcgggcagataccatgcgtg

SEQ ID NO: 266517 - DNA, 24 bp, Artificial Sequence
  Description of Artificial Sequence: Synthetic oligonucleotide
cgcctcgggcagataccatgcgtg

SEQ ID NO: 266518 - DNA, 26 bp, Artificial Sequence
  Description of Artificial Sequence: Synthetic oligonucleotide
gcctcgggcagataccatgcgtggaa

SEQ ID NO: 266519 - DNA, 26 bp, Artificial Sequence
  Description of Artificial Sequence: Synthetic oligonucleotide
cctcgggcagataccatgcgtggaag

SEQ ID NO: 266520 - DNA, 26 bp, Artificial Sequence
  Description of Artificial Sequence: Synthetic oligonucleotide
ctcgggcagataccatgcgtggaagg

SEQ ID NO: 266521 - DNA, 26 bp, Artificial Sequence
  Description of Artificial Sequence: Synthetic oligonucleotide
tcgggcagataccatgcgtggaaggc

SEQ ID NO: 266522 - DNA, 25 bp, Artificial Sequence
  Description of Artificial Sequence: Synthetic oligonucleotide
cgggcagataccatgcgtggaaggc

SEQ ID NO: 266523 - DNA, 27 bp, Artificial Sequence
  Description of Artificial Sequence: Synthetic oligonucleotide
gggcagataccatgcgtggaaggccta

SEQ ID NO: 266524 - DNA, 28 bp, Artificial Sequence
  Description of Artificial Sequence: Synthetic oligonucleotide
ggcagataccatgcgtggaaggcctatg

SEQ ID NO: 266525 - DNA, 28 bp, Artificial Sequence
  Description of Artificial Sequence: Synthetic oligonucleotide
gcagataccatgcgtggaaggcctatgc

SEQ ID NO: 266526 - DNA, 28 bp, Artificial Sequence
  Description of Artificial Sequence: Synthetic oligonucleotide
cagataccatgcgtggaaggcctatgcc

SEQ ID NO: 266527 - DNA, 31 bp, Artificial Sequence
  Description of Artificial Sequence: Synthetic oligonucleotide
agataccatgcgtggaaggcctatgccatag

SEQ ID NO: 266528 - DNA, 30 bp, Artificial Sequence
  Description of Artificial Sequence: Synthetic oligonucleotide
gataccatgcgtggaaggcctatgccatag

SEQ ID NO: 266529 - DNA, 30 bp, Artificial Sequence
  Description of Artificial Sequence: Synthetic oligonucleotide
ataccatgcgtggaaggcctatgccatagc

SEQ ID NO: 266530 - DNA, 29 bp, Artificial Sequence
  Description of Artificial Sequence: Synthetic oligonucleotide
taccatgcgtggaaggcctatgccatagc

SEQ ID NO: 266531 - DNA, 28 bp, Artificial Sequence
  Description of Artificial Sequence: Synthetic oligonucleotide
accatgcgtggaaggcctatgccatagc

SEQ ID NO: 266532 - DNA, 27 bp, Artificial Sequence
  Description of Artificial Sequence: Synthetic oligonucleotide
ccatgcgtggaaggcctatgccatagc

SEQ ID NO: 266533 - DNA, 28 bp, Artificial Sequence
  Description of Artificial Sequence: Synthetic oligonucleotide
catgcgtggaaggcctatgccatagctc

SEQ ID NO: 266534 - DNA, 28 bp, Artificial Sequence
  Description of Artificial Sequence: Synthetic oligonucleotide
atgcgtggaaggcctatgccatagctcg

SEQ ID NO: 266535 - DNA, 27 bp, Artificial Sequence
  Description of Artificial Sequence: Synthetic oligonucleotide
tgcgtggaaggcctatgccatagctcg

SEQ ID NO: 266536 - DNA, 26 bp, Artificial Sequence
  Description of Artificial Sequence: Synthetic oligonucleotide
gcgtggaaggcctatgccatagctcg

SEQ ID NO: 266537 - DNA, 26 bp, Artificial Sequence
  Description of Artificial Sequence: Synthetic oligonucleotide
cgtggaaggcctatgccatagctcgg

SEQ ID NO: 266538 - DNA, 26 bp, Artificial Sequence
  Description of Artificial Sequence: Synthetic oligonucleotide
gtggaaggcctatgccatagctcggg

SEQ ID NO: 266539 - DNA, 27 bp, Artificial Sequence
  Description of Artificial Sequence: Synthetic oligonucleotide
tggaaggcctatgccatagctcggggt

SEQ ID NO: 266540 - DNA, 26 bp, Artificial Sequence
  Description of Artificial Sequence: Synthetic oligonucleotide
ggaaggcctatgccatagctcggggt

SEQ ID NO: 266541 - DNA, 26 bp, Artificial Sequence
  Description of Artificial Sequence: Synthetic oligonucleotide
gaaggcctatgccatagctcggggtg

SEQ ID NO: 266542 - DNA, 26 bp, Artificial Sequence
  Description of Artificial Sequence: Synthetic oligonucleotide
aaggcctatgccatagctcggggtgc

SEQ ID NO: 266543 - DNA, 25 bp, Artificial Sequence
  Description of Artificial Sequence: Synthetic oligonucleotide
aggcctatgccatagctcggggtgc

SEQ ID NO: 266544 - DNA, 24 bp, Artificial Sequence
  Description of Artificial Sequence: Synthetic oligonucleotide
ggcctatgccatagctcggggtgc

SEQ ID NO: 266545 - DNA, 26 bp, Artificial Sequence
  Description of Artificial Sequence: Synthetic oligonucleotide
gcctatgccatagctcggggtgcgaa

SEQ ID NO: 266546 - DNA, 27 bp, Artificial Sequence
  Description of Artificial Sequence: Synthetic oligonucleotide
cctatgccatagctcggggtgcgaagt

SEQ ID NO: 266547 - DNA, 27 bp, Artificial Sequence
  Description of Artificial Sequence: Synthetic oligonucleotide
ctatgccatagctcggggtgcgaagtc

SEQ ID NO: 266548 - DNA, 28 bp, Artificial Sequence
  Description of Artificial Sequence: Synthetic oligonucleotide
tatgccatagctcggggtgcgaagtcag

SEQ ID NO: 266549 - DNA, 27 bp, Artificial Sequence
  Description of Artificial Sequence: Synthetic oligonucleotide
atgccatagctcggggtgcgaagtcag

SEQ ID NO: 266550 - DNA, 27 bp, Artificial Sequence
  Description of Artificial Sequence: Synthetic oligonucleotide
tgccatagctcggggtgcgaagtcagt

SEQ ID NO: 266551 - DNA, 26 bp, Artificial Sequence
  Description of Artificial Sequence: Synthetic oligonucleotide
gccatagctcggggtgcgaagtcagt

SEQ ID NO: 266552 - DNA, 26 bp, Artificial Sequence
  Description of Artificial Sequence: Synthetic oligonucleotide
ccatagctcggggtgcgaagtcagtg

SEQ ID NO: 266553 - DNA, 26 bp, Artificial Sequence
  Description of Artificial Sequence: Synthetic oligonucleotide
catagctcggggtgcgaagtcagtgg

SEQ ID NO: 266554 - DNA, 26 bp, Artificial Sequence
  Description of Artificial Sequence: Synthetic oligonucleotide
atagctcggggtgcgaagtcagtggg

SEQ ID NO: 266555 - DNA, 25 bp, Artificial Sequence
  Description of Artificial Sequence: Synthetic oligonucleotide
tagctcggggtgcgaagtcagtggg

SEQ ID NO: 266556 - DNA, 24 bp, Artificial Sequence
  Description of Artificial Sequence: Synthetic oligonucleotide
agctcggggtgcgaagtcagtggg

SEQ ID NO: 266557 - DNA, 23 bp, Artificial Sequence
  Description of Artificial Sequence: Synthetic oligonucleotide
gctcggggtgcgaagtcagtggg

SEQ ID NO: 266558 - DNA, 23 bp, Artificial Sequence
  Description of Artificial Sequence: Synthetic oligonucleotide
ctcggggtgcgaagtcagtgggc

SEQ ID NO: 266559 - DNA, 24 bp, Artificial Sequence
  Description of Artificial Sequence: Synthetic oligonucleotide
tcggggtgcgaagtcagtgggcga

SEQ ID NO: 266560 - DNA, 23 bp, Artificial Sequence
  Description of Artificial Sequence: Synthetic oligonucleotide
cggggtgcgaagtcagtgggcga

SEQ ID NO: 266561 - DNA, 25 bp, Artificial Sequence
  Description of Artificial Sequence: Synthetic oligonucleotide
ggggtgcgaagtcagtgggcgagtt

SEQ ID NO: 266562 - DNA, 25 bp, Artificial Sequence
  Description of Artificial Sequence: Synthetic oligonucleotide
gggtgcgaagtcagtgggcgagttc

SEQ ID NO: 266563 - DNA, 26 bp, Artificial Sequence
  Description of Artificial Sequence: Synthetic oligonucleotide
ggtgcgaagtcagtgggcgagttcca

SEQ ID NO: 266564 - DNA, 26 bp, Artificial Sequence
  Description of Artificial Sequence: Synthetic oligonucleotide
gtgcgaagtcagtgggcgagttccag

SEQ ID NO: 266565 - DNA, 27 bp, Artificial Sequence
  Description of Artificial Sequence: Synthetic oligonucleotide
tgcgaagtcagtgggcgagttccagga

SEQ ID NO: 266566 - DNA, 26 bp, Artificial Sequence
  Description of Artificial Sequence: Synthetic oligonucleotide
gcgaagtcagtgggcgagttccagga

SEQ ID NO: 266567 - DNA, 27 bp, Artificial Sequence
  Description of Artificial Sequence: Synthetic oligonucleotide
cgaagtcagtgggcgagttccaggaga

SEQ ID NO: 266568 - DNA, 28 bp, Artificial Sequence
  Description of Artificial Sequence: Synthetic oligonucleotide
gaagtcagtgggcgagttccaggagaag

SEQ ID NO: 266569 - DNA, 30 bp, Artificial Sequence
  Description of Artificial Sequence: Synthetic oligonucleotide
aagtcagtgggcgagttccaggagaagaag

SEQ ID NO: 266570 - DNA, 29 bp, Artificial Sequence
  Description of Artificial Sequence: Synthetic oligonucleotide
agtcagtgggcgagttccaggagaagaag

SEQ ID NO: 266571 - DNA, 28 bp, Artificial Sequence
  Description of Artificial Sequence: Synthetic oligonucleotide
gtcagtgggcgagttccaggagaagaag

SEQ ID NO: 266572 - DNA, 32 bp, Artificial Sequence
  Description of Artificial Sequence: Synthetic oligonucleotide
tcagtgggcgagttccaggagaagaagtatac

SEQ ID NO: 266573 - DNA, 31 bp, Artificial Sequence
  Description of Artificial Sequence: Synthetic oligonucleotide
cagtgggcgagttccaggagaagaagtatac

SEQ ID NO: 266574 - DNA, 32 bp, Artificial Sequence
  Description of Artificial Sequence: Synthetic oligonucleotide
agtgggcgagttccaggagaagaagtatactg

SEQ ID NO: 266575 - DNA, 31 bp, Artificial Sequence
  Description of Artificial Sequence: Synthetic oligonucleotide
gtgggcgagttccaggagaagaagtatactg

SEQ ID NO: 266576 - DNA, 32 bp, Artificial Sequence
  Description of Artificial Sequence: Synthetic oligonucleotide
tgggcgagttccaggagaagaagtatactgac

SEQ ID NO: 266577 - DNA, 31 bp, Artificial Sequence
  Description of Artificial Sequence: Synthetic oligonucleotide
gggcgagttccaggagaagaagtatactgac

SEQ ID NO: 266578 - DNA, 31 bp, Artificial Sequence
  Description of Artificial Sequence: Synthetic oligonucleotide
ggcgagttccaggagaagaagtatactgacc

SEQ ID NO: 266579 - DNA, 33 bp, Artificial Sequence
  Description of Artificial Sequence: Synthetic oligonucleotide
gcgagttccaggagaagaagtatactgaccaag

SEQ ID NO: 266580 - DNA, 33 bp, Artificial Sequence
  Description of Artificial Sequence: Synthetic oligonucleotide
cgagttccaggagaagaagtatactgaccaagc

SEQ ID NO: 266581 - DNA, 33 bp, Artificial Sequence
  Description of Artificial Sequence: Synthetic oligonucleotide
gagttccaggagaagaagtatactgaccaagcc

SEQ ID NO: 266582 - DNA, 36 bp, Artificial Sequence
  Description of Artificial Sequence: Synthetic oligonucleotide
agttccaggagaagaagtatactgaccaagccattg

SEQ ID NO: 266583 - DNA, 35 bp, Artificial Sequence
  Description of Artificial Sequence: Synthetic oligonucleotide
gttccaggagaagaagtatactgaccaagccattg

SEQ ID NO: 266584 - DNA, 38 bp, Artificial Sequence
  Description of Artificial Sequence: Synthetic oligonucleotide
ttccaggagaagaagtatactgaccaagccattgtaac

SEQ ID NO: 266585 - DNA, 37 bp, Artificial Sequence
  Description of Artificial Sequence: Synthetic oligonucleotide
tccaggagaagaagtatactgaccaagccattgtaac

SEQ ID NO: 266586 - DNA, 36 bp, Artificial Sequence
  Description of Artificial Sequence: Synthetic oligonucleotide
ccaggagaagaagtatactgaccaagccattgtaac

SEQ ID NO: 266587 - DNA, 37 bp, Artificial Sequence
  Description of Artificial Sequence: Synthetic oligonucleotide
caggagaagaagtatactgaccaagccattgtaacag

SEQ ID NO: 266588 - DNA, 39 bp, Artificial Sequence
  Description of Artificial Sequence: Synthetic oligonucleotide
aggagaagaagtatactgaccaagccattgtaacagatg

SEQ ID NO: 266589 - DNA, 38 bp, Artificial Sequence
  Description of Artificial Sequence: Synthetic oligonucleotide
ggagaagaagtatactgaccaagccattgtaacagatg

SEQ ID NO: 266590 - DNA, 40 bp, Artificial Sequence
  Description of Artificial Sequence: Synthetic oligonucleotide
gagaagaagtatactgaccaagccattgtaacagatgaac

SEQ ID NO: 266591 - DNA, 41 bp, Artificial Sequence
  Description of Artificial Sequence: Synthetic oligonucleotide
agaagaagtatactgaccaagccattgtaacagatgaactg

SEQ ID NO: 266592 - DNA, 40 bp, Artificial Sequence
  Description of Artificial Sequence: Synthetic oligonucleotide
gaagaagtatactgaccaagccattgtaacagatgaactg

SEQ ID NO: 266593 - DNA, 41 bp, Artificial Sequence
  Description of Artificial Sequence: Synthetic oligonucleotide
aagaagtatactgaccaagccattgtaacagatgaactgac

SEQ ID NO: 266594 - DNA, 40 bp, Artificial Sequence
  Description of Artificial Sequence: Synthetic oligonucleotide
agaagtatactgaccaagccattgtaacagatgaactgac

SEQ ID NO: 266595 - DNA, 39 bp, Artificial Sequence
  Description of Artificial Sequence: Synthetic oligonucleotide
gaagtatactgaccaagccattgtaacagatgaactgac

SEQ ID NO: 266596 - DNA, 39 bp, Artificial Sequence
  Description of Artificial Sequence: Synthetic oligonucleotide
aagtatactgaccaagccattgtaacagatgaactgacc

SEQ ID NO: 266597 - DNA, 38 bp, Artificial Sequence
  Description of Artificial Sequence: Synthetic oligonucleotide
agtatactgaccaagccattgtaacagatgaactgacc

SEQ ID NO: 266598 - DNA, 37 bp, Artificial Sequence
  Description of Artificial Sequence: Synthetic oligonucleotide
gtatactgaccaagccattgtaacagatgaactgacc

SEQ ID NO: 266599 - DNA, 42 bp, Artificial Sequence
  Description of Artificial Sequence: Synthetic oligonucleotide
tatactgaccaagccattgtaacagatgaactgaccatttag

SEQ ID NO: 266600 - DNA, 41 bp, Artificial Sequence
  Description of Artificial Sequence: Synthetic oligonucleotide
atactgaccaagccattgtaacagatgaactgaccatttag

SEQ ID NO: 266601 - DNA, 40 bp, Artificial Sequence
  Description of Artificial Sequence: Synthetic oligonucleotide
tactgaccaagccattgtaacagatgaactgaccatttag

SEQ ID NO: 266602 - DNA, 39 bp, Artificial Sequence
  Description of Artificial Sequence: Synthetic oligonucleotide
actgaccaagccattgtaacagatgaactgaccatttag

SEQ ID NO: 266603 - DNA, 38 bp, Artificial Sequence
  Description of Artificial Sequence: Synthetic oligonucleotide
ctgaccaagccattgtaacagatgaactgaccatttag

SEQ ID NO: 266604 - DNA, 38 bp, Artificial Sequence
  Description of Artificial Sequence: Synthetic oligonucleotide
tgaccaagccattgtaacagatgaactgaccatttagc

SEQ ID NO: 266605 - DNA, 37 bp, Artificial Sequence
  Description of Artificial Sequence: Synthetic oligonucleotide
gaccaagccattgtaacagatgaactgaccatttagc

SEQ ID NO: 266606 - DNA, 38 bp, Artificial Sequence
  Description of Artificial Sequence: Synthetic oligonucleotide
accaagccattgtaacagatgaactgaccatttagctg

SEQ ID NO: 266607 - DNA, 37 bp, Artificial Sequence
  Description of Artificial Sequence: Synthetic oligonucleotide
ccaagccattgtaacagatgaactgaccatttagctg

SEQ ID NO: 266608 - DNA, 37 bp, Artificial Sequence
  Description of Artificial Sequence: Synthetic oligonucleotide
caagccattgtaacagatgaactgaccatttagctgg

SEQ ID NO: 266609 - DNA, 38 bp, Artificial Sequence
  Description of Artificial Sequence: Synthetic oligonucleotide
aagccattgtaacagatgaactgaccatttagctggtg

SEQ ID NO: 266610 - DNA, 37 bp, Artificial Sequence
  Description of Artificial Sequence: Synthetic oligonucleotide
agccattgtaacagatgaactgaccatttagctggtg

SEQ ID NO: 266611 - DNA, 36 bp, Artificial Sequence
  Description of Artificial Sequence: Synthetic oligonucleotide
gccattgtaacagatgaactgaccatttagctggtg

SEQ ID NO: 266612 - DNA, 38 bp, Artificial Sequence
  Description of Artificial Sequence: Synthetic oligonucleotide
ccattgtaacagatgaactgaccatttagctggtgaac

SEQ ID NO: 266613 - DNA, 40 bp, Artificial Sequence
  Description of Artificial Sequence: Synthetic oligonucleotide
cattgtaacagatgaactgaccatttagctggtgaacaag

SEQ ID NO: 266614 - DNA, 40 bp, Artificial Sequence
  Description of Artificial Sequence: Synthetic oligonucleotide
attgtaacagatgaactgaccatttagctggtgaacaagg

SEQ ID NO: 266615 - DNA, 39 bp, Artificial Sequence
  Description of Artificial Sequence: Synthetic oligonucleotide
ttgtaacagatgaactgaccatttagctggtgaacaagg

SEQ ID NO: 266616 - DNA, 38 bp, Artificial Sequence
  Description of Artificial Sequence: Synthetic oligonucleotide
tgtaacagatgaactgaccatttagctggtgaacaagg

SEQ ID NO: 266617 - DNA, 37 bp, Artificial Sequence
  Description of Artificial Sequence: Synthetic oligonucleotide
gtaacagatgaactgaccatttagctggtgaacaagg

SEQ ID NO: 266618 - DNA, 37 bp, Artificial Sequence
  Description of Artificial Sequence: Synthetic oligonucleotide
taacagatgaactgaccatttagctggtgaacaaggc

SEQ ID NO: 266619 - DNA, 36 bp, Artificial Sequence
  Description of Artificial Sequence: Synthetic oligonucleotide
aacagatgaactgaccatttagctggtgaacaaggc

SEQ ID NO: 266620 - DNA, 35 bp, Artificial Sequence
  Description of Artificial Sequence: Synthetic oligonucleotide
acagatgaactgaccatttagctggtgaacaaggc

SEQ ID NO: 266621 - DNA, 34 bp, Artificial Sequence
  Description of Artificial Sequence: Synthetic oligonucleotide
cagatgaactgaccatttagctggtgaacaaggc

SEQ ID NO: 266622 - DNA, 35 bp, Artificial Sequence
  Description of Artificial Sequence: Synthetic oligonucleotide
agatgaactgaccatttagctggtgaacaaggcac

SEQ ID NO: 266623 - DNA, 34 bp, Artificial Sequence
  Description of Artificial Sequence: Synthetic oligonucleotide
gatgaactgaccatttagctggtgaacaaggcac

SEQ ID NO: 266624 - DNA, 35 bp, Artificial Sequence
  Description of Artificial Sequence: Synthetic oligonucleotide
atgaactgaccatttagctggtgaacaaggcactg

SEQ ID NO: 266625 - DNA, 34 bp, Artificial Sequence
  Description of Artificial Sequence: Synthetic oligonucleotide
tgaactgaccatttagctggtgaacaaggcactg

SEQ ID NO: 266626 - DNA, 33 bp, Artificial Sequence
  Description of Artificial Sequence: Synthetic oligonucleotide
gaactgaccatttagctggtgaacaaggcactg

SEQ ID NO: 266627 - DNA, 33 bp, Artificial Sequence
  Description of Artificial Sequence: Synthetic oligonucleotide
aactgaccatttagctggtgaacaaggcactgc

SEQ ID NO: 266628 - DNA, 32 bp, Artificial Sequence
  Description of Artificial Sequence: Synthetic oligonucleotide
actgaccatttagctggtgaacaaggcactgc

SEQ ID NO: 266629 - DNA, 31 bp, Artificial Sequence
  Description of Artificial Sequence: Synthetic oligonucleotide
ctgaccatttagctggtgaacaaggcactgc

SEQ ID NO: 266630 - DNA, 32 bp, Artificial Sequence
  Description of Artificial Sequence: Synthetic oligonucleotide
tgaccatttagctggtgaacaaggcactgctg

SEQ ID NO: 266631 - DNA, 31 bp, Artificial Sequence
  Description of Artificial Sequence: Synthetic oligonucleotide
gaccatttagctggtgaacaaggcactgctg

SEQ ID NO: 266632 - DNA, 31 bp, Artificial Sequence
  Description of Artificial Sequence: Synthetic oligonucleotide
accatttagctggtgaacaaggcactgctgg

SEQ ID NO: 266633 - DNA, 30 bp, Artificial Sequence
  Description of Artificial Sequence: Synthetic oligonucleotide
ccatttagctggtgaacaaggcactgctgg

SEQ ID NO: 266634 - DNA, 32 bp, Artificial Sequence
  Description of Artificial Sequence: Synthetic oligonucleotide
catttagctggtgaacaaggcactgctggaag

SEQ ID NO: 266635 - DNA, 33 bp, Artificial Sequence
  Description of Artificial Sequence: Synthetic oligonucleotide
atttagctggtgaacaaggcactgctggaagtg

SEQ ID NO: 266636 - DNA, 32 bp, Artificial Sequence
  Description of Artificial Sequence: Synthetic oligonucleotide
tttagctggtgaacaaggcactgctggaagtg

SEQ ID NO: 266637 - DNA, 31 bp, Artificial Sequence
  Description of Artificial Sequence: Synthetic oligonucleotide
ttagctggtgaacaaggcactgctggaagtg

SEQ ID NO: 266638 - DNA, 30 bp, Artificial Sequence
  Description of Artificial Sequence: Synthetic oligonucleotide
tagctggtgaacaaggcactgctggaagtg

SEQ ID NO: 266639 - DNA, 29 bp, Artificial Sequence
  Description of Artificial Sequence: Synthetic oligonucleotide
agctggtgaacaaggcactgctggaagtg

SEQ ID NO: 266640 - DNA, 28 bp, Artificial Sequence
  Description of Artificial Sequence: Synthetic oligonucleotide
gctggtgaacaaggcactgctggaagtg

SEQ ID NO: 266641 - DNA, 28 bp, Artificial Sequence
  Description of Artificial Sequence: Synthetic oligonucleotide
ctggtgaacaaggcactgctggaagtgc

SEQ ID NO: 266642 - DNA, 30 bp, Artificial Sequence
  Description of Artificial Sequence: Synthetic oligonucleotide
tggtgaacaaggcactgctggaagtgcttc

SEQ ID NO: 266643 - DNA, 29 bp, Artificial Sequence
  Description of Artificial Sequence: Synthetic oligonucleotide
ggtgaacaaggcactgctggaagtgcttc

SEQ ID NO: 266644 - DNA, 30 bp, Artificial Sequence
  Description of Artificial Sequence: Synthetic oligonucleotide
gtgaacaaggcactgctggaagtgcttcag

SEQ ID NO: 266645 - DNA, 31 bp, Artificial Sequence
  Description of Artificial Sequence: Synthetic oligonucleotide
tgaacaaggcactgctggaagtgcttcagtc

SEQ ID NO: 266646 - DNA, 30 bp, Artificial Sequence
  Description of Artificial Sequence: Synthetic oligonucleotide
gaacaaggcactgctggaagtgcttcagtc

SEQ ID NO: 266647 - DNA, 31 bp, Artificial Sequence
  Description of Artificial Sequence: Synthetic oligonucleotide
aacaaggcactgctggaagtgcttcagtcag

SEQ ID NO: 266648 - DNA, 30 bp, Artificial Sequence
  Description of Artificial Sequence: Synthetic oligonucleotide
acaaggcactgctggaagtgcttcagtcag

SEQ ID NO: 266649 - DNA, 29 bp, Artificial Sequence
  Description of Artificial Sequence: Synthetic oligonucleotide
caaggcactgctggaagtgcttcagtcag

SEQ ID NO: 266650 - DNA, 29 bp, Artificial Sequence
  Description of Artificial Sequence: Synthetic oligonucleotide
aaggcactgctggaagtgcttcagtcagc

SEQ ID NO: 266651 - DNA, 28 bp, Artificial Sequence
  Description of Artificial Sequence: Synthetic oligonucleotide
aggcactgctggaagtgcttcagtcagc

SEQ ID NO: 266652 - DNA, 27 bp, Artificial Sequence
  Description of Artificial Sequence: Synthetic oligonucleotide
ggcactgctggaagtgcttcagtcagc

SEQ ID NO: 266653 - DNA, 28 bp, Artificial Sequence
  Description of Artificial Sequence: Synthetic oligonucleotide
gcactgctggaagtgcttcagtcagctg

SEQ ID NO: 266654 - DNA, 28 bp, Artificial Sequence
  Description of Artificial Sequence: Synthetic oligonucleotide
cactgctggaagtgcttcagtcagctgg

SEQ ID NO: 266655 - DNA, 28 bp, Artificial Sequence
  Description of Artificial Sequence: Synthetic oligonucleotide
actgctggaagtgcttcagtcagctggc

SEQ ID NO: 266656 - DNA, 27 bp, Artificial Sequence
  Description of Artificial Sequence: Synthetic oligonucleotide
ctgctggaagtgcttcagtcagctggc

SEQ ID NO: 266657 - DNA, 32 bp, Artificial Sequence
  Description of Artificial Sequence: Synthetic oligonucleotide
tgctggaagtgcttcagtcagctggcaaaaag

SEQ ID NO: 266658 - DNA, 31 bp, Artificial Sequence
  Description of Artificial Sequence: Synthetic oligonucleotide
gctggaagtgcttcagtcagctggcaaaaag

SEQ ID NO: 266659 - DNA, 34 bp, Artificial Sequence
  Description of Artificial Sequence: Synthetic oligonucleotide
ctggaagtgcttcagtcagctggcaaaaagattg

SEQ ID NO: 266660 - DNA, 36 bp, Artificial Sequence
  Description of Artificial Sequence: Synthetic oligonucleotide
tggaagtgcttcagtcagctggcaaaaagattgaac

SEQ ID NO: 266661 - DNA, 35 bp, Artificial Sequence
  Description of Artificial Sequence: Synthetic oligonucleotide
ggaagtgcttcagtcagctggcaaaaagattgaac

SEQ ID NO: 266662 - DNA, 37 bp, Artificial Sequence
  Description of Artificial Sequence: Synthetic oligonucleotide
gaagtgcttcagtcagctggcaaaaagattgaacttc

SEQ ID NO: 266663 - DNA, 37 bp, Artificial Sequence
  Description of Artificial Sequence: Synthetic oligonucleotide
aagtgcttcagtcagctggcaaaaagattgaacttcc

SEQ ID NO: 266664 - DNA, 36 bp, Artificial Sequence
  Description of Artificial Sequence: Synthetic oligonucleotide
agtgcttcagtcagctggcaaaaagattgaacttcc

SEQ ID NO: 266665 - DNA, 35 bp, Artificial Sequence
  Description of Artificial Sequence: Synthetic oligonucleotide
gtgcttcagtcagctggcaaaaagattgaacttcc

SEQ ID NO: 266666 - DNA, 36 bp, Artificial Sequence
  Description of Artificial Sequence: Synthetic oligonucleotide
tgcttcagtcagctggcaaaaagattgaacttcctg

SEQ ID NO: 266667 - DNA, 35 bp, Artificial Sequence
  Description of Artificial Sequence: Synthetic oligonucleotide
gcttcagtcagctggcaaaaagattgaacttcctg

SEQ ID NO: 266668 - DNA, 36 bp, Artificial Sequence
  Description of Artificial Sequence: Synthetic oligonucleotide
cttcagtcagctggcaaaaagattgaacttcctgtc

SEQ ID NO: 266669 - DNA, 38 bp, Artificial Sequence
  Description of Artificial Sequence: Synthetic oligonucleotide
ttcagtcagctggcaaaaagattgaacttcctgtcatg

SEQ ID NO: 266670 - DNA, 37 bp, Artificial Sequence
  Description of Artificial Sequence: Synthetic oligonucleotide
tcagtcagctggcaaaaagattgaacttcctgtcatg

SEQ ID NO: 266671 - DNA, 36 bp, Artificial Sequence
  Description of Artificial Sequence: Synthetic oligonucleotide
cagtcagctggcaaaaagattgaacttcctgtcatg

SEQ ID NO: 266672 - DNA, 37 bp, Artificial Sequence
  Description of Artificial Sequence: Synthetic oligonucleotide
agtcagctggcaaaaagattgaacttcctgtcatgac

SEQ ID NO: 266673 - DNA, 36 bp, Artificial Sequence
  Description of Artificial Sequence: Synthetic oligonucleotide
gtcagctggcaaaaagattgaacttcctgtcatgac

SEQ ID NO: 266674 - DNA, 36 bp, Artificial Sequence
  Description of Artificial Sequence: Synthetic oligonucleotide
tcagctggcaaaaagattgaacttcctgtcatgacg

SEQ ID NO: 266675 - DNA, 35 bp, Artificial Sequence
  Description of Artificial Sequence: Synthetic oligonucleotide
cagctggcaaaaagattgaacttcctgtcatgacg

SEQ ID NO: 266676 - DNA, 35 bp, Artificial Sequence
  Description of Artificial Sequence: Synthetic oligonucleotide
agctggcaaaaagattgaacttcctgtcatgacgc

SEQ ID NO: 266677 - DNA, 34 bp, Artificial Sequence
  Description of Artificial Sequence: Synthetic oligonucleotide
gctggcaaaaagattgaacttcctgtcatgacgc

SEQ ID NO: 266678 - DNA, 34 bp, Artificial Sequence
  Description of Artificial Sequence: Synthetic oligonucleotide
ctggcaaaaagattgaacttcctgtcatgacgcg

SEQ ID NO: 266679 - DNA, 35 bp, Artificial Sequence
  Description of Artificial Sequence: Synthetic oligonucleotide
tggcaaaaagattgaacttcctgtcatgacgcgag

SEQ ID NO: 266680 - DNA, 34 bp, Artificial Sequence
  Description of Artificial Sequence: Synthetic oligonucleotide
ggcaaaaagattgaacttcctgtcatgacgcgag

SEQ ID NO: 266681 - DNA, 36 bp, Artificial Sequence
  Description of Artificial Sequence: Synthetic oligonucleotide
gcaaaaagattgaacttcctgtcatgacgcgagatc

SEQ ID NO: 266682 - DNA, 39 bp, Artificial Sequence
  Description of Artificial Sequence: Synthetic oligonucleotide
caaaaagattgaacttcctgtcatgacgcgagatcattc

SEQ ID NO: 266683 - DNA, 39 bp, Artificial Sequence
  Description of Artificial Sequence: Synthetic oligonucleotide
aaaaagattgaacttcctgtcatgacgcgagatcattcc

SEQ ID NO: 266684 - DNA, 38 bp, Artificial Sequence
  Description of Artificial Sequence: Synthetic oligonucleotide
aaaagattgaacttcctgtcatgacgcgagatcattcc

SEQ ID NO: 266685 - DNA, 37 bp, Artificial Sequence
  Description of Artificial Sequence: Synthetic oligonucleotide
aaagattgaacttcctgtcatgacgcgagatcattcc

SEQ ID NO: 266686 - DNA, 36 bp, Artificial Sequence
  Description of Artificial Sequence: Synthetic oligonucleotide
aagattgaacttcctgtcatgacgcgagatcattcc

SEQ ID NO: 266687 - DNA, 35 bp, Artificial Sequence
  Description of Artificial Sequence: Synthetic oligonucleotide
agattgaacttcctgtcatgacgcgagatcattcc

SEQ ID NO: 266688 - DNA, 34 bp, Artificial Sequence
  Description of Artificial Sequence: Synthetic oligonucleotide
gattgaacttcctgtcatgacgcgagatcattcc

SEQ ID NO: 266689 - DNA, 34 bp, Artificial Sequence
  Description of Artificial Sequence: Synthetic oligonucleotide
attgaacttcctgtcatgacgcgagatcattccc

SEQ ID NO: 266690 - DNA, 33 bp, Artificial Sequence
  Description of Artificial Sequence: Synthetic oligonucleotide
ttgaacttcctgtcatgacgcgagatcattccc

SEQ ID NO: 266691 - DNA, 32 bp, Artificial Sequence
  Description of Artificial Sequence: Synthetic oligonucleotide
tgaacttcctgtcatgacgcgagatcattccc

SEQ ID NO: 266692 - DNA, 31 bp, Artificial Sequence
  Description of Artificial Sequence: Synthetic oligonucleotide
gaacttcctgtcatgacgcgagatcattccc

SEQ ID NO: 266693 - DNA, 32 bp, Artificial Sequence
  Description of Artificial Sequence: Synthetic oligonucleotide
aacttcctgtcatgacgcgagatcattccctc

SEQ ID NO: 266694 - DNA, 31 bp, Artificial Sequence
  Description of Artificial Sequence: Synthetic oligonucleotide
acttcctgtcatgacgcgagatcattccctc

SEQ ID NO: 266695 - DNA, 30 bp, Artificial Sequence
  Description of Artificial Sequence: Synthetic oligonucleotide
cttcctgtcatgacgcgagatcattccctc

SEQ ID NO: 266696 - DNA, 32 bp, Artificial Sequence
  Description of Artificial Sequence: Synthetic oligonucleotide
ttcctgtcatgacgcgagatcattccctcaag

SEQ ID NO: 266697 - DNA, 31 bp, Artificial Sequence
  Description of Artificial Sequence: Synthetic oligonucleotide
tcctgtcatgacgcgagatcattccctcaag

SEQ ID NO: 266698 - DNA, 30 bp, Artificial Sequence
  Description of Artificial Sequence: Synthetic oligonucleotide
cctgtcatgacgcgagatcattccctcaag

SEQ ID NO: 266699 - DNA, 39 bp, Artificial Sequence
  Description of Artificial Sequence: Synthetic oligonucleotide
ctgtcatgacgcgagatcattccctcaagtttttaaatc

SEQ ID NO: 266700 - DNA, 39 bp, Artificial Sequence
  Description of Artificial Sequence: Synthetic oligonucleotide
tgtcatgacgcgagatcattccctcaagtttttaaatcg

SEQ ID NO: 266701 - DNA, 38 bp, Artificial Sequence
  Description of Artificial Sequence: Synthetic oligonucleotide
gtcatgacgcgagatcattccctcaagtttttaaatcg

SEQ ID NO: 266702 - DNA, 39 bp, Artificial Sequence
  Description of Artificial Sequence: Synthetic oligonucleotide
tcatgacgcgagatcattccctcaagtttttaaatcgtg

SEQ ID NO: 266703 - DNA, 38 bp, Artificial Sequence
  Description of Artificial Sequence: Synthetic oligonucleotide
catgacgcgagatcattccctcaagtttttaaatcgtg

SEQ ID NO: 266704 - DNA, 40 bp, Artificial Sequence
  Description of Artificial Sequence: Synthetic oligonucleotide
atgacgcgagatcattccctcaagtttttaaatcgtgaag

SEQ ID NO: 266705 - DNA, 39 bp, Artificial Sequence
  Description of Artificial Sequence: Synthetic oligonucleotide
tgacgcgagatcattccctcaagtttttaaatcgtgaag

SEQ ID NO: 266706 - DNA, 38 bp, Artificial Sequence
  Description of Artificial Sequence: Synthetic oligonucleotide
gacgcgagatcattccctcaagtttttaaatcgtgaag

SEQ ID NO: 266707 - DNA, 43 bp, Artificial Sequence
  Description of Artificial Sequence: Synthetic oligonucleotide
acgcgagatcattccctcaagtttttaaatcgtgaagaaatag

SEQ ID NO: 266708 - DNA, 42 bp, Artificial Sequence
  Description of Artificial Sequence: Synthetic oligonucleotide
cgcgagatcattccctcaagtttttaaatcgtgaagaaatag

SEQ ID NO: 266709 - DNA, 43 bp, Artificial Sequence
  Description of Artificial Sequence: Synthetic oligonucleotide
gcgagatcattccctcaagtttttaaatcgtgaagaaatagag

SEQ ID NO: 266710 - DNA, 45 bp, Artificial Sequence
  Description of Artificial Sequence: Synthetic oligonucleotide
cgagatcattccctcaagtttttaaatcgtgaagaaatagagaag

SEQ ID NO: 266711 - DNA, 48 bp, Artificial Sequence
  Description of Artificial Sequence: Synthetic oligonucleotide
gagatcattccctcaagtttttaaatcgtgaagaaatagagaagtatc

SEQ ID NO: 266712 - DNA, 50 bp, Artificial Sequence
  Description of Artificial Sequence: Synthetic oligonucleotide
agatcattccctcaagtttttaaatcgtgaagaaatagagaagtatcttg

SEQ ID NO: 266713 - DNA, 49 bp, Artificial Sequence
  Description of Artificial Sequence: Synthetic oligonucleotide
gatcattccctcaagtttttaaatcgtgaagaaatagagaagtatcttg

SEQ ID NO: 266714 - DNA, 49 bp, Artificial Sequence
  Description of Artificial Sequence: Synthetic oligonucleotide
atcattccctcaagtttttaaatcgtgaagaaatagagaagtatcttgc

SEQ ID NO: 266715 - DNA, 48 bp, Artificial Sequence
  Description of Artificial Sequence: Synthetic oligonucleotide
tcattccctcaagtttttaaatcgtgaagaaatagagaagtatcttgc

SEQ ID NO: 266716 - DNA, 47 bp, Artificial Sequence
  Description of Artificial Sequence: Synthetic oligonucleotide
cattccctcaagtttttaaatcgtgaagaaatagagaagtatcttgc

SEQ ID NO: 266717 - DNA, 48 bp, Artificial Sequence
  Description of Artificial Sequence: Synthetic oligonucleotide
attccctcaagtttttaaatcgtgaagaaatagagaagtatcttgctg

SEQ ID NO: 266718 - DNA, 47 bp, Artificial Sequence
  Description of Artificial Sequence: Synthetic oligonucleotide
ttccctcaagtttttaaatcgtgaagaaatagagaagtatcttgctg

SEQ ID NO: 266719 - DNA, 46 bp, Artificial Sequence
  Description of Artificial Sequence: Synthetic oligonucleotide
tccctcaagtttttaaatcgtgaagaaatagagaagtatcttgctg

SEQ ID NO: 266720 - DNA, 45 bp, Artificial Sequence
  Description of Artificial Sequence: Synthetic oligonucleotide
ccctcaagtttttaaatcgtgaagaaatagagaagtatcttgctg

SEQ ID NO: 266721 - DNA, 50 bp, Artificial Sequence
  Description of Artificial Sequence: Synthetic oligonucleotide
cctcaagtttttaaatcgtgaagaaatagagaagtatcttgctgaaaatg

SEQ ID NO: 266722 - DNA, 55 bp, Artificial Sequence
  Description of Artificial Sequence: Synthetic oligonucleotide
ctcaagtttttaaatcgtgaagaaatagagaagtatcttgctgaaaatgaaaaag

SEQ ID NO: 266723 - DNA, 60 bp, Artificial Sequence
  Description of Artificial Sequence: Synthetic oligonucleotide
tcaagtttttaaatcgtgaagaaatagagaagtatcttgctgaaaatgaaaaagataaag

SEQ ID NO: 266724 - DNA, 59 bp, Artificial Sequence
  Description of Artificial Sequence: Synthetic oligonucleotide
caagtttttaaatcgtgaagaaatagagaagtatcttgctgaaaatgaaaaagataaag

SEQ ID NO: 266725 - DNA, 60 bp, Artificial Sequence
  Description of Artificial Sequence: Synthetic oligonucleotide
aagtttttaaatcgtgaagaaatagagaagtatcttgctgaaaatgaaaaagataaagaa

SEQ ID NO: 266726 - DNA, 60 bp, Artificial Sequence
  Description of Artificial Sequence: Synthetic oligonucleotide
agtttttaaatcgtgaagaaatagagaagtatcttgctgaaaatgaaaaagataaagaag

SEQ ID NO: 266727 - DNA, 59 bp, Artificial Sequence
  Description of Artificial Sequence: Synthetic oligonucleotide
gtttttaaatcgtgaagaaatagagaagtatcttgctgaaaatgaaaaagataaagaag

SEQ ID NO: 266728 - DNA, 60 bp, Artificial Sequence
  Description of Artificial Sequence: Synthetic oligonucleotide
tttttaaatcgtgaagaaatagagaagtatcttgctgaaaatgaaaaagataaagaagaa

SEQ ID NO: 266729 - DNA, 60 bp, Artificial Sequence
  Description of Artificial Sequence: Synthetic oligonucleotide
ttttaaatcgtgaagaaatagagaagtatcttgctgaaaatgaaaaagataaagaagaat

SEQ ID NO: 266730 - DNA, 60 bp, Artificial Sequence
  Description of Artificial Sequence: Synthetic oligonucleotide
tttaaatcgtgaagaaatagagaagtatcttgctgaaaatgaaaaagataaagaagaata

SEQ ID NO: 266731 - DNA, 60 bp, Artificial Sequence
  Description of Artificial Sequence: Synthetic oligonucleotide
ttaaatcgtgaagaaatagagaagtatcttgctgaaaatgaaaaagataaagaagaatac

SEQ ID NO: 266732 - DNA, 59 bp, Artificial Sequence
  Description of Artificial Sequence: Synthetic oligonucleotide
taaatcgtgaagaaatagagaagtatcttgctgaaaatgaaaaagataaagaagaatac

SEQ ID NO: 266733 - DNA, 58 bp, Artificial Sequence
  Description of Artificial Sequence: Synthetic oligonucleotide
aaatcgtgaagaaatagagaagtatcttgctgaaaatgaaaaagataaagaagaatac

SEQ ID NO: 266734 - DNA, 57 bp, Artificial Sequence
  Description of Artificial Sequence: Synthetic oligonucleotide
aatcgtgaagaaatagagaagtatcttgctgaaaatgaaaaagataaagaagaatac

SEQ ID NO: 266735 - DNA, 56 bp, Artificial Sequence
  Description of Artificial Sequence: Synthetic oligonucleotide
atcgtgaagaaatagagaagtatcttgctgaaaatgaaaaagataaagaagaatac

SEQ ID NO: 266736 - DNA, 55 bp, Artificial Sequence
  Description of Artificial Sequence: Synthetic oligonucleotide
tcgtgaagaaatagagaagtatcttgctgaaaatgaaaaagataaagaagaatac

SEQ ID NO: 266737 - DNA, 54 bp, Artificial Sequence
  Description of Artificial Sequence: Synthetic oligonucleotide
cgtgaagaaatagagaagtatcttgctgaaaatgaaaaagataaagaagaatac

SEQ ID NO: 266738 - DNA, 54 bp, Artificial Sequence
  Description of Artificial Sequence: Synthetic oligonucleotide
gtgaagaaatagagaagtatcttgctgaaaatgaaaaagataaagaagaatacg

SEQ ID NO: 266739 - DNA, 58 bp, Artificial Sequence
  Description of Artificial Sequence: Synthetic oligonucleotide
tgaagaaatagagaagtatcttgctgaaaatgaaaaagataaagaagaatacgaaaag

SEQ ID NO: 266740 - DNA, 57 bp, Artificial Sequence
  Description of Artificial Sequence: Synthetic oligonucleotide
gaagaaatagagaagtatcttgctgaaaatgaaaaagataaagaagaatacgaaaag

SEQ ID NO: 266741 - DNA, 59 bp, Artificial Sequence
  Description of Artificial Sequence: Synthetic oligonucleotide
aagaaatagagaagtatcttgctgaaaatgaaaaagataaagaagaatacgaaaagatg

SEQ ID NO: 266742 - DNA, 58 bp, Artificial Sequence
  Description of Artificial Sequence: Synthetic oligonucleotide
agaaatagagaagtatcttgctgaaaatgaaaaagataaagaagaatacgaaaagatg

SEQ ID NO: 266743 - DNA, 57 bp, Artificial Sequence
  Description of Artificial Sequence: Synthetic oligonucleotide
gaaatagagaagtatcttgctgaaaatgaaaaagataaagaagaatacgaaaagatg

SEQ ID NO: 266744 - DNA, 60 bp, Artificial Sequence
  Description of Artificial Sequence: Synthetic oligonucleotide
aaatagagaagtatcttgctgaaaatgaaaaagataaagaagaatacgaaaagatgaaac

SEQ ID NO: 266745 - DNA, 59 bp, Artificial Sequence
  Description of Artificial Sequence: Synthetic oligonucleotide
aatagagaagtatcttgctgaaaatgaaaaagataaagaagaatacgaaaagatgaaac

SEQ ID NO: 266746 - DNA, 58 bp, Artificial Sequence
  Description of Artificial Sequence: Synthetic oligonucleotide
atagagaagtatcttgctgaaaatgaaaaagataaagaagaatacgaaaagatgaaac

SEQ ID NO: 266747 - DNA, 57 bp, Artificial Sequence
  Description of Artificial Sequence: Synthetic oligonucleotide
tagagaagtatcttgctgaaaatgaaaaagataaagaagaatacgaaaagatgaaac

SEQ ID NO: 266748 - DNA, 56 bp, Artificial Sequence
  Description of Artificial Sequence: Synthetic oligonucleotide
agagaagtatcttgctgaaaatgaaaaagataaagaagaatacgaaaagatgaaac

SEQ ID NO: 266749 - DNA, 55 bp, Artificial Sequence
  Description of Artificial Sequence: Synthetic oligonucleotide
gagaagtatcttgctgaaaatgaaaaagataaagaagaatacgaaaagatgaaac

SEQ ID NO: 266750 - DNA, 59 bp, Artificial Sequence
  Description of Artificial Sequence: Synthetic oligonucleotide
agaagtatcttgctgaaaatgaaaaagataaagaagaatacgaaaagatgaaacaaaac

SEQ ID NO: 266751 - DNA, 58 bp, Artificial Sequence
  Description of Artificial Sequence: Synthetic oligonucleotide
gaagtatcttgctgaaaatgaaaaagataaagaagaatacgaaaagatgaaacaaaac

SEQ ID NO: 266752 - DNA, 60 bp, Artificial Sequence
  Description of Artificial Sequence: Synthetic oligonucleotide
aagtatcttgctgaaaatgaaaaagataaagaagaatacgaaaagatgaaacaaaacaaa

SEQ ID NO: 266753 - DNA, 60 bp, Artificial Sequence
  Description of Artificial Sequence: Synthetic oligonucleotide
agtatcttgctgaaaatgaaaaagataaagaagaatacgaaaagatgaaacaaaacaaag

SEQ ID NO: 266754 - DNA, 59 bp, Artificial Sequence
  Description of Artificial Sequence: Synthetic oligonucleotide
gtatcttgctgaaaatgaaaaagataaagaagaatacgaaaagatgaaacaaaacaaag

SEQ ID NO: 266755 - DNA, 59 bp, Artificial Sequence
  Description of Artificial Sequence: Synthetic oligonucleotide
tatcttgctgaaaatgaaaaagataaagaagaatacgaaaagatgaaacaaaacaaagc

SEQ ID NO: 266756 - DNA, 58 bp, Artificial Sequence
  Description of Artificial Sequence: Synthetic oligonucleotide
atcttgctgaaaatgaaaaagataaagaagaatacgaaaagatgaaacaaaacaaagc

SEQ ID NO: 266757 - DNA, 57 bp, Artificial Sequence
  Description of Artificial Sequence: Synthetic oligonucleotide
tcttgctgaaaatgaaaaagataaagaagaatacgaaaagatgaaacaaaacaaagc

SEQ ID NO: 266758 - DNA, 56 bp, Artificial Sequence
  Description of Artificial Sequence: Synthetic oligonucleotide
cttgctgaaaatgaaaaagataaagaagaatacgaaaagatgaaacaaaacaaagc

SEQ ID NO: 266759 - DNA, 58 bp, Artificial Sequence
  Description of Artificial Sequence: Synthetic oligonucleotide
ttgctgaaaatgaaaaagataaagaagaatacgaaaagatgaaacaaaacaaagcatc

SEQ ID NO: 266760 - DNA, 57 bp, Artificial Sequence
  Description of Artificial Sequence: Synthetic oligonucleotide
tgctgaaaatgaaaaagataaagaagaatacgaaaagatgaaacaaaacaaagcatc

SEQ ID NO: 266761 - DNA, 56 bp, Artificial Sequence
  Description of Artificial Sequence: Synthetic oligonucleotide
gctgaaaatgaaaaagataaagaagaatacgaaaagatgaaacaaaacaaagcatc

SEQ ID NO: 266762 - DNA, 58 bp, Artificial Sequence
  Description of Artificial Sequence: Synthetic oligonucleotide
ctgaaaatgaaaaagataaagaagaatacgaaaagatgaaacaaaacaaagcatcaag

SEQ ID NO: 266763 - DNA, 58 bp, Artificial Sequence
  Description of Artificial Sequence: Synthetic oligonucleotide
tgaaaatgaaaaagataaagaagaatacgaaaagatgaaacaaaacaaagcatcaaga

SEQ ID NO: 266764 - DNA, 29 bp, Artificial Sequence
  Description of Artificial Sequence: Synthetic oligonucleotide
atggcctctcgatatcacagggcgaacac

SEQ ID NO: 266765 - DNA, 28 bp, Artificial Sequence
  Description of Artificial Sequence: Synthetic oligonucleotide
tggcctctcgatatcacagggcgaacac

SEQ ID NO: 266766 - DNA, 27 bp, Artificial Sequence
  Description of Artificial Sequence: Synthetic oligonucleotide
ggcctctcgatatcacagggcgaacac

SEQ ID NO: 266767 - DNA, 28 bp, Artificial Sequence
  Description of Artificial Sequence: Synthetic oligonucleotide
gcctctcgatatcacagggcgaacactg

SEQ ID NO: 266768 - DNA, 29 bp, Artificial Sequence
  Description of Artificial Sequence: Synthetic oligonucleotide
cctctcgatatcacagggcgaacactgtc

SEQ ID NO: 266769 - DNA, 31 bp, Artificial Sequence
  Description of Artificial Sequence: Synthetic oligonucleotide
ctctcgatatcacagggcgaacactgtcttg

SEQ ID NO: 266770 - DNA, 32 bp, Artificial Sequence
  Description of Artificial Sequence: Synthetic oligonucleotide
tctcgatatcacagggcgaacactgtcttgtc

SEQ ID NO: 266771 - DNA, 31 bp, Artificial Sequence
  Description of Artificial Sequence: Synthetic oligonucleotide
ctcgatatcacagggcgaacactgtcttgtc

SEQ ID NO: 266772 - DNA, 31 bp, Artificial Sequence
  Description of Artificial Sequence: Synthetic oligonucleotide
tcgatatcacagggcgaacactgtcttgtcc

SEQ ID NO: 266773 - DNA, 30 bp, Artificial Sequence
  Description of Artificial Sequence: Synthetic oligonucleotide
cgatatcacagggcgaacactgtcttgtcc

SEQ ID NO: 266774 - DNA, 30 bp, Artificial Sequence
  Description of Artificial Sequence: Synthetic oligonucleotide
gatatcacagggcgaacactgtcttgtccc

SEQ ID NO: 266775 - DNA, 30 bp, Artificial Sequence
  Description of Artificial Sequence: Synthetic oligonucleotide
atatcacagggcgaacactgtcttgtcccc

SEQ ID NO: 266776 - DNA, 29 bp, Artificial Sequence
  Description of Artificial Sequence: Synthetic oligonucleotide
tatcacagggcgaacactgtcttgtcccc

SEQ ID NO: 266777 - DNA, 28 bp, Artificial Sequence
  Description of Artificial Sequence: Synthetic oligonucleotide
atcacagggcgaacactgtcttgtcccc

SEQ ID NO: 266778 - DNA, 27 bp, Artificial Sequence
  Description of Artificial Sequence: Synthetic oligonucleotide
tcacagggcgaacactgtcttgtcccc

SEQ ID NO: 266779 - DNA, 27 bp, Artificial Sequence
  Description of Artificial Sequence: Synthetic oligonucleotide
cacagggcgaacactgtcttgtcccca

SEQ ID NO: 266780 - DNA, 27 bp, Artificial Sequence
  Description of Artificial Sequence: Synthetic oligonucleotide
acagggcgaacactgtcttgtccccag

SEQ ID NO: 266781 - DNA, 27 bp, Artificial Sequence
  Description of Artificial Sequence: Synthetic oligonucleotide
cagggcgaacactgtcttgtccccaga

SEQ ID NO: 266782 - DNA, 27 bp, Artificial Sequence
  Description of Artificial Sequence: Synthetic oligonucleotide
agggcgaacactgtcttgtccccagac

SEQ ID NO: 266783 - DNA, 26 bp, Artificial Sequence
  Description of Artificial Sequence: Synthetic oligonucleotide
gggcgaacactgtcttgtccccagac

SEQ ID NO: 266784 - DNA, 26 bp, Artificial Sequence
  Description of Artificial Sequence: Synthetic oligonucleotide
ggcgaacactgtcttgtccccagacc

SEQ ID NO: 266785 - DNA, 27 bp, Artificial Sequence
  Description of Artificial Sequence: Synthetic oligonucleotide
gcgaacactgtcttgtccccagaccga

SEQ ID NO: 266786 - DNA, 27 bp, Artificial Sequence
  Description of Artificial Sequence: Synthetic oligonucleotide
cgaacactgtcttgtccccagaccgac

SEQ ID NO: 266787 - DNA, 28 bp, Artificial Sequence
  Description of Artificial Sequence: Synthetic oligonucleotide
gaacactgtcttgtccccagaccgacac

SEQ ID NO: 266788 - DNA, 28 bp, Artificial Sequence
  Description of Artificial Sequence: Synthetic oligonucleotide
aacactgtcttgtccccagaccgacacc

SEQ ID NO: 266789 - DNA, 27 bp, Artificial Sequence
  Description of Artificial Sequence: Synthetic oligonucleotide
acactgtcttgtccccagaccgacacc

SEQ ID NO: 266790 - DNA, 27 bp, Artificial Sequence
  Description of Artificial Sequence: Synthetic oligonucleotide
cactgtcttgtccccagaccgacacct

SEQ ID NO: 266791 - DNA, 31 bp, Artificial Sequence
  Description of Artificial Sequence: Synthetic oligonucleotide
actgtcttgtccccagaccgacacctttatc

SEQ ID NO: 266792 - DNA, 30 bp, Artificial Sequence
  Description of Artificial Sequence: Synthetic oligonucleotide
ctgtcttgtccccagaccgacacctttatc

SEQ ID NO: 266793 - DNA, 32 bp, Artificial Sequence
  Description of Artificial Sequence: Synthetic oligonucleotide
tgtcttgtccccagaccgacacctttatcaag

SEQ ID NO: 266794 - DNA, 31 bp, Artificial Sequence
  Description of Artificial Sequence: Synthetic oligonucleotide
gtcttgtccccagaccgacacctttatcaag

SEQ ID NO: 266795 - DNA, 33 bp, Artificial Sequence
  Description of Artificial Sequence: Synthetic oligonucleotide
tcttgtccccagaccgacacctttatcaagttg

SEQ ID NO: 266796 - DNA, 32 bp, Artificial Sequence
  Description of Artificial Sequence: Synthetic oligonucleotide
cttgtccccagaccgacacctttatcaagttg

SEQ ID NO: 266797 - DNA, 37 bp, Artificial Sequence
  Description of Artificial Sequence: Synthetic oligonucleotide
ttgtccccagaccgacacctttatcaagttgattatg

SEQ ID NO: 266798 - DNA, 36 bp, Artificial Sequence
  Description of Artificial Sequence: Synthetic oligonucleotide
tgtccccagaccgacacctttatcaagttgattatg

SEQ ID NO: 266799 - DNA, 35 bp, Artificial Sequence
  Description of Artificial Sequence: Synthetic oligonucleotide
gtccccagaccgacacctttatcaagttgattatg

SEQ ID NO: 266800 - DNA, 35 bp, Artificial Sequence
  Description of Artificial Sequence: Synthetic oligonucleotide
tccccagaccgacacctttatcaagttgattatgc

SEQ ID NO: 266801 - DNA, 34 bp, Artificial Sequence
  Description of Artificial Sequence: Synthetic oligonucleotide
ccccagaccgacacctttatcaagttgattatgc

SEQ ID NO: 266802 - DNA, 34 bp, Artificial Sequence
  Description of Artificial Sequence: Synthetic oligonucleotide
cccagaccgacacctttatcaagttgattatgcc

SEQ ID NO: 266803 - DNA, 34 bp, Artificial Sequence
  Description of Artificial Sequence: Synthetic oligonucleotide
ccagaccgacacctttatcaagttgattatgccc

SEQ ID NO: 266804 - DNA, 35 bp, Artificial Sequence
  Description of Artificial Sequence: Synthetic oligonucleotide
cagaccgacacctttatcaagttgattatgcccag

SEQ ID NO: 266805 - DNA, 35 bp, Artificial Sequence
  Description of Artificial Sequence: Synthetic oligonucleotide
agaccgacacctttatcaagttgattatgcccagc

SEQ ID NO: 266806 - DNA, 34 bp, Artificial Sequence
  Description of Artificial Sequence: Synthetic oligonucleotide
gaccgacacctttatcaagttgattatgcccagc

SEQ ID NO: 266807 - DNA, 36 bp, Artificial Sequence
  Description of Artificial Sequence: Synthetic oligonucleotide
accgacacctttatcaagttgattatgcccagcaag

SEQ ID NO: 266808 - DNA, 35 bp, Artificial Sequence
  Description of Artificial Sequence: Synthetic oligonucleotide
ccgacacctttatcaagttgattatgcccagcaag

SEQ ID NO: 266809 - DNA, 35 bp, Artificial Sequence
  Description of Artificial Sequence: Synthetic oligonucleotide
cgacacctttatcaagttgattatgcccagcaagc

SEQ ID NO: 266810 - DNA, 35 bp, Artificial Sequence
  Description of Artificial Sequence: Synthetic oligonucleotide
gacacctttatcaagttgattatgcccagcaagcg

SEQ ID NO: 266811 - DNA, 35 bp, Artificial Sequence
  Description of Artificial Sequence: Synthetic oligonucleotide
acacctttatcaagttgattatgcccagcaagcgg

SEQ ID NO: 266812 - DNA, 34 bp, Artificial Sequence
  Description of Artificial Sequence: Synthetic oligonucleotide
cacctttatcaagttgattatgcccagcaagcgg

SEQ ID NO: 266813 - DNA, 35 bp, Artificial Sequence
  Description of Artificial Sequence: Synthetic oligonucleotide
acctttatcaagttgattatgcccagcaagcggtg

SEQ ID NO: 266814 - DNA, 34 bp, Artificial Sequence
  Description of Artificial Sequence: Synthetic oligonucleotide
cctttatcaagttgattatgcccagcaagcggtg

SEQ ID NO: 266815 - DNA, 36 bp, Artificial Sequence
  Description of Artificial Sequence: Synthetic oligonucleotide
ctttatcaagttgattatgcccagcaagcggtgatg

SEQ ID NO: 266816 - DNA, 39 bp, Artificial Sequence
  Description of Artificial Sequence: Synthetic oligonucleotide
tttatcaagttgattatgcccagcaagcggtgatgaaag

SEQ ID NO: 266817 - DNA, 38 bp, Artificial Sequence
  Description of Artificial Sequence: Synthetic oligonucleotide
ttatcaagttgattatgcccagcaagcggtgatgaaag

SEQ ID NO: 266818 - DNA, 37 bp, Artificial Sequence
  Description of Artificial Sequence: Synthetic oligonucleotide
tatcaagttgattatgcccagcaagcggtgatgaaag

SEQ ID NO: 266819 - DNA, 36 bp, Artificial Sequence
  Description of Artificial Sequence: Synthetic oligonucleotide
atcaagttgattatgcccagcaagcggtgatgaaag

SEQ ID NO: 266820 - DNA, 35 bp, Artificial Sequence
  Description of Artificial Sequence: Synthetic oligonucleotide
tcaagttgattatgcccagcaagcggtgatgaaag

SEQ ID NO: 266821 - DNA, 34 bp, Artificial Sequence
  Description of Artificial Sequence: Synthetic oligonucleotide
caagttgattatgcccagcaagcggtgatgaaag

SEQ ID NO: 266822 - DNA, 34 bp, Artificial Sequence
  Description of Artificial Sequence: Synthetic oligonucleotide
aagttgattatgcccagcaagcggtgatgaaagg

SEQ ID NO: 266823 - DNA, 33 bp, Artificial Sequence
  Description of Artificial Sequence: Synthetic oligonucleotide
agttgattatgcccagcaagcggtgatgaaagg

SEQ ID NO: 266824 - DNA, 32 bp, Artificial Sequence
  Description of Artificial Sequence: Synthetic oligonucleotide
gttgattatgcccagcaagcggtgatgaaagg

SEQ ID NO: 266825 - DNA, 34 bp, Artificial Sequence
  Description of Artificial Sequence: Synthetic oligonucleotide
ttgattatgcccagcaagcggtgatgaaaggatc

SEQ ID NO: 266826 - DNA, 33 bp, Artificial Sequence
  Description of Artificial Sequence: Synthetic oligonucleotide
tgattatgcccagcaagcggtgatgaaaggatc

SEQ ID NO: 266827 - DNA, 32 bp, Artificial Sequence
  Description of Artificial Sequence: Synthetic oligonucleotide
gattatgcccagcaagcggtgatgaaaggatc

SEQ ID NO: 266828 - DNA, 32 bp, Artificial Sequence
  Description of Artificial Sequence: Synthetic oligonucleotide
attatgcccagcaagcggtgatgaaaggatcg

SEQ ID NO: 266829 - DNA, 31 bp, Artificial Sequence
  Description of Artificial Sequence: Synthetic oligonucleotide
ttatgcccagcaagcggtgatgaaaggatcg

SEQ ID NO: 266830 - DNA, 30 bp, Artificial Sequence
  Description of Artificial Sequence: Synthetic oligonucleotide
tatgcccagcaagcggtgatgaaaggatcg

SEQ ID NO: 266831 - DNA, 29 bp, Artificial Sequence
  Description of Artificial Sequence: Synthetic oligonucleotide
atgcccagcaagcggtgatgaaaggatcg

SEQ ID NO: 266832 - DNA, 28 bp, Artificial Sequence
  Description of Artificial Sequence: Synthetic oligonucleotide
tgcccagcaagcggtgatgaaaggatcg

SEQ ID NO: 266833 - DNA, 27 bp, Artificial Sequence
  Description of Artificial Sequence: Synthetic oligonucleotide
gcccagcaagcggtgatgaaaggatcg

SEQ ID NO: 266834 - DNA, 28 bp, Artificial Sequence
  Description of Artificial Sequence: Synthetic oligonucleotide
cccagcaagcggtgatgaaaggatcgac

SEQ ID NO: 266835 - DNA, 28 bp, Artificial Sequence
  Description of Artificial Sequence: Synthetic oligonucleotide
ccagcaagcggtgatgaaaggatcgacc

SEQ ID NO: 266836 - DNA, 28 bp, Artificial Sequence
  Description of Artificial Sequence: Synthetic oligonucleotide
cagcaagcggtgatgaaaggatcgaccg

SEQ ID NO: 266837 - DNA, 28 bp, Artificial Sequence
  Description of Artificial Sequence: Synthetic oligonucleotide
agcaagcggtgatgaaaggatcgaccgc

SEQ ID NO: 266838 - DNA, 27 bp, Artificial Sequence
  Description of Artificial Sequence: Synthetic oligonucleotide
gcaagcggtgatgaaaggatcgaccgc

SEQ ID NO: 266839 - DNA, 27 bp, Artificial Sequence
  Description of Artificial Sequence: Synthetic oligonucleotide
caagcggtgatgaaaggatcgaccgcg

SEQ ID NO: 266840 - DNA, 27 bp, Artificial Sequence
  Description of Artificial Sequence: Synthetic oligonucleotide
aagcggtgatgaaaggatcgaccgcgg

SEQ ID NO: 266841 - DNA, 27 bp, Artificial Sequence
  Description of Artificial Sequence: Synthetic oligonucleotide
agcggtgatgaaaggatcgaccgcggt

SEQ ID NO: 266842 - DNA, 26 bp, Artificial Sequence
  Description of Artificial Sequence: Synthetic oligonucleotide
gcggtgatgaaaggatcgaccgcggt

SEQ ID NO: 266843 - DNA, 26 bp, Artificial Sequence
  Description of Artificial Sequence: Synthetic oligonucleotide
cggtgatgaaaggatcgaccgcggtc

SEQ ID NO: 266844 - DNA, 26 bp, Artificial Sequence
  Description of Artificial Sequence: Synthetic oligonucleotide
ggtgatgaaaggatcgaccgcggtcc

SEQ ID NO: 266845 - DNA, 27 bp, Artificial Sequence
  Description of Artificial Sequence: Synthetic oligonucleotide
gtgatgaaaggatcgaccgcggtccga

SEQ ID NO: 266846 - DNA, 30 bp, Artificial Sequence
  Description of Artificial Sequence: Synthetic oligonucleotide
tgatgaaaggatcgaccgcggtccgaattc

SEQ ID NO: 266847 - DNA, 29 bp, Artificial Sequence
  Description of Artificial Sequence: Synthetic oligonucleotide
gatgaaaggatcgaccgcggtccgaattc

SEQ ID NO: 266848 - DNA, 29 bp, Artificial Sequence
  Description of Artificial Sequence: Synthetic oligonucleotide
atgaaaggatcgaccgcggtccgaattcg

SEQ ID NO: 266849 - DNA, 28 bp, Artificial Sequence
  Description of Artificial Sequence: Synthetic oligonucleotide
tgaaaggatcgaccgcggtccgaattcg

SEQ ID NO: 266850 - DNA, 27 bp, Artificial Sequence
  Description of Artificial Sequence: Synthetic oligonucleotide
gaaaggatcgaccgcggtccgaattcg

SEQ ID NO: 266851 - DNA, 28 bp, Artificial Sequence
  Description of Artificial Sequence: Synthetic oligonucleotide
aaaggatcgaccgcggtccgaattcgag

SEQ ID NO: 266852 - DNA, 27 bp, Artificial Sequence
  Description of Artificial Sequence: Synthetic oligonucleotide
aaggatcgaccgcggtccgaattcgag

SEQ ID NO: 266853 - DNA, 26 bp, Artificial Sequence
  Description of Artificial Sequence: Synthetic oligonucleotide
aggatcgaccgcggtccgaattcgag

SEQ ID NO: 266854 - DNA, 25 bp, Artificial Sequence
  Description of Artificial Sequence: Synthetic oligonucleotide
ggatcgaccgcggtccgaattcgag

SEQ ID NO: 266855 - DNA, 27 bp, Artificial Sequence
  Description of Artificial Sequence: Synthetic oligonucleotide
gatcgaccgcggtccgaattcgagcta

SEQ ID NO: 266856 - DNA, 27 bp, Artificial Sequence
  Description of Artificial Sequence: Synthetic oligonucleotide
atcgaccgcggtccgaattcgagctac

SEQ ID NO: 266857 - DNA, 26 bp, Artificial Sequence
  Description of Artificial Sequence: Synthetic oligonucleotide
tcgaccgcggtccgaattcgagctac

SEQ ID NO: 266858 - DNA, 25 bp, Artificial Sequence
  Description of Artificial Sequence: Synthetic oligonucleotide
cgaccgcggtccgaattcgagctac

SEQ ID NO: 266859 - DNA, 27 bp, Artificial Sequence
  Description of Artificial Sequence: Synthetic oligonucleotide
gaccgcggtccgaattcgagctaccaa

SEQ ID NO: 266860 - DNA, 31 bp, Artificial Sequence
  Description of Artificial Sequence: Synthetic oligonucleotide
accgcggtccgaattcgagctaccaatattg

SEQ ID NO: 266861 - DNA, 30 bp, Artificial Sequence
  Description of Artificial Sequence: Synthetic oligonucleotide
ccgcggtccgaattcgagctaccaatattg

SEQ ID NO: 266862 - DNA, 32 bp, Artificial Sequence
  Description of Artificial Sequence: Synthetic oligonucleotide
cgcggtccgaattcgagctaccaatattgttg

SEQ ID NO: 266863 - DNA, 34 bp, Artificial Sequence
  Description of Artificial Sequence: Synthetic oligonucleotide
gcggtccgaattcgagctaccaatattgttgttc

SEQ ID NO: 266864 - DNA, 36 bp, Artificial Sequence
  Description of Artificial Sequence: Synthetic oligonucleotide
cggtccgaattcgagctaccaatattgttgttcttc

SEQ ID NO: 266865 - DNA, 36 bp, Artificial Sequence
  Description of Artificial Sequence: Synthetic oligonucleotide
ggtccgaattcgagctaccaatattgttgttcttcg

SEQ ID NO: 266866 - DNA, 36 bp, Artificial Sequence
  Description of Artificial Sequence: Synthetic oligonucleotide
gtccgaattcgagctaccaatattgttgttcttcgg

SEQ ID NO: 266867 - DNA, 36 bp, Artificial Sequence
  Description of Artificial Sequence: Synthetic oligonucleotide
tccgaattcgagctaccaatattgttgttcttcggg

SEQ ID NO: 266868 - DNA, 35 bp, Artificial Sequence
  Description of Artificial Sequence: Synthetic oligonucleotide
ccgaattcgagctaccaatattgttgttcttcggg

SEQ ID NO: 266869 - DNA, 37 bp, Artificial Sequence
  Description of Artificial Sequence: Synthetic oligonucleotide
cgaattcgagctaccaatattgttgttcttcgggtag

SEQ ID NO: 266870 - DNA, 46 bp, Artificial Sequence
  Description of Artificial Sequence: Synthetic oligonucleotide
gaattcgagctaccaatattgttgttcttcgggtagaaataaaatc

SEQ ID NO: 266871 - DNA, 47 bp, Artificial Sequence
  Description of Artificial Sequence: Synthetic oligonucleotide
aattcgagctaccaatattgttgttcttcgggtagaaataaaatctg

SEQ ID NO: 266872 - DNA, 46 bp, Artificial Sequence
  Description of Artificial Sequence: Synthetic oligonucleotide
attcgagctaccaatattgttgttcttcgggtagaaataaaatctg

SEQ ID NO: 266873 - DNA, 45 bp, Artificial Sequence
  Description of Artificial Sequence: Synthetic oligonucleotide
ttcgagctaccaatattgttgttcttcgggtagaaataaaatctg

SEQ ID NO: 266874 - DNA, 44 bp, Artificial Sequence
  Description of Artificial Sequence: Synthetic oligonucleotide
tcgagctaccaatattgttgttcttcgggtagaaataaaatctg

SEQ ID NO: 266875 - DNA, 43 bp, Artificial Sequence
  Description of Artificial Sequence: Synthetic oligonucleotide
cgagctaccaatattgttgttcttcgggtagaaataaaatctg

SEQ ID NO: 266876 - DNA, 45 bp, Artificial Sequence
  Description of Artificial Sequence: Synthetic oligonucleotide
gagctaccaatattgttgttcttcgggtagaaataaaatctgtag

SEQ ID NO: 266877 - DNA, 45 bp, Artificial Sequence
  Description of Artificial Sequence: Synthetic oligonucleotide
agctaccaatattgttgttcttcgggtagaaataaaatctgtagc

SEQ ID NO: 266878 - DNA, 44 bp, Artificial Sequence
  Description of Artificial Sequence: Synthetic oligonucleotide
gctaccaatattgttgttcttcgggtagaaataaaatctgtagc

SEQ ID NO: 266879 - DNA, 44 bp, Artificial Sequence
  Description of Artificial Sequence: Synthetic oligonucleotide
ctaccaatattgttgttcttcgggtagaaataaaatctgtagcc

SEQ ID NO: 266880 - DNA, 46 bp, Artificial Sequence
  Description of Artificial Sequence: Synthetic oligonucleotide
taccaatattgttgttcttcgggtagaaataaaatctgtagccaag

SEQ ID NO: 266881 - DNA, 45 bp, Artificial Sequence
  Description of Artificial Sequence: Synthetic oligonucleotide
accaatattgttgttcttcgggtagaaataaaatctgtagccaag

SEQ ID NO: 266882 - DNA, 44 bp, Artificial Sequence
  Description of Artificial Sequence: Synthetic oligonucleotide
ccaatattgttgttcttcgggtagaaataaaatctgtagccaag

SEQ ID NO: 266883 - DNA, 44 bp, Artificial Sequence
  Description of Artificial Sequence: Synthetic oligonucleotide
caatattgttgttcttcgggtagaaataaaatctgtagccaagc

SEQ ID NO: 266884 - DNA, 46 bp, Artificial Sequence
  Description of Artificial Sequence: Synthetic oligonucleotide
aatattgttgttcttcgggtagaaataaaatctgtagccaagcttg

SEQ ID NO: 266885 - DNA, 45 bp, Artificial Sequence
  Description of Artificial Sequence: Synthetic oligonucleotide
atattgttgttcttcgggtagaaataaaatctgtagccaagcttg

SEQ ID NO: 266886 - DNA, 44 bp, Artificial Sequence
  Description of Artificial Sequence: Synthetic oligonucleotide
tattgttgttcttcgggtagaaataaaatctgtagccaagcttg

SEQ ID NO: 266887 - DNA, 43 bp, Artificial Sequence
  Description of Artificial Sequence: Synthetic oligonucleotide
attgttgttcttcgggtagaaataaaatctgtagccaagcttg

SEQ ID NO: 266888 - DNA, 42 bp, Artificial Sequence
  Description of Artificial Sequence: Synthetic oligonucleotide
ttgttgttcttcgggtagaaataaaatctgtagccaagcttg

SEQ ID NO: 266889 - DNA, 41 bp, Artificial Sequence
  Description of Artificial Sequence: Synthetic oligonucleotide
tgttgttcttcgggtagaaataaaatctgtagccaagcttg

SEQ ID NO: 266890 - DNA, 40 bp, Artificial Sequence
  Description of Artificial Sequence: Synthetic oligonucleotide
gttgttcttcgggtagaaataaaatctgtagccaagcttg

SEQ ID NO: 266891 - DNA, 42 bp, Artificial Sequence
  Description of Artificial Sequence: Synthetic oligonucleotide
ttgttcttcgggtagaaataaaatctgtagccaagcttgaag

SEQ ID NO: 266892 - DNA, 41 bp, Artificial Sequence
  Description of Artificial Sequence: Synthetic oligonucleotide
tgttcttcgggtagaaataaaatctgtagccaagcttgaag

SEQ ID NO: 266893 - DNA, 40 bp, Artificial Sequence
  Description of Artificial Sequence: Synthetic oligonucleotide
gttcttcgggtagaaataaaatctgtagccaagcttgaag

SEQ ID NO: 266894 - DNA, 42 bp, Artificial Sequence
  Description of Artificial Sequence: Synthetic oligonucleotide
ttcttcgggtagaaataaaatctgtagccaagcttgaagatg

SEQ ID NO: 266895 - DNA, 41 bp, Artificial Sequence
  Description of Artificial Sequence: Synthetic oligonucleotide
tcttcgggtagaaataaaatctgtagccaagcttgaagatg

SEQ ID NO: 266896 - DNA, 40 bp, Artificial Sequence
  Description of Artificial Sequence: Synthetic oligonucleotide
cttcgggtagaaataaaatctgtagccaagcttgaagatg

SEQ ID NO: 266897 - DNA, 43 bp, Artificial Sequence
  Description of Artificial Sequence: Synthetic oligonucleotide
ttcgggtagaaataaaatctgtagccaagcttgaagatgaaac

SEQ ID NO: 266898 - DNA, 42 bp, Artificial Sequence
  Description of Artificial Sequence: Synthetic oligonucleotide
tcgggtagaaataaaatctgtagccaagcttgaagatgaaac

SEQ ID NO: 266899 - DNA, 41 bp, Artificial Sequence
  Description of Artificial Sequence: Synthetic oligonucleotide
cgggtagaaataaaatctgtagccaagcttgaagatgaaac

SEQ ID NO: 266900 - DNA, 43 bp, Artificial Sequence
  Description of Artificial Sequence: Synthetic oligonucleotide
gggtagaaataaaatctgtagccaagcttgaagatgaaacaac

SEQ ID NO: 266901 - DNA, 44 bp, Artificial Sequence
  Description of Artificial Sequence: Synthetic oligonucleotide
ggtagaaataaaatctgtagccaagcttgaagatgaaacaactg

SEQ ID NO: 266902 - DNA, 45 bp, Artificial Sequence
  Description of Artificial Sequence: Synthetic oligonucleotide
gtagaaataaaatctgtagccaagcttgaagatgaaacaactgtg

SEQ ID NO: 266903 - DNA, 46 bp, Artificial Sequence
  Description of Artificial Sequence: Synthetic oligonucleotide
tagaaataaaatctgtagccaagcttgaagatgaaacaactgtgag

SEQ ID NO: 266904 - DNA, 45 bp, Artificial Sequence
  Description of Artificial Sequence: Synthetic oligonucleotide
agaaataaaatctgtagccaagcttgaagatgaaacaactgtgag

SEQ ID NO: 266905 - DNA, 44 bp, Artificial Sequence
  Description of Artificial Sequence: Synthetic oligonucleotide
gaaataaaatctgtagccaagcttgaagatgaaacaactgtgag

SEQ ID NO: 266906 - DNA, 44 bp, Artificial Sequence
  Description of Artificial Sequence: Synthetic oligonucleotide
aaataaaatctgtagccaagcttgaagatgaaacaactgtgagc

SEQ ID NO: 266907 - DNA, 43 bp, Artificial Sequence
  Description of Artificial Sequence: Synthetic oligonucleotide
aataaaatctgtagccaagcttgaagatgaaacaactgtgagc

SEQ ID NO: 266908 - DNA, 42 bp, Artificial Sequence
  Description of Artificial Sequence: Synthetic oligonucleotide
ataaaatctgtagccaagcttgaagatgaaacaactgtgagc

SEQ ID NO: 266909 - DNA, 41 bp, Artificial Sequence
  Description of Artificial Sequence: Synthetic oligonucleotide
taaaatctgtagccaagcttgaagatgaaacaactgtgagc

SEQ ID NO: 266910 - DNA, 40 bp, Artificial Sequence
  Description of Artificial Sequence: Synthetic oligonucleotide
aaaatctgtagccaagcttgaagatgaaacaactgtgagc

SEQ ID NO: 266911 - DNA, 39 bp, Artificial Sequence
  Description of Artificial Sequence: Synthetic oligonucleotide
aaatctgtagccaagcttgaagatgaaacaactgtgagc

SEQ ID NO: 266912 - DNA, 38 bp, Artificial Sequence
  Description of Artificial Sequence: Synthetic oligonucleotide
aatctgtagccaagcttgaagatgaaacaactgtgagc

SEQ ID NO: 266913 - DNA, 37 bp, Artificial Sequence
  Description of Artificial Sequence: Synthetic oligonucleotide
atctgtagccaagcttgaagatgaaacaactgtgagc

SEQ ID NO: 266914 - DNA, 36 bp, Artificial Sequence
  Description of Artificial Sequence: Synthetic oligonucleotide
tctgtagccaagcttgaagatgaaacaactgtgagc

SEQ ID NO: 266915 - DNA, 35 bp, Artificial Sequence
  Description of Artificial Sequence: Synthetic oligonucleotide
ctgtagccaagcttgaagatgaaacaactgtgagc

SEQ ID NO: 266916 - DNA, 42 bp, Artificial Sequence
  Description of Artificial Sequence: Synthetic oligonucleotide
tgtagccaagcttgaagatgaaacaactgtgagcaaaatttg

SEQ ID NO: 266917 - DNA, 41 bp, Artificial Sequence
  Description of Artificial Sequence: Synthetic oligonucleotide
gtagccaagcttgaagatgaaacaactgtgagcaaaatttg

SEQ ID NO: 266918 - DNA, 42 bp, Artificial Sequence
  Description of Artificial Sequence: Synthetic oligonucleotide
tagccaagcttgaagatgaaacaactgtgagcaaaatttgtc

SEQ ID NO: 266919 - DNA, 41 bp, Artificial Sequence
  Description of Artificial Sequence: Synthetic oligonucleotide
agccaagcttgaagatgaaacaactgtgagcaaaatttgtc

SEQ ID NO: 266920 - DNA, 40 bp, Artificial Sequence
  Description of Artificial Sequence: Synthetic oligonucleotide
gccaagcttgaagatgaaacaactgtgagcaaaatttgtc

SEQ ID NO: 266921 - DNA, 40 bp, Artificial Sequence
  Description of Artificial Sequence: Synthetic oligonucleotide
ccaagcttgaagatgaaacaactgtgagcaaaatttgtcc

SEQ ID NO: 266922 - DNA, 40 bp, Artificial Sequence
  Description of Artificial Sequence: Synthetic oligonucleotide
caagcttgaagatgaaacaactgtgagcaaaatttgtccc

SEQ ID NO: 266923 - DNA, 40 bp, Artificial Sequence
  Description of Artificial Sequence: Synthetic oligonucleotide
aagcttgaagatgaaacaactgtgagcaaaatttgtcccc

SEQ ID NO: 266924 - DNA, 39 bp, Artificial Sequence
  Description of Artificial Sequence: Synthetic oligonucleotide
agcttgaagatgaaacaactgtgagcaaaatttgtcccc

SEQ ID NO: 266925 - DNA, 38 bp, Artificial Sequence
  Description of Artificial Sequence: Synthetic oligonucleotide
gcttgaagatgaaacaactgtgagcaaaatttgtcccc

SEQ ID NO: 266926 - DNA, 40 bp, Artificial Sequence
  Description of Artificial Sequence: Synthetic oligonucleotide
cttgaagatgaaacaactgtgagcaaaatttgtccccttg

SEQ ID NO: 266927 - DNA, 42 bp, Artificial Sequence
  Description of Artificial Sequence: Synthetic oligonucleotide
ttgaagatgaaacaactgtgagcaaaatttgtccccttgatg

SEQ ID NO: 266928 - DNA, 41 bp, Artificial Sequence
  Description of Artificial Sequence: Synthetic oligonucleotide
tgaagatgaaacaactgtgagcaaaatttgtccccttgatg

SEQ ID NO: 266929 - DNA, 40 bp, Artificial Sequence
  Description of Artificial Sequence: Synthetic oligonucleotide
gaagatgaaacaactgtgagcaaaatttgtccccttgatg

SEQ ID NO: 266930 - DNA, 41 bp, Artificial Sequence
  Description of Artificial Sequence: Synthetic oligonucleotide
aagatgaaacaactgtgagcaaaatttgtccccttgatgtc

SEQ ID NO: 266931 - DNA, 40 bp, Artificial Sequence
  Description of Artificial Sequence: Synthetic oligonucleotide
agatgaaacaactgtgagcaaaatttgtccccttgatgtc

SEQ ID NO: 266932 - DNA, 39 bp, Artificial Sequence
  Description of Artificial Sequence: Synthetic oligonucleotide
gatgaaacaactgtgagcaaaatttgtccccttgatgtc

SEQ ID NO: 266933 - DNA, 39 bp, Artificial Sequence
  Description of Artificial Sequence: Synthetic oligonucleotide
atgaaacaactgtgagcaaaatttgtccccttgatgtcc

SEQ ID NO: 266934 - DNA, 38 bp, Artificial Sequence
  Description of Artificial Sequence: Synthetic oligonucleotide
tgaaacaactgtgagcaaaatttgtccccttgatgtcc

SEQ ID NO: 266935 - DNA, 37 bp, Artificial Sequence
  Description of Artificial Sequence: Synthetic oligonucleotide
gaaacaactgtgagcaaaatttgtccccttgatgtcc

SEQ ID NO: 266936 - DNA, 39 bp, Artificial Sequence
  Description of Artificial Sequence: Synthetic oligonucleotide
aaacaactgtgagcaaaatttgtccccttgatgtccatg

SEQ ID NO: 266937 - DNA, 38 bp, Artificial Sequence
  Description of Artificial Sequence: Synthetic oligonucleotide
aacaactgtgagcaaaatttgtccccttgatgtccatg

SEQ ID NO: 266938 - DNA, 37 bp, Artificial Sequence
  Description of Artificial Sequence: Synthetic oligonucleotide
acaactgtgagcaaaatttgtccccttgatgtccatg

SEQ ID NO: 266939 - DNA, 36 bp, Artificial Sequence
  Description of Artificial Sequence: Synthetic oligonucleotide
caactgtgagcaaaatttgtccccttgatgtccatg

SEQ ID NO: 266940 - DNA, 37 bp, Artificial Sequence
  Description of Artificial Sequence: Synthetic oligonucleotide
aactgtgagcaaaatttgtccccttgatgtccatgtc

SEQ ID NO: 266941 - DNA, 36 bp, Artificial Sequence
  Description of Artificial Sequence: Synthetic oligonucleotide
actgtgagcaaaatttgtccccttgatgtccatgtc

SEQ ID NO: 266942 - DNA, 35 bp, Artificial Sequence
  Description of Artificial Sequence: Synthetic oligonucleotide
ctgtgagcaaaatttgtccccttgatgtccatgtc

SEQ ID NO: 266943 - DNA, 36 bp, Artificial Sequence
  Description of Artificial Sequence: Synthetic oligonucleotide
tgtgagcaaaatttgtccccttgatgtccatgtctg

SEQ ID NO: 266944 - DNA, 35 bp, Artificial Sequence
  Description of Artificial Sequence: Synthetic oligonucleotide
gtgagcaaaatttgtccccttgatgtccatgtctg

SEQ ID NO: 266945 - DNA, 35 bp, Artificial Sequence
  Description of Artificial Sequence: Synthetic oligonucleotide
tgagcaaaatttgtccccttgatgtccatgtctgg

SEQ ID NO: 266946 - DNA, 34 bp, Artificial Sequence
  Description of Artificial Sequence: Synthetic oligonucleotide
gagcaaaatttgtccccttgatgtccatgtctgg

SEQ ID NO: 266947 - DNA, 36 bp, Artificial Sequence
  Description of Artificial Sequence: Synthetic oligonucleotide
agcaaaatttgtccccttgatgtccatgtctggatg

SEQ ID NO: 266948 - DNA, 35 bp, Artificial Sequence
  Description of Artificial Sequence: Synthetic oligonucleotide
gcaaaatttgtccccttgatgtccatgtctggatg

SEQ ID NO: 266949 - DNA, 35 bp, Artificial Sequence
  Description of Artificial Sequence: Synthetic oligonucleotide
caaaatttgtccccttgatgtccatgtctggatgg

SEQ ID NO: 266950 - DNA, 35 bp, Artificial Sequence
  Description of Artificial Sequence: Synthetic oligonucleotide
aaaatttgtccccttgatgtccatgtctggatggc

SEQ ID NO: 266951 - DNA, 34 bp, Artificial Sequence
  Description of Artificial Sequence: Synthetic oligonucleotide
aaatttgtccccttgatgtccatgtctggatggc

SEQ ID NO: 266952 - DNA, 33 bp, Artificial Sequence
  Description of Artificial Sequence: Synthetic oligonucleotide
aatttgtccccttgatgtccatgtctggatggc

SEQ ID NO: 266953 - DNA, 32 bp, Artificial Sequence
  Description of Artificial Sequence: Synthetic oligonucleotide
atttgtccccttgatgtccatgtctggatggc

SEQ ID NO: 266954 - DNA, 31 bp, Artificial Sequence
  Description of Artificial Sequence: Synthetic oligonucleotide
tttgtccccttgatgtccatgtctggatggc

SEQ ID NO: 266955 - DNA, 30 bp, Artificial Sequence
  Description of Artificial Sequence: Synthetic oligonucleotide
ttgtccccttgatgtccatgtctggatggc

SEQ ID NO: 266956 - DNA, 29 bp, Artificial Sequence
  Description of Artificial Sequence: Synthetic oligonucleotide
tgtccccttgatgtccatgtctggatggc

SEQ ID NO: 266957 - DNA, 28 bp, Artificial Sequence
  Description of Artificial Sequence: Synthetic oligonucleotide
gtccccttgatgtccatgtctggatggc

SEQ ID NO: 266958 - DNA, 32 bp, Artificial Sequence
  Description of Artificial Sequence: Synthetic oligonucleotide
tccccttgatgtccatgtctggatggcttttc

SEQ ID NO: 266959 - DNA, 31 bp, Artificial Sequence
  Description of Artificial Sequence: Synthetic oligonucleotide
ccccttgatgtccatgtctggatggcttttc

SEQ ID NO: 266960 - DNA, 31 bp, Artificial Sequence
  Description of Artificial Sequence: Synthetic oligonucleotide
cccttgatgtccatgtctggatggcttttcc

SEQ ID NO: 266961 - DNA, 32 bp, Artificial Sequence
  Description of Artificial Sequence: Synthetic oligonucleotide
ccttgatgtccatgtctggatggcttttccag

SEQ ID NO: 266962 - DNA, 36 bp, Artificial Sequence
  Description of Artificial Sequence: Synthetic oligonucleotide
cttgatgtccatgtctggatggcttttccagttttg

SEQ ID NO: 266963 - DNA, 37 bp, Artificial Sequence
  Description of Artificial Sequence: Synthetic oligonucleotide
ttgatgtccatgtctggatggcttttccagttttgag

SEQ ID NO: 266964 - DNA, 36 bp, Artificial Sequence
  Description of Artificial Sequence: Synthetic oligonucleotide
tgatgtccatgtctggatggcttttccagttttgag

SEQ ID NO: 266965 - DNA, 35 bp, Artificial Sequence
  Description of Artificial Sequence: Synthetic oligonucleotide
gatgtccatgtctggatggcttttccagttttgag

SEQ ID NO: 266966 - DNA, 45 bp, Artificial Sequence
  Description of Artificial Sequence: Synthetic oligonucleotide
atgtccatgtctggatggcttttccagttttgagaatttttattg

SEQ ID NO: 266967 - DNA, 44 bp, Artificial Sequence
  Description of Artificial Sequence: Synthetic oligonucleotide
tgtccatgtctggatggcttttccagttttgagaatttttattg

SEQ ID NO: 266968 - DNA, 43 bp, Artificial Sequence
  Description of Artificial Sequence: Synthetic oligonucleotide
gtccatgtctggatggcttttccagttttgagaatttttattg

SEQ ID NO: 266969 - DNA, 43 bp, Artificial Sequence
  Description of Artificial Sequence: Synthetic oligonucleotide
tccatgtctggatggcttttccagttttgagaatttttattgg

SEQ ID NO: 266970 - DNA, 42 bp, Artificial Sequence
  Description of Artificial Sequence: Synthetic oligonucleotide
ccatgtctggatggcttttccagttttgagaatttttattgg

SEQ ID NO: 266971 - DNA, 43 bp, Artificial Sequence
  Description of Artificial Sequence: Synthetic oligonucleotide
catgtctggatggcttttccagttttgagaatttttattggac

SEQ ID NO: 266972 - DNA, 46 bp, Artificial Sequence
  Description of Artificial Sequence: Synthetic oligonucleotide
atgtctggatggcttttccagttttgagaatttttattggacttac

SEQ ID NO: 266973 - DNA, 45 bp, Artificial Sequence
  Description of Artificial Sequence: Synthetic oligonucleotide
tgtctggatggcttttccagttttgagaatttttattggacttac

SEQ ID NO: 266974 - DNA, 44 bp, Artificial Sequence
  Description of Artificial Sequence: Synthetic oligonucleotide
gtctggatggcttttccagttttgagaatttttattggacttac

SEQ ID NO: 266975 - DNA, 45 bp, Artificial Sequence
  Description of Artificial Sequence: Synthetic oligonucleotide
tctggatggcttttccagttttgagaatttttattggacttactc

SEQ ID NO: 266976 - DNA, 44 bp, Artificial Sequence
  Description of Artificial Sequence: Synthetic oligonucleotide
ctggatggcttttccagttttgagaatttttattggacttactc

SEQ ID NO: 266977 - DNA, 44 bp, Artificial Sequence
  Description of Artificial Sequence: Synthetic oligonucleotide
tggatggcttttccagttttgagaatttttattggacttactcc

SEQ ID NO: 266978 - DNA, 43 bp, Artificial Sequence
  Description of Artificial Sequence: Synthetic oligonucleotide
ggatggcttttccagttttgagaatttttattggacttactcc

SEQ ID NO: 266979 - DNA, 44 bp, Artificial Sequence
  Description of Artificial Sequence: Synthetic oligonucleotide
gatggcttttccagttttgagaatttttattggacttactcctg

SEQ ID NO: 266980 - DNA, 46 bp, Artificial Sequence
  Description of Artificial Sequence: Synthetic oligonucleotide
atggcttttccagttttgagaatttttattggacttactcctgatg

SEQ ID NO: 266981 - DNA, 45 bp, Artificial Sequence
  Description of Artificial Sequence: Synthetic oligonucleotide
tggcttttccagttttgagaatttttattggacttactcctgatg

SEQ ID NO: 266982 - DNA, 44 bp, Artificial Sequence
  Description of Artificial Sequence: Synthetic oligonucleotide
ggcttttccagttttgagaatttttattggacttactcctgatg

SEQ ID NO: 266983 - DNA, 44 bp, Artificial Sequence
  Description of Artificial Sequence: Synthetic oligonucleotide
gcttttccagttttgagaatttttattggacttactcctgatgc

SEQ ID NO: 266984 - DNA, 46 bp, Artificial Sequence
  Description of Artificial Sequence: Synthetic oligonucleotide
cttttccagttttgagaatttttattggacttactcctgatgctac

SEQ ID NO: 266985 - DNA, 47 bp, Artificial Sequence
  Description of Artificial Sequence: Synthetic oligonucleotide
ttttccagttttgagaatttttattggacttactcctgatgctacag

SEQ ID NO: 266986 - DNA, 46 bp, Artificial Sequence
  Description of Artificial Sequence: Synthetic oligonucleotide
tttccagttttgagaatttttattggacttactcctgatgctacag

SEQ ID NO: 266987 - DNA, 45 bp, Artificial Sequence
  Description of Artificial Sequence: Synthetic oligonucleotide
ttccagttttgagaatttttattggacttactcctgatgctacag

SEQ ID NO: 266988 - DNA, 44 bp, Artificial Sequence
  Description of Artificial Sequence: Synthetic oligonucleotide
tccagttttgagaatttttattggacttactcctgatgctacag

SEQ ID NO: 266989 - DNA, 43 bp, Artificial Sequence
  Description of Artificial Sequence: Synthetic oligonucleotide
ccagttttgagaatttttattggacttactcctgatgctacag

SEQ ID NO: 266990 - DNA, 45 bp, Artificial Sequence
  Description of Artificial Sequence: Synthetic oligonucleotide
cagttttgagaatttttattggacttactcctgatgctacagtag

SEQ ID NO: 266991 - DNA, 52 bp, Artificial Sequence
  Description of Artificial Sequence: Synthetic oligonucleotide
agttttgagaatttttattggacttactcctgatgctacagtagtaattaac

SEQ ID NO: 266992 - DNA, 51 bp, Artificial Sequence
  Description of Artificial Sequence: Synthetic oligonucleotide
gttttgagaatttttattggacttactcctgatgctacagtagtaattaac

SEQ ID NO: 266993 - DNA, 52 bp, Artificial Sequence
  Description of Artificial Sequence: Synthetic oligonucleotide
ttttgagaatttttattggacttactcctgatgctacagtagtaattaacag

SEQ ID NO: 266994 - DNA, 51 bp, Artificial Sequence
  Description of Artificial Sequence: Synthetic oligonucleotide
tttgagaatttttattggacttactcctgatgctacagtagtaattaacag

SEQ ID NO: 266995 - DNA, 50 bp, Artificial Sequence
  Description of Artificial Sequence: Synthetic oligonucleotide
ttgagaatttttattggacttactcctgatgctacagtagtaattaacag

SEQ ID NO: 266996 - DNA, 49 bp, Artificial Sequence
  Description of Artificial Sequence: Synthetic oligonucleotide
tgagaatttttattggacttactcctgatgctacagtagtaattaacag

SEQ ID NO: 266997 - DNA, 48 bp, Artificial Sequence
  Description of Artificial Sequence: Synthetic oligonucleotide
gagaatttttattggacttactcctgatgctacagtagtaattaacag

SEQ ID NO: 266998 - DNA, 49 bp, Artificial Sequence
  Description of Artificial Sequence: Synthetic oligonucleotide
agaatttttattggacttactcctgatgctacagtagtaattaacagag

SEQ ID NO: 266999 - DNA, 48 bp, Artificial Sequence
  Description of Artificial Sequence: Synthetic oligonucleotide
gaatttttattggacttactcctgatgctacagtagtaattaacagag

SEQ ID NO: 267000 - DNA, 48 bp, Artificial Sequence
  Description of Artificial Sequence: Synthetic oligonucleotide
aatttttattggacttactcctgatgctacagtagtaattaacagagc

SEQ ID NO: 267001 - DNA, 47 bp, Artificial Sequence
  Description of Artificial Sequence: Synthetic oligonucleotide
atttttattggacttactcctgatgctacagtagtaattaacagagc

SEQ ID NO: 267002 - DNA, 46 bp, Artificial Sequence
  Description of Artificial Sequence: Synthetic oligonucleotide
tttttattggacttactcctgatgctacagtagtaattaacagagc

SEQ ID NO: 267003 - DNA, 45 bp, Artificial Sequence
  Description of Artificial Sequence: Synthetic oligonucleotide
ttttattggacttactcctgatgctacagtagtaattaacagagc

SEQ ID NO: 267004 - DNA, 44 bp, Artificial Sequence
  Description of Artificial Sequence: Synthetic oligonucleotide
tttattggacttactcctgatgctacagtagtaattaacagagc

SEQ ID NO: 267005 - DNA, 43 bp, Artificial Sequence
  Description of Artificial Sequence: Synthetic oligonucleotide
ttattggacttactcctgatgctacagtagtaattaacagagc

SEQ ID NO: 267006 - DNA, 42 bp, Artificial Sequence
  Description of Artificial Sequence: Synthetic oligonucleotide
tattggacttactcctgatgctacagtagtaattaacagagc

SEQ ID NO: 267007 - DNA, 41 bp, Artificial Sequence
  Description of Artificial Sequence: Synthetic oligonucleotide
attggacttactcctgatgctacagtagtaattaacagagc

SEQ ID NO: 267008 - DNA, 40 bp, Artificial Sequence
  Description of Artificial Sequence: Synthetic oligonucleotide
ttggacttactcctgatgctacagtagtaattaacagagc

SEQ ID NO: 267009 - DNA, 39 bp, Artificial Sequence
  Description of Artificial Sequence: Synthetic oligonucleotide
tggacttactcctgatgctacagtagtaattaacagagc

SEQ ID NO: 267010 - DNA, 38 bp, Artificial Sequence
  Description of Artificial Sequence: Synthetic oligonucleotide
ggacttactcctgatgctacagtagtaattaacagagc

SEQ ID NO: 267011 - DNA, 38 bp, Artificial Sequence
  Description of Artificial Sequence: Synthetic oligonucleotide
gacttactcctgatgctacagtagtaattaacagagcc

SEQ ID NO: 267012 - DNA, 38 bp, Artificial Sequence
  Description of Artificial Sequence: Synthetic oligonucleotide
acttactcctgatgctacagtagtaattaacagagccg

SEQ ID NO: 267013 - DNA, 37 bp, Artificial Sequence
  Description of Artificial Sequence: Synthetic oligonucleotide
cttactcctgatgctacagtagtaattaacagagccg

SEQ ID NO: 267014 - DNA, 37 bp, Artificial Sequence
  Description of Artificial Sequence: Synthetic oligonucleotide
ttactcctgatgctacagtagtaattaacagagccgg

SEQ ID NO: 267015 - DNA, 36 bp, Artificial Sequence
  Description of Artificial Sequence: Synthetic oligonucleotide
tactcctgatgctacagtagtaattaacagagccgg

SEQ ID NO: 267016 - DNA, 35 bp, Artificial Sequence
  Description of Artificial Sequence: Synthetic oligonucleotide
actcctgatgctacagtagtaattaacagagccgg

SEQ ID NO: 267017 - DNA, 34 bp, Artificial Sequence
  Description of Artificial Sequence: Synthetic oligonucleotide
ctcctgatgctacagtagtaattaacagagccgg

SEQ ID NO: 267018 - DNA, 35 bp, Artificial Sequence
  Description of Artificial Sequence: Synthetic oligonucleotide
tcctgatgctacagtagtaattaacagagccggtg

SEQ ID NO: 267019 - DNA, 34 bp, Artificial Sequence
  Description of Artificial Sequence: Synthetic oligonucleotide
cctgatgctacagtagtaattaacagagccggtg

SEQ ID NO: 267020 - DNA, 35 bp, Artificial Sequence
  Description of Artificial Sequence: Synthetic oligonucleotide
ctgatgctacagtagtaattaacagagccggtgtg

SEQ ID NO: 267021 - DNA, 35 bp, Artificial Sequence
  Description of Artificial Sequence: Synthetic oligonucleotide
tgatgctacagtagtaattaacagagccggtgtgg

SEQ ID NO: 267022 - DNA, 34 bp, Artificial Sequence
  Description of Artificial Sequence: Synthetic oligonucleotide
gatgctacagtagtaattaacagagccggtgtgg

SEQ ID NO: 267023 - DNA, 35 bp, Artificial Sequence
  Description of Artificial Sequence: Synthetic oligonucleotide
atgctacagtagtaattaacagagccggtgtggag

SEQ ID NO: 267024 - DNA, 34 bp, Artificial Sequence
  Description of Artificial Sequence: Synthetic oligonucleotide
tgctacagtagtaattaacagagccggtgtggag

SEQ ID NO: 267025 - DNA, 33 bp, Artificial Sequence
  Description of Artificial Sequence: Synthetic oligonucleotide
gctacagtagtaattaacagagccggtgtggag

SEQ ID NO: 267026 - DNA, 34 bp, Artificial Sequence
  Description of Artificial Sequence: Synthetic oligonucleotide
ctacagtagtaattaacagagccggtgtggagtc

SEQ ID NO: 267027 - DNA, 34 bp, Artificial Sequence
  Description of Artificial Sequence: Synthetic oligonucleotide
tacagtagtaattaacagagccggtgtggagtcc

SEQ ID NO: 267028 - DNA, 33 bp, Artificial Sequence
  Description of Artificial Sequence: Synthetic oligonucleotide
acagtagtaattaacagagccggtgtggagtcc

SEQ ID NO: 267029 - DNA, 32 bp, Artificial Sequence
  Description of Artificial Sequence: Synthetic oligonucleotide
cagtagtaattaacagagccggtgtggagtcc

SEQ ID NO: 267030 - DNA, 32 bp, Artificial Sequence
  Description of Artificial Sequence: Synthetic oligonucleotide
agtagtaattaacagagccggtgtggagtccc

SEQ ID NO: 267031 - DNA, 31 bp, Artificial Sequence
  Description of Artificial Sequence: Synthetic oligonucleotide
gtagtaattaacagagccggtgtggagtccc

SEQ ID NO: 267032 - DNA, 32 bp, Artificial Sequence
  Description of Artificial Sequence: Synthetic oligonucleotide
tagtaattaacagagccggtgtggagtcccag

SEQ ID NO: 267033 - DNA, 31 bp, Artificial Sequence
  Description of Artificial Sequence: Synthetic oligonucleotide
agtaattaacagagccggtgtggagtcccag

SEQ ID NO: 267034 - DNA, 30 bp, Artificial Sequence
  Description of Artificial Sequence: Synthetic oligonucleotide
gtaattaacagagccggtgtggagtcccag

SEQ ID NO: 267035 - DNA, 31 bp, Artificial Sequence
  Description of Artificial Sequence: Synthetic oligonucleotide
taattaacagagccggtgtggagtcccagag

SEQ ID NO: 267036 - DNA, 30 bp, Artificial Sequence
  Description of Artificial Sequence: Synthetic oligonucleotide
aattaacagagccggtgtggagtcccagag

SEQ ID NO: 267037 - DNA, 29 bp, Artificial Sequence
  Description of Artificial Sequence: Synthetic oligonucleotide
attaacagagccggtgtggagtcccagag

SEQ ID NO: 267038 - DNA, 28 bp, Artificial Sequence
  Description of Artificial Sequence: Synthetic oligonucleotide
ttaacagagccggtgtggagtcccagag

SEQ ID NO: 267039 - DNA, 27 bp, Artificial Sequence
  Description of Artificial Sequence: Synthetic oligonucleotide
taacagagccggtgtggagtcccagag

SEQ ID NO: 267040 - DNA, 26 bp, Artificial Sequence
  Description of Artificial Sequence: Synthetic oligonucleotide
aacagagccggtgtggagtcccagag

SEQ ID NO: 267041 - DNA, 25 bp, Artificial Sequence
  Description of Artificial Sequence: Synthetic oligonucleotide
acagagccggtgtggagtcccagag

SEQ ID NO: 267042 - DNA, 24 bp, Artificial Sequence
  Description of Artificial Sequence: Synthetic oligonucleotide
cagagccggtgtggagtcccagag

SEQ ID NO: 267043 - DNA, 24 bp, Artificial Sequence
  Description of Artificial Sequence: Synthetic oligonucleotide
agagccggtgtggagtcccagagc

SEQ ID NO: 267044 - DNA, 23 bp, Artificial Sequence
  Description of Artificial Sequence: Synthetic oligonucleotide
gagccggtgtggagtcccagagc

SEQ ID NO: 267045 - DNA, 27 bp, Artificial Sequence
  Description of Artificial Sequence: Synthetic oligonucleotide
agccggtgtggagtcccagagccaaaa

SEQ ID NO: 267046 - DNA, 26 bp, Artificial Sequence
  Description of Artificial Sequence: Synthetic oligonucleotide
gccggtgtggagtcccagagccaaaa

SEQ ID NO: 267047 - DNA, 26 bp, Artificial Sequence
  Description of Artificial Sequence: Synthetic oligonucleotide
ccggtgtggagtcccagagccaaaag

SEQ ID NO: 267048 - DNA, 27 bp, Artificial Sequence
  Description of Artificial Sequence: Synthetic oligonucleotide
cggtgtggagtcccagagccaaaagct

SEQ ID NO: 267049 - DNA, 29 bp, Artificial Sequence
  Description of Artificial Sequence: Synthetic oligonucleotide
ggtgtggagtcccagagccaaaagcttac

SEQ ID NO: 267050 - DNA, 29 bp, Artificial Sequence
  Description of Artificial Sequence: Synthetic oligonucleotide
gtgtggagtcccagagccaaaagcttacg

SEQ ID NO: 267051 - DNA, 29 bp, Artificial Sequence
  Description of Artificial Sequence: Synthetic oligonucleotide
tgtggagtcccagagccaaaagcttacgc

SEQ ID NO: 267052 - DNA, 28 bp, Artificial Sequence
  Description of Artificial Sequence: Synthetic oligonucleotide
gtggagtcccagagccaaaagcttacgc

SEQ ID NO: 267053 - DNA, 30 bp, Artificial Sequence
  Description of Artificial Sequence: Synthetic oligonucleotide
tggagtcccagagccaaaagcttacgcttg

SEQ ID NO: 267054 - DNA, 29 bp, Artificial Sequence
  Description of Artificial Sequence: Synthetic oligonucleotide
ggagtcccagagccaaaagcttacgcttg

SEQ ID NO: 267055 - DNA, 30 bp, Artificial Sequence
  Description of Artificial Sequence: Synthetic oligonucleotide
gagtcccagagccaaaagcttacgcttgag

SEQ ID NO: 267056 - DNA, 30 bp, Artificial Sequence
  Description of Artificial Sequence: Synthetic oligonucleotide
agtcccagagccaaaagcttacgcttgagg

SEQ ID NO: 267057 - DNA, 29 bp, Artificial Sequence
  Description of Artificial Sequence: Synthetic oligonucleotide
gtcccagagccaaaagcttacgcttgagg

SEQ ID NO: 267058 - DNA, 30 bp, Artificial Sequence
  Description of Artificial Sequence: Synthetic oligonucleotide
tcccagagccaaaagcttacgcttgaggac

SEQ ID NO: 267059 - DNA, 29 bp, Artificial Sequence
  Description of Artificial Sequence: Synthetic oligonucleotide
cccagagccaaaagcttacgcttgaggac

SEQ ID NO: 267060 - DNA, 29 bp, Artificial Sequence
  Description of Artificial Sequence: Synthetic oligonucleotide
ccagagccaaaagcttacgcttgaggacc

SEQ ID NO: 267061 - DNA, 29 bp, Artificial Sequence
  Description of Artificial Sequence: Synthetic oligonucleotide
cagagccaaaagcttacgcttgaggaccg

SEQ ID NO: 267062 - DNA, 30 bp, Artificial Sequence
  Description of Artificial Sequence: Synthetic oligonucleotide
agagccaaaagcttacgcttgaggaccgag

SEQ ID NO: 267063 - DNA, 29 bp, Artificial Sequence
  Description of Artificial Sequence: Synthetic oligonucleotide
gagccaaaagcttacgcttgaggaccgag

SEQ ID NO: 267064 - DNA, 30 bp, Artificial Sequence
  Description of Artificial Sequence: Synthetic oligonucleotide
agccaaaagcttacgcttgaggaccgagtc

SEQ ID NO: 267065 - DNA, 29 bp, Artificial Sequence
  Description of Artificial Sequence: Synthetic oligonucleotide
gccaaaagcttacgcttgaggaccgagtc

SEQ ID NO: 267066 - DNA, 30 bp, Artificial Sequence
  Description of Artificial Sequence: Synthetic oligonucleotide
ccaaaagcttacgcttgaggaccgagtcac

SEQ ID NO: 267067 - DNA, 31 bp, Artificial Sequence
  Description of Artificial Sequence: Synthetic oligonucleotide
caaaagcttacgcttgaggaccgagtcactg

SEQ ID NO: 267068 - DNA, 33 bp, Artificial Sequence
  Description of Artificial Sequence: Synthetic oligonucleotide
aaaagcttacgcttgaggaccgagtcactgttg

SEQ ID NO: 267069 - DNA, 32 bp, Artificial Sequence
  Description of Artificial Sequence: Synthetic oligonucleotide
aaagcttacgcttgaggaccgagtcactgttg

SEQ ID NO: 267070 - DNA, 31 bp, Artificial Sequence
  Description of Artificial Sequence: Synthetic oligonucleotide
aagcttacgcttgaggaccgagtcactgttg

SEQ ID NO: 267071 - DNA, 30 bp, Artificial Sequence
  Description of Artificial Sequence: Synthetic oligonucleotide
agcttacgcttgaggaccgagtcactgttg

SEQ ID NO: 267072 - DNA, 29 bp, Artificial Sequence
  Description of Artificial Sequence: Synthetic oligonucleotide
gcttacgcttgaggaccgagtcactgttg

SEQ ID NO: 267073 - DNA, 33 bp, Artificial Sequence
  Description of Artificial Sequence: Synthetic oligonucleotide
cttacgcttgaggaccgagtcactgttgaatac

SEQ ID NO: 267074 - DNA, 37 bp, Artificial Sequence
  Description of Artificial Sequence: Synthetic oligonucleotide
ttacgcttgaggaccgagtcactgttgaatacatatc

SEQ ID NO: 267075 - DNA, 36 bp, Artificial Sequence
  Description of Artificial Sequence: Synthetic oligonucleotide
tacgcttgaggaccgagtcactgttgaatacatatc

SEQ ID NO: 267076 - DNA, 35 bp, Artificial Sequence
  Description of Artificial Sequence: Synthetic oligonucleotide
acgcttgaggaccgagtcactgttgaatacatatc

SEQ ID NO: 267077 - DNA, 34 bp, Artificial Sequence
  Description of Artificial Sequence: Synthetic oligonucleotide
cgcttgaggaccgagtcactgttgaatacatatc

SEQ ID NO: 267078 - DNA, 35 bp, Artificial Sequence
  Description of Artificial Sequence: Synthetic oligonucleotide
gcttgaggaccgagtcactgttgaatacatatctc

SEQ ID NO: 267079 - DNA, 35 bp, Artificial Sequence
  Description of Artificial Sequence: Synthetic oligonucleotide
cttgaggaccgagtcactgttgaatacatatctcg

SEQ ID NO: 267080 - DNA, 35 bp, Artificial Sequence
  Description of Artificial Sequence: Synthetic oligonucleotide
ttgaggaccgagtcactgttgaatacatatctcgc

SEQ ID NO: 267081 - DNA, 34 bp, Artificial Sequence
  Description of Artificial Sequence: Synthetic oligonucleotide
tgaggaccgagtcactgttgaatacatatctcgc

SEQ ID NO: 267082 - DNA, 33 bp, Artificial Sequence
  Description of Artificial Sequence: Synthetic oligonucleotide
gaggaccgagtcactgttgaatacatatctcgc

SEQ ID NO: 267083 - DNA, 35 bp, Artificial Sequence
  Description of Artificial Sequence: Synthetic oligonucleotide
aggaccgagtcactgttgaatacatatctcgcttc

SEQ ID NO: 267084 - DNA, 34 bp, Artificial Sequence
  Description of Artificial Sequence: Synthetic oligonucleotide
ggaccgagtcactgttgaatacatatctcgcttc

SEQ ID NO: 267085 - DNA, 37 bp, Artificial Sequence
  Description of Artificial Sequence: Synthetic oligonucleotide
gaccgagtcactgttgaatacatatctcgcttcaaag

SEQ ID NO: 267086 - DNA, 37 bp, Artificial Sequence
  Description of Artificial Sequence: Synthetic oligonucleotide
accgagtcactgttgaatacatatctcgcttcaaagc

SEQ ID NO: 267087 - DNA, 36 bp, Artificial Sequence
  Description of Artificial Sequence: Synthetic oligonucleotide
ccgagtcactgttgaatacatatctcgcttcaaagc

SEQ ID NO: 267088 - DNA, 38 bp, Artificial Sequence
  Description of Artificial Sequence: Synthetic oligonucleotide
cgagtcactgttgaatacatatctcgcttcaaagcaac

SEQ ID NO: 267089 - DNA, 44 bp, Artificial Sequence
  Description of Artificial Sequence: Synthetic oligonucleotide
gagtcactgttgaatacatatctcgcttcaaagcaacttttaag

SEQ ID NO: 267090 - DNA, 44 bp, Artificial Sequence
  Description of Artificial Sequence: Synthetic oligonucleotide
agtcactgttgaatacatatctcgcttcaaagcaacttttaagc

SEQ ID NO: 267091 - DNA, 43 bp, Artificial Sequence
  Description of Artificial Sequence: Synthetic oligonucleotide
gtcactgttgaatacatatctcgcttcaaagcaacttttaagc

SEQ ID NO: 267092 - DNA, 44 bp, Artificial Sequence
  Description of Artificial Sequence: Synthetic oligonucleotide
tcactgttgaatacatatctcgcttcaaagcaacttttaagcag

SEQ ID NO: 267093 - DNA, 43 bp, Artificial Sequence
  Description of Artificial Sequence: Synthetic oligonucleotide
cactgttgaatacatatctcgcttcaaagcaacttttaagcag

SEQ ID NO: 267094 - DNA, 50 bp, Artificial Sequence
  Description of Artificial Sequence: Synthetic oligonucleotide
actgttgaatacatatctcgcttcaaagcaacttttaagcagaaaaatac

SEQ ID NO: 267095 - DNA, 49 bp, Artificial Sequence
  Description of Artificial Sequence: Synthetic oligonucleotide
ctgttgaatacatatctcgcttcaaagcaacttttaagcagaaaaatac

SEQ ID NO: 267096 - DNA, 49 bp, Artificial Sequence
  Description of Artificial Sequence: Synthetic oligonucleotide
tgttgaatacatatctcgcttcaaagcaacttttaagcagaaaaatacc

SEQ ID NO: 267097 - DNA, 48 bp, Artificial Sequence
  Description of Artificial Sequence: Synthetic oligonucleotide
gttgaatacatatctcgcttcaaagcaacttttaagcagaaaaatacc

SEQ ID NO: 267098 - DNA, 48 bp, Artificial Sequence
  Description of Artificial Sequence: Synthetic oligonucleotide
ttgaatacatatctcgcttcaaagcaacttttaagcagaaaaataccc

SEQ ID NO: 267099 - DNA, 47 bp, Artificial Sequence
  Description of Artificial Sequence: Synthetic oligonucleotide
tgaatacatatctcgcttcaaagcaacttttaagcagaaaaataccc

SEQ ID NO: 267100 - DNA, 46 bp, Artificial Sequence
  Description of Artificial Sequence: Synthetic oligonucleotide
gaatacatatctcgcttcaaagcaacttttaagcagaaaaataccc

SEQ ID NO: 267101 - DNA, 49 bp, Artificial Sequence
  Description of Artificial Sequence: Synthetic oligonucleotide
aatacatatctcgcttcaaagcaacttttaagcagaaaaatacccaaac

SEQ ID NO: 267102 - DNA, 48 bp, Artificial Sequence
  Description of Artificial Sequence: Synthetic oligonucleotide
atacatatctcgcttcaaagcaacttttaagcagaaaaatacccaaac

SEQ ID NO: 267103 - DNA, 47 bp, Artificial Sequence
  Description of Artificial Sequence: Synthetic oligonucleotide
tacatatctcgcttcaaagcaacttttaagcagaaaaatacccaaac

SEQ ID NO: 267104 - DNA, 46 bp, Artificial Sequence
  Description of Artificial Sequence: Synthetic oligonucleotide
acatatctcgcttcaaagcaacttttaagcagaaaaatacccaaac

SEQ ID NO: 267105 - DNA, 45 bp, Artificial Sequence
  Description of Artificial Sequence: Synthetic oligonucleotide
catatctcgcttcaaagcaacttttaagcagaaaaatacccaaac

SEQ ID NO: 267106 - DNA, 45 bp, Artificial Sequence
  Description of Artificial Sequence: Synthetic oligonucleotide
atatctcgcttcaaagcaacttttaagcagaaaaatacccaaacc

SEQ ID NO: 267107 - DNA, 44 bp, Artificial Sequence
  Description of Artificial Sequence: Synthetic oligonucleotide
tatctcgcttcaaagcaacttttaagcagaaaaatacccaaacc

SEQ ID NO: 267108 - DNA, 43 bp, Artificial Sequence
  Description of Artificial Sequence: Synthetic oligonucleotide
atctcgcttcaaagcaacttttaagcagaaaaatacccaaacc

SEQ ID NO: 267109 - DNA, 42 bp, Artificial Sequence
  Description of Artificial Sequence: Synthetic oligonucleotide
tctcgcttcaaagcaacttttaagcagaaaaatacccaaacc

SEQ ID NO: 267110 - DNA, 41 bp, Artificial Sequence
  Description of Artificial Sequence: Synthetic oligonucleotide
ctcgcttcaaagcaacttttaagcagaaaaatacccaaacc

SEQ ID NO: 267111 - DNA, 44 bp, Artificial Sequence
  Description of Artificial Sequence: Synthetic oligonucleotide
tcgcttcaaagcaacttttaagcagaaaaatacccaaaccaatg

SEQ ID NO: 267112 - DNA, 43 bp, Artificial Sequence
  Description of Artificial Sequence: Synthetic oligonucleotide
cgcttcaaagcaacttttaagcagaaaaatacccaaaccaatg

SEQ ID NO: 267113 - DNA, 43 bp, Artificial Sequence
  Description of Artificial Sequence: Synthetic oligonucleotide
gcttcaaagcaacttttaagcagaaaaatacccaaaccaatgg

SEQ ID NO: 267114 - DNA, 44 bp, Artificial Sequence
  Description of Artificial Sequence: Synthetic oligonucleotide
cttcaaagcaacttttaagcagaaaaatacccaaaccaatggac

SEQ ID NO: 267115 - DNA, 44 bp, Artificial Sequence
  Description of Artificial Sequence: Synthetic oligonucleotide
ttcaaagcaacttttaagcagaaaaatacccaaaccaatggacg

SEQ ID NO: 267116 - DNA, 43 bp, Artificial Sequence
  Description of Artificial Sequence: Synthetic oligonucleotide
tcaaagcaacttttaagcagaaaaatacccaaaccaatggacg

SEQ ID NO: 267117 - DNA, 42 bp, Artificial Sequence
  Description of Artificial Sequence: Synthetic oligonucleotide
caaagcaacttttaagcagaaaaatacccaaaccaatggacg

SEQ ID NO: 267118 - DNA, 44 bp, Artificial Sequence
  Description of Artificial Sequence: Synthetic oligonucleotide
aaagcaacttttaagcagaaaaatacccaaaccaatggacgtag

SEQ ID NO: 267119 - DNA, 43 bp, Artificial Sequence
  Description of Artificial Sequence: Synthetic oligonucleotide
aagcaacttttaagcagaaaaatacccaaaccaatggacgtag

SEQ ID NO: 267120 - DNA, 42 bp, Artificial Sequence
  Description of Artificial Sequence: Synthetic oligonucleotide
agcaacttttaagcagaaaaatacccaaaccaatggacgtag

SEQ ID NO: 267121 - DNA, 41 bp, Artificial Sequence
  Description of Artificial Sequence: Synthetic oligonucleotide
gcaacttttaagcagaaaaatacccaaaccaatggacgtag

SEQ ID NO: 267122 - DNA, 42 bp, Artificial Sequence
  Description of Artificial Sequence: Synthetic oligonucleotide
caacttttaagcagaaaaatacccaaaccaatggacgtagac

SEQ ID NO: 267123 - DNA, 42 bp, Artificial Sequence
  Description of Artificial Sequence: Synthetic oligonucleotide
aacttttaagcagaaaaatacccaaaccaatggacgtagacc

SEQ ID NO: 267124 - DNA, 41 bp, Artificial Sequence
  Description of Artificial Sequence: Synthetic oligonucleotide
acttttaagcagaaaaatacccaaaccaatggacgtagacc

SEQ ID NO: 267125 - DNA, 40 bp, Artificial Sequence
  Description of Artificial Sequence: Synthetic oligonucleotide
cttttaagcagaaaaatacccaaaccaatggacgtagacc

SEQ ID NO: 267126 - DNA, 44 bp, Artificial Sequence
  Description of Artificial Sequence: Synthetic oligonucleotide
ttttaagcagaaaaatacccaaaccaatggacgtagaccttttc

SEQ ID NO: 267127 - DNA, 43 bp, Artificial Sequence
  Description of Artificial Sequence: Synthetic oligonucleotide
tttaagcagaaaaatacccaaaccaatggacgtagaccttttc

SEQ ID NO: 267128 - DNA, 42 bp, Artificial Sequence
  Description of Artificial Sequence: Synthetic oligonucleotide
ttaagcagaaaaatacccaaaccaatggacgtagaccttttc

SEQ ID NO: 267129 - DNA, 41 bp, Artificial Sequence
  Description of Artificial Sequence: Synthetic oligonucleotide
taagcagaaaaatacccaaaccaatggacgtagaccttttc

SEQ ID NO: 267130 - DNA, 40 bp, Artificial Sequence
  Description of Artificial Sequence: Synthetic oligonucleotide
aagcagaaaaatacccaaaccaatggacgtagaccttttc

SEQ ID NO: 267131 - DNA, 39 bp, Artificial Sequence
  Description of Artificial Sequence: Synthetic oligonucleotide
agcagaaaaatacccaaaccaatggacgtagaccttttc

SEQ ID NO: 267132 - DNA, 38 bp, Artificial Sequence
  Description of Artificial Sequence: Synthetic oligonucleotide
gcagaaaaatacccaaaccaatggacgtagaccttttc

SEQ ID NO: 267133 - DNA, 38 bp, Artificial Sequence
  Description of Artificial Sequence: Synthetic oligonucleotide
cagaaaaatacccaaaccaatggacgtagaccttttcg

SEQ ID NO: 267134 - DNA, 43 bp, Artificial Sequence
  Description of Artificial Sequence: Synthetic oligonucleotide
agaaaaatacccaaaccaatggacgtagaccttttcgtatttc

SEQ ID NO: 267135 - DNA, 42 bp, Artificial Sequence
  Description of Artificial Sequence: Synthetic oligonucleotide
gaaaaatacccaaaccaatggacgtagaccttttcgtatttc

SEQ ID NO: 267136 - DNA, 43 bp, Artificial Sequence
  Description of Artificial Sequence: Synthetic oligonucleotide
aaaaatacccaaaccaatggacgtagaccttttcgtatttctg

SEQ ID NO: 267137 - DNA, 42 bp, Artificial Sequence
  Description of Artificial Sequence: Synthetic oligonucleotide
aaaatacccaaaccaatggacgtagaccttttcgtatttctg

SEQ ID NO: 267138 - DNA, 41 bp, Artificial Sequence
  Description of Artificial Sequence: Synthetic oligonucleotide
aaatacccaaaccaatggacgtagaccttttcgtatttctg

SEQ ID NO: 267139 - DNA, 40 bp, Artificial Sequence
  Description of Artificial Sequence: Synthetic oligonucleotide
aatacccaaaccaatggacgtagaccttttcgtatttctg

SEQ ID NO: 267140 - DNA, 39 bp, Artificial Sequence
  Description of Artificial Sequence: Synthetic oligonucleotide
atacccaaaccaatggacgtagaccttttcgtatttctg

SEQ ID NO: 267141 - DNA, 38 bp, Artificial Sequence
  Description of Artificial Sequence: Synthetic oligonucleotide
tacccaaaccaatggacgtagaccttttcgtatttctg

SEQ ID NO: 267142 - DNA, 37 bp, Artificial Sequence
  Description of Artificial Sequence: Synthetic oligonucleotide
acccaaaccaatggacgtagaccttttcgtatttctg

SEQ ID NO: 267143 - DNA, 36 bp, Artificial Sequence
  Description of Artificial Sequence: Synthetic oligonucleotide
cccaaaccaatggacgtagaccttttcgtatttctg

SEQ ID NO: 267144 - DNA, 36 bp, Artificial Sequence
  Description of Artificial Sequence: Synthetic oligonucleotide
ccaaaccaatggacgtagaccttttcgtatttctgg

SEQ ID NO: 267145 - DNA, 36 bp, Artificial Sequence
  Description of Artificial Sequence: Synthetic oligonucleotide
caaaccaatggacgtagaccttttcgtatttctggc

SEQ ID NO: 267146 - DNA, 42 bp, Artificial Sequence
  Description of Artificial Sequence: Synthetic oligonucleotide
aaaccaatggacgtagaccttttcgtatttctggcttaattg

SEQ ID NO: 267147 - DNA, 41 bp, Artificial Sequence
  Description of Artificial Sequence: Synthetic oligonucleotide
aaccaatggacgtagaccttttcgtatttctggcttaattg

SEQ ID NO: 267148 - DNA, 40 bp, Artificial Sequence
  Description of Artificial Sequence: Synthetic oligonucleotide
accaatggacgtagaccttttcgtatttctggcttaattg

SEQ ID NO: 267149 - DNA, 39 bp, Artificial Sequence
  Description of Artificial Sequence: Synthetic oligonucleotide
ccaatggacgtagaccttttcgtatttctggcttaattg

SEQ ID NO: 267150 - DNA, 41 bp, Artificial Sequence
  Description of Artificial Sequence: Synthetic oligonucleotide
caatggacgtagaccttttcgtatttctggcttaattgttg

SEQ ID NO: 267151 - DNA, 41 bp, Artificial Sequence
  Description of Artificial Sequence: Synthetic oligonucleotide
aatggacgtagaccttttcgtatttctggcttaattgttgg

SEQ ID NO: 267152 - DNA, 40 bp, Artificial Sequence
  Description of Artificial Sequence: Synthetic oligonucleotide
atggacgtagaccttttcgtatttctggcttaattgttgg

SEQ ID NO: 267153 - DNA, 39 bp, Artificial Sequence
  Description of Artificial Sequence: Synthetic oligonucleotide
tggacgtagaccttttcgtatttctggcttaattgttgg

SEQ ID NO: 267154 - DNA, 38 bp, Artificial Sequence
  Description of Artificial Sequence: Synthetic oligonucleotide
ggacgtagaccttttcgtatttctggcttaattgttgg

SEQ ID NO: 267155 - DNA, 42 bp, Artificial Sequence
  Description of Artificial Sequence: Synthetic oligonucleotide
gacgtagaccttttcgtatttctggcttaattgttggttttg

SEQ ID NO: 267156 - DNA, 44 bp, Artificial Sequence
  Description of Artificial Sequence: Synthetic oligonucleotide
acgtagaccttttcgtatttctggcttaattgttggttttgatc

SEQ ID NO: 267157 - DNA, 43 bp, Artificial Sequence
  Description of Artificial Sequence: Synthetic oligonucleotide
cgtagaccttttcgtatttctggcttaattgttggttttgatc

SEQ ID NO: 267158 - DNA, 45 bp, Artificial Sequence
  Description of Artificial Sequence: Synthetic oligonucleotide
gtagaccttttcgtatttctggcttaattgttggttttgatcatg

SEQ ID NO: 267159 - DNA, 47 bp, Artificial Sequence
  Description of Artificial Sequence: Synthetic oligonucleotide
tagaccttttcgtatttctggcttaattgttggttttgatcatgatg

SEQ ID NO: 267160 - DNA, 46 bp, Artificial Sequence
  Description of Artificial Sequence: Synthetic oligonucleotide
agaccttttcgtatttctggcttaattgttggttttgatcatgatg

SEQ ID NO: 267161 - DNA, 45 bp, Artificial Sequence
  Description of Artificial Sequence: Synthetic oligonucleotide
gaccttttcgtatttctggcttaattgttggttttgatcatgatg

SEQ ID NO: 267162 - DNA, 45 bp, Artificial Sequence
  Description of Artificial Sequence: Synthetic oligonucleotide
accttttcgtatttctggcttaattgttggttttgatcatgatgg

SEQ ID NO: 267163 - DNA, 44 bp, Artificial Sequence
  Description of Artificial Sequence: Synthetic oligonucleotide
ccttttcgtatttctggcttaattgttggttttgatcatgatgg

SEQ ID NO: 267164 - DNA, 47 bp, Artificial Sequence
  Description of Artificial Sequence: Synthetic oligonucleotide
cttttcgtatttctggcttaattgttggttttgatcatgatggtaac

SEQ ID NO: 267165 - DNA, 48 bp, Artificial Sequence
  Description of Artificial Sequence: Synthetic oligonucleotide
ttttcgtatttctggcttaattgttggttttgatcatgatggtaactc

SEQ ID NO: 267166 - DNA, 47 bp, Artificial Sequence
  Description of Artificial Sequence: Synthetic oligonucleotide
tttcgtatttctggcttaattgttggttttgatcatgatggtaactc

SEQ ID NO: 267167 - DNA, 46 bp, Artificial Sequence
  Description of Artificial Sequence: Synthetic oligonucleotide
ttcgtatttctggcttaattgttggttttgatcatgatggtaactc

SEQ ID NO: 267168 - DNA, 45 bp, Artificial Sequence
  Description of Artificial Sequence: Synthetic oligonucleotide
tcgtatttctggcttaattgttggttttgatcatgatggtaactc

SEQ ID NO: 267169 - DNA, 44 bp, Artificial Sequence
  Description of Artificial Sequence: Synthetic oligonucleotide
cgtatttctggcttaattgttggttttgatcatgatggtaactc

SEQ ID NO: 267170 - DNA, 46 bp, Artificial Sequence
  Description of Artificial Sequence: Synthetic oligonucleotide
gtatttctggcttaattgttggttttgatcatgatggtaactcaag

SEQ ID NO: 267171 - DNA, 49 bp, Artificial Sequence
  Description of Artificial Sequence: Synthetic oligonucleotide
tatttctggcttaattgttggttttgatcatgatggtaactcaagattc

SEQ ID NO: 267172 - DNA, 48 bp, Artificial Sequence
  Description of Artificial Sequence: Synthetic oligonucleotide
atttctggcttaattgttggttttgatcatgatggtaactcaagattc

SEQ ID NO: 267173 - DNA, 47 bp, Artificial Sequence
  Description of Artificial Sequence: Synthetic oligonucleotide
tttctggcttaattgttggttttgatcatgatggtaactcaagattc

SEQ ID NO: 267174 - DNA, 46 bp, Artificial Sequence
  Description of Artificial Sequence: Synthetic oligonucleotide
ttctggcttaattgttggttttgatcatgatggtaactcaagattc

SEQ ID NO: 267175 - DNA, 45 bp, Artificial Sequence
  Description of Artificial Sequence: Synthetic oligonucleotide
tctggcttaattgttggttttgatcatgatggtaactcaagattc

SEQ ID NO: 267176 - DNA, 44 bp, Artificial Sequence
  Description of Artificial Sequence: Synthetic oligonucleotide
ctggcttaattgttggttttgatcatgatggtaactcaagattc

SEQ ID NO: 267177 - DNA, 47 bp, Artificial Sequence
  Description of Artificial Sequence: Synthetic oligonucleotide
tggcttaattgttggttttgatcatgatggtaactcaagattctatc

SEQ ID NO: 267178 - DNA, 46 bp, Artificial Sequence
  Description of Artificial Sequence: Synthetic oligonucleotide
ggcttaattgttggttttgatcatgatggtaactcaagattctatc

SEQ ID NO: 267179 - DNA, 47 bp, Artificial Sequence
  Description of Artificial Sequence: Synthetic oligonucleotide
gcttaattgttggttttgatcatgatggtaactcaagattctatcag

SEQ ID NO: 267180 - DNA, 48 bp, Artificial Sequence
  Description of Artificial Sequence: Synthetic oligonucleotide
cttaattgttggttttgatcatgatggtaactcaagattctatcagac

SEQ ID NO: 267181 - DNA, 49 bp, Artificial Sequence
  Description of Artificial Sequence: Synthetic oligonucleotide
ttaattgttggttttgatcatgatggtaactcaagattctatcagacac

SEQ ID NO: 267182 - DNA, 48 bp, Artificial Sequence
  Description of Artificial Sequence: Synthetic oligonucleotide
taattgttggttttgatcatgatggtaactcaagattctatcagacac

SEQ ID NO: 267183 - DNA, 47 bp, Artificial Sequence
  Description of Artificial Sequence: Synthetic oligonucleotide
aattgttggttttgatcatgatggtaactcaagattctatcagacac

SEQ ID NO: 267184 - DNA, 46 bp, Artificial Sequence
  Description of Artificial Sequence: Synthetic oligonucleotide
attgttggttttgatcatgatggtaactcaagattctatcagacac

SEQ ID NO: 267185 - DNA, 45 bp, Artificial Sequence
  Description of Artificial Sequence: Synthetic oligonucleotide
ttgttggttttgatcatgatggtaactcaagattctatcagacac

SEQ ID NO: 267186 - DNA, 44 bp, Artificial Sequence
  Description of Artificial Sequence: Synthetic oligonucleotide
tgttggttttgatcatgatggtaactcaagattctatcagacac

SEQ ID NO: 267187 - DNA, 43 bp, Artificial Sequence
  Description of Artificial Sequence: Synthetic oligonucleotide
gttggttttgatcatgatggtaactcaagattctatcagacac

SEQ ID NO: 267188 - DNA, 45 bp, Artificial Sequence
  Description of Artificial Sequence: Synthetic oligonucleotide
ttggttttgatcatgatggtaactcaagattctatcagacacatc

SEQ ID NO: 267189 - DNA, 44 bp, Artificial Sequence
  Description of Artificial Sequence: Synthetic oligonucleotide
tggttttgatcatgatggtaactcaagattctatcagacacatc

SEQ ID NO: 267190 - DNA, 43 bp, Artificial Sequence
  Description of Artificial Sequence: Synthetic oligonucleotide
ggttttgatcatgatggtaactcaagattctatcagacacatc

SEQ ID NO: 267191 - DNA, 43 bp, Artificial Sequence
  Description of Artificial Sequence: Synthetic oligonucleotide
gttttgatcatgatggtaactcaagattctatcagacacatcc

SEQ ID NO: 267192 - DNA, 45 bp, Artificial Sequence
  Description of Artificial Sequence: Synthetic oligonucleotide
ttttgatcatgatggtaactcaagattctatcagacacatccttc

SEQ ID NO: 267193 - DNA, 44 bp, Artificial Sequence
  Description of Artificial Sequence: Synthetic oligonucleotide
tttgatcatgatggtaactcaagattctatcagacacatccttc

SEQ ID NO: 267194 - DNA, 43 bp, Artificial Sequence
  Description of Artificial Sequence: Synthetic oligonucleotide
ttgatcatgatggtaactcaagattctatcagacacatccttc

SEQ ID NO: 267195 - DNA, 42 bp, Artificial Sequence
  Description of Artificial Sequence: Synthetic oligonucleotide
tgatcatgatggtaactcaagattctatcagacacatccttc

SEQ ID NO: 267196 - DNA, 41 bp, Artificial Sequence
  Description of Artificial Sequence: Synthetic oligonucleotide
gatcatgatggtaactcaagattctatcagacacatccttc

SEQ ID NO: 267197 - DNA, 42 bp, Artificial Sequence
  Description of Artificial Sequence: Synthetic oligonucleotide
atcatgatggtaactcaagattctatcagacacatccttctg

SEQ ID NO: 267198 - DNA, 41 bp, Artificial Sequence
  Description of Artificial Sequence: Synthetic oligonucleotide
tcatgatggtaactcaagattctatcagacacatccttctg

SEQ ID NO: 267199 - DNA, 40 bp, Artificial Sequence
  Description of Artificial Sequence: Synthetic oligonucleotide
catgatggtaactcaagattctatcagacacatccttctg

SEQ ID NO: 267200 - DNA, 40 bp, Artificial Sequence
  Description of Artificial Sequence: Synthetic oligonucleotide
atgatggtaactcaagattctatcagacacatccttctgc

SEQ ID NO: 267201 - DNA, 39 bp, Artificial Sequence
  Description of Artificial Sequence: Synthetic oligonucleotide
tgatggtaactcaagattctatcagacacatccttctgc

SEQ ID NO: 267202 - DNA, 38 bp, Artificial Sequence
  Description of Artificial Sequence: Synthetic oligonucleotide
gatggtaactcaagattctatcagacacatccttctgc

SEQ ID NO: 267203 - DNA, 40 bp, Artificial Sequence
  Description of Artificial Sequence: Synthetic oligonucleotide
atggtaactcaagattctatcagacacatccttctgctac

SEQ ID NO: 267204 - DNA, 39 bp, Artificial Sequence
  Description of Artificial Sequence: Synthetic oligonucleotide
tggtaactcaagattctatcagacacatccttctgctac

SEQ ID NO: 267205 - DNA, 38 bp, Artificial Sequence
  Description of Artificial Sequence: Synthetic oligonucleotide
ggtaactcaagattctatcagacacatccttctgctac

SEQ ID NO: 267206 - DNA, 42 bp, Artificial Sequence
  Description of Artificial Sequence: Synthetic oligonucleotide
gtaactcaagattctatcagacacatccttctgctacttatc

SEQ ID NO: 267207 - DNA, 44 bp, Artificial Sequence
  Description of Artificial Sequence: Synthetic oligonucleotide
taactcaagattctatcagacacatccttctgctacttatcaag

SEQ ID NO: 267208 - DNA, 43 bp, Artificial Sequence
  Description of Artificial Sequence: Synthetic oligonucleotide
aactcaagattctatcagacacatccttctgctacttatcaag

SEQ ID NO: 267209 - DNA, 42 bp, Artificial Sequence
  Description of Artificial Sequence: Synthetic oligonucleotide
actcaagattctatcagacacatccttctgctacttatcaag

SEQ ID NO: 267210 - DNA, 41 bp, Artificial Sequence
  Description of Artificial Sequence: Synthetic oligonucleotide
ctcaagattctatcagacacatccttctgctacttatcaag

SEQ ID NO: 267211 - DNA, 41 bp, Artificial Sequence
  Description of Artificial Sequence: Synthetic oligonucleotide
tcaagattctatcagacacatccttctgctacttatcaagc

SEQ ID NO: 267212 - DNA, 40 bp, Artificial Sequence
  Description of Artificial Sequence: Synthetic oligonucleotide
caagattctatcagacacatccttctgctacttatcaagc

SEQ ID NO: 267213 - DNA, 42 bp, Artificial Sequence
  Description of Artificial Sequence: Synthetic oligonucleotide
aagattctatcagacacatccttctgctacttatcaagcttg

SEQ ID NO: 267214 - DNA, 41 bp, Artificial Sequence
  Description of Artificial Sequence: Synthetic oligonucleotide
agattctatcagacacatccttctgctacttatcaagcttg

SEQ ID NO: 267215 - DNA, 40 bp, Artificial Sequence
  Description of Artificial Sequence: Synthetic oligonucleotide
gattctatcagacacatccttctgctacttatcaagcttg

SEQ ID NO: 267216 - DNA, 40 bp, Artificial Sequence
  Description of Artificial Sequence: Synthetic oligonucleotide
attctatcagacacatccttctgctacttatcaagcttgg

SEQ ID NO: 267217 - DNA, 39 bp, Artificial Sequence
  Description of Artificial Sequence: Synthetic oligonucleotide
ttctatcagacacatccttctgctacttatcaagcttgg

SEQ ID NO: 267218 - DNA, 38 bp, Artificial Sequence
  Description of Artificial Sequence: Synthetic oligonucleotide
tctatcagacacatccttctgctacttatcaagcttgg

SEQ ID NO: 267219 - DNA, 37 bp, Artificial Sequence
  Description of Artificial Sequence: Synthetic oligonucleotide
ctatcagacacatccttctgctacttatcaagcttgg

SEQ ID NO: 267220 - DNA, 39 bp, Artificial Sequence
  Description of Artificial Sequence: Synthetic oligonucleotide
tatcagacacatccttctgctacttatcaagcttggaag

SEQ ID NO: 267221 - DNA, 38 bp, Artificial Sequence
  Description of Artificial Sequence: Synthetic oligonucleotide
atcagacacatccttctgctacttatcaagcttggaag

SEQ ID NO: 267222 - DNA, 37 bp, Artificial Sequence
  Description of Artificial Sequence: Synthetic oligonucleotide
tcagacacatccttctgctacttatcaagcttggaag

SEQ ID NO: 267223 - DNA, 36 bp, Artificial Sequence
  Description of Artificial Sequence: Synthetic oligonucleotide
cagacacatccttctgctacttatcaagcttggaag

SEQ ID NO: 267224 - DNA, 36 bp, Artificial Sequence
  Description of Artificial Sequence: Synthetic oligonucleotide
agacacatccttctgctacttatcaagcttggaagc

SEQ ID NO: 267225 - DNA, 35 bp, Artificial Sequence
  Description of Artificial Sequence: Synthetic oligonucleotide
gacacatccttctgctacttatcaagcttggaagc

SEQ ID NO: 267226 - DNA, 35 bp, Artificial Sequence
  Description of Artificial Sequence: Synthetic oligonucleotide
acacatccttctgctacttatcaagcttggaagcc

SEQ ID NO: 267227 - DNA, 34 bp, Artificial Sequence
  Description of Artificial Sequence: Synthetic oligonucleotide
cacatccttctgctacttatcaagcttggaagcc

SEQ ID NO: 267228 - DNA, 38 bp, Artificial Sequence
  Description of Artificial Sequence: Synthetic oligonucleotide
acatccttctgctacttatcaagcttggaagccaaatg

SEQ ID NO: 267229 - DNA, 37 bp, Artificial Sequence
  Description of Artificial Sequence: Synthetic oligonucleotide
catccttctgctacttatcaagcttggaagccaaatg

SEQ ID NO: 267230 - DNA, 37 bp, Artificial Sequence
  Description of Artificial Sequence: Synthetic oligonucleotide
atccttctgctacttatcaagcttggaagccaaatgc

SEQ ID NO: 267231 - DNA, 36 bp, Artificial Sequence
  Description of Artificial Sequence: Synthetic oligonucleotide
tccttctgctacttatcaagcttggaagccaaatgc

SEQ ID NO: 267232 - DNA, 35 bp, Artificial Sequence
  Description of Artificial Sequence: Synthetic oligonucleotide
ccttctgctacttatcaagcttggaagccaaatgc

SEQ ID NO: 267233 - DNA, 39 bp, Artificial Sequence
  Description of Artificial Sequence: Synthetic oligonucleotide
cttctgctacttatcaagcttggaagccaaatgcaaaag

SEQ ID NO: 267234 - DNA, 39 bp, Artificial Sequence
  Description of Artificial Sequence: Synthetic oligonucleotide
ttctgctacttatcaagcttggaagccaaatgcaaaagg

SEQ ID NO: 267235 - DNA, 38 bp, Artificial Sequence
  Description of Artificial Sequence: Synthetic oligonucleotide
tctgctacttatcaagcttggaagccaaatgcaaaagg

SEQ ID NO: 267236 - DNA, 37 bp, Artificial Sequence
  Description of Artificial Sequence: Synthetic oligonucleotide
ctgctacttatcaagcttggaagccaaatgcaaaagg

SEQ ID NO: 267237 - DNA, 37 bp, Artificial Sequence
  Description of Artificial Sequence: Synthetic oligonucleotide
tgctacttatcaagcttggaagccaaatgcaaaaggc

SEQ ID NO: 267238 - DNA, 36 bp, Artificial Sequence
  Description of Artificial Sequence: Synthetic oligonucleotide
gctacttatcaagcttggaagccaaatgcaaaaggc

SEQ ID NO: 267239 - DNA, 36 bp, Artificial Sequence
  Description of Artificial Sequence: Synthetic oligonucleotide
ctacttatcaagcttggaagccaaatgcaaaaggcc

SEQ ID NO: 267240 - DNA, 36 bp, Artificial Sequence
  Description of Artificial Sequence: Synthetic oligonucleotide
tacttatcaagcttggaagccaaatgcaaaaggccg

SEQ ID NO: 267241 - DNA, 35 bp, Artificial Sequence
  Description of Artificial Sequence: Synthetic oligonucleotide
acttatcaagcttggaagccaaatgcaaaaggccg

SEQ ID NO: 267242 - DNA, 34 bp, Artificial Sequence
  Description of Artificial Sequence: Synthetic oligonucleotide
cttatcaagcttggaagccaaatgcaaaaggccg

SEQ ID NO: 267243 - DNA, 36 bp, Artificial Sequence
  Description of Artificial Sequence: Synthetic oligonucleotide
ttatcaagcttggaagccaaatgcaaaaggccgaag

SEQ ID NO: 267244 - DNA, 35 bp, Artificial Sequence
  Description of Artificial Sequence: Synthetic oligonucleotide
tatcaagcttggaagccaaatgcaaaaggccgaag

SEQ ID NO: 267245 - DNA, 34 bp, Artificial Sequence
  Description of Artificial Sequence: Synthetic oligonucleotide
atcaagcttggaagccaaatgcaaaaggccgaag

SEQ ID NO: 267246 - DNA, 33 bp, Artificial Sequence
  Description of Artificial Sequence: Synthetic oligonucleotide
tcaagcttggaagccaaatgcaaaaggccgaag

SEQ ID NO: 267247 - DNA, 32 bp, Artificial Sequence
  Description of Artificial Sequence: Synthetic oligonucleotide
caagcttggaagccaaatgcaaaaggccgaag

SEQ ID NO: 267248 - DNA, 33 bp, Artificial Sequence
  Description of Artificial Sequence: Synthetic oligonucleotide
aagcttggaagccaaatgcaaaaggccgaagag

SEQ ID NO: 267249 - DNA, 32 bp, Artificial Sequence
  Description of Artificial Sequence: Synthetic oligonucleotide
agcttggaagccaaatgcaaaaggccgaagag

SEQ ID NO: 267250 - DNA, 31 bp, Artificial Sequence
  Description of Artificial Sequence: Synthetic oligonucleotide
gcttggaagccaaatgcaaaaggccgaagag

SEQ ID NO: 267251 - DNA, 31 bp, Artificial Sequence
  Description of Artificial Sequence: Synthetic oligonucleotide
cttggaagccaaatgcaaaaggccgaagagc

SEQ ID NO: 267252 - DNA, 36 bp, Artificial Sequence
  Description of Artificial Sequence: Synthetic oligonucleotide
ttggaagccaaatgcaaaaggccgaagagctaaaac

SEQ ID NO: 267253 - DNA, 35 bp, Artificial Sequence
  Description of Artificial Sequence: Synthetic oligonucleotide
tggaagccaaatgcaaaaggccgaagagctaaaac

SEQ ID NO: 267254 - DNA, 34 bp, Artificial Sequence
  Description of Artificial Sequence: Synthetic oligonucleotide
ggaagccaaatgcaaaaggccgaagagctaaaac

SEQ ID NO: 267255 - DNA, 35 bp, Artificial Sequence
  Description of Artificial Sequence: Synthetic oligonucleotide
gaagccaaatgcaaaaggccgaagagctaaaactc

SEQ ID NO: 267256 - DNA, 37 bp, Artificial Sequence
  Description of Artificial Sequence: Synthetic oligonucleotide
aagccaaatgcaaaaggccgaagagctaaaactcttc

SEQ ID NO: 267257 - DNA, 36 bp, Artificial Sequence
  Description of Artificial Sequence: Synthetic oligonucleotide
agccaaatgcaaaaggccgaagagctaaaactcttc

SEQ ID NO: 267258 - DNA, 35 bp, Artificial Sequence
  Description of Artificial Sequence: Synthetic oligonucleotide
gccaaatgcaaaaggccgaagagctaaaactcttc

SEQ ID NO: 267259 - DNA, 35 bp, Artificial Sequence
  Description of Artificial Sequence: Synthetic oligonucleotide
ccaaatgcaaaaggccgaagagctaaaactcttcg

SEQ ID NO: 267260 - DNA, 36 bp, Artificial Sequence
  Description of Artificial Sequence: Synthetic oligonucleotide
caaatgcaaaaggccgaagagctaaaactcttcgag

SEQ ID NO: 267261 - DNA, 41 bp, Artificial Sequence
  Description of Artificial Sequence: Synthetic oligonucleotide
aaatgcaaaaggccgaagagctaaaactcttcgagaatatc

SEQ ID NO: 267262 - DNA, 40 bp, Artificial Sequence
  Description of Artificial Sequence: Synthetic oligonucleotide
aatgcaaaaggccgaagagctaaaactcttcgagaatatc

SEQ ID NO: 267263 - DNA, 39 bp, Artificial Sequence
  Description of Artificial Sequence: Synthetic oligonucleotide
atgcaaaaggccgaagagctaaaactcttcgagaatatc

SEQ ID NO: 267264 - DNA, 38 bp, Artificial Sequence
  Description of Artificial Sequence: Synthetic oligonucleotide
tgcaaaaggccgaagagctaaaactcttcgagaatatc

SEQ ID NO: 267265 - DNA, 37 bp, Artificial Sequence
  Description of Artificial Sequence: Synthetic oligonucleotide
gcaaaaggccgaagagctaaaactcttcgagaatatc

SEQ ID NO: 267266 - DNA, 39 bp, Artificial Sequence
  Description of Artificial Sequence: Synthetic oligonucleotide
caaaaggccgaagagctaaaactcttcgagaatatctag

SEQ ID NO: 267267 - DNA, 43 bp, Artificial Sequence
  Description of Artificial Sequence: Synthetic oligonucleotide
aaaaggccgaagagctaaaactcttcgagaatatctagaaaac

SEQ ID NO: 267268 - DNA, 42 bp, Artificial Sequence
  Description of Artificial Sequence: Synthetic oligonucleotide
aaaggccgaagagctaaaactcttcgagaatatctagaaaac

SEQ ID NO: 267269 - DNA, 41 bp, Artificial Sequence
  Description of Artificial Sequence: Synthetic oligonucleotide
aaggccgaagagctaaaactcttcgagaatatctagaaaac

SEQ ID NO: 267270 - DNA, 40 bp, Artificial Sequence
  Description of Artificial Sequence: Synthetic oligonucleotide
aggccgaagagctaaaactcttcgagaatatctagaaaac

SEQ ID NO: 267271 - DNA, 39 bp, Artificial Sequence
  Description of Artificial Sequence: Synthetic oligonucleotide
ggccgaagagctaaaactcttcgagaatatctagaaaac

SEQ ID NO: 267272 - DNA, 44 bp, Artificial Sequence
  Description of Artificial Sequence: Synthetic oligonucleotide
gccgaagagctaaaactcttcgagaatatctagaaaacaattac

SEQ ID NO: 267273 - DNA, 45 bp, Artificial Sequence
  Description of Artificial Sequence: Synthetic oligonucleotide
ccgaagagctaaaactcttcgagaatatctagaaaacaattacac

SEQ ID NO: 267274 - DNA, 46 bp, Artificial Sequence
  Description of Artificial Sequence: Synthetic oligonucleotide
cgaagagctaaaactcttcgagaatatctagaaaacaattacacac

SEQ ID NO: 267275 - DNA, 48 bp, Artificial Sequence
  Description of Artificial Sequence: Synthetic oligonucleotide
gaagagctaaaactcttcgagaatatctagaaaacaattacacacaag

SEQ ID NO: 267276 - DNA, 50 bp, Artificial Sequence
  Description of Artificial Sequence: Synthetic oligonucleotide
aagagctaaaactcttcgagaatatctagaaaacaattacacacaagatg

SEQ ID NO: 267277 - DNA, 49 bp, Artificial Sequence
  Description of Artificial Sequence: Synthetic oligonucleotide
agagctaaaactcttcgagaatatctagaaaacaattacacacaagatg

SEQ ID NO: 267278 - DNA, 48 bp, Artificial Sequence
  Description of Artificial Sequence: Synthetic oligonucleotide
gagctaaaactcttcgagaatatctagaaaacaattacacacaagatg

SEQ ID NO: 267279 - DNA, 48 bp, Artificial Sequence
  Description of Artificial Sequence: Synthetic oligonucleotide
agctaaaactcttcgagaatatctagaaaacaattacacacaagatgc

SEQ ID NO: 267280 - DNA, 47 bp, Artificial Sequence
  Description of Artificial Sequence: Synthetic oligonucleotide
gctaaaactcttcgagaatatctagaaaacaattacacacaagatgc

SEQ ID NO: 267281 - DNA, 47 bp, Artificial Sequence
  Description of Artificial Sequence: Synthetic oligonucleotide
ctaaaactcttcgagaatatctagaaaacaattacacacaagatgcc

SEQ ID NO: 267282 - DNA, 50 bp, Artificial Sequence
  Description of Artificial Sequence: Synthetic oligonucleotide
taaaactcttcgagaatatctagaaaacaattacacacaagatgccaaag

SEQ ID NO: 267283 - DNA, 49 bp, Artificial Sequence
  Description of Artificial Sequence: Synthetic oligonucleotide
aaaactcttcgagaatatctagaaaacaattacacacaagatgccaaag

SEQ ID NO: 267284 - DNA, 48 bp, Artificial Sequence
  Description of Artificial Sequence: Synthetic oligonucleotide
aaactcttcgagaatatctagaaaacaattacacacaagatgccaaag

SEQ ID NO: 267285 - DNA, 47 bp, Artificial Sequence
  Description of Artificial Sequence: Synthetic oligonucleotide
aactcttcgagaatatctagaaaacaattacacacaagatgccaaag

SEQ ID NO: 267286 - DNA, 46 bp, Artificial Sequence
  Description of Artificial Sequence: Synthetic oligonucleotide
actcttcgagaatatctagaaaacaattacacacaagatgccaaag

SEQ ID NO: 267287 - DNA, 45 bp, Artificial Sequence
  Description of Artificial Sequence: Synthetic oligonucleotide
ctcttcgagaatatctagaaaacaattacacacaagatgccaaag

SEQ ID NO: 267288 - DNA, 45 bp, Artificial Sequence
  Description of Artificial Sequence: Synthetic oligonucleotide
tcttcgagaatatctagaaaacaattacacacaagatgccaaagc

SEQ ID NO: 267289 - DNA, 44 bp, Artificial Sequence
  Description of Artificial Sequence: Synthetic oligonucleotide
cttcgagaatatctagaaaacaattacacacaagatgccaaagc

SEQ ID NO: 267290 - DNA, 46 bp, Artificial Sequence
  Description of Artificial Sequence: Synthetic oligonucleotide
ttcgagaatatctagaaaacaattacacacaagatgccaaagcaag

SEQ ID NO: 267291 - DNA, 45 bp, Artificial Sequence
  Description of Artificial Sequence: Synthetic oligonucleotide
tcgagaatatctagaaaacaattacacacaagatgccaaagcaag

SEQ ID NO: 267292 - DNA, 44 bp, Artificial Sequence
  Description of Artificial Sequence: Synthetic oligonucleotide
cgagaatatctagaaaacaattacacacaagatgccaaagcaag

SEQ ID NO: 267293 - DNA, 45 bp, Artificial Sequence
  Description of Artificial Sequence: Synthetic oligonucleotide
gagaatatctagaaaacaattacacacaagatgccaaagcaagtg

SEQ ID NO: 267294 - DNA, 46 bp, Artificial Sequence
  Description of Artificial Sequence: Synthetic oligonucleotide
agaatatctagaaaacaattacacacaagatgccaaagcaagtgag

SEQ ID NO: 267295 - DNA, 45 bp, Artificial Sequence
  Description of Artificial Sequence: Synthetic oligonucleotide
gaatatctagaaaacaattacacacaagatgccaaagcaagtgag

SEQ ID NO: 267296 - DNA, 46 bp, Artificial Sequence
  Description of Artificial Sequence: Synthetic oligonucleotide
aatatctagaaaacaattacacacaagatgccaaagcaagtgagag

SEQ ID NO: 267297 - DNA, 45 bp, Artificial Sequence
  Description of Artificial Sequence: Synthetic oligonucleotide
atatctagaaaacaattacacacaagatgccaaagcaagtgagag

SEQ ID NO: 267298 - DNA, 44 bp, Artificial Sequence
  Description of Artificial Sequence: Synthetic oligonucleotide
tatctagaaaacaattacacacaagatgccaaagcaagtgagag

SEQ ID NO: 267299 - DNA, 43 bp, Artificial Sequence
  Description of Artificial Sequence: Synthetic oligonucleotide
atctagaaaacaattacacacaagatgccaaagcaagtgagag

SEQ ID NO: 267300 - DNA, 42 bp, Artificial Sequence
  Description of Artificial Sequence: Synthetic oligonucleotide
tctagaaaacaattacacacaagatgccaaagcaagtgagag

SEQ ID NO: 267301 - DNA, 41 bp, Artificial Sequence
  Description of Artificial Sequence: Synthetic oligonucleotide
ctagaaaacaattacacacaagatgccaaagcaagtgagag

SEQ ID NO: 267302 - DNA, 42 bp, Artificial Sequence
  Description of Artificial Sequence: Synthetic oligonucleotide
tagaaaacaattacacacaagatgccaaagcaagtgagagtg

SEQ ID NO: 267303 - DNA, 41 bp, Artificial Sequence
  Description of Artificial Sequence: Synthetic oligonucleotide
agaaaacaattacacacaagatgccaaagcaagtgagagtg

SEQ ID NO: 267304 - DNA, 40 bp, Artificial Sequence
  Description of Artificial Sequence: Synthetic oligonucleotide
gaaaacaattacacacaagatgccaaagcaagtgagagtg

SEQ ID NO: 267305 - DNA, 42 bp, Artificial Sequence
  Description of Artificial Sequence: Synthetic oligonucleotide
aaaacaattacacacaagatgccaaagcaagtgagagtgaag

SEQ ID NO: 267306 - DNA, 41 bp, Artificial Sequence
  Description of Artificial Sequence: Synthetic oligonucleotide
aaacaattacacacaagatgccaaagcaagtgagagtgaag

SEQ ID NO: 267307 - DNA, 40 bp, Artificial Sequence
  Description of Artificial Sequence: Synthetic oligonucleotide
aacaattacacacaagatgccaaagcaagtgagagtgaag

SEQ ID NO: 267308 - DNA, 39 bp, Artificial Sequence
  Description of Artificial Sequence: Synthetic oligonucleotide
acaattacacacaagatgccaaagcaagtgagagtgaag

SEQ ID NO: 267309 - DNA, 38 bp, Artificial Sequence
  Description of Artificial Sequence: Synthetic oligonucleotide
caattacacacaagatgccaaagcaagtgagagtgaag

SEQ ID NO: 267310 - DNA, 38 bp, Artificial Sequence
  Description of Artificial Sequence: Synthetic oligonucleotide
aattacacacaagatgccaaagcaagtgagagtgaagc

SEQ ID NO: 267311 - DNA, 37 bp, Artificial Sequence
  Description of Artificial Sequence: Synthetic oligonucleotide
attacacacaagatgccaaagcaagtgagagtgaagc

SEQ ID NO: 267312 - DNA, 36 bp, Artificial Sequence
  Description of Artificial Sequence: Synthetic oligonucleotide
ttacacacaagatgccaaagcaagtgagagtgaagc

SEQ ID NO: 267313 - DNA, 35 bp, Artificial Sequence
  Description of Artificial Sequence: Synthetic oligonucleotide
tacacacaagatgccaaagcaagtgagagtgaagc

SEQ ID NO: 267314 - DNA, 34 bp, Artificial Sequence
  Description of Artificial Sequence: Synthetic oligonucleotide
acacacaagatgccaaagcaagtgagagtgaagc

SEQ ID NO: 267315 - DNA, 33 bp, Artificial Sequence
  Description of Artificial Sequence: Synthetic oligonucleotide
cacacaagatgccaaagcaagtgagagtgaagc

SEQ ID NO: 267316 - DNA, 36 bp, Artificial Sequence
  Description of Artificial Sequence: Synthetic oligonucleotide
acacaagatgccaaagcaagtgagagtgaagctttc

SEQ ID NO: 267317 - DNA, 35 bp, Artificial Sequence
  Description of Artificial Sequence: Synthetic oligonucleotide
cacaagatgccaaagcaagtgagagtgaagctttc

SEQ ID NO: 267318 - DNA, 37 bp, Artificial Sequence
  Description of Artificial Sequence: Synthetic oligonucleotide
acaagatgccaaagcaagtgagagtgaagctttcaag

SEQ ID NO: 267319 - DNA, 36 bp, Artificial Sequence
  Description of Artificial Sequence: Synthetic oligonucleotide
caagatgccaaagcaagtgagagtgaagctttcaag

SEQ ID NO: 267320 - DNA, 39 bp, Artificial Sequence
  Description of Artificial Sequence: Synthetic oligonucleotide
aagatgccaaagcaagtgagagtgaagctttcaagttag

SEQ ID NO: 267321 - DNA, 38 bp, Artificial Sequence
  Description of Artificial Sequence: Synthetic oligonucleotide
agatgccaaagcaagtgagagtgaagctttcaagttag

SEQ ID NO: 267322 - DNA, 37 bp, Artificial Sequence
  Description of Artificial Sequence: Synthetic oligonucleotide
gatgccaaagcaagtgagagtgaagctttcaagttag

SEQ ID NO: 267323 - DNA, 37 bp, Artificial Sequence
  Description of Artificial Sequence: Synthetic oligonucleotide
atgccaaagcaagtgagagtgaagctttcaagttagg

SEQ ID NO: 267324 - DNA, 36 bp, Artificial Sequence
  Description of Artificial Sequence: Synthetic oligonucleotide
tgccaaagcaagtgagagtgaagctttcaagttagg

SEQ ID NO: 267325 - DNA, 35 bp, Artificial Sequence
  Description of Artificial Sequence: Synthetic oligonucleotide
gccaaagcaagtgagagtgaagctttcaagttagg

SEQ ID NO: 267326 - DNA, 42 bp, Artificial Sequence
  Description of Artificial Sequence: Synthetic oligonucleotide
ccaaagcaagtgagagtgaagctttcaagttaggaataaaag

SEQ ID NO: 267327 - DNA, 42 bp, Artificial Sequence
  Description of Artificial Sequence: Synthetic oligonucleotide
caaagcaagtgagagtgaagctttcaagttaggaataaaagc

SEQ ID NO: 267328 - DNA, 45 bp, Artificial Sequence
  Description of Artificial Sequence: Synthetic oligonucleotide
aaagcaagtgagagtgaagctttcaagttaggaataaaagcattg

SEQ ID NO: 267329 - DNA, 44 bp, Artificial Sequence
  Description of Artificial Sequence: Synthetic oligonucleotide
aagcaagtgagagtgaagctttcaagttaggaataaaagcattg

SEQ ID NO: 267330 - DNA, 43 bp, Artificial Sequence
  Description of Artificial Sequence: Synthetic oligonucleotide
agcaagtgagagtgaagctttcaagttaggaataaaagcattg

SEQ ID NO: 267331 - DNA, 42 bp, Artificial Sequence
  Description of Artificial Sequence: Synthetic oligonucleotide
gcaagtgagagtgaagctttcaagttaggaataaaagcattg

SEQ ID NO: 267332 - DNA, 42 bp, Artificial Sequence
  Description of Artificial Sequence: Synthetic oligonucleotide
caagtgagagtgaagctttcaagttaggaataaaagcattgc

SEQ ID NO: 267333 - DNA, 44 bp, Artificial Sequence
  Description of Artificial Sequence: Synthetic oligonucleotide
aagtgagagtgaagctttcaagttaggaataaaagcattgctag

SEQ ID NO: 267334 - DNA, 43 bp, Artificial Sequence
  Description of Artificial Sequence: Synthetic oligonucleotide
agtgagagtgaagctttcaagttaggaataaaagcattgctag

SEQ ID NO: 267335 - DNA, 42 bp, Artificial Sequence
  Description of Artificial Sequence: Synthetic oligonucleotide
gtgagagtgaagctttcaagttaggaataaaagcattgctag

SEQ ID NO: 267336 - DNA, 44 bp, Artificial Sequence
  Description of Artificial Sequence: Synthetic oligonucleotide
tgagagtgaagctttcaagttaggaataaaagcattgctagaac

SEQ ID NO: 267337 - DNA, 43 bp, Artificial Sequence
  Description of Artificial Sequence: Synthetic oligonucleotide
gagagtgaagctttcaagttaggaataaaagcattgctagaac

SEQ ID NO: 267338 - DNA, 45 bp, Artificial Sequence
  Description of Artificial Sequence: Synthetic oligonucleotide
agagtgaagctttcaagttaggaataaaagcattgctagaacttg

SEQ ID NO: 267339 - DNA, 44 bp, Artificial Sequence
  Description of Artificial Sequence: Synthetic oligonucleotide
gagtgaagctttcaagttaggaataaaagcattgctagaacttg

SEQ ID NO: 267340 - DNA, 45 bp, Artificial Sequence
  Description of Artificial Sequence: Synthetic oligonucleotide
agtgaagctttcaagttaggaataaaagcattgctagaacttgtc

SEQ ID NO: 267341 - DNA, 44 bp, Artificial Sequence
  Description of Artificial Sequence: Synthetic oligonucleotide
gtgaagctttcaagttaggaataaaagcattgctagaacttgtc

SEQ ID NO: 267342 - DNA, 44 bp, Artificial Sequence
  Description of Artificial Sequence: Synthetic oligonucleotide
tgaagctttcaagttaggaataaaagcattgctagaacttgtcc

SEQ ID NO: 267343 - DNA, 43 bp, Artificial Sequence
  Description of Artificial Sequence: Synthetic oligonucleotide
gaagctttcaagttaggaataaaagcattgctagaacttgtcc

SEQ ID NO: 267344 - DNA, 44 bp, Artificial Sequence
  Description of Artificial Sequence: Synthetic oligonucleotide
aagctttcaagttaggaataaaagcattgctagaacttgtccag

SEQ ID NO: 267345 - DNA, 43 bp, Artificial Sequence
  Description of Artificial Sequence: Synthetic oligonucleotide
agctttcaagttaggaataaaagcattgctagaacttgtccag

SEQ ID NO: 267346 - DNA, 42 bp, Artificial Sequence
  Description of Artificial Sequence: Synthetic oligonucleotide
gctttcaagttaggaataaaagcattgctagaacttgtccag

SEQ ID NO: 267347 - DNA, 43 bp, Artificial Sequence
  Description of Artificial Sequence: Synthetic oligonucleotide
ctttcaagttaggaataaaagcattgctagaacttgtccagtg

SEQ ID NO: 267348 - DNA, 44 bp, Artificial Sequence
  Description of Artificial Sequence: Synthetic oligonucleotide
tttcaagttaggaataaaagcattgctagaacttgtccagtgtg

SEQ ID NO: 267349 - DNA, 43 bp, Artificial Sequence
  Description of Artificial Sequence: Synthetic oligonucleotide
ttcaagttaggaataaaagcattgctagaacttgtccagtgtg

SEQ ID NO: 267350 - DNA, 42 bp, Artificial Sequence
  Description of Artificial Sequence: Synthetic oligonucleotide
tcaagttaggaataaaagcattgctagaacttgtccagtgtg

SEQ ID NO: 267351 - DNA, 41 bp, Artificial Sequence
  Description of Artificial Sequence: Synthetic oligonucleotide
caagttaggaataaaagcattgctagaacttgtccagtgtg

SEQ ID NO: 267352 - DNA, 41 bp, Artificial Sequence
  Description of Artificial Sequence: Synthetic oligonucleotide
aagttaggaataaaagcattgctagaacttgtccagtgtgg

SEQ ID NO: 267353 - DNA, 40 bp, Artificial Sequence
  Description of Artificial Sequence: Synthetic oligonucleotide
agttaggaataaaagcattgctagaacttgtccagtgtgg

SEQ ID NO: 267354 - DNA, 39 bp, Artificial Sequence
  Description of Artificial Sequence: Synthetic oligonucleotide
gttaggaataaaagcattgctagaacttgtccagtgtgg

SEQ ID NO: 267355 - DNA, 40 bp, Artificial Sequence
  Description of Artificial Sequence: Synthetic oligonucleotide
ttaggaataaaagcattgctagaacttgtccagtgtggtg

SEQ ID NO: 267356 - DNA, 39 bp, Artificial Sequence
  Description of Artificial Sequence: Synthetic oligonucleotide
taggaataaaagcattgctagaacttgtccagtgtggtg

SEQ ID NO: 267357 - DNA, 38 bp, Artificial Sequence
  Description of Artificial Sequence: Synthetic oligonucleotide
aggaataaaagcattgctagaacttgtccagtgtggtg

SEQ ID NO: 267358 - DNA, 37 bp, Artificial Sequence
  Description of Artificial Sequence: Synthetic oligonucleotide
ggaataaaagcattgctagaacttgtccagtgtggtg

SEQ ID NO: 267359 - DNA, 37 bp, Artificial Sequence
  Description of Artificial Sequence: Synthetic oligonucleotide
gaataaaagcattgctagaacttgtccagtgtggtgg

SEQ ID NO: 267360 - DNA, 43 bp, Artificial Sequence
  Description of Artificial Sequence: Synthetic oligonucleotide
aataaaagcattgctagaacttgtccagtgtggtggaaataac

SEQ ID NO: 267361 - DNA, 42 bp, Artificial Sequence
  Description of Artificial Sequence: Synthetic oligonucleotide
ataaaagcattgctagaacttgtccagtgtggtggaaataac

SEQ ID NO: 267362 - DNA, 41 bp, Artificial Sequence
  Description of Artificial Sequence: Synthetic oligonucleotide
taaaagcattgctagaacttgtccagtgtggtggaaataac

SEQ ID NO: 267363 - DNA, 40 bp, Artificial Sequence
  Description of Artificial Sequence: Synthetic oligonucleotide
aaaagcattgctagaacttgtccagtgtggtggaaataac

SEQ ID NO: 267364 - DNA, 39 bp, Artificial Sequence
  Description of Artificial Sequence: Synthetic oligonucleotide
aaagcattgctagaacttgtccagtgtggtggaaataac

SEQ ID NO: 267365 - DNA, 38 bp, Artificial Sequence
  Description of Artificial Sequence: Synthetic oligonucleotide
aagcattgctagaacttgtccagtgtggtggaaataac

SEQ ID NO: 267366 - DNA, 37 bp, Artificial Sequence
  Description of Artificial Sequence: Synthetic oligonucleotide
agcattgctagaacttgtccagtgtggtggaaataac

SEQ ID NO: 267367 - DNA, 36 bp, Artificial Sequence
  Description of Artificial Sequence: Synthetic oligonucleotide
gcattgctagaacttgtccagtgtggtggaaataac

SEQ ID NO: 267368 - DNA, 39 bp, Artificial Sequence
  Description of Artificial Sequence: Synthetic oligonucleotide
cattgctagaacttgtccagtgtggtggaaataacattg

SEQ ID NO: 267369 - DNA, 41 bp, Artificial Sequence
  Description of Artificial Sequence: Synthetic oligonucleotide
attgctagaacttgtccagtgtggtggaaataacattgaag

SEQ ID NO: 267370 - DNA, 40 bp, Artificial Sequence
  Description of Artificial Sequence: Synthetic oligonucleotide
ttgctagaacttgtccagtgtggtggaaataacattgaag

SEQ ID NO: 267371 - DNA, 39 bp, Artificial Sequence
  Description of Artificial Sequence: Synthetic oligonucleotide
tgctagaacttgtccagtgtggtggaaataacattgaag

SEQ ID NO: 267372 - DNA, 38 bp, Artificial Sequence
  Description of Artificial Sequence: Synthetic oligonucleotide
gctagaacttgtccagtgtggtggaaataacattgaag

SEQ ID NO: 267373 - DNA, 40 bp, Artificial Sequence
  Description of Artificial Sequence: Synthetic oligonucleotide
ctagaacttgtccagtgtggtggaaataacattgaagttg

SEQ ID NO: 267374 - DNA, 40 bp, Artificial Sequence
  Description of Artificial Sequence: Synthetic oligonucleotide
tagaacttgtccagtgtggtggaaataacattgaagttgc

SEQ ID NO: 267375 - DNA, 39 bp, Artificial Sequence
  Description of Artificial Sequence: Synthetic oligonucleotide
agaacttgtccagtgtggtggaaataacattgaagttgc

SEQ ID NO: 267376 - DNA, 38 bp, Artificial Sequence
  Description of Artificial Sequence: Synthetic oligonucleotide
gaacttgtccagtgtggtggaaataacattgaagttgc

SEQ ID NO: 267377 - DNA, 46 bp, Artificial Sequence
  Description of Artificial Sequence: Synthetic oligonucleotide
aacttgtccagtgtggtggaaataacattgaagttgctataaaaag

SEQ ID NO: 267378 - DNA, 45 bp, Artificial Sequence
  Description of Artificial Sequence: Synthetic oligonucleotide
acttgtccagtgtggtggaaataacattgaagttgctataaaaag

SEQ ID NO: 267379 - DNA, 44 bp, Artificial Sequence
  Description of Artificial Sequence: Synthetic oligonucleotide
cttgtccagtgtggtggaaataacattgaagttgctataaaaag

SEQ ID NO: 267380 - DNA, 46 bp, Artificial Sequence
  Description of Artificial Sequence: Synthetic oligonucleotide
ttgtccagtgtggtggaaataacattgaagttgctataaaaagaag

SEQ ID NO: 267381 - DNA, 45 bp, Artificial Sequence
  Description of Artificial Sequence: Synthetic oligonucleotide
tgtccagtgtggtggaaataacattgaagttgctataaaaagaag

SEQ ID NO: 267382 - DNA, 44 bp, Artificial Sequence
  Description of Artificial Sequence: Synthetic oligonucleotide
gtccagtgtggtggaaataacattgaagttgctataaaaagaag

SEQ ID NO: 267383 - DNA, 48 bp, Artificial Sequence
  Description of Artificial Sequence: Synthetic oligonucleotide
tccagtgtggtggaaataacattgaagttgctataaaaagaagaaaac

SEQ ID NO: 267384 - DNA, 47 bp, Artificial Sequence
  Description of Artificial Sequence: Synthetic oligonucleotide
ccagtgtggtggaaataacattgaagttgctataaaaagaagaaaac

SEQ ID NO: 267385 - DNA, 49 bp, Artificial Sequence
  Description of Artificial Sequence: Synthetic oligonucleotide
cagtgtggtggaaataacattgaagttgctataaaaagaagaaaacaac

SEQ ID NO: 267386 - DNA, 49 bp, Artificial Sequence
  Description of Artificial Sequence: Synthetic oligonucleotide
agtgtggtggaaataacattgaagttgctataaaaagaagaaaacaacc

SEQ ID NO: 267387 - DNA, 48 bp, Artificial Sequence
  Description of Artificial Sequence: Synthetic oligonucleotide
gtgtggtggaaataacattgaagttgctataaaaagaagaaaacaacc

SEQ ID NO: 267388 - DNA, 51 bp, Artificial Sequence
  Description of Artificial Sequence: Synthetic oligonucleotide
tgtggtggaaataacattgaagttgctataaaaagaagaaaacaacctttg

SEQ ID NO: 267389 - DNA, 50 bp, Artificial Sequence
  Description of Artificial Sequence: Synthetic oligonucleotide
gtggtggaaataacattgaagttgctataaaaagaagaaaacaacctttg

SEQ ID NO: 267390 - DNA, 52 bp, Artificial Sequence
  Description of Artificial Sequence: Synthetic oligonucleotide
tggtggaaataacattgaagttgctataaaaagaagaaaacaacctttgtag

SEQ ID NO: 267391 - DNA, 51 bp, Artificial Sequence
  Description of Artificial Sequence: Synthetic oligonucleotide
ggtggaaataacattgaagttgctataaaaagaagaaaacaacctttgtag

SEQ ID NO: 267392 - DNA, 53 bp, Artificial Sequence
  Description of Artificial Sequence: Synthetic oligonucleotide
gtggaaataacattgaagttgctataaaaagaagaaaacaacctttgtagatg

SEQ ID NO: 267393 - DNA, 57 bp, Artificial Sequence
  Description of Artificial Sequence: Synthetic oligonucleotide
tggaaataacattgaagttgctataaaaagaagaaaacaacctttgtagatgtttac

SEQ ID NO: 267394 - DNA, 56 bp, Artificial Sequence
  Description of Artificial Sequence: Synthetic oligonucleotide
ggaaataacattgaagttgctataaaaagaagaaaacaacctttgtagatgtttac

SEQ ID NO: 267395 - DNA, 57 bp, Artificial Sequence
  Description of Artificial Sequence: Synthetic oligonucleotide
gaaataacattgaagttgctataaaaagaagaaaacaacctttgtagatgtttactg

SEQ ID NO: 267396 - DNA, 57 bp, Artificial Sequence
  Description of Artificial Sequence: Synthetic oligonucleotide
aaataacattgaagttgctataaaaagaagaaaacaacctttgtagatgtttactgc

SEQ ID NO: 267397 - DNA, 56 bp, Artificial Sequence
  Description of Artificial Sequence: Synthetic oligonucleotide
aataacattgaagttgctataaaaagaagaaaacaacctttgtagatgtttactgc

SEQ ID NO: 267398 - DNA, 55 bp, Artificial Sequence
  Description of Artificial Sequence: Synthetic oligonucleotide
ataacattgaagttgctataaaaagaagaaaacaacctttgtagatgtttactgc

SEQ ID NO: 267399 - DNA, 54 bp, Artificial Sequence
  Description of Artificial Sequence: Synthetic oligonucleotide
taacattgaagttgctataaaaagaagaaaacaacctttgtagatgtttactgc

SEQ ID NO: 267400 - DNA, 53 bp, Artificial Sequence
  Description of Artificial Sequence: Synthetic oligonucleotide
aacattgaagttgctataaaaagaagaaaacaacctttgtagatgtttactgc

SEQ ID NO: 267401 - DNA, 52 bp, Artificial Sequence
  Description of Artificial Sequence: Synthetic oligonucleotide
acattgaagttgctataaaaagaagaaaacaacctttgtagatgtttactgc

SEQ ID NO: 267402 - DNA, 51 bp, Artificial Sequence
  Description of Artificial Sequence: Synthetic oligonucleotide
cattgaagttgctataaaaagaagaaaacaacctttgtagatgtttactgc

SEQ ID NO: 267403 - DNA, 55 bp, Artificial Sequence
  Description of Artificial Sequence: Synthetic oligonucleotide
attgaagttgctataaaaagaagaaaacaacctttgtagatgtttactgcaaaag

SEQ ID NO: 267404 - DNA, 54 bp, Artificial Sequence
  Description of Artificial Sequence: Synthetic oligonucleotide
ttgaagttgctataaaaagaagaaaacaacctttgtagatgtttactgcaaaag

SEQ ID NO: 267405 - DNA, 53 bp, Artificial Sequence
  Description of Artificial Sequence: Synthetic oligonucleotide
tgaagttgctataaaaagaagaaaacaacctttgtagatgtttactgcaaaag

SEQ ID NO: 267406 - DNA, 52 bp, Artificial Sequence
  Description of Artificial Sequence: Synthetic oligonucleotide
gaagttgctataaaaagaagaaaacaacctttgtagatgtttactgcaaaag

SEQ ID NO: 267407 - DNA, 54 bp, Artificial Sequence
  Description of Artificial Sequence: Synthetic oligonucleotide
aagttgctataaaaagaagaaaacaacctttgtagatgtttactgcaaaagatg

SEQ ID NO: 267408 - DNA, 53 bp, Artificial Sequence
  Description of Artificial Sequence: Synthetic oligonucleotide
agttgctataaaaagaagaaaacaacctttgtagatgtttactgcaaaagatg

SEQ ID NO: 267409 - DNA, 52 bp, Artificial Sequence
  Description of Artificial Sequence: Synthetic oligonucleotide
gttgctataaaaagaagaaaacaacctttgtagatgtttactgcaaaagatg

SEQ ID NO: 267410 - DNA, 54 bp, Artificial Sequence
  Description of Artificial Sequence: Synthetic oligonucleotide
ttgctataaaaagaagaaaacaacctttgtagatgtttactgcaaaagatgttg

SEQ ID NO: 267411 - DNA, 53 bp, Artificial Sequence
  Description of Artificial Sequence: Synthetic oligonucleotide
tgctataaaaagaagaaaacaacctttgtagatgtttactgcaaaagatgttg

SEQ ID NO: 267412 - DNA, 52 bp, Artificial Sequence
  Description of Artificial Sequence: Synthetic oligonucleotide
gctataaaaagaagaaaacaacctttgtagatgtttactgcaaaagatgttg

SEQ ID NO: 267413 - DNA, 60 bp, Artificial Sequence
  Description of Artificial Sequence: Synthetic oligonucleotide
ctataaaaagaagaaaacaacctttgtagatgtttactgcaaaagatgttgaattaaatg

SEQ ID NO: 267414 - DNA, 60 bp, Artificial Sequence
  Description of Artificial Sequence: Synthetic oligonucleotide
tataaaaagaagaaaacaacctttgtagatgtttactgcaaaagatgttgaattaaatgt

SEQ ID NO: 267415 - DNA, 60 bp, Artificial Sequence
  Description of Artificial Sequence: Synthetic oligonucleotide
ataaaaagaagaaaacaacctttgtagatgtttactgcaaaagatgttgaattaaatgta

SEQ ID NO: 267416 - DNA, 60 bp, Artificial Sequence
  Description of Artificial Sequence: Synthetic oligonucleotide
taaaaagaagaaaacaacctttgtagatgtttactgcaaaagatgttgaattaaatgtaa

SEQ ID NO: 267417 - DNA, 60 bp, Artificial Sequence
  Description of Artificial Sequence: Synthetic oligonucleotide
aaaaagaagaaaacaacctttgtagatgtttactgcaaaagatgttgaattaaatgtaac

SEQ ID NO: 267418 - DNA, 59 bp, Artificial Sequence
  Description of Artificial Sequence: Synthetic oligonucleotide
aaaagaagaaaacaacctttgtagatgtttactgcaaaagatgttgaattaaatgtaac

SEQ ID NO: 267419 - DNA, 58 bp, Artificial Sequence
  Description of Artificial Sequence: Synthetic oligonucleotide
aaagaagaaaacaacctttgtagatgtttactgcaaaagatgttgaattaaatgtaac

SEQ ID NO: 267420 - DNA, 57 bp, Artificial Sequence
  Description of Artificial Sequence: Synthetic oligonucleotide
aagaagaaaacaacctttgtagatgtttactgcaaaagatgttgaattaaatgtaac

SEQ ID NO: 267421 - DNA, 56 bp, Artificial Sequence
  Description of Artificial Sequence: Synthetic oligonucleotide
agaagaaaacaacctttgtagatgtttactgcaaaagatgttgaattaaatgtaac

SEQ ID NO: 267422 - DNA, 55 bp, Artificial Sequence
  Description of Artificial Sequence: Synthetic oligonucleotide
gaagaaaacaacctttgtagatgtttactgcaaaagatgttgaattaaatgtaac

SEQ ID NO: 267423 - DNA, 56 bp, Artificial Sequence
  Description of Artificial Sequence: Synthetic oligonucleotide
aagaaaacaacctttgtagatgtttactgcaaaagatgttgaattaaatgtaactg

SEQ ID NO: 267424 - DNA, 55 bp, Artificial Sequence
  Description of Artificial Sequence: Synthetic oligonucleotide
agaaaacaacctttgtagatgtttactgcaaaagatgttgaattaaatgtaactg

SEQ ID NO: 267425 - DNA, 54 bp, Artificial Sequence
  Description of Artificial Sequence: Synthetic oligonucleotide
gaaaacaacctttgtagatgtttactgcaaaagatgttgaattaaatgtaactg

SEQ ID NO: 267426 - DNA, 59 bp, Artificial Sequence
  Description of Artificial Sequence: Synthetic oligonucleotide
aaaacaacctttgtagatgtttactgcaaaagatgttgaattaaatgtaactgtaatag

SEQ ID NO: 267427 - DNA, 58 bp, Artificial Sequence
  Description of Artificial Sequence: Synthetic oligonucleotide
aaacaacctttgtagatgtttactgcaaaagatgttgaattaaatgtaactgtaatag

SEQ ID NO: 267428 - DNA, 57 bp, Artificial Sequence
  Description of Artificial Sequence: Synthetic oligonucleotide
aacaacctttgtagatgtttactgcaaaagatgttgaattaaatgtaactgtaatag

SEQ ID NO: 267429 - DNA, 56 bp, Artificial Sequence
  Description of Artificial Sequence: Synthetic oligonucleotide
acaacctttgtagatgtttactgcaaaagatgttgaattaaatgtaactgtaatag

SEQ ID NO: 267430 - DNA, 55 bp, Artificial Sequence
  Description of Artificial Sequence: Synthetic oligonucleotide
caacctttgtagatgtttactgcaaaagatgttgaattaaatgtaactgtaatag

SEQ ID NO: 267431 - DNA, 59 bp, Artificial Sequence
  Description of Artificial Sequence: Synthetic oligonucleotide
aacctttgtagatgtttactgcaaaagatgttgaattaaatgtaactgtaatagaaaac

SEQ ID NO: 267432 - DNA, 58 bp, Artificial Sequence
  Description of Artificial Sequence: Synthetic oligonucleotide
acctttgtagatgtttactgcaaaagatgttgaattaaatgtaactgtaatagaaaac

SEQ ID NO: 267433 - DNA, 57 bp, Artificial Sequence
  Description of Artificial Sequence: Synthetic oligonucleotide
cctttgtagatgtttactgcaaaagatgttgaattaaatgtaactgtaatagaaaac

SEQ ID NO: 267434 - DNA, 57 bp, Artificial Sequence
  Description of Artificial Sequence: Synthetic oligonucleotide
ctttgtagatgtttactgcaaaagatgttgaattaaatgtaactgtaatagaaaacg

SEQ ID NO: 267435 - DNA, 60 bp, Artificial Sequence
  Description of Artificial Sequence: Synthetic oligonucleotide
tttgtagatgtttactgcaaaagatgttgaattaaatgtaactgtaatagaaaacgaaaa

SEQ ID NO: 267436 - DNA, 60 bp, Artificial Sequence
  Description of Artificial Sequence: Synthetic oligonucleotide
ttgtagatgtttactgcaaaagatgttgaattaaatgtaactgtaatagaaaacgaaaag

SEQ ID NO: 267437 - DNA, 59 bp, Artificial Sequence
  Description of Artificial Sequence: Synthetic oligonucleotide
tgtagatgtttactgcaaaagatgttgaattaaatgtaactgtaatagaaaacgaaaag

SEQ ID NO: 267438 - DNA, 58 bp, Artificial Sequence
  Description of Artificial Sequence: Synthetic oligonucleotide
gtagatgtttactgcaaaagatgttgaattaaatgtaactgtaatagaaaacgaaaag

SEQ ID NO: 267439 - DNA, 58 bp, Artificial Sequence
  Description of Artificial Sequence: Synthetic oligonucleotide
tagatgtttactgcaaaagatgttgaattaaatgtaactgtaatagaaaacgaaaagg

SEQ ID NO: 267440 - DNA, 57 bp, Artificial Sequence
  Description of Artificial Sequence: Synthetic oligonucleotide
agatgtttactgcaaaagatgttgaattaaatgtaactgtaatagaaaacgaaaagg

SEQ ID NO: 267441 - DNA, 56 bp, Artificial Sequence
  Description of Artificial Sequence: Synthetic oligonucleotide
gatgtttactgcaaaagatgttgaattaaatgtaactgtaatagaaaacgaaaagg

SEQ ID NO: 267442 - DNA, 58 bp, Artificial Sequence
  Description of Artificial Sequence: Synthetic oligonucleotide
atgtttactgcaaaagatgttgaattaaatgtaactgtaatagaaaacgaaaaggaac

SEQ ID NO: 267443 - DNA, 57 bp, Artificial Sequence
  Description of Artificial Sequence: Synthetic oligonucleotide
tgtttactgcaaaagatgttgaattaaatgtaactgtaatagaaaacgaaaaggaac

SEQ ID NO: 267444 - DNA, 56 bp, Artificial Sequence
  Description of Artificial Sequence: Synthetic oligonucleotide
gtttactgcaaaagatgttgaattaaatgtaactgtaatagaaaacgaaaaggaac

SEQ ID NO: 267445 - DNA, 58 bp, Artificial Sequence
  Description of Artificial Sequence: Synthetic oligonucleotide
tttactgcaaaagatgttgaattaaatgtaactgtaatagaaaacgaaaaggaacaag

SEQ ID NO: 267446 - DNA, 57 bp, Artificial Sequence
  Description of Artificial Sequence: Synthetic oligonucleotide
ttactgcaaaagatgttgaattaaatgtaactgtaatagaaaacgaaaaggaacaag

SEQ ID NO: 267447 - DNA, 56 bp, Artificial Sequence
  Description of Artificial Sequence: Synthetic oligonucleotide
tactgcaaaagatgttgaattaaatgtaactgtaatagaaaacgaaaaggaacaag

SEQ ID NO: 267448 - DNA, 55 bp, Artificial Sequence
  Description of Artificial Sequence: Synthetic oligonucleotide
actgcaaaagatgttgaattaaatgtaactgtaatagaaaacgaaaaggaacaag

SEQ ID NO: 267449 - DNA, 54 bp, Artificial Sequence
  Description of Artificial Sequence: Synthetic oligonucleotide
ctgcaaaagatgttgaattaaatgtaactgtaatagaaaacgaaaaggaacaag

SEQ ID NO: 267450 - DNA, 54 bp, Artificial Sequence
  Description of Artificial Sequence: Synthetic oligonucleotide
tgcaaaagatgttgaattaaatgtaactgtaatagaaaacgaaaaggaacaagc

SEQ ID NO: 267451 - DNA, 53 bp, Artificial Sequence
  Description of Artificial Sequence: Synthetic oligonucleotide
gcaaaagatgttgaattaaatgtaactgtaatagaaaacgaaaaggaacaagc

SEQ ID NO: 267452 - DNA, 54 bp, Artificial Sequence
  Description of Artificial Sequence: Synthetic oligonucleotide
caaaagatgttgaattaaatgtaactgtaatagaaaacgaaaaggaacaagcag

SEQ ID NO: 267453 - DNA, 55 bp, Artificial Sequence
  Description of Artificial Sequence: Synthetic oligonucleotide
aaaagatgttgaattaaatgtaactgtaatagaaaacgaaaaggaacaagcagag

SEQ ID NO: 267454 - DNA, 54 bp, Artificial Sequence
  Description of Artificial Sequence: Synthetic oligonucleotide
aaagatgttgaattaaatgtaactgtaatagaaaacgaaaaggaacaagcagag

SEQ ID NO: 267455 - DNA, 53 bp, Artificial Sequence
  Description of Artificial Sequence: Synthetic oligonucleotide
aagatgttgaattaaatgtaactgtaatagaaaacgaaaaggaacaagcagag

SEQ ID NO: 267456 - DNA, 52 bp, Artificial Sequence
  Description of Artificial Sequence: Synthetic oligonucleotide
agatgttgaattaaatgtaactgtaatagaaaacgaaaaggaacaagcagag

SEQ ID NO: 267457 - DNA, 51 bp, Artificial Sequence
  Description of Artificial Sequence: Synthetic oligonucleotide
gatgttgaattaaatgtaactgtaatagaaaacgaaaaggaacaagcagag

SEQ ID NO: 267458 - DNA, 53 bp, Artificial Sequence
  Description of Artificial Sequence: Synthetic oligonucleotide
atgttgaattaaatgtaactgtaatagaaaacgaaaaggaacaagcagagatg

SEQ ID NO: 267459 - DNA, 52 bp, Artificial Sequence
  Description of Artificial Sequence: Synthetic oligonucleotide
tgttgaattaaatgtaactgtaatagaaaacgaaaaggaacaagcagagatg

SEQ ID NO: 267460 - DNA, 51 bp, Artificial Sequence
  Description of Artificial Sequence: Synthetic oligonucleotide
gttgaattaaatgtaactgtaatagaaaacgaaaaggaacaagcagagatg

SEQ ID NO: 267461 - DNA, 58 bp, Artificial Sequence
  Description of Artificial Sequence: Synthetic oligonucleotide
ttgaattaaatgtaactgtaatagaaaacgaaaaggaacaagcagagatgaaaaaatc

SEQ ID NO: 267462 - DNA, 57 bp, Artificial Sequence
  Description of Artificial Sequence: Synthetic oligonucleotide
tgaattaaatgtaactgtaatagaaaacgaaaaggaacaagcagagatgaaaaaatc

SEQ ID NO: 267463 - DNA, 56 bp, Artificial Sequence
  Description of Artificial Sequence: Synthetic oligonucleotide
gaattaaatgtaactgtaatagaaaacgaaaaggaacaagcagagatgaaaaaatc

SEQ ID NO: 267464 - DNA, 59 bp, Artificial Sequence
  Description of Artificial Sequence: Synthetic oligonucleotide
aattaaatgtaactgtaatagaaaacgaaaaggaacaagcagagatgaaaaaatctaag

SEQ ID NO: 267465 - DNA, 58 bp, Artificial Sequence
  Description of Artificial Sequence: Synthetic oligonucleotide
attaaatgtaactgtaatagaaaacgaaaaggaacaagcagagatgaaaaaatctaag

SEQ ID NO: 267466 - DNA, 57 bp, Artificial Sequence
  Description of Artificial Sequence: Synthetic oligonucleotide
ttaaatgtaactgtaatagaaaacgaaaaggaacaagcagagatgaaaaaatctaag

SEQ ID NO: 267467 - DNA, 56 bp, Artificial Sequence
  Description of Artificial Sequence: Synthetic oligonucleotide
taaatgtaactgtaatagaaaacgaaaaggaacaagcagagatgaaaaaatctaag

SEQ ID NO: 267468 - DNA, 55 bp, Artificial Sequence
  Description of Artificial Sequence: Synthetic oligonucleotide
aaatgtaactgtaatagaaaacgaaaaggaacaagcagagatgaaaaaatctaag

SEQ ID NO: 267469 - DNA, 54 bp, Artificial Sequence
  Description of Artificial Sequence: Synthetic oligonucleotide
aatgtaactgtaatagaaaacgaaaaggaacaagcagagatgaaaaaatctaag

SEQ ID NO: 267470 - DNA, 53 bp, Artificial Sequence
  Description of Artificial Sequence: Synthetic oligonucleotide
atgtaactgtaatagaaaacgaaaaggaacaagcagagatgaaaaaatctaag

SEQ ID NO: 267471 - DNA, 52 bp, Artificial Sequence
  Description of Artificial Sequence: Synthetic oligonucleotide
tgtaactgtaatagaaaacgaaaaggaacaagcagagatgaaaaaatctaag

SEQ ID NO: 267472 - DNA, 51 bp, Artificial Sequence
  Description of Artificial Sequence: Synthetic oligonucleotide
gtaactgtaatagaaaacgaaaaggaacaagcagagatgaaaaaatctaag

SEQ ID NO: 267473 - DNA, 55 bp, Artificial Sequence
  Description of Artificial Sequence: Synthetic oligonucleotide
taactgtaatagaaaacgaaaaggaacaagcagagatgaaaaaatctaagaaatc

SEQ ID NO: 267474 - DNA, 54 bp, Artificial Sequence
  Description of Artificial Sequence: Synthetic oligonucleotide
aactgtaatagaaaacgaaaaggaacaagcagagatgaaaaaatctaagaaatc

SEQ ID NO: 267475 - DNA, 53 bp, Artificial Sequence
  Description of Artificial Sequence: Synthetic oligonucleotide
actgtaatagaaaacgaaaaggaacaagcagagatgaaaaaatctaagaaatc

SEQ ID NO: 267476 - DNA, 52 bp, Artificial Sequence
  Description of Artificial Sequence: Synthetic oligonucleotide
ctgtaatagaaaacgaaaaggaacaagcagagatgaaaaaatctaagaaatc

SEQ ID NO: 267477 - DNA, 53 bp, Artificial Sequence
  Description of Artificial Sequence: Synthetic oligonucleotide
tgtaatagaaaacgaaaaggaacaagcagagatgaaaaaatctaagaaatctc

SEQ ID NO: 267478 - DNA, 52 bp, Artificial Sequence
  Description of Artificial Sequence: Synthetic oligonucleotide
gtaatagaaaacgaaaaggaacaagcagagatgaaaaaatctaagaaatctc

SEQ ID NO: 267479 - DNA, 53 bp, Artificial Sequence
  Description of Artificial Sequence: Synthetic oligonucleotide
taatagaaaacgaaaaggaacaagcagagatgaaaaaatctaagaaatctctc

SEQ ID NO: 267480 - DNA, 52 bp, Artificial Sequence
  Description of Artificial Sequence: Synthetic oligonucleotide
aatagaaaacgaaaaggaacaagcagagatgaaaaaatctaagaaatctctc

SEQ ID NO: 267481 - DNA, 51 bp, Artificial Sequence
  Description of Artificial Sequence: Synthetic oligonucleotide
atagaaaacgaaaaggaacaagcagagatgaaaaaatctaagaaatctctc

SEQ ID NO: 267482 - DNA, 50 bp, Artificial Sequence
  Description of Artificial Sequence: Synthetic oligonucleotide
tagaaaacgaaaaggaacaagcagagatgaaaaaatctaagaaatctctc

SEQ ID NO: 267483 - DNA, 49 bp, Artificial Sequence
  Description of Artificial Sequence: Synthetic oligonucleotide
agaaaacgaaaaggaacaagcagagatgaaaaaatctaagaaatctctc

SEQ ID NO: 267484 - DNA, 48 bp, Artificial Sequence
  Description of Artificial Sequence: Synthetic oligonucleotide
gaaaacgaaaaggaacaagcagagatgaaaaaatctaagaaatctctc

SEQ ID NO: 267485 - DNA, 32 bp, Artificial Sequence
  Description of Artificial Sequence: Synthetic oligonucleotide
atcttgtcctcttcagccatgttttcggctcc

SEQ ID NO: 267486 - DNA, 31 bp, Artificial Sequence
  Description of Artificial Sequence: Synthetic oligonucleotide
tcttgtcctcttcagccatgttttcggctcc

SEQ ID NO: 267487 - DNA, 30 bp, Artificial Sequence
  Description of Artificial Sequence: Synthetic oligonucleotide
cttgtcctcttcagccatgttttcggctcc

SEQ ID NO: 267488 - DNA, 31 bp, Artificial Sequence
  Description of Artificial Sequence: Synthetic oligonucleotide
ttgtcctcttcagccatgttttcggctccag

SEQ ID NO: 267489 - DNA, 30 bp, Artificial Sequence
  Description of Artificial Sequence: Synthetic oligonucleotide
tgtcctcttcagccatgttttcggctccag

SEQ ID NO: 267490 - DNA, 29 bp, Artificial Sequence
  Description of Artificial Sequence: Synthetic oligonucleotide
gtcctcttcagccatgttttcggctccag

SEQ ID NO: 267491 - DNA, 29 bp, Artificial Sequence
  Description of Artificial Sequence: Synthetic oligonucleotide
tcctcttcagccatgttttcggctccagg

SEQ ID NO: 267492 - DNA, 28 bp, Artificial Sequence
  Description of Artificial Sequence: Synthetic oligonucleotide
cctcttcagccatgttttcggctccagg

SEQ ID NO: 267493 - DNA, 28 bp, Artificial Sequence
  Description of Artificial Sequence: Synthetic oligonucleotide
ctcttcagccatgttttcggctccaggc

SEQ ID NO: 267494 - DNA, 29 bp, Artificial Sequence
  Description of Artificial Sequence: Synthetic oligonucleotide
tcttcagccatgttttcggctccaggcag

SEQ ID NO: 267495 - DNA, 28 bp, Artificial Sequence
  Description of Artificial Sequence: Synthetic oligonucleotide
cttcagccatgttttcggctccaggcag

SEQ ID NO: 267496 - DNA, 29 bp, Artificial Sequence
  Description of Artificial Sequence: Synthetic oligonucleotide
ttcagccatgttttcggctccaggcagag

SEQ ID NO: 267497 - DNA, 28 bp, Artificial Sequence
  Description of Artificial Sequence: Synthetic oligonucleotide
tcagccatgttttcggctccaggcagag

SEQ ID NO: 267498 - DNA, 27 bp, Artificial Sequence
  Description of Artificial Sequence: Synthetic oligonucleotide
cagccatgttttcggctccaggcagag

SEQ ID NO: 267499 - DNA, 28 bp, Artificial Sequence
  Description of Artificial Sequence: Synthetic oligonucleotide
agccatgttttcggctccaggcagagac

SEQ ID NO: 267500 - DNA, 27 bp, Artificial Sequence
  Description of Artificial Sequence: Synthetic oligonucleotide
gccatgttttcggctccaggcagagac

SEQ ID NO: 267501 - DNA, 29 bp, Artificial Sequence
  Description of Artificial Sequence: Synthetic oligonucleotide
ccatgttttcggctccaggcagagacatg

SEQ ID NO: 267502 - DNA, 29 bp, Artificial Sequence
  Description of Artificial Sequence: Synthetic oligonucleotide
catgttttcggctccaggcagagacatgg

SEQ ID NO: 267503 - DNA, 29 bp, Artificial Sequence
  Description of Artificial Sequence: Synthetic oligonucleotide
atgttttcggctccaggcagagacatggg

SEQ ID NO: 267504 - DNA, 28 bp, Artificial Sequence
  Description of Artificial Sequence: Synthetic oligonucleotide
tgttttcggctccaggcagagacatggg

SEQ ID NO: 267505 - DNA, 27 bp, Artificial Sequence
  Description of Artificial Sequence: Synthetic oligonucleotide
gttttcggctccaggcagagacatggg

SEQ ID NO: 267506 - DNA, 27 bp, Artificial Sequence
  Description of Artificial Sequence: Synthetic oligonucleotide
ttttcggctccaggcagagacatgggg

SEQ ID NO: 267507 - DNA, 27 bp, Artificial Sequence
  Description of Artificial Sequence: Synthetic oligonucleotide
tttcggctccaggcagagacatgggga

SEQ ID NO: 267508 - DNA, 27 bp, Artificial Sequence
  Description of Artificial Sequence: Synthetic oligonucleotide
ttcggctccaggcagagacatggggat

SEQ ID NO: 267509 - DNA, 26 bp, Artificial Sequence
  Description of Artificial Sequence: Synthetic oligonucleotide
tcggctccaggcagagacatggggat

SEQ ID NO: 267510 - DNA, 25 bp, Artificial Sequence
  Description of Artificial Sequence: Synthetic oligonucleotide
cggctccaggcagagacatggggat

SEQ ID NO: 267511 - DNA, 25 bp, Artificial Sequence
  Description of Artificial Sequence: Synthetic oligonucleotide
ggctccaggcagagacatggggatg

SEQ ID NO: 267512 - DNA, 27 bp, Artificial Sequence
  Description of Artificial Sequence: Synthetic oligonucleotide
gctccaggcagagacatggggatggta

SEQ ID NO: 267513 - DNA, 27 bp, Artificial Sequence
  Description of Artificial Sequence: Synthetic oligonucleotide
ctccaggcagagacatggggatggtac

SEQ ID NO: 267514 - DNA, 27 bp, Artificial Sequence
  Description of Artificial Sequence: Synthetic oligonucleotide
tccaggcagagacatggggatggtacc

SEQ ID NO: 267515 - DNA, 26 bp, Artificial Sequence
  Description of Artificial Sequence: Synthetic oligonucleotide
ccaggcagagacatggggatggtacc

SEQ ID NO: 267516 - DNA, 26 bp, Artificial Sequence
  Description of Artificial Sequence: Synthetic oligonucleotide
caggcagagacatggggatggtaccg

SEQ ID NO: 267517 - DNA, 27 bp, Artificial Sequence
  Description of Artificial Sequence: Synthetic oligonucleotide
aggcagagacatggggatggtaccgca

SEQ ID NO: 267518 - DNA, 26 bp, Artificial Sequence
  Description of Artificial Sequence: Synthetic oligonucleotide
ggcagagacatggggatggtaccgca

SEQ ID NO: 267519 - DNA, 27 bp, Artificial Sequence
  Description of Artificial Sequence: Synthetic oligonucleotide
gcagagacatggggatggtaccgcaca

SEQ ID NO: 267520 - DNA, 27 bp, Artificial Sequence
  Description of Artificial Sequence: Synthetic oligonucleotide
cagagacatggggatggtaccgcacag

SEQ ID NO: 267521 - DNA, 28 bp, Artificial Sequence
  Description of Artificial Sequence: Synthetic oligonucleotide
agagacatggggatggtaccgcacagtg

SEQ ID NO: 267522 - DNA, 27 bp, Artificial Sequence
  Description of Artificial Sequence: Synthetic oligonucleotide
gagacatggggatggtaccgcacagtg

SEQ ID NO: 267523 - DNA, 27 bp, Artificial Sequence
  Description of Artificial Sequence: Synthetic oligonucleotide
agacatggggatggtaccgcacagtgc

SEQ ID NO: 267524 - DNA, 26 bp, Artificial Sequence
  Description of Artificial Sequence: Synthetic oligonucleotide
gacatggggatggtaccgcacagtgc

SEQ ID NO: 267525 - DNA, 26 bp, Artificial Sequence
  Description of Artificial Sequence: Synthetic oligonucleotide
acatggggatggtaccgcacagtgcc

SEQ ID NO: 267526 - DNA, 25 bp, Artificial Sequence
  Description of Artificial Sequence: Synthetic oligonucleotide
catggggatggtaccgcacagtgcc

SEQ ID NO: 267527 - DNA, 25 bp, Artificial Sequence
  Description of Artificial Sequence: Synthetic oligonucleotide
atggggatggtaccgcacagtgccg

SEQ ID NO: 267528 - DNA, 24 bp, Artificial Sequence
  Description of Artificial Sequence: Synthetic oligonucleotide
tggggatggtaccgcacagtgccg

SEQ ID NO: 267529 - DNA, 23 bp, Artificial Sequence
  Description of Artificial Sequence: Synthetic oligonucleotide
ggggatggtaccgcacagtgccg

SEQ ID NO: 267530 - DNA, 23 bp, Artificial Sequence
  Description of Artificial Sequence: Synthetic oligonucleotide
gggatggtaccgcacagtgccgc

SEQ ID NO: 267531 - DNA, 23 bp, Artificial Sequence
  Description of Artificial Sequence: Synthetic oligonucleotide
ggatggtaccgcacagtgccgcg

SEQ ID NO: 267532 - DNA, 23 bp, Artificial Sequence
  Description of Artificial Sequence: Synthetic oligonucleotide
gatggtaccgcacagtgccgcgg

SEQ ID NO: 267533 - DNA, 23 bp, Artificial Sequence
  Description of Artificial Sequence: Synthetic oligonucleotide
atggtaccgcacagtgccgcggg

SEQ ID NO: 267534 - DNA, 22 bp, Artificial Sequence
  Description of Artificial Sequence: Synthetic oligonucleotide
tggtaccgcacagtgccgcggg

SEQ ID NO: 267535 - DNA, 21 bp, Artificial Sequence
  Description of Artificial Sequence: Synthetic oligonucleotide
ggtaccgcacagtgccgcggg

SEQ ID NO: 267536 - DNA, 21 bp, Artificial Sequence
  Description of Artificial Sequence: Synthetic oligonucleotide
gtaccgcacagtgccgcgggc

SEQ ID NO: 267537 - DNA, 21 bp, Artificial Sequence
  Description of Artificial Sequence: Synthetic oligonucleotide
taccgcacagtgccgcgggcg

SEQ ID NO: 267538 - DNA, 20 bp, Artificial Sequence
  Description of Artificial Sequence: Synthetic oligonucleotide
accgcacagtgccgcgggcg

SEQ ID NO: 267539 - DNA, 20 bp, Artificial Sequence
  Description of Artificial Sequence: Synthetic oligonucleotide
ccgcacagtgccgcgggcgt

SEQ ID NO: 267540 - DNA, 22 bp, Artificial Sequence
  Description of Artificial Sequence: Synthetic oligonucleotide
cgcacagtgccgcgggcgcttt

SEQ ID NO: 267541 - DNA, 22 bp, Artificial Sequence
  Description of Artificial Sequence: Synthetic oligonucleotide
gcacagtgccgcgggcgctttg

SEQ ID NO: 267542 - DNA, 23 bp, Artificial Sequence
  Description of Artificial Sequence: Synthetic oligonucleotide
cacagtgccgcgggcgctttgca

SEQ ID NO: 267543 - DNA, 23 bp, Artificial Sequence
  Description of Artificial Sequence: Synthetic oligonucleotide
acagtgccgcgggcgctttgcag

SEQ ID NO: 267544 - DNA, 22 bp, Artificial Sequence
  Description of Artificial Sequence: Synthetic oligonucleotide
cagtgccgcgggcgctttgcag

SEQ ID NO: 267545 - DNA, 23 bp, Artificial Sequence
  Description of Artificial Sequence: Synthetic oligonucleotide
agtgccgcgggcgctttgcagca

SEQ ID NO: 267546 - DNA, 22 bp, Artificial Sequence
  Description of Artificial Sequence: Synthetic oligonucleotide
gtgccgcgggcgctttgcagca

SEQ ID NO: 267547 - DNA, 22 bp, Artificial Sequence
  Description of Artificial Sequence: Synthetic oligonucleotide
tgccgcgggcgctttgcagcag

SEQ ID NO: 267548 - DNA, 21 bp, Artificial Sequence
  Description of Artificial Sequence: Synthetic oligonucleotide
gccgcgggcgctttgcagcag

SEQ ID NO: 267549 - DNA, 21 bp, Artificial Sequence
  Description of Artificial Sequence: Synthetic oligonucleotide
ccgcgggcgctttgcagcagc

SEQ ID NO: 267550 - DNA, 26 bp, Artificial Sequence
  Description of Artificial Sequence: Synthetic oligonucleotide
cgcgggcgctttgcagcagcgatttt

SEQ ID NO: 267551 - DNA, 26 bp, Artificial Sequence
  Description of Artificial Sequence: Synthetic oligonucleotide
gcgggcgctttgcagcagcgattttc

SEQ ID NO: 267552 - DNA, 26 bp, Artificial Sequence
  Description of Artificial Sequence: Synthetic oligonucleotide
cgggcgctttgcagcagcgattttcc

SEQ ID NO: 267553 - DNA, 26 bp, Artificial Sequence
  Description of Artificial Sequence: Synthetic oligonucleotide
gggcgctttgcagcagcgattttccc

SEQ ID NO: 267554 - DNA, 26 bp, Artificial Sequence
  Description of Artificial Sequence: Synthetic oligonucleotide
ggcgctttgcagcagcgattttcccc

SEQ ID NO: 267555 - DNA, 27 bp, Artificial Sequence
  Description of Artificial Sequence: Synthetic oligonucleotide
gcgctttgcagcagcgattttccccct

SEQ ID NO: 267556 - DNA, 28 bp, Artificial Sequence
  Description of Artificial Sequence: Synthetic oligonucleotide
cgctttgcagcagcgattttccccctac

SEQ ID NO: 267557 - DNA, 28 bp, Artificial Sequence
  Description of Artificial Sequence: Synthetic oligonucleotide
gctttgcagcagcgattttccccctacg

SEQ ID NO: 267558 - DNA, 32 bp, Artificial Sequence
  Description of Artificial Sequence: Synthetic oligonucleotide
ctttgcagcagcgattttccccctacgttatc

SEQ ID NO: 267559 - DNA, 34 bp, Artificial Sequence
  Description of Artificial Sequence: Synthetic oligonucleotide
tttgcagcagcgattttccccctacgttatcaac

SEQ ID NO: 267560 - DNA, 33 bp, Artificial Sequence
  Description of Artificial Sequence: Synthetic oligonucleotide
ttgcagcagcgattttccccctacgttatcaac

SEQ ID NO: 267561 - DNA, 32 bp, Artificial Sequence
  Description of Artificial Sequence: Synthetic oligonucleotide
tgcagcagcgattttccccctacgttatcaac

SEQ ID NO: 267562 - DNA, 31 bp, Artificial Sequence
  Description of Artificial Sequence: Synthetic oligonucleotide
gcagcagcgattttccccctacgttatcaac

SEQ ID NO: 267563 - DNA, 31 bp, Artificial Sequence
  Description of Artificial Sequence: Synthetic oligonucleotide
cagcagcgattttccccctacgttatcaacg

SEQ ID NO: 267564 - DNA, 31 bp, Artificial Sequence
  Description of Artificial Sequence: Synthetic oligonucleotide
agcagcgattttccccctacgttatcaacgg

SEQ ID NO: 267565 - DNA, 30 bp, Artificial Sequence
  Description of Artificial Sequence: Synthetic oligonucleotide
gcagcgattttccccctacgttatcaacgg

SEQ ID NO: 267566 - DNA, 31 bp, Artificial Sequence
  Description of Artificial Sequence: Synthetic oligonucleotide
cagcgattttccccctacgttatcaacggag

SEQ ID NO: 267567 - DNA, 31 bp, Artificial Sequence
  Description of Artificial Sequence: Synthetic oligonucleotide
agcgattttccccctacgttatcaacggagc

SEQ ID NO: 267568 - DNA, 30 bp, Artificial Sequence
  Description of Artificial Sequence: Synthetic oligonucleotide
gcgattttccccctacgttatcaacggagc

SEQ ID NO: 267569 - DNA, 32 bp, Artificial Sequence
  Description of Artificial Sequence: Synthetic oligonucleotide
cgattttccccctacgttatcaacggagctac

SEQ ID NO: 267570 - DNA, 36 bp, Artificial Sequence
  Description of Artificial Sequence: Synthetic oligonucleotide
gattttccccctacgttatcaacggagctactatac

SEQ ID NO: 267571 - DNA, 37 bp, Artificial Sequence
  Description of Artificial Sequence: Synthetic oligonucleotide
attttccccctacgttatcaacggagctactatactc

SEQ ID NO: 267572 - DNA, 36 bp, Artificial Sequence
  Description of Artificial Sequence: Synthetic oligonucleotide
ttttccccctacgttatcaacggagctactatactc

SEQ ID NO: 267573 - DNA, 35 bp, Artificial Sequence
  Description of Artificial Sequence: Synthetic oligonucleotide
tttccccctacgttatcaacggagctactatactc

SEQ ID NO: 267574 - DNA, 34 bp, Artificial Sequence
  Description of Artificial Sequence: Synthetic oligonucleotide
ttccccctacgttatcaacggagctactatactc

SEQ ID NO: 267575 - DNA, 33 bp, Artificial Sequence
  Description of Artificial Sequence: Synthetic oligonucleotide
tccccctacgttatcaacggagctactatactc

SEQ ID NO: 267576 - DNA, 32 bp, Artificial Sequence
  Description of Artificial Sequence: Synthetic oligonucleotide
ccccctacgttatcaacggagctactatactc

SEQ ID NO: 267577 - DNA, 32 bp, Artificial Sequence
  Description of Artificial Sequence: Synthetic oligonucleotide
cccctacgttatcaacggagctactatactcg

SEQ ID NO: 267578 - DNA, 32 bp, Artificial Sequence
  Description of Artificial Sequence: Synthetic oligonucleotide
ccctacgttatcaacggagctactatactcgc

SEQ ID NO: 267579 - DNA, 36 bp, Artificial Sequence
  Description of Artificial Sequence: Synthetic oligonucleotide
cctacgttatcaacggagctactatactcgcaattg

SEQ ID NO: 267580 - DNA, 36 bp, Artificial Sequence
  Description of Artificial Sequence: Synthetic oligonucleotide
ctacgttatcaacggagctactatactcgcaattgc

SEQ ID NO: 267581 - DNA, 37 bp, Artificial Sequence
  Description of Artificial Sequence: Synthetic oligonucleotide
tacgttatcaacggagctactatactcgcaattgctc

SEQ ID NO: 267582 - DNA, 36 bp, Artificial Sequence
  Description of Artificial Sequence: Synthetic oligonucleotide
acgttatcaacggagctactatactcgcaattgctc

SEQ ID NO: 267583 - DNA, 35 bp, Artificial Sequence
  Description of Artificial Sequence: Synthetic oligonucleotide
cgttatcaacggagctactatactcgcaattgctc

SEQ ID NO: 267584 - DNA, 35 bp, Artificial Sequence
  Description of Artificial Sequence: Synthetic oligonucleotide
gttatcaacggagctactatactcgcaattgctcg

SEQ ID NO: 267585 - DNA, 36 bp, Artificial Sequence
  Description of Artificial Sequence: Synthetic oligonucleotide
ttatcaacggagctactatactcgcaattgctcgag

SEQ ID NO: 267586 - DNA, 35 bp, Artificial Sequence
  Description of Artificial Sequence: Synthetic oligonucleotide
tatcaacggagctactatactcgcaattgctcgag

SEQ ID NO: 267587 - DNA, 34 bp, Artificial Sequence
  Description of Artificial Sequence: Synthetic oligonucleotide
atcaacggagctactatactcgcaattgctcgag

SEQ ID NO: 267588 - DNA, 33 bp, Artificial Sequence
  Description of Artificial Sequence: Synthetic oligonucleotide
tcaacggagctactatactcgcaattgctcgag

SEQ ID NO: 267589 - DNA, 32 bp, Artificial Sequence
  Description of Artificial Sequence: Synthetic oligonucleotide
caacggagctactatactcgcaattgctcgag

SEQ ID NO: 267590 - DNA, 34 bp, Artificial Sequence
  Description of Artificial Sequence: Synthetic oligonucleotide
aacggagctactatactcgcaattgctcgagaag

SEQ ID NO: 267591 - DNA, 33 bp, Artificial Sequence
  Description of Artificial Sequence: Synthetic oligonucleotide
acggagctactatactcgcaattgctcgagaag

SEQ ID NO: 267592 - DNA, 32 bp, Artificial Sequence
  Description of Artificial Sequence: Synthetic oligonucleotide
cggagctactatactcgcaattgctcgagaag

SEQ ID NO: 267593 - DNA, 37 bp, Artificial Sequence
  Description of Artificial Sequence: Synthetic oligonucleotide
ggagctactatactcgcaattgctcgagaagattatg

SEQ ID NO: 267594 - DNA, 37 bp, Artificial Sequence
  Description of Artificial Sequence: Synthetic oligonucleotide
gagctactatactcgcaattgctcgagaagattatgc

SEQ ID NO: 267595 - DNA, 41 bp, Artificial Sequence
  Description of Artificial Sequence: Synthetic oligonucleotide
agctactatactcgcaattgctcgagaagattatgcaattg

SEQ ID NO: 267596 - DNA, 40 bp, Artificial Sequence
  Description of Artificial Sequence: Synthetic oligonucleotide
gctactatactcgcaattgctcgagaagattatgcaattg

SEQ ID NO: 267597 - DNA, 42 bp, Artificial Sequence
  Description of Artificial Sequence: Synthetic oligonucleotide
ctactatactcgcaattgctcgagaagattatgcaattgtag

SEQ ID NO: 267598 - DNA, 42 bp, Artificial Sequence
  Description of Artificial Sequence: Synthetic oligonucleotide
tactatactcgcaattgctcgagaagattatgcaattgtagc

SEQ ID NO: 267599 - DNA, 41 bp, Artificial Sequence
  Description of Artificial Sequence: Synthetic oligonucleotide
actatactcgcaattgctcgagaagattatgcaattgtagc

SEQ ID NO: 267600 - DNA, 40 bp, Artificial Sequence
  Description of Artificial Sequence: Synthetic oligonucleotide
ctatactcgcaattgctcgagaagattatgcaattgtagc

SEQ ID NO: 267601 - DNA, 42 bp, Artificial Sequence
  Description of Artificial Sequence: Synthetic oligonucleotide
tatactcgcaattgctcgagaagattatgcaattgtagcttc

SEQ ID NO: 267602 - DNA, 41 bp, Artificial Sequence
  Description of Artificial Sequence: Synthetic oligonucleotide
atactcgcaattgctcgagaagattatgcaattgtagcttc

SEQ ID NO: 267603 - DNA, 40 bp, Artificial Sequence
  Description of Artificial Sequence: Synthetic oligonucleotide
tactcgcaattgctcgagaagattatgcaattgtagcttc

SEQ ID NO: 267604 - DNA, 39 bp, Artificial Sequence
  Description of Artificial Sequence: Synthetic oligonucleotide
actcgcaattgctcgagaagattatgcaattgtagcttc

SEQ ID NO: 267605 - DNA, 38 bp, Artificial Sequence
  Description of Artificial Sequence: Synthetic oligonucleotide
ctcgcaattgctcgagaagattatgcaattgtagcttc

SEQ ID NO: 267606 - DNA, 39 bp, Artificial Sequence
  Description of Artificial Sequence: Synthetic oligonucleotide
tcgcaattgctcgagaagattatgcaattgtagcttctg

SEQ ID NO: 267607 - DNA, 38 bp, Artificial Sequence
  Description of Artificial Sequence: Synthetic oligonucleotide
cgcaattgctcgagaagattatgcaattgtagcttctg

SEQ ID NO: 267608 - DNA, 41 bp, Artificial Sequence
  Description of Artificial Sequence: Synthetic oligonucleotide
gcaattgctcgagaagattatgcaattgtagcttctgattc

SEQ ID NO: 267609 - DNA, 42 bp, Artificial Sequence
  Description of Artificial Sequence: Synthetic oligonucleotide
caattgctcgagaagattatgcaattgtagcttctgattctc

SEQ ID NO: 267610 - DNA, 42 bp, Artificial Sequence
  Description of Artificial Sequence: Synthetic oligonucleotide
aattgctcgagaagattatgcaattgtagcttctgattctcg

SEQ ID NO: 267611 - DNA, 41 bp, Artificial Sequence
  Description of Artificial Sequence: Synthetic oligonucleotide
attgctcgagaagattatgcaattgtagcttctgattctcg

SEQ ID NO: 267612 - DNA, 40 bp, Artificial Sequence
  Description of Artificial Sequence: Synthetic oligonucleotide
ttgctcgagaagattatgcaattgtagcttctgattctcg

SEQ ID NO: 267613 - DNA, 39 bp, Artificial Sequence
  Description of Artificial Sequence: Synthetic oligonucleotide
tgctcgagaagattatgcaattgtagcttctgattctcg

SEQ ID NO: 267614 - DNA, 38 bp, Artificial Sequence
  Description of Artificial Sequence: Synthetic oligonucleotide
gctcgagaagattatgcaattgtagcttctgattctcg

SEQ ID NO: 267615 - DNA, 41 bp, Artificial Sequence
  Description of Artificial Sequence: Synthetic oligonucleotide
ctcgagaagattatgcaattgtagcttctgattctcgattg

SEQ ID NO: 267616 - DNA, 42 bp, Artificial Sequence
  Description of Artificial Sequence: Synthetic oligonucleotide
tcgagaagattatgcaattgtagcttctgattctcgattgac

SEQ ID NO: 267617 - DNA, 41 bp, Artificial Sequence
  Description of Artificial Sequence: Synthetic oligonucleotide
cgagaagattatgcaattgtagcttctgattctcgattgac

SEQ ID NO: 267618 - DNA, 42 bp, Artificial Sequence
  Description of Artificial Sequence: Synthetic oligonucleotide
gagaagattatgcaattgtagcttctgattctcgattgactg

SEQ ID NO: 267619 - DNA, 44 bp, Artificial Sequence
  Description of Artificial Sequence: Synthetic oligonucleotide
agaagattatgcaattgtagcttctgattctcgattgactgaag

SEQ ID NO: 267620 - DNA, 43 bp, Artificial Sequence
  Description of Artificial Sequence: Synthetic oligonucleotide
gaagattatgcaattgtagcttctgattctcgattgactgaag

SEQ ID NO: 267621 - DNA, 43 bp, Artificial Sequence
  Description of Artificial Sequence: Synthetic oligonucleotide
aagattatgcaattgtagcttctgattctcgattgactgaagg

SEQ ID NO: 267622 - DNA, 42 bp, Artificial Sequence
  Description of Artificial Sequence: Synthetic oligonucleotide
agattatgcaattgtagcttctgattctcgattgactgaagg

SEQ ID NO: 267623 - DNA, 41 bp, Artificial Sequence
  Description of Artificial Sequence: Synthetic oligonucleotide
gattatgcaattgtagcttctgattctcgattgactgaagg

SEQ ID NO: 267624 - DNA, 41 bp, Artificial Sequence
  Description of Artificial Sequence: Synthetic oligonucleotide
attatgcaattgtagcttctgattctcgattgactgaaggg

SEQ ID NO: 267625 - DNA, 40 bp, Artificial Sequence
  Description of Artificial Sequence: Synthetic oligonucleotide
ttatgcaattgtagcttctgattctcgattgactgaaggg

SEQ ID NO: 267626 - DNA, 39 bp, Artificial Sequence
  Description of Artificial Sequence: Synthetic oligonucleotide
tatgcaattgtagcttctgattctcgattgactgaaggg

SEQ ID NO: 267627 - DNA, 38 bp, Artificial Sequence
  Description of Artificial Sequence: Synthetic oligonucleotide
atgcaattgtagcttctgattctcgattgactgaaggg

SEQ ID NO: 267628 - DNA, 37 bp, Artificial Sequence
  Description of Artificial Sequence: Synthetic oligonucleotide
tgcaattgtagcttctgattctcgattgactgaaggg

SEQ ID NO: 267629 - DNA, 36 bp, Artificial Sequence
  Description of Artificial Sequence: Synthetic oligonucleotide
gcaattgtagcttctgattctcgattgactgaaggg

SEQ ID NO: 267630 - DNA, 40 bp, Artificial Sequence
  Description of Artificial Sequence: Synthetic oligonucleotide
caattgtagcttctgattctcgattgactgaagggttatc

SEQ ID NO: 267631 - DNA, 44 bp, Artificial Sequence
  Description of Artificial Sequence: Synthetic oligonucleotide
aattgtagcttctgattctcgattgactgaagggttatcaattc

SEQ ID NO: 267632 - DNA, 43 bp, Artificial Sequence
  Description of Artificial Sequence: Synthetic oligonucleotide
attgtagcttctgattctcgattgactgaagggttatcaattc

SEQ ID NO: 267633 - DNA, 42 bp, Artificial Sequence
  Description of Artificial Sequence: Synthetic oligonucleotide
ttgtagcttctgattctcgattgactgaagggttatcaattc

SEQ ID NO: 267634 - DNA, 41 bp, Artificial Sequence
  Description of Artificial Sequence: Synthetic oligonucleotide
tgtagcttctgattctcgattgactgaagggttatcaattc

SEQ ID NO: 267635 - DNA, 40 bp, Artificial Sequence
  Description of Artificial Sequence: Synthetic oligonucleotide
gtagcttctgattctcgattgactgaagggttatcaattc

SEQ ID NO: 267636 - DNA, 43 bp, Artificial Sequence
  Description of Artificial Sequence: Synthetic oligonucleotide
tagcttctgattctcgattgactgaagggttatcaattcattc

SEQ ID NO: 267637 - DNA, 42 bp, Artificial Sequence
  Description of Artificial Sequence: Synthetic oligonucleotide
agcttctgattctcgattgactgaagggttatcaattcattc

SEQ ID NO: 267638 - DNA, 41 bp, Artificial Sequence
  Description of Artificial Sequence: Synthetic oligonucleotide
gcttctgattctcgattgactgaagggttatcaattcattc

SEQ ID NO: 267639 - DNA, 41 bp, Artificial Sequence
  Description of Artificial Sequence: Synthetic oligonucleotide
cttctgattctcgattgactgaagggttatcaattcattcg

SEQ ID NO: 267640 - DNA, 41 bp, Artificial Sequence
  Description of Artificial Sequence: Synthetic oligonucleotide
ttctgattctcgattgactgaagggttatcaattcattcgc

SEQ ID NO: 267641 - DNA, 40 bp, Artificial Sequence
  Description of Artificial Sequence: Synthetic oligonucleotide
tctgattctcgattgactgaagggttatcaattcattcgc

SEQ ID NO: 267642 - DNA, 39 bp, Artificial Sequence
  Description of Artificial Sequence: Synthetic oligonucleotide
ctgattctcgattgactgaagggttatcaattcattcgc

SEQ ID NO: 267643 - DNA, 39 bp, Artificial Sequence
  Description of Artificial Sequence: Synthetic oligonucleotide
tgattctcgattgactgaagggttatcaattcattcgcg

SEQ ID NO: 267644 - DNA, 38 bp, Artificial Sequence
  Description of Artificial Sequence: Synthetic oligonucleotide
gattctcgattgactgaagggttatcaattcattcgcg

SEQ ID NO: 267645 - DNA, 38 bp, Artificial Sequence
  Description of Artificial Sequence: Synthetic oligonucleotide
attctcgattgactgaagggttatcaattcattcgcgg

SEQ ID NO: 267646 - DNA, 37 bp, Artificial Sequence
  Description of Artificial Sequence: Synthetic oligonucleotide
ttctcgattgactgaagggttatcaattcattcgcgg

SEQ ID NO: 267647 - DNA, 36 bp, Artificial Sequence
  Description of Artificial Sequence: Synthetic oligonucleotide
tctcgattgactgaagggttatcaattcattcgcgg

SEQ ID NO: 267648 - DNA, 35 bp, Artificial Sequence
  Description of Artificial Sequence: Synthetic oligonucleotide
ctcgattgactgaagggttatcaattcattcgcgg

SEQ ID NO: 267649 - DNA, 35 bp, Artificial Sequence
  Description of Artificial Sequence: Synthetic oligonucleotide
tcgattgactgaagggttatcaattcattcgcggg

SEQ ID NO: 267650 - DNA, 34 bp, Artificial Sequence
  Description of Artificial Sequence: Synthetic oligonucleotide
cgattgactgaagggttatcaattcattcgcggg

SEQ ID NO: 267651 - DNA, 37 bp, Artificial Sequence
  Description of Artificial Sequence: Synthetic oligonucleotide
gattgactgaagggttatcaattcattcgcgggatac

SEQ ID NO: 267652 - DNA, 37 bp, Artificial Sequence
  Description of Artificial Sequence: Synthetic oligonucleotide
attgactgaagggttatcaattcattcgcgggatacc

SEQ ID NO: 267653 - DNA, 36 bp, Artificial Sequence
  Description of Artificial Sequence: Synthetic oligonucleotide
ttgactgaagggttatcaattcattcgcgggatacc

SEQ ID NO: 267654 - DNA, 35 bp, Artificial Sequence
  Description of Artificial Sequence: Synthetic oligonucleotide
tgactgaagggttatcaattcattcgcgggatacc

SEQ ID NO: 267655 - DNA, 34 bp, Artificial Sequence
  Description of Artificial Sequence: Synthetic oligonucleotide
gactgaagggttatcaattcattcgcgggatacc

SEQ ID NO: 267656 - DNA, 34 bp, Artificial Sequence
  Description of Artificial Sequence: Synthetic oligonucleotide
actgaagggttatcaattcattcgcgggataccc

SEQ ID NO: 267657 - DNA, 33 bp, Artificial Sequence
  Description of Artificial Sequence: Synthetic oligonucleotide
ctgaagggttatcaattcattcgcgggataccc

SEQ ID NO: 267658 - DNA, 33 bp, Artificial Sequence
  Description of Artificial Sequence: Synthetic oligonucleotide
tgaagggttatcaattcattcgcgggatacccc

SEQ ID NO: 267659 - DNA, 32 bp, Artificial Sequence
  Description of Artificial Sequence: Synthetic oligonucleotide
gaagggttatcaattcattcgcgggatacccc

SEQ ID NO: 267660 - DNA, 32 bp, Artificial Sequence
  Description of Artificial Sequence: Synthetic oligonucleotide
aagggttatcaattcattcgcgggataccccc

SEQ ID NO: 267661 - DNA, 31 bp, Artificial Sequence
  Description of Artificial Sequence: Synthetic oligonucleotide
agggttatcaattcattcgcgggataccccc

SEQ ID NO: 267662 - DNA, 30 bp, Artificial Sequence
  Description of Artificial Sequence: Synthetic oligonucleotide
gggttatcaattcattcgcgggataccccc

SEQ ID NO: 267663 - DNA, 34 bp, Artificial Sequence
  Description of Artificial Sequence: Synthetic oligonucleotide
ggttatcaattcattcgcgggatacccccaaatg

SEQ ID NO: 267664 - DNA, 37 bp, Artificial Sequence
  Description of Artificial Sequence: Synthetic oligonucleotide
gttatcaattcattcgcgggatacccccaaatgatac

SEQ ID NO: 267665 - DNA, 44 bp, Artificial Sequence
  Description of Artificial Sequence: Synthetic oligonucleotide
ttatcaattcattcgcgggatacccccaaatgatacaaattatc

SEQ ID NO: 267666 - DNA, 43 bp, Artificial Sequence
  Description of Artificial Sequence: Synthetic oligonucleotide
tatcaattcattcgcgggatacccccaaatgatacaaattatc

SEQ ID NO: 267667 - DNA, 42 bp, Artificial Sequence
  Description of Artificial Sequence: Synthetic oligonucleotide
atcaattcattcgcgggatacccccaaatgatacaaattatc

SEQ ID NO: 267668 - DNA, 41 bp, Artificial Sequence
  Description of Artificial Sequence: Synthetic oligonucleotide
tcaattcattcgcgggatacccccaaatgatacaaattatc

SEQ ID NO: 267669 - DNA, 40 bp, Artificial Sequence
  Description of Artificial Sequence: Synthetic oligonucleotide
caattcattcgcgggatacccccaaatgatacaaattatc

SEQ ID NO: 267670 - DNA, 41 bp, Artificial Sequence
  Description of Artificial Sequence: Synthetic oligonucleotide
aattcattcgcgggatacccccaaatgatacaaattatcag

SEQ ID NO: 267671 - DNA, 40 bp, Artificial Sequence
  Description of Artificial Sequence: Synthetic oligonucleotide
attcattcgcgggatacccccaaatgatacaaattatcag

SEQ ID NO: 267672 - DNA, 39 bp, Artificial Sequence
  Description of Artificial Sequence: Synthetic oligonucleotide
ttcattcgcgggatacccccaaatgatacaaattatcag

SEQ ID NO: 267673 - DNA, 38 bp, Artificial Sequence
  Description of Artificial Sequence: Synthetic oligonucleotide
tcattcgcgggatacccccaaatgatacaaattatcag

SEQ ID NO: 267674 - DNA, 37 bp, Artificial Sequence
  Description of Artificial Sequence: Synthetic oligonucleotide
cattcgcgggatacccccaaatgatacaaattatcag

SEQ ID NO: 267675 - DNA, 38 bp, Artificial Sequence
  Description of Artificial Sequence: Synthetic oligonucleotide
attcgcgggatacccccaaatgatacaaattatcagac

SEQ ID NO: 267676 - DNA, 37 bp, Artificial Sequence
  Description of Artificial Sequence: Synthetic oligonucleotide
ttcgcgggatacccccaaatgatacaaattatcagac

SEQ ID NO: 267677 - DNA, 36 bp, Artificial Sequence
  Description of Artificial Sequence: Synthetic oligonucleotide
tcgcgggatacccccaaatgatacaaattatcagac

SEQ ID NO: 267678 - DNA, 35 bp, Artificial Sequence
  Description of Artificial Sequence: Synthetic oligonucleotide
cgcgggatacccccaaatgatacaaattatcagac

SEQ ID NO: 267679 - DNA, 39 bp, Artificial Sequence
  Description of Artificial Sequence: Synthetic oligonucleotide
gcgggatacccccaaatgatacaaattatcagacaaaag

SEQ ID NO: 267680 - DNA, 40 bp, Artificial Sequence
  Description of Artificial Sequence: Synthetic oligonucleotide
cgggatacccccaaatgatacaaattatcagacaaaagag

SEQ ID NO: 267681 - DNA, 41 bp, Artificial Sequence
  Description of Artificial Sequence: Synthetic oligonucleotide
gggatacccccaaatgatacaaattatcagacaaaagagtc

SEQ ID NO: 267682 - DNA, 44 bp, Artificial Sequence
  Description of Artificial Sequence: Synthetic oligonucleotide
ggatacccccaaatgatacaaattatcagacaaaagagtcattg

SEQ ID NO: 267683 - DNA, 44 bp, Artificial Sequence
  Description of Artificial Sequence: Synthetic oligonucleotide
gatacccccaaatgatacaaattatcagacaaaagagtcattgg

SEQ ID NO: 267684 - DNA, 46 bp, Artificial Sequence
  Description of Artificial Sequence: Synthetic oligonucleotide
atacccccaaatgatacaaattatcagacaaaagagtcattggttg

SEQ ID NO: 267685 - DNA, 45 bp, Artificial Sequence
  Description of Artificial Sequence: Synthetic oligonucleotide
tacccccaaatgatacaaattatcagacaaaagagtcattggttg

SEQ ID NO: 267686 - DNA, 44 bp, Artificial Sequence
  Description of Artificial Sequence: Synthetic oligonucleotide
acccccaaatgatacaaattatcagacaaaagagtcattggttg

SEQ ID NO: 267687 - DNA, 43 bp, Artificial Sequence
  Description of Artificial Sequence: Synthetic oligonucleotide
cccccaaatgatacaaattatcagacaaaagagtcattggttg

SEQ ID NO: 267688 - DNA, 43 bp, Artificial Sequence
  Description of Artificial Sequence: Synthetic oligonucleotide
ccccaaatgatacaaattatcagacaaaagagtcattggttgc

SEQ ID NO: 267689 - DNA, 44 bp, Artificial Sequence
  Description of Artificial Sequence: Synthetic oligonucleotide
cccaaatgatacaaattatcagacaaaagagtcattggttgcag

SEQ ID NO: 267690 - DNA, 44 bp, Artificial Sequence
  Description of Artificial Sequence: Synthetic oligonucleotide
ccaaatgatacaaattatcagacaaaagagtcattggttgcagc

SEQ ID NO: 267691 - DNA, 44 bp, Artificial Sequence
  Description of Artificial Sequence: Synthetic oligonucleotide
caaatgatacaaattatcagacaaaagagtcattggttgcagcg

SEQ ID NO: 267692 - DNA, 44 bp, Artificial Sequence
  Description of Artificial Sequence: Synthetic oligonucleotide
aaatgatacaaattatcagacaaaagagtcattggttgcagcgg

SEQ ID NO: 267693 - DNA, 43 bp, Artificial Sequence
  Description of Artificial Sequence: Synthetic oligonucleotide
aatgatacaaattatcagacaaaagagtcattggttgcagcgg

SEQ ID NO: 267694 - DNA, 42 bp, Artificial Sequence
  Description of Artificial Sequence: Synthetic oligonucleotide
atgatacaaattatcagacaaaagagtcattggttgcagcgg

SEQ ID NO: 267695 - DNA, 41 bp, Artificial Sequence
  Description of Artificial Sequence: Synthetic oligonucleotide
tgatacaaattatcagacaaaagagtcattggttgcagcgg

SEQ ID NO: 267696 - DNA, 40 bp, Artificial Sequence
  Description of Artificial Sequence: Synthetic oligonucleotide
gatacaaattatcagacaaaagagtcattggttgcagcgg

SEQ ID NO: 267697 - DNA, 44 bp, Artificial Sequence
  Description of Artificial Sequence: Synthetic oligonucleotide
atacaaattatcagacaaaagagtcattggttgcagcggtattc

SEQ ID NO: 267698 - DNA, 43 bp, Artificial Sequence
  Description of Artificial Sequence: Synthetic oligonucleotide
tacaaattatcagacaaaagagtcattggttgcagcggtattc

SEQ ID NO: 267699 - DNA, 42 bp, Artificial Sequence
  Description of Artificial Sequence: Synthetic oligonucleotide
acaaattatcagacaaaagagtcattggttgcagcggtattc

SEQ ID NO: 267700 - DNA, 41 bp, Artificial Sequence
  Description of Artificial Sequence: Synthetic oligonucleotide
caaattatcagacaaaagagtcattggttgcagcggtattc

SEQ ID NO: 267701 - DNA, 43 bp, Artificial Sequence
  Description of Artificial Sequence: Synthetic oligonucleotide
aaattatcagacaaaagagtcattggttgcagcggtattcatg

SEQ ID NO: 267702 - DNA, 42 bp, Artificial Sequence
  Description of Artificial Sequence: Synthetic oligonucleotide
aattatcagacaaaagagtcattggttgcagcggtattcatg

SEQ ID NO: 267703 - DNA, 41 bp, Artificial Sequence
  Description of Artificial Sequence: Synthetic oligonucleotide
attatcagacaaaagagtcattggttgcagcggtattcatg

SEQ ID NO: 267704 - DNA, 40 bp, Artificial Sequence
  Description of Artificial Sequence: Synthetic oligonucleotide
ttatcagacaaaagagtcattggttgcagcggtattcatg

SEQ ID NO: 267705 - DNA, 39 bp, Artificial Sequence
  Description of Artificial Sequence: Synthetic oligonucleotide
tatcagacaaaagagtcattggttgcagcggtattcatg

SEQ ID NO: 267706 - DNA, 38 bp, Artificial Sequence
  Description of Artificial Sequence: Synthetic oligonucleotide
atcagacaaaagagtcattggttgcagcggtattcatg

SEQ ID NO: 267707 - DNA, 37 bp, Artificial Sequence
  Description of Artificial Sequence: Synthetic oligonucleotide
tcagacaaaagagtcattggttgcagcggtattcatg

SEQ ID NO: 267708 - DNA, 36 bp, Artificial Sequence
  Description of Artificial Sequence: Synthetic oligonucleotide
cagacaaaagagtcattggttgcagcggtattcatg

SEQ ID NO: 267709 - DNA, 36 bp, Artificial Sequence
  Description of Artificial Sequence: Synthetic oligonucleotide
agacaaaagagtcattggttgcagcggtattcatgg

SEQ ID NO: 267710 - DNA, 35 bp, Artificial Sequence
  Description of Artificial Sequence: Synthetic oligonucleotide
gacaaaagagtcattggttgcagcggtattcatgg

SEQ ID NO: 267711 - DNA, 36 bp, Artificial Sequence
  Description of Artificial Sequence: Synthetic oligonucleotide
acaaaagagtcattggttgcagcggtattcatggag

SEQ ID NO: 267712 - DNA, 35 bp, Artificial Sequence
  Description of Artificial Sequence: Synthetic oligonucleotide
caaaagagtcattggttgcagcggtattcatggag

SEQ ID NO: 267713 - DNA, 36 bp, Artificial Sequence
  Description of Artificial Sequence: Synthetic oligonucleotide
aaaagagtcattggttgcagcggtattcatggagtc

SEQ ID NO: 267714 - DNA, 35 bp, Artificial Sequence
  Description of Artificial Sequence: Synthetic oligonucleotide
aaagagtcattggttgcagcggtattcatggagtc

SEQ ID NO: 267715 - DNA, 34 bp, Artificial Sequence
  Description of Artificial Sequence: Synthetic oligonucleotide
aagagtcattggttgcagcggtattcatggagtc

SEQ ID NO: 267716 - DNA, 33 bp, Artificial Sequence
  Description of Artificial Sequence: Synthetic oligonucleotide
agagtcattggttgcagcggtattcatggagtc

SEQ ID NO: 267717 - DNA, 32 bp, Artificial Sequence
  Description of Artificial Sequence: Synthetic oligonucleotide
gagtcattggttgcagcggtattcatggagtc

SEQ ID NO: 267718 - DNA, 33 bp, Artificial Sequence
  Description of Artificial Sequence: Synthetic oligonucleotide
agtcattggttgcagcggtattcatggagtctg

SEQ ID NO: 267719 - DNA, 32 bp, Artificial Sequence
  Description of Artificial Sequence: Synthetic oligonucleotide
gtcattggttgcagcggtattcatggagtctg

SEQ ID NO: 267720 - DNA, 33 bp, Artificial Sequence
  Description of Artificial Sequence: Synthetic oligonucleotide
tcattggttgcagcggtattcatggagtctgtc

SEQ ID NO: 267721 - DNA, 32 bp, Artificial Sequence
  Description of Artificial Sequence: Synthetic oligonucleotide
cattggttgcagcggtattcatggagtctgtc

SEQ ID NO: 267722 - DNA, 35 bp, Artificial Sequence
  Description of Artificial Sequence: Synthetic oligonucleotide
attggttgcagcggtattcatggagtctgtcttac

SEQ ID NO: 267723 - DNA, 34 bp, Artificial Sequence
  Description of Artificial Sequence: Synthetic oligonucleotide
ttggttgcagcggtattcatggagtctgtcttac

SEQ ID NO: 267724 - DNA, 33 bp, Artificial Sequence
  Description of Artificial Sequence: Synthetic oligonucleotide
tggttgcagcggtattcatggagtctgtcttac

SEQ ID NO: 267725 - DNA, 32 bp, Artificial Sequence
  Description of Artificial Sequence: Synthetic oligonucleotide
ggttgcagcggtattcatggagtctgtcttac

SEQ ID NO: 267726 - DNA, 32 bp, Artificial Sequence
  Description of Artificial Sequence: Synthetic oligonucleotide
gttgcagcggtattcatggagtctgtcttacc

SEQ ID NO: 267727 - DNA, 32 bp, Artificial Sequence
  Description of Artificial Sequence: Synthetic oligonucleotide
ttgcagcggtattcatggagtctgtcttaccc

SEQ ID NO: 267728 - DNA, 31 bp, Artificial Sequence
  Description of Artificial Sequence: Synthetic oligonucleotide
tgcagcggtattcatggagtctgtcttaccc

SEQ ID NO: 267729 - DNA, 30 bp, Artificial Sequence
  Description of Artificial Sequence: Synthetic oligonucleotide
gcagcggtattcatggagtctgtcttaccc

SEQ ID NO: 267730 - DNA, 31 bp, Artificial Sequence
  Description of Artificial Sequence: Synthetic oligonucleotide
cagcggtattcatggagtctgtcttaccctg

SEQ ID NO: 267731 - DNA, 32 bp, Artificial Sequence
  Description of Artificial Sequence: Synthetic oligonucleotide
agcggtattcatggagtctgtcttaccctgac

SEQ ID NO: 267732 - DNA, 31 bp, Artificial Sequence
  Description of Artificial Sequence: Synthetic oligonucleotide
gcggtattcatggagtctgtcttaccctgac

SEQ ID NO: 267733 - DNA, 34 bp, Artificial Sequence
  Description of Artificial Sequence: Synthetic oligonucleotide
cggtattcatggagtctgtcttaccctgacaaag

SEQ ID NO: 267734 - DNA, 40 bp, Artificial Sequence
  Description of Artificial Sequence: Synthetic oligonucleotide
ggtattcatggagtctgtcttaccctgacaaagtttattg

SEQ ID NO: 267735 - DNA, 42 bp, Artificial Sequence
  Description of Artificial Sequence: Synthetic oligonucleotide
gtattcatggagtctgtcttaccctgacaaagtttattgaag

SEQ ID NO: 267736 - DNA, 42 bp, Artificial Sequence
  Description of Artificial Sequence: Synthetic oligonucleotide
tattcatggagtctgtcttaccctgacaaagtttattgaagg

SEQ ID NO: 267737 - DNA, 41 bp, Artificial Sequence
  Description of Artificial Sequence: Synthetic oligonucleotide
attcatggagtctgtcttaccctgacaaagtttattgaagg

SEQ ID NO: 267738 - DNA, 40 bp, Artificial Sequence
  Description of Artificial Sequence: Synthetic oligonucleotide
ttcatggagtctgtcttaccctgacaaagtttattgaagg

SEQ ID NO: 267739 - DNA, 39 bp, Artificial Sequence
  Description of Artificial Sequence: Synthetic oligonucleotide
tcatggagtctgtcttaccctgacaaagtttattgaagg

SEQ ID NO: 267740 - DNA, 38 bp, Artificial Sequence
  Description of Artificial Sequence: Synthetic oligonucleotide
catggagtctgtcttaccctgacaaagtttattgaagg

SEQ ID NO: 267741 - DNA, 40 bp, Artificial Sequence
  Description of Artificial Sequence: Synthetic oligonucleotide
atggagtctgtcttaccctgacaaagtttattgaaggaag

SEQ ID NO: 267742 - DNA, 39 bp, Artificial Sequence
  Description of Artificial Sequence: Synthetic oligonucleotide
tggagtctgtcttaccctgacaaagtttattgaaggaag

SEQ ID NO: 267743 - DNA, 38 bp, Artificial Sequence
  Description of Artificial Sequence: Synthetic oligonucleotide
ggagtctgtcttaccctgacaaagtttattgaaggaag

SEQ ID NO: 267744 - DNA, 39 bp, Artificial Sequence
  Description of Artificial Sequence: Synthetic oligonucleotide
gagtctgtcttaccctgacaaagtttattgaaggaagac

SEQ ID NO: 267745 - DNA, 43 bp, Artificial Sequence
  Description of Artificial Sequence: Synthetic oligonucleotide
agtctgtcttaccctgacaaagtttattgaaggaagactaaac

SEQ ID NO: 267746 - DNA, 42 bp, Artificial Sequence
  Description of Artificial Sequence: Synthetic oligonucleotide
gtctgtcttaccctgacaaagtttattgaaggaagactaaac

SEQ ID NO: 267747 - DNA, 44 bp, Artificial Sequence
  Description of Artificial Sequence: Synthetic oligonucleotide
tctgtcttaccctgacaaagtttattgaaggaagactaaacatg

SEQ ID NO: 267748 - DNA, 43 bp, Artificial Sequence
  Description of Artificial Sequence: Synthetic oligonucleotide
ctgtcttaccctgacaaagtttattgaaggaagactaaacatg

SEQ ID NO: 267749 - DNA, 48 bp, Artificial Sequence
  Description of Artificial Sequence: Synthetic oligonucleotide
tgtcttaccctgacaaagtttattgaaggaagactaaacatgtataag

SEQ ID NO: 267750 - DNA, 47 bp, Artificial Sequence
  Description of Artificial Sequence: Synthetic oligonucleotide
gtcttaccctgacaaagtttattgaaggaagactaaacatgtataag

SEQ ID NO: 267751 - DNA, 47 bp, Artificial Sequence
  Description of Artificial Sequence: Synthetic oligonucleotide
tcttaccctgacaaagtttattgaaggaagactaaacatgtataagg

SEQ ID NO: 267752 - DNA, 46 bp, Artificial Sequence
  Description of Artificial Sequence: Synthetic oligonucleotide
cttaccctgacaaagtttattgaaggaagactaaacatgtataagg

SEQ ID NO: 267753 - DNA, 49 bp, Artificial Sequence
  Description of Artificial Sequence: Synthetic oligonucleotide
ttaccctgacaaagtttattgaaggaagactaaacatgtataaggattc

SEQ ID NO: 267754 - DNA, 48 bp, Artificial Sequence
  Description of Artificial Sequence: Synthetic oligonucleotide
taccctgacaaagtttattgaaggaagactaaacatgtataaggattc

SEQ ID NO: 267755 - DNA, 47 bp, Artificial Sequence
  Description of Artificial Sequence: Synthetic oligonucleotide
accctgacaaagtttattgaaggaagactaaacatgtataaggattc

SEQ ID NO: 267756 - DNA, 46 bp, Artificial Sequence
  Description of Artificial Sequence: Synthetic oligonucleotide
ccctgacaaagtttattgaaggaagactaaacatgtataaggattc

SEQ ID NO: 267757 - DNA, 46 bp, Artificial Sequence
  Description of Artificial Sequence: Synthetic oligonucleotide
cctgacaaagtttattgaaggaagactaaacatgtataaggattcc

SEQ ID NO: 267758 - DNA, 54 bp, Artificial Sequence
  Description of Artificial Sequence: Synthetic oligonucleotide
ctgacaaagtttattgaaggaagactaaacatgtataaggattccaatattaag

SEQ ID NO: 267759 - DNA, 54 bp, Artificial Sequence
  Description of Artificial Sequence: Synthetic oligonucleotide
tgacaaagtttattgaaggaagactaaacatgtataaggattccaatattaagg

SEQ ID NO: 267760 - DNA, 53 bp, Artificial Sequence
  Description of Artificial Sequence: Synthetic oligonucleotide
gacaaagtttattgaaggaagactaaacatgtataaggattccaatattaagg

SEQ ID NO: 267761 - DNA, 53 bp, Artificial Sequence
  Description of Artificial Sequence: Synthetic oligonucleotide
acaaagtttattgaaggaagactaaacatgtataaggattccaatattaaggc

SEQ ID NO: 267762 - DNA, 52 bp, Artificial Sequence
  Description of Artificial Sequence: Synthetic oligonucleotide
caaagtttattgaaggaagactaaacatgtataaggattccaatattaaggc

SEQ ID NO: 267763 - DNA, 52 bp, Artificial Sequence
  Description of Artificial Sequence: Synthetic oligonucleotide
aaagtttattgaaggaagactaaacatgtataaggattccaatattaaggcc

SEQ ID NO: 267764 - DNA, 51 bp, Artificial Sequence
  Description of Artificial Sequence: Synthetic oligonucleotide
aagtttattgaaggaagactaaacatgtataaggattccaatattaaggcc

SEQ ID NO: 267765 - DNA, 50 bp, Artificial Sequence
  Description of Artificial Sequence: Synthetic oligonucleotide
agtttattgaaggaagactaaacatgtataaggattccaatattaaggcc

SEQ ID NO: 267766 - DNA, 49 bp, Artificial Sequence
  Description of Artificial Sequence: Synthetic oligonucleotide
gtttattgaaggaagactaaacatgtataaggattccaatattaaggcc

SEQ ID NO: 267767 - DNA, 51 bp, Artificial Sequence
  Description of Artificial Sequence: Synthetic oligonucleotide
tttattgaaggaagactaaacatgtataaggattccaatattaaggccatc

SEQ ID NO: 267768 - DNA, 50 bp, Artificial Sequence
  Description of Artificial Sequence: Synthetic oligonucleotide
ttattgaaggaagactaaacatgtataaggattccaatattaaggccatc

SEQ ID NO: 267769 - DNA, 49 bp, Artificial Sequence
  Description of Artificial Sequence: Synthetic oligonucleotide
tattgaaggaagactaaacatgtataaggattccaatattaaggccatc

SEQ ID NO: 267770 - DNA, 48 bp, Artificial Sequence
  Description of Artificial Sequence: Synthetic oligonucleotide
attgaaggaagactaaacatgtataaggattccaatattaaggccatc

SEQ ID NO: 267771 - DNA, 47 bp, Artificial Sequence
  Description of Artificial Sequence: Synthetic oligonucleotide
ttgaaggaagactaaacatgtataaggattccaatattaaggccatc

SEQ ID NO: 267772 - DNA, 46 bp, Artificial Sequence
  Description of Artificial Sequence: Synthetic oligonucleotide
tgaaggaagactaaacatgtataaggattccaatattaaggccatc

SEQ ID NO: 267773 - DNA, 45 bp, Artificial Sequence
  Description of Artificial Sequence: Synthetic oligonucleotide
gaaggaagactaaacatgtataaggattccaatattaaggccatc

SEQ ID NO: 267774 - DNA, 46 bp, Artificial Sequence
  Description of Artificial Sequence: Synthetic oligonucleotide
aaggaagactaaacatgtataaggattccaatattaaggccatcac

SEQ ID NO: 267775 - DNA, 45 bp, Artificial Sequence
  Description of Artificial Sequence: Synthetic oligonucleotide
aggaagactaaacatgtataaggattccaatattaaggccatcac

SEQ ID NO: 267776 - DNA, 44 bp, Artificial Sequence
  Description of Artificial Sequence: Synthetic oligonucleotide
ggaagactaaacatgtataaggattccaatattaaggccatcac

SEQ ID NO: 267777 - DNA, 46 bp, Artificial Sequence
  Description of Artificial Sequence: Synthetic oligonucleotide
gaagactaaacatgtataaggattccaatattaaggccatcactac

SEQ ID NO: 267778 - DNA, 46 bp, Artificial Sequence
  Description of Artificial Sequence: Synthetic oligonucleotide
aagactaaacatgtataaggattccaatattaaggccatcactacg

SEQ ID NO: 267779 - DNA, 45 bp, Artificial Sequence
  Description of Artificial Sequence: Synthetic oligonucleotide
agactaaacatgtataaggattccaatattaaggccatcactacg

SEQ ID NO: 267780 - DNA, 44 bp, Artificial Sequence
  Description of Artificial Sequence: Synthetic oligonucleotide
gactaaacatgtataaggattccaatattaaggccatcactacg

SEQ ID NO: 267781 - DNA, 44 bp, Artificial Sequence
  Description of Artificial Sequence: Synthetic oligonucleotide
actaaacatgtataaggattccaatattaaggccatcactacgg

SEQ ID NO: 267782 - DNA, 43 bp, Artificial Sequence
  Description of Artificial Sequence: Synthetic oligonucleotide
ctaaacatgtataaggattccaatattaaggccatcactacgg

SEQ ID NO: 267783 - DNA, 43 bp, Artificial Sequence
  Description of Artificial Sequence: Synthetic oligonucleotide
taaacatgtataaggattccaatattaaggccatcactacggg

SEQ ID NO: 267784 - DNA, 42 bp, Artificial Sequence
  Description of Artificial Sequence: Synthetic oligonucleotide
aaacatgtataaggattccaatattaaggccatcactacggg

SEQ ID NO: 267785 - DNA, 41 bp, Artificial Sequence
  Description of Artificial Sequence: Synthetic oligonucleotide
aacatgtataaggattccaatattaaggccatcactacggg

SEQ ID NO: 267786 - DNA, 40 bp, Artificial Sequence
  Description of Artificial Sequence: Synthetic oligonucleotide
acatgtataaggattccaatattaaggccatcactacggg

SEQ ID NO: 267787 - DNA, 39 bp, Artificial Sequence
  Description of Artificial Sequence: Synthetic oligonucleotide
catgtataaggattccaatattaaggccatcactacggg

SEQ ID NO: 267788 - DNA, 39 bp, Artificial Sequence
  Description of Artificial Sequence: Synthetic oligonucleotide
atgtataaggattccaatattaaggccatcactacgggg

SEQ ID NO: 267789 - DNA, 38 bp, Artificial Sequence
  Description of Artificial Sequence: Synthetic oligonucleotide
tgtataaggattccaatattaaggccatcactacgggg

SEQ ID NO: 267790 - DNA, 37 bp, Artificial Sequence
  Description of Artificial Sequence: Synthetic oligonucleotide
gtataaggattccaatattaaggccatcactacgggg

SEQ ID NO: 267791 - DNA, 37 bp, Artificial Sequence
  Description of Artificial Sequence: Synthetic oligonucleotide
tataaggattccaatattaaggccatcactacggggc

SEQ ID NO: 267792 - DNA, 36 bp, Artificial Sequence
  Description of Artificial Sequence: Synthetic oligonucleotide
ataaggattccaatattaaggccatcactacggggc

SEQ ID NO: 267793 - DNA, 35 bp, Artificial Sequence
  Description of Artificial Sequence: Synthetic oligonucleotide
taaggattccaatattaaggccatcactacggggc

SEQ ID NO: 267794 - DNA, 34 bp, Artificial Sequence
  Description of Artificial Sequence: Synthetic oligonucleotide
aaggattccaatattaaggccatcactacggggc

SEQ ID NO: 267795 - DNA, 33 bp, Artificial Sequence
  Description of Artificial Sequence: Synthetic oligonucleotide
aggattccaatattaaggccatcactacggggc

SEQ ID NO: 267796 - DNA, 32 bp, Artificial Sequence
  Description of Artificial Sequence: Synthetic oligonucleotide
ggattccaatattaaggccatcactacggggc

SEQ ID NO: 267797 - DNA, 32 bp, Artificial Sequence
  Description of Artificial Sequence: Synthetic oligonucleotide
gattccaatattaaggccatcactacggggcc

SEQ ID NO: 267798 - DNA, 36 bp, Artificial Sequence
  Description of Artificial Sequence: Synthetic oligonucleotide
attccaatattaaggccatcactacggggccaattg

SEQ ID NO: 267799 - DNA, 35 bp, Artificial Sequence
  Description of Artificial Sequence: Synthetic oligonucleotide
ttccaatattaaggccatcactacggggccaattg

SEQ ID NO: 267800 - DNA, 34 bp, Artificial Sequence
  Description of Artificial Sequence: Synthetic oligonucleotide
tccaatattaaggccatcactacggggccaattg

SEQ ID NO: 267801 - DNA, 33 bp, Artificial Sequence
  Description of Artificial Sequence: Synthetic oligonucleotide
ccaatattaaggccatcactacggggccaattg

SEQ ID NO: 267802 - DNA, 33 bp, Artificial Sequence
  Description of Artificial Sequence: Synthetic oligonucleotide
caatattaaggccatcactacggggccaattgc

SEQ ID NO: 267803 - DNA, 34 bp, Artificial Sequence
  Description of Artificial Sequence: Synthetic oligonucleotide
aatattaaggccatcactacggggccaattgctg

SEQ ID NO: 267804 - DNA, 33 bp, Artificial Sequence
  Description of Artificial Sequence: Synthetic oligonucleotide
atattaaggccatcactacggggccaattgctg

SEQ ID NO: 267805 - DNA, 32 bp, Artificial Sequence
  Description of Artificial Sequence: Synthetic oligonucleotide
tattaaggccatcactacggggccaattgctg

SEQ ID NO: 267806 - DNA, 31 bp, Artificial Sequence
  Description of Artificial Sequence: Synthetic oligonucleotide
attaaggccatcactacggggccaattgctg

SEQ ID NO: 267807 - DNA, 30 bp, Artificial Sequence
  Description of Artificial Sequence: Synthetic oligonucleotide
ttaaggccatcactacggggccaattgctg

SEQ ID NO: 267808 - DNA, 29 bp, Artificial Sequence
  Description of Artificial Sequence: Synthetic oligonucleotide
taaggccatcactacggggccaattgctg

SEQ ID NO: 267809 - DNA, 28 bp, Artificial Sequence
  Description of Artificial Sequence: Synthetic oligonucleotide
aaggccatcactacggggccaattgctg

SEQ ID NO: 267810 - DNA, 27 bp, Artificial Sequence
  Description of Artificial Sequence: Synthetic oligonucleotide
aggccatcactacggggccaattgctg

SEQ ID NO: 267811 - DNA, 26 bp, Artificial Sequence
  Description of Artificial Sequence: Synthetic oligonucleotide
ggccatcactacggggccaattgctg

SEQ ID NO: 267812 - DNA, 27 bp, Artificial Sequence
  Description of Artificial Sequence: Synthetic oligonucleotide
gccatcactacggggccaattgctgga

SEQ ID NO: 267813 - DNA, 29 bp, Artificial Sequence
  Description of Artificial Sequence: Synthetic oligonucleotide
ccatcactacggggccaattgctggaatg

SEQ ID NO: 267814 - DNA, 29 bp, Artificial Sequence
  Description of Artificial Sequence: Synthetic oligonucleotide
catcactacggggccaattgctggaatgc

SEQ ID NO: 267815 - DNA, 30 bp, Artificial Sequence
  Description of Artificial Sequence: Synthetic oligonucleotide
atcactacggggccaattgctggaatgctg

SEQ ID NO: 267816 - DNA, 29 bp, Artificial Sequence
  Description of Artificial Sequence: Synthetic oligonucleotide
tcactacggggccaattgctggaatgctg

SEQ ID NO: 267817 - DNA, 28 bp, Artificial Sequence
  Description of Artificial Sequence: Synthetic oligonucleotide
cactacggggccaattgctggaatgctg

SEQ ID NO: 267818 - DNA, 29 bp, Artificial Sequence
  Description of Artificial Sequence: Synthetic oligonucleotide
actacggggccaattgctggaatgctgtc

SEQ ID NO: 267819 - DNA, 28 bp, Artificial Sequence
  Description of Artificial Sequence: Synthetic oligonucleotide
ctacggggccaattgctggaatgctgtc

SEQ ID NO: 267820 - DNA, 30 bp, Artificial Sequence
  Description of Artificial Sequence: Synthetic oligonucleotide
tacggggccaattgctggaatgctgtcaac

SEQ ID NO: 267821 - DNA, 29 bp, Artificial Sequence
  Description of Artificial Sequence: Synthetic oligonucleotide
acggggccaattgctggaatgctgtcaac

SEQ ID NO: 267822 - DNA, 28 bp, Artificial Sequence
  Description of Artificial Sequence: Synthetic oligonucleotide
cggggccaattgctggaatgctgtcaac

SEQ ID NO: 267823 - DNA, 31 bp, Artificial Sequence
  Description of Artificial Sequence: Synthetic oligonucleotide
ggggccaattgctggaatgctgtcaacaatc

SEQ ID NO: 267824 - DNA, 31 bp, Artificial Sequence
  Description of Artificial Sequence: Synthetic oligonucleotide
gggccaattgctggaatgctgtcaacaatcc

SEQ ID NO: 267825 - DNA, 32 bp, Artificial Sequence
  Description of Artificial Sequence: Synthetic oligonucleotide
ggccaattgctggaatgctgtcaacaatcctg

SEQ ID NO: 267826 - DNA, 36 bp, Artificial Sequence
  Description of Artificial Sequence: Synthetic oligonucleotide
gccaattgctggaatgctgtcaacaatcctgaattc

SEQ ID NO: 267827 - DNA, 38 bp, Artificial Sequence
  Description of Artificial Sequence: Synthetic oligonucleotide
ccaattgctggaatgctgtcaacaatcctgaattcaag

SEQ ID NO: 267828 - DNA, 38 bp, Artificial Sequence
  Description of Artificial Sequence: Synthetic oligonucleotide
caattgctggaatgctgtcaacaatcctgaattcaagg

SEQ ID NO: 267829 - DNA, 38 bp, Artificial Sequence
  Description of Artificial Sequence: Synthetic oligonucleotide
aattgctggaatgctgtcaacaatcctgaattcaaggc

SEQ ID NO: 267830 - DNA, 37 bp, Artificial Sequence
  Description of Artificial Sequence: Synthetic oligonucleotide
attgctggaatgctgtcaacaatcctgaattcaaggc

SEQ ID NO: 267831 - DNA, 36 bp, Artificial Sequence
  Description of Artificial Sequence: Synthetic oligonucleotide
ttgctggaatgctgtcaacaatcctgaattcaaggc

SEQ ID NO: 267832 - DNA, 35 bp, Artificial Sequence
  Description of Artificial Sequence: Synthetic oligonucleotide
tgctggaatgctgtcaacaatcctgaattcaaggc

SEQ ID NO: 267833 - DNA, 34 bp, Artificial Sequence
  Description of Artificial Sequence: Synthetic oligonucleotide
gctggaatgctgtcaacaatcctgaattcaaggc

SEQ ID NO: 267834 - DNA, 34 bp, Artificial Sequence
  Description of Artificial Sequence: Synthetic oligonucleotide
ctggaatgctgtcaacaatcctgaattcaaggcc

SEQ ID NO: 267835 - DNA, 34 bp, Artificial Sequence
  Description of Artificial Sequence: Synthetic oligonucleotide
tggaatgctgtcaacaatcctgaattcaaggccc

SEQ ID NO: 267836 - DNA, 33 bp, Artificial Sequence
  Description of Artificial Sequence: Synthetic oligonucleotide
ggaatgctgtcaacaatcctgaattcaaggccc

SEQ ID NO: 267837 - DNA, 35 bp, Artificial Sequence
  Description of Artificial Sequence: Synthetic oligonucleotide
gaatgctgtcaacaatcctgaattcaaggcccttc

SEQ ID NO: 267838 - DNA, 38 bp, Artificial Sequence
  Description of Artificial Sequence: Synthetic oligonucleotide
aatgctgtcaacaatcctgaattcaaggcccttctttc

SEQ ID NO: 267839 - DNA, 37 bp, Artificial Sequence
  Description of Artificial Sequence: Synthetic oligonucleotide
atgctgtcaacaatcctgaattcaaggcccttctttc

SEQ ID NO: 267840 - DNA, 36 bp, Artificial Sequence
  Description of Artificial Sequence: Synthetic oligonucleotide
tgctgtcaacaatcctgaattcaaggcccttctttc

SEQ ID NO: 267841 - DNA, 35 bp, Artificial Sequence
  Description of Artificial Sequence: Synthetic oligonucleotide
gctgtcaacaatcctgaattcaaggcccttctttc

SEQ ID NO: 267842 - DNA, 35 bp, Artificial Sequence
  Description of Artificial Sequence: Synthetic oligonucleotide
ctgtcaacaatcctgaattcaaggcccttctttcc

SEQ ID NO: 267843 - DNA, 38 bp, Artificial Sequence
  Description of Artificial Sequence: Synthetic oligonucleotide
tgtcaacaatcctgaattcaaggcccttctttccttac

SEQ ID NO: 267844 - DNA, 37 bp, Artificial Sequence
  Description of Artificial Sequence: Synthetic oligonucleotide
gtcaacaatcctgaattcaaggcccttctttccttac

SEQ ID NO: 267845 - DNA, 40 bp, Artificial Sequence
  Description of Artificial Sequence: Synthetic oligonucleotide
tcaacaatcctgaattcaaggcccttctttccttactatg

SEQ ID NO: 267846 - DNA, 39 bp, Artificial Sequence
  Description of Artificial Sequence: Synthetic oligonucleotide
caacaatcctgaattcaaggcccttctttccttactatg

SEQ ID NO: 267847 - DNA, 43 bp, Artificial Sequence
  Description of Artificial Sequence: Synthetic oligonucleotide
aacaatcctgaattcaaggcccttctttccttactatgttaac

SEQ ID NO: 267848 - DNA, 42 bp, Artificial Sequence
  Description of Artificial Sequence: Synthetic oligonucleotide
acaatcctgaattcaaggcccttctttccttactatgttaac

SEQ ID NO: 267849 - DNA, 41 bp, Artificial Sequence
  Description of Artificial Sequence: Synthetic oligonucleotide
caatcctgaattcaaggcccttctttccttactatgttaac

SEQ ID NO: 267850 - DNA, 43 bp, Artificial Sequence
  Description of Artificial Sequence: Synthetic oligonucleotide
aatcctgaattcaaggcccttctttccttactatgttaacaac

SEQ ID NO: 267851 - DNA, 42 bp, Artificial Sequence
  Description of Artificial Sequence: Synthetic oligonucleotide
atcctgaattcaaggcccttctttccttactatgttaacaac

SEQ ID NO: 267852 - DNA, 41 bp, Artificial Sequence
  Description of Artificial Sequence: Synthetic oligonucleotide
tcctgaattcaaggcccttctttccttactatgttaacaac

SEQ ID NO: 267853 - DNA, 40 bp, Artificial Sequence
  Description of Artificial Sequence: Synthetic oligonucleotide
cctgaattcaaggcccttctttccttactatgttaacaac

SEQ ID NO: 267854 - DNA, 42 bp, Artificial Sequence
  Description of Artificial Sequence: Synthetic oligonucleotide
ctgaattcaaggcccttctttccttactatgttaacaacatc

SEQ ID NO: 267855 - DNA, 44 bp, Artificial Sequence
  Description of Artificial Sequence: Synthetic oligonucleotide
tgaattcaaggcccttctttccttactatgttaacaacatcaac

SEQ ID NO: 267856 - DNA, 43 bp, Artificial Sequence
  Description of Artificial Sequence: Synthetic oligonucleotide
gaattcaaggcccttctttccttactatgttaacaacatcaac

SEQ ID NO: 267857 - DNA, 43 bp, Artificial Sequence
  Description of Artificial Sequence: Synthetic oligonucleotide
aattcaaggcccttctttccttactatgttaacaacatcaacg

SEQ ID NO: 267858 - DNA, 42 bp, Artificial Sequence
  Description of Artificial Sequence: Synthetic oligonucleotide
attcaaggcccttctttccttactatgttaacaacatcaacg

SEQ ID NO: 267859 - DNA, 41 bp, Artificial Sequence
  Description of Artificial Sequence: Synthetic oligonucleotide
ttcaaggcccttctttccttactatgttaacaacatcaacg

SEQ ID NO: 267860 - DNA, 40 bp, Artificial Sequence
  Description of Artificial Sequence: Synthetic oligonucleotide
tcaaggcccttctttccttactatgttaacaacatcaacg

SEQ ID NO: 267861 - DNA, 39 bp, Artificial Sequence
  Description of Artificial Sequence: Synthetic oligonucleotide
caaggcccttctttccttactatgttaacaacatcaacg

SEQ ID NO: 267862 - DNA, 39 bp, Artificial Sequence
  Description of Artificial Sequence: Synthetic oligonucleotide
aaggcccttctttccttactatgttaacaacatcaacgg

SEQ ID NO: 267863 - DNA, 38 bp, Artificial Sequence
  Description of Artificial Sequence: Synthetic oligonucleotide
aggcccttctttccttactatgttaacaacatcaacgg

SEQ ID NO: 267864 - DNA, 37 bp, Artificial Sequence
  Description of Artificial Sequence: Synthetic oligonucleotide
ggcccttctttccttactatgttaacaacatcaacgg

SEQ ID NO: 267865 - DNA, 38 bp, Artificial Sequence
  Description of Artificial Sequence: Synthetic oligonucleotide
gcccttctttccttactatgttaacaacatcaacggtg

SEQ ID NO: 267866 - DNA, 38 bp, Artificial Sequence
  Description of Artificial Sequence: Synthetic oligonucleotide
cccttctttccttactatgttaacaacatcaacggtgg

SEQ ID NO: 267867 - DNA, 39 bp, Artificial Sequence
  Description of Artificial Sequence: Synthetic oligonucleotide
ccttctttccttactatgttaacaacatcaacggtggac

SEQ ID NO: 267868 - DNA, 41 bp, Artificial Sequence
  Description of Artificial Sequence: Synthetic oligonucleotide
cttctttccttactatgttaacaacatcaacggtggactag

SEQ ID NO: 267869 - DNA, 43 bp, Artificial Sequence
  Description of Artificial Sequence: Synthetic oligonucleotide
ttctttccttactatgttaacaacatcaacggtggactagatg

SEQ ID NO: 267870 - DNA, 42 bp, Artificial Sequence
  Description of Artificial Sequence: Synthetic oligonucleotide
tctttccttactatgttaacaacatcaacggtggactagatg

SEQ ID NO: 267871 - DNA, 41 bp, Artificial Sequence
  Description of Artificial Sequence: Synthetic oligonucleotide
ctttccttactatgttaacaacatcaacggtggactagatg

SEQ ID NO: 267872 - DNA, 43 bp, Artificial Sequence
  Description of Artificial Sequence: Synthetic oligonucleotide
tttccttactatgttaacaacatcaacggtggactagatgaag

SEQ ID NO: 267873 - DNA, 42 bp, Artificial Sequence
  Description of Artificial Sequence: Synthetic oligonucleotide
ttccttactatgttaacaacatcaacggtggactagatgaag

SEQ ID NO: 267874 - DNA, 41 bp, Artificial Sequence
  Description of Artificial Sequence: Synthetic oligonucleotide
tccttactatgttaacaacatcaacggtggactagatgaag

SEQ ID NO: 267875 - DNA, 40 bp, Artificial Sequence
  Description of Artificial Sequence: Synthetic oligonucleotide
ccttactatgttaacaacatcaacggtggactagatgaag

SEQ ID NO: 267876 - DNA, 42 bp, Artificial Sequence
  Description of Artificial Sequence: Synthetic oligonucleotide
cttactatgttaacaacatcaacggtggactagatgaagaac

SEQ ID NO: 267877 - DNA, 42 bp, Artificial Sequence
  Description of Artificial Sequence: Synthetic oligonucleotide
ttactatgttaacaacatcaacggtggactagatgaagaacg

SEQ ID NO: 267878 - DNA, 41 bp, Artificial Sequence
  Description of Artificial Sequence: Synthetic oligonucleotide
tactatgttaacaacatcaacggtggactagatgaagaacg

SEQ ID NO: 267879 - DNA, 40 bp, Artificial Sequence
  Description of Artificial Sequence: Synthetic oligonucleotide
actatgttaacaacatcaacggtggactagatgaagaacg

SEQ ID NO: 267880 - DNA, 39 bp, Artificial Sequence
  Description of Artificial Sequence: Synthetic oligonucleotide
ctatgttaacaacatcaacggtggactagatgaagaacg

SEQ ID NO: 267881 - DNA, 42 bp, Artificial Sequence
  Description of Artificial Sequence: Synthetic oligonucleotide
tatgttaacaacatcaacggtggactagatgaagaacgaaag

SEQ ID NO: 267882 - DNA, 41 bp, Artificial Sequence
  Description of Artificial Sequence: Synthetic oligonucleotide
atgttaacaacatcaacggtggactagatgaagaacgaaag

SEQ ID NO: 267883 - DNA, 40 bp, Artificial Sequence
  Description of Artificial Sequence: Synthetic oligonucleotide
tgttaacaacatcaacggtggactagatgaagaacgaaag

SEQ ID NO: 267884 - DNA, 39 bp, Artificial Sequence
  Description of Artificial Sequence: Synthetic oligonucleotide
gttaacaacatcaacggtggactagatgaagaacgaaag

SEQ ID NO: 267885 - DNA, 39 bp, Artificial Sequence
  Description of Artificial Sequence: Synthetic oligonucleotide
ttaacaacatcaacggtggactagatgaagaacgaaagg

SEQ ID NO: 267886 - DNA, 38 bp, Artificial Sequence
  Description of Artificial Sequence: Synthetic oligonucleotide
taacaacatcaacggtggactagatgaagaacgaaagg

SEQ ID NO: 267887 - DNA, 37 bp, Artificial Sequence
  Description of Artificial Sequence: Synthetic oligonucleotide
aacaacatcaacggtggactagatgaagaacgaaagg

SEQ ID NO: 267888 - DNA, 36 bp, Artificial Sequence
  Description of Artificial Sequence: Synthetic oligonucleotide
acaacatcaacggtggactagatgaagaacgaaagg

SEQ ID NO: 267889 - DNA, 35 bp, Artificial Sequence
  Description of Artificial Sequence: Synthetic oligonucleotide
caacatcaacggtggactagatgaagaacgaaagg

SEQ ID NO: 267890 - DNA, 35 bp, Artificial Sequence
  Description of Artificial Sequence: Synthetic oligonucleotide
aacatcaacggtggactagatgaagaacgaaaggg

SEQ ID NO: 267891 - DNA, 34 bp, Artificial Sequence
  Description of Artificial Sequence: Synthetic oligonucleotide
acatcaacggtggactagatgaagaacgaaaggg

SEQ ID NO: 267892 - DNA, 33 bp, Artificial Sequence
  Description of Artificial Sequence: Synthetic oligonucleotide
catcaacggtggactagatgaagaacgaaaggg

SEQ ID NO: 267893 - DNA, 33 bp, Artificial Sequence
  Description of Artificial Sequence: Synthetic oligonucleotide
atcaacggtggactagatgaagaacgaaagggg

SEQ ID NO: 267894 - DNA, 32 bp, Artificial Sequence
  Description of Artificial Sequence: Synthetic oligonucleotide
tcaacggtggactagatgaagaacgaaagggg

SEQ ID NO: 267895 - DNA, 31 bp, Artificial Sequence
  Description of Artificial Sequence: Synthetic oligonucleotide
caacggtggactagatgaagaacgaaagggg

SEQ ID NO: 267896 - DNA, 31 bp, Artificial Sequence
  Description of Artificial Sequence: Synthetic oligonucleotide
aacggtggactagatgaagaacgaaaggggg

SEQ ID NO: 267897 - DNA, 30 bp, Artificial Sequence
  Description of Artificial Sequence: Synthetic oligonucleotide
acggtggactagatgaagaacgaaaggggg

SEQ ID NO: 267898 - DNA, 29 bp, Artificial Sequence
  Description of Artificial Sequence: Synthetic oligonucleotide
cggtggactagatgaagaacgaaaggggg

SEQ ID NO: 267899 - DNA, 29 bp, Artificial Sequence
  Description of Artificial Sequence: Synthetic oligonucleotide
ggtggactagatgaagaacgaaagggggg

SEQ ID NO: 267900 - DNA, 30 bp, Artificial Sequence
  Description of Artificial Sequence: Synthetic oligonucleotide
gtggactagatgaagaacgaaaggggggtg

SEQ ID NO: 267901 - DNA, 34 bp, Artificial Sequence
  Description of Artificial Sequence: Synthetic oligonucleotide
tggactagatgaagaacgaaaggggggtgtatac

SEQ ID NO: 267902 - DNA, 33 bp, Artificial Sequence
  Description of Artificial Sequence: Synthetic oligonucleotide
ggactagatgaagaacgaaaggggggtgtatac

SEQ ID NO: 267903 - DNA, 34 bp, Artificial Sequence
  Description of Artificial Sequence: Synthetic oligonucleotide
gactagatgaagaacgaaaggggggtgtatacag

SEQ ID NO: 267904 - DNA, 34 bp, Artificial Sequence
  Description of Artificial Sequence: Synthetic oligonucleotide
actagatgaagaacgaaaggggggtgtatacagg

SEQ ID NO: 267905 - DNA, 33 bp, Artificial Sequence
  Description of Artificial Sequence: Synthetic oligonucleotide
ctagatgaagaacgaaaggggggtgtatacagg

SEQ ID NO: 267906 - DNA, 36 bp, Artificial Sequence
  Description of Artificial Sequence: Synthetic oligonucleotide
tagatgaagaacgaaaggggggtgtatacaggtttg

SEQ ID NO: 267907 - DNA, 35 bp, Artificial Sequence
  Description of Artificial Sequence: Synthetic oligonucleotide
agatgaagaacgaaaggggggtgtatacaggtttg

SEQ ID NO: 267908 - DNA, 34 bp, Artificial Sequence
  Description of Artificial Sequence: Synthetic oligonucleotide
gatgaagaacgaaaggggggtgtatacaggtttg

SEQ ID NO: 267909 - DNA, 36 bp, Artificial Sequence
  Description of Artificial Sequence: Synthetic oligonucleotide
atgaagaacgaaaggggggtgtatacaggtttgatc

SEQ ID NO: 267910 - DNA, 35 bp, Artificial Sequence
  Description of Artificial Sequence: Synthetic oligonucleotide
tgaagaacgaaaggggggtgtatacaggtttgatc

SEQ ID NO: 267911 - DNA, 34 bp, Artificial Sequence
  Description of Artificial Sequence: Synthetic oligonucleotide
gaagaacgaaaggggggtgtatacaggtttgatc

SEQ ID NO: 267912 - DNA, 34 bp, Artificial Sequence
  Description of Artificial Sequence: Synthetic oligonucleotide
aagaacgaaaggggggtgtatacaggtttgatcc

SEQ ID NO: 267913 - DNA, 33 bp, Artificial Sequence
  Description of Artificial Sequence: Synthetic oligonucleotide
agaacgaaaggggggtgtatacaggtttgatcc

SEQ ID NO: 267914 - DNA, 32 bp, Artificial Sequence
  Description of Artificial Sequence: Synthetic oligonucleotide
gaacgaaaggggggtgtatacaggtttgatcc

SEQ ID NO: 267915 - DNA, 33 bp, Artificial Sequence
  Description of Artificial Sequence: Synthetic oligonucleotide
aacgaaaggggggtgtatacaggtttgatccac

SEQ ID NO: 267916 - DNA, 32 bp, Artificial Sequence
  Description of Artificial Sequence: Synthetic oligonucleotide
acgaaaggggggtgtatacaggtttgatccac

SEQ ID NO: 267917 - DNA, 31 bp, Artificial Sequence
  Description of Artificial Sequence: Synthetic oligonucleotide
cgaaaggggggtgtatacaggtttgatccac

SEQ ID NO: 267918 - DNA, 33 bp, Artificial Sequence
  Description of Artificial Sequence: Synthetic oligonucleotide
gaaaggggggtgtatacaggtttgatccactag

SEQ ID NO: 267919 - DNA, 33 bp, Artificial Sequence
  Description of Artificial Sequence: Synthetic oligonucleotide
aaaggggggtgtatacaggtttgatccactagg

SEQ ID NO: 267920 - DNA, 32 bp, Artificial Sequence
  Description of Artificial Sequence: Synthetic oligonucleotide
aaggggggtgtatacaggtttgatccactagg

SEQ ID NO: 267921 - DNA, 31 bp, Artificial Sequence
  Description of Artificial Sequence: Synthetic oligonucleotide
aggggggtgtatacaggtttgatccactagg

SEQ ID NO: 267922 - DNA, 30 bp, Artificial Sequence
  Description of Artificial Sequence: Synthetic oligonucleotide
ggggggtgtatacaggtttgatccactagg

SEQ ID NO: 267923 - DNA, 30 bp, Artificial Sequence
  Description of Artificial Sequence: Synthetic oligonucleotide
gggggtgtatacaggtttgatccactaggg

SEQ ID NO: 267924 - DNA, 31 bp, Artificial Sequence
  Description of Artificial Sequence: Synthetic oligonucleotide
ggggtgtatacaggtttgatccactagggtc

SEQ ID NO: 267925 - DNA, 34 bp, Artificial Sequence
  Description of Artificial Sequence: Synthetic oligonucleotide
gggtgtatacaggtttgatccactagggtctttc

SEQ ID NO: 267926 - DNA, 34 bp, Artificial Sequence
  Description of Artificial Sequence: Synthetic oligonucleotide
ggtgtatacaggtttgatccactagggtctttcc

SEQ ID NO: 267927 - DNA, 35 bp, Artificial Sequence
  Description of Artificial Sequence: Synthetic oligonucleotide
gtgtatacaggtttgatccactagggtctttccag

SEQ ID NO: 267928 - DNA, 36 bp, Artificial Sequence
  Description of Artificial Sequence: Synthetic oligonucleotide
tgtatacaggtttgatccactagggtctttccagag

SEQ ID NO: 267929 - DNA, 35 bp, Artificial Sequence
  Description of Artificial Sequence: Synthetic oligonucleotide
gtatacaggtttgatccactagggtctttccagag

SEQ ID NO: 267930 - DNA, 36 bp, Artificial Sequence
  Description of Artificial Sequence: Synthetic oligonucleotide
tatacaggtttgatccactagggtctttccagagag

SEQ ID NO: 267931 - DNA, 35 bp, Artificial Sequence
  Description of Artificial Sequence: Synthetic oligonucleotide
atacaggtttgatccactagggtctttccagagag

SEQ ID NO: 267932 - DNA, 34 bp, Artificial Sequence
  Description of Artificial Sequence: Synthetic oligonucleotide
tacaggtttgatccactagggtctttccagagag

SEQ ID NO: 267933 - DNA, 33 bp, Artificial Sequence
  Description of Artificial Sequence: Synthetic oligonucleotide
acaggtttgatccactagggtctttccagagag

SEQ ID NO: 267934 - DNA, 32 bp, Artificial Sequence
  Description of Artificial Sequence: Synthetic oligonucleotide
caggtttgatccactagggtctttccagagag

SEQ ID NO: 267935 - DNA, 33 bp, Artificial Sequence
  Description of Artificial Sequence: Synthetic oligonucleotide
aggtttgatccactagggtctttccagagagag

SEQ ID NO: 267936 - DNA, 32 bp, Artificial Sequence
  Description of Artificial Sequence: Synthetic oligonucleotide
ggtttgatccactagggtctttccagagagag

SEQ ID NO: 267937 - DNA, 33 bp, Artificial Sequence
  Description of Artificial Sequence: Synthetic oligonucleotide
gtttgatccactagggtctttccagagagagtc

SEQ ID NO: 267938 - DNA, 33 bp, Artificial Sequence
  Description of Artificial Sequence: Synthetic oligonucleotide
tttgatccactagggtctttccagagagagtcc

SEQ ID NO: 267939 - DNA, 32 bp, Artificial Sequence
  Description of Artificial Sequence: Synthetic oligonucleotide
ttgatccactagggtctttccagagagagtcc

SEQ ID NO: 267940 - DNA, 31 bp, Artificial Sequence
  Description of Artificial Sequence: Synthetic oligonucleotide
tgatccactagggtctttccagagagagtcc

SEQ ID NO: 267941 - DNA, 30 bp, Artificial Sequence
  Description of Artificial Sequence: Synthetic oligonucleotide
gatccactagggtctttccagagagagtcc

SEQ ID NO: 267942 - DNA, 32 bp, Artificial Sequence
  Description of Artificial Sequence: Synthetic oligonucleotide
atccactagggtctttccagagagagtccttc

SEQ ID NO: 267943 - DNA, 31 bp, Artificial Sequence
  Description of Artificial Sequence: Synthetic oligonucleotide
tccactagggtctttccagagagagtccttc

SEQ ID NO: 267944 - DNA, 30 bp, Artificial Sequence
  Description of Artificial Sequence: Synthetic oligonucleotide
ccactagggtctttccagagagagtccttc

SEQ ID NO: 267945 - DNA, 32 bp, Artificial Sequence
  Description of Artificial Sequence: Synthetic oligonucleotide
cactagggtctttccagagagagtccttcaag

SEQ ID NO: 267946 - DNA, 32 bp, Artificial Sequence
  Description of Artificial Sequence: Synthetic oligonucleotide
actagggtctttccagagagagtccttcaagc

SEQ ID NO: 267947 - DNA, 31 bp, Artificial Sequence
  Description of Artificial Sequence: Synthetic oligonucleotide
ctagggtctttccagagagagtccttcaagc

SEQ ID NO: 267948 - DNA, 31 bp, Artificial Sequence
  Description of Artificial Sequence: Synthetic oligonucleotide
tagggtctttccagagagagtccttcaagcc

SEQ ID NO: 267949 - DNA, 30 bp, Artificial Sequence
  Description of Artificial Sequence: Synthetic oligonucleotide
agggtctttccagagagagtccttcaagcc

SEQ ID NO: 267950 - DNA, 29 bp, Artificial Sequence
  Description of Artificial Sequence: Synthetic oligonucleotide
gggtctttccagagagagtccttcaagcc

SEQ ID NO: 267951 - DNA, 30 bp, Artificial Sequence
  Description of Artificial Sequence: Synthetic oligonucleotide
ggtctttccagagagagtccttcaagcctg

SEQ ID NO: 267952 - DNA, 30 bp, Artificial Sequence
  Description of Artificial Sequence: Synthetic oligonucleotide
gtctttccagagagagtccttcaagcctgg

SEQ ID NO: 267953 - DNA, 31 bp, Artificial Sequence
  Description of Artificial Sequence: Synthetic oligonucleotide
tctttccagagagagtccttcaagcctggag

SEQ ID NO: 267954 - DNA, 30 bp, Artificial Sequence
  Description of Artificial Sequence: Synthetic oligonucleotide
ctttccagagagagtccttcaagcctggag

SEQ ID NO: 267955 - DNA, 30 bp, Artificial Sequence
  Description of Artificial Sequence: Synthetic oligonucleotide
tttccagagagagtccttcaagcctggagg

SEQ ID NO: 267956 - DNA, 29 bp, Artificial Sequence
  Description of Artificial Sequence: Synthetic oligonucleotide
ttccagagagagtccttcaagcctggagg

SEQ ID NO: 267957 - DNA, 28 bp, Artificial Sequence
  Description of Artificial Sequence: Synthetic oligonucleotide
tccagagagagtccttcaagcctggagg

SEQ ID NO: 267958 - DNA, 27 bp, Artificial Sequence
  Description of Artificial Sequence: Synthetic oligonucleotide
ccagagagagtccttcaagcctggagg

SEQ ID NO: 267959 - DNA, 27 bp, Artificial Sequence
  Description of Artificial Sequence: Synthetic oligonucleotide
cagagagagtccttcaagcctggaggc

SEQ ID NO: 267960 - DNA, 28 bp, Artificial Sequence
  Description of Artificial Sequence: Synthetic oligonucleotide
agagagagtccttcaagcctggaggctg

SEQ ID NO: 267961 - DNA, 27 bp, Artificial Sequence
  Description of Artificial Sequence: Synthetic oligonucleotide
gagagagtccttcaagcctggaggctg

SEQ ID NO: 267962 - DNA, 28 bp, Artificial Sequence
  Description of Artificial Sequence: Synthetic oligonucleotide
agagagtccttcaagcctggaggctgag

SEQ ID NO: 267963 - DNA, 27 bp, Artificial Sequence
  Description of Artificial Sequence: Synthetic oligonucleotide
gagagtccttcaagcctggaggctgag

SEQ ID NO: 267964 - DNA, 27 bp, Artificial Sequence
  Description of Artificial Sequence: Synthetic oligonucleotide
agagtccttcaagcctggaggctgagc

SEQ ID NO: 267965 - DNA, 27 bp, Artificial Sequence
  Description of Artificial Sequence: Synthetic oligonucleotide
gagtccttcaagcctggaggctgagca

SEQ ID NO: 267966 - DNA, 28 bp, Artificial Sequence
  Description of Artificial Sequence: Synthetic oligonucleotide
agtccttcaagcctggaggctgagcaag

SEQ ID NO: 267967 - DNA, 27 bp, Artificial Sequence
  Description of Artificial Sequence: Synthetic oligonucleotide
gtccttcaagcctggaggctgagcaag

SEQ ID NO: 267968 - DNA, 28 bp, Artificial Sequence
  Description of Artificial Sequence: Synthetic oligonucleotide
tccttcaagcctggaggctgagcaagtg

SEQ ID NO: 267969 - DNA, 27 bp, Artificial Sequence
  Description of Artificial Sequence: Synthetic oligonucleotide
ccttcaagcctggaggctgagcaagtg

SEQ ID NO: 267970 - DNA, 27 bp, Artificial Sequence
  Description of Artificial Sequence: Synthetic oligonucleotide
cttcaagcctggaggctgagcaagtgc

SEQ ID NO: 267971 - DNA, 27 bp, Artificial Sequence
  Description of Artificial Sequence: Synthetic oligonucleotide
ttcaagcctggaggctgagcaagtgcg

SEQ ID NO: 267972 - DNA, 27 bp, Artificial Sequence
  Description of Artificial Sequence: Synthetic oligonucleotide
tcaagcctggaggctgagcaagtgcga

SEQ ID NO: 267973 - DNA, 27 bp, Artificial Sequence
  Description of Artificial Sequence: Synthetic oligonucleotide
caagcctggaggctgagcaagtgcgat

SEQ ID NO: 267974 - DNA, 27 bp, Artificial Sequence
  Description of Artificial Sequence: Synthetic oligonucleotide
aagcctggaggctgagcaagtgcgatg

SEQ ID NO: 267975 - DNA, 26 bp, Artificial Sequence
  Description of Artificial Sequence: Synthetic oligonucleotide
agcctggaggctgagcaagtgcgatg

SEQ ID NO: 267976 - DNA, 25 bp, Artificial Sequence
  Description of Artificial Sequence: Synthetic oligonucleotide
gcctggaggctgagcaagtgcgatg

SEQ ID NO: 267977 - DNA, 27 bp, Artificial Sequence
  Description of Artificial Sequence: Synthetic oligonucleotide
cctggaggctgagcaagtgcgatgcta

SEQ ID NO: 267978 - DNA, 27 bp, Artificial Sequence
  Description of Artificial Sequence: Synthetic oligonucleotide
ctggaggctgagcaagtgcgatgctac

SEQ ID NO: 267979 - DNA, 28 bp, Artificial Sequence
  Description of Artificial Sequence: Synthetic oligonucleotide
tggaggctgagcaagtgcgatgctacag

SEQ ID NO: 267980 - DNA, 27 bp, Artificial Sequence
  Description of Artificial Sequence: Synthetic oligonucleotide
ggaggctgagcaagtgcgatgctacag

SEQ ID NO: 267981 - DNA, 27 bp, Artificial Sequence
  Description of Artificial Sequence: Synthetic oligonucleotide
gaggctgagcaagtgcgatgctacagg

SEQ ID NO: 267982 - DNA, 27 bp, Artificial Sequence
  Description of Artificial Sequence: Synthetic oligonucleotide
aggctgagcaagtgcgatgctacaggc

SEQ ID NO: 267983 - DNA, 26 bp, Artificial Sequence
  Description of Artificial Sequence: Synthetic oligonucleotide
ggctgagcaagtgcgatgctacaggc

SEQ ID NO: 267984 - DNA, 26 bp, Artificial Sequence
  Description of Artificial Sequence: Synthetic oligonucleotide
gctgagcaagtgcgatgctacaggcc

SEQ ID NO: 267985 - DNA, 27 bp, Artificial Sequence
  Description of Artificial Sequence: Synthetic oligonucleotide
ctgagcaagtgcgatgctacaggccct

SEQ ID NO: 267986 - DNA, 27 bp, Artificial Sequence
  Description of Artificial Sequence: Synthetic oligonucleotide
tgagcaagtgcgatgctacaggccctg

SEQ ID NO: 267987 - DNA, 26 bp, Artificial Sequence
  Description of Artificial Sequence: Synthetic oligonucleotide
gagcaagtgcgatgctacaggccctg

SEQ ID NO: 267988 - DNA, 27 bp, Artificial Sequence
  Description of Artificial Sequence: Synthetic oligonucleotide
agcaagtgcgatgctacaggccctgct

SEQ ID NO: 267989 - DNA, 27 bp, Artificial Sequence
  Description of Artificial Sequence: Synthetic oligonucleotide
gcaagtgcgatgctacaggccctgctt

SEQ ID NO: 267990 - DNA, 27 bp, Artificial Sequence
  Description of Artificial Sequence: Synthetic oligonucleotide
caagtgcgatgctacaggccctgcttg

SEQ ID NO: 267991 - DNA, 28 bp, Artificial Sequence
  Description of Artificial Sequence: Synthetic oligonucleotide
aagtgcgatgctacaggccctgcttgtc

SEQ ID NO: 267992 - DNA, 27 bp, Artificial Sequence
  Description of Artificial Sequence: Synthetic oligonucleotide
agtgcgatgctacaggccctgcttgtc

SEQ ID NO: 267993 - DNA, 27 bp, Artificial Sequence
  Description of Artificial Sequence: Synthetic oligonucleotide
gtgcgatgctacaggccctgcttgtca

SEQ ID NO: 267994 - DNA, 28 bp, Artificial Sequence
  Description of Artificial Sequence: Synthetic oligonucleotide
tgcgatgctacaggccctgcttgtcaac

SEQ ID NO: 267995 - DNA, 27 bp, Artificial Sequence
  Description of Artificial Sequence: Synthetic oligonucleotide
gcgatgctacaggccctgcttgtcaac

SEQ ID NO: 267996 - DNA, 27 bp, Artificial Sequence
  Description of Artificial Sequence: Synthetic oligonucleotide
cgatgctacaggccctgcttgtcaacc

SEQ ID NO: 267997 - DNA, 28 bp, Artificial Sequence
  Description of Artificial Sequence: Synthetic oligonucleotide
gatgctacaggccctgcttgtcaaccag

SEQ ID NO: 267998 - DNA, 28 bp, Artificial Sequence
  Description of Artificial Sequence: Synthetic oligonucleotide
atgctacaggccctgcttgtcaaccagg

SEQ ID NO: 267999 - DNA, 27 bp, Artificial Sequence
  Description of Artificial Sequence: Synthetic oligonucleotide
tgctacaggccctgcttgtcaaccagg

SEQ ID NO: 268000 - DNA, 27 bp, Artificial Sequence
  Description of Artificial Sequence: Synthetic oligonucleotide
gctacaggccctgcttgtcaaccaggt

SEQ ID NO: 268001 - DNA, 28 bp, Artificial Sequence
  Description of Artificial Sequence: Synthetic oligonucleotide
ctacaggccctgcttgtcaaccaggtag

SEQ ID NO: 268002 - DNA, 28 bp, Artificial Sequence
  Description of Artificial Sequence: Synthetic oligonucleotide
tacaggccctgcttgtcaaccaggtagg

SEQ ID NO: 268003 - DNA, 27 bp, Artificial Sequence
  Description of Artificial Sequence: Synthetic oligonucleotide
acaggccctgcttgtcaaccaggtagg

SEQ ID NO: 268004 - DNA, 27 bp, Artificial Sequence
  Description of Artificial Sequence: Synthetic oligonucleotide
caggccctgcttgtcaaccaggtaggt

SEQ ID NO: 268005 - DNA, 32 bp, Artificial Sequence
  Description of Artificial Sequence: Synthetic oligonucleotide
aggccctgcttgtcaaccaggtaggttttaag

SEQ ID NO: 268006 - DNA, 31 bp, Artificial Sequence
  Description of Artificial Sequence: Synthetic oligonucleotide
ggccctgcttgtcaaccaggtaggttttaag

SEQ ID NO: 268007 - DNA, 33 bp, Artificial Sequence
  Description of Artificial Sequence: Synthetic oligonucleotide
gccctgcttgtcaaccaggtaggttttaagtac

SEQ ID NO: 268008 - DNA, 35 bp, Artificial Sequence
  Description of Artificial Sequence: Synthetic oligonucleotide
ccctgcttgtcaaccaggtaggttttaagtacatg

SEQ ID NO: 268009 - DNA, 35 bp, Artificial Sequence
  Description of Artificial Sequence: Synthetic oligonucleotide
cctgcttgtcaaccaggtaggttttaagtacatgc

SEQ ID NO: 268010 - DNA, 36 bp, Artificial Sequence
  Description of Artificial Sequence: Synthetic oligonucleotide
ctgcttgtcaaccaggtaggttttaagtacatgcag

SEQ ID NO: 268011 - DNA, 39 bp, Artificial Sequence
  Description of Artificial Sequence: Synthetic oligonucleotide
tgcttgtcaaccaggtaggttttaagtacatgcagattg

SEQ ID NO: 268012 - DNA, 38 bp, Artificial Sequence
  Description of Artificial Sequence: Synthetic oligonucleotide
gcttgtcaaccaggtaggttttaagtacatgcagattg

SEQ ID NO: 268013 - DNA, 39 bp, Artificial Sequence
  Description of Artificial Sequence: Synthetic oligonucleotide
cttgtcaaccaggtaggttttaagtacatgcagattgtg

SEQ ID NO: 268014 - DNA, 39 bp, Artificial Sequence
  Description of Artificial Sequence: Synthetic oligonucleotide
ttgtcaaccaggtaggttttaagtacatgcagattgtgg

SEQ ID NO: 268015 - DNA, 38 bp, Artificial Sequence
  Description of Artificial Sequence: Synthetic oligonucleotide
tgtcaaccaggtaggttttaagtacatgcagattgtgg

SEQ ID NO: 268016 - DNA, 37 bp, Artificial Sequence
  Description of Artificial Sequence: Synthetic oligonucleotide
gtcaaccaggtaggttttaagtacatgcagattgtgg

SEQ ID NO: 268017 - DNA, 38 bp, Artificial Sequence
  Description of Artificial Sequence: Synthetic oligonucleotide
tcaaccaggtaggttttaagtacatgcagattgtggag

SEQ ID NO: 268018 - DNA, 37 bp, Artificial Sequence
  Description of Artificial Sequence: Synthetic oligonucleotide
caaccaggtaggttttaagtacatgcagattgtggag

SEQ ID NO: 268019 - DNA, 37 bp, Artificial Sequence
  Description of Artificial Sequence: Synthetic oligonucleotide
aaccaggtaggttttaagtacatgcagattgtggagc

SEQ ID NO: 268020 - DNA, 36 bp, Artificial Sequence
  Description of Artificial Sequence: Synthetic oligonucleotide
accaggtaggttttaagtacatgcagattgtggagc

SEQ ID NO: 268021 - DNA, 35 bp, Artificial Sequence
  Description of Artificial Sequence: Synthetic oligonucleotide
ccaggtaggttttaagtacatgcagattgtggagc

SEQ ID NO: 268022 - DNA, 37 bp, Artificial Sequence
  Description of Artificial Sequence: Synthetic oligonucleotide
caggtaggttttaagtacatgcagattgtggagcaag

SEQ ID NO: 268023 - DNA, 39 bp, Artificial Sequence
  Description of Artificial Sequence: Synthetic oligonucleotide
aggtaggttttaagtacatgcagattgtggagcaagttc

SEQ ID NO: 268024 - DNA, 38 bp, Artificial Sequence
  Description of Artificial Sequence: Synthetic oligonucleotide
ggtaggttttaagtacatgcagattgtggagcaagttc

SEQ ID NO: 268025 - DNA, 38 bp, Artificial Sequence
  Description of Artificial Sequence: Synthetic oligonucleotide
gtaggttttaagtacatgcagattgtggagcaagttcc

SEQ ID NO: 268026 - DNA, 38 bp, Artificial Sequence
  Description of Artificial Sequence: Synthetic oligonucleotide
taggttttaagtacatgcagattgtggagcaagttccg

SEQ ID NO: 268027 - DNA, 37 bp, Artificial Sequence
  Description of Artificial Sequence: Synthetic oligonucleotide
aggttttaagtacatgcagattgtggagcaagttccg

SEQ ID NO: 268028 - DNA, 36 bp, Artificial Sequence
  Description of Artificial Sequence: Synthetic oligonucleotide
ggttttaagtacatgcagattgtggagcaagttccg

SEQ ID NO: 268029 - DNA, 36 bp, Artificial Sequence
  Description of Artificial Sequence: Synthetic oligonucleotide
gttttaagtacatgcagattgtggagcaagttccgc

SEQ ID NO: 268030 - DNA, 37 bp, Artificial Sequence
  Description of Artificial Sequence: Synthetic oligonucleotide
ttttaagtacatgcagattgtggagcaagttccgctg

SEQ ID NO: 268031 - DNA, 36 bp, Artificial Sequence
  Description of Artificial Sequence: Synthetic oligonucleotide
tttaagtacatgcagattgtggagcaagttccgctg

SEQ ID NO: 268032 - DNA, 35 bp, Artificial Sequence
  Description of Artificial Sequence: Synthetic oligonucleotide
ttaagtacatgcagattgtggagcaagttccgctg

SEQ ID NO: 268033 - DNA, 34 bp, Artificial Sequence
  Description of Artificial Sequence: Synthetic oligonucleotide
taagtacatgcagattgtggagcaagttccgctg

SEQ ID NO: 268034 - DNA, 33 bp, Artificial Sequence
  Description of Artificial Sequence: Synthetic oligonucleotide
aagtacatgcagattgtggagcaagttccgctg

SEQ ID NO: 268035 - DNA, 32 bp, Artificial Sequence
  Description of Artificial Sequence: Synthetic oligonucleotide
agtacatgcagattgtggagcaagttccgctg

SEQ ID NO: 268036 - DNA, 31 bp, Artificial Sequence
  Description of Artificial Sequence: Synthetic oligonucleotide
gtacatgcagattgtggagcaagttccgctg

SEQ ID NO: 268037 - DNA, 32 bp, Artificial Sequence
  Description of Artificial Sequence: Synthetic oligonucleotide
tacatgcagattgtggagcaagttccgctgac

SEQ ID NO: 268038 - DNA, 31 bp, Artificial Sequence
  Description of Artificial Sequence: Synthetic oligonucleotide
acatgcagattgtggagcaagttccgctgac

SEQ ID NO: 268039 - DNA, 30 bp, Artificial Sequence
  Description of Artificial Sequence: Synthetic oligonucleotide
catgcagattgtggagcaagttccgctgac

SEQ ID NO: 268040 - DNA, 30 bp, Artificial Sequence
  Description of Artificial Sequence: Synthetic oligonucleotide
atgcagattgtggagcaagttccgctgacc

SEQ ID NO: 268041 - DNA, 29 bp, Artificial Sequence
  Description of Artificial Sequence: Synthetic oligonucleotide
tgcagattgtggagcaagttccgctgacc

SEQ ID NO: 268042 - DNA, 28 bp, Artificial Sequence
  Description of Artificial Sequence: Synthetic oligonucleotide
gcagattgtggagcaagttccgctgacc

SEQ ID NO: 268043 - DNA, 30 bp, Artificial Sequence
  Description of Artificial Sequence: Synthetic oligonucleotide
cagattgtggagcaagttccgctgaccttg

SEQ ID NO: 268044 - DNA, 30 bp, Artificial Sequence
  Description of Artificial Sequence: Synthetic oligonucleotide
agattgtggagcaagttccgctgaccttgg

SEQ ID NO: 268045 - DNA, 29 bp, Artificial Sequence
  Description of Artificial Sequence: Synthetic oligonucleotide
gattgtggagcaagttccgctgaccttgg

SEQ ID NO: 268046 - DNA, 30 bp, Artificial Sequence
  Description of Artificial Sequence: Synthetic oligonucleotide
attgtggagcaagttccgctgaccttggac

SEQ ID NO: 268047 - DNA, 29 bp, Artificial Sequence
  Description of Artificial Sequence: Synthetic oligonucleotide
ttgtggagcaagttccgctgaccttggac

SEQ ID NO: 268048 - DNA, 28 bp, Artificial Sequence
  Description of Artificial Sequence: Synthetic oligonucleotide
tgtggagcaagttccgctgaccttggac

SEQ ID NO: 268049 - DNA, 27 bp, Artificial Sequence
  Description of Artificial Sequence: Synthetic oligonucleotide
gtggagcaagttccgctgaccttggac

SEQ ID NO: 268050 - DNA, 28 bp, Artificial Sequence
  Description of Artificial Sequence: Synthetic oligonucleotide
tggagcaagttccgctgaccttggacac

SEQ ID NO: 268051 - DNA, 27 bp, Artificial Sequence
  Description of Artificial Sequence: Synthetic oligonucleotide
ggagcaagttccgctgaccttggacac

SEQ ID NO: 268052 - DNA, 28 bp, Artificial Sequence
  Description of Artificial Sequence: Synthetic oligonucleotide
gagcaagttccgctgaccttggacacag

SEQ ID NO: 268053 - DNA, 28 bp, Artificial Sequence
  Description of Artificial Sequence: Synthetic oligonucleotide
agcaagttccgctgaccttggacacagc

SEQ ID NO: 268054 - DNA, 27 bp, Artificial Sequence
  Description of Artificial Sequence: Synthetic oligonucleotide
gcaagttccgctgaccttggacacagc

SEQ ID NO: 268055 - DNA, 27 bp, Artificial Sequence
  Description of Artificial Sequence: Synthetic oligonucleotide
caagttccgctgaccttggacacagcc

SEQ ID NO: 268056 - DNA, 29 bp, Artificial Sequence
  Description of Artificial Sequence: Synthetic oligonucleotide
aagttccgctgaccttggacacagccatg

SEQ ID NO: 268057 - DNA, 28 bp, Artificial Sequence
  Description of Artificial Sequence: Synthetic oligonucleotide
agttccgctgaccttggacacagccatg

SEQ ID NO: 268058 - DNA, 27 bp, Artificial Sequence
  Description of Artificial Sequence: Synthetic oligonucleotide
gttccgctgaccttggacacagccatg

SEQ ID NO: 268059 - DNA, 27 bp, Artificial Sequence
  Description of Artificial Sequence: Synthetic oligonucleotide
ttccgctgaccttggacacagccatgc

SEQ ID NO: 268060 - DNA, 26 bp, Artificial Sequence
  Description of Artificial Sequence: Synthetic oligonucleotide
tccgctgaccttggacacagccatgc

SEQ ID NO: 268061 - DNA, 25 bp, Artificial Sequence
  Description of Artificial Sequence: Synthetic oligonucleotide
ccgctgaccttggacacagccatgc

SEQ ID NO: 268062 - DNA, 25 bp, Artificial Sequence
  Description of Artificial Sequence: Synthetic oligonucleotide
cgctgaccttggacacagccatgcg

SEQ ID NO: 268063 - DNA, 25 bp, Artificial Sequence
  Description of Artificial Sequence: Synthetic oligonucleotide
gctgaccttggacacagccatgcgc

SEQ ID NO: 268064 - DNA, 26 bp, Artificial Sequence
  Description of Artificial Sequence: Synthetic oligonucleotide
ctgaccttggacacagccatgcgcct

SEQ ID NO: 268065 - DNA, 26 bp, Artificial Sequence
  Description of Artificial Sequence: Synthetic oligonucleotide
tgaccttggacacagccatgcgcctg

SEQ ID NO: 268066 - DNA, 25 bp, Artificial Sequence
  Description of Artificial Sequence: Synthetic oligonucleotide
gaccttggacacagccatgcgcctg

SEQ ID NO: 268067 - DNA, 26 bp, Artificial Sequence
  Description of Artificial Sequence: Synthetic oligonucleotide
accttggacacagccatgcgcctggt

SEQ ID NO: 268068 - DNA, 25 bp, Artificial Sequence
  Description of Artificial Sequence: Synthetic oligonucleotide
ccttggacacagccatgcgcctggt

SEQ ID NO: 268069 - DNA, 27 bp, Artificial Sequence
  Description of Artificial Sequence: Synthetic oligonucleotide
cttggacacagccatgcgcctggtgaa

SEQ ID NO: 268070 - DNA, 28 bp, Artificial Sequence
  Description of Artificial Sequence: Synthetic oligonucleotide
ttggacacagccatgcgcctggtgaaac

SEQ ID NO: 268071 - DNA, 27 bp, Artificial Sequence
  Description of Artificial Sequence: Synthetic oligonucleotide
tggacacagccatgcgcctggtgaaac

SEQ ID NO: 268072 - DNA, 27 bp, Artificial Sequence
  Description of Artificial Sequence: Synthetic oligonucleotide
ggacacagccatgcgcctggtgaaaca

SEQ ID NO: 268073 - DNA, 28 bp, Artificial Sequence
  Description of Artificial Sequence: Synthetic oligonucleotide
gacacagccatgcgcctggtgaaacatg

SEQ ID NO: 268074 - DNA, 29 bp, Artificial Sequence
  Description of Artificial Sequence: Synthetic oligonucleotide
acacagccatgcgcctggtgaaacatgtc

SEQ ID NO: 268075 - DNA, 28 bp, Artificial Sequence
  Description of Artificial Sequence: Synthetic oligonucleotide
cacagccatgcgcctggtgaaacatgtc

SEQ ID NO: 268076 - DNA, 30 bp, Artificial Sequence
  Description of Artificial Sequence: Synthetic oligonucleotide
acagccatgcgcctggtgaaacatgtcttc

SEQ ID NO: 268077 - DNA, 29 bp, Artificial Sequence
  Description of Artificial Sequence: Synthetic oligonucleotide
cagccatgcgcctggtgaaacatgtcttc

SEQ ID NO: 268078 - DNA, 33 bp, Artificial Sequence
  Description of Artificial Sequence: Synthetic oligonucleotide
agccatgcgcctggtgaaacatgtcttcaattc

SEQ ID NO: 268079 - DNA, 32 bp, Artificial Sequence
  Description of Artificial Sequence: Synthetic oligonucleotide
gccatgcgcctggtgaaacatgtcttcaattc

SEQ ID NO: 268080 - DNA, 33 bp, Artificial Sequence
  Description of Artificial Sequence: Synthetic oligonucleotide
ccatgcgcctggtgaaacatgtcttcaattctg

SEQ ID NO: 268081 - DNA, 33 bp, Artificial Sequence
  Description of Artificial Sequence: Synthetic oligonucleotide
catgcgcctggtgaaacatgtcttcaattctgc

SEQ ID NO: 268082 - DNA, 33 bp, Artificial Sequence
  Description of Artificial Sequence: Synthetic oligonucleotide
atgcgcctggtgaaacatgtcttcaattctgcg

SEQ ID NO: 268083 - DNA, 32 bp, Artificial Sequence
  Description of Artificial Sequence: Synthetic oligonucleotide
tgcgcctggtgaaacatgtcttcaattctgcg

SEQ ID NO: 268084 - DNA, 31 bp, Artificial Sequence
  Description of Artificial Sequence: Synthetic oligonucleotide
gcgcctggtgaaacatgtcttcaattctgcg

SEQ ID NO: 268085 - DNA, 31 bp, Artificial Sequence
  Description of Artificial Sequence: Synthetic oligonucleotide
cgcctggtgaaacatgtcttcaattctgcgg

SEQ ID NO: 268086 - DNA, 31 bp, Artificial Sequence
  Description of Artificial Sequence: Synthetic oligonucleotide
gcctggtgaaacatgtcttcaattctgcggc

SEQ ID NO: 268087 - DNA, 32 bp, Artificial Sequence
  Description of Artificial Sequence: Synthetic oligonucleotide
cctggtgaaacatgtcttcaattctgcggcag

SEQ ID NO: 268088 - DNA, 33 bp, Artificial Sequence
  Description of Artificial Sequence: Synthetic oligonucleotide
ctggtgaaacatgtcttcaattctgcggcagag

SEQ ID NO: 268089 - DNA, 34 bp, Artificial Sequence
  Description of Artificial Sequence: Synthetic oligonucleotide
tggtgaaacatgtcttcaattctgcggcagagag

SEQ ID NO: 268090 - DNA, 33 bp, Artificial Sequence
  Description of Artificial Sequence: Synthetic oligonucleotide
ggtgaaacatgtcttcaattctgcggcagagag

SEQ ID NO: 268091 - DNA, 34 bp, Artificial Sequence
  Description of Artificial Sequence: Synthetic oligonucleotide
gtgaaacatgtcttcaattctgcggcagagagag

SEQ ID NO: 268092 - DNA, 36 bp, Artificial Sequence
  Description of Artificial Sequence: Synthetic oligonucleotide
tgaaacatgtcttcaattctgcggcagagagagatc

SEQ ID NO: 268093 - DNA, 35 bp, Artificial Sequence
  Description of Artificial Sequence: Synthetic oligonucleotide
gaaacatgtcttcaattctgcggcagagagagatc

SEQ ID NO: 268094 - DNA, 36 bp, Artificial Sequence
  Description of Artificial Sequence: Synthetic oligonucleotide
aaacatgtcttcaattctgcggcagagagagatctg

SEQ ID NO: 268095 - DNA, 35 bp, Artificial Sequence
  Description of Artificial Sequence: Synthetic oligonucleotide
aacatgtcttcaattctgcggcagagagagatctg

SEQ ID NO: 268096 - DNA, 34 bp, Artificial Sequence
  Description of Artificial Sequence: Synthetic oligonucleotide
acatgtcttcaattctgcggcagagagagatctg

SEQ ID NO: 268097 - DNA, 33 bp, Artificial Sequence
  Description of Artificial Sequence: Synthetic oligonucleotide
catgtcttcaattctgcggcagagagagatctg

SEQ ID NO: 268098 - DNA, 35 bp, Artificial Sequence
  Description of Artificial Sequence: Synthetic oligonucleotide
atgtcttcaattctgcggcagagagagatctgtac

SEQ ID NO: 268099 - DNA, 34 bp, Artificial Sequence
  Description of Artificial Sequence: Synthetic oligonucleotide
tgtcttcaattctgcggcagagagagatctgtac

SEQ ID NO: 268100 - DNA, 33 bp, Artificial Sequence
  Description of Artificial Sequence: Synthetic oligonucleotide
gtcttcaattctgcggcagagagagatctgtac

SEQ ID NO: 268101 - DNA, 34 bp, Artificial Sequence
  Description of Artificial Sequence: Synthetic oligonucleotide
tcttcaattctgcggcagagagagatctgtacac

SEQ ID NO: 268102 - DNA, 33 bp, Artificial Sequence
  Description of Artificial Sequence: Synthetic oligonucleotide
cttcaattctgcggcagagagagatctgtacac

SEQ ID NO: 268103 - DNA, 34 bp, Artificial Sequence
  Description of Artificial Sequence: Synthetic oligonucleotide
ttcaattctgcggcagagagagatctgtacactg

SEQ ID NO: 268104 - DNA, 33 bp, Artificial Sequence
  Description of Artificial Sequence: Synthetic oligonucleotide
tcaattctgcggcagagagagatctgtacactg

SEQ ID NO: 268105 - DNA, 32 bp, Artificial Sequence
  Description of Artificial Sequence: Synthetic oligonucleotide
caattctgcggcagagagagatctgtacactg

SEQ ID NO: 268106 - DNA, 32 bp, Artificial Sequence
  Description of Artificial Sequence: Synthetic oligonucleotide
aattctgcggcagagagagatctgtacactgc

SEQ ID NO: 268107 - DNA, 31 bp, Artificial Sequence
  Description of Artificial Sequence: Synthetic oligonucleotide
attctgcggcagagagagatctgtacactgc

SEQ ID NO: 268108 - DNA, 30 bp, Artificial Sequence
  Description of Artificial Sequence: Synthetic oligonucleotide
ttctgcggcagagagagatctgtacactgc

SEQ ID NO: 268109 - DNA, 29 bp, Artificial Sequence
  Description of Artificial Sequence: Synthetic oligonucleotide
tctgcggcagagagagatctgtacactgc

SEQ ID NO: 268110 - DNA, 28 bp, Artificial Sequence
  Description of Artificial Sequence: Synthetic oligonucleotide
ctgcggcagagagagatctgtacactgc

SEQ ID NO: 268111 - DNA, 28 bp, Artificial Sequence
  Description of Artificial Sequence: Synthetic oligonucleotide
tgcggcagagagagatctgtacactgcg

SEQ ID NO: 268112 - DNA, 27 bp, Artificial Sequence
  Description of Artificial Sequence: Synthetic oligonucleotide
gcggcagagagagatctgtacactgcg

SEQ ID NO: 268113 - DNA, 27 bp, Artificial Sequence
  Description of Artificial Sequence: Synthetic oligonucleotide
cggcagagagagatctgtacactgcgg

SEQ ID NO: 268114 - DNA, 28 bp, Artificial Sequence
  Description of Artificial Sequence: Synthetic oligonucleotide
ggcagagagagatctgtacactgcggac

SEQ ID NO: 268115 - DNA, 28 bp, Artificial Sequence
  Description of Artificial Sequence: Synthetic oligonucleotide
gcagagagagatctgtacactgcggacg

SEQ ID NO: 268116 - DNA, 28 bp, Artificial Sequence
  Description of Artificial Sequence: Synthetic oligonucleotide
cagagagagatctgtacactgcggacgc

SEQ ID NO: 268117 - DNA, 29 bp, Artificial Sequence
  Description of Artificial Sequence: Synthetic oligonucleotide
agagagagatctgtacactgcggacgcac

SEQ ID NO: 268118 - DNA, 28 bp, Artificial Sequence
  Description of Artificial Sequence: Synthetic oligonucleotide
gagagagatctgtacactgcggacgcac

SEQ ID NO: 268119 - DNA, 29 bp, Artificial Sequence
  Description of Artificial Sequence: Synthetic oligonucleotide
agagagatctgtacactgcggacgcactg

SEQ ID NO: 268120 - DNA, 28 bp, Artificial Sequence
  Description of Artificial Sequence: Synthetic oligonucleotide
gagagatctgtacactgcggacgcactg

SEQ ID NO: 268121 - DNA, 28 bp, Artificial Sequence
  Description of Artificial Sequence: Synthetic oligonucleotide
agagatctgtacactgcggacgcactgc

SEQ ID NO: 268122 - DNA, 27 bp, Artificial Sequence
  Description of Artificial Sequence: Synthetic oligonucleotide
gagatctgtacactgcggacgcactgc

SEQ ID NO: 268123 - DNA, 27 bp, Artificial Sequence
  Description of Artificial Sequence: Synthetic oligonucleotide
agatctgtacactgcggacgcactgcg

SEQ ID NO: 268124 - DNA, 26 bp, Artificial Sequence
  Description of Artificial Sequence: Synthetic oligonucleotide
gatctgtacactgcggacgcactgcg

SEQ ID NO: 268125 - DNA, 27 bp, Artificial Sequence
  Description of Artificial Sequence: Synthetic oligonucleotide
atctgtacactgcggacgcactgcgga

SEQ ID NO: 268126 - DNA, 27 bp, Artificial Sequence
  Description of Artificial Sequence: Synthetic oligonucleotide
tctgtacactgcggacgcactgcggat

SEQ ID NO: 268127 - DNA, 26 bp, Artificial Sequence
  Description of Artificial Sequence: Synthetic oligonucleotide
ctgtacactgcggacgcactgcggat

SEQ ID NO: 268128 - DNA, 27 bp, Artificial Sequence
  Description of Artificial Sequence: Synthetic oligonucleotide
tgtacactgcggacgcactgcggatct

SEQ ID NO: 268129 - DNA, 26 bp, Artificial Sequence
  Description of Artificial Sequence: Synthetic oligonucleotide
gtacactgcggacgcactgcggatct

SEQ ID NO: 268130 - DNA, 26 bp, Artificial Sequence
  Description of Artificial Sequence: Synthetic oligonucleotide
tacactgcggacgcactgcggatctg

SEQ ID NO: 268131 - DNA, 25 bp, Artificial Sequence
  Description of Artificial Sequence: Synthetic oligonucleotide
acactgcggacgcactgcggatctg

SEQ ID NO: 268132 - DNA, 24 bp, Artificial Sequence
  Description of Artificial Sequence: Synthetic oligonucleotide
cactgcggacgcactgcggatctg

SEQ ID NO: 268133 - DNA, 27 bp, Artificial Sequence
  Description of Artificial Sequence: Synthetic oligonucleotide
actgcggacgcactgcggatctgctta

SEQ ID NO: 268134 - DNA, 26 bp, Artificial Sequence
  Description of Artificial Sequence: Synthetic oligonucleotide
ctgcggacgcactgcggatctgctta

SEQ ID NO: 268135 - DNA, 27 bp, Artificial Sequence
  Description of Artificial Sequence: Synthetic oligonucleotide
tgcggacgcactgcggatctgcttagt

SEQ ID NO: 268136 - DNA, 26 bp, Artificial Sequence
  Description of Artificial Sequence: Synthetic oligonucleotide
gcggacgcactgcggatctgcttagt

SEQ ID NO: 268137 - DNA, 27 bp, Artificial Sequence
  Description of Artificial Sequence: Synthetic oligonucleotide
cggacgcactgcggatctgcttagtga

SEQ ID NO: 268138 - DNA, 27 bp, Artificial Sequence
  Description of Artificial Sequence: Synthetic oligonucleotide
ggacgcactgcggatctgcttagtgac

SEQ ID NO: 268139 - DNA, 27 bp, Artificial Sequence
  Description of Artificial Sequence: Synthetic oligonucleotide
gacgcactgcggatctgcttagtgacc

SEQ ID NO: 268140 - DNA, 30 bp, Artificial Sequence
  Description of Artificial Sequence: Synthetic oligonucleotide
acgcactgcggatctgcttagtgaccatag

SEQ ID NO: 268141 - DNA, 29 bp, Artificial Sequence
  Description of Artificial Sequence: Synthetic oligonucleotide
cgcactgcggatctgcttagtgaccatag

SEQ ID NO: 268142 - DNA, 30 bp, Artificial Sequence
  Description of Artificial Sequence: Synthetic oligonucleotide
gcactgcggatctgcttagtgaccatagag

SEQ ID NO: 268143 - DNA, 30 bp, Artificial Sequence
  Description of Artificial Sequence: Synthetic oligonucleotide
cactgcggatctgcttagtgaccatagagg

SEQ ID NO: 268144 - DNA, 30 bp, Artificial Sequence
  Description of Artificial Sequence: Synthetic oligonucleotide
actgcggatctgcttagtgaccatagaggg

SEQ ID NO: 268145 - DNA, 29 bp, Artificial Sequence
  Description of Artificial Sequence: Synthetic oligonucleotide
ctgcggatctgcttagtgaccatagaggg

SEQ ID NO: 268146 - DNA, 29 bp, Artificial Sequence
  Description of Artificial Sequence: Synthetic oligonucleotide
tgcggatctgcttagtgaccatagagggc

SEQ ID NO: 268147 - DNA, 28 bp, Artificial Sequence
  Description of Artificial Sequence: Synthetic oligonucleotide
gcggatctgcttagtgaccatagagggc

SEQ ID NO: 268148 - DNA, 30 bp, Artificial Sequence
  Description of Artificial Sequence: Synthetic oligonucleotide
cggatctgcttagtgaccatagagggcatg

SEQ ID NO: 268149 - DNA, 31 bp, Artificial Sequence
  Description of Artificial Sequence: Synthetic oligonucleotide
ggatctgcttagtgaccatagagggcatgag

SEQ ID NO: 268150 - DNA, 31 bp, Artificial Sequence
  Description of Artificial Sequence: Synthetic oligonucleotide
gatctgcttagtgaccatagagggcatgagg

SEQ ID NO: 268151 - DNA, 31 bp, Artificial Sequence
  Description of Artificial Sequence: Synthetic oligonucleotide
atctgcttagtgaccatagagggcatgaggg

SEQ ID NO: 268152 - DNA, 30 bp, Artificial Sequence
  Description of Artificial Sequence: Synthetic oligonucleotide
tctgcttagtgaccatagagggcatgaggg

SEQ ID NO: 268153 - DNA, 29 bp, Artificial Sequence
  Description of Artificial Sequence: Synthetic oligonucleotide
ctgcttagtgaccatagagggcatgaggg

SEQ ID NO: 268154 - DNA, 30 bp, Artificial Sequence
  Description of Artificial Sequence: Synthetic oligonucleotide
tgcttagtgaccatagagggcatgagggag

SEQ ID NO: 268155 - DNA, 29 bp, Artificial Sequence
  Description of Artificial Sequence: Synthetic oligonucleotide
gcttagtgaccatagagggcatgagggag

SEQ ID NO: 268156 - DNA, 29 bp, Artificial Sequence
  Description of Artificial Sequence: Synthetic oligonucleotide
cttagtgaccatagagggcatgagggagg

SEQ ID NO: 268157 - DNA, 32 bp, Artificial Sequence
  Description of Artificial Sequence: Synthetic oligonucleotide
ttagtgaccatagagggcatgagggaggaatc

SEQ ID NO: 268158 - DNA, 31 bp, Artificial Sequence
  Description of Artificial Sequence: Synthetic oligonucleotide
tagtgaccatagagggcatgagggaggaatc

SEQ ID NO: 268159 - DNA, 30 bp, Artificial Sequence
  Description of Artificial Sequence: Synthetic oligonucleotide
agtgaccatagagggcatgagggaggaatc

SEQ ID NO: 268160 - DNA, 29 bp, Artificial Sequence
  Description of Artificial Sequence: Synthetic oligonucleotide
gtgaccatagagggcatgagggaggaatc

SEQ ID NO: 268161 - DNA, 30 bp, Artificial Sequence
  Description of Artificial Sequence: Synthetic oligonucleotide
tgaccatagagggcatgagggaggaatctg

SEQ ID NO: 268162 - DNA, 29 bp, Artificial Sequence
  Description of Artificial Sequence: Synthetic oligonucleotide
gaccatagagggcatgagggaggaatctg

SEQ ID NO: 268163 - DNA, 32 bp, Artificial Sequence
  Description of Artificial Sequence: Synthetic oligonucleotide
accatagagggcatgagggaggaatctgtttc

SEQ ID NO: 268164 - DNA, 31 bp, Artificial Sequence
  Description of Artificial Sequence: Synthetic oligonucleotide
ccatagagggcatgagggaggaatctgtttc

SEQ ID NO: 268165 - DNA, 31 bp, Artificial Sequence
  Description of Artificial Sequence: Synthetic oligonucleotide
catagagggcatgagggaggaatctgtttcc

SEQ ID NO: 268166 - DNA, 35 bp, Artificial Sequence
  Description of Artificial Sequence: Synthetic oligonucleotide
atagagggcatgagggaggaatctgtttcctaaag

SEQ ID NO: 268167 - DNA, 34 bp, Artificial Sequence
  Description of Artificial Sequence: Synthetic oligonucleotide
tagagggcatgagggaggaatctgtttcctaaag

SEQ ID NO: 268168 - DNA, 33 bp, Artificial Sequence
  Description of Artificial Sequence: Synthetic oligonucleotide
agagggcatgagggaggaatctgtttcctaaag

SEQ ID NO: 268169 - DNA, 32 bp, Artificial Sequence
  Description of Artificial Sequence: Synthetic oligonucleotide
gagggcatgagggaggaatctgtttcctaaag

SEQ ID NO: 268170 - DNA, 32 bp, Artificial Sequence
  Description of Artificial Sequence: Synthetic oligonucleotide
agggcatgagggaggaatctgtttcctaaagg

SEQ ID NO: 268171 - DNA, 31 bp, Artificial Sequence
  Description of Artificial Sequence: Synthetic oligonucleotide
gggcatgagggaggaatctgtttcctaaagg

SEQ ID NO: 268172 - DNA, 33 bp, Artificial Sequence
  Description of Artificial Sequence: Synthetic oligonucleotide
ggcatgagggaggaatctgtttcctaaaggaag

SEQ ID NO: 268173 - DNA, 33 bp, Artificial Sequence
  Description of Artificial Sequence: Synthetic oligonucleotide
gcatgagggaggaatctgtttcctaaaggaagg

SEQ ID NO: 268174 - DNA, 34 bp, Artificial Sequence
  Description of Artificial Sequence: Synthetic oligonucleotide
catgagggaggaatctgtttcctaaaggaaggag

SEQ ID NO: 268175 - DNA, 35 bp, Artificial Sequence
  Description of Artificial Sequence: Synthetic oligonucleotide
atgagggaggaatctgtttcctaaaggaaggagtg

SEQ ID NO: 268176 - DNA, 34 bp, Artificial Sequence
  Description of Artificial Sequence: Synthetic oligonucleotide
tgagggaggaatctgtttcctaaaggaaggagtg

SEQ ID NO: 268177 - DNA, 33 bp, Artificial Sequence
  Description of Artificial Sequence: Synthetic oligonucleotide
gagggaggaatctgtttcctaaaggaaggagtg

SEQ ID NO: 268178 - DNA, 29 bp, Artificial Sequence
  Description of Artificial Sequence: Synthetic oligonucleotide
atggagtacgtcatcggtaaccaaggccc

SEQ ID NO: 268179 - DNA, 28 bp, Artificial Sequence
  Description of Artificial Sequence: Synthetic oligonucleotide
tggagtacgtcatcggtaaccaaggccc

SEQ ID NO: 268180 - DNA, 27 bp, Artificial Sequence
  Description of Artificial Sequence: Synthetic oligonucleotide
ggagtacgtcatcggtaaccaaggccc

SEQ ID NO: 268181 - DNA, 27 bp, Artificial Sequence
  Description of Artificial Sequence: Synthetic oligonucleotide
gagtacgtcatcggtaaccaaggcccg

SEQ ID NO: 268182 - DNA, 27 bp, Artificial Sequence
  Description of Artificial Sequence: Synthetic oligonucleotide
agtacgtcatcggtaaccaaggcccgg

SEQ ID NO: 268183 - DNA, 27 bp, Artificial Sequence
  Description of Artificial Sequence: Synthetic oligonucleotide
gtacgtcatcggtaaccaaggcccgga

SEQ ID NO: 268184 - DNA, 27 bp, Artificial Sequence
  Description of Artificial Sequence: Synthetic oligonucleotide
tacgtcatcggtaaccaaggcccggac

SEQ ID NO: 268185 - DNA, 27 bp, Artificial Sequence
  Description of Artificial Sequence: Synthetic oligonucleotide
acgtcatcggtaaccaaggcccggact

SEQ ID NO: 268186 - DNA, 27 bp, Artificial Sequence
  Description of Artificial Sequence: Synthetic oligonucleotide
cgtcatcggtaaccaaggcccggacta

SEQ ID NO: 268187 - DNA, 28 bp, Artificial Sequence
  Description of Artificial Sequence: Synthetic oligonucleotide
gtcatcggtaaccaaggcccggactatg

SEQ ID NO: 268188 - DNA, 30 bp, Artificial Sequence
  Description of Artificial Sequence: Synthetic oligonucleotide
tcatcggtaaccaaggcccggactatgttg

SEQ ID NO: 268189 - DNA, 29 bp, Artificial Sequence
  Description of Artificial Sequence: Synthetic oligonucleotide
catcggtaaccaaggcccggactatgttg

SEQ ID NO: 268190 - DNA, 31 bp, Artificial Sequence
  Description of Artificial Sequence: Synthetic oligonucleotide
atcggtaaccaaggcccggactatgttgttg

SEQ ID NO: 268191 - DNA, 30 bp, Artificial Sequence
  Description of Artificial Sequence: Synthetic oligonucleotide
tcggtaaccaaggcccggactatgttgttg

SEQ ID NO: 268192 - DNA, 29 bp, Artificial Sequence
  Description of Artificial Sequence: Synthetic oligonucleotide
cggtaaccaaggcccggactatgttgttg

SEQ ID NO: 268193 - DNA, 30 bp, Artificial Sequence
  Description of Artificial Sequence: Synthetic oligonucleotide
ggtaaccaaggcccggactatgttgttgtc

SEQ ID NO: 268194 - DNA, 30 bp, Artificial Sequence
  Description of Artificial Sequence: Synthetic oligonucleotide
gtaaccaaggcccggactatgttgttgtcg

SEQ ID NO: 268195 - DNA, 30 bp, Artificial Sequence
  Description of Artificial Sequence: Synthetic oligonucleotide
taaccaaggcccggactatgttgttgtcgc

SEQ ID NO: 268196 - DNA, 29 bp, Artificial Sequence
  Description of Artificial Sequence: Synthetic oligonucleotide
aaccaaggcccggactatgttgttgtcgc

SEQ ID NO: 268197 - DNA, 28 bp, Artificial Sequence
  Description of Artificial Sequence: Synthetic oligonucleotide
accaaggcccggactatgttgttgtcgc

SEQ ID NO: 268198 - DNA, 27 bp, Artificial Sequence
  Description of Artificial Sequence: Synthetic oligonucleotide
ccaaggcccggactatgttgttgtcgc

SEQ ID NO: 268199 - DNA, 27 bp, Artificial Sequence
  Description of Artificial Sequence: Synthetic oligonucleotide
caaggcccggactatgttgttgtcgcc

SEQ ID NO: 268200 - DNA, 28 bp, Artificial Sequence
  Description of Artificial Sequence: Synthetic oligonucleotide
aaggcccggactatgttgttgtcgcctg

SEQ ID NO: 268201 - DNA, 27 bp, Artificial Sequence
  Description of Artificial Sequence: Synthetic oligonucleotide
aggcccggactatgttgttgtcgcctg

SEQ ID NO: 268202 - DNA, 26 bp, Artificial Sequence
  Description of Artificial Sequence: Synthetic oligonucleotide
ggcccggactatgttgttgtcgcctg

SEQ ID NO: 268203 - DNA, 26 bp, Artificial Sequence
  Description of Artificial Sequence: Synthetic oligonucleotide
gcccggactatgttgttgtcgcctgc

SEQ ID NO: 268204 - DNA, 27 bp, Artificial Sequence
  Description of Artificial Sequence: Synthetic oligonucleotide
cccggactatgttgttgtcgcctgcga

SEQ ID NO: 268205 - DNA, 27 bp, Artificial Sequence
  Description of Artificial Sequence: Synthetic oligonucleotide
ccggactatgttgttgtcgcctgcgac

SEQ ID NO: 268206 - DNA, 27 bp, Artificial Sequence
  Description of Artificial Sequence: Synthetic oligonucleotide
cggactatgttgttgtcgcctgcgacc

SEQ ID NO: 268207 - DNA, 27 bp, Artificial Sequence
  Description of Artificial Sequence: Synthetic oligonucleotide
ggactatgttgttgtcgcctgcgaccg

SEQ ID NO: 268208 - DNA, 27 bp, Artificial Sequence
  Description of Artificial Sequence: Synthetic oligonucleotide
gactatgttgttgtcgcctgcgaccgg

SEQ ID NO: 268209 - DNA, 27 bp, Artificial Sequence
  Description of Artificial Sequence: Synthetic oligonucleotide
actatgttgttgtcgcctgcgaccggg

SEQ ID NO: 268210 - DNA, 27 bp, Artificial Sequence
  Description of Artificial Sequence: Synthetic oligonucleotide
ctatgttgttgtcgcctgcgaccgggt

SEQ ID NO: 268211 - DNA, 27 bp, Artificial Sequence
  Description of Artificial Sequence: Synthetic oligonucleotide
tatgttgttgtcgcctgcgaccgggtc

SEQ ID NO: 268212 - DNA, 26 bp, Artificial Sequence
  Description of Artificial Sequence: Synthetic oligonucleotide
atgttgttgtcgcctgcgaccgggtc

SEQ ID NO: 268213 - DNA, 25 bp, Artificial Sequence
  Description of Artificial Sequence: Synthetic oligonucleotide
tgttgttgtcgcctgcgaccgggtc

SEQ ID NO: 268214 - DNA, 24 bp, Artificial Sequence
  Description of Artificial Sequence: Synthetic oligonucleotide
gttgttgtcgcctgcgaccgggtc

SEQ ID NO: 268215 - DNA, 24 bp, Artificial Sequence
  Description of Artificial Sequence: Synthetic oligonucleotide
ttgttgtcgcctgcgaccgggtcg

SEQ ID NO: 268216 - DNA, 23 bp, Artificial Sequence
  Description of Artificial Sequence: Synthetic oligonucleotide
tgttgtcgcctgcgaccgggtcg

SEQ ID NO: 268217 - DNA, 22 bp, Artificial Sequence
  Description of Artificial Sequence: Synthetic oligonucleotide
gttgtcgcctgcgaccgggtcg

SEQ ID NO: 268218 - DNA, 22 bp, Artificial Sequence
  Description of Artificial Sequence: Synthetic oligonucleotide
ttgtcgcctgcgaccgggtcgc

SEQ ID NO: 268219 - DNA, 21 bp, Artificial Sequence
  Description of Artificial Sequence: Synthetic oligonucleotide
tgtcgcctgcgaccgggtcgc

SEQ ID NO: 268220 - DNA, 20 bp, Artificial Sequence
  Description of Artificial Sequence: Synthetic oligonucleotide
gtcgcctgcgaccgggtcgc

SEQ ID NO: 268221 - DNA, 20 bp, Artificial Sequence
  Description of Artificial Sequence: Synthetic oligonucleotide
tcgcctgcgaccgggtcgcc

SEQ ID NO: 268222 - DNA, 20 bp, Artificial Sequence
  Description of Artificial Sequence: Synthetic oligonucleotide
cgcctgcgaccgggtcgcct

SEQ ID NO: 268223 - DNA, 20 bp, Artificial Sequence
  Description of Artificial Sequence: Synthetic oligonucleotide
gcctgcgaccgggtcgccgt

SEQ ID NO: 268224 - DNA, 20 bp, Artificial Sequence
  Description of Artificial Sequence: Synthetic oligonucleotide
cctgcgaccgggtcgccgct

SEQ ID NO: 268225 - DNA, 20 bp, Artificial Sequence
  Description of Artificial Sequence: Synthetic oligonucleotide
ctgcgaccgggtcgccgcca

SEQ ID NO: 268226 - DNA, 20 bp, Artificial Sequence
  Description of Artificial Sequence: Synthetic oligonucleotide
tgcgaccgggtcgccgccag

SEQ ID NO: 268227 - DNA, 20 bp, Artificial Sequence
  Description of Artificial Sequence: Synthetic oligonucleotide
gcgaccgggtcgccgccagt

SEQ ID NO: 268228 - DNA, 25 bp, Artificial Sequence
  Description of Artificial Sequence: Synthetic oligonucleotide
cgaccgggtcgccgccagctatatt

SEQ ID NO: 268229 - DNA, 26 bp, Artificial Sequence
  Description of Artificial Sequence: Synthetic oligonucleotide
gaccgggtcgccgccagctatattgt

SEQ ID NO: 268230 - DNA, 26 bp, Artificial Sequence
  Description of Artificial Sequence: Synthetic oligonucleotide
accgggtcgccgccagctatattgtc

SEQ ID NO: 268231 - DNA, 25 bp, Artificial Sequence
  Description of Artificial Sequence: Synthetic oligonucleotide
ccgggtcgccgccagctatattgtc

SEQ ID NO: 268232 - DNA, 26 bp, Artificial Sequence
  Description of Artificial Sequence: Synthetic oligonucleotide
cgggtcgccgccagctatattgtcct

SEQ ID NO: 268233 - DNA, 27 bp, Artificial Sequence
  Description of Artificial Sequence: Synthetic oligonucleotide
gggtcgccgccagctatattgtcctga

SEQ ID NO: 268234 - DNA, 28 bp, Artificial Sequence
  Description of Artificial Sequence: Synthetic oligonucleotide
ggtcgccgccagctatattgtcctgatg

SEQ ID NO: 268235 - DNA, 30 bp, Artificial Sequence
  Description of Artificial Sequence: Synthetic oligonucleotide
gtcgccgccagctatattgtcctgatgaag

SEQ ID NO: 268236 - DNA, 30 bp, Artificial Sequence
  Description of Artificial Sequence: Synthetic oligonucleotide
tcgccgccagctatattgtcctgatgaagg

SEQ ID NO: 268237 - DNA, 29 bp, Artificial Sequence
  Description of Artificial Sequence: Synthetic oligonucleotide
cgccgccagctatattgtcctgatgaagg

SEQ ID NO: 268238 - DNA, 30 bp, Artificial Sequence
  Description of Artificial Sequence: Synthetic oligonucleotide
gccgccagctatattgtcctgatgaaggag

SEQ ID NO: 268239 - DNA, 30 bp, Artificial Sequence
  Description of Artificial Sequence: Synthetic oligonucleotide
ccgccagctatattgtcctgatgaaggagg

SEQ ID NO: 268240 - DNA, 32 bp, Artificial Sequence
  Description of Artificial Sequence: Synthetic oligonucleotide
cgccagctatattgtcctgatgaaggaggatc

SEQ ID NO: 268241 - DNA, 34 bp, Artificial Sequence
  Description of Artificial Sequence: Synthetic oligonucleotide
gccagctatattgtcctgatgaaggaggatcatg

SEQ ID NO: 268242 - DNA, 35 bp, Artificial Sequence
  Description of Artificial Sequence: Synthetic oligonucleotide
ccagctatattgtcctgatgaaggaggatcatgac

SEQ ID NO: 268243 - DNA, 37 bp, Artificial Sequence
  Description of Artificial Sequence: Synthetic oligonucleotide
cagctatattgtcctgatgaaggaggatcatgactag

SEQ ID NO: 268244 - DNA, 39 bp, Artificial Sequence
  Description of Artificial Sequence: Synthetic oligonucleotide
agctatattgtcctgatgaaggaggatcatgactagatg

SEQ ID NO: 268245 - DNA, 38 bp, Artificial Sequence
  Description of Artificial Sequence: Synthetic oligonucleotide
gctatattgtcctgatgaaggaggatcatgactagatg

SEQ ID NO: 268246 - DNA, 43 bp, Artificial Sequence
  Description of Artificial Sequence: Synthetic oligonucleotide
ctatattgtcctgatgaaggaggatcatgactagatgtttatg

SEQ ID NO: 268247 - DNA, 45 bp, Artificial Sequence
  Description of Artificial Sequence: Synthetic oligonucleotide
tatattgtcctgatgaaggaggatcatgactagatgtttatgatg

SEQ ID NO: 268248 - DNA, 44 bp, Artificial Sequence
  Description of Artificial Sequence: Synthetic oligonucleotide
atattgtcctgatgaaggaggatcatgactagatgtttatgatg

SEQ ID NO: 268249 - DNA, 43 bp, Artificial Sequence
  Description of Artificial Sequence: Synthetic oligonucleotide
tattgtcctgatgaaggaggatcatgactagatgtttatgatg

SEQ ID NO: 268250 - DNA, 42 bp, Artificial Sequence
  Description of Artificial Sequence: Synthetic oligonucleotide
attgtcctgatgaaggaggatcatgactagatgtttatgatg

SEQ ID NO: 268251 - DNA, 41 bp, Artificial Sequence
  Description of Artificial Sequence: Synthetic oligonucleotide
ttgtcctgatgaaggaggatcatgactagatgtttatgatg

SEQ ID NO: 268252 - DNA, 40 bp, Artificial Sequence
  Description of Artificial Sequence: Synthetic oligonucleotide
tgtcctgatgaaggaggatcatgactagatgtttatgatg

SEQ ID NO: 268253 - DNA, 39 bp, Artificial Sequence
  Description of Artificial Sequence: Synthetic oligonucleotide
gtcctgatgaaggaggatcatgactagatgtttatgatg

SEQ ID NO: 268254 - DNA, 40 bp, Artificial Sequence
  Description of Artificial Sequence: Synthetic oligonucleotide
tcctgatgaaggaggatcatgactagatgtttatgatgag

SEQ ID NO: 268255 - DNA, 39 bp, Artificial Sequence
  Description of Artificial Sequence: Synthetic oligonucleotide
cctgatgaaggaggatcatgactagatgtttatgatgag

SEQ ID NO: 268256 - DNA, 40 bp, Artificial Sequence
  Description of Artificial Sequence: Synthetic oligonucleotide
ctgatgaaggaggatcatgactagatgtttatgatgagtg

SEQ ID NO: 268257 - DNA, 44 bp, Artificial Sequence
  Description of Artificial Sequence: Synthetic oligonucleotide
tgatgaaggaggatcatgactagatgtttatgatgagtgataag

SEQ ID NO: 268258 - DNA, 43 bp, Artificial Sequence
  Description of Artificial Sequence: Synthetic oligonucleotide
gatgaaggaggatcatgactagatgtttatgatgagtgataag

SEQ ID NO: 268259 - DNA, 49 bp, Artificial Sequence
  Description of Artificial Sequence: Synthetic oligonucleotide
atgaaggaggatcatgactagatgtttatgatgagtgataagatattag

SEQ ID NO: 268260 - DNA, 48 bp, Artificial Sequence
  Description of Artificial Sequence: Synthetic oligonucleotide
tgaaggaggatcatgactagatgtttatgatgagtgataagatattag

SEQ ID NO: 268261 - DNA, 47 bp, Artificial Sequence
  Description of Artificial Sequence: Synthetic oligonucleotide
gaaggaggatcatgactagatgtttatgatgagtgataagatattag

SEQ ID NO: 268262 - DNA, 48 bp, Artificial Sequence
  Description of Artificial Sequence: Synthetic oligonucleotide
aaggaggatcatgactagatgtttatgatgagtgataagatattagtc

SEQ ID NO: 268263 - DNA, 47 bp, Artificial Sequence
  Description of Artificial Sequence: Synthetic oligonucleotide
aggaggatcatgactagatgtttatgatgagtgataagatattagtc

SEQ ID NO: 268264 - DNA, 46 bp, Artificial Sequence
  Description of Artificial Sequence: Synthetic oligonucleotide
ggaggatcatgactagatgtttatgatgagtgataagatattagtc

SEQ ID NO: 268265 - DNA, 46 bp, Artificial Sequence
  Description of Artificial Sequence: Synthetic oligonucleotide
gaggatcatgactagatgtttatgatgagtgataagatattagtcc

SEQ ID NO: 268266 - DNA, 47 bp, Artificial Sequence
  Description of Artificial Sequence: Synthetic oligonucleotide
aggatcatgactagatgtttatgatgagtgataagatattagtcctg

SEQ ID NO: 268267 - DNA, 46 bp, Artificial Sequence
  Description of Artificial Sequence: Synthetic oligonucleotide
ggatcatgactagatgtttatgatgagtgataagatattagtcctg

SEQ ID NO: 268268 - DNA, 47 bp, Artificial Sequence
  Description of Artificial Sequence: Synthetic oligonucleotide
gatcatgactagatgtttatgatgagtgataagatattagtcctgtg

SEQ ID NO: 268269 - DNA, 48 bp, Artificial Sequence
  Description of Artificial Sequence: Synthetic oligonucleotide
atcatgactagatgtttatgatgagtgataagatattagtcctgtgtg

SEQ ID NO: 268270 - DNA, 47 bp, Artificial Sequence
  Description of Artificial Sequence: Synthetic oligonucleotide
tcatgactagatgtttatgatgagtgataagatattagtcctgtgtg

SEQ ID NO: 268271 - DNA, 46 bp, Artificial Sequence
  Description of Artificial Sequence: Synthetic oligonucleotide
catgactagatgtttatgatgagtgataagatattagtcctgtgtg

SEQ ID NO: 268272 - DNA, 48 bp, Artificial Sequence
  Description of Artificial Sequence: Synthetic oligonucleotide
atgactagatgtttatgatgagtgataagatattagtcctgtgtgatg

SEQ ID NO: 268273 - DNA, 47 bp, Artificial Sequence
  Description of Artificial Sequence: Synthetic oligonucleotide
tgactagatgtttatgatgagtgataagatattagtcctgtgtgatg

SEQ ID NO: 268274 - DNA, 46 bp, Artificial Sequence
  Description of Artificial Sequence: Synthetic oligonucleotide
gactagatgtttatgatgagtgataagatattagtcctgtgtgatg

SEQ ID NO: 268275 - DNA, 46 bp, Artificial Sequence
  Description of Artificial Sequence: Synthetic oligonucleotide
actagatgtttatgatgagtgataagatattagtcctgtgtgatgg

SEQ ID NO: 268276 - DNA, 45 bp, Artificial Sequence
  Description of Artificial Sequence: Synthetic oligonucleotide
ctagatgtttatgatgagtgataagatattagtcctgtgtgatgg

SEQ ID NO: 268277 - DNA, 46 bp, Artificial Sequence
  Description of Artificial Sequence: Synthetic oligonucleotide
tagatgtttatgatgagtgataagatattagtcctgtgtgatggag

SEQ ID NO: 268278 - DNA, 45 bp, Artificial Sequence
  Description of Artificial Sequence: Synthetic oligonucleotide
agatgtttatgatgagtgataagatattagtcctgtgtgatggag

SEQ ID NO: 268279 - DNA, 44 bp, Artificial Sequence
  Description of Artificial Sequence: Synthetic oligonucleotide
gatgtttatgatgagtgataagatattagtcctgtgtgatggag

SEQ ID NO: 268280 - DNA, 45 bp, Artificial Sequence
  Description of Artificial Sequence: Synthetic oligonucleotide
atgtttatgatgagtgataagatattagtcctgtgtgatggagag

SEQ ID NO: 268281 - DNA, 44 bp, Artificial Sequence
  Description of Artificial Sequence: Synthetic oligonucleotide
tgtttatgatgagtgataagatattagtcctgtgtgatggagag

SEQ ID NO: 268282 - DNA, 43 bp, Artificial Sequence
  Description of Artificial Sequence: Synthetic oligonucleotide
gtttatgatgagtgataagatattagtcctgtgtgatggagag

SEQ ID NO: 268283 - DNA, 43 bp, Artificial Sequence
  Description of Artificial Sequence: Synthetic oligonucleotide
tttatgatgagtgataagatattagtcctgtgtgatggagagg

SEQ ID NO: 268284 - DNA, 42 bp, Artificial Sequence
  Description of Artificial Sequence: Synthetic oligonucleotide
ttatgatgagtgataagatattagtcctgtgtgatggagagg

SEQ ID NO: 268285 - DNA, 41 bp, Artificial Sequence
  Description of Artificial Sequence: Synthetic oligonucleotide
tatgatgagtgataagatattagtcctgtgtgatggagagg

SEQ ID NO: 268286 - DNA, 40 bp, Artificial Sequence
  Description of Artificial Sequence: Synthetic oligonucleotide
atgatgagtgataagatattagtcctgtgtgatggagagg

SEQ ID NO: 268287 - DNA, 39 bp, Artificial Sequence
  Description of Artificial Sequence: Synthetic oligonucleotide
tgatgagtgataagatattagtcctgtgtgatggagagg

SEQ ID NO: 268288 - DNA, 38 bp, Artificial Sequence
  Description of Artificial Sequence: Synthetic oligonucleotide
gatgagtgataagatattagtcctgtgtgatggagagg

SEQ ID NO: 268289 - DNA, 38 bp, Artificial Sequence
  Description of Artificial Sequence: Synthetic oligonucleotide
atgagtgataagatattagtcctgtgtgatggagaggc

SEQ ID NO: 268290 - DNA, 37 bp, Artificial Sequence
  Description of Artificial Sequence: Synthetic oligonucleotide
tgagtgataagatattagtcctgtgtgatggagaggc

SEQ ID NO: 268291 - DNA, 36 bp, Artificial Sequence
  Description of Artificial Sequence: Synthetic oligonucleotide
gagtgataagatattagtcctgtgtgatggagaggc

SEQ ID NO: 268292 - DNA, 37 bp, Artificial Sequence
  Description of Artificial Sequence: Synthetic oligonucleotide
agtgataagatattagtcctgtgtgatggagaggcag

SEQ ID NO: 268293 - DNA, 36 bp, Artificial Sequence
  Description of Artificial Sequence: Synthetic oligonucleotide
gtgataagatattagtcctgtgtgatggagaggcag

SEQ ID NO: 268294 - DNA, 36 bp, Artificial Sequence
  Description of Artificial Sequence: Synthetic oligonucleotide
tgataagatattagtcctgtgtgatggagaggcagg

SEQ ID NO: 268295 - DNA, 35 bp, Artificial Sequence
  Description of Artificial Sequence: Synthetic oligonucleotide
gataagatattagtcctgtgtgatggagaggcagg

SEQ ID NO: 268296 - DNA, 36 bp, Artificial Sequence
  Description of Artificial Sequence: Synthetic oligonucleotide
ataagatattagtcctgtgtgatggagaggcaggag

SEQ ID NO: 268297 - DNA, 35 bp, Artificial Sequence
  Description of Artificial Sequence: Synthetic oligonucleotide
taagatattagtcctgtgtgatggagaggcaggag

SEQ ID NO: 268298 - DNA, 34 bp, Artificial Sequence
  Description of Artificial Sequence: Synthetic oligonucleotide
aagatattagtcctgtgtgatggagaggcaggag

SEQ ID NO: 268299 - DNA, 33 bp, Artificial Sequence
  Description of Artificial Sequence: Synthetic oligonucleotide
agatattagtcctgtgtgatggagaggcaggag

SEQ ID NO: 268300 - DNA, 32 bp, Artificial Sequence
  Description of Artificial Sequence: Synthetic oligonucleotide
gatattagtcctgtgtgatggagaggcaggag

SEQ ID NO: 268301 - DNA, 33 bp, Artificial Sequence
  Description of Artificial Sequence: Synthetic oligonucleotide
atattagtcctgtgtgatggagaggcaggagac

SEQ ID NO: 268302 - DNA, 32 bp, Artificial Sequence
  Description of Artificial Sequence: Synthetic oligonucleotide
tattagtcctgtgtgatggagaggcaggagac

SEQ ID NO: 268303 - DNA, 31 bp, Artificial Sequence
  Description of Artificial Sequence: Synthetic oligonucleotide
attagtcctgtgtgatggagaggcaggagac

SEQ ID NO: 268304 - DNA, 30 bp, Artificial Sequence
  Description of Artificial Sequence: Synthetic oligonucleotide
ttagtcctgtgtgatggagaggcaggagac

SEQ ID NO: 268305 - DNA, 29 bp, Artificial Sequence
  Description of Artificial Sequence: Synthetic oligonucleotide
tagtcctgtgtgatggagaggcaggagac

SEQ ID NO: 268306 - DNA, 28 bp, Artificial Sequence
  Description of Artificial Sequence: Synthetic oligonucleotide
agtcctgtgtgatggagaggcaggagac

SEQ ID NO: 268307 - DNA, 27 bp, Artificial Sequence
  Description of Artificial Sequence: Synthetic oligonucleotide
gtcctgtgtgatggagaggcaggagac

SEQ ID NO: 268308 - DNA, 28 bp, Artificial Sequence
  Description of Artificial Sequence: Synthetic oligonucleotide
tcctgtgtgatggagaggcaggagacac

SEQ ID NO: 268309 - DNA, 27 bp, Artificial Sequence
  Description of Artificial Sequence: Synthetic oligonucleotide
cctgtgtgatggagaggcaggagacac

SEQ ID NO: 268310 - DNA, 28 bp, Artificial Sequence
  Description of Artificial Sequence: Synthetic oligonucleotide
ctgtgtgatggagaggcaggagacactc

SEQ ID NO: 268311 - DNA, 30 bp, Artificial Sequence
  Description of Artificial Sequence: Synthetic oligonucleotide
tgtgtgatggagaggcaggagacactctac

SEQ ID NO: 268312 - DNA, 29 bp, Artificial Sequence
  Description of Artificial Sequence: Synthetic oligonucleotide
gtgtgatggagaggcaggagacactctac

SEQ ID NO: 268313 - DNA, 30 bp, Artificial Sequence
  Description of Artificial Sequence: Synthetic oligonucleotide
tgtgatggagaggcaggagacactctacag

SEQ ID NO: 268314 - DNA, 29 bp, Artificial Sequence
  Description of Artificial Sequence: Synthetic oligonucleotide
gtgatggagaggcaggagacactctacag

SEQ ID NO: 268315 - DNA, 32 bp, Artificial Sequence
  Description of Artificial Sequence: Synthetic oligonucleotide
tgatggagaggcaggagacactctacagtttg

SEQ ID NO: 268316 - DNA, 31 bp, Artificial Sequence
  Description of Artificial Sequence: Synthetic oligonucleotide
gatggagaggcaggagacactctacagtttg

SEQ ID NO: 268317 - DNA, 31 bp, Artificial Sequence
  Description of Artificial Sequence: Synthetic oligonucleotide
atggagaggcaggagacactctacagtttgg

SEQ ID NO: 268318 - DNA, 30 bp, Artificial Sequence
  Description of Artificial Sequence: Synthetic oligonucleotide
tggagaggcaggagacactctacagtttgg

SEQ ID NO: 268319 - DNA, 29 bp, Artificial Sequence
  Description of Artificial Sequence: Synthetic oligonucleotide
ggagaggcaggagacactctacagtttgg

SEQ ID NO: 268320 - DNA, 30 bp, Artificial Sequence
  Description of Artificial Sequence: Synthetic oligonucleotide
gagaggcaggagacactctacagtttggag

SEQ ID NO: 268321 - DNA, 38 bp, Artificial Sequence
  Description of Artificial Sequence: Synthetic oligonucleotide
agaggcaggagacactctacagtttggagaatatatac

SEQ ID NO: 268322 - DNA, 37 bp, Artificial Sequence
  Description of Artificial Sequence: Synthetic oligonucleotide
gaggcaggagacactctacagtttggagaatatatac

SEQ ID NO: 268323 - DNA, 38 bp, Artificial Sequence
  Description of Artificial Sequence: Synthetic oligonucleotide
aggcaggagacactctacagtttggagaatatatacag

SEQ ID NO: 268324 - DNA, 37 bp, Artificial Sequence
  Description of Artificial Sequence: Synthetic oligonucleotide
ggcaggagacactctacagtttggagaatatatacag

SEQ ID NO: 268325 - DNA, 42 bp, Artificial Sequence
  Description of Artificial Sequence: Synthetic oligonucleotide
gcaggagacactctacagtttggagaatatatacagaaaaac

SEQ ID NO: 268326 - DNA, 42 bp, Artificial Sequence
  Description of Artificial Sequence: Synthetic oligonucleotide
caggagacactctacagtttggagaatatatacagaaaaacc

SEQ ID NO: 268327 - DNA, 43 bp, Artificial Sequence
  Description of Artificial Sequence: Synthetic oligonucleotide
aggagacactctacagtttggagaatatatacagaaaaacctg

SEQ ID NO: 268328 - DNA, 42 bp, Artificial Sequence
  Description of Artificial Sequence: Synthetic oligonucleotide
ggagacactctacagtttggagaatatatacagaaaaacctg

SEQ ID NO: 268329 - DNA, 42 bp, Artificial Sequence
  Description of Artificial Sequence: Synthetic oligonucleotide
gagacactctacagtttggagaatatatacagaaaaacctgc

SEQ ID NO: 268330 - DNA, 44 bp, Artificial Sequence
  Description of Artificial Sequence: Synthetic oligonucleotide
agacactctacagtttggagaatatatacagaaaaacctgcaac

SEQ ID NO: 268331 - DNA, 43 bp, Artificial Sequence
  Description of Artificial Sequence: Synthetic oligonucleotide
gacactctacagtttggagaatatatacagaaaaacctgcaac

SEQ ID NO: 268332 - DNA, 50 bp, Artificial Sequence
  Description of Artificial Sequence: Synthetic oligonucleotide
acactctacagtttggagaatatatacagaaaaacctgcaactttttaag

SEQ ID NO: 268333 - DNA, 49 bp, Artificial Sequence
  Description of Artificial Sequence: Synthetic oligonucleotide
cactctacagtttggagaatatatacagaaaaacctgcaactttttaag

SEQ ID NO: 268334 - DNA, 51 bp, Artificial Sequence
  Description of Artificial Sequence: Synthetic oligonucleotide
actctacagtttggagaatatatacagaaaaacctgcaactttttaagatg

SEQ ID NO: 268335 - DNA, 50 bp, Artificial Sequence
  Description of Artificial Sequence: Synthetic oligonucleotide
ctctacagtttggagaatatatacagaaaaacctgcaactttttaagatg

SEQ ID NO: 268336 - DNA, 50 bp, Artificial Sequence
  Description of Artificial Sequence: Synthetic oligonucleotide
tctacagtttggagaatatatacagaaaaacctgcaactttttaagatgc

SEQ ID NO: 268337 - DNA, 49 bp, Artificial Sequence
  Description of Artificial Sequence: Synthetic oligonucleotide
ctacagtttggagaatatatacagaaaaacctgcaactttttaagatgc

SEQ ID NO: 268338 - DNA, 49 bp, Artificial Sequence
  Description of Artificial Sequence: Synthetic oligonucleotide
tacagtttggagaatatatacagaaaaacctgcaactttttaagatgcg

SEQ ID NO: 268339 - DNA, 48 bp, Artificial Sequence
  Description of Artificial Sequence: Synthetic oligonucleotide
acagtttggagaatatatacagaaaaacctgcaactttttaagatgcg

SEQ ID NO: 268340 - DNA, 47 bp, Artificial Sequence
  Description of Artificial Sequence: Synthetic oligonucleotide
cagtttggagaatatatacagaaaaacctgcaactttttaagatgcg

SEQ ID NO: 268341 - DNA, 51 bp, Artificial Sequence
  Description of Artificial Sequence: Synthetic oligonucleotide
agtttggagaatatatacagaaaaacctgcaactttttaagatgcgtaatg

SEQ ID NO: 268342 - DNA, 50 bp, Artificial Sequence
  Description of Artificial Sequence: Synthetic oligonucleotide
gtttggagaatatatacagaaaaacctgcaactttttaagatgcgtaatg

SEQ ID NO: 268343 - DNA, 50 bp, Artificial Sequence
  Description of Artificial Sequence: Synthetic oligonucleotide
tttggagaatatatacagaaaaacctgcaactttttaagatgcgtaatgg

SEQ ID NO: 268344 - DNA, 49 bp, Artificial Sequence
  Description of Artificial Sequence: Synthetic oligonucleotide
ttggagaatatatacagaaaaacctgcaactttttaagatgcgtaatgg

SEQ ID NO: 268345 - DNA, 48 bp, Artificial Sequence
  Description of Artificial Sequence: Synthetic oligonucleotide
tggagaatatatacagaaaaacctgcaactttttaagatgcgtaatgg

SEQ ID NO: 268346 - DNA, 47 bp, Artificial Sequence
  Description of Artificial Sequence: Synthetic oligonucleotide
ggagaatatatacagaaaaacctgcaactttttaagatgcgtaatgg

SEQ ID NO: 268347 - DNA, 51 bp, Artificial Sequence
  Description of Artificial Sequence: Synthetic oligonucleotide
gagaatatatacagaaaaacctgcaactttttaagatgcgtaatggatatc

SEQ ID NO: 268348 - DNA, 55 bp, Artificial Sequence
  Description of Artificial Sequence: Synthetic oligonucleotide
agaatatatacagaaaaacctgcaactttttaagatgcgtaatggatatcaattg

SEQ ID NO: 268349 - DNA, 54 bp, Artificial Sequence
  Description of Artificial Sequence: Synthetic oligonucleotide
gaatatatacagaaaaacctgcaactttttaagatgcgtaatggatatcaattg

SEQ ID NO: 268350 - DNA, 55 bp, Artificial Sequence
  Description of Artificial Sequence: Synthetic oligonucleotide
aatatatacagaaaaacctgcaactttttaagatgcgtaatggatatcaattgtc

SEQ ID NO: 268351 - DNA, 54 bp, Artificial Sequence
  Description of Artificial Sequence: Synthetic oligonucleotide
atatatacagaaaaacctgcaactttttaagatgcgtaatggatatcaattgtc

SEQ ID NO: 268352 - DNA, 53 bp, Artificial Sequence
  Description of Artificial Sequence: Synthetic oligonucleotide
tatatacagaaaaacctgcaactttttaagatgcgtaatggatatcaattgtc

SEQ ID NO: 268353 - DNA, 52 bp, Artificial Sequence
  Description of Artificial Sequence: Synthetic oligonucleotide
atatacagaaaaacctgcaactttttaagatgcgtaatggatatcaattgtc

SEQ ID NO: 268354 - DNA, 51 bp, Artificial Sequence
  Description of Artificial Sequence: Synthetic oligonucleotide
tatacagaaaaacctgcaactttttaagatgcgtaatggatatcaattgtc

SEQ ID NO: 268355 - DNA, 50 bp, Artificial Sequence
  Description of Artificial Sequence: Synthetic oligonucleotide
atacagaaaaacctgcaactttttaagatgcgtaatggatatcaattgtc

SEQ ID NO: 268356 - DNA, 49 bp, Artificial Sequence
  Description of Artificial Sequence: Synthetic oligonucleotide
tacagaaaaacctgcaactttttaagatgcgtaatggatatcaattgtc

SEQ ID NO: 268357 - DNA, 48 bp, Artificial Sequence
  Description of Artificial Sequence: Synthetic oligonucleotide
acagaaaaacctgcaactttttaagatgcgtaatggatatcaattgtc

SEQ ID NO: 268358 - DNA, 47 bp, Artificial Sequence
  Description of Artificial Sequence: Synthetic oligonucleotide
cagaaaaacctgcaactttttaagatgcgtaatggatatcaattgtc

SEQ ID NO: 268359 - DNA, 48 bp, Artificial Sequence
  Description of Artificial Sequence: Synthetic oligonucleotide
agaaaaacctgcaactttttaagatgcgtaatggatatcaattgtctc

SEQ ID NO: 268360 - DNA, 47 bp, Artificial Sequence
  Description of Artificial Sequence: Synthetic oligonucleotide
gaaaaacctgcaactttttaagatgcgtaatggatatcaattgtctc

SEQ ID NO: 268361 - DNA, 47 bp, Artificial Sequence
  Description of Artificial Sequence: Synthetic oligonucleotide
aaaaacctgcaactttttaagatgcgtaatggatatcaattgtctcg

SEQ ID NO: 268362 - DNA, 46 bp, Artificial Sequence
  Description of Artificial Sequence: Synthetic oligonucleotide
aaaacctgcaactttttaagatgcgtaatggatatcaattgtctcg

SEQ ID NO: 268363 - DNA, 45 bp, Artificial Sequence
  Description of Artificial Sequence: Synthetic oligonucleotide
aaacctgcaactttttaagatgcgtaatggatatcaattgtctcg

SEQ ID NO: 268364 - DNA, 44 bp, Artificial Sequence
  Description of Artificial Sequence: Synthetic oligonucleotide
aacctgcaactttttaagatgcgtaatggatatcaattgtctcg

SEQ ID NO: 268365 - DNA, 43 bp, Artificial Sequence
  Description of Artificial Sequence: Synthetic oligonucleotide
acctgcaactttttaagatgcgtaatggatatcaattgtctcg

SEQ ID NO: 268366 - DNA, 42 bp, Artificial Sequence
  Description of Artificial Sequence: Synthetic oligonucleotide
cctgcaactttttaagatgcgtaatggatatcaattgtctcg

SEQ ID NO: 268367 - DNA, 42 bp, Artificial Sequence
  Description of Artificial Sequence: Synthetic oligonucleotide
ctgcaactttttaagatgcgtaatggatatcaattgtctcgc

SEQ ID NO: 268368 - DNA, 43 bp, Artificial Sequence
  Description of Artificial Sequence: Synthetic oligonucleotide
tgcaactttttaagatgcgtaatggatatcaattgtctcgcac

SEQ ID NO: 268369 - DNA, 42 bp, Artificial Sequence
  Description of Artificial Sequence: Synthetic oligonucleotide
gcaactttttaagatgcgtaatggatatcaattgtctcgcac

SEQ ID NO: 268370 - DNA, 42 bp, Artificial Sequence
  Description of Artificial Sequence: Synthetic oligonucleotide
caactttttaagatgcgtaatggatatcaattgtctcgcacg

SEQ ID NO: 268371 - DNA, 42 bp, Artificial Sequence
  Description of Artificial Sequence: Synthetic oligonucleotide
aactttttaagatgcgtaatggatatcaattgtctcgcacgg

SEQ ID NO: 268372 - DNA, 41 bp, Artificial Sequence
  Description of Artificial Sequence: Synthetic oligonucleotide
actttttaagatgcgtaatggatatcaattgtctcgcacgg

SEQ ID NO: 268373 - DNA, 40 bp, Artificial Sequence
  Description of Artificial Sequence: Synthetic oligonucleotide
ctttttaagatgcgtaatggatatcaattgtctcgcacgg

SEQ ID NO: 268374 - DNA, 40 bp, Artificial Sequence
  Description of Artificial Sequence: Synthetic oligonucleotide
tttttaagatgcgtaatggatatcaattgtctcgcacggc

SEQ ID NO: 268375 - DNA, 39 bp, Artificial Sequence
  Description of Artificial Sequence: Synthetic oligonucleotide
ttttaagatgcgtaatggatatcaattgtctcgcacggc

SEQ ID NO: 268376 - DNA, 38 bp, Artificial Sequence
  Description of Artificial Sequence: Synthetic oligonucleotide
tttaagatgcgtaatggatatcaattgtctcgcacggc

SEQ ID NO: 268377 - DNA, 37 bp, Artificial Sequence
  Description of Artificial Sequence: Synthetic oligonucleotide
ttaagatgcgtaatggatatcaattgtctcgcacggc

SEQ ID NO: 268378 - DNA, 36 bp, Artificial Sequence
  Description of Artificial Sequence: Synthetic oligonucleotide
taagatgcgtaatggatatcaattgtctcgcacggc

SEQ ID NO: 268379 - DNA, 35 bp, Artificial Sequence
  Description of Artificial Sequence: Synthetic oligonucleotide
aagatgcgtaatggatatcaattgtctcgcacggc

SEQ ID NO: 268380 - DNA, 34 bp, Artificial Sequence
  Description of Artificial Sequence: Synthetic oligonucleotide
agatgcgtaatggatatcaattgtctcgcacggc

SEQ ID NO: 268381 - DNA, 33 bp, Artificial Sequence
  Description of Artificial Sequence: Synthetic oligonucleotide
gatgcgtaatggatatcaattgtctcgcacggc

SEQ ID NO: 268382 - DNA, 34 bp, Artificial Sequence
  Description of Artificial Sequence: Synthetic oligonucleotide
atgcgtaatggatatcaattgtctcgcacggcag

SEQ ID NO: 268383 - DNA, 33 bp, Artificial Sequence
  Description of Artificial Sequence: Synthetic oligonucleotide
tgcgtaatggatatcaattgtctcgcacggcag

SEQ ID NO: 268384 - DNA, 32 bp, Artificial Sequence
  Description of Artificial Sequence: Synthetic oligonucleotide
gcgtaatggatatcaattgtctcgcacggcag

SEQ ID NO: 268385 - DNA, 32 bp, Artificial Sequence
  Description of Artificial Sequence: Synthetic oligonucleotide
cgtaatggatatcaattgtctcgcacggcagc

SEQ ID NO: 268386 - DNA, 33 bp, Artificial Sequence
  Description of Artificial Sequence: Synthetic oligonucleotide
gtaatggatatcaattgtctcgcacggcagctg

SEQ ID NO: 268387 - DNA, 33 bp, Artificial Sequence
  Description of Artificial Sequence: Synthetic oligonucleotide
taatggatatcaattgtctcgcacggcagctgc

SEQ ID NO: 268388 - DNA, 32 bp, Artificial Sequence
  Description of Artificial Sequence: Synthetic oligonucleotide
aatggatatcaattgtctcgcacggcagctgc

SEQ ID NO: 268389 - DNA, 31 bp, Artificial Sequence
  Description of Artificial Sequence: Synthetic oligonucleotide
atggatatcaattgtctcgcacggcagctgc

SEQ ID NO: 268390 - DNA, 30 bp, Artificial Sequence
  Description of Artificial Sequence: Synthetic oligonucleotide
tggatatcaattgtctcgcacggcagctgc

SEQ ID NO: 268391 - DNA, 29 bp, Artificial Sequence
  Description of Artificial Sequence: Synthetic oligonucleotide
ggatatcaattgtctcgcacggcagctgc

SEQ ID NO: 268392 - DNA, 32 bp, Artificial Sequence
  Description of Artificial Sequence: Synthetic oligonucleotide
gatatcaattgtctcgcacggcagctgctaac

SEQ ID NO: 268393 - DNA, 34 bp, Artificial Sequence
  Description of Artificial Sequence: Synthetic oligonucleotide
atatcaattgtctcgcacggcagctgctaacttc

SEQ ID NO: 268394 - DNA, 33 bp, Artificial Sequence
  Description of Artificial Sequence: Synthetic oligonucleotide
tatcaattgtctcgcacggcagctgctaacttc

SEQ ID NO: 268395 - DNA, 32 bp, Artificial Sequence
  Description of Artificial Sequence: Synthetic oligonucleotide
atcaattgtctcgcacggcagctgctaacttc

SEQ ID NO: 268396 - DNA, 31 bp, Artificial Sequence
  Description of Artificial Sequence: Synthetic oligonucleotide
tcaattgtctcgcacggcagctgctaacttc

SEQ ID NO: 268397 - DNA, 30 bp, Artificial Sequence
  Description of Artificial Sequence: Synthetic oligonucleotide
caattgtctcgcacggcagctgctaacttc

SEQ ID NO: 268398 - DNA, 31 bp, Artificial Sequence
  Description of Artificial Sequence: Synthetic oligonucleotide
aattgtctcgcacggcagctgctaacttctc

SEQ ID NO: 268399 - DNA, 30 bp, Artificial Sequence
  Description of Artificial Sequence: Synthetic oligonucleotide
attgtctcgcacggcagctgctaacttctc

SEQ ID NO: 268400 - DNA, 29 bp, Artificial Sequence
  Description of Artificial Sequence: Synthetic oligonucleotide
ttgtctcgcacggcagctgctaacttctc

SEQ ID NO: 268401 - DNA, 28 bp, Artificial Sequence
  Description of Artificial Sequence: Synthetic oligonucleotide
tgtctcgcacggcagctgctaacttctc

SEQ ID NO: 268402 - DNA, 27 bp, Artificial Sequence
  Description of Artificial Sequence: Synthetic oligonucleotide
gtctcgcacggcagctgctaacttctc

SEQ ID NO: 268403 - DNA, 28 bp, Artificial Sequence
  Description of Artificial Sequence: Synthetic oligonucleotide
tctcgcacggcagctgctaacttctcac

SEQ ID NO: 268404 - DNA, 27 bp, Artificial Sequence
  Description of Artificial Sequence: Synthetic oligonucleotide
ctcgcacggcagctgctaacttctcac

SEQ ID NO: 268405 - DNA, 27 bp, Artificial Sequence
  Description of Artificial Sequence: Synthetic oligonucleotide
tcgcacggcagctgctaacttctcacg

SEQ ID NO: 268406 - DNA, 26 bp, Artificial Sequence
  Description of Artificial Sequence: Synthetic oligonucleotide
cgcacggcagctgctaacttctcacg

SEQ ID NO: 268407 - DNA, 26 bp, Artificial Sequence
  Description of Artificial Sequence: Synthetic oligonucleotide
gcacggcagctgctaacttctcacgc

SEQ ID NO: 268408 - DNA, 26 bp, Artificial Sequence
  Description of Artificial Sequence: Synthetic oligonucleotide
cacggcagctgctaacttctcacgcc

SEQ ID NO: 268409 - DNA, 27 bp, Artificial Sequence
  Description of Artificial Sequence: Synthetic oligonucleotide
acggcagctgctaacttctcacgccga

SEQ ID NO: 268410 - DNA, 27 bp, Artificial Sequence
  Description of Artificial Sequence: Synthetic oligonucleotide
cggcagctgctaacttctcacgccgaa

SEQ ID NO: 268411 - DNA, 28 bp, Artificial Sequence
  Description of Artificial Sequence: Synthetic oligonucleotide
ggcagctgctaacttctcacgccgaatc

SEQ ID NO: 268412 - DNA, 28 bp, Artificial Sequence
  Description of Artificial Sequence: Synthetic oligonucleotide
gcagctgctaacttctcacgccgaatcc

SEQ ID NO: 268413 - DNA, 29 bp, Artificial Sequence
  Description of Artificial Sequence: Synthetic oligonucleotide
cagctgctaacttctcacgccgaatcctg

SEQ ID NO: 268414 - DNA, 29 bp, Artificial Sequence
  Description of Artificial Sequence: Synthetic oligonucleotide
agctgctaacttctcacgccgaatcctgg

SEQ ID NO: 268415 - DNA, 28 bp, Artificial Sequence
  Description of Artificial Sequence: Synthetic oligonucleotide
gctgctaacttctcacgccgaatcctgg

SEQ ID NO: 268416 - DNA, 28 bp, Artificial Sequence
  Description of Artificial Sequence: Synthetic oligonucleotide
ctgctaacttctcacgccgaatcctggc

SEQ ID NO: 268417 - DNA, 29 bp, Artificial Sequence
  Description of Artificial Sequence: Synthetic oligonucleotide
tgctaacttctcacgccgaatcctggctg

SEQ ID NO: 268418 - DNA, 28 bp, Artificial Sequence
  Description of Artificial Sequence: Synthetic oligonucleotide
gctaacttctcacgccgaatcctggctg

SEQ ID NO: 268419 - DNA, 29 bp, Artificial Sequence
  Description of Artificial Sequence: Synthetic oligonucleotide
ctaacttctcacgccgaatcctggctgag

SEQ ID NO: 268420 - DNA, 30 bp, Artificial Sequence
  Description of Artificial Sequence: Synthetic oligonucleotide
taacttctcacgccgaatcctggctgagtg

SEQ ID NO: 268421 - DNA, 29 bp, Artificial Sequence
  Description of Artificial Sequence: Synthetic oligonucleotide
aacttctcacgccgaatcctggctgagtg

SEQ ID NO: 268422 - DNA, 28 bp, Artificial Sequence
  Description of Artificial Sequence: Synthetic oligonucleotide
acttctcacgccgaatcctggctgagtg

SEQ ID NO: 268423 - DNA, 27 bp, Artificial Sequence
  Description of Artificial Sequence: Synthetic oligonucleotide
cttctcacgccgaatcctggctgagtg

SEQ ID NO: 268424 - DNA, 28 bp, Artificial Sequence
  Description of Artificial Sequence: Synthetic oligonucleotide
ttctcacgccgaatcctggctgagtgtc

SEQ ID NO: 268425 - DNA, 27 bp, Artificial Sequence
  Description of Artificial Sequence: Synthetic oligonucleotide
tctcacgccgaatcctggctgagtgtc

SEQ ID NO: 268426 - DNA, 27 bp, Artificial Sequence
  Description of Artificial Sequence: Synthetic oligonucleotide
ctcacgccgaatcctggctgagtgtct

SEQ ID NO: 268427 - DNA, 28 bp, Artificial Sequence
  Description of Artificial Sequence: Synthetic oligonucleotide
tcacgccgaatcctggctgagtgtcttc

SEQ ID NO: 268428 - DNA, 27 bp, Artificial Sequence
  Description of Artificial Sequence: Synthetic oligonucleotide
cacgccgaatcctggctgagtgtcttc

SEQ ID NO: 268429 - DNA, 27 bp, Artificial Sequence
  Description of Artificial Sequence: Synthetic oligonucleotide
acgccgaatcctggctgagtgtcttcg

SEQ ID NO: 268430 - DNA, 26 bp, Artificial Sequence
  Description of Artificial Sequence: Synthetic oligonucleotide
cgccgaatcctggctgagtgtcttcg

SEQ ID NO: 268431 - DNA, 27 bp, Artificial Sequence
  Description of Artificial Sequence: Synthetic oligonucleotide
gccgaatcctggctgagtgtcttcggt

SEQ ID NO: 268432 - DNA, 27 bp, Artificial Sequence
  Description of Artificial Sequence: Synthetic oligonucleotide
ccgaatcctggctgagtgtcttcggtg

SEQ ID NO: 268433 - DNA, 28 bp, Artificial Sequence
  Description of Artificial Sequence: Synthetic oligonucleotide
cgaatcctggctgagtgtcttcggtgtc

SEQ ID NO: 268434 - DNA, 28 bp, Artificial Sequence
  Description of Artificial Sequence: Synthetic oligonucleotide
gaatcctggctgagtgtcttcggtgtcg

SEQ ID NO: 268435 - DNA, 28 bp, Artificial Sequence
  Description of Artificial Sequence: Synthetic oligonucleotide
aatcctggctgagtgtcttcggtgtcgg

SEQ ID NO: 268436 - DNA, 27 bp, Artificial Sequence
  Description of Artificial Sequence: Synthetic oligonucleotide
atcctggctgagtgtcttcggtgtcgg

SEQ ID NO: 268437 - DNA, 27 bp, Artificial Sequence
  Description of Artificial Sequence: Synthetic oligonucleotide
tcctggctgagtgtcttcggtgtcgga

SEQ ID NO: 268438 - DNA, 26 bp, Artificial Sequence
  Description of Artificial Sequence: Synthetic oligonucleotide
cctggctgagtgtcttcggtgtcgga

SEQ ID NO: 268439 - DNA, 26 bp, Artificial Sequence
  Description of Artificial Sequence: Synthetic oligonucleotide
ctggctgagtgtcttcggtgtcggac

SEQ ID NO: 268440 - DNA, 26 bp, Artificial Sequence
  Description of Artificial Sequence: Synthetic oligonucleotide
tggctgagtgtcttcggtgtcggacc

SEQ ID NO: 268441 - DNA, 25 bp, Artificial Sequence
  Description of Artificial Sequence: Synthetic oligonucleotide
ggctgagtgtcttcggtgtcggacc

SEQ ID NO: 268442 - DNA, 25 bp, Artificial Sequence
  Description of Artificial Sequence: Synthetic oligonucleotide
gctgagtgtcttcggtgtcggaccc

SEQ ID NO: 268443 - DNA, 27 bp, Artificial Sequence
  Description of Artificial Sequence: Synthetic oligonucleotide
ctgagtgtcttcggtgtcggacccgat

SEQ ID NO: 268444 - DNA, 29 bp, Artificial Sequence
  Description of Artificial Sequence: Synthetic oligonucleotide
tgagtgtcttcggtgtcggacccgatatc

SEQ ID NO: 268445 - DNA, 28 bp, Artificial Sequence
  Description of Artificial Sequence: Synthetic oligonucleotide
gagtgtcttcggtgtcggacccgatatc

SEQ ID NO: 268446 - DNA, 30 bp, Artificial Sequence
  Description of Artificial Sequence: Synthetic oligonucleotide
agtgtcttcggtgtcggacccgatatcatg

SEQ ID NO: 268447 - DNA, 29 bp, Artificial Sequence
  Description of Artificial Sequence: Synthetic oligonucleotide
gtgtcttcggtgtcggacccgatatcatg

SEQ ID NO: 268448 - DNA, 30 bp, Artificial Sequence
  Description of Artificial Sequence: Synthetic oligonucleotide
tgtcttcggtgtcggacccgatatcatgtc

SEQ ID NO: 268449 - DNA, 29 bp, Artificial Sequence
  Description of Artificial Sequence: Synthetic oligonucleotide
gtcttcggtgtcggacccgatatcatgtc

SEQ ID NO: 268450 - DNA, 31 bp, Artificial Sequence
  Description of Artificial Sequence: Synthetic oligonucleotide
tcttcggtgtcggacccgatatcatgtcaac

SEQ ID NO: 268451 - DNA, 30 bp, Artificial Sequence
  Description of Artificial Sequence: Synthetic oligonucleotide
cttcggtgtcggacccgatatcatgtcaac

SEQ ID NO: 268452 - DNA, 30 bp, Artificial Sequence
  Description of Artificial Sequence: Synthetic oligonucleotide
ttcggtgtcggacccgatatcatgtcaacc

SEQ ID NO: 268453 - DNA, 29 bp, Artificial Sequence
  Description of Artificial Sequence: Synthetic oligonucleotide
tcggtgtcggacccgatatcatgtcaacc

SEQ ID NO: 268454 - DNA, 28 bp, Artificial Sequence
  Description of Artificial Sequence: Synthetic oligonucleotide
cggtgtcggacccgatatcatgtcaacc

SEQ ID NO: 268455 - DNA, 29 bp, Artificial Sequence
  Description of Artificial Sequence: Synthetic oligonucleotide
ggtgtcggacccgatatcatgtcaacctc

SEQ ID NO: 268456 - DNA, 29 bp, Artificial Sequence
  Description of Artificial Sequence: Synthetic oligonucleotide
gtgtcggacccgatatcatgtcaacctcc

SEQ ID NO: 268457 - DNA, 30 bp, Artificial Sequence
  Description of Artificial Sequence: Synthetic oligonucleotide
tgtcggacccgatatcatgtcaacctcctc

SEQ ID NO: 268458 - DNA, 29 bp, Artificial Sequence
  Description of Artificial Sequence: Synthetic oligonucleotide
gtcggacccgatatcatgtcaacctcctc

SEQ ID NO: 268459 - DNA, 29 bp, Artificial Sequence
  Description of Artificial Sequence: Synthetic oligonucleotide
tcggacccgatatcatgtcaacctcctcg

SEQ ID NO: 268460 - DNA, 28 bp, Artificial Sequence
  Description of Artificial Sequence: Synthetic oligonucleotide
cggacccgatatcatgtcaacctcctcg

SEQ ID NO: 268461 - DNA, 29 bp, Artificial Sequence
  Description of Artificial Sequence: Synthetic oligonucleotide
ggacccgatatcatgtcaacctcctcgtg

SEQ ID NO: 268462 - DNA, 29 bp, Artificial Sequence
  Description of Artificial Sequence: Synthetic oligonucleotide
gacccgatatcatgtcaacctcctcgtgg

SEQ ID NO: 268463 - DNA, 29 bp, Artificial Sequence
  Description of Artificial Sequence: Synthetic oligonucleotide
acccgatatcatgtcaacctcctcgtggc

SEQ ID NO: 268464 - DNA, 28 bp, Artificial Sequence
  Description of Artificial Sequence: Synthetic oligonucleotide
cccgatatcatgtcaacctcctcgtggc

SEQ ID NO: 268465 - DNA, 29 bp, Artificial Sequence
  Description of Artificial Sequence: Synthetic oligonucleotide
ccgatatcatgtcaacctcctcgtggctg

SEQ ID NO: 268466 - DNA, 29 bp, Artificial Sequence
  Description of Artificial Sequence: Synthetic oligonucleotide
cgatatcatgtcaacctcctcgtggctgg

SEQ ID NO: 268467 - DNA, 29 bp, Artificial Sequence
  Description of Artificial Sequence: Synthetic oligonucleotide
gatatcatgtcaacctcctcgtggctggc

SEQ ID NO: 268468 - DNA, 32 bp, Artificial Sequence
  Description of Artificial Sequence: Synthetic oligonucleotide
atatcatgtcaacctcctcgtggctggctttg

SEQ ID NO: 268469 - DNA, 31 bp, Artificial Sequence
  Description of Artificial Sequence: Synthetic oligonucleotide
tatcatgtcaacctcctcgtggctggctttg

SEQ ID NO: 268470 - DNA, 30 bp, Artificial Sequence
  Description of Artificial Sequence: Synthetic oligonucleotide
atcatgtcaacctcctcgtggctggctttg

SEQ ID NO: 268471 - DNA, 29 bp, Artificial Sequence
  Description of Artificial Sequence: Synthetic oligonucleotide
tcatgtcaacctcctcgtggctggctttg

SEQ ID NO: 268472 - DNA, 28 bp, Artificial Sequence
  Description of Artificial Sequence: Synthetic oligonucleotide
catgtcaacctcctcgtggctggctttg

SEQ ID NO: 268473 - DNA, 30 bp, Artificial Sequence
  Description of Artificial Sequence: Synthetic oligonucleotide
atgtcaacctcctcgtggctggctttgatg

SEQ ID NO: 268474 - DNA, 29 bp, Artificial Sequence
  Description of Artificial Sequence: Synthetic oligonucleotide
tgtcaacctcctcgtggctggctttgatg

SEQ ID NO: 268475 - DNA, 28 bp, Artificial Sequence
  Description of Artificial Sequence: Synthetic oligonucleotide
gtcaacctcctcgtggctggctttgatg

SEQ ID NO: 268476 - DNA, 29 bp, Artificial Sequence
  Description of Artificial Sequence: Synthetic oligonucleotide
tcaacctcctcgtggctggctttgatgag

SEQ ID NO: 268477 - DNA, 28 bp, Artificial Sequence
  Description of Artificial Sequence: Synthetic oligonucleotide
caacctcctcgtggctggctttgatgag

SEQ ID NO: 268478 - DNA, 28 bp, Artificial Sequence
  Description of Artificial Sequence: Synthetic oligonucleotide
aacctcctcgtggctggctttgatgagc

SEQ ID NO: 268479 - DNA, 27 bp, Artificial Sequence
  Description of Artificial Sequence: Synthetic oligonucleotide
acctcctcgtggctggctttgatgagc

SEQ ID NO: 268480 - DNA, 27 bp, Artificial Sequence
  Description of Artificial Sequence: Synthetic oligonucleotide
cctcctcgtggctggctttgatgagca

SEQ ID NO: 268481 - DNA, 28 bp, Artificial Sequence
  Description of Artificial Sequence: Synthetic oligonucleotide
ctcctcgtggctggctttgatgagcaag

SEQ ID NO: 268482 - DNA, 30 bp, Artificial Sequence
  Description of Artificial Sequence: Synthetic oligonucleotide
tcctcgtggctggctttgatgagcaagaag

SEQ ID NO: 268483 - DNA, 29 bp, Artificial Sequence
  Description of Artificial Sequence: Synthetic oligonucleotide
cctcgtggctggctttgatgagcaagaag

SEQ ID NO: 268484 - DNA, 29 bp, Artificial Sequence
  Description of Artificial Sequence: Synthetic oligonucleotide
ctcgtggctggctttgatgagcaagaagg

SEQ ID NO: 268485 - DNA, 29 bp, Artificial Sequence
  Description of Artificial Sequence: Synthetic oligonucleotide
tcgtggctggctttgatgagcaagaaggg

SEQ ID NO: 268486 - DNA, 28 bp, Artificial Sequence
  Description of Artificial Sequence: Synthetic oligonucleotide
cgtggctggctttgatgagcaagaaggg

SEQ ID NO: 268487 - DNA, 28 bp, Artificial Sequence
  Description of Artificial Sequence: Synthetic oligonucleotide
gtggctggctttgatgagcaagaagggc

SEQ ID NO: 268488 - DNA, 28 bp, Artificial Sequence
  Description of Artificial Sequence: Synthetic oligonucleotide
tggctggctttgatgagcaagaagggcc

SEQ ID NO: 268489 - DNA, 27 bp, Artificial Sequence
  Description of Artificial Sequence: Synthetic oligonucleotide
ggctggctttgatgagcaagaagggcc

SEQ ID NO: 268490 - DNA, 28 bp, Artificial Sequence
  Description of Artificial Sequence: Synthetic oligonucleotide
gctggctttgatgagcaagaagggccac

SEQ ID NO: 268491 - DNA, 28 bp, Artificial Sequence
  Description of Artificial Sequence: Synthetic oligonucleotide
ctggctttgatgagcaagaagggccacc

SEQ ID NO: 268492 - DNA, 28 bp, Artificial Sequence
  Description of Artificial Sequence: Synthetic oligonucleotide
tggctttgatgagcaagaagggccaccg

SEQ ID NO: 268493 - DNA, 27 bp, Artificial Sequence
  Description of Artificial Sequence: Synthetic oligonucleotide
ggctttgatgagcaagaagggccaccg

SEQ ID NO: 268494 - DNA, 27 bp, Artificial Sequence
  Description of Artificial Sequence: Synthetic oligonucleotide
gctttgatgagcaagaagggccaccgc

SEQ ID NO: 268495 - DNA, 28 bp, Artificial Sequence
  Description of Artificial Sequence: Synthetic oligonucleotide
ctttgatgagcaagaagggccaccgctg

SEQ ID NO: 268496 - DNA, 33 bp, Artificial Sequence
  Description of Artificial Sequence: Synthetic oligonucleotide
tttgatgagcaagaagggccaccgctgtatttc

SEQ ID NO: 268497 - DNA, 32 bp, Artificial Sequence
  Description of Artificial Sequence: Synthetic oligonucleotide
ttgatgagcaagaagggccaccgctgtatttc

SEQ ID NO: 268498 - DNA, 31 bp, Artificial Sequence
  Description of Artificial Sequence: Synthetic oligonucleotide
tgatgagcaagaagggccaccgctgtatttc

SEQ ID NO: 268499 - DNA, 30 bp, Artificial Sequence
  Description of Artificial Sequence: Synthetic oligonucleotide
gatgagcaagaagggccaccgctgtatttc

SEQ ID NO: 268500 - DNA, 32 bp, Artificial Sequence
  Description of Artificial Sequence: Synthetic oligonucleotide
atgagcaagaagggccaccgctgtatttcatg

SEQ ID NO: 268501 - DNA, 31 bp, Artificial Sequence
  Description of Artificial Sequence: Synthetic oligonucleotide
tgagcaagaagggccaccgctgtatttcatg

SEQ ID NO: 268502 - DNA, 30 bp, Artificial Sequence
  Description of Artificial Sequence: Synthetic oligonucleotide
gagcaagaagggccaccgctgtatttcatg

SEQ ID NO: 268503 - DNA, 30 bp, Artificial Sequence
  Description of Artificial Sequence: Synthetic oligonucleotide
agcaagaagggccaccgctgtatttcatgg

SEQ ID NO: 268504 - DNA, 29 bp, Artificial Sequence
  Description of Artificial Sequence: Synthetic oligonucleotide
gcaagaagggccaccgctgtatttcatgg

SEQ ID NO: 268505 - DNA, 30 bp, Artificial Sequence
  Description of Artificial Sequence: Synthetic oligonucleotide
caagaagggccaccgctgtatttcatggac

SEQ ID NO: 268506 - DNA, 32 bp, Artificial Sequence
  Description of Artificial Sequence: Synthetic oligonucleotide
aagaagggccaccgctgtatttcatggactag

SEQ ID NO: 268507 - DNA, 31 bp, Artificial Sequence
  Description of Artificial Sequence: Synthetic oligonucleotide
agaagggccaccgctgtatttcatggactag

SEQ ID NO: 268508 - DNA, 30 bp, Artificial Sequence
  Description of Artificial Sequence: Synthetic oligonucleotide
gaagggccaccgctgtatttcatggactag

SEQ ID NO: 268509 - DNA, 30 bp, Artificial Sequence
  Description of Artificial Sequence: Synthetic oligonucleotide
aagggccaccgctgtatttcatggactagc

SEQ ID NO: 268510 - DNA, 29 bp, Artificial Sequence
  Description of Artificial Sequence: Synthetic oligonucleotide
agggccaccgctgtatttcatggactagc

SEQ ID NO: 268511 - DNA, 28 bp, Artificial Sequence
  Description of Artificial Sequence: Synthetic oligonucleotide
gggccaccgctgtatttcatggactagc

SEQ ID NO: 268512 - DNA, 29 bp, Artificial Sequence
  Description of Artificial Sequence: Synthetic oligonucleotide
ggccaccgctgtatttcatggactagctg

SEQ ID NO: 268513 - DNA, 29 bp, Artificial Sequence
  Description of Artificial Sequence: Synthetic oligonucleotide
gccaccgctgtatttcatggactagctgg

SEQ ID NO: 268514 - DNA, 29 bp, Artificial Sequence
  Description of Artificial Sequence: Synthetic oligonucleotide
ccaccgctgtatttcatggactagctggc

SEQ ID NO: 268515 - DNA, 30 bp, Artificial Sequence
  Description of Artificial Sequence: Synthetic oligonucleotide
caccgctgtatttcatggactagctggcag

SEQ ID NO: 268516 - DNA, 30 bp, Artificial Sequence
  Description of Artificial Sequence: Synthetic oligonucleotide
accgctgtatttcatggactagctggcagc

SEQ ID NO: 268517 - DNA, 29 bp, Artificial Sequence
  Description of Artificial Sequence: Synthetic oligonucleotide
ccgctgtatttcatggactagctggcagc

SEQ ID NO: 268518 - DNA, 29 bp, Artificial Sequence
  Description of Artificial Sequence: Synthetic oligonucleotide
cgctgtatttcatggactagctggcagcc

SEQ ID NO: 268519 - DNA, 31 bp, Artificial Sequence
  Description of Artificial Sequence: Synthetic oligonucleotide
gctgtatttcatggactagctggcagccatg

SEQ ID NO: 268520 - DNA, 31 bp, Artificial Sequence
  Description of Artificial Sequence: Synthetic oligonucleotide
ctgtatttcatggactagctggcagccatgg

SEQ ID NO: 268521 - DNA, 31 bp, Artificial Sequence
  Description of Artificial Sequence: Synthetic oligonucleotide
tgtatttcatggactagctggcagccatggc

SEQ ID NO: 268522 - DNA, 30 bp, Artificial Sequence
  Description of Artificial Sequence: Synthetic oligonucleotide
gtatttcatggactagctggcagccatggc

SEQ ID NO: 268523 - DNA, 30 bp, Artificial Sequence
  Description of Artificial Sequence: Synthetic oligonucleotide
tatttcatggactagctggcagccatggcc

SEQ ID NO: 268524 - DNA, 29 bp, Artificial Sequence
  Description of Artificial Sequence: Synthetic oligonucleotide
atttcatggactagctggcagccatggcc

SEQ ID NO: 268525 - DNA, 28 bp, Artificial Sequence
  Description of Artificial Sequence: Synthetic oligonucleotide
tttcatggactagctggcagccatggcc

SEQ ID NO: 268526 - DNA, 27 bp, Artificial Sequence
  Description of Artificial Sequence: Synthetic oligonucleotide
ttcatggactagctggcagccatggcc

SEQ ID NO: 268527 - DNA, 27 bp, Artificial Sequence
  Description of Artificial Sequence: Synthetic oligonucleotide
tcatggactagctggcagccatggcca

SEQ ID NO: 268528 - DNA, 27 bp, Artificial Sequence
  Description of Artificial Sequence: Synthetic oligonucleotide
catggactagctggcagccatggccaa

SEQ ID NO: 268529 - DNA, 27 bp, Artificial Sequence
  Description of Artificial Sequence: Synthetic oligonucleotide
atggactagctggcagccatggccaag

SEQ ID NO: 268530 - DNA, 26 bp, Artificial Sequence
  Description of Artificial Sequence: Synthetic oligonucleotide
tggactagctggcagccatggccaag

SEQ ID NO: 268531 - DNA, 25 bp, Artificial Sequence
  Description of Artificial Sequence: Synthetic oligonucleotide
ggactagctggcagccatggccaag

SEQ ID NO: 268532 - DNA, 25 bp, Artificial Sequence
  Description of Artificial Sequence: Synthetic oligonucleotide
gactagctggcagccatggccaagg

SEQ ID NO: 268533 - DNA, 25 bp, Artificial Sequence
  Description of Artificial Sequence: Synthetic oligonucleotide
actagctggcagccatggccaaggg

SEQ ID NO: 268534 - DNA, 24 bp, Artificial Sequence
  Description of Artificial Sequence: Synthetic oligonucleotide
ctagctggcagccatggccaaggg

SEQ ID NO: 268535 - DNA, 24 bp, Artificial Sequence
  Description of Artificial Sequence: Synthetic oligonucleotide
tagctggcagccatggccaagggc

SEQ ID NO: 268536 - DNA, 23 bp, Artificial Sequence
  Description of Artificial Sequence: Synthetic oligonucleotide
agctggcagccatggccaagggc

SEQ ID NO: 268537 - DNA, 22 bp, Artificial Sequence
  Description of Artificial Sequence: Synthetic oligonucleotide
gctggcagccatggccaagggc

SEQ ID NO: 268538 - DNA, 22 bp, Artificial Sequence
  Description of Artificial Sequence: Synthetic oligonucleotide
ctggcagccatggccaagggcc

SEQ ID NO: 268539 - DNA, 26 bp, Artificial Sequence
  Description of Artificial Sequence: Synthetic oligonucleotide
tggcagccatggccaagggccctttt

SEQ ID NO: 268540 - DNA, 25 bp, Artificial Sequence
  Description of Artificial Sequence: Synthetic oligonucleotide
ggcagccatggccaagggccctttt

SEQ ID NO: 268541 - DNA, 25 bp, Artificial Sequence
  Description of Artificial Sequence: Synthetic oligonucleotide
gcagccatggccaagggcccttttg

SEQ ID NO: 268542 - DNA, 26 bp, Artificial Sequence
  Description of Artificial Sequence: Synthetic oligonucleotide
cagccatggccaagggcccttttgct

SEQ ID NO: 268543 - DNA, 26 bp, Artificial Sequence
  Description of Artificial Sequence: Synthetic oligonucleotide
agccatggccaagggcccttttgctg

SEQ ID NO: 268544 - DNA, 25 bp, Artificial Sequence
  Description of Artificial Sequence: Synthetic oligonucleotide
gccatggccaagggcccttttgctg

SEQ ID NO: 268545 - DNA, 25 bp, Artificial Sequence
  Description of Artificial Sequence: Synthetic oligonucleotide
ccatggccaagggcccttttgctgc

SEQ ID NO: 268546 - DNA, 25 bp, Artificial Sequence
  Description of Artificial Sequence: Synthetic oligonucleotide
catggccaagggcccttttgctgcc

SEQ ID NO: 268547 - DNA, 26 bp, Artificial Sequence
  Description of Artificial Sequence: Synthetic oligonucleotide
atggccaagggcccttttgctgccca

SEQ ID NO: 268548 - DNA, 25 bp, Artificial Sequence
  Description of Artificial Sequence: Synthetic oligonucleotide
tggccaagggcccttttgctgccca

SEQ ID NO: 268549 - DNA, 24 bp, Artificial Sequence
  Description of Artificial Sequence: Synthetic oligonucleotide
ggccaagggcccttttgctgccca

SEQ ID NO: 268550 - DNA, 24 bp, Artificial Sequence
  Description of Artificial Sequence: Synthetic oligonucleotide
gccaagggcccttttgctgcccac

SEQ ID NO: 268551 - DNA, 24 bp, Artificial Sequence
  Description of Artificial Sequence: Synthetic oligonucleotide
ccaagggcccttttgctgcccacg

SEQ ID NO: 268552 - DNA, 24 bp, Artificial Sequence
  Description of Artificial Sequence: Synthetic oligonucleotide
caagggcccttttgctgcccacgg

SEQ ID NO: 268553 - DNA, 27 bp, Artificial Sequence
  Description of Artificial Sequence: Synthetic oligonucleotide
aagggcccttttgctgcccacggcaat

SEQ ID NO: 268554 - DNA, 26 bp, Artificial Sequence
  Description of Artificial Sequence: Synthetic oligonucleotide
agggcccttttgctgcccacggcaat

SEQ ID NO: 268555 - DNA, 25 bp, Artificial Sequence
  Description of Artificial Sequence: Synthetic oligonucleotide
gggcccttttgctgcccacggcaat

SEQ ID NO: 268556 - DNA, 25 bp, Artificial Sequence
  Description of Artificial Sequence: Synthetic oligonucleotide
ggcccttttgctgcccacggcaatg

SEQ ID NO: 268557 - DNA, 26 bp, Artificial Sequence
  Description of Artificial Sequence: Synthetic oligonucleotide
gcccttttgctgcccacggcaatggt

SEQ ID NO: 268558 - DNA, 26 bp, Artificial Sequence
  Description of Artificial Sequence: Synthetic oligonucleotide
cccttttgctgcccacggcaatggtg

SEQ ID NO: 268559 - DNA, 26 bp, Artificial Sequence
  Description of Artificial Sequence: Synthetic oligonucleotide
ccttttgctgcccacggcaatggtgc

SEQ ID NO: 268560 - DNA, 27 bp, Artificial Sequence
  Description of Artificial Sequence: Synthetic oligonucleotide
cttttgctgcccacggcaatggtgcct

SEQ ID NO: 268561 - DNA, 28 bp, Artificial Sequence
  Description of Artificial Sequence: Synthetic oligonucleotide
ttttgctgcccacggcaatggtgcctac

SEQ ID NO: 268562 - DNA, 27 bp, Artificial Sequence
  Description of Artificial Sequence: Synthetic oligonucleotide
tttgctgcccacggcaatggtgcctac

SEQ ID NO: 268563 - DNA, 26 bp, Artificial Sequence
  Description of Artificial Sequence: Synthetic oligonucleotide
ttgctgcccacggcaatggtgcctac

SEQ ID NO: 268564 - DNA, 25 bp, Artificial Sequence
  Description of Artificial Sequence: Synthetic oligonucleotide
tgctgcccacggcaatggtgcctac

SEQ ID NO: 268565 - DNA, 24 bp, Artificial Sequence
  Description of Artificial Sequence: Synthetic oligonucleotide
gctgcccacggcaatggtgcctac

SEQ ID NO: 268566 - DNA, 25 bp, Artificial Sequence
  Description of Artificial Sequence: Synthetic oligonucleotide
ctgcccacggcaatggtgcctacct

SEQ ID NO: 268567 - DNA, 26 bp, Artificial Sequence
  Description of Artificial Sequence: Synthetic oligonucleotide
tgcccacggcaatggtgcctacctga

SEQ ID NO: 268568 - DNA, 25 bp, Artificial Sequence
  Description of Artificial Sequence: Synthetic oligonucleotide
gcccacggcaatggtgcctacctga

SEQ ID NO: 268569 - DNA, 26 bp, Artificial Sequence
  Description of Artificial Sequence: Synthetic oligonucleotide
cccacggcaatggtgcctacctgact

SEQ ID NO: 268570 - DNA, 27 bp, Artificial Sequence
  Description of Artificial Sequence: Synthetic oligonucleotide
ccacggcaatggtgcctacctgactct

SEQ ID NO: 268571 - DNA, 27 bp, Artificial Sequence
  Description of Artificial Sequence: Synthetic oligonucleotide
cacggcaatggtgcctacctgactctg

SEQ ID NO: 268572 - DNA, 28 bp, Artificial Sequence
  Description of Artificial Sequence: Synthetic oligonucleotide
acggcaatggtgcctacctgactctgag

SEQ ID NO: 268573 - DNA, 27 bp, Artificial Sequence
  Description of Artificial Sequence: Synthetic oligonucleotide
cggcaatggtgcctacctgactctgag

SEQ ID NO: 268574 - DNA, 30 bp, Artificial Sequence
  Description of Artificial Sequence: Synthetic oligonucleotide
ggcaatggtgcctacctgactctgagtatc

SEQ ID NO: 268575 - DNA, 30 bp, Artificial Sequence
  Description of Artificial Sequence: Synthetic oligonucleotide
gcaatggtgcctacctgactctgagtatcc

SEQ ID NO: 268576 - DNA, 31 bp, Artificial Sequence
  Description of Artificial Sequence: Synthetic oligonucleotide
caatggtgcctacctgactctgagtatcctc

SEQ ID NO: 268577 - DNA, 31 bp, Artificial Sequence
  Description of Artificial Sequence: Synthetic oligonucleotide
aatggtgcctacctgactctgagtatcctcc

SEQ ID NO: 268578 - DNA, 30 bp, Artificial Sequence
  Description of Artificial Sequence: Synthetic oligonucleotide
atggtgcctacctgactctgagtatcctcc

SEQ ID NO: 268579 - DNA, 29 bp, Artificial Sequence
  Description of Artificial Sequence: Synthetic oligonucleotide
tggtgcctacctgactctgagtatcctcc

SEQ ID NO: 268580 - DNA, 28 bp, Artificial Sequence
  Description of Artificial Sequence: Synthetic oligonucleotide
ggtgcctacctgactctgagtatcctcc

SEQ ID NO: 268581 - DNA, 29 bp, Artificial Sequence
  Description of Artificial Sequence: Synthetic oligonucleotide
gtgcctacctgactctgagtatcctccac

SEQ ID NO: 268582 - DNA, 29 bp, Artificial Sequence
  Description of Artificial Sequence: Synthetic oligonucleotide
tgcctacctgactctgagtatcctccacc

SEQ ID NO: 268583 - DNA, 28 bp, Artificial Sequence
  Description of Artificial Sequence: Synthetic oligonucleotide
gcctacctgactctgagtatcctccacc

SEQ ID NO: 268584 - DNA, 28 bp, Artificial Sequence
  Description of Artificial Sequence: Synthetic oligonucleotide
cctacctgactctgagtatcctccaccg

SEQ ID NO: 268585 - DNA, 31 bp, Artificial Sequence
  Description of Artificial Sequence: Synthetic oligonucleotide
ctacctgactctgagtatcctccaccgatac

SEQ ID NO: 268586 - DNA, 33 bp, Artificial Sequence
  Description of Artificial Sequence: Synthetic oligonucleotide
tacctgactctgagtatcctccaccgatacttc

SEQ ID NO: 268587 - DNA, 32 bp, Artificial Sequence
  Description of Artificial Sequence: Synthetic oligonucleotide
acctgactctgagtatcctccaccgatacttc

SEQ ID NO: 268588 - DNA, 31 bp, Artificial Sequence
  Description of Artificial Sequence: Synthetic oligonucleotide
cctgactctgagtatcctccaccgatacttc

SEQ ID NO: 268589 - DNA, 32 bp, Artificial Sequence
  Description of Artificial Sequence: Synthetic oligonucleotide
ctgactctgagtatcctccaccgatacttcac

SEQ ID NO: 268590 - DNA, 33 bp, Artificial Sequence
  Description of Artificial Sequence: Synthetic oligonucleotide
tgactctgagtatcctccaccgatacttcacac

SEQ ID NO: 268591 - DNA, 32 bp, Artificial Sequence
  Description of Artificial Sequence: Synthetic oligonucleotide
gactctgagtatcctccaccgatacttcacac

SEQ ID NO: 268592 - DNA, 32 bp, Artificial Sequence
  Description of Artificial Sequence: Synthetic oligonucleotide
actctgagtatcctccaccgatacttcacacc

SEQ ID NO: 268593 - DNA, 31 bp, Artificial Sequence
  Description of Artificial Sequence: Synthetic oligonucleotide
ctctgagtatcctccaccgatacttcacacc

SEQ ID NO: 268594 - DNA, 31 bp, Artificial Sequence
  Description of Artificial Sequence: Synthetic oligonucleotide
tctgagtatcctccaccgatacttcacaccg

SEQ ID NO: 268595 - DNA, 30 bp, Artificial Sequence
  Description of Artificial Sequence: Synthetic oligonucleotide
ctgagtatcctccaccgatacttcacaccg

SEQ ID NO: 268596 - DNA, 31 bp, Artificial Sequence
  Description of Artificial Sequence: Synthetic oligonucleotide
tgagtatcctccaccgatacttcacaccgac

SEQ ID NO: 268597 - DNA, 30 bp, Artificial Sequence
  Description of Artificial Sequence: Synthetic oligonucleotide
gagtatcctccaccgatacttcacaccgac

SEQ ID NO: 268598 - DNA, 33 bp, Artificial Sequence
  Description of Artificial Sequence: Synthetic oligonucleotide
agtatcctccaccgatacttcacaccgacaatc

SEQ ID NO: 268599 - DNA, 32 bp, Artificial Sequence
  Description of Artificial Sequence: Synthetic oligonucleotide
gtatcctccaccgatacttcacaccgacaatc

SEQ ID NO: 268600 - DNA, 33 bp, Artificial Sequence
  Description of Artificial Sequence: Synthetic oligonucleotide
tatcctccaccgatacttcacaccgacaatctc

SEQ ID NO: 268601 - DNA, 32 bp, Artificial Sequence
  Description of Artificial Sequence: Synthetic oligonucleotide
atcctccaccgatacttcacaccgacaatctc

SEQ ID NO: 268602 - DNA, 31 bp, Artificial Sequence
  Description of Artificial Sequence: Synthetic oligonucleotide
tcctccaccgatacttcacaccgacaatctc

SEQ ID NO: 268603 - DNA, 30 bp, Artificial Sequence
  Description of Artificial Sequence: Synthetic oligonucleotide
cctccaccgatacttcacaccgacaatctc

SEQ ID NO: 268604 - DNA, 31 bp, Artificial Sequence
  Description of Artificial Sequence: Synthetic oligonucleotide
ctccaccgatacttcacaccgacaatctcac

SEQ ID NO: 268605 - DNA, 31 bp, Artificial Sequence
  Description of Artificial Sequence: Synthetic oligonucleotide
tccaccgatacttcacaccgacaatctcacg

SEQ ID NO: 268606 - DNA, 30 bp, Artificial Sequence
  Description of Artificial Sequence: Synthetic oligonucleotide
ccaccgatacttcacaccgacaatctcacg

SEQ ID NO: 268607 - DNA, 31 bp, Artificial Sequence
  Description of Artificial Sequence: Synthetic oligonucleotide
caccgatacttcacaccgacaatctcacgtc

SEQ ID NO: 268608 - DNA, 32 bp, Artificial Sequence
  Description of Artificial Sequence: Synthetic oligonucleotide
accgatacttcacaccgacaatctcacgtcag

SEQ ID NO: 268609 - DNA, 31 bp, Artificial Sequence
  Description of Artificial Sequence: Synthetic oligonucleotide
ccgatacttcacaccgacaatctcacgtcag

SEQ ID NO: 268610 - DNA, 32 bp, Artificial Sequence
  Description of Artificial Sequence: Synthetic oligonucleotide
cgatacttcacaccgacaatctcacgtcagag

SEQ ID NO: 268611 - DNA, 32 bp, Artificial Sequence
  Description of Artificial Sequence: Synthetic oligonucleotide
gatacttcacaccgacaatctcacgtcagagg

SEQ ID NO: 268612 - DNA, 32 bp, Artificial Sequence
  Description of Artificial Sequence: Synthetic oligonucleotide
atacttcacaccgacaatctcacgtcagaggg

SEQ ID NO: 268613 - DNA, 31 bp, Artificial Sequence
  Description of Artificial Sequence: Synthetic oligonucleotide
tacttcacaccgacaatctcacgtcagaggg

SEQ ID NO: 268614 - DNA, 30 bp, Artificial Sequence
  Description of Artificial Sequence: Synthetic oligonucleotide
acttcacaccgacaatctcacgtcagaggg

SEQ ID NO: 268615 - DNA, 29 bp, Artificial Sequence
  Description of Artificial Sequence: Synthetic oligonucleotide
cttcacaccgacaatctcacgtcagaggg

SEQ ID NO: 268616 - DNA, 29 bp, Artificial Sequence
  Description of Artificial Sequence: Synthetic oligonucleotide
ttcacaccgacaatctcacgtcagagggc

SEQ ID NO: 268617 - DNA, 28 bp, Artificial Sequence
  Description of Artificial Sequence: Synthetic oligonucleotide
tcacaccgacaatctcacgtcagagggc

SEQ ID NO: 268618 - DNA, 27 bp, Artificial Sequence
  Description of Artificial Sequence: Synthetic oligonucleotide
cacaccgacaatctcacgtcagagggc

SEQ ID NO: 268619 - DNA, 28 bp, Artificial Sequence
  Description of Artificial Sequence: Synthetic oligonucleotide
acaccgacaatctcacgtcagagggcag

SEQ ID NO: 268620 - DNA, 27 bp, Artificial Sequence
  Description of Artificial Sequence: Synthetic oligonucleotide
caccgacaatctcacgtcagagggcag

SEQ ID NO: 268621 - DNA, 28 bp, Artificial Sequence
  Description of Artificial Sequence: Synthetic oligonucleotide
accgacaatctcacgtcagagggcagag

SEQ ID NO: 268622 - DNA, 27 bp, Artificial Sequence
  Description of Artificial Sequence: Synthetic oligonucleotide
ccgacaatctcacgtcagagggcagag

SEQ ID NO: 268623 - DNA, 27 bp, Artificial Sequence
  Description of Artificial Sequence: Synthetic oligonucleotide
cgacaatctcacgtcagagggcagagg

SEQ ID NO: 268624 - DNA, 29 bp, Artificial Sequence
  Description of Artificial Sequence: Synthetic oligonucleotide
gacaatctcacgtcagagggcagaggaac

SEQ ID NO: 268625 - DNA, 30 bp, Artificial Sequence
  Description of Artificial Sequence: Synthetic oligonucleotide
acaatctcacgtcagagggcagaggaactc

SEQ ID NO: 268626 - DNA, 29 bp, Artificial Sequence
  Description of Artificial Sequence: Synthetic oligonucleotide
caatctcacgtcagagggcagaggaactc

SEQ ID NO: 268627 - DNA, 29 bp, Artificial Sequence
  Description of Artificial Sequence: Synthetic oligonucleotide
aatctcacgtcagagggcagaggaactcc

SEQ ID NO: 268628 - DNA, 28 bp, Artificial Sequence
  Description of Artificial Sequence: Synthetic oligonucleotide
atctcacgtcagagggcagaggaactcc

SEQ ID NO: 268629 - DNA, 27 bp, Artificial Sequence
  Description of Artificial Sequence: Synthetic oligonucleotide
tctcacgtcagagggcagaggaactcc

SEQ ID NO: 268630 - DNA, 27 bp, Artificial Sequence
  Description of Artificial Sequence: Synthetic oligonucleotide
ctcacgtcagagggcagaggaactcct

SEQ ID NO: 268631 - DNA, 29 bp, Artificial Sequence
  Description of Artificial Sequence: Synthetic oligonucleotide
tcacgtcagagggcagaggaactcctaag

SEQ ID NO: 268632 - DNA, 28 bp, Artificial Sequence
  Description of Artificial Sequence: Synthetic oligonucleotide
cacgtcagagggcagaggaactcctaag

SEQ ID NO: 268633 - DNA, 28 bp, Artificial Sequence
  Description of Artificial Sequence: Synthetic oligonucleotide
acgtcagagggcagaggaactcctaagg

SEQ ID NO: 268634 - DNA, 27 bp, Artificial Sequence
  Description of Artificial Sequence: Synthetic oligonucleotide
cgtcagagggcagaggaactcctaagg

SEQ ID NO: 268635 - DNA, 31 bp, Artificial Sequence
  Description of Artificial Sequence: Synthetic oligonucleotide
gtcagagggcagaggaactcctaaggaaatg

SEQ ID NO: 268636 - DNA, 32 bp, Artificial Sequence
  Description of Artificial Sequence: Synthetic oligonucleotide
tcagagggcagaggaactcctaaggaaatgtg

SEQ ID NO: 268637 - DNA, 31 bp, Artificial Sequence
  Description of Artificial Sequence: Synthetic oligonucleotide
cagagggcagaggaactcctaaggaaatgtg

SEQ ID NO: 268638 - DNA, 32 bp, Artificial Sequence
  Description of Artificial Sequence: Synthetic oligonucleotide
agagggcagaggaactcctaaggaaatgtgtg

SEQ ID NO: 268639 - DNA, 31 bp, Artificial Sequence
  Description of Artificial Sequence: Synthetic oligonucleotide
gagggcagaggaactcctaaggaaatgtgtg

SEQ ID NO: 268640 - DNA, 31 bp, Artificial Sequence
  Description of Artificial Sequence: Synthetic oligonucleotide
agggcagaggaactcctaaggaaatgtgtgg

SEQ ID NO: 268641 - DNA, 30 bp, Artificial Sequence
  Description of Artificial Sequence: Synthetic oligonucleotide
gggcagaggaactcctaaggaaatgtgtgg

SEQ ID NO: 268642 - DNA, 31 bp, Artificial Sequence
  Description of Artificial Sequence: Synthetic oligonucleotide
ggcagaggaactcctaaggaaatgtgtggag

SEQ ID NO: 268643 - DNA, 31 bp, Artificial Sequence
  Description of Artificial Sequence: Synthetic oligonucleotide
gcagaggaactcctaaggaaatgtgtggagg

SEQ ID NO: 268644 - DNA, 32 bp, Artificial Sequence
  Description of Artificial Sequence: Synthetic oligonucleotide
cagaggaactcctaaggaaatgtgtggaggag

SEQ ID NO: 268645 - DNA, 32 bp, Artificial Sequence
  Description of Artificial Sequence: Synthetic oligonucleotide
agaggaactcctaaggaaatgtgtggaggagc

SEQ ID NO: 268646 - DNA, 31 bp, Artificial Sequence
  Description of Artificial Sequence: Synthetic oligonucleotide
gaggaactcctaaggaaatgtgtggaggagc

SEQ ID NO: 268647 - DNA, 32 bp, Artificial Sequence
  Description of Artificial Sequence: Synthetic oligonucleotide
aggaactcctaaggaaatgtgtggaggagcac

SEQ ID NO: 268648 - DNA, 31 bp, Artificial Sequence
  Description of Artificial Sequence: Synthetic oligonucleotide
ggaactcctaaggaaatgtgtggaggagcac

SEQ ID NO: 268649 - DNA, 31 bp, Artificial Sequence
  Description of Artificial Sequence: Synthetic oligonucleotide
gaactcctaaggaaatgtgtggaggagcacc

SEQ ID NO: 268650 - DNA, 32 bp, Artificial Sequence
  Description of Artificial Sequence: Synthetic oligonucleotide
aactcctaaggaaatgtgtggaggagcaccag

SEQ ID NO: 268651 - DNA, 31 bp, Artificial Sequence
  Description of Artificial Sequence: Synthetic oligonucleotide
actcctaaggaaatgtgtggaggagcaccag

SEQ ID NO: 268652 - DNA, 30 bp, Artificial Sequence
  Description of Artificial Sequence: Synthetic oligonucleotide
ctcctaaggaaatgtgtggaggagcaccag

SEQ ID NO: 268653 - DNA, 33 bp, Artificial Sequence
  Description of Artificial Sequence: Synthetic oligonucleotide
tcctaaggaaatgtgtggaggagcaccagaaac

SEQ ID NO: 268654 - DNA, 32 bp, Artificial Sequence
  Description of Artificial Sequence: Synthetic oligonucleotide
cctaaggaaatgtgtggaggagcaccagaaac

SEQ ID NO: 268655 - DNA, 32 bp, Artificial Sequence
  Description of Artificial Sequence: Synthetic oligonucleotide
ctaaggaaatgtgtggaggagcaccagaaacg

SEQ ID NO: 268656 - DNA, 32 bp, Artificial Sequence
  Description of Artificial Sequence: Synthetic oligonucleotide
taaggaaatgtgtggaggagcaccagaaacgg

SEQ ID NO: 268657 - DNA, 31 bp, Artificial Sequence
  Description of Artificial Sequence: Synthetic oligonucleotide
aaggaaatgtgtggaggagcaccagaaacgg

SEQ ID NO: 268658 - DNA, 30 bp, Artificial Sequence
  Description of Artificial Sequence: Synthetic oligonucleotide
aggaaatgtgtggaggagcaccagaaacgg

SEQ ID NO: 268659 - DNA, 29 bp, Artificial Sequence
  Description of Artificial Sequence: Synthetic oligonucleotide
ggaaatgtgtggaggagcaccagaaacgg

SEQ ID NO: 268660 - DNA, 31 bp, Artificial Sequence
  Description of Artificial Sequence: Synthetic oligonucleotide
gaaatgtgtggaggagcaccagaaacggttc

SEQ ID NO: 268661 - DNA, 33 bp, Artificial Sequence
  Description of Artificial Sequence: Synthetic oligonucleotide
aaatgtgtggaggagcaccagaaacggttcatc

SEQ ID NO: 268662 - DNA, 32 bp, Artificial Sequence
  Description of Artificial Sequence: Synthetic oligonucleotide
aatgtgtggaggagcaccagaaacggttcatc

SEQ ID NO: 268663 - DNA, 31 bp, Artificial Sequence
  Description of Artificial Sequence: Synthetic oligonucleotide
atgtgtggaggagcaccagaaacggttcatc

SEQ ID NO: 268664 - DNA, 30 bp, Artificial Sequence
  Description of Artificial Sequence: Synthetic oligonucleotide
tgtgtggaggagcaccagaaacggttcatc

SEQ ID NO: 268665 - DNA, 29 bp, Artificial Sequence
  Description of Artificial Sequence: Synthetic oligonucleotide
gtgtggaggagcaccagaaacggttcatc

SEQ ID NO: 268666 - DNA, 29 bp, Artificial Sequence
  Description of Artificial Sequence: Synthetic oligonucleotide
tgtggaggagcaccagaaacggttcatcc

SEQ ID NO: 268667 - DNA, 28 bp, Artificial Sequence
  Description of Artificial Sequence: Synthetic oligonucleotide
gtggaggagcaccagaaacggttcatcc

SEQ ID NO: 268668 - DNA, 29 bp, Artificial Sequence
  Description of Artificial Sequence: Synthetic oligonucleotide
tggaggagcaccagaaacggttcatcctg

SEQ ID NO: 268669 - DNA, 28 bp, Artificial Sequence
  Description of Artificial Sequence: Synthetic oligonucleotide
ggaggagcaccagaaacggttcatcctg

SEQ ID NO: 268670 - DNA, 31 bp, Artificial Sequence
  Description of Artificial Sequence: Synthetic oligonucleotide
gaggagcaccagaaacggttcatcctgtatc

SEQ ID NO: 268671 - DNA, 32 bp, Artificial Sequence
  Description of Artificial Sequence: Synthetic oligonucleotide
aggagcaccagaaacggttcatcctgtatctg

SEQ ID NO: 268672 - DNA, 31 bp, Artificial Sequence
  Description of Artificial Sequence: Synthetic oligonucleotide
ggagcaccagaaacggttcatcctgtatctg

SEQ ID NO: 268673 - DNA, 31 bp, Artificial Sequence
  Description of Artificial Sequence: Synthetic oligonucleotide
gagcaccagaaacggttcatcctgtatctgc

SEQ ID NO: 268674 - DNA, 31 bp, Artificial Sequence
  Description of Artificial Sequence: Synthetic oligonucleotide
agcaccagaaacggttcatcctgtatctgcc

SEQ ID NO: 268675 - DNA, 30 bp, Artificial Sequence
  Description of Artificial Sequence: Synthetic oligonucleotide
gcaccagaaacggttcatcctgtatctgcc

SEQ ID NO: 268676 - DNA, 32 bp, Artificial Sequence
  Description of Artificial Sequence: Synthetic oligonucleotide
caccagaaacggttcatcctgtatctgccaag

SEQ ID NO: 268677 - DNA, 32 bp, Artificial Sequence
  Description of Artificial Sequence: Synthetic oligonucleotide
accagaaacggttcatcctgtatctgccaagc

SEQ ID NO: 268678 - DNA, 31 bp, Artificial Sequence
  Description of Artificial Sequence: Synthetic oligonucleotide
ccagaaacggttcatcctgtatctgccaagc

SEQ ID NO: 268679 - DNA, 33 bp, Artificial Sequence
  Description of Artificial Sequence: Synthetic oligonucleotide
cagaaacggttcatcctgtatctgccaagcttc

SEQ ID NO: 268680 - DNA, 34 bp, Artificial Sequence
  Description of Artificial Sequence: Synthetic oligonucleotide
agaaacggttcatcctgtatctgccaagcttcag

SEQ ID NO: 268681 - DNA, 33 bp, Artificial Sequence
  Description of Artificial Sequence: Synthetic oligonucleotide
gaaacggttcatcctgtatctgccaagcttcag

SEQ ID NO: 268682 - DNA, 34 bp, Artificial Sequence
  Description of Artificial Sequence: Synthetic oligonucleotide
aaacggttcatcctgtatctgccaagcttcagtg

SEQ ID NO: 268683 - DNA, 33 bp, Artificial Sequence
  Description of Artificial Sequence: Synthetic oligonucleotide
aacggttcatcctgtatctgccaagcttcagtg

SEQ ID NO: 268684 - DNA, 32 bp, Artificial Sequence
  Description of Artificial Sequence: Synthetic oligonucleotide
acggttcatcctgtatctgccaagcttcagtg

SEQ ID NO: 268685 - DNA, 31 bp, Artificial Sequence
  Description of Artificial Sequence: Synthetic oligonucleotide
cggttcatcctgtatctgccaagcttcagtg

SEQ ID NO: 268686 - DNA, 33 bp, Artificial Sequence
  Description of Artificial Sequence: Synthetic oligonucleotide
ggttcatcctgtatctgccaagcttcagtgtac

SEQ ID NO: 268687 - DNA, 33 bp, Artificial Sequence
  Description of Artificial Sequence: Synthetic oligonucleotide
gttcatcctgtatctgccaagcttcagtgtacg

SEQ ID NO: 268688 - DNA, 36 bp, Artificial Sequence
  Description of Artificial Sequence: Synthetic oligonucleotide
ttcatcctgtatctgccaagcttcagtgtacgaatc

SEQ ID NO: 268689 - DNA, 35 bp, Artificial Sequence
  Description of Artificial Sequence: Synthetic oligonucleotide
tcatcctgtatctgccaagcttcagtgtacgaatc

SEQ ID NO: 268690 - DNA, 34 bp, Artificial Sequence
  Description of Artificial Sequence: Synthetic oligonucleotide
catcctgtatctgccaagcttcagtgtacgaatc

SEQ ID NO: 268691 - DNA, 37 bp, Artificial Sequence
  Description of Artificial Sequence: Synthetic oligonucleotide
atcctgtatctgccaagcttcagtgtacgaatcattc

SEQ ID NO: 268692 - DNA, 36 bp, Artificial Sequence
  Description of Artificial Sequence: Synthetic oligonucleotide
tcctgtatctgccaagcttcagtgtacgaatcattc

SEQ ID NO: 268693 - DNA, 35 bp, Artificial Sequence
  Description of Artificial Sequence: Synthetic oligonucleotide
cctgtatctgccaagcttcagtgtacgaatcattc

SEQ ID NO: 268694 - DNA, 36 bp, Artificial Sequence
  Description of Artificial Sequence: Synthetic oligonucleotide
ctgtatctgccaagcttcagtgtacgaatcattcac

SEQ ID NO: 268695 - DNA, 42 bp, Artificial Sequence
  Description of Artificial Sequence: Synthetic oligonucleotide
tgtatctgccaagcttcagtgtacgaatcattcacaaaaatg

SEQ ID NO: 268696 - DNA, 41 bp, Artificial Sequence
  Description of Artificial Sequence: Synthetic oligonucleotide
gtatctgccaagcttcagtgtacgaatcattcacaaaaatg

SEQ ID NO: 268697 - DNA, 41 bp, Artificial Sequence
  Description of Artificial Sequence: Synthetic oligonucleotide
tatctgccaagcttcagtgtacgaatcattcacaaaaatgc

SEQ ID NO: 268698 - DNA, 40 bp, Artificial Sequence
  Description of Artificial Sequence: Synthetic oligonucleotide
atctgccaagcttcagtgtacgaatcattcacaaaaatgc

SEQ ID NO: 268699 - DNA, 39 bp, Artificial Sequence
  Description of Artificial Sequence: Synthetic oligonucleotide
tctgccaagcttcagtgtacgaatcattcacaaaaatgc

SEQ ID NO: 268700 - DNA, 38 bp, Artificial Sequence
  Description of Artificial Sequence: Synthetic oligonucleotide
ctgccaagcttcagtgtacgaatcattcacaaaaatgc

SEQ ID NO: 268701 - DNA, 38 bp, Artificial Sequence
  Description of Artificial Sequence: Synthetic oligonucleotide
tgccaagcttcagtgtacgaatcattcacaaaaatgcc

SEQ ID NO: 268702 - DNA, 37 bp, Artificial Sequence
  Description of Artificial Sequence: Synthetic oligonucleotide
gccaagcttcagtgtacgaatcattcacaaaaatgcc

SEQ ID NO: 268703 - DNA, 39 bp, Artificial Sequence
  Description of Artificial Sequence: Synthetic oligonucleotide
ccaagcttcagtgtacgaatcattcacaaaaatgccatc

SEQ ID NO: 268704 - DNA, 39 bp, Artificial Sequence
  Description of Artificial Sequence: Synthetic oligonucleotide
caagcttcagtgtacgaatcattcacaaaaatgccatcc

SEQ ID NO: 268705 - DNA, 41 bp, Artificial Sequence
  Description of Artificial Sequence: Synthetic oligonucleotide
aagcttcagtgtacgaatcattcacaaaaatgccatccatg

SEQ ID NO: 268706 - DNA, 40 bp, Artificial Sequence
  Description of Artificial Sequence: Synthetic oligonucleotide
agcttcagtgtacgaatcattcacaaaaatgccatccatg

SEQ ID NO: 268707 - DNA, 39 bp, Artificial Sequence
  Description of Artificial Sequence: Synthetic oligonucleotide
gcttcagtgtacgaatcattcacaaaaatgccatccatg

SEQ ID NO: 268708 - DNA, 40 bp, Artificial Sequence
  Description of Artificial Sequence: Synthetic oligonucleotide
cttcagtgtacgaatcattcacaaaaatgccatccatgag

SEQ ID NO: 268709 - DNA, 40 bp, Artificial Sequence
  Description of Artificial Sequence: Synthetic oligonucleotide
ttcagtgtacgaatcattcacaaaaatgccatccatgagc

SEQ ID NO: 268710 - DNA, 39 bp, Artificial Sequence
  Description of Artificial Sequence: Synthetic oligonucleotide
tcagtgtacgaatcattcacaaaaatgccatccatgagc

SEQ ID NO: 268711 - DNA, 38 bp, Artificial Sequence
  Description of Artificial Sequence: Synthetic oligonucleotide
cagtgtacgaatcattcacaaaaatgccatccatgagc

SEQ ID NO: 268712 - DNA, 39 bp, Artificial Sequence
  Description of Artificial Sequence: Synthetic oligonucleotide
agtgtacgaatcattcacaaaaatgccatccatgagctg

SEQ ID NO: 268713 - DNA, 38 bp, Artificial Sequence
  Description of Artificial Sequence: Synthetic oligonucleotide
gtgtacgaatcattcacaaaaatgccatccatgagctg

SEQ ID NO: 268714 - DNA, 38 bp, Artificial Sequence
  Description of Artificial Sequence: Synthetic oligonucleotide
tgtacgaatcattcacaaaaatgccatccatgagctgg

SEQ ID NO: 268715 - DNA, 37 bp, Artificial Sequence
  Description of Artificial Sequence: Synthetic oligonucleotide
gtacgaatcattcacaaaaatgccatccatgagctgg

SEQ ID NO: 268716 - DNA, 41 bp, Artificial Sequence
  Description of Artificial Sequence: Synthetic oligonucleotide
tacgaatcattcacaaaaatgccatccatgagctggataac

SEQ ID NO: 268717 - DNA, 40 bp, Artificial Sequence
  Description of Artificial Sequence: Synthetic oligonucleotide
acgaatcattcacaaaaatgccatccatgagctggataac

SEQ ID NO: 268718 - DNA, 39 bp, Artificial Sequence
  Description of Artificial Sequence: Synthetic oligonucleotide
cgaatcattcacaaaaatgccatccatgagctggataac

SEQ ID NO: 268719 - DNA, 43 bp, Artificial Sequence
  Description of Artificial Sequence: Synthetic oligonucleotide
gaatcattcacaaaaatgccatccatgagctggataacttttc

SEQ ID NO: 268720 - DNA, 43 bp, Artificial Sequence
  Description of Artificial Sequence: Synthetic oligonucleotide
aatcattcacaaaaatgccatccatgagctggataacttttcc

SEQ ID NO: 268721 - DNA, 42 bp, Artificial Sequence
  Description of Artificial Sequence: Synthetic oligonucleotide
atcattcacaaaaatgccatccatgagctggataacttttcc

SEQ ID NO: 268722 - DNA, 41 bp, Artificial Sequence
  Description of Artificial Sequence: Synthetic oligonucleotide
tcattcacaaaaatgccatccatgagctggataacttttcc

SEQ ID NO: 268723 - DNA, 40 bp, Artificial Sequence
  Description of Artificial Sequence: Synthetic oligonucleotide
cattcacaaaaatgccatccatgagctggataacttttcc

SEQ ID NO: 268724 - DNA, 42 bp, Artificial Sequence
  Description of Artificial Sequence: Synthetic oligonucleotide
attcacaaaaatgccatccatgagctggataacttttccttc

SEQ ID NO: 268725 - DNA, 41 bp, Artificial Sequence
  Description of Artificial Sequence: Synthetic oligonucleotide
ttcacaaaaatgccatccatgagctggataacttttccttc

SEQ ID NO: 268726 - DNA, 40 bp, Artificial Sequence
  Description of Artificial Sequence: Synthetic oligonucleotide
tcacaaaaatgccatccatgagctggataacttttccttc

SEQ ID NO: 268727 - DNA, 39 bp, Artificial Sequence
  Description of Artificial Sequence: Synthetic oligonucleotide
cacaaaaatgccatccatgagctggataacttttccttc

SEQ ID NO: 268728 - DNA, 39 bp, Artificial Sequence
  Description of Artificial Sequence: Synthetic oligonucleotide
acaaaaatgccatccatgagctggataacttttccttcc

SEQ ID NO: 268729 - DNA, 38 bp, Artificial Sequence
  Description of Artificial Sequence: Synthetic oligonucleotide
caaaaatgccatccatgagctggataacttttccttcc

SEQ ID NO: 268730 - DNA, 38 bp, Artificial Sequence
  Description of Artificial Sequence: Synthetic oligonucleotide
aaaaatgccatccatgagctggataacttttccttccg

SEQ ID NO: 268731 - DNA, 37 bp, Artificial Sequence
  Description of Artificial Sequence: Synthetic oligonucleotide
aaaatgccatccatgagctggataacttttccttccg

SEQ ID NO: 268732 - DNA, 36 bp, Artificial Sequence
  Description of Artificial Sequence: Synthetic oligonucleotide
aaatgccatccatgagctggataacttttccttccg

SEQ ID NO: 268733 - DNA, 35 bp, Artificial Sequence
  Description of Artificial Sequence: Synthetic oligonucleotide
aatgccatccatgagctggataacttttccttccg

SEQ ID NO: 268734 - DNA, 34 bp, Artificial Sequence
  Description of Artificial Sequence: Synthetic oligonucleotide
atgccatccatgagctggataacttttccttccg

SEQ ID NO: 268735 - DNA, 33 bp, Artificial Sequence
  Description of Artificial Sequence: Synthetic oligonucleotide
tgccatccatgagctggataacttttccttccg

SEQ ID NO: 268736 - DNA, 32 bp, Artificial Sequence
  Description of Artificial Sequence: Synthetic oligonucleotide
gccatccatgagctggataacttttccttccg

SEQ ID NO: 268737 - DNA, 32 bp, Artificial Sequence
  Description of Artificial Sequence: Synthetic oligonucleotide
ccatccatgagctggataacttttccttccgc

SEQ ID NO: 268738 - DNA, 35 bp, Artificial Sequence
  Description of Artificial Sequence: Synthetic oligonucleotide
catccatgagctggataacttttccttccgcaaac

SEQ ID NO: 268739 - DNA, 36 bp, Artificial Sequence
  Description of Artificial Sequence: Synthetic oligonucleotide
atccatgagctggataacttttccttccgcaaacag

SEQ ID NO: 268740 - DNA, 35 bp, Artificial Sequence
  Description of Artificial Sequence: Synthetic oligonucleotide
tccatgagctggataacttttccttccgcaaacag

SEQ ID NO: 268741 - DNA, 34 bp, Artificial Sequence
  Description of Artificial Sequence: Synthetic oligonucleotide
ccatgagctggataacttttccttccgcaaacag

SEQ ID NO: 268742 - DNA, 34 bp, Artificial Sequence
  Description of Artificial Sequence: Synthetic oligonucleotide
catgagctggataacttttccttccgcaaacagg

SEQ ID NO: 268743 - DNA, 34 bp, Artificial Sequence
  Description of Artificial Sequence: Synthetic oligonucleotide
atgagctggataacttttccttccgcaaacaggg

SEQ ID NO: 268744 - DNA, 33 bp, Artificial Sequence
  Description of Artificial Sequence: Synthetic oligonucleotide
tgagctggataacttttccttccgcaaacaggg

SEQ ID NO: 268745 - DNA, 32 bp, Artificial Sequence
  Description of Artificial Sequence: Synthetic oligonucleotide
gagctggataacttttccttccgcaaacaggg

SEQ ID NO: 268746 - DNA, 32 bp, Artificial Sequence
  Description of Artificial Sequence: Synthetic oligonucleotide
agctggataacttttccttccgcaaacagggg

SEQ ID NO: 268747 - DNA, 31 bp, Artificial Sequence
  Description of Artificial Sequence: Synthetic oligonucleotide
gctggataacttttccttccgcaaacagggg

SEQ ID NO: 268748 - DNA, 32 bp, Artificial Sequence
  Description of Artificial Sequence: Synthetic oligonucleotide
ctggataacttttccttccgcaaacaggggtc

SEQ ID NO: 268749 - DNA, 32 bp, Artificial Sequence
  Description of Artificial Sequence: Synthetic oligonucleotide
tggataacttttccttccgcaaacaggggtcc

SEQ ID NO: 268750 - DNA, 31 bp, Artificial Sequence
  Description of Artificial Sequence: Synthetic oligonucleotide
ggataacttttccttccgcaaacaggggtcc

SEQ ID NO: 268751 - DNA, 33 bp, Artificial Sequence
  Description of Artificial Sequence: Synthetic oligonucleotide
aagtctattatctcctataaccgaggggccgac

SEQ ID NO: 268752 - DNA, 32 bp, Artificial Sequence
  Description of Artificial Sequence: Synthetic oligonucleotide
agtctattatctcctataaccgaggggccgac

SEQ ID NO: 268753 - DNA, 31 bp, Artificial Sequence
  Description of Artificial Sequence: Synthetic oligonucleotide
gtctattatctcctataaccgaggggccgac

SEQ ID NO: 268754 - DNA, 33 bp, Artificial Sequence
  Description of Artificial Sequence: Synthetic oligonucleotide
tctattatctcctataaccgaggggccgacatg

SEQ ID NO: 268755 - DNA, 32 bp, Artificial Sequence
  Description of Artificial Sequence: Synthetic oligonucleotide
ctattatctcctataaccgaggggccgacatg

SEQ ID NO: 268756 - DNA, 32 bp, Artificial Sequence
  Description of Artificial Sequence: Synthetic oligonucleotide
tattatctcctataaccgaggggccgacatgg

SEQ ID NO: 268757 - DNA, 31 bp, Artificial Sequence
  Description of Artificial Sequence: Synthetic oligonucleotide
attatctcctataaccgaggggccgacatgg

SEQ ID NO: 268758 - DNA, 30 bp, Artificial Sequence
  Description of Artificial Sequence: Synthetic oligonucleotide
ttatctcctataaccgaggggccgacatgg

SEQ ID NO: 268759 - DNA, 29 bp, Artificial Sequence
  Description of Artificial Sequence: Synthetic oligonucleotide
tatctcctataaccgaggggccgacatgg

SEQ ID NO: 268760 - DNA, 28 bp, Artificial Sequence
  Description of Artificial Sequence: Synthetic oligonucleotide
atctcctataaccgaggggccgacatgg

SEQ ID NO: 268761 - DNA, 27 bp, Artificial Sequence
  Description of Artificial Sequence: Synthetic oligonucleotide
tctcctataaccgaggggccgacatgg

SEQ ID NO: 268762 - DNA, 26 bp, Artificial Sequence
  Description of Artificial Sequence: Synthetic oligonucleotide
ctcctataaccgaggggccgacatgg

SEQ ID NO: 268763 - DNA, 26 bp, Artificial Sequence
  Description of Artificial Sequence: Synthetic oligonucleotide
tcctataaccgaggggccgacatggc

SEQ ID NO: 268764 - DNA, 25 bp, Artificial Sequence
  Description of Artificial Sequence: Synthetic oligonucleotide
cctataaccgaggggccgacatggc

SEQ ID NO: 268765 - DNA, 27 bp, Artificial Sequence
  Description of Artificial Sequence: Synthetic oligonucleotide
ctataaccgaggggccgacatggccat

SEQ ID NO: 268766 - DNA, 27 bp, Artificial Sequence
  Description of Artificial Sequence: Synthetic oligonucleotide
tataaccgaggggccgacatggccatc

SEQ ID NO: 268767 - DNA, 27 bp, Artificial Sequence
  Description of Artificial Sequence: Synthetic oligonucleotide
ataaccgaggggccgacatggccatca

SEQ ID NO: 268768 - DNA, 27 bp, Artificial Sequence
  Description of Artificial Sequence: Synthetic oligonucleotide
taaccgaggggccgacatggccatcaa

SEQ ID NO: 268769 - DNA, 26 bp, Artificial Sequence
  Description of Artificial Sequence: Synthetic oligonucleotide
aaccgaggggccgacatggccatcaa

SEQ ID NO: 268770 - DNA, 25 bp, Artificial Sequence
  Description of Artificial Sequence: Synthetic oligonucleotide
accgaggggccgacatggccatcaa

SEQ ID NO: 268771 - DNA, 24 bp, Artificial Sequence
  Description of Artificial Sequence: Synthetic oligonucleotide
ccgaggggccgacatggccatcaa

SEQ ID NO: 268772 - DNA, 24 bp, Artificial Sequence
  Description of Artificial Sequence: Synthetic oligonucleotide
cgaggggccgacatggccatcaag

SEQ ID NO: 268773 - DNA, 24 bp, Artificial Sequence
  Description of Artificial Sequence: Synthetic oligonucleotide
gaggggccgacatggccatcaagg

SEQ ID NO: 268774 - DNA, 24 bp, Artificial Sequence
  Description of Artificial Sequence: Synthetic oligonucleotide
aggggccgacatggccatcaaggg

SEQ ID NO: 268775 - DNA, 23 bp, Artificial Sequence
  Description of Artificial Sequence: Synthetic oligonucleotide
ggggccgacatggccatcaaggg

SEQ ID NO: 268776 - DNA, 25 bp, Artificial Sequence
  Description of Artificial Sequence: Synthetic oligonucleotide
gggccgacatggccatcaaggggaa

SEQ ID NO: 268777 - DNA, 27 bp, Artificial Sequence
  Description of Artificial Sequence: Synthetic oligonucleotide
ggccgacatggccatcaaggggaagta

SEQ ID NO: 268778 - DNA, 27 bp, Artificial Sequence
  Description of Artificial Sequence: Synthetic oligonucleotide
gccgacatggccatcaaggggaagtac

SEQ ID NO: 268779 - DNA, 28 bp, Artificial Sequence
  Description of Artificial Sequence: Synthetic oligonucleotide
ccgacatggccatcaaggggaagtactg

SEQ ID NO: 268780 - DNA, 29 bp, Artificial Sequence
  Description of Artificial Sequence: Synthetic oligonucleotide
cgacatggccatcaaggggaagtactgtg

SEQ ID NO: 268781 - DNA, 30 bp, Artificial Sequence
  Description of Artificial Sequence: Synthetic oligonucleotide
gacatggccatcaaggggaagtactgtgtg

SEQ ID NO: 268782 - DNA, 30 bp, Artificial Sequence
  Description of Artificial Sequence: Synthetic oligonucleotide
acatggccatcaaggggaagtactgtgtgg

SEQ ID NO: 268783 - DNA, 29 bp, Artificial Sequence
  Description of Artificial Sequence: Synthetic oligonucleotide
catggccatcaaggggaagtactgtgtgg

SEQ ID NO: 268784 - DNA, 29 bp, Artificial Sequence
  Description of Artificial Sequence: Synthetic oligonucleotide
atggccatcaaggggaagtactgtgtggg

SEQ ID NO: 268785 - DNA, 28 bp, Artificial Sequence
  Description of Artificial Sequence: Synthetic oligonucleotide
tggccatcaaggggaagtactgtgtggg

SEQ ID NO: 268786 - DNA, 27 bp, Artificial Sequence
  Description of Artificial Sequence: Synthetic oligonucleotide
ggccatcaaggggaagtactgtgtggg

SEQ ID NO: 268787 - DNA, 27 bp, Artificial Sequence
  Description of Artificial Sequence: Synthetic oligonucleotide
gccatcaaggggaagtactgtgtgggc

SEQ ID NO: 268788 - DNA, 29 bp, Artificial Sequence
  Description of Artificial Sequence: Synthetic oligonucleotide
ccatcaaggggaagtactgtgtgggcatc

SEQ ID NO: 268789 - DNA, 29 bp, Artificial Sequence
  Description of Artificial Sequence: Synthetic oligonucleotide
catcaaggggaagtactgtgtgggcatcg

SEQ ID NO: 268790 - DNA, 29 bp, Artificial Sequence
  Description of Artificial Sequence: Synthetic oligonucleotide
atcaaggggaagtactgtgtgggcatcgc

SEQ ID NO: 268791 - DNA, 28 bp, Artificial Sequence
  Description of Artificial Sequence: Synthetic oligonucleotide
tcaaggggaagtactgtgtgggcatcgc

SEQ ID NO: 268792 - DNA, 27 bp, Artificial Sequence
  Description of Artificial Sequence: Synthetic oligonucleotide
caaggggaagtactgtgtgggcatcgc

SEQ ID NO: 268793 - DNA, 28 bp, Artificial Sequence
  Description of Artificial Sequence: Synthetic oligonucleotide
aaggggaagtactgtgtgggcatcgctg

SEQ ID NO: 268794 - DNA, 27 bp, Artificial Sequence
  Description of Artificial Sequence: Synthetic oligonucleotide
aggggaagtactgtgtgggcatcgctg

SEQ ID NO: 268795 - DNA, 26 bp, Artificial Sequence
  Description of Artificial Sequence: Synthetic oligonucleotide
ggggaagtactgtgtgggcatcgctg

SEQ ID NO: 268796 - DNA, 27 bp, Artificial Sequence
  Description of Artificial Sequence: Synthetic oligonucleotide
gggaagtactgtgtgggcatcgctgct

SEQ ID NO: 268797 - DNA, 27 bp, Artificial Sequence
  Description of Artificial Sequence: Synthetic oligonucleotide
ggaagtactgtgtgggcatcgctgctg

SEQ ID NO: 268798 - DNA, 28 bp, Artificial Sequence
  Description of Artificial Sequence: Synthetic oligonucleotide
gaagtactgtgtgggcatcgctgctgac

SEQ ID NO: 268799 - DNA, 29 bp, Artificial Sequence
  Description of Artificial Sequence: Synthetic oligonucleotide
aagtactgtgtgggcatcgctgctgacag

SEQ ID NO: 268800 - DNA, 28 bp, Artificial Sequence
  Description of Artificial Sequence: Synthetic oligonucleotide
agtactgtgtgggcatcgctgctgacag

SEQ ID NO: 268801 - DNA, 27 bp, Artificial Sequence
  Description of Artificial Sequence: Synthetic oligonucleotide
gtactgtgtgggcatcgctgctgacag

SEQ ID NO: 268802 - DNA, 27 bp, Artificial Sequence
  Description of Artificial Sequence: Synthetic oligonucleotide
tactgtgtgggcatcgctgctgacagg

SEQ ID NO: 268803 - DNA, 26 bp, Artificial Sequence
  Description of Artificial Sequence: Synthetic oligonucleotide
actgtgtgggcatcgctgctgacagg

SEQ ID NO: 268804 - DNA, 25 bp, Artificial Sequence
  Description of Artificial Sequence: Synthetic oligonucleotide
ctgtgtgggcatcgctgctgacagg

SEQ ID NO: 268805 - DNA, 25 bp, Artificial Sequence
  Description of Artificial Sequence: Synthetic oligonucleotide
tgtgtgggcatcgctgctgacaggc

SEQ ID NO: 268806 - DNA, 24 bp, Artificial Sequence
  Description of Artificial Sequence: Synthetic oligonucleotide
gtgtgggcatcgctgctgacaggc

SEQ ID NO: 268807 - DNA, 24 bp, Artificial Sequence
  Description of Artificial Sequence: Synthetic oligonucleotide
tgtgggcatcgctgctgacaggcg

SEQ ID NO: 268808 - DNA, 23 bp, Artificial Sequence
  Description of Artificial Sequence: Synthetic oligonucleotide
gtgggcatcgctgctgacaggcg

SEQ ID NO: 268809 - DNA, 25 bp, Artificial Sequence
  Description of Artificial Sequence: Synthetic oligonucleotide
tgggcatcgctgctgacaggcgcat

SEQ ID NO: 268810 - DNA, 24 bp, Artificial Sequence
  Description of Artificial Sequence: Synthetic oligonucleotide
gggcatcgctgctgacaggcgcat

SEQ ID NO: 268811 - DNA, 24 bp, Artificial Sequence
  Description of Artificial Sequence: Synthetic oligonucleotide
ggcatcgctgctgacaggcgcatc

SEQ ID NO: 268812 - DNA, 24 bp, Artificial Sequence
  Description of Artificial Sequence: Synthetic oligonucleotide
gcatcgctgctgacaggcgcatcg

SEQ ID NO: 268813 - DNA, 24 bp, Artificial Sequence
  Description of Artificial Sequence: Synthetic oligonucleotide
catcgctgctgacaggcgcatcgg

SEQ ID NO: 268814 - DNA, 26 bp, Artificial Sequence
  Description of Artificial Sequence: Synthetic oligonucleotide
atcgctgctgacaggcgcatcgggat

SEQ ID NO: 268815 - DNA, 25 bp, Artificial Sequence
  Description of Artificial Sequence: Synthetic oligonucleotide
tcgctgctgacaggcgcatcgggat

SEQ ID NO: 268816 - DNA, 24 bp, Artificial Sequence
  Description of Artificial Sequence: Synthetic oligonucleotide
cgctgctgacaggcgcatcgggat

SEQ ID NO: 268817 - DNA, 24 bp, Artificial Sequence
  Description of Artificial Sequence: Synthetic oligonucleotide
gctgctgacaggcgcatcgggatc

SEQ ID NO: 268818 - DNA, 25 bp, Artificial Sequence
  Description of Artificial Sequence: Synthetic oligonucleotide
ctgctgacaggcgcatcgggatcct

SEQ ID NO: 268819 - DNA, 25 bp, Artificial Sequence
  Description of Artificial Sequence: Synthetic oligonucleotide
tgctgacaggcgcatcgggatcctg

SEQ ID NO: 268820 - DNA, 24 bp, Artificial Sequence
  Description of Artificial Sequence: Synthetic oligonucleotide
gctgacaggcgcatcgggatcctg

SEQ ID NO: 268821 - DNA, 24 bp, Artificial Sequence
  Description of Artificial Sequence: Synthetic oligonucleotide
ctgacaggcgcatcgggatcctgg

SEQ ID NO: 268822 - DNA, 24 bp, Artificial Sequence
  Description of Artificial Sequence: Synthetic oligonucleotide
tgacaggcgcatcgggatcctggc

SEQ ID NO: 268823 - DNA, 23 bp, Artificial Sequence
  Description of Artificial Sequence: Synthetic oligonucleotide
gacaggcgcatcgggatcctggc

SEQ ID NO: 268824 - DNA, 23 bp, Artificial Sequence
  Description of Artificial Sequence: Synthetic oligonucleotide
acaggcgcatcgggatcctggcc

SEQ ID NO: 268825 - DNA, 22 bp, Artificial Sequence
  Description of Artificial Sequence: Synthetic oligonucleotide
caggcgcatcgggatcctggcc

SEQ ID NO: 268826 - DNA, 23 bp, Artificial Sequence
  Description of Artificial Sequence: Synthetic oligonucleotide
aggcgcatcgggatcctggccca

SEQ ID NO: 268827 - DNA, 22 bp, Artificial Sequence
  Description of Artificial Sequence: Synthetic oligonucleotide
ggcgcatcgggatcctggccca

SEQ ID NO: 268828 - DNA, 24 bp, Artificial Sequence
  Description of Artificial Sequence: Synthetic oligonucleotide
gcgcatcgggatcctggcccagat

SEQ ID NO: 268829 - DNA, 24 bp, Artificial Sequence
  Description of Artificial Sequence: Synthetic oligonucleotide
cgcatcgggatcctggcccagatc

SEQ ID NO: 268830 - DNA, 25 bp, Artificial Sequence
  Description of Artificial Sequence: Synthetic oligonucleotide
gcatcgggatcctggcccagatcgt

SEQ ID NO: 268831 - DNA, 26 bp, Artificial Sequence
  Description of Artificial Sequence: Synthetic oligonucleotide
catcgggatcctggcccagatcgtga

SEQ ID NO: 268832 - DNA, 26 bp, Artificial Sequence
  Description of Artificial Sequence: Synthetic oligonucleotide
atcgggatcctggcccagatcgtgac

SEQ ID NO: 268833 - DNA, 25 bp, Artificial Sequence
  Description of Artificial Sequence: Synthetic oligonucleotide
tcgggatcctggcccagatcgtgac

SEQ ID NO: 268834 - DNA, 24 bp, Artificial Sequence
  Description of Artificial Sequence: Synthetic oligonucleotide
cgggatcctggcccagatcgtgac

SEQ ID NO: 268835 - DNA, 25 bp, Artificial Sequence
  Description of Artificial Sequence: Synthetic oligonucleotide
gggatcctggcccagatcgtgacca

SEQ ID NO: 268836 - DNA, 25 bp, Artificial Sequence
  Description of Artificial Sequence: Synthetic oligonucleotide
ggatcctggcccagatcgtgaccac

SEQ ID NO: 268837 - DNA, 25 bp, Artificial Sequence
  Description of Artificial Sequence: Synthetic oligonucleotide
gatcctggcccagatcgtgaccacg

SEQ ID NO: 268838 - DNA, 26 bp, Artificial Sequence
  Description of Artificial Sequence: Synthetic oligonucleotide
atcctggcccagatcgtgaccacgca

SEQ ID NO: 268839 - DNA, 25 bp, Artificial Sequence
  Description of Artificial Sequence: Synthetic oligonucleotide
tcctggcccagatcgtgaccacgca

SEQ ID NO: 268840 - DNA, 24 bp, Artificial Sequence
  Description of Artificial Sequence: Synthetic oligonucleotide
cctggcccagatcgtgaccacgca

SEQ ID NO: 268841 - DNA, 26 bp, Artificial Sequence
  Description of Artificial Sequence: Synthetic oligonucleotide
ctggcccagatcgtgaccacgcactt

SEQ ID NO: 268842 - DNA, 26 bp, Artificial Sequence
  Description of Artificial Sequence: Synthetic oligonucleotide
tggcccagatcgtgaccacgcacttc

SEQ ID NO: 268843 - DNA, 25 bp, Artificial Sequence
  Description of Artificial Sequence: Synthetic oligonucleotide
ggcccagatcgtgaccacgcacttc

SEQ ID NO: 268844 - DNA, 26 bp, Artificial Sequence
  Description of Artificial Sequence: Synthetic oligonucleotide
gcccagatcgtgaccacgcacttcca

SEQ ID NO: 268845 - DNA, 27 bp, Artificial Sequence
  Description of Artificial Sequence: Synthetic oligonucleotide
cccagatcgtgaccacgcacttccaga

SEQ ID NO: 268846 - DNA, 28 bp, Artificial Sequence
  Description of Artificial Sequence: Synthetic oligonucleotide
ccagatcgtgaccacgcacttccagatg

SEQ ID NO: 268847 - DNA, 30 bp, Artificial Sequence
  Description of Artificial Sequence: Synthetic oligonucleotide
cagatcgtgaccacgcacttccagatgatc

SEQ ID NO: 268848 - DNA, 33 bp, Artificial Sequence
  Description of Artificial Sequence: Synthetic oligonucleotide
agatcgtgaccacgcacttccagatgatctttc

SEQ ID NO: 268849 - DNA, 32 bp, Artificial Sequence
  Description of Artificial Sequence: Synthetic oligonucleotide
gatcgtgaccacgcacttccagatgatctttc

SEQ ID NO: 268850 - DNA, 32 bp, Artificial Sequence
  Description of Artificial Sequence: Synthetic oligonucleotide
atcgtgaccacgcacttccagatgatctttcc

SEQ ID NO: 268851 - DNA, 31 bp, Artificial Sequence
  Description of Artificial Sequence: Synthetic oligonucleotide
tcgtgaccacgcacttccagatgatctttcc

SEQ ID NO: 268852 - DNA, 30 bp, Artificial Sequence
  Description of Artificial Sequence: Synthetic oligonucleotide
cgtgaccacgcacttccagatgatctttcc

SEQ ID NO: 268853 - DNA, 30 bp, Artificial Sequence
  Description of Artificial Sequence: Synthetic oligonucleotide
gtgaccacgcacttccagatgatctttccg

SEQ ID NO: 268854 - DNA, 32 bp, Artificial Sequence
  Description of Artificial Sequence: Synthetic oligonucleotide
tgaccacgcacttccagatgatctttccgatg

SEQ ID NO: 268855 - DNA, 31 bp, Artificial Sequence
  Description of Artificial Sequence: Synthetic oligonucleotide
gaccacgcacttccagatgatctttccgatg

SEQ ID NO: 268856 - DNA, 31 bp, Artificial Sequence
  Description of Artificial Sequence: Synthetic oligonucleotide
accacgcacttccagatgatctttccgatgg

SEQ ID NO: 268857 - DNA, 30 bp, Artificial Sequence
  Description of Artificial Sequence: Synthetic oligonucleotide
ccacgcacttccagatgatctttccgatgg

SEQ ID NO: 268858 - DNA, 30 bp, Artificial Sequence
  Description of Artificial Sequence: Synthetic oligonucleotide
cacgcacttccagatgatctttccgatggg

SEQ ID NO: 268859 - DNA, 31 bp, Artificial Sequence
  Description of Artificial Sequence: Synthetic oligonucleotide
acgcacttccagatgatctttccgatgggtg

SEQ ID NO: 268860 - DNA, 30 bp, Artificial Sequence
  Description of Artificial Sequence: Synthetic oligonucleotide
cgcacttccagatgatctttccgatgggtg

SEQ ID NO: 268861 - DNA, 31 bp, Artificial Sequence
  Description of Artificial Sequence: Synthetic oligonucleotide
gcacttccagatgatctttccgatgggtgac

SEQ ID NO: 268862 - DNA, 31 bp, Artificial Sequence
  Description of Artificial Sequence: Synthetic oligonucleotide
cacttccagatgatctttccgatgggtgacg

SEQ ID NO: 268863 - DNA, 31 bp, Artificial Sequence
  Description of Artificial Sequence: Synthetic oligonucleotide
acttccagatgatctttccgatgggtgacgg

SEQ ID NO: 268864 - DNA, 30 bp, Artificial Sequence
  Description of Artificial Sequence: Synthetic oligonucleotide
cttccagatgatctttccgatgggtgacgg

SEQ ID NO: 268865 - DNA, 30 bp, Artificial Sequence
  Description of Artificial Sequence: Synthetic oligonucleotide
ttccagatgatctttccgatgggtgacggg

SEQ ID NO: 268866 - DNA, 29 bp, Artificial Sequence
  Description of Artificial Sequence: Synthetic oligonucleotide
tccagatgatctttccgatgggtgacggg

SEQ ID NO: 268867 - DNA, 28 bp, Artificial Sequence
  Description of Artificial Sequence: Synthetic oligonucleotide
ccagatgatctttccgatgggtgacggg

SEQ ID NO: 268868 - DNA, 28 bp, Artificial Sequence
  Description of Artificial Sequence: Synthetic oligonucleotide
cagatgatctttccgatgggtgacgggc

SEQ ID NO: 268869 - DNA, 29 bp, Artificial Sequence
  Description of Artificial Sequence: Synthetic oligonucleotide
agatgatctttccgatgggtgacgggctg

SEQ ID NO: 268870 - DNA, 28 bp, Artificial Sequence
  Description of Artificial Sequence: Synthetic oligonucleotide
gatgatctttccgatgggtgacgggctg

SEQ ID NO: 268871 - DNA, 30 bp, Artificial Sequence
  Description of Artificial Sequence: Synthetic oligonucleotide
atgatctttccgatgggtgacgggctgtac

SEQ ID NO: 268872 - DNA, 29 bp, Artificial Sequence
  Description of Artificial Sequence: Synthetic oligonucleotide
tgatctttccgatgggtgacgggctgtac

SEQ ID NO: 268873 - DNA, 28 bp, Artificial Sequence
  Description of Artificial Sequence: Synthetic oligonucleotide
gatctttccgatgggtgacgggctgtac

SEQ ID NO: 268874 - DNA, 30 bp, Artificial Sequence
  Description of Artificial Sequence: Synthetic oligonucleotide
atctttccgatgggtgacgggctgtacaac

SEQ ID NO: 268875 - DNA, 29 bp, Artificial Sequence
  Description of Artificial Sequence: Synthetic oligonucleotide
tctttccgatgggtgacgggctgtacaac

SEQ ID NO: 268876 - DNA, 28 bp, Artificial Sequence
  Description of Artificial Sequence: Synthetic oligonucleotide
ctttccgatgggtgacgggctgtacaac

SEQ ID NO: 268877 - DNA, 28 bp, Artificial Sequence
  Description of Artificial Sequence: Synthetic oligonucleotide
tttccgatgggtgacgggctgtacaacg

SEQ ID NO: 268878 - DNA, 27 bp, Artificial Sequence
  Description of Artificial Sequence: Synthetic oligonucleotide
ttccgatgggtgacgggctgtacaacg

SEQ ID NO: 268879 - DNA, 26 bp, Artificial Sequence
  Description of Artificial Sequence: Synthetic oligonucleotide
tccgatgggtgacgggctgtacaacg

SEQ ID NO: 268880 - DNA, 25 bp, Artificial Sequence
  Description of Artificial Sequence: Synthetic oligonucleotide
ccgatgggtgacgggctgtacaacg

SEQ ID NO: 268881 - DNA, 26 bp, Artificial Sequence
  Description of Artificial Sequence: Synthetic oligonucleotide
cgatgggtgacgggctgtacaacggt

SEQ ID NO: 268882 - DNA, 27 bp, Artificial Sequence
  Description of Artificial Sequence: Synthetic oligonucleotide
gatgggtgacgggctgtacaacggtct

SEQ ID NO: 268883 - DNA, 27 bp, Artificial Sequence
  Description of Artificial Sequence: Synthetic oligonucleotide
atgggtgacgggctgtacaacggtctg

SEQ ID NO: 268884 - DNA, 26 bp, Artificial Sequence
  Description of Artificial Sequence: Synthetic oligonucleotide
tgggtgacgggctgtacaacggtctg

SEQ ID NO: 268885 - DNA, 25 bp, Artificial Sequence
  Description of Artificial Sequence: Synthetic oligonucleotide
gggtgacgggctgtacaacggtctg

SEQ ID NO: 268886 - DNA, 25 bp, Artificial Sequence
  Description of Artificial Sequence: Synthetic oligonucleotide
ggtgacgggctgtacaacggtctgg

SEQ ID NO: 268887 - DNA, 25 bp, Artificial Sequence
  Description of Artificial Sequence: Synthetic oligonucleotide
gtgacgggctgtacaacggtctggc

SEQ ID NO: 268888 - DNA, 25 bp, Artificial Sequence
  Description of Artificial Sequence: Synthetic oligonucleotide
tgacgggctgtacaacggtctggcg

SEQ ID NO: 268889 - DNA, 24 bp, Artificial Sequence
  Description of Artificial Sequence: Synthetic oligonucleotide
gacgggctgtacaacggtctggcg

SEQ ID NO: 268890 - DNA, 24 bp, Artificial Sequence
  Description of Artificial Sequence: Synthetic oligonucleotide
acgggctgtacaacggtctggcgg

SEQ ID NO: 268891 - DNA, 23 bp, Artificial Sequence
  Description of Artificial Sequence: Synthetic oligonucleotide
cgggctgtacaacggtctggcgg

SEQ ID NO: 268892 - DNA, 23 bp, Artificial Sequence
  Description of Artificial Sequence: Synthetic oligonucleotide
gggctgtacaacggtctggcggg

SEQ ID NO: 268893 - DNA, 23 bp, Artificial Sequence
  Description of Artificial Sequence: Synthetic oligonucleotide
ggctgtacaacggtctggcgggg

SEQ ID NO: 268894 - DNA, 24 bp, Artificial Sequence
  Description of Artificial Sequence: Synthetic oligonucleotide
gctgtacaacggtctggcggggct

SEQ ID NO: 268895 - DNA, 24 bp, Artificial Sequence
  Description of Artificial Sequence: Synthetic oligonucleotide
ctgtacaacggtctggcggggctc

SEQ ID NO: 268896 - DNA, 24 bp, Artificial Sequence
  Description of Artificial Sequence: Synthetic oligonucleotide
tgtacaacggtctggcggggctcg

SEQ ID NO: 268897 - DNA, 23 bp, Artificial Sequence
  Description of Artificial Sequence: Synthetic oligonucleotide
gtacaacggtctggcggggctcg

SEQ ID NO: 268898 - DNA, 23 bp, Artificial Sequence
  Description of Artificial Sequence: Synthetic oligonucleotide
tacaacggtctggcggggctcgc

SEQ ID NO: 268899 - DNA, 22 bp, Artificial Sequence
  Description of Artificial Sequence: Synthetic oligonucleotide
acaacggtctggcggggctcgc

SEQ ID NO: 268900 - DNA, 21 bp, Artificial Sequence
  Description of Artificial Sequence: Synthetic oligonucleotide
caacggtctggcggggctcgc

SEQ ID NO: 268901 - DNA, 22 bp, Artificial Sequence
  Description of Artificial Sequence: Synthetic oligonucleotide
aacggtctggcggggctcgcct

SEQ ID NO: 268902 - DNA, 21 bp, Artificial Sequence
  Description of Artificial Sequence: Synthetic oligonucleotide
acggtctggcggggctcgcct

SEQ ID NO: 268903 - DNA, 20 bp, Artificial Sequence
  Description of Artificial Sequence: Synthetic oligonucleotide
cggtctggcggggctcgcct

SEQ ID NO: 268904 - DNA, 21 bp, Artificial Sequence
  Description of Artificial Sequence: Synthetic oligonucleotide
ggtctggcggggctcgcctct

SEQ ID NO: 268905 - DNA, 22 bp, Artificial Sequence
  Description of Artificial Sequence: Synthetic oligonucleotide
gtctggcggggctcgcctctga

SEQ ID NO: 268906 - DNA, 22 bp, Artificial Sequence
  Description of Artificial Sequence: Synthetic oligonucleotide
tctggcggggctcgcctctgac

SEQ ID NO: 268907 - DNA, 21 bp, Artificial Sequence
  Description of Artificial Sequence: Synthetic oligonucleotide
ctggcggggctcgcctctgac

SEQ ID NO: 268908 - DNA, 22 bp, Artificial Sequence
  Description of Artificial Sequence: Synthetic oligonucleotide
tggcggggctcgcctctgacgt

SEQ ID NO: 268909 - DNA, 21 bp, Artificial Sequence
  Description of Artificial Sequence: Synthetic oligonucleotide
ggcggggctcgcctctgacgt

SEQ ID NO: 268910 - DNA, 21 bp, Artificial Sequence
  Description of Artificial Sequence: Synthetic oligonucleotide
gcggggctcgcctctgacgtc

SEQ ID NO: 268911 - DNA, 22 bp, Artificial Sequence
  Description of Artificial Sequence: Synthetic oligonucleotide
cggggctcgcctctgacgtcct

SEQ ID NO: 268912 - DNA, 23 bp, Artificial Sequence
  Description of Artificial Sequence: Synthetic oligonucleotide
ggggctcgcctctgacgtcctga

SEQ ID NO: 268913 - DNA, 24 bp, Artificial Sequence
  Description of Artificial Sequence: Synthetic oligonucleotide
gggctcgcctctgacgtcctgaca

SEQ ID NO: 268914 - DNA, 26 bp, Artificial Sequence
  Description of Artificial Sequence: Synthetic oligonucleotide
ggctcgcctctgacgtcctgacagtt

SEQ ID NO: 268915 - DNA, 26 bp, Artificial Sequence
  Description of Artificial Sequence: Synthetic oligonucleotide
gctcgcctctgacgtcctgacagttg

SEQ ID NO: 268916 - DNA, 26 bp, Artificial Sequence
  Description of Artificial Sequence: Synthetic oligonucleotide
ctcgcctctgacgtcctgacagttgc

SEQ ID NO: 268917 - DNA, 26 bp, Artificial Sequence
  Description of Artificial Sequence: Synthetic oligonucleotide
tcgcctctgacgtcctgacagttgcg

SEQ ID NO: 268918 - DNA, 25 bp, Artificial Sequence
  Description of Artificial Sequence: Synthetic oligonucleotide
cgcctctgacgtcctgacagttgcg

SEQ ID NO: 268919 - DNA, 26 bp, Artificial Sequence
  Description of Artificial Sequence: Synthetic oligonucleotide
gcctctgacgtcctgacagttgcgca

SEQ ID NO: 268920 - DNA, 26 bp, Artificial Sequence
  Description of Artificial Sequence: Synthetic oligonucleotide
cctctgacgtcctgacagttgcgcag

SEQ ID NO: 268921 - DNA, 26 bp, Artificial Sequence
  Description of Artificial Sequence: Synthetic oligonucleotide
ctctgacgtcctgacagttgcgcagc

SEQ ID NO: 268922 - DNA, 26 bp, Artificial Sequence
  Description of Artificial Sequence: Synthetic oligonucleotide
tctgacgtcctgacagttgcgcagcg

SEQ ID NO: 268923 - DNA, 25 bp, Artificial Sequence
  Description of Artificial Sequence: Synthetic oligonucleotide
ctgacgtcctgacagttgcgcagcg

SEQ ID NO: 268924 - DNA, 25 bp, Artificial Sequence
  Description of Artificial Sequence: Synthetic oligonucleotide
tgacgtcctgacagttgcgcagcgc

SEQ ID NO: 268925 - DNA, 24 bp, Artificial Sequence
  Description of Artificial Sequence: Synthetic oligonucleotide
gacgtcctgacagttgcgcagcgc

SEQ ID NO: 268926 - DNA, 25 bp, Artificial Sequence
  Description of Artificial Sequence: Synthetic oligonucleotide
acgtcctgacagttgcgcagcgcct

SEQ ID NO: 268927 - DNA, 24 bp, Artificial Sequence
  Description of Artificial Sequence: Synthetic oligonucleotide
cgtcctgacagttgcgcagcgcct

SEQ ID NO: 268928 - DNA, 26 bp, Artificial Sequence
  Description of Artificial Sequence: Synthetic oligonucleotide
gtcctgacagttgcgcagcgcctcta

SEQ ID NO: 268929 - DNA, 27 bp, Artificial Sequence
  Description of Artificial Sequence: Synthetic oligonucleotide
tcctgacagttgcgcagcgcctctagt

SEQ ID NO: 268930 - DNA, 27 bp, Artificial Sequence
  Description of Artificial Sequence: Synthetic oligonucleotide
cctgacagttgcgcagcgcctctagtt

SEQ ID NO: 268931 - DNA, 27 bp, Artificial Sequence
  Description of Artificial Sequence: Synthetic oligonucleotide
ctgacagttgcgcagcgcctctagttc

SEQ ID NO: 268932 - DNA, 27 bp, Artificial Sequence
  Description of Artificial Sequence: Synthetic oligonucleotide
tgacagttgcgcagcgcctctagttcc

SEQ ID NO: 268933 - DNA, 26 bp, Artificial Sequence
  Description of Artificial Sequence: Synthetic oligonucleotide
gacagttgcgcagcgcctctagttcc

SEQ ID NO: 268934 - DNA, 26 bp, Artificial Sequence
  Description of Artificial Sequence: Synthetic oligonucleotide
acagttgcgcagcgcctctagttccg

SEQ ID NO: 268935 - DNA, 25 bp, Artificial Sequence
  Description of Artificial Sequence: Synthetic oligonucleotide
cagttgcgcagcgcctctagttccg

SEQ ID NO: 268936 - DNA, 25 bp, Artificial Sequence
  Description of Artificial Sequence: Synthetic oligonucleotide
agttgcgcagcgcctctagttccgg

SEQ ID NO: 268937 - DNA, 24 bp, Artificial Sequence
  Description of Artificial Sequence: Synthetic oligonucleotide
gttgcgcagcgcctctagttccgg

SEQ ID NO: 268938 - DNA, 25 bp, Artificial Sequence
  Description of Artificial Sequence: Synthetic oligonucleotide
ttgcgcagcgcctctagttccggca

SEQ ID NO: 268939 - DNA, 24 bp, Artificial Sequence
  Description of Artificial Sequence: Synthetic oligonucleotide
tgcgcagcgcctctagttccggca

SEQ ID NO: 268940 - DNA, 23 bp, Artificial Sequence
  Description of Artificial Sequence: Synthetic oligonucleotide
gcgcagcgcctctagttccggca

SEQ ID NO: 268941 - DNA, 25 bp, Artificial Sequence
  Description of Artificial Sequence: Synthetic oligonucleotide
cgcagcgcctctagttccggcagaa

SEQ ID NO: 268942 - DNA, 25 bp, Artificial Sequence
  Description of Artificial Sequence: Synthetic oligonucleotide
gcagcgcctctagttccggcagaac

SEQ ID NO: 268943 - DNA, 26 bp, Artificial Sequence
  Description of Artificial Sequence: Synthetic oligonucleotide
cagcgcctctagttccggcagaacct

SEQ ID NO: 268944 - DNA, 27 bp, Artificial Sequence
  Description of Artificial Sequence: Synthetic oligonucleotide
agcgcctctagttccggcagaacctgt

SEQ ID NO: 268945 - DNA, 27 bp, Artificial Sequence
  Description of Artificial Sequence: Synthetic oligonucleotide
gcgcctctagttccggcagaacctgta

SEQ ID NO: 268946 - DNA, 28 bp, Artificial Sequence
  Description of Artificial Sequence: Synthetic oligonucleotide
cgcctctagttccggcagaacctgtaag

SEQ ID NO: 268947 - DNA, 29 bp, Artificial Sequence
  Description of Artificial Sequence: Synthetic oligonucleotide
gcctctagttccggcagaacctgtaagag

SEQ ID NO: 268948 - DNA, 31 bp, Artificial Sequence
  Description of Artificial Sequence: Synthetic oligonucleotide
cctctagttccggcagaacctgtaagagttg

SEQ ID NO: 268949 - DNA, 33 bp, Artificial Sequence
  Description of Artificial Sequence: Synthetic oligonucleotide
ctctagttccggcagaacctgtaagagttgaag

SEQ ID NO: 268950 - DNA, 33 bp, Artificial Sequence
  Description of Artificial Sequence: Synthetic oligonucleotide
tctagttccggcagaacctgtaagagttgaagc

SEQ ID NO: 268951 - DNA, 32 bp, Artificial Sequence
  Description of Artificial Sequence: Synthetic oligonucleotide
ctagttccggcagaacctgtaagagttgaagc

SEQ ID NO: 268952 - DNA, 34 bp, Artificial Sequence
  Description of Artificial Sequence: Synthetic oligonucleotide
tagttccggcagaacctgtaagagttgaagcaag

SEQ ID NO: 268953 - DNA, 33 bp, Artificial Sequence
  Description of Artificial Sequence: Synthetic oligonucleotide
agttccggcagaacctgtaagagttgaagcaag

SEQ ID NO: 268954 - DNA, 32 bp, Artificial Sequence
  Description of Artificial Sequence: Synthetic oligonucleotide
gttccggcagaacctgtaagagttgaagcaag

SEQ ID NO: 268955 - DNA, 32 bp, Artificial Sequence
  Description of Artificial Sequence: Synthetic oligonucleotide
ttccggcagaacctgtaagagttgaagcaagg

SEQ ID NO: 268956 - DNA, 31 bp, Artificial Sequence
  Description of Artificial Sequence: Synthetic oligonucleotide
tccggcagaacctgtaagagttgaagcaagg

SEQ ID NO: 268957 - DNA, 30 bp, Artificial Sequence
  Description of Artificial Sequence: Synthetic oligonucleotide
ccggcagaacctgtaagagttgaagcaagg

SEQ ID NO: 268958 - DNA, 31 bp, Artificial Sequence
  Description of Artificial Sequence: Synthetic oligonucleotide
cggcagaacctgtaagagttgaagcaaggtc

SEQ ID NO: 268959 - DNA, 31 bp, Artificial Sequence
  Description of Artificial Sequence: Synthetic oligonucleotide
ggcagaacctgtaagagttgaagcaaggtcg

SEQ ID NO: 268960 - DNA, 31 bp, Artificial Sequence
  Description of Artificial Sequence: Synthetic oligonucleotide
gcagaacctgtaagagttgaagcaaggtcgg

SEQ ID NO: 268961 - DNA, 31 bp, Artificial Sequence
  Description of Artificial Sequence: Synthetic oligonucleotide
cagaacctgtaagagttgaagcaaggtcggc

SEQ ID NO: 268962 - DNA, 32 bp, Artificial Sequence
  Description of Artificial Sequence: Synthetic oligonucleotide
agaacctgtaagagttgaagcaaggtcggctg

SEQ ID NO: 268963 - DNA, 31 bp, Artificial Sequence
  Description of Artificial Sequence: Synthetic oligonucleotide
gaacctgtaagagttgaagcaaggtcggctg

SEQ ID NO: 268964 - DNA, 33 bp, Artificial Sequence
  Description of Artificial Sequence: Synthetic oligonucleotide
aacctgtaagagttgaagcaaggtcggctgatc

SEQ ID NO: 268965 - DNA, 32 bp, Artificial Sequence
  Description of Artificial Sequence: Synthetic oligonucleotide
acctgtaagagttgaagcaaggtcggctgatc

SEQ ID NO: 268966 - DNA, 31 bp, Artificial Sequence
  Description of Artificial Sequence: Synthetic oligonucleotide
cctgtaagagttgaagcaaggtcggctgatc

SEQ ID NO: 268967 - DNA, 34 bp, Artificial Sequence
  Description of Artificial Sequence: Synthetic oligonucleotide
ctgtaagagttgaagcaaggtcggctgatcaaac

SEQ ID NO: 268968 - DNA, 34 bp, Artificial Sequence
  Description of Artificial Sequence: Synthetic oligonucleotide
tgtaagagttgaagcaaggtcggctgatcaaacc

SEQ ID NO: 268969 - DNA, 33 bp, Artificial Sequence
  Description of Artificial Sequence: Synthetic oligonucleotide
gtaagagttgaagcaaggtcggctgatcaaacc

SEQ ID NO: 268970 - DNA, 38 bp, Artificial Sequence
  Description of Artificial Sequence: Synthetic oligonucleotide
taagagttgaagcaaggtcggctgatcaaaccatatac

SEQ ID NO: 268971 - DNA, 37 bp, Artificial Sequence
  Description of Artificial Sequence: Synthetic oligonucleotide
aagagttgaagcaaggtcggctgatcaaaccatatac

SEQ ID NO: 268972 - DNA, 36 bp, Artificial Sequence
  Description of Artificial Sequence: Synthetic oligonucleotide
agagttgaagcaaggtcggctgatcaaaccatatac

SEQ ID NO: 268973 - DNA, 35 bp, Artificial Sequence
  Description of Artificial Sequence: Synthetic oligonucleotide
gagttgaagcaaggtcggctgatcaaaccatatac

SEQ ID NO: 268974 - DNA, 35 bp, Artificial Sequence
  Description of Artificial Sequence: Synthetic oligonucleotide
agttgaagcaaggtcggctgatcaaaccatatacc

SEQ ID NO: 268975 - DNA, 34 bp, Artificial Sequence
  Description of Artificial Sequence: Synthetic oligonucleotide
gttgaagcaaggtcggctgatcaaaccatatacc

SEQ ID NO: 268976 - DNA, 34 bp, Artificial Sequence
  Description of Artificial Sequence: Synthetic oligonucleotide
ttgaagcaaggtcggctgatcaaaccatataccc

SEQ ID NO: 268977 - DNA, 33 bp, Artificial Sequence
  Description of Artificial Sequence: Synthetic oligonucleotide
tgaagcaaggtcggctgatcaaaccatataccc

SEQ ID NO: 268978 - DNA, 32 bp, Artificial Sequence
  Description of Artificial Sequence: Synthetic oligonucleotide
gaagcaaggtcggctgatcaaaccatataccc

SEQ ID NO: 268979 - DNA, 33 bp, Artificial Sequence
  Description of Artificial Sequence: Synthetic oligonucleotide
aagcaaggtcggctgatcaaaccatataccctc

SEQ ID NO: 268980 - DNA, 32 bp, Artificial Sequence
  Description of Artificial Sequence: Synthetic oligonucleotide
agcaaggtcggctgatcaaaccatataccctc

SEQ ID NO: 268981 - DNA, 31 bp, Artificial Sequence
  Description of Artificial Sequence: Synthetic oligonucleotide
gcaaggtcggctgatcaaaccatataccctc

SEQ ID NO: 268982 - DNA, 33 bp, Artificial Sequence
  Description of Artificial Sequence: Synthetic oligonucleotide
caaggtcggctgatcaaaccatataccctcttg

SEQ ID NO: 268983 - DNA, 34 bp, Artificial Sequence
  Description of Artificial Sequence: Synthetic oligonucleotide
aaggtcggctgatcaaaccatataccctcttgag

SEQ ID NO: 268984 - DNA, 33 bp, Artificial Sequence
  Description of Artificial Sequence: Synthetic oligonucleotide
aggtcggctgatcaaaccatataccctcttgag

SEQ ID NO: 268985 - DNA, 32 bp, Artificial Sequence
  Description of Artificial Sequence: Synthetic oligonucleotide
ggtcggctgatcaaaccatataccctcttgag

SEQ ID NO: 268986 - DNA, 32 bp, Artificial Sequence
  Description of Artificial Sequence: Synthetic oligonucleotide
gtcggctgatcaaaccatataccctcttgagc

SEQ ID NO: 268987 - DNA, 34 bp, Artificial Sequence
  Description of Artificial Sequence: Synthetic oligonucleotide
tcggctgatcaaaccatataccctcttgagcatg

SEQ ID NO: 268988 - DNA, 33 bp, Artificial Sequence
  Description of Artificial Sequence: Synthetic oligonucleotide
cggctgatcaaaccatataccctcttgagcatg

SEQ ID NO: 268989 - DNA, 33 bp, Artificial Sequence
  Description of Artificial Sequence: Synthetic oligonucleotide
ggctgatcaaaccatataccctcttgagcatgg

SEQ ID NO: 268990 - DNA, 34 bp, Artificial Sequence
  Description of Artificial Sequence: Synthetic oligonucleotide
gctgatcaaaccatataccctcttgagcatggag

SEQ ID NO: 268991 - DNA, 34 bp, Artificial Sequence
  Description of Artificial Sequence: Synthetic oligonucleotide
ctgatcaaaccatataccctcttgagcatggagg

SEQ ID NO: 268992 - DNA, 34 bp, Artificial Sequence
  Description of Artificial Sequence: Synthetic oligonucleotide
tgatcaaaccatataccctcttgagcatggaggc

SEQ ID NO: 268993 - DNA, 33 bp, Artificial Sequence
  Description of Artificial Sequence: Synthetic oligonucleotide
gatcaaaccatataccctcttgagcatggaggc

SEQ ID NO: 268994 - DNA, 33 bp, Artificial Sequence
  Description of Artificial Sequence: Synthetic oligonucleotide
atcaaaccatataccctcttgagcatggaggcc

SEQ ID NO: 268995 - DNA, 32 bp, Artificial Sequence
  Description of Artificial Sequence: Synthetic oligonucleotide
tcaaaccatataccctcttgagcatggaggcc

SEQ ID NO: 268996 - DNA, 31 bp, Artificial Sequence
  Description of Artificial Sequence: Synthetic oligonucleotide
caaaccatataccctcttgagcatggaggcc

SEQ ID NO: 268997 - DNA, 33 bp, Artificial Sequence
  Description of Artificial Sequence: Synthetic oligonucleotide
aaaccatataccctcttgagcatggaggccaac

SEQ ID NO: 268998 - DNA, 32 bp, Artificial Sequence
  Description of Artificial Sequence: Synthetic oligonucleotide
aaccatataccctcttgagcatggaggccaac

SEQ ID NO: 268999 - DNA, 31 bp, Artificial Sequence
  Description of Artificial Sequence: Synthetic oligonucleotide
accatataccctcttgagcatggaggccaac

SEQ ID NO: 269000 - DNA, 30 bp, Artificial Sequence
  Description of Artificial Sequence: Synthetic oligonucleotide
ccatataccctcttgagcatggaggccaac

SEQ ID NO: 269001 - DNA, 30 bp, Artificial Sequence
  Description of Artificial Sequence: Synthetic oligonucleotide
catataccctcttgagcatggaggccaacc

SEQ ID NO: 269002 - DNA, 31 bp, Artificial Sequence
  Description of Artificial Sequence: Synthetic oligonucleotide
atataccctcttgagcatggaggccaacctg

SEQ ID NO: 269003 - DNA, 30 bp, Artificial Sequence
  Description of Artificial Sequence: Synthetic oligonucleotide
tataccctcttgagcatggaggccaacctg

SEQ ID NO: 269004 - DNA, 29 bp, Artificial Sequence
  Description of Artificial Sequence: Synthetic oligonucleotide
ataccctcttgagcatggaggccaacctg

SEQ ID NO: 269005 - DNA, 28 bp, Artificial Sequence
  Description of Artificial Sequence: Synthetic oligonucleotide
taccctcttgagcatggaggccaacctg

SEQ ID NO: 269006 - DNA, 27 bp, Artificial Sequence
  Description of Artificial Sequence: Synthetic oligonucleotide
accctcttgagcatggaggccaacctg

SEQ ID NO: 269007 - DNA, 27 bp, Artificial Sequence
  Description of Artificial Sequence: Synthetic oligonucleotide
ccctcttgagcatggaggccaacctgt

SEQ ID NO: 269008 - DNA, 28 bp, Artificial Sequence
  Description of Artificial Sequence: Synthetic oligonucleotide
cctcttgagcatggaggccaacctgttg

SEQ ID NO: 269009 - DNA, 31 bp, Artificial Sequence
  Description of Artificial Sequence: Synthetic oligonucleotide
ctcttgagcatggaggccaacctgttgtatg

SEQ ID NO: 269010 - DNA, 32 bp, Artificial Sequence
  Description of Artificial Sequence: Synthetic oligonucleotide
tcttgagcatggaggccaacctgttgtatgag

SEQ ID NO: 269011 - DNA, 31 bp, Artificial Sequence
  Description of Artificial Sequence: Synthetic oligonucleotide
cttgagcatggaggccaacctgttgtatgag

SEQ ID NO: 269012 - DNA, 34 bp, Artificial Sequence
  Description of Artificial Sequence: Synthetic oligonucleotide
ttgagcatggaggccaacctgttgtatgagtaac

SEQ ID NO: 269013 - DNA, 33 bp, Artificial Sequence
  Description of Artificial Sequence: Synthetic oligonucleotide
tgagcatggaggccaacctgttgtatgagtaac

SEQ ID NO: 269014 - DNA, 32 bp, Artificial Sequence
  Description of Artificial Sequence: Synthetic oligonucleotide
gagcatggaggccaacctgttgtatgagtaac

SEQ ID NO: 269015 - DNA, 32 bp, Artificial Sequence
  Description of Artificial Sequence: Synthetic oligonucleotide
agcatggaggccaacctgttgtatgagtaacg

SEQ ID NO: 269016 - DNA, 31 bp, Artificial Sequence
  Description of Artificial Sequence: Synthetic oligonucleotide
gcatggaggccaacctgttgtatgagtaacg

SEQ ID NO: 269017 - DNA, 31 bp, Artificial Sequence
  Description of Artificial Sequence: Synthetic oligonucleotide
catggaggccaacctgttgtatgagtaacgg

SEQ ID NO: 269018 - DNA, 34 bp, Artificial Sequence
  Description of Artificial Sequence: Synthetic oligonucleotide
atggaggccaacctgttgtatgagtaacggtttg

SEQ ID NO: 269019 - DNA, 33 bp, Artificial Sequence
  Description of Artificial Sequence: Synthetic oligonucleotide
tggaggccaacctgttgtatgagtaacggtttg

SEQ ID NO: 269020 - DNA, 32 bp, Artificial Sequence
  Description of Artificial Sequence: Synthetic oligonucleotide
ggaggccaacctgttgtatgagtaacggtttg

SEQ ID NO: 269021 - DNA, 32 bp, Artificial Sequence
  Description of Artificial Sequence: Synthetic oligonucleotide
gaggccaacctgttgtatgagtaacggtttgc

SEQ ID NO: 269022 - DNA, 32 bp, Artificial Sequence
  Description of Artificial Sequence: Synthetic oligonucleotide
aggccaacctgttgtatgagtaacggtttgcc

SEQ ID NO: 269023 - DNA, 31 bp, Artificial Sequence
  Description of Artificial Sequence: Synthetic oligonucleotide
ggccaacctgttgtatgagtaacggtttgcc

SEQ ID NO: 269024 - DNA, 31 bp, Artificial Sequence
  Description of Artificial Sequence: Synthetic oligonucleotide
gccaacctgttgtatgagtaacggtttgccc

SEQ ID NO: 269025 - DNA, 31 bp, Artificial Sequence
  Description of Artificial Sequence: Synthetic oligonucleotide
ccaacctgttgtatgagtaacggtttgcccc

SEQ ID NO: 269026 - DNA, 34 bp, Artificial Sequence
  Description of Artificial Sequence: Synthetic oligonucleotide
caacctgttgtatgagtaacggtttgccccttac

SEQ ID NO: 269027 - DNA, 36 bp, Artificial Sequence
  Description of Artificial Sequence: Synthetic oligonucleotide
aacctgttgtatgagtaacggtttgccccttactag

SEQ ID NO: 269028 - DNA, 35 bp, Artificial Sequence
  Description of Artificial Sequence: Synthetic oligonucleotide
acctgttgtatgagtaacggtttgccccttactag

SEQ ID NO: 269029 - DNA, 34 bp, Artificial Sequence
  Description of Artificial Sequence: Synthetic oligonucleotide
cctgttgtatgagtaacggtttgccccttactag

SEQ ID NO: 269030 - DNA, 35 bp, Artificial Sequence
  Description of Artificial Sequence: Synthetic oligonucleotide
ctgttgtatgagtaacggtttgccccttactagac

SEQ ID NO: 269031 - DNA, 36 bp, Artificial Sequence
  Description of Artificial Sequence: Synthetic oligonucleotide
tgttgtatgagtaacggtttgccccttactagactg

SEQ ID NO: 269032 - DNA, 35 bp, Artificial Sequence
  Description of Artificial Sequence: Synthetic oligonucleotide
gttgtatgagtaacggtttgccccttactagactg

SEQ ID NO: 269033 - DNA, 36 bp, Artificial Sequence
  Description of Artificial Sequence: Synthetic oligonucleotide
ttgtatgagtaacggtttgccccttactagactgag

SEQ ID NO: 269034 - DNA, 35 bp, Artificial Sequence
  Description of Artificial Sequence: Synthetic oligonucleotide
tgtatgagtaacggtttgccccttactagactgag

SEQ ID NO: 269035 - DNA, 34 bp, Artificial Sequence
  Description of Artificial Sequence: Synthetic oligonucleotide
gtatgagtaacggtttgccccttactagactgag

SEQ ID NO: 269036 - DNA, 34 bp, Artificial Sequence
  Description of Artificial Sequence: Synthetic oligonucleotide
tatgagtaacggtttgccccttactagactgagc

SEQ ID NO: 269037 - DNA, 33 bp, Artificial Sequence
  Description of Artificial Sequence: Synthetic oligonucleotide
atgagtaacggtttgccccttactagactgagc

SEQ ID NO: 269038 - DNA, 32 bp, Artificial Sequence
  Description of Artificial Sequence: Synthetic oligonucleotide
tgagtaacggtttgccccttactagactgagc

SEQ ID NO: 269039 - DNA, 31 bp, Artificial Sequence
  Description of Artificial Sequence: Synthetic oligonucleotide
gagtaacggtttgccccttactagactgagc

SEQ ID NO: 269040 - DNA, 31 bp, Artificial Sequence
  Description of Artificial Sequence: Synthetic oligonucleotide
agtaacggtttgccccttactagactgagcc

SEQ ID NO: 269041 - DNA, 30 bp, Artificial Sequence
  Description of Artificial Sequence: Synthetic oligonucleotide
gtaacggtttgccccttactagactgagcc

SEQ ID NO: 269042 - DNA, 31 bp, Artificial Sequence
  Description of Artificial Sequence: Synthetic oligonucleotide
taacggtttgccccttactagactgagccac

SEQ ID NO: 269043 - DNA, 30 bp, Artificial Sequence
  Description of Artificial Sequence: Synthetic oligonucleotide
aacggtttgccccttactagactgagccac

SEQ ID NO: 269044 - DNA, 29 bp, Artificial Sequence
  Description of Artificial Sequence: Synthetic oligonucleotide
acggtttgccccttactagactgagccac

SEQ ID NO: 269045 - DNA, 28 bp, Artificial Sequence
  Description of Artificial Sequence: Synthetic oligonucleotide
cggtttgccccttactagactgagccac

SEQ ID NO: 269046 - DNA, 29 bp, Artificial Sequence
  Description of Artificial Sequence: Synthetic oligonucleotide
ggtttgccccttactagactgagccactc

SEQ ID NO: 269047 - DNA, 32 bp, Artificial Sequence
  Description of Artificial Sequence: Synthetic oligonucleotide
gtttgccccttactagactgagccactcattg

SEQ ID NO: 269048 - DNA, 32 bp, Artificial Sequence
  Description of Artificial Sequence: Synthetic oligonucleotide
tttgccccttactagactgagccactcattgc

SEQ ID NO: 269049 - DNA, 31 bp, Artificial Sequence
  Description of Artificial Sequence: Synthetic oligonucleotide
ttgccccttactagactgagccactcattgc

SEQ ID NO: 269050 - DNA, 30 bp, Artificial Sequence
  Description of Artificial Sequence: Synthetic oligonucleotide
tgccccttactagactgagccactcattgc

SEQ ID NO: 269051 - DNA, 29 bp, Artificial Sequence
  Description of Artificial Sequence: Synthetic oligonucleotide
gccccttactagactgagccactcattgc

SEQ ID NO: 269052 - DNA, 29 bp, Artificial Sequence
  Description of Artificial Sequence: Synthetic oligonucleotide
ccccttactagactgagccactcattgcc

SEQ ID NO: 269053 - DNA, 29 bp, Artificial Sequence
  Description of Artificial Sequence: Synthetic oligonucleotide
cccttactagactgagccactcattgccg

SEQ ID NO: 269054 - DNA, 29 bp, Artificial Sequence
  Description of Artificial Sequence: Synthetic oligonucleotide
ccttactagactgagccactcattgccgc

SEQ ID NO: 269055 - DNA, 29 bp, Artificial Sequence
  Description of Artificial Sequence: Synthetic oligonucleotide
cttactagactgagccactcattgccgcg

SEQ ID NO: 269056 - DNA, 31 bp, Artificial Sequence
  Description of Artificial Sequence: Synthetic oligonucleotide
ttactagactgagccactcattgccgcgttg

SEQ ID NO: 269057 - DNA, 30 bp, Artificial Sequence
  Description of Artificial Sequence: Synthetic oligonucleotide
tactagactgagccactcattgccgcgttg

SEQ ID NO: 269058 - DNA, 29 bp, Artificial Sequence
  Description of Artificial Sequence: Synthetic oligonucleotide
actagactgagccactcattgccgcgttg

SEQ ID NO: 269059 - DNA, 28 bp, Artificial Sequence
  Description of Artificial Sequence: Synthetic oligonucleotide
ctagactgagccactcattgccgcgttg

SEQ ID NO: 269060 - DNA, 28 bp, Artificial Sequence
  Description of Artificial Sequence: Synthetic oligonucleotide
tagactgagccactcattgccgcgttgg

SEQ ID NO: 269061 - DNA, 27 bp, Artificial Sequence
  Description of Artificial Sequence: Synthetic oligonucleotide
agactgagccactcattgccgcgttgg

SEQ ID NO: 269062 - DNA, 27 bp, Artificial Sequence
  Description of Artificial Sequence: Synthetic oligonucleotide
gactgagccactcattgccgcgttgga

SEQ ID NO: 269063 - DNA, 27 bp, Artificial Sequence
  Description of Artificial Sequence: Synthetic oligonucleotide
actgagccactcattgccgcgttggac

SEQ ID NO: 269064 - DNA, 26 bp, Artificial Sequence
  Description of Artificial Sequence: Synthetic oligonucleotide
ctgagccactcattgccgcgttggac

SEQ ID NO: 269065 - DNA, 26 bp, Artificial Sequence
  Description of Artificial Sequence: Synthetic oligonucleotide
tgagccactcattgccgcgttggacc

SEQ ID NO: 269066 - DNA, 25 bp, Artificial Sequence
  Description of Artificial Sequence: Synthetic oligonucleotide
gagccactcattgccgcgttggacc

SEQ ID NO: 269067 - DNA, 25 bp, Artificial Sequence
  Description of Artificial Sequence: Synthetic oligonucleotide
agccactcattgccgcgttggaccc

SEQ ID NO: 269068 - DNA, 24 bp, Artificial Sequence
  Description of Artificial Sequence: Synthetic oligonucleotide
gccactcattgccgcgttggaccc

SEQ ID NO: 269069 - DNA, 26 bp, Artificial Sequence
  Description of Artificial Sequence: Synthetic oligonucleotide
ccactcattgccgcgttggaccccaa

SEQ ID NO: 269070 - DNA, 27 bp, Artificial Sequence
  Description of Artificial Sequence: Synthetic oligonucleotide
cactcattgccgcgttggaccccaaga

SEQ ID NO: 269071 - DNA, 27 bp, Artificial Sequence
  Description of Artificial Sequence: Synthetic oligonucleotide
actcattgccgcgttggaccccaagac

SEQ ID NO: 269072 - DNA, 26 bp, Artificial Sequence
  Description of Artificial Sequence: Synthetic oligonucleotide
ctcattgccgcgttggaccccaagac

SEQ ID NO: 269073 - DNA, 27 bp, Artificial Sequence
  Description of Artificial Sequence: Synthetic oligonucleotide
tcattgccgcgttggaccccaagacct

SEQ ID NO: 269074 - DNA, 27 bp, Artificial Sequence
  Description of Artificial Sequence: Synthetic oligonucleotide
cattgccgcgttggaccccaagacctt

SEQ ID NO: 269075 - DNA, 30 bp, Artificial Sequence
  Description of Artificial Sequence: Synthetic oligonucleotide
attgccgcgttggaccccaagaccttttag

SEQ ID NO: 269076 - DNA, 29 bp, Artificial Sequence
  Description of Artificial Sequence: Synthetic oligonucleotide
ttgccgcgttggaccccaagaccttttag

SEQ ID NO: 269077 - DNA, 28 bp, Artificial Sequence
  Description of Artificial Sequence: Synthetic oligonucleotide
tgccgcgttggaccccaagaccttttag

SEQ ID NO: 269078 - DNA, 27 bp, Artificial Sequence
  Description of Artificial Sequence: Synthetic oligonucleotide
gccgcgttggaccccaagaccttttag

SEQ ID NO: 269079 - DNA, 27 bp, Artificial Sequence
  Description of Artificial Sequence: Synthetic oligonucleotide
ccgcgttggaccccaagaccttttagc

SEQ ID NO: 269080 - DNA, 27 bp, Artificial Sequence
  Description of Artificial Sequence: Synthetic oligonucleotide
cgcgttggaccccaagaccttttagcc

SEQ ID NO: 269081 - DNA, 27 bp, Artificial Sequence
  Description of Artificial Sequence: Synthetic oligonucleotide
gcgttggaccccaagaccttttagccc

SEQ ID NO: 269082 - DNA, 29 bp, Artificial Sequence
  Description of Artificial Sequence: Synthetic oligonucleotide
cgttggaccccaagaccttttagcccttc

SEQ ID NO: 269083 - DNA, 33 bp, Artificial Sequence
  Description of Artificial Sequence: Synthetic oligonucleotide
gttggaccccaagaccttttagcccttcaattg

SEQ ID NO: 269084 - DNA, 33 bp, Artificial Sequence
  Description of Artificial Sequence: Synthetic oligonucleotide
ttggaccccaagaccttttagcccttcaattgc

SEQ ID NO: 269085 - DNA, 32 bp, Artificial Sequence
  Description of Artificial Sequence: Synthetic oligonucleotide
tggaccccaagaccttttagcccttcaattgc

SEQ ID NO: 269086 - DNA, 31 bp, Artificial Sequence
  Description of Artificial Sequence: Synthetic oligonucleotide
ggaccccaagaccttttagcccttcaattgc

SEQ ID NO: 269087 - DNA, 32 bp, Artificial Sequence
  Description of Artificial Sequence: Synthetic oligonucleotide
gaccccaagaccttttagcccttcaattgctc

SEQ ID NO: 269088 - DNA, 33 bp, Artificial Sequence
  Description of Artificial Sequence: Synthetic oligonucleotide
accccaagaccttttagcccttcaattgctctc

SEQ ID NO: 269089 - DNA, 32 bp, Artificial Sequence
  Description of Artificial Sequence: Synthetic oligonucleotide
ccccaagaccttttagcccttcaattgctctc

SEQ ID NO: 269090 - DNA, 34 bp, Artificial Sequence
  Description of Artificial Sequence: Synthetic oligonucleotide
cccaagaccttttagcccttcaattgctctcttg

SEQ ID NO: 269091 - DNA, 35 bp, Artificial Sequence
  Description of Artificial Sequence: Synthetic oligonucleotide
ccaagaccttttagcccttcaattgctctcttgac

SEQ ID NO: 269092 - DNA, 35 bp, Artificial Sequence
  Description of Artificial Sequence: Synthetic oligonucleotide
caagaccttttagcccttcaattgctctcttgacc

SEQ ID NO: 269093 - DNA, 36 bp, Artificial Sequence
  Description of Artificial Sequence: Synthetic oligonucleotide
aagaccttttagcccttcaattgctctcttgacctc

SEQ ID NO: 269094 - DNA, 35 bp, Artificial Sequence
  Description of Artificial Sequence: Synthetic oligonucleotide
agaccttttagcccttcaattgctctcttgacctc

SEQ ID NO: 269095 - DNA, 34 bp, Artificial Sequence
  Description of Artificial Sequence: Synthetic oligonucleotide
gaccttttagcccttcaattgctctcttgacctc

SEQ ID NO: 269096 - DNA, 36 bp, Artificial Sequence
  Description of Artificial Sequence: Synthetic oligonucleotide
accttttagcccttcaattgctctcttgacctcatc

SEQ ID NO: 269097 - DNA, 35 bp, Artificial Sequence
  Description of Artificial Sequence: Synthetic oligonucleotide
ccttttagcccttcaattgctctcttgacctcatc

SEQ ID NO: 269098 - DNA, 35 bp, Artificial Sequence
  Description of Artificial Sequence: Synthetic oligonucleotide
cttttagcccttcaattgctctcttgacctcatcc

SEQ ID NO: 269099 - DNA, 35 bp, Artificial Sequence
  Description of Artificial Sequence: Synthetic oligonucleotide
ttttagcccttcaattgctctcttgacctcatccg

SEQ ID NO: 269100 - DNA, 34 bp, Artificial Sequence
  Description of Artificial Sequence: Synthetic oligonucleotide
tttagcccttcaattgctctcttgacctcatccg

SEQ ID NO: 269101 - DNA, 33 bp, Artificial Sequence
  Description of Artificial Sequence: Synthetic oligonucleotide
ttagcccttcaattgctctcttgacctcatccg

SEQ ID NO: 269102 - DNA, 32 bp, Artificial Sequence
  Description of Artificial Sequence: Synthetic oligonucleotide
tagcccttcaattgctctcttgacctcatccg

SEQ ID NO: 269103 - DNA, 31 bp, Artificial Sequence
  Description of Artificial Sequence: Synthetic oligonucleotide
agcccttcaattgctctcttgacctcatccg

SEQ ID NO: 269104 - DNA, 30 bp, Artificial Sequence
  Description of Artificial Sequence: Synthetic oligonucleotide
gcccttcaattgctctcttgacctcatccg

SEQ ID NO: 269105 - DNA, 30 bp, Artificial Sequence
  Description of Artificial Sequence: Synthetic oligonucleotide
cccttcaattgctctcttgacctcatccgc

SEQ ID NO: 269106 - DNA, 31 bp, Artificial Sequence
  Description of Artificial Sequence: Synthetic oligonucleotide
ccttcaattgctctcttgacctcatccgctg

SEQ ID NO: 269107 - DNA, 31 bp, Artificial Sequence
  Description of Artificial Sequence: Synthetic oligonucleotide
cttcaattgctctcttgacctcatccgctgc

SEQ ID NO: 269108 - DNA, 31 bp, Artificial Sequence
  Description of Artificial Sequence: Synthetic oligonucleotide
ttcaattgctctcttgacctcatccgctgcc

SEQ ID NO: 269109 - DNA, 30 bp, Artificial Sequence
  Description of Artificial Sequence: Synthetic oligonucleotide
tcaattgctctcttgacctcatccgctgcc

SEQ ID NO: 269110 - DNA, 29 bp, Artificial Sequence
  Description of Artificial Sequence: Synthetic oligonucleotide
caattgctctcttgacctcatccgctgcc

SEQ ID NO: 269111 - DNA, 29 bp, Artificial Sequence
  Description of Artificial Sequence: Synthetic oligonucleotide
aattgctctcttgacctcatccgctgccc

SEQ ID NO: 269112 - DNA, 28 bp, Artificial Sequence
  Description of Artificial Sequence: Synthetic oligonucleotide
attgctctcttgacctcatccgctgccc

SEQ ID NO: 269113 - DNA, 27 bp, Artificial Sequence
  Description of Artificial Sequence: Synthetic oligonucleotide
ttgctctcttgacctcatccgctgccc

SEQ ID NO: 269114 - DNA, 26 bp, Artificial Sequence
  Description of Artificial Sequence: Synthetic oligonucleotide
tgctctcttgacctcatccgctgccc

SEQ ID NO: 269115 - DNA, 25 bp, Artificial Sequence
  Description of Artificial Sequence: Synthetic oligonucleotide
gctctcttgacctcatccgctgccc

SEQ ID NO: 269116 - DNA, 27 bp, Artificial Sequence
  Description of Artificial Sequence: Synthetic oligonucleotide
ctctcttgacctcatccgctgccccaa

SEQ ID NO: 269117 - DNA, 27 bp, Artificial Sequence
  Description of Artificial Sequence: Synthetic oligonucleotide
tctcttgacctcatccgctgccccaag

SEQ ID NO: 269118 - DNA, 26 bp, Artificial Sequence
  Description of Artificial Sequence: Synthetic oligonucleotide
ctcttgacctcatccgctgccccaag

SEQ ID NO: 269119 - DNA, 27 bp, Artificial Sequence
  Description of Artificial Sequence: Synthetic oligonucleotide
tcttgacctcatccgctgccccaaggt

SEQ ID NO: 269120 - DNA, 26 bp, Artificial Sequence
  Description of Artificial Sequence: Synthetic oligonucleotide
cttgacctcatccgctgccccaaggt

SEQ ID NO: 269121 - DNA, 27 bp, Artificial Sequence
  Description of Artificial Sequence: Synthetic oligonucleotide
ttgacctcatccgctgccccaaggtga

SEQ ID NO: 269122 - DNA, 26 bp, Artificial Sequence
  Description of Artificial Sequence: Synthetic oligonucleotide
tgacctcatccgctgccccaaggtga

SEQ ID NO: 269123 - DNA, 25 bp, Artificial Sequence
  Description of Artificial Sequence: Synthetic oligonucleotide
gacctcatccgctgccccaaggtga

SEQ ID NO: 269124 - DNA, 26 bp, Artificial Sequence
  Description of Artificial Sequence: Synthetic oligonucleotide
acctcatccgctgccccaaggtgact

SEQ ID NO: 269125 - DNA, 25 bp, Artificial Sequence
  Description of Artificial Sequence: Synthetic oligonucleotide
cctcatccgctgccccaaggtgact

SEQ ID NO: 269126 - DNA, 27 bp, Artificial Sequence
  Description of Artificial Sequence: Synthetic oligonucleotide
ctcatccgctgccccaaggtgactgaa

SEQ ID NO: 269127 - DNA, 27 bp, Artificial Sequence
  Description of Artificial Sequence: Synthetic oligonucleotide
tcatccgctgccccaaggtgactgaag

SEQ ID NO: 269128 - DNA, 27 bp, Artificial Sequence
  Description of Artificial Sequence: Synthetic oligonucleotide
catccgctgccccaaggtgactgaaga

SEQ ID NO: 269129 - DNA, 27 bp, Artificial Sequence
  Description of Artificial Sequence: Synthetic oligonucleotide
atccgctgccccaaggtgactgaagac

SEQ ID NO: 269130 - DNA, 27 bp, Artificial Sequence
  Description of Artificial Sequence: Synthetic oligonucleotide
tccgctgccccaaggtgactgaagact

SEQ ID NO: 269131 - DNA, 27 bp, Artificial Sequence
  Description of Artificial Sequence: Synthetic oligonucleotide
ccgctgccccaaggtgactgaagactt

SEQ ID NO: 269132 - DNA, 28 bp, Artificial Sequence
  Description of Artificial Sequence: Synthetic oligonucleotide
cgctgccccaaggtgactgaagactttg

SEQ ID NO: 269133 - DNA, 29 bp, Artificial Sequence
  Description of Artificial Sequence: Synthetic oligonucleotide
gctgccccaaggtgactgaagactttgtg

SEQ ID NO: 269134 - DNA, 29 bp, Artificial Sequence
  Description of Artificial Sequence: Synthetic oligonucleotide
ctgccccaaggtgactgaagactttgtgc

SEQ ID NO: 269135 - DNA, 30 bp, Artificial Sequence
  Description of Artificial Sequence: Synthetic oligonucleotide
tgccccaaggtgactgaagactttgtgctc

SEQ ID NO: 269136 - DNA, 29 bp, Artificial Sequence
  Description of Artificial Sequence: Synthetic oligonucleotide
gccccaaggtgactgaagactttgtgctc

SEQ ID NO: 269137 - DNA, 30 bp, Artificial Sequence
  Description of Artificial Sequence: Synthetic oligonucleotide
ccccaaggtgactgaagactttgtgctcag

SEQ ID NO: 269138 - DNA, 31 bp, Artificial Sequence
  Description of Artificial Sequence: Synthetic oligonucleotide
cccaaggtgactgaagactttgtgctcagtg

SEQ ID NO: 269139 - DNA, 31 bp, Artificial Sequence
  Description of Artificial Sequence: Synthetic oligonucleotide
ccaaggtgactgaagactttgtgctcagtgg

SEQ ID NO: 269140 - DNA, 31 bp, Artificial Sequence
  Description of Artificial Sequence: Synthetic oligonucleotide
caaggtgactgaagactttgtgctcagtggc

SEQ ID NO: 269141 - DNA, 32 bp, Artificial Sequence
  Description of Artificial Sequence: Synthetic oligonucleotide
aaggtgactgaagactttgtgctcagtggcag

SEQ ID NO: 269142 - DNA, 31 bp, Artificial Sequence
  Description of Artificial Sequence: Synthetic oligonucleotide
aggtgactgaagactttgtgctcagtggcag

SEQ ID NO: 269143 - DNA, 30 bp, Artificial Sequence
  Description of Artificial Sequence: Synthetic oligonucleotide
ggtgactgaagactttgtgctcagtggcag

SEQ ID NO: 269144 - DNA, 30 bp, Artificial Sequence
  Description of Artificial Sequence: Synthetic oligonucleotide
gtgactgaagactttgtgctcagtggcagc

SEQ ID NO: 269145 - DNA, 31 bp, Artificial Sequence
  Description of Artificial Sequence: Synthetic oligonucleotide
tgactgaagactttgtgctcagtggcagctg

SEQ ID NO: 269146 - DNA, 30 bp, Artificial Sequence
  Description of Artificial Sequence: Synthetic oligonucleotide
gactgaagactttgtgctcagtggcagctg

SEQ ID NO: 269147 - DNA, 30 bp, Artificial Sequence
  Description of Artificial Sequence: Synthetic oligonucleotide
actgaagactttgtgctcagtggcagctgc

SEQ ID NO: 269148 - DNA, 29 bp, Artificial Sequence
  Description of Artificial Sequence: Synthetic oligonucleotide
ctgaagactttgtgctcagtggcagctgc

SEQ ID NO: 269149 - DNA, 29 bp, Artificial Sequence
  Description of Artificial Sequence: Synthetic oligonucleotide
tgaagactttgtgctcagtggcagctgcg

SEQ ID NO: 269150 - DNA, 28 bp, Artificial Sequence
  Description of Artificial Sequence: Synthetic oligonucleotide
gaagactttgtgctcagtggcagctgcg

SEQ ID NO: 269151 - DNA, 28 bp, Artificial Sequence
  Description of Artificial Sequence: Synthetic oligonucleotide
aagactttgtgctcagtggcagctgcgc

SEQ ID NO: 269152 - DNA, 27 bp, Artificial Sequence
  Description of Artificial Sequence: Synthetic oligonucleotide
agactttgtgctcagtggcagctgcgc

SEQ ID NO: 269153 - DNA, 26 bp, Artificial Sequence
  Description of Artificial Sequence: Synthetic oligonucleotide
gactttgtgctcagtggcagctgcgc

SEQ ID NO: 269154 - DNA, 26 bp, Artificial Sequence
  Description of Artificial Sequence: Synthetic oligonucleotide
actttgtgctcagtggcagctgcgcc

SEQ ID NO: 269155 - DNA, 25 bp, Artificial Sequence
  Description of Artificial Sequence: Synthetic oligonucleotide
ctttgtgctcagtggcagctgcgcc

SEQ ID NO: 269156 - DNA, 27 bp, Artificial Sequence
  Description of Artificial Sequence: Synthetic oligonucleotide
tttgtgctcagtggcagctgcgccgat

SEQ ID NO: 269157 - DNA, 26 bp, Artificial Sequence
  Description of Artificial Sequence: Synthetic oligonucleotide
ttgtgctcagtggcagctgcgccgat

SEQ ID NO: 269158 - DNA, 25 bp, Artificial Sequence
  Description of Artificial Sequence: Synthetic oligonucleotide
tgtgctcagtggcagctgcgccgat

SEQ ID NO: 269159 - DNA, 24 bp, Artificial Sequence
  Description of Artificial Sequence: Synthetic oligonucleotide
gtgctcagtggcagctgcgccgat

SEQ ID NO: 269160 - DNA, 27 bp, Artificial Sequence
  Description of Artificial Sequence: Synthetic oligonucleotide
tgctcagtggcagctgcgccgatcaaa

SEQ ID NO: 269161 - DNA, 27 bp, Artificial Sequence
  Description of Artificial Sequence: Synthetic oligonucleotide
gctcagtggcagctgcgccgatcaaat

SEQ ID NO: 269162 - DNA, 27 bp, Artificial Sequence
  Description of Artificial Sequence: Synthetic oligonucleotide
ctcagtggcagctgcgccgatcaaatg

SEQ ID NO: 269163 - DNA, 29 bp, Artificial Sequence
  Description of Artificial Sequence: Synthetic oligonucleotide
tcagtggcagctgcgccgatcaaatgtac

SEQ ID NO: 269164 - DNA, 28 bp, Artificial Sequence
  Description of Artificial Sequence: Synthetic oligonucleotide
cagtggcagctgcgccgatcaaatgtac

SEQ ID NO: 269165 - DNA, 28 bp, Artificial Sequence
  Description of Artificial Sequence: Synthetic oligonucleotide
agtggcagctgcgccgatcaaatgtacc

SEQ ID NO: 269166 - DNA, 27 bp, Artificial Sequence
  Description of Artificial Sequence: Synthetic oligonucleotide
gtggcagctgcgccgatcaaatgtacc

SEQ ID NO: 269167 - DNA, 27 bp, Artificial Sequence
  Description of Artificial Sequence: Synthetic oligonucleotide
tggcagctgcgccgatcaaatgtaccg

SEQ ID NO: 269168 - DNA, 27 bp, Artificial Sequence
  Description of Artificial Sequence: Synthetic oligonucleotide
ggcagctgcgccgatcaaatgtaccga

SEQ ID NO: 269169 - DNA, 29 bp, Artificial Sequence
  Description of Artificial Sequence: Synthetic oligonucleotide
gcagctgcgccgatcaaatgtaccgaatg

SEQ ID NO: 269170 - DNA, 30 bp, Artificial Sequence
  Description of Artificial Sequence: Synthetic oligonucleotide
cagctgcgccgatcaaatgtaccgaatgtg

SEQ ID NO: 269171 - DNA, 31 bp, Artificial Sequence
  Description of Artificial Sequence: Synthetic oligonucleotide
agctgcgccgatcaaatgtaccgaatgtgtg

SEQ ID NO: 269172 - DNA, 30 bp, Artificial Sequence
  Description of Artificial Sequence: Synthetic oligonucleotide
gctgcgccgatcaaatgtaccgaatgtgtg

SEQ ID NO: 269173 - DNA, 31 bp, Artificial Sequence
  Description of Artificial Sequence: Synthetic oligonucleotide
ctgcgccgatcaaatgtaccgaatgtgtgtg

SEQ ID NO: 269174 - DNA, 32 bp, Artificial Sequence
  Description of Artificial Sequence: Synthetic oligonucleotide
tgcgccgatcaaatgtaccgaatgtgtgtgtc

SEQ ID NO: 269175 - DNA, 31 bp, Artificial Sequence
  Description of Artificial Sequence: Synthetic oligonucleotide
gcgccgatcaaatgtaccgaatgtgtgtgtc

SEQ ID NO: 269176 - DNA, 31 bp, Artificial Sequence
  Description of Artificial Sequence: Synthetic oligonucleotide
cgccgatcaaatgtaccgaatgtgtgtgtcc

SEQ ID NO: 269177 - DNA, 31 bp, Artificial Sequence
  Description of Artificial Sequence: Synthetic oligonucleotide
gccgatcaaatgtaccgaatgtgtgtgtccc

SEQ ID NO: 269178 - DNA, 32 bp, Artificial Sequence
  Description of Artificial Sequence: Synthetic oligonucleotide
ccgatcaaatgtaccgaatgtgtgtgtccctc

SEQ ID NO: 269179 - DNA, 33 bp, Artificial Sequence
  Description of Artificial Sequence: Synthetic oligonucleotide
cgatcaaatgtaccgaatgtgtgtgtccctctg

SEQ ID NO: 269180 - DNA, 33 bp, Artificial Sequence
  Description of Artificial Sequence: Synthetic oligonucleotide
gatcaaatgtaccgaatgtgtgtgtccctctgc

SEQ ID NO: 269181 - DNA, 33 bp, Artificial Sequence
  Description of Artificial Sequence: Synthetic oligonucleotide
atcaaatgtaccgaatgtgtgtgtccctctgcg

SEQ ID NO: 269182 - DNA, 32 bp, Artificial Sequence
  Description of Artificial Sequence: Synthetic oligonucleotide
tcaaatgtaccgaatgtgtgtgtccctctgcg

SEQ ID NO: 269183 - DNA, 31 bp, Artificial Sequence
  Description of Artificial Sequence: Synthetic oligonucleotide
caaatgtaccgaatgtgtgtgtccctctgcg

SEQ ID NO: 269184 - DNA, 32 bp, Artificial Sequence
  Description of Artificial Sequence: Synthetic oligonucleotide
aaatgtaccgaatgtgtgtgtccctctgcgag

SEQ ID NO: 269185 - DNA, 31 bp, Artificial Sequence
  Description of Artificial Sequence: Synthetic oligonucleotide
aatgtaccgaatgtgtgtgtccctctgcgag

SEQ ID NO: 269186 - DNA, 30 bp, Artificial Sequence
  Description of Artificial Sequence: Synthetic oligonucleotide
atgtaccgaatgtgtgtgtccctctgcgag

SEQ ID NO: 269187 - DNA, 29 bp, Artificial Sequence
  Description of Artificial Sequence: Synthetic oligonucleotide
tgtaccgaatgtgtgtgtccctctgcgag

SEQ ID NO: 269188 - DNA, 28 bp, Artificial Sequence
  Description of Artificial Sequence: Synthetic oligonucleotide
gtaccgaatgtgtgtgtccctctgcgag

SEQ ID NO: 269189 - DNA, 28 bp, Artificial Sequence
  Description of Artificial Sequence: Synthetic oligonucleotide
taccgaatgtgtgtgtccctctgcgagc

SEQ ID NO: 269190 - DNA, 27 bp, Artificial Sequence
  Description of Artificial Sequence: Synthetic oligonucleotide
accgaatgtgtgtgtccctctgcgagc

SEQ ID NO: 269191 - DNA, 26 bp, Artificial Sequence
  Description of Artificial Sequence: Synthetic oligonucleotide
ccgaatgtgtgtgtccctctgcgagc

SEQ ID NO: 269192 - DNA, 26 bp, Artificial Sequence
  Description of Artificial Sequence: Synthetic oligonucleotide
cgaatgtgtgtgtccctctgcgagcc

SEQ ID NO: 269193 - DNA, 27 bp, Artificial Sequence
  Description of Artificial Sequence: Synthetic oligonucleotide
gaatgtgtgtgtccctctgcgagccca

SEQ ID NO: 269194 - DNA, 28 bp, Artificial Sequence
  Description of Artificial Sequence: Synthetic oligonucleotide
aatgtgtgtgtccctctgcgagcccaac

SEQ ID NO: 269195 - DNA, 27 bp, Artificial Sequence
  Description of Artificial Sequence: Synthetic oligonucleotide
atgtgtgtgtccctctgcgagcccaac

SEQ ID NO: 269196 - DNA, 27 bp, Artificial Sequence
  Description of Artificial Sequence: Synthetic oligonucleotide
tgtgtgtgtccctctgcgagcccaact

SEQ ID NO: 269197 - DNA, 27 bp, Artificial Sequence
  Description of Artificial Sequence: Synthetic oligonucleotide
gtgtgtgtccctctgcgagcccaactt

SEQ ID NO: 269198 - DNA, 27 bp, Artificial Sequence
  Description of Artificial Sequence: Synthetic oligonucleotide
tgtgtgtccctctgcgagcccaacttg

SEQ ID NO: 269199 - DNA, 26 bp, Artificial Sequence
  Description of Artificial Sequence: Synthetic oligonucleotide
gtgtgtccctctgcgagcccaacttg

SEQ ID NO: 269200 - DNA, 27 bp, Artificial Sequence
  Description of Artificial Sequence: Synthetic oligonucleotide
tgtgtccctctgcgagcccaacttgga

SEQ ID NO: 269201 - DNA, 27 bp, Artificial Sequence
  Description of Artificial Sequence: Synthetic oligonucleotide
gtgtccctctgcgagcccaacttggat

SEQ ID NO: 269202 - DNA, 27 bp, Artificial Sequence
  Description of Artificial Sequence: Synthetic oligonucleotide
tgtccctctgcgagcccaacttggatc

SEQ ID NO: 269203 - DNA, 26 bp, Artificial Sequence
  Description of Artificial Sequence: Synthetic oligonucleotide
gtccctctgcgagcccaacttggatc

SEQ ID NO: 269204 - DNA, 26 bp, Artificial Sequence
  Description of Artificial Sequence: Synthetic oligonucleotide
tccctctgcgagcccaacttggatcc

SEQ ID NO: 269205 - DNA, 25 bp, Artificial Sequence
  Description of Artificial Sequence: Synthetic oligonucleotide
ccctctgcgagcccaacttggatcc

SEQ ID NO: 269206 - DNA, 25 bp, Artificial Sequence
  Description of Artificial Sequence: Synthetic oligonucleotide
cctctgcgagcccaacttggatccg

SEQ ID NO: 269207 - DNA, 27 bp, Artificial Sequence
  Description of Artificial Sequence: Synthetic oligonucleotide
ctctgcgagcccaacttggatccggtt

SEQ ID NO: 269208 - DNA, 27 bp, Artificial Sequence
  Description of Artificial Sequence: Synthetic oligonucleotide
tctgcgagcccaacttggatccggttc

SEQ ID NO: 269209 - DNA, 27 bp, Artificial Sequence
  Description of Artificial Sequence: Synthetic oligonucleotide
ctgcgagcccaacttggatccggttca

SEQ ID NO: 269210 - DNA, 27 bp, Artificial Sequence
  Description of Artificial Sequence: Synthetic oligonucleotide
tgcgagcccaacttggatccggttcac

SEQ ID NO: 269211 - DNA, 26 bp, Artificial Sequence
  Description of Artificial Sequence: Synthetic oligonucleotide
gcgagcccaacttggatccggttcac

SEQ ID NO: 269212 - DNA, 27 bp, Artificial Sequence
  Description of Artificial Sequence: Synthetic oligonucleotide
cgagcccaacttggatccggttcacct

SEQ ID NO: 269213 - DNA, 27 bp, Artificial Sequence
  Description of Artificial Sequence: Synthetic oligonucleotide
gagcccaacttggatccggttcacctg

SEQ ID NO: 269214 - DNA, 30 bp, Artificial Sequence
  Description of Artificial Sequence: Synthetic oligonucleotide
agcccaacttggatccggttcacctgttag

SEQ ID NO: 269215 - DNA, 29 bp, Artificial Sequence
  Description of Artificial Sequence: Synthetic oligonucleotide
gcccaacttggatccggttcacctgttag

SEQ ID NO: 269216 - DNA, 32 bp, Artificial Sequence
  Description of Artificial Sequence: Synthetic oligonucleotide
cccaacttggatccggttcacctgttagaaac

SEQ ID NO: 269217 - DNA, 32 bp, Artificial Sequence
  Description of Artificial Sequence: Synthetic oligonucleotide
ccaacttggatccggttcacctgttagaaacc

SEQ ID NO: 269218 - DNA, 34 bp, Artificial Sequence
  Description of Artificial Sequence: Synthetic oligonucleotide
caacttggatccggttcacctgttagaaaccatc

SEQ ID NO: 269219 - DNA, 35 bp, Artificial Sequence
  Description of Artificial Sequence: Synthetic oligonucleotide
aacttggatccggttcacctgttagaaaccatcac

SEQ ID NO: 269220 - DNA, 34 bp, Artificial Sequence
  Description of Artificial Sequence: Synthetic oligonucleotide
acttggatccggttcacctgttagaaaccatcac

SEQ ID NO: 269221 - DNA, 33 bp, Artificial Sequence
  Description of Artificial Sequence: Synthetic oligonucleotide
cttggatccggttcacctgttagaaaccatcac

SEQ ID NO: 269222 - DNA, 33 bp, Artificial Sequence
  Description of Artificial Sequence: Synthetic oligonucleotide
ttggatccggttcacctgttagaaaccatcacc

SEQ ID NO: 269223 - DNA, 32 bp, Artificial Sequence
  Description of Artificial Sequence: Synthetic oligonucleotide
tggatccggttcacctgttagaaaccatcacc

SEQ ID NO: 269224 - DNA, 31 bp, Artificial Sequence
  Description of Artificial Sequence: Synthetic oligonucleotide
ggatccggttcacctgttagaaaccatcacc

SEQ ID NO: 269225 - DNA, 31 bp, Artificial Sequence
  Description of Artificial Sequence: Synthetic oligonucleotide
gatccggttcacctgttagaaaccatcaccc

SEQ ID NO: 269226 - DNA, 33 bp, Artificial Sequence
  Description of Artificial Sequence: Synthetic oligonucleotide
atccggttcacctgttagaaaccatcacccaag

SEQ ID NO: 269227 - DNA, 32 bp, Artificial Sequence
  Description of Artificial Sequence: Synthetic oligonucleotide
tccggttcacctgttagaaaccatcacccaag

SEQ ID NO: 269228 - DNA, 31 bp, Artificial Sequence
  Description of Artificial Sequence: Synthetic oligonucleotide
ccggttcacctgttagaaaccatcacccaag

SEQ ID NO: 269229 - DNA, 31 bp, Artificial Sequence
  Description of Artificial Sequence: Synthetic oligonucleotide
cggttcacctgttagaaaccatcacccaagc

SEQ ID NO: 269230 - DNA, 31 bp, Artificial Sequence
  Description of Artificial Sequence: Synthetic oligonucleotide
ggttcacctgttagaaaccatcacccaagcc

SEQ ID NO: 269231 - DNA, 33 bp, Artificial Sequence
  Description of Artificial Sequence: Synthetic oligonucleotide
gttcacctgttagaaaccatcacccaagccaag

SEQ ID NO: 269232 - DNA, 33 bp, Artificial Sequence
  Description of Artificial Sequence: Synthetic oligonucleotide
ttcacctgttagaaaccatcacccaagccaagc

SEQ ID NO: 269233 - DNA, 32 bp, Artificial Sequence
  Description of Artificial Sequence: Synthetic oligonucleotide
tcacctgttagaaaccatcacccaagccaagc

SEQ ID NO: 269234 - DNA, 31 bp, Artificial Sequence
  Description of Artificial Sequence: Synthetic oligonucleotide
cacctgttagaaaccatcacccaagccaagc

SEQ ID NO: 269235 - DNA, 32 bp, Artificial Sequence
  Description of Artificial Sequence: Synthetic oligonucleotide
acctgttagaaaccatcacccaagccaagctg

SEQ ID NO: 269236 - DNA, 31 bp, Artificial Sequence
  Description of Artificial Sequence: Synthetic oligonucleotide
cctgttagaaaccatcacccaagccaagctg

SEQ ID NO: 269237 - DNA, 34 bp, Artificial Sequence
  Description of Artificial Sequence: Synthetic oligonucleotide
ctgttagaaaccatcacccaagccaagctgaatg

SEQ ID NO: 269238 - DNA, 34 bp, Artificial Sequence
  Description of Artificial Sequence: Synthetic oligonucleotide
tgttagaaaccatcacccaagccaagctgaatgc

SEQ ID NO: 269239 - DNA, 33 bp, Artificial Sequence
  Description of Artificial Sequence: Synthetic oligonucleotide
gttagaaaccatcacccaagccaagctgaatgc

SEQ ID NO: 269240 - DNA, 34 bp, Artificial Sequence
  Description of Artificial Sequence: Synthetic oligonucleotide
ttagaaaccatcacccaagccaagctgaatgcag

SEQ ID NO: 269241 - DNA, 33 bp, Artificial Sequence
  Description of Artificial Sequence: Synthetic oligonucleotide
tagaaaccatcacccaagccaagctgaatgcag

SEQ ID NO: 269242 - DNA, 32 bp, Artificial Sequence
  Description of Artificial Sequence: Synthetic oligonucleotide
agaaaccatcacccaagccaagctgaatgcag

SEQ ID NO: 269243 - DNA, 31 bp, Artificial Sequence
  Description of Artificial Sequence: Synthetic oligonucleotide
gaaaccatcacccaagccaagctgaatgcag

SEQ ID NO: 269244 - DNA, 32 bp, Artificial Sequence
  Description of Artificial Sequence: Synthetic oligonucleotide
aaaccatcacccaagccaagctgaatgcagtg

SEQ ID NO: 269245 - DNA, 31 bp, Artificial Sequence
  Description of Artificial Sequence: Synthetic oligonucleotide
aaccatcacccaagccaagctgaatgcagtg

SEQ ID NO: 269246 - DNA, 30 bp, Artificial Sequence
  Description of Artificial Sequence: Synthetic oligonucleotide
accatcacccaagccaagctgaatgcagtg

SEQ ID NO: 269247 - DNA, 29 bp, Artificial Sequence
  Description of Artificial Sequence: Synthetic oligonucleotide
ccatcacccaagccaagctgaatgcagtg

SEQ ID NO: 269248 - DNA, 29 bp, Artificial Sequence
  Description of Artificial Sequence: Synthetic oligonucleotide
catcacccaagccaagctgaatgcagtgg

SEQ ID NO: 269249 - DNA, 30 bp, Artificial Sequence
  Description of Artificial Sequence: Synthetic oligonucleotide
atcacccaagccaagctgaatgcagtggac

SEQ ID NO: 269250 - DNA, 29 bp, Artificial Sequence
  Description of Artificial Sequence: Synthetic oligonucleotide
tcacccaagccaagctgaatgcagtggac

SEQ ID NO: 269251 - DNA, 28 bp, Artificial Sequence
  Description of Artificial Sequence: Synthetic oligonucleotide
cacccaagccaagctgaatgcagtggac

SEQ ID NO: 269252 - DNA, 28 bp, Artificial Sequence
  Description of Artificial Sequence: Synthetic oligonucleotide
acccaagccaagctgaatgcagtggacc

SEQ ID NO: 269253 - DNA, 27 bp, Artificial Sequence
  Description of Artificial Sequence: Synthetic oligonucleotide
cccaagccaagctgaatgcagtggacc

SEQ ID NO: 269254 - DNA, 27 bp, Artificial Sequence
  Description of Artificial Sequence: Synthetic oligonucleotide
ccaagccaagctgaatgcagtggaccg

SEQ ID NO: 269255 - DNA, 27 bp, Artificial Sequence
  Description of Artificial Sequence: Synthetic oligonucleotide
caagccaagctgaatgcagtggaccgg

SEQ ID NO: 269256 - DNA, 27 bp, Artificial Sequence
  Description of Artificial Sequence: Synthetic oligonucleotide
aagccaagctgaatgcagtggaccggc

SEQ ID NO: 269257 - DNA, 27 bp, Artificial Sequence
  Description of Artificial Sequence: Synthetic oligonucleotide
agccaagctgaatgcagtggaccggca

SEQ ID NO: 269258 - DNA, 27 bp, Artificial Sequence
  Description of Artificial Sequence: Synthetic oligonucleotide
gccaagctgaatgcagtggaccggcat

SEQ ID NO: 269259 - DNA, 27 bp, Artificial Sequence
  Description of Artificial Sequence: Synthetic oligonucleotide
ccaagctgaatgcagtggaccggcatg

SEQ ID NO: 269260 - DNA, 27 bp, Artificial Sequence
  Description of Artificial Sequence: Synthetic oligonucleotide
caagctgaatgcagtggaccggcatgc

SEQ ID NO: 269261 - DNA, 28 bp, Artificial Sequence
  Description of Artificial Sequence: Synthetic oligonucleotide
aagctgaatgcagtggaccggcatgcag

SEQ ID NO: 269262 - DNA, 27 bp, Artificial Sequence
  Description of Artificial Sequence: Synthetic oligonucleotide
agctgaatgcagtggaccggcatgcag

SEQ ID NO: 269263 - DNA, 27 bp, Artificial Sequence
  Description of Artificial Sequence: Synthetic oligonucleotide
gctgaatgcagtggaccggcatgcagt

SEQ ID NO: 269264 - DNA, 27 bp, Artificial Sequence
  Description of Artificial Sequence: Synthetic oligonucleotide
ctgaatgcagtggaccggcatgcagtg

SEQ ID NO: 269265 - DNA, 28 bp, Artificial Sequence
  Description of Artificial Sequence: Synthetic oligonucleotide
tgaatgcagtggaccggcatgcagtgtg

SEQ ID NO: 269266 - DNA, 27 bp, Artificial Sequence
  Description of Artificial Sequence: Synthetic oligonucleotide
gaatgcagtggaccggcatgcagtgtg

SEQ ID NO: 269267 - DNA, 28 bp, Artificial Sequence
  Description of Artificial Sequence: Synthetic oligonucleotide
aatgcagtggaccggcatgcagtgtgag

SEQ ID NO: 269268 - DNA, 27 bp, Artificial Sequence
  Description of Artificial Sequence: Synthetic oligonucleotide
atgcagtggaccggcatgcagtgtgag

SEQ ID NO: 269269 - DNA, 26 bp, Artificial Sequence
  Description of Artificial Sequence: Synthetic oligonucleotide
tgcagtggaccggcatgcagtgtgag

SEQ ID NO: 269270 - DNA, 25 bp, Artificial Sequence
  Description of Artificial Sequence: Synthetic oligonucleotide
gcagtggaccggcatgcagtgtgag

SEQ ID NO: 269271 - DNA, 25 bp, Artificial Sequence
  Description of Artificial Sequence: Synthetic oligonucleotide
cagtggaccggcatgcagtgtgagg

SEQ ID NO: 269272 - DNA, 27 bp, Artificial Sequence
  Description of Artificial Sequence: Synthetic oligonucleotide
agtggaccggcatgcagtgtgaggcat

SEQ ID NO: 269273 - DNA, 26 bp, Artificial Sequence
  Description of Artificial Sequence: Synthetic oligonucleotide
gtggaccggcatgcagtgtgaggcat

SEQ ID NO: 269274 - DNA, 26 bp, Artificial Sequence
  Description of Artificial Sequence: Synthetic oligonucleotide
tggaccggcatgcagtgtgaggcatg

SEQ ID NO: 269275 - DNA, 25 bp, Artificial Sequence
  Description of Artificial Sequence: Synthetic oligonucleotide
ggaccggcatgcagtgtgaggcatg

SEQ ID NO: 269276 - DNA, 25 bp, Artificial Sequence
  Description of Artificial Sequence: Synthetic oligonucleotide
gaccggcatgcagtgtgaggcatgg

SEQ ID NO: 269277 - DNA, 26 bp, Artificial Sequence
  Description of Artificial Sequence: Synthetic oligonucleotide
accggcatgcagtgtgaggcatgggt

SEQ ID NO: 269278 - DNA, 25 bp, Artificial Sequence
  Description of Artificial Sequence: Synthetic oligonucleotide
ccggcatgcagtgtgaggcatgggt

SEQ ID NO: 269279 - DNA, 26 bp, Artificial Sequence
  Description of Artificial Sequence: Synthetic oligonucleotide
cggcatgcagtgtgaggcatgggtgt

SEQ ID NO: 269280 - DNA, 27 bp, Artificial Sequence
  Description of Artificial Sequence: Synthetic oligonucleotide
ggcatgcagtgtgaggcatgggtgtca

SEQ ID NO: 269281 - DNA, 29 bp, Artificial Sequence
  Description of Artificial Sequence: Synthetic oligonucleotide
gcatgcagtgtgaggcatgggtgtcattg

SEQ ID NO: 269282 - DNA, 30 bp, Artificial Sequence
  Description of Artificial Sequence: Synthetic oligonucleotide
catgcagtgtgaggcatgggtgtcattgtc

SEQ ID NO: 269283 - DNA, 30 bp, Artificial Sequence
  Description of Artificial Sequence: Synthetic oligonucleotide
atgcagtgtgaggcatgggtgtcattgtcg

SEQ ID NO: 269284 - DNA, 29 bp, Artificial Sequence
  Description of Artificial Sequence: Synthetic oligonucleotide
tgcagtgtgaggcatgggtgtcattgtcg

SEQ ID NO: 269285 - DNA, 28 bp, Artificial Sequence
  Description of Artificial Sequence: Synthetic oligonucleotide
gcagtgtgaggcatgggtgtcattgtcg

SEQ ID NO: 269286 - DNA, 29 bp, Artificial Sequence
  Description of Artificial Sequence: Synthetic oligonucleotide
cagtgtgaggcatgggtgtcattgtcgac

SEQ ID NO: 269287 - DNA, 31 bp, Artificial Sequence
  Description of Artificial Sequence: Synthetic oligonucleotide
agtgtgaggcatgggtgtcattgtcgacatc

SEQ ID NO: 269288 - DNA, 30 bp, Artificial Sequence
  Description of Artificial Sequence: Synthetic oligonucleotide
gtgtgaggcatgggtgtcattgtcgacatc

SEQ ID NO: 269289 - DNA, 32 bp, Artificial Sequence
  Description of Artificial Sequence: Synthetic oligonucleotide
tgtgaggcatgggtgtcattgtcgacatcatc

SEQ ID NO: 269290 - DNA, 31 bp, Artificial Sequence
  Description of Artificial Sequence: Synthetic oligonucleotide
gtgaggcatgggtgtcattgtcgacatcatc

SEQ ID NO: 269291 - DNA, 31 bp, Artificial Sequence
  Description of Artificial Sequence: Synthetic oligonucleotide
tgaggcatgggtgtcattgtcgacatcatcg

SEQ ID NO: 269292 - DNA, 30 bp, Artificial Sequence
  Description of Artificial Sequence: Synthetic oligonucleotide
gaggcatgggtgtcattgtcgacatcatcg

SEQ ID NO: 269293 - DNA, 31 bp, Artificial Sequence
  Description of Artificial Sequence: Synthetic oligonucleotide
aggcatgggtgtcattgtcgacatcatcgtg

SEQ ID NO: 269294 - DNA, 30 bp, Artificial Sequence
  Description of Artificial Sequence: Synthetic oligonucleotide
ggcatgggtgtcattgtcgacatcatcgtg

SEQ ID NO: 269295 - DNA, 32 bp, Artificial Sequence
  Description of Artificial Sequence: Synthetic oligonucleotide
gcatgggtgtcattgtcgacatcatcgtgaag

SEQ ID NO: 269296 - DNA, 32 bp, Artificial Sequence
  Description of Artificial Sequence: Synthetic oligonucleotide
catgggtgtcattgtcgacatcatcgtgaagg

SEQ ID NO: 269297 - DNA, 33 bp, Artificial Sequence
  Description of Artificial Sequence: Synthetic oligonucleotide
atgggtgtcattgtcgacatcatcgtgaaggac

SEQ ID NO: 269298 - DNA, 32 bp, Artificial Sequence
  Description of Artificial Sequence: Synthetic oligonucleotide
tgggtgtcattgtcgacatcatcgtgaaggac

SEQ ID NO: 269299 - DNA, 31 bp, Artificial Sequence
  Description of Artificial Sequence: Synthetic oligonucleotide
gggtgtcattgtcgacatcatcgtgaaggac

SEQ ID NO: 269300 - DNA, 36 bp, Artificial Sequence
  Description of Artificial Sequence: Synthetic oligonucleotide
ggtgtcattgtcgacatcatcgtgaaggacaatatc

SEQ ID NO: 269301 - DNA, 37 bp, Artificial Sequence
  Description of Artificial Sequence: Synthetic oligonucleotide
gtgtcattgtcgacatcatcgtgaaggacaatatcac

SEQ ID NO: 269302 - DNA, 37 bp, Artificial Sequence
  Description of Artificial Sequence: Synthetic oligonucleotide
tgtcattgtcgacatcatcgtgaaggacaatatcacc

SEQ ID NO: 269303 - DNA, 36 bp, Artificial Sequence
  Description of Artificial Sequence: Synthetic oligonucleotide
gtcattgtcgacatcatcgtgaaggacaatatcacc

SEQ ID NO: 269304 - DNA, 37 bp, Artificial Sequence
  Description of Artificial Sequence: Synthetic oligonucleotide
tcattgtcgacatcatcgtgaaggacaatatcaccac

SEQ ID NO: 269305 - DNA, 36 bp, Artificial Sequence
  Description of Artificial Sequence: Synthetic oligonucleotide
cattgtcgacatcatcgtgaaggacaatatcaccac

SEQ ID NO: 269306 - DNA, 36 bp, Artificial Sequence
  Description of Artificial Sequence: Synthetic oligonucleotide
attgtcgacatcatcgtgaaggacaatatcaccacc

SEQ ID NO: 269307 - DNA, 35 bp, Artificial Sequence
  Description of Artificial Sequence: Synthetic oligonucleotide
ttgtcgacatcatcgtgaaggacaatatcaccacc

SEQ ID NO: 269308 - DNA, 34 bp, Artificial Sequence
  Description of Artificial Sequence: Synthetic oligonucleotide
tgtcgacatcatcgtgaaggacaatatcaccacc

SEQ ID NO: 269309 - DNA, 33 bp, Artificial Sequence
  Description of Artificial Sequence: Synthetic oligonucleotide
gtcgacatcatcgtgaaggacaatatcaccacc

SEQ ID NO: 269310 - DNA, 34 bp, Artificial Sequence
  Description of Artificial Sequence: Synthetic oligonucleotide
tcgacatcatcgtgaaggacaatatcaccacctg

SEQ ID NO: 269311 - DNA, 33 bp, Artificial Sequence
  Description of Artificial Sequence: Synthetic oligonucleotide
cgacatcatcgtgaaggacaatatcaccacctg

SEQ ID NO: 269312 - DNA, 33 bp, Artificial Sequence
  Description of Artificial Sequence: Synthetic oligonucleotide
gacatcatcgtgaaggacaatatcaccacctgg

SEQ ID NO: 269313 - DNA, 34 bp, Artificial Sequence
  Description of Artificial Sequence: Synthetic oligonucleotide
acatcatcgtgaaggacaatatcaccacctggac

SEQ ID NO: 269314 - DNA, 33 bp, Artificial Sequence
  Description of Artificial Sequence: Synthetic oligonucleotide
catcatcgtgaaggacaatatcaccacctggac

SEQ ID NO: 269315 - DNA, 34 bp, Artificial Sequence
  Description of Artificial Sequence: Synthetic oligonucleotide
atcatcgtgaaggacaatatcaccacctggacac

SEQ ID NO: 269316 - DNA, 33 bp, Artificial Sequence
  Description of Artificial Sequence: Synthetic oligonucleotide
tcatcgtgaaggacaatatcaccacctggacac

SEQ ID NO: 269317 - DNA, 32 bp, Artificial Sequence
  Description of Artificial Sequence: Synthetic oligonucleotide
catcgtgaaggacaatatcaccacctggacac

SEQ ID NO: 269318 - DNA, 33 bp, Artificial Sequence
  Description of Artificial Sequence: Synthetic oligonucleotide
atcgtgaaggacaatatcaccacctggacactg

SEQ ID NO: 269319 - DNA, 32 bp, Artificial Sequence
  Description of Artificial Sequence: Synthetic oligonucleotide
tcgtgaaggacaatatcaccacctggacactg

SEQ ID NO: 269320 - DNA, 31 bp, Artificial Sequence
  Description of Artificial Sequence: Synthetic oligonucleotide
cgtgaaggacaatatcaccacctggacactg

SEQ ID NO: 269321 - DNA, 33 bp, Artificial Sequence
  Description of Artificial Sequence: Synthetic oligonucleotide
gtgaaggacaatatcaccacctggacactgatg

SEQ ID NO: 269322 - DNA, 33 bp, Artificial Sequence
  Description of Artificial Sequence: Synthetic oligonucleotide
tgaaggacaatatcaccacctggacactgatgg

SEQ ID NO: 269323 - DNA, 32 bp, Artificial Sequence
  Description of Artificial Sequence: Synthetic oligonucleotide
gaaggacaatatcaccacctggacactgatgg

SEQ ID NO: 269324 - DNA, 32 bp, Artificial Sequence
  Description of Artificial Sequence: Synthetic oligonucleotide
aaggacaatatcaccacctggacactgatggc

SEQ ID NO: 269325 - DNA, 31 bp, Artificial Sequence
  Description of Artificial Sequence: Synthetic oligonucleotide
aggacaatatcaccacctggacactgatggc

SEQ ID NO: 269326 - DNA, 30 bp, Artificial Sequence
  Description of Artificial Sequence: Synthetic oligonucleotide
ggacaatatcaccacctggacactgatggc

SEQ ID NO: 269327 - DNA, 30 bp, Artificial Sequence
  Description of Artificial Sequence: Synthetic oligonucleotide
gacaatatcaccacctggacactgatggcc

SEQ ID NO: 269328 - DNA, 30 bp, Artificial Sequence
  Description of Artificial Sequence: Synthetic oligonucleotide
acaatatcaccacctggacactgatggccc

SEQ ID NO: 269329 - DNA, 29 bp, Artificial Sequence
  Description of Artificial Sequence: Synthetic oligonucleotide
caatatcaccacctggacactgatggccc

SEQ ID NO: 269330 - DNA, 29 bp, Artificial Sequence
  Description of Artificial Sequence: Synthetic oligonucleotide
aatatcaccacctggacactgatggcccg

SEQ ID NO: 269331 - DNA, 28 bp, Artificial Sequence
  Description of Artificial Sequence: Synthetic oligonucleotide
atatcaccacctggacactgatggcccg

SEQ ID NO: 269332 - DNA, 27 bp, Artificial Sequence
  Description of Artificial Sequence: Synthetic oligonucleotide
tatcaccacctggacactgatggcccg

SEQ ID NO: 269333 - DNA, 27 bp, Artificial Sequence
  Description of Artificial Sequence: Synthetic oligonucleotide
atcaccacctggacactgatggcccga

SEQ ID NO: 269334 - DNA, 27 bp, Artificial Sequence
  Description of Artificial Sequence: Synthetic oligonucleotide
tcaccacctggacactgatggcccgaa

SEQ ID NO: 269335 - DNA, 27 bp, Artificial Sequence
  Description of Artificial Sequence: Synthetic oligonucleotide
caccacctggacactgatggcccgaat

SEQ ID NO: 269336 - DNA, 27 bp, Artificial Sequence
  Description of Artificial Sequence: Synthetic oligonucleotide
accacctggacactgatggcccgaatc

SEQ ID NO: 269337 - DNA, 26 bp, Artificial Sequence
  Description of Artificial Sequence: Synthetic oligonucleotide
ccacctggacactgatggcccgaatc

SEQ ID NO: 269338 - DNA, 27 bp, Artificial Sequence
  Description of Artificial Sequence: Synthetic oligonucleotide
cacctggacactgatggcccgaatcga

SEQ ID NO: 269339 - DNA, 27 bp, Artificial Sequence
  Description of Artificial Sequence: Synthetic oligonucleotide
acctggacactgatggcccgaatcgac

SEQ ID NO: 269340 - DNA, 27 bp, Artificial Sequence
  Description of Artificial Sequence: Synthetic oligonucleotide
cctggacactgatggcccgaatcgact

SEQ ID NO: 269341 - DNA, 27 bp, Artificial Sequence
  Description of Artificial Sequence: Synthetic oligonucleotide
atggaaccgtttttggcgtcgcggtcg

SEQ ID NO: 269342 - DNA, 26 bp, Artificial Sequence
  Description of Artificial Sequence: Synthetic oligonucleotide
tggaaccgtttttggcgtcgcggtcg

SEQ ID NO: 269343 - DNA, 25 bp, Artificial Sequence
  Description of Artificial Sequence: Synthetic oligonucleotide
ggaaccgtttttggcgtcgcggtcg

SEQ ID NO: 269344 - DNA, 25 bp, Artificial Sequence
  Description of Artificial Sequence: Synthetic oligonucleotide
gaaccgtttttggcgtcgcggtcgg

SEQ ID NO: 269345 - DNA, 26 bp, Artificial Sequence
  Description of Artificial Sequence: Synthetic oligonucleotide
aaccgtttttggcgtcgcggtcggga

SEQ ID NO: 269346 - DNA, 25 bp, Artificial Sequence
  Description of Artificial Sequence: Synthetic oligonucleotide
accgtttttggcgtcgcggtcggga

SEQ ID NO: 269347 - DNA, 24 bp, Artificial Sequence
  Description of Artificial Sequence: Synthetic oligonucleotide
ccgtttttggcgtcgcggtcggga

SEQ ID NO: 269348 - DNA, 27 bp, Artificial Sequence
  Description of Artificial Sequence: Synthetic oligonucleotide
cgtttttggcgtcgcggtcgggacttt

SEQ ID NO: 269349 - DNA, 27 bp, Artificial Sequence
  Description of Artificial Sequence: Synthetic oligonucleotide
gtttttggcgtcgcggtcgggactttg

SEQ ID NO: 269350 - DNA, 27 bp, Artificial Sequence
  Description of Artificial Sequence: Synthetic oligonucleotide
tttttggcgtcgcggtcgggactttgg

SEQ ID NO: 269351 - DNA, 26 bp, Artificial Sequence
  Description of Artificial Sequence: Synthetic oligonucleotide
ttttggcgtcgcggtcgggactttgg

SEQ ID NO: 269352 - DNA, 25 bp, Artificial Sequence
  Description of Artificial Sequence: Synthetic oligonucleotide
tttggcgtcgcggtcgggactttgg

SEQ ID NO: 269353 - DNA, 24 bp, Artificial Sequence
  Description of Artificial Sequence: Synthetic oligonucleotide
ttggcgtcgcggtcgggactttgg

SEQ ID NO: 269354 - DNA, 23 bp, Artificial Sequence
  Description of Artificial Sequence: Synthetic oligonucleotide
tggcgtcgcggtcgggactttgg

SEQ ID NO: 269355 - DNA, 22 bp, Artificial Sequence
  Description of Artificial Sequence: Synthetic oligonucleotide
ggcgtcgcggtcgggactttgg

SEQ ID NO: 269356 - DNA, 22 bp, Artificial Sequence
  Description of Artificial Sequence: Synthetic oligonucleotide
gcgtcgcggtcgggactttggc

SEQ ID NO: 269357 - DNA, 22 bp, Artificial Sequence
  Description of Artificial Sequence: Synthetic oligonucleotide
cgtcgcggtcgggactttggcc

SEQ ID NO: 269358 - DNA, 22 bp, Artificial Sequence
  Description of Artificial Sequence: Synthetic oligonucleotide
gtcgcggtcgggactttggccg

SEQ ID NO: 269359 - DNA, 22 bp, Artificial Sequence
  Description of Artificial Sequence: Synthetic oligonucleotide
tcgcggtcgggactttggccgg

SEQ ID NO: 269360 - DNA, 21 bp, Artificial Sequence
  Description of Artificial Sequence: Synthetic oligonucleotide
cgcggtcgggactttggccgg

SEQ ID NO: 269361 - DNA, 21 bp, Artificial Sequence
  Description of Artificial Sequence: Synthetic oligonucleotide
gcggtcgggactttggccggg

SEQ ID NO: 269362 - DNA, 21 bp, Artificial Sequence
  Description of Artificial Sequence: Synthetic oligonucleotide
cggtcgggactttggccgggg

SEQ ID NO: 269363 - DNA, 21 bp, Artificial Sequence
  Description of Artificial Sequence: Synthetic oligonucleotide
ggtcgggactttggccggggg

SEQ ID NO: 269364 - DNA, 22 bp, Artificial Sequence
  Description of Artificial Sequence: Synthetic oligonucleotide
gtcgggactttggccggggggt

SEQ ID NO: 269365 - DNA, 22 bp, Artificial Sequence
  Description of Artificial Sequence: Synthetic oligonucleotide
tcgggactttggccggggggtc

SEQ ID NO: 269366 - DNA, 21 bp, Artificial Sequence
  Description of Artificial Sequence: Synthetic oligonucleotide
cgggactttggccggggggtc

SEQ ID NO: 269367 - DNA, 21 bp, Artificial Sequence
  Description of Artificial Sequence: Synthetic oligonucleotide
gggactttggccggggggtcg

SEQ ID NO: 269368 - DNA, 21 bp, Artificial Sequence
  Description of Artificial Sequence: Synthetic oligonucleotide
ggactttggccggggggtcgg

SEQ ID NO: 269369 - DNA, 21 bp, Artificial Sequence
  Description of Artificial Sequence: Synthetic oligonucleotide
gactttggccggggggtcggg

SEQ ID NO: 269370 - DNA, 21 bp, Artificial Sequence
  Description of Artificial Sequence: Synthetic oligonucleotide
actttggccggggggtcgggc

SEQ ID NO: 269371 - DNA, 20 bp, Artificial Sequence
  Description of Artificial Sequence: Synthetic oligonucleotide
ctttggccggggggtcgggc

SEQ ID NO: 269372 - DNA, 20 bp, Artificial Sequence
  Description of Artificial Sequence: Synthetic oligonucleotide
tttggccggggggtcgggcc

SEQ ID NO: 269373 - DNA, 20 bp, Artificial Sequence
  Description of Artificial Sequence: Synthetic oligonucleotide
ttggccggggggtcgggcct

SEQ ID NO: 269374 - DNA, 20 bp, Artificial Sequence
  Description of Artificial Sequence: Synthetic oligonucleotide
tggccggggggtcgggcctt

SEQ ID NO: 269375 - DNA, 20 bp, Artificial Sequence
  Description of Artificial Sequence: Synthetic oligonucleotide
ggccggggggtcgggccttt

SEQ ID NO: 269376 - DNA, 20 bp, Artificial Sequence
  Description of Artificial Sequence: Synthetic oligonucleotide
gccggggggtcgggcccttt

SEQ ID NO: 269377 - DNA, 20 bp, Artificial Sequence
  Description of Artificial Sequence: Synthetic oligonucleotide
ccggggggtcgggccccatt

SEQ ID NO: 269378 - DNA, 20 bp, Artificial Sequence
  Description of Artificial Sequence: Synthetic oligonucleotide
cggggggtcgggccccagtt

SEQ ID NO: 269379 - DNA, 20 bp, Artificial Sequence
  Description of Artificial Sequence: Synthetic oligonucleotide
ggggggtcgggccccaggtt

SEQ ID NO: 269380 - DNA, 20 bp, Artificial Sequence
  Description of Artificial Sequence: Synthetic oligonucleotide
gggggtcgggccccaggtca

SEQ ID NO: 269381 - DNA, 25 bp, Artificial Sequence
  Description of Artificial Sequence: Synthetic oligonucleotide
ggggtcgggccccaggtcagtttta

SEQ ID NO: 269382 - DNA, 25 bp, Artificial Sequence
  Description of Artificial Sequence: Synthetic oligonucleotide
gggtcgggccccaggtcagttttac

SEQ ID NO: 269383 - DNA, 25 bp, Artificial Sequence
  Description of Artificial Sequence: Synthetic oligonucleotide
ggtcgggccccaggtcagttttacg

SEQ ID NO: 269384 - DNA, 25 bp, Artificial Sequence
  Description of Artificial Sequence: Synthetic oligonucleotide
gtcgggccccaggtcagttttacgg

SEQ ID NO: 269385 - DNA, 27 bp, Artificial Sequence
  Description of Artificial Sequence: Synthetic oligonucleotide
tcgggccccaggtcagttttacggcat

SEQ ID NO: 269386 - DNA, 27 bp, Artificial Sequence
  Description of Artificial Sequence: Synthetic oligonucleotide
cgggccccaggtcagttttacggcatt

SEQ ID NO: 269387 - DNA, 27 bp, Artificial Sequence
  Description of Artificial Sequence: Synthetic oligonucleotide
gggccccaggtcagttttacggcattc

SEQ ID NO: 269388 - DNA, 27 bp, Artificial Sequence
  Description of Artificial Sequence: Synthetic oligonucleotide
ggccccaggtcagttttacggcattcc

SEQ ID NO: 269389 - DNA, 27 bp, Artificial Sequence
  Description of Artificial Sequence: Synthetic oligonucleotide
gccccaggtcagttttacggcattccg

SEQ ID NO: 269390 - DNA, 28 bp, Artificial Sequence
  Description of Artificial Sequence: Synthetic oligonucleotide
ccccaggtcagttttacggcattccgtg

SEQ ID NO: 269391 - DNA, 28 bp, Artificial Sequence
  Description of Artificial Sequence: Synthetic oligonucleotide
cccaggtcagttttacggcattccgtgc

SEQ ID NO: 269392 - DNA, 29 bp, Artificial Sequence
  Description of Artificial Sequence: Synthetic oligonucleotide
ccaggtcagttttacggcattccgtgcac

SEQ ID NO: 269393 - DNA, 30 bp, Artificial Sequence
  Description of Artificial Sequence: Synthetic oligonucleotide
caggtcagttttacggcattccgtgcactc

SEQ ID NO: 269394 - DNA, 30 bp, Artificial Sequence
  Description of Artificial Sequence: Synthetic oligonucleotide
aggtcagttttacggcattccgtgcactcc

SEQ ID NO: 269395 - DNA, 29 bp, Artificial Sequence
  Description of Artificial Sequence: Synthetic oligonucleotide
ggtcagttttacggcattccgtgcactcc

SEQ ID NO: 269396 - DNA, 29 bp, Artificial Sequence
  Description of Artificial Sequence: Synthetic oligonucleotide
gtcagttttacggcattccgtgcactccc

SEQ ID NO: 269397 - DNA, 29 bp, Artificial Sequence
  Description of Artificial Sequence: Synthetic oligonucleotide
tcagttttacggcattccgtgcactcccg

SEQ ID NO: 269398 - DNA, 28 bp, Artificial Sequence
  Description of Artificial Sequence: Synthetic oligonucleotide
cagttttacggcattccgtgcactcccg

SEQ ID NO: 269399 - DNA, 31 bp, Artificial Sequence
  Description of Artificial Sequence: Synthetic oligonucleotide
agttttacggcattccgtgcactcccgaatc

SEQ ID NO: 269400 - DNA, 30 bp, Artificial Sequence
  Description of Artificial Sequence: Synthetic oligonucleotide
gttttacggcattccgtgcactcccgaatc

SEQ ID NO: 269401 - DNA, 30 bp, Artificial Sequence
  Description of Artificial Sequence: Synthetic oligonucleotide
ttttacggcattccgtgcactcccgaatcc

SEQ ID NO: 269402 - DNA, 29 bp, Artificial Sequence
  Description of Artificial Sequence: Synthetic oligonucleotide
tttacggcattccgtgcactcccgaatcc

SEQ ID NO: 269403 - DNA, 28 bp, Artificial Sequence
  Description of Artificial Sequence: Synthetic oligonucleotide
ttacggcattccgtgcactcccgaatcc

SEQ ID NO: 269404 - DNA, 27 bp, Artificial Sequence
  Description of Artificial Sequence: Synthetic oligonucleotide
tacggcattccgtgcactcccgaatcc

SEQ ID NO: 269405 - DNA, 27 bp, Artificial Sequence
  Description of Artificial Sequence: Synthetic oligonucleotide
acggcattccgtgcactcccgaatcct

SEQ ID NO: 269406 - DNA, 27 bp, Artificial Sequence
  Description of Artificial Sequence: Synthetic oligonucleotide
cggcattccgtgcactcccgaatcctt

SEQ ID NO: 269407 - DNA, 27 bp, Artificial Sequence
  Description of Artificial Sequence: Synthetic oligonucleotide
ggcattccgtgcactcccgaatccttc

SEQ ID NO: 269408 - DNA, 29 bp, Artificial Sequence
  Description of Artificial Sequence: Synthetic oligonucleotide
gcattccgtgcactcccgaatccttcatg

SEQ ID NO: 269409 - DNA, 29 bp, Artificial Sequence
  Description of Artificial Sequence: Synthetic oligonucleotide
cattccgtgcactcccgaatccttcatgc

SEQ ID NO: 269410 - DNA, 31 bp, Artificial Sequence
  Description of Artificial Sequence: Synthetic oligonucleotide
attccgtgcactcccgaatccttcatgcatc

SEQ ID NO: 269411 - DNA, 30 bp, Artificial Sequence
  Description of Artificial Sequence: Synthetic oligonucleotide
ttccgtgcactcccgaatccttcatgcatc

SEQ ID NO: 269412 - DNA, 29 bp, Artificial Sequence
  Description of Artificial Sequence: Synthetic oligonucleotide
tccgtgcactcccgaatccttcatgcatc

SEQ ID NO: 269413 - DNA, 28 bp, Artificial Sequence
  Description of Artificial Sequence: Synthetic oligonucleotide
ccgtgcactcccgaatccttcatgcatc

SEQ ID NO: 269414 - DNA, 28 bp, Artificial Sequence
  Description of Artificial Sequence: Synthetic oligonucleotide
cgtgcactcccgaatccttcatgcatcc

SEQ ID NO: 269415 - DNA, 28 bp, Artificial Sequence
  Description of Artificial Sequence: Synthetic oligonucleotide
gtgcactcccgaatccttcatgcatccg

SEQ ID NO: 269416 - DNA, 28 bp, Artificial Sequence
  Description of Artificial Sequence: Synthetic oligonucleotide
tgcactcccgaatccttcatgcatccgg

SEQ ID NO: 269417 - DNA, 27 bp, Artificial Sequence
  Description of Artificial Sequence: Synthetic oligonucleotide
gcactcccgaatccttcatgcatccgg

SEQ ID NO: 269418 - DNA, 27 bp, Artificial Sequence
  Description of Artificial Sequence: Synthetic oligonucleotide
cactcccgaatccttcatgcatccggc

SEQ ID NO: 269419 - DNA, 27 bp, Artificial Sequence
  Description of Artificial Sequence: Synthetic oligonucleotide
actcccgaatccttcatgcatccggcg

SEQ ID NO: 269420 - DNA, 27 bp, Artificial Sequence
  Description of Artificial Sequence: Synthetic oligonucleotide
ctcccgaatccttcatgcatccggcgt

SEQ ID NO: 269421 - DNA, 27 bp, Artificial Sequence
  Description of Artificial Sequence: Synthetic oligonucleotide
tcccgaatccttcatgcatccggcgtg

SEQ ID NO: 269422 - DNA, 27 bp, Artificial Sequence
  Description of Artificial Sequence: Synthetic oligonucleotide
cccgaatccttcatgcatccggcgtgt

SEQ ID NO: 269423 - DNA, 27 bp, Artificial Sequence
  Description of Artificial Sequence: Synthetic oligonucleotide
ccgaatccttcatgcatccggcgtgtg

SEQ ID NO: 269424 - DNA, 27 bp, Artificial Sequence
  Description of Artificial Sequence: Synthetic oligonucleotide
cgaatccttcatgcatccggcgtgtgc

SEQ ID NO: 269425 - DNA, 28 bp, Artificial Sequence
  Description of Artificial Sequence: Synthetic oligonucleotide
gaatccttcatgcatccggcgtgtgcac

SEQ ID NO: 269426 - DNA, 32 bp, Artificial Sequence
  Description of Artificial Sequence: Synthetic oligonucleotide
aatccttcatgcatccggcgtgtgcactttag

SEQ ID NO: 269427 - DNA, 31 bp, Artificial Sequence
  Description of Artificial Sequence: Synthetic oligonucleotide
atccttcatgcatccggcgtgtgcactttag

SEQ ID NO: 269428 - DNA, 30 bp, Artificial Sequence
  Description of Artificial Sequence: Synthetic oligonucleotide
tccttcatgcatccggcgtgtgcactttag

SEQ ID NO: 269429 - DNA, 29 bp, Artificial Sequence
  Description of Artificial Sequence: Synthetic oligonucleotide
ccttcatgcatccggcgtgtgcactttag

SEQ ID NO: 269430 - DNA, 30 bp, Artificial Sequence
  Description of Artificial Sequence: Synthetic oligonucleotide
cttcatgcatccggcgtgtgcactttagag

SEQ ID NO: 269431 - DNA, 31 bp, Artificial Sequence
  Description of Artificial Sequence: Synthetic oligonucleotide
ttcatgcatccggcgtgtgcactttagagag

SEQ ID NO: 269432 - DNA, 30 bp, Artificial Sequence
  Description of Artificial Sequence: Synthetic oligonucleotide
tcatgcatccggcgtgtgcactttagagag

SEQ ID NO: 269433 - DNA, 29 bp, Artificial Sequence
  Description of Artificial Sequence: Synthetic oligonucleotide
catgcatccggcgtgtgcactttagagag

SEQ ID NO: 269434 - DNA, 29 bp, Artificial Sequence
  Description of Artificial Sequence: Synthetic oligonucleotide
atgcatccggcgtgtgcactttagagagg

SEQ ID NO: 269435 - DNA, 28 bp, Artificial Sequence
  Description of Artificial Sequence: Synthetic oligonucleotide
tgcatccggcgtgtgcactttagagagg

SEQ ID NO: 269436 - DNA, 27 bp, Artificial Sequence
  Description of Artificial Sequence: Synthetic oligonucleotide
gcatccggcgtgtgcactttagagagg

SEQ ID NO: 269437 - DNA, 28 bp, Artificial Sequence
  Description of Artificial Sequence: Synthetic oligonucleotide
catccggcgtgtgcactttagagaggtc

SEQ ID NO: 269438 - DNA, 28 bp, Artificial Sequence
  Description of Artificial Sequence: Synthetic oligonucleotide
atccggcgtgtgcactttagagaggtcc

SEQ ID NO: 269439 - DNA, 27 bp, Artificial Sequence
  Description of Artificial Sequence: Synthetic oligonucleotide
tccggcgtgtgcactttagagaggtcc

SEQ ID NO: 269440 - DNA, 27 bp, Artificial Sequence
  Description of Artificial Sequence: Synthetic oligonucleotide
ccggcgtgtgcactttagagaggtcca

SEQ ID NO: 269441 - DNA, 29 bp, Artificial Sequence
  Description of Artificial Sequence: Synthetic oligonucleotide
cggcgtgtgcactttagagaggtccattc

SEQ ID NO: 269442 - DNA, 30 bp, Artificial Sequence
  Description of Artificial Sequence: Synthetic oligonucleotide
ggcgtgtgcactttagagaggtccattcac

SEQ ID NO: 269443 - DNA, 30 bp, Artificial Sequence
  Description of Artificial Sequence: Synthetic oligonucleotide
gcgtgtgcactttagagaggtccattcacg

SEQ ID NO: 269444 - DNA, 30 bp, Artificial Sequence
  Description of Artificial Sequence: Synthetic oligonucleotide
cgtgtgcactttagagaggtccattcacgc

SEQ ID NO: 269445 - DNA, 30 bp, Artificial Sequence
  Description of Artificial Sequence: Synthetic oligonucleotide
gtgtgcactttagagaggtccattcacgcg

SEQ ID NO: 269446 - DNA, 30 bp, Artificial Sequence
  Description of Artificial Sequence: Synthetic oligonucleotide
tgtgcactttagagaggtccattcacgcgg

SEQ ID NO: 269447 - DNA, 29 bp, Artificial Sequence
  Description of Artificial Sequence: Synthetic oligonucleotide
gtgcactttagagaggtccattcacgcgg

SEQ ID NO: 269448 - DNA, 30 bp, Artificial Sequence
  Description of Artificial Sequence: Synthetic oligonucleotide
tgcactttagagaggtccattcacgcggag

SEQ ID NO: 269449 - DNA, 29 bp, Artificial Sequence
  Description of Artificial Sequence: Synthetic oligonucleotide
gcactttagagaggtccattcacgcggag

SEQ ID NO: 269450 - DNA, 29 bp, Artificial Sequence
  Description of Artificial Sequence: Synthetic oligonucleotide
cactttagagaggtccattcacgcggagc

SEQ ID NO: 269451 - DNA, 29 bp, Artificial Sequence
  Description of Artificial Sequence: Synthetic oligonucleotide
actttagagaggtccattcacgcggagcc

SEQ ID NO: 269452 - DNA, 28 bp, Artificial Sequence
  Description of Artificial Sequence: Synthetic oligonucleotide
ctttagagaggtccattcacgcggagcc

SEQ ID NO: 269453 - DNA, 29 bp, Artificial Sequence
  Description of Artificial Sequence: Synthetic oligonucleotide
tttagagaggtccattcacgcggagccag

SEQ ID NO: 269454 - DNA, 28 bp, Artificial Sequence
  Description of Artificial Sequence: Synthetic oligonucleotide
ttagagaggtccattcacgcggagccag

SEQ ID NO: 269455 - DNA, 27 bp, Artificial Sequence
  Description of Artificial Sequence: Synthetic oligonucleotide
tagagaggtccattcacgcggagccag

SEQ ID NO: 269456 - DNA, 27 bp, Artificial Sequence
  Description of Artificial Sequence: Synthetic oligonucleotide
agagaggtccattcacgcggagccaga

SEQ ID NO: 269457 - DNA, 27 bp, Artificial Sequence
  Description of Artificial Sequence: Synthetic oligonucleotide
gagaggtccattcacgcggagccagaa

SEQ ID NO: 269458 - DNA, 27 bp, Artificial Sequence
  Description of Artificial Sequence: Synthetic oligonucleotide
agaggtccattcacgcggagccagaac

SEQ ID NO: 269459 - DNA, 26 bp, Artificial Sequence
  Description of Artificial Sequence: Synthetic oligonucleotide
gaggtccattcacgcggagccagaac

SEQ ID NO: 269460 - DNA, 26 bp, Artificial Sequence
  Description of Artificial Sequence: Synthetic oligonucleotide
aggtccattcacgcggagccagaacc

SEQ ID NO: 269461 - DNA, 25 bp, Artificial Sequence
  Description of Artificial Sequence: Synthetic oligonucleotide
ggtccattcacgcggagccagaacc

SEQ ID NO: 269462 - DNA, 25 bp, Artificial Sequence
  Description of Artificial Sequence: Synthetic oligonucleotide
gtccattcacgcggagccagaaccc

SEQ ID NO: 269463 - DNA, 27 bp, Artificial Sequence
  Description of Artificial Sequence: Synthetic oligonucleotide
tccattcacgcggagccagaacccgat

SEQ ID NO: 269464 - DNA, 26 bp, Artificial Sequence
  Description of Artificial Sequence: Synthetic oligonucleotide
ccattcacgcggagccagaacccgat

SEQ ID NO: 269465 - DNA, 26 bp, Artificial Sequence
  Description of Artificial Sequence: Synthetic oligonucleotide
cattcacgcggagccagaacccgatg

SEQ ID NO: 269466 - DNA, 27 bp, Artificial Sequence
  Description of Artificial Sequence: Synthetic oligonucleotide
attcacgcggagccagaacccgatggt

SEQ ID NO: 269467 - DNA, 26 bp, Artificial Sequence
  Description of Artificial Sequence: Synthetic oligonucleotide
ttcacgcggagccagaacccgatggt

SEQ ID NO: 269468 - DNA, 25 bp, Artificial Sequence
  Description of Artificial Sequence: Synthetic oligonucleotide
tcacgcggagccagaacccgatggt

SEQ ID NO: 269469 - DNA, 24 bp, Artificial Sequence
  Description of Artificial Sequence: Synthetic oligonucleotide
cacgcggagccagaacccgatggt

SEQ ID NO: 269470 - DNA, 25 bp, Artificial Sequence
  Description of Artificial Sequence: Synthetic oligonucleotide
acgcggagccagaacccgatggtga

SEQ ID NO: 269471 - DNA, 24 bp, Artificial Sequence
  Description of Artificial Sequence: Synthetic oligonucleotide
cgcggagccagaacccgatggtga

SEQ ID NO: 269472 - DNA, 24 bp, Artificial Sequence
  Description of Artificial Sequence: Synthetic oligonucleotide
gcggagccagaacccgatggtgac

SEQ ID NO: 269473 - DNA, 24 bp, Artificial Sequence
  Description of Artificial Sequence: Synthetic oligonucleotide
cggagccagaacccgatggtgacc

SEQ ID NO: 269474 - DNA, 24 bp, Artificial Sequence
  Description of Artificial Sequence: Synthetic oligonucleotide
ggagccagaacccgatggtgaccc

SEQ ID NO: 269475 - DNA, 24 bp, Artificial Sequence
  Description of Artificial Sequence: Synthetic oligonucleotide
gagccagaacccgatggtgacccg

SEQ ID NO: 269476 - DNA, 25 bp, Artificial Sequence
  Description of Artificial Sequence: Synthetic oligonucleotide
agccagaacccgatggtgacccgga

SEQ ID NO: 269477 - DNA, 24 bp, Artificial Sequence
  Description of Artificial Sequence: Synthetic oligonucleotide
gccagaacccgatggtgacccgga

SEQ ID NO: 269478 - DNA, 24 bp, Artificial Sequence
  Description of Artificial Sequence: Synthetic oligonucleotide
ccagaacccgatggtgacccggac

SEQ ID NO: 269479 - DNA, 25 bp, Artificial Sequence
  Description of Artificial Sequence: Synthetic oligonucleotide
cagaacccgatggtgacccggacct

SEQ ID NO: 269480 - DNA, 26 bp, Artificial Sequence
  Description of Artificial Sequence: Synthetic oligonucleotide
agaacccgatggtgacccggacctca

SEQ ID NO: 269481 - DNA, 25 bp, Artificial Sequence
  Description of Artificial Sequence: Synthetic oligonucleotide
gaacccgatggtgacccggacctca

SEQ ID NO: 269482 - DNA, 26 bp, Artificial Sequence
  Description of Artificial Sequence: Synthetic oligonucleotide
aacccgatggtgacccggacctcaga

SEQ ID NO: 269483 - DNA, 25 bp, Artificial Sequence
  Description of Artificial Sequence: Synthetic oligonucleotide
acccgatggtgacccggacctcaga

SEQ ID NO: 269484 - DNA, 24 bp, Artificial Sequence
  Description of Artificial Sequence: Synthetic oligonucleotide
cccgatggtgacccggacctcaga

SEQ ID NO: 269485 - DNA, 24 bp, Artificial Sequence
  Description of Artificial Sequence: Synthetic oligonucleotide
ccgatggtgacccggacctcagac

SEQ ID NO: 269486 - DNA, 25 bp, Artificial Sequence
  Description of Artificial Sequence: Synthetic oligonucleotide
cgatggtgacccggacctcagacct

SEQ ID NO: 269487 - DNA, 25 bp, Artificial Sequence
  Description of Artificial Sequence: Synthetic oligonucleotide
gatggtgacccggacctcagacctc

SEQ ID NO: 269488 - DNA, 25 bp, Artificial Sequence
  Description of Artificial Sequence: Synthetic oligonucleotide
atggtgacccggacctcagacctcg

SEQ ID NO: 269489 - DNA, 24 bp, Artificial Sequence
  Description of Artificial Sequence: Synthetic oligonucleotide
tggtgacccggacctcagacctcg

SEQ ID NO: 269490 - DNA, 23 bp, Artificial Sequence
  Description of Artificial Sequence: Synthetic oligonucleotide
ggtgacccggacctcagacctcg

SEQ ID NO: 269491 - DNA, 23 bp, Artificial Sequence
  Description of Artificial Sequence: Synthetic oligonucleotide
gtgacccggacctcagacctcgg

SEQ ID NO: 269492 - DNA, 23 bp, Artificial Sequence
  Description of Artificial Sequence: Synthetic oligonucleotide
tgacccggacctcagacctcggc

SEQ ID NO: 269493 - DNA, 22 bp, Artificial Sequence
  Description of Artificial Sequence: Synthetic oligonucleotide
gacccggacctcagacctcggc

SEQ ID NO: 269494 - DNA, 26 bp, Artificial Sequence
  Description of Artificial Sequence: Synthetic oligonucleotide
acccggacctcagacctcggcgtaaa

SEQ ID NO: 269495 - DNA, 25 bp, Artificial Sequence
  Description of Artificial Sequence: Synthetic oligonucleotide
cccggacctcagacctcggcgtaaa

SEQ ID NO: 269496 - DNA, 27 bp, Artificial Sequence
  Description of Artificial Sequence: Synthetic oligonucleotide
ccggacctcagacctcggcgtaaagtt

SEQ ID NO: 269497 - DNA, 27 bp, Artificial Sequence
  Description of Artificial Sequence: Synthetic oligonucleotide
cggacctcagacctcggcgtaaagttc

SEQ ID NO: 269498 - DNA, 27 bp, Artificial Sequence
  Description of Artificial Sequence: Synthetic oligonucleotide
ggacctcagacctcggcgtaaagttcg

SEQ ID NO: 269499 - DNA, 28 bp, Artificial Sequence
  Description of Artificial Sequence: Synthetic oligonucleotide
gacctcagacctcggcgtaaagttcgag

SEQ ID NO: 269500 - DNA, 28 bp, Artificial Sequence
  Description of Artificial Sequence: Synthetic oligonucleotide
acctcagacctcggcgtaaagttcgagc

SEQ ID NO: 269501 - DNA, 27 bp, Artificial Sequence
  Description of Artificial Sequence: Synthetic oligonucleotide
cctcagacctcggcgtaaagttcgagc

SEQ ID NO: 269502 - DNA, 27 bp, Artificial Sequence
  Description of Artificial Sequence: Synthetic oligonucleotide
ctcagacctcggcgtaaagttcgagcg

SEQ ID NO: 269503 - DNA, 27 bp, Artificial Sequence
  Description of Artificial Sequence: Synthetic oligonucleotide
tcagacctcggcgtaaagttcgagcgc

SEQ ID NO: 269504 - DNA, 26 bp, Artificial Sequence
  Description of Artificial Sequence: Synthetic oligonucleotide
cagacctcggcgtaaagttcgagcgc

SEQ ID NO: 269505 - DNA, 26 bp, Artificial Sequence
  Description of Artificial Sequence: Synthetic oligonucleotide
agacctcggcgtaaagttcgagcgcg

SEQ ID NO: 269506 - DNA, 25 bp, Artificial Sequence
  Description of Artificial Sequence: Synthetic oligonucleotide
gacctcggcgtaaagttcgagcgcg

SEQ ID NO: 269507 - DNA, 26 bp, Artificial Sequence
  Description of Artificial Sequence: Synthetic oligonucleotide
acctcggcgtaaagttcgagcgcgga

SEQ ID NO: 269508 - DNA, 25 bp, Artificial Sequence
  Description of Artificial Sequence: Synthetic oligonucleotide
cctcggcgtaaagttcgagcgcgga

SEQ ID NO: 269509 - DNA, 26 bp, Artificial Sequence
  Description of Artificial Sequence: Synthetic oligonucleotide
ctcggcgtaaagttcgagcgcggagt

SEQ ID NO: 269510 - DNA, 26 bp, Artificial Sequence
  Description of Artificial Sequence: Synthetic oligonucleotide
tcggcgtaaagttcgagcgcggagtg

SEQ ID NO: 269511 - DNA, 25 bp, Artificial Sequence
  Description of Artificial Sequence: Synthetic oligonucleotide
cggcgtaaagttcgagcgcggagtg

SEQ ID NO: 269512 - DNA, 26 bp, Artificial Sequence
  Description of Artificial Sequence: Synthetic oligonucleotide
ggcgtaaagttcgagcgcggagtgga

SEQ ID NO: 269513 - DNA, 27 bp, Artificial Sequence
  Description of Artificial Sequence: Synthetic oligonucleotide
gcgtaaagttcgagcgcggagtggaga

SEQ ID NO: 269514 - DNA, 29 bp, Artificial Sequence
  Description of Artificial Sequence: Synthetic oligonucleotide
cgtaaagttcgagcgcggagtggagattg

SEQ ID NO: 269515 - DNA, 29 bp, Artificial Sequence
  Description of Artificial Sequence: Synthetic oligonucleotide
gtaaagttcgagcgcggagtggagattgc

SEQ ID NO: 269516 - DNA, 29 bp, Artificial Sequence
  Description of Artificial Sequence: Synthetic oligonucleotide
taaagttcgagcgcggagtggagattgcc

SEQ ID NO: 269517 - DNA, 28 bp, Artificial Sequence
  Description of Artificial Sequence: Synthetic oligonucleotide
aaagttcgagcgcggagtggagattgcc

SEQ ID NO: 269518 - DNA, 27 bp, Artificial Sequence
  Description of Artificial Sequence: Synthetic oligonucleotide
aagttcgagcgcggagtggagattgcc

SEQ ID NO: 269519 - DNA, 26 bp, Artificial Sequence
  Description of Artificial Sequence: Synthetic oligonucleotide
agttcgagcgcggagtggagattgcc

SEQ ID NO: 269520 - DNA, 25 bp, Artificial Sequence
  Description of Artificial Sequence: Synthetic oligonucleotide
gttcgagcgcggagtggagattgcc

SEQ ID NO: 269521 - DNA, 25 bp, Artificial Sequence
  Description of Artificial Sequence: Synthetic oligonucleotide
ttcgagcgcggagtggagattgccg

SEQ ID NO: 269522 - DNA, 24 bp, Artificial Sequence
  Description of Artificial Sequence: Synthetic oligonucleotide
tcgagcgcggagtggagattgccg

SEQ ID NO: 269523 - DNA, 23 bp, Artificial Sequence
  Description of Artificial Sequence: Synthetic oligonucleotide
cgagcgcggagtggagattgccg

SEQ ID NO: 269524 - DNA, 24 bp, Artificial Sequence
  Description of Artificial Sequence: Synthetic oligonucleotide
gagcgcggagtggagattgccgct

SEQ ID NO: 269525 - DNA, 25 bp, Artificial Sequence
  Description of Artificial Sequence: Synthetic oligonucleotide
agcgcggagtggagattgccgctga

SEQ ID NO: 269526 - DNA, 24 bp, Artificial Sequence
  Description of Artificial Sequence: Synthetic oligonucleotide
gcgcggagtggagattgccgctga

SEQ ID NO: 269527 - DNA, 26 bp, Artificial Sequence
  Description of Artificial Sequence: Synthetic oligonucleotide
cgcggagtggagattgccgctgacat

SEQ ID NO: 269528 - DNA, 26 bp, Artificial Sequence
  Description of Artificial Sequence: Synthetic oligonucleotide
gcggagtggagattgccgctgacatg

SEQ ID NO: 269529 - DNA, 27 bp, Artificial Sequence
  Description of Artificial Sequence: Synthetic oligonucleotide
cggagtggagattgccgctgacatgct

SEQ ID NO: 269530 - DNA, 27 bp, Artificial Sequence
  Description of Artificial Sequence: Synthetic oligonucleotide
ggagtggagattgccgctgacatgctg

SEQ ID NO: 269531 - DNA, 27 bp, Artificial Sequence
  Description of Artificial Sequence: Synthetic oligonucleotide
gagtggagattgccgctgacatgctgc

SEQ ID NO: 269532 - DNA, 27 bp, Artificial Sequence
  Description of Artificial Sequence: Synthetic oligonucleotide
agtggagattgccgctgacatgctgcg

SEQ ID NO: 269533 - DNA, 27 bp, Artificial Sequence
  Description of Artificial Sequence: Synthetic oligonucleotide
gtggagattgccgctgacatgctgcga

SEQ ID NO: 269534 - DNA, 28 bp, Artificial Sequence
  Description of Artificial Sequence: Synthetic oligonucleotide
tggagattgccgctgacatgctgcgatc

SEQ ID NO: 269535 - DNA, 27 bp, Artificial Sequence
  Description of Artificial Sequence: Synthetic oligonucleotide
ggagattgccgctgacatgctgcgatc

SEQ ID NO: 269536 - DNA, 27 bp, Artificial Sequence
  Description of Artificial Sequence: Synthetic oligonucleotide
gagattgccgctgacatgctgcgatcc

SEQ ID NO: 269537 - DNA, 29 bp, Artificial Sequence
  Description of Artificial Sequence: Synthetic oligonucleotide
agattgccgctgacatgctgcgatcctac

SEQ ID NO: 269538 - DNA, 28 bp, Artificial Sequence
  Description of Artificial Sequence: Synthetic oligonucleotide
gattgccgctgacatgctgcgatcctac

SEQ ID NO: 269539 - DNA, 28 bp, Artificial Sequence
  Description of Artificial Sequence: Synthetic oligonucleotide
attgccgctgacatgctgcgatcctacg

SEQ ID NO: 269540 - DNA, 27 bp, Artificial Sequence
  Description of Artificial Sequence: Synthetic oligonucleotide
ttgccgctgacatgctgcgatcctacg

SEQ ID NO: 269541 - DNA, 26 bp, Artificial Sequence
  Description of Artificial Sequence: Synthetic oligonucleotide
tgccgctgacatgctgcgatcctacg

SEQ ID NO: 269542 - DNA, 25 bp, Artificial Sequence
  Description of Artificial Sequence: Synthetic oligonucleotide
gccgctgacatgctgcgatcctacg

SEQ ID NO: 269543 - DNA, 25 bp, Artificial Sequence
  Description of Artificial Sequence: Synthetic oligonucleotide
ccgctgacatgctgcgatcctacgc

SEQ ID NO: 269544 - DNA, 26 bp, Artificial Sequence
  Description of Artificial Sequence: Synthetic oligonucleotide
cgctgacatgctgcgatcctacgcct

SEQ ID NO: 269545 - DNA, 26 bp, Artificial Sequence
  Description of Artificial Sequence: Synthetic oligonucleotide
gctgacatgctgcgatcctacgcctc

SEQ ID NO: 269546 - DNA, 27 bp, Artificial Sequence
  Description of Artificial Sequence: Synthetic oligonucleotide
ctgacatgctgcgatcctacgcctcct

SEQ ID NO: 269547 - DNA, 28 bp, Artificial Sequence
  Description of Artificial Sequence: Synthetic oligonucleotide
tgacatgctgcgatcctacgcctccttg

SEQ ID NO: 269548 - DNA, 27 bp, Artificial Sequence
  Description of Artificial Sequence: Synthetic oligonucleotide
gacatgctgcgatcctacgcctccttg

SEQ ID NO: 269549 - DNA, 27 bp, Artificial Sequence
  Description of Artificial Sequence: Synthetic oligonucleotide
acatgctgcgatcctacgcctccttgg

SEQ ID NO: 269550 - DNA, 26 bp, Artificial Sequence
  Description of Artificial Sequence: Synthetic oligonucleotide
catgctgcgatcctacgcctccttgg

SEQ ID NO: 269551 - DNA, 27 bp, Artificial Sequence
  Description of Artificial Sequence: Synthetic oligonucleotide
atgctgcgatcctacgcctccttggca

SEQ ID NO: 269552 - DNA, 26 bp, Artificial Sequence
  Description of Artificial Sequence: Synthetic oligonucleotide
tgctgcgatcctacgcctccttggca

SEQ ID NO: 269553 - DNA, 25 bp, Artificial Sequence
  Description of Artificial Sequence: Synthetic oligonucleotide
gctgcgatcctacgcctccttggca

SEQ ID NO: 269554 - DNA, 25 bp, Artificial Sequence
  Description of Artificial Sequence: Synthetic oligonucleotide
ctgcgatcctacgcctccttggcac

SEQ ID NO: 269555 - DNA, 27 bp, Artificial Sequence
  Description of Artificial Sequence: Synthetic oligonucleotide
tgcgatcctacgcctccttggcacgtt

SEQ ID NO: 269556 - DNA, 27 bp, Artificial Sequence
  Description of Artificial Sequence: Synthetic oligonucleotide
gcgatcctacgcctccttggcacgttt

SEQ ID NO: 269557 - DNA, 27 bp, Artificial Sequence
  Description of Artificial Sequence: Synthetic oligonucleotide
cgatcctacgcctccttggcacgtttc

SEQ ID NO: 269558 - DNA, 27 bp, Artificial Sequence
  Description of Artificial Sequence: Synthetic oligonucleotide
gatcctacgcctccttggcacgtttcc

SEQ ID NO: 269559 - DNA, 27 bp, Artificial Sequence
  Description of Artificial Sequence: Synthetic oligonucleotide
atcctacgcctccttggcacgtttccg

SEQ ID NO: 269560 - DNA, 26 bp, Artificial Sequence
  Description of Artificial Sequence: Synthetic oligonucleotide
tcctacgcctccttggcacgtttccg

SEQ ID NO: 269561 - DNA, 25 bp, Artificial Sequence
  Description of Artificial Sequence: Synthetic oligonucleotide
cctacgcctccttggcacgtttccg

SEQ ID NO: 269562 - DNA, 27 bp, Artificial Sequence
  Description of Artificial Sequence: Synthetic oligonucleotide
ctacgcctccttggcacgtttccgcta

SEQ ID NO: 269563 - DNA, 27 bp, Artificial Sequence
  Description of Artificial Sequence: Synthetic oligonucleotide
tacgcctccttggcacgtttccgctac

SEQ ID NO: 269564 - DNA, 27 bp, Artificial Sequence
  Description of Artificial Sequence: Synthetic oligonucleotide
acgcctccttggcacgtttccgctaca

SEQ ID NO: 269565 - DNA, 27 bp, Artificial Sequence
  Description of Artificial Sequence: Synthetic oligonucleotide
cgcctccttggcacgtttccgctacat

SEQ ID NO: 269566 - DNA, 27 bp, Artificial Sequence
  Description of Artificial Sequence: Synthetic oligonucleotide
gcctccttggcacgtttccgctacatc

SEQ ID NO: 269567 - DNA, 28 bp, Artificial Sequence
  Description of Artificial Sequence: Synthetic oligonucleotide
cctccttggcacgtttccgctacatctc

SEQ ID NO: 269568 - DNA, 29 bp, Artificial Sequence
  Description of Artificial Sequence: Synthetic oligonucleotide
ctccttggcacgtttccgctacatctctc

SEQ ID NO: 269569 - DNA, 29 bp, Artificial Sequence
  Description of Artificial Sequence: Synthetic oligonucleotide
tccttggcacgtttccgctacatctctcc

SEQ ID NO: 269570 - DNA, 28 bp, Artificial Sequence
  Description of Artificial Sequence: Synthetic oligonucleotide
ccttggcacgtttccgctacatctctcc

SEQ ID NO: 269571 - DNA, 28 bp, Artificial Sequence
  Description of Artificial Sequence: Synthetic oligonucleotide
cttggcacgtttccgctacatctctccc

SEQ ID NO: 269572 - DNA, 33 bp, Artificial Sequence
  Description of Artificial Sequence: Synthetic oligonucleotide
ttggcacgtttccgctacatctctcccattatg

SEQ ID NO: 269573 - DNA, 32 bp, Artificial Sequence
  Description of Artificial Sequence: Synthetic oligonucleotide
tggcacgtttccgctacatctctcccattatg

SEQ ID NO: 269574 - DNA, 31 bp, Artificial Sequence
  Description of Artificial Sequence: Synthetic oligonucleotide
ggcacgtttccgctacatctctcccattatg

SEQ ID NO: 269575 - DNA, 31 bp, Artificial Sequence
  Description of Artificial Sequence: Synthetic oligonucleotide
gcacgtttccgctacatctctcccattatgc

SEQ ID NO: 269576 - DNA, 31 bp, Artificial Sequence
  Description of Artificial Sequence: Synthetic oligonucleotide
cacgtttccgctacatctctcccattatgcg

SEQ ID NO: 269577 - DNA, 32 bp, Artificial Sequence
  Description of Artificial Sequence: Synthetic oligonucleotide
acgtttccgctacatctctcccattatgcgtg

SEQ ID NO: 269578 - DNA, 31 bp, Artificial Sequence
  Description of Artificial Sequence: Synthetic oligonucleotide
cgtttccgctacatctctcccattatgcgtg

SEQ ID NO: 269579 - DNA, 32 bp, Artificial Sequence
  Description of Artificial Sequence: Synthetic oligonucleotide
gtttccgctacatctctcccattatgcgtgtc

SEQ ID NO: 269580 - DNA, 34 bp, Artificial Sequence
  Description of Artificial Sequence: Synthetic oligonucleotide
tttccgctacatctctcccattatgcgtgtcaac

SEQ ID NO: 269581 - DNA, 33 bp, Artificial Sequence
  Description of Artificial Sequence: Synthetic oligonucleotide
ttccgctacatctctcccattatgcgtgtcaac

SEQ ID NO: 269582 - DNA, 32 bp, Artificial Sequence
  Description of Artificial Sequence: Synthetic oligonucleotide
tccgctacatctctcccattatgcgtgtcaac

SEQ ID NO: 269583 - DNA, 31 bp, Artificial Sequence
  Description of Artificial Sequence: Synthetic oligonucleotide
ccgctacatctctcccattatgcgtgtcaac

SEQ ID NO: 269584 - DNA, 33 bp, Artificial Sequence
  Description of Artificial Sequence: Synthetic oligonucleotide
cgctacatctctcccattatgcgtgtcaacaac

SEQ ID NO: 269585 - DNA, 34 bp, Artificial Sequence
  Description of Artificial Sequence: Synthetic oligonucleotide
gctacatctctcccattatgcgtgtcaacaactg

SEQ ID NO: 269586 - DNA, 36 bp, Artificial Sequence
  Description of Artificial Sequence: Synthetic oligonucleotide
ctacatctctcccattatgcgtgtcaacaactgtac

SEQ ID NO: 269587 - DNA, 36 bp, Artificial Sequence
  Description of Artificial Sequence: Synthetic oligonucleotide
tacatctctcccattatgcgtgtcaacaactgtacc

SEQ ID NO: 269588 - DNA, 35 bp, Artificial Sequence
  Description of Artificial Sequence: Synthetic oligonucleotide
acatctctcccattatgcgtgtcaacaactgtacc

SEQ ID NO: 269589 - DNA, 34 bp, Artificial Sequence
  Description of Artificial Sequence: Synthetic oligonucleotide
catctctcccattatgcgtgtcaacaactgtacc

SEQ ID NO: 269590 - DNA, 36 bp, Artificial Sequence
  Description of Artificial Sequence: Synthetic oligonucleotide
atctctcccattatgcgtgtcaacaactgtaccatg

SEQ ID NO: 269591 - DNA, 35 bp, Artificial Sequence
  Description of Artificial Sequence: Synthetic oligonucleotide
tctctcccattatgcgtgtcaacaactgtaccatg

SEQ ID NO: 269592 - DNA, 34 bp, Artificial Sequence
  Description of Artificial Sequence: Synthetic oligonucleotide
ctctcccattatgcgtgtcaacaactgtaccatg

SEQ ID NO: 269593 - DNA, 34 bp, Artificial Sequence
  Description of Artificial Sequence: Synthetic oligonucleotide
tctcccattatgcgtgtcaacaactgtaccatgc

SEQ ID NO: 269594 - DNA, 33 bp, Artificial Sequence
  Description of Artificial Sequence: Synthetic oligonucleotide
ctcccattatgcgtgtcaacaactgtaccatgc

SEQ ID NO: 269595 - DNA, 34 bp, Artificial Sequence
  Description of Artificial Sequence: Synthetic oligonucleotide
tcccattatgcgtgtcaacaactgtaccatgcag

SEQ ID NO: 269596 - DNA, 33 bp, Artificial Sequence
  Description of Artificial Sequence: Synthetic oligonucleotide
cccattatgcgtgtcaacaactgtaccatgcag

SEQ ID NO: 269597 - DNA, 33 bp, Artificial Sequence
  Description of Artificial Sequence: Synthetic oligonucleotide
ccattatgcgtgtcaacaactgtaccatgcagg

SEQ ID NO: 269598 - DNA, 33 bp, Artificial Sequence
  Description of Artificial Sequence: Synthetic oligonucleotide
cattatgcgtgtcaacaactgtaccatgcaggg

SEQ ID NO: 269599 - DNA, 34 bp, Artificial Sequence
  Description of Artificial Sequence: Synthetic oligonucleotide
attatgcgtgtcaacaactgtaccatgcagggtg

SEQ ID NO: 269600 - DNA, 33 bp, Artificial Sequence
  Description of Artificial Sequence: Synthetic oligonucleotide
ttatgcgtgtcaacaactgtaccatgcagggtg

SEQ ID NO: 269601 - DNA, 32 bp, Artificial Sequence
  Description of Artificial Sequence: Synthetic oligonucleotide
tatgcgtgtcaacaactgtaccatgcagggtg

SEQ ID NO: 269602 - DNA, 31 bp, Artificial Sequence
  Description of Artificial Sequence: Synthetic oligonucleotide
atgcgtgtcaacaactgtaccatgcagggtg

SEQ ID NO: 269603 - DNA, 30 bp, Artificial Sequence
  Description of Artificial Sequence: Synthetic oligonucleotide
tgcgtgtcaacaactgtaccatgcagggtg

SEQ ID NO: 269604 - DNA, 29 bp, Artificial Sequence
  Description of Artificial Sequence: Synthetic oligonucleotide
gcgtgtcaacaactgtaccatgcagggtg

SEQ ID NO: 269605 - DNA, 29 bp, Artificial Sequence
  Description of Artificial Sequence: Synthetic oligonucleotide
cgtgtcaacaactgtaccatgcagggtgc

SEQ ID NO: 269606 - DNA, 29 bp, Artificial Sequence
  Description of Artificial Sequence: Synthetic oligonucleotide
gtgtcaacaactgtaccatgcagggtgcc

SEQ ID NO: 269607 - DNA, 30 bp, Artificial Sequence
  Description of Artificial Sequence: Synthetic oligonucleotide
tgtcaacaactgtaccatgcagggtgcctc

SEQ ID NO: 269608 - DNA, 29 bp, Artificial Sequence
  Description of Artificial Sequence: Synthetic oligonucleotide
gtcaacaactgtaccatgcagggtgcctc

SEQ ID NO: 269609 - DNA, 30 bp, Artificial Sequence
  Description of Artificial Sequence: Synthetic oligonucleotide
tcaacaactgtaccatgcagggtgcctcag

SEQ ID NO: 269610 - DNA, 29 bp, Artificial Sequence
  Description of Artificial Sequence: Synthetic oligonucleotide
caacaactgtaccatgcagggtgcctcag

SEQ ID NO: 269611 - DNA, 29 bp, Artificial Sequence
  Description of Artificial Sequence: Synthetic oligonucleotide
aacaactgtaccatgcagggtgcctcagg

SEQ ID NO: 269612 - DNA, 28 bp, Artificial Sequence
  Description of Artificial Sequence: Synthetic oligonucleotide
acaactgtaccatgcagggtgcctcagg

SEQ ID NO: 269613 - DNA, 27 bp, Artificial Sequence
  Description of Artificial Sequence: Synthetic oligonucleotide
caactgtaccatgcagggtgcctcagg

SEQ ID NO: 269614 - DNA, 27 bp, Artificial Sequence
  Description of Artificial Sequence: Synthetic oligonucleotide
aactgtaccatgcagggtgcctcaggc

SEQ ID NO: 269615 - DNA, 26 bp, Artificial Sequence
  Description of Artificial Sequence: Synthetic oligonucleotide
actgtaccatgcagggtgcctcaggc

SEQ ID NO: 269616 - DNA, 25 bp, Artificial Sequence
  Description of Artificial Sequence: Synthetic oligonucleotide
ctgtaccatgcagggtgcctcaggc

SEQ ID NO: 269617 - DNA, 26 bp, Artificial Sequence
  Description of Artificial Sequence: Synthetic oligonucleotide
tgtaccatgcagggtgcctcaggcga

SEQ ID NO: 269618 - DNA, 25 bp, Artificial Sequence
  Description of Artificial Sequence: Synthetic oligonucleotide
gtaccatgcagggtgcctcaggcga

SEQ ID NO: 269619 - DNA, 27 bp, Artificial Sequence
  Description of Artificial Sequence: Synthetic oligonucleotide
taccatgcagggtgcctcaggcgacta

SEQ ID NO: 269620 - DNA, 26 bp, Artificial Sequence
  Description of Artificial Sequence: Synthetic oligonucleotide
accatgcagggtgcctcaggcgacta

SEQ ID NO: 269621 - DNA, 25 bp, Artificial Sequence
  Description of Artificial Sequence: Synthetic oligonucleotide
ccatgcagggtgcctcaggcgacta

SEQ ID NO: 269622 - DNA, 25 bp, Artificial Sequence
  Description of Artificial Sequence: Synthetic oligonucleotide
catgcagggtgcctcaggcgactac

SEQ ID NO: 269623 - DNA, 25 bp, Artificial Sequence
  Description of Artificial Sequence: Synthetic oligonucleotide
atgcagggtgcctcaggcgactacc

SEQ ID NO: 269624 - DNA, 24 bp, Artificial Sequence
  Description of Artificial Sequence: Synthetic oligonucleotide
tgcagggtgcctcaggcgactacc

SEQ ID NO: 269625 - DNA, 23 bp, Artificial Sequence
  Description of Artificial Sequence: Synthetic oligonucleotide
gcagggtgcctcaggcgactacc

SEQ ID NO: 269626 - DNA, 24 bp, Artificial Sequence
  Description of Artificial Sequence: Synthetic oligonucleotide
cagggtgcctcaggcgactaccct

SEQ ID NO: 269627 - DNA, 27 bp, Artificial Sequence
  Description of Artificial Sequence: Synthetic oligonucleotide
agggtgcctcaggcgactaccctgatt

SEQ ID NO: 269628 - DNA, 27 bp, Artificial Sequence
  Description of Artificial Sequence: Synthetic oligonucleotide
gggtgcctcaggcgactaccctgattt

SEQ ID NO: 269629 - DNA, 27 bp, Artificial Sequence
  Description of Artificial Sequence: Synthetic oligonucleotide
ggtgcctcaggcgactaccctgatttc

SEQ ID NO: 269630 - DNA, 27 bp, Artificial Sequence
  Description of Artificial Sequence: Synthetic oligonucleotide
gtgcctcaggcgactaccctgatttcc

SEQ ID NO: 269631 - DNA, 28 bp, Artificial Sequence
  Description of Artificial Sequence: Synthetic oligonucleotide
tgcctcaggcgactaccctgatttcctg

SEQ ID NO: 269632 - DNA, 27 bp, Artificial Sequence
  Description of Artificial Sequence: Synthetic oligonucleotide
gcctcaggcgactaccctgatttcctg

SEQ ID NO: 269633 - DNA, 32 bp, Artificial Sequence
  Description of Artificial Sequence: Synthetic oligonucleotide
cctcaggcgactaccctgatttcctgtatttg

SEQ ID NO: 269634 - DNA, 34 bp, Artificial Sequence
  Description of Artificial Sequence: Synthetic oligonucleotide
ctcaggcgactaccctgatttcctgtatttgaac

SEQ ID NO: 269635 - DNA, 34 bp, Artificial Sequence
  Description of Artificial Sequence: Synthetic oligonucleotide
tcaggcgactaccctgatttcctgtatttgaacc

SEQ ID NO: 269636 - DNA, 33 bp, Artificial Sequence
  Description of Artificial Sequence: Synthetic oligonucleotide
caggcgactaccctgatttcctgtatttgaacc

SEQ ID NO: 269637 - DNA, 35 bp, Artificial Sequence
  Description of Artificial Sequence: Synthetic oligonucleotide
aggcgactaccctgatttcctgtatttgaaccaag

SEQ ID NO: 269638 - DNA, 34 bp, Artificial Sequence
  Description of Artificial Sequence: Synthetic oligonucleotide
ggcgactaccctgatttcctgtatttgaaccaag

SEQ ID NO: 269639 - DNA, 36 bp, Artificial Sequence
  Description of Artificial Sequence: Synthetic oligonucleotide
gcgactaccctgatttcctgtatttgaaccaagttc

SEQ ID NO: 269640 - DNA, 37 bp, Artificial Sequence
  Description of Artificial Sequence: Synthetic oligonucleotide
cgactaccctgatttcctgtatttgaaccaagttctc

SEQ ID NO: 269641 - DNA, 37 bp, Artificial Sequence
  Description of Artificial Sequence: Synthetic oligonucleotide
gactaccctgatttcctgtatttgaaccaagttctcc

SEQ ID NO: 269642 - DNA, 37 bp, Artificial Sequence
  Description of Artificial Sequence: Synthetic oligonucleotide
actaccctgatttcctgtatttgaaccaagttctccg

SEQ ID NO: 269643 - DNA, 36 bp, Artificial Sequence
  Description of Artificial Sequence: Synthetic oligonucleotide
ctaccctgatttcctgtatttgaaccaagttctccg

SEQ ID NO: 269644 - DNA, 36 bp, Artificial Sequence
  Description of Artificial Sequence: Synthetic oligonucleotide
taccctgatttcctgtatttgaaccaagttctccgc

SEQ ID NO: 269645 - DNA, 35 bp, Artificial Sequence
  Description of Artificial Sequence: Synthetic oligonucleotide
accctgatttcctgtatttgaaccaagttctccgc

SEQ ID NO: 269646 - DNA, 34 bp, Artificial Sequence
  Description of Artificial Sequence: Synthetic oligonucleotide
ccctgatttcctgtatttgaaccaagttctccgc

SEQ ID NO: 269647 - DNA, 34 bp, Artificial Sequence
  Description of Artificial Sequence: Synthetic oligonucleotide
cctgatttcctgtatttgaaccaagttctccgcc

SEQ ID NO: 269648 - DNA, 35 bp, Artificial Sequence
  Description of Artificial Sequence: Synthetic oligonucleotide
ctgatttcctgtatttgaaccaagttctccgccag

SEQ ID NO: 269649 - DNA, 37 bp, Artificial Sequence
  Description of Artificial Sequence: Synthetic oligonucleotide
tgatttcctgtatttgaaccaagttctccgccagatg

SEQ ID NO: 269650 - DNA, 36 bp, Artificial Sequence
  Description of Artificial Sequence: Synthetic oligonucleotide
gatttcctgtatttgaaccaagttctccgccagatg

SEQ ID NO: 269651 - DNA, 36 bp, Artificial Sequence
  Description of Artificial Sequence: Synthetic oligonucleotide
atttcctgtatttgaaccaagttctccgccagatgg

SEQ ID NO: 269652 - DNA, 35 bp, Artificial Sequence
  Description of Artificial Sequence: Synthetic oligonucleotide
tttcctgtatttgaaccaagttctccgccagatgg

SEQ ID NO: 269653 - DNA, 34 bp, Artificial Sequence
  Description of Artificial Sequence: Synthetic oligonucleotide
ttcctgtatttgaaccaagttctccgccagatgg

SEQ ID NO: 269654 - DNA, 33 bp, Artificial Sequence
  Description of Artificial Sequence: Synthetic oligonucleotide
tcctgtatttgaaccaagttctccgccagatgg

SEQ ID NO: 269655 - DNA, 32 bp, Artificial Sequence
  Description of Artificial Sequence: Synthetic oligonucleotide
cctgtatttgaaccaagttctccgccagatgg

SEQ ID NO: 269656 - DNA, 33 bp, Artificial Sequence
  Description of Artificial Sequence: Synthetic oligonucleotide
ctgtatttgaaccaagttctccgccagatggag

SEQ ID NO: 269657 - DNA, 36 bp, Artificial Sequence
  Description of Artificial Sequence: Synthetic oligonucleotide
tgtatttgaaccaagttctccgccagatggagattg

SEQ ID NO: 269658 - DNA, 35 bp, Artificial Sequence
  Description of Artificial Sequence: Synthetic oligonucleotide
gtatttgaaccaagttctccgccagatggagattg

SEQ ID NO: 269659 - DNA, 37 bp, Artificial Sequence
  Description of Artificial Sequence: Synthetic oligonucleotide
tatttgaaccaagttctccgccagatggagattgatg

SEQ ID NO: 269660 - DNA, 36 bp, Artificial Sequence
  Description of Artificial Sequence: Synthetic oligonucleotide
atttgaaccaagttctccgccagatggagattgatg

SEQ ID NO: 269661 - DNA, 35 bp, Artificial Sequence
  Description of Artificial Sequence: Synthetic oligonucleotide
tttgaaccaagttctccgccagatggagattgatg

SEQ ID NO: 269662 - DNA, 34 bp, Artificial Sequence
  Description of Artificial Sequence: Synthetic oligonucleotide
ttgaaccaagttctccgccagatggagattgatg

SEQ ID NO: 269663 - DNA, 33 bp, Artificial Sequence
  Description of Artificial Sequence: Synthetic oligonucleotide
tgaaccaagttctccgccagatggagattgatg

SEQ ID NO: 269664 - DNA, 32 bp, Artificial Sequence
  Description of Artificial Sequence: Synthetic oligonucleotide
gaaccaagttctccgccagatggagattgatg

SEQ ID NO: 269665 - DNA, 33 bp, Artificial Sequence
  Description of Artificial Sequence: Synthetic oligonucleotide
aaccaagttctccgccagatggagattgatgac

SEQ ID NO: 269666 - DNA, 32 bp, Artificial Sequence
  Description of Artificial Sequence: Synthetic oligonucleotide
accaagttctccgccagatggagattgatgac

SEQ ID NO: 269667 - DNA, 31 bp, Artificial Sequence
  Description of Artificial Sequence: Synthetic oligonucleotide
ccaagttctccgccagatggagattgatgac

SEQ ID NO: 269668 - DNA, 31 bp, Artificial Sequence
  Description of Artificial Sequence: Synthetic oligonucleotide
caagttctccgccagatggagattgatgacg

SEQ ID NO: 269669 - DNA, 32 bp, Artificial Sequence
  Description of Artificial Sequence: Synthetic oligonucleotide
aagttctccgccagatggagattgatgacgag

SEQ ID NO: 269670 - DNA, 31 bp, Artificial Sequence
  Description of Artificial Sequence: Synthetic oligonucleotide
agttctccgccagatggagattgatgacgag

SEQ ID NO: 269671 - DNA, 30 bp, Artificial Sequence
  Description of Artificial Sequence: Synthetic oligonucleotide
gttctccgccagatggagattgatgacgag

SEQ ID NO: 269672 - DNA, 30 bp, Artificial Sequence
  Description of Artificial Sequence: Synthetic oligonucleotide
ttctccgccagatggagattgatgacgagc

SEQ ID NO: 269673 - DNA, 29 bp, Artificial Sequence
  Description of Artificial Sequence: Synthetic oligonucleotide
tctccgccagatggagattgatgacgagc

SEQ ID NO: 269674 - DNA, 28 bp, Artificial Sequence
  Description of Artificial Sequence: Synthetic oligonucleotide
ctccgccagatggagattgatgacgagc

SEQ ID NO: 269675 - DNA, 30 bp, Artificial Sequence
  Description of Artificial Sequence: Synthetic oligonucleotide
tccgccagatggagattgatgacgagcttc

SEQ ID NO: 269676 - DNA, 29 bp, Artificial Sequence
  Description of Artificial Sequence: Synthetic oligonucleotide
ccgccagatggagattgatgacgagcttc

SEQ ID NO: 269677 - DNA, 30 bp, Artificial Sequence
  Description of Artificial Sequence: Synthetic oligonucleotide
cgccagatggagattgatgacgagcttctg

SEQ ID NO: 269678 - DNA, 30 bp, Artificial Sequence
  Description of Artificial Sequence: Synthetic oligonucleotide
gccagatggagattgatgacgagcttctgc

SEQ ID NO: 269679 - DNA, 30 bp, Artificial Sequence
  Description of Artificial Sequence: Synthetic oligonucleotide
ccagatggagattgatgacgagcttctgcg

SEQ ID NO: 269680 - DNA, 31 bp, Artificial Sequence
  Description of Artificial Sequence: Synthetic oligonucleotide
cagatggagattgatgacgagcttctgcgag

SEQ ID NO: 269681 - DNA, 33 bp, Artificial Sequence
  Description of Artificial Sequence: Synthetic oligonucleotide
agatggagattgatgacgagcttctgcgagatg

SEQ ID NO: 269682 - DNA, 32 bp, Artificial Sequence
  Description of Artificial Sequence: Synthetic oligonucleotide
gatggagattgatgacgagcttctgcgagatg

SEQ ID NO: 269683 - DNA, 32 bp, Artificial Sequence
  Description of Artificial Sequence: Synthetic oligonucleotide
atggagattgatgacgagcttctgcgagatgg

SEQ ID NO: 269684 - DNA, 31 bp, Artificial Sequence
  Description of Artificial Sequence: Synthetic oligonucleotide
tggagattgatgacgagcttctgcgagatgg

SEQ ID NO: 269685 - DNA, 30 bp, Artificial Sequence
  Description of Artificial Sequence: Synthetic oligonucleotide
ggagattgatgacgagcttctgcgagatgg

SEQ ID NO: 269686 - DNA, 31 bp, Artificial Sequence
  Description of Artificial Sequence: Synthetic oligonucleotide
gagattgatgacgagcttctgcgagatggac

SEQ ID NO: 269687 - DNA, 32 bp, Artificial Sequence
  Description of Artificial Sequence: Synthetic oligonucleotide
agattgatgacgagcttctgcgagatggactc

SEQ ID NO: 269688 - DNA, 31 bp, Artificial Sequence
  Description of Artificial Sequence: Synthetic oligonucleotide
gattgatgacgagcttctgcgagatggactc

SEQ ID NO: 269689 - DNA, 32 bp, Artificial Sequence
  Description of Artificial Sequence: Synthetic oligonucleotide
attgatgacgagcttctgcgagatggactcag

SEQ ID NO: 269690 - DNA, 31 bp, Artificial Sequence
  Description of Artificial Sequence: Synthetic oligonucleotide
ttgatgacgagcttctgcgagatggactcag

SEQ ID NO: 269691 - DNA, 30 bp, Artificial Sequence
  Description of Artificial Sequence: Synthetic oligonucleotide
tgatgacgagcttctgcgagatggactcag

SEQ ID NO: 269692 - DNA, 29 bp, Artificial Sequence
  Description of Artificial Sequence: Synthetic oligonucleotide
gatgacgagcttctgcgagatggactcag

SEQ ID NO: 269693 - DNA, 29 bp, Artificial Sequence
  Description of Artificial Sequence: Synthetic oligonucleotide
atgacgagcttctgcgagatggactcagc

SEQ ID NO: 269694 - DNA, 28 bp, Artificial Sequence
  Description of Artificial Sequence: Synthetic oligonucleotide
tgacgagcttctgcgagatggactcagc

SEQ ID NO: 269695 - DNA, 27 bp, Artificial Sequence
  Description of Artificial Sequence: Synthetic oligonucleotide
gacgagcttctgcgagatggactcagc

SEQ ID NO: 269696 - DNA, 31 bp, Artificial Sequence
  Description of Artificial Sequence: Synthetic oligonucleotide
acgagcttctgcgagatggactcagctatag

SEQ ID NO: 269697 - DNA, 30 bp, Artificial Sequence
  Description of Artificial Sequence: Synthetic oligonucleotide
cgagcttctgcgagatggactcagctatag

SEQ ID NO: 269698 - DNA, 31 bp, Artificial Sequence
  Description of Artificial Sequence: Synthetic oligonucleotide
gagcttctgcgagatggactcagctatagac

SEQ ID NO: 269699 - DNA, 31 bp, Artificial Sequence
  Description of Artificial Sequence: Synthetic oligonucleotide
agcttctgcgagatggactcagctatagacc

SEQ ID NO: 269700 - DNA, 30 bp, Artificial Sequence
  Description of Artificial Sequence: Synthetic oligonucleotide
gcttctgcgagatggactcagctatagacc

SEQ ID NO: 269701 - DNA, 32 bp, Artificial Sequence
  Description of Artificial Sequence: Synthetic oligonucleotide
cttctgcgagatggactcagctatagacctag

SEQ ID NO: 269702 - DNA, 33 bp, Artificial Sequence
  Description of Artificial Sequence: Synthetic oligonucleotide
ttctgcgagatggactcagctatagacctagag

SEQ ID NO: 269703 - DNA, 32 bp, Artificial Sequence
  Description of Artificial Sequence: Synthetic oligonucleotide
tctgcgagatggactcagctatagacctagag

SEQ ID NO: 269704 - DNA, 31 bp, Artificial Sequence
  Description of Artificial Sequence: Synthetic oligonucleotide
ctgcgagatggactcagctatagacctagag

SEQ ID NO: 269705 - DNA, 31 bp, Artificial Sequence
  Description of Artificial Sequence: Synthetic oligonucleotide
tgcgagatggactcagctatagacctagagc

SEQ ID NO: 269706 - DNA, 30 bp, Artificial Sequence
  Description of Artificial Sequence: Synthetic oligonucleotide
gcgagatggactcagctatagacctagagc

SEQ ID NO: 269707 - DNA, 34 bp, Artificial Sequence
  Description of Artificial Sequence: Synthetic oligonucleotide
cgagatggactcagctatagacctagagcttttc

SEQ ID NO: 269708 - DNA, 37 bp, Artificial Sequence
  Description of Artificial Sequence: Synthetic oligonucleotide
gagatggactcagctatagacctagagcttttcattc

SEQ ID NO: 269709 - DNA, 39 bp, Artificial Sequence
  Description of Artificial Sequence: Synthetic oligonucleotide
agatggactcagctatagacctagagcttttcattcatc

SEQ ID NO: 269710 - DNA, 38 bp, Artificial Sequence
  Description of Artificial Sequence: Synthetic oligonucleotide
gatggactcagctatagacctagagcttttcattcatc

SEQ ID NO: 269711 - DNA, 38 bp, Artificial Sequence
  Description of Artificial Sequence: Synthetic oligonucleotide
atggactcagctatagacctagagcttttcattcatcg

SEQ ID NO: 269712 - DNA, 37 bp, Artificial Sequence
  Description of Artificial Sequence: Synthetic oligonucleotide
tggactcagctatagacctagagcttttcattcatcg

SEQ ID NO: 269713 - DNA, 36 bp, Artificial Sequence
  Description of Artificial Sequence: Synthetic oligonucleotide
ggactcagctatagacctagagcttttcattcatcg

SEQ ID NO: 269714 - DNA, 36 bp, Artificial Sequence
  Description of Artificial Sequence: Synthetic oligonucleotide
gactcagctatagacctagagcttttcattcatcgc

SEQ ID NO: 269715 - DNA, 37 bp, Artificial Sequence
  Description of Artificial Sequence: Synthetic oligonucleotide
actcagctatagacctagagcttttcattcatcgctg

SEQ ID NO: 269716 - DNA, 36 bp, Artificial Sequence
  Description of Artificial Sequence: Synthetic oligonucleotide
ctcagctatagacctagagcttttcattcatcgctg

SEQ ID NO: 269717 - DNA, 37 bp, Artificial Sequence
  Description of Artificial Sequence: Synthetic oligonucleotide
tcagctatagacctagagcttttcattcatcgctgac

SEQ ID NO: 269718 - DNA, 36 bp, Artificial Sequence
  Description of Artificial Sequence: Synthetic oligonucleotide
cagctatagacctagagcttttcattcatcgctgac

SEQ ID NO: 269719 - DNA, 36 bp, Artificial Sequence
  Description of Artificial Sequence: Synthetic oligonucleotide
agctatagacctagagcttttcattcatcgctgacc

SEQ ID NO: 269720 - DNA, 35 bp, Artificial Sequence
  Description of Artificial Sequence: Synthetic oligonucleotide
gctatagacctagagcttttcattcatcgctgacc

SEQ ID NO: 269721 - DNA, 36 bp, Artificial Sequence
  Description of Artificial Sequence: Synthetic oligonucleotide
ctatagacctagagcttttcattcatcgctgaccag

SEQ ID NO: 269722 - DNA, 36 bp, Artificial Sequence
  Description of Artificial Sequence: Synthetic oligonucleotide
tatagacctagagcttttcattcatcgctgaccagc

SEQ ID NO: 269723 - DNA, 35 bp, Artificial Sequence
  Description of Artificial Sequence: Synthetic oligonucleotide
atagacctagagcttttcattcatcgctgaccagc

SEQ ID NO: 269724 - DNA, 34 bp, Artificial Sequence
  Description of Artificial Sequence: Synthetic oligonucleotide
tagacctagagcttttcattcatcgctgaccagc

SEQ ID NO: 269725 - DNA, 33 bp, Artificial Sequence
  Description of Artificial Sequence: Synthetic oligonucleotide
agacctagagcttttcattcatcgctgaccagc

SEQ ID NO: 269726 - DNA, 32 bp, Artificial Sequence
  Description of Artificial Sequence: Synthetic oligonucleotide
gacctagagcttttcattcatcgctgaccagc

SEQ ID NO: 269727 - DNA, 32 bp, Artificial Sequence
  Description of Artificial Sequence: Synthetic oligonucleotide
acctagagcttttcattcatcgctgaccagcg

SEQ ID NO: 269728 - DNA, 31 bp, Artificial Sequence
  Description of Artificial Sequence: Synthetic oligonucleotide
cctagagcttttcattcatcgctgaccagcg

SEQ ID NO: 269729 - DNA, 31 bp, Artificial Sequence
  Description of Artificial Sequence: Synthetic oligonucleotide
ctagagcttttcattcatcgctgaccagcgc

SEQ ID NO: 269730 - DNA, 31 bp, Artificial Sequence
  Description of Artificial Sequence: Synthetic oligonucleotide
tagagcttttcattcatcgctgaccagcgcc

SEQ ID NO: 269731 - DNA, 30 bp, Artificial Sequence
  Description of Artificial Sequence: Synthetic oligonucleotide
agagcttttcattcatcgctgaccagcgcc

SEQ ID NO: 269732 - DNA, 29 bp, Artificial Sequence
  Description of Artificial Sequence: Synthetic oligonucleotide
gagcttttcattcatcgctgaccagcgcc

SEQ ID NO: 269733 - DNA, 31 bp, Artificial Sequence
  Description of Artificial Sequence: Synthetic oligonucleotide
agcttttcattcatcgctgaccagcgccatg

SEQ ID NO: 269734 - DNA, 30 bp, Artificial Sequence
  Description of Artificial Sequence: Synthetic oligonucleotide
gcttttcattcatcgctgaccagcgccatg

SEQ ID NO: 269735 - DNA, 32 bp, Artificial Sequence
  Description of Artificial Sequence: Synthetic oligonucleotide
cttttcattcatcgctgaccagcgccatgtac

SEQ ID NO: 269736 - DNA, 33 bp, Artificial Sequence
  Description of Artificial Sequence: Synthetic oligonucleotide
ttttcattcatcgctgaccagcgccatgtactg

SEQ ID NO: 269737 - DNA, 32 bp, Artificial Sequence
  Description of Artificial Sequence: Synthetic oligonucleotide
tttcattcatcgctgaccagcgccatgtactg

SEQ ID NO: 269738 - DNA, 31 bp, Artificial Sequence
  Description of Artificial Sequence: Synthetic oligonucleotide
ttcattcatcgctgaccagcgccatgtactg

SEQ ID NO: 269739 - DNA, 30 bp, Artificial Sequence
  Description of Artificial Sequence: Synthetic oligonucleotide
tcattcatcgctgaccagcgccatgtactg

SEQ ID NO: 269740 - DNA, 29 bp, Artificial Sequence
  Description of Artificial Sequence: Synthetic oligonucleotide
cattcatcgctgaccagcgccatgtactg

SEQ ID NO: 269741 - DNA, 29 bp, Artificial Sequence
  Description of Artificial Sequence: Synthetic oligonucleotide
attcatcgctgaccagcgccatgtactgc

SEQ ID NO: 269742 - DNA, 28 bp, Artificial Sequence
  Description of Artificial Sequence: Synthetic oligonucleotide
ttcatcgctgaccagcgccatgtactgc

SEQ ID NO: 269743 - DNA, 27 bp, Artificial Sequence
  Description of Artificial Sequence: Synthetic oligonucleotide
tcatcgctgaccagcgccatgtactgc

SEQ ID NO: 269744 - DNA, 26 bp, Artificial Sequence
  Description of Artificial Sequence: Synthetic oligonucleotide
catcgctgaccagcgccatgtactgc

SEQ ID NO: 269745 - DNA, 26 bp, Artificial Sequence
  Description of Artificial Sequence: Synthetic oligonucleotide
atcgctgaccagcgccatgtactgcc

SEQ ID NO: 269746 - DNA, 25 bp, Artificial Sequence
  Description of Artificial Sequence: Synthetic oligonucleotide
tcgctgaccagcgccatgtactgcc

SEQ ID NO: 269747 - DNA, 24 bp, Artificial Sequence
  Description of Artificial Sequence: Synthetic oligonucleotide
cgctgaccagcgccatgtactgcc

SEQ ID NO: 269748 - DNA, 24 bp, Artificial Sequence
  Description of Artificial Sequence: Synthetic oligonucleotide
gctgaccagcgccatgtactgccg

SEQ ID NO: 269749 - DNA, 24 bp, Artificial Sequence
  Description of Artificial Sequence: Synthetic oligonucleotide
ctgaccagcgccatgtactgccgg

SEQ ID NO: 269750 - DNA, 24 bp, Artificial Sequence
  Description of Artificial Sequence: Synthetic oligonucleotide
tgaccagcgccatgtactgccggc

SEQ ID NO: 269751 - DNA, 23 bp, Artificial Sequence
  Description of Artificial Sequence: Synthetic oligonucleotide
gaccagcgccatgtactgccggc

SEQ ID NO: 269752 - DNA, 23 bp, Artificial Sequence
  Description of Artificial Sequence: Synthetic oligonucleotide
accagcgccatgtactgccggcg

SEQ ID NO: 269753 - DNA, 22 bp, Artificial Sequence
  Description of Artificial Sequence: Synthetic oligonucleotide
ccagcgccatgtactgccggcg

SEQ ID NO: 269754 - DNA, 23 bp, Artificial Sequence
  Description of Artificial Sequence: Synthetic oligonucleotide
cagcgccatgtactgccggcgct

SEQ ID NO: 269755 - DNA, 23 bp, Artificial Sequence
  Description of Artificial Sequence: Synthetic oligonucleotide
agcgccatgtactgccggcgctg

SEQ ID NO: 269756 - DNA, 22 bp, Artificial Sequence
  Description of Artificial Sequence: Synthetic oligonucleotide
gcgccatgtactgccggcgctg

SEQ ID NO: 269757 - DNA, 24 bp, Artificial Sequence
  Description of Artificial Sequence: Synthetic oligonucleotide
cgccatgtactgccggcgctggaa

SEQ ID NO: 269758 - DNA, 26 bp, Artificial Sequence
  Description of Artificial Sequence: Synthetic oligonucleotide
gccatgtactgccggcgctggaagat

SEQ ID NO: 269759 - DNA, 27 bp, Artificial Sequence
  Description of Artificial Sequence: Synthetic oligonucleotide
ccatgtactgccggcgctggaagatga

SEQ ID NO: 269760 - DNA, 28 bp, Artificial Sequence
  Description of Artificial Sequence: Synthetic oligonucleotide
catgtactgccggcgctggaagatgaag

SEQ ID NO: 269761 - DNA, 28 bp, Artificial Sequence
  Description of Artificial Sequence: Synthetic oligonucleotide
atgtactgccggcgctggaagatgaagc

SEQ ID NO: 269762 - DNA, 27 bp, Artificial Sequence
  Description of Artificial Sequence: Synthetic oligonucleotide
tgtactgccggcgctggaagatgaagc

SEQ ID NO: 269763 - DNA, 26 bp, Artificial Sequence
  Description of Artificial Sequence: Synthetic oligonucleotide
gtactgccggcgctggaagatgaagc

SEQ ID NO: 269764 - DNA, 27 bp, Artificial Sequence
  Description of Artificial Sequence: Synthetic oligonucleotide
tactgccggcgctggaagatgaagcct

SEQ ID NO: 269765 - DNA, 27 bp, Artificial Sequence
  Description of Artificial Sequence: Synthetic oligonucleotide
actgccggcgctggaagatgaagcctt

SEQ ID NO: 269766 - DNA, 27 bp, Artificial Sequence
  Description of Artificial Sequence: Synthetic oligonucleotide
ctgccggcgctggaagatgaagccttt

SEQ ID NO: 269767 - DNA, 27 bp, Artificial Sequence
  Description of Artificial Sequence: Synthetic oligonucleotide
tgccggcgctggaagatgaagcctttg

SEQ ID NO: 269768 - DNA, 27 bp, Artificial Sequence
  Description of Artificial Sequence: Synthetic oligonucleotide
gccggcgctggaagatgaagcctttgt

SEQ ID NO: 269769 - DNA, 27 bp, Artificial Sequence
  Description of Artificial Sequence: Synthetic oligonucleotide
ccggcgctggaagatgaagcctttgtg

SEQ ID NO: 269770 - DNA, 27 bp, Artificial Sequence
  Description of Artificial Sequence: Synthetic oligonucleotide
cggcgctggaagatgaagcctttgtgg

SEQ ID NO: 269771 - DNA, 29 bp, Artificial Sequence
  Description of Artificial Sequence: Synthetic oligonucleotide
ggcgctggaagatgaagcctttgtggtac

SEQ ID NO: 269772 - DNA, 30 bp, Artificial Sequence
  Description of Artificial Sequence: Synthetic oligonucleotide
gcgctggaagatgaagcctttgtggtacac

SEQ ID NO: 269773 - DNA, 30 bp, Artificial Sequence
  Description of Artificial Sequence: Synthetic oligonucleotide
cgctggaagatgaagcctttgtggtacacc

SEQ ID NO: 269774 - DNA, 32 bp, Artificial Sequence
  Description of Artificial Sequence: Synthetic oligonucleotide
gctggaagatgaagcctttgtggtacaccatg

SEQ ID NO: 269775 - DNA, 32 bp, Artificial Sequence
  Description of Artificial Sequence: Synthetic oligonucleotide
ctggaagatgaagcctttgtggtacaccatgg

SEQ ID NO: 269776 - DNA, 33 bp, Artificial Sequence
  Description of Artificial Sequence: Synthetic oligonucleotide
tggaagatgaagcctttgtggtacaccatggac

SEQ ID NO: 269777 - DNA, 32 bp, Artificial Sequence
  Description of Artificial Sequence: Synthetic oligonucleotide
ggaagatgaagcctttgtggtacaccatggac

SEQ ID NO: 269778 - DNA, 34 bp, Artificial Sequence
  Description of Artificial Sequence: Synthetic oligonucleotide
gaagatgaagcctttgtggtacaccatggacatc

SEQ ID NO: 269779 - DNA, 34 bp, Artificial Sequence
  Description of Artificial Sequence: Synthetic oligonucleotide
aagatgaagcctttgtggtacaccatggacatcg

SEQ ID NO: 269780 - DNA, 33 bp, Artificial Sequence
  Description of Artificial Sequence: Synthetic oligonucleotide
agatgaagcctttgtggtacaccatggacatcg

SEQ ID NO: 269781 - DNA, 32 bp, Artificial Sequence
  Description of Artificial Sequence: Synthetic oligonucleotide
gatgaagcctttgtggtacaccatggacatcg

SEQ ID NO: 269782 - DNA, 32 bp, Artificial Sequence
  Description of Artificial Sequence: Synthetic oligonucleotide
atgaagcctttgtggtacaccatggacatcgg

SEQ ID NO: 269783 - DNA, 31 bp, Artificial Sequence
  Description of Artificial Sequence: Synthetic oligonucleotide
tgaagcctttgtggtacaccatggacatcgg

SEQ ID NO: 269784 - DNA, 30 bp, Artificial Sequence
  Description of Artificial Sequence: Synthetic oligonucleotide
gaagcctttgtggtacaccatggacatcgg

SEQ ID NO: 269785 - DNA, 31 bp, Artificial Sequence
  Description of Artificial Sequence: Synthetic oligonucleotide
aagcctttgtggtacaccatggacatcggag

SEQ ID NO: 269786 - DNA, 30 bp, Artificial Sequence
  Description of Artificial Sequence: Synthetic oligonucleotide
agcctttgtggtacaccatggacatcggag

SEQ ID NO: 269787 - DNA, 29 bp, Artificial Sequence
  Description of Artificial Sequence: Synthetic oligonucleotide
gcctttgtggtacaccatggacatcggag

SEQ ID NO: 269788 - DNA, 29 bp, Artificial Sequence
  Description of Artificial Sequence: Synthetic oligonucleotide
cctttgtggtacaccatggacatcggagg

SEQ ID NO: 269789 - DNA, 29 bp, Artificial Sequence
  Description of Artificial Sequence: Synthetic oligonucleotide
ctttgtggtacaccatggacatcggaggg

SEQ ID NO: 269790 - DNA, 32 bp, Artificial Sequence
  Description of Artificial Sequence: Synthetic oligonucleotide
tttgtggtacaccatggacatcggagggtatg

SEQ ID NO: 269791 - DNA, 31 bp, Artificial Sequence
  Description of Artificial Sequence: Synthetic oligonucleotide
ttgtggtacaccatggacatcggagggtatg

SEQ ID NO: 269792 - DNA, 30 bp, Artificial Sequence
  Description of Artificial Sequence: Synthetic oligonucleotide
tgtggtacaccatggacatcggagggtatg

SEQ ID NO: 269793 - DNA, 29 bp, Artificial Sequence
  Description of Artificial Sequence: Synthetic oligonucleotide
gtggtacaccatggacatcggagggtatg

SEQ ID NO: 269794 - DNA, 29 bp, Artificial Sequence
  Description of Artificial Sequence: Synthetic oligonucleotide
tggtacaccatggacatcggagggtatgc

SEQ ID NO: 269795 - DNA, 28 bp, Artificial Sequence
  Description of Artificial Sequence: Synthetic oligonucleotide
ggtacaccatggacatcggagggtatgc

SEQ ID NO: 269796 - DNA, 29 bp, Artificial Sequence
  Description of Artificial Sequence: Synthetic oligonucleotide
gtacaccatggacatcggagggtatgctg

SEQ ID NO: 269797 - DNA, 31 bp, Artificial Sequence
  Description of Artificial Sequence: Synthetic oligonucleotide
tacaccatggacatcggagggtatgctgatc

SEQ ID NO: 269798 - DNA, 30 bp, Artificial Sequence
  Description of Artificial Sequence: Synthetic oligonucleotide
acaccatggacatcggagggtatgctgatc

SEQ ID NO: 269799 - DNA, 29 bp, Artificial Sequence
  Description of Artificial Sequence: Synthetic oligonucleotide
caccatggacatcggagggtatgctgatc

SEQ ID NO: 269800 - DNA, 29 bp, Artificial Sequence
  Description of Artificial Sequence: Synthetic oligonucleotide
accatggacatcggagggtatgctgatcg

SEQ ID NO: 269801 - DNA, 28 bp, Artificial Sequence
  Description of Artificial Sequence: Synthetic oligonucleotide
ccatggacatcggagggtatgctgatcg

SEQ ID NO: 269802 - DNA, 29 bp, Artificial Sequence
  Description of Artificial Sequence: Synthetic oligonucleotide
catggacatcggagggtatgctgatcgag

SEQ ID NO: 269803 - DNA, 30 bp, Artificial Sequence
  Description of Artificial Sequence: Synthetic oligonucleotide
atggacatcggagggtatgctgatcgagag

SEQ ID NO: 269804 - DNA, 29 bp, Artificial Sequence
  Description of Artificial Sequence: Synthetic oligonucleotide
tggacatcggagggtatgctgatcgagag

SEQ ID NO: 269805 - DNA, 28 bp, Artificial Sequence
  Description of Artificial Sequence: Synthetic oligonucleotide
ggacatcggagggtatgctgatcgagag

SEQ ID NO: 269806 - DNA, 29 bp, Artificial Sequence
  Description of Artificial Sequence: Synthetic oligonucleotide
gacatcggagggtatgctgatcgagagag

SEQ ID NO: 269807 - DNA, 29 bp, Artificial Sequence
  Description of Artificial Sequence: Synthetic oligonucleotide
acatcggagggtatgctgatcgagagagc

SEQ ID NO: 269808 - DNA, 28 bp, Artificial Sequence
  Description of Artificial Sequence: Synthetic oligonucleotide
catcggagggtatgctgatcgagagagc

SEQ ID NO: 269809 - DNA, 30 bp, Artificial Sequence
  Description of Artificial Sequence: Synthetic oligonucleotide
atcggagggtatgctgatcgagagagctac

SEQ ID NO: 269810 - DNA, 29 bp, Artificial Sequence
  Description of Artificial Sequence: Synthetic oligonucleotide
tcggagggtatgctgatcgagagagctac

SEQ ID NO: 269811 - DNA, 28 bp, Artificial Sequence
  Description of Artificial Sequence: Synthetic oligonucleotide
cggagggtatgctgatcgagagagctac

SEQ ID NO: 269812 - DNA, 28 bp, Artificial Sequence
  Description of Artificial Sequence: Synthetic oligonucleotide
ggagggtatgctgatcgagagagctacc

SEQ ID NO: 269813 - DNA, 29 bp, Artificial Sequence
  Description of Artificial Sequence: Synthetic oligonucleotide
gagggtatgctgatcgagagagctacctc

SEQ ID NO: 269814 - DNA, 29 bp, Artificial Sequence
  Description of Artificial Sequence: Synthetic oligonucleotide
agggtatgctgatcgagagagctacctcg

SEQ ID NO: 269815 - DNA, 28 bp, Artificial Sequence
  Description of Artificial Sequence: Synthetic oligonucleotide
gggtatgctgatcgagagagctacctcg

SEQ ID NO: 269816 - DNA, 28 bp, Artificial Sequence
  Description of Artificial Sequence: Synthetic oligonucleotide
ggtatgctgatcgagagagctacctcgg

SEQ ID NO: 269817 - DNA, 32 bp, Artificial Sequence
  Description of Artificial Sequence: Synthetic oligonucleotide
gtatgctgatcgagagagctacctcggttaag

SEQ ID NO: 269818 - DNA, 33 bp, Artificial Sequence
  Description of Artificial Sequence: Synthetic oligonucleotide
tatgctgatcgagagagctacctcggttaagtg

SEQ ID NO: 269819 - DNA, 32 bp, Artificial Sequence
  Description of Artificial Sequence: Synthetic oligonucleotide
atgctgatcgagagagctacctcggttaagtg

SEQ ID NO: 269820 - DNA, 31 bp, Artificial Sequence
  Description of Artificial Sequence: Synthetic oligonucleotide
tgctgatcgagagagctacctcggttaagtg

SEQ ID NO: 269821 - DNA, 30 bp, Artificial Sequence
  Description of Artificial Sequence: Synthetic oligonucleotide
gctgatcgagagagctacctcggttaagtg

SEQ ID NO: 269822 - DNA, 30 bp, Artificial Sequence
  Description of Artificial Sequence: Synthetic oligonucleotide
ctgatcgagagagctacctcggttaagtgg

SEQ ID NO: 269823 - DNA, 31 bp, Artificial Sequence
  Description of Artificial Sequence: Synthetic oligonucleotide
tgatcgagagagctacctcggttaagtggac

SEQ ID NO: 269824 - DNA, 30 bp, Artificial Sequence
  Description of Artificial Sequence: Synthetic oligonucleotide
gatcgagagagctacctcggttaagtggac

SEQ ID NO: 269825 - DNA, 32 bp, Artificial Sequence
  Description of Artificial Sequence: Synthetic oligonucleotide
atcgagagagctacctcggttaagtggacatg

SEQ ID NO: 269826 - DNA, 31 bp, Artificial Sequence
  Description of Artificial Sequence: Synthetic oligonucleotide
tcgagagagctacctcggttaagtggacatg

SEQ ID NO: 269827 - DNA, 30 bp, Artificial Sequence
  Description of Artificial Sequence: Synthetic oligonucleotide
cgagagagctacctcggttaagtggacatg

SEQ ID NO: 269828 - DNA, 30 bp, Artificial Sequence
  Description of Artificial Sequence: Synthetic oligonucleotide
gagagagctacctcggttaagtggacatgg

SEQ ID NO: 269829 - DNA, 32 bp, Artificial Sequence
  Description of Artificial Sequence: Synthetic oligonucleotide
agagagctacctcggttaagtggacatggttg

SEQ ID NO: 269830 - DNA, 31 bp, Artificial Sequence
  Description of Artificial Sequence: Synthetic oligonucleotide
gagagctacctcggttaagtggacatggttg

SEQ ID NO: 269831 - DNA, 31 bp, Artificial Sequence
  Description of Artificial Sequence: Synthetic oligonucleotide
agagctacctcggttaagtggacatggttgg

SEQ ID NO: 269832 - DNA, 30 bp, Artificial Sequence
  Description of Artificial Sequence: Synthetic oligonucleotide
gagctacctcggttaagtggacatggttgg

SEQ ID NO: 269833 - DNA, 31 bp, Artificial Sequence
  Description of Artificial Sequence: Synthetic oligonucleotide
agctacctcggttaagtggacatggttggtg

SEQ ID NO: 269834 - DNA, 30 bp, Artificial Sequence
  Description of Artificial Sequence: Synthetic oligonucleotide
gctacctcggttaagtggacatggttggtg

SEQ ID NO: 269835 - DNA, 32 bp, Artificial Sequence
  Description of Artificial Sequence: Synthetic oligonucleotide
ctacctcggttaagtggacatggttggtgtag

SEQ ID NO: 269836 - DNA, 32 bp, Artificial Sequence
  Description of Artificial Sequence: Synthetic oligonucleotide
tacctcggttaagtggacatggttggtgtagg

SEQ ID NO: 269837 - DNA, 31 bp, Artificial Sequence
  Description of Artificial Sequence: Synthetic oligonucleotide
acctcggttaagtggacatggttggtgtagg

SEQ ID NO: 269838 - DNA, 30 bp, Artificial Sequence
  Description of Artificial Sequence: Synthetic oligonucleotide
cctcggttaagtggacatggttggtgtagg

SEQ ID NO: 269839 - DNA, 30 bp, Artificial Sequence
  Description of Artificial Sequence: Synthetic oligonucleotide
ctcggttaagtggacatggttggtgtaggc

SEQ ID NO: 269840 - DNA, 33 bp, Artificial Sequence
  Description of Artificial Sequence: Synthetic oligonucleotide
tcggttaagtggacatggttggtgtaggctatg

SEQ ID NO: 269841 - DNA, 32 bp, Artificial Sequence
  Description of Artificial Sequence: Synthetic oligonucleotide
cggttaagtggacatggttggtgtaggctatg

SEQ ID NO: 269842 - DNA, 34 bp, Artificial Sequence
  Description of Artificial Sequence: Synthetic oligonucleotide
ggttaagtggacatggttggtgtaggctatgaag

SEQ ID NO: 269843 - DNA, 34 bp, Artificial Sequence
  Description of Artificial Sequence: Synthetic oligonucleotide
gttaagtggacatggttggtgtaggctatgaagc

SEQ ID NO: 269844 - DNA, 34 bp, Artificial Sequence
  Description of Artificial Sequence: Synthetic oligonucleotide
ttaagtggacatggttggtgtaggctatgaagcg

SEQ ID NO: 269845 - DNA, 33 bp, Artificial Sequence
  Description of Artificial Sequence: Synthetic oligonucleotide
taagtggacatggttggtgtaggctatgaagcg

SEQ ID NO: 269846 - DNA, 32 bp, Artificial Sequence
  Description of Artificial Sequence: Synthetic oligonucleotide
aagtggacatggttggtgtaggctatgaagcg

SEQ ID NO: 269847 - DNA, 31 bp, Artificial Sequence
  Description of Artificial Sequence: Synthetic oligonucleotide
agtggacatggttggtgtaggctatgaagcg

SEQ ID NO: 269848 - DNA, 30 bp, Artificial Sequence
  Description of Artificial Sequence: Synthetic oligonucleotide
gtggacatggttggtgtaggctatgaagcg

SEQ ID NO: 269849 - DNA, 30 bp, Artificial Sequence
  Description of Artificial Sequence: Synthetic oligonucleotide
tggacatggttggtgtaggctatgaagcgc

SEQ ID NO: 269850 - DNA, 29 bp, Artificial Sequence
  Description of Artificial Sequence: Synthetic oligonucleotide
ggacatggttggtgtaggctatgaagcgc

SEQ ID NO: 269851 - DNA, 29 bp, Artificial Sequence
  Description of Artificial Sequence: Synthetic oligonucleotide
gacatggttggtgtaggctatgaagcgcc

SEQ ID NO: 269852 - DNA, 31 bp, Artificial Sequence
  Description of Artificial Sequence: Synthetic oligonucleotide
acatggttggtgtaggctatgaagcgccttc

SEQ ID NO: 269853 - DNA, 30 bp, Artificial Sequence
  Description of Artificial Sequence: Synthetic oligonucleotide
catggttggtgtaggctatgaagcgccttc

SEQ ID NO: 269854 - DNA, 30 bp, Artificial Sequence
  Description of Artificial Sequence: Synthetic oligonucleotide
atggttggtgtaggctatgaagcgccttcg

SEQ ID NO: 269855 - DNA, 29 bp, Artificial Sequence
  Description of Artificial Sequence: Synthetic oligonucleotide
tggttggtgtaggctatgaagcgccttcg

SEQ ID NO: 269856 - DNA, 28 bp, Artificial Sequence
  Description of Artificial Sequence: Synthetic oligonucleotide
ggttggtgtaggctatgaagcgccttcg

SEQ ID NO: 269857 - DNA, 28 bp, Artificial Sequence
  Description of Artificial Sequence: Synthetic oligonucleotide
gttggtgtaggctatgaagcgccttcgc

SEQ ID NO: 269858 - DNA, 29 bp, Artificial Sequence
  Description of Artificial Sequence: Synthetic oligonucleotide
ttggtgtaggctatgaagcgccttcgctg

SEQ ID NO: 269859 - DNA, 28 bp, Artificial Sequence
  Description of Artificial Sequence: Synthetic oligonucleotide
tggtgtaggctatgaagcgccttcgctg

SEQ ID NO: 269860 - DNA, 27 bp, Artificial Sequence
  Description of Artificial Sequence: Synthetic oligonucleotide
ggtgtaggctatgaagcgccttcgctg

SEQ ID NO: 269861 - DNA, 27 bp, Artificial Sequence
  Description of Artificial Sequence: Synthetic oligonucleotide
gtgtaggctatgaagcgccttcgctgc

SEQ ID NO: 269862 - DNA, 27 bp, Artificial Sequence
  Description of Artificial Sequence: Synthetic oligonucleotide
tgtaggctatgaagcgccttcgctgcc

SEQ ID NO: 269863 - DNA, 26 bp, Artificial Sequence
  Description of Artificial Sequence: Synthetic oligonucleotide
gtaggctatgaagcgccttcgctgcc

SEQ ID NO: 269864 - DNA, 27 bp, Artificial Sequence
  Description of Artificial Sequence: Synthetic oligonucleotide
taggctatgaagcgccttcgctgccca

SEQ ID NO: 269865 - DNA, 26 bp, Artificial Sequence
  Description of Artificial Sequence: Synthetic oligonucleotide
aggctatgaagcgccttcgctgccca

SEQ ID NO: 269866 - DNA, 25 bp, Artificial Sequence
  Description of Artificial Sequence: Synthetic oligonucleotide
ggctatgaagcgccttcgctgccca

SEQ ID NO: 269867 - DNA, 26 bp, Artificial Sequence
  Description of Artificial Sequence: Synthetic oligonucleotide
gctatgaagcgccttcgctgcccact

SEQ ID NO: 269868 - DNA, 26 bp, Artificial Sequence
  Description of Artificial Sequence: Synthetic oligonucleotide
ctatgaagcgccttcgctgcccactg

SEQ ID NO: 269869 - DNA, 27 bp, Artificial Sequence
  Description of Artificial Sequence: Synthetic oligonucleotide
tatgaagcgccttcgctgcccactggt

SEQ ID NO: 269870 - DNA, 27 bp, Artificial Sequence
  Description of Artificial Sequence: Synthetic oligonucleotide
atgaagcgccttcgctgcccactggtt

SEQ ID NO: 269871 - DNA, 27 bp, Artificial Sequence
  Description of Artificial Sequence: Synthetic oligonucleotide
tgaagcgccttcgctgcccactggttt

SEQ ID NO: 269872 - DNA, 27 bp, Artificial Sequence
  Description of Artificial Sequence: Synthetic oligonucleotide
gaagcgccttcgctgcccactggtttt

SEQ ID NO: 269873 - DNA, 27 bp, Artificial Sequence
  Description of Artificial Sequence: Synthetic oligonucleotide
aagcgccttcgctgcccactggttttg

SEQ ID NO: 269874 - DNA, 26 bp, Artificial Sequence
  Description of Artificial Sequence: Synthetic oligonucleotide
agcgccttcgctgcccactggttttg

SEQ ID NO: 269875 - DNA, 25 bp, Artificial Sequence
  Description of Artificial Sequence: Synthetic oligonucleotide
gcgccttcgctgcccactggttttg

SEQ ID NO: 269876 - DNA, 26 bp, Artificial Sequence
  Description of Artificial Sequence: Synthetic oligonucleotide
cgccttcgctgcccactggttttggt

SEQ ID NO: 269877 - DNA, 26 bp, Artificial Sequence
  Description of Artificial Sequence: Synthetic oligonucleotide
gccttcgctgcccactggttttggtg

SEQ ID NO: 269878 - DNA, 27 bp, Artificial Sequence
  Description of Artificial Sequence: Synthetic oligonucleotide
ccttcgctgcccactggttttggtgca

SEQ ID NO: 269879 - DNA, 29 bp, Artificial Sequence
  Description of Artificial Sequence: Synthetic oligonucleotide
cttcgctgcccactggttttggtgcatag

SEQ ID NO: 269880 - DNA, 31 bp, Artificial Sequence
  Description of Artificial Sequence: Synthetic oligonucleotide
ttcgctgcccactggttttggtgcatagttg

SEQ ID NO: 269881 - DNA, 30 bp, Artificial Sequence
  Description of Artificial Sequence: Synthetic oligonucleotide
tcgctgcccactggttttggtgcatagttg

SEQ ID NO: 269882 - DNA, 29 bp, Artificial Sequence
  Description of Artificial Sequence: Synthetic oligonucleotide
cgctgcccactggttttggtgcatagttg

SEQ ID NO: 269883 - DNA, 29 bp, Artificial Sequence
  Description of Artificial Sequence: Synthetic oligonucleotide
gctgcccactggttttggtgcatagttgg

SEQ ID NO: 269884 - DNA, 29 bp, Artificial Sequence
  Description of Artificial Sequence: Synthetic oligonucleotide
ctgcccactggttttggtgcatagttggc

SEQ ID NO: 269885 - DNA, 30 bp, Artificial Sequence
  Description of Artificial Sequence: Synthetic oligonucleotide
tgcccactggttttggtgcatagttggctc

SEQ ID NO: 269886 - DNA, 29 bp, Artificial Sequence
  Description of Artificial Sequence: Synthetic oligonucleotide
gcccactggttttggtgcatagttggctc

SEQ ID NO: 269887 - DNA, 30 bp, Artificial Sequence
  Description of Artificial Sequence: Synthetic oligonucleotide
cccactggttttggtgcatagttggctcag

SEQ ID NO: 269888 - DNA, 30 bp, Artificial Sequence
  Description of Artificial Sequence: Synthetic oligonucleotide
ccactggttttggtgcatagttggctcagg

SEQ ID NO: 269889 - DNA, 30 bp, Artificial Sequence
  Description of Artificial Sequence: Synthetic oligonucleotide
cactggttttggtgcatagttggctcaggc

SEQ ID NO: 269890 - DNA, 31 bp, Artificial Sequence
  Description of Artificial Sequence: Synthetic oligonucleotide
actggttttggtgcatagttggctcaggctc

SEQ ID NO: 269891 - DNA, 30 bp, Artificial Sequence
  Description of Artificial Sequence: Synthetic oligonucleotide
ctggttttggtgcatagttggctcaggctc

SEQ ID NO: 269892 - DNA, 31 bp, Artificial Sequence
  Description of Artificial Sequence: Synthetic oligonucleotide
tggttttggtgcatagttggctcaggctctg

SEQ ID NO: 269893 - DNA, 30 bp, Artificial Sequence
  Description of Artificial Sequence: Synthetic oligonucleotide
ggttttggtgcatagttggctcaggctctg

SEQ ID NO: 269894 - DNA, 30 bp, Artificial Sequence
  Description of Artificial Sequence: Synthetic oligonucleotide
gttttggtgcatagttggctcaggctctgc

SEQ ID NO: 269895 - DNA, 31 bp, Artificial Sequence
  Description of Artificial Sequence: Synthetic oligonucleotide
ttttggtgcatagttggctcaggctctgctg

SEQ ID NO: 269896 - DNA, 30 bp, Artificial Sequence
  Description of Artificial Sequence: Synthetic oligonucleotide
tttggtgcatagttggctcaggctctgctg

SEQ ID NO: 269897 - DNA, 29 bp, Artificial Sequence
  Description of Artificial Sequence: Synthetic oligonucleotide
ttggtgcatagttggctcaggctctgctg

SEQ ID NO: 269898 - DNA, 28 bp, Artificial Sequence
  Description of Artificial Sequence: Synthetic oligonucleotide
tggtgcatagttggctcaggctctgctg

SEQ ID NO: 269899 - DNA, 27 bp, Artificial Sequence
  Description of Artificial Sequence: Synthetic oligonucleotide
ggtgcatagttggctcaggctctgctg

SEQ ID NO: 269900 - DNA, 27 bp, Artificial Sequence
  Description of Artificial Sequence: Synthetic oligonucleotide
gtgcatagttggctcaggctctgctgc

SEQ ID NO: 269901 - DNA, 27 bp, Artificial Sequence
  Description of Artificial Sequence: Synthetic oligonucleotide
tgcatagttggctcaggctctgctgcc

SEQ ID NO: 269902 - DNA, 27 bp, Artificial Sequence
  Description of Artificial Sequence: Synthetic oligonucleotide
gcatagttggctcaggctctgctgcca

SEQ ID NO: 269903 - DNA, 27 bp, Artificial Sequence
  Description of Artificial Sequence: Synthetic oligonucleotide
catagttggctcaggctctgctgccag

SEQ ID NO: 269904 - DNA, 29 bp, Artificial Sequence
  Description of Artificial Sequence: Synthetic oligonucleotide
atagttggctcaggctctgctgccagaag

SEQ ID NO: 269905 - DNA, 28 bp, Artificial Sequence
  Description of Artificial Sequence: Synthetic oligonucleotide
tagttggctcaggctctgctgccagaag

SEQ ID NO: 269906 - DNA, 27 bp, Artificial Sequence
  Description of Artificial Sequence: Synthetic oligonucleotide
agttggctcaggctctgctgccagaag

SEQ ID NO: 269907 - DNA, 27 bp, Artificial Sequence
  Description of Artificial Sequence: Synthetic oligonucleotide
gttggctcaggctctgctgccagaagt

SEQ ID NO: 269908 - DNA, 28 bp, Artificial Sequence
  Description of Artificial Sequence: Synthetic oligonucleotide
ttggctcaggctctgctgccagaagttc

SEQ ID NO: 269909 - DNA, 27 bp, Artificial Sequence
  Description of Artificial Sequence: Synthetic oligonucleotide
tggctcaggctctgctgccagaagttc

SEQ ID NO: 269910 - DNA, 27 bp, Artificial Sequence
  Description of Artificial Sequence: Synthetic oligonucleotide
ggctcaggctctgctgccagaagttct

SEQ ID NO: 269911 - DNA, 27 bp, Artificial Sequence
  Description of Artificial Sequence: Synthetic oligonucleotide
gctcaggctctgctgccagaagttctc

SEQ ID NO: 269912 - DNA, 27 bp, Artificial Sequence
  Description of Artificial Sequence: Synthetic oligonucleotide
ctcaggctctgctgccagaagttctcg

SEQ ID NO: 269913 - DNA, 28 bp, Artificial Sequence
  Description of Artificial Sequence: Synthetic oligonucleotide
tcaggctctgctgccagaagttctcgag

SEQ ID NO: 269914 - DNA, 27 bp, Artificial Sequence
  Description of Artificial Sequence: Synthetic oligonucleotide
caggctctgctgccagaagttctcgag

SEQ ID NO: 269915 - DNA, 29 bp, Artificial Sequence
  Description of Artificial Sequence: Synthetic oligonucleotide
aggctctgctgccagaagttctcgagaag

SEQ ID NO: 269916 - DNA, 28 bp, Artificial Sequence
  Description of Artificial Sequence: Synthetic oligonucleotide
ggctctgctgccagaagttctcgagaag

SEQ ID NO: 269917 - DNA, 28 bp, Artificial Sequence
  Description of Artificial Sequence: Synthetic oligonucleotide
gctctgctgccagaagttctcgagaagc

SEQ ID NO: 269918 - DNA, 29 bp, Artificial Sequence
  Description of Artificial Sequence: Synthetic oligonucleotide
ctctgctgccagaagttctcgagaagcag

SEQ ID NO: 269919 - DNA, 29 bp, Artificial Sequence
  Description of Artificial Sequence: Synthetic oligonucleotide
tctgctgccagaagttctcgagaagcagg

SEQ ID NO: 269920 - DNA, 28 bp, Artificial Sequence
  Description of Artificial Sequence: Synthetic oligonucleotide
ctgctgccagaagttctcgagaagcagg

SEQ ID NO: 269921 - DNA, 28 bp, Artificial Sequence
  Description of Artificial Sequence: Synthetic oligonucleotide
tgctgccagaagttctcgagaagcaggc

SEQ ID NO: 269922 - DNA, 27 bp, Artificial Sequence
  Description of Artificial Sequence: Synthetic oligonucleotide
gctgccagaagttctcgagaagcaggc

SEQ ID NO: 269923 - DNA, 28 bp, Artificial Sequence
  Description of Artificial Sequence: Synthetic oligonucleotide
ctgccagaagttctcgagaagcaggcag

SEQ ID NO: 269924 - DNA, 29 bp, Artificial Sequence
  Description of Artificial Sequence: Synthetic oligonucleotide
tgccagaagttctcgagaagcaggcagtg

SEQ ID NO: 269925 - DNA, 28 bp, Artificial Sequence
  Description of Artificial Sequence: Synthetic oligonucleotide
gccagaagttctcgagaagcaggcagtg

SEQ ID NO: 269926 - DNA, 28 bp, Artificial Sequence
  Description of Artificial Sequence: Synthetic oligonucleotide
ccagaagttctcgagaagcaggcagtgc

SEQ ID NO: 269927 - DNA, 31 bp, Artificial Sequence
  Description of Artificial Sequence: Synthetic oligonucleotide
cagaagttctcgagaagcaggcagtgctaac

SEQ ID NO: 269928 - DNA, 31 bp, Artificial Sequence
  Description of Artificial Sequence: Synthetic oligonucleotide
agaagttctcgagaagcaggcagtgctaacc

SEQ ID NO: 269929 - DNA, 30 bp, Artificial Sequence
  Description of Artificial Sequence: Synthetic oligonucleotide
gaagttctcgagaagcaggcagtgctaacc

SEQ ID NO: 269930 - DNA, 30 bp, Artificial Sequence
  Description of Artificial Sequence: Synthetic oligonucleotide
aagttctcgagaagcaggcagtgctaaccc

SEQ ID NO: 269931 - DNA, 29 bp, Artificial Sequence
  Description of Artificial Sequence: Synthetic oligonucleotide
agttctcgagaagcaggcagtgctaaccc

SEQ ID NO: 269932 - DNA, 28 bp, Artificial Sequence
  Description of Artificial Sequence: Synthetic oligonucleotide
gttctcgagaagcaggcagtgctaaccc

SEQ ID NO: 269933 - DNA, 29 bp, Artificial Sequence
  Description of Artificial Sequence: Synthetic oligonucleotide
ttctcgagaagcaggcagtgctaacccag

SEQ ID NO: 269934 - DNA, 28 bp, Artificial Sequence
  Description of Artificial Sequence: Synthetic oligonucleotide
tctcgagaagcaggcagtgctaacccag

SEQ ID NO: 269935 - DNA, 27 bp, Artificial Sequence
  Description of Artificial Sequence: Synthetic oligonucleotide
ctcgagaagcaggcagtgctaacccag

SEQ ID NO: 269936 - DNA, 28 bp, Artificial Sequence
  Description of Artificial Sequence: Synthetic oligonucleotide
tcgagaagcaggcagtgctaacccagac

SEQ ID NO: 269937 - DNA, 27 bp, Artificial Sequence
  Description of Artificial Sequence: Synthetic oligonucleotide
cgagaagcaggcagtgctaacccagac

SEQ ID NO: 269938 - DNA, 27 bp, Artificial Sequence
  Description of Artificial Sequence: Synthetic oligonucleotide
gagaagcaggcagtgctaacccagacc

SEQ ID NO: 269939 - DNA, 27 bp, Artificial Sequence
  Description of Artificial Sequence: Synthetic oligonucleotide
agaagcaggcagtgctaacccagaccg

SEQ ID NO: 269940 - DNA, 27 bp, Artificial Sequence
  Description of Artificial Sequence: Synthetic oligonucleotide
gaagcaggcagtgctaacccagaccga

SEQ ID NO: 269941 - DNA, 27 bp, Artificial Sequence
  Description of Artificial Sequence: Synthetic oligonucleotide
aagcaggcagtgctaacccagaccgac

SEQ ID NO: 269942 - DNA, 26 bp, Artificial Sequence
  Description of Artificial Sequence: Synthetic oligonucleotide
agcaggcagtgctaacccagaccgac

SEQ ID NO: 269943 - DNA, 25 bp, Artificial Sequence
  Description of Artificial Sequence: Synthetic oligonucleotide
gcaggcagtgctaacccagaccgac

SEQ ID NO: 269944 - DNA, 25 bp, Artificial Sequence
  Description of Artificial Sequence: Synthetic oligonucleotide
caggcagtgctaacccagaccgacg

SEQ ID NO: 269945 - DNA, 25 bp, Artificial Sequence
  Description of Artificial Sequence: Synthetic oligonucleotide
aggcagtgctaacccagaccgacgc

SEQ ID NO: 269946 - DNA, 24 bp, Artificial Sequence
  Description of Artificial Sequence: Synthetic oligonucleotide
ggcagtgctaacccagaccgacgc

SEQ ID NO: 269947 - DNA, 24 bp, Artificial Sequence
  Description of Artificial Sequence: Synthetic oligonucleotide
gcagtgctaacccagaccgacgcc

SEQ ID NO: 269948 - DNA, 24 bp, Artificial Sequence
  Description of Artificial Sequence: Synthetic oligonucleotide
cagtgctaacccagaccgacgccc

SEQ ID NO: 269949 - DNA, 24 bp, Artificial Sequence
  Description of Artificial Sequence: Synthetic oligonucleotide
agtgctaacccagaccgacgcccg

SEQ ID NO: 269950 - DNA, 23 bp, Artificial Sequence
  Description of Artificial Sequence: Synthetic oligonucleotide
gtgctaacccagaccgacgcccg

SEQ ID NO: 269951 - DNA, 23 bp, Artificial Sequence
  Description of Artificial Sequence: Synthetic oligonucleotide
tgctaacccagaccgacgcccgc

SEQ ID NO: 269952 - DNA, 22 bp, Artificial Sequence
  Description of Artificial Sequence: Synthetic oligonucleotide
gctaacccagaccgacgcccgc

SEQ ID NO: 269953 - DNA, 23 bp, Artificial Sequence
  Description of Artificial Sequence: Synthetic oligonucleotide
ctaacccagaccgacgcccgcga

SEQ ID NO: 269954 - DNA, 26 bp, Artificial Sequence
  Description of Artificial Sequence: Synthetic oligonucleotide
taacccagaccgacgcccgcgacata

SEQ ID NO: 269955 - DNA, 25 bp, Artificial Sequence
  Description of Artificial Sequence: Synthetic oligonucleotide
aacccagaccgacgcccgcgacata

SEQ ID NO: 269956 - DNA, 24 bp, Artificial Sequence
  Description of Artificial Sequence: Synthetic oligonucleotide
acccagaccgacgcccgcgacata

SEQ ID NO: 269957 - DNA, 23 bp, Artificial Sequence
  Description of Artificial Sequence: Synthetic oligonucleotide
cccagaccgacgcccgcgacata

SEQ ID NO: 269958 - DNA, 25 bp, Artificial Sequence
  Description of Artificial Sequence: Synthetic oligonucleotide
ccagaccgacgcccgcgacatagta

SEQ ID NO: 269959 - DNA, 27 bp, Artificial Sequence
  Description of Artificial Sequence: Synthetic oligonucleotide
cagaccgacgcccgcgacatagtagaa

SEQ ID NO: 269960 - DNA, 27 bp, Artificial Sequence
  Description of Artificial Sequence: Synthetic oligonucleotide
agaccgacgcccgcgacatagtagaac

SEQ ID NO: 269961 - DNA, 26 bp, Artificial Sequence
  Description of Artificial Sequence: Synthetic oligonucleotide
gaccgacgcccgcgacatagtagaac

SEQ ID NO: 269962 - DNA, 26 bp, Artificial Sequence
  Description of Artificial Sequence: Synthetic oligonucleotide
accgacgcccgcgacatagtagaacc

SEQ ID NO: 269963 - DNA, 25 bp, Artificial Sequence
  Description of Artificial Sequence: Synthetic oligonucleotide
ccgacgcccgcgacatagtagaacc

SEQ ID NO: 269964 - DNA, 26 bp, Artificial Sequence
  Description of Artificial Sequence: Synthetic oligonucleotide
cgacgcccgcgacatagtagaaccct

SEQ ID NO: 269965 - DNA, 26 bp, Artificial Sequence
  Description of Artificial Sequence: Synthetic oligonucleotide
gacgcccgcgacatagtagaaccctg

SEQ ID NO: 269966 - DNA, 27 bp, Artificial Sequence
  Description of Artificial Sequence: Synthetic oligonucleotide
acgcccgcgacatagtagaaccctgca

SEQ ID NO: 269967 - DNA, 27 bp, Artificial Sequence
  Description of Artificial Sequence: Synthetic oligonucleotide
cgcccgcgacatagtagaaccctgcat

SEQ ID NO: 269968 - DNA, 27 bp, Artificial Sequence
  Description of Artificial Sequence: Synthetic oligonucleotide
gcccgcgacatagtagaaccctgcatg

SEQ ID NO: 269969 - DNA, 27 bp, Artificial Sequence
  Description of Artificial Sequence: Synthetic oligonucleotide
cccgcgacatagtagaaccctgcatgc

SEQ ID NO: 269970 - DNA, 27 bp, Artificial Sequence
  Description of Artificial Sequence: Synthetic oligonucleotide
ccgcgacatagtagaaccctgcatgcg

SEQ ID NO: 269971 - DNA, 28 bp, Artificial Sequence
  Description of Artificial Sequence: Synthetic oligonucleotide
cgcgacatagtagaaccctgcatgcgtg

SEQ ID NO: 269972 - DNA, 29 bp, Artificial Sequence
  Description of Artificial Sequence: Synthetic oligonucleotide
gcgacatagtagaaccctgcatgcgtgtg

SEQ ID NO: 269973 - DNA, 29 bp, Artificial Sequence
  Description of Artificial Sequence: Synthetic oligonucleotide
cgacatagtagaaccctgcatgcgtgtgc

SEQ ID NO: 269974 - DNA, 30 bp, Artificial Sequence
  Description of Artificial Sequence: Synthetic oligonucleotide
gacatagtagaaccctgcatgcgtgtgctg

SEQ ID NO: 269975 - DNA, 32 bp, Artificial Sequence
  Description of Artificial Sequence: Synthetic oligonucleotide
acatagtagaaccctgcatgcgtgtgctgtac

SEQ ID NO: 269976 - DNA, 31 bp, Artificial Sequence
  Description of Artificial Sequence: Synthetic oligonucleotide
catagtagaaccctgcatgcgtgtgctgtac

SEQ ID NO: 269977 - DNA, 33 bp, Artificial Sequence
  Description of Artificial Sequence: Synthetic oligonucleotide
atagtagaaccctgcatgcgtgtgctgtacaac

SEQ ID NO: 269978 - DNA, 32 bp, Artificial Sequence
  Description of Artificial Sequence: Synthetic oligonucleotide
tagtagaaccctgcatgcgtgtgctgtacaac

SEQ ID NO: 269979 - DNA, 31 bp, Artificial Sequence
  Description of Artificial Sequence: Synthetic oligonucleotide
agtagaaccctgcatgcgtgtgctgtacaac

SEQ ID NO: 269980 - DNA, 30 bp, Artificial Sequence
  Description of Artificial Sequence: Synthetic oligonucleotide
gtagaaccctgcatgcgtgtgctgtacaac

SEQ ID NO: 269981 - DNA, 30 bp, Artificial Sequence
  Description of Artificial Sequence: Synthetic oligonucleotide
tagaaccctgcatgcgtgtgctgtacaacc

SEQ ID NO: 269982 - DNA, 29 bp, Artificial Sequence
  Description of Artificial Sequence: Synthetic oligonucleotide
agaaccctgcatgcgtgtgctgtacaacc

SEQ ID NO: 269983 - DNA, 28 bp, Artificial Sequence
  Description of Artificial Sequence: Synthetic oligonucleotide
gaaccctgcatgcgtgtgctgtacaacc

SEQ ID NO: 269984 - DNA, 28 bp, Artificial Sequence
  Description of Artificial Sequence: Synthetic oligonucleotide
aaccctgcatgcgtgtgctgtacaaccg

SEQ ID NO: 269985 - DNA, 27 bp, Artificial Sequence
  Description of Artificial Sequence: Synthetic oligonucleotide
accctgcatgcgtgtgctgtacaaccg

SEQ ID NO: 269986 - DNA, 27 bp, Artificial Sequence
  Description of Artificial Sequence: Synthetic oligonucleotide
ccctgcatgcgtgtgctgtacaaccga

SEQ ID NO: 269987 - DNA, 27 bp, Artificial Sequence
  Description of Artificial Sequence: Synthetic oligonucleotide
cctgcatgcgtgtgctgtacaaccgag

SEQ ID NO: 269988 - DNA, 29 bp, Artificial Sequence
  Description of Artificial Sequence: Synthetic oligonucleotide
ctgcatgcgtgtgctgtacaaccgagatg

SEQ ID NO: 269989 - DNA, 29 bp, Artificial Sequence
  Description of Artificial Sequence: Synthetic oligonucleotide
tgcatgcgtgtgctgtacaaccgagatgg

SEQ ID NO: 269990 - DNA, 28 bp, Artificial Sequence
  Description of Artificial Sequence: Synthetic oligonucleotide
gcatgcgtgtgctgtacaaccgagatgg

SEQ ID NO: 269991 - DNA, 28 bp, Artificial Sequence
  Description of Artificial Sequence: Synthetic oligonucleotide
catgcgtgtgctgtacaaccgagatggc

SEQ ID NO: 269992 - DNA, 28 bp, Artificial Sequence
  Description of Artificial Sequence: Synthetic oligonucleotide
atgcgtgtgctgtacaaccgagatggcc

SEQ ID NO: 269993 - DNA, 27 bp, Artificial Sequence
  Description of Artificial Sequence: Synthetic oligonucleotide
tgcgtgtgctgtacaaccgagatggcc

SEQ ID NO: 269994 - DNA, 26 bp, Artificial Sequence
  Description of Artificial Sequence: Synthetic oligonucleotide
gcgtgtgctgtacaaccgagatggcc

SEQ ID NO: 269995 - DNA, 27 bp, Artificial Sequence
  Description of Artificial Sequence: Synthetic oligonucleotide
cgtgtgctgtacaaccgagatggccgt

SEQ ID NO: 269996 - DNA, 28 bp, Artificial Sequence
  Description of Artificial Sequence: Synthetic oligonucleotide
gtgtgctgtacaaccgagatggccgttc

SEQ ID NO: 269997 - DNA, 31 bp, Artificial Sequence
  Description of Artificial Sequence: Synthetic oligonucleotide
tgtgctgtacaaccgagatggccgttcttag

SEQ ID NO: 269998 - DNA, 30 bp, Artificial Sequence
  Description of Artificial Sequence: Synthetic oligonucleotide
gtgctgtacaaccgagatggccgttcttag

SEQ ID NO: 269999 - DNA, 32 bp, Artificial Sequence
  Description of Artificial Sequence: Synthetic oligonucleotide
tgctgtacaaccgagatggccgttcttagaac

SEQ ID NO: 270000 - DNA, 31 bp, Artificial Sequence
  Description of Artificial Sequence: Synthetic oligonucleotide
gctgtacaaccgagatggccgttcttagaac

SEQ ID NO: 270001 - DNA, 31 bp, Artificial Sequence
  Description of Artificial Sequence: Synthetic oligonucleotide
ctgtacaaccgagatggccgttcttagaacc

SEQ ID NO: 270002 - DNA, 31 bp, Artificial Sequence
  Description of Artificial Sequence: Synthetic oligonucleotide
tgtacaaccgagatggccgttcttagaaccg

SEQ ID NO: 270003 - DNA, 30 bp, Artificial Sequence
  Description of Artificial Sequence: Synthetic oligonucleotide
gtacaaccgagatggccgttcttagaaccg

SEQ ID NO: 270004 - DNA, 30 bp, Artificial Sequence
  Description of Artificial Sequence: Synthetic oligonucleotide
tacaaccgagatggccgttcttagaaccgg

SEQ ID NO: 270005 - DNA, 29 bp, Artificial Sequence
  Description of Artificial Sequence: Synthetic oligonucleotide
acaaccgagatggccgttcttagaaccgg

SEQ ID NO: 270006 - DNA, 28 bp, Artificial Sequence
  Description of Artificial Sequence: Synthetic oligonucleotide
caaccgagatggccgttcttagaaccgg

SEQ ID NO: 270007 - DNA, 31 bp, Artificial Sequence
  Description of Artificial Sequence: Synthetic oligonucleotide
aaccgagatggccgttcttagaaccggtttg

SEQ ID NO: 270008 - DNA, 30 bp, Artificial Sequence
  Description of Artificial Sequence: Synthetic oligonucleotide
accgagatggccgttcttagaaccggtttg

SEQ ID NO: 270009 - DNA, 29 bp, Artificial Sequence
  Description of Artificial Sequence: Synthetic oligonucleotide
ccgagatggccgttcttagaaccggtttg

SEQ ID NO: 270010 - DNA, 33 bp, Artificial Sequence
  Description of Artificial Sequence: Synthetic oligonucleotide
cgagatggccgttcttagaaccggtttgaaatc

SEQ ID NO: 270011 - DNA, 33 bp, Artificial Sequence
  Description of Artificial Sequence: Synthetic oligonucleotide
gagatggccgttcttagaaccggtttgaaatcg

SEQ ID NO: 270012 - DNA, 33 bp, Artificial Sequence
  Description of Artificial Sequence: Synthetic oligonucleotide
agatggccgttcttagaaccggtttgaaatcgc

SEQ ID NO: 270013 - DNA, 32 bp, Artificial Sequence
  Description of Artificial Sequence: Synthetic oligonucleotide
gatggccgttcttagaaccggtttgaaatcgc

SEQ ID NO: 270014 - DNA, 32 bp, Artificial Sequence
  Description of Artificial Sequence: Synthetic oligonucleotide
atggccgttcttagaaccggtttgaaatcgcc

SEQ ID NO: 270015 - DNA, 31 bp, Artificial Sequence
  Description of Artificial Sequence: Synthetic oligonucleotide
tggccgttcttagaaccggtttgaaatcgcc

SEQ ID NO: 270016 - DNA, 30 bp, Artificial Sequence
  Description of Artificial Sequence: Synthetic oligonucleotide
ggccgttcttagaaccggtttgaaatcgcc

SEQ ID NO: 270017 - DNA, 31 bp, Artificial Sequence
  Description of Artificial Sequence: Synthetic oligonucleotide
gccgttcttagaaccggtttgaaatcgccag

SEQ ID NO: 270018 - DNA, 32 bp, Artificial Sequence
  Description of Artificial Sequence: Synthetic oligonucleotide
ccgttcttagaaccggtttgaaatcgccagtg

SEQ ID NO: 270019 - DNA, 33 bp, Artificial Sequence
  Description of Artificial Sequence: Synthetic oligonucleotide
cgttcttagaaccggtttgaaatcgccagtgtc

SEQ ID NO: 270020 - DNA, 34 bp, Artificial Sequence
  Description of Artificial Sequence: Synthetic oligonucleotide
gttcttagaaccggtttgaaatcgccagtgtcac

SEQ ID NO: 270021 - DNA, 34 bp, Artificial Sequence
  Description of Artificial Sequence: Synthetic oligonucleotide
ttcttagaaccggtttgaaatcgccagtgtcacc

SEQ ID NO: 270022 - DNA, 33 bp, Artificial Sequence
  Description of Artificial Sequence: Synthetic oligonucleotide
tcttagaaccggtttgaaatcgccagtgtcacc

SEQ ID NO: 270023 - DNA, 32 bp, Artificial Sequence
  Description of Artificial Sequence: Synthetic oligonucleotide
cttagaaccggtttgaaatcgccagtgtcacc

SEQ ID NO: 270024 - DNA, 32 bp, Artificial Sequence
  Description of Artificial Sequence: Synthetic oligonucleotide
ttagaaccggtttgaaatcgccagtgtcaccg

SEQ ID NO: 270025 - DNA, 31 bp, Artificial Sequence
  Description of Artificial Sequence: Synthetic oligonucleotide
tagaaccggtttgaaatcgccagtgtcaccg

SEQ ID NO: 270026 - DNA, 30 bp, Artificial Sequence
  Description of Artificial Sequence: Synthetic oligonucleotide
agaaccggtttgaaatcgccagtgtcaccg

SEQ ID NO: 270027 - DNA, 29 bp, Artificial Sequence
  Description of Artificial Sequence: Synthetic oligonucleotide
gaaccggtttgaaatcgccagtgtcaccg

SEQ ID NO: 270028 - DNA, 34 bp, Artificial Sequence
  Description of Artificial Sequence: Synthetic oligonucleotide
aaccggtttgaaatcgccagtgtcaccgataaag

SEQ ID NO: 270029 - DNA, 33 bp, Artificial Sequence
  Description of Artificial Sequence: Synthetic oligonucleotide
accggtttgaaatcgccagtgtcaccgataaag

SEQ ID NO: 270030 - DNA, 32 bp, Artificial Sequence
  Description of Artificial Sequence: Synthetic oligonucleotide
ccggtttgaaatcgccagtgtcaccgataaag

SEQ ID NO: 270031 - DNA, 32 bp, Artificial Sequence
  Description of Artificial Sequence: Synthetic oligonucleotide
cggtttgaaatcgccagtgtcaccgataaagg

SEQ ID NO: 270032 - DNA, 33 bp, Artificial Sequence
  Description of Artificial Sequence: Synthetic oligonucleotide
ggtttgaaatcgccagtgtcaccgataaaggtg

SEQ ID NO: 270033 - DNA, 35 bp, Artificial Sequence
  Description of Artificial Sequence: Synthetic oligonucleotide
gtttgaaatcgccagtgtcaccgataaaggtgttc

SEQ ID NO: 270034 - DNA, 40 bp, Artificial Sequence
  Description of Artificial Sequence: Synthetic oligonucleotide
tttgaaatcgccagtgtcaccgataaaggtgttcaaatag

SEQ ID NO: 270035 - DNA, 39 bp, Artificial Sequence
  Description of Artificial Sequence: Synthetic oligonucleotide
ttgaaatcgccagtgtcaccgataaaggtgttcaaatag

SEQ ID NO: 270036 - DNA, 38 bp, Artificial Sequence
  Description of Artificial Sequence: Synthetic oligonucleotide
tgaaatcgccagtgtcaccgataaaggtgttcaaatag

SEQ ID NO: 270037 - DNA, 37 bp, Artificial Sequence
  Description of Artificial Sequence: Synthetic oligonucleotide
gaaatcgccagtgtcaccgataaaggtgttcaaatag

SEQ ID NO: 270038 - DNA, 38 bp, Artificial Sequence
  Description of Artificial Sequence: Synthetic oligonucleotide
aaatcgccagtgtcaccgataaaggtgttcaaatagag

SEQ ID NO: 270039 - DNA, 37 bp, Artificial Sequence
  Description of Artificial Sequence: Synthetic oligonucleotide
aatcgccagtgtcaccgataaaggtgttcaaatagag

SEQ ID NO: 270040 - DNA, 36 bp, Artificial Sequence
  Description of Artificial Sequence: Synthetic oligonucleotide
atcgccagtgtcaccgataaaggtgttcaaatagag

SEQ ID NO: 270041 - DNA, 35 bp, Artificial Sequence
  Description of Artificial Sequence: Synthetic oligonucleotide
tcgccagtgtcaccgataaaggtgttcaaatagag

SEQ ID NO: 270042 - DNA, 34 bp, Artificial Sequence
  Description of Artificial Sequence: Synthetic oligonucleotide
cgccagtgtcaccgataaaggtgttcaaatagag

SEQ ID NO: 270043 - DNA, 34 bp, Artificial Sequence
  Description of Artificial Sequence: Synthetic oligonucleotide
gccagtgtcaccgataaaggtgttcaaatagagg

SEQ ID NO: 270044 - DNA, 34 bp, Artificial Sequence
  Description of Artificial Sequence: Synthetic oligonucleotide
ccagtgtcaccgataaaggtgttcaaatagaggc

SEQ ID NO: 270045 - DNA, 35 bp, Artificial Sequence
  Description of Artificial Sequence: Synthetic oligonucleotide
cagtgtcaccgataaaggtgttcaaatagaggcac

SEQ ID NO: 270046 - DNA, 35 bp, Artificial Sequence
  Description of Artificial Sequence: Synthetic oligonucleotide
agtgtcaccgataaaggtgttcaaatagaggcacc

SEQ ID NO: 270047 - DNA, 34 bp, Artificial Sequence
  Description of Artificial Sequence: Synthetic oligonucleotide
gtgtcaccgataaaggtgttcaaatagaggcacc

SEQ ID NO: 270048 - DNA, 37 bp, Artificial Sequence
  Description of Artificial Sequence: Synthetic oligonucleotide
tgtcaccgataaaggtgttcaaatagaggcaccattg

SEQ ID NO: 270049 - DNA, 36 bp, Artificial Sequence
  Description of Artificial Sequence: Synthetic oligonucleotide
gtcaccgataaaggtgttcaaatagaggcaccattg

SEQ ID NO: 270050 - DNA, 37 bp, Artificial Sequence
  Description of Artificial Sequence: Synthetic oligonucleotide
tcaccgataaaggtgttcaaatagaggcaccattgtc

SEQ ID NO: 270051 - DNA, 36 bp, Artificial Sequence
  Description of Artificial Sequence: Synthetic oligonucleotide
caccgataaaggtgttcaaatagaggcaccattgtc

SEQ ID NO: 270052 - DNA, 38 bp, Artificial Sequence
  Description of Artificial Sequence: Synthetic oligonucleotide
accgataaaggtgttcaaatagaggcaccattgtcaac

SEQ ID NO: 270053 - DNA, 37 bp, Artificial Sequence
  Description of Artificial Sequence: Synthetic oligonucleotide
ccgataaaggtgttcaaatagaggcaccattgtcaac

SEQ ID NO: 270054 - DNA, 38 bp, Artificial Sequence
  Description of Artificial Sequence: Synthetic oligonucleotide
cgataaaggtgttcaaatagaggcaccattgtcaacag

SEQ ID NO: 270055 - DNA, 39 bp, Artificial Sequence
  Description of Artificial Sequence: Synthetic oligonucleotide
gataaaggtgttcaaatagaggcaccattgtcaacagag

SEQ ID NO: 270056 - DNA, 40 bp, Artificial Sequence
  Description of Artificial Sequence: Synthetic oligonucleotide
ataaaggtgttcaaatagaggcaccattgtcaacagagac

SEQ ID NO: 270057 - DNA, 39 bp, Artificial Sequence
  Description of Artificial Sequence: Synthetic oligonucleotide
taaaggtgttcaaatagaggcaccattgtcaacagagac

SEQ ID NO: 270058 - DNA, 38 bp, Artificial Sequence
  Description of Artificial Sequence: Synthetic oligonucleotide
aaaggtgttcaaatagaggcaccattgtcaacagagac

SEQ ID NO: 270059 - DNA, 37 bp, Artificial Sequence
  Description of Artificial Sequence: Synthetic oligonucleotide
aaggtgttcaaatagaggcaccattgtcaacagagac

SEQ ID NO: 270060 - DNA, 36 bp, Artificial Sequence
  Description of Artificial Sequence: Synthetic oligonucleotide
aggtgttcaaatagaggcaccattgtcaacagagac

SEQ ID NO: 270061 - DNA, 35 bp, Artificial Sequence
  Description of Artificial Sequence: Synthetic oligonucleotide
ggtgttcaaatagaggcaccattgtcaacagagac

SEQ ID NO: 270062 - DNA, 35 bp, Artificial Sequence
  Description of Artificial Sequence: Synthetic oligonucleotide
gtgttcaaatagaggcaccattgtcaacagagacc

SEQ ID NO: 270063 - DNA, 37 bp, Artificial Sequence
  Description of Artificial Sequence: Synthetic oligonucleotide
tgttcaaatagaggcaccattgtcaacagagacctac

SEQ ID NO: 270064 - DNA, 36 bp, Artificial Sequence
  Description of Artificial Sequence: Synthetic oligonucleotide
gttcaaatagaggcaccattgtcaacagagacctac

SEQ ID NO: 270065 - DNA, 37 bp, Artificial Sequence
  Description of Artificial Sequence: Synthetic oligonucleotide
ttcaaatagaggcaccattgtcaacagagacctactg

SEQ ID NO: 270066 - DNA, 36 bp, Artificial Sequence
  Description of Artificial Sequence: Synthetic oligonucleotide
tcaaatagaggcaccattgtcaacagagacctactg

SEQ ID NO: 270067 - DNA, 35 bp, Artificial Sequence
  Description of Artificial Sequence: Synthetic oligonucleotide
caaatagaggcaccattgtcaacagagacctactg

SEQ ID NO: 270068 - DNA, 35 bp, Artificial Sequence
  Description of Artificial Sequence: Synthetic oligonucleotide
aaatagaggcaccattgtcaacagagacctactgg

SEQ ID NO: 270069 - DNA, 34 bp, Artificial Sequence
  Description of Artificial Sequence: Synthetic oligonucleotide
aatagaggcaccattgtcaacagagacctactgg

SEQ ID NO: 270070 - DNA, 33 bp, Artificial Sequence
  Description of Artificial Sequence: Synthetic oligonucleotide
atagaggcaccattgtcaacagagacctactgg

SEQ ID NO: 270071 - DNA, 32 bp, Artificial Sequence
  Description of Artificial Sequence: Synthetic oligonucleotide
tagaggcaccattgtcaacagagacctactgg

SEQ ID NO: 270072 - DNA, 31 bp, Artificial Sequence
  Description of Artificial Sequence: Synthetic oligonucleotide
agaggcaccattgtcaacagagacctactgg

SEQ ID NO: 270073 - DNA, 30 bp, Artificial Sequence
  Description of Artificial Sequence: Synthetic oligonucleotide
gaggcaccattgtcaacagagacctactgg

SEQ ID NO: 270074 - DNA, 30 bp, Artificial Sequence
  Description of Artificial Sequence: Synthetic oligonucleotide
aggcaccattgtcaacagagacctactggg

SEQ ID NO: 270075 - DNA, 29 bp, Artificial Sequence
  Description of Artificial Sequence: Synthetic oligonucleotide
ggcaccattgtcaacagagacctactggg

SEQ ID NO: 270076 - DNA, 34 bp, Artificial Sequence
  Description of Artificial Sequence: Synthetic oligonucleotide
gcaccattgtcaacagagacctactgggataatg

SEQ ID NO: 270077 - DNA, 34 bp, Artificial Sequence
  Description of Artificial Sequence: Synthetic oligonucleotide
caccattgtcaacagagacctactgggataatgc

SEQ ID NO: 270078 - DNA, 34 bp, Artificial Sequence
  Description of Artificial Sequence: Synthetic oligonucleotide
accattgtcaacagagacctactgggataatgcc

SEQ ID NO: 270079 - DNA, 33 bp, Artificial Sequence
  Description of Artificial Sequence: Synthetic oligonucleotide
ccattgtcaacagagacctactgggataatgcc

SEQ ID NO: 270080 - DNA, 33 bp, Artificial Sequence
  Description of Artificial Sequence: Synthetic oligonucleotide
cattgtcaacagagacctactgggataatgccc

SEQ ID NO: 270081 - DNA, 34 bp, Artificial Sequence
  Description of Artificial Sequence: Synthetic oligonucleotide
attgtcaacagagacctactgggataatgcccac

SEQ ID NO: 270082 - DNA, 33 bp, Artificial Sequence
  Description of Artificial Sequence: Synthetic oligonucleotide
ttgtcaacagagacctactgggataatgcccac

SEQ ID NO: 270083 - DNA, 32 bp, Artificial Sequence
  Description of Artificial Sequence: Synthetic oligonucleotide
tgtcaacagagacctactgggataatgcccac

SEQ ID NO: 270084 - DNA, 31 bp, Artificial Sequence
  Description of Artificial Sequence: Synthetic oligonucleotide
gtcaacagagacctactgggataatgcccac

SEQ ID NO: 270085 - DNA, 33 bp, Artificial Sequence
  Description of Artificial Sequence: Synthetic oligonucleotide
tcaacagagacctactgggataatgcccacatc

SEQ ID NO: 270086 - DNA, 32 bp, Artificial Sequence
  Description of Artificial Sequence: Synthetic oligonucleotide
caacagagacctactgggataatgcccacatc

SEQ ID NO: 270087 - DNA, 34 bp, Artificial Sequence
  Description of Artificial Sequence: Synthetic oligonucleotide
aacagagacctactgggataatgcccacatcatc

SEQ ID NO: 270088 - DNA, 33 bp, Artificial Sequence
  Description of Artificial Sequence: Synthetic oligonucleotide
acagagacctactgggataatgcccacatcatc

SEQ ID NO: 270089 - DNA, 32 bp, Artificial Sequence
  Description of Artificial Sequence: Synthetic oligonucleotide
cagagacctactgggataatgcccacatcatc

SEQ ID NO: 270090 - DNA, 33 bp, Artificial Sequence
  Description of Artificial Sequence: Synthetic oligonucleotide
agagacctactgggataatgcccacatcatcag

SEQ ID NO: 270091 - DNA, 32 bp, Artificial Sequence
  Description of Artificial Sequence: Synthetic oligonucleotide
gagacctactgggataatgcccacatcatcag

SEQ ID NO: 270092 - DNA, 33 bp, Artificial Sequence
  Description of Artificial Sequence: Synthetic oligonucleotide
agacctactgggataatgcccacatcatcagtg

SEQ ID NO: 270093 - DNA, 32 bp, Artificial Sequence
  Description of Artificial Sequence: Synthetic oligonucleotide
gacctactgggataatgcccacatcatcagtg

SEQ ID NO: 270094 - DNA, 32 bp, Artificial Sequence
  Description of Artificial Sequence: Synthetic oligonucleotide
acctactgggataatgcccacatcatcagtgg

SEQ ID NO: 270095 - DNA, 31 bp, Artificial Sequence
  Description of Artificial Sequence: Synthetic oligonucleotide
cctactgggataatgcccacatcatcagtgg

SEQ ID NO: 270096 - DNA, 31 bp, Artificial Sequence
  Description of Artificial Sequence: Synthetic oligonucleotide
ctactgggataatgcccacatcatcagtggc

SEQ ID NO: 270097 - DNA, 34 bp, Artificial Sequence
  Description of Artificial Sequence: Synthetic oligonucleotide
tactgggataatgcccacatcatcagtggcattg

SEQ ID NO: 270098 - DNA, 33 bp, Artificial Sequence
  Description of Artificial Sequence: Synthetic oligonucleotide
actgggataatgcccacatcatcagtggcattg

SEQ ID NO: 270099 - DNA, 32 bp, Artificial Sequence
  Description of Artificial Sequence: Synthetic oligonucleotide
ctgggataatgcccacatcatcagtggcattg

SEQ ID NO: 270100 - DNA, 35 bp, Artificial Sequence
  Description of Artificial Sequence: Synthetic oligonucleotide
tgggataatgcccacatcatcagtggcattgaatg

SEQ ID NO: 270101 - DNA, 34 bp, Artificial Sequence
  Description of Artificial Sequence: Synthetic oligonucleotide
gggataatgcccacatcatcagtggcattgaatg

SEQ ID NO: 270102 - DNA, 27 bp, Artificial Sequence
  Description of Artificial Sequence: Synthetic oligonucleotide
atggcccttgccagcctgttggagaca

SEQ ID NO: 270103 - DNA, 26 bp, Artificial Sequence
  Description of Artificial Sequence: Synthetic oligonucleotide
tggcccttgccagcctgttggagaca

SEQ ID NO: 270104 - DNA, 25 bp, Artificial Sequence
  Description of Artificial Sequence: Synthetic oligonucleotide
ggcccttgccagcctgttggagaca

SEQ ID NO: 270105 - DNA, 25 bp, Artificial Sequence
  Description of Artificial Sequence: Synthetic oligonucleotide
gcccttgccagcctgttggagacac

SEQ ID NO: 270106 - DNA, 25 bp, Artificial Sequence
  Description of Artificial Sequence: Synthetic oligonucleotide
cccttgccagcctgttggagacacc

SEQ ID NO: 270107 - DNA, 25 bp, Artificial Sequence
  Description of Artificial Sequence: Synthetic oligonucleotide
ccttgccagcctgttggagacaccg

SEQ ID NO: 270108 - DNA, 27 bp, Artificial Sequence
  Description of Artificial Sequence: Synthetic oligonucleotide
cttgccagcctgttggagacaccgcta

SEQ ID NO: 270109 - DNA, 27 bp, Artificial Sequence
  Description of Artificial Sequence: Synthetic oligonucleotide
ttgccagcctgttggagacaccgctac

SEQ ID NO: 270110 - DNA, 26 bp, Artificial Sequence
  Description of Artificial Sequence: Synthetic oligonucleotide
tgccagcctgttggagacaccgctac

SEQ ID NO: 270111 - DNA, 25 bp, Artificial Sequence
  Description of Artificial Sequence: Synthetic oligonucleotide
gccagcctgttggagacaccgctac

SEQ ID NO: 270112 - DNA, 25 bp, Artificial Sequence
  Description of Artificial Sequence: Synthetic oligonucleotide
ccagcctgttggagacaccgctacg

SEQ ID NO: 270113 - DNA, 25 bp, Artificial Sequence
  Description of Artificial Sequence: Synthetic oligonucleotide
cagcctgttggagacaccgctacgg

SEQ ID NO: 270114 - DNA, 26 bp, Artificial Sequence
  Description of Artificial Sequence: Synthetic oligonucleotide
agcctgttggagacaccgctacgggt

SEQ ID NO: 270115 - DNA, 25 bp, Artificial Sequence
  Description of Artificial Sequence: Synthetic oligonucleotide
gcctgttggagacaccgctacgggt

SEQ ID NO: 270116 - DNA, 27 bp, Artificial Sequence
  Description of Artificial Sequence: Synthetic oligonucleotide
cctgttggagacaccgctacgggtgaa

SEQ ID NO: 270117 - DNA, 27 bp, Artificial Sequence
  Description of Artificial Sequence: Synthetic oligonucleotide
ctgttggagacaccgctacgggtgaac

SEQ ID NO: 270118 - DNA, 27 bp, Artificial Sequence
  Description of Artificial Sequence: Synthetic oligonucleotide
tgttggagacaccgctacgggtgaacc

SEQ ID NO: 270119 - DNA, 27 bp, Artificial Sequence
  Description of Artificial Sequence: Synthetic oligonucleotide
gttggagacaccgctacgggtgaacca

SEQ ID NO: 270120 - DNA, 27 bp, Artificial Sequence
  Description of Artificial Sequence: Synthetic oligonucleotide
ttggagacaccgctacgggtgaaccag

SEQ ID NO: 270121 - DNA, 26 bp, Artificial Sequence
  Description of Artificial Sequence: Synthetic oligonucleotide
tggagacaccgctacgggtgaaccag

SEQ ID NO: 270122 - DNA, 25 bp, Artificial Sequence
  Description of Artificial Sequence: Synthetic oligonucleotide
ggagacaccgctacgggtgaaccag

SEQ ID NO: 270123 - DNA, 25 bp, Artificial Sequence
  Description of Artificial Sequence: Synthetic oligonucleotide
gagacaccgctacgggtgaaccagg

SEQ ID NO: 270124 - DNA, 25 bp, Artificial Sequence
  Description of Artificial Sequence: Synthetic oligonucleotide
agacaccgctacgggtgaaccaggg

SEQ ID NO: 270125 - DNA, 24 bp, Artificial Sequence
  Description of Artificial Sequence: Synthetic oligonucleotide
gacaccgctacgggtgaaccaggg

SEQ ID NO: 270126 - DNA, 24 bp, Artificial Sequence
  Description of Artificial Sequence: Synthetic oligonucleotide
acaccgctacgggtgaaccagggc

SEQ ID NO: 270127 - DNA, 23 bp, Artificial Sequence
  Description of Artificial Sequence: Synthetic oligonucleotide
caccgctacgggtgaaccagggc

SEQ ID NO: 270128 - DNA, 23 bp, Artificial Sequence
  Description of Artificial Sequence: Synthetic oligonucleotide
accgctacgggtgaaccagggcg

SEQ ID NO: 270129 - DNA, 22 bp, Artificial Sequence
  Description of Artificial Sequence: Synthetic oligonucleotide
ccgctacgggtgaaccagggcg

SEQ ID NO: 270130 - DNA, 22 bp, Artificial Sequence
  Description of Artificial Sequence: Synthetic oligonucleotide
cgctacgggtgaaccagggcgg

SEQ ID NO: 270131 - DNA, 27 bp, Artificial Sequence
  Description of Artificial Sequence: Synthetic oligonucleotide
gctacgggtgaaccagggcgggtttta

SEQ ID NO: 270132 - DNA, 27 bp, Artificial Sequence
  Description of Artificial Sequence: Synthetic oligonucleotide
ctacgggtgaaccagggcgggttttac

SEQ ID NO: 270133 - DNA, 27 bp, Artificial Sequence
  Description of Artificial Sequence: Synthetic oligonucleotide
tacgggtgaaccagggcgggttttacg

SEQ ID NO: 270134 - DNA, 26 bp, Artificial Sequence
  Description of Artificial Sequence: Synthetic oligonucleotide
acgggtgaaccagggcgggttttacg

SEQ ID NO: 270135 - DNA, 25 bp, Artificial Sequence
  Description of Artificial Sequence: Synthetic oligonucleotide
cgggtgaaccagggcgggttttacg

SEQ ID NO: 270136 - DNA, 26 bp, Artificial Sequence
  Description of Artificial Sequence: Synthetic oligonucleotide
gggtgaaccagggcgggttttacgga

SEQ ID NO: 270137 - DNA, 27 bp, Artificial Sequence
  Description of Artificial Sequence: Synthetic oligonucleotide
ggtgaaccagggcgggttttacggact

SEQ ID NO: 270138 - DNA, 28 bp, Artificial Sequence
  Description of Artificial Sequence: Synthetic oligonucleotide
gtgaaccagggcgggttttacggacttg

SEQ ID NO: 270139 - DNA, 28 bp, Artificial Sequence
  Description of Artificial Sequence: Synthetic oligonucleotide
tgaaccagggcgggttttacggacttgg

SEQ ID NO: 270140 - DNA, 27 bp, Artificial Sequence
  Description of Artificial Sequence: Synthetic oligonucleotide
gaaccagggcgggttttacggacttgg

SEQ ID NO: 270141 - DNA, 27 bp, Artificial Sequence
  Description of Artificial Sequence: Synthetic oligonucleotide
aaccagggcgggttttacggacttggc

SEQ ID NO: 270142 - DNA, 26 bp, Artificial Sequence
  Description of Artificial Sequence: Synthetic oligonucleotide
accagggcgggttttacggacttggc

SEQ ID NO: 270143 - DNA, 25 bp, Artificial Sequence
  Description of Artificial Sequence: Synthetic oligonucleotide
ccagggcgggttttacggacttggc

SEQ ID NO: 270144 - DNA, 25 bp, Artificial Sequence
  Description of Artificial Sequence: Synthetic oligonucleotide
cagggcgggttttacggacttggcg

SEQ ID NO: 270145 - DNA, 26 bp, Artificial Sequence
  Description of Artificial Sequence: Synthetic oligonucleotide
agggcgggttttacggacttggcggt

SEQ ID NO: 270146 - DNA, 25 bp, Artificial Sequence
  Description of Artificial Sequence: Synthetic oligonucleotide
gggcgggttttacggacttggcggt

SEQ ID NO: 270147 - DNA, 25 bp, Artificial Sequence
  Description of Artificial Sequence: Synthetic oligonucleotide
ggcgggttttacggacttggcggtc

SEQ ID NO: 270148 - DNA, 26 bp, Artificial Sequence
  Description of Artificial Sequence: Synthetic oligonucleotide
gcgggttttacggacttggcggtcgt

SEQ ID NO: 270149 - DNA, 26 bp, Artificial Sequence
  Description of Artificial Sequence: Synthetic oligonucleotide
cgggttttacggacttggcggtcgtg

SEQ ID NO: 270150 - DNA, 27 bp, Artificial Sequence
  Description of Artificial Sequence: Synthetic oligonucleotide
gggttttacggacttggcggtcgtgca

SEQ ID NO: 270151 - DNA, 27 bp, Artificial Sequence
  Description of Artificial Sequence: Synthetic oligonucleotide
ggttttacggacttggcggtcgtgcac

SEQ ID NO: 270152 - DNA, 29 bp, Artificial Sequence
  Description of Artificial Sequence: Synthetic oligonucleotide
gttttacggacttggcggtcgtgcacatc

SEQ ID NO: 270153 - DNA, 30 bp, Artificial Sequence
  Description of Artificial Sequence: Synthetic oligonucleotide
ttttacggacttggcggtcgtgcacatctg

SEQ ID NO: 270154 - DNA, 29 bp, Artificial Sequence
  Description of Artificial Sequence: Synthetic oligonucleotide
tttacggacttggcggtcgtgcacatctg

SEQ ID NO: 270155 - DNA, 28 bp, Artificial Sequence
  Description of Artificial Sequence: Synthetic oligonucleotide
ttacggacttggcggtcgtgcacatctg

SEQ ID NO: 270156 - DNA, 27 bp, Artificial Sequence
  Description of Artificial Sequence: Synthetic oligonucleotide
tacggacttggcggtcgtgcacatctg

SEQ ID NO: 270157 - DNA, 26 bp, Artificial Sequence
  Description of Artificial Sequence: Synthetic oligonucleotide
acggacttggcggtcgtgcacatctg

SEQ ID NO: 270158 - DNA, 25 bp, Artificial Sequence
  Description of Artificial Sequence: Synthetic oligonucleotide
cggacttggcggtcgtgcacatctg

SEQ ID NO: 270159 - DNA, 26 bp, Artificial Sequence
  Description of Artificial Sequence: Synthetic oligonucleotide
ggacttggcggtcgtgcacatctgct

SEQ ID NO: 270160 - DNA, 26 bp, Artificial Sequence
  Description of Artificial Sequence: Synthetic oligonucleotide
gacttggcggtcgtgcacatctgctg

SEQ ID NO: 270161 - DNA, 27 bp, Artificial Sequence
  Description of Artificial Sequence: Synthetic oligonucleotide
acttggcggtcgtgcacatctgctggt

SEQ ID NO: 270162 - DNA, 27 bp, Artificial Sequence
  Description of Artificial Sequence: Synthetic oligonucleotide
cttggcggtcgtgcacatctgctggtt

SEQ ID NO: 270163 - DNA, 27 bp, Artificial Sequence
  Description of Artificial Sequence: Synthetic oligonucleotide
ttggcggtcgtgcacatctgctggttc

SEQ ID NO: 270164 - DNA, 27 bp, Artificial Sequence
  Description of Artificial Sequence: Synthetic oligonucleotide
tggcggtcgtgcacatctgctggttct

SEQ ID NO: 270165 - DNA, 27 bp, Artificial Sequence
  Description of Artificial Sequence: Synthetic oligonucleotide
ggcggtcgtgcacatctgctggttcta

SEQ ID NO: 270166 - DNA, 27 bp, Artificial Sequence
  Description of Artificial Sequence: Synthetic oligonucleotide
gcggtcgtgcacatctgctggttctag

SEQ ID NO: 270167 - DNA, 27 bp, Artificial Sequence
  Description of Artificial Sequence: Synthetic oligonucleotide
cggtcgtgcacatctgctggttctagg

SEQ ID NO: 270168 - DNA, 28 bp, Artificial Sequence
  Description of Artificial Sequence: Synthetic oligonucleotide
ggtcgtgcacatctgctggttctaggtc

SEQ ID NO: 270169 - DNA, 28 bp, Artificial Sequence
  Description of Artificial Sequence: Synthetic oligonucleotide
gtcgtgcacatctgctggttctaggtcc

SEQ ID NO: 270170 - DNA, 29 bp, Artificial Sequence
  Description of Artificial Sequence: Synthetic oligonucleotide
tcgtgcacatctgctggttctaggtcctg

SEQ ID NO: 270171 - DNA, 28 bp, Artificial Sequence
  Description of Artificial Sequence: Synthetic oligonucleotide
cgtgcacatctgctggttctaggtcctg

SEQ ID NO: 270172 - DNA, 28 bp, Artificial Sequence
  Description of Artificial Sequence: Synthetic oligonucleotide
gtgcacatctgctggttctaggtcctgg

SEQ ID NO: 270173 - DNA, 28 bp, Artificial Sequence
  Description of Artificial Sequence: Synthetic oligonucleotide
tgcacatctgctggttctaggtcctggg

SEQ ID NO: 270174 - DNA, 27 bp, Artificial Sequence
  Description of Artificial Sequence: Synthetic oligonucleotide
gcacatctgctggttctaggtcctggg

SEQ ID NO: 270175 - DNA, 28 bp, Artificial Sequence
  Description of Artificial Sequence: Synthetic oligonucleotide
cacatctgctggttctaggtcctgggag

SEQ ID NO: 270176 - DNA, 29 bp, Artificial Sequence
  Description of Artificial Sequence: Synthetic oligonucleotide
acatctgctggttctaggtcctgggagtc

SEQ ID NO: 270177 - DNA, 28 bp, Artificial Sequence
  Description of Artificial Sequence: Synthetic oligonucleotide
catctgctggttctaggtcctgggagtc

SEQ ID NO: 270178 - DNA, 29 bp, Artificial Sequence
  Description of Artificial Sequence: Synthetic oligonucleotide
atctgctggttctaggtcctgggagtctc

SEQ ID NO: 270179 - DNA, 28 bp, Artificial Sequence
  Description of Artificial Sequence: Synthetic oligonucleotide
tctgctggttctaggtcctgggagtctc

SEQ ID NO: 270180 - DNA, 27 bp, Artificial Sequence
  Description of Artificial Sequence: Synthetic oligonucleotide
ctgctggttctaggtcctgggagtctc

SEQ ID NO: 270181 - DNA, 28 bp, Artificial Sequence
  Description of Artificial Sequence: Synthetic oligonucleotide
tgctggttctaggtcctgggagtctctg

SEQ ID NO: 270182 - DNA, 27 bp, Artificial Sequence
  Description of Artificial Sequence: Synthetic oligonucleotide
gctggttctaggtcctgggagtctctg

SEQ ID NO: 270183 - DNA, 28 bp, Artificial Sequence
  Description of Artificial Sequence: Synthetic oligonucleotide
ctggttctaggtcctgggagtctctgtg

SEQ ID NO: 270184 - DNA, 30 bp, Artificial Sequence
  Description of Artificial Sequence: Synthetic oligonucleotide
tggttctaggtcctgggagtctctgtgatg

SEQ ID NO: 270185 - DNA, 29 bp, Artificial Sequence
  Description of Artificial Sequence: Synthetic oligonucleotide
ggttctaggtcctgggagtctctgtgatg

SEQ ID NO: 270186 - DNA, 29 bp, Artificial Sequence
  Description of Artificial Sequence: Synthetic oligonucleotide
gttctaggtcctgggagtctctgtgatgg

SEQ ID NO: 270187 - DNA, 30 bp, Artificial Sequence
  Description of Artificial Sequence: Synthetic oligonucleotide
ttctaggtcctgggagtctctgtgatggtc

SEQ ID NO: 270188 - DNA, 29 bp, Artificial Sequence
  Description of Artificial Sequence: Synthetic oligonucleotide
tctaggtcctgggagtctctgtgatggtc

SEQ ID NO: 270189 - DNA, 28 bp, Artificial Sequence
  Description of Artificial Sequence: Synthetic oligonucleotide
ctaggtcctgggagtctctgtgatggtc

SEQ ID NO: 270190 - DNA, 29 bp, Artificial Sequence
  Description of Artificial Sequence: Synthetic oligonucleotide
taggtcctgggagtctctgtgatggtcag

SEQ ID NO: 270191 - DNA, 28 bp, Artificial Sequence
  Description of Artificial Sequence: Synthetic oligonucleotide
aggtcctgggagtctctgtgatggtcag

SEQ ID NO: 270192 - DNA, 27 bp, Artificial Sequence
  Description of Artificial Sequence: Synthetic oligonucleotide
ggtcctgggagtctctgtgatggtcag

SEQ ID NO: 270193 - DNA, 28 bp, Artificial Sequence
  Description of Artificial Sequence: Synthetic oligonucleotide
gtcctgggagtctctgtgatggtcagag

SEQ ID NO: 270194 - DNA, 28 bp, Artificial Sequence
  Description of Artificial Sequence: Synthetic oligonucleotide
tcctgggagtctctgtgatggtcagagc

SEQ ID NO: 270195 - DNA, 27 bp, Artificial Sequence
  Description of Artificial Sequence: Synthetic oligonucleotide
cctgggagtctctgtgatggtcagagc

SEQ ID NO: 270196 - DNA, 27 bp, Artificial Sequence
  Description of Artificial Sequence: Synthetic oligonucleotide
ctgggagtctctgtgatggtcagagcc

SEQ ID NO: 270197 - DNA, 28 bp, Artificial Sequence
  Description of Artificial Sequence: Synthetic oligonucleotide
tgggagtctctgtgatggtcagagcctg

SEQ ID NO: 270198 - DNA, 27 bp, Artificial Sequence
  Description of Artificial Sequence: Synthetic oligonucleotide
gggagtctctgtgatggtcagagcctg

SEQ ID NO: 270199 - DNA, 27 bp, Artificial Sequence
  Description of Artificial Sequence: Synthetic oligonucleotide
ggagtctctgtgatggtcagagcctgg

SEQ ID NO: 270200 - DNA, 27 bp, Artificial Sequence
  Description of Artificial Sequence: Synthetic oligonucleotide
gagtctctgtgatggtcagagcctggc

SEQ ID NO: 270201 - DNA, 27 bp, Artificial Sequence
  Description of Artificial Sequence: Synthetic oligonucleotide
agtctctgtgatggtcagagcctggcg

SEQ ID NO: 270202 - DNA, 26 bp, Artificial Sequence
  Description of Artificial Sequence: Synthetic oligonucleotide
gtctctgtgatggtcagagcctggcg

SEQ ID NO: 270203 - DNA, 26 bp, Artificial Sequence
  Description of Artificial Sequence: Synthetic oligonucleotide
tctctgtgatggtcagagcctggcgg

SEQ ID NO: 270204 - DNA, 25 bp, Artificial Sequence
  Description of Artificial Sequence: Synthetic oligonucleotide
ctctgtgatggtcagagcctggcgg

SEQ ID NO: 270205 - DNA, 25 bp, Artificial Sequence
  Description of Artificial Sequence: Synthetic oligonucleotide
tctgtgatggtcagagcctggcggc

SEQ ID NO: 270206 - DNA, 24 bp, Artificial Sequence
  Description of Artificial Sequence: Synthetic oligonucleotide
ctgtgatggtcagagcctggcggc

SEQ ID NO: 270207 - DNA, 24 bp, Artificial Sequence
  Description of Artificial Sequence: Synthetic oligonucleotide
tgtgatggtcagagcctggcggcg

SEQ ID NO: 270208 - DNA, 23 bp, Artificial Sequence
  Description of Artificial Sequence: Synthetic oligonucleotide
gtgatggtcagagcctggcggcg

SEQ ID NO: 270209 - DNA, 23 bp, Artificial Sequence
  Description of Artificial Sequence: Synthetic oligonucleotide
tgatggtcagagcctggcggcgc

SEQ ID NO: 270210 - DNA, 22 bp, Artificial Sequence
  Description of Artificial Sequence: Synthetic oligonucleotide
gatggtcagagcctggcggcgc

SEQ ID NO: 270211 - DNA, 23 bp, Artificial Sequence
  Description of Artificial Sequence: Synthetic oligonucleotide
atggtcagagcctggcggcgcca

SEQ ID NO: 270212 - DNA, 22 bp, Artificial Sequence
  Description of Artificial Sequence: Synthetic oligonucleotide
tggtcagagcctggcggcgcca

SEQ ID NO: 270213 - DNA, 21 bp, Artificial Sequence
  Description of Artificial Sequence: Synthetic oligonucleotide
ggtcagagcctggcggcgcca

SEQ ID NO: 270214 - DNA, 21 bp, Artificial Sequence
  Description of Artificial Sequence: Synthetic oligonucleotide
gtcagagcctggcggcgccag

SEQ ID NO: 270215 - DNA, 21 bp, Artificial Sequence
  Description of Artificial Sequence: Synthetic oligonucleotide
tcagagcctggcggcgccagg

SEQ ID NO: 270216 - DNA, 20 bp, Artificial Sequence
  Description of Artificial Sequence: Synthetic oligonucleotide
cagagcctggcggcgccagg

SEQ ID NO: 270217 - DNA, 21 bp, Artificial Sequence
  Description of Artificial Sequence: Synthetic oligonucleotide
agagcctggcggcgccaggca

SEQ ID NO: 270218 - DNA, 20 bp, Artificial Sequence
  Description of Artificial Sequence: Synthetic oligonucleotide
gagcctggcggcgccaggca

SEQ ID NO: 270219 - DNA, 20 bp, Artificial Sequence
  Description of Artificial Sequence: Synthetic oligonucleotide
agcctggcggcgccaggcag

SEQ ID NO: 270220 - DNA, 20 bp, Artificial Sequence
  Description of Artificial Sequence: Synthetic oligonucleotide
gcctggcggcgccaggcagt

SEQ ID NO: 270221 - DNA, 20 bp, Artificial Sequence
  Description of Artificial Sequence: Synthetic oligonucleotide
cctggcggcgccaggcaggt

SEQ ID NO: 270222 - DNA, 20 bp, Artificial Sequence
  Description of Artificial Sequence: Synthetic oligonucleotide
ctggcggcgccaggcagggt

SEQ ID NO: 270223 - DNA, 20 bp, Artificial Sequence
  Description of Artificial Sequence: Synthetic oligonucleotide
tggcggcgccaggcaggggt

SEQ ID NO: 270224 - DNA, 20 bp, Artificial Sequence
  Description of Artificial Sequence: Synthetic oligonucleotide
ggcggcgccaggcaggggtt

SEQ ID NO: 270225 - DNA, 20 bp, Artificial Sequence
  Description of Artificial Sequence: Synthetic oligonucleotide
gcggcgccaggcaggggtgt

SEQ ID NO: 270226 - DNA, 20 bp, Artificial Sequence
  Description of Artificial Sequence: Synthetic oligonucleotide
cggcgccaggcaggggtgtc

SEQ ID NO: 270227 - DNA, 20 bp, Artificial Sequence
  Description of Artificial Sequence: Synthetic oligonucleotide
ggcgccaggcaggggtgtcc

SEQ ID NO: 270228 - DNA, 21 bp, Artificial Sequence
  Description of Artificial Sequence: Synthetic oligonucleotide
gcgccaggcaggggtgtccga

SEQ ID NO: 270229 - DNA, 23 bp, Artificial Sequence
  Description of Artificial Sequence: Synthetic oligonucleotide
cgccaggcaggggtgtccgagaa

SEQ ID NO: 270230 - DNA, 24 bp, Artificial Sequence
  Description of Artificial Sequence: Synthetic oligonucleotide
gccaggcaggggtgtccgagaaga

SEQ ID NO: 270231 - DNA, 24 bp, Artificial Sequence
  Description of Artificial Sequence: Synthetic oligonucleotide
ccaggcaggggtgtccgagaagag

SEQ ID NO: 270232 - DNA, 24 bp, Artificial Sequence
  Description of Artificial Sequence: Synthetic oligonucleotide
caggcaggggtgtccgagaagagc

SEQ ID NO: 270233 - DNA, 25 bp, Artificial Sequence
  Description of Artificial Sequence: Synthetic oligonucleotide
aggcaggggtgtccgagaagagcct

SEQ ID NO: 270234 - DNA, 24 bp, Artificial Sequence
  Description of Artificial Sequence: Synthetic oligonucleotide
ggcaggggtgtccgagaagagcct

SEQ ID NO: 270235 - DNA, 24 bp, Artificial Sequence
  Description of Artificial Sequence: Synthetic oligonucleotide
gcaggggtgtccgagaagagcctg

SEQ ID NO: 270236 - DNA, 27 bp, Artificial Sequence
  Description of Artificial Sequence: Synthetic oligonucleotide
caggggtgtccgagaagagcctggaat

SEQ ID NO: 270237 - DNA, 27 bp, Artificial Sequence
  Description of Artificial Sequence: Synthetic oligonucleotide
aggggtgtccgagaagagcctggaatc

SEQ ID NO: 270238 - DNA, 26 bp, Artificial Sequence
  Description of Artificial Sequence: Synthetic oligonucleotide
ggggtgtccgagaagagcctggaatc

SEQ ID NO: 270239 - DNA, 27 bp, Artificial Sequence
  Description of Artificial Sequence: Synthetic oligonucleotide
gggtgtccgagaagagcctggaatcga

SEQ ID NO: 270240 - DNA, 30 bp, Artificial Sequence
  Description of Artificial Sequence: Synthetic oligonucleotide
ggtgtccgagaagagcctggaatcgaattg

SEQ ID NO: 270241 - DNA, 30 bp, Artificial Sequence
  Description of Artificial Sequence: Synthetic oligonucleotide
gtgtccgagaagagcctggaatcgaattgc

SEQ ID NO: 270242 - DNA, 32 bp, Artificial Sequence
  Description of Artificial Sequence: Synthetic oligonucleotide
tgtccgagaagagcctggaatcgaattgcttc

SEQ ID NO: 270243 - DNA, 31 bp, Artificial Sequence
  Description of Artificial Sequence: Synthetic oligonucleotide
gtccgagaagagcctggaatcgaattgcttc

SEQ ID NO: 270244 - DNA, 33 bp, Artificial Sequence
  Description of Artificial Sequence: Synthetic oligonucleotide
tccgagaagagcctggaatcgaattgcttcatg

SEQ ID NO: 270245 - DNA, 32 bp, Artificial Sequence
  Description of Artificial Sequence: Synthetic oligonucleotide
ccgagaagagcctggaatcgaattgcttcatg

SEQ ID NO: 270246 - DNA, 32 bp, Artificial Sequence
  Description of Artificial Sequence: Synthetic oligonucleotide
cgagaagagcctggaatcgaattgcttcatgc

SEQ ID NO: 270247 - DNA, 34 bp, Artificial Sequence
  Description of Artificial Sequence: Synthetic oligonucleotide
gagaagagcctggaatcgaattgcttcatgcaac

SEQ ID NO: 270248 - DNA, 36 bp, Artificial Sequence
  Description of Artificial Sequence: Synthetic oligonucleotide
agaagagcctggaatcgaattgcttcatgcaacaac

SEQ ID NO: 270249 - DNA, 35 bp, Artificial Sequence
  Description of Artificial Sequence: Synthetic oligonucleotide
gaagagcctggaatcgaattgcttcatgcaacaac

SEQ ID NO: 270250 - DNA, 35 bp, Artificial Sequence
  Description of Artificial Sequence: Synthetic oligonucleotide
aagagcctggaatcgaattgcttcatgcaacaacc

SEQ ID NO: 270251 - DNA, 34 bp, Artificial Sequence
  Description of Artificial Sequence: Synthetic oligonucleotide
agagcctggaatcgaattgcttcatgcaacaacc

SEQ ID NO: 270252 - DNA, 33 bp, Artificial Sequence
  Description of Artificial Sequence: Synthetic oligonucleotide
gagcctggaatcgaattgcttcatgcaacaacc

SEQ ID NO: 270253 - DNA, 34 bp, Artificial Sequence
  Description of Artificial Sequence: Synthetic oligonucleotide
agcctggaatcgaattgcttcatgcaacaaccac

SEQ ID NO: 270254 - DNA, 33 bp, Artificial Sequence
  Description of Artificial Sequence: Synthetic oligonucleotide
gcctggaatcgaattgcttcatgcaacaaccac

SEQ ID NO: 270255 - DNA, 33 bp, Artificial Sequence
  Description of Artificial Sequence: Synthetic oligonucleotide
cctggaatcgaattgcttcatgcaacaaccacg

SEQ ID NO: 270256 - DNA, 33 bp, Artificial Sequence
  Description of Artificial Sequence: Synthetic oligonucleotide
ctggaatcgaattgcttcatgcaacaaccacgc

SEQ ID NO: 270257 - DNA, 34 bp, Artificial Sequence
  Description of Artificial Sequence: Synthetic oligonucleotide
tggaatcgaattgcttcatgcaacaaccacgctg

SEQ ID NO: 270258 - DNA, 33 bp, Artificial Sequence
  Description of Artificial Sequence: Synthetic oligonucleotide
ggaatcgaattgcttcatgcaacaaccacgctg

SEQ ID NO: 270259 - DNA, 33 bp, Artificial Sequence
  Description of Artificial Sequence: Synthetic oligonucleotide
gaatcgaattgcttcatgcaacaaccacgctgg

SEQ ID NO: 270260 - DNA, 33 bp, Artificial Sequence
  Description of Artificial Sequence: Synthetic oligonucleotide
aatcgaattgcttcatgcaacaaccacgctggc

SEQ ID NO: 270261 - DNA, 32 bp, Artificial Sequence
  Description of Artificial Sequence: Synthetic oligonucleotide
atcgaattgcttcatgcaacaaccacgctggc

SEQ ID NO: 270262 - DNA, 31 bp, Artificial Sequence
  Description of Artificial Sequence: Synthetic oligonucleotide
tcgaattgcttcatgcaacaaccacgctggc

SEQ ID NO: 270263 - DNA, 30 bp, Artificial Sequence
  Description of Artificial Sequence: Synthetic oligonucleotide
cgaattgcttcatgcaacaaccacgctggc

SEQ ID NO: 270264 - DNA, 30 bp, Artificial Sequence
  Description of Artificial Sequence: Synthetic oligonucleotide
gaattgcttcatgcaacaaccacgctggcc

SEQ ID NO: 270265 - DNA, 32 bp, Artificial Sequence
  Description of Artificial Sequence: Synthetic oligonucleotide
aattgcttcatgcaacaaccacgctggccttc

SEQ ID NO: 270266 - DNA, 31 bp, Artificial Sequence
  Description of Artificial Sequence: Synthetic oligonucleotide
attgcttcatgcaacaaccacgctggccttc

SEQ ID NO: 270267 - DNA, 30 bp, Artificial Sequence
  Description of Artificial Sequence: Synthetic oligonucleotide
ttgcttcatgcaacaaccacgctggccttc

SEQ ID NO: 270268 - DNA, 29 bp, Artificial Sequence
  Description of Artificial Sequence: Synthetic oligonucleotide
tgcttcatgcaacaaccacgctggccttc

SEQ ID NO: 270269 - DNA, 28 bp, Artificial Sequence
  Description of Artificial Sequence: Synthetic oligonucleotide
gcttcatgcaacaaccacgctggccttc

SEQ ID NO: 270270 - DNA, 30 bp, Artificial Sequence
  Description of Artificial Sequence: Synthetic oligonucleotide
cttcatgcaacaaccacgctggccttctag

SEQ ID NO: 270271 - DNA, 32 bp, Artificial Sequence
  Description of Artificial Sequence: Synthetic oligonucleotide
ttcatgcaacaaccacgctggccttctagttc

SEQ ID NO: 270272 - DNA, 31 bp, Artificial Sequence
  Description of Artificial Sequence: Synthetic oligonucleotide
tcatgcaacaaccacgctggccttctagttc

SEQ ID NO: 270273 - DNA, 30 bp, Artificial Sequence
  Description of Artificial Sequence: Synthetic oligonucleotide
catgcaacaaccacgctggccttctagttc

SEQ ID NO: 270274 - DNA, 30 bp, Artificial Sequence
  Description of Artificial Sequence: Synthetic oligonucleotide
atgcaacaaccacgctggccttctagttcc

SEQ ID NO: 270275 - DNA, 29 bp, Artificial Sequence
  Description of Artificial Sequence: Synthetic oligonucleotide
tgcaacaaccacgctggccttctagttcc

SEQ ID NO: 270276 - DNA, 28 bp, Artificial Sequence
  Description of Artificial Sequence: Synthetic oligonucleotide
gcaacaaccacgctggccttctagttcc

SEQ ID NO: 270277 - DNA, 28 bp, Artificial Sequence
  Description of Artificial Sequence: Synthetic oligonucleotide
caacaaccacgctggccttctagttccg

SEQ ID NO: 270278 - DNA, 28 bp, Artificial Sequence
  Description of Artificial Sequence: Synthetic oligonucleotide
aacaaccacgctggccttctagttccgc

SEQ ID NO: 270279 - DNA, 27 bp, Artificial Sequence
  Description of Artificial Sequence: Synthetic oligonucleotide
acaaccacgctggccttctagttccgc

SEQ ID NO: 270280 - DNA, 26 bp, Artificial Sequence
  Description of Artificial Sequence: Synthetic oligonucleotide
caaccacgctggccttctagttccgc

SEQ ID NO: 270281 - DNA, 27 bp, Artificial Sequence
  Description of Artificial Sequence: Synthetic oligonucleotide
aaccacgctggccttctagttccgcct

SEQ ID NO: 270282 - DNA, 27 bp, Artificial Sequence
  Description of Artificial Sequence: Synthetic oligonucleotide
accacgctggccttctagttccgcctt

SEQ ID NO: 270283 - DNA, 26 bp, Artificial Sequence
  Description of Artificial Sequence: Synthetic oligonucleotide
ccacgctggccttctagttccgcctt

SEQ ID NO: 270284 - DNA, 26 bp, Artificial Sequence
  Description of Artificial Sequence: Synthetic oligonucleotide
cacgctggccttctagttccgccttg

SEQ ID NO: 270285 - DNA, 27 bp, Artificial Sequence
  Description of Artificial Sequence: Synthetic oligonucleotide
acgctggccttctagttccgccttgga

SEQ ID NO: 270286 - DNA, 26 bp, Artificial Sequence
  Description of Artificial Sequence: Synthetic oligonucleotide
cgctggccttctagttccgccttgga

SEQ ID NO: 270287 - DNA, 27 bp, Artificial Sequence
  Description of Artificial Sequence: Synthetic oligonucleotide
gctggccttctagttccgccttggagt

SEQ ID NO: 270288 - DNA, 27 bp, Artificial Sequence
  Description of Artificial Sequence: Synthetic oligonucleotide
ctggccttctagttccgccttggagtc

SEQ ID NO: 270289 - DNA, 30 bp, Artificial Sequence
  Description of Artificial Sequence: Synthetic oligonucleotide
tggccttctagttccgccttggagtcattg

SEQ ID NO: 270290 - DNA, 29 bp, Artificial Sequence
  Description of Artificial Sequence: Synthetic oligonucleotide
ggccttctagttccgccttggagtcattg

SEQ ID NO: 270291 - DNA, 31 bp, Artificial Sequence
  Description of Artificial Sequence: Synthetic oligonucleotide
gccttctagttccgccttggagtcattgttg

SEQ ID NO: 270292 - DNA, 31 bp, Artificial Sequence
  Description of Artificial Sequence: Synthetic oligonucleotide
ccttctagttccgccttggagtcattgttgc

SEQ ID NO: 270293 - DNA, 32 bp, Artificial Sequence
  Description of Artificial Sequence: Synthetic oligonucleotide
cttctagttccgccttggagtcattgttgcag

SEQ ID NO: 270294 - DNA, 32 bp, Artificial Sequence
  Description of Artificial Sequence: Synthetic oligonucleotide
ttctagttccgccttggagtcattgttgcagc

SEQ ID NO: 270295 - DNA, 31 bp, Artificial Sequence
  Description of Artificial Sequence: Synthetic oligonucleotide
tctagttccgccttggagtcattgttgcagc

SEQ ID NO: 270296 - DNA, 30 bp, Artificial Sequence
  Description of Artificial Sequence: Synthetic oligonucleotide
ctagttccgccttggagtcattgttgcagc

SEQ ID NO: 270297 - DNA, 31 bp, Artificial Sequence
  Description of Artificial Sequence: Synthetic oligonucleotide
tagttccgccttggagtcattgttgcagctc

SEQ ID NO: 270298 - DNA, 30 bp, Artificial Sequence
  Description of Artificial Sequence: Synthetic oligonucleotide
agttccgccttggagtcattgttgcagctc

SEQ ID NO: 270299 - DNA, 29 bp, Artificial Sequence
  Description of Artificial Sequence: Synthetic oligonucleotide
gttccgccttggagtcattgttgcagctc

SEQ ID NO: 270300 - DNA, 30 bp, Artificial Sequence
  Description of Artificial Sequence: Synthetic oligonucleotide
ttccgccttggagtcattgttgcagctcac

SEQ ID NO: 270301 - DNA, 29 bp, Artificial Sequence
  Description of Artificial Sequence: Synthetic oligonucleotide
tccgccttggagtcattgttgcagctcac

SEQ ID NO: 270302 - DNA, 28 bp, Artificial Sequence
  Description of Artificial Sequence: Synthetic oligonucleotide
ccgccttggagtcattgttgcagctcac

SEQ ID NO: 270303 - DNA, 29 bp, Artificial Sequence
  Description of Artificial Sequence: Synthetic oligonucleotide
cgccttggagtcattgttgcagctcactc

SEQ ID NO: 270304 - DNA, 29 bp, Artificial Sequence
  Description of Artificial Sequence: Synthetic oligonucleotide
gccttggagtcattgttgcagctcactcc

SEQ ID NO: 270305 - DNA, 30 bp, Artificial Sequence
  Description of Artificial Sequence: Synthetic oligonucleotide
ccttggagtcattgttgcagctcactccag

SEQ ID NO: 270306 - DNA, 30 bp, Artificial Sequence
  Description of Artificial Sequence: Synthetic oligonucleotide
cttggagtcattgttgcagctcactccagg

SEQ ID NO: 270307 - DNA, 30 bp, Artificial Sequence
  Description of Artificial Sequence: Synthetic oligonucleotide
ttggagtcattgttgcagctcactccaggg

SEQ ID NO: 270308 - DNA, 29 bp, Artificial Sequence
  Description of Artificial Sequence: Synthetic oligonucleotide
tggagtcattgttgcagctcactccaggg

SEQ ID NO: 270309 - DNA, 28 bp, Artificial Sequence
  Description of Artificial Sequence: Synthetic oligonucleotide
ggagtcattgttgcagctcactccaggg

SEQ ID NO: 270310 - DNA, 28 bp, Artificial Sequence
  Description of Artificial Sequence: Synthetic oligonucleotide
gagtcattgttgcagctcactccagggg

SEQ ID NO: 270311 - DNA, 30 bp, Artificial Sequence
  Description of Artificial Sequence: Synthetic oligonucleotide
agtcattgttgcagctcactccaggggtac

SEQ ID NO: 270312 - DNA, 29 bp, Artificial Sequence
  Description of Artificial Sequence: Synthetic oligonucleotide
gtcattgttgcagctcactccaggggtac

SEQ ID NO: 270313 - DNA, 30 bp, Artificial Sequence
  Description of Artificial Sequence: Synthetic oligonucleotide
tcattgttgcagctcactccaggggtacag

SEQ ID NO: 270314 - DNA, 29 bp, Artificial Sequence
  Description of Artificial Sequence: Synthetic oligonucleotide
cattgttgcagctcactccaggggtacag

SEQ ID NO: 270315 - DNA, 29 bp, Artificial Sequence
  Description of Artificial Sequence: Synthetic oligonucleotide
attgttgcagctcactccaggggtacagc

SEQ ID NO: 270316 - DNA, 28 bp, Artificial Sequence
  Description of Artificial Sequence: Synthetic oligonucleotide
ttgttgcagctcactccaggggtacagc

SEQ ID NO: 270317 - DNA, 27 bp, Artificial Sequence
  Description of Artificial Sequence: Synthetic oligonucleotide
tgttgcagctcactccaggggtacagc

SEQ ID NO: 270318 - DNA, 26 bp, Artificial Sequence
  Description of Artificial Sequence: Synthetic oligonucleotide
gttgcagctcactccaggggtacagc

SEQ ID NO: 270319 - DNA, 26 bp, Artificial Sequence
  Description of Artificial Sequence: Synthetic oligonucleotide
ttgcagctcactccaggggtacagcg

SEQ ID NO: 270320 - DNA, 25 bp, Artificial Sequence
  Description of Artificial Sequence: Synthetic oligonucleotide
tgcagctcactccaggggtacagcg

SEQ ID NO: 270321 - DNA, 24 bp, Artificial Sequence
  Description of Artificial Sequence: Synthetic oligonucleotide
gcagctcactccaggggtacagcg

SEQ ID NO: 270322 - DNA, 24 bp, Artificial Sequence
  Description of Artificial Sequence: Synthetic oligonucleotide
cagctcactccaggggtacagcgg

SEQ ID NO: 270323 - DNA, 25 bp, Artificial Sequence
  Description of Artificial Sequence: Synthetic oligonucleotide
agctcactccaggggtacagcggga

SEQ ID NO: 270324 - DNA, 24 bp, Artificial Sequence
  Description of Artificial Sequence: Synthetic oligonucleotide
gctcactccaggggtacagcggga

SEQ ID NO: 270325 - DNA, 24 bp, Artificial Sequence
  Description of Artificial Sequence: Synthetic oligonucleotide
ctcactccaggggtacagcgggag

SEQ ID NO: 270326 - DNA, 27 bp, Artificial Sequence
  Description of Artificial Sequence: Synthetic oligonucleotide
tcactccaggggtacagcgggagctta

SEQ ID NO: 270327 - DNA, 26 bp, Artificial Sequence
  Description of Artificial Sequence: Synthetic oligonucleotide
cactccaggggtacagcgggagctta

SEQ ID NO: 270328 - DNA, 27 bp, Artificial Sequence
  Description of Artificial Sequence: Synthetic oligonucleotide
actccaggggtacagcgggagcttaca

SEQ ID NO: 270329 - DNA, 27 bp, Artificial Sequence
  Description of Artificial Sequence: Synthetic oligonucleotide
ctccaggggtacagcgggagcttacat

SEQ ID NO: 270330 - DNA, 28 bp, Artificial Sequence
  Description of Artificial Sequence: Synthetic oligonucleotide
tccaggggtacagcgggagcttacattc

SEQ ID NO: 270331 - DNA, 27 bp, Artificial Sequence
  Description of Artificial Sequence: Synthetic oligonucleotide
ccaggggtacagcgggagcttacattc

SEQ ID NO: 270332 - DNA, 27 bp, Artificial Sequence
  Description of Artificial Sequence: Synthetic oligonucleotide
caggggtacagcgggagcttacattcc

SEQ ID NO: 270333 - DNA, 27 bp, Artificial Sequence
  Description of Artificial Sequence: Synthetic oligonucleotide
aggggtacagcgggagcttacattccc

SEQ ID NO: 270334 - DNA, 27 bp, Artificial Sequence
  Description of Artificial Sequence: Synthetic oligonucleotide
ggggtacagcgggagcttacattccct

SEQ ID NO: 270335 - DNA, 27 bp, Artificial Sequence
  Description of Artificial Sequence: Synthetic oligonucleotide
gggtacagcgggagcttacattccctc

SEQ ID NO: 270336 - DNA, 27 bp, Artificial Sequence
  Description of Artificial Sequence: Synthetic oligonucleotide
ggtacagcgggagcttacattccctcc

SEQ ID NO: 270337 - DNA, 27 bp, Artificial Sequence
  Description of Artificial Sequence: Synthetic oligonucleotide
gtacagcgggagcttacattccctccc

SEQ ID NO: 270338 - DNA, 28 bp, Artificial Sequence
  Description of Artificial Sequence: Synthetic oligonucleotide
tacagcgggagcttacattccctcccag

SEQ ID NO: 270339 - DNA, 27 bp, Artificial Sequence
  Description of Artificial Sequence: Synthetic oligonucleotide
acagcgggagcttacattccctcccag

SEQ ID NO: 270340 - DNA, 27 bp, Artificial Sequence
  Description of Artificial Sequence: Synthetic oligonucleotide
cagcgggagcttacattccctcccaga

SEQ ID NO: 270341 - DNA, 27 bp, Artificial Sequence
  Description of Artificial Sequence: Synthetic oligonucleotide
agcgggagcttacattccctcccagag

SEQ ID NO: 270342 - DNA, 26 bp, Artificial Sequence
  Description of Artificial Sequence: Synthetic oligonucleotide
gcgggagcttacattccctcccagag

SEQ ID NO: 270343 - DNA, 26 bp, Artificial Sequence
  Description of Artificial Sequence: Synthetic oligonucleotide
cgggagcttacattccctcccagagg

SEQ ID NO: 270344 - DNA, 27 bp, Artificial Sequence
  Description of Artificial Sequence: Synthetic oligonucleotide
gggagcttacattccctcccagagggt

SEQ ID NO: 270345 - DNA, 27 bp, Artificial Sequence
  Description of Artificial Sequence: Synthetic oligonucleotide
ggagcttacattccctcccagagggtg

SEQ ID NO: 270346 - DNA, 29 bp, Artificial Sequence
  Description of Artificial Sequence: Synthetic oligonucleotide
gagcttacattccctcccagagggtgaag

SEQ ID NO: 270347 - DNA, 31 bp, Artificial Sequence
  Description of Artificial Sequence: Synthetic oligonucleotide
agcttacattccctcccagagggtgaagaac

SEQ ID NO: 270348 - DNA, 30 bp, Artificial Sequence
  Description of Artificial Sequence: Synthetic oligonucleotide
gcttacattccctcccagagggtgaagaac

SEQ ID NO: 270349 - DNA, 30 bp, Artificial Sequence
  Description of Artificial Sequence: Synthetic oligonucleotide
cttacattccctcccagagggtgaagaacg

SEQ ID NO: 270350 - DNA, 31 bp, Artificial Sequence
  Description of Artificial Sequence: Synthetic oligonucleotide
ttacattccctcccagagggtgaagaacgtg

SEQ ID NO: 270351 - DNA, 30 bp, Artificial Sequence
  Description of Artificial Sequence: Synthetic oligonucleotide
tacattccctcccagagggtgaagaacgtg

SEQ ID NO: 270352 - DNA, 29 bp, Artificial Sequence
  Description of Artificial Sequence: Synthetic oligonucleotide
acattccctcccagagggtgaagaacgtg

SEQ ID NO: 270353 - DNA, 28 bp, Artificial Sequence
  Description of Artificial Sequence: Synthetic oligonucleotide
cattccctcccagagggtgaagaacgtg

SEQ ID NO: 270354 - DNA, 31 bp, Artificial Sequence
  Description of Artificial Sequence: Synthetic oligonucleotide
attccctcccagagggtgaagaacgtgatag

SEQ ID NO: 270355 - DNA, 30 bp, Artificial Sequence
  Description of Artificial Sequence: Synthetic oligonucleotide
ttccctcccagagggtgaagaacgtgatag

SEQ ID NO: 270356 - DNA, 29 bp, Artificial Sequence
  Description of Artificial Sequence: Synthetic oligonucleotide
tccctcccagagggtgaagaacgtgatag

SEQ ID NO: 270357 - DNA, 28 bp, Artificial Sequence
  Description of Artificial Sequence: Synthetic oligonucleotide
ccctcccagagggtgaagaacgtgatag

SEQ ID NO: 270358 - DNA, 29 bp, Artificial Sequence
  Description of Artificial Sequence: Synthetic oligonucleotide
cctcccagagggtgaagaacgtgatagag

SEQ ID NO: 270359 - DNA, 31 bp, Artificial Sequence
  Description of Artificial Sequence: Synthetic oligonucleotide
ctcccagagggtgaagaacgtgatagagttc

SEQ ID NO: 270360 - DNA, 33 bp, Artificial Sequence
  Description of Artificial Sequence: Synthetic oligonucleotide
tcccagagggtgaagaacgtgatagagttcaac

SEQ ID NO: 270361 - DNA, 32 bp, Artificial Sequence
  Description of Artificial Sequence: Synthetic oligonucleotide
cccagagggtgaagaacgtgatagagttcaac

SEQ ID NO: 270362 - DNA, 32 bp, Artificial Sequence
  Description of Artificial Sequence: Synthetic oligonucleotide
ccagagggtgaagaacgtgatagagttcaacc

SEQ ID NO: 270363 - DNA, 32 bp, Artificial Sequence
  Description of Artificial Sequence: Synthetic oligonucleotide
cagagggtgaagaacgtgatagagttcaaccc

SEQ ID NO: 270364 - DNA, 35 bp, Artificial Sequence
  Description of Artificial Sequence: Synthetic oligonucleotide
agagggtgaagaacgtgatagagttcaacccattc

SEQ ID NO: 270365 - DNA, 34 bp, Artificial Sequence
  Description of Artificial Sequence: Synthetic oligonucleotide
gagggtgaagaacgtgatagagttcaacccattc

SEQ ID NO: 270366 - DNA, 34 bp, Artificial Sequence
  Description of Artificial Sequence: Synthetic oligonucleotide
agggtgaagaacgtgatagagttcaacccattcc

SEQ ID NO: 270367 - DNA, 33 bp, Artificial Sequence
  Description of Artificial Sequence: Synthetic oligonucleotide
gggtgaagaacgtgatagagttcaacccattcc

SEQ ID NO: 270368 - DNA, 34 bp, Artificial Sequence
  Description of Artificial Sequence: Synthetic oligonucleotide
ggtgaagaacgtgatagagttcaacccattcctg

SEQ ID NO: 270369 - DNA, 34 bp, Artificial Sequence
  Description of Artificial Sequence: Synthetic oligonucleotide
gtgaagaacgtgatagagttcaacccattcctgc

SEQ ID NO: 270370 - DNA, 36 bp, Artificial Sequence
  Description of Artificial Sequence: Synthetic oligonucleotide
tgaagaacgtgatagagttcaacccattcctgctag

SEQ ID NO: 270371 - DNA, 35 bp, Artificial Sequence
  Description of Artificial Sequence: Synthetic oligonucleotide
gaagaacgtgatagagttcaacccattcctgctag

SEQ ID NO: 270372 - DNA, 35 bp, Artificial Sequence
  Description of Artificial Sequence: Synthetic oligonucleotide
aagaacgtgatagagttcaacccattcctgctagg

SEQ ID NO: 270373 - DNA, 34 bp, Artificial Sequence
  Description of Artificial Sequence: Synthetic oligonucleotide
agaacgtgatagagttcaacccattcctgctagg

SEQ ID NO: 270374 - DNA, 33 bp, Artificial Sequence
  Description of Artificial Sequence: Synthetic oligonucleotide
gaacgtgatagagttcaacccattcctgctagg

SEQ ID NO: 270375 - DNA, 33 bp, Artificial Sequence
  Description of Artificial Sequence: Synthetic oligonucleotide
aacgtgatagagttcaacccattcctgctaggg

SEQ ID NO: 270376 - DNA, 32 bp, Artificial Sequence
  Description of Artificial Sequence: Synthetic oligonucleotide
acgtgatagagttcaacccattcctgctaggg

SEQ ID NO: 270377 - DNA, 31 bp, Artificial Sequence
  Description of Artificial Sequence: Synthetic oligonucleotide
cgtgatagagttcaacccattcctgctaggg

SEQ ID NO: 270378 - DNA, 32 bp, Artificial Sequence
  Description of Artificial Sequence: Synthetic oligonucleotide
gtgatagagttcaacccattcctgctagggac

SEQ ID NO: 270379 - DNA, 32 bp, Artificial Sequence
  Description of Artificial Sequence: Synthetic oligonucleotide
tgatagagttcaacccattcctgctagggacc

SEQ ID NO: 270380 - DNA, 31 bp, Artificial Sequence
  Description of Artificial Sequence: Synthetic oligonucleotide
gatagagttcaacccattcctgctagggacc

SEQ ID NO: 270381 - DNA, 33 bp, Artificial Sequence
  Description of Artificial Sequence: Synthetic oligonucleotide
atagagttcaacccattcctgctagggaccatg

SEQ ID NO: 270382 - DNA, 32 bp, Artificial Sequence
  Description of Artificial Sequence: Synthetic oligonucleotide
tagagttcaacccattcctgctagggaccatg

SEQ ID NO: 270383 - DNA, 31 bp, Artificial Sequence
  Description of Artificial Sequence: Synthetic oligonucleotide
agagttcaacccattcctgctagggaccatg

SEQ ID NO: 270384 - DNA, 30 bp, Artificial Sequence
  Description of Artificial Sequence: Synthetic oligonucleotide
gagttcaacccattcctgctagggaccatg

SEQ ID NO: 270385 - DNA, 30 bp, Artificial Sequence
  Description of Artificial Sequence: Synthetic oligonucleotide
agttcaacccattcctgctagggaccatgg

SEQ ID NO: 270386 - DNA, 29 bp, Artificial Sequence
  Description of Artificial Sequence: Synthetic oligonucleotide
gttcaacccattcctgctagggaccatgg

SEQ ID NO: 270387 - DNA, 29 bp, Artificial Sequence
  Description of Artificial Sequence: Synthetic oligonucleotide
ttcaacccattcctgctagggaccatggc

SEQ ID NO: 270388 - DNA, 28 bp, Artificial Sequence
  Description of Artificial Sequence: Synthetic oligonucleotide
tcaacccattcctgctagggaccatggc

SEQ ID NO: 270389 - DNA, 27 bp, Artificial Sequence
  Description of Artificial Sequence: Synthetic oligonucleotide
caacccattcctgctagggaccatggc

SEQ ID NO: 270390 - DNA, 28 bp, Artificial Sequence
  Description of Artificial Sequence: Synthetic oligonucleotide
aacccattcctgctagggaccatggctc

SEQ ID NO: 270391 - DNA, 27 bp, Artificial Sequence
  Description of Artificial Sequence: Synthetic oligonucleotide
acccattcctgctagggaccatggctc

SEQ ID NO: 270392 - DNA, 26 bp, Artificial Sequence
  Description of Artificial Sequence: Synthetic oligonucleotide
cccattcctgctagggaccatggctc

SEQ ID NO: 270393 - DNA, 26 bp, Artificial Sequence
  Description of Artificial Sequence: Synthetic oligonucleotide
ccattcctgctagggaccatggctcg

SEQ ID NO: 270394 - DNA, 26 bp, Artificial Sequence
  Description of Artificial Sequence: Synthetic oligonucleotide
cattcctgctagggaccatggctcgg

SEQ ID NO: 270395 - DNA, 26 bp, Artificial Sequence
  Description of Artificial Sequence: Synthetic oligonucleotide
attcctgctagggaccatggctcggg

SEQ ID NO: 270396 - DNA, 25 bp, Artificial Sequence
  Description of Artificial Sequence: Synthetic oligonucleotide
ttcctgctagggaccatggctcggg

SEQ ID NO: 270397 - DNA, 24 bp, Artificial Sequence
  Description of Artificial Sequence: Synthetic oligonucleotide
tcctgctagggaccatggctcggg

SEQ ID NO: 270398 - DNA, 23 bp, Artificial Sequence
  Description of Artificial Sequence: Synthetic oligonucleotide
cctgctagggaccatggctcggg

SEQ ID NO: 270399 - DNA, 23 bp, Artificial Sequence
  Description of Artificial Sequence: Synthetic oligonucleotide
ctgctagggaccatggctcgggg

SEQ ID NO: 270400 - DNA, 23 bp, Artificial Sequence
  Description of Artificial Sequence: Synthetic oligonucleotide
tgctagggaccatggctcggggc

SEQ ID NO: 270401 - DNA, 22 bp, Artificial Sequence
  Description of Artificial Sequence: Synthetic oligonucleotide
gctagggaccatggctcggggc

SEQ ID NO: 270402 - DNA, 22 bp, Artificial Sequence
  Description of Artificial Sequence: Synthetic oligonucleotide
ctagggaccatggctcggggcg

SEQ ID NO: 270403 - DNA, 23 bp, Artificial Sequence
  Description of Artificial Sequence: Synthetic oligonucleotide
tagggaccatggctcggggcgca

SEQ ID NO: 270404 - DNA, 22 bp, Artificial Sequence
  Description of Artificial Sequence: Synthetic oligonucleotide
agggaccatggctcggggcgca

SEQ ID NO: 270405 - DNA, 21 bp, Artificial Sequence
  Description of Artificial Sequence: Synthetic oligonucleotide
gggaccatggctcggggcgca

SEQ ID NO: 270406 - DNA, 21 bp, Artificial Sequence
  Description of Artificial Sequence: Synthetic oligonucleotide
ggaccatggctcggggcgcag

SEQ ID NO: 270407 - DNA, 21 bp, Artificial Sequence
  Description of Artificial Sequence: Synthetic oligonucleotide
gaccatggctcggggcgcagg

SEQ ID NO: 270408 - DNA, 21 bp, Artificial Sequence
  Description of Artificial Sequence: Synthetic oligonucleotide
accatggctcggggcgcaggg

SEQ ID NO: 270409 - DNA, 20 bp, Artificial Sequence
  Description of Artificial Sequence: Synthetic oligonucleotide
ccatggctcggggcgcaggg

SEQ ID NO: 270410 - DNA, 23 bp, Artificial Sequence
  Description of Artificial Sequence: Synthetic oligonucleotide
catggctcggggcgcaggggatt

SEQ ID NO: 270411 - DNA, 23 bp, Artificial Sequence
  Description of Artificial Sequence: Synthetic oligonucleotide
atggctcggggcgcaggggattg

SEQ ID NO: 270412 - DNA, 22 bp, Artificial Sequence
  Description of Artificial Sequence: Synthetic oligonucleotide
tggctcggggcgcaggggattg

SEQ ID NO: 270413 - DNA, 21 bp, Artificial Sequence
  Description of Artificial Sequence: Synthetic oligonucleotide
ggctcggggcgcaggggattg

SEQ ID NO: 270414 - DNA, 22 bp, Artificial Sequence
  Description of Artificial Sequence: Synthetic oligonucleotide
gctcggggcgcaggggattgca

SEQ ID NO: 270415 - DNA, 22 bp, Artificial Sequence
  Description of Artificial Sequence: Synthetic oligonucleotide
ctcggggcgcaggggattgcag

SEQ ID NO: 270416 - DNA, 24 bp, Artificial Sequence
  Description of Artificial Sequence: Synthetic oligonucleotide
tcggggcgcaggggattgcaggtt

SEQ ID NO: 270417 - DNA, 23 bp, Artificial Sequence
  Description of Artificial Sequence: Synthetic oligonucleotide
cggggcgcaggggattgcaggtt

SEQ ID NO: 270418 - DNA, 24 bp, Artificial Sequence
  Description of Artificial Sequence: Synthetic oligonucleotide
ggggcgcaggggattgcaggttct

SEQ ID NO: 270419 - DNA, 24 bp, Artificial Sequence
  Description of Artificial Sequence: Synthetic oligonucleotide
gggcgcaggggattgcaggttctg

SEQ ID NO: 270420 - DNA, 24 bp, Artificial Sequence
  Description of Artificial Sequence: Synthetic oligonucleotide
ggcgcaggggattgcaggttctgg

SEQ ID NO: 270421 - DNA, 26 bp, Artificial Sequence
  Description of Artificial Sequence: Synthetic oligonucleotide
gcgcaggggattgcaggttctgggaa

SEQ ID NO: 270422 - DNA, 26 bp, Artificial Sequence
  Description of Artificial Sequence: Synthetic oligonucleotide
cgcaggggattgcaggttctgggaag

SEQ ID NO: 270423 - DNA, 26 bp, Artificial Sequence
  Description of Artificial Sequence: Synthetic oligonucleotide
gcaggggattgcaggttctgggaagg

SEQ ID NO: 270424 - DNA, 26 bp, Artificial Sequence
  Description of Artificial Sequence: Synthetic oligonucleotide
caggggattgcaggttctgggaaggg

SEQ ID NO: 270425 - DNA, 27 bp, Artificial Sequence
  Description of Artificial Sequence: Synthetic oligonucleotide
aggggattgcaggttctgggaagggct

SEQ ID NO: 270426 - DNA, 26 bp, Artificial Sequence
  Description of Artificial Sequence: Synthetic oligonucleotide
ggggattgcaggttctgggaagggct

SEQ ID NO: 270427 - DNA, 27 bp, Artificial Sequence
  Description of Artificial Sequence: Synthetic oligonucleotide
gggattgcaggttctgggaagggctgt

SEQ ID NO: 270428 - DNA, 28 bp, Artificial Sequence
  Description of Artificial Sequence: Synthetic oligonucleotide
ggattgcaggttctgggaagggctgttg

SEQ ID NO: 270429 - DNA, 28 bp, Artificial Sequence
  Description of Artificial Sequence: Synthetic oligonucleotide
gattgcaggttctgggaagggctgttgg

SEQ ID NO: 270430 - DNA, 28 bp, Artificial Sequence
  Description of Artificial Sequence: Synthetic oligonucleotide
attgcaggttctgggaagggctgttggg

SEQ ID NO: 270431 - DNA, 27 bp, Artificial Sequence
  Description of Artificial Sequence: Synthetic oligonucleotide
ttgcaggttctgggaagggctgttggg

SEQ ID NO: 270432 - DNA, 27 bp, Artificial Sequence
  Description of Artificial Sequence: Synthetic oligonucleotide
tgcaggttctgggaagggctgttgggt

SEQ ID NO: 270433 - DNA, 26 bp, Artificial Sequence
  Description of Artificial Sequence: Synthetic oligonucleotide
gcaggttctgggaagggctgttgggt

SEQ ID NO: 270434 - DNA, 26 bp, Artificial Sequence
  Description of Artificial Sequence: Synthetic oligonucleotide
caggttctgggaagggctgttgggtc

SEQ ID NO: 270435 - DNA, 26 bp, Artificial Sequence
  Description of Artificial Sequence: Synthetic oligonucleotide
aggttctgggaagggctgttgggtcg

SEQ ID NO: 270436 - DNA, 25 bp, Artificial Sequence
  Description of Artificial Sequence: Synthetic oligonucleotide
ggttctgggaagggctgttgggtcg

SEQ ID NO: 270437 - DNA, 25 bp, Artificial Sequence
  Description of Artificial Sequence: Synthetic oligonucleotide
gttctgggaagggctgttgggtcgg

SEQ ID NO: 270438 - DNA, 27 bp, Artificial Sequence
  Description of Artificial Sequence: Synthetic oligonucleotide
ttctgggaagggctgttgggtcggcaa

SEQ ID NO: 270439 - DNA, 27 bp, Artificial Sequence
  Description of Artificial Sequence: Synthetic oligonucleotide
tctgggaagggctgttgggtcggcaat

SEQ ID NO: 270440 - DNA, 26 bp, Artificial Sequence
  Description of Artificial Sequence: Synthetic oligonucleotide
ctgggaagggctgttgggtcggcaat

SEQ ID NO: 270441 - DNA, 27 bp, Artificial Sequence
  Description of Artificial Sequence: Synthetic oligonucleotide
tgggaagggctgttgggtcggcaatga

SEQ ID NO: 270442 - DNA, 26 bp, Artificial Sequence
  Description of Artificial Sequence: Synthetic oligonucleotide
gggaagggctgttgggtcggcaatga

SEQ ID NO: 270443 - DNA, 26 bp, Artificial Sequence
  Description of Artificial Sequence: Synthetic oligonucleotide
ggaagggctgttgggtcggcaatgac

SEQ ID NO: 270444 - DNA, 27 bp, Artificial Sequence
  Description of Artificial Sequence: Synthetic oligonucleotide
gaagggctgttgggtcggcaatgacga

SEQ ID NO: 270445 - DNA, 29 bp, Artificial Sequence
  Description of Artificial Sequence: Synthetic oligonucleotide
aagggctgttgggtcggcaatgacgaatc

SEQ ID NO: 270446 - DNA, 28 bp, Artificial Sequence
  Description of Artificial Sequence: Synthetic oligonucleotide
agggctgttgggtcggcaatgacgaatc

SEQ ID NO: 270447 - DNA, 27 bp, Artificial Sequence
  Description of Artificial Sequence: Synthetic oligonucleotide
gggctgttgggtcggcaatgacgaatc

SEQ ID NO: 270448 - DNA, 30 bp, Artificial Sequence
  Description of Artificial Sequence: Synthetic oligonucleotide
ggctgttgggtcggcaatgacgaatctatc

SEQ ID NO: 270449 - DNA, 31 bp, Artificial Sequence
  Description of Artificial Sequence: Synthetic oligonucleotide
gctgttgggtcggcaatgacgaatctatcag

SEQ ID NO: 270450 - DNA, 31 bp, Artificial Sequence
  Description of Artificial Sequence: Synthetic oligonucleotide
ctgttgggtcggcaatgacgaatctatcagc

SEQ ID NO: 270451 - DNA, 33 bp, Artificial Sequence
  Description of Artificial Sequence: Synthetic oligonucleotide
tgttgggtcggcaatgacgaatctatcagcttc

SEQ ID NO: 270452 - DNA, 32 bp, Artificial Sequence
  Description of Artificial Sequence: Synthetic oligonucleotide
gttgggtcggcaatgacgaatctatcagcttc

SEQ ID NO: 270453 - DNA, 32 bp, Artificial Sequence
  Description of Artificial Sequence: Synthetic oligonucleotide
ttgggtcggcaatgacgaatctatcagcttcg

SEQ ID NO: 270454 - DNA, 31 bp, Artificial Sequence
  Description of Artificial Sequence: Synthetic oligonucleotide
tgggtcggcaatgacgaatctatcagcttcg

SEQ ID NO: 270455 - DNA, 30 bp, Artificial Sequence
  Description of Artificial Sequence: Synthetic oligonucleotide
gggtcggcaatgacgaatctatcagcttcg

SEQ ID NO: 270456 - DNA, 36 bp, Artificial Sequence
  Description of Artificial Sequence: Synthetic oligonucleotide
ggtcggcaatgacgaatctatcagcttcgaattaag

SEQ ID NO: 270457 - DNA, 36 bp, Artificial Sequence
  Description of Artificial Sequence: Synthetic oligonucleotide
gtcggcaatgacgaatctatcagcttcgaattaagg

SEQ ID NO: 270458 - DNA, 38 bp, Artificial Sequence
  Description of Artificial Sequence: Synthetic oligonucleotide
tcggcaatgacgaatctatcagcttcgaattaaggaac

SEQ ID NO: 270459 - DNA, 37 bp, Artificial Sequence
  Description of Artificial Sequence: Synthetic oligonucleotide
cggcaatgacgaatctatcagcttcgaattaaggaac

SEQ ID NO: 270460 - DNA, 37 bp, Artificial Sequence
  Description of Artificial Sequence: Synthetic oligonucleotide
ggcaatgacgaatctatcagcttcgaattaaggaacg

SEQ ID NO: 270461 - DNA, 37 bp, Artificial Sequence
  Description of Artificial Sequence: Synthetic oligonucleotide
gcaatgacgaatctatcagcttcgaattaaggaacgg

SEQ ID NO: 270462 - DNA, 39 bp, Artificial Sequence
  Description of Artificial Sequence: Synthetic oligonucleotide
caatgacgaatctatcagcttcgaattaaggaacggatc

SEQ ID NO: 270463 - DNA, 40 bp, Artificial Sequence
  Description of Artificial Sequence: Synthetic oligonucleotide
aatgacgaatctatcagcttcgaattaaggaacggatctc

SEQ ID NO: 270464 - DNA, 39 bp, Artificial Sequence
  Description of Artificial Sequence: Synthetic oligonucleotide
atgacgaatctatcagcttcgaattaaggaacggatctc

SEQ ID NO: 270465 - DNA, 38 bp, Artificial Sequence
  Description of Artificial Sequence: Synthetic oligonucleotide
tgacgaatctatcagcttcgaattaaggaacggatctc

SEQ ID NO: 270466 - DNA, 37 bp, Artificial Sequence
  Description of Artificial Sequence: Synthetic oligonucleotide
gacgaatctatcagcttcgaattaaggaacggatctc

SEQ ID NO: 270467 - DNA, 38 bp, Artificial Sequence
  Description of Artificial Sequence: Synthetic oligonucleotide
acgaatctatcagcttcgaattaaggaacggatctctg

SEQ ID NO: 270468 - DNA, 37 bp, Artificial Sequence
  Description of Artificial Sequence: Synthetic oligonucleotide
cgaatctatcagcttcgaattaaggaacggatctctg

SEQ ID NO: 270469 - DNA, 39 bp, Artificial Sequence
  Description of Artificial Sequence: Synthetic oligonucleotide
gaatctatcagcttcgaattaaggaacggatctctgtac

SEQ ID NO: 270470 - DNA, 39 bp, Artificial Sequence
  Description of Artificial Sequence: Synthetic oligonucleotide
aatctatcagcttcgaattaaggaacggatctctgtacc

SEQ ID NO: 270471 - DNA, 38 bp, Artificial Sequence
  Description of Artificial Sequence: Synthetic oligonucleotide
atctatcagcttcgaattaaggaacggatctctgtacc

SEQ ID NO: 270472 - DNA, 37 bp, Artificial Sequence
  Description of Artificial Sequence: Synthetic oligonucleotide
tctatcagcttcgaattaaggaacggatctctgtacc

SEQ ID NO: 270473 - DNA, 36 bp, Artificial Sequence
  Description of Artificial Sequence: Synthetic oligonucleotide
ctatcagcttcgaattaaggaacggatctctgtacc

SEQ ID NO: 270474 - DNA, 37 bp, Artificial Sequence
  Description of Artificial Sequence: Synthetic oligonucleotide
tatcagcttcgaattaaggaacggatctctgtaccag

SEQ ID NO: 270475 - DNA, 36 bp, Artificial Sequence
  Description of Artificial Sequence: Synthetic oligonucleotide
atcagcttcgaattaaggaacggatctctgtaccag

SEQ ID NO: 270476 - DNA, 35 bp, Artificial Sequence
  Description of Artificial Sequence: Synthetic oligonucleotide
tcagcttcgaattaaggaacggatctctgtaccag

SEQ ID NO: 270477 - DNA, 34 bp, Artificial Sequence
  Description of Artificial Sequence: Synthetic oligonucleotide
cagcttcgaattaaggaacggatctctgtaccag

SEQ ID NO: 270478 - DNA, 34 bp, Artificial Sequence
  Description of Artificial Sequence: Synthetic oligonucleotide
agcttcgaattaaggaacggatctctgtaccagc

SEQ ID NO: 270479 - DNA, 33 bp, Artificial Sequence
  Description of Artificial Sequence: Synthetic oligonucleotide
gcttcgaattaaggaacggatctctgtaccagc

SEQ ID NO: 270480 - DNA, 34 bp, Artificial Sequence
  Description of Artificial Sequence: Synthetic oligonucleotide
cttcgaattaaggaacggatctctgtaccagctg

SEQ ID NO: 270481 - DNA, 34 bp, Artificial Sequence
  Description of Artificial Sequence: Synthetic oligonucleotide
ttcgaattaaggaacggatctctgtaccagctgc

SEQ ID NO: 270482 - DNA, 33 bp, Artificial Sequence
  Description of Artificial Sequence: Synthetic oligonucleotide
tcgaattaaggaacggatctctgtaccagctgc

SEQ ID NO: 270483 - DNA, 32 bp, Artificial Sequence
  Description of Artificial Sequence: Synthetic oligonucleotide
cgaattaaggaacggatctctgtaccagctgc

SEQ ID NO: 270484 - DNA, 32 bp, Artificial Sequence
  Description of Artificial Sequence: Synthetic oligonucleotide
gaattaaggaacggatctctgtaccagctgcc

SEQ ID NO: 270485 - DNA, 33 bp, Artificial Sequence
  Description of Artificial Sequence: Synthetic oligonucleotide
aattaaggaacggatctctgtaccagctgcctg

SEQ ID NO: 270486 - DNA, 32 bp, Artificial Sequence
  Description of Artificial Sequence: Synthetic oligonucleotide
attaaggaacggatctctgtaccagctgcctg

SEQ ID NO: 270487 - DNA, 31 bp, Artificial Sequence
  Description of Artificial Sequence: Synthetic oligonucleotide
ttaaggaacggatctctgtaccagctgcctg

SEQ ID NO: 270488 - DNA, 30 bp, Artificial Sequence
  Description of Artificial Sequence: Synthetic oligonucleotide
taaggaacggatctctgtaccagctgcctg

SEQ ID NO: 270489 - DNA, 29 bp, Artificial Sequence
  Description of Artificial Sequence: Synthetic oligonucleotide
aaggaacggatctctgtaccagctgcctg

SEQ ID NO: 270490 - DNA, 28 bp, Artificial Sequence
  Description of Artificial Sequence: Synthetic oligonucleotide
aggaacggatctctgtaccagctgcctg

SEQ ID NO: 270491 - DNA, 27 bp, Artificial Sequence
  Description of Artificial Sequence: Synthetic oligonucleotide
ggaacggatctctgtaccagctgcctg

SEQ ID NO: 270492 - DNA, 27 bp, Artificial Sequence
  Description of Artificial Sequence: Synthetic oligonucleotide
gaacggatctctgtaccagctgcctgc

SEQ ID NO: 270493 - DNA, 30 bp, Artificial Sequence
  Description of Artificial Sequence: Synthetic oligonucleotide
aacggatctctgtaccagctgcctgcaaac

SEQ ID NO: 270494 - DNA, 29 bp, Artificial Sequence
  Description of Artificial Sequence: Synthetic oligonucleotide
acggatctctgtaccagctgcctgcaaac

SEQ ID NO: 270495 - DNA, 28 bp, Artificial Sequence
  Description of Artificial Sequence: Synthetic oligonucleotide
cggatctctgtaccagctgcctgcaaac

SEQ ID NO: 270496 - DNA, 29 bp, Artificial Sequence
  Description of Artificial Sequence: Synthetic oligonucleotide
ggatctctgtaccagctgcctgcaaactg

SEQ ID NO: 270497 - DNA, 29 bp, Artificial Sequence
  Description of Artificial Sequence: Synthetic oligonucleotide
gatctctgtaccagctgcctgcaaactgc

SEQ ID NO: 270498 - DNA, 31 bp, Artificial Sequence
  Description of Artificial Sequence: Synthetic oligonucleotide
atctctgtaccagctgcctgcaaactgctag

SEQ ID NO: 270499 - DNA, 30 bp, Artificial Sequence
  Description of Artificial Sequence: Synthetic oligonucleotide
tctctgtaccagctgcctgcaaactgctag

SEQ ID NO: 270500 - DNA, 29 bp, Artificial Sequence
  Description of Artificial Sequence: Synthetic oligonucleotide
ctctgtaccagctgcctgcaaactgctag

SEQ ID NO: 270501 - DNA, 29 bp, Artificial Sequence
  Description of Artificial Sequence: Synthetic oligonucleotide
tctgtaccagctgcctgcaaactgctagc

SEQ ID NO: 270502 - DNA, 28 bp, Artificial Sequence
  Description of Artificial Sequence: Synthetic oligonucleotide
ctgtaccagctgcctgcaaactgctagc

SEQ ID NO: 270503 - DNA, 28 bp, Artificial Sequence
  Description of Artificial Sequence: Synthetic oligonucleotide
tgtaccagctgcctgcaaactgctagcc

SEQ ID NO: 270504 - DNA, 27 bp, Artificial Sequence
  Description of Artificial Sequence: Synthetic oligonucleotide
gtaccagctgcctgcaaactgctagcc

SEQ ID NO: 270505 - DNA, 29 bp, Artificial Sequence
  Description of Artificial Sequence: Synthetic oligonucleotide
taccagctgcctgcaaactgctagccaac

SEQ ID NO: 270506 - DNA, 28 bp, Artificial Sequence
  Description of Artificial Sequence: Synthetic oligonucleotide
accagctgcctgcaaactgctagccaac

SEQ ID NO: 270507 - DNA, 27 bp, Artificial Sequence
  Description of Artificial Sequence: Synthetic oligonucleotide
ccagctgcctgcaaactgctagccaac

SEQ ID NO: 270508 - DNA, 29 bp, Artificial Sequence
  Description of Artificial Sequence: Synthetic oligonucleotide
cagctgcctgcaaactgctagccaacatg

SEQ ID NO: 270509 - DNA, 29 bp, Artificial Sequence
  Description of Artificial Sequence: Synthetic oligonucleotide
agctgcctgcaaactgctagccaacatgc

SEQ ID NO: 270510 - DNA, 28 bp, Artificial Sequence
  Description of Artificial Sequence: Synthetic oligonucleotide
gctgcctgcaaactgctagccaacatgc

SEQ ID NO: 270511 - DNA, 29 bp, Artificial Sequence
  Description of Artificial Sequence: Synthetic oligonucleotide
ctgcctgcaaactgctagccaacatgctg

SEQ ID NO: 270512 - DNA, 32 bp, Artificial Sequence
  Description of Artificial Sequence: Synthetic oligonucleotide
tgcctgcaaactgctagccaacatgctgtatc

SEQ ID NO: 270513 - DNA, 31 bp, Artificial Sequence
  Description of Artificial Sequence: Synthetic oligonucleotide
gcctgcaaactgctagccaacatgctgtatc

SEQ ID NO: 270514 - DNA, 32 bp, Artificial Sequence
  Description of Artificial Sequence: Synthetic oligonucleotide
cctgcaaactgctagccaacatgctgtatcag

SEQ ID NO: 270515 - DNA, 34 bp, Artificial Sequence
  Description of Artificial Sequence: Synthetic oligonucleotide
ctgcaaactgctagccaacatgctgtatcagttc

SEQ ID NO: 270516 - DNA, 37 bp, Artificial Sequence
  Description of Artificial Sequence: Synthetic oligonucleotide
tgcaaactgctagccaacatgctgtatcagttcaaag

SEQ ID NO: 270517 - DNA, 36 bp, Artificial Sequence
  Description of Artificial Sequence: Synthetic oligonucleotide
gcaaactgctagccaacatgctgtatcagttcaaag

SEQ ID NO: 270518 - DNA, 36 bp, Artificial Sequence
  Description of Artificial Sequence: Synthetic oligonucleotide
caaactgctagccaacatgctgtatcagttcaaagg

SEQ ID NO: 270519 - DNA, 36 bp, Artificial Sequence
  Description of Artificial Sequence: Synthetic oligonucleotide
aaactgctagccaacatgctgtatcagttcaaaggc

SEQ ID NO: 270520 - DNA, 35 bp, Artificial Sequence
  Description of Artificial Sequence: Synthetic oligonucleotide
aactgctagccaacatgctgtatcagttcaaaggc

SEQ ID NO: 270521 - DNA, 34 bp, Artificial Sequence
  Description of Artificial Sequence: Synthetic oligonucleotide
actgctagccaacatgctgtatcagttcaaaggc

SEQ ID NO: 270522 - DNA, 33 bp, Artificial Sequence
  Description of Artificial Sequence: Synthetic oligonucleotide
ctgctagccaacatgctgtatcagttcaaaggc

SEQ ID NO: 270523 - DNA, 35 bp, Artificial Sequence
  Description of Artificial Sequence: Synthetic oligonucleotide
tgctagccaacatgctgtatcagttcaaaggcatc

SEQ ID NO: 270524 - DNA, 34 bp, Artificial Sequence
  Description of Artificial Sequence: Synthetic oligonucleotide
gctagccaacatgctgtatcagttcaaaggcatc

SEQ ID NO: 270525 - DNA, 34 bp, Artificial Sequence
  Description of Artificial Sequence: Synthetic oligonucleotide
ctagccaacatgctgtatcagttcaaaggcatcg

SEQ ID NO: 270526 - DNA, 34 bp, Artificial Sequence
  Description of Artificial Sequence: Synthetic oligonucleotide
tagccaacatgctgtatcagttcaaaggcatcgg

SEQ ID NO: 270527 - DNA, 33 bp, Artificial Sequence
  Description of Artificial Sequence: Synthetic oligonucleotide
agccaacatgctgtatcagttcaaaggcatcgg

SEQ ID NO: 270528 - DNA, 32 bp, Artificial Sequence
  Description of Artificial Sequence: Synthetic oligonucleotide
gccaacatgctgtatcagttcaaaggcatcgg

SEQ ID NO: 270529 - DNA, 32 bp, Artificial Sequence
  Description of Artificial Sequence: Synthetic oligonucleotide
ccaacatgctgtatcagttcaaaggcatcggg

SEQ ID NO: 270530 - DNA, 32 bp, Artificial Sequence
  Description of Artificial Sequence: Synthetic oligonucleotide
caacatgctgtatcagttcaaaggcatcgggc

SEQ ID NO: 270531 - DNA, 33 bp, Artificial Sequence
  Description of Artificial Sequence: Synthetic oligonucleotide
aacatgctgtatcagttcaaaggcatcgggctg

SEQ ID NO: 270532 - DNA, 32 bp, Artificial Sequence
  Description of Artificial Sequence: Synthetic oligonucleotide
acatgctgtatcagttcaaaggcatcgggctg

SEQ ID NO: 270533 - DNA, 31 bp, Artificial Sequence
  Description of Artificial Sequence: Synthetic oligonucleotide
catgctgtatcagttcaaaggcatcgggctg

SEQ ID NO: 270534 - DNA, 32 bp, Artificial Sequence
  Description of Artificial Sequence: Synthetic oligonucleotide
atgctgtatcagttcaaaggcatcgggctgtc

SEQ ID NO: 270535 - DNA, 31 bp, Artificial Sequence
  Description of Artificial Sequence: Synthetic oligonucleotide
tgctgtatcagttcaaaggcatcgggctgtc

SEQ ID NO: 270536 - DNA, 30 bp, Artificial Sequence
  Description of Artificial Sequence: Synthetic oligonucleotide
gctgtatcagttcaaaggcatcgggctgtc

SEQ ID NO: 270537 - DNA, 30 bp, Artificial Sequence
  Description of Artificial Sequence: Synthetic oligonucleotide
ctgtatcagttcaaaggcatcgggctgtcc

SEQ ID NO: 270538 - DNA, 32 bp, Artificial Sequence
  Description of Artificial Sequence: Synthetic oligonucleotide
tgtatcagttcaaaggcatcgggctgtccttg

SEQ ID NO: 270539 - DNA, 31 bp, Artificial Sequence
  Description of Artificial Sequence: Synthetic oligonucleotide
gtatcagttcaaaggcatcgggctgtccttg

SEQ ID NO: 270540 - DNA, 31 bp, Artificial Sequence
  Description of Artificial Sequence: Synthetic oligonucleotide
tatcagttcaaaggcatcgggctgtccttgg

SEQ ID NO: 270541 - DNA, 30 bp, Artificial Sequence
  Description of Artificial Sequence: Synthetic oligonucleotide
atcagttcaaaggcatcgggctgtccttgg

SEQ ID NO: 270542 - DNA, 29 bp, Artificial Sequence
  Description of Artificial Sequence: Synthetic oligonucleotide
tcagttcaaaggcatcgggctgtccttgg

SEQ ID NO: 270543 - DNA, 28 bp, Artificial Sequence
  Description of Artificial Sequence: Synthetic oligonucleotide
cagttcaaaggcatcgggctgtccttgg

SEQ ID NO: 270544 - DNA, 28 bp, Artificial Sequence
  Description of Artificial Sequence: Synthetic oligonucleotide
agttcaaaggcatcgggctgtccttggg

SEQ ID NO: 270545 - DNA, 27 bp, Artificial Sequence
  Description of Artificial Sequence: Synthetic oligonucleotide
gttcaaaggcatcgggctgtccttggg

SEQ ID NO: 270546 - DNA, 27 bp, Artificial Sequence
  Description of Artificial Sequence: Synthetic oligonucleotide
ttcaaaggcatcgggctgtccttgggc

SEQ ID NO: 270547 - DNA, 27 bp, Artificial Sequence
  Description of Artificial Sequence: Synthetic oligonucleotide
tcaaaggcatcgggctgtccttgggca

SEQ ID NO: 270548 - DNA, 26 bp, Artificial Sequence
  Description of Artificial Sequence: Synthetic oligonucleotide
caaaggcatcgggctgtccttgggca

SEQ ID NO: 270549 - DNA, 26 bp, Artificial Sequence
  Description of Artificial Sequence: Synthetic oligonucleotide
aaaggcatcgggctgtccttgggcac

SEQ ID NO: 270550 - DNA, 25 bp, Artificial Sequence
  Description of Artificial Sequence: Synthetic oligonucleotide
aaggcatcgggctgtccttgggcac

SEQ ID NO: 270551 - DNA, 24 bp, Artificial Sequence
  Description of Artificial Sequence: Synthetic oligonucleotide
aggcatcgggctgtccttgggcac

SEQ ID NO: 270552 - DNA, 23 bp, Artificial Sequence
  Description of Artificial Sequence: Synthetic oligonucleotide
ggcatcgggctgtccttgggcac

SEQ ID NO: 270553 - DNA, 25 bp, Artificial Sequence
  Description of Artificial Sequence: Synthetic oligonucleotide
gcatcgggctgtccttgggcaccaa

SEQ ID NO: 270554 - DNA, 27 bp, Artificial Sequence
  Description of Artificial Sequence: Synthetic oligonucleotide
catcgggctgtccttgggcaccaagat

SEQ ID NO: 270555 - DNA, 27 bp, Artificial Sequence
  Description of Artificial Sequence: Synthetic oligonucleotide
atcgggctgtccttgggcaccaagatc

SEQ ID NO: 270556 - DNA, 27 bp, Artificial Sequence
  Description of Artificial Sequence: Synthetic oligonucleotide
tcgggctgtccttgggcaccaagatct

SEQ ID NO: 270557 - DNA, 26 bp, Artificial Sequence
  Description of Artificial Sequence: Synthetic oligonucleotide
cgggctgtccttgggcaccaagatct

SEQ ID NO: 270558 - DNA, 27 bp, Artificial Sequence
  Description of Artificial Sequence: Synthetic oligonucleotide
gggctgtccttgggcaccaagatctgt

SEQ ID NO: 270559 - DNA, 27 bp, Artificial Sequence
  Description of Artificial Sequence: Synthetic oligonucleotide
ggctgtccttgggcaccaagatctgtg

SEQ ID NO: 270560 - DNA, 27 bp, Artificial Sequence
  Description of Artificial Sequence: Synthetic oligonucleotide
gctgtccttgggcaccaagatctgtgg

SEQ ID NO: 270561 - DNA, 27 bp, Artificial Sequence
  Description of Artificial Sequence: Synthetic oligonucleotide
ctgtccttgggcaccaagatctgtggg

SEQ ID NO: 270562 - DNA, 28 bp, Artificial Sequence
  Description of Artificial Sequence: Synthetic oligonucleotide
tgtccttgggcaccaagatctgtgggtg

SEQ ID NO: 270563 - DNA, 27 bp, Artificial Sequence
  Description of Artificial Sequence: Synthetic oligonucleotide
gtccttgggcaccaagatctgtgggtg

SEQ ID NO: 270564 - DNA, 27 bp, Artificial Sequence
  Description of Artificial Sequence: Synthetic oligonucleotide
tccttgggcaccaagatctgtgggtgg

SEQ ID NO: 270565 - DNA, 26 bp, Artificial Sequence
  Description of Artificial Sequence: Synthetic oligonucleotide
ccttgggcaccaagatctgtgggtgg

SEQ ID NO: 270566 - DNA, 27 bp, Artificial Sequence
  Description of Artificial Sequence: Synthetic oligonucleotide
cttgggcaccaagatctgtgggtggga

SEQ ID NO: 270567 - DNA, 30 bp, Artificial Sequence
  Description of Artificial Sequence: Synthetic oligonucleotide
ttgggcaccaagatctgtgggtgggataag

SEQ ID NO: 270568 - DNA, 29 bp, Artificial Sequence
  Description of Artificial Sequence: Synthetic oligonucleotide
tgggcaccaagatctgtgggtgggataag

SEQ ID NO: 270569 - DNA, 28 bp, Artificial Sequence
  Description of Artificial Sequence: Synthetic oligonucleotide
gggcaccaagatctgtgggtgggataag

SEQ ID NO: 270570 - DNA, 29 bp, Artificial Sequence
  Description of Artificial Sequence: Synthetic oligonucleotide
ggcaccaagatctgtgggtgggataagtg

SEQ ID NO: 270571 - DNA, 30 bp, Artificial Sequence
  Description of Artificial Sequence: Synthetic oligonucleotide
gcaccaagatctgtgggtgggataagtgag

SEQ ID NO: 270572 - DNA, 30 bp, Artificial Sequence
  Description of Artificial Sequence: Synthetic oligonucleotide
caccaagatctgtgggtgggataagtgagg

SEQ ID NO: 270573 - DNA, 30 bp, Artificial Sequence
  Description of Artificial Sequence: Synthetic oligonucleotide
accaagatctgtgggtgggataagtgaggc

SEQ ID NO: 270574 - DNA, 29 bp, Artificial Sequence
  Description of Artificial Sequence: Synthetic oligonucleotide
ccaagatctgtgggtgggataagtgaggc

SEQ ID NO: 270575 - DNA, 29 bp, Artificial Sequence
  Description of Artificial Sequence: Synthetic oligonucleotide
caagatctgtgggtgggataagtgaggcc

SEQ ID NO: 270576 - DNA, 29 bp, Artificial Sequence
  Description of Artificial Sequence: Synthetic oligonucleotide
aagatctgtgggtgggataagtgaggccc

SEQ ID NO: 270577 - DNA, 28 bp, Artificial Sequence
  Description of Artificial Sequence: Synthetic oligonucleotide
agatctgtgggtgggataagtgaggccc

SEQ ID NO: 270578 - DNA, 27 bp, Artificial Sequence
  Description of Artificial Sequence: Synthetic oligonucleotide
gatctgtgggtgggataagtgaggccc

SEQ ID NO: 270579 - DNA, 28 bp, Artificial Sequence
  Description of Artificial Sequence: Synthetic oligonucleotide
atctgtgggtgggataagtgaggccctg

SEQ ID NO: 270580 - DNA, 27 bp, Artificial Sequence
  Description of Artificial Sequence: Synthetic oligonucleotide
tctgtgggtgggataagtgaggccctg

SEQ ID NO: 270581 - DNA, 27 bp, Artificial Sequence
  Description of Artificial Sequence: Synthetic oligonucleotide
ctgtgggtgggataagtgaggccctga

SEQ ID NO: 270582 - DNA, 27 bp, Artificial Sequence
  Description of Artificial Sequence: Synthetic oligonucleotide
tgtgggtgggataagtgaggccctgag

SEQ ID NO: 270583 - DNA, 27 bp, Artificial Sequence
  Description of Artificial Sequence: Synthetic oligonucleotide
gtgggtgggataagtgaggccctgagt

SEQ ID NO: 270584 - DNA, 27 bp, Artificial Sequence
  Description of Artificial Sequence: Synthetic oligonucleotide
tgggtgggataagtgaggccctgagtc

SEQ ID NO: 270585 - DNA, 27 bp, Artificial Sequence
  Description of Artificial Sequence: Synthetic oligonucleotide
gggtgggataagtgaggccctgagtct

SEQ ID NO: 270586 - DNA, 27 bp, Artificial Sequence
  Description of Artificial Sequence: Synthetic oligonucleotide
ggtgggataagtgaggccctgagtctg

SEQ ID NO: 270587 - DNA, 29 bp, Artificial Sequence
  Description of Artificial Sequence: Synthetic oligonucleotide
gtgggataagtgaggccctgagtctgaag

SEQ ID NO: 270588 - DNA, 31 bp, Artificial Sequence
  Description of Artificial Sequence: Synthetic oligonucleotide
tgggataagtgaggccctgagtctgaagtac

SEQ ID NO: 270589 - DNA, 30 bp, Artificial Sequence
  Description of Artificial Sequence: Synthetic oligonucleotide
gggataagtgaggccctgagtctgaagtac

SEQ ID NO: 270590 - DNA, 31 bp, Artificial Sequence
  Description of Artificial Sequence: Synthetic oligonucleotide
ggataagtgaggccctgagtctgaagtactg

SEQ ID NO: 270591 - DNA, 32 bp, Artificial Sequence
  Description of Artificial Sequence: Synthetic oligonucleotide
gataagtgaggccctgagtctgaagtactgtg

SEQ ID NO: 270592 - DNA, 32 bp, Artificial Sequence
  Description of Artificial Sequence: Synthetic oligonucleotide
ataagtgaggccctgagtctgaagtactgtgc

SEQ ID NO: 270593 - DNA, 31 bp, Artificial Sequence
  Description of Artificial Sequence: Synthetic oligonucleotide
taagtgaggccctgagtctgaagtactgtgc

SEQ ID NO: 270594 - DNA, 30 bp, Artificial Sequence
  Description of Artificial Sequence: Synthetic oligonucleotide
aagtgaggccctgagtctgaagtactgtgc

SEQ ID NO: 270595 - DNA, 29 bp, Artificial Sequence
  Description of Artificial Sequence: Synthetic oligonucleotide
agtgaggccctgagtctgaagtactgtgc

SEQ ID NO: 270596 - DNA, 28 bp, Artificial Sequence
  Description of Artificial Sequence: Synthetic oligonucleotide
gtgaggccctgagtctgaagtactgtgc

SEQ ID NO: 270597 - DNA, 30 bp, Artificial Sequence
  Description of Artificial Sequence: Synthetic oligonucleotide
tgaggccctgagtctgaagtactgtgcttg

SEQ ID NO: 270598 - DNA, 29 bp, Artificial Sequence
  Description of Artificial Sequence: Synthetic oligonucleotide
gaggccctgagtctgaagtactgtgcttg

SEQ ID NO: 270599 - DNA, 32 bp, Artificial Sequence
  Description of Artificial Sequence: Synthetic oligonucleotide
aggccctgagtctgaagtactgtgcttgtaac

SEQ ID NO: 270600 - DNA, 31 bp, Artificial Sequence
  Description of Artificial Sequence: Synthetic oligonucleotide
ggccctgagtctgaagtactgtgcttgtaac

SEQ ID NO: 270601 - DNA, 31 bp, Artificial Sequence
  Description of Artificial Sequence: Synthetic oligonucleotide
gccctgagtctgaagtactgtgcttgtaacc

SEQ ID NO: 270602 - DNA, 34 bp, Artificial Sequence
  Description of Artificial Sequence: Synthetic oligonucleotide
ccctgagtctgaagtactgtgcttgtaacctaag

SEQ ID NO: 270603 - DNA, 35 bp, Artificial Sequence
  Description of Artificial Sequence: Synthetic oligonucleotide
cctgagtctgaagtactgtgcttgtaacctaagtg

SEQ ID NO: 270604 - DNA, 39 bp, Artificial Sequence
  Description of Artificial Sequence: Synthetic oligonucleotide
ctgagtctgaagtactgtgcttgtaacctaagtgatttg

SEQ ID NO: 270605 - DNA, 39 bp, Artificial Sequence
  Description of Artificial Sequence: Synthetic oligonucleotide
tgagtctgaagtactgtgcttgtaacctaagtgatttgg

SEQ ID NO: 270606 - DNA, 38 bp, Artificial Sequence
  Description of Artificial Sequence: Synthetic oligonucleotide
gagtctgaagtactgtgcttgtaacctaagtgatttgg

SEQ ID NO: 270607 - DNA, 41 bp, Artificial Sequence
  Description of Artificial Sequence: Synthetic oligonucleotide
agtctgaagtactgtgcttgtaacctaagtgatttggaatc

SEQ ID NO: 270608 - DNA, 40 bp, Artificial Sequence
  Description of Artificial Sequence: Synthetic oligonucleotide
gtctgaagtactgtgcttgtaacctaagtgatttggaatc

SEQ ID NO: 270609 - DNA, 42 bp, Artificial Sequence
  Description of Artificial Sequence: Synthetic oligonucleotide
tctgaagtactgtgcttgtaacctaagtgatttggaatctac

SEQ ID NO: 270610 - DNA, 41 bp, Artificial Sequence
  Description of Artificial Sequence: Synthetic oligonucleotide
ctgaagtactgtgcttgtaacctaagtgatttggaatctac

SEQ ID NO: 270611 - DNA, 43 bp, Artificial Sequence
  Description of Artificial Sequence: Synthetic oligonucleotide
tgaagtactgtgcttgtaacctaagtgatttggaatctacttg

SEQ ID NO: 270612 - DNA, 42 bp, Artificial Sequence
  Description of Artificial Sequence: Synthetic oligonucleotide
gaagtactgtgcttgtaacctaagtgatttggaatctacttg

SEQ ID NO: 270613 - DNA, 46 bp, Artificial Sequence
  Description of Artificial Sequence: Synthetic oligonucleotide
aagtactgtgcttgtaacctaagtgatttggaatctacttgtttag

SEQ ID NO: 270614 - DNA, 45 bp, Artificial Sequence
  Description of Artificial Sequence: Synthetic oligonucleotide
agtactgtgcttgtaacctaagtgatttggaatctacttgtttag

SEQ ID NO: 270615 - DNA, 44 bp, Artificial Sequence
  Description of Artificial Sequence: Synthetic oligonucleotide
gtactgtgcttgtaacctaagtgatttggaatctacttgtttag

SEQ ID NO: 270616 - DNA, 45 bp, Artificial Sequence
  Description of Artificial Sequence: Synthetic oligonucleotide
tactgtgcttgtaacctaagtgatttggaatctacttgtttagtg

SEQ ID NO: 270617 - DNA, 44 bp, Artificial Sequence
  Description of Artificial Sequence: Synthetic oligonucleotide
actgtgcttgtaacctaagtgatttggaatctacttgtttagtg

SEQ ID NO: 270618 - DNA, 43 bp, Artificial Sequence
  Description of Artificial Sequence: Synthetic oligonucleotide
ctgtgcttgtaacctaagtgatttggaatctacttgtttagtg

SEQ ID NO: 270619 - DNA, 43 bp, Artificial Sequence
  Description of Artificial Sequence: Synthetic oligonucleotide
tgtgcttgtaacctaagtgatttggaatctacttgtttagtgg

SEQ ID NO: 270620 - DNA, 42 bp, Artificial Sequence
  Description of Artificial Sequence: Synthetic oligonucleotide
gtgcttgtaacctaagtgatttggaatctacttgtttagtgg

SEQ ID NO: 270621 - DNA, 42 bp, Artificial Sequence
  Description of Artificial Sequence: Synthetic oligonucleotide
tgcttgtaacctaagtgatttggaatctacttgtttagtggg

SEQ ID NO: 270622 - DNA, 41 bp, Artificial Sequence
  Description of Artificial Sequence: Synthetic oligonucleotide
gcttgtaacctaagtgatttggaatctacttgtttagtggg

SEQ ID NO: 270623 - DNA, 42 bp, Artificial Sequence
  Description of Artificial Sequence: Synthetic oligonucleotide
cttgtaacctaagtgatttggaatctacttgtttagtgggtg

SEQ ID NO: 270624 - DNA, 43 bp, Artificial Sequence
  Description of Artificial Sequence: Synthetic oligonucleotide
ttgtaacctaagtgatttggaatctacttgtttagtgggtgtg

SEQ ID NO: 270625 - DNA, 42 bp, Artificial Sequence
  Description of Artificial Sequence: Synthetic oligonucleotide
tgtaacctaagtgatttggaatctacttgtttagtgggtgtg

SEQ ID NO: 270626 - DNA, 41 bp, Artificial Sequence
  Description of Artificial Sequence: Synthetic oligonucleotide
gtaacctaagtgatttggaatctacttgtttagtgggtgtg

SEQ ID NO: 270627 - DNA, 41 bp, Artificial Sequence
  Description of Artificial Sequence: Synthetic oligonucleotide
taacctaagtgatttggaatctacttgtttagtgggtgtgg

SEQ ID NO: 270628 - DNA, 40 bp, Artificial Sequence
  Description of Artificial Sequence: Synthetic oligonucleotide
aacctaagtgatttggaatctacttgtttagtgggtgtgg

SEQ ID NO: 270629 - DNA, 39 bp, Artificial Sequence
  Description of Artificial Sequence: Synthetic oligonucleotide
acctaagtgatttggaatctacttgtttagtgggtgtgg

SEQ ID NO: 270630 - DNA, 38 bp, Artificial Sequence
  Description of Artificial Sequence: Synthetic oligonucleotide
cctaagtgatttggaatctacttgtttagtgggtgtgg

SEQ ID NO: 270631 - DNA, 39 bp, Artificial Sequence
  Description of Artificial Sequence: Synthetic oligonucleotide
ctaagtgatttggaatctacttgtttagtgggtgtggtg

SEQ ID NO: 270632 - DNA, 40 bp, Artificial Sequence
  Description of Artificial Sequence: Synthetic oligonucleotide
taagtgatttggaatctacttgtttagtgggtgtggtgag

SEQ ID NO: 270633 - DNA, 39 bp, Artificial Sequence
  Description of Artificial Sequence: Synthetic oligonucleotide
aagtgatttggaatctacttgtttagtgggtgtggtgag

SEQ ID NO: 270634 - DNA, 38 bp, Artificial Sequence
  Description of Artificial Sequence: Synthetic oligonucleotide
agtgatttggaatctacttgtttagtgggtgtggtgag

SEQ ID NO: 270635 - DNA, 37 bp, Artificial Sequence
  Description of Artificial Sequence: Synthetic oligonucleotide
gtgatttggaatctacttgtttagtgggtgtggtgag

SEQ ID NO: 270636 - DNA, 38 bp, Artificial Sequence
  Description of Artificial Sequence: Synthetic oligonucleotide
tgatttggaatctacttgtttagtgggtgtggtgagag

SEQ ID NO: 270637 - DNA, 37 bp, Artificial Sequence
  Description of Artificial Sequence: Synthetic oligonucleotide
gatttggaatctacttgtttagtgggtgtggtgagag

SEQ ID NO: 270638 - DNA, 37 bp, Artificial Sequence
  Description of Artificial Sequence: Synthetic oligonucleotide
atttggaatctacttgtttagtgggtgtggtgagagg

SEQ ID NO: 270639 - DNA, 36 bp, Artificial Sequence
  Description of Artificial Sequence: Synthetic oligonucleotide
tttggaatctacttgtttagtgggtgtggtgagagg

SEQ ID NO: 270640 - DNA, 35 bp, Artificial Sequence
  Description of Artificial Sequence: Synthetic oligonucleotide
ttggaatctacttgtttagtgggtgtggtgagagg

SEQ ID NO: 270641 - DNA, 34 bp, Artificial Sequence
  Description of Artificial Sequence: Synthetic oligonucleotide
tggaatctacttgtttagtgggtgtggtgagagg

SEQ ID NO: 270642 - DNA, 33 bp, Artificial Sequence
  Description of Artificial Sequence: Synthetic oligonucleotide
ggaatctacttgtttagtgggtgtggtgagagg

SEQ ID NO: 270643 - DNA, 35 bp, Artificial Sequence
  Description of Artificial Sequence: Synthetic oligonucleotide
gaatctacttgtttagtgggtgtggtgagaggatg

SEQ ID NO: 270644 - DNA, 35 bp, Artificial Sequence
  Description of Artificial Sequence: Synthetic oligonucleotide
aatctacttgtttagtgggtgtggtgagaggatgg

SEQ ID NO: 270645 - DNA, 34 bp, Artificial Sequence
  Description of Artificial Sequence: Synthetic oligonucleotide
atctacttgtttagtgggtgtggtgagaggatgg

SEQ ID NO: 270646 - DNA, 33 bp, Artificial Sequence
  Description of Artificial Sequence: Synthetic oligonucleotide
tctacttgtttagtgggtgtggtgagaggatgg

SEQ ID NO: 270647 - DNA, 32 bp, Artificial Sequence
  Description of Artificial Sequence: Synthetic oligonucleotide
ctacttgtttagtgggtgtggtgagaggatgg

SEQ ID NO: 270648 - DNA, 32 bp, Artificial Sequence
  Description of Artificial Sequence: Synthetic oligonucleotide
tacttgtttagtgggtgtggtgagaggatggg

SEQ ID NO: 270649 - DNA, 31 bp, Artificial Sequence
  Description of Artificial Sequence: Synthetic oligonucleotide
acttgtttagtgggtgtggtgagaggatggg

SEQ ID NO: 270650 - DNA, 30 bp, Artificial Sequence
  Description of Artificial Sequence: Synthetic oligonucleotide
cttgtttagtgggtgtggtgagaggatggg

SEQ ID NO: 270651 - DNA, 30 bp, Artificial Sequence
  Description of Artificial Sequence: Synthetic oligonucleotide
ttgtttagtgggtgtggtgagaggatgggc

SEQ ID NO: 270652 - DNA, 29 bp, Artificial Sequence
  Description of Artificial Sequence: Synthetic oligonucleotide
tgtttagtgggtgtggtgagaggatgggc

SEQ ID NO: 270653 - DNA, 28 bp, Artificial Sequence
  Description of Artificial Sequence: Synthetic oligonucleotide
gtttagtgggtgtggtgagaggatgggc

SEQ ID NO: 270654 - DNA, 30 bp, Artificial Sequence
  Description of Artificial Sequence: Synthetic oligonucleotide
tttagtgggtgtggtgagaggatgggcaac

SEQ ID NO: 270655 - DNA, 29 bp, Artificial Sequence
  Description of Artificial Sequence: Synthetic oligonucleotide
ttagtgggtgtggtgagaggatgggcaac

SEQ ID NO: 270656 - DNA, 28 bp, Artificial Sequence
  Description of Artificial Sequence: Synthetic oligonucleotide
tagtgggtgtggtgagaggatgggcaac

SEQ ID NO: 270657 - DNA, 27 bp, Artificial Sequence
  Description of Artificial Sequence: Synthetic oligonucleotide
agtgggtgtggtgagaggatgggcaac

SEQ ID NO: 270658 - DNA, 27 bp, Artificial Sequence
  Description of Artificial Sequence: Synthetic oligonucleotide
gtgggtgtggtgagaggatgggcaaca

SEQ ID NO: 270659 - DNA, 28 bp, Artificial Sequence
  Description of Artificial Sequence: Synthetic oligonucleotide
tgggtgtggtgagaggatgggcaacatg

SEQ ID NO: 270660 - DNA, 27 bp, Artificial Sequence
  Description of Artificial Sequence: Synthetic oligonucleotide
gggtgtggtgagaggatgggcaacatg

SEQ ID NO: 270661 - DNA, 27 bp, Artificial Sequence
  Description of Artificial Sequence: Synthetic oligonucleotide
ggtgtggtgagaggatgggcaacatgc

SEQ ID NO: 270662 - DNA, 27 bp, Artificial Sequence
  Description of Artificial Sequence: Synthetic oligonucleotide
gtgtggtgagaggatgggcaacatgcc

SEQ ID NO: 270663 - DNA, 29 bp, Artificial Sequence
  Description of Artificial Sequence: Synthetic oligonucleotide
tgtggtgagaggatgggcaacatgccaag

SEQ ID NO: 270664 - DNA, 28 bp, Artificial Sequence
  Description of Artificial Sequence: Synthetic oligonucleotide
gtggtgagaggatgggcaacatgccaag

SEQ ID NO: 270665 - DNA, 28 bp, Artificial Sequence
  Description of Artificial Sequence: Synthetic oligonucleotide
tggtgagaggatgggcaacatgccaagg

SEQ ID NO: 270666 - DNA, 27 bp, Artificial Sequence
  Description of Artificial Sequence: Synthetic oligonucleotide
ggtgagaggatgggcaacatgccaagg

SEQ ID NO: 270667 - DNA, 27 bp, Artificial Sequence
  Description of Artificial Sequence: Synthetic oligonucleotide
gtgagaggatgggcaacatgccaaggc

SEQ ID NO: 270668 - DNA, 27 bp, Artificial Sequence
  Description of Artificial Sequence: Synthetic oligonucleotide
tgagaggatgggcaacatgccaaggcc

SEQ ID NO: 270669 - DNA, 27 bp, Artificial Sequence
  Description of Artificial Sequence: Synthetic oligonucleotide
gagaggatgggcaacatgccaaggcct

SEQ ID NO: 270670 - DNA, 27 bp, Artificial Sequence
  Description of Artificial Sequence: Synthetic oligonucleotide
agaggatgggcaacatgccaaggcctc

SEQ ID NO: 270671 - DNA, 27 bp, Artificial Sequence
  Description of Artificial Sequence: Synthetic oligonucleotide
gaggatgggcaacatgccaaggcctca

SEQ ID NO: 270672 - DNA, 28 bp, Artificial Sequence
  Description of Artificial Sequence: Synthetic oligonucleotide
aggatgggcaacatgccaaggcctcaac

SEQ ID NO: 270673 - DNA, 27 bp, Artificial Sequence
  Description of Artificial Sequence: Synthetic oligonucleotide
ggatgggcaacatgccaaggcctcaac

SEQ ID NO: 270674 - DNA, 29 bp, Artificial Sequence
  Description of Artificial Sequence: Synthetic oligonucleotide
gatgggcaacatgccaaggcctcaactac

SEQ ID NO: 270675 - DNA, 29 bp, Artificial Sequence
  Description of Artificial Sequence: Synthetic oligonucleotide
atgggcaacatgccaaggcctcaactacg

SEQ ID NO: 270676 - DNA, 28 bp, Artificial Sequence
  Description of Artificial Sequence: Synthetic oligonucleotide
tgggcaacatgccaaggcctcaactacg

SEQ ID NO: 270677 - DNA, 27 bp, Artificial Sequence
  Description of Artificial Sequence: Synthetic oligonucleotide
gggcaacatgccaaggcctcaactacg

SEQ ID NO: 270678 - DNA, 28 bp, Artificial Sequence
  Description of Artificial Sequence: Synthetic oligonucleotide
ggcaacatgccaaggcctcaactacgtg

SEQ ID NO: 270679 - DNA, 28 bp, Artificial Sequence
  Description of Artificial Sequence: Synthetic oligonucleotide
gcaacatgccaaggcctcaactacgtgg

SEQ ID NO: 270680 - DNA, 29 bp, Artificial Sequence
  Description of Artificial Sequence: Synthetic oligonucleotide
caacatgccaaggcctcaactacgtggtc

SEQ ID NO: 270681 - DNA, 30 bp, Artificial Sequence
  Description of Artificial Sequence: Synthetic oligonucleotide
aacatgccaaggcctcaactacgtggtcag

SEQ ID NO: 270682 - DNA, 29 bp, Artificial Sequence
  Description of Artificial Sequence: Synthetic oligonucleotide
acatgccaaggcctcaactacgtggtcag

SEQ ID NO: 270683 - DNA, 28 bp, Artificial Sequence
  Description of Artificial Sequence: Synthetic oligonucleotide
catgccaaggcctcaactacgtggtcag

SEQ ID NO: 270684 - DNA, 29 bp, Artificial Sequence
  Description of Artificial Sequence: Synthetic oligonucleotide
atgccaaggcctcaactacgtggtcagtg

SEQ ID NO: 270685 - DNA, 28 bp, Artificial Sequence
  Description of Artificial Sequence: Synthetic oligonucleotide
tgccaaggcctcaactacgtggtcagtg

SEQ ID NO: 270686 - DNA, 27 bp, Artificial Sequence
  Description of Artificial Sequence: Synthetic oligonucleotide
gccaaggcctcaactacgtggtcagtg

SEQ ID NO: 270687 - DNA, 29 bp, Artificial Sequence
  Description of Artificial Sequence: Synthetic oligonucleotide
ccaaggcctcaactacgtggtcagtgaag

SEQ ID NO: 270688 - DNA, 29 bp, Artificial Sequence
  Description of Artificial Sequence: Synthetic oligonucleotide
caaggcctcaactacgtggtcagtgaagg

SEQ ID NO: 270689 - DNA, 29 bp, Artificial Sequence
  Description of Artificial Sequence: Synthetic oligonucleotide
aaggcctcaactacgtggtcagtgaaggc

SEQ ID NO: 270690 - DNA, 28 bp, Artificial Sequence
  Description of Artificial Sequence: Synthetic oligonucleotide
aggcctcaactacgtggtcagtgaaggc

SEQ ID NO: 270691 - DNA, 27 bp, Artificial Sequence
  Description of Artificial Sequence: Synthetic oligonucleotide
ggcctcaactacgtggtcagtgaaggc

SEQ ID NO: 270692 - DNA, 29 bp, Artificial Sequence
  Description of Artificial Sequence: Synthetic oligonucleotide
gcctcaactacgtggtcagtgaaggcaac

SEQ ID NO: 270693 - DNA, 29 bp, Artificial Sequence
  Description of Artificial Sequence: Synthetic oligonucleotide
cctcaactacgtggtcagtgaaggcaacc

SEQ ID NO: 270694 - DNA, 29 bp, Artificial Sequence
  Description of Artificial Sequence: Synthetic oligonucleotide
ctcaactacgtggtcagtgaaggcaaccg

SEQ ID NO: 270695 - DNA, 29 bp, Artificial Sequence
  Description of Artificial Sequence: Synthetic oligonucleotide
tcaactacgtggtcagtgaaggcaaccgg

SEQ ID NO: 270696 - DNA, 28 bp, Artificial Sequence
  Description of Artificial Sequence: Synthetic oligonucleotide
caactacgtggtcagtgaaggcaaccgg

SEQ ID NO: 270697 - DNA, 32 bp, Artificial Sequence
  Description of Artificial Sequence: Synthetic oligonucleotide
aactacgtggtcagtgaaggcaaccggattac

SEQ ID NO: 270698 - DNA, 31 bp, Artificial Sequence
  Description of Artificial Sequence: Synthetic oligonucleotide
actacgtggtcagtgaaggcaaccggattac

SEQ ID NO: 270699 - DNA, 30 bp, Artificial Sequence
  Description of Artificial Sequence: Synthetic oligonucleotide
ctacgtggtcagtgaaggcaaccggattac

SEQ ID NO: 270700 - DNA, 31 bp, Artificial Sequence
  Description of Artificial Sequence: Synthetic oligonucleotide
tacgtggtcagtgaaggcaaccggattacag

SEQ ID NO: 270701 - DNA, 30 bp, Artificial Sequence
  Description of Artificial Sequence: Synthetic oligonucleotide
acgtggtcagtgaaggcaaccggattacag

SEQ ID NO: 270702 - DNA, 29 bp, Artificial Sequence
  Description of Artificial Sequence: Synthetic oligonucleotide
cgtggtcagtgaaggcaaccggattacag

SEQ ID NO: 270703 - DNA, 29 bp, Artificial Sequence
  Description of Artificial Sequence: Synthetic oligonucleotide
gtggtcagtgaaggcaaccggattacagg

SEQ ID NO: 270704 - DNA, 29 bp, Artificial Sequence
  Description of Artificial Sequence: Synthetic oligonucleotide
tggtcagtgaaggcaaccggattacaggg

SEQ ID NO: 270705 - DNA, 28 bp, Artificial Sequence
  Description of Artificial Sequence: Synthetic oligonucleotide
ggtcagtgaaggcaaccggattacaggg

SEQ ID NO: 270706 - DNA, 28 bp, Artificial Sequence
  Description of Artificial Sequence: Synthetic oligonucleotide
gtcagtgaaggcaaccggattacagggg

SEQ ID NO: 270707 - DNA, 28 bp, Artificial Sequence
  Description of Artificial Sequence: Synthetic oligonucleotide
tcagtgaaggcaaccggattacaggggc

SEQ ID NO: 270708 - DNA, 27 bp, Artificial Sequence
  Description of Artificial Sequence: Synthetic oligonucleotide
cagtgaaggcaaccggattacaggggc

SEQ ID NO: 270709 - DNA, 27 bp, Artificial Sequence
  Description of Artificial Sequence: Synthetic oligonucleotide
agtgaaggcaaccggattacaggggcc

SEQ ID NO: 270710 - DNA, 27 bp, Artificial Sequence
  Description of Artificial Sequence: Synthetic oligonucleotide
gtgaaggcaaccggattacaggggcca

SEQ ID NO: 270711 - DNA, 27 bp, Artificial Sequence
  Description of Artificial Sequence: Synthetic oligonucleotide
tgaaggcaaccggattacaggggccag

SEQ ID NO: 270712 - DNA, 26 bp, Artificial Sequence
  Description of Artificial Sequence: Synthetic oligonucleotide
gaaggcaaccggattacaggggccag

SEQ ID NO: 270713 - DNA, 27 bp, Artificial Sequence
  Description of Artificial Sequence: Synthetic oligonucleotide
aaggcaaccggattacaggggccagct

SEQ ID NO: 270714 - DNA, 27 bp, Artificial Sequence
  Description of Artificial Sequence: Synthetic oligonucleotide
aggcaaccggattacaggggccagctt

SEQ ID NO: 270715 - DNA, 26 bp, Artificial Sequence
  Description of Artificial Sequence: Synthetic oligonucleotide
ggcaaccggattacaggggccagctt

SEQ ID NO: 270716 - DNA, 27 bp, Artificial Sequence
  Description of Artificial Sequence: Synthetic oligonucleotide
gcaaccggattacaggggccagcttct

SEQ ID NO: 270717 - DNA, 27 bp, Artificial Sequence
  Description of Artificial Sequence: Synthetic oligonucleotide
caaccggattacaggggccagcttctc

SEQ ID NO: 270718 - DNA, 28 bp, Artificial Sequence
  Description of Artificial Sequence: Synthetic oligonucleotide
aaccggattacaggggccagcttctctg

SEQ ID NO: 270719 - DNA, 27 bp, Artificial Sequence
  Description of Artificial Sequence: Synthetic oligonucleotide
accggattacaggggccagcttctctg

SEQ ID NO: 270720 - DNA, 27 bp, Artificial Sequence
  Description of Artificial Sequence: Synthetic oligonucleotide
ccggattacaggggccagcttctctgt

SEQ ID NO: 270721 - DNA, 28 bp, Artificial Sequence
  Description of Artificial Sequence: Synthetic oligonucleotide
cggattacaggggccagcttctctgttg

SEQ ID NO: 270722 - DNA, 28 bp, Artificial Sequence
  Description of Artificial Sequence: Synthetic oligonucleotide
ggattacaggggccagcttctctgttgg

SEQ ID NO: 270723 - DNA, 30 bp, Artificial Sequence
  Description of Artificial Sequence: Synthetic oligonucleotide
gattacaggggccagcttctctgttggttc

SEQ ID NO: 270724 - DNA, 31 bp, Artificial Sequence
  Description of Artificial Sequence: Synthetic oligonucleotide
attacaggggccagcttctctgttggttctg

SEQ ID NO: 270725 - DNA, 30 bp, Artificial Sequence
  Description of Artificial Sequence: Synthetic oligonucleotide
ttacaggggccagcttctctgttggttctg

SEQ ID NO: 270726 - DNA, 29 bp, Artificial Sequence
  Description of Artificial Sequence: Synthetic oligonucleotide
tacaggggccagcttctctgttggttctg

SEQ ID NO: 270727 - DNA, 28 bp, Artificial Sequence
  Description of Artificial Sequence: Synthetic oligonucleotide
acaggggccagcttctctgttggttctg

SEQ ID NO: 270728 - DNA, 27 bp, Artificial Sequence
  Description of Artificial Sequence: Synthetic oligonucleotide
caggggccagcttctctgttggttctg

SEQ ID NO: 270729 - DNA, 27 bp, Artificial Sequence
  Description of Artificial Sequence: Synthetic oligonucleotide
aggggccagcttctctgttggttctgg

SEQ ID NO: 270730 - DNA, 26 bp, Artificial Sequence
  Description of Artificial Sequence: Synthetic oligonucleotide
ggggccagcttctctgttggttctgg

SEQ ID NO: 270731 - DNA, 27 bp, Artificial Sequence
  Description of Artificial Sequence: Synthetic oligonucleotide
gggccagcttctctgttggttctggca

SEQ ID NO: 270732 - DNA, 27 bp, Artificial Sequence
  Description of Artificial Sequence: Synthetic oligonucleotide
ggccagcttctctgttggttctggcac

SEQ ID NO: 270733 - DNA, 28 bp, Artificial Sequence
  Description of Artificial Sequence: Synthetic oligonucleotide
gccagcttctctgttggttctggcactg

SEQ ID NO: 270734 - DNA, 29 bp, Artificial Sequence
  Description of Artificial Sequence: Synthetic oligonucleotide
ccagcttctctgttggttctggcactgtg

SEQ ID NO: 270735 - DNA, 32 bp, Artificial Sequence
  Description of Artificial Sequence: Synthetic oligonucleotide
cagcttctctgttggttctggcactgtgtatg

SEQ ID NO: 270736 - DNA, 32 bp, Artificial Sequence
  Description of Artificial Sequence: Synthetic oligonucleotide
agcttctctgttggttctggcactgtgtatgg

SEQ ID NO: 270737 - DNA, 31 bp, Artificial Sequence
  Description of Artificial Sequence: Synthetic oligonucleotide
gcttctctgttggttctggcactgtgtatgg

SEQ ID NO: 270738 - DNA, 35 bp, Artificial Sequence
  Description of Artificial Sequence: Synthetic oligonucleotide
cttctctgttggttctggcactgtgtatggatatg

SEQ ID NO: 270739 - DNA, 35 bp, Artificial Sequence
  Description of Artificial Sequence: Synthetic oligonucleotide
ttctctgttggttctggcactgtgtatggatatgg

SEQ ID NO: 270740 - DNA, 34 bp, Artificial Sequence
  Description of Artificial Sequence: Synthetic oligonucleotide
tctctgttggttctggcactgtgtatggatatgg

SEQ ID NO: 270741 - DNA, 33 bp, Artificial Sequence
  Description of Artificial Sequence: Synthetic oligonucleotide
ctctgttggttctggcactgtgtatggatatgg

SEQ ID NO: 270742 - DNA, 33 bp, Artificial Sequence
  Description of Artificial Sequence: Synthetic oligonucleotide
tctgttggttctggcactgtgtatggatatggg

SEQ ID NO: 270743 - DNA, 32 bp, Artificial Sequence
  Description of Artificial Sequence: Synthetic oligonucleotide
ctgttggttctggcactgtgtatggatatggg

SEQ ID NO: 270744 - DNA, 32 bp, Artificial Sequence
  Description of Artificial Sequence: Synthetic oligonucleotide
tgttggttctggcactgtgtatggatatgggg

SEQ ID NO: 270745 - DNA, 31 bp, Artificial Sequence
  Description of Artificial Sequence: Synthetic oligonucleotide
gttggttctggcactgtgtatggatatgggg

SEQ ID NO: 270746 - DNA, 32 bp, Artificial Sequence
  Description of Artificial Sequence: Synthetic oligonucleotide
ttggttctggcactgtgtatggatatggggtg

SEQ ID NO: 270747 - DNA, 31 bp, Artificial Sequence
  Description of Artificial Sequence: Synthetic oligonucleotide
tggttctggcactgtgtatggatatggggtg

SEQ ID NO: 270748 - DNA, 30 bp, Artificial Sequence
  Description of Artificial Sequence: Synthetic oligonucleotide
ggttctggcactgtgtatggatatggggtg

SEQ ID NO: 270749 - DNA, 32 bp, Artificial Sequence
  Description of Artificial Sequence: Synthetic oligonucleotide
gttctggcactgtgtatggatatggggtgatg

SEQ ID NO: 270750 - DNA, 32 bp, Artificial Sequence
  Description of Artificial Sequence: Synthetic oligonucleotide
ttctggcactgtgtatggatatggggtgatgg

SEQ ID NO: 270751 - DNA, 31 bp, Artificial Sequence
  Description of Artificial Sequence: Synthetic oligonucleotide
tctggcactgtgtatggatatggggtgatgg

SEQ ID NO: 270752 - DNA, 30 bp, Artificial Sequence
  Description of Artificial Sequence: Synthetic oligonucleotide
ctggcactgtgtatggatatggggtgatgg

SEQ ID NO: 270753 - DNA, 32 bp, Artificial Sequence
  Description of Artificial Sequence: Synthetic oligonucleotide
tggcactgtgtatggatatggggtgatggatc

SEQ ID NO: 270754 - DNA, 31 bp, Artificial Sequence
  Description of Artificial Sequence: Synthetic oligonucleotide
ggcactgtgtatggatatggggtgatggatc

SEQ ID NO: 270755 - DNA, 31 bp, Artificial Sequence
  Description of Artificial Sequence: Synthetic oligonucleotide
gcactgtgtatggatatggggtgatggatcg

SEQ ID NO: 270756 - DNA, 31 bp, Artificial Sequence
  Description of Artificial Sequence: Synthetic oligonucleotide
cactgtgtatggatatggggtgatggatcgg

SEQ ID NO: 270757 - DNA, 31 bp, Artificial Sequence
  Description of Artificial Sequence: Synthetic oligonucleotide
actgtgtatggatatggggtgatggatcggc

SEQ ID NO: 270758 - DNA, 30 bp, Artificial Sequence
  Description of Artificial Sequence: Synthetic oligonucleotide
ctgtgtatggatatggggtgatggatcggc

SEQ ID NO: 270759 - DNA, 30 bp, Artificial Sequence
  Description of Artificial Sequence: Synthetic oligonucleotide
tgtgtatggatatggggtgatggatcggcg

SEQ ID NO: 270760 - DNA, 29 bp, Artificial Sequence
  Description of Artificial Sequence: Synthetic oligonucleotide
gtgtatggatatggggtgatggatcggcg

SEQ ID NO: 270761 - DNA, 29 bp, Artificial Sequence
  Description of Artificial Sequence: Synthetic oligonucleotide
tgtatggatatggggtgatggatcggcgc

SEQ ID NO: 270762 - DNA, 28 bp, Artificial Sequence
  Description of Artificial Sequence: Synthetic oligonucleotide
gtatggatatggggtgatggatcggcgc

SEQ ID NO: 270763 - DNA, 32 bp, Artificial Sequence
  Description of Artificial Sequence: Synthetic oligonucleotide
tatggatatggggtgatggatcggcgctattc

SEQ ID NO: 270764 - DNA, 31 bp, Artificial Sequence
  Description of Artificial Sequence: Synthetic oligonucleotide
atggatatggggtgatggatcggcgctattc

SEQ ID NO: 270765 - DNA, 30 bp, Artificial Sequence
  Description of Artificial Sequence: Synthetic oligonucleotide
tggatatggggtgatggatcggcgctattc

SEQ ID NO: 270766 - DNA, 29 bp, Artificial Sequence
  Description of Artificial Sequence: Synthetic oligonucleotide
ggatatggggtgatggatcggcgctattc

SEQ ID NO: 270767 - DNA, 29 bp, Artificial Sequence
  Description of Artificial Sequence: Synthetic oligonucleotide
gatatggggtgatggatcggcgctattcc

SEQ ID NO: 270768 - DNA, 32 bp, Artificial Sequence
  Description of Artificial Sequence: Synthetic oligonucleotide
atatggggtgatggatcggcgctattcctttg

SEQ ID NO: 270769 - DNA, 31 bp, Artificial Sequence
  Description of Artificial Sequence: Synthetic oligonucleotide
tatggggtgatggatcggcgctattcctttg

SEQ ID NO: 270770 - DNA, 30 bp, Artificial Sequence
  Description of Artificial Sequence: Synthetic oligonucleotide
atggggtgatggatcggcgctattcctttg

SEQ ID NO: 270771 - DNA, 29 bp, Artificial Sequence
  Description of Artificial Sequence: Synthetic oligonucleotide
tggggtgatggatcggcgctattcctttg

SEQ ID NO: 270772 - DNA, 28 bp, Artificial Sequence
  Description of Artificial Sequence: Synthetic oligonucleotide
ggggtgatggatcggcgctattcctttg

SEQ ID NO: 270773 - DNA, 29 bp, Artificial Sequence
  Description of Artificial Sequence: Synthetic oligonucleotide
gggtgatggatcggcgctattcctttgac

SEQ ID NO: 270774 - DNA, 29 bp, Artificial Sequence
  Description of Artificial Sequence: Synthetic oligonucleotide
ggtgatggatcggcgctattcctttgacc

SEQ ID NO: 270775 - DNA, 30 bp, Artificial Sequence
  Description of Artificial Sequence: Synthetic oligonucleotide
gtgatggatcggcgctattcctttgacctg

SEQ ID NO: 270776 - DNA, 30 bp, Artificial Sequence
  Description of Artificial Sequence: Synthetic oligonucleotide
tgatggatcggcgctattcctttgacctgg

SEQ ID NO: 270777 - DNA, 29 bp, Artificial Sequence
  Description of Artificial Sequence: Synthetic oligonucleotide
gatggatcggcgctattcctttgacctgg

SEQ ID NO: 270778 - DNA, 31 bp, Artificial Sequence
  Description of Artificial Sequence: Synthetic oligonucleotide
atggatcggcgctattcctttgacctggatg

SEQ ID NO: 270779 - DNA, 30 bp, Artificial Sequence
  Description of Artificial Sequence: Synthetic oligonucleotide
tggatcggcgctattcctttgacctggatg

SEQ ID NO: 270780 - DNA, 29 bp, Artificial Sequence
  Description of Artificial Sequence: Synthetic oligonucleotide
ggatcggcgctattcctttgacctggatg

SEQ ID NO: 270781 - DNA, 30 bp, Artificial Sequence
  Description of Artificial Sequence: Synthetic oligonucleotide
gatcggcgctattcctttgacctggatgtg

SEQ ID NO: 270782 - DNA, 30 bp, Artificial Sequence
  Description of Artificial Sequence: Synthetic oligonucleotide
atcggcgctattcctttgacctggatgtgg

SEQ ID NO: 270783 - DNA, 29 bp, Artificial Sequence
  Description of Artificial Sequence: Synthetic oligonucleotide
tcggcgctattcctttgacctggatgtgg

SEQ ID NO: 270784 - DNA, 28 bp, Artificial Sequence
  Description of Artificial Sequence: Synthetic oligonucleotide
cggcgctattcctttgacctggatgtgg

SEQ ID NO: 270785 - DNA, 29 bp, Artificial Sequence
  Description of Artificial Sequence: Synthetic oligonucleotide
ggcgctattcctttgacctggatgtggag

SEQ ID NO: 270786 - DNA, 29 bp, Artificial Sequence
  Description of Artificial Sequence: Synthetic oligonucleotide
gcgctattcctttgacctggatgtggagc

SEQ ID NO: 270787 - DNA, 30 bp, Artificial Sequence
  Description of Artificial Sequence: Synthetic oligonucleotide
cgctattcctttgacctggatgtggagcag

SEQ ID NO: 270788 - DNA, 30 bp, Artificial Sequence
  Description of Artificial Sequence: Synthetic oligonucleotide
gctattcctttgacctggatgtggagcagc

SEQ ID NO: 270789 - DNA, 30 bp, Artificial Sequence
  Description of Artificial Sequence: Synthetic oligonucleotide
ctattcctttgacctggatgtggagcagcc

SEQ ID NO: 270790 - DNA, 30 bp, Artificial Sequence
  Description of Artificial Sequence: Synthetic oligonucleotide
tattcctttgacctggatgtggagcagccc

SEQ ID NO: 270791 - DNA, 29 bp, Artificial Sequence
  Description of Artificial Sequence: Synthetic oligonucleotide
attcctttgacctggatgtggagcagccc

SEQ ID NO: 270792 - DNA, 28 bp, Artificial Sequence
  Description of Artificial Sequence: Synthetic oligonucleotide
ttcctttgacctggatgtggagcagccc

SEQ ID NO: 270793 - DNA, 27 bp, Artificial Sequence
  Description of Artificial Sequence: Synthetic oligonucleotide
tcctttgacctggatgtggagcagccc

SEQ ID NO: 270794 - DNA, 27 bp, Artificial Sequence
  Description of Artificial Sequence: Synthetic oligonucleotide
cctttgacctggatgtggagcagccct

SEQ ID NO: 270795 - DNA, 29 bp, Artificial Sequence
  Description of Artificial Sequence: Synthetic oligonucleotide
ctttgacctggatgtggagcagccctatg

SEQ ID NO: 270796 - DNA, 31 bp, Artificial Sequence
  Description of Artificial Sequence: Synthetic oligonucleotide
tttgacctggatgtggagcagccctatgatc

SEQ ID NO: 270797 - DNA, 30 bp, Artificial Sequence
  Description of Artificial Sequence: Synthetic oligonucleotide
ttgacctggatgtggagcagccctatgatc

SEQ ID NO: 270798 - DNA, 29 bp, Artificial Sequence
  Description of Artificial Sequence: Synthetic oligonucleotide
tgacctggatgtggagcagccctatgatc

SEQ ID NO: 270799 - DNA, 28 bp, Artificial Sequence
  Description of Artificial Sequence: Synthetic oligonucleotide
gacctggatgtggagcagccctatgatc

SEQ ID NO: 270800 - DNA, 29 bp, Artificial Sequence
  Description of Artificial Sequence: Synthetic oligonucleotide
acctggatgtggagcagccctatgatcag

SEQ ID NO: 270801 - DNA, 28 bp, Artificial Sequence
  Description of Artificial Sequence: Synthetic oligonucleotide
cctggatgtggagcagccctatgatcag

SEQ ID NO: 270802 - DNA, 28 bp, Artificial Sequence
  Description of Artificial Sequence: Synthetic oligonucleotide
ctggatgtggagcagccctatgatcagg

SEQ ID NO: 270803 - DNA, 28 bp, Artificial Sequence
  Description of Artificial Sequence: Synthetic oligonucleotide
tggatgtggagcagccctatgatcaggc

SEQ ID NO: 270804 - DNA, 27 bp, Artificial Sequence
  Description of Artificial Sequence: Synthetic oligonucleotide
ggatgtggagcagccctatgatcaggc

SEQ ID NO: 270805 - DNA, 27 bp, Artificial Sequence
  Description of Artificial Sequence: Synthetic oligonucleotide
gatgtggagcagccctatgatcaggcc

SEQ ID NO: 270806 - DNA, 27 bp, Artificial Sequence
  Description of Artificial Sequence: Synthetic oligonucleotide
atgtggagcagccctatgatcaggccc

SEQ ID NO: 270807 - DNA, 26 bp, Artificial Sequence
  Description of Artificial Sequence: Synthetic oligonucleotide
tgtggagcagccctatgatcaggccc

SEQ ID NO: 270808 - DNA, 25 bp, Artificial Sequence
  Description of Artificial Sequence: Synthetic oligonucleotide
gtggagcagccctatgatcaggccc

SEQ ID NO: 270809 - DNA, 26 bp, Artificial Sequence
  Description of Artificial Sequence: Synthetic oligonucleotide
tggagcagccctatgatcaggcccgt

SEQ ID NO: 270810 - DNA, 25 bp, Artificial Sequence
  Description of Artificial Sequence: Synthetic oligonucleotide
ggagcagccctatgatcaggcccgt

SEQ ID NO: 270811 - DNA, 25 bp, Artificial Sequence
  Description of Artificial Sequence: Synthetic oligonucleotide
gagcagccctatgatcaggcccgtc

SEQ ID NO: 270812 - DNA, 26 bp, Artificial Sequence
  Description of Artificial Sequence: Synthetic oligonucleotide
agcagccctatgatcaggcccgtcgt

SEQ ID NO: 270813 - DNA, 25 bp, Artificial Sequence
  Description of Artificial Sequence: Synthetic oligonucleotide
gcagccctatgatcaggcccgtcgt

SEQ ID NO: 270814 - DNA, 25 bp, Artificial Sequence
  Description of Artificial Sequence: Synthetic oligonucleotide
cagccctatgatcaggcccgtcgtg

SEQ ID NO: 270815 - DNA, 25 bp, Artificial Sequence
  Description of Artificial Sequence: Synthetic oligonucleotide
agccctatgatcaggcccgtcgtgc

SEQ ID NO: 270816 - DNA, 24 bp, Artificial Sequence
  Description of Artificial Sequence: Synthetic oligonucleotide
gccctatgatcaggcccgtcgtgc

SEQ ID NO: 270817 - DNA, 26 bp, Artificial Sequence
  Description of Artificial Sequence: Synthetic oligonucleotide
ccctatgatcaggcccgtcgtgccat

SEQ ID NO: 270818 - DNA, 27 bp, Artificial Sequence
  Description of Artificial Sequence: Synthetic oligonucleotide
cctatgatcaggcccgtcgtgccatct

SEQ ID NO: 270819 - DNA, 28 bp, Artificial Sequence
  Description of Artificial Sequence: Synthetic oligonucleotide
ctatgatcaggcccgtcgtgccatctac

SEQ ID NO: 270820 - DNA, 28 bp, Artificial Sequence
  Description of Artificial Sequence: Synthetic oligonucleotide
tatgatcaggcccgtcgtgccatctacg

SEQ ID NO: 270821 - DNA, 27 bp, Artificial Sequence
  Description of Artificial Sequence: Synthetic oligonucleotide
atgatcaggcccgtcgtgccatctacg

SEQ ID NO: 270822 - DNA, 27 bp, Artificial Sequence
  Description of Artificial Sequence: Synthetic oligonucleotide
tgatcaggcccgtcgtgccatctacga

SEQ ID NO: 270823 - DNA, 27 bp, Artificial Sequence
  Description of Artificial Sequence: Synthetic oligonucleotide
gatcaggcccgtcgtgccatctacgaa

SEQ ID NO: 270824 - DNA, 27 bp, Artificial Sequence
  Description of Artificial Sequence: Synthetic oligonucleotide
atcaggcccgtcgtgccatctacgaag

SEQ ID NO: 270825 - DNA, 26 bp, Artificial Sequence
  Description of Artificial Sequence: Synthetic oligonucleotide
tcaggcccgtcgtgccatctacgaag

SEQ ID NO: 270826 - DNA, 25 bp, Artificial Sequence
  Description of Artificial Sequence: Synthetic oligonucleotide
caggcccgtcgtgccatctacgaag

SEQ ID NO: 270827 - DNA, 25 bp, Artificial Sequence
  Description of Artificial Sequence: Synthetic oligonucleotide
aggcccgtcgtgccatctacgaagc

SEQ ID NO: 270828 - DNA, 24 bp, Artificial Sequence
  Description of Artificial Sequence: Synthetic oligonucleotide
ggcccgtcgtgccatctacgaagc

SEQ ID NO: 270829 - DNA, 25 bp, Artificial Sequence
  Description of Artificial Sequence: Synthetic oligonucleotide
gcccgtcgtgccatctacgaagcca

SEQ ID NO: 270830 - DNA, 25 bp, Artificial Sequence
  Description of Artificial Sequence: Synthetic oligonucleotide
cccgtcgtgccatctacgaagccac

SEQ ID NO: 270831 - DNA, 27 bp, Artificial Sequence
  Description of Artificial Sequence: Synthetic oligonucleotide
ccgtcgtgccatctacgaagccacctt

SEQ ID NO: 270832 - DNA, 27 bp, Artificial Sequence
  Description of Artificial Sequence: Synthetic oligonucleotide
cgtcgtgccatctacgaagccaccttc

SEQ ID NO: 270833 - DNA, 28 bp, Artificial Sequence
  Description of Artificial Sequence: Synthetic oligonucleotide
gtcgtgccatctacgaagccaccttcag

SEQ ID NO: 270834 - DNA, 29 bp, Artificial Sequence
  Description of Artificial Sequence: Synthetic oligonucleotide
tcgtgccatctacgaagccaccttcagag

SEQ ID NO: 270835 - DNA, 28 bp, Artificial Sequence
  Description of Artificial Sequence: Synthetic oligonucleotide
cgtgccatctacgaagccaccttcagag

SEQ ID NO: 270836 - DNA, 30 bp, Artificial Sequence
  Description of Artificial Sequence: Synthetic oligonucleotide
gtgccatctacgaagccaccttcagagatg

SEQ ID NO: 270837 - DNA, 30 bp, Artificial Sequence
  Description of Artificial Sequence: Synthetic oligonucleotide
tgccatctacgaagccaccttcagagatgc

SEQ ID NO: 270838 - DNA, 29 bp, Artificial Sequence
  Description of Artificial Sequence: Synthetic oligonucleotide
gccatctacgaagccaccttcagagatgc

SEQ ID NO: 270839 - DNA, 29 bp, Artificial Sequence
  Description of Artificial Sequence: Synthetic oligonucleotide
ccatctacgaagccaccttcagagatgcg

SEQ ID NO: 270840 - DNA, 31 bp, Artificial Sequence
  Description of Artificial Sequence: Synthetic oligonucleotide
catctacgaagccaccttcagagatgcgtac

SEQ ID NO: 270841 - DNA, 32 bp, Artificial Sequence
  Description of Artificial Sequence: Synthetic oligonucleotide
atctacgaagccaccttcagagatgcgtactc

SEQ ID NO: 270842 - DNA, 31 bp, Artificial Sequence
  Description of Artificial Sequence: Synthetic oligonucleotide
tctacgaagccaccttcagagatgcgtactc

SEQ ID NO: 270843 - DNA, 30 bp, Artificial Sequence
  Description of Artificial Sequence: Synthetic oligonucleotide
ctacgaagccaccttcagagatgcgtactc

SEQ ID NO: 270844 - DNA, 31 bp, Artificial Sequence
  Description of Artificial Sequence: Synthetic oligonucleotide
tacgaagccaccttcagagatgcgtactcag

SEQ ID NO: 270845 - DNA, 30 bp, Artificial Sequence
  Description of Artificial Sequence: Synthetic oligonucleotide
acgaagccaccttcagagatgcgtactcag

SEQ ID NO: 270846 - DNA, 29 bp, Artificial Sequence
  Description of Artificial Sequence: Synthetic oligonucleotide
cgaagccaccttcagagatgcgtactcag

SEQ ID NO: 270847 - DNA, 29 bp, Artificial Sequence
  Description of Artificial Sequence: Synthetic oligonucleotide
gaagccaccttcagagatgcgtactcagg

SEQ ID NO: 270848 - DNA, 30 bp, Artificial Sequence
  Description of Artificial Sequence: Synthetic oligonucleotide
aagccaccttcagagatgcgtactcaggac

SEQ ID NO: 270849 - DNA, 29 bp, Artificial Sequence
  Description of Artificial Sequence: Synthetic oligonucleotide
agccaccttcagagatgcgtactcaggac

SEQ ID NO: 270850 - DNA, 28 bp, Artificial Sequence
  Description of Artificial Sequence: Synthetic oligonucleotide
gccaccttcagagatgcgtactcaggac

SEQ ID NO: 270851 - DNA, 28 bp, Artificial Sequence
  Description of Artificial Sequence: Synthetic oligonucleotide
ccaccttcagagatgcgtactcaggacg

SEQ ID NO: 270852 - DNA, 29 bp, Artificial Sequence
  Description of Artificial Sequence: Synthetic oligonucleotide
caccttcagagatgcgtactcaggacgtg

SEQ ID NO: 270853 - DNA, 29 bp, Artificial Sequence
  Description of Artificial Sequence: Synthetic oligonucleotide
accttcagagatgcgtactcaggacgtgc

SEQ ID NO: 270854 - DNA, 28 bp, Artificial Sequence
  Description of Artificial Sequence: Synthetic oligonucleotide
ccttcagagatgcgtactcaggacgtgc

SEQ ID NO: 270855 - DNA, 29 bp, Artificial Sequence
  Description of Artificial Sequence: Synthetic oligonucleotide
cttcagagatgcgtactcaggacgtgcag

SEQ ID NO: 270856 - DNA, 30 bp, Artificial Sequence
  Description of Artificial Sequence: Synthetic oligonucleotide
ttcagagatgcgtactcaggacgtgcagtc

SEQ ID NO: 270857 - DNA, 29 bp, Artificial Sequence
  Description of Artificial Sequence: Synthetic oligonucleotide
tcagagatgcgtactcaggacgtgcagtc

SEQ ID NO: 270858 - DNA, 28 bp, Artificial Sequence
  Description of Artificial Sequence: Synthetic oligonucleotide
cagagatgcgtactcaggacgtgcagtc

SEQ ID NO: 270859 - DNA, 30 bp, Artificial Sequence
  Description of Artificial Sequence: Synthetic oligonucleotide
agagatgcgtactcaggacgtgcagtcatc

SEQ ID NO: 270860 - DNA, 29 bp, Artificial Sequence
  Description of Artificial Sequence: Synthetic oligonucleotide
gagatgcgtactcaggacgtgcagtcatc

SEQ ID NO: 270861 - DNA, 29 bp, Artificial Sequence
  Description of Artificial Sequence: Synthetic oligonucleotide
agatgcgtactcaggacgtgcagtcatcc

SEQ ID NO: 270862 - DNA, 28 bp, Artificial Sequence
  Description of Artificial Sequence: Synthetic oligonucleotide
gatgcgtactcaggacgtgcagtcatcc

SEQ ID NO: 270863 - DNA, 29 bp, Artificial Sequence
  Description of Artificial Sequence: Synthetic oligonucleotide
atgcgtactcaggacgtgcagtcatcctc

SEQ ID NO: 270864 - DNA, 28 bp, Artificial Sequence
  Description of Artificial Sequence: Synthetic oligonucleotide
tgcgtactcaggacgtgcagtcatcctc

SEQ ID NO: 270865 - DNA, 27 bp, Artificial Sequence
  Description of Artificial Sequence: Synthetic oligonucleotide
gcgtactcaggacgtgcagtcatcctc

SEQ ID NO: 270866 - DNA, 29 bp, Artificial Sequence
  Description of Artificial Sequence: Synthetic oligonucleotide
cgtactcaggacgtgcagtcatcctctac

SEQ ID NO: 270867 - DNA, 29 bp, Artificial Sequence
  Description of Artificial Sequence: Synthetic oligonucleotide
gtactcaggacgtgcagtcatcctctacc

SEQ ID NO: 270868 - DNA, 30 bp, Artificial Sequence
  Description of Artificial Sequence: Synthetic oligonucleotide
tactcaggacgtgcagtcatcctctaccag

SEQ ID NO: 270869 - DNA, 29 bp, Artificial Sequence
  Description of Artificial Sequence: Synthetic oligonucleotide
actcaggacgtgcagtcatcctctaccag

SEQ ID NO: 270870 - DNA, 28 bp, Artificial Sequence
  Description of Artificial Sequence: Synthetic oligonucleotide
ctcaggacgtgcagtcatcctctaccag

SEQ ID NO: 270871 - DNA, 28 bp, Artificial Sequence
  Description of Artificial Sequence: Synthetic oligonucleotide
tcaggacgtgcagtcatcctctaccagg

SEQ ID NO: 270872 - DNA, 27 bp, Artificial Sequence
  Description of Artificial Sequence: Synthetic oligonucleotide
caggacgtgcagtcatcctctaccagg

SEQ ID NO: 270873 - DNA, 28 bp, Artificial Sequence
  Description of Artificial Sequence: Synthetic oligonucleotide
aggacgtgcagtcatcctctaccaggtg

SEQ ID NO: 270874 - DNA, 27 bp, Artificial Sequence
  Description of Artificial Sequence: Synthetic oligonucleotide
ggacgtgcagtcatcctctaccaggtg

SEQ ID NO: 270875 - DNA, 27 bp, Artificial Sequence
  Description of Artificial Sequence: Synthetic oligonucleotide
gacgtgcagtcatcctctaccaggtgc

SEQ ID NO: 270876 - DNA, 27 bp, Artificial Sequence
  Description of Artificial Sequence: Synthetic oligonucleotide
acgtgcagtcatcctctaccaggtgcg

SEQ ID NO: 270877 - DNA, 26 bp, Artificial Sequence
  Description of Artificial Sequence: Synthetic oligonucleotide
cgtgcagtcatcctctaccaggtgcg

SEQ ID NO: 270878 - DNA, 26 bp, Artificial Sequence
  Description of Artificial Sequence: Synthetic oligonucleotide
gtgcagtcatcctctaccaggtgcgg

SEQ ID NO: 270879 - DNA, 27 bp, Artificial Sequence
  Description of Artificial Sequence: Synthetic oligonucleotide
tgcagtcatcctctaccaggtgcggga

SEQ ID NO: 270880 - DNA, 26 bp, Artificial Sequence
  Description of Artificial Sequence: Synthetic oligonucleotide
gcagtcatcctctaccaggtgcggga

SEQ ID NO: 270881 - DNA, 26 bp, Artificial Sequence
  Description of Artificial Sequence: Synthetic oligonucleotide
cagtcatcctctaccaggtgcgggag

SEQ ID NO: 270882 - DNA, 27 bp, Artificial Sequence
  Description of Artificial Sequence: Synthetic oligonucleotide
agtcatcctctaccaggtgcgggagca

SEQ ID NO: 270883 - DNA, 27 bp, Artificial Sequence
  Description of Artificial Sequence: Synthetic oligonucleotide
gtcatcctctaccaggtgcgggagcat

SEQ ID NO: 270884 - DNA, 27 bp, Artificial Sequence
  Description of Artificial Sequence: Synthetic oligonucleotide
tcatcctctaccaggtgcgggagcatg

SEQ ID NO: 270885 - DNA, 26 bp, Artificial Sequence
  Description of Artificial Sequence: Synthetic oligonucleotide
catcctctaccaggtgcgggagcatg

SEQ ID NO: 270886 - DNA, 26 bp, Artificial Sequence
  Description of Artificial Sequence: Synthetic oligonucleotide
atcctctaccaggtgcgggagcatgg

SEQ ID NO: 270887 - DNA, 25 bp, Artificial Sequence
  Description of Artificial Sequence: Synthetic oligonucleotide
tcctctaccaggtgcgggagcatgg

SEQ ID NO: 270888 - DNA, 24 bp, Artificial Sequence
  Description of Artificial Sequence: Synthetic oligonucleotide
cctctaccaggtgcgggagcatgg

SEQ ID NO: 270889 - DNA, 25 bp, Artificial Sequence
  Description of Artificial Sequence: Synthetic oligonucleotide
ctctaccaggtgcgggagcatggct

SEQ ID NO: 270890 - DNA, 25 bp, Artificial Sequence
  Description of Artificial Sequence: Synthetic oligonucleotide
tctaccaggtgcgggagcatggctg

SEQ ID NO: 270891 - DNA, 24 bp, Artificial Sequence
  Description of Artificial Sequence: Synthetic oligonucleotide
ctaccaggtgcgggagcatggctg

SEQ ID NO: 270892 - DNA, 26 bp, Artificial Sequence
  Description of Artificial Sequence: Synthetic oligonucleotide
taccaggtgcgggagcatggctggaa

SEQ ID NO: 270893 - DNA, 25 bp, Artificial Sequence
  Description of Artificial Sequence: Synthetic oligonucleotide
accaggtgcgggagcatggctggaa

SEQ ID NO: 270894 - DNA, 24 bp, Artificial Sequence
  Description of Artificial Sequence: Synthetic oligonucleotide
ccaggtgcgggagcatggctggaa

SEQ ID NO: 270895 - DNA, 24 bp, Artificial Sequence
  Description of Artificial Sequence: Synthetic oligonucleotide
caggtgcgggagcatggctggaac

SEQ ID NO: 270896 - DNA, 24 bp, Artificial Sequence
  Description of Artificial Sequence: Synthetic oligonucleotide
aggtgcgggagcatggctggaacc

SEQ ID NO: 270897 - DNA, 23 bp, Artificial Sequence
  Description of Artificial Sequence: Synthetic oligonucleotide
ggtgcgggagcatggctggaacc

SEQ ID NO: 270898 - DNA, 24 bp, Artificial Sequence
  Description of Artificial Sequence: Synthetic oligonucleotide
gtgcgggagcatggctggaaccga

SEQ ID NO: 270899 - DNA, 25 bp, Artificial Sequence
  Description of Artificial Sequence: Synthetic oligonucleotide
tgcgggagcatggctggaaccgagt

SEQ ID NO: 270900 - DNA, 24 bp, Artificial Sequence
  Description of Artificial Sequence: Synthetic oligonucleotide
gcgggagcatggctggaaccgagt

SEQ ID NO: 270901 - DNA, 25 bp, Artificial Sequence
  Description of Artificial Sequence: Synthetic oligonucleotide
cgggagcatggctggaaccgagtct

SEQ ID NO: 270902 - DNA, 25 bp, Artificial Sequence
  Description of Artificial Sequence: Synthetic oligonucleotide
gggagcatggctggaaccgagtctc

SEQ ID NO: 270903 - DNA, 26 bp, Artificial Sequence
  Description of Artificial Sequence: Synthetic oligonucleotide
ggagcatggctggaaccgagtctcga

SEQ ID NO: 270904 - DNA, 27 bp, Artificial Sequence
  Description of Artificial Sequence: Synthetic oligonucleotide
gagcatggctggaaccgagtctcgagt

SEQ ID NO: 270905 - DNA, 27 bp, Artificial Sequence
  Description of Artificial Sequence: Synthetic oligonucleotide
agcatggctggaaccgagtctcgagtg

SEQ ID NO: 270906 - DNA, 27 bp, Artificial Sequence
  Description of Artificial Sequence: Synthetic oligonucleotide
gcatggctggaaccgagtctcgagtga

SEQ ID NO: 270907 - DNA, 27 bp, Artificial Sequence
  Description of Artificial Sequence: Synthetic oligonucleotide
catggctggaaccgagtctcgagtgac

SEQ ID NO: 270908 - DNA, 30 bp, Artificial Sequence
  Description of Artificial Sequence: Synthetic oligonucleotide
atggctggaaccgagtctcgagtgacaatc

SEQ ID NO: 270909 - DNA, 29 bp, Artificial Sequence
  Description of Artificial Sequence: Synthetic oligonucleotide
tggctggaaccgagtctcgagtgacaatc

SEQ ID NO: 270910 - DNA, 28 bp, Artificial Sequence
  Description of Artificial Sequence: Synthetic oligonucleotide
ggctggaaccgagtctcgagtgacaatc

SEQ ID NO: 270911 - DNA, 29 bp, Artificial Sequence
  Description of Artificial Sequence: Synthetic oligonucleotide
gctggaaccgagtctcgagtgacaatctg

SEQ ID NO: 270912 - DNA, 29 bp, Artificial Sequence
  Description of Artificial Sequence: Synthetic oligonucleotide
ctggaaccgagtctcgagtgacaatctgg

SEQ ID NO: 270913 - DNA, 29 bp, Artificial Sequence
  Description of Artificial Sequence: Synthetic oligonucleotide
tggaaccgagtctcgagtgacaatctggc

SEQ ID NO: 270914 - DNA, 28 bp, Artificial Sequence
  Description of Artificial Sequence: Synthetic oligonucleotide
ggaaccgagtctcgagtgacaatctggc

SEQ ID NO: 270915 - DNA, 29 bp, Artificial Sequence
  Description of Artificial Sequence: Synthetic oligonucleotide
gaaccgagtctcgagtgacaatctggctg

SEQ ID NO: 270916 - DNA, 31 bp, Artificial Sequence
  Description of Artificial Sequence: Synthetic oligonucleotide
aaccgagtctcgagtgacaatctggctgatc

SEQ ID NO: 270917 - DNA, 30 bp, Artificial Sequence
  Description of Artificial Sequence: Synthetic oligonucleotide
accgagtctcgagtgacaatctggctgatc

SEQ ID NO: 270918 - DNA, 29 bp, Artificial Sequence
  Description of Artificial Sequence: Synthetic oligonucleotide
ccgagtctcgagtgacaatctggctgatc

SEQ ID NO: 270919 - DNA, 31 bp, Artificial Sequence
  Description of Artificial Sequence: Synthetic oligonucleotide
cgagtctcgagtgacaatctggctgatcaac

SEQ ID NO: 270920 - DNA, 33 bp, Artificial Sequence
  Description of Artificial Sequence: Synthetic oligonucleotide
gagtctcgagtgacaatctggctgatcaacatg

SEQ ID NO: 270921 - DNA, 34 bp, Artificial Sequence
  Description of Artificial Sequence: Synthetic oligonucleotide
agtctcgagtgacaatctggctgatcaacatgag

SEQ ID NO: 270922 - DNA, 33 bp, Artificial Sequence
  Description of Artificial Sequence: Synthetic oligonucleotide
gtctcgagtgacaatctggctgatcaacatgag

SEQ ID NO: 270923 - DNA, 35 bp, Artificial Sequence
  Description of Artificial Sequence: Synthetic oligonucleotide
tctcgagtgacaatctggctgatcaacatgagaac

SEQ ID NO: 270924 - DNA, 34 bp, Artificial Sequence
  Description of Artificial Sequence: Synthetic oligonucleotide
ctcgagtgacaatctggctgatcaacatgagaac

SEQ ID NO: 270925 - DNA, 38 bp, Artificial Sequence
  Description of Artificial Sequence: Synthetic oligonucleotide
tcgagtgacaatctggctgatcaacatgagaactatag

SEQ ID NO: 270926 - DNA, 37 bp, Artificial Sequence
  Description of Artificial Sequence: Synthetic oligonucleotide
cgagtgacaatctggctgatcaacatgagaactatag

SEQ ID NO: 270927 - DNA, 38 bp, Artificial Sequence
  Description of Artificial Sequence: Synthetic oligonucleotide
gagtgacaatctggctgatcaacatgagaactatagtg

SEQ ID NO: 270928 - DNA, 38 bp, Artificial Sequence
  Description of Artificial Sequence: Synthetic oligonucleotide
agtgacaatctggctgatcaacatgagaactatagtgg

SEQ ID NO: 270929 - DNA, 37 bp, Artificial Sequence
  Description of Artificial Sequence: Synthetic oligonucleotide
gtgacaatctggctgatcaacatgagaactatagtgg

SEQ ID NO: 270930 - DNA, 37 bp, Artificial Sequence
  Description of Artificial Sequence: Synthetic oligonucleotide
tgacaatctggctgatcaacatgagaactatagtggc

SEQ ID NO: 270931 - DNA, 36 bp, Artificial Sequence
  Description of Artificial Sequence: Synthetic oligonucleotide
gacaatctggctgatcaacatgagaactatagtggc

SEQ ID NO: 270932 - DNA, 37 bp, Artificial Sequence
  Description of Artificial Sequence: Synthetic oligonucleotide
acaatctggctgatcaacatgagaactatagtggcac

SEQ ID NO: 270933 - DNA, 36 bp, Artificial Sequence
  Description of Artificial Sequence: Synthetic oligonucleotide
caatctggctgatcaacatgagaactatagtggcac

SEQ ID NO: 270934 - DNA, 38 bp, Artificial Sequence
  Description of Artificial Sequence: Synthetic oligonucleotide
aatctggctgatcaacatgagaactatagtggcactac

SEQ ID NO: 270935 - DNA, 37 bp, Artificial Sequence
  Description of Artificial Sequence: Synthetic oligonucleotide
atctggctgatcaacatgagaactatagtggcactac

SEQ ID NO: 270936 - DNA, 36 bp, Artificial Sequence
  Description of Artificial Sequence: Synthetic oligonucleotide
tctggctgatcaacatgagaactatagtggcactac

SEQ ID NO: 270937 - DNA, 35 bp, Artificial Sequence
  Description of Artificial Sequence: Synthetic oligonucleotide
ctggctgatcaacatgagaactatagtggcactac

SEQ ID NO: 270938 - DNA, 35 bp, Artificial Sequence
  Description of Artificial Sequence: Synthetic oligonucleotide
tggctgatcaacatgagaactatagtggcactacc

SEQ ID NO: 270939 - DNA, 34 bp, Artificial Sequence
  Description of Artificial Sequence: Synthetic oligonucleotide
ggctgatcaacatgagaactatagtggcactacc

SEQ ID NO: 270940 - DNA, 34 bp, Artificial Sequence
  Description of Artificial Sequence: Synthetic oligonucleotide
gctgatcaacatgagaactatagtggcactaccc

SEQ ID NO: 270941 - DNA, 34 bp, Artificial Sequence
  Description of Artificial Sequence: Synthetic oligonucleotide
ctgatcaacatgagaactatagtggcactacccc

SEQ ID NO: 270942 - DNA, 34 bp, Artificial Sequence
  Description of Artificial Sequence: Synthetic oligonucleotide
tgatcaacatgagaactatagtggcactaccccc

SEQ ID NO: 270943 - DNA, 33 bp, Artificial Sequence
  Description of Artificial Sequence: Synthetic oligonucleotide
gatcaacatgagaactatagtggcactaccccc

SEQ ID NO: 270944 - DNA, 34 bp, Artificial Sequence
  Description of Artificial Sequence: Synthetic oligonucleotide
atcaacatgagaactatagtggcactaccccctc

SEQ ID NO: 270945 - DNA, 33 bp, Artificial Sequence
  Description of Artificial Sequence: Synthetic oligonucleotide
tcaacatgagaactatagtggcactaccccctc

SEQ ID NO: 270946 - DNA, 32 bp, Artificial Sequence
  Description of Artificial Sequence: Synthetic oligonucleotide
caacatgagaactatagtggcactaccccctc

SEQ ID NO: 270947 - DNA, 27 bp, Artificial Sequence
  Description of Artificial Sequence: Synthetic oligonucleotide
atggcgcctaccttacaagctgctcgc

SEQ ID NO: 270948 - DNA, 26 bp, Artificial Sequence
  Description of Artificial Sequence: Synthetic oligonucleotide
tggcgcctaccttacaagctgctcgc

SEQ ID NO: 270949 - DNA, 25 bp, Artificial Sequence
  Description of Artificial Sequence: Synthetic oligonucleotide
ggcgcctaccttacaagctgctcgc

SEQ ID NO: 270950 - DNA, 25 bp, Artificial Sequence
  Description of Artificial Sequence: Synthetic oligonucleotide
gcgcctaccttacaagctgctcgcg

SEQ ID NO: 270951 - DNA, 26 bp, Artificial Sequence
  Description of Artificial Sequence: Synthetic oligonucleotide
cgcctaccttacaagctgctcgcgga

SEQ ID NO: 270952 - DNA, 26 bp, Artificial Sequence
  Description of Artificial Sequence: Synthetic oligonucleotide
gcctaccttacaagctgctcgcggag

SEQ ID NO: 270953 - DNA, 26 bp, Artificial Sequence
  Description of Artificial Sequence: Synthetic oligonucleotide
cctaccttacaagctgctcgcggagc

SEQ ID NO: 270954 - DNA, 26 bp, Artificial Sequence
  Description of Artificial Sequence: Synthetic oligonucleotide
ctaccttacaagctgctcgcggagcc

SEQ ID NO: 270955 - DNA, 26 bp, Artificial Sequence
  Description of Artificial Sequence: Synthetic oligonucleotide
taccttacaagctgctcgcggagccg

SEQ ID NO: 270956 - DNA, 25 bp, Artificial Sequence
  Description of Artificial Sequence: Synthetic oligonucleotide
accttacaagctgctcgcggagccg

SEQ ID NO: 270957 - DNA, 24 bp, Artificial Sequence
  Description of Artificial Sequence: Synthetic oligonucleotide
ccttacaagctgctcgcggagccg

SEQ ID NO: 270958 - DNA, 24 bp, Artificial Sequence
  Description of Artificial Sequence: Synthetic oligonucleotide
cttacaagctgctcgcggagccgg

SEQ ID NO: 270959 - DNA, 24 bp, Artificial Sequence
  Description of Artificial Sequence: Synthetic oligonucleotide
ttacaagctgctcgcggagccggg

SEQ ID NO: 270960 - DNA, 23 bp, Artificial Sequence
  Description of Artificial Sequence: Synthetic oligonucleotide
tacaagctgctcgcggagccggg

SEQ ID NO: 270961 - DNA, 22 bp, Artificial Sequence
  Description of Artificial Sequence: Synthetic oligonucleotide
acaagctgctcgcggagccggg

SEQ ID NO: 270962 - DNA, 21 bp, Artificial Sequence
  Description of Artificial Sequence: Synthetic oligonucleotide
caagctgctcgcggagccggg

SEQ ID NO: 270963 - DNA, 21 bp, Artificial Sequence
  Description of Artificial Sequence: Synthetic oligonucleotide
aagctgctcgcggagccgggg

SEQ ID NO: 270964 - DNA, 20 bp, Artificial Sequence
  Description of Artificial Sequence: Synthetic oligonucleotide
agctgctcgcggagccgggg

SEQ ID NO: 270965 - DNA, 20 bp, Artificial Sequence
  Description of Artificial Sequence: Synthetic oligonucleotide
gctgctcgcggagccggggt

SEQ ID NO: 270966 - DNA, 20 bp, Artificial Sequence
  Description of Artificial Sequence: Synthetic oligonucleotide
ctgctcgcggagccggggca

SEQ ID NO: 270967 - DNA, 20 bp, Artificial Sequence
  Description of Artificial Sequence: Synthetic oligonucleotide
tgctcgcggagccggggcag

SEQ ID NO: 270968 - DNA, 20 bp, Artificial Sequence
  Description of Artificial Sequence: Synthetic oligonucleotide
gctcgcggagccggggcagt

SEQ ID NO: 270969 - DNA, 20 bp, Artificial Sequence
  Description of Artificial Sequence: Synthetic oligonucleotide
ctcgcggagccggggcagca

SEQ ID NO: 270970 - DNA, 20 bp, Artificial Sequence
  Description of Artificial Sequence: Synthetic oligonucleotide
tcgcggagccggggcagcac

SEQ ID NO: 270971 - DNA, 20 bp, Artificial Sequence
  Description of Artificial Sequence: Synthetic oligonucleotide
cgcggagccggggcagcact

SEQ ID NO: 270972 - DNA, 20 bp, Artificial Sequence
  Description of Artificial Sequence: Synthetic oligonucleotide
gcggagccggggcagcacct

SEQ ID NO: 270973 - DNA, 20 bp, Artificial Sequence
  Description of Artificial Sequence: Synthetic oligonucleotide
cggagccggggcagcaccgt

SEQ ID NO: 270974 - DNA, 20 bp, Artificial Sequence
  Description of Artificial Sequence: Synthetic oligonucleotide
ggagccggggcagcaccggt

SEQ ID NO: 270975 - DNA, 21 bp, Artificial Sequence
  Description of Artificial Sequence: Synthetic oligonucleotide
gagccggggcagcaccgggtt

SEQ ID NO: 270976 - DNA, 21 bp, Artificial Sequence
  Description of Artificial Sequence: Synthetic oligonucleotide
agccggggcagcaccgggttg

SEQ ID NO: 270977 - DNA, 20 bp, Artificial Sequence
  Description of Artificial Sequence: Synthetic oligonucleotide
gccggggcagcaccgggttg

SEQ ID NO: 270978 - DNA, 20 bp, Artificial Sequence
  Description of Artificial Sequence: Synthetic oligonucleotide
ccggggcagcaccgggttgg

SEQ ID NO: 270979 - DNA, 20 bp, Artificial Sequence
  Description of Artificial Sequence: Synthetic oligonucleotide
cggggcagcaccgggttggg

SEQ ID NO: 270980 - DNA, 20 bp, Artificial Sequence
  Description of Artificial Sequence: Synthetic oligonucleotide
ggggcagcaccgggttgggg

SEQ ID NO: 270981 - DNA, 20 bp, Artificial Sequence
  Description of Artificial Sequence: Synthetic oligonucleotide
gggcagcaccgggttggggg

SEQ ID NO: 270982 - DNA, 20 bp, Artificial Sequence
  Description of Artificial Sequence: Synthetic oligonucleotide
ggcagcaccgggttgggggc

SEQ ID NO: 270983 - DNA, 20 bp, Artificial Sequence
  Description of Artificial Sequence: Synthetic oligonucleotide
gcagcaccgggttgggggcc

SEQ ID NO: 270984 - DNA, 20 bp, Artificial Sequence
  Description of Artificial Sequence: Synthetic oligonucleotide
cagcaccgggttgggggccc

SEQ ID NO: 270985 - DNA, 21 bp, Artificial Sequence
  Description of Artificial Sequence: Synthetic oligonucleotide
agcaccgggttgggggcccga

SEQ ID NO: 270986 - DNA, 20 bp, Artificial Sequence
  Description of Artificial Sequence: Synthetic oligonucleotide
gcaccgggttgggggcccga

SEQ ID NO: 270987 - DNA, 20 bp, Artificial Sequence
  Description of Artificial Sequence: Synthetic oligonucleotide
caccgggttgggggcccgag

SEQ ID NO: 270988 - DNA, 20 bp, Artificial Sequence
  Description of Artificial Sequence: Synthetic oligonucleotide
accgggttgggggcccgagg

SEQ ID NO: 270989 - DNA, 20 bp, Artificial Sequence
  Description of Artificial Sequence: Synthetic oligonucleotide
ccgggttgggggcccgaggt

SEQ ID NO: 270990 - DNA, 20 bp, Artificial Sequence
  Description of Artificial Sequence: Synthetic oligonucleotide
cgggttgggggcccgaggct

SEQ ID NO: 270991 - DNA, 21 bp, Artificial Sequence
  Description of Artificial Sequence: Synthetic oligonucleotide
gggttgggggcccgaggcgtt

SEQ ID NO: 270992 - DNA, 22 bp, Artificial Sequence
  Description of Artificial Sequence: Synthetic oligonucleotide
ggttgggggcccgaggcgttct

SEQ ID NO: 270993 - DNA, 23 bp, Artificial Sequence
  Description of Artificial Sequence: Synthetic oligonucleotide
gttgggggcccgaggcgttctct

SEQ ID NO: 270994 - DNA, 23 bp, Artificial Sequence
  Description of Artificial Sequence: Synthetic oligonucleotide
ttgggggcccgaggcgttctctc

SEQ ID NO: 270995 - DNA, 22 bp, Artificial Sequence
  Description of Artificial Sequence: Synthetic oligonucleotide
tgggggcccgaggcgttctctc

SEQ ID NO: 270996 - DNA, 21 bp, Artificial Sequence
  Description of Artificial Sequence: Synthetic oligonucleotide
gggggcccgaggcgttctctc

SEQ ID NO: 270997 - DNA, 22 bp, Artificial Sequence
  Description of Artificial Sequence: Synthetic oligonucleotide
ggggcccgaggcgttctctcca

SEQ ID NO: 270998 - DNA, 23 bp, Artificial Sequence
  Description of Artificial Sequence: Synthetic oligonucleotide
gggcccgaggcgttctctccaga

SEQ ID NO: 270999 - DNA, 24 bp, Artificial Sequence
  Description of Artificial Sequence: Synthetic oligonucleotide
ggcccgaggcgttctctccagact

SEQ ID NO: 271000 - DNA, 24 bp, Artificial Sequence
  Description of Artificial Sequence: Synthetic oligonucleotide
gcccgaggcgttctctccagactc

SEQ ID NO: 271001 - DNA, 24 bp, Artificial Sequence
  Description of Artificial Sequence: Synthetic oligonucleotide
cccgaggcgttctctccagactcg

SEQ ID NO: 271002 - DNA, 27 bp, Artificial Sequence
  Description of Artificial Sequence: Synthetic oligonucleotide
ccgaggcgttctctccagactcggaaa

SEQ ID NO: 271003 - DNA, 27 bp, Artificial Sequence
  Description of Artificial Sequence: Synthetic oligonucleotide
cgaggcgttctctccagactcggaaag

SEQ ID NO: 271004 - DNA, 27 bp, Artificial Sequence
  Description of Artificial Sequence: Synthetic oligonucleotide
gaggcgttctctccagactcggaaagc

SEQ ID NO: 271005 - DNA, 27 bp, Artificial Sequence
  Description of Artificial Sequence: Synthetic oligonucleotide
aggcgttctctccagactcggaaagcc

SEQ ID NO: 271006 - DNA, 26 bp, Artificial Sequence
  Description of Artificial Sequence: Synthetic oligonucleotide
ggcgttctctccagactcggaaagcc

SEQ ID NO: 271007 - DNA, 27 bp, Artificial Sequence
  Description of Artificial Sequence: Synthetic oligonucleotide
gcgttctctccagactcggaaagccgt

SEQ ID NO: 271008 - DNA, 27 bp, Artificial Sequence
  Description of Artificial Sequence: Synthetic oligonucleotide
cgttctctccagactcggaaagccgtg

SEQ ID NO: 271009 - DNA, 29 bp, Artificial Sequence
  Description of Artificial Sequence: Synthetic oligonucleotide
gttctctccagactcggaaagccgtgaag

SEQ ID NO: 271010 - DNA, 32 bp, Artificial Sequence
  Description of Artificial Sequence: Synthetic oligonucleotide
ttctctccagactcggaaagccgtgaagtttc

SEQ ID NO: 271011 - DNA, 31 bp, Artificial Sequence
  Description of Artificial Sequence: Synthetic oligonucleotide
tctctccagactcggaaagccgtgaagtttc

SEQ ID NO: 271012 - DNA, 30 bp, Artificial Sequence
  Description of Artificial Sequence: Synthetic oligonucleotide
ctctccagactcggaaagccgtgaagtttc

SEQ ID NO: 271013 - DNA, 30 bp, Artificial Sequence
  Description of Artificial Sequence: Synthetic oligonucleotide
tctccagactcggaaagccgtgaagtttcc

SEQ ID NO: 271014 - DNA, 29 bp, Artificial Sequence
  Description of Artificial Sequence: Synthetic oligonucleotide
ctccagactcggaaagccgtgaagtttcc

SEQ ID NO: 271015 - DNA, 30 bp, Artificial Sequence
  Description of Artificial Sequence: Synthetic oligonucleotide
tccagactcggaaagccgtgaagtttcctc

SEQ ID NO: 271016 - DNA, 29 bp, Artificial Sequence
  Description of Artificial Sequence: Synthetic oligonucleotide
ccagactcggaaagccgtgaagtttcctc

SEQ ID NO: 271017 - DNA, 30 bp, Artificial Sequence
  Description of Artificial Sequence: Synthetic oligonucleotide
cagactcggaaagccgtgaagtttcctctg

SEQ ID NO: 271018 - DNA, 30 bp, Artificial Sequence
  Description of Artificial Sequence: Synthetic oligonucleotide
agactcggaaagccgtgaagtttcctctgg

SEQ ID NO: 271019 - DNA, 29 bp, Artificial Sequence
  Description of Artificial Sequence: Synthetic oligonucleotide
gactcggaaagccgtgaagtttcctctgg

SEQ ID NO: 271020 - DNA, 29 bp, Artificial Sequence
  Description of Artificial Sequence: Synthetic oligonucleotide
actcggaaagccgtgaagtttcctctggg

SEQ ID NO: 271021 - DNA, 28 bp, Artificial Sequence
  Description of Artificial Sequence: Synthetic oligonucleotide
ctcggaaagccgtgaagtttcctctggg

SEQ ID NO: 271022 - DNA, 29 bp, Artificial Sequence
  Description of Artificial Sequence: Synthetic oligonucleotide
tcggaaagccgtgaagtttcctctgggac

SEQ ID NO: 271023 - DNA, 28 bp, Artificial Sequence
  Description of Artificial Sequence: Synthetic oligonucleotide
cggaaagccgtgaagtttcctctgggac

SEQ ID NO: 271024 - DNA, 28 bp, Artificial Sequence
  Description of Artificial Sequence: Synthetic oligonucleotide
ggaaagccgtgaagtttcctctgggacc

SEQ ID NO: 271025 - DNA, 29 bp, Artificial Sequence
  Description of Artificial Sequence: Synthetic oligonucleotide
gaaagccgtgaagtttcctctgggaccag

SEQ ID NO: 271026 - DNA, 32 bp, Artificial Sequence
  Description of Artificial Sequence: Synthetic oligonucleotide
aaagccgtgaagtttcctctgggaccagtatc

SEQ ID NO: 271027 - DNA, 31 bp, Artificial Sequence
  Description of Artificial Sequence: Synthetic oligonucleotide
aagccgtgaagtttcctctgggaccagtatc

SEQ ID NO: 271028 - DNA, 30 bp, Artificial Sequence
  Description of Artificial Sequence: Synthetic oligonucleotide
agccgtgaagtttcctctgggaccagtatc

SEQ ID NO: 271029 - DNA, 29 bp, Artificial Sequence
  Description of Artificial Sequence: Synthetic oligonucleotide
gccgtgaagtttcctctgggaccagtatc

SEQ ID NO: 271030 - DNA, 31 bp, Artificial Sequence
  Description of Artificial Sequence: Synthetic oligonucleotide
ccgtgaagtttcctctgggaccagtatcatg

SEQ ID NO: 271031 - DNA, 31 bp, Artificial Sequence
  Description of Artificial Sequence: Synthetic oligonucleotide
cgtgaagtttcctctgggaccagtatcatgg

SEQ ID NO: 271032 - DNA, 31 bp, Artificial Sequence
  Description of Artificial Sequence: Synthetic oligonucleotide
gtgaagtttcctctgggaccagtatcatggc

SEQ ID NO: 271033 - DNA, 31 bp, Artificial Sequence
  Description of Artificial Sequence: Synthetic oligonucleotide
tgaagtttcctctgggaccagtatcatggcg

SEQ ID NO: 271034 - DNA, 30 bp, Artificial Sequence
  Description of Artificial Sequence: Synthetic oligonucleotide
gaagtttcctctgggaccagtatcatggcg

SEQ ID NO: 271035 - DNA, 30 bp, Artificial Sequence
  Description of Artificial Sequence: Synthetic oligonucleotide
aagtttcctctgggaccagtatcatggcgg

SEQ ID NO: 271036 - DNA, 29 bp, Artificial Sequence
  Description of Artificial Sequence: Synthetic oligonucleotide
agtttcctctgggaccagtatcatggcgg

SEQ ID NO: 271037 - DNA, 28 bp, Artificial Sequence
  Description of Artificial Sequence: Synthetic oligonucleotide
gtttcctctgggaccagtatcatggcgg

SEQ ID NO: 271038 - DNA, 29 bp, Artificial Sequence
  Description of Artificial Sequence: Synthetic oligonucleotide
tttcctctgggaccagtatcatggcggtg

SEQ ID NO: 271039 - DNA, 28 bp, Artificial Sequence
  Description of Artificial Sequence: Synthetic oligonucleotide
ttcctctgggaccagtatcatggcggtg

SEQ ID NO: 271040 - DNA, 27 bp, Artificial Sequence
  Description of Artificial Sequence: Synthetic oligonucleotide
tcctctgggaccagtatcatggcggtg

SEQ ID NO: 271041 - DNA, 26 bp, Artificial Sequence
  Description of Artificial Sequence: Synthetic oligonucleotide
cctctgggaccagtatcatggcggtg

SEQ ID NO: 271042 - DNA, 27 bp, Artificial Sequence
  Description of Artificial Sequence: Synthetic oligonucleotide
ctctgggaccagtatcatggcggtgca

SEQ ID NO: 271043 - DNA, 27 bp, Artificial Sequence
  Description of Artificial Sequence: Synthetic oligonucleotide
tctgggaccagtatcatggcggtgcag

SEQ ID NO: 271044 - DNA, 27 bp, Artificial Sequence
  Description of Artificial Sequence: Synthetic oligonucleotide
ctgggaccagtatcatggcggtgcagt

SEQ ID NO: 271045 - DNA, 29 bp, Artificial Sequence
  Description of Artificial Sequence: Synthetic oligonucleotide
tgggaccagtatcatggcggtgcagtttc

SEQ ID NO: 271046 - DNA, 28 bp, Artificial Sequence
  Description of Artificial Sequence: Synthetic oligonucleotide
gggaccagtatcatggcggtgcagtttc

SEQ ID NO: 271047 - DNA, 29 bp, Artificial Sequence
  Description of Artificial Sequence: Synthetic oligonucleotide
ggaccagtatcatggcggtgcagtttcac

SEQ ID NO: 271048 - DNA, 29 bp, Artificial Sequence
  Description of Artificial Sequence: Synthetic oligonucleotide
gaccagtatcatggcggtgcagtttcacg

SEQ ID NO: 271049 - DNA, 29 bp, Artificial Sequence
  Description of Artificial Sequence: Synthetic oligonucleotide
accagtatcatggcggtgcagtttcacgg

SEQ ID NO: 271050 - DNA, 28 bp, Artificial Sequence
  Description of Artificial Sequence: Synthetic oligonucleotide
ccagtatcatggcggtgcagtttcacgg

SEQ ID NO: 271051 - DNA, 28 bp, Artificial Sequence
  Description of Artificial Sequence: Synthetic oligonucleotide
cagtatcatggcggtgcagtttcacggg

SEQ ID NO: 271052 - DNA, 28 bp, Artificial Sequence
  Description of Artificial Sequence: Synthetic oligonucleotide
agtatcatggcggtgcagtttcacgggg

SEQ ID NO: 271053 - DNA, 27 bp, Artificial Sequence
  Description of Artificial Sequence: Synthetic oligonucleotide
gtatcatggcggtgcagtttcacgggg

SEQ ID NO: 271054 - DNA, 27 bp, Artificial Sequence
  Description of Artificial Sequence: Synthetic oligonucleotide
tatcatggcggtgcagtttcacggggg

SEQ ID NO: 271055 - DNA, 26 bp, Artificial Sequence
  Description of Artificial Sequence: Synthetic oligonucleotide
atcatggcggtgcagtttcacggggg

SEQ ID NO: 271056 - DNA, 25 bp, Artificial Sequence
  Description of Artificial Sequence: Synthetic oligonucleotide
tcatggcggtgcagtttcacggggg

SEQ ID NO: 271057 - DNA, 24 bp, Artificial Sequence
  Description of Artificial Sequence: Synthetic oligonucleotide
catggcggtgcagtttcacggggg

SEQ ID NO: 271058 - DNA, 24 bp, Artificial Sequence
  Description of Artificial Sequence: Synthetic oligonucleotide
atggcggtgcagtttcacgggggc

SEQ ID NO: 271059 - DNA, 23 bp, Artificial Sequence
  Description of Artificial Sequence: Synthetic oligonucleotide
tggcggtgcagtttcacgggggc

SEQ ID NO: 271060 - DNA, 22 bp, Artificial Sequence
  Description of Artificial Sequence: Synthetic oligonucleotide
ggcggtgcagtttcacgggggc

SEQ ID NO: 271061 - DNA, 23 bp, Artificial Sequence
  Description of Artificial Sequence: Synthetic oligonucleotide
gcggtgcagtttcacgggggcga

SEQ ID NO: 271062 - DNA, 23 bp, Artificial Sequence
  Description of Artificial Sequence: Synthetic oligonucleotide
cggtgcagtttcacgggggcgag

SEQ ID NO: 271063 - DNA, 25 bp, Artificial Sequence
  Description of Artificial Sequence: Synthetic oligonucleotide
ggtgcagtttcacgggggcgaggtt

SEQ ID NO: 271064 - DNA, 26 bp, Artificial Sequence
  Description of Artificial Sequence: Synthetic oligonucleotide
gtgcagtttcacgggggcgaggttct

SEQ ID NO: 271065 - DNA, 26 bp, Artificial Sequence
  Description of Artificial Sequence: Synthetic oligonucleotide
tgcagtttcacgggggcgaggttctg

SEQ ID NO: 271066 - DNA, 25 bp, Artificial Sequence
  Description of Artificial Sequence: Synthetic oligonucleotide
gcagtttcacgggggcgaggttctg

SEQ ID NO: 271067 - DNA, 25 bp, Artificial Sequence
  Description of Artificial Sequence: Synthetic oligonucleotide
cagtttcacgggggcgaggttctgg

SEQ ID NO: 271068 - DNA, 25 bp, Artificial Sequence
  Description of Artificial Sequence: Synthetic oligonucleotide
agtttcacgggggcgaggttctggg

SEQ ID NO: 271069 - DNA, 24 bp, Artificial Sequence
  Description of Artificial Sequence: Synthetic oligonucleotide
gtttcacgggggcgaggttctggg

SEQ ID NO: 271070 - DNA, 24 bp, Artificial Sequence
  Description of Artificial Sequence: Synthetic oligonucleotide
tttcacgggggcgaggttctgggc

SEQ ID NO: 271071 - DNA, 23 bp, Artificial Sequence
  Description of Artificial Sequence: Synthetic oligonucleotide
ttcacgggggcgaggttctgggc

SEQ ID NO: 271072 - DNA, 22 bp, Artificial Sequence
  Description of Artificial Sequence: Synthetic oligonucleotide
tcacgggggcgaggttctgggc

SEQ ID NO: 271073 - DNA, 21 bp, Artificial Sequence
  Description of Artificial Sequence: Synthetic oligonucleotide
cacgggggcgaggttctgggc

SEQ ID NO: 271074 - DNA, 21 bp, Artificial Sequence
  Description of Artificial Sequence: Synthetic oligonucleotide
acgggggcgaggttctgggcg

SEQ ID NO: 271075 - DNA, 20 bp, Artificial Sequence
  Description of Artificial Sequence: Synthetic oligonucleotide
cgggggcgaggttctgggcg

SEQ ID NO: 271076 - DNA, 20 bp, Artificial Sequence
  Description of Artificial Sequence: Synthetic oligonucleotide
gggggcgaggttctgggcgc

SEQ ID NO: 271077 - DNA, 20 bp, Artificial Sequence
  Description of Artificial Sequence: Synthetic oligonucleotide
ggggcgaggttctgggcgcg

SEQ ID NO: 271078 - DNA, 21 bp, Artificial Sequence
  Description of Artificial Sequence: Synthetic oligonucleotide
gggcgaggttctgggcgcgga

SEQ ID NO: 271079 - DNA, 22 bp, Artificial Sequence
  Description of Artificial Sequence: Synthetic oligonucleotide
ggcgaggttctgggcgcggact

SEQ ID NO: 271080 - DNA, 22 bp, Artificial Sequence
  Description of Artificial Sequence: Synthetic oligonucleotide
gcgaggttctgggcgcggactc

SEQ ID NO: 271081 - DNA, 23 bp, Artificial Sequence
  Description of Artificial Sequence: Synthetic oligonucleotide
cgaggttctgggcgcggactcct

SEQ ID NO: 271082 - DNA, 25 bp, Artificial Sequence
  Description of Artificial Sequence: Synthetic oligonucleotide
gaggttctgggcgcggactcctgaa

SEQ ID NO: 271083 - DNA, 27 bp, Artificial Sequence
  Description of Artificial Sequence: Synthetic oligonucleotide
aggttctgggcgcggactcctgaacaa

SEQ ID NO: 271084 - DNA, 26 bp, Artificial Sequence
  Description of Artificial Sequence: Synthetic oligonucleotide
ggttctgggcgcggactcctgaacaa

SEQ ID NO: 271085 - DNA, 26 bp, Artificial Sequence
  Description of Artificial Sequence: Synthetic oligonucleotide
gttctgggcgcggactcctgaacaac

SEQ ID NO: 271086 - DNA, 27 bp, Artificial Sequence
  Description of Artificial Sequence: Synthetic oligonucleotide
ttctgggcgcggactcctgaacaacca

SEQ ID NO: 271087 - DNA, 26 bp, Artificial Sequence
  Description of Artificial Sequence: Synthetic oligonucleotide
tctgggcgcggactcctgaacaacca

SEQ ID NO: 271088 - DNA, 25 bp, Artificial Sequence
  Description of Artificial Sequence: Synthetic oligonucleotide
ctgggcgcggactcctgaacaacca

SEQ ID NO: 271089 - DNA, 26 bp, Artificial Sequence
  Description of Artificial Sequence: Synthetic oligonucleotide
tgggcgcggactcctgaacaaccagt

SEQ ID NO: 271090 - DNA, 25 bp, Artificial Sequence
  Description of Artificial Sequence: Synthetic oligonucleotide
gggcgcggactcctgaacaaccagt

SEQ ID NO: 271091 - DNA, 25 bp, Artificial Sequence
  Description of Artificial Sequence: Synthetic oligonucleotide
ggcgcggactcctgaacaaccagtg

SEQ ID NO: 271092 - DNA, 25 bp, Artificial Sequence
  Description of Artificial Sequence: Synthetic oligonucleotide
gcgcggactcctgaacaaccagtgg

SEQ ID NO: 271093 - DNA, 26 bp, Artificial Sequence
  Description of Artificial Sequence: Synthetic oligonucleotide
cgcggactcctgaacaaccagtgggt

SEQ ID NO: 271094 - DNA, 26 bp, Artificial Sequence
  Description of Artificial Sequence: Synthetic oligonucleotide
gcggactcctgaacaaccagtgggtc

SEQ ID NO: 271095 - DNA, 27 bp, Artificial Sequence
  Description of Artificial Sequence: Synthetic oligonucleotide
cggactcctgaacaaccagtgggtcct

SEQ ID NO: 271096 - DNA, 28 bp, Artificial Sequence
  Description of Artificial Sequence: Synthetic oligonucleotide
ggactcctgaacaaccagtgggtcctag

SEQ ID NO: 271097 - DNA, 30 bp, Artificial Sequence
  Description of Artificial Sequence: Synthetic oligonucleotide
gactcctgaacaaccagtgggtcctagatc

SEQ ID NO: 271098 - DNA, 30 bp, Artificial Sequence
  Description of Artificial Sequence: Synthetic oligonucleotide
actcctgaacaaccagtgggtcctagatcg

SEQ ID NO: 271099 - DNA, 29 bp, Artificial Sequence
  Description of Artificial Sequence: Synthetic oligonucleotide
ctcctgaacaaccagtgggtcctagatcg

SEQ ID NO: 271100 - DNA, 29 bp, Artificial Sequence
  Description of Artificial Sequence: Synthetic oligonucleotide
tcctgaacaaccagtgggtcctagatcgc

SEQ ID NO: 271101 - DNA, 28 bp, Artificial Sequence
  Description of Artificial Sequence: Synthetic oligonucleotide
cctgaacaaccagtgggtcctagatcgc

SEQ ID NO: 271102 - DNA, 28 bp, Artificial Sequence
  Description of Artificial Sequence: Synthetic oligonucleotide
ctgaacaaccagtgggtcctagatcgcc

SEQ ID NO: 271103 - DNA, 31 bp, Artificial Sequence
  Description of Artificial Sequence: Synthetic oligonucleotide
tgaacaaccagtgggtcctagatcgccaatg

SEQ ID NO: 271104 - DNA, 30 bp, Artificial Sequence
  Description of Artificial Sequence: Synthetic oligonucleotide
gaacaaccagtgggtcctagatcgccaatg

SEQ ID NO: 271105 - DNA, 30 bp, Artificial Sequence
  Description of Artificial Sequence: Synthetic oligonucleotide
aacaaccagtgggtcctagatcgccaatgg

SEQ ID NO: 271106 - DNA, 29 bp, Artificial Sequence
  Description of Artificial Sequence: Synthetic oligonucleotide
acaaccagtgggtcctagatcgccaatgg

SEQ ID NO: 271107 - DNA, 28 bp, Artificial Sequence
  Description of Artificial Sequence: Synthetic oligonucleotide
caaccagtgggtcctagatcgccaatgg

SEQ ID NO: 271108 - DNA, 29 bp, Artificial Sequence
  Description of Artificial Sequence: Synthetic oligonucleotide
aaccagtgggtcctagatcgccaatggag

SEQ ID NO: 271109 - DNA, 28 bp, Artificial Sequence
  Description of Artificial Sequence: Synthetic oligonucleotide
accagtgggtcctagatcgccaatggag

SEQ ID NO: 271110 - DNA, 27 bp, Artificial Sequence
  Description of Artificial Sequence: Synthetic oligonucleotide
ccagtgggtcctagatcgccaatggag

SEQ ID NO: 271111 - DNA, 28 bp, Artificial Sequence
  Description of Artificial Sequence: Synthetic oligonucleotide
cagtgggtcctagatcgccaatggagtg

SEQ ID NO: 271112 - DNA, 29 bp, Artificial Sequence
  Description of Artificial Sequence: Synthetic oligonucleotide
agtgggtcctagatcgccaatggagtgac

SEQ ID NO: 271113 - DNA, 28 bp, Artificial Sequence
  Description of Artificial Sequence: Synthetic oligonucleotide
gtgggtcctagatcgccaatggagtgac

SEQ ID NO: 271114 - DNA, 29 bp, Artificial Sequence
  Description of Artificial Sequence: Synthetic oligonucleotide
tgggtcctagatcgccaatggagtgactg

SEQ ID NO: 271115 - DNA, 28 bp, Artificial Sequence
  Description of Artificial Sequence: Synthetic oligonucleotide
gggtcctagatcgccaatggagtgactg

SEQ ID NO: 271116 - DNA, 29 bp, Artificial Sequence
  Description of Artificial Sequence: Synthetic oligonucleotide
ggtcctagatcgccaatggagtgactgtc

SEQ ID NO: 271117 - DNA, 31 bp, Artificial Sequence
  Description of Artificial Sequence: Synthetic oligonucleotide
gtcctagatcgccaatggagtgactgtcaag

SEQ ID NO: 271118 - DNA, 31 bp, Artificial Sequence
  Description of Artificial Sequence: Synthetic oligonucleotide
tcctagatcgccaatggagtgactgtcaagc

SEQ ID NO: 271119 - DNA, 30 bp, Artificial Sequence
  Description of Artificial Sequence: Synthetic oligonucleotide
cctagatcgccaatggagtgactgtcaagc

SEQ ID NO: 271120 - DNA, 31 bp, Artificial Sequence
  Description of Artificial Sequence: Synthetic oligonucleotide
ctagatcgccaatggagtgactgtcaagctg

SEQ ID NO: 271121 - DNA, 32 bp, Artificial Sequence
  Description of Artificial Sequence: Synthetic oligonucleotide
tagatcgccaatggagtgactgtcaagctgac

SEQ ID NO: 271122 - DNA, 31 bp, Artificial Sequence
  Description of Artificial Sequence: Synthetic oligonucleotide
agatcgccaatggagtgactgtcaagctgac

SEQ ID NO: 271123 - DNA, 30 bp, Artificial Sequence
  Description of Artificial Sequence: Synthetic oligonucleotide
gatcgccaatggagtgactgtcaagctgac

SEQ ID NO: 271124 - DNA, 31 bp, Artificial Sequence
  Description of Artificial Sequence: Synthetic oligonucleotide
atcgccaatggagtgactgtcaagctgactc

SEQ ID NO: 271125 - DNA, 30 bp, Artificial Sequence
  Description of Artificial Sequence: Synthetic oligonucleotide
tcgccaatggagtgactgtcaagctgactc

SEQ ID NO: 271126 - DNA, 29 bp, Artificial Sequence
  Description of Artificial Sequence: Synthetic oligonucleotide
cgccaatggagtgactgtcaagctgactc

SEQ ID NO: 271127 - DNA, 29 bp, Artificial Sequence
  Description of Artificial Sequence: Synthetic oligonucleotide
gccaatggagtgactgtcaagctgactcc

SEQ ID NO: 271128 - DNA, 33 bp, Artificial Sequence
  Description of Artificial Sequence: Synthetic oligonucleotide
ccaatggagtgactgtcaagctgactcctattc

SEQ ID NO: 271129 - DNA, 34 bp, Artificial Sequence
  Description of Artificial Sequence: Synthetic oligonucleotide
caatggagtgactgtcaagctgactcctattcac

SEQ ID NO: 271130 - DNA, 34 bp, Artificial Sequence
  Description of Artificial Sequence: Synthetic oligonucleotide
aatggagtgactgtcaagctgactcctattcacc

SEQ ID NO: 271131 - DNA, 33 bp, Artificial Sequence
  Description of Artificial Sequence: Synthetic oligonucleotide
atggagtgactgtcaagctgactcctattcacc

SEQ ID NO: 271132 - DNA, 32 bp, Artificial Sequence
  Description of Artificial Sequence: Synthetic oligonucleotide
tggagtgactgtcaagctgactcctattcacc

SEQ ID NO: 271133 - DNA, 31 bp, Artificial Sequence
  Description of Artificial Sequence: Synthetic oligonucleotide
ggagtgactgtcaagctgactcctattcacc

SEQ ID NO: 271134 - DNA, 32 bp, Artificial Sequence
  Description of Artificial Sequence: Synthetic oligonucleotide
gagtgactgtcaagctgactcctattcaccac

SEQ ID NO: 271135 - DNA, 32 bp, Artificial Sequence
  Description of Artificial Sequence: Synthetic oligonucleotide
agtgactgtcaagctgactcctattcaccacc

SEQ ID NO: 271136 - DNA, 31 bp, Artificial Sequence
  Description of Artificial Sequence: Synthetic oligonucleotide
gtgactgtcaagctgactcctattcaccacc

SEQ ID NO: 271137 - DNA, 31 bp, Artificial Sequence
  Description of Artificial Sequence: Synthetic oligonucleotide
tgactgtcaagctgactcctattcaccaccg

SEQ ID NO: 271138 - DNA, 30 bp, Artificial Sequence
  Description of Artificial Sequence: Synthetic oligonucleotide
gactgtcaagctgactcctattcaccaccg

SEQ ID NO: 271139 - DNA, 30 bp, Artificial Sequence
  Description of Artificial Sequence: Synthetic oligonucleotide
actgtcaagctgactcctattcaccaccgc

SEQ ID NO: 271140 - DNA, 29 bp, Artificial Sequence
  Description of Artificial Sequence: Synthetic oligonucleotide
ctgtcaagctgactcctattcaccaccgc

SEQ ID NO: 271141 - DNA, 34 bp, Artificial Sequence
  Description of Artificial Sequence: Synthetic oligonucleotide
tgtcaagctgactcctattcaccaccgcatttac

SEQ ID NO: 271142 - DNA, 33 bp, Artificial Sequence
  Description of Artificial Sequence: Synthetic oligonucleotide
gtcaagctgactcctattcaccaccgcatttac

SEQ ID NO: 271143 - DNA, 34 bp, Artificial Sequence
  Description of Artificial Sequence: Synthetic oligonucleotide
tcaagctgactcctattcaccaccgcatttactg

SEQ ID NO: 271144 - DNA, 33 bp, Artificial Sequence
  Description of Artificial Sequence: Synthetic oligonucleotide
caagctgactcctattcaccaccgcatttactg

SEQ ID NO: 271145 - DNA, 33 bp, Artificial Sequence
  Description of Artificial Sequence: Synthetic oligonucleotide
aagctgactcctattcaccaccgcatttactgc

SEQ ID NO: 271146 - DNA, 32 bp, Artificial Sequence
  Description of Artificial Sequence: Synthetic oligonucleotide
agctgactcctattcaccaccgcatttactgc

SEQ ID NO: 271147 - DNA, 31 bp, Artificial Sequence
  Description of Artificial Sequence: Synthetic oligonucleotide
gctgactcctattcaccaccgcatttactgc

SEQ ID NO: 271148 - DNA, 32 bp, Artificial Sequence
  Description of Artificial Sequence: Synthetic oligonucleotide
ctgactcctattcaccaccgcatttactgctg

SEQ ID NO: 271149 - DNA, 33 bp, Artificial Sequence
  Description of Artificial Sequence: Synthetic oligonucleotide
tgactcctattcaccaccgcatttactgctgtc

SEQ ID NO: 271150 - DNA, 32 bp, Artificial Sequence
  Description of Artificial Sequence: Synthetic oligonucleotide
gactcctattcaccaccgcatttactgctgtc

SEQ ID NO: 271151 - DNA, 32 bp, Artificial Sequence
  Description of Artificial Sequence: Synthetic oligonucleotide
actcctattcaccaccgcatttactgctgtcg

SEQ ID NO: 271152 - DNA, 31 bp, Artificial Sequence
  Description of Artificial Sequence: Synthetic oligonucleotide
ctcctattcaccaccgcatttactgctgtcg

SEQ ID NO: 271153 - DNA, 31 bp, Artificial Sequence
  Description of Artificial Sequence: Synthetic oligonucleotide
tcctattcaccaccgcatttactgctgtcgg

SEQ ID NO: 271154 - DNA, 30 bp, Artificial Sequence
  Description of Artificial Sequence: Synthetic oligonucleotide
cctattcaccaccgcatttactgctgtcgg

SEQ ID NO: 271155 - DNA, 31 bp, Artificial Sequence
  Description of Artificial Sequence: Synthetic oligonucleotide
ctattcaccaccgcatttactgctgtcggtc

SEQ ID NO: 271156 - DNA, 32 bp, Artificial Sequence
  Description of Artificial Sequence: Synthetic oligonucleotide
tattcaccaccgcatttactgctgtcggtcag

SEQ ID NO: 271157 - DNA, 31 bp, Artificial Sequence
  Description of Artificial Sequence: Synthetic oligonucleotide
attcaccaccgcatttactgctgtcggtcag

SEQ ID NO: 271158 - DNA, 30 bp, Artificial Sequence
  Description of Artificial Sequence: Synthetic oligonucleotide
ttcaccaccgcatttactgctgtcggtcag

SEQ ID NO: 271159 - DNA, 29 bp, Artificial Sequence
  Description of Artificial Sequence: Synthetic oligonucleotide
tcaccaccgcatttactgctgtcggtcag

SEQ ID NO: 271160 - DNA, 28 bp, Artificial Sequence
  Description of Artificial Sequence: Synthetic oligonucleotide
caccaccgcatttactgctgtcggtcag

SEQ ID NO: 271161 - DNA, 28 bp, Artificial Sequence
  Description of Artificial Sequence: Synthetic oligonucleotide
accaccgcatttactgctgtcggtcagg

SEQ ID NO: 271162 - DNA, 27 bp, Artificial Sequence
  Description of Artificial Sequence: Synthetic oligonucleotide
ccaccgcatttactgctgtcggtcagg

SEQ ID NO: 271163 - DNA, 27 bp, Artificial Sequence
  Description of Artificial Sequence: Synthetic oligonucleotide
caccgcatttactgctgtcggtcaggc

SEQ ID NO: 271164 - DNA, 28 bp, Artificial Sequence
  Description of Artificial Sequence: Synthetic oligonucleotide
accgcatttactgctgtcggtcaggctc

SEQ ID NO: 271165 - DNA, 27 bp, Artificial Sequence
  Description of Artificial Sequence: Synthetic oligonucleotide
ccgcatttactgctgtcggtcaggctc

SEQ ID NO: 271166 - DNA, 28 bp, Artificial Sequence
  Description of Artificial Sequence: Synthetic oligonucleotide
cgcatttactgctgtcggtcaggctcac

SEQ ID NO: 271167 - DNA, 28 bp, Artificial Sequence
  Description of Artificial Sequence: Synthetic oligonucleotide
gcatttactgctgtcggtcaggctcacc

SEQ ID NO: 271168 - DNA, 29 bp, Artificial Sequence
  Description of Artificial Sequence: Synthetic oligonucleotide
catttactgctgtcggtcaggctcacctg

SEQ ID NO: 271169 - DNA, 29 bp, Artificial Sequence
  Description of Artificial Sequence: Synthetic oligonucleotide
atttactgctgtcggtcaggctcacctgc

SEQ ID NO: 271170 - DNA, 28 bp, Artificial Sequence
  Description of Artificial Sequence: Synthetic oligonucleotide
tttactgctgtcggtcaggctcacctgc

SEQ ID NO: 271171 - DNA, 27 bp, Artificial Sequence
  Description of Artificial Sequence: Synthetic oligonucleotide
ttactgctgtcggtcaggctcacctgc

SEQ ID NO: 271172 - DNA, 27 bp, Artificial Sequence
  Description of Artificial Sequence: Synthetic oligonucleotide
tactgctgtcggtcaggctcacctgct

SEQ ID NO: 271173 - DNA, 26 bp, Artificial Sequence
  Description of Artificial Sequence: Synthetic oligonucleotide
actgctgtcggtcaggctcacctgct

SEQ ID NO: 271174 - DNA, 25 bp, Artificial Sequence
  Description of Artificial Sequence: Synthetic oligonucleotide
ctgctgtcggtcaggctcacctgct

SEQ ID NO: 271175 - DNA, 27 bp, Artificial Sequence
  Description of Artificial Sequence: Synthetic oligonucleotide
tgctgtcggtcaggctcacctgctgat

SEQ ID NO: 271176 - DNA, 27 bp, Artificial Sequence
  Description of Artificial Sequence: Synthetic oligonucleotide
gctgtcggtcaggctcacctgctgata

SEQ ID NO: 271177 - DNA, 27 bp, Artificial Sequence
  Description of Artificial Sequence: Synthetic oligonucleotide
ctgtcggtcaggctcacctgctgatag

SEQ ID NO: 271178 - DNA, 27 bp, Artificial Sequence
  Description of Artificial Sequence: Synthetic oligonucleotide
tgtcggtcaggctcacctgctgatagc

SEQ ID NO: 271179 - DNA, 26 bp, Artificial Sequence
  Description of Artificial Sequence: Synthetic oligonucleotide
gtcggtcaggctcacctgctgatagc

SEQ ID NO: 271180 - DNA, 27 bp, Artificial Sequence
  Description of Artificial Sequence: Synthetic oligonucleotide
tcggtcaggctcacctgctgatagcca

SEQ ID NO: 271181 - DNA, 26 bp, Artificial Sequence
  Description of Artificial Sequence: Synthetic oligonucleotide
cggtcaggctcacctgctgatagcca

SEQ ID NO: 271182 - DNA, 26 bp, Artificial Sequence
  Description of Artificial Sequence: Synthetic oligonucleotide
ggtcaggctcacctgctgatagccag

SEQ ID NO: 271183 - DNA, 26 bp, Artificial Sequence
  Description of Artificial Sequence: Synthetic oligonucleotide
gtcaggctcacctgctgatagccagg

SEQ ID NO: 271184 - DNA, 27 bp, Artificial Sequence
  Description of Artificial Sequence: Synthetic oligonucleotide
tcaggctcacctgctgatagccaggca

SEQ ID NO: 271185 - DNA, 26 bp, Artificial Sequence
  Description of Artificial Sequence: Synthetic oligonucleotide
caggctcacctgctgatagccaggca

SEQ ID NO: 271186 - DNA, 27 bp, Artificial Sequence
  Description of Artificial Sequence: Synthetic oligonucleotide
aggctcacctgctgatagccaggcagt

SEQ ID NO: 271187 - DNA, 27 bp, Artificial Sequence
  Description of Artificial Sequence: Synthetic oligonucleotide
ggctcacctgctgatagccaggcagtt

SEQ ID NO: 271188 - DNA, 27 bp, Artificial Sequence
  Description of Artificial Sequence: Synthetic oligonucleotide
gctcacctgctgatagccaggcagttg

SEQ ID NO: 271189 - DNA, 27 bp, Artificial Sequence
  Description of Artificial Sequence: Synthetic oligonucleotide
ctcacctgctgatagccaggcagttgc

SEQ ID NO: 271190 - DNA, 28 bp, Artificial Sequence
  Description of Artificial Sequence: Synthetic oligonucleotide
tcacctgctgatagccaggcagttgctg

SEQ ID NO: 271191 - DNA, 27 bp, Artificial Sequence
  Description of Artificial Sequence: Synthetic oligonucleotide
cacctgctgatagccaggcagttgctg

SEQ ID NO: 271192 - DNA, 29 bp, Artificial Sequence
  Description of Artificial Sequence: Synthetic oligonucleotide
acctgctgatagccaggcagttgctgatg

SEQ ID NO: 271193 - DNA, 28 bp, Artificial Sequence
  Description of Artificial Sequence: Synthetic oligonucleotide
cctgctgatagccaggcagttgctgatg

SEQ ID NO: 271194 - DNA, 28 bp, Artificial Sequence
  Description of Artificial Sequence: Synthetic oligonucleotide
ctgctgatagccaggcagttgctgatgc

SEQ ID NO: 271195 - DNA, 29 bp, Artificial Sequence
  Description of Artificial Sequence: Synthetic oligonucleotide
tgctgatagccaggcagttgctgatgctc

SEQ ID NO: 271196 - DNA, 28 bp, Artificial Sequence
  Description of Artificial Sequence: Synthetic oligonucleotide
gctgatagccaggcagttgctgatgctc

SEQ ID NO: 271197 - DNA, 29 bp, Artificial Sequence
  Description of Artificial Sequence: Synthetic oligonucleotide
ctgatagccaggcagttgctgatgctctc

SEQ ID NO: 271198 - DNA, 30 bp, Artificial Sequence
  Description of Artificial Sequence: Synthetic oligonucleotide
tgatagccaggcagttgctgatgctctcac

SEQ ID NO: 271199 - DNA, 29 bp, Artificial Sequence
  Description of Artificial Sequence: Synthetic oligonucleotide
gatagccaggcagttgctgatgctctcac

SEQ ID NO: 271200 - DNA, 29 bp, Artificial Sequence
  Description of Artificial Sequence: Synthetic oligonucleotide
atagccaggcagttgctgatgctctcacc

SEQ ID NO: 271201 - DNA, 28 bp, Artificial Sequence
  Description of Artificial Sequence: Synthetic oligonucleotide
tagccaggcagttgctgatgctctcacc

SEQ ID NO: 271202 - DNA, 27 bp, Artificial Sequence
  Description of Artificial Sequence: Synthetic oligonucleotide
agccaggcagttgctgatgctctcacc

SEQ ID NO: 271203 - DNA, 27 bp, Artificial Sequence
  Description of Artificial Sequence: Synthetic oligonucleotide
gccaggcagttgctgatgctctcacct

SEQ ID NO: 271204 - DNA, 28 bp, Artificial Sequence
  Description of Artificial Sequence: Synthetic oligonucleotide
ccaggcagttgctgatgctctcacctac

SEQ ID NO: 271205 - DNA, 28 bp, Artificial Sequence
  Description of Artificial Sequence: Synthetic oligonucleotide
caggcagttgctgatgctctcacctacc

SEQ ID NO: 271206 - DNA, 29 bp, Artificial Sequence
  Description of Artificial Sequence: Synthetic oligonucleotide
aggcagttgctgatgctctcacctacctg

SEQ ID NO: 271207 - DNA, 28 bp, Artificial Sequence
  Description of Artificial Sequence: Synthetic oligonucleotide
ggcagttgctgatgctctcacctacctg

SEQ ID NO: 271208 - DNA, 28 bp, Artificial Sequence
  Description of Artificial Sequence: Synthetic oligonucleotide
gcagttgctgatgctctcacctacctgc

SEQ ID NO: 271209 - DNA, 29 bp, Artificial Sequence
  Description of Artificial Sequence: Synthetic oligonucleotide
cagttgctgatgctctcacctacctgctc

SEQ ID NO: 271210 - DNA, 29 bp, Artificial Sequence
  Description of Artificial Sequence: Synthetic oligonucleotide
agttgctgatgctctcacctacctgctcg

SEQ ID NO: 271211 - DNA, 28 bp, Artificial Sequence
  Description of Artificial Sequence: Synthetic oligonucleotide
gttgctgatgctctcacctacctgctcg

SEQ ID NO: 271212 - DNA, 28 bp, Artificial Sequence
  Description of Artificial Sequence: Synthetic oligonucleotide
ttgctgatgctctcacctacctgctcgg

SEQ ID NO: 271213 - DNA, 27 bp, Artificial Sequence
  Description of Artificial Sequence: Synthetic oligonucleotide
tgctgatgctctcacctacctgctcgg

SEQ ID NO: 271214 - DNA, 27 bp, Artificial Sequence
  Description of Artificial Sequence: Synthetic oligonucleotide
gctgatgctctcacctacctgctcggt

SEQ ID NO: 271215 - DNA, 29 bp, Artificial Sequence
  Description of Artificial Sequence: Synthetic oligonucleotide
ctgatgctctcacctacctgctcggtttg

SEQ ID NO: 271216 - DNA, 29 bp, Artificial Sequence
  Description of Artificial Sequence: Synthetic oligonucleotide
tgatgctctcacctacctgctcggtttgc

SEQ ID NO: 271217 - DNA, 28 bp, Artificial Sequence
  Description of Artificial Sequence: Synthetic oligonucleotide
gatgctctcacctacctgctcggtttgc

SEQ ID NO: 271218 - DNA, 29 bp, Artificial Sequence
  Description of Artificial Sequence: Synthetic oligonucleotide
atgctctcacctacctgctcggtttgcac

SEQ ID NO: 271219 - DNA, 28 bp, Artificial Sequence
  Description of Artificial Sequence: Synthetic oligonucleotide
tgctctcacctacctgctcggtttgcac

SEQ ID NO: 271220 - DNA, 27 bp, Artificial Sequence
  Description of Artificial Sequence: Synthetic oligonucleotide
gctctcacctacctgctcggtttgcac

SEQ ID NO: 271221 - DNA, 28 bp, Artificial Sequence
  Description of Artificial Sequence: Synthetic oligonucleotide
ctctcacctacctgctcggtttgcacag

SEQ ID NO: 271222 - DNA, 28 bp, Artificial Sequence
  Description of Artificial Sequence: Synthetic oligonucleotide
tctcacctacctgctcggtttgcacagc

SEQ ID NO: 271223 - DNA, 27 bp, Artificial Sequence
  Description of Artificial Sequence: Synthetic oligonucleotide
ctcacctacctgctcggtttgcacagc

SEQ ID NO: 271224 - DNA, 30 bp, Artificial Sequence
  Description of Artificial Sequence: Synthetic oligonucleotide
tcacctacctgctcggtttgcacagcattc

SEQ ID NO: 271225 - DNA, 29 bp, Artificial Sequence
  Description of Artificial Sequence: Synthetic oligonucleotide
cacctacctgctcggtttgcacagcattc

SEQ ID NO: 271226 - DNA, 31 bp, Artificial Sequence
  Description of Artificial Sequence: Synthetic oligonucleotide
acctacctgctcggtttgcacagcattcaac

SEQ ID NO: 271227 - DNA, 30 bp, Artificial Sequence
  Description of Artificial Sequence: Synthetic oligonucleotide
cctacctgctcggtttgcacagcattcaac

SEQ ID NO: 271228 - DNA, 31 bp, Artificial Sequence
  Description of Artificial Sequence: Synthetic oligonucleotide
ctacctgctcggtttgcacagcattcaactg

SEQ ID NO: 271229 - DNA, 34 bp, Artificial Sequence
  Description of Artificial Sequence: Synthetic oligonucleotide
tacctgctcggtttgcacagcattcaactgaatg

SEQ ID NO: 271230 - DNA, 33 bp, Artificial Sequence
  Description of Artificial Sequence: Synthetic oligonucleotide
acctgctcggtttgcacagcattcaactgaatg

SEQ ID NO: 271231 - DNA, 32 bp, Artificial Sequence
  Description of Artificial Sequence: Synthetic oligonucleotide
cctgctcggtttgcacagcattcaactgaatg

SEQ ID NO: 271232 - DNA, 33 bp, Artificial Sequence
  Description of Artificial Sequence: Synthetic oligonucleotide
ctgctcggtttgcacagcattcaactgaatgtg

SEQ ID NO: 271233 - DNA, 33 bp, Artificial Sequence
  Description of Artificial Sequence: Synthetic oligonucleotide
tgctcggtttgcacagcattcaactgaatgtgc

SEQ ID NO: 271234 - DNA, 32 bp, Artificial Sequence
  Description of Artificial Sequence: Synthetic oligonucleotide
gctcggtttgcacagcattcaactgaatgtgc

SEQ ID NO: 271235 - DNA, 32 bp, Artificial Sequence
  Description of Artificial Sequence: Synthetic oligonucleotide
ctcggtttgcacagcattcaactgaatgtgcc

SEQ ID NO: 271236 - DNA, 33 bp, Artificial Sequence
  Description of Artificial Sequence: Synthetic oligonucleotide
tcggtttgcacagcattcaactgaatgtgcctc

SEQ ID NO: 271237 - DNA, 32 bp, Artificial Sequence
  Description of Artificial Sequence: Synthetic oligonucleotide
cggtttgcacagcattcaactgaatgtgcctc

SEQ ID NO: 271238 - DNA, 32 bp, Artificial Sequence
  Description of Artificial Sequence: Synthetic oligonucleotide
ggtttgcacagcattcaactgaatgtgcctcc

SEQ ID NO: 271239 - DNA, 33 bp, Artificial Sequence
  Description of Artificial Sequence: Synthetic oligonucleotide
gtttgcacagcattcaactgaatgtgcctccac

SEQ ID NO: 271240 - DNA, 34 bp, Artificial Sequence
  Description of Artificial Sequence: Synthetic oligonucleotide
tttgcacagcattcaactgaatgtgcctccactc

SEQ ID NO: 271241 - DNA, 33 bp, Artificial Sequence
  Description of Artificial Sequence: Synthetic oligonucleotide
ttgcacagcattcaactgaatgtgcctccactc

SEQ ID NO: 271242 - DNA, 32 bp, Artificial Sequence
  Description of Artificial Sequence: Synthetic oligonucleotide
tgcacagcattcaactgaatgtgcctccactc

SEQ ID NO: 271243 - DNA, 31 bp, Artificial Sequence
  Description of Artificial Sequence: Synthetic oligonucleotide
gcacagcattcaactgaatgtgcctccactc

SEQ ID NO: 271244 - DNA, 31 bp, Artificial Sequence
  Description of Artificial Sequence: Synthetic oligonucleotide
cacagcattcaactgaatgtgcctccactcg

SEQ ID NO: 271245 - DNA, 32 bp, Artificial Sequence
  Description of Artificial Sequence: Synthetic oligonucleotide
acagcattcaactgaatgtgcctccactcgtc

SEQ ID NO: 271246 - DNA, 31 bp, Artificial Sequence
  Description of Artificial Sequence: Synthetic oligonucleotide
cagcattcaactgaatgtgcctccactcgtc

SEQ ID NO: 271247 - DNA, 31 bp, Artificial Sequence
  Description of Artificial Sequence: Synthetic oligonucleotide
agcattcaactgaatgtgcctccactcgtcc

SEQ ID NO: 271248 - DNA, 30 bp, Artificial Sequence
  Description of Artificial Sequence: Synthetic oligonucleotide
gcattcaactgaatgtgcctccactcgtcc

SEQ ID NO: 271249 - DNA, 31 bp, Artificial Sequence
  Description of Artificial Sequence: Synthetic oligonucleotide
cattcaactgaatgtgcctccactcgtccac

SEQ ID NO: 271250 - DNA, 32 bp, Artificial Sequence
  Description of Artificial Sequence: Synthetic oligonucleotide
attcaactgaatgtgcctccactcgtccacac

SEQ ID NO: 271251 - DNA, 31 bp, Artificial Sequence
  Description of Artificial Sequence: Synthetic oligonucleotide
ttcaactgaatgtgcctccactcgtccacac

SEQ ID NO: 271252 - DNA, 30 bp, Artificial Sequence
  Description of Artificial Sequence: Synthetic oligonucleotide
tcaactgaatgtgcctccactcgtccacac

SEQ ID NO: 271253 - DNA, 29 bp, Artificial Sequence
  Description of Artificial Sequence: Synthetic oligonucleotide
caactgaatgtgcctccactcgtccacac

SEQ ID NO: 271254 - DNA, 30 bp, Artificial Sequence
  Description of Artificial Sequence: Synthetic oligonucleotide
aactgaatgtgcctccactcgtccacacac

SEQ ID NO: 271255 - DNA, 29 bp, Artificial Sequence
  Description of Artificial Sequence: Synthetic oligonucleotide
actgaatgtgcctccactcgtccacacac

SEQ ID NO: 271256 - DNA, 28 bp, Artificial Sequence
  Description of Artificial Sequence: Synthetic oligonucleotide
ctgaatgtgcctccactcgtccacacac

SEQ ID NO: 271257 - DNA, 28 bp, Artificial Sequence
  Description of Artificial Sequence: Synthetic oligonucleotide
tgaatgtgcctccactcgtccacacacc

SEQ ID NO: 271258 - DNA, 27 bp, Artificial Sequence
  Description of Artificial Sequence: Synthetic oligonucleotide
gaatgtgcctccactcgtccacacacc

SEQ ID NO: 271259 - DNA, 28 bp, Artificial Sequence
  Description of Artificial Sequence: Synthetic oligonucleotide
aatgtgcctccactcgtccacacaccag

SEQ ID NO: 271260 - DNA, 27 bp, Artificial Sequence
  Description of Artificial Sequence: Synthetic oligonucleotide
atgtgcctccactcgtccacacaccag

SEQ ID NO: 271261 - DNA, 26 bp, Artificial Sequence
  Description of Artificial Sequence: Synthetic oligonucleotide
tgtgcctccactcgtccacacaccag

SEQ ID NO: 271262 - DNA, 25 bp, Artificial Sequence
  Description of Artificial Sequence: Synthetic oligonucleotide
gtgcctccactcgtccacacaccag

SEQ ID NO: 271263 - DNA, 25 bp, Artificial Sequence
  Description of Artificial Sequence: Synthetic oligonucleotide
tgcctccactcgtccacacaccagc

SEQ ID NO: 271264 - DNA, 24 bp, Artificial Sequence
  Description of Artificial Sequence: Synthetic oligonucleotide
gcctccactcgtccacacaccagc

SEQ ID NO: 271265 - DNA, 25 bp, Artificial Sequence
  Description of Artificial Sequence: Synthetic oligonucleotide
cctccactcgtccacacaccagcca

SEQ ID NO: 271266 - DNA, 25 bp, Artificial Sequence
  Description of Artificial Sequence: Synthetic oligonucleotide
ctccactcgtccacacaccagccag

SEQ ID NO: 271267 - DNA, 25 bp, Artificial Sequence
  Description of Artificial Sequence: Synthetic oligonucleotide
tccactcgtccacacaccagccagc

SEQ ID NO: 271268 - DNA, 24 bp, Artificial Sequence
  Description of Artificial Sequence: Synthetic oligonucleotide
ccactcgtccacacaccagccagc

SEQ ID NO: 271269 - DNA, 25 bp, Artificial Sequence
  Description of Artificial Sequence: Synthetic oligonucleotide
cactcgtccacacaccagccagcca

SEQ ID NO: 271270 - DNA, 27 bp, Artificial Sequence
  Description of Artificial Sequence: Synthetic oligonucleotide
actcgtccacacaccagccagccactt

SEQ ID NO: 271271 - DNA, 27 bp, Artificial Sequence
  Description of Artificial Sequence: Synthetic oligonucleotide
ctcgtccacacaccagccagccacttt

SEQ ID NO: 271272 - DNA, 29 bp, Artificial Sequence
  Description of Artificial Sequence: Synthetic oligonucleotide
tcgtccacacaccagccagccactttaag

SEQ ID NO: 271273 - DNA, 28 bp, Artificial Sequence
  Description of Artificial Sequence: Synthetic oligonucleotide
cgtccacacaccagccagccactttaag

SEQ ID NO: 271274 - DNA, 28 bp, Artificial Sequence
  Description of Artificial Sequence: Synthetic oligonucleotide
gtccacacaccagccagccactttaagg

SEQ ID NO: 271275 - DNA, 29 bp, Artificial Sequence
  Description of Artificial Sequence: Synthetic oligonucleotide
tccacacaccagccagccactttaaggac

SEQ ID NO: 271276 - DNA, 28 bp, Artificial Sequence
  Description of Artificial Sequence: Synthetic oligonucleotide
ccacacaccagccagccactttaaggac

SEQ ID NO: 271277 - DNA, 30 bp, Artificial Sequence
  Description of Artificial Sequence: Synthetic oligonucleotide
cacacaccagccagccactttaaggacatg

SEQ ID NO: 271278 - DNA, 31 bp, Artificial Sequence
  Description of Artificial Sequence: Synthetic oligonucleotide
acacaccagccagccactttaaggacatgtg

SEQ ID NO: 271279 - DNA, 30 bp, Artificial Sequence
  Description of Artificial Sequence: Synthetic oligonucleotide
cacaccagccagccactttaaggacatgtg

SEQ ID NO: 271280 - DNA, 33 bp, Artificial Sequence
  Description of Artificial Sequence: Synthetic oligonucleotide
acaccagccagccactttaaggacatgtgttac

SEQ ID NO: 271281 - DNA, 32 bp, Artificial Sequence
  Description of Artificial Sequence: Synthetic oligonucleotide
caccagccagccactttaaggacatgtgttac

SEQ ID NO: 271282 - DNA, 32 bp, Artificial Sequence
  Description of Artificial Sequence: Synthetic oligonucleotide
accagccagccactttaaggacatgtgttacg

SEQ ID NO: 271283 - DNA, 31 bp, Artificial Sequence
  Description of Artificial Sequence: Synthetic oligonucleotide
ccagccagccactttaaggacatgtgttacg

SEQ ID NO: 271284 - DNA, 31 bp, Artificial Sequence
  Description of Artificial Sequence: Synthetic oligonucleotide
cagccagccactttaaggacatgtgttacgg

SEQ ID NO: 271285 - DNA, 34 bp, Artificial Sequence
  Description of Artificial Sequence: Synthetic oligonucleotide
agccagccactttaaggacatgtgttacggatac

SEQ ID NO: 271286 - DNA, 33 bp, Artificial Sequence
  Description of Artificial Sequence: Synthetic oligonucleotide
gccagccactttaaggacatgtgttacggatac

SEQ ID NO: 271287 - DNA, 33 bp, Artificial Sequence
  Description of Artificial Sequence: Synthetic oligonucleotide
ccagccactttaaggacatgtgttacggatacc

SEQ ID NO: 271288 - DNA, 33 bp, Artificial Sequence
  Description of Artificial Sequence: Synthetic oligonucleotide
cagccactttaaggacatgtgttacggataccg

SEQ ID NO: 271289 - DNA, 33 bp, Artificial Sequence
  Description of Artificial Sequence: Synthetic oligonucleotide
agccactttaaggacatgtgttacggataccgg

SEQ ID NO: 271290 - DNA, 32 bp, Artificial Sequence
  Description of Artificial Sequence: Synthetic oligonucleotide
gccactttaaggacatgtgttacggataccgg

SEQ ID NO: 271291 - DNA, 32 bp, Artificial Sequence
  Description of Artificial Sequence: Synthetic oligonucleotide
ccactttaaggacatgtgttacggataccggg

SEQ ID NO: 271292 - DNA, 34 bp, Artificial Sequence
  Description of Artificial Sequence: Synthetic oligonucleotide
cactttaaggacatgtgttacggataccgggtag

SEQ ID NO: 271293 - DNA, 35 bp, Artificial Sequence
  Description of Artificial Sequence: Synthetic oligonucleotide
actttaaggacatgtgttacggataccgggtagac

SEQ ID NO: 271294 - DNA, 34 bp, Artificial Sequence
  Description of Artificial Sequence: Synthetic oligonucleotide
ctttaaggacatgtgttacggataccgggtagac

SEQ ID NO: 271295 - DNA, 34 bp, Artificial Sequence
  Description of Artificial Sequence: Synthetic oligonucleotide
tttaaggacatgtgttacggataccgggtagacc

SEQ ID NO: 271296 - DNA, 33 bp, Artificial Sequence
  Description of Artificial Sequence: Synthetic oligonucleotide
ttaaggacatgtgttacggataccgggtagacc

SEQ ID NO: 271297 - DNA, 32 bp, Artificial Sequence
  Description of Artificial Sequence: Synthetic oligonucleotide
taaggacatgtgttacggataccgggtagacc

SEQ ID NO: 271298 - DNA, 31 bp, Artificial Sequence
  Description of Artificial Sequence: Synthetic oligonucleotide
aaggacatgtgttacggataccgggtagacc

SEQ ID NO: 271299 - DNA, 30 bp, Artificial Sequence
  Description of Artificial Sequence: Synthetic oligonucleotide
aggacatgtgttacggataccgggtagacc

SEQ ID NO: 271300 - DNA, 29 bp, Artificial Sequence
  Description of Artificial Sequence: Synthetic oligonucleotide
ggacatgtgttacggataccgggtagacc

SEQ ID NO: 271301 - DNA, 30 bp, Artificial Sequence
  Description of Artificial Sequence: Synthetic oligonucleotide
gacatgtgttacggataccgggtagacctg

SEQ ID NO: 271302 - DNA, 32 bp, Artificial Sequence
  Description of Artificial Sequence: Synthetic oligonucleotide
acatgtgttacggataccgggtagacctgatc

SEQ ID NO: 271303 - DNA, 31 bp, Artificial Sequence
  Description of Artificial Sequence: Synthetic oligonucleotide
catgtgttacggataccgggtagacctgatc

SEQ ID NO: 271304 - DNA, 31 bp, Artificial Sequence
  Description of Artificial Sequence: Synthetic oligonucleotide
atgtgttacggataccgggtagacctgatcg

SEQ ID NO: 271305 - DNA, 30 bp, Artificial Sequence
  Description of Artificial Sequence: Synthetic oligonucleotide
tgtgttacggataccgggtagacctgatcg

SEQ ID NO: 271306 - DNA, 29 bp, Artificial Sequence
  Description of Artificial Sequence: Synthetic oligonucleotide
gtgttacggataccgggtagacctgatcg

SEQ ID NO: 271307 - DNA, 29 bp, Artificial Sequence
  Description of Artificial Sequence: Synthetic oligonucleotide
tgttacggataccgggtagacctgatcgc

SEQ ID NO: 271308 - DNA, 28 bp, Artificial Sequence
  Description of Artificial Sequence: Synthetic oligonucleotide
gttacggataccgggtagacctgatcgc

SEQ ID NO: 271309 - DNA, 28 bp, Artificial Sequence
  Description of Artificial Sequence: Synthetic oligonucleotide
ttacggataccgggtagacctgatcgcg

SEQ ID NO: 271310 - DNA, 27 bp, Artificial Sequence
  Description of Artificial Sequence: Synthetic oligonucleotide
tacggataccgggtagacctgatcgcg

SEQ ID NO: 271311 - DNA, 26 bp, Artificial Sequence
  Description of Artificial Sequence: Synthetic oligonucleotide
acggataccgggtagacctgatcgcg

SEQ ID NO: 271312 - DNA, 25 bp, Artificial Sequence
  Description of Artificial Sequence: Synthetic oligonucleotide
cggataccgggtagacctgatcgcg

SEQ ID NO: 271313 - DNA, 25 bp, Artificial Sequence
  Description of Artificial Sequence: Synthetic oligonucleotide
ggataccgggtagacctgatcgcgg

SEQ ID NO: 271314 - DNA, 27 bp, Artificial Sequence
  Description of Artificial Sequence: Synthetic oligonucleotide
gataccgggtagacctgatcgcgggaa

SEQ ID NO: 271315 - DNA, 28 bp, Artificial Sequence
  Description of Artificial Sequence: Synthetic oligonucleotide
ataccgggtagacctgatcgcgggaatc

SEQ ID NO: 271316 - DNA, 27 bp, Artificial Sequence
  Description of Artificial Sequence: Synthetic oligonucleotide
taccgggtagacctgatcgcgggaatc

SEQ ID NO: 271317 - DNA, 27 bp, Artificial Sequence
  Description of Artificial Sequence: Synthetic oligonucleotide
accgggtagacctgatcgcgggaatct

SEQ ID NO: 271318 - DNA, 27 bp, Artificial Sequence
  Description of Artificial Sequence: Synthetic oligonucleotide
ccgggtagacctgatcgcgggaatctt

SEQ ID NO: 271319 - DNA, 27 bp, Artificial Sequence
  Description of Artificial Sequence: Synthetic oligonucleotide
cgggtagacctgatcgcgggaatcttc

SEQ ID NO: 271320 - DNA, 29 bp, Artificial Sequence
  Description of Artificial Sequence: Synthetic oligonucleotide
gggtagacctgatcgcgggaatcttcatc

SEQ ID NO: 271321 - DNA, 29 bp, Artificial Sequence
  Description of Artificial Sequence: Synthetic oligonucleotide
ggtagacctgatcgcgggaatcttcatcg

SEQ ID NO: 271322 - DNA, 29 bp, Artificial Sequence
  Description of Artificial Sequence: Synthetic oligonucleotide
gtagacctgatcgcgggaatcttcatcgc

SEQ ID NO: 271323 - DNA, 30 bp, Artificial Sequence
  Description of Artificial Sequence: Synthetic oligonucleotide
tagacctgatcgcgggaatcttcatcgcag

SEQ ID NO: 271324 - DNA, 29 bp, Artificial Sequence
  Description of Artificial Sequence: Synthetic oligonucleotide
agacctgatcgcgggaatcttcatcgcag

SEQ ID NO: 271325 - DNA, 28 bp, Artificial Sequence
  Description of Artificial Sequence: Synthetic oligonucleotide
gacctgatcgcgggaatcttcatcgcag

SEQ ID NO: 271326 - DNA, 28 bp, Artificial Sequence
  Description of Artificial Sequence: Synthetic oligonucleotide
acctgatcgcgggaatcttcatcgcagc

SEQ ID NO: 271327 - DNA, 27 bp, Artificial Sequence
  Description of Artificial Sequence: Synthetic oligonucleotide
cctgatcgcgggaatcttcatcgcagc

SEQ ID NO: 271328 - DNA, 27 bp, Artificial Sequence
  Description of Artificial Sequence: Synthetic oligonucleotide
ctgatcgcgggaatcttcatcgcagcc

SEQ ID NO: 271329 - DNA, 28 bp, Artificial Sequence
  Description of Artificial Sequence: Synthetic oligonucleotide
tgatcgcgggaatcttcatcgcagcctg

SEQ ID NO: 271330 - DNA, 27 bp, Artificial Sequence
  Description of Artificial Sequence: Synthetic oligonucleotide
gatcgcgggaatcttcatcgcagcctg

SEQ ID NO: 271331 - DNA, 27 bp, Artificial Sequence
  Description of Artificial Sequence: Synthetic oligonucleotide
atcgcgggaatcttcatcgcagcctgg

SEQ ID NO: 271332 - DNA, 26 bp, Artificial Sequence
  Description of Artificial Sequence: Synthetic oligonucleotide
tcgcgggaatcttcatcgcagcctgg

SEQ ID NO: 271333 - DNA, 25 bp, Artificial Sequence
  Description of Artificial Sequence: Synthetic oligonucleotide
cgcgggaatcttcatcgcagcctgg

SEQ ID NO: 271334 - DNA, 26 bp, Artificial Sequence
  Description of Artificial Sequence: Synthetic oligonucleotide
gcgggaatcttcatcgcagcctggga

SEQ ID NO: 271335 - DNA, 26 bp, Artificial Sequence
  Description of Artificial Sequence: Synthetic oligonucleotide
cgggaatcttcatcgcagcctgggac

SEQ ID NO: 271336 - DNA, 26 bp, Artificial Sequence
  Description of Artificial Sequence: Synthetic oligonucleotide
gggaatcttcatcgcagcctgggacc

SEQ ID NO: 271337 - DNA, 27 bp, Artificial Sequence
  Description of Artificial Sequence: Synthetic oligonucleotide
ggaatcttcatcgcagcctgggaccca

SEQ ID NO: 271338 - DNA, 27 bp, Artificial Sequence
  Description of Artificial Sequence: Synthetic oligonucleotide
gaatcttcatcgcagcctgggacccac

SEQ ID NO: 271339 - DNA, 29 bp, Artificial Sequence
  Description of Artificial Sequence: Synthetic oligonucleotide
aatcttcatcgcagcctgggacccacaag

SEQ ID NO: 271340 - DNA, 28 bp, Artificial Sequence
  Description of Artificial Sequence: Synthetic oligonucleotide
atcttcatcgcagcctgggacccacaag

SEQ ID NO: 271341 - DNA, 27 bp, Artificial Sequence
  Description of Artificial Sequence: Synthetic oligonucleotide
tcttcatcgcagcctgggacccacaag

SEQ ID NO: 271342 - DNA, 27 bp, Artificial Sequence
  Description of Artificial Sequence: Synthetic oligonucleotide
cttcatcgcagcctgggacccacaaga

SEQ ID NO: 271343 - DNA, 28 bp, Artificial Sequence
  Description of Artificial Sequence: Synthetic oligonucleotide
ttcatcgcagcctgggacccacaagaag

SEQ ID NO: 271344 - DNA, 27 bp, Artificial Sequence
  Description of Artificial Sequence: Synthetic oligonucleotide
tcatcgcagcctgggacccacaagaag

SEQ ID NO: 271345 - DNA, 26 bp, Artificial Sequence
  Description of Artificial Sequence: Synthetic oligonucleotide
catcgcagcctgggacccacaagaag

SEQ ID NO: 271346 - DNA, 27 bp, Artificial Sequence
  Description of Artificial Sequence: Synthetic oligonucleotide
atcgcagcctgggacccacaagaagga

SEQ ID NO: 271347 - DNA, 26 bp, Artificial Sequence
  Description of Artificial Sequence: Synthetic oligonucleotide
tcgcagcctgggacccacaagaagga

SEQ ID NO: 271348 - DNA, 25 bp, Artificial Sequence
  Description of Artificial Sequence: Synthetic oligonucleotide
cgcagcctgggacccacaagaagga

SEQ ID NO: 271349 - DNA, 25 bp, Artificial Sequence
  Description of Artificial Sequence: Synthetic oligonucleotide
gcagcctgggacccacaagaaggac

SEQ ID NO: 271350 - DNA, 25 bp, Artificial Sequence
  Description of Artificial Sequence: Synthetic oligonucleotide
cagcctgggacccacaagaaggacg

SEQ ID NO: 271351 - DNA, 25 bp, Artificial Sequence
  Description of Artificial Sequence: Synthetic oligonucleotide
agcctgggacccacaagaaggacgg

SEQ ID NO: 271352 - DNA, 24 bp, Artificial Sequence
  Description of Artificial Sequence: Synthetic oligonucleotide
gcctgggacccacaagaaggacgg

SEQ ID NO: 271353 - DNA, 25 bp, Artificial Sequence
  Description of Artificial Sequence: Synthetic oligonucleotide
cctgggacccacaagaaggacggca

SEQ ID NO: 271354 - DNA, 25 bp, Artificial Sequence
  Description of Artificial Sequence: Synthetic oligonucleotide
ctgggacccacaagaaggacggcag

SEQ ID NO: 271355 - DNA, 26 bp, Artificial Sequence
  Description of Artificial Sequence: Synthetic oligonucleotide
tgggacccacaagaaggacggcaggt

SEQ ID NO: 271356 - DNA, 25 bp, Artificial Sequence
  Description of Artificial Sequence: Synthetic oligonucleotide
gggacccacaagaaggacggcaggt

SEQ ID NO: 271357 - DNA, 27 bp, Artificial Sequence
  Description of Artificial Sequence: Synthetic oligonucleotide
ggacccacaagaaggacggcaggtgtt

SEQ ID NO: 271358 - DNA, 27 bp, Artificial Sequence
  Description of Artificial Sequence: Synthetic oligonucleotide
gacccacaagaaggacggcaggtgttc

SEQ ID NO: 271359 - DNA, 28 bp, Artificial Sequence
  Description of Artificial Sequence: Synthetic oligonucleotide
acccacaagaaggacggcaggtgttctc

SEQ ID NO: 271360 - DNA, 27 bp, Artificial Sequence
  Description of Artificial Sequence: Synthetic oligonucleotide
cccacaagaaggacggcaggtgttctc

SEQ ID NO: 271361 - DNA, 28 bp, Artificial Sequence
  Description of Artificial Sequence: Synthetic oligonucleotide
ccacaagaaggacggcaggtgttctcag

SEQ ID NO: 271362 - DNA, 29 bp, Artificial Sequence
  Description of Artificial Sequence: Synthetic oligonucleotide
cacaagaaggacggcaggtgttctcagtg

SEQ ID NO: 271363 - DNA, 29 bp, Artificial Sequence
  Description of Artificial Sequence: Synthetic oligonucleotide
acaagaaggacggcaggtgttctcagtgc

SEQ ID NO: 271364 - DNA, 28 bp, Artificial Sequence
  Description of Artificial Sequence: Synthetic oligonucleotide
caagaaggacggcaggtgttctcagtgc

SEQ ID NO: 271365 - DNA, 28 bp, Artificial Sequence
  Description of Artificial Sequence: Synthetic oligonucleotide
aagaaggacggcaggtgttctcagtgcc

SEQ ID NO: 271366 - DNA, 27 bp, Artificial Sequence
  Description of Artificial Sequence: Synthetic oligonucleotide
agaaggacggcaggtgttctcagtgcc

SEQ ID NO: 271367 - DNA, 27 bp, Artificial Sequence
  Description of Artificial Sequence: Synthetic oligonucleotide
gaaggacggcaggtgttctcagtgcca

SEQ ID NO: 271368 - DNA, 29 bp, Artificial Sequence
  Description of Artificial Sequence: Synthetic oligonucleotide
aaggacggcaggtgttctcagtgccaatg

SEQ ID NO: 271369 - DNA, 28 bp, Artificial Sequence
  Description of Artificial Sequence: Synthetic oligonucleotide
aggacggcaggtgttctcagtgccaatg

SEQ ID NO: 271370 - DNA, 27 bp, Artificial Sequence
  Description of Artificial Sequence: Synthetic oligonucleotide
ggacggcaggtgttctcagtgccaatg

SEQ ID NO: 271371 - DNA, 27 bp, Artificial Sequence
  Description of Artificial Sequence: Synthetic oligonucleotide
gacggcaggtgttctcagtgccaatgg

SEQ ID NO: 271372 - DNA, 27 bp, Artificial Sequence
  Description of Artificial Sequence: Synthetic oligonucleotide
acggcaggtgttctcagtgccaatggg

SEQ ID NO: 271373 - DNA, 26 bp, Artificial Sequence
  Description of Artificial Sequence: Synthetic oligonucleotide
cggcaggtgttctcagtgccaatggg

SEQ ID NO: 271374 - DNA, 26 bp, Artificial Sequence
  Description of Artificial Sequence: Synthetic oligonucleotide
ggcaggtgttctcagtgccaatgggg

SEQ ID NO: 271375 - DNA, 26 bp, Artificial Sequence
  Description of Artificial Sequence: Synthetic oligonucleotide
gcaggtgttctcagtgccaatggggg

SEQ ID NO: 271376 - DNA, 27 bp, Artificial Sequence
  Description of Artificial Sequence: Synthetic oligonucleotide
caggtgttctcagtgccaatggggggt

SEQ ID NO: 271377 - DNA, 29 bp, Artificial Sequence
  Description of Artificial Sequence: Synthetic oligonucleotide
aggtgttctcagtgccaatggggggtttg

SEQ ID NO: 271378 - DNA, 28 bp, Artificial Sequence
  Description of Artificial Sequence: Synthetic oligonucleotide
ggtgttctcagtgccaatggggggtttg

SEQ ID NO: 271379 - DNA, 30 bp, Artificial Sequence
  Description of Artificial Sequence: Synthetic oligonucleotide
gtgttctcagtgccaatggggggtttgatg

SEQ ID NO: 271380 - DNA, 30 bp, Artificial Sequence
  Description of Artificial Sequence: Synthetic oligonucleotide
tgttctcagtgccaatggggggtttgatgg

SEQ ID NO: 271381 - DNA, 29 bp, Artificial Sequence
  Description of Artificial Sequence: Synthetic oligonucleotide
gttctcagtgccaatggggggtttgatgg

SEQ ID NO: 271382 - DNA, 32 bp, Artificial Sequence
  Description of Artificial Sequence: Synthetic oligonucleotide
ttctcagtgccaatggggggtttgatggtaac

SEQ ID NO: 271383 - DNA, 31 bp, Artificial Sequence
  Description of Artificial Sequence: Synthetic oligonucleotide
tctcagtgccaatggggggtttgatggtaac

SEQ ID NO: 271384 - DNA, 30 bp, Artificial Sequence
  Description of Artificial Sequence: Synthetic oligonucleotide
ctcagtgccaatggggggtttgatggtaac

SEQ ID NO: 271385 - DNA, 30 bp, Artificial Sequence
  Description of Artificial Sequence: Synthetic oligonucleotide
tcagtgccaatggggggtttgatggtaacg

SEQ ID NO: 271386 - DNA, 29 bp, Artificial Sequence
  Description of Artificial Sequence: Synthetic oligonucleotide
cagtgccaatggggggtttgatggtaacg

SEQ ID NO: 271387 - DNA, 29 bp, Artificial Sequence
  Description of Artificial Sequence: Synthetic oligonucleotide
agtgccaatggggggtttgatggtaacgc

SEQ ID NO: 271388 - DNA, 28 bp, Artificial Sequence
  Description of Artificial Sequence: Synthetic oligonucleotide
gtgccaatggggggtttgatggtaacgc

SEQ ID NO: 271389 - DNA, 29 bp, Artificial Sequence
  Description of Artificial Sequence: Synthetic oligonucleotide
tgccaatggggggtttgatggtaacgcag

SEQ ID NO: 271390 - DNA, 28 bp, Artificial Sequence
  Description of Artificial Sequence: Synthetic oligonucleotide
gccaatggggggtttgatggtaacgcag

SEQ ID NO: 271391 - DNA, 29 bp, Artificial Sequence
  Description of Artificial Sequence: Synthetic oligonucleotide
ccaatggggggtttgatggtaacgcagtc

SEQ ID NO: 271392 - DNA, 29 bp, Artificial Sequence
  Description of Artificial Sequence: Synthetic oligonucleotide
caatggggggtttgatggtaacgcagtcc

SEQ ID NO: 271393 - DNA, 32 bp, Artificial Sequence
  Description of Artificial Sequence: Synthetic oligonucleotide
aatggggggtttgatggtaacgcagtccttag

SEQ ID NO: 271394 - DNA, 31 bp, Artificial Sequence
  Description of Artificial Sequence: Synthetic oligonucleotide
atggggggtttgatggtaacgcagtccttag

SEQ ID NO: 271395 - DNA, 30 bp, Artificial Sequence
  Description of Artificial Sequence: Synthetic oligonucleotide
tggggggtttgatggtaacgcagtccttag

SEQ ID NO: 271396 - DNA, 29 bp, Artificial Sequence
  Description of Artificial Sequence: Synthetic oligonucleotide
ggggggtttgatggtaacgcagtccttag

SEQ ID NO: 271397 - DNA, 29 bp, Artificial Sequence
  Description of Artificial Sequence: Synthetic oligonucleotide
gggggtttgatggtaacgcagtccttagc

SEQ ID NO: 271398 - DNA, 29 bp, Artificial Sequence
  Description of Artificial Sequence: Synthetic oligonucleotide
ggggtttgatggtaacgcagtccttagcc

SEQ ID NO: 271399 - DNA, 32 bp, Artificial Sequence
  Description of Artificial Sequence: Synthetic oligonucleotide
gggtttgatggtaacgcagtccttagccattg

SEQ ID NO: 271400 - DNA, 32 bp, Artificial Sequence
  Description of Artificial Sequence: Synthetic oligonucleotide
ggtttgatggtaacgcagtccttagccattgg

SEQ ID NO: 271401 - DNA, 33 bp, Artificial Sequence
  Description of Artificial Sequence: Synthetic oligonucleotide
gtttgatggtaacgcagtccttagccattggac

SEQ ID NO: 271402 - DNA, 33 bp, Artificial Sequence
  Description of Artificial Sequence: Synthetic oligonucleotide
tttgatggtaacgcagtccttagccattggacg

SEQ ID NO: 271403 - DNA, 32 bp, Artificial Sequence
  Description of Artificial Sequence: Synthetic oligonucleotide
ttgatggtaacgcagtccttagccattggacg

SEQ ID NO: 271404 - DNA, 31 bp, Artificial Sequence
  Description of Artificial Sequence: Synthetic oligonucleotide
tgatggtaacgcagtccttagccattggacg

SEQ ID NO: 271405 - DNA, 30 bp, Artificial Sequence
  Description of Artificial Sequence: Synthetic oligonucleotide
gatggtaacgcagtccttagccattggacg

SEQ ID NO: 271406 - DNA, 30 bp, Artificial Sequence
  Description of Artificial Sequence: Synthetic oligonucleotide
atggtaacgcagtccttagccattggacgc

SEQ ID NO: 271407 - DNA, 29 bp, Artificial Sequence
  Description of Artificial Sequence: Synthetic oligonucleotide
tggtaacgcagtccttagccattggacgc

SEQ ID NO: 271408 - DNA, 28 bp, Artificial Sequence
  Description of Artificial Sequence: Synthetic oligonucleotide
ggtaacgcagtccttagccattggacgc

SEQ ID NO: 271409 - DNA, 29 bp, Artificial Sequence
  Description of Artificial Sequence: Synthetic oligonucleotide
gtaacgcagtccttagccattggacgctc

SEQ ID NO: 271410 - DNA, 29 bp, Artificial Sequence
  Description of Artificial Sequence: Synthetic oligonucleotide
taacgcagtccttagccattggacgctcc

SEQ ID NO: 271411 - DNA, 28 bp, Artificial Sequence
  Description of Artificial Sequence: Synthetic oligonucleotide
aacgcagtccttagccattggacgctcc

SEQ ID NO: 271412 - DNA, 27 bp, Artificial Sequence
  Description of Artificial Sequence: Synthetic oligonucleotide
acgcagtccttagccattggacgctcc

SEQ ID NO: 271413 - DNA, 26 bp, Artificial Sequence
  Description of Artificial Sequence: Synthetic oligonucleotide
cgcagtccttagccattggacgctcc

SEQ ID NO: 271414 - DNA, 26 bp, Artificial Sequence
  Description of Artificial Sequence: Synthetic oligonucleotide
gcagtccttagccattggacgctccg

SEQ ID NO: 271415 - DNA, 26 bp, Artificial Sequence
  Description of Artificial Sequence: Synthetic oligonucleotide
cagtccttagccattggacgctccgg

SEQ ID NO: 271416 - DNA, 27 bp, Artificial Sequence
  Description of Artificial Sequence: Synthetic oligonucleotide
agtccttagccattggacgctccggga

SEQ ID NO: 271417 - DNA, 26 bp, Artificial Sequence
  Description of Artificial Sequence: Synthetic oligonucleotide
gtccttagccattggacgctccggga

SEQ ID NO: 271418 - DNA, 26 bp, Artificial Sequence
  Description of Artificial Sequence: Synthetic oligonucleotide
tccttagccattggacgctccgggac

SEQ ID NO: 271419 - DNA, 25 bp, Artificial Sequence
  Description of Artificial Sequence: Synthetic oligonucleotide
ccttagccattggacgctccgggac

SEQ ID NO: 271420 - DNA, 26 bp, Artificial Sequence
  Description of Artificial Sequence: Synthetic oligonucleotide
cttagccattggacgctccgggacct

SEQ ID NO: 271421 - DNA, 26 bp, Artificial Sequence
  Description of Artificial Sequence: Synthetic oligonucleotide
ttagccattggacgctccgggacctc

SEQ ID NO: 271422 - DNA, 25 bp, Artificial Sequence
  Description of Artificial Sequence: Synthetic oligonucleotide
tagccattggacgctccgggacctc

SEQ ID NO: 271423 - DNA, 24 bp, Artificial Sequence
  Description of Artificial Sequence: Synthetic oligonucleotide
agccattggacgctccgggacctc

SEQ ID NO: 271424 - DNA, 23 bp, Artificial Sequence
  Description of Artificial Sequence: Synthetic oligonucleotide
gccattggacgctccgggacctc

SEQ ID NO: 271425 - DNA, 25 bp, Artificial Sequence
  Description of Artificial Sequence: Synthetic oligonucleotide
ccattggacgctccgggacctccta

SEQ ID NO: 271426 - DNA, 27 bp, Artificial Sequence
  Description of Artificial Sequence: Synthetic oligonucleotide
cattggacgctccgggacctcctacat

SEQ ID NO: 271427 - DNA, 27 bp, Artificial Sequence
  Description of Artificial Sequence: Synthetic oligonucleotide
attggacgctccgggacctcctacatg

SEQ ID NO: 271428 - DNA, 27 bp, Artificial Sequence
  Description of Artificial Sequence: Synthetic oligonucleotide
ttggacgctccgggacctcctacatgt

SEQ ID NO: 271429 - DNA, 27 bp, Artificial Sequence
  Description of Artificial Sequence: Synthetic oligonucleotide
tggacgctccgggacctcctacatgta

SEQ ID NO: 271430 - DNA, 27 bp, Artificial Sequence
  Description of Artificial Sequence: Synthetic oligonucleotide
ggacgctccgggacctcctacatgtat

SEQ ID NO: 271431 - DNA, 27 bp, Artificial Sequence
  Description of Artificial Sequence: Synthetic oligonucleotide
gacgctccgggacctcctacatgtatg

SEQ ID NO: 271432 - DNA, 27 bp, Artificial Sequence
  Description of Artificial Sequence: Synthetic oligonucleotide
acgctccgggacctcctacatgtatgg

SEQ ID NO: 271433 - DNA, 26 bp, Artificial Sequence
  Description of Artificial Sequence: Synthetic oligonucleotide
cgctccgggacctcctacatgtatgg

SEQ ID NO: 271434 - DNA, 27 bp, Artificial Sequence
  Description of Artificial Sequence: Synthetic oligonucleotide
gctccgggacctcctacatgtatggct

SEQ ID NO: 271435 - DNA, 29 bp, Artificial Sequence
  Description of Artificial Sequence: Synthetic oligonucleotide
ctccgggacctcctacatgtatggctatc

SEQ ID NO: 271436 - DNA, 31 bp, Artificial Sequence
  Description of Artificial Sequence: Synthetic oligonucleotide
tccgggacctcctacatgtatggctatcttg

SEQ ID NO: 271437 - DNA, 30 bp, Artificial Sequence
  Description of Artificial Sequence: Synthetic oligonucleotide
ccgggacctcctacatgtatggctatcttg

SEQ ID NO: 271438 - DNA, 32 bp, Artificial Sequence
  Description of Artificial Sequence: Synthetic oligonucleotide
cgggacctcctacatgtatggctatcttgatg

SEQ ID NO: 271439 - DNA, 32 bp, Artificial Sequence
  Description of Artificial Sequence: Synthetic oligonucleotide
gggacctcctacatgtatggctatcttgatgc

SEQ ID NO: 271440 - DNA, 34 bp, Artificial Sequence
  Description of Artificial Sequence: Synthetic oligonucleotide
ggacctcctacatgtatggctatcttgatgctag

SEQ ID NO: 271441 - DNA, 34 bp, Artificial Sequence
  Description of Artificial Sequence: Synthetic oligonucleotide
gacctcctacatgtatggctatcttgatgctagc

SEQ ID NO: 271442 - DNA, 36 bp, Artificial Sequence
  Description of Artificial Sequence: Synthetic oligonucleotide
acctcctacatgtatggctatcttgatgctagctac

SEQ ID NO: 271443 - DNA, 35 bp, Artificial Sequence
  Description of Artificial Sequence: Synthetic oligonucleotide
cctcctacatgtatggctatcttgatgctagctac

SEQ ID NO: 271444 - DNA, 35 bp, Artificial Sequence
  Description of Artificial Sequence: Synthetic oligonucleotide
ctcctacatgtatggctatcttgatgctagctacc

SEQ ID NO: 271445 - DNA, 35 bp, Artificial Sequence
  Description of Artificial Sequence: Synthetic oligonucleotide
tcctacatgtatggctatcttgatgctagctaccg

SEQ ID NO: 271446 - DNA, 34 bp, Artificial Sequence
  Description of Artificial Sequence: Synthetic oligonucleotide
cctacatgtatggctatcttgatgctagctaccg

SEQ ID NO: 271447 - DNA, 34 bp, Artificial Sequence
  Description of Artificial Sequence: Synthetic oligonucleotide
ctacatgtatggctatcttgatgctagctaccgg

SEQ ID NO: 271448 - DNA, 34 bp, Artificial Sequence
  Description of Artificial Sequence: Synthetic oligonucleotide
tacatgtatggctatcttgatgctagctaccggg

SEQ ID NO: 271449 - DNA, 33 bp, Artificial Sequence
  Description of Artificial Sequence: Synthetic oligonucleotide
acatgtatggctatcttgatgctagctaccggg

SEQ ID NO: 271450 - DNA, 32 bp, Artificial Sequence
  Description of Artificial Sequence: Synthetic oligonucleotide
catgtatggctatcttgatgctagctaccggg

SEQ ID NO: 271451 - DNA, 34 bp, Artificial Sequence
  Description of Artificial Sequence: Synthetic oligonucleotide
atgtatggctatcttgatgctagctaccgggatg

SEQ ID NO: 271452 - DNA, 33 bp, Artificial Sequence
  Description of Artificial Sequence: Synthetic oligonucleotide
tgtatggctatcttgatgctagctaccgggatg

SEQ ID NO: 271453 - DNA, 32 bp, Artificial Sequence
  Description of Artificial Sequence: Synthetic oligonucleotide
gtatggctatcttgatgctagctaccgggatg

SEQ ID NO: 271454 - DNA, 32 bp, Artificial Sequence
  Description of Artificial Sequence: Synthetic oligonucleotide
tatggctatcttgatgctagctaccgggatgg

SEQ ID NO: 271455 - DNA, 31 bp, Artificial Sequence
  Description of Artificial Sequence: Synthetic oligonucleotide
atggctatcttgatgctagctaccgggatgg

SEQ ID NO: 271456 - DNA, 30 bp, Artificial Sequence
  Description of Artificial Sequence: Synthetic oligonucleotide
tggctatcttgatgctagctaccgggatgg

SEQ ID NO: 271457 - DNA, 29 bp, Artificial Sequence
  Description of Artificial Sequence: Synthetic oligonucleotide
ggctatcttgatgctagctaccgggatgg

SEQ ID NO: 271458 - DNA, 29 bp, Artificial Sequence
  Description of Artificial Sequence: Synthetic oligonucleotide
gctatcttgatgctagctaccgggatggc

SEQ ID NO: 271459 - DNA, 31 bp, Artificial Sequence
  Description of Artificial Sequence: Synthetic oligonucleotide
ctatcttgatgctagctaccgggatggcatg

SEQ ID NO: 271460 - DNA, 32 bp, Artificial Sequence
  Description of Artificial Sequence: Synthetic oligonucleotide
tatcttgatgctagctaccgggatggcatgac

SEQ ID NO: 271461 - DNA, 31 bp, Artificial Sequence
  Description of Artificial Sequence: Synthetic oligonucleotide
atcttgatgctagctaccgggatggcatgac

SEQ ID NO: 271462 - DNA, 30 bp, Artificial Sequence
  Description of Artificial Sequence: Synthetic oligonucleotide
tcttgatgctagctaccgggatggcatgac

SEQ ID NO: 271463 - DNA, 29 bp, Artificial Sequence
  Description of Artificial Sequence: Synthetic oligonucleotide
cttgatgctagctaccgggatggcatgac

SEQ ID NO: 271464 - DNA, 29 bp, Artificial Sequence
  Description of Artificial Sequence: Synthetic oligonucleotide
ttgatgctagctaccgggatggcatgacc

SEQ ID NO: 271465 - DNA, 28 bp, Artificial Sequence
  Description of Artificial Sequence: Synthetic oligonucleotide
tgatgctagctaccgggatggcatgacc

SEQ ID NO: 271466 - DNA, 27 bp, Artificial Sequence
  Description of Artificial Sequence: Synthetic oligonucleotide
gatgctagctaccgggatggcatgacc

SEQ ID NO: 271467 - DNA, 29 bp, Artificial Sequence
  Description of Artificial Sequence: Synthetic oligonucleotide
atgctagctaccgggatggcatgacctag

SEQ ID NO: 271468 - DNA, 28 bp, Artificial Sequence
  Description of Artificial Sequence: Synthetic oligonucleotide
tgctagctaccgggatggcatgacctag

SEQ ID NO: 271469 - DNA, 27 bp, Artificial Sequence
  Description of Artificial Sequence: Synthetic oligonucleotide
gctagctaccgggatggcatgacctag

SEQ ID NO: 271470 - DNA, 27 bp, Artificial Sequence
  Description of Artificial Sequence: Synthetic oligonucleotide
ctagctaccgggatggcatgacctagg

SEQ ID NO: 271471 - DNA, 29 bp, Artificial Sequence
  Description of Artificial Sequence: Synthetic oligonucleotide
tagctaccgggatggcatgacctaggaag

SEQ ID NO: 271472 - DNA, 28 bp, Artificial Sequence
  Description of Artificial Sequence: Synthetic oligonucleotide
agctaccgggatggcatgacctaggaag

SEQ ID NO: 271473 - DNA, 27 bp, Artificial Sequence
  Description of Artificial Sequence: Synthetic oligonucleotide
gctaccgggatggcatgacctaggaag

SEQ ID NO: 271474 - DNA, 28 bp, Artificial Sequence
  Description of Artificial Sequence: Synthetic oligonucleotide
ctaccgggatggcatgacctaggaagag

SEQ ID NO: 271475 - DNA, 29 bp, Artificial Sequence
  Description of Artificial Sequence: Synthetic oligonucleotide
taccgggatggcatgacctaggaagagtc

SEQ ID NO: 271476 - DNA, 28 bp, Artificial Sequence
  Description of Artificial Sequence: Synthetic oligonucleotide
accgggatggcatgacctaggaagagtc

SEQ ID NO: 271477 - DNA, 27 bp, Artificial Sequence
  Description of Artificial Sequence: Synthetic oligonucleotide
ccgggatggcatgacctaggaagagtc

SEQ ID NO: 271478 - DNA, 28 bp, Artificial Sequence
  Description of Artificial Sequence: Synthetic oligonucleotide
cgggatggcatgacctaggaagagtctc

SEQ ID NO: 271479 - DNA, 29 bp, Artificial Sequence
  Description of Artificial Sequence: Synthetic oligonucleotide
gggatggcatgacctaggaagagtctctg

SEQ ID NO: 271480 - DNA, 29 bp, Artificial Sequence
  Description of Artificial Sequence: Synthetic oligonucleotide
ggatggcatgacctaggaagagtctctgc

SEQ ID NO: 271481 - DNA, 33 bp, Artificial Sequence
  Description of Artificial Sequence: Synthetic oligonucleotide
gatggcatgacctaggaagagtctctgcaattg

SEQ ID NO: 271482 - DNA, 34 bp, Artificial Sequence
  Description of Artificial Sequence: Synthetic oligonucleotide
atggcatgacctaggaagagtctctgcaattgac

SEQ ID NO: 271483 - DNA, 33 bp, Artificial Sequence
  Description of Artificial Sequence: Synthetic oligonucleotide
tggcatgacctaggaagagtctctgcaattgac

SEQ ID NO: 271484 - DNA, 32 bp, Artificial Sequence
  Description of Artificial Sequence: Synthetic oligonucleotide
ggcatgacctaggaagagtctctgcaattgac

SEQ ID NO: 271485 - DNA, 33 bp, Artificial Sequence
  Description of Artificial Sequence: Synthetic oligonucleotide
gcatgacctaggaagagtctctgcaattgactg

SEQ ID NO: 271486 - DNA, 33 bp, Artificial Sequence
  Description of Artificial Sequence: Synthetic oligonucleotide
catgacctaggaagagtctctgcaattgactgc

SEQ ID NO: 271487 - DNA, 33 bp, Artificial Sequence
  Description of Artificial Sequence: Synthetic oligonucleotide
atgacctaggaagagtctctgcaattgactgcc

SEQ ID NO: 271488 - DNA, 32 bp, Artificial Sequence
  Description of Artificial Sequence: Synthetic oligonucleotide
tgacctaggaagagtctctgcaattgactgcc

SEQ ID NO: 271489 - DNA, 31 bp, Artificial Sequence
  Description of Artificial Sequence: Synthetic oligonucleotide
gacctaggaagagtctctgcaattgactgcc

SEQ ID NO: 271490 - DNA, 34 bp, Artificial Sequence
  Description of Artificial Sequence: Synthetic oligonucleotide
acctaggaagagtctctgcaattgactgccaatc

SEQ ID NO: 271491 - DNA, 33 bp, Artificial Sequence
  Description of Artificial Sequence: Synthetic oligonucleotide
cctaggaagagtctctgcaattgactgccaatc

SEQ ID NO: 271492 - DNA, 33 bp, Artificial Sequence
  Description of Artificial Sequence: Synthetic oligonucleotide
ctaggaagagtctctgcaattgactgccaatcc

SEQ ID NO: 271493 - DNA, 34 bp, Artificial Sequence
  Description of Artificial Sequence: Synthetic oligonucleotide
taggaagagtctctgcaattgactgccaatcctc

SEQ ID NO: 271494 - DNA, 33 bp, Artificial Sequence
  Description of Artificial Sequence: Synthetic oligonucleotide
aggaagagtctctgcaattgactgccaatcctc

SEQ ID NO: 271495 - DNA, 32 bp, Artificial Sequence
  Description of Artificial Sequence: Synthetic oligonucleotide
ggaagagtctctgcaattgactgccaatcctc

SEQ ID NO: 271496 - DNA, 33 bp, Artificial Sequence
  Description of Artificial Sequence: Synthetic oligonucleotide
gaagagtctctgcaattgactgccaatcctctc

SEQ ID NO: 271497 - DNA, 33 bp, Artificial Sequence
  Description of Artificial Sequence: Synthetic oligonucleotide
aagagtctctgcaattgactgccaatcctctcg

SEQ ID NO: 271498 - DNA, 32 bp, Artificial Sequence
  Description of Artificial Sequence: Synthetic oligonucleotide
agagtctctgcaattgactgccaatcctctcg

SEQ ID NO: 271499 - DNA, 31 bp, Artificial Sequence
  Description of Artificial Sequence: Synthetic oligonucleotide
gagtctctgcaattgactgccaatcctctcg

SEQ ID NO: 271500 - DNA, 31 bp, Artificial Sequence
  Description of Artificial Sequence: Synthetic oligonucleotide
agtctctgcaattgactgccaatcctctcgc

SEQ ID NO: 271501 - DNA, 30 bp, Artificial Sequence
  Description of Artificial Sequence: Synthetic oligonucleotide
gtctctgcaattgactgccaatcctctcgc

SEQ ID NO: 271502 - DNA, 33 bp, Artificial Sequence
  Description of Artificial Sequence: Synthetic oligonucleotide
tctctgcaattgactgccaatcctctcgcttag

SEQ ID NO: 271503 - DNA, 32 bp, Artificial Sequence
  Description of Artificial Sequence: Synthetic oligonucleotide
ctctgcaattgactgccaatcctctcgcttag

SEQ ID NO: 271504 - DNA, 32 bp, Artificial Sequence
  Description of Artificial Sequence: Synthetic oligonucleotide
tctgcaattgactgccaatcctctcgcttagg

SEQ ID NO: 271505 - DNA, 31 bp, Artificial Sequence
  Description of Artificial Sequence: Synthetic oligonucleotide
ctgcaattgactgccaatcctctcgcttagg

SEQ ID NO: 271506 - DNA, 31 bp, Artificial Sequence
  Description of Artificial Sequence: Synthetic oligonucleotide
tgcaattgactgccaatcctctcgcttaggc

SEQ ID NO: 271507 - DNA, 30 bp, Artificial Sequence
  Description of Artificial Sequence: Synthetic oligonucleotide
gcaattgactgccaatcctctcgcttaggc

SEQ ID NO: 271508 - DNA, 30 bp, Artificial Sequence
  Description of Artificial Sequence: Synthetic oligonucleotide
caattgactgccaatcctctcgcttaggcc

SEQ ID NO: 271509 - DNA, 32 bp, Artificial Sequence
  Description of Artificial Sequence: Synthetic oligonucleotide
aattgactgccaatcctctcgcttaggccatg

SEQ ID NO: 271510 - DNA, 31 bp, Artificial Sequence
  Description of Artificial Sequence: Synthetic oligonucleotide
attgactgccaatcctctcgcttaggccatg

SEQ ID NO: 271511 - DNA, 30 bp, Artificial Sequence
  Description of Artificial Sequence: Synthetic oligonucleotide
ttgactgccaatcctctcgcttaggccatg

SEQ ID NO: 271512 - DNA, 29 bp, Artificial Sequence
  Description of Artificial Sequence: Synthetic oligonucleotide
tgactgccaatcctctcgcttaggccatg

SEQ ID NO: 271513 - DNA, 28 bp, Artificial Sequence
  Description of Artificial Sequence: Synthetic oligonucleotide
gactgccaatcctctcgcttaggccatg

SEQ ID NO: 271514 - DNA, 28 bp, Artificial Sequence
  Description of Artificial Sequence: Synthetic oligonucleotide
actgccaatcctctcgcttaggccatgg

SEQ ID NO: 271515 - DNA, 27 bp, Artificial Sequence
  Description of Artificial Sequence: Synthetic oligonucleotide
ctgccaatcctctcgcttaggccatgg

SEQ ID NO: 271516 - DNA, 28 bp, Artificial Sequence
  Description of Artificial Sequence: Synthetic oligonucleotide
tgccaatcctctcgcttaggccatggac

SEQ ID NO: 271517 - DNA, 27 bp, Artificial Sequence
  Description of Artificial Sequence: Synthetic oligonucleotide
gccaatcctctcgcttaggccatggac

SEQ ID NO: 271518 - DNA, 27 bp, Artificial Sequence
  Description of Artificial Sequence: Synthetic oligonucleotide
ccaatcctctcgcttaggccatggacc

SEQ ID NO: 271519 - DNA, 27 bp, Artificial Sequence
  Description of Artificial Sequence: Synthetic oligonucleotide
caatcctctcgcttaggccatggaccg

SEQ ID NO: 271520 - DNA, 27 bp, Artificial Sequence
  Description of Artificial Sequence: Synthetic oligonucleotide
aatcctctcgcttaggccatggaccgg

SEQ ID NO: 271521 - DNA, 26 bp, Artificial Sequence
  Description of Artificial Sequence: Synthetic oligonucleotide
atcctctcgcttaggccatggaccgg

SEQ ID NO: 271522 - DNA, 25 bp, Artificial Sequence
  Description of Artificial Sequence: Synthetic oligonucleotide
tcctctcgcttaggccatggaccgg

SEQ ID NO: 271523 - DNA, 24 bp, Artificial Sequence
  Description of Artificial Sequence: Synthetic oligonucleotide
cctctcgcttaggccatggaccgg

SEQ ID NO: 271524 - DNA, 26 bp, Artificial Sequence
  Description of Artificial Sequence: Synthetic oligonucleotide
ctctcgcttaggccatggaccgggat

SEQ ID NO: 271525 - DNA, 26 bp, Artificial Sequence
  Description of Artificial Sequence: Synthetic oligonucleotide
tctcgcttaggccatggaccgggatg

SEQ ID NO: 271526 - DNA, 25 bp, Artificial Sequence
  Description of Artificial Sequence: Synthetic oligonucleotide
ctcgcttaggccatggaccgggatg

SEQ ID NO: 271527 - DNA, 25 bp, Artificial Sequence
  Description of Artificial Sequence: Synthetic oligonucleotide
tcgcttaggccatggaccgggatgg

SEQ ID NO: 271528 - DNA, 24 bp, Artificial Sequence
  Description of Artificial Sequence: Synthetic oligonucleotide
cgcttaggccatggaccgggatgg

SEQ ID NO: 271529 - DNA, 25 bp, Artificial Sequence
  Description of Artificial Sequence: Synthetic oligonucleotide
gcttaggccatggaccgggatggca

SEQ ID NO: 271530 - DNA, 25 bp, Artificial Sequence
  Description of Artificial Sequence: Synthetic oligonucleotide
cttaggccatggaccgggatggcac

SEQ ID NO: 271531 - DNA, 26 bp, Artificial Sequence
  Description of Artificial Sequence: Synthetic oligonucleotide
ttaggccatggaccgggatggcacca

SEQ ID NO: 271532 - DNA, 25 bp, Artificial Sequence
  Description of Artificial Sequence: Synthetic oligonucleotide
taggccatggaccgggatggcacca

SEQ ID NO: 271533 - DNA, 24 bp, Artificial Sequence
  Description of Artificial Sequence: Synthetic oligonucleotide
aggccatggaccgggatggcacca

SEQ ID NO: 271534 - DNA, 23 bp, Artificial Sequence
  Description of Artificial Sequence: Synthetic oligonucleotide
ggccatggaccgggatggcacca

SEQ ID NO: 271535 - DNA, 24 bp, Artificial Sequence
  Description of Artificial Sequence: Synthetic oligonucleotide
gccatggaccgggatggcaccagt

SEQ ID NO: 271536 - DNA, 24 bp, Artificial Sequence
  Description of Artificial Sequence: Synthetic oligonucleotide
ccatggaccgggatggcaccagtg

SEQ ID NO: 271537 - DNA, 25 bp, Artificial Sequence
  Description of Artificial Sequence: Synthetic oligonucleotide
catggaccgggatggcaccagtgga

SEQ ID NO: 271538 - DNA, 25 bp, Artificial Sequence
  Description of Artificial Sequence: Synthetic oligonucleotide
atggaccgggatggcaccagtggag

SEQ ID NO: 271539 - DNA, 24 bp, Artificial Sequence
  Description of Artificial Sequence: Synthetic oligonucleotide
tggaccgggatggcaccagtggag

SEQ ID NO: 271540 - DNA, 23 bp, Artificial Sequence
  Description of Artificial Sequence: Synthetic oligonucleotide
ggaccgggatggcaccagtggag

SEQ ID NO: 271541 - DNA, 24 bp, Artificial Sequence
  Description of Artificial Sequence: Synthetic oligonucleotide
gaccgggatggcaccagtggagca

SEQ ID NO: 271542 - DNA, 25 bp, Artificial Sequence
  Description of Artificial Sequence: Synthetic oligonucleotide
accgggatggcaccagtggagcagt

SEQ ID NO: 271543 - DNA, 24 bp, Artificial Sequence
  Description of Artificial Sequence: Synthetic oligonucleotide
ccgggatggcaccagtggagcagt

SEQ ID NO: 271544 - DNA, 26 bp, Artificial Sequence
  Description of Artificial Sequence: Synthetic oligonucleotide
cgggatggcaccagtggagcagtgat

SEQ ID NO: 271545 - DNA, 26 bp, Artificial Sequence
  Description of Artificial Sequence: Synthetic oligonucleotide
gggatggcaccagtggagcagtgatc

SEQ ID NO: 271546 - DNA, 26 bp, Artificial Sequence
  Description of Artificial Sequence: Synthetic oligonucleotide
ggatggcaccagtggagcagtgatcc

SEQ ID NO: 271547 - DNA, 26 bp, Artificial Sequence
  Description of Artificial Sequence: Synthetic oligonucleotide
gatggcaccagtggagcagtgatccg

SEQ ID NO: 271548 - DNA, 26 bp, Artificial Sequence
  Description of Artificial Sequence: Synthetic oligonucleotide
atggcaccagtggagcagtgatccgg

SEQ ID NO: 271549 - DNA, 25 bp, Artificial Sequence
  Description of Artificial Sequence: Synthetic oligonucleotide
tggcaccagtggagcagtgatccgg

SEQ ID NO: 271550 - DNA, 24 bp, Artificial Sequence
  Description of Artificial Sequence: Synthetic oligonucleotide
ggcaccagtggagcagtgatccgg

SEQ ID NO: 271551 - DNA, 25 bp, Artificial Sequence
  Description of Artificial Sequence: Synthetic oligonucleotide
gcaccagtggagcagtgatccggct

SEQ ID NO: 271552 - DNA, 25 bp, Artificial Sequence
  Description of Artificial Sequence: Synthetic oligonucleotide
caccagtggagcagtgatccggctg

SEQ ID NO: 271553 - DNA, 25 bp, Artificial Sequence
  Description of Artificial Sequence: Synthetic oligonucleotide
accagtggagcagtgatccggctgg

SEQ ID NO: 271554 - DNA, 24 bp, Artificial Sequence
  Description of Artificial Sequence: Synthetic oligonucleotide
ccagtggagcagtgatccggctgg

SEQ ID NO: 271555 - DNA, 25 bp, Artificial Sequence
  Description of Artificial Sequence: Synthetic oligonucleotide
cagtggagcagtgatccggctggca

SEQ ID NO: 271556 - DNA, 25 bp, Artificial Sequence
  Description of Artificial Sequence: Synthetic oligonucleotide
agtggagcagtgatccggctggcag

SEQ ID NO: 271557 - DNA, 24 bp, Artificial Sequence
  Description of Artificial Sequence: Synthetic oligonucleotide
gtggagcagtgatccggctggcag

SEQ ID NO: 271558 - DNA, 24 bp, Artificial Sequence
  Description of Artificial Sequence: Synthetic oligonucleotide
tggagcagtgatccggctggcagc

SEQ ID NO: 271559 - DNA, 23 bp, Artificial Sequence
  Description of Artificial Sequence: Synthetic oligonucleotide
ggagcagtgatccggctggcagc

SEQ ID NO: 271560 - DNA, 26 bp, Artificial Sequence
  Description of Artificial Sequence: Synthetic oligonucleotide
gagcagtgatccggctggcagccttt

SEQ ID NO: 271561 - DNA, 26 bp, Artificial Sequence
  Description of Artificial Sequence: Synthetic oligonucleotide
agcagtgatccggctggcagcctttg

SEQ ID NO: 271562 - DNA, 25 bp, Artificial Sequence
  Description of Artificial Sequence: Synthetic oligonucleotide
gcagtgatccggctggcagcctttg

SEQ ID NO: 271563 - DNA, 26 bp, Artificial Sequence
  Description of Artificial Sequence: Synthetic oligonucleotide
cagtgatccggctggcagcctttgca

SEQ ID NO: 271564 - DNA, 27 bp, Artificial Sequence
  Description of Artificial Sequence: Synthetic oligonucleotide
agtgatccggctggcagcctttgcaga

SEQ ID NO: 271565 - DNA, 26 bp, Artificial Sequence
  Description of Artificial Sequence: Synthetic oligonucleotide
gtgatccggctggcagcctttgcaga

SEQ ID NO: 271566 - DNA, 27 bp, Artificial Sequence
  Description of Artificial Sequence: Synthetic oligonucleotide
tgatccggctggcagcctttgcagagt

SEQ ID NO: 271567 - DNA, 26 bp, Artificial Sequence
  Description of Artificial Sequence: Synthetic oligonucleotide
gatccggctggcagcctttgcagagt

SEQ ID NO: 271568 - DNA, 27 bp, Artificial Sequence
  Description of Artificial Sequence: Synthetic oligonucleotide
atccggctggcagcctttgcagagtga

SEQ ID NO: 271569 - DNA, 26 bp, Artificial Sequence
  Description of Artificial Sequence: Synthetic oligonucleotide
tccggctggcagcctttgcagagtga

SEQ ID NO: 271570 - DNA, 25 bp, Artificial Sequence
  Description of Artificial Sequence: Synthetic oligonucleotide
ccggctggcagcctttgcagagtga

SEQ ID NO: 271571 - DNA, 25 bp, Artificial Sequence
  Description of Artificial Sequence: Synthetic oligonucleotide
cggctggcagcctttgcagagtgag

SEQ ID NO: 271572 - DNA, 25 bp, Artificial Sequence
  Description of Artificial Sequence: Synthetic oligonucleotide
ggctggcagcctttgcagagtgagg

SEQ ID NO: 271573 - DNA, 25 bp, Artificial Sequence
  Description of Artificial Sequence: Synthetic oligonucleotide
gctggcagcctttgcagagtgaggg

SEQ ID NO: 271574 - DNA, 27 bp, Artificial Sequence
  Description of Artificial Sequence: Synthetic oligonucleotide
ctggcagcctttgcagagtgaggggta

SEQ ID NO: 271575 - DNA, 27 bp, Artificial Sequence
  Description of Artificial Sequence: Synthetic oligonucleotide
tggcagcctttgcagagtgaggggtag

SEQ ID NO: 271576 - DNA, 27 bp, Artificial Sequence
  Description of Artificial Sequence: Synthetic oligonucleotide
ggcagcctttgcagagtgaggggtaga

SEQ ID NO: 271577 - DNA, 27 bp, Artificial Sequence
  Description of Artificial Sequence: Synthetic oligonucleotide
gcagcctttgcagagtgaggggtagac

SEQ ID NO: 271578 - DNA, 27 bp, Artificial Sequence
  Description of Artificial Sequence: Synthetic oligonucleotide
cagcctttgcagagtgaggggtagacc

SEQ ID NO: 271579 - DNA, 27 bp, Artificial Sequence
  Description of Artificial Sequence: Synthetic oligonucleotide
agcctttgcagagtgaggggtagaccg

SEQ ID NO: 271580 - DNA, 26 bp, Artificial Sequence
  Description of Artificial Sequence: Synthetic oligonucleotide
gcctttgcagagtgaggggtagaccg

SEQ ID NO: 271581 - DNA, 26 bp, Artificial Sequence
  Description of Artificial Sequence: Synthetic oligonucleotide
cctttgcagagtgaggggtagaccgg

SEQ ID NO: 271582 - DNA, 27 bp, Artificial Sequence
  Description of Artificial Sequence: Synthetic oligonucleotide
ctttgcagagtgaggggtagaccggca

SEQ ID NO: 271583 - DNA, 28 bp, Artificial Sequence
  Description of Artificial Sequence: Synthetic oligonucleotide
tttgcagagtgaggggtagaccggcaag

SEQ ID NO: 271584 - DNA, 27 bp, Artificial Sequence
  Description of Artificial Sequence: Synthetic oligonucleotide
ttgcagagtgaggggtagaccggcaag

SEQ ID NO: 271585 - DNA, 27 bp, Artificial Sequence
  Description of Artificial Sequence: Synthetic oligonucleotide
tgcagagtgaggggtagaccggcaagt

SEQ ID NO: 271586 - DNA, 27 bp, Artificial Sequence
  Description of Artificial Sequence: Synthetic oligonucleotide
gcagagtgaggggtagaccggcaagta

SEQ ID NO: 271587 - DNA, 27 bp, Artificial Sequence
  Description of Artificial Sequence: Synthetic oligonucleotide
cagagtgaggggtagaccggcaagtag

SEQ ID NO: 271588 - DNA, 31 bp, Artificial Sequence
  Description of Artificial Sequence: Synthetic oligonucleotide
agagtgaggggtagaccggcaagtagttttg

SEQ ID NO: 271589 - DNA, 30 bp, Artificial Sequence
  Description of Artificial Sequence: Synthetic oligonucleotide
gagtgaggggtagaccggcaagtagttttg

SEQ ID NO: 271590 - DNA, 30 bp, Artificial Sequence
  Description of Artificial Sequence: Synthetic oligonucleotide
agtgaggggtagaccggcaagtagttttgg

SEQ ID NO: 271591 - DNA, 29 bp, Artificial Sequence
  Description of Artificial Sequence: Synthetic oligonucleotide
gtgaggggtagaccggcaagtagttttgg

SEQ ID NO: 271592 - DNA, 29 bp, Artificial Sequence
  Description of Artificial Sequence: Synthetic oligonucleotide
tgaggggtagaccggcaagtagttttggg

SEQ ID NO: 271593 - DNA, 28 bp, Artificial Sequence
  Description of Artificial Sequence: Synthetic oligonucleotide
gaggggtagaccggcaagtagttttggg

SEQ ID NO: 271594 - DNA, 29 bp, Artificial Sequence
  Description of Artificial Sequence: Synthetic oligonucleotide
aggggtagaccggcaagtagttttgggag

SEQ ID NO: 271595 - DNA, 28 bp, Artificial Sequence
  Description of Artificial Sequence: Synthetic oligonucleotide
ggggtagaccggcaagtagttttgggag

SEQ ID NO: 271596 - DNA, 29 bp, Artificial Sequence
  Description of Artificial Sequence: Synthetic oligonucleotide
gggtagaccggcaagtagttttgggagtc

SEQ ID NO: 271597 - DNA, 29 bp, Artificial Sequence
  Description of Artificial Sequence: Synthetic oligonucleotide
ggtagaccggcaagtagttttgggagtcc

SEQ ID NO: 271598 - DNA, 30 bp, Artificial Sequence
  Description of Artificial Sequence: Synthetic oligonucleotide
gtagaccggcaagtagttttgggagtccag

SEQ ID NO: 271599 - DNA, 33 bp, Artificial Sequence
  Description of Artificial Sequence: Synthetic oligonucleotide
tagaccggcaagtagttttgggagtccagatac

SEQ ID NO: 271600 - DNA, 32 bp, Artificial Sequence
  Description of Artificial Sequence: Synthetic oligonucleotide
agaccggcaagtagttttgggagtccagatac

SEQ ID NO: 271601 - DNA, 31 bp, Artificial Sequence
  Description of Artificial Sequence: Synthetic oligonucleotide
gaccggcaagtagttttgggagtccagatac

SEQ ID NO: 271602 - DNA, 31 bp, Artificial Sequence
  Description of Artificial Sequence: Synthetic oligonucleotide
accggcaagtagttttgggagtccagatacc

SEQ ID NO: 271603 - DNA, 30 bp, Artificial Sequence
  Description of Artificial Sequence: Synthetic oligonucleotide
ccggcaagtagttttgggagtccagatacc

SEQ ID NO: 271604 - DNA, 30 bp, Artificial Sequence
  Description of Artificial Sequence: Synthetic oligonucleotide
cggcaagtagttttgggagtccagataccg

SEQ ID NO: 271605 - DNA, 35 bp, Artificial Sequence
  Description of Artificial Sequence: Synthetic oligonucleotide
ggcaagtagttttgggagtccagataccgaaattc

SEQ ID NO: 271606 - DNA, 35 bp, Artificial Sequence
  Description of Artificial Sequence: Synthetic oligonucleotide
gcaagtagttttgggagtccagataccgaaattcg

SEQ ID NO: 271607 - DNA, 35 bp, Artificial Sequence
  Description of Artificial Sequence: Synthetic oligonucleotide
caagtagttttgggagtccagataccgaaattcgc

SEQ ID NO: 271608 - DNA, 35 bp, Artificial Sequence
  Description of Artificial Sequence: Synthetic oligonucleotide
aagtagttttgggagtccagataccgaaattcgcc

SEQ ID NO: 271609 - DNA, 34 bp, Artificial Sequence
  Description of Artificial Sequence: Synthetic oligonucleotide
agtagttttgggagtccagataccgaaattcgcc

SEQ ID NO: 271610 - DNA, 33 bp, Artificial Sequence
  Description of Artificial Sequence: Synthetic oligonucleotide
gtagttttgggagtccagataccgaaattcgcc

SEQ ID NO: 271611 - DNA, 33 bp, Artificial Sequence
  Description of Artificial Sequence: Synthetic oligonucleotide
tagttttgggagtccagataccgaaattcgccc

SEQ ID NO: 271612 - DNA, 32 bp, Artificial Sequence
  Description of Artificial Sequence: Synthetic oligonucleotide
agttttgggagtccagataccgaaattcgccc

SEQ ID NO: 271613 - DNA, 31 bp, Artificial Sequence
  Description of Artificial Sequence: Synthetic oligonucleotide
gttttgggagtccagataccgaaattcgccc

SEQ ID NO: 271614 - DNA, 33 bp, Artificial Sequence
  Description of Artificial Sequence: Synthetic oligonucleotide
ttttgggagtccagataccgaaattcgcccttg

SEQ ID NO: 271615 - DNA, 32 bp, Artificial Sequence
  Description of Artificial Sequence: Synthetic oligonucleotide
tttgggagtccagataccgaaattcgcccttg

SEQ ID NO: 271616 - DNA, 31 bp, Artificial Sequence
  Description of Artificial Sequence: Synthetic oligonucleotide
ttgggagtccagataccgaaattcgcccttg

SEQ ID NO: 271617 - DNA, 30 bp, Artificial Sequence
  Description of Artificial Sequence: Synthetic oligonucleotide
tgggagtccagataccgaaattcgcccttg

SEQ ID NO: 271618 - DNA, 29 bp, Artificial Sequence
  Description of Artificial Sequence: Synthetic oligonucleotide
gggagtccagataccgaaattcgcccttg

SEQ ID NO: 271619 - DNA, 29 bp, Artificial Sequence
  Description of Artificial Sequence: Synthetic oligonucleotide
ggagtccagataccgaaattcgcccttgc

SEQ ID NO: 271620 - DNA, 29 bp, Artificial Sequence
  Description of Artificial Sequence: Synthetic oligonucleotide
gagtccagataccgaaattcgcccttgcc

SEQ ID NO: 271621 - DNA, 30 bp, Artificial Sequence
  Description of Artificial Sequence: Synthetic oligonucleotide
agtccagataccgaaattcgcccttgccac

SEQ ID NO: 271622 - DNA, 29 bp, Artificial Sequence
  Description of Artificial Sequence: Synthetic oligonucleotide
gtccagataccgaaattcgcccttgccac

SEQ ID NO: 271623 - DNA, 33 bp, Artificial Sequence
  Description of Artificial Sequence: Synthetic oligonucleotide
tccagataccgaaattcgcccttgccacttaac

SEQ ID NO: 271624 - DNA, 32 bp, Artificial Sequence
  Description of Artificial Sequence: Synthetic oligonucleotide
ccagataccgaaattcgcccttgccacttaac

SEQ ID NO: 271625 - DNA, 32 bp, Artificial Sequence
  Description of Artificial Sequence: Synthetic oligonucleotide
cagataccgaaattcgcccttgccacttaacc

SEQ ID NO: 271626 - DNA, 33 bp, Artificial Sequence
  Description of Artificial Sequence: Synthetic oligonucleotide
agataccgaaattcgcccttgccacttaaccac

SEQ ID NO: 271627 - DNA, 32 bp, Artificial Sequence
  Description of Artificial Sequence: Synthetic oligonucleotide
gataccgaaattcgcccttgccacttaaccac

SEQ ID NO: 271628 - DNA, 32 bp, Artificial Sequence
  Description of Artificial Sequence: Synthetic oligonucleotide
ataccgaaattcgcccttgccacttaaccacc

SEQ ID NO: 271629 - DNA, 31 bp, Artificial Sequence
  Description of Artificial Sequence: Synthetic oligonucleotide
taccgaaattcgcccttgccacttaaccacc

SEQ ID NO: 271630 - DNA, 30 bp, Artificial Sequence
  Description of Artificial Sequence: Synthetic oligonucleotide
accgaaattcgcccttgccacttaaccacc

SEQ ID NO: 271631 - DNA, 29 bp, Artificial Sequence
  Description of Artificial Sequence: Synthetic oligonucleotide
ccgaaattcgcccttgccacttaaccacc

SEQ ID NO: 271632 - DNA, 29 bp, Artificial Sequence
  Description of Artificial Sequence: Synthetic oligonucleotide
cgaaattcgcccttgccacttaaccaccc

SEQ ID NO: 271633 - DNA, 29 bp, Artificial Sequence
  Description of Artificial Sequence: Synthetic oligonucleotide
gaaattcgcccttgccacttaaccacccg

SEQ ID NO: 271634 - DNA, 29 bp, Artificial Sequence
  Description of Artificial Sequence: Synthetic oligonucleotide
aaattcgcccttgccacttaaccacccgc

SEQ ID NO: 271635 - DNA, 28 bp, Artificial Sequence
  Description of Artificial Sequence: Synthetic oligonucleotide
aattcgcccttgccacttaaccacccgc

SEQ ID NO: 271636 - DNA, 27 bp, Artificial Sequence
  Description of Artificial Sequence: Synthetic oligonucleotide
attcgcccttgccacttaaccacccgc

SEQ ID NO: 271637 - DNA, 26 bp, Artificial Sequence
  Description of Artificial Sequence: Synthetic oligonucleotide
ttcgcccttgccacttaaccacccgc

SEQ ID NO: 271638 - DNA, 25 bp, Artificial Sequence
  Description of Artificial Sequence: Synthetic oligonucleotide
tcgcccttgccacttaaccacccgc

SEQ ID NO: 271639 - DNA, 24 bp, Artificial Sequence
  Description of Artificial Sequence: Synthetic oligonucleotide
cgcccttgccacttaaccacccgc

SEQ ID NO: 271640 - DNA, 25 bp, Artificial Sequence
  Description of Artificial Sequence: Synthetic oligonucleotide
gcccttgccacttaaccacccgcgt

SEQ ID NO: 271641 - DNA, 26 bp, Artificial Sequence
  Description of Artificial Sequence: Synthetic oligonucleotide
cccttgccacttaaccacccgcgtga

SEQ ID NO: 271642 - DNA, 27 bp, Artificial Sequence
  Description of Artificial Sequence: Synthetic oligonucleotide
atcgcggctgtgacggtgtatggtcca

SEQ ID NO: 271643 - DNA, 26 bp, Artificial Sequence
  Description of Artificial Sequence: Synthetic oligonucleotide
tcgcggctgtgacggtgtatggtcca

SEQ ID NO: 271644 - DNA, 25 bp, Artificial Sequence
  Description of Artificial Sequence: Synthetic oligonucleotide
cgcggctgtgacggtgtatggtcca

SEQ ID NO: 271645 - DNA, 25 bp, Artificial Sequence
  Description of Artificial Sequence: Synthetic oligonucleotide
gcggctgtgacggtgtatggtccac

SEQ ID NO: 271646 - DNA, 26 bp, Artificial Sequence
  Description of Artificial Sequence: Synthetic oligonucleotide
cggctgtgacggtgtatggtccacca

SEQ ID NO: 271647 - DNA, 27 bp, Artificial Sequence
  Description of Artificial Sequence: Synthetic oligonucleotide
ggctgtgacggtgtatggtccaccagt

SEQ ID NO: 271648 - DNA, 28 bp, Artificial Sequence
  Description of Artificial Sequence: Synthetic oligonucleotide
gctgtgacggtgtatggtccaccagtag

SEQ ID NO: 271649 - DNA, 28 bp, Artificial Sequence
  Description of Artificial Sequence: Synthetic oligonucleotide
ctgtgacggtgtatggtccaccagtagg

SEQ ID NO: 271650 - DNA, 29 bp, Artificial Sequence
  Description of Artificial Sequence: Synthetic oligonucleotide
tgtgacggtgtatggtccaccagtaggag

SEQ ID NO: 271651 - DNA, 28 bp, Artificial Sequence
  Description of Artificial Sequence: Synthetic oligonucleotide
gtgacggtgtatggtccaccagtaggag

SEQ ID NO: 271652 - DNA, 28 bp, Artificial Sequence
  Description of Artificial Sequence: Synthetic oligonucleotide
tgacggtgtatggtccaccagtaggagg

SEQ ID NO: 271653 - DNA, 27 bp, Artificial Sequence
  Description of Artificial Sequence: Synthetic oligonucleotide
gacggtgtatggtccaccagtaggagg

SEQ ID NO: 271654 - DNA, 27 bp, Artificial Sequence
  Description of Artificial Sequence: Synthetic oligonucleotide
acggtgtatggtccaccagtaggaggc

SEQ ID NO: 271655 - DNA, 27 bp, Artificial Sequence
  Description of Artificial Sequence: Synthetic oligonucleotide
cggtgtatggtccaccagtaggaggct

SEQ ID NO: 271656 - DNA, 28 bp, Artificial Sequence
  Description of Artificial Sequence: Synthetic oligonucleotide
ggtgtatggtccaccagtaggaggcttc

SEQ ID NO: 271657 - DNA, 29 bp, Artificial Sequence
  Description of Artificial Sequence: Synthetic oligonucleotide
gtgtatggtccaccagtaggaggcttcac

SEQ ID NO: 271658 - DNA, 33 bp, Artificial Sequence
  Description of Artificial Sequence: Synthetic oligonucleotide
tgtatggtccaccagtaggaggcttcacttttg

SEQ ID NO: 271659 - DNA, 32 bp, Artificial Sequence
  Description of Artificial Sequence: Synthetic oligonucleotide
gtatggtccaccagtaggaggcttcacttttg

SEQ ID NO: 271660 - DNA, 36 bp, Artificial Sequence
  Description of Artificial Sequence: Synthetic oligonucleotide
tatggtccaccagtaggaggcttcacttttgatatc

SEQ ID NO: 271661 - DNA, 35 bp, Artificial Sequence
  Description of Artificial Sequence: Synthetic oligonucleotide
atggtccaccagtaggaggcttcacttttgatatc

SEQ ID NO: 271662 - DNA, 34 bp, Artificial Sequence
  Description of Artificial Sequence: Synthetic oligonucleotide
tggtccaccagtaggaggcttcacttttgatatc

SEQ ID NO: 271663 - DNA, 33 bp, Artificial Sequence
  Description of Artificial Sequence: Synthetic oligonucleotide
ggtccaccagtaggaggcttcacttttgatatc

SEQ ID NO: 271664 - DNA, 34 bp, Artificial Sequence
  Description of Artificial Sequence: Synthetic oligonucleotide
gtccaccagtaggaggcttcacttttgatatctg

SEQ ID NO: 271665 - DNA, 34 bp, Artificial Sequence
  Description of Artificial Sequence: Synthetic oligonucleotide
tccaccagtaggaggcttcacttttgatatctgc

SEQ ID NO: 271666 - DNA, 33 bp, Artificial Sequence
  Description of Artificial Sequence: Synthetic oligonucleotide
ccaccagtaggaggcttcacttttgatatctgc

SEQ ID NO: 271667 - DNA, 33 bp, Artificial Sequence
  Description of Artificial Sequence: Synthetic oligonucleotide
caccagtaggaggcttcacttttgatatctgcc

SEQ ID NO: 271668 - DNA, 33 bp, Artificial Sequence
  Description of Artificial Sequence: Synthetic oligonucleotide
accagtaggaggcttcacttttgatatctgccg

SEQ ID NO: 271669 - DNA, 32 bp, Artificial Sequence
  Description of Artificial Sequence: Synthetic oligonucleotide
ccagtaggaggcttcacttttgatatctgccg

SEQ ID NO: 271670 - DNA, 32 bp, Artificial Sequence
  Description of Artificial Sequence: Synthetic oligonucleotide
cagtaggaggcttcacttttgatatctgccgc

SEQ ID NO: 271671 - DNA, 33 bp, Artificial Sequence
  Description of Artificial Sequence: Synthetic oligonucleotide
agtaggaggcttcacttttgatatctgccgcag

SEQ ID NO: 271672 - DNA, 32 bp, Artificial Sequence
  Description of Artificial Sequence: Synthetic oligonucleotide
gtaggaggcttcacttttgatatctgccgcag

SEQ ID NO: 271673 - DNA, 32 bp, Artificial Sequence
  Description of Artificial Sequence: Synthetic oligonucleotide
taggaggcttcacttttgatatctgccgcagc

SEQ ID NO: 271674 - DNA, 31 bp, Artificial Sequence
  Description of Artificial Sequence: Synthetic oligonucleotide
aggaggcttcacttttgatatctgccgcagc

SEQ ID NO: 271675 - DNA, 30 bp, Artificial Sequence
  Description of Artificial Sequence: Synthetic oligonucleotide
ggaggcttcacttttgatatctgccgcagc

SEQ ID NO: 271676 - DNA, 33 bp, Artificial Sequence
  Description of Artificial Sequence: Synthetic oligonucleotide
gaggcttcacttttgatatctgccgcagcaatg

SEQ ID NO: 271677 - DNA, 33 bp, Artificial Sequence
  Description of Artificial Sequence: Synthetic oligonucleotide
aggcttcacttttgatatctgccgcagcaatgc

SEQ ID NO: 271678 - DNA, 32 bp, Artificial Sequence
  Description of Artificial Sequence: Synthetic oligonucleotide
ggcttcacttttgatatctgccgcagcaatgc

SEQ ID NO: 271679 - DNA, 32 bp, Artificial Sequence
  Description of Artificial Sequence: Synthetic oligonucleotide
gcttcacttttgatatctgccgcagcaatgcc

SEQ ID NO: 271680 - DNA, 32 bp, Artificial Sequence
  Description of Artificial Sequence: Synthetic oligonucleotide
cttcacttttgatatctgccgcagcaatgccg

SEQ ID NO: 271681 - DNA, 33 bp, Artificial Sequence
  Description of Artificial Sequence: Synthetic oligonucleotide
ttcacttttgatatctgccgcagcaatgccgtc

SEQ ID NO: 271682 - DNA, 32 bp, Artificial Sequence
  Description of Artificial Sequence: Synthetic oligonucleotide
tcacttttgatatctgccgcagcaatgccgtc

SEQ ID NO: 271683 - DNA, 31 bp, Artificial Sequence
  Description of Artificial Sequence: Synthetic oligonucleotide
cacttttgatatctgccgcagcaatgccgtc

SEQ ID NO: 271684 - DNA, 33 bp, Artificial Sequence
  Description of Artificial Sequence: Synthetic oligonucleotide
acttttgatatctgccgcagcaatgccgtcatg

SEQ ID NO: 271685 - DNA, 32 bp, Artificial Sequence
  Description of Artificial Sequence: Synthetic oligonucleotide
cttttgatatctgccgcagcaatgccgtcatg

SEQ ID NO: 271686 - DNA, 32 bp, Artificial Sequence
  Description of Artificial Sequence: Synthetic oligonucleotide
ttttgatatctgccgcagcaatgccgtcatgg

SEQ ID NO: 271687 - DNA, 31 bp, Artificial Sequence
  Description of Artificial Sequence: Synthetic oligonucleotide
tttgatatctgccgcagcaatgccgtcatgg

SEQ ID NO: 271688 - DNA, 30 bp, Artificial Sequence
  Description of Artificial Sequence: Synthetic oligonucleotide
ttgatatctgccgcagcaatgccgtcatgg

SEQ ID NO: 271689 - DNA, 29 bp, Artificial Sequence
  Description of Artificial Sequence: Synthetic oligonucleotide
tgatatctgccgcagcaatgccgtcatgg

SEQ ID NO: 271690 - DNA, 28 bp, Artificial Sequence
  Description of Artificial Sequence: Synthetic oligonucleotide
gatatctgccgcagcaatgccgtcatgg

SEQ ID NO: 271691 - DNA, 30 bp, Artificial Sequence
  Description of Artificial Sequence: Synthetic oligonucleotide
atatctgccgcagcaatgccgtcatggaag

SEQ ID NO: 271692 - DNA, 29 bp, Artificial Sequence
  Description of Artificial Sequence: Synthetic oligonucleotide
tatctgccgcagcaatgccgtcatggaag

SEQ ID NO: 271693 - DNA, 28 bp, Artificial Sequence
  Description of Artificial Sequence: Synthetic oligonucleotide
atctgccgcagcaatgccgtcatggaag

SEQ ID NO: 271694 - DNA, 27 bp, Artificial Sequence
  Description of Artificial Sequence: Synthetic oligonucleotide
tctgccgcagcaatgccgtcatggaag

SEQ ID NO: 271695 - DNA, 26 bp, Artificial Sequence
  Description of Artificial Sequence: Synthetic oligonucleotide
ctgccgcagcaatgccgtcatggaag

SEQ ID NO: 271696 - DNA, 26 bp, Artificial Sequence
  Description of Artificial Sequence: Synthetic oligonucleotide
tgccgcagcaatgccgtcatggaagc

SEQ ID NO: 271697 - DNA, 25 bp, Artificial Sequence
  Description of Artificial Sequence: Synthetic oligonucleotide
gccgcagcaatgccgtcatggaagc

SEQ ID NO: 271698 - DNA, 25 bp, Artificial Sequence
  Description of Artificial Sequence: Synthetic oligonucleotide
ccgcagcaatgccgtcatggaagcc

SEQ ID NO: 271699 - DNA, 27 bp, Artificial Sequence
  Description of Artificial Sequence: Synthetic oligonucleotide
cgcagcaatgccgtcatggaagccgtt

SEQ ID NO: 271700 - DNA, 30 bp, Artificial Sequence
  Description of Artificial Sequence: Synthetic oligonucleotide
gcagcaatgccgtcatggaagccgtttttg

SEQ ID NO: 271701 - DNA, 30 bp, Artificial Sequence
  Description of Artificial Sequence: Synthetic oligonucleotide
cagcaatgccgtcatggaagccgtttttgc

SEQ ID NO: 271702 - DNA, 33 bp, Artificial Sequence
  Description of Artificial Sequence: Synthetic oligonucleotide
agcaatgccgtcatggaagccgtttttgcaaac

SEQ ID NO: 271703 - DNA, 32 bp, Artificial Sequence
  Description of Artificial Sequence: Synthetic oligonucleotide
gcaatgccgtcatggaagccgtttttgcaaac

SEQ ID NO: 271704 - DNA, 33 bp, Artificial Sequence
  Description of Artificial Sequence: Synthetic oligonucleotide
caatgccgtcatggaagccgtttttgcaaacag

SEQ ID NO: 271705 - DNA, 33 bp, Artificial Sequence
  Description of Artificial Sequence: Synthetic oligonucleotide
aatgccgtcatggaagccgtttttgcaaacagg

SEQ ID NO: 271706 - DNA, 32 bp, Artificial Sequence
  Description of Artificial Sequence: Synthetic oligonucleotide
atgccgtcatggaagccgtttttgcaaacagg

SEQ ID NO: 271707 - DNA, 31 bp, Artificial Sequence
  Description of Artificial Sequence: Synthetic oligonucleotide
tgccgtcatggaagccgtttttgcaaacagg

SEQ ID NO: 271708 - DNA, 30 bp, Artificial Sequence
  Description of Artificial Sequence: Synthetic oligonucleotide
gccgtcatggaagccgtttttgcaaacagg

SEQ ID NO: 271709 - DNA, 30 bp, Artificial Sequence
  Description of Artificial Sequence: Synthetic oligonucleotide
ccgtcatggaagccgtttttgcaaacaggg

SEQ ID NO: 271710 - DNA, 30 bp, Artificial Sequence
  Description of Artificial Sequence: Synthetic oligonucleotide
cgtcatggaagccgtttttgcaaacagggg

SEQ ID NO: 271711 - DNA, 33 bp, Artificial Sequence
  Description of Artificial Sequence: Synthetic oligonucleotide
gtcatggaagccgtttttgcaaacaggggatac

SEQ ID NO: 271712 - DNA, 35 bp, Artificial Sequence
  Description of Artificial Sequence: Synthetic oligonucleotide
tcatggaagccgtttttgcaaacaggggatactag

SEQ ID NO: 271713 - DNA, 34 bp, Artificial Sequence
  Description of Artificial Sequence: Synthetic oligonucleotide
catggaagccgtttttgcaaacaggggatactag

SEQ ID NO: 271714 - DNA, 34 bp, Artificial Sequence
  Description of Artificial Sequence: Synthetic oligonucleotide
atggaagccgtttttgcaaacaggggatactagc

SEQ ID NO: 271715 - DNA, 33 bp, Artificial Sequence
  Description of Artificial Sequence: Synthetic oligonucleotide
tggaagccgtttttgcaaacaggggatactagc

SEQ ID NO: 271716 - DNA, 32 bp, Artificial Sequence
  Description of Artificial Sequence: Synthetic oligonucleotide
ggaagccgtttttgcaaacaggggatactagc

SEQ ID NO: 271717 - DNA, 34 bp, Artificial Sequence
  Description of Artificial Sequence: Synthetic oligonucleotide
gaagccgtttttgcaaacaggggatactagcttc

SEQ ID NO: 271718 - DNA, 34 bp, Artificial Sequence
  Description of Artificial Sequence: Synthetic oligonucleotide
aagccgtttttgcaaacaggggatactagcttcc

SEQ ID NO: 271719 - DNA, 33 bp, Artificial Sequence
  Description of Artificial Sequence: Synthetic oligonucleotide
agccgtttttgcaaacaggggatactagcttcc

SEQ ID NO: 271720 - DNA, 32 bp, Artificial Sequence
  Description of Artificial Sequence: Synthetic oligonucleotide
gccgtttttgcaaacaggggatactagcttcc

SEQ ID NO: 271721 - DNA, 35 bp, Artificial Sequence
  Description of Artificial Sequence: Synthetic oligonucleotide
ccgtttttgcaaacaggggatactagcttccaatg

SEQ ID NO: 271722 - DNA, 35 bp, Artificial Sequence
  Description of Artificial Sequence: Synthetic oligonucleotide
cgtttttgcaaacaggggatactagcttccaatgg

SEQ ID NO: 271723 - DNA, 36 bp, Artificial Sequence
  Description of Artificial Sequence: Synthetic oligonucleotide
gtttttgcaaacaggggatactagcttccaatggtc

SEQ ID NO: 271724 - DNA, 36 bp, Artificial Sequence
  Description of Artificial Sequence: Synthetic oligonucleotide
tttttgcaaacaggggatactagcttccaatggtcc

SEQ ID NO: 271725 - DNA, 35 bp, Artificial Sequence
  Description of Artificial Sequence: Synthetic oligonucleotide
ttttgcaaacaggggatactagcttccaatggtcc

SEQ ID NO: 271726 - DNA, 34 bp, Artificial Sequence
  Description of Artificial Sequence: Synthetic oligonucleotide
tttgcaaacaggggatactagcttccaatggtcc

SEQ ID NO: 271727 - DNA, 33 bp, Artificial Sequence
  Description of Artificial Sequence: Synthetic oligonucleotide
ttgcaaacaggggatactagcttccaatggtcc

SEQ ID NO: 271728 - DNA, 32 bp, Artificial Sequence
  Description of Artificial Sequence: Synthetic oligonucleotide
tgcaaacaggggatactagcttccaatggtcc

SEQ ID NO: 271729 - DNA, 31 bp, Artificial Sequence
  Description of Artificial Sequence: Synthetic oligonucleotide
gcaaacaggggatactagcttccaatggtcc

SEQ ID NO: 271730 - DNA, 31 bp, Artificial Sequence
  Description of Artificial Sequence: Synthetic oligonucleotide
caaacaggggatactagcttccaatggtccg

SEQ ID NO: 271731 - DNA, 31 bp, Artificial Sequence
  Description of Artificial Sequence: Synthetic oligonucleotide
aaacaggggatactagcttccaatggtccgg

SEQ ID NO: 271732 - DNA, 30 bp, Artificial Sequence
  Description of Artificial Sequence: Synthetic oligonucleotide
aacaggggatactagcttccaatggtccgg

SEQ ID NO: 271733 - DNA, 29 bp, Artificial Sequence
  Description of Artificial Sequence: Synthetic oligonucleotide
acaggggatactagcttccaatggtccgg

SEQ ID NO: 271734 - DNA, 28 bp, Artificial Sequence
  Description of Artificial Sequence: Synthetic oligonucleotide
caggggatactagcttccaatggtccgg

SEQ ID NO: 271735 - DNA, 32 bp, Artificial Sequence
  Description of Artificial Sequence: Synthetic oligonucleotide
aggggatactagcttccaatggtccggaatac

SEQ ID NO: 271736 - DNA, 31 bp, Artificial Sequence
  Description of Artificial Sequence: Synthetic oligonucleotide
ggggatactagcttccaatggtccggaatac

SEQ ID NO: 271737 - DNA, 32 bp, Artificial Sequence
  Description of Artificial Sequence: Synthetic oligonucleotide
gggatactagcttccaatggtccggaatactg

SEQ ID NO: 271738 - DNA, 32 bp, Artificial Sequence
  Description of Artificial Sequence: Synthetic oligonucleotide
ggatactagcttccaatggtccggaatactgg

SEQ ID NO: 271739 - DNA, 32 bp, Artificial Sequence
  Description of Artificial Sequence: Synthetic oligonucleotide
gatactagcttccaatggtccggaatactggc

SEQ ID NO: 271740 - DNA, 33 bp, Artificial Sequence
  Description of Artificial Sequence: Synthetic oligonucleotide
atactagcttccaatggtccggaatactggcac

SEQ ID NO: 271741 - DNA, 32 bp, Artificial Sequence
  Description of Artificial Sequence: Synthetic oligonucleotide
tactagcttccaatggtccggaatactggcac

SEQ ID NO: 271742 - DNA, 31 bp, Artificial Sequence
  Description of Artificial Sequence: Synthetic oligonucleotide
actagcttccaatggtccggaatactggcac

SEQ ID NO: 271743 - DNA, 30 bp, Artificial Sequence
  Description of Artificial Sequence: Synthetic oligonucleotide
ctagcttccaatggtccggaatactggcac

SEQ ID NO: 271744 - DNA, 30 bp, Artificial Sequence
  Description of Artificial Sequence: Synthetic oligonucleotide
tagcttccaatggtccggaatactggcacg

SEQ ID NO: 271745 - DNA, 29 bp, Artificial Sequence
  Description of Artificial Sequence: Synthetic oligonucleotide
agcttccaatggtccggaatactggcacg

SEQ ID NO: 271746 - DNA, 28 bp, Artificial Sequence
  Description of Artificial Sequence: Synthetic oligonucleotide
gcttccaatggtccggaatactggcacg

SEQ ID NO: 271747 - DNA, 29 bp, Artificial Sequence
  Description of Artificial Sequence: Synthetic oligonucleotide
cttccaatggtccggaatactggcacgtc

SEQ ID NO: 271748 - DNA, 29 bp, Artificial Sequence
  Description of Artificial Sequence: Synthetic oligonucleotide
ttccaatggtccggaatactggcacgtcc

SEQ ID NO: 271749 - DNA, 28 bp, Artificial Sequence
  Description of Artificial Sequence: Synthetic oligonucleotide
tccaatggtccggaatactggcacgtcc

SEQ ID NO: 271750 - DNA, 27 bp, Artificial Sequence
  Description of Artificial Sequence: Synthetic oligonucleotide
ccaatggtccggaatactggcacgtcc

SEQ ID NO: 271751 - DNA, 29 bp, Artificial Sequence
  Description of Artificial Sequence: Synthetic oligonucleotide
caatggtccggaatactggcacgtccatc

SEQ ID NO: 271752 - DNA, 29 bp, Artificial Sequence
  Description of Artificial Sequence: Synthetic oligonucleotide
aatggtccggaatactggcacgtccatcg

SEQ ID NO: 271753 - DNA, 28 bp, Artificial Sequence
  Description of Artificial Sequence: Synthetic oligonucleotide
atggtccggaatactggcacgtccatcg

SEQ ID NO: 271754 - DNA, 27 bp, Artificial Sequence
  Description of Artificial Sequence: Synthetic oligonucleotide
tggtccggaatactggcacgtccatcg

SEQ ID NO: 271755 - DNA, 26 bp, Artificial Sequence
  Description of Artificial Sequence: Synthetic oligonucleotide
ggtccggaatactggcacgtccatcg

SEQ ID NO: 271756 - DNA, 27 bp, Artificial Sequence
  Description of Artificial Sequence: Synthetic oligonucleotide
gtccggaatactggcacgtccatcgct

SEQ ID NO: 271757 - DNA, 27 bp, Artificial Sequence
  Description of Artificial Sequence: Synthetic oligonucleotide
tccggaatactggcacgtccatcgctg

SEQ ID NO: 271758 - DNA, 26 bp, Artificial Sequence
  Description of Artificial Sequence: Synthetic oligonucleotide
ccggaatactggcacgtccatcgctg

SEQ ID NO: 271759 - DNA, 26 bp, Artificial Sequence
  Description of Artificial Sequence: Synthetic oligonucleotide
cggaatactggcacgtccatcgctgc

SEQ ID NO: 271760 - DNA, 26 bp, Artificial Sequence
  Description of Artificial Sequence: Synthetic oligonucleotide
ggaatactggcacgtccatcgctgcg

SEQ ID NO: 271761 - DNA, 27 bp, Artificial Sequence
  Description of Artificial Sequence: Synthetic oligonucleotide
gaatactggcacgtccatcgctgcggt

SEQ ID NO: 271762 - DNA, 27 bp, Artificial Sequence
  Description of Artificial Sequence: Synthetic oligonucleotide
aatactggcacgtccatcgctgcggtg

SEQ ID NO: 271763 - DNA, 26 bp, Artificial Sequence
  Description of Artificial Sequence: Synthetic oligonucleotide
atactggcacgtccatcgctgcggtg

SEQ ID NO: 271764 - DNA, 25 bp, Artificial Sequence
  Description of Artificial Sequence: Synthetic oligonucleotide
tactggcacgtccatcgctgcggtg

SEQ ID NO: 271765 - DNA, 24 bp, Artificial Sequence
  Description of Artificial Sequence: Synthetic oligonucleotide
actggcacgtccatcgctgcggtg

SEQ ID NO: 271766 - DNA, 23 bp, Artificial Sequence
  Description of Artificial Sequence: Synthetic oligonucleotide
ctggcacgtccatcgctgcggtg

SEQ ID NO: 271767 - DNA, 24 bp, Artificial Sequence
  Description of Artificial Sequence: Synthetic oligonucleotide
tggcacgtccatcgctgcggtggt

SEQ ID NO: 271768 - DNA, 23 bp, Artificial Sequence
  Description of Artificial Sequence: Synthetic oligonucleotide
ggcacgtccatcgctgcggtggt

SEQ ID NO: 271769 - DNA, 27 bp, Artificial Sequence
  Description of Artificial Sequence: Synthetic oligonucleotide
gcacgtccatcgctgcggtggtctaaa

SEQ ID NO: 271770 - DNA, 28 bp, Artificial Sequence
  Description of Artificial Sequence: Synthetic oligonucleotide
cacgtccatcgctgcggtggtctaaaag

SEQ ID NO: 271771 - DNA, 28 bp, Artificial Sequence
  Description of Artificial Sequence: Synthetic oligonucleotide
acgtccatcgctgcggtggtctaaaagg

SEQ ID NO: 271772 - DNA, 27 bp, Artificial Sequence
  Description of Artificial Sequence: Synthetic oligonucleotide
cgtccatcgctgcggtggtctaaaagg

SEQ ID NO: 271773 - DNA, 29 bp, Artificial Sequence
  Description of Artificial Sequence: Synthetic oligonucleotide
gtccatcgctgcggtggtctaaaaggatg

SEQ ID NO: 271774 - DNA, 29 bp, Artificial Sequence
  Description of Artificial Sequence: Synthetic oligonucleotide
tccatcgctgcggtggtctaaaaggatgg

SEQ ID NO: 271775 - DNA, 28 bp, Artificial Sequence
  Description of Artificial Sequence: Synthetic oligonucleotide
ccatcgctgcggtggtctaaaaggatgg

SEQ ID NO: 271776 - DNA, 28 bp, Artificial Sequence
  Description of Artificial Sequence: Synthetic oligonucleotide
catcgctgcggtggtctaaaaggatggc

SEQ ID NO: 271777 - DNA, 31 bp, Artificial Sequence
  Description of Artificial Sequence: Synthetic oligonucleotide
atcgctgcggtggtctaaaaggatggcttag

SEQ ID NO: 271778 - DNA, 30 bp, Artificial Sequence
  Description of Artificial Sequence: Synthetic oligonucleotide
tcgctgcggtggtctaaaaggatggcttag

SEQ ID NO: 271779 - DNA, 29 bp, Artificial Sequence
  Description of Artificial Sequence: Synthetic oligonucleotide
cgctgcggtggtctaaaaggatggcttag

SEQ ID NO: 271780 - DNA, 31 bp, Artificial Sequence
  Description of Artificial Sequence: Synthetic oligonucleotide
gctgcggtggtctaaaaggatggcttagttc

SEQ ID NO: 271781 - DNA, 33 bp, Artificial Sequence
  Description of Artificial Sequence: Synthetic oligonucleotide
ctgcggtggtctaaaaggatggcttagttcttg

SEQ ID NO: 271782 - DNA, 33 bp, Artificial Sequence
  Description of Artificial Sequence: Synthetic oligonucleotide
tgcggtggtctaaaaggatggcttagttcttgc

SEQ ID NO: 271783 - DNA, 32 bp, Artificial Sequence
  Description of Artificial Sequence: Synthetic oligonucleotide
gcggtggtctaaaaggatggcttagttcttgc

SEQ ID NO: 271784 - DNA, 33 bp, Artificial Sequence
  Description of Artificial Sequence: Synthetic oligonucleotide
cggtggtctaaaaggatggcttagttcttgcag

SEQ ID NO: 271785 - DNA, 33 bp, Artificial Sequence
  Description of Artificial Sequence: Synthetic oligonucleotide
ggtggtctaaaaggatggcttagttcttgcagc

SEQ ID NO: 271786 - DNA, 34 bp, Artificial Sequence
  Description of Artificial Sequence: Synthetic oligonucleotide
gtggtctaaaaggatggcttagttcttgcagcag

SEQ ID NO: 271787 - DNA, 37 bp, Artificial Sequence
  Description of Artificial Sequence: Synthetic oligonucleotide
tggtctaaaaggatggcttagttcttgcagcagatac

SEQ ID NO: 271788 - DNA, 36 bp, Artificial Sequence
  Description of Artificial Sequence: Synthetic oligonucleotide
ggtctaaaaggatggcttagttcttgcagcagatac

SEQ ID NO: 271789 - DNA, 38 bp, Artificial Sequence
  Description of Artificial Sequence: Synthetic oligonucleotide
gtctaaaaggatggcttagttcttgcagcagatactag

SEQ ID NO: 271790 - DNA, 39 bp, Artificial Sequence
  Description of Artificial Sequence: Synthetic oligonucleotide
tctaaaaggatggcttagttcttgcagcagatactagag

SEQ ID NO: 271791 - DNA, 38 bp, Artificial Sequence
  Description of Artificial Sequence: Synthetic oligonucleotide
ctaaaaggatggcttagttcttgcagcagatactagag

SEQ ID NO: 271792 - DNA, 38 bp, Artificial Sequence
  Description of Artificial Sequence: Synthetic oligonucleotide
taaaaggatggcttagttcttgcagcagatactagagc

SEQ ID NO: 271793 - DNA, 37 bp, Artificial Sequence
  Description of Artificial Sequence: Synthetic oligonucleotide
aaaaggatggcttagttcttgcagcagatactagagc

SEQ ID NO: 271794 - DNA, 36 bp, Artificial Sequence
  Description of Artificial Sequence: Synthetic oligonucleotide
aaaggatggcttagttcttgcagcagatactagagc

SEQ ID NO: 271795 - DNA, 35 bp, Artificial Sequence
  Description of Artificial Sequence: Synthetic oligonucleotide
aaggatggcttagttcttgcagcagatactagagc

SEQ ID NO: 271796 - DNA, 34 bp, Artificial Sequence
  Description of Artificial Sequence: Synthetic oligonucleotide
aggatggcttagttcttgcagcagatactagagc

SEQ ID NO: 271797 - DNA, 33 bp, Artificial Sequence
  Description of Artificial Sequence: Synthetic oligonucleotide
ggatggcttagttcttgcagcagatactagagc

SEQ ID NO: 271798 - DNA, 35 bp, Artificial Sequence
  Description of Artificial Sequence: Synthetic oligonucleotide
gatggcttagttcttgcagcagatactagagcaac

SEQ ID NO: 271799 - DNA, 36 bp, Artificial Sequence
  Description of Artificial Sequence: Synthetic oligonucleotide
atggcttagttcttgcagcagatactagagcaactc

SEQ ID NO: 271800 - DNA, 35 bp, Artificial Sequence
  Description of Artificial Sequence: Synthetic oligonucleotide
tggcttagttcttgcagcagatactagagcaactc

SEQ ID NO: 271801 - DNA, 34 bp, Artificial Sequence
  Description of Artificial Sequence: Synthetic oligonucleotide
ggcttagttcttgcagcagatactagagcaactc

SEQ ID NO: 271802 - DNA, 36 bp, Artificial Sequence
  Description of Artificial Sequence: Synthetic oligonucleotide
gcttagttcttgcagcagatactagagcaactcaag

SEQ ID NO: 271803 - DNA, 36 bp, Artificial Sequence
  Description of Artificial Sequence: Synthetic oligonucleotide
cttagttcttgcagcagatactagagcaactcaagg

SEQ ID NO: 271804 - DNA, 36 bp, Artificial Sequence
  Description of Artificial Sequence: Synthetic oligonucleotide
ttagttcttgcagcagatactagagcaactcaaggg

SEQ ID NO: 271805 - DNA, 35 bp, Artificial Sequence
  Description of Artificial Sequence: Synthetic oligonucleotide
tagttcttgcagcagatactagagcaactcaaggg

SEQ ID NO: 271806 - DNA, 34 bp, Artificial Sequence
  Description of Artificial Sequence: Synthetic oligonucleotide
agttcttgcagcagatactagagcaactcaaggg

SEQ ID NO: 271807 - DNA, 33 bp, Artificial Sequence
  Description of Artificial Sequence: Synthetic oligonucleotide
gttcttgcagcagatactagagcaactcaaggg

SEQ ID NO: 271808 - DNA, 35 bp, Artificial Sequence
  Description of Artificial Sequence: Synthetic oligonucleotide
ttcttgcagcagatactagagcaactcaagggatg

SEQ ID NO: 271809 - DNA, 34 bp, Artificial Sequence
  Description of Artificial Sequence: Synthetic oligonucleotide
tcttgcagcagatactagagcaactcaagggatg

SEQ ID NO: 271810 - DNA, 33 bp, Artificial Sequence
  Description of Artificial Sequence: Synthetic oligonucleotide
cttgcagcagatactagagcaactcaagggatg

SEQ ID NO: 271811 - DNA, 33 bp, Artificial Sequence
  Description of Artificial Sequence: Synthetic oligonucleotide
ttgcagcagatactagagcaactcaagggatgg

SEQ ID NO: 271812 - DNA, 32 bp, Artificial Sequence
  Description of Artificial Sequence: Synthetic oligonucleotide
tgcagcagatactagagcaactcaagggatgg

SEQ ID NO: 271813 - DNA, 31 bp, Artificial Sequence
  Description of Artificial Sequence: Synthetic oligonucleotide
gcagcagatactagagcaactcaagggatgg

SEQ ID NO: 271814 - DNA, 33 bp, Artificial Sequence
  Description of Artificial Sequence: Synthetic oligonucleotide
cagcagatactagagcaactcaagggatggatg

SEQ ID NO: 271815 - DNA, 35 bp, Artificial Sequence
  Description of Artificial Sequence: Synthetic oligonucleotide
agcagatactagagcaactcaagggatggatgttg

SEQ ID NO: 271816 - DNA, 34 bp, Artificial Sequence
  Description of Artificial Sequence: Synthetic oligonucleotide
gcagatactagagcaactcaagggatggatgttg

SEQ ID NO: 271817 - DNA, 34 bp, Artificial Sequence
  Description of Artificial Sequence: Synthetic oligonucleotide
cagatactagagcaactcaagggatggatgttgc

SEQ ID NO: 271818 - DNA, 35 bp, Artificial Sequence
  Description of Artificial Sequence: Synthetic oligonucleotide
agatactagagcaactcaagggatggatgttgctg

SEQ ID NO: 271819 - DNA, 34 bp, Artificial Sequence
  Description of Artificial Sequence: Synthetic oligonucleotide
gatactagagcaactcaagggatggatgttgctg

SEQ ID NO: 271820 - DNA, 35 bp, Artificial Sequence
  Description of Artificial Sequence: Synthetic oligonucleotide
atactagagcaactcaagggatggatgttgctgag

SEQ ID NO: 271821 - DNA, 34 bp, Artificial Sequence
  Description of Artificial Sequence: Synthetic oligonucleotide
tactagagcaactcaagggatggatgttgctgag

SEQ ID NO: 271822 - DNA, 33 bp, Artificial Sequence
  Description of Artificial Sequence: Synthetic oligonucleotide
actagagcaactcaagggatggatgttgctgag

SEQ ID NO: 271823 - DNA, 32 bp, Artificial Sequence
  Description of Artificial Sequence: Synthetic oligonucleotide
ctagagcaactcaagggatggatgttgctgag

SEQ ID NO: 271824 - DNA, 34 bp, Artificial Sequence
  Description of Artificial Sequence: Synthetic oligonucleotide
tagagcaactcaagggatggatgttgctgagaag

SEQ ID NO: 271825 - DNA, 33 bp, Artificial Sequence
  Description of Artificial Sequence: Synthetic oligonucleotide
agagcaactcaagggatggatgttgctgagaag

SEQ ID NO: 271826 - DNA, 32 bp, Artificial Sequence
  Description of Artificial Sequence: Synthetic oligonucleotide
gagcaactcaagggatggatgttgctgagaag

SEQ ID NO: 271827 - DNA, 34 bp, Artificial Sequence
  Description of Artificial Sequence: Synthetic oligonucleotide
agcaactcaagggatggatgttgctgagaagaac

SEQ ID NO: 271828 - DNA, 33 bp, Artificial Sequence
  Description of Artificial Sequence: Synthetic oligonucleotide
gcaactcaagggatggatgttgctgagaagaac

SEQ ID NO: 271829 - DNA, 34 bp, Artificial Sequence
  Description of Artificial Sequence: Synthetic oligonucleotide
caactcaagggatggatgttgctgagaagaactg

SEQ ID NO: 271830 - DNA, 36 bp, Artificial Sequence
  Description of Artificial Sequence: Synthetic oligonucleotide
aactcaagggatggatgttgctgagaagaactgtac

SEQ ID NO: 271831 - DNA, 35 bp, Artificial Sequence
  Description of Artificial Sequence: Synthetic oligonucleotide
actcaagggatggatgttgctgagaagaactgtac

SEQ ID NO: 271832 - DNA, 34 bp, Artificial Sequence
  Description of Artificial Sequence: Synthetic oligonucleotide
ctcaagggatggatgttgctgagaagaactgtac

SEQ ID NO: 271833 - DNA, 41 bp, Artificial Sequence
  Description of Artificial Sequence: Synthetic oligonucleotide
tcaagggatggatgttgctgagaagaactgtacaaaaatac

SEQ ID NO: 271834 - DNA, 40 bp, Artificial Sequence
  Description of Artificial Sequence: Synthetic oligonucleotide
caagggatggatgttgctgagaagaactgtacaaaaatac

SEQ ID NO: 271835 - DNA, 41 bp, Artificial Sequence
  Description of Artificial Sequence: Synthetic oligonucleotide
aagggatggatgttgctgagaagaactgtacaaaaatactc

SEQ ID NO: 271836 - DNA, 40 bp, Artificial Sequence
  Description of Artificial Sequence: Synthetic oligonucleotide
agggatggatgttgctgagaagaactgtacaaaaatactc

SEQ ID NO: 271837 - DNA, 39 bp, Artificial Sequence
  Description of Artificial Sequence: Synthetic oligonucleotide
gggatggatgttgctgagaagaactgtacaaaaatactc

SEQ ID NO: 271838 - DNA, 41 bp, Artificial Sequence
  Description of Artificial Sequence: Synthetic oligonucleotide
ggatggatgttgctgagaagaactgtacaaaaatactcttc

SEQ ID NO: 271839 - DNA, 45 bp, Artificial Sequence
  Description of Artificial Sequence: Synthetic oligonucleotide
gatggatgttgctgagaagaactgtacaaaaatactcttcatatc

SEQ ID NO: 271840 - DNA, 46 bp, Artificial Sequence
  Description of Artificial Sequence: Synthetic oligonucleotide
atggatgttgctgagaagaactgtacaaaaatactcttcatatcac

SEQ ID NO: 271841 - DNA, 45 bp, Artificial Sequence
  Description of Artificial Sequence: Synthetic oligonucleotide
tggatgttgctgagaagaactgtacaaaaatactcttcatatcac

SEQ ID NO: 271842 - DNA, 44 bp, Artificial Sequence
  Description of Artificial Sequence: Synthetic oligonucleotide
ggatgttgctgagaagaactgtacaaaaatactcttcatatcac

SEQ ID NO: 271843 - DNA, 44 bp, Artificial Sequence
  Description of Artificial Sequence: Synthetic oligonucleotide
gatgttgctgagaagaactgtacaaaaatactcttcatatcacc

SEQ ID NO: 271844 - DNA, 55 bp, Artificial Sequence
  Description of Artificial Sequence: Synthetic oligonucleotide
atgttgctgagaagaactgtacaaaaatactcttcatatcacctaatattaattg

SEQ ID NO: 271845 - DNA, 54 bp, Artificial Sequence
  Description of Artificial Sequence: Synthetic oligonucleotide
tgttgctgagaagaactgtacaaaaatactcttcatatcacctaatattaattg

SEQ ID NO: 271846 - DNA, 53 bp, Artificial Sequence
  Description of Artificial Sequence: Synthetic oligonucleotide
gttgctgagaagaactgtacaaaaatactcttcatatcacctaatattaattg

SEQ ID NO: 271847 - DNA, 55 bp, Artificial Sequence
  Description of Artificial Sequence: Synthetic oligonucleotide
ttgctgagaagaactgtacaaaaatactcttcatatcacctaatattaattgttg

SEQ ID NO: 271848 - DNA, 54 bp, Artificial Sequence
  Description of Artificial Sequence: Synthetic oligonucleotide
tgctgagaagaactgtacaaaaatactcttcatatcacctaatattaattgttg

SEQ ID NO: 271849 - DNA, 53 bp, Artificial Sequence
  Description of Artificial Sequence: Synthetic oligonucleotide
gctgagaagaactgtacaaaaatactcttcatatcacctaatattaattgttg

SEQ ID NO: 271850 - DNA, 54 bp, Artificial Sequence
  Description of Artificial Sequence: Synthetic oligonucleotide
ctgagaagaactgtacaaaaatactcttcatatcacctaatattaattgttgtg

SEQ ID NO: 271851 - DNA, 54 bp, Artificial Sequence
  Description of Artificial Sequence: Synthetic oligonucleotide
tgagaagaactgtacaaaaatactcttcatatcacctaatattaattgttgtgc

SEQ ID NO: 271852 - DNA, 53 bp, Artificial Sequence
  Description of Artificial Sequence: Synthetic oligonucleotide
gagaagaactgtacaaaaatactcttcatatcacctaatattaattgttgtgc

SEQ ID NO: 271853 - DNA, 54 bp, Artificial Sequence
  Description of Artificial Sequence: Synthetic oligonucleotide
agaagaactgtacaaaaatactcttcatatcacctaatattaattgttgtgctg

SEQ ID NO: 271854 - DNA, 53 bp, Artificial Sequence
  Description of Artificial Sequence: Synthetic oligonucleotide
gaagaactgtacaaaaatactcttcatatcacctaatattaattgttgtgctg

SEQ ID NO: 271855 - DNA, 53 bp, Artificial Sequence
  Description of Artificial Sequence: Synthetic oligonucleotide
aagaactgtacaaaaatactcttcatatcacctaatattaattgttgtgctgc

SEQ ID NO: 271856 - DNA, 52 bp, Artificial Sequence
  Description of Artificial Sequence: Synthetic oligonucleotide
agaactgtacaaaaatactcttcatatcacctaatattaattgttgtgctgc

SEQ ID NO: 271857 - DNA, 51 bp, Artificial Sequence
  Description of Artificial Sequence: Synthetic oligonucleotide
gaactgtacaaaaatactcttcatatcacctaatattaattgttgtgctgc

SEQ ID NO: 271858 - DNA, 52 bp, Artificial Sequence
  Description of Artificial Sequence: Synthetic oligonucleotide
aactgtacaaaaatactcttcatatcacctaatattaattgttgtgctgctg

SEQ ID NO: 271859 - DNA, 51 bp, Artificial Sequence
  Description of Artificial Sequence: Synthetic oligonucleotide
actgtacaaaaatactcttcatatcacctaatattaattgttgtgctgctg

SEQ ID NO: 271860 - DNA, 50 bp, Artificial Sequence
  Description of Artificial Sequence: Synthetic oligonucleotide
ctgtacaaaaatactcttcatatcacctaatattaattgttgtgctgctg

SEQ ID NO: 271861 - DNA, 50 bp, Artificial Sequence
  Description of Artificial Sequence: Synthetic oligonucleotide
tgtacaaaaatactcttcatatcacctaatattaattgttgtgctgctgg

SEQ ID NO: 271862 - DNA, 49 bp, Artificial Sequence
  Description of Artificial Sequence: Synthetic oligonucleotide
gtacaaaaatactcttcatatcacctaatattaattgttgtgctgctgg

SEQ ID NO: 271863 - DNA, 49 bp, Artificial Sequence
  Description of Artificial Sequence: Synthetic oligonucleotide
tacaaaaatactcttcatatcacctaatattaattgttgtgctgctggg

SEQ ID NO: 271864 - DNA, 48 bp, Artificial Sequence
  Description of Artificial Sequence: Synthetic oligonucleotide
acaaaaatactcttcatatcacctaatattaattgttgtgctgctggg

SEQ ID NO: 271865 - DNA, 47 bp, Artificial Sequence
  Description of Artificial Sequence: Synthetic oligonucleotide
caaaaatactcttcatatcacctaatattaattgttgtgctgctggg

SEQ ID NO: 271866 - DNA, 48 bp, Artificial Sequence
  Description of Artificial Sequence: Synthetic oligonucleotide
aaaaatactcttcatatcacctaatattaattgttgtgctgctgggac

SEQ ID NO: 271867 - DNA, 47 bp, Artificial Sequence
  Description of Artificial Sequence: Synthetic oligonucleotide
aaaatactcttcatatcacctaatattaattgttgtgctgctgggac

SEQ ID NO: 271868 - DNA, 46 bp, Artificial Sequence
  Description of Artificial Sequence: Synthetic oligonucleotide
aaatactcttcatatcacctaatattaattgttgtgctgctgggac

SEQ ID NO: 271869 - DNA, 45 bp, Artificial Sequence
  Description of Artificial Sequence: Synthetic oligonucleotide
aatactcttcatatcacctaatattaattgttgtgctgctgggac

SEQ ID NO: 271870 - DNA, 44 bp, Artificial Sequence
  Description of Artificial Sequence: Synthetic oligonucleotide
atactcttcatatcacctaatattaattgttgtgctgctgggac

SEQ ID NO: 271871 - DNA, 43 bp, Artificial Sequence
  Description of Artificial Sequence: Synthetic oligonucleotide
tactcttcatatcacctaatattaattgttgtgctgctgggac

SEQ ID NO: 271872 - DNA, 42 bp, Artificial Sequence
  Description of Artificial Sequence: Synthetic oligonucleotide
actcttcatatcacctaatattaattgttgtgctgctgggac

SEQ ID NO: 271873 - DNA, 41 bp, Artificial Sequence
  Description of Artificial Sequence: Synthetic oligonucleotide
ctcttcatatcacctaatattaattgttgtgctgctgggac

SEQ ID NO: 271874 - DNA, 42 bp, Artificial Sequence
  Description of Artificial Sequence: Synthetic oligonucleotide
tcttcatatcacctaatattaattgttgtgctgctgggactg

SEQ ID NO: 271875 - DNA, 41 bp, Artificial Sequence
  Description of Artificial Sequence: Synthetic oligonucleotide
cttcatatcacctaatattaattgttgtgctgctgggactg

SEQ ID NO: 271876 - DNA, 41 bp, Artificial Sequence
  Description of Artificial Sequence: Synthetic oligonucleotide
ttcatatcacctaatattaattgttgtgctgctgggactgc

SEQ ID NO: 271877 - DNA, 40 bp, Artificial Sequence
  Description of Artificial Sequence: Synthetic oligonucleotide
tcatatcacctaatattaattgttgtgctgctgggactgc

SEQ ID NO: 271878 - DNA, 39 bp, Artificial Sequence
  Description of Artificial Sequence: Synthetic oligonucleotide
catatcacctaatattaattgttgtgctgctgggactgc

SEQ ID NO: 271879 - DNA, 40 bp, Artificial Sequence
  Description of Artificial Sequence: Synthetic oligonucleotide
atatcacctaatattaattgttgtgctgctgggactgctg

SEQ ID NO: 271880 - DNA, 39 bp, Artificial Sequence
  Description of Artificial Sequence: Synthetic oligonucleotide
tatcacctaatattaattgttgtgctgctgggactgctg

SEQ ID NO: 271881 - DNA, 38 bp, Artificial Sequence
  Description of Artificial Sequence: Synthetic oligonucleotide
atcacctaatattaattgttgtgctgctgggactgctg

SEQ ID NO: 271882 - DNA, 37 bp, Artificial Sequence
  Description of Artificial Sequence: Synthetic oligonucleotide
tcacctaatattaattgttgtgctgctgggactgctg

SEQ ID NO: 271883 - DNA, 36 bp, Artificial Sequence
  Description of Artificial Sequence: Synthetic oligonucleotide
cacctaatattaattgttgtgctgctgggactgctg

SEQ ID NO: 271884 - DNA, 36 bp, Artificial Sequence
  Description of Artificial Sequence: Synthetic oligonucleotide
acctaatattaattgttgtgctgctgggactgctgc

SEQ ID NO: 271885 - DNA, 35 bp, Artificial Sequence
  Description of Artificial Sequence: Synthetic oligonucleotide
cctaatattaattgttgtgctgctgggactgctgc

SEQ ID NO: 271886 - DNA, 36 bp, Artificial Sequence
  Description of Artificial Sequence: Synthetic oligonucleotide
ctaatattaattgttgtgctgctgggactgctgcag

SEQ ID NO: 271887 - DNA, 37 bp, Artificial Sequence
  Description of Artificial Sequence: Synthetic oligonucleotide
taatattaattgttgtgctgctgggactgctgcagac

SEQ ID NO: 271888 - DNA, 36 bp, Artificial Sequence
  Description of Artificial Sequence: Synthetic oligonucleotide
aatattaattgttgtgctgctgggactgctgcagac

SEQ ID NO: 271889 - DNA, 35 bp, Artificial Sequence
  Description of Artificial Sequence: Synthetic oligonucleotide
atattaattgttgtgctgctgggactgctgcagac

SEQ ID NO: 271890 - DNA, 34 bp, Artificial Sequence
  Description of Artificial Sequence: Synthetic oligonucleotide
tattaattgttgtgctgctgggactgctgcagac

SEQ ID NO: 271891 - DNA, 33 bp, Artificial Sequence
  Description of Artificial Sequence: Synthetic oligonucleotide
attaattgttgtgctgctgggactgctgcagac

SEQ ID NO: 271892 - DNA, 32 bp, Artificial Sequence
  Description of Artificial Sequence: Synthetic oligonucleotide
ttaattgttgtgctgctgggactgctgcagac

SEQ ID NO: 271893 - DNA, 31 bp, Artificial Sequence
  Description of Artificial Sequence: Synthetic oligonucleotide
taattgttgtgctgctgggactgctgcagac

SEQ ID NO: 271894 - DNA, 30 bp, Artificial Sequence
  Description of Artificial Sequence: Synthetic oligonucleotide
aattgttgtgctgctgggactgctgcagac

SEQ ID NO: 271895 - DNA, 29 bp, Artificial Sequence
  Description of Artificial Sequence: Synthetic oligonucleotide
attgttgtgctgctgggactgctgcagac

SEQ ID NO: 271896 - DNA, 28 bp, Artificial Sequence
  Description of Artificial Sequence: Synthetic oligonucleotide
ttgttgtgctgctgggactgctgcagac

SEQ ID NO: 271897 - DNA, 27 bp, Artificial Sequence
  Description of Artificial Sequence: Synthetic oligonucleotide
tgttgtgctgctgggactgctgcagac

SEQ ID NO: 271898 - DNA, 27 bp, Artificial Sequence
  Description of Artificial Sequence: Synthetic oligonucleotide
gttgtgctgctgggactgctgcagact

SEQ ID NO: 271899 - DNA, 27 bp, Artificial Sequence
  Description of Artificial Sequence: Synthetic oligonucleotide
ttgtgctgctgggactgctgcagactc

SEQ ID NO: 271900 - DNA, 27 bp, Artificial Sequence
  Description of Artificial Sequence: Synthetic oligonucleotide
tgtgctgctgggactgctgcagactca

SEQ ID NO: 271901 - DNA, 26 bp, Artificial Sequence
  Description of Artificial Sequence: Synthetic oligonucleotide
gtgctgctgggactgctgcagactca

SEQ ID NO: 271902 - DNA, 27 bp, Artificial Sequence
  Description of Artificial Sequence: Synthetic oligonucleotide
tgctgctgggactgctgcagactcaga

SEQ ID NO: 271903 - DNA, 26 bp, Artificial Sequence
  Description of Artificial Sequence: Synthetic oligonucleotide
gctgctgggactgctgcagactcaga

SEQ ID NO: 271904 - DNA, 27 bp, Artificial Sequence
  Description of Artificial Sequence: Synthetic oligonucleotide
ctgctgggactgctgcagactcagaca

SEQ ID NO: 271905 - DNA, 28 bp, Artificial Sequence
  Description of Artificial Sequence: Synthetic oligonucleotide
tgctgggactgctgcagactcagacatg

SEQ ID NO: 271906 - DNA, 27 bp, Artificial Sequence
  Description of Artificial Sequence: Synthetic oligonucleotide
gctgggactgctgcagactcagacatg

SEQ ID NO: 271907 - DNA, 28 bp, Artificial Sequence
  Description of Artificial Sequence: Synthetic oligonucleotide
ctgggactgctgcagactcagacatgag

SEQ ID NO: 271908 - DNA, 30 bp, Artificial Sequence
  Description of Artificial Sequence: Synthetic oligonucleotide
tgggactgctgcagactcagacatgagaac

SEQ ID NO: 271909 - DNA, 29 bp, Artificial Sequence
  Description of Artificial Sequence: Synthetic oligonucleotide
gggactgctgcagactcagacatgagaac

SEQ ID NO: 271910 - DNA, 29 bp, Artificial Sequence
  Description of Artificial Sequence: Synthetic oligonucleotide
ggactgctgcagactcagacatgagaacc

SEQ ID NO: 271911 - DNA, 29 bp, Artificial Sequence
  Description of Artificial Sequence: Synthetic oligonucleotide
gactgctgcagactcagacatgagaaccc

SEQ ID NO: 271912 - DNA, 30 bp, Artificial Sequence
  Description of Artificial Sequence: Synthetic oligonucleotide
actgctgcagactcagacatgagaacccag

SEQ ID NO: 271913 - DNA, 29 bp, Artificial Sequence
  Description of Artificial Sequence: Synthetic oligonucleotide
ctgctgcagactcagacatgagaacccag

SEQ ID NO: 271914 - DNA, 29 bp, Artificial Sequence
  Description of Artificial Sequence: Synthetic oligonucleotide
tgctgcagactcagacatgagaacccagc

SEQ ID NO: 271915 - DNA, 28 bp, Artificial Sequence
  Description of Artificial Sequence: Synthetic oligonucleotide
gctgcagactcagacatgagaacccagc

SEQ ID NO: 271916 - DNA, 29 bp, Artificial Sequence
  Description of Artificial Sequence: Synthetic oligonucleotide
ctgcagactcagacatgagaacccagctg

SEQ ID NO: 271917 - DNA, 33 bp, Artificial Sequence
  Description of Artificial Sequence: Synthetic oligonucleotide
tgcagactcagacatgagaacccagctgatttc

SEQ ID NO: 271918 - DNA, 32 bp, Artificial Sequence
  Description of Artificial Sequence: Synthetic oligonucleotide
gcagactcagacatgagaacccagctgatttc

SEQ ID NO: 271919 - DNA, 34 bp, Artificial Sequence
  Description of Artificial Sequence: Synthetic oligonucleotide
cagactcagacatgagaacccagctgatttcttc

SEQ ID NO: 271920 - DNA, 34 bp, Artificial Sequence
  Description of Artificial Sequence: Synthetic oligonucleotide
agactcagacatgagaacccagctgatttcttcc

SEQ ID NO: 271921 - DNA, 33 bp, Artificial Sequence
  Description of Artificial Sequence: Synthetic oligonucleotide
gactcagacatgagaacccagctgatttcttcc

SEQ ID NO: 271922 - DNA, 35 bp, Artificial Sequence
  Description of Artificial Sequence: Synthetic oligonucleotide
actcagacatgagaacccagctgatttcttcctac

SEQ ID NO: 271923 - DNA, 34 bp, Artificial Sequence
  Description of Artificial Sequence: Synthetic oligonucleotide
ctcagacatgagaacccagctgatttcttcctac

SEQ ID NO: 271924 - DNA, 34 bp, Artificial Sequence
  Description of Artificial Sequence: Synthetic oligonucleotide
tcagacatgagaacccagctgatttcttcctacc

SEQ ID NO: 271925 - DNA, 33 bp, Artificial Sequence
  Description of Artificial Sequence: Synthetic oligonucleotide
cagacatgagaacccagctgatttcttcctacc

SEQ ID NO: 271926 - DNA, 34 bp, Artificial Sequence
  Description of Artificial Sequence: Synthetic oligonucleotide
agacatgagaacccagctgatttcttcctacctg

SEQ ID NO: 271927 - DNA, 33 bp, Artificial Sequence
  Description of Artificial Sequence: Synthetic oligonucleotide
gacatgagaacccagctgatttcttcctacctg

SEQ ID NO: 271928 - DNA, 33 bp, Artificial Sequence
  Description of Artificial Sequence: Synthetic oligonucleotide
acatgagaacccagctgatttcttcctacctgg

SEQ ID NO: 271929 - DNA, 32 bp, Artificial Sequence
  Description of Artificial Sequence: Synthetic oligonucleotide
catgagaacccagctgatttcttcctacctgg

SEQ ID NO: 271930 - DNA, 33 bp, Artificial Sequence
  Description of Artificial Sequence: Synthetic oligonucleotide
atgagaacccagctgatttcttcctacctggag

SEQ ID NO: 271931 - DNA, 32 bp, Artificial Sequence
  Description of Artificial Sequence: Synthetic oligonucleotide
tgagaacccagctgatttcttcctacctggag

SEQ ID NO: 271932 - DNA, 31 bp, Artificial Sequence
  Description of Artificial Sequence: Synthetic oligonucleotide
gagaacccagctgatttcttcctacctggag

SEQ ID NO: 271933 - DNA, 31 bp, Artificial Sequence
  Description of Artificial Sequence: Synthetic oligonucleotide
agaacccagctgatttcttcctacctggagc

SEQ ID NO: 271934 - DNA, 30 bp, Artificial Sequence
  Description of Artificial Sequence: Synthetic oligonucleotide
gaacccagctgatttcttcctacctggagc

SEQ ID NO: 271935 - DNA, 31 bp, Artificial Sequence
  Description of Artificial Sequence: Synthetic oligonucleotide
aacccagctgatttcttcctacctggagcac

SEQ ID NO: 271936 - DNA, 30 bp, Artificial Sequence
  Description of Artificial Sequence: Synthetic oligonucleotide
acccagctgatttcttcctacctggagcac

SEQ ID NO: 271937 - DNA, 29 bp, Artificial Sequence
  Description of Artificial Sequence: Synthetic oligonucleotide
cccagctgatttcttcctacctggagcac

SEQ ID NO: 271938 - DNA, 29 bp, Artificial Sequence
  Description of Artificial Sequence: Synthetic oligonucleotide
ccagctgatttcttcctacctggagcacc

SEQ ID NO: 271939 - DNA, 30 bp, Artificial Sequence
  Description of Artificial Sequence: Synthetic oligonucleotide
cagctgatttcttcctacctggagcaccac

SEQ ID NO: 271940 - DNA, 31 bp, Artificial Sequence
  Description of Artificial Sequence: Synthetic oligonucleotide
agctgatttcttcctacctggagcaccactc

SEQ ID NO: 271941 - DNA, 30 bp, Artificial Sequence
  Description of Artificial Sequence: Synthetic oligonucleotide
gctgatttcttcctacctggagcaccactc

SEQ ID NO: 271942 - DNA, 30 bp, Artificial Sequence
  Description of Artificial Sequence: Synthetic oligonucleotide
ctgatttcttcctacctggagcaccactcc

SEQ ID NO: 271943 - DNA, 30 bp, Artificial Sequence
  Description of Artificial Sequence: Synthetic oligonucleotide
tgatttcttcctacctggagcaccactccc

SEQ ID NO: 271944 - DNA, 29 bp, Artificial Sequence
  Description of Artificial Sequence: Synthetic oligonucleotide
gatttcttcctacctggagcaccactccc

SEQ ID NO: 271945 - DNA, 30 bp, Artificial Sequence
  Description of Artificial Sequence: Synthetic oligonucleotide
atttcttcctacctggagcaccactccctg

SEQ ID NO: 271946 - DNA, 29 bp, Artificial Sequence
  Description of Artificial Sequence: Synthetic oligonucleotide
tttcttcctacctggagcaccactccctg

SEQ ID NO: 271947 - DNA, 28 bp, Artificial Sequence
  Description of Artificial Sequence: Synthetic oligonucleotide
ttcttcctacctggagcaccactccctg

SEQ ID NO: 271948 - DNA, 27 bp, Artificial Sequence
  Description of Artificial Sequence: Synthetic oligonucleotide
tcttcctacctggagcaccactccctg

SEQ ID NO: 271949 - DNA, 27 bp, Artificial Sequence
  Description of Artificial Sequence: Synthetic oligonucleotide
cttcctacctggagcaccactccctgt

SEQ ID NO: 271950 - DNA, 27 bp, Artificial Sequence
  Description of Artificial Sequence: Synthetic oligonucleotide
ttcctacctggagcaccactccctgtc

SEQ ID NO: 271951 - DNA, 26 bp, Artificial Sequence
  Description of Artificial Sequence: Synthetic oligonucleotide
tcctacctggagcaccactccctgtc

SEQ ID NO: 271952 - DNA, 25 bp, Artificial Sequence
  Description of Artificial Sequence: Synthetic oligonucleotide
cctacctggagcaccactccctgtc

SEQ ID NO: 271953 - DNA, 26 bp, Artificial Sequence
  Description of Artificial Sequence: Synthetic oligonucleotide
ctacctggagcaccactccctgtcca

SEQ ID NO: 271954 - DNA, 27 bp, Artificial Sequence
  Description of Artificial Sequence: Synthetic oligonucleotide
tacctggagcaccactccctgtccact

SEQ ID NO: 271955 - DNA, 26 bp, Artificial Sequence
  Description of Artificial Sequence: Synthetic oligonucleotide
acctggagcaccactccctgtccact

SEQ ID NO: 271956 - DNA, 25 bp, Artificial Sequence
  Description of Artificial Sequence: Synthetic oligonucleotide
cctggagcaccactccctgtccact

SEQ ID NO: 271957 - DNA, 25 bp, Artificial Sequence
  Description of Artificial Sequence: Synthetic oligonucleotide
ctggagcaccactccctgtccactg

SEQ ID NO: 271958 - DNA, 25 bp, Artificial Sequence
  Description of Artificial Sequence: Synthetic oligonucleotide
tggagcaccactccctgtccactgg

SEQ ID NO: 271959 - DNA, 24 bp, Artificial Sequence
  Description of Artificial Sequence: Synthetic oligonucleotide
ggagcaccactccctgtccactgg

SEQ ID NO: 271960 - DNA, 24 bp, Artificial Sequence
  Description of Artificial Sequence: Synthetic oligonucleotide
gagcaccactccctgtccactggc

SEQ ID NO: 271961 - DNA, 24 bp, Artificial Sequence
  Description of Artificial Sequence: Synthetic oligonucleotide
agcaccactccctgtccactggcg

SEQ ID NO: 271962 - DNA, 23 bp, Artificial Sequence
  Description of Artificial Sequence: Synthetic oligonucleotide
gcaccactccctgtccactggcg

SEQ ID NO: 271963 - DNA, 24 bp, Artificial Sequence
  Description of Artificial Sequence: Synthetic oligonucleotide
caccactccctgtccactggcggt

SEQ ID NO: 271964 - DNA, 26 bp, Artificial Sequence
  Description of Artificial Sequence: Synthetic oligonucleotide
accactccctgtccactggcggtctt

SEQ ID NO: 271965 - DNA, 25 bp, Artificial Sequence
  Description of Artificial Sequence: Synthetic oligonucleotide
ccactccctgtccactggcggtctt

SEQ ID NO: 271966 - DNA, 25 bp, Artificial Sequence
  Description of Artificial Sequence: Synthetic oligonucleotide
cactccctgtccactggcggtcttc

SEQ ID NO: 271967 - DNA, 25 bp, Artificial Sequence
  Description of Artificial Sequence: Synthetic oligonucleotide
actccctgtccactggcggtcttcc

SEQ ID NO: 271968 - DNA, 24 bp, Artificial Sequence
  Description of Artificial Sequence: Synthetic oligonucleotide
ctccctgtccactggcggtcttcc

SEQ ID NO: 271969 - DNA, 25 bp, Artificial Sequence
  Description of Artificial Sequence: Synthetic oligonucleotide
tccctgtccactggcggtcttccca

SEQ ID NO: 271970 - DNA, 24 bp, Artificial Sequence
  Description of Artificial Sequence: Synthetic oligonucleotide
ccctgtccactggcggtcttccca

SEQ ID NO: 271971 - DNA, 25 bp, Artificial Sequence
  Description of Artificial Sequence: Synthetic oligonucleotide
cctgtccactggcggtcttcccaca

SEQ ID NO: 271972 - DNA, 27 bp, Artificial Sequence
  Description of Artificial Sequence: Synthetic oligonucleotide
ctgtccactggcggtcttcccacagtt

SEQ ID NO: 271973 - DNA, 27 bp, Artificial Sequence
  Description of Artificial Sequence: Synthetic oligonucleotide
tgtccactggcggtcttcccacagttg

SEQ ID NO: 271974 - DNA, 27 bp, Artificial Sequence
  Description of Artificial Sequence: Synthetic oligonucleotide
gtccactggcggtcttcccacagttgt

SEQ ID NO: 271975 - DNA, 27 bp, Artificial Sequence
  Description of Artificial Sequence: Synthetic oligonucleotide
tccactggcggtcttcccacagttgtg

SEQ ID NO: 271976 - DNA, 27 bp, Artificial Sequence
  Description of Artificial Sequence: Synthetic oligonucleotide
ccactggcggtcttcccacagttgtga

SEQ ID NO: 271977 - DNA, 27 bp, Artificial Sequence
  Description of Artificial Sequence: Synthetic oligonucleotide
cactggcggtcttcccacagttgtgac

SEQ ID NO: 271978 - DNA, 28 bp, Artificial Sequence
  Description of Artificial Sequence: Synthetic oligonucleotide
actggcggtcttcccacagttgtgactg

SEQ ID NO: 271979 - DNA, 27 bp, Artificial Sequence
  Description of Artificial Sequence: Synthetic oligonucleotide
ctggcggtcttcccacagttgtgactg

SEQ ID NO: 271980 - DNA, 27 bp, Artificial Sequence
  Description of Artificial Sequence: Synthetic oligonucleotide
tggcggtcttcccacagttgtgactgc

SEQ ID NO: 271981 - DNA, 26 bp, Artificial Sequence
  Description of Artificial Sequence: Synthetic oligonucleotide
ggcggtcttcccacagttgtgactgc

SEQ ID NO: 271982 - DNA, 27 bp, Artificial Sequence
  Description of Artificial Sequence: Synthetic oligonucleotide
gcggtcttcccacagttgtgactgcca

SEQ ID NO: 271983 - DNA, 29 bp, Artificial Sequence
  Description of Artificial Sequence: Synthetic oligonucleotide
cggtcttcccacagttgtgactgccaatc

SEQ ID NO: 271984 - DNA, 29 bp, Artificial Sequence
  Description of Artificial Sequence: Synthetic oligonucleotide
ggtcttcccacagttgtgactgccaatcg

SEQ ID NO: 271985 - DNA, 29 bp, Artificial Sequence
  Description of Artificial Sequence: Synthetic oligonucleotide
gtcttcccacagttgtgactgccaatcgg

SEQ ID NO: 271986 - DNA, 31 bp, Artificial Sequence
  Description of Artificial Sequence: Synthetic oligonucleotide
tcttcccacagttgtgactgccaatcggttg

SEQ ID NO: 271987 - DNA, 30 bp, Artificial Sequence
  Description of Artificial Sequence: Synthetic oligonucleotide
cttcccacagttgtgactgccaatcggttg

SEQ ID NO: 271988 - DNA, 30 bp, Artificial Sequence
  Description of Artificial Sequence: Synthetic oligonucleotide
ttcccacagttgtgactgccaatcggttgc

SEQ ID NO: 271989 - DNA, 29 bp, Artificial Sequence
  Description of Artificial Sequence: Synthetic oligonucleotide
tcccacagttgtgactgccaatcggttgc

SEQ ID NO: 271990 - DNA, 28 bp, Artificial Sequence
  Description of Artificial Sequence: Synthetic oligonucleotide
cccacagttgtgactgccaatcggttgc

SEQ ID NO: 271991 - DNA, 29 bp, Artificial Sequence
  Description of Artificial Sequence: Synthetic oligonucleotide
ccacagttgtgactgccaatcggttgctg

SEQ ID NO: 271992 - DNA, 31 bp, Artificial Sequence
  Description of Artificial Sequence: Synthetic oligonucleotide
cacagttgtgactgccaatcggttgctgaag

SEQ ID NO: 271993 - DNA, 31 bp, Artificial Sequence
  Description of Artificial Sequence: Synthetic oligonucleotide
acagttgtgactgccaatcggttgctgaagc

SEQ ID NO: 271994 - DNA, 30 bp, Artificial Sequence
  Description of Artificial Sequence: Synthetic oligonucleotide
cagttgtgactgccaatcggttgctgaagc

SEQ ID NO: 271995 - DNA, 31 bp, Artificial Sequence
  Description of Artificial Sequence: Synthetic oligonucleotide
agttgtgactgccaatcggttgctgaagctg

SEQ ID NO: 271996 - DNA, 30 bp, Artificial Sequence
  Description of Artificial Sequence: Synthetic oligonucleotide
gttgtgactgccaatcggttgctgaagctg

SEQ ID NO: 271997 - DNA, 32 bp, Artificial Sequence
  Description of Artificial Sequence: Synthetic oligonucleotide
ttgtgactgccaatcggttgctgaagctgatg

SEQ ID NO: 271998 - DNA, 31 bp, Artificial Sequence
  Description of Artificial Sequence: Synthetic oligonucleotide
tgtgactgccaatcggttgctgaagctgatg

SEQ ID NO: 271999 - DNA, 30 bp, Artificial Sequence
  Description of Artificial Sequence: Synthetic oligonucleotide
gtgactgccaatcggttgctgaagctgatg

SEQ ID NO: 272000 - DNA, 30 bp, Artificial Sequence
  Description of Artificial Sequence: Synthetic oligonucleotide
tgactgccaatcggttgctgaagctgatgc

SEQ ID NO: 272001 - DNA, 29 bp, Artificial Sequence
  Description of Artificial Sequence: Synthetic oligonucleotide
gactgccaatcggttgctgaagctgatgc

SEQ ID NO: 272002 - DNA, 33 bp, Artificial Sequence
  Description of Artificial Sequence: Synthetic oligonucleotide
actgccaatcggttgctgaagctgatgcttttg

SEQ ID NO: 272003 - DNA, 32 bp, Artificial Sequence
  Description of Artificial Sequence: Synthetic oligonucleotide
ctgccaatcggttgctgaagctgatgcttttg

SEQ ID NO: 272004 - DNA, 33 bp, Artificial Sequence
  Description of Artificial Sequence: Synthetic oligonucleotide
tgccaatcggttgctgaagctgatgcttttgag

SEQ ID NO: 272005 - DNA, 32 bp, Artificial Sequence
  Description of Artificial Sequence: Synthetic oligonucleotide
gccaatcggttgctgaagctgatgcttttgag

SEQ ID NO: 272006 - DNA, 32 bp, Artificial Sequence
  Description of Artificial Sequence: Synthetic oligonucleotide
ccaatcggttgctgaagctgatgcttttgagg

SEQ ID NO: 272007 - DNA, 35 bp, Artificial Sequence
  Description of Artificial Sequence: Synthetic oligonucleotide
caatcggttgctgaagctgatgcttttgaggtatc

SEQ ID NO: 272008 - DNA, 37 bp, Artificial Sequence
  Description of Artificial Sequence: Synthetic oligonucleotide
aatcggttgctgaagctgatgcttttgaggtatcaac

SEQ ID NO: 272009 - DNA, 36 bp, Artificial Sequence
  Description of Artificial Sequence: Synthetic oligonucleotide
atcggttgctgaagctgatgcttttgaggtatcaac

SEQ ID NO: 272010 - DNA, 35 bp, Artificial Sequence
  Description of Artificial Sequence: Synthetic oligonucleotide
tcggttgctgaagctgatgcttttgaggtatcaac

SEQ ID NO: 272011 - DNA, 34 bp, Artificial Sequence
  Description of Artificial Sequence: Synthetic oligonucleotide
cggttgctgaagctgatgcttttgaggtatcaac

SEQ ID NO: 272012 - DNA, 34 bp, Artificial Sequence
  Description of Artificial Sequence: Synthetic oligonucleotide
ggttgctgaagctgatgcttttgaggtatcaacg

SEQ ID NO: 272013 - DNA, 37 bp, Artificial Sequence
  Description of Artificial Sequence: Synthetic oligonucleotide
gttgctgaagctgatgcttttgaggtatcaacgttac

SEQ ID NO: 272014 - DNA, 40 bp, Artificial Sequence
  Description of Artificial Sequence: Synthetic oligonucleotide
ttgctgaagctgatgcttttgaggtatcaacgttacattg

SEQ ID NO: 272015 - DNA, 39 bp, Artificial Sequence
  Description of Artificial Sequence: Synthetic oligonucleotide
tgctgaagctgatgcttttgaggtatcaacgttacattg

SEQ ID NO: 272016 - DNA, 38 bp, Artificial Sequence
  Description of Artificial Sequence: Synthetic oligonucleotide
gctgaagctgatgcttttgaggtatcaacgttacattg

SEQ ID NO: 272017 - DNA, 38 bp, Artificial Sequence
  Description of Artificial Sequence: Synthetic oligonucleotide
ctgaagctgatgcttttgaggtatcaacgttacattgc

SEQ ID NO: 272018 - DNA, 39 bp, Artificial Sequence
  Description of Artificial Sequence: Synthetic oligonucleotide
tgaagctgatgcttttgaggtatcaacgttacattgctg

SEQ ID NO: 272019 - DNA, 38 bp, Artificial Sequence
  Description of Artificial Sequence: Synthetic oligonucleotide
gaagctgatgcttttgaggtatcaacgttacattgctg

SEQ ID NO: 272020 - DNA, 38 bp, Artificial Sequence
  Description of Artificial Sequence: Synthetic oligonucleotide
aagctgatgcttttgaggtatcaacgttacattgctgc

SEQ ID NO: 272021 - DNA, 37 bp, Artificial Sequence
  Description of Artificial Sequence: Synthetic oligonucleotide
agctgatgcttttgaggtatcaacgttacattgctgc

SEQ ID NO: 272022 - DNA, 36 bp, Artificial Sequence
  Description of Artificial Sequence: Synthetic oligonucleotide
gctgatgcttttgaggtatcaacgttacattgctgc

SEQ ID NO: 272023 - DNA, 37 bp, Artificial Sequence
  Description of Artificial Sequence: Synthetic oligonucleotide
ctgatgcttttgaggtatcaacgttacattgctgcag

SEQ ID NO: 272024 - DNA, 37 bp, Artificial Sequence
  Description of Artificial Sequence: Synthetic oligonucleotide
tgatgcttttgaggtatcaacgttacattgctgcagc

SEQ ID NO: 272025 - DNA, 36 bp, Artificial Sequence
  Description of Artificial Sequence: Synthetic oligonucleotide
gatgcttttgaggtatcaacgttacattgctgcagc

SEQ ID NO: 272026 - DNA, 36 bp, Artificial Sequence
  Description of Artificial Sequence: Synthetic oligonucleotide
atgcttttgaggtatcaacgttacattgctgcagcc

SEQ ID NO: 272027 - DNA, 35 bp, Artificial Sequence
  Description of Artificial Sequence: Synthetic oligonucleotide
tgcttttgaggtatcaacgttacattgctgcagcc

SEQ ID NO: 272028 - DNA, 34 bp, Artificial Sequence
  Description of Artificial Sequence: Synthetic oligonucleotide
gcttttgaggtatcaacgttacattgctgcagcc

SEQ ID NO: 272029 - DNA, 34 bp, Artificial Sequence
  Description of Artificial Sequence: Synthetic oligonucleotide
cttttgaggtatcaacgttacattgctgcagccc

SEQ ID NO: 272030 - DNA, 36 bp, Artificial Sequence
  Description of Artificial Sequence: Synthetic oligonucleotide
ttttgaggtatcaacgttacattgctgcagcccttg

SEQ ID NO: 272031 - DNA, 35 bp, Artificial Sequence
  Description of Artificial Sequence: Synthetic oligonucleotide
tttgaggtatcaacgttacattgctgcagcccttg

SEQ ID NO: 272032 - DNA, 34 bp, Artificial Sequence
  Description of Artificial Sequence: Synthetic oligonucleotide
ttgaggtatcaacgttacattgctgcagcccttg

SEQ ID NO: 272033 - DNA, 33 bp, Artificial Sequence
  Description of Artificial Sequence: Synthetic oligonucleotide
tgaggtatcaacgttacattgctgcagcccttg

SEQ ID NO: 272034 - DNA, 32 bp, Artificial Sequence
  Description of Artificial Sequence: Synthetic oligonucleotide
gaggtatcaacgttacattgctgcagcccttg

SEQ ID NO: 272035 - DNA, 37 bp, Artificial Sequence
  Description of Artificial Sequence: Synthetic oligonucleotide
aggtatcaacgttacattgctgcagcccttgttttag

SEQ ID NO: 272036 - DNA, 36 bp, Artificial Sequence
  Description of Artificial Sequence: Synthetic oligonucleotide
ggtatcaacgttacattgctgcagcccttgttttag

SEQ ID NO: 272037 - DNA, 36 bp, Artificial Sequence
  Description of Artificial Sequence: Synthetic oligonucleotide
gtatcaacgttacattgctgcagcccttgttttagg

SEQ ID NO: 272038 - DNA, 36 bp, Artificial Sequence
  Description of Artificial Sequence: Synthetic oligonucleotide
tatcaacgttacattgctgcagcccttgttttaggg

SEQ ID NO: 272039 - DNA, 35 bp, Artificial Sequence
  Description of Artificial Sequence: Synthetic oligonucleotide
atcaacgttacattgctgcagcccttgttttaggg

SEQ ID NO: 272040 - DNA, 34 bp, Artificial Sequence
  Description of Artificial Sequence: Synthetic oligonucleotide
tcaacgttacattgctgcagcccttgttttaggg

SEQ ID NO: 272041 - DNA, 33 bp, Artificial Sequence
  Description of Artificial Sequence: Synthetic oligonucleotide
caacgttacattgctgcagcccttgttttaggg

SEQ ID NO: 272042 - DNA, 33 bp, Artificial Sequence
  Description of Artificial Sequence: Synthetic oligonucleotide
aacgttacattgctgcagcccttgttttagggc

SEQ ID NO: 272043 - DNA, 32 bp, Artificial Sequence
  Description of Artificial Sequence: Synthetic oligonucleotide
acgttacattgctgcagcccttgttttagggc

SEQ ID NO: 272044 - DNA, 31 bp, Artificial Sequence
  Description of Artificial Sequence: Synthetic oligonucleotide
cgttacattgctgcagcccttgttttagggc

SEQ ID NO: 272045 - DNA, 31 bp, Artificial Sequence
  Description of Artificial Sequence: Synthetic oligonucleotide
gttacattgctgcagcccttgttttagggcg

SEQ ID NO: 272046 - DNA, 32 bp, Artificial Sequence
  Description of Artificial Sequence: Synthetic oligonucleotide
ttacattgctgcagcccttgttttagggcgag

SEQ ID NO: 272047 - DNA, 31 bp, Artificial Sequence
  Description of Artificial Sequence: Synthetic oligonucleotide
tacattgctgcagcccttgttttagggcgag

SEQ ID NO: 272048 - DNA, 30 bp, Artificial Sequence
  Description of Artificial Sequence: Synthetic oligonucleotide
acattgctgcagcccttgttttagggcgag

SEQ ID NO: 272049 - DNA, 29 bp, Artificial Sequence
  Description of Artificial Sequence: Synthetic oligonucleotide
cattgctgcagcccttgttttagggcgag

SEQ ID NO: 272050 - DNA, 31 bp, Artificial Sequence
  Description of Artificial Sequence: Synthetic oligonucleotide
attgctgcagcccttgttttagggcgagtag

SEQ ID NO: 272051 - DNA, 30 bp, Artificial Sequence
  Description of Artificial Sequence: Synthetic oligonucleotide
ttgctgcagcccttgttttagggcgagtag

SEQ ID NO: 272052 - DNA, 29 bp, Artificial Sequence
  Description of Artificial Sequence: Synthetic oligonucleotide
tgctgcagcccttgttttagggcgagtag

SEQ ID NO: 272053 - DNA, 28 bp, Artificial Sequence
  Description of Artificial Sequence: Synthetic oligonucleotide
gctgcagcccttgttttagggcgagtag

SEQ ID NO: 272054 - DNA, 30 bp, Artificial Sequence
  Description of Artificial Sequence: Synthetic oligonucleotide
ctgcagcccttgttttagggcgagtagatg

SEQ ID NO: 272055 - DNA, 33 bp, Artificial Sequence
  Description of Artificial Sequence: Synthetic oligonucleotide
tgcagcccttgttttagggcgagtagatgatac

SEQ ID NO: 272056 - DNA, 32 bp, Artificial Sequence
  Description of Artificial Sequence: Synthetic oligonucleotide
gcagcccttgttttagggcgagtagatgatac

SEQ ID NO: 272057 - DNA, 33 bp, Artificial Sequence
  Description of Artificial Sequence: Synthetic oligonucleotide
cagcccttgttttagggcgagtagatgatactg

SEQ ID NO: 272058 - DNA, 33 bp, Artificial Sequence
  Description of Artificial Sequence: Synthetic oligonucleotide
agcccttgttttagggcgagtagatgatactgg

SEQ ID NO: 272059 - DNA, 32 bp, Artificial Sequence
  Description of Artificial Sequence: Synthetic oligonucleotide
gcccttgttttagggcgagtagatgatactgg

SEQ ID NO: 272060 - DNA, 33 bp, Artificial Sequence
  Description of Artificial Sequence: Synthetic oligonucleotide
cccttgttttagggcgagtagatgatactggac

SEQ ID NO: 272061 - DNA, 33 bp, Artificial Sequence
  Description of Artificial Sequence: Synthetic oligonucleotide
ccttgttttagggcgagtagatgatactggacc

SEQ ID NO: 272062 - DNA, 34 bp, Artificial Sequence
  Description of Artificial Sequence: Synthetic oligonucleotide
cttgttttagggcgagtagatgatactggaccac

SEQ ID NO: 272063 - DNA, 35 bp, Artificial Sequence
  Description of Artificial Sequence: Synthetic oligonucleotide
ttgttttagggcgagtagatgatactggaccacac

SEQ ID NO: 272064 - DNA, 34 bp, Artificial Sequence
  Description of Artificial Sequence: Synthetic oligonucleotide
tgttttagggcgagtagatgatactggaccacac

SEQ ID NO: 272065 - DNA, 33 bp, Artificial Sequence
  Description of Artificial Sequence: Synthetic oligonucleotide
gttttagggcgagtagatgatactggaccacac

SEQ ID NO: 272066 - DNA, 33 bp, Artificial Sequence
  Description of Artificial Sequence: Synthetic oligonucleotide
ttttagggcgagtagatgatactggaccacacc

SEQ ID NO: 272067 - DNA, 32 bp, Artificial Sequence
  Description of Artificial Sequence: Synthetic oligonucleotide
tttagggcgagtagatgatactggaccacacc

SEQ ID NO: 272068 - DNA, 31 bp, Artificial Sequence
  Description of Artificial Sequence: Synthetic oligonucleotide
ttagggcgagtagatgatactggaccacacc

SEQ ID NO: 272069 - DNA, 30 bp, Artificial Sequence
  Description of Artificial Sequence: Synthetic oligonucleotide
tagggcgagtagatgatactggaccacacc

SEQ ID NO: 272070 - DNA, 29 bp, Artificial Sequence
  Description of Artificial Sequence: Synthetic oligonucleotide
agggcgagtagatgatactggaccacacc

SEQ ID NO: 272071 - DNA, 28 bp, Artificial Sequence
  Description of Artificial Sequence: Synthetic oligonucleotide
gggcgagtagatgatactggaccacacc

SEQ ID NO: 272072 - DNA, 29 bp, Artificial Sequence
  Description of Artificial Sequence: Synthetic oligonucleotide
ggcgagtagatgatactggaccacacctc

SEQ ID NO: 272073 - DNA, 31 bp, Artificial Sequence
  Description of Artificial Sequence: Synthetic oligonucleotide
gcgagtagatgatactggaccacacctctac

SEQ ID NO: 272074 - DNA, 32 bp, Artificial Sequence
  Description of Artificial Sequence: Synthetic oligonucleotide
cgagtagatgatactggaccacacctctactg

SEQ ID NO: 272075 - DNA, 32 bp, Artificial Sequence
  Description of Artificial Sequence: Synthetic oligonucleotide
gagtagatgatactggaccacacctctactgc

SEQ ID NO: 272076 - DNA, 34 bp, Artificial Sequence
  Description of Artificial Sequence: Synthetic oligonucleotide
agtagatgatactggaccacacctctactgcatc

SEQ ID NO: 272077 - DNA, 33 bp, Artificial Sequence
  Description of Artificial Sequence: Synthetic oligonucleotide
gtagatgatactggaccacacctctactgcatc

SEQ ID NO: 272078 - DNA, 36 bp, Artificial Sequence
  Description of Artificial Sequence: Synthetic oligonucleotide
tagatgatactggaccacacctctactgcatctatc

SEQ ID NO: 272079 - DNA, 35 bp, Artificial Sequence
  Description of Artificial Sequence: Synthetic oligonucleotide
agatgatactggaccacacctctactgcatctatc

SEQ ID NO: 272080 - DNA, 34 bp, Artificial Sequence
  Description of Artificial Sequence: Synthetic oligonucleotide
gatgatactggaccacacctctactgcatctatc

SEQ ID NO: 272081 - DNA, 34 bp, Artificial Sequence
  Description of Artificial Sequence: Synthetic oligonucleotide
atgatactggaccacacctctactgcatctatcg

SEQ ID NO: 272082 - DNA, 33 bp, Artificial Sequence
  Description of Artificial Sequence: Synthetic oligonucleotide
tgatactggaccacacctctactgcatctatcg

SEQ ID NO: 272083 - DNA, 32 bp, Artificial Sequence
  Description of Artificial Sequence: Synthetic oligonucleotide
gatactggaccacacctctactgcatctatcg

SEQ ID NO: 272084 - DNA, 33 bp, Artificial Sequence
  Description of Artificial Sequence: Synthetic oligonucleotide
atactggaccacacctctactgcatctatcgtc

SEQ ID NO: 272085 - DNA, 32 bp, Artificial Sequence
  Description of Artificial Sequence: Synthetic oligonucleotide
tactggaccacacctctactgcatctatcgtc

SEQ ID NO: 272086 - DNA, 31 bp, Artificial Sequence
  Description of Artificial Sequence: Synthetic oligonucleotide
actggaccacacctctactgcatctatcgtc

SEQ ID NO: 272087 - DNA, 30 bp, Artificial Sequence
  Description of Artificial Sequence: Synthetic oligonucleotide
ctggaccacacctctactgcatctatcgtc

SEQ ID NO: 272088 - DNA, 32 bp, Artificial Sequence
  Description of Artificial Sequence: Synthetic oligonucleotide
tggaccacacctctactgcatctatcgtcatg

SEQ ID NO: 272089 - DNA, 31 bp, Artificial Sequence
  Description of Artificial Sequence: Synthetic oligonucleotide
ggaccacacctctactgcatctatcgtcatg

SEQ ID NO: 272090 - DNA, 31 bp, Artificial Sequence
  Description of Artificial Sequence: Synthetic oligonucleotide
gaccacacctctactgcatctatcgtcatgg

SEQ ID NO: 272091 - DNA, 33 bp, Artificial Sequence
  Description of Artificial Sequence: Synthetic oligonucleotide
accacacctctactgcatctatcgtcatggatc

SEQ ID NO: 272092 - DNA, 32 bp, Artificial Sequence
  Description of Artificial Sequence: Synthetic oligonucleotide
ccacacctctactgcatctatcgtcatggatc

SEQ ID NO: 272093 - DNA, 34 bp, Artificial Sequence
  Description of Artificial Sequence: Synthetic oligonucleotide
cacacctctactgcatctatcgtcatggatctac

SEQ ID NO: 272094 - DNA, 35 bp, Artificial Sequence
  Description of Artificial Sequence: Synthetic oligonucleotide
acacctctactgcatctatcgtcatggatctactg

SEQ ID NO: 272095 - DNA, 34 bp, Artificial Sequence
  Description of Artificial Sequence: Synthetic oligonucleotide
cacctctactgcatctatcgtcatggatctactg

SEQ ID NO: 272096 - DNA, 38 bp, Artificial Sequence
  Description of Artificial Sequence: Synthetic oligonucleotide
acctctactgcatctatcgtcatggatctactgataag

SEQ ID NO: 272097 - DNA, 37 bp, Artificial Sequence
  Description of Artificial Sequence: Synthetic oligonucleotide
cctctactgcatctatcgtcatggatctactgataag

SEQ ID NO: 272098 - DNA, 39 bp, Artificial Sequence
  Description of Artificial Sequence: Synthetic oligonucleotide
ctctactgcatctatcgtcatggatctactgataagatg

SEQ ID NO: 272099 - DNA, 39 bp, Artificial Sequence
  Description of Artificial Sequence: Synthetic oligonucleotide
tctactgcatctatcgtcatggatctactgataagatgc

SEQ ID NO: 272100 - DNA, 38 bp, Artificial Sequence
  Description of Artificial Sequence: Synthetic oligonucleotide
ctactgcatctatcgtcatggatctactgataagatgc

SEQ ID NO: 272101 - DNA, 38 bp, Artificial Sequence
  Description of Artificial Sequence: Synthetic oligonucleotide
tactgcatctatcgtcatggatctactgataagatgcc

SEQ ID NO: 272102 - DNA, 37 bp, Artificial Sequence
  Description of Artificial Sequence: Synthetic oligonucleotide
actgcatctatcgtcatggatctactgataagatgcc

SEQ ID NO: 272103 - DNA, 36 bp, Artificial Sequence
  Description of Artificial Sequence: Synthetic oligonucleotide
ctgcatctatcgtcatggatctactgataagatgcc

SEQ ID NO: 272104 - DNA, 40 bp, Artificial Sequence
  Description of Artificial Sequence: Synthetic oligonucleotide
tgcatctatcgtcatggatctactgataagatgccttatg

SEQ ID NO: 272105 - DNA, 39 bp, Artificial Sequence
  Description of Artificial Sequence: Synthetic oligonucleotide
gcatctatcgtcatggatctactgataagatgccttatg

SEQ ID NO: 272106 - DNA, 40 bp, Artificial Sequence
  Description of Artificial Sequence: Synthetic oligonucleotide
catctatcgtcatggatctactgataagatgccttatgac

SEQ ID NO: 272107 - DNA, 41 bp, Artificial Sequence
  Description of Artificial Sequence: Synthetic oligonucleotide
atctatcgtcatggatctactgataagatgccttatgacac

SEQ ID NO: 272108 - DNA, 40 bp, Artificial Sequence
  Description of Artificial Sequence: Synthetic oligonucleotide
tctatcgtcatggatctactgataagatgccttatgacac

SEQ ID NO: 272109 - DNA, 39 bp, Artificial Sequence
  Description of Artificial Sequence: Synthetic oligonucleotide
ctatcgtcatggatctactgataagatgccttatgacac

SEQ ID NO: 272110 - DNA, 39 bp, Artificial Sequence
  Description of Artificial Sequence: Synthetic oligonucleotide
tatcgtcatggatctactgataagatgccttatgacacc

SEQ ID NO: 272111 - DNA, 38 bp, Artificial Sequence
  Description of Artificial Sequence: Synthetic oligonucleotide
atcgtcatggatctactgataagatgccttatgacacc

SEQ ID NO: 272112 - DNA, 37 bp, Artificial Sequence
  Description of Artificial Sequence: Synthetic oligonucleotide
tcgtcatggatctactgataagatgccttatgacacc

SEQ ID NO: 272113 - DNA, 36 bp, Artificial Sequence
  Description of Artificial Sequence: Synthetic oligonucleotide
cgtcatggatctactgataagatgccttatgacacc

SEQ ID NO: 272114 - DNA, 38 bp, Artificial Sequence
  Description of Artificial Sequence: Synthetic oligonucleotide
gtcatggatctactgataagatgccttatgacaccatg

SEQ ID NO: 272115 - DNA, 38 bp, Artificial Sequence
  Description of Artificial Sequence: Synthetic oligonucleotide
tcatggatctactgataagatgccttatgacaccatgg

SEQ ID NO: 272116 - DNA, 37 bp, Artificial Sequence
  Description of Artificial Sequence: Synthetic oligonucleotide
catggatctactgataagatgccttatgacaccatgg

SEQ ID NO: 272117 - DNA, 37 bp, Artificial Sequence
  Description of Artificial Sequence: Synthetic oligonucleotide
atggatctactgataagatgccttatgacaccatggg

SEQ ID NO: 272118 - DNA, 36 bp, Artificial Sequence
  Description of Artificial Sequence: Synthetic oligonucleotide
tggatctactgataagatgccttatgacaccatggg

SEQ ID NO: 272119 - DNA, 35 bp, Artificial Sequence
  Description of Artificial Sequence: Synthetic oligonucleotide
ggatctactgataagatgccttatgacaccatggg

SEQ ID NO: 272120 - DNA, 37 bp, Artificial Sequence
  Description of Artificial Sequence: Synthetic oligonucleotide
gatctactgataagatgccttatgacaccatgggatc

SEQ ID NO: 272121 - DNA, 38 bp, Artificial Sequence
  Description of Artificial Sequence: Synthetic oligonucleotide
atctactgataagatgccttatgacaccatgggatctg

SEQ ID NO: 272122 - DNA, 37 bp, Artificial Sequence
  Description of Artificial Sequence: Synthetic oligonucleotide
tctactgataagatgccttatgacaccatgggatctg

SEQ ID NO: 272123 - DNA, 36 bp, Artificial Sequence
  Description of Artificial Sequence: Synthetic oligonucleotide
ctactgataagatgccttatgacaccatgggatctg

SEQ ID NO: 272124 - DNA, 36 bp, Artificial Sequence
  Description of Artificial Sequence: Synthetic oligonucleotide
tactgataagatgccttatgacaccatgggatctgg

SEQ ID NO: 272125 - DNA, 35 bp, Artificial Sequence
  Description of Artificial Sequence: Synthetic oligonucleotide
actgataagatgccttatgacaccatgggatctgg

SEQ ID NO: 272126 - DNA, 34 bp, Artificial Sequence
  Description of Artificial Sequence: Synthetic oligonucleotide
ctgataagatgccttatgacaccatgggatctgg

SEQ ID NO: 272127 - DNA, 34 bp, Artificial Sequence
  Description of Artificial Sequence: Synthetic oligonucleotide
tgataagatgccttatgacaccatgggatctggc

SEQ ID NO: 272128 - DNA, 33 bp, Artificial Sequence
  Description of Artificial Sequence: Synthetic oligonucleotide
gataagatgccttatgacaccatgggatctggc

SEQ ID NO: 272129 - DNA, 34 bp, Artificial Sequence
  Description of Artificial Sequence: Synthetic oligonucleotide
ataagatgccttatgacaccatgggatctggctc

SEQ ID NO: 272130 - DNA, 33 bp, Artificial Sequence
  Description of Artificial Sequence: Synthetic oligonucleotide
taagatgccttatgacaccatgggatctggctc

SEQ ID NO: 272131 - DNA, 32 bp, Artificial Sequence
  Description of Artificial Sequence: Synthetic oligonucleotide
aagatgccttatgacaccatgggatctggctc

SEQ ID NO: 272132 - DNA, 31 bp, Artificial Sequence
  Description of Artificial Sequence: Synthetic oligonucleotide
agatgccttatgacaccatgggatctggctc

SEQ ID NO: 272133 - DNA, 30 bp, Artificial Sequence
  Description of Artificial Sequence: Synthetic oligonucleotide
gatgccttatgacaccatgggatctggctc

SEQ ID NO: 272134 - DNA, 30 bp, Artificial Sequence
  Description of Artificial Sequence: Synthetic oligonucleotide
atgccttatgacaccatgggatctggctcc

SEQ ID NO: 272135 - DNA, 29 bp, Artificial Sequence
  Description of Artificial Sequence: Synthetic oligonucleotide
tgccttatgacaccatgggatctggctcc

SEQ ID NO: 272136 - DNA, 28 bp, Artificial Sequence
  Description of Artificial Sequence: Synthetic oligonucleotide
gccttatgacaccatgggatctggctcc

SEQ ID NO: 272137 - DNA, 30 bp, Artificial Sequence
  Description of Artificial Sequence: Synthetic oligonucleotide
ccttatgacaccatgggatctggctccatg

SEQ ID NO: 272138 - DNA, 30 bp, Artificial Sequence
  Description of Artificial Sequence: Synthetic oligonucleotide
cttatgacaccatgggatctggctccatgg

SEQ ID NO: 272139 - DNA, 30 bp, Artificial Sequence
  Description of Artificial Sequence: Synthetic oligonucleotide
ttatgacaccatgggatctggctccatggc

SEQ ID NO: 272140 - DNA, 29 bp, Artificial Sequence
  Description of Artificial Sequence: Synthetic oligonucleotide
tatgacaccatgggatctggctccatggc

SEQ ID NO: 272141 - DNA, 28 bp, Artificial Sequence
  Description of Artificial Sequence: Synthetic oligonucleotide
atgacaccatgggatctggctccatggc

SEQ ID NO: 272142 - DNA, 27 bp, Artificial Sequence
  Description of Artificial Sequence: Synthetic oligonucleotide
tgacaccatgggatctggctccatggc

SEQ ID NO: 272143 - DNA, 27 bp, Artificial Sequence
  Description of Artificial Sequence: Synthetic oligonucleotide
gacaccatgggatctggctccatggca

SEQ ID NO: 272144 - DNA, 27 bp, Artificial Sequence
  Description of Artificial Sequence: Synthetic oligonucleotide
acaccatgggatctggctccatggcag

SEQ ID NO: 272145 - DNA, 26 bp, Artificial Sequence
  Description of Artificial Sequence: Synthetic oligonucleotide
caccatgggatctggctccatggcag

SEQ ID NO: 272146 - DNA, 27 bp, Artificial Sequence
  Description of Artificial Sequence: Synthetic oligonucleotide
accatgggatctggctccatggcagca

SEQ ID NO: 272147 - DNA, 27 bp, Artificial Sequence
  Description of Artificial Sequence: Synthetic oligonucleotide
ccatgggatctggctccatggcagcaa

SEQ ID NO: 272148 - DNA, 28 bp, Artificial Sequence
  Description of Artificial Sequence: Synthetic oligonucleotide
catgggatctggctccatggcagcaaag

SEQ ID NO: 272149 - DNA, 28 bp, Artificial Sequence
  Description of Artificial Sequence: Synthetic oligonucleotide
atgggatctggctccatggcagcaaagg

SEQ ID NO: 272150 - DNA, 27 bp, Artificial Sequence
  Description of Artificial Sequence: Synthetic oligonucleotide
tgggatctggctccatggcagcaaagg

SEQ ID NO: 272151 - DNA, 26 bp, Artificial Sequence
  Description of Artificial Sequence: Synthetic oligonucleotide
gggatctggctccatggcagcaaagg

SEQ ID NO: 272152 - DNA, 27 bp, Artificial Sequence
  Description of Artificial Sequence: Synthetic oligonucleotide
ggatctggctccatggcagcaaaggct

SEQ ID NO: 272153 - DNA, 27 bp, Artificial Sequence
  Description of Artificial Sequence: Synthetic oligonucleotide
gatctggctccatggcagcaaaggctg

SEQ ID NO: 272154 - DNA, 32 bp, Artificial Sequence
  Description of Artificial Sequence: Synthetic oligonucleotide
atctggctccatggcagcaaaggctgtattag

SEQ ID NO: 272155 - DNA, 31 bp, Artificial Sequence
  Description of Artificial Sequence: Synthetic oligonucleotide
tctggctccatggcagcaaaggctgtattag

SEQ ID NO: 272156 - DNA, 30 bp, Artificial Sequence
  Description of Artificial Sequence: Synthetic oligonucleotide
ctggctccatggcagcaaaggctgtattag

SEQ ID NO: 272157 - DNA, 32 bp, Artificial Sequence
  Description of Artificial Sequence: Synthetic oligonucleotide
tggctccatggcagcaaaggctgtattagaag

SEQ ID NO: 272158 - DNA, 31 bp, Artificial Sequence
  Description of Artificial Sequence: Synthetic oligonucleotide
ggctccatggcagcaaaggctgtattagaag

SEQ ID NO: 272159 - DNA, 35 bp, Artificial Sequence
  Description of Artificial Sequence: Synthetic oligonucleotide
gctccatggcagcaaaggctgtattagaagataag

SEQ ID NO: 272160 - DNA, 39 bp, Artificial Sequence
  Description of Artificial Sequence: Synthetic oligonucleotide
ctccatggcagcaaaggctgtattagaagataagattag

SEQ ID NO: 272161 - DNA, 39 bp, Artificial Sequence
  Description of Artificial Sequence: Synthetic oligonucleotide
tccatggcagcaaaggctgtattagaagataagattagg

SEQ ID NO: 272162 - DNA, 38 bp, Artificial Sequence
  Description of Artificial Sequence: Synthetic oligonucleotide
ccatggcagcaaaggctgtattagaagataagattagg

SEQ ID NO: 272163 - DNA, 38 bp, Artificial Sequence
  Description of Artificial Sequence: Synthetic oligonucleotide
catggcagcaaaggctgtattagaagataagattaggc

SEQ ID NO: 272164 - DNA, 38 bp, Artificial Sequence
  Description of Artificial Sequence: Synthetic oligonucleotide
atggcagcaaaggctgtattagaagataagattaggcc

SEQ ID NO: 272165 - DNA, 37 bp, Artificial Sequence
  Description of Artificial Sequence: Synthetic oligonucleotide
tggcagcaaaggctgtattagaagataagattaggcc

SEQ ID NO: 272166 - DNA, 36 bp, Artificial Sequence
  Description of Artificial Sequence: Synthetic oligonucleotide
ggcagcaaaggctgtattagaagataagattaggcc

SEQ ID NO: 272167 - DNA, 37 bp, Artificial Sequence
  Description of Artificial Sequence: Synthetic oligonucleotide
gcagcaaaggctgtattagaagataagattaggccag

SEQ ID NO: 272168 - DNA, 38 bp, Artificial Sequence
  Description of Artificial Sequence: Synthetic oligonucleotide
cagcaaaggctgtattagaagataagattaggccagtc

SEQ ID NO: 272169 - DNA, 40 bp, Artificial Sequence
  Description of Artificial Sequence: Synthetic oligonucleotide
agcaaaggctgtattagaagataagattaggccagtcatg

SEQ ID NO: 272170 - DNA, 39 bp, Artificial Sequence
  Description of Artificial Sequence: Synthetic oligonucleotide
gcaaaggctgtattagaagataagattaggccagtcatg

SEQ ID NO: 272171 - DNA, 39 bp, Artificial Sequence
  Description of Artificial Sequence: Synthetic oligonucleotide
caaaggctgtattagaagataagattaggccagtcatgg

SEQ ID NO: 272172 - DNA, 40 bp, Artificial Sequence
  Description of Artificial Sequence: Synthetic oligonucleotide
aaaggctgtattagaagataagattaggccagtcatggag

SEQ ID NO: 272173 - DNA, 39 bp, Artificial Sequence
  Description of Artificial Sequence: Synthetic oligonucleotide
aaggctgtattagaagataagattaggccagtcatggag

SEQ ID NO: 272174 - DNA, 38 bp, Artificial Sequence
  Description of Artificial Sequence: Synthetic oligonucleotide
aggctgtattagaagataagattaggccagtcatggag

SEQ ID NO: 272175 - DNA, 37 bp, Artificial Sequence
  Description of Artificial Sequence: Synthetic oligonucleotide
ggctgtattagaagataagattaggccagtcatggag

SEQ ID NO: 272176 - DNA, 37 bp, Artificial Sequence
  Description of Artificial Sequence: Synthetic oligonucleotide
gctgtattagaagataagattaggccagtcatggagg

SEQ ID NO: 272177 - DNA, 38 bp, Artificial Sequence
  Description of Artificial Sequence: Synthetic oligonucleotide
ctgtattagaagataagattaggccagtcatggaggac

SEQ ID NO: 272178 - DNA, 38 bp, Artificial Sequence
  Description of Artificial Sequence: Synthetic oligonucleotide
tgtattagaagataagattaggccagtcatggaggacg

SEQ ID NO: 272179 - DNA, 37 bp, Artificial Sequence
  Description of Artificial Sequence: Synthetic oligonucleotide
gtattagaagataagattaggccagtcatggaggacg

SEQ ID NO: 272180 - DNA, 38 bp, Artificial Sequence
  Description of Artificial Sequence: Synthetic oligonucleotide
tattagaagataagattaggccagtcatggaggacgag

SEQ ID NO: 272181 - DNA, 37 bp, Artificial Sequence
  Description of Artificial Sequence: Synthetic oligonucleotide
attagaagataagattaggccagtcatggaggacgag

SEQ ID NO: 272182 - DNA, 36 bp, Artificial Sequence
  Description of Artificial Sequence: Synthetic oligonucleotide
ttagaagataagattaggccagtcatggaggacgag

SEQ ID NO: 272183 - DNA, 35 bp, Artificial Sequence
  Description of Artificial Sequence: Synthetic oligonucleotide
tagaagataagattaggccagtcatggaggacgag

SEQ ID NO: 272184 - DNA, 34 bp, Artificial Sequence
  Description of Artificial Sequence: Synthetic oligonucleotide
agaagataagattaggccagtcatggaggacgag

SEQ ID NO: 272185 - DNA, 33 bp, Artificial Sequence
  Description of Artificial Sequence: Synthetic oligonucleotide
gaagataagattaggccagtcatggaggacgag

SEQ ID NO: 272186 - DNA, 33 bp, Artificial Sequence
  Description of Artificial Sequence: Synthetic oligonucleotide
aagataagattaggccagtcatggaggacgagg

SEQ ID NO: 272187 - DNA, 32 bp, Artificial Sequence
  Description of Artificial Sequence: Synthetic oligonucleotide
agataagattaggccagtcatggaggacgagg

SEQ ID NO: 272188 - DNA, 31 bp, Artificial Sequence
  Description of Artificial Sequence: Synthetic oligonucleotide
gataagattaggccagtcatggaggacgagg

SEQ ID NO: 272189 - DNA, 33 bp, Artificial Sequence
  Description of Artificial Sequence: Synthetic oligonucleotide
ataagattaggccagtcatggaggacgaggaag

SEQ ID NO: 272190 - DNA, 32 bp, Artificial Sequence
  Description of Artificial Sequence: Synthetic oligonucleotide
taagattaggccagtcatggaggacgaggaag

SEQ ID NO: 272191 - DNA, 31 bp, Artificial Sequence
  Description of Artificial Sequence: Synthetic oligonucleotide
aagattaggccagtcatggaggacgaggaag

SEQ ID NO: 272192 - DNA, 30 bp, Artificial Sequence
  Description of Artificial Sequence: Synthetic oligonucleotide
agattaggccagtcatggaggacgaggaag

SEQ ID NO: 272193 - DNA, 29 bp, Artificial Sequence
  Description of Artificial Sequence: Synthetic oligonucleotide
gattaggccagtcatggaggacgaggaag

SEQ ID NO: 272194 - DNA, 29 bp, Artificial Sequence
  Description of Artificial Sequence: Synthetic oligonucleotide
attaggccagtcatggaggacgaggaagc

SEQ ID NO: 272195 - DNA, 28 bp, Artificial Sequence
  Description of Artificial Sequence: Synthetic oligonucleotide
ttaggccagtcatggaggacgaggaagc

SEQ ID NO: 272196 - DNA, 27 bp, Artificial Sequence
  Description of Artificial Sequence: Synthetic oligonucleotide
taggccagtcatggaggacgaggaagc

SEQ ID NO: 272197 - DNA, 26 bp, Artificial Sequence
  Description of Artificial Sequence: Synthetic oligonucleotide
aggccagtcatggaggacgaggaagc

SEQ ID NO: 272198 - DNA, 25 bp, Artificial Sequence
  Description of Artificial Sequence: Synthetic oligonucleotide
ggccagtcatggaggacgaggaagc

SEQ ID NO: 272199 - DNA, 27 bp, Artificial Sequence
  Description of Artificial Sequence: Synthetic oligonucleotide
gccagtcatggaggacgaggaagccta

SEQ ID NO: 272200 - DNA, 27 bp, Artificial Sequence
  Description of Artificial Sequence: Synthetic oligonucleotide
ccagtcatggaggacgaggaagcctag

SEQ ID NO: 272201 - DNA, 30 bp, Artificial Sequence
  Description of Artificial Sequence: Synthetic oligonucleotide
cagtcatggaggacgaggaagcctagaatc

SEQ ID NO: 272202 - DNA, 31 bp, Artificial Sequence
  Description of Artificial Sequence: Synthetic oligonucleotide
agtcatggaggacgaggaagcctagaatctg

SEQ ID NO: 272203 - DNA, 30 bp, Artificial Sequence
  Description of Artificial Sequence: Synthetic oligonucleotide
gtcatggaggacgaggaagcctagaatctg

SEQ ID NO: 272204 - DNA, 30 bp, Artificial Sequence
  Description of Artificial Sequence: Synthetic oligonucleotide
tcatggaggacgaggaagcctagaatctgg

SEQ ID NO: 272205 - DNA, 29 bp, Artificial Sequence
  Description of Artificial Sequence: Synthetic oligonucleotide
catggaggacgaggaagcctagaatctgg

SEQ ID NO: 272206 - DNA, 30 bp, Artificial Sequence
  Description of Artificial Sequence: Synthetic oligonucleotide
atggaggacgaggaagcctagaatctggag

SEQ ID NO: 272207 - DNA, 29 bp, Artificial Sequence
  Description of Artificial Sequence: Synthetic oligonucleotide
tggaggacgaggaagcctagaatctggag

SEQ ID NO: 272208 - DNA, 28 bp, Artificial Sequence
  Description of Artificial Sequence: Synthetic oligonucleotide
ggaggacgaggaagcctagaatctggag

SEQ ID NO: 272209 - DNA, 29 bp, Artificial Sequence
  Description of Artificial Sequence: Synthetic oligonucleotide
gaggacgaggaagcctagaatctggagag

SEQ ID NO: 272210 - DNA, 29 bp, Artificial Sequence
  Description of Artificial Sequence: Synthetic oligonucleotide
aggacgaggaagcctagaatctggagagc

SEQ ID NO: 272211 - DNA, 28 bp, Artificial Sequence
  Description of Artificial Sequence: Synthetic oligonucleotide
ggacgaggaagcctagaatctggagagc

SEQ ID NO: 272212 - DNA, 28 bp, Artificial Sequence
  Description of Artificial Sequence: Synthetic oligonucleotide
gacgaggaagcctagaatctggagagcg

SEQ ID NO: 272213 - DNA, 30 bp, Artificial Sequence
  Description of Artificial Sequence: Synthetic oligonucleotide
acgaggaagcctagaatctggagagcgaag

SEQ ID NO: 272214 - DNA, 29 bp, Artificial Sequence
  Description of Artificial Sequence: Synthetic oligonucleotide
cgaggaagcctagaatctggagagcgaag

SEQ ID NO: 272215 - DNA, 29 bp, Artificial Sequence
  Description of Artificial Sequence: Synthetic oligonucleotide
gaggaagcctagaatctggagagcgaagc

SEQ ID NO: 272216 - DNA, 29 bp, Artificial Sequence
  Description of Artificial Sequence: Synthetic oligonucleotide
aggaagcctagaatctggagagcgaagcg

SEQ ID NO: 272217 - DNA, 28 bp, Artificial Sequence
  Description of Artificial Sequence: Synthetic oligonucleotide
ggaagcctagaatctggagagcgaagcg

SEQ ID NO: 272218 - DNA, 30 bp, Artificial Sequence
  Description of Artificial Sequence: Synthetic oligonucleotide
gaagcctagaatctggagagcgaagcgatc

SEQ ID NO: 272219 - DNA, 30 bp, Artificial Sequence
  Description of Artificial Sequence: Synthetic oligonucleotide
aagcctagaatctggagagcgaagcgatcg

SEQ ID NO: 272220 - DNA, 29 bp, Artificial Sequence
  Description of Artificial Sequence: Synthetic oligonucleotide
agcctagaatctggagagcgaagcgatcg

SEQ ID NO: 272221 - DNA, 28 bp, Artificial Sequence
  Description of Artificial Sequence: Synthetic oligonucleotide
gcctagaatctggagagcgaagcgatcg

SEQ ID NO: 272222 - DNA, 28 bp, Artificial Sequence
  Description of Artificial Sequence: Synthetic oligonucleotide
cctagaatctggagagcgaagcgatcgc

SEQ ID NO: 272223 - DNA, 29 bp, Artificial Sequence
  Description of Artificial Sequence: Synthetic oligonucleotide
ctagaatctggagagcgaagcgatcgcag

SEQ ID NO: 272224 - DNA, 29 bp, Artificial Sequence
  Description of Artificial Sequence: Synthetic oligonucleotide
tagaatctggagagcgaagcgatcgcagc

SEQ ID NO: 272225 - DNA, 28 bp, Artificial Sequence
  Description of Artificial Sequence: Synthetic oligonucleotide
agaatctggagagcgaagcgatcgcagc

SEQ ID NO: 272226 - DNA, 27 bp, Artificial Sequence
  Description of Artificial Sequence: Synthetic oligonucleotide
gaatctggagagcgaagcgatcgcagc

SEQ ID NO: 272227 - DNA, 28 bp, Artificial Sequence
  Description of Artificial Sequence: Synthetic oligonucleotide
aatctggagagcgaagcgatcgcagctc

SEQ ID NO: 272228 - DNA, 27 bp, Artificial Sequence
  Description of Artificial Sequence: Synthetic oligonucleotide
atctggagagcgaagcgatcgcagctc

SEQ ID NO: 272229 - DNA, 26 bp, Artificial Sequence
  Description of Artificial Sequence: Synthetic oligonucleotide
tctggagagcgaagcgatcgcagctc

SEQ ID NO: 272230 - DNA, 25 bp, Artificial Sequence
  Description of Artificial Sequence: Synthetic oligonucleotide
ctggagagcgaagcgatcgcagctc

SEQ ID NO: 272231 - DNA, 25 bp, Artificial Sequence
  Description of Artificial Sequence: Synthetic oligonucleotide
tggagagcgaagcgatcgcagctcg

SEQ ID NO: 272232 - DNA, 24 bp, Artificial Sequence
  Description of Artificial Sequence: Synthetic oligonucleotide
ggagagcgaagcgatcgcagctcg

SEQ ID NO: 272233 - DNA, 26 bp, Artificial Sequence
  Description of Artificial Sequence: Synthetic oligonucleotide
gagagcgaagcgatcgcagctcgcat

SEQ ID NO: 272234 - DNA, 27 bp, Artificial Sequence
  Description of Artificial Sequence: Synthetic oligonucleotide
agagcgaagcgatcgcagctcgcatct

SEQ ID NO: 272235 - DNA, 27 bp, Artificial Sequence
  Description of Artificial Sequence: Synthetic oligonucleotide
gagcgaagcgatcgcagctcgcatctt

SEQ ID NO: 272236 - DNA, 27 bp, Artificial Sequence
  Description of Artificial Sequence: Synthetic oligonucleotide
agcgaagcgatcgcagctcgcatcttc

SEQ ID NO: 272237 - DNA, 27 bp, Artificial Sequence
  Description of Artificial Sequence: Synthetic oligonucleotide
gcgaagcgatcgcagctcgcatcttca

SEQ ID NO: 272238 - DNA, 28 bp, Artificial Sequence
  Description of Artificial Sequence: Synthetic oligonucleotide
cgaagcgatcgcagctcgcatcttcatc

SEQ ID NO: 272239 - DNA, 28 bp, Artificial Sequence
  Description of Artificial Sequence: Synthetic oligonucleotide
gaagcgatcgcagctcgcatcttcatcg

SEQ ID NO: 272240 - DNA, 29 bp, Artificial Sequence
  Description of Artificial Sequence: Synthetic oligonucleotide
aagcgatcgcagctcgcatcttcatcgac

SEQ ID NO: 272241 - DNA, 28 bp, Artificial Sequence
  Description of Artificial Sequence: Synthetic oligonucleotide
agcgatcgcagctcgcatcttcatcgac

SEQ ID NO: 272242 - DNA, 27 bp, Artificial Sequence
  Description of Artificial Sequence: Synthetic oligonucleotide
gcgatcgcagctcgcatcttcatcgac

SEQ ID NO: 272243 - DNA, 27 bp, Artificial Sequence
  Description of Artificial Sequence: Synthetic oligonucleotide
cgatcgcagctcgcatcttcatcgacc

SEQ ID NO: 272244 - DNA, 28 bp, Artificial Sequence
  Description of Artificial Sequence: Synthetic oligonucleotide
gatcgcagctcgcatcttcatcgacctg

SEQ ID NO: 272245 - DNA, 28 bp, Artificial Sequence
  Description of Artificial Sequence: Synthetic oligonucleotide
atcgcagctcgcatcttcatcgacctgg

SEQ ID NO: 272246 - DNA, 27 bp, Artificial Sequence
  Description of Artificial Sequence: Synthetic oligonucleotide
tcgcagctcgcatcttcatcgacctgg

SEQ ID NO: 272247 - DNA, 26 bp, Artificial Sequence
  Description of Artificial Sequence: Synthetic oligonucleotide
cgcagctcgcatcttcatcgacctgg

SEQ ID NO: 272248 - DNA, 26 bp, Artificial Sequence
  Description of Artificial Sequence: Synthetic oligonucleotide
gcagctcgcatcttcatcgacctggg

SEQ ID NO: 272249 - DNA, 27 bp, Artificial Sequence
  Description of Artificial Sequence: Synthetic oligonucleotide
cagctcgcatcttcatcgacctggggt

SEQ ID NO: 272250 - DNA, 27 bp, Artificial Sequence
  Description of Artificial Sequence: Synthetic oligonucleotide
agctcgcatcttcatcgacctggggtc

SEQ ID NO: 272251 - DNA, 26 bp, Artificial Sequence
  Description of Artificial Sequence: Synthetic oligonucleotide
gctcgcatcttcatcgacctggggtc

SEQ ID NO: 272252 - DNA, 26 bp, Artificial Sequence
  Description of Artificial Sequence: Synthetic oligonucleotide
ctcgcatcttcatcgacctggggtcc

SEQ ID NO: 272253 - DNA, 26 bp, Artificial Sequence
  Description of Artificial Sequence: Synthetic oligonucleotide
tcgcatcttcatcgacctggggtccg

SEQ ID NO: 272254 - DNA, 25 bp, Artificial Sequence
  Description of Artificial Sequence: Synthetic oligonucleotide
cgcatcttcatcgacctggggtccg

SEQ ID NO: 272255 - DNA, 27 bp, Artificial Sequence
  Description of Artificial Sequence: Synthetic oligonucleotide
gcatcttcatcgacctggggtccggaa

SEQ ID NO: 272256 - DNA, 27 bp, Artificial Sequence
  Description of Artificial Sequence: Synthetic oligonucleotide
catcttcatcgacctggggtccggaag

SEQ ID NO: 272257 - DNA, 27 bp, Artificial Sequence
  Description of Artificial Sequence: Synthetic oligonucleotide
atcttcatcgacctggggtccggaagc

SEQ ID NO: 272258 - DNA, 27 bp, Artificial Sequence
  Description of Artificial Sequence: Synthetic oligonucleotide
tcttcatcgacctggggtccggaagct

SEQ ID NO: 272259 - DNA, 27 bp, Artificial Sequence
  Description of Artificial Sequence: Synthetic oligonucleotide
cttcatcgacctggggtccggaagcta

SEQ ID NO: 272260 - DNA, 27 bp, Artificial Sequence
  Description of Artificial Sequence: Synthetic oligonucleotide
ttcatcgacctggggtccggaagctac

SEQ ID NO: 272261 - DNA, 27 bp, Artificial Sequence
  Description of Artificial Sequence: Synthetic oligonucleotide
tcatcgacctggggtccggaagctaca

SEQ ID NO: 272262 - DNA, 27 bp, Artificial Sequence
  Description of Artificial Sequence: Synthetic oligonucleotide
catcgacctggggtccggaagctacat

SEQ ID NO: 272263 - DNA, 28 bp, Artificial Sequence
  Description of Artificial Sequence: Synthetic oligonucleotide
atcgacctggggtccggaagctacattg

SEQ ID NO: 272264 - DNA, 27 bp, Artificial Sequence
  Description of Artificial Sequence: Synthetic oligonucleotide
tcgacctggggtccggaagctacattg

SEQ ID NO: 272265 - DNA, 27 bp, Artificial Sequence
  Description of Artificial Sequence: Synthetic oligonucleotide
cgacctggggtccggaagctacattga

SEQ ID NO: 272266 - DNA, 27 bp, Artificial Sequence
  Description of Artificial Sequence: Synthetic oligonucleotide
gacctggggtccggaagctacattgac

SEQ ID NO: 272267 - DNA, 27 bp, Artificial Sequence
  Description of Artificial Sequence: Synthetic oligonucleotide
acctggggtccggaagctacattgacc

SEQ ID NO: 272268 - DNA, 27 bp, Artificial Sequence
  Description of Artificial Sequence: Synthetic oligonucleotide
cctggggtccggaagctacattgacca

SEQ ID NO: 272269 - DNA, 27 bp, Artificial Sequence
  Description of Artificial Sequence: Synthetic oligonucleotide
ctggggtccggaagctacattgaccac

SEQ ID NO: 272270 - DNA, 28 bp, Artificial Sequence
  Description of Artificial Sequence: Synthetic oligonucleotide
tggggtccggaagctacattgaccactg

SEQ ID NO: 272271 - DNA, 27 bp, Artificial Sequence
  Description of Artificial Sequence: Synthetic oligonucleotide
ggggtccggaagctacattgaccactg

SEQ ID NO: 272272 - DNA, 27 bp, Artificial Sequence
  Description of Artificial Sequence: Synthetic oligonucleotide
gggtccggaagctacattgaccactgc

SEQ ID NO: 272273 - DNA, 27 bp, Artificial Sequence
  Description of Artificial Sequence: Synthetic oligonucleotide
ggtccggaagctacattgaccactgcg

SEQ ID NO: 272274 - DNA, 28 bp, Artificial Sequence
  Description of Artificial Sequence: Synthetic oligonucleotide
gtccggaagctacattgaccactgcgtc

SEQ ID NO: 272275 - DNA, 30 bp, Artificial Sequence
  Description of Artificial Sequence: Synthetic oligonucleotide
tccggaagctacattgaccactgcgtcatg

SEQ ID NO: 272276 - DNA, 29 bp, Artificial Sequence
  Description of Artificial Sequence: Synthetic oligonucleotide
ccggaagctacattgaccactgcgtcatg

SEQ ID NO: 272277 - DNA, 30 bp, Artificial Sequence
  Description of Artificial Sequence: Synthetic oligonucleotide
cggaagctacattgaccactgcgtcatgag

SEQ ID NO: 272278 - DNA, 30 bp, Artificial Sequence
  Description of Artificial Sequence: Synthetic oligonucleotide
ggaagctacattgaccactgcgtcatgagc

SEQ ID NO: 272279 - DNA, 32 bp, Artificial Sequence
  Description of Artificial Sequence: Synthetic oligonucleotide
gaagctacattgaccactgcgtcatgagcaag

SEQ ID NO: 272280 - DNA, 34 bp, Artificial Sequence
  Description of Artificial Sequence: Synthetic oligonucleotide
aagctacattgaccactgcgtcatgagcaagaac

SEQ ID NO: 272281 - DNA, 33 bp, Artificial Sequence
  Description of Artificial Sequence: Synthetic oligonucleotide
agctacattgaccactgcgtcatgagcaagaac

SEQ ID NO: 272282 - DNA, 32 bp, Artificial Sequence
  Description of Artificial Sequence: Synthetic oligonucleotide
gctacattgaccactgcgtcatgagcaagaac

SEQ ID NO: 272283 - DNA, 34 bp, Artificial Sequence
  Description of Artificial Sequence: Synthetic oligonucleotide
ctacattgaccactgcgtcatgagcaagaactag

SEQ ID NO: 272284 - DNA, 34 bp, Artificial Sequence
  Description of Artificial Sequence: Synthetic oligonucleotide
tacattgaccactgcgtcatgagcaagaactagc

SEQ ID NO: 272285 - DNA, 33 bp, Artificial Sequence
  Description of Artificial Sequence: Synthetic oligonucleotide
acattgaccactgcgtcatgagcaagaactagc

SEQ ID NO: 272286 - DNA, 32 bp, Artificial Sequence
  Description of Artificial Sequence: Synthetic oligonucleotide
cattgaccactgcgtcatgagcaagaactagc

SEQ ID NO: 272287 - DNA, 33 bp, Artificial Sequence
  Description of Artificial Sequence: Synthetic oligonucleotide
attgaccactgcgtcatgagcaagaactagctg

SEQ ID NO: 272288 - DNA, 32 bp, Artificial Sequence
  Description of Artificial Sequence: Synthetic oligonucleotide
ttgaccactgcgtcatgagcaagaactagctg

SEQ ID NO: 272289 - DNA, 31 bp, Artificial Sequence
  Description of Artificial Sequence: Synthetic oligonucleotide
tgaccactgcgtcatgagcaagaactagctg

SEQ ID NO: 272290 - DNA, 30 bp, Artificial Sequence
  Description of Artificial Sequence: Synthetic oligonucleotide
gaccactgcgtcatgagcaagaactagctg

SEQ ID NO: 272291 - DNA, 30 bp, Artificial Sequence
  Description of Artificial Sequence: Synthetic oligonucleotide
accactgcgtcatgagcaagaactagctgg

SEQ ID NO: 272292 - DNA, 29 bp, Artificial Sequence
  Description of Artificial Sequence: Synthetic oligonucleotide
ccactgcgtcatgagcaagaactagctgg

SEQ ID NO: 272293 - DNA, 34 bp, Artificial Sequence
  Description of Artificial Sequence: Synthetic oligonucleotide
cactgcgtcatgagcaagaactagctggattatc

SEQ ID NO: 272294 - DNA, 35 bp, Artificial Sequence
  Description of Artificial Sequence: Synthetic oligonucleotide
actgcgtcatgagcaagaactagctggattatctc

SEQ ID NO: 272295 - DNA, 34 bp, Artificial Sequence
  Description of Artificial Sequence: Synthetic oligonucleotide
ctgcgtcatgagcaagaactagctggattatctc

SEQ ID NO: 272296 - DNA, 34 bp, Artificial Sequence
  Description of Artificial Sequence: Synthetic oligonucleotide
tgcgtcatgagcaagaactagctggattatctcc

SEQ ID NO: 272297 - DNA, 33 bp, Artificial Sequence
  Description of Artificial Sequence: Synthetic oligonucleotide
gcgtcatgagcaagaactagctggattatctcc

SEQ ID NO: 272298 - DNA, 33 bp, Artificial Sequence
  Description of Artificial Sequence: Synthetic oligonucleotide
cgtcatgagcaagaactagctggattatctccg

SEQ ID NO: 272299 - DNA, 33 bp, Artificial Sequence
  Description of Artificial Sequence: Synthetic oligonucleotide
gtcatgagcaagaactagctggattatctccgc

SEQ ID NO: 272300 - DNA, 33 bp, Artificial Sequence
  Description of Artificial Sequence: Synthetic oligonucleotide
tcatgagcaagaactagctggattatctccgcc

SEQ ID NO: 272301 - DNA, 32 bp, Artificial Sequence
  Description of Artificial Sequence: Synthetic oligonucleotide
catgagcaagaactagctggattatctccgcc

SEQ ID NO: 272302 - DNA, 32 bp, Artificial Sequence
  Description of Artificial Sequence: Synthetic oligonucleotide
atgagcaagaactagctggattatctccgccc

SEQ ID NO: 272303 - DNA, 31 bp, Artificial Sequence
  Description of Artificial Sequence: Synthetic oligonucleotide
tgagcaagaactagctggattatctccgccc

SEQ ID NO: 272304 - DNA, 30 bp, Artificial Sequence
  Description of Artificial Sequence: Synthetic oligonucleotide
gagcaagaactagctggattatctccgccc

SEQ ID NO: 272305 - DNA, 33 bp, Artificial Sequence
  Description of Artificial Sequence: Synthetic oligonucleotide
agcaagaactagctggattatctccgcccttac

SEQ ID NO: 272306 - DNA, 32 bp, Artificial Sequence
  Description of Artificial Sequence: Synthetic oligonucleotide
gcaagaactagctggattatctccgcccttac

SEQ ID NO: 272307 - DNA, 33 bp, Artificial Sequence
  Description of Artificial Sequence: Synthetic oligonucleotide
caagaactagctggattatctccgcccttacac

SEQ ID NO: 272308 - DNA, 34 bp, Artificial Sequence
  Description of Artificial Sequence: Synthetic oligonucleotide
aagaactagctggattatctccgcccttacacag

SEQ ID NO: 272309 - DNA, 33 bp, Artificial Sequence
  Description of Artificial Sequence: Synthetic oligonucleotide
agaactagctggattatctccgcccttacacag

SEQ ID NO: 272310 - DNA, 32 bp, Artificial Sequence
  Description of Artificial Sequence: Synthetic oligonucleotide
gaactagctggattatctccgcccttacacag

SEQ ID NO: 272311 - DNA, 33 bp, Artificial Sequence
  Description of Artificial Sequence: Synthetic oligonucleotide
aactagctggattatctccgcccttacacagtg

SEQ ID NO: 272312 - DNA, 32 bp, Artificial Sequence
  Description of Artificial Sequence: Synthetic oligonucleotide
actagctggattatctccgcccttacacagtg

SEQ ID NO: 272313 - DNA, 31 bp, Artificial Sequence
  Description of Artificial Sequence: Synthetic oligonucleotide
ctagctggattatctccgcccttacacagtg

SEQ ID NO: 272314 - DNA, 31 bp, Artificial Sequence
  Description of Artificial Sequence: Synthetic oligonucleotide
tagctggattatctccgcccttacacagtgg

SEQ ID NO: 272315 - DNA, 30 bp, Artificial Sequence
  Description of Artificial Sequence: Synthetic oligonucleotide
agctggattatctccgcccttacacagtgg

SEQ ID NO: 272316 - DNA, 29 bp, Artificial Sequence
  Description of Artificial Sequence: Synthetic oligonucleotide
gctggattatctccgcccttacacagtgg

SEQ ID NO: 272317 - DNA, 29 bp, Artificial Sequence
  Description of Artificial Sequence: Synthetic oligonucleotide
ctggattatctccgcccttacacagtggc

SEQ ID NO: 272318 - DNA, 29 bp, Artificial Sequence
  Description of Artificial Sequence: Synthetic oligonucleotide
tggattatctccgcccttacacagtggcc

SEQ ID NO: 272319 - DNA, 28 bp, Artificial Sequence
  Description of Artificial Sequence: Synthetic oligonucleotide
ggattatctccgcccttacacagtggcc

SEQ ID NO: 272320 - DNA, 30 bp, Artificial Sequence
  Description of Artificial Sequence: Synthetic oligonucleotide
gattatctccgcccttacacagtggccaac

SEQ ID NO: 272321 - DNA, 32 bp, Artificial Sequence
  Description of Artificial Sequence: Synthetic oligonucleotide
attatctccgcccttacacagtggccaacaag

SEQ ID NO: 272322 - DNA, 31 bp, Artificial Sequence
  Description of Artificial Sequence: Synthetic oligonucleotide
ttatctccgcccttacacagtggccaacaag

SEQ ID NO: 272323 - DNA, 30 bp, Artificial Sequence
  Description of Artificial Sequence: Synthetic oligonucleotide
tatctccgcccttacacagtggccaacaag

SEQ ID NO: 272324 - DNA, 29 bp, Artificial Sequence
  Description of Artificial Sequence: Synthetic oligonucleotide
atctccgcccttacacagtggccaacaag

SEQ ID NO: 272325 - DNA, 28 bp, Artificial Sequence
  Description of Artificial Sequence: Synthetic oligonucleotide
tctccgcccttacacagtggccaacaag

SEQ ID NO: 272326 - DNA, 27 bp, Artificial Sequence
  Description of Artificial Sequence: Synthetic oligonucleotide
ctccgcccttacacagtggccaacaag

SEQ ID NO: 272327 - DNA, 29 bp, Artificial Sequence
  Description of Artificial Sequence: Synthetic oligonucleotide
tccgcccttacacagtggccaacaagatg

SEQ ID NO: 272328 - DNA, 28 bp, Artificial Sequence
  Description of Artificial Sequence: Synthetic oligonucleotide
ccgcccttacacagtggccaacaagatg

SEQ ID NO: 272329 - DNA, 28 bp, Artificial Sequence
  Description of Artificial Sequence: Synthetic oligonucleotide
cgcccttacacagtggccaacaagatgg

SEQ ID NO: 272330 - DNA, 28 bp, Artificial Sequence
  Description of Artificial Sequence: Synthetic oligonucleotide
gcccttacacagtggccaacaagatggg

SEQ ID NO: 272331 - DNA, 28 bp, Artificial Sequence
  Description of Artificial Sequence: Synthetic oligonucleotide
cccttacacagtggccaacaagatgggg

SEQ ID NO: 272332 - DNA, 29 bp, Artificial Sequence
  Description of Artificial Sequence: Synthetic oligonucleotide
ccttacacagtggccaacaagatggggac

SEQ ID NO: 272333 - DNA, 29 bp, Artificial Sequence
  Description of Artificial Sequence: Synthetic oligonucleotide
cttacacagtggccaacaagatggggacc

SEQ ID NO: 272334 - DNA, 30 bp, Artificial Sequence
  Description of Artificial Sequence: Synthetic oligonucleotide
ttacacagtggccaacaagatggggaccag

SEQ ID NO: 272335 - DNA, 29 bp, Artificial Sequence
  Description of Artificial Sequence: Synthetic oligonucleotide
tacacagtggccaacaagatggggaccag

SEQ ID NO: 272336 - DNA, 28 bp, Artificial Sequence
  Description of Artificial Sequence: Synthetic oligonucleotide
acacagtggccaacaagatggggaccag

SEQ ID NO: 272337 - DNA, 27 bp, Artificial Sequence
  Description of Artificial Sequence: Synthetic oligonucleotide
cacagtggccaacaagatggggaccag

SEQ ID NO: 272338 - DNA, 27 bp, Artificial Sequence
  Description of Artificial Sequence: Synthetic oligonucleotide
acagtggccaacaagatggggaccagc

SEQ ID NO: 272339 - DNA, 26 bp, Artificial Sequence
  Description of Artificial Sequence: Synthetic oligonucleotide
cagtggccaacaagatggggaccagc

SEQ ID NO: 272340 - DNA, 27 bp, Artificial Sequence
  Description of Artificial Sequence: Synthetic oligonucleotide
agtggccaacaagatggggaccagcct

SEQ ID NO: 272341 - DNA, 27 bp, Artificial Sequence
  Description of Artificial Sequence: Synthetic oligonucleotide
gtggccaacaagatggggaccagcctt

SEQ ID NO: 272342 - DNA, 27 bp, Artificial Sequence
  Description of Artificial Sequence: Synthetic oligonucleotide
tggccaacaagatggggaccagccttg

SEQ ID NO: 272343 - DNA, 26 bp, Artificial Sequence
  Description of Artificial Sequence: Synthetic oligonucleotide
ggccaacaagatggggaccagccttg

SEQ ID NO: 272344 - DNA, 26 bp, Artificial Sequence
  Description of Artificial Sequence: Synthetic oligonucleotide
gccaacaagatggggaccagccttgg

SEQ ID NO: 272345 - DNA, 26 bp, Artificial Sequence
  Description of Artificial Sequence: Synthetic oligonucleotide
ccaacaagatggggaccagccttggc

SEQ ID NO: 272346 - DNA, 26 bp, Artificial Sequence
  Description of Artificial Sequence: Synthetic oligonucleotide
caacaagatggggaccagccttggcc

SEQ ID NO: 272347 - DNA, 26 bp, Artificial Sequence
  Description of Artificial Sequence: Synthetic oligonucleotide
aacaagatggggaccagccttggccg

SEQ ID NO: 272348 - DNA, 25 bp, Artificial Sequence
  Description of Artificial Sequence: Synthetic oligonucleotide
acaagatggggaccagccttggccg

SEQ ID NO: 272349 - DNA, 24 bp, Artificial Sequence
  Description of Artificial Sequence: Synthetic oligonucleotide
caagatggggaccagccttggccg

SEQ ID NO: 272350 - DNA, 26 bp, Artificial Sequence
  Description of Artificial Sequence: Synthetic oligonucleotide
aagatggggaccagccttggccggaa

SEQ ID NO: 272351 - DNA, 25 bp, Artificial Sequence
  Description of Artificial Sequence: Synthetic oligonucleotide
agatggggaccagccttggccggaa

SEQ ID NO: 272352 - DNA, 24 bp, Artificial Sequence
  Description of Artificial Sequence: Synthetic oligonucleotide
gatggggaccagccttggccggaa

SEQ ID NO: 272353 - DNA, 25 bp, Artificial Sequence
  Description of Artificial Sequence: Synthetic oligonucleotide
atggggaccagccttggccggaaca

SEQ ID NO: 272354 - DNA, 24 bp, Artificial Sequence
  Description of Artificial Sequence: Synthetic oligonucleotide
tggggaccagccttggccggaaca

SEQ ID NO: 272355 - DNA, 23 bp, Artificial Sequence
  Description of Artificial Sequence: Synthetic oligonucleotide
ggggaccagccttggccggaaca

SEQ ID NO: 272356 - DNA, 23 bp, Artificial Sequence
  Description of Artificial Sequence: Synthetic oligonucleotide
gggaccagccttggccggaacag

SEQ ID NO: 272357 - DNA, 24 bp, Artificial Sequence
  Description of Artificial Sequence: Synthetic oligonucleotide
ggaccagccttggccggaacaggt

SEQ ID NO: 272358 - DNA, 25 bp, Artificial Sequence
  Description of Artificial Sequence: Synthetic oligonucleotide
gaccagccttggccggaacaggtgt

SEQ ID NO: 272359 - DNA, 26 bp, Artificial Sequence
  Description of Artificial Sequence: Synthetic oligonucleotide
accagccttggccggaacaggtgtgt

SEQ ID NO: 272360 - DNA, 25 bp, Artificial Sequence
  Description of Artificial Sequence: Synthetic oligonucleotide
ccagccttggccggaacaggtgtgt

SEQ ID NO: 272361 - DNA, 27 bp, Artificial Sequence
  Description of Artificial Sequence: Synthetic oligonucleotide
cagccttggccggaacaggtgtgtgaa

SEQ ID NO: 272362 - DNA, 28 bp, Artificial Sequence
  Description of Artificial Sequence: Synthetic oligonucleotide
agccttggccggaacaggtgtgtgaaag

SEQ ID NO: 272363 - DNA, 27 bp, Artificial Sequence
  Description of Artificial Sequence: Synthetic oligonucleotide
gccttggccggaacaggtgtgtgaaag

SEQ ID NO: 272364 - DNA, 27 bp, Artificial Sequence
  Description of Artificial Sequence: Synthetic oligonucleotide
ccttggccggaacaggtgtgtgaaagg

SEQ ID NO: 272365 - DNA, 27 bp, Artificial Sequence
  Description of Artificial Sequence: Synthetic oligonucleotide
cttggccggaacaggtgtgtgaaaggg

SEQ ID NO: 272366 - DNA, 28 bp, Artificial Sequence
  Description of Artificial Sequence: Synthetic oligonucleotide
ttggccggaacaggtgtgtgaaagggac

SEQ ID NO: 272367 - DNA, 27 bp, Artificial Sequence
  Description of Artificial Sequence: Synthetic oligonucleotide
tggccggaacaggtgtgtgaaagggac

SEQ ID NO: 272368 - DNA, 27 bp, Artificial Sequence
  Description of Artificial Sequence: Synthetic oligonucleotide
ggccggaacaggtgtgtgaaagggaca

SEQ ID NO: 272369 - DNA, 28 bp, Artificial Sequence
  Description of Artificial Sequence: Synthetic oligonucleotide
gccggaacaggtgtgtgaaagggacaac

SEQ ID NO: 272370 - DNA, 29 bp, Artificial Sequence
  Description of Artificial Sequence: Synthetic oligonucleotide
ccggaacaggtgtgtgaaagggacaactg

SEQ ID NO: 272371 - DNA, 29 bp, Artificial Sequence
  Description of Artificial Sequence: Synthetic oligonucleotide
cggaacaggtgtgtgaaagggacaactgc

SEQ ID NO: 272372 - DNA, 30 bp, Artificial Sequence
  Description of Artificial Sequence: Synthetic oligonucleotide
ggaacaggtgtgtgaaagggacaactgcag

SEQ ID NO: 272373 - DNA, 31 bp, Artificial Sequence
  Description of Artificial Sequence: Synthetic oligonucleotide
gaacaggtgtgtgaaagggacaactgcagtc

SEQ ID NO: 272374 - DNA, 31 bp, Artificial Sequence
  Description of Artificial Sequence: Synthetic oligonucleotide
aacaggtgtgtgaaagggacaactgcagtcg

SEQ ID NO: 272375 - DNA, 30 bp, Artificial Sequence
  Description of Artificial Sequence: Synthetic oligonucleotide
acaggtgtgtgaaagggacaactgcagtcg

SEQ ID NO: 272376 - DNA, 29 bp, Artificial Sequence
  Description of Artificial Sequence: Synthetic oligonucleotide
caggtgtgtgaaagggacaactgcagtcg

SEQ ID NO: 272377 - DNA, 30 bp, Artificial Sequence
  Description of Artificial Sequence: Synthetic oligonucleotide
aggtgtgtgaaagggacaactgcagtcgtc

SEQ ID NO: 272378 - DNA, 29 bp, Artificial Sequence
  Description of Artificial Sequence: Synthetic oligonucleotide
ggtgtgtgaaagggacaactgcagtcgtc

SEQ ID NO: 272379 - DNA, 30 bp, Artificial Sequence
  Description of Artificial Sequence: Synthetic oligonucleotide
gtgtgtgaaagggacaactgcagtcgtcac

SEQ ID NO: 272380 - DNA, 31 bp, Artificial Sequence
  Description of Artificial Sequence: Synthetic oligonucleotide
tgtgtgaaagggacaactgcagtcgtcactg

SEQ ID NO: 272381 - DNA, 30 bp, Artificial Sequence
  Description of Artificial Sequence: Synthetic oligonucleotide
gtgtgaaagggacaactgcagtcgtcactg

SEQ ID NO: 272382 - DNA, 31 bp, Artificial Sequence
  Description of Artificial Sequence: Synthetic oligonucleotide
tgtgaaagggacaactgcagtcgtcactgag

SEQ ID NO: 272383 - DNA, 30 bp, Artificial Sequence
  Description of Artificial Sequence: Synthetic oligonucleotide
gtgaaagggacaactgcagtcgtcactgag

SEQ ID NO: 272384 - DNA, 35 bp, Artificial Sequence
  Description of Artificial Sequence: Synthetic oligonucleotide
tgaaagggacaactgcagtcgtcactgagataatc

SEQ ID NO: 272385 - DNA, 34 bp, Artificial Sequence
  Description of Artificial Sequence: Synthetic oligonucleotide
gaaagggacaactgcagtcgtcactgagataatc

SEQ ID NO: 272386 - DNA, 35 bp, Artificial Sequence
  Description of Artificial Sequence: Synthetic oligonucleotide
aaagggacaactgcagtcgtcactgagataatcac

SEQ ID NO: 272387 - DNA, 34 bp, Artificial Sequence
  Description of Artificial Sequence: Synthetic oligonucleotide
aagggacaactgcagtcgtcactgagataatcac

SEQ ID NO: 272388 - DNA, 33 bp, Artificial Sequence
  Description of Artificial Sequence: Synthetic oligonucleotide
agggacaactgcagtcgtcactgagataatcac

SEQ ID NO: 272389 - DNA, 32 bp, Artificial Sequence
  Description of Artificial Sequence: Synthetic oligonucleotide
gggacaactgcagtcgtcactgagataatcac

SEQ ID NO: 272390 - DNA, 33 bp, Artificial Sequence
  Description of Artificial Sequence: Synthetic oligonucleotide
ggacaactgcagtcgtcactgagataatcactc

SEQ ID NO: 272391 - DNA, 33 bp, Artificial Sequence
  Description of Artificial Sequence: Synthetic oligonucleotide
gacaactgcagtcgtcactgagataatcactcc

SEQ ID NO: 272392 - DNA, 34 bp, Artificial Sequence
  Description of Artificial Sequence: Synthetic oligonucleotide
acaactgcagtcgtcactgagataatcactccac

SEQ ID NO: 272393 - DNA, 33 bp, Artificial Sequence
  Description of Artificial Sequence: Synthetic oligonucleotide
caactgcagtcgtcactgagataatcactccac

SEQ ID NO: 272394 - DNA, 34 bp, Artificial Sequence
  Description of Artificial Sequence: Synthetic oligonucleotide
aactgcagtcgtcactgagataatcactccactg

SEQ ID NO: 272395 - DNA, 33 bp, Artificial Sequence
  Description of Artificial Sequence: Synthetic oligonucleotide
actgcagtcgtcactgagataatcactccactg

SEQ ID NO: 272396 - DNA, 32 bp, Artificial Sequence
  Description of Artificial Sequence: Synthetic oligonucleotide
ctgcagtcgtcactgagataatcactccactg

SEQ ID NO: 272397 - DNA, 32 bp, Artificial Sequence
  Description of Artificial Sequence: Synthetic oligonucleotide
tgcagtcgtcactgagataatcactccactgg

SEQ ID NO: 272398 - DNA, 31 bp, Artificial Sequence
  Description of Artificial Sequence: Synthetic oligonucleotide
gcagtcgtcactgagataatcactccactgg

SEQ ID NO: 272399 - DNA, 32 bp, Artificial Sequence
  Description of Artificial Sequence: Synthetic oligonucleotide
cagtcgtcactgagataatcactccactggag

SEQ ID NO: 272400 - DNA, 35 bp, Artificial Sequence
  Description of Artificial Sequence: Synthetic oligonucleotide
agtcgtcactgagataatcactccactggagattc

SEQ ID NO: 272401 - DNA, 34 bp, Artificial Sequence
  Description of Artificial Sequence: Synthetic oligonucleotide
gtcgtcactgagataatcactccactggagattc

SEQ ID NO: 272402 - DNA, 35 bp, Artificial Sequence
  Description of Artificial Sequence: Synthetic oligonucleotide
tcgtcactgagataatcactccactggagattcag

SEQ ID NO: 272403 - DNA, 34 bp, Artificial Sequence
  Description of Artificial Sequence: Synthetic oligonucleotide
cgtcactgagataatcactccactggagattcag

SEQ ID NO: 272404 - DNA, 34 bp, Artificial Sequence
  Description of Artificial Sequence: Synthetic oligonucleotide
gtcactgagataatcactccactggagattcagg

SEQ ID NO: 272405 - DNA, 35 bp, Artificial Sequence
  Description of Artificial Sequence: Synthetic oligonucleotide
tcactgagataatcactccactggagattcaggtg

SEQ ID NO: 272406 - DNA, 34 bp, Artificial Sequence
  Description of Artificial Sequence: Synthetic oligonucleotide
cactgagataatcactccactggagattcaggtg

SEQ ID NO: 272407 - DNA, 34 bp, Artificial Sequence
  Description of Artificial Sequence: Synthetic oligonucleotide
actgagataatcactccactggagattcaggtgc

SEQ ID NO: 272408 - DNA, 33 bp, Artificial Sequence
  Description of Artificial Sequence: Synthetic oligonucleotide
ctgagataatcactccactggagattcaggtgc

SEQ ID NO: 272409 - DNA, 34 bp, Artificial Sequence
  Description of Artificial Sequence: Synthetic oligonucleotide
tgagataatcactccactggagattcaggtgctg

SEQ ID NO: 272410 - DNA, 33 bp, Artificial Sequence
  Description of Artificial Sequence: Synthetic oligonucleotide
gagataatcactccactggagattcaggtgctg

SEQ ID NO: 272411 - DNA, 33 bp, Artificial Sequence
  Description of Artificial Sequence: Synthetic oligonucleotide
agataatcactccactggagattcaggtgctgg

SEQ ID NO: 272412 - DNA, 32 bp, Artificial Sequence
  Description of Artificial Sequence: Synthetic oligonucleotide
gataatcactccactggagattcaggtgctgg

SEQ ID NO: 272413 - DNA, 34 bp, Artificial Sequence
  Description of Artificial Sequence: Synthetic oligonucleotide
ataatcactccactggagattcaggtgctggtag

SEQ ID NO: 272414 - DNA, 33 bp, Artificial Sequence
  Description of Artificial Sequence: Synthetic oligonucleotide
taatcactccactggagattcaggtgctggtag

SEQ ID NO: 272415 - DNA, 32 bp, Artificial Sequence
  Description of Artificial Sequence: Synthetic oligonucleotide
aatcactccactggagattcaggtgctggtag

SEQ ID NO: 272416 - DNA, 31 bp, Artificial Sequence
  Description of Artificial Sequence: Synthetic oligonucleotide
atcactccactggagattcaggtgctggtag

SEQ ID NO: 272417 - DNA, 30 bp, Artificial Sequence
  Description of Artificial Sequence: Synthetic oligonucleotide
tcactccactggagattcaggtgctggtag

SEQ ID NO: 272418 - DNA, 29 bp, Artificial Sequence
  Description of Artificial Sequence: Synthetic oligonucleotide
cactccactggagattcaggtgctggtag

SEQ ID NO: 272419 - DNA, 32 bp, Artificial Sequence
  Description of Artificial Sequence: Synthetic oligonucleotide
actccactggagattcaggtgctggtagaaac

SEQ ID NO: 272420 - DNA, 31 bp, Artificial Sequence
  Description of Artificial Sequence: Synthetic oligonucleotide
ctccactggagattcaggtgctggtagaaac

SEQ ID NO: 272421 - DNA, 32 bp, Artificial Sequence
  Description of Artificial Sequence: Synthetic oligonucleotide
tccactggagattcaggtgctggtagaaacag

SEQ ID NO: 272422 - DNA, 31 bp, Artificial Sequence
  Description of Artificial Sequence: Synthetic oligonucleotide
ccactggagattcaggtgctggtagaaacag

SEQ ID NO: 272423 - DNA, 32 bp, Artificial Sequence
  Description of Artificial Sequence: Synthetic oligonucleotide
cactggagattcaggtgctggtagaaacagtg

SEQ ID NO: 272424 - DNA, 32 bp, Artificial Sequence
  Description of Artificial Sequence: Synthetic oligonucleotide
actggagattcaggtgctggtagaaacagtgc

SEQ ID NO: 272425 - DNA, 31 bp, Artificial Sequence
  Description of Artificial Sequence: Synthetic oligonucleotide
ctggagattcaggtgctggtagaaacagtgc

SEQ ID NO: 272426 - DNA, 34 bp, Artificial Sequence
  Description of Artificial Sequence: Synthetic oligonucleotide
tggagattcaggtgctggtagaaacagtgcaaac

SEQ ID NO: 272427 - DNA, 33 bp, Artificial Sequence
  Description of Artificial Sequence: Synthetic oligonucleotide
ggagattcaggtgctggtagaaacagtgcaaac

SEQ ID NO: 272428 - DNA, 36 bp, Artificial Sequence
  Description of Artificial Sequence: Synthetic oligonucleotide
gagattcaggtgctggtagaaacagtgcaaacaatg

SEQ ID NO: 272429 - DNA, 36 bp, Artificial Sequence
  Description of Artificial Sequence: Synthetic oligonucleotide
agattcaggtgctggtagaaacagtgcaaacaatgc

SEQ ID NO: 272430 - DNA, 35 bp, Artificial Sequence
  Description of Artificial Sequence: Synthetic oligonucleotide
gattcaggtgctggtagaaacagtgcaaacaatgc

SEQ ID NO: 272431 - DNA, 36 bp, Artificial Sequence
  Description of Artificial Sequence: Synthetic oligonucleotide
attcaggtgctggtagaaacagtgcaaacaatgcac

SEQ ID NO: 272432 - DNA, 35 bp, Artificial Sequence
  Description of Artificial Sequence: Synthetic oligonucleotide
ttcaggtgctggtagaaacagtgcaaacaatgcac

SEQ ID NO: 272433 - DNA, 34 bp, Artificial Sequence
  Description of Artificial Sequence: Synthetic oligonucleotide
tcaggtgctggtagaaacagtgcaaacaatgcac

SEQ ID NO: 272434 - DNA, 33 bp, Artificial Sequence
  Description of Artificial Sequence: Synthetic oligonucleotide
caggtgctggtagaaacagtgcaaacaatgcac

SEQ ID NO: 272435 - DNA, 34 bp, Artificial Sequence
  Description of Artificial Sequence: Synthetic oligonucleotide
aggtgctggtagaaacagtgcaaacaatgcacac

SEQ ID NO: 272436 - DNA, 33 bp, Artificial Sequence
  Description of Artificial Sequence: Synthetic oligonucleotide
ggtgctggtagaaacagtgcaaacaatgcacac

SEQ ID NO: 272437 - DNA, 35 bp, Artificial Sequence
  Description of Artificial Sequence: Synthetic oligonucleotide
gtgctggtagaaacagtgcaaacaatgcacacttc

SEQ ID NO: 272438 - DNA, 35 bp, Artificial Sequence
  Description of Artificial Sequence: Synthetic oligonucleotide
tgctggtagaaacagtgcaaacaatgcacacttcc

SEQ ID NO: 272439 - DNA, 34 bp, Artificial Sequence
  Description of Artificial Sequence: Synthetic oligonucleotide
gctggtagaaacagtgcaaacaatgcacacttcc

SEQ ID NO: 272440 - DNA, 35 bp, Artificial Sequence
  Description of Artificial Sequence: Synthetic oligonucleotide
ctggtagaaacagtgcaaacaatgcacacttcctc

SEQ ID NO: 272441 - DNA, 25 bp, Artificial Sequence
  Description of Artificial Sequence: Synthetic oligonucleotide
atgctcattggaaccccctccccgc

SEQ ID NO: 272442 - DNA, 24 bp, Artificial Sequence
  Description of Artificial Sequence: Synthetic oligonucleotide
tgctcattggaaccccctccccgc

SEQ ID NO: 272443 - DNA, 23 bp, Artificial Sequence
  Description of Artificial Sequence: Synthetic oligonucleotide
gctcattggaaccccctccccgc

SEQ ID NO: 272444 - DNA, 24 bp, Artificial Sequence
  Description of Artificial Sequence: Synthetic oligonucleotide
ctcattggaaccccctccccgcgt

SEQ ID NO: 272445 - DNA, 25 bp, Artificial Sequence
  Description of Artificial Sequence: Synthetic oligonucleotide
tcattggaaccccctccccgcgtgt

SEQ ID NO: 272446 - DNA, 24 bp, Artificial Sequence
  Description of Artificial Sequence: Synthetic oligonucleotide
cattggaaccccctccccgcgtgt

SEQ ID NO: 272447 - DNA, 25 bp, Artificial Sequence
  Description of Artificial Sequence: Synthetic oligonucleotide
attggaaccccctccccgcgtgtca

SEQ ID NO: 272448 - DNA, 24 bp, Artificial Sequence
  Description of Artificial Sequence: Synthetic oligonucleotide
ttggaaccccctccccgcgtgtca

SEQ ID NO: 272449 - DNA, 23 bp, Artificial Sequence
  Description of Artificial Sequence: Synthetic oligonucleotide
tggaaccccctccccgcgtgtca

SEQ ID NO: 272450 - DNA, 22 bp, Artificial Sequence
  Description of Artificial Sequence: Synthetic oligonucleotide
ggaaccccctccccgcgtgtca

SEQ ID NO: 272451 - DNA, 24 bp, Artificial Sequence
  Description of Artificial Sequence: Synthetic oligonucleotide
gaaccccctccccgcgtgtcacta

SEQ ID NO: 272452 - DNA, 25 bp, Artificial Sequence
  Description of Artificial Sequence: Synthetic oligonucleotide
aaccccctccccgcgtgtcactact

SEQ ID NO: 272453 - DNA, 24 bp, Artificial Sequence
  Description of Artificial Sequence: Synthetic oligonucleotide
accccctccccgcgtgtcactact

SEQ ID NO: 272454 - DNA, 23 bp, Artificial Sequence
  Description of Artificial Sequence: Synthetic oligonucleotide
ccccctccccgcgtgtcactact

SEQ ID NO: 272455 - DNA, 23 bp, Artificial Sequence
  Description of Artificial Sequence: Synthetic oligonucleotide
cccctccccgcgtgtcactactc

SEQ ID NO: 272456 - DNA, 23 bp, Artificial Sequence
  Description of Artificial Sequence: Synthetic oligonucleotide
ccctccccgcgtgtcactactcc

SEQ ID NO: 272457 - DNA, 24 bp, Artificial Sequence
  Description of Artificial Sequence: Synthetic oligonucleotide
cctccccgcgtgtcactactccga

SEQ ID NO: 272458 - DNA, 24 bp, Artificial Sequence
  Description of Artificial Sequence: Synthetic oligonucleotide
ctccccgcgtgtcactactccgag

SEQ ID NO: 272459 - DNA, 25 bp, Artificial Sequence
  Description of Artificial Sequence: Synthetic oligonucleotide
tccccgcgtgtcactactccgagct

SEQ ID NO: 272460 - DNA, 24 bp, Artificial Sequence
  Description of Artificial Sequence: Synthetic oligonucleotide
ccccgcgtgtcactactccgagct

SEQ ID NO: 272461 - DNA, 24 bp, Artificial Sequence
  Description of Artificial Sequence: Synthetic oligonucleotide
cccgcgtgtcactactccgagctc

SEQ ID NO: 272462 - DNA, 25 bp, Artificial Sequence
  Description of Artificial Sequence: Synthetic oligonucleotide
ccgcgtgtcactactccgagctcct

SEQ ID NO: 272463 - DNA, 25 bp, Artificial Sequence
  Description of Artificial Sequence: Synthetic oligonucleotide
cgcgtgtcactactccgagctcctg

SEQ ID NO: 272464 - DNA, 25 bp, Artificial Sequence
  Description of Artificial Sequence: Synthetic oligonucleotide
gcgtgtcactactccgagctcctgg

SEQ ID NO: 272465 - DNA, 26 bp, Artificial Sequence
  Description of Artificial Sequence: Synthetic oligonucleotide
cgtgtcactactccgagctcctggca

SEQ ID NO: 272466 - DNA, 27 bp, Artificial Sequence
  Description of Artificial Sequence: Synthetic oligonucleotide
gtgtcactactccgagctcctggcaga

SEQ ID NO: 272467 - DNA, 27 bp, Artificial Sequence
  Description of Artificial Sequence: Synthetic oligonucleotide
tgtcactactccgagctcctggcagac

SEQ ID NO: 272468 - DNA, 27 bp, Artificial Sequence
  Description of Artificial Sequence: Synthetic oligonucleotide
gtcactactccgagctcctggcagact

SEQ ID NO: 272469 - DNA, 28 bp, Artificial Sequence
  Description of Artificial Sequence: Synthetic oligonucleotide
tcactactccgagctcctggcagacttc

SEQ ID NO: 272470 - DNA, 27 bp, Artificial Sequence
  Description of Artificial Sequence: Synthetic oligonucleotide
cactactccgagctcctggcagacttc

SEQ ID NO: 272471 - DNA, 29 bp, Artificial Sequence
  Description of Artificial Sequence: Synthetic oligonucleotide
actactccgagctcctggcagacttctac

SEQ ID NO: 272472 - DNA, 28 bp, Artificial Sequence
  Description of Artificial Sequence: Synthetic oligonucleotide
ctactccgagctcctggcagacttctac

SEQ ID NO: 272473 - DNA, 29 bp, Artificial Sequence
  Description of Artificial Sequence: Synthetic oligonucleotide
tactccgagctcctggcagacttctactc

SEQ ID NO: 272474 - DNA, 28 bp, Artificial Sequence
  Description of Artificial Sequence: Synthetic oligonucleotide
actccgagctcctggcagacttctactc

SEQ ID NO: 272475 - DNA, 27 bp, Artificial Sequence
  Description of Artificial Sequence: Synthetic oligonucleotide
ctccgagctcctggcagacttctactc

SEQ ID NO: 272476 - DNA, 29 bp, Artificial Sequence
  Description of Artificial Sequence: Synthetic oligonucleotide
tccgagctcctggcagacttctactcttc

SEQ ID NO: 272477 - DNA, 28 bp, Artificial Sequence
  Description of Artificial Sequence: Synthetic oligonucleotide
ccgagctcctggcagacttctactcttc

SEQ ID NO: 272478 - DNA, 29 bp, Artificial Sequence
  Description of Artificial Sequence: Synthetic oligonucleotide
cgagctcctggcagacttctactcttctg

SEQ ID NO: 272479 - DNA, 29 bp, Artificial Sequence
  Description of Artificial Sequence: Synthetic oligonucleotide
gagctcctggcagacttctactcttctgg

SEQ ID NO: 272480 - DNA, 31 bp, Artificial Sequence
  Description of Artificial Sequence: Synthetic oligonucleotide
agctcctggcagacttctactcttctggtag

SEQ ID NO: 272481 - DNA, 30 bp, Artificial Sequence
  Description of Artificial Sequence: Synthetic oligonucleotide
gctcctggcagacttctactcttctggtag

SEQ ID NO: 272482 - DNA, 32 bp, Artificial Sequence
  Description of Artificial Sequence: Synthetic oligonucleotide
ctcctggcagacttctactcttctggtagaag

SEQ ID NO: 272483 - DNA, 32 bp, Artificial Sequence
  Description of Artificial Sequence: Synthetic oligonucleotide
tcctggcagacttctactcttctggtagaagc

SEQ ID NO: 272484 - DNA, 31 bp, Artificial Sequence
  Description of Artificial Sequence: Synthetic oligonucleotide
cctggcagacttctactcttctggtagaagc

SEQ ID NO: 272485 - DNA, 32 bp, Artificial Sequence
  Description of Artificial Sequence: Synthetic oligonucleotide
ctggcagacttctactcttctggtagaagctg

SEQ ID NO: 272486 - DNA, 32 bp, Artificial Sequence
  Description of Artificial Sequence: Synthetic oligonucleotide
tggcagacttctactcttctggtagaagctgc

SEQ ID NO: 272487 - DNA, 31 bp, Artificial Sequence
  Description of Artificial Sequence: Synthetic oligonucleotide
ggcagacttctactcttctggtagaagctgc

SEQ ID NO: 272488 - DNA, 31 bp, Artificial Sequence
  Description of Artificial Sequence: Synthetic oligonucleotide
gcagacttctactcttctggtagaagctgcg

SEQ ID NO: 272489 - DNA, 31 bp, Artificial Sequence
  Description of Artificial Sequence: Synthetic oligonucleotide
cagacttctactcttctggtagaagctgcgg

SEQ ID NO: 272490 - DNA, 31 bp, Artificial Sequence
  Description of Artificial Sequence: Synthetic oligonucleotide
agacttctactcttctggtagaagctgcggc

SEQ ID NO: 272491 - DNA, 30 bp, Artificial Sequence
  Description of Artificial Sequence: Synthetic oligonucleotide
gacttctactcttctggtagaagctgcggc

SEQ ID NO: 272492 - DNA, 34 bp, Artificial Sequence
  Description of Artificial Sequence: Synthetic oligonucleotide
acttctactcttctggtagaagctgcggctttag

SEQ ID NO: 272493 - DNA, 33 bp, Artificial Sequence
  Description of Artificial Sequence: Synthetic oligonucleotide
cttctactcttctggtagaagctgcggctttag

SEQ ID NO: 272494 - DNA, 35 bp, Artificial Sequence
  Description of Artificial Sequence: Synthetic oligonucleotide
ttctactcttctggtagaagctgcggctttagatg

SEQ ID NO: 272495 - DNA, 34 bp, Artificial Sequence
  Description of Artificial Sequence: Synthetic oligonucleotide
tctactcttctggtagaagctgcggctttagatg

SEQ ID NO: 272496 - DNA, 33 bp, Artificial Sequence
  Description of Artificial Sequence: Synthetic oligonucleotide
ctactcttctggtagaagctgcggctttagatg

SEQ ID NO: 272497 - DNA, 34 bp, Artificial Sequence
  Description of Artificial Sequence: Synthetic oligonucleotide
tactcttctggtagaagctgcggctttagatgtc

SEQ ID NO: 272498 - DNA, 33 bp, Artificial Sequence
  Description of Artificial Sequence: Synthetic oligonucleotide
actcttctggtagaagctgcggctttagatgtc

SEQ ID NO: 272499 - DNA, 32 bp, Artificial Sequence
  Description of Artificial Sequence: Synthetic oligonucleotide
ctcttctggtagaagctgcggctttagatgtc

SEQ ID NO: 272500 - DNA, 33 bp, Artificial Sequence
  Description of Artificial Sequence: Synthetic oligonucleotide
tcttctggtagaagctgcggctttagatgtcac

SEQ ID NO: 272501 - DNA, 32 bp, Artificial Sequence
  Description of Artificial Sequence: Synthetic oligonucleotide
cttctggtagaagctgcggctttagatgtcac

SEQ ID NO: 272502 - DNA, 32 bp, Artificial Sequence
  Description of Artificial Sequence: Synthetic oligonucleotide
ttctggtagaagctgcggctttagatgtcacg

SEQ ID NO: 272503 - DNA, 31 bp, Artificial Sequence
  Description of Artificial Sequence: Synthetic oligonucleotide
tctggtagaagctgcggctttagatgtcacg

SEQ ID NO: 272504 - DNA, 30 bp, Artificial Sequence
  Description of Artificial Sequence: Synthetic oligonucleotide
ctggtagaagctgcggctttagatgtcacg

SEQ ID NO: 272505 - DNA, 31 bp, Artificial Sequence
  Description of Artificial Sequence: Synthetic oligonucleotide
tggtagaagctgcggctttagatgtcacgac

SEQ ID NO: 272506 - DNA, 30 bp, Artificial Sequence
  Description of Artificial Sequence: Synthetic oligonucleotide
ggtagaagctgcggctttagatgtcacgac

SEQ ID NO: 272507 - DNA, 30 bp, Artificial Sequence
  Description of Artificial Sequence: Synthetic oligonucleotide
gtagaagctgcggctttagatgtcacgacc

SEQ ID NO: 272508 - DNA, 30 bp, Artificial Sequence
  Description of Artificial Sequence: Synthetic oligonucleotide
tagaagctgcggctttagatgtcacgaccc

SEQ ID NO: 272509 - DNA, 29 bp, Artificial Sequence
  Description of Artificial Sequence: Synthetic oligonucleotide
agaagctgcggctttagatgtcacgaccc

SEQ ID NO: 272510 - DNA, 28 bp, Artificial Sequence
  Description of Artificial Sequence: Synthetic oligonucleotide
gaagctgcggctttagatgtcacgaccc

SEQ ID NO: 272511 - DNA, 30 bp, Artificial Sequence
  Description of Artificial Sequence: Synthetic oligonucleotide
aagctgcggctttagatgtcacgacccttc

SEQ ID NO: 272512 - DNA, 29 bp, Artificial Sequence
  Description of Artificial Sequence: Synthetic oligonucleotide
agctgcggctttagatgtcacgacccttc

SEQ ID NO: 272513 - DNA, 28 bp, Artificial Sequence
  Description of Artificial Sequence: Synthetic oligonucleotide
gctgcggctttagatgtcacgacccttc

SEQ ID NO: 272514 - DNA, 28 bp, Artificial Sequence
  Description of Artificial Sequence: Synthetic oligonucleotide
ctgcggctttagatgtcacgacccttcc

SEQ ID NO: 272515 - DNA, 28 bp, Artificial Sequence
  Description of Artificial Sequence: Synthetic oligonucleotide
tgcggctttagatgtcacgacccttccc

SEQ ID NO: 272516 - DNA, 27 bp, Artificial Sequence
  Description of Artificial Sequence: Synthetic oligonucleotide
gcggctttagatgtcacgacccttccc

SEQ ID NO: 272517 - DNA, 28 bp, Artificial Sequence
  Description of Artificial Sequence: Synthetic oligonucleotide
cggctttagatgtcacgacccttcccac

SEQ ID NO: 272518 - DNA, 28 bp, Artificial Sequence
  Description of Artificial Sequence: Synthetic oligonucleotide
ggctttagatgtcacgacccttcccacc

SEQ ID NO: 272519 - DNA, 28 bp, Artificial Sequence
  Description of Artificial Sequence: Synthetic oligonucleotide
gctttagatgtcacgacccttcccaccc

SEQ ID NO: 272520 - DNA, 28 bp, Artificial Sequence
  Description of Artificial Sequence: Synthetic oligonucleotide
ctttagatgtcacgacccttcccacccc

SEQ ID NO: 272521 - DNA, 29 bp, Artificial Sequence
  Description of Artificial Sequence: Synthetic oligonucleotide
tttagatgtcacgacccttcccacccctc

SEQ ID NO: 272522 - DNA, 28 bp, Artificial Sequence
  Description of Artificial Sequence: Synthetic oligonucleotide
ttagatgtcacgacccttcccacccctc

SEQ ID NO: 272523 - DNA, 27 bp, Artificial Sequence
  Description of Artificial Sequence: Synthetic oligonucleotide
tagatgtcacgacccttcccacccctc

SEQ ID NO: 272524 - DNA, 27 bp, Artificial Sequence
  Description of Artificial Sequence: Synthetic oligonucleotide
agatgtcacgacccttcccacccctct

SEQ ID NO: 272525 - DNA, 27 bp, Artificial Sequence
  Description of Artificial Sequence: Synthetic oligonucleotide
gatgtcacgacccttcccacccctctt

SEQ ID NO: 272526 - DNA, 28 bp, Artificial Sequence
  Description of Artificial Sequence: Synthetic oligonucleotide
atgtcacgacccttcccacccctctttc

SEQ ID NO: 272527 - DNA, 27 bp, Artificial Sequence
  Description of Artificial Sequence: Synthetic oligonucleotide
tgtcacgacccttcccacccctctttc

SEQ ID NO: 272528 - DNA, 26 bp, Artificial Sequence
  Description of Artificial Sequence: Synthetic oligonucleotide
gtcacgacccttcccacccctctttc

SEQ ID NO: 272529 - DNA, 27 bp, Artificial Sequence
  Description of Artificial Sequence: Synthetic oligonucleotide
tcacgacccttcccacccctctttcca

SEQ ID NO: 272530 - DNA, 26 bp, Artificial Sequence
  Description of Artificial Sequence: Synthetic oligonucleotide
cacgacccttcccacccctctttcca

SEQ ID NO: 272531 - DNA, 26 bp, Artificial Sequence
  Description of Artificial Sequence: Synthetic oligonucleotide
acgacccttcccacccctctttccag

SEQ ID NO: 272532 - DNA, 25 bp, Artificial Sequence
  Description of Artificial Sequence: Synthetic oligonucleotide
cgacccttcccacccctctttccag

SEQ ID NO: 272533 - DNA, 25 bp, Artificial Sequence
  Description of Artificial Sequence: Synthetic oligonucleotide
gacccttcccacccctctttccagc

SEQ ID NO: 272534 - DNA, 25 bp, Artificial Sequence
  Description of Artificial Sequence: Synthetic oligonucleotide
acccttcccacccctctttccagcg

SEQ ID NO: 272535 - DNA, 24 bp, Artificial Sequence
  Description of Artificial Sequence: Synthetic oligonucleotide
cccttcccacccctctttccagcg

SEQ ID NO: 272536 - DNA, 26 bp, Artificial Sequence
  Description of Artificial Sequence: Synthetic oligonucleotide
ccttcccacccctctttccagcgcat

SEQ ID NO: 272537 - DNA, 26 bp, Artificial Sequence
  Description of Artificial Sequence: Synthetic oligonucleotide
cttcccacccctctttccagcgcatg

SEQ ID NO: 272538 - DNA, 26 bp, Artificial Sequence
  Description of Artificial Sequence: Synthetic oligonucleotide
ttcccacccctctttccagcgcatgc

SEQ ID NO: 272539 - DNA, 25 bp, Artificial Sequence
  Description of Artificial Sequence: Synthetic oligonucleotide
tcccacccctctttccagcgcatgc

SEQ ID NO: 272540 - DNA, 24 bp, Artificial Sequence
  Description of Artificial Sequence: Synthetic oligonucleotide
cccacccctctttccagcgcatgc

SEQ ID NO: 272541 - DNA, 24 bp, Artificial Sequence
  Description of Artificial Sequence: Synthetic oligonucleotide
ccacccctctttccagcgcatgcc

SEQ ID NO: 272542 - DNA, 24 bp, Artificial Sequence
  Description of Artificial Sequence: Synthetic oligonucleotide
cacccctctttccagcgcatgccc

SEQ ID NO: 272543 - DNA, 24 bp, Artificial Sequence
  Description of Artificial Sequence: Synthetic oligonucleotide
acccctctttccagcgcatgcccg

SEQ ID NO: 272544 - DNA, 23 bp, Artificial Sequence
  Description of Artificial Sequence: Synthetic oligonucleotide
cccctctttccagcgcatgcccg

SEQ ID NO: 272545 - DNA, 23 bp, Artificial Sequence
  Description of Artificial Sequence: Synthetic oligonucleotide
ccctctttccagcgcatgcccgg

SEQ ID NO: 272546 - DNA, 23 bp, Artificial Sequence
  Description of Artificial Sequence: Synthetic oligonucleotide
cctctttccagcgcatgcccggc

SEQ ID NO: 272547 - DNA, 23 bp, Artificial Sequence
  Description of Artificial Sequence: Synthetic oligonucleotide
ctctttccagcgcatgcccggcc

SEQ ID NO: 272548 - DNA, 24 bp, Artificial Sequence
  Description of Artificial Sequence: Synthetic oligonucleotide
tctttccagcgcatgcccggccct

SEQ ID NO: 272549 - DNA, 23 bp, Artificial Sequence
  Description of Artificial Sequence: Synthetic oligonucleotide
ctttccagcgcatgcccggccct

SEQ ID NO: 272550 - DNA, 23 bp, Artificial Sequence
  Description of Artificial Sequence: Synthetic oligonucleotide
tttccagcgcatgcccggccctg

SEQ ID NO: 272551 - DNA, 22 bp, Artificial Sequence
  Description of Artificial Sequence: Synthetic oligonucleotide
ttccagcgcatgcccggccctg

SEQ ID NO: 272552 - DNA, 21 bp, Artificial Sequence
  Description of Artificial Sequence: Synthetic oligonucleotide
tccagcgcatgcccggccctg

SEQ ID NO: 272553 - DNA, 20 bp, Artificial Sequence
  Description of Artificial Sequence: Synthetic oligonucleotide
ccagcgcatgcccggccctg

SEQ ID NO: 272554 - DNA, 21 bp, Artificial Sequence
  Description of Artificial Sequence: Synthetic oligonucleotide
cagcgcatgcccggccctgga

SEQ ID NO: 272555 - DNA, 21 bp, Artificial Sequence
  Description of Artificial Sequence: Synthetic oligonucleotide
agcgcatgcccggccctggag

SEQ ID NO: 272556 - DNA, 20 bp, Artificial Sequence
  Description of Artificial Sequence: Synthetic oligonucleotide
gcgcatgcccggccctggag

SEQ ID NO: 272557 - DNA, 20 bp, Artificial Sequence
  Description of Artificial Sequence: Synthetic oligonucleotide
cgcatgcccggccctggagc

SEQ ID NO: 272558 - DNA, 20 bp, Artificial Sequence
  Description of Artificial Sequence: Synthetic oligonucleotide
gcatgcccggccctggagcc

SEQ ID NO: 272559 - DNA, 21 bp, Artificial Sequence
  Description of Artificial Sequence: Synthetic oligonucleotide
catgcccggccctggagccct

SEQ ID NO: 272560 - DNA, 22 bp, Artificial Sequence
  Description of Artificial Sequence: Synthetic oligonucleotide
atgcccggccctggagccctca

SEQ ID NO: 272561 - DNA, 21 bp, Artificial Sequence
  Description of Artificial Sequence: Synthetic oligonucleotide
tgcccggccctggagccctca

SEQ ID NO: 272562 - DNA, 20 bp, Artificial Sequence
  Description of Artificial Sequence: Synthetic oligonucleotide
gcccggccctggagccctca

SEQ ID NO: 272563 - DNA, 24 bp, Artificial Sequence
  Description of Artificial Sequence: Synthetic oligonucleotide
cccggccctggagccctcagaatt

SEQ ID NO: 272564 - DNA, 26 bp, Artificial Sequence
  Description of Artificial Sequence: Synthetic oligonucleotide
ccggccctggagccctcagaattcta

SEQ ID NO: 272565 - DNA, 26 bp, Artificial Sequence
  Description of Artificial Sequence: Synthetic oligonucleotide
cggccctggagccctcagaattctac

SEQ ID NO: 272566 - DNA, 27 bp, Artificial Sequence
  Description of Artificial Sequence: Synthetic oligonucleotide
ggccctggagccctcagaattctacca

SEQ ID NO: 272567 - DNA, 27 bp, Artificial Sequence
  Description of Artificial Sequence: Synthetic oligonucleotide
gccctggagccctcagaattctaccag

SEQ ID NO: 272568 - DNA, 28 bp, Artificial Sequence
  Description of Artificial Sequence: Synthetic oligonucleotide
ccctggagccctcagaattctaccagtc

SEQ ID NO: 272569 - DNA, 28 bp, Artificial Sequence
  Description of Artificial Sequence: Synthetic oligonucleotide
cctggagccctcagaattctaccagtcc

SEQ ID NO: 272570 - DNA, 28 bp, Artificial Sequence
  Description of Artificial Sequence: Synthetic oligonucleotide
ctggagccctcagaattctaccagtccc

SEQ ID NO: 272571 - DNA, 29 bp, Artificial Sequence
  Description of Artificial Sequence: Synthetic oligonucleotide
tggagccctcagaattctaccagtccctc

SEQ ID NO: 272572 - DNA, 28 bp, Artificial Sequence
  Description of Artificial Sequence: Synthetic oligonucleotide
ggagccctcagaattctaccagtccctc

SEQ ID NO: 272573 - DNA, 28 bp, Artificial Sequence
  Description of Artificial Sequence: Synthetic oligonucleotide
gagccctcagaattctaccagtccctcg

SEQ ID NO: 272574 - DNA, 28 bp, Artificial Sequence
  Description of Artificial Sequence: Synthetic oligonucleotide
agccctcagaattctaccagtccctcgg

SEQ ID NO: 272575 - DNA, 27 bp, Artificial Sequence
  Description of Artificial Sequence: Synthetic oligonucleotide
gccctcagaattctaccagtccctcgg

SEQ ID NO: 272576 - DNA, 28 bp, Artificial Sequence
  Description of Artificial Sequence: Synthetic oligonucleotide
ccctcagaattctaccagtccctcggtg

SEQ ID NO: 272577 - DNA, 28 bp, Artificial Sequence
  Description of Artificial Sequence: Synthetic oligonucleotide
cctcagaattctaccagtccctcggtgg

SEQ ID NO: 272578 - DNA, 28 bp, Artificial Sequence
  Description of Artificial Sequence: Synthetic oligonucleotide
ctcagaattctaccagtccctcggtggg

SEQ ID NO: 272579 - DNA, 28 bp, Artificial Sequence
  Description of Artificial Sequence: Synthetic oligonucleotide
tcagaattctaccagtccctcggtgggg

SEQ ID NO: 272580 - DNA, 27 bp, Artificial Sequence
  Description of Artificial Sequence: Synthetic oligonucleotide
cagaattctaccagtccctcggtgggg

SEQ ID NO: 272581 - DNA, 28 bp, Artificial Sequence
  Description of Artificial Sequence: Synthetic oligonucleotide
agaattctaccagtccctcggtggggac

SEQ ID NO: 272582 - DNA, 27 bp, Artificial Sequence
  Description of Artificial Sequence: Synthetic oligonucleotide
gaattctaccagtccctcggtggggac

SEQ ID NO: 272583 - DNA, 27 bp, Artificial Sequence
  Description of Artificial Sequence: Synthetic oligonucleotide
aattctaccagtccctcggtggggacc

SEQ ID NO: 272584 - DNA, 26 bp, Artificial Sequence
  Description of Artificial Sequence: Synthetic oligonucleotide
attctaccagtccctcggtggggacc

SEQ ID NO: 272585 - DNA, 25 bp, Artificial Sequence
  Description of Artificial Sequence: Synthetic oligonucleotide
ttctaccagtccctcggtggggacc

SEQ ID NO: 272586 - DNA, 24 bp, Artificial Sequence
  Description of Artificial Sequence: Synthetic oligonucleotide
tctaccagtccctcggtggggacc

SEQ ID NO: 272587 - DNA, 23 bp, Artificial Sequence
  Description of Artificial Sequence: Synthetic oligonucleotide
ctaccagtccctcggtggggacc

SEQ ID NO: 272588 - DNA, 24 bp, Artificial Sequence
  Description of Artificial Sequence: Synthetic oligonucleotide
taccagtccctcggtggggaccga

SEQ ID NO: 272589 - DNA, 23 bp, Artificial Sequence
  Description of Artificial Sequence: Synthetic oligonucleotide
accagtccctcggtggggaccga

SEQ ID NO: 272590 - DNA, 22 bp, Artificial Sequence
  Description of Artificial Sequence: Synthetic oligonucleotide
ccagtccctcggtggggaccga

SEQ ID NO: 272591 - DNA, 25 bp, Artificial Sequence
  Description of Artificial Sequence: Synthetic oligonucleotide
cagtccctcggtggggaccgagaaa

SEQ ID NO: 272592 - DNA, 25 bp, Artificial Sequence
  Description of Artificial Sequence: Synthetic oligonucleotide
agtccctcggtggggaccgagaaag

SEQ ID NO: 272593 - DNA, 24 bp, Artificial Sequence
  Description of Artificial Sequence: Synthetic oligonucleotide
gtccctcggtggggaccgagaaag

SEQ ID NO: 272594 - DNA, 26 bp, Artificial Sequence
  Description of Artificial Sequence: Synthetic oligonucleotide
tccctcggtggggaccgagaaaggat

SEQ ID NO: 272595 - DNA, 25 bp, Artificial Sequence
  Description of Artificial Sequence: Synthetic oligonucleotide
ccctcggtggggaccgagaaaggat

SEQ ID NO: 272596 - DNA, 25 bp, Artificial Sequence
  Description of Artificial Sequence: Synthetic oligonucleotide
cctcggtggggaccgagaaaggatc

SEQ ID NO: 272597 - DNA, 27 bp, Artificial Sequence
  Description of Artificial Sequence: Synthetic oligonucleotide
ctcggtggggaccgagaaaggatcgtt

SEQ ID NO: 272598 - DNA, 27 bp, Artificial Sequence
  Description of Artificial Sequence: Synthetic oligonucleotide
tcggtggggaccgagaaaggatcgttc

SEQ ID NO: 272599 - DNA, 27 bp, Artificial Sequence
  Description of Artificial Sequence: Synthetic oligonucleotide
cggtggggaccgagaaaggatcgttca

SEQ ID NO: 272600 - DNA, 27 bp, Artificial Sequence
  Description of Artificial Sequence: Synthetic oligonucleotide
ggtggggaccgagaaaggatcgttcag

SEQ ID NO: 272601 - DNA, 30 bp, Artificial Sequence
  Description of Artificial Sequence: Synthetic oligonucleotide
gtggggaccgagaaaggatcgttcagatag

SEQ ID NO: 272602 - DNA, 31 bp, Artificial Sequence
  Description of Artificial Sequence: Synthetic oligonucleotide
tggggaccgagaaaggatcgttcagatagag

SEQ ID NO: 272603 - DNA, 30 bp, Artificial Sequence
  Description of Artificial Sequence: Synthetic oligonucleotide
ggggaccgagaaaggatcgttcagatagag

SEQ ID NO: 272604 - DNA, 32 bp, Artificial Sequence
  Description of Artificial Sequence: Synthetic oligonucleotide
gggaccgagaaaggatcgttcagatagagatg

SEQ ID NO: 272605 - DNA, 32 bp, Artificial Sequence
  Description of Artificial Sequence: Synthetic oligonucleotide
ggaccgagaaaggatcgttcagatagagatgg

SEQ ID NO: 272606 - DNA, 32 bp, Artificial Sequence
  Description of Artificial Sequence: Synthetic oligonucleotide
gaccgagaaaggatcgttcagatagagatggc

SEQ ID NO: 272607 - DNA, 32 bp, Artificial Sequence
  Description of Artificial Sequence: Synthetic oligonucleotide
accgagaaaggatcgttcagatagagatggcc

SEQ ID NO: 272608 - DNA, 31 bp, Artificial Sequence
  Description of Artificial Sequence: Synthetic oligonucleotide
ccgagaaaggatcgttcagatagagatggcc

SEQ ID NO: 272609 - DNA, 31 bp, Artificial Sequence
  Description of Artificial Sequence: Synthetic oligonucleotide
cgagaaaggatcgttcagatagagatggccg

SEQ ID NO: 272610 - DNA, 33 bp, Artificial Sequence
  Description of Artificial Sequence: Synthetic oligonucleotide
gagaaaggatcgttcagatagagatggccgatg

SEQ ID NO: 272611 - DNA, 33 bp, Artificial Sequence
  Description of Artificial Sequence: Synthetic oligonucleotide
agaaaggatcgttcagatagagatggccgatgg

SEQ ID NO: 272612 - DNA, 32 bp, Artificial Sequence
  Description of Artificial Sequence: Synthetic oligonucleotide
gaaaggatcgttcagatagagatggccgatgg

SEQ ID NO: 272613 - DNA, 32 bp, Artificial Sequence
  Description of Artificial Sequence: Synthetic oligonucleotide
aaaggatcgttcagatagagatggccgatggc

SEQ ID NO: 272614 - DNA, 31 bp, Artificial Sequence
  Description of Artificial Sequence: Synthetic oligonucleotide
aaggatcgttcagatagagatggccgatggc

SEQ ID NO: 272615 - DNA, 30 bp, Artificial Sequence
  Description of Artificial Sequence: Synthetic oligonucleotide
aggatcgttcagatagagatggccgatggc

SEQ ID NO: 272616 - DNA, 29 bp, Artificial Sequence
  Description of Artificial Sequence: Synthetic oligonucleotide
ggatcgttcagatagagatggccgatggc

SEQ ID NO: 272617 - DNA, 30 bp, Artificial Sequence
  Description of Artificial Sequence: Synthetic oligonucleotide
gatcgttcagatagagatggccgatggcac

SEQ ID NO: 272618 - DNA, 30 bp, Artificial Sequence
  Description of Artificial Sequence: Synthetic oligonucleotide
atcgttcagatagagatggccgatggcacc

SEQ ID NO: 272619 - DNA, 29 bp, Artificial Sequence
  Description of Artificial Sequence: Synthetic oligonucleotide
tcgttcagatagagatggccgatggcacc

SEQ ID NO: 272620 - DNA, 28 bp, Artificial Sequence
  Description of Artificial Sequence: Synthetic oligonucleotide
cgttcagatagagatggccgatggcacc

SEQ ID NO: 272621 - DNA, 29 bp, Artificial Sequence
  Description of Artificial Sequence: Synthetic oligonucleotide
gttcagatagagatggccgatggcaccag

SEQ ID NO: 272622 - DNA, 29 bp, Artificial Sequence
  Description of Artificial Sequence: Synthetic oligonucleotide
ttcagatagagatggccgatggcaccagc

SEQ ID NO: 272623 - DNA, 28 bp, Artificial Sequence
  Description of Artificial Sequence: Synthetic oligonucleotide
tcagatagagatggccgatggcaccagc

SEQ ID NO: 272624 - DNA, 27 bp, Artificial Sequence
  Description of Artificial Sequence: Synthetic oligonucleotide
cagatagagatggccgatggcaccagc

SEQ ID NO: 272625 - DNA, 28 bp, Artificial Sequence
  Description of Artificial Sequence: Synthetic oligonucleotide
agatagagatggccgatggcaccagcac

SEQ ID NO: 272626 - DNA, 27 bp, Artificial Sequence
  Description of Artificial Sequence: Synthetic oligonucleotide
gatagagatggccgatggcaccagcac

SEQ ID NO: 272627 - DNA, 27 bp, Artificial Sequence
  Description of Artificial Sequence: Synthetic oligonucleotide
atagagatggccgatggcaccagcacg

SEQ ID NO: 272628 - DNA, 26 bp, Artificial Sequence
  Description of Artificial Sequence: Synthetic oligonucleotide
tagagatggccgatggcaccagcacg

SEQ ID NO: 272629 - DNA, 25 bp, Artificial Sequence
  Description of Artificial Sequence: Synthetic oligonucleotide
agagatggccgatggcaccagcacg

SEQ ID NO: 272630 - DNA, 24 bp, Artificial Sequence
  Description of Artificial Sequence: Synthetic oligonucleotide
gagatggccgatggcaccagcacg

SEQ ID NO: 272631 - DNA, 25 bp, Artificial Sequence
  Description of Artificial Sequence: Synthetic oligonucleotide
agatggccgatggcaccagcacgct

SEQ ID NO: 272632 - DNA, 24 bp, Artificial Sequence
  Description of Artificial Sequence: Synthetic oligonucleotide
gatggccgatggcaccagcacgct

SEQ ID NO: 272633 - DNA, 24 bp, Artificial Sequence
  Description of Artificial Sequence: Synthetic oligonucleotide
atggccgatggcaccagcacgctc

SEQ ID NO: 272634 - DNA, 23 bp, Artificial Sequence
  Description of Artificial Sequence: Synthetic oligonucleotide
tggccgatggcaccagcacgctc

SEQ ID NO: 272635 - DNA, 22 bp, Artificial Sequence
  Description of Artificial Sequence: Synthetic oligonucleotide
ggccgatggcaccagcacgctc

SEQ ID NO: 272636 - DNA, 22 bp, Artificial Sequence
  Description of Artificial Sequence: Synthetic oligonucleotide
gccgatggcaccagcacgctcg

SEQ ID NO: 272637 - DNA, 22 bp, Artificial Sequence
  Description of Artificial Sequence: Synthetic oligonucleotide
ccgatggcaccagcacgctcgc

SEQ ID NO: 272638 - DNA, 24 bp, Artificial Sequence
  Description of Artificial Sequence: Synthetic oligonucleotide
cgatggcaccagcacgctcgcgtt

SEQ ID NO: 272639 - DNA, 26 bp, Artificial Sequence
  Description of Artificial Sequence: Synthetic oligonucleotide
gatggcaccagcacgctcgcgttcaa

SEQ ID NO: 272640 - DNA, 27 bp, Artificial Sequence
  Description of Artificial Sequence: Synthetic oligonucleotide
atggcaccagcacgctcgcgttcaagt

SEQ ID NO: 272641 - DNA, 27 bp, Artificial Sequence
  Description of Artificial Sequence: Synthetic oligonucleotide
tggcaccagcacgctcgcgttcaagtt

SEQ ID NO: 272642 - DNA, 26 bp, Artificial Sequence
  Description of Artificial Sequence: Synthetic oligonucleotide
ggcaccagcacgctcgcgttcaagtt

SEQ ID NO: 272643 - DNA, 26 bp, Artificial Sequence
  Description of Artificial Sequence: Synthetic oligonucleotide
gcaccagcacgctcgcgttcaagttc

SEQ ID NO: 272644 - DNA, 27 bp, Artificial Sequence
  Description of Artificial Sequence: Synthetic oligonucleotide
caccagcacgctcgcgttcaagttcga

SEQ ID NO: 272645 - DNA, 27 bp, Artificial Sequence
  Description of Artificial Sequence: Synthetic oligonucleotide
accagcacgctcgcgttcaagttcgag

SEQ ID NO: 272646 - DNA, 26 bp, Artificial Sequence
  Description of Artificial Sequence: Synthetic oligonucleotide
ccagcacgctcgcgttcaagttcgag

SEQ ID NO: 272647 - DNA, 27 bp, Artificial Sequence
  Description of Artificial Sequence: Synthetic oligonucleotide
cagcacgctcgcgttcaagttcgagca

SEQ ID NO: 272648 - DNA, 28 bp, Artificial Sequence
  Description of Artificial Sequence: Synthetic oligonucleotide
agcacgctcgcgttcaagttcgagcatg

SEQ ID NO: 272649 - DNA, 27 bp, Artificial Sequence
  Description of Artificial Sequence: Synthetic oligonucleotide
gcacgctcgcgttcaagttcgagcatg

SEQ ID NO: 272650 - DNA, 27 bp, Artificial Sequence
  Description of Artificial Sequence: Synthetic oligonucleotide
cacgctcgcgttcaagttcgagcatgg

SEQ ID NO: 272651 - DNA, 28 bp, Artificial Sequence
  Description of Artificial Sequence: Synthetic oligonucleotide
acgctcgcgttcaagttcgagcatggag

SEQ ID NO: 272652 - DNA, 27 bp, Artificial Sequence
  Description of Artificial Sequence: Synthetic oligonucleotide
cgctcgcgttcaagttcgagcatggag

SEQ ID NO: 272653 - DNA, 28 bp, Artificial Sequence
  Description of Artificial Sequence: Synthetic oligonucleotide
gctcgcgttcaagttcgagcatggagag

SEQ ID NO: 272654 - DNA, 31 bp, Artificial Sequence
  Description of Artificial Sequence: Synthetic oligonucleotide
ctcgcgttcaagttcgagcatggagagattg

SEQ ID NO: 272655 - DNA, 31 bp, Artificial Sequence
  Description of Artificial Sequence: Synthetic oligonucleotide
tcgcgttcaagttcgagcatggagagattgc

SEQ ID NO: 272656 - DNA, 30 bp, Artificial Sequence
  Description of Artificial Sequence: Synthetic oligonucleotide
cgcgttcaagttcgagcatggagagattgc

SEQ ID NO: 272657 - DNA, 31 bp, Artificial Sequence
  Description of Artificial Sequence: Synthetic oligonucleotide
gcgttcaagttcgagcatggagagattgcag

SEQ ID NO: 272658 - DNA, 31 bp, Artificial Sequence
  Description of Artificial Sequence: Synthetic oligonucleotide
cgttcaagttcgagcatggagagattgcagc

SEQ ID NO: 272659 - DNA, 32 bp, Artificial Sequence
  Description of Artificial Sequence: Synthetic oligonucleotide
gttcaagttcgagcatggagagattgcagctg

SEQ ID NO: 272660 - DNA, 33 bp, Artificial Sequence
  Description of Artificial Sequence: Synthetic oligonucleotide
ttcaagttcgagcatggagagattgcagctgtg

SEQ ID NO: 272661 - DNA, 32 bp, Artificial Sequence
  Description of Artificial Sequence: Synthetic oligonucleotide
tcaagttcgagcatggagagattgcagctgtg

SEQ ID NO: 272662 - DNA, 31 bp, Artificial Sequence
  Description of Artificial Sequence: Synthetic oligonucleotide
caagttcgagcatggagagattgcagctgtg

SEQ ID NO: 272663 - DNA, 31 bp, Artificial Sequence
  Description of Artificial Sequence: Synthetic oligonucleotide
aagttcgagcatggagagattgcagctgtgg

SEQ ID NO: 272664 - DNA, 30 bp, Artificial Sequence
  Description of Artificial Sequence: Synthetic oligonucleotide
agttcgagcatggagagattgcagctgtgg

SEQ ID NO: 272665 - DNA, 29 bp, Artificial Sequence
  Description of Artificial Sequence: Synthetic oligonucleotide
gttcgagcatggagagattgcagctgtgg

SEQ ID NO: 272666 - DNA, 32 bp, Artificial Sequence
  Description of Artificial Sequence: Synthetic oligonucleotide
ttcgagcatggagagattgcagctgtggattc

SEQ ID NO: 272667 - DNA, 31 bp, Artificial Sequence
  Description of Artificial Sequence: Synthetic oligonucleotide
tcgagcatggagagattgcagctgtggattc

SEQ ID NO: 272668 - DNA, 30 bp, Artificial Sequence
  Description of Artificial Sequence: Synthetic oligonucleotide
cgagcatggagagattgcagctgtggattc

SEQ ID NO: 272669 - DNA, 31 bp, Artificial Sequence
  Description of Artificial Sequence: Synthetic oligonucleotide
gagcatggagagattgcagctgtggattctg

SEQ ID NO: 272670 - DNA, 31 bp, Artificial Sequence
  Description of Artificial Sequence: Synthetic oligonucleotide
agcatggagagattgcagctgtggattctgg

SEQ ID NO: 272671 - DNA, 30 bp, Artificial Sequence
  Description of Artificial Sequence: Synthetic oligonucleotide
gcatggagagattgcagctgtggattctgg

SEQ ID NO: 272672 - DNA, 30 bp, Artificial Sequence
  Description of Artificial Sequence: Synthetic oligonucleotide
catggagagattgcagctgtggattctggg

SEQ ID NO: 272673 - DNA, 30 bp, Artificial Sequence
  Description of Artificial Sequence: Synthetic oligonucleotide
atggagagattgcagctgtggattctgggg

SEQ ID NO: 272674 - DNA, 29 bp, Artificial Sequence
  Description of Artificial Sequence: Synthetic oligonucleotide
tggagagattgcagctgtggattctgggg

SEQ ID NO: 272675 - DNA, 28 bp, Artificial Sequence
  Description of Artificial Sequence: Synthetic oligonucleotide
ggagagattgcagctgtggattctgggg

SEQ ID NO: 272676 - DNA, 28 bp, Artificial Sequence
  Description of Artificial Sequence: Synthetic oligonucleotide
gagagattgcagctgtggattctggggc

SEQ ID NO: 272677 - DNA, 28 bp, Artificial Sequence
  Description of Artificial Sequence: Synthetic oligonucleotide
agagattgcagctgtggattctggggcc

SEQ ID NO: 272678 - DNA, 27 bp, Artificial Sequence
  Description of Artificial Sequence: Synthetic oligonucleotide
gagattgcagctgtggattctggggcc

SEQ ID NO: 272679 - DNA, 28 bp, Artificial Sequence
  Description of Artificial Sequence: Synthetic oligonucleotide
agattgcagctgtggattctggggcctc

SEQ ID NO: 272680 - DNA, 27 bp, Artificial Sequence
  Description of Artificial Sequence: Synthetic oligonucleotide
gattgcagctgtggattctggggcctc

SEQ ID NO: 272681 - DNA, 28 bp, Artificial Sequence
  Description of Artificial Sequence: Synthetic oligonucleotide
attgcagctgtggattctggggcctcag

SEQ ID NO: 272682 - DNA, 27 bp, Artificial Sequence
  Description of Artificial Sequence: Synthetic oligonucleotide
ttgcagctgtggattctggggcctcag

SEQ ID NO: 272683 - DNA, 26 bp, Artificial Sequence
  Description of Artificial Sequence: Synthetic oligonucleotide
tgcagctgtggattctggggcctcag

SEQ ID NO: 272684 - DNA, 25 bp, Artificial Sequence
  Description of Artificial Sequence: Synthetic oligonucleotide
gcagctgtggattctggggcctcag

SEQ ID NO: 272685 - DNA, 26 bp, Artificial Sequence
  Description of Artificial Sequence: Synthetic oligonucleotide
cagctgtggattctggggcctcaggt

SEQ ID NO: 272686 - DNA, 26 bp, Artificial Sequence
  Description of Artificial Sequence: Synthetic oligonucleotide
agctgtggattctggggcctcaggtg

SEQ ID NO: 272687 - DNA, 25 bp, Artificial Sequence
  Description of Artificial Sequence: Synthetic oligonucleotide
gctgtggattctggggcctcaggtg

SEQ ID NO: 272688 - DNA, 25 bp, Artificial Sequence
  Description of Artificial Sequence: Synthetic oligonucleotide
ctgtggattctggggcctcaggtgg

SEQ ID NO: 272689 - DNA, 26 bp, Artificial Sequence
  Description of Artificial Sequence: Synthetic oligonucleotide
tgtggattctggggcctcaggtgggt

SEQ ID NO: 272690 - DNA, 25 bp, Artificial Sequence
  Description of Artificial Sequence: Synthetic oligonucleotide
gtggattctggggcctcaggtgggt

SEQ ID NO: 272691 - DNA, 25 bp, Artificial Sequence
  Description of Artificial Sequence: Synthetic oligonucleotide
tggattctggggcctcaggtgggtc

SEQ ID NO: 272692 - DNA, 24 bp, Artificial Sequence
  Description of Artificial Sequence: Synthetic oligonucleotide
ggattctggggcctcaggtgggtc

SEQ ID NO: 272693 - DNA, 26 bp, Artificial Sequence
  Description of Artificial Sequence: Synthetic oligonucleotide
gattctggggcctcaggtgggtccta

SEQ ID NO: 272694 - DNA, 27 bp, Artificial Sequence
  Description of Artificial Sequence: Synthetic oligonucleotide
attctggggcctcaggtgggtcctaga

SEQ ID NO: 272695 - DNA, 27 bp, Artificial Sequence
  Description of Artificial Sequence: Synthetic oligonucleotide
ttctggggcctcaggtgggtcctagat

SEQ ID NO: 272696 - DNA, 27 bp, Artificial Sequence
  Description of Artificial Sequence: Synthetic oligonucleotide
tctggggcctcaggtgggtcctagatt

SEQ ID NO: 272697 - DNA, 27 bp, Artificial Sequence
  Description of Artificial Sequence: Synthetic oligonucleotide
ctggggcctcaggtgggtcctagatta

SEQ ID NO: 272698 - DNA, 27 bp, Artificial Sequence
  Description of Artificial Sequence: Synthetic oligonucleotide
tggggcctcaggtgggtcctagattag

SEQ ID NO: 272699 - DNA, 27 bp, Artificial Sequence
  Description of Artificial Sequence: Synthetic oligonucleotide
ggggcctcaggtgggtcctagattagt

SEQ ID NO: 272700 - DNA, 27 bp, Artificial Sequence
  Description of Artificial Sequence: Synthetic oligonucleotide
gggcctcaggtgggtcctagattagtg

SEQ ID NO: 272701 - DNA, 27 bp, Artificial Sequence
  Description of Artificial Sequence: Synthetic oligonucleotide
ggcctcaggtgggtcctagattagtgc

SEQ ID NO: 272702 - DNA, 27 bp, Artificial Sequence
  Description of Artificial Sequence: Synthetic oligonucleotide
gcctcaggtgggtcctagattagtgcc

SEQ ID NO: 272703 - DNA, 30 bp, Artificial Sequence
  Description of Artificial Sequence: Synthetic oligonucleotide
cctcaggtgggtcctagattagtgccatac

SEQ ID NO: 272704 - DNA, 30 bp, Artificial Sequence
  Description of Artificial Sequence: Synthetic oligonucleotide
ctcaggtgggtcctagattagtgccatacg

SEQ ID NO: 272705 - DNA, 30 bp, Artificial Sequence
  Description of Artificial Sequence: Synthetic oligonucleotide
tcaggtgggtcctagattagtgccatacgg

SEQ ID NO: 272706 - DNA, 29 bp, Artificial Sequence
  Description of Artificial Sequence: Synthetic oligonucleotide
caggtgggtcctagattagtgccatacgg

SEQ ID NO: 272707 - DNA, 29 bp, Artificial Sequence
  Description of Artificial Sequence: Synthetic oligonucleotide
aggtgggtcctagattagtgccatacggg

SEQ ID NO: 272708 - DNA, 28 bp, Artificial Sequence
  Description of Artificial Sequence: Synthetic oligonucleotide
ggtgggtcctagattagtgccatacggg

SEQ ID NO: 272709 - DNA, 29 bp, Artificial Sequence
  Description of Artificial Sequence: Synthetic oligonucleotide
gtgggtcctagattagtgccatacgggtg

SEQ ID NO: 272710 - DNA, 31 bp, Artificial Sequence
  Description of Artificial Sequence: Synthetic oligonucleotide
tgggtcctagattagtgccatacgggtgatc

SEQ ID NO: 272711 - DNA, 30 bp, Artificial Sequence
  Description of Artificial Sequence: Synthetic oligonucleotide
gggtcctagattagtgccatacgggtgatc

SEQ ID NO: 272712 - DNA, 32 bp, Artificial Sequence
  Description of Artificial Sequence: Synthetic oligonucleotide
ggtcctagattagtgccatacgggtgatcaag

SEQ ID NO: 272713 - DNA, 32 bp, Artificial Sequence
  Description of Artificial Sequence: Synthetic oligonucleotide
gtcctagattagtgccatacgggtgatcaagg

SEQ ID NO: 272714 - DNA, 33 bp, Artificial Sequence
  Description of Artificial Sequence: Synthetic oligonucleotide
tcctagattagtgccatacgggtgatcaaggtg

SEQ ID NO: 272715 - DNA, 32 bp, Artificial Sequence
  Description of Artificial Sequence: Synthetic oligonucleotide
cctagattagtgccatacgggtgatcaaggtg

SEQ ID NO: 272716 - DNA, 35 bp, Artificial Sequence
  Description of Artificial Sequence: Synthetic oligonucleotide
ctagattagtgccatacgggtgatcaaggtgatag

SEQ ID NO: 272717 - DNA, 36 bp, Artificial Sequence
  Description of Artificial Sequence: Synthetic oligonucleotide
tagattagtgccatacgggtgatcaaggtgatagag

SEQ ID NO: 272718 - DNA, 35 bp, Artificial Sequence
  Description of Artificial Sequence: Synthetic oligonucleotide
agattagtgccatacgggtgatcaaggtgatagag

SEQ ID NO: 272719 - DNA, 34 bp, Artificial Sequence
  Description of Artificial Sequence: Synthetic oligonucleotide
gattagtgccatacgggtgatcaaggtgatagag

SEQ ID NO: 272720 - DNA, 39 bp, Artificial Sequence
  Description of Artificial Sequence: Synthetic oligonucleotide
attagtgccatacgggtgatcaaggtgatagagattaac

SEQ ID NO: 272721 - DNA, 38 bp, Artificial Sequence
  Description of Artificial Sequence: Synthetic oligonucleotide
ttagtgccatacgggtgatcaaggtgatagagattaac

SEQ ID NO: 272722 - DNA, 37 bp, Artificial Sequence
  Description of Artificial Sequence: Synthetic oligonucleotide
tagtgccatacgggtgatcaaggtgatagagattaac

SEQ ID NO: 272723 - DNA, 36 bp, Artificial Sequence
  Description of Artificial Sequence: Synthetic oligonucleotide
agtgccatacgggtgatcaaggtgatagagattaac

SEQ ID NO: 272724 - DNA, 35 bp, Artificial Sequence
  Description of Artificial Sequence: Synthetic oligonucleotide
gtgccatacgggtgatcaaggtgatagagattaac

SEQ ID NO: 272725 - DNA, 35 bp, Artificial Sequence
  Description of Artificial Sequence: Synthetic oligonucleotide
tgccatacgggtgatcaaggtgatagagattaacg

SEQ ID NO: 272726 - DNA, 34 bp, Artificial Sequence
  Description of Artificial Sequence: Synthetic oligonucleotide
gccatacgggtgatcaaggtgatagagattaacg

SEQ ID NO: 272727 - DNA, 34 bp, Artificial Sequence
  Description of Artificial Sequence: Synthetic oligonucleotide
ccatacgggtgatcaaggtgatagagattaacgc

SEQ ID NO: 272728 - DNA, 37 bp, Artificial Sequence
  Description of Artificial Sequence: Synthetic oligonucleotide
catacgggtgatcaaggtgatagagattaacgcttac

SEQ ID NO: 272729 - DNA, 37 bp, Artificial Sequence
  Description of Artificial Sequence: Synthetic oligonucleotide
atacgggtgatcaaggtgatagagattaacgcttacc

SEQ ID NO: 272730 - DNA, 36 bp, Artificial Sequence
  Description of Artificial Sequence: Synthetic oligonucleotide
tacgggtgatcaaggtgatagagattaacgcttacc

SEQ ID NO: 272731 - DNA, 35 bp, Artificial Sequence
  Description of Artificial Sequence: Synthetic oligonucleotide
acgggtgatcaaggtgatagagattaacgcttacc

SEQ ID NO: 272732 - DNA, 34 bp, Artificial Sequence
  Description of Artificial Sequence: Synthetic oligonucleotide
cgggtgatcaaggtgatagagattaacgcttacc

SEQ ID NO: 272733 - DNA, 35 bp, Artificial Sequence
  Description of Artificial Sequence: Synthetic oligonucleotide
gggtgatcaaggtgatagagattaacgcttacctg

SEQ ID NO: 272734 - DNA, 35 bp, Artificial Sequence
  Description of Artificial Sequence: Synthetic oligonucleotide
ggtgatcaaggtgatagagattaacgcttacctgc

SEQ ID NO: 272735 - DNA, 37 bp, Artificial Sequence
  Description of Artificial Sequence: Synthetic oligonucleotide
gtgatcaaggtgatagagattaacgcttacctgcatg

SEQ ID NO: 272736 - DNA, 37 bp, Artificial Sequence
  Description of Artificial Sequence: Synthetic oligonucleotide
tgatcaaggtgatagagattaacgcttacctgcatgg

SEQ ID NO: 272737 - DNA, 36 bp, Artificial Sequence
  Description of Artificial Sequence: Synthetic oligonucleotide
gatcaaggtgatagagattaacgcttacctgcatgg

SEQ ID NO: 272738 - DNA, 36 bp, Artificial Sequence
  Description of Artificial Sequence: Synthetic oligonucleotide
atcaaggtgatagagattaacgcttacctgcatggc

SEQ ID NO: 272739 - DNA, 35 bp, Artificial Sequence
  Description of Artificial Sequence: Synthetic oligonucleotide
tcaaggtgatagagattaacgcttacctgcatggc

SEQ ID NO: 272740 - DNA, 34 bp, Artificial Sequence
  Description of Artificial Sequence: Synthetic oligonucleotide
caaggtgatagagattaacgcttacctgcatggc

SEQ ID NO: 272741 - DNA, 35 bp, Artificial Sequence
  Description of Artificial Sequence: Synthetic oligonucleotide
aaggtgatagagattaacgcttacctgcatggcac

SEQ ID NO: 272742 - DNA, 34 bp, Artificial Sequence
  Description of Artificial Sequence: Synthetic oligonucleotide
aggtgatagagattaacgcttacctgcatggcac

SEQ ID NO: 272743 - DNA, 33 bp, Artificial Sequence
  Description of Artificial Sequence: Synthetic oligonucleotide
ggtgatagagattaacgcttacctgcatggcac

SEQ ID NO: 272744 - DNA, 33 bp, Artificial Sequence
  Description of Artificial Sequence: Synthetic oligonucleotide
gtgatagagattaacgcttacctgcatggcacc

SEQ ID NO: 272745 - DNA, 35 bp, Artificial Sequence
  Description of Artificial Sequence: Synthetic oligonucleotide
tgatagagattaacgcttacctgcatggcaccatc

SEQ ID NO: 272746 - DNA, 34 bp, Artificial Sequence
  Description of Artificial Sequence: Synthetic oligonucleotide
gatagagattaacgcttacctgcatggcaccatc

SEQ ID NO: 272747 - DNA, 35 bp, Artificial Sequence
  Description of Artificial Sequence: Synthetic oligonucleotide
atagagattaacgcttacctgcatggcaccatctc

SEQ ID NO: 272748 - DNA, 34 bp, Artificial Sequence
  Description of Artificial Sequence: Synthetic oligonucleotide
tagagattaacgcttacctgcatggcaccatctc

SEQ ID NO: 272749 - DNA, 33 bp, Artificial Sequence
  Description of Artificial Sequence: Synthetic oligonucleotide
agagattaacgcttacctgcatggcaccatctc

SEQ ID NO: 272750 - DNA, 32 bp, Artificial Sequence
  Description of Artificial Sequence: Synthetic oligonucleotide
gagattaacgcttacctgcatggcaccatctc

SEQ ID NO: 272751 - DNA, 33 bp, Artificial Sequence
  Description of Artificial Sequence: Synthetic oligonucleotide
agattaacgcttacctgcatggcaccatctctg

SEQ ID NO: 272752 - DNA, 32 bp, Artificial Sequence
  Description of Artificial Sequence: Synthetic oligonucleotide
gattaacgcttacctgcatggcaccatctctg

SEQ ID NO: 272753 - DNA, 32 bp, Artificial Sequence
  Description of Artificial Sequence: Synthetic oligonucleotide
attaacgcttacctgcatggcaccatctctgg

SEQ ID NO: 272754 - DNA, 31 bp, Artificial Sequence
  Description of Artificial Sequence: Synthetic oligonucleotide
ttaacgcttacctgcatggcaccatctctgg

SEQ ID NO: 272755 - DNA, 30 bp, Artificial Sequence
  Description of Artificial Sequence: Synthetic oligonucleotide
taacgcttacctgcatggcaccatctctgg

SEQ ID NO: 272756 - DNA, 29 bp, Artificial Sequence
  Description of Artificial Sequence: Synthetic oligonucleotide
aacgcttacctgcatggcaccatctctgg

SEQ ID NO: 272757 - DNA, 28 bp, Artificial Sequence
  Description of Artificial Sequence: Synthetic oligonucleotide
acgcttacctgcatggcaccatctctgg

SEQ ID NO: 272758 - DNA, 27 bp, Artificial Sequence
  Description of Artificial Sequence: Synthetic oligonucleotide
cgcttacctgcatggcaccatctctgg

SEQ ID NO: 272759 - DNA, 27 bp, Artificial Sequence
  Description of Artificial Sequence: Synthetic oligonucleotide
gcttacctgcatggcaccatctctggc

SEQ ID NO: 272760 - DNA, 28 bp, Artificial Sequence
  Description of Artificial Sequence: Synthetic oligonucleotide
cttacctgcatggcaccatctctggctg

SEQ ID NO: 272761 - DNA, 29 bp, Artificial Sequence
  Description of Artificial Sequence: Synthetic oligonucleotide
ttacctgcatggcaccatctctggctgtc

SEQ ID NO: 272762 - DNA, 28 bp, Artificial Sequence
  Description of Artificial Sequence: Synthetic oligonucleotide
tacctgcatggcaccatctctggctgtc

SEQ ID NO: 272763 - DNA, 27 bp, Artificial Sequence
  Description of Artificial Sequence: Synthetic oligonucleotide
acctgcatggcaccatctctggctgtc

SEQ ID NO: 272764 - DNA, 26 bp, Artificial Sequence
  Description of Artificial Sequence: Synthetic oligonucleotide
cctgcatggcaccatctctggctgtc

SEQ ID NO: 272765 - DNA, 27 bp, Artificial Sequence
  Description of Artificial Sequence: Synthetic oligonucleotide
ctgcatggcaccatctctggctgtcca

SEQ ID NO: 272766 - DNA, 27 bp, Artificial Sequence
  Description of Artificial Sequence: Synthetic oligonucleotide
tgcatggcaccatctctggctgtccag

SEQ ID NO: 272767 - DNA, 26 bp, Artificial Sequence
  Description of Artificial Sequence: Synthetic oligonucleotide
gcatggcaccatctctggctgtccag

SEQ ID NO: 272768 - DNA, 27 bp, Artificial Sequence
  Description of Artificial Sequence: Synthetic oligonucleotide
catggcaccatctctggctgtccagca

SEQ ID NO: 272769 - DNA, 27 bp, Artificial Sequence
  Description of Artificial Sequence: Synthetic oligonucleotide
atggcaccatctctggctgtccagcag

SEQ ID NO: 272770 - DNA, 27 bp, Artificial Sequence
  Description of Artificial Sequence: Synthetic oligonucleotide
tggcaccatctctggctgtccagcaga

SEQ ID NO: 272771 - DNA, 26 bp, Artificial Sequence
  Description of Artificial Sequence: Synthetic oligonucleotide
ggcaccatctctggctgtccagcaga

SEQ ID NO: 272772 - DNA, 27 bp, Artificial Sequence
  Description of Artificial Sequence: Synthetic oligonucleotide
gcaccatctctggctgtccagcagact

SEQ ID NO: 272773 - DNA, 27 bp, Artificial Sequence
  Description of Artificial Sequence: Synthetic oligonucleotide
caccatctctggctgtccagcagactc

SEQ ID NO: 272774 - DNA, 28 bp, Artificial Sequence
  Description of Artificial Sequence: Synthetic oligonucleotide
accatctctggctgtccagcagactctc

SEQ ID NO: 272775 - DNA, 27 bp, Artificial Sequence
  Description of Artificial Sequence: Synthetic oligonucleotide
ccatctctggctgtccagcagactctc

SEQ ID NO: 272776 - DNA, 28 bp, Artificial Sequence
  Description of Artificial Sequence: Synthetic oligonucleotide
catctctggctgtccagcagactctcag

SEQ ID NO: 272777 - DNA, 30 bp, Artificial Sequence
  Description of Artificial Sequence: Synthetic oligonucleotide
atctctggctgtccagcagactctcagtac

SEQ ID NO: 272778 - DNA, 29 bp, Artificial Sequence
  Description of Artificial Sequence: Synthetic oligonucleotide
tctctggctgtccagcagactctcagtac

SEQ ID NO: 272779 - DNA, 28 bp, Artificial Sequence
  Description of Artificial Sequence: Synthetic oligonucleotide
ctctggctgtccagcagactctcagtac

SEQ ID NO: 272780 - DNA, 29 bp, Artificial Sequence
  Description of Artificial Sequence: Synthetic oligonucleotide
tctggctgtccagcagactctcagtactg

SEQ ID NO: 272781 - DNA, 28 bp, Artificial Sequence
  Description of Artificial Sequence: Synthetic oligonucleotide
ctggctgtccagcagactctcagtactg

SEQ ID NO: 272782 - DNA, 28 bp, Artificial Sequence
  Description of Artificial Sequence: Synthetic oligonucleotide
tggctgtccagcagactctcagtactgc

SEQ ID NO: 272783 - DNA, 27 bp, Artificial Sequence
  Description of Artificial Sequence: Synthetic oligonucleotide
ggctgtccagcagactctcagtactgc

SEQ ID NO: 272784 - DNA, 27 bp, Artificial Sequence
  Description of Artificial Sequence: Synthetic oligonucleotide
gctgtccagcagactctcagtactgcg

SEQ ID NO: 272785 - DNA, 28 bp, Artificial Sequence
  Description of Artificial Sequence: Synthetic oligonucleotide
ctgtccagcagactctcagtactgcgag

SEQ ID NO: 272786 - DNA, 28 bp, Artificial Sequence
  Description of Artificial Sequence: Synthetic oligonucleotide
tgtccagcagactctcagtactgcgagc

SEQ ID NO: 272787 - DNA, 27 bp, Artificial Sequence
  Description of Artificial Sequence: Synthetic oligonucleotide
gtccagcagactctcagtactgcgagc

SEQ ID NO: 272788 - DNA, 27 bp, Artificial Sequence
  Description of Artificial Sequence: Synthetic oligonucleotide
tccagcagactctcagtactgcgagcg

SEQ ID NO: 272789 - DNA, 26 bp, Artificial Sequence
  Description of Artificial Sequence: Synthetic oligonucleotide
ccagcagactctcagtactgcgagcg

SEQ ID NO: 272790 - DNA, 26 bp, Artificial Sequence
  Description of Artificial Sequence: Synthetic oligonucleotide
cagcagactctcagtactgcgagcgc

SEQ ID NO: 272791 - DNA, 27 bp, Artificial Sequence
  Description of Artificial Sequence: Synthetic oligonucleotide
agcagactctcagtactgcgagcgcct

SEQ ID NO: 272792 - DNA, 26 bp, Artificial Sequence
  Description of Artificial Sequence: Synthetic oligonucleotide
gcagactctcagtactgcgagcgcct

SEQ ID NO: 272793 - DNA, 26 bp, Artificial Sequence
  Description of Artificial Sequence: Synthetic oligonucleotide
cagactctcagtactgcgagcgcctg

SEQ ID NO: 272794 - DNA, 27 bp, Artificial Sequence
  Description of Artificial Sequence: Synthetic oligonucleotide
agactctcagtactgcgagcgcctggt

SEQ ID NO: 272795 - DNA, 26 bp, Artificial Sequence
  Description of Artificial Sequence: Synthetic oligonucleotide
gactctcagtactgcgagcgcctggt

SEQ ID NO: 272796 - DNA, 26 bp, Artificial Sequence
  Description of Artificial Sequence: Synthetic oligonucleotide
actctcagtactgcgagcgcctggtg

SEQ ID NO: 272797 - DNA, 25 bp, Artificial Sequence
  Description of Artificial Sequence: Synthetic oligonucleotide
ctctcagtactgcgagcgcctggtg

SEQ ID NO: 272798 - DNA, 25 bp, Artificial Sequence
  Description of Artificial Sequence: Synthetic oligonucleotide
tctcagtactgcgagcgcctggtgg

SEQ ID NO: 272799 - DNA, 24 bp, Artificial Sequence
  Description of Artificial Sequence: Synthetic oligonucleotide
ctcagtactgcgagcgcctggtgg

SEQ ID NO: 272800 - DNA, 24 bp, Artificial Sequence
  Description of Artificial Sequence: Synthetic oligonucleotide
tcagtactgcgagcgcctggtggc

SEQ ID NO: 272801 - DNA, 23 bp, Artificial Sequence
  Description of Artificial Sequence: Synthetic oligonucleotide
cagtactgcgagcgcctggtggc

SEQ ID NO: 272802 - DNA, 25 bp, Artificial Sequence
  Description of Artificial Sequence: Synthetic oligonucleotide
agtactgcgagcgcctggtggccaa

SEQ ID NO: 272803 - DNA, 24 bp, Artificial Sequence
  Description of Artificial Sequence: Synthetic oligonucleotide
gtactgcgagcgcctggtggccaa

SEQ ID NO: 272804 - DNA, 24 bp, Artificial Sequence
  Description of Artificial Sequence: Synthetic oligonucleotide
tactgcgagcgcctggtggccaag

SEQ ID NO: 272805 - DNA, 23 bp, Artificial Sequence
  Description of Artificial Sequence: Synthetic oligonucleotide
actgcgagcgcctggtggccaag

SEQ ID NO: 272806 - DNA, 22 bp, Artificial Sequence
  Description of Artificial Sequence: Synthetic oligonucleotide
ctgcgagcgcctggtggccaag

SEQ ID NO: 272807 - DNA, 25 bp, Artificial Sequence
  Description of Artificial Sequence: Synthetic oligonucleotide
tgcgagcgcctggtggccaaggtat

SEQ ID NO: 272808 - DNA, 24 bp, Artificial Sequence
  Description of Artificial Sequence: Synthetic oligonucleotide
gcgagcgcctggtggccaaggtat

SEQ ID NO: 272809 - DNA, 24 bp, Artificial Sequence
  Description of Artificial Sequence: Synthetic oligonucleotide
cgagcgcctggtggccaaggtatg

SEQ ID NO: 272810 - DNA, 25 bp, Artificial Sequence
  Description of Artificial Sequence: Synthetic oligonucleotide
gagcgcctggtggccaaggtatgca

SEQ ID NO: 272811 - DNA, 25 bp, Artificial Sequence
  Description of Artificial Sequence: Synthetic oligonucleotide
agcgcctggtggccaaggtatgcag

SEQ ID NO: 272812 - DNA, 24 bp, Artificial Sequence
  Description of Artificial Sequence: Synthetic oligonucleotide
gcgcctggtggccaaggtatgcag

SEQ ID NO: 272813 - DNA, 24 bp, Artificial Sequence
  Description of Artificial Sequence: Synthetic oligonucleotide
cgcctggtggccaaggtatgcagg

SEQ ID NO: 272814 - DNA, 25 bp, Artificial Sequence
  Description of Artificial Sequence: Synthetic oligonucleotide
gcctggtggccaaggtatgcaggct

SEQ ID NO: 272815 - DNA, 27 bp, Artificial Sequence
  Description of Artificial Sequence: Synthetic oligonucleotide
cctggtggccaaggtatgcaggctcta

SEQ ID NO: 272816 - DNA, 27 bp, Artificial Sequence
  Description of Artificial Sequence: Synthetic oligonucleotide
ctggtggccaaggtatgcaggctctac

SEQ ID NO: 272817 - DNA, 30 bp, Artificial Sequence
  Description of Artificial Sequence: Synthetic oligonucleotide
tggtggccaaggtatgcaggctctactatc

SEQ ID NO: 272818 - DNA, 29 bp, Artificial Sequence
  Description of Artificial Sequence: Synthetic oligonucleotide
ggtggccaaggtatgcaggctctactatc

SEQ ID NO: 272819 - DNA, 30 bp, Artificial Sequence
  Description of Artificial Sequence: Synthetic oligonucleotide
gtggccaaggtatgcaggctctactatctg

SEQ ID NO: 272820 - DNA, 30 bp, Artificial Sequence
  Description of Artificial Sequence: Synthetic oligonucleotide
tggccaaggtatgcaggctctactatctgg

SEQ ID NO: 272821 - DNA, 29 bp, Artificial Sequence
  Description of Artificial Sequence: Synthetic oligonucleotide
ggccaaggtatgcaggctctactatctgg

SEQ ID NO: 272822 - DNA, 29 bp, Artificial Sequence
  Description of Artificial Sequence: Synthetic oligonucleotide
gccaaggtatgcaggctctactatctggg

SEQ ID NO: 272823 - DNA, 33 bp, Artificial Sequence
  Description of Artificial Sequence: Synthetic oligonucleotide
ccaaggtatgcaggctctactatctgggaaatg

SEQ ID NO: 272824 - DNA, 33 bp, Artificial Sequence
  Description of Artificial Sequence: Synthetic oligonucleotide
caaggtatgcaggctctactatctgggaaatgg

SEQ ID NO: 272825 - DNA, 34 bp, Artificial Sequence
  Description of Artificial Sequence: Synthetic oligonucleotide
aaggtatgcaggctctactatctgggaaatggag

SEQ ID NO: 272826 - DNA, 33 bp, Artificial Sequence
  Description of Artificial Sequence: Synthetic oligonucleotide
aggtatgcaggctctactatctgggaaatggag

SEQ ID NO: 272827 - DNA, 32 bp, Artificial Sequence
  Description of Artificial Sequence: Synthetic oligonucleotide
ggtatgcaggctctactatctgggaaatggag

SEQ ID NO: 272828 - DNA, 34 bp, Artificial Sequence
  Description of Artificial Sequence: Synthetic oligonucleotide
gtatgcaggctctactatctgggaaatggagtac

SEQ ID NO: 272829 - DNA, 34 bp, Artificial Sequence
  Description of Artificial Sequence: Synthetic oligonucleotide
tatgcaggctctactatctgggaaatggagtacg

SEQ ID NO: 272830 - DNA, 33 bp, Artificial Sequence
  Description of Artificial Sequence: Synthetic oligonucleotide
atgcaggctctactatctgggaaatggagtacg

SEQ ID NO: 272831 - DNA, 32 bp, Artificial Sequence
  Description of Artificial Sequence: Synthetic oligonucleotide
tgcaggctctactatctgggaaatggagtacg

SEQ ID NO: 272832 - DNA, 31 bp, Artificial Sequence
  Description of Artificial Sequence: Synthetic oligonucleotide
gcaggctctactatctgggaaatggagtacg

SEQ ID NO: 272833 - DNA, 36 bp, Artificial Sequence
  Description of Artificial Sequence: Synthetic oligonucleotide
caggctctactatctgggaaatggagtacgtatttc

SEQ ID NO: 272834 - DNA, 37 bp, Artificial Sequence
  Description of Artificial Sequence: Synthetic oligonucleotide
aggctctactatctgggaaatggagtacgtatttctg

SEQ ID NO: 272835 - DNA, 36 bp, Artificial Sequence
  Description of Artificial Sequence: Synthetic oligonucleotide
ggctctactatctgggaaatggagtacgtatttctg

SEQ ID NO: 272836 - DNA, 37 bp, Artificial Sequence
  Description of Artificial Sequence: Synthetic oligonucleotide
gctctactatctgggaaatggagtacgtatttctgtg

SEQ ID NO: 272837 - DNA, 38 bp, Artificial Sequence
  Description of Artificial Sequence: Synthetic oligonucleotide
ctctactatctgggaaatggagtacgtatttctgtgtc

SEQ ID NO: 272838 - DNA, 38 bp, Artificial Sequence
  Description of Artificial Sequence: Synthetic oligonucleotide
tctactatctgggaaatggagtacgtatttctgtgtcg

SEQ ID NO: 272839 - DNA, 37 bp, Artificial Sequence
  Description of Artificial Sequence: Synthetic oligonucleotide
ctactatctgggaaatggagtacgtatttctgtgtcg

SEQ ID NO: 272840 - DNA, 37 bp, Artificial Sequence
  Description of Artificial Sequence: Synthetic oligonucleotide
tactatctgggaaatggagtacgtatttctgtgtcgg

SEQ ID NO: 272841 - DNA, 36 bp, Artificial Sequence
  Description of Artificial Sequence: Synthetic oligonucleotide
actatctgggaaatggagtacgtatttctgtgtcgg

SEQ ID NO: 272842 - DNA, 35 bp, Artificial Sequence
  Description of Artificial Sequence: Synthetic oligonucleotide
ctatctgggaaatggagtacgtatttctgtgtcgg

SEQ ID NO: 272843 - DNA, 35 bp, Artificial Sequence
  Description of Artificial Sequence: Synthetic oligonucleotide
tatctgggaaatggagtacgtatttctgtgtcggc

SEQ ID NO: 272844 - DNA, 34 bp, Artificial Sequence
  Description of Artificial Sequence: Synthetic oligonucleotide
atctgggaaatggagtacgtatttctgtgtcggc

SEQ ID NO: 272845 - DNA, 33 bp, Artificial Sequence
  Description of Artificial Sequence: Synthetic oligonucleotide
tctgggaaatggagtacgtatttctgtgtcggc

SEQ ID NO: 272846 - DNA, 32 bp, Artificial Sequence
  Description of Artificial Sequence: Synthetic oligonucleotide
ctgggaaatggagtacgtatttctgtgtcggc

SEQ ID NO: 272847 - DNA, 33 bp, Artificial Sequence
  Description of Artificial Sequence: Synthetic oligonucleotide
tgggaaatggagtacgtatttctgtgtcggcac

SEQ ID NO: 272848 - DNA, 32 bp, Artificial Sequence
  Description of Artificial Sequence: Synthetic oligonucleotide
gggaaatggagtacgtatttctgtgtcggcac

SEQ ID NO: 272849 - DNA, 32 bp, Artificial Sequence
  Description of Artificial Sequence: Synthetic oligonucleotide
ggaaatggagtacgtatttctgtgtcggcacc

SEQ ID NO: 272850 - DNA, 32 bp, Artificial Sequence
  Description of Artificial Sequence: Synthetic oligonucleotide
gaaatggagtacgtatttctgtgtcggcaccc

SEQ ID NO: 272851 - DNA, 33 bp, Artificial Sequence
  Description of Artificial Sequence: Synthetic oligonucleotide
aaatggagtacgtatttctgtgtcggcaccctc

SEQ ID NO: 272852 - DNA, 32 bp, Artificial Sequence
  Description of Artificial Sequence: Synthetic oligonucleotide
aatggagtacgtatttctgtgtcggcaccctc

SEQ ID NO: 272853 - DNA, 31 bp, Artificial Sequence
  Description of Artificial Sequence: Synthetic oligonucleotide
atggagtacgtatttctgtgtcggcaccctc

SEQ ID NO: 272854 - DNA, 30 bp, Artificial Sequence
  Description of Artificial Sequence: Synthetic oligonucleotide
tggagtacgtatttctgtgtcggcaccctc

SEQ ID NO: 272855 - DNA, 29 bp, Artificial Sequence
  Description of Artificial Sequence: Synthetic oligonucleotide
ggagtacgtatttctgtgtcggcaccctc

SEQ ID NO: 272856 - DNA, 29 bp, Artificial Sequence
  Description of Artificial Sequence: Synthetic oligonucleotide
gagtacgtatttctgtgtcggcaccctcc

SEQ ID NO: 272857 - DNA, 31 bp, Artificial Sequence
  Description of Artificial Sequence: Synthetic oligonucleotide
agtacgtatttctgtgtcggcaccctccaag

SEQ ID NO: 272858 - DNA, 30 bp, Artificial Sequence
  Description of Artificial Sequence: Synthetic oligonucleotide
gtacgtatttctgtgtcggcaccctccaag

SEQ ID NO: 272859 - DNA, 30 bp, Artificial Sequence
  Description of Artificial Sequence: Synthetic oligonucleotide
tacgtatttctgtgtcggcaccctccaagc

SEQ ID NO: 272860 - DNA, 29 bp, Artificial Sequence
  Description of Artificial Sequence: Synthetic oligonucleotide
acgtatttctgtgtcggcaccctccaagc

SEQ ID NO: 272861 - DNA, 28 bp, Artificial Sequence
  Description of Artificial Sequence: Synthetic oligonucleotide
cgtatttctgtgtcggcaccctccaagc

SEQ ID NO: 272862 - DNA, 29 bp, Artificial Sequence
  Description of Artificial Sequence: Synthetic oligonucleotide
gtatttctgtgtcggcaccctccaagcag

SEQ ID NO: 272863 - DNA, 29 bp, Artificial Sequence
  Description of Artificial Sequence: Synthetic oligonucleotide
tatttctgtgtcggcaccctccaagcagc

SEQ ID NO: 272864 - DNA, 28 bp, Artificial Sequence
  Description of Artificial Sequence: Synthetic oligonucleotide
atttctgtgtcggcaccctccaagcagc

SEQ ID NO: 272865 - DNA, 27 bp, Artificial Sequence
  Description of Artificial Sequence: Synthetic oligonucleotide
tttctgtgtcggcaccctccaagcagc

SEQ ID NO: 272866 - DNA, 27 bp, Artificial Sequence
  Description of Artificial Sequence: Synthetic oligonucleotide
ttctgtgtcggcaccctccaagcagct

SEQ ID NO: 272867 - DNA, 26 bp, Artificial Sequence
  Description of Artificial Sequence: Synthetic oligonucleotide
tctgtgtcggcaccctccaagcagct

SEQ ID NO: 272868 - DNA, 25 bp, Artificial Sequence
  Description of Artificial Sequence: Synthetic oligonucleotide
ctgtgtcggcaccctccaagcagct

SEQ ID NO: 272869 - DNA, 26 bp, Artificial Sequence
  Description of Artificial Sequence: Synthetic oligonucleotide
tgtgtcggcaccctccaagcagctgt

SEQ ID NO: 272870 - DNA, 25 bp, Artificial Sequence
  Description of Artificial Sequence: Synthetic oligonucleotide
gtgtcggcaccctccaagcagctgt

SEQ ID NO: 272871 - DNA, 25 bp, Artificial Sequence
  Description of Artificial Sequence: Synthetic oligonucleotide
tgtcggcaccctccaagcagctgtc

SEQ ID NO: 272872 - DNA, 24 bp, Artificial Sequence
  Description of Artificial Sequence: Synthetic oligonucleotide
gtcggcaccctccaagcagctgtc

SEQ ID NO: 272873 - DNA, 26 bp, Artificial Sequence
  Description of Artificial Sequence: Synthetic oligonucleotide
tcggcaccctccaagcagctgtccaa

SEQ ID NO: 272874 - DNA, 25 bp, Artificial Sequence
  Description of Artificial Sequence: Synthetic oligonucleotide
cggcaccctccaagcagctgtccaa

SEQ ID NO: 272875 - DNA, 27 bp, Artificial Sequence
  Description of Artificial Sequence: Synthetic oligonucleotide
ggcaccctccaagcagctgtccaagat

SEQ ID NO: 272876 - DNA, 27 bp, Artificial Sequence
  Description of Artificial Sequence: Synthetic oligonucleotide
gcaccctccaagcagctgtccaagatg

SEQ ID NO: 272877 - DNA, 29 bp, Artificial Sequence
  Description of Artificial Sequence: Synthetic oligonucleotide
caccctccaagcagctgtccaagatgatg

SEQ ID NO: 272878 - DNA, 30 bp, Artificial Sequence
  Description of Artificial Sequence: Synthetic oligonucleotide
accctccaagcagctgtccaagatgatgtg

SEQ ID NO: 272879 - DNA, 29 bp, Artificial Sequence
  Description of Artificial Sequence: Synthetic oligonucleotide
ccctccaagcagctgtccaagatgatgtg

SEQ ID NO: 272880 - DNA, 29 bp, Artificial Sequence
  Description of Artificial Sequence: Synthetic oligonucleotide
cctccaagcagctgtccaagatgatgtgc

SEQ ID NO: 272881 - DNA, 29 bp, Artificial Sequence
  Description of Artificial Sequence: Synthetic oligonucleotide
ctccaagcagctgtccaagatgatgtgcg

SEQ ID NO: 272882 - DNA, 30 bp, Artificial Sequence
  Description of Artificial Sequence: Synthetic oligonucleotide
tccaagcagctgtccaagatgatgtgcgag

SEQ ID NO: 272883 - DNA, 29 bp, Artificial Sequence
  Description of Artificial Sequence: Synthetic oligonucleotide
ccaagcagctgtccaagatgatgtgcgag

SEQ ID NO: 272884 - DNA, 31 bp, Artificial Sequence
  Description of Artificial Sequence: Synthetic oligonucleotide
caagcagctgtccaagatgatgtgcgagtac

SEQ ID NO: 272885 - DNA, 31 bp, Artificial Sequence
  Description of Artificial Sequence: Synthetic oligonucleotide
aagcagctgtccaagatgatgtgcgagtacc

SEQ ID NO: 272886 - DNA, 30 bp, Artificial Sequence
  Description of Artificial Sequence: Synthetic oligonucleotide
agcagctgtccaagatgatgtgcgagtacc

SEQ ID NO: 272887 - DNA, 29 bp, Artificial Sequence
  Description of Artificial Sequence: Synthetic oligonucleotide
gcagctgtccaagatgatgtgcgagtacc

SEQ ID NO: 272888 - DNA, 29 bp, Artificial Sequence
  Description of Artificial Sequence: Synthetic oligonucleotide
cagctgtccaagatgatgtgcgagtaccg

SEQ ID NO: 272889 - DNA, 29 bp, Artificial Sequence
  Description of Artificial Sequence: Synthetic oligonucleotide
agctgtccaagatgatgtgcgagtaccgg

SEQ ID NO: 272890 - DNA, 28 bp, Artificial Sequence
  Description of Artificial Sequence: Synthetic oligonucleotide
gctgtccaagatgatgtgcgagtaccgg

SEQ ID NO: 272891 - DNA, 28 bp, Artificial Sequence
  Description of Artificial Sequence: Synthetic oligonucleotide
ctgtccaagatgatgtgcgagtaccggg

SEQ ID NO: 272892 - DNA, 28 bp, Artificial Sequence
  Description of Artificial Sequence: Synthetic oligonucleotide
tgtccaagatgatgtgcgagtaccgggc

SEQ ID NO: 272893 - DNA, 27 bp, Artificial Sequence
  Description of Artificial Sequence: Synthetic oligonucleotide
gtccaagatgatgtgcgagtaccgggc

SEQ ID NO: 272894 - DNA, 27 bp, Artificial Sequence
  Description of Artificial Sequence: Synthetic oligonucleotide
tccaagatgatgtgcgagtaccgggcc

SEQ ID NO: 272895 - DNA, 27 bp, Artificial Sequence
  Description of Artificial Sequence: Synthetic oligonucleotide
ccaagatgatgtgcgagtaccgggcca

SEQ ID NO: 272896 - DNA, 28 bp, Artificial Sequence
  Description of Artificial Sequence: Synthetic oligonucleotide
caagatgatgtgcgagtaccgggccatg

SEQ ID NO: 272897 - DNA, 28 bp, Artificial Sequence
  Description of Artificial Sequence: Synthetic oligonucleotide
aagatgatgtgcgagtaccgggccatgg

SEQ ID NO: 272898 - DNA, 27 bp, Artificial Sequence
  Description of Artificial Sequence: Synthetic oligonucleotide
agatgatgtgcgagtaccgggccatgg

SEQ ID NO: 272899 - DNA, 26 bp, Artificial Sequence
  Description of Artificial Sequence: Synthetic oligonucleotide
gatgatgtgcgagtaccgggccatgg

SEQ ID NO: 272900 - DNA, 26 bp, Artificial Sequence
  Description of Artificial Sequence: Synthetic oligonucleotide
atgatgtgcgagtaccgggccatggg

SEQ ID NO: 272901 - DNA, 25 bp, Artificial Sequence
  Description of Artificial Sequence: Synthetic oligonucleotide
tgatgtgcgagtaccgggccatggg

SEQ ID NO: 272902 - DNA, 24 bp, Artificial Sequence
  Description of Artificial Sequence: Synthetic oligonucleotide
gatgtgcgagtaccgggccatggg

SEQ ID NO: 272903 - DNA, 24 bp, Artificial Sequence
  Description of Artificial Sequence: Synthetic oligonucleotide
atgtgcgagtaccgggccatgggc

SEQ ID NO: 272904 - DNA, 23 bp, Artificial Sequence
  Description of Artificial Sequence: Synthetic oligonucleotide
tgtgcgagtaccgggccatgggc

SEQ ID NO: 272905 - DNA, 22 bp, Artificial Sequence
  Description of Artificial Sequence: Synthetic oligonucleotide
gtgcgagtaccgggccatgggc

SEQ ID NO: 272906 - DNA, 23 bp, Artificial Sequence
  Description of Artificial Sequence: Synthetic oligonucleotide
tgcgagtaccgggccatgggcct

SEQ ID NO: 272907 - DNA, 22 bp, Artificial Sequence
  Description of Artificial Sequence: Synthetic oligonucleotide
gcgagtaccgggccatgggcct

SEQ ID NO: 272908 - DNA, 23 bp, Artificial Sequence
  Description of Artificial Sequence: Synthetic oligonucleotide
cgagtaccgggccatgggcctgt

SEQ ID NO: 272909 - DNA, 26 bp, Artificial Sequence
  Description of Artificial Sequence: Synthetic oligonucleotide
gagtaccgggccatgggcctgtctat

SEQ ID NO: 272910 - DNA, 26 bp, Artificial Sequence
  Description of Artificial Sequence: Synthetic oligonucleotide
agtaccgggccatgggcctgtctatg

SEQ ID NO: 272911 - DNA, 25 bp, Artificial Sequence
  Description of Artificial Sequence: Synthetic oligonucleotide
gtaccgggccatgggcctgtctatg

SEQ ID NO: 272912 - DNA, 25 bp, Artificial Sequence
  Description of Artificial Sequence: Synthetic oligonucleotide
taccgggccatgggcctgtctatgg

SEQ ID NO: 272913 - DNA, 24 bp, Artificial Sequence
  Description of Artificial Sequence: Synthetic oligonucleotide
accgggccatgggcctgtctatgg

SEQ ID NO: 272914 - DNA, 23 bp, Artificial Sequence
  Description of Artificial Sequence: Synthetic oligonucleotide
ccgggccatgggcctgtctatgg

SEQ ID NO: 272915 - DNA, 23 bp, Artificial Sequence
  Description of Artificial Sequence: Synthetic oligonucleotide
cgggccatgggcctgtctatggg

SEQ ID NO: 272916 - DNA, 24 bp, Artificial Sequence
  Description of Artificial Sequence: Synthetic oligonucleotide
gggccatgggcctgtctatgggct

SEQ ID NO: 272917 - DNA, 27 bp, Artificial Sequence
  Description of Artificial Sequence: Synthetic oligonucleotide
ggccatgggcctgtctatgggctgtat

SEQ ID NO: 272918 - DNA, 27 bp, Artificial Sequence
  Description of Artificial Sequence: Synthetic oligonucleotide
gccatgggcctgtctatgggctgtatg

SEQ ID NO: 272919 - DNA, 29 bp, Artificial Sequence
  Description of Artificial Sequence: Synthetic oligonucleotide
ccatgggcctgtctatgggctgtatgatc

SEQ ID NO: 272920 - DNA, 30 bp, Artificial Sequence
  Description of Artificial Sequence: Synthetic oligonucleotide
catgggcctgtctatgggctgtatgatctc

SEQ ID NO: 272921 - DNA, 31 bp, Artificial Sequence
  Description of Artificial Sequence: Synthetic oligonucleotide
atgggcctgtctatgggctgtatgatctctg

SEQ ID NO: 272922 - DNA, 30 bp, Artificial Sequence
  Description of Artificial Sequence: Synthetic oligonucleotide
tgggcctgtctatgggctgtatgatctctg

SEQ ID NO: 272923 - DNA, 29 bp, Artificial Sequence
  Description of Artificial Sequence: Synthetic oligonucleotide
gggcctgtctatgggctgtatgatctctg

SEQ ID NO: 272924 - DNA, 29 bp, Artificial Sequence
  Description of Artificial Sequence: Synthetic oligonucleotide
ggcctgtctatgggctgtatgatctctgg

SEQ ID NO: 272925 - DNA, 29 bp, Artificial Sequence
  Description of Artificial Sequence: Synthetic oligonucleotide
gcctgtctatgggctgtatgatctctggc

SEQ ID NO: 272926 - DNA, 30 bp, Artificial Sequence
  Description of Artificial Sequence: Synthetic oligonucleotide
cctgtctatgggctgtatgatctctggctg

SEQ ID NO: 272927 - DNA, 30 bp, Artificial Sequence
  Description of Artificial Sequence: Synthetic oligonucleotide
ctgtctatgggctgtatgatctctggctgg

SEQ ID NO: 272928 - DNA, 30 bp, Artificial Sequence
  Description of Artificial Sequence: Synthetic oligonucleotide
tgtctatgggctgtatgatctctggctggg

SEQ ID NO: 272929 - DNA, 29 bp, Artificial Sequence
  Description of Artificial Sequence: Synthetic oligonucleotide
gtctatgggctgtatgatctctggctggg

SEQ ID NO: 272930 - DNA, 33 bp, Artificial Sequence
  Description of Artificial Sequence: Synthetic oligonucleotide
tctatgggctgtatgatctctggctgggaaaag

SEQ ID NO: 272931 - DNA, 32 bp, Artificial Sequence
  Description of Artificial Sequence: Synthetic oligonucleotide
ctatgggctgtatgatctctggctgggaaaag

SEQ ID NO: 272932 - DNA, 34 bp, Artificial Sequence
  Description of Artificial Sequence: Synthetic oligonucleotide
tatgggctgtatgatctctggctgggaaaagaag

SEQ ID NO: 272933 - DNA, 33 bp, Artificial Sequence
  Description of Artificial Sequence: Synthetic oligonucleotide
atgggctgtatgatctctggctgggaaaagaag

SEQ ID NO: 272934 - DNA, 32 bp, Artificial Sequence
  Description of Artificial Sequence: Synthetic oligonucleotide
tgggctgtatgatctctggctgggaaaagaag

SEQ ID NO: 272935 - DNA, 31 bp, Artificial Sequence
  Description of Artificial Sequence: Synthetic oligonucleotide
gggctgtatgatctctggctgggaaaagaag

SEQ ID NO: 272936 - DNA, 31 bp, Artificial Sequence
  Description of Artificial Sequence: Synthetic oligonucleotide
ggctgtatgatctctggctgggaaaagaagg

SEQ ID NO: 272937 - DNA, 31 bp, Artificial Sequence
  Description of Artificial Sequence: Synthetic oligonucleotide
gctgtatgatctctggctgggaaaagaaggg

SEQ ID NO: 272938 - DNA, 32 bp, Artificial Sequence
  Description of Artificial Sequence: Synthetic oligonucleotide
ctgtatgatctctggctgggaaaagaagggtg

SEQ ID NO: 272939 - DNA, 32 bp, Artificial Sequence
  Description of Artificial Sequence: Synthetic oligonucleotide
tgtatgatctctggctgggaaaagaagggtgc

SEQ ID NO: 272940 - DNA, 31 bp, Artificial Sequence
  Description of Artificial Sequence: Synthetic oligonucleotide
gtatgatctctggctgggaaaagaagggtgc

SEQ ID NO: 272941 - DNA, 32 bp, Artificial Sequence
  Description of Artificial Sequence: Synthetic oligonucleotide
tatgatctctggctgggaaaagaagggtgctg

SEQ ID NO: 272942 - DNA, 31 bp, Artificial Sequence
  Description of Artificial Sequence: Synthetic oligonucleotide
atgatctctggctgggaaaagaagggtgctg

SEQ ID NO: 272943 - DNA, 30 bp, Artificial Sequence
  Description of Artificial Sequence: Synthetic oligonucleotide
tgatctctggctgggaaaagaagggtgctg

SEQ ID NO: 272944 - DNA, 29 bp, Artificial Sequence
  Description of Artificial Sequence: Synthetic oligonucleotide
gatctctggctgggaaaagaagggtgctg

SEQ ID NO: 272945 - DNA, 29 bp, Artificial Sequence
  Description of Artificial Sequence: Synthetic oligonucleotide
atctctggctgggaaaagaagggtgctgg

SEQ ID NO: 272946 - DNA, 28 bp, Artificial Sequence
  Description of Artificial Sequence: Synthetic oligonucleotide
tctctggctgggaaaagaagggtgctgg

SEQ ID NO: 272947 - DNA, 27 bp, Artificial Sequence
  Description of Artificial Sequence: Synthetic oligonucleotide
ctctggctgggaaaagaagggtgctgg

SEQ ID NO: 272948 - DNA, 28 bp, Artificial Sequence
  Description of Artificial Sequence: Synthetic oligonucleotide
tctggctgggaaaagaagggtgctggac

SEQ ID NO: 272949 - DNA, 27 bp, Artificial Sequence
  Description of Artificial Sequence: Synthetic oligonucleotide
ctggctgggaaaagaagggtgctggac

SEQ ID NO: 272950 - DNA, 28 bp, Artificial Sequence
  Description of Artificial Sequence: Synthetic oligonucleotide
tggctgggaaaagaagggtgctggactc

SEQ ID NO: 272951 - DNA, 27 bp, Artificial Sequence
  Description of Artificial Sequence: Synthetic oligonucleotide
ggctgggaaaagaagggtgctggactc

SEQ ID NO: 272952 - DNA, 29 bp, Artificial Sequence
  Description of Artificial Sequence: Synthetic oligonucleotide
gctgggaaaagaagggtgctggactcttc

SEQ ID NO: 272953 - DNA, 31 bp, Artificial Sequence
  Description of Artificial Sequence: Synthetic oligonucleotide
ctgggaaaagaagggtgctggactcttctac

SEQ ID NO: 272954 - DNA, 31 bp, Artificial Sequence
  Description of Artificial Sequence: Synthetic oligonucleotide
tgggaaaagaagggtgctggactcttctacg

SEQ ID NO: 272955 - DNA, 30 bp, Artificial Sequence
  Description of Artificial Sequence: Synthetic oligonucleotide
gggaaaagaagggtgctggactcttctacg

SEQ ID NO: 272956 - DNA, 31 bp, Artificial Sequence
  Description of Artificial Sequence: Synthetic oligonucleotide
ggaaaagaagggtgctggactcttctacgtg

SEQ ID NO: 272957 - DNA, 31 bp, Artificial Sequence
  Description of Artificial Sequence: Synthetic oligonucleotide
gaaaagaagggtgctggactcttctacgtgg

SEQ ID NO: 272958 - DNA, 33 bp, Artificial Sequence
  Description of Artificial Sequence: Synthetic oligonucleotide
aaaagaagggtgctggactcttctacgtggaag

SEQ ID NO: 272959 - DNA, 32 bp, Artificial Sequence
  Description of Artificial Sequence: Synthetic oligonucleotide
aaagaagggtgctggactcttctacgtggaag

SEQ ID NO: 272960 - DNA, 31 bp, Artificial Sequence
  Description of Artificial Sequence: Synthetic oligonucleotide
aagaagggtgctggactcttctacgtggaag

SEQ ID NO: 272961 - DNA, 30 bp, Artificial Sequence
  Description of Artificial Sequence: Synthetic oligonucleotide
agaagggtgctggactcttctacgtggaag

SEQ ID NO: 272962 - DNA, 29 bp, Artificial Sequence
  Description of Artificial Sequence: Synthetic oligonucleotide
gaagggtgctggactcttctacgtggaag

SEQ ID NO: 272963 - DNA, 31 bp, Artificial Sequence
  Description of Artificial Sequence: Synthetic oligonucleotide
aagggtgctggactcttctacgtggaagaac

SEQ ID NO: 272964 - DNA, 30 bp, Artificial Sequence
  Description of Artificial Sequence: Synthetic oligonucleotide
agggtgctggactcttctacgtggaagaac

SEQ ID NO: 272965 - DNA, 29 bp, Artificial Sequence
  Description of Artificial Sequence: Synthetic oligonucleotide
gggtgctggactcttctacgtggaagaac

SEQ ID NO: 272966 - DNA, 31 bp, Artificial Sequence
  Description of Artificial Sequence: Synthetic oligonucleotide
ggtgctggactcttctacgtggaagaacatg

SEQ ID NO: 272967 - DNA, 31 bp, Artificial Sequence
  Description of Artificial Sequence: Synthetic oligonucleotide
gtgctggactcttctacgtggaagaacatgg

SEQ ID NO: 272968 - DNA, 31 bp, Artificial Sequence
  Description of Artificial Sequence: Synthetic oligonucleotide
tgctggactcttctacgtggaagaacatggg

SEQ ID NO: 272969 - DNA, 30 bp, Artificial Sequence
  Description of Artificial Sequence: Synthetic oligonucleotide
gctggactcttctacgtggaagaacatggg

SEQ ID NO: 272970 - DNA, 31 bp, Artificial Sequence
  Description of Artificial Sequence: Synthetic oligonucleotide
ctggactcttctacgtggaagaacatgggtc

SEQ ID NO: 272971 - DNA, 32 bp, Artificial Sequence
  Description of Artificial Sequence: Synthetic oligonucleotide
tggactcttctacgtggaagaacatgggtctc

SEQ ID NO: 272972 - DNA, 31 bp, Artificial Sequence
  Description of Artificial Sequence: Synthetic oligonucleotide
ggactcttctacgtggaagaacatgggtctc

SEQ ID NO: 272973 - DNA, 31 bp, Artificial Sequence
  Description of Artificial Sequence: Synthetic oligonucleotide
gactcttctacgtggaagaacatgggtctcg

SEQ ID NO: 272974 - DNA, 31 bp, Artificial Sequence
  Description of Artificial Sequence: Synthetic oligonucleotide
actcttctacgtggaagaacatgggtctcgg

SEQ ID NO: 272975 - DNA, 30 bp, Artificial Sequence
  Description of Artificial Sequence: Synthetic oligonucleotide
ctcttctacgtggaagaacatgggtctcgg

SEQ ID NO: 272976 - DNA, 30 bp, Artificial Sequence
  Description of Artificial Sequence: Synthetic oligonucleotide
tcttctacgtggaagaacatgggtctcggc

SEQ ID NO: 272977 - DNA, 29 bp, Artificial Sequence
  Description of Artificial Sequence: Synthetic oligonucleotide
cttctacgtggaagaacatgggtctcggc

SEQ ID NO: 272978 - DNA, 30 bp, Artificial Sequence
  Description of Artificial Sequence: Synthetic oligonucleotide
ttctacgtggaagaacatgggtctcggctc

SEQ ID NO: 272979 - DNA, 29 bp, Artificial Sequence
  Description of Artificial Sequence: Synthetic oligonucleotide
tctacgtggaagaacatgggtctcggctc

SEQ ID NO: 272980 - DNA, 28 bp, Artificial Sequence
  Description of Artificial Sequence: Synthetic oligonucleotide
ctacgtggaagaacatgggtctcggctc

SEQ ID NO: 272981 - DNA, 29 bp, Artificial Sequence
  Description of Artificial Sequence: Synthetic oligonucleotide
tacgtggaagaacatgggtctcggctctg

SEQ ID NO: 272982 - DNA, 28 bp, Artificial Sequence
  Description of Artificial Sequence: Synthetic oligonucleotide
acgtggaagaacatgggtctcggctctg

SEQ ID NO: 272983 - DNA, 27 bp, Artificial Sequence
  Description of Artificial Sequence: Synthetic oligonucleotide
cgtggaagaacatgggtctcggctctg

SEQ ID NO: 272984 - DNA, 28 bp, Artificial Sequence
  Description of Artificial Sequence: Synthetic oligonucleotide
gtggaagaacatgggtctcggctctgag

SEQ ID NO: 272985 - DNA, 28 bp, Artificial Sequence
  Description of Artificial Sequence: Synthetic oligonucleotide
tggaagaacatgggtctcggctctgagg

SEQ ID NO: 272986 - DNA, 27 bp, Artificial Sequence
  Description of Artificial Sequence: Synthetic oligonucleotide
ggaagaacatgggtctcggctctgagg

SEQ ID NO: 272987 - DNA, 33 bp, Artificial Sequence
  Description of Artificial Sequence: Synthetic oligonucleotide
gaagaacatgggtctcggctctgaggaaatatc

SEQ ID NO: 272988 - DNA, 35 bp, Artificial Sequence
  Description of Artificial Sequence: Synthetic oligonucleotide
aagaacatgggtctcggctctgaggaaatatcttc

SEQ ID NO: 272989 - DNA, 34 bp, Artificial Sequence
  Description of Artificial Sequence: Synthetic oligonucleotide
agaacatgggtctcggctctgaggaaatatcttc

SEQ ID NO: 272990 - DNA, 33 bp, Artificial Sequence
  Description of Artificial Sequence: Synthetic oligonucleotide
gaacatgggtctcggctctgaggaaatatcttc

SEQ ID NO: 272991 - DNA, 34 bp, Artificial Sequence
  Description of Artificial Sequence: Synthetic oligonucleotide
aacatgggtctcggctctgaggaaatatcttctc

SEQ ID NO: 272992 - DNA, 33 bp, Artificial Sequence
  Description of Artificial Sequence: Synthetic oligonucleotide
acatgggtctcggctctgaggaaatatcttctc

SEQ ID NO: 272993 - DNA, 32 bp, Artificial Sequence
  Description of Artificial Sequence: Synthetic oligonucleotide
catgggtctcggctctgaggaaatatcttctc

SEQ ID NO: 272994 - DNA, 32 bp, Artificial Sequence
  Description of Artificial Sequence: Synthetic oligonucleotide
atgggtctcggctctgaggaaatatcttctcc

SEQ ID NO: 272995 - DNA, 31 bp, Artificial Sequence
  Description of Artificial Sequence: Synthetic oligonucleotide
tgggtctcggctctgaggaaatatcttctcc

SEQ ID NO: 272996 - DNA, 30 bp, Artificial Sequence
  Description of Artificial Sequence: Synthetic oligonucleotide
gggtctcggctctgaggaaatatcttctcc

SEQ ID NO: 272997 - DNA, 31 bp, Artificial Sequence
  Description of Artificial Sequence: Synthetic oligonucleotide
ggtctcggctctgaggaaatatcttctccac

SEQ ID NO: 272998 - DNA, 31 bp, Artificial Sequence
  Description of Artificial Sequence: Synthetic oligonucleotide
gtctcggctctgaggaaatatcttctccacg

SEQ ID NO: 272999 - DNA, 31 bp, Artificial Sequence
  Description of Artificial Sequence: Synthetic oligonucleotide
tctcggctctgaggaaatatcttctccacgc

SEQ ID NO: 273000 - DNA, 30 bp, Artificial Sequence
  Description of Artificial Sequence: Synthetic oligonucleotide
ctcggctctgaggaaatatcttctccacgc

SEQ ID NO: 273001 - DNA, 30 bp, Artificial Sequence
  Description of Artificial Sequence: Synthetic oligonucleotide
tcggctctgaggaaatatcttctccacgcg

SEQ ID NO: 273002 - DNA, 29 bp, Artificial Sequence
  Description of Artificial Sequence: Synthetic oligonucleotide
cggctctgaggaaatatcttctccacgcg

SEQ ID NO: 273003 - DNA, 31 bp, Artificial Sequence
  Description of Artificial Sequence: Synthetic oligonucleotide
ggctctgaggaaatatcttctccacgcgtag

SEQ ID NO: 273004 - DNA, 32 bp, Artificial Sequence
  Description of Artificial Sequence: Synthetic oligonucleotide
gctctgaggaaatatcttctccacgcgtagtg

SEQ ID NO: 273005 - DNA, 32 bp, Artificial Sequence
  Description of Artificial Sequence: Synthetic oligonucleotide
ctctgaggaaatatcttctccacgcgtagtgg

SEQ ID NO: 273006 - DNA, 32 bp, Artificial Sequence
  Description of Artificial Sequence: Synthetic oligonucleotide
tctgaggaaatatcttctccacgcgtagtggg

SEQ ID NO: 273007 - DNA, 31 bp, Artificial Sequence
  Description of Artificial Sequence: Synthetic oligonucleotide
ctgaggaaatatcttctccacgcgtagtggg

SEQ ID NO: 273008 - DNA, 33 bp, Artificial Sequence
  Description of Artificial Sequence: Synthetic oligonucleotide
tgaggaaatatcttctccacgcgtagtgggatc

SEQ ID NO: 273009 - DNA, 32 bp, Artificial Sequence
  Description of Artificial Sequence: Synthetic oligonucleotide
gaggaaatatcttctccacgcgtagtgggatc

SEQ ID NO: 273010 - DNA, 33 bp, Artificial Sequence
  Description of Artificial Sequence: Synthetic oligonucleotide
aggaaatatcttctccacgcgtagtgggatcac

SEQ ID NO: 273011 - DNA, 32 bp, Artificial Sequence
  Description of Artificial Sequence: Synthetic oligonucleotide
ggaaatatcttctccacgcgtagtgggatcac

SEQ ID NO: 273012 - DNA, 36 bp, Artificial Sequence
  Description of Artificial Sequence: Synthetic oligonucleotide
gaaatatcttctccacgcgtagtgggatcacttatg

SEQ ID NO: 273013 - DNA, 36 bp, Artificial Sequence
  Description of Artificial Sequence: Synthetic oligonucleotide
aaatatcttctccacgcgtagtgggatcacttatgc

SEQ ID NO: 273014 - DNA, 35 bp, Artificial Sequence
  Description of Artificial Sequence: Synthetic oligonucleotide
aatatcttctccacgcgtagtgggatcacttatgc

SEQ ID NO: 273015 - DNA, 34 bp, Artificial Sequence
  Description of Artificial Sequence: Synthetic oligonucleotide
atatcttctccacgcgtagtgggatcacttatgc

SEQ ID NO: 273016 - DNA, 33 bp, Artificial Sequence
  Description of Artificial Sequence: Synthetic oligonucleotide
tatcttctccacgcgtagtgggatcacttatgc

SEQ ID NO: 273017 - DNA, 32 bp, Artificial Sequence
  Description of Artificial Sequence: Synthetic oligonucleotide
atcttctccacgcgtagtgggatcacttatgc

SEQ ID NO: 273018 - DNA, 31 bp, Artificial Sequence
  Description of Artificial Sequence: Synthetic oligonucleotide
tcttctccacgcgtagtgggatcacttatgc

SEQ ID NO: 273019 - DNA, 30 bp, Artificial Sequence
  Description of Artificial Sequence: Synthetic oligonucleotide
cttctccacgcgtagtgggatcacttatgc

SEQ ID NO: 273020 - DNA, 30 bp, Artificial Sequence
  Description of Artificial Sequence: Synthetic oligonucleotide
ttctccacgcgtagtgggatcacttatgcg

SEQ ID NO: 273021 - DNA, 29 bp, Artificial Sequence
  Description of Artificial Sequence: Synthetic oligonucleotide
tctccacgcgtagtgggatcacttatgcg

SEQ ID NO: 273022 - DNA, 28 bp, Artificial Sequence
  Description of Artificial Sequence: Synthetic oligonucleotide
ctccacgcgtagtgggatcacttatgcg

SEQ ID NO: 273023 - DNA, 30 bp, Artificial Sequence
  Description of Artificial Sequence: Synthetic oligonucleotide
tccacgcgtagtgggatcacttatgcgtac

SEQ ID NO: 273024 - DNA, 29 bp, Artificial Sequence
  Description of Artificial Sequence: Synthetic oligonucleotide
ccacgcgtagtgggatcacttatgcgtac

SEQ ID NO: 273025 - DNA, 29 bp, Artificial Sequence
  Description of Artificial Sequence: Synthetic oligonucleotide
cacgcgtagtgggatcacttatgcgtacg

SEQ ID NO: 273026 - DNA, 29 bp, Artificial Sequence
  Description of Artificial Sequence: Synthetic oligonucleotide
acgcgtagtgggatcacttatgcgtacgg

SEQ ID NO: 273027 - DNA, 28 bp, Artificial Sequence
  Description of Artificial Sequence: Synthetic oligonucleotide
cgcgtagtgggatcacttatgcgtacgg

SEQ ID NO: 273028 - DNA, 28 bp, Artificial Sequence
  Description of Artificial Sequence: Synthetic oligonucleotide
gcgtagtgggatcacttatgcgtacggg

SEQ ID NO: 273029 - DNA, 28 bp, Artificial Sequence
  Description of Artificial Sequence: Synthetic oligonucleotide
cgtagtgggatcacttatgcgtacgggg

SEQ ID NO: 273030 - DNA, 29 bp, Artificial Sequence
  Description of Artificial Sequence: Synthetic oligonucleotide
gtagtgggatcacttatgcgtacggggtc

SEQ ID NO: 273031 - DNA, 31 bp, Artificial Sequence
  Description of Artificial Sequence: Synthetic oligonucleotide
tagtgggatcacttatgcgtacggggtcttg

SEQ ID NO: 273032 - DNA, 30 bp, Artificial Sequence
  Description of Artificial Sequence: Synthetic oligonucleotide
agtgggatcacttatgcgtacggggtcttg

SEQ ID NO: 273033 - DNA, 29 bp, Artificial Sequence
  Description of Artificial Sequence: Synthetic oligonucleotide
gtgggatcacttatgcgtacggggtcttg

SEQ ID NO: 273034 - DNA, 29 bp, Artificial Sequence
  Description of Artificial Sequence: Synthetic oligonucleotide
tgggatcacttatgcgtacggggtcttgg

SEQ ID NO: 273035 - DNA, 28 bp, Artificial Sequence
  Description of Artificial Sequence: Synthetic oligonucleotide
gggatcacttatgcgtacggggtcttgg

SEQ ID NO: 273036 - DNA, 29 bp, Artificial Sequence
  Description of Artificial Sequence: Synthetic oligonucleotide
ggatcacttatgcgtacggggtcttggac

SEQ ID NO: 273037 - DNA, 30 bp, Artificial Sequence
  Description of Artificial Sequence: Synthetic oligonucleotide
gatcacttatgcgtacggggtcttggacag

SEQ ID NO: 273038 - DNA, 31 bp, Artificial Sequence
  Description of Artificial Sequence: Synthetic oligonucleotide
atcacttatgcgtacggggtcttggacagtg

SEQ ID NO: 273039 - DNA, 30 bp, Artificial Sequence
  Description of Artificial Sequence: Synthetic oligonucleotide
tcacttatgcgtacggggtcttggacagtg

SEQ ID NO: 273040 - DNA, 29 bp, Artificial Sequence
  Description of Artificial Sequence: Synthetic oligonucleotide
cacttatgcgtacggggtcttggacagtg

SEQ ID NO: 273041 - DNA, 29 bp, Artificial Sequence
  Description of Artificial Sequence: Synthetic oligonucleotide
acttatgcgtacggggtcttggacagtgc

SEQ ID NO: 273042 - DNA, 28 bp, Artificial Sequence
  Description of Artificial Sequence: Synthetic oligonucleotide
cttatgcgtacggggtcttggacagtgc

SEQ ID NO: 273043 - DNA, 28 bp, Artificial Sequence
  Description of Artificial Sequence: Synthetic oligonucleotide
ttatgcgtacggggtcttggacagtgcc

SEQ ID NO: 273044 - DNA, 27 bp, Artificial Sequence
  Description of Artificial Sequence: Synthetic oligonucleotide
tatgcgtacggggtcttggacagtgcc

SEQ ID NO: 273045 - DNA, 27 bp, Artificial Sequence
  Description of Artificial Sequence: Synthetic oligonucleotide
atgcgtacggggtcttggacagtgcct

SEQ ID NO: 273046 - DNA, 27 bp, Artificial Sequence
  Description of Artificial Sequence: Synthetic oligonucleotide
tgcgtacggggtcttggacagtgccta

SEQ ID NO: 273047 - DNA, 27 bp, Artificial Sequence
  Description of Artificial Sequence: Synthetic oligonucleotide
gcgtacggggtcttggacagtgcctat

SEQ ID NO: 273048 - DNA, 27 bp, Artificial Sequence
  Description of Artificial Sequence: Synthetic oligonucleotide
cgtacggggtcttggacagtgcctatc

SEQ ID NO: 273049 - DNA, 27 bp, Artificial Sequence
  Description of Artificial Sequence: Synthetic oligonucleotide
gtacggggtcttggacagtgcctatcg

SEQ ID NO: 273050 - DNA, 27 bp, Artificial Sequence
  Description of Artificial Sequence: Synthetic oligonucleotide
tacggggtcttggacagtgcctatcgg

SEQ ID NO: 273051 - DNA, 26 bp, Artificial Sequence
  Description of Artificial Sequence: Synthetic oligonucleotide
acggggtcttggacagtgcctatcgg

SEQ ID NO: 273052 - DNA, 25 bp, Artificial Sequence
  Description of Artificial Sequence: Synthetic oligonucleotide
cggggtcttggacagtgcctatcgg

SEQ ID NO: 273053 - DNA, 25 bp, Artificial Sequence
  Description of Artificial Sequence: Synthetic oligonucleotide
ggggtcttggacagtgcctatcggc

SEQ ID NO: 273054 - DNA, 27 bp, Artificial Sequence
  Description of Artificial Sequence: Synthetic oligonucleotide
gggtcttggacagtgcctatcggccaa

SEQ ID NO: 273055 - DNA, 29 bp, Artificial Sequence
  Description of Artificial Sequence: Synthetic oligonucleotide
ggtcttggacagtgcctatcggccaaatc

SEQ ID NO: 273056 - DNA, 32 bp, Artificial Sequence
  Description of Artificial Sequence: Synthetic oligonucleotide
gtcttggacagtgcctatcggccaaatcttag

SEQ ID NO: 273057 - DNA, 32 bp, Artificial Sequence
  Description of Artificial Sequence: Synthetic oligonucleotide
tcttggacagtgcctatcggccaaatcttagc

SEQ ID NO: 273058 - DNA, 31 bp, Artificial Sequence
  Description of Artificial Sequence: Synthetic oligonucleotide
cttggacagtgcctatcggccaaatcttagc

SEQ ID NO: 273059 - DNA, 31 bp, Artificial Sequence
  Description of Artificial Sequence: Synthetic oligonucleotide
ttggacagtgcctatcggccaaatcttagcg

SEQ ID NO: 273060 - DNA, 30 bp, Artificial Sequence
  Description of Artificial Sequence: Synthetic oligonucleotide
tggacagtgcctatcggccaaatcttagcg

SEQ ID NO: 273061 - DNA, 29 bp, Artificial Sequence
  Description of Artificial Sequence: Synthetic oligonucleotide
ggacagtgcctatcggccaaatcttagcg

SEQ ID NO: 273062 - DNA, 29 bp, Artificial Sequence
  Description of Artificial Sequence: Synthetic oligonucleotide
gacagtgcctatcggccaaatcttagcgc

SEQ ID NO: 273063 - DNA, 30 bp, Artificial Sequence
  Description of Artificial Sequence: Synthetic oligonucleotide
acagtgcctatcggccaaatcttagcgctg

SEQ ID NO: 273064 - DNA, 29 bp, Artificial Sequence
  Description of Artificial Sequence: Synthetic oligonucleotide
cagtgcctatcggccaaatcttagcgctg

SEQ ID NO: 273065 - DNA, 31 bp, Artificial Sequence
  Description of Artificial Sequence: Synthetic oligonucleotide
agtgcctatcggccaaatcttagcgctgaag

SEQ ID NO: 273066 - DNA, 30 bp, Artificial Sequence
  Description of Artificial Sequence: Synthetic oligonucleotide
gtgcctatcggccaaatcttagcgctgaag

SEQ ID NO: 273067 - DNA, 31 bp, Artificial Sequence
  Description of Artificial Sequence: Synthetic oligonucleotide
tgcctatcggccaaatcttagcgctgaagag

SEQ ID NO: 273068 - DNA, 30 bp, Artificial Sequence
  Description of Artificial Sequence: Synthetic oligonucleotide
gcctatcggccaaatcttagcgctgaagag

SEQ ID NO: 273069 - DNA, 30 bp, Artificial Sequence
  Description of Artificial Sequence: Synthetic oligonucleotide
cctatcggccaaatcttagcgctgaagagg

SEQ ID NO: 273070 - DNA, 30 bp, Artificial Sequence
  Description of Artificial Sequence: Synthetic oligonucleotide
ctatcggccaaatcttagcgctgaagaggg

SEQ ID NO: 273071 - DNA, 30 bp, Artificial Sequence
  Description of Artificial Sequence: Synthetic oligonucleotide
tatcggccaaatcttagcgctgaagagggc

SEQ ID NO: 273072 - DNA, 29 bp, Artificial Sequence
  Description of Artificial Sequence: Synthetic oligonucleotide
atcggccaaatcttagcgctgaagagggc

SEQ ID NO: 273073 - DNA, 28 bp, Artificial Sequence
  Description of Artificial Sequence: Synthetic oligonucleotide
tcggccaaatcttagcgctgaagagggc

SEQ ID NO: 273074 - DNA, 27 bp, Artificial Sequence
  Description of Artificial Sequence: Synthetic oligonucleotide
cggccaaatcttagcgctgaagagggc

SEQ ID NO: 273075 - DNA, 30 bp, Artificial Sequence
  Description of Artificial Sequence: Synthetic oligonucleotide
ggccaaatcttagcgctgaagagggctatg

SEQ ID NO: 273076 - DNA, 31 bp, Artificial Sequence
  Description of Artificial Sequence: Synthetic oligonucleotide
gccaaatcttagcgctgaagagggctatgac

SEQ ID NO: 273077 - DNA, 31 bp, Artificial Sequence
  Description of Artificial Sequence: Synthetic oligonucleotide
ccaaatcttagcgctgaagagggctatgacc

SEQ ID NO: 273078 - DNA, 33 bp, Artificial Sequence
  Description of Artificial Sequence: Synthetic oligonucleotide
caaatcttagcgctgaagagggctatgacctag

SEQ ID NO: 273079 - DNA, 33 bp, Artificial Sequence
  Description of Artificial Sequence: Synthetic oligonucleotide
aaatcttagcgctgaagagggctatgacctagg

SEQ ID NO: 273080 - DNA, 32 bp, Artificial Sequence
  Description of Artificial Sequence: Synthetic oligonucleotide
aatcttagcgctgaagagggctatgacctagg

SEQ ID NO: 273081 - DNA, 31 bp, Artificial Sequence
  Description of Artificial Sequence: Synthetic oligonucleotide
atcttagcgctgaagagggctatgacctagg

SEQ ID NO: 273082 - DNA, 30 bp, Artificial Sequence
  Description of Artificial Sequence: Synthetic oligonucleotide
tcttagcgctgaagagggctatgacctagg

SEQ ID NO: 273083 - DNA, 29 bp, Artificial Sequence
  Description of Artificial Sequence: Synthetic oligonucleotide
cttagcgctgaagagggctatgacctagg

SEQ ID NO: 273084 - DNA, 29 bp, Artificial Sequence
  Description of Artificial Sequence: Synthetic oligonucleotide
ttagcgctgaagagggctatgacctaggc

SEQ ID NO: 273085 - DNA, 28 bp, Artificial Sequence
  Description of Artificial Sequence: Synthetic oligonucleotide
tagcgctgaagagggctatgacctaggc

SEQ ID NO: 273086 - DNA, 27 bp, Artificial Sequence
  Description of Artificial Sequence: Synthetic oligonucleotide
agcgctgaagagggctatgacctaggc

SEQ ID NO: 273087 - DNA, 26 bp, Artificial Sequence
  Description of Artificial Sequence: Synthetic oligonucleotide
gcgctgaagagggctatgacctaggc

SEQ ID NO: 273088 - DNA, 26 bp, Artificial Sequence
  Description of Artificial Sequence: Synthetic oligonucleotide
cgctgaagagggctatgacctaggcc

SEQ ID NO: 273089 - DNA, 26 bp, Artificial Sequence
  Description of Artificial Sequence: Synthetic oligonucleotide
gctgaagagggctatgacctaggccg

SEQ ID NO: 273090 - DNA, 27 bp, Artificial Sequence
  Description of Artificial Sequence: Synthetic oligonucleotide
ctgaagagggctatgacctaggccgca

SEQ ID NO: 273091 - DNA, 27 bp, Artificial Sequence
  Description of Artificial Sequence: Synthetic oligonucleotide
tgaagagggctatgacctaggccgcag

SEQ ID NO: 273092 - DNA, 26 bp, Artificial Sequence
  Description of Artificial Sequence: Synthetic oligonucleotide
gaagagggctatgacctaggccgcag

SEQ ID NO: 273093 - DNA, 26 bp, Artificial Sequence
  Description of Artificial Sequence: Synthetic oligonucleotide
aagagggctatgacctaggccgcagg

SEQ ID NO: 273094 - DNA, 25 bp, Artificial Sequence
  Description of Artificial Sequence: Synthetic oligonucleotide
agagggctatgacctaggccgcagg

SEQ ID NO: 273095 - DNA, 24 bp, Artificial Sequence
  Description of Artificial Sequence: Synthetic oligonucleotide
gagggctatgacctaggccgcagg

SEQ ID NO: 273096 - DNA, 24 bp, Artificial Sequence
  Description of Artificial Sequence: Synthetic oligonucleotide
agggctatgacctaggccgcaggc

SEQ ID NO: 273097 - DNA, 23 bp, Artificial Sequence
  Description of Artificial Sequence: Synthetic oligonucleotide
gggctatgacctaggccgcaggc

SEQ ID NO: 273098 - DNA, 27 bp, Artificial Sequence
  Description of Artificial Sequence: Synthetic oligonucleotide
ggctatgacctaggccgcaggcctatt

SEQ ID NO: 273099 - DNA, 27 bp, Artificial Sequence
  Description of Artificial Sequence: Synthetic oligonucleotide
gctatgacctaggccgcaggcctattg

SEQ ID NO: 273100 - DNA, 27 bp, Artificial Sequence
  Description of Artificial Sequence: Synthetic oligonucleotide
ctatgacctaggccgcaggcctattgc

SEQ ID NO: 273101 - DNA, 31 bp, Artificial Sequence
  Description of Artificial Sequence: Synthetic oligonucleotide
tatgacctaggccgcaggcctattgcttttg

SEQ ID NO: 273102 - DNA, 30 bp, Artificial Sequence
  Description of Artificial Sequence: Synthetic oligonucleotide
atgacctaggccgcaggcctattgcttttg

SEQ ID NO: 273103 - DNA, 29 bp, Artificial Sequence
  Description of Artificial Sequence: Synthetic oligonucleotide
tgacctaggccgcaggcctattgcttttg

SEQ ID NO: 273104 - DNA, 28 bp, Artificial Sequence
  Description of Artificial Sequence: Synthetic oligonucleotide
gacctaggccgcaggcctattgcttttg

SEQ ID NO: 273105 - DNA, 28 bp, Artificial Sequence
  Description of Artificial Sequence: Synthetic oligonucleotide
acctaggccgcaggcctattgcttttgc

SEQ ID NO: 273106 - DNA, 27 bp, Artificial Sequence
  Description of Artificial Sequence: Synthetic oligonucleotide
cctaggccgcaggcctattgcttttgc

SEQ ID NO: 273107 - DNA, 27 bp, Artificial Sequence
  Description of Artificial Sequence: Synthetic oligonucleotide
ctaggccgcaggcctattgcttttgcc

SEQ ID NO: 273108 - DNA, 28 bp, Artificial Sequence
  Description of Artificial Sequence: Synthetic oligonucleotide
taggccgcaggcctattgcttttgccac

SEQ ID NO: 273109 - DNA, 27 bp, Artificial Sequence
  Description of Artificial Sequence: Synthetic oligonucleotide
aggccgcaggcctattgcttttgccac

SEQ ID NO: 273110 - DNA, 27 bp, Artificial Sequence
  Description of Artificial Sequence: Synthetic oligonucleotide
ggccgcaggcctattgcttttgccact

SEQ ID NO: 273111 - DNA, 27 bp, Artificial Sequence
  Description of Artificial Sequence: Synthetic oligonucleotide
gccgcaggcctattgcttttgccactc

SEQ ID NO: 273112 - DNA, 28 bp, Artificial Sequence
  Description of Artificial Sequence: Synthetic oligonucleotide
ccgcaggcctattgcttttgccactcag

SEQ ID NO: 273113 - DNA, 29 bp, Artificial Sequence
  Description of Artificial Sequence: Synthetic oligonucleotide
cgcaggcctattgcttttgccactcagag

SEQ ID NO: 273114 - DNA, 30 bp, Artificial Sequence
  Description of Artificial Sequence: Synthetic oligonucleotide
gcaggcctattgcttttgccactcagagag

SEQ ID NO: 273115 - DNA, 31 bp, Artificial Sequence
  Description of Artificial Sequence: Synthetic oligonucleotide
caggcctattgcttttgccactcagagagac

SEQ ID NO: 273116 - DNA, 32 bp, Artificial Sequence
  Description of Artificial Sequence: Synthetic oligonucleotide
aggcctattgcttttgccactcagagagacag

SEQ ID NO: 273117 - DNA, 31 bp, Artificial Sequence
  Description of Artificial Sequence: Synthetic oligonucleotide
ggcctattgcttttgccactcagagagacag

SEQ ID NO: 273118 - DNA, 31 bp, Artificial Sequence
  Description of Artificial Sequence: Synthetic oligonucleotide
gcctattgcttttgccactcagagagacagc

SEQ ID NO: 273119 - DNA, 35 bp, Artificial Sequence
  Description of Artificial Sequence: Synthetic oligonucleotide
cctattgcttttgccactcagagagacagcaattc

SEQ ID NO: 273120 - DNA, 36 bp, Artificial Sequence
  Description of Artificial Sequence: Synthetic oligonucleotide
ctattgcttttgccactcagagagacagcaattctg

SEQ ID NO: 273121 - DNA, 36 bp, Artificial Sequence
  Description of Artificial Sequence: Synthetic oligonucleotide
tattgcttttgccactcagagagacagcaattctgg

SEQ ID NO: 273122 - DNA, 35 bp, Artificial Sequence
  Description of Artificial Sequence: Synthetic oligonucleotide
attgcttttgccactcagagagacagcaattctgg

SEQ ID NO: 273123 - DNA, 34 bp, Artificial Sequence
  Description of Artificial Sequence: Synthetic oligonucleotide
ttgcttttgccactcagagagacagcaattctgg

SEQ ID NO: 273124 - DNA, 33 bp, Artificial Sequence
  Description of Artificial Sequence: Synthetic oligonucleotide
tgcttttgccactcagagagacagcaattctgg

SEQ ID NO: 273125 - DNA, 32 bp, Artificial Sequence
  Description of Artificial Sequence: Synthetic oligonucleotide
gcttttgccactcagagagacagcaattctgg

SEQ ID NO: 273126 - DNA, 33 bp, Artificial Sequence
  Description of Artificial Sequence: Synthetic oligonucleotide
cttttgccactcagagagacagcaattctggag

SEQ ID NO: 273127 - DNA, 33 bp, Artificial Sequence
  Description of Artificial Sequence: Synthetic oligonucleotide
ttttgccactcagagagacagcaattctggagc

SEQ ID NO: 273128 - DNA, 32 bp, Artificial Sequence
  Description of Artificial Sequence: Synthetic oligonucleotide
tttgccactcagagagacagcaattctggagc

SEQ ID NO: 273129 - DNA, 31 bp, Artificial Sequence
  Description of Artificial Sequence: Synthetic oligonucleotide
ttgccactcagagagacagcaattctggagc

SEQ ID NO: 273130 - DNA, 30 bp, Artificial Sequence
  Description of Artificial Sequence: Synthetic oligonucleotide
tgccactcagagagacagcaattctggagc

SEQ ID NO: 273131 - DNA, 29 bp, Artificial Sequence
  Description of Artificial Sequence: Synthetic oligonucleotide
gccactcagagagacagcaattctggagc

SEQ ID NO: 273132 - DNA, 29 bp, Artificial Sequence
  Description of Artificial Sequence: Synthetic oligonucleotide
ccactcagagagacagcaattctggagcc

SEQ ID NO: 273133 - DNA, 29 bp, Artificial Sequence
  Description of Artificial Sequence: Synthetic oligonucleotide
cactcagagagacagcaattctggagccg

SEQ ID NO: 273134 - DNA, 31 bp, Artificial Sequence
  Description of Artificial Sequence: Synthetic oligonucleotide
actcagagagacagcaattctggagccgttg

SEQ ID NO: 273135 - DNA, 30 bp, Artificial Sequence
  Description of Artificial Sequence: Synthetic oligonucleotide
ctcagagagacagcaattctggagccgttg

SEQ ID NO: 273136 - DNA, 31 bp, Artificial Sequence
  Description of Artificial Sequence: Synthetic oligonucleotide
tcagagagacagcaattctggagccgttgtc

SEQ ID NO: 273137 - DNA, 30 bp, Artificial Sequence
  Description of Artificial Sequence: Synthetic oligonucleotide
cagagagacagcaattctggagccgttgtc

SEQ ID NO: 273138 - DNA, 35 bp, Artificial Sequence
  Description of Artificial Sequence: Synthetic oligonucleotide
agagagacagcaattctggagccgttgtcaaaatg

SEQ ID NO: 273139 - DNA, 34 bp, Artificial Sequence
  Description of Artificial Sequence: Synthetic oligonucleotide
gagagacagcaattctggagccgttgtcaaaatg

SEQ ID NO: 273140 - DNA, 36 bp, Artificial Sequence
  Description of Artificial Sequence: Synthetic oligonucleotide
agagacagcaattctggagccgttgtcaaaatgtac

SEQ ID NO: 273141 - DNA, 35 bp, Artificial Sequence
  Description of Artificial Sequence: Synthetic oligonucleotide
gagacagcaattctggagccgttgtcaaaatgtac

SEQ ID NO: 273142 - DNA, 35 bp, Artificial Sequence
  Description of Artificial Sequence: Synthetic oligonucleotide
agacagcaattctggagccgttgtcaaaatgtacc

SEQ ID NO: 273143 - DNA, 34 bp, Artificial Sequence
  Description of Artificial Sequence: Synthetic oligonucleotide
gacagcaattctggagccgttgtcaaaatgtacc

SEQ ID NO: 273144 - DNA, 35 bp, Artificial Sequence
  Description of Artificial Sequence: Synthetic oligonucleotide
acagcaattctggagccgttgtcaaaatgtaccac

SEQ ID NO: 273145 - DNA, 34 bp, Artificial Sequence
  Description of Artificial Sequence: Synthetic oligonucleotide
cagcaattctggagccgttgtcaaaatgtaccac

SEQ ID NO: 273146 - DNA, 36 bp, Artificial Sequence
  Description of Artificial Sequence: Synthetic oligonucleotide
agcaattctggagccgttgtcaaaatgtaccacttg

SEQ ID NO: 273147 - DNA, 35 bp, Artificial Sequence
  Description of Artificial Sequence: Synthetic oligonucleotide
gcaattctggagccgttgtcaaaatgtaccacttg

SEQ ID NO: 273148 - DNA, 37 bp, Artificial Sequence
  Description of Artificial Sequence: Synthetic oligonucleotide
caattctggagccgttgtcaaaatgtaccacttgaag

SEQ ID NO: 273149 - DNA, 37 bp, Artificial Sequence
  Description of Artificial Sequence: Synthetic oligonucleotide
aattctggagccgttgtcaaaatgtaccacttgaagg

SEQ ID NO: 273150 - DNA, 36 bp, Artificial Sequence
  Description of Artificial Sequence: Synthetic oligonucleotide
attctggagccgttgtcaaaatgtaccacttgaagg

SEQ ID NO: 273151 - DNA, 35 bp, Artificial Sequence
  Description of Artificial Sequence: Synthetic oligonucleotide
ttctggagccgttgtcaaaatgtaccacttgaagg

SEQ ID NO: 273152 - DNA, 34 bp, Artificial Sequence
  Description of Artificial Sequence: Synthetic oligonucleotide
tctggagccgttgtcaaaatgtaccacttgaagg

SEQ ID NO: 273153 - DNA, 33 bp, Artificial Sequence
  Description of Artificial Sequence: Synthetic oligonucleotide
ctggagccgttgtcaaaatgtaccacttgaagg

SEQ ID NO: 273154 - DNA, 35 bp, Artificial Sequence
  Description of Artificial Sequence: Synthetic oligonucleotide
tggagccgttgtcaaaatgtaccacttgaaggaag

SEQ ID NO: 273155 - DNA, 34 bp, Artificial Sequence
  Description of Artificial Sequence: Synthetic oligonucleotide
ggagccgttgtcaaaatgtaccacttgaaggaag

SEQ ID NO: 273156 - DNA, 36 bp, Artificial Sequence
  Description of Artificial Sequence: Synthetic oligonucleotide
gagccgttgtcaaaatgtaccacttgaaggaagttg

SEQ ID NO: 273157 - DNA, 36 bp, Artificial Sequence
  Description of Artificial Sequence: Synthetic oligonucleotide
agccgttgtcaaaatgtaccacttgaaggaagttgg

SEQ ID NO: 273158 - DNA, 35 bp, Artificial Sequence
  Description of Artificial Sequence: Synthetic oligonucleotide
gccgttgtcaaaatgtaccacttgaaggaagttgg

SEQ ID NO: 273159 - DNA, 37 bp, Artificial Sequence
  Description of Artificial Sequence: Synthetic oligonucleotide
ccgttgtcaaaatgtaccacttgaaggaagttggttg

SEQ ID NO: 273160 - DNA, 37 bp, Artificial Sequence
  Description of Artificial Sequence: Synthetic oligonucleotide
cgttgtcaaaatgtaccacttgaaggaagttggttgg

SEQ ID NO: 273161 - DNA, 37 bp, Artificial Sequence
  Description of Artificial Sequence: Synthetic oligonucleotide
gttgtcaaaatgtaccacttgaaggaagttggttggg

SEQ ID NO: 273162 - DNA, 38 bp, Artificial Sequence
  Description of Artificial Sequence: Synthetic oligonucleotide
ttgtcaaaatgtaccacttgaaggaagttggttgggtc

SEQ ID NO: 273163 - DNA, 37 bp, Artificial Sequence
  Description of Artificial Sequence: Synthetic oligonucleotide
tgtcaaaatgtaccacttgaaggaagttggttgggtc

SEQ ID NO: 273164 - DNA, 36 bp, Artificial Sequence
  Description of Artificial Sequence: Synthetic oligonucleotide
gtcaaaatgtaccacttgaaggaagttggttgggtc

SEQ ID NO: 273165 - DNA, 39 bp, Artificial Sequence
  Description of Artificial Sequence: Synthetic oligonucleotide
tcaaaatgtaccacttgaaggaagttggttgggtcaaag

SEQ ID NO: 273166 - DNA, 38 bp, Artificial Sequence
  Description of Artificial Sequence: Synthetic oligonucleotide
caaaatgtaccacttgaaggaagttggttgggtcaaag

SEQ ID NO: 273167 - DNA, 40 bp, Artificial Sequence
  Description of Artificial Sequence: Synthetic oligonucleotide
aaaatgtaccacttgaaggaagttggttgggtcaaagtag

SEQ ID NO: 273168 - DNA, 39 bp, Artificial Sequence
  Description of Artificial Sequence: Synthetic oligonucleotide
aaatgtaccacttgaaggaagttggttgggtcaaagtag

SEQ ID NO: 273169 - DNA, 38 bp, Artificial Sequence
  Description of Artificial Sequence: Synthetic oligonucleotide
aatgtaccacttgaaggaagttggttgggtcaaagtag

SEQ ID NO: 273170 - DNA, 37 bp, Artificial Sequence
  Description of Artificial Sequence: Synthetic oligonucleotide
atgtaccacttgaaggaagttggttgggtcaaagtag

SEQ ID NO: 273171 - DNA, 36 bp, Artificial Sequence
  Description of Artificial Sequence: Synthetic oligonucleotide
tgtaccacttgaaggaagttggttgggtcaaagtag

SEQ ID NO: 273172 - DNA, 35 bp, Artificial Sequence
  Description of Artificial Sequence: Synthetic oligonucleotide
gtaccacttgaaggaagttggttgggtcaaagtag

SEQ ID NO: 273173 - DNA, 38 bp, Artificial Sequence
  Description of Artificial Sequence: Synthetic oligonucleotide
taccacttgaaggaagttggttgggtcaaagtagaatg

SEQ ID NO: 273174 - DNA, 37 bp, Artificial Sequence
  Description of Artificial Sequence: Synthetic oligonucleotide
accacttgaaggaagttggttgggtcaaagtagaatg

SEQ ID NO: 273175 - DNA, 36 bp, Artificial Sequence
  Description of Artificial Sequence: Synthetic oligonucleotide
ccacttgaaggaagttggttgggtcaaagtagaatg

SEQ ID NO: 273176 - DNA, 38 bp, Artificial Sequence
  Description of Artificial Sequence: Synthetic oligonucleotide
cacttgaaggaagttggttgggtcaaagtagaatgtac

SEQ ID NO: 273177 - DNA, 39 bp, Artificial Sequence
  Description of Artificial Sequence: Synthetic oligonucleotide
acttgaaggaagttggttgggtcaaagtagaatgtacag

SEQ ID NO: 273178 - DNA, 38 bp, Artificial Sequence
  Description of Artificial Sequence: Synthetic oligonucleotide
cttgaaggaagttggttgggtcaaagtagaatgtacag

SEQ ID NO: 273179 - DNA, 40 bp, Artificial Sequence
  Description of Artificial Sequence: Synthetic oligonucleotide
ttgaaggaagttggttgggtcaaagtagaatgtacagatg

SEQ ID NO: 273180 - DNA, 39 bp, Artificial Sequence
  Description of Artificial Sequence: Synthetic oligonucleotide
tgaaggaagttggttgggtcaaagtagaatgtacagatg

SEQ ID NO: 273181 - DNA, 38 bp, Artificial Sequence
  Description of Artificial Sequence: Synthetic oligonucleotide
gaaggaagttggttgggtcaaagtagaatgtacagatg

SEQ ID NO: 273182 - DNA, 39 bp, Artificial Sequence
  Description of Artificial Sequence: Synthetic oligonucleotide
aaggaagttggttgggtcaaagtagaatgtacagatgac

SEQ ID NO: 273183 - DNA, 38 bp, Artificial Sequence
  Description of Artificial Sequence: Synthetic oligonucleotide
aggaagttggttgggtcaaagtagaatgtacagatgac

SEQ ID NO: 273184 - DNA, 37 bp, Artificial Sequence
  Description of Artificial Sequence: Synthetic oligonucleotide
ggaagttggttgggtcaaagtagaatgtacagatgac

SEQ ID NO: 273185 - DNA, 38 bp, Artificial Sequence
  Description of Artificial Sequence: Synthetic oligonucleotide
gaagttggttgggtcaaagtagaatgtacagatgacag

SEQ ID NO: 273186 - DNA, 39 bp, Artificial Sequence
  Description of Artificial Sequence: Synthetic oligonucleotide
aagttggttgggtcaaagtagaatgtacagatgacagtg

SEQ ID NO: 273187 - DNA, 38 bp, Artificial Sequence
  Description of Artificial Sequence: Synthetic oligonucleotide
agttggttgggtcaaagtagaatgtacagatgacagtg

SEQ ID NO: 273188 - DNA, 37 bp, Artificial Sequence
  Description of Artificial Sequence: Synthetic oligonucleotide
gttggttgggtcaaagtagaatgtacagatgacagtg

SEQ ID NO: 273189 - DNA, 38 bp, Artificial Sequence
  Description of Artificial Sequence: Synthetic oligonucleotide
ttggttgggtcaaagtagaatgtacagatgacagtgac

SEQ ID NO: 273190 - DNA, 37 bp, Artificial Sequence
  Description of Artificial Sequence: Synthetic oligonucleotide
tggttgggtcaaagtagaatgtacagatgacagtgac

SEQ ID NO: 273191 - DNA, 36 bp, Artificial Sequence
  Description of Artificial Sequence: Synthetic oligonucleotide
ggttgggtcaaagtagaatgtacagatgacagtgac

SEQ ID NO: 273192 - DNA, 36 bp, Artificial Sequence
  Description of Artificial Sequence: Synthetic oligonucleotide
gttgggtcaaagtagaatgtacagatgacagtgacc

SEQ ID NO: 273193 - DNA, 37 bp, Artificial Sequence
  Description of Artificial Sequence: Synthetic oligonucleotide
ttgggtcaaagtagaatgtacagatgacagtgacctc

SEQ ID NO: 273194 - DNA, 36 bp, Artificial Sequence
  Description of Artificial Sequence: Synthetic oligonucleotide
tgggtcaaagtagaatgtacagatgacagtgacctc

SEQ ID NO: 273195 - DNA, 35 bp, Artificial Sequence
  Description of Artificial Sequence: Synthetic oligonucleotide
gggtcaaagtagaatgtacagatgacagtgacctc

SEQ ID NO: 273196 - DNA, 35 bp, Artificial Sequence
  Description of Artificial Sequence: Synthetic oligonucleotide
ggtcaaagtagaatgtacagatgacagtgacctcc

SEQ ID NO: 273197 - DNA, 36 bp, Artificial Sequence
  Description of Artificial Sequence: Synthetic oligonucleotide
gtcaaagtagaatgtacagatgacagtgacctcctg

SEQ ID NO: 273198 - DNA, 36 bp, Artificial Sequence
  Description of Artificial Sequence: Synthetic oligonucleotide
tcaaagtagaatgtacagatgacagtgacctcctgc

SEQ ID NO: 273199 - DNA, 35 bp, Artificial Sequence
  Description of Artificial Sequence: Synthetic oligonucleotide
caaagtagaatgtacagatgacagtgacctcctgc

SEQ ID NO: 273200 - DNA, 36 bp, Artificial Sequence
  Description of Artificial Sequence: Synthetic oligonucleotide
aaagtagaatgtacagatgacagtgacctcctgcac

SEQ ID NO: 273201 - DNA, 35 bp, Artificial Sequence
  Description of Artificial Sequence: Synthetic oligonucleotide
aagtagaatgtacagatgacagtgacctcctgcac

SEQ ID NO: 273202 - DNA, 34 bp, Artificial Sequence
  Description of Artificial Sequence: Synthetic oligonucleotide
agtagaatgtacagatgacagtgacctcctgcac

SEQ ID NO: 273203 - DNA, 33 bp, Artificial Sequence
  Description of Artificial Sequence: Synthetic oligonucleotide
gtagaatgtacagatgacagtgacctcctgcac

SEQ ID NO: 273204 - DNA, 33 bp, Artificial Sequence
  Description of Artificial Sequence: Synthetic oligonucleotide
tagaatgtacagatgacagtgacctcctgcacc

SEQ ID NO: 273205 - DNA, 32 bp, Artificial Sequence
  Description of Artificial Sequence: Synthetic oligonucleotide
agaatgtacagatgacagtgacctcctgcacc

SEQ ID NO: 273206 - DNA, 31 bp, Artificial Sequence
  Description of Artificial Sequence: Synthetic oligonucleotide
gaatgtacagatgacagtgacctcctgcacc

SEQ ID NO: 273207 - DNA, 32 bp, Artificial Sequence
  Description of Artificial Sequence: Synthetic oligonucleotide
aatgtacagatgacagtgacctcctgcaccag

SEQ ID NO: 273208 - DNA, 31 bp, Artificial Sequence
  Description of Artificial Sequence: Synthetic oligonucleotide
atgtacagatgacagtgacctcctgcaccag

SEQ ID NO: 273209 - DNA, 30 bp, Artificial Sequence
  Description of Artificial Sequence: Synthetic oligonucleotide
tgtacagatgacagtgacctcctgcaccag

SEQ ID NO: 273210 - DNA, 29 bp, Artificial Sequence
  Description of Artificial Sequence: Synthetic oligonucleotide
gtacagatgacagtgacctcctgcaccag

SEQ ID NO: 273211 - DNA, 31 bp, Artificial Sequence
  Description of Artificial Sequence: Synthetic oligonucleotide
tacagatgacagtgacctcctgcaccagaac

SEQ ID NO: 273212 - DNA, 30 bp, Artificial Sequence
  Description of Artificial Sequence: Synthetic oligonucleotide
acagatgacagtgacctcctgcaccagaac

SEQ ID NO: 273213 - DNA, 29 bp, Artificial Sequence
  Description of Artificial Sequence: Synthetic oligonucleotide
cagatgacagtgacctcctgcaccagaac

SEQ ID NO: 273214 - DNA, 29 bp, Artificial Sequence
  Description of Artificial Sequence: Synthetic oligonucleotide
agatgacagtgacctcctgcaccagaacc

SEQ ID NO: 273215 - DNA, 28 bp, Artificial Sequence
  Description of Artificial Sequence: Synthetic oligonucleotide
gatgacagtgacctcctgcaccagaacc

SEQ ID NO: 273216 - DNA, 28 bp, Artificial Sequence
  Description of Artificial Sequence: Synthetic oligonucleotide
atgacagtgacctcctgcaccagaaccg

SEQ ID NO: 273217 - DNA, 27 bp, Artificial Sequence
  Description of Artificial Sequence: Synthetic oligonucleotide
tgacagtgacctcctgcaccagaaccg

SEQ ID NO: 273218 - DNA, 26 bp, Artificial Sequence
  Description of Artificial Sequence: Synthetic oligonucleotide
gacagtgacctcctgcaccagaaccg

SEQ ID NO: 273219 - DNA, 26 bp, Artificial Sequence
  Description of Artificial Sequence: Synthetic oligonucleotide
acagtgacctcctgcaccagaaccgg

SEQ ID NO: 273220 - DNA, 25 bp, Artificial Sequence
  Description of Artificial Sequence: Synthetic oligonucleotide
cagtgacctcctgcaccagaaccgg

SEQ ID NO: 273221 - DNA, 27 bp, Artificial Sequence
  Description of Artificial Sequence: Synthetic oligonucleotide
agtgacctcctgcaccagaaccgggaa

SEQ ID NO: 273222 - DNA, 26 bp, Artificial Sequence
  Description of Artificial Sequence: Synthetic oligonucleotide
gtgacctcctgcaccagaaccgggaa

SEQ ID NO: 273223 - DNA, 26 bp, Artificial Sequence
  Description of Artificial Sequence: Synthetic oligonucleotide
tgacctcctgcaccagaaccgggaag

SEQ ID NO: 273224 - DNA, 25 bp, Artificial Sequence
  Description of Artificial Sequence: Synthetic oligonucleotide
gacctcctgcaccagaaccgggaag

SEQ ID NO: 273225 - DNA, 25 bp, Artificial Sequence
  Description of Artificial Sequence: Synthetic oligonucleotide
acctcctgcaccagaaccgggaagg

SEQ ID NO: 273226 - DNA, 24 bp, Artificial Sequence
  Description of Artificial Sequence: Synthetic oligonucleotide
cctcctgcaccagaaccgggaagg

SEQ ID NO: 273227 - DNA, 27 bp, Artificial Sequence
  Description of Artificial Sequence: Synthetic oligonucleotide
ctcctgcaccagaaccgggaaggcaat

SEQ ID NO: 273228 - DNA, 27 bp, Artificial Sequence
  Description of Artificial Sequence: Synthetic oligonucleotide
tcctgcaccagaaccgggaaggcaatc

SEQ ID NO: 273229 - DNA, 27 bp, Artificial Sequence
  Description of Artificial Sequence: Synthetic oligonucleotide
cctgcaccagaaccgggaaggcaatca

SEQ ID NO: 273230 - DNA, 23 bp, Artificial Sequence
  Description of Artificial Sequence: Synthetic oligonucleotide
ttgctgcgggggggagcacctac

SEQ ID NO: 273231 - DNA, 22 bp, Artificial Sequence
  Description of Artificial Sequence: Synthetic oligonucleotide
tgctgcgggggggagcacctac

SEQ ID NO: 273232 - DNA, 21 bp, Artificial Sequence
  Description of Artificial Sequence: Synthetic oligonucleotide
gctgcgggggggagcacctac

SEQ ID NO: 273233 - DNA, 21 bp, Artificial Sequence
  Description of Artificial Sequence: Synthetic oligonucleotide
ctgcgggggggagcacctacc

SEQ ID NO: 273234 - DNA, 21 bp, Artificial Sequence
  Description of Artificial Sequence: Synthetic oligonucleotide
tgcgggggggagcacctaccg

SEQ ID NO: 273235 - DNA, 20 bp, Artificial Sequence
  Description of Artificial Sequence: Synthetic oligonucleotide
gcgggggggagcacctaccg

SEQ ID NO: 273236 - DNA, 20 bp, Artificial Sequence
  Description of Artificial Sequence: Synthetic oligonucleotide
cgggggggagcacctaccgg

SEQ ID NO: 273237 - DNA, 20 bp, Artificial Sequence
  Description of Artificial Sequence: Synthetic oligonucleotide
gggggggagcacctaccggg

SEQ ID NO: 273238 - DNA, 21 bp, Artificial Sequence
  Description of Artificial Sequence: Synthetic oligonucleotide
ggggggagcacctaccgggga

SEQ ID NO: 273239 - DNA, 24 bp, Artificial Sequence
  Description of Artificial Sequence: Synthetic oligonucleotide
gggggagcacctaccggggacata

SEQ ID NO: 273240 - DNA, 24 bp, Artificial Sequence
  Description of Artificial Sequence: Synthetic oligonucleotide
ggggagcacctaccggggacatac

SEQ ID NO: 273241 - DNA, 24 bp, Artificial Sequence
  Description of Artificial Sequence: Synthetic oligonucleotide
gggagcacctaccggggacatacc

SEQ ID NO: 273242 - DNA, 24 bp, Artificial Sequence
  Description of Artificial Sequence: Synthetic oligonucleotide
ggagcacctaccggggacataccc

SEQ ID NO: 273243 - DNA, 24 bp, Artificial Sequence
  Description of Artificial Sequence: Synthetic oligonucleotide
gagcacctaccggggacatacccc

SEQ ID NO: 273244 - DNA, 24 bp, Artificial Sequence
  Description of Artificial Sequence: Synthetic oligonucleotide
agcacctaccggggacataccccg

SEQ ID NO: 273245 - DNA, 23 bp, Artificial Sequence
  Description of Artificial Sequence: Synthetic oligonucleotide
gcacctaccggggacataccccg

SEQ ID NO: 273246 - DNA, 23 bp, Artificial Sequence
  Description of Artificial Sequence: Synthetic oligonucleotide
cacctaccggggacataccccgg

SEQ ID NO: 273247 - DNA, 23 bp, Artificial Sequence
  Description of Artificial Sequence: Synthetic oligonucleotide
acctaccggggacataccccggg

SEQ ID NO: 273248 - DNA, 22 bp, Artificial Sequence
  Description of Artificial Sequence: Synthetic oligonucleotide
cctaccggggacataccccggg

SEQ ID NO: 273249 - DNA, 22 bp, Artificial Sequence
  Description of Artificial Sequence: Synthetic oligonucleotide
ctaccggggacataccccgggg

SEQ ID NO: 273250 - DNA, 22 bp, Artificial Sequence
  Description of Artificial Sequence: Synthetic oligonucleotide
taccggggacataccccggggg

SEQ ID NO: 273251 - DNA, 21 bp, Artificial Sequence
  Description of Artificial Sequence: Synthetic oligonucleotide
accggggacataccccggggg

SEQ ID NO: 273252 - DNA, 20 bp, Artificial Sequence
  Description of Artificial Sequence: Synthetic oligonucleotide
ccggggacataccccggggg

SEQ ID NO: 273253 - DNA, 20 bp, Artificial Sequence
  Description of Artificial Sequence: Synthetic oligonucleotide
cggggacataccccgggggg

SEQ ID NO: 273254 - DNA, 21 bp, Artificial Sequence
  Description of Artificial Sequence: Synthetic oligonucleotide
ggggacataccccggggggga

SEQ ID NO: 273255 - DNA, 23 bp, Artificial Sequence
  Description of Artificial Sequence: Synthetic oligonucleotide
gggacataccccgggggggagaa

SEQ ID NO: 273256 - DNA, 24 bp, Artificial Sequence
  Description of Artificial Sequence: Synthetic oligonucleotide
ggacataccccgggggggagaagt

SEQ ID NO: 273257 - DNA, 24 bp, Artificial Sequence
  Description of Artificial Sequence: Synthetic oligonucleotide
gacataccccgggggggagaagtg

SEQ ID NO: 273258 - DNA, 25 bp, Artificial Sequence
  Description of Artificial Sequence: Synthetic oligonucleotide
acataccccgggggggagaagtgca

SEQ ID NO: 273259 - DNA, 24 bp, Artificial Sequence
  Description of Artificial Sequence: Synthetic oligonucleotide
cataccccgggggggagaagtgca

SEQ ID NO: 273260 - DNA, 25 bp, Artificial Sequence
  Description of Artificial Sequence: Synthetic oligonucleotide
ataccccgggggggagaagtgcaca

SEQ ID NO: 273261 - DNA, 24 bp, Artificial Sequence
  Description of Artificial Sequence: Synthetic oligonucleotide
taccccgggggggagaagtgcaca

SEQ ID NO: 273262 - DNA, 23 bp, Artificial Sequence
  Description of Artificial Sequence: Synthetic oligonucleotide
accccgggggggagaagtgcaca

SEQ ID NO: 273263 - DNA, 22 bp, Artificial Sequence
  Description of Artificial Sequence: Synthetic oligonucleotide
ccccgggggggagaagtgcaca

SEQ ID NO: 273264 - DNA, 22 bp, Artificial Sequence
  Description of Artificial Sequence: Synthetic oligonucleotide
cccgggggggagaagtgcacac

SEQ ID NO: 273265 - DNA, 22 bp, Artificial Sequence
  Description of Artificial Sequence: Synthetic oligonucleotide
ccgggggggagaagtgcacacc

SEQ ID NO: 273266 - DNA, 22 bp, Artificial Sequence
  Description of Artificial Sequence: Synthetic oligonucleotide
cgggggggagaagtgcacaccg

SEQ ID NO: 273267 - DNA, 22 bp, Artificial Sequence
  Description of Artificial Sequence: Synthetic oligonucleotide
gggggggagaagtgcacaccgg

SEQ ID NO: 273268 - DNA, 23 bp, Artificial Sequence
  Description of Artificial Sequence: Synthetic oligonucleotide
ggggggagaagtgcacaccgggt

SEQ ID NO: 273269 - DNA, 23 bp, Artificial Sequence
  Description of Artificial Sequence: Synthetic oligonucleotide
gggggagaagtgcacaccgggtc

SEQ ID NO: 273270 - DNA, 24 bp, Artificial Sequence
  Description of Artificial Sequence: Synthetic oligonucleotide
ggggagaagtgcacaccgggtcca

SEQ ID NO: 273271 - DNA, 24 bp, Artificial Sequence
  Description of Artificial Sequence: Synthetic oligonucleotide
gggagaagtgcacaccgggtccac

SEQ ID NO: 273272 - DNA, 26 bp, Artificial Sequence
  Description of Artificial Sequence: Synthetic oligonucleotide
ggagaagtgcacaccgggtccaccat

SEQ ID NO: 273273 - DNA, 27 bp, Artificial Sequence
  Description of Artificial Sequence: Synthetic oligonucleotide
gagaagtgcacaccgggtccaccatca

SEQ ID NO: 273274 - DNA, 28 bp, Artificial Sequence
  Description of Artificial Sequence: Synthetic oligonucleotide
agaagtgcacaccgggtccaccatcaag

SEQ ID NO: 273275 - DNA, 27 bp, Artificial Sequence
  Description of Artificial Sequence: Synthetic oligonucleotide
gaagtgcacaccgggtccaccatcaag

SEQ ID NO: 273276 - DNA, 27 bp, Artificial Sequence
  Description of Artificial Sequence: Synthetic oligonucleotide
aagtgcacaccgggtccaccatcaagg

SEQ ID NO: 273277 - DNA, 26 bp, Artificial Sequence
  Description of Artificial Sequence: Synthetic oligonucleotide
agtgcacaccgggtccaccatcaagg

SEQ ID NO: 273278 - DNA, 25 bp, Artificial Sequence
  Description of Artificial Sequence: Synthetic oligonucleotide
gtgcacaccgggtccaccatcaagg

SEQ ID NO: 273279 - DNA, 26 bp, Artificial Sequence
  Description of Artificial Sequence: Synthetic oligonucleotide
tgcacaccgggtccaccatcaaggca

SEQ ID NO: 273280 - DNA, 25 bp, Artificial Sequence
  Description of Artificial Sequence: Synthetic oligonucleotide
gcacaccgggtccaccatcaaggca

SEQ ID NO: 273281 - DNA, 26 bp, Artificial Sequence
  Description of Artificial Sequence: Synthetic oligonucleotide
cacaccgggtccaccatcaaggcagt

SEQ ID NO: 273282 - DNA, 26 bp, Artificial Sequence
  Description of Artificial Sequence: Synthetic oligonucleotide
acaccgggtccaccatcaaggcagtg

SEQ ID NO: 273283 - DNA, 25 bp, Artificial Sequence
  Description of Artificial Sequence: Synthetic oligonucleotide
caccgggtccaccatcaaggcagtg

SEQ ID NO: 273284 - DNA, 26 bp, Artificial Sequence
  Description of Artificial Sequence: Synthetic oligonucleotide
accgggtccaccatcaaggcagtgga

SEQ ID NO: 273285 - DNA, 25 bp, Artificial Sequence
  Description of Artificial Sequence: Synthetic oligonucleotide
ccgggtccaccatcaaggcagtgga

SEQ ID NO: 273286 - DNA, 27 bp, Artificial Sequence
  Description of Artificial Sequence: Synthetic oligonucleotide
cgggtccaccatcaaggcagtggactt

SEQ ID NO: 273287 - DNA, 28 bp, Artificial Sequence
  Description of Artificial Sequence: Synthetic oligonucleotide
gggtccaccatcaaggcagtggactttg

SEQ ID NO: 273288 - DNA, 29 bp, Artificial Sequence
  Description of Artificial Sequence: Synthetic oligonucleotide
ggtccaccatcaaggcagtggactttgac

SEQ ID NO: 273289 - DNA, 29 bp, Artificial Sequence
  Description of Artificial Sequence: Synthetic oligonucleotide
gtccaccatcaaggcagtggactttgacg

SEQ ID NO: 273290 - DNA, 29 bp, Artificial Sequence
  Description of Artificial Sequence: Synthetic oligonucleotide
tccaccatcaaggcagtggactttgacgg

SEQ ID NO: 273291 - DNA, 28 bp, Artificial Sequence
  Description of Artificial Sequence: Synthetic oligonucleotide
ccaccatcaaggcagtggactttgacgg

SEQ ID NO: 273292 - DNA, 28 bp, Artificial Sequence
  Description of Artificial Sequence: Synthetic oligonucleotide
caccatcaaggcagtggactttgacggg

SEQ ID NO: 273293 - DNA, 28 bp, Artificial Sequence
  Description of Artificial Sequence: Synthetic oligonucleotide
accatcaaggcagtggactttgacgggc

SEQ ID NO: 273294 - DNA, 27 bp, Artificial Sequence
  Description of Artificial Sequence: Synthetic oligonucleotide
ccatcaaggcagtggactttgacgggc

SEQ ID NO: 273295 - DNA, 27 bp, Artificial Sequence
  Description of Artificial Sequence: Synthetic oligonucleotide
catcaaggcagtggactttgacgggcg

SEQ ID NO: 273296 - DNA, 27 bp, Artificial Sequence
  Description of Artificial Sequence: Synthetic oligonucleotide
atcaaggcagtggactttgacgggcgc

SEQ ID NO: 273297 - DNA, 26 bp, Artificial Sequence
  Description of Artificial Sequence: Synthetic oligonucleotide
tcaaggcagtggactttgacgggcgc

SEQ ID NO: 273298 - DNA, 25 bp, Artificial Sequence
  Description of Artificial Sequence: Synthetic oligonucleotide
caaggcagtggactttgacgggcgc

SEQ ID NO: 273299 - DNA, 27 bp, Artificial Sequence
  Description of Artificial Sequence: Synthetic oligonucleotide
aaggcagtggactttgacgggcgcgtt

SEQ ID NO: 273300 - DNA, 26 bp, Artificial Sequence
  Description of Artificial Sequence: Synthetic oligonucleotide
aggcagtggactttgacgggcgcgtt

SEQ ID NO: 273301 - DNA, 25 bp, Artificial Sequence
  Description of Artificial Sequence: Synthetic oligonucleotide
ggcagtggactttgacgggcgcgtt

SEQ ID NO: 273302 - DNA, 26 bp, Artificial Sequence
  Description of Artificial Sequence: Synthetic oligonucleotide
gcagtggactttgacgggcgcgttgt

SEQ ID NO: 273303 - DNA, 27 bp, Artificial Sequence
  Description of Artificial Sequence: Synthetic oligonucleotide
cagtggactttgacgggcgcgttgtga

SEQ ID NO: 273304 - DNA, 28 bp, Artificial Sequence
  Description of Artificial Sequence: Synthetic oligonucleotide
agtggactttgacgggcgcgttgtgaag

SEQ ID NO: 273305 - DNA, 27 bp, Artificial Sequence
  Description of Artificial Sequence: Synthetic oligonucleotide
gtggactttgacgggcgcgttgtgaag

SEQ ID NO: 273306 - DNA, 27 bp, Artificial Sequence
  Description of Artificial Sequence: Synthetic oligonucleotide
tggactttgacgggcgcgttgtgaagg

SEQ ID NO: 273307 - DNA, 26 bp, Artificial Sequence
  Description of Artificial Sequence: Synthetic oligonucleotide
ggactttgacgggcgcgttgtgaagg

SEQ ID NO: 273308 - DNA, 27 bp, Artificial Sequence
  Description of Artificial Sequence: Synthetic oligonucleotide
gactttgacgggcgcgttgtgaagggt

SEQ ID NO: 273309 - DNA, 28 bp, Artificial Sequence
  Description of Artificial Sequence: Synthetic oligonucleotide
actttgacgggcgcgttgtgaagggttc

SEQ ID NO: 273310 - DNA, 27 bp, Artificial Sequence
  Description of Artificial Sequence: Synthetic oligonucleotide
ctttgacgggcgcgttgtgaagggttc

SEQ ID NO: 273311 - DNA, 28 bp, Artificial Sequence
  Description of Artificial Sequence: Synthetic oligonucleotide
tttgacgggcgcgttgtgaagggttctg

SEQ ID NO: 273312 - DNA, 27 bp, Artificial Sequence
  Description of Artificial Sequence: Synthetic oligonucleotide
ttgacgggcgcgttgtgaagggttctg

SEQ ID NO: 273313 - DNA, 27 bp, Artificial Sequence
  Description of Artificial Sequence: Synthetic oligonucleotide
tgacgggcgcgttgtgaagggttctga

SEQ ID NO: 273314 - DNA, 27 bp, Artificial Sequence
  Description of Artificial Sequence: Synthetic oligonucleotide
gacgggcgcgttgtgaagggttctgaa

SEQ ID NO: 273315 - DNA, 28 bp, Artificial Sequence
  Description of Artificial Sequence: Synthetic oligonucleotide
acgggcgcgttgtgaagggttctgaatc

SEQ ID NO: 273316 - DNA, 27 bp, Artificial Sequence
  Description of Artificial Sequence: Synthetic oligonucleotide
cgggcgcgttgtgaagggttctgaatc

SEQ ID NO: 273317 - DNA, 27 bp, Artificial Sequence
  Description of Artificial Sequence: Synthetic oligonucleotide
gggcgcgttgtgaagggttctgaatcc

SEQ ID NO: 273318 - DNA, 27 bp, Artificial Sequence
  Description of Artificial Sequence: Synthetic oligonucleotide
ggcgcgttgtgaagggttctgaatccc

SEQ ID NO: 273319 - DNA, 27 bp, Artificial Sequence
  Description of Artificial Sequence: Synthetic oligonucleotide
gcgcgttgtgaagggttctgaatcccg

SEQ ID NO: 273320 - DNA, 28 bp, Artificial Sequence
  Description of Artificial Sequence: Synthetic oligonucleotide
cgcgttgtgaagggttctgaatcccgag

SEQ ID NO: 273321 - DNA, 29 bp, Artificial Sequence
  Description of Artificial Sequence: Synthetic oligonucleotide
gcgttgtgaagggttctgaatcccgagtg

SEQ ID NO: 273322 - DNA, 30 bp, Artificial Sequence
  Description of Artificial Sequence: Synthetic oligonucleotide
cgttgtgaagggttctgaatcccgagtgac

SEQ ID NO: 273323 - DNA, 31 bp, Artificial Sequence
  Description of Artificial Sequence: Synthetic oligonucleotide
gttgtgaagggttctgaatcccgagtgactg

SEQ ID NO: 273324 - DNA, 31 bp, Artificial Sequence
  Description of Artificial Sequence: Synthetic oligonucleotide
ttgtgaagggttctgaatcccgagtgactgc

SEQ ID NO: 273325 - DNA, 30 bp, Artificial Sequence
  Description of Artificial Sequence: Synthetic oligonucleotide
tgtgaagggttctgaatcccgagtgactgc

SEQ ID NO: 273326 - DNA, 29 bp, Artificial Sequence
  Description of Artificial Sequence: Synthetic oligonucleotide
gtgaagggttctgaatcccgagtgactgc

SEQ ID NO: 273327 - DNA, 30 bp, Artificial Sequence
  Description of Artificial Sequence: Synthetic oligonucleotide
tgaagggttctgaatcccgagtgactgcag

SEQ ID NO: 273328 - DNA, 29 bp, Artificial Sequence
  Description of Artificial Sequence: Synthetic oligonucleotide
gaagggttctgaatcccgagtgactgcag

SEQ ID NO: 273329 - DNA, 29 bp, Artificial Sequence
  Description of Artificial Sequence: Synthetic oligonucleotide
aagggttctgaatcccgagtgactgcagg

SEQ ID NO: 273330 - DNA, 28 bp, Artificial Sequence
  Description of Artificial Sequence: Synthetic oligonucleotide
agggttctgaatcccgagtgactgcagg

SEQ ID NO: 273331 - DNA, 27 bp, Artificial Sequence
  Description of Artificial Sequence: Synthetic oligonucleotide
gggttctgaatcccgagtgactgcagg

SEQ ID NO: 273332 - DNA, 27 bp, Artificial Sequence
  Description of Artificial Sequence: Synthetic oligonucleotide
ggttctgaatcccgagtgactgcaggc

SEQ ID NO: 273333 - DNA, 27 bp, Artificial Sequence
  Description of Artificial Sequence: Synthetic oligonucleotide
gttctgaatcccgagtgactgcaggcg

SEQ ID NO: 273334 - DNA, 28 bp, Artificial Sequence
  Description of Artificial Sequence: Synthetic oligonucleotide
ttctgaatcccgagtgactgcaggcgtg

SEQ ID NO: 273335 - DNA, 27 bp, Artificial Sequence
  Description of Artificial Sequence: Synthetic oligonucleotide
tctgaatcccgagtgactgcaggcgtg

SEQ ID NO: 273336 - DNA, 26 bp, Artificial Sequence
  Description of Artificial Sequence: Synthetic oligonucleotide
ctgaatcccgagtgactgcaggcgtg

SEQ ID NO: 273337 - DNA, 26 bp, Artificial Sequence
  Description of Artificial Sequence: Synthetic oligonucleotide
tgaatcccgagtgactgcaggcgtgg

SEQ ID NO: 273338 - DNA, 25 bp, Artificial Sequence
  Description of Artificial Sequence: Synthetic oligonucleotide
gaatcccgagtgactgcaggcgtgg

SEQ ID NO: 273339 - DNA, 25 bp, Artificial Sequence
  Description of Artificial Sequence: Synthetic oligonucleotide
aatcccgagtgactgcaggcgtggc

SEQ ID NO: 273340 - DNA, 24 bp, Artificial Sequence
  Description of Artificial Sequence: Synthetic oligonucleotide
atcccgagtgactgcaggcgtggc

SEQ ID NO: 273341 - DNA, 23 bp, Artificial Sequence
  Description of Artificial Sequence: Synthetic oligonucleotide
tcccgagtgactgcaggcgtggc

SEQ ID NO: 273342 - DNA, 22 bp, Artificial Sequence
  Description of Artificial Sequence: Synthetic oligonucleotide
cccgagtgactgcaggcgtggc

SEQ ID NO: 273343 - DNA, 22 bp, Artificial Sequence
  Description of Artificial Sequence: Synthetic oligonucleotide
ccgagtgactgcaggcgtggcg

SEQ ID NO: 273344 - DNA, 23 bp, Artificial Sequence
  Description of Artificial Sequence: Synthetic oligonucleotide
cgagtgactgcaggcgtggcggt

SEQ ID NO: 273345 - DNA, 23 bp, Artificial Sequence
  Description of Artificial Sequence: Synthetic oligonucleotide
gagtgactgcaggcgtggcggtg

SEQ ID NO: 273346 - DNA, 24 bp, Artificial Sequence
  Description of Artificial Sequence: Synthetic oligonucleotide
agtgactgcaggcgtggcggtggt

SEQ ID NO: 273347 - DNA, 23 bp, Artificial Sequence
  Description of Artificial Sequence: Synthetic oligonucleotide
gtgactgcaggcgtggcggtggt

SEQ ID NO: 273348 - DNA, 25 bp, Artificial Sequence
  Description of Artificial Sequence: Synthetic oligonucleotide
tgactgcaggcgtggcggtggtcaa

SEQ ID NO: 273349 - DNA, 24 bp, Artificial Sequence
  Description of Artificial Sequence: Synthetic oligonucleotide
gactgcaggcgtggcggtggtcaa

SEQ ID NO: 273350 - DNA, 24 bp, Artificial Sequence
  Description of Artificial Sequence: Synthetic oligonucleotide
actgcaggcgtggcggtggtcaac

SEQ ID NO: 273351 - DNA, 23 bp, Artificial Sequence
  Description of Artificial Sequence: Synthetic oligonucleotide
ctgcaggcgtggcggtggtcaac

SEQ ID NO: 273352 - DNA, 23 bp, Artificial Sequence
  Description of Artificial Sequence: Synthetic oligonucleotide
tgcaggcgtggcggtggtcaacc

SEQ ID NO: 273353 - DNA, 22 bp, Artificial Sequence
  Description of Artificial Sequence: Synthetic oligonucleotide
gcaggcgtggcggtggtcaacc

SEQ ID NO: 273354 - DNA, 23 bp, Artificial Sequence
  Description of Artificial Sequence: Synthetic oligonucleotide
caggcgtggcggtggtcaaccga

SEQ ID NO: 273355 - DNA, 24 bp, Artificial Sequence
  Description of Artificial Sequence: Synthetic oligonucleotide
aggcgtggcggtggtcaaccgagt

SEQ ID NO: 273356 - DNA, 23 bp, Artificial Sequence
  Description of Artificial Sequence: Synthetic oligonucleotide
ggcgtggcggtggtcaaccgagt

SEQ ID NO: 273357 - DNA, 26 bp, Artificial Sequence
  Description of Artificial Sequence: Synthetic oligonucleotide
gcgtggcggtggtcaaccgagtgatt

SEQ ID NO: 273358 - DNA, 27 bp, Artificial Sequence
  Description of Artificial Sequence: Synthetic oligonucleotide
cgtggcggtggtcaaccgagtgattga

SEQ ID NO: 273359 - DNA, 27 bp, Artificial Sequence
  Description of Artificial Sequence: Synthetic oligonucleotide
gtggcggtggtcaaccgagtgattgac

SEQ ID NO: 273360 - DNA, 29 bp, Artificial Sequence
  Description of Artificial Sequence: Synthetic oligonucleotide
tggcggtggtcaaccgagtgattgacaag

SEQ ID NO: 273361 - DNA, 28 bp, Artificial Sequence
  Description of Artificial Sequence: Synthetic oligonucleotide
ggcggtggtcaaccgagtgattgacaag

SEQ ID NO: 273362 - DNA, 28 bp, Artificial Sequence
  Description of Artificial Sequence: Synthetic oligonucleotide
gcggtggtcaaccgagtgattgacaagc

SEQ ID NO: 273363 - DNA, 29 bp, Artificial Sequence
  Description of Artificial Sequence: Synthetic oligonucleotide
cggtggtcaaccgagtgattgacaagcag

SEQ ID NO: 273364 - DNA, 30 bp, Artificial Sequence
  Description of Artificial Sequence: Synthetic oligonucleotide
ggtggtcaaccgagtgattgacaagcagtc

SEQ ID NO: 273365 - DNA, 30 bp, Artificial Sequence
  Description of Artificial Sequence: Synthetic oligonucleotide
gtggtcaaccgagtgattgacaagcagtcc

SEQ ID NO: 273366 - DNA, 30 bp, Artificial Sequence
  Description of Artificial Sequence: Synthetic oligonucleotide
tggtcaaccgagtgattgacaagcagtccc

SEQ ID NO: 273367 - DNA, 29 bp, Artificial Sequence
  Description of Artificial Sequence: Synthetic oligonucleotide
ggtcaaccgagtgattgacaagcagtccc

SEQ ID NO: 273368 - DNA, 29 bp, Artificial Sequence
  Description of Artificial Sequence: Synthetic oligonucleotide
gtcaaccgagtgattgacaagcagtcccc

SEQ ID NO: 273369 - DNA, 29 bp, Artificial Sequence
  Description of Artificial Sequence: Synthetic oligonucleotide
tcaaccgagtgattgacaagcagtccccg

SEQ ID NO: 273370 - DNA, 28 bp, Artificial Sequence
  Description of Artificial Sequence: Synthetic oligonucleotide
caaccgagtgattgacaagcagtccccg

SEQ ID NO: 273371 - DNA, 28 bp, Artificial Sequence
  Description of Artificial Sequence: Synthetic oligonucleotide
aaccgagtgattgacaagcagtccccgc

SEQ ID NO: 273372 - DNA, 27 bp, Artificial Sequence
  Description of Artificial Sequence: Synthetic oligonucleotide
accgagtgattgacaagcagtccccgc

SEQ ID NO: 273373 - DNA, 27 bp, Artificial Sequence
  Description of Artificial Sequence: Synthetic oligonucleotide
ccgagtgattgacaagcagtccccgct

SEQ ID NO: 273374 - DNA, 27 bp, Artificial Sequence
  Description of Artificial Sequence: Synthetic oligonucleotide
cgagtgattgacaagcagtccccgctc

SEQ ID NO: 273375 - DNA, 27 bp, Artificial Sequence
  Description of Artificial Sequence: Synthetic oligonucleotide
gagtgattgacaagcagtccccgctcc

SEQ ID NO: 273376 - DNA, 28 bp, Artificial Sequence
  Description of Artificial Sequence: Synthetic oligonucleotide
agtgattgacaagcagtccccgctccac

SEQ ID NO: 273377 - DNA, 27 bp, Artificial Sequence
  Description of Artificial Sequence: Synthetic oligonucleotide
gtgattgacaagcagtccccgctccac

SEQ ID NO: 273378 - DNA, 27 bp, Artificial Sequence
  Description of Artificial Sequence: Synthetic oligonucleotide
tgattgacaagcagtccccgctccacg

SEQ ID NO: 273379 - DNA, 27 bp, Artificial Sequence
  Description of Artificial Sequence: Synthetic oligonucleotide
gattgacaagcagtccccgctccacga

SEQ ID NO: 273380 - DNA, 27 bp, Artificial Sequence
  Description of Artificial Sequence: Synthetic oligonucleotide
attgacaagcagtccccgctccacgag

SEQ ID NO: 273381 - DNA, 26 bp, Artificial Sequence
  Description of Artificial Sequence: Synthetic oligonucleotide
ttgacaagcagtccccgctccacgag

SEQ ID NO: 273382 - DNA, 25 bp, Artificial Sequence
  Description of Artificial Sequence: Synthetic oligonucleotide
tgacaagcagtccccgctccacgag

SEQ ID NO: 273383 - DNA, 24 bp, Artificial Sequence
  Description of Artificial Sequence: Synthetic oligonucleotide
gacaagcagtccccgctccacgag

SEQ ID NO: 273384 - DNA, 24 bp, Artificial Sequence
  Description of Artificial Sequence: Synthetic oligonucleotide
acaagcagtccccgctccacgagc

SEQ ID NO: 273385 - DNA, 23 bp, Artificial Sequence
  Description of Artificial Sequence: Synthetic oligonucleotide
caagcagtccccgctccacgagc

SEQ ID NO: 273386 - DNA, 23 bp, Artificial Sequence
  Description of Artificial Sequence: Synthetic oligonucleotide
aagcagtccccgctccacgagcg

SEQ ID NO: 273387 - DNA, 22 bp, Artificial Sequence
  Description of Artificial Sequence: Synthetic oligonucleotide
agcagtccccgctccacgagcg

SEQ ID NO: 273388 - DNA, 21 bp, Artificial Sequence
  Description of Artificial Sequence: Synthetic oligonucleotide
gcagtccccgctccacgagcg

SEQ ID NO: 273389 - DNA, 23 bp, Artificial Sequence
  Description of Artificial Sequence: Synthetic oligonucleotide
cagtccccgctccacgagcgctt

SEQ ID NO: 273390 - DNA, 25 bp, Artificial Sequence
  Description of Artificial Sequence: Synthetic oligonucleotide
agtccccgctccacgagcgcttcta

SEQ ID NO: 273391 - DNA, 24 bp, Artificial Sequence
  Description of Artificial Sequence: Synthetic oligonucleotide
gtccccgctccacgagcgcttcta

SEQ ID NO: 273392 - DNA, 25 bp, Artificial Sequence
  Description of Artificial Sequence: Synthetic oligonucleotide
tccccgctccacgagcgcttctact

SEQ ID NO: 273393 - DNA, 24 bp, Artificial Sequence
  Description of Artificial Sequence: Synthetic oligonucleotide
ccccgctccacgagcgcttctact

SEQ ID NO: 273394 - DNA, 25 bp, Artificial Sequence
  Description of Artificial Sequence: Synthetic oligonucleotide
cccgctccacgagcgcttctactgt

SEQ ID NO: 273395 - DNA, 25 bp, Artificial Sequence
  Description of Artificial Sequence: Synthetic oligonucleotide
ccgctccacgagcgcttctactgtg

SEQ ID NO: 273396 - DNA, 26 bp, Artificial Sequence
  Description of Artificial Sequence: Synthetic oligonucleotide
cgctccacgagcgcttctactgtgga

SEQ ID NO: 273397 - DNA, 27 bp, Artificial Sequence
  Description of Artificial Sequence: Synthetic oligonucleotide
gctccacgagcgcttctactgtggact

SEQ ID NO: 273398 - DNA, 27 bp, Artificial Sequence
  Description of Artificial Sequence: Synthetic oligonucleotide
ctccacgagcgcttctactgtggactc

SEQ ID NO: 273399 - DNA, 28 bp, Artificial Sequence
  Description of Artificial Sequence: Synthetic oligonucleotide
tccacgagcgcttctactgtggactctc

SEQ ID NO: 273400 - DNA, 27 bp, Artificial Sequence
  Description of Artificial Sequence: Synthetic oligonucleotide
ccacgagcgcttctactgtggactctc

SEQ ID NO: 273401 - DNA, 28 bp, Artificial Sequence
  Description of Artificial Sequence: Synthetic oligonucleotide
cacgagcgcttctactgtggactctctg

SEQ ID NO: 273402 - DNA, 28 bp, Artificial Sequence
  Description of Artificial Sequence: Synthetic oligonucleotide
acgagcgcttctactgtggactctctgg

SEQ ID NO: 273403 - DNA, 27 bp, Artificial Sequence
  Description of Artificial Sequence: Synthetic oligonucleotide
cgagcgcttctactgtggactctctgg

SEQ ID NO: 273404 - DNA, 29 bp, Artificial Sequence
  Description of Artificial Sequence: Synthetic oligonucleotide
gagcgcttctactgtggactctctggatc

SEQ ID NO: 273405 - DNA, 30 bp, Artificial Sequence
  Description of Artificial Sequence: Synthetic oligonucleotide
agcgcttctactgtggactctctggatcag

SEQ ID NO: 273406 - DNA, 29 bp, Artificial Sequence
  Description of Artificial Sequence: Synthetic oligonucleotide
gcgcttctactgtggactctctggatcag

SEQ ID NO: 273407 - DNA, 29 bp, Artificial Sequence
  Description of Artificial Sequence: Synthetic oligonucleotide
cgcttctactgtggactctctggatcagc

SEQ ID NO: 273408 - DNA, 30 bp, Artificial Sequence
  Description of Artificial Sequence: Synthetic oligonucleotide
gcttctactgtggactctctggatcagctg

SEQ ID NO: 273409 - DNA, 30 bp, Artificial Sequence
  Description of Artificial Sequence: Synthetic oligonucleotide
cttctactgtggactctctggatcagctgc

SEQ ID NO: 273410 - DNA, 31 bp, Artificial Sequence
  Description of Artificial Sequence: Synthetic oligonucleotide
ttctactgtggactctctggatcagctgctc

SEQ ID NO: 273411 - DNA, 30 bp, Artificial Sequence
  Description of Artificial Sequence: Synthetic oligonucleotide
tctactgtggactctctggatcagctgctc

SEQ ID NO: 273412 - DNA, 29 bp, Artificial Sequence
  Description of Artificial Sequence: Synthetic oligonucleotide
ctactgtggactctctggatcagctgctc

SEQ ID NO: 273413 - DNA, 31 bp, Artificial Sequence
  Description of Artificial Sequence: Synthetic oligonucleotide
tactgtggactctctggatcagctgctcatg

SEQ ID NO: 273414 - DNA, 30 bp, Artificial Sequence
  Description of Artificial Sequence: Synthetic oligonucleotide
actgtggactctctggatcagctgctcatg

SEQ ID NO: 273415 - DNA, 29 bp, Artificial Sequence
  Description of Artificial Sequence: Synthetic oligonucleotide
ctgtggactctctggatcagctgctcatg

SEQ ID NO: 273416 - DNA, 29 bp, Artificial Sequence
  Description of Artificial Sequence: Synthetic oligonucleotide
tgtggactctctggatcagctgctcatgc

SEQ ID NO: 273417 - DNA, 28 bp, Artificial Sequence
  Description of Artificial Sequence: Synthetic oligonucleotide
gtggactctctggatcagctgctcatgc

SEQ ID NO: 273418 - DNA, 28 bp, Artificial Sequence
  Description of Artificial Sequence: Synthetic oligonucleotide
tggactctctggatcagctgctcatgcc

SEQ ID NO: 273419 - DNA, 27 bp, Artificial Sequence
  Description of Artificial Sequence: Synthetic oligonucleotide
ggactctctggatcagctgctcatgcc

SEQ ID NO: 273420 - DNA, 27 bp, Artificial Sequence
  Description of Artificial Sequence: Synthetic oligonucleotide
gactctctggatcagctgctcatgccc

SEQ ID NO: 273421 - DNA, 29 bp, Artificial Sequence
  Description of Artificial Sequence: Synthetic oligonucleotide
actctctggatcagctgctcatgcccaag

SEQ ID NO: 273422 - DNA, 28 bp, Artificial Sequence
  Description of Artificial Sequence: Synthetic oligonucleotide
ctctctggatcagctgctcatgcccaag

SEQ ID NO: 273423 - DNA, 28 bp, Artificial Sequence
  Description of Artificial Sequence: Synthetic oligonucleotide
tctctggatcagctgctcatgcccaagg

SEQ ID NO: 273424 - DNA, 27 bp, Artificial Sequence
  Description of Artificial Sequence: Synthetic oligonucleotide
ctctggatcagctgctcatgcccaagg

SEQ ID NO: 273425 - DNA, 27 bp, Artificial Sequence
  Description of Artificial Sequence: Synthetic oligonucleotide
tctggatcagctgctcatgcccaaggc

SEQ ID NO: 273426 - DNA, 26 bp, Artificial Sequence
  Description of Artificial Sequence: Synthetic oligonucleotide
ctggatcagctgctcatgcccaaggc

SEQ ID NO: 273427 - DNA, 27 bp, Artificial Sequence
  Description of Artificial Sequence: Synthetic oligonucleotide
tggatcagctgctcatgcccaaggcgt

SEQ ID NO: 273428 - DNA, 26 bp, Artificial Sequence
  Description of Artificial Sequence: Synthetic oligonucleotide
ggatcagctgctcatgcccaaggcgt

SEQ ID NO: 273429 - DNA, 26 bp, Artificial Sequence
  Description of Artificial Sequence: Synthetic oligonucleotide
gatcagctgctcatgcccaaggcgtg

SEQ ID NO: 273430 - DNA, 26 bp, Artificial Sequence
  Description of Artificial Sequence: Synthetic oligonucleotide
atcagctgctcatgcccaaggcgtgg

SEQ ID NO: 273431 - DNA, 25 bp, Artificial Sequence
  Description of Artificial Sequence: Synthetic oligonucleotide
tcagctgctcatgcccaaggcgtgg

SEQ ID NO: 273432 - DNA, 24 bp, Artificial Sequence
  Description of Artificial Sequence: Synthetic oligonucleotide
cagctgctcatgcccaaggcgtgg

SEQ ID NO: 273433 - DNA, 24 bp, Artificial Sequence
  Description of Artificial Sequence: Synthetic oligonucleotide
agctgctcatgcccaaggcgtggc

SEQ ID NO: 273434 - DNA, 23 bp, Artificial Sequence
  Description of Artificial Sequence: Synthetic oligonucleotide
gctgctcatgcccaaggcgtggc

SEQ ID NO: 273435 - DNA, 23 bp, Artificial Sequence
  Description of Artificial Sequence: Synthetic oligonucleotide
ctgctcatgcccaaggcgtggcc

SEQ ID NO: 273436 - DNA, 24 bp, Artificial Sequence
  Description of Artificial Sequence: Synthetic oligonucleotide
tgctcatgcccaaggcgtggccga

SEQ ID NO: 273437 - DNA, 23 bp, Artificial Sequence
  Description of Artificial Sequence: Synthetic oligonucleotide
gctcatgcccaaggcgtggccga

SEQ ID NO: 273438 - DNA, 25 bp, Artificial Sequence
  Description of Artificial Sequence: Synthetic oligonucleotide
ctcatgcccaaggcgtggccgagat

SEQ ID NO: 273439 - DNA, 25 bp, Artificial Sequence
  Description of Artificial Sequence: Synthetic oligonucleotide
tcatgcccaaggcgtggccgagatg

SEQ ID NO: 273440 - DNA, 24 bp, Artificial Sequence
  Description of Artificial Sequence: Synthetic oligonucleotide
catgcccaaggcgtggccgagatg

SEQ ID NO: 273441 - DNA, 24 bp, Artificial Sequence
  Description of Artificial Sequence: Synthetic oligonucleotide
atgcccaaggcgtggccgagatgg

SEQ ID NO: 273442 - DNA, 23 bp, Artificial Sequence
  Description of Artificial Sequence: Synthetic oligonucleotide
tgcccaaggcgtggccgagatgg

SEQ ID NO: 273443 - DNA, 22 bp, Artificial Sequence
  Description of Artificial Sequence: Synthetic oligonucleotide
gcccaaggcgtggccgagatgg

SEQ ID NO: 273444 - DNA, 22 bp, Artificial Sequence
  Description of Artificial Sequence: Synthetic oligonucleotide
cccaaggcgtggccgagatggc

SEQ ID NO: 273445 - DNA, 22 bp, Artificial Sequence
  Description of Artificial Sequence: Synthetic oligonucleotide
ccaaggcgtggccgagatggcc

SEQ ID NO: 273446 - DNA, 22 bp, Artificial Sequence
  Description of Artificial Sequence: Synthetic oligonucleotide
caaggcgtggccgagatggccg

SEQ ID NO: 273447 - DNA, 22 bp, Artificial Sequence
  Description of Artificial Sequence: Synthetic oligonucleotide
aaggcgtggccgagatggccgc

SEQ ID NO: 273448 - DNA, 21 bp, Artificial Sequence
  Description of Artificial Sequence: Synthetic oligonucleotide
aggcgtggccgagatggccgc

SEQ ID NO: 273449 - DNA, 20 bp, Artificial Sequence
  Description of Artificial Sequence: Synthetic oligonucleotide
ggcgtggccgagatggccgc

SEQ ID NO: 273450 - DNA, 22 bp, Artificial Sequence
  Description of Artificial Sequence: Synthetic oligonucleotide
gcgtggccgagatggccgccaa

SEQ ID NO: 273451 - DNA, 22 bp, Artificial Sequence
  Description of Artificial Sequence: Synthetic oligonucleotide
cgtggccgagatggccgccaac

SEQ ID NO: 273452 - DNA, 23 bp, Artificial Sequence
  Description of Artificial Sequence: Synthetic oligonucleotide
gtggccgagatggccgccaacca

SEQ ID NO: 273453 - DNA, 23 bp, Artificial Sequence
  Description of Artificial Sequence: Synthetic oligonucleotide
tggccgagatggccgccaaccag

SEQ ID NO: 273454 - DNA, 22 bp, Artificial Sequence
  Description of Artificial Sequence: Synthetic oligonucleotide
ggccgagatggccgccaaccag

SEQ ID NO: 273455 - DNA, 23 bp, Artificial Sequence
  Description of Artificial Sequence: Synthetic oligonucleotide
gccgagatggccgccaaccagct

SEQ ID NO: 273456 - DNA, 23 bp, Artificial Sequence
  Description of Artificial Sequence: Synthetic oligonucleotide
ccgagatggccgccaaccagctg

SEQ ID NO: 273457 - DNA, 24 bp, Artificial Sequence
  Description of Artificial Sequence: Synthetic oligonucleotide
cgagatggccgccaaccagctggt

SEQ ID NO: 273458 - DNA, 24 bp, Artificial Sequence
  Description of Artificial Sequence: Synthetic oligonucleotide
gagatggccgccaaccagctggtg

SEQ ID NO: 273459 - DNA, 25 bp, Artificial Sequence
  Description of Artificial Sequence: Synthetic oligonucleotide
agatggccgccaaccagctggtgct

SEQ ID NO: 273460 - DNA, 24 bp, Artificial Sequence
  Description of Artificial Sequence: Synthetic oligonucleotide
gatggccgccaaccagctggtgct

SEQ ID NO: 273461 - DNA, 24 bp, Artificial Sequence
  Description of Artificial Sequence: Synthetic oligonucleotide
atggccgccaaccagctggtgctc

SEQ ID NO: 273462 - DNA, 23 bp, Artificial Sequence
  Description of Artificial Sequence: Synthetic oligonucleotide
tggccgccaaccagctggtgctc

SEQ ID NO: 273463 - DNA, 22 bp, Artificial Sequence
  Description of Artificial Sequence: Synthetic oligonucleotide
ggccgccaaccagctggtgctc

SEQ ID NO: 273464 - DNA, 24 bp, Artificial Sequence
  Description of Artificial Sequence: Synthetic oligonucleotide
gccgccaaccagctggtgctccat

SEQ ID NO: 273465 - DNA, 24 bp, Artificial Sequence
  Description of Artificial Sequence: Synthetic oligonucleotide
ccgccaaccagctggtgctccatg

SEQ ID NO: 273466 - DNA, 24 bp, Artificial Sequence
  Description of Artificial Sequence: Synthetic oligonucleotide
cgccaaccagctggtgctccatgg

SEQ ID NO: 273467 - DNA, 27 bp, Artificial Sequence
  Description of Artificial Sequence: Synthetic oligonucleotide
gccaaccagctggtgctccatggcata

SEQ ID NO: 273468 - DNA, 27 bp, Artificial Sequence
  Description of Artificial Sequence: Synthetic oligonucleotide
ccaaccagctggtgctccatggcatag

SEQ ID NO: 273469 - DNA, 29 bp, Artificial Sequence
  Description of Artificial Sequence: Synthetic oligonucleotide
caaccagctggtgctccatggcatagaac

SEQ ID NO: 273470 - DNA, 30 bp, Artificial Sequence
  Description of Artificial Sequence: Synthetic oligonucleotide
aaccagctggtgctccatggcatagaactg

SEQ ID NO: 273471 - DNA, 29 bp, Artificial Sequence
  Description of Artificial Sequence: Synthetic oligonucleotide
accagctggtgctccatggcatagaactg

SEQ ID NO: 273472 - DNA, 28 bp, Artificial Sequence
  Description of Artificial Sequence: Synthetic oligonucleotide
ccagctggtgctccatggcatagaactg

SEQ ID NO: 273473 - DNA, 28 bp, Artificial Sequence
  Description of Artificial Sequence: Synthetic oligonucleotide
cagctggtgctccatggcatagaactgc

SEQ ID NO: 273474 - DNA, 29 bp, Artificial Sequence
  Description of Artificial Sequence: Synthetic oligonucleotide
agctggtgctccatggcatagaactgcag

SEQ ID NO: 273475 - DNA, 28 bp, Artificial Sequence
  Description of Artificial Sequence: Synthetic oligonucleotide
gctggtgctccatggcatagaactgcag

SEQ ID NO: 273476 - DNA, 28 bp, Artificial Sequence
  Description of Artificial Sequence: Synthetic oligonucleotide
ctggtgctccatggcatagaactgcagg

SEQ ID NO: 273477 - DNA, 30 bp, Artificial Sequence
  Description of Artificial Sequence: Synthetic oligonucleotide
tggtgctccatggcatagaactgcaggaac

SEQ ID NO: 273478 - DNA, 29 bp, Artificial Sequence
  Description of Artificial Sequence: Synthetic oligonucleotide
ggtgctccatggcatagaactgcaggaac

SEQ ID NO: 273479 - DNA, 29 bp, Artificial Sequence
  Description of Artificial Sequence: Synthetic oligonucleotide
gtgctccatggcatagaactgcaggaacc

SEQ ID NO: 273480 - DNA, 30 bp, Artificial Sequence
  Description of Artificial Sequence: Synthetic oligonucleotide
tgctccatggcatagaactgcaggaacctc

SEQ ID NO: 273481 - DNA, 29 bp, Artificial Sequence
  Description of Artificial Sequence: Synthetic oligonucleotide
gctccatggcatagaactgcaggaacctc

SEQ ID NO: 273482 - DNA, 29 bp, Artificial Sequence
  Description of Artificial Sequence: Synthetic oligonucleotide
ctccatggcatagaactgcaggaacctcg

SEQ ID NO: 273483 - DNA, 30 bp, Artificial Sequence
  Description of Artificial Sequence: Synthetic oligonucleotide
tccatggcatagaactgcaggaacctcgac

SEQ ID NO: 273484 - DNA, 29 bp, Artificial Sequence
  Description of Artificial Sequence: Synthetic oligonucleotide
ccatggcatagaactgcaggaacctcgac

SEQ ID NO: 273485 - DNA, 31 bp, Artificial Sequence
  Description of Artificial Sequence: Synthetic oligonucleotide
catggcatagaactgcaggaacctcgacttg

SEQ ID NO: 273486 - DNA, 35 bp, Artificial Sequence
  Description of Artificial Sequence: Synthetic oligonucleotide
atggcatagaactgcaggaacctcgacttgttttc

SEQ ID NO: 273487 - DNA, 34 bp, Artificial Sequence
  Description of Artificial Sequence: Synthetic oligonucleotide
tggcatagaactgcaggaacctcgacttgttttc

SEQ ID NO: 273488 - DNA, 33 bp, Artificial Sequence
  Description of Artificial Sequence: Synthetic oligonucleotide
ggcatagaactgcaggaacctcgacttgttttc

SEQ ID NO: 273489 - DNA, 33 bp, Artificial Sequence
  Description of Artificial Sequence: Synthetic oligonucleotide
gcatagaactgcaggaacctcgacttgttttcg

SEQ ID NO: 273490 - DNA, 33 bp, Artificial Sequence
  Description of Artificial Sequence: Synthetic oligonucleotide
catagaactgcaggaacctcgacttgttttcgc

SEQ ID NO: 273491 - DNA, 34 bp, Artificial Sequence
  Description of Artificial Sequence: Synthetic oligonucleotide
atagaactgcaggaacctcgacttgttttcgctg

SEQ ID NO: 273492 - DNA, 33 bp, Artificial Sequence
  Description of Artificial Sequence: Synthetic oligonucleotide
tagaactgcaggaacctcgacttgttttcgctg

SEQ ID NO: 273493 - DNA, 32 bp, Artificial Sequence
  Description of Artificial Sequence: Synthetic oligonucleotide
agaactgcaggaacctcgacttgttttcgctg

SEQ ID NO: 273494 - DNA, 31 bp, Artificial Sequence
  Description of Artificial Sequence: Synthetic oligonucleotide
gaactgcaggaacctcgacttgttttcgctg

SEQ ID NO: 273495 - DNA, 31 bp, Artificial Sequence
  Description of Artificial Sequence: Synthetic oligonucleotide
aactgcaggaacctcgacttgttttcgctgc

SEQ ID NO: 273496 - DNA, 30 bp, Artificial Sequence
  Description of Artificial Sequence: Synthetic oligonucleotide
actgcaggaacctcgacttgttttcgctgc

SEQ ID NO: 273497 - DNA, 29 bp, Artificial Sequence
  Description of Artificial Sequence: Synthetic oligonucleotide
ctgcaggaacctcgacttgttttcgctgc

SEQ ID NO: 273498 - DNA, 30 bp, Artificial Sequence
  Description of Artificial Sequence: Synthetic oligonucleotide
tgcaggaacctcgacttgttttcgctgctg

SEQ ID NO: 273499 - DNA, 29 bp, Artificial Sequence
  Description of Artificial Sequence: Synthetic oligonucleotide
gcaggaacctcgacttgttttcgctgctg

SEQ ID NO: 273500 - DNA, 29 bp, Artificial Sequence
  Description of Artificial Sequence: Synthetic oligonucleotide
caggaacctcgacttgttttcgctgctgc

SEQ ID NO: 273501 - DNA, 33 bp, Artificial Sequence
  Description of Artificial Sequence: Synthetic oligonucleotide
aggaacctcgacttgttttcgctgctgcatatg

SEQ ID NO: 273502 - DNA, 32 bp, Artificial Sequence
  Description of Artificial Sequence: Synthetic oligonucleotide
ggaacctcgacttgttttcgctgctgcatatg

SEQ ID NO: 273503 - DNA, 33 bp, Artificial Sequence
  Description of Artificial Sequence: Synthetic oligonucleotide
gaacctcgacttgttttcgctgctgcatatgtg

SEQ ID NO: 273504 - DNA, 33 bp, Artificial Sequence
  Description of Artificial Sequence: Synthetic oligonucleotide
aacctcgacttgttttcgctgctgcatatgtgg

SEQ ID NO: 273505 - DNA, 32 bp, Artificial Sequence
  Description of Artificial Sequence: Synthetic oligonucleotide
acctcgacttgttttcgctgctgcatatgtgg

SEQ ID NO: 273506 - DNA, 31 bp, Artificial Sequence
  Description of Artificial Sequence: Synthetic oligonucleotide
cctcgacttgttttcgctgctgcatatgtgg

SEQ ID NO: 273507 - DNA, 32 bp, Artificial Sequence
  Description of Artificial Sequence: Synthetic oligonucleotide
ctcgacttgttttcgctgctgcatatgtggtg

SEQ ID NO: 273508 - DNA, 33 bp, Artificial Sequence
  Description of Artificial Sequence: Synthetic oligonucleotide
tcgacttgttttcgctgctgcatatgtggtgac

SEQ ID NO: 273509 - DNA, 32 bp, Artificial Sequence
  Description of Artificial Sequence: Synthetic oligonucleotide
cgacttgttttcgctgctgcatatgtggtgac

SEQ ID NO: 273510 - DNA, 38 bp, Artificial Sequence
  Description of Artificial Sequence: Synthetic oligonucleotide
gacttgttttcgctgctgcatatgtggtgacaaatatc

SEQ ID NO: 273511 - DNA, 39 bp, Artificial Sequence
  Description of Artificial Sequence: Synthetic oligonucleotide
acttgttttcgctgctgcatatgtggtgacaaatatcag

SEQ ID NO: 273512 - DNA, 38 bp, Artificial Sequence
  Description of Artificial Sequence: Synthetic oligonucleotide
cttgttttcgctgctgcatatgtggtgacaaatatcag

SEQ ID NO: 273513 - DNA, 38 bp, Artificial Sequence
  Description of Artificial Sequence: Synthetic oligonucleotide
ttgttttcgctgctgcatatgtggtgacaaatatcagg

SEQ ID NO: 273514 - DNA, 37 bp, Artificial Sequence
  Description of Artificial Sequence: Synthetic oligonucleotide
tgttttcgctgctgcatatgtggtgacaaatatcagg

SEQ ID NO: 273515 - DNA, 36 bp, Artificial Sequence
  Description of Artificial Sequence: Synthetic oligonucleotide
gttttcgctgctgcatatgtggtgacaaatatcagg

SEQ ID NO: 273516 - DNA, 45 bp, Artificial Sequence
  Description of Artificial Sequence: Synthetic oligonucleotide
ttttcgctgctgcatatgtggtgacaaatatcaggtataaatatg

SEQ ID NO: 273517 - DNA, 44 bp, Artificial Sequence
  Description of Artificial Sequence: Synthetic oligonucleotide
tttcgctgctgcatatgtggtgacaaatatcaggtataaatatg

SEQ ID NO: 273518 - DNA, 43 bp, Artificial Sequence
  Description of Artificial Sequence: Synthetic oligonucleotide
ttcgctgctgcatatgtggtgacaaatatcaggtataaatatg

SEQ ID NO: 273519 - DNA, 42 bp, Artificial Sequence
  Description of Artificial Sequence: Synthetic oligonucleotide
tcgctgctgcatatgtggtgacaaatatcaggtataaatatg

SEQ ID NO: 273520 - DNA, 41 bp, Artificial Sequence
  Description of Artificial Sequence: Synthetic oligonucleotide
cgctgctgcatatgtggtgacaaatatcaggtataaatatg

SEQ ID NO: 273521 - DNA, 41 bp, Artificial Sequence
  Description of Artificial Sequence: Synthetic oligonucleotide
gctgctgcatatgtggtgacaaatatcaggtataaatatgg

SEQ ID NO: 273522 - DNA, 42 bp, Artificial Sequence
  Description of Artificial Sequence: Synthetic oligonucleotide
ctgctgcatatgtggtgacaaatatcaggtataaatatggag

SEQ ID NO: 273523 - DNA, 43 bp, Artificial Sequence
  Description of Artificial Sequence: Synthetic oligonucleotide
tgctgcatatgtggtgacaaatatcaggtataaatatggagag

SEQ ID NO: 273524 - DNA, 42 bp, Artificial Sequence
  Description of Artificial Sequence: Synthetic oligonucleotide
gctgcatatgtggtgacaaatatcaggtataaatatggagag

SEQ ID NO: 273525 - DNA, 42 bp, Artificial Sequence
  Description of Artificial Sequence: Synthetic oligonucleotide
ctgcatatgtggtgacaaatatcaggtataaatatggagagg

SEQ ID NO: 273526 - DNA, 43 bp, Artificial Sequence
  Description of Artificial Sequence: Synthetic oligonucleotide
tgcatatgtggtgacaaatatcaggtataaatatggagaggac

SEQ ID NO: 273527 - DNA, 42 bp, Artificial Sequence
  Description of Artificial Sequence: Synthetic oligonucleotide
gcatatgtggtgacaaatatcaggtataaatatggagaggac

SEQ ID NO: 273528 - DNA, 44 bp, Artificial Sequence
  Description of Artificial Sequence: Synthetic oligonucleotide
catatgtggtgacaaatatcaggtataaatatggagaggactag

SEQ ID NO: 273529 - DNA, 45 bp, Artificial Sequence
  Description of Artificial Sequence: Synthetic oligonucleotide
atatgtggtgacaaatatcaggtataaatatggagaggactagtc

SEQ ID NO: 273530 - DNA, 44 bp, Artificial Sequence
  Description of Artificial Sequence: Synthetic oligonucleotide
tatgtggtgacaaatatcaggtataaatatggagaggactagtc

SEQ ID NO: 273531 - DNA, 43 bp, Artificial Sequence
  Description of Artificial Sequence: Synthetic oligonucleotide
atgtggtgacaaatatcaggtataaatatggagaggactagtc

SEQ ID NO: 273532 - DNA, 42 bp, Artificial Sequence
  Description of Artificial Sequence: Synthetic oligonucleotide
tgtggtgacaaatatcaggtataaatatggagaggactagtc

SEQ ID NO: 273533 - DNA, 41 bp, Artificial Sequence
  Description of Artificial Sequence: Synthetic oligonucleotide
gtggtgacaaatatcaggtataaatatggagaggactagtc

SEQ ID NO: 273534 - DNA, 42 bp, Artificial Sequence
  Description of Artificial Sequence: Synthetic oligonucleotide
tggtgacaaatatcaggtataaatatggagaggactagtctg

SEQ ID NO: 273535 - DNA, 41 bp, Artificial Sequence
  Description of Artificial Sequence: Synthetic oligonucleotide
ggtgacaaatatcaggtataaatatggagaggactagtctg

SEQ ID NO: 273536 - DNA, 41 bp, Artificial Sequence
  Description of Artificial Sequence: Synthetic oligonucleotide
gtgacaaatatcaggtataaatatggagaggactagtctgc

SEQ ID NO: 273537 - DNA, 42 bp, Artificial Sequence
  Description of Artificial Sequence: Synthetic oligonucleotide
tgacaaatatcaggtataaatatggagaggactagtctgcac

SEQ ID NO: 273538 - DNA, 41 bp, Artificial Sequence
  Description of Artificial Sequence: Synthetic oligonucleotide
gacaaatatcaggtataaatatggagaggactagtctgcac

SEQ ID NO: 273539 - DNA, 43 bp, Artificial Sequence
  Description of Artificial Sequence: Synthetic oligonucleotide
acaaatatcaggtataaatatggagaggactagtctgcacaac

SEQ ID NO: 273540 - DNA, 42 bp, Artificial Sequence
  Description of Artificial Sequence: Synthetic oligonucleotide
caaatatcaggtataaatatggagaggactagtctgcacaac

SEQ ID NO: 273541 - DNA, 43 bp, Artificial Sequence
  Description of Artificial Sequence: Synthetic oligonucleotide
aaatatcaggtataaatatggagaggactagtctgcacaactc

SEQ ID NO: 273542 - DNA, 42 bp, Artificial Sequence
  Description of Artificial Sequence: Synthetic oligonucleotide
aatatcaggtataaatatggagaggactagtctgcacaactc

SEQ ID NO: 273543 - DNA, 41 bp, Artificial Sequence
  Description of Artificial Sequence: Synthetic oligonucleotide
atatcaggtataaatatggagaggactagtctgcacaactc

SEQ ID NO: 273544 - DNA, 40 bp, Artificial Sequence
  Description of Artificial Sequence: Synthetic oligonucleotide
tatcaggtataaatatggagaggactagtctgcacaactc

SEQ ID NO: 273545 - DNA, 39 bp, Artificial Sequence
  Description of Artificial Sequence: Synthetic oligonucleotide
atcaggtataaatatggagaggactagtctgcacaactc

SEQ ID NO: 273546 - DNA, 38 bp, Artificial Sequence
  Description of Artificial Sequence: Synthetic oligonucleotide
tcaggtataaatatggagaggactagtctgcacaactc

SEQ ID NO: 273547 - DNA, 37 bp, Artificial Sequence
  Description of Artificial Sequence: Synthetic oligonucleotide
caggtataaatatggagaggactagtctgcacaactc

SEQ ID NO: 273548 - DNA, 39 bp, Artificial Sequence
  Description of Artificial Sequence: Synthetic oligonucleotide
aggtataaatatggagaggactagtctgcacaactcatg

SEQ ID NO: 273549 - DNA, 38 bp, Artificial Sequence
  Description of Artificial Sequence: Synthetic oligonucleotide
ggtataaatatggagaggactagtctgcacaactcatg

SEQ ID NO: 273550 - DNA, 38 bp, Artificial Sequence
  Description of Artificial Sequence: Synthetic oligonucleotide
gtataaatatggagaggactagtctgcacaactcatgg

SEQ ID NO: 273551 - DNA, 40 bp, Artificial Sequence
  Description of Artificial Sequence: Synthetic oligonucleotide
tataaatatggagaggactagtctgcacaactcatggtac

SEQ ID NO: 273552 - DNA, 39 bp, Artificial Sequence
  Description of Artificial Sequence: Synthetic oligonucleotide
ataaatatggagaggactagtctgcacaactcatggtac

SEQ ID NO: 273553 - DNA, 38 bp, Artificial Sequence
  Description of Artificial Sequence: Synthetic oligonucleotide
taaatatggagaggactagtctgcacaactcatggtac

SEQ ID NO: 273554 - DNA, 37 bp, Artificial Sequence
  Description of Artificial Sequence: Synthetic oligonucleotide
aaatatggagaggactagtctgcacaactcatggtac

SEQ ID NO: 273555 - DNA, 36 bp, Artificial Sequence
  Description of Artificial Sequence: Synthetic oligonucleotide
aatatggagaggactagtctgcacaactcatggtac

SEQ ID NO: 273556 - DNA, 35 bp, Artificial Sequence
  Description of Artificial Sequence: Synthetic oligonucleotide
atatggagaggactagtctgcacaactcatggtac

SEQ ID NO: 273557 - DNA, 34 bp, Artificial Sequence
  Description of Artificial Sequence: Synthetic oligonucleotide
tatggagaggactagtctgcacaactcatggtac

SEQ ID NO: 273558 - DNA, 33 bp, Artificial Sequence
  Description of Artificial Sequence: Synthetic oligonucleotide
atggagaggactagtctgcacaactcatggtac

SEQ ID NO: 273559 - DNA, 32 bp, Artificial Sequence
  Description of Artificial Sequence: Synthetic oligonucleotide
tggagaggactagtctgcacaactcatggtac

SEQ ID NO: 273560 - DNA, 31 bp, Artificial Sequence
  Description of Artificial Sequence: Synthetic oligonucleotide
ggagaggactagtctgcacaactcatggtac

SEQ ID NO: 273561 - DNA, 31 bp, Artificial Sequence
  Description of Artificial Sequence: Synthetic oligonucleotide
gagaggactagtctgcacaactcatggtacc

SEQ ID NO: 273562 - DNA, 32 bp, Artificial Sequence
  Description of Artificial Sequence: Synthetic oligonucleotide
agaggactagtctgcacaactcatggtacctg

SEQ ID NO: 273563 - DNA, 31 bp, Artificial Sequence
  Description of Artificial Sequence: Synthetic oligonucleotide
gaggactagtctgcacaactcatggtacctg

SEQ ID NO: 273564 - DNA, 31 bp, Artificial Sequence
  Description of Artificial Sequence: Synthetic oligonucleotide
aggactagtctgcacaactcatggtacctgg

SEQ ID NO: 273565 - DNA, 30 bp, Artificial Sequence
  Description of Artificial Sequence: Synthetic oligonucleotide
ggactagtctgcacaactcatggtacctgg

SEQ ID NO: 273566 - DNA, 30 bp, Artificial Sequence
  Description of Artificial Sequence: Synthetic oligonucleotide
gactagtctgcacaactcatggtacctggc

SEQ ID NO: 273567 - DNA, 31 bp, Artificial Sequence
  Description of Artificial Sequence: Synthetic oligonucleotide
actagtctgcacaactcatggtacctggctg

SEQ ID NO: 273568 - DNA, 30 bp, Artificial Sequence
  Description of Artificial Sequence: Synthetic oligonucleotide
ctagtctgcacaactcatggtacctggctg

SEQ ID NO: 273569 - DNA, 30 bp, Artificial Sequence
  Description of Artificial Sequence: Synthetic oligonucleotide
tagtctgcacaactcatggtacctggctgg

SEQ ID NO: 273570 - DNA, 29 bp, Artificial Sequence
  Description of Artificial Sequence: Synthetic oligonucleotide
agtctgcacaactcatggtacctggctgg

SEQ ID NO: 273571 - DNA, 28 bp, Artificial Sequence
  Description of Artificial Sequence: Synthetic oligonucleotide
gtctgcacaactcatggtacctggctgg

SEQ ID NO: 273572 - DNA, 28 bp, Artificial Sequence
  Description of Artificial Sequence: Synthetic oligonucleotide
tctgcacaactcatggtacctggctggg

SEQ ID NO: 273573 - DNA, 27 bp, Artificial Sequence
  Description of Artificial Sequence: Synthetic oligonucleotide
ctgcacaactcatggtacctggctggg

SEQ ID NO: 273574 - DNA, 28 bp, Artificial Sequence
  Description of Artificial Sequence: Synthetic oligonucleotide
tgcacaactcatggtacctggctgggtc

SEQ ID NO: 273575 - DNA, 27 bp, Artificial Sequence
  Description of Artificial Sequence: Synthetic oligonucleotide
gcacaactcatggtacctggctgggtc

SEQ ID NO: 273576 - DNA, 27 bp, Artificial Sequence
  Description of Artificial Sequence: Synthetic oligonucleotide
cacaactcatggtacctggctgggtcc

SEQ ID NO: 273577 - DNA, 29 bp, Artificial Sequence
  Description of Artificial Sequence: Synthetic oligonucleotide
acaactcatggtacctggctgggtccaac

SEQ ID NO: 273578 - DNA, 28 bp, Artificial Sequence
  Description of Artificial Sequence: Synthetic oligonucleotide
caactcatggtacctggctgggtccaac

SEQ ID NO: 273579 - DNA, 28 bp, Artificial Sequence
  Description of Artificial Sequence: Synthetic oligonucleotide
aactcatggtacctggctgggtccaacg

SEQ ID NO: 273580 - DNA, 27 bp, Artificial Sequence
  Description of Artificial Sequence: Synthetic oligonucleotide
actcatggtacctggctgggtccaacg

SEQ ID NO: 273581 - DNA, 27 bp, Artificial Sequence
  Description of Artificial Sequence: Synthetic oligonucleotide
ctcatggtacctggctgggtccaacgt

SEQ ID NO: 273582 - DNA, 27 bp, Artificial Sequence
  Description of Artificial Sequence: Synthetic oligonucleotide
tcatggtacctggctgggtccaacgtg

SEQ ID NO: 273583 - DNA, 27 bp, Artificial Sequence
  Description of Artificial Sequence: Synthetic oligonucleotide
catggtacctggctgggtccaacgtga

SEQ ID NO: 273584 - DNA, 28 bp, Artificial Sequence
  Description of Artificial Sequence: Synthetic oligonucleotide
atggtacctggctgggtccaacgtgatg

SEQ ID NO: 273585 - DNA, 27 bp, Artificial Sequence
  Description of Artificial Sequence: Synthetic oligonucleotide
tggtacctggctgggtccaacgtgatg

SEQ ID NO: 273586 - DNA, 26 bp, Artificial Sequence
  Description of Artificial Sequence: Synthetic oligonucleotide
ggtacctggctgggtccaacgtgatg

SEQ ID NO: 273587 - DNA, 27 bp, Artificial Sequence
  Description of Artificial Sequence: Synthetic oligonucleotide
gtacctggctgggtccaacgtgatgga

SEQ ID NO: 273588 - DNA, 27 bp, Artificial Sequence
  Description of Artificial Sequence: Synthetic oligonucleotide
tacctggctgggtccaacgtgatggag

SEQ ID NO: 273589 - DNA, 26 bp, Artificial Sequence
  Description of Artificial Sequence: Synthetic oligonucleotide
acctggctgggtccaacgtgatggag

SEQ ID NO: 273590 - DNA, 25 bp, Artificial Sequence
  Description of Artificial Sequence: Synthetic oligonucleotide
cctggctgggtccaacgtgatggag

SEQ ID NO: 273591 - DNA, 26 bp, Artificial Sequence
  Description of Artificial Sequence: Synthetic oligonucleotide
ctggctgggtccaacgtgatggaggt

SEQ ID NO: 273592 - DNA, 27 bp, Artificial Sequence
  Description of Artificial Sequence: Synthetic oligonucleotide
tggctgggtccaacgtgatggaggtca

SEQ ID NO: 273593 - DNA, 26 bp, Artificial Sequence
  Description of Artificial Sequence: Synthetic oligonucleotide
ggctgggtccaacgtgatggaggtca

SEQ ID NO: 273594 - DNA, 26 bp, Artificial Sequence
  Description of Artificial Sequence: Synthetic oligonucleotide
gctgggtccaacgtgatggaggtcag

SEQ ID NO: 273595 - DNA, 27 bp, Artificial Sequence
  Description of Artificial Sequence: Synthetic oligonucleotide
ctgggtccaacgtgatggaggtcagct

SEQ ID NO: 273596 - DNA, 31 bp, Artificial Sequence
  Description of Artificial Sequence: Synthetic oligonucleotide
tgggtccaacgtgatggaggtcagctatatg

SEQ ID NO: 273597 - DNA, 30 bp, Artificial Sequence
  Description of Artificial Sequence: Synthetic oligonucleotide
gggtccaacgtgatggaggtcagctatatg

SEQ ID NO: 273598 - DNA, 30 bp, Artificial Sequence
  Description of Artificial Sequence: Synthetic oligonucleotide
ggtccaacgtgatggaggtcagctatatgg

SEQ ID NO: 273599 - DNA, 32 bp, Artificial Sequence
  Description of Artificial Sequence: Synthetic oligonucleotide
gtccaacgtgatggaggtcagctatatggaag

SEQ ID NO: 273600 - DNA, 32 bp, Artificial Sequence
  Description of Artificial Sequence: Synthetic oligonucleotide
tccaacgtgatggaggtcagctatatggaagc

SEQ ID NO: 273601 - DNA, 31 bp, Artificial Sequence
  Description of Artificial Sequence: Synthetic oligonucleotide
ccaacgtgatggaggtcagctatatggaagc

SEQ ID NO: 273602 - DNA, 31 bp, Artificial Sequence
  Description of Artificial Sequence: Synthetic oligonucleotide
caacgtgatggaggtcagctatatggaagcc

SEQ ID NO: 273603 - DNA, 32 bp, Artificial Sequence
  Description of Artificial Sequence: Synthetic oligonucleotide
aacgtgatggaggtcagctatatggaagcctg

SEQ ID NO: 273604 - DNA, 31 bp, Artificial Sequence
  Description of Artificial Sequence: Synthetic oligonucleotide
acgtgatggaggtcagctatatggaagcctg

SEQ ID NO: 273605 - DNA, 30 bp, Artificial Sequence
  Description of Artificial Sequence: Synthetic oligonucleotide
cgtgatggaggtcagctatatggaagcctg

SEQ ID NO: 273606 - DNA, 30 bp, Artificial Sequence
  Description of Artificial Sequence: Synthetic oligonucleotide
gtgatggaggtcagctatatggaagcctgg

SEQ ID NO: 273607 - DNA, 30 bp, Artificial Sequence
  Description of Artificial Sequence: Synthetic oligonucleotide
tgatggaggtcagctatatggaagcctggg

SEQ ID NO: 273608 - DNA, 29 bp, Artificial Sequence
  Description of Artificial Sequence: Synthetic oligonucleotide
gatggaggtcagctatatggaagcctggg

SEQ ID NO: 273609 - DNA, 30 bp, Artificial Sequence
  Description of Artificial Sequence: Synthetic oligonucleotide
atggaggtcagctatatggaagcctgggag

SEQ ID NO: 273610 - DNA, 29 bp, Artificial Sequence
  Description of Artificial Sequence: Synthetic oligonucleotide
tggaggtcagctatatggaagcctgggag

SEQ ID NO: 273611 - DNA, 28 bp, Artificial Sequence
  Description of Artificial Sequence: Synthetic oligonucleotide
ggaggtcagctatatggaagcctgggag

SEQ ID NO: 273612 - DNA, 28 bp, Artificial Sequence
  Description of Artificial Sequence: Synthetic oligonucleotide
gaggtcagctatatggaagcctgggagg

SEQ ID NO: 273613 - DNA, 31 bp, Artificial Sequence
  Description of Artificial Sequence: Synthetic oligonucleotide
aggtcagctatatggaagcctgggaggtatg

SEQ ID NO: 273614 - DNA, 30 bp, Artificial Sequence
  Description of Artificial Sequence: Synthetic oligonucleotide
ggtcagctatatggaagcctgggaggtatg

SEQ ID NO: 273615 - DNA, 30 bp, Artificial Sequence
  Description of Artificial Sequence: Synthetic oligonucleotide
gtcagctatatggaagcctgggaggtatgc

SEQ ID NO: 273616 - DNA, 31 bp, Artificial Sequence
  Description of Artificial Sequence: Synthetic oligonucleotide
tcagctatatggaagcctgggaggtatgctg

SEQ ID NO: 273617 - DNA, 30 bp, Artificial Sequence
  Description of Artificial Sequence: Synthetic oligonucleotide
cagctatatggaagcctgggaggtatgctg

SEQ ID NO: 273618 - DNA, 31 bp, Artificial Sequence
  Description of Artificial Sequence: Synthetic oligonucleotide
agctatatggaagcctgggaggtatgctgac

SEQ ID NO: 273619 - DNA, 30 bp, Artificial Sequence
  Description of Artificial Sequence: Synthetic oligonucleotide
gctatatggaagcctgggaggtatgctgac

SEQ ID NO: 273620 - DNA, 31 bp, Artificial Sequence
  Description of Artificial Sequence: Synthetic oligonucleotide
ctatatggaagcctgggaggtatgctgactg

SEQ ID NO: 273621 - DNA, 31 bp, Artificial Sequence
  Description of Artificial Sequence: Synthetic oligonucleotide
tatatggaagcctgggaggtatgctgactgg

SEQ ID NO: 273622 - DNA, 30 bp, Artificial Sequence
  Description of Artificial Sequence: Synthetic oligonucleotide
atatggaagcctgggaggtatgctgactgg

SEQ ID NO: 273623 - DNA, 29 bp, Artificial Sequence
  Description of Artificial Sequence: Synthetic oligonucleotide
tatggaagcctgggaggtatgctgactgg

SEQ ID NO: 273624 - DNA, 28 bp, Artificial Sequence
  Description of Artificial Sequence: Synthetic oligonucleotide
atggaagcctgggaggtatgctgactgg

SEQ ID NO: 273625 - DNA, 27 bp, Artificial Sequence
  Description of Artificial Sequence: Synthetic oligonucleotide
tggaagcctgggaggtatgctgactgg

SEQ ID NO: 273626 - DNA, 27 bp, Artificial Sequence
  Description of Artificial Sequence: Synthetic oligonucleotide
ggaagcctgggaggtatgctgactgga

SEQ ID NO: 273627 - DNA, 27 bp, Artificial Sequence
  Description of Artificial Sequence: Synthetic oligonucleotide
gaagcctgggaggtatgctgactggac

SEQ ID NO: 273628 - DNA, 28 bp, Artificial Sequence
  Description of Artificial Sequence: Synthetic oligonucleotide
aagcctgggaggtatgctgactggacag

SEQ ID NO: 273629 - DNA, 27 bp, Artificial Sequence
  Description of Artificial Sequence: Synthetic oligonucleotide
agcctgggaggtatgctgactggacag

SEQ ID NO: 273630 - DNA, 26 bp, Artificial Sequence
  Description of Artificial Sequence: Synthetic oligonucleotide
gcctgggaggtatgctgactggacag

SEQ ID NO: 273631 - DNA, 26 bp, Artificial Sequence
  Description of Artificial Sequence: Synthetic oligonucleotide
cctgggaggtatgctgactggacagc

SEQ ID NO: 273632 - DNA, 27 bp, Artificial Sequence
  Description of Artificial Sequence: Synthetic oligonucleotide
ctgggaggtatgctgactggacagcct

SEQ ID NO: 273633 - DNA, 30 bp, Artificial Sequence
  Description of Artificial Sequence: Synthetic oligonucleotide
tgggaggtatgctgactggacagccttatg

SEQ ID NO: 273634 - DNA, 29 bp, Artificial Sequence
  Description of Artificial Sequence: Synthetic oligonucleotide
gggaggtatgctgactggacagccttatg

SEQ ID NO: 273635 - DNA, 29 bp, Artificial Sequence
  Description of Artificial Sequence: Synthetic oligonucleotide
ggaggtatgctgactggacagccttatgc

SEQ ID NO: 273636 - DNA, 29 bp, Artificial Sequence
  Description of Artificial Sequence: Synthetic oligonucleotide
gaggtatgctgactggacagccttatgcc

SEQ ID NO: 273637 - DNA, 32 bp, Artificial Sequence
  Description of Artificial Sequence: Synthetic oligonucleotide
aggtatgctgactggacagccttatgccattg

SEQ ID NO: 273638 - DNA, 31 bp, Artificial Sequence
  Description of Artificial Sequence: Synthetic oligonucleotide
ggtatgctgactggacagccttatgccattg

SEQ ID NO: 273639 - DNA, 31 bp, Artificial Sequence
  Description of Artificial Sequence: Synthetic oligonucleotide
gtatgctgactggacagccttatgccattgg

SEQ ID NO: 273640 - DNA, 32 bp, Artificial Sequence
  Description of Artificial Sequence: Synthetic oligonucleotide
tatgctgactggacagccttatgccattggag

SEQ ID NO: 273641 - DNA, 31 bp, Artificial Sequence
  Description of Artificial Sequence: Synthetic oligonucleotide
atgctgactggacagccttatgccattggag

SEQ ID NO: 273642 - DNA, 30 bp, Artificial Sequence
  Description of Artificial Sequence: Synthetic oligonucleotide
tgctgactggacagccttatgccattggag

SEQ ID NO: 273643 - DNA, 29 bp, Artificial Sequence
  Description of Artificial Sequence: Synthetic oligonucleotide
gctgactggacagccttatgccattggag

SEQ ID NO: 273644 - DNA, 29 bp, Artificial Sequence
  Description of Artificial Sequence: Synthetic oligonucleotide
ctgactggacagccttatgccattggagg

SEQ ID NO: 273645 - DNA, 29 bp, Artificial Sequence
  Description of Artificial Sequence: Synthetic oligonucleotide
tgactggacagccttatgccattggaggc

SEQ ID NO: 273646 - DNA, 28 bp, Artificial Sequence
  Description of Artificial Sequence: Synthetic oligonucleotide
gactggacagccttatgccattggaggc

SEQ ID NO: 273647 - DNA, 29 bp, Artificial Sequence
  Description of Artificial Sequence: Synthetic oligonucleotide
actggacagccttatgccattggaggctc

SEQ ID NO: 273648 - DNA, 28 bp, Artificial Sequence
  Description of Artificial Sequence: Synthetic oligonucleotide
ctggacagccttatgccattggaggctc

SEQ ID NO: 273649 - DNA, 28 bp, Artificial Sequence
  Description of Artificial Sequence: Synthetic oligonucleotide
tggacagccttatgccattggaggctcc

SEQ ID NO: 273650 - DNA, 27 bp, Artificial Sequence
  Description of Artificial Sequence: Synthetic oligonucleotide
ggacagccttatgccattggaggctcc

SEQ ID NO: 273651 - DNA, 27 bp, Artificial Sequence
  Description of Artificial Sequence: Synthetic oligonucleotide
gacagccttatgccattggaggctccg

SEQ ID NO: 273652 - DNA, 27 bp, Artificial Sequence
  Description of Artificial Sequence: Synthetic oligonucleotide
acagccttatgccattggaggctccgg

SEQ ID NO: 273653 - DNA, 26 bp, Artificial Sequence
  Description of Artificial Sequence: Synthetic oligonucleotide
cagccttatgccattggaggctccgg

SEQ ID NO: 273654 - DNA, 27 bp, Artificial Sequence
  Description of Artificial Sequence: Synthetic oligonucleotide
agccttatgccattggaggctccggct

SEQ ID NO: 273655 - DNA, 26 bp, Artificial Sequence
  Description of Artificial Sequence: Synthetic oligonucleotide
gccttatgccattggaggctccggct

SEQ ID NO: 273656 - DNA, 26 bp, Artificial Sequence
  Description of Artificial Sequence: Synthetic oligonucleotide
ccttatgccattggaggctccggctg

SEQ ID NO: 273657 - DNA, 27 bp, Artificial Sequence
  Description of Artificial Sequence: Synthetic oligonucleotide
cttatgccattggaggctccggctgca

SEQ ID NO: 273658 - DNA, 27 bp, Artificial Sequence
  Description of Artificial Sequence: Synthetic oligonucleotide
ttatgccattggaggctccggctgcac

SEQ ID NO: 273659 - DNA, 26 bp, Artificial Sequence
  Description of Artificial Sequence: Synthetic oligonucleotide
tatgccattggaggctccggctgcac

SEQ ID NO: 273660 - DNA, 25 bp, Artificial Sequence
  Description of Artificial Sequence: Synthetic oligonucleotide
atgccattggaggctccggctgcac

SEQ ID NO: 273661 - DNA, 24 bp, Artificial Sequence
  Description of Artificial Sequence: Synthetic oligonucleotide
tgccattggaggctccggctgcac

SEQ ID NO: 273662 - DNA, 23 bp, Artificial Sequence
  Description of Artificial Sequence: Synthetic oligonucleotide
gccattggaggctccggctgcac

SEQ ID NO: 273663 - DNA, 27 bp, Artificial Sequence
  Description of Artificial Sequence: Synthetic oligonucleotide
ccattggaggctccggctgcaccttta

SEQ ID NO: 273664 - DNA, 28 bp, Artificial Sequence
  Description of Artificial Sequence: Synthetic oligonucleotide
cattggaggctccggctgcacctttaac

SEQ ID NO: 273665 - DNA, 31 bp, Artificial Sequence
  Description of Artificial Sequence: Synthetic oligonucleotide
attggaggctccggctgcacctttaactatg

SEQ ID NO: 273666 - DNA, 30 bp, Artificial Sequence
  Description of Artificial Sequence: Synthetic oligonucleotide
ttggaggctccggctgcacctttaactatg

SEQ ID NO: 273667 - DNA, 29 bp, Artificial Sequence
  Description of Artificial Sequence: Synthetic oligonucleotide
tggaggctccggctgcacctttaactatg

SEQ ID NO: 273668 - DNA, 28 bp, Artificial Sequence
  Description of Artificial Sequence: Synthetic oligonucleotide
ggaggctccggctgcacctttaactatg

SEQ ID NO: 273669 - DNA, 28 bp, Artificial Sequence
  Description of Artificial Sequence: Synthetic oligonucleotide
gaggctccggctgcacctttaactatgg

SEQ ID NO: 273670 - DNA, 32 bp, Artificial Sequence
  Description of Artificial Sequence: Synthetic oligonucleotide
aggctccggctgcacctttaactatggttaag

SEQ ID NO: 273671 - DNA, 31 bp, Artificial Sequence
  Description of Artificial Sequence: Synthetic oligonucleotide
ggctccggctgcacctttaactatggttaag

SEQ ID NO: 273672 - DNA, 32 bp, Artificial Sequence
  Description of Artificial Sequence: Synthetic oligonucleotide
gctccggctgcacctttaactatggttaagtg

SEQ ID NO: 273673 - DNA, 32 bp, Artificial Sequence
  Description of Artificial Sequence: Synthetic oligonucleotide
ctccggctgcacctttaactatggttaagtgg

SEQ ID NO: 273674 - DNA, 34 bp, Artificial Sequence
  Description of Artificial Sequence: Synthetic oligonucleotide
tccggctgcacctttaactatggttaagtggatg

SEQ ID NO: 273675 - DNA, 33 bp, Artificial Sequence
  Description of Artificial Sequence: Synthetic oligonucleotide
ccggctgcacctttaactatggttaagtggatg

SEQ ID NO: 273676 - DNA, 33 bp, Artificial Sequence
  Description of Artificial Sequence: Synthetic oligonucleotide
cggctgcacctttaactatggttaagtggatgc

SEQ ID NO: 273677 - DNA, 34 bp, Artificial Sequence
  Description of Artificial Sequence: Synthetic oligonucleotide
ggctgcacctttaactatggttaagtggatgcac

SEQ ID NO: 273678 - DNA, 34 bp, Artificial Sequence
  Description of Artificial Sequence: Synthetic oligonucleotide
gctgcacctttaactatggttaagtggatgcacc

SEQ ID NO: 273679 - DNA, 40 bp, Artificial Sequence
  Description of Artificial Sequence: Synthetic oligonucleotide
ctgcacctttaactatggttaagtggatgcaccatataag

SEQ ID NO: 273680 - DNA, 40 bp, Artificial Sequence
  Description of Artificial Sequence: Synthetic oligonucleotide
tgcacctttaactatggttaagtggatgcaccatataagc

SEQ ID NO: 273681 - DNA, 39 bp, Artificial Sequence
  Description of Artificial Sequence: Synthetic oligonucleotide
gcacctttaactatggttaagtggatgcaccatataagc

SEQ ID NO: 273682 - DNA, 39 bp, Artificial Sequence
  Description of Artificial Sequence: Synthetic oligonucleotide
cacctttaactatggttaagtggatgcaccatataagcg

SEQ ID NO: 273683 - DNA, 40 bp, Artificial Sequence
  Description of Artificial Sequence: Synthetic oligonucleotide
acctttaactatggttaagtggatgcaccatataagcgag

SEQ ID NO: 273684 - DNA, 39 bp, Artificial Sequence
  Description of Artificial Sequence: Synthetic oligonucleotide
cctttaactatggttaagtggatgcaccatataagcgag

SEQ ID NO: 273685 - DNA, 39 bp, Artificial Sequence
  Description of Artificial Sequence: Synthetic oligonucleotide
ctttaactatggttaagtggatgcaccatataagcgagg

SEQ ID NO: 273686 - DNA, 39 bp, Artificial Sequence
  Description of Artificial Sequence: Synthetic oligonucleotide
tttaactatggttaagtggatgcaccatataagcgaggc

SEQ ID NO: 273687 - DNA, 38 bp, Artificial Sequence
  Description of Artificial Sequence: Synthetic oligonucleotide
ttaactatggttaagtggatgcaccatataagcgaggc

SEQ ID NO: 273688 - DNA, 37 bp, Artificial Sequence
  Description of Artificial Sequence: Synthetic oligonucleotide
taactatggttaagtggatgcaccatataagcgaggc

SEQ ID NO: 273689 - DNA, 36 bp, Artificial Sequence
  Description of Artificial Sequence: Synthetic oligonucleotide
aactatggttaagtggatgcaccatataagcgaggc

SEQ ID NO: 273690 - DNA, 35 bp, Artificial Sequence
  Description of Artificial Sequence: Synthetic oligonucleotide
actatggttaagtggatgcaccatataagcgaggc

SEQ ID NO: 273691 - DNA, 34 bp, Artificial Sequence
  Description of Artificial Sequence: Synthetic oligonucleotide
ctatggttaagtggatgcaccatataagcgaggc

SEQ ID NO: 273692 - DNA, 36 bp, Artificial Sequence
  Description of Artificial Sequence: Synthetic oligonucleotide
tatggttaagtggatgcaccatataagcgaggcatg

SEQ ID NO: 273693 - DNA, 35 bp, Artificial Sequence
  Description of Artificial Sequence: Synthetic oligonucleotide
atggttaagtggatgcaccatataagcgaggcatg

SEQ ID NO: 273694 - DNA, 34 bp, Artificial Sequence
  Description of Artificial Sequence: Synthetic oligonucleotide
tggttaagtggatgcaccatataagcgaggcatg

SEQ ID NO: 273695 - DNA, 33 bp, Artificial Sequence
  Description of Artificial Sequence: Synthetic oligonucleotide
ggttaagtggatgcaccatataagcgaggcatg

SEQ ID NO: 273696 - DNA, 34 bp, Artificial Sequence
  Description of Artificial Sequence: Synthetic oligonucleotide
gttaagtggatgcaccatataagcgaggcatgtc

SEQ ID NO: 273697 - DNA, 35 bp, Artificial Sequence
  Description of Artificial Sequence: Synthetic oligonucleotide
ttaagtggatgcaccatataagcgaggcatgtcac

SEQ ID NO: 273698 - DNA, 34 bp, Artificial Sequence
  Description of Artificial Sequence: Synthetic oligonucleotide
taagtggatgcaccatataagcgaggcatgtcac

SEQ ID NO: 273699 - DNA, 33 bp, Artificial Sequence
  Description of Artificial Sequence: Synthetic oligonucleotide
aagtggatgcaccatataagcgaggcatgtcac

SEQ ID NO: 273700 - DNA, 32 bp, Artificial Sequence
  Description of Artificial Sequence: Synthetic oligonucleotide
agtggatgcaccatataagcgaggcatgtcac

SEQ ID NO: 273701 - DNA, 31 bp, Artificial Sequence
  Description of Artificial Sequence: Synthetic oligonucleotide
gtggatgcaccatataagcgaggcatgtcac

SEQ ID NO: 273702 - DNA, 31 bp, Artificial Sequence
  Description of Artificial Sequence: Synthetic oligonucleotide
tggatgcaccatataagcgaggcatgtcacc

SEQ ID NO: 273703 - DNA, 30 bp, Artificial Sequence
  Description of Artificial Sequence: Synthetic oligonucleotide
ggatgcaccatataagcgaggcatgtcacc

SEQ ID NO: 273704 - DNA, 30 bp, Artificial Sequence
  Description of Artificial Sequence: Synthetic oligonucleotide
gatgcaccatataagcgaggcatgtcaccc

SEQ ID NO: 273705 - DNA, 30 bp, Artificial Sequence
  Description of Artificial Sequence: Synthetic oligonucleotide
atgcaccatataagcgaggcatgtcacccg

SEQ ID NO: 273706 - DNA, 29 bp, Artificial Sequence
  Description of Artificial Sequence: Synthetic oligonucleotide
tgcaccatataagcgaggcatgtcacccg

SEQ ID NO: 273707 - DNA, 28 bp, Artificial Sequence
  Description of Artificial Sequence: Synthetic oligonucleotide
gcaccatataagcgaggcatgtcacccg

SEQ ID NO: 273708 - DNA, 29 bp, Artificial Sequence
  Description of Artificial Sequence: Synthetic oligonucleotide
caccatataagcgaggcatgtcacccgag

SEQ ID NO: 273709 - DNA, 29 bp, Artificial Sequence
  Description of Artificial Sequence: Synthetic oligonucleotide
accatataagcgaggcatgtcacccgagg

SEQ ID NO: 273710 - DNA, 28 bp, Artificial Sequence
  Description of Artificial Sequence: Synthetic oligonucleotide
ccatataagcgaggcatgtcacccgagg

SEQ ID NO: 273711 - DNA, 29 bp, Artificial Sequence
  Description of Artificial Sequence: Synthetic oligonucleotide
catataagcgaggcatgtcacccgaggag

SEQ ID NO: 273712 - DNA, 30 bp, Artificial Sequence
  Description of Artificial Sequence: Synthetic oligonucleotide
atataagcgaggcatgtcacccgaggagag

SEQ ID NO: 273713 - DNA, 29 bp, Artificial Sequence
  Description of Artificial Sequence: Synthetic oligonucleotide
tataagcgaggcatgtcacccgaggagag

SEQ ID NO: 273714 - DNA, 28 bp, Artificial Sequence
  Description of Artificial Sequence: Synthetic oligonucleotide
ataagcgaggcatgtcacccgaggagag

SEQ ID NO: 273715 - DNA, 27 bp, Artificial Sequence
  Description of Artificial Sequence: Synthetic oligonucleotide
taagcgaggcatgtcacccgaggagag

SEQ ID NO: 273716 - DNA, 26 bp, Artificial Sequence
  Description of Artificial Sequence: Synthetic oligonucleotide
aagcgaggcatgtcacccgaggagag

SEQ ID NO: 273717 - DNA, 25 bp, Artificial Sequence
  Description of Artificial Sequence: Synthetic oligonucleotide
agcgaggcatgtcacccgaggagag

SEQ ID NO: 273718 - DNA, 24 bp, Artificial Sequence
  Description of Artificial Sequence: Synthetic oligonucleotide
gcgaggcatgtcacccgaggagag

SEQ ID NO: 273719 - DNA, 25 bp, Artificial Sequence
  Description of Artificial Sequence: Synthetic oligonucleotide
cgaggcatgtcacccgaggagagca

SEQ ID NO: 273720 - DNA, 25 bp, Artificial Sequence
  Description of Artificial Sequence: Synthetic oligonucleotide
gaggcatgtcacccgaggagagcag

SEQ ID NO: 273721 - DNA, 25 bp, Artificial Sequence
  Description of Artificial Sequence: Synthetic oligonucleotide
aggcatgtcacccgaggagagcagg

SEQ ID NO: 273722 - DNA, 24 bp, Artificial Sequence
  Description of Artificial Sequence: Synthetic oligonucleotide
ggcatgtcacccgaggagagcagg

SEQ ID NO: 273723 - DNA, 24 bp, Artificial Sequence
  Description of Artificial Sequence: Synthetic oligonucleotide
gcatgtcacccgaggagagcaggc

SEQ ID NO: 273724 - DNA, 24 bp, Artificial Sequence
  Description of Artificial Sequence: Synthetic oligonucleotide
catgtcacccgaggagagcaggcg

SEQ ID NO: 273725 - DNA, 26 bp, Artificial Sequence
  Description of Artificial Sequence: Synthetic oligonucleotide
atgtcacccgaggagagcaggcgcta

SEQ ID NO: 273726 - DNA, 25 bp, Artificial Sequence
  Description of Artificial Sequence: Synthetic oligonucleotide
tgtcacccgaggagagcaggcgcta

SEQ ID NO: 273727 - DNA, 24 bp, Artificial Sequence
  Description of Artificial Sequence: Synthetic oligonucleotide
gtcacccgaggagagcaggcgcta

SEQ ID NO: 273728 - DNA, 25 bp, Artificial Sequence
  Description of Artificial Sequence: Synthetic oligonucleotide
tcacccgaggagagcaggcgctaca

SEQ ID NO: 273729 - DNA, 24 bp, Artificial Sequence
  Description of Artificial Sequence: Synthetic oligonucleotide
cacccgaggagagcaggcgctaca

SEQ ID NO: 273730 - DNA, 24 bp, Artificial Sequence
  Description of Artificial Sequence: Synthetic oligonucleotide
acccgaggagagcaggcgctacac

SEQ ID NO: 273731 - DNA, 23 bp, Artificial Sequence
  Description of Artificial Sequence: Synthetic oligonucleotide
cccgaggagagcaggcgctacac

SEQ ID NO: 273732 - DNA, 24 bp, Artificial Sequence
  Description of Artificial Sequence: Synthetic oligonucleotide
ccgaggagagcaggcgctacacca

SEQ ID NO: 273733 - DNA, 25 bp, Artificial Sequence
  Description of Artificial Sequence: Synthetic oligonucleotide
cgaggagagcaggcgctacaccaca

SEQ ID NO: 273734 - DNA, 26 bp, Artificial Sequence
  Description of Artificial Sequence: Synthetic oligonucleotide
gaggagagcaggcgctacaccacaga

SEQ ID NO: 273735 - DNA, 26 bp, Artificial Sequence
  Description of Artificial Sequence: Synthetic oligonucleotide
aggagagcaggcgctacaccacagag

SEQ ID NO: 273736 - DNA, 25 bp, Artificial Sequence
  Description of Artificial Sequence: Synthetic oligonucleotide
ggagagcaggcgctacaccacagag

SEQ ID NO: 273737 - DNA, 25 bp, Artificial Sequence
  Description of Artificial Sequence: Synthetic oligonucleotide
gagagcaggcgctacaccacagagg

SEQ ID NO: 273738 - DNA, 27 bp, Artificial Sequence
  Description of Artificial Sequence: Synthetic oligonucleotide
agagcaggcgctacaccacagaggcta

SEQ ID NO: 273739 - DNA, 27 bp, Artificial Sequence
  Description of Artificial Sequence: Synthetic oligonucleotide
gagcaggcgctacaccacagaggctat

SEQ ID NO: 273740 - DNA, 28 bp, Artificial Sequence
  Description of Artificial Sequence: Synthetic oligonucleotide
agcaggcgctacaccacagaggctattg

SEQ ID NO: 273741 - DNA, 27 bp, Artificial Sequence
  Description of Artificial Sequence: Synthetic oligonucleotide
gcaggcgctacaccacagaggctattg

SEQ ID NO: 273742 - DNA, 27 bp, Artificial Sequence
  Description of Artificial Sequence: Synthetic oligonucleotide
caggcgctacaccacagaggctattgc

SEQ ID NO: 273743 - DNA, 28 bp, Artificial Sequence
  Description of Artificial Sequence: Synthetic oligonucleotide
aggcgctacaccacagaggctattgctg

SEQ ID NO: 273744 - DNA, 27 bp, Artificial Sequence
  Description of Artificial Sequence: Synthetic oligonucleotide
ggcgctacaccacagaggctattgctg

SEQ ID NO: 273745 - DNA, 28 bp, Artificial Sequence
  Description of Artificial Sequence: Synthetic oligonucleotide
gcgctacaccacagaggctattgctgtg

SEQ ID NO: 273746 - DNA, 28 bp, Artificial Sequence
  Description of Artificial Sequence: Synthetic oligonucleotide
cgctacaccacagaggctattgctgtgg

SEQ ID NO: 273747 - DNA, 28 bp, Artificial Sequence
  Description of Artificial Sequence: Synthetic oligonucleotide
gctacaccacagaggctattgctgtggc

SEQ ID NO: 273748 - DNA, 28 bp, Artificial Sequence
  Description of Artificial Sequence: Synthetic oligonucleotide
ctacaccacagaggctattgctgtggcc

SEQ ID NO: 273749 - DNA, 30 bp, Artificial Sequence
  Description of Artificial Sequence: Synthetic oligonucleotide
tacaccacagaggctattgctgtggccatg

SEQ ID NO: 273750 - DNA, 29 bp, Artificial Sequence
  Description of Artificial Sequence: Synthetic oligonucleotide
acaccacagaggctattgctgtggccatg

SEQ ID NO: 273751 - DNA, 28 bp, Artificial Sequence
  Description of Artificial Sequence: Synthetic oligonucleotide
caccacagaggctattgctgtggccatg

SEQ ID NO: 273752 - DNA, 29 bp, Artificial Sequence
  Description of Artificial Sequence: Synthetic oligonucleotide
accacagaggctattgctgtggccatgac

SEQ ID NO: 273753 - DNA, 28 bp, Artificial Sequence
  Description of Artificial Sequence: Synthetic oligonucleotide
ccacagaggctattgctgtggccatgac

SEQ ID NO: 273754 - DNA, 28 bp, Artificial Sequence
  Description of Artificial Sequence: Synthetic oligonucleotide
cacagaggctattgctgtggccatgacc

SEQ ID NO: 273755 - DNA, 28 bp, Artificial Sequence
  Description of Artificial Sequence: Synthetic oligonucleotide
acagaggctattgctgtggccatgaccc

SEQ ID NO: 273756 - DNA, 27 bp, Artificial Sequence
  Description of Artificial Sequence: Synthetic oligonucleotide
cagaggctattgctgtggccatgaccc

SEQ ID NO: 273757 - DNA, 27 bp, Artificial Sequence
  Description of Artificial Sequence: Synthetic oligonucleotide
agaggctattgctgtggccatgacccg

SEQ ID NO: 273758 - DNA, 26 bp, Artificial Sequence
  Description of Artificial Sequence: Synthetic oligonucleotide
gaggctattgctgtggccatgacccg

SEQ ID NO: 273759 - DNA, 26 bp, Artificial Sequence
  Description of Artificial Sequence: Synthetic oligonucleotide
aggctattgctgtggccatgacccgg

SEQ ID NO: 273760 - DNA, 25 bp, Artificial Sequence
  Description of Artificial Sequence: Synthetic oligonucleotide
ggctattgctgtggccatgacccgg

SEQ ID NO: 273761 - DNA, 27 bp, Artificial Sequence
  Description of Artificial Sequence: Synthetic oligonucleotide
gctattgctgtggccatgacccgggat

SEQ ID NO: 273762 - DNA, 27 bp, Artificial Sequence
  Description of Artificial Sequence: Synthetic oligonucleotide
ctattgctgtggccatgacccgggatg

SEQ ID NO: 273763 - DNA, 27 bp, Artificial Sequence
  Description of Artificial Sequence: Synthetic oligonucleotide
tattgctgtggccatgacccgggatgg

SEQ ID NO: 273764 - DNA, 26 bp, Artificial Sequence
  Description of Artificial Sequence: Synthetic oligonucleotide
attgctgtggccatgacccgggatgg

SEQ ID NO: 273765 - DNA, 25 bp, Artificial Sequence
  Description of Artificial Sequence: Synthetic oligonucleotide
ttgctgtggccatgacccgggatgg

SEQ ID NO: 273766 - DNA, 24 bp, Artificial Sequence
  Description of Artificial Sequence: Synthetic oligonucleotide
tgctgtggccatgacccgggatgg

SEQ ID NO: 273767 - DNA, 23 bp, Artificial Sequence
  Description of Artificial Sequence: Synthetic oligonucleotide
gctgtggccatgacccgggatgg

SEQ ID NO: 273768 - DNA, 24 bp, Artificial Sequence
  Description of Artificial Sequence: Synthetic oligonucleotide
ctgtggccatgacccgggatgggt

SEQ ID NO: 273769 - DNA, 26 bp, Artificial Sequence
  Description of Artificial Sequence: Synthetic oligonucleotide
tgtggccatgacccgggatgggtcaa

SEQ ID NO: 273770 - DNA, 25 bp, Artificial Sequence
  Description of Artificial Sequence: Synthetic oligonucleotide
gtggccatgacccgggatgggtcaa

SEQ ID NO: 273771 - DNA, 25 bp, Artificial Sequence
  Description of Artificial Sequence: Synthetic oligonucleotide
tggccatgacccgggatgggtcaag

SEQ ID NO: 273772 - DNA, 24 bp, Artificial Sequence
  Description of Artificial Sequence: Synthetic oligonucleotide
ggccatgacccgggatgggtcaag

SEQ ID NO: 273773 - DNA, 24 bp, Artificial Sequence
  Description of Artificial Sequence: Synthetic oligonucleotide
gccatgacccgggatgggtcaagc

SEQ ID NO: 273774 - DNA, 24 bp, Artificial Sequence
  Description of Artificial Sequence: Synthetic oligonucleotide
ccatgacccgggatgggtcaagcg

SEQ ID NO: 273775 - DNA, 24 bp, Artificial Sequence
  Description of Artificial Sequence: Synthetic oligonucleotide
catgacccgggatgggtcaagcgg

SEQ ID NO: 273776 - DNA, 24 bp, Artificial Sequence
  Description of Artificial Sequence: Synthetic oligonucleotide
atgacccgggatgggtcaagcggg

SEQ ID NO: 273777 - DNA, 23 bp, Artificial Sequence
  Description of Artificial Sequence: Synthetic oligonucleotide
tgacccgggatgggtcaagcggg

SEQ ID NO: 273778 - DNA, 22 bp, Artificial Sequence
  Description of Artificial Sequence: Synthetic oligonucleotide
gacccgggatgggtcaagcggg

SEQ ID NO: 273779 - DNA, 22 bp, Artificial Sequence
  Description of Artificial Sequence: Synthetic oligonucleotide
acccgggatgggtcaagcgggc

SEQ ID NO: 273780 - DNA, 21 bp, Artificial Sequence
  Description of Artificial Sequence: Synthetic oligonucleotide
cccgggatgggtcaagcgggc

SEQ ID NO: 273781 - DNA, 22 bp, Artificial Sequence
  Description of Artificial Sequence: Synthetic oligonucleotide
ccgggatgggtcaagcgggcgt

SEQ ID NO: 273782 - DNA, 23 bp, Artificial Sequence
  Description of Artificial Sequence: Synthetic oligonucleotide
cgggatgggtcaagcgggcgtgt

SEQ ID NO: 273783 - DNA, 25 bp, Artificial Sequence
  Description of Artificial Sequence: Synthetic oligonucleotide
gggatgggtcaagcgggcgtgtcat

SEQ ID NO: 273784 - DNA, 27 bp, Artificial Sequence
  Description of Artificial Sequence: Synthetic oligonucleotide
ggatgggtcaagcgggcgtgtcatctt

SEQ ID NO: 273785 - DNA, 27 bp, Artificial Sequence
  Description of Artificial Sequence: Synthetic oligonucleotide
gatgggtcaagcgggcgtgtcatcttc

SEQ ID NO: 273786 - DNA, 27 bp, Artificial Sequence
  Description of Artificial Sequence: Synthetic oligonucleotide
atgggtcaagcgggcgtgtcatcttcc

SEQ ID NO: 273787 - DNA, 27 bp, Artificial Sequence
  Description of Artificial Sequence: Synthetic oligonucleotide
tgggtcaagcgggcgtgtcatcttcct

SEQ ID NO: 273788 - DNA, 26 bp, Artificial Sequence
  Description of Artificial Sequence: Synthetic oligonucleotide
gggtcaagcgggcgtgtcatcttcct

SEQ ID NO: 273789 - DNA, 26 bp, Artificial Sequence
  Description of Artificial Sequence: Synthetic oligonucleotide
ggtcaagcgggcgtgtcatcttcctg

SEQ ID NO: 273790 - DNA, 27 bp, Artificial Sequence
  Description of Artificial Sequence: Synthetic oligonucleotide
gtcaagcgggcgtgtcatcttcctggt

SEQ ID NO: 273791 - DNA, 27 bp, Artificial Sequence
  Description of Artificial Sequence: Synthetic oligonucleotide
tcaagcgggcgtgtcatcttcctggtc

SEQ ID NO: 273792 - DNA, 27 bp, Artificial Sequence
  Description of Artificial Sequence: Synthetic oligonucleotide
caagcgggcgtgtcatcttcctggtca

SEQ ID NO: 273793 - DNA, 27 bp, Artificial Sequence
  Description of Artificial Sequence: Synthetic oligonucleotide
aagcgggcgtgtcatcttcctggtcac

SEQ ID NO: 273794 - DNA, 27 bp, Artificial Sequence
  Description of Artificial Sequence: Synthetic oligonucleotide
agcgggcgtgtcatcttcctggtcaca

SEQ ID NO: 273795 - DNA, 27 bp, Artificial Sequence
  Description of Artificial Sequence: Synthetic oligonucleotide
gcgggcgtgtcatcttcctggtcacaa

SEQ ID NO: 273796 - DNA, 30 bp, Artificial Sequence
  Description of Artificial Sequence: Synthetic oligonucleotide
cgggcgtgtcatcttcctggtcacaattac

SEQ ID NO: 273797 - DNA, 31 bp, Artificial Sequence
  Description of Artificial Sequence: Synthetic oligonucleotide
gggcgtgtcatcttcctggtcacaattacag

SEQ ID NO: 273798 - DNA, 31 bp, Artificial Sequence
  Description of Artificial Sequence: Synthetic oligonucleotide
ggcgtgtcatcttcctggtcacaattacagc

SEQ ID NO: 273799 - DNA, 32 bp, Artificial Sequence
  Description of Artificial Sequence: Synthetic oligonucleotide
gcgtgtcatcttcctggtcacaattacagctc

SEQ ID NO: 273800 - DNA, 32 bp, Artificial Sequence
  Description of Artificial Sequence: Synthetic oligonucleotide
cgtgtcatcttcctggtcacaattacagctcc

SEQ ID NO: 273801 - DNA, 32 bp, Artificial Sequence
  Description of Artificial Sequence: Synthetic oligonucleotide
gtgtcatcttcctggtcacaattacagctccc

SEQ ID NO: 273802 - DNA, 32 bp, Artificial Sequence
  Description of Artificial Sequence: Synthetic oligonucleotide
tgtcatcttcctggtcacaattacagctcccg

SEQ ID NO: 273803 - DNA, 31 bp, Artificial Sequence
  Description of Artificial Sequence: Synthetic oligonucleotide
gtcatcttcctggtcacaattacagctcccg

SEQ ID NO: 273804 - DNA, 31 bp, Artificial Sequence
  Description of Artificial Sequence: Synthetic oligonucleotide
tcatcttcctggtcacaattacagctcccgg

SEQ ID NO: 273805 - DNA, 30 bp, Artificial Sequence
  Description of Artificial Sequence: Synthetic oligonucleotide
catcttcctggtcacaattacagctcccgg

SEQ ID NO: 273806 - DNA, 31 bp, Artificial Sequence
  Description of Artificial Sequence: Synthetic oligonucleotide
atcttcctggtcacaattacagctcccggtg

SEQ ID NO: 273807 - DNA, 30 bp, Artificial Sequence
  Description of Artificial Sequence: Synthetic oligonucleotide
tcttcctggtcacaattacagctcccggtg

SEQ ID NO: 273808 - DNA, 29 bp, Artificial Sequence
  Description of Artificial Sequence: Synthetic oligonucleotide
cttcctggtcacaattacagctcccggtg

SEQ ID NO: 273809 - DNA, 30 bp, Artificial Sequence
  Description of Artificial Sequence: Synthetic oligonucleotide
ttcctggtcacaattacagctcccggtgtg

SEQ ID NO: 273810 - DNA, 29 bp, Artificial Sequence
  Description of Artificial Sequence: Synthetic oligonucleotide
tcctggtcacaattacagctcccggtgtg

SEQ ID NO: 273811 - DNA, 28 bp, Artificial Sequence
  Description of Artificial Sequence: Synthetic oligonucleotide
cctggtcacaattacagctcccggtgtg

SEQ ID NO: 273812 - DNA, 28 bp, Artificial Sequence
  Description of Artificial Sequence: Synthetic oligonucleotide
ctggtcacaattacagctcccggtgtgg

SEQ ID NO: 273813 - DNA, 29 bp, Artificial Sequence
  Description of Artificial Sequence: Synthetic oligonucleotide
tggtcacaattacagctcccggtgtggtc

SEQ ID NO: 273814 - DNA, 28 bp, Artificial Sequence
  Description of Artificial Sequence: Synthetic oligonucleotide
ggtcacaattacagctcccggtgtggtc

SEQ ID NO: 273815 - DNA, 28 bp, Artificial Sequence
  Description of Artificial Sequence: Synthetic oligonucleotide
gtcacaattacagctcccggtgtggtcc

SEQ ID NO: 273816 - DNA, 30 bp, Artificial Sequence
  Description of Artificial Sequence: Synthetic oligonucleotide
tcacaattacagctcccggtgtggtccatc

SEQ ID NO: 273817 - DNA, 29 bp, Artificial Sequence
  Description of Artificial Sequence: Synthetic oligonucleotide
cacaattacagctcccggtgtggtccatc

SEQ ID NO: 273818 - DNA, 29 bp, Artificial Sequence
  Description of Artificial Sequence: Synthetic oligonucleotide
acaattacagctcccggtgtggtccatcg

SEQ ID NO: 273819 - DNA, 28 bp, Artificial Sequence
  Description of Artificial Sequence: Synthetic oligonucleotide
caattacagctcccggtgtggtccatcg

SEQ ID NO: 273820 - DNA, 29 bp, Artificial Sequence
  Description of Artificial Sequence: Synthetic oligonucleotide
aattacagctcccggtgtggtccatcgag

SEQ ID NO: 273821 - DNA, 28 bp, Artificial Sequence
  Description of Artificial Sequence: Synthetic oligonucleotide
attacagctcccggtgtggtccatcgag

SEQ ID NO: 273822 - DNA, 27 bp, Artificial Sequence
  Description of Artificial Sequence: Synthetic oligonucleotide
ttacagctcccggtgtggtccatcgag

SEQ ID NO: 273823 - DNA, 27 bp, Artificial Sequence
  Description of Artificial Sequence: Synthetic oligonucleotide
tacagctcccggtgtggtccatcgagt

SEQ ID NO: 273824 - DNA, 26 bp, Artificial Sequence
  Description of Artificial Sequence: Synthetic oligonucleotide
acagctcccggtgtggtccatcgagt

SEQ ID NO: 273825 - DNA, 25 bp, Artificial Sequence
  Description of Artificial Sequence: Synthetic oligonucleotide
cagctcccggtgtggtccatcgagt

SEQ ID NO: 273826 - DNA, 27 bp, Artificial Sequence
  Description of Artificial Sequence: Synthetic oligonucleotide
agctcccggtgtggtccatcgagtgat

SEQ ID NO: 273827 - DNA, 26 bp, Artificial Sequence
  Description of Artificial Sequence: Synthetic oligonucleotide
gctcccggtgtggtccatcgagtgat

SEQ ID NO: 273828 - DNA, 27 bp, Artificial Sequence
  Description of Artificial Sequence: Synthetic oligonucleotide
ctcccggtgtggtccatcgagtgatct

SEQ ID NO: 273829 - DNA, 28 bp, Artificial Sequence
  Description of Artificial Sequence: Synthetic oligonucleotide
tcccggtgtggtccatcgagtgatcttg

SEQ ID NO: 273830 - DNA, 27 bp, Artificial Sequence
  Description of Artificial Sequence: Synthetic oligonucleotide
cccggtgtggtccatcgagtgatcttg

SEQ ID NO: 273831 - DNA, 27 bp, Artificial Sequence
  Description of Artificial Sequence: Synthetic oligonucleotide
ccggtgtggtccatcgagtgatcttgg

SEQ ID NO: 273832 - DNA, 27 bp, Artificial Sequence
  Description of Artificial Sequence: Synthetic oligonucleotide
cggtgtggtccatcgagtgatcttggg

SEQ ID NO: 273833 - DNA, 27 bp, Artificial Sequence
  Description of Artificial Sequence: Synthetic oligonucleotide
ggtgtggtccatcgagtgatcttgggc

SEQ ID NO: 273834 - DNA, 30 bp, Artificial Sequence
  Description of Artificial Sequence: Synthetic oligonucleotide
gtgtggtccatcgagtgatcttgggctatg

SEQ ID NO: 273835 - DNA, 32 bp, Artificial Sequence
  Description of Artificial Sequence: Synthetic oligonucleotide
tgtggtccatcgagtgatcttgggctatgaac

SEQ ID NO: 273836 - DNA, 31 bp, Artificial Sequence
  Description of Artificial Sequence: Synthetic oligonucleotide
gtggtccatcgagtgatcttgggctatgaac

SEQ ID NO: 273837 - DNA, 32 bp, Artificial Sequence
  Description of Artificial Sequence: Synthetic oligonucleotide
tggtccatcgagtgatcttgggctatgaactg

SEQ ID NO: 273838 - DNA, 31 bp, Artificial Sequence
  Description of Artificial Sequence: Synthetic oligonucleotide
ggtccatcgagtgatcttgggctatgaactg

SEQ ID NO: 273839 - DNA, 31 bp, Artificial Sequence
  Description of Artificial Sequence: Synthetic oligonucleotide
gtccatcgagtgatcttgggctatgaactgc

SEQ ID NO: 273840 - DNA, 31 bp, Artificial Sequence
  Description of Artificial Sequence: Synthetic oligonucleotide
tccatcgagtgatcttgggctatgaactgcg

SEQ ID NO: 273841 - DNA, 30 bp, Artificial Sequence
  Description of Artificial Sequence: Synthetic oligonucleotide
ccatcgagtgatcttgggctatgaactgcg

SEQ ID NO: 273842 - DNA, 36 bp, Artificial Sequence
  Description of Artificial Sequence: Synthetic oligonucleotide
catcgagtgatcttgggctatgaactgcgaaaattc

SEQ ID NO: 273843 - DNA, 39 bp, Artificial Sequence
  Description of Artificial Sequence: Synthetic oligonucleotide
atcgagtgatcttgggctatgaactgcgaaaattctaag

SEQ ID NO: 273844 - DNA, 38 bp, Artificial Sequence
  Description of Artificial Sequence: Synthetic oligonucleotide
tcgagtgatcttgggctatgaactgcgaaaattctaag

SEQ ID NO: 273845 - DNA, 37 bp, Artificial Sequence
  Description of Artificial Sequence: Synthetic oligonucleotide
cgagtgatcttgggctatgaactgcgaaaattctaag

SEQ ID NO: 273846 - DNA, 39 bp, Artificial Sequence
  Description of Artificial Sequence: Synthetic oligonucleotide
gagtgatcttgggctatgaactgcgaaaattctaagatg

SEQ ID NO: 273847 - DNA, 40 bp, Artificial Sequence
  Description of Artificial Sequence: Synthetic oligonucleotide
agtgatcttgggctatgaactgcgaaaattctaagatgag

SEQ ID NO: 273848 - DNA, 39 bp, Artificial Sequence
  Description of Artificial Sequence: Synthetic oligonucleotide
gtgatcttgggctatgaactgcgaaaattctaagatgag

SEQ ID NO: 273849 - DNA, 40 bp, Artificial Sequence
  Description of Artificial Sequence: Synthetic oligonucleotide
tgatcttgggctatgaactgcgaaaattctaagatgagtg

SEQ ID NO: 273850 - DNA, 39 bp, Artificial Sequence
  Description of Artificial Sequence: Synthetic oligonucleotide
gatcttgggctatgaactgcgaaaattctaagatgagtg

SEQ ID NO: 273851 - DNA, 26 bp, Artificial Sequence
  Description of Artificial Sequence: Synthetic oligonucleotide
atgatgctgaacccagccctgcagcc

SEQ ID NO: 273852 - DNA, 25 bp, Artificial Sequence
  Description of Artificial Sequence: Synthetic oligonucleotide
tgatgctgaacccagccctgcagcc

SEQ ID NO: 273853 - DNA, 24 bp, Artificial Sequence
  Description of Artificial Sequence: Synthetic oligonucleotide
gatgctgaacccagccctgcagcc

SEQ ID NO: 273854 - DNA, 24 bp, Artificial Sequence
  Description of Artificial Sequence: Synthetic oligonucleotide
atgctgaacccagccctgcagccc

SEQ ID NO: 273855 - DNA, 23 bp, Artificial Sequence
  Description of Artificial Sequence: Synthetic oligonucleotide
tgctgaacccagccctgcagccc

SEQ ID NO: 273856 - DNA, 22 bp, Artificial Sequence
  Description of Artificial Sequence: Synthetic oligonucleotide
gctgaacccagccctgcagccc

SEQ ID NO: 273857 - DNA, 22 bp, Artificial Sequence
  Description of Artificial Sequence: Synthetic oligonucleotide
ctgaacccagccctgcagcccc

SEQ ID NO: 273858 - DNA, 23 bp, Artificial Sequence
  Description of Artificial Sequence: Synthetic oligonucleotide
tgaacccagccctgcagccccga

SEQ ID NO: 273859 - DNA, 22 bp, Artificial Sequence
  Description of Artificial Sequence: Synthetic oligonucleotide
gaacccagccctgcagccccga

SEQ ID NO: 273860 - DNA, 22 bp, Artificial Sequence
  Description of Artificial Sequence: Synthetic oligonucleotide
aacccagccctgcagccccgag

SEQ ID NO: 273861 - DNA, 21 bp, Artificial Sequence
  Description of Artificial Sequence: Synthetic oligonucleotide
acccagccctgcagccccgag

SEQ ID NO: 273862 - DNA, 20 bp, Artificial Sequence
  Description of Artificial Sequence: Synthetic oligonucleotide
cccagccctgcagccccgag

SEQ ID NO: 273863 - DNA, 20 bp, Artificial Sequence
  Description of Artificial Sequence: Synthetic oligonucleotide
ccagccctgcagccccgagc

SEQ ID NO: 273864 - DNA, 20 bp, Artificial Sequence
  Description of Artificial Sequence: Synthetic oligonucleotide
cagccctgcagccccgagcg

SEQ ID NO: 273865 - DNA, 20 bp, Artificial Sequence
  Description of Artificial Sequence: Synthetic oligonucleotide
agccctgcagccccgagcgg

SEQ ID NO: 273866 - DNA, 20 bp, Artificial Sequence
  Description of Artificial Sequence: Synthetic oligonucleotide
gccctgcagccccgagcggt

SEQ ID NO: 273867 - DNA, 20 bp, Artificial Sequence
  Description of Artificial Sequence: Synthetic oligonucleotide
ccctgcagccccgagcgggt

SEQ ID NO: 273868 - DNA, 21 bp, Artificial Sequence
  Description of Artificial Sequence: Synthetic oligonucleotide
cctgcagccccgagcgggctt

SEQ ID NO: 273869 - DNA, 22 bp, Artificial Sequence
  Description of Artificial Sequence: Synthetic oligonucleotide
ctgcagccccgagcgggcttct

SEQ ID NO: 273870 - DNA, 22 bp, Artificial Sequence
  Description of Artificial Sequence: Synthetic oligonucleotide
tgcagccccgagcgggcttctc

SEQ ID NO: 273871 - DNA, 21 bp, Artificial Sequence
  Description of Artificial Sequence: Synthetic oligonucleotide
gcagccccgagcgggcttctc

SEQ ID NO: 273872 - DNA, 23 bp, Artificial Sequence
  Description of Artificial Sequence: Synthetic oligonucleotide
cagccccgagcgggcttctcgtt

SEQ ID NO: 273873 - DNA, 23 bp, Artificial Sequence
  Description of Artificial Sequence: Synthetic oligonucleotide
agccccgagcgggcttctcgttc

SEQ ID NO: 273874 - DNA, 22 bp, Artificial Sequence
  Description of Artificial Sequence: Synthetic oligonucleotide
gccccgagcgggcttctcgttc

SEQ ID NO: 273875 - DNA, 23 bp, Artificial Sequence
  Description of Artificial Sequence: Synthetic oligonucleotide
ccccgagcgggcttctcgttcga

SEQ ID NO: 273876 - DNA, 25 bp, Artificial Sequence
  Description of Artificial Sequence: Synthetic oligonucleotide
cccgagcgggcttctcgttcgagaa

SEQ ID NO: 273877 - DNA, 26 bp, Artificial Sequence
  Description of Artificial Sequence: Synthetic oligonucleotide
ccgagcgggcttctcgttcgagaaca

SEQ ID NO: 273878 - DNA, 26 bp, Artificial Sequence
  Description of Artificial Sequence: Synthetic oligonucleotide
cgagcgggcttctcgttcgagaacag

SEQ ID NO: 273879 - DNA, 26 bp, Artificial Sequence
  Description of Artificial Sequence: Synthetic oligonucleotide
gagcgggcttctcgttcgagaacagc

SEQ ID NO: 273880 - DNA, 27 bp, Artificial Sequence
  Description of Artificial Sequence: Synthetic oligonucleotide
agcgggcttctcgttcgagaacagcca

SEQ ID NO: 273881 - DNA, 27 bp, Artificial Sequence
  Description of Artificial Sequence: Synthetic oligonucleotide
gcgggcttctcgttcgagaacagccaa

SEQ ID NO: 273882 - DNA, 28 bp, Artificial Sequence
  Description of Artificial Sequence: Synthetic oligonucleotide
cgggcttctcgttcgagaacagccaaag

SEQ ID NO: 273883 - DNA, 32 bp, Artificial Sequence
  Description of Artificial Sequence: Synthetic oligonucleotide
gggcttctcgttcgagaacagccaaagaattg

SEQ ID NO: 273884 - DNA, 32 bp, Artificial Sequence
  Description of Artificial Sequence: Synthetic oligonucleotide
ggcttctcgttcgagaacagccaaagaattgc

SEQ ID NO: 273885 - DNA, 34 bp, Artificial Sequence
  Description of Artificial Sequence: Synthetic oligonucleotide
gcttctcgttcgagaacagccaaagaattgcatc

SEQ ID NO: 273886 - DNA, 37 bp, Artificial Sequence
  Description of Artificial Sequence: Synthetic oligonucleotide
cttctcgttcgagaacagccaaagaattgcatcattc

SEQ ID NO: 273887 - DNA, 37 bp, Artificial Sequence
  Description of Artificial Sequence: Synthetic oligonucleotide
ttctcgttcgagaacagccaaagaattgcatcattcg

SEQ ID NO: 273888 - DNA, 36 bp, Artificial Sequence
  Description of Artificial Sequence: Synthetic oligonucleotide
tctcgttcgagaacagccaaagaattgcatcattcg

SEQ ID NO: 273889 - DNA, 35 bp, Artificial Sequence
  Description of Artificial Sequence: Synthetic oligonucleotide
ctcgttcgagaacagccaaagaattgcatcattcg

SEQ ID NO: 273890 - DNA, 37 bp, Artificial Sequence
  Description of Artificial Sequence: Synthetic oligonucleotide
tcgttcgagaacagccaaagaattgcatcattcgaac

SEQ ID NO: 273891 - DNA, 36 bp, Artificial Sequence
  Description of Artificial Sequence: Synthetic oligonucleotide
cgttcgagaacagccaaagaattgcatcattcgaac

SEQ ID NO: 273892 - DNA, 36 bp, Artificial Sequence
  Description of Artificial Sequence: Synthetic oligonucleotide
gttcgagaacagccaaagaattgcatcattcgaacg

SEQ ID NO: 273893 - DNA, 36 bp, Artificial Sequence
  Description of Artificial Sequence: Synthetic oligonucleotide
ttcgagaacagccaaagaattgcatcattcgaacgc

SEQ ID NO: 273894 - DNA, 35 bp, Artificial Sequence
  Description of Artificial Sequence: Synthetic oligonucleotide
tcgagaacagccaaagaattgcatcattcgaacgc

SEQ ID NO: 273895 - DNA, 34 bp, Artificial Sequence
  Description of Artificial Sequence: Synthetic oligonucleotide
cgagaacagccaaagaattgcatcattcgaacgc

SEQ ID NO: 273896 - DNA, 34 bp, Artificial Sequence
  Description of Artificial Sequence: Synthetic oligonucleotide
gagaacagccaaagaattgcatcattcgaacgcg

SEQ ID NO: 273897 - DNA, 35 bp, Artificial Sequence
  Description of Artificial Sequence: Synthetic oligonucleotide
agaacagccaaagaattgcatcattcgaacgcgtc

SEQ ID NO: 273898 - DNA, 34 bp, Artificial Sequence
  Description of Artificial Sequence: Synthetic oligonucleotide
gaacagccaaagaattgcatcattcgaacgcgtc

SEQ ID NO: 273899 - DNA, 34 bp, Artificial Sequence
  Description of Artificial Sequence: Synthetic oligonucleotide
aacagccaaagaattgcatcattcgaacgcgtcg

SEQ ID NO: 273900 - DNA, 33 bp, Artificial Sequence
  Description of Artificial Sequence: Synthetic oligonucleotide
acagccaaagaattgcatcattcgaacgcgtcg

SEQ ID NO: 273901 - DNA, 32 bp, Artificial Sequence
  Description of Artificial Sequence: Synthetic oligonucleotide
cagccaaagaattgcatcattcgaacgcgtcg

SEQ ID NO: 273902 - DNA, 33 bp, Artificial Sequence
  Description of Artificial Sequence: Synthetic oligonucleotide
agccaaagaattgcatcattcgaacgcgtcgtc

SEQ ID NO: 273903 - DNA, 32 bp, Artificial Sequence
  Description of Artificial Sequence: Synthetic oligonucleotide
gccaaagaattgcatcattcgaacgcgtcgtc

SEQ ID NO: 273904 - DNA, 32 bp, Artificial Sequence
  Description of Artificial Sequence: Synthetic oligonucleotide
ccaaagaattgcatcattcgaacgcgtcgtcc

SEQ ID NO: 273905 - DNA, 32 bp, Artificial Sequence
  Description of Artificial Sequence: Synthetic oligonucleotide
caaagaattgcatcattcgaacgcgtcgtccc

SEQ ID NO: 273906 - DNA, 32 bp, Artificial Sequence
  Description of Artificial Sequence: Synthetic oligonucleotide
aaagaattgcatcattcgaacgcgtcgtcccg

SEQ ID NO: 273907 - DNA, 31 bp, Artificial Sequence
  Description of Artificial Sequence: Synthetic oligonucleotide
aagaattgcatcattcgaacgcgtcgtcccg

SEQ ID NO: 273908 - DNA, 30 bp, Artificial Sequence
  Description of Artificial Sequence: Synthetic oligonucleotide
agaattgcatcattcgaacgcgtcgtcccg

SEQ ID NO: 273909 - DNA, 29 bp, Artificial Sequence
  Description of Artificial Sequence: Synthetic oligonucleotide
gaattgcatcattcgaacgcgtcgtcccg

SEQ ID NO: 273910 - DNA, 29 bp, Artificial Sequence
  Description of Artificial Sequence: Synthetic oligonucleotide
aattgcatcattcgaacgcgtcgtcccgg

SEQ ID NO: 273911 - DNA, 28 bp, Artificial Sequence
  Description of Artificial Sequence: Synthetic oligonucleotide
attgcatcattcgaacgcgtcgtcccgg

SEQ ID NO: 273912 - DNA, 27 bp, Artificial Sequence
  Description of Artificial Sequence: Synthetic oligonucleotide
ttgcatcattcgaacgcgtcgtcccgg

SEQ ID NO: 273913 - DNA, 26 bp, Artificial Sequence
  Description of Artificial Sequence: Synthetic oligonucleotide
tgcatcattcgaacgcgtcgtcccgg

SEQ ID NO: 273914 - DNA, 25 bp, Artificial Sequence
  Description of Artificial Sequence: Synthetic oligonucleotide
gcatcattcgaacgcgtcgtcccgg

SEQ ID NO: 273915 - DNA, 25 bp, Artificial Sequence
  Description of Artificial Sequence: Synthetic oligonucleotide
catcattcgaacgcgtcgtcccggg

SEQ ID NO: 273916 - DNA, 25 bp, Artificial Sequence
  Description of Artificial Sequence: Synthetic oligonucleotide
atcattcgaacgcgtcgtcccgggg

SEQ ID NO: 273917 - DNA, 24 bp, Artificial Sequence
  Description of Artificial Sequence: Synthetic oligonucleotide
tcattcgaacgcgtcgtcccgggg

SEQ ID NO: 273918 - DNA, 23 bp, Artificial Sequence
  Description of Artificial Sequence: Synthetic oligonucleotide
cattcgaacgcgtcgtcccgggg

SEQ ID NO: 273919 - DNA, 24 bp, Artificial Sequence
  Description of Artificial Sequence: Synthetic oligonucleotide
attcgaacgcgtcgtcccggggca

SEQ ID NO: 273920 - DNA, 23 bp, Artificial Sequence
  Description of Artificial Sequence: Synthetic oligonucleotide
ttcgaacgcgtcgtcccggggca

SEQ ID NO: 273921 - DNA, 22 bp, Artificial Sequence
  Description of Artificial Sequence: Synthetic oligonucleotide
tcgaacgcgtcgtcccggggca

SEQ ID NO: 273922 - DNA, 21 bp, Artificial Sequence
  Description of Artificial Sequence: Synthetic oligonucleotide
cgaacgcgtcgtcccggggca

SEQ ID NO: 273923 - DNA, 23 bp, Artificial Sequence
  Description of Artificial Sequence: Synthetic oligonucleotide
gaacgcgtcgtcccggggcacaa

SEQ ID NO: 273924 - DNA, 23 bp, Artificial Sequence
  Description of Artificial Sequence: Synthetic oligonucleotide
aacgcgtcgtcccggggcacaag

SEQ ID NO: 273925 - DNA, 22 bp, Artificial Sequence
  Description of Artificial Sequence: Synthetic oligonucleotide
acgcgtcgtcccggggcacaag

SEQ ID NO: 273926 - DNA, 21 bp, Artificial Sequence
  Description of Artificial Sequence: Synthetic oligonucleotide
cgcgtcgtcccggggcacaag

SEQ ID NO: 273927 - DNA, 22 bp, Artificial Sequence
  Description of Artificial Sequence: Synthetic oligonucleotide
gcgtcgtcccggggcacaaggt

SEQ ID NO: 273928 - DNA, 22 bp, Artificial Sequence
  Description of Artificial Sequence: Synthetic oligonucleotide
cgtcgtcccggggcacaaggtc

SEQ ID NO: 273929 - DNA, 22 bp, Artificial Sequence
  Description of Artificial Sequence: Synthetic oligonucleotide
gtcgtcccggggcacaaggtcc

SEQ ID NO: 273930 - DNA, 23 bp, Artificial Sequence
  Description of Artificial Sequence: Synthetic oligonucleotide
tcgtcccggggcacaaggtccca

SEQ ID NO: 273931 - DNA, 22 bp, Artificial Sequence
  Description of Artificial Sequence: Synthetic oligonucleotide
cgtcccggggcacaaggtccca

SEQ ID NO: 273932 - DNA, 23 bp, Artificial Sequence
  Description of Artificial Sequence: Synthetic oligonucleotide
gtcccggggcacaaggtcccaca

SEQ ID NO: 273933 - DNA, 23 bp, Artificial Sequence
  Description of Artificial Sequence: Synthetic oligonucleotide
tcccggggcacaaggtcccacac

SEQ ID NO: 273934 - DNA, 22 bp, Artificial Sequence
  Description of Artificial Sequence: Synthetic oligonucleotide
cccggggcacaaggtcccacac

SEQ ID NO: 273935 - DNA, 22 bp, Artificial Sequence
  Description of Artificial Sequence: Synthetic oligonucleotide
ccggggcacaaggtcccacacg

SEQ ID NO: 273936 - DNA, 23 bp, Artificial Sequence
  Description of Artificial Sequence: Synthetic oligonucleotide
cggggcacaaggtcccacacgca

SEQ ID NO: 273937 - DNA, 23 bp, Artificial Sequence
  Description of Artificial Sequence: Synthetic oligonucleotide
ggggcacaaggtcccacacgcac

SEQ ID NO: 273938 - DNA, 23 bp, Artificial Sequence
  Description of Artificial Sequence: Synthetic oligonucleotide
gggcacaaggtcccacacgcacg

SEQ ID NO: 273939 - DNA, 25 bp, Artificial Sequence
  Description of Artificial Sequence: Synthetic oligonucleotide
ggcacaaggtcccacacgcacgcta

SEQ ID NO: 273940 - DNA, 26 bp, Artificial Sequence
  Description of Artificial Sequence: Synthetic oligonucleotide
gcacaaggtcccacacgcacgctaga

SEQ ID NO: 273941 - DNA, 26 bp, Artificial Sequence
  Description of Artificial Sequence: Synthetic oligonucleotide
cacaaggtcccacacgcacgctagac

SEQ ID NO: 273942 - DNA, 26 bp, Artificial Sequence
  Description of Artificial Sequence: Synthetic oligonucleotide
acaaggtcccacacgcacgctagacc

SEQ ID NO: 273943 - DNA, 25 bp, Artificial Sequence
  Description of Artificial Sequence: Synthetic oligonucleotide
caaggtcccacacgcacgctagacc

SEQ ID NO: 273944 - DNA, 25 bp, Artificial Sequence
  Description of Artificial Sequence: Synthetic oligonucleotide
aaggtcccacacgcacgctagaccg

SEQ ID NO: 273945 - DNA, 24 bp, Artificial Sequence
  Description of Artificial Sequence: Synthetic oligonucleotide
aggtcccacacgcacgctagaccg

SEQ ID NO: 273946 - DNA, 23 bp, Artificial Sequence
  Description of Artificial Sequence: Synthetic oligonucleotide
ggtcccacacgcacgctagaccg

SEQ ID NO: 273947 - DNA, 23 bp, Artificial Sequence
  Description of Artificial Sequence: Synthetic oligonucleotide
gtcccacacgcacgctagaccgg

SEQ ID NO: 273948 - DNA, 24 bp, Artificial Sequence
  Description of Artificial Sequence: Synthetic oligonucleotide
tcccacacgcacgctagaccggga

SEQ ID NO: 273949 - DNA, 23 bp, Artificial Sequence
  Description of Artificial Sequence: Synthetic oligonucleotide
cccacacgcacgctagaccggga

SEQ ID NO: 273950 - DNA, 23 bp, Artificial Sequence
  Description of Artificial Sequence: Synthetic oligonucleotide
ccacacgcacgctagaccgggag

SEQ ID NO: 273951 - DNA, 24 bp, Artificial Sequence
  Description of Artificial Sequence: Synthetic oligonucleotide
cacacgcacgctagaccgggagca

SEQ ID NO: 273952 - DNA, 24 bp, Artificial Sequence
  Description of Artificial Sequence: Synthetic oligonucleotide
acacgcacgctagaccgggagcac

SEQ ID NO: 273953 - DNA, 23 bp, Artificial Sequence
  Description of Artificial Sequence: Synthetic oligonucleotide
cacgcacgctagaccgggagcac

SEQ ID NO: 273954 - DNA, 25 bp, Artificial Sequence
  Description of Artificial Sequence: Synthetic oligonucleotide
acgcacgctagaccgggagcaccat

SEQ ID NO: 273955 - DNA, 24 bp, Artificial Sequence
  Description of Artificial Sequence: Synthetic oligonucleotide
cgcacgctagaccgggagcaccat

SEQ ID NO: 273956 - DNA, 24 bp, Artificial Sequence
  Description of Artificial Sequence: Synthetic oligonucleotide
gcacgctagaccgggagcaccatc

SEQ ID NO: 273957 - DNA, 24 bp, Artificial Sequence
  Description of Artificial Sequence: Synthetic oligonucleotide
cacgctagaccgggagcaccatcg

SEQ ID NO: 273958 - DNA, 24 bp, Artificial Sequence
  Description of Artificial Sequence: Synthetic oligonucleotide
acgctagaccgggagcaccatcgc

SEQ ID NO: 273959 - DNA, 23 bp, Artificial Sequence
  Description of Artificial Sequence: Synthetic oligonucleotide
cgctagaccgggagcaccatcgc

SEQ ID NO: 273960 - DNA, 23 bp, Artificial Sequence
  Description of Artificial Sequence: Synthetic oligonucleotide
gctagaccgggagcaccatcgcc

SEQ ID NO: 273961 - DNA, 23 bp, Artificial Sequence
  Description of Artificial Sequence: Synthetic oligonucleotide
ctagaccgggagcaccatcgccg

SEQ ID NO: 273962 - DNA, 23 bp, Artificial Sequence
  Description of Artificial Sequence: Synthetic oligonucleotide
tagaccgggagcaccatcgccgg

SEQ ID NO: 273963 - DNA, 22 bp, Artificial Sequence
  Description of Artificial Sequence: Synthetic oligonucleotide
agaccgggagcaccatcgccgg

SEQ ID NO: 273964 - DNA, 21 bp, Artificial Sequence
  Description of Artificial Sequence: Synthetic oligonucleotide
gaccgggagcaccatcgccgg

SEQ ID NO: 273965 - DNA, 21 bp, Artificial Sequence
  Description of Artificial Sequence: Synthetic oligonucleotide
accgggagcaccatcgccggc

SEQ ID NO: 273966 - DNA, 20 bp, Artificial Sequence
  Description of Artificial Sequence: Synthetic oligonucleotide
ccgggagcaccatcgccggc

SEQ ID NO: 273967 - DNA, 21 bp, Artificial Sequence
  Description of Artificial Sequence: Synthetic oligonucleotide
cgggagcaccatcgccggcct

SEQ ID NO: 273968 - DNA, 21 bp, Artificial Sequence
  Description of Artificial Sequence: Synthetic oligonucleotide
gggagcaccatcgccggcctg

SEQ ID NO: 273969 - DNA, 22 bp, Artificial Sequence
  Description of Artificial Sequence: Synthetic oligonucleotide
ggagcaccatcgccggcctggt

SEQ ID NO: 273970 - DNA, 24 bp, Artificial Sequence
  Description of Artificial Sequence: Synthetic oligonucleotide
gagcaccatcgccggcctggtgat

SEQ ID NO: 273971 - DNA, 24 bp, Artificial Sequence
  Description of Artificial Sequence: Synthetic oligonucleotide
agcaccatcgccggcctggtgatc

SEQ ID NO: 273972 - DNA, 23 bp, Artificial Sequence
  Description of Artificial Sequence: Synthetic oligonucleotide
gcaccatcgccggcctggtgatc

SEQ ID NO: 273973 - DNA, 25 bp, Artificial Sequence
  Description of Artificial Sequence: Synthetic oligonucleotide
caccatcgccggcctggtgatccaa

SEQ ID NO: 273974 - DNA, 26 bp, Artificial Sequence
  Description of Artificial Sequence: Synthetic oligonucleotide
accatcgccggcctggtgatccaaga

SEQ ID NO: 273975 - DNA, 25 bp, Artificial Sequence
  Description of Artificial Sequence: Synthetic oligonucleotide
ccatcgccggcctggtgatccaaga

SEQ ID NO: 273976 - DNA, 25 bp, Artificial Sequence
  Description of Artificial Sequence: Synthetic oligonucleotide
catcgccggcctggtgatccaagac

SEQ ID NO: 273977 - DNA, 25 bp, Artificial Sequence
  Description of Artificial Sequence: Synthetic oligonucleotide
atcgccggcctggtgatccaagacg

SEQ ID NO: 273978 - DNA, 24 bp, Artificial Sequence
  Description of Artificial Sequence: Synthetic oligonucleotide
tcgccggcctggtgatccaagacg

SEQ ID NO: 273979 - DNA, 23 bp, Artificial Sequence
  Description of Artificial Sequence: Synthetic oligonucleotide
cgccggcctggtgatccaagacg

SEQ ID NO: 273980 - DNA, 23 bp, Artificial Sequence
  Description of Artificial Sequence: Synthetic oligonucleotide
gccggcctggtgatccaagacgc

SEQ ID NO: 273981 - DNA, 23 bp, Artificial Sequence
  Description of Artificial Sequence: Synthetic oligonucleotide
ccggcctggtgatccaagacgcg

SEQ ID NO: 273982 - DNA, 24 bp, Artificial Sequence
  Description of Artificial Sequence: Synthetic oligonucleotide
cggcctggtgatccaagacgcggt

SEQ ID NO: 273983 - DNA, 27 bp, Artificial Sequence
  Description of Artificial Sequence: Synthetic oligonucleotide
ggcctggtgatccaagacgcggtcatt

SEQ ID NO: 273984 - DNA, 27 bp, Artificial Sequence
  Description of Artificial Sequence: Synthetic oligonucleotide
gcctggtgatccaagacgcggtcattc

SEQ ID NO: 273985 - DNA, 28 bp, Artificial Sequence
  Description of Artificial Sequence: Synthetic oligonucleotide
cctggtgatccaagacgcggtcattctc

SEQ ID NO: 273986 - DNA, 28 bp, Artificial Sequence
  Description of Artificial Sequence: Synthetic oligonucleotide
ctggtgatccaagacgcggtcattctcg

SEQ ID NO: 273987 - DNA, 28 bp, Artificial Sequence
  Description of Artificial Sequence: Synthetic oligonucleotide
tggtgatccaagacgcggtcattctcgg

SEQ ID NO: 273988 - DNA, 27 bp, Artificial Sequence
  Description of Artificial Sequence: Synthetic oligonucleotide
ggtgatccaagacgcggtcattctcgg

SEQ ID NO: 273989 - DNA, 27 bp, Artificial Sequence
  Description of Artificial Sequence: Synthetic oligonucleotide
gtgatccaagacgcggtcattctcggc

SEQ ID NO: 273990 - DNA, 27 bp, Artificial Sequence
  Description of Artificial Sequence: Synthetic oligonucleotide
tgatccaagacgcggtcattctcggcg

SEQ ID NO: 273991 - DNA, 26 bp, Artificial Sequence
  Description of Artificial Sequence: Synthetic oligonucleotide
gatccaagacgcggtcattctcggcg

SEQ ID NO: 273992 - DNA, 26 bp, Artificial Sequence
  Description of Artificial Sequence: Synthetic oligonucleotide
atccaagacgcggtcattctcggcgc

SEQ ID NO: 273993 - DNA, 25 bp, Artificial Sequence
  Description of Artificial Sequence: Synthetic oligonucleotide
tccaagacgcggtcattctcggcgc

SEQ ID NO: 273994 - DNA, 24 bp, Artificial Sequence
  Description of Artificial Sequence: Synthetic oligonucleotide
ccaagacgcggtcattctcggcgc

SEQ ID NO: 273995 - DNA, 24 bp, Artificial Sequence
  Description of Artificial Sequence: Synthetic oligonucleotide
caagacgcggtcattctcggcgcc

SEQ ID NO: 273996 - DNA, 27 bp, Artificial Sequence
  Description of Artificial Sequence: Synthetic oligonucleotide
aagacgcggtcattctcggcgccgatt

SEQ ID NO: 273997 - DNA, 26 bp, Artificial Sequence
  Description of Artificial Sequence: Synthetic oligonucleotide
agacgcggtcattctcggcgccgatt

SEQ ID NO: 273998 - DNA, 25 bp, Artificial Sequence
  Description of Artificial Sequence: Synthetic oligonucleotide
gacgcggtcattctcggcgccgatt

SEQ ID NO: 273999 - DNA, 25 bp, Artificial Sequence
  Description of Artificial Sequence: Synthetic oligonucleotide
acgcggtcattctcggcgccgattc

SEQ ID NO: 274000 - DNA, 24 bp, Artificial Sequence
  Description of Artificial Sequence: Synthetic oligonucleotide
cgcggtcattctcggcgccgattc

SEQ ID NO: 274001 - DNA, 24 bp, Artificial Sequence
  Description of Artificial Sequence: Synthetic oligonucleotide
gcggtcattctcggcgccgattcg

SEQ ID NO: 274002 - DNA, 24 bp, Artificial Sequence
  Description of Artificial Sequence: Synthetic oligonucleotide
cggtcattctcggcgccgattcgc

SEQ ID NO: 274003 - DNA, 25 bp, Artificial Sequence
  Description of Artificial Sequence: Synthetic oligonucleotide
ggtcattctcggcgccgattcgcga

SEQ ID NO: 274004 - DNA, 25 bp, Artificial Sequence
  Description of Artificial Sequence: Synthetic oligonucleotide
gtcattctcggcgccgattcgcgag

SEQ ID NO: 274005 - DNA, 25 bp, Artificial Sequence
  Description of Artificial Sequence: Synthetic oligonucleotide
tcattctcggcgccgattcgcgagc

SEQ ID NO: 274006 - DNA, 24 bp, Artificial Sequence
  Description of Artificial Sequence: Synthetic oligonucleotide
cattctcggcgccgattcgcgagc

SEQ ID NO: 274007 - DNA, 25 bp, Artificial Sequence
  Description of Artificial Sequence: Synthetic oligonucleotide
attctcggcgccgattcgcgagcca

SEQ ID NO: 274008 - DNA, 24 bp, Artificial Sequence
  Description of Artificial Sequence: Synthetic oligonucleotide
ttctcggcgccgattcgcgagcca

SEQ ID NO: 274009 - DNA, 23 bp, Artificial Sequence
  Description of Artificial Sequence: Synthetic oligonucleotide
tctcggcgccgattcgcgagcca

SEQ ID NO: 274010 - DNA, 22 bp, Artificial Sequence
  Description of Artificial Sequence: Synthetic oligonucleotide
ctcggcgccgattcgcgagcca

SEQ ID NO: 274011 - DNA, 25 bp, Artificial Sequence
  Description of Artificial Sequence: Synthetic oligonucleotide
tcggcgccgattcgcgagccagtaa

SEQ ID NO: 274012 - DNA, 24 bp, Artificial Sequence
  Description of Artificial Sequence: Synthetic oligonucleotide
cggcgccgattcgcgagccagtaa

SEQ ID NO: 274013 - DNA, 24 bp, Artificial Sequence
  Description of Artificial Sequence: Synthetic oligonucleotide
ggcgccgattcgcgagccagtaac

SEQ ID NO: 274014 - DNA, 27 bp, Artificial Sequence
  Description of Artificial Sequence: Synthetic oligonucleotide
gcgccgattcgcgagccagtaacgatt

SEQ ID NO: 274015 - DNA, 27 bp, Artificial Sequence
  Description of Artificial Sequence: Synthetic oligonucleotide
cgccgattcgcgagccagtaacgattc

SEQ ID NO: 274016 - DNA, 27 bp, Artificial Sequence
  Description of Artificial Sequence: Synthetic oligonucleotide
gccgattcgcgagccagtaacgattcc

SEQ ID NO: 274017 - DNA, 27 bp, Artificial Sequence
  Description of Artificial Sequence: Synthetic oligonucleotide
ccgattcgcgagccagtaacgattccg

SEQ ID NO: 274018 - DNA, 28 bp, Artificial Sequence
  Description of Artificial Sequence: Synthetic oligonucleotide
cgattcgcgagccagtaacgattccgtc

SEQ ID NO: 274019 - DNA, 28 bp, Artificial Sequence
  Description of Artificial Sequence: Synthetic oligonucleotide
gattcgcgagccagtaacgattccgtcg

SEQ ID NO: 274020 - DNA, 29 bp, Artificial Sequence
  Description of Artificial Sequence: Synthetic oligonucleotide
attcgcgagccagtaacgattccgtcgtg

SEQ ID NO: 274021 - DNA, 28 bp, Artificial Sequence
  Description of Artificial Sequence: Synthetic oligonucleotide
ttcgcgagccagtaacgattccgtcgtg

SEQ ID NO: 274022 - DNA, 27 bp, Artificial Sequence
  Description of Artificial Sequence: Synthetic oligonucleotide
tcgcgagccagtaacgattccgtcgtg

SEQ ID NO: 274023 - DNA, 26 bp, Artificial Sequence
  Description of Artificial Sequence: Synthetic oligonucleotide
cgcgagccagtaacgattccgtcgtg

SEQ ID NO: 274024 - DNA, 26 bp, Artificial Sequence
  Description of Artificial Sequence: Synthetic oligonucleotide
gcgagccagtaacgattccgtcgtgg

SEQ ID NO: 274025 - DNA, 26 bp, Artificial Sequence
  Description of Artificial Sequence: Synthetic oligonucleotide
cgagccagtaacgattccgtcgtggc

SEQ ID NO: 274026 - DNA, 26 bp, Artificial Sequence
  Description of Artificial Sequence: Synthetic oligonucleotide
gagccagtaacgattccgtcgtggcg

SEQ ID NO: 274027 - DNA, 27 bp, Artificial Sequence
  Description of Artificial Sequence: Synthetic oligonucleotide
agccagtaacgattccgtcgtggcgca

SEQ ID NO: 274028 - DNA, 26 bp, Artificial Sequence
  Description of Artificial Sequence: Synthetic oligonucleotide
gccagtaacgattccgtcgtggcgca

SEQ ID NO: 274029 - DNA, 27 bp, Artificial Sequence
  Description of Artificial Sequence: Synthetic oligonucleotide
ccagtaacgattccgtcgtggcgcaca

SEQ ID NO: 274030 - DNA, 28 bp, Artificial Sequence
  Description of Artificial Sequence: Synthetic oligonucleotide
cagtaacgattccgtcgtggcgcacaag

SEQ ID NO: 274031 - DNA, 29 bp, Artificial Sequence
  Description of Artificial Sequence: Synthetic oligonucleotide
agtaacgattccgtcgtggcgcacaagag

SEQ ID NO: 274032 - DNA, 28 bp, Artificial Sequence
  Description of Artificial Sequence: Synthetic oligonucleotide
gtaacgattccgtcgtggcgcacaagag

SEQ ID NO: 274033 - DNA, 28 bp, Artificial Sequence
  Description of Artificial Sequence: Synthetic oligonucleotide
taacgattccgtcgtggcgcacaagagc

SEQ ID NO: 274034 - DNA, 27 bp, Artificial Sequence
  Description of Artificial Sequence: Synthetic oligonucleotide
aacgattccgtcgtggcgcacaagagc

SEQ ID NO: 274035 - DNA, 27 bp, Artificial Sequence
  Description of Artificial Sequence: Synthetic oligonucleotide
acgattccgtcgtggcgcacaagagct

SEQ ID NO: 274036 - DNA, 26 bp, Artificial Sequence
  Description of Artificial Sequence: Synthetic oligonucleotide
cgattccgtcgtggcgcacaagagct

SEQ ID NO: 274037 - DNA, 26 bp, Artificial Sequence
  Description of Artificial Sequence: Synthetic oligonucleotide
gattccgtcgtggcgcacaagagctc

SEQ ID NO: 274038 - DNA, 26 bp, Artificial Sequence
  Description of Artificial Sequence: Synthetic oligonucleotide
attccgtcgtggcgcacaagagctcc

SEQ ID NO: 274039 - DNA, 25 bp, Artificial Sequence
  Description of Artificial Sequence: Synthetic oligonucleotide
ttccgtcgtggcgcacaagagctcc

SEQ ID NO: 274040 - DNA, 24 bp, Artificial Sequence
  Description of Artificial Sequence: Synthetic oligonucleotide
tccgtcgtggcgcacaagagctcc

SEQ ID NO: 274041 - DNA, 23 bp, Artificial Sequence
  Description of Artificial Sequence: Synthetic oligonucleotide
ccgtcgtggcgcacaagagctcc

SEQ ID NO: 274042 - DNA, 24 bp, Artificial Sequence
  Description of Artificial Sequence: Synthetic oligonucleotide
cgtcgtggcgcacaagagctccga

SEQ ID NO: 274043 - DNA, 26 bp, Artificial Sequence
  Description of Artificial Sequence: Synthetic oligonucleotide
gtcgtggcgcacaagagctccgagaa

SEQ ID NO: 274044 - DNA, 27 bp, Artificial Sequence
  Description of Artificial Sequence: Synthetic oligonucleotide
tcgtggcgcacaagagctccgagaaga

SEQ ID NO: 274045 - DNA, 27 bp, Artificial Sequence
  Description of Artificial Sequence: Synthetic oligonucleotide
cgtggcgcacaagagctccgagaagat

SEQ ID NO: 274046 - DNA, 27 bp, Artificial Sequence
  Description of Artificial Sequence: Synthetic oligonucleotide
gtggcgcacaagagctccgagaagatg

SEQ ID NO: 274047 - DNA, 27 bp, Artificial Sequence
  Description of Artificial Sequence: Synthetic oligonucleotide
tggcgcacaagagctccgagaagatgc

SEQ ID NO: 274048 - DNA, 27 bp, Artificial Sequence
  Description of Artificial Sequence: Synthetic oligonucleotide
ggcgcacaagagctccgagaagatgca

SEQ ID NO: 274049 - DNA, 27 bp, Artificial Sequence
  Description of Artificial Sequence: Synthetic oligonucleotide
gcgcacaagagctccgagaagatgcac

SEQ ID NO: 274050 - DNA, 29 bp, Artificial Sequence
  Description of Artificial Sequence: Synthetic oligonucleotide
cgcacaagagctccgagaagatgcacttc

SEQ ID NO: 274051 - DNA, 31 bp, Artificial Sequence
  Description of Artificial Sequence: Synthetic oligonucleotide
gcacaagagctccgagaagatgcacttcatc

SEQ ID NO: 274052 - DNA, 31 bp, Artificial Sequence
  Description of Artificial Sequence: Synthetic oligonucleotide
cacaagagctccgagaagatgcacttcatcc

SEQ ID NO: 274053 - DNA, 31 bp, Artificial Sequence
  Description of Artificial Sequence: Synthetic oligonucleotide
acaagagctccgagaagatgcacttcatccc

SEQ ID NO: 274054 - DNA, 30 bp, Artificial Sequence
  Description of Artificial Sequence: Synthetic oligonucleotide
caagagctccgagaagatgcacttcatccc

SEQ ID NO: 274055 - DNA, 30 bp, Artificial Sequence
  Description of Artificial Sequence: Synthetic oligonucleotide
aagagctccgagaagatgcacttcatcccc

SEQ ID NO: 274056 - DNA, 29 bp, Artificial Sequence
  Description of Artificial Sequence: Synthetic oligonucleotide
agagctccgagaagatgcacttcatcccc

SEQ ID NO: 274057 - DNA, 28 bp, Artificial Sequence
  Description of Artificial Sequence: Synthetic oligonucleotide
gagctccgagaagatgcacttcatcccc

SEQ ID NO: 274058 - DNA, 28 bp, Artificial Sequence
  Description of Artificial Sequence: Synthetic oligonucleotide
agctccgagaagatgcacttcatccccc

SEQ ID NO: 274059 - DNA, 27 bp, Artificial Sequence
  Description of Artificial Sequence: Synthetic oligonucleotide
gctccgagaagatgcacttcatccccc

SEQ ID NO: 274060 - DNA, 27 bp, Artificial Sequence
  Description of Artificial Sequence: Synthetic oligonucleotide
ctccgagaagatgcacttcatcccccc

SEQ ID NO: 274061 - DNA, 27 bp, Artificial Sequence
  Description of Artificial Sequence: Synthetic oligonucleotide
tccgagaagatgcacttcatccccccc

SEQ ID NO: 274062 - DNA, 27 bp, Artificial Sequence
  Description of Artificial Sequence: Synthetic oligonucleotide
ccgagaagatgcacttcatccccccca

SEQ ID NO: 274063 - DNA, 31 bp, Artificial Sequence
  Description of Artificial Sequence: Synthetic oligonucleotide
cgagaagatgcacttcatcccccccaaaaac

SEQ ID NO: 274064 - DNA, 33 bp, Artificial Sequence
  Description of Artificial Sequence: Synthetic oligonucleotide
gagaagatgcacttcatcccccccaaaaactac

SEQ ID NO: 274065 - DNA, 34 bp, Artificial Sequence
  Description of Artificial Sequence: Synthetic oligonucleotide
agaagatgcacttcatcccccccaaaaactactg

SEQ ID NO: 274066 - DNA, 33 bp, Artificial Sequence
  Description of Artificial Sequence: Synthetic oligonucleotide
gaagatgcacttcatcccccccaaaaactactg

SEQ ID NO: 274067 - DNA, 33 bp, Artificial Sequence
  Description of Artificial Sequence: Synthetic oligonucleotide
aagatgcacttcatcccccccaaaaactactgc

SEQ ID NO: 274068 - DNA, 32 bp, Artificial Sequence
  Description of Artificial Sequence: Synthetic oligonucleotide
agatgcacttcatcccccccaaaaactactgc

SEQ ID NO: 274069 - DNA, 31 bp, Artificial Sequence
  Description of Artificial Sequence: Synthetic oligonucleotide
gatgcacttcatcccccccaaaaactactgc

SEQ ID NO: 274070 - DNA, 32 bp, Artificial Sequence
  Description of Artificial Sequence: Synthetic oligonucleotide
atgcacttcatcccccccaaaaactactgctg

SEQ ID NO: 274071 - DNA, 31 bp, Artificial Sequence
  Description of Artificial Sequence: Synthetic oligonucleotide
tgcacttcatcccccccaaaaactactgctg

SEQ ID NO: 274072 - DNA, 30 bp, Artificial Sequence
  Description of Artificial Sequence: Synthetic oligonucleotide
gcacttcatcccccccaaaaactactgctg

SEQ ID NO: 274073 - DNA, 31 bp, Artificial Sequence
  Description of Artificial Sequence: Synthetic oligonucleotide
cacttcatcccccccaaaaactactgctgag

SEQ ID NO: 274074 - DNA, 31 bp, Artificial Sequence
  Description of Artificial Sequence: Synthetic oligonucleotide
acttcatcccccccaaaaactactgctgagg

SEQ ID NO: 274075 - DNA, 30 bp, Artificial Sequence
  Description of Artificial Sequence: Synthetic oligonucleotide
cttcatcccccccaaaaactactgctgagg

SEQ ID NO: 274076 - DNA, 30 bp, Artificial Sequence
  Description of Artificial Sequence: Synthetic oligonucleotide
ttcatcccccccaaaaactactgctgaggg

SEQ ID NO: 274077 - DNA, 29 bp, Artificial Sequence
  Description of Artificial Sequence: Synthetic oligonucleotide
tcatcccccccaaaaactactgctgaggg

SEQ ID NO: 274078 - DNA, 28 bp, Artificial Sequence
  Description of Artificial Sequence: Synthetic oligonucleotide
catcccccccaaaaactactgctgaggg

SEQ ID NO: 274079 - DNA, 28 bp, Artificial Sequence
  Description of Artificial Sequence: Synthetic oligonucleotide
atcccccccaaaaactactgctgagggg

SEQ ID NO: 274080 - DNA, 27 bp, Artificial Sequence
  Description of Artificial Sequence: Synthetic oligonucleotide
tcccccccaaaaactactgctgagggg

SEQ ID NO: 274081 - DNA, 26 bp, Artificial Sequence
  Description of Artificial Sequence: Synthetic oligonucleotide
cccccccaaaaactactgctgagggg

SEQ ID NO: 274082 - DNA, 27 bp, Artificial Sequence
  Description of Artificial Sequence: Synthetic oligonucleotide
ccccccaaaaactactgctgaggggct

SEQ ID NO: 274083 - DNA, 27 bp, Artificial Sequence
  Description of Artificial Sequence: Synthetic oligonucleotide
cccccaaaaactactgctgaggggctg

SEQ ID NO: 274084 - DNA, 27 bp, Artificial Sequence
  Description of Artificial Sequence: Synthetic oligonucleotide
ccccaaaaactactgctgaggggctgg

SEQ ID NO: 274085 - DNA, 28 bp, Artificial Sequence
  Description of Artificial Sequence: Synthetic oligonucleotide
cccaaaaactactgctgaggggctggac

SEQ ID NO: 274086 - DNA, 30 bp, Artificial Sequence
  Description of Artificial Sequence: Synthetic oligonucleotide
ccaaaaactactgctgaggggctggactag

SEQ ID NO: 274087 - DNA, 30 bp, Artificial Sequence
  Description of Artificial Sequence: Synthetic oligonucleotide
caaaaactactgctgaggggctggactagc

SEQ ID NO: 274088 - DNA, 30 bp, Artificial Sequence
  Description of Artificial Sequence: Synthetic oligonucleotide
aaaaactactgctgaggggctggactagcc

SEQ ID NO: 274089 - DNA, 29 bp, Artificial Sequence
  Description of Artificial Sequence: Synthetic oligonucleotide
aaaactactgctgaggggctggactagcc

SEQ ID NO: 274090 - DNA, 28 bp, Artificial Sequence
  Description of Artificial Sequence: Synthetic oligonucleotide
aaactactgctgaggggctggactagcc

SEQ ID NO: 274091 - DNA, 27 bp, Artificial Sequence
  Description of Artificial Sequence: Synthetic oligonucleotide
aactactgctgaggggctggactagcc

SEQ ID NO: 274092 - DNA, 26 bp, Artificial Sequence
  Description of Artificial Sequence: Synthetic oligonucleotide
actactgctgaggggctggactagcc

SEQ ID NO: 274093 - DNA, 25 bp, Artificial Sequence
  Description of Artificial Sequence: Synthetic oligonucleotide
ctactgctgaggggctggactagcc

SEQ ID NO: 274094 - DNA, 25 bp, Artificial Sequence
  Description of Artificial Sequence: Synthetic oligonucleotide
tactgctgaggggctggactagccg

SEQ ID NO: 274095 - DNA, 24 bp, Artificial Sequence
  Description of Artificial Sequence: Synthetic oligonucleotide
actgctgaggggctggactagccg

SEQ ID NO: 274096 - DNA, 23 bp, Artificial Sequence
  Description of Artificial Sequence: Synthetic oligonucleotide
ctgctgaggggctggactagccg

SEQ ID NO: 274097 - DNA, 23 bp, Artificial Sequence
  Description of Artificial Sequence: Synthetic oligonucleotide
tgctgaggggctggactagccgc

SEQ ID NO: 274098 - DNA, 22 bp, Artificial Sequence
  Description of Artificial Sequence: Synthetic oligonucleotide
gctgaggggctggactagccgc

SEQ ID NO: 274099 - DNA, 22 bp, Artificial Sequence
  Description of Artificial Sequence: Synthetic oligonucleotide
ctgaggggctggactagccgcg

SEQ ID NO: 274100 - DNA, 23 bp, Artificial Sequence
  Description of Artificial Sequence: Synthetic oligonucleotide
tgaggggctggactagccgcggt

SEQ ID NO: 274101 - DNA, 22 bp, Artificial Sequence
  Description of Artificial Sequence: Synthetic oligonucleotide
gaggggctggactagccgcggt

SEQ ID NO: 274102 - DNA, 22 bp, Artificial Sequence
  Description of Artificial Sequence: Synthetic oligonucleotide
aggggctggactagccgcggtc

SEQ ID NO: 274103 - DNA, 21 bp, Artificial Sequence
  Description of Artificial Sequence: Synthetic oligonucleotide
ggggctggactagccgcggtc

SEQ ID NO: 274104 - DNA, 21 bp, Artificial Sequence
  Description of Artificial Sequence: Synthetic oligonucleotide
gggctggactagccgcggtcg

SEQ ID NO: 274105 - DNA, 21 bp, Artificial Sequence
  Description of Artificial Sequence: Synthetic oligonucleotide
ggctggactagccgcggtcgc

SEQ ID NO: 274106 - DNA, 21 bp, Artificial Sequence
  Description of Artificial Sequence: Synthetic oligonucleotide
gctggactagccgcggtcgcc

SEQ ID NO: 274107 - DNA, 22 bp, Artificial Sequence
  Description of Artificial Sequence: Synthetic oligonucleotide
ctggactagccgcggtcgccga

SEQ ID NO: 274108 - DNA, 24 bp, Artificial Sequence
  Description of Artificial Sequence: Synthetic oligonucleotide
tggactagccgcggtcgccgagat

SEQ ID NO: 274109 - DNA, 23 bp, Artificial Sequence
  Description of Artificial Sequence: Synthetic oligonucleotide
ggactagccgcggtcgccgagat

SEQ ID NO: 274110 - DNA, 24 bp, Artificial Sequence
  Description of Artificial Sequence: Synthetic oligonucleotide
gactagccgcggtcgccgagatca

SEQ ID NO: 274111 - DNA, 24 bp, Artificial Sequence
  Description of Artificial Sequence: Synthetic oligonucleotide
actagccgcggtcgccgagatcac

SEQ ID NO: 274112 - DNA, 23 bp, Artificial Sequence
  Description of Artificial Sequence: Synthetic oligonucleotide
ctagccgcggtcgccgagatcac

SEQ ID NO: 274113 - DNA, 24 bp, Artificial Sequence
  Description of Artificial Sequence: Synthetic oligonucleotide
tagccgcggtcgccgagatcacca

SEQ ID NO: 274114 - DNA, 23 bp, Artificial Sequence
  Description of Artificial Sequence: Synthetic oligonucleotide
agccgcggtcgccgagatcacca

SEQ ID NO: 274115 - DNA, 22 bp, Artificial Sequence
  Description of Artificial Sequence: Synthetic oligonucleotide
gccgcggtcgccgagatcacca

SEQ ID NO: 274116 - DNA, 23 bp, Artificial Sequence
  Description of Artificial Sequence: Synthetic oligonucleotide
ccgcggtcgccgagatcaccaca

SEQ ID NO: 274117 - DNA, 23 bp, Artificial Sequence
  Description of Artificial Sequence: Synthetic oligonucleotide
cgcggtcgccgagatcaccacac

SEQ ID NO: 274118 - DNA, 23 bp, Artificial Sequence
  Description of Artificial Sequence: Synthetic oligonucleotide
gcggtcgccgagatcaccacacg

SEQ ID NO: 274119 - DNA, 25 bp, Artificial Sequence
  Description of Artificial Sequence: Synthetic oligonucleotide
cggtcgccgagatcaccacacggtt

SEQ ID NO: 274120 - DNA, 25 bp, Artificial Sequence
  Description of Artificial Sequence: Synthetic oligonucleotide
ggtcgccgagatcaccacacggttg

SEQ ID NO: 274121 - DNA, 26 bp, Artificial Sequence
  Description of Artificial Sequence: Synthetic oligonucleotide
gtcgccgagatcaccacacggttggt

SEQ ID NO: 274122 - DNA, 26 bp, Artificial Sequence
  Description of Artificial Sequence: Synthetic oligonucleotide
tcgccgagatcaccacacggttggtg

SEQ ID NO: 274123 - DNA, 25 bp, Artificial Sequence
  Description of Artificial Sequence: Synthetic oligonucleotide
cgccgagatcaccacacggttggtg

SEQ ID NO: 274124 - DNA, 25 bp, Artificial Sequence
  Description of Artificial Sequence: Synthetic oligonucleotide
gccgagatcaccacacggttggtgg

SEQ ID NO: 274125 - DNA, 25 bp, Artificial Sequence
  Description of Artificial Sequence: Synthetic oligonucleotide
ccgagatcaccacacggttggtggc

SEQ ID NO: 274126 - DNA, 26 bp, Artificial Sequence
  Description of Artificial Sequence: Synthetic oligonucleotide
cgagatcaccacacggttggtggcgt

SEQ ID NO: 274127 - DNA, 26 bp, Artificial Sequence
  Description of Artificial Sequence: Synthetic oligonucleotide
gagatcaccacacggttggtggcgtg

SEQ ID NO: 274128 - DNA, 27 bp, Artificial Sequence
  Description of Artificial Sequence: Synthetic oligonucleotide
agatcaccacacggttggtggcgtgca

SEQ ID NO: 274129 - DNA, 27 bp, Artificial Sequence
  Description of Artificial Sequence: Synthetic oligonucleotide
gatcaccacacggttggtggcgtgcaa

SEQ ID NO: 274130 - DNA, 27 bp, Artificial Sequence
  Description of Artificial Sequence: Synthetic oligonucleotide
atcaccacacggttggtggcgtgcaag

SEQ ID NO: 274131 - DNA, 27 bp, Artificial Sequence
  Description of Artificial Sequence: Synthetic oligonucleotide
tcaccacacggttggtggcgtgcaaga

SEQ ID NO: 274132 - DNA, 27 bp, Artificial Sequence
  Description of Artificial Sequence: Synthetic oligonucleotide
caccacacggttggtggcgtgcaagat

SEQ ID NO: 274133 - DNA, 27 bp, Artificial Sequence
  Description of Artificial Sequence: Synthetic oligonucleotide
accacacggttggtggcgtgcaagatg

SEQ ID NO: 274134 - DNA, 26 bp, Artificial Sequence
  Description of Artificial Sequence: Synthetic oligonucleotide
ccacacggttggtggcgtgcaagatg

SEQ ID NO: 274135 - DNA, 27 bp, Artificial Sequence
  Description of Artificial Sequence: Synthetic oligonucleotide
cacacggttggtggcgtgcaagatgga

SEQ ID NO: 274136 - DNA, 27 bp, Artificial Sequence
  Description of Artificial Sequence: Synthetic oligonucleotide
acacggttggtggcgtgcaagatggac

SEQ ID NO: 274137 - DNA, 26 bp, Artificial Sequence
  Description of Artificial Sequence: Synthetic oligonucleotide
cacggttggtggcgtgcaagatggac

SEQ ID NO: 274138 - DNA, 27 bp, Artificial Sequence
  Description of Artificial Sequence: Synthetic oligonucleotide
acggttggtggcgtgcaagatggacct

SEQ ID NO: 274139 - DNA, 27 bp, Artificial Sequence
  Description of Artificial Sequence: Synthetic oligonucleotide
cggttggtggcgtgcaagatggaccta

SEQ ID NO: 274140 - DNA, 27 bp, Artificial Sequence
  Description of Artificial Sequence: Synthetic oligonucleotide
ggttggtggcgtgcaagatggacctac

SEQ ID NO: 274141 - DNA, 28 bp, Artificial Sequence
  Description of Artificial Sequence: Synthetic oligonucleotide
gttggtggcgtgcaagatggacctacac

SEQ ID NO: 274142 - DNA, 28 bp, Artificial Sequence
  Description of Artificial Sequence: Synthetic oligonucleotide
ttggtggcgtgcaagatggacctacacg

SEQ ID NO: 274143 - DNA, 27 bp, Artificial Sequence
  Description of Artificial Sequence: Synthetic oligonucleotide
tggtggcgtgcaagatggacctacacg

SEQ ID NO: 274144 - DNA, 26 bp, Artificial Sequence
  Description of Artificial Sequence: Synthetic oligonucleotide
ggtggcgtgcaagatggacctacacg

SEQ ID NO: 274145 - DNA, 26 bp, Artificial Sequence
  Description of Artificial Sequence: Synthetic oligonucleotide
gtggcgtgcaagatggacctacacgc

SEQ ID NO: 274146 - DNA, 27 bp, Artificial Sequence
  Description of Artificial Sequence: Synthetic oligonucleotide
tggcgtgcaagatggacctacacgcga

SEQ ID NO: 274147 - DNA, 27 bp, Artificial Sequence
  Description of Artificial Sequence: Synthetic oligonucleotide
ggcgtgcaagatggacctacacgcgat

SEQ ID NO: 274148 - DNA, 29 bp, Artificial Sequence
  Description of Artificial Sequence: Synthetic oligonucleotide
gcgtgcaagatggacctacacgcgatatc

SEQ ID NO: 274149 - DNA, 31 bp, Artificial Sequence
  Description of Artificial Sequence: Synthetic oligonucleotide
cgtgcaagatggacctacacgcgatatctac

SEQ ID NO: 274150 - DNA, 31 bp, Artificial Sequence
  Description of Artificial Sequence: Synthetic oligonucleotide
gtgcaagatggacctacacgcgatatctacg

SEQ ID NO: 274151 - DNA, 31 bp, Artificial Sequence
  Description of Artificial Sequence: Synthetic oligonucleotide
tgcaagatggacctacacgcgatatctacgg

SEQ ID NO: 274152 - DNA, 30 bp, Artificial Sequence
  Description of Artificial Sequence: Synthetic oligonucleotide
gcaagatggacctacacgcgatatctacgg

SEQ ID NO: 274153 - DNA, 30 bp, Artificial Sequence
  Description of Artificial Sequence: Synthetic oligonucleotide
caagatggacctacacgcgatatctacggc

SEQ ID NO: 274154 - DNA, 30 bp, Artificial Sequence
  Description of Artificial Sequence: Synthetic oligonucleotide
aagatggacctacacgcgatatctacggcc

SEQ ID NO: 274155 - DNA, 29 bp, Artificial Sequence
  Description of Artificial Sequence: Synthetic oligonucleotide
agatggacctacacgcgatatctacggcc

SEQ ID NO: 274156 - DNA, 28 bp, Artificial Sequence
  Description of Artificial Sequence: Synthetic oligonucleotide
gatggacctacacgcgatatctacggcc

SEQ ID NO: 274157 - DNA, 28 bp, Artificial Sequence
  Description of Artificial Sequence: Synthetic oligonucleotide
atggacctacacgcgatatctacggccc

SEQ ID NO: 274158 - DNA, 27 bp, Artificial Sequence
  Description of Artificial Sequence: Synthetic oligonucleotide
tggacctacacgcgatatctacggccc

SEQ ID NO: 274159 - DNA, 26 bp, Artificial Sequence
  Description of Artificial Sequence: Synthetic oligonucleotide
ggacctacacgcgatatctacggccc

SEQ ID NO: 274160 - DNA, 26 bp, Artificial Sequence
  Description of Artificial Sequence: Synthetic oligonucleotide
gacctacacgcgatatctacggcccg

SEQ ID NO: 274161 - DNA, 26 bp, Artificial Sequence
  Description of Artificial Sequence: Synthetic oligonucleotide
acctacacgcgatatctacggcccgc

SEQ ID NO: 274162 - DNA, 25 bp, Artificial Sequence
  Description of Artificial Sequence: Synthetic oligonucleotide
cctacacgcgatatctacggcccgc

SEQ ID NO: 274163 - DNA, 26 bp, Artificial Sequence
  Description of Artificial Sequence: Synthetic oligonucleotide
ctacacgcgatatctacggcccgcga

SEQ ID NO: 274164 - DNA, 26 bp, Artificial Sequence
  Description of Artificial Sequence: Synthetic oligonucleotide
tacacgcgatatctacggcccgcgag

SEQ ID NO: 274165 - DNA, 25 bp, Artificial Sequence
  Description of Artificial Sequence: Synthetic oligonucleotide
acacgcgatatctacggcccgcgag

SEQ ID NO: 274166 - DNA, 24 bp, Artificial Sequence
  Description of Artificial Sequence: Synthetic oligonucleotide
cacgcgatatctacggcccgcgag

SEQ ID NO: 274167 - DNA, 24 bp, Artificial Sequence
  Description of Artificial Sequence: Synthetic oligonucleotide
acgcgatatctacggcccgcgagc

SEQ ID NO: 274168 - DNA, 23 bp, Artificial Sequence
  Description of Artificial Sequence: Synthetic oligonucleotide
cgcgatatctacggcccgcgagc

SEQ ID NO: 274169 - DNA, 23 bp, Artificial Sequence
  Description of Artificial Sequence: Synthetic oligonucleotide
gcgatatctacggcccgcgagcc

SEQ ID NO: 274170 - DNA, 23 bp, Artificial Sequence
  Description of Artificial Sequence: Synthetic oligonucleotide
cgatatctacggcccgcgagccg

SEQ ID NO: 274171 - DNA, 23 bp, Artificial Sequence
  Description of Artificial Sequence: Synthetic oligonucleotide
gatatctacggcccgcgagccgc

SEQ ID NO: 274172 - DNA, 23 bp, Artificial Sequence
  Description of Artificial Sequence: Synthetic oligonucleotide
atatctacggcccgcgagccgcg

SEQ ID NO: 274173 - DNA, 22 bp, Artificial Sequence
  Description of Artificial Sequence: Synthetic oligonucleotide
tatctacggcccgcgagccgcg

SEQ ID NO: 274174 - DNA, 21 bp, Artificial Sequence
  Description of Artificial Sequence: Synthetic oligonucleotide
atctacggcccgcgagccgcg

SEQ ID NO: 274175 - DNA, 20 bp, Artificial Sequence
  Description of Artificial Sequence: Synthetic oligonucleotide
tctacggcccgcgagccgcg

SEQ ID NO: 274176 - DNA, 20 bp, Artificial Sequence
  Description of Artificial Sequence: Synthetic oligonucleotide
ctacggcccgcgagccgcgt

SEQ ID NO: 274177 - DNA, 20 bp, Artificial Sequence
  Description of Artificial Sequence: Synthetic oligonucleotide
tacggcccgcgagccgcgct

SEQ ID NO: 274178 - DNA, 20 bp, Artificial Sequence
  Description of Artificial Sequence: Synthetic oligonucleotide
acggcccgcgagccgcgctt

SEQ ID NO: 274179 - DNA, 20 bp, Artificial Sequence
  Description of Artificial Sequence: Synthetic oligonucleotide
cggcccgcgagccgcgcttt

SEQ ID NO: 274180 - DNA, 20 bp, Artificial Sequence
  Description of Artificial Sequence: Synthetic oligonucleotide
ggcccgcgagccgcgcgttt

SEQ ID NO: 274181 - DNA, 20 bp, Artificial Sequence
  Description of Artificial Sequence: Synthetic oligonucleotide
gcccgcgagccgcgcgtgtt

SEQ ID NO: 274182 - DNA, 20 bp, Artificial Sequence
  Description of Artificial Sequence: Synthetic oligonucleotide
cccgcgagccgcgcgtggtt

SEQ ID NO: 274183 - DNA, 20 bp, Artificial Sequence
  Description of Artificial Sequence: Synthetic oligonucleotide
ccgcgagccgcgcgtggctt

SEQ ID NO: 274184 - DNA, 20 bp, Artificial Sequence
  Description of Artificial Sequence: Synthetic oligonucleotide
cgcgagccgcgcgtggcctt

SEQ ID NO: 274185 - DNA, 20 bp, Artificial Sequence
  Description of Artificial Sequence: Synthetic oligonucleotide
gcgagccgcgcgtggcctct

SEQ ID NO: 274186 - DNA, 20 bp, Artificial Sequence
  Description of Artificial Sequence: Synthetic oligonucleotide
cgagccgcgcgtggcctcgt

SEQ ID NO: 274187 - DNA, 20 bp, Artificial Sequence
  Description of Artificial Sequence: Synthetic oligonucleotide
gagccgcgcgtggcctcggt

SEQ ID NO: 274188 - DNA, 21 bp, Artificial Sequence
  Description of Artificial Sequence: Synthetic oligonucleotide
agccgcgcgtggcctcggtca

SEQ ID NO: 274189 - DNA, 20 bp, Artificial Sequence
  Description of Artificial Sequence: Synthetic oligonucleotide
gccgcgcgtggcctcggtca

SEQ ID NO: 274190 - DNA, 21 bp, Artificial Sequence
  Description of Artificial Sequence: Synthetic oligonucleotide
ccgcgcgtggcctcggtcact

SEQ ID NO: 274191 - DNA, 21 bp, Artificial Sequence
  Description of Artificial Sequence: Synthetic oligonucleotide
cgcgcgtggcctcggtcactc

SEQ ID NO: 274192 - DNA, 21 bp, Artificial Sequence
  Description of Artificial Sequence: Synthetic oligonucleotide
gcgcgtggcctcggtcactcc

SEQ ID NO: 274193 - DNA, 23 bp, Artificial Sequence
  Description of Artificial Sequence: Synthetic oligonucleotide
cgcgtggcctcggtcactcccat

SEQ ID NO: 274194 - DNA, 23 bp, Artificial Sequence
  Description of Artificial Sequence: Synthetic oligonucleotide
gcgtggcctcggtcactcccatc

SEQ ID NO: 274195 - DNA, 24 bp, Artificial Sequence
  Description of Artificial Sequence: Synthetic oligonucleotide
cgtggcctcggtcactcccatcct

SEQ ID NO: 274196 - DNA, 24 bp, Artificial Sequence
  Description of Artificial Sequence: Synthetic oligonucleotide
gtggcctcggtcactcccatcctg

SEQ ID NO: 274197 - DNA, 24 bp, Artificial Sequence
  Description of Artificial Sequence: Synthetic oligonucleotide
tggcctcggtcactcccatcctgc

SEQ ID NO: 274198 - DNA, 23 bp, Artificial Sequence
  Description of Artificial Sequence: Synthetic oligonucleotide
ggcctcggtcactcccatcctgc

SEQ ID NO: 274199 - DNA, 23 bp, Artificial Sequence
  Description of Artificial Sequence: Synthetic oligonucleotide
gcctcggtcactcccatcctgcg

SEQ ID NO: 274200 - DNA, 23 bp, Artificial Sequence
  Description of Artificial Sequence: Synthetic oligonucleotide
cctcggtcactcccatcctgcgg

SEQ ID NO: 274201 - DNA, 24 bp, Artificial Sequence
  Description of Artificial Sequence: Synthetic oligonucleotide
ctcggtcactcccatcctgcggca

SEQ ID NO: 274202 - DNA, 25 bp, Artificial Sequence
  Description of Artificial Sequence: Synthetic oligonucleotide
tcggtcactcccatcctgcggcaga

SEQ ID NO: 274203 - DNA, 24 bp, Artificial Sequence
  Description of Artificial Sequence: Synthetic oligonucleotide
cggtcactcccatcctgcggcaga

SEQ ID NO: 274204 - DNA, 24 bp, Artificial Sequence
  Description of Artificial Sequence: Synthetic oligonucleotide
ggtcactcccatcctgcggcagac

SEQ ID NO: 274205 - DNA, 24 bp, Artificial Sequence
  Description of Artificial Sequence: Synthetic oligonucleotide
gtcactcccatcctgcggcagacg

SEQ ID NO: 274206 - DNA, 25 bp, Artificial Sequence
  Description of Artificial Sequence: Synthetic oligonucleotide
tcactcccatcctgcggcagacgct

SEQ ID NO: 274207 - DNA, 24 bp, Artificial Sequence
  Description of Artificial Sequence: Synthetic oligonucleotide
cactcccatcctgcggcagacgct

SEQ ID NO: 274208 - DNA, 26 bp, Artificial Sequence
  Description of Artificial Sequence: Synthetic oligonucleotide
actcccatcctgcggcagacgctcat

SEQ ID NO: 274209 - DNA, 25 bp, Artificial Sequence
  Description of Artificial Sequence: Synthetic oligonucleotide
ctcccatcctgcggcagacgctcat

SEQ ID NO: 274210 - DNA, 26 bp, Artificial Sequence
  Description of Artificial Sequence: Synthetic oligonucleotide
tcccatcctgcggcagacgctcatca

SEQ ID NO: 274211 - DNA, 25 bp, Artificial Sequence
  Description of Artificial Sequence: Synthetic oligonucleotide
cccatcctgcggcagacgctcatca

SEQ ID NO: 274212 - DNA, 25 bp, Artificial Sequence
  Description of Artificial Sequence: Synthetic oligonucleotide
ccatcctgcggcagacgctcatcag

SEQ ID NO: 274213 - DNA, 27 bp, Artificial Sequence
  Description of Artificial Sequence: Synthetic oligonucleotide
catcctgcggcagacgctcatcaggta

SEQ ID NO: 274214 - DNA, 27 bp, Artificial Sequence
  Description of Artificial Sequence: Synthetic oligonucleotide
atcctgcggcagacgctcatcaggtac

SEQ ID NO: 274215 - DNA, 26 bp, Artificial Sequence
  Description of Artificial Sequence: Synthetic oligonucleotide
tcctgcggcagacgctcatcaggtac

SEQ ID NO: 274216 - DNA, 25 bp, Artificial Sequence
  Description of Artificial Sequence: Synthetic oligonucleotide
cctgcggcagacgctcatcaggtac

SEQ ID NO: 274217 - DNA, 26 bp, Artificial Sequence
  Description of Artificial Sequence: Synthetic oligonucleotide
ctgcggcagacgctcatcaggtacct

SEQ ID NO: 274218 - DNA, 26 bp, Artificial Sequence
  Description of Artificial Sequence: Synthetic oligonucleotide
tgcggcagacgctcatcaggtacctg

SEQ ID NO: 274219 - DNA, 25 bp, Artificial Sequence
  Description of Artificial Sequence: Synthetic oligonucleotide
gcggcagacgctcatcaggtacctg

SEQ ID NO: 274220 - DNA, 25 bp, Artificial Sequence
  Description of Artificial Sequence: Synthetic oligonucleotide
cggcagacgctcatcaggtacctgg

SEQ ID NO: 274221 - DNA, 25 bp, Artificial Sequence
  Description of Artificial Sequence: Synthetic oligonucleotide
ggcagacgctcatcaggtacctggg

SEQ ID NO: 274222 - DNA, 25 bp, Artificial Sequence
  Description of Artificial Sequence: Synthetic oligonucleotide
gcagacgctcatcaggtacctgggc

SEQ ID NO: 274223 - DNA, 26 bp, Artificial Sequence
  Description of Artificial Sequence: Synthetic oligonucleotide
cagacgctcatcaggtacctgggcca

SEQ ID NO: 274224 - DNA, 26 bp, Artificial Sequence
  Description of Artificial Sequence: Synthetic oligonucleotide
agacgctcatcaggtacctgggccac

SEQ ID NO: 274225 - DNA, 25 bp, Artificial Sequence
  Description of Artificial Sequence: Synthetic oligonucleotide
gacgctcatcaggtacctgggccac

SEQ ID NO: 274226 - DNA, 26 bp, Artificial Sequence
  Description of Artificial Sequence: Synthetic oligonucleotide
acgctcatcaggtacctgggccacgt

SEQ ID NO: 274227 - DNA, 25 bp, Artificial Sequence
  Description of Artificial Sequence: Synthetic oligonucleotide
cgctcatcaggtacctgggccacgt

SEQ ID NO: 274228 - DNA, 25 bp, Artificial Sequence
  Description of Artificial Sequence: Synthetic oligonucleotide
gctcatcaggtacctgggccacgtc

SEQ ID NO: 274229 - DNA, 25 bp, Artificial Sequence
  Description of Artificial Sequence: Synthetic oligonucleotide
ctcatcaggtacctgggccacgtcg

SEQ ID NO: 274230 - DNA, 26 bp, Artificial Sequence
  Description of Artificial Sequence: Synthetic oligonucleotide
tcatcaggtacctgggccacgtcggt

SEQ ID NO: 274231 - DNA, 25 bp, Artificial Sequence
  Description of Artificial Sequence: Synthetic oligonucleotide
catcaggtacctgggccacgtcggt

SEQ ID NO: 274232 - DNA, 25 bp, Artificial Sequence
  Description of Artificial Sequence: Synthetic oligonucleotide
atcaggtacctgggccacgtcggtg

SEQ ID NO: 274233 - DNA, 24 bp, Artificial Sequence
  Description of Artificial Sequence: Synthetic oligonucleotide
tcaggtacctgggccacgtcggtg

SEQ ID NO: 274234 - DNA, 23 bp, Artificial Sequence
  Description of Artificial Sequence: Synthetic oligonucleotide
caggtacctgggccacgtcggtg

SEQ ID NO: 274235 - DNA, 25 bp, Artificial Sequence
  Description of Artificial Sequence: Synthetic oligonucleotide
aggtacctgggccacgtcggtgcat

SEQ ID NO: 274236 - DNA, 24 bp, Artificial Sequence
  Description of Artificial Sequence: Synthetic oligonucleotide
ggtacctgggccacgtcggtgcat

SEQ ID NO: 274237 - DNA, 24 bp, Artificial Sequence
  Description of Artificial Sequence: Synthetic oligonucleotide
gtacctgggccacgtcggtgcatc

SEQ ID NO: 274238 - DNA, 24 bp, Artificial Sequence
  Description of Artificial Sequence: Synthetic oligonucleotide
tacctgggccacgtcggtgcatcg

SEQ ID NO: 274239 - DNA, 23 bp, Artificial Sequence
  Description of Artificial Sequence: Synthetic oligonucleotide
acctgggccacgtcggtgcatcg

SEQ ID NO: 274240 - DNA, 22 bp, Artificial Sequence
  Description of Artificial Sequence: Synthetic oligonucleotide
cctgggccacgtcggtgcatcg

SEQ ID NO: 274241 - DNA, 23 bp, Artificial Sequence
  Description of Artificial Sequence: Synthetic oligonucleotide
ctgggccacgtcggtgcatcggt

SEQ ID NO: 274242 - DNA, 25 bp, Artificial Sequence
  Description of Artificial Sequence: Synthetic oligonucleotide
tgggccacgtcggtgcatcggtgat

SEQ ID NO: 274243 - DNA, 24 bp, Artificial Sequence
  Description of Artificial Sequence: Synthetic oligonucleotide
gggccacgtcggtgcatcggtgat

SEQ ID NO: 274244 - DNA, 24 bp, Artificial Sequence
  Description of Artificial Sequence: Synthetic oligonucleotide
ggccacgtcggtgcatcggtgatc

SEQ ID NO: 274245 - DNA, 25 bp, Artificial Sequence
  Description of Artificial Sequence: Synthetic oligonucleotide
gccacgtcggtgcatcggtgatcgt

SEQ ID NO: 274246 - DNA, 25 bp, Artificial Sequence
  Description of Artificial Sequence: Synthetic oligonucleotide
ccacgtcggtgcatcggtgatcgtg

SEQ ID NO: 274247 - DNA, 25 bp, Artificial Sequence
  Description of Artificial Sequence: Synthetic oligonucleotide
cacgtcggtgcatcggtgatcgtgg

SEQ ID NO: 274248 - DNA, 25 bp, Artificial Sequence
  Description of Artificial Sequence: Synthetic oligonucleotide
acgtcggtgcatcggtgatcgtggc

SEQ ID NO: 274249 - DNA, 24 bp, Artificial Sequence
  Description of Artificial Sequence: Synthetic oligonucleotide
cgtcggtgcatcggtgatcgtggc

SEQ ID NO: 274250 - DNA, 24 bp, Artificial Sequence
  Description of Artificial Sequence: Synthetic oligonucleotide
gtcggtgcatcggtgatcgtggcc

SEQ ID NO: 274251 - DNA, 24 bp, Artificial Sequence
  Description of Artificial Sequence: Synthetic oligonucleotide
tcggtgcatcggtgatcgtggccg

SEQ ID NO: 274252 - DNA, 23 bp, Artificial Sequence
  Description of Artificial Sequence: Synthetic oligonucleotide
cggtgcatcggtgatcgtggccg

SEQ ID NO: 274253 - DNA, 23 bp, Artificial Sequence
  Description of Artificial Sequence: Synthetic oligonucleotide
ggtgcatcggtgatcgtggccgg

SEQ ID NO: 274254 - DNA, 23 bp, Artificial Sequence
  Description of Artificial Sequence: Synthetic oligonucleotide
gtgcatcggtgatcgtggccggc

SEQ ID NO: 274255 - DNA, 25 bp, Artificial Sequence
  Description of Artificial Sequence: Synthetic oligonucleotide
tgcatcggtgatcgtggccggcgta

SEQ ID NO: 274256 - DNA, 24 bp, Artificial Sequence
  Description of Artificial Sequence: Synthetic oligonucleotide
gcatcggtgatcgtggccggcgta

SEQ ID NO: 274257 - DNA, 25 bp, Artificial Sequence
  Description of Artificial Sequence: Synthetic oligonucleotide
catcggtgatcgtggccggcgtaga

SEQ ID NO: 274258 - DNA, 25 bp, Artificial Sequence
  Description of Artificial Sequence: Synthetic oligonucleotide
atcggtgatcgtggccggcgtagag

SEQ ID NO: 274259 - DNA, 24 bp, Artificial Sequence
  Description of Artificial Sequence: Synthetic oligonucleotide
tcggtgatcgtggccggcgtagag

SEQ ID NO: 274260 - DNA, 23 bp, Artificial Sequence
  Description of Artificial Sequence: Synthetic oligonucleotide
cggtgatcgtggccggcgtagag

SEQ ID NO: 274261 - DNA, 24 bp, Artificial Sequence
  Description of Artificial Sequence: Synthetic oligonucleotide
ggtgatcgtggccggcgtagagct

SEQ ID NO: 274262 - DNA, 25 bp, Artificial Sequence
  Description of Artificial Sequence: Synthetic oligonucleotide
gtgatcgtggccggcgtagagctga

SEQ ID NO: 274263 - DNA, 26 bp, Artificial Sequence
  Description of Artificial Sequence: Synthetic oligonucleotide
tgatcgtggccggcgtagagctgact

SEQ ID NO: 274264 - DNA, 25 bp, Artificial Sequence
  Description of Artificial Sequence: Synthetic oligonucleotide
gatcgtggccggcgtagagctgact

SEQ ID NO: 274265 - DNA, 25 bp, Artificial Sequence
  Description of Artificial Sequence: Synthetic oligonucleotide
atcgtggccggcgtagagctgactg

SEQ ID NO: 274266 - DNA, 24 bp, Artificial Sequence
  Description of Artificial Sequence: Synthetic oligonucleotide
tcgtggccggcgtagagctgactg

SEQ ID NO: 274267 - DNA, 23 bp, Artificial Sequence
  Description of Artificial Sequence: Synthetic oligonucleotide
cgtggccggcgtagagctgactg

SEQ ID NO: 274268 - DNA, 24 bp, Artificial Sequence
  Description of Artificial Sequence: Synthetic oligonucleotide
gtggccggcgtagagctgactgga

SEQ ID NO: 274269 - DNA, 24 bp, Artificial Sequence
  Description of Artificial Sequence: Synthetic oligonucleotide
tggccggcgtagagctgactggag

SEQ ID NO: 274270 - DNA, 23 bp, Artificial Sequence
  Description of Artificial Sequence: Synthetic oligonucleotide
ggccggcgtagagctgactggag

SEQ ID NO: 274271 - DNA, 23 bp, Artificial Sequence
  Description of Artificial Sequence: Synthetic oligonucleotide
gccggcgtagagctgactggagc

SEQ ID NO: 274272 - DNA, 23 bp, Artificial Sequence
  Description of Artificial Sequence: Synthetic oligonucleotide
ccggcgtagagctgactggagcg

SEQ ID NO: 274273 - DNA, 24 bp, Artificial Sequence
  Description of Artificial Sequence: Synthetic oligonucleotide
cggcgtagagctgactggagcgca

SEQ ID NO: 274274 - DNA, 24 bp, Artificial Sequence
  Description of Artificial Sequence: Synthetic oligonucleotide
ggcgtagagctgactggagcgcag

SEQ ID NO: 274275 - DNA, 25 bp, Artificial Sequence
  Description of Artificial Sequence: Synthetic oligonucleotide
gcgtagagctgactggagcgcagct

SEQ ID NO: 274276 - DNA, 27 bp, Artificial Sequence
  Description of Artificial Sequence: Synthetic oligonucleotide
cgtagagctgactggagcgcagctctt

SEQ ID NO: 274277 - DNA, 27 bp, Artificial Sequence
  Description of Artificial Sequence: Synthetic oligonucleotide
gtagagctgactggagcgcagctcttc

SEQ ID NO: 274278 - DNA, 27 bp, Artificial Sequence
  Description of Artificial Sequence: Synthetic oligonucleotide
tagagctgactggagcgcagctcttcg

SEQ ID NO: 274279 - DNA, 26 bp, Artificial Sequence
  Description of Artificial Sequence: Synthetic oligonucleotide
agagctgactggagcgcagctcttcg

SEQ ID NO: 274280 - DNA, 25 bp, Artificial Sequence
  Description of Artificial Sequence: Synthetic oligonucleotide
gagctgactggagcgcagctcttcg

SEQ ID NO: 274281 - DNA, 25 bp, Artificial Sequence
  Description of Artificial Sequence: Synthetic oligonucleotide
agctgactggagcgcagctcttcgg

SEQ ID NO: 274282 - DNA, 24 bp, Artificial Sequence
  Description of Artificial Sequence: Synthetic oligonucleotide
gctgactggagcgcagctcttcgg

SEQ ID NO: 274283 - DNA, 24 bp, Artificial Sequence
  Description of Artificial Sequence: Synthetic oligonucleotide
ctgactggagcgcagctcttcggc

SEQ ID NO: 274284 - DNA, 25 bp, Artificial Sequence
  Description of Artificial Sequence: Synthetic oligonucleotide
tgactggagcgcagctcttcggcgt

SEQ ID NO: 274285 - DNA, 24 bp, Artificial Sequence
  Description of Artificial Sequence: Synthetic oligonucleotide
gactggagcgcagctcttcggcgt

SEQ ID NO: 274286 - DNA, 24 bp, Artificial Sequence
  Description of Artificial Sequence: Synthetic oligonucleotide
actggagcgcagctcttcggcgtg

SEQ ID NO: 274287 - DNA, 23 bp, Artificial Sequence
  Description of Artificial Sequence: Synthetic oligonucleotide
ctggagcgcagctcttcggcgtg

SEQ ID NO: 274288 - DNA, 25 bp, Artificial Sequence
  Description of Artificial Sequence: Synthetic oligonucleotide
tggagcgcagctcttcggcgtgcaa

SEQ ID NO: 274289 - DNA, 24 bp, Artificial Sequence
  Description of Artificial Sequence: Synthetic oligonucleotide
ggagcgcagctcttcggcgtgcaa

SEQ ID NO: 274290 - DNA, 24 bp, Artificial Sequence
  Description of Artificial Sequence: Synthetic oligonucleotide
gagcgcagctcttcggcgtgcaac

SEQ ID NO: 274291 - DNA, 24 bp, Artificial Sequence
  Description of Artificial Sequence: Synthetic oligonucleotide
agcgcagctcttcggcgtgcaacc

SEQ ID NO: 274292 - DNA, 23 bp, Artificial Sequence
  Description of Artificial Sequence: Synthetic oligonucleotide
gcgcagctcttcggcgtgcaacc

SEQ ID NO: 274293 - DNA, 23 bp, Artificial Sequence
  Description of Artificial Sequence: Synthetic oligonucleotide
cgcagctcttcggcgtgcaaccc

SEQ ID NO: 274294 - DNA, 25 bp, Artificial Sequence
  Description of Artificial Sequence: Synthetic oligonucleotide
gcagctcttcggcgtgcaaccccat

SEQ ID NO: 274295 - DNA, 25 bp, Artificial Sequence
  Description of Artificial Sequence: Synthetic oligonucleotide
cagctcttcggcgtgcaaccccatg

SEQ ID NO: 274296 - DNA, 25 bp, Artificial Sequence
  Description of Artificial Sequence: Synthetic oligonucleotide
agctcttcggcgtgcaaccccatgg

SEQ ID NO: 274297 - DNA, 24 bp, Artificial Sequence
  Description of Artificial Sequence: Synthetic oligonucleotide
gctcttcggcgtgcaaccccatgg

SEQ ID NO: 274298 - DNA, 25 bp, Artificial Sequence
  Description of Artificial Sequence: Synthetic oligonucleotide
ctcttcggcgtgcaaccccatggca

SEQ ID NO: 274299 - DNA, 25 bp, Artificial Sequence
  Description of Artificial Sequence: Synthetic oligonucleotide
tcttcggcgtgcaaccccatggcac

SEQ ID NO: 274300 - DNA, 24 bp, Artificial Sequence
  Description of Artificial Sequence: Synthetic oligonucleotide
cttcggcgtgcaaccccatggcac

SEQ ID NO: 274301 - DNA, 26 bp, Artificial Sequence
  Description of Artificial Sequence: Synthetic oligonucleotide
ttcggcgtgcaaccccatggcaccta

SEQ ID NO: 274302 - DNA, 25 bp, Artificial Sequence
  Description of Artificial Sequence: Synthetic oligonucleotide
tcggcgtgcaaccccatggcaccta

SEQ ID NO: 274303 - DNA, 24 bp, Artificial Sequence
  Description of Artificial Sequence: Synthetic oligonucleotide
cggcgtgcaaccccatggcaccta

SEQ ID NO: 274304 - DNA, 25 bp, Artificial Sequence
  Description of Artificial Sequence: Synthetic oligonucleotide
ggcgtgcaaccccatggcacctaca

SEQ ID NO: 274305 - DNA, 25 bp, Artificial Sequence
  Description of Artificial Sequence: Synthetic oligonucleotide
gcgtgcaaccccatggcacctacag

SEQ ID NO: 274306 - DNA, 25 bp, Artificial Sequence
  Description of Artificial Sequence: Synthetic oligonucleotide
cgtgcaaccccatggcacctacagc

SEQ ID NO: 274307 - DNA, 25 bp, Artificial Sequence
  Description of Artificial Sequence: Synthetic oligonucleotide
gtgcaaccccatggcacctacagcc

SEQ ID NO: 274308 - DNA, 26 bp, Artificial Sequence
  Description of Artificial Sequence: Synthetic oligonucleotide
tgcaaccccatggcacctacagccct

SEQ ID NO: 274309 - DNA, 25 bp, Artificial Sequence
  Description of Artificial Sequence: Synthetic oligonucleotide
gcaaccccatggcacctacagccct

SEQ ID NO: 274310 - DNA, 26 bp, Artificial Sequence
  Description of Artificial Sequence: Synthetic oligonucleotide
caaccccatggcacctacagccctct

SEQ ID NO: 274311 - DNA, 26 bp, Artificial Sequence
  Description of Artificial Sequence: Synthetic oligonucleotide
aaccccatggcacctacagccctctg

SEQ ID NO: 274312 - DNA, 25 bp, Artificial Sequence
  Description of Artificial Sequence: Synthetic oligonucleotide
accccatggcacctacagccctctg

SEQ ID NO: 274313 - DNA, 24 bp, Artificial Sequence
  Description of Artificial Sequence: Synthetic oligonucleotide
ccccatggcacctacagccctctg

SEQ ID NO: 274314 - DNA, 24 bp, Artificial Sequence
  Description of Artificial Sequence: Synthetic oligonucleotide
cccatggcacctacagccctctgc

SEQ ID NO: 274315 - DNA, 24 bp, Artificial Sequence
  Description of Artificial Sequence: Synthetic oligonucleotide
ccatggcacctacagccctctgcc

SEQ ID NO: 274316 - DNA, 26 bp, Artificial Sequence
  Description of Artificial Sequence: Synthetic oligonucleotide
catggcacctacagccctctgccctt

SEQ ID NO: 274317 - DNA, 27 bp, Artificial Sequence
  Description of Artificial Sequence: Synthetic oligonucleotide
atggcacctacagccctctgcccttga

SEQ ID NO: 274318 - DNA, 26 bp, Artificial Sequence
  Description of Artificial Sequence: Synthetic oligonucleotide
tggcacctacagccctctgcccttga

SEQ ID NO: 274319 - DNA, 25 bp, Artificial Sequence
  Description of Artificial Sequence: Synthetic oligonucleotide
ggcacctacagccctctgcccttga

SEQ ID NO: 274320 - DNA, 26 bp, Artificial Sequence
  Description of Artificial Sequence: Synthetic oligonucleotide
gcacctacagccctctgcccttgaca

SEQ ID NO: 274321 - DNA, 26 bp, Artificial Sequence
  Description of Artificial Sequence: Synthetic oligonucleotide
cacctacagccctctgcccttgacag

SEQ ID NO: 274322 - DNA, 26 bp, Artificial Sequence
  Description of Artificial Sequence: Synthetic oligonucleotide
acctacagccctctgcccttgacagc

SEQ ID NO: 274323 - DNA, 25 bp, Artificial Sequence
  Description of Artificial Sequence: Synthetic oligonucleotide
cctacagccctctgcccttgacagc

SEQ ID NO: 274324 - DNA, 25 bp, Artificial Sequence
  Description of Artificial Sequence: Synthetic oligonucleotide
ctacagccctctgcccttgacagcc

SEQ ID NO: 274325 - DNA, 26 bp, Artificial Sequence
  Description of Artificial Sequence: Synthetic oligonucleotide
tacagccctctgcccttgacagccct

SEQ ID NO: 274326 - DNA, 25 bp, Artificial Sequence
  Description of Artificial Sequence: Synthetic oligonucleotide
acagccctctgcccttgacagccct

SEQ ID NO: 274327 - DNA, 24 bp, Artificial Sequence
  Description of Artificial Sequence: Synthetic oligonucleotide
cagccctctgcccttgacagccct

SEQ ID NO: 274328 - DNA, 24 bp, Artificial Sequence
  Description of Artificial Sequence: Synthetic oligonucleotide
agccctctgcccttgacagccctg

SEQ ID NO: 274329 - DNA, 23 bp, Artificial Sequence
  Description of Artificial Sequence: Synthetic oligonucleotide
gccctctgcccttgacagccctg

SEQ ID NO: 274330 - DNA, 23 bp, Artificial Sequence
  Description of Artificial Sequence: Synthetic oligonucleotide
ccctctgcccttgacagccctgc

SEQ ID NO: 274331 - DNA, 23 bp, Artificial Sequence
  Description of Artificial Sequence: Synthetic oligonucleotide
cctctgcccttgacagccctgcg

SEQ ID NO: 274332 - DNA, 24 bp, Artificial Sequence
  Description of Artificial Sequence: Synthetic oligonucleotide
ctctgcccttgacagccctgcgct

SEQ ID NO: 274333 - DNA, 25 bp, Artificial Sequence
  Description of Artificial Sequence: Synthetic oligonucleotide
tctgcccttgacagccctgcgctct

SEQ ID NO: 274334 - DNA, 24 bp, Artificial Sequence
  Description of Artificial Sequence: Synthetic oligonucleotide
ctgcccttgacagccctgcgctct

SEQ ID NO: 274335 - DNA, 24 bp, Artificial Sequence
  Description of Artificial Sequence: Synthetic oligonucleotide
tgcccttgacagccctgcgctctg

SEQ ID NO: 274336 - DNA, 23 bp, Artificial Sequence
  Description of Artificial Sequence: Synthetic oligonucleotide
gcccttgacagccctgcgctctg

SEQ ID NO: 274337 - DNA, 24 bp, Artificial Sequence
  Description of Artificial Sequence: Synthetic oligonucleotide
cccttgacagccctgcgctctggt

SEQ ID NO: 274338 - DNA, 25 bp, Artificial Sequence
  Description of Artificial Sequence: Synthetic oligonucleotide
ccttgacagccctgcgctctggtct

SEQ ID NO: 274339 - DNA, 25 bp, Artificial Sequence
  Description of Artificial Sequence: Synthetic oligonucleotide
cttgacagccctgcgctctggtctg

SEQ ID NO: 274340 - DNA, 26 bp, Artificial Sequence
  Description of Artificial Sequence: Synthetic oligonucleotide
ttgacagccctgcgctctggtctgga

SEQ ID NO: 274341 - DNA, 25 bp, Artificial Sequence
  Description of Artificial Sequence: Synthetic oligonucleotide
tgacagccctgcgctctggtctgga

SEQ ID NO: 274342 - DNA, 24 bp, Artificial Sequence
  Description of Artificial Sequence: Synthetic oligonucleotide
gacagccctgcgctctggtctgga

SEQ ID NO: 274343 - DNA, 24 bp, Artificial Sequence
  Description of Artificial Sequence: Synthetic oligonucleotide
acagccctgcgctctggtctggac

SEQ ID NO: 274344 - DNA, 23 bp, Artificial Sequence
  Description of Artificial Sequence: Synthetic oligonucleotide
cagccctgcgctctggtctggac

SEQ ID NO: 274345 - DNA, 23 bp, Artificial Sequence
  Description of Artificial Sequence: Synthetic oligonucleotide
agccctgcgctctggtctggacg

SEQ ID NO: 274346 - DNA, 22 bp, Artificial Sequence
  Description of Artificial Sequence: Synthetic oligonucleotide
gccctgcgctctggtctggacg

SEQ ID NO: 274347 - DNA, 22 bp, Artificial Sequence
  Description of Artificial Sequence: Synthetic oligonucleotide
ccctgcgctctggtctggacgc

SEQ ID NO: 274348 - DNA, 22 bp, Artificial Sequence
  Description of Artificial Sequence: Synthetic oligonucleotide
cctgcgctctggtctggacgcg

SEQ ID NO: 274349 - DNA, 22 bp, Artificial Sequence
  Description of Artificial Sequence: Synthetic oligonucleotide
ctgcgctctggtctggacgcgg

SEQ ID NO: 274350 - DNA, 22 bp, Artificial Sequence
  Description of Artificial Sequence: Synthetic oligonucleotide
tgcgctctggtctggacgcggc

SEQ ID NO: 274351 - DNA, 21 bp, Artificial Sequence
  Description of Artificial Sequence: Synthetic oligonucleotide
gcgctctggtctggacgcggc

SEQ ID NO: 274352 - DNA, 21 bp, Artificial Sequence
  Description of Artificial Sequence: Synthetic oligonucleotide
cgctctggtctggacgcggcg

SEQ ID NO: 274353 - DNA, 22 bp, Artificial Sequence
  Description of Artificial Sequence: Synthetic oligonucleotide
gctctggtctggacgcggcgct

SEQ ID NO: 274354 - DNA, 22 bp, Artificial Sequence
  Description of Artificial Sequence: Synthetic oligonucleotide
ctctggtctggacgcggcgctg

SEQ ID NO: 274355 - DNA, 22 bp, Artificial Sequence
  Description of Artificial Sequence: Synthetic oligonucleotide
tctggtctggacgcggcgctgg

SEQ ID NO: 274356 - DNA, 21 bp, Artificial Sequence
  Description of Artificial Sequence: Synthetic oligonucleotide
ctggtctggacgcggcgctgg

SEQ ID NO: 274357 - DNA, 21 bp, Artificial Sequence
  Description of Artificial Sequence: Synthetic oligonucleotide
tggtctggacgcggcgctggc

SEQ ID NO: 274358 - DNA, 20 bp, Artificial Sequence
  Description of Artificial Sequence: Synthetic oligonucleotide
ggtctggacgcggcgctggc

SEQ ID NO: 274359 - DNA, 20 bp, Artificial Sequence
  Description of Artificial Sequence: Synthetic oligonucleotide
gtctggacgcggcgctggcg

SEQ ID NO: 274360 - DNA, 21 bp, Artificial Sequence
  Description of Artificial Sequence: Synthetic oligonucleotide
tctggacgcggcgctggcggt

SEQ ID NO: 274361 - DNA, 20 bp, Artificial Sequence
  Description of Artificial Sequence: Synthetic oligonucleotide
ctggacgcggcgctggcggt

SEQ ID NO: 274362 - DNA, 20 bp, Artificial Sequence
  Description of Artificial Sequence: Synthetic oligonucleotide
tggacgcggcgctggcggtg

SEQ ID NO: 274363 - DNA, 20 bp, Artificial Sequence
  Description of Artificial Sequence: Synthetic oligonucleotide
ggacgcggcgctggcggtgt

SEQ ID NO: 274364 - DNA, 21 bp, Artificial Sequence
  Description of Artificial Sequence: Synthetic oligonucleotide
gacgcggcgctggcggtggta

SEQ ID NO: 274365 - DNA, 23 bp, Artificial Sequence
  Description of Artificial Sequence: Synthetic oligonucleotide
acgcggcgctggcggtggtagaa

SEQ ID NO: 274366 - DNA, 22 bp, Artificial Sequence
  Description of Artificial Sequence: Synthetic oligonucleotide
cgcggcgctggcggtggtagaa

SEQ ID NO: 274367 - DNA, 23 bp, Artificial Sequence
  Description of Artificial Sequence: Synthetic oligonucleotide
gcggcgctggcggtggtagaaga

SEQ ID NO: 274368 - DNA, 23 bp, Artificial Sequence
  Description of Artificial Sequence: Synthetic oligonucleotide
cggcgctggcggtggtagaagac

SEQ ID NO: 274369 - DNA, 23 bp, Artificial Sequence
  Description of Artificial Sequence: Synthetic oligonucleotide
ggcgctggcggtggtagaagacc

SEQ ID NO: 274370 - DNA, 23 bp, Artificial Sequence
  Description of Artificial Sequence: Synthetic oligonucleotide
gcgctggcggtggtagaagaccc

SEQ ID NO: 274371 - DNA, 25 bp, Artificial Sequence
  Description of Artificial Sequence: Synthetic oligonucleotide
cgctggcggtggtagaagacccgtt

SEQ ID NO: 274372 - DNA, 25 bp, Artificial Sequence
  Description of Artificial Sequence: Synthetic oligonucleotide
gctggcggtggtagaagacccgttc

SEQ ID NO: 274373 - DNA, 26 bp, Artificial Sequence
  Description of Artificial Sequence: Synthetic oligonucleotide
ctggcggtggtagaagacccgttcca

SEQ ID NO: 274374 - DNA, 26 bp, Artificial Sequence
  Description of Artificial Sequence: Synthetic oligonucleotide
tggcggtggtagaagacccgttccag

SEQ ID NO: 274375 - DNA, 25 bp, Artificial Sequence
  Description of Artificial Sequence: Synthetic oligonucleotide
ggcggtggtagaagacccgttccag

SEQ ID NO: 274376 - DNA, 25 bp, Artificial Sequence
  Description of Artificial Sequence: Synthetic oligonucleotide
gcggtggtagaagacccgttccagc

SEQ ID NO: 274377 - DNA, 25 bp, Artificial Sequence
  Description of Artificial Sequence: Synthetic oligonucleotide
cggtggtagaagacccgttccagcc

SEQ ID NO: 274378 - DNA, 27 bp, Artificial Sequence
  Description of Artificial Sequence: Synthetic oligonucleotide
ggtggtagaagacccgttccagcccaa

SEQ ID NO: 274379 - DNA, 27 bp, Artificial Sequence
  Description of Artificial Sequence: Synthetic oligonucleotide
gtggtagaagacccgttccagcccaac

SEQ ID NO: 274380 - DNA, 29 bp, Artificial Sequence
  Description of Artificial Sequence: Synthetic oligonucleotide
tggtagaagacccgttccagcccaacatg

SEQ ID NO: 274381 - DNA, 28 bp, Artificial Sequence
  Description of Artificial Sequence: Synthetic oligonucleotide
ggtagaagacccgttccagcccaacatg

SEQ ID NO: 274382 - DNA, 29 bp, Artificial Sequence
  Description of Artificial Sequence: Synthetic oligonucleotide
gtagaagacccgttccagcccaacatgac

SEQ ID NO: 274383 - DNA, 29 bp, Artificial Sequence
  Description of Artificial Sequence: Synthetic oligonucleotide
tagaagacccgttccagcccaacatgacg

SEQ ID NO: 274384 - DNA, 28 bp, Artificial Sequence
  Description of Artificial Sequence: Synthetic oligonucleotide
agaagacccgttccagcccaacatgacg

SEQ ID NO: 274385 - DNA, 27 bp, Artificial Sequence
  Description of Artificial Sequence: Synthetic oligonucleotide
gaagacccgttccagcccaacatgacg

SEQ ID NO: 274386 - DNA, 27 bp, Artificial Sequence
  Description of Artificial Sequence: Synthetic oligonucleotide
aagacccgttccagcccaacatgacgg

SEQ ID NO: 274387 - DNA, 27 bp, Artificial Sequence
  Description of Artificial Sequence: Synthetic oligonucleotide
agacccgttccagcccaacatgacggt

SEQ ID NO: 274388 - DNA, 26 bp, Artificial Sequence
  Description of Artificial Sequence: Synthetic oligonucleotide
gacccgttccagcccaacatgacggt

SEQ ID NO: 274389 - DNA, 26 bp, Artificial Sequence
  Description of Artificial Sequence: Synthetic oligonucleotide
acccgttccagcccaacatgacggtg

SEQ ID NO: 274390 - DNA, 25 bp, Artificial Sequence
  Description of Artificial Sequence: Synthetic oligonucleotide
cccgttccagcccaacatgacggtg

SEQ ID NO: 274391 - DNA, 26 bp, Artificial Sequence
  Description of Artificial Sequence: Synthetic oligonucleotide
ccgttccagcccaacatgacggtgga

SEQ ID NO: 274392 - DNA, 26 bp, Artificial Sequence
  Description of Artificial Sequence: Synthetic oligonucleotide
cgttccagcccaacatgacggtggag

SEQ ID NO: 274393 - DNA, 26 bp, Artificial Sequence
  Description of Artificial Sequence: Synthetic oligonucleotide
gttccagcccaacatgacggtggagg

SEQ ID NO: 274394 - DNA, 27 bp, Artificial Sequence
  Description of Artificial Sequence: Synthetic oligonucleotide
ttccagcccaacatgacggtggaggct

SEQ ID NO: 274395 - DNA, 26 bp, Artificial Sequence
  Description of Artificial Sequence: Synthetic oligonucleotide
tccagcccaacatgacggtggaggct

SEQ ID NO: 274396 - DNA, 25 bp, Artificial Sequence
  Description of Artificial Sequence: Synthetic oligonucleotide
ccagcccaacatgacggtggaggct

SEQ ID NO: 274397 - DNA, 25 bp, Artificial Sequence
  Description of Artificial Sequence: Synthetic oligonucleotide
cagcccaacatgacggtggaggctg

SEQ ID NO: 274398 - DNA, 26 bp, Artificial Sequence
  Description of Artificial Sequence: Synthetic oligonucleotide
agcccaacatgacggtggaggctggt

SEQ ID NO: 274399 - DNA, 25 bp, Artificial Sequence
  Description of Artificial Sequence: Synthetic oligonucleotide
gcccaacatgacggtggaggctggt

SEQ ID NO: 274400 - DNA, 26 bp, Artificial Sequence
  Description of Artificial Sequence: Synthetic oligonucleotide
cccaacatgacggtggaggctggtca

SEQ ID NO: 274401 - DNA, 26 bp, Artificial Sequence
  Description of Artificial Sequence: Synthetic oligonucleotide
ccaacatgacggtggaggctggtcag

SEQ ID NO: 274402 - DNA, 26 bp, Artificial Sequence
  Description of Artificial Sequence: Synthetic oligonucleotide
caacatgacggtggaggctggtcagg

SEQ ID NO: 274403 - DNA, 26 bp, Artificial Sequence
  Description of Artificial Sequence: Synthetic oligonucleotide
aacatgacggtggaggctggtcaggg

SEQ ID NO: 274404 - DNA, 25 bp, Artificial Sequence
  Description of Artificial Sequence: Synthetic oligonucleotide
acatgacggtggaggctggtcaggg

SEQ ID NO: 274405 - DNA, 24 bp, Artificial Sequence
  Description of Artificial Sequence: Synthetic oligonucleotide
catgacggtggaggctggtcaggg

SEQ ID NO: 274406 - DNA, 24 bp, Artificial Sequence
  Description of Artificial Sequence: Synthetic oligonucleotide
atgacggtggaggctggtcagggg

SEQ ID NO: 274407 - DNA, 23 bp, Artificial Sequence
  Description of Artificial Sequence: Synthetic oligonucleotide
tgacggtggaggctggtcagggg

SEQ ID NO: 274408 - DNA, 22 bp, Artificial Sequence
  Description of Artificial Sequence: Synthetic oligonucleotide
gacggtggaggctggtcagggg

SEQ ID NO: 274409 - DNA, 23 bp, Artificial Sequence
  Description of Artificial Sequence: Synthetic oligonucleotide
acggtggaggctggtcaggggct

SEQ ID NO: 274410 - DNA, 22 bp, Artificial Sequence
  Description of Artificial Sequence: Synthetic oligonucleotide
cggtggaggctggtcaggggct

SEQ ID NO: 274411 - DNA, 22 bp, Artificial Sequence
  Description of Artificial Sequence: Synthetic oligonucleotide
ggtggaggctggtcaggggctc

SEQ ID NO: 274412 - DNA, 23 bp, Artificial Sequence
  Description of Artificial Sequence: Synthetic oligonucleotide
gtggaggctggtcaggggctcct

SEQ ID NO: 274413 - DNA, 23 bp, Artificial Sequence
  Description of Artificial Sequence: Synthetic oligonucleotide
tggaggctggtcaggggctcctg

SEQ ID NO: 274414 - DNA, 22 bp, Artificial Sequence
  Description of Artificial Sequence: Synthetic oligonucleotide
ggaggctggtcaggggctcctg

SEQ ID NO: 274415 - DNA, 23 bp, Artificial Sequence
  Description of Artificial Sequence: Synthetic oligonucleotide
gaggctggtcaggggctcctggt

SEQ ID NO: 274416 - DNA, 23 bp, Artificial Sequence
  Description of Artificial Sequence: Synthetic oligonucleotide
aggctggtcaggggctcctggtg

SEQ ID NO: 274417 - DNA, 22 bp, Artificial Sequence
  Description of Artificial Sequence: Synthetic oligonucleotide
ggctggtcaggggctcctggtg

SEQ ID NO: 274418 - DNA, 24 bp, Artificial Sequence
  Description of Artificial Sequence: Synthetic oligonucleotide
gctggtcaggggctcctggtggaa

SEQ ID NO: 274419 - DNA, 24 bp, Artificial Sequence
  Description of Artificial Sequence: Synthetic oligonucleotide
ctggtcaggggctcctggtggaac

SEQ ID NO: 274420 - DNA, 24 bp, Artificial Sequence
  Description of Artificial Sequence: Synthetic oligonucleotide
tggtcaggggctcctggtggaacc

SEQ ID NO: 274421 - DNA, 23 bp, Artificial Sequence
  Description of Artificial Sequence: Synthetic oligonucleotide
ggtcaggggctcctggtggaacc

SEQ ID NO: 274422 - DNA, 23 bp, Artificial Sequence
  Description of Artificial Sequence: Synthetic oligonucleotide
gtcaggggctcctggtggaaccc

SEQ ID NO: 274423 - DNA, 24 bp, Artificial Sequence
  Description of Artificial Sequence: Synthetic oligonucleotide
tcaggggctcctggtggaacccgt

SEQ ID NO: 274424 - DNA, 23 bp, Artificial Sequence
  Description of Artificial Sequence: Synthetic oligonucleotide
caggggctcctggtggaacccgt

SEQ ID NO: 274425 - DNA, 24 bp, Artificial Sequence
  Description of Artificial Sequence: Synthetic oligonucleotide
aggggctcctggtggaacccgtca

SEQ ID NO: 274426 - DNA, 23 bp, Artificial Sequence
  Description of Artificial Sequence: Synthetic oligonucleotide
ggggctcctggtggaacccgtca

SEQ ID NO: 274427 - DNA, 23 bp, Artificial Sequence
  Description of Artificial Sequence: Synthetic oligonucleotide
gggctcctggtggaacccgtcac

SEQ ID NO: 274428 - DNA, 23 bp, Artificial Sequence
  Description of Artificial Sequence: Synthetic oligonucleotide
ggctcctggtggaacccgtcacc

SEQ ID NO: 274429 - DNA, 23 bp, Artificial Sequence
  Description of Artificial Sequence: Synthetic oligonucleotide
gctcctggtggaacccgtcaccg

SEQ ID NO: 274430 - DNA, 23 bp, Artificial Sequence
  Description of Artificial Sequence: Synthetic oligonucleotide
ctcctggtggaacccgtcaccgg

SEQ ID NO: 274431 - DNA, 23 bp, Artificial Sequence
  Description of Artificial Sequence: Synthetic oligonucleotide
tcctggtggaacccgtcaccggc

SEQ ID NO: 274432 - DNA, 22 bp, Artificial Sequence
  Description of Artificial Sequence: Synthetic oligonucleotide
cctggtggaacccgtcaccggc

SEQ ID NO: 274433 - DNA, 22 bp, Artificial Sequence
  Description of Artificial Sequence: Synthetic oligonucleotide
ctggtggaacccgtcaccggcg

SEQ ID NO: 274434 - DNA, 22 bp, Artificial Sequence
  Description of Artificial Sequence: Synthetic oligonucleotide
tggtggaacccgtcaccggcgg

SEQ ID NO: 274435 - DNA, 21 bp, Artificial Sequence
  Description of Artificial Sequence: Synthetic oligonucleotide
ggtggaacccgtcaccggcgg

SEQ ID NO: 274436 - DNA, 23 bp, Artificial Sequence
  Description of Artificial Sequence: Synthetic oligonucleotide
gtggaacccgtcaccggcgggat

SEQ ID NO: 274437 - DNA, 25 bp, Artificial Sequence
  Description of Artificial Sequence: Synthetic oligonucleotide
tggaacccgtcaccggcgggatctt

SEQ ID NO: 274438 - DNA, 24 bp, Artificial Sequence
  Description of Artificial Sequence: Synthetic oligonucleotide
ggaacccgtcaccggcgggatctt

SEQ ID NO: 274439 - DNA, 24 bp, Artificial Sequence
  Description of Artificial Sequence: Synthetic oligonucleotide
gaacccgtcaccggcgggatcttc

SEQ ID NO: 274440 - DNA, 24 bp, Artificial Sequence
  Description of Artificial Sequence: Synthetic oligonucleotide
aacccgtcaccggcgggatcttcg

SEQ ID NO: 274441 - DNA, 23 bp, Artificial Sequence
  Description of Artificial Sequence: Synthetic oligonucleotide
acccgtcaccggcgggatcttcg

SEQ ID NO: 274442 - DNA, 22 bp, Artificial Sequence
  Description of Artificial Sequence: Synthetic oligonucleotide
cccgtcaccggcgggatcttcg

SEQ ID NO: 274443 - DNA, 23 bp, Artificial Sequence
  Description of Artificial Sequence: Synthetic oligonucleotide
ccgtcaccggcgggatcttcggt

SEQ ID NO: 274444 - DNA, 24 bp, Artificial Sequence
  Description of Artificial Sequence: Synthetic oligonucleotide
cgtcaccggcgggatcttcggtga

SEQ ID NO: 274445 - DNA, 24 bp, Artificial Sequence
  Description of Artificial Sequence: Synthetic oligonucleotide
gtcaccggcgggatcttcggtgac

SEQ ID NO: 274446 - DNA, 25 bp, Artificial Sequence
  Description of Artificial Sequence: Synthetic oligonucleotide
tcaccggcgggatcttcggtgacct

SEQ ID NO: 274447 - DNA, 24 bp, Artificial Sequence
  Description of Artificial Sequence: Synthetic oligonucleotide
caccggcgggatcttcggtgacct

SEQ ID NO: 274448 - DNA, 24 bp, Artificial Sequence
  Description of Artificial Sequence: Synthetic oligonucleotide
accggcgggatcttcggtgacctg

SEQ ID NO: 274449 - DNA, 23 bp, Artificial Sequence
  Description of Artificial Sequence: Synthetic oligonucleotide
ccggcgggatcttcggtgacctg

SEQ ID NO: 274450 - DNA, 23 bp, Artificial Sequence
  Description of Artificial Sequence: Synthetic oligonucleotide
cggcgggatcttcggtgacctgc

SEQ ID NO: 274451 - DNA, 23 bp, Artificial Sequence
  Description of Artificial Sequence: Synthetic oligonucleotide
ggcgggatcttcggtgacctgcg

SEQ ID NO: 274452 - DNA, 24 bp, Artificial Sequence
  Description of Artificial Sequence: Synthetic oligonucleotide
gcgggatcttcggtgacctgcgct

SEQ ID NO: 274453 - DNA, 24 bp, Artificial Sequence
  Description of Artificial Sequence: Synthetic oligonucleotide
cgggatcttcggtgacctgcgctc

SEQ ID NO: 274454 - DNA, 24 bp, Artificial Sequence
  Description of Artificial Sequence: Synthetic oligonucleotide
gggatcttcggtgacctgcgctcc

SEQ ID NO: 274455 - DNA, 24 bp, Artificial Sequence
  Description of Artificial Sequence: Synthetic oligonucleotide
ggatcttcggtgacctgcgctccg

SEQ ID NO: 274456 - DNA, 24 bp, Artificial Sequence
  Description of Artificial Sequence: Synthetic oligonucleotide
gatcttcggtgacctgcgctccgg

SEQ ID NO: 274457 - DNA, 24 bp, Artificial Sequence
  Description of Artificial Sequence: Synthetic oligonucleotide
atcttcggtgacctgcgctccggg

SEQ ID NO: 274458 - DNA, 23 bp, Artificial Sequence
  Description of Artificial Sequence: Synthetic oligonucleotide
tcttcggtgacctgcgctccggg

SEQ ID NO: 274459 - DNA, 22 bp, Artificial Sequence
  Description of Artificial Sequence: Synthetic oligonucleotide
cttcggtgacctgcgctccggg

SEQ ID NO: 274460 - DNA, 22 bp, Artificial Sequence
  Description of Artificial Sequence: Synthetic oligonucleotide
ttcggtgacctgcgctccgggg

SEQ ID NO: 274461 - DNA, 21 bp, Artificial Sequence
  Description of Artificial Sequence: Synthetic oligonucleotide
tcggtgacctgcgctccgggg

SEQ ID NO: 274462 - DNA, 20 bp, Artificial Sequence
  Description of Artificial Sequence: Synthetic oligonucleotide
cggtgacctgcgctccgggg

SEQ ID NO: 274463 - DNA, 20 bp, Artificial Sequence
  Description of Artificial Sequence: Synthetic oligonucleotide
ggtgacctgcgctccggggc

SEQ ID NO: 274464 - DNA, 23 bp, Artificial Sequence
  Description of Artificial Sequence: Synthetic oligonucleotide
gtgacctgcgctccggggccaat

SEQ ID NO: 274465 - DNA, 24 bp, Artificial Sequence
  Description of Artificial Sequence: Synthetic oligonucleotide
tgacctgcgctccggggccaatgt

SEQ ID NO: 274466 - DNA, 23 bp, Artificial Sequence
  Description of Artificial Sequence: Synthetic oligonucleotide
gacctgcgctccggggccaatgt

SEQ ID NO: 274467 - DNA, 23 bp, Artificial Sequence
  Description of Artificial Sequence: Synthetic oligonucleotide
acctgcgctccggggccaatgtg

SEQ ID NO: 274468 - DNA, 22 bp, Artificial Sequence
  Description of Artificial Sequence: Synthetic oligonucleotide
cctgcgctccggggccaatgtg

SEQ ID NO: 274469 - DNA, 23 bp, Artificial Sequence
  Description of Artificial Sequence: Synthetic oligonucleotide
ctgcgctccggggccaatgtgga

SEQ ID NO: 274470 - DNA, 23 bp, Artificial Sequence
  Description of Artificial Sequence: Synthetic oligonucleotide
tgcgctccggggccaatgtggag

SEQ ID NO: 274471 - DNA, 22 bp, Artificial Sequence
  Description of Artificial Sequence: Synthetic oligonucleotide
gcgctccggggccaatgtggag

SEQ ID NO: 274472 - DNA, 22 bp, Artificial Sequence
  Description of Artificial Sequence: Synthetic oligonucleotide
cgctccggggccaatgtggagg

SEQ ID NO: 274473 - DNA, 24 bp, Artificial Sequence
  Description of Artificial Sequence: Synthetic oligonucleotide
gctccggggccaatgtggaggcat

SEQ ID NO: 274474 - DNA, 25 bp, Artificial Sequence
  Description of Artificial Sequence: Synthetic oligonucleotide
ctccggggccaatgtggaggcatgt

SEQ ID NO: 274475 - DNA, 26 bp, Artificial Sequence
  Description of Artificial Sequence: Synthetic oligonucleotide
tccggggccaatgtggaggcatgtgt

SEQ ID NO: 274476 - DNA, 25 bp, Artificial Sequence
  Description of Artificial Sequence: Synthetic oligonucleotide
ccggggccaatgtggaggcatgtgt

SEQ ID NO: 274477 - DNA, 27 bp, Artificial Sequence
  Description of Artificial Sequence: Synthetic oligonucleotide
cggggccaatgtggaggcatgtgtgtt

SEQ ID NO: 274478 - DNA, 27 bp, Artificial Sequence
  Description of Artificial Sequence: Synthetic oligonucleotide
ggggccaatgtggaggcatgtgtgttc

SEQ ID NO: 274479 - DNA, 28 bp, Artificial Sequence
  Description of Artificial Sequence: Synthetic oligonucleotide
gggccaatgtggaggcatgtgtgttcac

SEQ ID NO: 274480 - DNA, 31 bp, Artificial Sequence
  Description of Artificial Sequence: Synthetic oligonucleotide
ggccaatgtggaggcatgtgtgttcacaaag

SEQ ID NO: 274481 - DNA, 32 bp, Artificial Sequence
  Description of Artificial Sequence: Synthetic oligonucleotide
gccaatgtggaggcatgtgtgttcacaaagag

SEQ ID NO: 274482 - DNA, 33 bp, Artificial Sequence
  Description of Artificial Sequence: Synthetic oligonucleotide
ccaatgtggaggcatgtgtgttcacaaagagtg

SEQ ID NO: 274483 - DNA, 33 bp, Artificial Sequence
  Description of Artificial Sequence: Synthetic oligonucleotide
caatgtggaggcatgtgtgttcacaaagagtgg

SEQ ID NO: 274484 - DNA, 33 bp, Artificial Sequence
  Description of Artificial Sequence: Synthetic oligonucleotide
aatgtggaggcatgtgtgttcacaaagagtggc

SEQ ID NO: 274485 - DNA, 32 bp, Artificial Sequence
  Description of Artificial Sequence: Synthetic oligonucleotide
atgtggaggcatgtgtgttcacaaagagtggc

SEQ ID NO: 274486 - DNA, 31 bp, Artificial Sequence
  Description of Artificial Sequence: Synthetic oligonucleotide
tgtggaggcatgtgtgttcacaaagagtggc

SEQ ID NO: 274487 - DNA, 30 bp, Artificial Sequence
  Description of Artificial Sequence: Synthetic oligonucleotide
gtggaggcatgtgtgttcacaaagagtggc

SEQ ID NO: 274488 - DNA, 30 bp, Artificial Sequence
  Description of Artificial Sequence: Synthetic oligonucleotide
tggaggcatgtgtgttcacaaagagtggcg

SEQ ID NO: 274489 - DNA, 29 bp, Artificial Sequence
  Description of Artificial Sequence: Synthetic oligonucleotide
ggaggcatgtgtgttcacaaagagtggcg

SEQ ID NO: 274490 - DNA, 29 bp, Artificial Sequence
  Description of Artificial Sequence: Synthetic oligonucleotide
gaggcatgtgtgttcacaaagagtggcgc

SEQ ID NO: 274491 - DNA, 29 bp, Artificial Sequence
  Description of Artificial Sequence: Synthetic oligonucleotide
aggcatgtgtgttcacaaagagtggcgcc

SEQ ID NO: 274492 - DNA, 28 bp, Artificial Sequence
  Description of Artificial Sequence: Synthetic oligonucleotide
ggcatgtgtgttcacaaagagtggcgcc

SEQ ID NO: 274493 - DNA, 30 bp, Artificial Sequence
  Description of Artificial Sequence: Synthetic oligonucleotide
gcatgtgtgttcacaaagagtggcgccaac

SEQ ID NO: 274494 - DNA, 30 bp, Artificial Sequence
  Description of Artificial Sequence: Synthetic oligonucleotide
catgtgtgttcacaaagagtggcgccaacc

SEQ ID NO: 274495 - DNA, 31 bp, Artificial Sequence
  Description of Artificial Sequence: Synthetic oligonucleotide
atgtgtgttcacaaagagtggcgccaacctg

SEQ ID NO: 274496 - DNA, 30 bp, Artificial Sequence
  Description of Artificial Sequence: Synthetic oligonucleotide
tgtgtgttcacaaagagtggcgccaacctg

SEQ ID NO: 274497 - DNA, 29 bp, Artificial Sequence
  Description of Artificial Sequence: Synthetic oligonucleotide
gtgtgttcacaaagagtggcgccaacctg

SEQ ID NO: 274498 - DNA, 29 bp, Artificial Sequence
  Description of Artificial Sequence: Synthetic oligonucleotide
tgtgttcacaaagagtggcgccaacctgc

SEQ ID NO: 274499 - DNA, 28 bp, Artificial Sequence
  Description of Artificial Sequence: Synthetic oligonucleotide
gtgttcacaaagagtggcgccaacctgc

SEQ ID NO: 274500 - DNA, 29 bp, Artificial Sequence
  Description of Artificial Sequence: Synthetic oligonucleotide
tgttcacaaagagtggcgccaacctgctg

SEQ ID NO: 274501 - DNA, 28 bp, Artificial Sequence
  Description of Artificial Sequence: Synthetic oligonucleotide
gttcacaaagagtggcgccaacctgctg

SEQ ID NO: 274502 - DNA, 28 bp, Artificial Sequence
  Description of Artificial Sequence: Synthetic oligonucleotide
ttcacaaagagtggcgccaacctgctgc

SEQ ID NO: 274503 - DNA, 27 bp, Artificial Sequence
  Description of Artificial Sequence: Synthetic oligonucleotide
tcacaaagagtggcgccaacctgctgc

SEQ ID NO: 274504 - DNA, 26 bp, Artificial Sequence
  Description of Artificial Sequence: Synthetic oligonucleotide
cacaaagagtggcgccaacctgctgc

SEQ ID NO: 274505 - DNA, 26 bp, Artificial Sequence
  Description of Artificial Sequence: Synthetic oligonucleotide
acaaagagtggcgccaacctgctgcg

SEQ ID NO: 274506 - DNA, 25 bp, Artificial Sequence
  Description of Artificial Sequence: Synthetic oligonucleotide
caaagagtggcgccaacctgctgcg

SEQ ID NO: 274507 - DNA, 26 bp, Artificial Sequence
  Description of Artificial Sequence: Synthetic oligonucleotide
aaagagtggcgccaacctgctgcggt

SEQ ID NO: 274508 - DNA, 25 bp, Artificial Sequence
  Description of Artificial Sequence: Synthetic oligonucleotide
aagagtggcgccaacctgctgcggt

SEQ ID NO: 274509 - DNA, 24 bp, Artificial Sequence
  Description of Artificial Sequence: Synthetic oligonucleotide
agagtggcgccaacctgctgcggt

SEQ ID NO: 274510 - DNA, 23 bp, Artificial Sequence
  Description of Artificial Sequence: Synthetic oligonucleotide
gagtggcgccaacctgctgcggt

SEQ ID NO: 274511 - DNA, 24 bp, Artificial Sequence
  Description of Artificial Sequence: Synthetic oligonucleotide
agtggcgccaacctgctgcggtca

SEQ ID NO: 274512 - DNA, 23 bp, Artificial Sequence
  Description of Artificial Sequence: Synthetic oligonucleotide
gtggcgccaacctgctgcggtca

SEQ ID NO: 274513 - DNA, 24 bp, Artificial Sequence
  Description of Artificial Sequence: Synthetic oligonucleotide
tggcgccaacctgctgcggtcact

SEQ ID NO: 274514 - DNA, 23 bp, Artificial Sequence
  Description of Artificial Sequence: Synthetic oligonucleotide
ggcgccaacctgctgcggtcact

SEQ ID NO: 274515 - DNA, 24 bp, Artificial Sequence
  Description of Artificial Sequence: Synthetic oligonucleotide
gcgccaacctgctgcggtcactga

SEQ ID NO: 274516 - DNA, 24 bp, Artificial Sequence
  Description of Artificial Sequence: Synthetic oligonucleotide
cgccaacctgctgcggtcactgag

SEQ ID NO: 274517 - DNA, 25 bp, Artificial Sequence
  Description of Artificial Sequence: Synthetic oligonucleotide
gccaacctgctgcggtcactgagct

SEQ ID NO: 274518 - DNA, 26 bp, Artificial Sequence
  Description of Artificial Sequence: Synthetic oligonucleotide
ccaacctgctgcggtcactgagctga

SEQ ID NO: 274519 - DNA, 26 bp, Artificial Sequence
  Description of Artificial Sequence: Synthetic oligonucleotide
caacctgctgcggtcactgagctgac

SEQ ID NO: 274520 - DNA, 26 bp, Artificial Sequence
  Description of Artificial Sequence: Synthetic oligonucleotide
aacctgctgcggtcactgagctgacc

SEQ ID NO: 274521 - DNA, 25 bp, Artificial Sequence
  Description of Artificial Sequence: Synthetic oligonucleotide
acctgctgcggtcactgagctgacc

SEQ ID NO: 274522 - DNA, 24 bp, Artificial Sequence
  Description of Artificial Sequence: Synthetic oligonucleotide
cctgctgcggtcactgagctgacc

SEQ ID NO: 274523 - DNA, 25 bp, Artificial Sequence
  Description of Artificial Sequence: Synthetic oligonucleotide
ctgctgcggtcactgagctgaccca

SEQ ID NO: 274524 - DNA, 26 bp, Artificial Sequence
  Description of Artificial Sequence: Synthetic oligonucleotide
tgctgcggtcactgagctgacccaca

SEQ ID NO: 274525 - DNA, 25 bp, Artificial Sequence
  Description of Artificial Sequence: Synthetic oligonucleotide
gctgcggtcactgagctgacccaca

SEQ ID NO: 274526 - DNA, 26 bp, Artificial Sequence
  Description of Artificial Sequence: Synthetic oligonucleotide
ctgcggtcactgagctgacccacaga

SEQ ID NO: 274527 - DNA, 26 bp, Artificial Sequence
  Description of Artificial Sequence: Synthetic oligonucleotide
tgcggtcactgagctgacccacagac

SEQ ID NO: 274528 - DNA, 25 bp, Artificial Sequence
  Description of Artificial Sequence: Synthetic oligonucleotide
gcggtcactgagctgacccacagac

SEQ ID NO: 274529 - DNA, 25 bp, Artificial Sequence
  Description of Artificial Sequence: Synthetic oligonucleotide
cggtcactgagctgacccacagacc

SEQ ID NO: 274530 - DNA, 25 bp, Artificial Sequence
  Description of Artificial Sequence: Synthetic oligonucleotide
ggtcactgagctgacccacagaccc

SEQ ID NO: 274531 - DNA, 25 bp, Artificial Sequence
  Description of Artificial Sequence: Synthetic oligonucleotide
gtcactgagctgacccacagacccc

SEQ ID NO: 274532 - DNA, 26 bp, Artificial Sequence
  Description of Artificial Sequence: Synthetic oligonucleotide
tcactgagctgacccacagaccccgt

SEQ ID NO: 274533 - DNA, 25 bp, Artificial Sequence
  Description of Artificial Sequence: Synthetic oligonucleotide
cactgagctgacccacagaccccgt

SEQ ID NO: 274534 - DNA, 27 bp, Artificial Sequence
  Description of Artificial Sequence: Synthetic oligonucleotide
actgagctgacccacagaccccgtgaa

SEQ ID NO: 274535 - DNA, 26 bp, Artificial Sequence
  Description of Artificial Sequence: Synthetic oligonucleotide
ctgagctgacccacagaccccgtgaa

SEQ ID NO: 274536 - DNA, 27 bp, Artificial Sequence
  Description of Artificial Sequence: Synthetic oligonucleotide
tgagctgacccacagaccccgtgaagt

SEQ ID NO: 274537 - DNA, 26 bp, Artificial Sequence
  Description of Artificial Sequence: Synthetic oligonucleotide
gagctgacccacagaccccgtgaagt

SEQ ID NO: 274538 - DNA, 26 bp, Artificial Sequence
  Description of Artificial Sequence: Synthetic oligonucleotide
agctgacccacagaccccgtgaagtg

SEQ ID NO: 274539 - DNA, 25 bp, Artificial Sequence
  Description of Artificial Sequence: Synthetic oligonucleotide
gctgacccacagaccccgtgaagtg

SEQ ID NO: 274540 - DNA, 26 bp, Artificial Sequence
  Description of Artificial Sequence: Synthetic oligonucleotide
ctgacccacagaccccgtgaagtggt

SEQ ID NO: 274541 - DNA, 27 bp, Artificial Sequence
  Description of Artificial Sequence: Synthetic oligonucleotide
tgacccacagaccccgtgaagtggtct

SEQ ID NO: 274542 - DNA, 26 bp, Artificial Sequence
  Description of Artificial Sequence: Synthetic oligonucleotide
gacccacagaccccgtgaagtggtct

SEQ ID NO: 274543 - DNA, 26 bp, Artificial Sequence
  Description of Artificial Sequence: Synthetic oligonucleotide
acccacagaccccgtgaagtggtctg

SEQ ID NO: 274544 - DNA, 25 bp, Artificial Sequence
  Description of Artificial Sequence: Synthetic oligonucleotide
cccacagaccccgtgaagtggtctg

SEQ ID NO: 274545 - DNA, 25 bp, Artificial Sequence
  Description of Artificial Sequence: Synthetic oligonucleotide
ccacagaccccgtgaagtggtctgg

SEQ ID NO: 274546 - DNA, 25 bp, Artificial Sequence
  Description of Artificial Sequence: Synthetic oligonucleotide
cacagaccccgtgaagtggtctggc

SEQ ID NO: 274547 - DNA, 25 bp, Artificial Sequence
  Description of Artificial Sequence: Synthetic oligonucleotide
acagaccccgtgaagtggtctggcc

SEQ ID NO: 274548 - DNA, 24 bp, Artificial Sequence
  Description of Artificial Sequence: Synthetic oligonucleotide
cagaccccgtgaagtggtctggcc

SEQ ID NO: 274549 - DNA, 24 bp, Artificial Sequence
  Description of Artificial Sequence: Synthetic oligonucleotide
agaccccgtgaagtggtctggccc

SEQ ID NO: 274550 - DNA, 23 bp, Artificial Sequence
  Description of Artificial Sequence: Synthetic oligonucleotide
gaccccgtgaagtggtctggccc

SEQ ID NO: 274551 - DNA, 25 bp, Artificial Sequence
  Description of Artificial Sequence: Synthetic oligonucleotide
accccgtgaagtggtctggccccta

SEQ ID NO: 274552 - DNA, 24 bp, Artificial Sequence
  Description of Artificial Sequence: Synthetic oligonucleotide
ccccgtgaagtggtctggccccta

SEQ ID NO: 274553 - DNA, 24 bp, Artificial Sequence
  Description of Artificial Sequence: Synthetic oligonucleotide
cccgtgaagtggtctggcccctac

SEQ ID NO: 274554 - DNA, 25 bp, Artificial Sequence
  Description of Artificial Sequence: Synthetic oligonucleotide
ccgtgaagtggtctggcccctacca

SEQ ID NO: 274555 - DNA, 27 bp, Artificial Sequence
  Description of Artificial Sequence: Synthetic oligonucleotide
cgtgaagtggtctggcccctaccactt

SEQ ID NO: 274556 - DNA, 28 bp, Artificial Sequence
  Description of Artificial Sequence: Synthetic oligonucleotide
gtgaagtggtctggcccctaccacttag

SEQ ID NO: 274557 - DNA, 29 bp, Artificial Sequence
  Description of Artificial Sequence: Synthetic oligonucleotide
tgaagtggtctggcccctaccacttagtg

SEQ ID NO: 274558 - DNA, 28 bp, Artificial Sequence
  Description of Artificial Sequence: Synthetic oligonucleotide
gaagtggtctggcccctaccacttagtg

SEQ ID NO: 274559 - DNA, 28 bp, Artificial Sequence
  Description of Artificial Sequence: Synthetic oligonucleotide
aagtggtctggcccctaccacttagtgc

SEQ ID NO: 274560 - DNA, 27 bp, Artificial Sequence
  Description of Artificial Sequence: Synthetic oligonucleotide
agtggtctggcccctaccacttagtgc

SEQ ID NO: 274561 - DNA, 26 bp, Artificial Sequence
  Description of Artificial Sequence: Synthetic oligonucleotide
gtggtctggcccctaccacttagtgc

SEQ ID NO: 274562 - DNA, 27 bp, Artificial Sequence
  Description of Artificial Sequence: Synthetic oligonucleotide
tggtctggcccctaccacttagtgcct

SEQ ID NO: 274563 - DNA, 26 bp, Artificial Sequence
  Description of Artificial Sequence: Synthetic oligonucleotide
ggtctggcccctaccacttagtgcct

SEQ ID NO: 274564 - DNA, 26 bp, Artificial Sequence
  Description of Artificial Sequence: Synthetic oligonucleotide
gtctggcccctaccacttagtgcctg

SEQ ID NO: 274565 - DNA, 27 bp, Artificial Sequence
  Description of Artificial Sequence: Synthetic oligonucleotide
tctggcccctaccacttagtgcctgga

SEQ ID NO: 274566 - DNA, 27 bp, Artificial Sequence
  Description of Artificial Sequence: Synthetic oligonucleotide
ctggcccctaccacttagtgcctggat

SEQ ID NO: 274567 - DNA, 27 bp, Artificial Sequence
  Description of Artificial Sequence: Synthetic oligonucleotide
tggcccctaccacttagtgcctggatc

SEQ ID NO: 274568 - DNA, 26 bp, Artificial Sequence
  Description of Artificial Sequence: Synthetic oligonucleotide
ggcccctaccacttagtgcctggatc

SEQ ID NO: 274569 - DNA, 27 bp, Artificial Sequence
  Description of Artificial Sequence: Synthetic oligonucleotide
gcccctaccacttagtgcctggatcca

SEQ ID NO: 274570 - DNA, 27 bp, Artificial Sequence
  Description of Artificial Sequence: Synthetic oligonucleotide
cccctaccacttagtgcctggatccac

SEQ ID NO: 274571 - DNA, 28 bp, Artificial Sequence
  Description of Artificial Sequence: Synthetic oligonucleotide
ccctaccacttagtgcctggatccacag

SEQ ID NO: 274572 - DNA, 28 bp, Artificial Sequence
  Description of Artificial Sequence: Synthetic oligonucleotide
cctaccacttagtgcctggatccacagc

SEQ ID NO: 274573 - DNA, 29 bp, Artificial Sequence
  Description of Artificial Sequence: Synthetic oligonucleotide
ctaccacttagtgcctggatccacagctg

SEQ ID NO: 274574 - DNA, 30 bp, Artificial Sequence
  Description of Artificial Sequence: Synthetic oligonucleotide
taccacttagtgcctggatccacagctgac

SEQ ID NO: 274575 - DNA, 29 bp, Artificial Sequence
  Description of Artificial Sequence: Synthetic oligonucleotide
accacttagtgcctggatccacagctgac

SEQ ID NO: 274576 - DNA, 28 bp, Artificial Sequence
  Description of Artificial Sequence: Synthetic oligonucleotide
ccacttagtgcctggatccacagctgac

SEQ ID NO: 274577 - DNA, 28 bp, Artificial Sequence
  Description of Artificial Sequence: Synthetic oligonucleotide
cacttagtgcctggatccacagctgacc

SEQ ID NO: 274578 - DNA, 29 bp, Artificial Sequence
  Description of Artificial Sequence: Synthetic oligonucleotide
acttagtgcctggatccacagctgacctg

SEQ ID NO: 274579 - DNA, 28 bp, Artificial Sequence
  Description of Artificial Sequence: Synthetic oligonucleotide
cttagtgcctggatccacagctgacctg

SEQ ID NO: 274580 - DNA, 29 bp, Artificial Sequence
  Description of Artificial Sequence: Synthetic oligonucleotide
ttagtgcctggatccacagctgacctgac

SEQ ID NO: 274581 - DNA, 28 bp, Artificial Sequence
  Description of Artificial Sequence: Synthetic oligonucleotide
tagtgcctggatccacagctgacctgac

SEQ ID NO: 274582 - DNA, 27 bp, Artificial Sequence
  Description of Artificial Sequence: Synthetic oligonucleotide
agtgcctggatccacagctgacctgac

SEQ ID NO: 274583 - DNA, 26 bp, Artificial Sequence
  Description of Artificial Sequence: Synthetic oligonucleotide
gtgcctggatccacagctgacctgac

SEQ ID NO: 274584 - DNA, 26 bp, Artificial Sequence
  Description of Artificial Sequence: Synthetic oligonucleotide
tgcctggatccacagctgacctgacc

SEQ ID NO: 274585 - DNA, 25 bp, Artificial Sequence
  Description of Artificial Sequence: Synthetic oligonucleotide
gcctggatccacagctgacctgacc

SEQ ID NO: 274586 - DNA, 26 bp, Artificial Sequence
  Description of Artificial Sequence: Synthetic oligonucleotide
cctggatccacagctgacctgaccca

SEQ ID NO: 274587 - DNA, 27 bp, Artificial Sequence
  Description of Artificial Sequence: Synthetic oligonucleotide
ctggatccacagctgacctgacccaca

SEQ ID NO: 274588 - DNA, 27 bp, Artificial Sequence
  Description of Artificial Sequence: Synthetic oligonucleotide
tggatccacagctgacctgacccacac

SEQ ID NO: 274589 - DNA, 27 bp, Artificial Sequence
  Description of Artificial Sequence: Synthetic oligonucleotide
ggatccacagctgacctgacccacaca

SEQ ID NO: 274590 - DNA, 27 bp, Artificial Sequence
  Description of Artificial Sequence: Synthetic oligonucleotide
gatccacagctgacctgacccacacag

SEQ ID NO: 274591 - DNA, 28 bp, Artificial Sequence
  Description of Artificial Sequence: Synthetic oligonucleotide
atccacagctgacctgacccacacagtg

SEQ ID NO: 274592 - DNA, 27 bp, Artificial Sequence
  Description of Artificial Sequence: Synthetic oligonucleotide
tccacagctgacctgacccacacagtg

SEQ ID NO: 274593 - DNA, 27 bp, Artificial Sequence
  Description of Artificial Sequence: Synthetic oligonucleotide
ccacagctgacctgacccacacagtga

SEQ ID NO: 274594 - DNA, 28 bp, Artificial Sequence
  Description of Artificial Sequence: Synthetic oligonucleotide
cacagctgacctgacccacacagtgaag

SEQ ID NO: 274595 - DNA, 28 bp, Artificial Sequence
  Description of Artificial Sequence: Synthetic oligonucleotide
acagctgacctgacccacacagtgaagg

SEQ ID NO: 274596 - DNA, 27 bp, Artificial Sequence
  Description of Artificial Sequence: Synthetic oligonucleotide
cagctgacctgacccacacagtgaagg

SEQ ID NO: 274597 - DNA, 27 bp, Artificial Sequence
  Description of Artificial Sequence: Synthetic oligonucleotide
agctgacctgacccacacagtgaaggc

SEQ ID NO: 274598 - DNA, 27 bp, Artificial Sequence
  Description of Artificial Sequence: Synthetic oligonucleotide
gctgacctgacccacacagtgaaggca

SEQ ID NO: 274599 - DNA, 27 bp, Artificial Sequence
  Description of Artificial Sequence: Synthetic oligonucleotide
ctgacctgacccacacagtgaaggcac

SEQ ID NO: 274600 - DNA, 30 bp, Artificial Sequence
  Description of Artificial Sequence: Synthetic oligonucleotide
tgacctgacccacacagtgaaggcactaac

SEQ ID NO: 274601 - DNA, 29 bp, Artificial Sequence
  Description of Artificial Sequence: Synthetic oligonucleotide
gacctgacccacacagtgaaggcactaac

SEQ ID NO: 274602 - DNA, 29 bp, Artificial Sequence
  Description of Artificial Sequence: Synthetic oligonucleotide
acctgacccacacagtgaaggcactaacc

SEQ ID NO: 274603 - DNA, 28 bp, Artificial Sequence
  Description of Artificial Sequence: Synthetic oligonucleotide
cctgacccacacagtgaaggcactaacc

SEQ ID NO: 274604 - DNA, 28 bp, Artificial Sequence
  Description of Artificial Sequence: Synthetic oligonucleotide
ctgacccacacagtgaaggcactaaccc

SEQ ID NO: 274605 - DNA, 29 bp, Artificial Sequence
  Description of Artificial Sequence: Synthetic oligonucleotide
tgacccacacagtgaaggcactaacccag

SEQ ID NO: 274606 - DNA, 28 bp, Artificial Sequence
  Description of Artificial Sequence: Synthetic oligonucleotide
gacccacacagtgaaggcactaacccag

SEQ ID NO: 274607 - DNA, 28 bp, Artificial Sequence
  Description of Artificial Sequence: Synthetic oligonucleotide
acccacacagtgaaggcactaacccagg

SEQ ID NO: 274608 - DNA, 27 bp, Artificial Sequence
  Description of Artificial Sequence: Synthetic oligonucleotide
cccacacagtgaaggcactaacccagg

SEQ ID NO: 274609 - DNA, 28 bp, Artificial Sequence
  Description of Artificial Sequence: Synthetic oligonucleotide
ccacacagtgaaggcactaacccaggag

SEQ ID NO: 274610 - DNA, 28 bp, Artificial Sequence
  Description of Artificial Sequence: Synthetic oligonucleotide
cacacagtgaaggcactaacccaggagc

SEQ ID NO: 274611 - DNA, 30 bp, Artificial Sequence
  Description of Artificial Sequence: Synthetic oligonucleotide
acacagtgaaggcactaacccaggagctag

SEQ ID NO: 274612 - DNA, 29 bp, Artificial Sequence
  Description of Artificial Sequence: Synthetic oligonucleotide
cacagtgaaggcactaacccaggagctag

SEQ ID NO: 274613 - DNA, 30 bp, Artificial Sequence
  Description of Artificial Sequence: Synthetic oligonucleotide
acagtgaaggcactaacccaggagctagtc

SEQ ID NO: 274614 - DNA, 29 bp, Artificial Sequence
  Description of Artificial Sequence: Synthetic oligonucleotide
cagtgaaggcactaacccaggagctagtc

SEQ ID NO: 274615 - DNA, 29 bp, Artificial Sequence
  Description of Artificial Sequence: Synthetic oligonucleotide
agtgaaggcactaacccaggagctagtcg

SEQ ID NO: 274616 - DNA, 28 bp, Artificial Sequence
  Description of Artificial Sequence: Synthetic oligonucleotide
gtgaaggcactaacccaggagctagtcg

SEQ ID NO: 274617 - DNA, 29 bp, Artificial Sequence
  Description of Artificial Sequence: Synthetic oligonucleotide
tgaaggcactaacccaggagctagtcgag

SEQ ID NO: 274618 - DNA, 28 bp, Artificial Sequence
  Description of Artificial Sequence: Synthetic oligonucleotide
gaaggcactaacccaggagctagtcgag

SEQ ID NO: 274619 - DNA, 28 bp, Artificial Sequence
  Description of Artificial Sequence: Synthetic oligonucleotide
aaggcactaacccaggagctagtcgagg

SEQ ID NO: 274620 - DNA, 27 bp, Artificial Sequence
  Description of Artificial Sequence: Synthetic oligonucleotide
aggcactaacccaggagctagtcgagg

SEQ ID NO: 274621 - DNA, 27 bp, Artificial Sequence
  Description of Artificial Sequence: Synthetic oligonucleotide
ggcactaacccaggagctagtcgagga

SEQ ID NO: 274622 - DNA, 29 bp, Artificial Sequence
  Description of Artificial Sequence: Synthetic oligonucleotide
gcactaacccaggagctagtcgaggaaac

SEQ ID NO: 274623 - DNA, 30 bp, Artificial Sequence
  Description of Artificial Sequence: Synthetic oligonucleotide
cactaacccaggagctagtcgaggaaactc

SEQ ID NO: 274624 - DNA, 31 bp, Artificial Sequence
  Description of Artificial Sequence: Synthetic oligonucleotide
actaacccaggagctagtcgaggaaactctg

SEQ ID NO: 274625 - DNA, 30 bp, Artificial Sequence
  Description of Artificial Sequence: Synthetic oligonucleotide
ctaacccaggagctagtcgaggaaactctg

SEQ ID NO: 274626 - DNA, 30 bp, Artificial Sequence
  Description of Artificial Sequence: Synthetic oligonucleotide
taacccaggagctagtcgaggaaactctgc

SEQ ID NO: 274627 - DNA, 29 bp, Artificial Sequence
  Description of Artificial Sequence: Synthetic oligonucleotide
aacccaggagctagtcgaggaaactctgc

SEQ ID NO: 274628 - DNA, 28 bp, Artificial Sequence
  Description of Artificial Sequence: Synthetic oligonucleotide
acccaggagctagtcgaggaaactctgc

SEQ ID NO: 274629 - DNA, 27 bp, Artificial Sequence
  Description of Artificial Sequence: Synthetic oligonucleotide
cccaggagctagtcgaggaaactctgc

SEQ ID NO: 274630 - DNA, 28 bp, Artificial Sequence
  Description of Artificial Sequence: Synthetic oligonucleotide
ccaggagctagtcgaggaaactctgcag

SEQ ID NO: 274631 - DNA, 28 bp, Artificial Sequence
  Description of Artificial Sequence: Synthetic oligonucleotide
caggagctagtcgaggaaactctgcagg

SEQ ID NO: 274632 - DNA, 28 bp, Artificial Sequence
  Description of Artificial Sequence: Synthetic oligonucleotide
aggagctagtcgaggaaactctgcaggc

SEQ ID NO: 274633 - DNA, 27 bp, Artificial Sequence
  Description of Artificial Sequence: Synthetic oligonucleotide
ggagctagtcgaggaaactctgcaggc

SEQ ID NO: 274634 - DNA, 30 bp, Artificial Sequence
  Description of Artificial Sequence: Synthetic oligonucleotide
gagctagtcgaggaaactctgcaggctaag

SEQ ID NO: 274635 - DNA, 30 bp, Artificial Sequence
  Description of Artificial Sequence: Synthetic oligonucleotide
agctagtcgaggaaactctgcaggctaagg

SEQ ID NO: 274636 - DNA, 29 bp, Artificial Sequence
  Description of Artificial Sequence: Synthetic oligonucleotide
gctagtcgaggaaactctgcaggctaagg

SEQ ID NO: 274637 - DNA, 30 bp, Artificial Sequence
  Description of Artificial Sequence: Synthetic oligonucleotide
ctagtcgaggaaactctgcaggctaaggag

SEQ ID NO: 274638 - DNA, 30 bp, Artificial Sequence
  Description of Artificial Sequence: Synthetic oligonucleotide
tagtcgaggaaactctgcaggctaaggagg

SEQ ID NO: 274639 - DNA, 29 bp, Artificial Sequence
  Description of Artificial Sequence: Synthetic oligonucleotide
agtcgaggaaactctgcaggctaaggagg

SEQ ID NO: 274640 - DNA, 28 bp, Artificial Sequence
  Description of Artificial Sequence: Synthetic oligonucleotide
gtcgaggaaactctgcaggctaaggagg

SEQ ID NO: 274641 - DNA, 29 bp, Artificial Sequence
  Description of Artificial Sequence: Synthetic oligonucleotide
tcgaggaaactctgcaggctaaggaggtg

SEQ ID NO: 274642 - DNA, 28 bp, Artificial Sequence
  Description of Artificial Sequence: Synthetic oligonucleotide
cgaggaaactctgcaggctaaggaggtg

SEQ ID NO: 274643 - DNA, 28 bp, Artificial Sequence
  Description of Artificial Sequence: Synthetic oligonucleotide
gaggaaactctgcaggctaaggaggtgg

SEQ ID NO: 274644 - DNA, 29 bp, Artificial Sequence
  Description of Artificial Sequence: Synthetic oligonucleotide
aggaaactctgcaggctaaggaggtggac

SEQ ID NO: 274645 - DNA, 28 bp, Artificial Sequence
  Description of Artificial Sequence: Synthetic oligonucleotide
ggaaactctgcaggctaaggaggtggac

SEQ ID NO: 274646 - DNA, 28 bp, Artificial Sequence
  Description of Artificial Sequence: Synthetic oligonucleotide
ttggctctgctggatgtgtggaagtggc

SEQ ID NO: 274647 - DNA, 27 bp, Artificial Sequence
  Description of Artificial Sequence: Synthetic oligonucleotide
tggctctgctggatgtgtggaagtggc

SEQ ID NO: 274648 - DNA, 27 bp, Artificial Sequence
  Description of Artificial Sequence: Synthetic oligonucleotide
ggctctgctggatgtgtggaagtggca

SEQ ID NO: 274649 - DNA, 27 bp, Artificial Sequence
  Description of Artificial Sequence: Synthetic oligonucleotide
gctctgctggatgtgtggaagtggcag

SEQ ID NO: 274650 - DNA, 28 bp, Artificial Sequence
  Description of Artificial Sequence: Synthetic oligonucleotide
ctctgctggatgtgtggaagtggcagac

SEQ ID NO: 274651 - DNA, 28 bp, Artificial Sequence
  Description of Artificial Sequence: Synthetic oligonucleotide
tctgctggatgtgtggaagtggcagacc

SEQ ID NO: 274652 - DNA, 27 bp, Artificial Sequence
  Description of Artificial Sequence: Synthetic oligonucleotide
ctgctggatgtgtggaagtggcagacc

SEQ ID NO: 274653 - DNA, 27 bp, Artificial Sequence
  Description of Artificial Sequence: Synthetic oligonucleotide
tgctggatgtgtggaagtggcagaccc

SEQ ID NO: 274654 - DNA, 26 bp, Artificial Sequence
  Description of Artificial Sequence: Synthetic oligonucleotide
gctggatgtgtggaagtggcagaccc

SEQ ID NO: 274655 - DNA, 27 bp, Artificial Sequence
  Description of Artificial Sequence: Synthetic oligonucleotide
ctggatgtgtggaagtggcagacccct

SEQ ID NO: 274656 - DNA, 27 bp, Artificial Sequence
  Description of Artificial Sequence: Synthetic oligonucleotide
tggatgtgtggaagtggcagacccctg

SEQ ID NO: 274657 - DNA, 27 bp, Artificial Sequence
  Description of Artificial Sequence: Synthetic oligonucleotide
ggatgtgtggaagtggcagacccctga

SEQ ID NO: 274658 - DNA, 27 bp, Artificial Sequence
  Description of Artificial Sequence: Synthetic oligonucleotide
gatgtgtggaagtggcagacccctgac

SEQ ID NO: 274659 - DNA, 28 bp, Artificial Sequence
  Description of Artificial Sequence: Synthetic oligonucleotide
atgtgtggaagtggcagacccctgacag

SEQ ID NO: 274660 - DNA, 27 bp, Artificial Sequence
  Description of Artificial Sequence: Synthetic oligonucleotide
tgtgtggaagtggcagacccctgacag

SEQ ID NO: 274661 - DNA, 26 bp, Artificial Sequence
  Description of Artificial Sequence: Synthetic oligonucleotide
gtgtggaagtggcagacccctgacag

SEQ ID NO: 274662 - DNA, 26 bp, Artificial Sequence
  Description of Artificial Sequence: Synthetic oligonucleotide
tgtggaagtggcagacccctgacagc

SEQ ID NO: 274663 - DNA, 25 bp, Artificial Sequence
  Description of Artificial Sequence: Synthetic oligonucleotide
gtggaagtggcagacccctgacagc

SEQ ID NO: 274664 - DNA, 26 bp, Artificial Sequence
  Description of Artificial Sequence: Synthetic oligonucleotide
tggaagtggcagacccctgacagcca

SEQ ID NO: 274665 - DNA, 25 bp, Artificial Sequence
  Description of Artificial Sequence: Synthetic oligonucleotide
ggaagtggcagacccctgacagcca

SEQ ID NO: 274666 - DNA, 25 bp, Artificial Sequence
  Description of Artificial Sequence: Synthetic oligonucleotide
gaagtggcagacccctgacagccag

SEQ ID NO: 274667 - DNA, 25 bp, Artificial Sequence
  Description of Artificial Sequence: Synthetic oligonucleotide
aagtggcagacccctgacagccagg

SEQ ID NO: 274668 - DNA, 24 bp, Artificial Sequence
  Description of Artificial Sequence: Synthetic oligonucleotide
agtggcagacccctgacagccagg

SEQ ID NO: 274669 - DNA, 23 bp, Artificial Sequence
  Description of Artificial Sequence: Synthetic oligonucleotide
gtggcagacccctgacagccagg

SEQ ID NO: 274670 - DNA, 24 bp, Artificial Sequence
  Description of Artificial Sequence: Synthetic oligonucleotide
tggcagacccctgacagccaggga

SEQ ID NO: 274671 - DNA, 23 bp, Artificial Sequence
  Description of Artificial Sequence: Synthetic oligonucleotide
ggcagacccctgacagccaggga

SEQ ID NO: 274672 - DNA, 23 bp, Artificial Sequence
  Description of Artificial Sequence: Synthetic oligonucleotide
gcagacccctgacagccagggac

SEQ ID NO: 274673 - DNA, 25 bp, Artificial Sequence
  Description of Artificial Sequence: Synthetic oligonucleotide
cagacccctgacagccagggacctt

SEQ ID NO: 274674 - DNA, 26 bp, Artificial Sequence
  Description of Artificial Sequence: Synthetic oligonucleotide
agacccctgacagccagggaccttca

SEQ ID NO: 274675 - DNA, 25 bp, Artificial Sequence
  Description of Artificial Sequence: Synthetic oligonucleotide
gacccctgacagccagggaccttca

SEQ ID NO: 274676 - DNA, 25 bp, Artificial Sequence
  Description of Artificial Sequence: Synthetic oligonucleotide
acccctgacagccagggaccttcac

SEQ ID NO: 274677 - DNA, 24 bp, Artificial Sequence
  Description of Artificial Sequence: Synthetic oligonucleotide
cccctgacagccagggaccttcac

SEQ ID NO: 274678 - DNA, 25 bp, Artificial Sequence
  Description of Artificial Sequence: Synthetic oligonucleotide
ccctgacagccagggaccttcacct

SEQ ID NO: 274679 - DNA, 26 bp, Artificial Sequence
  Description of Artificial Sequence: Synthetic oligonucleotide
cctgacagccagggaccttcacctca

SEQ ID NO: 274680 - DNA, 26 bp, Artificial Sequence
  Description of Artificial Sequence: Synthetic oligonucleotide
ctgacagccagggaccttcacctcac

SEQ ID NO: 274681 - DNA, 27 bp, Artificial Sequence
  Description of Artificial Sequence: Synthetic oligonucleotide
tgacagccagggaccttcacctcacgt

SEQ ID NO: 274682 - DNA, 26 bp, Artificial Sequence
  Description of Artificial Sequence: Synthetic oligonucleotide
gacagccagggaccttcacctcacgt

SEQ ID NO: 274683 - DNA, 26 bp, Artificial Sequence
  Description of Artificial Sequence: Synthetic oligonucleotide
acagccagggaccttcacctcacgtg

SEQ ID NO: 274684 - DNA, 25 bp, Artificial Sequence
  Description of Artificial Sequence: Synthetic oligonucleotide
cagccagggaccttcacctcacgtg

SEQ ID NO: 274685 - DNA, 25 bp, Artificial Sequence
  Description of Artificial Sequence: Synthetic oligonucleotide
agccagggaccttcacctcacgtgc

SEQ ID NO: 274686 - DNA, 24 bp, Artificial Sequence
  Description of Artificial Sequence: Synthetic oligonucleotide
gccagggaccttcacctcacgtgc

SEQ ID NO: 274687 - DNA, 25 bp, Artificial Sequence
  Description of Artificial Sequence: Synthetic oligonucleotide
ccagggaccttcacctcacgtgcct

SEQ ID NO: 274688 - DNA, 25 bp, Artificial Sequence
  Description of Artificial Sequence: Synthetic oligonucleotide
cagggaccttcacctcacgtgcctc

SEQ ID NO: 274689 - DNA, 25 bp, Artificial Sequence
  Description of Artificial Sequence: Synthetic oligonucleotide
agggaccttcacctcacgtgcctcg

SEQ ID NO: 274690 - DNA, 24 bp, Artificial Sequence
  Description of Artificial Sequence: Synthetic oligonucleotide
gggaccttcacctcacgtgcctcg

SEQ ID NO: 274691 - DNA, 24 bp, Artificial Sequence
  Description of Artificial Sequence: Synthetic oligonucleotide
ggaccttcacctcacgtgcctcgg

SEQ ID NO: 274692 - DNA, 24 bp, Artificial Sequence
  Description of Artificial Sequence: Synthetic oligonucleotide
gaccttcacctcacgtgcctcggg

SEQ ID NO: 274693 - DNA, 25 bp, Artificial Sequence
  Description of Artificial Sequence: Synthetic oligonucleotide
accttcacctcacgtgcctcggggt

SEQ ID NO: 274694 - DNA, 24 bp, Artificial Sequence
  Description of Artificial Sequence: Synthetic oligonucleotide
ccttcacctcacgtgcctcggggt

SEQ ID NO: 274695 - DNA, 24 bp, Artificial Sequence
  Description of Artificial Sequence: Synthetic oligonucleotide
cttcacctcacgtgcctcggggtg

SEQ ID NO: 274696 - DNA, 24 bp, Artificial Sequence
  Description of Artificial Sequence: Synthetic oligonucleotide
ttcacctcacgtgcctcggggtgg

SEQ ID NO: 274697 - DNA, 23 bp, Artificial Sequence
  Description of Artificial Sequence: Synthetic oligonucleotide
tcacctcacgtgcctcggggtgg

SEQ ID NO: 274698 - DNA, 22 bp, Artificial Sequence
  Description of Artificial Sequence: Synthetic oligonucleotide
cacctcacgtgcctcggggtgg

SEQ ID NO: 274699 - DNA, 22 bp, Artificial Sequence
  Description of Artificial Sequence: Synthetic oligonucleotide
acctcacgtgcctcggggtggc

SEQ ID NO: 274700 - DNA, 21 bp, Artificial Sequence
  Description of Artificial Sequence: Synthetic oligonucleotide
cctcacgtgcctcggggtggc

SEQ ID NO: 274701 - DNA, 21 bp, Artificial Sequence
  Description of Artificial Sequence: Synthetic oligonucleotide
ctcacgtgcctcggggtggcg

SEQ ID NO: 274702 - DNA, 21 bp, Artificial Sequence
  Description of Artificial Sequence: Synthetic oligonucleotide
tcacgtgcctcggggtggcgg

SEQ ID NO: 274703 - DNA, 20 bp, Artificial Sequence
  Description of Artificial Sequence: Synthetic oligonucleotide
cacgtgcctcggggtggcgg

SEQ ID NO: 274704 - DNA, 21 bp, Artificial Sequence
  Description of Artificial Sequence: Synthetic oligonucleotide
acgtgcctcggggtggcggct

SEQ ID NO: 274705 - DNA, 20 bp, Artificial Sequence
  Description of Artificial Sequence: Synthetic oligonucleotide
cgtgcctcggggtggcggct

SEQ ID NO: 274706 - DNA, 20 bp, Artificial Sequence
  Description of Artificial Sequence: Synthetic oligonucleotide
gtgcctcggggtggcggctg

SEQ ID NO: 274707 - DNA, 20 bp, Artificial Sequence
  Description of Artificial Sequence: Synthetic oligonucleotide
tgcctcggggtggcggctgc

SEQ ID NO: 274708 - DNA, 20 bp, Artificial Sequence
  Description of Artificial Sequence: Synthetic oligonucleotide
gcctcggggtggcggctgct

SEQ ID NO: 274709 - DNA, 20 bp, Artificial Sequence
  Description of Artificial Sequence: Synthetic oligonucleotide
cctcggggtggcggctgcgt

SEQ ID NO: 274710 - DNA, 20 bp, Artificial Sequence
  Description of Artificial Sequence: Synthetic oligonucleotide
ctcggggtggcggctgcgct

SEQ ID NO: 274711 - DNA, 21 bp, Artificial Sequence
  Description of Artificial Sequence: Synthetic oligonucleotide
tcggggtggcggctgcgctgt

SEQ ID NO: 274712 - DNA, 20 bp, Artificial Sequence
  Description of Artificial Sequence: Synthetic oligonucleotide
cggggtggcggctgcgctgt

SEQ ID NO: 274713 - DNA, 20 bp, Artificial Sequence
  Description of Artificial Sequence: Synthetic oligonucleotide
ggggtggcggctgcgctgtg

SEQ ID NO: 274714 - DNA, 20 bp, Artificial Sequence
  Description of Artificial Sequence: Synthetic oligonucleotide
gggtggcggctgcgctgtgc

SEQ ID NO: 274715 - DNA, 20 bp, Artificial Sequence
  Description of Artificial Sequence: Synthetic oligonucleotide
ggtggcggctgcgctgtgcc

SEQ ID NO: 274716 - DNA, 20 bp, Artificial Sequence
  Description of Artificial Sequence: Synthetic oligonucleotide
gtggcggctgcgctgtgccc

SEQ ID NO: 274717 - DNA, 20 bp, Artificial Sequence
  Description of Artificial Sequence: Synthetic oligonucleotide
tggcggctgcgctgtgcccg

SEQ ID NO: 274718 - DNA, 20 bp, Artificial Sequence
  Description of Artificial Sequence: Synthetic oligonucleotide
ggcggctgcgctgtgcccgt

SEQ ID NO: 274719 - DNA, 20 bp, Artificial Sequence
  Description of Artificial Sequence: Synthetic oligonucleotide
gcggctgcgctgtgcccggt

SEQ ID NO: 274720 - DNA, 20 bp, Artificial Sequence
  Description of Artificial Sequence: Synthetic oligonucleotide
cggctgcgctgtgcccgggt

SEQ ID NO: 274721 - DNA, 20 bp, Artificial Sequence
  Description of Artificial Sequence: Synthetic oligonucleotide
ggctgcgctgtgcccggggt

SEQ ID NO: 274722 - DNA, 21 bp, Artificial Sequence
  Description of Artificial Sequence: Synthetic oligonucleotide
gctgcgctgtgcccgggggtt

SEQ ID NO: 274723 - DNA, 22 bp, Artificial Sequence
  Description of Artificial Sequence: Synthetic oligonucleotide
ctgcgctgtgcccgggggttgt

SEQ ID NO: 274724 - DNA, 23 bp, Artificial Sequence
  Description of Artificial Sequence: Synthetic oligonucleotide
tgcgctgtgcccgggggttgtgt

SEQ ID NO: 274725 - DNA, 22 bp, Artificial Sequence
  Description of Artificial Sequence: Synthetic oligonucleotide
gcgctgtgcccgggggttgtgt

SEQ ID NO: 274726 - DNA, 22 bp, Artificial Sequence
  Description of Artificial Sequence: Synthetic oligonucleotide
cgctgtgcccgggggttgtgtc

SEQ ID NO: 274727 - DNA, 22 bp, Artificial Sequence
  Description of Artificial Sequence: Synthetic oligonucleotide
gctgtgcccgggggttgtgtcc

SEQ ID NO: 274728 - DNA, 23 bp, Artificial Sequence
  Description of Artificial Sequence: Synthetic oligonucleotide
ctgtgcccgggggttgtgtccct

SEQ ID NO: 274729 - DNA, 26 bp, Artificial Sequence
  Description of Artificial Sequence: Synthetic oligonucleotide
tgtgcccgggggttgtgtccctcaaa

SEQ ID NO: 274730 - DNA, 25 bp, Artificial Sequence
  Description of Artificial Sequence: Synthetic oligonucleotide
gtgcccgggggttgtgtccctcaaa

SEQ ID NO: 274731 - DNA, 25 bp, Artificial Sequence
  Description of Artificial Sequence: Synthetic oligonucleotide
tgcccgggggttgtgtccctcaaac

SEQ ID NO: 274732 - DNA, 24 bp, Artificial Sequence
  Description of Artificial Sequence: Synthetic oligonucleotide
gcccgggggttgtgtccctcaaac

SEQ ID NO: 274733 - DNA, 26 bp, Artificial Sequence
  Description of Artificial Sequence: Synthetic oligonucleotide
cccgggggttgtgtccctcaaacgtt

SEQ ID NO: 274734 - DNA, 26 bp, Artificial Sequence
  Description of Artificial Sequence: Synthetic oligonucleotide
ccgggggttgtgtccctcaaacgttc

SEQ ID NO: 274735 - DNA, 27 bp, Artificial Sequence
  Description of Artificial Sequence: Synthetic oligonucleotide
cgggggttgtgtccctcaaacgttcct

SEQ ID NO: 274736 - DNA, 27 bp, Artificial Sequence
  Description of Artificial Sequence: Synthetic oligonucleotide
gggggttgtgtccctcaaacgttcctg

SEQ ID NO: 274737 - DNA, 27 bp, Artificial Sequence
  Description of Artificial Sequence: Synthetic oligonucleotide
ggggttgtgtccctcaaacgttcctgc

SEQ ID NO: 274738 - DNA, 28 bp, Artificial Sequence
  Description of Artificial Sequence: Synthetic oligonucleotide
gggttgtgtccctcaaacgttcctgcag

SEQ ID NO: 274739 - DNA, 30 bp, Artificial Sequence
  Description of Artificial Sequence: Synthetic oligonucleotide
ggttgtgtccctcaaacgttcctgcagttc

SEQ ID NO: 274740 - DNA, 30 bp, Artificial Sequence
  Description of Artificial Sequence: Synthetic oligonucleotide
gttgtgtccctcaaacgttcctgcagttcc

SEQ ID NO: 274741 - DNA, 32 bp, Artificial Sequence
  Description of Artificial Sequence: Synthetic oligonucleotide
ttgtgtccctcaaacgttcctgcagttccatg

SEQ ID NO: 274742 - DNA, 31 bp, Artificial Sequence
  Description of Artificial Sequence: Synthetic oligonucleotide
tgtgtccctcaaacgttcctgcagttccatg

SEQ ID NO: 274743 - DNA, 30 bp, Artificial Sequence
  Description of Artificial Sequence: Synthetic oligonucleotide
gtgtccctcaaacgttcctgcagttccatg

SEQ ID NO: 274744 - DNA, 30 bp, Artificial Sequence
  Description of Artificial Sequence: Synthetic oligonucleotide
tgtccctcaaacgttcctgcagttccatgg

SEQ ID NO: 274745 - DNA, 29 bp, Artificial Sequence
  Description of Artificial Sequence: Synthetic oligonucleotide
gtccctcaaacgttcctgcagttccatgg

SEQ ID NO: 274746 - DNA, 29 bp, Artificial Sequence
  Description of Artificial Sequence: Synthetic oligonucleotide
tccctcaaacgttcctgcagttccatggc

SEQ ID NO: 274747 - DNA, 28 bp, Artificial Sequence
  Description of Artificial Sequence: Synthetic oligonucleotide
ccctcaaacgttcctgcagttccatggc

SEQ ID NO: 274748 - DNA, 28 bp, Artificial Sequence
  Description of Artificial Sequence: Synthetic oligonucleotide
cctcaaacgttcctgcagttccatggcc

SEQ ID NO: 274749 - DNA, 28 bp, Artificial Sequence
  Description of Artificial Sequence: Synthetic oligonucleotide
ctcaaacgttcctgcagttccatggccg

SEQ ID NO: 274750 - DNA, 28 bp, Artificial Sequence
  Description of Artificial Sequence: Synthetic oligonucleotide
tcaaacgttcctgcagttccatggccgc

SEQ ID NO: 274751 - DNA, 27 bp, Artificial Sequence
  Description of Artificial Sequence: Synthetic oligonucleotide
caaacgttcctgcagttccatggccgc

SEQ ID NO: 274752 - DNA, 28 bp, Artificial Sequence
  Description of Artificial Sequence: Synthetic oligonucleotide
aaacgttcctgcagttccatggccgcag

SEQ ID NO: 274753 - DNA, 27 bp, Artificial Sequence
  Description of Artificial Sequence: Synthetic oligonucleotide
aacgttcctgcagttccatggccgcag

SEQ ID NO: 274754 - DNA, 27 bp, Artificial Sequence
  Description of Artificial Sequence: Synthetic oligonucleotide
acgttcctgcagttccatggccgcaga

SEQ ID NO: 274755 - DNA, 26 bp, Artificial Sequence
  Description of Artificial Sequence: Synthetic oligonucleotide
cgttcctgcagttccatggccgcaga

SEQ ID NO: 274756 - DNA, 27 bp, Artificial Sequence
  Description of Artificial Sequence: Synthetic oligonucleotide
gttcctgcagttccatggccgcagact

SEQ ID NO: 274757 - DNA, 27 bp, Artificial Sequence
  Description of Artificial Sequence: Synthetic oligonucleotide
ttcctgcagttccatggccgcagactg

SEQ ID NO: 274758 - DNA, 26 bp, Artificial Sequence
  Description of Artificial Sequence: Synthetic oligonucleotide
tcctgcagttccatggccgcagactg

SEQ ID NO: 274759 - DNA, 25 bp, Artificial Sequence
  Description of Artificial Sequence: Synthetic oligonucleotide
cctgcagttccatggccgcagactg

SEQ ID NO: 274760 - DNA, 25 bp, Artificial Sequence
  Description of Artificial Sequence: Synthetic oligonucleotide
ctgcagttccatggccgcagactgg

SEQ ID NO: 274761 - DNA, 25 bp, Artificial Sequence
  Description of Artificial Sequence: Synthetic oligonucleotide
tgcagttccatggccgcagactggc

SEQ ID NO: 274762 - DNA, 24 bp, Artificial Sequence
  Description of Artificial Sequence: Synthetic oligonucleotide
gcagttccatggccgcagactggc

SEQ ID NO: 274763 - DNA, 24 bp, Artificial Sequence
  Description of Artificial Sequence: Synthetic oligonucleotide
cagttccatggccgcagactggcg

SEQ ID NO: 274764 - DNA, 25 bp, Artificial Sequence
  Description of Artificial Sequence: Synthetic oligonucleotide
agttccatggccgcagactggcgca

SEQ ID NO: 274765 - DNA, 24 bp, Artificial Sequence
  Description of Artificial Sequence: Synthetic oligonucleotide
gttccatggccgcagactggcgca

SEQ ID NO: 274766 - DNA, 24 bp, Artificial Sequence
  Description of Artificial Sequence: Synthetic oligonucleotide
ttccatggccgcagactggcgcac

SEQ ID NO: 274767 - DNA, 23 bp, Artificial Sequence
  Description of Artificial Sequence: Synthetic oligonucleotide
tccatggccgcagactggcgcac

SEQ ID NO: 274768 - DNA, 22 bp, Artificial Sequence
  Description of Artificial Sequence: Synthetic oligonucleotide
ccatggccgcagactggcgcac

SEQ ID NO: 274769 - DNA, 22 bp, Artificial Sequence
  Description of Artificial Sequence: Synthetic oligonucleotide
catggccgcagactggcgcacg

SEQ ID NO: 274770 - DNA, 22 bp, Artificial Sequence
  Description of Artificial Sequence: Synthetic oligonucleotide
atggccgcagactggcgcacgg

SEQ ID NO: 274771 - DNA, 21 bp, Artificial Sequence
  Description of Artificial Sequence: Synthetic oligonucleotide
tggccgcagactggcgcacgg

SEQ ID NO: 274772 - DNA, 20 bp, Artificial Sequence
  Description of Artificial Sequence: Synthetic oligonucleotide
ggccgcagactggcgcacgg

SEQ ID NO: 274773 - DNA, 21 bp, Artificial Sequence
  Description of Artificial Sequence: Synthetic oligonucleotide
gccgcagactggcgcacggca

SEQ ID NO: 274774 - DNA, 21 bp, Artificial Sequence
  Description of Artificial Sequence: Synthetic oligonucleotide
ccgcagactggcgcacggcac

SEQ ID NO: 274775 - DNA, 22 bp, Artificial Sequence
  Description of Artificial Sequence: Synthetic oligonucleotide
cgcagactggcgcacggcacct

SEQ ID NO: 274776 - DNA, 22 bp, Artificial Sequence
  Description of Artificial Sequence: Synthetic oligonucleotide
gcagactggcgcacggcacctc

SEQ ID NO: 274777 - DNA, 23 bp, Artificial Sequence
  Description of Artificial Sequence: Synthetic oligonucleotide
cagactggcgcacggcacctcca

SEQ ID NO: 274778 - DNA, 24 bp, Artificial Sequence
  Description of Artificial Sequence: Synthetic oligonucleotide
agactggcgcacggcacctccact

SEQ ID NO: 274779 - DNA, 23 bp, Artificial Sequence
  Description of Artificial Sequence: Synthetic oligonucleotide
gactggcgcacggcacctccact

SEQ ID NO: 274780 - DNA, 24 bp, Artificial Sequence
  Description of Artificial Sequence: Synthetic oligonucleotide
actggcgcacggcacctccactct

SEQ ID NO: 274781 - DNA, 23 bp, Artificial Sequence
  Description of Artificial Sequence: Synthetic oligonucleotide
ctggcgcacggcacctccactct

SEQ ID NO: 274782 - DNA, 23 bp, Artificial Sequence
  Description of Artificial Sequence: Synthetic oligonucleotide
tggcgcacggcacctccactctg

SEQ ID NO: 274783 - DNA, 22 bp, Artificial Sequence
  Description of Artificial Sequence: Synthetic oligonucleotide
ggcgcacggcacctccactctg

SEQ ID NO: 274784 - DNA, 22 bp, Artificial Sequence
  Description of Artificial Sequence: Synthetic oligonucleotide
gcgcacggcacctccactctgg

SEQ ID NO: 274785 - DNA, 22 bp, Artificial Sequence
  Description of Artificial Sequence: Synthetic oligonucleotide
cgcacggcacctccactctggg

SEQ ID NO: 274786 - DNA, 24 bp, Artificial Sequence
  Description of Artificial Sequence: Synthetic oligonucleotide
gcacggcacctccactctgggctt

SEQ ID NO: 274787 - DNA, 24 bp, Artificial Sequence
  Description of Artificial Sequence: Synthetic oligonucleotide
cacggcacctccactctgggcttc

SEQ ID NO: 274788 - DNA, 24 bp, Artificial Sequence
  Description of Artificial Sequence: Synthetic oligonucleotide
acggcacctccactctgggcttcc

SEQ ID NO: 274789 - DNA, 23 bp, Artificial Sequence
  Description of Artificial Sequence: Synthetic oligonucleotide
cggcacctccactctgggcttcc

SEQ ID NO: 274790 - DNA, 23 bp, Artificial Sequence
  Description of Artificial Sequence: Synthetic oligonucleotide
ggcacctccactctgggcttccg

SEQ ID NO: 274791 - DNA, 25 bp, Artificial Sequence
  Description of Artificial Sequence: Synthetic oligonucleotide
gcacctccactctgggcttccgctt

SEQ ID NO: 274792 - DNA, 25 bp, Artificial Sequence
  Description of Artificial Sequence: Synthetic oligonucleotide
cacctccactctgggcttccgcttg

SEQ ID NO: 274793 - DNA, 25 bp, Artificial Sequence
  Description of Artificial Sequence: Synthetic oligonucleotide
acctccactctgggcttccgcttgc

SEQ ID NO: 274794 - DNA, 24 bp, Artificial Sequence
  Description of Artificial Sequence: Synthetic oligonucleotide
cctccactctgggcttccgcttgc

SEQ ID NO: 274795 - DNA, 25 bp, Artificial Sequence
  Description of Artificial Sequence: Synthetic oligonucleotide
ctccactctgggcttccgcttgcgt

SEQ ID NO: 274796 - DNA, 27 bp, Artificial Sequence
  Description of Artificial Sequence: Synthetic oligonucleotide
tccactctgggcttccgcttgcgtcat

SEQ ID NO: 274797 - DNA, 26 bp, Artificial Sequence
  Description of Artificial Sequence: Synthetic oligonucleotide
ccactctgggcttccgcttgcgtcat

SEQ ID NO: 274798 - DNA, 26 bp, Artificial Sequence
  Description of Artificial Sequence: Synthetic oligonucleotide
cactctgggcttccgcttgcgtcatg

SEQ ID NO: 274799 - DNA, 27 bp, Artificial Sequence
  Description of Artificial Sequence: Synthetic oligonucleotide
actctgggcttccgcttgcgtcatgga

SEQ ID NO: 274800 - DNA, 26 bp, Artificial Sequence
  Description of Artificial Sequence: Synthetic oligonucleotide
ctctgggcttccgcttgcgtcatgga

SEQ ID NO: 274801 - DNA, 27 bp, Artificial Sequence
  Description of Artificial Sequence: Synthetic oligonucleotide
tctgggcttccgcttgcgtcatggact

SEQ ID NO: 274802 - DNA, 26 bp, Artificial Sequence
  Description of Artificial Sequence: Synthetic oligonucleotide
ctgggcttccgcttgcgtcatggact

SEQ ID NO: 274803 - DNA, 27 bp, Artificial Sequence
  Description of Artificial Sequence: Synthetic oligonucleotide
tgggcttccgcttgcgtcatggactca

SEQ ID NO: 274804 - DNA, 27 bp, Artificial Sequence
  Description of Artificial Sequence: Synthetic oligonucleotide
gggcttccgcttgcgtcatggactcat

SEQ ID NO: 274805 - DNA, 28 bp, Artificial Sequence
  Description of Artificial Sequence: Synthetic oligonucleotide
ggcttccgcttgcgtcatggactcattg

SEQ ID NO: 274806 - DNA, 28 bp, Artificial Sequence
  Description of Artificial Sequence: Synthetic oligonucleotide
gcttccgcttgcgtcatggactcattgc

SEQ ID NO: 274807 - DNA, 29 bp, Artificial Sequence
  Description of Artificial Sequence: Synthetic oligonucleotide
cttccgcttgcgtcatggactcattgctg

SEQ ID NO: 274808 - DNA, 29 bp, Artificial Sequence
  Description of Artificial Sequence: Synthetic oligonucleotide
ttccgcttgcgtcatggactcattgctgg

SEQ ID NO: 274809 - DNA, 28 bp, Artificial Sequence
  Description of Artificial Sequence: Synthetic oligonucleotide
tccgcttgcgtcatggactcattgctgg

SEQ ID NO: 274810 - DNA, 27 bp, Artificial Sequence
  Description of Artificial Sequence: Synthetic oligonucleotide
ccgcttgcgtcatggactcattgctgg

SEQ ID NO: 274811 - DNA, 28 bp, Artificial Sequence
  Description of Artificial Sequence: Synthetic oligonucleotide
cgcttgcgtcatggactcattgctggag

SEQ ID NO: 274812 - DNA, 28 bp, Artificial Sequence
  Description of Artificial Sequence: Synthetic oligonucleotide
gcttgcgtcatggactcattgctggagc

SEQ ID NO: 274813 - DNA, 29 bp, Artificial Sequence
  Description of Artificial Sequence: Synthetic oligonucleotide
cttgcgtcatggactcattgctggagctg

SEQ ID NO: 274814 - DNA, 30 bp, Artificial Sequence
  Description of Artificial Sequence: Synthetic oligonucleotide
ttgcgtcatggactcattgctggagctgac

SEQ ID NO: 274815 - DNA, 29 bp, Artificial Sequence
  Description of Artificial Sequence: Synthetic oligonucleotide
tgcgtcatggactcattgctggagctgac

SEQ ID NO: 274816 - DNA, 28 bp, Artificial Sequence
  Description of Artificial Sequence: Synthetic oligonucleotide
gcgtcatggactcattgctggagctgac

SEQ ID NO: 274817 - DNA, 29 bp, Artificial Sequence
  Description of Artificial Sequence: Synthetic oligonucleotide
cgtcatggactcattgctggagctgacac

SEQ ID NO: 274818 - DNA, 29 bp, Artificial Sequence
  Description of Artificial Sequence: Synthetic oligonucleotide
gtcatggactcattgctggagctgacacc

SEQ ID NO: 274819 - DNA, 29 bp, Artificial Sequence
  Description of Artificial Sequence: Synthetic oligonucleotide
tcatggactcattgctggagctgacaccc

SEQ ID NO: 274820 - DNA, 28 bp, Artificial Sequence
  Description of Artificial Sequence: Synthetic oligonucleotide
catggactcattgctggagctgacaccc

SEQ ID NO: 274821 - DNA, 28 bp, Artificial Sequence
  Description of Artificial Sequence: Synthetic oligonucleotide
atggactcattgctggagctgacacccg

SEQ ID NO: 274822 - DNA, 27 bp, Artificial Sequence
  Description of Artificial Sequence: Synthetic oligonucleotide
tggactcattgctggagctgacacccg

SEQ ID NO: 274823 - DNA, 27 bp, Artificial Sequence
  Description of Artificial Sequence: Synthetic oligonucleotide
ggactcattgctggagctgacacccgt

SEQ ID NO: 274824 - DNA, 28 bp, Artificial Sequence
  Description of Artificial Sequence: Synthetic oligonucleotide
gactcattgctggagctgacacccgttc

SEQ ID NO: 274825 - DNA, 28 bp, Artificial Sequence
  Description of Artificial Sequence: Synthetic oligonucleotide
actcattgctggagctgacacccgttcc

SEQ ID NO: 274826 - DNA, 27 bp, Artificial Sequence
  Description of Artificial Sequence: Synthetic oligonucleotide
ctcattgctggagctgacacccgttcc

SEQ ID NO: 274827 - DNA, 28 bp, Artificial Sequence
  Description of Artificial Sequence: Synthetic oligonucleotide
tcattgctggagctgacacccgttcctc

SEQ ID NO: 274828 - DNA, 27 bp, Artificial Sequence
  Description of Artificial Sequence: Synthetic oligonucleotide
cattgctggagctgacacccgttcctc

SEQ ID NO: 274829 - DNA, 27 bp, Artificial Sequence
  Description of Artificial Sequence: Synthetic oligonucleotide
attgctggagctgacacccgttcctcc

SEQ ID NO: 274830 - DNA, 27 bp, Artificial Sequence
  Description of Artificial Sequence: Synthetic oligonucleotide
ttgctggagctgacacccgttcctcca

SEQ ID NO: 274831 - DNA, 26 bp, Artificial Sequence
  Description of Artificial Sequence: Synthetic oligonucleotide
tgctggagctgacacccgttcctcca

SEQ ID NO: 274832 - DNA, 25 bp, Artificial Sequence
  Description of Artificial Sequence: Synthetic oligonucleotide
gctggagctgacacccgttcctcca

SEQ ID NO: 274833 - DNA, 26 bp, Artificial Sequence
  Description of Artificial Sequence: Synthetic oligonucleotide
ctggagctgacacccgttcctccagt

SEQ ID NO: 274834 - DNA, 26 bp, Artificial Sequence
  Description of Artificial Sequence: Synthetic oligonucleotide
tggagctgacacccgttcctccagtg

SEQ ID NO: 274835 - DNA, 25 bp, Artificial Sequence
  Description of Artificial Sequence: Synthetic oligonucleotide
ggagctgacacccgttcctccagtg

SEQ ID NO: 274836 - DNA, 25 bp, Artificial Sequence
  Description of Artificial Sequence: Synthetic oligonucleotide
gagctgacacccgttcctccagtgg

SEQ ID NO: 274837 - DNA, 26 bp, Artificial Sequence
  Description of Artificial Sequence: Synthetic oligonucleotide
agctgacacccgttcctccagtggca

SEQ ID NO: 274838 - DNA, 25 bp, Artificial Sequence
  Description of Artificial Sequence: Synthetic oligonucleotide
gctgacacccgttcctccagtggca

SEQ ID NO: 274839 - DNA, 25 bp, Artificial Sequence
  Description of Artificial Sequence: Synthetic oligonucleotide
ctgacacccgttcctccagtggcag

SEQ ID NO: 274840 - DNA, 27 bp, Artificial Sequence
  Description of Artificial Sequence: Synthetic oligonucleotide
tgacacccgttcctccagtggcagctt

SEQ ID NO: 274841 - DNA, 27 bp, Artificial Sequence
  Description of Artificial Sequence: Synthetic oligonucleotide
gacacccgttcctccagtggcagcttt

SEQ ID NO: 274842 - DNA, 27 bp, Artificial Sequence
  Description of Artificial Sequence: Synthetic oligonucleotide
acacccgttcctccagtggcagctttg

SEQ ID NO: 274843 - DNA, 27 bp, Artificial Sequence
  Description of Artificial Sequence: Synthetic oligonucleotide
cacccgttcctccagtggcagctttgt

SEQ ID NO: 274844 - DNA, 27 bp, Artificial Sequence
  Description of Artificial Sequence: Synthetic oligonucleotide
acccgttcctccagtggcagctttgtg

SEQ ID NO: 274845 - DNA, 26 bp, Artificial Sequence
  Description of Artificial Sequence: Synthetic oligonucleotide
cccgttcctccagtggcagctttgtg

SEQ ID NO: 274846 - DNA, 26 bp, Artificial Sequence
  Description of Artificial Sequence: Synthetic oligonucleotide
ccgttcctccagtggcagctttgtgg

SEQ ID NO: 274847 - DNA, 26 bp, Artificial Sequence
  Description of Artificial Sequence: Synthetic oligonucleotide
cgttcctccagtggcagctttgtggc

SEQ ID NO: 274848 - DNA, 27 bp, Artificial Sequence
  Description of Artificial Sequence: Synthetic oligonucleotide
gttcctccagtggcagctttgtggcgt

SEQ ID NO: 274849 - DNA, 27 bp, Artificial Sequence
  Description of Artificial Sequence: Synthetic oligonucleotide
ttcctccagtggcagctttgtggcgtg

SEQ ID NO: 274850 - DNA, 27 bp, Artificial Sequence
  Description of Artificial Sequence: Synthetic oligonucleotide
tcctccagtggcagctttgtggcgtga

SEQ ID NO: 274851 - DNA, 26 bp, Artificial Sequence
  Description of Artificial Sequence: Synthetic oligonucleotide
cctccagtggcagctttgtggcgtga

SEQ ID NO: 274852 - DNA, 26 bp, Artificial Sequence
  Description of Artificial Sequence: Synthetic oligonucleotide
ctccagtggcagctttgtggcgtgac

SEQ ID NO: 274853 - DNA, 27 bp, Artificial Sequence
  Description of Artificial Sequence: Synthetic oligonucleotide
tccagtggcagctttgtggcgtgacca

SEQ ID NO: 274854 - DNA, 26 bp, Artificial Sequence
  Description of Artificial Sequence: Synthetic oligonucleotide
ccagtggcagctttgtggcgtgacca

SEQ ID NO: 274855 - DNA, 26 bp, Artificial Sequence
  Description of Artificial Sequence: Synthetic oligonucleotide
cagtggcagctttgtggcgtgaccag

SEQ ID NO: 274856 - DNA, 26 bp, Artificial Sequence
  Description of Artificial Sequence: Synthetic oligonucleotide
agtggcagctttgtggcgtgaccagc

SEQ ID NO: 274857 - DNA, 25 bp, Artificial Sequence
  Description of Artificial Sequence: Synthetic oligonucleotide
gtggcagctttgtggcgtgaccagc

SEQ ID NO: 274858 - DNA, 26 bp, Artificial Sequence
  Description of Artificial Sequence: Synthetic oligonucleotide
tggcagctttgtggcgtgaccagcct

SEQ ID NO: 274859 - DNA, 25 bp, Artificial Sequence
  Description of Artificial Sequence: Synthetic oligonucleotide
ggcagctttgtggcgtgaccagcct

SEQ ID NO: 274860 - DNA, 27 bp, Artificial Sequence
  Description of Artificial Sequence: Synthetic oligonucleotide
gcagctttgtggcgtgaccagcctcaa

SEQ ID NO: 274861 - DNA, 27 bp, Artificial Sequence
  Description of Artificial Sequence: Synthetic oligonucleotide
cagctttgtggcgtgaccagcctcaag

SEQ ID NO: 274862 - DNA, 27 bp, Artificial Sequence
  Description of Artificial Sequence: Synthetic oligonucleotide
agctttgtggcgtgaccagcctcaagc

SEQ ID NO: 274863 - DNA, 27 bp, Artificial Sequence
  Description of Artificial Sequence: Synthetic oligonucleotide
gctttgtggcgtgaccagcctcaagca

SEQ ID NO: 274864 - DNA, 28 bp, Artificial Sequence
  Description of Artificial Sequence: Synthetic oligonucleotide
ctttgtggcgtgaccagcctcaagcaag

SEQ ID NO: 274865 - DNA, 28 bp, Artificial Sequence
  Description of Artificial Sequence: Synthetic oligonucleotide
tttgtggcgtgaccagcctcaagcaagg

SEQ ID NO: 274866 - DNA, 27 bp, Artificial Sequence
  Description of Artificial Sequence: Synthetic oligonucleotide
ttgtggcgtgaccagcctcaagcaagg

SEQ ID NO: 274867 - DNA, 27 bp, Artificial Sequence
  Description of Artificial Sequence: Synthetic oligonucleotide
tgtggcgtgaccagcctcaagcaaggt

SEQ ID NO: 274868 - DNA, 26 bp, Artificial Sequence
  Description of Artificial Sequence: Synthetic oligonucleotide
gtggcgtgaccagcctcaagcaaggt

SEQ ID NO: 274869 - DNA, 27 bp, Artificial Sequence
  Description of Artificial Sequence: Synthetic oligonucleotide
tggcgtgaccagcctcaagcaaggtca

SEQ ID NO: 274870 - DNA, 27 bp, Artificial Sequence
  Description of Artificial Sequence: Synthetic oligonucleotide
ggcgtgaccagcctcaagcaaggtcaa

SEQ ID NO: 274871 - DNA, 27 bp, Artificial Sequence
  Description of Artificial Sequence: Synthetic oligonucleotide
gcgtgaccagcctcaagcaaggtcaac

SEQ ID NO: 274872 - DNA, 27 bp, Artificial Sequence
  Description of Artificial Sequence: Synthetic oligonucleotide
cgtgaccagcctcaagcaaggtcaacc

SEQ ID NO: 274873 - DNA, 27 bp, Artificial Sequence
  Description of Artificial Sequence: Synthetic oligonucleotide
gtgaccagcctcaagcaaggtcaaccc

SEQ ID NO: 274874 - DNA, 28 bp, Artificial Sequence
  Description of Artificial Sequence: Synthetic oligonucleotide
tgaccagcctcaagcaaggtcaaccctg

SEQ ID NO: 274875 - DNA, 27 bp, Artificial Sequence
  Description of Artificial Sequence: Synthetic oligonucleotide
gaccagcctcaagcaaggtcaaccctg

SEQ ID NO: 274876 - DNA, 28 bp, Artificial Sequence
  Description of Artificial Sequence: Synthetic oligonucleotide
accagcctcaagcaaggtcaaccctgtg

SEQ ID NO: 274877 - DNA, 27 bp, Artificial Sequence
  Description of Artificial Sequence: Synthetic oligonucleotide
ccagcctcaagcaaggtcaaccctgtg

SEQ ID NO: 274878 - DNA, 27 bp, Artificial Sequence
  Description of Artificial Sequence: Synthetic oligonucleotide
cagcctcaagcaaggtcaaccctgtgc

SEQ ID NO: 274879 - DNA, 28 bp, Artificial Sequence
  Description of Artificial Sequence: Synthetic oligonucleotide
agcctcaagcaaggtcaaccctgtgcag

SEQ ID NO: 274880 - DNA, 27 bp, Artificial Sequence
  Description of Artificial Sequence: Synthetic oligonucleotide
gcctcaagcaaggtcaaccctgtgcag

SEQ ID NO: 274881 - DNA, 27 bp, Artificial Sequence
  Description of Artificial Sequence: Synthetic oligonucleotide
cctcaagcaaggtcaaccctgtgcagc

SEQ ID NO: 274882 - DNA, 28 bp, Artificial Sequence
  Description of Artificial Sequence: Synthetic oligonucleotide
ctcaagcaaggtcaaccctgtgcagcag

SEQ ID NO: 274883 - DNA, 28 bp, Artificial Sequence
  Description of Artificial Sequence: Synthetic oligonucleotide
tcaagcaaggtcaaccctgtgcagcagc

SEQ ID NO: 274884 - DNA, 27 bp, Artificial Sequence
  Description of Artificial Sequence: Synthetic oligonucleotide
caagcaaggtcaaccctgtgcagcagc

SEQ ID NO: 274885 - DNA, 28 bp, Artificial Sequence
  Description of Artificial Sequence: Synthetic oligonucleotide
aagcaaggtcaaccctgtgcagcagcac

SEQ ID NO: 274886 - DNA, 27 bp, Artificial Sequence
  Description of Artificial Sequence: Synthetic oligonucleotide
agcaaggtcaaccctgtgcagcagcac

SEQ ID NO: 274887 - DNA, 26 bp, Artificial Sequence
  Description of Artificial Sequence: Synthetic oligonucleotide
gcaaggtcaaccctgtgcagcagcac

SEQ ID NO: 274888 - DNA, 27 bp, Artificial Sequence
  Description of Artificial Sequence: Synthetic oligonucleotide
caaggtcaaccctgtgcagcagcacct

SEQ ID NO: 274889 - DNA, 27 bp, Artificial Sequence
  Description of Artificial Sequence: Synthetic oligonucleotide
aaggtcaaccctgtgcagcagcacctc

SEQ ID NO: 274890 - DNA, 26 bp, Artificial Sequence
  Description of Artificial Sequence: Synthetic oligonucleotide
aggtcaaccctgtgcagcagcacctc

SEQ ID NO: 274891 - DNA, 25 bp, Artificial Sequence
  Description of Artificial Sequence: Synthetic oligonucleotide
ggtcaaccctgtgcagcagcacctc

SEQ ID NO: 274892 - DNA, 26 bp, Artificial Sequence
  Description of Artificial Sequence: Synthetic oligonucleotide
gtcaaccctgtgcagcagcacctcgt

SEQ ID NO: 274893 - DNA, 26 bp, Artificial Sequence
  Description of Artificial Sequence: Synthetic oligonucleotide
tcaaccctgtgcagcagcacctcgtg

SEQ ID NO: 274894 - DNA, 25 bp, Artificial Sequence
  Description of Artificial Sequence: Synthetic oligonucleotide
caaccctgtgcagcagcacctcgtg

SEQ ID NO: 274895 - DNA, 25 bp, Artificial Sequence
  Description of Artificial Sequence: Synthetic oligonucleotide
aaccctgtgcagcagcacctcgtgg

SEQ ID NO: 274896 - DNA, 24 bp, Artificial Sequence
  Description of Artificial Sequence: Synthetic oligonucleotide
accctgtgcagcagcacctcgtgg

SEQ ID NO: 274897 - DNA, 23 bp, Artificial Sequence
  Description of Artificial Sequence: Synthetic oligonucleotide
ccctgtgcagcagcacctcgtgg

SEQ ID NO: 274898 - DNA, 25 bp, Artificial Sequence
  Description of Artificial Sequence: Synthetic oligonucleotide
cctgtgcagcagcacctcgtgggta

SEQ ID NO: 274899 - DNA, 25 bp, Artificial Sequence
  Description of Artificial Sequence: Synthetic oligonucleotide
ctgtgcagcagcacctcgtgggtac

SEQ ID NO: 274900 - DNA, 26 bp, Artificial Sequence
  Description of Artificial Sequence: Synthetic oligonucleotide
tgtgcagcagcacctcgtgggtacca

SEQ ID NO: 274901 - DNA, 25 bp, Artificial Sequence
  Description of Artificial Sequence: Synthetic oligonucleotide
gtgcagcagcacctcgtgggtacca

SEQ ID NO: 274902 - DNA, 25 bp, Artificial Sequence
  Description of Artificial Sequence: Synthetic oligonucleotide
tgcagcagcacctcgtgggtaccag

SEQ ID NO: 274903 - DNA, 24 bp, Artificial Sequence
  Description of Artificial Sequence: Synthetic oligonucleotide
gcagcagcacctcgtgggtaccag

SEQ ID NO: 274904 - DNA, 25 bp, Artificial Sequence
  Description of Artificial Sequence: Synthetic oligonucleotide
cagcagcacctcgtgggtaccagct

SEQ ID NO: 274905 - DNA, 26 bp, Artificial Sequence
  Description of Artificial Sequence: Synthetic oligonucleotide
agcagcacctcgtgggtaccagctct

SEQ ID NO: 274906 - DNA, 25 bp, Artificial Sequence
  Description of Artificial Sequence: Synthetic oligonucleotide
gcagcacctcgtgggtaccagctct

SEQ ID NO: 274907 - DNA, 25 bp, Artificial Sequence
  Description of Artificial Sequence: Synthetic oligonucleotide
cagcacctcgtgggtaccagctctg

SEQ ID NO: 274908 - DNA, 25 bp, Artificial Sequence
  Description of Artificial Sequence: Synthetic oligonucleotide
agcacctcgtgggtaccagctctgg

SEQ ID NO: 274909 - DNA, 24 bp, Artificial Sequence
  Description of Artificial Sequence: Synthetic oligonucleotide
gcacctcgtgggtaccagctctgg

SEQ ID NO: 274910 - DNA, 25 bp, Artificial Sequence
  Description of Artificial Sequence: Synthetic oligonucleotide
cacctcgtgggtaccagctctggca

SEQ ID NO: 274911 - DNA, 25 bp, Artificial Sequence
  Description of Artificial Sequence: Synthetic oligonucleotide
acctcgtgggtaccagctctggcac

SEQ ID NO: 274912 - DNA, 24 bp, Artificial Sequence
  Description of Artificial Sequence: Synthetic oligonucleotide
cctcgtgggtaccagctctggcac

SEQ ID NO: 274913 - DNA, 25 bp, Artificial Sequence
  Description of Artificial Sequence: Synthetic oligonucleotide
ctcgtgggtaccagctctggcacgt

SEQ ID NO: 274914 - DNA, 26 bp, Artificial Sequence
  Description of Artificial Sequence: Synthetic oligonucleotide
tcgtgggtaccagctctggcacgtct

SEQ ID NO: 274915 - DNA, 25 bp, Artificial Sequence
  Description of Artificial Sequence: Synthetic oligonucleotide
cgtgggtaccagctctggcacgtct

SEQ ID NO: 274916 - DNA, 25 bp, Artificial Sequence
  Description of Artificial Sequence: Synthetic oligonucleotide
gtgggtaccagctctggcacgtctg

SEQ ID NO: 274917 - DNA, 25 bp, Artificial Sequence
  Description of Artificial Sequence: Synthetic oligonucleotide
tgggtaccagctctggcacgtctgc

SEQ ID NO: 274918 - DNA, 24 bp, Artificial Sequence
  Description of Artificial Sequence: Synthetic oligonucleotide
gggtaccagctctggcacgtctgc

SEQ ID NO: 274919 - DNA, 24 bp, Artificial Sequence
  Description of Artificial Sequence: Synthetic oligonucleotide
ggtaccagctctggcacgtctgcc

SEQ ID NO: 274920 - DNA, 25 bp, Artificial Sequence
  Description of Artificial Sequence: Synthetic oligonucleotide
gtaccagctctggcacgtctgccga

SEQ ID NO: 274921 - DNA, 26 bp, Artificial Sequence
  Description of Artificial Sequence: Synthetic oligonucleotide
taccagctctggcacgtctgccgaca

SEQ ID NO: 274922 - DNA, 25 bp, Artificial Sequence
  Description of Artificial Sequence: Synthetic oligonucleotide
accagctctggcacgtctgccgaca

SEQ ID NO: 274923 - DNA, 24 bp, Artificial Sequence
  Description of Artificial Sequence: Synthetic oligonucleotide
ccagctctggcacgtctgccgaca

SEQ ID NO: 274924 - DNA, 25 bp, Artificial Sequence
  Description of Artificial Sequence: Synthetic oligonucleotide
cagctctggcacgtctgccgacagt

SEQ ID NO: 274925 - DNA, 25 bp, Artificial Sequence
  Description of Artificial Sequence: Synthetic oligonucleotide
agctctggcacgtctgccgacagtg

SEQ ID NO: 274926 - DNA, 24 bp, Artificial Sequence
  Description of Artificial Sequence: Synthetic oligonucleotide
gctctggcacgtctgccgacagtg

SEQ ID NO: 274927 - DNA, 26 bp, Artificial Sequence
  Description of Artificial Sequence: Synthetic oligonucleotide
ctctggcacgtctgccgacagtgcta

SEQ ID NO: 274928 - DNA, 26 bp, Artificial Sequence
  Description of Artificial Sequence: Synthetic oligonucleotide
tctggcacgtctgccgacagtgctac

SEQ ID NO: 274929 - DNA, 25 bp, Artificial Sequence
  Description of Artificial Sequence: Synthetic oligonucleotide
ctggcacgtctgccgacagtgctac

SEQ ID NO: 274930 - DNA, 26 bp, Artificial Sequence
  Description of Artificial Sequence: Synthetic oligonucleotide
tggcacgtctgccgacagtgctacct

SEQ ID NO: 274931 - DNA, 25 bp, Artificial Sequence
  Description of Artificial Sequence: Synthetic oligonucleotide
ggcacgtctgccgacagtgctacct

SEQ ID NO: 274932 - DNA, 25 bp, Artificial Sequence
  Description of Artificial Sequence: Synthetic oligonucleotide
gcacgtctgccgacagtgctacctc

SEQ ID NO: 274933 - DNA, 27 bp, Artificial Sequence
  Description of Artificial Sequence: Synthetic oligonucleotide
cacgtctgccgacagtgctacctcgta

SEQ ID NO: 274934 - DNA, 28 bp, Artificial Sequence
  Description of Artificial Sequence: Synthetic oligonucleotide
acgtctgccgacagtgctacctcgtatc

SEQ ID NO: 274935 - DNA, 27 bp, Artificial Sequence
  Description of Artificial Sequence: Synthetic oligonucleotide
cgtctgccgacagtgctacctcgtatc

SEQ ID NO: 274936 - DNA, 27 bp, Artificial Sequence
  Description of Artificial Sequence: Synthetic oligonucleotide
gtctgccgacagtgctacctcgtatcg

SEQ ID NO: 274937 - DNA, 27 bp, Artificial Sequence
  Description of Artificial Sequence: Synthetic oligonucleotide
tctgccgacagtgctacctcgtatcgg

SEQ ID NO: 274938 - DNA, 26 bp, Artificial Sequence
  Description of Artificial Sequence: Synthetic oligonucleotide
ctgccgacagtgctacctcgtatcgg

SEQ ID NO: 274939 - DNA, 27 bp, Artificial Sequence
  Description of Artificial Sequence: Synthetic oligonucleotide
tgccgacagtgctacctcgtatcgggt

SEQ ID NO: 274940 - DNA, 27 bp, Artificial Sequence
  Description of Artificial Sequence: Synthetic oligonucleotide
gccgacagtgctacctcgtatcgggtt

SEQ ID NO: 274941 - DNA, 30 bp, Artificial Sequence
  Description of Artificial Sequence: Synthetic oligonucleotide
ccgacagtgctacctcgtatcgggttttac

SEQ ID NO: 274942 - DNA, 31 bp, Artificial Sequence
  Description of Artificial Sequence: Synthetic oligonucleotide
cgacagtgctacctcgtatcgggttttacag

SEQ ID NO: 274943 - DNA, 31 bp, Artificial Sequence
  Description of Artificial Sequence: Synthetic oligonucleotide
gacagtgctacctcgtatcgggttttacagc

SEQ ID NO: 274944 - DNA, 31 bp, Artificial Sequence
  Description of Artificial Sequence: Synthetic oligonucleotide
acagtgctacctcgtatcgggttttacagcg

SEQ ID NO: 274945 - DNA, 30 bp, Artificial Sequence
  Description of Artificial Sequence: Synthetic oligonucleotide
cagtgctacctcgtatcgggttttacagcg

SEQ ID NO: 274946 - DNA, 30 bp, Artificial Sequence
  Description of Artificial Sequence: Synthetic oligonucleotide
agtgctacctcgtatcgggttttacagcgg

SEQ ID NO: 274947 - DNA, 29 bp, Artificial Sequence
  Description of Artificial Sequence: Synthetic oligonucleotide
gtgctacctcgtatcgggttttacagcgg

SEQ ID NO: 274948 - DNA, 29 bp, Artificial Sequence
  Description of Artificial Sequence: Synthetic oligonucleotide
tgctacctcgtatcgggttttacagcggc

SEQ ID NO: 274949 - DNA, 28 bp, Artificial Sequence
  Description of Artificial Sequence: Synthetic oligonucleotide
gctacctcgtatcgggttttacagcggc

SEQ ID NO: 274950 - DNA, 29 bp, Artificial Sequence
  Description of Artificial Sequence: Synthetic oligonucleotide
ctacctcgtatcgggttttacagcggcag

SEQ ID NO: 274951 - DNA, 29 bp, Artificial Sequence
  Description of Artificial Sequence: Synthetic oligonucleotide
tacctcgtatcgggttttacagcggcagc

SEQ ID NO: 274952 - DNA, 28 bp, Artificial Sequence
  Description of Artificial Sequence: Synthetic oligonucleotide
acctcgtatcgggttttacagcggcagc

SEQ ID NO: 274953 - DNA, 27 bp, Artificial Sequence
  Description of Artificial Sequence: Synthetic oligonucleotide
cctcgtatcgggttttacagcggcagc

SEQ ID NO: 274954 - DNA, 28 bp, Artificial Sequence
  Description of Artificial Sequence: Synthetic oligonucleotide
ctcgtatcgggttttacagcggcagctg

SEQ ID NO: 274955 - DNA, 28 bp, Artificial Sequence
  Description of Artificial Sequence: Synthetic oligonucleotide
tcgtatcgggttttacagcggcagctgc

SEQ ID NO: 274956 - DNA, 27 bp, Artificial Sequence
  Description of Artificial Sequence: Synthetic oligonucleotide
cgtatcgggttttacagcggcagctgc

SEQ ID NO: 274957 - DNA, 27 bp, Artificial Sequence
  Description of Artificial Sequence: Synthetic oligonucleotide
gtatcgggttttacagcggcagctgcg

SEQ ID NO: 274958 - DNA, 27 bp, Artificial Sequence
  Description of Artificial Sequence: Synthetic oligonucleotide
tatcgggttttacagcggcagctgcgg

SEQ ID NO: 274959 - DNA, 26 bp, Artificial Sequence
  Description of Artificial Sequence: Synthetic oligonucleotide
atcgggttttacagcggcagctgcgg

SEQ ID NO: 274960 - DNA, 25 bp, Artificial Sequence
  Description of Artificial Sequence: Synthetic oligonucleotide
tcgggttttacagcggcagctgcgg

SEQ ID NO: 274961 - DNA, 24 bp, Artificial Sequence
  Description of Artificial Sequence: Synthetic oligonucleotide
cgggttttacagcggcagctgcgg

SEQ ID NO: 274962 - DNA, 26 bp, Artificial Sequence
  Description of Artificial Sequence: Synthetic oligonucleotide
gggttttacagcggcagctgcggcat

SEQ ID NO: 274963 - DNA, 26 bp, Artificial Sequence
  Description of Artificial Sequence: Synthetic oligonucleotide
ggttttacagcggcagctgcggcatc

SEQ ID NO: 274964 - DNA, 26 bp, Artificial Sequence
  Description of Artificial Sequence: Synthetic oligonucleotide
gttttacagcggcagctgcggcatcg

SEQ ID NO: 274965 - DNA, 26 bp, Artificial Sequence
  Description of Artificial Sequence: Synthetic oligonucleotide
ttttacagcggcagctgcggcatcgg

SEQ ID NO: 274966 - DNA, 25 bp, Artificial Sequence
  Description of Artificial Sequence: Synthetic oligonucleotide
tttacagcggcagctgcggcatcgg

SEQ ID NO: 274967 - DNA, 24 bp, Artificial Sequence
  Description of Artificial Sequence: Synthetic oligonucleotide
ttacagcggcagctgcggcatcgg

SEQ ID NO: 274968 - DNA, 23 bp, Artificial Sequence
  Description of Artificial Sequence: Synthetic oligonucleotide
tacagcggcagctgcggcatcgg

SEQ ID NO: 274969 - DNA, 22 bp, Artificial Sequence
  Description of Artificial Sequence: Synthetic oligonucleotide
acagcggcagctgcggcatcgg

SEQ ID NO: 274970 - DNA, 21 bp, Artificial Sequence
  Description of Artificial Sequence: Synthetic oligonucleotide
cagcggcagctgcggcatcgg

SEQ ID NO: 274971 - DNA, 23 bp, Artificial Sequence
  Description of Artificial Sequence: Synthetic oligonucleotide
agcggcagctgcggcatcgggaa

SEQ ID NO: 274972 - DNA, 22 bp, Artificial Sequence
  Description of Artificial Sequence: Synthetic oligonucleotide
gcggcagctgcggcatcgggaa

SEQ ID NO: 274973 - DNA, 23 bp, Artificial Sequence
  Description of Artificial Sequence: Synthetic oligonucleotide
cggcagctgcggcatcgggaact

SEQ ID NO: 274974 - DNA, 24 bp, Artificial Sequence
  Description of Artificial Sequence: Synthetic oligonucleotide
ggcagctgcggcatcgggaactca

SEQ ID NO: 274975 - DNA, 24 bp, Artificial Sequence
  Description of Artificial Sequence: Synthetic oligonucleotide
gcagctgcggcatcgggaactcag

SEQ ID NO: 274976 - DNA, 24 bp, Artificial Sequence
  Description of Artificial Sequence: Synthetic oligonucleotide
cagctgcggcatcgggaactcagg

SEQ ID NO: 274977 - DNA, 25 bp, Artificial Sequence
  Description of Artificial Sequence: Synthetic oligonucleotide
agctgcggcatcgggaactcaggga

SEQ ID NO: 274978 - DNA, 24 bp, Artificial Sequence
  Description of Artificial Sequence: Synthetic oligonucleotide
gctgcggcatcgggaactcaggga

SEQ ID NO: 274979 - DNA, 24 bp, Artificial Sequence
  Description of Artificial Sequence: Synthetic oligonucleotide
ctgcggcatcgggaactcagggag

SEQ ID NO: 274980 - DNA, 24 bp, Artificial Sequence
  Description of Artificial Sequence: Synthetic oligonucleotide
tgcggcatcgggaactcagggagg

SEQ ID NO: 274981 - DNA, 23 bp, Artificial Sequence
  Description of Artificial Sequence: Synthetic oligonucleotide
gcggcatcgggaactcagggagg

SEQ ID NO: 274982 - DNA, 24 bp, Artificial Sequence
  Description of Artificial Sequence: Synthetic oligonucleotide
cggcatcgggaactcagggagggt

SEQ ID NO: 274983 - DNA, 25 bp, Artificial Sequence
  Description of Artificial Sequence: Synthetic oligonucleotide
ggcatcgggaactcagggagggtga

SEQ ID NO: 274984 - DNA, 25 bp, Artificial Sequence
  Description of Artificial Sequence: Synthetic oligonucleotide
gcatcgggaactcagggagggtgag

SEQ ID NO: 274985 - DNA, 26 bp, Artificial Sequence
  Description of Artificial Sequence: Synthetic oligonucleotide
catcgggaactcagggagggtgagct

SEQ ID NO: 274986 - DNA, 26 bp, Artificial Sequence
  Description of Artificial Sequence: Synthetic oligonucleotide
atcgggaactcagggagggtgagctg

SEQ ID NO: 274987 - DNA, 25 bp, Artificial Sequence
  Description of Artificial Sequence: Synthetic oligonucleotide
tcgggaactcagggagggtgagctg

SEQ ID NO: 274988 - DNA, 24 bp, Artificial Sequence
  Description of Artificial Sequence: Synthetic oligonucleotide
cgggaactcagggagggtgagctg

SEQ ID NO: 274989 - DNA, 24 bp, Artificial Sequence
  Description of Artificial Sequence: Synthetic oligonucleotide
gggaactcagggagggtgagctgc

SEQ ID NO: 274990 - DNA, 24 bp, Artificial Sequence
  Description of Artificial Sequence: Synthetic oligonucleotide
ggaactcagggagggtgagctgcc

SEQ ID NO: 274991 - DNA, 25 bp, Artificial Sequence
  Description of Artificial Sequence: Synthetic oligonucleotide
gaactcagggagggtgagctgccca

SEQ ID NO: 274992 - DNA, 26 bp, Artificial Sequence
  Description of Artificial Sequence: Synthetic oligonucleotide
aactcagggagggtgagctgcccact

SEQ ID NO: 274993 - DNA, 25 bp, Artificial Sequence
  Description of Artificial Sequence: Synthetic oligonucleotide
actcagggagggtgagctgcccact

SEQ ID NO: 274994 - DNA, 24 bp, Artificial Sequence
  Description of Artificial Sequence: Synthetic oligonucleotide
ctcagggagggtgagctgcccact

SEQ ID NO: 274995 - DNA, 25 bp, Artificial Sequence
  Description of Artificial Sequence: Synthetic oligonucleotide
tcagggagggtgagctgcccactgt

SEQ ID NO: 274996 - DNA, 24 bp, Artificial Sequence
  Description of Artificial Sequence: Synthetic oligonucleotide
cagggagggtgagctgcccactgt

SEQ ID NO: 274997 - DNA, 24 bp, Artificial Sequence
  Description of Artificial Sequence: Synthetic oligonucleotide
agggagggtgagctgcccactgtg

SEQ ID NO: 274998 - DNA, 23 bp, Artificial Sequence
  Description of Artificial Sequence: Synthetic oligonucleotide
gggagggtgagctgcccactgtg

SEQ ID NO: 274999 - DNA, 23 bp, Artificial Sequence
  Description of Artificial Sequence: Synthetic oligonucleotide
ggagggtgagctgcccactgtgg

SEQ ID NO: 275000 - DNA, 23 bp, Artificial Sequence
  Description of Artificial Sequence: Synthetic oligonucleotide
gagggtgagctgcccactgtggc

SEQ ID NO: 275001 - DNA, 24 bp, Artificial Sequence
  Description of Artificial Sequence: Synthetic oligonucleotide
agggtgagctgcccactgtggcca

SEQ ID NO: 275002 - DNA, 23 bp, Artificial Sequence
  Description of Artificial Sequence: Synthetic oligonucleotide
gggtgagctgcccactgtggcca

SEQ ID NO: 275003 - DNA, 24 bp, Artificial Sequence
  Description of Artificial Sequence: Synthetic oligonucleotide
ggtgagctgcccactgtggccaga

SEQ ID NO: 275004 - DNA, 24 bp, Artificial Sequence
  Description of Artificial Sequence: Synthetic oligonucleotide
gtgagctgcccactgtggccagag

SEQ ID NO: 275005 - DNA, 25 bp, Artificial Sequence
  Description of Artificial Sequence: Synthetic oligonucleotide
tgagctgcccactgtggccagagct

SEQ ID NO: 275006 - DNA, 24 bp, Artificial Sequence
  Description of Artificial Sequence: Synthetic oligonucleotide
gagctgcccactgtggccagagct

SEQ ID NO: 275007 - DNA, 24 bp, Artificial Sequence
  Description of Artificial Sequence: Synthetic oligonucleotide
agctgcccactgtggccagagctg

SEQ ID NO: 275008 - DNA, 23 bp, Artificial Sequence
  Description of Artificial Sequence: Synthetic oligonucleotide
gctgcccactgtggccagagctg

SEQ ID NO: 275009 - DNA, 23 bp, Artificial Sequence
  Description of Artificial Sequence: Synthetic oligonucleotide
ctgcccactgtggccagagctgc

SEQ ID NO: 275010 - DNA, 25 bp, Artificial Sequence
  Description of Artificial Sequence: Synthetic oligonucleotide
tgcccactgtggccagagctgccaa

SEQ ID NO: 275011 - DNA, 24 bp, Artificial Sequence
  Description of Artificial Sequence: Synthetic oligonucleotide
gcccactgtggccagagctgccaa

SEQ ID NO: 275012 - DNA, 24 bp, Artificial Sequence
  Description of Artificial Sequence: Synthetic oligonucleotide
cccactgtggccagagctgccaag

SEQ ID NO: 275013 - DNA, 25 bp, Artificial Sequence
  Description of Artificial Sequence: Synthetic oligonucleotide
ccactgtggccagagctgccaaggt

SEQ ID NO: 275014 - DNA, 27 bp, Artificial Sequence
  Description of Artificial Sequence: Synthetic oligonucleotide
cactgtggccagagctgccaaggtctt

SEQ ID NO: 275015 - DNA, 27 bp, Artificial Sequence
  Description of Artificial Sequence: Synthetic oligonucleotide
actgtggccagagctgccaaggtcttg

SEQ ID NO: 275016 - DNA, 27 bp, Artificial Sequence
  Description of Artificial Sequence: Synthetic oligonucleotide
ctgtggccagagctgccaaggtcttgt

SEQ ID NO: 275017 - DNA, 27 bp, Artificial Sequence
  Description of Artificial Sequence: Synthetic oligonucleotide
tgtggccagagctgccaaggtcttgtc

SEQ ID NO: 275018 - DNA, 27 bp, Artificial Sequence
  Description of Artificial Sequence: Synthetic oligonucleotide
gtggccagagctgccaaggtcttgtca

SEQ ID NO: 275019 - DNA, 27 bp, Artificial Sequence
  Description of Artificial Sequence: Synthetic oligonucleotide
tggccagagctgccaaggtcttgtcag

SEQ ID NO: 275020 - DNA, 26 bp, Artificial Sequence
  Description of Artificial Sequence: Synthetic oligonucleotide
ggccagagctgccaaggtcttgtcag

SEQ ID NO: 275021 - DNA, 26 bp, Artificial Sequence
  Description of Artificial Sequence: Synthetic oligonucleotide
gccagagctgccaaggtcttgtcagg

SEQ ID NO: 275022 - DNA, 27 bp, Artificial Sequence
  Description of Artificial Sequence: Synthetic oligonucleotide
ccagagctgccaaggtcttgtcaggca

SEQ ID NO: 275023 - DNA, 28 bp, Artificial Sequence
  Description of Artificial Sequence: Synthetic oligonucleotide
cagagctgccaaggtcttgtcaggcatg

SEQ ID NO: 275024 - DNA, 30 bp, Artificial Sequence
  Description of Artificial Sequence: Synthetic oligonucleotide
agagctgccaaggtcttgtcaggcatgatg

SEQ ID NO: 275025 - DNA, 29 bp, Artificial Sequence
  Description of Artificial Sequence: Synthetic oligonucleotide
gagctgccaaggtcttgtcaggcatgatg

SEQ ID NO: 275026 - DNA, 30 bp, Artificial Sequence
  Description of Artificial Sequence: Synthetic oligonucleotide
agctgccaaggtcttgtcaggcatgatgtc

SEQ ID NO: 275027 - DNA, 29 bp, Artificial Sequence
  Description of Artificial Sequence: Synthetic oligonucleotide
gctgccaaggtcttgtcaggcatgatgtc

SEQ ID NO: 275028 - DNA, 30 bp, Artificial Sequence
  Description of Artificial Sequence: Synthetic oligonucleotide
ctgccaaggtcttgtcaggcatgatgtcac

SEQ ID NO: 275029 - DNA, 34 bp, Artificial Sequence
  Description of Artificial Sequence: Synthetic oligonucleotide
tgccaaggtcttgtcaggcatgatgtcacaatac

SEQ ID NO: 275030 - DNA, 33 bp, Artificial Sequence
  Description of Artificial Sequence: Synthetic oligonucleotide
gccaaggtcttgtcaggcatgatgtcacaatac

SEQ ID NO: 275031 - DNA, 33 bp, Artificial Sequence
  Description of Artificial Sequence: Synthetic oligonucleotide
ccaaggtcttgtcaggcatgatgtcacaatacc

SEQ ID NO: 275032 - DNA, 33 bp, Artificial Sequence
  Description of Artificial Sequence: Synthetic oligonucleotide
caaggtcttgtcaggcatgatgtcacaataccg

SEQ ID NO: 275033 - DNA, 33 bp, Artificial Sequence
  Description of Artificial Sequence: Synthetic oligonucleotide
aaggtcttgtcaggcatgatgtcacaataccgg

SEQ ID NO: 275034 - DNA, 32 bp, Artificial Sequence
  Description of Artificial Sequence: Synthetic oligonucleotide
aggtcttgtcaggcatgatgtcacaataccgg

SEQ ID NO: 275035 - DNA, 31 bp, Artificial Sequence
  Description of Artificial Sequence: Synthetic oligonucleotide
ggtcttgtcaggcatgatgtcacaataccgg

SEQ ID NO: 275036 - DNA, 31 bp, Artificial Sequence
  Description of Artificial Sequence: Synthetic oligonucleotide
gtcttgtcaggcatgatgtcacaataccggc

SEQ ID NO: 275037 - DNA, 31 bp, Artificial Sequence
  Description of Artificial Sequence: Synthetic oligonucleotide
tcttgtcaggcatgatgtcacaataccggcg

SEQ ID NO: 275038 - DNA, 30 bp, Artificial Sequence
  Description of Artificial Sequence: Synthetic oligonucleotide
cttgtcaggcatgatgtcacaataccggcg

SEQ ID NO: 275039 - DNA, 31 bp, Artificial Sequence
  Description of Artificial Sequence: Synthetic oligonucleotide
ttgtcaggcatgatgtcacaataccggcgac

SEQ ID NO: 275040 - DNA, 30 bp, Artificial Sequence
  Description of Artificial Sequence: Synthetic oligonucleotide
tgtcaggcatgatgtcacaataccggcgac

SEQ ID NO: 275041 - DNA, 29 bp, Artificial Sequence
  Description of Artificial Sequence: Synthetic oligonucleotide
gtcaggcatgatgtcacaataccggcgac

SEQ ID NO: 275042 - DNA, 30 bp, Artificial Sequence
  Description of Artificial Sequence: Synthetic oligonucleotide
tcaggcatgatgtcacaataccggcgactg

SEQ ID NO: 275043 - DNA, 29 bp, Artificial Sequence
  Description of Artificial Sequence: Synthetic oligonucleotide
caggcatgatgtcacaataccggcgactg

SEQ ID NO: 275044 - DNA, 29 bp, Artificial Sequence
  Description of Artificial Sequence: Synthetic oligonucleotide
aggcatgatgtcacaataccggcgactgg

SEQ ID NO: 275045 - DNA, 28 bp, Artificial Sequence
  Description of Artificial Sequence: Synthetic oligonucleotide
ggcatgatgtcacaataccggcgactgg

SEQ ID NO: 275046 - DNA, 30 bp, Artificial Sequence
  Description of Artificial Sequence: Synthetic oligonucleotide
gcatgatgtcacaataccggcgactggatc

SEQ ID NO: 275047 - DNA, 31 bp, Artificial Sequence
  Description of Artificial Sequence: Synthetic oligonucleotide
catgatgtcacaataccggcgactggatcac

SEQ ID NO: 275048 - DNA, 32 bp, Artificial Sequence
  Description of Artificial Sequence: Synthetic oligonucleotide
atgatgtcacaataccggcgactggatcactg

SEQ ID NO: 275049 - DNA, 31 bp, Artificial Sequence
  Description of Artificial Sequence: Synthetic oligonucleotide
tgatgtcacaataccggcgactggatcactg

SEQ ID NO: 275050 - DNA, 30 bp, Artificial Sequence
  Description of Artificial Sequence: Synthetic oligonucleotide
gatgtcacaataccggcgactggatcactg

SEQ ID NO: 275051 - DNA, 31 bp, Artificial Sequence
  Description of Artificial Sequence: Synthetic oligonucleotide
atgtcacaataccggcgactggatcactgtg

SEQ ID NO: 275052 - DNA, 30 bp, Artificial Sequence
  Description of Artificial Sequence: Synthetic oligonucleotide
tgtcacaataccggcgactggatcactgtg

SEQ ID NO: 275053 - DNA, 29 bp, Artificial Sequence
  Description of Artificial Sequence: Synthetic oligonucleotide
gtcacaataccggcgactggatcactgtg

SEQ ID NO: 275054 - DNA, 30 bp, Artificial Sequence
  Description of Artificial Sequence: Synthetic oligonucleotide
tcacaataccggcgactggatcactgtgtg

SEQ ID NO: 275055 - DNA, 29 bp, Artificial Sequence
  Description of Artificial Sequence: Synthetic oligonucleotide
cacaataccggcgactggatcactgtgtg

SEQ ID NO: 275056 - DNA, 29 bp, Artificial Sequence
  Description of Artificial Sequence: Synthetic oligonucleotide
acaataccggcgactggatcactgtgtgg

SEQ ID NO: 275057 - DNA, 28 bp, Artificial Sequence
  Description of Artificial Sequence: Synthetic oligonucleotide
caataccggcgactggatcactgtgtgg

SEQ ID NO: 275058 - DNA, 28 bp, Artificial Sequence
  Description of Artificial Sequence: Synthetic oligonucleotide
aataccggcgactggatcactgtgtggc

SEQ ID NO: 275059 - DNA, 27 bp, Artificial Sequence
  Description of Artificial Sequence: Synthetic oligonucleotide
ataccggcgactggatcactgtgtggc

SEQ ID NO: 275060 - DNA, 26 bp, Artificial Sequence
  Description of Artificial Sequence: Synthetic oligonucleotide
taccggcgactggatcactgtgtggc

SEQ ID NO: 275061 - DNA, 25 bp, Artificial Sequence
  Description of Artificial Sequence: Synthetic oligonucleotide
accggcgactggatcactgtgtggc

SEQ ID NO: 275062 - DNA, 24 bp, Artificial Sequence
  Description of Artificial Sequence: Synthetic oligonucleotide
ccggcgactggatcactgtgtggc

SEQ ID NO: 275063 - DNA, 25 bp, Artificial Sequence
  Description of Artificial Sequence: Synthetic oligonucleotide
cggcgactggatcactgtgtggcga

SEQ ID NO: 275064 - DNA, 26 bp, Artificial Sequence
  Description of Artificial Sequence: Synthetic oligonucleotide
ggcgactggatcactgtgtggcgact

SEQ ID NO: 275065 - DNA, 26 bp, Artificial Sequence
  Description of Artificial Sequence: Synthetic oligonucleotide
gcgactggatcactgtgtggcgactg

SEQ ID NO: 275066 - DNA, 26 bp, Artificial Sequence
  Description of Artificial Sequence: Synthetic oligonucleotide
cgactggatcactgtgtggcgactgc

SEQ ID NO: 275067 - DNA, 26 bp, Artificial Sequence
  Description of Artificial Sequence: Synthetic oligonucleotide
gactggatcactgtgtggcgactgcc

SEQ ID NO: 275068 - DNA, 27 bp, Artificial Sequence
  Description of Artificial Sequence: Synthetic oligonucleotide
actggatcactgtgtggcgactgccct

SEQ ID NO: 275069 - DNA, 26 bp, Artificial Sequence
  Description of Artificial Sequence: Synthetic oligonucleotide
ctggatcactgtgtggcgactgccct

SEQ ID NO: 275070 - DNA, 27 bp, Artificial Sequence
  Description of Artificial Sequence: Synthetic oligonucleotide
tggatcactgtgtggcgactgccctca

SEQ ID NO: 275071 - DNA, 26 bp, Artificial Sequence
  Description of Artificial Sequence: Synthetic oligonucleotide
ggatcactgtgtggcgactgccctca

SEQ ID NO: 275072 - DNA, 26 bp, Artificial Sequence
  Description of Artificial Sequence: Synthetic oligonucleotide
gatcactgtgtggcgactgccctcag

SEQ ID NO: 275073 - DNA, 26 bp, Artificial Sequence
  Description of Artificial Sequence: Synthetic oligonucleotide
atcactgtgtggcgactgccctcagc

SEQ ID NO: 275074 - DNA, 25 bp, Artificial Sequence
  Description of Artificial Sequence: Synthetic oligonucleotide
tcactgtgtggcgactgccctcagc

SEQ ID NO: 275075 - DNA, 24 bp, Artificial Sequence
  Description of Artificial Sequence: Synthetic oligonucleotide
cactgtgtggcgactgccctcagc

SEQ ID NO: 275076 - DNA, 24 bp, Artificial Sequence
  Description of Artificial Sequence: Synthetic oligonucleotide
actgtgtggcgactgccctcagcg

SEQ ID NO: 275077 - DNA, 23 bp, Artificial Sequence
  Description of Artificial Sequence: Synthetic oligonucleotide
ctgtgtggcgactgccctcagcg

SEQ ID NO: 275078 - DNA, 23 bp, Artificial Sequence
  Description of Artificial Sequence: Synthetic oligonucleotide
tgtgtggcgactgccctcagcgg

SEQ ID NO: 275079 - DNA, 22 bp, Artificial Sequence
  Description of Artificial Sequence: Synthetic oligonucleotide
gtgtggcgactgccctcagcgg

SEQ ID NO: 275080 - DNA, 23 bp, Artificial Sequence
  Description of Artificial Sequence: Synthetic oligonucleotide
tgtggcgactgccctcagcggct

SEQ ID NO: 275081 - DNA, 22 bp, Artificial Sequence
  Description of Artificial Sequence: Synthetic oligonucleotide
gtggcgactgccctcagcggct

SEQ ID NO: 275082 - DNA, 22 bp, Artificial Sequence
  Description of Artificial Sequence: Synthetic oligonucleotide
tggcgactgccctcagcggctg

SEQ ID NO: 275083 - DNA, 21 bp, Artificial Sequence
  Description of Artificial Sequence: Synthetic oligonucleotide
ggcgactgccctcagcggctg

SEQ ID NO: 275084 - DNA, 21 bp, Artificial Sequence
  Description of Artificial Sequence: Synthetic oligonucleotide
gcgactgccctcagcggctgg

SEQ ID NO: 275085 - DNA, 22 bp, Artificial Sequence
  Description of Artificial Sequence: Synthetic oligonucleotide
cgactgccctcagcggctgggt

SEQ ID NO: 275086 - DNA, 22 bp, Artificial Sequence
  Description of Artificial Sequence: Synthetic oligonucleotide
gactgccctcagcggctgggtc

SEQ ID NO: 275087 - DNA, 22 bp, Artificial Sequence
  Description of Artificial Sequence: Synthetic oligonucleotide
actgccctcagcggctgggtcc

SEQ ID NO: 275088 - DNA, 21 bp, Artificial Sequence
  Description of Artificial Sequence: Synthetic oligonucleotide
ctgccctcagcggctgggtcc

SEQ ID NO: 275089 - DNA, 21 bp, Artificial Sequence
  Description of Artificial Sequence: Synthetic oligonucleotide
tgccctcagcggctgggtccg

SEQ ID NO: 275090 - DNA, 20 bp, Artificial Sequence
  Description of Artificial Sequence: Synthetic oligonucleotide
gccctcagcggctgggtccg

SEQ ID NO: 275091 - DNA, 21 bp, Artificial Sequence
  Description of Artificial Sequence: Synthetic oligonucleotide
ccctcagcggctgggtccgct

SEQ ID NO: 275092 - DNA, 22 bp, Artificial Sequence
  Description of Artificial Sequence: Synthetic oligonucleotide
cctcagcggctgggtccgctct

SEQ ID NO: 275093 - DNA, 22 bp, Artificial Sequence
  Description of Artificial Sequence: Synthetic oligonucleotide
ctcagcggctgggtccgctctg

SEQ ID NO: 275094 - DNA, 22 bp, Artificial Sequence
  Description of Artificial Sequence: Synthetic oligonucleotide
tcagcggctgggtccgctctgg

SEQ ID NO: 275095 - DNA, 21 bp, Artificial Sequence
  Description of Artificial Sequence: Synthetic oligonucleotide
cagcggctgggtccgctctgg

SEQ ID NO: 275096 - DNA, 21 bp, Artificial Sequence
  Description of Artificial Sequence: Synthetic oligonucleotide
agcggctgggtccgctctggg

SEQ ID NO: 275097 - DNA, 20 bp, Artificial Sequence
  Description of Artificial Sequence: Synthetic oligonucleotide
gcggctgggtccgctctggg

SEQ ID NO: 275098 - DNA, 20 bp, Artificial Sequence
  Description of Artificial Sequence: Synthetic oligonucleotide
cggctgggtccgctctgggc

SEQ ID NO: 275099 - DNA, 21 bp, Artificial Sequence
  Description of Artificial Sequence: Synthetic oligonucleotide
ggctgggtccgctctgggcct

SEQ ID NO: 275100 - DNA, 22 bp, Artificial Sequence
  Description of Artificial Sequence: Synthetic oligonucleotide
gctgggtccgctctgggcctga

SEQ ID NO: 275101 - DNA, 22 bp, Artificial Sequence
  Description of Artificial Sequence: Synthetic oligonucleotide
ctgggtccgctctgggcctgag

SEQ ID NO: 275102 - DNA, 23 bp, Artificial Sequence
  Description of Artificial Sequence: Synthetic oligonucleotide
tgggtccgctctgggcctgagct

SEQ ID NO: 275103 - DNA, 22 bp, Artificial Sequence
  Description of Artificial Sequence: Synthetic oligonucleotide
gggtccgctctgggcctgagct

SEQ ID NO: 275104 - DNA, 24 bp, Artificial Sequence
  Description of Artificial Sequence: Synthetic oligonucleotide
ggtccgctctgggcctgagctcat

SEQ ID NO: 275105 - DNA, 26 bp, Artificial Sequence
  Description of Artificial Sequence: Synthetic oligonucleotide
gtccgctctgggcctgagctcatcta

SEQ ID NO: 275106 - DNA, 26 bp, Artificial Sequence
  Description of Artificial Sequence: Synthetic oligonucleotide
tccgctctgggcctgagctcatctac

SEQ ID NO: 275107 - DNA, 25 bp, Artificial Sequence
  Description of Artificial Sequence: Synthetic oligonucleotide
ccgctctgggcctgagctcatctac

SEQ ID NO: 275108 - DNA, 26 bp, Artificial Sequence
  Description of Artificial Sequence: Synthetic oligonucleotide
cgctctgggcctgagctcatctacgt

SEQ ID NO: 275109 - DNA, 27 bp, Artificial Sequence
  Description of Artificial Sequence: Synthetic oligonucleotide
gctctgggcctgagctcatctacgtct

SEQ ID NO: 275110 - DNA, 30 bp, Artificial Sequence
  Description of Artificial Sequence: Synthetic oligonucleotide
ctctgggcctgagctcatctacgtctttag

SEQ ID NO: 275111 - DNA, 30 bp, Artificial Sequence
  Description of Artificial Sequence: Synthetic oligonucleotide
tctgggcctgagctcatctacgtctttagc

SEQ ID NO: 275112 - DNA, 29 bp, Artificial Sequence
  Description of Artificial Sequence: Synthetic oligonucleotide
ctgggcctgagctcatctacgtctttagc

SEQ ID NO: 275113 - DNA, 29 bp, Artificial Sequence
  Description of Artificial Sequence: Synthetic oligonucleotide
tgggcctgagctcatctacgtctttagcg

SEQ ID NO: 275114 - DNA, 28 bp, Artificial Sequence
  Description of Artificial Sequence: Synthetic oligonucleotide
gggcctgagctcatctacgtctttagcg

SEQ ID NO: 275115 - DNA, 29 bp, Artificial Sequence
  Description of Artificial Sequence: Synthetic oligonucleotide
ggcctgagctcatctacgtctttagcgac

SEQ ID NO: 275116 - DNA, 29 bp, Artificial Sequence
  Description of Artificial Sequence: Synthetic oligonucleotide
gcctgagctcatctacgtctttagcgacg

SEQ ID NO: 275117 - DNA, 29 bp, Artificial Sequence
  Description of Artificial Sequence: Synthetic oligonucleotide
cctgagctcatctacgtctttagcgacgg

SEQ ID NO: 275118 - DNA, 29 bp, Artificial Sequence
  Description of Artificial Sequence: Synthetic oligonucleotide
ctgagctcatctacgtctttagcgacggg

SEQ ID NO: 275119 - DNA, 30 bp, Artificial Sequence
  Description of Artificial Sequence: Synthetic oligonucleotide
tgagctcatctacgtctttagcgacgggac

SEQ ID NO: 275120 - DNA, 29 bp, Artificial Sequence
  Description of Artificial Sequence: Synthetic oligonucleotide
gagctcatctacgtctttagcgacgggac

SEQ ID NO: 275121 - DNA, 29 bp, Artificial Sequence
  Description of Artificial Sequence: Synthetic oligonucleotide
agctcatctacgtctttagcgacgggacc

SEQ ID NO: 275122 - DNA, 28 bp, Artificial Sequence
  Description of Artificial Sequence: Synthetic oligonucleotide
gctcatctacgtctttagcgacgggacc

SEQ ID NO: 275123 - DNA, 28 bp, Artificial Sequence
  Description of Artificial Sequence: Synthetic oligonucleotide
ctcatctacgtctttagcgacgggaccc

SEQ ID NO: 275124 - DNA, 28 bp, Artificial Sequence
  Description of Artificial Sequence: Synthetic oligonucleotide
tcatctacgtctttagcgacgggacccg

SEQ ID NO: 275125 - DNA, 27 bp, Artificial Sequence
  Description of Artificial Sequence: Synthetic oligonucleotide
catctacgtctttagcgacgggacccg

SEQ ID NO: 275126 - DNA, 27 bp, Artificial Sequence
  Description of Artificial Sequence: Synthetic oligonucleotide
atctacgtctttagcgacgggacccgc

SEQ ID NO: 275127 - DNA, 26 bp, Artificial Sequence
  Description of Artificial Sequence: Synthetic oligonucleotide
tctacgtctttagcgacgggacccgc

SEQ ID NO: 275128 - DNA, 25 bp, Artificial Sequence
  Description of Artificial Sequence: Synthetic oligonucleotide
ctacgtctttagcgacgggacccgc

SEQ ID NO: 275129 - DNA, 26 bp, Artificial Sequence
  Description of Artificial Sequence: Synthetic oligonucleotide
tacgtctttagcgacgggacccgcct

SEQ ID NO: 275130 - DNA, 25 bp, Artificial Sequence
  Description of Artificial Sequence: Synthetic oligonucleotide
acgtctttagcgacgggacccgcct

SEQ ID NO: 275131 - DNA, 24 bp, Artificial Sequence
  Description of Artificial Sequence: Synthetic oligonucleotide
cgtctttagcgacgggacccgcct

SEQ ID NO: 275132 - DNA, 24 bp, Artificial Sequence
  Description of Artificial Sequence: Synthetic oligonucleotide
gtctttagcgacgggacccgcctg

SEQ ID NO: 275133 - DNA, 25 bp, Artificial Sequence
  Description of Artificial Sequence: Synthetic oligonucleotide
tctttagcgacgggacccgcctgga

SEQ ID NO: 275134 - DNA, 24 bp, Artificial Sequence
  Description of Artificial Sequence: Synthetic oligonucleotide
ctttagcgacgggacccgcctgga

SEQ ID NO: 275135 - DNA, 24 bp, Artificial Sequence
  Description of Artificial Sequence: Synthetic oligonucleotide
tttagcgacgggacccgcctggag

SEQ ID NO: 275136 - DNA, 23 bp, Artificial Sequence
  Description of Artificial Sequence: Synthetic oligonucleotide
ttagcgacgggacccgcctggag

SEQ ID NO: 275137 - DNA, 22 bp, Artificial Sequence
  Description of Artificial Sequence: Synthetic oligonucleotide
tagcgacgggacccgcctggag

SEQ ID NO: 275138 - DNA, 21 bp, Artificial Sequence
  Description of Artificial Sequence: Synthetic oligonucleotide
agcgacgggacccgcctggag

SEQ ID NO: 275139 - DNA, 20 bp, Artificial Sequence
  Description of Artificial Sequence: Synthetic oligonucleotide
gcgacgggacccgcctggag

SEQ ID NO: 275140 - DNA, 20 bp, Artificial Sequence
  Description of Artificial Sequence: Synthetic oligonucleotide
cgacgggacccgcctggagg

SEQ ID NO: 275141 - DNA, 20 bp, Artificial Sequence
  Description of Artificial Sequence: Synthetic oligonucleotide
gacgggacccgcctggaggg

SEQ ID NO: 275142 - DNA, 20 bp, Artificial Sequence
  Description of Artificial Sequence: Synthetic oligonucleotide
acgggacccgcctggagggg

SEQ ID NO: 275143 - DNA, 20 bp, Artificial Sequence
  Description of Artificial Sequence: Synthetic oligonucleotide
cgggacccgcctggaggggt

SEQ ID NO: 275144 - DNA, 20 bp, Artificial Sequence
  Description of Artificial Sequence: Synthetic oligonucleotide
gggacccgcctggaggggga

SEQ ID NO: 275145 - DNA, 22 bp, Artificial Sequence
  Description of Artificial Sequence: Synthetic oligonucleotide
ggacccgcctggagggggacaa

SEQ ID NO: 275146 - DNA, 24 bp, Artificial Sequence
  Description of Artificial Sequence: Synthetic oligonucleotide
gacccgcctggagggggacaactt

SEQ ID NO: 275147 - DNA, 25 bp, Artificial Sequence
  Description of Artificial Sequence: Synthetic oligonucleotide
acccgcctggagggggacaacttct

SEQ ID NO: 275148 - DNA, 24 bp, Artificial Sequence
  Description of Artificial Sequence: Synthetic oligonucleotide
cccgcctggagggggacaacttct

SEQ ID NO: 275149 - DNA, 25 bp, Artificial Sequence
  Description of Artificial Sequence: Synthetic oligonucleotide
ccgcctggagggggacaacttctct

SEQ ID NO: 275150 - DNA, 26 bp, Artificial Sequence
  Description of Artificial Sequence: Synthetic oligonucleotide
cgcctggagggggacaacttctctgt

SEQ ID NO: 275151 - DNA, 26 bp, Artificial Sequence
  Description of Artificial Sequence: Synthetic oligonucleotide
gcctggagggggacaacttctctgtc

SEQ ID NO: 275152 - DNA, 26 bp, Artificial Sequence
  Description of Artificial Sequence: Synthetic oligonucleotide
cctggagggggacaacttctctgtcg

SEQ ID NO: 275153 - DNA, 26 bp, Artificial Sequence
  Description of Artificial Sequence: Synthetic oligonucleotide
ctggagggggacaacttctctgtcgg

SEQ ID NO: 275154 - DNA, 27 bp, Artificial Sequence
  Description of Artificial Sequence: Synthetic oligonucleotide
tggagggggacaacttctctgtcggct

SEQ ID NO: 275155 - DNA, 26 bp, Artificial Sequence
  Description of Artificial Sequence: Synthetic oligonucleotide
ggagggggacaacttctctgtcggct

SEQ ID NO: 275156 - DNA, 27 bp, Artificial Sequence
  Description of Artificial Sequence: Synthetic oligonucleotide
gagggggacaacttctctgtcggctct

SEQ ID NO: 275157 - DNA, 27 bp, Artificial Sequence
  Description of Artificial Sequence: Synthetic oligonucleotide
agggggacaacttctctgtcggctctg

SEQ ID NO: 275158 - DNA, 26 bp, Artificial Sequence
  Description of Artificial Sequence: Synthetic oligonucleotide
gggggacaacttctctgtcggctctg

SEQ ID NO: 275159 - DNA, 27 bp, Artificial Sequence
  Description of Artificial Sequence: Synthetic oligonucleotide
ggggacaacttctctgtcggctctgga

SEQ ID NO: 275160 - DNA, 28 bp, Artificial Sequence
  Description of Artificial Sequence: Synthetic oligonucleotide
gggacaacttctctgtcggctctggaac

SEQ ID NO: 275161 - DNA, 29 bp, Artificial Sequence
  Description of Artificial Sequence: Synthetic oligonucleotide
ggacaacttctctgtcggctctggaactc

SEQ ID NO: 275162 - DNA, 29 bp, Artificial Sequence
  Description of Artificial Sequence: Synthetic oligonucleotide
gacaacttctctgtcggctctggaactcc

SEQ ID NO: 275163 - DNA, 29 bp, Artificial Sequence
  Description of Artificial Sequence: Synthetic oligonucleotide
acaacttctctgtcggctctggaactccc

SEQ ID NO: 275164 - DNA, 28 bp, Artificial Sequence
  Description of Artificial Sequence: Synthetic oligonucleotide
caacttctctgtcggctctggaactccc

SEQ ID NO: 275165 - DNA, 31 bp, Artificial Sequence
  Description of Artificial Sequence: Synthetic oligonucleotide
aacttctctgtcggctctggaactccctatg

SEQ ID NO: 275166 - DNA, 30 bp, Artificial Sequence
  Description of Artificial Sequence: Synthetic oligonucleotide
acttctctgtcggctctggaactccctatg

SEQ ID NO: 275167 - DNA, 29 bp, Artificial Sequence
  Description of Artificial Sequence: Synthetic oligonucleotide
cttctctgtcggctctggaactccctatg

SEQ ID NO: 275168 - DNA, 29 bp, Artificial Sequence
  Description of Artificial Sequence: Synthetic oligonucleotide
ttctctgtcggctctggaactccctatgg

SEQ ID NO: 275169 - DNA, 28 bp, Artificial Sequence
  Description of Artificial Sequence: Synthetic oligonucleotide
tctctgtcggctctggaactccctatgg

SEQ ID NO: 275170 - DNA, 27 bp, Artificial Sequence
  Description of Artificial Sequence: Synthetic oligonucleotide
ctctgtcggctctggaactccctatgg

SEQ ID NO: 275171 - DNA, 27 bp, Artificial Sequence
  Description of Artificial Sequence: Synthetic oligonucleotide
tctgtcggctctggaactccctatggc

SEQ ID NO: 275172 - DNA, 27 bp, Artificial Sequence
  Description of Artificial Sequence: Synthetic oligonucleotide
ctgtcggctctggaactccctatggct

SEQ ID NO: 275173 - DNA, 28 bp, Artificial Sequence
  Description of Artificial Sequence: Synthetic oligonucleotide
tgtcggctctggaactccctatggctac

SEQ ID NO: 275174 - DNA, 27 bp, Artificial Sequence
  Description of Artificial Sequence: Synthetic oligonucleotide
gtcggctctggaactccctatggctac

SEQ ID NO: 275175 - DNA, 27 bp, Artificial Sequence
  Description of Artificial Sequence: Synthetic oligonucleotide
tcggctctggaactccctatggctacg

SEQ ID NO: 275176 - DNA, 26 bp, Artificial Sequence
  Description of Artificial Sequence: Synthetic oligonucleotide
cggctctggaactccctatggctacg

SEQ ID NO: 275177 - DNA, 26 bp, Artificial Sequence
  Description of Artificial Sequence: Synthetic oligonucleotide
ggctctggaactccctatggctacgg

SEQ ID NO: 275178 - DNA, 26 bp, Artificial Sequence
  Description of Artificial Sequence: Synthetic oligonucleotide
gctctggaactccctatggctacggc

SEQ ID NO: 275179 - DNA, 27 bp, Artificial Sequence
  Description of Artificial Sequence: Synthetic oligonucleotide
ctctggaactccctatggctacggcgt

SEQ ID NO: 275180 - DNA, 27 bp, Artificial Sequence
  Description of Artificial Sequence: Synthetic oligonucleotide
tctggaactccctatggctacggcgtc

SEQ ID NO: 275181 - DNA, 26 bp, Artificial Sequence
  Description of Artificial Sequence: Synthetic oligonucleotide
ctggaactccctatggctacggcgtc

SEQ ID NO: 275182 - DNA, 27 bp, Artificial Sequence
  Description of Artificial Sequence: Synthetic oligonucleotide
tggaactccctatggctacggcgtcct

SEQ ID NO: 275183 - DNA, 27 bp, Artificial Sequence
  Description of Artificial Sequence: Synthetic oligonucleotide
ggaactccctatggctacggcgtccta

SEQ ID NO: 275184 - DNA, 27 bp, Artificial Sequence
  Description of Artificial Sequence: Synthetic oligonucleotide
gaactccctatggctacggcgtcctag

SEQ ID NO: 275185 - DNA, 28 bp, Artificial Sequence
  Description of Artificial Sequence: Synthetic oligonucleotide
aactccctatggctacggcgtcctagac

SEQ ID NO: 275186 - DNA, 27 bp, Artificial Sequence
  Description of Artificial Sequence: Synthetic oligonucleotide
actccctatggctacggcgtcctagac

SEQ ID NO: 275187 - DNA, 26 bp, Artificial Sequence
  Description of Artificial Sequence: Synthetic oligonucleotide
ctccctatggctacggcgtcctagac

SEQ ID NO: 275188 - DNA, 26 bp, Artificial Sequence
  Description of Artificial Sequence: Synthetic oligonucleotide
tccctatggctacggcgtcctagacc

SEQ ID NO: 275189 - DNA, 25 bp, Artificial Sequence
  Description of Artificial Sequence: Synthetic oligonucleotide
ccctatggctacggcgtcctagacc

SEQ ID NO: 275190 - DNA, 26 bp, Artificial Sequence
  Description of Artificial Sequence: Synthetic oligonucleotide
cctatggctacggcgtcctagaccgt

SEQ ID NO: 275191 - DNA, 26 bp, Artificial Sequence
  Description of Artificial Sequence: Synthetic oligonucleotide
ctatggctacggcgtcctagaccgtc

SEQ ID NO: 275192 - DNA, 26 bp, Artificial Sequence
  Description of Artificial Sequence: Synthetic oligonucleotide
tatggctacggcgtcctagaccgtcg

SEQ ID NO: 275193 - DNA, 25 bp, Artificial Sequence
  Description of Artificial Sequence: Synthetic oligonucleotide
atggctacggcgtcctagaccgtcg

SEQ ID NO: 275194 - DNA, 24 bp, Artificial Sequence
  Description of Artificial Sequence: Synthetic oligonucleotide
tggctacggcgtcctagaccgtcg

SEQ ID NO: 275195 - DNA, 23 bp, Artificial Sequence
  Description of Artificial Sequence: Synthetic oligonucleotide
ggctacggcgtcctagaccgtcg

SEQ ID NO: 275196 - DNA, 26 bp, Artificial Sequence
  Description of Artificial Sequence: Synthetic oligonucleotide
gctacggcgtcctagaccgtcgctat

SEQ ID NO: 275197 - DNA, 26 bp, Artificial Sequence
  Description of Artificial Sequence: Synthetic oligonucleotide
ctacggcgtcctagaccgtcgctatc

SEQ ID NO: 275198 - DNA, 26 bp, Artificial Sequence
  Description of Artificial Sequence: Synthetic oligonucleotide
tacggcgtcctagaccgtcgctatcg

SEQ ID NO: 275199 - DNA, 25 bp, Artificial Sequence
  Description of Artificial Sequence: Synthetic oligonucleotide
acggcgtcctagaccgtcgctatcg

SEQ ID NO: 275200 - DNA, 24 bp, Artificial Sequence
  Description of Artificial Sequence: Synthetic oligonucleotide
cggcgtcctagaccgtcgctatcg

SEQ ID NO: 275201 - DNA, 26 bp, Artificial Sequence
  Description of Artificial Sequence: Synthetic oligonucleotide
ggcgtcctagaccgtcgctatcgctt

SEQ ID NO: 275202 - DNA, 26 bp, Artificial Sequence
  Description of Artificial Sequence: Synthetic oligonucleotide
gcgtcctagaccgtcgctatcgcttc

SEQ ID NO: 275203 - DNA, 27 bp, Artificial Sequence
  Description of Artificial Sequence: Synthetic oligonucleotide
cgtcctagaccgtcgctatcgcttcga

SEQ ID NO: 275204 - DNA, 27 bp, Artificial Sequence
  Description of Artificial Sequence: Synthetic oligonucleotide
gtcctagaccgtcgctatcgcttcgac

SEQ ID NO: 275205 - DNA, 29 bp, Artificial Sequence
  Description of Artificial Sequence: Synthetic oligonucleotide
tcctagaccgtcgctatcgcttcgacatg

SEQ ID NO: 275206 - DNA, 28 bp, Artificial Sequence
  Description of Artificial Sequence: Synthetic oligonucleotide
cctagaccgtcgctatcgcttcgacatg

SEQ ID NO: 275207 - DNA, 29 bp, Artificial Sequence
  Description of Artificial Sequence: Synthetic oligonucleotide
ctagaccgtcgctatcgcttcgacatgag

SEQ ID NO: 275208 - DNA, 29 bp, Artificial Sequence
  Description of Artificial Sequence: Synthetic oligonucleotide
tagaccgtcgctatcgcttcgacatgagg

SEQ ID NO: 275209 - DNA, 28 bp, Artificial Sequence
  Description of Artificial Sequence: Synthetic oligonucleotide
agaccgtcgctatcgcttcgacatgagg

SEQ ID NO: 275210 - DNA, 27 bp, Artificial Sequence
  Description of Artificial Sequence: Synthetic oligonucleotide
gaccgtcgctatcgcttcgacatgagg

SEQ ID NO: 275211 - DNA, 28 bp, Artificial Sequence
  Description of Artificial Sequence: Synthetic oligonucleotide
accgtcgctatcgcttcgacatgaggac

SEQ ID NO: 275212 - DNA, 27 bp, Artificial Sequence
  Description of Artificial Sequence: Synthetic oligonucleotide
ccgtcgctatcgcttcgacatgaggac

SEQ ID NO: 275213 - DNA, 27 bp, Artificial Sequence
  Description of Artificial Sequence: Synthetic oligonucleotide
cgtcgctatcgcttcgacatgaggacc

SEQ ID NO: 275214 - DNA, 27 bp, Artificial Sequence
  Description of Artificial Sequence: Synthetic oligonucleotide
gtcgctatcgcttcgacatgaggaccc

SEQ ID NO: 275215 - DNA, 28 bp, Artificial Sequence
  Description of Artificial Sequence: Synthetic oligonucleotide
tcgctatcgcttcgacatgaggacccag

SEQ ID NO: 275216 - DNA, 27 bp, Artificial Sequence
  Description of Artificial Sequence: Synthetic oligonucleotide
cgctatcgcttcgacatgaggacccag

SEQ ID NO: 275217 - DNA, 27 bp, Artificial Sequence
  Description of Artificial Sequence: Synthetic oligonucleotide
gctatcgcttcgacatgaggacccagg

SEQ ID NO: 275218 - DNA, 29 bp, Artificial Sequence
  Description of Artificial Sequence: Synthetic oligonucleotide
ctatcgcttcgacatgaggacccaggaac

SEQ ID NO: 275219 - DNA, 29 bp, Artificial Sequence
  Description of Artificial Sequence: Synthetic oligonucleotide
tatcgcttcgacatgaggacccaggaacc

SEQ ID NO: 275220 - DNA, 28 bp, Artificial Sequence
  Description of Artificial Sequence: Synthetic oligonucleotide
atcgcttcgacatgaggacccaggaacc

SEQ ID NO: 275221 - DNA, 27 bp, Artificial Sequence
  Description of Artificial Sequence: Synthetic oligonucleotide
tcgcttcgacatgaggacccaggaacc

SEQ ID NO: 275222 - DNA, 26 bp, Artificial Sequence
  Description of Artificial Sequence: Synthetic oligonucleotide
cgcttcgacatgaggacccaggaacc

SEQ ID NO: 275223 - DNA, 27 bp, Artificial Sequence
  Description of Artificial Sequence: Synthetic oligonucleotide
gcttcgacatgaggacccaggaaccct

SEQ ID NO: 275224 - DNA, 28 bp, Artificial Sequence
  Description of Artificial Sequence: Synthetic oligonucleotide
cttcgacatgaggacccaggaaccctac

SEQ ID NO: 275225 - DNA, 28 bp, Artificial Sequence
  Description of Artificial Sequence: Synthetic oligonucleotide
ttcgacatgaggacccaggaaccctacg

SEQ ID NO: 275226 - DNA, 27 bp, Artificial Sequence
  Description of Artificial Sequence: Synthetic oligonucleotide
tcgacatgaggacccaggaaccctacg

SEQ ID NO: 275227 - DNA, 26 bp, Artificial Sequence
  Description of Artificial Sequence: Synthetic oligonucleotide
cgacatgaggacccaggaaccctacg

SEQ ID NO: 275228 - DNA, 26 bp, Artificial Sequence
  Description of Artificial Sequence: Synthetic oligonucleotide
gacatgaggacccaggaaccctacgc

SEQ ID NO: 275229 - DNA, 26 bp, Artificial Sequence
  Description of Artificial Sequence: Synthetic oligonucleotide
acatgaggacccaggaaccctacgcc

SEQ ID NO: 275230 - DNA, 25 bp, Artificial Sequence
  Description of Artificial Sequence: Synthetic oligonucleotide
catgaggacccaggaaccctacgcc

SEQ ID NO: 275231 - DNA, 26 bp, Artificial Sequence
  Description of Artificial Sequence: Synthetic oligonucleotide
atgaggacccaggaaccctacgccca

SEQ ID NO: 275232 - DNA, 25 bp, Artificial Sequence
  Description of Artificial Sequence: Synthetic oligonucleotide
tgaggacccaggaaccctacgccca

SEQ ID NO: 275233 - DNA, 24 bp, Artificial Sequence
  Description of Artificial Sequence: Synthetic oligonucleotide
gaggacccaggaaccctacgccca

SEQ ID NO: 275234 - DNA, 24 bp, Artificial Sequence
  Description of Artificial Sequence: Synthetic oligonucleotide
aggacccaggaaccctacgcccag

SEQ ID NO: 275235 - DNA, 23 bp, Artificial Sequence
  Description of Artificial Sequence: Synthetic oligonucleotide
ggacccaggaaccctacgcccag

SEQ ID NO: 275236 - DNA, 23 bp, Artificial Sequence
  Description of Artificial Sequence: Synthetic oligonucleotide
gacccaggaaccctacgcccagg

SEQ ID NO: 275237 - DNA, 24 bp, Artificial Sequence
  Description of Artificial Sequence: Synthetic oligonucleotide
acccaggaaccctacgcccaggct

SEQ ID NO: 275238 - DNA, 23 bp, Artificial Sequence
  Description of Artificial Sequence: Synthetic oligonucleotide
cccaggaaccctacgcccaggct

SEQ ID NO: 275239 - DNA, 23 bp, Artificial Sequence
  Description of Artificial Sequence: Synthetic oligonucleotide
ccaggaaccctacgcccaggctc

SEQ ID NO: 275240 - DNA, 23 bp, Artificial Sequence
  Description of Artificial Sequence: Synthetic oligonucleotide
caggaaccctacgcccaggctcg

SEQ ID NO: 275241 - DNA, 24 bp, Artificial Sequence
  Description of Artificial Sequence: Synthetic oligonucleotide
aggaaccctacgcccaggctcgct

SEQ ID NO: 275242 - DNA, 23 bp, Artificial Sequence
  Description of Artificial Sequence: Synthetic oligonucleotide
ggaaccctacgcccaggctcgct

SEQ ID NO: 275243 - DNA, 23 bp, Artificial Sequence
  Description of Artificial Sequence: Synthetic oligonucleotide
gaaccctacgcccaggctcgctg

SEQ ID NO: 275244 - DNA, 23 bp, Artificial Sequence
  Description of Artificial Sequence: Synthetic oligonucleotide
aaccctacgcccaggctcgctgg

SEQ ID NO: 275245 - DNA, 22 bp, Artificial Sequence
  Description of Artificial Sequence: Synthetic oligonucleotide
accctacgcccaggctcgctgg

SEQ ID NO: 275246 - DNA, 21 bp, Artificial Sequence
  Description of Artificial Sequence: Synthetic oligonucleotide
ccctacgcccaggctcgctgg

SEQ ID NO: 275247 - DNA, 21 bp, Artificial Sequence
  Description of Artificial Sequence: Synthetic oligonucleotide
cctacgcccaggctcgctggg

SEQ ID NO: 275248 - DNA, 21 bp, Artificial Sequence
  Description of Artificial Sequence: Synthetic oligonucleotide
ctacgcccaggctcgctgggc

SEQ ID NO: 275249 - DNA, 21 bp, Artificial Sequence
  Description of Artificial Sequence: Synthetic oligonucleotide
tacgcccaggctcgctgggcc

SEQ ID NO: 275250 - DNA, 20 bp, Artificial Sequence
  Description of Artificial Sequence: Synthetic oligonucleotide
acgcccaggctcgctgggcc

SEQ ID NO: 275251 - DNA, 20 bp, Artificial Sequence
  Description of Artificial Sequence: Synthetic oligonucleotide
cgcccaggctcgctgggcct

SEQ ID NO: 275252 - DNA, 20 bp, Artificial Sequence
  Description of Artificial Sequence: Synthetic oligonucleotide
gcccaggctcgctgggccgt

SEQ ID NO: 275253 - DNA, 20 bp, Artificial Sequence
  Description of Artificial Sequence: Synthetic oligonucleotide
cccaggctcgctgggccgtg

SEQ ID NO: 275254 - DNA, 20 bp, Artificial Sequence
  Description of Artificial Sequence: Synthetic oligonucleotide
ccaggctcgctgggccgtgg

SEQ ID NO: 275255 - DNA, 20 bp, Artificial Sequence
  Description of Artificial Sequence: Synthetic oligonucleotide
caggctcgctgggccgtggc

SEQ ID NO: 275256 - DNA, 20 bp, Artificial Sequence
  Description of Artificial Sequence: Synthetic oligonucleotide
aggctcgctgggccgtggcc

SEQ ID NO: 275257 - DNA, 20 bp, Artificial Sequence
  Description of Artificial Sequence: Synthetic oligonucleotide
ggctcgctgggccgtggcct

SEQ ID NO: 275258 - DNA, 20 bp, Artificial Sequence
  Description of Artificial Sequence: Synthetic oligonucleotide
gctcgctgggccgtggccga

SEQ ID NO: 275259 - DNA, 20 bp, Artificial Sequence
  Description of Artificial Sequence: Synthetic oligonucleotide
ctcgctgggccgtggccgac

SEQ ID NO: 275260 - DNA, 20 bp, Artificial Sequence
  Description of Artificial Sequence: Synthetic oligonucleotide
tcgctgggccgtggccgacg

SEQ ID NO: 275261 - DNA, 20 bp, Artificial Sequence
  Description of Artificial Sequence: Synthetic oligonucleotide
cgctgggccgtggccgacgt

SEQ ID NO: 275262 - DNA, 20 bp, Artificial Sequence
  Description of Artificial Sequence: Synthetic oligonucleotide
gctgggccgtggccgacgct

SEQ ID NO: 275263 - DNA, 20 bp, Artificial Sequence
  Description of Artificial Sequence: Synthetic oligonucleotide
ctgggccgtggccgacgcca

SEQ ID NO: 275264 - DNA, 20 bp, Artificial Sequence
  Description of Artificial Sequence: Synthetic oligonucleotide
tgggccgtggccgacgccac

SEQ ID NO: 275265 - DNA, 20 bp, Artificial Sequence
  Description of Artificial Sequence: Synthetic oligonucleotide
gggccgtggccgacgccact

SEQ ID NO: 275266 - DNA, 20 bp, Artificial Sequence
  Description of Artificial Sequence: Synthetic oligonucleotide
ggccgtggccgacgccacct

SEQ ID NO: 275267 - DNA, 20 bp, Artificial Sequence
  Description of Artificial Sequence: Synthetic oligonucleotide
gccgtggccgacgccaccct

SEQ ID NO: 275268 - DNA, 20 bp, Artificial Sequence
  Description of Artificial Sequence: Synthetic oligonucleotide
ccgtggccgacgccaccctc

SEQ ID NO: 275269 - DNA, 20 bp, Artificial Sequence
  Description of Artificial Sequence: Synthetic oligonucleotide
cgtggccgacgccaccctcc

SEQ ID NO: 275270 - DNA, 21 bp, Artificial Sequence
  Description of Artificial Sequence: Synthetic oligonucleotide
gtggccgacgccaccctccgt

SEQ ID NO: 275271 - DNA, 23 bp, Artificial Sequence
  Description of Artificial Sequence: Synthetic oligonucleotide
tggccgacgccaccctccgtgat

SEQ ID NO: 275272 - DNA, 22 bp, Artificial Sequence
  Description of Artificial Sequence: Synthetic oligonucleotide
ggccgacgccaccctccgtgat

SEQ ID NO: 275273 - DNA, 22 bp, Artificial Sequence
  Description of Artificial Sequence: Synthetic oligonucleotide
gccgacgccaccctccgtgatg

SEQ ID NO: 275274 - DNA, 22 bp, Artificial Sequence
  Description of Artificial Sequence: Synthetic oligonucleotide
ccgacgccaccctccgtgatgc

SEQ ID NO: 275275 - DNA, 26 bp, Artificial Sequence
  Description of Artificial Sequence: Synthetic oligonucleotide
cgacgccaccctccgtgatgcgtatt

SEQ ID NO: 275276 - DNA, 27 bp, Artificial Sequence
  Description of Artificial Sequence: Synthetic oligonucleotide
gacgccaccctccgtgatgcgtattca

SEQ ID NO: 275277 - DNA, 27 bp, Artificial Sequence
  Description of Artificial Sequence: Synthetic oligonucleotide
acgccaccctccgtgatgcgtattcag

SEQ ID NO: 275278 - DNA, 26 bp, Artificial Sequence
  Description of Artificial Sequence: Synthetic oligonucleotide
cgccaccctccgtgatgcgtattcag

SEQ ID NO: 275279 - DNA, 26 bp, Artificial Sequence
  Description of Artificial Sequence: Synthetic oligonucleotide
gccaccctccgtgatgcgtattcagg

SEQ ID NO: 275280 - DNA, 26 bp, Artificial Sequence
  Description of Artificial Sequence: Synthetic oligonucleotide
ccaccctccgtgatgcgtattcaggg

SEQ ID NO: 275281 - DNA, 26 bp, Artificial Sequence
  Description of Artificial Sequence: Synthetic oligonucleotide
caccctccgtgatgcgtattcagggc

SEQ ID NO: 275282 - DNA, 26 bp, Artificial Sequence
  Description of Artificial Sequence: Synthetic oligonucleotide
accctccgtgatgcgtattcagggcg

SEQ ID NO: 275283 - DNA, 25 bp, Artificial Sequence
  Description of Artificial Sequence: Synthetic oligonucleotide
ccctccgtgatgcgtattcagggcg

SEQ ID NO: 275284 - DNA, 26 bp, Artificial Sequence
  Description of Artificial Sequence: Synthetic oligonucleotide
cctccgtgatgcgtattcagggcgct

SEQ ID NO: 275285 - DNA, 27 bp, Artificial Sequence
  Description of Artificial Sequence: Synthetic oligonucleotide
ctccgtgatgcgtattcagggcgctct

SEQ ID NO: 275286 - DNA, 27 bp, Artificial Sequence
  Description of Artificial Sequence: Synthetic oligonucleotide
tccgtgatgcgtattcagggcgctctg

SEQ ID NO: 275287 - DNA, 27 bp, Artificial Sequence
  Description of Artificial Sequence: Synthetic oligonucleotide
ccgtgatgcgtattcagggcgctctgt

SEQ ID NO: 275288 - DNA, 28 bp, Artificial Sequence
  Description of Artificial Sequence: Synthetic oligonucleotide
cgtgatgcgtattcagggcgctctgtag

SEQ ID NO: 275289 - DNA, 29 bp, Artificial Sequence
  Description of Artificial Sequence: Synthetic oligonucleotide
gtgatgcgtattcagggcgctctgtagtc

SEQ ID NO: 275290 - DNA, 29 bp, Artificial Sequence
  Description of Artificial Sequence: Synthetic oligonucleotide
tgatgcgtattcagggcgctctgtagtcc

SEQ ID NO: 275291 - DNA, 28 bp, Artificial Sequence
  Description of Artificial Sequence: Synthetic oligonucleotide
gatgcgtattcagggcgctctgtagtcc

SEQ ID NO: 275292 - DNA, 32 bp, Artificial Sequence
  Description of Artificial Sequence: Synthetic oligonucleotide
atgcgtattcagggcgctctgtagtccttttc

SEQ ID NO: 275293 - DNA, 31 bp, Artificial Sequence
  Description of Artificial Sequence: Synthetic oligonucleotide
tgcgtattcagggcgctctgtagtccttttc

SEQ ID NO: 275294 - DNA, 30 bp, Artificial Sequence
  Description of Artificial Sequence: Synthetic oligonucleotide
gcgtattcagggcgctctgtagtccttttc

SEQ ID NO: 275295 - DNA, 30 bp, Artificial Sequence
  Description of Artificial Sequence: Synthetic oligonucleotide
cgtattcagggcgctctgtagtccttttcc

SEQ ID NO: 275296 - DNA, 31 bp, Artificial Sequence
  Description of Artificial Sequence: Synthetic oligonucleotide
gtattcagggcgctctgtagtccttttccag

SEQ ID NO: 275297 - DNA, 31 bp, Artificial Sequence
  Description of Artificial Sequence: Synthetic oligonucleotide
tattcagggcgctctgtagtccttttccagg

SEQ ID NO: 275298 - DNA, 30 bp, Artificial Sequence
  Description of Artificial Sequence: Synthetic oligonucleotide
attcagggcgctctgtagtccttttccagg

SEQ ID NO: 275299 - DNA, 29 bp, Artificial Sequence
  Description of Artificial Sequence: Synthetic oligonucleotide
ttcagggcgctctgtagtccttttccagg

SEQ ID NO: 275300 - DNA, 28 bp, Artificial Sequence
  Description of Artificial Sequence: Synthetic oligonucleotide
tcagggcgctctgtagtccttttccagg

SEQ ID NO: 275301 - DNA, 27 bp, Artificial Sequence
  Description of Artificial Sequence: Synthetic oligonucleotide
cagggcgctctgtagtccttttccagg

SEQ ID NO: 275302 - DNA, 28 bp, Artificial Sequence
  Description of Artificial Sequence: Synthetic oligonucleotide
agggcgctctgtagtccttttccaggtg

SEQ ID NO: 275303 - DNA, 27 bp, Artificial Sequence
  Description of Artificial Sequence: Synthetic oligonucleotide
gggcgctctgtagtccttttccaggtg

SEQ ID NO: 275304 - DNA, 27 bp, Artificial Sequence
  Description of Artificial Sequence: Synthetic oligonucleotide
ggcgctctgtagtccttttccaggtgc

SEQ ID NO: 275305 - DNA, 27 bp, Artificial Sequence
  Description of Artificial Sequence: Synthetic oligonucleotide
gcgctctgtagtccttttccaggtgcg

SEQ ID NO: 275306 - DNA, 27 bp, Artificial Sequence
  Description of Artificial Sequence: Synthetic oligonucleotide
cgctctgtagtccttttccaggtgcgg

SEQ ID NO: 275307 - DNA, 27 bp, Artificial Sequence
  Description of Artificial Sequence: Synthetic oligonucleotide
gctctgtagtccttttccaggtgcggg

SEQ ID NO: 275308 - DNA, 28 bp, Artificial Sequence
  Description of Artificial Sequence: Synthetic oligonucleotide
ctctgtagtccttttccaggtgcgggag

SEQ ID NO: 275309 - DNA, 29 bp, Artificial Sequence
  Description of Artificial Sequence: Synthetic oligonucleotide
tctgtagtccttttccaggtgcgggagtg

SEQ ID NO: 275310 - DNA, 28 bp, Artificial Sequence
  Description of Artificial Sequence: Synthetic oligonucleotide
ctgtagtccttttccaggtgcgggagtg

SEQ ID NO: 275311 - DNA, 29 bp, Artificial Sequence
  Description of Artificial Sequence: Synthetic oligonucleotide
tgtagtccttttccaggtgcgggagtgtg

SEQ ID NO: 275312 - DNA, 28 bp, Artificial Sequence
  Description of Artificial Sequence: Synthetic oligonucleotide
gtagtccttttccaggtgcgggagtgtg

SEQ ID NO: 275313 - DNA, 28 bp, Artificial Sequence
  Description of Artificial Sequence: Synthetic oligonucleotide
tagtccttttccaggtgcgggagtgtgg

SEQ ID NO: 275314 - DNA, 27 bp, Artificial Sequence
  Description of Artificial Sequence: Synthetic oligonucleotide
agtccttttccaggtgcgggagtgtgg

SEQ ID NO: 275315 - DNA, 27 bp, Artificial Sequence
  Description of Artificial Sequence: Synthetic oligonucleotide
gtccttttccaggtgcgggagtgtgga

SEQ ID NO: 275316 - DNA, 28 bp, Artificial Sequence
  Description of Artificial Sequence: Synthetic oligonucleotide
tccttttccaggtgcgggagtgtggatg

SEQ ID NO: 275317 - DNA, 27 bp, Artificial Sequence
  Description of Artificial Sequence: Synthetic oligonucleotide
ccttttccaggtgcgggagtgtggatg

SEQ ID NO: 275318 - DNA, 27 bp, Artificial Sequence
  Description of Artificial Sequence: Synthetic oligonucleotide
cttttccaggtgcgggagtgtggatgg

SEQ ID NO: 275319 - DNA, 27 bp, Artificial Sequence
  Description of Artificial Sequence: Synthetic oligonucleotide
ttttccaggtgcgggagtgtggatggg

SEQ ID NO: 275320 - DNA, 27 bp, Artificial Sequence
  Description of Artificial Sequence: Synthetic oligonucleotide
tttccaggtgcgggagtgtggatgggt

SEQ ID NO: 275321 - DNA, 26 bp, Artificial Sequence
  Description of Artificial Sequence: Synthetic oligonucleotide
ttccaggtgcgggagtgtggatgggt

SEQ ID NO: 275322 - DNA, 25 bp, Artificial Sequence
  Description of Artificial Sequence: Synthetic oligonucleotide
tccaggtgcgggagtgtggatgggt

SEQ ID NO: 275323 - DNA, 24 bp, Artificial Sequence
  Description of Artificial Sequence: Synthetic oligonucleotide
ccaggtgcgggagtgtggatgggt

SEQ ID NO: 275324 - DNA, 24 bp, Artificial Sequence
  Description of Artificial Sequence: Synthetic oligonucleotide
caggtgcgggagtgtggatgggtg

SEQ ID NO: 275325 - DNA, 26 bp, Artificial Sequence
  Description of Artificial Sequence: Synthetic oligonucleotide
aggtgcgggagtgtggatgggtgcat

SEQ ID NO: 275326 - DNA, 25 bp, Artificial Sequence
  Description of Artificial Sequence: Synthetic oligonucleotide
ggtgcgggagtgtggatgggtgcat

SEQ ID NO: 275327 - DNA, 26 bp, Artificial Sequence
  Description of Artificial Sequence: Synthetic oligonucleotide
gtgcgggagtgtggatgggtgcatgt

SEQ ID NO: 275328 - DNA, 27 bp, Artificial Sequence
  Description of Artificial Sequence: Synthetic oligonucleotide
tgcgggagtgtggatgggtgcatgtgt

SEQ ID NO: 275329 - DNA, 26 bp, Artificial Sequence
  Description of Artificial Sequence: Synthetic oligonucleotide
gcgggagtgtggatgggtgcatgtgt

SEQ ID NO: 275330 - DNA, 27 bp, Artificial Sequence
  Description of Artificial Sequence: Synthetic oligonucleotide
cgggagtgtggatgggtgcatgtgtct

SEQ ID NO: 275331 - DNA, 27 bp, Artificial Sequence
  Description of Artificial Sequence: Synthetic oligonucleotide
gggagtgtggatgggtgcatgtgtctc

SEQ ID NO: 275332 - DNA, 27 bp, Artificial Sequence
  Description of Artificial Sequence: Synthetic oligonucleotide
ggagtgtggatgggtgcatgtgtctcg

SEQ ID NO: 275333 - DNA, 27 bp, Artificial Sequence
  Description of Artificial Sequence: Synthetic oligonucleotide
gagtgtggatgggtgcatgtgtctcgc

SEQ ID NO: 275334 - DNA, 28 bp, Artificial Sequence
  Description of Artificial Sequence: Synthetic oligonucleotide
agtgtggatgggtgcatgtgtctcgcag

SEQ ID NO: 275335 - DNA, 27 bp, Artificial Sequence
  Description of Artificial Sequence: Synthetic oligonucleotide
gtgtggatgggtgcatgtgtctcgcag

SEQ ID NO: 275336 - DNA, 28 bp, Artificial Sequence
  Description of Artificial Sequence: Synthetic oligonucleotide
tgtggatgggtgcatgtgtctcgcagtg

SEQ ID NO: 275337 - DNA, 27 bp, Artificial Sequence
  Description of Artificial Sequence: Synthetic oligonucleotide
gtggatgggtgcatgtgtctcgcagtg

SEQ ID NO: 275338 - DNA, 29 bp, Artificial Sequence
  Description of Artificial Sequence: Synthetic oligonucleotide
tggatgggtgcatgtgtctcgcagtgatc

SEQ ID NO: 275339 - DNA, 28 bp, Artificial Sequence
  Description of Artificial Sequence: Synthetic oligonucleotide
ggatgggtgcatgtgtctcgcagtgatc

SEQ ID NO: 275340 - DNA, 28 bp, Artificial Sequence
  Description of Artificial Sequence: Synthetic oligonucleotide
gatgggtgcatgtgtctcgcagtgatcc

SEQ ID NO: 275341 - DNA, 28 bp, Artificial Sequence
  Description of Artificial Sequence: Synthetic oligonucleotide
atgggtgcatgtgtctcgcagtgatccc

SEQ ID NO: 275342 - DNA, 27 bp, Artificial Sequence
  Description of Artificial Sequence: Synthetic oligonucleotide
tgggtgcatgtgtctcgcagtgatccc

SEQ ID NO: 275343 - DNA, 27 bp, Artificial Sequence
  Description of Artificial Sequence: Synthetic oligonucleotide
gggtgcatgtgtctcgcagtgatccct

SEQ ID NO: 275344 - DNA, 27 bp, Artificial Sequence
  Description of Artificial Sequence: Synthetic oligonucleotide
ggtgcatgtgtctcgcagtgatccctg

SEQ ID NO: 275345 - DNA, 28 bp, Artificial Sequence
  Description of Artificial Sequence: Synthetic oligonucleotide
gtgcatgtgtctcgcagtgatccctgtg

SEQ ID NO: 275346 - DNA, 29 bp, Artificial Sequence
  Description of Artificial Sequence: Synthetic oligonucleotide
tgcatgtgtctcgcagtgatccctgtgtg

SEQ ID NO: 275347 - DNA, 28 bp, Artificial Sequence
  Description of Artificial Sequence: Synthetic oligonucleotide
gcatgtgtctcgcagtgatccctgtgtg

SEQ ID NO: 275348 - DNA, 28 bp, Artificial Sequence
  Description of Artificial Sequence: Synthetic oligonucleotide
catgtgtctcgcagtgatccctgtgtgc

SEQ ID NO: 275349 - DNA, 29 bp, Artificial Sequence
  Description of Artificial Sequence: Synthetic oligonucleotide
atgtgtctcgcagtgatccctgtgtgcag

SEQ ID NO: 275350 - DNA, 28 bp, Artificial Sequence
  Description of Artificial Sequence: Synthetic oligonucleotide
tgtgtctcgcagtgatccctgtgtgcag

SEQ ID NO: 275351 - DNA, 27 bp, Artificial Sequence
  Description of Artificial Sequence: Synthetic oligonucleotide
gtgtctcgcagtgatccctgtgtgcag

SEQ ID NO: 275352 - DNA, 29 bp, Artificial Sequence
  Description of Artificial Sequence: Synthetic oligonucleotide
tgtctcgcagtgatccctgtgtgcagtac

SEQ ID NO: 275353 - DNA, 28 bp, Artificial Sequence
  Description of Artificial Sequence: Synthetic oligonucleotide
gtctcgcagtgatccctgtgtgcagtac

SEQ ID NO: 275354 - DNA, 28 bp, Artificial Sequence
  Description of Artificial Sequence: Synthetic oligonucleotide
tctcgcagtgatccctgtgtgcagtacg

SEQ ID NO: 275355 - DNA, 27 bp, Artificial Sequence
  Description of Artificial Sequence: Synthetic oligonucleotide
ctcgcagtgatccctgtgtgcagtacg

SEQ ID NO: 275356 - DNA, 28 bp, Artificial Sequence
  Description of Artificial Sequence: Synthetic oligonucleotide
tcgcagtgatccctgtgtgcagtacgtg

SEQ ID NO: 275357 - DNA, 27 bp, Artificial Sequence
  Description of Artificial Sequence: Synthetic oligonucleotide
cgcagtgatccctgtgtgcagtacgtg

SEQ ID NO: 275358 - DNA, 27 bp, Artificial Sequence
  Description of Artificial Sequence: Synthetic oligonucleotide
gcagtgatccctgtgtgcagtacgtgg

SEQ ID NO: 275359 - DNA, 28 bp, Artificial Sequence
  Description of Artificial Sequence: Synthetic oligonucleotide
cagtgatccctgtgtgcagtacgtggac

SEQ ID NO: 275360 - DNA, 31 bp, Artificial Sequence
  Description of Artificial Sequence: Synthetic oligonucleotide
agtgatccctgtgtgcagtacgtggacttac

SEQ ID NO: 275361 - DNA, 30 bp, Artificial Sequence
  Description of Artificial Sequence: Synthetic oligonucleotide
gtgatccctgtgtgcagtacgtggacttac

SEQ ID NO: 275362 - DNA, 31 bp, Artificial Sequence
  Description of Artificial Sequence: Synthetic oligonucleotide
tgatccctgtgtgcagtacgtggacttacag

SEQ ID NO: 275363 - DNA, 30 bp, Artificial Sequence
  Description of Artificial Sequence: Synthetic oligonucleotide
gatccctgtgtgcagtacgtggacttacag

SEQ ID NO: 275364 - DNA, 32 bp, Artificial Sequence
  Description of Artificial Sequence: Synthetic oligonucleotide
atccctgtgtgcagtacgtggacttacagaag

SEQ ID NO: 275365 - DNA, 31 bp, Artificial Sequence
  Description of Artificial Sequence: Synthetic oligonucleotide
tccctgtgtgcagtacgtggacttacagaag

SEQ ID NO: 275366 - DNA, 30 bp, Artificial Sequence
  Description of Artificial Sequence: Synthetic oligonucleotide
ccctgtgtgcagtacgtggacttacagaag

SEQ ID NO: 275367 - DNA, 30 bp, Artificial Sequence
  Description of Artificial Sequence: Synthetic oligonucleotide
cctgtgtgcagtacgtggacttacagaagg

SEQ ID NO: 275368 - DNA, 31 bp, Artificial Sequence
  Description of Artificial Sequence: Synthetic oligonucleotide
ctgtgtgcagtacgtggacttacagaaggtc

SEQ ID NO: 275369 - DNA, 31 bp, Artificial Sequence
  Description of Artificial Sequence: Synthetic oligonucleotide
tgtgtgcagtacgtggacttacagaaggtcc

SEQ ID NO: 275370 - DNA, 30 bp, Artificial Sequence
  Description of Artificial Sequence: Synthetic oligonucleotide
gtgtgcagtacgtggacttacagaaggtcc

SEQ ID NO: 275371 - DNA, 31 bp, Artificial Sequence
  Description of Artificial Sequence: Synthetic oligonucleotide
tgtgcagtacgtggacttacagaaggtcctg

SEQ ID NO: 275372 - DNA, 30 bp, Artificial Sequence
  Description of Artificial Sequence: Synthetic oligonucleotide
gtgcagtacgtggacttacagaaggtcctg

SEQ ID NO: 275373 - DNA, 30 bp, Artificial Sequence
  Description of Artificial Sequence: Synthetic oligonucleotide
tgcagtacgtggacttacagaaggtcctgg

SEQ ID NO: 275374 - DNA, 29 bp, Artificial Sequence
  Description of Artificial Sequence: Synthetic oligonucleotide
gcagtacgtggacttacagaaggtcctgg

SEQ ID NO: 275375 - DNA, 30 bp, Artificial Sequence
  Description of Artificial Sequence: Synthetic oligonucleotide
cagtacgtggacttacagaaggtcctggag

SEQ ID NO: 275376 - DNA, 30 bp, Artificial Sequence
  Description of Artificial Sequence: Synthetic oligonucleotide
agtacgtggacttacagaaggtcctggagc

SEQ ID NO: 275377 - DNA, 29 bp, Artificial Sequence
  Description of Artificial Sequence: Synthetic oligonucleotide
gtacgtggacttacagaaggtcctggagc

SEQ ID NO: 275378 - DNA, 29 bp, Artificial Sequence
  Description of Artificial Sequence: Synthetic oligonucleotide
tacgtggacttacagaaggtcctggagcg

SEQ ID NO: 275379 - DNA, 28 bp, Artificial Sequence
  Description of Artificial Sequence: Synthetic oligonucleotide
acgtggacttacagaaggtcctggagcg

SEQ ID NO: 275380 - DNA, 27 bp, Artificial Sequence
  Description of Artificial Sequence: Synthetic oligonucleotide
cgtggacttacagaaggtcctggagcg

SEQ ID NO: 275381 - DNA, 27 bp, Artificial Sequence
  Description of Artificial Sequence: Synthetic oligonucleotide
gtggacttacagaaggtcctggagcgg

SEQ ID NO: 275382 - DNA, 27 bp, Artificial Sequence
  Description of Artificial Sequence: Synthetic oligonucleotide
tggacttacagaaggtcctggagcggg

SEQ ID NO: 275383 - DNA, 27 bp, Artificial Sequence
  Description of Artificial Sequence: Synthetic oligonucleotide
ggacttacagaaggtcctggagcggga

SEQ ID NO: 275384 - DNA, 27 bp, Artificial Sequence
  Description of Artificial Sequence: Synthetic oligonucleotide
gacttacagaaggtcctggagcgggag

SEQ ID NO: 275385 - DNA, 27 bp, Artificial Sequence
  Description of Artificial Sequence: Synthetic oligonucleotide
acttacagaaggtcctggagcgggagc

SEQ ID NO: 275386 - DNA, 26 bp, Artificial Sequence
  Description of Artificial Sequence: Synthetic oligonucleotide
cttacagaaggtcctggagcgggagc

SEQ ID NO: 275387 - DNA, 27 bp, Artificial Sequence
  Description of Artificial Sequence: Synthetic oligonucleotide
ttacagaaggtcctggagcgggagcca

SEQ ID NO: 275388 - DNA, 26 bp, Artificial Sequence
  Description of Artificial Sequence: Synthetic oligonucleotide
tacagaaggtcctggagcgggagcca

SEQ ID NO: 275389 - DNA, 25 bp, Artificial Sequence
  Description of Artificial Sequence: Synthetic oligonucleotide
acagaaggtcctggagcgggagcca

SEQ ID NO: 275390 - DNA, 24 bp, Artificial Sequence
  Description of Artificial Sequence: Synthetic oligonucleotide
cagaaggtcctggagcgggagcca

SEQ ID NO: 275391 - DNA, 25 bp, Artificial Sequence
  Description of Artificial Sequence: Synthetic oligonucleotide
agaaggtcctggagcgggagccaga

SEQ ID NO: 275392 - DNA, 24 bp, Artificial Sequence
  Description of Artificial Sequence: Synthetic oligonucleotide
gaaggtcctggagcgggagccaga

SEQ ID NO: 275393 - DNA, 24 bp, Artificial Sequence
  Description of Artificial Sequence: Synthetic oligonucleotide
aaggtcctggagcgggagccagac

SEQ ID NO: 275394 - DNA, 23 bp, Artificial Sequence
  Description of Artificial Sequence: Synthetic oligonucleotide
aggtcctggagcgggagccagac

SEQ ID NO: 275395 - DNA, 22 bp, Artificial Sequence
  Description of Artificial Sequence: Synthetic oligonucleotide
ggtcctggagcgggagccagac

SEQ ID NO: 275396 - DNA, 23 bp, Artificial Sequence
  Description of Artificial Sequence: Synthetic oligonucleotide
gtcctggagcgggagccagacga

SEQ ID NO: 275397 - DNA, 23 bp, Artificial Sequence
  Description of Artificial Sequence: Synthetic oligonucleotide
tcctggagcgggagccagacgag

SEQ ID NO: 275398 - DNA, 22 bp, Artificial Sequence
  Description of Artificial Sequence: Synthetic oligonucleotide
cctggagcgggagccagacgag

SEQ ID NO: 275399 - DNA, 24 bp, Artificial Sequence
  Description of Artificial Sequence: Synthetic oligonucleotide
ctggagcgggagccagacgaggat

SEQ ID NO: 275400 - DNA, 24 bp, Artificial Sequence
  Description of Artificial Sequence: Synthetic oligonucleotide
tggagcgggagccagacgaggatg

SEQ ID NO: 275401 - DNA, 23 bp, Artificial Sequence
  Description of Artificial Sequence: Synthetic oligonucleotide
ggagcgggagccagacgaggatg

SEQ ID NO: 275402 - DNA, 23 bp, Artificial Sequence
  Description of Artificial Sequence: Synthetic oligonucleotide
gagcgggagccagacgaggatgc

SEQ ID NO: 275403 - DNA, 24 bp, Artificial Sequence
  Description of Artificial Sequence: Synthetic oligonucleotide
agcgggagccagacgaggatgcct

SEQ ID NO: 275404 - DNA, 23 bp, Artificial Sequence
  Description of Artificial Sequence: Synthetic oligonucleotide
gcgggagccagacgaggatgcct

SEQ ID NO: 275405 - DNA, 23 bp, Artificial Sequence
  Description of Artificial Sequence: Synthetic oligonucleotide
cgggagccagacgaggatgcctg

SEQ ID NO: 275406 - DNA, 23 bp, Artificial Sequence
  Description of Artificial Sequence: Synthetic oligonucleotide
gggagccagacgaggatgcctgc

SEQ ID NO: 275407 - DNA, 25 bp, Artificial Sequence
  Description of Artificial Sequence: Synthetic oligonucleotide
ggagccagacgaggatgcctgccat

SEQ ID NO: 275408 - DNA, 25 bp, Artificial Sequence
  Description of Artificial Sequence: Synthetic oligonucleotide
gagccagacgaggatgcctgccatg

SEQ ID NO: 275409 - DNA, 25 bp, Artificial Sequence
  Description of Artificial Sequence: Synthetic oligonucleotide
agccagacgaggatgcctgccatgc

SEQ ID NO: 275410 - DNA, 24 bp, Artificial Sequence
  Description of Artificial Sequence: Synthetic oligonucleotide
gccagacgaggatgcctgccatgc

SEQ ID NO: 275411 - DNA, 24 bp, Artificial Sequence
  Description of Artificial Sequence: Synthetic oligonucleotide
ccagacgaggatgcctgccatgcc

SEQ ID NO: 275412 - DNA, 26 bp, Artificial Sequence
  Description of Artificial Sequence: Synthetic oligonucleotide
cagacgaggatgcctgccatgccctt

SEQ ID NO: 275413 - DNA, 26 bp, Artificial Sequence
  Description of Artificial Sequence: Synthetic oligonucleotide
agacgaggatgcctgccatgcccttc

SEQ ID NO: 275414 - DNA, 25 bp, Artificial Sequence
  Description of Artificial Sequence: Synthetic oligonucleotide
gacgaggatgcctgccatgcccttc

SEQ ID NO: 275415 - DNA, 26 bp, Artificial Sequence
  Description of Artificial Sequence: Synthetic oligonucleotide
acgaggatgcctgccatgcccttcct

SEQ ID NO: 275416 - DNA, 25 bp, Artificial Sequence
  Description of Artificial Sequence: Synthetic oligonucleotide
cgaggatgcctgccatgcccttcct

SEQ ID NO: 275417 - DNA, 26 bp, Artificial Sequence
  Description of Artificial Sequence: Synthetic oligonucleotide
gaggatgcctgccatgcccttcctga

SEQ ID NO: 275418 - DNA, 26 bp, Artificial Sequence
  Description of Artificial Sequence: Synthetic oligonucleotide
aggatgcctgccatgcccttcctgag

SEQ ID NO: 275419 - DNA, 25 bp, Artificial Sequence
  Description of Artificial Sequence: Synthetic oligonucleotide
ggatgcctgccatgcccttcctgag

SEQ ID NO: 275420 - DNA, 25 bp, Artificial Sequence
  Description of Artificial Sequence: Synthetic oligonucleotide
gatgcctgccatgcccttcctgagc

SEQ ID NO: 275421 - DNA, 26 bp, Artificial Sequence
  Description of Artificial Sequence: Synthetic oligonucleotide
atgcctgccatgcccttcctgagcca

SEQ ID NO: 275422 - DNA, 25 bp, Artificial Sequence
  Description of Artificial Sequence: Synthetic oligonucleotide
tgcctgccatgcccttcctgagcca

SEQ ID NO: 275423 - DNA, 24 bp, Artificial Sequence
  Description of Artificial Sequence: Synthetic oligonucleotide
gcctgccatgcccttcctgagcca

SEQ ID NO: 275424 - DNA, 24 bp, Artificial Sequence
  Description of Artificial Sequence: Synthetic oligonucleotide
cctgccatgcccttcctgagccag

SEQ ID NO: 275425 - DNA, 24 bp, Artificial Sequence
  Description of Artificial Sequence: Synthetic oligonucleotide
ctgccatgcccttcctgagccagc

SEQ ID NO: 275426 - DNA, 25 bp, Artificial Sequence
  Description of Artificial Sequence: Synthetic oligonucleotide
tgccatgcccttcctgagccagcca

SEQ ID NO: 275427 - DNA, 24 bp, Artificial Sequence
  Description of Artificial Sequence: Synthetic oligonucleotide
gccatgcccttcctgagccagcca

SEQ ID NO: 275428 - DNA, 25 bp, Artificial Sequence
  Description of Artificial Sequence: Synthetic oligonucleotide
ccatgcccttcctgagccagccact

SEQ ID NO: 275429 - DNA, 25 bp, Artificial Sequence
  Description of Artificial Sequence: Synthetic oligonucleotide
catgcccttcctgagccagccactg

SEQ ID NO: 275430 - DNA, 25 bp, Artificial Sequence
  Description of Artificial Sequence: Synthetic oligonucleotide
atgcccttcctgagccagccactgc

SEQ ID NO: 275431 - DNA, 24 bp, Artificial Sequence
  Description of Artificial Sequence: Synthetic oligonucleotide
tgcccttcctgagccagccactgc

SEQ ID NO: 275432 - DNA, 23 bp, Artificial Sequence
  Description of Artificial Sequence: Synthetic oligonucleotide
gcccttcctgagccagccactgc

SEQ ID NO: 275433 - DNA, 23 bp, Artificial Sequence
  Description of Artificial Sequence: Synthetic oligonucleotide
cccttcctgagccagccactgcc

SEQ ID NO: 275434 - DNA, 24 bp, Artificial Sequence
  Description of Artificial Sequence: Synthetic oligonucleotide
ccttcctgagccagccactgccga

SEQ ID NO: 275435 - DNA, 25 bp, Artificial Sequence
  Description of Artificial Sequence: Synthetic oligonucleotide
cttcctgagccagccactgccgaca

SEQ ID NO: 275436 - DNA, 26 bp, Artificial Sequence
  Description of Artificial Sequence: Synthetic oligonucleotide
ttcctgagccagccactgccgacaga

SEQ ID NO: 275437 - DNA, 25 bp, Artificial Sequence
  Description of Artificial Sequence: Synthetic oligonucleotide
tcctgagccagccactgccgacaga

SEQ ID NO: 275438 - DNA, 24 bp, Artificial Sequence
  Description of Artificial Sequence: Synthetic oligonucleotide
cctgagccagccactgccgacaga

SEQ ID NO: 275439 - DNA, 24 bp, Artificial Sequence
  Description of Artificial Sequence: Synthetic oligonucleotide
ctgagccagccactgccgacagag

SEQ ID NO: 275440 - DNA, 25 bp, Artificial Sequence
  Description of Artificial Sequence: Synthetic oligonucleotide
tgagccagccactgccgacagagct

SEQ ID NO: 275441 - DNA, 24 bp, Artificial Sequence
  Description of Artificial Sequence: Synthetic oligonucleotide
gagccagccactgccgacagagct

SEQ ID NO: 275442 - DNA, 24 bp, Artificial Sequence
  Description of Artificial Sequence: Synthetic oligonucleotide
agccagccactgccgacagagctg

SEQ ID NO: 275443 - DNA, 23 bp, Artificial Sequence
  Description of Artificial Sequence: Synthetic oligonucleotide
gccagccactgccgacagagctg

SEQ ID NO: 275444 - DNA, 24 bp, Artificial Sequence
  Description of Artificial Sequence: Synthetic oligonucleotide
ccagccactgccgacagagctgga

SEQ ID NO: 275445 - DNA, 26 bp, Artificial Sequence
  Description of Artificial Sequence: Synthetic oligonucleotide
cagccactgccgacagagctggagaa

SEQ ID NO: 275446 - DNA, 27 bp, Artificial Sequence
  Description of Artificial Sequence: Synthetic oligonucleotide
agccactgccgacagagctggagaaga

SEQ ID NO: 275447 - DNA, 27 bp, Artificial Sequence
  Description of Artificial Sequence: Synthetic oligonucleotide
gccactgccgacagagctggagaagat

SEQ ID NO: 275448 - DNA, 28 bp, Artificial Sequence
  Description of Artificial Sequence: Synthetic oligonucleotide
ccactgccgacagagctggagaagatag

SEQ ID NO: 275449 - DNA, 29 bp, Artificial Sequence
  Description of Artificial Sequence: Synthetic oligonucleotide
cactgccgacagagctggagaagatagtg

SEQ ID NO: 275450 - DNA, 30 bp, Artificial Sequence
  Description of Artificial Sequence: Synthetic oligonucleotide
actgccgacagagctggagaagatagtgag

SEQ ID NO: 275451 - DNA, 29 bp, Artificial Sequence
  Description of Artificial Sequence: Synthetic oligonucleotide
ctgccgacagagctggagaagatagtgag

SEQ ID NO: 275452 - DNA, 29 bp, Artificial Sequence
  Description of Artificial Sequence: Synthetic oligonucleotide
tgccgacagagctggagaagatagtgagc

SEQ ID NO: 275453 - DNA, 28 bp, Artificial Sequence
  Description of Artificial Sequence: Synthetic oligonucleotide
gccgacagagctggagaagatagtgagc

SEQ ID NO: 275454 - DNA, 29 bp, Artificial Sequence
  Description of Artificial Sequence: Synthetic oligonucleotide
ccgacagagctggagaagatagtgagctc

SEQ ID NO: 275455 - DNA, 30 bp, Artificial Sequence
  Description of Artificial Sequence: Synthetic oligonucleotide
cgacagagctggagaagatagtgagctctc

SEQ ID NO: 275456 - DNA, 31 bp, Artificial Sequence
  Description of Artificial Sequence: Synthetic oligonucleotide
gacagagctggagaagatagtgagctctctc

SEQ ID NO: 275457 - DNA, 32 bp, Artificial Sequence
  Description of Artificial Sequence: Synthetic oligonucleotide
acagagctggagaagatagtgagctctctctg

SEQ ID NO: 275458 - DNA, 31 bp, Artificial Sequence
  Description of Artificial Sequence: Synthetic oligonucleotide
cagagctggagaagatagtgagctctctctg

SEQ ID NO: 275459 - DNA, 31 bp, Artificial Sequence
  Description of Artificial Sequence: Synthetic oligonucleotide
agagctggagaagatagtgagctctctctgg

SEQ ID NO: 275460 - DNA, 30 bp, Artificial Sequence
  Description of Artificial Sequence: Synthetic oligonucleotide
gagctggagaagatagtgagctctctctgg

SEQ ID NO: 275461 - DNA, 30 bp, Artificial Sequence
  Description of Artificial Sequence: Synthetic oligonucleotide
agctggagaagatagtgagctctctctggg

SEQ ID NO: 275462 - DNA, 29 bp, Artificial Sequence
  Description of Artificial Sequence: Synthetic oligonucleotide
gctggagaagatagtgagctctctctggg

SEQ ID NO: 275463 - DNA, 29 bp, Artificial Sequence
  Description of Artificial Sequence: Synthetic oligonucleotide
ctggagaagatagtgagctctctctgggg

SEQ ID NO: 275464 - DNA, 29 bp, Artificial Sequence
  Description of Artificial Sequence: Synthetic oligonucleotide
tggagaagatagtgagctctctctggggc

SEQ ID NO: 275465 - DNA, 28 bp, Artificial Sequence
  Description of Artificial Sequence: Synthetic oligonucleotide
ggagaagatagtgagctctctctggggc

SEQ ID NO: 275466 - DNA, 28 bp, Artificial Sequence
  Description of Artificial Sequence: Synthetic oligonucleotide
gagaagatagtgagctctctctggggcc

SEQ ID NO: 275467 - DNA, 29 bp, Artificial Sequence
  Description of Artificial Sequence: Synthetic oligonucleotide
agaagatagtgagctctctctggggccag

SEQ ID NO: 275468 - DNA, 28 bp, Artificial Sequence
  Description of Artificial Sequence: Synthetic oligonucleotide
gaagatagtgagctctctctggggccag

SEQ ID NO: 275469 - DNA, 28 bp, Artificial Sequence
  Description of Artificial Sequence: Synthetic oligonucleotide
aagatagtgagctctctctggggccagc

SEQ ID NO: 275470 - DNA, 27 bp, Artificial Sequence
  Description of Artificial Sequence: Synthetic oligonucleotide
agatagtgagctctctctggggccagc

SEQ ID NO: 275471 - DNA, 26 bp, Artificial Sequence
  Description of Artificial Sequence: Synthetic oligonucleotide
gatagtgagctctctctggggccagc

SEQ ID NO: 275472 - DNA, 26 bp, Artificial Sequence
  Description of Artificial Sequence: Synthetic oligonucleotide
atagtgagctctctctggggccagcg

SEQ ID NO: 275473 - DNA, 25 bp, Artificial Sequence
  Description of Artificial Sequence: Synthetic oligonucleotide
tagtgagctctctctggggccagcg

SEQ ID NO: 275474 - DNA, 24 bp, Artificial Sequence
  Description of Artificial Sequence: Synthetic oligonucleotide
agtgagctctctctggggccagcg

SEQ ID NO: 275475 - DNA, 23 bp, Artificial Sequence
  Description of Artificial Sequence: Synthetic oligonucleotide
gtgagctctctctggggccagcg

SEQ ID NO: 275476 - DNA, 24 bp, Artificial Sequence
  Description of Artificial Sequence: Synthetic oligonucleotide
tgagctctctctggggccagcgga

SEQ ID NO: 275477 - DNA, 23 bp, Artificial Sequence
  Description of Artificial Sequence: Synthetic oligonucleotide
gagctctctctggggccagcgga

SEQ ID NO: 275478 - DNA, 23 bp, Artificial Sequence
  Description of Artificial Sequence: Synthetic oligonucleotide
agctctctctggggccagcggag

SEQ ID NO: 275479 - DNA, 22 bp, Artificial Sequence
  Description of Artificial Sequence: Synthetic oligonucleotide
gctctctctggggccagcggag

SEQ ID NO: 275480 - DNA, 23 bp, Artificial Sequence
  Description of Artificial Sequence: Synthetic oligonucleotide
ctctctctggggccagcggaggt

SEQ ID NO: 275481 - DNA, 24 bp, Artificial Sequence
  Description of Artificial Sequence: Synthetic oligonucleotide
tctctctggggccagcggaggtga

SEQ ID NO: 275482 - DNA, 23 bp, Artificial Sequence
  Description of Artificial Sequence: Synthetic oligonucleotide
ctctctggggccagcggaggtga

SEQ ID NO: 275483 - DNA, 24 bp, Artificial Sequence
  Description of Artificial Sequence: Synthetic oligonucleotide
tctctggggccagcggaggtgact

SEQ ID NO: 275484 - DNA, 23 bp, Artificial Sequence
  Description of Artificial Sequence: Synthetic oligonucleotide
ctctggggccagcggaggtgact

SEQ ID NO: 275485 - DNA, 23 bp, Artificial Sequence
  Description of Artificial Sequence: Synthetic oligonucleotide
tctggggccagcggaggtgactc

SEQ ID NO: 275486 - DNA, 22 bp, Artificial Sequence
  Description of Artificial Sequence: Synthetic oligonucleotide
ctggggccagcggaggtgactc

SEQ ID NO: 275487 - DNA, 23 bp, Artificial Sequence
  Description of Artificial Sequence: Synthetic oligonucleotide
tggggccagcggaggtgactcca

SEQ ID NO: 275488 - DNA, 22 bp, Artificial Sequence
  Description of Artificial Sequence: Synthetic oligonucleotide
ggggccagcggaggtgactcca

SEQ ID NO: 275489 - DNA, 22 bp, Artificial Sequence
  Description of Artificial Sequence: Synthetic oligonucleotide
gggccagcggaggtgactccag

SEQ ID NO: 275490 - DNA, 23 bp, Artificial Sequence
  Description of Artificial Sequence: Synthetic oligonucleotide
ggccagcggaggtgactccagga

SEQ ID NO: 275491 - DNA, 24 bp, Artificial Sequence
  Description of Artificial Sequence: Synthetic oligonucleotide
gccagcggaggtgactccaggaga

SEQ ID NO: 275492 - DNA, 25 bp, Artificial Sequence
  Description of Artificial Sequence: Synthetic oligonucleotide
ccagcggaggtgactccaggagaca

SEQ ID NO: 275493 - DNA, 25 bp, Artificial Sequence
  Description of Artificial Sequence: Synthetic oligonucleotide
cagcggaggtgactccaggagacac

SEQ ID NO: 275494 - DNA, 26 bp, Artificial Sequence
  Description of Artificial Sequence: Synthetic oligonucleotide
agcggaggtgactccaggagacacca

SEQ ID NO: 275495 - DNA, 25 bp, Artificial Sequence
  Description of Artificial Sequence: Synthetic oligonucleotide
gcggaggtgactccaggagacacca

SEQ ID NO: 275496 - DNA, 25 bp, Artificial Sequence
  Description of Artificial Sequence: Synthetic oligonucleotide
cggaggtgactccaggagacaccag

SEQ ID NO: 275497 - DNA, 27 bp, Artificial Sequence
  Description of Artificial Sequence: Synthetic oligonucleotide
ggaggtgactccaggagacaccaggat

SEQ ID NO: 275498 - DNA, 27 bp, Artificial Sequence
  Description of Artificial Sequence: Synthetic oligonucleotide
gaggtgactccaggagacaccaggatg

SEQ ID NO: 275499 - DNA, 27 bp, Artificial Sequence
  Description of Artificial Sequence: Synthetic oligonucleotide
aggtgactccaggagacaccaggatgc

SEQ ID NO: 275500 - DNA, 26 bp, Artificial Sequence
  Description of Artificial Sequence: Synthetic oligonucleotide
ggtgactccaggagacaccaggatgc

SEQ ID NO: 275501 - DNA, 27 bp, Artificial Sequence
  Description of Artificial Sequence: Synthetic oligonucleotide
gtgactccaggagacaccaggatgcga

SEQ ID NO: 275502 - DNA, 27 bp, Artificial Sequence
  Description of Artificial Sequence: Synthetic oligonucleotide
tgactccaggagacaccaggatgcgag

SEQ ID NO: 275503 - DNA, 26 bp, Artificial Sequence
  Description of Artificial Sequence: Synthetic oligonucleotide
gactccaggagacaccaggatgcgag

SEQ ID NO: 275504 - DNA, 27 bp, Artificial Sequence
  Description of Artificial Sequence: Synthetic oligonucleotide
actccaggagacaccaggatgcgagca

SEQ ID NO: 275505 - DNA, 26 bp, Artificial Sequence
  Description of Artificial Sequence: Synthetic oligonucleotide
ctccaggagacaccaggatgcgagca

SEQ ID NO: 275506 - DNA, 26 bp, Artificial Sequence
  Description of Artificial Sequence: Synthetic oligonucleotide
tccaggagacaccaggatgcgagcag

SEQ ID NO: 275507 - DNA, 25 bp, Artificial Sequence
  Description of Artificial Sequence: Synthetic oligonucleotide
ccaggagacaccaggatgcgagcag

SEQ ID NO: 275508 - DNA, 25 bp, Artificial Sequence
  Description of Artificial Sequence: Synthetic oligonucleotide
caggagacaccaggatgcgagcagg

SEQ ID NO: 275509 - DNA, 26 bp, Artificial Sequence
  Description of Artificial Sequence: Synthetic oligonucleotide
aggagacaccaggatgcgagcaggga

SEQ ID NO: 275510 - DNA, 25 bp, Artificial Sequence
  Description of Artificial Sequence: Synthetic oligonucleotide
ggagacaccaggatgcgagcaggga

SEQ ID NO: 275511 - DNA, 26 bp, Artificial Sequence
  Description of Artificial Sequence: Synthetic oligonucleotide
gagacaccaggatgcgagcagggaca

SEQ ID NO: 275512 - DNA, 27 bp, Artificial Sequence
  Description of Artificial Sequence: Synthetic oligonucleotide
agacaccaggatgcgagcagggacaga

SEQ ID NO: 275513 - DNA, 26 bp, Artificial Sequence
  Description of Artificial Sequence: Synthetic oligonucleotide
gacaccaggatgcgagcagggacaga

SEQ ID NO: 275514 - DNA, 27 bp, Artificial Sequence
  Description of Artificial Sequence: Synthetic oligonucleotide
acaccaggatgcgagcagggacagaga

SEQ ID NO: 275515 - DNA, 26 bp, Artificial Sequence
  Description of Artificial Sequence: Synthetic oligonucleotide
caccaggatgcgagcagggacagaga

SEQ ID NO: 275516 - DNA, 26 bp, Artificial Sequence
  Description of Artificial Sequence: Synthetic oligonucleotide
accaggatgcgagcagggacagagac

SEQ ID NO: 275517 - DNA, 25 bp, Artificial Sequence
  Description of Artificial Sequence: Synthetic oligonucleotide
ccaggatgcgagcagggacagagac

SEQ ID NO: 275518 - DNA, 25 bp, Artificial Sequence
  Description of Artificial Sequence: Synthetic oligonucleotide
caggatgcgagcagggacagagacg

SEQ ID NO: 275519 - DNA, 26 bp, Artificial Sequence
  Description of Artificial Sequence: Synthetic oligonucleotide
aggatgcgagcagggacagagacggt

SEQ ID NO: 275520 - DNA, 25 bp, Artificial Sequence
  Description of Artificial Sequence: Synthetic oligonucleotide
ggatgcgagcagggacagagacggt

SEQ ID NO: 275521 - DNA, 26 bp, Artificial Sequence
  Description of Artificial Sequence: Synthetic oligonucleotide
gatgcgagcagggacagagacggtga

SEQ ID NO: 275522 - DNA, 27 bp, Artificial Sequence
  Description of Artificial Sequence: Synthetic oligonucleotide
atgcgagcagggacagagacggtgaga

SEQ ID NO: 275523 - DNA, 31 bp, Artificial Sequence
  Description of Artificial Sequence: Synthetic oligonucleotide
aagggtcaaagacagagtggtcgtcatggtc

SEQ ID NO: 275524 - DNA, 30 bp, Artificial Sequence
  Description of Artificial Sequence: Synthetic oligonucleotide
agggtcaaagacagagtggtcgtcatggtc

SEQ ID NO: 275525 - DNA, 29 bp, Artificial Sequence
  Description of Artificial Sequence: Synthetic oligonucleotide
gggtcaaagacagagtggtcgtcatggtc

SEQ ID NO: 275526 - DNA, 29 bp, Artificial Sequence
  Description of Artificial Sequence: Synthetic oligonucleotide
ggtcaaagacagagtggtcgtcatggtcg

SEQ ID NO: 275527 - DNA, 30 bp, Artificial Sequence
  Description of Artificial Sequence: Synthetic oligonucleotide
gtcaaagacagagtggtcgtcatggtcgtg

SEQ ID NO: 275528 - DNA, 30 bp, Artificial Sequence
  Description of Artificial Sequence: Synthetic oligonucleotide
tcaaagacagagtggtcgtcatggtcgtgg

SEQ ID NO: 275529 - DNA, 29 bp, Artificial Sequence
  Description of Artificial Sequence: Synthetic oligonucleotide
caaagacagagtggtcgtcatggtcgtgg

SEQ ID NO: 275530 - DNA, 30 bp, Artificial Sequence
  Description of Artificial Sequence: Synthetic oligonucleotide
aaagacagagtggtcgtcatggtcgtggag

SEQ ID NO: 275531 - DNA, 29 bp, Artificial Sequence
  Description of Artificial Sequence: Synthetic oligonucleotide
aagacagagtggtcgtcatggtcgtggag

SEQ ID NO: 275532 - DNA, 28 bp, Artificial Sequence
  Description of Artificial Sequence: Synthetic oligonucleotide
agacagagtggtcgtcatggtcgtggag

SEQ ID NO: 275533 - DNA, 27 bp, Artificial Sequence
  Description of Artificial Sequence: Synthetic oligonucleotide
gacagagtggtcgtcatggtcgtggag

SEQ ID NO: 275534 - DNA, 27 bp, Artificial Sequence
  Description of Artificial Sequence: Synthetic oligonucleotide
acagagtggtcgtcatggtcgtggagg

SEQ ID NO: 275535 - DNA, 27 bp, Artificial Sequence
  Description of Artificial Sequence: Synthetic oligonucleotide
cagagtggtcgtcatggtcgtggaggt

SEQ ID NO: 275536 - DNA, 27 bp, Artificial Sequence
  Description of Artificial Sequence: Synthetic oligonucleotide
agagtggtcgtcatggtcgtggaggtg

SEQ ID NO: 275537 - DNA, 26 bp, Artificial Sequence
  Description of Artificial Sequence: Synthetic oligonucleotide
gagtggtcgtcatggtcgtggaggtg

SEQ ID NO: 275538 - DNA, 26 bp, Artificial Sequence
  Description of Artificial Sequence: Synthetic oligonucleotide
agtggtcgtcatggtcgtggaggtgg

SEQ ID NO: 275539 - DNA, 25 bp, Artificial Sequence
  Description of Artificial Sequence: Synthetic oligonucleotide
gtggtcgtcatggtcgtggaggtgg

SEQ ID NO: 275540 - DNA, 27 bp, Artificial Sequence
  Description of Artificial Sequence: Synthetic oligonucleotide
tggtcgtcatggtcgtggaggtgggaa

SEQ ID NO: 275541 - DNA, 26 bp, Artificial Sequence
  Description of Artificial Sequence: Synthetic oligonucleotide
ggtcgtcatggtcgtggaggtgggaa

SEQ ID NO: 275542 - DNA, 27 bp, Artificial Sequence
  Description of Artificial Sequence: Synthetic oligonucleotide
gtcgtcatggtcgtggaggtgggaaga

SEQ ID NO: 275543 - DNA, 28 bp, Artificial Sequence
  Description of Artificial Sequence: Synthetic oligonucleotide
tcgtcatggtcgtggaggtgggaagaag

SEQ ID NO: 275544 - DNA, 27 bp, Artificial Sequence
  Description of Artificial Sequence: Synthetic oligonucleotide
cgtcatggtcgtggaggtgggaagaag

SEQ ID NO: 275545 - DNA, 27 bp, Artificial Sequence
  Description of Artificial Sequence: Synthetic oligonucleotide
gtcatggtcgtggaggtgggaagaagg

SEQ ID NO: 275546 - DNA, 29 bp, Artificial Sequence
  Description of Artificial Sequence: Synthetic oligonucleotide
tcatggtcgtggaggtgggaagaaggatc

SEQ ID NO: 275547 - DNA, 28 bp, Artificial Sequence
  Description of Artificial Sequence: Synthetic oligonucleotide
catggtcgtggaggtgggaagaaggatc

SEQ ID NO: 275548 - DNA, 29 bp, Artificial Sequence
  Description of Artificial Sequence: Synthetic oligonucleotide
atggtcgtggaggtgggaagaaggatcac

SEQ ID NO: 275549 - DNA, 28 bp, Artificial Sequence
  Description of Artificial Sequence: Synthetic oligonucleotide
tggtcgtggaggtgggaagaaggatcac

SEQ ID NO: 275550 - DNA, 27 bp, Artificial Sequence
  Description of Artificial Sequence: Synthetic oligonucleotide
ggtcgtggaggtgggaagaaggatcac

SEQ ID NO: 275551 - DNA, 29 bp, Artificial Sequence
  Description of Artificial Sequence: Synthetic oligonucleotide
gtcgtggaggtgggaagaaggatcacaag

SEQ ID NO: 275552 - DNA, 29 bp, Artificial Sequence
  Description of Artificial Sequence: Synthetic oligonucleotide
tcgtggaggtgggaagaaggatcacaagg

SEQ ID NO: 275553 - DNA, 28 bp, Artificial Sequence
  Description of Artificial Sequence: Synthetic oligonucleotide
cgtggaggtgggaagaaggatcacaagg

SEQ ID NO: 275554 - DNA, 29 bp, Artificial Sequence
  Description of Artificial Sequence: Synthetic oligonucleotide
gtggaggtgggaagaaggatcacaaggac

SEQ ID NO: 275555 - DNA, 31 bp, Artificial Sequence
  Description of Artificial Sequence: Synthetic oligonucleotide
tggaggtgggaagaaggatcacaaggacatg

SEQ ID NO: 275556 - DNA, 30 bp, Artificial Sequence
  Description of Artificial Sequence: Synthetic oligonucleotide
ggaggtgggaagaaggatcacaaggacatg

SEQ ID NO: 275557 - DNA, 35 bp, Artificial Sequence
  Description of Artificial Sequence: Synthetic oligonucleotide
gaggtgggaagaaggatcacaaggacatgaaaaag

SEQ ID NO: 275558 - DNA, 41 bp, Artificial Sequence
  Description of Artificial Sequence: Synthetic oligonucleotide
aggtgggaagaaggatcacaaggacatgaaaaagaattatg

SEQ ID NO: 275559 - DNA, 40 bp, Artificial Sequence
  Description of Artificial Sequence: Synthetic oligonucleotide
ggtgggaagaaggatcacaaggacatgaaaaagaattatg

SEQ ID NO: 275560 - DNA, 42 bp, Artificial Sequence
  Description of Artificial Sequence: Synthetic oligonucleotide
gtgggaagaaggatcacaaggacatgaaaaagaattatgaac

SEQ ID NO: 275561 - DNA, 42 bp, Artificial Sequence
  Description of Artificial Sequence: Synthetic oligonucleotide
tgggaagaaggatcacaaggacatgaaaaagaattatgaacc

SEQ ID NO: 275562 - DNA, 41 bp, Artificial Sequence
  Description of Artificial Sequence: Synthetic oligonucleotide
gggaagaaggatcacaaggacatgaaaaagaattatgaacc

SEQ ID NO: 275563 - DNA, 42 bp, Artificial Sequence
  Description of Artificial Sequence: Synthetic oligonucleotide
ggaagaaggatcacaaggacatgaaaaagaattatgaacctg

SEQ ID NO: 275564 - DNA, 42 bp, Artificial Sequence
  Description of Artificial Sequence: Synthetic oligonucleotide
gaagaaggatcacaaggacatgaaaaagaattatgaacctgc

SEQ ID NO: 275565 - DNA, 43 bp, Artificial Sequence
  Description of Artificial Sequence: Synthetic oligonucleotide
aagaaggatcacaaggacatgaaaaagaattatgaacctgctg

SEQ ID NO: 275566 - DNA, 42 bp, Artificial Sequence
  Description of Artificial Sequence: Synthetic oligonucleotide
agaaggatcacaaggacatgaaaaagaattatgaacctgctg

SEQ ID NO: 275567 - DNA, 41 bp, Artificial Sequence
  Description of Artificial Sequence: Synthetic oligonucleotide
gaaggatcacaaggacatgaaaaagaattatgaacctgctg

SEQ ID NO: 275568 - DNA, 43 bp, Artificial Sequence
  Description of Artificial Sequence: Synthetic oligonucleotide
aaggatcacaaggacatgaaaaagaattatgaacctgctgtac

SEQ ID NO: 275569 - DNA, 42 bp, Artificial Sequence
  Description of Artificial Sequence: Synthetic oligonucleotide
aggatcacaaggacatgaaaaagaattatgaacctgctgtac

SEQ ID NO: 275570 - DNA, 41 bp, Artificial Sequence
  Description of Artificial Sequence: Synthetic oligonucleotide
ggatcacaaggacatgaaaaagaattatgaacctgctgtac

SEQ ID NO: 275571 - DNA, 41 bp, Artificial Sequence
  Description of Artificial Sequence: Synthetic oligonucleotide
gatcacaaggacatgaaaaagaattatgaacctgctgtacc

SEQ ID NO: 275572 - DNA, 43 bp, Artificial Sequence
  Description of Artificial Sequence: Synthetic oligonucleotide
atcacaaggacatgaaaaagaattatgaacctgctgtaccaag

SEQ ID NO: 275573 - DNA, 42 bp, Artificial Sequence
  Description of Artificial Sequence: Synthetic oligonucleotide
tcacaaggacatgaaaaagaattatgaacctgctgtaccaag

SEQ ID NO: 275574 - DNA, 41 bp, Artificial Sequence
  Description of Artificial Sequence: Synthetic oligonucleotide
cacaaggacatgaaaaagaattatgaacctgctgtaccaag

SEQ ID NO: 275575 - DNA, 43 bp, Artificial Sequence
  Description of Artificial Sequence: Synthetic oligonucleotide
acaaggacatgaaaaagaattatgaacctgctgtaccaagtag

SEQ ID NO: 275576 - DNA, 42 bp, Artificial Sequence
  Description of Artificial Sequence: Synthetic oligonucleotide
caaggacatgaaaaagaattatgaacctgctgtaccaagtag

SEQ ID NO: 275577 - DNA, 43 bp, Artificial Sequence
  Description of Artificial Sequence: Synthetic oligonucleotide
aaggacatgaaaaagaattatgaacctgctgtaccaagtagag

SEQ ID NO: 275578 - DNA, 42 bp, Artificial Sequence
  Description of Artificial Sequence: Synthetic oligonucleotide
aggacatgaaaaagaattatgaacctgctgtaccaagtagag

SEQ ID NO: 275579 - DNA, 41 bp, Artificial Sequence
  Description of Artificial Sequence: Synthetic oligonucleotide
ggacatgaaaaagaattatgaacctgctgtaccaagtagag

SEQ ID NO: 275580 - DNA, 42 bp, Artificial Sequence
  Description of Artificial Sequence: Synthetic oligonucleotide
gacatgaaaaagaattatgaacctgctgtaccaagtagagtg

SEQ ID NO: 275581 - DNA, 42 bp, Artificial Sequence
  Description of Artificial Sequence: Synthetic oligonucleotide
acatgaaaaagaattatgaacctgctgtaccaagtagagtgg

SEQ ID NO: 275582 - DNA, 41 bp, Artificial Sequence
  Description of Artificial Sequence: Synthetic oligonucleotide
catgaaaaagaattatgaacctgctgtaccaagtagagtgg

SEQ ID NO: 275583 - DNA, 41 bp, Artificial Sequence
  Description of Artificial Sequence: Synthetic oligonucleotide
atgaaaaagaattatgaacctgctgtaccaagtagagtggg

SEQ ID NO: 275584 - DNA, 40 bp, Artificial Sequence
  Description of Artificial Sequence: Synthetic oligonucleotide
tgaaaaagaattatgaacctgctgtaccaagtagagtggg

SEQ ID NO: 275585 - DNA, 39 bp, Artificial Sequence
  Description of Artificial Sequence: Synthetic oligonucleotide
gaaaaagaattatgaacctgctgtaccaagtagagtggg

SEQ ID NO: 275586 - DNA, 39 bp, Artificial Sequence
  Description of Artificial Sequence: Synthetic oligonucleotide
aaaaagaattatgaacctgctgtaccaagtagagtgggc

SEQ ID NO: 275587 - DNA, 38 bp, Artificial Sequence
  Description of Artificial Sequence: Synthetic oligonucleotide
aaaagaattatgaacctgctgtaccaagtagagtgggc

SEQ ID NO: 275588 - DNA, 37 bp, Artificial Sequence
  Description of Artificial Sequence: Synthetic oligonucleotide
aaagaattatgaacctgctgtaccaagtagagtgggc

SEQ ID NO: 275589 - DNA, 36 bp, Artificial Sequence
  Description of Artificial Sequence: Synthetic oligonucleotide
aagaattatgaacctgctgtaccaagtagagtgggc

SEQ ID NO: 275590 - DNA, 35 bp, Artificial Sequence
  Description of Artificial Sequence: Synthetic oligonucleotide
agaattatgaacctgctgtaccaagtagagtgggc

SEQ ID NO: 275591 - DNA, 34 bp, Artificial Sequence
  Description of Artificial Sequence: Synthetic oligonucleotide
gaattatgaacctgctgtaccaagtagagtgggc

SEQ ID NO: 275592 - DNA, 39 bp, Artificial Sequence
  Description of Artificial Sequence: Synthetic oligonucleotide
aattatgaacctgctgtaccaagtagagtgggcaaaaag

SEQ ID NO: 275593 - DNA, 38 bp, Artificial Sequence
  Description of Artificial Sequence: Synthetic oligonucleotide
attatgaacctgctgtaccaagtagagtgggcaaaaag

SEQ ID NO: 275594 - DNA, 37 bp, Artificial Sequence
  Description of Artificial Sequence: Synthetic oligonucleotide
ttatgaacctgctgtaccaagtagagtgggcaaaaag

SEQ ID NO: 275595 - DNA, 36 bp, Artificial Sequence
  Description of Artificial Sequence: Synthetic oligonucleotide
tatgaacctgctgtaccaagtagagtgggcaaaaag

SEQ ID NO: 275596 - DNA, 35 bp, Artificial Sequence
  Description of Artificial Sequence: Synthetic oligonucleotide
atgaacctgctgtaccaagtagagtgggcaaaaag

SEQ ID NO: 275597 - DNA, 34 bp, Artificial Sequence
  Description of Artificial Sequence: Synthetic oligonucleotide
tgaacctgctgtaccaagtagagtgggcaaaaag

SEQ ID NO: 275598 - DNA, 33 bp, Artificial Sequence
  Description of Artificial Sequence: Synthetic oligonucleotide
gaacctgctgtaccaagtagagtgggcaaaaag

SEQ ID NO: 275599 - DNA, 35 bp, Artificial Sequence
  Description of Artificial Sequence: Synthetic oligonucleotide
aacctgctgtaccaagtagagtgggcaaaaagaag

SEQ ID NO: 275600 - DNA, 34 bp, Artificial Sequence
  Description of Artificial Sequence: Synthetic oligonucleotide
acctgctgtaccaagtagagtgggcaaaaagaag

SEQ ID NO: 275601 - DNA, 33 bp, Artificial Sequence
  Description of Artificial Sequence: Synthetic oligonucleotide
cctgctgtaccaagtagagtgggcaaaaagaag

SEQ ID NO: 275602 - DNA, 35 bp, Artificial Sequence
  Description of Artificial Sequence: Synthetic oligonucleotide
ctgctgtaccaagtagagtgggcaaaaagaagtag

SEQ ID NO: 275603 - DNA, 39 bp, Artificial Sequence
  Description of Artificial Sequence: Synthetic oligonucleotide
tgctgtaccaagtagagtgggcaaaaagaagtagaaaac

SEQ ID NO: 275604 - DNA, 38 bp, Artificial Sequence
  Description of Artificial Sequence: Synthetic oligonucleotide
gctgtaccaagtagagtgggcaaaaagaagtagaaaac

SEQ ID NO: 275605 - DNA, 41 bp, Artificial Sequence
  Description of Artificial Sequence: Synthetic oligonucleotide
ctgtaccaagtagagtgggcaaaaagaagtagaaaacaatg

SEQ ID NO: 275606 - DNA, 41 bp, Artificial Sequence
  Description of Artificial Sequence: Synthetic oligonucleotide
tgtaccaagtagagtgggcaaaaagaagtagaaaacaatgg

SEQ ID NO: 275607 - DNA, 40 bp, Artificial Sequence
  Description of Artificial Sequence: Synthetic oligonucleotide
gtaccaagtagagtgggcaaaaagaagtagaaaacaatgg

SEQ ID NO: 275608 - DNA, 40 bp, Artificial Sequence
  Description of Artificial Sequence: Synthetic oligonucleotide
taccaagtagagtgggcaaaaagaagtagaaaacaatggg

SEQ ID NO: 275609 - DNA, 39 bp, Artificial Sequence
  Description of Artificial Sequence: Synthetic oligonucleotide
accaagtagagtgggcaaaaagaagtagaaaacaatggg

SEQ ID NO: 275610 - DNA, 38 bp, Artificial Sequence
  Description of Artificial Sequence: Synthetic oligonucleotide
ccaagtagagtgggcaaaaagaagtagaaaacaatggg

SEQ ID NO: 275611 - DNA, 39 bp, Artificial Sequence
  Description of Artificial Sequence: Synthetic oligonucleotide
caagtagagtgggcaaaaagaagtagaaaacaatgggac

SEQ ID NO: 275612 - DNA, 39 bp, Artificial Sequence
  Description of Artificial Sequence: Synthetic oligonucleotide
aagtagagtgggcaaaaagaagtagaaaacaatgggacc

SEQ ID NO: 275613 - DNA, 38 bp, Artificial Sequence
  Description of Artificial Sequence: Synthetic oligonucleotide
agtagagtgggcaaaaagaagtagaaaacaatgggacc

SEQ ID NO: 275614 - DNA, 37 bp, Artificial Sequence
  Description of Artificial Sequence: Synthetic oligonucleotide
gtagagtgggcaaaaagaagtagaaaacaatgggacc

SEQ ID NO: 275615 - DNA, 38 bp, Artificial Sequence
  Description of Artificial Sequence: Synthetic oligonucleotide
tagagtgggcaaaaagaagtagaaaacaatgggaccag

SEQ ID NO: 275616 - DNA, 37 bp, Artificial Sequence
  Description of Artificial Sequence: Synthetic oligonucleotide
agagtgggcaaaaagaagtagaaaacaatgggaccag

SEQ ID NO: 275617 - DNA, 36 bp, Artificial Sequence
  Description of Artificial Sequence: Synthetic oligonucleotide
gagtgggcaaaaagaagtagaaaacaatgggaccag

SEQ ID NO: 275618 - DNA, 38 bp, Artificial Sequence
  Description of Artificial Sequence: Synthetic oligonucleotide
agtgggcaaaaagaagtagaaaacaatgggaccagaag

SEQ ID NO: 275619 - DNA, 37 bp, Artificial Sequence
  Description of Artificial Sequence: Synthetic oligonucleotide
gtgggcaaaaagaagtagaaaacaatgggaccagaag

SEQ ID NO: 275620 - DNA, 37 bp, Artificial Sequence
  Description of Artificial Sequence: Synthetic oligonucleotide
tgggcaaaaagaagtagaaaacaatgggaccagaagc

SEQ ID NO: 275621 - DNA, 36 bp, Artificial Sequence
  Description of Artificial Sequence: Synthetic oligonucleotide
gggcaaaaagaagtagaaaacaatgggaccagaagc

SEQ ID NO: 275622 - DNA, 37 bp, Artificial Sequence
  Description of Artificial Sequence: Synthetic oligonucleotide
ggcaaaaagaagtagaaaacaatgggaccagaagctg

SEQ ID NO: 275623 - DNA, 37 bp, Artificial Sequence
  Description of Artificial Sequence: Synthetic oligonucleotide
gcaaaaagaagtagaaaacaatgggaccagaagctgc

SEQ ID NO: 275624 - DNA, 37 bp, Artificial Sequence
  Description of Artificial Sequence: Synthetic oligonucleotide
caaaaagaagtagaaaacaatgggaccagaagctgcc

SEQ ID NO: 275625 - DNA, 38 bp, Artificial Sequence
  Description of Artificial Sequence: Synthetic oligonucleotide
aaaaagaagtagaaaacaatgggaccagaagctgccag

SEQ ID NO: 275626 - DNA, 37 bp, Artificial Sequence
  Description of Artificial Sequence: Synthetic oligonucleotide
aaaagaagtagaaaacaatgggaccagaagctgccag

SEQ ID NO: 275627 - DNA, 36 bp, Artificial Sequence
  Description of Artificial Sequence: Synthetic oligonucleotide
aaagaagtagaaaacaatgggaccagaagctgccag

SEQ ID NO: 275628 - DNA, 35 bp, Artificial Sequence
  Description of Artificial Sequence: Synthetic oligonucleotide
aagaagtagaaaacaatgggaccagaagctgccag

SEQ ID NO: 275629 - DNA, 34 bp, Artificial Sequence
  Description of Artificial Sequence: Synthetic oligonucleotide
agaagtagaaaacaatgggaccagaagctgccag

SEQ ID NO: 275630 - DNA, 33 bp, Artificial Sequence
  Description of Artificial Sequence: Synthetic oligonucleotide
gaagtagaaaacaatgggaccagaagctgccag

SEQ ID NO: 275631 - DNA, 33 bp, Artificial Sequence
  Description of Artificial Sequence: Synthetic oligonucleotide
aagtagaaaacaatgggaccagaagctgccagc

SEQ ID NO: 275632 - DNA, 32 bp, Artificial Sequence
  Description of Artificial Sequence: Synthetic oligonucleotide
agtagaaaacaatgggaccagaagctgccagc

SEQ ID NO: 275633 - DNA, 31 bp, Artificial Sequence
  Description of Artificial Sequence: Synthetic oligonucleotide
gtagaaaacaatgggaccagaagctgccagc

SEQ ID NO: 275634 - DNA, 34 bp, Artificial Sequence
  Description of Artificial Sequence: Synthetic oligonucleotide
tagaaaacaatgggaccagaagctgccagctaac

SEQ ID NO: 275635 - DNA, 33 bp, Artificial Sequence
  Description of Artificial Sequence: Synthetic oligonucleotide
agaaaacaatgggaccagaagctgccagctaac

SEQ ID NO: 275636 - DNA, 32 bp, Artificial Sequence
  Description of Artificial Sequence: Synthetic oligonucleotide
gaaaacaatgggaccagaagctgccagctaac

SEQ ID NO: 275637 - DNA, 33 bp, Artificial Sequence
  Description of Artificial Sequence: Synthetic oligonucleotide
aaaacaatgggaccagaagctgccagctaactg

SEQ ID NO: 275638 - DNA, 32 bp, Artificial Sequence
  Description of Artificial Sequence: Synthetic oligonucleotide
aaacaatgggaccagaagctgccagctaactg

SEQ ID NO: 275639 - DNA, 31 bp, Artificial Sequence
  Description of Artificial Sequence: Synthetic oligonucleotide
aacaatgggaccagaagctgccagctaactg

SEQ ID NO: 275640 - DNA, 30 bp, Artificial Sequence
  Description of Artificial Sequence: Synthetic oligonucleotide
acaatgggaccagaagctgccagctaactg

SEQ ID NO: 275641 - DNA, 29 bp, Artificial Sequence
  Description of Artificial Sequence: Synthetic oligonucleotide
caatgggaccagaagctgccagctaactg

SEQ ID NO: 275642 - DNA, 29 bp, Artificial Sequence
  Description of Artificial Sequence: Synthetic oligonucleotide
aatgggaccagaagctgccagctaactgc

SEQ ID NO: 275643 - DNA, 28 bp, Artificial Sequence
  Description of Artificial Sequence: Synthetic oligonucleotide
atgggaccagaagctgccagctaactgc

SEQ ID NO: 275644 - DNA, 27 bp, Artificial Sequence
  Description of Artificial Sequence: Synthetic oligonucleotide
tgggaccagaagctgccagctaactgc

SEQ ID NO: 275645 - DNA, 26 bp, Artificial Sequence
  Description of Artificial Sequence: Synthetic oligonucleotide
gggaccagaagctgccagctaactgc

SEQ ID NO: 275646 - DNA, 27 bp, Artificial Sequence
  Description of Artificial Sequence: Synthetic oligonucleotide
ggaccagaagctgccagctaactgcca

SEQ ID NO: 275647 - DNA, 27 bp, Artificial Sequence
  Description of Artificial Sequence: Synthetic oligonucleotide
gaccagaagctgccagctaactgccac

SEQ ID NO: 275648 - DNA, 28 bp, Artificial Sequence
  Description of Artificial Sequence: Synthetic oligonucleotide
accagaagctgccagctaactgccacag

SEQ ID NO: 275649 - DNA, 27 bp, Artificial Sequence
  Description of Artificial Sequence: Synthetic oligonucleotide
ccagaagctgccagctaactgccacag

SEQ ID NO: 275650 - DNA, 27 bp, Artificial Sequence
  Description of Artificial Sequence: Synthetic oligonucleotide
cagaagctgccagctaactgccacagg

SEQ ID NO: 275651 - DNA, 28 bp, Artificial Sequence
  Description of Artificial Sequence: Synthetic oligonucleotide
agaagctgccagctaactgccacaggtg

SEQ ID NO: 275652 - DNA, 27 bp, Artificial Sequence
  Description of Artificial Sequence: Synthetic oligonucleotide
gaagctgccagctaactgccacaggtg

SEQ ID NO: 275653 - DNA, 28 bp, Artificial Sequence
  Description of Artificial Sequence: Synthetic oligonucleotide
aagctgccagctaactgccacaggtgac

SEQ ID NO: 275654 - DNA, 27 bp, Artificial Sequence
  Description of Artificial Sequence: Synthetic oligonucleotide
agctgccagctaactgccacaggtgac

SEQ ID NO: 275655 - DNA, 27 bp, Artificial Sequence
  Description of Artificial Sequence: Synthetic oligonucleotide
gctgccagctaactgccacaggtgaca

SEQ ID NO: 275656 - DNA, 27 bp, Artificial Sequence
  Description of Artificial Sequence: Synthetic oligonucleotide
ctgccagctaactgccacaggtgacac

SEQ ID NO: 275657 - DNA, 27 bp, Artificial Sequence
  Description of Artificial Sequence: Synthetic oligonucleotide
tgccagctaactgccacaggtgacacc

SEQ ID NO: 275658 - DNA, 27 bp, Artificial Sequence
  Description of Artificial Sequence: Synthetic oligonucleotide
gccagctaactgccacaggtgacacca

SEQ ID NO: 275659 - DNA, 27 bp, Artificial Sequence
  Description of Artificial Sequence: Synthetic oligonucleotide
ccagctaactgccacaggtgacaccac

SEQ ID NO: 275660 - DNA, 28 bp, Artificial Sequence
  Description of Artificial Sequence: Synthetic oligonucleotide
cagctaactgccacaggtgacaccacac

SEQ ID NO: 275661 - DNA, 29 bp, Artificial Sequence
  Description of Artificial Sequence: Synthetic oligonucleotide
agctaactgccacaggtgacaccacacac

SEQ ID NO: 275662 - DNA, 28 bp, Artificial Sequence
  Description of Artificial Sequence: Synthetic oligonucleotide
gctaactgccacaggtgacaccacacac

SEQ ID NO: 275663 - DNA, 29 bp, Artificial Sequence
  Description of Artificial Sequence: Synthetic oligonucleotide
ctaactgccacaggtgacaccacacactc

SEQ ID NO: 275664 - DNA, 30 bp, Artificial Sequence
  Description of Artificial Sequence: Synthetic oligonucleotide
taactgccacaggtgacaccacacactcag

SEQ ID NO: 275665 - DNA, 29 bp, Artificial Sequence
  Description of Artificial Sequence: Synthetic oligonucleotide
aactgccacaggtgacaccacacactcag

SEQ ID NO: 275666 - DNA, 28 bp, Artificial Sequence
  Description of Artificial Sequence: Synthetic oligonucleotide
actgccacaggtgacaccacacactcag

SEQ ID NO: 275667 - DNA, 27 bp, Artificial Sequence
  Description of Artificial Sequence: Synthetic oligonucleotide
ctgccacaggtgacaccacacactcag

SEQ ID NO: 275668 - DNA, 28 bp, Artificial Sequence
  Description of Artificial Sequence: Synthetic oligonucleotide
tgccacaggtgacaccacacactcagag

SEQ ID NO: 275669 - DNA, 27 bp, Artificial Sequence
  Description of Artificial Sequence: Synthetic oligonucleotide
gccacaggtgacaccacacactcagag

SEQ ID NO: 275670 - DNA, 27 bp, Artificial Sequence
  Description of Artificial Sequence: Synthetic oligonucleotide
ccacaggtgacaccacacactcagagc

SEQ ID NO: 275671 - DNA, 27 bp, Artificial Sequence
  Description of Artificial Sequence: Synthetic oligonucleotide
cacaggtgacaccacacactcagagcc

SEQ ID NO: 275672 - DNA, 27 bp, Artificial Sequence
  Description of Artificial Sequence: Synthetic oligonucleotide
acaggtgacaccacacactcagagccg

SEQ ID NO: 275673 - DNA, 26 bp, Artificial Sequence
  Description of Artificial Sequence: Synthetic oligonucleotide
caggtgacaccacacactcagagccg

SEQ ID NO: 275674 - DNA, 27 bp, Artificial Sequence
  Description of Artificial Sequence: Synthetic oligonucleotide
aggtgacaccacacactcagagccggt

SEQ ID NO: 275675 - DNA, 27 bp, Artificial Sequence
  Description of Artificial Sequence: Synthetic oligonucleotide
ggtgacaccacacactcagagccggtt

SEQ ID NO: 275676 - DNA, 34 bp, Artificial Sequence
  Description of Artificial Sequence: Synthetic oligonucleotide
gtgacaccacacactcagagccggttaatattac

SEQ ID NO: 275677 - DNA, 35 bp, Artificial Sequence
  Description of Artificial Sequence: Synthetic oligonucleotide
tgacaccacacactcagagccggttaatattactg

SEQ ID NO: 275678 - DNA, 34 bp, Artificial Sequence
  Description of Artificial Sequence: Synthetic oligonucleotide
gacaccacacactcagagccggttaatattactg

SEQ ID NO: 275679 - DNA, 36 bp, Artificial Sequence
  Description of Artificial Sequence: Synthetic oligonucleotide
acaccacacactcagagccggttaatattactgaac

SEQ ID NO: 275680 - DNA, 35 bp, Artificial Sequence
  Description of Artificial Sequence: Synthetic oligonucleotide
caccacacactcagagccggttaatattactgaac

SEQ ID NO: 275681 - DNA, 38 bp, Artificial Sequence
  Description of Artificial Sequence: Synthetic oligonucleotide
accacacactcagagccggttaatattactgaacttag

SEQ ID NO: 275682 - DNA, 37 bp, Artificial Sequence
  Description of Artificial Sequence: Synthetic oligonucleotide
ccacacactcagagccggttaatattactgaacttag

SEQ ID NO: 275683 - DNA, 38 bp, Artificial Sequence
  Description of Artificial Sequence: Synthetic oligonucleotide
cacacactcagagccggttaatattactgaacttagag

SEQ ID NO: 275684 - DNA, 39 bp, Artificial Sequence
  Description of Artificial Sequence: Synthetic oligonucleotide
acacactcagagccggttaatattactgaacttagagag

SEQ ID NO: 275685 - DNA, 38 bp, Artificial Sequence
  Description of Artificial Sequence: Synthetic oligonucleotide
cacactcagagccggttaatattactgaacttagagag

SEQ ID NO: 275686 - DNA, 45 bp, Artificial Sequence
  Description of Artificial Sequence: Synthetic oligonucleotide
acactcagagccggttaatattactgaacttagagagatttaaag

SEQ ID NO: 275687 - DNA, 44 bp, Artificial Sequence
  Description of Artificial Sequence: Synthetic oligonucleotide
cactcagagccggttaatattactgaacttagagagatttaaag

SEQ ID NO: 275688 - DNA, 45 bp, Artificial Sequence
  Description of Artificial Sequence: Synthetic oligonucleotide
actcagagccggttaatattactgaacttagagagatttaaagac

SEQ ID NO: 275689 - DNA, 44 bp, Artificial Sequence
  Description of Artificial Sequence: Synthetic oligonucleotide
ctcagagccggttaatattactgaacttagagagatttaaagac

SEQ ID NO: 275690 - DNA, 47 bp, Artificial Sequence
  Description of Artificial Sequence: Synthetic oligonucleotide
tcagagccggttaatattactgaacttagagagatttaaagactttc

SEQ ID NO: 275691 - DNA, 46 bp, Artificial Sequence
  Description of Artificial Sequence: Synthetic oligonucleotide
cagagccggttaatattactgaacttagagagatttaaagactttc

SEQ ID NO: 275692 - DNA, 48 bp, Artificial Sequence
  Description of Artificial Sequence: Synthetic oligonucleotide
agagccggttaatattactgaacttagagagatttaaagactttcttc

SEQ ID NO: 275693 - DNA, 47 bp, Artificial Sequence
  Description of Artificial Sequence: Synthetic oligonucleotide
gagccggttaatattactgaacttagagagatttaaagactttcttc

SEQ ID NO: 275694 - DNA, 48 bp, Artificial Sequence
  Description of Artificial Sequence: Synthetic oligonucleotide
agccggttaatattactgaacttagagagatttaaagactttcttctc

SEQ ID NO: 275695 - DNA, 47 bp, Artificial Sequence
  Description of Artificial Sequence: Synthetic oligonucleotide
gccggttaatattactgaacttagagagatttaaagactttcttctc

SEQ ID NO: 275696 - DNA, 49 bp, Artificial Sequence
  Description of Artificial Sequence: Synthetic oligonucleotide
ccggttaatattactgaacttagagagatttaaagactttcttctcatc

SEQ ID NO: 275697 - DNA, 49 bp, Artificial Sequence
  Description of Artificial Sequence: Synthetic oligonucleotide
cggttaatattactgaacttagagagatttaaagactttcttctcatcg

SEQ ID NO: 275698 - DNA, 50 bp, Artificial Sequence
  Description of Artificial Sequence: Synthetic oligonucleotide
ggttaatattactgaacttagagagatttaaagactttcttctcatcgag

SEQ ID NO: 275699 - DNA, 50 bp, Artificial Sequence
  Description of Artificial Sequence: Synthetic oligonucleotide
gttaatattactgaacttagagagatttaaagactttcttctcatcgagg

SEQ ID NO: 275700 - DNA, 52 bp, Artificial Sequence
  Description of Artificial Sequence: Synthetic oligonucleotide
ttaatattactgaacttagagagatttaaagactttcttctcatcgaggaag

SEQ ID NO: 275701 - DNA, 51 bp, Artificial Sequence
  Description of Artificial Sequence: Synthetic oligonucleotide
taatattactgaacttagagagatttaaagactttcttctcatcgaggaag

SEQ ID NO: 275702 - DNA, 50 bp, Artificial Sequence
  Description of Artificial Sequence: Synthetic oligonucleotide
aatattactgaacttagagagatttaaagactttcttctcatcgaggaag

SEQ ID NO: 275703 - DNA, 49 bp, Artificial Sequence
  Description of Artificial Sequence: Synthetic oligonucleotide
atattactgaacttagagagatttaaagactttcttctcatcgaggaag

SEQ ID NO: 275704 - DNA, 48 bp, Artificial Sequence
  Description of Artificial Sequence: Synthetic oligonucleotide
tattactgaacttagagagatttaaagactttcttctcatcgaggaag

SEQ ID NO: 275705 - DNA, 47 bp, Artificial Sequence
  Description of Artificial Sequence: Synthetic oligonucleotide
attactgaacttagagagatttaaagactttcttctcatcgaggaag

SEQ ID NO: 275706 - DNA, 46 bp, Artificial Sequence
  Description of Artificial Sequence: Synthetic oligonucleotide
ttactgaacttagagagatttaaagactttcttctcatcgaggaag

SEQ ID NO: 275707 - DNA, 45 bp, Artificial Sequence
  Description of Artificial Sequence: Synthetic oligonucleotide
tactgaacttagagagatttaaagactttcttctcatcgaggaag

SEQ ID NO: 275708 - DNA, 44 bp, Artificial Sequence
  Description of Artificial Sequence: Synthetic oligonucleotide
actgaacttagagagatttaaagactttcttctcatcgaggaag

SEQ ID NO: 275709 - DNA, 43 bp, Artificial Sequence
  Description of Artificial Sequence: Synthetic oligonucleotide
ctgaacttagagagatttaaagactttcttctcatcgaggaag

SEQ ID NO: 275710 - DNA, 47 bp, Artificial Sequence
  Description of Artificial Sequence: Synthetic oligonucleotide
tgaacttagagagatttaaagactttcttctcatcgaggaagaaatc

SEQ ID NO: 275711 - DNA, 46 bp, Artificial Sequence
  Description of Artificial Sequence: Synthetic oligonucleotide
gaacttagagagatttaaagactttcttctcatcgaggaagaaatc

SEQ ID NO: 275712 - DNA, 50 bp, Artificial Sequence
  Description of Artificial Sequence: Synthetic oligonucleotide
aacttagagagatttaaagactttcttctcatcgaggaagaaatcattag

SEQ ID NO: 275713 - DNA, 49 bp, Artificial Sequence
  Description of Artificial Sequence: Synthetic oligonucleotide
acttagagagatttaaagactttcttctcatcgaggaagaaatcattag

SEQ ID NO: 275714 - DNA, 48 bp, Artificial Sequence
  Description of Artificial Sequence: Synthetic oligonucleotide
cttagagagatttaaagactttcttctcatcgaggaagaaatcattag

SEQ ID NO: 275715 - DNA, 52 bp, Artificial Sequence
  Description of Artificial Sequence: Synthetic oligonucleotide
ttagagagatttaaagactttcttctcatcgaggaagaaatcattagaattc

SEQ ID NO: 275716 - DNA, 51 bp, Artificial Sequence
  Description of Artificial Sequence: Synthetic oligonucleotide
tagagagatttaaagactttcttctcatcgaggaagaaatcattagaattc

SEQ ID NO: 275717 - DNA, 50 bp, Artificial Sequence
  Description of Artificial Sequence: Synthetic oligonucleotide
agagagatttaaagactttcttctcatcgaggaagaaatcattagaattc

SEQ ID NO: 275718 - DNA, 49 bp, Artificial Sequence
  Description of Artificial Sequence: Synthetic oligonucleotide
gagagatttaaagactttcttctcatcgaggaagaaatcattagaattc

SEQ ID NO: 275719 - DNA, 50 bp, Artificial Sequence
  Description of Artificial Sequence: Synthetic oligonucleotide
agagatttaaagactttcttctcatcgaggaagaaatcattagaattcag

SEQ ID NO: 275720 - DNA, 49 bp, Artificial Sequence
  Description of Artificial Sequence: Synthetic oligonucleotide
gagatttaaagactttcttctcatcgaggaagaaatcattagaattcag

SEQ ID NO: 275721 - DNA, 49 bp, Artificial Sequence
  Description of Artificial Sequence: Synthetic oligonucleotide
agatttaaagactttcttctcatcgaggaagaaatcattagaattcagg

SEQ ID NO: 275722 - DNA, 48 bp, Artificial Sequence
  Description of Artificial Sequence: Synthetic oligonucleotide
gatttaaagactttcttctcatcgaggaagaaatcattagaattcagg

SEQ ID NO: 275723 - DNA, 50 bp, Artificial Sequence
  Description of Artificial Sequence: Synthetic oligonucleotide
atttaaagactttcttctcatcgaggaagaaatcattagaattcaggaac

SEQ ID NO: 275724 - DNA, 49 bp, Artificial Sequence
  Description of Artificial Sequence: Synthetic oligonucleotide
tttaaagactttcttctcatcgaggaagaaatcattagaattcaggaac

SEQ ID NO: 275725 - DNA, 48 bp, Artificial Sequence
  Description of Artificial Sequence: Synthetic oligonucleotide
ttaaagactttcttctcatcgaggaagaaatcattagaattcaggaac

SEQ ID NO: 275726 - DNA, 47 bp, Artificial Sequence
  Description of Artificial Sequence: Synthetic oligonucleotide
taaagactttcttctcatcgaggaagaaatcattagaattcaggaac

SEQ ID NO: 275727 - DNA, 46 bp, Artificial Sequence
  Description of Artificial Sequence: Synthetic oligonucleotide
aaagactttcttctcatcgaggaagaaatcattagaattcaggaac

SEQ ID NO: 275728 - DNA, 45 bp, Artificial Sequence
  Description of Artificial Sequence: Synthetic oligonucleotide
aagactttcttctcatcgaggaagaaatcattagaattcaggaac

SEQ ID NO: 275729 - DNA, 44 bp, Artificial Sequence
  Description of Artificial Sequence: Synthetic oligonucleotide
agactttcttctcatcgaggaagaaatcattagaattcaggaac

SEQ ID NO: 275730 - DNA, 43 bp, Artificial Sequence
  Description of Artificial Sequence: Synthetic oligonucleotide
gactttcttctcatcgaggaagaaatcattagaattcaggaac

SEQ ID NO: 275731 - DNA, 47 bp, Artificial Sequence
  Description of Artificial Sequence: Synthetic oligonucleotide
actttcttctcatcgaggaagaaatcattagaattcaggaacatatg

SEQ ID NO: 275732 - DNA, 46 bp, Artificial Sequence
  Description of Artificial Sequence: Synthetic oligonucleotide
ctttcttctcatcgaggaagaaatcattagaattcaggaacatatg

SEQ ID NO: 275733 - DNA, 49 bp, Artificial Sequence
  Description of Artificial Sequence: Synthetic oligonucleotide
tttcttctcatcgaggaagaaatcattagaattcaggaacatatgaaac

SEQ ID NO: 275734 - DNA, 48 bp, Artificial Sequence
  Description of Artificial Sequence: Synthetic oligonucleotide
ttcttctcatcgaggaagaaatcattagaattcaggaacatatgaaac

SEQ ID NO: 275735 - DNA, 47 bp, Artificial Sequence
  Description of Artificial Sequence: Synthetic oligonucleotide
tcttctcatcgaggaagaaatcattagaattcaggaacatatgaaac

SEQ ID NO: 275736 - DNA, 46 bp, Artificial Sequence
  Description of Artificial Sequence: Synthetic oligonucleotide
cttctcatcgaggaagaaatcattagaattcaggaacatatgaaac

SEQ ID NO: 275737 - DNA, 46 bp, Artificial Sequence
  Description of Artificial Sequence: Synthetic oligonucleotide
ttctcatcgaggaagaaatcattagaattcaggaacatatgaaacc

SEQ ID NO: 275738 - DNA, 45 bp, Artificial Sequence
  Description of Artificial Sequence: Synthetic oligonucleotide
tctcatcgaggaagaaatcattagaattcaggaacatatgaaacc

SEQ ID NO: 275739 - DNA, 44 bp, Artificial Sequence
  Description of Artificial Sequence: Synthetic oligonucleotide
ctcatcgaggaagaaatcattagaattcaggaacatatgaaacc

SEQ ID NO: 275740 - DNA, 48 bp, Artificial Sequence
  Description of Artificial Sequence: Synthetic oligonucleotide
tcatcgaggaagaaatcattagaattcaggaacatatgaaaccaatag

SEQ ID NO: 275741 - DNA, 47 bp, Artificial Sequence
  Description of Artificial Sequence: Synthetic oligonucleotide
catcgaggaagaaatcattagaattcaggaacatatgaaaccaatag

SEQ ID NO: 275742 - DNA, 49 bp, Artificial Sequence
  Description of Artificial Sequence: Synthetic oligonucleotide
atcgaggaagaaatcattagaattcaggaacatatgaaaccaatagaag

SEQ ID NO: 275743 - DNA, 48 bp, Artificial Sequence
  Description of Artificial Sequence: Synthetic oligonucleotide
tcgaggaagaaatcattagaattcaggaacatatgaaaccaatagaag

SEQ ID NO: 275744 - DNA, 47 bp, Artificial Sequence
  Description of Artificial Sequence: Synthetic oligonucleotide
cgaggaagaaatcattagaattcaggaacatatgaaaccaatagaag

SEQ ID NO: 275745 - DNA, 51 bp, Artificial Sequence
  Description of Artificial Sequence: Synthetic oligonucleotide
gaggaagaaatcattagaattcaggaacatatgaaaccaatagaagaaatg

SEQ ID NO: 275746 - DNA, 51 bp, Artificial Sequence
  Description of Artificial Sequence: Synthetic oligonucleotide
aggaagaaatcattagaattcaggaacatatgaaaccaatagaagaaatgc

SEQ ID NO: 275747 - DNA, 50 bp, Artificial Sequence
  Description of Artificial Sequence: Synthetic oligonucleotide
ggaagaaatcattagaattcaggaacatatgaaaccaatagaagaaatgc

SEQ ID NO: 275748 - DNA, 52 bp, Artificial Sequence
  Description of Artificial Sequence: Synthetic oligonucleotide
gaagaaatcattagaattcaggaacatatgaaaccaatagaagaaatgcaag

SEQ ID NO: 275749 - DNA, 53 bp, Artificial Sequence
  Description of Artificial Sequence: Synthetic oligonucleotide
aagaaatcattagaattcaggaacatatgaaaccaatagaagaaatgcaagag

SEQ ID NO: 275750 - DNA, 52 bp, Artificial Sequence
  Description of Artificial Sequence: Synthetic oligonucleotide
agaaatcattagaattcaggaacatatgaaaccaatagaagaaatgcaagag

SEQ ID NO: 275751 - DNA, 51 bp, Artificial Sequence
  Description of Artificial Sequence: Synthetic oligonucleotide
gaaatcattagaattcaggaacatatgaaaccaatagaagaaatgcaagag

SEQ ID NO: 275752 - DNA, 51 bp, Artificial Sequence
  Description of Artificial Sequence: Synthetic oligonucleotide
aaatcattagaattcaggaacatatgaaaccaatagaagaaatgcaagagg

SEQ ID NO: 275753 - DNA, 50 bp, Artificial Sequence
  Description of Artificial Sequence: Synthetic oligonucleotide
aatcattagaattcaggaacatatgaaaccaatagaagaaatgcaagagg

SEQ ID NO: 275754 - DNA, 49 bp, Artificial Sequence
  Description of Artificial Sequence: Synthetic oligonucleotide
atcattagaattcaggaacatatgaaaccaatagaagaaatgcaagagg

SEQ ID NO: 275755 - DNA, 48 bp, Artificial Sequence
  Description of Artificial Sequence: Synthetic oligonucleotide
tcattagaattcaggaacatatgaaaccaatagaagaaatgcaagagg

SEQ ID NO: 275756 - DNA, 47 bp, Artificial Sequence
  Description of Artificial Sequence: Synthetic oligonucleotide
cattagaattcaggaacatatgaaaccaatagaagaaatgcaagagg

SEQ ID NO: 275757 - DNA, 48 bp, Artificial Sequence
  Description of Artificial Sequence: Synthetic oligonucleotide
attagaattcaggaacatatgaaaccaatagaagaaatgcaagaggac

SEQ ID NO: 275758 - DNA, 47 bp, Artificial Sequence
  Description of Artificial Sequence: Synthetic oligonucleotide
ttagaattcaggaacatatgaaaccaatagaagaaatgcaagaggac

SEQ ID NO: 275759 - DNA, 46 bp, Artificial Sequence
  Description of Artificial Sequence: Synthetic oligonucleotide
tagaattcaggaacatatgaaaccaatagaagaaatgcaagaggac

SEQ ID NO: 275760 - DNA, 45 bp, Artificial Sequence
  Description of Artificial Sequence: Synthetic oligonucleotide
agaattcaggaacatatgaaaccaatagaagaaatgcaagaggac

SEQ ID NO: 275761 - DNA, 44 bp, Artificial Sequence
  Description of Artificial Sequence: Synthetic oligonucleotide
gaattcaggaacatatgaaaccaatagaagaaatgcaagaggac

SEQ ID NO: 275762 - DNA, 44 bp, Artificial Sequence
  Description of Artificial Sequence: Synthetic oligonucleotide
aattcaggaacatatgaaaccaatagaagaaatgcaagaggacg

SEQ ID NO: 275763 - DNA, 43 bp, Artificial Sequence
  Description of Artificial Sequence: Synthetic oligonucleotide
attcaggaacatatgaaaccaatagaagaaatgcaagaggacg

SEQ ID NO: 275764 - DNA, 42 bp, Artificial Sequence
  Description of Artificial Sequence: Synthetic oligonucleotide
ttcaggaacatatgaaaccaatagaagaaatgcaagaggacg

SEQ ID NO: 275765 - DNA, 41 bp, Artificial Sequence
  Description of Artificial Sequence: Synthetic oligonucleotide
tcaggaacatatgaaaccaatagaagaaatgcaagaggacg

SEQ ID NO: 275766 - DNA, 40 bp, Artificial Sequence
  Description of Artificial Sequence: Synthetic oligonucleotide
caggaacatatgaaaccaatagaagaaatgcaagaggacg

SEQ ID NO: 275767 - DNA, 43 bp, Artificial Sequence
  Description of Artificial Sequence: Synthetic oligonucleotide
aggaacatatgaaaccaatagaagaaatgcaagaggacgaaag

SEQ ID NO: 275768 - DNA, 42 bp, Artificial Sequence
  Description of Artificial Sequence: Synthetic oligonucleotide
ggaacatatgaaaccaatagaagaaatgcaagaggacgaaag

SEQ ID NO: 275769 - DNA, 44 bp, Artificial Sequence
  Description of Artificial Sequence: Synthetic oligonucleotide
gaacatatgaaaccaatagaagaaatgcaagaggacgaaagatc

SEQ ID NO: 275770 - DNA, 48 bp, Artificial Sequence
  Description of Artificial Sequence: Synthetic oligonucleotide
aacatatgaaaccaatagaagaaatgcaagaggacgaaagatcataag

SEQ ID NO: 275771 - DNA, 47 bp, Artificial Sequence
  Description of Artificial Sequence: Synthetic oligonucleotide
acatatgaaaccaatagaagaaatgcaagaggacgaaagatcataag

SEQ ID NO: 275772 - DNA, 46 bp, Artificial Sequence
  Description of Artificial Sequence: Synthetic oligonucleotide
catatgaaaccaatagaagaaatgcaagaggacgaaagatcataag

SEQ ID NO: 275773 - DNA, 47 bp, Artificial Sequence
  Description of Artificial Sequence: Synthetic oligonucleotide
atatgaaaccaatagaagaaatgcaagaggacgaaagatcataagtg

SEQ ID NO: 275774 - DNA, 46 bp, Artificial Sequence
  Description of Artificial Sequence: Synthetic oligonucleotide
tatgaaaccaatagaagaaatgcaagaggacgaaagatcataagtg

SEQ ID NO: 275775 - DNA, 45 bp, Artificial Sequence
  Description of Artificial Sequence: Synthetic oligonucleotide
atgaaaccaatagaagaaatgcaagaggacgaaagatcataagtg

SEQ ID NO: 275776 - DNA, 44 bp, Artificial Sequence
  Description of Artificial Sequence: Synthetic oligonucleotide
tgaaaccaatagaagaaatgcaagaggacgaaagatcataagtg

SEQ ID NO: 275777 - DNA, 43 bp, Artificial Sequence
  Description of Artificial Sequence: Synthetic oligonucleotide
gaaaccaatagaagaaatgcaagaggacgaaagatcataagtg

SEQ ID NO: 275778 - DNA, 43 bp, Artificial Sequence
  Description of Artificial Sequence: Synthetic oligonucleotide
aaaccaatagaagaaatgcaagaggacgaaagatcataagtgg

SEQ ID NO: 275779 - DNA, 42 bp, Artificial Sequence
  Description of Artificial Sequence: Synthetic oligonucleotide
aaccaatagaagaaatgcaagaggacgaaagatcataagtgg

SEQ ID NO: 275780 - DNA, 41 bp, Artificial Sequence
  Description of Artificial Sequence: Synthetic oligonucleotide
accaatagaagaaatgcaagaggacgaaagatcataagtgg

SEQ ID NO: 275781 - DNA, 40 bp, Artificial Sequence
  Description of Artificial Sequence: Synthetic oligonucleotide
ccaatagaagaaatgcaagaggacgaaagatcataagtgg

SEQ ID NO: 275782 - DNA, 42 bp, Artificial Sequence
  Description of Artificial Sequence: Synthetic oligonucleotide
caatagaagaaatgcaagaggacgaaagatcataagtggatg

SEQ ID NO: 275783 - DNA, 44 bp, Artificial Sequence
  Description of Artificial Sequence: Synthetic oligonucleotide
aatagaagaaatgcaagaggacgaaagatcataagtggatgttc

SEQ ID NO: 275784 - DNA, 43 bp, Artificial Sequence
  Description of Artificial Sequence: Synthetic oligonucleotide
atagaagaaatgcaagaggacgaaagatcataagtggatgttc

SEQ ID NO: 275785 - DNA, 42 bp, Artificial Sequence
  Description of Artificial Sequence: Synthetic oligonucleotide
tagaagaaatgcaagaggacgaaagatcataagtggatgttc

SEQ ID NO: 275786 - DNA, 41 bp, Artificial Sequence
  Description of Artificial Sequence: Synthetic oligonucleotide
agaagaaatgcaagaggacgaaagatcataagtggatgttc

SEQ ID NO: 275787 - DNA, 40 bp, Artificial Sequence
  Description of Artificial Sequence: Synthetic oligonucleotide
gaagaaatgcaagaggacgaaagatcataagtggatgttc

SEQ ID NO: 275788 - DNA, 41 bp, Artificial Sequence
  Description of Artificial Sequence: Synthetic oligonucleotide
aagaaatgcaagaggacgaaagatcataagtggatgttctg

SEQ ID NO: 275789 - DNA, 40 bp, Artificial Sequence
  Description of Artificial Sequence: Synthetic oligonucleotide
agaaatgcaagaggacgaaagatcataagtggatgttctg

SEQ ID NO: 275790 - DNA, 39 bp, Artificial Sequence
  Description of Artificial Sequence: Synthetic oligonucleotide
gaaatgcaagaggacgaaagatcataagtggatgttctg

SEQ ID NO: 275791 - DNA, 40 bp, Artificial Sequence
  Description of Artificial Sequence: Synthetic oligonucleotide
aaatgcaagaggacgaaagatcataagtggatgttctgag

SEQ ID NO: 275792 - DNA, 39 bp, Artificial Sequence
  Description of Artificial Sequence: Synthetic oligonucleotide
aatgcaagaggacgaaagatcataagtggatgttctgag

SEQ ID NO: 275793 - DNA, 38 bp, Artificial Sequence
  Description of Artificial Sequence: Synthetic oligonucleotide
atgcaagaggacgaaagatcataagtggatgttctgag

SEQ ID NO: 275794 - DNA, 37 bp, Artificial Sequence
  Description of Artificial Sequence: Synthetic oligonucleotide
tgcaagaggacgaaagatcataagtggatgttctgag

SEQ ID NO: 275795 - DNA, 36 bp, Artificial Sequence
  Description of Artificial Sequence: Synthetic oligonucleotide
gcaagaggacgaaagatcataagtggatgttctgag

SEQ ID NO: 275796 - DNA, 36 bp, Artificial Sequence
  Description of Artificial Sequence: Synthetic oligonucleotide
caagaggacgaaagatcataagtggatgttctgagg

SEQ ID NO: 275797 - DNA, 36 bp, Artificial Sequence
  Description of Artificial Sequence: Synthetic oligonucleotide
aagaggacgaaagatcataagtggatgttctgaggg

SEQ ID NO: 275798 - DNA, 35 bp, Artificial Sequence
  Description of Artificial Sequence: Synthetic oligonucleotide
agaggacgaaagatcataagtggatgttctgaggg

SEQ ID NO: 275799 - DNA, 34 bp, Artificial Sequence
  Description of Artificial Sequence: Synthetic oligonucleotide
gaggacgaaagatcataagtggatgttctgaggg

SEQ ID NO: 275800 - DNA, 34 bp, Artificial Sequence
  Description of Artificial Sequence: Synthetic oligonucleotide
aggacgaaagatcataagtggatgttctgagggg

SEQ ID NO: 275801 - DNA, 33 bp, Artificial Sequence
  Description of Artificial Sequence: Synthetic oligonucleotide
ggacgaaagatcataagtggatgttctgagggg

SEQ ID NO: 275802 - DNA, 33 bp, Artificial Sequence
  Description of Artificial Sequence: Synthetic oligonucleotide
gacgaaagatcataagtggatgttctgaggggc

SEQ ID NO: 275803 - DNA, 34 bp, Artificial Sequence
  Description of Artificial Sequence: Synthetic oligonucleotide
acgaaagatcataagtggatgttctgaggggcac

SEQ ID NO: 275804 - DNA, 33 bp, Artificial Sequence
  Description of Artificial Sequence: Synthetic oligonucleotide
cgaaagatcataagtggatgttctgaggggcac

SEQ ID NO: 275805 - DNA, 33 bp, Artificial Sequence
  Description of Artificial Sequence: Synthetic oligonucleotide
gaaagatcataagtggatgttctgaggggcacc

SEQ ID NO: 275806 - DNA, 33 bp, Artificial Sequence
  Description of Artificial Sequence: Synthetic oligonucleotide
aaagatcataagtggatgttctgaggggcaccc

SEQ ID NO: 275807 - DNA, 32 bp, Artificial Sequence
  Description of Artificial Sequence: Synthetic oligonucleotide
aagatcataagtggatgttctgaggggcaccc

SEQ ID NO: 275808 - DNA, 31 bp, Artificial Sequence
  Description of Artificial Sequence: Synthetic oligonucleotide
agatcataagtggatgttctgaggggcaccc

SEQ ID NO: 275809 - DNA, 30 bp, Artificial Sequence
  Description of Artificial Sequence: Synthetic oligonucleotide
gatcataagtggatgttctgaggggcaccc

SEQ ID NO: 275810 - DNA, 30 bp, Artificial Sequence
  Description of Artificial Sequence: Synthetic oligonucleotide
atcataagtggatgttctgaggggcacccc

SEQ ID NO: 275811 - DNA, 29 bp, Artificial Sequence
  Description of Artificial Sequence: Synthetic oligonucleotide
tcataagtggatgttctgaggggcacccc

SEQ ID NO: 275812 - DNA, 28 bp, Artificial Sequence
  Description of Artificial Sequence: Synthetic oligonucleotide
cataagtggatgttctgaggggcacccc

SEQ ID NO: 275813 - DNA, 28 bp, Artificial Sequence
  Description of Artificial Sequence: Synthetic oligonucleotide
ataagtggatgttctgaggggcaccccg

SEQ ID NO: 275814 - DNA, 27 bp, Artificial Sequence
  Description of Artificial Sequence: Synthetic oligonucleotide
taagtggatgttctgaggggcaccccg

SEQ ID NO: 275815 - DNA, 27 bp, Artificial Sequence
  Description of Artificial Sequence: Synthetic oligonucleotide
aagtggatgttctgaggggcaccccga

SEQ ID NO: 275816 - DNA, 27 bp, Artificial Sequence
  Description of Artificial Sequence: Synthetic oligonucleotide
agtggatgttctgaggggcaccccgat

SEQ ID NO: 275817 - DNA, 26 bp, Artificial Sequence
  Description of Artificial Sequence: Synthetic oligonucleotide
gtggatgttctgaggggcaccccgat

SEQ ID NO: 275818 - DNA, 27 bp, Artificial Sequence
  Description of Artificial Sequence: Synthetic oligonucleotide
tggatgttctgaggggcaccccgatga

SEQ ID NO: 275819 - DNA, 26 bp, Artificial Sequence
  Description of Artificial Sequence: Synthetic oligonucleotide
ggatgttctgaggggcaccccgatga

SEQ ID NO: 275820 - DNA, 27 bp, Artificial Sequence
  Description of Artificial Sequence: Synthetic oligonucleotide
gatgttctgaggggcaccccgatgaca

SEQ ID NO: 275821 - DNA, 27 bp, Artificial Sequence
  Description of Artificial Sequence: Synthetic oligonucleotide
atgttctgaggggcaccccgatgacag

SEQ ID NO: 275822 - DNA, 27 bp, Artificial Sequence
  Description of Artificial Sequence: Synthetic oligonucleotide
tgttctgaggggcaccccgatgacagt

SEQ ID NO: 275823 - DNA, 27 bp, Artificial Sequence
  Description of Artificial Sequence: Synthetic oligonucleotide
gttctgaggggcaccccgatgacagta

SEQ ID NO: 275824 - DNA, 27 bp, Artificial Sequence
  Description of Artificial Sequence: Synthetic oligonucleotide
ttctgaggggcaccccgatgacagtag

SEQ ID NO: 275825 - DNA, 26 bp, Artificial Sequence
  Description of Artificial Sequence: Synthetic oligonucleotide
tctgaggggcaccccgatgacagtag

SEQ ID NO: 275826 - DNA, 25 bp, Artificial Sequence
  Description of Artificial Sequence: Synthetic oligonucleotide
ctgaggggcaccccgatgacagtag

SEQ ID NO: 275827 - DNA, 27 bp, Artificial Sequence
  Description of Artificial Sequence: Synthetic oligonucleotide
tgaggggcaccccgatgacagtaggaa

SEQ ID NO: 275828 - DNA, 26 bp, Artificial Sequence
  Description of Artificial Sequence: Synthetic oligonucleotide
gaggggcaccccgatgacagtaggaa

SEQ ID NO: 275829 - DNA, 26 bp, Artificial Sequence
  Description of Artificial Sequence: Synthetic oligonucleotide
aggggcaccccgatgacagtaggaag

SEQ ID NO: 275830 - DNA, 25 bp, Artificial Sequence
  Description of Artificial Sequence: Synthetic oligonucleotide
ggggcaccccgatgacagtaggaag

SEQ ID NO: 275831 - DNA, 27 bp, Artificial Sequence
  Description of Artificial Sequence: Synthetic oligonucleotide
gggcaccccgatgacagtaggaagctt

SEQ ID NO: 275832 - DNA, 27 bp, Artificial Sequence
  Description of Artificial Sequence: Synthetic oligonucleotide
ggcaccccgatgacagtaggaagcttg

SEQ ID NO: 275833 - DNA, 27 bp, Artificial Sequence
  Description of Artificial Sequence: Synthetic oligonucleotide
gcaccccgatgacagtaggaagcttgg

SEQ ID NO: 275834 - DNA, 29 bp, Artificial Sequence
  Description of Artificial Sequence: Synthetic oligonucleotide
caccccgatgacagtaggaagcttggaag

SEQ ID NO: 275835 - DNA, 30 bp, Artificial Sequence
  Description of Artificial Sequence: Synthetic oligonucleotide
accccgatgacagtaggaagcttggaagac

SEQ ID NO: 275836 - DNA, 29 bp, Artificial Sequence
  Description of Artificial Sequence: Synthetic oligonucleotide
ccccgatgacagtaggaagcttggaagac

SEQ ID NO: 275837 - DNA, 31 bp, Artificial Sequence
  Description of Artificial Sequence: Synthetic oligonucleotide
cccgatgacagtaggaagcttggaagacatc

SEQ ID NO: 275838 - DNA, 34 bp, Artificial Sequence
  Description of Artificial Sequence: Synthetic oligonucleotide
ccgatgacagtaggaagcttggaagacatcattg

SEQ ID NO: 275839 - DNA, 36 bp, Artificial Sequence
  Description of Artificial Sequence: Synthetic oligonucleotide
cgatgacagtaggaagcttggaagacatcattgatc

SEQ ID NO: 275840 - DNA, 37 bp, Artificial Sequence
  Description of Artificial Sequence: Synthetic oligonucleotide
gatgacagtaggaagcttggaagacatcattgatcac

SEQ ID NO: 275841 - DNA, 40 bp, Artificial Sequence
  Description of Artificial Sequence: Synthetic oligonucleotide
atgacagtaggaagcttggaagacatcattgatcacaatc

SEQ ID NO: 275842 - DNA, 39 bp, Artificial Sequence
  Description of Artificial Sequence: Synthetic oligonucleotide
tgacagtaggaagcttggaagacatcattgatcacaatc

SEQ ID NO: 275843 - DNA, 38 bp, Artificial Sequence
  Description of Artificial Sequence: Synthetic oligonucleotide
gacagtaggaagcttggaagacatcattgatcacaatc

SEQ ID NO: 275844 - DNA, 40 bp, Artificial Sequence
  Description of Artificial Sequence: Synthetic oligonucleotide
acagtaggaagcttggaagacatcattgatcacaatcatg

SEQ ID NO: 275845 - DNA, 39 bp, Artificial Sequence
  Description of Artificial Sequence: Synthetic oligonucleotide
cagtaggaagcttggaagacatcattgatcacaatcatg

SEQ ID NO: 275846 - DNA, 39 bp, Artificial Sequence
  Description of Artificial Sequence: Synthetic oligonucleotide
agtaggaagcttggaagacatcattgatcacaatcatgg

SEQ ID NO: 275847 - DNA, 38 bp, Artificial Sequence
  Description of Artificial Sequence: Synthetic oligonucleotide
gtaggaagcttggaagacatcattgatcacaatcatgg

SEQ ID NO: 275848 - DNA, 38 bp, Artificial Sequence
  Description of Artificial Sequence: Synthetic oligonucleotide
taggaagcttggaagacatcattgatcacaatcatggc

SEQ ID NO: 275849 - DNA, 37 bp, Artificial Sequence
  Description of Artificial Sequence: Synthetic oligonucleotide
aggaagcttggaagacatcattgatcacaatcatggc

SEQ ID NO: 275850 - DNA, 36 bp, Artificial Sequence
  Description of Artificial Sequence: Synthetic oligonucleotide
ggaagcttggaagacatcattgatcacaatcatggc

SEQ ID NO: 275851 - DNA, 38 bp, Artificial Sequence
  Description of Artificial Sequence: Synthetic oligonucleotide
gaagcttggaagacatcattgatcacaatcatggcatc

SEQ ID NO: 275852 - DNA, 38 bp, Artificial Sequence
  Description of Artificial Sequence: Synthetic oligonucleotide
aagcttggaagacatcattgatcacaatcatggcatcg

SEQ ID NO: 275853 - DNA, 37 bp, Artificial Sequence
  Description of Artificial Sequence: Synthetic oligonucleotide
agcttggaagacatcattgatcacaatcatggcatcg

SEQ ID NO: 275854 - DNA, 36 bp, Artificial Sequence
  Description of Artificial Sequence: Synthetic oligonucleotide
gcttggaagacatcattgatcacaatcatggcatcg

SEQ ID NO: 275855 - DNA, 37 bp, Artificial Sequence
  Description of Artificial Sequence: Synthetic oligonucleotide
cttggaagacatcattgatcacaatcatggcatcgtg

SEQ ID NO: 275856 - DNA, 38 bp, Artificial Sequence
  Description of Artificial Sequence: Synthetic oligonucleotide
ttggaagacatcattgatcacaatcatggcatcgtgtc

SEQ ID NO: 275857 - DNA, 37 bp, Artificial Sequence
  Description of Artificial Sequence: Synthetic oligonucleotide
tggaagacatcattgatcacaatcatggcatcgtgtc

SEQ ID NO: 275858 - DNA, 36 bp, Artificial Sequence
  Description of Artificial Sequence: Synthetic oligonucleotide
ggaagacatcattgatcacaatcatggcatcgtgtc

SEQ ID NO: 275859 - DNA, 38 bp, Artificial Sequence
  Description of Artificial Sequence: Synthetic oligonucleotide
gaagacatcattgatcacaatcatggcatcgtgtcaac

SEQ ID NO: 275860 - DNA, 40 bp, Artificial Sequence
  Description of Artificial Sequence: Synthetic oligonucleotide
aagacatcattgatcacaatcatggcatcgtgtcaacatc

SEQ ID NO: 275861 - DNA, 39 bp, Artificial Sequence
  Description of Artificial Sequence: Synthetic oligonucleotide
agacatcattgatcacaatcatggcatcgtgtcaacatc

SEQ ID NO: 275862 - DNA, 38 bp, Artificial Sequence
  Description of Artificial Sequence: Synthetic oligonucleotide
gacatcattgatcacaatcatggcatcgtgtcaacatc

SEQ ID NO: 275863 - DNA, 39 bp, Artificial Sequence
  Description of Artificial Sequence: Synthetic oligonucleotide
acatcattgatcacaatcatggcatcgtgtcaacatctg

SEQ ID NO: 275864 - DNA, 38 bp, Artificial Sequence
  Description of Artificial Sequence: Synthetic oligonucleotide
catcattgatcacaatcatggcatcgtgtcaacatctg

SEQ ID NO: 275865 - DNA, 39 bp, Artificial Sequence
  Description of Artificial Sequence: Synthetic oligonucleotide
atcattgatcacaatcatggcatcgtgtcaacatctgtg

SEQ ID NO: 275866 - DNA, 38 bp, Artificial Sequence
  Description of Artificial Sequence: Synthetic oligonucleotide
tcattgatcacaatcatggcatcgtgtcaacatctgtg

SEQ ID NO: 275867 - DNA, 37 bp, Artificial Sequence
  Description of Artificial Sequence: Synthetic oligonucleotide
cattgatcacaatcatggcatcgtgtcaacatctgtg

SEQ ID NO: 275868 - DNA, 37 bp, Artificial Sequence
  Description of Artificial Sequence: Synthetic oligonucleotide
attgatcacaatcatggcatcgtgtcaacatctgtgc

SEQ ID NO: 275869 - DNA, 36 bp, Artificial Sequence
  Description of Artificial Sequence: Synthetic oligonucleotide
ttgatcacaatcatggcatcgtgtcaacatctgtgc

SEQ ID NO: 275870 - DNA, 35 bp, Artificial Sequence
  Description of Artificial Sequence: Synthetic oligonucleotide
tgatcacaatcatggcatcgtgtcaacatctgtgc

SEQ ID NO: 275871 - DNA, 34 bp, Artificial Sequence
  Description of Artificial Sequence: Synthetic oligonucleotide
gatcacaatcatggcatcgtgtcaacatctgtgc

SEQ ID NO: 275872 - DNA, 34 bp, Artificial Sequence
  Description of Artificial Sequence: Synthetic oligonucleotide
atcacaatcatggcatcgtgtcaacatctgtgcg

SEQ ID NO: 275873 - DNA, 33 bp, Artificial Sequence
  Description of Artificial Sequence: Synthetic oligonucleotide
tcacaatcatggcatcgtgtcaacatctgtgcg

SEQ ID NO: 275874 - DNA, 32 bp, Artificial Sequence
  Description of Artificial Sequence: Synthetic oligonucleotide
cacaatcatggcatcgtgtcaacatctgtgcg

SEQ ID NO: 275875 - DNA, 32 bp, Artificial Sequence
  Description of Artificial Sequence: Synthetic oligonucleotide
acaatcatggcatcgtgtcaacatctgtgcgc

SEQ ID NO: 275876 - DNA, 31 bp, Artificial Sequence
  Description of Artificial Sequence: Synthetic oligonucleotide
caatcatggcatcgtgtcaacatctgtgcgc

SEQ ID NO: 275877 - DNA, 32 bp, Artificial Sequence
  Description of Artificial Sequence: Synthetic oligonucleotide
aatcatggcatcgtgtcaacatctgtgcgctc

SEQ ID NO: 275878 - DNA, 31 bp, Artificial Sequence
  Description of Artificial Sequence: Synthetic oligonucleotide
atcatggcatcgtgtcaacatctgtgcgctc

SEQ ID NO: 275879 - DNA, 30 bp, Artificial Sequence
  Description of Artificial Sequence: Synthetic oligonucleotide
tcatggcatcgtgtcaacatctgtgcgctc

SEQ ID NO: 275880 - DNA, 29 bp, Artificial Sequence
  Description of Artificial Sequence: Synthetic oligonucleotide
catggcatcgtgtcaacatctgtgcgctc

SEQ ID NO: 275881 - DNA, 30 bp, Artificial Sequence
  Description of Artificial Sequence: Synthetic oligonucleotide
atggcatcgtgtcaacatctgtgcgctcag

SEQ ID NO: 275882 - DNA, 29 bp, Artificial Sequence
  Description of Artificial Sequence: Synthetic oligonucleotide
tggcatcgtgtcaacatctgtgcgctcag

SEQ ID NO: 275883 - DNA, 28 bp, Artificial Sequence
  Description of Artificial Sequence: Synthetic oligonucleotide
ggcatcgtgtcaacatctgtgcgctcag

SEQ ID NO: 275884 - DNA, 30 bp, Artificial Sequence
  Description of Artificial Sequence: Synthetic oligonucleotide
gcatcgtgtcaacatctgtgcgctcagaac

SEQ ID NO: 275885 - DNA, 31 bp, Artificial Sequence
  Description of Artificial Sequence: Synthetic oligonucleotide
catcgtgtcaacatctgtgcgctcagaactc

SEQ ID NO: 275886 - DNA, 33 bp, Artificial Sequence
  Description of Artificial Sequence: Synthetic oligonucleotide
atcgtgtcaacatctgtgcgctcagaactctac

SEQ ID NO: 275887 - DNA, 32 bp, Artificial Sequence
  Description of Artificial Sequence: Synthetic oligonucleotide
tcgtgtcaacatctgtgcgctcagaactctac

SEQ ID NO: 275888 - DNA, 31 bp, Artificial Sequence
  Description of Artificial Sequence: Synthetic oligonucleotide
cgtgtcaacatctgtgcgctcagaactctac

SEQ ID NO: 275889 - DNA, 31 bp, Artificial Sequence
  Description of Artificial Sequence: Synthetic oligonucleotide
gtgtcaacatctgtgcgctcagaactctacg

SEQ ID NO: 275890 - DNA, 32 bp, Artificial Sequence
  Description of Artificial Sequence: Synthetic oligonucleotide
tgtcaacatctgtgcgctcagaactctacgtc

SEQ ID NO: 275891 - DNA, 31 bp, Artificial Sequence
  Description of Artificial Sequence: Synthetic oligonucleotide
gtcaacatctgtgcgctcagaactctacgtc

SEQ ID NO: 275892 - DNA, 32 bp, Artificial Sequence
  Description of Artificial Sequence: Synthetic oligonucleotide
tcaacatctgtgcgctcagaactctacgtcag

SEQ ID NO: 275893 - DNA, 31 bp, Artificial Sequence
  Description of Artificial Sequence: Synthetic oligonucleotide
caacatctgtgcgctcagaactctacgtcag

SEQ ID NO: 275894 - DNA, 31 bp, Artificial Sequence
  Description of Artificial Sequence: Synthetic oligonucleotide
aacatctgtgcgctcagaactctacgtcagg

SEQ ID NO: 275895 - DNA, 30 bp, Artificial Sequence
  Description of Artificial Sequence: Synthetic oligonucleotide
acatctgtgcgctcagaactctacgtcagg

SEQ ID NO: 275896 - DNA, 29 bp, Artificial Sequence
  Description of Artificial Sequence: Synthetic oligonucleotide
catctgtgcgctcagaactctacgtcagg

SEQ ID NO: 275897 - DNA, 32 bp, Artificial Sequence
  Description of Artificial Sequence: Synthetic oligonucleotide
atctgtgcgctcagaactctacgtcaggattc

SEQ ID NO: 275898 - DNA, 31 bp, Artificial Sequence
  Description of Artificial Sequence: Synthetic oligonucleotide
tctgtgcgctcagaactctacgtcaggattc

SEQ ID NO: 275899 - DNA, 30 bp, Artificial Sequence
  Description of Artificial Sequence: Synthetic oligonucleotide
ctgtgcgctcagaactctacgtcaggattc

SEQ ID NO: 275900 - DNA, 33 bp, Artificial Sequence
  Description of Artificial Sequence: Synthetic oligonucleotide
tgtgcgctcagaactctacgtcaggattctttc

SEQ ID NO: 275901 - DNA, 32 bp, Artificial Sequence
  Description of Artificial Sequence: Synthetic oligonucleotide
gtgcgctcagaactctacgtcaggattctttc

SEQ ID NO: 275902 - DNA, 36 bp, Artificial Sequence
  Description of Artificial Sequence: Synthetic oligonucleotide
tgcgctcagaactctacgtcaggattctttcaattg

SEQ ID NO: 275903 - DNA, 35 bp, Artificial Sequence
  Description of Artificial Sequence: Synthetic oligonucleotide
gcgctcagaactctacgtcaggattctttcaattg

SEQ ID NO: 275904 - DNA, 37 bp, Artificial Sequence
  Description of Artificial Sequence: Synthetic oligonucleotide
cgctcagaactctacgtcaggattctttcaattgtag

SEQ ID NO: 275905 - DNA, 38 bp, Artificial Sequence
  Description of Artificial Sequence: Synthetic oligonucleotide
gctcagaactctacgtcaggattctttcaattgtagac

SEQ ID NO: 275906 - DNA, 40 bp, Artificial Sequence
  Description of Artificial Sequence: Synthetic oligonucleotide
ctcagaactctacgtcaggattctttcaattgtagacatg

SEQ ID NO: 275907 - DNA, 40 bp, Artificial Sequence
  Description of Artificial Sequence: Synthetic oligonucleotide
tcagaactctacgtcaggattctttcaattgtagacatgg

SEQ ID NO: 275908 - DNA, 39 bp, Artificial Sequence
  Description of Artificial Sequence: Synthetic oligonucleotide
cagaactctacgtcaggattctttcaattgtagacatgg

SEQ ID NO: 275909 - DNA, 41 bp, Artificial Sequence
  Description of Artificial Sequence: Synthetic oligonucleotide
agaactctacgtcaggattctttcaattgtagacatggatc

SEQ ID NO: 275910 - DNA, 40 bp, Artificial Sequence
  Description of Artificial Sequence: Synthetic oligonucleotide
gaactctacgtcaggattctttcaattgtagacatggatc

SEQ ID NO: 275911 - DNA, 41 bp, Artificial Sequence
  Description of Artificial Sequence: Synthetic oligonucleotide
aactctacgtcaggattctttcaattgtagacatggatctg

SEQ ID NO: 275912 - DNA, 40 bp, Artificial Sequence
  Description of Artificial Sequence: Synthetic oligonucleotide
actctacgtcaggattctttcaattgtagacatggatctg

SEQ ID NO: 275913 - DNA, 39 bp, Artificial Sequence
  Description of Artificial Sequence: Synthetic oligonucleotide
ctctacgtcaggattctttcaattgtagacatggatctg

SEQ ID NO: 275914 - DNA, 39 bp, Artificial Sequence
  Description of Artificial Sequence: Synthetic oligonucleotide
tctacgtcaggattctttcaattgtagacatggatctgc

SEQ ID NO: 275915 - DNA, 38 bp, Artificial Sequence
  Description of Artificial Sequence: Synthetic oligonucleotide
ctacgtcaggattctttcaattgtagacatggatctgc

SEQ ID NO: 275916 - DNA, 39 bp, Artificial Sequence
  Description of Artificial Sequence: Synthetic oligonucleotide
tacgtcaggattctttcaattgtagacatggatctgctc

SEQ ID NO: 275917 - DNA, 38 bp, Artificial Sequence
  Description of Artificial Sequence: Synthetic oligonucleotide
acgtcaggattctttcaattgtagacatggatctgctc

SEQ ID NO: 275918 - DNA, 37 bp, Artificial Sequence
  Description of Artificial Sequence: Synthetic oligonucleotide
cgtcaggattctttcaattgtagacatggatctgctc

SEQ ID NO: 275919 - DNA, 37 bp, Artificial Sequence
  Description of Artificial Sequence: Synthetic oligonucleotide
gtcaggattctttcaattgtagacatggatctgctcg

SEQ ID NO: 275920 - DNA, 39 bp, Artificial Sequence
  Description of Artificial Sequence: Synthetic oligonucleotide
tcaggattctttcaattgtagacatggatctgctcgaac

SEQ ID NO: 275921 - DNA, 38 bp, Artificial Sequence
  Description of Artificial Sequence: Synthetic oligonucleotide
caggattctttcaattgtagacatggatctgctcgaac

SEQ ID NO: 275922 - DNA, 38 bp, Artificial Sequence
  Description of Artificial Sequence: Synthetic oligonucleotide
aggattctttcaattgtagacatggatctgctcgaacc

SEQ ID NO: 275923 - DNA, 37 bp, Artificial Sequence
  Description of Artificial Sequence: Synthetic oligonucleotide
ggattctttcaattgtagacatggatctgctcgaacc

SEQ ID NO: 275924 - DNA, 38 bp, Artificial Sequence
  Description of Artificial Sequence: Synthetic oligonucleotide
gattctttcaattgtagacatggatctgctcgaacctg

SEQ ID NO: 275925 - DNA, 38 bp, Artificial Sequence
  Description of Artificial Sequence: Synthetic oligonucleotide
attctttcaattgtagacatggatctgctcgaacctgg

SEQ ID NO: 275926 - DNA, 37 bp, Artificial Sequence
  Description of Artificial Sequence: Synthetic oligonucleotide
ttctttcaattgtagacatggatctgctcgaacctgg

SEQ ID NO: 275927 - DNA, 36 bp, Artificial Sequence
  Description of Artificial Sequence: Synthetic oligonucleotide
tctttcaattgtagacatggatctgctcgaacctgg

SEQ ID NO: 275928 - DNA, 35 bp, Artificial Sequence
  Description of Artificial Sequence: Synthetic oligonucleotide
ctttcaattgtagacatggatctgctcgaacctgg

SEQ ID NO: 275929 - DNA, 35 bp, Artificial Sequence
  Description of Artificial Sequence: Synthetic oligonucleotide
tttcaattgtagacatggatctgctcgaacctggc

SEQ ID NO: 275930 - DNA, 34 bp, Artificial Sequence
  Description of Artificial Sequence: Synthetic oligonucleotide
ttcaattgtagacatggatctgctcgaacctggc

SEQ ID NO: 275931 - DNA, 33 bp, Artificial Sequence
  Description of Artificial Sequence: Synthetic oligonucleotide
tcaattgtagacatggatctgctcgaacctggc

SEQ ID NO: 275932 - DNA, 32 bp, Artificial Sequence
  Description of Artificial Sequence: Synthetic oligonucleotide
caattgtagacatggatctgctcgaacctggc

SEQ ID NO: 275933 - DNA, 33 bp, Artificial Sequence
  Description of Artificial Sequence: Synthetic oligonucleotide
aattgtagacatggatctgctcgaacctggcag

SEQ ID NO: 275934 - DNA, 32 bp, Artificial Sequence
  Description of Artificial Sequence: Synthetic oligonucleotide
attgtagacatggatctgctcgaacctggcag

SEQ ID NO: 275935 - DNA, 31 bp, Artificial Sequence
  Description of Artificial Sequence: Synthetic oligonucleotide
ttgtagacatggatctgctcgaacctggcag

SEQ ID NO: 275936 - DNA, 30 bp, Artificial Sequence
  Description of Artificial Sequence: Synthetic oligonucleotide
tgtagacatggatctgctcgaacctggcag

SEQ ID NO: 275937 - DNA, 29 bp, Artificial Sequence
  Description of Artificial Sequence: Synthetic oligonucleotide
gtagacatggatctgctcgaacctggcag

SEQ ID NO: 275938 - DNA, 29 bp, Artificial Sequence
  Description of Artificial Sequence: Synthetic oligonucleotide
tagacatggatctgctcgaacctggcagc

SEQ ID NO: 275939 - DNA, 28 bp, Artificial Sequence
  Description of Artificial Sequence: Synthetic oligonucleotide
agacatggatctgctcgaacctggcagc

SEQ ID NO: 275940 - DNA, 27 bp, Artificial Sequence
  Description of Artificial Sequence: Synthetic oligonucleotide
gacatggatctgctcgaacctggcagc

SEQ ID NO: 275941 - DNA, 28 bp, Artificial Sequence
  Description of Artificial Sequence: Synthetic oligonucleotide
acatggatctgctcgaacctggcagctc

SEQ ID NO: 275942 - DNA, 27 bp, Artificial Sequence
  Description of Artificial Sequence: Synthetic oligonucleotide
catggatctgctcgaacctggcagctc

SEQ ID NO: 275943 - DNA, 27 bp, Artificial Sequence
  Description of Artificial Sequence: Synthetic oligonucleotide
atggatctgctcgaacctggcagctcg

SEQ ID NO: 275944 - DNA, 26 bp, Artificial Sequence
  Description of Artificial Sequence: Synthetic oligonucleotide
tggatctgctcgaacctggcagctcg

SEQ ID NO: 275945 - DNA, 25 bp, Artificial Sequence
  Description of Artificial Sequence: Synthetic oligonucleotide
ggatctgctcgaacctggcagctcg

SEQ ID NO: 275946 - DNA, 26 bp, Artificial Sequence
  Description of Artificial Sequence: Synthetic oligonucleotide
gatctgctcgaacctggcagctcggt

SEQ ID NO: 275947 - DNA, 26 bp, Artificial Sequence
  Description of Artificial Sequence: Synthetic oligonucleotide
atctgctcgaacctggcagctcggtc

SEQ ID NO: 275948 - DNA, 25 bp, Artificial Sequence
  Description of Artificial Sequence: Synthetic oligonucleotide
tctgctcgaacctggcagctcggtc

SEQ ID NO: 275949 - DNA, 24 bp, Artificial Sequence
  Description of Artificial Sequence: Synthetic oligonucleotide
ctgctcgaacctggcagctcggtc

SEQ ID NO: 275950 - DNA, 25 bp, Artificial Sequence
  Description of Artificial Sequence: Synthetic oligonucleotide
tgctcgaacctggcagctcggtcca

SEQ ID NO: 275951 - DNA, 24 bp, Artificial Sequence
  Description of Artificial Sequence: Synthetic oligonucleotide
gctcgaacctggcagctcggtcca

SEQ ID NO: 275952 - DNA, 24 bp, Artificial Sequence
  Description of Artificial Sequence: Synthetic oligonucleotide
ctcgaacctggcagctcggtccag

SEQ ID NO: 275953 - DNA, 25 bp, Artificial Sequence
  Description of Artificial Sequence: Synthetic oligonucleotide
tcgaacctggcagctcggtccagct

SEQ ID NO: 275954 - DNA, 24 bp, Artificial Sequence
  Description of Artificial Sequence: Synthetic oligonucleotide
cgaacctggcagctcggtccagct

SEQ ID NO: 275955 - DNA, 26 bp, Artificial Sequence
  Description of Artificial Sequence: Synthetic oligonucleotide
gaacctggcagctcggtccagctcaa

SEQ ID NO: 275956 - DNA, 26 bp, Artificial Sequence
  Description of Artificial Sequence: Synthetic oligonucleotide
aacctggcagctcggtccagctcaac

SEQ ID NO: 275957 - DNA, 25 bp, Artificial Sequence
  Description of Artificial Sequence: Synthetic oligonucleotide
acctggcagctcggtccagctcaac

SEQ ID NO: 275958 - DNA, 24 bp, Artificial Sequence
  Description of Artificial Sequence: Synthetic oligonucleotide
cctggcagctcggtccagctcaac

SEQ ID NO: 275959 - DNA, 25 bp, Artificial Sequence
  Description of Artificial Sequence: Synthetic oligonucleotide
ctggcagctcggtccagctcaacca

SEQ ID NO: 275960 - DNA, 27 bp, Artificial Sequence
  Description of Artificial Sequence: Synthetic oligonucleotide
tggcagctcggtccagctcaaccagaa

SEQ ID NO: 275961 - DNA, 26 bp, Artificial Sequence
  Description of Artificial Sequence: Synthetic oligonucleotide
ggcagctcggtccagctcaaccagaa

SEQ ID NO: 275962 - DNA, 26 bp, Artificial Sequence
  Description of Artificial Sequence: Synthetic oligonucleotide
gcagctcggtccagctcaaccagaag

SEQ ID NO: 275963 - DNA, 27 bp, Artificial Sequence
  Description of Artificial Sequence: Synthetic oligonucleotide
cagctcggtccagctcaaccagaaggt

SEQ ID NO: 275964 - DNA, 27 bp, Artificial Sequence
  Description of Artificial Sequence: Synthetic oligonucleotide
agctcggtccagctcaaccagaaggtg

SEQ ID NO: 275965 - DNA, 26 bp, Artificial Sequence
  Description of Artificial Sequence: Synthetic oligonucleotide
gctcggtccagctcaaccagaaggtg

SEQ ID NO: 275966 - DNA, 27 bp, Artificial Sequence
  Description of Artificial Sequence: Synthetic oligonucleotide
ctcggtccagctcaaccagaaggtgca

SEQ ID NO: 275967 - DNA, 28 bp, Artificial Sequence
  Description of Artificial Sequence: Synthetic oligonucleotide
tcggtccagctcaaccagaaggtgcatc

SEQ ID NO: 275968 - DNA, 27 bp, Artificial Sequence
  Description of Artificial Sequence: Synthetic oligonucleotide
cggtccagctcaaccagaaggtgcatc

SEQ ID NO: 275969 - DNA, 27 bp, Artificial Sequence
  Description of Artificial Sequence: Synthetic oligonucleotide
ggtccagctcaaccagaaggtgcatcc

SEQ ID NO: 275970 - DNA, 27 bp, Artificial Sequence
  Description of Artificial Sequence: Synthetic oligonucleotide
gtccagctcaaccagaaggtgcatccc

SEQ ID NO: 275971 - DNA, 27 bp, Artificial Sequence
  Description of Artificial Sequence: Synthetic oligonucleotide
tccagctcaaccagaaggtgcatcccg

SEQ ID NO: 275972 - DNA, 27 bp, Artificial Sequence
  Description of Artificial Sequence: Synthetic oligonucleotide
ccagctcaaccagaaggtgcatcccgt

SEQ ID NO: 275973 - DNA, 27 bp, Artificial Sequence
  Description of Artificial Sequence: Synthetic oligonucleotide
cagctcaaccagaaggtgcatcccgtg

SEQ ID NO: 275974 - DNA, 30 bp, Artificial Sequence
  Description of Artificial Sequence: Synthetic oligonucleotide
agctcaaccagaaggtgcatcccgtgatag

SEQ ID NO: 275975 - DNA, 29 bp, Artificial Sequence
  Description of Artificial Sequence: Synthetic oligonucleotide
gctcaaccagaaggtgcatcccgtgatag

SEQ ID NO: 275976 - DNA, 29 bp, Artificial Sequence
  Description of Artificial Sequence: Synthetic oligonucleotide
ctcaaccagaaggtgcatcccgtgatagc

SEQ ID NO: 275977 - DNA, 29 bp, Artificial Sequence
  Description of Artificial Sequence: Synthetic oligonucleotide
tcaaccagaaggtgcatcccgtgatagcg

SEQ ID NO: 275978 - DNA, 28 bp, Artificial Sequence
  Description of Artificial Sequence: Synthetic oligonucleotide
caaccagaaggtgcatcccgtgatagcg

SEQ ID NO: 275979 - DNA, 28 bp, Artificial Sequence
  Description of Artificial Sequence: Synthetic oligonucleotide
aaccagaaggtgcatcccgtgatagcgg

SEQ ID NO: 275980 - DNA, 27 bp, Artificial Sequence
  Description of Artificial Sequence: Synthetic oligonucleotide
accagaaggtgcatcccgtgatagcgg

SEQ ID NO: 275981 - DNA, 27 bp, Artificial Sequence
  Description of Artificial Sequence: Synthetic oligonucleotide
ccagaaggtgcatcccgtgatagcggt

SEQ ID NO: 275982 - DNA, 27 bp, Artificial Sequence
  Description of Artificial Sequence: Synthetic oligonucleotide
cagaaggtgcatcccgtgatagcggtg

SEQ ID NO: 275983 - DNA, 27 bp, Artificial Sequence
  Description of Artificial Sequence: Synthetic oligonucleotide
agaaggtgcatcccgtgatagcggtgc

SEQ ID NO: 275984 - DNA, 27 bp, Artificial Sequence
  Description of Artificial Sequence: Synthetic oligonucleotide
gaaggtgcatcccgtgatagcggtgct

SEQ ID NO: 275985 - DNA, 27 bp, Artificial Sequence
  Description of Artificial Sequence: Synthetic oligonucleotide
aaggtgcatcccgtgatagcggtgctg

SEQ ID NO: 275986 - DNA, 27 bp, Artificial Sequence
  Description of Artificial Sequence: Synthetic oligonucleotide
aggtgcatcccgtgatagcggtgctga

SEQ ID NO: 275987 - DNA, 27 bp, Artificial Sequence
  Description of Artificial Sequence: Synthetic oligonucleotide
ggtgcatcccgtgatagcggtgctgat

SEQ ID NO: 275988 - DNA, 27 bp, Artificial Sequence
  Description of Artificial Sequence: Synthetic oligonucleotide
gtgcatcccgtgatagcggtgctgatc

SEQ ID NO: 275989 - DNA, 27 bp, Artificial Sequence
  Description of Artificial Sequence: Synthetic oligonucleotide
tgcatcccgtgatagcggtgctgatcg

SEQ ID NO: 275990 - DNA, 27 bp, Artificial Sequence
  Description of Artificial Sequence: Synthetic oligonucleotide
gcatcccgtgatagcggtgctgatcga

SEQ ID NO: 275991 - DNA, 28 bp, Artificial Sequence
  Description of Artificial Sequence: Synthetic oligonucleotide
catcccgtgatagcggtgctgatcgatg

SEQ ID NO: 275992 - DNA, 29 bp, Artificial Sequence
  Description of Artificial Sequence: Synthetic oligonucleotide
atcccgtgatagcggtgctgatcgatgac

SEQ ID NO: 275993 - DNA, 28 bp, Artificial Sequence
  Description of Artificial Sequence: Synthetic oligonucleotide
tcccgtgatagcggtgctgatcgatgac

SEQ ID NO: 275994 - DNA, 27 bp, Artificial Sequence
  Description of Artificial Sequence: Synthetic oligonucleotide
cccgtgatagcggtgctgatcgatgac

SEQ ID NO: 275995 - DNA, 28 bp, Artificial Sequence
  Description of Artificial Sequence: Synthetic oligonucleotide
ccgtgatagcggtgctgatcgatgacac

SEQ ID NO: 275996 - DNA, 28 bp, Artificial Sequence
  Description of Artificial Sequence: Synthetic oligonucleotide
cgtgatagcggtgctgatcgatgacacg

SEQ ID NO: 275997 - DNA, 28 bp, Artificial Sequence
  Description of Artificial Sequence: Synthetic oligonucleotide
gtgatagcggtgctgatcgatgacacgc

SEQ ID NO: 275998 - DNA, 30 bp, Artificial Sequence
  Description of Artificial Sequence: Synthetic oligonucleotide
tgatagcggtgctgatcgatgacacgcatc

SEQ ID NO: 275999 - DNA, 29 bp, Artificial Sequence
  Description of Artificial Sequence: Synthetic oligonucleotide
gatagcggtgctgatcgatgacacgcatc

SEQ ID NO: 276000 - DNA, 29 bp, Artificial Sequence
  Description of Artificial Sequence: Synthetic oligonucleotide
atagcggtgctgatcgatgacacgcatcc

SEQ ID NO: 276001 - DNA, 28 bp, Artificial Sequence
  Description of Artificial Sequence: Synthetic oligonucleotide
tagcggtgctgatcgatgacacgcatcc

SEQ ID NO: 276002 - DNA, 27 bp, Artificial Sequence
  Description of Artificial Sequence: Synthetic oligonucleotide
agcggtgctgatcgatgacacgcatcc

SEQ ID NO: 276003 - DNA, 26 bp, Artificial Sequence
  Description of Artificial Sequence: Synthetic oligonucleotide
gcggtgctgatcgatgacacgcatcc

SEQ ID NO: 276004 - DNA, 26 bp, Artificial Sequence
  Description of Artificial Sequence: Synthetic oligonucleotide
cggtgctgatcgatgacacgcatccc

SEQ ID NO: 276005 - DNA, 27 bp, Artificial Sequence
  Description of Artificial Sequence: Synthetic oligonucleotide
ggtgctgatcgatgacacgcatcccct

SEQ ID NO: 276006 - DNA, 27 bp, Artificial Sequence
  Description of Artificial Sequence: Synthetic oligonucleotide
gtgctgatcgatgacacgcatcccctg

SEQ ID NO: 276007 - DNA, 27 bp, Artificial Sequence
  Description of Artificial Sequence: Synthetic oligonucleotide
tgctgatcgatgacacgcatcccctgg

SEQ ID NO: 276008 - DNA, 27 bp, Artificial Sequence
  Description of Artificial Sequence: Synthetic oligonucleotide
gctgatcgatgacacgcatcccctgga

SEQ ID NO: 276009 - DNA, 27 bp, Artificial Sequence
  Description of Artificial Sequence: Synthetic oligonucleotide
ctgatcgatgacacgcatcccctggac

SEQ ID NO: 276010 - DNA, 28 bp, Artificial Sequence
  Description of Artificial Sequence: Synthetic oligonucleotide
tgatcgatgacacgcatcccctggacac

SEQ ID NO: 276011 - DNA, 27 bp, Artificial Sequence
  Description of Artificial Sequence: Synthetic oligonucleotide
gatcgatgacacgcatcccctggacac

SEQ ID NO: 276012 - DNA, 28 bp, Artificial Sequence
  Description of Artificial Sequence: Synthetic oligonucleotide
atcgatgacacgcatcccctggacacag

SEQ ID NO: 276013 - DNA, 27 bp, Artificial Sequence
  Description of Artificial Sequence: Synthetic oligonucleotide
tcgatgacacgcatcccctggacacag

SEQ ID NO: 276014 - DNA, 27 bp, Artificial Sequence
  Description of Artificial Sequence: Synthetic oligonucleotide
cgatgacacgcatcccctggacacagt

SEQ ID NO: 276015 - DNA, 27 bp, Artificial Sequence
  Description of Artificial Sequence: Synthetic oligonucleotide
gatgacacgcatcccctggacacagtg

SEQ ID NO: 276016 - DNA, 29 bp, Artificial Sequence
  Description of Artificial Sequence: Synthetic oligonucleotide
atgacacgcatcccctggacacagtgatc

SEQ ID NO: 276017 - DNA, 28 bp, Artificial Sequence
  Description of Artificial Sequence: Synthetic oligonucleotide
tgacacgcatcccctggacacagtgatc

SEQ ID NO: 276018 - DNA, 27 bp, Artificial Sequence
  Description of Artificial Sequence: Synthetic oligonucleotide
gacacgcatcccctggacacagtgatc

SEQ ID NO: 276019 - DNA, 29 bp, Artificial Sequence
  Description of Artificial Sequence: Synthetic oligonucleotide
acacgcatcccctggacacagtgatcaag

SEQ ID NO: 276020 - DNA, 28 bp, Artificial Sequence
  Description of Artificial Sequence: Synthetic oligonucleotide
cacgcatcccctggacacagtgatcaag

SEQ ID NO: 276021 - DNA, 28 bp, Artificial Sequence
  Description of Artificial Sequence: Synthetic oligonucleotide
acgcatcccctggacacagtgatcaagg

SEQ ID NO: 276022 - DNA, 27 bp, Artificial Sequence
  Description of Artificial Sequence: Synthetic oligonucleotide
cgcatcccctggacacagtgatcaagg

SEQ ID NO: 276023 - DNA, 29 bp, Artificial Sequence
  Description of Artificial Sequence: Synthetic oligonucleotide
gcatcccctggacacagtgatcaaggtag

SEQ ID NO: 276024 - DNA, 33 bp, Artificial Sequence
  Description of Artificial Sequence: Synthetic oligonucleotide
catcccctggacacagtgatcaaggtagaatag

SEQ ID NO: 276025 - DNA, 33 bp, Artificial Sequence
  Description of Artificial Sequence: Synthetic oligonucleotide
atcccctggacacagtgatcaaggtagaatagg

SEQ ID NO: 276026 - DNA, 32 bp, Artificial Sequence
  Description of Artificial Sequence: Synthetic oligonucleotide
tcccctggacacagtgatcaaggtagaatagg

SEQ ID NO: 276027 - DNA, 31 bp, Artificial Sequence
  Description of Artificial Sequence: Synthetic oligonucleotide
cccctggacacagtgatcaaggtagaatagg

SEQ ID NO: 276028 - DNA, 31 bp, Artificial Sequence
  Description of Artificial Sequence: Synthetic oligonucleotide
ccctggacacagtgatcaaggtagaataggc

SEQ ID NO: 276029 - DNA, 31 bp, Artificial Sequence
  Description of Artificial Sequence: Synthetic oligonucleotide
cctggacacagtgatcaaggtagaataggcc

SEQ ID NO: 276030 - DNA, 31 bp, Artificial Sequence
  Description of Artificial Sequence: Synthetic oligonucleotide
ctggacacagtgatcaaggtagaataggccc

SEQ ID NO: 276031 - DNA, 31 bp, Artificial Sequence
  Description of Artificial Sequence: Synthetic oligonucleotide
tggacacagtgatcaaggtagaataggcccc

SEQ ID NO: 276032 - DNA, 30 bp, Artificial Sequence
  Description of Artificial Sequence: Synthetic oligonucleotide
ggacacagtgatcaaggtagaataggcccc

SEQ ID NO: 276033 - DNA, 30 bp, Artificial Sequence
  Description of Artificial Sequence: Synthetic oligonucleotide
gacacagtgatcaaggtagaataggccccc

SEQ ID NO: 276034 - DNA, 30 bp, Artificial Sequence
  Description of Artificial Sequence: Synthetic oligonucleotide
acacagtgatcaaggtagaataggcccccc

SEQ ID NO: 276035 - DNA, 29 bp, Artificial Sequence
  Description of Artificial Sequence: Synthetic oligonucleotide
cacagtgatcaaggtagaataggcccccc

SEQ ID NO: 276036 - DNA, 30 bp, Artificial Sequence
  Description of Artificial Sequence: Synthetic oligonucleotide
acagtgatcaaggtagaataggcccccctg

SEQ ID NO: 276037 - DNA, 29 bp, Artificial Sequence
  Description of Artificial Sequence: Synthetic oligonucleotide
cagtgatcaaggtagaataggcccccctg

SEQ ID NO: 276038 - DNA, 29 bp, Artificial Sequence
  Description of Artificial Sequence: Synthetic oligonucleotide
agtgatcaaggtagaataggcccccctgg

SEQ ID NO: 276039 - DNA, 28 bp, Artificial Sequence
  Description of Artificial Sequence: Synthetic oligonucleotide
gtgatcaaggtagaataggcccccctgg

SEQ ID NO: 276040 - DNA, 29 bp, Artificial Sequence
  Description of Artificial Sequence: Synthetic oligonucleotide
tgatcaaggtagaataggcccccctggag

SEQ ID NO: 276041 - DNA, 28 bp, Artificial Sequence
  Description of Artificial Sequence: Synthetic oligonucleotide
gatcaaggtagaataggcccccctggag

SEQ ID NO: 276042 - DNA, 29 bp, Artificial Sequence
  Description of Artificial Sequence: Synthetic oligonucleotide
atcaaggtagaataggcccccctggagac

SEQ ID NO: 276043 - DNA, 28 bp, Artificial Sequence
  Description of Artificial Sequence: Synthetic oligonucleotide
tcaaggtagaataggcccccctggagac

SEQ ID NO: 276044 - DNA, 27 bp, Artificial Sequence
  Description of Artificial Sequence: Synthetic oligonucleotide
caaggtagaataggcccccctggagac

SEQ ID NO: 276045 - DNA, 27 bp, Artificial Sequence
  Description of Artificial Sequence: Synthetic oligonucleotide
aaggtagaataggcccccctggagacc

SEQ ID NO: 276046 - DNA, 27 bp, Artificial Sequence
  Description of Artificial Sequence: Synthetic oligonucleotide
aggtagaataggcccccctggagacct

SEQ ID NO: 276047 - DNA, 27 bp, Artificial Sequence
  Description of Artificial Sequence: Synthetic oligonucleotide
ggtagaataggcccccctggagaccta

SEQ ID NO: 276048 - DNA, 28 bp, Artificial Sequence
  Description of Artificial Sequence: Synthetic oligonucleotide
gtagaataggcccccctggagacctaag

SEQ ID NO: 276049 - DNA, 28 bp, Artificial Sequence
  Description of Artificial Sequence: Synthetic oligonucleotide
tagaataggcccccctggagacctaagc

SEQ ID NO: 276050 - DNA, 27 bp, Artificial Sequence
  Description of Artificial Sequence: Synthetic oligonucleotide
agaataggcccccctggagacctaagc

SEQ ID NO: 276051 - DNA, 27 bp, Artificial Sequence
  Description of Artificial Sequence: Synthetic oligonucleotide
gaataggcccccctggagacctaagca

SEQ ID NO: 276052 - DNA, 27 bp, Artificial Sequence
  Description of Artificial Sequence: Synthetic oligonucleotide
aataggcccccctggagacctaagcag

SEQ ID NO: 276053 - DNA, 27 bp, Artificial Sequence
  Description of Artificial Sequence: Synthetic oligonucleotide
ataggcccccctggagacctaagcaga

SEQ ID NO: 276054 - DNA, 27 bp, Artificial Sequence
  Description of Artificial Sequence: Synthetic oligonucleotide
taggcccccctggagacctaagcagat

SEQ ID NO: 276055 - DNA, 27 bp, Artificial Sequence
  Description of Artificial Sequence: Synthetic oligonucleotide
aggcccccctggagacctaagcagata

SEQ ID NO: 276056 - DNA, 27 bp, Artificial Sequence
  Description of Artificial Sequence: Synthetic oligonucleotide
ggcccccctggagacctaagcagatat

SEQ ID NO: 276057 - DNA, 28 bp, Artificial Sequence
  Description of Artificial Sequence: Synthetic oligonucleotide
gcccccctggagacctaagcagatattc

SEQ ID NO: 276058 - DNA, 28 bp, Artificial Sequence
  Description of Artificial Sequence: Synthetic oligonucleotide
cccccctggagacctaagcagatattcg

SEQ ID NO: 276059 - DNA, 28 bp, Artificial Sequence
  Description of Artificial Sequence: Synthetic oligonucleotide
ccccctggagacctaagcagatattcgg

SEQ ID NO: 276060 - DNA, 28 bp, Artificial Sequence
  Description of Artificial Sequence: Synthetic oligonucleotide
cccctggagacctaagcagatattcggg

SEQ ID NO: 276061 - DNA, 28 bp, Artificial Sequence
  Description of Artificial Sequence: Synthetic oligonucleotide
ccctggagacctaagcagatattcgggg

SEQ ID NO: 276062 - DNA, 28 bp, Artificial Sequence
  Description of Artificial Sequence: Synthetic oligonucleotide
cctggagacctaagcagatattcggggg

SEQ ID NO: 276063 - DNA, 30 bp, Artificial Sequence
  Description of Artificial Sequence: Synthetic oligonucleotide
ctggagacctaagcagatattcgggggttg

SEQ ID NO: 276064 - DNA, 30 bp, Artificial Sequence
  Description of Artificial Sequence: Synthetic oligonucleotide
tggagacctaagcagatattcgggggttgg

SEQ ID NO: 276065 - DNA, 29 bp, Artificial Sequence
  Description of Artificial Sequence: Synthetic oligonucleotide
ggagacctaagcagatattcgggggttgg

SEQ ID NO: 276066 - DNA, 30 bp, Artificial Sequence
  Description of Artificial Sequence: Synthetic oligonucleotide
gagacctaagcagatattcgggggttggtc

SEQ ID NO: 276067 - DNA, 32 bp, Artificial Sequence
  Description of Artificial Sequence: Synthetic oligonucleotide
agacctaagcagatattcgggggttggtcaac

SEQ ID NO: 276068 - DNA, 31 bp, Artificial Sequence
  Description of Artificial Sequence: Synthetic oligonucleotide
gacctaagcagatattcgggggttggtcaac

SEQ ID NO: 276069 - DNA, 31 bp, Artificial Sequence
  Description of Artificial Sequence: Synthetic oligonucleotide
acctaagcagatattcgggggttggtcaacc

SEQ ID NO: 276070 - DNA, 30 bp, Artificial Sequence
  Description of Artificial Sequence: Synthetic oligonucleotide
cctaagcagatattcgggggttggtcaacc

SEQ ID NO: 276071 - DNA, 35 bp, Artificial Sequence
  Description of Artificial Sequence: Synthetic oligonucleotide
ctaagcagatattcgggggttggtcaaccaaatac

SEQ ID NO: 276072 - DNA, 36 bp, Artificial Sequence
  Description of Artificial Sequence: Synthetic oligonucleotide
taagcagatattcgggggttggtcaaccaaatacag

SEQ ID NO: 276073 - DNA, 35 bp, Artificial Sequence
  Description of Artificial Sequence: Synthetic oligonucleotide
aagcagatattcgggggttggtcaaccaaatacag

SEQ ID NO: 276074 - DNA, 34 bp, Artificial Sequence
  Description of Artificial Sequence: Synthetic oligonucleotide
agcagatattcgggggttggtcaaccaaatacag

SEQ ID NO: 276075 - DNA, 33 bp, Artificial Sequence
  Description of Artificial Sequence: Synthetic oligonucleotide
gcagatattcgggggttggtcaaccaaatacag

SEQ ID NO: 276076 - DNA, 33 bp, Artificial Sequence
  Description of Artificial Sequence: Synthetic oligonucleotide
cagatattcgggggttggtcaaccaaatacagg

SEQ ID NO: 276077 - DNA, 40 bp, Artificial Sequence
  Description of Artificial Sequence: Synthetic oligonucleotide
agatattcgggggttggtcaaccaaatacaggaaatttag

SEQ ID NO: 276078 - DNA, 39 bp, Artificial Sequence
  Description of Artificial Sequence: Synthetic oligonucleotide
gatattcgggggttggtcaaccaaatacaggaaatttag

SEQ ID NO: 276079 - DNA, 39 bp, Artificial Sequence
  Description of Artificial Sequence: Synthetic oligonucleotide
atattcgggggttggtcaaccaaatacaggaaatttagg

SEQ ID NO: 276080 - DNA, 38 bp, Artificial Sequence
  Description of Artificial Sequence: Synthetic oligonucleotide
tattcgggggttggtcaaccaaatacaggaaatttagg

SEQ ID NO: 276081 - DNA, 37 bp, Artificial Sequence
  Description of Artificial Sequence: Synthetic oligonucleotide
attcgggggttggtcaaccaaatacaggaaatttagg

SEQ ID NO: 276082 - DNA, 36 bp, Artificial Sequence
  Description of Artificial Sequence: Synthetic oligonucleotide
ttcgggggttggtcaaccaaatacaggaaatttagg

SEQ ID NO: 276083 - DNA, 35 bp, Artificial Sequence
  Description of Artificial Sequence: Synthetic oligonucleotide
tcgggggttggtcaaccaaatacaggaaatttagg

SEQ ID NO: 276084 - DNA, 34 bp, Artificial Sequence
  Description of Artificial Sequence: Synthetic oligonucleotide
cgggggttggtcaaccaaatacaggaaatttagg

SEQ ID NO: 276085 - DNA, 37 bp, Artificial Sequence
  Description of Artificial Sequence: Synthetic oligonucleotide
gggggttggtcaaccaaatacaggaaatttaggaatc

SEQ ID NO: 276086 - DNA, 38 bp, Artificial Sequence
  Description of Artificial Sequence: Synthetic oligonucleotide
ggggttggtcaaccaaatacaggaaatttaggaatctg

SEQ ID NO: 276087 - DNA, 39 bp, Artificial Sequence
  Description of Artificial Sequence: Synthetic oligonucleotide
gggttggtcaaccaaatacaggaaatttaggaatctgag

SEQ ID NO: 276088 - DNA, 39 bp, Artificial Sequence
  Description of Artificial Sequence: Synthetic oligonucleotide
ggttggtcaaccaaatacaggaaatttaggaatctgagg

SEQ ID NO: 276089 - DNA, 40 bp, Artificial Sequence
  Description of Artificial Sequence: Synthetic oligonucleotide
gttggtcaaccaaatacaggaaatttaggaatctgaggag

SEQ ID NO: 276090 - DNA, 40 bp, Artificial Sequence
  Description of Artificial Sequence: Synthetic oligonucleotide
ttggtcaaccaaatacaggaaatttaggaatctgaggagc

SEQ ID NO: 276091 - DNA, 39 bp, Artificial Sequence
  Description of Artificial Sequence: Synthetic oligonucleotide
tggtcaaccaaatacaggaaatttaggaatctgaggagc

SEQ ID NO: 276092 - DNA, 38 bp, Artificial Sequence
  Description of Artificial Sequence: Synthetic oligonucleotide
ggtcaaccaaatacaggaaatttaggaatctgaggagc

SEQ ID NO: 276093 - DNA, 40 bp, Artificial Sequence
  Description of Artificial Sequence: Synthetic oligonucleotide
gtcaaccaaatacaggaaatttaggaatctgaggagcttc

SEQ ID NO: 276094 - DNA, 40 bp, Artificial Sequence
  Description of Artificial Sequence: Synthetic oligonucleotide
tcaaccaaatacaggaaatttaggaatctgaggagcttcc

SEQ ID NO: 276095 - DNA, 39 bp, Artificial Sequence
  Description of Artificial Sequence: Synthetic oligonucleotide
caaccaaatacaggaaatttaggaatctgaggagcttcc

SEQ ID NO: 276096 - DNA, 40 bp, Artificial Sequence
  Description of Artificial Sequence: Synthetic oligonucleotide
aaccaaatacaggaaatttaggaatctgaggagcttccac

SEQ ID NO: 276097 - DNA, 39 bp, Artificial Sequence
  Description of Artificial Sequence: Synthetic oligonucleotide
accaaatacaggaaatttaggaatctgaggagcttccac

SEQ ID NO: 276098 - DNA, 38 bp, Artificial Sequence
  Description of Artificial Sequence: Synthetic oligonucleotide
ccaaatacaggaaatttaggaatctgaggagcttccac

SEQ ID NO: 276099 - DNA, 39 bp, Artificial Sequence
  Description of Artificial Sequence: Synthetic oligonucleotide
caaatacaggaaatttaggaatctgaggagcttccactc

SEQ ID NO: 276100 - DNA, 40 bp, Artificial Sequence
  Description of Artificial Sequence: Synthetic oligonucleotide
aaatacaggaaatttaggaatctgaggagcttccactcac

SEQ ID NO: 276101 - DNA, 39 bp, Artificial Sequence
  Description of Artificial Sequence: Synthetic oligonucleotide
aatacaggaaatttaggaatctgaggagcttccactcac

SEQ ID NO: 276102 - DNA, 38 bp, Artificial Sequence
  Description of Artificial Sequence: Synthetic oligonucleotide
atacaggaaatttaggaatctgaggagcttccactcac

SEQ ID NO: 276103 - DNA, 37 bp, Artificial Sequence
  Description of Artificial Sequence: Synthetic oligonucleotide
tacaggaaatttaggaatctgaggagcttccactcac

SEQ ID NO: 276104 - DNA, 36 bp, Artificial Sequence
  Description of Artificial Sequence: Synthetic oligonucleotide
acaggaaatttaggaatctgaggagcttccactcac

SEQ ID NO: 276105 - DNA, 35 bp, Artificial Sequence
  Description of Artificial Sequence: Synthetic oligonucleotide
caggaaatttaggaatctgaggagcttccactcac

SEQ ID NO: 276106 - DNA, 35 bp, Artificial Sequence
  Description of Artificial Sequence: Synthetic oligonucleotide
aggaaatttaggaatctgaggagcttccactcacc

SEQ ID NO: 276107 - DNA, 34 bp, Artificial Sequence
  Description of Artificial Sequence: Synthetic oligonucleotide
ggaaatttaggaatctgaggagcttccactcacc

SEQ ID NO: 276108 - DNA, 34 bp, Artificial Sequence
  Description of Artificial Sequence: Synthetic oligonucleotide
gaaatttaggaatctgaggagcttccactcaccc

SEQ ID NO: 276109 - DNA, 36 bp, Artificial Sequence
  Description of Artificial Sequence: Synthetic oligonucleotide
aaatttaggaatctgaggagcttccactcacccatg

SEQ ID NO: 276110 - DNA, 35 bp, Artificial Sequence
  Description of Artificial Sequence: Synthetic oligonucleotide
aatttaggaatctgaggagcttccactcacccatg

SEQ ID NO: 276111 - DNA, 34 bp, Artificial Sequence
  Description of Artificial Sequence: Synthetic oligonucleotide
atttaggaatctgaggagcttccactcacccatg

SEQ ID NO: 276112 - DNA, 33 bp, Artificial Sequence
  Description of Artificial Sequence: Synthetic oligonucleotide
tttaggaatctgaggagcttccactcacccatg

SEQ ID NO: 276113 - DNA, 32 bp, Artificial Sequence
  Description of Artificial Sequence: Synthetic oligonucleotide
ttaggaatctgaggagcttccactcacccatg

SEQ ID NO: 276114 - DNA, 31 bp, Artificial Sequence
  Description of Artificial Sequence: Synthetic oligonucleotide
taggaatctgaggagcttccactcacccatg

SEQ ID NO: 276115 - DNA, 30 bp, Artificial Sequence
  Description of Artificial Sequence: Synthetic oligonucleotide
aggaatctgaggagcttccactcacccatg

SEQ ID NO: 276116 - DNA, 29 bp, Artificial Sequence
  Description of Artificial Sequence: Synthetic oligonucleotide
ggaatctgaggagcttccactcacccatg

SEQ ID NO: 276117 - DNA, 29 bp, Artificial Sequence
  Description of Artificial Sequence: Synthetic oligonucleotide
gaatctgaggagcttccactcacccatgc

SEQ ID NO: 276118 - DNA, 30 bp, Artificial Sequence
  Description of Artificial Sequence: Synthetic oligonucleotide
aatctgaggagcttccactcacccatgctg

SEQ ID NO: 276119 - DNA, 29 bp, Artificial Sequence
  Description of Artificial Sequence: Synthetic oligonucleotide
atctgaggagcttccactcacccatgctg

SEQ ID NO: 276120 - DNA, 28 bp, Artificial Sequence
  Description of Artificial Sequence: Synthetic oligonucleotide
tctgaggagcttccactcacccatgctg

SEQ ID NO: 276121 - DNA, 27 bp, Artificial Sequence
  Description of Artificial Sequence: Synthetic oligonucleotide
ctgaggagcttccactcacccatgctg

SEQ ID NO: 276122 - DNA, 35 bp, Artificial Sequence
  Description of Artificial Sequence: Synthetic oligonucleotide
tgaggagcttccactcacccatgctgaatattttg

SEQ ID NO: 276123 - DNA, 34 bp, Artificial Sequence
  Description of Artificial Sequence: Synthetic oligonucleotide
gaggagcttccactcacccatgctgaatattttg

SEQ ID NO: 276124 - DNA, 36 bp, Artificial Sequence
  Description of Artificial Sequence: Synthetic oligonucleotide
aggagcttccactcacccatgctgaatattttgaag

SEQ ID NO: 276125 - DNA, 35 bp, Artificial Sequence
  Description of Artificial Sequence: Synthetic oligonucleotide
ggagcttccactcacccatgctgaatattttgaag

SEQ ID NO: 276126 - DNA, 36 bp, Artificial Sequence
  Description of Artificial Sequence: Synthetic oligonucleotide
gagcttccactcacccatgctgaatattttgaagag

SEQ ID NO: 276127 - DNA, 38 bp, Artificial Sequence
  Description of Artificial Sequence: Synthetic oligonucleotide
agcttccactcacccatgctgaatattttgaagagatc

SEQ ID NO: 276128 - DNA, 37 bp, Artificial Sequence
  Description of Artificial Sequence: Synthetic oligonucleotide
gcttccactcacccatgctgaatattttgaagagatc

SEQ ID NO: 276129 - DNA, 37 bp, Artificial Sequence
  Description of Artificial Sequence: Synthetic oligonucleotide
cttccactcacccatgctgaatattttgaagagatcg

SEQ ID NO: 276130 - DNA, 37 bp, Artificial Sequence
  Description of Artificial Sequence: Synthetic oligonucleotide
ttccactcacccatgctgaatattttgaagagatcgg

SEQ ID NO: 276131 - DNA, 36 bp, Artificial Sequence
  Description of Artificial Sequence: Synthetic oligonucleotide
tccactcacccatgctgaatattttgaagagatcgg

SEQ ID NO: 276132 - DNA, 35 bp, Artificial Sequence
  Description of Artificial Sequence: Synthetic oligonucleotide
ccactcacccatgctgaatattttgaagagatcgg

SEQ ID NO: 276133 - DNA, 41 bp, Artificial Sequence
  Description of Artificial Sequence: Synthetic oligonucleotide
cactcacccatgctgaatattttgaagagatcggtataaag

SEQ ID NO: 276134 - DNA, 41 bp, Artificial Sequence
  Description of Artificial Sequence: Synthetic oligonucleotide
actcacccatgctgaatattttgaagagatcggtataaagg

SEQ ID NO: 276135 - DNA, 40 bp, Artificial Sequence
  Description of Artificial Sequence: Synthetic oligonucleotide
ctcacccatgctgaatattttgaagagatcggtataaagg

SEQ ID NO: 276136 - DNA, 40 bp, Artificial Sequence
  Description of Artificial Sequence: Synthetic oligonucleotide
tcacccatgctgaatattttgaagagatcggtataaaggc

SEQ ID NO: 276137 - DNA, 39 bp, Artificial Sequence
  Description of Artificial Sequence: Synthetic oligonucleotide
cacccatgctgaatattttgaagagatcggtataaaggc

SEQ ID NO: 276138 - DNA, 40 bp, Artificial Sequence
  Description of Artificial Sequence: Synthetic oligonucleotide
acccatgctgaatattttgaagagatcggtataaaggctc

SEQ ID NO: 276139 - DNA, 39 bp, Artificial Sequence
  Description of Artificial Sequence: Synthetic oligonucleotide
cccatgctgaatattttgaagagatcggtataaaggctc

SEQ ID NO: 276140 - DNA, 39 bp, Artificial Sequence
  Description of Artificial Sequence: Synthetic oligonucleotide
ccatgctgaatattttgaagagatcggtataaaggctcc

SEQ ID NO: 276141 - DNA, 42 bp, Artificial Sequence
  Description of Artificial Sequence: Synthetic oligonucleotide
catgctgaatattttgaagagatcggtataaaggctcctaag

SEQ ID NO: 276142 - DNA, 42 bp, Artificial Sequence
  Description of Artificial Sequence: Synthetic oligonucleotide
atgctgaatattttgaagagatcggtataaaggctcctaagg

SEQ ID NO: 276143 - DNA, 41 bp, Artificial Sequence
  Description of Artificial Sequence: Synthetic oligonucleotide
tgctgaatattttgaagagatcggtataaaggctcctaagg

SEQ ID NO: 276144 - DNA, 40 bp, Artificial Sequence
  Description of Artificial Sequence: Synthetic oligonucleotide
gctgaatattttgaagagatcggtataaaggctcctaagg

SEQ ID NO: 276145 - DNA, 40 bp, Artificial Sequence
  Description of Artificial Sequence: Synthetic oligonucleotide
ctgaatattttgaagagatcggtataaaggctcctaaggc

SEQ ID NO: 276146 - DNA, 40 bp, Artificial Sequence
  Description of Artificial Sequence: Synthetic oligonucleotide
tgaatattttgaagagatcggtataaaggctcctaaggcg

SEQ ID NO: 276147 - DNA, 39 bp, Artificial Sequence
  Description of Artificial Sequence: Synthetic oligonucleotide
gaatattttgaagagatcggtataaaggctcctaaggcg

SEQ ID NO: 276148 - DNA, 39 bp, Artificial Sequence
  Description of Artificial Sequence: Synthetic oligonucleotide
aatattttgaagagatcggtataaaggctcctaaggcgg

SEQ ID NO: 276149 - DNA, 38 bp, Artificial Sequence
  Description of Artificial Sequence: Synthetic oligonucleotide
atattttgaagagatcggtataaaggctcctaaggcgg

SEQ ID NO: 276150 - DNA, 37 bp, Artificial Sequence
  Description of Artificial Sequence: Synthetic oligonucleotide
tattttgaagagatcggtataaaggctcctaaggcgg

SEQ ID NO: 276151 - DNA, 36 bp, Artificial Sequence
  Description of Artificial Sequence: Synthetic oligonucleotide
attttgaagagatcggtataaaggctcctaaggcgg

SEQ ID NO: 276152 - DNA, 35 bp, Artificial Sequence
  Description of Artificial Sequence: Synthetic oligonucleotide
ttttgaagagatcggtataaaggctcctaaggcgg

SEQ ID NO: 276153 - DNA, 34 bp, Artificial Sequence
  Description of Artificial Sequence: Synthetic oligonucleotide
tttgaagagatcggtataaaggctcctaaggcgg

SEQ ID NO: 276154 - DNA, 33 bp, Artificial Sequence
  Description of Artificial Sequence: Synthetic oligonucleotide
ttgaagagatcggtataaaggctcctaaggcgg

SEQ ID NO: 276155 - DNA, 32 bp, Artificial Sequence
  Description of Artificial Sequence: Synthetic oligonucleotide
tgaagagatcggtataaaggctcctaaggcgg

SEQ ID NO: 276156 - DNA, 31 bp, Artificial Sequence
  Description of Artificial Sequence: Synthetic oligonucleotide
gaagagatcggtataaaggctcctaaggcgg

SEQ ID NO: 276157 - DNA, 32 bp, Artificial Sequence
  Description of Artificial Sequence: Synthetic oligonucleotide
aagagatcggtataaaggctcctaaggcggtc

SEQ ID NO: 276158 - DNA, 31 bp, Artificial Sequence
  Description of Artificial Sequence: Synthetic oligonucleotide
agagatcggtataaaggctcctaaggcggtc

SEQ ID NO: 276159 - DNA, 30 bp, Artificial Sequence
  Description of Artificial Sequence: Synthetic oligonucleotide
gagatcggtataaaggctcctaaggcggtc

SEQ ID NO: 276160 - DNA, 33 bp, Artificial Sequence
  Description of Artificial Sequence: Synthetic oligonucleotide
agatcggtataaaggctcctaaggcggtcattc

SEQ ID NO: 276161 - DNA, 32 bp, Artificial Sequence
  Description of Artificial Sequence: Synthetic oligonucleotide
gatcggtataaaggctcctaaggcggtcattc

SEQ ID NO: 276162 - DNA, 33 bp, Artificial Sequence
  Description of Artificial Sequence: Synthetic oligonucleotide
atcggtataaaggctcctaaggcggtcattctg

SEQ ID NO: 276163 - DNA, 32 bp, Artificial Sequence
  Description of Artificial Sequence: Synthetic oligonucleotide
tcggtataaaggctcctaaggcggtcattctg

SEQ ID NO: 276164 - DNA, 31 bp, Artificial Sequence
  Description of Artificial Sequence: Synthetic oligonucleotide
cggtataaaggctcctaaggcggtcattctg

SEQ ID NO: 276165 - DNA, 34 bp, Artificial Sequence
  Description of Artificial Sequence: Synthetic oligonucleotide
ggtataaaggctcctaaggcggtcattctgtatg

SEQ ID NO: 276166 - DNA, 34 bp, Artificial Sequence
  Description of Artificial Sequence: Synthetic oligonucleotide
gtataaaggctcctaaggcggtcattctgtatgg

SEQ ID NO: 276167 - DNA, 35 bp, Artificial Sequence
  Description of Artificial Sequence: Synthetic oligonucleotide
tataaaggctcctaaggcggtcattctgtatggtc

SEQ ID NO: 276168 - DNA, 34 bp, Artificial Sequence
  Description of Artificial Sequence: Synthetic oligonucleotide
ataaaggctcctaaggcggtcattctgtatggtc

SEQ ID NO: 276169 - DNA, 33 bp, Artificial Sequence
  Description of Artificial Sequence: Synthetic oligonucleotide
taaaggctcctaaggcggtcattctgtatggtc

SEQ ID NO: 276170 - DNA, 32 bp, Artificial Sequence
  Description of Artificial Sequence: Synthetic oligonucleotide
aaaggctcctaaggcggtcattctgtatggtc

SEQ ID NO: 276171 - DNA, 31 bp, Artificial Sequence
  Description of Artificial Sequence: Synthetic oligonucleotide
aaggctcctaaggcggtcattctgtatggtc

SEQ ID NO: 276172 - DNA, 30 bp, Artificial Sequence
  Description of Artificial Sequence: Synthetic oligonucleotide
aggctcctaaggcggtcattctgtatggtc

SEQ ID NO: 276173 - DNA, 29 bp, Artificial Sequence
  Description of Artificial Sequence: Synthetic oligonucleotide
ggctcctaaggcggtcattctgtatggtc

SEQ ID NO: 276174 - DNA, 29 bp, Artificial Sequence
  Description of Artificial Sequence: Synthetic oligonucleotide
gctcctaaggcggtcattctgtatggtcc

SEQ ID NO: 276175 - DNA, 30 bp, Artificial Sequence
  Description of Artificial Sequence: Synthetic oligonucleotide
ctcctaaggcggtcattctgtatggtccag

SEQ ID NO: 276176 - DNA, 30 bp, Artificial Sequence
  Description of Artificial Sequence: Synthetic oligonucleotide
tcctaaggcggtcattctgtatggtccagc

SEQ ID NO: 276177 - DNA, 29 bp, Artificial Sequence
  Description of Artificial Sequence: Synthetic oligonucleotide
cctaaggcggtcattctgtatggtccagc

SEQ ID NO: 276178 - DNA, 30 bp, Artificial Sequence
  Description of Artificial Sequence: Synthetic oligonucleotide
ctaaggcggtcattctgtatggtccagctg

SEQ ID NO: 276179 - DNA, 30 bp, Artificial Sequence
  Description of Artificial Sequence: Synthetic oligonucleotide
taaggcggtcattctgtatggtccagctgg

SEQ ID NO: 276180 - DNA, 29 bp, Artificial Sequence
  Description of Artificial Sequence: Synthetic oligonucleotide
aaggcggtcattctgtatggtccagctgg

SEQ ID NO: 276181 - DNA, 28 bp, Artificial Sequence
  Description of Artificial Sequence: Synthetic oligonucleotide
aggcggtcattctgtatggtccagctgg

SEQ ID NO: 276182 - DNA, 27 bp, Artificial Sequence
  Description of Artificial Sequence: Synthetic oligonucleotide
ggcggtcattctgtatggtccagctgg

SEQ ID NO: 276183 - DNA, 27 bp, Artificial Sequence
  Description of Artificial Sequence: Synthetic oligonucleotide
gcggtcattctgtatggtccagctggc

SEQ ID NO: 276184 - DNA, 28 bp, Artificial Sequence
  Description of Artificial Sequence: Synthetic oligonucleotide
cggtcattctgtatggtccagctggcac

SEQ ID NO: 276185 - DNA, 29 bp, Artificial Sequence
  Description of Artificial Sequence: Synthetic oligonucleotide
ggtcattctgtatggtccagctggcacag

SEQ ID NO: 276186 - DNA, 29 bp, Artificial Sequence
  Description of Artificial Sequence: Synthetic oligonucleotide
gtcattctgtatggtccagctggcacagc

SEQ ID NO: 276187 - DNA, 34 bp, Artificial Sequence
  Description of Artificial Sequence: Synthetic oligonucleotide
tcattctgtatggtccagctggcacagctaaaac

SEQ ID NO: 276188 - DNA, 33 bp, Artificial Sequence
  Description of Artificial Sequence: Synthetic oligonucleotide
cattctgtatggtccagctggcacagctaaaac

SEQ ID NO: 276189 - DNA, 33 bp, Artificial Sequence
  Description of Artificial Sequence: Synthetic oligonucleotide
attctgtatggtccagctggcacagctaaaacc

SEQ ID NO: 276190 - DNA, 32 bp, Artificial Sequence
  Description of Artificial Sequence: Synthetic oligonucleotide
ttctgtatggtccagctggcacagctaaaacc

SEQ ID NO: 276191 - DNA, 31 bp, Artificial Sequence
  Description of Artificial Sequence: Synthetic oligonucleotide
tctgtatggtccagctggcacagctaaaacc

SEQ ID NO: 276192 - DNA, 30 bp, Artificial Sequence
  Description of Artificial Sequence: Synthetic oligonucleotide
ctgtatggtccagctggcacagctaaaacc

SEQ ID NO: 276193 - DNA, 32 bp, Artificial Sequence
  Description of Artificial Sequence: Synthetic oligonucleotide
tgtatggtccagctggcacagctaaaaccttc

SEQ ID NO: 276194 - DNA, 31 bp, Artificial Sequence
  Description of Artificial Sequence: Synthetic oligonucleotide
gtatggtccagctggcacagctaaaaccttc

SEQ ID NO: 276195 - DNA, 34 bp, Artificial Sequence
  Description of Artificial Sequence: Synthetic oligonucleotide
tatggtccagctggcacagctaaaaccttcttag

SEQ ID NO: 276196 - DNA, 33 bp, Artificial Sequence
  Description of Artificial Sequence: Synthetic oligonucleotide
atggtccagctggcacagctaaaaccttcttag

SEQ ID NO: 276197 - DNA, 32 bp, Artificial Sequence
  Description of Artificial Sequence: Synthetic oligonucleotide
tggtccagctggcacagctaaaaccttcttag

SEQ ID NO: 276198 - DNA, 31 bp, Artificial Sequence
  Description of Artificial Sequence: Synthetic oligonucleotide
ggtccagctggcacagctaaaaccttcttag

SEQ ID NO: 276199 - DNA, 31 bp, Artificial Sequence
  Description of Artificial Sequence: Synthetic oligonucleotide
gtccagctggcacagctaaaaccttcttagc

SEQ ID NO: 276200 - DNA, 31 bp, Artificial Sequence
  Description of Artificial Sequence: Synthetic oligonucleotide
tccagctggcacagctaaaaccttcttagcc

SEQ ID NO: 276201 - DNA, 30 bp, Artificial Sequence
  Description of Artificial Sequence: Synthetic oligonucleotide
ccagctggcacagctaaaaccttcttagcc

SEQ ID NO: 276202 - DNA, 33 bp, Artificial Sequence
  Description of Artificial Sequence: Synthetic oligonucleotide
cagctggcacagctaaaaccttcttagccaaac

SEQ ID NO: 276203 - DNA, 33 bp, Artificial Sequence
  Description of Artificial Sequence: Synthetic oligonucleotide
agctggcacagctaaaaccttcttagccaaacc

SEQ ID NO: 276204 - DNA, 32 bp, Artificial Sequence
  Description of Artificial Sequence: Synthetic oligonucleotide
gctggcacagctaaaaccttcttagccaaacc

SEQ ID NO: 276205 - DNA, 33 bp, Artificial Sequence
  Description of Artificial Sequence: Synthetic oligonucleotide
ctggcacagctaaaaccttcttagccaaaccag

SEQ ID NO: 276206 - DNA, 35 bp, Artificial Sequence
  Description of Artificial Sequence: Synthetic oligonucleotide
tggcacagctaaaaccttcttagccaaaccagtag

SEQ ID NO: 276207 - DNA, 34 bp, Artificial Sequence
  Description of Artificial Sequence: Synthetic oligonucleotide
ggcacagctaaaaccttcttagccaaaccagtag

SEQ ID NO: 276208 - DNA, 34 bp, Artificial Sequence
  Description of Artificial Sequence: Synthetic oligonucleotide
gcacagctaaaaccttcttagccaaaccagtagc

SEQ ID NO: 276209 - DNA, 37 bp, Artificial Sequence
  Description of Artificial Sequence: Synthetic oligonucleotide
cacagctaaaaccttcttagccaaaccagtagcaatc

SEQ ID NO: 276210 - DNA, 37 bp, Artificial Sequence
  Description of Artificial Sequence: Synthetic oligonucleotide
acagctaaaaccttcttagccaaaccagtagcaatcc

SEQ ID NO: 276211 - DNA, 36 bp, Artificial Sequence
  Description of Artificial Sequence: Synthetic oligonucleotide
cagctaaaaccttcttagccaaaccagtagcaatcc

SEQ ID NO: 276212 - DNA, 39 bp, Artificial Sequence
  Description of Artificial Sequence: Synthetic oligonucleotide
agctaaaaccttcttagccaaaccagtagcaatccaaac

SEQ ID NO: 276213 - DNA, 38 bp, Artificial Sequence
  Description of Artificial Sequence: Synthetic oligonucleotide
gctaaaaccttcttagccaaaccagtagcaatccaaac

SEQ ID NO: 276214 - DNA, 38 bp, Artificial Sequence
  Description of Artificial Sequence: Synthetic oligonucleotide
ctaaaaccttcttagccaaaccagtagcaatccaaacc

SEQ ID NO: 276215 - DNA, 39 bp, Artificial Sequence
  Description of Artificial Sequence: Synthetic oligonucleotide
taaaaccttcttagccaaaccagtagcaatccaaacctc

SEQ ID NO: 276216 - DNA, 38 bp, Artificial Sequence
  Description of Artificial Sequence: Synthetic oligonucleotide
aaaaccttcttagccaaaccagtagcaatccaaacctc

SEQ ID NO: 276217 - DNA, 37 bp, Artificial Sequence
  Description of Artificial Sequence: Synthetic oligonucleotide
aaaccttcttagccaaaccagtagcaatccaaacctc

SEQ ID NO: 276218 - DNA, 36 bp, Artificial Sequence
  Description of Artificial Sequence: Synthetic oligonucleotide
aaccttcttagccaaaccagtagcaatccaaacctc

SEQ ID NO: 276219 - DNA, 35 bp, Artificial Sequence
  Description of Artificial Sequence: Synthetic oligonucleotide
accttcttagccaaaccagtagcaatccaaacctc

SEQ ID NO: 276220 - DNA, 34 bp, Artificial Sequence
  Description of Artificial Sequence: Synthetic oligonucleotide
ccttcttagccaaaccagtagcaatccaaacctc

SEQ ID NO: 276221 - DNA, 35 bp, Artificial Sequence
  Description of Artificial Sequence: Synthetic oligonucleotide
cttcttagccaaaccagtagcaatccaaacctctg

SEQ ID NO: 276222 - DNA, 35 bp, Artificial Sequence
  Description of Artificial Sequence: Synthetic oligonucleotide
ttcttagccaaaccagtagcaatccaaacctctgc

SEQ ID NO: 276223 - DNA, 34 bp, Artificial Sequence
  Description of Artificial Sequence: Synthetic oligonucleotide
tcttagccaaaccagtagcaatccaaacctctgc

SEQ ID NO: 276224 - DNA, 33 bp, Artificial Sequence
  Description of Artificial Sequence: Synthetic oligonucleotide
cttagccaaaccagtagcaatccaaacctctgc

SEQ ID NO: 276225 - DNA, 33 bp, Artificial Sequence
  Description of Artificial Sequence: Synthetic oligonucleotide
ttagccaaaccagtagcaatccaaacctctgcc

SEQ ID NO: 276226 - DNA, 32 bp, Artificial Sequence
  Description of Artificial Sequence: Synthetic oligonucleotide
tagccaaaccagtagcaatccaaacctctgcc

SEQ ID NO: 276227 - DNA, 31 bp, Artificial Sequence
  Description of Artificial Sequence: Synthetic oligonucleotide
agccaaaccagtagcaatccaaacctctgcc

SEQ ID NO: 276228 - DNA, 30 bp, Artificial Sequence
  Description of Artificial Sequence: Synthetic oligonucleotide
gccaaaccagtagcaatccaaacctctgcc

SEQ ID NO: 276229 - DNA, 31 bp, Artificial Sequence
  Description of Artificial Sequence: Synthetic oligonucleotide
ccaaaccagtagcaatccaaacctctgccac

SEQ ID NO: 276230 - DNA, 34 bp, Artificial Sequence
  Description of Artificial Sequence: Synthetic oligonucleotide
caaaccagtagcaatccaaacctctgccactttc

SEQ ID NO: 276231 - DNA, 36 bp, Artificial Sequence
  Description of Artificial Sequence: Synthetic oligonucleotide
aaaccagtagcaatccaaacctctgccactttcatg

SEQ ID NO: 276232 - DNA, 35 bp, Artificial Sequence
  Description of Artificial Sequence: Synthetic oligonucleotide
aaccagtagcaatccaaacctctgccactttcatg

SEQ ID NO: 276233 - DNA, 34 bp, Artificial Sequence
  Description of Artificial Sequence: Synthetic oligonucleotide
accagtagcaatccaaacctctgccactttcatg

SEQ ID NO: 276234 - DNA, 33 bp, Artificial Sequence
  Description of Artificial Sequence: Synthetic oligonucleotide
ccagtagcaatccaaacctctgccactttcatg

SEQ ID NO: 276235 - DNA, 34 bp, Artificial Sequence
  Description of Artificial Sequence: Synthetic oligonucleotide
cagtagcaatccaaacctctgccactttcatgag

SEQ ID NO: 276236 - DNA, 35 bp, Artificial Sequence
  Description of Artificial Sequence: Synthetic oligonucleotide
agtagcaatccaaacctctgccactttcatgagag

SEQ ID NO: 276237 - DNA, 34 bp, Artificial Sequence
  Description of Artificial Sequence: Synthetic oligonucleotide
gtagcaatccaaacctctgccactttcatgagag

SEQ ID NO: 276238 - DNA, 35 bp, Artificial Sequence
  Description of Artificial Sequence: Synthetic oligonucleotide
tagcaatccaaacctctgccactttcatgagagtg

SEQ ID NO: 276239 - DNA, 34 bp, Artificial Sequence
  Description of Artificial Sequence: Synthetic oligonucleotide
agcaatccaaacctctgccactttcatgagagtg

SEQ ID NO: 276240 - DNA, 33 bp, Artificial Sequence
  Description of Artificial Sequence: Synthetic oligonucleotide
gcaatccaaacctctgccactttcatgagagtg

SEQ ID NO: 276241 - DNA, 33 bp, Artificial Sequence
  Description of Artificial Sequence: Synthetic oligonucleotide
caatccaaacctctgccactttcatgagagtgg

SEQ ID NO: 276242 - DNA, 35 bp, Artificial Sequence
  Description of Artificial Sequence: Synthetic oligonucleotide
aatccaaacctctgccactttcatgagagtggatg

SEQ ID NO: 276243 - DNA, 34 bp, Artificial Sequence
  Description of Artificial Sequence: Synthetic oligonucleotide
atccaaacctctgccactttcatgagagtggatg

SEQ ID NO: 276244 - DNA, 33 bp, Artificial Sequence
  Description of Artificial Sequence: Synthetic oligonucleotide
tccaaacctctgccactttcatgagagtggatg

SEQ ID NO: 276245 - DNA, 32 bp, Artificial Sequence
  Description of Artificial Sequence: Synthetic oligonucleotide
ccaaacctctgccactttcatgagagtggatg

SEQ ID NO: 276246 - DNA, 32 bp, Artificial Sequence
  Description of Artificial Sequence: Synthetic oligonucleotide
caaacctctgccactttcatgagagtggatgg

SEQ ID NO: 276247 - DNA, 32 bp, Artificial Sequence
  Description of Artificial Sequence: Synthetic oligonucleotide
aaacctctgccactttcatgagagtggatggc

SEQ ID NO: 276248 - DNA, 31 bp, Artificial Sequence
  Description of Artificial Sequence: Synthetic oligonucleotide
aacctctgccactttcatgagagtggatggc

SEQ ID NO: 276249 - DNA, 30 bp, Artificial Sequence
  Description of Artificial Sequence: Synthetic oligonucleotide
acctctgccactttcatgagagtggatggc

SEQ ID NO: 276250 - DNA, 29 bp, Artificial Sequence
  Description of Artificial Sequence: Synthetic oligonucleotide
cctctgccactttcatgagagtggatggc

SEQ ID NO: 276251 - DNA, 30 bp, Artificial Sequence
  Description of Artificial Sequence: Synthetic oligonucleotide
ctctgccactttcatgagagtggatggctc

SEQ ID NO: 276252 - DNA, 31 bp, Artificial Sequence
  Description of Artificial Sequence: Synthetic oligonucleotide
tctgccactttcatgagagtggatggctctg

SEQ ID NO: 276253 - DNA, 30 bp, Artificial Sequence
  Description of Artificial Sequence: Synthetic oligonucleotide
ctgccactttcatgagagtggatggctctg

SEQ ID NO: 276254 - DNA, 32 bp, Artificial Sequence
  Description of Artificial Sequence: Synthetic oligonucleotide
tgccactttcatgagagtggatggctctgatc

SEQ ID NO: 276255 - DNA, 31 bp, Artificial Sequence
  Description of Artificial Sequence: Synthetic oligonucleotide
gccactttcatgagagtggatggctctgatc

SEQ ID NO: 276256 - DNA, 36 bp, Artificial Sequence
  Description of Artificial Sequence: Synthetic oligonucleotide
ccactttcatgagagtggatggctctgatcttattc

SEQ ID NO: 276257 - DNA, 37 bp, Artificial Sequence
  Description of Artificial Sequence: Synthetic oligonucleotide
cactttcatgagagtggatggctctgatcttattcag

SEQ ID NO: 276258 - DNA, 39 bp, Artificial Sequence
  Description of Artificial Sequence: Synthetic oligonucleotide
actttcatgagagtggatggctctgatcttattcagtag

SEQ ID NO: 276259 - DNA, 38 bp, Artificial Sequence
  Description of Artificial Sequence: Synthetic oligonucleotide
ctttcatgagagtggatggctctgatcttattcagtag

SEQ ID NO: 276260 - DNA, 40 bp, Artificial Sequence
  Description of Artificial Sequence: Synthetic oligonucleotide
tttcatgagagtggatggctctgatcttattcagtagtac

SEQ ID NO: 276261 - DNA, 39 bp, Artificial Sequence
  Description of Artificial Sequence: Synthetic oligonucleotide
ttcatgagagtggatggctctgatcttattcagtagtac

SEQ ID NO: 276262 - DNA, 38 bp, Artificial Sequence
  Description of Artificial Sequence: Synthetic oligonucleotide
tcatgagagtggatggctctgatcttattcagtagtac

SEQ ID NO: 276263 - DNA, 37 bp, Artificial Sequence
  Description of Artificial Sequence: Synthetic oligonucleotide
catgagagtggatggctctgatcttattcagtagtac

SEQ ID NO: 276264 - DNA, 37 bp, Artificial Sequence
  Description of Artificial Sequence: Synthetic oligonucleotide
atgagagtggatggctctgatcttattcagtagtacc

SEQ ID NO: 276265 - DNA, 36 bp, Artificial Sequence
  Description of Artificial Sequence: Synthetic oligonucleotide
tgagagtggatggctctgatcttattcagtagtacc

SEQ ID NO: 276266 - DNA, 35 bp, Artificial Sequence
  Description of Artificial Sequence: Synthetic oligonucleotide
gagagtggatggctctgatcttattcagtagtacc

SEQ ID NO: 276267 - DNA, 37 bp, Artificial Sequence
  Description of Artificial Sequence: Synthetic oligonucleotide
agagtggatggctctgatcttattcagtagtacctag

SEQ ID NO: 276268 - DNA, 36 bp, Artificial Sequence
  Description of Artificial Sequence: Synthetic oligonucleotide
gagtggatggctctgatcttattcagtagtacctag

SEQ ID NO: 276269 - DNA, 36 bp, Artificial Sequence
  Description of Artificial Sequence: Synthetic oligonucleotide
agtggatggctctgatcttattcagtagtacctagc

SEQ ID NO: 276270 - DNA, 35 bp, Artificial Sequence
  Description of Artificial Sequence: Synthetic oligonucleotide
gtggatggctctgatcttattcagtagtacctagc

SEQ ID NO: 276271 - DNA, 36 bp, Artificial Sequence
  Description of Artificial Sequence: Synthetic oligonucleotide
tggatggctctgatcttattcagtagtacctagctg

SEQ ID NO: 276272 - DNA, 35 bp, Artificial Sequence
  Description of Artificial Sequence: Synthetic oligonucleotide
ggatggctctgatcttattcagtagtacctagctg

SEQ ID NO: 276273 - DNA, 37 bp, Artificial Sequence
  Description of Artificial Sequence: Synthetic oligonucleotide
gatggctctgatcttattcagtagtacctagctgatg

SEQ ID NO: 276274 - DNA, 37 bp, Artificial Sequence
  Description of Artificial Sequence: Synthetic oligonucleotide
atggctctgatcttattcagtagtacctagctgatgg

SEQ ID NO: 276275 - DNA, 36 bp, Artificial Sequence
  Description of Artificial Sequence: Synthetic oligonucleotide
tggctctgatcttattcagtagtacctagctgatgg

SEQ ID NO: 276276 - DNA, 35 bp, Artificial Sequence
  Description of Artificial Sequence: Synthetic oligonucleotide
ggctctgatcttattcagtagtacctagctgatgg

SEQ ID NO: 276277 - DNA, 35 bp, Artificial Sequence
  Description of Artificial Sequence: Synthetic oligonucleotide
gctctgatcttattcagtagtacctagctgatggg

SEQ ID NO: 276278 - DNA, 35 bp, Artificial Sequence
  Description of Artificial Sequence: Synthetic oligonucleotide
ctctgatcttattcagtagtacctagctgatgggc

SEQ ID NO: 276279 - DNA, 35 bp, Artificial Sequence
  Description of Artificial Sequence: Synthetic oligonucleotide
tctgatcttattcagtagtacctagctgatgggcc

SEQ ID NO: 276280 - DNA, 34 bp, Artificial Sequence
  Description of Artificial Sequence: Synthetic oligonucleotide
ctgatcttattcagtagtacctagctgatgggcc

SEQ ID NO: 276281 - DNA, 34 bp, Artificial Sequence
  Description of Artificial Sequence: Synthetic oligonucleotide
tgatcttattcagtagtacctagctgatgggccg

SEQ ID NO: 276282 - DNA, 33 bp, Artificial Sequence
  Description of Artificial Sequence: Synthetic oligonucleotide
gatcttattcagtagtacctagctgatgggccg

SEQ ID NO: 276283 - DNA, 36 bp, Artificial Sequence
  Description of Artificial Sequence: Synthetic oligonucleotide
atcttattcagtagtacctagctgatgggccgaaac

SEQ ID NO: 276284 - DNA, 35 bp, Artificial Sequence
  Description of Artificial Sequence: Synthetic oligonucleotide
tcttattcagtagtacctagctgatgggccgaaac

SEQ ID NO: 276285 - DNA, 34 bp, Artificial Sequence
  Description of Artificial Sequence: Synthetic oligonucleotide
cttattcagtagtacctagctgatgggccgaaac

SEQ ID NO: 276286 - DNA, 35 bp, Artificial Sequence
  Description of Artificial Sequence: Synthetic oligonucleotide
ttattcagtagtacctagctgatgggccgaaactc

SEQ ID NO: 276287 - DNA, 34 bp, Artificial Sequence
  Description of Artificial Sequence: Synthetic oligonucleotide
tattcagtagtacctagctgatgggccgaaactc

SEQ ID NO: 276288 - DNA, 33 bp, Artificial Sequence
  Description of Artificial Sequence: Synthetic oligonucleotide
attcagtagtacctagctgatgggccgaaactc

SEQ ID NO: 276289 - DNA, 32 bp, Artificial Sequence
  Description of Artificial Sequence: Synthetic oligonucleotide
ttcagtagtacctagctgatgggccgaaactc

SEQ ID NO: 276290 - DNA, 31 bp, Artificial Sequence
  Description of Artificial Sequence: Synthetic oligonucleotide
tcagtagtacctagctgatgggccgaaactc

SEQ ID NO: 276291 - DNA, 30 bp, Artificial Sequence
  Description of Artificial Sequence: Synthetic oligonucleotide
cagtagtacctagctgatgggccgaaactc

SEQ ID NO: 276292 - DNA, 30 bp, Artificial Sequence
  Description of Artificial Sequence: Synthetic oligonucleotide
agtagtacctagctgatgggccgaaactcg

SEQ ID NO: 276293 - DNA, 29 bp, Artificial Sequence
  Description of Artificial Sequence: Synthetic oligonucleotide
gtagtacctagctgatgggccgaaactcg

SEQ ID NO: 276294 - DNA, 31 bp, Artificial Sequence
  Description of Artificial Sequence: Synthetic oligonucleotide
tagtacctagctgatgggccgaaactcgtag

SEQ ID NO: 276295 - DNA, 30 bp, Artificial Sequence
  Description of Artificial Sequence: Synthetic oligonucleotide
agtacctagctgatgggccgaaactcgtag

SEQ ID NO: 276296 - DNA, 29 bp, Artificial Sequence
  Description of Artificial Sequence: Synthetic oligonucleotide
gtacctagctgatgggccgaaactcgtag

SEQ ID NO: 276297 - DNA, 29 bp, Artificial Sequence
  Description of Artificial Sequence: Synthetic oligonucleotide
tacctagctgatgggccgaaactcgtagg

SEQ ID NO: 276298 - DNA, 28 bp, Artificial Sequence
  Description of Artificial Sequence: Synthetic oligonucleotide
acctagctgatgggccgaaactcgtagg

SEQ ID NO: 276299 - DNA, 27 bp, Artificial Sequence
  Description of Artificial Sequence: Synthetic oligonucleotide
cctagctgatgggccgaaactcgtagg

SEQ ID NO: 276300 - DNA, 27 bp, Artificial Sequence
  Description of Artificial Sequence: Synthetic oligonucleotide
ctagctgatgggccgaaactcgtaggg

SEQ ID NO: 276301 - DNA, 27 bp, Artificial Sequence
  Description of Artificial Sequence: Synthetic oligonucleotide
tagctgatgggccgaaactcgtagggg

SEQ ID NO: 276302 - DNA, 27 bp, Artificial Sequence
  Description of Artificial Sequence: Synthetic oligonucleotide
agctgatgggccgaaactcgtagggga

SEQ ID NO: 276303 - DNA, 27 bp, Artificial Sequence
  Description of Artificial Sequence: Synthetic oligonucleotide
gctgatgggccgaaactcgtaggggaa

SEQ ID NO: 276304 - DNA, 29 bp, Artificial Sequence
  Description of Artificial Sequence: Synthetic oligonucleotide
ctgatgggccgaaactcgtaggggaattg

SEQ ID NO: 276305 - DNA, 31 bp, Artificial Sequence
  Description of Artificial Sequence: Synthetic oligonucleotide
tgatgggccgaaactcgtaggggaattgtac

SEQ ID NO: 276306 - DNA, 30 bp, Artificial Sequence
  Description of Artificial Sequence: Synthetic oligonucleotide
gatgggccgaaactcgtaggggaattgtac

SEQ ID NO: 276307 - DNA, 30 bp, Artificial Sequence
  Description of Artificial Sequence: Synthetic oligonucleotide
atgggccgaaactcgtaggggaattgtacc

SEQ ID NO: 276308 - DNA, 29 bp, Artificial Sequence
  Description of Artificial Sequence: Synthetic oligonucleotide
tgggccgaaactcgtaggggaattgtacc

SEQ ID NO: 276309 - DNA, 28 bp, Artificial Sequence
  Description of Artificial Sequence: Synthetic oligonucleotide
gggccgaaactcgtaggggaattgtacc

SEQ ID NO: 276310 - DNA, 28 bp, Artificial Sequence
  Description of Artificial Sequence: Synthetic oligonucleotide
ggccgaaactcgtaggggaattgtaccg

SEQ ID NO: 276311 - DNA, 29 bp, Artificial Sequence
  Description of Artificial Sequence: Synthetic oligonucleotide
gccgaaactcgtaggggaattgtaccgag

SEQ ID NO: 276312 - DNA, 31 bp, Artificial Sequence
  Description of Artificial Sequence: Synthetic oligonucleotide
ccgaaactcgtaggggaattgtaccgagttg

SEQ ID NO: 276313 - DNA, 31 bp, Artificial Sequence
  Description of Artificial Sequence: Synthetic oligonucleotide
cgaaactcgtaggggaattgtaccgagttgc

SEQ ID NO: 276314 - DNA, 32 bp, Artificial Sequence
  Description of Artificial Sequence: Synthetic oligonucleotide
gaaactcgtaggggaattgtaccgagttgcag

SEQ ID NO: 276315 - DNA, 34 bp, Artificial Sequence
  Description of Artificial Sequence: Synthetic oligonucleotide
aaactcgtaggggaattgtaccgagttgcagaag

SEQ ID NO: 276316 - DNA, 33 bp, Artificial Sequence
  Description of Artificial Sequence: Synthetic oligonucleotide
aactcgtaggggaattgtaccgagttgcagaag

SEQ ID NO: 276317 - DNA, 32 bp, Artificial Sequence
  Description of Artificial Sequence: Synthetic oligonucleotide
actcgtaggggaattgtaccgagttgcagaag

SEQ ID NO: 276318 - DNA, 31 bp, Artificial Sequence
  Description of Artificial Sequence: Synthetic oligonucleotide
ctcgtaggggaattgtaccgagttgcagaag

SEQ ID NO: 276319 - DNA, 33 bp, Artificial Sequence
  Description of Artificial Sequence: Synthetic oligonucleotide
tcgtaggggaattgtaccgagttgcagaagaac

SEQ ID NO: 276320 - DNA, 32 bp, Artificial Sequence
  Description of Artificial Sequence: Synthetic oligonucleotide
cgtaggggaattgtaccgagttgcagaagaac

SEQ ID NO: 276321 - DNA, 34 bp, Artificial Sequence
  Description of Artificial Sequence: Synthetic oligonucleotide
gtaggggaattgtaccgagttgcagaagaacatc

SEQ ID NO: 276322 - DNA, 34 bp, Artificial Sequence
  Description of Artificial Sequence: Synthetic oligonucleotide
taggggaattgtaccgagttgcagaagaacatcc

SEQ ID NO: 276323 - DNA, 33 bp, Artificial Sequence
  Description of Artificial Sequence: Synthetic oligonucleotide
aggggaattgtaccgagttgcagaagaacatcc

SEQ ID NO: 276324 - DNA, 32 bp, Artificial Sequence
  Description of Artificial Sequence: Synthetic oligonucleotide
ggggaattgtaccgagttgcagaagaacatcc

SEQ ID NO: 276325 - DNA, 33 bp, Artificial Sequence
  Description of Artificial Sequence: Synthetic oligonucleotide
gggaattgtaccgagttgcagaagaacatccac

SEQ ID NO: 276326 - DNA, 33 bp, Artificial Sequence
  Description of Artificial Sequence: Synthetic oligonucleotide
ggaattgtaccgagttgcagaagaacatccacc

SEQ ID NO: 276327 - DNA, 33 bp, Artificial Sequence
  Description of Artificial Sequence: Synthetic oligonucleotide
gaattgtaccgagttgcagaagaacatccaccg

SEQ ID NO: 276328 - DNA, 34 bp, Artificial Sequence
  Description of Artificial Sequence: Synthetic oligonucleotide
aattgtaccgagttgcagaagaacatccaccgtc

SEQ ID NO: 276329 - DNA, 33 bp, Artificial Sequence
  Description of Artificial Sequence: Synthetic oligonucleotide
attgtaccgagttgcagaagaacatccaccgtc

SEQ ID NO: 276330 - DNA, 32 bp, Artificial Sequence
  Description of Artificial Sequence: Synthetic oligonucleotide
ttgtaccgagttgcagaagaacatccaccgtc

SEQ ID NO: 276331 - DNA, 31 bp, Artificial Sequence
  Description of Artificial Sequence: Synthetic oligonucleotide
tgtaccgagttgcagaagaacatccaccgtc

SEQ ID NO: 276332 - DNA, 30 bp, Artificial Sequence
  Description of Artificial Sequence: Synthetic oligonucleotide
gtaccgagttgcagaagaacatccaccgtc

SEQ ID NO: 276333 - DNA, 30 bp, Artificial Sequence
  Description of Artificial Sequence: Synthetic oligonucleotide
taccgagttgcagaagaacatccaccgtcc

SEQ ID NO: 276334 - DNA, 29 bp, Artificial Sequence
  Description of Artificial Sequence: Synthetic oligonucleotide
accgagttgcagaagaacatccaccgtcc

SEQ ID NO: 276335 - DNA, 28 bp, Artificial Sequence
  Description of Artificial Sequence: Synthetic oligonucleotide
ccgagttgcagaagaacatccaccgtcc

SEQ ID NO: 276336 - DNA, 30 bp, Artificial Sequence
  Description of Artificial Sequence: Synthetic oligonucleotide
cgagttgcagaagaacatccaccgtccaac

SEQ ID NO: 276337 - DNA, 30 bp, Artificial Sequence
  Description of Artificial Sequence: Synthetic oligonucleotide
gagttgcagaagaacatccaccgtccaacg

SEQ ID NO: 276338 - DNA, 31 bp, Artificial Sequence
  Description of Artificial Sequence: Synthetic oligonucleotide
agttgcagaagaacatccaccgtccaacgtg

SEQ ID NO: 276339 - DNA, 30 bp, Artificial Sequence
  Description of Artificial Sequence: Synthetic oligonucleotide
gttgcagaagaacatccaccgtccaacgtg

SEQ ID NO: 276340 - DNA, 36 bp, Artificial Sequence
  Description of Artificial Sequence: Synthetic oligonucleotide
ttgcagaagaacatccaccgtccaacgtgtttatag

SEQ ID NO: 276341 - DNA, 35 bp, Artificial Sequence
  Description of Artificial Sequence: Synthetic oligonucleotide
tgcagaagaacatccaccgtccaacgtgtttatag

SEQ ID NO: 276342 - DNA, 34 bp, Artificial Sequence
  Description of Artificial Sequence: Synthetic oligonucleotide
gcagaagaacatccaccgtccaacgtgtttatag

SEQ ID NO: 276343 - DNA, 36 bp, Artificial Sequence
  Description of Artificial Sequence: Synthetic oligonucleotide
cagaagaacatccaccgtccaacgtgtttatagatg

SEQ ID NO: 276344 - DNA, 41 bp, Artificial Sequence
  Description of Artificial Sequence: Synthetic oligonucleotide
agaagaacatccaccgtccaacgtgtttatagatgaaattc

SEQ ID NO: 276345 - DNA, 40 bp, Artificial Sequence
  Description of Artificial Sequence: Synthetic oligonucleotide
gaagaacatccaccgtccaacgtgtttatagatgaaattc

SEQ ID NO: 276346 - DNA, 41 bp, Artificial Sequence
  Description of Artificial Sequence: Synthetic oligonucleotide
aagaacatccaccgtccaacgtgtttatagatgaaattcac

SEQ ID NO: 276347 - DNA, 40 bp, Artificial Sequence
  Description of Artificial Sequence: Synthetic oligonucleotide
agaacatccaccgtccaacgtgtttatagatgaaattcac

SEQ ID NO: 276348 - DNA, 39 bp, Artificial Sequence
  Description of Artificial Sequence: Synthetic oligonucleotide
gaacatccaccgtccaacgtgtttatagatgaaattcac

SEQ ID NO: 276349 - DNA, 39 bp, Artificial Sequence
  Description of Artificial Sequence: Synthetic oligonucleotide
aacatccaccgtccaacgtgtttatagatgaaattcacg

SEQ ID NO: 276350 - DNA, 38 bp, Artificial Sequence
  Description of Artificial Sequence: Synthetic oligonucleotide
acatccaccgtccaacgtgtttatagatgaaattcacg

SEQ ID NO: 276351 - DNA, 37 bp, Artificial Sequence
  Description of Artificial Sequence: Synthetic oligonucleotide
catccaccgtccaacgtgtttatagatgaaattcacg

SEQ ID NO: 276352 - DNA, 37 bp, Artificial Sequence
  Description of Artificial Sequence: Synthetic oligonucleotide
atccaccgtccaacgtgtttatagatgaaattcacgc

SEQ ID NO: 276353 - DNA, 36 bp, Artificial Sequence
  Description of Artificial Sequence: Synthetic oligonucleotide
tccaccgtccaacgtgtttatagatgaaattcacgc

SEQ ID NO: 276354 - DNA, 35 bp, Artificial Sequence
  Description of Artificial Sequence: Synthetic oligonucleotide
ccaccgtccaacgtgtttatagatgaaattcacgc

SEQ ID NO: 276355 - DNA, 35 bp, Artificial Sequence
  Description of Artificial Sequence: Synthetic oligonucleotide
caccgtccaacgtgtttatagatgaaattcacgcc

SEQ ID NO: 276356 - DNA, 38 bp, Artificial Sequence
  Description of Artificial Sequence: Synthetic oligonucleotide
accgtccaacgtgtttatagatgaaattcacgccattg

SEQ ID NO: 276357 - DNA, 37 bp, Artificial Sequence
  Description of Artificial Sequence: Synthetic oligonucleotide
ccgtccaacgtgtttatagatgaaattcacgccattg

SEQ ID NO: 276358 - DNA, 37 bp, Artificial Sequence
  Description of Artificial Sequence: Synthetic oligonucleotide
cgtccaacgtgtttatagatgaaattcacgccattgc

SEQ ID NO: 276359 - DNA, 37 bp, Artificial Sequence
  Description of Artificial Sequence: Synthetic oligonucleotide
gtccaacgtgtttatagatgaaattcacgccattgcg

SEQ ID NO: 276360 - DNA, 38 bp, Artificial Sequence
  Description of Artificial Sequence: Synthetic oligonucleotide
tccaacgtgtttatagatgaaattcacgccattgcgac

SEQ ID NO: 276361 - DNA, 37 bp, Artificial Sequence
  Description of Artificial Sequence: Synthetic oligonucleotide
ccaacgtgtttatagatgaaattcacgccattgcgac

SEQ ID NO: 276362 - DNA, 42 bp, Artificial Sequence
  Description of Artificial Sequence: Synthetic oligonucleotide
caacgtgtttatagatgaaattcacgccattgcgacaaaaag

SEQ ID NO: 276363 - DNA, 46 bp, Artificial Sequence
  Description of Artificial Sequence: Synthetic oligonucleotide
aacgtgtttatagatgaaattcacgccattgcgacaaaaagttatg

SEQ ID NO: 276364 - DNA, 45 bp, Artificial Sequence
  Description of Artificial Sequence: Synthetic oligonucleotide
acgtgtttatagatgaaattcacgccattgcgacaaaaagttatg

SEQ ID NO: 276365 - DNA, 44 bp, Artificial Sequence
  Description of Artificial Sequence: Synthetic oligonucleotide
cgtgtttatagatgaaattcacgccattgcgacaaaaagttatg

SEQ ID NO: 276366 - DNA, 45 bp, Artificial Sequence
  Description of Artificial Sequence: Synthetic oligonucleotide
gtgtttatagatgaaattcacgccattgcgacaaaaagttatgac

SEQ ID NO: 276367 - DNA, 46 bp, Artificial Sequence
  Description of Artificial Sequence: Synthetic oligonucleotide
tgtttatagatgaaattcacgccattgcgacaaaaagttatgactc

SEQ ID NO: 276368 - DNA, 45 bp, Artificial Sequence
  Description of Artificial Sequence: Synthetic oligonucleotide
gtttatagatgaaattcacgccattgcgacaaaaagttatgactc

SEQ ID NO: 276369 - DNA, 45 bp, Artificial Sequence
  Description of Artificial Sequence: Synthetic oligonucleotide
tttatagatgaaattcacgccattgcgacaaaaagttatgactcc

SEQ ID NO: 276370 - DNA, 44 bp, Artificial Sequence
  Description of Artificial Sequence: Synthetic oligonucleotide
ttatagatgaaattcacgccattgcgacaaaaagttatgactcc

SEQ ID NO: 276371 - DNA, 43 bp, Artificial Sequence
  Description of Artificial Sequence: Synthetic oligonucleotide
tatagatgaaattcacgccattgcgacaaaaagttatgactcc

SEQ ID NO: 276372 - DNA, 42 bp, Artificial Sequence
  Description of Artificial Sequence: Synthetic oligonucleotide
atagatgaaattcacgccattgcgacaaaaagttatgactcc

SEQ ID NO: 276373 - DNA, 41 bp, Artificial Sequence
  Description of Artificial Sequence: Synthetic oligonucleotide
tagatgaaattcacgccattgcgacaaaaagttatgactcc

SEQ ID NO: 276374 - DNA, 40 bp, Artificial Sequence
  Description of Artificial Sequence: Synthetic oligonucleotide
agatgaaattcacgccattgcgacaaaaagttatgactcc

SEQ ID NO: 276375 - DNA, 39 bp, Artificial Sequence
  Description of Artificial Sequence: Synthetic oligonucleotide
gatgaaattcacgccattgcgacaaaaagttatgactcc

SEQ ID NO: 276376 - DNA, 43 bp, Artificial Sequence
  Description of Artificial Sequence: Synthetic oligonucleotide
atgaaattcacgccattgcgacaaaaagttatgactcctattc

SEQ ID NO: 276377 - DNA, 42 bp, Artificial Sequence
  Description of Artificial Sequence: Synthetic oligonucleotide
tgaaattcacgccattgcgacaaaaagttatgactcctattc

SEQ ID NO: 276378 - DNA, 41 bp, Artificial Sequence
  Description of Artificial Sequence: Synthetic oligonucleotide
gaaattcacgccattgcgacaaaaagttatgactcctattc

SEQ ID NO: 276379 - DNA, 42 bp, Artificial Sequence
  Description of Artificial Sequence: Synthetic oligonucleotide
aaattcacgccattgcgacaaaaagttatgactcctattctg

SEQ ID NO: 276380 - DNA, 41 bp, Artificial Sequence
  Description of Artificial Sequence: Synthetic oligonucleotide
aattcacgccattgcgacaaaaagttatgactcctattctg

SEQ ID NO: 276381 - DNA, 40 bp, Artificial Sequence
  Description of Artificial Sequence: Synthetic oligonucleotide
attcacgccattgcgacaaaaagttatgactcctattctg

SEQ ID NO: 276382 - DNA, 39 bp, Artificial Sequence
  Description of Artificial Sequence: Synthetic oligonucleotide
ttcacgccattgcgacaaaaagttatgactcctattctg

SEQ ID NO: 276383 - DNA, 38 bp, Artificial Sequence
  Description of Artificial Sequence: Synthetic oligonucleotide
tcacgccattgcgacaaaaagttatgactcctattctg

SEQ ID NO: 276384 - DNA, 37 bp, Artificial Sequence
  Description of Artificial Sequence: Synthetic oligonucleotide
cacgccattgcgacaaaaagttatgactcctattctg

SEQ ID NO: 276385 - DNA, 37 bp, Artificial Sequence
  Description of Artificial Sequence: Synthetic oligonucleotide
acgccattgcgacaaaaagttatgactcctattctgg

SEQ ID NO: 276386 - DNA, 36 bp, Artificial Sequence
  Description of Artificial Sequence: Synthetic oligonucleotide
cgccattgcgacaaaaagttatgactcctattctgg

SEQ ID NO: 276387 - DNA, 37 bp, Artificial Sequence
  Description of Artificial Sequence: Synthetic oligonucleotide
gccattgcgacaaaaagttatgactcctattctggtg

SEQ ID NO: 276388 - DNA, 37 bp, Artificial Sequence
  Description of Artificial Sequence: Synthetic oligonucleotide
ccattgcgacaaaaagttatgactcctattctggtgc

SEQ ID NO: 276389 - DNA, 38 bp, Artificial Sequence
  Description of Artificial Sequence: Synthetic oligonucleotide
cattgcgacaaaaagttatgactcctattctggtgctg

SEQ ID NO: 276390 - DNA, 39 bp, Artificial Sequence
  Description of Artificial Sequence: Synthetic oligonucleotide
attgcgacaaaaagttatgactcctattctggtgctgag

SEQ ID NO: 276391 - DNA, 38 bp, Artificial Sequence
  Description of Artificial Sequence: Synthetic oligonucleotide
ttgcgacaaaaagttatgactcctattctggtgctgag

SEQ ID NO: 276392 - DNA, 37 bp, Artificial Sequence
  Description of Artificial Sequence: Synthetic oligonucleotide
tgcgacaaaaagttatgactcctattctggtgctgag

SEQ ID NO: 276393 - DNA, 36 bp, Artificial Sequence
  Description of Artificial Sequence: Synthetic oligonucleotide
gcgacaaaaagttatgactcctattctggtgctgag

SEQ ID NO: 276394 - DNA, 37 bp, Artificial Sequence
  Description of Artificial Sequence: Synthetic oligonucleotide
cgacaaaaagttatgactcctattctggtgctgagag

SEQ ID NO: 276395 - DNA, 38 bp, Artificial Sequence
  Description of Artificial Sequence: Synthetic oligonucleotide
gacaaaaagttatgactcctattctggtgctgagagag

SEQ ID NO: 276396 - DNA, 43 bp, Artificial Sequence
  Description of Artificial Sequence: Synthetic oligonucleotide
acaaaaagttatgactcctattctggtgctgagagagatattc

SEQ ID NO: 276397 - DNA, 42 bp, Artificial Sequence
  Description of Artificial Sequence: Synthetic oligonucleotide
caaaaagttatgactcctattctggtgctgagagagatattc

SEQ ID NO: 276398 - DNA, 43 bp, Artificial Sequence
  Description of Artificial Sequence: Synthetic oligonucleotide
aaaaagttatgactcctattctggtgctgagagagatattcag

SEQ ID NO: 276399 - DNA, 42 bp, Artificial Sequence
  Description of Artificial Sequence: Synthetic oligonucleotide
aaaagttatgactcctattctggtgctgagagagatattcag

SEQ ID NO: 276400 - DNA, 41 bp, Artificial Sequence
  Description of Artificial Sequence: Synthetic oligonucleotide
aaagttatgactcctattctggtgctgagagagatattcag

SEQ ID NO: 276401 - DNA, 40 bp, Artificial Sequence
  Description of Artificial Sequence: Synthetic oligonucleotide
aagttatgactcctattctggtgctgagagagatattcag

SEQ ID NO: 276402 - DNA, 39 bp, Artificial Sequence
  Description of Artificial Sequence: Synthetic oligonucleotide
agttatgactcctattctggtgctgagagagatattcag

SEQ ID NO: 276403 - DNA, 38 bp, Artificial Sequence
  Description of Artificial Sequence: Synthetic oligonucleotide
gttatgactcctattctggtgctgagagagatattcag

SEQ ID NO: 276404 - DNA, 38 bp, Artificial Sequence
  Description of Artificial Sequence: Synthetic oligonucleotide
ttatgactcctattctggtgctgagagagatattcagc

SEQ ID NO: 276405 - DNA, 37 bp, Artificial Sequence
  Description of Artificial Sequence: Synthetic oligonucleotide
tatgactcctattctggtgctgagagagatattcagc

SEQ ID NO: 276406 - DNA, 36 bp, Artificial Sequence
  Description of Artificial Sequence: Synthetic oligonucleotide
atgactcctattctggtgctgagagagatattcagc

SEQ ID NO: 276407 - DNA, 35 bp, Artificial Sequence
  Description of Artificial Sequence: Synthetic oligonucleotide
tgactcctattctggtgctgagagagatattcagc

SEQ ID NO: 276408 - DNA, 34 bp, Artificial Sequence
  Description of Artificial Sequence: Synthetic oligonucleotide
gactcctattctggtgctgagagagatattcagc

SEQ ID NO: 276409 - DNA, 34 bp, Artificial Sequence
  Description of Artificial Sequence: Synthetic oligonucleotide
actcctattctggtgctgagagagatattcagcg

SEQ ID NO: 276410 - DNA, 33 bp, Artificial Sequence
  Description of Artificial Sequence: Synthetic oligonucleotide
ctcctattctggtgctgagagagatattcagcg

SEQ ID NO: 276411 - DNA, 35 bp, Artificial Sequence
  Description of Artificial Sequence: Synthetic oligonucleotide
tcctattctggtgctgagagagatattcagcgatc

SEQ ID NO: 276412 - DNA, 34 bp, Artificial Sequence
  Description of Artificial Sequence: Synthetic oligonucleotide
cctattctggtgctgagagagatattcagcgatc

SEQ ID NO: 276413 - DNA, 37 bp, Artificial Sequence
  Description of Artificial Sequence: Synthetic oligonucleotide
ctattctggtgctgagagagatattcagcgatcaatg

SEQ ID NO: 276414 - DNA, 39 bp, Artificial Sequence
  Description of Artificial Sequence: Synthetic oligonucleotide
tattctggtgctgagagagatattcagcgatcaatgttg

SEQ ID NO: 276415 - DNA, 38 bp, Artificial Sequence
  Description of Artificial Sequence: Synthetic oligonucleotide
attctggtgctgagagagatattcagcgatcaatgttg

SEQ ID NO: 276416 - DNA, 37 bp, Artificial Sequence
  Description of Artificial Sequence: Synthetic oligonucleotide
ttctggtgctgagagagatattcagcgatcaatgttg

SEQ ID NO: 276417 - DNA, 36 bp, Artificial Sequence
  Description of Artificial Sequence: Synthetic oligonucleotide
tctggtgctgagagagatattcagcgatcaatgttg

SEQ ID NO: 276418 - DNA, 35 bp, Artificial Sequence
  Description of Artificial Sequence: Synthetic oligonucleotide
ctggtgctgagagagatattcagcgatcaatgttg

SEQ ID NO: 276419 - DNA, 35 bp, Artificial Sequence
  Description of Artificial Sequence: Synthetic oligonucleotide
tggtgctgagagagatattcagcgatcaatgttgg

SEQ ID NO: 276420 - DNA, 34 bp, Artificial Sequence
  Description of Artificial Sequence: Synthetic oligonucleotide
ggtgctgagagagatattcagcgatcaatgttgg

SEQ ID NO: 276421 - DNA, 36 bp, Artificial Sequence
  Description of Artificial Sequence: Synthetic oligonucleotide
gtgctgagagagatattcagcgatcaatgttggtac

SEQ ID NO: 276422 - DNA, 37 bp, Artificial Sequence
  Description of Artificial Sequence: Synthetic oligonucleotide
tgctgagagagatattcagcgatcaatgttggtactg

SEQ ID NO: 276423 - DNA, 36 bp, Artificial Sequence
  Description of Artificial Sequence: Synthetic oligonucleotide
gctgagagagatattcagcgatcaatgttggtactg

SEQ ID NO: 276424 - DNA, 36 bp, Artificial Sequence
  Description of Artificial Sequence: Synthetic oligonucleotide
ctgagagagatattcagcgatcaatgttggtactgc

SEQ ID NO: 276425 - DNA, 37 bp, Artificial Sequence
  Description of Artificial Sequence: Synthetic oligonucleotide
tgagagagatattcagcgatcaatgttggtactgctg

SEQ ID NO: 276426 - DNA, 36 bp, Artificial Sequence
  Description of Artificial Sequence: Synthetic oligonucleotide
gagagagatattcagcgatcaatgttggtactgctg

SEQ ID NO: 276427 - DNA, 38 bp, Artificial Sequence
  Description of Artificial Sequence: Synthetic oligonucleotide
agagagatattcagcgatcaatgttggtactgctgaag

SEQ ID NO: 276428 - DNA, 37 bp, Artificial Sequence
  Description of Artificial Sequence: Synthetic oligonucleotide
gagagatattcagcgatcaatgttggtactgctgaag

SEQ ID NO: 276429 - DNA, 37 bp, Artificial Sequence
  Description of Artificial Sequence: Synthetic oligonucleotide
agagatattcagcgatcaatgttggtactgctgaagc

SEQ ID NO: 276430 - DNA, 36 bp, Artificial Sequence
  Description of Artificial Sequence: Synthetic oligonucleotide
gagatattcagcgatcaatgttggtactgctgaagc

SEQ ID NO: 276431 - DNA, 37 bp, Artificial Sequence
  Description of Artificial Sequence: Synthetic oligonucleotide
agatattcagcgatcaatgttggtactgctgaagcag

SEQ ID NO: 276432 - DNA, 36 bp, Artificial Sequence
  Description of Artificial Sequence: Synthetic oligonucleotide
gatattcagcgatcaatgttggtactgctgaagcag

SEQ ID NO: 276433 - DNA, 38 bp, Artificial Sequence
  Description of Artificial Sequence: Synthetic oligonucleotide
atattcagcgatcaatgttggtactgctgaagcagttg

SEQ ID NO: 276434 - DNA, 37 bp, Artificial Sequence
  Description of Artificial Sequence: Synthetic oligonucleotide
tattcagcgatcaatgttggtactgctgaagcagttg

SEQ ID NO: 276435 - DNA, 36 bp, Artificial Sequence
  Description of Artificial Sequence: Synthetic oligonucleotide
attcagcgatcaatgttggtactgctgaagcagttg

SEQ ID NO: 276436 - DNA, 35 bp, Artificial Sequence
  Description of Artificial Sequence: Synthetic oligonucleotide
ttcagcgatcaatgttggtactgctgaagcagttg

SEQ ID NO: 276437 - DNA, 34 bp, Artificial Sequence
  Description of Artificial Sequence: Synthetic oligonucleotide
tcagcgatcaatgttggtactgctgaagcagttg

SEQ ID NO: 276438 - DNA, 33 bp, Artificial Sequence
  Description of Artificial Sequence: Synthetic oligonucleotide
cagcgatcaatgttggtactgctgaagcagttg

SEQ ID NO: 276439 - DNA, 33 bp, Artificial Sequence
  Description of Artificial Sequence: Synthetic oligonucleotide
agcgatcaatgttggtactgctgaagcagttgg

SEQ ID NO: 276440 - DNA, 32 bp, Artificial Sequence
  Description of Artificial Sequence: Synthetic oligonucleotide
gcgatcaatgttggtactgctgaagcagttgg

SEQ ID NO: 276441 - DNA, 34 bp, Artificial Sequence
  Description of Artificial Sequence: Synthetic oligonucleotide
cgatcaatgttggtactgctgaagcagttggatc

SEQ ID NO: 276442 - DNA, 34 bp, Artificial Sequence
  Description of Artificial Sequence: Synthetic oligonucleotide
gatcaatgttggtactgctgaagcagttggatcg

SEQ ID NO: 276443 - DNA, 38 bp, Artificial Sequence
  Description of Artificial Sequence: Synthetic oligonucleotide
atcaatgttggtactgctgaagcagttggatcgatttg

SEQ ID NO: 276444 - DNA, 37 bp, Artificial Sequence
  Description of Artificial Sequence: Synthetic oligonucleotide
tcaatgttggtactgctgaagcagttggatcgatttg

SEQ ID NO: 276445 - DNA, 36 bp, Artificial Sequence
  Description of Artificial Sequence: Synthetic oligonucleotide
caatgttggtactgctgaagcagttggatcgatttg

SEQ ID NO: 276446 - DNA, 39 bp, Artificial Sequence
  Description of Artificial Sequence: Synthetic oligonucleotide
aatgttggtactgctgaagcagttggatcgatttgattg

SEQ ID NO: 276447 - DNA, 38 bp, Artificial Sequence
  Description of Artificial Sequence: Synthetic oligonucleotide
atgttggtactgctgaagcagttggatcgatttgattg

SEQ ID NO: 276448 - DNA, 37 bp, Artificial Sequence
  Description of Artificial Sequence: Synthetic oligonucleotide
tgttggtactgctgaagcagttggatcgatttgattg

SEQ ID NO: 276449 - DNA, 36 bp, Artificial Sequence
  Description of Artificial Sequence: Synthetic oligonucleotide
gttggtactgctgaagcagttggatcgatttgattg

SEQ ID NO: 276450 - DNA, 38 bp, Artificial Sequence
  Description of Artificial Sequence: Synthetic oligonucleotide
ttggtactgctgaagcagttggatcgatttgattgtag

SEQ ID NO: 276451 - DNA, 37 bp, Artificial Sequence
  Description of Artificial Sequence: Synthetic oligonucleotide
tggtactgctgaagcagttggatcgatttgattgtag

SEQ ID NO: 276452 - DNA, 36 bp, Artificial Sequence
  Description of Artificial Sequence: Synthetic oligonucleotide
ggtactgctgaagcagttggatcgatttgattgtag

SEQ ID NO: 276453 - DNA, 36 bp, Artificial Sequence
  Description of Artificial Sequence: Synthetic oligonucleotide
gtactgctgaagcagttggatcgatttgattgtagg

SEQ ID NO: 276454 - DNA, 36 bp, Artificial Sequence
  Description of Artificial Sequence: Synthetic oligonucleotide
tactgctgaagcagttggatcgatttgattgtaggg

SEQ ID NO: 276455 - DNA, 35 bp, Artificial Sequence
  Description of Artificial Sequence: Synthetic oligonucleotide
actgctgaagcagttggatcgatttgattgtaggg

SEQ ID NO: 276456 - DNA, 34 bp, Artificial Sequence
  Description of Artificial Sequence: Synthetic oligonucleotide
ctgctgaagcagttggatcgatttgattgtaggg

SEQ ID NO: 276457 - DNA, 34 bp, Artificial Sequence
  Description of Artificial Sequence: Synthetic oligonucleotide
tgctgaagcagttggatcgatttgattgtagggg

SEQ ID NO: 276458 - DNA, 33 bp, Artificial Sequence
  Description of Artificial Sequence: Synthetic oligonucleotide
gctgaagcagttggatcgatttgattgtagggg

SEQ ID NO: 276459 - DNA, 34 bp, Artificial Sequence
  Description of Artificial Sequence: Synthetic oligonucleotide
ctgaagcagttggatcgatttgattgtaggggag

SEQ ID NO: 276460 - DNA, 36 bp, Artificial Sequence
  Description of Artificial Sequence: Synthetic oligonucleotide
tgaagcagttggatcgatttgattgtaggggagaag

SEQ ID NO: 276461 - DNA, 35 bp, Artificial Sequence
  Description of Artificial Sequence: Synthetic oligonucleotide
gaagcagttggatcgatttgattgtaggggagaag

SEQ ID NO: 276462 - DNA, 36 bp, Artificial Sequence
  Description of Artificial Sequence: Synthetic oligonucleotide
aagcagttggatcgatttgattgtaggggagaagtg

SEQ ID NO: 276463 - DNA, 35 bp, Artificial Sequence
  Description of Artificial Sequence: Synthetic oligonucleotide
agcagttggatcgatttgattgtaggggagaagtg

SEQ ID NO: 276464 - DNA, 34 bp, Artificial Sequence
  Description of Artificial Sequence: Synthetic oligonucleotide
gcagttggatcgatttgattgtaggggagaagtg

SEQ ID NO: 276465 - DNA, 37 bp, Artificial Sequence
  Description of Artificial Sequence: Synthetic oligonucleotide
cagttggatcgatttgattgtaggggagaagtgaaag

SEQ ID NO: 276466 - DNA, 41 bp, Artificial Sequence
  Description of Artificial Sequence: Synthetic oligonucleotide
agttggatcgatttgattgtaggggagaagtgaaagttttc

SEQ ID NO: 276467 - DNA, 40 bp, Artificial Sequence
  Description of Artificial Sequence: Synthetic oligonucleotide
gttggatcgatttgattgtaggggagaagtgaaagttttc

SEQ ID NO: 276468 - DNA, 42 bp, Artificial Sequence
  Description of Artificial Sequence: Synthetic oligonucleotide
ttggatcgatttgattgtaggggagaagtgaaagttttcatg

SEQ ID NO: 276469 - DNA, 41 bp, Artificial Sequence
  Description of Artificial Sequence: Synthetic oligonucleotide
tggatcgatttgattgtaggggagaagtgaaagttttcatg

SEQ ID NO: 276470 - DNA, 40 bp, Artificial Sequence
  Description of Artificial Sequence: Synthetic oligonucleotide
ggatcgatttgattgtaggggagaagtgaaagttttcatg

SEQ ID NO: 276471 - DNA, 40 bp, Artificial Sequence
  Description of Artificial Sequence: Synthetic oligonucleotide
gatcgatttgattgtaggggagaagtgaaagttttcatgg

SEQ ID NO: 276472 - DNA, 40 bp, Artificial Sequence
  Description of Artificial Sequence: Synthetic oligonucleotide
atcgatttgattgtaggggagaagtgaaagttttcatggc

SEQ ID NO: 276473 - DNA, 39 bp, Artificial Sequence
  Description of Artificial Sequence: Synthetic oligonucleotide
tcgatttgattgtaggggagaagtgaaagttttcatggc

SEQ ID NO: 276474 - DNA, 38 bp, Artificial Sequence
  Description of Artificial Sequence: Synthetic oligonucleotide
cgatttgattgtaggggagaagtgaaagttttcatggc

SEQ ID NO: 276475 - DNA, 38 bp, Artificial Sequence
  Description of Artificial Sequence: Synthetic oligonucleotide
gatttgattgtaggggagaagtgaaagttttcatggcc

SEQ ID NO: 276476 - DNA, 39 bp, Artificial Sequence
  Description of Artificial Sequence: Synthetic oligonucleotide
atttgattgtaggggagaagtgaaagttttcatggccag

SEQ ID NO: 276477 - DNA, 38 bp, Artificial Sequence
  Description of Artificial Sequence: Synthetic oligonucleotide
tttgattgtaggggagaagtgaaagttttcatggccag

SEQ ID NO: 276478 - DNA, 37 bp, Artificial Sequence
  Description of Artificial Sequence: Synthetic oligonucleotide
ttgattgtaggggagaagtgaaagttttcatggccag

SEQ ID NO: 276479 - DNA, 36 bp, Artificial Sequence
  Description of Artificial Sequence: Synthetic oligonucleotide
tgattgtaggggagaagtgaaagttttcatggccag

SEQ ID NO: 276480 - DNA, 35 bp, Artificial Sequence
  Description of Artificial Sequence: Synthetic oligonucleotide
gattgtaggggagaagtgaaagttttcatggccag

SEQ ID NO: 276481 - DNA, 38 bp, Artificial Sequence
  Description of Artificial Sequence: Synthetic oligonucleotide
attgtaggggagaagtgaaagttttcatggccagaaac

SEQ ID NO: 276482 - DNA, 37 bp, Artificial Sequence
  Description of Artificial Sequence: Synthetic oligonucleotide
ttgtaggggagaagtgaaagttttcatggccagaaac

SEQ ID NO: 276483 - DNA, 36 bp, Artificial Sequence
  Description of Artificial Sequence: Synthetic oligonucleotide
tgtaggggagaagtgaaagttttcatggccagaaac

SEQ ID NO: 276484 - DNA, 35 bp, Artificial Sequence
  Description of Artificial Sequence: Synthetic oligonucleotide
gtaggggagaagtgaaagttttcatggccagaaac

SEQ ID NO: 276485 - DNA, 35 bp, Artificial Sequence
  Description of Artificial Sequence: Synthetic oligonucleotide
taggggagaagtgaaagttttcatggccagaaacc

SEQ ID NO: 276486 - DNA, 34 bp, Artificial Sequence
  Description of Artificial Sequence: Synthetic oligonucleotide
aggggagaagtgaaagttttcatggccagaaacc

SEQ ID NO: 276487 - DNA, 33 bp, Artificial Sequence
  Description of Artificial Sequence: Synthetic oligonucleotide
ggggagaagtgaaagttttcatggccagaaacc

SEQ ID NO: 276488 - DNA, 33 bp, Artificial Sequence
  Description of Artificial Sequence: Synthetic oligonucleotide
gggagaagtgaaagttttcatggccagaaaccg

SEQ ID NO: 276489 - DNA, 37 bp, Artificial Sequence
  Description of Artificial Sequence: Synthetic oligonucleotide
ggagaagtgaaagttttcatggccagaaaccgaattg

SEQ ID NO: 276490 - DNA, 40 bp, Artificial Sequence
  Description of Artificial Sequence: Synthetic oligonucleotide
gagaagtgaaagttttcatggccagaaaccgaattgaaac

SEQ ID NO: 276491 - DNA, 43 bp, Artificial Sequence
  Description of Artificial Sequence: Synthetic oligonucleotide
agaagtgaaagttttcatggccagaaaccgaattgaaactttg

SEQ ID NO: 276492 - DNA, 42 bp, Artificial Sequence
  Description of Artificial Sequence: Synthetic oligonucleotide
gaagtgaaagttttcatggccagaaaccgaattgaaactttg

SEQ ID NO: 276493 - DNA, 42 bp, Artificial Sequence
  Description of Artificial Sequence: Synthetic oligonucleotide
aagtgaaagttttcatggccagaaaccgaattgaaactttgc

SEQ ID NO: 276494 - DNA, 41 bp, Artificial Sequence
  Description of Artificial Sequence: Synthetic oligonucleotide
agtgaaagttttcatggccagaaaccgaattgaaactttgc

SEQ ID NO: 276495 - DNA, 40 bp, Artificial Sequence
  Description of Artificial Sequence: Synthetic oligonucleotide
gtgaaagttttcatggccagaaaccgaattgaaactttgc

SEQ ID NO: 276496 - DNA, 42 bp, Artificial Sequence
  Description of Artificial Sequence: Synthetic oligonucleotide
tgaaagttttcatggccagaaaccgaattgaaactttgcatc

SEQ ID NO: 276497 - DNA, 41 bp, Artificial Sequence
  Description of Artificial Sequence: Synthetic oligonucleotide
gaaagttttcatggccagaaaccgaattgaaactttgcatc

SEQ ID NO: 276498 - DNA, 41 bp, Artificial Sequence
  Description of Artificial Sequence: Synthetic oligonucleotide
aaagttttcatggccagaaaccgaattgaaactttgcatcc

SEQ ID NO: 276499 - DNA, 40 bp, Artificial Sequence
  Description of Artificial Sequence: Synthetic oligonucleotide
aagttttcatggccagaaaccgaattgaaactttgcatcc

SEQ ID NO: 276500 - DNA, 39 bp, Artificial Sequence
  Description of Artificial Sequence: Synthetic oligonucleotide
agttttcatggccagaaaccgaattgaaactttgcatcc

SEQ ID NO: 276501 - DNA, 38 bp, Artificial Sequence
  Description of Artificial Sequence: Synthetic oligonucleotide
gttttcatggccagaaaccgaattgaaactttgcatcc

SEQ ID NO: 276502 - DNA, 39 bp, Artificial Sequence
  Description of Artificial Sequence: Synthetic oligonucleotide
ttttcatggccagaaaccgaattgaaactttgcatccag

SEQ ID NO: 276503 - DNA, 38 bp, Artificial Sequence
  Description of Artificial Sequence: Synthetic oligonucleotide
tttcatggccagaaaccgaattgaaactttgcatccag

SEQ ID NO: 276504 - DNA, 37 bp, Artificial Sequence
  Description of Artificial Sequence: Synthetic oligonucleotide
ttcatggccagaaaccgaattgaaactttgcatccag

SEQ ID NO: 276505 - DNA, 36 bp, Artificial Sequence
  Description of Artificial Sequence: Synthetic oligonucleotide
tcatggccagaaaccgaattgaaactttgcatccag

SEQ ID NO: 276506 - DNA, 35 bp, Artificial Sequence
  Description of Artificial Sequence: Synthetic oligonucleotide
catggccagaaaccgaattgaaactttgcatccag

SEQ ID NO: 276507 - DNA, 35 bp, Artificial Sequence
  Description of Artificial Sequence: Synthetic oligonucleotide
atggccagaaaccgaattgaaactttgcatccagc

SEQ ID NO: 276508 - DNA, 34 bp, Artificial Sequence
  Description of Artificial Sequence: Synthetic oligonucleotide
tggccagaaaccgaattgaaactttgcatccagc

SEQ ID NO: 276509 - DNA, 33 bp, Artificial Sequence
  Description of Artificial Sequence: Synthetic oligonucleotide
ggccagaaaccgaattgaaactttgcatccagc

SEQ ID NO: 276510 - DNA, 34 bp, Artificial Sequence
  Description of Artificial Sequence: Synthetic oligonucleotide
gccagaaaccgaattgaaactttgcatccagcac

SEQ ID NO: 276511 - DNA, 38 bp, Artificial Sequence
  Description of Artificial Sequence: Synthetic oligonucleotide
ccagaaaccgaattgaaactttgcatccagcacatatc

SEQ ID NO: 276512 - DNA, 39 bp, Artificial Sequence
  Description of Artificial Sequence: Synthetic oligonucleotide
cagaaaccgaattgaaactttgcatccagcacatatcag

SEQ ID NO: 276513 - DNA, 40 bp, Artificial Sequence
  Description of Artificial Sequence: Synthetic oligonucleotide
agaaaccgaattgaaactttgcatccagcacatatcagac

SEQ ID NO: 276514 - DNA, 39 bp, Artificial Sequence
  Description of Artificial Sequence: Synthetic oligonucleotide
gaaaccgaattgaaactttgcatccagcacatatcagac

SEQ ID NO: 276515 - DNA, 39 bp, Artificial Sequence
  Description of Artificial Sequence: Synthetic oligonucleotide
aaaccgaattgaaactttgcatccagcacatatcagacc

SEQ ID NO: 276516 - DNA, 38 bp, Artificial Sequence
  Description of Artificial Sequence: Synthetic oligonucleotide
aaccgaattgaaactttgcatccagcacatatcagacc

SEQ ID NO: 276517 - DNA, 37 bp, Artificial Sequence
  Description of Artificial Sequence: Synthetic oligonucleotide
accgaattgaaactttgcatccagcacatatcagacc

SEQ ID NO: 276518 - DNA, 36 bp, Artificial Sequence
  Description of Artificial Sequence: Synthetic oligonucleotide
ccgaattgaaactttgcatccagcacatatcagacc

SEQ ID NO: 276519 - DNA, 37 bp, Artificial Sequence
  Description of Artificial Sequence: Synthetic oligonucleotide
cgaattgaaactttgcatccagcacatatcagacctg

SEQ ID NO: 276520 - DNA, 37 bp, Artificial Sequence
  Description of Artificial Sequence: Synthetic oligonucleotide
gaattgaaactttgcatccagcacatatcagacctgg

SEQ ID NO: 276521 - DNA, 37 bp, Artificial Sequence
  Description of Artificial Sequence: Synthetic oligonucleotide
aattgaaactttgcatccagcacatatcagacctggc

SEQ ID NO: 276522 - DNA, 36 bp, Artificial Sequence
  Description of Artificial Sequence: Synthetic oligonucleotide
attgaaactttgcatccagcacatatcagacctggc

SEQ ID NO: 276523 - DNA, 35 bp, Artificial Sequence
  Description of Artificial Sequence: Synthetic oligonucleotide
ttgaaactttgcatccagcacatatcagacctggc

SEQ ID NO: 276524 - DNA, 34 bp, Artificial Sequence
  Description of Artificial Sequence: Synthetic oligonucleotide
tgaaactttgcatccagcacatatcagacctggc

SEQ ID NO: 276525 - DNA, 33 bp, Artificial Sequence
  Description of Artificial Sequence: Synthetic oligonucleotide
gaaactttgcatccagcacatatcagacctggc

SEQ ID NO: 276526 - DNA, 33 bp, Artificial Sequence
  Description of Artificial Sequence: Synthetic oligonucleotide
aaactttgcatccagcacatatcagacctggcc

SEQ ID NO: 276527 - DNA, 32 bp, Artificial Sequence
  Description of Artificial Sequence: Synthetic oligonucleotide
aactttgcatccagcacatatcagacctggcc

SEQ ID NO: 276528 - DNA, 31 bp, Artificial Sequence
  Description of Artificial Sequence: Synthetic oligonucleotide
actttgcatccagcacatatcagacctggcc

SEQ ID NO: 276529 - DNA, 30 bp, Artificial Sequence
  Description of Artificial Sequence: Synthetic oligonucleotide
ctttgcatccagcacatatcagacctggcc

SEQ ID NO: 276530 - DNA, 30 bp, Artificial Sequence
  Description of Artificial Sequence: Synthetic oligonucleotide
tttgcatccagcacatatcagacctggccg

SEQ ID NO: 276531 - DNA, 29 bp, Artificial Sequence
  Description of Artificial Sequence: Synthetic oligonucleotide
ttgcatccagcacatatcagacctggccg

SEQ ID NO: 276532 - DNA, 28 bp, Artificial Sequence
  Description of Artificial Sequence: Synthetic oligonucleotide
tgcatccagcacatatcagacctggccg

SEQ ID NO: 276533 - DNA, 27 bp, Artificial Sequence
  Description of Artificial Sequence: Synthetic oligonucleotide
gcatccagcacatatcagacctggccg

SEQ ID NO: 276534 - DNA, 27 bp, Artificial Sequence
  Description of Artificial Sequence: Synthetic oligonucleotide
catccagcacatatcagacctggccgc

SEQ ID NO: 276535 - DNA, 30 bp, Artificial Sequence
  Description of Artificial Sequence: Synthetic oligonucleotide
atccagcacatatcagacctggccgcattc

SEQ ID NO: 276536 - DNA, 29 bp, Artificial Sequence
  Description of Artificial Sequence: Synthetic oligonucleotide
tccagcacatatcagacctggccgcattc

SEQ ID NO: 276537 - DNA, 28 bp, Artificial Sequence
  Description of Artificial Sequence: Synthetic oligonucleotide
ccagcacatatcagacctggccgcattc

SEQ ID NO: 276538 - DNA, 29 bp, Artificial Sequence
  Description of Artificial Sequence: Synthetic oligonucleotide
cagcacatatcagacctggccgcattcac

SEQ ID NO: 276539 - DNA, 30 bp, Artificial Sequence
  Description of Artificial Sequence: Synthetic oligonucleotide
agcacatatcagacctggccgcattcacag

SEQ ID NO: 276540 - DNA, 29 bp, Artificial Sequence
  Description of Artificial Sequence: Synthetic oligonucleotide
gcacatatcagacctggccgcattcacag

SEQ ID NO: 276541 - DNA, 29 bp, Artificial Sequence
  Description of Artificial Sequence: Synthetic oligonucleotide
cacatatcagacctggccgcattcacagg

SEQ ID NO: 276542 - DNA, 31 bp, Artificial Sequence
  Description of Artificial Sequence: Synthetic oligonucleotide
acatatcagacctggccgcattcacaggaag

SEQ ID NO: 276543 - DNA, 30 bp, Artificial Sequence
  Description of Artificial Sequence: Synthetic oligonucleotide
catatcagacctggccgcattcacaggaag

SEQ ID NO: 276544 - DNA, 33 bp, Artificial Sequence
  Description of Artificial Sequence: Synthetic oligonucleotide
atatcagacctggccgcattcacaggaagaatg

SEQ ID NO: 276545 - DNA, 32 bp, Artificial Sequence
  Description of Artificial Sequence: Synthetic oligonucleotide
tatcagacctggccgcattcacaggaagaatg

SEQ ID NO: 276546 - DNA, 31 bp, Artificial Sequence
  Description of Artificial Sequence: Synthetic oligonucleotide
atcagacctggccgcattcacaggaagaatg

SEQ ID NO: 276547 - DNA, 30 bp, Artificial Sequence
  Description of Artificial Sequence: Synthetic oligonucleotide
tcagacctggccgcattcacaggaagaatg

SEQ ID NO: 276548 - DNA, 29 bp, Artificial Sequence
  Description of Artificial Sequence: Synthetic oligonucleotide
cagacctggccgcattcacaggaagaatg

SEQ ID NO: 276549 - DNA, 30 bp, Artificial Sequence
  Description of Artificial Sequence: Synthetic oligonucleotide
agacctggccgcattcacaggaagaatgag

SEQ ID NO: 276550 - DNA, 29 bp, Artificial Sequence
  Description of Artificial Sequence: Synthetic oligonucleotide
gacctggccgcattcacaggaagaatgag

SEQ ID NO: 276551 - DNA, 31 bp, Artificial Sequence
  Description of Artificial Sequence: Synthetic oligonucleotide
acctggccgcattcacaggaagaatgagttc

SEQ ID NO: 276552 - DNA, 30 bp, Artificial Sequence
  Description of Artificial Sequence: Synthetic oligonucleotide
cctggccgcattcacaggaagaatgagttc

SEQ ID NO: 276553 - DNA, 30 bp, Artificial Sequence
  Description of Artificial Sequence: Synthetic oligonucleotide
ctggccgcattcacaggaagaatgagttcc

SEQ ID NO: 276554 - DNA, 30 bp, Artificial Sequence
  Description of Artificial Sequence: Synthetic oligonucleotide
tggccgcattcacaggaagaatgagttccc

SEQ ID NO: 276555 - DNA, 29 bp, Artificial Sequence
  Description of Artificial Sequence: Synthetic oligonucleotide
ggccgcattcacaggaagaatgagttccc

SEQ ID NO: 276556 - DNA, 29 bp, Artificial Sequence
  Description of Artificial Sequence: Synthetic oligonucleotide
gccgcattcacaggaagaatgagttcccg

SEQ ID NO: 276557 - DNA, 29 bp, Artificial Sequence
  Description of Artificial Sequence: Synthetic oligonucleotide
ccgcattcacaggaagaatgagttcccgc

SEQ ID NO: 276558 - DNA, 30 bp, Artificial Sequence
  Description of Artificial Sequence: Synthetic oligonucleotide
cgcattcacaggaagaatgagttcccgctg

SEQ ID NO: 276559 - DNA, 30 bp, Artificial Sequence
  Description of Artificial Sequence: Synthetic oligonucleotide
gcattcacaggaagaatgagttcccgctgc

SEQ ID NO: 276560 - DNA, 30 bp, Artificial Sequence
  Description of Artificial Sequence: Synthetic oligonucleotide
cattcacaggaagaatgagttcccgctgcc

SEQ ID NO: 276561 - DNA, 31 bp, Artificial Sequence
  Description of Artificial Sequence: Synthetic oligonucleotide
attcacaggaagaatgagttcccgctgcctg

SEQ ID NO: 276562 - DNA, 30 bp, Artificial Sequence
  Description of Artificial Sequence: Synthetic oligonucleotide
ttcacaggaagaatgagttcccgctgcctg

SEQ ID NO: 276563 - DNA, 29 bp, Artificial Sequence
  Description of Artificial Sequence: Synthetic oligonucleotide
tcacaggaagaatgagttcccgctgcctg

SEQ ID NO: 276564 - DNA, 28 bp, Artificial Sequence
  Description of Artificial Sequence: Synthetic oligonucleotide
cacaggaagaatgagttcccgctgcctg

SEQ ID NO: 276565 - DNA, 30 bp, Artificial Sequence
  Description of Artificial Sequence: Synthetic oligonucleotide
acaggaagaatgagttcccgctgcctgatc

SEQ ID NO: 276566 - DNA, 29 bp, Artificial Sequence
  Description of Artificial Sequence: Synthetic oligonucleotide
caggaagaatgagttcccgctgcctgatc

SEQ ID NO: 276567 - DNA, 33 bp, Artificial Sequence
  Description of Artificial Sequence: Synthetic oligonucleotide
aggaagaatgagttcccgctgcctgatcaaaag

SEQ ID NO: 276568 - DNA, 32 bp, Artificial Sequence
  Description of Artificial Sequence: Synthetic oligonucleotide
ggaagaatgagttcccgctgcctgatcaaaag

SEQ ID NO: 276569 - DNA, 33 bp, Artificial Sequence
  Description of Artificial Sequence: Synthetic oligonucleotide
gaagaatgagttcccgctgcctgatcaaaagac

SEQ ID NO: 276570 - DNA, 33 bp, Artificial Sequence
  Description of Artificial Sequence: Synthetic oligonucleotide
aagaatgagttcccgctgcctgatcaaaagacg

SEQ ID NO: 276571 - DNA, 32 bp, Artificial Sequence
  Description of Artificial Sequence: Synthetic oligonucleotide
agaatgagttcccgctgcctgatcaaaagacg

SEQ ID NO: 276572 - DNA, 31 bp, Artificial Sequence
  Description of Artificial Sequence: Synthetic oligonucleotide
gaatgagttcccgctgcctgatcaaaagacg

SEQ ID NO: 276573 - DNA, 33 bp, Artificial Sequence
  Description of Artificial Sequence: Synthetic oligonucleotide
aatgagttcccgctgcctgatcaaaagacgatg

SEQ ID NO: 276574 - DNA, 32 bp, Artificial Sequence
  Description of Artificial Sequence: Synthetic oligonucleotide
atgagttcccgctgcctgatcaaaagacgatg

SEQ ID NO: 276575 - DNA, 31 bp, Artificial Sequence
  Description of Artificial Sequence: Synthetic oligonucleotide
tgagttcccgctgcctgatcaaaagacgatg

SEQ ID NO: 276576 - DNA, 30 bp, Artificial Sequence
  Description of Artificial Sequence: Synthetic oligonucleotide
gagttcccgctgcctgatcaaaagacgatg

SEQ ID NO: 276577 - DNA, 32 bp, Artificial Sequence
  Description of Artificial Sequence: Synthetic oligonucleotide
agttcccgctgcctgatcaaaagacgatgaag

SEQ ID NO: 276578 - DNA, 31 bp, Artificial Sequence
  Description of Artificial Sequence: Synthetic oligonucleotide
gttcccgctgcctgatcaaaagacgatgaag

SEQ ID NO: 276579 - DNA, 31 bp, Artificial Sequence
  Description of Artificial Sequence: Synthetic oligonucleotide
ttcccgctgcctgatcaaaagacgatgaagc

SEQ ID NO: 276580 - DNA, 30 bp, Artificial Sequence
  Description of Artificial Sequence: Synthetic oligonucleotide
tcccgctgcctgatcaaaagacgatgaagc

SEQ ID NO: 276581 - DNA, 29 bp, Artificial Sequence
  Description of Artificial Sequence: Synthetic oligonucleotide
cccgctgcctgatcaaaagacgatgaagc

SEQ ID NO: 276582 - DNA, 29 bp, Artificial Sequence
  Description of Artificial Sequence: Synthetic oligonucleotide
ccgctgcctgatcaaaagacgatgaagcg

SEQ ID NO: 276583 - DNA, 29 bp, Artificial Sequence
  Description of Artificial Sequence: Synthetic oligonucleotide
cgctgcctgatcaaaagacgatgaagcgc

SEQ ID NO: 276584 - DNA, 31 bp, Artificial Sequence
  Description of Artificial Sequence: Synthetic oligonucleotide
gctgcctgatcaaaagacgatgaagcgcatg

SEQ ID NO: 276585 - DNA, 34 bp, Artificial Sequence
  Description of Artificial Sequence: Synthetic oligonucleotide
ctgcctgatcaaaagacgatgaagcgcatgtttc

SEQ ID NO: 276586 - DNA, 35 bp, Artificial Sequence
  Description of Artificial Sequence: Synthetic oligonucleotide
tgcctgatcaaaagacgatgaagcgcatgtttcag

SEQ ID NO: 276587 - DNA, 34 bp, Artificial Sequence
  Description of Artificial Sequence: Synthetic oligonucleotide
gcctgatcaaaagacgatgaagcgcatgtttcag

SEQ ID NO: 276588 - DNA, 37 bp, Artificial Sequence
  Description of Artificial Sequence: Synthetic oligonucleotide
cctgatcaaaagacgatgaagcgcatgtttcagattg

SEQ ID NO: 276589 - DNA, 38 bp, Artificial Sequence
  Description of Artificial Sequence: Synthetic oligonucleotide
ctgatcaaaagacgatgaagcgcatgtttcagattgac

SEQ ID NO: 276590 - DNA, 39 bp, Artificial Sequence
  Description of Artificial Sequence: Synthetic oligonucleotide
tgatcaaaagacgatgaagcgcatgtttcagattgacac

SEQ ID NO: 276591 - DNA, 38 bp, Artificial Sequence
  Description of Artificial Sequence: Synthetic oligonucleotide
gatcaaaagacgatgaagcgcatgtttcagattgacac

SEQ ID NO: 276592 - DNA, 40 bp, Artificial Sequence
  Description of Artificial Sequence: Synthetic oligonucleotide
atcaaaagacgatgaagcgcatgtttcagattgacacaag

SEQ ID NO: 276593 - DNA, 39 bp, Artificial Sequence
  Description of Artificial Sequence: Synthetic oligonucleotide
tcaaaagacgatgaagcgcatgtttcagattgacacaag

SEQ ID NO: 276594 - DNA, 38 bp, Artificial Sequence
  Description of Artificial Sequence: Synthetic oligonucleotide
caaaagacgatgaagcgcatgtttcagattgacacaag

SEQ ID NO: 276595 - DNA, 38 bp, Artificial Sequence
  Description of Artificial Sequence: Synthetic oligonucleotide
aaaagacgatgaagcgcatgtttcagattgacacaagc

SEQ ID NO: 276596 - DNA, 37 bp, Artificial Sequence
  Description of Artificial Sequence: Synthetic oligonucleotide
aaagacgatgaagcgcatgtttcagattgacacaagc

SEQ ID NO: 276597 - DNA, 36 bp, Artificial Sequence
  Description of Artificial Sequence: Synthetic oligonucleotide
aagacgatgaagcgcatgtttcagattgacacaagc

SEQ ID NO: 276598 - DNA, 35 bp, Artificial Sequence
  Description of Artificial Sequence: Synthetic oligonucleotide
agacgatgaagcgcatgtttcagattgacacaagc

SEQ ID NO: 276599 - DNA, 34 bp, Artificial Sequence
  Description of Artificial Sequence: Synthetic oligonucleotide
gacgatgaagcgcatgtttcagattgacacaagc

SEQ ID NO: 276600 - DNA, 35 bp, Artificial Sequence
  Description of Artificial Sequence: Synthetic oligonucleotide
acgatgaagcgcatgtttcagattgacacaagcac

SEQ ID NO: 276601 - DNA, 34 bp, Artificial Sequence
  Description of Artificial Sequence: Synthetic oligonucleotide
cgatgaagcgcatgtttcagattgacacaagcac

SEQ ID NO: 276602 - DNA, 34 bp, Artificial Sequence
  Description of Artificial Sequence: Synthetic oligonucleotide
gatgaagcgcatgtttcagattgacacaagcacg

SEQ ID NO: 276603 - DNA, 36 bp, Artificial Sequence
  Description of Artificial Sequence: Synthetic oligonucleotide
atgaagcgcatgtttcagattgacacaagcacgatg

SEQ ID NO: 276604 - DNA, 35 bp, Artificial Sequence
  Description of Artificial Sequence: Synthetic oligonucleotide
tgaagcgcatgtttcagattgacacaagcacgatg

SEQ ID NO: 276605 - DNA, 34 bp, Artificial Sequence
  Description of Artificial Sequence: Synthetic oligonucleotide
gaagcgcatgtttcagattgacacaagcacgatg

SEQ ID NO: 276606 - DNA, 35 bp, Artificial Sequence
  Description of Artificial Sequence: Synthetic oligonucleotide
aagcgcatgtttcagattgacacaagcacgatgac

SEQ ID NO: 276607 - DNA, 34 bp, Artificial Sequence
  Description of Artificial Sequence: Synthetic oligonucleotide
agcgcatgtttcagattgacacaagcacgatgac

SEQ ID NO: 276608 - DNA, 33 bp, Artificial Sequence
  Description of Artificial Sequence: Synthetic oligonucleotide
gcgcatgtttcagattgacacaagcacgatgac

SEQ ID NO: 276609 - DNA, 33 bp, Artificial Sequence
  Description of Artificial Sequence: Synthetic oligonucleotide
cgcatgtttcagattgacacaagcacgatgacg

SEQ ID NO: 276610 - DNA, 33 bp, Artificial Sequence
  Description of Artificial Sequence: Synthetic oligonucleotide
gcatgtttcagattgacacaagcacgatgacgc

SEQ ID NO: 276611 - DNA, 34 bp, Artificial Sequence
  Description of Artificial Sequence: Synthetic oligonucleotide
catgtttcagattgacacaagcacgatgacgctc

SEQ ID NO: 276612 - DNA, 34 bp, Artificial Sequence
  Description of Artificial Sequence: Synthetic oligonucleotide
atgtttcagattgacacaagcacgatgacgctcg

SEQ ID NO: 276613 - DNA, 33 bp, Artificial Sequence
  Description of Artificial Sequence: Synthetic oligonucleotide
tgtttcagattgacacaagcacgatgacgctcg

SEQ ID NO: 276614 - DNA, 32 bp, Artificial Sequence
  Description of Artificial Sequence: Synthetic oligonucleotide
gtttcagattgacacaagcacgatgacgctcg

SEQ ID NO: 276615 - DNA, 32 bp, Artificial Sequence
  Description of Artificial Sequence: Synthetic oligonucleotide
tttcagattgacacaagcacgatgacgctcgc

SEQ ID NO: 276616 - DNA, 31 bp, Artificial Sequence
  Description of Artificial Sequence: Synthetic oligonucleotide
ttcagattgacacaagcacgatgacgctcgc

SEQ ID NO: 276617 - DNA, 30 bp, Artificial Sequence
  Description of Artificial Sequence: Synthetic oligonucleotide
tcagattgacacaagcacgatgacgctcgc

SEQ ID NO: 276618 - DNA, 29 bp, Artificial Sequence
  Description of Artificial Sequence: Synthetic oligonucleotide
cagattgacacaagcacgatgacgctcgc

SEQ ID NO: 276619 - DNA, 30 bp, Artificial Sequence
  Description of Artificial Sequence: Synthetic oligonucleotide
agattgacacaagcacgatgacgctcgctg

SEQ ID NO: 276620 - DNA, 29 bp, Artificial Sequence
  Description of Artificial Sequence: Synthetic oligonucleotide
gattgacacaagcacgatgacgctcgctg

SEQ ID NO: 276621 - DNA, 31 bp, Artificial Sequence
  Description of Artificial Sequence: Synthetic oligonucleotide
attgacacaagcacgatgacgctcgctgatg

SEQ ID NO: 276622 - DNA, 30 bp, Artificial Sequence
  Description of Artificial Sequence: Synthetic oligonucleotide
ttgacacaagcacgatgacgctcgctgatg

SEQ ID NO: 276623 - DNA, 29 bp, Artificial Sequence
  Description of Artificial Sequence: Synthetic oligonucleotide
tgacacaagcacgatgacgctcgctgatg

SEQ ID NO: 276624 - DNA, 28 bp, Artificial Sequence
  Description of Artificial Sequence: Synthetic oligonucleotide
gacacaagcacgatgacgctcgctgatg

SEQ ID NO: 276625 - DNA, 30 bp, Artificial Sequence
  Description of Artificial Sequence: Synthetic oligonucleotide
acacaagcacgatgacgctcgctgatgatc

SEQ ID NO: 276626 - DNA, 29 bp, Artificial Sequence
  Description of Artificial Sequence: Synthetic oligonucleotide
cacaagcacgatgacgctcgctgatgatc

SEQ ID NO: 276627 - DNA, 32 bp, Artificial Sequence
  Description of Artificial Sequence: Synthetic oligonucleotide
acaagcacgatgacgctcgctgatgatctaac

SEQ ID NO: 276628 - DNA, 31 bp, Artificial Sequence
  Description of Artificial Sequence: Synthetic oligonucleotide
caagcacgatgacgctcgctgatgatctaac

SEQ ID NO: 276629 - DNA, 31 bp, Artificial Sequence
  Description of Artificial Sequence: Synthetic oligonucleotide
aagcacgatgacgctcgctgatgatctaacc

SEQ ID NO: 276630 - DNA, 30 bp, Artificial Sequence
  Description of Artificial Sequence: Synthetic oligonucleotide
agcacgatgacgctcgctgatgatctaacc

SEQ ID NO: 276631 - DNA, 29 bp, Artificial Sequence
  Description of Artificial Sequence: Synthetic oligonucleotide
gcacgatgacgctcgctgatgatctaacc

SEQ ID NO: 276632 - DNA, 29 bp, Artificial Sequence
  Description of Artificial Sequence: Synthetic oligonucleotide
cacgatgacgctcgctgatgatctaaccc

SEQ ID NO: 276633 - DNA, 30 bp, Artificial Sequence
  Description of Artificial Sequence: Synthetic oligonucleotide
acgatgacgctcgctgatgatctaaccctg

SEQ ID NO: 276634 - DNA, 29 bp, Artificial Sequence
  Description of Artificial Sequence: Synthetic oligonucleotide
cgatgacgctcgctgatgatctaaccctg

SEQ ID NO: 276635 - DNA, 29 bp, Artificial Sequence
  Description of Artificial Sequence: Synthetic oligonucleotide
gatgacgctcgctgatgatctaaccctgg

SEQ ID NO: 276636 - DNA, 30 bp, Artificial Sequence
  Description of Artificial Sequence: Synthetic oligonucleotide
atgacgctcgctgatgatctaaccctggtc

SEQ ID NO: 276637 - DNA, 29 bp, Artificial Sequence
  Description of Artificial Sequence: Synthetic oligonucleotide
tgacgctcgctgatgatctaaccctggtc

SEQ ID NO: 276638 - DNA, 28 bp, Artificial Sequence
  Description of Artificial Sequence: Synthetic oligonucleotide
gacgctcgctgatgatctaaccctggtc

SEQ ID NO: 276639 - DNA, 28 bp, Artificial Sequence
  Description of Artificial Sequence: Synthetic oligonucleotide
acgctcgctgatgatctaaccctggtcg

SEQ ID NO: 276640 - DNA, 27 bp, Artificial Sequence
  Description of Artificial Sequence: Synthetic oligonucleotide
cgctcgctgatgatctaaccctggtcg

SEQ ID NO: 276641 - DNA, 28 bp, Artificial Sequence
  Description of Artificial Sequence: Synthetic oligonucleotide
gctcgctgatgatctaaccctggtcgac

SEQ ID NO: 276642 - DNA, 28 bp, Artificial Sequence
  Description of Artificial Sequence: Synthetic oligonucleotide
ctcgctgatgatctaaccctggtcgacc

SEQ ID NO: 276643 - DNA, 29 bp, Artificial Sequence
  Description of Artificial Sequence: Synthetic oligonucleotide
tcgctgatgatctaaccctggtcgacctg

SEQ ID NO: 276644 - DNA, 28 bp, Artificial Sequence
  Description of Artificial Sequence: Synthetic oligonucleotide
cgctgatgatctaaccctggtcgacctg

SEQ ID NO: 276645 - DNA, 30 bp, Artificial Sequence
  Description of Artificial Sequence: Synthetic oligonucleotide
gctgatgatctaaccctggtcgacctgatg

SEQ ID NO: 276646 - DNA, 32 bp, Artificial Sequence
  Description of Artificial Sequence: Synthetic oligonucleotide
ctgatgatctaaccctggtcgacctgatgatg

SEQ ID NO: 276647 - DNA, 32 bp, Artificial Sequence
  Description of Artificial Sequence: Synthetic oligonucleotide
tgatgatctaaccctggtcgacctgatgatgg

SEQ ID NO: 276648 - DNA, 31 bp, Artificial Sequence
  Description of Artificial Sequence: Synthetic oligonucleotide
gatgatctaaccctggtcgacctgatgatgg

SEQ ID NO: 276649 - DNA, 31 bp, Artificial Sequence
  Description of Artificial Sequence: Synthetic oligonucleotide
atgatctaaccctggtcgacctgatgatggc

SEQ ID NO: 276650 - DNA, 30 bp, Artificial Sequence
  Description of Artificial Sequence: Synthetic oligonucleotide
tgatctaaccctggtcgacctgatgatggc

SEQ ID NO: 276651 - DNA, 29 bp, Artificial Sequence
  Description of Artificial Sequence: Synthetic oligonucleotide
gatctaaccctggtcgacctgatgatggc

SEQ ID NO: 276652 - DNA, 33 bp, Artificial Sequence
  Description of Artificial Sequence: Synthetic oligonucleotide
atctaaccctggtcgacctgatgatggctaaac

SEQ ID NO: 276653 - DNA, 32 bp, Artificial Sequence
  Description of Artificial Sequence: Synthetic oligonucleotide
tctaaccctggtcgacctgatgatggctaaac

SEQ ID NO: 276654 - DNA, 31 bp, Artificial Sequence
  Description of Artificial Sequence: Synthetic oligonucleotide
ctaaccctggtcgacctgatgatggctaaac

SEQ ID NO: 276655 - DNA, 33 bp, Artificial Sequence
  Description of Artificial Sequence: Synthetic oligonucleotide
taaccctggtcgacctgatgatggctaaacatg

SEQ ID NO: 276656 - DNA, 32 bp, Artificial Sequence
  Description of Artificial Sequence: Synthetic oligonucleotide
aaccctggtcgacctgatgatggctaaacatg

SEQ ID NO: 276657 - DNA, 31 bp, Artificial Sequence
  Description of Artificial Sequence: Synthetic oligonucleotide
accctggtcgacctgatgatggctaaacatg

SEQ ID NO: 276658 - DNA, 30 bp, Artificial Sequence
  Description of Artificial Sequence: Synthetic oligonucleotide
ccctggtcgacctgatgatggctaaacatg

SEQ ID NO: 276659 - DNA, 31 bp, Artificial Sequence
  Description of Artificial Sequence: Synthetic oligonucleotide
cctggtcgacctgatgatggctaaacatgac

SEQ ID NO: 276660 - DNA, 31 bp, Artificial Sequence
  Description of Artificial Sequence: Synthetic oligonucleotide
ctggtcgacctgatgatggctaaacatgacc

SEQ ID NO: 276661 - DNA, 32 bp, Artificial Sequence
  Description of Artificial Sequence: Synthetic oligonucleotide
tggtcgacctgatgatggctaaacatgacctc

SEQ ID NO: 276662 - DNA, 31 bp, Artificial Sequence
  Description of Artificial Sequence: Synthetic oligonucleotide
ggtcgacctgatgatggctaaacatgacctc

SEQ ID NO: 276663 - DNA, 32 bp, Artificial Sequence
  Description of Artificial Sequence: Synthetic oligonucleotide
gtcgacctgatgatggctaaacatgacctctg

SEQ ID NO: 276664 - DNA, 33 bp, Artificial Sequence
  Description of Artificial Sequence: Synthetic oligonucleotide
tcgacctgatgatggctaaacatgacctctgtg

SEQ ID NO: 276665 - DNA, 32 bp, Artificial Sequence
  Description of Artificial Sequence: Synthetic oligonucleotide
cgacctgatgatggctaaacatgacctctgtg

SEQ ID NO: 276666 - DNA, 32 bp, Artificial Sequence
  Description of Artificial Sequence: Synthetic oligonucleotide
gacctgatgatggctaaacatgacctctgtgg

SEQ ID NO: 276667 - DNA, 33 bp, Artificial Sequence
  Description of Artificial Sequence: Synthetic oligonucleotide
acctgatgatggctaaacatgacctctgtggtg

SEQ ID NO: 276668 - DNA, 32 bp, Artificial Sequence
  Description of Artificial Sequence: Synthetic oligonucleotide
cctgatgatggctaaacatgacctctgtggtg

SEQ ID NO: 276669 - DNA, 32 bp, Artificial Sequence
  Description of Artificial Sequence: Synthetic oligonucleotide
ctgatgatggctaaacatgacctctgtggtgc

SEQ ID NO: 276670 - DNA, 33 bp, Artificial Sequence
  Description of Artificial Sequence: Synthetic oligonucleotide
tgatgatggctaaacatgacctctgtggtgctg

SEQ ID NO: 276671 - DNA, 32 bp, Artificial Sequence
  Description of Artificial Sequence: Synthetic oligonucleotide
gatgatggctaaacatgacctctgtggtgctg

SEQ ID NO: 276672 - DNA, 33 bp, Artificial Sequence
  Description of Artificial Sequence: Synthetic oligonucleotide
atgatggctaaacatgacctctgtggtgctgag

SEQ ID NO: 276673 - DNA, 32 bp, Artificial Sequence
  Description of Artificial Sequence: Synthetic oligonucleotide
tgatggctaaacatgacctctgtggtgctgag

SEQ ID NO: 276674 - DNA, 31 bp, Artificial Sequence
  Description of Artificial Sequence: Synthetic oligonucleotide
gatggctaaacatgacctctgtggtgctgag

SEQ ID NO: 276675 - DNA, 33 bp, Artificial Sequence
  Description of Artificial Sequence: Synthetic oligonucleotide
atggctaaacatgacctctgtggtgctgagatc

SEQ ID NO: 276676 - DNA, 32 bp, Artificial Sequence
  Description of Artificial Sequence: Synthetic oligonucleotide
tggctaaacatgacctctgtggtgctgagatc

SEQ ID NO: 276677 - DNA, 31 bp, Artificial Sequence
  Description of Artificial Sequence: Synthetic oligonucleotide
ggctaaacatgacctctgtggtgctgagatc

SEQ ID NO: 276678 - DNA, 33 bp, Artificial Sequence
  Description of Artificial Sequence: Synthetic oligonucleotide
gctaaacatgacctctgtggtgctgagatcaag

SEQ ID NO: 276679 - DNA, 33 bp, Artificial Sequence
  Description of Artificial Sequence: Synthetic oligonucleotide
ctaaacatgacctctgtggtgctgagatcaagg

SEQ ID NO: 276680 - DNA, 33 bp, Artificial Sequence
  Description of Artificial Sequence: Synthetic oligonucleotide
taaacatgacctctgtggtgctgagatcaaggc

SEQ ID NO: 276681 - DNA, 32 bp, Artificial Sequence
  Description of Artificial Sequence: Synthetic oligonucleotide
aaacatgacctctgtggtgctgagatcaaggc

SEQ ID NO: 276682 - DNA, 31 bp, Artificial Sequence
  Description of Artificial Sequence: Synthetic oligonucleotide
aacatgacctctgtggtgctgagatcaaggc

SEQ ID NO: 276683 - DNA, 30 bp, Artificial Sequence
  Description of Artificial Sequence: Synthetic oligonucleotide
acatgacctctgtggtgctgagatcaaggc

SEQ ID NO: 276684 - DNA, 29 bp, Artificial Sequence
  Description of Artificial Sequence: Synthetic oligonucleotide
catgacctctgtggtgctgagatcaaggc

SEQ ID NO: 276685 - DNA, 32 bp, Artificial Sequence
  Description of Artificial Sequence: Synthetic oligonucleotide
atgacctctgtggtgctgagatcaaggcattc

SEQ ID NO: 276686 - DNA, 31 bp, Artificial Sequence
  Description of Artificial Sequence: Synthetic oligonucleotide
tgacctctgtggtgctgagatcaaggcattc

SEQ ID NO: 276687 - DNA, 30 bp, Artificial Sequence
  Description of Artificial Sequence: Synthetic oligonucleotide
gacctctgtggtgctgagatcaaggcattc

SEQ ID NO: 276688 - DNA, 31 bp, Artificial Sequence
  Description of Artificial Sequence: Synthetic oligonucleotide
acctctgtggtgctgagatcaaggcattctg

SEQ ID NO: 276689 - DNA, 30 bp, Artificial Sequence
  Description of Artificial Sequence: Synthetic oligonucleotide
cctctgtggtgctgagatcaaggcattctg

SEQ ID NO: 276690 - DNA, 32 bp, Artificial Sequence
  Description of Artificial Sequence: Synthetic oligonucleotide
ctctgtggtgctgagatcaaggcattctgtac

SEQ ID NO: 276691 - DNA, 33 bp, Artificial Sequence
  Description of Artificial Sequence: Synthetic oligonucleotide
tctgtggtgctgagatcaaggcattctgtacag

SEQ ID NO: 276692 - DNA, 32 bp, Artificial Sequence
  Description of Artificial Sequence: Synthetic oligonucleotide
ctgtggtgctgagatcaaggcattctgtacag

SEQ ID NO: 276693 - DNA, 34 bp, Artificial Sequence
  Description of Artificial Sequence: Synthetic oligonucleotide
tgtggtgctgagatcaaggcattctgtacagtag

SEQ ID NO: 276694 - DNA, 33 bp, Artificial Sequence
  Description of Artificial Sequence: Synthetic oligonucleotide
gtggtgctgagatcaaggcattctgtacagtag

SEQ ID NO: 276695 - DNA, 33 bp, Artificial Sequence
  Description of Artificial Sequence: Synthetic oligonucleotide
tggtgctgagatcaaggcattctgtacagtagc

SEQ ID NO: 276696 - DNA, 32 bp, Artificial Sequence
  Description of Artificial Sequence: Synthetic oligonucleotide
ggtgctgagatcaaggcattctgtacagtagc

SEQ ID NO: 276697 - DNA, 33 bp, Artificial Sequence
  Description of Artificial Sequence: Synthetic oligonucleotide
gtgctgagatcaaggcattctgtacagtagctg

SEQ ID NO: 276698 - DNA, 33 bp, Artificial Sequence
  Description of Artificial Sequence: Synthetic oligonucleotide
tgctgagatcaaggcattctgtacagtagctgg

SEQ ID NO: 276699 - DNA, 32 bp, Artificial Sequence
  Description of Artificial Sequence: Synthetic oligonucleotide
gctgagatcaaggcattctgtacagtagctgg

SEQ ID NO: 276700 - DNA, 33 bp, Artificial Sequence
  Description of Artificial Sequence: Synthetic oligonucleotide
ctgagatcaaggcattctgtacagtagctggtc

SEQ ID NO: 276701 - DNA, 34 bp, Artificial Sequence
  Description of Artificial Sequence: Synthetic oligonucleotide
tgagatcaaggcattctgtacagtagctggtctc

SEQ ID NO: 276702 - DNA, 33 bp, Artificial Sequence
  Description of Artificial Sequence: Synthetic oligonucleotide
gagatcaaggcattctgtacagtagctggtctc

SEQ ID NO: 276703 - DNA, 35 bp, Artificial Sequence
  Description of Artificial Sequence: Synthetic oligonucleotide
agatcaaggcattctgtacagtagctggtctcatg

SEQ ID NO: 276704 - DNA, 34 bp, Artificial Sequence
  Description of Artificial Sequence: Synthetic oligonucleotide
gatcaaggcattctgtacagtagctggtctcatg

SEQ ID NO: 276705 - DNA, 34 bp, Artificial Sequence
  Description of Artificial Sequence: Synthetic oligonucleotide
atcaaggcattctgtacagtagctggtctcatgg

SEQ ID NO: 276706 - DNA, 33 bp, Artificial Sequence
  Description of Artificial Sequence: Synthetic oligonucleotide
tcaaggcattctgtacagtagctggtctcatgg

SEQ ID NO: 276707 - DNA, 32 bp, Artificial Sequence
  Description of Artificial Sequence: Synthetic oligonucleotide
caaggcattctgtacagtagctggtctcatgg

SEQ ID NO: 276708 - DNA, 32 bp, Artificial Sequence
  Description of Artificial Sequence: Synthetic oligonucleotide
aaggcattctgtacagtagctggtctcatggc

SEQ ID NO: 276709 - DNA, 31 bp, Artificial Sequence
  Description of Artificial Sequence: Synthetic oligonucleotide
aggcattctgtacagtagctggtctcatggc

SEQ ID NO: 276710 - DNA, 30 bp, Artificial Sequence
  Description of Artificial Sequence: Synthetic oligonucleotide
ggcattctgtacagtagctggtctcatggc

SEQ ID NO: 276711 - DNA, 30 bp, Artificial Sequence
  Description of Artificial Sequence: Synthetic oligonucleotide
gcattctgtacagtagctggtctcatggcc

SEQ ID NO: 276712 - DNA, 34 bp, Artificial Sequence
  Description of Artificial Sequence: Synthetic oligonucleotide
cattctgtacagtagctggtctcatggccttatg

SEQ ID NO: 276713 - DNA, 35 bp, Artificial Sequence
  Description of Artificial Sequence: Synthetic oligonucleotide
attctgtacagtagctggtctcatggccttatgag

SEQ ID NO: 276714 - DNA, 34 bp, Artificial Sequence
  Description of Artificial Sequence: Synthetic oligonucleotide
ttctgtacagtagctggtctcatggccttatgag

SEQ ID NO: 276715 - DNA, 33 bp, Artificial Sequence
  Description of Artificial Sequence: Synthetic oligonucleotide
tctgtacagtagctggtctcatggccttatgag

SEQ ID NO: 276716 - DNA, 32 bp, Artificial Sequence
  Description of Artificial Sequence: Synthetic oligonucleotide
ctgtacagtagctggtctcatggccttatgag

SEQ ID NO: 276717 - DNA, 34 bp, Artificial Sequence
  Description of Artificial Sequence: Synthetic oligonucleotide
tgtacagtagctggtctcatggccttatgagaac

SEQ ID NO: 276718 - DNA, 33 bp, Artificial Sequence
  Description of Artificial Sequence: Synthetic oligonucleotide
gtacagtagctggtctcatggccttatgagaac

SEQ ID NO: 276719 - DNA, 33 bp, Artificial Sequence
  Description of Artificial Sequence: Synthetic oligonucleotide
tacagtagctggtctcatggccttatgagaacg

SEQ ID NO: 276720 - DNA, 32 bp, Artificial Sequence
  Description of Artificial Sequence: Synthetic oligonucleotide
acagtagctggtctcatggccttatgagaacg

SEQ ID NO: 276721 - DNA, 31 bp, Artificial Sequence
  Description of Artificial Sequence: Synthetic oligonucleotide
cagtagctggtctcatggccttatgagaacg

SEQ ID NO: 276722 - DNA, 33 bp, Artificial Sequence
  Description of Artificial Sequence: Synthetic oligonucleotide
agtagctggtctcatggccttatgagaacgtac

SEQ ID NO: 276723 - DNA, 32 bp, Artificial Sequence
  Description of Artificial Sequence: Synthetic oligonucleotide
gtagctggtctcatggccttatgagaacgtac

SEQ ID NO: 276724 - DNA, 35 bp, Artificial Sequence
  Description of Artificial Sequence: Synthetic oligonucleotide
tagctggtctcatggccttatgagaacgtacaatg

SEQ ID NO: 276725 - DNA, 34 bp, Artificial Sequence
  Description of Artificial Sequence: Synthetic oligonucleotide
agctggtctcatggccttatgagaacgtacaatg

SEQ ID NO: 276726 - DNA, 33 bp, Artificial Sequence
  Description of Artificial Sequence: Synthetic oligonucleotide
gctggtctcatggccttatgagaacgtacaatg

SEQ ID NO: 276727 - DNA, 36 bp, Artificial Sequence
  Description of Artificial Sequence: Synthetic oligonucleotide
ctggtctcatggccttatgagaacgtacaatgaaag

SEQ ID NO: 276728 - DNA, 39 bp, Artificial Sequence
  Description of Artificial Sequence: Synthetic oligonucleotide
tggtctcatggccttatgagaacgtacaatgaaagttac

SEQ ID NO: 276729 - DNA, 38 bp, Artificial Sequence
  Description of Artificial Sequence: Synthetic oligonucleotide
ggtctcatggccttatgagaacgtacaatgaaagttac

SEQ ID NO: 276730 - DNA, 42 bp, Artificial Sequence
  Description of Artificial Sequence: Synthetic oligonucleotide
gtctcatggccttatgagaacgtacaatgaaagttacaaatg

SEQ ID NO: 276731 - DNA, 44 bp, Artificial Sequence
  Description of Artificial Sequence: Synthetic oligonucleotide
tctcatggccttatgagaacgtacaatgaaagttacaaatgaac

SEQ ID NO: 276732 - DNA, 43 bp, Artificial Sequence
  Description of Artificial Sequence: Synthetic oligonucleotide
ctcatggccttatgagaacgtacaatgaaagttacaaatgaac

SEQ ID NO: 276733 - DNA, 44 bp, Artificial Sequence
  Description of Artificial Sequence: Synthetic oligonucleotide
tcatggccttatgagaacgtacaatgaaagttacaaatgaacac

SEQ ID NO: 276734 - DNA, 43 bp, Artificial Sequence
  Description of Artificial Sequence: Synthetic oligonucleotide
catggccttatgagaacgtacaatgaaagttacaaatgaacac

SEQ ID NO: 276735 - DNA, 45 bp, Artificial Sequence
  Description of Artificial Sequence: Synthetic oligonucleotide
atggccttatgagaacgtacaatgaaagttacaaatgaacacttc

SEQ ID NO: 276736 - DNA, 44 bp, Artificial Sequence
  Description of Artificial Sequence: Synthetic oligonucleotide
tggccttatgagaacgtacaatgaaagttacaaatgaacacttc

SEQ ID NO: 276737 - DNA, 43 bp, Artificial Sequence
  Description of Artificial Sequence: Synthetic oligonucleotide
ggccttatgagaacgtacaatgaaagttacaaatgaacacttc

SEQ ID NO: 276738 - DNA, 50 bp, Artificial Sequence
  Description of Artificial Sequence: Synthetic oligonucleotide
gccttatgagaacgtacaatgaaagttacaaatgaacacttcaaaatatc

SEQ ID NO: 276739 - DNA, 54 bp, Artificial Sequence
  Description of Artificial Sequence: Synthetic oligonucleotide
ccttatgagaacgtacaatgaaagttacaaatgaacacttcaaaatatctaaag

SEQ ID NO: 276740 - DNA, 59 bp, Artificial Sequence
  Description of Artificial Sequence: Synthetic oligonucleotide
cttatgagaacgtacaatgaaagttacaaatgaacacttcaaaatatctaaagataatg

SEQ ID NO: 276741 - DNA, 60 bp, Artificial Sequence
  Description of Artificial Sequence: Synthetic oligonucleotide
ttatgagaacgtacaatgaaagttacaaatgaacacttcaaaatatctaaagataatgtt

SEQ ID NO: 276742 - DNA, 60 bp, Artificial Sequence
  Description of Artificial Sequence: Synthetic oligonucleotide
tatgagaacgtacaatgaaagttacaaatgaacacttcaaaatatctaaagataatgttc

SEQ ID NO: 276743 - DNA, 59 bp, Artificial Sequence
  Description of Artificial Sequence: Synthetic oligonucleotide
atgagaacgtacaatgaaagttacaaatgaacacttcaaaatatctaaagataatgttc

SEQ ID NO: 276744 - DNA, 58 bp, Artificial Sequence
  Description of Artificial Sequence: Synthetic oligonucleotide
tgagaacgtacaatgaaagttacaaatgaacacttcaaaatatctaaagataatgttc

SEQ ID NO: 276745 - DNA, 57 bp, Artificial Sequence
  Description of Artificial Sequence: Synthetic oligonucleotide
gagaacgtacaatgaaagttacaaatgaacacttcaaaatatctaaagataatgttc

SEQ ID NO: 276746 - DNA, 60 bp, Artificial Sequence
  Description of Artificial Sequence: Synthetic oligonucleotide
agaacgtacaatgaaagttacaaatgaacacttcaaaatatctaaagataatgttcttaa

SEQ ID NO: 276747 - DNA, 60 bp, Artificial Sequence
  Description of Artificial Sequence: Synthetic oligonucleotide
gaacgtacaatgaaagttacaaatgaacacttcaaaatatctaaagataatgttcttaat

SEQ ID NO: 276748 - DNA, 60 bp, Artificial Sequence
  Description of Artificial Sequence: Synthetic oligonucleotide
aacgtacaatgaaagttacaaatgaacacttcaaaatatctaaagataatgttcttaata

SEQ ID NO: 276749 - DNA, 60 bp, Artificial Sequence
  Description of Artificial Sequence: Synthetic oligonucleotide
acgtacaatgaaagttacaaatgaacacttcaaaatatctaaagataatgttcttaataa

SEQ ID NO: 276750 - DNA, 60 bp, Artificial Sequence
  Description of Artificial Sequence: Synthetic oligonucleotide
cgtacaatgaaagttacaaatgaacacttcaaaatatctaaagataatgttcttaataag

SEQ ID NO: 276751 - DNA, 60 bp, Artificial Sequence
  Description of Artificial Sequence: Synthetic oligonucleotide
gtacaatgaaagttacaaatgaacacttcaaaatatctaaagataatgttcttaataaga

SEQ ID NO: 276752 - DNA, 60 bp, Artificial Sequence
  Description of Artificial Sequence: Synthetic oligonucleotide
tacaatgaaagttacaaatgaacacttcaaaatatctaaagataatgttcttaataagaa

SEQ ID NO: 276753 - DNA, 60 bp, Artificial Sequence
  Description of Artificial Sequence: Synthetic oligonucleotide
acaatgaaagttacaaatgaacacttcaaaatatctaaagataatgttcttaataagaaa

SEQ ID NO: 276754 - DNA, 60 bp, Artificial Sequence
  Description of Artificial Sequence: Synthetic oligonucleotide
caatgaaagttacaaatgaacacttcaaaatatctaaagataatgttcttaataagaaac

SEQ ID NO: 276755 - DNA, 60 bp, Artificial Sequence
  Description of Artificial Sequence: Synthetic oligonucleotide
aatgaaagttacaaatgaacacttcaaaatatctaaagataatgttcttaataagaaact

SEQ ID NO: 276756 - DNA, 60 bp, Artificial Sequence
  Description of Artificial Sequence: Synthetic oligonucleotide
atgaaagttacaaatgaacacttcaaaatatctaaagataatgttcttaataagaaactg

SEQ ID NO: 276757 - DNA, 60 bp, Artificial Sequence
  Description of Artificial Sequence: Synthetic oligonucleotide
tgaaagttacaaatgaacacttcaaaatatctaaagataatgttcttaataagaaactgg

SEQ ID NO: 276758 - DNA, 60 bp, Artificial Sequence
  Description of Artificial Sequence: Synthetic oligonucleotide
gaaagttacaaatgaacacttcaaaatatctaaagataatgttcttaataagaaactgga

SEQ ID NO: 276759 - DNA, 60 bp, Artificial Sequence
  Description of Artificial Sequence: Synthetic oligonucleotide
aaagttacaaatgaacacttcaaaatatctaaagataatgttcttaataagaaactggaa

SEQ ID NO: 276760 - DNA, 60 bp, Artificial Sequence
  Description of Artificial Sequence: Synthetic oligonucleotide
aagttacaaatgaacacttcaaaatatctaaagataatgttcttaataagaaactggaag

SEQ ID NO: 276761 - DNA, 60 bp, Artificial Sequence
  Description of Artificial Sequence: Synthetic oligonucleotide
agttacaaatgaacacttcaaaatatctaaagataatgttcttaataagaaactggaagg

SEQ ID NO: 276762 - DNA, 59 bp, Artificial Sequence
  Description of Artificial Sequence: Synthetic oligonucleotide
gttacaaatgaacacttcaaaatatctaaagataatgttcttaataagaaactggaagg

SEQ ID NO: 276763 - DNA, 59 bp, Artificial Sequence
  Description of Artificial Sequence: Synthetic oligonucleotide
ttacaaatgaacacttcaaaatatctaaagataatgttcttaataagaaactggaaggc

SEQ ID NO: 276764 - DNA, 58 bp, Artificial Sequence
  Description of Artificial Sequence: Synthetic oligonucleotide
tacaaatgaacacttcaaaatatctaaagataatgttcttaataagaaactggaaggc

SEQ ID NO: 276765 - DNA, 57 bp, Artificial Sequence
  Description of Artificial Sequence: Synthetic oligonucleotide
acaaatgaacacttcaaaatatctaaagataatgttcttaataagaaactggaaggc

SEQ ID NO: 276766 - DNA, 56 bp, Artificial Sequence
  Description of Artificial Sequence: Synthetic oligonucleotide
caaatgaacacttcaaaatatctaaagataatgttcttaataagaaactggaaggc

SEQ ID NO: 276767 - DNA, 57 bp, Artificial Sequence
  Description of Artificial Sequence: Synthetic oligonucleotide
aaatgaacacttcaaaatatctaaagataatgttcttaataagaaactggaaggcac

SEQ ID NO: 276768 - DNA, 56 bp, Artificial Sequence
  Description of Artificial Sequence: Synthetic oligonucleotide
aatgaacacttcaaaatatctaaagataatgttcttaataagaaactggaaggcac

SEQ ID NO: 276769 - DNA, 55 bp, Artificial Sequence
  Description of Artificial Sequence: Synthetic oligonucleotide
atgaacacttcaaaatatctaaagataatgttcttaataagaaactggaaggcac

SEQ ID NO: 276770 - DNA, 54 bp, Artificial Sequence
  Description of Artificial Sequence: Synthetic oligonucleotide
tgaacacttcaaaatatctaaagataatgttcttaataagaaactggaaggcac

SEQ ID NO: 276771 - DNA, 53 bp, Artificial Sequence
  Description of Artificial Sequence: Synthetic oligonucleotide
gaacacttcaaaatatctaaagataatgttcttaataagaaactggaaggcac

SEQ ID NO: 276772 - DNA, 53 bp, Artificial Sequence
  Description of Artificial Sequence: Synthetic oligonucleotide
aacacttcaaaatatctaaagataatgttcttaataagaaactggaaggcacg

SEQ ID NO: 276773 - DNA, 52 bp, Artificial Sequence
  Description of Artificial Sequence: Synthetic oligonucleotide
acacttcaaaatatctaaagataatgttcttaataagaaactggaaggcacg

SEQ ID NO: 276774 - DNA, 51 bp, Artificial Sequence
  Description of Artificial Sequence: Synthetic oligonucleotide
cacttcaaaatatctaaagataatgttcttaataagaaactggaaggcacg

SEQ ID NO: 276775 - DNA, 51 bp, Artificial Sequence
  Description of Artificial Sequence: Synthetic oligonucleotide
acttcaaaatatctaaagataatgttcttaataagaaactggaaggcacgc

SEQ ID NO: 276776 - DNA, 50 bp, Artificial Sequence
  Description of Artificial Sequence: Synthetic oligonucleotide
cttcaaaatatctaaagataatgttcttaataagaaactggaaggcacgc

SEQ ID NO: 276777 - DNA, 50 bp, Artificial Sequence
  Description of Artificial Sequence: Synthetic oligonucleotide
ttcaaaatatctaaagataatgttcttaataagaaactggaaggcacgcc

SEQ ID NO: 276778 - DNA, 49 bp, Artificial Sequence
  Description of Artificial Sequence: Synthetic oligonucleotide
tcaaaatatctaaagataatgttcttaataagaaactggaaggcacgcc

SEQ ID NO: 276779 - DNA, 48 bp, Artificial Sequence
  Description of Artificial Sequence: Synthetic oligonucleotide
caaaatatctaaagataatgttcttaataagaaactggaaggcacgcc

SEQ ID NO: 276780 - DNA, 49 bp, Artificial Sequence
  Description of Artificial Sequence: Synthetic oligonucleotide
aaaatatctaaagataatgttcttaataagaaactggaaggcacgcctg

SEQ ID NO: 276781 - DNA, 48 bp, Artificial Sequence
  Description of Artificial Sequence: Synthetic oligonucleotide
aaatatctaaagataatgttcttaataagaaactggaaggcacgcctg

SEQ ID NO: 276782 - DNA, 47 bp, Artificial Sequence
  Description of Artificial Sequence: Synthetic oligonucleotide
aatatctaaagataatgttcttaataagaaactggaaggcacgcctg

SEQ ID NO: 276783 - DNA, 46 bp, Artificial Sequence
  Description of Artificial Sequence: Synthetic oligonucleotide
atatctaaagataatgttcttaataagaaactggaaggcacgcctg

SEQ ID NO: 276784 - DNA, 45 bp, Artificial Sequence
  Description of Artificial Sequence: Synthetic oligonucleotide
tatctaaagataatgttcttaataagaaactggaaggcacgcctg

SEQ ID NO: 276785 - DNA, 44 bp, Artificial Sequence
  Description of Artificial Sequence: Synthetic oligonucleotide
atctaaagataatgttcttaataagaaactggaaggcacgcctg

SEQ ID NO: 276786 - DNA, 43 bp, Artificial Sequence
  Description of Artificial Sequence: Synthetic oligonucleotide
tctaaagataatgttcttaataagaaactggaaggcacgcctg

SEQ ID NO: 276787 - DNA, 42 bp, Artificial Sequence
  Description of Artificial Sequence: Synthetic oligonucleotide
ctaaagataatgttcttaataagaaactggaaggcacgcctg

SEQ ID NO: 276788 - DNA, 43 bp, Artificial Sequence
  Description of Artificial Sequence: Synthetic oligonucleotide
taaagataatgttcttaataagaaactggaaggcacgcctgag

SEQ ID NO: 276789 - DNA, 42 bp, Artificial Sequence
  Description of Artificial Sequence: Synthetic oligonucleotide
aaagataatgttcttaataagaaactggaaggcacgcctgag

SEQ ID NO: 276790 - DNA, 41 bp, Artificial Sequence
  Description of Artificial Sequence: Synthetic oligonucleotide
aagataatgttcttaataagaaactggaaggcacgcctgag

SEQ ID NO: 276791 - DNA, 40 bp, Artificial Sequence
  Description of Artificial Sequence: Synthetic oligonucleotide
agataatgttcttaataagaaactggaaggcacgcctgag

SEQ ID NO: 276792 - DNA, 39 bp, Artificial Sequence
  Description of Artificial Sequence: Synthetic oligonucleotide
gataatgttcttaataagaaactggaaggcacgcctgag

SEQ ID NO: 276793 - DNA, 39 bp, Artificial Sequence
  Description of Artificial Sequence: Synthetic oligonucleotide
ataatgttcttaataagaaactggaaggcacgcctgagg

SEQ ID NO: 276794 - DNA, 38 bp, Artificial Sequence
  Description of Artificial Sequence: Synthetic oligonucleotide
taatgttcttaataagaaactggaaggcacgcctgagg

SEQ ID NO: 276795 - DNA, 37 bp, Artificial Sequence
  Description of Artificial Sequence: Synthetic oligonucleotide
aatgttcttaataagaaactggaaggcacgcctgagg

SEQ ID NO: 276796 - DNA, 36 bp, Artificial Sequence
  Description of Artificial Sequence: Synthetic oligonucleotide
atgttcttaataagaaactggaaggcacgcctgagg

SEQ ID NO: 276797 - DNA, 35 bp, Artificial Sequence
  Description of Artificial Sequence: Synthetic oligonucleotide
tgttcttaataagaaactggaaggcacgcctgagg

SEQ ID NO: 276798 - DNA, 34 bp, Artificial Sequence
  Description of Artificial Sequence: Synthetic oligonucleotide
gttcttaataagaaactggaaggcacgcctgagg

SEQ ID NO: 276799 - DNA, 34 bp, Artificial Sequence
  Description of Artificial Sequence: Synthetic oligonucleotide
ttcttaataagaaactggaaggcacgcctgaggg

SEQ ID NO: 276800 - DNA, 33 bp, Artificial Sequence
  Description of Artificial Sequence: Synthetic oligonucleotide
tcttaataagaaactggaaggcacgcctgaggg

SEQ ID NO: 276801 - DNA, 32 bp, Artificial Sequence
  Description of Artificial Sequence: Synthetic oligonucleotide
cttaataagaaactggaaggcacgcctgaggg

SEQ ID NO: 276802 - DNA, 32 bp, Artificial Sequence
  Description of Artificial Sequence: Synthetic oligonucleotide
ttaataagaaactggaaggcacgcctgagggg

SEQ ID NO: 276803 - DNA, 31 bp, Artificial Sequence
  Description of Artificial Sequence: Synthetic oligonucleotide
taataagaaactggaaggcacgcctgagggg

SEQ ID NO: 276804 - DNA, 30 bp, Artificial Sequence
  Description of Artificial Sequence: Synthetic oligonucleotide
aataagaaactggaaggcacgcctgagggg

SEQ ID NO: 276805 - DNA, 29 bp, Artificial Sequence
  Description of Artificial Sequence: Synthetic oligonucleotide
ataagaaactggaaggcacgcctgagggg

SEQ ID NO: 276806 - DNA, 28 bp, Artificial Sequence
  Description of Artificial Sequence: Synthetic oligonucleotide
taagaaactggaaggcacgcctgagggg

SEQ ID NO: 276807 - DNA, 27 bp, Artificial Sequence
  Description of Artificial Sequence: Synthetic oligonucleotide
aagaaactggaaggcacgcctgagggg

SEQ ID NO: 276808 - DNA, 26 bp, Artificial Sequence
  Description of Artificial Sequence: Synthetic oligonucleotide
agaaactggaaggcacgcctgagggg

SEQ ID NO: 276809 - DNA, 25 bp, Artificial Sequence
  Description of Artificial Sequence: Synthetic oligonucleotide
gaaactggaaggcacgcctgagggg

SEQ ID NO: 276810 - DNA, 26 bp, Artificial Sequence
  Description of Artificial Sequence: Synthetic oligonucleotide
aaactggaaggcacgcctgagggggt

SEQ ID NO: 276811 - DNA, 25 bp, Artificial Sequence
  Description of Artificial Sequence: Synthetic oligonucleotide
aactggaaggcacgcctgagggggt

SEQ ID NO: 276812 - DNA, 24 bp, Artificial Sequence
  Description of Artificial Sequence: Synthetic oligonucleotide
actggaaggcacgcctgagggggt

SEQ ID NO: 276813 - DNA, 23 bp, Artificial Sequence
  Description of Artificial Sequence: Synthetic oligonucleotide
ctggaaggcacgcctgagggggt

SEQ ID NO: 276814 - DNA, 26 bp, Artificial Sequence
  Description of Artificial Sequence: Synthetic oligonucleotide
tggaaggcacgcctgagggggtgtat

SEQ ID NO: 276815 - DNA, 25 bp, Artificial Sequence
  Description of Artificial Sequence: Synthetic oligonucleotide
ggaaggcacgcctgagggggtgtat

SEQ ID NO: 276816 - DNA, 26 bp, Artificial Sequence
  Description of Artificial Sequence: Synthetic oligonucleotide
gaaggcacgcctgagggggtgtatct

SEQ ID NO: 276817 - DNA, 27 bp, Artificial Sequence
  Description of Artificial Sequence: Synthetic oligonucleotide
aaggcacgcctgagggggtgtatctct

SEQ ID NO: 276818 - DNA, 27 bp, Artificial Sequence
  Description of Artificial Sequence: Synthetic oligonucleotide
aggcacgcctgagggggtgtatctctt

SEQ ID NO: 276819 - DNA, 27 bp, Artificial Sequence
  Description of Artificial Sequence: Synthetic oligonucleotide
ggcacgcctgagggggtgtatctctta

SEQ ID NO: 276820 - DNA, 27 bp, Artificial Sequence
  Description of Artificial Sequence: Synthetic oligonucleotide
atgccggataacctcggtggcgatcag

SEQ ID NO: 276821 - DNA, 26 bp, Artificial Sequence
  Description of Artificial Sequence: Synthetic oligonucleotide
tgccggataacctcggtggcgatcag

SEQ ID NO: 276822 - DNA, 25 bp, Artificial Sequence
  Description of Artificial Sequence: Synthetic oligonucleotide
gccggataacctcggtggcgatcag

SEQ ID NO: 276823 - DNA, 25 bp, Artificial Sequence
  Description of Artificial Sequence: Synthetic oligonucleotide
ccggataacctcggtggcgatcagc

SEQ ID NO: 276824 - DNA, 25 bp, Artificial Sequence
  Description of Artificial Sequence: Synthetic oligonucleotide
cggataacctcggtggcgatcagcg

SEQ ID NO: 276825 - DNA, 27 bp, Artificial Sequence
  Description of Artificial Sequence: Synthetic oligonucleotide
ggataacctcggtggcgatcagcgcaa

SEQ ID NO: 276826 - DNA, 27 bp, Artificial Sequence
  Description of Artificial Sequence: Synthetic oligonucleotide
gataacctcggtggcgatcagcgcaag

SEQ ID NO: 276827 - DNA, 28 bp, Artificial Sequence
  Description of Artificial Sequence: Synthetic oligonucleotide
ataacctcggtggcgatcagcgcaagac

SEQ ID NO: 276828 - DNA, 27 bp, Artificial Sequence
  Description of Artificial Sequence: Synthetic oligonucleotide
taacctcggtggcgatcagcgcaagac

SEQ ID NO: 276829 - DNA, 26 bp, Artificial Sequence
  Description of Artificial Sequence: Synthetic oligonucleotide
aacctcggtggcgatcagcgcaagac

SEQ ID NO: 276830 - DNA, 25 bp, Artificial Sequence
  Description of Artificial Sequence: Synthetic oligonucleotide
acctcggtggcgatcagcgcaagac

SEQ ID NO: 276831 - DNA, 24 bp, Artificial Sequence
  Description of Artificial Sequence: Synthetic oligonucleotide
cctcggtggcgatcagcgcaagac

SEQ ID NO: 276832 - DNA, 27 bp, Artificial Sequence
  Description of Artificial Sequence: Synthetic oligonucleotide
ctcggtggcgatcagcgcaagaccaaa

SEQ ID NO: 276833 - DNA, 27 bp, Artificial Sequence
  Description of Artificial Sequence: Synthetic oligonucleotide
tcggtggcgatcagcgcaagaccaaac

SEQ ID NO: 276834 - DNA, 27 bp, Artificial Sequence
  Description of Artificial Sequence: Synthetic oligonucleotide
cggtggcgatcagcgcaagaccaaaca

SEQ ID NO: 276835 - DNA, 27 bp, Artificial Sequence
  Description of Artificial Sequence: Synthetic oligonucleotide
ggtggcgatcagcgcaagaccaaacag

SEQ ID NO: 276836 - DNA, 27 bp, Artificial Sequence
  Description of Artificial Sequence: Synthetic oligonucleotide
gtggcgatcagcgcaagaccaaacagg

SEQ ID NO: 276837 - DNA, 29 bp, Artificial Sequence
  Description of Artificial Sequence: Synthetic oligonucleotide
tggcgatcagcgcaagaccaaacaggatg

SEQ ID NO: 276838 - DNA, 28 bp, Artificial Sequence
  Description of Artificial Sequence: Synthetic oligonucleotide
ggcgatcagcgcaagaccaaacaggatg

SEQ ID NO: 276839 - DNA, 29 bp, Artificial Sequence
  Description of Artificial Sequence: Synthetic oligonucleotide
gcgatcagcgcaagaccaaacaggatgag

SEQ ID NO: 276840 - DNA, 31 bp, Artificial Sequence
  Description of Artificial Sequence: Synthetic oligonucleotide
cgatcagcgcaagaccaaacaggatgagatg

SEQ ID NO: 276841 - DNA, 31 bp, Artificial Sequence
  Description of Artificial Sequence: Synthetic oligonucleotide
gatcagcgcaagaccaaacaggatgagatgg

SEQ ID NO: 276842 - DNA, 32 bp, Artificial Sequence
  Description of Artificial Sequence: Synthetic oligonucleotide
atcagcgcaagaccaaacaggatgagatggac

SEQ ID NO: 276843 - DNA, 31 bp, Artificial Sequence
  Description of Artificial Sequence: Synthetic oligonucleotide
tcagcgcaagaccaaacaggatgagatggac

SEQ ID NO: 276844 - DNA, 30 bp, Artificial Sequence
  Description of Artificial Sequence: Synthetic oligonucleotide
cagcgcaagaccaaacaggatgagatggac

SEQ ID NO: 276845 - DNA, 30 bp, Artificial Sequence
  Description of Artificial Sequence: Synthetic oligonucleotide
agcgcaagaccaaacaggatgagatggacg

SEQ ID NO: 276846 - DNA, 29 bp, Artificial Sequence
  Description of Artificial Sequence: Synthetic oligonucleotide
gcgcaagaccaaacaggatgagatggacg

SEQ ID NO: 276847 - DNA, 30 bp, Artificial Sequence
  Description of Artificial Sequence: Synthetic oligonucleotide
cgcaagaccaaacaggatgagatggacgac

SEQ ID NO: 276848 - DNA, 32 bp, Artificial Sequence
  Description of Artificial Sequence: Synthetic oligonucleotide
gcaagaccaaacaggatgagatggacgacaac

SEQ ID NO: 276849 - DNA, 32 bp, Artificial Sequence
  Description of Artificial Sequence: Synthetic oligonucleotide
caagaccaaacaggatgagatggacgacaacc

SEQ ID NO: 276850 - DNA, 32 bp, Artificial Sequence
  Description of Artificial Sequence: Synthetic oligonucleotide
aagaccaaacaggatgagatggacgacaaccc

SEQ ID NO: 276851 - DNA, 31 bp, Artificial Sequence
  Description of Artificial Sequence: Synthetic oligonucleotide
agaccaaacaggatgagatggacgacaaccc

SEQ ID NO: 276852 - DNA, 30 bp, Artificial Sequence
  Description of Artificial Sequence: Synthetic oligonucleotide
gaccaaacaggatgagatggacgacaaccc

SEQ ID NO: 276853 - DNA, 30 bp, Artificial Sequence
  Description of Artificial Sequence: Synthetic oligonucleotide
accaaacaggatgagatggacgacaacccc

SEQ ID NO: 276854 - DNA, 29 bp, Artificial Sequence
  Description of Artificial Sequence: Synthetic oligonucleotide
ccaaacaggatgagatggacgacaacccc

SEQ ID NO: 276855 - DNA, 31 bp, Artificial Sequence
  Description of Artificial Sequence: Synthetic oligonucleotide
caaacaggatgagatggacgacaaccccatc

SEQ ID NO: 276856 - DNA, 31 bp, Artificial Sequence
  Description of Artificial Sequence: Synthetic oligonucleotide
aaacaggatgagatggacgacaaccccatcc

SEQ ID NO: 276857 - DNA, 30 bp, Artificial Sequence
  Description of Artificial Sequence: Synthetic oligonucleotide
aacaggatgagatggacgacaaccccatcc

SEQ ID NO: 276858 - DNA, 29 bp, Artificial Sequence
  Description of Artificial Sequence: Synthetic oligonucleotide
acaggatgagatggacgacaaccccatcc

SEQ ID NO: 276859 - DNA, 28 bp, Artificial Sequence
  Description of Artificial Sequence: Synthetic oligonucleotide
caggatgagatggacgacaaccccatcc

SEQ ID NO: 276860 - DNA, 28 bp, Artificial Sequence
  Description of Artificial Sequence: Synthetic oligonucleotide
aggatgagatggacgacaaccccatccg

SEQ ID NO: 276861 - DNA, 27 bp, Artificial Sequence
  Description of Artificial Sequence: Synthetic oligonucleotide
ggatgagatggacgacaaccccatccg

SEQ ID NO: 276862 - DNA, 28 bp, Artificial Sequence
  Description of Artificial Sequence: Synthetic oligonucleotide
gatgagatggacgacaaccccatccgac

SEQ ID NO: 276863 - DNA, 28 bp, Artificial Sequence
  Description of Artificial Sequence: Synthetic oligonucleotide
atgagatggacgacaaccccatccgacc

SEQ ID NO: 276864 - DNA, 27 bp, Artificial Sequence
  Description of Artificial Sequence: Synthetic oligonucleotide
tgagatggacgacaaccccatccgacc

SEQ ID NO: 276865 - DNA, 27 bp, Artificial Sequence
  Description of Artificial Sequence: Synthetic oligonucleotide
gagatggacgacaaccccatccgacct

SEQ ID NO: 276866 - DNA, 27 bp, Artificial Sequence
  Description of Artificial Sequence: Synthetic oligonucleotide
agatggacgacaaccccatccgacctc

SEQ ID NO: 276867 - DNA, 27 bp, Artificial Sequence
  Description of Artificial Sequence: Synthetic oligonucleotide
gatggacgacaaccccatccgacctct

SEQ ID NO: 276868 - DNA, 27 bp, Artificial Sequence
  Description of Artificial Sequence: Synthetic oligonucleotide
atggacgacaaccccatccgacctctg

SEQ ID NO: 276869 - DNA, 26 bp, Artificial Sequence
  Description of Artificial Sequence: Synthetic oligonucleotide
tggacgacaaccccatccgacctctg

SEQ ID NO: 276870 - DNA, 25 bp, Artificial Sequence
  Description of Artificial Sequence: Synthetic oligonucleotide
ggacgacaaccccatccgacctctg

SEQ ID NO: 276871 - DNA, 27 bp, Artificial Sequence
  Description of Artificial Sequence: Synthetic oligonucleotide
gacgacaaccccatccgacctctggat

SEQ ID NO: 276872 - DNA, 27 bp, Artificial Sequence
  Description of Artificial Sequence: Synthetic oligonucleotide
acgacaaccccatccgacctctggatg

SEQ ID NO: 276873 - DNA, 27 bp, Artificial Sequence
  Description of Artificial Sequence: Synthetic oligonucleotide
cgacaaccccatccgacctctggatgt

SEQ ID NO: 276874 - DNA, 27 bp, Artificial Sequence
  Description of Artificial Sequence: Synthetic oligonucleotide
gacaaccccatccgacctctggatgtg

SEQ ID NO: 276875 - DNA, 27 bp, Artificial Sequence
  Description of Artificial Sequence: Synthetic oligonucleotide
acaaccccatccgacctctggatgtgg

SEQ ID NO: 276876 - DNA, 26 bp, Artificial Sequence
  Description of Artificial Sequence: Synthetic oligonucleotide
caaccccatccgacctctggatgtgg

SEQ ID NO: 276877 - DNA, 26 bp, Artificial Sequence
  Description of Artificial Sequence: Synthetic oligonucleotide
aaccccatccgacctctggatgtggg

SEQ ID NO: 276878 - DNA, 25 bp, Artificial Sequence
  Description of Artificial Sequence: Synthetic oligonucleotide
accccatccgacctctggatgtggg

SEQ ID NO: 276879 - DNA, 24 bp, Artificial Sequence
  Description of Artificial Sequence: Synthetic oligonucleotide
ccccatccgacctctggatgtggg

SEQ ID NO: 276880 - DNA, 24 bp, Artificial Sequence
  Description of Artificial Sequence: Synthetic oligonucleotide
cccatccgacctctggatgtgggg

SEQ ID NO: 276881 - DNA, 27 bp, Artificial Sequence
  Description of Artificial Sequence: Synthetic oligonucleotide
ccatccgacctctggatgtgggggata

SEQ ID NO: 276882 - DNA, 29 bp, Artificial Sequence
  Description of Artificial Sequence: Synthetic oligonucleotide
catccgacctctggatgtgggggatatag

SEQ ID NO: 276883 - DNA, 29 bp, Artificial Sequence
  Description of Artificial Sequence: Synthetic oligonucleotide
atccgacctctggatgtgggggatatagc

SEQ ID NO: 276884 - DNA, 28 bp, Artificial Sequence
  Description of Artificial Sequence: Synthetic oligonucleotide
tccgacctctggatgtgggggatatagc

SEQ ID NO: 276885 - DNA, 27 bp, Artificial Sequence
  Description of Artificial Sequence: Synthetic oligonucleotide
ccgacctctggatgtgggggatatagc

SEQ ID NO: 276886 - DNA, 27 bp, Artificial Sequence
  Description of Artificial Sequence: Synthetic oligonucleotide
cgacctctggatgtgggggatatagcc

SEQ ID NO: 276887 - DNA, 29 bp, Artificial Sequence
  Description of Artificial Sequence: Synthetic oligonucleotide
gacctctggatgtgggggatatagccttg

SEQ ID NO: 276888 - DNA, 31 bp, Artificial Sequence
  Description of Artificial Sequence: Synthetic oligonucleotide
acctctggatgtgggggatatagccttgttg

SEQ ID NO: 276889 - DNA, 30 bp, Artificial Sequence
  Description of Artificial Sequence: Synthetic oligonucleotide
cctctggatgtgggggatatagccttgttg

SEQ ID NO: 276890 - DNA, 34 bp, Artificial Sequence
  Description of Artificial Sequence: Synthetic oligonucleotide
ctctggatgtgggggatatagccttgttgtaaac

SEQ ID NO: 276891 - DNA, 38 bp, Artificial Sequence
  Description of Artificial Sequence: Synthetic oligonucleotide
tctggatgtgggggatatagccttgttgtaaacttatg

SEQ ID NO: 276892 - DNA, 37 bp, Artificial Sequence
  Description of Artificial Sequence: Synthetic oligonucleotide
ctggatgtgggggatatagccttgttgtaaacttatg

SEQ ID NO: 276893 - DNA, 37 bp, Artificial Sequence
  Description of Artificial Sequence: Synthetic oligonucleotide
tggatgtgggggatatagccttgttgtaaacttatgc

SEQ ID NO: 276894 - DNA, 36 bp, Artificial Sequence
  Description of Artificial Sequence: Synthetic oligonucleotide
ggatgtgggggatatagccttgttgtaaacttatgc

SEQ ID NO: 276895 - DNA, 37 bp, Artificial Sequence
  Description of Artificial Sequence: Synthetic oligonucleotide
gatgtgggggatatagccttgttgtaaacttatgctc

SEQ ID NO: 276896 - DNA, 38 bp, Artificial Sequence
  Description of Artificial Sequence: Synthetic oligonucleotide
atgtgggggatatagccttgttgtaaacttatgctcag

SEQ ID NO: 276897 - DNA, 37 bp, Artificial Sequence
  Description of Artificial Sequence: Synthetic oligonucleotide
tgtgggggatatagccttgttgtaaacttatgctcag

SEQ ID NO: 276898 - DNA, 36 bp, Artificial Sequence
  Description of Artificial Sequence: Synthetic oligonucleotide
gtgggggatatagccttgttgtaaacttatgctcag

SEQ ID NO: 276899 - DNA, 37 bp, Artificial Sequence
  Description of Artificial Sequence: Synthetic oligonucleotide
tgggggatatagccttgttgtaaacttatgctcagag

SEQ ID NO: 276900 - DNA, 36 bp, Artificial Sequence
  Description of Artificial Sequence: Synthetic oligonucleotide
gggggatatagccttgttgtaaacttatgctcagag

SEQ ID NO: 276901 - DNA, 36 bp, Artificial Sequence
  Description of Artificial Sequence: Synthetic oligonucleotide
ggggatatagccttgttgtaaacttatgctcagagc

SEQ ID NO: 276902 - DNA, 37 bp, Artificial Sequence
  Description of Artificial Sequence: Synthetic oligonucleotide
gggatatagccttgttgtaaacttatgctcagagcac

SEQ ID NO: 276903 - DNA, 40 bp, Artificial Sequence
  Description of Artificial Sequence: Synthetic oligonucleotide
ggatatagccttgttgtaaacttatgctcagagcacatac

SEQ ID NO: 276904 - DNA, 41 bp, Artificial Sequence
  Description of Artificial Sequence: Synthetic oligonucleotide
gatatagccttgttgtaaacttatgctcagagcacatactc

SEQ ID NO: 276905 - DNA, 43 bp, Artificial Sequence
  Description of Artificial Sequence: Synthetic oligonucleotide
atatagccttgttgtaaacttatgctcagagcacatactctag

SEQ ID NO: 276906 - DNA, 42 bp, Artificial Sequence
  Description of Artificial Sequence: Synthetic oligonucleotide
tatagccttgttgtaaacttatgctcagagcacatactctag

SEQ ID NO: 276907 - DNA, 41 bp, Artificial Sequence
  Description of Artificial Sequence: Synthetic oligonucleotide
atagccttgttgtaaacttatgctcagagcacatactctag

SEQ ID NO: 276908 - DNA, 40 bp, Artificial Sequence
  Description of Artificial Sequence: Synthetic oligonucleotide
tagccttgttgtaaacttatgctcagagcacatactctag

SEQ ID NO: 276909 - DNA, 39 bp, Artificial Sequence
  Description of Artificial Sequence: Synthetic oligonucleotide
agccttgttgtaaacttatgctcagagcacatactctag

SEQ ID NO: 276910 - DNA, 38 bp, Artificial Sequence
  Description of Artificial Sequence: Synthetic oligonucleotide
gccttgttgtaaacttatgctcagagcacatactctag

SEQ ID NO: 276911 - DNA, 38 bp, Artificial Sequence
  Description of Artificial Sequence: Synthetic oligonucleotide
ccttgttgtaaacttatgctcagagcacatactctagg

SEQ ID NO: 276912 - DNA, 38 bp, Artificial Sequence
  Description of Artificial Sequence: Synthetic oligonucleotide
cttgttgtaaacttatgctcagagcacatactctaggg

SEQ ID NO: 276913 - DNA, 39 bp, Artificial Sequence
  Description of Artificial Sequence: Synthetic oligonucleotide
ttgttgtaaacttatgctcagagcacatactctagggag

SEQ ID NO: 276914 - DNA, 38 bp, Artificial Sequence
  Description of Artificial Sequence: Synthetic oligonucleotide
tgttgtaaacttatgctcagagcacatactctagggag

SEQ ID NO: 276915 - DNA, 37 bp, Artificial Sequence
  Description of Artificial Sequence: Synthetic oligonucleotide
gttgtaaacttatgctcagagcacatactctagggag

SEQ ID NO: 276916 - DNA, 39 bp, Artificial Sequence
  Description of Artificial Sequence: Synthetic oligonucleotide
ttgtaaacttatgctcagagcacatactctagggagatc

SEQ ID NO: 276917 - DNA, 38 bp, Artificial Sequence
  Description of Artificial Sequence: Synthetic oligonucleotide
tgtaaacttatgctcagagcacatactctagggagatc

SEQ ID NO: 276918 - DNA, 37 bp, Artificial Sequence
  Description of Artificial Sequence: Synthetic oligonucleotide
gtaaacttatgctcagagcacatactctagggagatc

SEQ ID NO: 276919 - DNA, 39 bp, Artificial Sequence
  Description of Artificial Sequence: Synthetic oligonucleotide
taaacttatgctcagagcacatactctagggagatcaag

SEQ ID NO: 276920 - DNA, 38 bp, Artificial Sequence
  Description of Artificial Sequence: Synthetic oligonucleotide
aaacttatgctcagagcacatactctagggagatcaag

SEQ ID NO: 276921 - DNA, 37 bp, Artificial Sequence
  Description of Artificial Sequence: Synthetic oligonucleotide
aacttatgctcagagcacatactctagggagatcaag

SEQ ID NO: 276922 - DNA, 36 bp, Artificial Sequence
  Description of Artificial Sequence: Synthetic oligonucleotide
acttatgctcagagcacatactctagggagatcaag

SEQ ID NO: 276923 - DNA, 35 bp, Artificial Sequence
  Description of Artificial Sequence: Synthetic oligonucleotide
cttatgctcagagcacatactctagggagatcaag

SEQ ID NO: 276924 - DNA, 35 bp, Artificial Sequence
  Description of Artificial Sequence: Synthetic oligonucleotide
ttatgctcagagcacatactctagggagatcaagc

SEQ ID NO: 276925 - DNA, 34 bp, Artificial Sequence
  Description of Artificial Sequence: Synthetic oligonucleotide
tatgctcagagcacatactctagggagatcaagc

SEQ ID NO: 276926 - DNA, 33 bp, Artificial Sequence
  Description of Artificial Sequence: Synthetic oligonucleotide
atgctcagagcacatactctagggagatcaagc

SEQ ID NO: 276927 - DNA, 32 bp, Artificial Sequence
  Description of Artificial Sequence: Synthetic oligonucleotide
tgctcagagcacatactctagggagatcaagc

SEQ ID NO: 276928 - DNA, 31 bp, Artificial Sequence
  Description of Artificial Sequence: Synthetic oligonucleotide
gctcagagcacatactctagggagatcaagc

SEQ ID NO: 276929 - DNA, 33 bp, Artificial Sequence
  Description of Artificial Sequence: Synthetic oligonucleotide
ctcagagcacatactctagggagatcaagctag

SEQ ID NO: 276930 - DNA, 35 bp, Artificial Sequence
  Description of Artificial Sequence: Synthetic oligonucleotide
tcagagcacatactctagggagatcaagctagttg

SEQ ID NO: 276931 - DNA, 34 bp, Artificial Sequence
  Description of Artificial Sequence: Synthetic oligonucleotide
cagagcacatactctagggagatcaagctagttg

SEQ ID NO: 276932 - DNA, 36 bp, Artificial Sequence
  Description of Artificial Sequence: Synthetic oligonucleotide
agagcacatactctagggagatcaagctagttgaag

SEQ ID NO: 276933 - DNA, 35 bp, Artificial Sequence
  Description of Artificial Sequence: Synthetic oligonucleotide
gagcacatactctagggagatcaagctagttgaag

SEQ ID NO: 276934 - DNA, 37 bp, Artificial Sequence
  Description of Artificial Sequence: Synthetic oligonucleotide
agcacatactctagggagatcaagctagttgaagaag

SEQ ID NO: 276935 - DNA, 36 bp, Artificial Sequence
  Description of Artificial Sequence: Synthetic oligonucleotide
gcacatactctagggagatcaagctagttgaagaag

SEQ ID NO: 276936 - DNA, 37 bp, Artificial Sequence
  Description of Artificial Sequence: Synthetic oligonucleotide
cacatactctagggagatcaagctagttgaagaagac

SEQ ID NO: 276937 - DNA, 40 bp, Artificial Sequence
  Description of Artificial Sequence: Synthetic oligonucleotide
acatactctagggagatcaagctagttgaagaagacattc

SEQ ID NO: 276938 - DNA, 39 bp, Artificial Sequence
  Description of Artificial Sequence: Synthetic oligonucleotide
catactctagggagatcaagctagttgaagaagacattc

SEQ ID NO: 276939 - DNA, 40 bp, Artificial Sequence
  Description of Artificial Sequence: Synthetic oligonucleotide
atactctagggagatcaagctagttgaagaagacattcag

SEQ ID NO: 276940 - DNA, 39 bp, Artificial Sequence
  Description of Artificial Sequence: Synthetic oligonucleotide
tactctagggagatcaagctagttgaagaagacattcag

SEQ ID NO: 276941 - DNA, 38 bp, Artificial Sequence
  Description of Artificial Sequence: Synthetic oligonucleotide
actctagggagatcaagctagttgaagaagacattcag

SEQ ID NO: 276942 - DNA, 37 bp, Artificial Sequence
  Description of Artificial Sequence: Synthetic oligonucleotide
ctctagggagatcaagctagttgaagaagacattcag

SEQ ID NO: 276943 - DNA, 37 bp, Artificial Sequence
  Description of Artificial Sequence: Synthetic oligonucleotide
tctagggagatcaagctagttgaagaagacattcagg

SEQ ID NO: 276944 - DNA, 36 bp, Artificial Sequence
  Description of Artificial Sequence: Synthetic oligonucleotide
ctagggagatcaagctagttgaagaagacattcagg

SEQ ID NO: 276945 - DNA, 38 bp, Artificial Sequence
  Description of Artificial Sequence: Synthetic oligonucleotide
tagggagatcaagctagttgaagaagacattcaggaac

SEQ ID NO: 276946 - DNA, 37 bp, Artificial Sequence
  Description of Artificial Sequence: Synthetic oligonucleotide
agggagatcaagctagttgaagaagacattcaggaac

SEQ ID NO: 276947 - DNA, 36 bp, Artificial Sequence
  Description of Artificial Sequence: Synthetic oligonucleotide
gggagatcaagctagttgaagaagacattcaggaac

SEQ ID NO: 276948 - DNA, 38 bp, Artificial Sequence
  Description of Artificial Sequence: Synthetic oligonucleotide
ggagatcaagctagttgaagaagacattcaggaacttc

SEQ ID NO: 276949 - DNA, 39 bp, Artificial Sequence
  Description of Artificial Sequence: Synthetic oligonucleotide
gagatcaagctagttgaagaagacattcaggaacttctc

SEQ ID NO: 276950 - DNA, 41 bp, Artificial Sequence
  Description of Artificial Sequence: Synthetic oligonucleotide
agatcaagctagttgaagaagacattcaggaacttctcatg

SEQ ID NO: 276951 - DNA, 40 bp, Artificial Sequence
  Description of Artificial Sequence: Synthetic oligonucleotide
gatcaagctagttgaagaagacattcaggaacttctcatg

SEQ ID NO: 276952 - DNA, 49 bp, Artificial Sequence
  Description of Artificial Sequence: Synthetic oligonucleotide
atcaagctagttgaagaagacattcaggaacttctcatgaaaattaaag

SEQ ID NO: 276953 - DNA, 48 bp, Artificial Sequence
  Description of Artificial Sequence: Synthetic oligonucleotide
tcaagctagttgaagaagacattcaggaacttctcatgaaaattaaag

SEQ ID NO: 276954 - DNA, 47 bp, Artificial Sequence
  Description of Artificial Sequence: Synthetic oligonucleotide
caagctagttgaagaagacattcaggaacttctcatgaaaattaaag

SEQ ID NO: 276955 - DNA, 48 bp, Artificial Sequence
  Description of Artificial Sequence: Synthetic oligonucleotide
aagctagttgaagaagacattcaggaacttctcatgaaaattaaagag

SEQ ID NO: 276956 - DNA, 47 bp, Artificial Sequence
  Description of Artificial Sequence: Synthetic oligonucleotide
agctagttgaagaagacattcaggaacttctcatgaaaattaaagag

SEQ ID NO: 276957 - DNA, 46 bp, Artificial Sequence
  Description of Artificial Sequence: Synthetic oligonucleotide
gctagttgaagaagacattcaggaacttctcatgaaaattaaagag

SEQ ID NO: 276958 - DNA, 46 bp, Artificial Sequence
  Description of Artificial Sequence: Synthetic oligonucleotide
ctagttgaagaagacattcaggaacttctcatgaaaattaaagagc

SEQ ID NO: 276959 - DNA, 47 bp, Artificial Sequence
  Description of Artificial Sequence: Synthetic oligonucleotide
tagttgaagaagacattcaggaacttctcatgaaaattaaagagctc

SEQ ID NO: 276960 - DNA, 46 bp, Artificial Sequence
  Description of Artificial Sequence: Synthetic oligonucleotide
agttgaagaagacattcaggaacttctcatgaaaattaaagagctc

SEQ ID NO: 276961 - DNA, 45 bp, Artificial Sequence
  Description of Artificial Sequence: Synthetic oligonucleotide
gttgaagaagacattcaggaacttctcatgaaaattaaagagctc

SEQ ID NO: 276962 - DNA, 46 bp, Artificial Sequence
  Description of Artificial Sequence: Synthetic oligonucleotide
ttgaagaagacattcaggaacttctcatgaaaattaaagagctcac

SEQ ID NO: 276963 - DNA, 45 bp, Artificial Sequence
  Description of Artificial Sequence: Synthetic oligonucleotide
tgaagaagacattcaggaacttctcatgaaaattaaagagctcac

SEQ ID NO: 276964 - DNA, 44 bp, Artificial Sequence
  Description of Artificial Sequence: Synthetic oligonucleotide
gaagaagacattcaggaacttctcatgaaaattaaagagctcac

SEQ ID NO: 276965 - DNA, 45 bp, Artificial Sequence
  Description of Artificial Sequence: Synthetic oligonucleotide
aagaagacattcaggaacttctcatgaaaattaaagagctcactc

SEQ ID NO: 276966 - DNA, 44 bp, Artificial Sequence
  Description of Artificial Sequence: Synthetic oligonucleotide
agaagacattcaggaacttctcatgaaaattaaagagctcactc

SEQ ID NO: 276967 - DNA, 43 bp, Artificial Sequence
  Description of Artificial Sequence: Synthetic oligonucleotide
gaagacattcaggaacttctcatgaaaattaaagagctcactc

SEQ ID NO: 276968 - DNA, 43 bp, Artificial Sequence
  Description of Artificial Sequence: Synthetic oligonucleotide
aagacattcaggaacttctcatgaaaattaaagagctcactcg

SEQ ID NO: 276969 - DNA, 42 bp, Artificial Sequence
  Description of Artificial Sequence: Synthetic oligonucleotide
agacattcaggaacttctcatgaaaattaaagagctcactcg

SEQ ID NO: 276970 - DNA, 41 bp, Artificial Sequence
  Description of Artificial Sequence: Synthetic oligonucleotide
gacattcaggaacttctcatgaaaattaaagagctcactcg

SEQ ID NO: 276971 - DNA, 48 bp, Artificial Sequence
  Description of Artificial Sequence: Synthetic oligonucleotide
acattcaggaacttctcatgaaaattaaagagctcactcgtattaaag

SEQ ID NO: 276972 - DNA, 47 bp, Artificial Sequence
  Description of Artificial Sequence: Synthetic oligonucleotide
cattcaggaacttctcatgaaaattaaagagctcactcgtattaaag

SEQ ID NO: 276973 - DNA, 50 bp, Artificial Sequence
  Description of Artificial Sequence: Synthetic oligonucleotide
attcaggaacttctcatgaaaattaaagagctcactcgtattaaagtatc

SEQ ID NO: 276974 - DNA, 49 bp, Artificial Sequence
  Description of Artificial Sequence: Synthetic oligonucleotide
ttcaggaacttctcatgaaaattaaagagctcactcgtattaaagtatc

SEQ ID NO: 276975 - DNA, 48 bp, Artificial Sequence
  Description of Artificial Sequence: Synthetic oligonucleotide
tcaggaacttctcatgaaaattaaagagctcactcgtattaaagtatc

SEQ ID NO: 276976 - DNA, 47 bp, Artificial Sequence
  Description of Artificial Sequence: Synthetic oligonucleotide
caggaacttctcatgaaaattaaagagctcactcgtattaaagtatc

SEQ ID NO: 276977 - DNA, 48 bp, Artificial Sequence
  Description of Artificial Sequence: Synthetic oligonucleotide
aggaacttctcatgaaaattaaagagctcactcgtattaaagtatctg

SEQ ID NO: 276978 - DNA, 47 bp, Artificial Sequence
  Description of Artificial Sequence: Synthetic oligonucleotide
ggaacttctcatgaaaattaaagagctcactcgtattaaagtatctg

SEQ ID NO: 276979 - DNA, 48 bp, Artificial Sequence
  Description of Artificial Sequence: Synthetic oligonucleotide
gaacttctcatgaaaattaaagagctcactcgtattaaagtatctgac

SEQ ID NO: 276980 - DNA, 49 bp, Artificial Sequence
  Description of Artificial Sequence: Synthetic oligonucleotide
aacttctcatgaaaattaaagagctcactcgtattaaagtatctgacac

SEQ ID NO: 276981 - DNA, 48 bp, Artificial Sequence
  Description of Artificial Sequence: Synthetic oligonucleotide
acttctcatgaaaattaaagagctcactcgtattaaagtatctgacac

SEQ ID NO: 276982 - DNA, 47 bp, Artificial Sequence
  Description of Artificial Sequence: Synthetic oligonucleotide
cttctcatgaaaattaaagagctcactcgtattaaagtatctgacac

SEQ ID NO: 276983 - DNA, 48 bp, Artificial Sequence
  Description of Artificial Sequence: Synthetic oligonucleotide
ttctcatgaaaattaaagagctcactcgtattaaagtatctgacacag

SEQ ID NO: 276984 - DNA, 47 bp, Artificial Sequence
  Description of Artificial Sequence: Synthetic oligonucleotide
tctcatgaaaattaaagagctcactcgtattaaagtatctgacacag

SEQ ID NO: 276985 - DNA, 46 bp, Artificial Sequence
  Description of Artificial Sequence: Synthetic oligonucleotide
ctcatgaaaattaaagagctcactcgtattaaagtatctgacacag

SEQ ID NO: 276986 - DNA, 46 bp, Artificial Sequence
  Description of Artificial Sequence: Synthetic oligonucleotide
tcatgaaaattaaagagctcactcgtattaaagtatctgacacagg

SEQ ID NO: 276987 - DNA, 45 bp, Artificial Sequence
  Description of Artificial Sequence: Synthetic oligonucleotide
catgaaaattaaagagctcactcgtattaaagtatctgacacagg

SEQ ID NO: 276988 - DNA, 45 bp, Artificial Sequence
  Description of Artificial Sequence: Synthetic oligonucleotide
atgaaaattaaagagctcactcgtattaaagtatctgacacaggc

SEQ ID NO: 276989 - DNA, 44 bp, Artificial Sequence
  Description of Artificial Sequence: Synthetic oligonucleotide
tgaaaattaaagagctcactcgtattaaagtatctgacacaggc

SEQ ID NO: 276990 - DNA, 43 bp, Artificial Sequence
  Description of Artificial Sequence: Synthetic oligonucleotide
gaaaattaaagagctcactcgtattaaagtatctgacacaggc

SEQ ID NO: 276991 - DNA, 43 bp, Artificial Sequence
  Description of Artificial Sequence: Synthetic oligonucleotide
aaaattaaagagctcactcgtattaaagtatctgacacaggcc

SEQ ID NO: 276992 - DNA, 42 bp, Artificial Sequence
  Description of Artificial Sequence: Synthetic oligonucleotide
aaattaaagagctcactcgtattaaagtatctgacacaggcc

SEQ ID NO: 276993 - DNA, 41 bp, Artificial Sequence
  Description of Artificial Sequence: Synthetic oligonucleotide
aattaaagagctcactcgtattaaagtatctgacacaggcc

SEQ ID NO: 276994 - DNA, 40 bp, Artificial Sequence
  Description of Artificial Sequence: Synthetic oligonucleotide
attaaagagctcactcgtattaaagtatctgacacaggcc

SEQ ID NO: 276995 - DNA, 39 bp, Artificial Sequence
  Description of Artificial Sequence: Synthetic oligonucleotide
ttaaagagctcactcgtattaaagtatctgacacaggcc

SEQ ID NO: 276996 - DNA, 38 bp, Artificial Sequence
  Description of Artificial Sequence: Synthetic oligonucleotide
taaagagctcactcgtattaaagtatctgacacaggcc

SEQ ID NO: 276997 - DNA, 37 bp, Artificial Sequence
  Description of Artificial Sequence: Synthetic oligonucleotide
aaagagctcactcgtattaaagtatctgacacaggcc

SEQ ID NO: 276998 - DNA, 36 bp, Artificial Sequence
  Description of Artificial Sequence: Synthetic oligonucleotide
aagagctcactcgtattaaagtatctgacacaggcc

SEQ ID NO: 276999 - DNA, 35 bp, Artificial Sequence
  Description of Artificial Sequence: Synthetic oligonucleotide
agagctcactcgtattaaagtatctgacacaggcc

SEQ ID NO: 277000 - DNA, 34 bp, Artificial Sequence
  Description of Artificial Sequence: Synthetic oligonucleotide
gagctcactcgtattaaagtatctgacacaggcc

SEQ ID NO: 277001 - DNA, 35 bp, Artificial Sequence
  Description of Artificial Sequence: Synthetic oligonucleotide
agctcactcgtattaaagtatctgacacaggcctg

SEQ ID NO: 277002 - DNA, 34 bp, Artificial Sequence
  Description of Artificial Sequence: Synthetic oligonucleotide
gctcactcgtattaaagtatctgacacaggcctg

SEQ ID NO: 277003 - DNA, 34 bp, Artificial Sequence
  Description of Artificial Sequence: Synthetic oligonucleotide
ctcactcgtattaaagtatctgacacaggcctgg

SEQ ID NO: 277004 - DNA, 34 bp, Artificial Sequence
  Description of Artificial Sequence: Synthetic oligonucleotide
tcactcgtattaaagtatctgacacaggcctggc

SEQ ID NO: 277005 - DNA, 33 bp, Artificial Sequence
  Description of Artificial Sequence: Synthetic oligonucleotide
cactcgtattaaagtatctgacacaggcctggc

SEQ ID NO: 277006 - DNA, 33 bp, Artificial Sequence
  Description of Artificial Sequence: Synthetic oligonucleotide
actcgtattaaagtatctgacacaggcctggcc

SEQ ID NO: 277007 - DNA, 32 bp, Artificial Sequence
  Description of Artificial Sequence: Synthetic oligonucleotide
ctcgtattaaagtatctgacacaggcctggcc

SEQ ID NO: 277008 - DNA, 32 bp, Artificial Sequence
  Description of Artificial Sequence: Synthetic oligonucleotide
tcgtattaaagtatctgacacaggcctggccg

SEQ ID NO: 277009 - DNA, 31 bp, Artificial Sequence
  Description of Artificial Sequence: Synthetic oligonucleotide
cgtattaaagtatctgacacaggcctggccg

SEQ ID NO: 277010 - DNA, 31 bp, Artificial Sequence
  Description of Artificial Sequence: Synthetic oligonucleotide
gtattaaagtatctgacacaggcctggccgc

SEQ ID NO: 277011 - DNA, 32 bp, Artificial Sequence
  Description of Artificial Sequence: Synthetic oligonucleotide
tattaaagtatctgacacaggcctggccgcac

SEQ ID NO: 277012 - DNA, 31 bp, Artificial Sequence
  Description of Artificial Sequence: Synthetic oligonucleotide
attaaagtatctgacacaggcctggccgcac

SEQ ID NO: 277013 - DNA, 30 bp, Artificial Sequence
  Description of Artificial Sequence: Synthetic oligonucleotide
ttaaagtatctgacacaggcctggccgcac

SEQ ID NO: 277014 - DNA, 29 bp, Artificial Sequence
  Description of Artificial Sequence: Synthetic oligonucleotide
taaagtatctgacacaggcctggccgcac

SEQ ID NO: 277015 - DNA, 28 bp, Artificial Sequence
  Description of Artificial Sequence: Synthetic oligonucleotide
aaagtatctgacacaggcctggccgcac

SEQ ID NO: 277016 - DNA, 27 bp, Artificial Sequence
  Description of Artificial Sequence: Synthetic oligonucleotide
aagtatctgacacaggcctggccgcac

SEQ ID NO: 277017 - DNA, 26 bp, Artificial Sequence
  Description of Artificial Sequence: Synthetic oligonucleotide
agtatctgacacaggcctggccgcac

SEQ ID NO: 277018 - DNA, 25 bp, Artificial Sequence
  Description of Artificial Sequence: Synthetic oligonucleotide
gtatctgacacaggcctggccgcac

SEQ ID NO: 277019 - DNA, 26 bp, Artificial Sequence
  Description of Artificial Sequence: Synthetic oligonucleotide
tatctgacacaggcctggccgcacca

SEQ ID NO: 277020 - DNA, 25 bp, Artificial Sequence
  Description of Artificial Sequence: Synthetic oligonucleotide
atctgacacaggcctggccgcacca

SEQ ID NO: 277021 - DNA, 24 bp, Artificial Sequence
  Description of Artificial Sequence: Synthetic oligonucleotide
tctgacacaggcctggccgcacca

SEQ ID NO: 277022 - DNA, 23 bp, Artificial Sequence
  Description of Artificial Sequence: Synthetic oligonucleotide
ctgacacaggcctggccgcacca

SEQ ID NO: 277023 - DNA, 23 bp, Artificial Sequence
  Description of Artificial Sequence: Synthetic oligonucleotide
tgacacaggcctggccgcaccag

SEQ ID NO: 277024 - DNA, 22 bp, Artificial Sequence
  Description of Artificial Sequence: Synthetic oligonucleotide
gacacaggcctggccgcaccag

SEQ ID NO: 277025 - DNA, 23 bp, Artificial Sequence
  Description of Artificial Sequence: Synthetic oligonucleotide
acacaggcctggccgcaccagca

SEQ ID NO: 277026 - DNA, 22 bp, Artificial Sequence
  Description of Artificial Sequence: Synthetic oligonucleotide
cacaggcctggccgcaccagca

SEQ ID NO: 277027 - DNA, 23 bp, Artificial Sequence
  Description of Artificial Sequence: Synthetic oligonucleotide
acaggcctggccgcaccagcaca

SEQ ID NO: 277028 - DNA, 22 bp, Artificial Sequence
  Description of Artificial Sequence: Synthetic oligonucleotide
caggcctggccgcaccagcaca

SEQ ID NO: 277029 - DNA, 23 bp, Artificial Sequence
  Description of Artificial Sequence: Synthetic oligonucleotide
aggcctggccgcaccagcacact

SEQ ID NO: 277030 - DNA, 22 bp, Artificial Sequence
  Description of Artificial Sequence: Synthetic oligonucleotide
ggcctggccgcaccagcacact

SEQ ID NO: 277031 - DNA, 22 bp, Artificial Sequence
  Description of Artificial Sequence: Synthetic oligonucleotide
gcctggccgcaccagcacactg

SEQ ID NO: 277032 - DNA, 22 bp, Artificial Sequence
  Description of Artificial Sequence: Synthetic oligonucleotide
cctggccgcaccagcacactgg

SEQ ID NO: 277033 - DNA, 26 bp, Artificial Sequence
  Description of Artificial Sequence: Synthetic oligonucleotide
ctggccgcaccagcacactgggattt

SEQ ID NO: 277034 - DNA, 26 bp, Artificial Sequence
  Description of Artificial Sequence: Synthetic oligonucleotide
tggccgcaccagcacactgggatttc

SEQ ID NO: 277035 - DNA, 25 bp, Artificial Sequence
  Description of Artificial Sequence: Synthetic oligonucleotide
ggccgcaccagcacactgggatttc

SEQ ID NO: 277036 - DNA, 25 bp, Artificial Sequence
  Description of Artificial Sequence: Synthetic oligonucleotide
gccgcaccagcacactgggatttcg

SEQ ID NO: 277037 - DNA, 26 bp, Artificial Sequence
  Description of Artificial Sequence: Synthetic oligonucleotide
ccgcaccagcacactgggatttcgct

SEQ ID NO: 277038 - DNA, 26 bp, Artificial Sequence
  Description of Artificial Sequence: Synthetic oligonucleotide
cgcaccagcacactgggatttcgctg

SEQ ID NO: 277039 - DNA, 27 bp, Artificial Sequence
  Description of Artificial Sequence: Synthetic oligonucleotide
gcaccagcacactgggatttcgctgca

SEQ ID NO: 277040 - DNA, 27 bp, Artificial Sequence
  Description of Artificial Sequence: Synthetic oligonucleotide
caccagcacactgggatttcgctgcag

SEQ ID NO: 277041 - DNA, 31 bp, Artificial Sequence
  Description of Artificial Sequence: Synthetic oligonucleotide
accagcacactgggatttcgctgcagattag

SEQ ID NO: 277042 - DNA, 30 bp, Artificial Sequence
  Description of Artificial Sequence: Synthetic oligonucleotide
ccagcacactgggatttcgctgcagattag

SEQ ID NO: 277043 - DNA, 30 bp, Artificial Sequence
  Description of Artificial Sequence: Synthetic oligonucleotide
cagcacactgggatttcgctgcagattagc

SEQ ID NO: 277044 - DNA, 31 bp, Artificial Sequence
  Description of Artificial Sequence: Synthetic oligonucleotide
agcacactgggatttcgctgcagattagcag

SEQ ID NO: 277045 - DNA, 30 bp, Artificial Sequence
  Description of Artificial Sequence: Synthetic oligonucleotide
gcacactgggatttcgctgcagattagcag

SEQ ID NO: 277046 - DNA, 31 bp, Artificial Sequence
  Description of Artificial Sequence: Synthetic oligonucleotide
cacactgggatttcgctgcagattagcagac

SEQ ID NO: 277047 - DNA, 32 bp, Artificial Sequence
  Description of Artificial Sequence: Synthetic oligonucleotide
acactgggatttcgctgcagattagcagacac

SEQ ID NO: 277048 - DNA, 31 bp, Artificial Sequence
  Description of Artificial Sequence: Synthetic oligonucleotide
cactgggatttcgctgcagattagcagacac

SEQ ID NO: 277049 - DNA, 32 bp, Artificial Sequence
  Description of Artificial Sequence: Synthetic oligonucleotide
actgggatttcgctgcagattagcagacacac

SEQ ID NO: 277050 - DNA, 31 bp, Artificial Sequence
  Description of Artificial Sequence: Synthetic oligonucleotide
ctgggatttcgctgcagattagcagacacac

SEQ ID NO: 277051 - DNA, 31 bp, Artificial Sequence
  Description of Artificial Sequence: Synthetic oligonucleotide
tgggatttcgctgcagattagcagacacacc

SEQ ID NO: 277052 - DNA, 30 bp, Artificial Sequence
  Description of Artificial Sequence: Synthetic oligonucleotide
gggatttcgctgcagattagcagacacacc

SEQ ID NO: 277053 - DNA, 31 bp, Artificial Sequence
  Description of Artificial Sequence: Synthetic oligonucleotide
ggatttcgctgcagattagcagacacaccag

SEQ ID NO: 277054 - DNA, 32 bp, Artificial Sequence
  Description of Artificial Sequence: Synthetic oligonucleotide
gatttcgctgcagattagcagacacaccagag

SEQ ID NO: 277055 - DNA, 33 bp, Artificial Sequence
  Description of Artificial Sequence: Synthetic oligonucleotide
atttcgctgcagattagcagacacaccagagtg

SEQ ID NO: 277056 - DNA, 32 bp, Artificial Sequence
  Description of Artificial Sequence: Synthetic oligonucleotide
tttcgctgcagattagcagacacaccagagtg

SEQ ID NO: 277057 - DNA, 31 bp, Artificial Sequence
  Description of Artificial Sequence: Synthetic oligonucleotide
ttcgctgcagattagcagacacaccagagtg

SEQ ID NO: 277058 - DNA, 30 bp, Artificial Sequence
  Description of Artificial Sequence: Synthetic oligonucleotide
tcgctgcagattagcagacacaccagagtg

SEQ ID NO: 277059 - DNA, 29 bp, Artificial Sequence
  Description of Artificial Sequence: Synthetic oligonucleotide
cgctgcagattagcagacacaccagagtg

SEQ ID NO: 277060 - DNA, 31 bp, Artificial Sequence
  Description of Artificial Sequence: Synthetic oligonucleotide
gctgcagattagcagacacaccagagtgatc

SEQ ID NO: 277061 - DNA, 32 bp, Artificial Sequence
  Description of Artificial Sequence: Synthetic oligonucleotide
ctgcagattagcagacacaccagagtgatcag

SEQ ID NO: 277062 - DNA, 32 bp, Artificial Sequence
  Description of Artificial Sequence: Synthetic oligonucleotide
tgcagattagcagacacaccagagtgatcagc

SEQ ID NO: 277063 - DNA, 31 bp, Artificial Sequence
  Description of Artificial Sequence: Synthetic oligonucleotide
gcagattagcagacacaccagagtgatcagc

SEQ ID NO: 277064 - DNA, 31 bp, Artificial Sequence
  Description of Artificial Sequence: Synthetic oligonucleotide
cagattagcagacacaccagagtgatcagcc

SEQ ID NO: 277065 - DNA, 35 bp, Artificial Sequence
  Description of Artificial Sequence: Synthetic oligonucleotide
agattagcagacacaccagagtgatcagcctttag

SEQ ID NO: 277066 - DNA, 34 bp, Artificial Sequence
  Description of Artificial Sequence: Synthetic oligonucleotide
gattagcagacacaccagagtgatcagcctttag

SEQ ID NO: 277067 - DNA, 35 bp, Artificial Sequence
  Description of Artificial Sequence: Synthetic oligonucleotide
attagcagacacaccagagtgatcagcctttagag

SEQ ID NO: 277068 - DNA, 34 bp, Artificial Sequence
  Description of Artificial Sequence: Synthetic oligonucleotide
ttagcagacacaccagagtgatcagcctttagag

SEQ ID NO: 277069 - DNA, 33 bp, Artificial Sequence
  Description of Artificial Sequence: Synthetic oligonucleotide
tagcagacacaccagagtgatcagcctttagag

SEQ ID NO: 277070 - DNA, 32 bp, Artificial Sequence
  Description of Artificial Sequence: Synthetic oligonucleotide
agcagacacaccagagtgatcagcctttagag

SEQ ID NO: 277071 - DNA, 31 bp, Artificial Sequence
  Description of Artificial Sequence: Synthetic oligonucleotide
gcagacacaccagagtgatcagcctttagag

SEQ ID NO: 277072 - DNA, 31 bp, Artificial Sequence
  Description of Artificial Sequence: Synthetic oligonucleotide
cagacacaccagagtgatcagcctttagagg

SEQ ID NO: 277073 - DNA, 33 bp, Artificial Sequence
  Description of Artificial Sequence: Synthetic oligonucleotide
agacacaccagagtgatcagcctttagaggttg

SEQ ID NO: 277074 - DNA, 32 bp, Artificial Sequence
  Description of Artificial Sequence: Synthetic oligonucleotide
gacacaccagagtgatcagcctttagaggttg

SEQ ID NO: 277075 - DNA, 32 bp, Artificial Sequence
  Description of Artificial Sequence: Synthetic oligonucleotide
acacaccagagtgatcagcctttagaggttgc

SEQ ID NO: 277076 - DNA, 31 bp, Artificial Sequence
  Description of Artificial Sequence: Synthetic oligonucleotide
cacaccagagtgatcagcctttagaggttgc

SEQ ID NO: 277077 - DNA, 31 bp, Artificial Sequence
  Description of Artificial Sequence: Synthetic oligonucleotide
acaccagagtgatcagcctttagaggttgcc

SEQ ID NO: 277078 - DNA, 30 bp, Artificial Sequence
  Description of Artificial Sequence: Synthetic oligonucleotide
caccagagtgatcagcctttagaggttgcc

SEQ ID NO: 277079 - DNA, 31 bp, Artificial Sequence
  Description of Artificial Sequence: Synthetic oligonucleotide
accagagtgatcagcctttagaggttgccac

SEQ ID NO: 277080 - DNA, 30 bp, Artificial Sequence
  Description of Artificial Sequence: Synthetic oligonucleotide
ccagagtgatcagcctttagaggttgccac

SEQ ID NO: 277081 - DNA, 30 bp, Artificial Sequence
  Description of Artificial Sequence: Synthetic oligonucleotide
cagagtgatcagcctttagaggttgccacg

SEQ ID NO: 277082 - DNA, 31 bp, Artificial Sequence
  Description of Artificial Sequence: Synthetic oligonucleotide
agagtgatcagcctttagaggttgccacgtg

SEQ ID NO: 277083 - DNA, 30 bp, Artificial Sequence
  Description of Artificial Sequence: Synthetic oligonucleotide
gagtgatcagcctttagaggttgccacgtg

SEQ ID NO: 277084 - DNA, 32 bp, Artificial Sequence
  Description of Artificial Sequence: Synthetic oligonucleotide
agtgatcagcctttagaggttgccacgtgtac

SEQ ID NO: 277085 - DNA, 31 bp, Artificial Sequence
  Description of Artificial Sequence: Synthetic oligonucleotide
gtgatcagcctttagaggttgccacgtgtac

SEQ ID NO: 277086 - DNA, 34 bp, Artificial Sequence
  Description of Artificial Sequence: Synthetic oligonucleotide
tgatcagcctttagaggttgccacgtgtacaaac

SEQ ID NO: 277087 - DNA, 33 bp, Artificial Sequence
  Description of Artificial Sequence: Synthetic oligonucleotide
gatcagcctttagaggttgccacgtgtacaaac

SEQ ID NO: 277088 - DNA, 38 bp, Artificial Sequence
  Description of Artificial Sequence: Synthetic oligonucleotide
atcagcctttagaggttgccacgtgtacaaacataatc

SEQ ID NO: 277089 - DNA, 37 bp, Artificial Sequence
  Description of Artificial Sequence: Synthetic oligonucleotide
tcagcctttagaggttgccacgtgtacaaacataatc

SEQ ID NO: 277090 - DNA, 36 bp, Artificial Sequence
  Description of Artificial Sequence: Synthetic oligonucleotide
cagcctttagaggttgccacgtgtacaaacataatc

SEQ ID NO: 277091 - DNA, 39 bp, Artificial Sequence
  Description of Artificial Sequence: Synthetic oligonucleotide
agcctttagaggttgccacgtgtacaaacataatcaatc

SEQ ID NO: 277092 - DNA, 38 bp, Artificial Sequence
  Description of Artificial Sequence: Synthetic oligonucleotide
gcctttagaggttgccacgtgtacaaacataatcaatc

SEQ ID NO: 277093 - DNA, 38 bp, Artificial Sequence
  Description of Artificial Sequence: Synthetic oligonucleotide
cctttagaggttgccacgtgtacaaacataatcaatcc

SEQ ID NO: 277094 - DNA, 39 bp, Artificial Sequence
  Description of Artificial Sequence: Synthetic oligonucleotide
ctttagaggttgccacgtgtacaaacataatcaatcctg

SEQ ID NO: 277095 - DNA, 42 bp, Artificial Sequence
  Description of Artificial Sequence: Synthetic oligonucleotide
tttagaggttgccacgtgtacaaacataatcaatcctgattc

SEQ ID NO: 277096 - DNA, 41 bp, Artificial Sequence
  Description of Artificial Sequence: Synthetic oligonucleotide
ttagaggttgccacgtgtacaaacataatcaatcctgattc

SEQ ID NO: 277097 - DNA, 40 bp, Artificial Sequence
  Description of Artificial Sequence: Synthetic oligonucleotide
tagaggttgccacgtgtacaaacataatcaatcctgattc

SEQ ID NO: 277098 - DNA, 39 bp, Artificial Sequence
  Description of Artificial Sequence: Synthetic oligonucleotide
agaggttgccacgtgtacaaacataatcaatcctgattc

SEQ ID NO: 277099 - DNA, 38 bp, Artificial Sequence
  Description of Artificial Sequence: Synthetic oligonucleotide
gaggttgccacgtgtacaaacataatcaatcctgattc

SEQ ID NO: 277100 - DNA, 38 bp, Artificial Sequence
  Description of Artificial Sequence: Synthetic oligonucleotide
aggttgccacgtgtacaaacataatcaatcctgattcg

SEQ ID NO: 277101 - DNA, 37 bp, Artificial Sequence
  Description of Artificial Sequence: Synthetic oligonucleotide
ggttgccacgtgtacaaacataatcaatcctgattcg

SEQ ID NO: 277102 - DNA, 37 bp, Artificial Sequence
  Description of Artificial Sequence: Synthetic oligonucleotide
gttgccacgtgtacaaacataatcaatcctgattcgg

SEQ ID NO: 277103 - DNA, 38 bp, Artificial Sequence
  Description of Artificial Sequence: Synthetic oligonucleotide
ttgccacgtgtacaaacataatcaatcctgattcggtg

SEQ ID NO: 277104 - DNA, 37 bp, Artificial Sequence
  Description of Artificial Sequence: Synthetic oligonucleotide
tgccacgtgtacaaacataatcaatcctgattcggtg

SEQ ID NO: 277105 - DNA, 36 bp, Artificial Sequence
  Description of Artificial Sequence: Synthetic oligonucleotide
gccacgtgtacaaacataatcaatcctgattcggtg

SEQ ID NO: 277106 - DNA, 36 bp, Artificial Sequence
  Description of Artificial Sequence: Synthetic oligonucleotide
ccacgtgtacaaacataatcaatcctgattcggtgg

SEQ ID NO: 277107 - DNA, 37 bp, Artificial Sequence
  Description of Artificial Sequence: Synthetic oligonucleotide
cacgtgtacaaacataatcaatcctgattcggtggac

SEQ ID NO: 277108 - DNA, 37 bp, Artificial Sequence
  Description of Artificial Sequence: Synthetic oligonucleotide
acgtgtacaaacataatcaatcctgattcggtggacc

SEQ ID NO: 277109 - DNA, 36 bp, Artificial Sequence
  Description of Artificial Sequence: Synthetic oligonucleotide
cgtgtacaaacataatcaatcctgattcggtggacc

SEQ ID NO: 277110 - DNA, 36 bp, Artificial Sequence
  Description of Artificial Sequence: Synthetic oligonucleotide
gtgtacaaacataatcaatcctgattcggtggaccc

SEQ ID NO: 277111 - DNA, 42 bp, Artificial Sequence
  Description of Artificial Sequence: Synthetic oligonucleotide
tgtacaaacataatcaatcctgattcggtggacccaaattac

SEQ ID NO: 277112 - DNA, 41 bp, Artificial Sequence
  Description of Artificial Sequence: Synthetic oligonucleotide
gtacaaacataatcaatcctgattcggtggacccaaattac

SEQ ID NO: 277113 - DNA, 46 bp, Artificial Sequence
  Description of Artificial Sequence: Synthetic oligonucleotide
tacaaacataatcaatcctgattcggtggacccaaattacattatc

SEQ ID NO: 277114 - DNA, 45 bp, Artificial Sequence
  Description of Artificial Sequence: Synthetic oligonucleotide
acaaacataatcaatcctgattcggtggacccaaattacattatc

SEQ ID NO: 277115 - DNA, 44 bp, Artificial Sequence
  Description of Artificial Sequence: Synthetic oligonucleotide
caaacataatcaatcctgattcggtggacccaaattacattatc

SEQ ID NO: 277116 - DNA, 46 bp, Artificial Sequence
  Description of Artificial Sequence: Synthetic oligonucleotide
aaacataatcaatcctgattcggtggacccaaattacattatctac

SEQ ID NO: 277117 - DNA, 45 bp, Artificial Sequence
  Description of Artificial Sequence: Synthetic oligonucleotide
aacataatcaatcctgattcggtggacccaaattacattatctac

SEQ ID NO: 277118 - DNA, 44 bp, Artificial Sequence
  Description of Artificial Sequence: Synthetic oligonucleotide
acataatcaatcctgattcggtggacccaaattacattatctac

SEQ ID NO: 277119 - DNA, 43 bp, Artificial Sequence
  Description of Artificial Sequence: Synthetic oligonucleotide
cataatcaatcctgattcggtggacccaaattacattatctac

SEQ ID NO: 277120 - DNA, 43 bp, Artificial Sequence
  Description of Artificial Sequence: Synthetic oligonucleotide
ataatcaatcctgattcggtggacccaaattacattatctacg

SEQ ID NO: 277121 - DNA, 42 bp, Artificial Sequence
  Description of Artificial Sequence: Synthetic oligonucleotide
taatcaatcctgattcggtggacccaaattacattatctacg

SEQ ID NO: 277122 - DNA, 41 bp, Artificial Sequence
  Description of Artificial Sequence: Synthetic oligonucleotide
aatcaatcctgattcggtggacccaaattacattatctacg

SEQ ID NO: 277123 - DNA, 40 bp, Artificial Sequence
  Description of Artificial Sequence: Synthetic oligonucleotide
atcaatcctgattcggtggacccaaattacattatctacg

SEQ ID NO: 277124 - DNA, 39 bp, Artificial Sequence
  Description of Artificial Sequence: Synthetic oligonucleotide
tcaatcctgattcggtggacccaaattacattatctacg

SEQ ID NO: 277125 - DNA, 38 bp, Artificial Sequence
  Description of Artificial Sequence: Synthetic oligonucleotide
caatcctgattcggtggacccaaattacattatctacg

SEQ ID NO: 277126 - DNA, 42 bp, Artificial Sequence
  Description of Artificial Sequence: Synthetic oligonucleotide
aatcctgattcggtggacccaaattacattatctacgtaaag

SEQ ID NO: 277127 - DNA, 41 bp, Artificial Sequence
  Description of Artificial Sequence: Synthetic oligonucleotide
atcctgattcggtggacccaaattacattatctacgtaaag

SEQ ID NO: 277128 - DNA, 40 bp, Artificial Sequence
  Description of Artificial Sequence: Synthetic oligonucleotide
tcctgattcggtggacccaaattacattatctacgtaaag

SEQ ID NO: 277129 - DNA, 39 bp, Artificial Sequence
  Description of Artificial Sequence: Synthetic oligonucleotide
cctgattcggtggacccaaattacattatctacgtaaag

SEQ ID NO: 277130 - DNA, 39 bp, Artificial Sequence
  Description of Artificial Sequence: Synthetic oligonucleotide
ctgattcggtggacccaaattacattatctacgtaaagc

SEQ ID NO: 277131 - DNA, 40 bp, Artificial Sequence
  Description of Artificial Sequence: Synthetic oligonucleotide
tgattcggtggacccaaattacattatctacgtaaagctg

SEQ ID NO: 277132 - DNA, 39 bp, Artificial Sequence
  Description of Artificial Sequence: Synthetic oligonucleotide
gattcggtggacccaaattacattatctacgtaaagctg

SEQ ID NO: 277133 - DNA, 42 bp, Artificial Sequence
  Description of Artificial Sequence: Synthetic oligonucleotide
attcggtggacccaaattacattatctacgtaaagctgtttg

SEQ ID NO: 277134 - DNA, 41 bp, Artificial Sequence
  Description of Artificial Sequence: Synthetic oligonucleotide
ttcggtggacccaaattacattatctacgtaaagctgtttg

SEQ ID NO: 277135 - DNA, 40 bp, Artificial Sequence
  Description of Artificial Sequence: Synthetic oligonucleotide
tcggtggacccaaattacattatctacgtaaagctgtttg

SEQ ID NO: 277136 - DNA, 39 bp, Artificial Sequence
  Description of Artificial Sequence: Synthetic oligonucleotide
cggtggacccaaattacattatctacgtaaagctgtttg

SEQ ID NO: 277137 - DNA, 39 bp, Artificial Sequence
  Description of Artificial Sequence: Synthetic oligonucleotide
ggtggacccaaattacattatctacgtaaagctgtttgc

SEQ ID NO: 277138 - DNA, 39 bp, Artificial Sequence
  Description of Artificial Sequence: Synthetic oligonucleotide
gtggacccaaattacattatctacgtaaagctgtttgcc

SEQ ID NO: 277139 - DNA, 41 bp, Artificial Sequence
  Description of Artificial Sequence: Synthetic oligonucleotide
tggacccaaattacattatctacgtaaagctgtttgccaac

SEQ ID NO: 277140 - DNA, 40 bp, Artificial Sequence
  Description of Artificial Sequence: Synthetic oligonucleotide
ggacccaaattacattatctacgtaaagctgtttgccaac

SEQ ID NO: 277141 - DNA, 43 bp, Artificial Sequence
  Description of Artificial Sequence: Synthetic oligonucleotide
gacccaaattacattatctacgtaaagctgtttgccaactttg

SEQ ID NO: 277142 - DNA, 44 bp, Artificial Sequence
  Description of Artificial Sequence: Synthetic oligonucleotide
acccaaattacattatctacgtaaagctgtttgccaactttgtg

SEQ ID NO: 277143 - DNA, 43 bp, Artificial Sequence
  Description of Artificial Sequence: Synthetic oligonucleotide
cccaaattacattatctacgtaaagctgtttgccaactttgtg

SEQ ID NO: 277144 - DNA, 43 bp, Artificial Sequence
  Description of Artificial Sequence: Synthetic oligonucleotide
ccaaattacattatctacgtaaagctgtttgccaactttgtgg

SEQ ID NO: 277145 - DNA, 44 bp, Artificial Sequence
  Description of Artificial Sequence: Synthetic oligonucleotide
caaattacattatctacgtaaagctgtttgccaactttgtggtg

SEQ ID NO: 277146 - DNA, 44 bp, Artificial Sequence
  Description of Artificial Sequence: Synthetic oligonucleotide
aaattacattatctacgtaaagctgtttgccaactttgtggtgc

SEQ ID NO: 277147 - DNA, 43 bp, Artificial Sequence
  Description of Artificial Sequence: Synthetic oligonucleotide
aattacattatctacgtaaagctgtttgccaactttgtggtgc

SEQ ID NO: 277148 - DNA, 42 bp, Artificial Sequence
  Description of Artificial Sequence: Synthetic oligonucleotide
attacattatctacgtaaagctgtttgccaactttgtggtgc

SEQ ID NO: 277149 - DNA, 41 bp, Artificial Sequence
  Description of Artificial Sequence: Synthetic oligonucleotide
ttacattatctacgtaaagctgtttgccaactttgtggtgc

SEQ ID NO: 277150 - DNA, 40 bp, Artificial Sequence
  Description of Artificial Sequence: Synthetic oligonucleotide
tacattatctacgtaaagctgtttgccaactttgtggtgc

SEQ ID NO: 277151 - DNA, 39 bp, Artificial Sequence
  Description of Artificial Sequence: Synthetic oligonucleotide
acattatctacgtaaagctgtttgccaactttgtggtgc

SEQ ID NO: 277152 - DNA, 38 bp, Artificial Sequence
  Description of Artificial Sequence: Synthetic oligonucleotide
cattatctacgtaaagctgtttgccaactttgtggtgc

SEQ ID NO: 277153 - DNA, 39 bp, Artificial Sequence
  Description of Artificial Sequence: Synthetic oligonucleotide
attatctacgtaaagctgtttgccaactttgtggtgcac

SEQ ID NO: 277154 - DNA, 38 bp, Artificial Sequence
  Description of Artificial Sequence: Synthetic oligonucleotide
ttatctacgtaaagctgtttgccaactttgtggtgcac

SEQ ID NO: 277155 - DNA, 37 bp, Artificial Sequence
  Description of Artificial Sequence: Synthetic oligonucleotide
tatctacgtaaagctgtttgccaactttgtggtgcac

SEQ ID NO: 277156 - DNA, 36 bp, Artificial Sequence
  Description of Artificial Sequence: Synthetic oligonucleotide
atctacgtaaagctgtttgccaactttgtggtgcac

SEQ ID NO: 277157 - DNA, 35 bp, Artificial Sequence
  Description of Artificial Sequence: Synthetic oligonucleotide
tctacgtaaagctgtttgccaactttgtggtgcac

SEQ ID NO: 277158 - DNA, 34 bp, Artificial Sequence
  Description of Artificial Sequence: Synthetic oligonucleotide
ctacgtaaagctgtttgccaactttgtggtgcac

SEQ ID NO: 277159 - DNA, 34 bp, Artificial Sequence
  Description of Artificial Sequence: Synthetic oligonucleotide
tacgtaaagctgtttgccaactttgtggtgcacc

SEQ ID NO: 277160 - DNA, 33 bp, Artificial Sequence
  Description of Artificial Sequence: Synthetic oligonucleotide
acgtaaagctgtttgccaactttgtggtgcacc

SEQ ID NO: 277161 - DNA, 32 bp, Artificial Sequence
  Description of Artificial Sequence: Synthetic oligonucleotide
cgtaaagctgtttgccaactttgtggtgcacc

SEQ ID NO: 277162 - DNA, 35 bp, Artificial Sequence
  Description of Artificial Sequence: Synthetic oligonucleotide
gtaaagctgtttgccaactttgtggtgcaccttag

SEQ ID NO: 277163 - DNA, 36 bp, Artificial Sequence
  Description of Artificial Sequence: Synthetic oligonucleotide
taaagctgtttgccaactttgtggtgcaccttagtg

SEQ ID NO: 277164 - DNA, 35 bp, Artificial Sequence
  Description of Artificial Sequence: Synthetic oligonucleotide
aaagctgtttgccaactttgtggtgcaccttagtg

SEQ ID NO: 277165 - DNA, 34 bp, Artificial Sequence
  Description of Artificial Sequence: Synthetic oligonucleotide
aagctgtttgccaactttgtggtgcaccttagtg

SEQ ID NO: 277166 - DNA, 33 bp, Artificial Sequence
  Description of Artificial Sequence: Synthetic oligonucleotide
agctgtttgccaactttgtggtgcaccttagtg

SEQ ID NO: 277167 - DNA, 32 bp, Artificial Sequence
  Description of Artificial Sequence: Synthetic oligonucleotide
gctgtttgccaactttgtggtgcaccttagtg

SEQ ID NO: 277168 - DNA, 34 bp, Artificial Sequence
  Description of Artificial Sequence: Synthetic oligonucleotide
ctgtttgccaactttgtggtgcaccttagtgttc

SEQ ID NO: 277169 - DNA, 35 bp, Artificial Sequence
  Description of Artificial Sequence: Synthetic oligonucleotide
tgtttgccaactttgtggtgcaccttagtgttcag

SEQ ID NO: 277170 - DNA, 34 bp, Artificial Sequence
  Description of Artificial Sequence: Synthetic oligonucleotide
gtttgccaactttgtggtgcaccttagtgttcag

SEQ ID NO: 277171 - DNA, 34 bp, Artificial Sequence
  Description of Artificial Sequence: Synthetic oligonucleotide
tttgccaactttgtggtgcaccttagtgttcagg

SEQ ID NO: 277172 - DNA, 33 bp, Artificial Sequence
  Description of Artificial Sequence: Synthetic oligonucleotide
ttgccaactttgtggtgcaccttagtgttcagg

SEQ ID NO: 277173 - DNA, 32 bp, Artificial Sequence
  Description of Artificial Sequence: Synthetic oligonucleotide
tgccaactttgtggtgcaccttagtgttcagg

SEQ ID NO: 277174 - DNA, 31 bp, Artificial Sequence
  Description of Artificial Sequence: Synthetic oligonucleotide
gccaactttgtggtgcaccttagtgttcagg

SEQ ID NO: 277175 - DNA, 32 bp, Artificial Sequence
  Description of Artificial Sequence: Synthetic oligonucleotide
ccaactttgtggtgcaccttagtgttcaggtg

SEQ ID NO: 277176 - DNA, 32 bp, Artificial Sequence
  Description of Artificial Sequence: Synthetic oligonucleotide
caactttgtggtgcaccttagtgttcaggtgg

SEQ ID NO: 277177 - DNA, 32 bp, Artificial Sequence
  Description of Artificial Sequence: Synthetic oligonucleotide
aactttgtggtgcaccttagtgttcaggtggc

SEQ ID NO: 277178 - DNA, 31 bp, Artificial Sequence
  Description of Artificial Sequence: Synthetic oligonucleotide
actttgtggtgcaccttagtgttcaggtggc

SEQ ID NO: 277179 - DNA, 30 bp, Artificial Sequence
  Description of Artificial Sequence: Synthetic oligonucleotide
ctttgtggtgcaccttagtgttcaggtggc

SEQ ID NO: 277180 - DNA, 31 bp, Artificial Sequence
  Description of Artificial Sequence: Synthetic oligonucleotide
tttgtggtgcaccttagtgttcaggtggctc

SEQ ID NO: 277181 - DNA, 30 bp, Artificial Sequence
  Description of Artificial Sequence: Synthetic oligonucleotide
ttgtggtgcaccttagtgttcaggtggctc

SEQ ID NO: 277182 - DNA, 29 bp, Artificial Sequence
  Description of Artificial Sequence: Synthetic oligonucleotide
tgtggtgcaccttagtgttcaggtggctc

SEQ ID NO: 277183 - DNA, 28 bp, Artificial Sequence
  Description of Artificial Sequence: Synthetic oligonucleotide
gtggtgcaccttagtgttcaggtggctc

SEQ ID NO: 277184 - DNA, 28 bp, Artificial Sequence
  Description of Artificial Sequence: Synthetic oligonucleotide
tggtgcaccttagtgttcaggtggctcc

SEQ ID NO: 277185 - DNA, 27 bp, Artificial Sequence
  Description of Artificial Sequence: Synthetic oligonucleotide
ggtgcaccttagtgttcaggtggctcc

SEQ ID NO: 277186 - DNA, 29 bp, Artificial Sequence
  Description of Artificial Sequence: Synthetic oligonucleotide
gtgcaccttagtgttcaggtggctcctac

SEQ ID NO: 277187 - DNA, 30 bp, Artificial Sequence
  Description of Artificial Sequence: Synthetic oligonucleotide
tgcaccttagtgttcaggtggctcctactg

SEQ ID NO: 277188 - DNA, 29 bp, Artificial Sequence
  Description of Artificial Sequence: Synthetic oligonucleotide
gcaccttagtgttcaggtggctcctactg

SEQ ID NO: 277189 - DNA, 30 bp, Artificial Sequence
  Description of Artificial Sequence: Synthetic oligonucleotide
caccttagtgttcaggtggctcctactgac

SEQ ID NO: 277190 - DNA, 33 bp, Artificial Sequence
  Description of Artificial Sequence: Synthetic oligonucleotide
accttagtgttcaggtggctcctactgactttg

SEQ ID NO: 277191 - DNA, 32 bp, Artificial Sequence
  Description of Artificial Sequence: Synthetic oligonucleotide
ccttagtgttcaggtggctcctactgactttg

SEQ ID NO: 277192 - DNA, 34 bp, Artificial Sequence
  Description of Artificial Sequence: Synthetic oligonucleotide
cttagtgttcaggtggctcctactgactttgaag

SEQ ID NO: 277193 - DNA, 36 bp, Artificial Sequence
  Description of Artificial Sequence: Synthetic oligonucleotide
ttagtgttcaggtggctcctactgactttgaagaag

SEQ ID NO: 277194 - DNA, 35 bp, Artificial Sequence
  Description of Artificial Sequence: Synthetic oligonucleotide
tagtgttcaggtggctcctactgactttgaagaag

SEQ ID NO: 277195 - DNA, 34 bp, Artificial Sequence
  Description of Artificial Sequence: Synthetic oligonucleotide
agtgttcaggtggctcctactgactttgaagaag

SEQ ID NO: 277196 - DNA, 33 bp, Artificial Sequence
  Description of Artificial Sequence: Synthetic oligonucleotide
gtgttcaggtggctcctactgactttgaagaag

SEQ ID NO: 277197 - DNA, 33 bp, Artificial Sequence
  Description of Artificial Sequence: Synthetic oligonucleotide
tgttcaggtggctcctactgactttgaagaagc

SEQ ID NO: 277198 - DNA, 32 bp, Artificial Sequence
  Description of Artificial Sequence: Synthetic oligonucleotide
gttcaggtggctcctactgactttgaagaagc

SEQ ID NO: 277199 - DNA, 32 bp, Artificial Sequence
  Description of Artificial Sequence: Synthetic oligonucleotide
ttcaggtggctcctactgactttgaagaagcg

SEQ ID NO: 277200 - DNA, 31 bp, Artificial Sequence
  Description of Artificial Sequence: Synthetic oligonucleotide
tcaggtggctcctactgactttgaagaagcg

SEQ ID NO: 277201 - DNA, 30 bp, Artificial Sequence
  Description of Artificial Sequence: Synthetic oligonucleotide
caggtggctcctactgactttgaagaagcg

SEQ ID NO: 277202 - DNA, 32 bp, Artificial Sequence
  Description of Artificial Sequence: Synthetic oligonucleotide
aggtggctcctactgactttgaagaagcgatg

SEQ ID NO: 277203 - DNA, 31 bp, Artificial Sequence
  Description of Artificial Sequence: Synthetic oligonucleotide
ggtggctcctactgactttgaagaagcgatg

SEQ ID NO: 277204 - DNA, 32 bp, Artificial Sequence
  Description of Artificial Sequence: Synthetic oligonucleotide
gtggctcctactgactttgaagaagcgatgag

SEQ ID NO: 277205 - DNA, 33 bp, Artificial Sequence
  Description of Artificial Sequence: Synthetic oligonucleotide
tggctcctactgactttgaagaagcgatgagag

SEQ ID NO: 277206 - DNA, 32 bp, Artificial Sequence
  Description of Artificial Sequence: Synthetic oligonucleotide
ggctcctactgactttgaagaagcgatgagag

SEQ ID NO: 277207 - DNA, 33 bp, Artificial Sequence
  Description of Artificial Sequence: Synthetic oligonucleotide
gctcctactgactttgaagaagcgatgagagtc

SEQ ID NO: 277208 - DNA, 33 bp, Artificial Sequence
  Description of Artificial Sequence: Synthetic oligonucleotide
ctcctactgactttgaagaagcgatgagagtcg

SEQ ID NO: 277209 - DNA, 33 bp, Artificial Sequence
  Description of Artificial Sequence: Synthetic oligonucleotide
tcctactgactttgaagaagcgatgagagtcgg

SEQ ID NO: 277210 - DNA, 32 bp, Artificial Sequence
  Description of Artificial Sequence: Synthetic oligonucleotide
cctactgactttgaagaagcgatgagagtcgg

SEQ ID NO: 277211 - DNA, 32 bp, Artificial Sequence
  Description of Artificial Sequence: Synthetic oligonucleotide
ctactgactttgaagaagcgatgagagtcggc

SEQ ID NO: 277212 - DNA, 32 bp, Artificial Sequence
  Description of Artificial Sequence: Synthetic oligonucleotide
tactgactttgaagaagcgatgagagtcggcg

SEQ ID NO: 277213 - DNA, 31 bp, Artificial Sequence
  Description of Artificial Sequence: Synthetic oligonucleotide
actgactttgaagaagcgatgagagtcggcg

SEQ ID NO: 277214 - DNA, 30 bp, Artificial Sequence
  Description of Artificial Sequence: Synthetic oligonucleotide
ctgactttgaagaagcgatgagagtcggcg

SEQ ID NO: 277215 - DNA, 31 bp, Artificial Sequence
  Description of Artificial Sequence: Synthetic oligonucleotide
tgactttgaagaagcgatgagagtcggcgtg

SEQ ID NO: 277216 - DNA, 30 bp, Artificial Sequence
  Description of Artificial Sequence: Synthetic oligonucleotide
gactttgaagaagcgatgagagtcggcgtg

SEQ ID NO: 277217 - DNA, 30 bp, Artificial Sequence
  Description of Artificial Sequence: Synthetic oligonucleotide
actttgaagaagcgatgagagtcggcgtgg

SEQ ID NO: 277218 - DNA, 29 bp, Artificial Sequence
  Description of Artificial Sequence: Synthetic oligonucleotide
ctttgaagaagcgatgagagtcggcgtgg

SEQ ID NO: 277219 - DNA, 32 bp, Artificial Sequence
  Description of Artificial Sequence: Synthetic oligonucleotide
tttgaagaagcgatgagagtcggcgtggattg

SEQ ID NO: 277220 - DNA, 31 bp, Artificial Sequence
  Description of Artificial Sequence: Synthetic oligonucleotide
ttgaagaagcgatgagagtcggcgtggattg

SEQ ID NO: 277221 - DNA, 30 bp, Artificial Sequence
  Description of Artificial Sequence: Synthetic oligonucleotide
tgaagaagcgatgagagtcggcgtggattg

SEQ ID NO: 277222 - DNA, 29 bp, Artificial Sequence
  Description of Artificial Sequence: Synthetic oligonucleotide
gaagaagcgatgagagtcggcgtggattg

SEQ ID NO: 277223 - DNA, 39 bp, Artificial Sequence
  Description of Artificial Sequence: Synthetic oligonucleotide
aagaagcgatgagagtcggcgtggattgaaataaatttc

SEQ ID NO: 277224 - DNA, 38 bp, Artificial Sequence
  Description of Artificial Sequence: Synthetic oligonucleotide
agaagcgatgagagtcggcgtggattgaaataaatttc

SEQ ID NO: 277225 - DNA, 37 bp, Artificial Sequence
  Description of Artificial Sequence: Synthetic oligonucleotide
gaagcgatgagagtcggcgtggattgaaataaatttc

SEQ ID NO: 277226 - DNA, 42 bp, Artificial Sequence
  Description of Artificial Sequence: Synthetic oligonucleotide
aagcgatgagagtcggcgtggattgaaataaatttcaaattc

SEQ ID NO: 277227 - DNA, 41 bp, Artificial Sequence
  Description of Artificial Sequence: Synthetic oligonucleotide
agcgatgagagtcggcgtggattgaaataaatttcaaattc

SEQ ID NO: 277228 - DNA, 40 bp, Artificial Sequence
  Description of Artificial Sequence: Synthetic oligonucleotide
gcgatgagagtcggcgtggattgaaataaatttcaaattc

SEQ ID NO: 277229 - DNA, 41 bp, Artificial Sequence
  Description of Artificial Sequence: Synthetic oligonucleotide
cgatgagagtcggcgtggattgaaataaatttcaaattcag

SEQ ID NO: 277230 - DNA, 44 bp, Artificial Sequence
  Description of Artificial Sequence: Synthetic oligonucleotide
gatgagagtcggcgtggattgaaataaatttcaaattcagattc

SEQ ID NO: 277231 - DNA, 44 bp, Artificial Sequence
  Description of Artificial Sequence: Synthetic oligonucleotide
atgagagtcggcgtggattgaaataaatttcaaattcagattcc

SEQ ID NO: 277232 - DNA, 43 bp, Artificial Sequence
  Description of Artificial Sequence: Synthetic oligonucleotide
tgagagtcggcgtggattgaaataaatttcaaattcagattcc

SEQ ID NO: 277233 - DNA, 42 bp, Artificial Sequence
  Description of Artificial Sequence: Synthetic oligonucleotide
gagagtcggcgtggattgaaataaatttcaaattcagattcc

SEQ ID NO: 277234 - DNA, 45 bp, Artificial Sequence
  Description of Artificial Sequence: Synthetic oligonucleotide
agagtcggcgtggattgaaataaatttcaaattcagattccattg

SEQ ID NO: 277235 - DNA, 44 bp, Artificial Sequence
  Description of Artificial Sequence: Synthetic oligonucleotide
gagtcggcgtggattgaaataaatttcaaattcagattccattg

SEQ ID NO: 277236 - DNA, 44 bp, Artificial Sequence
  Description of Artificial Sequence: Synthetic oligonucleotide
agtcggcgtggattgaaataaatttcaaattcagattccattgg

SEQ ID NO: 277237 - DNA, 43 bp, Artificial Sequence
  Description of Artificial Sequence: Synthetic oligonucleotide
gtcggcgtggattgaaataaatttcaaattcagattccattgg

SEQ ID NO: 277238 - DNA, 43 bp, Artificial Sequence
  Description of Artificial Sequence: Synthetic oligonucleotide
tcggcgtggattgaaataaatttcaaattcagattccattggc

SEQ ID NO: 277239 - DNA, 42 bp, Artificial Sequence
  Description of Artificial Sequence: Synthetic oligonucleotide
cggcgtggattgaaataaatttcaaattcagattccattggc

SEQ ID NO: 277240 - DNA, 43 bp, Artificial Sequence
  Description of Artificial Sequence: Synthetic oligonucleotide
ggcgtggattgaaataaatttcaaattcagattccattggctc

SEQ ID NO: 277241 - DNA, 43 bp, Artificial Sequence
  Description of Artificial Sequence: Synthetic oligonucleotide
gcgtggattgaaataaatttcaaattcagattccattggctcc

SEQ ID NO: 277242 - DNA, 46 bp, Artificial Sequence
  Description of Artificial Sequence: Synthetic oligonucleotide
cgtggattgaaataaatttcaaattcagattccattggctcctaag

SEQ ID NO: 277243 - DNA, 49 bp, Artificial Sequence
  Description of Artificial Sequence: Synthetic oligonucleotide
gtggattgaaataaatttcaaattcagattccattggctcctaagaatg

SEQ ID NO: 277244 - DNA, 50 bp, Artificial Sequence
  Description of Artificial Sequence: Synthetic oligonucleotide
tggattgaaataaatttcaaattcagattccattggctcctaagaatgac

SEQ ID NO: 277245 - DNA, 49 bp, Artificial Sequence
  Description of Artificial Sequence: Synthetic oligonucleotide
ggattgaaataaatttcaaattcagattccattggctcctaagaatgac

SEQ ID NO: 277246 - DNA, 49 bp, Artificial Sequence
  Description of Artificial Sequence: Synthetic oligonucleotide
gattgaaataaatttcaaattcagattccattggctcctaagaatgacc

SEQ ID NO: 277247 - DNA, 49 bp, Artificial Sequence
  Description of Artificial Sequence: Synthetic oligonucleotide
attgaaataaatttcaaattcagattccattggctcctaagaatgaccc

SEQ ID NO: 277248 - DNA, 48 bp, Artificial Sequence
  Description of Artificial Sequence: Synthetic oligonucleotide
ttgaaataaatttcaaattcagattccattggctcctaagaatgaccc

SEQ ID NO: 277249 - DNA, 47 bp, Artificial Sequence
  Description of Artificial Sequence: Synthetic oligonucleotide
tgaaataaatttcaaattcagattccattggctcctaagaatgaccc

SEQ ID NO: 277250 - DNA, 46 bp, Artificial Sequence
  Description of Artificial Sequence: Synthetic oligonucleotide
gaaataaatttcaaattcagattccattggctcctaagaatgaccc

SEQ ID NO: 277251 - DNA, 48 bp, Artificial Sequence
  Description of Artificial Sequence: Synthetic oligonucleotide
aaataaatttcaaattcagattccattggctcctaagaatgacccaac

SEQ ID NO: 277252 - DNA, 47 bp, Artificial Sequence
  Description of Artificial Sequence: Synthetic oligonucleotide
aataaatttcaaattcagattccattggctcctaagaatgacccaac

SEQ ID NO: 277253 - DNA, 46 bp, Artificial Sequence
  Description of Artificial Sequence: Synthetic oligonucleotide
ataaatttcaaattcagattccattggctcctaagaatgacccaac

SEQ ID NO: 277254 - DNA, 45 bp, Artificial Sequence
  Description of Artificial Sequence: Synthetic oligonucleotide
taaatttcaaattcagattccattggctcctaagaatgacccaac

SEQ ID NO: 277255 - DNA, 44 bp, Artificial Sequence
  Description of Artificial Sequence: Synthetic oligonucleotide
aaatttcaaattcagattccattggctcctaagaatgacccaac

SEQ ID NO: 277256 - DNA, 43 bp, Artificial Sequence
  Description of Artificial Sequence: Synthetic oligonucleotide
aatttcaaattcagattccattggctcctaagaatgacccaac

SEQ ID NO: 277257 - DNA, 42 bp, Artificial Sequence
  Description of Artificial Sequence: Synthetic oligonucleotide
atttcaaattcagattccattggctcctaagaatgacccaac

SEQ ID NO: 277258 - DNA, 41 bp, Artificial Sequence
  Description of Artificial Sequence: Synthetic oligonucleotide
tttcaaattcagattccattggctcctaagaatgacccaac

SEQ ID NO: 277259 - DNA, 40 bp, Artificial Sequence
  Description of Artificial Sequence: Synthetic oligonucleotide
ttcaaattcagattccattggctcctaagaatgacccaac

SEQ ID NO: 277260 - DNA, 39 bp, Artificial Sequence
  Description of Artificial Sequence: Synthetic oligonucleotide
tcaaattcagattccattggctcctaagaatgacccaac

SEQ ID NO: 277261 - DNA, 38 bp, Artificial Sequence
  Description of Artificial Sequence: Synthetic oligonucleotide
caaattcagattccattggctcctaagaatgacccaac

SEQ ID NO: 277262 - DNA, 39 bp, Artificial Sequence
  Description of Artificial Sequence: Synthetic oligonucleotide
aaattcagattccattggctcctaagaatgacccaactg

SEQ ID NO: 277263 - DNA, 38 bp, Artificial Sequence
  Description of Artificial Sequence: Synthetic oligonucleotide
aattcagattccattggctcctaagaatgacccaactg

SEQ ID NO: 277264 - DNA, 37 bp, Artificial Sequence
  Description of Artificial Sequence: Synthetic oligonucleotide
attcagattccattggctcctaagaatgacccaactg

SEQ ID NO: 277265 - DNA, 36 bp, Artificial Sequence
  Description of Artificial Sequence: Synthetic oligonucleotide
ttcagattccattggctcctaagaatgacccaactg

SEQ ID NO: 277266 - DNA, 35 bp, Artificial Sequence
  Description of Artificial Sequence: Synthetic oligonucleotide
tcagattccattggctcctaagaatgacccaactg

SEQ ID NO: 277267 - DNA, 34 bp, Artificial Sequence
  Description of Artificial Sequence: Synthetic oligonucleotide
cagattccattggctcctaagaatgacccaactg

SEQ ID NO: 277268 - DNA, 37 bp, Artificial Sequence
  Description of Artificial Sequence: Synthetic oligonucleotide
agattccattggctcctaagaatgacccaactgttac

SEQ ID NO: 277269 - DNA, 36 bp, Artificial Sequence
  Description of Artificial Sequence: Synthetic oligonucleotide
gattccattggctcctaagaatgacccaactgttac

SEQ ID NO: 277270 - DNA, 36 bp, Artificial Sequence
  Description of Artificial Sequence: Synthetic oligonucleotide
attccattggctcctaagaatgacccaactgttacc

SEQ ID NO: 277271 - DNA, 35 bp, Artificial Sequence
  Description of Artificial Sequence: Synthetic oligonucleotide
ttccattggctcctaagaatgacccaactgttacc

SEQ ID NO: 277272 - DNA, 34 bp, Artificial Sequence
  Description of Artificial Sequence: Synthetic oligonucleotide
tccattggctcctaagaatgacccaactgttacc

SEQ ID NO: 277273 - DNA, 33 bp, Artificial Sequence
  Description of Artificial Sequence: Synthetic oligonucleotide
ccattggctcctaagaatgacccaactgttacc

SEQ ID NO: 277274 - DNA, 35 bp, Artificial Sequence
  Description of Artificial Sequence: Synthetic oligonucleotide
cattggctcctaagaatgacccaactgttaccatg

SEQ ID NO: 277275 - DNA, 37 bp, Artificial Sequence
  Description of Artificial Sequence: Synthetic oligonucleotide
attggctcctaagaatgacccaactgttaccatgttg

SEQ ID NO: 277276 - DNA, 36 bp, Artificial Sequence
  Description of Artificial Sequence: Synthetic oligonucleotide
ttggctcctaagaatgacccaactgttaccatgttg

SEQ ID NO: 277277 - DNA, 35 bp, Artificial Sequence
  Description of Artificial Sequence: Synthetic oligonucleotide
tggctcctaagaatgacccaactgttaccatgttg

SEQ ID NO: 277278 - DNA, 34 bp, Artificial Sequence
  Description of Artificial Sequence: Synthetic oligonucleotide
ggctcctaagaatgacccaactgttaccatgttg

SEQ ID NO: 277279 - DNA, 34 bp, Artificial Sequence
  Description of Artificial Sequence: Synthetic oligonucleotide
gctcctaagaatgacccaactgttaccatgttgc

SEQ ID NO: 277280 - DNA, 35 bp, Artificial Sequence
  Description of Artificial Sequence: Synthetic oligonucleotide
ctcctaagaatgacccaactgttaccatgttgcag

SEQ ID NO: 277281 - DNA, 35 bp, Artificial Sequence
  Description of Artificial Sequence: Synthetic oligonucleotide
tcctaagaatgacccaactgttaccatgttgcagg

SEQ ID NO: 277282 - DNA, 34 bp, Artificial Sequence
  Description of Artificial Sequence: Synthetic oligonucleotide
cctaagaatgacccaactgttaccatgttgcagg

SEQ ID NO: 277283 - DNA, 35 bp, Artificial Sequence
  Description of Artificial Sequence: Synthetic oligonucleotide
ctaagaatgacccaactgttaccatgttgcaggtg

SEQ ID NO: 277284 - DNA, 35 bp, Artificial Sequence
  Description of Artificial Sequence: Synthetic oligonucleotide
taagaatgacccaactgttaccatgttgcaggtgg

SEQ ID NO: 277285 - DNA, 34 bp, Artificial Sequence
  Description of Artificial Sequence: Synthetic oligonucleotide
aagaatgacccaactgttaccatgttgcaggtgg

SEQ ID NO: 277286 - DNA, 33 bp, Artificial Sequence
  Description of Artificial Sequence: Synthetic oligonucleotide
agaatgacccaactgttaccatgttgcaggtgg

SEQ ID NO: 277287 - DNA, 32 bp, Artificial Sequence
  Description of Artificial Sequence: Synthetic oligonucleotide
gaatgacccaactgttaccatgttgcaggtgg

SEQ ID NO: 277288 - DNA, 34 bp, Artificial Sequence
  Description of Artificial Sequence: Synthetic oligonucleotide
aatgacccaactgttaccatgttgcaggtggtag

SEQ ID NO: 277289 - DNA, 33 bp, Artificial Sequence
  Description of Artificial Sequence: Synthetic oligonucleotide
atgacccaactgttaccatgttgcaggtggtag

SEQ ID NO: 277290 - DNA, 32 bp, Artificial Sequence
  Description of Artificial Sequence: Synthetic oligonucleotide
tgacccaactgttaccatgttgcaggtggtag

SEQ ID NO: 277291 - DNA, 31 bp, Artificial Sequence
  Description of Artificial Sequence: Synthetic oligonucleotide
gacccaactgttaccatgttgcaggtggtag

SEQ ID NO: 277292 - DNA, 32 bp, Artificial Sequence
  Description of Artificial Sequence: Synthetic oligonucleotide
acccaactgttaccatgttgcaggtggtagag

SEQ ID NO: 277293 - DNA, 31 bp, Artificial Sequence
  Description of Artificial Sequence: Synthetic oligonucleotide
cccaactgttaccatgttgcaggtggtagag

SEQ ID NO: 277294 - DNA, 34 bp, Artificial Sequence
  Description of Artificial Sequence: Synthetic oligonucleotide
ccaactgttaccatgttgcaggtggtagagaaac

SEQ ID NO: 277295 - DNA, 34 bp, Artificial Sequence
  Description of Artificial Sequence: Synthetic oligonucleotide
caactgttaccatgttgcaggtggtagagaaacc

SEQ ID NO: 277296 - DNA, 35 bp, Artificial Sequence
  Description of Artificial Sequence: Synthetic oligonucleotide
aactgttaccatgttgcaggtggtagagaaaccag

SEQ ID NO: 277297 - DNA, 34 bp, Artificial Sequence
  Description of Artificial Sequence: Synthetic oligonucleotide
actgttaccatgttgcaggtggtagagaaaccag

SEQ ID NO: 277298 - DNA, 33 bp, Artificial Sequence
  Description of Artificial Sequence: Synthetic oligonucleotide
ctgttaccatgttgcaggtggtagagaaaccag

SEQ ID NO: 277299 - DNA, 35 bp, Artificial Sequence
  Description of Artificial Sequence: Synthetic oligonucleotide
tgttaccatgttgcaggtggtagagaaaccagatg

SEQ ID NO: 277300 - DNA, 34 bp, Artificial Sequence
  Description of Artificial Sequence: Synthetic oligonucleotide
gttaccatgttgcaggtggtagagaaaccagatg

SEQ ID NO: 277301 - DNA, 35 bp, Artificial Sequence
  Description of Artificial Sequence: Synthetic oligonucleotide
ttaccatgttgcaggtggtagagaaaccagatgtc

SEQ ID NO: 277302 - DNA, 34 bp, Artificial Sequence
  Description of Artificial Sequence: Synthetic oligonucleotide
taccatgttgcaggtggtagagaaaccagatgtc

SEQ ID NO: 277303 - DNA, 33 bp, Artificial Sequence
  Description of Artificial Sequence: Synthetic oligonucleotide
accatgttgcaggtggtagagaaaccagatgtc

SEQ ID NO: 277304 - DNA, 32 bp, Artificial Sequence
  Description of Artificial Sequence: Synthetic oligonucleotide
ccatgttgcaggtggtagagaaaccagatgtc

SEQ ID NO: 277305 - DNA, 33 bp, Artificial Sequence
  Description of Artificial Sequence: Synthetic oligonucleotide
catgttgcaggtggtagagaaaccagatgtcac

SEQ ID NO: 277306 - DNA, 36 bp, Artificial Sequence
  Description of Artificial Sequence: Synthetic oligonucleotide
atgttgcaggtggtagagaaaccagatgtcacaaac

SEQ ID NO: 277307 - DNA, 35 bp, Artificial Sequence
  Description of Artificial Sequence: Synthetic oligonucleotide
tgttgcaggtggtagagaaaccagatgtcacaaac

SEQ ID NO: 277308 - DNA, 34 bp, Artificial Sequence
  Description of Artificial Sequence: Synthetic oligonucleotide
gttgcaggtggtagagaaaccagatgtcacaaac

SEQ ID NO: 277309 - DNA, 35 bp, Artificial Sequence
  Description of Artificial Sequence: Synthetic oligonucleotide
ttgcaggtggtagagaaaccagatgtcacaaacag

SEQ ID NO: 277310 - DNA, 34 bp, Artificial Sequence
  Description of Artificial Sequence: Synthetic oligonucleotide
tgcaggtggtagagaaaccagatgtcacaaacag

SEQ ID NO: 277311 - DNA, 33 bp, Artificial Sequence
  Description of Artificial Sequence: Synthetic oligonucleotide
gcaggtggtagagaaaccagatgtcacaaacag

SEQ ID NO: 277312 - DNA, 34 bp, Artificial Sequence
  Description of Artificial Sequence: Synthetic oligonucleotide
caggtggtagagaaaccagatgtcacaaacagtg

SEQ ID NO: 277313 - DNA, 36 bp, Artificial Sequence
  Description of Artificial Sequence: Synthetic oligonucleotide
aggtggtagagaaaccagatgtcacaaacagtgatg

SEQ ID NO: 277314 - DNA, 35 bp, Artificial Sequence
  Description of Artificial Sequence: Synthetic oligonucleotide
ggtggtagagaaaccagatgtcacaaacagtgatg

SEQ ID NO: 277315 - DNA, 37 bp, Artificial Sequence
  Description of Artificial Sequence: Synthetic oligonucleotide
gtggtagagaaaccagatgtcacaaacagtgatgatg

SEQ ID NO: 277316 - DNA, 37 bp, Artificial Sequence
  Description of Artificial Sequence: Synthetic oligonucleotide
tggtagagaaaccagatgtcacaaacagtgatgatgg

SEQ ID NO: 277317 - DNA, 36 bp, Artificial Sequence
  Description of Artificial Sequence: Synthetic oligonucleotide
ggtagagaaaccagatgtcacaaacagtgatgatgg

SEQ ID NO: 277318 - DNA, 37 bp, Artificial Sequence
  Description of Artificial Sequence: Synthetic oligonucleotide
gtagagaaaccagatgtcacaaacagtgatgatggtg

SEQ ID NO: 277319 - DNA, 37 bp, Artificial Sequence
  Description of Artificial Sequence: Synthetic oligonucleotide
tagagaaaccagatgtcacaaacagtgatgatggtgg

SEQ ID NO: 277320 - DNA, 36 bp, Artificial Sequence
  Description of Artificial Sequence: Synthetic oligonucleotide
agagaaaccagatgtcacaaacagtgatgatggtgg

SEQ ID NO: 277321 - DNA, 35 bp, Artificial Sequence
  Description of Artificial Sequence: Synthetic oligonucleotide
gagaaaccagatgtcacaaacagtgatgatggtgg

SEQ ID NO: 277322 - DNA, 35 bp, Artificial Sequence
  Description of Artificial Sequence: Synthetic oligonucleotide
agaaaccagatgtcacaaacagtgatgatggtggc

SEQ ID NO: 277323 - DNA, 34 bp, Artificial Sequence
  Description of Artificial Sequence: Synthetic oligonucleotide
gaaaccagatgtcacaaacagtgatgatggtggc

SEQ ID NO: 277324 - DNA, 35 bp, Artificial Sequence
  Description of Artificial Sequence: Synthetic oligonucleotide
aaaccagatgtcacaaacagtgatgatggtggctg

SEQ ID NO: 277325 - DNA, 34 bp, Artificial Sequence
  Description of Artificial Sequence: Synthetic oligonucleotide
aaccagatgtcacaaacagtgatgatggtggctg

SEQ ID NO: 277326 - DNA, 33 bp, Artificial Sequence
  Description of Artificial Sequence: Synthetic oligonucleotide
accagatgtcacaaacagtgatgatggtggctg

SEQ ID NO: 277327 - DNA, 32 bp, Artificial Sequence
  Description of Artificial Sequence: Synthetic oligonucleotide
ccagatgtcacaaacagtgatgatggtggctg

SEQ ID NO: 277328 - DNA, 35 bp, Artificial Sequence
  Description of Artificial Sequence: Synthetic oligonucleotide
cagatgtcacaaacagtgatgatggtggctgaaag

SEQ ID NO: 277329 - DNA, 35 bp, Artificial Sequence
  Description of Artificial Sequence: Synthetic oligonucleotide
agatgtcacaaacagtgatgatggtggctgaaagg

SEQ ID NO: 277330 - DNA, 34 bp, Artificial Sequence
  Description of Artificial Sequence: Synthetic oligonucleotide
gatgtcacaaacagtgatgatggtggctgaaagg

SEQ ID NO: 277331 - DNA, 36 bp, Artificial Sequence
  Description of Artificial Sequence: Synthetic oligonucleotide
atgtcacaaacagtgatgatggtggctgaaaggaac

SEQ ID NO: 277332 - DNA, 35 bp, Artificial Sequence
  Description of Artificial Sequence: Synthetic oligonucleotide
tgtcacaaacagtgatgatggtggctgaaaggaac

SEQ ID NO: 277333 - DNA, 34 bp, Artificial Sequence
  Description of Artificial Sequence: Synthetic oligonucleotide
gtcacaaacagtgatgatggtggctgaaaggaac

SEQ ID NO: 277334 - DNA, 35 bp, Artificial Sequence
  Description of Artificial Sequence: Synthetic oligonucleotide
tcacaaacagtgatgatggtggctgaaaggaacag

SEQ ID NO: 277335 - DNA, 34 bp, Artificial Sequence
  Description of Artificial Sequence: Synthetic oligonucleotide
cacaaacagtgatgatggtggctgaaaggaacag

SEQ ID NO: 277336 - DNA, 37 bp, Artificial Sequence
  Description of Artificial Sequence: Synthetic oligonucleotide
acaaacagtgatgatggtggctgaaaggaacagtttg

SEQ ID NO: 277337 - DNA, 36 bp, Artificial Sequence
  Description of Artificial Sequence: Synthetic oligonucleotide
caaacagtgatgatggtggctgaaaggaacagtttg

SEQ ID NO: 277338 - DNA, 37 bp, Artificial Sequence
  Description of Artificial Sequence: Synthetic oligonucleotide
aaacagtgatgatggtggctgaaaggaacagtttgag

SEQ ID NO: 277339 - DNA, 36 bp, Artificial Sequence
  Description of Artificial Sequence: Synthetic oligonucleotide
aacagtgatgatggtggctgaaaggaacagtttgag

SEQ ID NO: 277340 - DNA, 35 bp, Artificial Sequence
  Description of Artificial Sequence: Synthetic oligonucleotide
acagtgatgatggtggctgaaaggaacagtttgag

SEQ ID NO: 277341 - DNA, 34 bp, Artificial Sequence
  Description of Artificial Sequence: Synthetic oligonucleotide
cagtgatgatggtggctgaaaggaacagtttgag

SEQ ID NO: 277342 - DNA, 37 bp, Artificial Sequence
  Description of Artificial Sequence: Synthetic oligonucleotide
agtgatgatggtggctgaaaggaacagtttgagaaac

SEQ ID NO: 277343 - DNA, 36 bp, Artificial Sequence
  Description of Artificial Sequence: Synthetic oligonucleotide
gtgatgatggtggctgaaaggaacagtttgagaaac

SEQ ID NO: 277344 - DNA, 37 bp, Artificial Sequence
  Description of Artificial Sequence: Synthetic oligonucleotide
tgatgatggtggctgaaaggaacagtttgagaaacag

SEQ ID NO: 277345 - DNA, 36 bp, Artificial Sequence
  Description of Artificial Sequence: Synthetic oligonucleotide
gatgatggtggctgaaaggaacagtttgagaaacag

SEQ ID NO: 277346 - DNA, 36 bp, Artificial Sequence
  Description of Artificial Sequence: Synthetic oligonucleotide
atgatggtggctgaaaggaacagtttgagaaacagc

SEQ ID NO: 277347 - DNA, 35 bp, Artificial Sequence
  Description of Artificial Sequence: Synthetic oligonucleotide
tgatggtggctgaaaggaacagtttgagaaacagc

SEQ ID NO: 277348 - DNA, 34 bp, Artificial Sequence
  Description of Artificial Sequence: Synthetic oligonucleotide
gatggtggctgaaaggaacagtttgagaaacagc

SEQ ID NO: 277349 - DNA, 34 bp, Artificial Sequence
  Description of Artificial Sequence: Synthetic oligonucleotide
atggtggctgaaaggaacagtttgagaaacagcg

SEQ ID NO: 277350 - DNA, 33 bp, Artificial Sequence
  Description of Artificial Sequence: Synthetic oligonucleotide
tggtggctgaaaggaacagtttgagaaacagcg

SEQ ID NO: 277351 - DNA, 32 bp, Artificial Sequence
  Description of Artificial Sequence: Synthetic oligonucleotide
ggtggctgaaaggaacagtttgagaaacagcg

SEQ ID NO: 277352 - DNA, 33 bp, Artificial Sequence
  Description of Artificial Sequence: Synthetic oligonucleotide
gtggctgaaaggaacagtttgagaaacagcgag

SEQ ID NO: 277353 - DNA, 35 bp, Artificial Sequence
  Description of Artificial Sequence: Synthetic oligonucleotide
tggctgaaaggaacagtttgagaaacagcgagaag

SEQ ID NO: 277354 - DNA, 34 bp, Artificial Sequence
  Description of Artificial Sequence: Synthetic oligonucleotide
ggctgaaaggaacagtttgagaaacagcgagaag

SEQ ID NO: 277355 - DNA, 36 bp, Artificial Sequence
  Description of Artificial Sequence: Synthetic oligonucleotide
gctgaaaggaacagtttgagaaacagcgagaagttg

SEQ ID NO: 277356 - DNA, 38 bp, Artificial Sequence
  Description of Artificial Sequence: Synthetic oligonucleotide
ctgaaaggaacagtttgagaaacagcgagaagttgttg

SEQ ID NO: 277357 - DNA, 41 bp, Artificial Sequence
  Description of Artificial Sequence: Synthetic oligonucleotide
tgaaaggaacagtttgagaaacagcgagaagttgttgaaac

SEQ ID NO: 277358 - DNA, 40 bp, Artificial Sequence
  Description of Artificial Sequence: Synthetic oligonucleotide
gaaaggaacagtttgagaaacagcgagaagttgttgaaac

SEQ ID NO: 277359 - DNA, 40 bp, Artificial Sequence
  Description of Artificial Sequence: Synthetic oligonucleotide
aaaggaacagtttgagaaacagcgagaagttgttgaaacc

SEQ ID NO: 277360 - DNA, 39 bp, Artificial Sequence
  Description of Artificial Sequence: Synthetic oligonucleotide
aaggaacagtttgagaaacagcgagaagttgttgaaacc

SEQ ID NO: 277361 - DNA, 38 bp, Artificial Sequence
  Description of Artificial Sequence: Synthetic oligonucleotide
aggaacagtttgagaaacagcgagaagttgttgaaacc

SEQ ID NO: 277362 - DNA, 37 bp, Artificial Sequence
  Description of Artificial Sequence: Synthetic oligonucleotide
ggaacagtttgagaaacagcgagaagttgttgaaacc

SEQ ID NO: 277363 - DNA, 37 bp, Artificial Sequence
  Description of Artificial Sequence: Synthetic oligonucleotide
gaacagtttgagaaacagcgagaagttgttgaaaccg

SEQ ID NO: 277364 - DNA, 37 bp, Artificial Sequence
  Description of Artificial Sequence: Synthetic oligonucleotide
aacagtttgagaaacagcgagaagttgttgaaaccgc

SEQ ID NO: 277365 - DNA, 36 bp, Artificial Sequence
  Description of Artificial Sequence: Synthetic oligonucleotide
acagtttgagaaacagcgagaagttgttgaaaccgc

SEQ ID NO: 277366 - DNA, 35 bp, Artificial Sequence
  Description of Artificial Sequence: Synthetic oligonucleotide
cagtttgagaaacagcgagaagttgttgaaaccgc

SEQ ID NO: 277367 - DNA, 39 bp, Artificial Sequence
  Description of Artificial Sequence: Synthetic oligonucleotide
agtttgagaaacagcgagaagttgttgaaaccgcattac

SEQ ID NO: 277368 - DNA, 38 bp, Artificial Sequence
  Description of Artificial Sequence: Synthetic oligonucleotide
gtttgagaaacagcgagaagttgttgaaaccgcattac

SEQ ID NO: 277369 - DNA, 40 bp, Artificial Sequence
  Description of Artificial Sequence: Synthetic oligonucleotide
tttgagaaacagcgagaagttgttgaaaccgcattacttc

SEQ ID NO: 277370 - DNA, 39 bp, Artificial Sequence
  Description of Artificial Sequence: Synthetic oligonucleotide
ttgagaaacagcgagaagttgttgaaaccgcattacttc

SEQ ID NO: 277371 - DNA, 38 bp, Artificial Sequence
  Description of Artificial Sequence: Synthetic oligonucleotide
tgagaaacagcgagaagttgttgaaaccgcattacttc

SEQ ID NO: 277372 - DNA, 37 bp, Artificial Sequence
  Description of Artificial Sequence: Synthetic oligonucleotide
gagaaacagcgagaagttgttgaaaccgcattacttc

SEQ ID NO: 277373 - DNA, 39 bp, Artificial Sequence
  Description of Artificial Sequence: Synthetic oligonucleotide
agaaacagcgagaagttgttgaaaccgcattacttcttc

SEQ ID NO: 277374 - DNA, 38 bp, Artificial Sequence
  Description of Artificial Sequence: Synthetic oligonucleotide
gaaacagcgagaagttgttgaaaccgcattacttcttc

SEQ ID NO: 277375 - DNA, 38 bp, Artificial Sequence
  Description of Artificial Sequence: Synthetic oligonucleotide
aaacagcgagaagttgttgaaaccgcattacttcttcc

SEQ ID NO: 277376 - DNA, 37 bp, Artificial Sequence
  Description of Artificial Sequence: Synthetic oligonucleotide
aacagcgagaagttgttgaaaccgcattacttcttcc

SEQ ID NO: 277377 - DNA, 36 bp, Artificial Sequence
  Description of Artificial Sequence: Synthetic oligonucleotide
acagcgagaagttgttgaaaccgcattacttcttcc

SEQ ID NO: 277378 - DNA, 35 bp, Artificial Sequence
  Description of Artificial Sequence: Synthetic oligonucleotide
cagcgagaagttgttgaaaccgcattacttcttcc

SEQ ID NO: 277379 - DNA, 36 bp, Artificial Sequence
  Description of Artificial Sequence: Synthetic oligonucleotide
agcgagaagttgttgaaaccgcattacttcttccag

SEQ ID NO: 277380 - DNA, 35 bp, Artificial Sequence
  Description of Artificial Sequence: Synthetic oligonucleotide
gcgagaagttgttgaaaccgcattacttcttccag

SEQ ID NO: 277381 - DNA, 36 bp, Artificial Sequence
  Description of Artificial Sequence: Synthetic oligonucleotide
cgagaagttgttgaaaccgcattacttcttccagag

SEQ ID NO: 277382 - DNA, 37 bp, Artificial Sequence
  Description of Artificial Sequence: Synthetic oligonucleotide
gagaagttgttgaaaccgcattacttcttccagagag

SEQ ID NO: 277383 - DNA, 37 bp, Artificial Sequence
  Description of Artificial Sequence: Synthetic oligonucleotide
agaagttgttgaaaccgcattacttcttccagagagc

SEQ ID NO: 277384 - DNA, 36 bp, Artificial Sequence
  Description of Artificial Sequence: Synthetic oligonucleotide
gaagttgttgaaaccgcattacttcttccagagagc

SEQ ID NO: 277385 - DNA, 39 bp, Artificial Sequence
  Description of Artificial Sequence: Synthetic oligonucleotide
aagttgttgaaaccgcattacttcttccagagagctttg

SEQ ID NO: 277386 - DNA, 38 bp, Artificial Sequence
  Description of Artificial Sequence: Synthetic oligonucleotide
agttgttgaaaccgcattacttcttccagagagctttg

SEQ ID NO: 277387 - DNA, 37 bp, Artificial Sequence
  Description of Artificial Sequence: Synthetic oligonucleotide
gttgttgaaaccgcattacttcttccagagagctttg

SEQ ID NO: 277388 - DNA, 38 bp, Artificial Sequence
  Description of Artificial Sequence: Synthetic oligonucleotide
ttgttgaaaccgcattacttcttccagagagctttgtg

SEQ ID NO: 277389 - DNA, 37 bp, Artificial Sequence
  Description of Artificial Sequence: Synthetic oligonucleotide
tgttgaaaccgcattacttcttccagagagctttgtg

SEQ ID NO: 277390 - DNA, 36 bp, Artificial Sequence
  Description of Artificial Sequence: Synthetic oligonucleotide
gttgaaaccgcattacttcttccagagagctttgtg

SEQ ID NO: 277391 - DNA, 38 bp, Artificial Sequence
  Description of Artificial Sequence: Synthetic oligonucleotide
ttgaaaccgcattacttcttccagagagctttgtgaac

SEQ ID NO: 277392 - DNA, 37 bp, Artificial Sequence
  Description of Artificial Sequence: Synthetic oligonucleotide
tgaaaccgcattacttcttccagagagctttgtgaac

SEQ ID NO: 277393 - DNA, 36 bp, Artificial Sequence
  Description of Artificial Sequence: Synthetic oligonucleotide
gaaaccgcattacttcttccagagagctttgtgaac

SEQ ID NO: 277394 - DNA, 36 bp, Artificial Sequence
  Description of Artificial Sequence: Synthetic oligonucleotide
aaaccgcattacttcttccagagagctttgtgaacg

SEQ ID NO: 277395 - DNA, 35 bp, Artificial Sequence
  Description of Artificial Sequence: Synthetic oligonucleotide
aaccgcattacttcttccagagagctttgtgaacg

SEQ ID NO: 277396 - DNA, 34 bp, Artificial Sequence
  Description of Artificial Sequence: Synthetic oligonucleotide
accgcattacttcttccagagagctttgtgaacg

SEQ ID NO: 277397 - DNA, 33 bp, Artificial Sequence
  Description of Artificial Sequence: Synthetic oligonucleotide
ccgcattacttcttccagagagctttgtgaacg

SEQ ID NO: 277398 - DNA, 35 bp, Artificial Sequence
  Description of Artificial Sequence: Synthetic oligonucleotide
cgcattacttcttccagagagctttgtgaacgttg

SEQ ID NO: 277399 - DNA, 35 bp, Artificial Sequence
  Description of Artificial Sequence: Synthetic oligonucleotide
gcattacttcttccagagagctttgtgaacgttgg

SEQ ID NO: 277400 - DNA, 35 bp, Artificial Sequence
  Description of Artificial Sequence: Synthetic oligonucleotide
cattacttcttccagagagctttgtgaacgttggc

SEQ ID NO: 277401 - DNA, 38 bp, Artificial Sequence
  Description of Artificial Sequence: Synthetic oligonucleotide
attacttcttccagagagctttgtgaacgttggcattg

SEQ ID NO: 277402 - DNA, 37 bp, Artificial Sequence
  Description of Artificial Sequence: Synthetic oligonucleotide
ttacttcttccagagagctttgtgaacgttggcattg

SEQ ID NO: 277403 - DNA, 36 bp, Artificial Sequence
  Description of Artificial Sequence: Synthetic oligonucleotide
tacttcttccagagagctttgtgaacgttggcattg

SEQ ID NO: 277404 - DNA, 35 bp, Artificial Sequence
  Description of Artificial Sequence: Synthetic oligonucleotide
acttcttccagagagctttgtgaacgttggcattg

SEQ ID NO: 277405 - DNA, 34 bp, Artificial Sequence
  Description of Artificial Sequence: Synthetic oligonucleotide
cttcttccagagagctttgtgaacgttggcattg

SEQ ID NO: 277406 - DNA, 35 bp, Artificial Sequence
  Description of Artificial Sequence: Synthetic oligonucleotide
ttcttccagagagctttgtgaacgttggcattgtg

SEQ ID NO: 277407 - DNA, 34 bp, Artificial Sequence
  Description of Artificial Sequence: Synthetic oligonucleotide
tcttccagagagctttgtgaacgttggcattgtg

SEQ ID NO: 277408 - DNA, 33 bp, Artificial Sequence
  Description of Artificial Sequence: Synthetic oligonucleotide
cttccagagagctttgtgaacgttggcattgtg

SEQ ID NO: 277409 - DNA, 33 bp, Artificial Sequence
  Description of Artificial Sequence: Synthetic oligonucleotide
ttccagagagctttgtgaacgttggcattgtgc

SEQ ID NO: 277410 - DNA, 32 bp, Artificial Sequence
  Description of Artificial Sequence: Synthetic oligonucleotide
tccagagagctttgtgaacgttggcattgtgc

SEQ ID NO: 277411 - DNA, 31 bp, Artificial Sequence
  Description of Artificial Sequence: Synthetic oligonucleotide
ccagagagctttgtgaacgttggcattgtgc

SEQ ID NO: 277412 - DNA, 31 bp, Artificial Sequence
  Description of Artificial Sequence: Synthetic oligonucleotide
cagagagctttgtgaacgttggcattgtgcc

SEQ ID NO: 277413 - DNA, 32 bp, Artificial Sequence
  Description of Artificial Sequence: Synthetic oligonucleotide
agagagctttgtgaacgttggcattgtgcctc

SEQ ID NO: 277414 - DNA, 31 bp, Artificial Sequence
  Description of Artificial Sequence: Synthetic oligonucleotide
gagagctttgtgaacgttggcattgtgcctc

SEQ ID NO: 277415 - DNA, 31 bp, Artificial Sequence
  Description of Artificial Sequence: Synthetic oligonucleotide
agagctttgtgaacgttggcattgtgcctcc

SEQ ID NO: 277416 - DNA, 30 bp, Artificial Sequence
  Description of Artificial Sequence: Synthetic oligonucleotide
gagctttgtgaacgttggcattgtgcctcc

SEQ ID NO: 277417 - DNA, 30 bp, Artificial Sequence
  Description of Artificial Sequence: Synthetic oligonucleotide
agctttgtgaacgttggcattgtgcctccc

SEQ ID NO: 277418 - DNA, 29 bp, Artificial Sequence
  Description of Artificial Sequence: Synthetic oligonucleotide
gctttgtgaacgttggcattgtgcctccc

SEQ ID NO: 277419 - DNA, 31 bp, Artificial Sequence
  Description of Artificial Sequence: Synthetic oligonucleotide
ctttgtgaacgttggcattgtgcctcccaac

SEQ ID NO: 277420 - DNA, 31 bp, Artificial Sequence
  Description of Artificial Sequence: Synthetic oligonucleotide
tttgtgaacgttggcattgtgcctcccaacg

SEQ ID NO: 277421 - DNA, 30 bp, Artificial Sequence
  Description of Artificial Sequence: Synthetic oligonucleotide
ttgtgaacgttggcattgtgcctcccaacg

SEQ ID NO: 277422 - DNA, 29 bp, Artificial Sequence
  Description of Artificial Sequence: Synthetic oligonucleotide
tgtgaacgttggcattgtgcctcccaacg

SEQ ID NO: 277423 - DNA, 28 bp, Artificial Sequence
  Description of Artificial Sequence: Synthetic oligonucleotide
gtgaacgttggcattgtgcctcccaacg

SEQ ID NO: 277424 - DNA, 28 bp, Artificial Sequence
  Description of Artificial Sequence: Synthetic oligonucleotide
tgaacgttggcattgtgcctcccaacgg

SEQ ID NO: 277425 - DNA, 27 bp, Artificial Sequence
  Description of Artificial Sequence: Synthetic oligonucleotide
gaacgttggcattgtgcctcccaacgg

SEQ ID NO: 277426 - DNA, 27 bp, Artificial Sequence
  Description of Artificial Sequence: Synthetic oligonucleotide
aacgttggcattgtgcctcccaacggc

SEQ ID NO: 277427 - DNA, 26 bp, Artificial Sequence
  Description of Artificial Sequence: Synthetic oligonucleotide
acgttggcattgtgcctcccaacggc

SEQ ID NO: 277428 - DNA, 25 bp, Artificial Sequence
  Description of Artificial Sequence: Synthetic oligonucleotide
cgttggcattgtgcctcccaacggc

SEQ ID NO: 277429 - DNA, 26 bp, Artificial Sequence
  Description of Artificial Sequence: Synthetic oligonucleotide
gttggcattgtgcctcccaacggcgt

SEQ ID NO: 277430 - DNA, 26 bp, Artificial Sequence
  Description of Artificial Sequence: Synthetic oligonucleotide
ttggcattgtgcctcccaacggcgtg

SEQ ID NO: 277431 - DNA, 25 bp, Artificial Sequence
  Description of Artificial Sequence: Synthetic oligonucleotide
tggcattgtgcctcccaacggcgtg

SEQ ID NO: 277432 - DNA, 24 bp, Artificial Sequence
  Description of Artificial Sequence: Synthetic oligonucleotide
ggcattgtgcctcccaacggcgtg

SEQ ID NO: 277433 - DNA, 25 bp, Artificial Sequence
  Description of Artificial Sequence: Synthetic oligonucleotide
gcattgtgcctcccaacggcgtgct

SEQ ID NO: 277434 - DNA, 25 bp, Artificial Sequence
  Description of Artificial Sequence: Synthetic oligonucleotide
cattgtgcctcccaacggcgtgctg

SEQ ID NO: 277435 - DNA, 26 bp, Artificial Sequence
  Description of Artificial Sequence: Synthetic oligonucleotide
attgtgcctcccaacggcgtgctggt

SEQ ID NO: 277436 - DNA, 25 bp, Artificial Sequence
  Description of Artificial Sequence: Synthetic oligonucleotide
ttgtgcctcccaacggcgtgctggt

SEQ ID NO: 277437 - DNA, 24 bp, Artificial Sequence
  Description of Artificial Sequence: Synthetic oligonucleotide
tgtgcctcccaacggcgtgctggt

SEQ ID NO: 277438 - DNA, 23 bp, Artificial Sequence
  Description of Artificial Sequence: Synthetic oligonucleotide
gtgcctcccaacggcgtgctggt

SEQ ID NO: 277439 - DNA, 26 bp, Artificial Sequence
  Description of Artificial Sequence: Synthetic oligonucleotide
tgcctcccaacggcgtgctggtcttt

SEQ ID NO: 277440 - DNA, 25 bp, Artificial Sequence
  Description of Artificial Sequence: Synthetic oligonucleotide
gcctcccaacggcgtgctggtcttt

SEQ ID NO: 277441 - DNA, 25 bp, Artificial Sequence
  Description of Artificial Sequence: Synthetic oligonucleotide
cctcccaacggcgtgctggtctttg

SEQ ID NO: 277442 - DNA, 26 bp, Artificial Sequence
  Description of Artificial Sequence: Synthetic oligonucleotide
ctcccaacggcgtgctggtctttggt

SEQ ID NO: 277443 - DNA, 26 bp, Artificial Sequence
  Description of Artificial Sequence: Synthetic oligonucleotide
tcccaacggcgtgctggtctttggtc

SEQ ID NO: 277444 - DNA, 25 bp, Artificial Sequence
  Description of Artificial Sequence: Synthetic oligonucleotide
cccaacggcgtgctggtctttggtc

SEQ ID NO: 277445 - DNA, 26 bp, Artificial Sequence
  Description of Artificial Sequence: Synthetic oligonucleotide
ccaacggcgtgctggtctttggtcga

SEQ ID NO: 277446 - DNA, 26 bp, Artificial Sequence
  Description of Artificial Sequence: Synthetic oligonucleotide
caacggcgtgctggtctttggtcgac

SEQ ID NO: 277447 - DNA, 26 bp, Artificial Sequence
  Description of Artificial Sequence: Synthetic oligonucleotide
aacggcgtgctggtctttggtcgacc

SEQ ID NO: 277448 - DNA, 25 bp, Artificial Sequence
  Description of Artificial Sequence: Synthetic oligonucleotide
acggcgtgctggtctttggtcgacc

SEQ ID NO: 277449 - DNA, 24 bp, Artificial Sequence
  Description of Artificial Sequence: Synthetic oligonucleotide
cggcgtgctggtctttggtcgacc

SEQ ID NO: 277450 - DNA, 24 bp, Artificial Sequence
  Description of Artificial Sequence: Synthetic oligonucleotide
ggcgtgctggtctttggtcgaccc

SEQ ID NO: 277451 - DNA, 24 bp, Artificial Sequence
  Description of Artificial Sequence: Synthetic oligonucleotide
gcgtgctggtctttggtcgacccg

SEQ ID NO: 277452 - DNA, 26 bp, Artificial Sequence
  Description of Artificial Sequence: Synthetic oligonucleotide
cgtgctggtctttggtcgacccggta

SEQ ID NO: 277453 - DNA, 27 bp, Artificial Sequence
  Description of Artificial Sequence: Synthetic oligonucleotide
gtgctggtctttggtcgacccggtact

SEQ ID NO: 277454 - DNA, 27 bp, Artificial Sequence
  Description of Artificial Sequence: Synthetic oligonucleotide
tgctggtctttggtcgacccggtactg

SEQ ID NO: 277455 - DNA, 26 bp, Artificial Sequence
  Description of Artificial Sequence: Synthetic oligonucleotide
gctggtctttggtcgacccggtactg

SEQ ID NO: 277456 - DNA, 26 bp, Artificial Sequence
  Description of Artificial Sequence: Synthetic oligonucleotide
ctggtctttggtcgacccggtactgg

SEQ ID NO: 277457 - DNA, 27 bp, Artificial Sequence
  Description of Artificial Sequence: Synthetic oligonucleotide
tggtctttggtcgacccggtactggca

SEQ ID NO: 277458 - DNA, 27 bp, Artificial Sequence
  Description of Artificial Sequence: Synthetic oligonucleotide
ggtctttggtcgacccggtactggcaa

SEQ ID NO: 277459 - DNA, 27 bp, Artificial Sequence
  Description of Artificial Sequence: Synthetic oligonucleotide
gtctttggtcgacccggtactggcaag

SEQ ID NO: 277460 - DNA, 28 bp, Artificial Sequence
  Description of Artificial Sequence: Synthetic oligonucleotide
tctttggtcgacccggtactggcaagac

SEQ ID NO: 277461 - DNA, 27 bp, Artificial Sequence
  Description of Artificial Sequence: Synthetic oligonucleotide
ctttggtcgacccggtactggcaagac

SEQ ID NO: 277462 - DNA, 28 bp, Artificial Sequence
  Description of Artificial Sequence: Synthetic oligonucleotide
tttggtcgacccggtactggcaagacag

SEQ ID NO: 277463 - DNA, 27 bp, Artificial Sequence
  Description of Artificial Sequence: Synthetic oligonucleotide
ttggtcgacccggtactggcaagacag

SEQ ID NO: 277464 - DNA, 27 bp, Artificial Sequence
  Description of Artificial Sequence: Synthetic oligonucleotide
tggtcgacccggtactggcaagacagt

SEQ ID NO: 277465 - DNA, 26 bp, Artificial Sequence
  Description of Artificial Sequence: Synthetic oligonucleotide
ggtcgacccggtactggcaagacagt

SEQ ID NO: 277466 - DNA, 27 bp, Artificial Sequence
  Description of Artificial Sequence: Synthetic oligonucleotide
gtcgacccggtactggcaagacagtct

SEQ ID NO: 277467 - DNA, 27 bp, Artificial Sequence
  Description of Artificial Sequence: Synthetic oligonucleotide
tcgacccggtactggcaagacagtctg

SEQ ID NO: 277468 - DNA, 27 bp, Artificial Sequence
  Description of Artificial Sequence: Synthetic oligonucleotide
cgacccggtactggcaagacagtctgt

SEQ ID NO: 277469 - DNA, 27 bp, Artificial Sequence
  Description of Artificial Sequence: Synthetic oligonucleotide
gacccggtactggcaagacagtctgtg

SEQ ID NO: 277470 - DNA, 27 bp, Artificial Sequence
  Description of Artificial Sequence: Synthetic oligonucleotide
acccggtactggcaagacagtctgtgc

SEQ ID NO: 277471 - DNA, 26 bp, Artificial Sequence
  Description of Artificial Sequence: Synthetic oligonucleotide
cccggtactggcaagacagtctgtgc

SEQ ID NO: 277472 - DNA, 26 bp, Artificial Sequence
  Description of Artificial Sequence: Synthetic oligonucleotide
ccggtactggcaagacagtctgtgcg

SEQ ID NO: 277473 - DNA, 26 bp, Artificial Sequence
  Description of Artificial Sequence: Synthetic oligonucleotide
cggtactggcaagacagtctgtgcgc

SEQ ID NO: 277474 - DNA, 26 bp, Artificial Sequence
  Description of Artificial Sequence: Synthetic oligonucleotide
ggtactggcaagacagtctgtgcgcc

SEQ ID NO: 277475 - DNA, 26 bp, Artificial Sequence
  Description of Artificial Sequence: Synthetic oligonucleotide
gtactggcaagacagtctgtgcgccg

SEQ ID NO: 277476 - DNA, 26 bp, Artificial Sequence
  Description of Artificial Sequence: Synthetic oligonucleotide
tactggcaagacagtctgtgcgccgg

SEQ ID NO: 277477 - DNA, 25 bp, Artificial Sequence
  Description of Artificial Sequence: Synthetic oligonucleotide
actggcaagacagtctgtgcgccgg

SEQ ID NO: 277478 - DNA, 24 bp, Artificial Sequence
  Description of Artificial Sequence: Synthetic oligonucleotide
ctggcaagacagtctgtgcgccgg

SEQ ID NO: 277479 - DNA, 25 bp, Artificial Sequence
  Description of Artificial Sequence: Synthetic oligonucleotide
tggcaagacagtctgtgcgccggca

SEQ ID NO: 277480 - DNA, 24 bp, Artificial Sequence
  Description of Artificial Sequence: Synthetic oligonucleotide
ggcaagacagtctgtgcgccggca

SEQ ID NO: 277481 - DNA, 26 bp, Artificial Sequence
  Description of Artificial Sequence: Synthetic oligonucleotide
gcaagacagtctgtgcgccggcagtt

SEQ ID NO: 277482 - DNA, 26 bp, Artificial Sequence
  Description of Artificial Sequence: Synthetic oligonucleotide
caagacagtctgtgcgccggcagttg

SEQ ID NO: 277483 - DNA, 27 bp, Artificial Sequence
  Description of Artificial Sequence: Synthetic oligonucleotide
aagacagtctgtgcgccggcagttgca

SEQ ID NO: 277484 - DNA, 27 bp, Artificial Sequence
  Description of Artificial Sequence: Synthetic oligonucleotide
agacagtctgtgcgccggcagttgcaa

SEQ ID NO: 277485 - DNA, 27 bp, Artificial Sequence
  Description of Artificial Sequence: Synthetic oligonucleotide
gacagtctgtgcgccggcagttgcaaa

SEQ ID NO: 277486 - DNA, 28 bp, Artificial Sequence
  Description of Artificial Sequence: Synthetic oligonucleotide
acagtctgtgcgccggcagttgcaaatc

SEQ ID NO: 277487 - DNA, 27 bp, Artificial Sequence
  Description of Artificial Sequence: Synthetic oligonucleotide
cagtctgtgcgccggcagttgcaaatc

SEQ ID NO: 277488 - DNA, 27 bp, Artificial Sequence
  Description of Artificial Sequence: Synthetic oligonucleotide
agtctgtgcgccggcagttgcaaatcg

SEQ ID NO: 277489 - DNA, 26 bp, Artificial Sequence
  Description of Artificial Sequence: Synthetic oligonucleotide
gtctgtgcgccggcagttgcaaatcg

SEQ ID NO: 277490 - DNA, 27 bp, Artificial Sequence
  Description of Artificial Sequence: Synthetic oligonucleotide
tctgtgcgccggcagttgcaaatcgga

SEQ ID NO: 277491 - DNA, 26 bp, Artificial Sequence
  Description of Artificial Sequence: Synthetic oligonucleotide
ctgtgcgccggcagttgcaaatcgga

SEQ ID NO: 277492 - DNA, 27 bp, Artificial Sequence
  Description of Artificial Sequence: Synthetic oligonucleotide
tgtgcgccggcagttgcaaatcggact

SEQ ID NO: 277493 - DNA, 26 bp, Artificial Sequence
  Description of Artificial Sequence: Synthetic oligonucleotide
gtgcgccggcagttgcaaatcggact

SEQ ID NO: 277494 - DNA, 27 bp, Artificial Sequence
  Description of Artificial Sequence: Synthetic oligonucleotide
tgcgccggcagttgcaaatcggactca

SEQ ID NO: 277495 - DNA, 27 bp, Artificial Sequence
  Description of Artificial Sequence: Synthetic oligonucleotide
gcgccggcagttgcaaatcggactcat

SEQ ID NO: 277496 - DNA, 27 bp, Artificial Sequence
  Description of Artificial Sequence: Synthetic oligonucleotide
cgccggcagttgcaaatcggactcatg

SEQ ID NO: 277497 - DNA, 27 bp, Artificial Sequence
  Description of Artificial Sequence: Synthetic oligonucleotide
gccggcagttgcaaatcggactcatgc

SEQ ID NO: 277498 - DNA, 27 bp, Artificial Sequence
  Description of Artificial Sequence: Synthetic oligonucleotide
ccggcagttgcaaatcggactcatgcg

SEQ ID NO: 277499 - DNA, 28 bp, Artificial Sequence
  Description of Artificial Sequence: Synthetic oligonucleotide
cggcagttgcaaatcggactcatgcgtg

SEQ ID NO: 277500 - DNA, 28 bp, Artificial Sequence
  Description of Artificial Sequence: Synthetic oligonucleotide
ggcagttgcaaatcggactcatgcgtgc

SEQ ID NO: 277501 - DNA, 30 bp, Artificial Sequence
  Description of Artificial Sequence: Synthetic oligonucleotide
gcagttgcaaatcggactcatgcgtgctac

SEQ ID NO: 277502 - DNA, 33 bp, Artificial Sequence
  Description of Artificial Sequence: Synthetic oligonucleotide
cagttgcaaatcggactcatgcgtgctacattc

SEQ ID NO: 277503 - DNA, 33 bp, Artificial Sequence
  Description of Artificial Sequence: Synthetic oligonucleotide
agttgcaaatcggactcatgcgtgctacattcg

SEQ ID NO: 277504 - DNA, 32 bp, Artificial Sequence
  Description of Artificial Sequence: Synthetic oligonucleotide
gttgcaaatcggactcatgcgtgctacattcg

SEQ ID NO: 277505 - DNA, 33 bp, Artificial Sequence
  Description of Artificial Sequence: Synthetic oligonucleotide
ttgcaaatcggactcatgcgtgctacattcgag

SEQ ID NO: 277506 - DNA, 32 bp, Artificial Sequence
  Description of Artificial Sequence: Synthetic oligonucleotide
tgcaaatcggactcatgcgtgctacattcgag

SEQ ID NO: 277507 - DNA, 31 bp, Artificial Sequence
  Description of Artificial Sequence: Synthetic oligonucleotide
gcaaatcggactcatgcgtgctacattcgag

SEQ ID NO: 277508 - DNA, 36 bp, Artificial Sequence
  Description of Artificial Sequence: Synthetic oligonucleotide
caaatcggactcatgcgtgctacattcgagtaattg

SEQ ID NO: 277509 - DNA, 36 bp, Artificial Sequence
  Description of Artificial Sequence: Synthetic oligonucleotide
aaatcggactcatgcgtgctacattcgagtaattgg

SEQ ID NO: 277510 - DNA, 35 bp, Artificial Sequence
  Description of Artificial Sequence: Synthetic oligonucleotide
aatcggactcatgcgtgctacattcgagtaattgg

SEQ ID NO: 277511 - DNA, 34 bp, Artificial Sequence
  Description of Artificial Sequence: Synthetic oligonucleotide
atcggactcatgcgtgctacattcgagtaattgg

SEQ ID NO: 277512 - DNA, 33 bp, Artificial Sequence
  Description of Artificial Sequence: Synthetic oligonucleotide
tcggactcatgcgtgctacattcgagtaattgg

SEQ ID NO: 277513 - DNA, 32 bp, Artificial Sequence
  Description of Artificial Sequence: Synthetic oligonucleotide
cggactcatgcgtgctacattcgagtaattgg

SEQ ID NO: 277514 - DNA, 34 bp, Artificial Sequence
  Description of Artificial Sequence: Synthetic oligonucleotide
ggactcatgcgtgctacattcgagtaattggatc

SEQ ID NO: 277515 - DNA, 35 bp, Artificial Sequence
  Description of Artificial Sequence: Synthetic oligonucleotide
gactcatgcgtgctacattcgagtaattggatctc

SEQ ID NO: 277516 - DNA, 36 bp, Artificial Sequence
  Description of Artificial Sequence: Synthetic oligonucleotide
actcatgcgtgctacattcgagtaattggatctcag

SEQ ID NO: 277517 - DNA, 35 bp, Artificial Sequence
  Description of Artificial Sequence: Synthetic oligonucleotide
ctcatgcgtgctacattcgagtaattggatctcag

SEQ ID NO: 277518 - DNA, 35 bp, Artificial Sequence
  Description of Artificial Sequence: Synthetic oligonucleotide
tcatgcgtgctacattcgagtaattggatctcagc

SEQ ID NO: 277519 - DNA, 34 bp, Artificial Sequence
  Description of Artificial Sequence: Synthetic oligonucleotide
catgcgtgctacattcgagtaattggatctcagc

SEQ ID NO: 277520 - DNA, 36 bp, Artificial Sequence
  Description of Artificial Sequence: Synthetic oligonucleotide
atgcgtgctacattcgagtaattggatctcagcttg

SEQ ID NO: 277521 - DNA, 35 bp, Artificial Sequence
  Description of Artificial Sequence: Synthetic oligonucleotide
tgcgtgctacattcgagtaattggatctcagcttg

SEQ ID NO: 277522 - DNA, 34 bp, Artificial Sequence
  Description of Artificial Sequence: Synthetic oligonucleotide
gcgtgctacattcgagtaattggatctcagcttg

SEQ ID NO: 277523 - DNA, 36 bp, Artificial Sequence
  Description of Artificial Sequence: Synthetic oligonucleotide
cgtgctacattcgagtaattggatctcagcttgtac

SEQ ID NO: 277524 - DNA, 37 bp, Artificial Sequence
  Description of Artificial Sequence: Synthetic oligonucleotide
gtgctacattcgagtaattggatctcagcttgtactg

SEQ ID NO: 277525 - DNA, 42 bp, Artificial Sequence
  Description of Artificial Sequence: Synthetic oligonucleotide
tgctacattcgagtaattggatctcagcttgtactgaaatac

SEQ ID NO: 277526 - DNA, 41 bp, Artificial Sequence
  Description of Artificial Sequence: Synthetic oligonucleotide
gctacattcgagtaattggatctcagcttgtactgaaatac

SEQ ID NO: 277527 - DNA, 41 bp, Artificial Sequence
  Description of Artificial Sequence: Synthetic oligonucleotide
ctacattcgagtaattggatctcagcttgtactgaaatacg

SEQ ID NO: 277528 - DNA, 42 bp, Artificial Sequence
  Description of Artificial Sequence: Synthetic oligonucleotide
tacattcgagtaattggatctcagcttgtactgaaatacgtg

SEQ ID NO: 277529 - DNA, 41 bp, Artificial Sequence
  Description of Artificial Sequence: Synthetic oligonucleotide
acattcgagtaattggatctcagcttgtactgaaatacgtg

SEQ ID NO: 277530 - DNA, 40 bp, Artificial Sequence
  Description of Artificial Sequence: Synthetic oligonucleotide
cattcgagtaattggatctcagcttgtactgaaatacgtg

SEQ ID NO: 277531 - DNA, 40 bp, Artificial Sequence
  Description of Artificial Sequence: Synthetic oligonucleotide
attcgagtaattggatctcagcttgtactgaaatacgtgg

SEQ ID NO: 277532 - DNA, 39 bp, Artificial Sequence
  Description of Artificial Sequence: Synthetic oligonucleotide
ttcgagtaattggatctcagcttgtactgaaatacgtgg

SEQ ID NO: 277533 - DNA, 38 bp, Artificial Sequence
  Description of Artificial Sequence: Synthetic oligonucleotide
tcgagtaattggatctcagcttgtactgaaatacgtgg

SEQ ID NO: 277534 - DNA, 37 bp, Artificial Sequence
  Description of Artificial Sequence: Synthetic oligonucleotide
cgagtaattggatctcagcttgtactgaaatacgtgg

SEQ ID NO: 277535 - DNA, 37 bp, Artificial Sequence
  Description of Artificial Sequence: Synthetic oligonucleotide
gagtaattggatctcagcttgtactgaaatacgtggg

SEQ ID NO: 277536 - DNA, 38 bp, Artificial Sequence
  Description of Artificial Sequence: Synthetic oligonucleotide
agtaattggatctcagcttgtactgaaatacgtgggtg

SEQ ID NO: 277537 - DNA, 37 bp, Artificial Sequence
  Description of Artificial Sequence: Synthetic oligonucleotide
gtaattggatctcagcttgtactgaaatacgtgggtg

SEQ ID NO: 277538 - DNA, 38 bp, Artificial Sequence
  Description of Artificial Sequence: Synthetic oligonucleotide
taattggatctcagcttgtactgaaatacgtgggtgag

SEQ ID NO: 277539 - DNA, 37 bp, Artificial Sequence
  Description of Artificial Sequence: Synthetic oligonucleotide
aattggatctcagcttgtactgaaatacgtgggtgag

SEQ ID NO: 277540 - DNA, 36 bp, Artificial Sequence
  Description of Artificial Sequence: Synthetic oligonucleotide
attggatctcagcttgtactgaaatacgtgggtgag

SEQ ID NO: 277541 - DNA, 35 bp, Artificial Sequence
  Description of Artificial Sequence: Synthetic oligonucleotide
ttggatctcagcttgtactgaaatacgtgggtgag

SEQ ID NO: 277542 - DNA, 34 bp, Artificial Sequence
  Description of Artificial Sequence: Synthetic oligonucleotide
tggatctcagcttgtactgaaatacgtgggtgag

SEQ ID NO: 277543 - DNA, 33 bp, Artificial Sequence
  Description of Artificial Sequence: Synthetic oligonucleotide
ggatctcagcttgtactgaaatacgtgggtgag

SEQ ID NO: 277544 - DNA, 33 bp, Artificial Sequence
  Description of Artificial Sequence: Synthetic oligonucleotide
gatctcagcttgtactgaaatacgtgggtgagg

SEQ ID NO: 277545 - DNA, 33 bp, Artificial Sequence
  Description of Artificial Sequence: Synthetic oligonucleotide
atctcagcttgtactgaaatacgtgggtgaggg

SEQ ID NO: 277546 - DNA, 32 bp, Artificial Sequence
  Description of Artificial Sequence: Synthetic oligonucleotide
tctcagcttgtactgaaatacgtgggtgaggg

SEQ ID NO: 277547 - DNA, 31 bp, Artificial Sequence
  Description of Artificial Sequence: Synthetic oligonucleotide
ctcagcttgtactgaaatacgtgggtgaggg

SEQ ID NO: 277548 - DNA, 31 bp, Artificial Sequence
  Description of Artificial Sequence: Synthetic oligonucleotide
tcagcttgtactgaaatacgtgggtgagggg

SEQ ID NO: 277549 - DNA, 30 bp, Artificial Sequence
  Description of Artificial Sequence: Synthetic oligonucleotide
cagcttgtactgaaatacgtgggtgagggg

SEQ ID NO: 277550 - DNA, 30 bp, Artificial Sequence
  Description of Artificial Sequence: Synthetic oligonucleotide
agcttgtactgaaatacgtgggtgaggggc

SEQ ID NO: 277551 - DNA, 29 bp, Artificial Sequence
  Description of Artificial Sequence: Synthetic oligonucleotide
gcttgtactgaaatacgtgggtgaggggc

SEQ ID NO: 277552 - DNA, 29 bp, Artificial Sequence
  Description of Artificial Sequence: Synthetic oligonucleotide
cttgtactgaaatacgtgggtgaggggcc

SEQ ID NO: 277553 - DNA, 30 bp, Artificial Sequence
  Description of Artificial Sequence: Synthetic oligonucleotide
ttgtactgaaatacgtgggtgaggggcctc

SEQ ID NO: 277554 - DNA, 29 bp, Artificial Sequence
  Description of Artificial Sequence: Synthetic oligonucleotide
tgtactgaaatacgtgggtgaggggcctc

SEQ ID NO: 277555 - DNA, 28 bp, Artificial Sequence
  Description of Artificial Sequence: Synthetic oligonucleotide
gtactgaaatacgtgggtgaggggcctc

SEQ ID NO: 277556 - DNA, 28 bp, Artificial Sequence
  Description of Artificial Sequence: Synthetic oligonucleotide
tactgaaatacgtgggtgaggggcctcg

SEQ ID NO: 277557 - DNA, 27 bp, Artificial Sequence
  Description of Artificial Sequence: Synthetic oligonucleotide
actgaaatacgtgggtgaggggcctcg

SEQ ID NO: 277558 - DNA, 27 bp, Artificial Sequence
  Description of Artificial Sequence: Synthetic oligonucleotide
ctgaaatacgtgggtgaggggcctcga

SEQ ID NO: 277559 - DNA, 29 bp, Artificial Sequence
  Description of Artificial Sequence: Synthetic oligonucleotide
tgaaatacgtgggtgaggggcctcgaatg

SEQ ID NO: 277560 - DNA, 28 bp, Artificial Sequence
  Description of Artificial Sequence: Synthetic oligonucleotide
gaaatacgtgggtgaggggcctcgaatg

SEQ ID NO: 277561 - DNA, 28 bp, Artificial Sequence
  Description of Artificial Sequence: Synthetic oligonucleotide
aaatacgtgggtgaggggcctcgaatgg

SEQ ID NO: 277562 - DNA, 27 bp, Artificial Sequence
  Description of Artificial Sequence: Synthetic oligonucleotide
aatacgtgggtgaggggcctcgaatgg

SEQ ID NO: 277563 - DNA, 27 bp, Artificial Sequence
  Description of Artificial Sequence: Synthetic oligonucleotide
atacgtgggtgaggggcctcgaatgga

SEQ ID NO: 277564 - DNA, 27 bp, Artificial Sequence
  Description of Artificial Sequence: Synthetic oligonucleotide
tacgtgggtgaggggcctcgaatggat

SEQ ID NO: 277565 - DNA, 26 bp, Artificial Sequence
  Description of Artificial Sequence: Synthetic oligonucleotide
acgtgggtgaggggcctcgaatggat

SEQ ID NO: 277566 - DNA, 25 bp, Artificial Sequence
  Description of Artificial Sequence: Synthetic oligonucleotide
cgtgggtgaggggcctcgaatggat

SEQ ID NO: 277567 - DNA, 25 bp, Artificial Sequence
  Description of Artificial Sequence: Synthetic oligonucleotide
gtgggtgaggggcctcgaatggatc

SEQ ID NO: 277568 - DNA, 26 bp, Artificial Sequence
  Description of Artificial Sequence: Synthetic oligonucleotide
tgggtgaggggcctcgaatggatcgt

SEQ ID NO: 277569 - DNA, 25 bp, Artificial Sequence
  Description of Artificial Sequence: Synthetic oligonucleotide
gggtgaggggcctcgaatggatcgt

SEQ ID NO: 277570 - DNA, 27 bp, Artificial Sequence
  Description of Artificial Sequence: Synthetic oligonucleotide
ggtgaggggcctcgaatggatcgtgaa

SEQ ID NO: 277571 - DNA, 27 bp, Artificial Sequence
  Description of Artificial Sequence: Synthetic oligonucleotide
gtgaggggcctcgaatggatcgtgaac

SEQ ID NO: 277572 - DNA, 28 bp, Artificial Sequence
  Description of Artificial Sequence: Synthetic oligonucleotide
tgaggggcctcgaatggatcgtgaactg

SEQ ID NO: 277573 - DNA, 27 bp, Artificial Sequence
  Description of Artificial Sequence: Synthetic oligonucleotide
gaggggcctcgaatggatcgtgaactg

SEQ ID NO: 277574 - DNA, 30 bp, Artificial Sequence
  Description of Artificial Sequence: Synthetic oligonucleotide
aggggcctcgaatggatcgtgaactgtttg

SEQ ID NO: 277575 - DNA, 29 bp, Artificial Sequence
  Description of Artificial Sequence: Synthetic oligonucleotide
ggggcctcgaatggatcgtgaactgtttg

SEQ ID NO: 277576 - DNA, 33 bp, Artificial Sequence
  Description of Artificial Sequence: Synthetic oligonucleotide
gggcctcgaatggatcgtgaactgtttgaaatg

SEQ ID NO: 277577 - DNA, 33 bp, Artificial Sequence
  Description of Artificial Sequence: Synthetic oligonucleotide
ggcctcgaatggatcgtgaactgtttgaaatgc

SEQ ID NO: 277578 - DNA, 33 bp, Artificial Sequence
  Description of Artificial Sequence: Synthetic oligonucleotide
gcctcgaatggatcgtgaactgtttgaaatgcc

SEQ ID NO: 277579 - DNA, 33 bp, Artificial Sequence
  Description of Artificial Sequence: Synthetic oligonucleotide
cctcgaatggatcgtgaactgtttgaaatgccc

SEQ ID NO: 277580 - DNA, 34 bp, Artificial Sequence
  Description of Artificial Sequence: Synthetic oligonucleotide
ctcgaatggatcgtgaactgtttgaaatgcccag

SEQ ID NO: 277581 - DNA, 36 bp, Artificial Sequence
  Description of Artificial Sequence: Synthetic oligonucleotide
tcgaatggatcgtgaactgtttgaaatgcccagaac

SEQ ID NO: 277582 - DNA, 35 bp, Artificial Sequence
  Description of Artificial Sequence: Synthetic oligonucleotide
cgaatggatcgtgaactgtttgaaatgcccagaac

SEQ ID NO: 277583 - DNA, 42 bp, Artificial Sequence
  Description of Artificial Sequence: Synthetic oligonucleotide
gaatggatcgtgaactgtttgaaatgcccagaacaataaaag

SEQ ID NO: 277584 - DNA, 42 bp, Artificial Sequence
  Description of Artificial Sequence: Synthetic oligonucleotide
aatggatcgtgaactgtttgaaatgcccagaacaataaaagc

SEQ ID NO: 277585 - DNA, 41 bp, Artificial Sequence
  Description of Artificial Sequence: Synthetic oligonucleotide
atggatcgtgaactgtttgaaatgcccagaacaataaaagc

SEQ ID NO: 277586 - DNA, 40 bp, Artificial Sequence
  Description of Artificial Sequence: Synthetic oligonucleotide
tggatcgtgaactgtttgaaatgcccagaacaataaaagc

SEQ ID NO: 277587 - DNA, 39 bp, Artificial Sequence
  Description of Artificial Sequence: Synthetic oligonucleotide
ggatcgtgaactgtttgaaatgcccagaacaataaaagc

SEQ ID NO: 277588 - DNA, 39 bp, Artificial Sequence
  Description of Artificial Sequence: Synthetic oligonucleotide
gatcgtgaactgtttgaaatgcccagaacaataaaagcc

SEQ ID NO: 277589 - DNA, 40 bp, Artificial Sequence
  Description of Artificial Sequence: Synthetic oligonucleotide
atcgtgaactgtttgaaatgcccagaacaataaaagcctg

SEQ ID NO: 277590 - DNA, 39 bp, Artificial Sequence
  Description of Artificial Sequence: Synthetic oligonucleotide
tcgtgaactgtttgaaatgcccagaacaataaaagcctg

SEQ ID NO: 277591 - DNA, 38 bp, Artificial Sequence
  Description of Artificial Sequence: Synthetic oligonucleotide
cgtgaactgtttgaaatgcccagaacaataaaagcctg

SEQ ID NO: 277592 - DNA, 38 bp, Artificial Sequence
  Description of Artificial Sequence: Synthetic oligonucleotide
gtgaactgtttgaaatgcccagaacaataaaagcctgg

SEQ ID NO: 277593 - DNA, 38 bp, Artificial Sequence
  Description of Artificial Sequence: Synthetic oligonucleotide
tgaactgtttgaaatgcccagaacaataaaagcctggc

SEQ ID NO: 277594 - DNA, 37 bp, Artificial Sequence
  Description of Artificial Sequence: Synthetic oligonucleotide
gaactgtttgaaatgcccagaacaataaaagcctggc

SEQ ID NO: 277595 - DNA, 41 bp, Artificial Sequence
  Description of Artificial Sequence: Synthetic oligonucleotide
aactgtttgaaatgcccagaacaataaaagcctggcttatc

SEQ ID NO: 277596 - DNA, 40 bp, Artificial Sequence
  Description of Artificial Sequence: Synthetic oligonucleotide
actgtttgaaatgcccagaacaataaaagcctggcttatc

SEQ ID NO: 277597 - DNA, 39 bp, Artificial Sequence
  Description of Artificial Sequence: Synthetic oligonucleotide
ctgtttgaaatgcccagaacaataaaagcctggcttatc

SEQ ID NO: 277598 - DNA, 41 bp, Artificial Sequence
  Description of Artificial Sequence: Synthetic oligonucleotide
tgtttgaaatgcccagaacaataaaagcctggcttatcttc

SEQ ID NO: 277599 - DNA, 40 bp, Artificial Sequence
  Description of Artificial Sequence: Synthetic oligonucleotide
gtttgaaatgcccagaacaataaaagcctggcttatcttc

SEQ ID NO: 277600 - DNA, 43 bp, Artificial Sequence
  Description of Artificial Sequence: Synthetic oligonucleotide
tttgaaatgcccagaacaataaaagcctggcttatcttcattg

SEQ ID NO: 277601 - DNA, 42 bp, Artificial Sequence
  Description of Artificial Sequence: Synthetic oligonucleotide
ttgaaatgcccagaacaataaaagcctggcttatcttcattg

SEQ ID NO: 277602 - DNA, 41 bp, Artificial Sequence
  Description of Artificial Sequence: Synthetic oligonucleotide
tgaaatgcccagaacaataaaagcctggcttatcttcattg

SEQ ID NO: 277603 - DNA, 40 bp, Artificial Sequence
  Description of Artificial Sequence: Synthetic oligonucleotide
gaaatgcccagaacaataaaagcctggcttatcttcattg

SEQ ID NO: 277604 - DNA, 42 bp, Artificial Sequence
  Description of Artificial Sequence: Synthetic oligonucleotide
aaatgcccagaacaataaaagcctggcttatcttcattgatg

SEQ ID NO: 277605 - DNA, 41 bp, Artificial Sequence
  Description of Artificial Sequence: Synthetic oligonucleotide
aatgcccagaacaataaaagcctggcttatcttcattgatg

SEQ ID NO: 277606 - DNA, 40 bp, Artificial Sequence
  Description of Artificial Sequence: Synthetic oligonucleotide
atgcccagaacaataaaagcctggcttatcttcattgatg

SEQ ID NO: 277607 - DNA, 39 bp, Artificial Sequence
  Description of Artificial Sequence: Synthetic oligonucleotide
tgcccagaacaataaaagcctggcttatcttcattgatg

SEQ ID NO: 277608 - DNA, 38 bp, Artificial Sequence
  Description of Artificial Sequence: Synthetic oligonucleotide
gcccagaacaataaaagcctggcttatcttcattgatg

SEQ ID NO: 277609 - DNA, 43 bp, Artificial Sequence
  Description of Artificial Sequence: Synthetic oligonucleotide
cccagaacaataaaagcctggcttatcttcattgatgaaaatg

SEQ ID NO: 277610 - DNA, 45 bp, Artificial Sequence
  Description of Artificial Sequence: Synthetic oligonucleotide
ccagaacaataaaagcctggcttatcttcattgatgaaaatgatg

SEQ ID NO: 277611 - DNA, 45 bp, Artificial Sequence
  Description of Artificial Sequence: Synthetic oligonucleotide
cagaacaataaaagcctggcttatcttcattgatgaaaatgatgc

SEQ ID NO: 277612 - DNA, 49 bp, Artificial Sequence
  Description of Artificial Sequence: Synthetic oligonucleotide
agaacaataaaagcctggcttatcttcattgatgaaaatgatgctatag

SEQ ID NO: 277613 - DNA, 48 bp, Artificial Sequence
  Description of Artificial Sequence: Synthetic oligonucleotide
gaacaataaaagcctggcttatcttcattgatgaaaatgatgctatag

SEQ ID NO: 277614 - DNA, 48 bp, Artificial Sequence
  Description of Artificial Sequence: Synthetic oligonucleotide
aacaataaaagcctggcttatcttcattgatgaaaatgatgctatagg

SEQ ID NO: 277615 - DNA, 47 bp, Artificial Sequence
  Description of Artificial Sequence: Synthetic oligonucleotide
acaataaaagcctggcttatcttcattgatgaaaatgatgctatagg

SEQ ID NO: 277616 - DNA, 46 bp, Artificial Sequence
  Description of Artificial Sequence: Synthetic oligonucleotide
caataaaagcctggcttatcttcattgatgaaaatgatgctatagg

SEQ ID NO: 277617 - DNA, 47 bp, Artificial Sequence
  Description of Artificial Sequence: Synthetic oligonucleotide
aataaaagcctggcttatcttcattgatgaaaatgatgctataggag

SEQ ID NO: 277618 - DNA, 46 bp, Artificial Sequence
  Description of Artificial Sequence: Synthetic oligonucleotide
ataaaagcctggcttatcttcattgatgaaaatgatgctataggag

SEQ ID NO: 277619 - DNA, 45 bp, Artificial Sequence
  Description of Artificial Sequence: Synthetic oligonucleotide
taaaagcctggcttatcttcattgatgaaaatgatgctataggag

SEQ ID NO: 277620 - DNA, 44 bp, Artificial Sequence
  Description of Artificial Sequence: Synthetic oligonucleotide
aaaagcctggcttatcttcattgatgaaaatgatgctataggag

SEQ ID NO: 277621 - DNA, 43 bp, Artificial Sequence
  Description of Artificial Sequence: Synthetic oligonucleotide
aaagcctggcttatcttcattgatgaaaatgatgctataggag

SEQ ID NO: 277622 - DNA, 42 bp, Artificial Sequence
  Description of Artificial Sequence: Synthetic oligonucleotide
aagcctggcttatcttcattgatgaaaatgatgctataggag

SEQ ID NO: 277623 - DNA, 41 bp, Artificial Sequence
  Description of Artificial Sequence: Synthetic oligonucleotide
agcctggcttatcttcattgatgaaaatgatgctataggag

SEQ ID NO: 277624 - DNA, 40 bp, Artificial Sequence
  Description of Artificial Sequence: Synthetic oligonucleotide
gcctggcttatcttcattgatgaaaatgatgctataggag

SEQ ID NO: 277625 - DNA, 40 bp, Artificial Sequence
  Description of Artificial Sequence: Synthetic oligonucleotide
cctggcttatcttcattgatgaaaatgatgctataggagg

SEQ ID NO: 277626 - DNA, 40 bp, Artificial Sequence
  Description of Artificial Sequence: Synthetic oligonucleotide
ctggcttatcttcattgatgaaaatgatgctataggaggg

SEQ ID NO: 277627 - DNA, 40 bp, Artificial Sequence
  Description of Artificial Sequence: Synthetic oligonucleotide
tggcttatcttcattgatgaaaatgatgctataggagggg

SEQ ID NO: 277628 - DNA, 39 bp, Artificial Sequence
  Description of Artificial Sequence: Synthetic oligonucleotide
ggcttatcttcattgatgaaaatgatgctataggagggg

SEQ ID NO: 277629 - DNA, 39 bp, Artificial Sequence
  Description of Artificial Sequence: Synthetic oligonucleotide
gcttatcttcattgatgaaaatgatgctataggaggggc

SEQ ID NO: 277630 - DNA, 40 bp, Artificial Sequence
  Description of Artificial Sequence: Synthetic oligonucleotide
cttatcttcattgatgaaaatgatgctataggaggggctg

SEQ ID NO: 277631 - DNA, 40 bp, Artificial Sequence
  Description of Artificial Sequence: Synthetic oligonucleotide
ttatcttcattgatgaaaatgatgctataggaggggctgg

SEQ ID NO: 277632 - DNA, 39 bp, Artificial Sequence
  Description of Artificial Sequence: Synthetic oligonucleotide
tatcttcattgatgaaaatgatgctataggaggggctgg

SEQ ID NO: 277633 - DNA, 38 bp, Artificial Sequence
  Description of Artificial Sequence: Synthetic oligonucleotide
atcttcattgatgaaaatgatgctataggaggggctgg

SEQ ID NO: 277634 - DNA, 37 bp, Artificial Sequence
  Description of Artificial Sequence: Synthetic oligonucleotide
tcttcattgatgaaaatgatgctataggaggggctgg

SEQ ID NO: 277635 - DNA, 36 bp, Artificial Sequence
  Description of Artificial Sequence: Synthetic oligonucleotide
cttcattgatgaaaatgatgctataggaggggctgg

SEQ ID NO: 277636 - DNA, 40 bp, Artificial Sequence
  Description of Artificial Sequence: Synthetic oligonucleotide
ttcattgatgaaaatgatgctataggaggggctggttttg

SEQ ID NO: 277637 - DNA, 39 bp, Artificial Sequence
  Description of Artificial Sequence: Synthetic oligonucleotide
tcattgatgaaaatgatgctataggaggggctggttttg

SEQ ID NO: 277638 - DNA, 38 bp, Artificial Sequence
  Description of Artificial Sequence: Synthetic oligonucleotide
cattgatgaaaatgatgctataggaggggctggttttg

SEQ ID NO: 277639 - DNA, 40 bp, Artificial Sequence
  Description of Artificial Sequence: Synthetic oligonucleotide
attgatgaaaatgatgctataggaggggctggttttgatg

SEQ ID NO: 277640 - DNA, 39 bp, Artificial Sequence
  Description of Artificial Sequence: Synthetic oligonucleotide
ttgatgaaaatgatgctataggaggggctggttttgatg

SEQ ID NO: 277641 - DNA, 38 bp, Artificial Sequence
  Description of Artificial Sequence: Synthetic oligonucleotide
tgatgaaaatgatgctataggaggggctggttttgatg

SEQ ID NO: 277642 - DNA, 37 bp, Artificial Sequence
  Description of Artificial Sequence: Synthetic oligonucleotide
gatgaaaatgatgctataggaggggctggttttgatg

SEQ ID NO: 277643 - DNA, 39 bp, Artificial Sequence
  Description of Artificial Sequence: Synthetic oligonucleotide
atgaaaatgatgctataggaggggctggttttgatgttg

SEQ ID NO: 277644 - DNA, 38 bp, Artificial Sequence
  Description of Artificial Sequence: Synthetic oligonucleotide
tgaaaatgatgctataggaggggctggttttgatgttg

SEQ ID NO: 277645 - DNA, 37 bp, Artificial Sequence
  Description of Artificial Sequence: Synthetic oligonucleotide
gaaaatgatgctataggaggggctggttttgatgttg

SEQ ID NO: 277646 - DNA, 37 bp, Artificial Sequence
  Description of Artificial Sequence: Synthetic oligonucleotide
aaaatgatgctataggaggggctggttttgatgttgg

SEQ ID NO: 277647 - DNA, 36 bp, Artificial Sequence
  Description of Artificial Sequence: Synthetic oligonucleotide
aaatgatgctataggaggggctggttttgatgttgg

SEQ ID NO: 277648 - DNA, 35 bp, Artificial Sequence
  Description of Artificial Sequence: Synthetic oligonucleotide
aatgatgctataggaggggctggttttgatgttgg

SEQ ID NO: 277649 - DNA, 34 bp, Artificial Sequence
  Description of Artificial Sequence: Synthetic oligonucleotide
atgatgctataggaggggctggttttgatgttgg

SEQ ID NO: 277650 - DNA, 33 bp, Artificial Sequence
  Description of Artificial Sequence: Synthetic oligonucleotide
tgatgctataggaggggctggttttgatgttgg

SEQ ID NO: 277651 - DNA, 32 bp, Artificial Sequence
  Description of Artificial Sequence: Synthetic oligonucleotide
gatgctataggaggggctggttttgatgttgg

SEQ ID NO: 277652 - DNA, 33 bp, Artificial Sequence
  Description of Artificial Sequence: Synthetic oligonucleotide
atgctataggaggggctggttttgatgttggtg

SEQ ID NO: 277653 - DNA, 32 bp, Artificial Sequence
  Description of Artificial Sequence: Synthetic oligonucleotide
tgctataggaggggctggttttgatgttggtg

SEQ ID NO: 277654 - DNA, 31 bp, Artificial Sequence
  Description of Artificial Sequence: Synthetic oligonucleotide
gctataggaggggctggttttgatgttggtg

SEQ ID NO: 277655 - DNA, 31 bp, Artificial Sequence
  Description of Artificial Sequence: Synthetic oligonucleotide
ctataggaggggctggttttgatgttggtgc

SEQ ID NO: 277656 - DNA, 32 bp, Artificial Sequence
  Description of Artificial Sequence: Synthetic oligonucleotide
tataggaggggctggttttgatgttggtgctg

SEQ ID NO: 277657 - DNA, 31 bp, Artificial Sequence
  Description of Artificial Sequence: Synthetic oligonucleotide
ataggaggggctggttttgatgttggtgctg

SEQ ID NO: 277658 - DNA, 30 bp, Artificial Sequence
  Description of Artificial Sequence: Synthetic oligonucleotide
taggaggggctggttttgatgttggtgctg

SEQ ID NO: 277659 - DNA, 29 bp, Artificial Sequence
  Description of Artificial Sequence: Synthetic oligonucleotide
aggaggggctggttttgatgttggtgctg

SEQ ID NO: 277660 - DNA, 28 bp, Artificial Sequence
  Description of Artificial Sequence: Synthetic oligonucleotide
ggaggggctggttttgatgttggtgctg

SEQ ID NO: 277661 - DNA, 28 bp, Artificial Sequence
  Description of Artificial Sequence: Synthetic oligonucleotide
gaggggctggttttgatgttggtgctgg

SEQ ID NO: 277662 - DNA, 29 bp, Artificial Sequence
  Description of Artificial Sequence: Synthetic oligonucleotide
aggggctggttttgatgttggtgctggtg

SEQ ID NO: 277663 - DNA, 28 bp, Artificial Sequence
  Description of Artificial Sequence: Synthetic oligonucleotide
ggggctggttttgatgttggtgctggtg

SEQ ID NO: 277664 - DNA, 28 bp, Artificial Sequence
  Description of Artificial Sequence: Synthetic oligonucleotide
gggctggttttgatgttggtgctggtgg

SEQ ID NO: 277665 - DNA, 29 bp, Artificial Sequence
  Description of Artificial Sequence: Synthetic oligonucleotide
ggctggttttgatgttggtgctggtggtg

SEQ ID NO: 277666 - DNA, 30 bp, Artificial Sequence
  Description of Artificial Sequence: Synthetic oligonucleotide
gctggttttgatgttggtgctggtggtgac

SEQ ID NO: 277667 - DNA, 33 bp, Artificial Sequence
  Description of Artificial Sequence: Synthetic oligonucleotide
ctggttttgatgttggtgctggtggtgacaatc

SEQ ID NO: 277668 - DNA, 35 bp, Artificial Sequence
  Description of Artificial Sequence: Synthetic oligonucleotide
tggttttgatgttggtgctggtggtgacaatcaag

SEQ ID NO: 277669 - DNA, 34 bp, Artificial Sequence
  Description of Artificial Sequence: Synthetic oligonucleotide
ggttttgatgttggtgctggtggtgacaatcaag

SEQ ID NO: 277670 - DNA, 35 bp, Artificial Sequence
  Description of Artificial Sequence: Synthetic oligonucleotide
gttttgatgttggtgctggtggtgacaatcaagtg

SEQ ID NO: 277671 - DNA, 35 bp, Artificial Sequence
  Description of Artificial Sequence: Synthetic oligonucleotide
ttttgatgttggtgctggtggtgacaatcaagtgc

SEQ ID NO: 277672 - DNA, 34 bp, Artificial Sequence
  Description of Artificial Sequence: Synthetic oligonucleotide
tttgatgttggtgctggtggtgacaatcaagtgc

SEQ ID NO: 277673 - DNA, 33 bp, Artificial Sequence
  Description of Artificial Sequence: Synthetic oligonucleotide
ttgatgttggtgctggtggtgacaatcaagtgc

SEQ ID NO: 277674 - DNA, 32 bp, Artificial Sequence
  Description of Artificial Sequence: Synthetic oligonucleotide
tgatgttggtgctggtggtgacaatcaagtgc

SEQ ID NO: 277675 - DNA, 31 bp, Artificial Sequence
  Description of Artificial Sequence: Synthetic oligonucleotide
gatgttggtgctggtggtgacaatcaagtgc

SEQ ID NO: 277676 - DNA, 32 bp, Artificial Sequence
  Description of Artificial Sequence: Synthetic oligonucleotide
atgttggtgctggtggtgacaatcaagtgcag

SEQ ID NO: 277677 - DNA, 31 bp, Artificial Sequence
  Description of Artificial Sequence: Synthetic oligonucleotide
tgttggtgctggtggtgacaatcaagtgcag

SEQ ID NO: 277678 - DNA, 30 bp, Artificial Sequence
  Description of Artificial Sequence: Synthetic oligonucleotide
gttggtgctggtggtgacaatcaagtgcag

SEQ ID NO: 277679 - DNA, 31 bp, Artificial Sequence
  Description of Artificial Sequence: Synthetic oligonucleotide
ttggtgctggtggtgacaatcaagtgcagac

SEQ ID NO: 277680 - DNA, 30 bp, Artificial Sequence
  Description of Artificial Sequence: Synthetic oligonucleotide
tggtgctggtggtgacaatcaagtgcagac

SEQ ID NO: 277681 - DNA, 29 bp, Artificial Sequence
  Description of Artificial Sequence: Synthetic oligonucleotide
ggtgctggtggtgacaatcaagtgcagac

SEQ ID NO: 277682 - DNA, 31 bp, Artificial Sequence
  Description of Artificial Sequence: Synthetic oligonucleotide
gtgctggtggtgacaatcaagtgcagacaac

SEQ ID NO: 277683 - DNA, 34 bp, Artificial Sequence
  Description of Artificial Sequence: Synthetic oligonucleotide
tgctggtggtgacaatcaagtgcagacaacaatg

SEQ ID NO: 277684 - DNA, 33 bp, Artificial Sequence
  Description of Artificial Sequence: Synthetic oligonucleotide
gctggtggtgacaatcaagtgcagacaacaatg

SEQ ID NO: 277685 - DNA, 35 bp, Artificial Sequence
  Description of Artificial Sequence: Synthetic oligonucleotide
ctggtggtgacaatcaagtgcagacaacaatgttc

SEQ ID NO: 277686 - DNA, 35 bp, Artificial Sequence
  Description of Artificial Sequence: Synthetic oligonucleotide
tggtggtgacaatcaagtgcagacaacaatgttcg

SEQ ID NO: 277687 - DNA, 34 bp, Artificial Sequence
  Description of Artificial Sequence: Synthetic oligonucleotide
ggtggtgacaatcaagtgcagacaacaatgttcg

SEQ ID NO: 277688 - DNA, 36 bp, Artificial Sequence
  Description of Artificial Sequence: Synthetic oligonucleotide
gtggtgacaatcaagtgcagacaacaatgttcgaac

SEQ ID NO: 277689 - DNA, 37 bp, Artificial Sequence
  Description of Artificial Sequence: Synthetic oligonucleotide
tggtgacaatcaagtgcagacaacaatgttcgaactg

SEQ ID NO: 277690 - DNA, 36 bp, Artificial Sequence
  Description of Artificial Sequence: Synthetic oligonucleotide
ggtgacaatcaagtgcagacaacaatgttcgaactg

SEQ ID NO: 277691 - DNA, 38 bp, Artificial Sequence
  Description of Artificial Sequence: Synthetic oligonucleotide
gtgacaatcaagtgcagacaacaatgttcgaactgatc

SEQ ID NO: 277692 - DNA, 41 bp, Artificial Sequence
  Description of Artificial Sequence: Synthetic oligonucleotide
tgacaatcaagtgcagacaacaatgttcgaactgatctatc

SEQ ID NO: 277693 - DNA, 40 bp, Artificial Sequence
  Description of Artificial Sequence: Synthetic oligonucleotide
gacaatcaagtgcagacaacaatgttcgaactgatctatc

SEQ ID NO: 277694 - DNA, 41 bp, Artificial Sequence
  Description of Artificial Sequence: Synthetic oligonucleotide
acaatcaagtgcagacaacaatgttcgaactgatctatcag

SEQ ID NO: 277695 - DNA, 40 bp, Artificial Sequence
  Description of Artificial Sequence: Synthetic oligonucleotide
caatcaagtgcagacaacaatgttcgaactgatctatcag

SEQ ID NO: 277696 - DNA, 40 bp, Artificial Sequence
  Description of Artificial Sequence: Synthetic oligonucleotide
aatcaagtgcagacaacaatgttcgaactgatctatcagc

SEQ ID NO: 277697 - DNA, 39 bp, Artificial Sequence
  Description of Artificial Sequence: Synthetic oligonucleotide
atcaagtgcagacaacaatgttcgaactgatctatcagc

SEQ ID NO: 277698 - DNA, 38 bp, Artificial Sequence
  Description of Artificial Sequence: Synthetic oligonucleotide
tcaagtgcagacaacaatgttcgaactgatctatcagc

SEQ ID NO: 277699 - DNA, 37 bp, Artificial Sequence
  Description of Artificial Sequence: Synthetic oligonucleotide
caagtgcagacaacaatgttcgaactgatctatcagc

SEQ ID NO: 277700 - DNA, 39 bp, Artificial Sequence
  Description of Artificial Sequence: Synthetic oligonucleotide
aagtgcagacaacaatgttcgaactgatctatcagcttg

SEQ ID NO: 277701 - DNA, 38 bp, Artificial Sequence
  Description of Artificial Sequence: Synthetic oligonucleotide
agtgcagacaacaatgttcgaactgatctatcagcttg

SEQ ID NO: 277702 - DNA, 37 bp, Artificial Sequence
  Description of Artificial Sequence: Synthetic oligonucleotide
gtgcagacaacaatgttcgaactgatctatcagcttg

SEQ ID NO: 277703 - DNA, 39 bp, Artificial Sequence
  Description of Artificial Sequence: Synthetic oligonucleotide
tgcagacaacaatgttcgaactgatctatcagcttgttg

SEQ ID NO: 277704 - DNA, 38 bp, Artificial Sequence
  Description of Artificial Sequence: Synthetic oligonucleotide
gcagacaacaatgttcgaactgatctatcagcttgttg

SEQ ID NO: 277705 - DNA, 38 bp, Artificial Sequence
  Description of Artificial Sequence: Synthetic oligonucleotide
cagacaacaatgttcgaactgatctatcagcttgttgg

SEQ ID NO: 277706 - DNA, 42 bp, Artificial Sequence
  Description of Artificial Sequence: Synthetic oligonucleotide
agacaacaatgttcgaactgatctatcagcttgttggttttg

SEQ ID NO: 277707 - DNA, 41 bp, Artificial Sequence
  Description of Artificial Sequence: Synthetic oligonucleotide
gacaacaatgttcgaactgatctatcagcttgttggttttg

SEQ ID NO: 277708 - DNA, 43 bp, Artificial Sequence
  Description of Artificial Sequence: Synthetic oligonucleotide
acaacaatgttcgaactgatctatcagcttgttggttttgaac

SEQ ID NO: 277709 - DNA, 42 bp, Artificial Sequence
  Description of Artificial Sequence: Synthetic oligonucleotide
caacaatgttcgaactgatctatcagcttgttggttttgaac

SEQ ID NO: 277710 - DNA, 42 bp, Artificial Sequence
  Description of Artificial Sequence: Synthetic oligonucleotide
aacaatgttcgaactgatctatcagcttgttggttttgaacc

SEQ ID NO: 277711 - DNA, 41 bp, Artificial Sequence
  Description of Artificial Sequence: Synthetic oligonucleotide
acaatgttcgaactgatctatcagcttgttggttttgaacc

SEQ ID NO: 277712 - DNA, 40 bp, Artificial Sequence
  Description of Artificial Sequence: Synthetic oligonucleotide
caatgttcgaactgatctatcagcttgttggttttgaacc

SEQ ID NO: 277713 - DNA, 41 bp, Artificial Sequence
  Description of Artificial Sequence: Synthetic oligonucleotide
aatgttcgaactgatctatcagcttgttggttttgaacctc

SEQ ID NO: 277714 - DNA, 40 bp, Artificial Sequence
  Description of Artificial Sequence: Synthetic oligonucleotide
atgttcgaactgatctatcagcttgttggttttgaacctc

SEQ ID NO: 277715 - DNA, 39 bp, Artificial Sequence
  Description of Artificial Sequence: Synthetic oligonucleotide
tgttcgaactgatctatcagcttgttggttttgaacctc

SEQ ID NO: 277716 - DNA, 38 bp, Artificial Sequence
  Description of Artificial Sequence: Synthetic oligonucleotide
gttcgaactgatctatcagcttgttggttttgaacctc

SEQ ID NO: 277717 - DNA, 38 bp, Artificial Sequence
  Description of Artificial Sequence: Synthetic oligonucleotide
ttcgaactgatctatcagcttgttggttttgaacctcg

SEQ ID NO: 277718 - DNA, 37 bp, Artificial Sequence
  Description of Artificial Sequence: Synthetic oligonucleotide
tcgaactgatctatcagcttgttggttttgaacctcg

SEQ ID NO: 277719 - DNA, 36 bp, Artificial Sequence
  Description of Artificial Sequence: Synthetic oligonucleotide
cgaactgatctatcagcttgttggttttgaacctcg

SEQ ID NO: 277720 - DNA, 37 bp, Artificial Sequence
  Description of Artificial Sequence: Synthetic oligonucleotide
gaactgatctatcagcttgttggttttgaacctcgag

SEQ ID NO: 277721 - DNA, 37 bp, Artificial Sequence
  Description of Artificial Sequence: Synthetic oligonucleotide
aactgatctatcagcttgttggttttgaacctcgagg

SEQ ID NO: 277722 - DNA, 36 bp, Artificial Sequence
  Description of Artificial Sequence: Synthetic oligonucleotide
actgatctatcagcttgttggttttgaacctcgagg

SEQ ID NO: 277723 - DNA, 35 bp, Artificial Sequence
  Description of Artificial Sequence: Synthetic oligonucleotide
ctgatctatcagcttgttggttttgaacctcgagg

SEQ ID NO: 277724 - DNA, 35 bp, Artificial Sequence
  Description of Artificial Sequence: Synthetic oligonucleotide
tgatctatcagcttgttggttttgaacctcgaggc

SEQ ID NO: 277725 - DNA, 34 bp, Artificial Sequence
  Description of Artificial Sequence: Synthetic oligonucleotide
gatctatcagcttgttggttttgaacctcgaggc

SEQ ID NO: 277726 - DNA, 43 bp, Artificial Sequence
  Description of Artificial Sequence: Synthetic oligonucleotide
atctatcagcttgttggttttgaacctcgaggctatattaaag

SEQ ID NO: 277727 - DNA, 42 bp, Artificial Sequence
  Description of Artificial Sequence: Synthetic oligonucleotide
tctatcagcttgttggttttgaacctcgaggctatattaaag

SEQ ID NO: 277728 - DNA, 41 bp, Artificial Sequence
  Description of Artificial Sequence: Synthetic oligonucleotide
ctatcagcttgttggttttgaacctcgaggctatattaaag

SEQ ID NO: 277729 - DNA, 42 bp, Artificial Sequence
  Description of Artificial Sequence: Synthetic oligonucleotide
tatcagcttgttggttttgaacctcgaggctatattaaagag

SEQ ID NO: 277730 - DNA, 41 bp, Artificial Sequence
  Description of Artificial Sequence: Synthetic oligonucleotide
atcagcttgttggttttgaacctcgaggctatattaaagag

SEQ ID NO: 277731 - DNA, 40 bp, Artificial Sequence
  Description of Artificial Sequence: Synthetic oligonucleotide
tcagcttgttggttttgaacctcgaggctatattaaagag

SEQ ID NO: 277732 - DNA, 39 bp, Artificial Sequence
  Description of Artificial Sequence: Synthetic oligonucleotide
cagcttgttggttttgaacctcgaggctatattaaagag

SEQ ID NO: 277733 - DNA, 39 bp, Artificial Sequence
  Description of Artificial Sequence: Synthetic oligonucleotide
agcttgttggttttgaacctcgaggctatattaaagagc

SEQ ID NO: 277734 - DNA, 38 bp, Artificial Sequence
  Description of Artificial Sequence: Synthetic oligonucleotide
gcttgttggttttgaacctcgaggctatattaaagagc

SEQ ID NO: 277735 - DNA, 39 bp, Artificial Sequence
  Description of Artificial Sequence: Synthetic oligonucleotide
cttgttggttttgaacctcgaggctatattaaagagctg

SEQ ID NO: 277736 - DNA, 41 bp, Artificial Sequence
  Description of Artificial Sequence: Synthetic oligonucleotide
ttgttggttttgaacctcgaggctatattaaagagctgatg

SEQ ID NO: 277737 - DNA, 40 bp, Artificial Sequence
  Description of Artificial Sequence: Synthetic oligonucleotide
tgttggttttgaacctcgaggctatattaaagagctgatg

SEQ ID NO: 277738 - DNA, 39 bp, Artificial Sequence
  Description of Artificial Sequence: Synthetic oligonucleotide
gttggttttgaacctcgaggctatattaaagagctgatg

SEQ ID NO: 277739 - DNA, 39 bp, Artificial Sequence
  Description of Artificial Sequence: Synthetic oligonucleotide
ttggttttgaacctcgaggctatattaaagagctgatgg

SEQ ID NO: 277740 - DNA, 38 bp, Artificial Sequence
  Description of Artificial Sequence: Synthetic oligonucleotide
tggttttgaacctcgaggctatattaaagagctgatgg

SEQ ID NO: 277741 - DNA, 37 bp, Artificial Sequence
  Description of Artificial Sequence: Synthetic oligonucleotide
ggttttgaacctcgaggctatattaaagagctgatgg

SEQ ID NO: 277742 - DNA, 37 bp, Artificial Sequence
  Description of Artificial Sequence: Synthetic oligonucleotide
gttttgaacctcgaggctatattaaagagctgatggc

SEQ ID NO: 277743 - DNA, 37 bp, Artificial Sequence
  Description of Artificial Sequence: Synthetic oligonucleotide
ttttgaacctcgaggctatattaaagagctgatggcg

SEQ ID NO: 277744 - DNA, 36 bp, Artificial Sequence
  Description of Artificial Sequence: Synthetic oligonucleotide
tttgaacctcgaggctatattaaagagctgatggcg

SEQ ID NO: 277745 - DNA, 35 bp, Artificial Sequence
  Description of Artificial Sequence: Synthetic oligonucleotide
ttgaacctcgaggctatattaaagagctgatggcg

SEQ ID NO: 277746 - DNA, 34 bp, Artificial Sequence
  Description of Artificial Sequence: Synthetic oligonucleotide
tgaacctcgaggctatattaaagagctgatggcg

SEQ ID NO: 277747 - DNA, 33 bp, Artificial Sequence
  Description of Artificial Sequence: Synthetic oligonucleotide
gaacctcgaggctatattaaagagctgatggcg

SEQ ID NO: 277748 - DNA, 34 bp, Artificial Sequence
  Description of Artificial Sequence: Synthetic oligonucleotide
aacctcgaggctatattaaagagctgatggcgac

SEQ ID NO: 277749 - DNA, 33 bp, Artificial Sequence
  Description of Artificial Sequence: Synthetic oligonucleotide
acctcgaggctatattaaagagctgatggcgac

SEQ ID NO: 277750 - DNA, 32 bp, Artificial Sequence
  Description of Artificial Sequence: Synthetic oligonucleotide
cctcgaggctatattaaagagctgatggcgac

SEQ ID NO: 277751 - DNA, 35 bp, Artificial Sequence
  Description of Artificial Sequence: Synthetic oligonucleotide
ctcgaggctatattaaagagctgatggcgactaac

SEQ ID NO: 277752 - DNA, 36 bp, Artificial Sequence
  Description of Artificial Sequence: Synthetic oligonucleotide
tcgaggctatattaaagagctgatggcgactaacag

SEQ ID NO: 277753 - DNA, 35 bp, Artificial Sequence
  Description of Artificial Sequence: Synthetic oligonucleotide
cgaggctatattaaagagctgatggcgactaacag

SEQ ID NO: 277754 - DNA, 36 bp, Artificial Sequence
  Description of Artificial Sequence: Synthetic oligonucleotide
gaggctatattaaagagctgatggcgactaacagag

SEQ ID NO: 277755 - DNA, 36 bp, Artificial Sequence
  Description of Artificial Sequence: Synthetic oligonucleotide
aggctatattaaagagctgatggcgactaacagagc

SEQ ID NO: 277756 - DNA, 35 bp, Artificial Sequence
  Description of Artificial Sequence: Synthetic oligonucleotide
ggctatattaaagagctgatggcgactaacagagc

SEQ ID NO: 277757 - DNA, 36 bp, Artificial Sequence
  Description of Artificial Sequence: Synthetic oligonucleotide
gctatattaaagagctgatggcgactaacagagctg

SEQ ID NO: 277758 - DNA, 39 bp, Artificial Sequence
  Description of Artificial Sequence: Synthetic oligonucleotide
ctatattaaagagctgatggcgactaacagagctgatac

SEQ ID NO: 277759 - DNA, 42 bp, Artificial Sequence
  Description of Artificial Sequence: Synthetic oligonucleotide
tatattaaagagctgatggcgactaacagagctgatacttag

SEQ ID NO: 277760 - DNA, 41 bp, Artificial Sequence
  Description of Artificial Sequence: Synthetic oligonucleotide
atattaaagagctgatggcgactaacagagctgatacttag

SEQ ID NO: 277761 - DNA, 40 bp, Artificial Sequence
  Description of Artificial Sequence: Synthetic oligonucleotide
tattaaagagctgatggcgactaacagagctgatacttag

SEQ ID NO: 277762 - DNA, 39 bp, Artificial Sequence
  Description of Artificial Sequence: Synthetic oligonucleotide
attaaagagctgatggcgactaacagagctgatacttag

SEQ ID NO: 277763 - DNA, 38 bp, Artificial Sequence
  Description of Artificial Sequence: Synthetic oligonucleotide
ttaaagagctgatggcgactaacagagctgatacttag

SEQ ID NO: 277764 - DNA, 37 bp, Artificial Sequence
  Description of Artificial Sequence: Synthetic oligonucleotide
taaagagctgatggcgactaacagagctgatacttag

SEQ ID NO: 277765 - DNA, 36 bp, Artificial Sequence
  Description of Artificial Sequence: Synthetic oligonucleotide
aaagagctgatggcgactaacagagctgatacttag

SEQ ID NO: 277766 - DNA, 35 bp, Artificial Sequence
  Description of Artificial Sequence: Synthetic oligonucleotide
aagagctgatggcgactaacagagctgatacttag

SEQ ID NO: 277767 - DNA, 34 bp, Artificial Sequence
  Description of Artificial Sequence: Synthetic oligonucleotide
agagctgatggcgactaacagagctgatacttag

SEQ ID NO: 277768 - DNA, 33 bp, Artificial Sequence
  Description of Artificial Sequence: Synthetic oligonucleotide
gagctgatggcgactaacagagctgatacttag

SEQ ID NO: 277769 - DNA, 33 bp, Artificial Sequence
  Description of Artificial Sequence: Synthetic oligonucleotide
agctgatggcgactaacagagctgatacttagg

SEQ ID NO: 277770 - DNA, 32 bp, Artificial Sequence
  Description of Artificial Sequence: Synthetic oligonucleotide
gctgatggcgactaacagagctgatacttagg

SEQ ID NO: 277771 - DNA, 34 bp, Artificial Sequence
  Description of Artificial Sequence: Synthetic oligonucleotide
ctgatggcgactaacagagctgatacttaggatc

SEQ ID NO: 277772 - DNA, 34 bp, Artificial Sequence
  Description of Artificial Sequence: Synthetic oligonucleotide
tgatggcgactaacagagctgatacttaggatcc

SEQ ID NO: 277773 - DNA, 33 bp, Artificial Sequence
  Description of Artificial Sequence: Synthetic oligonucleotide
gatggcgactaacagagctgatacttaggatcc

SEQ ID NO: 277774 - DNA, 34 bp, Artificial Sequence
  Description of Artificial Sequence: Synthetic oligonucleotide
atggcgactaacagagctgatacttaggatccag

SEQ ID NO: 277775 - DNA, 33 bp, Artificial Sequence
  Description of Artificial Sequence: Synthetic oligonucleotide
tggcgactaacagagctgatacttaggatccag

SEQ ID NO: 277776 - DNA, 32 bp, Artificial Sequence
  Description of Artificial Sequence: Synthetic oligonucleotide
ggcgactaacagagctgatacttaggatccag

SEQ ID NO: 277777 - DNA, 32 bp, Artificial Sequence
  Description of Artificial Sequence: Synthetic oligonucleotide
gcgactaacagagctgatacttaggatccagc

SEQ ID NO: 277778 - DNA, 33 bp, Artificial Sequence
  Description of Artificial Sequence: Synthetic oligonucleotide
cgactaacagagctgatacttaggatccagctc

SEQ ID NO: 277779 - DNA, 34 bp, Artificial Sequence
  Description of Artificial Sequence: Synthetic oligonucleotide
gactaacagagctgatacttaggatccagctctg

SEQ ID NO: 277780 - DNA, 36 bp, Artificial Sequence
  Description of Artificial Sequence: Synthetic oligonucleotide
actaacagagctgatacttaggatccagctctgatg

SEQ ID NO: 277781 - DNA, 35 bp, Artificial Sequence
  Description of Artificial Sequence: Synthetic oligonucleotide
ctaacagagctgatacttaggatccagctctgatg

SEQ ID NO: 277782 - DNA, 36 bp, Artificial Sequence
  Description of Artificial Sequence: Synthetic oligonucleotide
taacagagctgatacttaggatccagctctgatgag

SEQ ID NO: 277783 - DNA, 35 bp, Artificial Sequence
  Description of Artificial Sequence: Synthetic oligonucleotide
aacagagctgatacttaggatccagctctgatgag

SEQ ID NO: 277784 - DNA, 34 bp, Artificial Sequence
  Description of Artificial Sequence: Synthetic oligonucleotide
acagagctgatacttaggatccagctctgatgag

SEQ ID NO: 277785 - DNA, 33 bp, Artificial Sequence
  Description of Artificial Sequence: Synthetic oligonucleotide
cagagctgatacttaggatccagctctgatgag

SEQ ID NO: 277786 - DNA, 33 bp, Artificial Sequence
  Description of Artificial Sequence: Synthetic oligonucleotide
agagctgatacttaggatccagctctgatgagg

SEQ ID NO: 277787 - DNA, 32 bp, Artificial Sequence
  Description of Artificial Sequence: Synthetic oligonucleotide
gagctgatacttaggatccagctctgatgagg

SEQ ID NO: 277788 - DNA, 32 bp, Artificial Sequence
  Description of Artificial Sequence: Synthetic oligonucleotide
agctgatacttaggatccagctctgatgaggg

SEQ ID NO: 277789 - DNA, 31 bp, Artificial Sequence
  Description of Artificial Sequence: Synthetic oligonucleotide
gctgatacttaggatccagctctgatgaggg

SEQ ID NO: 277790 - DNA, 31 bp, Artificial Sequence
  Description of Artificial Sequence: Synthetic oligonucleotide
ctgatacttaggatccagctctgatgagggc

SEQ ID NO: 277791 - DNA, 32 bp, Artificial Sequence
  Description of Artificial Sequence: Synthetic oligonucleotide
tgatacttaggatccagctctgatgagggcag

SEQ ID NO: 277792 - DNA, 31 bp, Artificial Sequence
  Description of Artificial Sequence: Synthetic oligonucleotide
gatacttaggatccagctctgatgagggcag

SEQ ID NO: 277793 - DNA, 31 bp, Artificial Sequence
  Description of Artificial Sequence: Synthetic oligonucleotide
atacttaggatccagctctgatgagggcagg

SEQ ID NO: 277794 - DNA, 30 bp, Artificial Sequence
  Description of Artificial Sequence: Synthetic oligonucleotide
tacttaggatccagctctgatgagggcagg

SEQ ID NO: 277795 - DNA, 29 bp, Artificial Sequence
  Description of Artificial Sequence: Synthetic oligonucleotide
acttaggatccagctctgatgagggcagg

SEQ ID NO: 277796 - DNA, 28 bp, Artificial Sequence
  Description of Artificial Sequence: Synthetic oligonucleotide
cttaggatccagctctgatgagggcagg

SEQ ID NO: 277797 - DNA, 28 bp, Artificial Sequence
  Description of Artificial Sequence: Synthetic oligonucleotide
ttaggatccagctctgatgagggcaggg

SEQ ID NO: 277798 - DNA, 27 bp, Artificial Sequence
  Description of Artificial Sequence: Synthetic oligonucleotide
taggatccagctctgatgagggcaggg

SEQ ID NO: 277799 - DNA, 27 bp, Artificial Sequence
  Description of Artificial Sequence: Synthetic oligonucleotide
aggatccagctctgatgagggcaggga

SEQ ID NO: 277800 - DNA, 26 bp, Artificial Sequence
  Description of Artificial Sequence: Synthetic oligonucleotide
ggatccagctctgatgagggcaggga

SEQ ID NO: 277801 - DNA, 27 bp, Artificial Sequence
  Description of Artificial Sequence: Synthetic oligonucleotide
gatccagctctgatgagggcagggaga

SEQ ID NO: 277802 - DNA, 29 bp, Artificial Sequence
  Description of Artificial Sequence: Synthetic oligonucleotide
atccagctctgatgagggcagggagatag

SEQ ID NO: 277803 - DNA, 28 bp, Artificial Sequence
  Description of Artificial Sequence: Synthetic oligonucleotide
tccagctctgatgagggcagggagatag

SEQ ID NO: 277804 - DNA, 27 bp, Artificial Sequence
  Description of Artificial Sequence: Synthetic oligonucleotide
ccagctctgatgagggcagggagatag

SEQ ID NO: 277805 - DNA, 27 bp, Artificial Sequence
  Description of Artificial Sequence: Synthetic oligonucleotide
cagctctgatgagggcagggagatagg

SEQ ID NO: 277806 - DNA, 30 bp, Artificial Sequence
  Description of Artificial Sequence: Synthetic oligonucleotide
agctctgatgagggcagggagataggatag

SEQ ID NO: 277807 - DNA, 29 bp, Artificial Sequence
  Description of Artificial Sequence: Synthetic oligonucleotide
gctctgatgagggcagggagataggatag

SEQ ID NO: 277808 - DNA, 36 bp, Artificial Sequence
  Description of Artificial Sequence: Synthetic oligonucleotide
ctctgatgagggcagggagataggatagaaatattg

SEQ ID NO: 277809 - DNA, 42 bp, Artificial Sequence
  Description of Artificial Sequence: Synthetic oligonucleotide
tctgatgagggcagggagataggatagaaatattgaattttg

SEQ ID NO: 277810 - DNA, 41 bp, Artificial Sequence
  Description of Artificial Sequence: Synthetic oligonucleotide
ctgatgagggcagggagataggatagaaatattgaattttg

SEQ ID NO: 277811 - DNA, 41 bp, Artificial Sequence
  Description of Artificial Sequence: Synthetic oligonucleotide
tgatgagggcagggagataggatagaaatattgaattttgc

SEQ ID NO: 277812 - DNA, 40 bp, Artificial Sequence
  Description of Artificial Sequence: Synthetic oligonucleotide
gatgagggcagggagataggatagaaatattgaattttgc

SEQ ID NO: 277813 - DNA, 42 bp, Artificial Sequence
  Description of Artificial Sequence: Synthetic oligonucleotide
atgagggcagggagataggatagaaatattgaattttgcttg

SEQ ID NO: 277814 - DNA, 41 bp, Artificial Sequence
  Description of Artificial Sequence: Synthetic oligonucleotide
tgagggcagggagataggatagaaatattgaattttgcttg

SEQ ID NO: 277815 - DNA, 40 bp, Artificial Sequence
  Description of Artificial Sequence: Synthetic oligonucleotide
gagggcagggagataggatagaaatattgaattttgcttg

SEQ ID NO: 277816 - DNA, 40 bp, Artificial Sequence
  Description of Artificial Sequence: Synthetic oligonucleotide
agggcagggagataggatagaaatattgaattttgcttgc

SEQ ID NO: 277817 - DNA, 39 bp, Artificial Sequence
  Description of Artificial Sequence: Synthetic oligonucleotide
gggcagggagataggatagaaatattgaattttgcttgc

SEQ ID NO: 277818 - DNA, 39 bp, Artificial Sequence
  Description of Artificial Sequence: Synthetic oligonucleotide
ggcagggagataggatagaaatattgaattttgcttgcc

SEQ ID NO: 277819 - DNA, 39 bp, Artificial Sequence
  Description of Artificial Sequence: Synthetic oligonucleotide
gcagggagataggatagaaatattgaattttgcttgccc

SEQ ID NO: 277820 - DNA, 39 bp, Artificial Sequence
  Description of Artificial Sequence: Synthetic oligonucleotide
cagggagataggatagaaatattgaattttgcttgcccg

SEQ ID NO: 277821 - DNA, 41 bp, Artificial Sequence
  Description of Artificial Sequence: Synthetic oligonucleotide
agggagataggatagaaatattgaattttgcttgcccgttc

SEQ ID NO: 277822 - DNA, 40 bp, Artificial Sequence
  Description of Artificial Sequence: Synthetic oligonucleotide
gggagataggatagaaatattgaattttgcttgcccgttc

SEQ ID NO: 277823 - DNA, 42 bp, Artificial Sequence
  Description of Artificial Sequence: Synthetic oligonucleotide
ggagataggatagaaatattgaattttgcttgcccgttctag

SEQ ID NO: 277824 - DNA, 43 bp, Artificial Sequence
  Description of Artificial Sequence: Synthetic oligonucleotide
gagataggatagaaatattgaattttgcttgcccgttctagag

SEQ ID NO: 277825 - DNA, 43 bp, Artificial Sequence
  Description of Artificial Sequence: Synthetic oligonucleotide
agataggatagaaatattgaattttgcttgcccgttctagagg

SEQ ID NO: 277826 - DNA, 42 bp, Artificial Sequence
  Description of Artificial Sequence: Synthetic oligonucleotide
gataggatagaaatattgaattttgcttgcccgttctagagg

SEQ ID NO: 277827 - DNA, 42 bp, Artificial Sequence
  Description of Artificial Sequence: Synthetic oligonucleotide
ataggatagaaatattgaattttgcttgcccgttctagaggg

SEQ ID NO: 277828 - DNA, 41 bp, Artificial Sequence
  Description of Artificial Sequence: Synthetic oligonucleotide
taggatagaaatattgaattttgcttgcccgttctagaggg

SEQ ID NO: 277829 - DNA, 40 bp, Artificial Sequence
  Description of Artificial Sequence: Synthetic oligonucleotide
aggatagaaatattgaattttgcttgcccgttctagaggg

SEQ ID NO: 277830 - DNA, 39 bp, Artificial Sequence
  Description of Artificial Sequence: Synthetic oligonucleotide
ggatagaaatattgaattttgcttgcccgttctagaggg

SEQ ID NO: 277831 - DNA, 40 bp, Artificial Sequence
  Description of Artificial Sequence: Synthetic oligonucleotide
gatagaaatattgaattttgcttgcccgttctagagggac

SEQ ID NO: 277832 - DNA, 40 bp, Artificial Sequence
  Description of Artificial Sequence: Synthetic oligonucleotide
atagaaatattgaattttgcttgcccgttctagagggacg

SEQ ID NO: 277833 - DNA, 39 bp, Artificial Sequence
  Description of Artificial Sequence: Synthetic oligonucleotide
tagaaatattgaattttgcttgcccgttctagagggacg

SEQ ID NO: 277834 - DNA, 38 bp, Artificial Sequence
  Description of Artificial Sequence: Synthetic oligonucleotide
agaaatattgaattttgcttgcccgttctagagggacg

SEQ ID NO: 277835 - DNA, 37 bp, Artificial Sequence
  Description of Artificial Sequence: Synthetic oligonucleotide
gaaatattgaattttgcttgcccgttctagagggacg

SEQ ID NO: 277836 - DNA, 37 bp, Artificial Sequence
  Description of Artificial Sequence: Synthetic oligonucleotide
aaatattgaattttgcttgcccgttctagagggacgg

SEQ ID NO: 277837 - DNA, 36 bp, Artificial Sequence
  Description of Artificial Sequence: Synthetic oligonucleotide
aatattgaattttgcttgcccgttctagagggacgg

SEQ ID NO: 277838 - DNA, 35 bp, Artificial Sequence
  Description of Artificial Sequence: Synthetic oligonucleotide
atattgaattttgcttgcccgttctagagggacgg

SEQ ID NO: 277839 - DNA, 34 bp, Artificial Sequence
  Description of Artificial Sequence: Synthetic oligonucleotide
tattgaattttgcttgcccgttctagagggacgg

SEQ ID NO: 277840 - DNA, 33 bp, Artificial Sequence
  Description of Artificial Sequence: Synthetic oligonucleotide
attgaattttgcttgcccgttctagagggacgg

SEQ ID NO: 277841 - DNA, 32 bp, Artificial Sequence
  Description of Artificial Sequence: Synthetic oligonucleotide
ttgaattttgcttgcccgttctagagggacgg

SEQ ID NO: 277842 - DNA, 31 bp, Artificial Sequence
  Description of Artificial Sequence: Synthetic oligonucleotide
tgaattttgcttgcccgttctagagggacgg

SEQ ID NO: 277843 - DNA, 30 bp, Artificial Sequence
  Description of Artificial Sequence: Synthetic oligonucleotide
gaattttgcttgcccgttctagagggacgg

SEQ ID NO: 277844 - DNA, 31 bp, Artificial Sequence
  Description of Artificial Sequence: Synthetic oligonucleotide
aattttgcttgcccgttctagagggacggac

SEQ ID NO: 277845 - DNA, 30 bp, Artificial Sequence
  Description of Artificial Sequence: Synthetic oligonucleotide
attttgcttgcccgttctagagggacggac

SEQ ID NO: 277846 - DNA, 29 bp, Artificial Sequence
  Description of Artificial Sequence: Synthetic oligonucleotide
ttttgcttgcccgttctagagggacggac

SEQ ID NO: 277847 - DNA, 28 bp, Artificial Sequence
  Description of Artificial Sequence: Synthetic oligonucleotide
tttgcttgcccgttctagagggacggac

SEQ ID NO: 277848 - DNA, 27 bp, Artificial Sequence
  Description of Artificial Sequence: Synthetic oligonucleotide
ttgcttgcccgttctagagggacggac

SEQ ID NO: 277849 - DNA, 26 bp, Artificial Sequence
  Description of Artificial Sequence: Synthetic oligonucleotide
tgcttgcccgttctagagggacggac

SEQ ID NO: 277850 - DNA, 25 bp, Artificial Sequence
  Description of Artificial Sequence: Synthetic oligonucleotide
gcttgcccgttctagagggacggac

SEQ ID NO: 277851 - DNA, 25 bp, Artificial Sequence
  Description of Artificial Sequence: Synthetic oligonucleotide
cttgcccgttctagagggacggacc

SEQ ID NO: 277852 - DNA, 26 bp, Artificial Sequence
  Description of Artificial Sequence: Synthetic oligonucleotide
ttgcccgttctagagggacggaccca

SEQ ID NO: 277853 - DNA, 25 bp, Artificial Sequence
  Description of Artificial Sequence: Synthetic oligonucleotide
tgcccgttctagagggacggaccca

SEQ ID NO: 277854 - DNA, 24 bp, Artificial Sequence
  Description of Artificial Sequence: Synthetic oligonucleotide
gcccgttctagagggacggaccca

SEQ ID NO: 277855 - DNA, 27 bp, Artificial Sequence
  Description of Artificial Sequence: Synthetic oligonucleotide
cccgttctagagggacggacccactta

SEQ ID NO: 277856 - DNA, 32 bp, Artificial Sequence
  Description of Artificial Sequence: Synthetic oligonucleotide
ccgttctagagggacggacccacttatttaag

SEQ ID NO: 277857 - DNA, 35 bp, Artificial Sequence
  Description of Artificial Sequence: Synthetic oligonucleotide
cgttctagagggacggacccacttatttaagaatc

SEQ ID NO: 277858 - DNA, 36 bp, Artificial Sequence
  Description of Artificial Sequence: Synthetic oligonucleotide
gttctagagggacggacccacttatttaagaatcac

SEQ ID NO: 277859 - DNA, 36 bp, Artificial Sequence
  Description of Artificial Sequence: Synthetic oligonucleotide
ttctagagggacggacccacttatttaagaatcacg

SEQ ID NO: 277860 - DNA, 35 bp, Artificial Sequence
  Description of Artificial Sequence: Synthetic oligonucleotide
tctagagggacggacccacttatttaagaatcacg

SEQ ID NO: 277861 - DNA, 34 bp, Artificial Sequence
  Description of Artificial Sequence: Synthetic oligonucleotide
ctagagggacggacccacttatttaagaatcacg

SEQ ID NO: 277862 - DNA, 34 bp, Artificial Sequence
  Description of Artificial Sequence: Synthetic oligonucleotide
tagagggacggacccacttatttaagaatcacgc

SEQ ID NO: 277863 - DNA, 33 bp, Artificial Sequence
  Description of Artificial Sequence: Synthetic oligonucleotide
agagggacggacccacttatttaagaatcacgc

SEQ ID NO: 277864 - DNA, 32 bp, Artificial Sequence
  Description of Artificial Sequence: Synthetic oligonucleotide
gagggacggacccacttatttaagaatcacgc

SEQ ID NO: 277865 - DNA, 33 bp, Artificial Sequence
  Description of Artificial Sequence: Synthetic oligonucleotide
agggacggacccacttatttaagaatcacgctc

SEQ ID NO: 277866 - DNA, 32 bp, Artificial Sequence
  Description of Artificial Sequence: Synthetic oligonucleotide
gggacggacccacttatttaagaatcacgctc

SEQ ID NO: 277867 - DNA, 32 bp, Artificial Sequence
  Description of Artificial Sequence: Synthetic oligonucleotide
ggacggacccacttatttaagaatcacgctcg

SEQ ID NO: 277868 - DNA, 34 bp, Artificial Sequence
  Description of Artificial Sequence: Synthetic oligonucleotide
gacggacccacttatttaagaatcacgctcgatc

SEQ ID NO: 277869 - DNA, 37 bp, Artificial Sequence
  Description of Artificial Sequence: Synthetic oligonucleotide
acggacccacttatttaagaatcacgctcgatcaatg

SEQ ID NO: 277870 - DNA, 36 bp, Artificial Sequence
  Description of Artificial Sequence: Synthetic oligonucleotide
cggacccacttatttaagaatcacgctcgatcaatg

SEQ ID NO: 277871 - DNA, 37 bp, Artificial Sequence
  Description of Artificial Sequence: Synthetic oligonucleotide
ggacccacttatttaagaatcacgctcgatcaatgag

SEQ ID NO: 277872 - DNA, 38 bp, Artificial Sequence
  Description of Artificial Sequence: Synthetic oligonucleotide
gacccacttatttaagaatcacgctcgatcaatgagtc

SEQ ID NO: 277873 - DNA, 40 bp, Artificial Sequence
  Description of Artificial Sequence: Synthetic oligonucleotide
acccacttatttaagaatcacgctcgatcaatgagtcttg

SEQ ID NO: 277874 - DNA, 39 bp, Artificial Sequence
  Description of Artificial Sequence: Synthetic oligonucleotide
cccacttatttaagaatcacgctcgatcaatgagtcttg

SEQ ID NO: 277875 - DNA, 42 bp, Artificial Sequence
  Description of Artificial Sequence: Synthetic oligonucleotide
ccacttatttaagaatcacgctcgatcaatgagtcttgaaag

SEQ ID NO: 277876 - DNA, 43 bp, Artificial Sequence
  Description of Artificial Sequence: Synthetic oligonucleotide
cacttatttaagaatcacgctcgatcaatgagtcttgaaagag

SEQ ID NO: 277877 - DNA, 47 bp, Artificial Sequence
  Description of Artificial Sequence: Synthetic oligonucleotide
acttatttaagaatcacgctcgatcaatgagtcttgaaagagttatc

SEQ ID NO: 277878 - DNA, 46 bp, Artificial Sequence
  Description of Artificial Sequence: Synthetic oligonucleotide
cttatttaagaatcacgctcgatcaatgagtcttgaaagagttatc

SEQ ID NO: 277879 - DNA, 47 bp, Artificial Sequence
  Description of Artificial Sequence: Synthetic oligonucleotide
ttatttaagaatcacgctcgatcaatgagtcttgaaagagttatcag

SEQ ID NO: 277880 - DNA, 46 bp, Artificial Sequence
  Description of Artificial Sequence: Synthetic oligonucleotide
tatttaagaatcacgctcgatcaatgagtcttgaaagagttatcag

SEQ ID NO: 277881 - DNA, 45 bp, Artificial Sequence
  Description of Artificial Sequence: Synthetic oligonucleotide
atttaagaatcacgctcgatcaatgagtcttgaaagagttatcag

SEQ ID NO: 277882 - DNA, 44 bp, Artificial Sequence
  Description of Artificial Sequence: Synthetic oligonucleotide
tttaagaatcacgctcgatcaatgagtcttgaaagagttatcag

SEQ ID NO: 277883 - DNA, 43 bp, Artificial Sequence
  Description of Artificial Sequence: Synthetic oligonucleotide
ttaagaatcacgctcgatcaatgagtcttgaaagagttatcag

SEQ ID NO: 277884 - DNA, 42 bp, Artificial Sequence
  Description of Artificial Sequence: Synthetic oligonucleotide
taagaatcacgctcgatcaatgagtcttgaaagagttatcag

SEQ ID NO: 277885 - DNA, 41 bp, Artificial Sequence
  Description of Artificial Sequence: Synthetic oligonucleotide
aagaatcacgctcgatcaatgagtcttgaaagagttatcag

SEQ ID NO: 277886 - DNA, 40 bp, Artificial Sequence
  Description of Artificial Sequence: Synthetic oligonucleotide
agaatcacgctcgatcaatgagtcttgaaagagttatcag

SEQ ID NO: 277887 - DNA, 39 bp, Artificial Sequence
  Description of Artificial Sequence: Synthetic oligonucleotide
gaatcacgctcgatcaatgagtcttgaaagagttatcag

SEQ ID NO: 277888 - DNA, 43 bp, Artificial Sequence
  Description of Artificial Sequence: Synthetic oligonucleotide
aatcacgctcgatcaatgagtcttgaaagagttatcagattag

SEQ ID NO: 277889 - DNA, 42 bp, Artificial Sequence
  Description of Artificial Sequence: Synthetic oligonucleotide
atcacgctcgatcaatgagtcttgaaagagttatcagattag

SEQ ID NO: 277890 - DNA, 41 bp, Artificial Sequence
  Description of Artificial Sequence: Synthetic oligonucleotide
tcacgctcgatcaatgagtcttgaaagagttatcagattag

SEQ ID NO: 277891 - DNA, 40 bp, Artificial Sequence
  Description of Artificial Sequence: Synthetic oligonucleotide
cacgctcgatcaatgagtcttgaaagagttatcagattag

SEQ ID NO: 277892 - DNA, 42 bp, Artificial Sequence
  Description of Artificial Sequence: Synthetic oligonucleotide
acgctcgatcaatgagtcttgaaagagttatcagattagaac

SEQ ID NO: 277893 - DNA, 41 bp, Artificial Sequence
  Description of Artificial Sequence: Synthetic oligonucleotide
cgctcgatcaatgagtcttgaaagagttatcagattagaac

SEQ ID NO: 277894 - DNA, 42 bp, Artificial Sequence
  Description of Artificial Sequence: Synthetic oligonucleotide
gctcgatcaatgagtcttgaaagagttatcagattagaactg

SEQ ID NO: 277895 - DNA, 45 bp, Artificial Sequence
  Description of Artificial Sequence: Synthetic oligonucleotide
ctcgatcaatgagtcttgaaagagttatcagattagaactgttac

SEQ ID NO: 277896 - DNA, 45 bp, Artificial Sequence
  Description of Artificial Sequence: Synthetic oligonucleotide
tcgatcaatgagtcttgaaagagttatcagattagaactgttacc

SEQ ID NO: 277897 - DNA, 44 bp, Artificial Sequence
  Description of Artificial Sequence: Synthetic oligonucleotide
cgatcaatgagtcttgaaagagttatcagattagaactgttacc

SEQ ID NO: 277898 - DNA, 45 bp, Artificial Sequence
  Description of Artificial Sequence: Synthetic oligonucleotide
gatcaatgagtcttgaaagagttatcagattagaactgttaccac

SEQ ID NO: 277899 - DNA, 45 bp, Artificial Sequence
  Description of Artificial Sequence: Synthetic oligonucleotide
atcaatgagtcttgaaagagttatcagattagaactgttaccacg

SEQ ID NO: 277900 - DNA, 44 bp, Artificial Sequence
  Description of Artificial Sequence: Synthetic oligonucleotide
tcaatgagtcttgaaagagttatcagattagaactgttaccacg

SEQ ID NO: 277901 - DNA, 43 bp, Artificial Sequence
  Description of Artificial Sequence: Synthetic oligonucleotide
caatgagtcttgaaagagttatcagattagaactgttaccacg

SEQ ID NO: 277902 - DNA, 44 bp, Artificial Sequence
  Description of Artificial Sequence: Synthetic oligonucleotide
aatgagtcttgaaagagttatcagattagaactgttaccacgac

SEQ ID NO: 277903 - DNA, 43 bp, Artificial Sequence
  Description of Artificial Sequence: Synthetic oligonucleotide
atgagtcttgaaagagttatcagattagaactgttaccacgac

SEQ ID NO: 277904 - DNA, 42 bp, Artificial Sequence
  Description of Artificial Sequence: Synthetic oligonucleotide
tgagtcttgaaagagttatcagattagaactgttaccacgac

SEQ ID NO: 277905 - DNA, 41 bp, Artificial Sequence
  Description of Artificial Sequence: Synthetic oligonucleotide
gagtcttgaaagagttatcagattagaactgttaccacgac

SEQ ID NO: 277906 - DNA, 42 bp, Artificial Sequence
  Description of Artificial Sequence: Synthetic oligonucleotide
agtcttgaaagagttatcagattagaactgttaccacgactg

SEQ ID NO: 277907 - DNA, 41 bp, Artificial Sequence
  Description of Artificial Sequence: Synthetic oligonucleotide
gtcttgaaagagttatcagattagaactgttaccacgactg

SEQ ID NO: 277908 - DNA, 42 bp, Artificial Sequence
  Description of Artificial Sequence: Synthetic oligonucleotide
tcttgaaagagttatcagattagaactgttaccacgactgtc

SEQ ID NO: 277909 - DNA, 41 bp, Artificial Sequence
  Description of Artificial Sequence: Synthetic oligonucleotide
cttgaaagagttatcagattagaactgttaccacgactgtc

SEQ ID NO: 277910 - DNA, 42 bp, Artificial Sequence
  Description of Artificial Sequence: Synthetic oligonucleotide
ttgaaagagttatcagattagaactgttaccacgactgtctc

SEQ ID NO: 277911 - DNA, 41 bp, Artificial Sequence
  Description of Artificial Sequence: Synthetic oligonucleotide
tgaaagagttatcagattagaactgttaccacgactgtctc

SEQ ID NO: 277912 - DNA, 40 bp, Artificial Sequence
  Description of Artificial Sequence: Synthetic oligonucleotide
gaaagagttatcagattagaactgttaccacgactgtctc

SEQ ID NO: 277913 - DNA, 40 bp, Artificial Sequence
  Description of Artificial Sequence: Synthetic oligonucleotide
aaagagttatcagattagaactgttaccacgactgtctcc

SEQ ID NO: 277914 - DNA, 39 bp, Artificial Sequence
  Description of Artificial Sequence: Synthetic oligonucleotide
aagagttatcagattagaactgttaccacgactgtctcc

SEQ ID NO: 277915 - DNA, 38 bp, Artificial Sequence
  Description of Artificial Sequence: Synthetic oligonucleotide
agagttatcagattagaactgttaccacgactgtctcc

SEQ ID NO: 277916 - DNA, 37 bp, Artificial Sequence
  Description of Artificial Sequence: Synthetic oligonucleotide
gagttatcagattagaactgttaccacgactgtctcc

SEQ ID NO: 277917 - DNA, 42 bp, Artificial Sequence
  Description of Artificial Sequence: Synthetic oligonucleotide
agttatcagattagaactgttaccacgactgtctccaaatag

SEQ ID NO: 277918 - DNA, 41 bp, Artificial Sequence
  Description of Artificial Sequence: Synthetic oligonucleotide
gttatcagattagaactgttaccacgactgtctccaaatag

SEQ ID NO: 277919 - DNA, 41 bp, Artificial Sequence
  Description of Artificial Sequence: Synthetic oligonucleotide
ttatcagattagaactgttaccacgactgtctccaaatagg

SEQ ID NO: 277920 - DNA, 40 bp, Artificial Sequence
  Description of Artificial Sequence: Synthetic oligonucleotide
tatcagattagaactgttaccacgactgtctccaaatagg

SEQ ID NO: 277921 - DNA, 39 bp, Artificial Sequence
  Description of Artificial Sequence: Synthetic oligonucleotide
atcagattagaactgttaccacgactgtctccaaatagg

SEQ ID NO: 277922 - DNA, 38 bp, Artificial Sequence
  Description of Artificial Sequence: Synthetic oligonucleotide
tcagattagaactgttaccacgactgtctccaaatagg

SEQ ID NO: 277923 - DNA, 37 bp, Artificial Sequence
  Description of Artificial Sequence: Synthetic oligonucleotide
cagattagaactgttaccacgactgtctccaaatagg

SEQ ID NO: 277924 - DNA, 38 bp, Artificial Sequence
  Description of Artificial Sequence: Synthetic oligonucleotide
agattagaactgttaccacgactgtctccaaataggac

SEQ ID NO: 277925 - DNA, 37 bp, Artificial Sequence
  Description of Artificial Sequence: Synthetic oligonucleotide
gattagaactgttaccacgactgtctccaaataggac

SEQ ID NO: 277926 - DNA, 38 bp, Artificial Sequence
  Description of Artificial Sequence: Synthetic oligonucleotide
attagaactgttaccacgactgtctccaaataggactg

SEQ ID NO: 277927 - DNA, 37 bp, Artificial Sequence
  Description of Artificial Sequence: Synthetic oligonucleotide
ttagaactgttaccacgactgtctccaaataggactg

SEQ ID NO: 277928 - DNA, 36 bp, Artificial Sequence
  Description of Artificial Sequence: Synthetic oligonucleotide
tagaactgttaccacgactgtctccaaataggactg

SEQ ID NO: 277929 - DNA, 35 bp, Artificial Sequence
  Description of Artificial Sequence: Synthetic oligonucleotide
agaactgttaccacgactgtctccaaataggactg

SEQ ID NO: 277930 - DNA, 34 bp, Artificial Sequence
  Description of Artificial Sequence: Synthetic oligonucleotide
gaactgttaccacgactgtctccaaataggactg

SEQ ID NO: 277931 - DNA, 34 bp, Artificial Sequence
  Description of Artificial Sequence: Synthetic oligonucleotide
aactgttaccacgactgtctccaaataggactgg

SEQ ID NO: 277932 - DNA, 33 bp, Artificial Sequence
  Description of Artificial Sequence: Synthetic oligonucleotide
actgttaccacgactgtctccaaataggactgg

SEQ ID NO: 277933 - DNA, 32 bp, Artificial Sequence
  Description of Artificial Sequence: Synthetic oligonucleotide
ctgttaccacgactgtctccaaataggactgg

SEQ ID NO: 277934 - DNA, 33 bp, Artificial Sequence
  Description of Artificial Sequence: Synthetic oligonucleotide
tgttaccacgactgtctccaaataggactggtg

SEQ ID NO: 277935 - DNA, 32 bp, Artificial Sequence
  Description of Artificial Sequence: Synthetic oligonucleotide
gttaccacgactgtctccaaataggactggtg

SEQ ID NO: 277936 - DNA, 32 bp, Artificial Sequence
  Description of Artificial Sequence: Synthetic oligonucleotide
ttaccacgactgtctccaaataggactggtgc

SEQ ID NO: 277937 - DNA, 31 bp, Artificial Sequence
  Description of Artificial Sequence: Synthetic oligonucleotide
taccacgactgtctccaaataggactggtgc

SEQ ID NO: 277938 - DNA, 30 bp, Artificial Sequence
  Description of Artificial Sequence: Synthetic oligonucleotide
accacgactgtctccaaataggactggtgc

SEQ ID NO: 277939 - DNA, 29 bp, Artificial Sequence
  Description of Artificial Sequence: Synthetic oligonucleotide
ccacgactgtctccaaataggactggtgc

SEQ ID NO: 277940 - DNA, 30 bp, Artificial Sequence
  Description of Artificial Sequence: Synthetic oligonucleotide
cacgactgtctccaaataggactggtgctc

SEQ ID NO: 277941 - DNA, 31 bp, Artificial Sequence
  Description of Artificial Sequence: Synthetic oligonucleotide
acgactgtctccaaataggactggtgctcag

SEQ ID NO: 277942 - DNA, 30 bp, Artificial Sequence
  Description of Artificial Sequence: Synthetic oligonucleotide
cgactgtctccaaataggactggtgctcag

SEQ ID NO: 277943 - DNA, 34 bp, Artificial Sequence
  Description of Artificial Sequence: Synthetic oligonucleotide
gactgtctccaaataggactggtgctcagattag

SEQ ID NO: 277944 - DNA, 36 bp, Artificial Sequence
  Description of Artificial Sequence: Synthetic oligonucleotide
actgtctccaaataggactggtgctcagattagaac

SEQ ID NO: 277945 - DNA, 35 bp, Artificial Sequence
  Description of Artificial Sequence: Synthetic oligonucleotide
ctgtctccaaataggactggtgctcagattagaac

SEQ ID NO: 277946 - DNA, 35 bp, Artificial Sequence
  Description of Artificial Sequence: Synthetic oligonucleotide
tgtctccaaataggactggtgctcagattagaacc

SEQ ID NO: 277947 - DNA, 34 bp, Artificial Sequence
  Description of Artificial Sequence: Synthetic oligonucleotide
gtctccaaataggactggtgctcagattagaacc

SEQ ID NO: 277948 - DNA, 34 bp, Artificial Sequence
  Description of Artificial Sequence: Synthetic oligonucleotide
tctccaaataggactggtgctcagattagaaccg

SEQ ID NO: 277949 - DNA, 33 bp, Artificial Sequence
  Description of Artificial Sequence: Synthetic oligonucleotide
ctccaaataggactggtgctcagattagaaccg

SEQ ID NO: 277950 - DNA, 34 bp, Artificial Sequence
  Description of Artificial Sequence: Synthetic oligonucleotide
tccaaataggactggtgctcagattagaaccgtc

SEQ ID NO: 277951 - DNA, 33 bp, Artificial Sequence
  Description of Artificial Sequence: Synthetic oligonucleotide
ccaaataggactggtgctcagattagaaccgtc

SEQ ID NO: 277952 - DNA, 34 bp, Artificial Sequence
  Description of Artificial Sequence: Synthetic oligonucleotide
caaataggactggtgctcagattagaaccgtctg

SEQ ID NO: 277953 - DNA, 34 bp, Artificial Sequence
  Description of Artificial Sequence: Synthetic oligonucleotide
aaataggactggtgctcagattagaaccgtctgc

SEQ ID NO: 277954 - DNA, 33 bp, Artificial Sequence
  Description of Artificial Sequence: Synthetic oligonucleotide
aataggactggtgctcagattagaaccgtctgc

SEQ ID NO: 277955 - DNA, 32 bp, Artificial Sequence
  Description of Artificial Sequence: Synthetic oligonucleotide
ataggactggtgctcagattagaaccgtctgc

SEQ ID NO: 277956 - DNA, 31 bp, Artificial Sequence
  Description of Artificial Sequence: Synthetic oligonucleotide
taggactggtgctcagattagaaccgtctgc

SEQ ID NO: 277957 - DNA, 30 bp, Artificial Sequence
  Description of Artificial Sequence: Synthetic oligonucleotide
aggactggtgctcagattagaaccgtctgc

SEQ ID NO: 277958 - DNA, 29 bp, Artificial Sequence
  Description of Artificial Sequence: Synthetic oligonucleotide
ggactggtgctcagattagaaccgtctgc

SEQ ID NO: 277959 - DNA, 30 bp, Artificial Sequence
  Description of Artificial Sequence: Synthetic oligonucleotide
gactggtgctcagattagaaccgtctgcac

SEQ ID NO: 277960 - DNA, 31 bp, Artificial Sequence
  Description of Artificial Sequence: Synthetic oligonucleotide
actggtgctcagattagaaccgtctgcactg

SEQ ID NO: 277961 - DNA, 30 bp, Artificial Sequence
  Description of Artificial Sequence: Synthetic oligonucleotide
ctggtgctcagattagaaccgtctgcactg

SEQ ID NO: 277962 - DNA, 31 bp, Artificial Sequence
  Description of Artificial Sequence: Synthetic oligonucleotide
tggtgctcagattagaaccgtctgcactgag

SEQ ID NO: 277963 - DNA, 30 bp, Artificial Sequence
  Description of Artificial Sequence: Synthetic oligonucleotide
ggtgctcagattagaaccgtctgcactgag

SEQ ID NO: 277964 - DNA, 30 bp, Artificial Sequence
  Description of Artificial Sequence: Synthetic oligonucleotide
gtgctcagattagaaccgtctgcactgagg

SEQ ID NO: 277965 - DNA, 30 bp, Artificial Sequence
  Description of Artificial Sequence: Synthetic oligonucleotide
tgctcagattagaaccgtctgcactgaggc

SEQ ID NO: 277966 - DNA, 29 bp, Artificial Sequence
  Description of Artificial Sequence: Synthetic oligonucleotide
gctcagattagaaccgtctgcactgaggc

SEQ ID NO: 277967 - DNA, 30 bp, Artificial Sequence
  Description of Artificial Sequence: Synthetic oligonucleotide
ctcagattagaaccgtctgcactgaggctg

SEQ ID NO: 277968 - DNA, 30 bp, Artificial Sequence
  Description of Artificial Sequence: Synthetic oligonucleotide
tcagattagaaccgtctgcactgaggctgg

SEQ ID NO: 277969 - DNA, 29 bp, Artificial Sequence
  Description of Artificial Sequence: Synthetic oligonucleotide
cagattagaaccgtctgcactgaggctgg

SEQ ID NO: 277970 - DNA, 32 bp, Artificial Sequence
  Description of Artificial Sequence: Synthetic oligonucleotide
agattagaaccgtctgcactgaggctggtttg

SEQ ID NO: 277971 - DNA, 31 bp, Artificial Sequence
  Description of Artificial Sequence: Synthetic oligonucleotide
gattagaaccgtctgcactgaggctggtttg

SEQ ID NO: 277972 - DNA, 34 bp, Artificial Sequence
  Description of Artificial Sequence: Synthetic oligonucleotide
attagaaccgtctgcactgaggctggtttgtttg

SEQ ID NO: 277973 - DNA, 33 bp, Artificial Sequence
  Description of Artificial Sequence: Synthetic oligonucleotide
ttagaaccgtctgcactgaggctggtttgtttg

SEQ ID NO: 277974 - DNA, 32 bp, Artificial Sequence
  Description of Artificial Sequence: Synthetic oligonucleotide
tagaaccgtctgcactgaggctggtttgtttg

SEQ ID NO: 277975 - DNA, 31 bp, Artificial Sequence
  Description of Artificial Sequence: Synthetic oligonucleotide
agaaccgtctgcactgaggctggtttgtttg

SEQ ID NO: 277976 - DNA, 30 bp, Artificial Sequence
  Description of Artificial Sequence: Synthetic oligonucleotide
gaaccgtctgcactgaggctggtttgtttg

SEQ ID NO: 277977 - DNA, 30 bp, Artificial Sequence
  Description of Artificial Sequence: Synthetic oligonucleotide
aaccgtctgcactgaggctggtttgtttgc

SEQ ID NO: 277978 - DNA, 29 bp, Artificial Sequence
  Description of Artificial Sequence: Synthetic oligonucleotide
accgtctgcactgaggctggtttgtttgc

SEQ ID NO: 277979 - DNA, 28 bp, Artificial Sequence
  Description of Artificial Sequence: Synthetic oligonucleotide
ccgtctgcactgaggctggtttgtttgc

SEQ ID NO: 277980 - DNA, 28 bp, Artificial Sequence
  Description of Artificial Sequence: Synthetic oligonucleotide
cgtctgcactgaggctggtttgtttgcc

SEQ ID NO: 277981 - DNA, 30 bp, Artificial Sequence
  Description of Artificial Sequence: Synthetic oligonucleotide
gtctgcactgaggctggtttgtttgccaac

SEQ ID NO: 277982 - DNA, 31 bp, Artificial Sequence
  Description of Artificial Sequence: Synthetic oligonucleotide
tctgcactgaggctggtttgtttgccaacag

SEQ ID NO: 277983 - DNA, 30 bp, Artificial Sequence
  Description of Artificial Sequence: Synthetic oligonucleotide
ctgcactgaggctggtttgtttgccaacag

SEQ ID NO: 277984 - DNA, 31 bp, Artificial Sequence
  Description of Artificial Sequence: Synthetic oligonucleotide
tgcactgaggctggtttgtttgccaacagag

SEQ ID NO: 277985 - DNA, 30 bp, Artificial Sequence
  Description of Artificial Sequence: Synthetic oligonucleotide
gcactgaggctggtttgtttgccaacagag

SEQ ID NO: 277986 - DNA, 30 bp, Artificial Sequence
  Description of Artificial Sequence: Synthetic oligonucleotide
cactgaggctggtttgtttgccaacagagc

SEQ ID NO: 277987 - DNA, 31 bp, Artificial Sequence
  Description of Artificial Sequence: Synthetic oligonucleotide
actgaggctggtttgtttgccaacagagcac

SEQ ID NO: 277988 - DNA, 30 bp, Artificial Sequence
  Description of Artificial Sequence: Synthetic oligonucleotide
ctgaggctggtttgtttgccaacagagcac

SEQ ID NO: 277989 - DNA, 30 bp, Artificial Sequence
  Description of Artificial Sequence: Synthetic oligonucleotide
tgaggctggtttgtttgccaacagagcacg

SEQ ID NO: 277990 - DNA, 29 bp, Artificial Sequence
  Description of Artificial Sequence: Synthetic oligonucleotide
gaggctggtttgtttgccaacagagcacg

SEQ ID NO: 277991 - DNA, 29 bp, Artificial Sequence
  Description of Artificial Sequence: Synthetic oligonucleotide
aggctggtttgtttgccaacagagcacgc

SEQ ID NO: 277992 - DNA, 28 bp, Artificial Sequence
  Description of Artificial Sequence: Synthetic oligonucleotide
ggctggtttgtttgccaacagagcacgc

SEQ ID NO: 277993 - DNA, 28 bp, Artificial Sequence
  Description of Artificial Sequence: Synthetic oligonucleotide
gctggtttgtttgccaacagagcacgcc

SEQ ID NO: 277994 - DNA, 28 bp, Artificial Sequence
  Description of Artificial Sequence: Synthetic oligonucleotide
ctggtttgtttgccaacagagcacgccg

SEQ ID NO: 277995 - DNA, 35 bp, Artificial Sequence
  Description of Artificial Sequence: Synthetic oligonucleotide
tggtttgtttgccaacagagcacgccgaaaaattc

SEQ ID NO: 277996 - DNA, 34 bp, Artificial Sequence
  Description of Artificial Sequence: Synthetic oligonucleotide
ggtttgtttgccaacagagcacgccgaaaaattc

SEQ ID NO: 277997 - DNA, 34 bp, Artificial Sequence
  Description of Artificial Sequence: Synthetic oligonucleotide
gtttgtttgccaacagagcacgccgaaaaattcc

SEQ ID NO: 277998 - DNA, 36 bp, Artificial Sequence
  Description of Artificial Sequence: Synthetic oligonucleotide
tttgtttgccaacagagcacgccgaaaaattcctac

SEQ ID NO: 277999 - DNA, 35 bp, Artificial Sequence
  Description of Artificial Sequence: Synthetic oligonucleotide
ttgtttgccaacagagcacgccgaaaaattcctac

SEQ ID NO: 278000 - DNA, 34 bp, Artificial Sequence
  Description of Artificial Sequence: Synthetic oligonucleotide
tgtttgccaacagagcacgccgaaaaattcctac

SEQ ID NO: 278001 - DNA, 33 bp, Artificial Sequence
  Description of Artificial Sequence: Synthetic oligonucleotide
gtttgccaacagagcacgccgaaaaattcctac

SEQ ID NO: 278002 - DNA, 33 bp, Artificial Sequence
  Description of Artificial Sequence: Synthetic oligonucleotide
tttgccaacagagcacgccgaaaaattcctacc

SEQ ID NO: 278003 - DNA, 32 bp, Artificial Sequence
  Description of Artificial Sequence: Synthetic oligonucleotide
ttgccaacagagcacgccgaaaaattcctacc

SEQ ID NO: 278004 - DNA, 31 bp, Artificial Sequence
  Description of Artificial Sequence: Synthetic oligonucleotide
tgccaacagagcacgccgaaaaattcctacc

SEQ ID NO: 278005 - DNA, 30 bp, Artificial Sequence
  Description of Artificial Sequence: Synthetic oligonucleotide
gccaacagagcacgccgaaaaattcctacc

SEQ ID NO: 278006 - DNA, 30 bp, Artificial Sequence
  Description of Artificial Sequence: Synthetic oligonucleotide
ccaacagagcacgccgaaaaattcctaccg

SEQ ID NO: 278007 - DNA, 31 bp, Artificial Sequence
  Description of Artificial Sequence: Synthetic oligonucleotide
caacagagcacgccgaaaaattcctaccgag

SEQ ID NO: 278008 - DNA, 33 bp, Artificial Sequence
  Description of Artificial Sequence: Synthetic oligonucleotide
aacagagcacgccgaaaaattcctaccgagatg

SEQ ID NO: 278009 - DNA, 32 bp, Artificial Sequence
  Description of Artificial Sequence: Synthetic oligonucleotide
acagagcacgccgaaaaattcctaccgagatg

SEQ ID NO: 278010 - DNA, 31 bp, Artificial Sequence
  Description of Artificial Sequence: Synthetic oligonucleotide
cagagcacgccgaaaaattcctaccgagatg

SEQ ID NO: 278011 - DNA, 31 bp, Artificial Sequence
  Description of Artificial Sequence: Synthetic oligonucleotide
agagcacgccgaaaaattcctaccgagatgg

SEQ ID NO: 278012 - DNA, 30 bp, Artificial Sequence
  Description of Artificial Sequence: Synthetic oligonucleotide
gagcacgccgaaaaattcctaccgagatgg

SEQ ID NO: 278013 - DNA, 34 bp, Artificial Sequence
  Description of Artificial Sequence: Synthetic oligonucleotide
agcacgccgaaaaattcctaccgagatggatttc

SEQ ID NO: 278014 - DNA, 33 bp, Artificial Sequence
  Description of Artificial Sequence: Synthetic oligonucleotide
gcacgccgaaaaattcctaccgagatggatttc

SEQ ID NO: 278015 - DNA, 35 bp, Artificial Sequence
  Description of Artificial Sequence: Synthetic oligonucleotide
cacgccgaaaaattcctaccgagatggatttcttc

SEQ ID NO: 278016 - DNA, 35 bp, Artificial Sequence
  Description of Artificial Sequence: Synthetic oligonucleotide
acgccgaaaaattcctaccgagatggatttcttcg

SEQ ID NO: 278017 - DNA, 34 bp, Artificial Sequence
  Description of Artificial Sequence: Synthetic oligonucleotide
cgccgaaaaattcctaccgagatggatttcttcg

SEQ ID NO: 278018 - DNA, 36 bp, Artificial Sequence
  Description of Artificial Sequence: Synthetic oligonucleotide
gccgaaaaattcctaccgagatggatttcttcgaag

SEQ ID NO: 278019 - DNA, 36 bp, Artificial Sequence
  Description of Artificial Sequence: Synthetic oligonucleotide
ccgaaaaattcctaccgagatggatttcttcgaagc

SEQ ID NO: 278020 - DNA, 37 bp, Artificial Sequence
  Description of Artificial Sequence: Synthetic oligonucleotide
cgaaaaattcctaccgagatggatttcttcgaagctg

SEQ ID NO: 278021 - DNA, 44 bp, Artificial Sequence
  Description of Artificial Sequence: Synthetic oligonucleotide
gaaaaattcctaccgagatggatttcttcgaagctgtatataag

SEQ ID NO: 278022 - DNA, 44 bp, Artificial Sequence
  Description of Artificial Sequence: Synthetic oligonucleotide
aaaaattcctaccgagatggatttcttcgaagctgtatataagg

SEQ ID NO: 278023 - DNA, 43 bp, Artificial Sequence
  Description of Artificial Sequence: Synthetic oligonucleotide
aaaattcctaccgagatggatttcttcgaagctgtatataagg

SEQ ID NO: 278024 - DNA, 42 bp, Artificial Sequence
  Description of Artificial Sequence: Synthetic oligonucleotide
aaattcctaccgagatggatttcttcgaagctgtatataagg

SEQ ID NO: 278025 - DNA, 41 bp, Artificial Sequence
  Description of Artificial Sequence: Synthetic oligonucleotide
aattcctaccgagatggatttcttcgaagctgtatataagg

SEQ ID NO: 278026 - DNA, 40 bp, Artificial Sequence
  Description of Artificial Sequence: Synthetic oligonucleotide
attcctaccgagatggatttcttcgaagctgtatataagg

SEQ ID NO: 278027 - DNA, 39 bp, Artificial Sequence
  Description of Artificial Sequence: Synthetic oligonucleotide
ttcctaccgagatggatttcttcgaagctgtatataagg

SEQ ID NO: 278028 - DNA, 38 bp, Artificial Sequence
  Description of Artificial Sequence: Synthetic oligonucleotide
tcctaccgagatggatttcttcgaagctgtatataagg

SEQ ID NO: 278029 - DNA, 37 bp, Artificial Sequence
  Description of Artificial Sequence: Synthetic oligonucleotide
cctaccgagatggatttcttcgaagctgtatataagg

SEQ ID NO: 278030 - DNA, 38 bp, Artificial Sequence
  Description of Artificial Sequence: Synthetic oligonucleotide
ctaccgagatggatttcttcgaagctgtatataaggtc

SEQ ID NO: 278031 - DNA, 43 bp, Artificial Sequence
  Description of Artificial Sequence: Synthetic oligonucleotide
taccgagatggatttcttcgaagctgtatataaggtcaataag

SEQ ID NO: 278032 - DNA, 42 bp, Artificial Sequence
  Description of Artificial Sequence: Synthetic oligonucleotide
accgagatggatttcttcgaagctgtatataaggtcaataag

SEQ ID NO: 278033 - DNA, 41 bp, Artificial Sequence
  Description of Artificial Sequence: Synthetic oligonucleotide
ccgagatggatttcttcgaagctgtatataaggtcaataag

SEQ ID NO: 278034 - DNA, 42 bp, Artificial Sequence
  Description of Artificial Sequence: Synthetic oligonucleotide
cgagatggatttcttcgaagctgtatataaggtcaataagtc

SEQ ID NO: 278035 - DNA, 46 bp, Artificial Sequence
  Description of Artificial Sequence: Synthetic oligonucleotide
gagatggatttcttcgaagctgtatataaggtcaataagtcttaag

SEQ ID NO: 278036 - DNA, 46 bp, Artificial Sequence
  Description of Artificial Sequence: Synthetic oligonucleotide
agatggatttcttcgaagctgtatataaggtcaataagtcttaagc

SEQ ID NO: 278037 - DNA, 45 bp, Artificial Sequence
  Description of Artificial Sequence: Synthetic oligonucleotide
gatggatttcttcgaagctgtatataaggtcaataagtcttaagc

SEQ ID NO: 278038 - DNA, 45 bp, Artificial Sequence
  Description of Artificial Sequence: Synthetic oligonucleotide
atggatttcttcgaagctgtatataaggtcaataagtcttaagcc

SEQ ID NO: 278039 - DNA, 44 bp, Artificial Sequence
  Description of Artificial Sequence: Synthetic oligonucleotide
tggatttcttcgaagctgtatataaggtcaataagtcttaagcc

SEQ ID NO: 278040 - DNA, 43 bp, Artificial Sequence
  Description of Artificial Sequence: Synthetic oligonucleotide
ggatttcttcgaagctgtatataaggtcaataagtcttaagcc

SEQ ID NO: 278041 - DNA, 48 bp, Artificial Sequence
  Description of Artificial Sequence: Synthetic oligonucleotide
gatttcttcgaagctgtatataaggtcaataagtcttaagccaaattc

SEQ ID NO: 278042 - DNA, 49 bp, Artificial Sequence
  Description of Artificial Sequence: Synthetic oligonucleotide
atttcttcgaagctgtatataaggtcaataagtcttaagccaaattctg

SEQ ID NO: 278043 - DNA, 48 bp, Artificial Sequence
  Description of Artificial Sequence: Synthetic oligonucleotide
tttcttcgaagctgtatataaggtcaataagtcttaagccaaattctg

SEQ ID NO: 278044 - DNA, 47 bp, Artificial Sequence
  Description of Artificial Sequence: Synthetic oligonucleotide
ttcttcgaagctgtatataaggtcaataagtcttaagccaaattctg

SEQ ID NO: 278045 - DNA, 46 bp, Artificial Sequence
  Description of Artificial Sequence: Synthetic oligonucleotide
tcttcgaagctgtatataaggtcaataagtcttaagccaaattctg

SEQ ID NO: 278046 - DNA, 45 bp, Artificial Sequence
  Description of Artificial Sequence: Synthetic oligonucleotide
cttcgaagctgtatataaggtcaataagtcttaagccaaattctg

SEQ ID NO: 278047 - DNA, 46 bp, Artificial Sequence
  Description of Artificial Sequence: Synthetic oligonucleotide
ttcgaagctgtatataaggtcaataagtcttaagccaaattctgtg

SEQ ID NO: 278048 - DNA, 45 bp, Artificial Sequence
  Description of Artificial Sequence: Synthetic oligonucleotide
tcgaagctgtatataaggtcaataagtcttaagccaaattctgtg

SEQ ID NO: 278049 - DNA, 44 bp, Artificial Sequence
  Description of Artificial Sequence: Synthetic oligonucleotide
cgaagctgtatataaggtcaataagtcttaagccaaattctgtg

SEQ ID NO: 278050 - DNA, 44 bp, Artificial Sequence
  Description of Artificial Sequence: Synthetic oligonucleotide
gaagctgtatataaggtcaataagtcttaagccaaattctgtgc

SEQ ID NO: 278051 - DNA, 46 bp, Artificial Sequence
  Description of Artificial Sequence: Synthetic oligonucleotide
aagctgtatataaggtcaataagtcttaagccaaattctgtgctac

SEQ ID NO: 278052 - DNA, 45 bp, Artificial Sequence
  Description of Artificial Sequence: Synthetic oligonucleotide
agctgtatataaggtcaataagtcttaagccaaattctgtgctac

SEQ ID NO: 278053 - DNA, 44 bp, Artificial Sequence
  Description of Artificial Sequence: Synthetic oligonucleotide
gctgtatataaggtcaataagtcttaagccaaattctgtgctac

SEQ ID NO: 278054 - DNA, 45 bp, Artificial Sequence
  Description of Artificial Sequence: Synthetic oligonucleotide
ctgtatataaggtcaataagtcttaagccaaattctgtgctactc

SEQ ID NO: 278055 - DNA, 45 bp, Artificial Sequence
  Description of Artificial Sequence: Synthetic oligonucleotide
tgtatataaggtcaataagtcttaagccaaattctgtgctactcg

SEQ ID NO: 278056 - DNA, 44 bp, Artificial Sequence
  Description of Artificial Sequence: Synthetic oligonucleotide
gtatataaggtcaataagtcttaagccaaattctgtgctactcg

SEQ ID NO: 278057 - DNA, 45 bp, Artificial Sequence
  Description of Artificial Sequence: Synthetic oligonucleotide
tatataaggtcaataagtcttaagccaaattctgtgctactcgtc

SEQ ID NO: 278058 - DNA, 44 bp, Artificial Sequence
  Description of Artificial Sequence: Synthetic oligonucleotide
atataaggtcaataagtcttaagccaaattctgtgctactcgtc

SEQ ID NO: 278059 - DNA, 43 bp, Artificial Sequence
  Description of Artificial Sequence: Synthetic oligonucleotide
tataaggtcaataagtcttaagccaaattctgtgctactcgtc

SEQ ID NO: 278060 - DNA, 42 bp, Artificial Sequence
  Description of Artificial Sequence: Synthetic oligonucleotide
ataaggtcaataagtcttaagccaaattctgtgctactcgtc

SEQ ID NO: 278061 - DNA, 41 bp, Artificial Sequence
  Description of Artificial Sequence: Synthetic oligonucleotide
taaggtcaataagtcttaagccaaattctgtgctactcgtc

SEQ ID NO: 278062 - DNA, 40 bp, Artificial Sequence
  Description of Artificial Sequence: Synthetic oligonucleotide
aaggtcaataagtcttaagccaaattctgtgctactcgtc

SEQ ID NO: 278063 - DNA, 39 bp, Artificial Sequence
  Description of Artificial Sequence: Synthetic oligonucleotide
aggtcaataagtcttaagccaaattctgtgctactcgtc

SEQ ID NO: 278064 - DNA, 38 bp, Artificial Sequence
  Description of Artificial Sequence: Synthetic oligonucleotide
ggtcaataagtcttaagccaaattctgtgctactcgtc

SEQ ID NO: 278065 - DNA, 38 bp, Artificial Sequence
  Description of Artificial Sequence: Synthetic oligonucleotide
gtcaataagtcttaagccaaattctgtgctactcgtcg

SEQ ID NO: 278066 - DNA, 41 bp, Artificial Sequence
  Description of Artificial Sequence: Synthetic oligonucleotide
tcaataagtcttaagccaaattctgtgctactcgtcgttac

SEQ ID NO: 278067 - DNA, 40 bp, Artificial Sequence
  Description of Artificial Sequence: Synthetic oligonucleotide
caataagtcttaagccaaattctgtgctactcgtcgttac

SEQ ID NO: 278068 - DNA, 42 bp, Artificial Sequence
  Description of Artificial Sequence: Synthetic oligonucleotide
aataagtcttaagccaaattctgtgctactcgtcgttacatc

SEQ ID NO: 278069 - DNA, 41 bp, Artificial Sequence
  Description of Artificial Sequence: Synthetic oligonucleotide
ataagtcttaagccaaattctgtgctactcgtcgttacatc

SEQ ID NO: 278070 - DNA, 40 bp, Artificial Sequence
  Description of Artificial Sequence: Synthetic oligonucleotide
taagtcttaagccaaattctgtgctactcgtcgttacatc

SEQ ID NO: 278071 - DNA, 39 bp, Artificial Sequence
  Description of Artificial Sequence: Synthetic oligonucleotide
aagtcttaagccaaattctgtgctactcgtcgttacatc

SEQ ID NO: 278072 - DNA, 38 bp, Artificial Sequence
  Description of Artificial Sequence: Synthetic oligonucleotide
agtcttaagccaaattctgtgctactcgtcgttacatc

SEQ ID NO: 278073 - DNA, 37 bp, Artificial Sequence
  Description of Artificial Sequence: Synthetic oligonucleotide
gtcttaagccaaattctgtgctactcgtcgttacatc

SEQ ID NO: 278074 - DNA, 38 bp, Artificial Sequence
  Description of Artificial Sequence: Synthetic oligonucleotide
tcttaagccaaattctgtgctactcgtcgttacatcac

SEQ ID NO: 278075 - DNA, 37 bp, Artificial Sequence
  Description of Artificial Sequence: Synthetic oligonucleotide
cttaagccaaattctgtgctactcgtcgttacatcac

SEQ ID NO: 278076 - DNA, 40 bp, Artificial Sequence
  Description of Artificial Sequence: Synthetic oligonucleotide
ttaagccaaattctgtgctactcgtcgttacatcacatac

SEQ ID NO: 278077 - DNA, 39 bp, Artificial Sequence
  Description of Artificial Sequence: Synthetic oligonucleotide
taagccaaattctgtgctactcgtcgttacatcacatac

SEQ ID NO: 278078 - DNA, 38 bp, Artificial Sequence
  Description of Artificial Sequence: Synthetic oligonucleotide
aagccaaattctgtgctactcgtcgttacatcacatac

SEQ ID NO: 278079 - DNA, 37 bp, Artificial Sequence
  Description of Artificial Sequence: Synthetic oligonucleotide
agccaaattctgtgctactcgtcgttacatcacatac

SEQ ID NO: 278080 - DNA, 36 bp, Artificial Sequence
  Description of Artificial Sequence: Synthetic oligonucleotide
gccaaattctgtgctactcgtcgttacatcacatac

SEQ ID NO: 278081 - DNA, 38 bp, Artificial Sequence
  Description of Artificial Sequence: Synthetic oligonucleotide
ccaaattctgtgctactcgtcgttacatcacatacaac

SEQ ID NO: 278082 - DNA, 39 bp, Artificial Sequence
  Description of Artificial Sequence: Synthetic oligonucleotide
caaattctgtgctactcgtcgttacatcacatacaacag

SEQ ID NO: 278083 - DNA, 35 bp, Artificial Sequence
  Description of Artificial Sequence: Synthetic oligonucleotide
atgaaactgctgccgtatattgagactccagtgac

SEQ ID NO: 278084 - DNA, 34 bp, Artificial Sequence
  Description of Artificial Sequence: Synthetic oligonucleotide
tgaaactgctgccgtatattgagactccagtgac

SEQ ID NO: 278085 - DNA, 33 bp, Artificial Sequence
  Description of Artificial Sequence: Synthetic oligonucleotide
gaaactgctgccgtatattgagactccagtgac

SEQ ID NO: 278086 - DNA, 34 bp, Artificial Sequence
  Description of Artificial Sequence: Synthetic oligonucleotide
aaactgctgccgtatattgagactccagtgacac

SEQ ID NO: 278087 - DNA, 33 bp, Artificial Sequence
  Description of Artificial Sequence: Synthetic oligonucleotide
aactgctgccgtatattgagactccagtgacac

SEQ ID NO: 278088 - DNA, 32 bp, Artificial Sequence
  Description of Artificial Sequence: Synthetic oligonucleotide
actgctgccgtatattgagactccagtgacac

SEQ ID NO: 278089 - DNA, 31 bp, Artificial Sequence
  Description of Artificial Sequence: Synthetic oligonucleotide
ctgctgccgtatattgagactccagtgacac

SEQ ID NO: 278090 - DNA, 31 bp, Artificial Sequence
  Description of Artificial Sequence: Synthetic oligonucleotide
tgctgccgtatattgagactccagtgacacg

SEQ ID NO: 278091 - DNA, 30 bp, Artificial Sequence
  Description of Artificial Sequence: Synthetic oligonucleotide
gctgccgtatattgagactccagtgacacg

SEQ ID NO: 278092 - DNA, 30 bp, Artificial Sequence
  Description of Artificial Sequence: Synthetic oligonucleotide
ctgccgtatattgagactccagtgacacgg

SEQ ID NO: 278093 - DNA, 30 bp, Artificial Sequence
  Description of Artificial Sequence: Synthetic oligonucleotide
tgccgtatattgagactccagtgacacggc

SEQ ID NO: 278094 - DNA, 29 bp, Artificial Sequence
  Description of Artificial Sequence: Synthetic oligonucleotide
gccgtatattgagactccagtgacacggc

SEQ ID NO: 278095 - DNA, 30 bp, Artificial Sequence
  Description of Artificial Sequence: Synthetic oligonucleotide
ccgtatattgagactccagtgacacggcag

SEQ ID NO: 278096 - DNA, 30 bp, Artificial Sequence
  Description of Artificial Sequence: Synthetic oligonucleotide
cgtatattgagactccagtgacacggcagg

SEQ ID NO: 278097 - DNA, 31 bp, Artificial Sequence
  Description of Artificial Sequence: Synthetic oligonucleotide
gtatattgagactccagtgacacggcaggag

SEQ ID NO: 278098 - DNA, 33 bp, Artificial Sequence
  Description of Artificial Sequence: Synthetic oligonucleotide
tatattgagactccagtgacacggcaggagtag

SEQ ID NO: 278099 - DNA, 32 bp, Artificial Sequence
  Description of Artificial Sequence: Synthetic oligonucleotide
atattgagactccagtgacacggcaggagtag

SEQ ID NO: 278100 - DNA, 31 bp, Artificial Sequence
  Description of Artificial Sequence: Synthetic oligonucleotide
tattgagactccagtgacacggcaggagtag

SEQ ID NO: 278101 - DNA, 30 bp, Artificial Sequence
  Description of Artificial Sequence: Synthetic oligonucleotide
attgagactccagtgacacggcaggagtag

SEQ ID NO: 278102 - DNA, 29 bp, Artificial Sequence
  Description of Artificial Sequence: Synthetic oligonucleotide
ttgagactccagtgacacggcaggagtag

SEQ ID NO: 278103 - DNA, 28 bp, Artificial Sequence
  Description of Artificial Sequence: Synthetic oligonucleotide
tgagactccagtgacacggcaggagtag

SEQ ID NO: 278104 - DNA, 27 bp, Artificial Sequence
  Description of Artificial Sequence: Synthetic oligonucleotide
gagactccagtgacacggcaggagtag

SEQ ID NO: 278105 - DNA, 29 bp, Artificial Sequence
  Description of Artificial Sequence: Synthetic oligonucleotide
agactccagtgacacggcaggagtagatg

SEQ ID NO: 278106 - DNA, 28 bp, Artificial Sequence
  Description of Artificial Sequence: Synthetic oligonucleotide
gactccagtgacacggcaggagtagatg

SEQ ID NO: 278107 - DNA, 28 bp, Artificial Sequence
  Description of Artificial Sequence: Synthetic oligonucleotide
actccagtgacacggcaggagtagatgg

SEQ ID NO: 278108 - DNA, 27 bp, Artificial Sequence
  Description of Artificial Sequence: Synthetic oligonucleotide
ctccagtgacacggcaggagtagatgg

SEQ ID NO: 278109 - DNA, 27 bp, Artificial Sequence
  Description of Artificial Sequence: Synthetic oligonucleotide
tccagtgacacggcaggagtagatggc

SEQ ID NO: 278110 - DNA, 26 bp, Artificial Sequence
  Description of Artificial Sequence: Synthetic oligonucleotide
ccagtgacacggcaggagtagatggc

SEQ ID NO: 278111 - DNA, 27 bp, Artificial Sequence
  Description of Artificial Sequence: Synthetic oligonucleotide
cagtgacacggcaggagtagatggcga

SEQ ID NO: 278112 - DNA, 27 bp, Artificial Sequence
  Description of Artificial Sequence: Synthetic oligonucleotide
agtgacacggcaggagtagatggcgag

SEQ ID NO: 278113 - DNA, 26 bp, Artificial Sequence
  Description of Artificial Sequence: Synthetic oligonucleotide
gtgacacggcaggagtagatggcgag

SEQ ID NO: 278114 - DNA, 26 bp, Artificial Sequence
  Description of Artificial Sequence: Synthetic oligonucleotide
tgacacggcaggagtagatggcgagc

SEQ ID NO: 278115 - DNA, 25 bp, Artificial Sequence
  Description of Artificial Sequence: Synthetic oligonucleotide
gacacggcaggagtagatggcgagc

SEQ ID NO: 278116 - DNA, 26 bp, Artificial Sequence
  Description of Artificial Sequence: Synthetic oligonucleotide
acacggcaggagtagatggcgagcgt

SEQ ID NO: 278117 - DNA, 25 bp, Artificial Sequence
  Description of Artificial Sequence: Synthetic oligonucleotide
cacggcaggagtagatggcgagcgt

SEQ ID NO: 278118 - DNA, 26 bp, Artificial Sequence
  Description of Artificial Sequence: Synthetic oligonucleotide
acggcaggagtagatggcgagcgtgt

SEQ ID NO: 278119 - DNA, 25 bp, Artificial Sequence
  Description of Artificial Sequence: Synthetic oligonucleotide
cggcaggagtagatggcgagcgtgt

SEQ ID NO: 278120 - DNA, 25 bp, Artificial Sequence
  Description of Artificial Sequence: Synthetic oligonucleotide
ggcaggagtagatggcgagcgtgtg

SEQ ID NO: 278121 - DNA, 25 bp, Artificial Sequence
  Description of Artificial Sequence: Synthetic oligonucleotide
gcaggagtagatggcgagcgtgtgg

SEQ ID NO: 278122 - DNA, 27 bp, Artificial Sequence
  Description of Artificial Sequence: Synthetic oligonucleotide
caggagtagatggcgagcgtgtgggaa

SEQ ID NO: 278123 - DNA, 27 bp, Artificial Sequence
  Description of Artificial Sequence: Synthetic oligonucleotide
aggagtagatggcgagcgtgtgggaag

SEQ ID NO: 278124 - DNA, 27 bp, Artificial Sequence
  Description of Artificial Sequence: Synthetic oligonucleotide
ggagtagatggcgagcgtgtgggaaga

SEQ ID NO: 278125 - DNA, 27 bp, Artificial Sequence
  Description of Artificial Sequence: Synthetic oligonucleotide
gagtagatggcgagcgtgtgggaagag

SEQ ID NO: 278126 - DNA, 27 bp, Artificial Sequence
  Description of Artificial Sequence: Synthetic oligonucleotide
agtagatggcgagcgtgtgggaagagg

SEQ ID NO: 278127 - DNA, 26 bp, Artificial Sequence
  Description of Artificial Sequence: Synthetic oligonucleotide
gtagatggcgagcgtgtgggaagagg

SEQ ID NO: 278128 - DNA, 26 bp, Artificial Sequence
  Description of Artificial Sequence: Synthetic oligonucleotide
tagatggcgagcgtgtgggaagaggc

SEQ ID NO: 278129 - DNA, 25 bp, Artificial Sequence
  Description of Artificial Sequence: Synthetic oligonucleotide
agatggcgagcgtgtgggaagaggc

SEQ ID NO: 278130 - DNA, 24 bp, Artificial Sequence
  Description of Artificial Sequence: Synthetic oligonucleotide
gatggcgagcgtgtgggaagaggc

SEQ ID NO: 278131 - DNA, 24 bp, Artificial Sequence
  Description of Artificial Sequence: Synthetic oligonucleotide
atggcgagcgtgtgggaagaggcc

SEQ ID NO: 278132 - DNA, 23 bp, Artificial Sequence
  Description of Artificial Sequence: Synthetic oligonucleotide
tggcgagcgtgtgggaagaggcc

SEQ ID NO: 278133 - DNA, 22 bp, Artificial Sequence
  Description of Artificial Sequence: Synthetic oligonucleotide
ggcgagcgtgtgggaagaggcc

SEQ ID NO: 278134 - DNA, 23 bp, Artificial Sequence
  Description of Artificial Sequence: Synthetic oligonucleotide
gcgagcgtgtgggaagaggccga

SEQ ID NO: 278135 - DNA, 23 bp, Artificial Sequence
  Description of Artificial Sequence: Synthetic oligonucleotide
cgagcgtgtgggaagaggccgag

SEQ ID NO: 278136 - DNA, 25 bp, Artificial Sequence
  Description of Artificial Sequence: Synthetic oligonucleotide
gagcgtgtgggaagaggccgaggaa

SEQ ID NO: 278137 - DNA, 27 bp, Artificial Sequence
  Description of Artificial Sequence: Synthetic oligonucleotide
agcgtgtgggaagaggccgaggaagat

SEQ ID NO: 278138 - DNA, 26 bp, Artificial Sequence
  Description of Artificial Sequence: Synthetic oligonucleotide
gcgtgtgggaagaggccgaggaagat

SEQ ID NO: 278139 - DNA, 26 bp, Artificial Sequence
  Description of Artificial Sequence: Synthetic oligonucleotide
cgtgtgggaagaggccgaggaagatg

SEQ ID NO: 278140 - DNA, 27 bp, Artificial Sequence
  Description of Artificial Sequence: Synthetic oligonucleotide
gtgtgggaagaggccgaggaagatgga

SEQ ID NO: 278141 - DNA, 30 bp, Artificial Sequence
  Description of Artificial Sequence: Synthetic oligonucleotide
tgtgggaagaggccgaggaagatggaaatg

SEQ ID NO: 278142 - DNA, 29 bp, Artificial Sequence
  Description of Artificial Sequence: Synthetic oligonucleotide
gtgggaagaggccgaggaagatggaaatg

SEQ ID NO: 278143 - DNA, 29 bp, Artificial Sequence
  Description of Artificial Sequence: Synthetic oligonucleotide
tgggaagaggccgaggaagatggaaatgg

SEQ ID NO: 278144 - DNA, 28 bp, Artificial Sequence
  Description of Artificial Sequence: Synthetic oligonucleotide
gggaagaggccgaggaagatggaaatgg

SEQ ID NO: 278145 - DNA, 28 bp, Artificial Sequence
  Description of Artificial Sequence: Synthetic oligonucleotide
ggaagaggccgaggaagatggaaatggg

SEQ ID NO: 278146 - DNA, 28 bp, Artificial Sequence
  Description of Artificial Sequence: Synthetic oligonucleotide
gaagaggccgaggaagatggaaatgggg

SEQ ID NO: 278147 - DNA, 29 bp, Artificial Sequence
  Description of Artificial Sequence: Synthetic oligonucleotide
aagaggccgaggaagatggaaatggggag

SEQ ID NO: 278148 - DNA, 28 bp, Artificial Sequence
  Description of Artificial Sequence: Synthetic oligonucleotide
agaggccgaggaagatggaaatggggag

SEQ ID NO: 278149 - DNA, 27 bp, Artificial Sequence
  Description of Artificial Sequence: Synthetic oligonucleotide
gaggccgaggaagatggaaatggggag

SEQ ID NO: 278150 - DNA, 27 bp, Artificial Sequence
  Description of Artificial Sequence: Synthetic oligonucleotide
aggccgaggaagatggaaatggggagg

SEQ ID NO: 278151 - DNA, 27 bp, Artificial Sequence
  Description of Artificial Sequence: Synthetic oligonucleotide
ggccgaggaagatggaaatggggagga

SEQ ID NO: 278152 - DNA, 27 bp, Artificial Sequence
  Description of Artificial Sequence: Synthetic oligonucleotide
gccgaggaagatggaaatggggaggac

SEQ ID NO: 278153 - DNA, 27 bp, Artificial Sequence
  Description of Artificial Sequence: Synthetic oligonucleotide
ccgaggaagatggaaatggggaggacg

SEQ ID NO: 278154 - DNA, 28 bp, Artificial Sequence
  Description of Artificial Sequence: Synthetic oligonucleotide
cgaggaagatggaaatggggaggacgtg

SEQ ID NO: 278155 - DNA, 28 bp, Artificial Sequence
  Description of Artificial Sequence: Synthetic oligonucleotide
gaggaagatggaaatggggaggacgtgc

SEQ ID NO: 278156 - DNA, 29 bp, Artificial Sequence
  Description of Artificial Sequence: Synthetic oligonucleotide
aggaagatggaaatggggaggacgtgctc

SEQ ID NO: 278157 - DNA, 28 bp, Artificial Sequence
  Description of Artificial Sequence: Synthetic oligonucleotide
ggaagatggaaatggggaggacgtgctc

SEQ ID NO: 278158 - DNA, 30 bp, Artificial Sequence
  Description of Artificial Sequence: Synthetic oligonucleotide
gaagatggaaatggggaggacgtgctcaag

SEQ ID NO: 278159 - DNA, 32 bp, Artificial Sequence
  Description of Artificial Sequence: Synthetic oligonucleotide
aagatggaaatggggaggacgtgctcaagttg

SEQ ID NO: 278160 - DNA, 31 bp, Artificial Sequence
  Description of Artificial Sequence: Synthetic oligonucleotide
agatggaaatggggaggacgtgctcaagttg

SEQ ID NO: 278161 - DNA, 30 bp, Artificial Sequence
  Description of Artificial Sequence: Synthetic oligonucleotide
gatggaaatggggaggacgtgctcaagttg

SEQ ID NO: 278162 - DNA, 31 bp, Artificial Sequence
  Description of Artificial Sequence: Synthetic oligonucleotide
atggaaatggggaggacgtgctcaagttgtc

SEQ ID NO: 278163 - DNA, 30 bp, Artificial Sequence
  Description of Artificial Sequence: Synthetic oligonucleotide
tggaaatggggaggacgtgctcaagttgtc

SEQ ID NO: 278164 - DNA, 29 bp, Artificial Sequence
  Description of Artificial Sequence: Synthetic oligonucleotide
ggaaatggggaggacgtgctcaagttgtc

SEQ ID NO: 278165 - DNA, 29 bp, Artificial Sequence
  Description of Artificial Sequence: Synthetic oligonucleotide
gaaatggggaggacgtgctcaagttgtcc

SEQ ID NO: 278166 - DNA, 30 bp, Artificial Sequence
  Description of Artificial Sequence: Synthetic oligonucleotide
aaatggggaggacgtgctcaagttgtccac

SEQ ID NO: 278167 - DNA, 29 bp, Artificial Sequence
  Description of Artificial Sequence: Synthetic oligonucleotide
aatggggaggacgtgctcaagttgtccac

SEQ ID NO: 278168 - DNA, 28 bp, Artificial Sequence
  Description of Artificial Sequence: Synthetic oligonucleotide
atggggaggacgtgctcaagttgtccac

SEQ ID NO: 278169 - DNA, 27 bp, Artificial Sequence
  Description of Artificial Sequence: Synthetic oligonucleotide
tggggaggacgtgctcaagttgtccac

SEQ ID NO: 278170 - DNA, 26 bp, Artificial Sequence
  Description of Artificial Sequence: Synthetic oligonucleotide
ggggaggacgtgctcaagttgtccac

SEQ ID NO: 278171 - DNA, 26 bp, Artificial Sequence
  Description of Artificial Sequence: Synthetic oligonucleotide
gggaggacgtgctcaagttgtccacg

SEQ ID NO: 278172 - DNA, 27 bp, Artificial Sequence
  Description of Artificial Sequence: Synthetic oligonucleotide
ggaggacgtgctcaagttgtccacggt

SEQ ID NO: 278173 - DNA, 27 bp, Artificial Sequence
  Description of Artificial Sequence: Synthetic oligonucleotide
gaggacgtgctcaagttgtccacggtg

SEQ ID NO: 278174 - DNA, 27 bp, Artificial Sequence
  Description of Artificial Sequence: Synthetic oligonucleotide
aggacgtgctcaagttgtccacggtgg

SEQ ID NO: 278175 - DNA, 27 bp, Artificial Sequence
  Description of Artificial Sequence: Synthetic oligonucleotide
ggacgtgctcaagttgtccacggtgga

SEQ ID NO: 278176 - DNA, 27 bp, Artificial Sequence
  Description of Artificial Sequence: Synthetic oligonucleotide
gacgtgctcaagttgtccacggtggag

SEQ ID NO: 278177 - DNA, 29 bp, Artificial Sequence
  Description of Artificial Sequence: Synthetic oligonucleotide
acgtgctcaagttgtccacggtggagatc

SEQ ID NO: 278178 - DNA, 28 bp, Artificial Sequence
  Description of Artificial Sequence: Synthetic oligonucleotide
cgtgctcaagttgtccacggtggagatc

SEQ ID NO: 278179 - DNA, 30 bp, Artificial Sequence
  Description of Artificial Sequence: Synthetic oligonucleotide
gtgctcaagttgtccacggtggagatcatg

SEQ ID NO: 278180 - DNA, 30 bp, Artificial Sequence
  Description of Artificial Sequence: Synthetic oligonucleotide
tgctcaagttgtccacggtggagatcatgc

SEQ ID NO: 278181 - DNA, 29 bp, Artificial Sequence
  Description of Artificial Sequence: Synthetic oligonucleotide
gctcaagttgtccacggtggagatcatgc

SEQ ID NO: 278182 - DNA, 30 bp, Artificial Sequence
  Description of Artificial Sequence: Synthetic oligonucleotide
ctcaagttgtccacggtggagatcatgcag

SEQ ID NO: 278183 - DNA, 30 bp, Artificial Sequence
  Description of Artificial Sequence: Synthetic oligonucleotide
tcaagttgtccacggtggagatcatgcagc

SEQ ID NO: 278184 - DNA, 29 bp, Artificial Sequence
  Description of Artificial Sequence: Synthetic oligonucleotide
caagttgtccacggtggagatcatgcagc

SEQ ID NO: 278185 - DNA, 29 bp, Artificial Sequence
  Description of Artificial Sequence: Synthetic oligonucleotide
aagttgtccacggtggagatcatgcagcg

SEQ ID NO: 278186 - DNA, 28 bp, Artificial Sequence
  Description of Artificial Sequence: Synthetic oligonucleotide
agttgtccacggtggagatcatgcagcg

SEQ ID NO: 278187 - DNA, 27 bp, Artificial Sequence
  Description of Artificial Sequence: Synthetic oligonucleotide
gttgtccacggtggagatcatgcagcg

SEQ ID NO: 278188 - DNA, 27 bp, Artificial Sequence
  Description of Artificial Sequence: Synthetic oligonucleotide
ttgtccacggtggagatcatgcagcgc

SEQ ID NO: 278189 - DNA, 27 bp, Artificial Sequence
  Description of Artificial Sequence: Synthetic oligonucleotide
tgtccacggtggagatcatgcagcgca

SEQ ID NO: 278190 - DNA, 26 bp, Artificial Sequence
  Description of Artificial Sequence: Synthetic oligonucleotide
gtccacggtggagatcatgcagcgca

SEQ ID NO: 278191 - DNA, 27 bp, Artificial Sequence
  Description of Artificial Sequence: Synthetic oligonucleotide
tccacggtggagatcatgcagcgcaca

SEQ ID NO: 278192 - DNA, 26 bp, Artificial Sequence
  Description of Artificial Sequence: Synthetic oligonucleotide
ccacggtggagatcatgcagcgcaca

SEQ ID NO: 278193 - DNA, 26 bp, Artificial Sequence
  Description of Artificial Sequence: Synthetic oligonucleotide
cacggtggagatcatgcagcgcacag

SEQ ID NO: 278194 - DNA, 26 bp, Artificial Sequence
  Description of Artificial Sequence: Synthetic oligonucleotide
acggtggagatcatgcagcgcacagg

SEQ ID NO: 278195 - DNA, 25 bp, Artificial Sequence
  Description of Artificial Sequence: Synthetic oligonucleotide
cggtggagatcatgcagcgcacagg

SEQ ID NO: 278196 - DNA, 25 bp, Artificial Sequence
  Description of Artificial Sequence: Synthetic oligonucleotide
ggtggagatcatgcagcgcacaggg

SEQ ID NO: 278197 - DNA, 26 bp, Artificial Sequence
  Description of Artificial Sequence: Synthetic oligonucleotide
gtggagatcatgcagcgcacagggct

SEQ ID NO: 278198 - DNA, 26 bp, Artificial Sequence
  Description of Artificial Sequence: Synthetic oligonucleotide
tggagatcatgcagcgcacagggctg

SEQ ID NO: 278199 - DNA, 25 bp, Artificial Sequence
  Description of Artificial Sequence: Synthetic oligonucleotide
ggagatcatgcagcgcacagggctg

SEQ ID NO: 278200 - DNA, 26 bp, Artificial Sequence
  Description of Artificial Sequence: Synthetic oligonucleotide
gagatcatgcagcgcacagggctgct

SEQ ID NO: 278201 - DNA, 26 bp, Artificial Sequence
  Description of Artificial Sequence: Synthetic oligonucleotide
agatcatgcagcgcacagggctgctg

SEQ ID NO: 278202 - DNA, 25 bp, Artificial Sequence
  Description of Artificial Sequence: Synthetic oligonucleotide
gatcatgcagcgcacagggctgctg

SEQ ID NO: 278203 - DNA, 26 bp, Artificial Sequence
  Description of Artificial Sequence: Synthetic oligonucleotide
atcatgcagcgcacagggctgctggt

SEQ ID NO: 278204 - DNA, 25 bp, Artificial Sequence
  Description of Artificial Sequence: Synthetic oligonucleotide
tcatgcagcgcacagggctgctggt

SEQ ID NO: 278205 - DNA, 24 bp, Artificial Sequence
  Description of Artificial Sequence: Synthetic oligonucleotide
catgcagcgcacagggctgctggt

SEQ ID NO: 278206 - DNA, 25 bp, Artificial Sequence
  Description of Artificial Sequence: Synthetic oligonucleotide
atgcagcgcacagggctgctggtca

SEQ ID NO: 278207 - DNA, 24 bp, Artificial Sequence
  Description of Artificial Sequence: Synthetic oligonucleotide
tgcagcgcacagggctgctggtca

SEQ ID NO: 278208 - DNA, 23 bp, Artificial Sequence
  Description of Artificial Sequence: Synthetic oligonucleotide
gcagcgcacagggctgctggtca

SEQ ID NO: 278209 - DNA, 24 bp, Artificial Sequence
  Description of Artificial Sequence: Synthetic oligonucleotide
cagcgcacagggctgctggtcagt

SEQ ID NO: 278210 - DNA, 25 bp, Artificial Sequence
  Description of Artificial Sequence: Synthetic oligonucleotide
agcgcacagggctgctggtcagtga

SEQ ID NO: 278211 - DNA, 24 bp, Artificial Sequence
  Description of Artificial Sequence: Synthetic oligonucleotide
gcgcacagggctgctggtcagtga

SEQ ID NO: 278212 - DNA, 26 bp, Artificial Sequence
  Description of Artificial Sequence: Synthetic oligonucleotide
cgcacagggctgctggtcagtgagat

SEQ ID NO: 278213 - DNA, 27 bp, Artificial Sequence
  Description of Artificial Sequence: Synthetic oligonucleotide
gcacagggctgctggtcagtgagatga

SEQ ID NO: 278214 - DNA, 28 bp, Artificial Sequence
  Description of Artificial Sequence: Synthetic oligonucleotide
cacagggctgctggtcagtgagatgaag

SEQ ID NO: 278215 - DNA, 30 bp, Artificial Sequence
  Description of Artificial Sequence: Synthetic oligonucleotide
acagggctgctggtcagtgagatgaagatc

SEQ ID NO: 278216 - DNA, 29 bp, Artificial Sequence
  Description of Artificial Sequence: Synthetic oligonucleotide
cagggctgctggtcagtgagatgaagatc

SEQ ID NO: 278217 - DNA, 31 bp, Artificial Sequence
  Description of Artificial Sequence: Synthetic oligonucleotide
agggctgctggtcagtgagatgaagatcatg

SEQ ID NO: 278218 - DNA, 30 bp, Artificial Sequence
  Description of Artificial Sequence: Synthetic oligonucleotide
gggctgctggtcagtgagatgaagatcatg

SEQ ID NO: 278219 - DNA, 32 bp, Artificial Sequence
  Description of Artificial Sequence: Synthetic oligonucleotide
ggctgctggtcagtgagatgaagatcatgtag

SEQ ID NO: 278220 - DNA, 33 bp, Artificial Sequence
  Description of Artificial Sequence: Synthetic oligonucleotide
gctgctggtcagtgagatgaagatcatgtagag

SEQ ID NO: 278221 - DNA, 34 bp, Artificial Sequence
  Description of Artificial Sequence: Synthetic oligonucleotide
ctgctggtcagtgagatgaagatcatgtagagtg

SEQ ID NO: 278222 - DNA, 36 bp, Artificial Sequence
  Description of Artificial Sequence: Synthetic oligonucleotide
tgctggtcagtgagatgaagatcatgtagagtgaag

SEQ ID NO: 278223 - DNA, 35 bp, Artificial Sequence
  Description of Artificial Sequence: Synthetic oligonucleotide
gctggtcagtgagatgaagatcatgtagagtgaag

SEQ ID NO: 278224 - DNA, 36 bp, Artificial Sequence
  Description of Artificial Sequence: Synthetic oligonucleotide
ctggtcagtgagatgaagatcatgtagagtgaagag

SEQ ID NO: 278225 - DNA, 38 bp, Artificial Sequence
  Description of Artificial Sequence: Synthetic oligonucleotide
tggtcagtgagatgaagatcatgtagagtgaagagttg

SEQ ID NO: 278226 - DNA, 37 bp, Artificial Sequence
  Description of Artificial Sequence: Synthetic oligonucleotide
ggtcagtgagatgaagatcatgtagagtgaagagttg

SEQ ID NO: 278227 - DNA, 38 bp, Artificial Sequence
  Description of Artificial Sequence: Synthetic oligonucleotide
gtcagtgagatgaagatcatgtagagtgaagagttgag

SEQ ID NO: 278228 - DNA, 39 bp, Artificial Sequence
  Description of Artificial Sequence: Synthetic oligonucleotide
tcagtgagatgaagatcatgtagagtgaagagttgagag

SEQ ID NO: 278229 - DNA, 38 bp, Artificial Sequence
  Description of Artificial Sequence: Synthetic oligonucleotide
cagtgagatgaagatcatgtagagtgaagagttgagag

SEQ ID NO: 278230 - DNA, 39 bp, Artificial Sequence
  Description of Artificial Sequence: Synthetic oligonucleotide
agtgagatgaagatcatgtagagtgaagagttgagagtg

SEQ ID NO: 278231 - DNA, 38 bp, Artificial Sequence
  Description of Artificial Sequence: Synthetic oligonucleotide
gtgagatgaagatcatgtagagtgaagagttgagagtg

SEQ ID NO: 278232 - DNA, 39 bp, Artificial Sequence
  Description of Artificial Sequence: Synthetic oligonucleotide
tgagatgaagatcatgtagagtgaagagttgagagtgac

SEQ ID NO: 278233 - DNA, 38 bp, Artificial Sequence
  Description of Artificial Sequence: Synthetic oligonucleotide
gagatgaagatcatgtagagtgaagagttgagagtgac

SEQ ID NO: 278234 - DNA, 38 bp, Artificial Sequence
  Description of Artificial Sequence: Synthetic oligonucleotide
agatgaagatcatgtagagtgaagagttgagagtgacc

SEQ ID NO: 278235 - DNA, 37 bp, Artificial Sequence
  Description of Artificial Sequence: Synthetic oligonucleotide
gatgaagatcatgtagagtgaagagttgagagtgacc

SEQ ID NO: 278236 - DNA, 37 bp, Artificial Sequence
  Description of Artificial Sequence: Synthetic oligonucleotide
atgaagatcatgtagagtgaagagttgagagtgaccc

SEQ ID NO: 278237 - DNA, 36 bp, Artificial Sequence
  Description of Artificial Sequence: Synthetic oligonucleotide
tgaagatcatgtagagtgaagagttgagagtgaccc

SEQ ID NO: 278238 - DNA, 35 bp, Artificial Sequence
  Description of Artificial Sequence: Synthetic oligonucleotide
gaagatcatgtagagtgaagagttgagagtgaccc

SEQ ID NO: 278239 - DNA, 37 bp, Artificial Sequence
  Description of Artificial Sequence: Synthetic oligonucleotide
aagatcatgtagagtgaagagttgagagtgacccatg

SEQ ID NO: 278240 - DNA, 36 bp, Artificial Sequence
  Description of Artificial Sequence: Synthetic oligonucleotide
agatcatgtagagtgaagagttgagagtgacccatg

SEQ ID NO: 278241 - DNA, 35 bp, Artificial Sequence
  Description of Artificial Sequence: Synthetic oligonucleotide
gatcatgtagagtgaagagttgagagtgacccatg

SEQ ID NO: 278242 - DNA, 36 bp, Artificial Sequence
  Description of Artificial Sequence: Synthetic oligonucleotide
atcatgtagagtgaagagttgagagtgacccatgag

SEQ ID NO: 278243 - DNA, 35 bp, Artificial Sequence
  Description of Artificial Sequence: Synthetic oligonucleotide
tcatgtagagtgaagagttgagagtgacccatgag

SEQ ID NO: 278244 - DNA, 34 bp, Artificial Sequence
  Description of Artificial Sequence: Synthetic oligonucleotide
catgtagagtgaagagttgagagtgacccatgag

SEQ ID NO: 278245 - DNA, 34 bp, Artificial Sequence
  Description of Artificial Sequence: Synthetic oligonucleotide
atgtagagtgaagagttgagagtgacccatgagg

SEQ ID NO: 278246 - DNA, 33 bp, Artificial Sequence
  Description of Artificial Sequence: Synthetic oligonucleotide
tgtagagtgaagagttgagagtgacccatgagg

SEQ ID NO: 278247 - DNA, 32 bp, Artificial Sequence
  Description of Artificial Sequence: Synthetic oligonucleotide
gtagagtgaagagttgagagtgacccatgagg

SEQ ID NO: 278248 - DNA, 33 bp, Artificial Sequence
  Description of Artificial Sequence: Synthetic oligonucleotide
tagagtgaagagttgagagtgacccatgaggtc

SEQ ID NO: 278249 - DNA, 32 bp, Artificial Sequence
  Description of Artificial Sequence: Synthetic oligonucleotide
agagtgaagagttgagagtgacccatgaggtc

SEQ ID NO: 278250 - DNA, 31 bp, Artificial Sequence
  Description of Artificial Sequence: Synthetic oligonucleotide
gagtgaagagttgagagtgacccatgaggtc

SEQ ID NO: 278251 - DNA, 31 bp, Artificial Sequence
  Description of Artificial Sequence: Synthetic oligonucleotide
agtgaagagttgagagtgacccatgaggtcc

SEQ ID NO: 278252 - DNA, 30 bp, Artificial Sequence
  Description of Artificial Sequence: Synthetic oligonucleotide
gtgaagagttgagagtgacccatgaggtcc

SEQ ID NO: 278253 - DNA, 32 bp, Artificial Sequence
  Description of Artificial Sequence: Synthetic oligonucleotide
tgaagagttgagagtgacccatgaggtccaag

SEQ ID NO: 278254 - DNA, 31 bp, Artificial Sequence
  Description of Artificial Sequence: Synthetic oligonucleotide
gaagagttgagagtgacccatgaggtccaag

SEQ ID NO: 278255 - DNA, 31 bp, Artificial Sequence
  Description of Artificial Sequence: Synthetic oligonucleotide
aagagttgagagtgacccatgaggtccaagc

SEQ ID NO: 278256 - DNA, 30 bp, Artificial Sequence
  Description of Artificial Sequence: Synthetic oligonucleotide
agagttgagagtgacccatgaggtccaagc

SEQ ID NO: 278257 - DNA, 29 bp, Artificial Sequence
  Description of Artificial Sequence: Synthetic oligonucleotide
gagttgagagtgacccatgaggtccaagc

SEQ ID NO: 278258 - DNA, 29 bp, Artificial Sequence
  Description of Artificial Sequence: Synthetic oligonucleotide
agttgagagtgacccatgaggtccaagcc

SEQ ID NO: 278259 - DNA, 28 bp, Artificial Sequence
  Description of Artificial Sequence: Synthetic oligonucleotide
gttgagagtgacccatgaggtccaagcc

SEQ ID NO: 278260 - DNA, 30 bp, Artificial Sequence
  Description of Artificial Sequence: Synthetic oligonucleotide
ttgagagtgacccatgaggtccaagccaag

SEQ ID NO: 278261 - DNA, 29 bp, Artificial Sequence
  Description of Artificial Sequence: Synthetic oligonucleotide
tgagagtgacccatgaggtccaagccaag

SEQ ID NO: 278262 - DNA, 28 bp, Artificial Sequence
  Description of Artificial Sequence: Synthetic oligonucleotide
gagagtgacccatgaggtccaagccaag

SEQ ID NO: 278263 - DNA, 30 bp, Artificial Sequence
  Description of Artificial Sequence: Synthetic oligonucleotide
agagtgacccatgaggtccaagccaagaag

SEQ ID NO: 278264 - DNA, 29 bp, Artificial Sequence
  Description of Artificial Sequence: Synthetic oligonucleotide
gagtgacccatgaggtccaagccaagaag

SEQ ID NO: 278265 - DNA, 29 bp, Artificial Sequence
  Description of Artificial Sequence: Synthetic oligonucleotide
agtgacccatgaggtccaagccaagaagg

SEQ ID NO: 278266 - DNA, 28 bp, Artificial Sequence
  Description of Artificial Sequence: Synthetic oligonucleotide
gtgacccatgaggtccaagccaagaagg

SEQ ID NO: 278267 - DNA, 29 bp, Artificial Sequence
  Description of Artificial Sequence: Synthetic oligonucleotide
tgacccatgaggtccaagccaagaaggac

SEQ ID NO: 278268 - DNA, 28 bp, Artificial Sequence
  Description of Artificial Sequence: Synthetic oligonucleotide
gacccatgaggtccaagccaagaaggac

SEQ ID NO: 278269 - DNA, 30 bp, Artificial Sequence
  Description of Artificial Sequence: Synthetic oligonucleotide
acccatgaggtccaagccaagaaggacaac

SEQ ID NO: 278270 - DNA, 29 bp, Artificial Sequence
  Description of Artificial Sequence: Synthetic oligonucleotide
cccatgaggtccaagccaagaaggacaac

SEQ ID NO: 278271 - DNA, 35 bp, Artificial Sequence
  Description of Artificial Sequence: Synthetic oligonucleotide
ccatgaggtccaagccaagaaggacaacataaaag

SEQ ID NO: 278272 - DNA, 36 bp, Artificial Sequence
  Description of Artificial Sequence: Synthetic oligonucleotide
catgaggtccaagccaagaaggacaacataaaagag

SEQ ID NO: 278273 - DNA, 38 bp, Artificial Sequence
  Description of Artificial Sequence: Synthetic oligonucleotide
atgaggtccaagccaagaaggacaacataaaagagtac

SEQ ID NO: 278274 - DNA, 37 bp, Artificial Sequence
  Description of Artificial Sequence: Synthetic oligonucleotide
tgaggtccaagccaagaaggacaacataaaagagtac

SEQ ID NO: 278275 - DNA, 36 bp, Artificial Sequence
  Description of Artificial Sequence: Synthetic oligonucleotide
gaggtccaagccaagaaggacaacataaaagagtac

SEQ ID NO: 278276 - DNA, 37 bp, Artificial Sequence
  Description of Artificial Sequence: Synthetic oligonucleotide
aggtccaagccaagaaggacaacataaaagagtacag

SEQ ID NO: 278277 - DNA, 36 bp, Artificial Sequence
  Description of Artificial Sequence: Synthetic oligonucleotide
ggtccaagccaagaaggacaacataaaagagtacag

SEQ ID NO: 278278 - DNA, 37 bp, Artificial Sequence
  Description of Artificial Sequence: Synthetic oligonucleotide
gtccaagccaagaaggacaacataaaagagtacagtg

SEQ ID NO: 278279 - DNA, 38 bp, Artificial Sequence
  Description of Artificial Sequence: Synthetic oligonucleotide
tccaagccaagaaggacaacataaaagagtacagtgag

SEQ ID NO: 278280 - DNA, 37 bp, Artificial Sequence
  Description of Artificial Sequence: Synthetic oligonucleotide
ccaagccaagaaggacaacataaaagagtacagtgag

SEQ ID NO: 278281 - DNA, 42 bp, Artificial Sequence
  Description of Artificial Sequence: Synthetic oligonucleotide
caagccaagaaggacaacataaaagagtacagtgagataatc

SEQ ID NO: 278282 - DNA, 45 bp, Artificial Sequence
  Description of Artificial Sequence: Synthetic oligonucleotide
aagccaagaaggacaacataaaagagtacagtgagataatcaaag

SEQ ID NO: 278283 - DNA, 44 bp, Artificial Sequence
  Description of Artificial Sequence: Synthetic oligonucleotide
agccaagaaggacaacataaaagagtacagtgagataatcaaag

SEQ ID NO: 278284 - DNA, 43 bp, Artificial Sequence
  Description of Artificial Sequence: Synthetic oligonucleotide
gccaagaaggacaacataaaagagtacagtgagataatcaaag

SEQ ID NO: 278285 - DNA, 44 bp, Artificial Sequence
  Description of Artificial Sequence: Synthetic oligonucleotide
ccaagaaggacaacataaaagagtacagtgagataatcaaagtc

SEQ ID NO: 278286 - DNA, 46 bp, Artificial Sequence
  Description of Artificial Sequence: Synthetic oligonucleotide
caagaaggacaacataaaagagtacagtgagataatcaaagtcaac

SEQ ID NO: 278287 - DNA, 48 bp, Artificial Sequence
  Description of Artificial Sequence: Synthetic oligonucleotide
aagaaggacaacataaaagagtacagtgagataatcaaagtcaacaag

SEQ ID NO: 278288 - DNA, 47 bp, Artificial Sequence
  Description of Artificial Sequence: Synthetic oligonucleotide
agaaggacaacataaaagagtacagtgagataatcaaagtcaacaag

SEQ ID NO: 278289 - DNA, 46 bp, Artificial Sequence
  Description of Artificial Sequence: Synthetic oligonucleotide
gaaggacaacataaaagagtacagtgagataatcaaagtcaacaag

SEQ ID NO: 278290 - DNA, 47 bp, Artificial Sequence
  Description of Artificial Sequence: Synthetic oligonucleotide
aaggacaacataaaagagtacagtgagataatcaaagtcaacaagac

SEQ ID NO: 278291 - DNA, 46 bp, Artificial Sequence
  Description of Artificial Sequence: Synthetic oligonucleotide
aggacaacataaaagagtacagtgagataatcaaagtcaacaagac

SEQ ID NO: 278292 - DNA, 45 bp, Artificial Sequence
  Description of Artificial Sequence: Synthetic oligonucleotide
ggacaacataaaagagtacagtgagataatcaaagtcaacaagac

SEQ ID NO: 278293 - DNA, 45 bp, Artificial Sequence
  Description of Artificial Sequence: Synthetic oligonucleotide
gacaacataaaagagtacagtgagataatcaaagtcaacaagacc

SEQ ID NO: 278294 - DNA, 45 bp, Artificial Sequence
  Description of Artificial Sequence: Synthetic oligonucleotide
acaacataaaagagtacagtgagataatcaaagtcaacaagaccg

SEQ ID NO: 278295 - DNA, 44 bp, Artificial Sequence
  Description of Artificial Sequence: Synthetic oligonucleotide
caacataaaagagtacagtgagataatcaaagtcaacaagaccg

SEQ ID NO: 278296 - DNA, 45 bp, Artificial Sequence
  Description of Artificial Sequence: Synthetic oligonucleotide
aacataaaagagtacagtgagataatcaaagtcaacaagaccgtg

SEQ ID NO: 278297 - DNA, 44 bp, Artificial Sequence
  Description of Artificial Sequence: Synthetic oligonucleotide
acataaaagagtacagtgagataatcaaagtcaacaagaccgtg

SEQ ID NO: 278298 - DNA, 43 bp, Artificial Sequence
  Description of Artificial Sequence: Synthetic oligonucleotide
cataaaagagtacagtgagataatcaaagtcaacaagaccgtg

SEQ ID NO: 278299 - DNA, 43 bp, Artificial Sequence
  Description of Artificial Sequence: Synthetic oligonucleotide
ataaaagagtacagtgagataatcaaagtcaacaagaccgtgc

SEQ ID NO: 278300 - DNA, 42 bp, Artificial Sequence
  Description of Artificial Sequence: Synthetic oligonucleotide
taaaagagtacagtgagataatcaaagtcaacaagaccgtgc

SEQ ID NO: 278301 - DNA, 41 bp, Artificial Sequence
  Description of Artificial Sequence: Synthetic oligonucleotide
aaaagagtacagtgagataatcaaagtcaacaagaccgtgc

SEQ ID NO: 278302 - DNA, 40 bp, Artificial Sequence
  Description of Artificial Sequence: Synthetic oligonucleotide
aaagagtacagtgagataatcaaagtcaacaagaccgtgc

SEQ ID NO: 278303 - DNA, 39 bp, Artificial Sequence
  Description of Artificial Sequence: Synthetic oligonucleotide
aagagtacagtgagataatcaaagtcaacaagaccgtgc

SEQ ID NO: 278304 - DNA, 38 bp, Artificial Sequence
  Description of Artificial Sequence: Synthetic oligonucleotide
agagtacagtgagataatcaaagtcaacaagaccgtgc

SEQ ID NO: 278305 - DNA, 37 bp, Artificial Sequence
  Description of Artificial Sequence: Synthetic oligonucleotide
gagtacagtgagataatcaaagtcaacaagaccgtgc

SEQ ID NO: 278306 - DNA, 37 bp, Artificial Sequence
  Description of Artificial Sequence: Synthetic oligonucleotide
agtacagtgagataatcaaagtcaacaagaccgtgcc

SEQ ID NO: 278307 - DNA, 36 bp, Artificial Sequence
  Description of Artificial Sequence: Synthetic oligonucleotide
gtacagtgagataatcaaagtcaacaagaccgtgcc

SEQ ID NO: 278308 - DNA, 36 bp, Artificial Sequence
  Description of Artificial Sequence: Synthetic oligonucleotide
tacagtgagataatcaaagtcaacaagaccgtgccg

SEQ ID NO: 278309 - DNA, 35 bp, Artificial Sequence
  Description of Artificial Sequence: Synthetic oligonucleotide
acagtgagataatcaaagtcaacaagaccgtgccg

SEQ ID NO: 278310 - DNA, 34 bp, Artificial Sequence
  Description of Artificial Sequence: Synthetic oligonucleotide
cagtgagataatcaaagtcaacaagaccgtgccg

SEQ ID NO: 278311 - DNA, 36 bp, Artificial Sequence
  Description of Artificial Sequence: Synthetic oligonucleotide
agtgagataatcaaagtcaacaagaccgtgccgtac

SEQ ID NO: 278312 - DNA, 35 bp, Artificial Sequence
  Description of Artificial Sequence: Synthetic oligonucleotide
gtgagataatcaaagtcaacaagaccgtgccgtac

SEQ ID NO: 278313 - DNA, 35 bp, Artificial Sequence
  Description of Artificial Sequence: Synthetic oligonucleotide
tgagataatcaaagtcaacaagaccgtgccgtacc

SEQ ID NO: 278314 - DNA, 34 bp, Artificial Sequence
  Description of Artificial Sequence: Synthetic oligonucleotide
gagataatcaaagtcaacaagaccgtgccgtacc

SEQ ID NO: 278315 - DNA, 36 bp, Artificial Sequence
  Description of Artificial Sequence: Synthetic oligonucleotide
agataatcaaagtcaacaagaccgtgccgtaccatg

SEQ ID NO: 278316 - DNA, 35 bp, Artificial Sequence
  Description of Artificial Sequence: Synthetic oligonucleotide
gataatcaaagtcaacaagaccgtgccgtaccatg

SEQ ID NO: 278317 - DNA, 36 bp, Artificial Sequence
  Description of Artificial Sequence: Synthetic oligonucleotide
ataatcaaagtcaacaagaccgtgccgtaccatgtc

SEQ ID NO: 278318 - DNA, 35 bp, Artificial Sequence
  Description of Artificial Sequence: Synthetic oligonucleotide
taatcaaagtcaacaagaccgtgccgtaccatgtc

SEQ ID NO: 278319 - DNA, 34 bp, Artificial Sequence
  Description of Artificial Sequence: Synthetic oligonucleotide
aatcaaagtcaacaagaccgtgccgtaccatgtc

SEQ ID NO: 278320 - DNA, 33 bp, Artificial Sequence
  Description of Artificial Sequence: Synthetic oligonucleotide
atcaaagtcaacaagaccgtgccgtaccatgtc

SEQ ID NO: 278321 - DNA, 32 bp, Artificial Sequence
  Description of Artificial Sequence: Synthetic oligonucleotide
tcaaagtcaacaagaccgtgccgtaccatgtc

SEQ ID NO: 278322 - DNA, 31 bp, Artificial Sequence
  Description of Artificial Sequence: Synthetic oligonucleotide
caaagtcaacaagaccgtgccgtaccatgtc

SEQ ID NO: 278323 - DNA, 32 bp, Artificial Sequence
  Description of Artificial Sequence: Synthetic oligonucleotide
aaagtcaacaagaccgtgccgtaccatgtctc

SEQ ID NO: 278324 - DNA, 31 bp, Artificial Sequence
  Description of Artificial Sequence: Synthetic oligonucleotide
aagtcaacaagaccgtgccgtaccatgtctc

SEQ ID NO: 278325 - DNA, 30 bp, Artificial Sequence
  Description of Artificial Sequence: Synthetic oligonucleotide
agtcaacaagaccgtgccgtaccatgtctc

SEQ ID NO: 278326 - DNA, 29 bp, Artificial Sequence
  Description of Artificial Sequence: Synthetic oligonucleotide
gtcaacaagaccgtgccgtaccatgtctc

SEQ ID NO: 278327 - DNA, 29 bp, Artificial Sequence
  Description of Artificial Sequence: Synthetic oligonucleotide
tcaacaagaccgtgccgtaccatgtctcc

SEQ ID NO: 278328 - DNA, 28 bp, Artificial Sequence
  Description of Artificial Sequence: Synthetic oligonucleotide
caacaagaccgtgccgtaccatgtctcc

SEQ ID NO: 278329 - DNA, 30 bp, Artificial Sequence
  Description of Artificial Sequence: Synthetic oligonucleotide
aacaagaccgtgccgtaccatgtctccaag

SEQ ID NO: 278330 - DNA, 29 bp, Artificial Sequence
  Description of Artificial Sequence: Synthetic oligonucleotide
acaagaccgtgccgtaccatgtctccaag

SEQ ID NO: 278331 - DNA, 28 bp, Artificial Sequence
  Description of Artificial Sequence: Synthetic oligonucleotide
caagaccgtgccgtaccatgtctccaag

SEQ ID NO: 278332 - DNA, 28 bp, Artificial Sequence
  Description of Artificial Sequence: Synthetic oligonucleotide
aagaccgtgccgtaccatgtctccaagg

SEQ ID NO: 278333 - DNA, 27 bp, Artificial Sequence
  Description of Artificial Sequence: Synthetic oligonucleotide
agaccgtgccgtaccatgtctccaagg

SEQ ID NO: 278334 - DNA, 27 bp, Artificial Sequence
  Description of Artificial Sequence: Synthetic oligonucleotide
gaccgtgccgtaccatgtctccaaggt

SEQ ID NO: 278335 - DNA, 27 bp, Artificial Sequence
  Description of Artificial Sequence: Synthetic oligonucleotide
accgtgccgtaccatgtctccaaggtc

SEQ ID NO: 278336 - DNA, 27 bp, Artificial Sequence
  Description of Artificial Sequence: Synthetic oligonucleotide
ccgtgccgtaccatgtctccaaggtca

SEQ ID NO: 278337 - DNA, 28 bp, Artificial Sequence
  Description of Artificial Sequence: Synthetic oligonucleotide
cgtgccgtaccatgtctccaaggtcatc

SEQ ID NO: 278338 - DNA, 28 bp, Artificial Sequence
  Description of Artificial Sequence: Synthetic oligonucleotide
gtgccgtaccatgtctccaaggtcatcg

SEQ ID NO: 278339 - DNA, 29 bp, Artificial Sequence
  Description of Artificial Sequence: Synthetic oligonucleotide
tgccgtaccatgtctccaaggtcatcgag

SEQ ID NO: 278340 - DNA, 28 bp, Artificial Sequence
  Description of Artificial Sequence: Synthetic oligonucleotide
gccgtaccatgtctccaaggtcatcgag

SEQ ID NO: 278341 - DNA, 28 bp, Artificial Sequence
  Description of Artificial Sequence: Synthetic oligonucleotide
ccgtaccatgtctccaaggtcatcgagg

SEQ ID NO: 278342 - DNA, 29 bp, Artificial Sequence
  Description of Artificial Sequence: Synthetic oligonucleotide
cgtaccatgtctccaaggtcatcgaggtc

SEQ ID NO: 278343 - DNA, 29 bp, Artificial Sequence
  Description of Artificial Sequence: Synthetic oligonucleotide
gtaccatgtctccaaggtcatcgaggtcc

SEQ ID NO: 278344 - DNA, 30 bp, Artificial Sequence
  Description of Artificial Sequence: Synthetic oligonucleotide
taccatgtctccaaggtcatcgaggtcctg

SEQ ID NO: 278345 - DNA, 29 bp, Artificial Sequence
  Description of Artificial Sequence: Synthetic oligonucleotide
accatgtctccaaggtcatcgaggtcctg

SEQ ID NO: 278346 - DNA, 28 bp, Artificial Sequence
  Description of Artificial Sequence: Synthetic oligonucleotide
ccatgtctccaaggtcatcgaggtcctg

SEQ ID NO: 278347 - DNA, 28 bp, Artificial Sequence
  Description of Artificial Sequence: Synthetic oligonucleotide
catgtctccaaggtcatcgaggtcctgg

SEQ ID NO: 278348 - DNA, 30 bp, Artificial Sequence
  Description of Artificial Sequence: Synthetic oligonucleotide
atgtctccaaggtcatcgaggtcctggatg

SEQ ID NO: 278349 - DNA, 29 bp, Artificial Sequence
  Description of Artificial Sequence: Synthetic oligonucleotide
tgtctccaaggtcatcgaggtcctggatg

SEQ ID NO: 278350 - DNA, 28 bp, Artificial Sequence
  Description of Artificial Sequence: Synthetic oligonucleotide
gtctccaaggtcatcgaggtcctggatg

SEQ ID NO: 278351 - DNA, 30 bp, Artificial Sequence
  Description of Artificial Sequence: Synthetic oligonucleotide
tctccaaggtcatcgaggtcctggatgatg

SEQ ID NO: 278352 - DNA, 29 bp, Artificial Sequence
  Description of Artificial Sequence: Synthetic oligonucleotide
ctccaaggtcatcgaggtcctggatgatg

SEQ ID NO: 278353 - DNA, 31 bp, Artificial Sequence
  Description of Artificial Sequence: Synthetic oligonucleotide
tccaaggtcatcgaggtcctggatgatgatc

SEQ ID NO: 278354 - DNA, 30 bp, Artificial Sequence
  Description of Artificial Sequence: Synthetic oligonucleotide
ccaaggtcatcgaggtcctggatgatgatc

SEQ ID NO: 278355 - DNA, 30 bp, Artificial Sequence
  Description of Artificial Sequence: Synthetic oligonucleotide
caaggtcatcgaggtcctggatgatgatcc

SEQ ID NO: 278356 - DNA, 34 bp, Artificial Sequence
  Description of Artificial Sequence: Synthetic oligonucleotide
aaggtcatcgaggtcctggatgatgatcctaaag

SEQ ID NO: 278357 - DNA, 33 bp, Artificial Sequence
  Description of Artificial Sequence: Synthetic oligonucleotide
aggtcatcgaggtcctggatgatgatcctaaag

SEQ ID NO: 278358 - DNA, 32 bp, Artificial Sequence
  Description of Artificial Sequence: Synthetic oligonucleotide
ggtcatcgaggtcctggatgatgatcctaaag

SEQ ID NO: 278359 - DNA, 33 bp, Artificial Sequence
  Description of Artificial Sequence: Synthetic oligonucleotide
gtcatcgaggtcctggatgatgatcctaaagac

SEQ ID NO: 278360 - DNA, 33 bp, Artificial Sequence
  Description of Artificial Sequence: Synthetic oligonucleotide
tcatcgaggtcctggatgatgatcctaaagacc

SEQ ID NO: 278361 - DNA, 32 bp, Artificial Sequence
  Description of Artificial Sequence: Synthetic oligonucleotide
catcgaggtcctggatgatgatcctaaagacc

SEQ ID NO: 278362 - DNA, 34 bp, Artificial Sequence
  Description of Artificial Sequence: Synthetic oligonucleotide
atcgaggtcctggatgatgatcctaaagaccaag

SEQ ID NO: 278363 - DNA, 33 bp, Artificial Sequence
  Description of Artificial Sequence: Synthetic oligonucleotide
tcgaggtcctggatgatgatcctaaagaccaag

SEQ ID NO: 278364 - DNA, 32 bp, Artificial Sequence
  Description of Artificial Sequence: Synthetic oligonucleotide
cgaggtcctggatgatgatcctaaagaccaag

SEQ ID NO: 278365 - DNA, 33 bp, Artificial Sequence
  Description of Artificial Sequence: Synthetic oligonucleotide
gaggtcctggatgatgatcctaaagaccaagag

SEQ ID NO: 278366 - DNA, 33 bp, Artificial Sequence
  Description of Artificial Sequence: Synthetic oligonucleotide
aggtcctggatgatgatcctaaagaccaagagc

SEQ ID NO: 278367 - DNA, 32 bp, Artificial Sequence
  Description of Artificial Sequence: Synthetic oligonucleotide
ggtcctggatgatgatcctaaagaccaagagc

SEQ ID NO: 278368 - DNA, 33 bp, Artificial Sequence
  Description of Artificial Sequence: Synthetic oligonucleotide
gtcctggatgatgatcctaaagaccaagagcag

SEQ ID NO: 278369 - DNA, 33 bp, Artificial Sequence
  Description of Artificial Sequence: Synthetic oligonucleotide
tcctggatgatgatcctaaagaccaagagcagg

SEQ ID NO: 278370 - DNA, 32 bp, Artificial Sequence
  Description of Artificial Sequence: Synthetic oligonucleotide
cctggatgatgatcctaaagaccaagagcagg

SEQ ID NO: 278371 - DNA, 34 bp, Artificial Sequence
  Description of Artificial Sequence: Synthetic oligonucleotide
ctggatgatgatcctaaagaccaagagcaggatg

SEQ ID NO: 278372 - DNA, 34 bp, Artificial Sequence
  Description of Artificial Sequence: Synthetic oligonucleotide
tggatgatgatcctaaagaccaagagcaggatgg

SEQ ID NO: 278373 - DNA, 33 bp, Artificial Sequence
  Description of Artificial Sequence: Synthetic oligonucleotide
ggatgatgatcctaaagaccaagagcaggatgg

SEQ ID NO: 278374 - DNA, 34 bp, Artificial Sequence
  Description of Artificial Sequence: Synthetic oligonucleotide
gatgatgatcctaaagaccaagagcaggatggtg

SEQ ID NO: 278375 - DNA, 34 bp, Artificial Sequence
  Description of Artificial Sequence: Synthetic oligonucleotide
atgatgatcctaaagaccaagagcaggatggtgg

SEQ ID NO: 278376 - DNA, 33 bp, Artificial Sequence
  Description of Artificial Sequence: Synthetic oligonucleotide
tgatgatcctaaagaccaagagcaggatggtgg

SEQ ID NO: 278377 - DNA, 32 bp, Artificial Sequence
  Description of Artificial Sequence: Synthetic oligonucleotide
gatgatcctaaagaccaagagcaggatggtgg

SEQ ID NO: 278378 - DNA, 32 bp, Artificial Sequence
  Description of Artificial Sequence: Synthetic oligonucleotide
atgatcctaaagaccaagagcaggatggtggc

SEQ ID NO: 278379 - DNA, 31 bp, Artificial Sequence
  Description of Artificial Sequence: Synthetic oligonucleotide
tgatcctaaagaccaagagcaggatggtggc

SEQ ID NO: 278380 - DNA, 30 bp, Artificial Sequence
  Description of Artificial Sequence: Synthetic oligonucleotide
gatcctaaagaccaagagcaggatggtggc

SEQ ID NO: 278381 - DNA, 36 bp, Artificial Sequence
  Description of Artificial Sequence: Synthetic oligonucleotide
atcctaaagaccaagagcaggatggtggcaatattg

SEQ ID NO: 278382 - DNA, 35 bp, Artificial Sequence
  Description of Artificial Sequence: Synthetic oligonucleotide
tcctaaagaccaagagcaggatggtggcaatattg

SEQ ID NO: 278383 - DNA, 34 bp, Artificial Sequence
  Description of Artificial Sequence: Synthetic oligonucleotide
cctaaagaccaagagcaggatggtggcaatattg

SEQ ID NO: 278384 - DNA, 35 bp, Artificial Sequence
  Description of Artificial Sequence: Synthetic oligonucleotide
ctaaagaccaagagcaggatggtggcaatattgag

SEQ ID NO: 278385 - DNA, 35 bp, Artificial Sequence
  Description of Artificial Sequence: Synthetic oligonucleotide
taaagaccaagagcaggatggtggcaatattgagc

SEQ ID NO: 278386 - DNA, 34 bp, Artificial Sequence
  Description of Artificial Sequence: Synthetic oligonucleotide
aaagaccaagagcaggatggtggcaatattgagc

SEQ ID NO: 278387 - DNA, 33 bp, Artificial Sequence
  Description of Artificial Sequence: Synthetic oligonucleotide
aagaccaagagcaggatggtggcaatattgagc

SEQ ID NO: 278388 - DNA, 32 bp, Artificial Sequence
  Description of Artificial Sequence: Synthetic oligonucleotide
agaccaagagcaggatggtggcaatattgagc

SEQ ID NO: 278389 - DNA, 31 bp, Artificial Sequence
  Description of Artificial Sequence: Synthetic oligonucleotide
gaccaagagcaggatggtggcaatattgagc

SEQ ID NO: 278390 - DNA, 32 bp, Artificial Sequence
  Description of Artificial Sequence: Synthetic oligonucleotide
accaagagcaggatggtggcaatattgagctg

SEQ ID NO: 278391 - DNA, 31 bp, Artificial Sequence
  Description of Artificial Sequence: Synthetic oligonucleotide
ccaagagcaggatggtggcaatattgagctg

SEQ ID NO: 278392 - DNA, 31 bp, Artificial Sequence
  Description of Artificial Sequence: Synthetic oligonucleotide
caagagcaggatggtggcaatattgagctgg

SEQ ID NO: 278393 - DNA, 32 bp, Artificial Sequence
  Description of Artificial Sequence: Synthetic oligonucleotide
aagagcaggatggtggcaatattgagctggac

SEQ ID NO: 278394 - DNA, 31 bp, Artificial Sequence
  Description of Artificial Sequence: Synthetic oligonucleotide
agagcaggatggtggcaatattgagctggac

SEQ ID NO: 278395 - DNA, 30 bp, Artificial Sequence
  Description of Artificial Sequence: Synthetic oligonucleotide
gagcaggatggtggcaatattgagctggac

SEQ ID NO: 278396 - DNA, 31 bp, Artificial Sequence
  Description of Artificial Sequence: Synthetic oligonucleotide
agcaggatggtggcaatattgagctggactc

SEQ ID NO: 278397 - DNA, 30 bp, Artificial Sequence
  Description of Artificial Sequence: Synthetic oligonucleotide
gcaggatggtggcaatattgagctggactc

SEQ ID NO: 278398 - DNA, 30 bp, Artificial Sequence
  Description of Artificial Sequence: Synthetic oligonucleotide
caggatggtggcaatattgagctggactcc

SEQ ID NO: 278399 - DNA, 30 bp, Artificial Sequence
  Description of Artificial Sequence: Synthetic oligonucleotide
aggatggtggcaatattgagctggactccg

SEQ ID NO: 278400 - DNA, 29 bp, Artificial Sequence
  Description of Artificial Sequence: Synthetic oligonucleotide
ggatggtggcaatattgagctggactccg

SEQ ID NO: 278401 - DNA, 30 bp, Artificial Sequence
  Description of Artificial Sequence: Synthetic oligonucleotide
gatggtggcaatattgagctggactccgag

SEQ ID NO: 278402 - DNA, 31 bp, Artificial Sequence
  Description of Artificial Sequence: Synthetic oligonucleotide
atggtggcaatattgagctggactccgagag

SEQ ID NO: 278403 - DNA, 30 bp, Artificial Sequence
  Description of Artificial Sequence: Synthetic oligonucleotide
tggtggcaatattgagctggactccgagag

SEQ ID NO: 278404 - DNA, 29 bp, Artificial Sequence
  Description of Artificial Sequence: Synthetic oligonucleotide
ggtggcaatattgagctggactccgagag

SEQ ID NO: 278405 - DNA, 29 bp, Artificial Sequence
  Description of Artificial Sequence: Synthetic oligonucleotide
gtggcaatattgagctggactccgagagg

SEQ ID NO: 278406 - DNA, 31 bp, Artificial Sequence
  Description of Artificial Sequence: Synthetic oligonucleotide
tggcaatattgagctggactccgagaggaag

SEQ ID NO: 278407 - DNA, 30 bp, Artificial Sequence
  Description of Artificial Sequence: Synthetic oligonucleotide
ggcaatattgagctggactccgagaggaag

SEQ ID NO: 278408 - DNA, 30 bp, Artificial Sequence
  Description of Artificial Sequence: Synthetic oligonucleotide
gcaatattgagctggactccgagaggaagg

SEQ ID NO: 278409 - DNA, 30 bp, Artificial Sequence
  Description of Artificial Sequence: Synthetic oligonucleotide
caatattgagctggactccgagaggaaggc

SEQ ID NO: 278410 - DNA, 30 bp, Artificial Sequence
  Description of Artificial Sequence: Synthetic oligonucleotide
aatattgagctggactccgagaggaaggcc

SEQ ID NO: 278411 - DNA, 29 bp, Artificial Sequence
  Description of Artificial Sequence: Synthetic oligonucleotide
atattgagctggactccgagaggaaggcc

SEQ ID NO: 278412 - DNA, 28 bp, Artificial Sequence
  Description of Artificial Sequence: Synthetic oligonucleotide
tattgagctggactccgagaggaaggcc

SEQ ID NO: 278413 - DNA, 27 bp, Artificial Sequence
  Description of Artificial Sequence: Synthetic oligonucleotide
attgagctggactccgagaggaaggcc

SEQ ID NO: 278414 - DNA, 27 bp, Artificial Sequence
  Description of Artificial Sequence: Synthetic oligonucleotide
ttgagctggactccgagaggaaggcca

SEQ ID NO: 278415 - DNA, 27 bp, Artificial Sequence
  Description of Artificial Sequence: Synthetic oligonucleotide
tgagctggactccgagaggaaggccaa

SEQ ID NO: 278416 - DNA, 26 bp, Artificial Sequence
  Description of Artificial Sequence: Synthetic oligonucleotide
gagctggactccgagaggaaggccaa

SEQ ID NO: 278417 - DNA, 27 bp, Artificial Sequence
  Description of Artificial Sequence: Synthetic oligonucleotide
agctggactccgagaggaaggccaagt

SEQ ID NO: 278418 - DNA, 26 bp, Artificial Sequence
  Description of Artificial Sequence: Synthetic oligonucleotide
gctggactccgagaggaaggccaagt

SEQ ID NO: 278419 - DNA, 27 bp, Artificial Sequence
  Description of Artificial Sequence: Synthetic oligonucleotide
ctggactccgagaggaaggccaagtgt

SEQ ID NO: 278420 - DNA, 27 bp, Artificial Sequence
  Description of Artificial Sequence: Synthetic oligonucleotide
tggactccgagaggaaggccaagtgtg

SEQ ID NO: 278421 - DNA, 26 bp, Artificial Sequence
  Description of Artificial Sequence: Synthetic oligonucleotide
ggactccgagaggaaggccaagtgtg

SEQ ID NO: 278422 - DNA, 27 bp, Artificial Sequence
  Description of Artificial Sequence: Synthetic oligonucleotide
gactccgagaggaaggccaagtgtgca

SEQ ID NO: 278423 - DNA, 27 bp, Artificial Sequence
  Description of Artificial Sequence: Synthetic oligonucleotide
actccgagaggaaggccaagtgtgcag

SEQ ID NO: 278424 - DNA, 27 bp, Artificial Sequence
  Description of Artificial Sequence: Synthetic oligonucleotide
ctccgagaggaaggccaagtgtgcagt

SEQ ID NO: 278425 - DNA, 27 bp, Artificial Sequence
  Description of Artificial Sequence: Synthetic oligonucleotide
tccgagaggaaggccaagtgtgcagtg

SEQ ID NO: 278426 - DNA, 27 bp, Artificial Sequence
  Description of Artificial Sequence: Synthetic oligonucleotide
ccgagaggaaggccaagtgtgcagtga

SEQ ID NO: 278427 - DNA, 28 bp, Artificial Sequence
  Description of Artificial Sequence: Synthetic oligonucleotide
cgagaggaaggccaagtgtgcagtgatc

SEQ ID NO: 278428 - DNA, 32 bp, Artificial Sequence
  Description of Artificial Sequence: Synthetic oligonucleotide
gagaggaaggccaagtgtgcagtgatcaaatc

SEQ ID NO: 278429 - DNA, 32 bp, Artificial Sequence
  Description of Artificial Sequence: Synthetic oligonucleotide
agaggaaggccaagtgtgcagtgatcaaatcc

SEQ ID NO: 278430 - DNA, 31 bp, Artificial Sequence
  Description of Artificial Sequence: Synthetic oligonucleotide
gaggaaggccaagtgtgcagtgatcaaatcc

SEQ ID NO: 278431 - DNA, 32 bp, Artificial Sequence
  Description of Artificial Sequence: Synthetic oligonucleotide
aggaaggccaagtgtgcagtgatcaaatcctc

SEQ ID NO: 278432 - DNA, 31 bp, Artificial Sequence
  Description of Artificial Sequence: Synthetic oligonucleotide
ggaaggccaagtgtgcagtgatcaaatcctc

SEQ ID NO: 278433 - DNA, 33 bp, Artificial Sequence
  Description of Artificial Sequence: Synthetic oligonucleotide
gaaggccaagtgtgcagtgatcaaatcctctac

SEQ ID NO: 278434 - DNA, 34 bp, Artificial Sequence
  Description of Artificial Sequence: Synthetic oligonucleotide
aaggccaagtgtgcagtgatcaaatcctctacac

SEQ ID NO: 278435 - DNA, 33 bp, Artificial Sequence
  Description of Artificial Sequence: Synthetic oligonucleotide
aggccaagtgtgcagtgatcaaatcctctacac

SEQ ID NO: 278436 - DNA, 32 bp, Artificial Sequence
  Description of Artificial Sequence: Synthetic oligonucleotide
ggccaagtgtgcagtgatcaaatcctctacac

SEQ ID NO: 278437 - DNA, 32 bp, Artificial Sequence
  Description of Artificial Sequence: Synthetic oligonucleotide
gccaagtgtgcagtgatcaaatcctctacacc

SEQ ID NO: 278438 - DNA, 33 bp, Artificial Sequence
  Description of Artificial Sequence: Synthetic oligonucleotide
ccaagtgtgcagtgatcaaatcctctacaccac

SEQ ID NO: 278439 - DNA, 34 bp, Artificial Sequence
  Description of Artificial Sequence: Synthetic oligonucleotide
caagtgtgcagtgatcaaatcctctacaccacag

SEQ ID NO: 278440 - DNA, 35 bp, Artificial Sequence
  Description of Artificial Sequence: Synthetic oligonucleotide
aagtgtgcagtgatcaaatcctctacaccacagac

SEQ ID NO: 278441 - DNA, 34 bp, Artificial Sequence
  Description of Artificial Sequence: Synthetic oligonucleotide
agtgtgcagtgatcaaatcctctacaccacagac

SEQ ID NO: 278442 - DNA, 33 bp, Artificial Sequence
  Description of Artificial Sequence: Synthetic oligonucleotide
gtgtgcagtgatcaaatcctctacaccacagac

SEQ ID NO: 278443 - DNA, 33 bp, Artificial Sequence
  Description of Artificial Sequence: Synthetic oligonucleotide
tgtgcagtgatcaaatcctctacaccacagacg

SEQ ID NO: 278444 - DNA, 32 bp, Artificial Sequence
  Description of Artificial Sequence: Synthetic oligonucleotide
gtgcagtgatcaaatcctctacaccacagacg

SEQ ID NO: 278445 - DNA, 34 bp, Artificial Sequence
  Description of Artificial Sequence: Synthetic oligonucleotide
tgcagtgatcaaatcctctacaccacagacgtag

SEQ ID NO: 278446 - DNA, 33 bp, Artificial Sequence
  Description of Artificial Sequence: Synthetic oligonucleotide
gcagtgatcaaatcctctacaccacagacgtag

SEQ ID NO: 278447 - DNA, 35 bp, Artificial Sequence
  Description of Artificial Sequence: Synthetic oligonucleotide
cagtgatcaaatcctctacaccacagacgtagttc

SEQ ID NO: 278448 - DNA, 35 bp, Artificial Sequence
  Description of Artificial Sequence: Synthetic oligonucleotide
agtgatcaaatcctctacaccacagacgtagttcc

SEQ ID NO: 278449 - DNA, 34 bp, Artificial Sequence
  Description of Artificial Sequence: Synthetic oligonucleotide
gtgatcaaatcctctacaccacagacgtagttcc

SEQ ID NO: 278450 - DNA, 36 bp, Artificial Sequence
  Description of Artificial Sequence: Synthetic oligonucleotide
tgatcaaatcctctacaccacagacgtagttccttc

SEQ ID NO: 278451 - DNA, 35 bp, Artificial Sequence
  Description of Artificial Sequence: Synthetic oligonucleotide
gatcaaatcctctacaccacagacgtagttccttc

SEQ ID NO: 278452 - DNA, 35 bp, Artificial Sequence
  Description of Artificial Sequence: Synthetic oligonucleotide
atcaaatcctctacaccacagacgtagttccttcc

SEQ ID NO: 278453 - DNA, 34 bp, Artificial Sequence
  Description of Artificial Sequence: Synthetic oligonucleotide
tcaaatcctctacaccacagacgtagttccttcc

SEQ ID NO: 278454 - DNA, 33 bp, Artificial Sequence
  Description of Artificial Sequence: Synthetic oligonucleotide
caaatcctctacaccacagacgtagttccttcc

SEQ ID NO: 278455 - DNA, 34 bp, Artificial Sequence
  Description of Artificial Sequence: Synthetic oligonucleotide
aaatcctctacaccacagacgtagttccttcctc

SEQ ID NO: 278456 - DNA, 33 bp, Artificial Sequence
  Description of Artificial Sequence: Synthetic oligonucleotide
aatcctctacaccacagacgtagttccttcctc

SEQ ID NO: 278457 - DNA, 32 bp, Artificial Sequence
  Description of Artificial Sequence: Synthetic oligonucleotide
atcctctacaccacagacgtagttccttcctc

SEQ ID NO: 278458 - DNA, 31 bp, Artificial Sequence
  Description of Artificial Sequence: Synthetic oligonucleotide
tcctctacaccacagacgtagttccttcctc

SEQ ID NO: 278459 - DNA, 30 bp, Artificial Sequence
  Description of Artificial Sequence: Synthetic oligonucleotide
cctctacaccacagacgtagttccttcctc

SEQ ID NO: 278460 - DNA, 31 bp, Artificial Sequence
  Description of Artificial Sequence: Synthetic oligonucleotide
ctctacaccacagacgtagttccttcctctg

SEQ ID NO: 278461 - DNA, 34 bp, Artificial Sequence
  Description of Artificial Sequence: Synthetic oligonucleotide
tctacaccacagacgtagttccttcctctgattg

SEQ ID NO: 278462 - DNA, 33 bp, Artificial Sequence
  Description of Artificial Sequence: Synthetic oligonucleotide
ctacaccacagacgtagttccttcctctgattg

SEQ ID NO: 278463 - DNA, 33 bp, Artificial Sequence
  Description of Artificial Sequence: Synthetic oligonucleotide
tacaccacagacgtagttccttcctctgattgg

SEQ ID NO: 278464 - DNA, 32 bp, Artificial Sequence
  Description of Artificial Sequence: Synthetic oligonucleotide
acaccacagacgtagttccttcctctgattgg

SEQ ID NO: 278465 - DNA, 31 bp, Artificial Sequence
  Description of Artificial Sequence: Synthetic oligonucleotide
caccacagacgtagttccttcctctgattgg

SEQ ID NO: 278466 - DNA, 31 bp, Artificial Sequence
  Description of Artificial Sequence: Synthetic oligonucleotide
accacagacgtagttccttcctctgattggg

SEQ ID NO: 278467 - DNA, 30 bp, Artificial Sequence
  Description of Artificial Sequence: Synthetic oligonucleotide
ccacagacgtagttccttcctctgattggg

SEQ ID NO: 278468 - DNA, 32 bp, Artificial Sequence
  Description of Artificial Sequence: Synthetic oligonucleotide
cacagacgtagttccttcctctgattgggtag

SEQ ID NO: 278469 - DNA, 32 bp, Artificial Sequence
  Description of Artificial Sequence: Synthetic oligonucleotide
acagacgtagttccttcctctgattgggtagg

SEQ ID NO: 278470 - DNA, 31 bp, Artificial Sequence
  Description of Artificial Sequence: Synthetic oligonucleotide
cagacgtagttccttcctctgattgggtagg

SEQ ID NO: 278471 - DNA, 32 bp, Artificial Sequence
  Description of Artificial Sequence: Synthetic oligonucleotide
agacgtagttccttcctctgattgggtaggtg

SEQ ID NO: 278472 - DNA, 31 bp, Artificial Sequence
  Description of Artificial Sequence: Synthetic oligonucleotide
gacgtagttccttcctctgattgggtaggtg

SEQ ID NO: 278473 - DNA, 31 bp, Artificial Sequence
  Description of Artificial Sequence: Synthetic oligonucleotide
acgtagttccttcctctgattgggtaggtgg

SEQ ID NO: 278474 - DNA, 30 bp, Artificial Sequence
  Description of Artificial Sequence: Synthetic oligonucleotide
cgtagttccttcctctgattgggtaggtgg

SEQ ID NO: 278475 - DNA, 32 bp, Artificial Sequence
  Description of Artificial Sequence: Synthetic oligonucleotide
gtagttccttcctctgattgggtaggtggatg

SEQ ID NO: 278476 - DNA, 32 bp, Artificial Sequence
  Description of Artificial Sequence: Synthetic oligonucleotide
tagttccttcctctgattgggtaggtggatgc

SEQ ID NO: 278477 - DNA, 31 bp, Artificial Sequence
  Description of Artificial Sequence: Synthetic oligonucleotide
agttccttcctctgattgggtaggtggatgc

SEQ ID NO: 278478 - DNA, 30 bp, Artificial Sequence
  Description of Artificial Sequence: Synthetic oligonucleotide
gttccttcctctgattgggtaggtggatgc

SEQ ID NO: 278479 - DNA, 31 bp, Artificial Sequence
  Description of Artificial Sequence: Synthetic oligonucleotide
ttccttcctctgattgggtaggtggatgcag

SEQ ID NO: 278480 - DNA, 30 bp, Artificial Sequence
  Description of Artificial Sequence: Synthetic oligonucleotide
tccttcctctgattgggtaggtggatgcag

SEQ ID NO: 278481 - DNA, 29 bp, Artificial Sequence
  Description of Artificial Sequence: Synthetic oligonucleotide
ccttcctctgattgggtaggtggatgcag

SEQ ID NO: 278482 - DNA, 33 bp, Artificial Sequence
  Description of Artificial Sequence: Synthetic oligonucleotide
cttcctctgattgggtaggtggatgcagaaaag

SEQ ID NO: 278483 - DNA, 33 bp, Artificial Sequence
  Description of Artificial Sequence: Synthetic oligonucleotide
ttcctctgattgggtaggtggatgcagaaaagc

SEQ ID NO: 278484 - DNA, 32 bp, Artificial Sequence
  Description of Artificial Sequence: Synthetic oligonucleotide
tcctctgattgggtaggtggatgcagaaaagc

SEQ ID NO: 278485 - DNA, 31 bp, Artificial Sequence
  Description of Artificial Sequence: Synthetic oligonucleotide
cctctgattgggtaggtggatgcagaaaagc

SEQ ID NO: 278486 - DNA, 35 bp, Artificial Sequence
  Description of Artificial Sequence: Synthetic oligonucleotide
ctctgattgggtaggtggatgcagaaaagctatag

SEQ ID NO: 278487 - DNA, 35 bp, Artificial Sequence
  Description of Artificial Sequence: Synthetic oligonucleotide
tctgattgggtaggtggatgcagaaaagctatagc

SEQ ID NO: 278488 - DNA, 34 bp, Artificial Sequence
  Description of Artificial Sequence: Synthetic oligonucleotide
ctgattgggtaggtggatgcagaaaagctatagc

SEQ ID NO: 278489 - DNA, 34 bp, Artificial Sequence
  Description of Artificial Sequence: Synthetic oligonucleotide
tgattgggtaggtggatgcagaaaagctatagcc

SEQ ID NO: 278490 - DNA, 33 bp, Artificial Sequence
  Description of Artificial Sequence: Synthetic oligonucleotide
gattgggtaggtggatgcagaaaagctatagcc

SEQ ID NO: 278491 - DNA, 34 bp, Artificial Sequence
  Description of Artificial Sequence: Synthetic oligonucleotide
attgggtaggtggatgcagaaaagctatagccag

SEQ ID NO: 278492 - DNA, 33 bp, Artificial Sequence
  Description of Artificial Sequence: Synthetic oligonucleotide
ttgggtaggtggatgcagaaaagctatagccag

SEQ ID NO: 278493 - DNA, 32 bp, Artificial Sequence
  Description of Artificial Sequence: Synthetic oligonucleotide
tgggtaggtggatgcagaaaagctatagccag

SEQ ID NO: 278494 - DNA, 31 bp, Artificial Sequence
  Description of Artificial Sequence: Synthetic oligonucleotide
gggtaggtggatgcagaaaagctatagccag

SEQ ID NO: 278495 - DNA, 31 bp, Artificial Sequence
  Description of Artificial Sequence: Synthetic oligonucleotide
ggtaggtggatgcagaaaagctatagccagg

SEQ ID NO: 278496 - DNA, 32 bp, Artificial Sequence
  Description of Artificial Sequence: Synthetic oligonucleotide
gtaggtggatgcagaaaagctatagccaggag

SEQ ID NO: 278497 - DNA, 33 bp, Artificial Sequence
  Description of Artificial Sequence: Synthetic oligonucleotide
taggtggatgcagaaaagctatagccaggagtc

SEQ ID NO: 278498 - DNA, 32 bp, Artificial Sequence
  Description of Artificial Sequence: Synthetic oligonucleotide
aggtggatgcagaaaagctatagccaggagtc

SEQ ID NO: 278499 - DNA, 31 bp, Artificial Sequence
  Description of Artificial Sequence: Synthetic oligonucleotide
ggtggatgcagaaaagctatagccaggagtc

SEQ ID NO: 278500 - DNA, 31 bp, Artificial Sequence
  Description of Artificial Sequence: Synthetic oligonucleotide
gtggatgcagaaaagctatagccaggagtcc

SEQ ID NO: 278501 - DNA, 32 bp, Artificial Sequence
  Description of Artificial Sequence: Synthetic oligonucleotide
tggatgcagaaaagctatagccaggagtcctg

SEQ ID NO: 278502 - DNA, 31 bp, Artificial Sequence
  Description of Artificial Sequence: Synthetic oligonucleotide
ggatgcagaaaagctatagccaggagtcctg

SEQ ID NO: 278503 - DNA, 31 bp, Artificial Sequence
  Description of Artificial Sequence: Synthetic oligonucleotide
gatgcagaaaagctatagccaggagtcctgg

SEQ ID NO: 278504 - DNA, 32 bp, Artificial Sequence
  Description of Artificial Sequence: Synthetic oligonucleotide
atgcagaaaagctatagccaggagtcctggtg

SEQ ID NO: 278505 - DNA, 31 bp, Artificial Sequence
  Description of Artificial Sequence: Synthetic oligonucleotide
tgcagaaaagctatagccaggagtcctggtg

SEQ ID NO: 278506 - DNA, 30 bp, Artificial Sequence
  Description of Artificial Sequence: Synthetic oligonucleotide
gcagaaaagctatagccaggagtcctggtg

SEQ ID NO: 278507 - DNA, 30 bp, Artificial Sequence
  Description of Artificial Sequence: Synthetic oligonucleotide
cagaaaagctatagccaggagtcctggtgg

SEQ ID NO: 278508 - DNA, 30 bp, Artificial Sequence
  Description of Artificial Sequence: Synthetic oligonucleotide
agaaaagctatagccaggagtcctggtggg

SEQ ID NO: 278509 - DNA, 29 bp, Artificial Sequence
  Description of Artificial Sequence: Synthetic oligonucleotide
gaaaagctatagccaggagtcctggtggg

SEQ ID NO: 278510 - DNA, 30 bp, Artificial Sequence
  Description of Artificial Sequence: Synthetic oligonucleotide
aaaagctatagccaggagtcctggtgggag

SEQ ID NO: 278511 - DNA, 29 bp, Artificial Sequence
  Description of Artificial Sequence: Synthetic oligonucleotide
aaagctatagccaggagtcctggtgggag

SEQ ID NO: 278512 - DNA, 28 bp, Artificial Sequence
  Description of Artificial Sequence: Synthetic oligonucleotide
aagctatagccaggagtcctggtgggag

SEQ ID NO: 278513 - DNA, 27 bp, Artificial Sequence
  Description of Artificial Sequence: Synthetic oligonucleotide
agctatagccaggagtcctggtgggag

SEQ ID NO: 278514 - DNA, 27 bp, Artificial Sequence
  Description of Artificial Sequence: Synthetic oligonucleotide
gctatagccaggagtcctggtgggagt

SEQ ID NO: 278515 - DNA, 27 bp, Artificial Sequence
  Description of Artificial Sequence: Synthetic oligonucleotide
ctatagccaggagtcctggtgggagtg

SEQ ID NO: 278516 - DNA, 29 bp, Artificial Sequence
  Description of Artificial Sequence: Synthetic oligonucleotide
tatagccaggagtcctggtgggagtgaac

SEQ ID NO: 278517 - DNA, 28 bp, Artificial Sequence
  Description of Artificial Sequence: Synthetic oligonucleotide
atagccaggagtcctggtgggagtgaac

SEQ ID NO: 278518 - DNA, 27 bp, Artificial Sequence
  Description of Artificial Sequence: Synthetic oligonucleotide
tagccaggagtcctggtgggagtgaac

SEQ ID NO: 278519 - DNA, 27 bp, Artificial Sequence
  Description of Artificial Sequence: Synthetic oligonucleotide
agccaggagtcctggtgggagtgaaca

SEQ ID NO: 278520 - DNA, 27 bp, Artificial Sequence
  Description of Artificial Sequence: Synthetic oligonucleotide
gccaggagtcctggtgggagtgaacaa

SEQ ID NO: 278521 - DNA, 28 bp, Artificial Sequence
  Description of Artificial Sequence: Synthetic oligonucleotide
ccaggagtcctggtgggagtgaacaaac

SEQ ID NO: 278522 - DNA, 29 bp, Artificial Sequence
  Description of Artificial Sequence: Synthetic oligonucleotide
caggagtcctggtgggagtgaacaaacac

SEQ ID NO: 278523 - DNA, 30 bp, Artificial Sequence
  Description of Artificial Sequence: Synthetic oligonucleotide
aggagtcctggtgggagtgaacaaacactc

SEQ ID NO: 278524 - DNA, 29 bp, Artificial Sequence
  Description of Artificial Sequence: Synthetic oligonucleotide
ggagtcctggtgggagtgaacaaacactc

SEQ ID NO: 278525 - DNA, 29 bp, Artificial Sequence
  Description of Artificial Sequence: Synthetic oligonucleotide
gagtcctggtgggagtgaacaaacactcc

SEQ ID NO: 278526 - DNA, 32 bp, Artificial Sequence
  Description of Artificial Sequence: Synthetic oligonucleotide
agtcctggtgggagtgaacaaacactcctatc

SEQ ID NO: 278527 - DNA, 31 bp, Artificial Sequence
  Description of Artificial Sequence: Synthetic oligonucleotide
gtcctggtgggagtgaacaaacactcctatc

SEQ ID NO: 278528 - DNA, 32 bp, Artificial Sequence
  Description of Artificial Sequence: Synthetic oligonucleotide
tcctggtgggagtgaacaaacactcctatcag

SEQ ID NO: 278529 - DNA, 31 bp, Artificial Sequence
  Description of Artificial Sequence: Synthetic oligonucleotide
cctggtgggagtgaacaaacactcctatcag

SEQ ID NO: 278530 - DNA, 33 bp, Artificial Sequence
  Description of Artificial Sequence: Synthetic oligonucleotide
ctggtgggagtgaacaaacactcctatcagatc

SEQ ID NO: 278531 - DNA, 33 bp, Artificial Sequence
  Description of Artificial Sequence: Synthetic oligonucleotide
tggtgggagtgaacaaacactcctatcagatcc

SEQ ID NO: 278532 - DNA, 32 bp, Artificial Sequence
  Description of Artificial Sequence: Synthetic oligonucleotide
ggtgggagtgaacaaacactcctatcagatcc

SEQ ID NO: 278533 - DNA, 33 bp, Artificial Sequence
  Description of Artificial Sequence: Synthetic oligonucleotide
gtgggagtgaacaaacactcctatcagatcctg

SEQ ID NO: 278534 - DNA, 33 bp, Artificial Sequence
  Description of Artificial Sequence: Synthetic oligonucleotide
tgggagtgaacaaacactcctatcagatcctgg

SEQ ID NO: 278535 - DNA, 32 bp, Artificial Sequence
  Description of Artificial Sequence: Synthetic oligonucleotide
gggagtgaacaaacactcctatcagatcctgg

SEQ ID NO: 278536 - DNA, 33 bp, Artificial Sequence
  Description of Artificial Sequence: Synthetic oligonucleotide
ggagtgaacaaacactcctatcagatcctggac

SEQ ID NO: 278537 - DNA, 34 bp, Artificial Sequence
  Description of Artificial Sequence: Synthetic oligonucleotide
gagtgaacaaacactcctatcagatcctggacac

SEQ ID NO: 278538 - DNA, 34 bp, Artificial Sequence
  Description of Artificial Sequence: Synthetic oligonucleotide
agtgaacaaacactcctatcagatcctggacacg

SEQ ID NO: 278539 - DNA, 33 bp, Artificial Sequence
  Description of Artificial Sequence: Synthetic oligonucleotide
gtgaacaaacactcctatcagatcctggacacg

SEQ ID NO: 278540 - DNA, 33 bp, Artificial Sequence
  Description of Artificial Sequence: Synthetic oligonucleotide
tgaacaaacactcctatcagatcctggacacgc

SEQ ID NO: 278541 - DNA, 32 bp, Artificial Sequence
  Description of Artificial Sequence: Synthetic oligonucleotide
gaacaaacactcctatcagatcctggacacgc

SEQ ID NO: 278542 - DNA, 33 bp, Artificial Sequence
  Description of Artificial Sequence: Synthetic oligonucleotide
aacaaacactcctatcagatcctggacacgctg

SEQ ID NO: 278543 - DNA, 32 bp, Artificial Sequence
  Description of Artificial Sequence: Synthetic oligonucleotide
acaaacactcctatcagatcctggacacgctg

SEQ ID NO: 278544 - DNA, 31 bp, Artificial Sequence
  Description of Artificial Sequence: Synthetic oligonucleotide
caaacactcctatcagatcctggacacgctg

SEQ ID NO: 278545 - DNA, 31 bp, Artificial Sequence
  Description of Artificial Sequence: Synthetic oligonucleotide
aaacactcctatcagatcctggacacgctgc

SEQ ID NO: 278546 - DNA, 30 bp, Artificial Sequence
  Description of Artificial Sequence: Synthetic oligonucleotide
aacactcctatcagatcctggacacgctgc

SEQ ID NO: 278547 - DNA, 29 bp, Artificial Sequence
  Description of Artificial Sequence: Synthetic oligonucleotide
acactcctatcagatcctggacacgctgc

SEQ ID NO: 278548 - DNA, 28 bp, Artificial Sequence
  Description of Artificial Sequence: Synthetic oligonucleotide
cactcctatcagatcctggacacgctgc

SEQ ID NO: 278549 - DNA, 28 bp, Artificial Sequence
  Description of Artificial Sequence: Synthetic oligonucleotide
actcctatcagatcctggacacgctgcc

SEQ ID NO: 278550 - DNA, 27 bp, Artificial Sequence
  Description of Artificial Sequence: Synthetic oligonucleotide
ctcctatcagatcctggacacgctgcc

SEQ ID NO: 278551 - DNA, 27 bp, Artificial Sequence
  Description of Artificial Sequence: Synthetic oligonucleotide
tcctatcagatcctggacacgctgccc

SEQ ID NO: 278552 - DNA, 27 bp, Artificial Sequence
  Description of Artificial Sequence: Synthetic oligonucleotide
cctatcagatcctggacacgctgccct

SEQ ID NO: 278553 - DNA, 27 bp, Artificial Sequence
  Description of Artificial Sequence: Synthetic oligonucleotide
ctatcagatcctggacacgctgccctc

SEQ ID NO: 278554 - DNA, 28 bp, Artificial Sequence
  Description of Artificial Sequence: Synthetic oligonucleotide
tatcagatcctggacacgctgccctcag

SEQ ID NO: 278555 - DNA, 27 bp, Artificial Sequence
  Description of Artificial Sequence: Synthetic oligonucleotide
atcagatcctggacacgctgccctcag

SEQ ID NO: 278556 - DNA, 27 bp, Artificial Sequence
  Description of Artificial Sequence: Synthetic oligonucleotide
tcagatcctggacacgctgccctcaga

SEQ ID NO: 278557 - DNA, 26 bp, Artificial Sequence
  Description of Artificial Sequence: Synthetic oligonucleotide
cagatcctggacacgctgccctcaga

SEQ ID NO: 278558 - DNA, 27 bp, Artificial Sequence
  Description of Artificial Sequence: Synthetic oligonucleotide
agatcctggacacgctgccctcagagt

SEQ ID NO: 278559 - DNA, 27 bp, Artificial Sequence
  Description of Artificial Sequence: Synthetic oligonucleotide
gatcctggacacgctgccctcagagta

SEQ ID NO: 278560 - DNA, 28 bp, Artificial Sequence
  Description of Artificial Sequence: Synthetic oligonucleotide
atcctggacacgctgccctcagagtatg

SEQ ID NO: 278561 - DNA, 27 bp, Artificial Sequence
  Description of Artificial Sequence: Synthetic oligonucleotide
tcctggacacgctgccctcagagtatg

SEQ ID NO: 278562 - DNA, 27 bp, Artificial Sequence
  Description of Artificial Sequence: Synthetic oligonucleotide
cctggacacgctgccctcagagtatgt

SEQ ID NO: 278563 - DNA, 27 bp, Artificial Sequence
  Description of Artificial Sequence: Synthetic oligonucleotide
ctggacacgctgccctcagagtatgtc

SEQ ID NO: 278564 - DNA, 28 bp, Artificial Sequence
  Description of Artificial Sequence: Synthetic oligonucleotide
tggacacgctgccctcagagtatgtctc

SEQ ID NO: 278565 - DNA, 27 bp, Artificial Sequence
  Description of Artificial Sequence: Synthetic oligonucleotide
ggacacgctgccctcagagtatgtctc

SEQ ID NO: 278566 - DNA, 27 bp, Artificial Sequence
  Description of Artificial Sequence: Synthetic oligonucleotide
gacacgctgccctcagagtatgtctcg

SEQ ID NO: 278567 - DNA, 27 bp, Artificial Sequence
  Description of Artificial Sequence: Synthetic oligonucleotide
acacgctgccctcagagtatgtctcgc

SEQ ID NO: 278568 - DNA, 26 bp, Artificial Sequence
  Description of Artificial Sequence: Synthetic oligonucleotide
cacgctgccctcagagtatgtctcgc

SEQ ID NO: 278569 - DNA, 26 bp, Artificial Sequence
  Description of Artificial Sequence: Synthetic oligonucleotide
acgctgccctcagagtatgtctcgcg

SEQ ID NO: 278570 - DNA, 25 bp, Artificial Sequence
  Description of Artificial Sequence: Synthetic oligonucleotide
cgctgccctcagagtatgtctcgcg

SEQ ID NO: 278571 - DNA, 25 bp, Artificial Sequence
  Description of Artificial Sequence: Synthetic oligonucleotide
gctgccctcagagtatgtctcgcgg

SEQ ID NO: 278572 - DNA, 26 bp, Artificial Sequence
  Description of Artificial Sequence: Synthetic oligonucleotide
ctgccctcagagtatgtctcgcgggt

SEQ ID NO: 278573 - DNA, 27 bp, Artificial Sequence
  Description of Artificial Sequence: Synthetic oligonucleotide
tgccctcagagtatgtctcgcgggtca

SEQ ID NO: 278574 - DNA, 27 bp, Artificial Sequence
  Description of Artificial Sequence: Synthetic oligonucleotide
gccctcagagtatgtctcgcgggtcaa

SEQ ID NO: 278575 - DNA, 27 bp, Artificial Sequence
  Description of Artificial Sequence: Synthetic oligonucleotide
ccctcagagtatgtctcgcgggtcaag

SEQ ID NO: 278576 - DNA, 27 bp, Artificial Sequence
  Description of Artificial Sequence: Synthetic oligonucleotide
cctcagagtatgtctcgcgggtcaagg

SEQ ID NO: 278577 - DNA, 27 bp, Artificial Sequence
  Description of Artificial Sequence: Synthetic oligonucleotide
ctcagagtatgtctcgcgggtcaaggc

SEQ ID NO: 278578 - DNA, 27 bp, Artificial Sequence
  Description of Artificial Sequence: Synthetic oligonucleotide
tcagagtatgtctcgcgggtcaaggcc

SEQ ID NO: 278579 - DNA, 27 bp, Artificial Sequence
  Description of Artificial Sequence: Synthetic oligonucleotide
cagagtatgtctcgcgggtcaaggcca

SEQ ID NO: 278580 - DNA, 28 bp, Artificial Sequence
  Description of Artificial Sequence: Synthetic oligonucleotide
agagtatgtctcgcgggtcaaggccatg

SEQ ID NO: 278581 - DNA, 27 bp, Artificial Sequence
  Description of Artificial Sequence: Synthetic oligonucleotide
gagtatgtctcgcgggtcaaggccatg

SEQ ID NO: 278582 - DNA, 27 bp, Artificial Sequence
  Description of Artificial Sequence: Synthetic oligonucleotide
agtatgtctcgcgggtcaaggccatgc

SEQ ID NO: 278583 - DNA, 27 bp, Artificial Sequence
  Description of Artificial Sequence: Synthetic oligonucleotide
gtatgtctcgcgggtcaaggccatgca

SEQ ID NO: 278584 - DNA, 27 bp, Artificial Sequence
  Description of Artificial Sequence: Synthetic oligonucleotide
tatgtctcgcgggtcaaggccatgcag

SEQ ID NO: 278585 - DNA, 26 bp, Artificial Sequence
  Description of Artificial Sequence: Synthetic oligonucleotide
atgtctcgcgggtcaaggccatgcag

SEQ ID NO: 278586 - DNA, 25 bp, Artificial Sequence
  Description of Artificial Sequence: Synthetic oligonucleotide
tgtctcgcgggtcaaggccatgcag

SEQ ID NO: 278587 - DNA, 24 bp, Artificial Sequence
  Description of Artificial Sequence: Synthetic oligonucleotide
gtctcgcgggtcaaggccatgcag

SEQ ID NO: 278588 - DNA, 26 bp, Artificial Sequence
  Description of Artificial Sequence: Synthetic oligonucleotide
tctcgcgggtcaaggccatgcaggta

SEQ ID NO: 278589 - DNA, 25 bp, Artificial Sequence
  Description of Artificial Sequence: Synthetic oligonucleotide
ctcgcgggtcaaggccatgcaggta

SEQ ID NO: 278590 - DNA, 26 bp, Artificial Sequence
  Description of Artificial Sequence: Synthetic oligonucleotide
tcgcgggtcaaggccatgcaggtaga

SEQ ID NO: 278591 - DNA, 25 bp, Artificial Sequence
  Description of Artificial Sequence: Synthetic oligonucleotide
cgcgggtcaaggccatgcaggtaga

SEQ ID NO: 278592 - DNA, 25 bp, Artificial Sequence
  Description of Artificial Sequence: Synthetic oligonucleotide
gcgggtcaaggccatgcaggtagac

SEQ ID NO: 278593 - DNA, 26 bp, Artificial Sequence
  Description of Artificial Sequence: Synthetic oligonucleotide
cgggtcaaggccatgcaggtagacgt

SEQ ID NO: 278594 - DNA, 27 bp, Artificial Sequence
  Description of Artificial Sequence: Synthetic oligonucleotide
gggtcaaggccatgcaggtagacgtga

SEQ ID NO: 278595 - DNA, 27 bp, Artificial Sequence
  Description of Artificial Sequence: Synthetic oligonucleotide
ggtcaaggccatgcaggtagacgtgag

SEQ ID NO: 278596 - DNA, 27 bp, Artificial Sequence
  Description of Artificial Sequence: Synthetic oligonucleotide
gtcaaggccatgcaggtagacgtgagg

SEQ ID NO: 278597 - DNA, 27 bp, Artificial Sequence
  Description of Artificial Sequence: Synthetic oligonucleotide
tcaaggccatgcaggtagacgtgaggc

SEQ ID NO: 278598 - DNA, 26 bp, Artificial Sequence
  Description of Artificial Sequence: Synthetic oligonucleotide
caaggccatgcaggtagacgtgaggc

SEQ ID NO: 278599 - DNA, 26 bp, Artificial Sequence
  Description of Artificial Sequence: Synthetic oligonucleotide
aaggccatgcaggtagacgtgaggcc

SEQ ID NO: 278600 - DNA, 25 bp, Artificial Sequence
  Description of Artificial Sequence: Synthetic oligonucleotide
aggccatgcaggtagacgtgaggcc

SEQ ID NO: 278601 - DNA, 24 bp, Artificial Sequence
  Description of Artificial Sequence: Synthetic oligonucleotide
ggccatgcaggtagacgtgaggcc

SEQ ID NO: 278602 - DNA, 25 bp, Artificial Sequence
  Description of Artificial Sequence: Synthetic oligonucleotide
gccatgcaggtagacgtgaggccca

SEQ ID NO: 278603 - DNA, 25 bp, Artificial Sequence
  Description of Artificial Sequence: Synthetic oligonucleotide
ccatgcaggtagacgtgaggcccac

SEQ ID NO: 278604 - DNA, 25 bp, Artificial Sequence
  Description of Artificial Sequence: Synthetic oligonucleotide
catgcaggtagacgtgaggcccacc

SEQ ID NO: 278605 - DNA, 26 bp, Artificial Sequence
  Description of Artificial Sequence: Synthetic oligonucleotide
atgcaggtagacgtgaggcccaccga

SEQ ID NO: 278606 - DNA, 25 bp, Artificial Sequence
  Description of Artificial Sequence: Synthetic oligonucleotide
tgcaggtagacgtgaggcccaccga

SEQ ID NO: 278607 - DNA, 24 bp, Artificial Sequence
  Description of Artificial Sequence: Synthetic oligonucleotide
gcaggtagacgtgaggcccaccga

SEQ ID NO: 278608 - DNA, 24 bp, Artificial Sequence
  Description of Artificial Sequence: Synthetic oligonucleotide
caggtagacgtgaggcccaccgag

SEQ ID NO: 278609 - DNA, 27 bp, Artificial Sequence
  Description of Artificial Sequence: Synthetic oligonucleotide
aggtagacgtgaggcccaccgagcaat

SEQ ID NO: 278610 - DNA, 27 bp, Artificial Sequence
  Description of Artificial Sequence: Synthetic oligonucleotide
ggtagacgtgaggcccaccgagcaata

SEQ ID NO: 278611 - DNA, 27 bp, Artificial Sequence
  Description of Artificial Sequence: Synthetic oligonucleotide
gtagacgtgaggcccaccgagcaatac

SEQ ID NO: 278612 - DNA, 28 bp, Artificial Sequence
  Description of Artificial Sequence: Synthetic oligonucleotide
tagacgtgaggcccaccgagcaatactg

SEQ ID NO: 278613 - DNA, 27 bp, Artificial Sequence
  Description of Artificial Sequence: Synthetic oligonucleotide
agacgtgaggcccaccgagcaatactg

SEQ ID NO: 278614 - DNA, 27 bp, Artificial Sequence
  Description of Artificial Sequence: Synthetic oligonucleotide
gacgtgaggcccaccgagcaatactgt

SEQ ID NO: 278615 - DNA, 27 bp, Artificial Sequence
  Description of Artificial Sequence: Synthetic oligonucleotide
acgtgaggcccaccgagcaatactgtg

SEQ ID NO: 278616 - DNA, 27 bp, Artificial Sequence
  Description of Artificial Sequence: Synthetic oligonucleotide
cgtgaggcccaccgagcaatactgtga

SEQ ID NO: 278617 - DNA, 27 bp, Artificial Sequence
  Description of Artificial Sequence: Synthetic oligonucleotide
gtgaggcccaccgagcaatactgtgac

SEQ ID NO: 278618 - DNA, 30 bp, Artificial Sequence
  Description of Artificial Sequence: Synthetic oligonucleotide
tgaggcccaccgagcaatactgtgacattg

SEQ ID NO: 278619 - DNA, 29 bp, Artificial Sequence
  Description of Artificial Sequence: Synthetic oligonucleotide
gaggcccaccgagcaatactgtgacattg

SEQ ID NO: 278620 - DNA, 29 bp, Artificial Sequence
  Description of Artificial Sequence: Synthetic oligonucleotide
aggcccaccgagcaatactgtgacattgc

SEQ ID NO: 278621 - DNA, 28 bp, Artificial Sequence
  Description of Artificial Sequence: Synthetic oligonucleotide
ggcccaccgagcaatactgtgacattgc

SEQ ID NO: 278622 - DNA, 28 bp, Artificial Sequence
  Description of Artificial Sequence: Synthetic oligonucleotide
gcccaccgagcaatactgtgacattgcg

SEQ ID NO: 278623 - DNA, 28 bp, Artificial Sequence
  Description of Artificial Sequence: Synthetic oligonucleotide
cccaccgagcaatactgtgacattgcgg

SEQ ID NO: 278624 - DNA, 28 bp, Artificial Sequence
  Description of Artificial Sequence: Synthetic oligonucleotide
ccaccgagcaatactgtgacattgcggg

SEQ ID NO: 278625 - DNA, 31 bp, Artificial Sequence
  Description of Artificial Sequence: Synthetic oligonucleotide
caccgagcaatactgtgacattgcgggtttg

SEQ ID NO: 278626 - DNA, 31 bp, Artificial Sequence
  Description of Artificial Sequence: Synthetic oligonucleotide
accgagcaatactgtgacattgcgggtttgg

SEQ ID NO: 278627 - DNA, 30 bp, Artificial Sequence
  Description of Artificial Sequence: Synthetic oligonucleotide
ccgagcaatactgtgacattgcgggtttgg

SEQ ID NO: 278628 - DNA, 31 bp, Artificial Sequence
  Description of Artificial Sequence: Synthetic oligonucleotide
cgagcaatactgtgacattgcgggtttggag

SEQ ID NO: 278629 - DNA, 33 bp, Artificial Sequence
  Description of Artificial Sequence: Synthetic oligonucleotide
gagcaatactgtgacattgcgggtttggagaag

SEQ ID NO: 278630 - DNA, 33 bp, Artificial Sequence
  Description of Artificial Sequence: Synthetic oligonucleotide
agcaatactgtgacattgcgggtttggagaagc

SEQ ID NO: 278631 - DNA, 32 bp, Artificial Sequence
  Description of Artificial Sequence: Synthetic oligonucleotide
gcaatactgtgacattgcgggtttggagaagc

SEQ ID NO: 278632 - DNA, 33 bp, Artificial Sequence
  Description of Artificial Sequence: Synthetic oligonucleotide
caatactgtgacattgcgggtttggagaagcag

SEQ ID NO: 278633 - DNA, 35 bp, Artificial Sequence
  Description of Artificial Sequence: Synthetic oligonucleotide
aatactgtgacattgcgggtttggagaagcagatc

SEQ ID NO: 278634 - DNA, 34 bp, Artificial Sequence
  Description of Artificial Sequence: Synthetic oligonucleotide
atactgtgacattgcgggtttggagaagcagatc

SEQ ID NO: 278635 - DNA, 33 bp, Artificial Sequence
  Description of Artificial Sequence: Synthetic oligonucleotide
tactgtgacattgcgggtttggagaagcagatc

SEQ ID NO: 278636 - DNA, 32 bp, Artificial Sequence
  Description of Artificial Sequence: Synthetic oligonucleotide
actgtgacattgcgggtttggagaagcagatc

SEQ ID NO: 278637 - DNA, 31 bp, Artificial Sequence
  Description of Artificial Sequence: Synthetic oligonucleotide
ctgtgacattgcgggtttggagaagcagatc

SEQ ID NO: 278638 - DNA, 31 bp, Artificial Sequence
  Description of Artificial Sequence: Synthetic oligonucleotide
tgtgacattgcgggtttggagaagcagatcg

SEQ ID NO: 278639 - DNA, 30 bp, Artificial Sequence
  Description of Artificial Sequence: Synthetic oligonucleotide
gtgacattgcgggtttggagaagcagatcg

SEQ ID NO: 278640 - DNA, 31 bp, Artificial Sequence
  Description of Artificial Sequence: Synthetic oligonucleotide
tgacattgcgggtttggagaagcagatcgag

SEQ ID NO: 278641 - DNA, 30 bp, Artificial Sequence
  Description of Artificial Sequence: Synthetic oligonucleotide
gacattgcgggtttggagaagcagatcgag

SEQ ID NO: 278642 - DNA, 30 bp, Artificial Sequence
  Description of Artificial Sequence: Synthetic oligonucleotide
acattgcgggtttggagaagcagatcgagg

SEQ ID NO: 278643 - DNA, 29 bp, Artificial Sequence
  Description of Artificial Sequence: Synthetic oligonucleotide
cattgcgggtttggagaagcagatcgagg

SEQ ID NO: 278644 - DNA, 30 bp, Artificial Sequence
  Description of Artificial Sequence: Synthetic oligonucleotide
attgcgggtttggagaagcagatcgaggag

SEQ ID NO: 278645 - DNA, 29 bp, Artificial Sequence
  Description of Artificial Sequence: Synthetic oligonucleotide
ttgcgggtttggagaagcagatcgaggag

SEQ ID NO: 278646 - DNA, 28 bp, Artificial Sequence
  Description of Artificial Sequence: Synthetic oligonucleotide
tgcgggtttggagaagcagatcgaggag

SEQ ID NO: 278647 - DNA, 27 bp, Artificial Sequence
  Description of Artificial Sequence: Synthetic oligonucleotide
gcgggtttggagaagcagatcgaggag

SEQ ID NO: 278648 - DNA, 27 bp, Artificial Sequence
  Description of Artificial Sequence: Synthetic oligonucleotide
cgggtttggagaagcagatcgaggagc

SEQ ID NO: 278649 - DNA, 28 bp, Artificial Sequence
  Description of Artificial Sequence: Synthetic oligonucleotide
gggtttggagaagcagatcgaggagctg

SEQ ID NO: 278650 - DNA, 28 bp, Artificial Sequence
  Description of Artificial Sequence: Synthetic oligonucleotide
ggtttggagaagcagatcgaggagctgg

SEQ ID NO: 278651 - DNA, 29 bp, Artificial Sequence
  Description of Artificial Sequence: Synthetic oligonucleotide
gtttggagaagcagatcgaggagctggag

SEQ ID NO: 278652 - DNA, 29 bp, Artificial Sequence
  Description of Artificial Sequence: Synthetic oligonucleotide
tttggagaagcagatcgaggagctggagg

SEQ ID NO: 278653 - DNA, 28 bp, Artificial Sequence
  Description of Artificial Sequence: Synthetic oligonucleotide
ttggagaagcagatcgaggagctggagg

SEQ ID NO: 278654 - DNA, 27 bp, Artificial Sequence
  Description of Artificial Sequence: Synthetic oligonucleotide
tggagaagcagatcgaggagctggagg

SEQ ID NO: 278655 - DNA, 27 bp, Artificial Sequence
  Description of Artificial Sequence: Synthetic oligonucleotide
ggagaagcagatcgaggagctggagga

SEQ ID NO: 278656 - DNA, 27 bp, Artificial Sequence
  Description of Artificial Sequence: Synthetic oligonucleotide
gagaagcagatcgaggagctggaggag

SEQ ID NO: 278657 - DNA, 27 bp, Artificial Sequence
  Description of Artificial Sequence: Synthetic oligonucleotide
agaagcagatcgaggagctggaggagg

SEQ ID NO: 278658 - DNA, 26 bp, Artificial Sequence
  Description of Artificial Sequence: Synthetic oligonucleotide
gaagcagatcgaggagctggaggagg

SEQ ID NO: 278659 - DNA, 26 bp, Artificial Sequence
  Description of Artificial Sequence: Synthetic oligonucleotide
aagcagatcgaggagctggaggaggc

SEQ ID NO: 278660 - DNA, 25 bp, Artificial Sequence
  Description of Artificial Sequence: Synthetic oligonucleotide
agcagatcgaggagctggaggaggc

SEQ ID NO: 278661 - DNA, 24 bp, Artificial Sequence
  Description of Artificial Sequence: Synthetic oligonucleotide
gcagatcgaggagctggaggaggc

SEQ ID NO: 278662 - DNA, 27 bp, Artificial Sequence
  Description of Artificial Sequence: Synthetic oligonucleotide
cagatcgaggagctggaggaggccata

SEQ ID NO: 278663 - DNA, 27 bp, Artificial Sequence
  Description of Artificial Sequence: Synthetic oligonucleotide
agatcgaggagctggaggaggccatag

SEQ ID NO: 278664 - DNA, 27 bp, Artificial Sequence
  Description of Artificial Sequence: Synthetic oligonucleotide
gatcgaggagctggaggaggccatagt

SEQ ID NO: 278665 - DNA, 27 bp, Artificial Sequence
  Description of Artificial Sequence: Synthetic oligonucleotide
atcgaggagctggaggaggccatagtc

SEQ ID NO: 278666 - DNA, 27 bp, Artificial Sequence
  Description of Artificial Sequence: Synthetic oligonucleotide
tcgaggagctggaggaggccatagtct

SEQ ID NO: 278667 - DNA, 27 bp, Artificial Sequence
  Description of Artificial Sequence: Synthetic oligonucleotide
cgaggagctggaggaggccatagtctt

SEQ ID NO: 278668 - DNA, 27 bp, Artificial Sequence
  Description of Artificial Sequence: Synthetic oligonucleotide
gaggagctggaggaggccatagtcttg

SEQ ID NO: 278669 - DNA, 27 bp, Artificial Sequence
  Description of Artificial Sequence: Synthetic oligonucleotide
aggagctggaggaggccatagtcttgc

SEQ ID NO: 278670 - DNA, 26 bp, Artificial Sequence
  Description of Artificial Sequence: Synthetic oligonucleotide
ggagctggaggaggccatagtcttgc

SEQ ID NO: 278671 - DNA, 27 bp, Artificial Sequence
  Description of Artificial Sequence: Synthetic oligonucleotide
gagctggaggaggccatagtcttgcca

SEQ ID NO: 278672 - DNA, 29 bp, Artificial Sequence
  Description of Artificial Sequence: Synthetic oligonucleotide
agctggaggaggccatagtcttgccattg

SEQ ID NO: 278673 - DNA, 28 bp, Artificial Sequence
  Description of Artificial Sequence: Synthetic oligonucleotide
gctggaggaggccatagtcttgccattg

SEQ ID NO: 278674 - DNA, 30 bp, Artificial Sequence
  Description of Artificial Sequence: Synthetic oligonucleotide
ctggaggaggccatagtcttgccattgaac

SEQ ID NO: 278675 - DNA, 30 bp, Artificial Sequence
  Description of Artificial Sequence: Synthetic oligonucleotide
tggaggaggccatagtcttgccattgaacc

SEQ ID NO: 278676 - DNA, 29 bp, Artificial Sequence
  Description of Artificial Sequence: Synthetic oligonucleotide
ggaggaggccatagtcttgccattgaacc

SEQ ID NO: 278677 - DNA, 30 bp, Artificial Sequence
  Description of Artificial Sequence: Synthetic oligonucleotide
gaggaggccatagtcttgccattgaaccac

SEQ ID NO: 278678 - DNA, 32 bp, Artificial Sequence
  Description of Artificial Sequence: Synthetic oligonucleotide
aggaggccatagtcttgccattgaaccacatg

SEQ ID NO: 278679 - DNA, 31 bp, Artificial Sequence
  Description of Artificial Sequence: Synthetic oligonucleotide
ggaggccatagtcttgccattgaaccacatg

SEQ ID NO: 278680 - DNA, 31 bp, Artificial Sequence
  Description of Artificial Sequence: Synthetic oligonucleotide
gaggccatagtcttgccattgaaccacatgg

SEQ ID NO: 278681 - DNA, 32 bp, Artificial Sequence
  Description of Artificial Sequence: Synthetic oligonucleotide
aggccatagtcttgccattgaaccacatggag

SEQ ID NO: 278682 - DNA, 31 bp, Artificial Sequence
  Description of Artificial Sequence: Synthetic oligonucleotide
ggccatagtcttgccattgaaccacatggag

SEQ ID NO: 278683 - DNA, 33 bp, Artificial Sequence
  Description of Artificial Sequence: Synthetic oligonucleotide
gccatagtcttgccattgaaccacatggagaag

SEQ ID NO: 278684 - DNA, 36 bp, Artificial Sequence
  Description of Artificial Sequence: Synthetic oligonucleotide
ccatagtcttgccattgaaccacatggagaagttag

SEQ ID NO: 278685 - DNA, 37 bp, Artificial Sequence
  Description of Artificial Sequence: Synthetic oligonucleotide
catagtcttgccattgaaccacatggagaagttagag

SEQ ID NO: 278686 - DNA, 39 bp, Artificial Sequence
  Description of Artificial Sequence: Synthetic oligonucleotide
atagtcttgccattgaaccacatggagaagttagagaac

SEQ ID NO: 278687 - DNA, 38 bp, Artificial Sequence
  Description of Artificial Sequence: Synthetic oligonucleotide
tagtcttgccattgaaccacatggagaagttagagaac

SEQ ID NO: 278688 - DNA, 37 bp, Artificial Sequence
  Description of Artificial Sequence: Synthetic oligonucleotide
agtcttgccattgaaccacatggagaagttagagaac

SEQ ID NO: 278689 - DNA, 36 bp, Artificial Sequence
  Description of Artificial Sequence: Synthetic oligonucleotide
gtcttgccattgaaccacatggagaagttagagaac

SEQ ID NO: 278690 - DNA, 38 bp, Artificial Sequence
  Description of Artificial Sequence: Synthetic oligonucleotide
tcttgccattgaaccacatggagaagttagagaacttg

SEQ ID NO: 278691 - DNA, 37 bp, Artificial Sequence
  Description of Artificial Sequence: Synthetic oligonucleotide
cttgccattgaaccacatggagaagttagagaacttg

SEQ ID NO: 278692 - DNA, 37 bp, Artificial Sequence
  Description of Artificial Sequence: Synthetic oligonucleotide
ttgccattgaaccacatggagaagttagagaacttgc

SEQ ID NO: 278693 - DNA, 36 bp, Artificial Sequence
  Description of Artificial Sequence: Synthetic oligonucleotide
tgccattgaaccacatggagaagttagagaacttgc

SEQ ID NO: 278694 - DNA, 35 bp, Artificial Sequence
  Description of Artificial Sequence: Synthetic oligonucleotide
gccattgaaccacatggagaagttagagaacttgc

SEQ ID NO: 278695 - DNA, 35 bp, Artificial Sequence
  Description of Artificial Sequence: Synthetic oligonucleotide
ccattgaaccacatggagaagttagagaacttgcg

SEQ ID NO: 278696 - DNA, 35 bp, Artificial Sequence
  Description of Artificial Sequence: Synthetic oligonucleotide
cattgaaccacatggagaagttagagaacttgcgg

SEQ ID NO: 278697 - DNA, 37 bp, Artificial Sequence
  Description of Artificial Sequence: Synthetic oligonucleotide
attgaaccacatggagaagttagagaacttgcggatc

SEQ ID NO: 278698 - DNA, 36 bp, Artificial Sequence
  Description of Artificial Sequence: Synthetic oligonucleotide
ttgaaccacatggagaagttagagaacttgcggatc

SEQ ID NO: 278699 - DNA, 35 bp, Artificial Sequence
  Description of Artificial Sequence: Synthetic oligonucleotide
tgaaccacatggagaagttagagaacttgcggatc

SEQ ID NO: 278700 - DNA, 34 bp, Artificial Sequence
  Description of Artificial Sequence: Synthetic oligonucleotide
gaaccacatggagaagttagagaacttgcggatc

SEQ ID NO: 278701 - DNA, 34 bp, Artificial Sequence
  Description of Artificial Sequence: Synthetic oligonucleotide
aaccacatggagaagttagagaacttgcggatcc

SEQ ID NO: 278702 - DNA, 33 bp, Artificial Sequence
  Description of Artificial Sequence: Synthetic oligonucleotide
accacatggagaagttagagaacttgcggatcc

SEQ ID NO: 278703 - DNA, 32 bp, Artificial Sequence
  Description of Artificial Sequence: Synthetic oligonucleotide
ccacatggagaagttagagaacttgcggatcc

SEQ ID NO: 278704 - DNA, 34 bp, Artificial Sequence
  Description of Artificial Sequence: Synthetic oligonucleotide
cacatggagaagttagagaacttgcggatccaac

SEQ ID NO: 278705 - DNA, 34 bp, Artificial Sequence
  Description of Artificial Sequence: Synthetic oligonucleotide
acatggagaagttagagaacttgcggatccaacg

SEQ ID NO: 278706 - DNA, 33 bp, Artificial Sequence
  Description of Artificial Sequence: Synthetic oligonucleotide
catggagaagttagagaacttgcggatccaacg

SEQ ID NO: 278707 - DNA, 34 bp, Artificial Sequence
  Description of Artificial Sequence: Synthetic oligonucleotide
atggagaagttagagaacttgcggatccaacgtc

SEQ ID NO: 278708 - DNA, 33 bp, Artificial Sequence
  Description of Artificial Sequence: Synthetic oligonucleotide
tggagaagttagagaacttgcggatccaacgtc

SEQ ID NO: 278709 - DNA, 32 bp, Artificial Sequence
  Description of Artificial Sequence: Synthetic oligonucleotide
ggagaagttagagaacttgcggatccaacgtc

SEQ ID NO: 278710 - DNA, 32 bp, Artificial Sequence
  Description of Artificial Sequence: Synthetic oligonucleotide
gagaagttagagaacttgcggatccaacgtcc

SEQ ID NO: 278711 - DNA, 36 bp, Artificial Sequence
  Description of Artificial Sequence: Synthetic oligonucleotide
agaagttagagaacttgcggatccaacgtccaaaag

SEQ ID NO: 278712 - DNA, 35 bp, Artificial Sequence
  Description of Artificial Sequence: Synthetic oligonucleotide
gaagttagagaacttgcggatccaacgtccaaaag

SEQ ID NO: 278713 - DNA, 35 bp, Artificial Sequence
  Description of Artificial Sequence: Synthetic oligonucleotide
aagttagagaacttgcggatccaacgtccaaaagg

SEQ ID NO: 278714 - DNA, 34 bp, Artificial Sequence
  Description of Artificial Sequence: Synthetic oligonucleotide
agttagagaacttgcggatccaacgtccaaaagg

SEQ ID NO: 278715 - DNA, 33 bp, Artificial Sequence
  Description of Artificial Sequence: Synthetic oligonucleotide
gttagagaacttgcggatccaacgtccaaaagg

SEQ ID NO: 278716 - DNA, 33 bp, Artificial Sequence
  Description of Artificial Sequence: Synthetic oligonucleotide
ttagagaacttgcggatccaacgtccaaaaggc

SEQ ID NO: 278717 - DNA, 32 bp, Artificial Sequence
  Description of Artificial Sequence: Synthetic oligonucleotide
tagagaacttgcggatccaacgtccaaaaggc

SEQ ID NO: 278718 - DNA, 31 bp, Artificial Sequence
  Description of Artificial Sequence: Synthetic oligonucleotide
agagaacttgcggatccaacgtccaaaaggc

SEQ ID NO: 278719 - DNA, 30 bp, Artificial Sequence
  Description of Artificial Sequence: Synthetic oligonucleotide
gagaacttgcggatccaacgtccaaaaggc

SEQ ID NO: 278720 - DNA, 30 bp, Artificial Sequence
  Description of Artificial Sequence: Synthetic oligonucleotide
agaacttgcggatccaacgtccaaaaggcg

SEQ ID NO: 278721 - DNA, 29 bp, Artificial Sequence
  Description of Artificial Sequence: Synthetic oligonucleotide
gaacttgcggatccaacgtccaaaaggcg

SEQ ID NO: 278722 - DNA, 30 bp, Artificial Sequence
  Description of Artificial Sequence: Synthetic oligonucleotide
aacttgcggatccaacgtccaaaaggcgtg

SEQ ID NO: 278723 - DNA, 29 bp, Artificial Sequence
  Description of Artificial Sequence: Synthetic oligonucleotide
acttgcggatccaacgtccaaaaggcgtg

SEQ ID NO: 278724 - DNA, 28 bp, Artificial Sequence
  Description of Artificial Sequence: Synthetic oligonucleotide
cttgcggatccaacgtccaaaaggcgtg

SEQ ID NO: 278725 - DNA, 28 bp, Artificial Sequence
  Description of Artificial Sequence: Synthetic oligonucleotide
ttgcggatccaacgtccaaaaggcgtgc

SEQ ID NO: 278726 - DNA, 27 bp, Artificial Sequence
  Description of Artificial Sequence: Synthetic oligonucleotide
tgcggatccaacgtccaaaaggcgtgc

SEQ ID NO: 278727 - DNA, 27 bp, Artificial Sequence
  Description of Artificial Sequence: Synthetic oligonucleotide
gcggatccaacgtccaaaaggcgtgct

SEQ ID NO: 278728 - DNA, 27 bp, Artificial Sequence
  Description of Artificial Sequence: Synthetic oligonucleotide
cggatccaacgtccaaaaggcgtgctg

SEQ ID NO: 278729 - DNA, 29 bp, Artificial Sequence
  Description of Artificial Sequence: Synthetic oligonucleotide
ggatccaacgtccaaaaggcgtgctgatg

SEQ ID NO: 278730 - DNA, 32 bp, Artificial Sequence
  Description of Artificial Sequence: Synthetic oligonucleotide
gatccaacgtccaaaaggcgtgctgatgaatg

SEQ ID NO: 278731 - DNA, 32 bp, Artificial Sequence
  Description of Artificial Sequence: Synthetic oligonucleotide
atccaacgtccaaaaggcgtgctgatgaatgg

SEQ ID NO: 278732 - DNA, 31 bp, Artificial Sequence
  Description of Artificial Sequence: Synthetic oligonucleotide
tccaacgtccaaaaggcgtgctgatgaatgg

SEQ ID NO: 278733 - DNA, 30 bp, Artificial Sequence
  Description of Artificial Sequence: Synthetic oligonucleotide
ccaacgtccaaaaggcgtgctgatgaatgg

SEQ ID NO: 278734 - DNA, 30 bp, Artificial Sequence
  Description of Artificial Sequence: Synthetic oligonucleotide
caacgtccaaaaggcgtgctgatgaatggg

SEQ ID NO: 278735 - DNA, 30 bp, Artificial Sequence
  Description of Artificial Sequence: Synthetic oligonucleotide
aacgtccaaaaggcgtgctgatgaatgggc

SEQ ID NO: 278736 - DNA, 29 bp, Artificial Sequence
  Description of Artificial Sequence: Synthetic oligonucleotide
acgtccaaaaggcgtgctgatgaatgggc

SEQ ID NO: 278737 - DNA, 28 bp, Artificial Sequence
  Description of Artificial Sequence: Synthetic oligonucleotide
cgtccaaaaggcgtgctgatgaatgggc

SEQ ID NO: 278738 - DNA, 28 bp, Artificial Sequence
  Description of Artificial Sequence: Synthetic oligonucleotide
gtccaaaaggcgtgctgatgaatgggcc

SEQ ID NO: 278739 - DNA, 28 bp, Artificial Sequence
  Description of Artificial Sequence: Synthetic oligonucleotide
tccaaaaggcgtgctgatgaatgggccc

SEQ ID NO: 278740 - DNA, 27 bp, Artificial Sequence
  Description of Artificial Sequence: Synthetic oligonucleotide
ccaaaaggcgtgctgatgaatgggccc

SEQ ID NO: 278741 - DNA, 27 bp, Artificial Sequence
  Description of Artificial Sequence: Synthetic oligonucleotide
caaaaggcgtgctgatgaatgggcccc

SEQ ID NO: 278742 - DNA, 27 bp, Artificial Sequence
  Description of Artificial Sequence: Synthetic oligonucleotide
aaaaggcgtgctgatgaatgggccccg

SEQ ID NO: 278743 - DNA, 27 bp, Artificial Sequence
  Description of Artificial Sequence: Synthetic oligonucleotide
aaaggcgtgctgatgaatgggccccga

SEQ ID NO: 278744 - DNA, 26 bp, Artificial Sequence
  Description of Artificial Sequence: Synthetic oligonucleotide
aaggcgtgctgatgaatgggccccga

SEQ ID NO: 278745 - DNA, 25 bp, Artificial Sequence
  Description of Artificial Sequence: Synthetic oligonucleotide
aggcgtgctgatgaatgggccccga

SEQ ID NO: 278746 - DNA, 24 bp, Artificial Sequence
  Description of Artificial Sequence: Synthetic oligonucleotide
ggcgtgctgatgaatgggccccga

SEQ ID NO: 278747 - DNA, 24 bp, Artificial Sequence
  Description of Artificial Sequence: Synthetic oligonucleotide
gcgtgctgatgaatgggccccgag

SEQ ID NO: 278748 - DNA, 24 bp, Artificial Sequence
  Description of Artificial Sequence: Synthetic oligonucleotide
cgtgctgatgaatgggccccgagg

SEQ ID NO: 278749 - DNA, 25 bp, Artificial Sequence
  Description of Artificial Sequence: Synthetic oligonucleotide
gtgctgatgaatgggccccgaggga

SEQ ID NO: 278750 - DNA, 25 bp, Artificial Sequence
  Description of Artificial Sequence: Synthetic oligonucleotide
tgctgatgaatgggccccgagggac

SEQ ID NO: 278751 - DNA, 24 bp, Artificial Sequence
  Description of Artificial Sequence: Synthetic oligonucleotide
gctgatgaatgggccccgagggac

SEQ ID NO: 278752 - DNA, 24 bp, Artificial Sequence
  Description of Artificial Sequence: Synthetic oligonucleotide
ctgatgaatgggccccgagggacg

SEQ ID NO: 278753 - DNA, 24 bp, Artificial Sequence
  Description of Artificial Sequence: Synthetic oligonucleotide
tgatgaatgggccccgagggacgg

SEQ ID NO: 278754 - DNA, 23 bp, Artificial Sequence
  Description of Artificial Sequence: Synthetic oligonucleotide
gatgaatgggccccgagggacgg

SEQ ID NO: 278755 - DNA, 23 bp, Artificial Sequence
  Description of Artificial Sequence: Synthetic oligonucleotide
atgaatgggccccgagggacggg

SEQ ID NO: 278756 - DNA, 22 bp, Artificial Sequence
  Description of Artificial Sequence: Synthetic oligonucleotide
tgaatgggccccgagggacggg

SEQ ID NO: 278757 - DNA, 21 bp, Artificial Sequence
  Description of Artificial Sequence: Synthetic oligonucleotide
gaatgggccccgagggacggg

SEQ ID NO: 278758 - DNA, 23 bp, Artificial Sequence
  Description of Artificial Sequence: Synthetic oligonucleotide
aatgggccccgagggacgggcaa

SEQ ID NO: 278759 - DNA, 22 bp, Artificial Sequence
  Description of Artificial Sequence: Synthetic oligonucleotide
atgggccccgagggacgggcaa

SEQ ID NO: 278760 - DNA, 21 bp, Artificial Sequence
  Description of Artificial Sequence: Synthetic oligonucleotide
tgggccccgagggacgggcaa

SEQ ID NO: 278761 - DNA, 20 bp, Artificial Sequence
  Description of Artificial Sequence: Synthetic oligonucleotide
gggccccgagggacgggcaa

SEQ ID NO: 278762 - DNA, 21 bp, Artificial Sequence
  Description of Artificial Sequence: Synthetic oligonucleotide
ggccccgagggacgggcaaga

SEQ ID NO: 278763 - DNA, 21 bp, Artificial Sequence
  Description of Artificial Sequence: Synthetic oligonucleotide
gccccgagggacgggcaagac

SEQ ID NO: 278764 - DNA, 21 bp, Artificial Sequence
  Description of Artificial Sequence: Synthetic oligonucleotide
ccccgagggacgggcaagacc

SEQ ID NO: 278765 - DNA, 22 bp, Artificial Sequence
  Description of Artificial Sequence: Synthetic oligonucleotide
cccgagggacgggcaagaccct

SEQ ID NO: 278766 - DNA, 22 bp, Artificial Sequence
  Description of Artificial Sequence: Synthetic oligonucleotide
ccgagggacgggcaagaccctc

SEQ ID NO: 278767 - DNA, 23 bp, Artificial Sequence
  Description of Artificial Sequence: Synthetic oligonucleotide
cgagggacgggcaagaccctcgt

SEQ ID NO: 278768 - DNA, 23 bp, Artificial Sequence
  Description of Artificial Sequence: Synthetic oligonucleotide
gagggacgggcaagaccctcgtg

SEQ ID NO: 278769 - DNA, 23 bp, Artificial Sequence
  Description of Artificial Sequence: Synthetic oligonucleotide
agggacgggcaagaccctcgtgg

SEQ ID NO: 278770 - DNA, 22 bp, Artificial Sequence
  Description of Artificial Sequence: Synthetic oligonucleotide
gggacgggcaagaccctcgtgg

SEQ ID NO: 278771 - DNA, 22 bp, Artificial Sequence
  Description of Artificial Sequence: Synthetic oligonucleotide
ggacgggcaagaccctcgtggc

SEQ ID NO: 278772 - DNA, 22 bp, Artificial Sequence
  Description of Artificial Sequence: Synthetic oligonucleotide
gacgggcaagaccctcgtggcc

SEQ ID NO: 278773 - DNA, 22 bp, Artificial Sequence
  Description of Artificial Sequence: Synthetic oligonucleotide
acgggcaagaccctcgtggccc

SEQ ID NO: 278774 - DNA, 21 bp, Artificial Sequence
  Description of Artificial Sequence: Synthetic oligonucleotide
cgggcaagaccctcgtggccc

SEQ ID NO: 278775 - DNA, 21 bp, Artificial Sequence
  Description of Artificial Sequence: Synthetic oligonucleotide
gggcaagaccctcgtggcccg

SEQ ID NO: 278776 - DNA, 21 bp, Artificial Sequence
  Description of Artificial Sequence: Synthetic oligonucleotide
ggcaagaccctcgtggcccgg

SEQ ID NO: 278777 - DNA, 21 bp, Artificial Sequence
  Description of Artificial Sequence: Synthetic oligonucleotide
gcaagaccctcgtggcccggg

SEQ ID NO: 278778 - DNA, 21 bp, Artificial Sequence
  Description of Artificial Sequence: Synthetic oligonucleotide
caagaccctcgtggcccgggg

SEQ ID NO: 278779 - DNA, 22 bp, Artificial Sequence
  Description of Artificial Sequence: Synthetic oligonucleotide
aagaccctcgtggcccggggct

SEQ ID NO: 278780 - DNA, 21 bp, Artificial Sequence
  Description of Artificial Sequence: Synthetic oligonucleotide
agaccctcgtggcccggggct

SEQ ID NO: 278781 - DNA, 20 bp, Artificial Sequence
  Description of Artificial Sequence: Synthetic oligonucleotide
gaccctcgtggcccggggct

SEQ ID NO: 278782 - DNA, 21 bp, Artificial Sequence
  Description of Artificial Sequence: Synthetic oligonucleotide
accctcgtggcccggggctgt

SEQ ID NO: 278783 - DNA, 20 bp, Artificial Sequence
  Description of Artificial Sequence: Synthetic oligonucleotide
ccctcgtggcccggggctgt

SEQ ID NO: 278784 - DNA, 20 bp, Artificial Sequence
  Description of Artificial Sequence: Synthetic oligonucleotide
cctcgtggcccggggctgtg

SEQ ID NO: 278785 - DNA, 20 bp, Artificial Sequence
  Description of Artificial Sequence: Synthetic oligonucleotide
ctcgtggcccggggctgtgc

SEQ ID NO: 278786 - DNA, 20 bp, Artificial Sequence
  Description of Artificial Sequence: Synthetic oligonucleotide
tcgtggcccggggctgtgcc

SEQ ID NO: 278787 - DNA, 20 bp, Artificial Sequence
  Description of Artificial Sequence: Synthetic oligonucleotide
cgtggcccggggctgtgcct

SEQ ID NO: 278788 - DNA, 20 bp, Artificial Sequence
  Description of Artificial Sequence: Synthetic oligonucleotide
gtggcccggggctgtgccgt

SEQ ID NO: 278789 - DNA, 20 bp, Artificial Sequence
  Description of Artificial Sequence: Synthetic oligonucleotide
tggcccggggctgtgccgct

SEQ ID NO: 278790 - DNA, 20 bp, Artificial Sequence
  Description of Artificial Sequence: Synthetic oligonucleotide
ggcccggggctgtgccgctt

SEQ ID NO: 278791 - DNA, 20 bp, Artificial Sequence
  Description of Artificial Sequence: Synthetic oligonucleotide
gcccggggctgtgccgctca

SEQ ID NO: 278792 - DNA, 21 bp, Artificial Sequence
  Description of Artificial Sequence: Synthetic oligonucleotide
cccggggctgtgccgctcaga

SEQ ID NO: 278793 - DNA, 24 bp, Artificial Sequence
  Description of Artificial Sequence: Synthetic oligonucleotide
ccggggctgtgccgctcagactaa

SEQ ID NO: 278794 - DNA, 24 bp, Artificial Sequence
  Description of Artificial Sequence: Synthetic oligonucleotide
cggggctgtgccgctcagactaag

SEQ ID NO: 278795 - DNA, 24 bp, Artificial Sequence
  Description of Artificial Sequence: Synthetic oligonucleotide
ggggctgtgccgctcagactaagc

SEQ ID NO: 278796 - DNA, 24 bp, Artificial Sequence
  Description of Artificial Sequence: Synthetic oligonucleotide
gggctgtgccgctcagactaagcc

SEQ ID NO: 278797 - DNA, 25 bp, Artificial Sequence
  Description of Artificial Sequence: Synthetic oligonucleotide
ggctgtgccgctcagactaagccca

SEQ ID NO: 278798 - DNA, 25 bp, Artificial Sequence
  Description of Artificial Sequence: Synthetic oligonucleotide
gctgtgccgctcagactaagcccac

SEQ ID NO: 278799 - DNA, 27 bp, Artificial Sequence
  Description of Artificial Sequence: Synthetic oligonucleotide
ctgtgccgctcagactaagcccacctt

SEQ ID NO: 278800 - DNA, 27 bp, Artificial Sequence
  Description of Artificial Sequence: Synthetic oligonucleotide
tgtgccgctcagactaagcccaccttc

SEQ ID NO: 278801 - DNA, 26 bp, Artificial Sequence
  Description of Artificial Sequence: Synthetic oligonucleotide
gtgccgctcagactaagcccaccttc

SEQ ID NO: 278802 - DNA, 27 bp, Artificial Sequence
  Description of Artificial Sequence: Synthetic oligonucleotide
tgccgctcagactaagcccaccttcca

SEQ ID NO: 278803 - DNA, 27 bp, Artificial Sequence
  Description of Artificial Sequence: Synthetic oligonucleotide
gccgctcagactaagcccaccttccaa

SEQ ID NO: 278804 - DNA, 29 bp, Artificial Sequence
  Description of Artificial Sequence: Synthetic oligonucleotide
ccgctcagactaagcccaccttccaaaag

SEQ ID NO: 278805 - DNA, 29 bp, Artificial Sequence
  Description of Artificial Sequence: Synthetic oligonucleotide
cgctcagactaagcccaccttccaaaagc

SEQ ID NO: 278806 - DNA, 30 bp, Artificial Sequence
  Description of Artificial Sequence: Synthetic oligonucleotide
gctcagactaagcccaccttccaaaagctg

SEQ ID NO: 278807 - DNA, 30 bp, Artificial Sequence
  Description of Artificial Sequence: Synthetic oligonucleotide
ctcagactaagcccaccttccaaaagctgg

SEQ ID NO: 278808 - DNA, 30 bp, Artificial Sequence
  Description of Artificial Sequence: Synthetic oligonucleotide
tcagactaagcccaccttccaaaagctggc

SEQ ID NO: 278809 - DNA, 29 bp, Artificial Sequence
  Description of Artificial Sequence: Synthetic oligonucleotide
cagactaagcccaccttccaaaagctggc

SEQ ID NO: 278810 - DNA, 30 bp, Artificial Sequence
  Description of Artificial Sequence: Synthetic oligonucleotide
agactaagcccaccttccaaaagctggcag

SEQ ID NO: 278811 - DNA, 29 bp, Artificial Sequence
  Description of Artificial Sequence: Synthetic oligonucleotide
gactaagcccaccttccaaaagctggcag

SEQ ID NO: 278812 - DNA, 29 bp, Artificial Sequence
  Description of Artificial Sequence: Synthetic oligonucleotide
actaagcccaccttccaaaagctggcagg

SEQ ID NO: 278813 - DNA, 28 bp, Artificial Sequence
  Description of Artificial Sequence: Synthetic oligonucleotide
ctaagcccaccttccaaaagctggcagg

SEQ ID NO: 278814 - DNA, 28 bp, Artificial Sequence
  Description of Artificial Sequence: Synthetic oligonucleotide
taagcccaccttccaaaagctggcaggc

SEQ ID NO: 278815 - DNA, 27 bp, Artificial Sequence
  Description of Artificial Sequence: Synthetic oligonucleotide
aagcccaccttccaaaagctggcaggc

SEQ ID NO: 278816 - DNA, 26 bp, Artificial Sequence
  Description of Artificial Sequence: Synthetic oligonucleotide
agcccaccttccaaaagctggcaggc

SEQ ID NO: 278817 - DNA, 25 bp, Artificial Sequence
  Description of Artificial Sequence: Synthetic oligonucleotide
gcccaccttccaaaagctggcaggc

SEQ ID NO: 278818 - DNA, 25 bp, Artificial Sequence
  Description of Artificial Sequence: Synthetic oligonucleotide
cccaccttccaaaagctggcaggcc

SEQ ID NO: 278819 - DNA, 25 bp, Artificial Sequence
  Description of Artificial Sequence: Synthetic oligonucleotide
ccaccttccaaaagctggcaggccc

SEQ ID NO: 278820 - DNA, 25 bp, Artificial Sequence
  Description of Artificial Sequence: Synthetic oligonucleotide
caccttccaaaagctggcaggcccc

SEQ ID NO: 278821 - DNA, 26 bp, Artificial Sequence
  Description of Artificial Sequence: Synthetic oligonucleotide
accttccaaaagctggcaggccccca

SEQ ID NO: 278822 - DNA, 25 bp, Artificial Sequence
  Description of Artificial Sequence: Synthetic oligonucleotide
ccttccaaaagctggcaggccccca

SEQ ID NO: 278823 - DNA, 25 bp, Artificial Sequence
  Description of Artificial Sequence: Synthetic oligonucleotide
cttccaaaagctggcaggcccccag

SEQ ID NO: 278824 - DNA, 26 bp, Artificial Sequence
  Description of Artificial Sequence: Synthetic oligonucleotide
ttccaaaagctggcaggcccccaggt

SEQ ID NO: 278825 - DNA, 25 bp, Artificial Sequence
  Description of Artificial Sequence: Synthetic oligonucleotide
tccaaaagctggcaggcccccaggt

SEQ ID NO: 278826 - DNA, 24 bp, Artificial Sequence
  Description of Artificial Sequence: Synthetic oligonucleotide
ccaaaagctggcaggcccccaggt

SEQ ID NO: 278827 - DNA, 24 bp, Artificial Sequence
  Description of Artificial Sequence: Synthetic oligonucleotide
caaaagctggcaggcccccaggtg

SEQ ID NO: 278828 - DNA, 25 bp, Artificial Sequence
  Description of Artificial Sequence: Synthetic oligonucleotide
aaaagctggcaggcccccaggtggt

SEQ ID NO: 278829 - DNA, 24 bp, Artificial Sequence
  Description of Artificial Sequence: Synthetic oligonucleotide
aaagctggcaggcccccaggtggt

SEQ ID NO: 278830 - DNA, 23 bp, Artificial Sequence
  Description of Artificial Sequence: Synthetic oligonucleotide
aagctggcaggcccccaggtggt

SEQ ID NO: 278831 - DNA, 22 bp, Artificial Sequence
  Description of Artificial Sequence: Synthetic oligonucleotide
agctggcaggcccccaggtggt

SEQ ID NO: 278832 - DNA, 21 bp, Artificial Sequence
  Description of Artificial Sequence: Synthetic oligonucleotide
gctggcaggcccccaggtggt

SEQ ID NO: 278833 - DNA, 21 bp, Artificial Sequence
  Description of Artificial Sequence: Synthetic oligonucleotide
ctggcaggcccccaggtggtg

SEQ ID NO: 278834 - DNA, 22 bp, Artificial Sequence
  Description of Artificial Sequence: Synthetic oligonucleotide
tggcaggcccccaggtggtgca

SEQ ID NO: 278835 - DNA, 21 bp, Artificial Sequence
  Description of Artificial Sequence: Synthetic oligonucleotide
ggcaggcccccaggtggtgca

SEQ ID NO: 278836 - DNA, 23 bp, Artificial Sequence
  Description of Artificial Sequence: Synthetic oligonucleotide
gcaggcccccaggtggtgcagaa

SEQ ID NO: 278837 - DNA, 25 bp, Artificial Sequence
  Description of Artificial Sequence: Synthetic oligonucleotide
caggcccccaggtggtgcagaagtt

SEQ ID NO: 278838 - DNA, 27 bp, Artificial Sequence
  Description of Artificial Sequence: Synthetic oligonucleotide
aggcccccaggtggtgcagaagttcat

SEQ ID NO: 278839 - DNA, 27 bp, Artificial Sequence
  Description of Artificial Sequence: Synthetic oligonucleotide
ggcccccaggtggtgcagaagttcatt

SEQ ID NO: 278840 - DNA, 27 bp, Artificial Sequence
  Description of Artificial Sequence: Synthetic oligonucleotide
gcccccaggtggtgcagaagttcattg

SEQ ID NO: 278841 - DNA, 27 bp, Artificial Sequence
  Description of Artificial Sequence: Synthetic oligonucleotide
cccccaggtggtgcagaagttcattgg

SEQ ID NO: 278842 - DNA, 28 bp, Artificial Sequence
  Description of Artificial Sequence: Synthetic oligonucleotide
ccccaggtggtgcagaagttcattggtg

SEQ ID NO: 278843 - DNA, 30 bp, Artificial Sequence
  Description of Artificial Sequence: Synthetic oligonucleotide
cccaggtggtgcagaagttcattggtgatg

SEQ ID NO: 278844 - DNA, 30 bp, Artificial Sequence
  Description of Artificial Sequence: Synthetic oligonucleotide
ccaggtggtgcagaagttcattggtgatgg

SEQ ID NO: 278845 - DNA, 31 bp, Artificial Sequence
  Description of Artificial Sequence: Synthetic oligonucleotide
caggtggtgcagaagttcattggtgatggtg

SEQ ID NO: 278846 - DNA, 31 bp, Artificial Sequence
  Description of Artificial Sequence: Synthetic oligonucleotide
aggtggtgcagaagttcattggtgatggtgc

SEQ ID NO: 278847 - DNA, 30 bp, Artificial Sequence
  Description of Artificial Sequence: Synthetic oligonucleotide
ggtggtgcagaagttcattggtgatggtgc

SEQ ID NO: 278848 - DNA, 30 bp, Artificial Sequence
  Description of Artificial Sequence: Synthetic oligonucleotide
gtggtgcagaagttcattggtgatggtgcc

SEQ ID NO: 278849 - DNA, 32 bp, Artificial Sequence
  Description of Artificial Sequence: Synthetic oligonucleotide
tggtgcagaagttcattggtgatggtgcctag

SEQ ID NO: 278850 - DNA, 31 bp, Artificial Sequence
  Description of Artificial Sequence: Synthetic oligonucleotide
ggtgcagaagttcattggtgatggtgcctag

SEQ ID NO: 278851 - DNA, 31 bp, Artificial Sequence
  Description of Artificial Sequence: Synthetic oligonucleotide
gtgcagaagttcattggtgatggtgcctagc

SEQ ID NO: 278852 - DNA, 33 bp, Artificial Sequence
  Description of Artificial Sequence: Synthetic oligonucleotide
tgcagaagttcattggtgatggtgcctagctag

SEQ ID NO: 278853 - DNA, 32 bp, Artificial Sequence
  Description of Artificial Sequence: Synthetic oligonucleotide
gcagaagttcattggtgatggtgcctagctag

SEQ ID NO: 278854 - DNA, 33 bp, Artificial Sequence
  Description of Artificial Sequence: Synthetic oligonucleotide
cagaagttcattggtgatggtgcctagctagtc

SEQ ID NO: 278855 - DNA, 33 bp, Artificial Sequence
  Description of Artificial Sequence: Synthetic oligonucleotide
agaagttcattggtgatggtgcctagctagtcc

SEQ ID NO: 278856 - DNA, 32 bp, Artificial Sequence
  Description of Artificial Sequence: Synthetic oligonucleotide
gaagttcattggtgatggtgcctagctagtcc

SEQ ID NO: 278857 - DNA, 32 bp, Artificial Sequence
  Description of Artificial Sequence: Synthetic oligonucleotide
aagttcattggtgatggtgcctagctagtccc

SEQ ID NO: 278858 - DNA, 31 bp, Artificial Sequence
  Description of Artificial Sequence: Synthetic oligonucleotide
agttcattggtgatggtgcctagctagtccc

SEQ ID NO: 278859 - DNA, 30 bp, Artificial Sequence
  Description of Artificial Sequence: Synthetic oligonucleotide
gttcattggtgatggtgcctagctagtccc

SEQ ID NO: 278860 - DNA, 30 bp, Artificial Sequence
  Description of Artificial Sequence: Synthetic oligonucleotide
ttcattggtgatggtgcctagctagtcccg

SEQ ID NO: 278861 - DNA, 29 bp, Artificial Sequence
  Description of Artificial Sequence: Synthetic oligonucleotide
tcattggtgatggtgcctagctagtcccg

SEQ ID NO: 278862 - DNA, 28 bp, Artificial Sequence
  Description of Artificial Sequence: Synthetic oligonucleotide
cattggtgatggtgcctagctagtcccg

SEQ ID NO: 278863 - DNA, 28 bp, Artificial Sequence
  Description of Artificial Sequence: Synthetic oligonucleotide
attggtgatggtgcctagctagtcccgg

SEQ ID NO: 278864 - DNA, 27 bp, Artificial Sequence
  Description of Artificial Sequence: Synthetic oligonucleotide
ttggtgatggtgcctagctagtcccgg

SEQ ID NO: 278865 - DNA, 27 bp, Artificial Sequence
  Description of Artificial Sequence: Synthetic oligonucleotide
tggtgatggtgcctagctagtcccgga

SEQ ID NO: 278866 - DNA, 27 bp, Artificial Sequence
  Description of Artificial Sequence: Synthetic oligonucleotide
ggtgatggtgcctagctagtcccggat

SEQ ID NO: 278867 - DNA, 27 bp, Artificial Sequence
  Description of Artificial Sequence: Synthetic oligonucleotide
gtgatggtgcctagctagtcccggatg

SEQ ID NO: 278868 - DNA, 27 bp, Artificial Sequence
  Description of Artificial Sequence: Synthetic oligonucleotide
tgatggtgcctagctagtcccggatgc

SEQ ID NO: 278869 - DNA, 26 bp, Artificial Sequence
  Description of Artificial Sequence: Synthetic oligonucleotide
gatggtgcctagctagtcccggatgc

SEQ ID NO: 278870 - DNA, 27 bp, Artificial Sequence
  Description of Artificial Sequence: Synthetic oligonucleotide
atggtgcctagctagtcccggatgcct

SEQ ID NO: 278871 - DNA, 27 bp, Artificial Sequence
  Description of Artificial Sequence: Synthetic oligonucleotide
tggtgcctagctagtcccggatgcctt

SEQ ID NO: 278872 - DNA, 27 bp, Artificial Sequence
  Description of Artificial Sequence: Synthetic oligonucleotide
ggtgcctagctagtcccggatgcctta

SEQ ID NO: 278873 - DNA, 27 bp, Artificial Sequence
  Description of Artificial Sequence: Synthetic oligonucleotide
gtgcctagctagtcccggatgccttag

SEQ ID NO: 278874 - DNA, 27 bp, Artificial Sequence
  Description of Artificial Sequence: Synthetic oligonucleotide
tgcctagctagtcccggatgccttagc

SEQ ID NO: 278875 - DNA, 26 bp, Artificial Sequence
  Description of Artificial Sequence: Synthetic oligonucleotide
gcctagctagtcccggatgccttagc

SEQ ID NO: 278876 - DNA, 26 bp, Artificial Sequence
  Description of Artificial Sequence: Synthetic oligonucleotide
cctagctagtcccggatgccttagcc

SEQ ID NO: 278877 - DNA, 27 bp, Artificial Sequence
  Description of Artificial Sequence: Synthetic oligonucleotide
ctagctagtcccggatgccttagccct

SEQ ID NO: 278878 - DNA, 27 bp, Artificial Sequence
  Description of Artificial Sequence: Synthetic oligonucleotide
tagctagtcccggatgccttagccctg

SEQ ID NO: 278879 - DNA, 26 bp, Artificial Sequence
  Description of Artificial Sequence: Synthetic oligonucleotide
agctagtcccggatgccttagccctg

SEQ ID NO: 278880 - DNA, 25 bp, Artificial Sequence
  Description of Artificial Sequence: Synthetic oligonucleotide
gctagtcccggatgccttagccctg

SEQ ID NO: 278881 - DNA, 25 bp, Artificial Sequence
  Description of Artificial Sequence: Synthetic oligonucleotide
ctagtcccggatgccttagccctgg

SEQ ID NO: 278882 - DNA, 25 bp, Artificial Sequence
  Description of Artificial Sequence: Synthetic oligonucleotide
tagtcccggatgccttagccctggc

SEQ ID NO: 278883 - DNA, 24 bp, Artificial Sequence
  Description of Artificial Sequence: Synthetic oligonucleotide
agtcccggatgccttagccctggc

SEQ ID NO: 278884 - DNA, 23 bp, Artificial Sequence
  Description of Artificial Sequence: Synthetic oligonucleotide
gtcccggatgccttagccctggc

SEQ ID NO: 278885 - DNA, 25 bp, Artificial Sequence
  Description of Artificial Sequence: Synthetic oligonucleotide
tcccggatgccttagccctggccta

SEQ ID NO: 278886 - DNA, 24 bp, Artificial Sequence
  Description of Artificial Sequence: Synthetic oligonucleotide
cccggatgccttagccctggccta

SEQ ID NO: 278887 - DNA, 24 bp, Artificial Sequence
  Description of Artificial Sequence: Synthetic oligonucleotide
ccggatgccttagccctggcctag

SEQ ID NO: 278888 - DNA, 25 bp, Artificial Sequence
  Description of Artificial Sequence: Synthetic oligonucleotide
cggatgccttagccctggcctagga

SEQ ID NO: 278889 - DNA, 27 bp, Artificial Sequence
  Description of Artificial Sequence: Synthetic oligonucleotide
ggatgccttagccctggcctaggagaa

SEQ ID NO: 278890 - DNA, 28 bp, Artificial Sequence
  Description of Artificial Sequence: Synthetic oligonucleotide
gatgccttagccctggcctaggagaaag

SEQ ID NO: 278891 - DNA, 28 bp, Artificial Sequence
  Description of Artificial Sequence: Synthetic oligonucleotide
atgccttagccctggcctaggagaaagg

SEQ ID NO: 278892 - DNA, 27 bp, Artificial Sequence
  Description of Artificial Sequence: Synthetic oligonucleotide
tgccttagccctggcctaggagaaagg

SEQ ID NO: 278893 - DNA, 26 bp, Artificial Sequence
  Description of Artificial Sequence: Synthetic oligonucleotide
gccttagccctggcctaggagaaagg

SEQ ID NO: 278894 - DNA, 26 bp, Artificial Sequence
  Description of Artificial Sequence: Synthetic oligonucleotide
ccttagccctggcctaggagaaaggg

SEQ ID NO: 278895 - DNA, 26 bp, Artificial Sequence
  Description of Artificial Sequence: Synthetic oligonucleotide
cttagccctggcctaggagaaagggc

SEQ ID NO: 278896 - DNA, 26 bp, Artificial Sequence
  Description of Artificial Sequence: Synthetic oligonucleotide
ttagccctggcctaggagaaagggcc

SEQ ID NO: 278897 - DNA, 25 bp, Artificial Sequence
  Description of Artificial Sequence: Synthetic oligonucleotide
tagccctggcctaggagaaagggcc

SEQ ID NO: 278898 - DNA, 24 bp, Artificial Sequence
  Description of Artificial Sequence: Synthetic oligonucleotide
agccctggcctaggagaaagggcc

SEQ ID NO: 278899 - DNA, 23 bp, Artificial Sequence
  Description of Artificial Sequence: Synthetic oligonucleotide
gccctggcctaggagaaagggcc

SEQ ID NO: 278900 - DNA, 24 bp, Artificial Sequence
  Description of Artificial Sequence: Synthetic oligonucleotide
ccctggcctaggagaaagggccct

SEQ ID NO: 278901 - DNA, 27 bp, Artificial Sequence
  Description of Artificial Sequence: Synthetic oligonucleotide
cctggcctaggagaaagggccctctat

SEQ ID NO: 278902 - DNA, 27 bp, Artificial Sequence
  Description of Artificial Sequence: Synthetic oligonucleotide
ctggcctaggagaaagggccctctatg

SEQ ID NO: 278903 - DNA, 29 bp, Artificial Sequence
  Description of Artificial Sequence: Synthetic oligonucleotide
tggcctaggagaaagggccctctatgatc

SEQ ID NO: 278904 - DNA, 28 bp, Artificial Sequence
  Description of Artificial Sequence: Synthetic oligonucleotide
ggcctaggagaaagggccctctatgatc

SEQ ID NO: 278905 - DNA, 30 bp, Artificial Sequence
  Description of Artificial Sequence: Synthetic oligonucleotide
gcctaggagaaagggccctctatgatcttc

SEQ ID NO: 278906 - DNA, 33 bp, Artificial Sequence
  Description of Artificial Sequence: Synthetic oligonucleotide
cctaggagaaagggccctctatgatcttcattc

SEQ ID NO: 278907 - DNA, 35 bp, Artificial Sequence
  Description of Artificial Sequence: Synthetic oligonucleotide
ctaggagaaagggccctctatgatcttcattcatg

SEQ ID NO: 278908 - DNA, 36 bp, Artificial Sequence
  Description of Artificial Sequence: Synthetic oligonucleotide
taggagaaagggccctctatgatcttcattcatgag

SEQ ID NO: 278909 - DNA, 35 bp, Artificial Sequence
  Description of Artificial Sequence: Synthetic oligonucleotide
aggagaaagggccctctatgatcttcattcatgag

SEQ ID NO: 278910 - DNA, 34 bp, Artificial Sequence
  Description of Artificial Sequence: Synthetic oligonucleotide
ggagaaagggccctctatgatcttcattcatgag

SEQ ID NO: 278911 - DNA, 36 bp, Artificial Sequence
  Description of Artificial Sequence: Synthetic oligonucleotide
gagaaagggccctctatgatcttcattcatgagttg

SEQ ID NO: 278912 - DNA, 36 bp, Artificial Sequence
  Description of Artificial Sequence: Synthetic oligonucleotide
agaaagggccctctatgatcttcattcatgagttgg

SEQ ID NO: 278913 - DNA, 35 bp, Artificial Sequence
  Description of Artificial Sequence: Synthetic oligonucleotide
gaaagggccctctatgatcttcattcatgagttgg

SEQ ID NO: 278914 - DNA, 37 bp, Artificial Sequence
  Description of Artificial Sequence: Synthetic oligonucleotide
aaagggccctctatgatcttcattcatgagttggttg

SEQ ID NO: 278915 - DNA, 36 bp, Artificial Sequence
  Description of Artificial Sequence: Synthetic oligonucleotide
aagggccctctatgatcttcattcatgagttggttg

SEQ ID NO: 278916 - DNA, 35 bp, Artificial Sequence
  Description of Artificial Sequence: Synthetic oligonucleotide
agggccctctatgatcttcattcatgagttggttg

SEQ ID NO: 278917 - DNA, 34 bp, Artificial Sequence
  Description of Artificial Sequence: Synthetic oligonucleotide
gggccctctatgatcttcattcatgagttggttg

SEQ ID NO: 278918 - DNA, 34 bp, Artificial Sequence
  Description of Artificial Sequence: Synthetic oligonucleotide
ggccctctatgatcttcattcatgagttggttgc

SEQ ID NO: 278919 - DNA, 34 bp, Artificial Sequence
  Description of Artificial Sequence: Synthetic oligonucleotide
gccctctatgatcttcattcatgagttggttgcc

SEQ ID NO: 278920 - DNA, 36 bp, Artificial Sequence
  Description of Artificial Sequence: Synthetic oligonucleotide
ccctctatgatcttcattcatgagttggttgccatc

SEQ ID NO: 278921 - DNA, 36 bp, Artificial Sequence
  Description of Artificial Sequence: Synthetic oligonucleotide
cctctatgatcttcattcatgagttggttgccatcg

SEQ ID NO: 278922 - DNA, 36 bp, Artificial Sequence
  Description of Artificial Sequence: Synthetic oligonucleotide
ctctatgatcttcattcatgagttggttgccatcgg

SEQ ID NO: 278923 - DNA, 36 bp, Artificial Sequence
  Description of Artificial Sequence: Synthetic oligonucleotide
tctatgatcttcattcatgagttggttgccatcggg

SEQ ID NO: 278924 - DNA, 35 bp, Artificial Sequence
  Description of Artificial Sequence: Synthetic oligonucleotide
ctatgatcttcattcatgagttggttgccatcggg

SEQ ID NO: 278925 - DNA, 36 bp, Artificial Sequence
  Description of Artificial Sequence: Synthetic oligonucleotide
tatgatcttcattcatgagttggttgccatcgggac

SEQ ID NO: 278926 - DNA, 35 bp, Artificial Sequence
  Description of Artificial Sequence: Synthetic oligonucleotide
atgatcttcattcatgagttggttgccatcgggac

SEQ ID NO: 278927 - DNA, 34 bp, Artificial Sequence
  Description of Artificial Sequence: Synthetic oligonucleotide
tgatcttcattcatgagttggttgccatcgggac

SEQ ID NO: 278928 - DNA, 33 bp, Artificial Sequence
  Description of Artificial Sequence: Synthetic oligonucleotide
gatcttcattcatgagttggttgccatcgggac

SEQ ID NO: 278929 - DNA, 33 bp, Artificial Sequence
  Description of Artificial Sequence: Synthetic oligonucleotide
atcttcattcatgagttggttgccatcgggacc

SEQ ID NO: 278930 - DNA, 32 bp, Artificial Sequence
  Description of Artificial Sequence: Synthetic oligonucleotide
tcttcattcatgagttggttgccatcgggacc

SEQ ID NO: 278931 - DNA, 31 bp, Artificial Sequence
  Description of Artificial Sequence: Synthetic oligonucleotide
cttcattcatgagttggttgccatcgggacc

SEQ ID NO: 278932 - DNA, 33 bp, Artificial Sequence
  Description of Artificial Sequence: Synthetic oligonucleotide
ttcattcatgagttggttgccatcgggaccaag

SEQ ID NO: 278933 - DNA, 32 bp, Artificial Sequence
  Description of Artificial Sequence: Synthetic oligonucleotide
tcattcatgagttggttgccatcgggaccaag

SEQ ID NO: 278934 - DNA, 31 bp, Artificial Sequence
  Description of Artificial Sequence: Synthetic oligonucleotide
cattcatgagttggttgccatcgggaccaag

SEQ ID NO: 278935 - DNA, 31 bp, Artificial Sequence
  Description of Artificial Sequence: Synthetic oligonucleotide
attcatgagttggttgccatcgggaccaagc

SEQ ID NO: 278936 - DNA, 30 bp, Artificial Sequence
  Description of Artificial Sequence: Synthetic oligonucleotide
ttcatgagttggttgccatcgggaccaagc

SEQ ID NO: 278937 - DNA, 29 bp, Artificial Sequence
  Description of Artificial Sequence: Synthetic oligonucleotide
tcatgagttggttgccatcgggaccaagc

SEQ ID NO: 278938 - DNA, 28 bp, Artificial Sequence
  Description of Artificial Sequence: Synthetic oligonucleotide
catgagttggttgccatcgggaccaagc

SEQ ID NO: 278939 - DNA, 28 bp, Artificial Sequence
  Description of Artificial Sequence: Synthetic oligonucleotide
atgagttggttgccatcgggaccaagcg

SEQ ID NO: 278940 - DNA, 27 bp, Artificial Sequence
  Description of Artificial Sequence: Synthetic oligonucleotide
tgagttggttgccatcgggaccaagcg

SEQ ID NO: 278941 - DNA, 26 bp, Artificial Sequence
  Description of Artificial Sequence: Synthetic oligonucleotide
gagttggttgccatcgggaccaagcg

SEQ ID NO: 278942 - DNA, 27 bp, Artificial Sequence
  Description of Artificial Sequence: Synthetic oligonucleotide
agttggttgccatcgggaccaagcgca

SEQ ID NO: 278943 - DNA, 27 bp, Artificial Sequence
  Description of Artificial Sequence: Synthetic oligonucleotide
gttggttgccatcgggaccaagcgcat

SEQ ID NO: 278944 - DNA, 28 bp, Artificial Sequence
  Description of Artificial Sequence: Synthetic oligonucleotide
ttggttgccatcgggaccaagcgcattg

SEQ ID NO: 278945 - DNA, 27 bp, Artificial Sequence
  Description of Artificial Sequence: Synthetic oligonucleotide
tggttgccatcgggaccaagcgcattg

SEQ ID NO: 278946 - DNA, 27 bp, Artificial Sequence
  Description of Artificial Sequence: Synthetic oligonucleotide
ggttgccatcgggaccaagcgcattga

SEQ ID NO: 278947 - DNA, 27 bp, Artificial Sequence
  Description of Artificial Sequence: Synthetic oligonucleotide
gttgccatcgggaccaagcgcattgac

SEQ ID NO: 278948 - DNA, 28 bp, Artificial Sequence
  Description of Artificial Sequence: Synthetic oligonucleotide
ttgccatcgggaccaagcgcattgacag

SEQ ID NO: 278949 - DNA, 27 bp, Artificial Sequence
  Description of Artificial Sequence: Synthetic oligonucleotide
tgccatcgggaccaagcgcattgacag

SEQ ID NO: 278950 - DNA, 27 bp, Artificial Sequence
  Description of Artificial Sequence: Synthetic oligonucleotide
gccatcgggaccaagcgcattgacagt

SEQ ID NO: 278951 - DNA, 27 bp, Artificial Sequence
  Description of Artificial Sequence: Synthetic oligonucleotide
ccatcgggaccaagcgcattgacagtg

SEQ ID NO: 278952 - DNA, 28 bp, Artificial Sequence
  Description of Artificial Sequence: Synthetic oligonucleotide
catcgggaccaagcgcattgacagtgtg

SEQ ID NO: 278953 - DNA, 30 bp, Artificial Sequence
  Description of Artificial Sequence: Synthetic oligonucleotide
atcgggaccaagcgcattgacagtgtgaag

SEQ ID NO: 278954 - DNA, 29 bp, Artificial Sequence
  Description of Artificial Sequence: Synthetic oligonucleotide
tcgggaccaagcgcattgacagtgtgaag

SEQ ID NO: 278955 - DNA, 28 bp, Artificial Sequence
  Description of Artificial Sequence: Synthetic oligonucleotide
cgggaccaagcgcattgacagtgtgaag

SEQ ID NO: 278956 - DNA, 28 bp, Artificial Sequence
  Description of Artificial Sequence: Synthetic oligonucleotide
gggaccaagcgcattgacagtgtgaagg

SEQ ID NO: 278957 - DNA, 28 bp, Artificial Sequence
  Description of Artificial Sequence: Synthetic oligonucleotide
ggaccaagcgcattgacagtgtgaaggc

SEQ ID NO: 278958 - DNA, 29 bp, Artificial Sequence
  Description of Artificial Sequence: Synthetic oligonucleotide
gaccaagcgcattgacagtgtgaaggctg

SEQ ID NO: 278959 - DNA, 29 bp, Artificial Sequence
  Description of Artificial Sequence: Synthetic oligonucleotide
accaagcgcattgacagtgtgaaggctgg

SEQ ID NO: 278960 - DNA, 28 bp, Artificial Sequence
  Description of Artificial Sequence: Synthetic oligonucleotide
ccaagcgcattgacagtgtgaaggctgg

SEQ ID NO: 278961 - DNA, 28 bp, Artificial Sequence
  Description of Artificial Sequence: Synthetic oligonucleotide
caagcgcattgacagtgtgaaggctggc

SEQ ID NO: 278962 - DNA, 28 bp, Artificial Sequence
  Description of Artificial Sequence: Synthetic oligonucleotide
aagcgcattgacagtgtgaaggctggcg

SEQ ID NO: 278963 - DNA, 27 bp, Artificial Sequence
  Description of Artificial Sequence: Synthetic oligonucleotide
agcgcattgacagtgtgaaggctggcg

SEQ ID NO: 278964 - DNA, 27 bp, Artificial Sequence
  Description of Artificial Sequence: Synthetic oligonucleotide
gcgcattgacagtgtgaaggctggcga

SEQ ID NO: 278965 - DNA, 27 bp, Artificial Sequence
  Description of Artificial Sequence: Synthetic oligonucleotide
cgcattgacagtgtgaaggctggcgac

SEQ ID NO: 278966 - DNA, 27 bp, Artificial Sequence
  Description of Artificial Sequence: Synthetic oligonucleotide
gcattgacagtgtgaaggctggcgacc

SEQ ID NO: 278967 - DNA, 27 bp, Artificial Sequence
  Description of Artificial Sequence: Synthetic oligonucleotide
cattgacagtgtgaaggctggcgaccg

SEQ ID NO: 278968 - DNA, 27 bp, Artificial Sequence
  Description of Artificial Sequence: Synthetic oligonucleotide
attgacagtgtgaaggctggcgaccgg

SEQ ID NO: 278969 - DNA, 26 bp, Artificial Sequence
  Description of Artificial Sequence: Synthetic oligonucleotide
ttgacagtgtgaaggctggcgaccgg

SEQ ID NO: 278970 - DNA, 25 bp, Artificial Sequence
  Description of Artificial Sequence: Synthetic oligonucleotide
tgacagtgtgaaggctggcgaccgg

SEQ ID NO: 278971 - DNA, 24 bp, Artificial Sequence
  Description of Artificial Sequence: Synthetic oligonucleotide
gacagtgtgaaggctggcgaccgg

SEQ ID NO: 278972 - DNA, 25 bp, Artificial Sequence
  Description of Artificial Sequence: Synthetic oligonucleotide
acagtgtgaaggctggcgaccggga

SEQ ID NO: 278973 - DNA, 24 bp, Artificial Sequence
  Description of Artificial Sequence: Synthetic oligonucleotide
cagtgtgaaggctggcgaccggga

SEQ ID NO: 278974 - DNA, 24 bp, Artificial Sequence
  Description of Artificial Sequence: Synthetic oligonucleotide
agtgtgaaggctggcgaccgggag

SEQ ID NO: 278975 - DNA, 23 bp, Artificial Sequence
  Description of Artificial Sequence: Synthetic oligonucleotide
gtgtgaaggctggcgaccgggag

SEQ ID NO: 278976 - DNA, 24 bp, Artificial Sequence
  Description of Artificial Sequence: Synthetic oligonucleotide
tgtgaaggctggcgaccgggagct

SEQ ID NO: 278977 - DNA, 23 bp, Artificial Sequence
  Description of Artificial Sequence: Synthetic oligonucleotide
gtgaaggctggcgaccgggagct

SEQ ID NO: 278978 - DNA, 23 bp, Artificial Sequence
  Description of Artificial Sequence: Synthetic oligonucleotide
tgaaggctggcgaccgggagctg

SEQ ID NO: 278979 - DNA, 22 bp, Artificial Sequence
  Description of Artificial Sequence: Synthetic oligonucleotide
gaaggctggcgaccgggagctg

SEQ ID NO: 278980 - DNA, 23 bp, Artificial Sequence
  Description of Artificial Sequence: Synthetic oligonucleotide
aaggctggcgaccgggagctgca

SEQ ID NO: 278981 - DNA, 22 bp, Artificial Sequence
  Description of Artificial Sequence: Synthetic oligonucleotide
aggctggcgaccgggagctgca

SEQ ID NO: 278982 - DNA, 21 bp, Artificial Sequence
  Description of Artificial Sequence: Synthetic oligonucleotide
ggctggcgaccgggagctgca

SEQ ID NO: 278983 - DNA, 22 bp, Artificial Sequence
  Description of Artificial Sequence: Synthetic oligonucleotide
gctggcgaccgggagctgcaga

SEQ ID NO: 278984 - DNA, 22 bp, Artificial Sequence
  Description of Artificial Sequence: Synthetic oligonucleotide
ctggcgaccgggagctgcagag

SEQ ID NO: 278985 - DNA, 23 bp, Artificial Sequence
  Description of Artificial Sequence: Synthetic oligonucleotide
tggcgaccgggagctgcagagga

SEQ ID NO: 278986 - DNA, 22 bp, Artificial Sequence
  Description of Artificial Sequence: Synthetic oligonucleotide
ggcgaccgggagctgcagagga

SEQ ID NO: 278987 - DNA, 25 bp, Artificial Sequence
  Description of Artificial Sequence: Synthetic oligonucleotide
gcgaccgggagctgcagaggagaat

SEQ ID NO: 278988 - DNA, 25 bp, Artificial Sequence
  Description of Artificial Sequence: Synthetic oligonucleotide
cgaccgggagctgcagaggagaatg

SEQ ID NO: 278989 - DNA, 26 bp, Artificial Sequence
  Description of Artificial Sequence: Synthetic oligonucleotide
gaccgggagctgcagaggagaatgct

SEQ ID NO: 278990 - DNA, 26 bp, Artificial Sequence
  Description of Artificial Sequence: Synthetic oligonucleotide
accgggagctgcagaggagaatgctg

SEQ ID NO: 278991 - DNA, 25 bp, Artificial Sequence
  Description of Artificial Sequence: Synthetic oligonucleotide
ccgggagctgcagaggagaatgctg

SEQ ID NO: 278992 - DNA, 26 bp, Artificial Sequence
  Description of Artificial Sequence: Synthetic oligonucleotide
cgggagctgcagaggagaatgctgga

SEQ ID NO: 278993 - DNA, 26 bp, Artificial Sequence
  Description of Artificial Sequence: Synthetic oligonucleotide
gggagctgcagaggagaatgctggac

SEQ ID NO: 278994 - DNA, 27 bp, Artificial Sequence
  Description of Artificial Sequence: Synthetic oligonucleotide
ggagctgcagaggagaatgctggacct

SEQ ID NO: 278995 - DNA, 28 bp, Artificial Sequence
  Description of Artificial Sequence: Synthetic oligonucleotide
gagctgcagaggagaatgctggaccttc

SEQ ID NO: 278996 - DNA, 29 bp, Artificial Sequence
  Description of Artificial Sequence: Synthetic oligonucleotide
agctgcagaggagaatgctggaccttctg

SEQ ID NO: 278997 - DNA, 28 bp, Artificial Sequence
  Description of Artificial Sequence: Synthetic oligonucleotide
gctgcagaggagaatgctggaccttctg

SEQ ID NO: 278998 - DNA, 30 bp, Artificial Sequence
  Description of Artificial Sequence: Synthetic oligonucleotide
ctgcagaggagaatgctggaccttctgaac

SEQ ID NO: 278999 - DNA, 30 bp, Artificial Sequence
  Description of Artificial Sequence: Synthetic oligonucleotide
tgcagaggagaatgctggaccttctgaacg

SEQ ID NO: 279000 - DNA, 29 bp, Artificial Sequence
  Description of Artificial Sequence: Synthetic oligonucleotide
gcagaggagaatgctggaccttctgaacg

SEQ ID NO: 279001 - DNA, 30 bp, Artificial Sequence
  Description of Artificial Sequence: Synthetic oligonucleotide
cagaggagaatgctggaccttctgaacgag

SEQ ID NO: 279002 - DNA, 30 bp, Artificial Sequence
  Description of Artificial Sequence: Synthetic oligonucleotide
agaggagaatgctggaccttctgaacgagc

SEQ ID NO: 279003 - DNA, 29 bp, Artificial Sequence
  Description of Artificial Sequence: Synthetic oligonucleotide
gaggagaatgctggaccttctgaacgagc

SEQ ID NO: 279004 - DNA, 30 bp, Artificial Sequence
  Description of Artificial Sequence: Synthetic oligonucleotide
aggagaatgctggaccttctgaacgagctg

SEQ ID NO: 279005 - DNA, 29 bp, Artificial Sequence
  Description of Artificial Sequence: Synthetic oligonucleotide
ggagaatgctggaccttctgaacgagctg

SEQ ID NO: 279006 - DNA, 29 bp, Artificial Sequence
  Description of Artificial Sequence: Synthetic oligonucleotide
gagaatgctggaccttctgaacgagctgg

SEQ ID NO: 279007 - DNA, 31 bp, Artificial Sequence
  Description of Artificial Sequence: Synthetic oligonucleotide
agaatgctggaccttctgaacgagctggatg

SEQ ID NO: 279008 - DNA, 30 bp, Artificial Sequence
  Description of Artificial Sequence: Synthetic oligonucleotide
gaatgctggaccttctgaacgagctggatg

SEQ ID NO: 279009 - DNA, 30 bp, Artificial Sequence
  Description of Artificial Sequence: Synthetic oligonucleotide
aatgctggaccttctgaacgagctggatgc

SEQ ID NO: 279010 - DNA, 29 bp, Artificial Sequence
  Description of Artificial Sequence: Synthetic oligonucleotide
atgctggaccttctgaacgagctggatgc

SEQ ID NO: 279011 - DNA, 28 bp, Artificial Sequence
  Description of Artificial Sequence: Synthetic oligonucleotide
tgctggaccttctgaacgagctggatgc

SEQ ID NO: 279012 - DNA, 27 bp, Artificial Sequence
  Description of Artificial Sequence: Synthetic oligonucleotide
gctggaccttctgaacgagctggatgc

SEQ ID NO: 279013 - DNA, 27 bp, Artificial Sequence
  Description of Artificial Sequence: Synthetic oligonucleotide
ctggaccttctgaacgagctggatgcc

SEQ ID NO: 279014 - DNA, 29 bp, Artificial Sequence
  Description of Artificial Sequence: Synthetic oligonucleotide
tggaccttctgaacgagctggatgccttc

SEQ ID NO: 279015 - DNA, 28 bp, Artificial Sequence
  Description of Artificial Sequence: Synthetic oligonucleotide
ggaccttctgaacgagctggatgccttc

SEQ ID NO: 279016 - DNA, 28 bp, Artificial Sequence
  Description of Artificial Sequence: Synthetic oligonucleotide
gaccttctgaacgagctggatgccttcc

SEQ ID NO: 279017 - DNA, 29 bp, Artificial Sequence
  Description of Artificial Sequence: Synthetic oligonucleotide
accttctgaacgagctggatgccttccag

SEQ ID NO: 279018 - DNA, 28 bp, Artificial Sequence
  Description of Artificial Sequence: Synthetic oligonucleotide
ccttctgaacgagctggatgccttccag

SEQ ID NO: 279019 - DNA, 28 bp, Artificial Sequence
  Description of Artificial Sequence: Synthetic oligonucleotide
cttctgaacgagctggatgccttccagc

SEQ ID NO: 279020 - DNA, 28 bp, Artificial Sequence
  Description of Artificial Sequence: Synthetic oligonucleotide
ttctgaacgagctggatgccttccagcc

SEQ ID NO: 279021 - DNA, 27 bp, Artificial Sequence
  Description of Artificial Sequence: Synthetic oligonucleotide
tctgaacgagctggatgccttccagcc

SEQ ID NO: 279022 - DNA, 26 bp, Artificial Sequence
  Description of Artificial Sequence: Synthetic oligonucleotide
ctgaacgagctggatgccttccagcc

SEQ ID NO: 279023 - DNA, 27 bp, Artificial Sequence
  Description of Artificial Sequence: Synthetic oligonucleotide
tgaacgagctggatgccttccagccga

SEQ ID NO: 279024 - DNA, 27 bp, Artificial Sequence
  Description of Artificial Sequence: Synthetic oligonucleotide
gaacgagctggatgccttccagccgaa

SEQ ID NO: 279025 - DNA, 27 bp, Artificial Sequence
  Description of Artificial Sequence: Synthetic oligonucleotide
aacgagctggatgccttccagccgaac

SEQ ID NO: 279026 - DNA, 27 bp, Artificial Sequence
  Description of Artificial Sequence: Synthetic oligonucleotide
acgagctggatgccttccagccgaaca

SEQ ID NO: 279027 - DNA, 26 bp, Artificial Sequence
  Description of Artificial Sequence: Synthetic oligonucleotide
cgagctggatgccttccagccgaaca

SEQ ID NO: 279028 - DNA, 26 bp, Artificial Sequence
  Description of Artificial Sequence: Synthetic oligonucleotide
gagctggatgccttccagccgaacac

SEQ ID NO: 279029 - DNA, 26 bp, Artificial Sequence
  Description of Artificial Sequence: Synthetic oligonucleotide
agctggatgccttccagccgaacacc

SEQ ID NO: 279030 - DNA, 25 bp, Artificial Sequence
  Description of Artificial Sequence: Synthetic oligonucleotide
gctggatgccttccagccgaacacc

SEQ ID NO: 279031 - DNA, 27 bp, Artificial Sequence
  Description of Artificial Sequence: Synthetic oligonucleotide
ctggatgccttccagccgaacacccaa

SEQ ID NO: 279032 - DNA, 27 bp, Artificial Sequence
  Description of Artificial Sequence: Synthetic oligonucleotide
tggatgccttccagccgaacacccaac

SEQ ID NO: 279033 - DNA, 27 bp, Artificial Sequence
  Description of Artificial Sequence: Synthetic oligonucleotide
ggatgccttccagccgaacacccaact

SEQ ID NO: 279034 - DNA, 30 bp, Artificial Sequence
  Description of Artificial Sequence: Synthetic oligonucleotide
gatgccttccagccgaacacccaacttaag

SEQ ID NO: 279035 - DNA, 30 bp, Artificial Sequence
  Description of Artificial Sequence: Synthetic oligonucleotide
atgccttccagccgaacacccaacttaagg

SEQ ID NO: 279036 - DNA, 29 bp, Artificial Sequence
  Description of Artificial Sequence: Synthetic oligonucleotide
tgccttccagccgaacacccaacttaagg

SEQ ID NO: 279037 - DNA, 28 bp, Artificial Sequence
  Description of Artificial Sequence: Synthetic oligonucleotide
gccttccagccgaacacccaacttaagg

SEQ ID NO: 279038 - DNA, 33 bp, Artificial Sequence
  Description of Artificial Sequence: Synthetic oligonucleotide
ccttccagccgaacacccaacttaaggtaaatg

SEQ ID NO: 279039 - DNA, 33 bp, Artificial Sequence
  Description of Artificial Sequence: Synthetic oligonucleotide
cttccagccgaacacccaacttaaggtaaatgc

SEQ ID NO: 279040 - DNA, 34 bp, Artificial Sequence
  Description of Artificial Sequence: Synthetic oligonucleotide
ttccagccgaacacccaacttaaggtaaatgcag

SEQ ID NO: 279041 - DNA, 33 bp, Artificial Sequence
  Description of Artificial Sequence: Synthetic oligonucleotide
tccagccgaacacccaacttaaggtaaatgcag

SEQ ID NO: 279042 - DNA, 32 bp, Artificial Sequence
  Description of Artificial Sequence: Synthetic oligonucleotide
ccagccgaacacccaacttaaggtaaatgcag

SEQ ID NO: 279043 - DNA, 32 bp, Artificial Sequence
  Description of Artificial Sequence: Synthetic oligonucleotide
cagccgaacacccaacttaaggtaaatgcagc

SEQ ID NO: 279044 - DNA, 32 bp, Artificial Sequence
  Description of Artificial Sequence: Synthetic oligonucleotide
agccgaacacccaacttaaggtaaatgcagcc

SEQ ID NO: 279045 - DNA, 31 bp, Artificial Sequence
  Description of Artificial Sequence: Synthetic oligonucleotide
gccgaacacccaacttaaggtaaatgcagcc

SEQ ID NO: 279046 - DNA, 32 bp, Artificial Sequence
  Description of Artificial Sequence: Synthetic oligonucleotide
ccgaacacccaacttaaggtaaatgcagccac

SEQ ID NO: 279047 - DNA, 35 bp, Artificial Sequence
  Description of Artificial Sequence: Synthetic oligonucleotide
cgaacacccaacttaaggtaaatgcagccactaac

SEQ ID NO: 279048 - DNA, 36 bp, Artificial Sequence
  Description of Artificial Sequence: Synthetic oligonucleotide
gaacacccaacttaaggtaaatgcagccactaacag

SEQ ID NO: 279049 - DNA, 36 bp, Artificial Sequence
  Description of Artificial Sequence: Synthetic oligonucleotide
aacacccaacttaaggtaaatgcagccactaacagg

SEQ ID NO: 279050 - DNA, 35 bp, Artificial Sequence
  Description of Artificial Sequence: Synthetic oligonucleotide
acacccaacttaaggtaaatgcagccactaacagg

SEQ ID NO: 279051 - DNA, 34 bp, Artificial Sequence
  Description of Artificial Sequence: Synthetic oligonucleotide
cacccaacttaaggtaaatgcagccactaacagg

SEQ ID NO: 279052 - DNA, 34 bp, Artificial Sequence
  Description of Artificial Sequence: Synthetic oligonucleotide
acccaacttaaggtaaatgcagccactaacaggg

SEQ ID NO: 279053 - DNA, 33 bp, Artificial Sequence
  Description of Artificial Sequence: Synthetic oligonucleotide
cccaacttaaggtaaatgcagccactaacaggg

SEQ ID NO: 279054 - DNA, 34 bp, Artificial Sequence
  Description of Artificial Sequence: Synthetic oligonucleotide
ccaacttaaggtaaatgcagccactaacagggtg

SEQ ID NO: 279055 - DNA, 34 bp, Artificial Sequence
  Description of Artificial Sequence: Synthetic oligonucleotide
caacttaaggtaaatgcagccactaacagggtgc

SEQ ID NO: 279056 - DNA, 35 bp, Artificial Sequence
  Description of Artificial Sequence: Synthetic oligonucleotide
aacttaaggtaaatgcagccactaacagggtgcac

SEQ ID NO: 279057 - DNA, 34 bp, Artificial Sequence
  Description of Artificial Sequence: Synthetic oligonucleotide
acttaaggtaaatgcagccactaacagggtgcac

SEQ ID NO: 279058 - DNA, 33 bp, Artificial Sequence
  Description of Artificial Sequence: Synthetic oligonucleotide
cttaaggtaaatgcagccactaacagggtgcac

SEQ ID NO: 279059 - DNA, 35 bp, Artificial Sequence
  Description of Artificial Sequence: Synthetic oligonucleotide
ttaaggtaaatgcagccactaacagggtgcacatc

SEQ ID NO: 279060 - DNA, 34 bp, Artificial Sequence
  Description of Artificial Sequence: Synthetic oligonucleotide
taaggtaaatgcagccactaacagggtgcacatc

SEQ ID NO: 279061 - DNA, 33 bp, Artificial Sequence
  Description of Artificial Sequence: Synthetic oligonucleotide
aaggtaaatgcagccactaacagggtgcacatc

SEQ ID NO: 279062 - DNA, 32 bp, Artificial Sequence
  Description of Artificial Sequence: Synthetic oligonucleotide
aggtaaatgcagccactaacagggtgcacatc

SEQ ID NO: 279063 - DNA, 31 bp, Artificial Sequence
  Description of Artificial Sequence: Synthetic oligonucleotide
ggtaaatgcagccactaacagggtgcacatc

SEQ ID NO: 279064 - DNA, 31 bp, Artificial Sequence
  Description of Artificial Sequence: Synthetic oligonucleotide
gtaaatgcagccactaacagggtgcacatcc

SEQ ID NO: 279065 - DNA, 32 bp, Artificial Sequence
  Description of Artificial Sequence: Synthetic oligonucleotide
taaatgcagccactaacagggtgcacatcctg

SEQ ID NO: 279066 - DNA, 31 bp, Artificial Sequence
  Description of Artificial Sequence: Synthetic oligonucleotide
aaatgcagccactaacagggtgcacatcctg

SEQ ID NO: 279067 - DNA, 30 bp, Artificial Sequence
  Description of Artificial Sequence: Synthetic oligonucleotide
aatgcagccactaacagggtgcacatcctg

SEQ ID NO: 279068 - DNA, 29 bp, Artificial Sequence
  Description of Artificial Sequence: Synthetic oligonucleotide
atgcagccactaacagggtgcacatcctg

SEQ ID NO: 279069 - DNA, 28 bp, Artificial Sequence
  Description of Artificial Sequence: Synthetic oligonucleotide
tgcagccactaacagggtgcacatcctg

SEQ ID NO: 279070 - DNA, 27 bp, Artificial Sequence
  Description of Artificial Sequence: Synthetic oligonucleotide
gcagccactaacagggtgcacatcctg

SEQ ID NO: 279071 - DNA, 27 bp, Artificial Sequence
  Description of Artificial Sequence: Synthetic oligonucleotide
cagccactaacagggtgcacatcctgg

SEQ ID NO: 279072 - DNA, 28 bp, Artificial Sequence
  Description of Artificial Sequence: Synthetic oligonucleotide
agccactaacagggtgcacatcctggtc

SEQ ID NO: 279073 - DNA, 27 bp, Artificial Sequence
  Description of Artificial Sequence: Synthetic oligonucleotide
gccactaacagggtgcacatcctggtc

SEQ ID NO: 279074 - DNA, 27 bp, Artificial Sequence
  Description of Artificial Sequence: Synthetic oligonucleotide
ccactaacagggtgcacatcctggtcc

SEQ ID NO: 279075 - DNA, 27 bp, Artificial Sequence
  Description of Artificial Sequence: Synthetic oligonucleotide
cactaacagggtgcacatcctggtccc

SEQ ID NO: 279076 - DNA, 27 bp, Artificial Sequence
  Description of Artificial Sequence: Synthetic oligonucleotide
actaacagggtgcacatcctggtcccc

SEQ ID NO: 279077 - DNA, 26 bp, Artificial Sequence
  Description of Artificial Sequence: Synthetic oligonucleotide
ctaacagggtgcacatcctggtcccc

SEQ ID NO: 279078 - DNA, 26 bp, Artificial Sequence
  Description of Artificial Sequence: Synthetic oligonucleotide
taacagggtgcacatcctggtccccg

SEQ ID NO: 279079 - DNA, 25 bp, Artificial Sequence
  Description of Artificial Sequence: Synthetic oligonucleotide
aacagggtgcacatcctggtccccg

SEQ ID NO: 279080 - DNA, 24 bp, Artificial Sequence
  Description of Artificial Sequence: Synthetic oligonucleotide
acagggtgcacatcctggtccccg

SEQ ID NO: 279081 - DNA, 23 bp, Artificial Sequence
  Description of Artificial Sequence: Synthetic oligonucleotide
cagggtgcacatcctggtccccg

SEQ ID NO: 279082 - DNA, 23 bp, Artificial Sequence
  Description of Artificial Sequence: Synthetic oligonucleotide
agggtgcacatcctggtccccgc

SEQ ID NO: 279083 - DNA, 22 bp, Artificial Sequence
  Description of Artificial Sequence: Synthetic oligonucleotide
gggtgcacatcctggtccccgc

SEQ ID NO: 279084 - DNA, 22 bp, Artificial Sequence
  Description of Artificial Sequence: Synthetic oligonucleotide
ggtgcacatcctggtccccgcc

SEQ ID NO: 279085 - DNA, 23 bp, Artificial Sequence
  Description of Artificial Sequence: Synthetic oligonucleotide
gtgcacatcctggtccccgccct

SEQ ID NO: 279086 - DNA, 23 bp, Artificial Sequence
  Description of Artificial Sequence: Synthetic oligonucleotide
tgcacatcctggtccccgccctg

SEQ ID NO: 279087 - DNA, 22 bp, Artificial Sequence
  Description of Artificial Sequence: Synthetic oligonucleotide
gcacatcctggtccccgccctg

SEQ ID NO: 279088 - DNA, 23 bp, Artificial Sequence
  Description of Artificial Sequence: Synthetic oligonucleotide
cacatcctggtccccgccctgct

SEQ ID NO: 279089 - DNA, 23 bp, Artificial Sequence
  Description of Artificial Sequence: Synthetic oligonucleotide
acatcctggtccccgccctgctc

SEQ ID NO: 279090 - DNA, 22 bp, Artificial Sequence
  Description of Artificial Sequence: Synthetic oligonucleotide
catcctggtccccgccctgctc

SEQ ID NO: 279091 - DNA, 22 bp, Artificial Sequence
  Description of Artificial Sequence: Synthetic oligonucleotide
atcctggtccccgccctgctcc

SEQ ID NO: 279092 - DNA, 21 bp, Artificial Sequence
  Description of Artificial Sequence: Synthetic oligonucleotide
tcctggtccccgccctgctcc

SEQ ID NO: 279093 - DNA, 20 bp, Artificial Sequence
  Description of Artificial Sequence: Synthetic oligonucleotide
cctggtccccgccctgctcc

SEQ ID NO: 279094 - DNA, 20 bp, Artificial Sequence
  Description of Artificial Sequence: Synthetic oligonucleotide
ctggtccccgccctgctccg

SEQ ID NO: 279095 - DNA, 21 bp, Artificial Sequence
  Description of Artificial Sequence: Synthetic oligonucleotide
tggtccccgccctgctccgct

SEQ ID NO: 279096 - DNA, 20 bp, Artificial Sequence
  Description of Artificial Sequence: Synthetic oligonucleotide
ggtccccgccctgctccgct

SEQ ID NO: 279097 - DNA, 20 bp, Artificial Sequence
  Description of Artificial Sequence: Synthetic oligonucleotide
gtccccgccctgctccgctc

SEQ ID NO: 279098 - DNA, 20 bp, Artificial Sequence
  Description of Artificial Sequence: Synthetic oligonucleotide
tccccgccctgctccgctcg

SEQ ID NO: 279099 - DNA, 20 bp, Artificial Sequence
  Description of Artificial Sequence: Synthetic oligonucleotide
ccccgccctgctccgctcgt

SEQ ID NO: 279100 - DNA, 20 bp, Artificial Sequence
  Description of Artificial Sequence: Synthetic oligonucleotide
cccgccctgctccgctcgct

SEQ ID NO: 279101 - DNA, 20 bp, Artificial Sequence
  Description of Artificial Sequence: Synthetic oligonucleotide
ccgccctgctccgctcgcgt

SEQ ID NO: 279102 - DNA, 20 bp, Artificial Sequence
  Description of Artificial Sequence: Synthetic oligonucleotide
cgccctgctccgctcgcgct

SEQ ID NO: 279103 - DNA, 20 bp, Artificial Sequence
  Description of Artificial Sequence: Synthetic oligonucleotide
gccctgctccgctcgcgcct

SEQ ID NO: 279104 - DNA, 20 bp, Artificial Sequence
  Description of Artificial Sequence: Synthetic oligonucleotide
ccctgctccgctcgcgccgt

SEQ ID NO: 279105 - DNA, 20 bp, Artificial Sequence
  Description of Artificial Sequence: Synthetic oligonucleotide
cctgctccgctcgcgccgct

SEQ ID NO: 279106 - DNA, 21 bp, Artificial Sequence
  Description of Artificial Sequence: Synthetic oligonucleotide
ctgctccgctcgcgccgcctt

SEQ ID NO: 279107 - DNA, 22 bp, Artificial Sequence
  Description of Artificial Sequence: Synthetic oligonucleotide
tgctccgctcgcgccgccttgt

SEQ ID NO: 279108 - DNA, 21 bp, Artificial Sequence
  Description of Artificial Sequence: Synthetic oligonucleotide
gctccgctcgcgccgccttgt

SEQ ID NO: 279109 - DNA, 21 bp, Artificial Sequence
  Description of Artificial Sequence: Synthetic oligonucleotide
ctccgctcgcgccgccttgtc

SEQ ID NO: 279110 - DNA, 21 bp, Artificial Sequence
  Description of Artificial Sequence: Synthetic oligonucleotide
tccgctcgcgccgccttgtcc

SEQ ID NO: 279111 - DNA, 20 bp, Artificial Sequence
  Description of Artificial Sequence: Synthetic oligonucleotide
ccgctcgcgccgccttgtcc

SEQ ID NO: 279112 - DNA, 20 bp, Artificial Sequence
  Description of Artificial Sequence: Synthetic oligonucleotide
cgctcgcgccgccttgtccg

SEQ ID NO: 279113 - DNA, 22 bp, Artificial Sequence
  Description of Artificial Sequence: Synthetic oligonucleotide
gctcgcgccgccttgtccgcaa

SEQ ID NO: 279114 - DNA, 25 bp, Artificial Sequence
  Description of Artificial Sequence: Synthetic oligonucleotide
ctcgcgccgccttgtccgcaagatt

SEQ ID NO: 279115 - DNA, 26 bp, Artificial Sequence
  Description of Artificial Sequence: Synthetic oligonucleotide
tcgcgccgccttgtccgcaagattga

SEQ ID NO: 279116 - DNA, 25 bp, Artificial Sequence
  Description of Artificial Sequence: Synthetic oligonucleotide
cgcgccgccttgtccgcaagattga

SEQ ID NO: 279117 - DNA, 27 bp, Artificial Sequence
  Description of Artificial Sequence: Synthetic oligonucleotide
gcgccgccttgtccgcaagattgagtt

SEQ ID NO: 279118 - DNA, 27 bp, Artificial Sequence
  Description of Artificial Sequence: Synthetic oligonucleotide
cgccgccttgtccgcaagattgagttc

SEQ ID NO: 279119 - DNA, 27 bp, Artificial Sequence
  Description of Artificial Sequence: Synthetic oligonucleotide
gccgccttgtccgcaagattgagttcc

SEQ ID NO: 279120 - DNA, 27 bp, Artificial Sequence
  Description of Artificial Sequence: Synthetic oligonucleotide
ccgccttgtccgcaagattgagttccc

SEQ ID NO: 279121 - DNA, 27 bp, Artificial Sequence
  Description of Artificial Sequence: Synthetic oligonucleotide
cgccttgtccgcaagattgagttcccg

SEQ ID NO: 279122 - DNA, 29 bp, Artificial Sequence
  Description of Artificial Sequence: Synthetic oligonucleotide
gccttgtccgcaagattgagttcccgttg

SEQ ID NO: 279123 - DNA, 29 bp, Artificial Sequence
  Description of Artificial Sequence: Synthetic oligonucleotide
ccttgtccgcaagattgagttcccgttgc

SEQ ID NO: 279124 - DNA, 29 bp, Artificial Sequence
  Description of Artificial Sequence: Synthetic oligonucleotide
cttgtccgcaagattgagttcccgttgcc

SEQ ID NO: 279125 - DNA, 29 bp, Artificial Sequence
  Description of Artificial Sequence: Synthetic oligonucleotide
ttgtccgcaagattgagttcccgttgccc

SEQ ID NO: 279126 - DNA, 28 bp, Artificial Sequence
  Description of Artificial Sequence: Synthetic oligonucleotide
tgtccgcaagattgagttcccgttgccc

SEQ ID NO: 279127 - DNA, 27 bp, Artificial Sequence
  Description of Artificial Sequence: Synthetic oligonucleotide
gtccgcaagattgagttcccgttgccc

SEQ ID NO: 279128 - DNA, 30 bp, Artificial Sequence
  Description of Artificial Sequence: Synthetic oligonucleotide
tccgcaagattgagttcccgttgcccaatg

SEQ ID NO: 279129 - DNA, 29 bp, Artificial Sequence
  Description of Artificial Sequence: Synthetic oligonucleotide
ccgcaagattgagttcccgttgcccaatg

SEQ ID NO: 279130 - DNA, 30 bp, Artificial Sequence
  Description of Artificial Sequence: Synthetic oligonucleotide
cgcaagattgagttcccgttgcccaatgtg

SEQ ID NO: 279131 - DNA, 30 bp, Artificial Sequence
  Description of Artificial Sequence: Synthetic oligonucleotide
gcaagattgagttcccgttgcccaatgtgg

SEQ ID NO: 279132 - DNA, 31 bp, Artificial Sequence
  Description of Artificial Sequence: Synthetic oligonucleotide
caagattgagttcccgttgcccaatgtggag

SEQ ID NO: 279133 - DNA, 31 bp, Artificial Sequence
  Description of Artificial Sequence: Synthetic oligonucleotide
aagattgagttcccgttgcccaatgtggagg

SEQ ID NO: 279134 - DNA, 30 bp, Artificial Sequence
  Description of Artificial Sequence: Synthetic oligonucleotide
agattgagttcccgttgcccaatgtggagg

SEQ ID NO: 279135 - DNA, 29 bp, Artificial Sequence
  Description of Artificial Sequence: Synthetic oligonucleotide
gattgagttcccgttgcccaatgtggagg

SEQ ID NO: 279136 - DNA, 29 bp, Artificial Sequence
  Description of Artificial Sequence: Synthetic oligonucleotide
attgagttcccgttgcccaatgtggaggc

SEQ ID NO: 279137 - DNA, 28 bp, Artificial Sequence
  Description of Artificial Sequence: Synthetic oligonucleotide
ttgagttcccgttgcccaatgtggaggc

SEQ ID NO: 279138 - DNA, 27 bp, Artificial Sequence
  Description of Artificial Sequence: Synthetic oligonucleotide
tgagttcccgttgcccaatgtggaggc

SEQ ID NO: 279139 - DNA, 26 bp, Artificial Sequence
  Description of Artificial Sequence: Synthetic oligonucleotide
gagttcccgttgcccaatgtggaggc

SEQ ID NO: 279140 - DNA, 26 bp, Artificial Sequence
  Description of Artificial Sequence: Synthetic oligonucleotide
agttcccgttgcccaatgtggaggcc

SEQ ID NO: 279141 - DNA, 25 bp, Artificial Sequence
  Description of Artificial Sequence: Synthetic oligonucleotide
gttcccgttgcccaatgtggaggcc

SEQ ID NO: 279142 - DNA, 25 bp, Artificial Sequence
  Description of Artificial Sequence: Synthetic oligonucleotide
ttcccgttgcccaatgtggaggccc

SEQ ID NO: 279143 - DNA, 24 bp, Artificial Sequence
  Description of Artificial Sequence: Synthetic oligonucleotide
tcccgttgcccaatgtggaggccc

SEQ ID NO: 279144 - DNA, 23 bp, Artificial Sequence
  Description of Artificial Sequence: Synthetic oligonucleotide
cccgttgcccaatgtggaggccc

SEQ ID NO: 279145 - DNA, 23 bp, Artificial Sequence
  Description of Artificial Sequence: Synthetic oligonucleotide
ccgttgcccaatgtggaggcccg

SEQ ID NO: 279146 - DNA, 23 bp, Artificial Sequence
  Description of Artificial Sequence: Synthetic oligonucleotide
cgttgcccaatgtggaggcccgc

SEQ ID NO: 279147 - DNA, 23 bp, Artificial Sequence
  Description of Artificial Sequence: Synthetic oligonucleotide
gttgcccaatgtggaggcccgcg

SEQ ID NO: 279148 - DNA, 23 bp, Artificial Sequence
  Description of Artificial Sequence: Synthetic oligonucleotide
ttgcccaatgtggaggcccgcgc

SEQ ID NO: 279149 - DNA, 22 bp, Artificial Sequence
  Description of Artificial Sequence: Synthetic oligonucleotide
tgcccaatgtggaggcccgcgc

SEQ ID NO: 279150 - DNA, 21 bp, Artificial Sequence
  Description of Artificial Sequence: Synthetic oligonucleotide
gcccaatgtggaggcccgcgc

SEQ ID NO: 279151 - DNA, 22 bp, Artificial Sequence
  Description of Artificial Sequence: Synthetic oligonucleotide
cccaatgtggaggcccgcgcca

SEQ ID NO: 279152 - DNA, 25 bp, Artificial Sequence
  Description of Artificial Sequence: Synthetic oligonucleotide
ccaatgtggaggcccgcgccagaat

SEQ ID NO: 279153 - DNA, 27 bp, Artificial Sequence
  Description of Artificial Sequence: Synthetic oligonucleotide
caatgtggaggcccgcgccagaatctt

SEQ ID NO: 279154 - DNA, 27 bp, Artificial Sequence
  Description of Artificial Sequence: Synthetic oligonucleotide
aatgtggaggcccgcgccagaatcttg

SEQ ID NO: 279155 - DNA, 26 bp, Artificial Sequence
  Description of Artificial Sequence: Synthetic oligonucleotide
atgtggaggcccgcgccagaatcttg

SEQ ID NO: 279156 - DNA, 25 bp, Artificial Sequence
  Description of Artificial Sequence: Synthetic oligonucleotide
tgtggaggcccgcgccagaatcttg

SEQ ID NO: 279157 - DNA, 24 bp, Artificial Sequence
  Description of Artificial Sequence: Synthetic oligonucleotide
gtggaggcccgcgccagaatcttg

SEQ ID NO: 279158 - DNA, 25 bp, Artificial Sequence
  Description of Artificial Sequence: Synthetic oligonucleotide
tggaggcccgcgccagaatcttgca

SEQ ID NO: 279159 - DNA, 24 bp, Artificial Sequence
  Description of Artificial Sequence: Synthetic oligonucleotide
ggaggcccgcgccagaatcttgca

SEQ ID NO: 279160 - DNA, 26 bp, Artificial Sequence
  Description of Artificial Sequence: Synthetic oligonucleotide
gaggcccgcgccagaatcttgcagat

SEQ ID NO: 279161 - DNA, 26 bp, Artificial Sequence
  Description of Artificial Sequence: Synthetic oligonucleotide
aggcccgcgccagaatcttgcagatc

SEQ ID NO: 279162 - DNA, 25 bp, Artificial Sequence
  Description of Artificial Sequence: Synthetic oligonucleotide
ggcccgcgccagaatcttgcagatc

SEQ ID NO: 279163 - DNA, 26 bp, Artificial Sequence
  Description of Artificial Sequence: Synthetic oligonucleotide
gcccgcgccagaatcttgcagatcct

SEQ ID NO: 279164 - DNA, 27 bp, Artificial Sequence
  Description of Artificial Sequence: Synthetic oligonucleotide
cccgcgccagaatcttgcagatcctct

SEQ ID NO: 279165 - DNA, 27 bp, Artificial Sequence
  Description of Artificial Sequence: Synthetic oligonucleotide
ccgcgccagaatcttgcagatcctctc

SEQ ID NO: 279166 - DNA, 27 bp, Artificial Sequence
  Description of Artificial Sequence: Synthetic oligonucleotide
cgcgccagaatcttgcagatcctctcc

SEQ ID NO: 279167 - DNA, 27 bp, Artificial Sequence
  Description of Artificial Sequence: Synthetic oligonucleotide
gcgccagaatcttgcagatcctctccc

SEQ ID NO: 279168 - DNA, 27 bp, Artificial Sequence
  Description of Artificial Sequence: Synthetic oligonucleotide
cgccagaatcttgcagatcctctcccg

SEQ ID NO: 279169 - DNA, 30 bp, Artificial Sequence
  Description of Artificial Sequence: Synthetic oligonucleotide
gccagaatcttgcagatcctctcccgaaac

SEQ ID NO: 279170 - DNA, 32 bp, Artificial Sequence
  Description of Artificial Sequence: Synthetic oligonucleotide
ccagaatcttgcagatcctctcccgaaacatg

SEQ ID NO: 279171 - DNA, 35 bp, Artificial Sequence
  Description of Artificial Sequence: Synthetic oligonucleotide
cagaatcttgcagatcctctcccgaaacatgaatg

SEQ ID NO: 279172 - DNA, 36 bp, Artificial Sequence
  Description of Artificial Sequence: Synthetic oligonucleotide
agaatcttgcagatcctctcccgaaacatgaatgtc

SEQ ID NO: 279173 - DNA, 35 bp, Artificial Sequence
  Description of Artificial Sequence: Synthetic oligonucleotide
gaatcttgcagatcctctcccgaaacatgaatgtc

SEQ ID NO: 279174 - DNA, 36 bp, Artificial Sequence
  Description of Artificial Sequence: Synthetic oligonucleotide
aatcttgcagatcctctcccgaaacatgaatgtctg

SEQ ID NO: 279175 - DNA, 35 bp, Artificial Sequence
  Description of Artificial Sequence: Synthetic oligonucleotide
atcttgcagatcctctcccgaaacatgaatgtctg

SEQ ID NO: 279176 - DNA, 34 bp, Artificial Sequence
  Description of Artificial Sequence: Synthetic oligonucleotide
tcttgcagatcctctcccgaaacatgaatgtctg

SEQ ID NO: 279177 - DNA, 33 bp, Artificial Sequence
  Description of Artificial Sequence: Synthetic oligonucleotide
cttgcagatcctctcccgaaacatgaatgtctg

SEQ ID NO: 279178 - DNA, 34 bp, Artificial Sequence
  Description of Artificial Sequence: Synthetic oligonucleotide
ttgcagatcctctcccgaaacatgaatgtctgtc

SEQ ID NO: 279179 - DNA, 33 bp, Artificial Sequence
  Description of Artificial Sequence: Synthetic oligonucleotide
tgcagatcctctcccgaaacatgaatgtctgtc

SEQ ID NO: 279180 - DNA, 32 bp, Artificial Sequence
  Description of Artificial Sequence: Synthetic oligonucleotide
gcagatcctctcccgaaacatgaatgtctgtc

SEQ ID NO: 279181 - DNA, 32 bp, Artificial Sequence
  Description of Artificial Sequence: Synthetic oligonucleotide
cagatcctctcccgaaacatgaatgtctgtcc

SEQ ID NO: 279182 - DNA, 33 bp, Artificial Sequence
  Description of Artificial Sequence: Synthetic oligonucleotide
agatcctctcccgaaacatgaatgtctgtcctg

SEQ ID NO: 279183 - DNA, 32 bp, Artificial Sequence
  Description of Artificial Sequence: Synthetic oligonucleotide
gatcctctcccgaaacatgaatgtctgtcctg

SEQ ID NO: 279184 - DNA, 33 bp, Artificial Sequence
  Description of Artificial Sequence: Synthetic oligonucleotide
atcctctcccgaaacatgaatgtctgtcctgac

SEQ ID NO: 279185 - DNA, 32 bp, Artificial Sequence
  Description of Artificial Sequence: Synthetic oligonucleotide
tcctctcccgaaacatgaatgtctgtcctgac

SEQ ID NO: 279186 - DNA, 31 bp, Artificial Sequence
  Description of Artificial Sequence: Synthetic oligonucleotide
cctctcccgaaacatgaatgtctgtcctgac

SEQ ID NO: 279187 - DNA, 31 bp, Artificial Sequence
  Description of Artificial Sequence: Synthetic oligonucleotide
ctctcccgaaacatgaatgtctgtcctgacg

SEQ ID NO: 279188 - DNA, 32 bp, Artificial Sequence
  Description of Artificial Sequence: Synthetic oligonucleotide
tctcccgaaacatgaatgtctgtcctgacgag

SEQ ID NO: 279189 - DNA, 31 bp, Artificial Sequence
  Description of Artificial Sequence: Synthetic oligonucleotide
ctcccgaaacatgaatgtctgtcctgacgag

SEQ ID NO: 279190 - DNA, 33 bp, Artificial Sequence
  Description of Artificial Sequence: Synthetic oligonucleotide
tcccgaaacatgaatgtctgtcctgacgagaac

SEQ ID NO: 279191 - DNA, 32 bp, Artificial Sequence
  Description of Artificial Sequence: Synthetic oligonucleotide
cccgaaacatgaatgtctgtcctgacgagaac

SEQ ID NO: 279192 - DNA, 34 bp, Artificial Sequence
  Description of Artificial Sequence: Synthetic oligonucleotide
ccgaaacatgaatgtctgtcctgacgagaactac

SEQ ID NO: 279193 - DNA, 34 bp, Artificial Sequence
  Description of Artificial Sequence: Synthetic oligonucleotide
cgaaacatgaatgtctgtcctgacgagaactacg

SEQ ID NO: 279194 - DNA, 35 bp, Artificial Sequence
  Description of Artificial Sequence: Synthetic oligonucleotide
gaaacatgaatgtctgtcctgacgagaactacgac

SEQ ID NO: 279195 - DNA, 35 bp, Artificial Sequence
  Description of Artificial Sequence: Synthetic oligonucleotide
aaacatgaatgtctgtcctgacgagaactacgacg

SEQ ID NO: 279196 - DNA, 34 bp, Artificial Sequence
  Description of Artificial Sequence: Synthetic oligonucleotide
aacatgaatgtctgtcctgacgagaactacgacg

SEQ ID NO: 279197 - DNA, 33 bp, Artificial Sequence
  Description of Artificial Sequence: Synthetic oligonucleotide
acatgaatgtctgtcctgacgagaactacgacg

SEQ ID NO: 279198 - DNA, 32 bp, Artificial Sequence
  Description of Artificial Sequence: Synthetic oligonucleotide
catgaatgtctgtcctgacgagaactacgacg

SEQ ID NO: 279199 - DNA, 33 bp, Artificial Sequence
  Description of Artificial Sequence: Synthetic oligonucleotide
atgaatgtctgtcctgacgagaactacgacgag

SEQ ID NO: 279200 - DNA, 32 bp, Artificial Sequence
  Description of Artificial Sequence: Synthetic oligonucleotide
tgaatgtctgtcctgacgagaactacgacgag

SEQ ID NO: 279201 - DNA, 31 bp, Artificial Sequence
  Description of Artificial Sequence: Synthetic oligonucleotide
gaatgtctgtcctgacgagaactacgacgag

SEQ ID NO: 279202 - DNA, 31 bp, Artificial Sequence
  Description of Artificial Sequence: Synthetic oligonucleotide
aatgtctgtcctgacgagaactacgacgagc

SEQ ID NO: 279203 - DNA, 30 bp, Artificial Sequence
  Description of Artificial Sequence: Synthetic oligonucleotide
atgtctgtcctgacgagaactacgacgagc

SEQ ID NO: 279204 - DNA, 29 bp, Artificial Sequence
  Description of Artificial Sequence: Synthetic oligonucleotide
tgtctgtcctgacgagaactacgacgagc

SEQ ID NO: 279205 - DNA, 28 bp, Artificial Sequence
  Description of Artificial Sequence: Synthetic oligonucleotide
gtctgtcctgacgagaactacgacgagc

SEQ ID NO: 279206 - DNA, 29 bp, Artificial Sequence
  Description of Artificial Sequence: Synthetic oligonucleotide
tctgtcctgacgagaactacgacgagctg

SEQ ID NO: 279207 - DNA, 28 bp, Artificial Sequence
  Description of Artificial Sequence: Synthetic oligonucleotide
ctgtcctgacgagaactacgacgagctg

SEQ ID NO: 279208 - DNA, 28 bp, Artificial Sequence
  Description of Artificial Sequence: Synthetic oligonucleotide
tgtcctgacgagaactacgacgagctgg

SEQ ID NO: 279209 - DNA, 27 bp, Artificial Sequence
  Description of Artificial Sequence: Synthetic oligonucleotide
gtcctgacgagaactacgacgagctgg

SEQ ID NO: 279210 - DNA, 27 bp, Artificial Sequence
  Description of Artificial Sequence: Synthetic oligonucleotide
tcctgacgagaactacgacgagctggc

SEQ ID NO: 279211 - DNA, 26 bp, Artificial Sequence
  Description of Artificial Sequence: Synthetic oligonucleotide
cctgacgagaactacgacgagctggc

SEQ ID NO: 279212 - DNA, 26 bp, Artificial Sequence
  Description of Artificial Sequence: Synthetic oligonucleotide
ctgacgagaactacgacgagctggcc

SEQ ID NO: 279213 - DNA, 26 bp, Artificial Sequence
  Description of Artificial Sequence: Synthetic oligonucleotide
tgacgagaactacgacgagctggccg

SEQ ID NO: 279214 - DNA, 25 bp, Artificial Sequence
  Description of Artificial Sequence: Synthetic oligonucleotide
gacgagaactacgacgagctggccg

SEQ ID NO: 279215 - DNA, 25 bp, Artificial Sequence
  Description of Artificial Sequence: Synthetic oligonucleotide
acgagaactacgacgagctggccgg

SEQ ID NO: 279216 - DNA, 24 bp, Artificial Sequence
  Description of Artificial Sequence: Synthetic oligonucleotide
cgagaactacgacgagctggccgg

SEQ ID NO: 279217 - DNA, 25 bp, Artificial Sequence
  Description of Artificial Sequence: Synthetic oligonucleotide
gagaactacgacgagctggccggct

SEQ ID NO: 279218 - DNA, 25 bp, Artificial Sequence
  Description of Artificial Sequence: Synthetic oligonucleotide
agaactacgacgagctggccggctg

SEQ ID NO: 279219 - DNA, 24 bp, Artificial Sequence
  Description of Artificial Sequence: Synthetic oligonucleotide
gaactacgacgagctggccggctg

SEQ ID NO: 279220 - DNA, 25 bp, Artificial Sequence
  Description of Artificial Sequence: Synthetic oligonucleotide
aactacgacgagctggccggctgca

SEQ ID NO: 279221 - DNA, 24 bp, Artificial Sequence
  Description of Artificial Sequence: Synthetic oligonucleotide
actacgacgagctggccggctgca

SEQ ID NO: 279222 - DNA, 23 bp, Artificial Sequence
  Description of Artificial Sequence: Synthetic oligonucleotide
ctacgacgagctggccggctgca

SEQ ID NO: 279223 - DNA, 24 bp, Artificial Sequence
  Description of Artificial Sequence: Synthetic oligonucleotide
tacgacgagctggccggctgcaca

SEQ ID NO: 279224 - DNA, 23 bp, Artificial Sequence
  Description of Artificial Sequence: Synthetic oligonucleotide
acgacgagctggccggctgcaca

SEQ ID NO: 279225 - DNA, 22 bp, Artificial Sequence
  Description of Artificial Sequence: Synthetic oligonucleotide
cgacgagctggccggctgcaca

SEQ ID NO: 279226 - DNA, 24 bp, Artificial Sequence
  Description of Artificial Sequence: Synthetic oligonucleotide
gacgagctggccggctgcacagtt

SEQ ID NO: 279227 - DNA, 25 bp, Artificial Sequence
  Description of Artificial Sequence: Synthetic oligonucleotide
acgagctggccggctgcacagttga

SEQ ID NO: 279228 - DNA, 24 bp, Artificial Sequence
  Description of Artificial Sequence: Synthetic oligonucleotide
cgagctggccggctgcacagttga

SEQ ID NO: 279229 - DNA, 26 bp, Artificial Sequence
  Description of Artificial Sequence: Synthetic oligonucleotide
gagctggccggctgcacagttgactt

SEQ ID NO: 279230 - DNA, 27 bp, Artificial Sequence
  Description of Artificial Sequence: Synthetic oligonucleotide
agctggccggctgcacagttgacttca

SEQ ID NO: 279231 - DNA, 27 bp, Artificial Sequence
  Description of Artificial Sequence: Synthetic oligonucleotide
gctggccggctgcacagttgacttcaa

SEQ ID NO: 279232 - DNA, 28 bp, Artificial Sequence
  Description of Artificial Sequence: Synthetic oligonucleotide
ctggccggctgcacagttgacttcaaag

SEQ ID NO: 279233 - DNA, 28 bp, Artificial Sequence
  Description of Artificial Sequence: Synthetic oligonucleotide
tggccggctgcacagttgacttcaaagg

SEQ ID NO: 279234 - DNA, 27 bp, Artificial Sequence
  Description of Artificial Sequence: Synthetic oligonucleotide
ggccggctgcacagttgacttcaaagg

SEQ ID NO: 279235 - DNA, 27 bp, Artificial Sequence
  Description of Artificial Sequence: Synthetic oligonucleotide
gccggctgcacagttgacttcaaaggg

SEQ ID NO: 279236 - DNA, 27 bp, Artificial Sequence
  Description of Artificial Sequence: Synthetic oligonucleotide
ccggctgcacagttgacttcaaagggg

SEQ ID NO: 279237 - DNA, 27 bp, Artificial Sequence
  Description of Artificial Sequence: Synthetic oligonucleotide
cggctgcacagttgacttcaaaggggc

SEQ ID NO: 279238 - DNA, 27 bp, Artificial Sequence
  Description of Artificial Sequence: Synthetic oligonucleotide
ggctgcacagttgacttcaaaggggcc

SEQ ID NO: 279239 - DNA, 27 bp, Artificial Sequence
  Description of Artificial Sequence: Synthetic oligonucleotide
gctgcacagttgacttcaaaggggccc

SEQ ID NO: 279240 - DNA, 28 bp, Artificial Sequence
  Description of Artificial Sequence: Synthetic oligonucleotide
ctgcacagttgacttcaaaggggcccag

SEQ ID NO: 279241 - DNA, 29 bp, Artificial Sequence
  Description of Artificial Sequence: Synthetic oligonucleotide
tgcacagttgacttcaaaggggcccagag

SEQ ID NO: 279242 - DNA, 28 bp, Artificial Sequence
  Description of Artificial Sequence: Synthetic oligonucleotide
gcacagttgacttcaaaggggcccagag

SEQ ID NO: 279243 - DNA, 28 bp, Artificial Sequence
  Description of Artificial Sequence: Synthetic oligonucleotide
cacagttgacttcaaaggggcccagagc

SEQ ID NO: 279244 - DNA, 30 bp, Artificial Sequence
  Description of Artificial Sequence: Synthetic oligonucleotide
acagttgacttcaaaggggcccagagcaag

SEQ ID NO: 279245 - DNA, 29 bp, Artificial Sequence
  Description of Artificial Sequence: Synthetic oligonucleotide
cagttgacttcaaaggggcccagagcaag

SEQ ID NO: 279246 - DNA, 29 bp, Artificial Sequence
  Description of Artificial Sequence: Synthetic oligonucleotide
agttgacttcaaaggggcccagagcaagg

SEQ ID NO: 279247 - DNA, 28 bp, Artificial Sequence
  Description of Artificial Sequence: Synthetic oligonucleotide
gttgacttcaaaggggcccagagcaagg

SEQ ID NO: 279248 - DNA, 28 bp, Artificial Sequence
  Description of Artificial Sequence: Synthetic oligonucleotide
ttgacttcaaaggggcccagagcaaggc

SEQ ID NO: 279249 - DNA, 27 bp, Artificial Sequence
  Description of Artificial Sequence: Synthetic oligonucleotide
tgacttcaaaggggcccagagcaaggc

SEQ ID NO: 279250 - DNA, 27 bp, Artificial Sequence
  Description of Artificial Sequence: Synthetic oligonucleotide
gacttcaaaggggcccagagcaaggct

SEQ ID NO: 279251 - DNA, 27 bp, Artificial Sequence
  Description of Artificial Sequence: Synthetic oligonucleotide
acttcaaaggggcccagagcaaggctg

SEQ ID NO: 279252 - DNA, 27 bp, Artificial Sequence
  Description of Artificial Sequence: Synthetic oligonucleotide
cttcaaaggggcccagagcaaggctga

SEQ ID NO: 279253 - DNA, 27 bp, Artificial Sequence
  Description of Artificial Sequence: Synthetic oligonucleotide
ttcaaaggggcccagagcaaggctgag

SEQ ID NO: 279254 - DNA, 27 bp, Artificial Sequence
  Description of Artificial Sequence: Synthetic oligonucleotide
tcaaaggggcccagagcaaggctgagt

SEQ ID NO: 279255 - DNA, 26 bp, Artificial Sequence
  Description of Artificial Sequence: Synthetic oligonucleotide
caaaggggcccagagcaaggctgagt

SEQ ID NO: 279256 - DNA, 27 bp, Artificial Sequence
  Description of Artificial Sequence: Synthetic oligonucleotide
aaaggggcccagagcaaggctgagtgt

SEQ ID NO: 279257 - DNA, 26 bp, Artificial Sequence
  Description of Artificial Sequence: Synthetic oligonucleotide
aaggggcccagagcaaggctgagtgt

SEQ ID NO: 279258 - DNA, 25 bp, Artificial Sequence
  Description of Artificial Sequence: Synthetic oligonucleotide
aggggcccagagcaaggctgagtgt

SEQ ID NO: 279259 - DNA, 24 bp, Artificial Sequence
  Description of Artificial Sequence: Synthetic oligonucleotide
ggggcccagagcaaggctgagtgt

SEQ ID NO: 279260 - DNA, 25 bp, Artificial Sequence
  Description of Artificial Sequence: Synthetic oligonucleotide
gggcccagagcaaggctgagtgtgt

SEQ ID NO: 279261 - DNA, 25 bp, Artificial Sequence
  Description of Artificial Sequence: Synthetic oligonucleotide
ggcccagagcaaggctgagtgtgtg

SEQ ID NO: 279262 - DNA, 26 bp, Artificial Sequence
  Description of Artificial Sequence: Synthetic oligonucleotide
gcccagagcaaggctgagtgtgtgga

SEQ ID NO: 279263 - DNA, 26 bp, Artificial Sequence
  Description of Artificial Sequence: Synthetic oligonucleotide
cccagagcaaggctgagtgtgtggac

SEQ ID NO: 279264 - DNA, 26 bp, Artificial Sequence
  Description of Artificial Sequence: Synthetic oligonucleotide
ccagagcaaggctgagtgtgtggacg

SEQ ID NO: 279265 - DNA, 26 bp, Artificial Sequence
  Description of Artificial Sequence: Synthetic oligonucleotide
cagagcaaggctgagtgtgtggacgc

SEQ ID NO: 279266 - DNA, 26 bp, Artificial Sequence
  Description of Artificial Sequence: Synthetic oligonucleotide
agagcaaggctgagtgtgtggacgcg

SEQ ID NO: 279267 - DNA, 25 bp, Artificial Sequence
  Description of Artificial Sequence: Synthetic oligonucleotide
gagcaaggctgagtgtgtggacgcg

SEQ ID NO: 279268 - DNA, 25 bp, Artificial Sequence
  Description of Artificial Sequence: Synthetic oligonucleotide
agcaaggctgagtgtgtggacgcgg

SEQ ID NO: 279269 - DNA, 24 bp, Artificial Sequence
  Description of Artificial Sequence: Synthetic oligonucleotide
gcaaggctgagtgtgtggacgcgg

SEQ ID NO: 279270 - DNA, 24 bp, Artificial Sequence
  Description of Artificial Sequence: Synthetic oligonucleotide
caaggctgagtgtgtggacgcggg

SEQ ID NO: 279271 - DNA, 26 bp, Artificial Sequence
  Description of Artificial Sequence: Synthetic oligonucleotide
aaggctgagtgtgtggacgcgggcat

SEQ ID NO: 279272 - DNA, 25 bp, Artificial Sequence
  Description of Artificial Sequence: Synthetic oligonucleotide
aggctgagtgtgtggacgcgggcat

SEQ ID NO: 279273 - DNA, 24 bp, Artificial Sequence
  Description of Artificial Sequence: Synthetic oligonucleotide
ggctgagtgtgtggacgcgggcat

SEQ ID NO: 279274 - DNA, 26 bp, Artificial Sequence
  Description of Artificial Sequence: Synthetic oligonucleotide
gctgagtgtgtggacgcgggcatgtt

SEQ ID NO: 279275 - DNA, 26 bp, Artificial Sequence
  Description of Artificial Sequence: Synthetic oligonucleotide
ctgagtgtgtggacgcgggcatgttc

SEQ ID NO: 279276 - DNA, 26 bp, Artificial Sequence
  Description of Artificial Sequence: Synthetic oligonucleotide
tgagtgtgtggacgcgggcatgttcg

SEQ ID NO: 279277 - DNA, 25 bp, Artificial Sequence
  Description of Artificial Sequence: Synthetic oligonucleotide
gagtgtgtggacgcgggcatgttcg

SEQ ID NO: 279278 - DNA, 26 bp, Artificial Sequence
  Description of Artificial Sequence: Synthetic oligonucleotide
agtgtgtggacgcgggcatgttcgca

SEQ ID NO: 279279 - DNA, 25 bp, Artificial Sequence
  Description of Artificial Sequence: Synthetic oligonucleotide
gtgtgtggacgcgggcatgttcgca

SEQ ID NO: 279280 - DNA, 26 bp, Artificial Sequence
  Description of Artificial Sequence: Synthetic oligonucleotide
tgtgtggacgcgggcatgttcgcact

SEQ ID NO: 279281 - DNA, 25 bp, Artificial Sequence
  Description of Artificial Sequence: Synthetic oligonucleotide
gtgtggacgcgggcatgttcgcact

SEQ ID NO: 279282 - DNA, 25 bp, Artificial Sequence
  Description of Artificial Sequence: Synthetic oligonucleotide
tgtggacgcgggcatgttcgcactg

SEQ ID NO: 279283 - DNA, 24 bp, Artificial Sequence
  Description of Artificial Sequence: Synthetic oligonucleotide
gtggacgcgggcatgttcgcactg

SEQ ID NO: 279284 - DNA, 24 bp, Artificial Sequence
  Description of Artificial Sequence: Synthetic oligonucleotide
tggacgcgggcatgttcgcactgc

SEQ ID NO: 279285 - DNA, 23 bp, Artificial Sequence
  Description of Artificial Sequence: Synthetic oligonucleotide
ggacgcgggcatgttcgcactgc

SEQ ID NO: 279286 - DNA, 23 bp, Artificial Sequence
  Description of Artificial Sequence: Synthetic oligonucleotide
gacgcgggcatgttcgcactgcc

SEQ ID NO: 279287 - DNA, 24 bp, Artificial Sequence
  Description of Artificial Sequence: Synthetic oligonucleotide
acgcgggcatgttcgcactgccca

SEQ ID NO: 279288 - DNA, 23 bp, Artificial Sequence
  Description of Artificial Sequence: Synthetic oligonucleotide
cgcgggcatgttcgcactgccca

SEQ ID NO: 279289 - DNA, 23 bp, Artificial Sequence
  Description of Artificial Sequence: Synthetic oligonucleotide
gcgggcatgttcgcactgcccag

SEQ ID NO: 279290 - DNA, 23 bp, Artificial Sequence
  Description of Artificial Sequence: Synthetic oligonucleotide
cgggcatgttcgcactgcccagg

SEQ ID NO: 279291 - DNA, 23 bp, Artificial Sequence
  Description of Artificial Sequence: Synthetic oligonucleotide
gggcatgttcgcactgcccaggg

SEQ ID NO: 279292 - DNA, 24 bp, Artificial Sequence
  Description of Artificial Sequence: Synthetic oligonucleotide
ggcatgttcgcactgcccaggggt

SEQ ID NO: 279293 - DNA, 24 bp, Artificial Sequence
  Description of Artificial Sequence: Synthetic oligonucleotide
gcatgttcgcactgcccaggggtg

SEQ ID NO: 279294 - DNA, 24 bp, Artificial Sequence
  Description of Artificial Sequence: Synthetic oligonucleotide
catgttcgcactgcccaggggtgc

SEQ ID NO: 279295 - DNA, 25 bp, Artificial Sequence
  Description of Artificial Sequence: Synthetic oligonucleotide
atgttcgcactgcccaggggtgcga

SEQ ID NO: 279296 - DNA, 24 bp, Artificial Sequence
  Description of Artificial Sequence: Synthetic oligonucleotide
tgttcgcactgcccaggggtgcga

SEQ ID NO: 279297 - DNA, 23 bp, Artificial Sequence
  Description of Artificial Sequence: Synthetic oligonucleotide
gttcgcactgcccaggggtgcga

SEQ ID NO: 279298 - DNA, 23 bp, Artificial Sequence
  Description of Artificial Sequence: Synthetic oligonucleotide
ttcgcactgcccaggggtgcgac

SEQ ID NO: 279299 - DNA, 22 bp, Artificial Sequence
  Description of Artificial Sequence: Synthetic oligonucleotide
tcgcactgcccaggggtgcgac

SEQ ID NO: 279300 - DNA, 21 bp, Artificial Sequence
  Description of Artificial Sequence: Synthetic oligonucleotide
cgcactgcccaggggtgcgac

SEQ ID NO: 279301 - DNA, 21 bp, Artificial Sequence
  Description of Artificial Sequence: Synthetic oligonucleotide
gcactgcccaggggtgcgacg

SEQ ID NO: 279302 - DNA, 22 bp, Artificial Sequence
  Description of Artificial Sequence: Synthetic oligonucleotide
cactgcccaggggtgcgacgga

SEQ ID NO: 279303 - DNA, 22 bp, Artificial Sequence
  Description of Artificial Sequence: Synthetic oligonucleotide
actgcccaggggtgcgacggag

SEQ ID NO: 279304 - DNA, 21 bp, Artificial Sequence
  Description of Artificial Sequence: Synthetic oligonucleotide
ctgcccaggggtgcgacggag

SEQ ID NO: 279305 - DNA, 22 bp, Artificial Sequence
  Description of Artificial Sequence: Synthetic oligonucleotide
tgcccaggggtgcgacggagct

SEQ ID NO: 279306 - DNA, 21 bp, Artificial Sequence
  Description of Artificial Sequence: Synthetic oligonucleotide
gcccaggggtgcgacggagct

SEQ ID NO: 279307 - DNA, 22 bp, Artificial Sequence
  Description of Artificial Sequence: Synthetic oligonucleotide
cccaggggtgcgacggagctct

SEQ ID NO: 279308 - DNA, 22 bp, Artificial Sequence
  Description of Artificial Sequence: Synthetic oligonucleotide
ccaggggtgcgacggagctctc

SEQ ID NO: 279309 - DNA, 22 bp, Artificial Sequence
  Description of Artificial Sequence: Synthetic oligonucleotide
caggggtgcgacggagctctcc

SEQ ID NO: 279310 - DNA, 23 bp, Artificial Sequence
  Description of Artificial Sequence: Synthetic oligonucleotide
aggggtgcgacggagctctccca

SEQ ID NO: 279311 - DNA, 22 bp, Artificial Sequence
  Description of Artificial Sequence: Synthetic oligonucleotide
ggggtgcgacggagctctccca

SEQ ID NO: 279312 - DNA, 22 bp, Artificial Sequence
  Description of Artificial Sequence: Synthetic oligonucleotide
gggtgcgacggagctctcccac

SEQ ID NO: 279313 - DNA, 23 bp, Artificial Sequence
  Description of Artificial Sequence: Synthetic oligonucleotide
ggtgcgacggagctctcccacga

SEQ ID NO: 279314 - DNA, 23 bp, Artificial Sequence
  Description of Artificial Sequence: Synthetic oligonucleotide
gtgcgacggagctctcccacgag

SEQ ID NO: 279315 - DNA, 24 bp, Artificial Sequence
  Description of Artificial Sequence: Synthetic oligonucleotide
tgcgacggagctctcccacgaggt

SEQ ID NO: 279316 - DNA, 23 bp, Artificial Sequence
  Description of Artificial Sequence: Synthetic oligonucleotide
gcgacggagctctcccacgaggt

SEQ ID NO: 279317 - DNA, 25 bp, Artificial Sequence
  Description of Artificial Sequence: Synthetic oligonucleotide
cgacggagctctcccacgaggtcta

SEQ ID NO: 279318 - DNA, 27 bp, Artificial Sequence
  Description of Artificial Sequence: Synthetic oligonucleotide
gacggagctctcccacgaggtctacat

SEQ ID NO: 279319 - DNA, 27 bp, Artificial Sequence
  Description of Artificial Sequence: Synthetic oligonucleotide
acggagctctcccacgaggtctacatg

SEQ ID NO: 279320 - DNA, 26 bp, Artificial Sequence
  Description of Artificial Sequence: Synthetic oligonucleotide
cggagctctcccacgaggtctacatg

SEQ ID NO: 279321 - DNA, 27 bp, Artificial Sequence
  Description of Artificial Sequence: Synthetic oligonucleotide
ggagctctcccacgaggtctacatgga

SEQ ID NO: 279322 - DNA, 28 bp, Artificial Sequence
  Description of Artificial Sequence: Synthetic oligonucleotide
gagctctcccacgaggtctacatggatg

SEQ ID NO: 279323 - DNA, 28 bp, Artificial Sequence
  Description of Artificial Sequence: Synthetic oligonucleotide
agctctcccacgaggtctacatggatgg

SEQ ID NO: 279324 - DNA, 27 bp, Artificial Sequence
  Description of Artificial Sequence: Synthetic oligonucleotide
gctctcccacgaggtctacatggatgg

SEQ ID NO: 279325 - DNA, 27 bp, Artificial Sequence
  Description of Artificial Sequence: Synthetic oligonucleotide
ctctcccacgaggtctacatggatggc

SEQ ID NO: 279326 - DNA, 29 bp, Artificial Sequence
  Description of Artificial Sequence: Synthetic oligonucleotide
tctcccacgaggtctacatggatggcatc

SEQ ID NO: 279327 - DNA, 28 bp, Artificial Sequence
  Description of Artificial Sequence: Synthetic oligonucleotide
ctcccacgaggtctacatggatggcatc

SEQ ID NO: 279328 - DNA, 28 bp, Artificial Sequence
  Description of Artificial Sequence: Synthetic oligonucleotide
tcccacgaggtctacatggatggcatcc

SEQ ID NO: 279329 - DNA, 27 bp, Artificial Sequence
  Description of Artificial Sequence: Synthetic oligonucleotide
cccacgaggtctacatggatggcatcc

SEQ ID NO: 279330 - DNA, 28 bp, Artificial Sequence
  Description of Artificial Sequence: Synthetic oligonucleotide
ccacgaggtctacatggatggcatcctg

SEQ ID NO: 279331 - DNA, 28 bp, Artificial Sequence
  Description of Artificial Sequence: Synthetic oligonucleotide
cacgaggtctacatggatggcatcctgc

SEQ ID NO: 279332 - DNA, 29 bp, Artificial Sequence
  Description of Artificial Sequence: Synthetic oligonucleotide
acgaggtctacatggatggcatcctgcag

SEQ ID NO: 279333 - DNA, 28 bp, Artificial Sequence
  Description of Artificial Sequence: Synthetic oligonucleotide
cgaggtctacatggatggcatcctgcag

SEQ ID NO: 279334 - DNA, 28 bp, Artificial Sequence
  Description of Artificial Sequence: Synthetic oligonucleotide
gaggtctacatggatggcatcctgcagg

SEQ ID NO: 279335 - DNA, 29 bp, Artificial Sequence
  Description of Artificial Sequence: Synthetic oligonucleotide
aggtctacatggatggcatcctgcaggtg

SEQ ID NO: 279336 - DNA, 28 bp, Artificial Sequence
  Description of Artificial Sequence: Synthetic oligonucleotide
ggtctacatggatggcatcctgcaggtg

SEQ ID NO: 279337 - DNA, 28 bp, Artificial Sequence
  Description of Artificial Sequence: Synthetic oligonucleotide
gtctacatggatggcatcctgcaggtgc

SEQ ID NO: 279338 - DNA, 29 bp, Artificial Sequence
  Description of Artificial Sequence: Synthetic oligonucleotide
tctacatggatggcatcctgcaggtgcag

SEQ ID NO: 279339 - DNA, 28 bp, Artificial Sequence
  Description of Artificial Sequence: Synthetic oligonucleotide
ctacatggatggcatcctgcaggtgcag

SEQ ID NO: 279340 - DNA, 28 bp, Artificial Sequence
  Description of Artificial Sequence: Synthetic oligonucleotide
tacatggatggcatcctgcaggtgcagg

SEQ ID NO: 279341 - DNA, 27 bp, Artificial Sequence
  Description of Artificial Sequence: Synthetic oligonucleotide
acatggatggcatcctgcaggtgcagg

SEQ ID NO: 279342 - DNA, 26 bp, Artificial Sequence
  Description of Artificial Sequence: Synthetic oligonucleotide
catggatggcatcctgcaggtgcagg

SEQ ID NO: 279343 - DNA, 26 bp, Artificial Sequence
  Description of Artificial Sequence: Synthetic oligonucleotide
atggatggcatcctgcaggtgcaggg

SEQ ID NO: 279344 - DNA, 25 bp, Artificial Sequence
  Description of Artificial Sequence: Synthetic oligonucleotide
tggatggcatcctgcaggtgcaggg

SEQ ID NO: 279345 - DNA, 24 bp, Artificial Sequence
  Description of Artificial Sequence: Synthetic oligonucleotide
ggatggcatcctgcaggtgcaggg

SEQ ID NO: 279346 - DNA, 26 bp, Artificial Sequence
  Description of Artificial Sequence: Synthetic oligonucleotide
gatggcatcctgcaggtgcagggcaa

SEQ ID NO: 279347 - DNA, 27 bp, Artificial Sequence
  Description of Artificial Sequence: Synthetic oligonucleotide
atggcatcctgcaggtgcagggcaaga

SEQ ID NO: 279348 - DNA, 27 bp, Artificial Sequence
  Description of Artificial Sequence: Synthetic oligonucleotide
tggcatcctgcaggtgcagggcaagaa

SEQ ID NO: 279349 - DNA, 26 bp, Artificial Sequence
  Description of Artificial Sequence: Synthetic oligonucleotide
ggcatcctgcaggtgcagggcaagaa

SEQ ID NO: 279350 - DNA, 27 bp, Artificial Sequence
  Description of Artificial Sequence: Synthetic oligonucleotide
gcatcctgcaggtgcagggcaagaaga

SEQ ID NO: 279351 - DNA, 29 bp, Artificial Sequence
  Description of Artificial Sequence: Synthetic oligonucleotide
catcctgcaggtgcagggcaagaagaatg

SEQ ID NO: 279352 - DNA, 29 bp, Artificial Sequence
  Description of Artificial Sequence: Synthetic oligonucleotide
atcctgcaggtgcagggcaagaagaatgc

SEQ ID NO: 279353 - DNA, 28 bp, Artificial Sequence
  Description of Artificial Sequence: Synthetic oligonucleotide
tcctgcaggtgcagggcaagaagaatgc

SEQ ID NO: 279354 - DNA, 27 bp, Artificial Sequence
  Description of Artificial Sequence: Synthetic oligonucleotide
cctgcaggtgcagggcaagaagaatgc

SEQ ID NO: 279355 - DNA, 27 bp, Artificial Sequence
  Description of Artificial Sequence: Synthetic oligonucleotide
ctgcaggtgcagggcaagaagaatgcc

SEQ ID NO: 279356 - DNA, 29 bp, Artificial Sequence
  Description of Artificial Sequence: Synthetic oligonucleotide
tgcaggtgcagggcaagaagaatgccaac

SEQ ID NO: 279357 - DNA, 28 bp, Artificial Sequence
  Description of Artificial Sequence: Synthetic oligonucleotide
gcaggtgcagggcaagaagaatgccaac

SEQ ID NO: 279358 - DNA, 28 bp, Artificial Sequence
  Description of Artificial Sequence: Synthetic oligonucleotide
caggtgcagggcaagaagaatgccaacc

SEQ ID NO: 279359 - DNA, 30 bp, Artificial Sequence
  Description of Artificial Sequence: Synthetic oligonucleotide
aggtgcagggcaagaagaatgccaacctag

SEQ ID NO: 279360 - DNA, 29 bp, Artificial Sequence
  Description of Artificial Sequence: Synthetic oligonucleotide
ggtgcagggcaagaagaatgccaacctag

SEQ ID NO: 279361 - DNA, 33 bp, Artificial Sequence
  Description of Artificial Sequence: Synthetic oligonucleotide
gtgcagggcaagaagaatgccaacctagaatac

SEQ ID NO: 279362 - DNA, 35 bp, Artificial Sequence
  Description of Artificial Sequence: Synthetic oligonucleotide
tgcagggcaagaagaatgccaacctagaatactac

SEQ ID NO: 279363 - DNA, 34 bp, Artificial Sequence
  Description of Artificial Sequence: Synthetic oligonucleotide
gcagggcaagaagaatgccaacctagaatactac

SEQ ID NO: 279364 - DNA, 34 bp, Artificial Sequence
  Description of Artificial Sequence: Synthetic oligonucleotide
cagggcaagaagaatgccaacctagaatactacg

SEQ ID NO: 279365 - DNA, 34 bp, Artificial Sequence
  Description of Artificial Sequence: Synthetic oligonucleotide
agggcaagaagaatgccaacctagaatactacgg

SEQ ID NO: 279366 - DNA, 33 bp, Artificial Sequence
  Description of Artificial Sequence: Synthetic oligonucleotide
gggcaagaagaatgccaacctagaatactacgg

SEQ ID NO: 279367 - DNA, 33 bp, Artificial Sequence
  Description of Artificial Sequence: Synthetic oligonucleotide
ggcaagaagaatgccaacctagaatactacggc

SEQ ID NO: 279368 - DNA, 35 bp, Artificial Sequence
  Description of Artificial Sequence: Synthetic oligonucleotide
gcaagaagaatgccaacctagaatactacggctag

SEQ ID NO: 279369 - DNA, 31 bp, Artificial Sequence
  Description of Artificial Sequence: Synthetic oligonucleotide
atcgaggagatacgcatcttggaggagaagg

SEQ ID NO: 279370 - DNA, 30 bp, Artificial Sequence
  Description of Artificial Sequence: Synthetic oligonucleotide
tcgaggagatacgcatcttggaggagaagg

SEQ ID NO: 279371 - DNA, 29 bp, Artificial Sequence
  Description of Artificial Sequence: Synthetic oligonucleotide
cgaggagatacgcatcttggaggagaagg

SEQ ID NO: 279372 - DNA, 29 bp, Artificial Sequence
  Description of Artificial Sequence: Synthetic oligonucleotide
gaggagatacgcatcttggaggagaaggc

SEQ ID NO: 279373 - DNA, 30 bp, Artificial Sequence
  Description of Artificial Sequence: Synthetic oligonucleotide
aggagatacgcatcttggaggagaaggcac

SEQ ID NO: 279374 - DNA, 29 bp, Artificial Sequence
  Description of Artificial Sequence: Synthetic oligonucleotide
ggagatacgcatcttggaggagaaggcac

SEQ ID NO: 279375 - DNA, 30 bp, Artificial Sequence
  Description of Artificial Sequence: Synthetic oligonucleotide
gagatacgcatcttggaggagaaggcacag

SEQ ID NO: 279376 - DNA, 30 bp, Artificial Sequence
  Description of Artificial Sequence: Synthetic oligonucleotide
agatacgcatcttggaggagaaggcacagg

SEQ ID NO: 279377 - DNA, 29 bp, Artificial Sequence
  Description of Artificial Sequence: Synthetic oligonucleotide
gatacgcatcttggaggagaaggcacagg

SEQ ID NO: 279378 - DNA, 31 bp, Artificial Sequence
  Description of Artificial Sequence: Synthetic oligonucleotide
atacgcatcttggaggagaaggcacaggatg

SEQ ID NO: 279379 - DNA, 30 bp, Artificial Sequence
  Description of Artificial Sequence: Synthetic oligonucleotide
tacgcatcttggaggagaaggcacaggatg

SEQ ID NO: 279380 - DNA, 29 bp, Artificial Sequence
  Description of Artificial Sequence: Synthetic oligonucleotide
acgcatcttggaggagaaggcacaggatg

SEQ ID NO: 279381 - DNA, 28 bp, Artificial Sequence
  Description of Artificial Sequence: Synthetic oligonucleotide
cgcatcttggaggagaaggcacaggatg

SEQ ID NO: 279382 - DNA, 29 bp, Artificial Sequence
  Description of Artificial Sequence: Synthetic oligonucleotide
gcatcttggaggagaaggcacaggatgag

SEQ ID NO: 279383 - DNA, 31 bp, Artificial Sequence
  Description of Artificial Sequence: Synthetic oligonucleotide
catcttggaggagaaggcacaggatgagttc

SEQ ID NO: 279384 - DNA, 31 bp, Artificial Sequence
  Description of Artificial Sequence: Synthetic oligonucleotide
atcttggaggagaaggcacaggatgagttcc

SEQ ID NO: 279385 - DNA, 30 bp, Artificial Sequence
  Description of Artificial Sequence: Synthetic oligonucleotide
tcttggaggagaaggcacaggatgagttcc

SEQ ID NO: 279386 - DNA, 29 bp, Artificial Sequence
  Description of Artificial Sequence: Synthetic oligonucleotide
cttggaggagaaggcacaggatgagttcc

SEQ ID NO: 279387 - DNA, 29 bp, Artificial Sequence
  Description of Artificial Sequence: Synthetic oligonucleotide
ttggaggagaaggcacaggatgagttccc

SEQ ID NO: 279388 - DNA, 28 bp, Artificial Sequence
  Description of Artificial Sequence: Synthetic oligonucleotide
tggaggagaaggcacaggatgagttccc

SEQ ID NO: 279389 - DNA, 27 bp, Artificial Sequence
  Description of Artificial Sequence: Synthetic oligonucleotide
ggaggagaaggcacaggatgagttccc

SEQ ID NO: 279390 - DNA, 28 bp, Artificial Sequence
  Description of Artificial Sequence: Synthetic oligonucleotide
gaggagaaggcacaggatgagttcccag

SEQ ID NO: 279391 - DNA, 28 bp, Artificial Sequence
  Description of Artificial Sequence: Synthetic oligonucleotide
aggagaaggcacaggatgagttcccagc

SEQ ID NO: 279392 - DNA, 27 bp, Artificial Sequence
  Description of Artificial Sequence: Synthetic oligonucleotide
ggagaaggcacaggatgagttcccagc

SEQ ID NO: 279393 - DNA, 28 bp, Artificial Sequence
  Description of Artificial Sequence: Synthetic oligonucleotide
gagaaggcacaggatgagttcccagcac

SEQ ID NO: 279394 - DNA, 29 bp, Artificial Sequence
  Description of Artificial Sequence: Synthetic oligonucleotide
agaaggcacaggatgagttcccagcacag

SEQ ID NO: 279395 - DNA, 28 bp, Artificial Sequence
  Description of Artificial Sequence: Synthetic oligonucleotide
gaaggcacaggatgagttcccagcacag

SEQ ID NO: 279396 - DNA, 29 bp, Artificial Sequence
  Description of Artificial Sequence: Synthetic oligonucleotide
aaggcacaggatgagttcccagcacagtc

SEQ ID NO: 279397 - DNA, 28 bp, Artificial Sequence
  Description of Artificial Sequence: Synthetic oligonucleotide
aggcacaggatgagttcccagcacagtc

SEQ ID NO: 279398 - DNA, 27 bp, Artificial Sequence
  Description of Artificial Sequence: Synthetic oligonucleotide
ggcacaggatgagttcccagcacagtc

SEQ ID NO: 279399 - DNA, 27 bp, Artificial Sequence
  Description of Artificial Sequence: Synthetic oligonucleotide
gcacaggatgagttcccagcacagtcc

SEQ ID NO: 279400 - DNA, 27 bp, Artificial Sequence
  Description of Artificial Sequence: Synthetic oligonucleotide
cacaggatgagttcccagcacagtccg

SEQ ID NO: 279401 - DNA, 28 bp, Artificial Sequence
  Description of Artificial Sequence: Synthetic oligonucleotide
acaggatgagttcccagcacagtccgtg

SEQ ID NO: 279402 - DNA, 27 bp, Artificial Sequence
  Description of Artificial Sequence: Synthetic oligonucleotide
caggatgagttcccagcacagtccgtg

SEQ ID NO: 279403 - DNA, 28 bp, Artificial Sequence
  Description of Artificial Sequence: Synthetic oligonucleotide
aggatgagttcccagcacagtccgtgtc

SEQ ID NO: 279404 - DNA, 27 bp, Artificial Sequence
  Description of Artificial Sequence: Synthetic oligonucleotide
ggatgagttcccagcacagtccgtgtc

SEQ ID NO: 279405 - DNA, 27 bp, Artificial Sequence
  Description of Artificial Sequence: Synthetic oligonucleotide
gatgagttcccagcacagtccgtgtcg

SEQ ID NO: 279406 - DNA, 27 bp, Artificial Sequence
  Description of Artificial Sequence: Synthetic oligonucleotide
atgagttcccagcacagtccgtgtcgc

SEQ ID NO: 279407 - DNA, 26 bp, Artificial Sequence
  Description of Artificial Sequence: Synthetic oligonucleotide
tgagttcccagcacagtccgtgtcgc

SEQ ID NO: 279408 - DNA, 25 bp, Artificial Sequence
  Description of Artificial Sequence: Synthetic oligonucleotide
gagttcccagcacagtccgtgtcgc

SEQ ID NO: 279409 - DNA, 25 bp, Artificial Sequence
  Description of Artificial Sequence: Synthetic oligonucleotide
agttcccagcacagtccgtgtcgcg

SEQ ID NO: 279410 - DNA, 24 bp, Artificial Sequence
  Description of Artificial Sequence: Synthetic oligonucleotide
gttcccagcacagtccgtgtcgcg

SEQ ID NO: 279411 - DNA, 24 bp, Artificial Sequence
  Description of Artificial Sequence: Synthetic oligonucleotide
ttcccagcacagtccgtgtcgcgg

SEQ ID NO: 279412 - DNA, 23 bp, Artificial Sequence
  Description of Artificial Sequence: Synthetic oligonucleotide
tcccagcacagtccgtgtcgcgg

SEQ ID NO: 279413 - DNA, 22 bp, Artificial Sequence
  Description of Artificial Sequence: Synthetic oligonucleotide
cccagcacagtccgtgtcgcgg

SEQ ID NO: 279414 - DNA, 22 bp, Artificial Sequence
  Description of Artificial Sequence: Synthetic oligonucleotide
ccagcacagtccgtgtcgcggc

SEQ ID NO: 279415 - DNA, 22 bp, Artificial Sequence
  Description of Artificial Sequence: Synthetic oligonucleotide
cagcacagtccgtgtcgcggcc

SEQ ID NO: 279416 - DNA, 22 bp, Artificial Sequence
  Description of Artificial Sequence: Synthetic oligonucleotide
agcacagtccgtgtcgcggccc

SEQ ID NO: 279417 - DNA, 21 bp, Artificial Sequence
  Description of Artificial Sequence: Synthetic oligonucleotide
gcacagtccgtgtcgcggccc

SEQ ID NO: 279418 - DNA, 22 bp, Artificial Sequence
  Description of Artificial Sequence: Synthetic oligonucleotide
cacagtccgtgtcgcggcccca

SEQ ID NO: 279419 - DNA, 23 bp, Artificial Sequence
  Description of Artificial Sequence: Synthetic oligonucleotide
acagtccgtgtcgcggccccagt

SEQ ID NO: 279420 - DNA, 22 bp, Artificial Sequence
  Description of Artificial Sequence: Synthetic oligonucleotide
cagtccgtgtcgcggccccagt

SEQ ID NO: 279421 - DNA, 22 bp, Artificial Sequence
  Description of Artificial Sequence: Synthetic oligonucleotide
agtccgtgtcgcggccccagtc

SEQ ID NO: 279422 - DNA, 21 bp, Artificial Sequence
  Description of Artificial Sequence: Synthetic oligonucleotide
gtccgtgtcgcggccccagtc

SEQ ID NO: 279423 - DNA, 21 bp, Artificial Sequence
  Description of Artificial Sequence: Synthetic oligonucleotide
tccgtgtcgcggccccagtcc

SEQ ID NO: 279424 - DNA, 20 bp, Artificial Sequence
  Description of Artificial Sequence: Synthetic oligonucleotide
ccgtgtcgcggccccagtcc

SEQ ID NO: 279425 - DNA, 20 bp, Artificial Sequence
  Description of Artificial Sequence: Synthetic oligonucleotide
cgtgtcgcggccccagtccg

SEQ ID NO: 279426 - DNA, 20 bp, Artificial Sequence
  Description of Artificial Sequence: Synthetic oligonucleotide
gtgtcgcggccccagtccgg

SEQ ID NO: 279427 - DNA, 20 bp, Artificial Sequence
  Description of Artificial Sequence: Synthetic oligonucleotide
tgtcgcggccccagtccggc

SEQ ID NO: 279428 - DNA, 20 bp, Artificial Sequence
  Description of Artificial Sequence: Synthetic oligonucleotide
gtcgcggccccagtccggct

SEQ ID NO: 279429 - DNA, 20 bp, Artificial Sequence
  Description of Artificial Sequence: Synthetic oligonucleotide
tcgcggccccagtccggcct

SEQ ID NO: 279430 - DNA, 20 bp, Artificial Sequence
  Description of Artificial Sequence: Synthetic oligonucleotide
cgcggccccagtccggcctt

SEQ ID NO: 279431 - DNA, 20 bp, Artificial Sequence
  Description of Artificial Sequence: Synthetic oligonucleotide
gcggccccagtccggcctgt

SEQ ID NO: 279432 - DNA, 20 bp, Artificial Sequence
  Description of Artificial Sequence: Synthetic oligonucleotide
cggccccagtccggcctgtg

SEQ ID NO: 279433 - DNA, 22 bp, Artificial Sequence
  Description of Artificial Sequence: Synthetic oligonucleotide
ggccccagtccggcctgtgctt

SEQ ID NO: 279434 - DNA, 22 bp, Artificial Sequence
  Description of Artificial Sequence: Synthetic oligonucleotide
gccccagtccggcctgtgcttc

SEQ ID NO: 279435 - DNA, 23 bp, Artificial Sequence
  Description of Artificial Sequence: Synthetic oligonucleotide
ccccagtccggcctgtgcttcct

SEQ ID NO: 279436 - DNA, 23 bp, Artificial Sequence
  Description of Artificial Sequence: Synthetic oligonucleotide
cccagtccggcctgtgcttcctg

SEQ ID NO: 279437 - DNA, 23 bp, Artificial Sequence
  Description of Artificial Sequence: Synthetic oligonucleotide
ccagtccggcctgtgcttcctgg

SEQ ID NO: 279438 - DNA, 23 bp, Artificial Sequence
  Description of Artificial Sequence: Synthetic oligonucleotide
cagtccggcctgtgcttcctggg

SEQ ID NO: 279439 - DNA, 23 bp, Artificial Sequence
  Description of Artificial Sequence: Synthetic oligonucleotide
agtccggcctgtgcttcctgggg

SEQ ID NO: 279440 - DNA, 22 bp, Artificial Sequence
  Description of Artificial Sequence: Synthetic oligonucleotide
gtccggcctgtgcttcctgggg

SEQ ID NO: 279441 - DNA, 22 bp, Artificial Sequence
  Description of Artificial Sequence: Synthetic oligonucleotide
tccggcctgtgcttcctggggc

SEQ ID NO: 279442 - DNA, 21 bp, Artificial Sequence
  Description of Artificial Sequence: Synthetic oligonucleotide
ccggcctgtgcttcctggggc

SEQ ID NO: 279443 - DNA, 22 bp, Artificial Sequence
  Description of Artificial Sequence: Synthetic oligonucleotide
cggcctgtgcttcctggggcct

SEQ ID NO: 279444 - DNA, 23 bp, Artificial Sequence
  Description of Artificial Sequence: Synthetic oligonucleotide
ggcctgtgcttcctggggcctga

SEQ ID NO: 279445 - DNA, 23 bp, Artificial Sequence
  Description of Artificial Sequence: Synthetic oligonucleotide
gcctgtgcttcctggggcctgag

SEQ ID NO: 279446 - DNA, 23 bp, Artificial Sequence
  Description of Artificial Sequence: Synthetic oligonucleotide
cctgtgcttcctggggcctgagc

SEQ ID NO: 279447 - DNA, 24 bp, Artificial Sequence
  Description of Artificial Sequence: Synthetic oligonucleotide
ctgtgcttcctggggcctgagcct

SEQ ID NO: 279448 - DNA, 25 bp, Artificial Sequence
  Description of Artificial Sequence: Synthetic oligonucleotide
tgtgcttcctggggcctgagcctca

SEQ ID NO: 279449 - DNA, 24 bp, Artificial Sequence
  Description of Artificial Sequence: Synthetic oligonucleotide
gtgcttcctggggcctgagcctca

SEQ ID NO: 279450 - DNA, 24 bp, Artificial Sequence
  Description of Artificial Sequence: Synthetic oligonucleotide
tgcttcctggggcctgagcctcag

SEQ ID NO: 279451 - DNA, 23 bp, Artificial Sequence
  Description of Artificial Sequence: Synthetic oligonucleotide
gcttcctggggcctgagcctcag

SEQ ID NO: 279452 - DNA, 24 bp, Artificial Sequence
  Description of Artificial Sequence: Synthetic oligonucleotide
cttcctggggcctgagcctcagga

SEQ ID NO: 279453 - DNA, 24 bp, Artificial Sequence
  Description of Artificial Sequence: Synthetic oligonucleotide
ttcctggggcctgagcctcaggac

SEQ ID NO: 279454 - DNA, 23 bp, Artificial Sequence
  Description of Artificial Sequence: Synthetic oligonucleotide
tcctggggcctgagcctcaggac

SEQ ID NO: 279455 - DNA, 22 bp, Artificial Sequence
  Description of Artificial Sequence: Synthetic oligonucleotide
cctggggcctgagcctcaggac

SEQ ID NO: 279456 - DNA, 23 bp, Artificial Sequence
  Description of Artificial Sequence: Synthetic oligonucleotide
ctggggcctgagcctcaggacct

SEQ ID NO: 279457 - DNA, 23 bp, Artificial Sequence
  Description of Artificial Sequence: Synthetic oligonucleotide
tggggcctgagcctcaggacctg

SEQ ID NO: 279458 - DNA, 22 bp, Artificial Sequence
  Description of Artificial Sequence: Synthetic oligonucleotide
ggggcctgagcctcaggacctg

SEQ ID NO: 279459 - DNA, 23 bp, Artificial Sequence
  Description of Artificial Sequence: Synthetic oligonucleotide
gggcctgagcctcaggacctggt

SEQ ID NO: 279460 - DNA, 23 bp, Artificial Sequence
  Description of Artificial Sequence: Synthetic oligonucleotide
ggcctgagcctcaggacctggtg

SEQ ID NO: 279461 - DNA, 24 bp, Artificial Sequence
  Description of Artificial Sequence: Synthetic oligonucleotide
gcctgagcctcaggacctggtgga

SEQ ID NO: 279462 - DNA, 24 bp, Artificial Sequence
  Description of Artificial Sequence: Synthetic oligonucleotide
cctgagcctcaggacctggtggac

SEQ ID NO: 279463 - DNA, 25 bp, Artificial Sequence
  Description of Artificial Sequence: Synthetic oligonucleotide
ctgagcctcaggacctggtggacct

SEQ ID NO: 279464 - DNA, 27 bp, Artificial Sequence
  Description of Artificial Sequence: Synthetic oligonucleotide
tgagcctcaggacctggtggacctgta

SEQ ID NO: 279465 - DNA, 26 bp, Artificial Sequence
  Description of Artificial Sequence: Synthetic oligonucleotide
gagcctcaggacctggtggacctgta

SEQ ID NO: 279466 - DNA, 27 bp, Artificial Sequence
  Description of Artificial Sequence: Synthetic oligonucleotide
agcctcaggacctggtggacctgtaga

SEQ ID NO: 279467 - DNA, 26 bp, Artificial Sequence
  Description of Artificial Sequence: Synthetic oligonucleotide
gcctcaggacctggtggacctgtaga

SEQ ID NO: 279468 - DNA, 26 bp, Artificial Sequence
  Description of Artificial Sequence: Synthetic oligonucleotide
cctcaggacctggtggacctgtagag

SEQ ID NO: 279469 - DNA, 26 bp, Artificial Sequence
  Description of Artificial Sequence: Synthetic oligonucleotide
ctcaggacctggtggacctgtagagc

SEQ ID NO: 279470 - DNA, 26 bp, Artificial Sequence
  Description of Artificial Sequence: Synthetic oligonucleotide
tcaggacctggtggacctgtagagcc

SEQ ID NO: 279471 - DNA, 25 bp, Artificial Sequence
  Description of Artificial Sequence: Synthetic oligonucleotide
caggacctggtggacctgtagagcc

SEQ ID NO: 279472 - DNA, 25 bp, Artificial Sequence
  Description of Artificial Sequence: Synthetic oligonucleotide
aggacctggtggacctgtagagccg

SEQ ID NO: 279473 - DNA, 24 bp, Artificial Sequence
  Description of Artificial Sequence: Synthetic oligonucleotide
ggacctggtggacctgtagagccg

SEQ ID NO: 279474 - DNA, 26 bp, Artificial Sequence
  Description of Artificial Sequence: Synthetic oligonucleotide
gacctggtggacctgtagagccgcta

SEQ ID NO: 279475 - DNA, 27 bp, Artificial Sequence
  Description of Artificial Sequence: Synthetic oligonucleotide
acctggtggacctgtagagccgctact

SEQ ID NO: 279476 - DNA, 27 bp, Artificial Sequence
  Description of Artificial Sequence: Synthetic oligonucleotide
cctggtggacctgtagagccgctacta

SEQ ID NO: 279477 - DNA, 27 bp, Artificial Sequence
  Description of Artificial Sequence: Synthetic oligonucleotide
ctggtggacctgtagagccgctactag

SEQ ID NO: 279478 - DNA, 29 bp, Artificial Sequence
  Description of Artificial Sequence: Synthetic oligonucleotide
tggtggacctgtagagccgctactagaag

SEQ ID NO: 279479 - DNA, 28 bp, Artificial Sequence
  Description of Artificial Sequence: Synthetic oligonucleotide
ggtggacctgtagagccgctactagaag

SEQ ID NO: 279480 - DNA, 28 bp, Artificial Sequence
  Description of Artificial Sequence: Synthetic oligonucleotide
gtggacctgtagagccgctactagaagc

SEQ ID NO: 279481 - DNA, 29 bp, Artificial Sequence
  Description of Artificial Sequence: Synthetic oligonucleotide
tggacctgtagagccgctactagaagctg

SEQ ID NO: 279482 - DNA, 28 bp, Artificial Sequence
  Description of Artificial Sequence: Synthetic oligonucleotide
ggacctgtagagccgctactagaagctg

SEQ ID NO: 279483 - DNA, 28 bp, Artificial Sequence
  Description of Artificial Sequence: Synthetic oligonucleotide
gacctgtagagccgctactagaagctgc

SEQ ID NO: 279484 - DNA, 29 bp, Artificial Sequence
  Description of Artificial Sequence: Synthetic oligonucleotide
acctgtagagccgctactagaagctgctg

SEQ ID NO: 279485 - DNA, 28 bp, Artificial Sequence
  Description of Artificial Sequence: Synthetic oligonucleotide
cctgtagagccgctactagaagctgctg

SEQ ID NO: 279486 - DNA, 28 bp, Artificial Sequence
  Description of Artificial Sequence: Synthetic oligonucleotide
ctgtagagccgctactagaagctgctgc

SEQ ID NO: 279487 - DNA, 30 bp, Artificial Sequence
  Description of Artificial Sequence: Synthetic oligonucleotide
tgtagagccgctactagaagctgctgcaag

SEQ ID NO: 279488 - DNA, 29 bp, Artificial Sequence
  Description of Artificial Sequence: Synthetic oligonucleotide
gtagagccgctactagaagctgctgcaag

SEQ ID NO: 279489 - DNA, 30 bp, Artificial Sequence
  Description of Artificial Sequence: Synthetic oligonucleotide
tagagccgctactagaagctgctgcaagag

SEQ ID NO: 279490 - DNA, 29 bp, Artificial Sequence
  Description of Artificial Sequence: Synthetic oligonucleotide
agagccgctactagaagctgctgcaagag

SEQ ID NO: 279491 - DNA, 28 bp, Artificial Sequence
  Description of Artificial Sequence: Synthetic oligonucleotide
gagccgctactagaagctgctgcaagag

SEQ ID NO: 279492 - DNA, 28 bp, Artificial Sequence
  Description of Artificial Sequence: Synthetic oligonucleotide
agccgctactagaagctgctgcaagagc

SEQ ID NO: 279493 - DNA, 27 bp, Artificial Sequence
  Description of Artificial Sequence: Synthetic oligonucleotide
gccgctactagaagctgctgcaagagc

SEQ ID NO: 279494 - DNA, 28 bp, Artificial Sequence
  Description of Artificial Sequence: Synthetic oligonucleotide
ccgctactagaagctgctgcaagagctc

SEQ ID NO: 279495 - DNA, 28 bp, Artificial Sequence
  Description of Artificial Sequence: Synthetic oligonucleotide
cgctactagaagctgctgcaagagctcg

SEQ ID NO: 279496 - DNA, 29 bp, Artificial Sequence
  Description of Artificial Sequence: Synthetic oligonucleotide
gctactagaagctgctgcaagagctcgag

SEQ ID NO: 279497 - DNA, 31 bp, Artificial Sequence
  Description of Artificial Sequence: Synthetic oligonucleotide
ctactagaagctgctgcaagagctcgagttc

SEQ ID NO: 279498 - DNA, 31 bp, Artificial Sequence
  Description of Artificial Sequence: Synthetic oligonucleotide
tactagaagctgctgcaagagctcgagttcc

SEQ ID NO: 279499 - DNA, 30 bp, Artificial Sequence
  Description of Artificial Sequence: Synthetic oligonucleotide
actagaagctgctgcaagagctcgagttcc

SEQ ID NO: 279500 - DNA, 29 bp, Artificial Sequence
  Description of Artificial Sequence: Synthetic oligonucleotide
ctagaagctgctgcaagagctcgagttcc

SEQ ID NO: 279501 - DNA, 30 bp, Artificial Sequence
  Description of Artificial Sequence: Synthetic oligonucleotide
tagaagctgctgcaagagctcgagttcctg

SEQ ID NO: 279502 - DNA, 29 bp, Artificial Sequence
  Description of Artificial Sequence: Synthetic oligonucleotide
agaagctgctgcaagagctcgagttcctg

SEQ ID NO: 279503 - DNA, 28 bp, Artificial Sequence
  Description of Artificial Sequence: Synthetic oligonucleotide
gaagctgctgcaagagctcgagttcctg

SEQ ID NO: 279504 - DNA, 28 bp, Artificial Sequence
  Description of Artificial Sequence: Synthetic oligonucleotide
aagctgctgcaagagctcgagttcctgc

SEQ ID NO: 279505 - DNA, 27 bp, Artificial Sequence
  Description of Artificial Sequence: Synthetic oligonucleotide
agctgctgcaagagctcgagttcctgc

SEQ ID NO: 279506 - DNA, 27 bp, Artificial Sequence
  Description of Artificial Sequence: Synthetic oligonucleotide
gctgctgcaagagctcgagttcctgca

SEQ ID NO: 279507 - DNA, 27 bp, Artificial Sequence
  Description of Artificial Sequence: Synthetic oligonucleotide
ctgctgcaagagctcgagttcctgcag

SEQ ID NO: 279508 - DNA, 27 bp, Artificial Sequence
  Description of Artificial Sequence: Synthetic oligonucleotide
tgctgcaagagctcgagttcctgcagg

SEQ ID NO: 279509 - DNA, 27 bp, Artificial Sequence
  Description of Artificial Sequence: Synthetic oligonucleotide
gctgcaagagctcgagttcctgcaggt

SEQ ID NO: 279510 - DNA, 27 bp, Artificial Sequence
  Description of Artificial Sequence: Synthetic oligonucleotide
ctgcaagagctcgagttcctgcaggtg

SEQ ID NO: 279511 - DNA, 27 bp, Artificial Sequence
  Description of Artificial Sequence: Synthetic oligonucleotide
tgcaagagctcgagttcctgcaggtgc

SEQ ID NO: 279512 - DNA, 27 bp, Artificial Sequence
  Description of Artificial Sequence: Synthetic oligonucleotide
gcaagagctcgagttcctgcaggtgca

SEQ ID NO: 279513 - DNA, 27 bp, Artificial Sequence
  Description of Artificial Sequence: Synthetic oligonucleotide
caagagctcgagttcctgcaggtgcag

SEQ ID NO: 279514 - DNA, 27 bp, Artificial Sequence
  Description of Artificial Sequence: Synthetic oligonucleotide
aagagctcgagttcctgcaggtgcagg

SEQ ID NO: 279515 - DNA, 27 bp, Artificial Sequence
  Description of Artificial Sequence: Synthetic oligonucleotide
agagctcgagttcctgcaggtgcaggt

SEQ ID NO: 279516 - DNA, 26 bp, Artificial Sequence
  Description of Artificial Sequence: Synthetic oligonucleotide
gagctcgagttcctgcaggtgcaggt

SEQ ID NO: 279517 - DNA, 26 bp, Artificial Sequence
  Description of Artificial Sequence: Synthetic oligonucleotide
agctcgagttcctgcaggtgcaggtg

SEQ ID NO: 279518 - DNA, 25 bp, Artificial Sequence
  Description of Artificial Sequence: Synthetic oligonucleotide
gctcgagttcctgcaggtgcaggtg

SEQ ID NO: 279519 - DNA, 27 bp, Artificial Sequence
  Description of Artificial Sequence: Synthetic oligonucleotide
ctcgagttcctgcaggtgcaggtggaa

SEQ ID NO: 279520 - DNA, 29 bp, Artificial Sequence
  Description of Artificial Sequence: Synthetic oligonucleotide
tcgagttcctgcaggtgcaggtggaatac

SEQ ID NO: 279521 - DNA, 28 bp, Artificial Sequence
  Description of Artificial Sequence: Synthetic oligonucleotide
cgagttcctgcaggtgcaggtggaatac

SEQ ID NO: 279522 - DNA, 30 bp, Artificial Sequence
  Description of Artificial Sequence: Synthetic oligonucleotide
gagttcctgcaggtgcaggtggaatacatg

SEQ ID NO: 279523 - DNA, 33 bp, Artificial Sequence
  Description of Artificial Sequence: Synthetic oligonucleotide
agttcctgcaggtgcaggtggaatacatgaaag

SEQ ID NO: 279524 - DNA, 32 bp, Artificial Sequence
  Description of Artificial Sequence: Synthetic oligonucleotide
gttcctgcaggtgcaggtggaatacatgaaag

SEQ ID NO: 279525 - DNA, 34 bp, Artificial Sequence
  Description of Artificial Sequence: Synthetic oligonucleotide
ttcctgcaggtgcaggtggaatacatgaaagatg

SEQ ID NO: 279526 - DNA, 33 bp, Artificial Sequence
  Description of Artificial Sequence: Synthetic oligonucleotide
tcctgcaggtgcaggtggaatacatgaaagatg

SEQ ID NO: 279527 - DNA, 32 bp, Artificial Sequence
  Description of Artificial Sequence: Synthetic oligonucleotide
cctgcaggtgcaggtggaatacatgaaagatg

SEQ ID NO: 279528 - DNA, 33 bp, Artificial Sequence
  Description of Artificial Sequence: Synthetic oligonucleotide
ctgcaggtgcaggtggaatacatgaaagatgag

SEQ ID NO: 279529 - DNA, 33 bp, Artificial Sequence
  Description of Artificial Sequence: Synthetic oligonucleotide
tgcaggtgcaggtggaatacatgaaagatgagg

SEQ ID NO: 279530 - DNA, 32 bp, Artificial Sequence
  Description of Artificial Sequence: Synthetic oligonucleotide
gcaggtgcaggtggaatacatgaaagatgagg

SEQ ID NO: 279531 - DNA, 36 bp, Artificial Sequence
  Description of Artificial Sequence: Synthetic oligonucleotide
caggtgcaggtggaatacatgaaagatgaggaaaag

SEQ ID NO: 279532 - DNA, 38 bp, Artificial Sequence
  Description of Artificial Sequence: Synthetic oligonucleotide
aggtgcaggtggaatacatgaaagatgaggaaaagaac

SEQ ID NO: 279533 - DNA, 37 bp, Artificial Sequence
  Description of Artificial Sequence: Synthetic oligonucleotide
ggtgcaggtggaatacatgaaagatgaggaaaagaac

SEQ ID NO: 279534 - DNA, 37 bp, Artificial Sequence
  Description of Artificial Sequence: Synthetic oligonucleotide
gtgcaggtggaatacatgaaagatgaggaaaagaacc

SEQ ID NO: 279535 - DNA, 38 bp, Artificial Sequence
  Description of Artificial Sequence: Synthetic oligonucleotide
tgcaggtggaatacatgaaagatgaggaaaagaaccag

SEQ ID NO: 279536 - DNA, 37 bp, Artificial Sequence
  Description of Artificial Sequence: Synthetic oligonucleotide
gcaggtggaatacatgaaagatgaggaaaagaaccag

SEQ ID NO: 279537 - DNA, 42 bp, Artificial Sequence
  Description of Artificial Sequence: Synthetic oligonucleotide
caggtggaatacatgaaagatgaggaaaagaaccagaaaaag

SEQ ID NO: 279538 - DNA, 42 bp, Artificial Sequence
  Description of Artificial Sequence: Synthetic oligonucleotide
aggtggaatacatgaaagatgaggaaaagaaccagaaaaagg

SEQ ID NO: 279539 - DNA, 41 bp, Artificial Sequence
  Description of Artificial Sequence: Synthetic oligonucleotide
ggtggaatacatgaaagatgaggaaaagaaccagaaaaagg

SEQ ID NO: 279540 - DNA, 46 bp, Artificial Sequence
  Description of Artificial Sequence: Synthetic oligonucleotide
gtggaatacatgaaagatgaggaaaagaaccagaaaaaggattttc

SEQ ID NO: 279541 - DNA, 47 bp, Artificial Sequence
  Description of Artificial Sequence: Synthetic oligonucleotide
tggaatacatgaaagatgaggaaaagaaccagaaaaaggattttctc

SEQ ID NO: 279542 - DNA, 46 bp, Artificial Sequence
  Description of Artificial Sequence: Synthetic oligonucleotide
ggaatacatgaaagatgaggaaaagaaccagaaaaaggattttctc

SEQ ID NO: 279543 - DNA, 46 bp, Artificial Sequence
  Description of Artificial Sequence: Synthetic oligonucleotide
gaatacatgaaagatgaggaaaagaaccagaaaaaggattttctcc

SEQ ID NO: 279544 - DNA, 48 bp, Artificial Sequence
  Description of Artificial Sequence: Synthetic oligonucleotide
aatacatgaaagatgaggaaaagaaccagaaaaaggattttctccatc

SEQ ID NO: 279545 - DNA, 47 bp, Artificial Sequence
  Description of Artificial Sequence: Synthetic oligonucleotide
atacatgaaagatgaggaaaagaaccagaaaaaggattttctccatc

SEQ ID NO: 279546 - DNA, 46 bp, Artificial Sequence
  Description of Artificial Sequence: Synthetic oligonucleotide
tacatgaaagatgaggaaaagaaccagaaaaaggattttctccatc

SEQ ID NO: 279547 - DNA, 45 bp, Artificial Sequence
  Description of Artificial Sequence: Synthetic oligonucleotide
acatgaaagatgaggaaaagaaccagaaaaaggattttctccatc

SEQ ID NO: 279548 - DNA, 44 bp, Artificial Sequence
  Description of Artificial Sequence: Synthetic oligonucleotide
catgaaagatgaggaaaagaaccagaaaaaggattttctccatc

SEQ ID NO: 279549 - DNA, 44 bp, Artificial Sequence
  Description of Artificial Sequence: Synthetic oligonucleotide
atgaaagatgaggaaaagaaccagaaaaaggattttctccatcc

SEQ ID NO: 279550 - DNA, 43 bp, Artificial Sequence
  Description of Artificial Sequence: Synthetic oligonucleotide
tgaaagatgaggaaaagaaccagaaaaaggattttctccatcc

SEQ ID NO: 279551 - DNA, 42 bp, Artificial Sequence
  Description of Artificial Sequence: Synthetic oligonucleotide
gaaagatgaggaaaagaaccagaaaaaggattttctccatcc

SEQ ID NO: 279552 - DNA, 42 bp, Artificial Sequence
  Description of Artificial Sequence: Synthetic oligonucleotide
aaagatgaggaaaagaaccagaaaaaggattttctccatccc

SEQ ID NO: 279553 - DNA, 41 bp, Artificial Sequence
  Description of Artificial Sequence: Synthetic oligonucleotide
aagatgaggaaaagaaccagaaaaaggattttctccatccc

SEQ ID NO: 279554 - DNA, 40 bp, Artificial Sequence
  Description of Artificial Sequence: Synthetic oligonucleotide
agatgaggaaaagaaccagaaaaaggattttctccatccc

SEQ ID NO: 279555 - DNA, 39 bp, Artificial Sequence
  Description of Artificial Sequence: Synthetic oligonucleotide
gatgaggaaaagaaccagaaaaaggattttctccatccc

SEQ ID NO: 279556 - DNA, 39 bp, Artificial Sequence
  Description of Artificial Sequence: Synthetic oligonucleotide
atgaggaaaagaaccagaaaaaggattttctccatcccc

SEQ ID NO: 279557 - DNA, 38 bp, Artificial Sequence
  Description of Artificial Sequence: Synthetic oligonucleotide
tgaggaaaagaaccagaaaaaggattttctccatcccc

SEQ ID NO: 279558 - DNA, 37 bp, Artificial Sequence
  Description of Artificial Sequence: Synthetic oligonucleotide
gaggaaaagaaccagaaaaaggattttctccatcccc

SEQ ID NO: 279559 - DNA, 38 bp, Artificial Sequence
  Description of Artificial Sequence: Synthetic oligonucleotide
aggaaaagaaccagaaaaaggattttctccatccccag

SEQ ID NO: 279560 - DNA, 37 bp, Artificial Sequence
  Description of Artificial Sequence: Synthetic oligonucleotide
ggaaaagaaccagaaaaaggattttctccatccccag

SEQ ID NO: 279561 - DNA, 37 bp, Artificial Sequence
  Description of Artificial Sequence: Synthetic oligonucleotide
gaaaagaaccagaaaaaggattttctccatccccagg

SEQ ID NO: 279562 - DNA, 38 bp, Artificial Sequence
  Description of Artificial Sequence: Synthetic oligonucleotide
aaaagaaccagaaaaaggattttctccatccccaggag

SEQ ID NO: 279563 - DNA, 37 bp, Artificial Sequence
  Description of Artificial Sequence: Synthetic oligonucleotide
aaagaaccagaaaaaggattttctccatccccaggag

SEQ ID NO: 279564 - DNA, 36 bp, Artificial Sequence
  Description of Artificial Sequence: Synthetic oligonucleotide
aagaaccagaaaaaggattttctccatccccaggag

SEQ ID NO: 279565 - DNA, 35 bp, Artificial Sequence
  Description of Artificial Sequence: Synthetic oligonucleotide
agaaccagaaaaaggattttctccatccccaggag

SEQ ID NO: 279566 - DNA, 34 bp, Artificial Sequence
  Description of Artificial Sequence: Synthetic oligonucleotide
gaaccagaaaaaggattttctccatccccaggag

SEQ ID NO: 279567 - DNA, 34 bp, Artificial Sequence
  Description of Artificial Sequence: Synthetic oligonucleotide
aaccagaaaaaggattttctccatccccaggagg

SEQ ID NO: 279568 - DNA, 33 bp, Artificial Sequence
  Description of Artificial Sequence: Synthetic oligonucleotide
accagaaaaaggattttctccatccccaggagg

SEQ ID NO: 279569 - DNA, 32 bp, Artificial Sequence
  Description of Artificial Sequence: Synthetic oligonucleotide
ccagaaaaaggattttctccatccccaggagg

SEQ ID NO: 279570 - DNA, 33 bp, Artificial Sequence
  Description of Artificial Sequence: Synthetic oligonucleotide
cagaaaaaggattttctccatccccaggaggtg

SEQ ID NO: 279571 - DNA, 33 bp, Artificial Sequence
  Description of Artificial Sequence: Synthetic oligonucleotide
agaaaaaggattttctccatccccaggaggtgg

SEQ ID NO: 279572 - DNA, 32 bp, Artificial Sequence
  Description of Artificial Sequence: Synthetic oligonucleotide
gaaaaaggattttctccatccccaggaggtgg

SEQ ID NO: 279573 - DNA, 33 bp, Artificial Sequence
  Description of Artificial Sequence: Synthetic oligonucleotide
aaaaaggattttctccatccccaggaggtggtg

SEQ ID NO: 279574 - DNA, 32 bp, Artificial Sequence
  Description of Artificial Sequence: Synthetic oligonucleotide
aaaaggattttctccatccccaggaggtggtg

SEQ ID NO: 279575 - DNA, 31 bp, Artificial Sequence
  Description of Artificial Sequence: Synthetic oligonucleotide
aaaggattttctccatccccaggaggtggtg

SEQ ID NO: 279576 - DNA, 30 bp, Artificial Sequence
  Description of Artificial Sequence: Synthetic oligonucleotide
aaggattttctccatccccaggaggtggtg

SEQ ID NO: 279577 - DNA, 29 bp, Artificial Sequence
  Description of Artificial Sequence: Synthetic oligonucleotide
aggattttctccatccccaggaggtggtg

SEQ ID NO: 279578 - DNA, 28 bp, Artificial Sequence
  Description of Artificial Sequence: Synthetic oligonucleotide
ggattttctccatccccaggaggtggtg

SEQ ID NO: 279579 - DNA, 30 bp, Artificial Sequence
  Description of Artificial Sequence: Synthetic oligonucleotide
gattttctccatccccaggaggtggtgaag

SEQ ID NO: 279580 - DNA, 30 bp, Artificial Sequence
  Description of Artificial Sequence: Synthetic oligonucleotide
attttctccatccccaggaggtggtgaagc

SEQ ID NO: 279581 - DNA, 29 bp, Artificial Sequence
  Description of Artificial Sequence: Synthetic oligonucleotide
ttttctccatccccaggaggtggtgaagc

SEQ ID NO: 279582 - DNA, 28 bp, Artificial Sequence
  Description of Artificial Sequence: Synthetic oligonucleotide
tttctccatccccaggaggtggtgaagc

SEQ ID NO: 279583 - DNA, 27 bp, Artificial Sequence
  Description of Artificial Sequence: Synthetic oligonucleotide
ttctccatccccaggaggtggtgaagc

SEQ ID NO: 279584 - DNA, 26 bp, Artificial Sequence
  Description of Artificial Sequence: Synthetic oligonucleotide
tctccatccccaggaggtggtgaagc

SEQ ID NO: 279585 - DNA, 25 bp, Artificial Sequence
  Description of Artificial Sequence: Synthetic oligonucleotide
ctccatccccaggaggtggtgaagc

SEQ ID NO: 279586 - DNA, 27 bp, Artificial Sequence
  Description of Artificial Sequence: Synthetic oligonucleotide
tccatccccaggaggtggtgaagcgta

SEQ ID NO: 279587 - DNA, 27 bp, Artificial Sequence
  Description of Artificial Sequence: Synthetic oligonucleotide
ccatccccaggaggtggtgaagcgtat

SEQ ID NO: 279588 - DNA, 27 bp, Artificial Sequence
  Description of Artificial Sequence: Synthetic oligonucleotide
catccccaggaggtggtgaagcgtatc

SEQ ID NO: 279589 - DNA, 27 bp, Artificial Sequence
  Description of Artificial Sequence: Synthetic oligonucleotide
atccccaggaggtggtgaagcgtatcc

SEQ ID NO: 279590 - DNA, 27 bp, Artificial Sequence
  Description of Artificial Sequence: Synthetic oligonucleotide
tccccaggaggtggtgaagcgtatcca

SEQ ID NO: 279591 - DNA, 27 bp, Artificial Sequence
  Description of Artificial Sequence: Synthetic oligonucleotide
ccccaggaggtggtgaagcgtatccaa

SEQ ID NO: 279592 - DNA, 28 bp, Artificial Sequence
  Description of Artificial Sequence: Synthetic oligonucleotide
cccaggaggtggtgaagcgtatccaaag

SEQ ID NO: 279593 - DNA, 28 bp, Artificial Sequence
  Description of Artificial Sequence: Synthetic oligonucleotide
ccaggaggtggtgaagcgtatccaaagc

SEQ ID NO: 279594 - DNA, 30 bp, Artificial Sequence
  Description of Artificial Sequence: Synthetic oligonucleotide
caggaggtggtgaagcgtatccaaagcttc

SEQ ID NO: 279595 - DNA, 30 bp, Artificial Sequence
  Description of Artificial Sequence: Synthetic oligonucleotide
aggaggtggtgaagcgtatccaaagcttcc

SEQ ID NO: 279596 - DNA, 29 bp, Artificial Sequence
  Description of Artificial Sequence: Synthetic oligonucleotide
ggaggtggtgaagcgtatccaaagcttcc

SEQ ID NO: 279597 - DNA, 29 bp, Artificial Sequence
  Description of Artificial Sequence: Synthetic oligonucleotide
gaggtggtgaagcgtatccaaagcttccc

SEQ ID NO: 279598 - DNA, 29 bp, Artificial Sequence
  Description of Artificial Sequence: Synthetic oligonucleotide
aggtggtgaagcgtatccaaagcttcccg

SEQ ID NO: 279599 - DNA, 28 bp, Artificial Sequence
  Description of Artificial Sequence: Synthetic oligonucleotide
ggtggtgaagcgtatccaaagcttcccg

SEQ ID NO: 279600 - DNA, 28 bp, Artificial Sequence
  Description of Artificial Sequence: Synthetic oligonucleotide
gtggtgaagcgtatccaaagcttcccgc

SEQ ID NO: 279601 - DNA, 29 bp, Artificial Sequence
  Description of Artificial Sequence: Synthetic oligonucleotide
tggtgaagcgtatccaaagcttcccgctg

SEQ ID NO: 279602 - DNA, 28 bp, Artificial Sequence
  Description of Artificial Sequence: Synthetic oligonucleotide
ggtgaagcgtatccaaagcttcccgctg

SEQ ID NO: 279603 - DNA, 28 bp, Artificial Sequence
  Description of Artificial Sequence: Synthetic oligonucleotide
gtgaagcgtatccaaagcttcccgctgg

SEQ ID NO: 279604 - DNA, 29 bp, Artificial Sequence
  Description of Artificial Sequence: Synthetic oligonucleotide
tgaagcgtatccaaagcttcccgctggac

SEQ ID NO: 279605 - DNA, 28 bp, Artificial Sequence
  Description of Artificial Sequence: Synthetic oligonucleotide
gaagcgtatccaaagcttcccgctggac

SEQ ID NO: 279606 - DNA, 30 bp, Artificial Sequence
  Description of Artificial Sequence: Synthetic oligonucleotide
aagcgtatccaaagcttcccgctggacatc

SEQ ID NO: 279607 - DNA, 29 bp, Artificial Sequence
  Description of Artificial Sequence: Synthetic oligonucleotide
agcgtatccaaagcttcccgctggacatc

SEQ ID NO: 279608 - DNA, 28 bp, Artificial Sequence
  Description of Artificial Sequence: Synthetic oligonucleotide
gcgtatccaaagcttcccgctggacatc

SEQ ID NO: 279609 - DNA, 28 bp, Artificial Sequence
  Description of Artificial Sequence: Synthetic oligonucleotide
cgtatccaaagcttcccgctggacatcg

SEQ ID NO: 279610 - DNA, 28 bp, Artificial Sequence
  Description of Artificial Sequence: Synthetic oligonucleotide
gtatccaaagcttcccgctggacatcgg

SEQ ID NO: 279611 - DNA, 29 bp, Artificial Sequence
  Description of Artificial Sequence: Synthetic oligonucleotide
tatccaaagcttcccgctggacatcggac

SEQ ID NO: 279612 - DNA, 28 bp, Artificial Sequence
  Description of Artificial Sequence: Synthetic oligonucleotide
atccaaagcttcccgctggacatcggac

SEQ ID NO: 279613 - DNA, 27 bp, Artificial Sequence
  Description of Artificial Sequence: Synthetic oligonucleotide
tccaaagcttcccgctggacatcggac

SEQ ID NO: 279614 - DNA, 27 bp, Artificial Sequence
  Description of Artificial Sequence: Synthetic oligonucleotide
ccaaagcttcccgctggacatcggaca

SEQ ID NO: 279615 - DNA, 31 bp, Artificial Sequence
  Description of Artificial Sequence: Synthetic oligonucleotide
caaagcttcccgctggacatcggacattttc

SEQ ID NO: 279616 - DNA, 32 bp, Artificial Sequence
  Description of Artificial Sequence: Synthetic oligonucleotide
aaagcttcccgctggacatcggacattttctg

SEQ ID NO: 279617 - DNA, 31 bp, Artificial Sequence
  Description of Artificial Sequence: Synthetic oligonucleotide
aagcttcccgctggacatcggacattttctg

SEQ ID NO: 279618 - DNA, 30 bp, Artificial Sequence
  Description of Artificial Sequence: Synthetic oligonucleotide
agcttcccgctggacatcggacattttctg

SEQ ID NO: 279619 - DNA, 29 bp, Artificial Sequence
  Description of Artificial Sequence: Synthetic oligonucleotide
gcttcccgctggacatcggacattttctg

SEQ ID NO: 279620 - DNA, 29 bp, Artificial Sequence
  Description of Artificial Sequence: Synthetic oligonucleotide
cttcccgctggacatcggacattttctgg

SEQ ID NO: 279621 - DNA, 30 bp, Artificial Sequence
  Description of Artificial Sequence: Synthetic oligonucleotide
ttcccgctggacatcggacattttctggag

SEQ ID NO: 279622 - DNA, 29 bp, Artificial Sequence
  Description of Artificial Sequence: Synthetic oligonucleotide
tcccgctggacatcggacattttctggag

SEQ ID NO: 279623 - DNA, 28 bp, Artificial Sequence
  Description of Artificial Sequence: Synthetic oligonucleotide
cccgctggacatcggacattttctggag

SEQ ID NO: 279624 - DNA, 28 bp, Artificial Sequence
  Description of Artificial Sequence: Synthetic oligonucleotide
ccgctggacatcggacattttctggagc

SEQ ID NO: 279625 - DNA, 28 bp, Artificial Sequence
  Description of Artificial Sequence: Synthetic oligonucleotide
cgctggacatcggacattttctggagcc

SEQ ID NO: 279626 - DNA, 29 bp, Artificial Sequence
  Description of Artificial Sequence: Synthetic oligonucleotide
gctggacatcggacattttctggagcctg

SEQ ID NO: 279627 - DNA, 30 bp, Artificial Sequence
  Description of Artificial Sequence: Synthetic oligonucleotide
ctggacatcggacattttctggagcctgtg

SEQ ID NO: 279628 - DNA, 30 bp, Artificial Sequence
  Description of Artificial Sequence: Synthetic oligonucleotide
tggacatcggacattttctggagcctgtgg

SEQ ID NO: 279629 - DNA, 29 bp, Artificial Sequence
  Description of Artificial Sequence: Synthetic oligonucleotide
ggacatcggacattttctggagcctgtgg

SEQ ID NO: 279630 - DNA, 31 bp, Artificial Sequence
  Description of Artificial Sequence: Synthetic oligonucleotide
gacatcggacattttctggagcctgtggatc

SEQ ID NO: 279631 - DNA, 32 bp, Artificial Sequence
  Description of Artificial Sequence: Synthetic oligonucleotide
acatcggacattttctggagcctgtggatctg

SEQ ID NO: 279632 - DNA, 31 bp, Artificial Sequence
  Description of Artificial Sequence: Synthetic oligonucleotide
catcggacattttctggagcctgtggatctg

SEQ ID NO: 279633 - DNA, 35 bp, Artificial Sequence
  Description of Artificial Sequence: Synthetic oligonucleotide
atcggacattttctggagcctgtggatctgaatac

SEQ ID NO: 279634 - DNA, 34 bp, Artificial Sequence
  Description of Artificial Sequence: Synthetic oligonucleotide
tcggacattttctggagcctgtggatctgaatac

SEQ ID NO: 279635 - DNA, 33 bp, Artificial Sequence
  Description of Artificial Sequence: Synthetic oligonucleotide
cggacattttctggagcctgtggatctgaatac

SEQ ID NO: 279636 - DNA, 34 bp, Artificial Sequence
  Description of Artificial Sequence: Synthetic oligonucleotide
ggacattttctggagcctgtggatctgaatacag

SEQ ID NO: 279637 - DNA, 34 bp, Artificial Sequence
  Description of Artificial Sequence: Synthetic oligonucleotide
gacattttctggagcctgtggatctgaatacagc

SEQ ID NO: 279638 - DNA, 34 bp, Artificial Sequence
  Description of Artificial Sequence: Synthetic oligonucleotide
acattttctggagcctgtggatctgaatacagcg

SEQ ID NO: 279639 - DNA, 33 bp, Artificial Sequence
  Description of Artificial Sequence: Synthetic oligonucleotide
cattttctggagcctgtggatctgaatacagcg

SEQ ID NO: 279640 - DNA, 35 bp, Artificial Sequence
  Description of Artificial Sequence: Synthetic oligonucleotide
attttctggagcctgtggatctgaatacagcgatc

SEQ ID NO: 279641 - DNA, 34 bp, Artificial Sequence
  Description of Artificial Sequence: Synthetic oligonucleotide
ttttctggagcctgtggatctgaatacagcgatc

SEQ ID NO: 279642 - DNA, 33 bp, Artificial Sequence
  Description of Artificial Sequence: Synthetic oligonucleotide
tttctggagcctgtggatctgaatacagcgatc

SEQ ID NO: 279643 - DNA, 32 bp, Artificial Sequence
  Description of Artificial Sequence: Synthetic oligonucleotide
ttctggagcctgtggatctgaatacagcgatc

SEQ ID NO: 279644 - DNA, 31 bp, Artificial Sequence
  Description of Artificial Sequence: Synthetic oligonucleotide
tctggagcctgtggatctgaatacagcgatc

SEQ ID NO: 279645 - DNA, 30 bp, Artificial Sequence
  Description of Artificial Sequence: Synthetic oligonucleotide
ctggagcctgtggatctgaatacagcgatc

SEQ ID NO: 279646 - DNA, 30 bp, Artificial Sequence
  Description of Artificial Sequence: Synthetic oligonucleotide
tggagcctgtggatctgaatacagcgatcg

SEQ ID NO: 279647 - DNA, 29 bp, Artificial Sequence
  Description of Artificial Sequence: Synthetic oligonucleotide
ggagcctgtggatctgaatacagcgatcg

SEQ ID NO: 279648 - DNA, 30 bp, Artificial Sequence
  Description of Artificial Sequence: Synthetic oligonucleotide
gagcctgtggatctgaatacagcgatcgtg

SEQ ID NO: 279649 - DNA, 30 bp, Artificial Sequence
  Description of Artificial Sequence: Synthetic oligonucleotide
agcctgtggatctgaatacagcgatcgtgg

SEQ ID NO: 279650 - DNA, 29 bp, Artificial Sequence
  Description of Artificial Sequence: Synthetic oligonucleotide
gcctgtggatctgaatacagcgatcgtgg

SEQ ID NO: 279651 - DNA, 29 bp, Artificial Sequence
  Description of Artificial Sequence: Synthetic oligonucleotide
cctgtggatctgaatacagcgatcgtggg

SEQ ID NO: 279652 - DNA, 29 bp, Artificial Sequence
  Description of Artificial Sequence: Synthetic oligonucleotide
ctgtggatctgaatacagcgatcgtgggc

SEQ ID NO: 279653 - DNA, 30 bp, Artificial Sequence
  Description of Artificial Sequence: Synthetic oligonucleotide
tgtggatctgaatacagcgatcgtgggcac

SEQ ID NO: 279654 - DNA, 29 bp, Artificial Sequence
  Description of Artificial Sequence: Synthetic oligonucleotide
gtggatctgaatacagcgatcgtgggcac

SEQ ID NO: 279655 - DNA, 31 bp, Artificial Sequence
  Description of Artificial Sequence: Synthetic oligonucleotide
tggatctgaatacagcgatcgtgggcactac

SEQ ID NO: 279656 - DNA, 30 bp, Artificial Sequence
  Description of Artificial Sequence: Synthetic oligonucleotide
ggatctgaatacagcgatcgtgggcactac

SEQ ID NO: 279657 - DNA, 30 bp, Artificial Sequence
  Description of Artificial Sequence: Synthetic oligonucleotide
gatctgaatacagcgatcgtgggcactacc

SEQ ID NO: 279658 - DNA, 31 bp, Artificial Sequence
  Description of Artificial Sequence: Synthetic oligonucleotide
atctgaatacagcgatcgtgggcactaccac

SEQ ID NO: 279659 - DNA, 30 bp, Artificial Sequence
  Description of Artificial Sequence: Synthetic oligonucleotide
tctgaatacagcgatcgtgggcactaccac

SEQ ID NO: 279660 - DNA, 29 bp, Artificial Sequence
  Description of Artificial Sequence: Synthetic oligonucleotide
ctgaatacagcgatcgtgggcactaccac

SEQ ID NO: 279661 - DNA, 30 bp, Artificial Sequence
  Description of Artificial Sequence: Synthetic oligonucleotide
tgaatacagcgatcgtgggcactaccacag

SEQ ID NO: 279662 - DNA, 29 bp, Artificial Sequence
  Description of Artificial Sequence: Synthetic oligonucleotide
gaatacagcgatcgtgggcactaccacag

SEQ ID NO: 279663 - DNA, 29 bp, Artificial Sequence
  Description of Artificial Sequence: Synthetic oligonucleotide
aatacagcgatcgtgggcactaccacagc

SEQ ID NO: 279664 - DNA, 28 bp, Artificial Sequence
  Description of Artificial Sequence: Synthetic oligonucleotide
atacagcgatcgtgggcactaccacagc

SEQ ID NO: 279665 - DNA, 27 bp, Artificial Sequence
  Description of Artificial Sequence: Synthetic oligonucleotide
tacagcgatcgtgggcactaccacagc

SEQ ID NO: 279666 - DNA, 26 bp, Artificial Sequence
  Description of Artificial Sequence: Synthetic oligonucleotide
acagcgatcgtgggcactaccacagc

SEQ ID NO: 279667 - DNA, 25 bp, Artificial Sequence
  Description of Artificial Sequence: Synthetic oligonucleotide
cagcgatcgtgggcactaccacagc

SEQ ID NO: 279668 - DNA, 26 bp, Artificial Sequence
  Description of Artificial Sequence: Synthetic oligonucleotide
agcgatcgtgggcactaccacagcct

SEQ ID NO: 279669 - DNA, 25 bp, Artificial Sequence
  Description of Artificial Sequence: Synthetic oligonucleotide
gcgatcgtgggcactaccacagcct

SEQ ID NO: 279670 - DNA, 25 bp, Artificial Sequence
  Description of Artificial Sequence: Synthetic oligonucleotide
cgatcgtgggcactaccacagcctc

SEQ ID NO: 279671 - DNA, 27 bp, Artificial Sequence
  Description of Artificial Sequence: Synthetic oligonucleotide
gatcgtgggcactaccacagcctccaa

SEQ ID NO: 279672 - DNA, 27 bp, Artificial Sequence
  Description of Artificial Sequence: Synthetic oligonucleotide
atcgtgggcactaccacagcctccaac

SEQ ID NO: 279673 - DNA, 27 bp, Artificial Sequence
  Description of Artificial Sequence: Synthetic oligonucleotide
tcgtgggcactaccacagcctccaact

SEQ ID NO: 279674 - DNA, 27 bp, Artificial Sequence
  Description of Artificial Sequence: Synthetic oligonucleotide
cgtgggcactaccacagcctccaacta

SEQ ID NO: 279675 - DNA, 31 bp, Artificial Sequence
  Description of Artificial Sequence: Synthetic oligonucleotide
gtgggcactaccacagcctccaactaatatg

SEQ ID NO: 279676 - DNA, 32 bp, Artificial Sequence
  Description of Artificial Sequence: Synthetic oligonucleotide
tgggcactaccacagcctccaactaatatgtg

SEQ ID NO: 279677 - DNA, 31 bp, Artificial Sequence
  Description of Artificial Sequence: Synthetic oligonucleotide
gggcactaccacagcctccaactaatatgtg

SEQ ID NO: 279678 - DNA, 31 bp, Artificial Sequence
  Description of Artificial Sequence: Synthetic oligonucleotide
ggcactaccacagcctccaactaatatgtgc

SEQ ID NO: 279679 - DNA, 31 bp, Artificial Sequence
  Description of Artificial Sequence: Synthetic oligonucleotide
gcactaccacagcctccaactaatatgtgcg

SEQ ID NO: 279680 - DNA, 31 bp, Artificial Sequence
  Description of Artificial Sequence: Synthetic oligonucleotide
cactaccacagcctccaactaatatgtgcgc

SEQ ID NO: 279681 - DNA, 33 bp, Artificial Sequence
  Description of Artificial Sequence: Synthetic oligonucleotide
actaccacagcctccaactaatatgtgcgcttc

SEQ ID NO: 279682 - DNA, 32 bp, Artificial Sequence
  Description of Artificial Sequence: Synthetic oligonucleotide
ctaccacagcctccaactaatatgtgcgcttc

SEQ ID NO: 279683 - DNA, 32 bp, Artificial Sequence
  Description of Artificial Sequence: Synthetic oligonucleotide
taccacagcctccaactaatatgtgcgcttcc

SEQ ID NO: 279684 - DNA, 31 bp, Artificial Sequence
  Description of Artificial Sequence: Synthetic oligonucleotide
accacagcctccaactaatatgtgcgcttcc

SEQ ID NO: 279685 - DNA, 30 bp, Artificial Sequence
  Description of Artificial Sequence: Synthetic oligonucleotide
ccacagcctccaactaatatgtgcgcttcc

SEQ ID NO: 279686 - DNA, 31 bp, Artificial Sequence
  Description of Artificial Sequence: Synthetic oligonucleotide
cacagcctccaactaatatgtgcgcttcctg

SEQ ID NO: 279687 - DNA, 32 bp, Artificial Sequence
  Description of Artificial Sequence: Synthetic oligonucleotide
acagcctccaactaatatgtgcgcttcctgag

SEQ ID NO: 279688 - DNA, 31 bp, Artificial Sequence
  Description of Artificial Sequence: Synthetic oligonucleotide
cagcctccaactaatatgtgcgcttcctgag

SEQ ID NO: 279689 - DNA, 31 bp, Artificial Sequence
  Description of Artificial Sequence: Synthetic oligonucleotide
agcctccaactaatatgtgcgcttcctgagc

SEQ ID NO: 279690 - DNA, 30 bp, Artificial Sequence
  Description of Artificial Sequence: Synthetic oligonucleotide
gcctccaactaatatgtgcgcttcctgagc

SEQ ID NO: 279691 - DNA, 31 bp, Artificial Sequence
  Description of Artificial Sequence: Synthetic oligonucleotide
cctccaactaatatgtgcgcttcctgagcag

SEQ ID NO: 279692 - DNA, 31 bp, Artificial Sequence
  Description of Artificial Sequence: Synthetic oligonucleotide
ctccaactaatatgtgcgcttcctgagcagc

SEQ ID NO: 279693 - DNA, 33 bp, Artificial Sequence
  Description of Artificial Sequence: Synthetic oligonucleotide
tccaactaatatgtgcgcttcctgagcagcatc

SEQ ID NO: 279694 - DNA, 32 bp, Artificial Sequence
  Description of Artificial Sequence: Synthetic oligonucleotide
ccaactaatatgtgcgcttcctgagcagcatc

SEQ ID NO: 279695 - DNA, 32 bp, Artificial Sequence
  Description of Artificial Sequence: Synthetic oligonucleotide
caactaatatgtgcgcttcctgagcagcatcg

SEQ ID NO: 279696 - DNA, 34 bp, Artificial Sequence
  Description of Artificial Sequence: Synthetic oligonucleotide
aactaatatgtgcgcttcctgagcagcatcgatc

SEQ ID NO: 279697 - DNA, 33 bp, Artificial Sequence
  Description of Artificial Sequence: Synthetic oligonucleotide
actaatatgtgcgcttcctgagcagcatcgatc

SEQ ID NO: 279698 - DNA, 32 bp, Artificial Sequence
  Description of Artificial Sequence: Synthetic oligonucleotide
ctaatatgtgcgcttcctgagcagcatcgatc

SEQ ID NO: 279699 - DNA, 32 bp, Artificial Sequence
  Description of Artificial Sequence: Synthetic oligonucleotide
taatatgtgcgcttcctgagcagcatcgatcg

SEQ ID NO: 279700 - DNA, 31 bp, Artificial Sequence
  Description of Artificial Sequence: Synthetic oligonucleotide
aatatgtgcgcttcctgagcagcatcgatcg

SEQ ID NO: 279701 - DNA, 30 bp, Artificial Sequence
  Description of Artificial Sequence: Synthetic oligonucleotide
atatgtgcgcttcctgagcagcatcgatcg

SEQ ID NO: 279702 - DNA, 29 bp, Artificial Sequence
  Description of Artificial Sequence: Synthetic oligonucleotide
tatgtgcgcttcctgagcagcatcgatcg

SEQ ID NO: 279703 - DNA, 28 bp, Artificial Sequence
  Description of Artificial Sequence: Synthetic oligonucleotide
atgtgcgcttcctgagcagcatcgatcg

SEQ ID NO: 279704 - DNA, 27 bp, Artificial Sequence
  Description of Artificial Sequence: Synthetic oligonucleotide
tgtgcgcttcctgagcagcatcgatcg

SEQ ID NO: 279705 - DNA, 26 bp, Artificial Sequence
  Description of Artificial Sequence: Synthetic oligonucleotide
gtgcgcttcctgagcagcatcgatcg

SEQ ID NO: 279706 - DNA, 26 bp, Artificial Sequence
  Description of Artificial Sequence: Synthetic oligonucleotide
tgcgcttcctgagcagcatcgatcgc

SEQ ID NO: 279707 - DNA, 25 bp, Artificial Sequence
  Description of Artificial Sequence: Synthetic oligonucleotide
gcgcttcctgagcagcatcgatcgc

SEQ ID NO: 279708 - DNA, 26 bp, Artificial Sequence
  Description of Artificial Sequence: Synthetic oligonucleotide
cgcttcctgagcagcatcgatcgcga

SEQ ID NO: 279709 - DNA, 26 bp, Artificial Sequence
  Description of Artificial Sequence: Synthetic oligonucleotide
gcttcctgagcagcatcgatcgcgag

SEQ ID NO: 279710 - DNA, 27 bp, Artificial Sequence
  Description of Artificial Sequence: Synthetic oligonucleotide
cttcctgagcagcatcgatcgcgagct

SEQ ID NO: 279711 - DNA, 27 bp, Artificial Sequence
  Description of Artificial Sequence: Synthetic oligonucleotide
ttcctgagcagcatcgatcgcgagctg

SEQ ID NO: 279712 - DNA, 26 bp, Artificial Sequence
  Description of Artificial Sequence: Synthetic oligonucleotide
tcctgagcagcatcgatcgcgagctg

SEQ ID NO: 279713 - DNA, 25 bp, Artificial Sequence
  Description of Artificial Sequence: Synthetic oligonucleotide
cctgagcagcatcgatcgcgagctg

SEQ ID NO: 279714 - DNA, 26 bp, Artificial Sequence
  Description of Artificial Sequence: Synthetic oligonucleotide
ctgagcagcatcgatcgcgagctgct

SEQ ID NO: 279715 - DNA, 27 bp, Artificial Sequence
  Description of Artificial Sequence: Synthetic oligonucleotide
tgagcagcatcgatcgcgagctgctct

SEQ ID NO: 279716 - DNA, 27 bp, Artificial Sequence
  Description of Artificial Sequence: Synthetic oligonucleotide
gagcagcatcgatcgcgagctgctcta

SEQ ID NO: 279717 - DNA, 27 bp, Artificial Sequence
  Description of Artificial Sequence: Synthetic oligonucleotide
agcagcatcgatcgcgagctgctctag

SEQ ID NO: 279718 - DNA, 26 bp, Artificial Sequence
  Description of Artificial Sequence: Synthetic oligonucleotide
gcagcatcgatcgcgagctgctctag

SEQ ID NO: 279719 - DNA, 26 bp, Artificial Sequence
  Description of Artificial Sequence: Synthetic oligonucleotide
cagcatcgatcgcgagctgctctagc

SEQ ID NO: 279720 - DNA, 26 bp, Artificial Sequence
  Description of Artificial Sequence: Synthetic oligonucleotide
agcatcgatcgcgagctgctctagcc

SEQ ID NO: 279721 - DNA, 25 bp, Artificial Sequence
  Description of Artificial Sequence: Synthetic oligonucleotide
gcatcgatcgcgagctgctctagcc

SEQ ID NO: 279722 - DNA, 27 bp, Artificial Sequence
  Description of Artificial Sequence: Synthetic oligonucleotide
catcgatcgcgagctgctctagcccaa

SEQ ID NO: 279723 - DNA, 27 bp, Artificial Sequence
  Description of Artificial Sequence: Synthetic oligonucleotide
atcgatcgcgagctgctctagcccaac

SEQ ID NO: 279724 - DNA, 26 bp, Artificial Sequence
  Description of Artificial Sequence: Synthetic oligonucleotide
tcgatcgcgagctgctctagcccaac

SEQ ID NO: 279725 - DNA, 25 bp, Artificial Sequence
  Description of Artificial Sequence: Synthetic oligonucleotide
cgatcgcgagctgctctagcccaac

SEQ ID NO: 279726 - DNA, 25 bp, Artificial Sequence
  Description of Artificial Sequence: Synthetic oligonucleotide
gatcgcgagctgctctagcccaacg

SEQ ID NO: 279727 - DNA, 25 bp, Artificial Sequence
  Description of Artificial Sequence: Synthetic oligonucleotide
atcgcgagctgctctagcccaacgg

SEQ ID NO: 279728 - DNA, 24 bp, Artificial Sequence
  Description of Artificial Sequence: Synthetic oligonucleotide
tcgcgagctgctctagcccaacgg

SEQ ID NO: 279729 - DNA, 23 bp, Artificial Sequence
  Description of Artificial Sequence: Synthetic oligonucleotide
cgcgagctgctctagcccaacgg

SEQ ID NO: 279730 - DNA, 24 bp, Artificial Sequence
  Description of Artificial Sequence: Synthetic oligonucleotide
gcgagctgctctagcccaacggct

SEQ ID NO: 279731 - DNA, 25 bp, Artificial Sequence
  Description of Artificial Sequence: Synthetic oligonucleotide
cgagctgctctagcccaacggctca

SEQ ID NO: 279732 - DNA, 26 bp, Artificial Sequence
  Description of Artificial Sequence: Synthetic oligonucleotide
gagctgctctagcccaacggctcagt

SEQ ID NO: 279733 - DNA, 26 bp, Artificial Sequence
  Description of Artificial Sequence: Synthetic oligonucleotide
agctgctctagcccaacggctcagtg

SEQ ID NO: 279734 - DNA, 25 bp, Artificial Sequence
  Description of Artificial Sequence: Synthetic oligonucleotide
gctgctctagcccaacggctcagtg

SEQ ID NO: 279735 - DNA, 25 bp, Artificial Sequence
  Description of Artificial Sequence: Synthetic oligonucleotide
ctgctctagcccaacggctcagtgg

SEQ ID NO: 279736 - DNA, 25 bp, Artificial Sequence
  Description of Artificial Sequence: Synthetic oligonucleotide
tgctctagcccaacggctcagtggc

SEQ ID NO: 279737 - DNA, 24 bp, Artificial Sequence
  Description of Artificial Sequence: Synthetic oligonucleotide
gctctagcccaacggctcagtggc

SEQ ID NO: 279738 - DNA, 24 bp, Artificial Sequence
  Description of Artificial Sequence: Synthetic oligonucleotide
ctctagcccaacggctcagtggcg

SEQ ID NO: 279739 - DNA, 25 bp, Artificial Sequence
  Description of Artificial Sequence: Synthetic oligonucleotide
tctagcccaacggctcagtggcgct

SEQ ID NO: 279740 - DNA, 24 bp, Artificial Sequence
  Description of Artificial Sequence: Synthetic oligonucleotide
ctagcccaacggctcagtggcgct

SEQ ID NO: 279741 - DNA, 24 bp, Artificial Sequence
  Description of Artificial Sequence: Synthetic oligonucleotide
tagcccaacggctcagtggcgctc

SEQ ID NO: 279742 - DNA, 23 bp, Artificial Sequence
  Description of Artificial Sequence: Synthetic oligonucleotide
agcccaacggctcagtggcgctc

SEQ ID NO: 279743 - DNA, 22 bp, Artificial Sequence
  Description of Artificial Sequence: Synthetic oligonucleotide
gcccaacggctcagtggcgctc

SEQ ID NO: 279744 - DNA, 23 bp, Artificial Sequence
  Description of Artificial Sequence: Synthetic oligonucleotide
cccaacggctcagtggcgctcca

SEQ ID NO: 279745 - DNA, 25 bp, Artificial Sequence
  Description of Artificial Sequence: Synthetic oligonucleotide
ccaacggctcagtggcgctccacaa

SEQ ID NO: 279746 - DNA, 25 bp, Artificial Sequence
  Description of Artificial Sequence: Synthetic oligonucleotide
caacggctcagtggcgctccacaag

SEQ ID NO: 279747 - DNA, 26 bp, Artificial Sequence
  Description of Artificial Sequence: Synthetic oligonucleotide
aacggctcagtggcgctccacaagga

SEQ ID NO: 279748 - DNA, 25 bp, Artificial Sequence
  Description of Artificial Sequence: Synthetic oligonucleotide
acggctcagtggcgctccacaagga

SEQ ID NO: 279749 - DNA, 24 bp, Artificial Sequence
  Description of Artificial Sequence: Synthetic oligonucleotide
cggctcagtggcgctccacaagga

SEQ ID NO: 279750 - DNA, 25 bp, Artificial Sequence
  Description of Artificial Sequence: Synthetic oligonucleotide
ggctcagtggcgctccacaaggaca

SEQ ID NO: 279751 - DNA, 25 bp, Artificial Sequence
  Description of Artificial Sequence: Synthetic oligonucleotide
gctcagtggcgctccacaaggacag

SEQ ID NO: 279752 - DNA, 27 bp, Artificial Sequence
  Description of Artificial Sequence: Synthetic oligonucleotide
ctcagtggcgctccacaaggacagcaa

SEQ ID NO: 279753 - DNA, 28 bp, Artificial Sequence
  Description of Artificial Sequence: Synthetic oligonucleotide
tcagtggcgctccacaaggacagcaatg

SEQ ID NO: 279754 - DNA, 27 bp, Artificial Sequence
  Description of Artificial Sequence: Synthetic oligonucleotide
cagtggcgctccacaaggacagcaatg

SEQ ID NO: 279755 - DNA, 27 bp, Artificial Sequence
  Description of Artificial Sequence: Synthetic oligonucleotide
agtggcgctccacaaggacagcaatgg

SEQ ID NO: 279756 - DNA, 27 bp, Artificial Sequence
  Description of Artificial Sequence: Synthetic oligonucleotide
gtggcgctccacaaggacagcaatgga

SEQ ID NO: 279757 - DNA, 27 bp, Artificial Sequence
  Description of Artificial Sequence: Synthetic oligonucleotide
tggcgctccacaaggacagcaatggac

SEQ ID NO: 279758 - DNA, 27 bp, Artificial Sequence
  Description of Artificial Sequence: Synthetic oligonucleotide
ggcgctccacaaggacagcaatggact

SEQ ID NO: 279759 - DNA, 27 bp, Artificial Sequence
  Description of Artificial Sequence: Synthetic oligonucleotide
gcgctccacaaggacagcaatggactg

SEQ ID NO: 279760 - DNA, 27 bp, Artificial Sequence
  Description of Artificial Sequence: Synthetic oligonucleotide
cgctccacaaggacagcaatggactgg

SEQ ID NO: 279761 - DNA, 28 bp, Artificial Sequence
  Description of Artificial Sequence: Synthetic oligonucleotide
gctccacaaggacagcaatggactggtg

SEQ ID NO: 279762 - DNA, 28 bp, Artificial Sequence
  Description of Artificial Sequence: Synthetic oligonucleotide
ctccacaaggacagcaatggactggtgg

SEQ ID NO: 279763 - DNA, 29 bp, Artificial Sequence
  Description of Artificial Sequence: Synthetic oligonucleotide
tccacaaggacagcaatggactggtggag

SEQ ID NO: 279764 - DNA, 28 bp, Artificial Sequence
  Description of Artificial Sequence: Synthetic oligonucleotide
ccacaaggacagcaatggactggtggag

SEQ ID NO: 279765 - DNA, 28 bp, Artificial Sequence
  Description of Artificial Sequence: Synthetic oligonucleotide
cacaaggacagcaatggactggtggagg

SEQ ID NO: 279766 - DNA, 29 bp, Artificial Sequence
  Description of Artificial Sequence: Synthetic oligonucleotide
acaaggacagcaatggactggtggaggtg

SEQ ID NO: 279767 - DNA, 28 bp, Artificial Sequence
  Description of Artificial Sequence: Synthetic oligonucleotide
caaggacagcaatggactggtggaggtg

SEQ ID NO: 279768 - DNA, 28 bp, Artificial Sequence
  Description of Artificial Sequence: Synthetic oligonucleotide
aaggacagcaatggactggtggaggtgc

SEQ ID NO: 279769 - DNA, 27 bp, Artificial Sequence
  Description of Artificial Sequence: Synthetic oligonucleotide
aggacagcaatggactggtggaggtgc

SEQ ID NO: 279770 - DNA, 27 bp, Artificial Sequence
  Description of Artificial Sequence: Synthetic oligonucleotide
ggacagcaatggactggtggaggtgct

SEQ ID NO: 279771 - DNA, 27 bp, Artificial Sequence
  Description of Artificial Sequence: Synthetic oligonucleotide
gacagcaatggactggtggaggtgctg

SEQ ID NO: 279772 - DNA, 27 bp, Artificial Sequence
  Description of Artificial Sequence: Synthetic oligonucleotide
acagcaatggactggtggaggtgctgc

SEQ ID NO: 279773 - DNA, 26 bp, Artificial Sequence
  Description of Artificial Sequence: Synthetic oligonucleotide
cagcaatggactggtggaggtgctgc

SEQ ID NO: 279774 - DNA, 26 bp, Artificial Sequence
  Description of Artificial Sequence: Synthetic oligonucleotide
agcaatggactggtggaggtgctgcc

SEQ ID NO: 279775 - DNA, 25 bp, Artificial Sequence
  Description of Artificial Sequence: Synthetic oligonucleotide
gcaatggactggtggaggtgctgcc

SEQ ID NO: 279776 - DNA, 25 bp, Artificial Sequence
  Description of Artificial Sequence: Synthetic oligonucleotide
caatggactggtggaggtgctgccc

SEQ ID NO: 279777 - DNA, 25 bp, Artificial Sequence
  Description of Artificial Sequence: Synthetic oligonucleotide
aatggactggtggaggtgctgcccg

SEQ ID NO: 279778 - DNA, 24 bp, Artificial Sequence
  Description of Artificial Sequence: Synthetic oligonucleotide
atggactggtggaggtgctgcccg

SEQ ID NO: 279779 - DNA, 23 bp, Artificial Sequence
  Description of Artificial Sequence: Synthetic oligonucleotide
tggactggtggaggtgctgcccg

SEQ ID NO: 279780 - DNA, 22 bp, Artificial Sequence
  Description of Artificial Sequence: Synthetic oligonucleotide
ggactggtggaggtgctgcccg

SEQ ID NO: 279781 - DNA, 22 bp, Artificial Sequence
  Description of Artificial Sequence: Synthetic oligonucleotide
gactggtggaggtgctgcccgc

SEQ ID NO: 279782 - DNA, 22 bp, Artificial Sequence
  Description of Artificial Sequence: Synthetic oligonucleotide
actggtggaggtgctgcccgcc

SEQ ID NO: 279783 - DNA, 21 bp, Artificial Sequence
  Description of Artificial Sequence: Synthetic oligonucleotide
ctggtggaggtgctgcccgcc

SEQ ID NO: 279784 - DNA, 23 bp, Artificial Sequence
  Description of Artificial Sequence: Synthetic oligonucleotide
tggtggaggtgctgcccgccgaa

SEQ ID NO: 279785 - DNA, 22 bp, Artificial Sequence
  Description of Artificial Sequence: Synthetic oligonucleotide
ggtggaggtgctgcccgccgaa

SEQ ID NO: 279786 - DNA, 22 bp, Artificial Sequence
  Description of Artificial Sequence: Synthetic oligonucleotide
gtggaggtgctgcccgccgaag

SEQ ID NO: 279787 - DNA, 22 bp, Artificial Sequence
  Description of Artificial Sequence: Synthetic oligonucleotide
tggaggtgctgcccgccgaagc

SEQ ID NO: 279788 - DNA, 21 bp, Artificial Sequence
  Description of Artificial Sequence: Synthetic oligonucleotide
ggaggtgctgcccgccgaagc

SEQ ID NO: 279789 - DNA, 21 bp, Artificial Sequence
  Description of Artificial Sequence: Synthetic oligonucleotide
gaggtgctgcccgccgaagcc

SEQ ID NO: 279790 - DNA, 22 bp, Artificial Sequence
  Description of Artificial Sequence: Synthetic oligonucleotide
aggtgctgcccgccgaagccgt

SEQ ID NO: 279791 - DNA, 21 bp, Artificial Sequence
  Description of Artificial Sequence: Synthetic oligonucleotide
ggtgctgcccgccgaagccgt

SEQ ID NO: 279792 - DNA, 22 bp, Artificial Sequence
  Description of Artificial Sequence: Synthetic oligonucleotide
gtgctgcccgccgaagccgtca

SEQ ID NO: 279793 - DNA, 22 bp, Artificial Sequence
  Description of Artificial Sequence: Synthetic oligonucleotide
tgctgcccgccgaagccgtcag

SEQ ID NO: 279794 - DNA, 21 bp, Artificial Sequence
  Description of Artificial Sequence: Synthetic oligonucleotide
gctgcccgccgaagccgtcag

SEQ ID NO: 279795 - DNA, 22 bp, Artificial Sequence
  Description of Artificial Sequence: Synthetic oligonucleotide
ctgcccgccgaagccgtcagca

SEQ ID NO: 279796 - DNA, 22 bp, Artificial Sequence
  Description of Artificial Sequence: Synthetic oligonucleotide
tgcccgccgaagccgtcagcag

SEQ ID NO: 279797 - DNA, 21 bp, Artificial Sequence
  Description of Artificial Sequence: Synthetic oligonucleotide
gcccgccgaagccgtcagcag

SEQ ID NO: 279798 - DNA, 23 bp, Artificial Sequence
  Description of Artificial Sequence: Synthetic oligonucleotide
cccgccgaagccgtcagcagcat

SEQ ID NO: 279799 - DNA, 25 bp, Artificial Sequence
  Description of Artificial Sequence: Synthetic oligonucleotide
ccgccgaagccgtcagcagcatgat

SEQ ID NO: 279800 - DNA, 27 bp, Artificial Sequence
  Description of Artificial Sequence: Synthetic oligonucleotide
cgccgaagccgtcagcagcatgatgat

SEQ ID NO: 279801 - DNA, 27 bp, Artificial Sequence
  Description of Artificial Sequence: Synthetic oligonucleotide
gccgaagccgtcagcagcatgatgatg

SEQ ID NO: 279802 - DNA, 27 bp, Artificial Sequence
  Description of Artificial Sequence: Synthetic oligonucleotide
ccgaagccgtcagcagcatgatgatgc

SEQ ID NO: 279803 - DNA, 28 bp, Artificial Sequence
  Description of Artificial Sequence: Synthetic oligonucleotide
cgaagccgtcagcagcatgatgatgctc

SEQ ID NO: 279804 - DNA, 29 bp, Artificial Sequence
  Description of Artificial Sequence: Synthetic oligonucleotide
gaagccgtcagcagcatgatgatgctctc

SEQ ID NO: 279805 - DNA, 29 bp, Artificial Sequence
  Description of Artificial Sequence: Synthetic oligonucleotide
aagccgtcagcagcatgatgatgctctcc

SEQ ID NO: 279806 - DNA, 28 bp, Artificial Sequence
  Description of Artificial Sequence: Synthetic oligonucleotide
agccgtcagcagcatgatgatgctctcc

SEQ ID NO: 279807 - DNA, 27 bp, Artificial Sequence
  Description of Artificial Sequence: Synthetic oligonucleotide
gccgtcagcagcatgatgatgctctcc

SEQ ID NO: 279808 - DNA, 28 bp, Artificial Sequence
  Description of Artificial Sequence: Synthetic oligonucleotide
ccgtcagcagcatgatgatgctctcctc

SEQ ID NO: 279809 - DNA, 29 bp, Artificial Sequence
  Description of Artificial Sequence: Synthetic oligonucleotide
cgtcagcagcatgatgatgctctcctcag

SEQ ID NO: 279810 - DNA, 30 bp, Artificial Sequence
  Description of Artificial Sequence: Synthetic oligonucleotide
gtcagcagcatgatgatgctctcctcagac

SEQ ID NO: 279811 - DNA, 30 bp, Artificial Sequence
  Description of Artificial Sequence: Synthetic oligonucleotide
tcagcagcatgatgatgctctcctcagacc

SEQ ID NO: 279812 - DNA, 29 bp, Artificial Sequence
  Description of Artificial Sequence: Synthetic oligonucleotide
cagcagcatgatgatgctctcctcagacc

SEQ ID NO: 279813 - DNA, 30 bp, Artificial Sequence
  Description of Artificial Sequence: Synthetic oligonucleotide
agcagcatgatgatgctctcctcagacctg

SEQ ID NO: 279814 - DNA, 29 bp, Artificial Sequence
  Description of Artificial Sequence: Synthetic oligonucleotide
gcagcatgatgatgctctcctcagacctg

SEQ ID NO: 279815 - DNA, 31 bp, Artificial Sequence
  Description of Artificial Sequence: Synthetic oligonucleotide
cagcatgatgatgctctcctcagacctgaag

SEQ ID NO: 279816 - DNA, 31 bp, Artificial Sequence
  Description of Artificial Sequence: Synthetic oligonucleotide
agcatgatgatgctctcctcagacctgaagc

SEQ ID NO: 279817 - DNA, 30 bp, Artificial Sequence
  Description of Artificial Sequence: Synthetic oligonucleotide
gcatgatgatgctctcctcagacctgaagc

SEQ ID NO: 279818 - DNA, 30 bp, Artificial Sequence
  Description of Artificial Sequence: Synthetic oligonucleotide
catgatgatgctctcctcagacctgaagcc

SEQ ID NO: 279819 - DNA, 31 bp, Artificial Sequence
  Description of Artificial Sequence: Synthetic oligonucleotide
atgatgatgctctcctcagacctgaagccag

SEQ ID NO: 279820 - DNA, 30 bp, Artificial Sequence
  Description of Artificial Sequence: Synthetic oligonucleotide
tgatgatgctctcctcagacctgaagccag

SEQ ID NO: 279821 - DNA, 29 bp, Artificial Sequence
  Description of Artificial Sequence: Synthetic oligonucleotide
gatgatgctctcctcagacctgaagccag

SEQ ID NO: 279822 - DNA, 31 bp, Artificial Sequence
  Description of Artificial Sequence: Synthetic oligonucleotide
atgatgctctcctcagacctgaagccagaag

SEQ ID NO: 279823 - DNA, 30 bp, Artificial Sequence
  Description of Artificial Sequence: Synthetic oligonucleotide
tgatgctctcctcagacctgaagccagaag

SEQ ID NO: 279824 - DNA, 29 bp, Artificial Sequence
  Description of Artificial Sequence: Synthetic oligonucleotide
gatgctctcctcagacctgaagccagaag

SEQ ID NO: 279825 - DNA, 30 bp, Artificial Sequence
  Description of Artificial Sequence: Synthetic oligonucleotide
atgctctcctcagacctgaagccagaagtg

SEQ ID NO: 279826 - DNA, 29 bp, Artificial Sequence
  Description of Artificial Sequence: Synthetic oligonucleotide
tgctctcctcagacctgaagccagaagtg

SEQ ID NO: 279827 - DNA, 28 bp, Artificial Sequence
  Description of Artificial Sequence: Synthetic oligonucleotide
gctctcctcagacctgaagccagaagtg

SEQ ID NO: 279828 - DNA, 30 bp, Artificial Sequence
  Description of Artificial Sequence: Synthetic oligonucleotide
ctctcctcagacctgaagccagaagtgatg

SEQ ID NO: 279829 - DNA, 32 bp, Artificial Sequence
  Description of Artificial Sequence: Synthetic oligonucleotide
tctcctcagacctgaagccagaagtgatgtac

SEQ ID NO: 279830 - DNA, 31 bp, Artificial Sequence
  Description of Artificial Sequence: Synthetic oligonucleotide
ctcctcagacctgaagccagaagtgatgtac

SEQ ID NO: 279831 - DNA, 31 bp, Artificial Sequence
  Description of Artificial Sequence: Synthetic oligonucleotide
tcctcagacctgaagccagaagtgatgtacc

SEQ ID NO: 279832 - DNA, 30 bp, Artificial Sequence
  Description of Artificial Sequence: Synthetic oligonucleotide
cctcagacctgaagccagaagtgatgtacc

SEQ ID NO: 279833 - DNA, 30 bp, Artificial Sequence
  Description of Artificial Sequence: Synthetic oligonucleotide
ctcagacctgaagccagaagtgatgtaccc

SEQ ID NO: 279834 - DNA, 30 bp, Artificial Sequence
  Description of Artificial Sequence: Synthetic oligonucleotide
tcagacctgaagccagaagtgatgtacccg

SEQ ID NO: 279835 - DNA, 29 bp, Artificial Sequence
  Description of Artificial Sequence: Synthetic oligonucleotide
cagacctgaagccagaagtgatgtacccg

SEQ ID NO: 279836 - DNA, 29 bp, Artificial Sequence
  Description of Artificial Sequence: Synthetic oligonucleotide
agacctgaagccagaagtgatgtacccgg

SEQ ID NO: 279837 - DNA, 28 bp, Artificial Sequence
  Description of Artificial Sequence: Synthetic oligonucleotide
gacctgaagccagaagtgatgtacccgg

SEQ ID NO: 279838 - DNA, 29 bp, Artificial Sequence
  Description of Artificial Sequence: Synthetic oligonucleotide
acctgaagccagaagtgatgtacccggac

SEQ ID NO: 279839 - DNA, 28 bp, Artificial Sequence
  Description of Artificial Sequence: Synthetic oligonucleotide
cctgaagccagaagtgatgtacccggac

SEQ ID NO: 279840 - DNA, 30 bp, Artificial Sequence
  Description of Artificial Sequence: Synthetic oligonucleotide
ctgaagccagaagtgatgtacccggacatc

SEQ ID NO: 279841 - DNA, 30 bp, Artificial Sequence
  Description of Artificial Sequence: Synthetic oligonucleotide
tgaagccagaagtgatgtacccggacatcg

SEQ ID NO: 279842 - DNA, 29 bp, Artificial Sequence
  Description of Artificial Sequence: Synthetic oligonucleotide
gaagccagaagtgatgtacccggacatcg

SEQ ID NO: 279843 - DNA, 29 bp, Artificial Sequence
  Description of Artificial Sequence: Synthetic oligonucleotide
aagccagaagtgatgtacccggacatcgc

SEQ ID NO: 279844 - DNA, 28 bp, Artificial Sequence
  Description of Artificial Sequence: Synthetic oligonucleotide
agccagaagtgatgtacccggacatcgc

SEQ ID NO: 279845 - DNA, 27 bp, Artificial Sequence
  Description of Artificial Sequence: Synthetic oligonucleotide
gccagaagtgatgtacccggacatcgc

SEQ ID NO: 279846 - DNA, 28 bp, Artificial Sequence
  Description of Artificial Sequence: Synthetic oligonucleotide
ccagaagtgatgtacccggacatcgcag

SEQ ID NO: 279847 - DNA, 28 bp, Artificial Sequence
  Description of Artificial Sequence: Synthetic oligonucleotide
cagaagtgatgtacccggacatcgcagg

SEQ ID NO: 279848 - DNA, 28 bp, Artificial Sequence
  Description of Artificial Sequence: Synthetic oligonucleotide
agaagtgatgtacccggacatcgcaggc

SEQ ID NO: 279849 - DNA, 27 bp, Artificial Sequence
  Description of Artificial Sequence: Synthetic oligonucleotide
gaagtgatgtacccggacatcgcaggc

SEQ ID NO: 279850 - DNA, 29 bp, Artificial Sequence
  Description of Artificial Sequence: Synthetic oligonucleotide
aagtgatgtacccggacatcgcaggcatg

SEQ ID NO: 279851 - DNA, 28 bp, Artificial Sequence
  Description of Artificial Sequence: Synthetic oligonucleotide
agtgatgtacccggacatcgcaggcatg

SEQ ID NO: 279852 - DNA, 27 bp, Artificial Sequence
  Description of Artificial Sequence: Synthetic oligonucleotide
gtgatgtacccggacatcgcaggcatg

SEQ ID NO: 279853 - DNA, 27 bp, Artificial Sequence
  Description of Artificial Sequence: Synthetic oligonucleotide
tgatgtacccggacatcgcaggcatgg

SEQ ID NO: 279854 - DNA, 27 bp, Artificial Sequence
  Description of Artificial Sequence: Synthetic oligonucleotide
gatgtacccggacatcgcaggcatgga

SEQ ID NO: 279855 - DNA, 27 bp, Artificial Sequence
  Description of Artificial Sequence: Synthetic oligonucleotide
atgtacccggacatcgcaggcatggag

SEQ ID NO: 279856 - DNA, 27 bp, Artificial Sequence
  Description of Artificial Sequence: Synthetic oligonucleotide
tgtacccggacatcgcaggcatggaga

SEQ ID NO: 279857 - DNA, 27 bp, Artificial Sequence
  Description of Artificial Sequence: Synthetic oligonucleotide
gtacccggacatcgcaggcatggagat

SEQ ID NO: 279858 - DNA, 27 bp, Artificial Sequence
  Description of Artificial Sequence: Synthetic oligonucleotide
tacccggacatcgcaggcatggagatc

SEQ ID NO: 279859 - DNA, 26 bp, Artificial Sequence
  Description of Artificial Sequence: Synthetic oligonucleotide
acccggacatcgcaggcatggagatc

SEQ ID NO: 279860 - DNA, 25 bp, Artificial Sequence
  Description of Artificial Sequence: Synthetic oligonucleotide
cccggacatcgcaggcatggagatc

SEQ ID NO: 279861 - DNA, 26 bp, Artificial Sequence
  Description of Artificial Sequence: Synthetic oligonucleotide
ccggacatcgcaggcatggagatcca

SEQ ID NO: 279862 - DNA, 27 bp, Artificial Sequence
  Description of Artificial Sequence: Synthetic oligonucleotide
cggacatcgcaggcatggagatccaga

SEQ ID NO: 279863 - DNA, 28 bp, Artificial Sequence
  Description of Artificial Sequence: Synthetic oligonucleotide
ggacatcgcaggcatggagatccagaag

SEQ ID NO: 279864 - DNA, 28 bp, Artificial Sequence
  Description of Artificial Sequence: Synthetic oligonucleotide
gacatcgcaggcatggagatccagaagg

SEQ ID NO: 279865 - DNA, 29 bp, Artificial Sequence
  Description of Artificial Sequence: Synthetic oligonucleotide
acatcgcaggcatggagatccagaaggag

SEQ ID NO: 279866 - DNA, 28 bp, Artificial Sequence
  Description of Artificial Sequence: Synthetic oligonucleotide
catcgcaggcatggagatccagaaggag

SEQ ID NO: 279867 - DNA, 28 bp, Artificial Sequence
  Description of Artificial Sequence: Synthetic oligonucleotide
atcgcaggcatggagatccagaaggagg

SEQ ID NO: 279868 - DNA, 27 bp, Artificial Sequence
  Description of Artificial Sequence: Synthetic oligonucleotide
tcgcaggcatggagatccagaaggagg

SEQ ID NO: 279869 - DNA, 27 bp, Artificial Sequence
  Description of Artificial Sequence: Synthetic oligonucleotide
cgcaggcatggagatccagaaggagga

SEQ ID NO: 279870 - DNA, 27 bp, Artificial Sequence
  Description of Artificial Sequence: Synthetic oligonucleotide
gcaggcatggagatccagaaggaggag

SEQ ID NO: 279871 - DNA, 27 bp, Artificial Sequence
  Description of Artificial Sequence: Synthetic oligonucleotide
caggcatggagatccagaaggaggagg

SEQ ID NO: 279872 - DNA, 28 bp, Artificial Sequence
  Description of Artificial Sequence: Synthetic oligonucleotide
aggcatggagatccagaaggaggaggtg

SEQ ID NO: 279873 - DNA, 27 bp, Artificial Sequence
  Description of Artificial Sequence: Synthetic oligonucleotide
ggcatggagatccagaaggaggaggtg

SEQ ID NO: 279874 - DNA, 27 bp, Artificial Sequence
  Description of Artificial Sequence: Synthetic oligonucleotide
gcatggagatccagaaggaggaggtgc

SEQ ID NO: 279875 - DNA, 27 bp, Artificial Sequence
  Description of Artificial Sequence: Synthetic oligonucleotide
catggagatccagaaggaggaggtgcc

SEQ ID NO: 279876 - DNA, 27 bp, Artificial Sequence
  Description of Artificial Sequence: Synthetic oligonucleotide
atggagatccagaaggaggaggtgccg

SEQ ID NO: 279877 - DNA, 26 bp, Artificial Sequence
  Description of Artificial Sequence: Synthetic oligonucleotide
tggagatccagaaggaggaggtgccg

SEQ ID NO: 279878 - DNA, 25 bp, Artificial Sequence
  Description of Artificial Sequence: Synthetic oligonucleotide
ggagatccagaaggaggaggtgccg

SEQ ID NO: 279879 - DNA, 26 bp, Artificial Sequence
  Description of Artificial Sequence: Synthetic oligonucleotide
gagatccagaaggaggaggtgccgga

SEQ ID NO: 279880 - DNA, 26 bp, Artificial Sequence
  Description of Artificial Sequence: Synthetic oligonucleotide
agatccagaaggaggaggtgccggag

SEQ ID NO: 279881 - DNA, 25 bp, Artificial Sequence
  Description of Artificial Sequence: Synthetic oligonucleotide
gatccagaaggaggaggtgccggag

SEQ ID NO: 279882 - DNA, 25 bp, Artificial Sequence
  Description of Artificial Sequence: Synthetic oligonucleotide
atccagaaggaggaggtgccggagg

SEQ ID NO: 279883 - DNA, 24 bp, Artificial Sequence
  Description of Artificial Sequence: Synthetic oligonucleotide
tccagaaggaggaggtgccggagg

SEQ ID NO: 279884 - DNA, 23 bp, Artificial Sequence
  Description of Artificial Sequence: Synthetic oligonucleotide
ccagaaggaggaggtgccggagg

SEQ ID NO: 279885 - DNA, 23 bp, Artificial Sequence
  Description of Artificial Sequence: Synthetic oligonucleotide
cagaaggaggaggtgccggaggc

SEQ ID NO: 279886 - DNA, 23 bp, Artificial Sequence
  Description of Artificial Sequence: Synthetic oligonucleotide
agaaggaggaggtgccggaggcc

SEQ ID NO: 279887 - DNA, 22 bp, Artificial Sequence
  Description of Artificial Sequence: Synthetic oligonucleotide
gaaggaggaggtgccggaggcc

SEQ ID NO: 279888 - DNA, 23 bp, Artificial Sequence
  Description of Artificial Sequence: Synthetic oligonucleotide
aaggaggaggtgccggaggccgt

SEQ ID NO: 279889 - DNA, 22 bp, Artificial Sequence
  Description of Artificial Sequence: Synthetic oligonucleotide
aggaggaggtgccggaggccgt

SEQ ID NO: 279890 - DNA, 21 bp, Artificial Sequence
  Description of Artificial Sequence: Synthetic oligonucleotide
ggaggaggtgccggaggccgt

SEQ ID NO: 279891 - DNA, 21 bp, Artificial Sequence
  Description of Artificial Sequence: Synthetic oligonucleotide
gaggaggtgccggaggccgtc

SEQ ID NO: 279892 - DNA, 22 bp, Artificial Sequence
  Description of Artificial Sequence: Synthetic oligonucleotide
aggaggtgccggaggccgtcga

SEQ ID NO: 279893 - DNA, 21 bp, Artificial Sequence
  Description of Artificial Sequence: Synthetic oligonucleotide
ggaggtgccggaggccgtcga

SEQ ID NO: 279894 - DNA, 21 bp, Artificial Sequence
  Description of Artificial Sequence: Synthetic oligonucleotide
gaggtgccggaggccgtcgag

SEQ ID NO: 279895 - DNA, 22 bp, Artificial Sequence
  Description of Artificial Sequence: Synthetic oligonucleotide
aggtgccggaggccgtcgagct

SEQ ID NO: 279896 - DNA, 21 bp, Artificial Sequence
  Description of Artificial Sequence: Synthetic oligonucleotide
ggtgccggaggccgtcgagct

SEQ ID NO: 279897 - DNA, 21 bp, Artificial Sequence
  Description of Artificial Sequence: Synthetic oligonucleotide
gtgccggaggccgtcgagctc

SEQ ID NO: 279898 - DNA, 21 bp, Artificial Sequence
  Description of Artificial Sequence: Synthetic oligonucleotide
tgccggaggccgtcgagctcc

SEQ ID NO: 279899 - DNA, 20 bp, Artificial Sequence
  Description of Artificial Sequence: Synthetic oligonucleotide
gccggaggccgtcgagctcc

SEQ ID NO: 279900 - DNA, 20 bp, Artificial Sequence
  Description of Artificial Sequence: Synthetic oligonucleotide
ccggaggccgtcgagctccc

SEQ ID NO: 279901 - DNA, 20 bp, Artificial Sequence
  Description of Artificial Sequence: Synthetic oligonucleotide
cggaggccgtcgagctcccg

SEQ ID NO: 279902 - DNA, 21 bp, Artificial Sequence
  Description of Artificial Sequence: Synthetic oligonucleotide
ggaggccgtcgagctcccggt

SEQ ID NO: 279903 - DNA, 22 bp, Artificial Sequence
  Description of Artificial Sequence: Synthetic oligonucleotide
gaggccgtcgagctcccggtca

SEQ ID NO: 279904 - DNA, 22 bp, Artificial Sequence
  Description of Artificial Sequence: Synthetic oligonucleotide
aggccgtcgagctcccggtcac

SEQ ID NO: 279905 - DNA, 21 bp, Artificial Sequence
  Description of Artificial Sequence: Synthetic oligonucleotide
ggccgtcgagctcccggtcac

SEQ ID NO: 279906 - DNA, 21 bp, Artificial Sequence
  Description of Artificial Sequence: Synthetic oligonucleotide
gccgtcgagctcccggtcacg

SEQ ID NO: 279907 - DNA, 25 bp, Artificial Sequence
  Description of Artificial Sequence: Synthetic oligonucleotide
ccgtcgagctcccggtcacgcatta

SEQ ID NO: 279908 - DNA, 25 bp, Artificial Sequence
  Description of Artificial Sequence: Synthetic oligonucleotide
cgtcgagctcccggtcacgcattac

SEQ ID NO: 279909 - DNA, 26 bp, Artificial Sequence
  Description of Artificial Sequence: Synthetic oligonucleotide
gtcgagctcccggtcacgcattacga

SEQ ID NO: 279910 - DNA, 26 bp, Artificial Sequence
  Description of Artificial Sequence: Synthetic oligonucleotide
tcgagctcccggtcacgcattacgag

SEQ ID NO: 279911 - DNA, 25 bp, Artificial Sequence
  Description of Artificial Sequence: Synthetic oligonucleotide
cgagctcccggtcacgcattacgag

SEQ ID NO: 279912 - DNA, 26 bp, Artificial Sequence
  Description of Artificial Sequence: Synthetic oligonucleotide
gagctcccggtcacgcattacgagct

SEQ ID NO: 279913 - DNA, 27 bp, Artificial Sequence
  Description of Artificial Sequence: Synthetic oligonucleotide
agctcccggtcacgcattacgagctct

SEQ ID NO: 279914 - DNA, 27 bp, Artificial Sequence
  Description of Artificial Sequence: Synthetic oligonucleotide
gctcccggtcacgcattacgagctcta

SEQ ID NO: 279915 - DNA, 27 bp, Artificial Sequence
  Description of Artificial Sequence: Synthetic oligonucleotide
ctcccggtcacgcattacgagctctag

SEQ ID NO: 279916 - DNA, 29 bp, Artificial Sequence
  Description of Artificial Sequence: Synthetic oligonucleotide
tcccggtcacgcattacgagctctagaag

SEQ ID NO: 279917 - DNA, 28 bp, Artificial Sequence
  Description of Artificial Sequence: Synthetic oligonucleotide
cccggtcacgcattacgagctctagaag

SEQ ID NO: 279918 - DNA, 28 bp, Artificial Sequence
  Description of Artificial Sequence: Synthetic oligonucleotide
ccggtcacgcattacgagctctagaagc

SEQ ID NO: 279919 - DNA, 29 bp, Artificial Sequence
  Description of Artificial Sequence: Synthetic oligonucleotide
cggtcacgcattacgagctctagaagcag

SEQ ID NO: 279920 - DNA, 31 bp, Artificial Sequence
  Description of Artificial Sequence: Synthetic oligonucleotide
ggtcacgcattacgagctctagaagcagatc

SEQ ID NO: 279921 - DNA, 31 bp, Artificial Sequence
  Description of Artificial Sequence: Synthetic oligonucleotide
gtcacgcattacgagctctagaagcagatcc

SEQ ID NO: 279922 - DNA, 31 bp, Artificial Sequence
  Description of Artificial Sequence: Synthetic oligonucleotide
tcacgcattacgagctctagaagcagatccg

SEQ ID NO: 279923 - DNA, 30 bp, Artificial Sequence
  Description of Artificial Sequence: Synthetic oligonucleotide
cacgcattacgagctctagaagcagatccg

SEQ ID NO: 279924 - DNA, 30 bp, Artificial Sequence
  Description of Artificial Sequence: Synthetic oligonucleotide
acgcattacgagctctagaagcagatccgc

SEQ ID NO: 279925 - DNA, 29 bp, Artificial Sequence
  Description of Artificial Sequence: Synthetic oligonucleotide
cgcattacgagctctagaagcagatccgc

SEQ ID NO: 279926 - DNA, 31 bp, Artificial Sequence
  Description of Artificial Sequence: Synthetic oligonucleotide
gcattacgagctctagaagcagatccgcatc

SEQ ID NO: 279927 - DNA, 31 bp, Artificial Sequence
  Description of Artificial Sequence: Synthetic oligonucleotide
cattacgagctctagaagcagatccgcatcg

SEQ ID NO: 279928 - DNA, 33 bp, Artificial Sequence
  Description of Artificial Sequence: Synthetic oligonucleotide
attacgagctctagaagcagatccgcatcgatc

SEQ ID NO: 279929 - DNA, 32 bp, Artificial Sequence
  Description of Artificial Sequence: Synthetic oligonucleotide
ttacgagctctagaagcagatccgcatcgatc

SEQ ID NO: 279930 - DNA, 31 bp, Artificial Sequence
  Description of Artificial Sequence: Synthetic oligonucleotide
tacgagctctagaagcagatccgcatcgatc

SEQ ID NO: 279931 - DNA, 30 bp, Artificial Sequence
  Description of Artificial Sequence: Synthetic oligonucleotide
acgagctctagaagcagatccgcatcgatc

SEQ ID NO: 279932 - DNA, 29 bp, Artificial Sequence
  Description of Artificial Sequence: Synthetic oligonucleotide
cgagctctagaagcagatccgcatcgatc

SEQ ID NO: 279933 - DNA, 29 bp, Artificial Sequence
  Description of Artificial Sequence: Synthetic oligonucleotide
gagctctagaagcagatccgcatcgatcg

SEQ ID NO: 279934 - DNA, 29 bp, Artificial Sequence
  Description of Artificial Sequence: Synthetic oligonucleotide
agctctagaagcagatccgcatcgatcgc

SEQ ID NO: 279935 - DNA, 28 bp, Artificial Sequence
  Description of Artificial Sequence: Synthetic oligonucleotide
gctctagaagcagatccgcatcgatcgc

SEQ ID NO: 279936 - DNA, 28 bp, Artificial Sequence
  Description of Artificial Sequence: Synthetic oligonucleotide
ctctagaagcagatccgcatcgatcgcc

SEQ ID NO: 279937 - DNA, 28 bp, Artificial Sequence
  Description of Artificial Sequence: Synthetic oligonucleotide
tctagaagcagatccgcatcgatcgccc

SEQ ID NO: 279938 - DNA, 27 bp, Artificial Sequence
  Description of Artificial Sequence: Synthetic oligonucleotide
ctagaagcagatccgcatcgatcgccc

SEQ ID NO: 279939 - DNA, 27 bp, Artificial Sequence
  Description of Artificial Sequence: Synthetic oligonucleotide
tagaagcagatccgcatcgatcgcccc

SEQ ID NO: 279940 - DNA, 26 bp, Artificial Sequence
  Description of Artificial Sequence: Synthetic oligonucleotide
agaagcagatccgcatcgatcgcccc

SEQ ID NO: 279941 - DNA, 25 bp, Artificial Sequence
  Description of Artificial Sequence: Synthetic oligonucleotide
gaagcagatccgcatcgatcgcccc

SEQ ID NO: 279942 - DNA, 25 bp, Artificial Sequence
  Description of Artificial Sequence: Synthetic oligonucleotide
aagcagatccgcatcgatcgccccc

SEQ ID NO: 279943 - DNA, 24 bp, Artificial Sequence
  Description of Artificial Sequence: Synthetic oligonucleotide
agcagatccgcatcgatcgccccc

SEQ ID NO: 279944 - DNA, 23 bp, Artificial Sequence
  Description of Artificial Sequence: Synthetic oligonucleotide
gcagatccgcatcgatcgccccc

SEQ ID NO: 279945 - DNA, 24 bp, Artificial Sequence
  Description of Artificial Sequence: Synthetic oligonucleotide
cagatccgcatcgatcgcccccga

SEQ ID NO: 279946 - DNA, 24 bp, Artificial Sequence
  Description of Artificial Sequence: Synthetic oligonucleotide
agatccgcatcgatcgcccccgag

SEQ ID NO: 279947 - DNA, 23 bp, Artificial Sequence
  Description of Artificial Sequence: Synthetic oligonucleotide
gatccgcatcgatcgcccccgag

SEQ ID NO: 279948 - DNA, 23 bp, Artificial Sequence
  Description of Artificial Sequence: Synthetic oligonucleotide
atccgcatcgatcgcccccgagg

SEQ ID NO: 279949 - DNA, 22 bp, Artificial Sequence
  Description of Artificial Sequence: Synthetic oligonucleotide
tccgcatcgatcgcccccgagg

SEQ ID NO: 279950 - DNA, 21 bp, Artificial Sequence
  Description of Artificial Sequence: Synthetic oligonucleotide
ccgcatcgatcgcccccgagg

SEQ ID NO: 279951 - DNA, 21 bp, Artificial Sequence
  Description of Artificial Sequence: Synthetic oligonucleotide
cgcatcgatcgcccccgaggg

SEQ ID NO: 279952 - DNA, 22 bp, Artificial Sequence
  Description of Artificial Sequence: Synthetic oligonucleotide
gcatcgatcgcccccgaggggt

SEQ ID NO: 279953 - DNA, 22 bp, Artificial Sequence
  Description of Artificial Sequence: Synthetic oligonucleotide
catcgatcgcccccgaggggtc

SEQ ID NO: 279954 - DNA, 23 bp, Artificial Sequence
  Description of Artificial Sequence: Synthetic oligonucleotide
atcgatcgcccccgaggggtcct

SEQ ID NO: 279955 - DNA, 22 bp, Artificial Sequence
  Description of Artificial Sequence: Synthetic oligonucleotide
tcgatcgcccccgaggggtcct

SEQ ID NO: 279956 - DNA, 21 bp, Artificial Sequence
  Description of Artificial Sequence: Synthetic oligonucleotide
cgatcgcccccgaggggtcct

SEQ ID NO: 279957 - DNA, 23 bp, Artificial Sequence
  Description of Artificial Sequence: Synthetic oligonucleotide
gatcgcccccgaggggtcctcat

SEQ ID NO: 279958 - DNA, 26 bp, Artificial Sequence
  Description of Artificial Sequence: Synthetic oligonucleotide
atcgcccccgaggggtcctcatgaat

SEQ ID NO: 279959 - DNA, 25 bp, Artificial Sequence
  Description of Artificial Sequence: Synthetic oligonucleotide
tcgcccccgaggggtcctcatgaat

SEQ ID NO: 279960 - DNA, 24 bp, Artificial Sequence
  Description of Artificial Sequence: Synthetic oligonucleotide
cgcccccgaggggtcctcatgaat

SEQ ID NO: 279961 - DNA, 24 bp, Artificial Sequence
  Description of Artificial Sequence: Synthetic oligonucleotide
gcccccgaggggtcctcatgaatg

SEQ ID NO: 279962 - DNA, 24 bp, Artificial Sequence
  Description of Artificial Sequence: Synthetic oligonucleotide
cccccgaggggtcctcatgaatgg

SEQ ID NO: 279963 - DNA, 24 bp, Artificial Sequence
  Description of Artificial Sequence: Synthetic oligonucleotide
ccccgaggggtcctcatgaatggc

SEQ ID NO: 279964 - DNA, 24 bp, Artificial Sequence
  Description of Artificial Sequence: Synthetic oligonucleotide
cccgaggggtcctcatgaatggcc

SEQ ID NO: 279965 - DNA, 25 bp, Artificial Sequence
  Description of Artificial Sequence: Synthetic oligonucleotide
ccgaggggtcctcatgaatggccca

SEQ ID NO: 279966 - DNA, 25 bp, Artificial Sequence
  Description of Artificial Sequence: Synthetic oligonucleotide
cgaggggtcctcatgaatggcccac

SEQ ID NO: 279967 - DNA, 26 bp, Artificial Sequence
  Description of Artificial Sequence: Synthetic oligonucleotide
gaggggtcctcatgaatggcccacgt

SEQ ID NO: 279968 - DNA, 26 bp, Artificial Sequence
  Description of Artificial Sequence: Synthetic oligonucleotide
aggggtcctcatgaatggcccacgtg

SEQ ID NO: 279969 - DNA, 25 bp, Artificial Sequence
  Description of Artificial Sequence: Synthetic oligonucleotide
ggggtcctcatgaatggcccacgtg

SEQ ID NO: 279970 - DNA, 25 bp, Artificial Sequence
  Description of Artificial Sequence: Synthetic oligonucleotide
gggtcctcatgaatggcccacgtgg

SEQ ID NO: 279971 - DNA, 26 bp, Artificial Sequence
  Description of Artificial Sequence: Synthetic oligonucleotide
ggtcctcatgaatggcccacgtggct

SEQ ID NO: 279972 - DNA, 27 bp, Artificial Sequence
  Description of Artificial Sequence: Synthetic oligonucleotide
gtcctcatgaatggcccacgtggctgt

SEQ ID NO: 279973 - DNA, 27 bp, Artificial Sequence
  Description of Artificial Sequence: Synthetic oligonucleotide
tcctcatgaatggcccacgtggctgtg

SEQ ID NO: 279974 - DNA, 26 bp, Artificial Sequence
  Description of Artificial Sequence: Synthetic oligonucleotide
cctcatgaatggcccacgtggctgtg

SEQ ID NO: 279975 - DNA, 26 bp, Artificial Sequence
  Description of Artificial Sequence: Synthetic oligonucleotide
ctcatgaatggcccacgtggctgtgg

SEQ ID NO: 279976 - DNA, 27 bp, Artificial Sequence
  Description of Artificial Sequence: Synthetic oligonucleotide
tcatgaatggcccacgtggctgtggca

SEQ ID NO: 279977 - DNA, 27 bp, Artificial Sequence
  Description of Artificial Sequence: Synthetic oligonucleotide
catgaatggcccacgtggctgtggcaa

SEQ ID NO: 279978 - DNA, 27 bp, Artificial Sequence
  Description of Artificial Sequence: Synthetic oligonucleotide
atgaatggcccacgtggctgtggcaag

SEQ ID NO: 279979 - DNA, 27 bp, Artificial Sequence
  Description of Artificial Sequence: Synthetic oligonucleotide
tgaatggcccacgtggctgtggcaaga

SEQ ID NO: 279980 - DNA, 26 bp, Artificial Sequence
  Description of Artificial Sequence: Synthetic oligonucleotide
gaatggcccacgtggctgtggcaaga

SEQ ID NO: 279981 - DNA, 26 bp, Artificial Sequence
  Description of Artificial Sequence: Synthetic oligonucleotide
aatggcccacgtggctgtggcaagac

SEQ ID NO: 279982 - DNA, 25 bp, Artificial Sequence
  Description of Artificial Sequence: Synthetic oligonucleotide
atggcccacgtggctgtggcaagac

SEQ ID NO: 279983 - DNA, 24 bp, Artificial Sequence
  Description of Artificial Sequence: Synthetic oligonucleotide
tggcccacgtggctgtggcaagac

SEQ ID NO: 279984 - DNA, 23 bp, Artificial Sequence
  Description of Artificial Sequence: Synthetic oligonucleotide
ggcccacgtggctgtggcaagac

SEQ ID NO: 279985 - DNA, 25 bp, Artificial Sequence
  Description of Artificial Sequence: Synthetic oligonucleotide
gcccacgtggctgtggcaagaccat

SEQ ID NO: 279986 - DNA, 27 bp, Artificial Sequence
  Description of Artificial Sequence: Synthetic oligonucleotide
cccacgtggctgtggcaagaccatgat

SEQ ID NO: 279987 - DNA, 27 bp, Artificial Sequence
  Description of Artificial Sequence: Synthetic oligonucleotide
ccacgtggctgtggcaagaccatgatg

SEQ ID NO: 279988 - DNA, 27 bp, Artificial Sequence
  Description of Artificial Sequence: Synthetic oligonucleotide
cacgtggctgtggcaagaccatgatgg

SEQ ID NO: 279989 - DNA, 27 bp, Artificial Sequence
  Description of Artificial Sequence: Synthetic oligonucleotide
acgtggctgtggcaagaccatgatggc

SEQ ID NO: 279990 - DNA, 27 bp, Artificial Sequence
  Description of Artificial Sequence: Synthetic oligonucleotide
cgtggctgtggcaagaccatgatggca

SEQ ID NO: 279991 - DNA, 29 bp, Artificial Sequence
  Description of Artificial Sequence: Synthetic oligonucleotide
gtggctgtggcaagaccatgatggcaaag

SEQ ID NO: 279992 - DNA, 29 bp, Artificial Sequence
  Description of Artificial Sequence: Synthetic oligonucleotide
tggctgtggcaagaccatgatggcaaagg

SEQ ID NO: 279993 - DNA, 28 bp, Artificial Sequence
  Description of Artificial Sequence: Synthetic oligonucleotide
ggctgtggcaagaccatgatggcaaagg

SEQ ID NO: 279994 - DNA, 28 bp, Artificial Sequence
  Description of Artificial Sequence: Synthetic oligonucleotide
gctgtggcaagaccatgatggcaaaggg

SEQ ID NO: 279995 - DNA, 28 bp, Artificial Sequence
  Description of Artificial Sequence: Synthetic oligonucleotide
ctgtggcaagaccatgatggcaaagggg

SEQ ID NO: 279996 - DNA, 28 bp, Artificial Sequence
  Description of Artificial Sequence: Synthetic oligonucleotide
tgtggcaagaccatgatggcaaaggggg

SEQ ID NO: 279997 - DNA, 27 bp, Artificial Sequence
  Description of Artificial Sequence: Synthetic oligonucleotide
gtggcaagaccatgatggcaaaggggg

SEQ ID NO: 279998 - DNA, 28 bp, Artificial Sequence
  Description of Artificial Sequence: Synthetic oligonucleotide
tggcaagaccatgatggcaaagggggtg

SEQ ID NO: 279999 - DNA, 27 bp, Artificial Sequence
  Description of Artificial Sequence: Synthetic oligonucleotide
ggcaagaccatgatggcaaagggggtg

SEQ ID NO: 280000 - DNA, 27 bp, Artificial Sequence
  Description of Artificial Sequence: Synthetic oligonucleotide
gcaagaccatgatggcaaagggggtgg

SEQ ID NO: 280001 - DNA, 27 bp, Artificial Sequence
  Description of Artificial Sequence: Synthetic oligonucleotide
caagaccatgatggcaaagggggtggc

SEQ ID NO: 280002 - DNA, 28 bp, Artificial Sequence
  Description of Artificial Sequence: Synthetic oligonucleotide
aagaccatgatggcaaagggggtggcac

SEQ ID NO: 280003 - DNA, 27 bp, Artificial Sequence
  Description of Artificial Sequence: Synthetic oligonucleotide
agaccatgatggcaaagggggtggcac

SEQ ID NO: 280004 - DNA, 27 bp, Artificial Sequence
  Description of Artificial Sequence: Synthetic oligonucleotide
gaccatgatggcaaagggggtggcaca

SEQ ID NO: 280005 - DNA, 28 bp, Artificial Sequence
  Description of Artificial Sequence: Synthetic oligonucleotide
accatgatggcaaagggggtggcacaac

SEQ ID NO: 280006 - DNA, 27 bp, Artificial Sequence
  Description of Artificial Sequence: Synthetic oligonucleotide
ccatgatggcaaagggggtggcacaac

SEQ ID NO: 280007 - DNA, 28 bp, Artificial Sequence
  Description of Artificial Sequence: Synthetic oligonucleotide
catgatggcaaagggggtggcacaacac

SEQ ID NO: 280008 - DNA, 29 bp, Artificial Sequence
  Description of Artificial Sequence: Synthetic oligonucleotide
atgatggcaaagggggtggcacaacacac

SEQ ID NO: 280009 - DNA, 28 bp, Artificial Sequence
  Description of Artificial Sequence: Synthetic oligonucleotide
tgatggcaaagggggtggcacaacacac

SEQ ID NO: 280010 - DNA, 27 bp, Artificial Sequence
  Description of Artificial Sequence: Synthetic oligonucleotide
gatggcaaagggggtggcacaacacac

SEQ ID NO: 280011 - DNA, 29 bp, Artificial Sequence
  Description of Artificial Sequence: Synthetic oligonucleotide
atggcaaagggggtggcacaacacacaac

SEQ ID NO: 280012 - DNA, 28 bp, Artificial Sequence
  Description of Artificial Sequence: Synthetic oligonucleotide
tggcaaagggggtggcacaacacacaac

SEQ ID NO: 280013 - DNA, 27 bp, Artificial Sequence
  Description of Artificial Sequence: Synthetic oligonucleotide
ggcaaagggggtggcacaacacacaac

SEQ ID NO: 280014 - DNA, 28 bp, Artificial Sequence
  Description of Artificial Sequence: Synthetic oligonucleotide
gcaaagggggtggcacaacacacaacac

SEQ ID NO: 280015 - DNA, 28 bp, Artificial Sequence
  Description of Artificial Sequence: Synthetic oligonucleotide
caaagggggtggcacaacacacaacacc

SEQ ID NO: 280016 - DNA, 29 bp, Artificial Sequence
  Description of Artificial Sequence: Synthetic oligonucleotide
aaagggggtggcacaacacacaacacctg

SEQ ID NO: 280017 - DNA, 28 bp, Artificial Sequence
  Description of Artificial Sequence: Synthetic oligonucleotide
aagggggtggcacaacacacaacacctg

SEQ ID NO: 280018 - DNA, 27 bp, Artificial Sequence
  Description of Artificial Sequence: Synthetic oligonucleotide
agggggtggcacaacacacaacacctg

SEQ ID NO: 280019 - DNA, 26 bp, Artificial Sequence
  Description of Artificial Sequence: Synthetic oligonucleotide
gggggtggcacaacacacaacacctg

SEQ ID NO: 280020 - DNA, 27 bp, Artificial Sequence
  Description of Artificial Sequence: Synthetic oligonucleotide
ggggtggcacaacacacaacacctgca

SEQ ID NO: 280021 - DNA, 29 bp, Artificial Sequence
  Description of Artificial Sequence: Synthetic oligonucleotide
gggtggcacaacacacaacacctgcattc

SEQ ID NO: 280022 - DNA, 31 bp, Artificial Sequence
  Description of Artificial Sequence: Synthetic oligonucleotide
ggtggcacaacacacaacacctgcattcaac

SEQ ID NO: 280023 - DNA, 31 bp, Artificial Sequence
  Description of Artificial Sequence: Synthetic oligonucleotide
gtggcacaacacacaacacctgcattcaacc

SEQ ID NO: 280024 - DNA, 31 bp, Artificial Sequence
  Description of Artificial Sequence: Synthetic oligonucleotide
tggcacaacacacaacacctgcattcaaccg

SEQ ID NO: 280025 - DNA, 30 bp, Artificial Sequence
  Description of Artificial Sequence: Synthetic oligonucleotide
ggcacaacacacaacacctgcattcaaccg

SEQ ID NO: 280026 - DNA, 30 bp, Artificial Sequence
  Description of Artificial Sequence: Synthetic oligonucleotide
gcacaacacacaacacctgcattcaaccgg

SEQ ID NO: 280027 - DNA, 30 bp, Artificial Sequence
  Description of Artificial Sequence: Synthetic oligonucleotide
cacaacacacaacacctgcattcaaccggg

SEQ ID NO: 280028 - DNA, 31 bp, Artificial Sequence
  Description of Artificial Sequence: Synthetic oligonucleotide
acaacacacaacacctgcattcaaccgggtc

SEQ ID NO: 280029 - DNA, 30 bp, Artificial Sequence
  Description of Artificial Sequence: Synthetic oligonucleotide
caacacacaacacctgcattcaaccgggtc

SEQ ID NO: 280030 - DNA, 30 bp, Artificial Sequence
  Description of Artificial Sequence: Synthetic oligonucleotide
aacacacaacacctgcattcaaccgggtcg

SEQ ID NO: 280031 - DNA, 29 bp, Artificial Sequence
  Description of Artificial Sequence: Synthetic oligonucleotide
acacacaacacctgcattcaaccgggtcg

SEQ ID NO: 280032 - DNA, 28 bp, Artificial Sequence
  Description of Artificial Sequence: Synthetic oligonucleotide
cacacaacacctgcattcaaccgggtcg

SEQ ID NO: 280033 - DNA, 29 bp, Artificial Sequence
  Description of Artificial Sequence: Synthetic oligonucleotide
acacaacacctgcattcaaccgggtcgtc

SEQ ID NO: 280034 - DNA, 28 bp, Artificial Sequence
  Description of Artificial Sequence: Synthetic oligonucleotide
cacaacacctgcattcaaccgggtcgtc

SEQ ID NO: 280035 - DNA, 28 bp, Artificial Sequence
  Description of Artificial Sequence: Synthetic oligonucleotide
acaacacctgcattcaaccgggtcgtcg

SEQ ID NO: 280036 - DNA, 27 bp, Artificial Sequence
  Description of Artificial Sequence: Synthetic oligonucleotide
caacacctgcattcaaccgggtcgtcg

SEQ ID NO: 280037 - DNA, 27 bp, Artificial Sequence
  Description of Artificial Sequence: Synthetic oligonucleotide
aacacctgcattcaaccgggtcgtcgg

SEQ ID NO: 280038 - DNA, 26 bp, Artificial Sequence
  Description of Artificial Sequence: Synthetic oligonucleotide
acacctgcattcaaccgggtcgtcgg

SEQ ID NO: 280039 - DNA, 25 bp, Artificial Sequence
  Description of Artificial Sequence: Synthetic oligonucleotide
cacctgcattcaaccgggtcgtcgg

SEQ ID NO: 280040 - DNA, 26 bp, Artificial Sequence
  Description of Artificial Sequence: Synthetic oligonucleotide
acctgcattcaaccgggtcgtcggct

SEQ ID NO: 280041 - DNA, 25 bp, Artificial Sequence
  Description of Artificial Sequence: Synthetic oligonucleotide
cctgcattcaaccgggtcgtcggct

SEQ ID NO: 280042 - DNA, 25 bp, Artificial Sequence
  Description of Artificial Sequence: Synthetic oligonucleotide
ctgcattcaaccgggtcgtcggctc

SEQ ID NO: 280043 - DNA, 25 bp, Artificial Sequence
  Description of Artificial Sequence: Synthetic oligonucleotide
tgcattcaaccgggtcgtcggctcg

SEQ ID NO: 280044 - DNA, 24 bp, Artificial Sequence
  Description of Artificial Sequence: Synthetic oligonucleotide
gcattcaaccgggtcgtcggctcg

SEQ ID NO: 280045 - DNA, 25 bp, Artificial Sequence
  Description of Artificial Sequence: Synthetic oligonucleotide
cattcaaccgggtcgtcggctcgga

SEQ ID NO: 280046 - DNA, 27 bp, Artificial Sequence
  Description of Artificial Sequence: Synthetic oligonucleotide
attcaaccgggtcgtcggctcggagat

SEQ ID NO: 280047 - DNA, 27 bp, Artificial Sequence
  Description of Artificial Sequence: Synthetic oligonucleotide
ttcaaccgggtcgtcggctcggagatt

SEQ ID NO: 280048 - DNA, 26 bp, Artificial Sequence
  Description of Artificial Sequence: Synthetic oligonucleotide
tcaaccgggtcgtcggctcggagatt

SEQ ID NO: 280049 - DNA, 25 bp, Artificial Sequence
  Description of Artificial Sequence: Synthetic oligonucleotide
caaccgggtcgtcggctcggagatt

SEQ ID NO: 280050 - DNA, 27 bp, Artificial Sequence
  Description of Artificial Sequence: Synthetic oligonucleotide
aaccgggtcgtcggctcggagattgta

SEQ ID NO: 280051 - DNA, 26 bp, Artificial Sequence
  Description of Artificial Sequence: Synthetic oligonucleotide
accgggtcgtcggctcggagattgta

SEQ ID NO: 280052 - DNA, 25 bp, Artificial Sequence
  Description of Artificial Sequence: Synthetic oligonucleotide
ccgggtcgtcggctcggagattgta

SEQ ID NO: 280053 - DNA, 26 bp, Artificial Sequence
  Description of Artificial Sequence: Synthetic oligonucleotide
cgggtcgtcggctcggagattgtaca

SEQ ID NO: 280054 - DNA, 27 bp, Artificial Sequence
  Description of Artificial Sequence: Synthetic oligonucleotide
gggtcgtcggctcggagattgtacaga

SEQ ID NO: 280055 - DNA, 28 bp, Artificial Sequence
  Description of Artificial Sequence: Synthetic oligonucleotide
ggtcgtcggctcggagattgtacagatg

SEQ ID NO: 280056 - DNA, 31 bp, Artificial Sequence
  Description of Artificial Sequence: Synthetic oligonucleotide
gtcgtcggctcggagattgtacagatgtatc

SEQ ID NO: 280057 - DNA, 32 bp, Artificial Sequence
  Description of Artificial Sequence: Synthetic oligonucleotide
tcgtcggctcggagattgtacagatgtatctg

SEQ ID NO: 280058 - DNA, 31 bp, Artificial Sequence
  Description of Artificial Sequence: Synthetic oligonucleotide
cgtcggctcggagattgtacagatgtatctg

SEQ ID NO: 280059 - DNA, 31 bp, Artificial Sequence
  Description of Artificial Sequence: Synthetic oligonucleotide
gtcggctcggagattgtacagatgtatctgg

SEQ ID NO: 280060 - DNA, 31 bp, Artificial Sequence
  Description of Artificial Sequence: Synthetic oligonucleotide
tcggctcggagattgtacagatgtatctggg

SEQ ID NO: 280061 - DNA, 30 bp, Artificial Sequence
  Description of Artificial Sequence: Synthetic oligonucleotide
cggctcggagattgtacagatgtatctggg

SEQ ID NO: 280062 - DNA, 31 bp, Artificial Sequence
  Description of Artificial Sequence: Synthetic oligonucleotide
ggctcggagattgtacagatgtatctgggag

SEQ ID NO: 280063 - DNA, 32 bp, Artificial Sequence
  Description of Artificial Sequence: Synthetic oligonucleotide
gctcggagattgtacagatgtatctgggagag

SEQ ID NO: 280064 - DNA, 32 bp, Artificial Sequence
  Description of Artificial Sequence: Synthetic oligonucleotide
ctcggagattgtacagatgtatctgggagagg

SEQ ID NO: 280065 - DNA, 32 bp, Artificial Sequence
  Description of Artificial Sequence: Synthetic oligonucleotide
tcggagattgtacagatgtatctgggagaggg

SEQ ID NO: 280066 - DNA, 31 bp, Artificial Sequence
  Description of Artificial Sequence: Synthetic oligonucleotide
cggagattgtacagatgtatctgggagaggg

SEQ ID NO: 280067 - DNA, 31 bp, Artificial Sequence
  Description of Artificial Sequence: Synthetic oligonucleotide
ggagattgtacagatgtatctgggagagggc

SEQ ID NO: 280068 - DNA, 31 bp, Artificial Sequence
  Description of Artificial Sequence: Synthetic oligonucleotide
gagattgtacagatgtatctgggagagggcc

SEQ ID NO: 280069 - DNA, 31 bp, Artificial Sequence
  Description of Artificial Sequence: Synthetic oligonucleotide
agattgtacagatgtatctgggagagggccc

SEQ ID NO: 280070 - DNA, 30 bp, Artificial Sequence
  Description of Artificial Sequence: Synthetic oligonucleotide
gattgtacagatgtatctgggagagggccc

SEQ ID NO: 280071 - DNA, 30 bp, Artificial Sequence
  Description of Artificial Sequence: Synthetic oligonucleotide
attgtacagatgtatctgggagagggcccc

SEQ ID NO: 280072 - DNA, 29 bp, Artificial Sequence
  Description of Artificial Sequence: Synthetic oligonucleotide
ttgtacagatgtatctgggagagggcccc

SEQ ID NO: 280073 - DNA, 28 bp, Artificial Sequence
  Description of Artificial Sequence: Synthetic oligonucleotide
tgtacagatgtatctgggagagggcccc

SEQ ID NO: 280074 - DNA, 27 bp, Artificial Sequence
  Description of Artificial Sequence: Synthetic oligonucleotide
gtacagatgtatctgggagagggcccc

SEQ ID NO: 280075 - DNA, 27 bp, Artificial Sequence
  Description of Artificial Sequence: Synthetic oligonucleotide
tacagatgtatctgggagagggccccg

SEQ ID NO: 280076 - DNA, 26 bp, Artificial Sequence
  Description of Artificial Sequence: Synthetic oligonucleotide
acagatgtatctgggagagggccccg

SEQ ID NO: 280077 - DNA, 25 bp, Artificial Sequence
  Description of Artificial Sequence: Synthetic oligonucleotide
cagatgtatctgggagagggccccg

SEQ ID NO: 280078 - DNA, 25 bp, Artificial Sequence
  Description of Artificial Sequence: Synthetic oligonucleotide
agatgtatctgggagagggccccgg

SEQ ID NO: 280079 - DNA, 24 bp, Artificial Sequence
  Description of Artificial Sequence: Synthetic oligonucleotide
gatgtatctgggagagggccccgg

SEQ ID NO: 280080 - DNA, 26 bp, Artificial Sequence
  Description of Artificial Sequence: Synthetic oligonucleotide
atgtatctgggagagggccccggcat

SEQ ID NO: 280081 - DNA, 25 bp, Artificial Sequence
  Description of Artificial Sequence: Synthetic oligonucleotide
tgtatctgggagagggccccggcat

SEQ ID NO: 280082 - DNA, 24 bp, Artificial Sequence
  Description of Artificial Sequence: Synthetic oligonucleotide
gtatctgggagagggccccggcat

SEQ ID NO: 280083 - DNA, 24 bp, Artificial Sequence
  Description of Artificial Sequence: Synthetic oligonucleotide
tatctgggagagggccccggcatg

SEQ ID NO: 280084 - DNA, 23 bp, Artificial Sequence
  Description of Artificial Sequence: Synthetic oligonucleotide
atctgggagagggccccggcatg

SEQ ID NO: 280085 - DNA, 22 bp, Artificial Sequence
  Description of Artificial Sequence: Synthetic oligonucleotide
tctgggagagggccccggcatg

SEQ ID NO: 280086 - DNA, 21 bp, Artificial Sequence
  Description of Artificial Sequence: Synthetic oligonucleotide
ctgggagagggccccggcatg

SEQ ID NO: 280087 - DNA, 22 bp, Artificial Sequence
  Description of Artificial Sequence: Synthetic oligonucleotide
tgggagagggccccggcatggt

SEQ ID NO: 280088 - DNA, 21 bp, Artificial Sequence
  Description of Artificial Sequence: Synthetic oligonucleotide
gggagagggccccggcatggt

SEQ ID NO: 280089 - DNA, 21 bp, Artificial Sequence
  Description of Artificial Sequence: Synthetic oligonucleotide
ggagagggccccggcatggtc

SEQ ID NO: 280090 - DNA, 21 bp, Artificial Sequence
  Description of Artificial Sequence: Synthetic oligonucleotide
gagagggccccggcatggtcc

SEQ ID NO: 280091 - DNA, 21 bp, Artificial Sequence
  Description of Artificial Sequence: Synthetic oligonucleotide
agagggccccggcatggtccc

SEQ ID NO: 280092 - DNA, 20 bp, Artificial Sequence
  Description of Artificial Sequence: Synthetic oligonucleotide
gagggccccggcatggtccc

SEQ ID NO: 280093 - DNA, 20 bp, Artificial Sequence
  Description of Artificial Sequence: Synthetic oligonucleotide
agggccccggcatggtcccg

SEQ ID NO: 280094 - DNA, 20 bp, Artificial Sequence
  Description of Artificial Sequence: Synthetic oligonucleotide
gggccccggcatggtcccgt

SEQ ID NO: 280095 - DNA, 21 bp, Artificial Sequence
  Description of Artificial Sequence: Synthetic oligonucleotide
ggccccggcatggtcccggat

SEQ ID NO: 280096 - DNA, 22 bp, Artificial Sequence
  Description of Artificial Sequence: Synthetic oligonucleotide
gccccggcatggtcccggatgt

SEQ ID NO: 280097 - DNA, 24 bp, Artificial Sequence
  Description of Artificial Sequence: Synthetic oligonucleotide
ccccggcatggtcccggatgtgtt

SEQ ID NO: 280098 - DNA, 24 bp, Artificial Sequence
  Description of Artificial Sequence: Synthetic oligonucleotide
cccggcatggtcccggatgtgttg

SEQ ID NO: 280099 - DNA, 24 bp, Artificial Sequence
  Description of Artificial Sequence: Synthetic oligonucleotide
ccggcatggtcccggatgtgttgc

SEQ ID NO: 280100 - DNA, 24 bp, Artificial Sequence
  Description of Artificial Sequence: Synthetic oligonucleotide
cggcatggtcccggatgtgttgcg

SEQ ID NO: 280101 - DNA, 24 bp, Artificial Sequence
  Description of Artificial Sequence: Synthetic oligonucleotide
ggcatggtcccggatgtgttgcgc

SEQ ID NO: 280102 - DNA, 25 bp, Artificial Sequence
  Description of Artificial Sequence: Synthetic oligonucleotide
gcatggtcccggatgtgttgcgcct

SEQ ID NO: 280103 - DNA, 25 bp, Artificial Sequence
  Description of Artificial Sequence: Synthetic oligonucleotide
catggtcccggatgtgttgcgcctg

SEQ ID NO: 280104 - DNA, 25 bp, Artificial Sequence
  Description of Artificial Sequence: Synthetic oligonucleotide
atggtcccggatgtgttgcgcctgg

SEQ ID NO: 280105 - DNA, 24 bp, Artificial Sequence
  Description of Artificial Sequence: Synthetic oligonucleotide
tggtcccggatgtgttgcgcctgg

SEQ ID NO: 280106 - DNA, 23 bp, Artificial Sequence
  Description of Artificial Sequence: Synthetic oligonucleotide
ggtcccggatgtgttgcgcctgg

SEQ ID NO: 280107 - DNA, 23 bp, Artificial Sequence
  Description of Artificial Sequence: Synthetic oligonucleotide
gtcccggatgtgttgcgcctggc

SEQ ID NO: 280108 - DNA, 25 bp, Artificial Sequence
  Description of Artificial Sequence: Synthetic oligonucleotide
tcccggatgtgttgcgcctggccta

SEQ ID NO: 280109 - DNA, 24 bp, Artificial Sequence
  Description of Artificial Sequence: Synthetic oligonucleotide
cccggatgtgttgcgcctggccta

SEQ ID NO: 280110 - DNA, 24 bp, Artificial Sequence
  Description of Artificial Sequence: Synthetic oligonucleotide
ccggatgtgttgcgcctggcctag

SEQ ID NO: 280111 - DNA, 25 bp, Artificial Sequence
  Description of Artificial Sequence: Synthetic oligonucleotide
cggatgtgttgcgcctggcctagga

SEQ ID NO: 280112 - DNA, 27 bp, Artificial Sequence
  Description of Artificial Sequence: Synthetic oligonucleotide
ggatgtgttgcgcctggcctaggagaa

SEQ ID NO: 280113 - DNA, 28 bp, Artificial Sequence
  Description of Artificial Sequence: Synthetic oligonucleotide
gatgtgttgcgcctggcctaggagaatg

SEQ ID NO: 280114 - DNA, 28 bp, Artificial Sequence
  Description of Artificial Sequence: Synthetic oligonucleotide
atgtgttgcgcctggcctaggagaatgg

SEQ ID NO: 280115 - DNA, 27 bp, Artificial Sequence
  Description of Artificial Sequence: Synthetic oligonucleotide
tgtgttgcgcctggcctaggagaatgg

SEQ ID NO: 280116 - DNA, 27 bp, Artificial Sequence
  Description of Artificial Sequence: Synthetic oligonucleotide
gtgttgcgcctggcctaggagaatgga

SEQ ID NO: 280117 - DNA, 27 bp, Artificial Sequence
  Description of Artificial Sequence: Synthetic oligonucleotide
tgttgcgcctggcctaggagaatggac

SEQ ID NO: 280118 - DNA, 26 bp, Artificial Sequence
  Description of Artificial Sequence: Synthetic oligonucleotide
gttgcgcctggcctaggagaatggac

SEQ ID NO: 280119 - DNA, 27 bp, Artificial Sequence
  Description of Artificial Sequence: Synthetic oligonucleotide
ttgcgcctggcctaggagaatggacct

SEQ ID NO: 280120 - DNA, 26 bp, Artificial Sequence
  Description of Artificial Sequence: Synthetic oligonucleotide
tgcgcctggcctaggagaatggacct

SEQ ID NO: 280121 - DNA, 25 bp, Artificial Sequence
  Description of Artificial Sequence: Synthetic oligonucleotide
gcgcctggcctaggagaatggacct

SEQ ID NO: 280122 - DNA, 25 bp, Artificial Sequence
  Description of Artificial Sequence: Synthetic oligonucleotide
cgcctggcctaggagaatggacctg

SEQ ID NO: 280123 - DNA, 25 bp, Artificial Sequence
  Description of Artificial Sequence: Synthetic oligonucleotide
gcctggcctaggagaatggacctgc

SEQ ID NO: 280124 - DNA, 27 bp, Artificial Sequence
  Description of Artificial Sequence: Synthetic oligonucleotide
cctggcctaggagaatggacctgccat

SEQ ID NO: 280125 - DNA, 27 bp, Artificial Sequence
  Description of Artificial Sequence: Synthetic oligonucleotide
ctggcctaggagaatggacctgccatg

SEQ ID NO: 280126 - DNA, 29 bp, Artificial Sequence
  Description of Artificial Sequence: Synthetic oligonucleotide
tggcctaggagaatggacctgccatgatc

SEQ ID NO: 280127 - DNA, 28 bp, Artificial Sequence
  Description of Artificial Sequence: Synthetic oligonucleotide
ggcctaggagaatggacctgccatgatc

SEQ ID NO: 280128 - DNA, 30 bp, Artificial Sequence
  Description of Artificial Sequence: Synthetic oligonucleotide
gcctaggagaatggacctgccatgatcttc

SEQ ID NO: 280129 - DNA, 33 bp, Artificial Sequence
  Description of Artificial Sequence: Synthetic oligonucleotide
cctaggagaatggacctgccatgatcttcatac

SEQ ID NO: 280130 - DNA, 34 bp, Artificial Sequence
  Description of Artificial Sequence: Synthetic oligonucleotide
ctaggagaatggacctgccatgatcttcatacac

SEQ ID NO: 280131 - DNA, 34 bp, Artificial Sequence
  Description of Artificial Sequence: Synthetic oligonucleotide
taggagaatggacctgccatgatcttcatacacg

SEQ ID NO: 280132 - DNA, 33 bp, Artificial Sequence
  Description of Artificial Sequence: Synthetic oligonucleotide
aggagaatggacctgccatgatcttcatacacg

SEQ ID NO: 280133 - DNA, 32 bp, Artificial Sequence
  Description of Artificial Sequence: Synthetic oligonucleotide
ggagaatggacctgccatgatcttcatacacg

SEQ ID NO: 280134 - DNA, 33 bp, Artificial Sequence
  Description of Artificial Sequence: Synthetic oligonucleotide
gagaatggacctgccatgatcttcatacacgag

SEQ ID NO: 280135 - DNA, 36 bp, Artificial Sequence
  Description of Artificial Sequence: Synthetic oligonucleotide
agaatggacctgccatgatcttcatacacgagattg

SEQ ID NO: 280136 - DNA, 35 bp, Artificial Sequence
  Description of Artificial Sequence: Synthetic oligonucleotide
gaatggacctgccatgatcttcatacacgagattg

SEQ ID NO: 280137 - DNA, 37 bp, Artificial Sequence
  Description of Artificial Sequence: Synthetic oligonucleotide
aatggacctgccatgatcttcatacacgagattgttg

SEQ ID NO: 280138 - DNA, 36 bp, Artificial Sequence
  Description of Artificial Sequence: Synthetic oligonucleotide
atggacctgccatgatcttcatacacgagattgttg

SEQ ID NO: 280139 - DNA, 35 bp, Artificial Sequence
  Description of Artificial Sequence: Synthetic oligonucleotide
tggacctgccatgatcttcatacacgagattgttg

SEQ ID NO: 280140 - DNA, 34 bp, Artificial Sequence
  Description of Artificial Sequence: Synthetic oligonucleotide
ggacctgccatgatcttcatacacgagattgttg

SEQ ID NO: 280141 - DNA, 34 bp, Artificial Sequence
  Description of Artificial Sequence: Synthetic oligonucleotide
gacctgccatgatcttcatacacgagattgttgc

SEQ ID NO: 280142 - DNA, 34 bp, Artificial Sequence
  Description of Artificial Sequence: Synthetic oligonucleotide
acctgccatgatcttcatacacgagattgttgcc

SEQ ID NO: 280143 - DNA, 33 bp, Artificial Sequence
  Description of Artificial Sequence: Synthetic oligonucleotide
cctgccatgatcttcatacacgagattgttgcc

SEQ ID NO: 280144 - DNA, 35 bp, Artificial Sequence
  Description of Artificial Sequence: Synthetic oligonucleotide
ctgccatgatcttcatacacgagattgttgccatc

SEQ ID NO: 280145 - DNA, 35 bp, Artificial Sequence
  Description of Artificial Sequence: Synthetic oligonucleotide
tgccatgatcttcatacacgagattgttgccatcg

SEQ ID NO: 280146 - DNA, 34 bp, Artificial Sequence
  Description of Artificial Sequence: Synthetic oligonucleotide
gccatgatcttcatacacgagattgttgccatcg

SEQ ID NO: 280147 - DNA, 34 bp, Artificial Sequence
  Description of Artificial Sequence: Synthetic oligonucleotide
ccatgatcttcatacacgagattgttgccatcgc

SEQ ID NO: 280148 - DNA, 34 bp, Artificial Sequence
  Description of Artificial Sequence: Synthetic oligonucleotide
catgatcttcatacacgagattgttgccatcgcg

SEQ ID NO: 280149 - DNA, 35 bp, Artificial Sequence
  Description of Artificial Sequence: Synthetic oligonucleotide
atgatcttcatacacgagattgttgccatcgcgac

SEQ ID NO: 280150 - DNA, 34 bp, Artificial Sequence
  Description of Artificial Sequence: Synthetic oligonucleotide
tgatcttcatacacgagattgttgccatcgcgac

SEQ ID NO: 280151 - DNA, 33 bp, Artificial Sequence
  Description of Artificial Sequence: Synthetic oligonucleotide
gatcttcatacacgagattgttgccatcgcgac

SEQ ID NO: 280152 - DNA, 33 bp, Artificial Sequence
  Description of Artificial Sequence: Synthetic oligonucleotide
atcttcatacacgagattgttgccatcgcgacc

SEQ ID NO: 280153 - DNA, 32 bp, Artificial Sequence
  Description of Artificial Sequence: Synthetic oligonucleotide
tcttcatacacgagattgttgccatcgcgacc

SEQ ID NO: 280154 - DNA, 31 bp, Artificial Sequence
  Description of Artificial Sequence: Synthetic oligonucleotide
cttcatacacgagattgttgccatcgcgacc

SEQ ID NO: 280155 - DNA, 33 bp, Artificial Sequence
  Description of Artificial Sequence: Synthetic oligonucleotide
ttcatacacgagattgttgccatcgcgaccaag

SEQ ID NO: 280156 - DNA, 32 bp, Artificial Sequence
  Description of Artificial Sequence: Synthetic oligonucleotide
tcatacacgagattgttgccatcgcgaccaag

SEQ ID NO: 280157 - DNA, 31 bp, Artificial Sequence
  Description of Artificial Sequence: Synthetic oligonucleotide
catacacgagattgttgccatcgcgaccaag

SEQ ID NO: 280158 - DNA, 32 bp, Artificial Sequence
  Description of Artificial Sequence: Synthetic oligonucleotide
atacacgagattgttgccatcgcgaccaagag

SEQ ID NO: 280159 - DNA, 31 bp, Artificial Sequence
  Description of Artificial Sequence: Synthetic oligonucleotide
tacacgagattgttgccatcgcgaccaagag

SEQ ID NO: 280160 - DNA, 30 bp, Artificial Sequence
  Description of Artificial Sequence: Synthetic oligonucleotide
acacgagattgttgccatcgcgaccaagag

SEQ ID NO: 280161 - DNA, 29 bp, Artificial Sequence
  Description of Artificial Sequence: Synthetic oligonucleotide
cacgagattgttgccatcgcgaccaagag

SEQ ID NO: 280162 - DNA, 32 bp, Artificial Sequence
  Description of Artificial Sequence: Synthetic oligonucleotide
acgagattgttgccatcgcgaccaagagaatc

SEQ ID NO: 280163 - DNA, 31 bp, Artificial Sequence
  Description of Artificial Sequence: Synthetic oligonucleotide
cgagattgttgccatcgcgaccaagagaatc

SEQ ID NO: 280164 - DNA, 31 bp, Artificial Sequence
  Description of Artificial Sequence: Synthetic oligonucleotide
gagattgttgccatcgcgaccaagagaatcg

SEQ ID NO: 280165 - DNA, 33 bp, Artificial Sequence
  Description of Artificial Sequence: Synthetic oligonucleotide
agattgttgccatcgcgaccaagagaatcgatg

SEQ ID NO: 280166 - DNA, 32 bp, Artificial Sequence
  Description of Artificial Sequence: Synthetic oligonucleotide
gattgttgccatcgcgaccaagagaatcgatg

SEQ ID NO: 280167 - DNA, 32 bp, Artificial Sequence
  Description of Artificial Sequence: Synthetic oligonucleotide
attgttgccatcgcgaccaagagaatcgatgc

SEQ ID NO: 280168 - DNA, 31 bp, Artificial Sequence
  Description of Artificial Sequence: Synthetic oligonucleotide
ttgttgccatcgcgaccaagagaatcgatgc

SEQ ID NO: 280169 - DNA, 30 bp, Artificial Sequence
  Description of Artificial Sequence: Synthetic oligonucleotide
tgttgccatcgcgaccaagagaatcgatgc

SEQ ID NO: 280170 - DNA, 29 bp, Artificial Sequence
  Description of Artificial Sequence: Synthetic oligonucleotide
gttgccatcgcgaccaagagaatcgatgc

SEQ ID NO: 280171 - DNA, 30 bp, Artificial Sequence
  Description of Artificial Sequence: Synthetic oligonucleotide
ttgccatcgcgaccaagagaatcgatgctc

SEQ ID NO: 280172 - DNA, 29 bp, Artificial Sequence
  Description of Artificial Sequence: Synthetic oligonucleotide
tgccatcgcgaccaagagaatcgatgctc

SEQ ID NO: 280173 - DNA, 28 bp, Artificial Sequence
  Description of Artificial Sequence: Synthetic oligonucleotide
gccatcgcgaccaagagaatcgatgctc

SEQ ID NO: 280174 - DNA, 29 bp, Artificial Sequence
  Description of Artificial Sequence: Synthetic oligonucleotide
ccatcgcgaccaagagaatcgatgctctg

SEQ ID NO: 280175 - DNA, 30 bp, Artificial Sequence
  Description of Artificial Sequence: Synthetic oligonucleotide
catcgcgaccaagagaatcgatgctctgac

SEQ ID NO: 280176 - DNA, 31 bp, Artificial Sequence
  Description of Artificial Sequence: Synthetic oligonucleotide
atcgcgaccaagagaatcgatgctctgacag

SEQ ID NO: 280177 - DNA, 30 bp, Artificial Sequence
  Description of Artificial Sequence: Synthetic oligonucleotide
tcgcgaccaagagaatcgatgctctgacag

SEQ ID NO: 280178 - DNA, 29 bp, Artificial Sequence
  Description of Artificial Sequence: Synthetic oligonucleotide
cgcgaccaagagaatcgatgctctgacag

SEQ ID NO: 280179 - DNA, 29 bp, Artificial Sequence
  Description of Artificial Sequence: Synthetic oligonucleotide
gcgaccaagagaatcgatgctctgacagg

SEQ ID NO: 280180 - DNA, 29 bp, Artificial Sequence
  Description of Artificial Sequence: Synthetic oligonucleotide
cgaccaagagaatcgatgctctgacaggg

SEQ ID NO: 280181 - DNA, 29 bp, Artificial Sequence
  Description of Artificial Sequence: Synthetic oligonucleotide
gaccaagagaatcgatgctctgacagggg

SEQ ID NO: 280182 - DNA, 29 bp, Artificial Sequence
  Description of Artificial Sequence: Synthetic oligonucleotide
accaagagaatcgatgctctgacaggggc

SEQ ID NO: 280183 - DNA, 28 bp, Artificial Sequence
  Description of Artificial Sequence: Synthetic oligonucleotide
ccaagagaatcgatgctctgacaggggc

SEQ ID NO: 280184 - DNA, 28 bp, Artificial Sequence
  Description of Artificial Sequence: Synthetic oligonucleotide
caagagaatcgatgctctgacaggggcg

SEQ ID NO: 280185 - DNA, 28 bp, Artificial Sequence
  Description of Artificial Sequence: Synthetic oligonucleotide
aagagaatcgatgctctgacaggggcgg

SEQ ID NO: 280186 - DNA, 27 bp, Artificial Sequence
  Description of Artificial Sequence: Synthetic oligonucleotide
agagaatcgatgctctgacaggggcgg

SEQ ID NO: 280187 - DNA, 27 bp, Artificial Sequence
  Description of Artificial Sequence: Synthetic oligonucleotide
gagaatcgatgctctgacaggggcgga

SEQ ID NO: 280188 - DNA, 27 bp, Artificial Sequence
  Description of Artificial Sequence: Synthetic oligonucleotide
agaatcgatgctctgacaggggcggac

SEQ ID NO: 280189 - DNA, 27 bp, Artificial Sequence
  Description of Artificial Sequence: Synthetic oligonucleotide
gaatcgatgctctgacaggggcggaca

SEQ ID NO: 280190 - DNA, 27 bp, Artificial Sequence
  Description of Artificial Sequence: Synthetic oligonucleotide
aatcgatgctctgacaggggcggacag

SEQ ID NO: 280191 - DNA, 26 bp, Artificial Sequence
  Description of Artificial Sequence: Synthetic oligonucleotide
atcgatgctctgacaggggcggacag

SEQ ID NO: 280192 - DNA, 25 bp, Artificial Sequence
  Description of Artificial Sequence: Synthetic oligonucleotide
tcgatgctctgacaggggcggacag

SEQ ID NO: 280193 - DNA, 24 bp, Artificial Sequence
  Description of Artificial Sequence: Synthetic oligonucleotide
cgatgctctgacaggggcggacag

SEQ ID NO: 280194 - DNA, 24 bp, Artificial Sequence
  Description of Artificial Sequence: Synthetic oligonucleotide
gatgctctgacaggggcggacagg

SEQ ID NO: 280195 - DNA, 25 bp, Artificial Sequence
  Description of Artificial Sequence: Synthetic oligonucleotide
atgctctgacaggggcggacaggga

SEQ ID NO: 280196 - DNA, 24 bp, Artificial Sequence
  Description of Artificial Sequence: Synthetic oligonucleotide
tgctctgacaggggcggacaggga

SEQ ID NO: 280197 - DNA, 23 bp, Artificial Sequence
  Description of Artificial Sequence: Synthetic oligonucleotide
gctctgacaggggcggacaggga

SEQ ID NO: 280198 - DNA, 23 bp, Artificial Sequence
  Description of Artificial Sequence: Synthetic oligonucleotide
ctctgacaggggcggacagggag

SEQ ID NO: 280199 - DNA, 25 bp, Artificial Sequence
  Description of Artificial Sequence: Synthetic oligonucleotide
tctgacaggggcggacagggagctt

SEQ ID NO: 280200 - DNA, 24 bp, Artificial Sequence
  Description of Artificial Sequence: Synthetic oligonucleotide
ctgacaggggcggacagggagctt

SEQ ID NO: 280201 - DNA, 25 bp, Artificial Sequence
  Description of Artificial Sequence: Synthetic oligonucleotide
tgacaggggcggacagggagcttca

SEQ ID NO: 280202 - DNA, 24 bp, Artificial Sequence
  Description of Artificial Sequence: Synthetic oligonucleotide
gacaggggcggacagggagcttca

SEQ ID NO: 280203 - DNA, 25 bp, Artificial Sequence
  Description of Artificial Sequence: Synthetic oligonucleotide
acaggggcggacagggagcttcaga

SEQ ID NO: 280204 - DNA, 24 bp, Artificial Sequence
  Description of Artificial Sequence: Synthetic oligonucleotide
caggggcggacagggagcttcaga

SEQ ID NO: 280205 - DNA, 24 bp, Artificial Sequence
  Description of Artificial Sequence: Synthetic oligonucleotide
aggggcggacagggagcttcagag

SEQ ID NO: 280206 - DNA, 23 bp, Artificial Sequence
  Description of Artificial Sequence: Synthetic oligonucleotide
ggggcggacagggagcttcagag

SEQ ID NO: 280207 - DNA, 25 bp, Artificial Sequence
  Description of Artificial Sequence: Synthetic oligonucleotide
gggcggacagggagcttcagaggaa

SEQ ID NO: 280208 - DNA, 25 bp, Artificial Sequence
  Description of Artificial Sequence: Synthetic oligonucleotide
ggcggacagggagcttcagaggaac

SEQ ID NO: 280209 - DNA, 26 bp, Artificial Sequence
  Description of Artificial Sequence: Synthetic oligonucleotide
gcggacagggagcttcagaggaacct

SEQ ID NO: 280210 - DNA, 26 bp, Artificial Sequence
  Description of Artificial Sequence: Synthetic oligonucleotide
cggacagggagcttcagaggaacctg

SEQ ID NO: 280211 - DNA, 27 bp, Artificial Sequence
  Description of Artificial Sequence: Synthetic oligonucleotide
ggacagggagcttcagaggaacctgct

SEQ ID NO: 280212 - DNA, 27 bp, Artificial Sequence
  Description of Artificial Sequence: Synthetic oligonucleotide
gacagggagcttcagaggaacctgctg

SEQ ID NO: 280213 - DNA, 27 bp, Artificial Sequence
  Description of Artificial Sequence: Synthetic oligonucleotide
acagggagcttcagaggaacctgctgg

SEQ ID NO: 280214 - DNA, 27 bp, Artificial Sequence
  Description of Artificial Sequence: Synthetic oligonucleotide
cagggagcttcagaggaacctgctgga

SEQ ID NO: 280215 - DNA, 27 bp, Artificial Sequence
  Description of Artificial Sequence: Synthetic oligonucleotide
agggagcttcagaggaacctgctggac

SEQ ID NO: 280216 - DNA, 26 bp, Artificial Sequence
  Description of Artificial Sequence: Synthetic oligonucleotide
gggagcttcagaggaacctgctggac

SEQ ID NO: 280217 - DNA, 27 bp, Artificial Sequence
  Description of Artificial Sequence: Synthetic oligonucleotide
ggagcttcagaggaacctgctggacct

SEQ ID NO: 280218 - DNA, 27 bp, Artificial Sequence
  Description of Artificial Sequence: Synthetic oligonucleotide
gagcttcagaggaacctgctggacctg

SEQ ID NO: 280219 - DNA, 27 bp, Artificial Sequence
  Description of Artificial Sequence: Synthetic oligonucleotide
agcttcagaggaacctgctggacctgc

SEQ ID NO: 280220 - DNA, 27 bp, Artificial Sequence
  Description of Artificial Sequence: Synthetic oligonucleotide
gcttcagaggaacctgctggacctgct

SEQ ID NO: 280221 - DNA, 27 bp, Artificial Sequence
  Description of Artificial Sequence: Synthetic oligonucleotide
cttcagaggaacctgctggacctgctg

SEQ ID NO: 280222 - DNA, 30 bp, Artificial Sequence
  Description of Artificial Sequence: Synthetic oligonucleotide
ttcagaggaacctgctggacctgctgaatg

SEQ ID NO: 280223 - DNA, 29 bp, Artificial Sequence
  Description of Artificial Sequence: Synthetic oligonucleotide
tcagaggaacctgctggacctgctgaatg

SEQ ID NO: 280224 - DNA, 28 bp, Artificial Sequence
  Description of Artificial Sequence: Synthetic oligonucleotide
cagaggaacctgctggacctgctgaatg

SEQ ID NO: 280225 - DNA, 29 bp, Artificial Sequence
  Description of Artificial Sequence: Synthetic oligonucleotide
agaggaacctgctggacctgctgaatgag

SEQ ID NO: 280226 - DNA, 28 bp, Artificial Sequence
  Description of Artificial Sequence: Synthetic oligonucleotide
gaggaacctgctggacctgctgaatgag

SEQ ID NO: 280227 - DNA, 30 bp, Artificial Sequence
  Description of Artificial Sequence: Synthetic oligonucleotide
aggaacctgctggacctgctgaatgagatg

SEQ ID NO: 280228 - DNA, 29 bp, Artificial Sequence
  Description of Artificial Sequence: Synthetic oligonucleotide
ggaacctgctggacctgctgaatgagatg

SEQ ID NO: 280229 - DNA, 29 bp, Artificial Sequence
  Description of Artificial Sequence: Synthetic oligonucleotide
gaacctgctggacctgctgaatgagatgg

SEQ ID NO: 280230 - DNA, 31 bp, Artificial Sequence
  Description of Artificial Sequence: Synthetic oligonucleotide
aacctgctggacctgctgaatgagatggatg

SEQ ID NO: 280231 - DNA, 30 bp, Artificial Sequence
  Description of Artificial Sequence: Synthetic oligonucleotide
acctgctggacctgctgaatgagatggatg

SEQ ID NO: 280232 - DNA, 29 bp, Artificial Sequence
  Description of Artificial Sequence: Synthetic oligonucleotide
cctgctggacctgctgaatgagatggatg

SEQ ID NO: 280233 - DNA, 29 bp, Artificial Sequence
  Description of Artificial Sequence: Synthetic oligonucleotide
ctgctggacctgctgaatgagatggatgc

SEQ ID NO: 280234 - DNA, 33 bp, Artificial Sequence
  Description of Artificial Sequence: Synthetic oligonucleotide
tgctggacctgctgaatgagatggatgcatttg

SEQ ID NO: 280235 - DNA, 32 bp, Artificial Sequence
  Description of Artificial Sequence: Synthetic oligonucleotide
gctggacctgctgaatgagatggatgcatttg

SEQ ID NO: 280236 - DNA, 34 bp, Artificial Sequence
  Description of Artificial Sequence: Synthetic oligonucleotide
ctggacctgctgaatgagatggatgcatttgatc

SEQ ID NO: 280237 - DNA, 35 bp, Artificial Sequence
  Description of Artificial Sequence: Synthetic oligonucleotide
tggacctgctgaatgagatggatgcatttgatcac

SEQ ID NO: 280238 - DNA, 34 bp, Artificial Sequence
  Description of Artificial Sequence: Synthetic oligonucleotide
ggacctgctgaatgagatggatgcatttgatcac

SEQ ID NO: 280239 - DNA, 37 bp, Artificial Sequence
  Description of Artificial Sequence: Synthetic oligonucleotide
gacctgctgaatgagatggatgcatttgatcacaatg

SEQ ID NO: 280240 - DNA, 38 bp, Artificial Sequence
  Description of Artificial Sequence: Synthetic oligonucleotide
acctgctgaatgagatggatgcatttgatcacaatgtc

SEQ ID NO: 280241 - DNA, 37 bp, Artificial Sequence
  Description of Artificial Sequence: Synthetic oligonucleotide
cctgctgaatgagatggatgcatttgatcacaatgtc

SEQ ID NO: 280242 - DNA, 40 bp, Artificial Sequence
  Description of Artificial Sequence: Synthetic oligonucleotide
ctgctgaatgagatggatgcatttgatcacaatgtcaatc

SEQ ID NO: 280243 - DNA, 41 bp, Artificial Sequence
  Description of Artificial Sequence: Synthetic oligonucleotide
tgctgaatgagatggatgcatttgatcacaatgtcaatctc

SEQ ID NO: 280244 - DNA, 40 bp, Artificial Sequence
  Description of Artificial Sequence: Synthetic oligonucleotide
gctgaatgagatggatgcatttgatcacaatgtcaatctc

SEQ ID NO: 280245 - DNA, 42 bp, Artificial Sequence
  Description of Artificial Sequence: Synthetic oligonucleotide
ctgaatgagatggatgcatttgatcacaatgtcaatctcaag

SEQ ID NO: 280246 - DNA, 42 bp, Artificial Sequence
  Description of Artificial Sequence: Synthetic oligonucleotide
tgaatgagatggatgcatttgatcacaatgtcaatctcaagg

SEQ ID NO: 280247 - DNA, 41 bp, Artificial Sequence
  Description of Artificial Sequence: Synthetic oligonucleotide
gaatgagatggatgcatttgatcacaatgtcaatctcaagg

SEQ ID NO: 280248 - DNA, 45 bp, Artificial Sequence
  Description of Artificial Sequence: Synthetic oligonucleotide
aatgagatggatgcatttgatcacaatgtcaatctcaaggtaaac

SEQ ID NO: 280249 - DNA, 44 bp, Artificial Sequence
  Description of Artificial Sequence: Synthetic oligonucleotide
atgagatggatgcatttgatcacaatgtcaatctcaaggtaaac

SEQ ID NO: 280250 - DNA, 43 bp, Artificial Sequence
  Description of Artificial Sequence: Synthetic oligonucleotide
tgagatggatgcatttgatcacaatgtcaatctcaaggtaaac

SEQ ID NO: 280251 - DNA, 42 bp, Artificial Sequence
  Description of Artificial Sequence: Synthetic oligonucleotide
gagatggatgcatttgatcacaatgtcaatctcaaggtaaac

SEQ ID NO: 280252 - DNA, 44 bp, Artificial Sequence
  Description of Artificial Sequence: Synthetic oligonucleotide
agatggatgcatttgatcacaatgtcaatctcaaggtaaacatg

SEQ ID NO: 280253 - DNA, 43 bp, Artificial Sequence
  Description of Artificial Sequence: Synthetic oligonucleotide
gatggatgcatttgatcacaatgtcaatctcaaggtaaacatg

SEQ ID NO: 280254 - DNA, 43 bp, Artificial Sequence
  Description of Artificial Sequence: Synthetic oligonucleotide
atggatgcatttgatcacaatgtcaatctcaaggtaaacatgg

SEQ ID NO: 280255 - DNA, 42 bp, Artificial Sequence
  Description of Artificial Sequence: Synthetic oligonucleotide
tggatgcatttgatcacaatgtcaatctcaaggtaaacatgg

SEQ ID NO: 280256 - DNA, 41 bp, Artificial Sequence
  Description of Artificial Sequence: Synthetic oligonucleotide
ggatgcatttgatcacaatgtcaatctcaaggtaaacatgg

SEQ ID NO: 280257 - DNA, 41 bp, Artificial Sequence
  Description of Artificial Sequence: Synthetic oligonucleotide
gatgcatttgatcacaatgtcaatctcaaggtaaacatggc

SEQ ID NO: 280258 - DNA, 41 bp, Artificial Sequence
  Description of Artificial Sequence: Synthetic oligonucleotide
atgcatttgatcacaatgtcaatctcaaggtaaacatggcc

SEQ ID NO: 280259 - DNA, 40 bp, Artificial Sequence
  Description of Artificial Sequence: Synthetic oligonucleotide
tgcatttgatcacaatgtcaatctcaaggtaaacatggcc

SEQ ID NO: 280260 - DNA, 39 bp, Artificial Sequence
  Description of Artificial Sequence: Synthetic oligonucleotide
gcatttgatcacaatgtcaatctcaaggtaaacatggcc

SEQ ID NO: 280261 - DNA, 40 bp, Artificial Sequence
  Description of Artificial Sequence: Synthetic oligonucleotide
catttgatcacaatgtcaatctcaaggtaaacatggccac

SEQ ID NO: 280262 - DNA, 43 bp, Artificial Sequence
  Description of Artificial Sequence: Synthetic oligonucleotide
atttgatcacaatgtcaatctcaaggtaaacatggccactaac

SEQ ID NO: 280263 - DNA, 42 bp, Artificial Sequence
  Description of Artificial Sequence: Synthetic oligonucleotide
tttgatcacaatgtcaatctcaaggtaaacatggccactaac

SEQ ID NO: 280264 - DNA, 41 bp, Artificial Sequence
  Description of Artificial Sequence: Synthetic oligonucleotide
ttgatcacaatgtcaatctcaaggtaaacatggccactaac

SEQ ID NO: 280265 - DNA, 40 bp, Artificial Sequence
  Description of Artificial Sequence: Synthetic oligonucleotide
tgatcacaatgtcaatctcaaggtaaacatggccactaac

SEQ ID NO: 280266 - DNA, 39 bp, Artificial Sequence
  Description of Artificial Sequence: Synthetic oligonucleotide
gatcacaatgtcaatctcaaggtaaacatggccactaac

SEQ ID NO: 280267 - DNA, 40 bp, Artificial Sequence
  Description of Artificial Sequence: Synthetic oligonucleotide
atcacaatgtcaatctcaaggtaaacatggccactaacag

SEQ ID NO: 280268 - DNA, 39 bp, Artificial Sequence
  Description of Artificial Sequence: Synthetic oligonucleotide
tcacaatgtcaatctcaaggtaaacatggccactaacag

SEQ ID NO: 280269 - DNA, 38 bp, Artificial Sequence
  Description of Artificial Sequence: Synthetic oligonucleotide
cacaatgtcaatctcaaggtaaacatggccactaacag

SEQ ID NO: 280270 - DNA, 39 bp, Artificial Sequence
  Description of Artificial Sequence: Synthetic oligonucleotide
acaatgtcaatctcaaggtaaacatggccactaacagag

SEQ ID NO: 280271 - DNA, 38 bp, Artificial Sequence
  Description of Artificial Sequence: Synthetic oligonucleotide
caatgtcaatctcaaggtaaacatggccactaacagag

SEQ ID NO: 280272 - DNA, 38 bp, Artificial Sequence
  Description of Artificial Sequence: Synthetic oligonucleotide
aatgtcaatctcaaggtaaacatggccactaacagagc

SEQ ID NO: 280273 - DNA, 37 bp, Artificial Sequence
  Description of Artificial Sequence: Synthetic oligonucleotide
atgtcaatctcaaggtaaacatggccactaacagagc

SEQ ID NO: 280274 - DNA, 36 bp, Artificial Sequence
  Description of Artificial Sequence: Synthetic oligonucleotide
tgtcaatctcaaggtaaacatggccactaacagagc

SEQ ID NO: 280275 - DNA, 35 bp, Artificial Sequence
  Description of Artificial Sequence: Synthetic oligonucleotide
gtcaatctcaaggtaaacatggccactaacagagc

SEQ ID NO: 280276 - DNA, 36 bp, Artificial Sequence
  Description of Artificial Sequence: Synthetic oligonucleotide
tcaatctcaaggtaaacatggccactaacagagcac

SEQ ID NO: 280277 - DNA, 35 bp, Artificial Sequence
  Description of Artificial Sequence: Synthetic oligonucleotide
caatctcaaggtaaacatggccactaacagagcac

SEQ ID NO: 280278 - DNA, 36 bp, Artificial Sequence
  Description of Artificial Sequence: Synthetic oligonucleotide
aatctcaaggtaaacatggccactaacagagcacac

SEQ ID NO: 280279 - DNA, 35 bp, Artificial Sequence
  Description of Artificial Sequence: Synthetic oligonucleotide
atctcaaggtaaacatggccactaacagagcacac

SEQ ID NO: 280280 - DNA, 34 bp, Artificial Sequence
  Description of Artificial Sequence: Synthetic oligonucleotide
tctcaaggtaaacatggccactaacagagcacac

SEQ ID NO: 280281 - DNA, 33 bp, Artificial Sequence
  Description of Artificial Sequence: Synthetic oligonucleotide
ctcaaggtaaacatggccactaacagagcacac

SEQ ID NO: 280282 - DNA, 34 bp, Artificial Sequence
  Description of Artificial Sequence: Synthetic oligonucleotide
tcaaggtaaacatggccactaacagagcacacac

SEQ ID NO: 280283 - DNA, 33 bp, Artificial Sequence
  Description of Artificial Sequence: Synthetic oligonucleotide
caaggtaaacatggccactaacagagcacacac

SEQ ID NO: 280284 - DNA, 33 bp, Artificial Sequence
  Description of Artificial Sequence: Synthetic oligonucleotide
aaggtaaacatggccactaacagagcacacacc

SEQ ID NO: 280285 - DNA, 32 bp, Artificial Sequence
  Description of Artificial Sequence: Synthetic oligonucleotide
aggtaaacatggccactaacagagcacacacc

SEQ ID NO: 280286 - DNA, 31 bp, Artificial Sequence
  Description of Artificial Sequence: Synthetic oligonucleotide
ggtaaacatggccactaacagagcacacacc

SEQ ID NO: 280287 - DNA, 31 bp, Artificial Sequence
  Description of Artificial Sequence: Synthetic oligonucleotide
gtaaacatggccactaacagagcacacaccc

SEQ ID NO: 280288 - DNA, 32 bp, Artificial Sequence
  Description of Artificial Sequence: Synthetic oligonucleotide
taaacatggccactaacagagcacacaccctg

SEQ ID NO: 280289 - DNA, 31 bp, Artificial Sequence
  Description of Artificial Sequence: Synthetic oligonucleotide
aaacatggccactaacagagcacacaccctg

SEQ ID NO: 280290 - DNA, 30 bp, Artificial Sequence
  Description of Artificial Sequence: Synthetic oligonucleotide
aacatggccactaacagagcacacaccctg

SEQ ID NO: 280291 - DNA, 29 bp, Artificial Sequence
  Description of Artificial Sequence: Synthetic oligonucleotide
acatggccactaacagagcacacaccctg

SEQ ID NO: 280292 - DNA, 28 bp, Artificial Sequence
  Description of Artificial Sequence: Synthetic oligonucleotide
catggccactaacagagcacacaccctg

SEQ ID NO: 280293 - DNA, 28 bp, Artificial Sequence
  Description of Artificial Sequence: Synthetic oligonucleotide
atggccactaacagagcacacaccctgg

SEQ ID NO: 280294 - DNA, 27 bp, Artificial Sequence
  Description of Artificial Sequence: Synthetic oligonucleotide
tggccactaacagagcacacaccctgg

SEQ ID NO: 280295 - DNA, 27 bp, Artificial Sequence
  Description of Artificial Sequence: Synthetic oligonucleotide
ggccactaacagagcacacaccctggt

SEQ ID NO: 280296 - DNA, 28 bp, Artificial Sequence
  Description of Artificial Sequence: Synthetic oligonucleotide
gccactaacagagcacacaccctggttc

SEQ ID NO: 280297 - DNA, 28 bp, Artificial Sequence
  Description of Artificial Sequence: Synthetic oligonucleotide
ccactaacagagcacacaccctggttcc

SEQ ID NO: 280298 - DNA, 28 bp, Artificial Sequence
  Description of Artificial Sequence: Synthetic oligonucleotide
cactaacagagcacacaccctggttccg

SEQ ID NO: 280299 - DNA, 28 bp, Artificial Sequence
  Description of Artificial Sequence: Synthetic oligonucleotide
actaacagagcacacaccctggttccgg

SEQ ID NO: 280300 - DNA, 27 bp, Artificial Sequence
  Description of Artificial Sequence: Synthetic oligonucleotide
ctaacagagcacacaccctggttccgg

SEQ ID NO: 280301 - DNA, 27 bp, Artificial Sequence
  Description of Artificial Sequence: Synthetic oligonucleotide
taacagagcacacaccctggttccggc

SEQ ID NO: 280302 - DNA, 26 bp, Artificial Sequence
  Description of Artificial Sequence: Synthetic oligonucleotide
aacagagcacacaccctggttccggc

SEQ ID NO: 280303 - DNA, 25 bp, Artificial Sequence
  Description of Artificial Sequence: Synthetic oligonucleotide
acagagcacacaccctggttccggc

SEQ ID NO: 280304 - DNA, 24 bp, Artificial Sequence
  Description of Artificial Sequence: Synthetic oligonucleotide
cagagcacacaccctggttccggc

SEQ ID NO: 280305 - DNA, 24 bp, Artificial Sequence
  Description of Artificial Sequence: Synthetic oligonucleotide
agagcacacaccctggttccggcc

SEQ ID NO: 280306 - DNA, 23 bp, Artificial Sequence
  Description of Artificial Sequence: Synthetic oligonucleotide
gagcacacaccctggttccggcc

SEQ ID NO: 280307 - DNA, 24 bp, Artificial Sequence
  Description of Artificial Sequence: Synthetic oligonucleotide
agcacacaccctggttccggccct

SEQ ID NO: 280308 - DNA, 23 bp, Artificial Sequence
  Description of Artificial Sequence: Synthetic oligonucleotide
gcacacaccctggttccggccct

SEQ ID NO: 280309 - DNA, 23 bp, Artificial Sequence
  Description of Artificial Sequence: Synthetic oligonucleotide
cacacaccctggttccggccctc

SEQ ID NO: 280310 - DNA, 25 bp, Artificial Sequence
  Description of Artificial Sequence: Synthetic oligonucleotide
acacaccctggttccggccctccta

SEQ ID NO: 280311 - DNA, 24 bp, Artificial Sequence
  Description of Artificial Sequence: Synthetic oligonucleotide
cacaccctggttccggccctccta

SEQ ID NO: 280312 - DNA, 24 bp, Artificial Sequence
  Description of Artificial Sequence: Synthetic oligonucleotide
acaccctggttccggccctcctac

SEQ ID NO: 280313 - DNA, 23 bp, Artificial Sequence
  Description of Artificial Sequence: Synthetic oligonucleotide
caccctggttccggccctcctac

SEQ ID NO: 280314 - DNA, 23 bp, Artificial Sequence
  Description of Artificial Sequence: Synthetic oligonucleotide
accctggttccggccctcctacg

SEQ ID NO: 280315 - DNA, 22 bp, Artificial Sequence
  Description of Artificial Sequence: Synthetic oligonucleotide
ccctggttccggccctcctacg

SEQ ID NO: 280316 - DNA, 22 bp, Artificial Sequence
  Description of Artificial Sequence: Synthetic oligonucleotide
cctggttccggccctcctacgg

SEQ ID NO: 280317 - DNA, 22 bp, Artificial Sequence
  Description of Artificial Sequence: Synthetic oligonucleotide
ctggttccggccctcctacggc

SEQ ID NO: 280318 - DNA, 23 bp, Artificial Sequence
  Description of Artificial Sequence: Synthetic oligonucleotide
tggttccggccctcctacggcca

SEQ ID NO: 280319 - DNA, 22 bp, Artificial Sequence
  Description of Artificial Sequence: Synthetic oligonucleotide
ggttccggccctcctacggcca

SEQ ID NO: 280320 - DNA, 22 bp, Artificial Sequence
  Description of Artificial Sequence: Synthetic oligonucleotide
gttccggccctcctacggccac

SEQ ID NO: 280321 - DNA, 23 bp, Artificial Sequence
  Description of Artificial Sequence: Synthetic oligonucleotide
ttccggccctcctacggccacga

SEQ ID NO: 280322 - DNA, 22 bp, Artificial Sequence
  Description of Artificial Sequence: Synthetic oligonucleotide
tccggccctcctacggccacga

SEQ ID NO: 280323 - DNA, 21 bp, Artificial Sequence
  Description of Artificial Sequence: Synthetic oligonucleotide
ccggccctcctacggccacga

SEQ ID NO: 280324 - DNA, 21 bp, Artificial Sequence
  Description of Artificial Sequence: Synthetic oligonucleotide
cggccctcctacggccacgac

SEQ ID NO: 280325 - DNA, 21 bp, Artificial Sequence
  Description of Artificial Sequence: Synthetic oligonucleotide
ggccctcctacggccacgacg

SEQ ID NO: 280326 - DNA, 21 bp, Artificial Sequence
  Description of Artificial Sequence: Synthetic oligonucleotide
gccctcctacggccacgacgg

SEQ ID NO: 280327 - DNA, 22 bp, Artificial Sequence
  Description of Artificial Sequence: Synthetic oligonucleotide
ccctcctacggccacgacggct

SEQ ID NO: 280328 - DNA, 22 bp, Artificial Sequence
  Description of Artificial Sequence: Synthetic oligonucleotide
cctcctacggccacgacggctg

SEQ ID NO: 280329 - DNA, 23 bp, Artificial Sequence
  Description of Artificial Sequence: Synthetic oligonucleotide
ctcctacggccacgacggctggt

SEQ ID NO: 280330 - DNA, 23 bp, Artificial Sequence
  Description of Artificial Sequence: Synthetic oligonucleotide
tcctacggccacgacggctggtc

SEQ ID NO: 280331 - DNA, 22 bp, Artificial Sequence
  Description of Artificial Sequence: Synthetic oligonucleotide
cctacggccacgacggctggtc

SEQ ID NO: 280332 - DNA, 22 bp, Artificial Sequence
  Description of Artificial Sequence: Synthetic oligonucleotide
ctacggccacgacggctggtcc

SEQ ID NO: 280333 - DNA, 27 bp, Artificial Sequence
  Description of Artificial Sequence: Synthetic oligonucleotide
tacggccacgacggctggtccgtaaaa

SEQ ID NO: 280334 - DNA, 27 bp, Artificial Sequence
  Description of Artificial Sequence: Synthetic oligonucleotide
acggccacgacggctggtccgtaaaat

SEQ ID NO: 280335 - DNA, 27 bp, Artificial Sequence
  Description of Artificial Sequence: Synthetic oligonucleotide
cggccacgacggctggtccgtaaaata

SEQ ID NO: 280336 - DNA, 27 bp, Artificial Sequence
  Description of Artificial Sequence: Synthetic oligonucleotide
ggccacgacggctggtccgtaaaatag

SEQ ID NO: 280337 - DNA, 32 bp, Artificial Sequence
  Description of Artificial Sequence: Synthetic oligonucleotide
gccacgacggctggtccgtaaaatagaatttc

SEQ ID NO: 280338 - DNA, 32 bp, Artificial Sequence
  Description of Artificial Sequence: Synthetic oligonucleotide
ccacgacggctggtccgtaaaatagaatttcc

SEQ ID NO: 280339 - DNA, 33 bp, Artificial Sequence
  Description of Artificial Sequence: Synthetic oligonucleotide
cacgacggctggtccgtaaaatagaatttccag

SEQ ID NO: 280340 - DNA, 35 bp, Artificial Sequence
  Description of Artificial Sequence: Synthetic oligonucleotide
acgacggctggtccgtaaaatagaatttccagttc

SEQ ID NO: 280341 - DNA, 34 bp, Artificial Sequence
  Description of Artificial Sequence: Synthetic oligonucleotide
cgacggctggtccgtaaaatagaatttccagttc

SEQ ID NO: 280342 - DNA, 34 bp, Artificial Sequence
  Description of Artificial Sequence: Synthetic oligonucleotide
gacggctggtccgtaaaatagaatttccagttcc

SEQ ID NO: 280343 - DNA, 35 bp, Artificial Sequence
  Description of Artificial Sequence: Synthetic oligonucleotide
acggctggtccgtaaaatagaatttccagttcctg

SEQ ID NO: 280344 - DNA, 34 bp, Artificial Sequence
  Description of Artificial Sequence: Synthetic oligonucleotide
cggctggtccgtaaaatagaatttccagttcctg

SEQ ID NO: 280345 - DNA, 35 bp, Artificial Sequence
  Description of Artificial Sequence: Synthetic oligonucleotide
ggctggtccgtaaaatagaatttccagttcctgac

SEQ ID NO: 280346 - DNA, 35 bp, Artificial Sequence
  Description of Artificial Sequence: Synthetic oligonucleotide
gctggtccgtaaaatagaatttccagttcctgacc

SEQ ID NO: 280347 - DNA, 35 bp, Artificial Sequence
  Description of Artificial Sequence: Synthetic oligonucleotide
ctggtccgtaaaatagaatttccagttcctgaccc

SEQ ID NO: 280348 - DNA, 35 bp, Artificial Sequence
  Description of Artificial Sequence: Synthetic oligonucleotide
tggtccgtaaaatagaatttccagttcctgacccc

SEQ ID NO: 280349 - DNA, 34 bp, Artificial Sequence
  Description of Artificial Sequence: Synthetic oligonucleotide
ggtccgtaaaatagaatttccagttcctgacccc

SEQ ID NO: 280350 - DNA, 34 bp, Artificial Sequence
  Description of Artificial Sequence: Synthetic oligonucleotide
gtccgtaaaatagaatttccagttcctgaccccc

SEQ ID NO: 280351 - DNA, 34 bp, Artificial Sequence
  Description of Artificial Sequence: Synthetic oligonucleotide
tccgtaaaatagaatttccagttcctgacccccg

SEQ ID NO: 280352 - DNA, 33 bp, Artificial Sequence
  Description of Artificial Sequence: Synthetic oligonucleotide
ccgtaaaatagaatttccagttcctgacccccg

SEQ ID NO: 280353 - DNA, 33 bp, Artificial Sequence
  Description of Artificial Sequence: Synthetic oligonucleotide
cgtaaaatagaatttccagttcctgacccccgc

SEQ ID NO: 280354 - DNA, 33 bp, Artificial Sequence
  Description of Artificial Sequence: Synthetic oligonucleotide
gtaaaatagaatttccagttcctgacccccgcc

SEQ ID NO: 280355 - DNA, 34 bp, Artificial Sequence
  Description of Artificial Sequence: Synthetic oligonucleotide
taaaatagaatttccagttcctgacccccgccag

SEQ ID NO: 280356 - DNA, 33 bp, Artificial Sequence
  Description of Artificial Sequence: Synthetic oligonucleotide
aaaatagaatttccagttcctgacccccgccag

SEQ ID NO: 280357 - DNA, 32 bp, Artificial Sequence
  Description of Artificial Sequence: Synthetic oligonucleotide
aaatagaatttccagttcctgacccccgccag

SEQ ID NO: 280358 - DNA, 31 bp, Artificial Sequence
  Description of Artificial Sequence: Synthetic oligonucleotide
aatagaatttccagttcctgacccccgccag

SEQ ID NO: 280359 - DNA, 30 bp, Artificial Sequence
  Description of Artificial Sequence: Synthetic oligonucleotide
atagaatttccagttcctgacccccgccag

SEQ ID NO: 280360 - DNA, 29 bp, Artificial Sequence
  Description of Artificial Sequence: Synthetic oligonucleotide
tagaatttccagttcctgacccccgccag

SEQ ID NO: 280361 - DNA, 28 bp, Artificial Sequence
  Description of Artificial Sequence: Synthetic oligonucleotide
agaatttccagttcctgacccccgccag

SEQ ID NO: 280362 - DNA, 27 bp, Artificial Sequence
  Description of Artificial Sequence: Synthetic oligonucleotide
gaatttccagttcctgacccccgccag

SEQ ID NO: 280363 - DNA, 29 bp, Artificial Sequence
  Description of Artificial Sequence: Synthetic oligonucleotide
aatttccagttcctgacccccgccagaac

SEQ ID NO: 280364 - DNA, 28 bp, Artificial Sequence
  Description of Artificial Sequence: Synthetic oligonucleotide
atttccagttcctgacccccgccagaac

SEQ ID NO: 280365 - DNA, 27 bp, Artificial Sequence
  Description of Artificial Sequence: Synthetic oligonucleotide
tttccagttcctgacccccgccagaac

SEQ ID NO: 280366 - DNA, 27 bp, Artificial Sequence
  Description of Artificial Sequence: Synthetic oligonucleotide
ttccagttcctgacccccgccagaaca

SEQ ID NO: 280367 - DNA, 26 bp, Artificial Sequence
  Description of Artificial Sequence: Synthetic oligonucleotide
tccagttcctgacccccgccagaaca

SEQ ID NO: 280368 - DNA, 25 bp, Artificial Sequence
  Description of Artificial Sequence: Synthetic oligonucleotide
ccagttcctgacccccgccagaaca

SEQ ID NO: 280369 - DNA, 27 bp, Artificial Sequence
  Description of Artificial Sequence: Synthetic oligonucleotide
cagttcctgacccccgccagaacagat

SEQ ID NO: 280370 - DNA, 28 bp, Artificial Sequence
  Description of Artificial Sequence: Synthetic oligonucleotide
agttcctgacccccgccagaacagattg

SEQ ID NO: 280371 - DNA, 27 bp, Artificial Sequence
  Description of Artificial Sequence: Synthetic oligonucleotide
gttcctgacccccgccagaacagattg

SEQ ID NO: 280372 - DNA, 32 bp, Artificial Sequence
  Description of Artificial Sequence: Synthetic oligonucleotide
ttcctgacccccgccagaacagattgattatc

SEQ ID NO: 280373 - DNA, 31 bp, Artificial Sequence
  Description of Artificial Sequence: Synthetic oligonucleotide
tcctgacccccgccagaacagattgattatc

SEQ ID NO: 280374 - DNA, 30 bp, Artificial Sequence
  Description of Artificial Sequence: Synthetic oligonucleotide
cctgacccccgccagaacagattgattatc

SEQ ID NO: 280375 - DNA, 31 bp, Artificial Sequence
  Description of Artificial Sequence: Synthetic oligonucleotide
ctgacccccgccagaacagattgattatctc

SEQ ID NO: 280376 - DNA, 31 bp, Artificial Sequence
  Description of Artificial Sequence: Synthetic oligonucleotide
tgacccccgccagaacagattgattatctcc

SEQ ID NO: 280377 - DNA, 30 bp, Artificial Sequence
  Description of Artificial Sequence: Synthetic oligonucleotide
gacccccgccagaacagattgattatctcc

SEQ ID NO: 280378 - DNA, 31 bp, Artificial Sequence
  Description of Artificial Sequence: Synthetic oligonucleotide
acccccgccagaacagattgattatctccac

SEQ ID NO: 280379 - DNA, 30 bp, Artificial Sequence
  Description of Artificial Sequence: Synthetic oligonucleotide
cccccgccagaacagattgattatctccac

SEQ ID NO: 280380 - DNA, 33 bp, Artificial Sequence
  Description of Artificial Sequence: Synthetic oligonucleotide
ccccgccagaacagattgattatctccactaac

SEQ ID NO: 280381 - DNA, 34 bp, Artificial Sequence
  Description of Artificial Sequence: Synthetic oligonucleotide
cccgccagaacagattgattatctccactaacac

SEQ ID NO: 280382 - DNA, 36 bp, Artificial Sequence
  Description of Artificial Sequence: Synthetic oligonucleotide
ccgccagaacagattgattatctccactaacactag

SEQ ID NO: 280383 - DNA, 36 bp, Artificial Sequence
  Description of Artificial Sequence: Synthetic oligonucleotide
cgccagaacagattgattatctccactaacactagc

SEQ ID NO: 280384 - DNA, 38 bp, Artificial Sequence
  Description of Artificial Sequence: Synthetic oligonucleotide
gccagaacagattgattatctccactaacactagcaac

SEQ ID NO: 280385 - DNA, 40 bp, Artificial Sequence
  Description of Artificial Sequence: Synthetic oligonucleotide
ccagaacagattgattatctccactaacactagcaacatg

SEQ ID NO: 280386 - DNA, 42 bp, Artificial Sequence
  Description of Artificial Sequence: Synthetic oligonucleotide
cagaacagattgattatctccactaacactagcaacatgaac

SEQ ID NO: 280387 - DNA, 42 bp, Artificial Sequence
  Description of Artificial Sequence: Synthetic oligonucleotide
agaacagattgattatctccactaacactagcaacatgaacc

SEQ ID NO: 280388 - DNA, 41 bp, Artificial Sequence
  Description of Artificial Sequence: Synthetic oligonucleotide
gaacagattgattatctccactaacactagcaacatgaacc

SEQ ID NO: 280389 - DNA, 42 bp, Artificial Sequence
  Description of Artificial Sequence: Synthetic oligonucleotide
aacagattgattatctccactaacactagcaacatgaacctc

SEQ ID NO: 280390 - DNA, 41 bp, Artificial Sequence
  Description of Artificial Sequence: Synthetic oligonucleotide
acagattgattatctccactaacactagcaacatgaacctc

SEQ ID NO: 280391 - DNA, 40 bp, Artificial Sequence
  Description of Artificial Sequence: Synthetic oligonucleotide
cagattgattatctccactaacactagcaacatgaacctc

SEQ ID NO: 280392 - DNA, 41 bp, Artificial Sequence
  Description of Artificial Sequence: Synthetic oligonucleotide
agattgattatctccactaacactagcaacatgaacctcac

SEQ ID NO: 280393 - DNA, 40 bp, Artificial Sequence
  Description of Artificial Sequence: Synthetic oligonucleotide
gattgattatctccactaacactagcaacatgaacctcac

SEQ ID NO: 280394 - DNA, 41 bp, Artificial Sequence
  Description of Artificial Sequence: Synthetic oligonucleotide
attgattatctccactaacactagcaacatgaacctcactg

SEQ ID NO: 280395 - DNA, 40 bp, Artificial Sequence
  Description of Artificial Sequence: Synthetic oligonucleotide
ttgattatctccactaacactagcaacatgaacctcactg

SEQ ID NO: 280396 - DNA, 39 bp, Artificial Sequence
  Description of Artificial Sequence: Synthetic oligonucleotide
tgattatctccactaacactagcaacatgaacctcactg

SEQ ID NO: 280397 - DNA, 38 bp, Artificial Sequence
  Description of Artificial Sequence: Synthetic oligonucleotide
gattatctccactaacactagcaacatgaacctcactg

SEQ ID NO: 280398 - DNA, 39 bp, Artificial Sequence
  Description of Artificial Sequence: Synthetic oligonucleotide
attatctccactaacactagcaacatgaacctcactgag

SEQ ID NO: 280399 - DNA, 38 bp, Artificial Sequence
  Description of Artificial Sequence: Synthetic oligonucleotide
ttatctccactaacactagcaacatgaacctcactgag

SEQ ID NO: 280400 - DNA, 37 bp, Artificial Sequence
  Description of Artificial Sequence: Synthetic oligonucleotide
tatctccactaacactagcaacatgaacctcactgag

SEQ ID NO: 280401 - DNA, 36 bp, Artificial Sequence
  Description of Artificial Sequence: Synthetic oligonucleotide
atctccactaacactagcaacatgaacctcactgag

SEQ ID NO: 280402 - DNA, 35 bp, Artificial Sequence
  Description of Artificial Sequence: Synthetic oligonucleotide
tctccactaacactagcaacatgaacctcactgag

SEQ ID NO: 280403 - DNA, 34 bp, Artificial Sequence
  Description of Artificial Sequence: Synthetic oligonucleotide
ctccactaacactagcaacatgaacctcactgag

SEQ ID NO: 280404 - DNA, 34 bp, Artificial Sequence
  Description of Artificial Sequence: Synthetic oligonucleotide
tccactaacactagcaacatgaacctcactgagg

SEQ ID NO: 280405 - DNA, 33 bp, Artificial Sequence
  Description of Artificial Sequence: Synthetic oligonucleotide
ccactaacactagcaacatgaacctcactgagg

SEQ ID NO: 280406 - DNA, 34 bp, Artificial Sequence
  Description of Artificial Sequence: Synthetic oligonucleotide
cactaacactagcaacatgaacctcactgaggag

SEQ ID NO: 280407 - DNA, 34 bp, Artificial Sequence
  Description of Artificial Sequence: Synthetic oligonucleotide
actaacactagcaacatgaacctcactgaggagg

SEQ ID NO: 280408 - DNA, 33 bp, Artificial Sequence
  Description of Artificial Sequence: Synthetic oligonucleotide
ctaacactagcaacatgaacctcactgaggagg

SEQ ID NO: 280409 - DNA, 35 bp, Artificial Sequence
  Description of Artificial Sequence: Synthetic oligonucleotide
taacactagcaacatgaacctcactgaggaggatg

SEQ ID NO: 280410 - DNA, 34 bp, Artificial Sequence
  Description of Artificial Sequence: Synthetic oligonucleotide
aacactagcaacatgaacctcactgaggaggatg

SEQ ID NO: 280411 - DNA, 33 bp, Artificial Sequence
  Description of Artificial Sequence: Synthetic oligonucleotide
acactagcaacatgaacctcactgaggaggatg

SEQ ID NO: 280412 - DNA, 32 bp, Artificial Sequence
  Description of Artificial Sequence: Synthetic oligonucleotide
cactagcaacatgaacctcactgaggaggatg

SEQ ID NO: 280413 - DNA, 33 bp, Artificial Sequence
  Description of Artificial Sequence: Synthetic oligonucleotide
actagcaacatgaacctcactgaggaggatgac

SEQ ID NO: 280414 - DNA, 32 bp, Artificial Sequence
  Description of Artificial Sequence: Synthetic oligonucleotide
ctagcaacatgaacctcactgaggaggatgac

SEQ ID NO: 280415 - DNA, 34 bp, Artificial Sequence
  Description of Artificial Sequence: Synthetic oligonucleotide
tagcaacatgaacctcactgaggaggatgacttg

SEQ ID NO: 280416 - DNA, 33 bp, Artificial Sequence
  Description of Artificial Sequence: Synthetic oligonucleotide
agcaacatgaacctcactgaggaggatgacttg

SEQ ID NO: 280417 - DNA, 32 bp, Artificial Sequence
  Description of Artificial Sequence: Synthetic oligonucleotide
gcaacatgaacctcactgaggaggatgacttg

SEQ ID NO: 280418 - DNA, 32 bp, Artificial Sequence
  Description of Artificial Sequence: Synthetic oligonucleotide
caacatgaacctcactgaggaggatgacttgg

SEQ ID NO: 280419 - DNA, 34 bp, Artificial Sequence
  Description of Artificial Sequence: Synthetic oligonucleotide
aacatgaacctcactgaggaggatgacttggatg

SEQ ID NO: 280420 - DNA, 33 bp, Artificial Sequence
  Description of Artificial Sequence: Synthetic oligonucleotide
acatgaacctcactgaggaggatgacttggatg

SEQ ID NO: 280421 - DNA, 32 bp, Artificial Sequence
  Description of Artificial Sequence: Synthetic oligonucleotide
catgaacctcactgaggaggatgacttggatg

SEQ ID NO: 280422 - DNA, 33 bp, Artificial Sequence
  Description of Artificial Sequence: Synthetic oligonucleotide
atgaacctcactgaggaggatgacttggatgac

SEQ ID NO: 280423 - DNA, 32 bp, Artificial Sequence
  Description of Artificial Sequence: Synthetic oligonucleotide
tgaacctcactgaggaggatgacttggatgac

SEQ ID NO: 280424 - DNA, 31 bp, Artificial Sequence
  Description of Artificial Sequence: Synthetic oligonucleotide
gaacctcactgaggaggatgacttggatgac

SEQ ID NO: 280425 - DNA, 34 bp, Artificial Sequence
  Description of Artificial Sequence: Synthetic oligonucleotide
aacctcactgaggaggatgacttggatgactatg

SEQ ID NO: 280426 - DNA, 33 bp, Artificial Sequence
  Description of Artificial Sequence: Synthetic oligonucleotide
acctcactgaggaggatgacttggatgactatg

SEQ ID NO: 280427 - DNA, 32 bp, Artificial Sequence
  Description of Artificial Sequence: Synthetic oligonucleotide
cctcactgaggaggatgacttggatgactatg

SEQ ID NO: 280428 - DNA, 33 bp, Artificial Sequence
  Description of Artificial Sequence: Synthetic oligonucleotide
ctcactgaggaggatgacttggatgactatgtg

SEQ ID NO: 280429 - DNA, 33 bp, Artificial Sequence
  Description of Artificial Sequence: Synthetic oligonucleotide
tcactgaggaggatgacttggatgactatgtgc

SEQ ID NO: 280430 - DNA, 32 bp, Artificial Sequence
  Description of Artificial Sequence: Synthetic oligonucleotide
cactgaggaggatgacttggatgactatgtgc

SEQ ID NO: 280431 - DNA, 32 bp, Artificial Sequence
  Description of Artificial Sequence: Synthetic oligonucleotide
actgaggaggatgacttggatgactatgtgcc

SEQ ID NO: 280432 - DNA, 31 bp, Artificial Sequence
  Description of Artificial Sequence: Synthetic oligonucleotide
ctgaggaggatgacttggatgactatgtgcc

SEQ ID NO: 280433 - DNA, 31 bp, Artificial Sequence
  Description of Artificial Sequence: Synthetic oligonucleotide
tgaggaggatgacttggatgactatgtgccc

SEQ ID NO: 280434 - DNA, 30 bp, Artificial Sequence
  Description of Artificial Sequence: Synthetic oligonucleotide
gaggaggatgacttggatgactatgtgccc

SEQ ID NO: 280435 - DNA, 30 bp, Artificial Sequence
  Description of Artificial Sequence: Synthetic oligonucleotide
aggaggatgacttggatgactatgtgcccc

SEQ ID NO: 280436 - DNA, 29 bp, Artificial Sequence
  Description of Artificial Sequence: Synthetic oligonucleotide
ggaggatgacttggatgactatgtgcccc

SEQ ID NO: 280437 - DNA, 29 bp, Artificial Sequence
  Description of Artificial Sequence: Synthetic oligonucleotide
gaggatgacttggatgactatgtgccccg

SEQ ID NO: 280438 - DNA, 29 bp, Artificial Sequence
  Description of Artificial Sequence: Synthetic oligonucleotide
aggatgacttggatgactatgtgccccgg

SEQ ID NO: 280439 - DNA, 28 bp, Artificial Sequence
  Description of Artificial Sequence: Synthetic oligonucleotide
ggatgacttggatgactatgtgccccgg

SEQ ID NO: 280440 - DNA, 28 bp, Artificial Sequence
  Description of Artificial Sequence: Synthetic oligonucleotide
gatgacttggatgactatgtgccccggc

SEQ ID NO: 280441 - DNA, 28 bp, Artificial Sequence
  Description of Artificial Sequence: Synthetic oligonucleotide
atgacttggatgactatgtgccccggcc

SEQ ID NO: 280442 - DNA, 27 bp, Artificial Sequence
  Description of Artificial Sequence: Synthetic oligonucleotide
tgacttggatgactatgtgccccggcc

SEQ ID NO: 280443 - DNA, 27 bp, Artificial Sequence
  Description of Artificial Sequence: Synthetic oligonucleotide
gacttggatgactatgtgccccggcca

SEQ ID NO: 280444 - DNA, 27 bp, Artificial Sequence
  Description of Artificial Sequence: Synthetic oligonucleotide
acttggatgactatgtgccccggccag

SEQ ID NO: 280445 - DNA, 27 bp, Artificial Sequence
  Description of Artificial Sequence: Synthetic oligonucleotide
cttggatgactatgtgccccggccagt

SEQ ID NO: 280446 - DNA, 30 bp, Artificial Sequence
  Description of Artificial Sequence: Synthetic oligonucleotide
ttggatgactatgtgccccggccagttaag

SEQ ID NO: 280447 - DNA, 29 bp, Artificial Sequence
  Description of Artificial Sequence: Synthetic oligonucleotide
tggatgactatgtgccccggccagttaag

SEQ ID NO: 280448 - DNA, 28 bp, Artificial Sequence
  Description of Artificial Sequence: Synthetic oligonucleotide
ggatgactatgtgccccggccagttaag

SEQ ID NO: 280449 - DNA, 32 bp, Artificial Sequence
  Description of Artificial Sequence: Synthetic oligonucleotide
gatgactatgtgccccggccagttaagatttc

SEQ ID NO: 280450 - DNA, 33 bp, Artificial Sequence
  Description of Artificial Sequence: Synthetic oligonucleotide
atgactatgtgccccggccagttaagatttctg

SEQ ID NO: 280451 - DNA, 32 bp, Artificial Sequence
  Description of Artificial Sequence: Synthetic oligonucleotide
tgactatgtgccccggccagttaagatttctg

SEQ ID NO: 280452 - DNA, 31 bp, Artificial Sequence
  Description of Artificial Sequence: Synthetic oligonucleotide
gactatgtgccccggccagttaagatttctg

SEQ ID NO: 280453 - DNA, 31 bp, Artificial Sequence
  Description of Artificial Sequence: Synthetic oligonucleotide
actatgtgccccggccagttaagatttctgg

SEQ ID NO: 280454 - DNA, 30 bp, Artificial Sequence
  Description of Artificial Sequence: Synthetic oligonucleotide
ctatgtgccccggccagttaagatttctgg

SEQ ID NO: 280455 - DNA, 31 bp, Artificial Sequence
  Description of Artificial Sequence: Synthetic oligonucleotide
tatgtgccccggccagttaagatttctggag

SEQ ID NO: 280456 - DNA, 30 bp, Artificial Sequence
  Description of Artificial Sequence: Synthetic oligonucleotide
atgtgccccggccagttaagatttctggag

SEQ ID NO: 280457 - DNA, 29 bp, Artificial Sequence
  Description of Artificial Sequence: Synthetic oligonucleotide
tgtgccccggccagttaagatttctggag

SEQ ID NO: 280458 - DNA, 28 bp, Artificial Sequence
  Description of Artificial Sequence: Synthetic oligonucleotide
gtgccccggccagttaagatttctggag

SEQ ID NO: 280459 - DNA, 28 bp, Artificial Sequence
  Description of Artificial Sequence: Synthetic oligonucleotide
tgccccggccagttaagatttctggagc

SEQ ID NO: 280460 - DNA, 27 bp, Artificial Sequence
  Description of Artificial Sequence: Synthetic oligonucleotide
gccccggccagttaagatttctggagc

SEQ ID NO: 280461 - DNA, 28 bp, Artificial Sequence
  Description of Artificial Sequence: Synthetic oligonucleotide
ccccggccagttaagatttctggagctg

SEQ ID NO: 280462 - DNA, 35 bp, Artificial Sequence
  Description of Artificial Sequence: Synthetic oligonucleotide
cccggccagttaagatttctggagctgattttaac

SEQ ID NO: 280463 - DNA, 36 bp, Artificial Sequence
  Description of Artificial Sequence: Synthetic oligonucleotide
ccggccagttaagatttctggagctgattttaactc

SEQ ID NO: 280464 - DNA, 36 bp, Artificial Sequence
  Description of Artificial Sequence: Synthetic oligonucleotide
cggccagttaagatttctggagctgattttaactcc

SEQ ID NO: 280465 - DNA, 38 bp, Artificial Sequence
  Description of Artificial Sequence: Synthetic oligonucleotide
ggccagttaagatttctggagctgattttaactccaac

SEQ ID NO: 280466 - DNA, 39 bp, Artificial Sequence
  Description of Artificial Sequence: Synthetic oligonucleotide
gccagttaagatttctggagctgattttaactccaactg

SEQ ID NO: 280467 - DNA, 40 bp, Artificial Sequence
  Description of Artificial Sequence: Synthetic oligonucleotide
ccagttaagatttctggagctgattttaactccaactgtc

SEQ ID NO: 280468 - DNA, 41 bp, Artificial Sequence
  Description of Artificial Sequence: Synthetic oligonucleotide
cagttaagatttctggagctgattttaactccaactgtcag

SEQ ID NO: 280469 - DNA, 41 bp, Artificial Sequence
  Description of Artificial Sequence: Synthetic oligonucleotide
agttaagatttctggagctgattttaactccaactgtcagg

SEQ ID NO: 280470 - DNA, 40 bp, Artificial Sequence
  Description of Artificial Sequence: Synthetic oligonucleotide
gttaagatttctggagctgattttaactccaactgtcagg

SEQ ID NO: 280471 - DNA, 41 bp, Artificial Sequence
  Description of Artificial Sequence: Synthetic oligonucleotide
ttaagatttctggagctgattttaactccaactgtcaggac

SEQ ID NO: 280472 - DNA, 40 bp, Artificial Sequence
  Description of Artificial Sequence: Synthetic oligonucleotide
taagatttctggagctgattttaactccaactgtcaggac

SEQ ID NO: 280473 - DNA, 39 bp, Artificial Sequence
  Description of Artificial Sequence: Synthetic oligonucleotide
aagatttctggagctgattttaactccaactgtcaggac

SEQ ID NO: 280474 - DNA, 38 bp, Artificial Sequence
  Description of Artificial Sequence: Synthetic oligonucleotide
agatttctggagctgattttaactccaactgtcaggac

SEQ ID NO: 280475 - DNA, 37 bp, Artificial Sequence
  Description of Artificial Sequence: Synthetic oligonucleotide
gatttctggagctgattttaactccaactgtcaggac

SEQ ID NO: 280476 - DNA, 38 bp, Artificial Sequence
  Description of Artificial Sequence: Synthetic oligonucleotide
atttctggagctgattttaactccaactgtcaggacag

SEQ ID NO: 280477 - DNA, 37 bp, Artificial Sequence
  Description of Artificial Sequence: Synthetic oligonucleotide
tttctggagctgattttaactccaactgtcaggacag

SEQ ID NO: 280478 - DNA, 36 bp, Artificial Sequence
  Description of Artificial Sequence: Synthetic oligonucleotide
ttctggagctgattttaactccaactgtcaggacag

SEQ ID NO: 280479 - DNA, 35 bp, Artificial Sequence
  Description of Artificial Sequence: Synthetic oligonucleotide
tctggagctgattttaactccaactgtcaggacag

SEQ ID NO: 280480 - DNA, 34 bp, Artificial Sequence
  Description of Artificial Sequence: Synthetic oligonucleotide
ctggagctgattttaactccaactgtcaggacag

SEQ ID NO: 280481 - DNA, 35 bp, Artificial Sequence
  Description of Artificial Sequence: Synthetic oligonucleotide
tggagctgattttaactccaactgtcaggacagtg

SEQ ID NO: 280482 - DNA, 34 bp, Artificial Sequence
  Description of Artificial Sequence: Synthetic oligonucleotide
ggagctgattttaactccaactgtcaggacagtg

SEQ ID NO: 280483 - DNA, 34 bp, Artificial Sequence
  Description of Artificial Sequence: Synthetic oligonucleotide
gagctgattttaactccaactgtcaggacagtgg

SEQ ID NO: 280484 - DNA, 37 bp, Artificial Sequence
  Description of Artificial Sequence: Synthetic oligonucleotide
agctgattttaactccaactgtcaggacagtggaatg

SEQ ID NO: 280485 - DNA, 36 bp, Artificial Sequence
  Description of Artificial Sequence: Synthetic oligonucleotide
gctgattttaactccaactgtcaggacagtggaatg

SEQ ID NO: 280486 - DNA, 38 bp, Artificial Sequence
  Description of Artificial Sequence: Synthetic oligonucleotide
ctgattttaactccaactgtcaggacagtggaatgatg

SEQ ID NO: 280487 - DNA, 38 bp, Artificial Sequence
  Description of Artificial Sequence: Synthetic oligonucleotide
tgattttaactccaactgtcaggacagtggaatgatgg

SEQ ID NO: 280488 - DNA, 37 bp, Artificial Sequence
  Description of Artificial Sequence: Synthetic oligonucleotide
gattttaactccaactgtcaggacagtggaatgatgg

SEQ ID NO: 280489 - DNA, 37 bp, Artificial Sequence
  Description of Artificial Sequence: Synthetic oligonucleotide
attttaactccaactgtcaggacagtggaatgatggc

SEQ ID NO: 280490 - DNA, 36 bp, Artificial Sequence
  Description of Artificial Sequence: Synthetic oligonucleotide
ttttaactccaactgtcaggacagtggaatgatggc

SEQ ID NO: 280491 - DNA, 35 bp, Artificial Sequence
  Description of Artificial Sequence: Synthetic oligonucleotide
tttaactccaactgtcaggacagtggaatgatggc

SEQ ID NO: 280492 - DNA, 34 bp, Artificial Sequence
  Description of Artificial Sequence: Synthetic oligonucleotide
ttaactccaactgtcaggacagtggaatgatggc

SEQ ID NO: 280493 - DNA, 33 bp, Artificial Sequence
  Description of Artificial Sequence: Synthetic oligonucleotide
taactccaactgtcaggacagtggaatgatggc

SEQ ID NO: 280494 - DNA, 32 bp, Artificial Sequence
  Description of Artificial Sequence: Synthetic oligonucleotide
aactccaactgtcaggacagtggaatgatggc

SEQ ID NO: 280495 - DNA, 31 bp, Artificial Sequence
  Description of Artificial Sequence: Synthetic oligonucleotide
actccaactgtcaggacagtggaatgatggc

SEQ ID NO: 280496 - DNA, 30 bp, Artificial Sequence
  Description of Artificial Sequence: Synthetic oligonucleotide
ctccaactgtcaggacagtggaatgatggc

SEQ ID NO: 280497 - DNA, 31 bp, Artificial Sequence
  Description of Artificial Sequence: Synthetic oligonucleotide
tccaactgtcaggacagtggaatgatggctg

SEQ ID NO: 280498 - DNA, 30 bp, Artificial Sequence
  Description of Artificial Sequence: Synthetic oligonucleotide
ccaactgtcaggacagtggaatgatggctg

SEQ ID NO: 280499 - DNA, 31 bp, Artificial Sequence
  Description of Artificial Sequence: Synthetic oligonucleotide
caactgtcaggacagtggaatgatggctgtc

SEQ ID NO: 280500 - DNA, 31 bp, Artificial Sequence
  Description of Artificial Sequence: Synthetic oligonucleotide
aactgtcaggacagtggaatgatggctgtcc

SEQ ID NO: 280501 - DNA, 30 bp, Artificial Sequence
  Description of Artificial Sequence: Synthetic oligonucleotide
actgtcaggacagtggaatgatggctgtcc

SEQ ID NO: 280502 - DNA, 29 bp, Artificial Sequence
  Description of Artificial Sequence: Synthetic oligonucleotide
ctgtcaggacagtggaatgatggctgtcc

SEQ ID NO: 280503 - DNA, 29 bp, Artificial Sequence
  Description of Artificial Sequence: Synthetic oligonucleotide
tgtcaggacagtggaatgatggctgtccc

SEQ ID NO: 280504 - DNA, 28 bp, Artificial Sequence
  Description of Artificial Sequence: Synthetic oligonucleotide
gtcaggacagtggaatgatggctgtccc

SEQ ID NO: 280505 - DNA, 29 bp, Artificial Sequence
  Description of Artificial Sequence: Synthetic oligonucleotide
tcaggacagtggaatgatggctgtccctg

SEQ ID NO: 280506 - DNA, 28 bp, Artificial Sequence
  Description of Artificial Sequence: Synthetic oligonucleotide
caggacagtggaatgatggctgtccctg

SEQ ID NO: 280507 - DNA, 32 bp, Artificial Sequence
  Description of Artificial Sequence: Synthetic oligonucleotide
aggacagtggaatgatggctgtccctgaaaac

SEQ ID NO: 280508 - DNA, 31 bp, Artificial Sequence
  Description of Artificial Sequence: Synthetic oligonucleotide
ggacagtggaatgatggctgtccctgaaaac

SEQ ID NO: 280509 - DNA, 31 bp, Artificial Sequence
  Description of Artificial Sequence: Synthetic oligonucleotide
gacagtggaatgatggctgtccctgaaaacc

SEQ ID NO: 280510 - DNA, 31 bp, Artificial Sequence
  Description of Artificial Sequence: Synthetic oligonucleotide
acagtggaatgatggctgtccctgaaaaccg

SEQ ID NO: 280511 - DNA, 30 bp, Artificial Sequence
  Description of Artificial Sequence: Synthetic oligonucleotide
cagtggaatgatggctgtccctgaaaaccg

SEQ ID NO: 280512 - DNA, 30 bp, Artificial Sequence
  Description of Artificial Sequence: Synthetic oligonucleotide
agtggaatgatggctgtccctgaaaaccgg

SEQ ID NO: 280513 - DNA, 29 bp, Artificial Sequence
  Description of Artificial Sequence: Synthetic oligonucleotide
gtggaatgatggctgtccctgaaaaccgg

SEQ ID NO: 280514 - DNA, 31 bp, Artificial Sequence
  Description of Artificial Sequence: Synthetic oligonucleotide
tggaatgatggctgtccctgaaaaccggtac

SEQ ID NO: 280515 - DNA, 30 bp, Artificial Sequence
  Description of Artificial Sequence: Synthetic oligonucleotide
ggaatgatggctgtccctgaaaaccggtac

SEQ ID NO: 280516 - DNA, 33 bp, Artificial Sequence
  Description of Artificial Sequence: Synthetic oligonucleotide
gaatgatggctgtccctgaaaaccggtacattg

SEQ ID NO: 280517 - DNA, 34 bp, Artificial Sequence
  Description of Artificial Sequence: Synthetic oligonucleotide
aatgatggctgtccctgaaaaccggtacattgtc

SEQ ID NO: 280518 - DNA, 33 bp, Artificial Sequence
  Description of Artificial Sequence: Synthetic oligonucleotide
atgatggctgtccctgaaaaccggtacattgtc

SEQ ID NO: 280519 - DNA, 32 bp, Artificial Sequence
  Description of Artificial Sequence: Synthetic oligonucleotide
tgatggctgtccctgaaaaccggtacattgtc

SEQ ID NO: 280520 - DNA, 31 bp, Artificial Sequence
  Description of Artificial Sequence: Synthetic oligonucleotide
gatggctgtccctgaaaaccggtacattgtc

SEQ ID NO: 280521 - DNA, 31 bp, Artificial Sequence
  Description of Artificial Sequence: Synthetic oligonucleotide
atggctgtccctgaaaaccggtacattgtcg

SEQ ID NO: 280522 - DNA, 30 bp, Artificial Sequence
  Description of Artificial Sequence: Synthetic oligonucleotide
tggctgtccctgaaaaccggtacattgtcg

SEQ ID NO: 280523 - DNA, 29 bp, Artificial Sequence
  Description of Artificial Sequence: Synthetic oligonucleotide
ggctgtccctgaaaaccggtacattgtcg

SEQ ID NO: 280524 - DNA, 30 bp, Artificial Sequence
  Description of Artificial Sequence: Synthetic oligonucleotide
gctgtccctgaaaaccggtacattgtcgtg

SEQ ID NO: 280525 - DNA, 30 bp, Artificial Sequence
  Description of Artificial Sequence: Synthetic oligonucleotide
ctgtccctgaaaaccggtacattgtcgtgg

SEQ ID NO: 280526 - DNA, 30 bp, Artificial Sequence
  Description of Artificial Sequence: Synthetic oligonucleotide
tgtccctgaaaaccggtacattgtcgtggc

SEQ ID NO: 280527 - DNA, 29 bp, Artificial Sequence
  Description of Artificial Sequence: Synthetic oligonucleotide
gtccctgaaaaccggtacattgtcgtggc

SEQ ID NO: 280528 - DNA, 29 bp, Artificial Sequence
  Description of Artificial Sequence: Synthetic oligonucleotide
tccctgaaaaccggtacattgtcgtggcc

SEQ ID NO: 280529 - DNA, 28 bp, Artificial Sequence
  Description of Artificial Sequence: Synthetic oligonucleotide
ccctgaaaaccggtacattgtcgtggcc

SEQ ID NO: 280530 - DNA, 30 bp, Artificial Sequence
  Description of Artificial Sequence: Synthetic oligonucleotide
cctgaaaaccggtacattgtcgtggccaag

SEQ ID NO: 280531 - DNA, 30 bp, Artificial Sequence
  Description of Artificial Sequence: Synthetic oligonucleotide
ctgaaaaccggtacattgtcgtggccaagg

SEQ ID NO: 280532 - DNA, 31 bp, Artificial Sequence
  Description of Artificial Sequence: Synthetic oligonucleotide
tgaaaaccggtacattgtcgtggccaaggtc

SEQ ID NO: 280533 - DNA, 30 bp, Artificial Sequence
  Description of Artificial Sequence: Synthetic oligonucleotide
gaaaaccggtacattgtcgtggccaaggtc

SEQ ID NO: 280534 - DNA, 32 bp, Artificial Sequence
  Description of Artificial Sequence: Synthetic oligonucleotide
aaaaccggtacattgtcgtggccaaggtcttc

SEQ ID NO: 280535 - DNA, 31 bp, Artificial Sequence
  Description of Artificial Sequence: Synthetic oligonucleotide
aaaccggtacattgtcgtggccaaggtcttc

SEQ ID NO: 280536 - DNA, 30 bp, Artificial Sequence
  Description of Artificial Sequence: Synthetic oligonucleotide
aaccggtacattgtcgtggccaaggtcttc

SEQ ID NO: 280537 - DNA, 29 bp, Artificial Sequence
  Description of Artificial Sequence: Synthetic oligonucleotide
accggtacattgtcgtggccaaggtcttc

SEQ ID NO: 280538 - DNA, 28 bp, Artificial Sequence
  Description of Artificial Sequence: Synthetic oligonucleotide
ccggtacattgtcgtggccaaggtcttc

SEQ ID NO: 280539 - DNA, 28 bp, Artificial Sequence
  Description of Artificial Sequence: Synthetic oligonucleotide
cggtacattgtcgtggccaaggtcttcg

SEQ ID NO: 280540 - DNA, 29 bp, Artificial Sequence
  Description of Artificial Sequence: Synthetic oligonucleotide
ggtacattgtcgtggccaaggtcttcgag

SEQ ID NO: 280541 - DNA, 32 bp, Artificial Sequence
  Description of Artificial Sequence: Synthetic oligonucleotide
gtacattgtcgtggccaaggtcttcgagaatg

SEQ ID NO: 280542 - DNA, 32 bp, Artificial Sequence
  Description of Artificial Sequence: Synthetic oligonucleotide
tacattgtcgtggccaaggtcttcgagaatgc

SEQ ID NO: 280543 - DNA, 31 bp, Artificial Sequence
  Description of Artificial Sequence: Synthetic oligonucleotide
acattgtcgtggccaaggtcttcgagaatgc

SEQ ID NO: 280544 - DNA, 30 bp, Artificial Sequence
  Description of Artificial Sequence: Synthetic oligonucleotide
cattgtcgtggccaaggtcttcgagaatgc

SEQ ID NO: 280545 - DNA, 33 bp, Artificial Sequence
  Description of Artificial Sequence: Synthetic oligonucleotide
attgtcgtggccaaggtcttcgagaatgcatac

SEQ ID NO: 280546 - DNA, 32 bp, Artificial Sequence
  Description of Artificial Sequence: Synthetic oligonucleotide
ttgtcgtggccaaggtcttcgagaatgcatac

SEQ ID NO: 280547 - DNA, 31 bp, Artificial Sequence
  Description of Artificial Sequence: Synthetic oligonucleotide
tgtcgtggccaaggtcttcgagaatgcatac

SEQ ID NO: 280548 - DNA, 30 bp, Artificial Sequence
  Description of Artificial Sequence: Synthetic oligonucleotide
gtcgtggccaaggtcttcgagaatgcatac

SEQ ID NO: 280549 - DNA, 32 bp, Artificial Sequence
  Description of Artificial Sequence: Synthetic oligonucleotide
tcgtggccaaggtcttcgagaatgcatacaag

SEQ ID NO: 280550 - DNA, 31 bp, Artificial Sequence
  Description of Artificial Sequence: Synthetic oligonucleotide
cgtggccaaggtcttcgagaatgcatacaag

SEQ ID NO: 280551 - DNA, 32 bp, Artificial Sequence
  Description of Artificial Sequence: Synthetic oligonucleotide
gtggccaaggtcttcgagaatgcatacaagtc

SEQ ID NO: 280552 - DNA, 33 bp, Artificial Sequence
  Description of Artificial Sequence: Synthetic oligonucleotide
tggccaaggtcttcgagaatgcatacaagtctg

SEQ ID NO: 280553 - DNA, 32 bp, Artificial Sequence
  Description of Artificial Sequence: Synthetic oligonucleotide
ggccaaggtcttcgagaatgcatacaagtctg

SEQ ID NO: 280554 - DNA, 33 bp, Artificial Sequence
  Description of Artificial Sequence: Synthetic oligonucleotide
gccaaggtcttcgagaatgcatacaagtctgtc

SEQ ID NO: 280555 - DNA, 35 bp, Artificial Sequence
  Description of Artificial Sequence: Synthetic oligonucleotide
ccaaggtcttcgagaatgcatacaagtctgtcatc

SEQ ID NO: 280556 - DNA, 37 bp, Artificial Sequence
  Description of Artificial Sequence: Synthetic oligonucleotide
caaggtcttcgagaatgcatacaagtctgtcatcatg

SEQ ID NO: 280557 - DNA, 39 bp, Artificial Sequence
  Description of Artificial Sequence: Synthetic oligonucleotide
aaggtcttcgagaatgcatacaagtctgtcatcatgaag

SEQ ID NO: 280558 - DNA, 38 bp, Artificial Sequence
  Description of Artificial Sequence: Synthetic oligonucleotide
aggtcttcgagaatgcatacaagtctgtcatcatgaag

SEQ ID NO: 280559 - DNA, 37 bp, Artificial Sequence
  Description of Artificial Sequence: Synthetic oligonucleotide
ggtcttcgagaatgcatacaagtctgtcatcatgaag

SEQ ID NO: 280560 - DNA, 37 bp, Artificial Sequence
  Description of Artificial Sequence: Synthetic oligonucleotide
gtcttcgagaatgcatacaagtctgtcatcatgaagg

SEQ ID NO: 280561 - DNA, 38 bp, Artificial Sequence
  Description of Artificial Sequence: Synthetic oligonucleotide
tcttcgagaatgcatacaagtctgtcatcatgaaggac

SEQ ID NO: 280562 - DNA, 37 bp, Artificial Sequence
  Description of Artificial Sequence: Synthetic oligonucleotide
cttcgagaatgcatacaagtctgtcatcatgaaggac

SEQ ID NO: 280563 - DNA, 37 bp, Artificial Sequence
  Description of Artificial Sequence: Synthetic oligonucleotide
ttcgagaatgcatacaagtctgtcatcatgaaggacg

SEQ ID NO: 280564 - DNA, 36 bp, Artificial Sequence
  Description of Artificial Sequence: Synthetic oligonucleotide
tcgagaatgcatacaagtctgtcatcatgaaggacg

SEQ ID NO: 280565 - DNA, 35 bp, Artificial Sequence
  Description of Artificial Sequence: Synthetic oligonucleotide
cgagaatgcatacaagtctgtcatcatgaaggacg

SEQ ID NO: 280566 - DNA, 36 bp, Artificial Sequence
  Description of Artificial Sequence: Synthetic oligonucleotide
gagaatgcatacaagtctgtcatcatgaaggacgac

SEQ ID NO: 280567 - DNA, 36 bp, Artificial Sequence
  Description of Artificial Sequence: Synthetic oligonucleotide
agaatgcatacaagtctgtcatcatgaaggacgacc

SEQ ID NO: 280568 - DNA, 35 bp, Artificial Sequence
  Description of Artificial Sequence: Synthetic oligonucleotide
gaatgcatacaagtctgtcatcatgaaggacgacc

SEQ ID NO: 280569 - DNA, 36 bp, Artificial Sequence
  Description of Artificial Sequence: Synthetic oligonucleotide
aatgcatacaagtctgtcatcatgaaggacgaccag

SEQ ID NO: 280570 - DNA, 35 bp, Artificial Sequence
  Description of Artificial Sequence: Synthetic oligonucleotide
atgcatacaagtctgtcatcatgaaggacgaccag

SEQ ID NO: 280571 - DNA, 34 bp, Artificial Sequence
  Description of Artificial Sequence: Synthetic oligonucleotide
tgcatacaagtctgtcatcatgaaggacgaccag

SEQ ID NO: 280572 - DNA, 33 bp, Artificial Sequence
  Description of Artificial Sequence: Synthetic oligonucleotide
gcatacaagtctgtcatcatgaaggacgaccag

SEQ ID NO: 280573 - DNA, 33 bp, Artificial Sequence
  Description of Artificial Sequence: Synthetic oligonucleotide
catacaagtctgtcatcatgaaggacgaccagg

SEQ ID NO: 280574 - DNA, 34 bp, Artificial Sequence
  Description of Artificial Sequence: Synthetic oligonucleotide
atacaagtctgtcatcatgaaggacgaccaggag

SEQ ID NO: 280575 - DNA, 33 bp, Artificial Sequence
  Description of Artificial Sequence: Synthetic oligonucleotide
tacaagtctgtcatcatgaaggacgaccaggag

SEQ ID NO: 280576 - DNA, 32 bp, Artificial Sequence
  Description of Artificial Sequence: Synthetic oligonucleotide
acaagtctgtcatcatgaaggacgaccaggag

SEQ ID NO: 280577 - DNA, 31 bp, Artificial Sequence
  Description of Artificial Sequence: Synthetic oligonucleotide
caagtctgtcatcatgaaggacgaccaggag

SEQ ID NO: 280578 - DNA, 31 bp, Artificial Sequence
  Description of Artificial Sequence: Synthetic oligonucleotide
aagtctgtcatcatgaaggacgaccaggagc

SEQ ID NO: 280579 - DNA, 30 bp, Artificial Sequence
  Description of Artificial Sequence: Synthetic oligonucleotide
agtctgtcatcatgaaggacgaccaggagc

SEQ ID NO: 280580 - DNA, 29 bp, Artificial Sequence
  Description of Artificial Sequence: Synthetic oligonucleotide
gtctgtcatcatgaaggacgaccaggagc

SEQ ID NO: 280581 - DNA, 31 bp, Artificial Sequence
  Description of Artificial Sequence: Synthetic oligonucleotide
tctgtcatcatgaaggacgaccaggagcatc

SEQ ID NO: 280582 - DNA, 30 bp, Artificial Sequence
  Description of Artificial Sequence: Synthetic oligonucleotide
ctgtcatcatgaaggacgaccaggagcatc

SEQ ID NO: 280583 - DNA, 31 bp, Artificial Sequence
  Description of Artificial Sequence: Synthetic oligonucleotide
tgtcatcatgaaggacgaccaggagcatcag

SEQ ID NO: 280584 - DNA, 30 bp, Artificial Sequence
  Description of Artificial Sequence: Synthetic oligonucleotide
gtcatcatgaaggacgaccaggagcatcag

SEQ ID NO: 280585 - DNA, 35 bp, Artificial Sequence
  Description of Artificial Sequence: Synthetic oligonucleotide
tcatcatgaaggacgaccaggagcatcagttttac

SEQ ID NO: 280586 - DNA, 34 bp, Artificial Sequence
  Description of Artificial Sequence: Synthetic oligonucleotide
catcatgaaggacgaccaggagcatcagttttac

SEQ ID NO: 280587 - DNA, 36 bp, Artificial Sequence
  Description of Artificial Sequence: Synthetic oligonucleotide
atcatgaaggacgaccaggagcatcagttttacatg

SEQ ID NO: 280588 - DNA, 35 bp, Artificial Sequence
  Description of Artificial Sequence: Synthetic oligonucleotide
tcatgaaggacgaccaggagcatcagttttacatg

SEQ ID NO: 280589 - DNA, 34 bp, Artificial Sequence
  Description of Artificial Sequence: Synthetic oligonucleotide
catgaaggacgaccaggagcatcagttttacatg

SEQ ID NO: 280590 - DNA, 35 bp, Artificial Sequence
  Description of Artificial Sequence: Synthetic oligonucleotide
atgaaggacgaccaggagcatcagttttacatgtg

SEQ ID NO: 280591 - DNA, 34 bp, Artificial Sequence
  Description of Artificial Sequence: Synthetic oligonucleotide
tgaaggacgaccaggagcatcagttttacatgtg

SEQ ID NO: 280592 - DNA, 33 bp, Artificial Sequence
  Description of Artificial Sequence: Synthetic oligonucleotide
gaaggacgaccaggagcatcagttttacatgtg

SEQ ID NO: 280593 - DNA, 27 bp, Artificial Sequence
  Description of Artificial Sequence: Synthetic oligonucleotide
atgatggcgctagacggaccacagcag

SEQ ID NO: 280594 - DNA, 27 bp, Artificial Sequence
  Description of Artificial Sequence: Synthetic oligonucleotide
tgatggcgctagacggaccacagcaga

SEQ ID NO: 280595 - DNA, 27 bp, Artificial Sequence
  Description of Artificial Sequence: Synthetic oligonucleotide
gatggcgctagacggaccacagcagat

SEQ ID NO: 280596 - DNA, 27 bp, Artificial Sequence
  Description of Artificial Sequence: Synthetic oligonucleotide
atggcgctagacggaccacagcagatg

SEQ ID NO: 280597 - DNA, 26 bp, Artificial Sequence
  Description of Artificial Sequence: Synthetic oligonucleotide
tggcgctagacggaccacagcagatg

SEQ ID NO: 280598 - DNA, 25 bp, Artificial Sequence
  Description of Artificial Sequence: Synthetic oligonucleotide
ggcgctagacggaccacagcagatg

SEQ ID NO: 280599 - DNA, 26 bp, Artificial Sequence
  Description of Artificial Sequence: Synthetic oligonucleotide
gcgctagacggaccacagcagatggt

SEQ ID NO: 280600 - DNA, 26 bp, Artificial Sequence
  Description of Artificial Sequence: Synthetic oligonucleotide
cgctagacggaccacagcagatggtg

SEQ ID NO: 280601 - DNA, 27 bp, Artificial Sequence
  Description of Artificial Sequence: Synthetic oligonucleotide
gctagacggaccacagcagatggtgct

SEQ ID NO: 280602 - DNA, 27 bp, Artificial Sequence
  Description of Artificial Sequence: Synthetic oligonucleotide
ctagacggaccacagcagatggtgctg

SEQ ID NO: 280603 - DNA, 27 bp, Artificial Sequence
  Description of Artificial Sequence: Synthetic oligonucleotide
tagacggaccacagcagatggtgctgg

SEQ ID NO: 280604 - DNA, 27 bp, Artificial Sequence
  Description of Artificial Sequence: Synthetic oligonucleotide
agacggaccacagcagatggtgctgga

SEQ ID NO: 280605 - DNA, 26 bp, Artificial Sequence
  Description of Artificial Sequence: Synthetic oligonucleotide
gacggaccacagcagatggtgctgga

SEQ ID NO: 280606 - DNA, 26 bp, Artificial Sequence
  Description of Artificial Sequence: Synthetic oligonucleotide
acggaccacagcagatggtgctggag

SEQ ID NO: 280607 - DNA, 25 bp, Artificial Sequence
  Description of Artificial Sequence: Synthetic oligonucleotide
cggaccacagcagatggtgctggag

SEQ ID NO: 280608 - DNA, 26 bp, Artificial Sequence
  Description of Artificial Sequence: Synthetic oligonucleotide
ggaccacagcagatggtgctggagga

SEQ ID NO: 280609 - DNA, 26 bp, Artificial Sequence
  Description of Artificial Sequence: Synthetic oligonucleotide
gaccacagcagatggtgctggaggac

SEQ ID NO: 280610 - DNA, 26 bp, Artificial Sequence
  Description of Artificial Sequence: Synthetic oligonucleotide
accacagcagatggtgctggaggacg

SEQ ID NO: 280611 - DNA, 25 bp, Artificial Sequence
  Description of Artificial Sequence: Synthetic oligonucleotide
ccacagcagatggtgctggaggacg

SEQ ID NO: 280612 - DNA, 25 bp, Artificial Sequence
  Description of Artificial Sequence: Synthetic oligonucleotide
cacagcagatggtgctggaggacgg

SEQ ID NO: 280613 - DNA, 27 bp, Artificial Sequence
  Description of Artificial Sequence: Synthetic oligonucleotide
acagcagatggtgctggaggacgggaa

SEQ ID NO: 280614 - DNA, 26 bp, Artificial Sequence
  Description of Artificial Sequence: Synthetic oligonucleotide
cagcagatggtgctggaggacgggaa

SEQ ID NO: 280615 - DNA, 26 bp, Artificial Sequence
  Description of Artificial Sequence: Synthetic oligonucleotide
agcagatggtgctggaggacgggaag

SEQ ID NO: 280616 - DNA, 25 bp, Artificial Sequence
  Description of Artificial Sequence: Synthetic oligonucleotide
gcagatggtgctggaggacgggaag

SEQ ID NO: 280617 - DNA, 25 bp, Artificial Sequence
  Description of Artificial Sequence: Synthetic oligonucleotide
cagatggtgctggaggacgggaagg

SEQ ID NO: 280618 - DNA, 26 bp, Artificial Sequence
  Description of Artificial Sequence: Synthetic oligonucleotide
agatggtgctggaggacgggaaggca

SEQ ID NO: 280619 - DNA, 25 bp, Artificial Sequence
  Description of Artificial Sequence: Synthetic oligonucleotide
gatggtgctggaggacgggaaggca

SEQ ID NO: 280620 - DNA, 25 bp, Artificial Sequence
  Description of Artificial Sequence: Synthetic oligonucleotide
atggtgctggaggacgggaaggcac

SEQ ID NO: 280621 - DNA, 24 bp, Artificial Sequence
  Description of Artificial Sequence: Synthetic oligonucleotide
tggtgctggaggacgggaaggcac

SEQ ID NO: 280622 - DNA, 23 bp, Artificial Sequence
  Description of Artificial Sequence: Synthetic oligonucleotide
ggtgctggaggacgggaaggcac

SEQ ID NO: 280623 - DNA, 23 bp, Artificial Sequence
  Description of Artificial Sequence: Synthetic oligonucleotide
gtgctggaggacgggaaggcacg

SEQ ID NO: 280624 - DNA, 24 bp, Artificial Sequence
  Description of Artificial Sequence: Synthetic oligonucleotide
tgctggaggacgggaaggcacgca

SEQ ID NO: 280625 - DNA, 23 bp, Artificial Sequence
  Description of Artificial Sequence: Synthetic oligonucleotide
gctggaggacgggaaggcacgca

SEQ ID NO: 280626 - DNA, 23 bp, Artificial Sequence
  Description of Artificial Sequence: Synthetic oligonucleotide
ctggaggacgggaaggcacgcag

SEQ ID NO: 280627 - DNA, 23 bp, Artificial Sequence
  Description of Artificial Sequence: Synthetic oligonucleotide
tggaggacgggaaggcacgcagc

SEQ ID NO: 280628 - DNA, 22 bp, Artificial Sequence
  Description of Artificial Sequence: Synthetic oligonucleotide
ggaggacgggaaggcacgcagc

SEQ ID NO: 280629 - DNA, 22 bp, Artificial Sequence
  Description of Artificial Sequence: Synthetic oligonucleotide
gaggacgggaaggcacgcagcg

SEQ ID NO: 280630 - DNA, 23 bp, Artificial Sequence
  Description of Artificial Sequence: Synthetic oligonucleotide
aggacgggaaggcacgcagcgga

SEQ ID NO: 280631 - DNA, 22 bp, Artificial Sequence
  Description of Artificial Sequence: Synthetic oligonucleotide
ggacgggaaggcacgcagcgga

SEQ ID NO: 280632 - DNA, 23 bp, Artificial Sequence
  Description of Artificial Sequence: Synthetic oligonucleotide
gacgggaaggcacgcagcggaca

SEQ ID NO: 280633 - DNA, 23 bp, Artificial Sequence
  Description of Artificial Sequence: Synthetic oligonucleotide
acgggaaggcacgcagcggacac

SEQ ID NO: 280634 - DNA, 22 bp, Artificial Sequence
  Description of Artificial Sequence: Synthetic oligonucleotide
cgggaaggcacgcagcggacac

SEQ ID NO: 280635 - DNA, 22 bp, Artificial Sequence
  Description of Artificial Sequence: Synthetic oligonucleotide
gggaaggcacgcagcggacacc

SEQ ID NO: 280636 - DNA, 22 bp, Artificial Sequence
  Description of Artificial Sequence: Synthetic oligonucleotide
ggaaggcacgcagcggacaccg

SEQ ID NO: 280637 - DNA, 22 bp, Artificial Sequence
  Description of Artificial Sequence: Synthetic oligonucleotide
gaaggcacgcagcggacaccgc

SEQ ID NO: 280638 - DNA, 27 bp, Artificial Sequence
  Description of Artificial Sequence: Synthetic oligonucleotide
aaggcacgcagcggacaccgccaataa

SEQ ID NO: 280639 - DNA, 27 bp, Artificial Sequence
  Description of Artificial Sequence: Synthetic oligonucleotide
aggcacgcagcggacaccgccaataat

SEQ ID NO: 280640 - DNA, 27 bp, Artificial Sequence
  Description of Artificial Sequence: Synthetic oligonucleotide
ggcacgcagcggacaccgccaataata

SEQ ID NO: 280641 - DNA, 28 bp, Artificial Sequence
  Description of Artificial Sequence: Synthetic oligonucleotide
gcacgcagcggacaccgccaataatatc

SEQ ID NO: 280642 - DNA, 29 bp, Artificial Sequence
  Description of Artificial Sequence: Synthetic oligonucleotide
cacgcagcggacaccgccaataatatctg

SEQ ID NO: 280643 - DNA, 30 bp, Artificial Sequence
  Description of Artificial Sequence: Synthetic oligonucleotide
acgcagcggacaccgccaataatatctgtc

SEQ ID NO: 280644 - DNA, 29 bp, Artificial Sequence
  Description of Artificial Sequence: Synthetic oligonucleotide
cgcagcggacaccgccaataatatctgtc

SEQ ID NO: 280645 - DNA, 29 bp, Artificial Sequence
  Description of Artificial Sequence: Synthetic oligonucleotide
gcagcggacaccgccaataatatctgtcc

SEQ ID NO: 280646 - DNA, 31 bp, Artificial Sequence
  Description of Artificial Sequence: Synthetic oligonucleotide
cagcggacaccgccaataatatctgtcctag

SEQ ID NO: 280647 - DNA, 34 bp, Artificial Sequence
  Description of Artificial Sequence: Synthetic oligonucleotide
agcggacaccgccaataatatctgtcctagattg

SEQ ID NO: 280648 - DNA, 33 bp, Artificial Sequence
  Description of Artificial Sequence: Synthetic oligonucleotide
gcggacaccgccaataatatctgtcctagattg

SEQ ID NO: 280649 - DNA, 35 bp, Artificial Sequence
  Description of Artificial Sequence: Synthetic oligonucleotide
cggacaccgccaataatatctgtcctagattgaag

SEQ ID NO: 280650 - DNA, 37 bp, Artificial Sequence
  Description of Artificial Sequence: Synthetic oligonucleotide
ggacaccgccaataatatctgtcctagattgaagtac

SEQ ID NO: 280651 - DNA, 38 bp, Artificial Sequence
  Description of Artificial Sequence: Synthetic oligonucleotide
gacaccgccaataatatctgtcctagattgaagtactc

SEQ ID NO: 280652 - DNA, 38 bp, Artificial Sequence
  Description of Artificial Sequence: Synthetic oligonucleotide
acaccgccaataatatctgtcctagattgaagtactcc

SEQ ID NO: 280653 - DNA, 37 bp, Artificial Sequence
  Description of Artificial Sequence: Synthetic oligonucleotide
caccgccaataatatctgtcctagattgaagtactcc

SEQ ID NO: 280654 - DNA, 38 bp, Artificial Sequence
  Description of Artificial Sequence: Synthetic oligonucleotide
accgccaataatatctgtcctagattgaagtactccag

SEQ ID NO: 280655 - DNA, 37 bp, Artificial Sequence
  Description of Artificial Sequence: Synthetic oligonucleotide
ccgccaataatatctgtcctagattgaagtactccag

SEQ ID NO: 280656 - DNA, 37 bp, Artificial Sequence
  Description of Artificial Sequence: Synthetic oligonucleotide
cgccaataatatctgtcctagattgaagtactccagc

SEQ ID NO: 280657 - DNA, 38 bp, Artificial Sequence
  Description of Artificial Sequence: Synthetic oligonucleotide
gccaataatatctgtcctagattgaagtactccagctc

SEQ ID NO: 280658 - DNA, 41 bp, Artificial Sequence
  Description of Artificial Sequence: Synthetic oligonucleotide
ccaataatatctgtcctagattgaagtactccagctcattg

SEQ ID NO: 280659 - DNA, 42 bp, Artificial Sequence
  Description of Artificial Sequence: Synthetic oligonucleotide
caataatatctgtcctagattgaagtactccagctcattgtg

SEQ ID NO: 280660 - DNA, 45 bp, Artificial Sequence
  Description of Artificial Sequence: Synthetic oligonucleotide
aataatatctgtcctagattgaagtactccagctcattgtgaatc

SEQ ID NO: 280661 - DNA, 44 bp, Artificial Sequence
  Description of Artificial Sequence: Synthetic oligonucleotide
ataatatctgtcctagattgaagtactccagctcattgtgaatc

SEQ ID NO: 280662 - DNA, 43 bp, Artificial Sequence
  Description of Artificial Sequence: Synthetic oligonucleotide
taatatctgtcctagattgaagtactccagctcattgtgaatc

SEQ ID NO: 280663 - DNA, 42 bp, Artificial Sequence
  Description of Artificial Sequence: Synthetic oligonucleotide
aatatctgtcctagattgaagtactccagctcattgtgaatc

SEQ ID NO: 280664 - DNA, 41 bp, Artificial Sequence
  Description of Artificial Sequence: Synthetic oligonucleotide
atatctgtcctagattgaagtactccagctcattgtgaatc

SEQ ID NO: 280665 - DNA, 40 bp, Artificial Sequence
  Description of Artificial Sequence: Synthetic oligonucleotide
tatctgtcctagattgaagtactccagctcattgtgaatc

SEQ ID NO: 280666 - DNA, 39 bp, Artificial Sequence
  Description of Artificial Sequence: Synthetic oligonucleotide
atctgtcctagattgaagtactccagctcattgtgaatc

SEQ ID NO: 280667 - DNA, 38 bp, Artificial Sequence
  Description of Artificial Sequence: Synthetic oligonucleotide
tctgtcctagattgaagtactccagctcattgtgaatc

SEQ ID NO: 280668 - DNA, 37 bp, Artificial Sequence
  Description of Artificial Sequence: Synthetic oligonucleotide
ctgtcctagattgaagtactccagctcattgtgaatc

SEQ ID NO: 280669 - DNA, 41 bp, Artificial Sequence
  Description of Artificial Sequence: Synthetic oligonucleotide
tgtcctagattgaagtactccagctcattgtgaatcataag

SEQ ID NO: 280670 - DNA, 40 bp, Artificial Sequence
  Description of Artificial Sequence: Synthetic oligonucleotide
gtcctagattgaagtactccagctcattgtgaatcataag

SEQ ID NO: 280671 - DNA, 41 bp, Artificial Sequence
  Description of Artificial Sequence: Synthetic oligonucleotide
tcctagattgaagtactccagctcattgtgaatcataagag

SEQ ID NO: 280672 - DNA, 40 bp, Artificial Sequence
  Description of Artificial Sequence: Synthetic oligonucleotide
cctagattgaagtactccagctcattgtgaatcataagag

SEQ ID NO: 280673 - DNA, 40 bp, Artificial Sequence
  Description of Artificial Sequence: Synthetic oligonucleotide
ctagattgaagtactccagctcattgtgaatcataagagc

SEQ ID NO: 280674 - DNA, 40 bp, Artificial Sequence
  Description of Artificial Sequence: Synthetic oligonucleotide
tagattgaagtactccagctcattgtgaatcataagagcc

SEQ ID NO: 280675 - DNA, 39 bp, Artificial Sequence
  Description of Artificial Sequence: Synthetic oligonucleotide
agattgaagtactccagctcattgtgaatcataagagcc

SEQ ID NO: 280676 - DNA, 38 bp, Artificial Sequence
  Description of Artificial Sequence: Synthetic oligonucleotide
gattgaagtactccagctcattgtgaatcataagagcc

SEQ ID NO: 280677 - DNA, 42 bp, Artificial Sequence
  Description of Artificial Sequence: Synthetic oligonucleotide
attgaagtactccagctcattgtgaatcataagagcctaaac

SEQ ID NO: 280678 - DNA, 41 bp, Artificial Sequence
  Description of Artificial Sequence: Synthetic oligonucleotide
ttgaagtactccagctcattgtgaatcataagagcctaaac

SEQ ID NO: 280679 - DNA, 40 bp, Artificial Sequence
  Description of Artificial Sequence: Synthetic oligonucleotide
tgaagtactccagctcattgtgaatcataagagcctaaac

SEQ ID NO: 280680 - DNA, 39 bp, Artificial Sequence
  Description of Artificial Sequence: Synthetic oligonucleotide
gaagtactccagctcattgtgaatcataagagcctaaac

SEQ ID NO: 280681 - DNA, 39 bp, Artificial Sequence
  Description of Artificial Sequence: Synthetic oligonucleotide
aagtactccagctcattgtgaatcataagagcctaaacc

SEQ ID NO: 280682 - DNA, 38 bp, Artificial Sequence
  Description of Artificial Sequence: Synthetic oligonucleotide
agtactccagctcattgtgaatcataagagcctaaacc

SEQ ID NO: 280683 - DNA, 37 bp, Artificial Sequence
  Description of Artificial Sequence: Synthetic oligonucleotide
gtactccagctcattgtgaatcataagagcctaaacc

SEQ ID NO: 280684 - DNA, 38 bp, Artificial Sequence
  Description of Artificial Sequence: Synthetic oligonucleotide
tactccagctcattgtgaatcataagagcctaaacctc

SEQ ID NO: 280685 - DNA, 37 bp, Artificial Sequence
  Description of Artificial Sequence: Synthetic oligonucleotide
actccagctcattgtgaatcataagagcctaaacctc

SEQ ID NO: 280686 - DNA, 36 bp, Artificial Sequence
  Description of Artificial Sequence: Synthetic oligonucleotide
ctccagctcattgtgaatcataagagcctaaacctc

SEQ ID NO: 280687 - DNA, 36 bp, Artificial Sequence
  Description of Artificial Sequence: Synthetic oligonucleotide
tccagctcattgtgaatcataagagcctaaacctcc

SEQ ID NO: 280688 - DNA, 35 bp, Artificial Sequence
  Description of Artificial Sequence: Synthetic oligonucleotide
ccagctcattgtgaatcataagagcctaaacctcc

SEQ ID NO: 280689 - DNA, 35 bp, Artificial Sequence
  Description of Artificial Sequence: Synthetic oligonucleotide
cagctcattgtgaatcataagagcctaaacctccg

SEQ ID NO: 280690 - DNA, 35 bp, Artificial Sequence
  Description of Artificial Sequence: Synthetic oligonucleotide
agctcattgtgaatcataagagcctaaacctccgc

SEQ ID NO: 280691 - DNA, 34 bp, Artificial Sequence
  Description of Artificial Sequence: Synthetic oligonucleotide
gctcattgtgaatcataagagcctaaacctccgc

SEQ ID NO: 280692 - DNA, 35 bp, Artificial Sequence
  Description of Artificial Sequence: Synthetic oligonucleotide
ctcattgtgaatcataagagcctaaacctccgcag

SEQ ID NO: 280693 - DNA, 35 bp, Artificial Sequence
  Description of Artificial Sequence: Synthetic oligonucleotide
tcattgtgaatcataagagcctaaacctccgcagg

SEQ ID NO: 280694 - DNA, 34 bp, Artificial Sequence
  Description of Artificial Sequence: Synthetic oligonucleotide
cattgtgaatcataagagcctaaacctccgcagg

SEQ ID NO: 280695 - DNA, 34 bp, Artificial Sequence
  Description of Artificial Sequence: Synthetic oligonucleotide
attgtgaatcataagagcctaaacctccgcaggc

SEQ ID NO: 280696 - DNA, 33 bp, Artificial Sequence
  Description of Artificial Sequence: Synthetic oligonucleotide
ttgtgaatcataagagcctaaacctccgcaggc

SEQ ID NO: 280697 - DNA, 32 bp, Artificial Sequence
  Description of Artificial Sequence: Synthetic oligonucleotide
tgtgaatcataagagcctaaacctccgcaggc

SEQ ID NO: 280698 - DNA, 31 bp, Artificial Sequence
  Description of Artificial Sequence: Synthetic oligonucleotide
gtgaatcataagagcctaaacctccgcaggc

SEQ ID NO: 280699 - DNA, 32 bp, Artificial Sequence
  Description of Artificial Sequence: Synthetic oligonucleotide
tgaatcataagagcctaaacctccgcaggctg

SEQ ID NO: 280700 - DNA, 31 bp, Artificial Sequence
  Description of Artificial Sequence: Synthetic oligonucleotide
gaatcataagagcctaaacctccgcaggctg

SEQ ID NO: 280701 - DNA, 31 bp, Artificial Sequence
  Description of Artificial Sequence: Synthetic oligonucleotide
aatcataagagcctaaacctccgcaggctgc

SEQ ID NO: 280702 - DNA, 30 bp, Artificial Sequence
  Description of Artificial Sequence: Synthetic oligonucleotide
atcataagagcctaaacctccgcaggctgc

SEQ ID NO: 280703 - DNA, 29 bp, Artificial Sequence
  Description of Artificial Sequence: Synthetic oligonucleotide
tcataagagcctaaacctccgcaggctgc

SEQ ID NO: 280704 - DNA, 28 bp, Artificial Sequence
  Description of Artificial Sequence: Synthetic oligonucleotide
cataagagcctaaacctccgcaggctgc

SEQ ID NO: 280705 - DNA, 29 bp, Artificial Sequence
  Description of Artificial Sequence: Synthetic oligonucleotide
ataagagcctaaacctccgcaggctgcag

SEQ ID NO: 280706 - DNA, 28 bp, Artificial Sequence
  Description of Artificial Sequence: Synthetic oligonucleotide
taagagcctaaacctccgcaggctgcag

SEQ ID NO: 280707 - DNA, 27 bp, Artificial Sequence
  Description of Artificial Sequence: Synthetic oligonucleotide
aagagcctaaacctccgcaggctgcag

SEQ ID NO: 280708 - DNA, 26 bp, Artificial Sequence
  Description of Artificial Sequence: Synthetic oligonucleotide
agagcctaaacctccgcaggctgcag

SEQ ID NO: 280709 - DNA, 25 bp, Artificial Sequence
  Description of Artificial Sequence: Synthetic oligonucleotide
gagcctaaacctccgcaggctgcag

SEQ ID NO: 280710 - DNA, 25 bp, Artificial Sequence
  Description of Artificial Sequence: Synthetic oligonucleotide
agcctaaacctccgcaggctgcagc

SEQ ID NO: 280711 - DNA, 24 bp, Artificial Sequence
  Description of Artificial Sequence: Synthetic oligonucleotide
gcctaaacctccgcaggctgcagc

SEQ ID NO: 280712 - DNA, 25 bp, Artificial Sequence
  Description of Artificial Sequence: Synthetic oligonucleotide
cctaaacctccgcaggctgcagcca

SEQ ID NO: 280713 - DNA, 26 bp, Artificial Sequence
  Description of Artificial Sequence: Synthetic oligonucleotide
ctaaacctccgcaggctgcagccaca

SEQ ID NO: 280714 - DNA, 27 bp, Artificial Sequence
  Description of Artificial Sequence: Synthetic oligonucleotide
taaacctccgcaggctgcagccacaga

SEQ ID NO: 280715 - DNA, 26 bp, Artificial Sequence
  Description of Artificial Sequence: Synthetic oligonucleotide
aaacctccgcaggctgcagccacaga

SEQ ID NO: 280716 - DNA, 25 bp, Artificial Sequence
  Description of Artificial Sequence: Synthetic oligonucleotide
aacctccgcaggctgcagccacaga

SEQ ID NO: 280717 - DNA, 24 bp, Artificial Sequence
  Description of Artificial Sequence: Synthetic oligonucleotide
acctccgcaggctgcagccacaga

SEQ ID NO: 280718 - DNA, 23 bp, Artificial Sequence
  Description of Artificial Sequence: Synthetic oligonucleotide
cctccgcaggctgcagccacaga

SEQ ID NO: 280719 - DNA, 23 bp, Artificial Sequence
  Description of Artificial Sequence: Synthetic oligonucleotide
ctccgcaggctgcagccacagag

SEQ ID NO: 280720 - DNA, 25 bp, Artificial Sequence
  Description of Artificial Sequence: Synthetic oligonucleotide
tccgcaggctgcagccacagaggat

SEQ ID NO: 280721 - DNA, 24 bp, Artificial Sequence
  Description of Artificial Sequence: Synthetic oligonucleotide
ccgcaggctgcagccacagaggat

SEQ ID NO: 280722 - DNA, 24 bp, Artificial Sequence
  Description of Artificial Sequence: Synthetic oligonucleotide
cgcaggctgcagccacagaggatc

SEQ ID NO: 280723 - DNA, 26 bp, Artificial Sequence
  Description of Artificial Sequence: Synthetic oligonucleotide
gcaggctgcagccacagaggatcgaa

SEQ ID NO: 280724 - DNA, 27 bp, Artificial Sequence
  Description of Artificial Sequence: Synthetic oligonucleotide
caggctgcagccacagaggatcgaact

SEQ ID NO: 280725 - DNA, 31 bp, Artificial Sequence
  Description of Artificial Sequence: Synthetic oligonucleotide
aggctgcagccacagaggatcgaactaaaag

SEQ ID NO: 280726 - DNA, 30 bp, Artificial Sequence
  Description of Artificial Sequence: Synthetic oligonucleotide
ggctgcagccacagaggatcgaactaaaag

SEQ ID NO: 280727 - DNA, 30 bp, Artificial Sequence
  Description of Artificial Sequence: Synthetic oligonucleotide
gctgcagccacagaggatcgaactaaaagc

SEQ ID NO: 280728 - DNA, 34 bp, Artificial Sequence
  Description of Artificial Sequence: Synthetic oligonucleotide
ctgcagccacagaggatcgaactaaaagctaaag

SEQ ID NO: 280729 - DNA, 36 bp, Artificial Sequence
  Description of Artificial Sequence: Synthetic oligonucleotide
tgcagccacagaggatcgaactaaaagctaaagttg

SEQ ID NO: 280730 - DNA, 35 bp, Artificial Sequence
  Description of Artificial Sequence: Synthetic oligonucleotide
gcagccacagaggatcgaactaaaagctaaagttg

SEQ ID NO: 280731 - DNA, 35 bp, Artificial Sequence
  Description of Artificial Sequence: Synthetic oligonucleotide
cagccacagaggatcgaactaaaagctaaagttgg

SEQ ID NO: 280732 - DNA, 35 bp, Artificial Sequence
  Description of Artificial Sequence: Synthetic oligonucleotide
agccacagaggatcgaactaaaagctaaagttggc

SEQ ID NO: 280733 - DNA, 34 bp, Artificial Sequence
  Description of Artificial Sequence: Synthetic oligonucleotide
gccacagaggatcgaactaaaagctaaagttggc

SEQ ID NO: 280734 - DNA, 34 bp, Artificial Sequence
  Description of Artificial Sequence: Synthetic oligonucleotide
ccacagaggatcgaactaaaagctaaagttggcc

SEQ ID NO: 280735 - DNA, 38 bp, Artificial Sequence
  Description of Artificial Sequence: Synthetic oligonucleotide
cacagaggatcgaactaaaagctaaagttggcctattg

SEQ ID NO: 280736 - DNA, 38 bp, Artificial Sequence
  Description of Artificial Sequence: Synthetic oligonucleotide
acagaggatcgaactaaaagctaaagttggcctattgc

SEQ ID NO: 280737 - DNA, 37 bp, Artificial Sequence
  Description of Artificial Sequence: Synthetic oligonucleotide
cagaggatcgaactaaaagctaaagttggcctattgc

SEQ ID NO: 280738 - DNA, 37 bp, Artificial Sequence
  Description of Artificial Sequence: Synthetic oligonucleotide
agaggatcgaactaaaagctaaagttggcctattgcc

SEQ ID NO: 280739 - DNA, 36 bp, Artificial Sequence
  Description of Artificial Sequence: Synthetic oligonucleotide
gaggatcgaactaaaagctaaagttggcctattgcc

SEQ ID NO: 280740 - DNA, 36 bp, Artificial Sequence
  Description of Artificial Sequence: Synthetic oligonucleotide
aggatcgaactaaaagctaaagttggcctattgccg

SEQ ID NO: 280741 - DNA, 35 bp, Artificial Sequence
  Description of Artificial Sequence: Synthetic oligonucleotide
ggatcgaactaaaagctaaagttggcctattgccg

SEQ ID NO: 280742 - DNA, 35 bp, Artificial Sequence
  Description of Artificial Sequence: Synthetic oligonucleotide
gatcgaactaaaagctaaagttggcctattgccgg

SEQ ID NO: 280743 - DNA, 36 bp, Artificial Sequence
  Description of Artificial Sequence: Synthetic oligonucleotide
atcgaactaaaagctaaagttggcctattgccggag

SEQ ID NO: 280744 - DNA, 35 bp, Artificial Sequence
  Description of Artificial Sequence: Synthetic oligonucleotide
tcgaactaaaagctaaagttggcctattgccggag

SEQ ID NO: 280745 - DNA, 34 bp, Artificial Sequence
  Description of Artificial Sequence: Synthetic oligonucleotide
cgaactaaaagctaaagttggcctattgccggag

SEQ ID NO: 280746 - DNA, 34 bp, Artificial Sequence
  Description of Artificial Sequence: Synthetic oligonucleotide
gaactaaaagctaaagttggcctattgccggagg

SEQ ID NO: 280747 - DNA, 35 bp, Artificial Sequence
  Description of Artificial Sequence: Synthetic oligonucleotide
aactaaaagctaaagttggcctattgccggaggag

SEQ ID NO: 280748 - DNA, 34 bp, Artificial Sequence
  Description of Artificial Sequence: Synthetic oligonucleotide
actaaaagctaaagttggcctattgccggaggag

SEQ ID NO: 280749 - DNA, 33 bp, Artificial Sequence
  Description of Artificial Sequence: Synthetic oligonucleotide
ctaaaagctaaagttggcctattgccggaggag

SEQ ID NO: 280750 - DNA, 33 bp, Artificial Sequence
  Description of Artificial Sequence: Synthetic oligonucleotide
taaaagctaaagttggcctattgccggaggagc

SEQ ID NO: 280751 - DNA, 32 bp, Artificial Sequence
  Description of Artificial Sequence: Synthetic oligonucleotide
aaaagctaaagttggcctattgccggaggagc

SEQ ID NO: 280752 - DNA, 31 bp, Artificial Sequence
  Description of Artificial Sequence: Synthetic oligonucleotide
aaagctaaagttggcctattgccggaggagc

SEQ ID NO: 280753 - DNA, 30 bp, Artificial Sequence
  Description of Artificial Sequence: Synthetic oligonucleotide
aagctaaagttggcctattgccggaggagc

SEQ ID NO: 280754 - DNA, 29 bp, Artificial Sequence
  Description of Artificial Sequence: Synthetic oligonucleotide
agctaaagttggcctattgccggaggagc

SEQ ID NO: 280755 - DNA, 28 bp, Artificial Sequence
  Description of Artificial Sequence: Synthetic oligonucleotide
gctaaagttggcctattgccggaggagc

SEQ ID NO: 280756 - DNA, 30 bp, Artificial Sequence
  Description of Artificial Sequence: Synthetic oligonucleotide
ctaaagttggcctattgccggaggagcttc

SEQ ID NO: 280757 - DNA, 31 bp, Artificial Sequence
  Description of Artificial Sequence: Synthetic oligonucleotide
taaagttggcctattgccggaggagcttcag

SEQ ID NO: 280758 - DNA, 30 bp, Artificial Sequence
  Description of Artificial Sequence: Synthetic oligonucleotide
aaagttggcctattgccggaggagcttcag

SEQ ID NO: 280759 - DNA, 29 bp, Artificial Sequence
  Description of Artificial Sequence: Synthetic oligonucleotide
aagttggcctattgccggaggagcttcag

SEQ ID NO: 280760 - DNA, 28 bp, Artificial Sequence
  Description of Artificial Sequence: Synthetic oligonucleotide
agttggcctattgccggaggagcttcag

SEQ ID NO: 280761 - DNA, 27 bp, Artificial Sequence
  Description of Artificial Sequence: Synthetic oligonucleotide
gttggcctattgccggaggagcttcag

SEQ ID NO: 280762 - DNA, 27 bp, Artificial Sequence
  Description of Artificial Sequence: Synthetic oligonucleotide
ttggcctattgccggaggagcttcagc

SEQ ID NO: 280763 - DNA, 27 bp, Artificial Sequence
  Description of Artificial Sequence: Synthetic oligonucleotide
tggcctattgccggaggagcttcagct

SEQ ID NO: 280764 - DNA, 26 bp, Artificial Sequence
  Description of Artificial Sequence: Synthetic oligonucleotide
ggcctattgccggaggagcttcagct

SEQ ID NO: 280765 - DNA, 26 bp, Artificial Sequence
  Description of Artificial Sequence: Synthetic oligonucleotide
gcctattgccggaggagcttcagctg

SEQ ID NO: 280766 - DNA, 27 bp, Artificial Sequence
  Description of Artificial Sequence: Synthetic oligonucleotide
cctattgccggaggagcttcagctgct

SEQ ID NO: 280767 - DNA, 27 bp, Artificial Sequence
  Description of Artificial Sequence: Synthetic oligonucleotide
ctattgccggaggagcttcagctgctg

SEQ ID NO: 280768 - DNA, 27 bp, Artificial Sequence
  Description of Artificial Sequence: Synthetic oligonucleotide
tattgccggaggagcttcagctgctgg

SEQ ID NO: 280769 - DNA, 27 bp, Artificial Sequence
  Description of Artificial Sequence: Synthetic oligonucleotide
attgccggaggagcttcagctgctgga

SEQ ID NO: 280770 - DNA, 26 bp, Artificial Sequence
  Description of Artificial Sequence: Synthetic oligonucleotide
ttgccggaggagcttcagctgctgga

SEQ ID NO: 280771 - DNA, 25 bp, Artificial Sequence
  Description of Artificial Sequence: Synthetic oligonucleotide
tgccggaggagcttcagctgctgga

SEQ ID NO: 280772 - DNA, 24 bp, Artificial Sequence
  Description of Artificial Sequence: Synthetic oligonucleotide
gccggaggagcttcagctgctgga

SEQ ID NO: 280773 - DNA, 24 bp, Artificial Sequence
  Description of Artificial Sequence: Synthetic oligonucleotide
ccggaggagcttcagctgctggag

SEQ ID NO: 280774 - DNA, 25 bp, Artificial Sequence
  Description of Artificial Sequence: Synthetic oligonucleotide
cggaggagcttcagctgctggagga

SEQ ID NO: 280775 - DNA, 25 bp, Artificial Sequence
  Description of Artificial Sequence: Synthetic oligonucleotide
ggaggagcttcagctgctggaggag

SEQ ID NO: 280776 - DNA, 26 bp, Artificial Sequence
  Description of Artificial Sequence: Synthetic oligonucleotide
gaggagcttcagctgctggaggagca

SEQ ID NO: 280777 - DNA, 26 bp, Artificial Sequence
  Description of Artificial Sequence: Synthetic oligonucleotide
aggagcttcagctgctggaggagcag

SEQ ID NO: 280778 - DNA, 25 bp, Artificial Sequence
  Description of Artificial Sequence: Synthetic oligonucleotide
ggagcttcagctgctggaggagcag

SEQ ID NO: 280779 - DNA, 25 bp, Artificial Sequence
  Description of Artificial Sequence: Synthetic oligonucleotide
gagcttcagctgctggaggagcagg

SEQ ID NO: 280780 - DNA, 25 bp, Artificial Sequence
  Description of Artificial Sequence: Synthetic oligonucleotide
agcttcagctgctggaggagcaggc

SEQ ID NO: 280781 - DNA, 24 bp, Artificial Sequence
  Description of Artificial Sequence: Synthetic oligonucleotide
gcttcagctgctggaggagcaggc

SEQ ID NO: 280782 - DNA, 25 bp, Artificial Sequence
  Description of Artificial Sequence: Synthetic oligonucleotide
cttcagctgctggaggagcaggcct

SEQ ID NO: 280783 - DNA, 25 bp, Artificial Sequence
  Description of Artificial Sequence: Synthetic oligonucleotide
ttcagctgctggaggagcaggcctc

SEQ ID NO: 280784 - DNA, 24 bp, Artificial Sequence
  Description of Artificial Sequence: Synthetic oligonucleotide
tcagctgctggaggagcaggcctc

SEQ ID NO: 280785 - DNA, 23 bp, Artificial Sequence
  Description of Artificial Sequence: Synthetic oligonucleotide
cagctgctggaggagcaggcctc

SEQ ID NO: 280786 - DNA, 26 bp, Artificial Sequence
  Description of Artificial Sequence: Synthetic oligonucleotide
agctgctggaggagcaggcctcctat

SEQ ID NO: 280787 - DNA, 25 bp, Artificial Sequence
  Description of Artificial Sequence: Synthetic oligonucleotide
gctgctggaggagcaggcctcctat

SEQ ID NO: 280788 - DNA, 26 bp, Artificial Sequence
  Description of Artificial Sequence: Synthetic oligonucleotide
ctgctggaggagcaggcctcctatgt

SEQ ID NO: 280789 - DNA, 26 bp, Artificial Sequence
  Description of Artificial Sequence: Synthetic oligonucleotide
tgctggaggagcaggcctcctatgtc

SEQ ID NO: 280790 - DNA, 25 bp, Artificial Sequence
  Description of Artificial Sequence: Synthetic oligonucleotide
gctggaggagcaggcctcctatgtc

SEQ ID NO: 280791 - DNA, 25 bp, Artificial Sequence
  Description of Artificial Sequence: Synthetic oligonucleotide
ctggaggagcaggcctcctatgtcg

SEQ ID NO: 280792 - DNA, 25 bp, Artificial Sequence
  Description of Artificial Sequence: Synthetic oligonucleotide
tggaggagcaggcctcctatgtcgg

SEQ ID NO: 280793 - DNA, 24 bp, Artificial Sequence
  Description of Artificial Sequence: Synthetic oligonucleotide
ggaggagcaggcctcctatgtcgg

SEQ ID NO: 280794 - DNA, 24 bp, Artificial Sequence
  Description of Artificial Sequence: Synthetic oligonucleotide
gaggagcaggcctcctatgtcggg

SEQ ID NO: 280795 - DNA, 26 bp, Artificial Sequence
  Description of Artificial Sequence: Synthetic oligonucleotide
aggagcaggcctcctatgtcggggaa

SEQ ID NO: 280796 - DNA, 25 bp, Artificial Sequence
  Description of Artificial Sequence: Synthetic oligonucleotide
ggagcaggcctcctatgtcggggaa

SEQ ID NO: 280797 - DNA, 27 bp, Artificial Sequence
  Description of Artificial Sequence: Synthetic oligonucleotide
gagcaggcctcctatgtcggggaagta

SEQ ID NO: 280798 - DNA, 27 bp, Artificial Sequence
  Description of Artificial Sequence: Synthetic oligonucleotide
agcaggcctcctatgtcggggaagtac

SEQ ID NO: 280799 - DNA, 27 bp, Artificial Sequence
  Description of Artificial Sequence: Synthetic oligonucleotide
gcaggcctcctatgtcggggaagtact

SEQ ID NO: 280800 - DNA, 27 bp, Artificial Sequence
  Description of Artificial Sequence: Synthetic oligonucleotide
caggcctcctatgtcggggaagtactc

SEQ ID NO: 280801 - DNA, 27 bp, Artificial Sequence
  Description of Artificial Sequence: Synthetic oligonucleotide
aggcctcctatgtcggggaagtactcc

SEQ ID NO: 280802 - DNA, 26 bp, Artificial Sequence
  Description of Artificial Sequence: Synthetic oligonucleotide
ggcctcctatgtcggggaagtactcc

SEQ ID NO: 280803 - DNA, 26 bp, Artificial Sequence
  Description of Artificial Sequence: Synthetic oligonucleotide
gcctcctatgtcggggaagtactccg

SEQ ID NO: 280804 - DNA, 26 bp, Artificial Sequence
  Description of Artificial Sequence: Synthetic oligonucleotide
cctcctatgtcggggaagtactccgg

SEQ ID NO: 280805 - DNA, 26 bp, Artificial Sequence
  Description of Artificial Sequence: Synthetic oligonucleotide
ctcctatgtcggggaagtactccggg

SEQ ID NO: 280806 - DNA, 26 bp, Artificial Sequence
  Description of Artificial Sequence: Synthetic oligonucleotide
tcctatgtcggggaagtactccgggc

SEQ ID NO: 280807 - DNA, 25 bp, Artificial Sequence
  Description of Artificial Sequence: Synthetic oligonucleotide
cctatgtcggggaagtactccgggc

SEQ ID NO: 280808 - DNA, 27 bp, Artificial Sequence
  Description of Artificial Sequence: Synthetic oligonucleotide
ctatgtcggggaagtactccgggccaa

SEQ ID NO: 280809 - DNA, 27 bp, Artificial Sequence
  Description of Artificial Sequence: Synthetic oligonucleotide
tatgtcggggaagtactccgggccaag

SEQ ID NO: 280810 - DNA, 26 bp, Artificial Sequence
  Description of Artificial Sequence: Synthetic oligonucleotide
atgtcggggaagtactccgggccaag

SEQ ID NO: 280811 - DNA, 25 bp, Artificial Sequence
  Description of Artificial Sequence: Synthetic oligonucleotide
tgtcggggaagtactccgggccaag

SEQ ID NO: 280812 - DNA, 24 bp, Artificial Sequence
  Description of Artificial Sequence: Synthetic oligonucleotide
gtcggggaagtactccgggccaag

SEQ ID NO: 280813 - DNA, 27 bp, Artificial Sequence
  Description of Artificial Sequence: Synthetic oligonucleotide
tcggggaagtactccgggccaaggata

SEQ ID NO: 280814 - DNA, 27 bp, Artificial Sequence
  Description of Artificial Sequence: Synthetic oligonucleotide
cggggaagtactccgggccaaggataa

SEQ ID NO: 280815 - DNA, 27 bp, Artificial Sequence
  Description of Artificial Sequence: Synthetic oligonucleotide
ggggaagtactccgggccaaggataag

SEQ ID NO: 280816 - DNA, 29 bp, Artificial Sequence
  Description of Artificial Sequence: Synthetic oligonucleotide
gggaagtactccgggccaaggataagaac

SEQ ID NO: 280817 - DNA, 32 bp, Artificial Sequence
  Description of Artificial Sequence: Synthetic oligonucleotide
ggaagtactccgggccaaggataagaacaaag

SEQ ID NO: 280818 - DNA, 33 bp, Artificial Sequence
  Description of Artificial Sequence: Synthetic oligonucleotide
gaagtactccgggccaaggataagaacaaagtg

SEQ ID NO: 280819 - DNA, 35 bp, Artificial Sequence
  Description of Artificial Sequence: Synthetic oligonucleotide
aagtactccgggccaaggataagaacaaagtgttg

SEQ ID NO: 280820 - DNA, 34 bp, Artificial Sequence
  Description of Artificial Sequence: Synthetic oligonucleotide
agtactccgggccaaggataagaacaaagtgttg

SEQ ID NO: 280821 - DNA, 33 bp, Artificial Sequence
  Description of Artificial Sequence: Synthetic oligonucleotide
gtactccgggccaaggataagaacaaagtgttg

SEQ ID NO: 280822 - DNA, 33 bp, Artificial Sequence
  Description of Artificial Sequence: Synthetic oligonucleotide
tactccgggccaaggataagaacaaagtgttgc

SEQ ID NO: 280823 - DNA, 32 bp, Artificial Sequence
  Description of Artificial Sequence: Synthetic oligonucleotide
actccgggccaaggataagaacaaagtgttgc

SEQ ID NO: 280824 - DNA, 31 bp, Artificial Sequence
  Description of Artificial Sequence: Synthetic oligonucleotide
ctccgggccaaggataagaacaaagtgttgc

SEQ ID NO: 280825 - DNA, 32 bp, Artificial Sequence
  Description of Artificial Sequence: Synthetic oligonucleotide
tccgggccaaggataagaacaaagtgttgctc

SEQ ID NO: 280826 - DNA, 31 bp, Artificial Sequence
  Description of Artificial Sequence: Synthetic oligonucleotide
ccgggccaaggataagaacaaagtgttgctc

SEQ ID NO: 280827 - DNA, 33 bp, Artificial Sequence
  Description of Artificial Sequence: Synthetic oligonucleotide
cgggccaaggataagaacaaagtgttgctcaag

SEQ ID NO: 280828 - DNA, 33 bp, Artificial Sequence
  Description of Artificial Sequence: Synthetic oligonucleotide
gggccaaggataagaacaaagtgttgctcaagg

SEQ ID NO: 280829 - DNA, 35 bp, Artificial Sequence
  Description of Artificial Sequence: Synthetic oligonucleotide
ggccaaggataagaacaaagtgttgctcaaggtac

SEQ ID NO: 280830 - DNA, 37 bp, Artificial Sequence
  Description of Artificial Sequence: Synthetic oligonucleotide
gccaaggataagaacaaagtgttgctcaaggtacttc

SEQ ID NO: 280831 - DNA, 37 bp, Artificial Sequence
  Description of Artificial Sequence: Synthetic oligonucleotide
ccaaggataagaacaaagtgttgctcaaggtacttcc

SEQ ID NO: 280832 - DNA, 38 bp, Artificial Sequence
  Description of Artificial Sequence: Synthetic oligonucleotide
caaggataagaacaaagtgttgctcaaggtacttcctg

SEQ ID NO: 280833 - DNA, 40 bp, Artificial Sequence
  Description of Artificial Sequence: Synthetic oligonucleotide
aaggataagaacaaagtgttgctcaaggtacttcctgaag

SEQ ID NO: 280834 - DNA, 39 bp, Artificial Sequence
  Description of Artificial Sequence: Synthetic oligonucleotide
aggataagaacaaagtgttgctcaaggtacttcctgaag

SEQ ID NO: 280835 - DNA, 38 bp, Artificial Sequence
  Description of Artificial Sequence: Synthetic oligonucleotide
ggataagaacaaagtgttgctcaaggtacttcctgaag

SEQ ID NO: 280836 - DNA, 38 bp, Artificial Sequence
  Description of Artificial Sequence: Synthetic oligonucleotide
gataagaacaaagtgttgctcaaggtacttcctgaagg

SEQ ID NO: 280837 - DNA, 45 bp, Artificial Sequence
  Description of Artificial Sequence: Synthetic oligonucleotide
ataagaacaaagtgttgctcaaggtacttcctgaaggaaaatttg

SEQ ID NO: 280838 - DNA, 44 bp, Artificial Sequence
  Description of Artificial Sequence: Synthetic oligonucleotide
taagaacaaagtgttgctcaaggtacttcctgaaggaaaatttg

SEQ ID NO: 280839 - DNA, 43 bp, Artificial Sequence
  Description of Artificial Sequence: Synthetic oligonucleotide
aagaacaaagtgttgctcaaggtacttcctgaaggaaaatttg

SEQ ID NO: 280840 - DNA, 42 bp, Artificial Sequence
  Description of Artificial Sequence: Synthetic oligonucleotide
agaacaaagtgttgctcaaggtacttcctgaaggaaaatttg

SEQ ID NO: 280841 - DNA, 41 bp, Artificial Sequence
  Description of Artificial Sequence: Synthetic oligonucleotide
gaacaaagtgttgctcaaggtacttcctgaaggaaaatttg

SEQ ID NO: 280842 - DNA, 43 bp, Artificial Sequence
  Description of Artificial Sequence: Synthetic oligonucleotide
aacaaagtgttgctcaaggtacttcctgaaggaaaatttgttc

SEQ ID NO: 280843 - DNA, 42 bp, Artificial Sequence
  Description of Artificial Sequence: Synthetic oligonucleotide
acaaagtgttgctcaaggtacttcctgaaggaaaatttgttc

SEQ ID NO: 280844 - DNA, 41 bp, Artificial Sequence
  Description of Artificial Sequence: Synthetic oligonucleotide
caaagtgttgctcaaggtacttcctgaaggaaaatttgttc

SEQ ID NO: 280845 - DNA, 43 bp, Artificial Sequence
  Description of Artificial Sequence: Synthetic oligonucleotide
aaagtgttgctcaaggtacttcctgaaggaaaatttgttctag

SEQ ID NO: 280846 - DNA, 42 bp, Artificial Sequence
  Description of Artificial Sequence: Synthetic oligonucleotide
aagtgttgctcaaggtacttcctgaaggaaaatttgttctag

SEQ ID NO: 280847 - DNA, 41 bp, Artificial Sequence
  Description of Artificial Sequence: Synthetic oligonucleotide
agtgttgctcaaggtacttcctgaaggaaaatttgttctag

SEQ ID NO: 280848 - DNA, 40 bp, Artificial Sequence
  Description of Artificial Sequence: Synthetic oligonucleotide
gtgttgctcaaggtacttcctgaaggaaaatttgttctag

SEQ ID NO: 280849 - DNA, 41 bp, Artificial Sequence
  Description of Artificial Sequence: Synthetic oligonucleotide
tgttgctcaaggtacttcctgaaggaaaatttgttctagac

SEQ ID NO: 280850 - DNA, 40 bp, Artificial Sequence
  Description of Artificial Sequence: Synthetic oligonucleotide
gttgctcaaggtacttcctgaaggaaaatttgttctagac

SEQ ID NO: 280851 - DNA, 40 bp, Artificial Sequence
  Description of Artificial Sequence: Synthetic oligonucleotide
ttgctcaaggtacttcctgaaggaaaatttgttctagacg

SEQ ID NO: 280852 - DNA, 39 bp, Artificial Sequence
  Description of Artificial Sequence: Synthetic oligonucleotide
tgctcaaggtacttcctgaaggaaaatttgttctagacg

SEQ ID NO: 280853 - DNA, 38 bp, Artificial Sequence
  Description of Artificial Sequence: Synthetic oligonucleotide
gctcaaggtacttcctgaaggaaaatttgttctagacg

SEQ ID NO: 280854 - DNA, 39 bp, Artificial Sequence
  Description of Artificial Sequence: Synthetic oligonucleotide
ctcaaggtacttcctgaaggaaaatttgttctagacgtg

SEQ ID NO: 280855 - DNA, 39 bp, Artificial Sequence
  Description of Artificial Sequence: Synthetic oligonucleotide
tcaaggtacttcctgaaggaaaatttgttctagacgtgg

SEQ ID NO: 280856 - DNA, 38 bp, Artificial Sequence
  Description of Artificial Sequence: Synthetic oligonucleotide
caaggtacttcctgaaggaaaatttgttctagacgtgg

SEQ ID NO: 280857 - DNA, 39 bp, Artificial Sequence
  Description of Artificial Sequence: Synthetic oligonucleotide
aaggtacttcctgaaggaaaatttgttctagacgtggtc

SEQ ID NO: 280858 - DNA, 38 bp, Artificial Sequence
  Description of Artificial Sequence: Synthetic oligonucleotide
aggtacttcctgaaggaaaatttgttctagacgtggtc

SEQ ID NO: 280859 - DNA, 37 bp, Artificial Sequence
  Description of Artificial Sequence: Synthetic oligonucleotide
ggtacttcctgaaggaaaatttgttctagacgtggtc

SEQ ID NO: 280860 - DNA, 42 bp, Artificial Sequence
  Description of Artificial Sequence: Synthetic oligonucleotide
gtacttcctgaaggaaaatttgttctagacgtggtcaaaaac

SEQ ID NO: 280861 - DNA, 45 bp, Artificial Sequence
  Description of Artificial Sequence: Synthetic oligonucleotide
tacttcctgaaggaaaatttgttctagacgtggtcaaaaacatag

SEQ ID NO: 280862 - DNA, 44 bp, Artificial Sequence
  Description of Artificial Sequence: Synthetic oligonucleotide
acttcctgaaggaaaatttgttctagacgtggtcaaaaacatag

SEQ ID NO: 280863 - DNA, 43 bp, Artificial Sequence
  Description of Artificial Sequence: Synthetic oligonucleotide
cttcctgaaggaaaatttgttctagacgtggtcaaaaacatag

SEQ ID NO: 280864 - DNA, 44 bp, Artificial Sequence
  Description of Artificial Sequence: Synthetic oligonucleotide
ttcctgaaggaaaatttgttctagacgtggtcaaaaacatagac

SEQ ID NO: 280865 - DNA, 43 bp, Artificial Sequence
  Description of Artificial Sequence: Synthetic oligonucleotide
tcctgaaggaaaatttgttctagacgtggtcaaaaacatagac

SEQ ID NO: 280866 - DNA, 42 bp, Artificial Sequence
  Description of Artificial Sequence: Synthetic oligonucleotide
cctgaaggaaaatttgttctagacgtggtcaaaaacatagac

SEQ ID NO: 280867 - DNA, 44 bp, Artificial Sequence
  Description of Artificial Sequence: Synthetic oligonucleotide
ctgaaggaaaatttgttctagacgtggtcaaaaacatagacatc

SEQ ID NO: 280868 - DNA, 47 bp, Artificial Sequence
  Description of Artificial Sequence: Synthetic oligonucleotide
tgaaggaaaatttgttctagacgtggtcaaaaacatagacatcaatc

SEQ ID NO: 280869 - DNA, 46 bp, Artificial Sequence
  Description of Artificial Sequence: Synthetic oligonucleotide
gaaggaaaatttgttctagacgtggtcaaaaacatagacatcaatc

SEQ ID NO: 280870 - DNA, 48 bp, Artificial Sequence
  Description of Artificial Sequence: Synthetic oligonucleotide
aaggaaaatttgttctagacgtggtcaaaaacatagacatcaatcatg

SEQ ID NO: 280871 - DNA, 47 bp, Artificial Sequence
  Description of Artificial Sequence: Synthetic oligonucleotide
aggaaaatttgttctagacgtggtcaaaaacatagacatcaatcatg

SEQ ID NO: 280872 - DNA, 46 bp, Artificial Sequence
  Description of Artificial Sequence: Synthetic oligonucleotide
ggaaaatttgttctagacgtggtcaaaaacatagacatcaatcatg

SEQ ID NO: 280873 - DNA, 47 bp, Artificial Sequence
  Description of Artificial Sequence: Synthetic oligonucleotide
gaaaatttgttctagacgtggtcaaaaacatagacatcaatcatgtg

SEQ ID NO: 280874 - DNA, 48 bp, Artificial Sequence
  Description of Artificial Sequence: Synthetic oligonucleotide
aaaatttgttctagacgtggtcaaaaacatagacatcaatcatgtgac

SEQ ID NO: 280875 - DNA, 47 bp, Artificial Sequence
  Description of Artificial Sequence: Synthetic oligonucleotide
aaatttgttctagacgtggtcaaaaacatagacatcaatcatgtgac

SEQ ID NO: 280876 - DNA, 46 bp, Artificial Sequence
  Description of Artificial Sequence: Synthetic oligonucleotide
aatttgttctagacgtggtcaaaaacatagacatcaatcatgtgac

SEQ ID NO: 280877 - DNA, 45 bp, Artificial Sequence
  Description of Artificial Sequence: Synthetic oligonucleotide
atttgttctagacgtggtcaaaaacatagacatcaatcatgtgac

SEQ ID NO: 280878 - DNA, 44 bp, Artificial Sequence
  Description of Artificial Sequence: Synthetic oligonucleotide
tttgttctagacgtggtcaaaaacatagacatcaatcatgtgac

SEQ ID NO: 280879 - DNA, 43 bp, Artificial Sequence
  Description of Artificial Sequence: Synthetic oligonucleotide
ttgttctagacgtggtcaaaaacatagacatcaatcatgtgac

SEQ ID NO: 280880 - DNA, 42 bp, Artificial Sequence
  Description of Artificial Sequence: Synthetic oligonucleotide
tgttctagacgtggtcaaaaacatagacatcaatcatgtgac

SEQ ID NO: 280881 - DNA, 41 bp, Artificial Sequence
  Description of Artificial Sequence: Synthetic oligonucleotide
gttctagacgtggtcaaaaacatagacatcaatcatgtgac

SEQ ID NO: 280882 - DNA, 42 bp, Artificial Sequence
  Description of Artificial Sequence: Synthetic oligonucleotide
ttctagacgtggtcaaaaacatagacatcaatcatgtgacac

SEQ ID NO: 280883 - DNA, 41 bp, Artificial Sequence
  Description of Artificial Sequence: Synthetic oligonucleotide
tctagacgtggtcaaaaacatagacatcaatcatgtgacac

SEQ ID NO: 280884 - DNA, 40 bp, Artificial Sequence
  Description of Artificial Sequence: Synthetic oligonucleotide
ctagacgtggtcaaaaacatagacatcaatcatgtgacac

SEQ ID NO: 280885 - DNA, 40 bp, Artificial Sequence
  Description of Artificial Sequence: Synthetic oligonucleotide
tagacgtggtcaaaaacatagacatcaatcatgtgacacg

SEQ ID NO: 280886 - DNA, 39 bp, Artificial Sequence
  Description of Artificial Sequence: Synthetic oligonucleotide
agacgtggtcaaaaacatagacatcaatcatgtgacacg

SEQ ID NO: 280887 - DNA, 38 bp, Artificial Sequence
  Description of Artificial Sequence: Synthetic oligonucleotide
gacgtggtcaaaaacatagacatcaatcatgtgacacg

SEQ ID NO: 280888 - DNA, 38 bp, Artificial Sequence
  Description of Artificial Sequence: Synthetic oligonucleotide
acgtggtcaaaaacatagacatcaatcatgtgacacgc

SEQ ID NO: 280889 - DNA, 37 bp, Artificial Sequence
  Description of Artificial Sequence: Synthetic oligonucleotide
cgtggtcaaaaacatagacatcaatcatgtgacacgc

SEQ ID NO: 280890 - DNA, 41 bp, Artificial Sequence
  Description of Artificial Sequence: Synthetic oligonucleotide
gtggtcaaaaacatagacatcaatcatgtgacacgcaattg

SEQ ID NO: 280891 - DNA, 41 bp, Artificial Sequence
  Description of Artificial Sequence: Synthetic oligonucleotide
tggtcaaaaacatagacatcaatcatgtgacacgcaattgc

SEQ ID NO: 280892 - DNA, 40 bp, Artificial Sequence
  Description of Artificial Sequence: Synthetic oligonucleotide
ggtcaaaaacatagacatcaatcatgtgacacgcaattgc

SEQ ID NO: 280893 - DNA, 40 bp, Artificial Sequence
  Description of Artificial Sequence: Synthetic oligonucleotide
gtcaaaaacatagacatcaatcatgtgacacgcaattgcc

SEQ ID NO: 280894 - DNA, 40 bp, Artificial Sequence
  Description of Artificial Sequence: Synthetic oligonucleotide
tcaaaaacatagacatcaatcatgtgacacgcaattgccg

SEQ ID NO: 280895 - DNA, 39 bp, Artificial Sequence
  Description of Artificial Sequence: Synthetic oligonucleotide
caaaaacatagacatcaatcatgtgacacgcaattgccg

SEQ ID NO: 280896 - DNA, 39 bp, Artificial Sequence
  Description of Artificial Sequence: Synthetic oligonucleotide
aaaaacatagacatcaatcatgtgacacgcaattgccgc

SEQ ID NO: 280897 - DNA, 38 bp, Artificial Sequence
  Description of Artificial Sequence: Synthetic oligonucleotide
aaaacatagacatcaatcatgtgacacgcaattgccgc

SEQ ID NO: 280898 - DNA, 37 bp, Artificial Sequence
  Description of Artificial Sequence: Synthetic oligonucleotide
aaacatagacatcaatcatgtgacacgcaattgccgc

SEQ ID NO: 280899 - DNA, 36 bp, Artificial Sequence
  Description of Artificial Sequence: Synthetic oligonucleotide
aacatagacatcaatcatgtgacacgcaattgccgc

SEQ ID NO: 280900 - DNA, 35 bp, Artificial Sequence
  Description of Artificial Sequence: Synthetic oligonucleotide
acatagacatcaatcatgtgacacgcaattgccgc

SEQ ID NO: 280901 - DNA, 34 bp, Artificial Sequence
  Description of Artificial Sequence: Synthetic oligonucleotide
catagacatcaatcatgtgacacgcaattgccgc

SEQ ID NO: 280902 - DNA, 34 bp, Artificial Sequence
  Description of Artificial Sequence: Synthetic oligonucleotide
atagacatcaatcatgtgacacgcaattgccgcg

SEQ ID NO: 280903 - DNA, 33 bp, Artificial Sequence
  Description of Artificial Sequence: Synthetic oligonucleotide
tagacatcaatcatgtgacacgcaattgccgcg

SEQ ID NO: 280904 - DNA, 32 bp, Artificial Sequence
  Description of Artificial Sequence: Synthetic oligonucleotide
agacatcaatcatgtgacacgcaattgccgcg

SEQ ID NO: 280905 - DNA, 31 bp, Artificial Sequence
  Description of Artificial Sequence: Synthetic oligonucleotide
gacatcaatcatgtgacacgcaattgccgcg

SEQ ID NO: 280906 - DNA, 32 bp, Artificial Sequence
  Description of Artificial Sequence: Synthetic oligonucleotide
acatcaatcatgtgacacgcaattgccgcgtg

SEQ ID NO: 280907 - DNA, 31 bp, Artificial Sequence
  Description of Artificial Sequence: Synthetic oligonucleotide
catcaatcatgtgacacgcaattgccgcgtg

SEQ ID NO: 280908 - DNA, 31 bp, Artificial Sequence
  Description of Artificial Sequence: Synthetic oligonucleotide
atcaatcatgtgacacgcaattgccgcgtgg

SEQ ID NO: 280909 - DNA, 30 bp, Artificial Sequence
  Description of Artificial Sequence: Synthetic oligonucleotide
tcaatcatgtgacacgcaattgccgcgtgg

SEQ ID NO: 280910 - DNA, 29 bp, Artificial Sequence
  Description of Artificial Sequence: Synthetic oligonucleotide
caatcatgtgacacgcaattgccgcgtgg

SEQ ID NO: 280911 - DNA, 29 bp, Artificial Sequence
  Description of Artificial Sequence: Synthetic oligonucleotide
aatcatgtgacacgcaattgccgcgtggc

SEQ ID NO: 280912 - DNA, 28 bp, Artificial Sequence
  Description of Artificial Sequence: Synthetic oligonucleotide
atcatgtgacacgcaattgccgcgtggc

SEQ ID NO: 280913 - DNA, 27 bp, Artificial Sequence
  Description of Artificial Sequence: Synthetic oligonucleotide
tcatgtgacacgcaattgccgcgtggc

SEQ ID NO: 280914 - DNA, 27 bp, Artificial Sequence
  Description of Artificial Sequence: Synthetic oligonucleotide
catgtgacacgcaattgccgcgtggct

SEQ ID NO: 280915 - DNA, 27 bp, Artificial Sequence
  Description of Artificial Sequence: Synthetic oligonucleotide
atgtgacacgcaattgccgcgtggctc

SEQ ID NO: 280916 - DNA, 27 bp, Artificial Sequence
  Description of Artificial Sequence: Synthetic oligonucleotide
tgtgacacgcaattgccgcgtggctct

SEQ ID NO: 280917 - DNA, 27 bp, Artificial Sequence
  Description of Artificial Sequence: Synthetic oligonucleotide
gtgacacgcaattgccgcgtggctcta

SEQ ID NO: 280918 - DNA, 28 bp, Artificial Sequence
  Description of Artificial Sequence: Synthetic oligonucleotide
tgacacgcaattgccgcgtggctctatg

SEQ ID NO: 280919 - DNA, 27 bp, Artificial Sequence
  Description of Artificial Sequence: Synthetic oligonucleotide
gacacgcaattgccgcgtggctctatg

SEQ ID NO: 280920 - DNA, 27 bp, Artificial Sequence
  Description of Artificial Sequence: Synthetic oligonucleotide
acacgcaattgccgcgtggctctatgg

SEQ ID NO: 280921 - DNA, 27 bp, Artificial Sequence
  Description of Artificial Sequence: Synthetic oligonucleotide
cacgcaattgccgcgtggctctatgga

SEQ ID NO: 280922 - DNA, 29 bp, Artificial Sequence
  Description of Artificial Sequence: Synthetic oligonucleotide
acgcaattgccgcgtggctctatggaatg

SEQ ID NO: 280923 - DNA, 28 bp, Artificial Sequence
  Description of Artificial Sequence: Synthetic oligonucleotide
cgcaattgccgcgtggctctatggaatg

SEQ ID NO: 280924 - DNA, 29 bp, Artificial Sequence
  Description of Artificial Sequence: Synthetic oligonucleotide
gcaattgccgcgtggctctatggaatgac

SEQ ID NO: 280925 - DNA, 30 bp, Artificial Sequence
  Description of Artificial Sequence: Synthetic oligonucleotide
caattgccgcgtggctctatggaatgacac

SEQ ID NO: 280926 - DNA, 30 bp, Artificial Sequence
  Description of Artificial Sequence: Synthetic oligonucleotide
aattgccgcgtggctctatggaatgacacc

SEQ ID NO: 280927 - DNA, 29 bp, Artificial Sequence
  Description of Artificial Sequence: Synthetic oligonucleotide
attgccgcgtggctctatggaatgacacc

SEQ ID NO: 280928 - DNA, 28 bp, Artificial Sequence
  Description of Artificial Sequence: Synthetic oligonucleotide
ttgccgcgtggctctatggaatgacacc

SEQ ID NO: 280929 - DNA, 27 bp, Artificial Sequence
  Description of Artificial Sequence: Synthetic oligonucleotide
tgccgcgtggctctatggaatgacacc

SEQ ID NO: 280930 - DNA, 27 bp, Artificial Sequence
  Description of Artificial Sequence: Synthetic oligonucleotide
gccgcgtggctctatggaatgacacct

SEQ ID NO: 280931 - DNA, 28 bp, Artificial Sequence
  Description of Artificial Sequence: Synthetic oligonucleotide
ccgcgtggctctatggaatgacacctac

SEQ ID NO: 280932 - DNA, 29 bp, Artificial Sequence
  Description of Artificial Sequence: Synthetic oligonucleotide
cgcgtggctctatggaatgacacctacac

SEQ ID NO: 280933 - DNA, 30 bp, Artificial Sequence
  Description of Artificial Sequence: Synthetic oligonucleotide
gcgtggctctatggaatgacacctacactc

SEQ ID NO: 280934 - DNA, 31 bp, Artificial Sequence
  Description of Artificial Sequence: Synthetic oligonucleotide
cgtggctctatggaatgacacctacactctc

SEQ ID NO: 280935 - DNA, 31 bp, Artificial Sequence
  Description of Artificial Sequence: Synthetic oligonucleotide
gtggctctatggaatgacacctacactctcc

SEQ ID NO: 280936 - DNA, 32 bp, Artificial Sequence
  Description of Artificial Sequence: Synthetic oligonucleotide
tggctctatggaatgacacctacactctccac

SEQ ID NO: 280937 - DNA, 31 bp, Artificial Sequence
  Description of Artificial Sequence: Synthetic oligonucleotide
ggctctatggaatgacacctacactctccac

SEQ ID NO: 280938 - DNA, 33 bp, Artificial Sequence
  Description of Artificial Sequence: Synthetic oligonucleotide
gctctatggaatgacacctacactctccacaag

SEQ ID NO: 280939 - DNA, 35 bp, Artificial Sequence
  Description of Artificial Sequence: Synthetic oligonucleotide
ctctatggaatgacacctacactctccacaagatc

SEQ ID NO: 280940 - DNA, 35 bp, Artificial Sequence
  Description of Artificial Sequence: Synthetic oligonucleotide
tctatggaatgacacctacactctccacaagatcg

SEQ ID NO: 280941 - DNA, 34 bp, Artificial Sequence
  Description of Artificial Sequence: Synthetic oligonucleotide
ctatggaatgacacctacactctccacaagatcg

SEQ ID NO: 280942 - DNA, 35 bp, Artificial Sequence
  Description of Artificial Sequence: Synthetic oligonucleotide
tatggaatgacacctacactctccacaagatcgtg

SEQ ID NO: 280943 - DNA, 34 bp, Artificial Sequence
  Description of Artificial Sequence: Synthetic oligonucleotide
atggaatgacacctacactctccacaagatcgtg

SEQ ID NO: 280944 - DNA, 33 bp, Artificial Sequence
  Description of Artificial Sequence: Synthetic oligonucleotide
tggaatgacacctacactctccacaagatcgtg

SEQ ID NO: 280945 - DNA, 32 bp, Artificial Sequence
  Description of Artificial Sequence: Synthetic oligonucleotide
ggaatgacacctacactctccacaagatcgtg

SEQ ID NO: 280946 - DNA, 32 bp, Artificial Sequence
  Description of Artificial Sequence: Synthetic oligonucleotide
gaatgacacctacactctccacaagatcgtgc

SEQ ID NO: 280947 - DNA, 32 bp, Artificial Sequence
  Description of Artificial Sequence: Synthetic oligonucleotide
aatgacacctacactctccacaagatcgtgcc

SEQ ID NO: 280948 - DNA, 31 bp, Artificial Sequence
  Description of Artificial Sequence: Synthetic oligonucleotide
atgacacctacactctccacaagatcgtgcc

SEQ ID NO: 280949 - DNA, 30 bp, Artificial Sequence
  Description of Artificial Sequence: Synthetic oligonucleotide
tgacacctacactctccacaagatcgtgcc

SEQ ID NO: 280950 - DNA, 29 bp, Artificial Sequence
  Description of Artificial Sequence: Synthetic oligonucleotide
gacacctacactctccacaagatcgtgcc

SEQ ID NO: 280951 - DNA, 29 bp, Artificial Sequence
  Description of Artificial Sequence: Synthetic oligonucleotide
acacctacactctccacaagatcgtgccc

SEQ ID NO: 280952 - DNA, 28 bp, Artificial Sequence
  Description of Artificial Sequence: Synthetic oligonucleotide
cacctacactctccacaagatcgtgccc

SEQ ID NO: 280953 - DNA, 30 bp, Artificial Sequence
  Description of Artificial Sequence: Synthetic oligonucleotide
acctacactctccacaagatcgtgcccaac

SEQ ID NO: 280954 - DNA, 29 bp, Artificial Sequence
  Description of Artificial Sequence: Synthetic oligonucleotide
cctacactctccacaagatcgtgcccaac

SEQ ID NO: 280955 - DNA, 31 bp, Artificial Sequence
  Description of Artificial Sequence: Synthetic oligonucleotide
ctacactctccacaagatcgtgcccaacatg

SEQ ID NO: 280956 - DNA, 31 bp, Artificial Sequence
  Description of Artificial Sequence: Synthetic oligonucleotide
tacactctccacaagatcgtgcccaacatgg

SEQ ID NO: 280957 - DNA, 30 bp, Artificial Sequence
  Description of Artificial Sequence: Synthetic oligonucleotide
acactctccacaagatcgtgcccaacatgg

SEQ ID NO: 280958 - DNA, 29 bp, Artificial Sequence
  Description of Artificial Sequence: Synthetic oligonucleotide
cactctccacaagatcgtgcccaacatgg

SEQ ID NO: 280959 - DNA, 31 bp, Artificial Sequence
  Description of Artificial Sequence: Synthetic oligonucleotide
actctccacaagatcgtgcccaacatggtag

SEQ ID NO: 280960 - DNA, 30 bp, Artificial Sequence
  Description of Artificial Sequence: Synthetic oligonucleotide
ctctccacaagatcgtgcccaacatggtag

SEQ ID NO: 280961 - DNA, 31 bp, Artificial Sequence
  Description of Artificial Sequence: Synthetic oligonucleotide
tctccacaagatcgtgcccaacatggtagac

SEQ ID NO: 280962 - DNA, 30 bp, Artificial Sequence
  Description of Artificial Sequence: Synthetic oligonucleotide
ctccacaagatcgtgcccaacatggtagac

SEQ ID NO: 280963 - DNA, 30 bp, Artificial Sequence
  Description of Artificial Sequence: Synthetic oligonucleotide
tccacaagatcgtgcccaacatggtagacc

SEQ ID NO: 280964 - DNA, 29 bp, Artificial Sequence
  Description of Artificial Sequence: Synthetic oligonucleotide
ccacaagatcgtgcccaacatggtagacc

SEQ ID NO: 280965 - DNA, 29 bp, Artificial Sequence
  Description of Artificial Sequence: Synthetic oligonucleotide
cacaagatcgtgcccaacatggtagaccc

SEQ ID NO: 280966 - DNA, 33 bp, Artificial Sequence
  Description of Artificial Sequence: Synthetic oligonucleotide
acaagatcgtgcccaacatggtagaccctttag

SEQ ID NO: 280967 - DNA, 32 bp, Artificial Sequence
  Description of Artificial Sequence: Synthetic oligonucleotide
caagatcgtgcccaacatggtagaccctttag

SEQ ID NO: 280968 - DNA, 33 bp, Artificial Sequence
  Description of Artificial Sequence: Synthetic oligonucleotide
aagatcgtgcccaacatggtagaccctttagtg

SEQ ID NO: 280969 - DNA, 32 bp, Artificial Sequence
  Description of Artificial Sequence: Synthetic oligonucleotide
agatcgtgcccaacatggtagaccctttagtg

SEQ ID NO: 280970 - DNA, 31 bp, Artificial Sequence
  Description of Artificial Sequence: Synthetic oligonucleotide
gatcgtgcccaacatggtagaccctttagtg

SEQ ID NO: 280971 - DNA, 32 bp, Artificial Sequence
  Description of Artificial Sequence: Synthetic oligonucleotide
atcgtgcccaacatggtagaccctttagtgtc

SEQ ID NO: 280972 - DNA, 31 bp, Artificial Sequence
  Description of Artificial Sequence: Synthetic oligonucleotide
tcgtgcccaacatggtagaccctttagtgtc

SEQ ID NO: 280973 - DNA, 30 bp, Artificial Sequence
  Description of Artificial Sequence: Synthetic oligonucleotide
cgtgcccaacatggtagaccctttagtgtc

SEQ ID NO: 280974 - DNA, 31 bp, Artificial Sequence
  Description of Artificial Sequence: Synthetic oligonucleotide
gtgcccaacatggtagaccctttagtgtcag

SEQ ID NO: 280975 - DNA, 32 bp, Artificial Sequence
  Description of Artificial Sequence: Synthetic oligonucleotide
tgcccaacatggtagaccctttagtgtcagtg

SEQ ID NO: 280976 - DNA, 31 bp, Artificial Sequence
  Description of Artificial Sequence: Synthetic oligonucleotide
gcccaacatggtagaccctttagtgtcagtg

SEQ ID NO: 280977 - DNA, 33 bp, Artificial Sequence
  Description of Artificial Sequence: Synthetic oligonucleotide
cccaacatggtagaccctttagtgtcagtgatg

SEQ ID NO: 280978 - DNA, 35 bp, Artificial Sequence
  Description of Artificial Sequence: Synthetic oligonucleotide
ccaacatggtagaccctttagtgtcagtgatgatg

SEQ ID NO: 280979 - DNA, 35 bp, Artificial Sequence
  Description of Artificial Sequence: Synthetic oligonucleotide
caacatggtagaccctttagtgtcagtgatgatgg

SEQ ID NO: 280980 - DNA, 36 bp, Artificial Sequence
  Description of Artificial Sequence: Synthetic oligonucleotide
aacatggtagaccctttagtgtcagtgatgatggag

SEQ ID NO: 280981 - DNA, 35 bp, Artificial Sequence
  Description of Artificial Sequence: Synthetic oligonucleotide
acatggtagaccctttagtgtcagtgatgatggag

SEQ ID NO: 280982 - DNA, 34 bp, Artificial Sequence
  Description of Artificial Sequence: Synthetic oligonucleotide
catggtagaccctttagtgtcagtgatgatggag

SEQ ID NO: 280983 - DNA, 34 bp, Artificial Sequence
  Description of Artificial Sequence: Synthetic oligonucleotide
atggtagaccctttagtgtcagtgatgatggagg

SEQ ID NO: 280984 - DNA, 33 bp, Artificial Sequence
  Description of Artificial Sequence: Synthetic oligonucleotide
tggtagaccctttagtgtcagtgatgatggagg

SEQ ID NO: 280985 - DNA, 32 bp, Artificial Sequence
  Description of Artificial Sequence: Synthetic oligonucleotide
ggtagaccctttagtgtcagtgatgatggagg

SEQ ID NO: 280986 - DNA, 33 bp, Artificial Sequence
  Description of Artificial Sequence: Synthetic oligonucleotide
gtagaccctttagtgtcagtgatgatggaggag

SEQ ID NO: 280987 - DNA, 36 bp, Artificial Sequence
  Description of Artificial Sequence: Synthetic oligonucleotide
tagaccctttagtgtcagtgatgatggaggagaaag

SEQ ID NO: 280988 - DNA, 35 bp, Artificial Sequence
  Description of Artificial Sequence: Synthetic oligonucleotide
agaccctttagtgtcagtgatgatggaggagaaag

SEQ ID NO: 280989 - DNA, 34 bp, Artificial Sequence
  Description of Artificial Sequence: Synthetic oligonucleotide
gaccctttagtgtcagtgatgatggaggagaaag

SEQ ID NO: 280990 - DNA, 36 bp, Artificial Sequence
  Description of Artificial Sequence: Synthetic oligonucleotide
accctttagtgtcagtgatgatggaggagaaagttc

SEQ ID NO: 280991 - DNA, 35 bp, Artificial Sequence
  Description of Artificial Sequence: Synthetic oligonucleotide
ccctttagtgtcagtgatgatggaggagaaagttc

SEQ ID NO: 280992 - DNA, 35 bp, Artificial Sequence
  Description of Artificial Sequence: Synthetic oligonucleotide
cctttagtgtcagtgatgatggaggagaaagttcc

SEQ ID NO: 280993 - DNA, 36 bp, Artificial Sequence
  Description of Artificial Sequence: Synthetic oligonucleotide
ctttagtgtcagtgatgatggaggagaaagttccag

SEQ ID NO: 280994 - DNA, 39 bp, Artificial Sequence
  Description of Artificial Sequence: Synthetic oligonucleotide
tttagtgtcagtgatgatggaggagaaagttccagattc

SEQ ID NO: 280995 - DNA, 38 bp, Artificial Sequence
  Description of Artificial Sequence: Synthetic oligonucleotide
ttagtgtcagtgatgatggaggagaaagttccagattc

SEQ ID NO: 280996 - DNA, 37 bp, Artificial Sequence
  Description of Artificial Sequence: Synthetic oligonucleotide
tagtgtcagtgatgatggaggagaaagttccagattc

SEQ ID NO: 280997 - DNA, 36 bp, Artificial Sequence
  Description of Artificial Sequence: Synthetic oligonucleotide
agtgtcagtgatgatggaggagaaagttccagattc

SEQ ID NO: 280998 - DNA, 35 bp, Artificial Sequence
  Description of Artificial Sequence: Synthetic oligonucleotide
gtgtcagtgatgatggaggagaaagttccagattc

SEQ ID NO: 280999 - DNA, 37 bp, Artificial Sequence
  Description of Artificial Sequence: Synthetic oligonucleotide
tgtcagtgatgatggaggagaaagttccagattcatc

SEQ ID NO: 281000 - DNA, 36 bp, Artificial Sequence
  Description of Artificial Sequence: Synthetic oligonucleotide
gtcagtgatgatggaggagaaagttccagattcatc

SEQ ID NO: 281001 - DNA, 40 bp, Artificial Sequence
  Description of Artificial Sequence: Synthetic oligonucleotide
tcagtgatgatggaggagaaagttccagattcatcttatg

SEQ ID NO: 281002 - DNA, 39 bp, Artificial Sequence
  Description of Artificial Sequence: Synthetic oligonucleotide
cagtgatgatggaggagaaagttccagattcatcttatg

SEQ ID NO: 281003 - DNA, 40 bp, Artificial Sequence
  Description of Artificial Sequence: Synthetic oligonucleotide
agtgatgatggaggagaaagttccagattcatcttatgag

SEQ ID NO: 281004 - DNA, 39 bp, Artificial Sequence
  Description of Artificial Sequence: Synthetic oligonucleotide
gtgatgatggaggagaaagttccagattcatcttatgag

SEQ ID NO: 281005 - DNA, 41 bp, Artificial Sequence
  Description of Artificial Sequence: Synthetic oligonucleotide
tgatgatggaggagaaagttccagattcatcttatgagaag

SEQ ID NO: 281006 - DNA, 40 bp, Artificial Sequence
  Description of Artificial Sequence: Synthetic oligonucleotide
gatgatggaggagaaagttccagattcatcttatgagaag

SEQ ID NO: 281007 - DNA, 43 bp, Artificial Sequence
  Description of Artificial Sequence: Synthetic oligonucleotide
atgatggaggagaaagttccagattcatcttatgagaagattg

SEQ ID NO: 281008 - DNA, 42 bp, Artificial Sequence
  Description of Artificial Sequence: Synthetic oligonucleotide
tgatggaggagaaagttccagattcatcttatgagaagattg

SEQ ID NO: 281009 - DNA, 41 bp, Artificial Sequence
  Description of Artificial Sequence: Synthetic oligonucleotide
gatggaggagaaagttccagattcatcttatgagaagattg

SEQ ID NO: 281010 - DNA, 41 bp, Artificial Sequence
  Description of Artificial Sequence: Synthetic oligonucleotide
atggaggagaaagttccagattcatcttatgagaagattgg

SEQ ID NO: 281011 - DNA, 40 bp, Artificial Sequence
  Description of Artificial Sequence: Synthetic oligonucleotide
tggaggagaaagttccagattcatcttatgagaagattgg

SEQ ID NO: 281012 - DNA, 39 bp, Artificial Sequence
  Description of Artificial Sequence: Synthetic oligonucleotide
ggaggagaaagttccagattcatcttatgagaagattgg

SEQ ID NO: 281013 - DNA, 40 bp, Artificial Sequence
  Description of Artificial Sequence: Synthetic oligonucleotide
gaggagaaagttccagattcatcttatgagaagattggtg

SEQ ID NO: 281014 - DNA, 40 bp, Artificial Sequence
  Description of Artificial Sequence: Synthetic oligonucleotide
aggagaaagttccagattcatcttatgagaagattggtgg

SEQ ID NO: 281015 - DNA, 39 bp, Artificial Sequence
  Description of Artificial Sequence: Synthetic oligonucleotide
ggagaaagttccagattcatcttatgagaagattggtgg

SEQ ID NO: 281016 - DNA, 40 bp, Artificial Sequence
  Description of Artificial Sequence: Synthetic oligonucleotide
gagaaagttccagattcatcttatgagaagattggtggtc

SEQ ID NO: 281017 - DNA, 41 bp, Artificial Sequence
  Description of Artificial Sequence: Synthetic oligonucleotide
agaaagttccagattcatcttatgagaagattggtggtctg

SEQ ID NO: 281018 - DNA, 40 bp, Artificial Sequence
  Description of Artificial Sequence: Synthetic oligonucleotide
gaaagttccagattcatcttatgagaagattggtggtctg

SEQ ID NO: 281019 - DNA, 40 bp, Artificial Sequence
  Description of Artificial Sequence: Synthetic oligonucleotide
aaagttccagattcatcttatgagaagattggtggtctgg

SEQ ID NO: 281020 - DNA, 39 bp, Artificial Sequence
  Description of Artificial Sequence: Synthetic oligonucleotide
aagttccagattcatcttatgagaagattggtggtctgg

SEQ ID NO: 281021 - DNA, 38 bp, Artificial Sequence
  Description of Artificial Sequence: Synthetic oligonucleotide
agttccagattcatcttatgagaagattggtggtctgg

SEQ ID NO: 281022 - DNA, 37 bp, Artificial Sequence
  Description of Artificial Sequence: Synthetic oligonucleotide
gttccagattcatcttatgagaagattggtggtctgg

SEQ ID NO: 281023 - DNA, 38 bp, Artificial Sequence
  Description of Artificial Sequence: Synthetic oligonucleotide
ttccagattcatcttatgagaagattggtggtctggac

SEQ ID NO: 281024 - DNA, 37 bp, Artificial Sequence
  Description of Artificial Sequence: Synthetic oligonucleotide
tccagattcatcttatgagaagattggtggtctggac

SEQ ID NO: 281025 - DNA, 36 bp, Artificial Sequence
  Description of Artificial Sequence: Synthetic oligonucleotide
ccagattcatcttatgagaagattggtggtctggac

SEQ ID NO: 281026 - DNA, 39 bp, Artificial Sequence
  Description of Artificial Sequence: Synthetic oligonucleotide
cagattcatcttatgagaagattggtggtctggacaaag

SEQ ID NO: 281027 - DNA, 40 bp, Artificial Sequence
  Description of Artificial Sequence: Synthetic oligonucleotide
agattcatcttatgagaagattggtggtctggacaaagag

SEQ ID NO: 281028 - DNA, 39 bp, Artificial Sequence
  Description of Artificial Sequence: Synthetic oligonucleotide
gattcatcttatgagaagattggtggtctggacaaagag

SEQ ID NO: 281029 - DNA, 41 bp, Artificial Sequence
  Description of Artificial Sequence: Synthetic oligonucleotide
attcatcttatgagaagattggtggtctggacaaagagatc

SEQ ID NO: 281030 - DNA, 40 bp, Artificial Sequence
  Description of Artificial Sequence: Synthetic oligonucleotide
ttcatcttatgagaagattggtggtctggacaaagagatc

SEQ ID NO: 281031 - DNA, 39 bp, Artificial Sequence
  Description of Artificial Sequence: Synthetic oligonucleotide
tcatcttatgagaagattggtggtctggacaaagagatc

SEQ ID NO: 281032 - DNA, 38 bp, Artificial Sequence
  Description of Artificial Sequence: Synthetic oligonucleotide
catcttatgagaagattggtggtctggacaaagagatc

SEQ ID NO: 281033 - DNA, 40 bp, Artificial Sequence
  Description of Artificial Sequence: Synthetic oligonucleotide
atcttatgagaagattggtggtctggacaaagagatcaag

SEQ ID NO: 281034 - DNA, 39 bp, Artificial Sequence
  Description of Artificial Sequence: Synthetic oligonucleotide
tcttatgagaagattggtggtctggacaaagagatcaag

SEQ ID NO: 281035 - DNA, 38 bp, Artificial Sequence
  Description of Artificial Sequence: Synthetic oligonucleotide
cttatgagaagattggtggtctggacaaagagatcaag

SEQ ID NO: 281036 - DNA, 38 bp, Artificial Sequence
  Description of Artificial Sequence: Synthetic oligonucleotide
ttatgagaagattggtggtctggacaaagagatcaagg

SEQ ID NO: 281037 - DNA, 37 bp, Artificial Sequence
  Description of Artificial Sequence: Synthetic oligonucleotide
tatgagaagattggtggtctggacaaagagatcaagg

SEQ ID NO: 281038 - DNA, 36 bp, Artificial Sequence
  Description of Artificial Sequence: Synthetic oligonucleotide
atgagaagattggtggtctggacaaagagatcaagg

SEQ ID NO: 281039 - DNA, 35 bp, Artificial Sequence
  Description of Artificial Sequence: Synthetic oligonucleotide
tgagaagattggtggtctggacaaagagatcaagg

SEQ ID NO: 281040 - DNA, 34 bp, Artificial Sequence
  Description of Artificial Sequence: Synthetic oligonucleotide
gagaagattggtggtctggacaaagagatcaagg

SEQ ID NO: 281041 - DNA, 35 bp, Artificial Sequence
  Description of Artificial Sequence: Synthetic oligonucleotide
agaagattggtggtctggacaaagagatcaaggtg

SEQ ID NO: 281042 - DNA, 34 bp, Artificial Sequence
  Description of Artificial Sequence: Synthetic oligonucleotide
gaagattggtggtctggacaaagagatcaaggtg

SEQ ID NO: 281043 - DNA, 36 bp, Artificial Sequence
  Description of Artificial Sequence: Synthetic oligonucleotide
aagattggtggtctggacaaagagatcaaggtgatc

SEQ ID NO: 281044 - DNA, 35 bp, Artificial Sequence
  Description of Artificial Sequence: Synthetic oligonucleotide
agattggtggtctggacaaagagatcaaggtgatc

SEQ ID NO: 281045 - DNA, 34 bp, Artificial Sequence
  Description of Artificial Sequence: Synthetic oligonucleotide
gattggtggtctggacaaagagatcaaggtgatc

SEQ ID NO: 281046 - DNA, 37 bp, Artificial Sequence
  Description of Artificial Sequence: Synthetic oligonucleotide
attggtggtctggacaaagagatcaaggtgatcaaag

SEQ ID NO: 281047 - DNA, 36 bp, Artificial Sequence
  Description of Artificial Sequence: Synthetic oligonucleotide
ttggtggtctggacaaagagatcaaggtgatcaaag

SEQ ID NO: 281048 - DNA, 35 bp, Artificial Sequence
  Description of Artificial Sequence: Synthetic oligonucleotide
tggtggtctggacaaagagatcaaggtgatcaaag

SEQ ID NO: 281049 - DNA, 34 bp, Artificial Sequence
  Description of Artificial Sequence: Synthetic oligonucleotide
ggtggtctggacaaagagatcaaggtgatcaaag

SEQ ID NO: 281050 - DNA, 36 bp, Artificial Sequence
  Description of Artificial Sequence: Synthetic oligonucleotide
gtggtctggacaaagagatcaaggtgatcaaagatg

SEQ ID NO: 281051 - DNA, 37 bp, Artificial Sequence
  Description of Artificial Sequence: Synthetic oligonucleotide
tggtctggacaaagagatcaaggtgatcaaagatgtg

SEQ ID NO: 281052 - DNA, 36 bp, Artificial Sequence
  Description of Artificial Sequence: Synthetic oligonucleotide
ggtctggacaaagagatcaaggtgatcaaagatgtg

SEQ ID NO: 281053 - DNA, 38 bp, Artificial Sequence
  Description of Artificial Sequence: Synthetic oligonucleotide
gtctggacaaagagatcaaggtgatcaaagatgtgatc

SEQ ID NO: 281054 - DNA, 38 bp, Artificial Sequence
  Description of Artificial Sequence: Synthetic oligonucleotide
tctggacaaagagatcaaggtgatcaaagatgtgatcg

SEQ ID NO: 281055 - DNA, 37 bp, Artificial Sequence
  Description of Artificial Sequence: Synthetic oligonucleotide
ctggacaaagagatcaaggtgatcaaagatgtgatcg

SEQ ID NO: 281056 - DNA, 38 bp, Artificial Sequence
  Description of Artificial Sequence: Synthetic oligonucleotide
tggacaaagagatcaaggtgatcaaagatgtgatcgag

SEQ ID NO: 281057 - DNA, 37 bp, Artificial Sequence
  Description of Artificial Sequence: Synthetic oligonucleotide
ggacaaagagatcaaggtgatcaaagatgtgatcgag

SEQ ID NO: 281058 - DNA, 37 bp, Artificial Sequence
  Description of Artificial Sequence: Synthetic oligonucleotide
gacaaagagatcaaggtgatcaaagatgtgatcgagg

SEQ ID NO: 281059 - DNA, 38 bp, Artificial Sequence
  Description of Artificial Sequence: Synthetic oligonucleotide
acaaagagatcaaggtgatcaaagatgtgatcgaggtg

SEQ ID NO: 281060 - DNA, 37 bp, Artificial Sequence
  Description of Artificial Sequence: Synthetic oligonucleotide
caaagagatcaaggtgatcaaagatgtgatcgaggtg

SEQ ID NO: 281061 - DNA, 37 bp, Artificial Sequence
  Description of Artificial Sequence: Synthetic oligonucleotide
aaagagatcaaggtgatcaaagatgtgatcgaggtgc

SEQ ID NO: 281062 - DNA, 36 bp, Artificial Sequence
  Description of Artificial Sequence: Synthetic oligonucleotide
aagagatcaaggtgatcaaagatgtgatcgaggtgc

SEQ ID NO: 281063 - DNA, 35 bp, Artificial Sequence
  Description of Artificial Sequence: Synthetic oligonucleotide
agagatcaaggtgatcaaagatgtgatcgaggtgc

SEQ ID NO: 281064 - DNA, 34 bp, Artificial Sequence
  Description of Artificial Sequence: Synthetic oligonucleotide
gagatcaaggtgatcaaagatgtgatcgaggtgc

SEQ ID NO: 281065 - DNA, 34 bp, Artificial Sequence
  Description of Artificial Sequence: Synthetic oligonucleotide
agatcaaggtgatcaaagatgtgatcgaggtgcc

SEQ ID NO: 281066 - DNA, 33 bp, Artificial Sequence
  Description of Artificial Sequence: Synthetic oligonucleotide
gatcaaggtgatcaaagatgtgatcgaggtgcc

SEQ ID NO: 281067 - DNA, 34 bp, Artificial Sequence
  Description of Artificial Sequence: Synthetic oligonucleotide
atcaaggtgatcaaagatgtgatcgaggtgcctg

SEQ ID NO: 281068 - DNA, 33 bp, Artificial Sequence
  Description of Artificial Sequence: Synthetic oligonucleotide
tcaaggtgatcaaagatgtgatcgaggtgcctg

SEQ ID NO: 281069 - DNA, 32 bp, Artificial Sequence
  Description of Artificial Sequence: Synthetic oligonucleotide
caaggtgatcaaagatgtgatcgaggtgcctg

SEQ ID NO: 281070 - DNA, 36 bp, Artificial Sequence
  Description of Artificial Sequence: Synthetic oligonucleotide
aaggtgatcaaagatgtgatcgaggtgcctgttatg

SEQ ID NO: 281071 - DNA, 35 bp, Artificial Sequence
  Description of Artificial Sequence: Synthetic oligonucleotide
aggtgatcaaagatgtgatcgaggtgcctgttatg

SEQ ID NO: 281072 - DNA, 34 bp, Artificial Sequence
  Description of Artificial Sequence: Synthetic oligonucleotide
ggtgatcaaagatgtgatcgaggtgcctgttatg

SEQ ID NO: 281073 - DNA, 34 bp, Artificial Sequence
  Description of Artificial Sequence: Synthetic oligonucleotide
gtgatcaaagatgtgatcgaggtgcctgttatgc

SEQ ID NO: 281074 - DNA, 36 bp, Artificial Sequence
  Description of Artificial Sequence: Synthetic oligonucleotide
tgatcaaagatgtgatcgaggtgcctgttatgcatc

SEQ ID NO: 281075 - DNA, 35 bp, Artificial Sequence
  Description of Artificial Sequence: Synthetic oligonucleotide
gatcaaagatgtgatcgaggtgcctgttatgcatc

SEQ ID NO: 281076 - DNA, 35 bp, Artificial Sequence
  Description of Artificial Sequence: Synthetic oligonucleotide
atcaaagatgtgatcgaggtgcctgttatgcatcc

SEQ ID NO: 281077 - DNA, 34 bp, Artificial Sequence
  Description of Artificial Sequence: Synthetic oligonucleotide
tcaaagatgtgatcgaggtgcctgttatgcatcc

SEQ ID NO: 281078 - DNA, 33 bp, Artificial Sequence
  Description of Artificial Sequence: Synthetic oligonucleotide
caaagatgtgatcgaggtgcctgttatgcatcc

SEQ ID NO: 281079 - DNA, 34 bp, Artificial Sequence
  Description of Artificial Sequence: Synthetic oligonucleotide
aaagatgtgatcgaggtgcctgttatgcatcctg

SEQ ID NO: 281080 - DNA, 33 bp, Artificial Sequence
  Description of Artificial Sequence: Synthetic oligonucleotide
aagatgtgatcgaggtgcctgttatgcatcctg

SEQ ID NO: 281081 - DNA, 32 bp, Artificial Sequence
  Description of Artificial Sequence: Synthetic oligonucleotide
agatgtgatcgaggtgcctgttatgcatcctg

SEQ ID NO: 281082 - DNA, 31 bp, Artificial Sequence
  Description of Artificial Sequence: Synthetic oligonucleotide
gatgtgatcgaggtgcctgttatgcatcctg

SEQ ID NO: 281083 - DNA, 32 bp, Artificial Sequence
  Description of Artificial Sequence: Synthetic oligonucleotide
atgtgatcgaggtgcctgttatgcatcctgac

SEQ ID NO: 281084 - DNA, 31 bp, Artificial Sequence
  Description of Artificial Sequence: Synthetic oligonucleotide
tgtgatcgaggtgcctgttatgcatcctgac

SEQ ID NO: 281085 - DNA, 30 bp, Artificial Sequence
  Description of Artificial Sequence: Synthetic oligonucleotide
gtgatcgaggtgcctgttatgcatcctgac

SEQ ID NO: 281086 - DNA, 30 bp, Artificial Sequence
  Description of Artificial Sequence: Synthetic oligonucleotide
tgatcgaggtgcctgttatgcatcctgacc

SEQ ID NO: 281087 - DNA, 29 bp, Artificial Sequence
  Description of Artificial Sequence: Synthetic oligonucleotide
gatcgaggtgcctgttatgcatcctgacc

SEQ ID NO: 281088 - DNA, 30 bp, Artificial Sequence
  Description of Artificial Sequence: Synthetic oligonucleotide
atcgaggtgcctgttatgcatcctgacctc

SEQ ID NO: 281089 - DNA, 29 bp, Artificial Sequence
  Description of Artificial Sequence: Synthetic oligonucleotide
tcgaggtgcctgttatgcatcctgacctc

SEQ ID NO: 281090 - DNA, 28 bp, Artificial Sequence
  Description of Artificial Sequence: Synthetic oligonucleotide
cgaggtgcctgttatgcatcctgacctc

SEQ ID NO: 281091 - DNA, 30 bp, Artificial Sequence
  Description of Artificial Sequence: Synthetic oligonucleotide
gaggtgcctgttatgcatcctgacctcttc

SEQ ID NO: 281092 - DNA, 30 bp, Artificial Sequence
  Description of Artificial Sequence: Synthetic oligonucleotide
aggtgcctgttatgcatcctgacctcttcg

SEQ ID NO: 281093 - DNA, 29 bp, Artificial Sequence
  Description of Artificial Sequence: Synthetic oligonucleotide
ggtgcctgttatgcatcctgacctcttcg

SEQ ID NO: 281094 - DNA, 31 bp, Artificial Sequence
  Description of Artificial Sequence: Synthetic oligonucleotide
gtgcctgttatgcatcctgacctcttcgaac

SEQ ID NO: 281095 - DNA, 31 bp, Artificial Sequence
  Description of Artificial Sequence: Synthetic oligonucleotide
tgcctgttatgcatcctgacctcttcgaacc

SEQ ID NO: 281096 - DNA, 30 bp, Artificial Sequence
  Description of Artificial Sequence: Synthetic oligonucleotide
gcctgttatgcatcctgacctcttcgaacc

SEQ ID NO: 281097 - DNA, 31 bp, Artificial Sequence
  Description of Artificial Sequence: Synthetic oligonucleotide
cctgttatgcatcctgacctcttcgaaccac

SEQ ID NO: 281098 - DNA, 32 bp, Artificial Sequence
  Description of Artificial Sequence: Synthetic oligonucleotide
ctgttatgcatcctgacctcttcgaaccactg

SEQ ID NO: 281099 - DNA, 32 bp, Artificial Sequence
  Description of Artificial Sequence: Synthetic oligonucleotide
tgttatgcatcctgacctcttcgaaccactgg

SEQ ID NO: 281100 - DNA, 31 bp, Artificial Sequence
  Description of Artificial Sequence: Synthetic oligonucleotide
gttatgcatcctgacctcttcgaaccactgg

SEQ ID NO: 281101 - DNA, 31 bp, Artificial Sequence
  Description of Artificial Sequence: Synthetic oligonucleotide
ttatgcatcctgacctcttcgaaccactggg

SEQ ID NO: 281102 - DNA, 30 bp, Artificial Sequence
  Description of Artificial Sequence: Synthetic oligonucleotide
tatgcatcctgacctcttcgaaccactggg

SEQ ID NO: 281103 - DNA, 29 bp, Artificial Sequence
  Description of Artificial Sequence: Synthetic oligonucleotide
atgcatcctgacctcttcgaaccactggg

SEQ ID NO: 281104 - DNA, 28 bp, Artificial Sequence
  Description of Artificial Sequence: Synthetic oligonucleotide
tgcatcctgacctcttcgaaccactggg

SEQ ID NO: 281105 - DNA, 27 bp, Artificial Sequence
  Description of Artificial Sequence: Synthetic oligonucleotide
gcatcctgacctcttcgaaccactggg

SEQ ID NO: 281106 - DNA, 27 bp, Artificial Sequence
  Description of Artificial Sequence: Synthetic oligonucleotide
catcctgacctcttcgaaccactgggc

SEQ ID NO: 281107 - DNA, 30 bp, Artificial Sequence
  Description of Artificial Sequence: Synthetic oligonucleotide
atcctgacctcttcgaaccactgggcaatg

SEQ ID NO: 281108 - DNA, 29 bp, Artificial Sequence
  Description of Artificial Sequence: Synthetic oligonucleotide
tcctgacctcttcgaaccactgggcaatg

SEQ ID NO: 281109 - DNA, 28 bp, Artificial Sequence
  Description of Artificial Sequence: Synthetic oligonucleotide
cctgacctcttcgaaccactgggcaatg

SEQ ID NO: 281110 - DNA, 28 bp, Artificial Sequence
  Description of Artificial Sequence: Synthetic oligonucleotide
ctgacctcttcgaaccactgggcaatgc

SEQ ID NO: 281111 - DNA, 29 bp, Artificial Sequence
  Description of Artificial Sequence: Synthetic oligonucleotide
tgacctcttcgaaccactgggcaatgctc

SEQ ID NO: 281112 - DNA, 28 bp, Artificial Sequence
  Description of Artificial Sequence: Synthetic oligonucleotide
gacctcttcgaaccactgggcaatgctc

SEQ ID NO: 281113 - DNA, 29 bp, Artificial Sequence
  Description of Artificial Sequence: Synthetic oligonucleotide
acctcttcgaaccactgggcaatgctcag

SEQ ID NO: 281114 - DNA, 28 bp, Artificial Sequence
  Description of Artificial Sequence: Synthetic oligonucleotide
cctcttcgaaccactgggcaatgctcag

SEQ ID NO: 281115 - DNA, 28 bp, Artificial Sequence
  Description of Artificial Sequence: Synthetic oligonucleotide
ctcttcgaaccactgggcaatgctcagc

SEQ ID NO: 281116 - DNA, 28 bp, Artificial Sequence
  Description of Artificial Sequence: Synthetic oligonucleotide
tcttcgaaccactgggcaatgctcagcc

SEQ ID NO: 281117 - DNA, 27 bp, Artificial Sequence
  Description of Artificial Sequence: Synthetic oligonucleotide
cttcgaaccactgggcaatgctcagcc

SEQ ID NO: 281118 - DNA, 27 bp, Artificial Sequence
  Description of Artificial Sequence: Synthetic oligonucleotide
ttcgaaccactgggcaatgctcagccg

SEQ ID NO: 281119 - DNA, 27 bp, Artificial Sequence
  Description of Artificial Sequence: Synthetic oligonucleotide
tcgaaccactgggcaatgctcagccga

SEQ ID NO: 281120 - DNA, 27 bp, Artificial Sequence
  Description of Artificial Sequence: Synthetic oligonucleotide
cgaaccactgggcaatgctcagccgaa

SEQ ID NO: 281121 - DNA, 27 bp, Artificial Sequence
  Description of Artificial Sequence: Synthetic oligonucleotide
gaaccactgggcaatgctcagccgaag

SEQ ID NO: 281122 - DNA, 27 bp, Artificial Sequence
  Description of Artificial Sequence: Synthetic oligonucleotide
aaccactgggcaatgctcagccgaagg

SEQ ID NO: 281123 - DNA, 26 bp, Artificial Sequence
  Description of Artificial Sequence: Synthetic oligonucleotide
accactgggcaatgctcagccgaagg

SEQ ID NO: 281124 - DNA, 25 bp, Artificial Sequence
  Description of Artificial Sequence: Synthetic oligonucleotide
ccactgggcaatgctcagccgaagg

SEQ ID NO: 281125 - DNA, 26 bp, Artificial Sequence
  Description of Artificial Sequence: Synthetic oligonucleotide
cactgggcaatgctcagccgaaggga

SEQ ID NO: 281126 - DNA, 27 bp, Artificial Sequence
  Description of Artificial Sequence: Synthetic oligonucleotide
actgggcaatgctcagccgaagggagt

SEQ ID NO: 281127 - DNA, 26 bp, Artificial Sequence
  Description of Artificial Sequence: Synthetic oligonucleotide
ctgggcaatgctcagccgaagggagt

SEQ ID NO: 281128 - DNA, 26 bp, Artificial Sequence
  Description of Artificial Sequence: Synthetic oligonucleotide
tgggcaatgctcagccgaagggagtg

SEQ ID NO: 281129 - DNA, 25 bp, Artificial Sequence
  Description of Artificial Sequence: Synthetic oligonucleotide
gggcaatgctcagccgaagggagtg

SEQ ID NO: 281130 - DNA, 26 bp, Artificial Sequence
  Description of Artificial Sequence: Synthetic oligonucleotide
ggcaatgctcagccgaagggagtggt

SEQ ID NO: 281131 - DNA, 26 bp, Artificial Sequence
  Description of Artificial Sequence: Synthetic oligonucleotide
gcaatgctcagccgaagggagtggtg

SEQ ID NO: 281132 - DNA, 27 bp, Artificial Sequence
  Description of Artificial Sequence: Synthetic oligonucleotide
caatgctcagccgaagggagtggtgct

SEQ ID NO: 281133 - DNA, 27 bp, Artificial Sequence
  Description of Artificial Sequence: Synthetic oligonucleotide
aatgctcagccgaagggagtggtgctg

SEQ ID NO: 281134 - DNA, 27 bp, Artificial Sequence
  Description of Artificial Sequence: Synthetic oligonucleotide
atgctcagccgaagggagtggtgctgt

SEQ ID NO: 281135 - DNA, 27 bp, Artificial Sequence
  Description of Artificial Sequence: Synthetic oligonucleotide
tgctcagccgaagggagtggtgctgta

SEQ ID NO: 281136 - DNA, 27 bp, Artificial Sequence
  Description of Artificial Sequence: Synthetic oligonucleotide
gctcagccgaagggagtggtgctgtat

SEQ ID NO: 281137 - DNA, 27 bp, Artificial Sequence
  Description of Artificial Sequence: Synthetic oligonucleotide
ctcagccgaagggagtggtgctgtatg

SEQ ID NO: 281138 - DNA, 27 bp, Artificial Sequence
  Description of Artificial Sequence: Synthetic oligonucleotide
tcagccgaagggagtggtgctgtatgc

SEQ ID NO: 281139 - DNA, 27 bp, Artificial Sequence
  Description of Artificial Sequence: Synthetic oligonucleotide
cagccgaagggagtggtgctgtatgca

SEQ ID NO: 281140 - DNA, 27 bp, Artificial Sequence
  Description of Artificial Sequence: Synthetic oligonucleotide
agccgaagggagtggtgctgtatgcac

SEQ ID NO: 281141 - DNA, 26 bp, Artificial Sequence
  Description of Artificial Sequence: Synthetic oligonucleotide
gccgaagggagtggtgctgtatgcac

SEQ ID NO: 281142 - DNA, 27 bp, Artificial Sequence
  Description of Artificial Sequence: Synthetic oligonucleotide
ccgaagggagtggtgctgtatgcacct

SEQ ID NO: 281143 - DNA, 27 bp, Artificial Sequence
  Description of Artificial Sequence: Synthetic oligonucleotide
cgaagggagtggtgctgtatgcacctc

SEQ ID NO: 281144 - DNA, 27 bp, Artificial Sequence
  Description of Artificial Sequence: Synthetic oligonucleotide
gaagggagtggtgctgtatgcacctcc

SEQ ID NO: 281145 - DNA, 28 bp, Artificial Sequence
  Description of Artificial Sequence: Synthetic oligonucleotide
aagggagtggtgctgtatgcacctccag

SEQ ID NO: 281146 - DNA, 27 bp, Artificial Sequence
  Description of Artificial Sequence: Synthetic oligonucleotide
agggagtggtgctgtatgcacctccag

SEQ ID NO: 281147 - DNA, 26 bp, Artificial Sequence
  Description of Artificial Sequence: Synthetic oligonucleotide
gggagtggtgctgtatgcacctccag

SEQ ID NO: 281148 - DNA, 26 bp, Artificial Sequence
  Description of Artificial Sequence: Synthetic oligonucleotide
ggagtggtgctgtatgcacctccagg

SEQ ID NO: 281149 - DNA, 27 bp, Artificial Sequence
  Description of Artificial Sequence: Synthetic oligonucleotide
gagtggtgctgtatgcacctccaggga

SEQ ID NO: 281150 - DNA, 27 bp, Artificial Sequence
  Description of Artificial Sequence: Synthetic oligonucleotide
agtggtgctgtatgcacctccagggac

SEQ ID NO: 281151 - DNA, 27 bp, Artificial Sequence
  Description of Artificial Sequence: Synthetic oligonucleotide
gtggtgctgtatgcacctccagggact

SEQ ID NO: 281152 - DNA, 27 bp, Artificial Sequence
  Description of Artificial Sequence: Synthetic oligonucleotide
tggtgctgtatgcacctccagggactg

SEQ ID NO: 281153 - DNA, 26 bp, Artificial Sequence
  Description of Artificial Sequence: Synthetic oligonucleotide
ggtgctgtatgcacctccagggactg

SEQ ID NO: 281154 - DNA, 26 bp, Artificial Sequence
  Description of Artificial Sequence: Synthetic oligonucleotide
gtgctgtatgcacctccagggactgg

SEQ ID NO: 281155 - DNA, 27 bp, Artificial Sequence
  Description of Artificial Sequence: Synthetic oligonucleotide
tgctgtatgcacctccagggactggga

SEQ ID NO: 281156 - DNA, 27 bp, Artificial Sequence
  Description of Artificial Sequence: Synthetic oligonucleotide
gctgtatgcacctccagggactgggaa

SEQ ID NO: 281157 - DNA, 27 bp, Artificial Sequence
  Description of Artificial Sequence: Synthetic oligonucleotide
ctgtatgcacctccagggactgggaag

SEQ ID NO: 281158 - DNA, 28 bp, Artificial Sequence
  Description of Artificial Sequence: Synthetic oligonucleotide
tgtatgcacctccagggactgggaagtc

SEQ ID NO: 281159 - DNA, 27 bp, Artificial Sequence
  Description of Artificial Sequence: Synthetic oligonucleotide
gtatgcacctccagggactgggaagtc

SEQ ID NO: 281160 - DNA, 28 bp, Artificial Sequence
  Description of Artificial Sequence: Synthetic oligonucleotide
tatgcacctccagggactgggaagtcac

SEQ ID NO: 281161 - DNA, 27 bp, Artificial Sequence
  Description of Artificial Sequence: Synthetic oligonucleotide
atgcacctccagggactgggaagtcac

SEQ ID NO: 281162 - DNA, 27 bp, Artificial Sequence
  Description of Artificial Sequence: Synthetic oligonucleotide
tgcacctccagggactgggaagtcact

SEQ ID NO: 281163 - DNA, 26 bp, Artificial Sequence
  Description of Artificial Sequence: Synthetic oligonucleotide
gcacctccagggactgggaagtcact

SEQ ID NO: 281164 - DNA, 27 bp, Artificial Sequence
  Description of Artificial Sequence: Synthetic oligonucleotide
cacctccagggactgggaagtcactgt

SEQ ID NO: 281165 - DNA, 28 bp, Artificial Sequence
  Description of Artificial Sequence: Synthetic oligonucleotide
acctccagggactgggaagtcactgttg

SEQ ID NO: 281166 - DNA, 27 bp, Artificial Sequence
  Description of Artificial Sequence: Synthetic oligonucleotide
cctccagggactgggaagtcactgttg

SEQ ID NO: 281167 - DNA, 27 bp, Artificial Sequence
  Description of Artificial Sequence: Synthetic oligonucleotide
ctccagggactgggaagtcactgttgg

SEQ ID NO: 281168 - DNA, 27 bp, Artificial Sequence
  Description of Artificial Sequence: Synthetic oligonucleotide
tccagggactgggaagtcactgttggg

SEQ ID NO: 281169 - DNA, 26 bp, Artificial Sequence
  Description of Artificial Sequence: Synthetic oligonucleotide
ccagggactgggaagtcactgttggg

SEQ ID NO: 281170 - DNA, 26 bp, Artificial Sequence
  Description of Artificial Sequence: Synthetic oligonucleotide
cagggactgggaagtcactgttgggc

SEQ ID NO: 281171 - DNA, 26 bp, Artificial Sequence
  Description of Artificial Sequence: Synthetic oligonucleotide
agggactgggaagtcactgttgggcc

SEQ ID NO: 281172 - DNA, 25 bp, Artificial Sequence
  Description of Artificial Sequence: Synthetic oligonucleotide
gggactgggaagtcactgttgggcc

SEQ ID NO: 281173 - DNA, 25 bp, Artificial Sequence
  Description of Artificial Sequence: Synthetic oligonucleotide
ggactgggaagtcactgttgggccg

SEQ ID NO: 281174 - DNA, 25 bp, Artificial Sequence
  Description of Artificial Sequence: Synthetic oligonucleotide
gactgggaagtcactgttgggccgg

SEQ ID NO: 281175 - DNA, 25 bp, Artificial Sequence
  Description of Artificial Sequence: Synthetic oligonucleotide
actgggaagtcactgttgggccggg

SEQ ID NO: 281176 - DNA, 24 bp, Artificial Sequence
  Description of Artificial Sequence: Synthetic oligonucleotide
ctgggaagtcactgttgggccggg

SEQ ID NO: 281177 - DNA, 25 bp, Artificial Sequence
  Description of Artificial Sequence: Synthetic oligonucleotide
tgggaagtcactgttgggccgggct

SEQ ID NO: 281178 - DNA, 24 bp, Artificial Sequence
  Description of Artificial Sequence: Synthetic oligonucleotide
gggaagtcactgttgggccgggct

SEQ ID NO: 281179 - DNA, 25 bp, Artificial Sequence
  Description of Artificial Sequence: Synthetic oligonucleotide
ggaagtcactgttgggccgggctgt

SEQ ID NO: 281180 - DNA, 25 bp, Artificial Sequence
  Description of Artificial Sequence: Synthetic oligonucleotide
gaagtcactgttgggccgggctgtc

SEQ ID NO: 281181 - DNA, 25 bp, Artificial Sequence
  Description of Artificial Sequence: Synthetic oligonucleotide
aagtcactgttgggccgggctgtcg

SEQ ID NO: 281182 - DNA, 24 bp, Artificial Sequence
  Description of Artificial Sequence: Synthetic oligonucleotide
agtcactgttgggccgggctgtcg

SEQ ID NO: 281183 - DNA, 23 bp, Artificial Sequence
  Description of Artificial Sequence: Synthetic oligonucleotide
gtcactgttgggccgggctgtcg

SEQ ID NO: 281184 - DNA, 24 bp, Artificial Sequence
  Description of Artificial Sequence: Synthetic oligonucleotide
tcactgttgggccgggctgtcgct

SEQ ID NO: 281185 - DNA, 23 bp, Artificial Sequence
  Description of Artificial Sequence: Synthetic oligonucleotide
cactgttgggccgggctgtcgct

SEQ ID NO: 281186 - DNA, 25 bp, Artificial Sequence
  Description of Artificial Sequence: Synthetic oligonucleotide
actgttgggccgggctgtcgctcat

SEQ ID NO: 281187 - DNA, 24 bp, Artificial Sequence
  Description of Artificial Sequence: Synthetic oligonucleotide
ctgttgggccgggctgtcgctcat

SEQ ID NO: 281188 - DNA, 27 bp, Artificial Sequence
  Description of Artificial Sequence: Synthetic oligonucleotide
tgttgggccgggctgtcgctcatcatt

SEQ ID NO: 281189 - DNA, 26 bp, Artificial Sequence
  Description of Artificial Sequence: Synthetic oligonucleotide
gttgggccgggctgtcgctcatcatt

SEQ ID NO: 281190 - DNA, 26 bp, Artificial Sequence
  Description of Artificial Sequence: Synthetic oligonucleotide
ttgggccgggctgtcgctcatcattc

SEQ ID NO: 281191 - DNA, 25 bp, Artificial Sequence
  Description of Artificial Sequence: Synthetic oligonucleotide
tgggccgggctgtcgctcatcattc

SEQ ID NO: 281192 - DNA, 24 bp, Artificial Sequence
  Description of Artificial Sequence: Synthetic oligonucleotide
gggccgggctgtcgctcatcattc

SEQ ID NO: 281193 - DNA, 24 bp, Artificial Sequence
  Description of Artificial Sequence: Synthetic oligonucleotide
ggccgggctgtcgctcatcattcg

SEQ ID NO: 281194 - DNA, 25 bp, Artificial Sequence
  Description of Artificial Sequence: Synthetic oligonucleotide
gccgggctgtcgctcatcattcgga

SEQ ID NO: 281195 - DNA, 26 bp, Artificial Sequence
  Description of Artificial Sequence: Synthetic oligonucleotide
ccgggctgtcgctcatcattcggact

SEQ ID NO: 281196 - DNA, 27 bp, Artificial Sequence
  Description of Artificial Sequence: Synthetic oligonucleotide
cgggctgtcgctcatcattcggactgt

SEQ ID NO: 281197 - DNA, 28 bp, Artificial Sequence
  Description of Artificial Sequence: Synthetic oligonucleotide
gggctgtcgctcatcattcggactgtag

SEQ ID NO: 281198 - DNA, 28 bp, Artificial Sequence
  Description of Artificial Sequence: Synthetic oligonucleotide
ggctgtcgctcatcattcggactgtagc

SEQ ID NO: 281199 - DNA, 34 bp, Artificial Sequence
  Description of Artificial Sequence: Synthetic oligonucleotide
gctgtcgctcatcattcggactgtagctttattc

SEQ ID NO: 281200 - DNA, 34 bp, Artificial Sequence
  Description of Artificial Sequence: Synthetic oligonucleotide
ctgtcgctcatcattcggactgtagctttattcg

SEQ ID NO: 281201 - DNA, 35 bp, Artificial Sequence
  Description of Artificial Sequence: Synthetic oligonucleotide
tgtcgctcatcattcggactgtagctttattcgag

SEQ ID NO: 281202 - DNA, 34 bp, Artificial Sequence
  Description of Artificial Sequence: Synthetic oligonucleotide
gtcgctcatcattcggactgtagctttattcgag

SEQ ID NO: 281203 - DNA, 35 bp, Artificial Sequence
  Description of Artificial Sequence: Synthetic oligonucleotide
tcgctcatcattcggactgtagctttattcgagtc

SEQ ID NO: 281204 - DNA, 34 bp, Artificial Sequence
  Description of Artificial Sequence: Synthetic oligonucleotide
cgctcatcattcggactgtagctttattcgagtc

SEQ ID NO: 281205 - DNA, 35 bp, Artificial Sequence
  Description of Artificial Sequence: Synthetic oligonucleotide
gctcatcattcggactgtagctttattcgagtctc

SEQ ID NO: 281206 - DNA, 36 bp, Artificial Sequence
  Description of Artificial Sequence: Synthetic oligonucleotide
ctcatcattcggactgtagctttattcgagtctctg

SEQ ID NO: 281207 - DNA, 36 bp, Artificial Sequence
  Description of Artificial Sequence: Synthetic oligonucleotide
tcatcattcggactgtagctttattcgagtctctgg

SEQ ID NO: 281208 - DNA, 35 bp, Artificial Sequence
  Description of Artificial Sequence: Synthetic oligonucleotide
catcattcggactgtagctttattcgagtctctgg

SEQ ID NO: 281209 - DNA, 35 bp, Artificial Sequence
  Description of Artificial Sequence: Synthetic oligonucleotide
atcattcggactgtagctttattcgagtctctggc

SEQ ID NO: 281210 - DNA, 34 bp, Artificial Sequence
  Description of Artificial Sequence: Synthetic oligonucleotide
tcattcggactgtagctttattcgagtctctggc

SEQ ID NO: 281211 - DNA, 33 bp, Artificial Sequence
  Description of Artificial Sequence: Synthetic oligonucleotide
cattcggactgtagctttattcgagtctctggc

SEQ ID NO: 281212 - DNA, 34 bp, Artificial Sequence
  Description of Artificial Sequence: Synthetic oligonucleotide
attcggactgtagctttattcgagtctctggcac

SEQ ID NO: 281213 - DNA, 33 bp, Artificial Sequence
  Description of Artificial Sequence: Synthetic oligonucleotide
ttcggactgtagctttattcgagtctctggcac

SEQ ID NO: 281214 - DNA, 32 bp, Artificial Sequence
  Description of Artificial Sequence: Synthetic oligonucleotide
tcggactgtagctttattcgagtctctggcac

SEQ ID NO: 281215 - DNA, 31 bp, Artificial Sequence
  Description of Artificial Sequence: Synthetic oligonucleotide
cggactgtagctttattcgagtctctggcac

SEQ ID NO: 281216 - DNA, 32 bp, Artificial Sequence
  Description of Artificial Sequence: Synthetic oligonucleotide
ggactgtagctttattcgagtctctggcactg

SEQ ID NO: 281217 - DNA, 34 bp, Artificial Sequence
  Description of Artificial Sequence: Synthetic oligonucleotide
gactgtagctttattcgagtctctggcactgaac

SEQ ID NO: 281218 - DNA, 35 bp, Artificial Sequence
  Description of Artificial Sequence: Synthetic oligonucleotide
actgtagctttattcgagtctctggcactgaactg

SEQ ID NO: 281219 - DNA, 34 bp, Artificial Sequence
  Description of Artificial Sequence: Synthetic oligonucleotide
ctgtagctttattcgagtctctggcactgaactg

SEQ ID NO: 281220 - DNA, 34 bp, Artificial Sequence
  Description of Artificial Sequence: Synthetic oligonucleotide
tgtagctttattcgagtctctggcactgaactgg

SEQ ID NO: 281221 - DNA, 33 bp, Artificial Sequence
  Description of Artificial Sequence: Synthetic oligonucleotide
gtagctttattcgagtctctggcactgaactgg

SEQ ID NO: 281222 - DNA, 35 bp, Artificial Sequence
  Description of Artificial Sequence: Synthetic oligonucleotide
tagctttattcgagtctctggcactgaactggaac

SEQ ID NO: 281223 - DNA, 34 bp, Artificial Sequence
  Description of Artificial Sequence: Synthetic oligonucleotide
agctttattcgagtctctggcactgaactggaac

SEQ ID NO: 281224 - DNA, 33 bp, Artificial Sequence
  Description of Artificial Sequence: Synthetic oligonucleotide
gctttattcgagtctctggcactgaactggaac

SEQ ID NO: 281225 - DNA, 34 bp, Artificial Sequence
  Description of Artificial Sequence: Synthetic oligonucleotide
ctttattcgagtctctggcactgaactggaacag

SEQ ID NO: 281226 - DNA, 39 bp, Artificial Sequence
  Description of Artificial Sequence: Synthetic oligonucleotide
tttattcgagtctctggcactgaactggaacagaaattg

SEQ ID NO: 281227 - DNA, 38 bp, Artificial Sequence
  Description of Artificial Sequence: Synthetic oligonucleotide
ttattcgagtctctggcactgaactggaacagaaattg

SEQ ID NO: 281228 - DNA, 37 bp, Artificial Sequence
  Description of Artificial Sequence: Synthetic oligonucleotide
tattcgagtctctggcactgaactggaacagaaattg

SEQ ID NO: 281229 - DNA, 36 bp, Artificial Sequence
  Description of Artificial Sequence: Synthetic oligonucleotide
attcgagtctctggcactgaactggaacagaaattg

SEQ ID NO: 281230 - DNA, 35 bp, Artificial Sequence
  Description of Artificial Sequence: Synthetic oligonucleotide
ttcgagtctctggcactgaactggaacagaaattg

SEQ ID NO: 281231 - DNA, 34 bp, Artificial Sequence
  Description of Artificial Sequence: Synthetic oligonucleotide
tcgagtctctggcactgaactggaacagaaattg

SEQ ID NO: 281232 - DNA, 33 bp, Artificial Sequence
  Description of Artificial Sequence: Synthetic oligonucleotide
cgagtctctggcactgaactggaacagaaattg

SEQ ID NO: 281233 - DNA, 36 bp, Artificial Sequence
  Description of Artificial Sequence: Synthetic oligonucleotide
gagtctctggcactgaactggaacagaaattgatag

SEQ ID NO: 281234 - DNA, 36 bp, Artificial Sequence
  Description of Artificial Sequence: Synthetic oligonucleotide
agtctctggcactgaactggaacagaaattgatagg

SEQ ID NO: 281235 - DNA, 35 bp, Artificial Sequence
  Description of Artificial Sequence: Synthetic oligonucleotide
gtctctggcactgaactggaacagaaattgatagg

SEQ ID NO: 281236 - DNA, 35 bp, Artificial Sequence
  Description of Artificial Sequence: Synthetic oligonucleotide
tctctggcactgaactggaacagaaattgataggg

SEQ ID NO: 281237 - DNA, 34 bp, Artificial Sequence
  Description of Artificial Sequence: Synthetic oligonucleotide
ctctggcactgaactggaacagaaattgataggg

SEQ ID NO: 281238 - DNA, 34 bp, Artificial Sequence
  Description of Artificial Sequence: Synthetic oligonucleotide
tctggcactgaactggaacagaaattgatagggg

SEQ ID NO: 281239 - DNA, 33 bp, Artificial Sequence
  Description of Artificial Sequence: Synthetic oligonucleotide
ctggcactgaactggaacagaaattgatagggg

SEQ ID NO: 281240 - DNA, 35 bp, Artificial Sequence
  Description of Artificial Sequence: Synthetic oligonucleotide
tggcactgaactggaacagaaattgataggggaac

SEQ ID NO: 281241 - DNA, 34 bp, Artificial Sequence
  Description of Artificial Sequence: Synthetic oligonucleotide
ggcactgaactggaacagaaattgataggggaac

SEQ ID NO: 281242 - DNA, 34 bp, Artificial Sequence
  Description of Artificial Sequence: Synthetic oligonucleotide
gcactgaactggaacagaaattgataggggaacg

SEQ ID NO: 281243 - DNA, 34 bp, Artificial Sequence
  Description of Artificial Sequence: Synthetic oligonucleotide
cactgaactggaacagaaattgataggggaacgg

SEQ ID NO: 281244 - DNA, 34 bp, Artificial Sequence
  Description of Artificial Sequence: Synthetic oligonucleotide
actgaactggaacagaaattgataggggaacggg

SEQ ID NO: 281245 - DNA, 33 bp, Artificial Sequence
  Description of Artificial Sequence: Synthetic oligonucleotide
ctgaactggaacagaaattgataggggaacggg

SEQ ID NO: 281246 - DNA, 33 bp, Artificial Sequence
  Description of Artificial Sequence: Synthetic oligonucleotide
tgaactggaacagaaattgataggggaacgggc

SEQ ID NO: 281247 - DNA, 32 bp, Artificial Sequence
  Description of Artificial Sequence: Synthetic oligonucleotide
gaactggaacagaaattgataggggaacgggc

SEQ ID NO: 281248 - DNA, 34 bp, Artificial Sequence
  Description of Artificial Sequence: Synthetic oligonucleotide
aactggaacagaaattgataggggaacgggcaag

SEQ ID NO: 281249 - DNA, 33 bp, Artificial Sequence
  Description of Artificial Sequence: Synthetic oligonucleotide
actggaacagaaattgataggggaacgggcaag

SEQ ID NO: 281250 - DNA, 32 bp, Artificial Sequence
  Description of Artificial Sequence: Synthetic oligonucleotide
ctggaacagaaattgataggggaacgggcaag

SEQ ID NO: 281251 - DNA, 35 bp, Artificial Sequence
  Description of Artificial Sequence: Synthetic oligonucleotide
tggaacagaaattgataggggaacgggcaagaaag

SEQ ID NO: 281252 - DNA, 34 bp, Artificial Sequence
  Description of Artificial Sequence: Synthetic oligonucleotide
ggaacagaaattgataggggaacgggcaagaaag

SEQ ID NO: 281253 - DNA, 34 bp, Artificial Sequence
  Description of Artificial Sequence: Synthetic oligonucleotide
gaacagaaattgataggggaacgggcaagaaagg

SEQ ID NO: 281254 - DNA, 35 bp, Artificial Sequence
  Description of Artificial Sequence: Synthetic oligonucleotide
aacagaaattgataggggaacgggcaagaaaggtg

SEQ ID NO: 281255 - DNA, 34 bp, Artificial Sequence
  Description of Artificial Sequence: Synthetic oligonucleotide
acagaaattgataggggaacgggcaagaaaggtg

SEQ ID NO: 281256 - DNA, 33 bp, Artificial Sequence
  Description of Artificial Sequence: Synthetic oligonucleotide
cagaaattgataggggaacgggcaagaaaggtg

SEQ ID NO: 281257 - DNA, 34 bp, Artificial Sequence
  Description of Artificial Sequence: Synthetic oligonucleotide
agaaattgataggggaacgggcaagaaaggtgag

SEQ ID NO: 281258 - DNA, 33 bp, Artificial Sequence
  Description of Artificial Sequence: Synthetic oligonucleotide
gaaattgataggggaacgggcaagaaaggtgag

SEQ ID NO: 281259 - DNA, 33 bp, Artificial Sequence
  Description of Artificial Sequence: Synthetic oligonucleotide
aaattgataggggaacgggcaagaaaggtgagg

SEQ ID NO: 281260 - DNA, 32 bp, Artificial Sequence
  Description of Artificial Sequence: Synthetic oligonucleotide
aattgataggggaacgggcaagaaaggtgagg

SEQ ID NO: 281261 - DNA, 31 bp, Artificial Sequence
  Description of Artificial Sequence: Synthetic oligonucleotide
attgataggggaacgggcaagaaaggtgagg

SEQ ID NO: 281262 - DNA, 30 bp, Artificial Sequence
  Description of Artificial Sequence: Synthetic oligonucleotide
ttgataggggaacgggcaagaaaggtgagg

SEQ ID NO: 281263 - DNA, 29 bp, Artificial Sequence
  Description of Artificial Sequence: Synthetic oligonucleotide
tgataggggaacgggcaagaaaggtgagg

SEQ ID NO: 281264 - DNA, 28 bp, Artificial Sequence
  Description of Artificial Sequence: Synthetic oligonucleotide
gataggggaacgggcaagaaaggtgagg

SEQ ID NO: 281265 - DNA, 28 bp, Artificial Sequence
  Description of Artificial Sequence: Synthetic oligonucleotide
ataggggaacgggcaagaaaggtgaggg

SEQ ID NO: 281266 - DNA, 27 bp, Artificial Sequence
  Description of Artificial Sequence: Synthetic oligonucleotide
taggggaacgggcaagaaaggtgaggg

SEQ ID NO: 281267 - DNA, 27 bp, Artificial Sequence
  Description of Artificial Sequence: Synthetic oligonucleotide
aggggaacgggcaagaaaggtgaggga

SEQ ID NO: 281268 - DNA, 26 bp, Artificial Sequence
  Description of Artificial Sequence: Synthetic oligonucleotide
ggggaacgggcaagaaaggtgaggga

SEQ ID NO: 281269 - DNA, 26 bp, Artificial Sequence
  Description of Artificial Sequence: Synthetic oligonucleotide
gggaacgggcaagaaaggtgagggac

SEQ ID NO: 281270 - DNA, 27 bp, Artificial Sequence
  Description of Artificial Sequence: Synthetic oligonucleotide
ggaacgggcaagaaaggtgagggacct

SEQ ID NO: 281271 - DNA, 27 bp, Artificial Sequence
  Description of Artificial Sequence: Synthetic oligonucleotide
gaacgggcaagaaaggtgagggacctg

SEQ ID NO: 281272 - DNA, 30 bp, Artificial Sequence
  Description of Artificial Sequence: Synthetic oligonucleotide
aacgggcaagaaaggtgagggacctgtttg

SEQ ID NO: 281273 - DNA, 29 bp, Artificial Sequence
  Description of Artificial Sequence: Synthetic oligonucleotide
acgggcaagaaaggtgagggacctgtttg

SEQ ID NO: 281274 - DNA, 28 bp, Artificial Sequence
  Description of Artificial Sequence: Synthetic oligonucleotide
cgggcaagaaaggtgagggacctgtttg

SEQ ID NO: 281275 - DNA, 29 bp, Artificial Sequence
  Description of Artificial Sequence: Synthetic oligonucleotide
gggcaagaaaggtgagggacctgtttgtc

SEQ ID NO: 281276 - DNA, 31 bp, Artificial Sequence
  Description of Artificial Sequence: Synthetic oligonucleotide
ggcaagaaaggtgagggacctgtttgtcttg

SEQ ID NO: 281277 - DNA, 31 bp, Artificial Sequence
  Description of Artificial Sequence: Synthetic oligonucleotide
gcaagaaaggtgagggacctgtttgtcttgg

SEQ ID NO: 281278 - DNA, 31 bp, Artificial Sequence
  Description of Artificial Sequence: Synthetic oligonucleotide
caagaaaggtgagggacctgtttgtcttggc

SEQ ID NO: 281279 - DNA, 32 bp, Artificial Sequence
  Description of Artificial Sequence: Synthetic oligonucleotide
aagaaaggtgagggacctgtttgtcttggcac

SEQ ID NO: 281280 - DNA, 31 bp, Artificial Sequence
  Description of Artificial Sequence: Synthetic oligonucleotide
agaaaggtgagggacctgtttgtcttggcac

SEQ ID NO: 281281 - DNA, 30 bp, Artificial Sequence
  Description of Artificial Sequence: Synthetic oligonucleotide
gaaaggtgagggacctgtttgtcttggcac

SEQ ID NO: 281282 - DNA, 30 bp, Artificial Sequence
  Description of Artificial Sequence: Synthetic oligonucleotide
aaaggtgagggacctgtttgtcttggcacg

SEQ ID NO: 281283 - DNA, 29 bp, Artificial Sequence
  Description of Artificial Sequence: Synthetic oligonucleotide
aaggtgagggacctgtttgtcttggcacg

SEQ ID NO: 281284 - DNA, 28 bp, Artificial Sequence
  Description of Artificial Sequence: Synthetic oligonucleotide
aggtgagggacctgtttgtcttggcacg

SEQ ID NO: 281285 - DNA, 27 bp, Artificial Sequence
  Description of Artificial Sequence: Synthetic oligonucleotide
ggtgagggacctgtttgtcttggcacg

SEQ ID NO: 281286 - DNA, 27 bp, Artificial Sequence
  Description of Artificial Sequence: Synthetic oligonucleotide
gtgagggacctgtttgtcttggcacgg

SEQ ID NO: 281287 - DNA, 27 bp, Artificial Sequence
  Description of Artificial Sequence: Synthetic oligonucleotide
tgagggacctgtttgtcttggcacggg

SEQ ID NO: 281288 - DNA, 27 bp, Artificial Sequence
  Description of Artificial Sequence: Synthetic oligonucleotide
gagggacctgtttgtcttggcacgggt

SEQ ID NO: 281289 - DNA, 28 bp, Artificial Sequence
  Description of Artificial Sequence: Synthetic oligonucleotide
agggacctgtttgtcttggcacgggtac

SEQ ID NO: 281290 - DNA, 27 bp, Artificial Sequence
  Description of Artificial Sequence: Synthetic oligonucleotide
gggacctgtttgtcttggcacgggtac

SEQ ID NO: 281291 - DNA, 29 bp, Artificial Sequence
  Description of Artificial Sequence: Synthetic oligonucleotide
ggacctgtttgtcttggcacgggtacatg

SEQ ID NO: 281292 - DNA, 29 bp, Artificial Sequence
  Description of Artificial Sequence: Synthetic oligonucleotide
gacctgtttgtcttggcacgggtacatgc

SEQ ID NO: 281293 - DNA, 30 bp, Artificial Sequence
  Description of Artificial Sequence: Synthetic oligonucleotide
acctgtttgtcttggcacgggtacatgctc

SEQ ID NO: 281294 - DNA, 29 bp, Artificial Sequence
  Description of Artificial Sequence: Synthetic oligonucleotide
cctgtttgtcttggcacgggtacatgctc

SEQ ID NO: 281295 - DNA, 29 bp, Artificial Sequence
  Description of Artificial Sequence: Synthetic oligonucleotide
ctgtttgtcttggcacgggtacatgctcc

SEQ ID NO: 281296 - DNA, 31 bp, Artificial Sequence
  Description of Artificial Sequence: Synthetic oligonucleotide
tgtttgtcttggcacgggtacatgctccttc

SEQ ID NO: 281297 - DNA, 30 bp, Artificial Sequence
  Description of Artificial Sequence: Synthetic oligonucleotide
gtttgtcttggcacgggtacatgctccttc

SEQ ID NO: 281298 - DNA, 33 bp, Artificial Sequence
  Description of Artificial Sequence: Synthetic oligonucleotide
tttgtcttggcacgggtacatgctccttctatc

SEQ ID NO: 281299 - DNA, 32 bp, Artificial Sequence
  Description of Artificial Sequence: Synthetic oligonucleotide
ttgtcttggcacgggtacatgctccttctatc

SEQ ID NO: 281300 - DNA, 31 bp, Artificial Sequence
  Description of Artificial Sequence: Synthetic oligonucleotide
tgtcttggcacgggtacatgctccttctatc

SEQ ID NO: 281301 - DNA, 30 bp, Artificial Sequence
  Description of Artificial Sequence: Synthetic oligonucleotide
gtcttggcacgggtacatgctccttctatc

SEQ ID NO: 281302 - DNA, 32 bp, Artificial Sequence
  Description of Artificial Sequence: Synthetic oligonucleotide
tcttggcacgggtacatgctccttctatcatc

SEQ ID NO: 281303 - DNA, 31 bp, Artificial Sequence
  Description of Artificial Sequence: Synthetic oligonucleotide
cttggcacgggtacatgctccttctatcatc

SEQ ID NO: 281304 - DNA, 33 bp, Artificial Sequence
  Description of Artificial Sequence: Synthetic oligonucleotide
ttggcacgggtacatgctccttctatcatcatc

SEQ ID NO: 281305 - DNA, 32 bp, Artificial Sequence
  Description of Artificial Sequence: Synthetic oligonucleotide
tggcacgggtacatgctccttctatcatcatc

SEQ ID NO: 281306 - DNA, 31 bp, Artificial Sequence
  Description of Artificial Sequence: Synthetic oligonucleotide
ggcacgggtacatgctccttctatcatcatc

SEQ ID NO: 281307 - DNA, 33 bp, Artificial Sequence
  Description of Artificial Sequence: Synthetic oligonucleotide
gcacgggtacatgctccttctatcatcatcatg

SEQ ID NO: 281308 - DNA, 33 bp, Artificial Sequence
  Description of Artificial Sequence: Synthetic oligonucleotide
cacgggtacatgctccttctatcatcatcatgg

SEQ ID NO: 281309 - DNA, 34 bp, Artificial Sequence
  Description of Artificial Sequence: Synthetic oligonucleotide
acgggtacatgctccttctatcatcatcatggac

SEQ ID NO: 281310 - DNA, 33 bp, Artificial Sequence
  Description of Artificial Sequence: Synthetic oligonucleotide
cgggtacatgctccttctatcatcatcatggac

SEQ ID NO: 281311 - DNA, 33 bp, Artificial Sequence
  Description of Artificial Sequence: Synthetic oligonucleotide
gggtacatgctccttctatcatcatcatggacg

SEQ ID NO: 281312 - DNA, 37 bp, Artificial Sequence
  Description of Artificial Sequence: Synthetic oligonucleotide
ggtacatgctccttctatcatcatcatggacgtaatc

SEQ ID NO: 281313 - DNA, 37 bp, Artificial Sequence
  Description of Artificial Sequence: Synthetic oligonucleotide
gtacatgctccttctatcatcatcatggacgtaatcg

SEQ ID NO: 281314 - DNA, 38 bp, Artificial Sequence
  Description of Artificial Sequence: Synthetic oligonucleotide
tacatgctccttctatcatcatcatggacgtaatcgac

SEQ ID NO: 281315 - DNA, 37 bp, Artificial Sequence
  Description of Artificial Sequence: Synthetic oligonucleotide
acatgctccttctatcatcatcatggacgtaatcgac

SEQ ID NO: 281316 - DNA, 36 bp, Artificial Sequence
  Description of Artificial Sequence: Synthetic oligonucleotide
catgctccttctatcatcatcatggacgtaatcgac

SEQ ID NO: 281317 - DNA, 37 bp, Artificial Sequence
  Description of Artificial Sequence: Synthetic oligonucleotide
atgctccttctatcatcatcatggacgtaatcgactc

SEQ ID NO: 281318 - DNA, 36 bp, Artificial Sequence
  Description of Artificial Sequence: Synthetic oligonucleotide
tgctccttctatcatcatcatggacgtaatcgactc

SEQ ID NO: 281319 - DNA, 35 bp, Artificial Sequence
  Description of Artificial Sequence: Synthetic oligonucleotide
gctccttctatcatcatcatggacgtaatcgactc

SEQ ID NO: 281320 - DNA, 35 bp, Artificial Sequence
  Description of Artificial Sequence: Synthetic oligonucleotide
ctccttctatcatcatcatggacgtaatcgactcg

SEQ ID NO: 281321 - DNA, 37 bp, Artificial Sequence
  Description of Artificial Sequence: Synthetic oligonucleotide
tccttctatcatcatcatggacgtaatcgactcgatc

SEQ ID NO: 281322 - DNA, 36 bp, Artificial Sequence
  Description of Artificial Sequence: Synthetic oligonucleotide
ccttctatcatcatcatggacgtaatcgactcgatc

SEQ ID NO: 281323 - DNA, 36 bp, Artificial Sequence
  Description of Artificial Sequence: Synthetic oligonucleotide
cttctatcatcatcatggacgtaatcgactcgatcg

SEQ ID NO: 281324 - DNA, 36 bp, Artificial Sequence
  Description of Artificial Sequence: Synthetic oligonucleotide
ttctatcatcatcatggacgtaatcgactcgatcgg

SEQ ID NO: 281325 - DNA, 35 bp, Artificial Sequence
  Description of Artificial Sequence: Synthetic oligonucleotide
tctatcatcatcatggacgtaatcgactcgatcgg

SEQ ID NO: 281326 - DNA, 34 bp, Artificial Sequence
  Description of Artificial Sequence: Synthetic oligonucleotide
ctatcatcatcatggacgtaatcgactcgatcgg

SEQ ID NO: 281327 - DNA, 34 bp, Artificial Sequence
  Description of Artificial Sequence: Synthetic oligonucleotide
tatcatcatcatggacgtaatcgactcgatcggc

SEQ ID NO: 281328 - DNA, 33 bp, Artificial Sequence
  Description of Artificial Sequence: Synthetic oligonucleotide
atcatcatcatggacgtaatcgactcgatcggc

SEQ ID NO: 281329 - DNA, 32 bp, Artificial Sequence
  Description of Artificial Sequence: Synthetic oligonucleotide
tcatcatcatggacgtaatcgactcgatcggc

SEQ ID NO: 281330 - DNA, 31 bp, Artificial Sequence
  Description of Artificial Sequence: Synthetic oligonucleotide
catcatcatggacgtaatcgactcgatcggc

SEQ ID NO: 281331 - DNA, 32 bp, Artificial Sequence
  Description of Artificial Sequence: Synthetic oligonucleotide
atcatcatggacgtaatcgactcgatcggctc

SEQ ID NO: 281332 - DNA, 31 bp, Artificial Sequence
  Description of Artificial Sequence: Synthetic oligonucleotide
tcatcatggacgtaatcgactcgatcggctc

SEQ ID NO: 281333 - DNA, 30 bp, Artificial Sequence
  Description of Artificial Sequence: Synthetic oligonucleotide
catcatggacgtaatcgactcgatcggctc

SEQ ID NO: 281334 - DNA, 30 bp, Artificial Sequence
  Description of Artificial Sequence: Synthetic oligonucleotide
atcatggacgtaatcgactcgatcggctcc

SEQ ID NO: 281335 - DNA, 29 bp, Artificial Sequence
  Description of Artificial Sequence: Synthetic oligonucleotide
tcatggacgtaatcgactcgatcggctcc

SEQ ID NO: 281336 - DNA, 28 bp, Artificial Sequence
  Description of Artificial Sequence: Synthetic oligonucleotide
catggacgtaatcgactcgatcggctcc

SEQ ID NO: 281337 - DNA, 29 bp, Artificial Sequence
  Description of Artificial Sequence: Synthetic oligonucleotide
atggacgtaatcgactcgatcggctccac

SEQ ID NO: 281338 - DNA, 28 bp, Artificial Sequence
  Description of Artificial Sequence: Synthetic oligonucleotide
tggacgtaatcgactcgatcggctccac

SEQ ID NO: 281339 - DNA, 27 bp, Artificial Sequence
  Description of Artificial Sequence: Synthetic oligonucleotide
ggacgtaatcgactcgatcggctccac

SEQ ID NO: 281340 - DNA, 27 bp, Artificial Sequence
  Description of Artificial Sequence: Synthetic oligonucleotide
gacgtaatcgactcgatcggctccacg

SEQ ID NO: 281341 - DNA, 27 bp, Artificial Sequence
  Description of Artificial Sequence: Synthetic oligonucleotide
acgtaatcgactcgatcggctccacgc

SEQ ID NO: 281342 - DNA, 26 bp, Artificial Sequence
  Description of Artificial Sequence: Synthetic oligonucleotide
cgtaatcgactcgatcggctccacgc

SEQ ID NO: 281343 - DNA, 26 bp, Artificial Sequence
  Description of Artificial Sequence: Synthetic oligonucleotide
gtaatcgactcgatcggctccacgcg

SEQ ID NO: 281344 - DNA, 26 bp, Artificial Sequence
  Description of Artificial Sequence: Synthetic oligonucleotide
taatcgactcgatcggctccacgcgg

SEQ ID NO: 281345 - DNA, 25 bp, Artificial Sequence
  Description of Artificial Sequence: Synthetic oligonucleotide
aatcgactcgatcggctccacgcgg

SEQ ID NO: 281346 - DNA, 24 bp, Artificial Sequence
  Description of Artificial Sequence: Synthetic oligonucleotide
atcgactcgatcggctccacgcgg

SEQ ID NO: 281347 - DNA, 23 bp, Artificial Sequence
  Description of Artificial Sequence: Synthetic oligonucleotide
tcgactcgatcggctccacgcgg

SEQ ID NO: 281348 - DNA, 22 bp, Artificial Sequence
  Description of Artificial Sequence: Synthetic oligonucleotide
cgactcgatcggctccacgcgg

SEQ ID NO: 281349 - DNA, 23 bp, Artificial Sequence
  Description of Artificial Sequence: Synthetic oligonucleotide
gactcgatcggctccacgcggct

SEQ ID NO: 281350 - DNA, 23 bp, Artificial Sequence
  Description of Artificial Sequence: Synthetic oligonucleotide
actcgatcggctccacgcggctg

SEQ ID NO: 281351 - DNA, 22 bp, Artificial Sequence
  Description of Artificial Sequence: Synthetic oligonucleotide
ctcgatcggctccacgcggctg

SEQ ID NO: 281352 - DNA, 23 bp, Artificial Sequence
  Description of Artificial Sequence: Synthetic oligonucleotide
tcgatcggctccacgcggctggt

SEQ ID NO: 281353 - DNA, 22 bp, Artificial Sequence
  Description of Artificial Sequence: Synthetic oligonucleotide
cgatcggctccacgcggctggt

SEQ ID NO: 281354 - DNA, 22 bp, Artificial Sequence
  Description of Artificial Sequence: Synthetic oligonucleotide
gatcggctccacgcggctggtg

SEQ ID NO: 281355 - DNA, 22 bp, Artificial Sequence
  Description of Artificial Sequence: Synthetic oligonucleotide
atcggctccacgcggctggtgg

SEQ ID NO: 281356 - DNA, 21 bp, Artificial Sequence
  Description of Artificial Sequence: Synthetic oligonucleotide
tcggctccacgcggctggtgg

SEQ ID NO: 281357 - DNA, 20 bp, Artificial Sequence
  Description of Artificial Sequence: Synthetic oligonucleotide
cggctccacgcggctggtgg

SEQ ID NO: 281358 - DNA, 20 bp, Artificial Sequence
  Description of Artificial Sequence: Synthetic oligonucleotide
ggctccacgcggctggtggg

SEQ ID NO: 281359 - DNA, 20 bp, Artificial Sequence
  Description of Artificial Sequence: Synthetic oligonucleotide
gctccacgcggctggtgggg

SEQ ID NO: 281360 - DNA, 20 bp, Artificial Sequence
  Description of Artificial Sequence: Synthetic oligonucleotide
ctccacgcggctggtggggg

SEQ ID NO: 281361 - DNA, 22 bp, Artificial Sequence
  Description of Artificial Sequence: Synthetic oligonucleotide
tccacgcggctggtggggggtt

SEQ ID NO: 281362 - DNA, 21 bp, Artificial Sequence
  Description of Artificial Sequence: Synthetic oligonucleotide
ccacgcggctggtggggggtt

SEQ ID NO: 281363 - DNA, 22 bp, Artificial Sequence
  Description of Artificial Sequence: Synthetic oligonucleotide
cacgcggctggtggggggttca

SEQ ID NO: 281364 - DNA, 22 bp, Artificial Sequence
  Description of Artificial Sequence: Synthetic oligonucleotide
acgcggctggtggggggttcag

SEQ ID NO: 281365 - DNA, 21 bp, Artificial Sequence
  Description of Artificial Sequence: Synthetic oligonucleotide
cgcggctggtggggggttcag

SEQ ID NO: 281366 - DNA, 22 bp, Artificial Sequence
  Description of Artificial Sequence: Synthetic oligonucleotide
gcggctggtggggggttcagga

SEQ ID NO: 281367 - DNA, 22 bp, Artificial Sequence
  Description of Artificial Sequence: Synthetic oligonucleotide
cggctggtggggggttcaggag

SEQ ID NO: 281368 - DNA, 22 bp, Artificial Sequence
  Description of Artificial Sequence: Synthetic oligonucleotide
ggctggtggggggttcaggagg

SEQ ID NO: 281369 - DNA, 22 bp, Artificial Sequence
  Description of Artificial Sequence: Synthetic oligonucleotide
gctggtggggggttcaggaggg

SEQ ID NO: 281370 - DNA, 23 bp, Artificial Sequence
  Description of Artificial Sequence: Synthetic oligonucleotide
ctggtggggggttcaggagggga

SEQ ID NO: 281371 - DNA, 24 bp, Artificial Sequence
  Description of Artificial Sequence: Synthetic oligonucleotide
tggtggggggttcaggaggggact

SEQ ID NO: 281372 - DNA, 23 bp, Artificial Sequence
  Description of Artificial Sequence: Synthetic oligonucleotide
ggtggggggttcaggaggggact

SEQ ID NO: 281373 - DNA, 24 bp, Artificial Sequence
  Description of Artificial Sequence: Synthetic oligonucleotide
gtggggggttcaggaggggactgt

SEQ ID NO: 281374 - DNA, 26 bp, Artificial Sequence
  Description of Artificial Sequence: Synthetic oligonucleotide
tggggggttcaggaggggactgtgaa

SEQ ID NO: 281375 - DNA, 25 bp, Artificial Sequence
  Description of Artificial Sequence: Synthetic oligonucleotide
ggggggttcaggaggggactgtgaa

SEQ ID NO: 281376 - DNA, 26 bp, Artificial Sequence
  Description of Artificial Sequence: Synthetic oligonucleotide
gggggttcaggaggggactgtgaagt

SEQ ID NO: 281377 - DNA, 26 bp, Artificial Sequence
  Description of Artificial Sequence: Synthetic oligonucleotide
ggggttcaggaggggactgtgaagtg

SEQ ID NO: 281378 - DNA, 27 bp, Artificial Sequence
  Description of Artificial Sequence: Synthetic oligonucleotide
gggttcaggaggggactgtgaagtgct

SEQ ID NO: 281379 - DNA, 27 bp, Artificial Sequence
  Description of Artificial Sequence: Synthetic oligonucleotide
ggttcaggaggggactgtgaagtgctg

SEQ ID NO: 281380 - DNA, 27 bp, Artificial Sequence
  Description of Artificial Sequence: Synthetic oligonucleotide
gttcaggaggggactgtgaagtgctgc

SEQ ID NO: 281381 - DNA, 27 bp, Artificial Sequence
  Description of Artificial Sequence: Synthetic oligonucleotide
ttcaggaggggactgtgaagtgctgcg

SEQ ID NO: 281382 - DNA, 26 bp, Artificial Sequence
  Description of Artificial Sequence: Synthetic oligonucleotide
tcaggaggggactgtgaagtgctgcg

SEQ ID NO: 281383 - DNA, 25 bp, Artificial Sequence
  Description of Artificial Sequence: Synthetic oligonucleotide
caggaggggactgtgaagtgctgcg

SEQ ID NO: 281384 - DNA, 26 bp, Artificial Sequence
  Description of Artificial Sequence: Synthetic oligonucleotide
aggaggggactgtgaagtgctgcgca

SEQ ID NO: 281385 - DNA, 25 bp, Artificial Sequence
  Description of Artificial Sequence: Synthetic oligonucleotide
ggaggggactgtgaagtgctgcgca

SEQ ID NO: 281386 - DNA, 25 bp, Artificial Sequence
  Description of Artificial Sequence: Synthetic oligonucleotide
gaggggactgtgaagtgctgcgcac

SEQ ID NO: 281387 - DNA, 27 bp, Artificial Sequence
  Description of Artificial Sequence: Synthetic oligonucleotide
aggggactgtgaagtgctgcgcacgat

SEQ ID NO: 281388 - DNA, 26 bp, Artificial Sequence
  Description of Artificial Sequence: Synthetic oligonucleotide
ggggactgtgaagtgctgcgcacgat

SEQ ID NO: 281389 - DNA, 26 bp, Artificial Sequence
  Description of Artificial Sequence: Synthetic oligonucleotide
gggactgtgaagtgctgcgcacgatc

SEQ ID NO: 281390 - DNA, 27 bp, Artificial Sequence
  Description of Artificial Sequence: Synthetic oligonucleotide
ggactgtgaagtgctgcgcacgatcct

SEQ ID NO: 281391 - DNA, 27 bp, Artificial Sequence
  Description of Artificial Sequence: Synthetic oligonucleotide
gactgtgaagtgctgcgcacgatcctg

SEQ ID NO: 281392 - DNA, 27 bp, Artificial Sequence
  Description of Artificial Sequence: Synthetic oligonucleotide
actgtgaagtgctgcgcacgatcctgg

SEQ ID NO: 281393 - DNA, 27 bp, Artificial Sequence
  Description of Artificial Sequence: Synthetic oligonucleotide
ctgtgaagtgctgcgcacgatcctgga

SEQ ID NO: 281394 - DNA, 27 bp, Artificial Sequence
  Description of Artificial Sequence: Synthetic oligonucleotide
tgtgaagtgctgcgcacgatcctggag

SEQ ID NO: 281395 - DNA, 27 bp, Artificial Sequence
  Description of Artificial Sequence: Synthetic oligonucleotide
gtgaagtgctgcgcacgatcctggagt

SEQ ID NO: 281396 - DNA, 28 bp, Artificial Sequence
  Description of Artificial Sequence: Synthetic oligonucleotide
tgaagtgctgcgcacgatcctggagttg

SEQ ID NO: 281397 - DNA, 27 bp, Artificial Sequence
  Description of Artificial Sequence: Synthetic oligonucleotide
gaagtgctgcgcacgatcctggagttg

SEQ ID NO: 281398 - DNA, 27 bp, Artificial Sequence
  Description of Artificial Sequence: Synthetic oligonucleotide
aagtgctgcgcacgatcctggagttgg

SEQ ID NO: 281399 - DNA, 27 bp, Artificial Sequence
  Description of Artificial Sequence: Synthetic oligonucleotide
agtgctgcgcacgatcctggagttggt

SEQ ID NO: 281400 - DNA, 26 bp, Artificial Sequence
  Description of Artificial Sequence: Synthetic oligonucleotide
gtgctgcgcacgatcctggagttggt

SEQ ID NO: 281401 - DNA, 27 bp, Artificial Sequence
  Description of Artificial Sequence: Synthetic oligonucleotide
tgctgcgcacgatcctggagttggtca

SEQ ID NO: 281402 - DNA, 27 bp, Artificial Sequence
  Description of Artificial Sequence: Synthetic oligonucleotide
gctgcgcacgatcctggagttggtcaa

SEQ ID NO: 281403 - DNA, 27 bp, Artificial Sequence
  Description of Artificial Sequence: Synthetic oligonucleotide
ctgcgcacgatcctggagttggtcaac

SEQ ID NO: 281404 - DNA, 27 bp, Artificial Sequence
  Description of Artificial Sequence: Synthetic oligonucleotide
tgcgcacgatcctggagttggtcaacc

SEQ ID NO: 281405 - DNA, 27 bp, Artificial Sequence
  Description of Artificial Sequence: Synthetic oligonucleotide
gcgcacgatcctggagttggtcaacca

SEQ ID NO: 281406 - DNA, 27 bp, Artificial Sequence
  Description of Artificial Sequence: Synthetic oligonucleotide
cgcacgatcctggagttggtcaaccag

SEQ ID NO: 281407 - DNA, 27 bp, Artificial Sequence
  Description of Artificial Sequence: Synthetic oligonucleotide
gcacgatcctggagttggtcaaccagc

SEQ ID NO: 281408 - DNA, 28 bp, Artificial Sequence
  Description of Artificial Sequence: Synthetic oligonucleotide
cacgatcctggagttggtcaaccagcac

SEQ ID NO: 281409 - DNA, 28 bp, Artificial Sequence
  Description of Artificial Sequence: Synthetic oligonucleotide
acgatcctggagttggtcaaccagcacg

SEQ ID NO: 281410 - DNA, 27 bp, Artificial Sequence
  Description of Artificial Sequence: Synthetic oligonucleotide
cgatcctggagttggtcaaccagcacg

SEQ ID NO: 281411 - DNA, 28 bp, Artificial Sequence
  Description of Artificial Sequence: Synthetic oligonucleotide
gatcctggagttggtcaaccagcacgac

SEQ ID NO: 281412 - DNA, 28 bp, Artificial Sequence
  Description of Artificial Sequence: Synthetic oligonucleotide
atcctggagttggtcaaccagcacgacg

SEQ ID NO: 281413 - DNA, 27 bp, Artificial Sequence
  Description of Artificial Sequence: Synthetic oligonucleotide
tcctggagttggtcaaccagcacgacg

SEQ ID NO: 281414 - DNA, 26 bp, Artificial Sequence
  Description of Artificial Sequence: Synthetic oligonucleotide
cctggagttggtcaaccagcacgacg

SEQ ID NO: 281415 - DNA, 26 bp, Artificial Sequence
  Description of Artificial Sequence: Synthetic oligonucleotide
ctggagttggtcaaccagcacgacgg

SEQ ID NO: 281416 - DNA, 27 bp, Artificial Sequence
  Description of Artificial Sequence: Synthetic oligonucleotide
tggagttggtcaaccagcacgacggct

SEQ ID NO: 281417 - DNA, 27 bp, Artificial Sequence
  Description of Artificial Sequence: Synthetic oligonucleotide
ggagttggtcaaccagcacgacggctt

SEQ ID NO: 281418 - DNA, 28 bp, Artificial Sequence
  Description of Artificial Sequence: Synthetic oligonucleotide
gagttggtcaaccagcacgacggcttag

SEQ ID NO: 281419 - DNA, 29 bp, Artificial Sequence
  Description of Artificial Sequence: Synthetic oligonucleotide
agttggtcaaccagcacgacggcttagag

SEQ ID NO: 281420 - DNA, 28 bp, Artificial Sequence
  Description of Artificial Sequence: Synthetic oligonucleotide
gttggtcaaccagcacgacggcttagag

SEQ ID NO: 281421 - DNA, 28 bp, Artificial Sequence
  Description of Artificial Sequence: Synthetic oligonucleotide
ttggtcaaccagcacgacggcttagagg

SEQ ID NO: 281422 - DNA, 27 bp, Artificial Sequence
  Description of Artificial Sequence: Synthetic oligonucleotide
tggtcaaccagcacgacggcttagagg

SEQ ID NO: 281423 - DNA, 26 bp, Artificial Sequence
  Description of Artificial Sequence: Synthetic oligonucleotide
ggtcaaccagcacgacggcttagagg

SEQ ID NO: 281424 - DNA, 26 bp, Artificial Sequence
  Description of Artificial Sequence: Synthetic oligonucleotide
gtcaaccagcacgacggcttagaggc

SEQ ID NO: 281425 - DNA, 27 bp, Artificial Sequence
  Description of Artificial Sequence: Synthetic oligonucleotide
tcaaccagcacgacggcttagaggcca

SEQ ID NO: 281426 - DNA, 26 bp, Artificial Sequence
  Description of Artificial Sequence: Synthetic oligonucleotide
caaccagcacgacggcttagaggcca

SEQ ID NO: 281427 - DNA, 26 bp, Artificial Sequence
  Description of Artificial Sequence: Synthetic oligonucleotide
aaccagcacgacggcttagaggccac

SEQ ID NO: 281428 - DNA, 25 bp, Artificial Sequence
  Description of Artificial Sequence: Synthetic oligonucleotide
accagcacgacggcttagaggccac

SEQ ID NO: 281429 - DNA, 24 bp, Artificial Sequence
  Description of Artificial Sequence: Synthetic oligonucleotide
ccagcacgacggcttagaggccac

SEQ ID NO: 281430 - DNA, 26 bp, Artificial Sequence
  Description of Artificial Sequence: Synthetic oligonucleotide
cagcacgacggcttagaggccaccta

SEQ ID NO: 281431 - DNA, 27 bp, Artificial Sequence
  Description of Artificial Sequence: Synthetic oligonucleotide
agcacgacggcttagaggccacctaga

SEQ ID NO: 281432 - DNA, 27 bp, Artificial Sequence
  Description of Artificial Sequence: Synthetic oligonucleotide
gcacgacggcttagaggccacctagaa

SEQ ID NO: 281433 - DNA, 27 bp, Artificial Sequence
  Description of Artificial Sequence: Synthetic oligonucleotide
cacgacggcttagaggccacctagaac

SEQ ID NO: 281434 - DNA, 29 bp, Artificial Sequence
  Description of Artificial Sequence: Synthetic oligonucleotide
acgacggcttagaggccacctagaacatc

SEQ ID NO: 281435 - DNA, 28 bp, Artificial Sequence
  Description of Artificial Sequence: Synthetic oligonucleotide
cgacggcttagaggccacctagaacatc

SEQ ID NO: 281436 - DNA, 30 bp, Artificial Sequence
  Description of Artificial Sequence: Synthetic oligonucleotide
gacggcttagaggccacctagaacatcatg

SEQ ID NO: 281437 - DNA, 30 bp, Artificial Sequence
  Description of Artificial Sequence: Synthetic oligonucleotide
acggcttagaggccacctagaacatcatgg

SEQ ID NO: 281438 - DNA, 29 bp, Artificial Sequence
  Description of Artificial Sequence: Synthetic oligonucleotide
cggcttagaggccacctagaacatcatgg

SEQ ID NO: 281439 - DNA, 33 bp, Artificial Sequence
  Description of Artificial Sequence: Synthetic oligonucleotide
ggcttagaggccacctagaacatcatggttatc

SEQ ID NO: 281440 - DNA, 35 bp, Artificial Sequence
  Description of Artificial Sequence: Synthetic oligonucleotide
gcttagaggccacctagaacatcatggttatcatc

SEQ ID NO: 281441 - DNA, 35 bp, Artificial Sequence
  Description of Artificial Sequence: Synthetic oligonucleotide
cttagaggccacctagaacatcatggttatcatcg

SEQ ID NO: 281442 - DNA, 35 bp, Artificial Sequence
  Description of Artificial Sequence: Synthetic oligonucleotide
ttagaggccacctagaacatcatggttatcatcgc

SEQ ID NO: 281443 - DNA, 34 bp, Artificial Sequence
  Description of Artificial Sequence: Synthetic oligonucleotide
tagaggccacctagaacatcatggttatcatcgc

SEQ ID NO: 281444 - DNA, 33 bp, Artificial Sequence
  Description of Artificial Sequence: Synthetic oligonucleotide
agaggccacctagaacatcatggttatcatcgc

SEQ ID NO: 281445 - DNA, 32 bp, Artificial Sequence
  Description of Artificial Sequence: Synthetic oligonucleotide
gaggccacctagaacatcatggttatcatcgc

SEQ ID NO: 281446 - DNA, 34 bp, Artificial Sequence
  Description of Artificial Sequence: Synthetic oligonucleotide
aggccacctagaacatcatggttatcatcgctac

SEQ ID NO: 281447 - DNA, 33 bp, Artificial Sequence
  Description of Artificial Sequence: Synthetic oligonucleotide
ggccacctagaacatcatggttatcatcgctac

SEQ ID NO: 281448 - DNA, 38 bp, Artificial Sequence
  Description of Artificial Sequence: Synthetic oligonucleotide
gccacctagaacatcatggttatcatcgctactaattg

SEQ ID NO: 281449 - DNA, 38 bp, Artificial Sequence
  Description of Artificial Sequence: Synthetic oligonucleotide
ccacctagaacatcatggttatcatcgctactaattgg

SEQ ID NO: 281450 - DNA, 41 bp, Artificial Sequence
  Description of Artificial Sequence: Synthetic oligonucleotide
cacctagaacatcatggttatcatcgctactaattggattg

SEQ ID NO: 281451 - DNA, 45 bp, Artificial Sequence
  Description of Artificial Sequence: Synthetic oligonucleotide
acctagaacatcatggttatcatcgctactaattggattgataac

SEQ ID NO: 281452 - DNA, 44 bp, Artificial Sequence
  Description of Artificial Sequence: Synthetic oligonucleotide
cctagaacatcatggttatcatcgctactaattggattgataac

SEQ ID NO: 281453 - DNA, 44 bp, Artificial Sequence
  Description of Artificial Sequence: Synthetic oligonucleotide
ctagaacatcatggttatcatcgctactaattggattgataacc

SEQ ID NO: 281454 - DNA, 45 bp, Artificial Sequence
  Description of Artificial Sequence: Synthetic oligonucleotide
tagaacatcatggttatcatcgctactaattggattgataacctg

SEQ ID NO: 281455 - DNA, 44 bp, Artificial Sequence
  Description of Artificial Sequence: Synthetic oligonucleotide
agaacatcatggttatcatcgctactaattggattgataacctg

SEQ ID NO: 281456 - DNA, 43 bp, Artificial Sequence
  Description of Artificial Sequence: Synthetic oligonucleotide
gaacatcatggttatcatcgctactaattggattgataacctg

SEQ ID NO: 281457 - DNA, 43 bp, Artificial Sequence
  Description of Artificial Sequence: Synthetic oligonucleotide
aacatcatggttatcatcgctactaattggattgataacctgg

SEQ ID NO: 281458 - DNA, 42 bp, Artificial Sequence
  Description of Artificial Sequence: Synthetic oligonucleotide
acatcatggttatcatcgctactaattggattgataacctgg

SEQ ID NO: 281459 - DNA, 41 bp, Artificial Sequence
  Description of Artificial Sequence: Synthetic oligonucleotide
catcatggttatcatcgctactaattggattgataacctgg

SEQ ID NO: 281460 - DNA, 42 bp, Artificial Sequence
  Description of Artificial Sequence: Synthetic oligonucleotide
atcatggttatcatcgctactaattggattgataacctggac

SEQ ID NO: 281461 - DNA, 41 bp, Artificial Sequence
  Description of Artificial Sequence: Synthetic oligonucleotide
tcatggttatcatcgctactaattggattgataacctggac

SEQ ID NO: 281462 - DNA, 40 bp, Artificial Sequence
  Description of Artificial Sequence: Synthetic oligonucleotide
catggttatcatcgctactaattggattgataacctggac

SEQ ID NO: 281463 - DNA, 41 bp, Artificial Sequence
  Description of Artificial Sequence: Synthetic oligonucleotide
atggttatcatcgctactaattggattgataacctggactc

SEQ ID NO: 281464 - DNA, 40 bp, Artificial Sequence
  Description of Artificial Sequence: Synthetic oligonucleotide
tggttatcatcgctactaattggattgataacctggactc

SEQ ID NO: 281465 - DNA, 39 bp, Artificial Sequence
  Description of Artificial Sequence: Synthetic oligonucleotide
ggttatcatcgctactaattggattgataacctggactc

SEQ ID NO: 281466 - DNA, 39 bp, Artificial Sequence
  Description of Artificial Sequence: Synthetic oligonucleotide
gttatcatcgctactaattggattgataacctggactcc

SEQ ID NO: 281467 - DNA, 39 bp, Artificial Sequence
  Description of Artificial Sequence: Synthetic oligonucleotide
ttatcatcgctactaattggattgataacctggactccg

SEQ ID NO: 281468 - DNA, 38 bp, Artificial Sequence
  Description of Artificial Sequence: Synthetic oligonucleotide
tatcatcgctactaattggattgataacctggactccg

SEQ ID NO: 281469 - DNA, 37 bp, Artificial Sequence
  Description of Artificial Sequence: Synthetic oligonucleotide
atcatcgctactaattggattgataacctggactccg

SEQ ID NO: 281470 - DNA, 36 bp, Artificial Sequence
  Description of Artificial Sequence: Synthetic oligonucleotide
tcatcgctactaattggattgataacctggactccg

SEQ ID NO: 281471 - DNA, 35 bp, Artificial Sequence
  Description of Artificial Sequence: Synthetic oligonucleotide
catcgctactaattggattgataacctggactccg

SEQ ID NO: 281472 - DNA, 35 bp, Artificial Sequence
  Description of Artificial Sequence: Synthetic oligonucleotide
atcgctactaattggattgataacctggactccgc

SEQ ID NO: 281473 - DNA, 34 bp, Artificial Sequence
  Description of Artificial Sequence: Synthetic oligonucleotide
tcgctactaattggattgataacctggactccgc

SEQ ID NO: 281474 - DNA, 33 bp, Artificial Sequence
  Description of Artificial Sequence: Synthetic oligonucleotide
cgctactaattggattgataacctggactccgc

SEQ ID NO: 281475 - DNA, 34 bp, Artificial Sequence
  Description of Artificial Sequence: Synthetic oligonucleotide
gctactaattggattgataacctggactccgcac

SEQ ID NO: 281476 - DNA, 35 bp, Artificial Sequence
  Description of Artificial Sequence: Synthetic oligonucleotide
ctactaattggattgataacctggactccgcactg

SEQ ID NO: 281477 - DNA, 35 bp, Artificial Sequence
  Description of Artificial Sequence: Synthetic oligonucleotide
tactaattggattgataacctggactccgcactgc

SEQ ID NO: 281478 - DNA, 34 bp, Artificial Sequence
  Description of Artificial Sequence: Synthetic oligonucleotide
actaattggattgataacctggactccgcactgc

SEQ ID NO: 281479 - DNA, 33 bp, Artificial Sequence
  Description of Artificial Sequence: Synthetic oligonucleotide
ctaattggattgataacctggactccgcactgc

SEQ ID NO: 281480 - DNA, 35 bp, Artificial Sequence
  Description of Artificial Sequence: Synthetic oligonucleotide
taattggattgataacctggactccgcactgcttg

SEQ ID NO: 281481 - DNA, 34 bp, Artificial Sequence
  Description of Artificial Sequence: Synthetic oligonucleotide
aattggattgataacctggactccgcactgcttg

SEQ ID NO: 281482 - DNA, 33 bp, Artificial Sequence
  Description of Artificial Sequence: Synthetic oligonucleotide
attggattgataacctggactccgcactgcttg

SEQ ID NO: 281483 - DNA, 32 bp, Artificial Sequence
  Description of Artificial Sequence: Synthetic oligonucleotide
ttggattgataacctggactccgcactgcttg

SEQ ID NO: 281484 - DNA, 31 bp, Artificial Sequence
  Description of Artificial Sequence: Synthetic oligonucleotide
tggattgataacctggactccgcactgcttg

SEQ ID NO: 281485 - DNA, 30 bp, Artificial Sequence
  Description of Artificial Sequence: Synthetic oligonucleotide
ggattgataacctggactccgcactgcttg

SEQ ID NO: 281486 - DNA, 30 bp, Artificial Sequence
  Description of Artificial Sequence: Synthetic oligonucleotide
gattgataacctggactccgcactgcttgg

SEQ ID NO: 281487 - DNA, 30 bp, Artificial Sequence
  Description of Artificial Sequence: Synthetic oligonucleotide
attgataacctggactccgcactgcttggc

SEQ ID NO: 281488 - DNA, 29 bp, Artificial Sequence
  Description of Artificial Sequence: Synthetic oligonucleotide
ttgataacctggactccgcactgcttggc

SEQ ID NO: 281489 - DNA, 28 bp, Artificial Sequence
  Description of Artificial Sequence: Synthetic oligonucleotide
tgataacctggactccgcactgcttggc

SEQ ID NO: 281490 - DNA, 27 bp, Artificial Sequence
  Description of Artificial Sequence: Synthetic oligonucleotide
gataacctggactccgcactgcttggc

SEQ ID NO: 281491 - DNA, 27 bp, Artificial Sequence
  Description of Artificial Sequence: Synthetic oligonucleotide
ataacctggactccgcactgcttggcc

SEQ ID NO: 281492 - DNA, 26 bp, Artificial Sequence
  Description of Artificial Sequence: Synthetic oligonucleotide
taacctggactccgcactgcttggcc

SEQ ID NO: 281493 - DNA, 25 bp, Artificial Sequence
  Description of Artificial Sequence: Synthetic oligonucleotide
aacctggactccgcactgcttggcc

SEQ ID NO: 281494 - DNA, 24 bp, Artificial Sequence
  Description of Artificial Sequence: Synthetic oligonucleotide
acctggactccgcactgcttggcc

SEQ ID NO: 281495 - DNA, 23 bp, Artificial Sequence
  Description of Artificial Sequence: Synthetic oligonucleotide
cctggactccgcactgcttggcc

SEQ ID NO: 281496 - DNA, 24 bp, Artificial Sequence
  Description of Artificial Sequence: Synthetic oligonucleotide
ctggactccgcactgcttggccca

SEQ ID NO: 281497 - DNA, 24 bp, Artificial Sequence
  Description of Artificial Sequence: Synthetic oligonucleotide
tggactccgcactgcttggcccag

SEQ ID NO: 281498 - DNA, 23 bp, Artificial Sequence
  Description of Artificial Sequence: Synthetic oligonucleotide
ggactccgcactgcttggcccag

SEQ ID NO: 281499 - DNA, 23 bp, Artificial Sequence
  Description of Artificial Sequence: Synthetic oligonucleotide
gactccgcactgcttggcccagg

SEQ ID NO: 281500 - DNA, 23 bp, Artificial Sequence
  Description of Artificial Sequence: Synthetic oligonucleotide
actccgcactgcttggcccaggg

SEQ ID NO: 281501 - DNA, 22 bp, Artificial Sequence
  Description of Artificial Sequence: Synthetic oligonucleotide
ctccgcactgcttggcccaggg

SEQ ID NO: 281502 - DNA, 22 bp, Artificial Sequence
  Description of Artificial Sequence: Synthetic oligonucleotide
tccgcactgcttggcccagggc

SEQ ID NO: 281503 - DNA, 21 bp, Artificial Sequence
  Description of Artificial Sequence: Synthetic oligonucleotide
ccgcactgcttggcccagggc

SEQ ID NO: 281504 - DNA, 21 bp, Artificial Sequence
  Description of Artificial Sequence: Synthetic oligonucleotide
cgcactgcttggcccagggcc

SEQ ID NO: 281505 - DNA, 24 bp, Artificial Sequence
  Description of Artificial Sequence: Synthetic oligonucleotide
gcactgcttggcccagggcccatt

SEQ ID NO: 281506 - DNA, 25 bp, Artificial Sequence
  Description of Artificial Sequence: Synthetic oligonucleotide
cactgcttggcccagggcccattga

SEQ ID NO: 281507 - DNA, 26 bp, Artificial Sequence
  Description of Artificial Sequence: Synthetic oligonucleotide
actgcttggcccagggcccattgaca

SEQ ID NO: 281508 - DNA, 25 bp, Artificial Sequence
  Description of Artificial Sequence: Synthetic oligonucleotide
ctgcttggcccagggcccattgaca

SEQ ID NO: 281509 - DNA, 27 bp, Artificial Sequence
  Description of Artificial Sequence: Synthetic oligonucleotide
tgcttggcccagggcccattgacagta

SEQ ID NO: 281510 - DNA, 27 bp, Artificial Sequence
  Description of Artificial Sequence: Synthetic oligonucleotide
gcttggcccagggcccattgacagtaa

SEQ ID NO: 281511 - DNA, 31 bp, Artificial Sequence
  Description of Artificial Sequence: Synthetic oligonucleotide
cttggcccagggcccattgacagtaaaattg

SEQ ID NO: 281512 - DNA, 35 bp, Artificial Sequence
  Description of Artificial Sequence: Synthetic oligonucleotide
ttggcccagggcccattgacagtaaaattgaaatc

SEQ ID NO: 281513 - DNA, 34 bp, Artificial Sequence
  Description of Artificial Sequence: Synthetic oligonucleotide
tggcccagggcccattgacagtaaaattgaaatc

SEQ ID NO: 281514 - DNA, 33 bp, Artificial Sequence
  Description of Artificial Sequence: Synthetic oligonucleotide
ggcccagggcccattgacagtaaaattgaaatc

SEQ ID NO: 281515 - DNA, 33 bp, Artificial Sequence
  Description of Artificial Sequence: Synthetic oligonucleotide
gcccagggcccattgacagtaaaattgaaatcc

SEQ ID NO: 281516 - DNA, 33 bp, Artificial Sequence
  Description of Artificial Sequence: Synthetic oligonucleotide
cccagggcccattgacagtaaaattgaaatccc

SEQ ID NO: 281517 - DNA, 34 bp, Artificial Sequence
  Description of Artificial Sequence: Synthetic oligonucleotide
ccagggcccattgacagtaaaattgaaatcccac

SEQ ID NO: 281518 - DNA, 34 bp, Artificial Sequence
  Description of Artificial Sequence: Synthetic oligonucleotide
cagggcccattgacagtaaaattgaaatcccacc

SEQ ID NO: 281519 - DNA, 34 bp, Artificial Sequence
  Description of Artificial Sequence: Synthetic oligonucleotide
agggcccattgacagtaaaattgaaatcccaccc

SEQ ID NO: 281520 - DNA, 33 bp, Artificial Sequence
  Description of Artificial Sequence: Synthetic oligonucleotide
gggcccattgacagtaaaattgaaatcccaccc

SEQ ID NO: 281521 - DNA, 33 bp, Artificial Sequence
  Description of Artificial Sequence: Synthetic oligonucleotide
ggcccattgacagtaaaattgaaatcccacccc

SEQ ID NO: 281522 - DNA, 33 bp, Artificial Sequence
  Description of Artificial Sequence: Synthetic oligonucleotide
gcccattgacagtaaaattgaaatcccaccccg

SEQ ID NO: 281523 - DNA, 33 bp, Artificial Sequence
  Description of Artificial Sequence: Synthetic oligonucleotide
cccattgacagtaaaattgaaatcccaccccgc

SEQ ID NO: 281524 - DNA, 36 bp, Artificial Sequence
  Description of Artificial Sequence: Synthetic oligonucleotide
ccattgacagtaaaattgaaatcccaccccgcaatg

SEQ ID NO: 281525 - DNA, 37 bp, Artificial Sequence
  Description of Artificial Sequence: Synthetic oligonucleotide
cattgacagtaaaattgaaatcccaccccgcaatgag

SEQ ID NO: 281526 - DNA, 37 bp, Artificial Sequence
  Description of Artificial Sequence: Synthetic oligonucleotide
attgacagtaaaattgaaatcccaccccgcaatgagg

SEQ ID NO: 281527 - DNA, 36 bp, Artificial Sequence
  Description of Artificial Sequence: Synthetic oligonucleotide
ttgacagtaaaattgaaatcccaccccgcaatgagg

SEQ ID NO: 281528 - DNA, 35 bp, Artificial Sequence
  Description of Artificial Sequence: Synthetic oligonucleotide
tgacagtaaaattgaaatcccaccccgcaatgagg

SEQ ID NO: 281529 - DNA, 34 bp, Artificial Sequence
  Description of Artificial Sequence: Synthetic oligonucleotide
gacagtaaaattgaaatcccaccccgcaatgagg

SEQ ID NO: 281530 - DNA, 35 bp, Artificial Sequence
  Description of Artificial Sequence: Synthetic oligonucleotide
acagtaaaattgaaatcccaccccgcaatgaggac

SEQ ID NO: 281531 - DNA, 34 bp, Artificial Sequence
  Description of Artificial Sequence: Synthetic oligonucleotide
cagtaaaattgaaatcccaccccgcaatgaggac

SEQ ID NO: 281532 - DNA, 34 bp, Artificial Sequence
  Description of Artificial Sequence: Synthetic oligonucleotide
agtaaaattgaaatcccaccccgcaatgaggacg

SEQ ID NO: 281533 - DNA, 33 bp, Artificial Sequence
  Description of Artificial Sequence: Synthetic oligonucleotide
gtaaaattgaaatcccaccccgcaatgaggacg

SEQ ID NO: 281534 - DNA, 33 bp, Artificial Sequence
  Description of Artificial Sequence: Synthetic oligonucleotide
taaaattgaaatcccaccccgcaatgaggacgc

SEQ ID NO: 281535 - DNA, 32 bp, Artificial Sequence
  Description of Artificial Sequence: Synthetic oligonucleotide
aaaattgaaatcccaccccgcaatgaggacgc

SEQ ID NO: 281536 - DNA, 31 bp, Artificial Sequence
  Description of Artificial Sequence: Synthetic oligonucleotide
aaattgaaatcccaccccgcaatgaggacgc

SEQ ID NO: 281537 - DNA, 30 bp, Artificial Sequence
  Description of Artificial Sequence: Synthetic oligonucleotide
aattgaaatcccaccccgcaatgaggacgc

SEQ ID NO: 281538 - DNA, 29 bp, Artificial Sequence
  Description of Artificial Sequence: Synthetic oligonucleotide
attgaaatcccaccccgcaatgaggacgc

SEQ ID NO: 281539 - DNA, 28 bp, Artificial Sequence
  Description of Artificial Sequence: Synthetic oligonucleotide
ttgaaatcccaccccgcaatgaggacgc

SEQ ID NO: 281540 - DNA, 27 bp, Artificial Sequence
  Description of Artificial Sequence: Synthetic oligonucleotide
tgaaatcccaccccgcaatgaggacgc

SEQ ID NO: 281541 - DNA, 26 bp, Artificial Sequence
  Description of Artificial Sequence: Synthetic oligonucleotide
gaaatcccaccccgcaatgaggacgc

SEQ ID NO: 281542 - DNA, 26 bp, Artificial Sequence
  Description of Artificial Sequence: Synthetic oligonucleotide
aaatcccaccccgcaatgaggacgcc

SEQ ID NO: 281543 - DNA, 25 bp, Artificial Sequence
  Description of Artificial Sequence: Synthetic oligonucleotide
aatcccaccccgcaatgaggacgcc

SEQ ID NO: 281544 - DNA, 24 bp, Artificial Sequence
  Description of Artificial Sequence: Synthetic oligonucleotide
atcccaccccgcaatgaggacgcc

SEQ ID NO: 281545 - DNA, 23 bp, Artificial Sequence
  Description of Artificial Sequence: Synthetic oligonucleotide
tcccaccccgcaatgaggacgcc

SEQ ID NO: 281546 - DNA, 22 bp, Artificial Sequence
  Description of Artificial Sequence: Synthetic oligonucleotide
cccaccccgcaatgaggacgcc

SEQ ID NO: 281547 - DNA, 22 bp, Artificial Sequence
  Description of Artificial Sequence: Synthetic oligonucleotide
ccaccccgcaatgaggacgccc

SEQ ID NO: 281548 - DNA, 22 bp, Artificial Sequence
  Description of Artificial Sequence: Synthetic oligonucleotide
caccccgcaatgaggacgcccg

SEQ ID NO: 281549 - DNA, 22 bp, Artificial Sequence
  Description of Artificial Sequence: Synthetic oligonucleotide
accccgcaatgaggacgcccgg

SEQ ID NO: 281550 - DNA, 21 bp, Artificial Sequence
  Description of Artificial Sequence: Synthetic oligonucleotide
ccccgcaatgaggacgcccgg

SEQ ID NO: 281551 - DNA, 22 bp, Artificial Sequence
  Description of Artificial Sequence: Synthetic oligonucleotide
cccgcaatgaggacgcccggct

SEQ ID NO: 281552 - DNA, 22 bp, Artificial Sequence
  Description of Artificial Sequence: Synthetic oligonucleotide
ccgcaatgaggacgcccggctg

SEQ ID NO: 281553 - DNA, 23 bp, Artificial Sequence
  Description of Artificial Sequence: Synthetic oligonucleotide
cgcaatgaggacgcccggctgca

SEQ ID NO: 281554 - DNA, 27 bp, Artificial Sequence
  Description of Artificial Sequence: Synthetic oligonucleotide
gcaatgaggacgcccggctgcacattt

SEQ ID NO: 281555 - DNA, 28 bp, Artificial Sequence
  Description of Artificial Sequence: Synthetic oligonucleotide
caatgaggacgcccggctgcacattttg

SEQ ID NO: 281556 - DNA, 30 bp, Artificial Sequence
  Description of Artificial Sequence: Synthetic oligonucleotide
aatgaggacgcccggctgcacattttgatg

SEQ ID NO: 281557 - DNA, 29 bp, Artificial Sequence
  Description of Artificial Sequence: Synthetic oligonucleotide
atgaggacgcccggctgcacattttgatg

SEQ ID NO: 281558 - DNA, 28 bp, Artificial Sequence
  Description of Artificial Sequence: Synthetic oligonucleotide
tgaggacgcccggctgcacattttgatg

SEQ ID NO: 281559 - DNA, 27 bp, Artificial Sequence
  Description of Artificial Sequence: Synthetic oligonucleotide
gaggacgcccggctgcacattttgatg

SEQ ID NO: 281560 - DNA, 30 bp, Artificial Sequence
  Description of Artificial Sequence: Synthetic oligonucleotide
aggacgcccggctgcacattttgatgattc

SEQ ID NO: 281561 - DNA, 29 bp, Artificial Sequence
  Description of Artificial Sequence: Synthetic oligonucleotide
ggacgcccggctgcacattttgatgattc

SEQ ID NO: 281562 - DNA, 32 bp, Artificial Sequence
  Description of Artificial Sequence: Synthetic oligonucleotide
gacgcccggctgcacattttgatgattcattc

SEQ ID NO: 281563 - DNA, 33 bp, Artificial Sequence
  Description of Artificial Sequence: Synthetic oligonucleotide
acgcccggctgcacattttgatgattcattcac

SEQ ID NO: 281564 - DNA, 32 bp, Artificial Sequence
  Description of Artificial Sequence: Synthetic oligonucleotide
cgcccggctgcacattttgatgattcattcac

SEQ ID NO: 281565 - DNA, 32 bp, Artificial Sequence
  Description of Artificial Sequence: Synthetic oligonucleotide
gcccggctgcacattttgatgattcattcacg

SEQ ID NO: 281566 - DNA, 32 bp, Artificial Sequence
  Description of Artificial Sequence: Synthetic oligonucleotide
cccggctgcacattttgatgattcattcacgg

SEQ ID NO: 281567 - DNA, 34 bp, Artificial Sequence
  Description of Artificial Sequence: Synthetic oligonucleotide
ccggctgcacattttgatgattcattcacggaag

SEQ ID NO: 281568 - DNA, 36 bp, Artificial Sequence
  Description of Artificial Sequence: Synthetic oligonucleotide
cggctgcacattttgatgattcattcacggaagatg

SEQ ID NO: 281569 - DNA, 38 bp, Artificial Sequence
  Description of Artificial Sequence: Synthetic oligonucleotide
ggctgcacattttgatgattcattcacggaagatgtac

SEQ ID NO: 281570 - DNA, 38 bp, Artificial Sequence
  Description of Artificial Sequence: Synthetic oligonucleotide
gctgcacattttgatgattcattcacggaagatgtacc

SEQ ID NO: 281571 - DNA, 39 bp, Artificial Sequence
  Description of Artificial Sequence: Synthetic oligonucleotide
ctgcacattttgatgattcattcacggaagatgtacctg

SEQ ID NO: 281572 - DNA, 40 bp, Artificial Sequence
  Description of Artificial Sequence: Synthetic oligonucleotide
tgcacattttgatgattcattcacggaagatgtacctgac

SEQ ID NO: 281573 - DNA, 39 bp, Artificial Sequence
  Description of Artificial Sequence: Synthetic oligonucleotide
gcacattttgatgattcattcacggaagatgtacctgac

SEQ ID NO: 281574 - DNA, 39 bp, Artificial Sequence
  Description of Artificial Sequence: Synthetic oligonucleotide
cacattttgatgattcattcacggaagatgtacctgacc

SEQ ID NO: 281575 - DNA, 39 bp, Artificial Sequence
  Description of Artificial Sequence: Synthetic oligonucleotide
acattttgatgattcattcacggaagatgtacctgaccc

SEQ ID NO: 281576 - DNA, 38 bp, Artificial Sequence
  Description of Artificial Sequence: Synthetic oligonucleotide
cattttgatgattcattcacggaagatgtacctgaccc

SEQ ID NO: 281577 - DNA, 38 bp, Artificial Sequence
  Description of Artificial Sequence: Synthetic oligonucleotide
attttgatgattcattcacggaagatgtacctgacccc

SEQ ID NO: 281578 - DNA, 37 bp, Artificial Sequence
  Description of Artificial Sequence: Synthetic oligonucleotide
ttttgatgattcattcacggaagatgtacctgacccc

SEQ ID NO: 281579 - DNA, 36 bp, Artificial Sequence
  Description of Artificial Sequence: Synthetic oligonucleotide
tttgatgattcattcacggaagatgtacctgacccc

SEQ ID NO: 281580 - DNA, 35 bp, Artificial Sequence
  Description of Artificial Sequence: Synthetic oligonucleotide
ttgatgattcattcacggaagatgtacctgacccc

SEQ ID NO: 281581 - DNA, 34 bp, Artificial Sequence
  Description of Artificial Sequence: Synthetic oligonucleotide
tgatgattcattcacggaagatgtacctgacccc

SEQ ID NO: 281582 - DNA, 33 bp, Artificial Sequence
  Description of Artificial Sequence: Synthetic oligonucleotide
gatgattcattcacggaagatgtacctgacccc

SEQ ID NO: 281583 - DNA, 33 bp, Artificial Sequence
  Description of Artificial Sequence: Synthetic oligonucleotide
atgattcattcacggaagatgtacctgaccccg

SEQ ID NO: 281584 - DNA, 32 bp, Artificial Sequence
  Description of Artificial Sequence: Synthetic oligonucleotide
tgattcattcacggaagatgtacctgaccccg

SEQ ID NO: 281585 - DNA, 31 bp, Artificial Sequence
  Description of Artificial Sequence: Synthetic oligonucleotide
gattcattcacggaagatgtacctgaccccg

SEQ ID NO: 281586 - DNA, 31 bp, Artificial Sequence
  Description of Artificial Sequence: Synthetic oligonucleotide
attcattcacggaagatgtacctgaccccgg

SEQ ID NO: 281587 - DNA, 30 bp, Artificial Sequence
  Description of Artificial Sequence: Synthetic oligonucleotide
ttcattcacggaagatgtacctgaccccgg

SEQ ID NO: 281588 - DNA, 29 bp, Artificial Sequence
  Description of Artificial Sequence: Synthetic oligonucleotide
tcattcacggaagatgtacctgaccccgg

SEQ ID NO: 281589 - DNA, 28 bp, Artificial Sequence
  Description of Artificial Sequence: Synthetic oligonucleotide
cattcacggaagatgtacctgaccccgg

SEQ ID NO: 281590 - DNA, 28 bp, Artificial Sequence
  Description of Artificial Sequence: Synthetic oligonucleotide
attcacggaagatgtacctgaccccggg

SEQ ID NO: 281591 - DNA, 27 bp, Artificial Sequence
  Description of Artificial Sequence: Synthetic oligonucleotide
ttcacggaagatgtacctgaccccggg

SEQ ID NO: 281592 - DNA, 26 bp, Artificial Sequence
  Description of Artificial Sequence: Synthetic oligonucleotide
tcacggaagatgtacctgaccccggg

SEQ ID NO: 281593 - DNA, 25 bp, Artificial Sequence
  Description of Artificial Sequence: Synthetic oligonucleotide
cacggaagatgtacctgaccccggg

SEQ ID NO: 281594 - DNA, 27 bp, Artificial Sequence
  Description of Artificial Sequence: Synthetic oligonucleotide
acggaagatgtacctgaccccggggat

SEQ ID NO: 281595 - DNA, 26 bp, Artificial Sequence
  Description of Artificial Sequence: Synthetic oligonucleotide
cggaagatgtacctgaccccggggat

SEQ ID NO: 281596 - DNA, 27 bp, Artificial Sequence
  Description of Artificial Sequence: Synthetic oligonucleotide
ggaagatgtacctgaccccggggatca

SEQ ID NO: 281597 - DNA, 28 bp, Artificial Sequence
  Description of Artificial Sequence: Synthetic oligonucleotide
gaagatgtacctgaccccggggatcaag

SEQ ID NO: 281598 - DNA, 28 bp, Artificial Sequence
  Description of Artificial Sequence: Synthetic oligonucleotide
aagatgtacctgaccccggggatcaagc

SEQ ID NO: 281599 - DNA, 27 bp, Artificial Sequence
  Description of Artificial Sequence: Synthetic oligonucleotide
agatgtacctgaccccggggatcaagc

SEQ ID NO: 281600 - DNA, 27 bp, Artificial Sequence
  Description of Artificial Sequence: Synthetic oligonucleotide
gatgtacctgaccccggggatcaagct

SEQ ID NO: 281601 - DNA, 27 bp, Artificial Sequence
  Description of Artificial Sequence: Synthetic oligonucleotide
atgtacctgaccccggggatcaagctg

SEQ ID NO: 281602 - DNA, 27 bp, Artificial Sequence
  Description of Artificial Sequence: Synthetic oligonucleotide
tgtacctgaccccggggatcaagctga

SEQ ID NO: 281603 - DNA, 26 bp, Artificial Sequence
  Description of Artificial Sequence: Synthetic oligonucleotide
gtacctgaccccggggatcaagctga

SEQ ID NO: 281604 - DNA, 27 bp, Artificial Sequence
  Description of Artificial Sequence: Synthetic oligonucleotide
tacctgaccccggggatcaagctgaga

SEQ ID NO: 281605 - DNA, 27 bp, Artificial Sequence
  Description of Artificial Sequence: Synthetic oligonucleotide
acctgaccccggggatcaagctgagaa

SEQ ID NO: 281606 - DNA, 27 bp, Artificial Sequence
  Description of Artificial Sequence: Synthetic oligonucleotide
cctgaccccggggatcaagctgagaaa

SEQ ID NO: 281607 - DNA, 31 bp, Artificial Sequence
  Description of Artificial Sequence: Synthetic oligonucleotide
ctgaccccggggatcaagctgagaaaatttg

SEQ ID NO: 281608 - DNA, 31 bp, Artificial Sequence
  Description of Artificial Sequence: Synthetic oligonucleotide
tgaccccggggatcaagctgagaaaatttgc

SEQ ID NO: 281609 - DNA, 30 bp, Artificial Sequence
  Description of Artificial Sequence: Synthetic oligonucleotide
gaccccggggatcaagctgagaaaatttgc

SEQ ID NO: 281610 - DNA, 31 bp, Artificial Sequence
  Description of Artificial Sequence: Synthetic oligonucleotide
accccggggatcaagctgagaaaatttgctg

SEQ ID NO: 281611 - DNA, 30 bp, Artificial Sequence
  Description of Artificial Sequence: Synthetic oligonucleotide
ccccggggatcaagctgagaaaatttgctg

SEQ ID NO: 281612 - DNA, 31 bp, Artificial Sequence
  Description of Artificial Sequence: Synthetic oligonucleotide
cccggggatcaagctgagaaaatttgctgag

SEQ ID NO: 281613 - DNA, 31 bp, Artificial Sequence
  Description of Artificial Sequence: Synthetic oligonucleotide
ccggggatcaagctgagaaaatttgctgagc

SEQ ID NO: 281614 - DNA, 32 bp, Artificial Sequence
  Description of Artificial Sequence: Synthetic oligonucleotide
cggggatcaagctgagaaaatttgctgagcac

SEQ ID NO: 281615 - DNA, 34 bp, Artificial Sequence
  Description of Artificial Sequence: Synthetic oligonucleotide
ggggatcaagctgagaaaatttgctgagcacatg

SEQ ID NO: 281616 - DNA, 34 bp, Artificial Sequence
  Description of Artificial Sequence: Synthetic oligonucleotide
gggatcaagctgagaaaatttgctgagcacatgc

SEQ ID NO: 281617 - DNA, 34 bp, Artificial Sequence
  Description of Artificial Sequence: Synthetic oligonucleotide
ggatcaagctgagaaaatttgctgagcacatgcc

SEQ ID NO: 281618 - DNA, 35 bp, Artificial Sequence
  Description of Artificial Sequence: Synthetic oligonucleotide
gatcaagctgagaaaatttgctgagcacatgccag

SEQ ID NO: 281619 - DNA, 35 bp, Artificial Sequence
  Description of Artificial Sequence: Synthetic oligonucleotide
atcaagctgagaaaatttgctgagcacatgccagg

SEQ ID NO: 281620 - DNA, 34 bp, Artificial Sequence
  Description of Artificial Sequence: Synthetic oligonucleotide
tcaagctgagaaaatttgctgagcacatgccagg

SEQ ID NO: 281621 - DNA, 33 bp, Artificial Sequence
  Description of Artificial Sequence: Synthetic oligonucleotide
caagctgagaaaatttgctgagcacatgccagg

SEQ ID NO: 281622 - DNA, 34 bp, Artificial Sequence
  Description of Artificial Sequence: Synthetic oligonucleotide
aagctgagaaaatttgctgagcacatgccaggtg

SEQ ID NO: 281623 - DNA, 33 bp, Artificial Sequence
  Description of Artificial Sequence: Synthetic oligonucleotide
agctgagaaaatttgctgagcacatgccaggtg

SEQ ID NO: 281624 - DNA, 32 bp, Artificial Sequence
  Description of Artificial Sequence: Synthetic oligonucleotide
gctgagaaaatttgctgagcacatgccaggtg

SEQ ID NO: 281625 - DNA, 32 bp, Artificial Sequence
  Description of Artificial Sequence: Synthetic oligonucleotide
ctgagaaaatttgctgagcacatgccaggtgc

SEQ ID NO: 281626 - DNA, 34 bp, Artificial Sequence
  Description of Artificial Sequence: Synthetic oligonucleotide
tgagaaaatttgctgagcacatgccaggtgcatc

SEQ ID NO: 281627 - DNA, 33 bp, Artificial Sequence
  Description of Artificial Sequence: Synthetic oligonucleotide
gagaaaatttgctgagcacatgccaggtgcatc

SEQ ID NO: 281628 - DNA, 34 bp, Artificial Sequence
  Description of Artificial Sequence: Synthetic oligonucleotide
agaaaatttgctgagcacatgccaggtgcatcag

SEQ ID NO: 281629 - DNA, 33 bp, Artificial Sequence
  Description of Artificial Sequence: Synthetic oligonucleotide
gaaaatttgctgagcacatgccaggtgcatcag

SEQ ID NO: 281630 - DNA, 33 bp, Artificial Sequence
  Description of Artificial Sequence: Synthetic oligonucleotide
aaaatttgctgagcacatgccaggtgcatcagg

SEQ ID NO: 281631 - DNA, 32 bp, Artificial Sequence
  Description of Artificial Sequence: Synthetic oligonucleotide
aaatttgctgagcacatgccaggtgcatcagg

SEQ ID NO: 281632 - DNA, 31 bp, Artificial Sequence
  Description of Artificial Sequence: Synthetic oligonucleotide
aatttgctgagcacatgccaggtgcatcagg

SEQ ID NO: 281633 - DNA, 30 bp, Artificial Sequence
  Description of Artificial Sequence: Synthetic oligonucleotide
atttgctgagcacatgccaggtgcatcagg

SEQ ID NO: 281634 - DNA, 29 bp, Artificial Sequence
  Description of Artificial Sequence: Synthetic oligonucleotide
tttgctgagcacatgccaggtgcatcagg

SEQ ID NO: 281635 - DNA, 28 bp, Artificial Sequence
  Description of Artificial Sequence: Synthetic oligonucleotide
ttgctgagcacatgccaggtgcatcagg

SEQ ID NO: 281636 - DNA, 27 bp, Artificial Sequence
  Description of Artificial Sequence: Synthetic oligonucleotide
tgctgagcacatgccaggtgcatcagg

SEQ ID NO: 281637 - DNA, 26 bp, Artificial Sequence
  Description of Artificial Sequence: Synthetic oligonucleotide
gctgagcacatgccaggtgcatcagg

SEQ ID NO: 281638 - DNA, 26 bp, Artificial Sequence
  Description of Artificial Sequence: Synthetic oligonucleotide
ctgagcacatgccaggtgcatcaggg

SEQ ID NO: 281639 - DNA, 26 bp, Artificial Sequence
  Description of Artificial Sequence: Synthetic oligonucleotide
tgagcacatgccaggtgcatcagggc

SEQ ID NO: 281640 - DNA, 25 bp, Artificial Sequence
  Description of Artificial Sequence: Synthetic oligonucleotide
gagcacatgccaggtgcatcagggc

SEQ ID NO: 281641 - DNA, 26 bp, Artificial Sequence
  Description of Artificial Sequence: Synthetic oligonucleotide
agcacatgccaggtgcatcagggcct

SEQ ID NO: 281642 - DNA, 25 bp, Artificial Sequence
  Description of Artificial Sequence: Synthetic oligonucleotide
gcacatgccaggtgcatcagggcct

SEQ ID NO: 281643 - DNA, 27 bp, Artificial Sequence
  Description of Artificial Sequence: Synthetic oligonucleotide
cacatgccaggtgcatcagggcctgaa

SEQ ID NO: 281644 - DNA, 27 bp, Artificial Sequence
  Description of Artificial Sequence: Synthetic oligonucleotide
acatgccaggtgcatcagggcctgaag

SEQ ID NO: 281645 - DNA, 27 bp, Artificial Sequence
  Description of Artificial Sequence: Synthetic oligonucleotide
catgccaggtgcatcagggcctgaagt

SEQ ID NO: 281646 - DNA, 27 bp, Artificial Sequence
  Description of Artificial Sequence: Synthetic oligonucleotide
atgccaggtgcatcagggcctgaagtg

SEQ ID NO: 281647 - DNA, 27 bp, Artificial Sequence
  Description of Artificial Sequence: Synthetic oligonucleotide
tgccaggtgcatcagggcctgaagtga

SEQ ID NO: 281648 - DNA, 27 bp, Artificial Sequence
  Description of Artificial Sequence: Synthetic oligonucleotide
gccaggtgcatcagggcctgaagtgat

SEQ ID NO: 281649 - DNA, 27 bp, Artificial Sequence
  Description of Artificial Sequence: Synthetic oligonucleotide
ccaggtgcatcagggcctgaagtgatg

SEQ ID NO: 281650 - DNA, 27 bp, Artificial Sequence
  Description of Artificial Sequence: Synthetic oligonucleotide
caggtgcatcagggcctgaagtgatgg

SEQ ID NO: 281651 - DNA, 27 bp, Artificial Sequence
  Description of Artificial Sequence: Synthetic oligonucleotide
aggtgcatcagggcctgaagtgatggg

SEQ ID NO: 281652 - DNA, 26 bp, Artificial Sequence
  Description of Artificial Sequence: Synthetic oligonucleotide
ggtgcatcagggcctgaagtgatggg

SEQ ID NO: 281653 - DNA, 26 bp, Artificial Sequence
  Description of Artificial Sequence: Synthetic oligonucleotide
gtgcatcagggcctgaagtgatgggc

SEQ ID NO: 281654 - DNA, 27 bp, Artificial Sequence
  Description of Artificial Sequence: Synthetic oligonucleotide
tgcatcagggcctgaagtgatgggcgt

SEQ ID NO: 281655 - DNA, 26 bp, Artificial Sequence
  Description of Artificial Sequence: Synthetic oligonucleotide
gcatcagggcctgaagtgatgggcgt

SEQ ID NO: 281656 - DNA, 27 bp, Artificial Sequence
  Description of Artificial Sequence: Synthetic oligonucleotide
catcagggcctgaagtgatgggcgtgt

SEQ ID NO: 281657 - DNA, 27 bp, Artificial Sequence
  Description of Artificial Sequence: Synthetic oligonucleotide
atcagggcctgaagtgatgggcgtgtg

SEQ ID NO: 281658 - DNA, 26 bp, Artificial Sequence
  Description of Artificial Sequence: Synthetic oligonucleotide
tcagggcctgaagtgatgggcgtgtg

SEQ ID NO: 281659 - DNA, 25 bp, Artificial Sequence
  Description of Artificial Sequence: Synthetic oligonucleotide
cagggcctgaagtgatgggcgtgtg

SEQ ID NO: 281660 - DNA, 26 bp, Artificial Sequence
  Description of Artificial Sequence: Synthetic oligonucleotide
agggcctgaagtgatgggcgtgtgga

SEQ ID NO: 281661 - DNA, 25 bp, Artificial Sequence
  Description of Artificial Sequence: Synthetic oligonucleotide
gggcctgaagtgatgggcgtgtgga

SEQ ID NO: 281662 - DNA, 26 bp, Artificial Sequence
  Description of Artificial Sequence: Synthetic oligonucleotide
ggcctgaagtgatgggcgtgtggaca

SEQ ID NO: 281663 - DNA, 27 bp, Artificial Sequence
  Description of Artificial Sequence: Synthetic oligonucleotide
gcctgaagtgatgggcgtgtggacaga

SEQ ID NO: 281664 - DNA, 28 bp, Artificial Sequence
  Description of Artificial Sequence: Synthetic oligonucleotide
cctgaagtgatgggcgtgtggacagaag

SEQ ID NO: 281665 - DNA, 28 bp, Artificial Sequence
  Description of Artificial Sequence: Synthetic oligonucleotide
ctgaagtgatgggcgtgtggacagaagc

SEQ ID NO: 281666 - DNA, 29 bp, Artificial Sequence
  Description of Artificial Sequence: Synthetic oligonucleotide
tgaagtgatgggcgtgtggacagaagctc

SEQ ID NO: 281667 - DNA, 28 bp, Artificial Sequence
  Description of Artificial Sequence: Synthetic oligonucleotide
gaagtgatgggcgtgtggacagaagctc

SEQ ID NO: 281668 - DNA, 28 bp, Artificial Sequence
  Description of Artificial Sequence: Synthetic oligonucleotide
aagtgatgggcgtgtggacagaagctcg

SEQ ID NO: 281669 - DNA, 27 bp, Artificial Sequence
  Description of Artificial Sequence: Synthetic oligonucleotide
agtgatgggcgtgtggacagaagctcg

SEQ ID NO: 281670 - DNA, 26 bp, Artificial Sequence
  Description of Artificial Sequence: Synthetic oligonucleotide
gtgatgggcgtgtggacagaagctcg

SEQ ID NO: 281671 - DNA, 27 bp, Artificial Sequence
  Description of Artificial Sequence: Synthetic oligonucleotide
tgatgggcgtgtggacagaagctcgca

SEQ ID NO: 281672 - DNA, 27 bp, Artificial Sequence
  Description of Artificial Sequence: Synthetic oligonucleotide
gatgggcgtgtggacagaagctcgcat

SEQ ID NO: 281673 - DNA, 27 bp, Artificial Sequence
  Description of Artificial Sequence: Synthetic oligonucleotide
atgggcgtgtggacagaagctcgcatg

SEQ ID NO: 281674 - DNA, 27 bp, Artificial Sequence
  Description of Artificial Sequence: Synthetic oligonucleotide
tgggcgtgtggacagaagctcgcatgt

SEQ ID NO: 281675 - DNA, 27 bp, Artificial Sequence
  Description of Artificial Sequence: Synthetic oligonucleotide
gggcgtgtggacagaagctcgcatgta

SEQ ID NO: 281676 - DNA, 28 bp, Artificial Sequence
  Description of Artificial Sequence: Synthetic oligonucleotide
ggcgtgtggacagaagctcgcatgtatg

SEQ ID NO: 281677 - DNA, 28 bp, Artificial Sequence
  Description of Artificial Sequence: Synthetic oligonucleotide
gcgtgtggacagaagctcgcatgtatgg

SEQ ID NO: 281678 - DNA, 28 bp, Artificial Sequence
  Description of Artificial Sequence: Synthetic oligonucleotide
cgtgtggacagaagctcgcatgtatggc

SEQ ID NO: 281679 - DNA, 28 bp, Artificial Sequence
  Description of Artificial Sequence: Synthetic oligonucleotide
gtgtggacagaagctcgcatgtatggcc

SEQ ID NO: 281680 - DNA, 29 bp, Artificial Sequence
  Description of Artificial Sequence: Synthetic oligonucleotide
tgtggacagaagctcgcatgtatggcctg

SEQ ID NO: 281681 - DNA, 28 bp, Artificial Sequence
  Description of Artificial Sequence: Synthetic oligonucleotide
gtggacagaagctcgcatgtatggcctg

SEQ ID NO: 281682 - DNA, 28 bp, Artificial Sequence
  Description of Artificial Sequence: Synthetic oligonucleotide
tggacagaagctcgcatgtatggcctgc

SEQ ID NO: 281683 - DNA, 27 bp, Artificial Sequence
  Description of Artificial Sequence: Synthetic oligonucleotide
ggacagaagctcgcatgtatggcctgc

SEQ ID NO: 281684 - DNA, 27 bp, Artificial Sequence
  Description of Artificial Sequence: Synthetic oligonucleotide
gacagaagctcgcatgtatggcctgcg

SEQ ID NO: 281685 - DNA, 28 bp, Artificial Sequence
  Description of Artificial Sequence: Synthetic oligonucleotide
acagaagctcgcatgtatggcctgcgag

SEQ ID NO: 281686 - DNA, 27 bp, Artificial Sequence
  Description of Artificial Sequence: Synthetic oligonucleotide
cagaagctcgcatgtatggcctgcgag

SEQ ID NO: 281687 - DNA, 29 bp, Artificial Sequence
  Description of Artificial Sequence: Synthetic oligonucleotide
agaagctcgcatgtatggcctgcgagatc

SEQ ID NO: 281688 - DNA, 28 bp, Artificial Sequence
  Description of Artificial Sequence: Synthetic oligonucleotide
gaagctcgcatgtatggcctgcgagatc

SEQ ID NO: 281689 - DNA, 28 bp, Artificial Sequence
  Description of Artificial Sequence: Synthetic oligonucleotide
aagctcgcatgtatggcctgcgagatcg

SEQ ID NO: 281690 - DNA, 27 bp, Artificial Sequence
  Description of Artificial Sequence: Synthetic oligonucleotide
agctcgcatgtatggcctgcgagatcg

SEQ ID NO: 281691 - DNA, 26 bp, Artificial Sequence
  Description of Artificial Sequence: Synthetic oligonucleotide
gctcgcatgtatggcctgcgagatcg

SEQ ID NO: 281692 - DNA, 26 bp, Artificial Sequence
  Description of Artificial Sequence: Synthetic oligonucleotide
ctcgcatgtatggcctgcgagatcgg

SEQ ID NO: 281693 - DNA, 26 bp, Artificial Sequence
  Description of Artificial Sequence: Synthetic oligonucleotide
tcgcatgtatggcctgcgagatcggc

SEQ ID NO: 281694 - DNA, 25 bp, Artificial Sequence
  Description of Artificial Sequence: Synthetic oligonucleotide
cgcatgtatggcctgcgagatcggc

SEQ ID NO: 281695 - DNA, 26 bp, Artificial Sequence
  Description of Artificial Sequence: Synthetic oligonucleotide
gcatgtatggcctgcgagatcggcga

SEQ ID NO: 281696 - DNA, 27 bp, Artificial Sequence
  Description of Artificial Sequence: Synthetic oligonucleotide
catgtatggcctgcgagatcggcgagt

SEQ ID NO: 281697 - DNA, 27 bp, Artificial Sequence
  Description of Artificial Sequence: Synthetic oligonucleotide
atgtatggcctgcgagatcggcgagtc

SEQ ID NO: 281698 - DNA, 26 bp, Artificial Sequence
  Description of Artificial Sequence: Synthetic oligonucleotide
tgtatggcctgcgagatcggcgagtc

SEQ ID NO: 281699 - DNA, 25 bp, Artificial Sequence
  Description of Artificial Sequence: Synthetic oligonucleotide
gtatggcctgcgagatcggcgagtc

SEQ ID NO: 281700 - DNA, 27 bp, Artificial Sequence
  Description of Artificial Sequence: Synthetic oligonucleotide
tatggcctgcgagatcggcgagtcgat

SEQ ID NO: 281701 - DNA, 26 bp, Artificial Sequence
  Description of Artificial Sequence: Synthetic oligonucleotide
atggcctgcgagatcggcgagtcgat

SEQ ID NO: 281702 - DNA, 25 bp, Artificial Sequence
  Description of Artificial Sequence: Synthetic oligonucleotide
tggcctgcgagatcggcgagtcgat

SEQ ID NO: 281703 - DNA, 24 bp, Artificial Sequence
  Description of Artificial Sequence: Synthetic oligonucleotide
ggcctgcgagatcggcgagtcgat

SEQ ID NO: 281704 - DNA, 25 bp, Artificial Sequence
  Description of Artificial Sequence: Synthetic oligonucleotide
gcctgcgagatcggcgagtcgatgt

SEQ ID NO: 281705 - DNA, 26 bp, Artificial Sequence
  Description of Artificial Sequence: Synthetic oligonucleotide
cctgcgagatcggcgagtcgatgtca

SEQ ID NO: 281706 - DNA, 27 bp, Artificial Sequence
  Description of Artificial Sequence: Synthetic oligonucleotide
ctgcgagatcggcgagtcgatgtcact

SEQ ID NO: 281707 - DNA, 27 bp, Artificial Sequence
  Description of Artificial Sequence: Synthetic oligonucleotide
tgcgagatcggcgagtcgatgtcactc

SEQ ID NO: 281708 - DNA, 27 bp, Artificial Sequence
  Description of Artificial Sequence: Synthetic oligonucleotide
gcgagatcggcgagtcgatgtcactct

SEQ ID NO: 281709 - DNA, 27 bp, Artificial Sequence
  Description of Artificial Sequence: Synthetic oligonucleotide
cgagatcggcgagtcgatgtcactctg

SEQ ID NO: 281710 - DNA, 27 bp, Artificial Sequence
  Description of Artificial Sequence: Synthetic oligonucleotide
gagatcggcgagtcgatgtcactctgg

SEQ ID NO: 281711 - DNA, 28 bp, Artificial Sequence
  Description of Artificial Sequence: Synthetic oligonucleotide
agatcggcgagtcgatgtcactctggag

SEQ ID NO: 281712 - DNA, 27 bp, Artificial Sequence
  Description of Artificial Sequence: Synthetic oligonucleotide
gatcggcgagtcgatgtcactctggag

SEQ ID NO: 281713 - DNA, 27 bp, Artificial Sequence
  Description of Artificial Sequence: Synthetic oligonucleotide
atcggcgagtcgatgtcactctggagg

SEQ ID NO: 281714 - DNA, 27 bp, Artificial Sequence
  Description of Artificial Sequence: Synthetic oligonucleotide
tcggcgagtcgatgtcactctggagga

SEQ ID NO: 281715 - DNA, 26 bp, Artificial Sequence
  Description of Artificial Sequence: Synthetic oligonucleotide
cggcgagtcgatgtcactctggagga

SEQ ID NO: 281716 - DNA, 27 bp, Artificial Sequence
  Description of Artificial Sequence: Synthetic oligonucleotide
ggcgagtcgatgtcactctggaggact

SEQ ID NO: 281717 - DNA, 29 bp, Artificial Sequence
  Description of Artificial Sequence: Synthetic oligonucleotide
gcgagtcgatgtcactctggaggacttag

SEQ ID NO: 281718 - DNA, 30 bp, Artificial Sequence
  Description of Artificial Sequence: Synthetic oligonucleotide
cgagtcgatgtcactctggaggacttagag

SEQ ID NO: 281719 - DNA, 32 bp, Artificial Sequence
  Description of Artificial Sequence: Synthetic oligonucleotide
gagtcgatgtcactctggaggacttagagatg

SEQ ID NO: 281720 - DNA, 32 bp, Artificial Sequence
  Description of Artificial Sequence: Synthetic oligonucleotide
agtcgatgtcactctggaggacttagagatgg

SEQ ID NO: 281721 - DNA, 31 bp, Artificial Sequence
  Description of Artificial Sequence: Synthetic oligonucleotide
gtcgatgtcactctggaggacttagagatgg

SEQ ID NO: 281722 - DNA, 31 bp, Artificial Sequence
  Description of Artificial Sequence: Synthetic oligonucleotide
tcgatgtcactctggaggacttagagatggc

SEQ ID NO: 281723 - DNA, 30 bp, Artificial Sequence
  Description of Artificial Sequence: Synthetic oligonucleotide
cgatgtcactctggaggacttagagatggc

SEQ ID NO: 281724 - DNA, 31 bp, Artificial Sequence
  Description of Artificial Sequence: Synthetic oligonucleotide
gatgtcactctggaggacttagagatggcac

SEQ ID NO: 281725 - DNA, 33 bp, Artificial Sequence
  Description of Artificial Sequence: Synthetic oligonucleotide
atgtcactctggaggacttagagatggcactag

SEQ ID NO: 281726 - DNA, 32 bp, Artificial Sequence
  Description of Artificial Sequence: Synthetic oligonucleotide
tgtcactctggaggacttagagatggcactag

SEQ ID NO: 281727 - DNA, 31 bp, Artificial Sequence
  Description of Artificial Sequence: Synthetic oligonucleotide
gtcactctggaggacttagagatggcactag

SEQ ID NO: 281728 - DNA, 31 bp, Artificial Sequence
  Description of Artificial Sequence: Synthetic oligonucleotide
tcactctggaggacttagagatggcactagc

SEQ ID NO: 281729 - DNA, 30 bp, Artificial Sequence
  Description of Artificial Sequence: Synthetic oligonucleotide
cactctggaggacttagagatggcactagc

SEQ ID NO: 281730 - DNA, 30 bp, Artificial Sequence
  Description of Artificial Sequence: Synthetic oligonucleotide
actctggaggacttagagatggcactagcc

SEQ ID NO: 281731 - DNA, 29 bp, Artificial Sequence
  Description of Artificial Sequence: Synthetic oligonucleotide
ctctggaggacttagagatggcactagcc

SEQ ID NO: 281732 - DNA, 31 bp, Artificial Sequence
  Description of Artificial Sequence: Synthetic oligonucleotide
tctggaggacttagagatggcactagccaag

SEQ ID NO: 281733 - DNA, 30 bp, Artificial Sequence
  Description of Artificial Sequence: Synthetic oligonucleotide
ctggaggacttagagatggcactagccaag

SEQ ID NO: 281734 - DNA, 30 bp, Artificial Sequence
  Description of Artificial Sequence: Synthetic oligonucleotide
tggaggacttagagatggcactagccaagg

SEQ ID NO: 281735 - DNA, 29 bp, Artificial Sequence
  Description of Artificial Sequence: Synthetic oligonucleotide
ggaggacttagagatggcactagccaagg

SEQ ID NO: 281736 - DNA, 30 bp, Artificial Sequence
  Description of Artificial Sequence: Synthetic oligonucleotide
gaggacttagagatggcactagccaaggac

SEQ ID NO: 281737 - DNA, 32 bp, Artificial Sequence
  Description of Artificial Sequence: Synthetic oligonucleotide
aggacttagagatggcactagccaaggacatg

SEQ ID NO: 281738 - DNA, 31 bp, Artificial Sequence
  Description of Artificial Sequence: Synthetic oligonucleotide
ggacttagagatggcactagccaaggacatg

SEQ ID NO: 281739 - DNA, 31 bp, Artificial Sequence
  Description of Artificial Sequence: Synthetic oligonucleotide
gacttagagatggcactagccaaggacatgc

SEQ ID NO: 281740 - DNA, 32 bp, Artificial Sequence
  Description of Artificial Sequence: Synthetic oligonucleotide
acttagagatggcactagccaaggacatgcag

SEQ ID NO: 281741 - DNA, 31 bp, Artificial Sequence
  Description of Artificial Sequence: Synthetic oligonucleotide
cttagagatggcactagccaaggacatgcag

SEQ ID NO: 281742 - DNA, 33 bp, Artificial Sequence
  Description of Artificial Sequence: Synthetic oligonucleotide
ttagagatggcactagccaaggacatgcagaac

SEQ ID NO: 281743 - DNA, 32 bp, Artificial Sequence
  Description of Artificial Sequence: Synthetic oligonucleotide
tagagatggcactagccaaggacatgcagaac

SEQ ID NO: 281744 - DNA, 31 bp, Artificial Sequence
  Description of Artificial Sequence: Synthetic oligonucleotide
agagatggcactagccaaggacatgcagaac

SEQ ID NO: 281745 - DNA, 30 bp, Artificial Sequence
  Description of Artificial Sequence: Synthetic oligonucleotide
gagatggcactagccaaggacatgcagaac

SEQ ID NO: 281746 - DNA, 30 bp, Artificial Sequence
  Description of Artificial Sequence: Synthetic oligonucleotide
agatggcactagccaaggacatgcagaacg

SEQ ID NO: 281747 - DNA, 29 bp, Artificial Sequence
  Description of Artificial Sequence: Synthetic oligonucleotide
gatggcactagccaaggacatgcagaacg

SEQ ID NO: 281748 - DNA, 30 bp, Artificial Sequence
  Description of Artificial Sequence: Synthetic oligonucleotide
atggcactagccaaggacatgcagaacgac

SEQ ID NO: 281749 - DNA, 29 bp, Artificial Sequence
  Description of Artificial Sequence: Synthetic oligonucleotide
tggcactagccaaggacatgcagaacgac

SEQ ID NO: 281750 - DNA, 28 bp, Artificial Sequence
  Description of Artificial Sequence: Synthetic oligonucleotide
ggcactagccaaggacatgcagaacgac

SEQ ID NO: 281751 - DNA, 29 bp, Artificial Sequence
  Description of Artificial Sequence: Synthetic oligonucleotide
gcactagccaaggacatgcagaacgacag

SEQ ID NO: 281752 - DNA, 30 bp, Artificial Sequence
  Description of Artificial Sequence: Synthetic oligonucleotide
cactagccaaggacatgcagaacgacagtg

SEQ ID NO: 281753 - DNA, 31 bp, Artificial Sequence
  Description of Artificial Sequence: Synthetic oligonucleotide
actagccaaggacatgcagaacgacagtgag

SEQ ID NO: 281754 - DNA, 30 bp, Artificial Sequence
  Description of Artificial Sequence: Synthetic oligonucleotide
ctagccaaggacatgcagaacgacagtgag

SEQ ID NO: 281755 - DNA, 35 bp, Artificial Sequence
  Description of Artificial Sequence: Synthetic oligonucleotide
tagccaaggacatgcagaacgacagtgagtaaaac

SEQ ID NO: 281756 - DNA, 34 bp, Artificial Sequence
  Description of Artificial Sequence: Synthetic oligonucleotide
agccaaggacatgcagaacgacagtgagtaaaac

SEQ ID NO: 281757 - DNA, 33 bp, Artificial Sequence
  Description of Artificial Sequence: Synthetic oligonucleotide
gccaaggacatgcagaacgacagtgagtaaaac

SEQ ID NO: 281758 - DNA, 35 bp, Artificial Sequence
  Description of Artificial Sequence: Synthetic oligonucleotide
ccaaggacatgcagaacgacagtgagtaaaacatg

SEQ ID NO: 281759 - DNA, 36 bp, Artificial Sequence
  Description of Artificial Sequence: Synthetic oligonucleotide
caaggacatgcagaacgacagtgagtaaaacatgtg

SEQ ID NO: 281760 - DNA, 36 bp, Artificial Sequence
  Description of Artificial Sequence: Synthetic oligonucleotide
aaggacatgcagaacgacagtgagtaaaacatgtgc

SEQ ID NO: 281761 - DNA, 35 bp, Artificial Sequence
  Description of Artificial Sequence: Synthetic oligonucleotide
aggacatgcagaacgacagtgagtaaaacatgtgc

SEQ ID NO: 281762 - DNA, 34 bp, Artificial Sequence
  Description of Artificial Sequence: Synthetic oligonucleotide
ggacatgcagaacgacagtgagtaaaacatgtgc

SEQ ID NO: 281763 - DNA, 36 bp, Artificial Sequence
  Description of Artificial Sequence: Synthetic oligonucleotide
gacatgcagaacgacagtgagtaaaacatgtgcatc

SEQ ID NO: 281764 - DNA, 38 bp, Artificial Sequence
  Description of Artificial Sequence: Synthetic oligonucleotide
acatgcagaacgacagtgagtaaaacatgtgcatcaag

SEQ ID NO: 281765 - DNA, 37 bp, Artificial Sequence
  Description of Artificial Sequence: Synthetic oligonucleotide
catgcagaacgacagtgagtaaaacatgtgcatcaag

SEQ ID NO: 281766 - DNA, 44 bp, Artificial Sequence
  Description of Artificial Sequence: Synthetic oligonucleotide
atgcagaacgacagtgagtaaaacatgtgcatcaagaatttatg

SEQ ID NO: 281767 - DNA, 43 bp, Artificial Sequence
  Description of Artificial Sequence: Synthetic oligonucleotide
tgcagaacgacagtgagtaaaacatgtgcatcaagaatttatg

SEQ ID NO: 281768 - DNA, 42 bp, Artificial Sequence
  Description of Artificial Sequence: Synthetic oligonucleotide
gcagaacgacagtgagtaaaacatgtgcatcaagaatttatg

SEQ ID NO: 281769 - DNA, 42 bp, Artificial Sequence
  Description of Artificial Sequence: Synthetic oligonucleotide
cagaacgacagtgagtaaaacatgtgcatcaagaatttatgg

SEQ ID NO: 281770 - DNA, 44 bp, Artificial Sequence
  Description of Artificial Sequence: Synthetic oligonucleotide
agaacgacagtgagtaaaacatgtgcatcaagaatttatggaag

SEQ ID NO: 281771 - DNA, 43 bp, Artificial Sequence
  Description of Artificial Sequence: Synthetic oligonucleotide
gaacgacagtgagtaaaacatgtgcatcaagaatttatggaag

SEQ ID NO: 281772 - DNA, 44 bp, Artificial Sequence
  Description of Artificial Sequence: Synthetic oligonucleotide
aacgacagtgagtaaaacatgtgcatcaagaatttatggaagag

SEQ ID NO: 281773 - DNA, 43 bp, Artificial Sequence
  Description of Artificial Sequence: Synthetic oligonucleotide
acgacagtgagtaaaacatgtgcatcaagaatttatggaagag

SEQ ID NO: 281774 - DNA, 42 bp, Artificial Sequence
  Description of Artificial Sequence: Synthetic oligonucleotide
cgacagtgagtaaaacatgtgcatcaagaatttatggaagag

SEQ ID NO: 281775 - DNA, 27 bp, Artificial Sequence
  Description of Artificial Sequence: Synthetic oligonucleotide
atggccattgccggcatccgctatgag

SEQ ID NO: 281776 - DNA, 27 bp, Artificial Sequence
  Description of Artificial Sequence: Synthetic oligonucleotide
tggccattgccggcatccgctatgaga

SEQ ID NO: 281777 - DNA, 26 bp, Artificial Sequence
  Description of Artificial Sequence: Synthetic oligonucleotide
ggccattgccggcatccgctatgaga

SEQ ID NO: 281778 - DNA, 27 bp, Artificial Sequence
  Description of Artificial Sequence: Synthetic oligonucleotide
gccattgccggcatccgctatgagagt

SEQ ID NO: 281779 - DNA, 27 bp, Artificial Sequence
  Description of Artificial Sequence: Synthetic oligonucleotide
ccattgccggcatccgctatgagagtc

SEQ ID NO: 281780 - DNA, 27 bp, Artificial Sequence
  Description of Artificial Sequence: Synthetic oligonucleotide
cattgccggcatccgctatgagagtcg

SEQ ID NO: 281781 - DNA, 27 bp, Artificial Sequence
  Description of Artificial Sequence: Synthetic oligonucleotide
attgccggcatccgctatgagagtcgg

SEQ ID NO: 281782 - DNA, 26 bp, Artificial Sequence
  Description of Artificial Sequence: Synthetic oligonucleotide
ttgccggcatccgctatgagagtcgg

SEQ ID NO: 281783 - DNA, 25 bp, Artificial Sequence
  Description of Artificial Sequence: Synthetic oligonucleotide
tgccggcatccgctatgagagtcgg

SEQ ID NO: 281784 - DNA, 24 bp, Artificial Sequence
  Description of Artificial Sequence: Synthetic oligonucleotide
gccggcatccgctatgagagtcgg

SEQ ID NO: 281785 - DNA, 26 bp, Artificial Sequence
  Description of Artificial Sequence: Synthetic oligonucleotide
ccggcatccgctatgagagtcggctt

SEQ ID NO: 281786 - DNA, 27 bp, Artificial Sequence
  Description of Artificial Sequence: Synthetic oligonucleotide
cggcatccgctatgagagtcggcttct

SEQ ID NO: 281787 - DNA, 27 bp, Artificial Sequence
  Description of Artificial Sequence: Synthetic oligonucleotide
ggcatccgctatgagagtcggcttctc

SEQ ID NO: 281788 - DNA, 29 bp, Artificial Sequence
  Description of Artificial Sequence: Synthetic oligonucleotide
gcatccgctatgagagtcggcttctcttc

SEQ ID NO: 281789 - DNA, 31 bp, Artificial Sequence
  Description of Artificial Sequence: Synthetic oligonucleotide
catccgctatgagagtcggcttctcttcatg

SEQ ID NO: 281790 - DNA, 31 bp, Artificial Sequence
  Description of Artificial Sequence: Synthetic oligonucleotide
atccgctatgagagtcggcttctcttcatgg

SEQ ID NO: 281791 - DNA, 30 bp, Artificial Sequence
  Description of Artificial Sequence: Synthetic oligonucleotide
tccgctatgagagtcggcttctcttcatgg

SEQ ID NO: 281792 - DNA, 29 bp, Artificial Sequence
  Description of Artificial Sequence: Synthetic oligonucleotide
ccgctatgagagtcggcttctcttcatgg

SEQ ID NO: 281793 - DNA, 29 bp, Artificial Sequence
  Description of Artificial Sequence: Synthetic oligonucleotide
cgctatgagagtcggcttctcttcatggc

SEQ ID NO: 281794 - DNA, 29 bp, Artificial Sequence
  Description of Artificial Sequence: Synthetic oligonucleotide
gctatgagagtcggcttctcttcatggcg

SEQ ID NO: 281795 - DNA, 29 bp, Artificial Sequence
  Description of Artificial Sequence: Synthetic oligonucleotide
ctatgagagtcggcttctcttcatggcgg

SEQ ID NO: 281796 - DNA, 30 bp, Artificial Sequence
  Description of Artificial Sequence: Synthetic oligonucleotide
tatgagagtcggcttctcttcatggcggtc

SEQ ID NO: 281797 - DNA, 29 bp, Artificial Sequence
  Description of Artificial Sequence: Synthetic oligonucleotide
atgagagtcggcttctcttcatggcggtc

SEQ ID NO: 281798 - DNA, 28 bp, Artificial Sequence
  Description of Artificial Sequence: Synthetic oligonucleotide
tgagagtcggcttctcttcatggcggtc

SEQ ID NO: 281799 - DNA, 27 bp, Artificial Sequence
  Description of Artificial Sequence: Synthetic oligonucleotide
gagagtcggcttctcttcatggcggtc

SEQ ID NO: 281800 - DNA, 27 bp, Artificial Sequence
  Description of Artificial Sequence: Synthetic oligonucleotide
agagtcggcttctcttcatggcggtcc

SEQ ID NO: 281801 - DNA, 26 bp, Artificial Sequence
  Description of Artificial Sequence: Synthetic oligonucleotide
gagtcggcttctcttcatggcggtcc

SEQ ID NO: 281802 - DNA, 27 bp, Artificial Sequence
  Description of Artificial Sequence: Synthetic oligonucleotide
agtcggcttctcttcatggcggtccct

SEQ ID NO: 281803 - DNA, 27 bp, Artificial Sequence
  Description of Artificial Sequence: Synthetic oligonucleotide
gtcggcttctcttcatggcggtcccta

SEQ ID NO: 281804 - DNA, 27 bp, Artificial Sequence
  Description of Artificial Sequence: Synthetic oligonucleotide
tcggcttctcttcatggcggtccctag

SEQ ID NO: 281805 - DNA, 27 bp, Artificial Sequence
  Description of Artificial Sequence: Synthetic oligonucleotide
cggcttctcttcatggcggtccctaga

SEQ ID NO: 281806 - DNA, 27 bp, Artificial Sequence
  Description of Artificial Sequence: Synthetic oligonucleotide
ggcttctcttcatggcggtccctagag

SEQ ID NO: 281807 - DNA, 31 bp, Artificial Sequence
  Description of Artificial Sequence: Synthetic oligonucleotide
gcttctcttcatggcggtccctagagaaaag

SEQ ID NO: 281808 - DNA, 31 bp, Artificial Sequence
  Description of Artificial Sequence: Synthetic oligonucleotide
cttctcttcatggcggtccctagagaaaagg

SEQ ID NO: 281809 - DNA, 31 bp, Artificial Sequence
  Description of Artificial Sequence: Synthetic oligonucleotide
ttctcttcatggcggtccctagagaaaaggc

SEQ ID NO: 281810 - DNA, 30 bp, Artificial Sequence
  Description of Artificial Sequence: Synthetic oligonucleotide
tctcttcatggcggtccctagagaaaaggc

SEQ ID NO: 281811 - DNA, 29 bp, Artificial Sequence
  Description of Artificial Sequence: Synthetic oligonucleotide
ctcttcatggcggtccctagagaaaaggc

SEQ ID NO: 281812 - DNA, 29 bp, Artificial Sequence
  Description of Artificial Sequence: Synthetic oligonucleotide
tcttcatggcggtccctagagaaaaggcg

SEQ ID NO: 281813 - DNA, 28 bp, Artificial Sequence
  Description of Artificial Sequence: Synthetic oligonucleotide
cttcatggcggtccctagagaaaaggcg

SEQ ID NO: 281814 - DNA, 28 bp, Artificial Sequence
  Description of Artificial Sequence: Synthetic oligonucleotide
ttcatggcggtccctagagaaaaggcgc

SEQ ID NO: 281815 - DNA, 27 bp, Artificial Sequence
  Description of Artificial Sequence: Synthetic oligonucleotide
tcatggcggtccctagagaaaaggcgc

SEQ ID NO: 281816 - DNA, 27 bp, Artificial Sequence
  Description of Artificial Sequence: Synthetic oligonucleotide
catggcggtccctagagaaaaggcgct

SEQ ID NO: 281817 - DNA, 28 bp, Artificial Sequence
  Description of Artificial Sequence: Synthetic oligonucleotide
atggcggtccctagagaaaaggcgcttg

SEQ ID NO: 281818 - DNA, 27 bp, Artificial Sequence
  Description of Artificial Sequence: Synthetic oligonucleotide
tggcggtccctagagaaaaggcgcttg

SEQ ID NO: 281819 - DNA, 27 bp, Artificial Sequence
  Description of Artificial Sequence: Synthetic oligonucleotide
ggcggtccctagagaaaaggcgcttga

SEQ ID NO: 281820 - DNA, 27 bp, Artificial Sequence
  Description of Artificial Sequence: Synthetic oligonucleotide
gcggtccctagagaaaaggcgcttgag

SEQ ID NO: 281821 - DNA, 27 bp, Artificial Sequence
  Description of Artificial Sequence: Synthetic oligonucleotide
cggtccctagagaaaaggcgcttgagg

SEQ ID NO: 281822 - DNA, 28 bp, Artificial Sequence
  Description of Artificial Sequence: Synthetic oligonucleotide
ggtccctagagaaaaggcgcttgaggac

SEQ ID NO: 281823 - DNA, 30 bp, Artificial Sequence
  Description of Artificial Sequence: Synthetic oligonucleotide
gtccctagagaaaaggcgcttgaggactac

SEQ ID NO: 281824 - DNA, 30 bp, Artificial Sequence
  Description of Artificial Sequence: Synthetic oligonucleotide
tccctagagaaaaggcgcttgaggactacc

SEQ ID NO: 281825 - DNA, 29 bp, Artificial Sequence
  Description of Artificial Sequence: Synthetic oligonucleotide
ccctagagaaaaggcgcttgaggactacc

SEQ ID NO: 281826 - DNA, 29 bp, Artificial Sequence
  Description of Artificial Sequence: Synthetic oligonucleotide
cctagagaaaaggcgcttgaggactaccc

SEQ ID NO: 281827 - DNA, 29 bp, Artificial Sequence
  Description of Artificial Sequence: Synthetic oligonucleotide
ctagagaaaaggcgcttgaggactacccc

SEQ ID NO: 281828 - DNA, 31 bp, Artificial Sequence
  Description of Artificial Sequence: Synthetic oligonucleotide
tagagaaaaggcgcttgaggactaccccaag

SEQ ID NO: 281829 - DNA, 30 bp, Artificial Sequence
  Description of Artificial Sequence: Synthetic oligonucleotide
agagaaaaggcgcttgaggactaccccaag

SEQ ID NO: 281830 - DNA, 29 bp, Artificial Sequence
  Description of Artificial Sequence: Synthetic oligonucleotide
gagaaaaggcgcttgaggactaccccaag

SEQ ID NO: 281831 - DNA, 31 bp, Artificial Sequence
  Description of Artificial Sequence: Synthetic oligonucleotide
agaaaaggcgcttgaggactaccccaagaag

SEQ ID NO: 281832 - DNA, 30 bp, Artificial Sequence
  Description of Artificial Sequence: Synthetic oligonucleotide
gaaaaggcgcttgaggactaccccaagaag

SEQ ID NO: 281833 - DNA, 32 bp, Artificial Sequence
  Description of Artificial Sequence: Synthetic oligonucleotide
aaaaggcgcttgaggactaccccaagaagttc

SEQ ID NO: 281834 - DNA, 31 bp, Artificial Sequence
  Description of Artificial Sequence: Synthetic oligonucleotide
aaaggcgcttgaggactaccccaagaagttc

SEQ ID NO: 281835 - DNA, 30 bp, Artificial Sequence
  Description of Artificial Sequence: Synthetic oligonucleotide
aaggcgcttgaggactaccccaagaagttc

SEQ ID NO: 281836 - DNA, 29 bp, Artificial Sequence
  Description of Artificial Sequence: Synthetic oligonucleotide
aggcgcttgaggactaccccaagaagttc

SEQ ID NO: 281837 - DNA, 28 bp, Artificial Sequence
  Description of Artificial Sequence: Synthetic oligonucleotide
ggcgcttgaggactaccccaagaagttc

SEQ ID NO: 281838 - DNA, 28 bp, Artificial Sequence
  Description of Artificial Sequence: Synthetic oligonucleotide
gcgcttgaggactaccccaagaagttcc

SEQ ID NO: 281839 - DNA, 30 bp, Artificial Sequence
  Description of Artificial Sequence: Synthetic oligonucleotide
cgcttgaggactaccccaagaagttccttg

SEQ ID NO: 281840 - DNA, 32 bp, Artificial Sequence
  Description of Artificial Sequence: Synthetic oligonucleotide
gcttgaggactaccccaagaagttccttgaac

SEQ ID NO: 281841 - DNA, 33 bp, Artificial Sequence
  Description of Artificial Sequence: Synthetic oligonucleotide
cttgaggactaccccaagaagttccttgaacac

SEQ ID NO: 281842 - DNA, 35 bp, Artificial Sequence
  Description of Artificial Sequence: Synthetic oligonucleotide
ttgaggactaccccaagaagttccttgaacactag

SEQ ID NO: 281843 - DNA, 34 bp, Artificial Sequence
  Description of Artificial Sequence: Synthetic oligonucleotide
tgaggactaccccaagaagttccttgaacactag

SEQ ID NO: 281844 - DNA, 33 bp, Artificial Sequence
  Description of Artificial Sequence: Synthetic oligonucleotide
gaggactaccccaagaagttccttgaacactag

SEQ ID NO: 281845 - DNA, 33 bp, Artificial Sequence
  Description of Artificial Sequence: Synthetic oligonucleotide
aggactaccccaagaagttccttgaacactagg

SEQ ID NO: 281846 - DNA, 32 bp, Artificial Sequence
  Description of Artificial Sequence: Synthetic oligonucleotide
ggactaccccaagaagttccttgaacactagg

SEQ ID NO: 281847 - DNA, 33 bp, Artificial Sequence
  Description of Artificial Sequence: Synthetic oligonucleotide
gactaccccaagaagttccttgaacactaggag

SEQ ID NO: 281848 - DNA, 35 bp, Artificial Sequence
  Description of Artificial Sequence: Synthetic oligonucleotide
actaccccaagaagttccttgaacactaggagatc

SEQ ID NO: 281849 - DNA, 34 bp, Artificial Sequence
  Description of Artificial Sequence: Synthetic oligonucleotide
ctaccccaagaagttccttgaacactaggagatc

SEQ ID NO: 281850 - DNA, 34 bp, Artificial Sequence
  Description of Artificial Sequence: Synthetic oligonucleotide
taccccaagaagttccttgaacactaggagatcg

SEQ ID NO: 281851 - DNA, 33 bp, Artificial Sequence
  Description of Artificial Sequence: Synthetic oligonucleotide
accccaagaagttccttgaacactaggagatcg

SEQ ID NO: 281852 - DNA, 32 bp, Artificial Sequence
  Description of Artificial Sequence: Synthetic oligonucleotide
ccccaagaagttccttgaacactaggagatcg

SEQ ID NO: 281853 - DNA, 33 bp, Artificial Sequence
  Description of Artificial Sequence: Synthetic oligonucleotide
cccaagaagttccttgaacactaggagatcgtc

SEQ ID NO: 281854 - DNA, 33 bp, Artificial Sequence
  Description of Artificial Sequence: Synthetic oligonucleotide
ccaagaagttccttgaacactaggagatcgtcg

SEQ ID NO: 281855 - DNA, 33 bp, Artificial Sequence
  Description of Artificial Sequence: Synthetic oligonucleotide
caagaagttccttgaacactaggagatcgtcgg

SEQ ID NO: 281856 - DNA, 33 bp, Artificial Sequence
  Description of Artificial Sequence: Synthetic oligonucleotide
aagaagttccttgaacactaggagatcgtcggc

SEQ ID NO: 281857 - DNA, 32 bp, Artificial Sequence
  Description of Artificial Sequence: Synthetic oligonucleotide
agaagttccttgaacactaggagatcgtcggc

SEQ ID NO: 281858 - DNA, 31 bp, Artificial Sequence
  Description of Artificial Sequence: Synthetic oligonucleotide
gaagttccttgaacactaggagatcgtcggc

SEQ ID NO: 281859 - DNA, 31 bp, Artificial Sequence
  Description of Artificial Sequence: Synthetic oligonucleotide
aagttccttgaacactaggagatcgtcggcc

SEQ ID NO: 281860 - DNA, 30 bp, Artificial Sequence
  Description of Artificial Sequence: Synthetic oligonucleotide
agttccttgaacactaggagatcgtcggcc

SEQ ID NO: 281861 - DNA, 29 bp, Artificial Sequence
  Description of Artificial Sequence: Synthetic oligonucleotide
gttccttgaacactaggagatcgtcggcc

SEQ ID NO: 281862 - DNA, 29 bp, Artificial Sequence
  Description of Artificial Sequence: Synthetic oligonucleotide
ttccttgaacactaggagatcgtcggccg

SEQ ID NO: 281863 - DNA, 28 bp, Artificial Sequence
  Description of Artificial Sequence: Synthetic oligonucleotide
tccttgaacactaggagatcgtcggccg

SEQ ID NO: 281864 - DNA, 27 bp, Artificial Sequence
  Description of Artificial Sequence: Synthetic oligonucleotide
ccttgaacactaggagatcgtcggccg

SEQ ID NO: 281865 - DNA, 28 bp, Artificial Sequence
  Description of Artificial Sequence: Synthetic oligonucleotide
cttgaacactaggagatcgtcggccgtc

SEQ ID NO: 281866 - DNA, 32 bp, Artificial Sequence
  Description of Artificial Sequence: Synthetic oligonucleotide
ttgaacactaggagatcgtcggccgtctaaag

SEQ ID NO: 281867 - DNA, 31 bp, Artificial Sequence
  Description of Artificial Sequence: Synthetic oligonucleotide
tgaacactaggagatcgtcggccgtctaaag

SEQ ID NO: 281868 - DNA, 30 bp, Artificial Sequence
  Description of Artificial Sequence: Synthetic oligonucleotide
gaacactaggagatcgtcggccgtctaaag

SEQ ID NO: 281869 - DNA, 30 bp, Artificial Sequence
  Description of Artificial Sequence: Synthetic oligonucleotide
aacactaggagatcgtcggccgtctaaagg

SEQ ID NO: 281870 - DNA, 29 bp, Artificial Sequence
  Description of Artificial Sequence: Synthetic oligonucleotide
acactaggagatcgtcggccgtctaaagg

SEQ ID NO: 281871 - DNA, 28 bp, Artificial Sequence
  Description of Artificial Sequence: Synthetic oligonucleotide
cactaggagatcgtcggccgtctaaagg

SEQ ID NO: 281872 - DNA, 29 bp, Artificial Sequence
  Description of Artificial Sequence: Synthetic oligonucleotide
actaggagatcgtcggccgtctaaaggag

SEQ ID NO: 281873 - DNA, 28 bp, Artificial Sequence
  Description of Artificial Sequence: Synthetic oligonucleotide
ctaggagatcgtcggccgtctaaaggag

SEQ ID NO: 281874 - DNA, 32 bp, Artificial Sequence
  Description of Artificial Sequence: Synthetic oligonucleotide
taggagatcgtcggccgtctaaaggagttatg

SEQ ID NO: 281875 - DNA, 31 bp, Artificial Sequence
  Description of Artificial Sequence: Synthetic oligonucleotide
aggagatcgtcggccgtctaaaggagttatg

SEQ ID NO: 281876 - DNA, 30 bp, Artificial Sequence
  Description of Artificial Sequence: Synthetic oligonucleotide
ggagatcgtcggccgtctaaaggagttatg

SEQ ID NO: 281877 - DNA, 30 bp, Artificial Sequence
  Description of Artificial Sequence: Synthetic oligonucleotide
gagatcgtcggccgtctaaaggagttatgg

SEQ ID NO: 281878 - DNA, 30 bp, Artificial Sequence
  Description of Artificial Sequence: Synthetic oligonucleotide
agatcgtcggccgtctaaaggagttatggg

SEQ ID NO: 281879 - DNA, 29 bp, Artificial Sequence
  Description of Artificial Sequence: Synthetic oligonucleotide
gatcgtcggccgtctaaaggagttatggg

SEQ ID NO: 281880 - DNA, 31 bp, Artificial Sequence
  Description of Artificial Sequence: Synthetic oligonucleotide
atcgtcggccgtctaaaggagttatgggaac

SEQ ID NO: 281881 - DNA, 30 bp, Artificial Sequence
  Description of Artificial Sequence: Synthetic oligonucleotide
tcgtcggccgtctaaaggagttatgggaac

SEQ ID NO: 281882 - DNA, 29 bp, Artificial Sequence
  Description of Artificial Sequence: Synthetic oligonucleotide
cgtcggccgtctaaaggagttatgggaac

SEQ ID NO: 281883 - DNA, 37 bp, Artificial Sequence
  Description of Artificial Sequence: Synthetic oligonucleotide
gtcggccgtctaaaggagttatgggaacaataaaaag

SEQ ID NO: 281884 - DNA, 39 bp, Artificial Sequence
  Description of Artificial Sequence: Synthetic oligonucleotide
tcggccgtctaaaggagttatgggaacaataaaaagaac

SEQ ID NO: 281885 - DNA, 38 bp, Artificial Sequence
  Description of Artificial Sequence: Synthetic oligonucleotide
cggccgtctaaaggagttatgggaacaataaaaagaac

SEQ ID NO: 281886 - DNA, 41 bp, Artificial Sequence
  Description of Artificial Sequence: Synthetic oligonucleotide
ggccgtctaaaggagttatgggaacaataaaaagaactaac

SEQ ID NO: 281887 - DNA, 41 bp, Artificial Sequence
  Description of Artificial Sequence: Synthetic oligonucleotide
gccgtctaaaggagttatgggaacaataaaaagaactaacc

SEQ ID NO: 281888 - DNA, 43 bp, Artificial Sequence
  Description of Artificial Sequence: Synthetic oligonucleotide
ccgtctaaaggagttatgggaacaataaaaagaactaaccaag

SEQ ID NO: 281889 - DNA, 43 bp, Artificial Sequence
  Description of Artificial Sequence: Synthetic oligonucleotide
cgtctaaaggagttatgggaacaataaaaagaactaaccaagc

SEQ ID NO: 281890 - DNA, 44 bp, Artificial Sequence
  Description of Artificial Sequence: Synthetic oligonucleotide
gtctaaaggagttatgggaacaataaaaagaactaaccaagcag

SEQ ID NO: 281891 - DNA, 47 bp, Artificial Sequence
  Description of Artificial Sequence: Synthetic oligonucleotide
tctaaaggagttatgggaacaataaaaagaactaaccaagcagaatg

SEQ ID NO: 281892 - DNA, 46 bp, Artificial Sequence
  Description of Artificial Sequence: Synthetic oligonucleotide
ctaaaggagttatgggaacaataaaaagaactaaccaagcagaatg

SEQ ID NO: 281893 - DNA, 50 bp, Artificial Sequence
  Description of Artificial Sequence: Synthetic oligonucleotide
taaaggagttatgggaacaataaaaagaactaaccaagcagaatgaaaag

SEQ ID NO: 281894 - DNA, 49 bp, Artificial Sequence
  Description of Artificial Sequence: Synthetic oligonucleotide
aaaggagttatgggaacaataaaaagaactaaccaagcagaatgaaaag

SEQ ID NO: 281895 - DNA, 48 bp, Artificial Sequence
  Description of Artificial Sequence: Synthetic oligonucleotide
aaggagttatgggaacaataaaaagaactaaccaagcagaatgaaaag

SEQ ID NO: 281896 - DNA, 47 bp, Artificial Sequence
  Description of Artificial Sequence: Synthetic oligonucleotide
aggagttatgggaacaataaaaagaactaaccaagcagaatgaaaag

SEQ ID NO: 281897 - DNA, 46 bp, Artificial Sequence
  Description of Artificial Sequence: Synthetic oligonucleotide
ggagttatgggaacaataaaaagaactaaccaagcagaatgaaaag

SEQ ID NO: 281898 - DNA, 47 bp, Artificial Sequence
  Description of Artificial Sequence: Synthetic oligonucleotide
gagttatgggaacaataaaaagaactaaccaagcagaatgaaaagtg

SEQ ID NO: 281899 - DNA, 48 bp, Artificial Sequence
  Description of Artificial Sequence: Synthetic oligonucleotide
agttatgggaacaataaaaagaactaaccaagcagaatgaaaagtgtg

SEQ ID NO: 281900 - DNA, 47 bp, Artificial Sequence
  Description of Artificial Sequence: Synthetic oligonucleotide
gttatgggaacaataaaaagaactaaccaagcagaatgaaaagtgtg

SEQ ID NO: 281901 - DNA, 52 bp, Artificial Sequence
  Description of Artificial Sequence: Synthetic oligonucleotide
ttatgggaacaataaaaagaactaaccaagcagaatgaaaagtgtgaaaatg

SEQ ID NO: 281902 - DNA, 51 bp, Artificial Sequence
  Description of Artificial Sequence: Synthetic oligonucleotide
tatgggaacaataaaaagaactaaccaagcagaatgaaaagtgtgaaaatg

SEQ ID NO: 281903 - DNA, 50 bp, Artificial Sequence
  Description of Artificial Sequence: Synthetic oligonucleotide
atgggaacaataaaaagaactaaccaagcagaatgaaaagtgtgaaaatg

SEQ ID NO: 281904 - DNA, 49 bp, Artificial Sequence
  Description of Artificial Sequence: Synthetic oligonucleotide
tgggaacaataaaaagaactaaccaagcagaatgaaaagtgtgaaaatg

SEQ ID NO: 281905 - DNA, 48 bp, Artificial Sequence
  Description of Artificial Sequence: Synthetic oligonucleotide
gggaacaataaaaagaactaaccaagcagaatgaaaagtgtgaaaatg

SEQ ID NO: 281906 - DNA, 50 bp, Artificial Sequence
  Description of Artificial Sequence: Synthetic oligonucleotide
ggaacaataaaaagaactaaccaagcagaatgaaaagtgtgaaaatgaac

SEQ ID NO: 281907 - DNA, 51 bp, Artificial Sequence
  Description of Artificial Sequence: Synthetic oligonucleotide
gaacaataaaaagaactaaccaagcagaatgaaaagtgtgaaaatgaactg

SEQ ID NO: 281908 - DNA, 53 bp, Artificial Sequence
  Description of Artificial Sequence: Synthetic oligonucleotide
aacaataaaaagaactaaccaagcagaatgaaaagtgtgaaaatgaactgaag

SEQ ID NO: 281909 - DNA, 52 bp, Artificial Sequence
  Description of Artificial Sequence: Synthetic oligonucleotide
acaataaaaagaactaaccaagcagaatgaaaagtgtgaaaatgaactgaag

SEQ ID NO: 281910 - DNA, 51 bp, Artificial Sequence
  Description of Artificial Sequence: Synthetic oligonucleotide
caataaaaagaactaaccaagcagaatgaaaagtgtgaaaatgaactgaag

SEQ ID NO: 281911 - DNA, 51 bp, Artificial Sequence
  Description of Artificial Sequence: Synthetic oligonucleotide
aataaaaagaactaaccaagcagaatgaaaagtgtgaaaatgaactgaagg

SEQ ID NO: 281912 - DNA, 50 bp, Artificial Sequence
  Description of Artificial Sequence: Synthetic oligonucleotide
ataaaaagaactaaccaagcagaatgaaaagtgtgaaaatgaactgaagg

SEQ ID NO: 281913 - DNA, 49 bp, Artificial Sequence
  Description of Artificial Sequence: Synthetic oligonucleotide
taaaaagaactaaccaagcagaatgaaaagtgtgaaaatgaactgaagg

SEQ ID NO: 281914 - DNA, 48 bp, Artificial Sequence
  Description of Artificial Sequence: Synthetic oligonucleotide
aaaaagaactaaccaagcagaatgaaaagtgtgaaaatgaactgaagg

SEQ ID NO: 281915 - DNA, 47 bp, Artificial Sequence
  Description of Artificial Sequence: Synthetic oligonucleotide
aaaagaactaaccaagcagaatgaaaagtgtgaaaatgaactgaagg

SEQ ID NO: 281916 - DNA, 46 bp, Artificial Sequence
  Description of Artificial Sequence: Synthetic oligonucleotide
aaagaactaaccaagcagaatgaaaagtgtgaaaatgaactgaagg

SEQ ID NO: 281917 - DNA, 45 bp, Artificial Sequence
  Description of Artificial Sequence: Synthetic oligonucleotide
aagaactaaccaagcagaatgaaaagtgtgaaaatgaactgaagg

SEQ ID NO: 281918 - DNA, 44 bp, Artificial Sequence
  Description of Artificial Sequence: Synthetic oligonucleotide
agaactaaccaagcagaatgaaaagtgtgaaaatgaactgaagg

SEQ ID NO: 281919 - DNA, 43 bp, Artificial Sequence
  Description of Artificial Sequence: Synthetic oligonucleotide
gaactaaccaagcagaatgaaaagtgtgaaaatgaactgaagg

SEQ ID NO: 281920 - DNA, 43 bp, Artificial Sequence
  Description of Artificial Sequence: Synthetic oligonucleotide
aactaaccaagcagaatgaaaagtgtgaaaatgaactgaaggc

SEQ ID NO: 281921 - DNA, 42 bp, Artificial Sequence
  Description of Artificial Sequence: Synthetic oligonucleotide
actaaccaagcagaatgaaaagtgtgaaaatgaactgaaggc

SEQ ID NO: 281922 - DNA, 41 bp, Artificial Sequence
  Description of Artificial Sequence: Synthetic oligonucleotide
ctaaccaagcagaatgaaaagtgtgaaaatgaactgaaggc

SEQ ID NO: 281923 - DNA, 41 bp, Artificial Sequence
  Description of Artificial Sequence: Synthetic oligonucleotide
taaccaagcagaatgaaaagtgtgaaaatgaactgaaggcc

SEQ ID NO: 281924 - DNA, 40 bp, Artificial Sequence
  Description of Artificial Sequence: Synthetic oligonucleotide
aaccaagcagaatgaaaagtgtgaaaatgaactgaaggcc

SEQ ID NO: 281925 - DNA, 39 bp, Artificial Sequence
  Description of Artificial Sequence: Synthetic oligonucleotide
accaagcagaatgaaaagtgtgaaaatgaactgaaggcc

SEQ ID NO: 281926 - DNA, 38 bp, Artificial Sequence
  Description of Artificial Sequence: Synthetic oligonucleotide
ccaagcagaatgaaaagtgtgaaaatgaactgaaggcc

SEQ ID NO: 281927 - DNA, 38 bp, Artificial Sequence
  Description of Artificial Sequence: Synthetic oligonucleotide
caagcagaatgaaaagtgtgaaaatgaactgaaggccg

SEQ ID NO: 281928 - DNA, 40 bp, Artificial Sequence
  Description of Artificial Sequence: Synthetic oligonucleotide
aagcagaatgaaaagtgtgaaaatgaactgaaggccgtac

SEQ ID NO: 281929 - DNA, 39 bp, Artificial Sequence
  Description of Artificial Sequence: Synthetic oligonucleotide
agcagaatgaaaagtgtgaaaatgaactgaaggccgtac

SEQ ID NO: 281930 - DNA, 38 bp, Artificial Sequence
  Description of Artificial Sequence: Synthetic oligonucleotide
gcagaatgaaaagtgtgaaaatgaactgaaggccgtac

SEQ ID NO: 281931 - DNA, 39 bp, Artificial Sequence
  Description of Artificial Sequence: Synthetic oligonucleotide
cagaatgaaaagtgtgaaaatgaactgaaggccgtacag

SEQ ID NO: 281932 - DNA, 40 bp, Artificial Sequence
  Description of Artificial Sequence: Synthetic oligonucleotide
agaatgaaaagtgtgaaaatgaactgaaggccgtacagag

SEQ ID NO: 281933 - DNA, 39 bp, Artificial Sequence
  Description of Artificial Sequence: Synthetic oligonucleotide
gaatgaaaagtgtgaaaatgaactgaaggccgtacagag

SEQ ID NO: 281934 - DNA, 40 bp, Artificial Sequence
  Description of Artificial Sequence: Synthetic oligonucleotide
aatgaaaagtgtgaaaatgaactgaaggccgtacagagtg

SEQ ID NO: 281935 - DNA, 39 bp, Artificial Sequence
  Description of Artificial Sequence: Synthetic oligonucleotide
atgaaaagtgtgaaaatgaactgaaggccgtacagagtg

SEQ ID NO: 281936 - DNA, 38 bp, Artificial Sequence
  Description of Artificial Sequence: Synthetic oligonucleotide
tgaaaagtgtgaaaatgaactgaaggccgtacagagtg

SEQ ID NO: 281937 - DNA, 37 bp, Artificial Sequence
  Description of Artificial Sequence: Synthetic oligonucleotide
gaaaagtgtgaaaatgaactgaaggccgtacagagtg

SEQ ID NO: 281938 - DNA, 39 bp, Artificial Sequence
  Description of Artificial Sequence: Synthetic oligonucleotide
aaaagtgtgaaaatgaactgaaggccgtacagagtgatg

SEQ ID NO: 281939 - DNA, 38 bp, Artificial Sequence
  Description of Artificial Sequence: Synthetic oligonucleotide
aaagtgtgaaaatgaactgaaggccgtacagagtgatg

SEQ ID NO: 281940 - DNA, 37 bp, Artificial Sequence
  Description of Artificial Sequence: Synthetic oligonucleotide
aagtgtgaaaatgaactgaaggccgtacagagtgatg

SEQ ID NO: 281941 - DNA, 36 bp, Artificial Sequence
  Description of Artificial Sequence: Synthetic oligonucleotide
agtgtgaaaatgaactgaaggccgtacagagtgatg

SEQ ID NO: 281942 - DNA, 35 bp, Artificial Sequence
  Description of Artificial Sequence: Synthetic oligonucleotide
gtgtgaaaatgaactgaaggccgtacagagtgatg

SEQ ID NO: 281943 - DNA, 35 bp, Artificial Sequence
  Description of Artificial Sequence: Synthetic oligonucleotide
tgtgaaaatgaactgaaggccgtacagagtgatgg

SEQ ID NO: 281944 - DNA, 34 bp, Artificial Sequence
  Description of Artificial Sequence: Synthetic oligonucleotide
gtgaaaatgaactgaaggccgtacagagtgatgg

SEQ ID NO: 281945 - DNA, 34 bp, Artificial Sequence
  Description of Artificial Sequence: Synthetic oligonucleotide
tgaaaatgaactgaaggccgtacagagtgatggg

SEQ ID NO: 281946 - DNA, 33 bp, Artificial Sequence
  Description of Artificial Sequence: Synthetic oligonucleotide
gaaaatgaactgaaggccgtacagagtgatggg

SEQ ID NO: 281947 - DNA, 33 bp, Artificial Sequence
  Description of Artificial Sequence: Synthetic oligonucleotide
aaaatgaactgaaggccgtacagagtgatgggc

SEQ ID NO: 281948 - DNA, 32 bp, Artificial Sequence
  Description of Artificial Sequence: Synthetic oligonucleotide
aaatgaactgaaggccgtacagagtgatgggc

SEQ ID NO: 281949 - DNA, 31 bp, Artificial Sequence
  Description of Artificial Sequence: Synthetic oligonucleotide
aatgaactgaaggccgtacagagtgatgggc

SEQ ID NO: 281950 - DNA, 30 bp, Artificial Sequence
  Description of Artificial Sequence: Synthetic oligonucleotide
atgaactgaaggccgtacagagtgatgggc

SEQ ID NO: 281951 - DNA, 29 bp, Artificial Sequence
  Description of Artificial Sequence: Synthetic oligonucleotide
tgaactgaaggccgtacagagtgatgggc

SEQ ID NO: 281952 - DNA, 28 bp, Artificial Sequence
  Description of Artificial Sequence: Synthetic oligonucleotide
gaactgaaggccgtacagagtgatgggc

SEQ ID NO: 281953 - DNA, 29 bp, Artificial Sequence
  Description of Artificial Sequence: Synthetic oligonucleotide
aactgaaggccgtacagagtgatgggcag

SEQ ID NO: 281954 - DNA, 28 bp, Artificial Sequence
  Description of Artificial Sequence: Synthetic oligonucleotide
actgaaggccgtacagagtgatgggcag

SEQ ID NO: 281955 - DNA, 27 bp, Artificial Sequence
  Description of Artificial Sequence: Synthetic oligonucleotide
ctgaaggccgtacagagtgatgggcag

SEQ ID NO: 281956 - DNA, 29 bp, Artificial Sequence
  Description of Artificial Sequence: Synthetic oligonucleotide
tgaaggccgtacagagtgatgggcagatg

SEQ ID NO: 281957 - DNA, 28 bp, Artificial Sequence
  Description of Artificial Sequence: Synthetic oligonucleotide
gaaggccgtacagagtgatgggcagatg

SEQ ID NO: 281958 - DNA, 28 bp, Artificial Sequence
  Description of Artificial Sequence: Synthetic oligonucleotide
aaggccgtacagagtgatgggcagatgg

SEQ ID NO: 281959 - DNA, 27 bp, Artificial Sequence
  Description of Artificial Sequence: Synthetic oligonucleotide
aggccgtacagagtgatgggcagatgg

SEQ ID NO: 281960 - DNA, 27 bp, Artificial Sequence
  Description of Artificial Sequence: Synthetic oligonucleotide
ggccgtacagagtgatgggcagatggt

SEQ ID NO: 281961 - DNA, 27 bp, Artificial Sequence
  Description of Artificial Sequence: Synthetic oligonucleotide
gccgtacagagtgatgggcagatggtg

SEQ ID NO: 281962 - DNA, 27 bp, Artificial Sequence
  Description of Artificial Sequence: Synthetic oligonucleotide
ccgtacagagtgatgggcagatggtgg

SEQ ID NO: 281963 - DNA, 27 bp, Artificial Sequence
  Description of Artificial Sequence: Synthetic oligonucleotide
cgtacagagtgatgggcagatggtggg

SEQ ID NO: 281964 - DNA, 28 bp, Artificial Sequence
  Description of Artificial Sequence: Synthetic oligonucleotide
gtacagagtgatgggcagatggtgggtg

SEQ ID NO: 281965 - DNA, 30 bp, Artificial Sequence
  Description of Artificial Sequence: Synthetic oligonucleotide
tacagagtgatgggcagatggtgggtgaac

SEQ ID NO: 281966 - DNA, 29 bp, Artificial Sequence
  Description of Artificial Sequence: Synthetic oligonucleotide
acagagtgatgggcagatggtgggtgaac

SEQ ID NO: 281967 - DNA, 28 bp, Artificial Sequence
  Description of Artificial Sequence: Synthetic oligonucleotide
cagagtgatgggcagatggtgggtgaac

SEQ ID NO: 281968 - DNA, 29 bp, Artificial Sequence
  Description of Artificial Sequence: Synthetic oligonucleotide
agagtgatgggcagatggtgggtgaactg

SEQ ID NO: 281969 - DNA, 28 bp, Artificial Sequence
  Description of Artificial Sequence: Synthetic oligonucleotide
gagtgatgggcagatggtgggtgaactg

SEQ ID NO: 281970 - DNA, 28 bp, Artificial Sequence
  Description of Artificial Sequence: Synthetic oligonucleotide
agtgatgggcagatggtgggtgaactgc

SEQ ID NO: 281971 - DNA, 27 bp, Artificial Sequence
  Description of Artificial Sequence: Synthetic oligonucleotide
gtgatgggcagatggtgggtgaactgc

SEQ ID NO: 281972 - DNA, 32 bp, Artificial Sequence
  Description of Artificial Sequence: Synthetic oligonucleotide
tgatgggcagatggtgggtgaactgcttaaac

SEQ ID NO: 281973 - DNA, 31 bp, Artificial Sequence
  Description of Artificial Sequence: Synthetic oligonucleotide
gatgggcagatggtgggtgaactgcttaaac

SEQ ID NO: 281974 - DNA, 32 bp, Artificial Sequence
  Description of Artificial Sequence: Synthetic oligonucleotide
atgggcagatggtgggtgaactgcttaaactg

SEQ ID NO: 281975 - DNA, 31 bp, Artificial Sequence
  Description of Artificial Sequence: Synthetic oligonucleotide
tgggcagatggtgggtgaactgcttaaactg

SEQ ID NO: 281976 - DNA, 30 bp, Artificial Sequence
  Description of Artificial Sequence: Synthetic oligonucleotide
gggcagatggtgggtgaactgcttaaactg

SEQ ID NO: 281977 - DNA, 34 bp, Artificial Sequence
  Description of Artificial Sequence: Synthetic oligonucleotide
ggcagatggtgggtgaactgcttaaactgttaac

SEQ ID NO: 281978 - DNA, 35 bp, Artificial Sequence
  Description of Artificial Sequence: Synthetic oligonucleotide
gcagatggtgggtgaactgcttaaactgttaactg

SEQ ID NO: 281979 - DNA, 37 bp, Artificial Sequence
  Description of Artificial Sequence: Synthetic oligonucleotide
cagatggtgggtgaactgcttaaactgttaactgatg

SEQ ID NO: 281980 - DNA, 44 bp, Artificial Sequence
  Description of Artificial Sequence: Synthetic oligonucleotide
agatggtgggtgaactgcttaaactgttaactgatgaaaaattc

SEQ ID NO: 281981 - DNA, 43 bp, Artificial Sequence
  Description of Artificial Sequence: Synthetic oligonucleotide
gatggtgggtgaactgcttaaactgttaactgatgaaaaattc

SEQ ID NO: 281982 - DNA, 46 bp, Artificial Sequence
  Description of Artificial Sequence: Synthetic oligonucleotide
atggtgggtgaactgcttaaactgttaactgatgaaaaattctttg

SEQ ID NO: 281983 - DNA, 45 bp, Artificial Sequence
  Description of Artificial Sequence: Synthetic oligonucleotide
tggtgggtgaactgcttaaactgttaactgatgaaaaattctttg

SEQ ID NO: 281984 - DNA, 44 bp, Artificial Sequence
  Description of Artificial Sequence: Synthetic oligonucleotide
ggtgggtgaactgcttaaactgttaactgatgaaaaattctttg

SEQ ID NO: 281985 - DNA, 49 bp, Artificial Sequence
  Description of Artificial Sequence: Synthetic oligonucleotide
gtgggtgaactgcttaaactgttaactgatgaaaaattctttgttaaag

SEQ ID NO: 281986 - DNA, 49 bp, Artificial Sequence
  Description of Artificial Sequence: Synthetic oligonucleotide
tgggtgaactgcttaaactgttaactgatgaaaaattctttgttaaagg

SEQ ID NO: 281987 - DNA, 48 bp, Artificial Sequence
  Description of Artificial Sequence: Synthetic oligonucleotide
gggtgaactgcttaaactgttaactgatgaaaaattctttgttaaagg

SEQ ID NO: 281988 - DNA, 50 bp, Artificial Sequence
  Description of Artificial Sequence: Synthetic oligonucleotide
ggtgaactgcttaaactgttaactgatgaaaaattctttgttaaaggtac

SEQ ID NO: 281989 - DNA, 50 bp, Artificial Sequence
  Description of Artificial Sequence: Synthetic oligonucleotide
gtgaactgcttaaactgttaactgatgaaaaattctttgttaaaggtacc

SEQ ID NO: 281990 - DNA, 53 bp, Artificial Sequence
  Description of Artificial Sequence: Synthetic oligonucleotide
tgaactgcttaaactgttaactgatgaaaaattctttgttaaaggtaccaatg

SEQ ID NO: 281991 - DNA, 52 bp, Artificial Sequence
  Description of Artificial Sequence: Synthetic oligonucleotide
gaactgcttaaactgttaactgatgaaaaattctttgttaaaggtaccaatg

SEQ ID NO: 281992 - DNA, 52 bp, Artificial Sequence
  Description of Artificial Sequence: Synthetic oligonucleotide
aactgcttaaactgttaactgatgaaaaattctttgttaaaggtaccaatgg

SEQ ID NO: 281993 - DNA, 51 bp, Artificial Sequence
  Description of Artificial Sequence: Synthetic oligonucleotide
actgcttaaactgttaactgatgaaaaattctttgttaaaggtaccaatgg

SEQ ID NO: 281994 - DNA, 50 bp, Artificial Sequence
  Description of Artificial Sequence: Synthetic oligonucleotide
ctgcttaaactgttaactgatgaaaaattctttgttaaaggtaccaatgg

SEQ ID NO: 281995 - DNA, 51 bp, Artificial Sequence
  Description of Artificial Sequence: Synthetic oligonucleotide
tgcttaaactgttaactgatgaaaaattctttgttaaaggtaccaatggtc

SEQ ID NO: 281996 - DNA, 50 bp, Artificial Sequence
  Description of Artificial Sequence: Synthetic oligonucleotide
gcttaaactgttaactgatgaaaaattctttgttaaaggtaccaatggtc

SEQ ID NO: 281997 - DNA, 50 bp, Artificial Sequence
  Description of Artificial Sequence: Synthetic oligonucleotide
cttaaactgttaactgatgaaaaattctttgttaaaggtaccaatggtcc

SEQ ID NO: 281998 - DNA, 52 bp, Artificial Sequence
  Description of Artificial Sequence: Synthetic oligonucleotide
ttaaactgttaactgatgaaaaattctttgttaaaggtaccaatggtccaag

SEQ ID NO: 281999 - DNA, 51 bp, Artificial Sequence
  Description of Artificial Sequence: Synthetic oligonucleotide
taaactgttaactgatgaaaaattctttgttaaaggtaccaatggtccaag

SEQ ID NO: 282000 - DNA, 50 bp, Artificial Sequence
  Description of Artificial Sequence: Synthetic oligonucleotide
aaactgttaactgatgaaaaattctttgttaaaggtaccaatggtccaag

SEQ ID NO: 282001 - DNA, 49 bp, Artificial Sequence
  Description of Artificial Sequence: Synthetic oligonucleotide
aactgttaactgatgaaaaattctttgttaaaggtaccaatggtccaag

SEQ ID NO: 282002 - DNA, 48 bp, Artificial Sequence
  Description of Artificial Sequence: Synthetic oligonucleotide
actgttaactgatgaaaaattctttgttaaaggtaccaatggtccaag

SEQ ID NO: 282003 - DNA, 47 bp, Artificial Sequence
  Description of Artificial Sequence: Synthetic oligonucleotide
ctgttaactgatgaaaaattctttgttaaaggtaccaatggtccaag

SEQ ID NO: 282004 - DNA, 51 bp, Artificial Sequence
  Description of Artificial Sequence: Synthetic oligonucleotide
tgttaactgatgaaaaattctttgttaaaggtaccaatggtccaagatatc

SEQ ID NO: 282005 - DNA, 50 bp, Artificial Sequence
  Description of Artificial Sequence: Synthetic oligonucleotide
gttaactgatgaaaaattctttgttaaaggtaccaatggtccaagatatc

SEQ ID NO: 282006 - DNA, 52 bp, Artificial Sequence
  Description of Artificial Sequence: Synthetic oligonucleotide
ttaactgatgaaaaattctttgttaaaggtaccaatggtccaagatatcttg

SEQ ID NO: 282007 - DNA, 51 bp, Artificial Sequence
  Description of Artificial Sequence: Synthetic oligonucleotide
taactgatgaaaaattctttgttaaaggtaccaatggtccaagatatcttg

SEQ ID NO: 282008 - DNA, 50 bp, Artificial Sequence
  Description of Artificial Sequence: Synthetic oligonucleotide
aactgatgaaaaattctttgttaaaggtaccaatggtccaagatatcttg

SEQ ID NO: 282009 - DNA, 49 bp, Artificial Sequence
  Description of Artificial Sequence: Synthetic oligonucleotide
actgatgaaaaattctttgttaaaggtaccaatggtccaagatatcttg

SEQ ID NO: 282010 - DNA, 48 bp, Artificial Sequence
  Description of Artificial Sequence: Synthetic oligonucleotide
ctgatgaaaaattctttgttaaaggtaccaatggtccaagatatcttg

SEQ ID NO: 282011 - DNA, 49 bp, Artificial Sequence
  Description of Artificial Sequence: Synthetic oligonucleotide
tgatgaaaaattctttgttaaaggtaccaatggtccaagatatcttgtg

SEQ ID NO: 282012 - DNA, 48 bp, Artificial Sequence
  Description of Artificial Sequence: Synthetic oligonucleotide
gatgaaaaattctttgttaaaggtaccaatggtccaagatatcttgtg

SEQ ID NO: 282013 - DNA, 48 bp, Artificial Sequence
  Description of Artificial Sequence: Synthetic oligonucleotide
atgaaaaattctttgttaaaggtaccaatggtccaagatatcttgtgg

SEQ ID NO: 282014 - DNA, 47 bp, Artificial Sequence
  Description of Artificial Sequence: Synthetic oligonucleotide
tgaaaaattctttgttaaaggtaccaatggtccaagatatcttgtgg

SEQ ID NO: 282015 - DNA, 46 bp, Artificial Sequence
  Description of Artificial Sequence: Synthetic oligonucleotide
gaaaaattctttgttaaaggtaccaatggtccaagatatcttgtgg

SEQ ID NO: 282016 - DNA, 46 bp, Artificial Sequence
  Description of Artificial Sequence: Synthetic oligonucleotide
aaaaattctttgttaaaggtaccaatggtccaagatatcttgtggg

SEQ ID NO: 282017 - DNA, 45 bp, Artificial Sequence
  Description of Artificial Sequence: Synthetic oligonucleotide
aaaattctttgttaaaggtaccaatggtccaagatatcttgtggg

SEQ ID NO: 282018 - DNA, 44 bp, Artificial Sequence
  Description of Artificial Sequence: Synthetic oligonucleotide
aaattctttgttaaaggtaccaatggtccaagatatcttgtggg

SEQ ID NO: 282019 - DNA, 43 bp, Artificial Sequence
  Description of Artificial Sequence: Synthetic oligonucleotide
aattctttgttaaaggtaccaatggtccaagatatcttgtggg

SEQ ID NO: 282020 - DNA, 42 bp, Artificial Sequence
  Description of Artificial Sequence: Synthetic oligonucleotide
attctttgttaaaggtaccaatggtccaagatatcttgtggg

SEQ ID NO: 282021 - DNA, 41 bp, Artificial Sequence
  Description of Artificial Sequence: Synthetic oligonucleotide
ttctttgttaaaggtaccaatggtccaagatatcttgtggg

SEQ ID NO: 282022 - DNA, 40 bp, Artificial Sequence
  Description of Artificial Sequence: Synthetic oligonucleotide
tctttgttaaaggtaccaatggtccaagatatcttgtggg

SEQ ID NO: 282023 - DNA, 39 bp, Artificial Sequence
  Description of Artificial Sequence: Synthetic oligonucleotide
ctttgttaaaggtaccaatggtccaagatatcttgtggg

SEQ ID NO: 282024 - DNA, 41 bp, Artificial Sequence
  Description of Artificial Sequence: Synthetic oligonucleotide
tttgttaaaggtaccaatggtccaagatatcttgtgggttc

SEQ ID NO: 282025 - DNA, 40 bp, Artificial Sequence
  Description of Artificial Sequence: Synthetic oligonucleotide
ttgttaaaggtaccaatggtccaagatatcttgtgggttc

SEQ ID NO: 282026 - DNA, 39 bp, Artificial Sequence
  Description of Artificial Sequence: Synthetic oligonucleotide
tgttaaaggtaccaatggtccaagatatcttgtgggttc

SEQ ID NO: 282027 - DNA, 38 bp, Artificial Sequence
  Description of Artificial Sequence: Synthetic oligonucleotide
gttaaaggtaccaatggtccaagatatcttgtgggttc

SEQ ID NO: 282028 - DNA, 39 bp, Artificial Sequence
  Description of Artificial Sequence: Synthetic oligonucleotide
ttaaaggtaccaatggtccaagatatcttgtgggttctc

SEQ ID NO: 282029 - DNA, 38 bp, Artificial Sequence
  Description of Artificial Sequence: Synthetic oligonucleotide
taaaggtaccaatggtccaagatatcttgtgggttctc

SEQ ID NO: 282030 - DNA, 37 bp, Artificial Sequence
  Description of Artificial Sequence: Synthetic oligonucleotide
aaaggtaccaatggtccaagatatcttgtgggttctc

SEQ ID NO: 282031 - DNA, 36 bp, Artificial Sequence
  Description of Artificial Sequence: Synthetic oligonucleotide
aaggtaccaatggtccaagatatcttgtgggttctc

SEQ ID NO: 282032 - DNA, 35 bp, Artificial Sequence
  Description of Artificial Sequence: Synthetic oligonucleotide
aggtaccaatggtccaagatatcttgtgggttctc

SEQ ID NO: 282033 - DNA, 34 bp, Artificial Sequence
  Description of Artificial Sequence: Synthetic oligonucleotide
ggtaccaatggtccaagatatcttgtgggttctc

SEQ ID NO: 282034 - DNA, 34 bp, Artificial Sequence
  Description of Artificial Sequence: Synthetic oligonucleotide
gtaccaatggtccaagatatcttgtgggttctcg

SEQ ID NO: 282035 - DNA, 35 bp, Artificial Sequence
  Description of Artificial Sequence: Synthetic oligonucleotide
taccaatggtccaagatatcttgtgggttctcgtc

SEQ ID NO: 282036 - DNA, 34 bp, Artificial Sequence
  Description of Artificial Sequence: Synthetic oligonucleotide
accaatggtccaagatatcttgtgggttctcgtc

SEQ ID NO: 282037 - DNA, 33 bp, Artificial Sequence
  Description of Artificial Sequence: Synthetic oligonucleotide
ccaatggtccaagatatcttgtgggttctcgtc

SEQ ID NO: 282038 - DNA, 33 bp, Artificial Sequence
  Description of Artificial Sequence: Synthetic oligonucleotide
caatggtccaagatatcttgtgggttctcgtcg

SEQ ID NO: 282039 - DNA, 34 bp, Artificial Sequence
  Description of Artificial Sequence: Synthetic oligonucleotide
aatggtccaagatatcttgtgggttctcgtcgac

SEQ ID NO: 282040 - DNA, 33 bp, Artificial Sequence
  Description of Artificial Sequence: Synthetic oligonucleotide
atggtccaagatatcttgtgggttctcgtcgac

SEQ ID NO: 282041 - DNA, 32 bp, Artificial Sequence
  Description of Artificial Sequence: Synthetic oligonucleotide
tggtccaagatatcttgtgggttctcgtcgac

SEQ ID NO: 282042 - DNA, 31 bp, Artificial Sequence
  Description of Artificial Sequence: Synthetic oligonucleotide
ggtccaagatatcttgtgggttctcgtcgac

SEQ ID NO: 282043 - DNA, 32 bp, Artificial Sequence
  Description of Artificial Sequence: Synthetic oligonucleotide
gtccaagatatcttgtgggttctcgtcgacac

SEQ ID NO: 282044 - DNA, 32 bp, Artificial Sequence
  Description of Artificial Sequence: Synthetic oligonucleotide
tccaagatatcttgtgggttctcgtcgacacc

SEQ ID NO: 282045 - DNA, 31 bp, Artificial Sequence
  Description of Artificial Sequence: Synthetic oligonucleotide
ccaagatatcttgtgggttctcgtcgacacc

SEQ ID NO: 282046 - DNA, 33 bp, Artificial Sequence
  Description of Artificial Sequence: Synthetic oligonucleotide
caagatatcttgtgggttctcgtcgacaccttg

SEQ ID NO: 282047 - DNA, 34 bp, Artificial Sequence
  Description of Artificial Sequence: Synthetic oligonucleotide
aagatatcttgtgggttctcgtcgacaccttgac

SEQ ID NO: 282048 - DNA, 33 bp, Artificial Sequence
  Description of Artificial Sequence: Synthetic oligonucleotide
agatatcttgtgggttctcgtcgacaccttgac

SEQ ID NO: 282049 - DNA, 32 bp, Artificial Sequence
  Description of Artificial Sequence: Synthetic oligonucleotide
gatatcttgtgggttctcgtcgacaccttgac

SEQ ID NO: 282050 - DNA, 36 bp, Artificial Sequence
  Description of Artificial Sequence: Synthetic oligonucleotide
atatcttgtgggttctcgtcgacaccttgacaaatg

SEQ ID NO: 282051 - DNA, 35 bp, Artificial Sequence
  Description of Artificial Sequence: Synthetic oligonucleotide
tatcttgtgggttctcgtcgacaccttgacaaatg

SEQ ID NO: 282052 - DNA, 34 bp, Artificial Sequence
  Description of Artificial Sequence: Synthetic oligonucleotide
atcttgtgggttctcgtcgacaccttgacaaatg

SEQ ID NO: 282053 - DNA, 33 bp, Artificial Sequence
  Description of Artificial Sequence: Synthetic oligonucleotide
tcttgtgggttctcgtcgacaccttgacaaatg

SEQ ID NO: 282054 - DNA, 32 bp, Artificial Sequence
  Description of Artificial Sequence: Synthetic oligonucleotide
cttgtgggttctcgtcgacaccttgacaaatg

SEQ ID NO: 282055 - DNA, 35 bp, Artificial Sequence
  Description of Artificial Sequence: Synthetic oligonucleotide
ttgtgggttctcgtcgacaccttgacaaatgtaag

SEQ ID NO: 282056 - DNA, 34 bp, Artificial Sequence
  Description of Artificial Sequence: Synthetic oligonucleotide
tgtgggttctcgtcgacaccttgacaaatgtaag

SEQ ID NO: 282057 - DNA, 33 bp, Artificial Sequence
  Description of Artificial Sequence: Synthetic oligonucleotide
gtgggttctcgtcgacaccttgacaaatgtaag

SEQ ID NO: 282058 - DNA, 33 bp, Artificial Sequence
  Description of Artificial Sequence: Synthetic oligonucleotide
tgggttctcgtcgacaccttgacaaatgtaagc

SEQ ID NO: 282059 - DNA, 32 bp, Artificial Sequence
  Description of Artificial Sequence: Synthetic oligonucleotide
gggttctcgtcgacaccttgacaaatgtaagc

SEQ ID NO: 282060 - DNA, 33 bp, Artificial Sequence
  Description of Artificial Sequence: Synthetic oligonucleotide
ggttctcgtcgacaccttgacaaatgtaagctg

SEQ ID NO: 282061 - DNA, 35 bp, Artificial Sequence
  Description of Artificial Sequence: Synthetic oligonucleotide
gttctcgtcgacaccttgacaaatgtaagctgatg

SEQ ID NO: 282062 - DNA, 35 bp, Artificial Sequence
  Description of Artificial Sequence: Synthetic oligonucleotide
ttctcgtcgacaccttgacaaatgtaagctgatgc

SEQ ID NO: 282063 - DNA, 34 bp, Artificial Sequence
  Description of Artificial Sequence: Synthetic oligonucleotide
tctcgtcgacaccttgacaaatgtaagctgatgc

SEQ ID NO: 282064 - DNA, 33 bp, Artificial Sequence
  Description of Artificial Sequence: Synthetic oligonucleotide
ctcgtcgacaccttgacaaatgtaagctgatgc

SEQ ID NO: 282065 - DNA, 33 bp, Artificial Sequence
  Description of Artificial Sequence: Synthetic oligonucleotide
tcgtcgacaccttgacaaatgtaagctgatgcc

SEQ ID NO: 282066 - DNA, 32 bp, Artificial Sequence
  Description of Artificial Sequence: Synthetic oligonucleotide
cgtcgacaccttgacaaatgtaagctgatgcc

SEQ ID NO: 282067 - DNA, 33 bp, Artificial Sequence
  Description of Artificial Sequence: Synthetic oligonucleotide
gtcgacaccttgacaaatgtaagctgatgccag

SEQ ID NO: 282068 - DNA, 33 bp, Artificial Sequence
  Description of Artificial Sequence: Synthetic oligonucleotide
tcgacaccttgacaaatgtaagctgatgccagg

SEQ ID NO: 282069 - DNA, 32 bp, Artificial Sequence
  Description of Artificial Sequence: Synthetic oligonucleotide
cgacaccttgacaaatgtaagctgatgccagg

SEQ ID NO: 282070 - DNA, 34 bp, Artificial Sequence
  Description of Artificial Sequence: Synthetic oligonucleotide
gacaccttgacaaatgtaagctgatgccaggaac

SEQ ID NO: 282071 - DNA, 36 bp, Artificial Sequence
  Description of Artificial Sequence: Synthetic oligonucleotide
acaccttgacaaatgtaagctgatgccaggaactag

SEQ ID NO: 282072 - DNA, 35 bp, Artificial Sequence
  Description of Artificial Sequence: Synthetic oligonucleotide
caccttgacaaatgtaagctgatgccaggaactag

SEQ ID NO: 282073 - DNA, 36 bp, Artificial Sequence
  Description of Artificial Sequence: Synthetic oligonucleotide
accttgacaaatgtaagctgatgccaggaactagag

SEQ ID NO: 282074 - DNA, 35 bp, Artificial Sequence
  Description of Artificial Sequence: Synthetic oligonucleotide
ccttgacaaatgtaagctgatgccaggaactagag

SEQ ID NO: 282075 - DNA, 37 bp, Artificial Sequence
  Description of Artificial Sequence: Synthetic oligonucleotide
cttgacaaatgtaagctgatgccaggaactagagttg

SEQ ID NO: 282076 - DNA, 37 bp, Artificial Sequence
  Description of Artificial Sequence: Synthetic oligonucleotide
ttgacaaatgtaagctgatgccaggaactagagttgc

SEQ ID NO: 282077 - DNA, 36 bp, Artificial Sequence
  Description of Artificial Sequence: Synthetic oligonucleotide
tgacaaatgtaagctgatgccaggaactagagttgc

SEQ ID NO: 282078 - DNA, 35 bp, Artificial Sequence
  Description of Artificial Sequence: Synthetic oligonucleotide
gacaaatgtaagctgatgccaggaactagagttgc

SEQ ID NO: 282079 - DNA, 38 bp, Artificial Sequence
  Description of Artificial Sequence: Synthetic oligonucleotide
acaaatgtaagctgatgccaggaactagagttgctatg

SEQ ID NO: 282080 - DNA, 37 bp, Artificial Sequence
  Description of Artificial Sequence: Synthetic oligonucleotide
caaatgtaagctgatgccaggaactagagttgctatg

SEQ ID NO: 282081 - DNA, 37 bp, Artificial Sequence
  Description of Artificial Sequence: Synthetic oligonucleotide
aaatgtaagctgatgccaggaactagagttgctatgg

SEQ ID NO: 282082 - DNA, 36 bp, Artificial Sequence
  Description of Artificial Sequence: Synthetic oligonucleotide
aatgtaagctgatgccaggaactagagttgctatgg

SEQ ID NO: 282083 - DNA, 35 bp, Artificial Sequence
  Description of Artificial Sequence: Synthetic oligonucleotide
atgtaagctgatgccaggaactagagttgctatgg

SEQ ID NO: 282084 - DNA, 34 bp, Artificial Sequence
  Description of Artificial Sequence: Synthetic oligonucleotide
tgtaagctgatgccaggaactagagttgctatgg

SEQ ID NO: 282085 - DNA, 33 bp, Artificial Sequence
  Description of Artificial Sequence: Synthetic oligonucleotide
gtaagctgatgccaggaactagagttgctatgg

SEQ ID NO: 282086 - DNA, 37 bp, Artificial Sequence
  Description of Artificial Sequence: Synthetic oligonucleotide
taagctgatgccaggaactagagttgctatggatatg

SEQ ID NO: 282087 - DNA, 36 bp, Artificial Sequence
  Description of Artificial Sequence: Synthetic oligonucleotide
aagctgatgccaggaactagagttgctatggatatg

SEQ ID NO: 282088 - DNA, 35 bp, Artificial Sequence
  Description of Artificial Sequence: Synthetic oligonucleotide
agctgatgccaggaactagagttgctatggatatg

SEQ ID NO: 282089 - DNA, 34 bp, Artificial Sequence
  Description of Artificial Sequence: Synthetic oligonucleotide
gctgatgccaggaactagagttgctatggatatg

SEQ ID NO: 282090 - DNA, 35 bp, Artificial Sequence
  Description of Artificial Sequence: Synthetic oligonucleotide
ctgatgccaggaactagagttgctatggatatgag

SEQ ID NO: 282091 - DNA, 37 bp, Artificial Sequence
  Description of Artificial Sequence: Synthetic oligonucleotide
tgatgccaggaactagagttgctatggatatgagtac

SEQ ID NO: 282092 - DNA, 36 bp, Artificial Sequence
  Description of Artificial Sequence: Synthetic oligonucleotide
gatgccaggaactagagttgctatggatatgagtac

SEQ ID NO: 282093 - DNA, 37 bp, Artificial Sequence
  Description of Artificial Sequence: Synthetic oligonucleotide
atgccaggaactagagttgctatggatatgagtacac

SEQ ID NO: 282094 - DNA, 36 bp, Artificial Sequence
  Description of Artificial Sequence: Synthetic oligonucleotide
tgccaggaactagagttgctatggatatgagtacac

SEQ ID NO: 282095 - DNA, 35 bp, Artificial Sequence
  Description of Artificial Sequence: Synthetic oligonucleotide
gccaggaactagagttgctatggatatgagtacac

SEQ ID NO: 282096 - DNA, 38 bp, Artificial Sequence
  Description of Artificial Sequence: Synthetic oligonucleotide
ccaggaactagagttgctatggatatgagtacactaac

SEQ ID NO: 282097 - DNA, 41 bp, Artificial Sequence
  Description of Artificial Sequence: Synthetic oligonucleotide
caggaactagagttgctatggatatgagtacactaacaatc

SEQ ID NO: 282098 - DNA, 43 bp, Artificial Sequence
  Description of Artificial Sequence: Synthetic oligonucleotide
aggaactagagttgctatggatatgagtacactaacaatcatg

SEQ ID NO: 282099 - DNA, 42 bp, Artificial Sequence
  Description of Artificial Sequence: Synthetic oligonucleotide
ggaactagagttgctatggatatgagtacactaacaatcatg

SEQ ID NO: 282100 - DNA, 43 bp, Artificial Sequence
  Description of Artificial Sequence: Synthetic oligonucleotide
gaactagagttgctatggatatgagtacactaacaatcatgag

SEQ ID NO: 282101 - DNA, 49 bp, Artificial Sequence
  Description of Artificial Sequence: Synthetic oligonucleotide
aactagagttgctatggatatgagtacactaacaatcatgagaaatttg

SEQ ID NO: 282102 - DNA, 48 bp, Artificial Sequence
  Description of Artificial Sequence: Synthetic oligonucleotide
actagagttgctatggatatgagtacactaacaatcatgagaaatttg

SEQ ID NO: 282103 - DNA, 47 bp, Artificial Sequence
  Description of Artificial Sequence: Synthetic oligonucleotide
ctagagttgctatggatatgagtacactaacaatcatgagaaatttg

SEQ ID NO: 282104 - DNA, 47 bp, Artificial Sequence
  Description of Artificial Sequence: Synthetic oligonucleotide
tagagttgctatggatatgagtacactaacaatcatgagaaatttgc

SEQ ID NO: 282105 - DNA, 46 bp, Artificial Sequence
  Description of Artificial Sequence: Synthetic oligonucleotide
agagttgctatggatatgagtacactaacaatcatgagaaatttgc

SEQ ID NO: 282106 - DNA, 45 bp, Artificial Sequence
  Description of Artificial Sequence: Synthetic oligonucleotide
gagttgctatggatatgagtacactaacaatcatgagaaatttgc

SEQ ID NO: 282107 - DNA, 45 bp, Artificial Sequence
  Description of Artificial Sequence: Synthetic oligonucleotide
agttgctatggatatgagtacactaacaatcatgagaaatttgcc

SEQ ID NO: 282108 - DNA, 44 bp, Artificial Sequence
  Description of Artificial Sequence: Synthetic oligonucleotide
gttgctatggatatgagtacactaacaatcatgagaaatttgcc

SEQ ID NO: 282109 - DNA, 44 bp, Artificial Sequence
  Description of Artificial Sequence: Synthetic oligonucleotide
ttgctatggatatgagtacactaacaatcatgagaaatttgccg

SEQ ID NO: 282110 - DNA, 43 bp, Artificial Sequence
  Description of Artificial Sequence: Synthetic oligonucleotide
tgctatggatatgagtacactaacaatcatgagaaatttgccg

SEQ ID NO: 282111 - DNA, 42 bp, Artificial Sequence
  Description of Artificial Sequence: Synthetic oligonucleotide
gctatggatatgagtacactaacaatcatgagaaatttgccg

SEQ ID NO: 282112 - DNA, 43 bp, Artificial Sequence
  Description of Artificial Sequence: Synthetic oligonucleotide
ctatggatatgagtacactaacaatcatgagaaatttgccgac

SEQ ID NO: 282113 - DNA, 44 bp, Artificial Sequence
  Description of Artificial Sequence: Synthetic oligonucleotide
tatggatatgagtacactaacaatcatgagaaatttgccgacag

SEQ ID NO: 282114 - DNA, 43 bp, Artificial Sequence
  Description of Artificial Sequence: Synthetic oligonucleotide
atggatatgagtacactaacaatcatgagaaatttgccgacag

SEQ ID NO: 282115 - DNA, 42 bp, Artificial Sequence
  Description of Artificial Sequence: Synthetic oligonucleotide
tggatatgagtacactaacaatcatgagaaatttgccgacag

SEQ ID NO: 282116 - DNA, 41 bp, Artificial Sequence
  Description of Artificial Sequence: Synthetic oligonucleotide
ggatatgagtacactaacaatcatgagaaatttgccgacag

SEQ ID NO: 282117 - DNA, 42 bp, Artificial Sequence
  Description of Artificial Sequence: Synthetic oligonucleotide
gatatgagtacactaacaatcatgagaaatttgccgacagag

SEQ ID NO: 282118 - DNA, 42 bp, Artificial Sequence
  Description of Artificial Sequence: Synthetic oligonucleotide
atatgagtacactaacaatcatgagaaatttgccgacagagg

SEQ ID NO: 282119 - DNA, 41 bp, Artificial Sequence
  Description of Artificial Sequence: Synthetic oligonucleotide
tatgagtacactaacaatcatgagaaatttgccgacagagg

SEQ ID NO: 282120 - DNA, 40 bp, Artificial Sequence
  Description of Artificial Sequence: Synthetic oligonucleotide
atgagtacactaacaatcatgagaaatttgccgacagagg

SEQ ID NO: 282121 - DNA, 39 bp, Artificial Sequence
  Description of Artificial Sequence: Synthetic oligonucleotide
tgagtacactaacaatcatgagaaatttgccgacagagg

SEQ ID NO: 282122 - DNA, 38 bp, Artificial Sequence
  Description of Artificial Sequence: Synthetic oligonucleotide
gagtacactaacaatcatgagaaatttgccgacagagg

SEQ ID NO: 282123 - DNA, 39 bp, Artificial Sequence
  Description of Artificial Sequence: Synthetic oligonucleotide
agtacactaacaatcatgagaaatttgccgacagaggtg

SEQ ID NO: 282124 - DNA, 38 bp, Artificial Sequence
  Description of Artificial Sequence: Synthetic oligonucleotide
gtacactaacaatcatgagaaatttgccgacagaggtg

SEQ ID NO: 282125 - DNA, 38 bp, Artificial Sequence
  Description of Artificial Sequence: Synthetic oligonucleotide
tacactaacaatcatgagaaatttgccgacagaggtgg

SEQ ID NO: 282126 - DNA, 37 bp, Artificial Sequence
  Description of Artificial Sequence: Synthetic oligonucleotide
acactaacaatcatgagaaatttgccgacagaggtgg

SEQ ID NO: 282127 - DNA, 36 bp, Artificial Sequence
  Description of Artificial Sequence: Synthetic oligonucleotide
cactaacaatcatgagaaatttgccgacagaggtgg

SEQ ID NO: 282128 - DNA, 38 bp, Artificial Sequence
  Description of Artificial Sequence: Synthetic oligonucleotide
actaacaatcatgagaaatttgccgacagaggtggaac

SEQ ID NO: 282129 - DNA, 37 bp, Artificial Sequence
  Description of Artificial Sequence: Synthetic oligonucleotide
ctaacaatcatgagaaatttgccgacagaggtggaac

SEQ ID NO: 282130 - DNA, 37 bp, Artificial Sequence
  Description of Artificial Sequence: Synthetic oligonucleotide
taacaatcatgagaaatttgccgacagaggtggaacc

SEQ ID NO: 282131 - DNA, 36 bp, Artificial Sequence
  Description of Artificial Sequence: Synthetic oligonucleotide
aacaatcatgagaaatttgccgacagaggtggaacc

SEQ ID NO: 282132 - DNA, 35 bp, Artificial Sequence
  Description of Artificial Sequence: Synthetic oligonucleotide
acaatcatgagaaatttgccgacagaggtggaacc

SEQ ID NO: 282133 - DNA, 34 bp, Artificial Sequence
  Description of Artificial Sequence: Synthetic oligonucleotide
caatcatgagaaatttgccgacagaggtggaacc

SEQ ID NO: 282134 - DNA, 35 bp, Artificial Sequence
  Description of Artificial Sequence: Synthetic oligonucleotide
aatcatgagaaatttgccgacagaggtggaaccac

SEQ ID NO: 282135 - DNA, 34 bp, Artificial Sequence
  Description of Artificial Sequence: Synthetic oligonucleotide
atcatgagaaatttgccgacagaggtggaaccac

SEQ ID NO: 282136 - DNA, 33 bp, Artificial Sequence
  Description of Artificial Sequence: Synthetic oligonucleotide
tcatgagaaatttgccgacagaggtggaaccac

SEQ ID NO: 282137 - DNA, 32 bp, Artificial Sequence
  Description of Artificial Sequence: Synthetic oligonucleotide
catgagaaatttgccgacagaggtggaaccac

SEQ ID NO: 282138 - DNA, 33 bp, Artificial Sequence
  Description of Artificial Sequence: Synthetic oligonucleotide
atgagaaatttgccgacagaggtggaaccactg

SEQ ID NO: 282139 - DNA, 32 bp, Artificial Sequence
  Description of Artificial Sequence: Synthetic oligonucleotide
tgagaaatttgccgacagaggtggaaccactg

SEQ ID NO: 282140 - DNA, 31 bp, Artificial Sequence
  Description of Artificial Sequence: Synthetic oligonucleotide
gagaaatttgccgacagaggtggaaccactg

SEQ ID NO: 282141 - DNA, 31 bp, Artificial Sequence
  Description of Artificial Sequence: Synthetic oligonucleotide
agaaatttgccgacagaggtggaaccactgg

SEQ ID NO: 282142 - DNA, 30 bp, Artificial Sequence
  Description of Artificial Sequence: Synthetic oligonucleotide
gaaatttgccgacagaggtggaaccactgg

SEQ ID NO: 282143 - DNA, 37 bp, Artificial Sequence
  Description of Artificial Sequence: Synthetic oligonucleotide
aaatttgccgacagaggtggaaccactggttaataac

SEQ ID NO: 282144 - DNA, 36 bp, Artificial Sequence
  Description of Artificial Sequence: Synthetic oligonucleotide
aatttgccgacagaggtggaaccactggttaataac

SEQ ID NO: 282145 - DNA, 35 bp, Artificial Sequence
  Description of Artificial Sequence: Synthetic oligonucleotide
atttgccgacagaggtggaaccactggttaataac

SEQ ID NO: 282146 - DNA, 34 bp, Artificial Sequence
  Description of Artificial Sequence: Synthetic oligonucleotide
tttgccgacagaggtggaaccactggttaataac

SEQ ID NO: 282147 - DNA, 33 bp, Artificial Sequence
  Description of Artificial Sequence: Synthetic oligonucleotide
ttgccgacagaggtggaaccactggttaataac

SEQ ID NO: 282148 - DNA, 32 bp, Artificial Sequence
  Description of Artificial Sequence: Synthetic oligonucleotide
tgccgacagaggtggaaccactggttaataac

SEQ ID NO: 282149 - DNA, 31 bp, Artificial Sequence
  Description of Artificial Sequence: Synthetic oligonucleotide
gccgacagaggtggaaccactggttaataac

SEQ ID NO: 282150 - DNA, 33 bp, Artificial Sequence
  Description of Artificial Sequence: Synthetic oligonucleotide
ccgacagaggtggaaccactggttaataacatg

SEQ ID NO: 282151 - DNA, 34 bp, Artificial Sequence
  Description of Artificial Sequence: Synthetic oligonucleotide
cgacagaggtggaaccactggttaataacatgtg

SEQ ID NO: 282152 - DNA, 35 bp, Artificial Sequence
  Description of Artificial Sequence: Synthetic oligonucleotide
gacagaggtggaaccactggttaataacatgtgtc

SEQ ID NO: 282153 - DNA, 37 bp, Artificial Sequence
  Description of Artificial Sequence: Synthetic oligonucleotide
acagaggtggaaccactggttaataacatgtgtcatg

SEQ ID NO: 282154 - DNA, 36 bp, Artificial Sequence
  Description of Artificial Sequence: Synthetic oligonucleotide
cagaggtggaaccactggttaataacatgtgtcatg

SEQ ID NO: 282155 - DNA, 37 bp, Artificial Sequence
  Description of Artificial Sequence: Synthetic oligonucleotide
agaggtggaaccactggttaataacatgtgtcatgag

SEQ ID NO: 282156 - DNA, 36 bp, Artificial Sequence
  Description of Artificial Sequence: Synthetic oligonucleotide
gaggtggaaccactggttaataacatgtgtcatgag

SEQ ID NO: 282157 - DNA, 36 bp, Artificial Sequence
  Description of Artificial Sequence: Synthetic oligonucleotide
aggtggaaccactggttaataacatgtgtcatgagg

SEQ ID NO: 282158 - DNA, 35 bp, Artificial Sequence
  Description of Artificial Sequence: Synthetic oligonucleotide
ggtggaaccactggttaataacatgtgtcatgagg

SEQ ID NO: 282159 - DNA, 36 bp, Artificial Sequence
  Description of Artificial Sequence: Synthetic oligonucleotide
gtggaaccactggttaataacatgtgtcatgaggag

SEQ ID NO: 282160 - DNA, 36 bp, Artificial Sequence
  Description of Artificial Sequence: Synthetic oligonucleotide
tggaaccactggttaataacatgtgtcatgaggagc

SEQ ID NO: 282161 - DNA, 35 bp, Artificial Sequence
  Description of Artificial Sequence: Synthetic oligonucleotide
ggaaccactggttaataacatgtgtcatgaggagc

SEQ ID NO: 282162 - DNA, 35 bp, Artificial Sequence
  Description of Artificial Sequence: Synthetic oligonucleotide
gaaccactggttaataacatgtgtcatgaggagcc

SEQ ID NO: 282163 - DNA, 36 bp, Artificial Sequence
  Description of Artificial Sequence: Synthetic oligonucleotide
aaccactggttaataacatgtgtcatgaggagcctg

SEQ ID NO: 282164 - DNA, 35 bp, Artificial Sequence
  Description of Artificial Sequence: Synthetic oligonucleotide
accactggttaataacatgtgtcatgaggagcctg

SEQ ID NO: 282165 - DNA, 34 bp, Artificial Sequence
  Description of Artificial Sequence: Synthetic oligonucleotide
ccactggttaataacatgtgtcatgaggagcctg

SEQ ID NO: 282166 - DNA, 34 bp, Artificial Sequence
  Description of Artificial Sequence: Synthetic oligonucleotide
cactggttaataacatgtgtcatgaggagcctgg

SEQ ID NO: 282167 - DNA, 34 bp, Artificial Sequence
  Description of Artificial Sequence: Synthetic oligonucleotide
actggttaataacatgtgtcatgaggagcctggg

SEQ ID NO: 282168 - DNA, 33 bp, Artificial Sequence
  Description of Artificial Sequence: Synthetic oligonucleotide
ctggttaataacatgtgtcatgaggagcctggg

SEQ ID NO: 282169 - DNA, 36 bp, Artificial Sequence
  Description of Artificial Sequence: Synthetic oligonucleotide
tggttaataacatgtgtcatgaggagcctgggaatc

SEQ ID NO: 282170 - DNA, 35 bp, Artificial Sequence
  Description of Artificial Sequence: Synthetic oligonucleotide
ggttaataacatgtgtcatgaggagcctgggaatc

SEQ ID NO: 282171 - DNA, 38 bp, Artificial Sequence
  Description of Artificial Sequence: Synthetic oligonucleotide
gttaataacatgtgtcatgaggagcctgggaatctttc

SEQ ID NO: 282172 - DNA, 43 bp, Artificial Sequence
  Description of Artificial Sequence: Synthetic oligonucleotide
ttaataacatgtgtcatgaggagcctgggaatctttcttattg

SEQ ID NO: 282173 - DNA, 42 bp, Artificial Sequence
  Description of Artificial Sequence: Synthetic oligonucleotide
taataacatgtgtcatgaggagcctgggaatctttcttattg

SEQ ID NO: 282174 - DNA, 41 bp, Artificial Sequence
  Description of Artificial Sequence: Synthetic oligonucleotide
aataacatgtgtcatgaggagcctgggaatctttcttattg

SEQ ID NO: 282175 - DNA, 40 bp, Artificial Sequence
  Description of Artificial Sequence: Synthetic oligonucleotide
ataacatgtgtcatgaggagcctgggaatctttcttattg

SEQ ID NO: 282176 - DNA, 39 bp, Artificial Sequence
  Description of Artificial Sequence: Synthetic oligonucleotide
taacatgtgtcatgaggagcctgggaatctttcttattg

SEQ ID NO: 282177 - DNA, 38 bp, Artificial Sequence
  Description of Artificial Sequence: Synthetic oligonucleotide
aacatgtgtcatgaggagcctgggaatctttcttattg

SEQ ID NO: 282178 - DNA, 37 bp, Artificial Sequence
  Description of Artificial Sequence: Synthetic oligonucleotide
acatgtgtcatgaggagcctgggaatctttcttattg

SEQ ID NO: 282179 - DNA, 36 bp, Artificial Sequence
  Description of Artificial Sequence: Synthetic oligonucleotide
catgtgtcatgaggagcctgggaatctttcttattg

SEQ ID NO: 282180 - DNA, 37 bp, Artificial Sequence
  Description of Artificial Sequence: Synthetic oligonucleotide
atgtgtcatgaggagcctgggaatctttcttattgtg

SEQ ID NO: 282181 - DNA, 36 bp, Artificial Sequence
  Description of Artificial Sequence: Synthetic oligonucleotide
tgtgtcatgaggagcctgggaatctttcttattgtg

SEQ ID NO: 282182 - DNA, 35 bp, Artificial Sequence
  Description of Artificial Sequence: Synthetic oligonucleotide
gtgtcatgaggagcctgggaatctttcttattgtg

SEQ ID NO: 282183 - DNA, 36 bp, Artificial Sequence
  Description of Artificial Sequence: Synthetic oligonucleotide
tgtcatgaggagcctgggaatctttcttattgtgag

SEQ ID NO: 282184 - DNA, 35 bp, Artificial Sequence
  Description of Artificial Sequence: Synthetic oligonucleotide
gtcatgaggagcctgggaatctttcttattgtgag

SEQ ID NO: 282185 - DNA, 38 bp, Artificial Sequence
  Description of Artificial Sequence: Synthetic oligonucleotide
tcatgaggagcctgggaatctttcttattgtgagattg

SEQ ID NO: 282186 - DNA, 37 bp, Artificial Sequence
  Description of Artificial Sequence: Synthetic oligonucleotide
catgaggagcctgggaatctttcttattgtgagattg

SEQ ID NO: 282187 - DNA, 37 bp, Artificial Sequence
  Description of Artificial Sequence: Synthetic oligonucleotide
atgaggagcctgggaatctttcttattgtgagattgg

SEQ ID NO: 282188 - DNA, 36 bp, Artificial Sequence
  Description of Artificial Sequence: Synthetic oligonucleotide
tgaggagcctgggaatctttcttattgtgagattgg

SEQ ID NO: 282189 - DNA, 35 bp, Artificial Sequence
  Description of Artificial Sequence: Synthetic oligonucleotide
gaggagcctgggaatctttcttattgtgagattgg

SEQ ID NO: 282190 - DNA, 36 bp, Artificial Sequence
  Description of Artificial Sequence: Synthetic oligonucleotide
aggagcctgggaatctttcttattgtgagattggtg

SEQ ID NO: 282191 - DNA, 35 bp, Artificial Sequence
  Description of Artificial Sequence: Synthetic oligonucleotide
ggagcctgggaatctttcttattgtgagattggtg

SEQ ID NO: 282192 - DNA, 35 bp, Artificial Sequence
  Description of Artificial Sequence: Synthetic oligonucleotide
gagcctgggaatctttcttattgtgagattggtgg

SEQ ID NO: 282193 - DNA, 35 bp, Artificial Sequence
  Description of Artificial Sequence: Synthetic oligonucleotide
agcctgggaatctttcttattgtgagattggtggg

SEQ ID NO: 282194 - DNA, 34 bp, Artificial Sequence
  Description of Artificial Sequence: Synthetic oligonucleotide
gcctgggaatctttcttattgtgagattggtggg

SEQ ID NO: 282195 - DNA, 34 bp, Artificial Sequence
  Description of Artificial Sequence: Synthetic oligonucleotide
cctgggaatctttcttattgtgagattggtgggc

SEQ ID NO: 282196 - DNA, 37 bp, Artificial Sequence
  Description of Artificial Sequence: Synthetic oligonucleotide
ctgggaatctttcttattgtgagattggtgggctatc

SEQ ID NO: 282197 - DNA, 38 bp, Artificial Sequence
  Description of Artificial Sequence: Synthetic oligonucleotide
tgggaatctttcttattgtgagattggtgggctatcac

SEQ ID NO: 282198 - DNA, 37 bp, Artificial Sequence
  Description of Artificial Sequence: Synthetic oligonucleotide
gggaatctttcttattgtgagattggtgggctatcac

SEQ ID NO: 282199 - DNA, 39 bp, Artificial Sequence
  Description of Artificial Sequence: Synthetic oligonucleotide
ggaatctttcttattgtgagattggtgggctatcacaac

SEQ ID NO: 282200 - DNA, 40 bp, Artificial Sequence
  Description of Artificial Sequence: Synthetic oligonucleotide
gaatctttcttattgtgagattggtgggctatcacaacag

SEQ ID NO: 282201 - DNA, 42 bp, Artificial Sequence
  Description of Artificial Sequence: Synthetic oligonucleotide
aatctttcttattgtgagattggtgggctatcacaacagatc

SEQ ID NO: 282202 - DNA, 41 bp, Artificial Sequence
  Description of Artificial Sequence: Synthetic oligonucleotide
atctttcttattgtgagattggtgggctatcacaacagatc

SEQ ID NO: 282203 - DNA, 40 bp, Artificial Sequence
  Description of Artificial Sequence: Synthetic oligonucleotide
tctttcttattgtgagattggtgggctatcacaacagatc

SEQ ID NO: 282204 - DNA, 39 bp, Artificial Sequence
  Description of Artificial Sequence: Synthetic oligonucleotide
ctttcttattgtgagattggtgggctatcacaacagatc

SEQ ID NO: 282205 - DNA, 39 bp, Artificial Sequence
  Description of Artificial Sequence: Synthetic oligonucleotide
tttcttattgtgagattggtgggctatcacaacagatcc

SEQ ID NO: 282206 - DNA, 38 bp, Artificial Sequence
  Description of Artificial Sequence: Synthetic oligonucleotide
ttcttattgtgagattggtgggctatcacaacagatcc

SEQ ID NO: 282207 - DNA, 37 bp, Artificial Sequence
  Description of Artificial Sequence: Synthetic oligonucleotide
tcttattgtgagattggtgggctatcacaacagatcc

SEQ ID NO: 282208 - DNA, 36 bp, Artificial Sequence
  Description of Artificial Sequence: Synthetic oligonucleotide
cttattgtgagattggtgggctatcacaacagatcc

SEQ ID NO: 282209 - DNA, 36 bp, Artificial Sequence
  Description of Artificial Sequence: Synthetic oligonucleotide
ttattgtgagattggtgggctatcacaacagatccc

SEQ ID NO: 282210 - DNA, 35 bp, Artificial Sequence
  Description of Artificial Sequence: Synthetic oligonucleotide
tattgtgagattggtgggctatcacaacagatccc

SEQ ID NO: 282211 - DNA, 34 bp, Artificial Sequence
  Description of Artificial Sequence: Synthetic oligonucleotide
attgtgagattggtgggctatcacaacagatccc

SEQ ID NO: 282212 - DNA, 33 bp, Artificial Sequence
  Description of Artificial Sequence: Synthetic oligonucleotide
ttgtgagattggtgggctatcacaacagatccc

SEQ ID NO: 282213 - DNA, 32 bp, Artificial Sequence
  Description of Artificial Sequence: Synthetic oligonucleotide
tgtgagattggtgggctatcacaacagatccc

SEQ ID NO: 282214 - DNA, 31 bp, Artificial Sequence
  Description of Artificial Sequence: Synthetic oligonucleotide
gtgagattggtgggctatcacaacagatccc

SEQ ID NO: 282215 - DNA, 31 bp, Artificial Sequence
  Description of Artificial Sequence: Synthetic oligonucleotide
tgagattggtgggctatcacaacagatcccg

SEQ ID NO: 282216 - DNA, 30 bp, Artificial Sequence
  Description of Artificial Sequence: Synthetic oligonucleotide
gagattggtgggctatcacaacagatcccg

SEQ ID NO: 282217 - DNA, 30 bp, Artificial Sequence
  Description of Artificial Sequence: Synthetic oligonucleotide
agattggtgggctatcacaacagatcccgg

SEQ ID NO: 282218 - DNA, 29 bp, Artificial Sequence
  Description of Artificial Sequence: Synthetic oligonucleotide
gattggtgggctatcacaacagatcccgg

SEQ ID NO: 282219 - DNA, 35 bp, Artificial Sequence
  Description of Artificial Sequence: Synthetic oligonucleotide
attggtgggctatcacaacagatcccggaattaag

SEQ ID NO: 282220 - DNA, 34 bp, Artificial Sequence
  Description of Artificial Sequence: Synthetic oligonucleotide
ttggtgggctatcacaacagatcccggaattaag

SEQ ID NO: 282221 - DNA, 33 bp, Artificial Sequence
  Description of Artificial Sequence: Synthetic oligonucleotide
tggtgggctatcacaacagatcccggaattaag

SEQ ID NO: 282222 - DNA, 32 bp, Artificial Sequence
  Description of Artificial Sequence: Synthetic oligonucleotide
ggtgggctatcacaacagatcccggaattaag

SEQ ID NO: 282223 - DNA, 33 bp, Artificial Sequence
  Description of Artificial Sequence: Synthetic oligonucleotide
gtgggctatcacaacagatcccggaattaagtg

SEQ ID NO: 282224 - DNA, 34 bp, Artificial Sequence
  Description of Artificial Sequence: Synthetic oligonucleotide
tgggctatcacaacagatcccggaattaagtgag

SEQ ID NO: 282225 - DNA, 33 bp, Artificial Sequence
  Description of Artificial Sequence: Synthetic oligonucleotide
gggctatcacaacagatcccggaattaagtgag

SEQ ID NO: 282226 - DNA, 33 bp, Artificial Sequence
  Description of Artificial Sequence: Synthetic oligonucleotide
ggctatcacaacagatcccggaattaagtgagg

SEQ ID NO: 282227 - DNA, 34 bp, Artificial Sequence
  Description of Artificial Sequence: Synthetic oligonucleotide
gctatcacaacagatcccggaattaagtgaggtg

SEQ ID NO: 282228 - DNA, 37 bp, Artificial Sequence
  Description of Artificial Sequence: Synthetic oligonucleotide
ctatcacaacagatcccggaattaagtgaggtgatac

SEQ ID NO: 282229 - DNA, 42 bp, Artificial Sequence
  Description of Artificial Sequence: Synthetic oligonucleotide
tatcacaacagatcccggaattaagtgaggtgatacaattac

SEQ ID NO: 282230 - DNA, 41 bp, Artificial Sequence
  Description of Artificial Sequence: Synthetic oligonucleotide
atcacaacagatcccggaattaagtgaggtgatacaattac

SEQ ID NO: 282231 - DNA, 40 bp, Artificial Sequence
  Description of Artificial Sequence: Synthetic oligonucleotide
tcacaacagatcccggaattaagtgaggtgatacaattac

SEQ ID NO: 282232 - DNA, 39 bp, Artificial Sequence
  Description of Artificial Sequence: Synthetic oligonucleotide
cacaacagatcccggaattaagtgaggtgatacaattac

SEQ ID NO: 282233 - DNA, 39 bp, Artificial Sequence
  Description of Artificial Sequence: Synthetic oligonucleotide
acaacagatcccggaattaagtgaggtgatacaattacc

SEQ ID NO: 282234 - DNA, 38 bp, Artificial Sequence
  Description of Artificial Sequence: Synthetic oligonucleotide
caacagatcccggaattaagtgaggtgatacaattacc

SEQ ID NO: 282235 - DNA, 39 bp, Artificial Sequence
  Description of Artificial Sequence: Synthetic oligonucleotide
aacagatcccggaattaagtgaggtgatacaattacctc

SEQ ID NO: 282236 - DNA, 38 bp, Artificial Sequence
  Description of Artificial Sequence: Synthetic oligonucleotide
acagatcccggaattaagtgaggtgatacaattacctc

SEQ ID NO: 282237 - DNA, 37 bp, Artificial Sequence
  Description of Artificial Sequence: Synthetic oligonucleotide
cagatcccggaattaagtgaggtgatacaattacctc

SEQ ID NO: 282238 - DNA, 40 bp, Artificial Sequence
  Description of Artificial Sequence: Synthetic oligonucleotide
agatcccggaattaagtgaggtgatacaattacctcatac

SEQ ID NO: 282239 - DNA, 39 bp, Artificial Sequence
  Description of Artificial Sequence: Synthetic oligonucleotide
gatcccggaattaagtgaggtgatacaattacctcatac

SEQ ID NO: 282240 - DNA, 42 bp, Artificial Sequence
  Description of Artificial Sequence: Synthetic oligonucleotide
atcccggaattaagtgaggtgatacaattacctcatacaaac

SEQ ID NO: 282241 - DNA, 41 bp, Artificial Sequence
  Description of Artificial Sequence: Synthetic oligonucleotide
tcccggaattaagtgaggtgatacaattacctcatacaaac

SEQ ID NO: 282242 - DNA, 40 bp, Artificial Sequence
  Description of Artificial Sequence: Synthetic oligonucleotide
cccggaattaagtgaggtgatacaattacctcatacaaac

SEQ ID NO: 282243 - DNA, 40 bp, Artificial Sequence
  Description of Artificial Sequence: Synthetic oligonucleotide
ccggaattaagtgaggtgatacaattacctcatacaaacc

SEQ ID NO: 282244 - DNA, 40 bp, Artificial Sequence
  Description of Artificial Sequence: Synthetic oligonucleotide
cggaattaagtgaggtgatacaattacctcatacaaaccc

SEQ ID NO: 282245 - DNA, 41 bp, Artificial Sequence
  Description of Artificial Sequence: Synthetic oligonucleotide
ggaattaagtgaggtgatacaattacctcatacaaaccctg

SEQ ID NO: 282246 - DNA, 42 bp, Artificial Sequence
  Description of Artificial Sequence: Synthetic oligonucleotide
gaattaagtgaggtgatacaattacctcatacaaaccctgag

SEQ ID NO: 282247 - DNA, 48 bp, Artificial Sequence
  Description of Artificial Sequence: Synthetic oligonucleotide
aattaagtgaggtgatacaattacctcatacaaaccctgagttatttg

SEQ ID NO: 282248 - DNA, 47 bp, Artificial Sequence
  Description of Artificial Sequence: Synthetic oligonucleotide
attaagtgaggtgatacaattacctcatacaaaccctgagttatttg

SEQ ID NO: 282249 - DNA, 46 bp, Artificial Sequence
  Description of Artificial Sequence: Synthetic oligonucleotide
ttaagtgaggtgatacaattacctcatacaaaccctgagttatttg

SEQ ID NO: 282250 - DNA, 45 bp, Artificial Sequence
  Description of Artificial Sequence: Synthetic oligonucleotide
taagtgaggtgatacaattacctcatacaaaccctgagttatttg

SEQ ID NO: 282251 - DNA, 44 bp, Artificial Sequence
  Description of Artificial Sequence: Synthetic oligonucleotide
aagtgaggtgatacaattacctcatacaaaccctgagttatttg

SEQ ID NO: 282252 - DNA, 43 bp, Artificial Sequence
  Description of Artificial Sequence: Synthetic oligonucleotide
agtgaggtgatacaattacctcatacaaaccctgagttatttg

SEQ ID NO: 282253 - DNA, 42 bp, Artificial Sequence
  Description of Artificial Sequence: Synthetic oligonucleotide
gtgaggtgatacaattacctcatacaaaccctgagttatttg

SEQ ID NO: 282254 - DNA, 43 bp, Artificial Sequence
  Description of Artificial Sequence: Synthetic oligonucleotide
tgaggtgatacaattacctcatacaaaccctgagttatttgag

SEQ ID NO: 282255 - DNA, 42 bp, Artificial Sequence
  Description of Artificial Sequence: Synthetic oligonucleotide
gaggtgatacaattacctcatacaaaccctgagttatttgag

SEQ ID NO: 282256 - DNA, 42 bp, Artificial Sequence
  Description of Artificial Sequence: Synthetic oligonucleotide
aggtgatacaattacctcatacaaaccctgagttatttgagc

SEQ ID NO: 282257 - DNA, 41 bp, Artificial Sequence
  Description of Artificial Sequence: Synthetic oligonucleotide
ggtgatacaattacctcatacaaaccctgagttatttgagc

SEQ ID NO: 282258 - DNA, 41 bp, Artificial Sequence
  Description of Artificial Sequence: Synthetic oligonucleotide
gtgatacaattacctcatacaaaccctgagttatttgagcg

SEQ ID NO: 282259 - DNA, 42 bp, Artificial Sequence
  Description of Artificial Sequence: Synthetic oligonucleotide
tgatacaattacctcatacaaaccctgagttatttgagcgtg

SEQ ID NO: 282260 - DNA, 41 bp, Artificial Sequence
  Description of Artificial Sequence: Synthetic oligonucleotide
gatacaattacctcatacaaaccctgagttatttgagcgtg

SEQ ID NO: 282261 - DNA, 43 bp, Artificial Sequence
  Description of Artificial Sequence: Synthetic oligonucleotide
atacaattacctcatacaaaccctgagttatttgagcgtgtag

SEQ ID NO: 282262 - DNA, 42 bp, Artificial Sequence
  Description of Artificial Sequence: Synthetic oligonucleotide
tacaattacctcatacaaaccctgagttatttgagcgtgtag

SEQ ID NO: 282263 - DNA, 41 bp, Artificial Sequence
  Description of Artificial Sequence: Synthetic oligonucleotide
acaattacctcatacaaaccctgagttatttgagcgtgtag

SEQ ID NO: 282264 - DNA, 40 bp, Artificial Sequence
  Description of Artificial Sequence: Synthetic oligonucleotide
caattacctcatacaaaccctgagttatttgagcgtgtag

SEQ ID NO: 282265 - DNA, 40 bp, Artificial Sequence
  Description of Artificial Sequence: Synthetic oligonucleotide
aattacctcatacaaaccctgagttatttgagcgtgtagc

SEQ ID NO: 282266 - DNA, 39 bp, Artificial Sequence
  Description of Artificial Sequence: Synthetic oligonucleotide
attacctcatacaaaccctgagttatttgagcgtgtagc

SEQ ID NO: 282267 - DNA, 38 bp, Artificial Sequence
  Description of Artificial Sequence: Synthetic oligonucleotide
ttacctcatacaaaccctgagttatttgagcgtgtagc

SEQ ID NO: 282268 - DNA, 37 bp, Artificial Sequence
  Description of Artificial Sequence: Synthetic oligonucleotide
tacctcatacaaaccctgagttatttgagcgtgtagc

SEQ ID NO: 282269 - DNA, 36 bp, Artificial Sequence
  Description of Artificial Sequence: Synthetic oligonucleotide
acctcatacaaaccctgagttatttgagcgtgtagc

SEQ ID NO: 282270 - DNA, 35 bp, Artificial Sequence
  Description of Artificial Sequence: Synthetic oligonucleotide
cctcatacaaaccctgagttatttgagcgtgtagc

SEQ ID NO: 282271 - DNA, 42 bp, Artificial Sequence
  Description of Artificial Sequence: Synthetic oligonucleotide
ctcatacaaaccctgagttatttgagcgtgtagcaataatac

SEQ ID NO: 282272 - DNA, 42 bp, Artificial Sequence
  Description of Artificial Sequence: Synthetic oligonucleotide
tcatacaaaccctgagttatttgagcgtgtagcaataatacc

SEQ ID NO: 282273 - DNA, 41 bp, Artificial Sequence
  Description of Artificial Sequence: Synthetic oligonucleotide
catacaaaccctgagttatttgagcgtgtagcaataatacc

SEQ ID NO: 282274 - DNA, 42 bp, Artificial Sequence
  Description of Artificial Sequence: Synthetic oligonucleotide
atacaaaccctgagttatttgagcgtgtagcaataataccac

SEQ ID NO: 282275 - DNA, 41 bp, Artificial Sequence
  Description of Artificial Sequence: Synthetic oligonucleotide
tacaaaccctgagttatttgagcgtgtagcaataataccac

SEQ ID NO: 282276 - DNA, 40 bp, Artificial Sequence
  Description of Artificial Sequence: Synthetic oligonucleotide
acaaaccctgagttatttgagcgtgtagcaataataccac

SEQ ID NO: 282277 - DNA, 39 bp, Artificial Sequence
  Description of Artificial Sequence: Synthetic oligonucleotide
caaaccctgagttatttgagcgtgtagcaataataccac

SEQ ID NO: 282278 - DNA, 39 bp, Artificial Sequence
  Description of Artificial Sequence: Synthetic oligonucleotide
aaaccctgagttatttgagcgtgtagcaataataccacc

SEQ ID NO: 282279 - DNA, 38 bp, Artificial Sequence
  Description of Artificial Sequence: Synthetic oligonucleotide
aaccctgagttatttgagcgtgtagcaataataccacc

SEQ ID NO: 282280 - DNA, 37 bp, Artificial Sequence
  Description of Artificial Sequence: Synthetic oligonucleotide
accctgagttatttgagcgtgtagcaataataccacc

SEQ ID NO: 282281 - DNA, 36 bp, Artificial Sequence
  Description of Artificial Sequence: Synthetic oligonucleotide
ccctgagttatttgagcgtgtagcaataataccacc

SEQ ID NO: 282282 - DNA, 40 bp, Artificial Sequence
  Description of Artificial Sequence: Synthetic oligonucleotide
cctgagttatttgagcgtgtagcaataataccaccaaaag

SEQ ID NO: 282283 - DNA, 40 bp, Artificial Sequence
  Description of Artificial Sequence: Synthetic oligonucleotide
ctgagttatttgagcgtgtagcaataataccaccaaaagg

SEQ ID NO: 282284 - DNA, 40 bp, Artificial Sequence
  Description of Artificial Sequence: Synthetic oligonucleotide
tgagttatttgagcgtgtagcaataataccaccaaaaggc

SEQ ID NO: 282285 - DNA, 39 bp, Artificial Sequence
  Description of Artificial Sequence: Synthetic oligonucleotide
gagttatttgagcgtgtagcaataataccaccaaaaggc

SEQ ID NO: 282286 - DNA, 40 bp, Artificial Sequence
  Description of Artificial Sequence: Synthetic oligonucleotide
agttatttgagcgtgtagcaataataccaccaaaaggcag

SEQ ID NO: 282287 - DNA, 39 bp, Artificial Sequence
  Description of Artificial Sequence: Synthetic oligonucleotide
gttatttgagcgtgtagcaataataccaccaaaaggcag

SEQ ID NO: 282288 - DNA, 42 bp, Artificial Sequence
  Description of Artificial Sequence: Synthetic oligonucleotide
ttatttgagcgtgtagcaataataccaccaaaaggcagtttg

SEQ ID NO: 282289 - DNA, 41 bp, Artificial Sequence
  Description of Artificial Sequence: Synthetic oligonucleotide
tatttgagcgtgtagcaataataccaccaaaaggcagtttg

SEQ ID NO: 282290 - DNA, 40 bp, Artificial Sequence
  Description of Artificial Sequence: Synthetic oligonucleotide
atttgagcgtgtagcaataataccaccaaaaggcagtttg

SEQ ID NO: 282291 - DNA, 39 bp, Artificial Sequence
  Description of Artificial Sequence: Synthetic oligonucleotide
tttgagcgtgtagcaataataccaccaaaaggcagtttg

SEQ ID NO: 282292 - DNA, 38 bp, Artificial Sequence
  Description of Artificial Sequence: Synthetic oligonucleotide
ttgagcgtgtagcaataataccaccaaaaggcagtttg

SEQ ID NO: 282293 - DNA, 37 bp, Artificial Sequence
  Description of Artificial Sequence: Synthetic oligonucleotide
tgagcgtgtagcaataataccaccaaaaggcagtttg

SEQ ID NO: 282294 - DNA, 36 bp, Artificial Sequence
  Description of Artificial Sequence: Synthetic oligonucleotide
gagcgtgtagcaataataccaccaaaaggcagtttg

SEQ ID NO: 282295 - DNA, 42 bp, Artificial Sequence
  Description of Artificial Sequence: Synthetic oligonucleotide
agcgtgtagcaataataccaccaaaaggcagtttgttatttg

SEQ ID NO: 282296 - DNA, 41 bp, Artificial Sequence
  Description of Artificial Sequence: Synthetic oligonucleotide
gcgtgtagcaataataccaccaaaaggcagtttgttatttg

SEQ ID NO: 282297 - DNA, 41 bp, Artificial Sequence
  Description of Artificial Sequence: Synthetic oligonucleotide
cgtgtagcaataataccaccaaaaggcagtttgttatttgg

SEQ ID NO: 282298 - DNA, 42 bp, Artificial Sequence
  Description of Artificial Sequence: Synthetic oligonucleotide
gtgtagcaataataccaccaaaaggcagtttgttatttggac

SEQ ID NO: 282299 - DNA, 42 bp, Artificial Sequence
  Description of Artificial Sequence: Synthetic oligonucleotide
tgtagcaataataccaccaaaaggcagtttgttatttggacc

SEQ ID NO: 282300 - DNA, 41 bp, Artificial Sequence
  Description of Artificial Sequence: Synthetic oligonucleotide
gtagcaataataccaccaaaaggcagtttgttatttggacc

SEQ ID NO: 282301 - DNA, 42 bp, Artificial Sequence
  Description of Artificial Sequence: Synthetic oligonucleotide
tagcaataataccaccaaaaggcagtttgttatttggaccac

SEQ ID NO: 282302 - DNA, 41 bp, Artificial Sequence
  Description of Artificial Sequence: Synthetic oligonucleotide
agcaataataccaccaaaaggcagtttgttatttggaccac

SEQ ID NO: 282303 - DNA, 40 bp, Artificial Sequence
  Description of Artificial Sequence: Synthetic oligonucleotide
gcaataataccaccaaaaggcagtttgttatttggaccac

SEQ ID NO: 282304 - DNA, 40 bp, Artificial Sequence
  Description of Artificial Sequence: Synthetic oligonucleotide
caataataccaccaaaaggcagtttgttatttggaccacc

SEQ ID NO: 282305 - DNA, 41 bp, Artificial Sequence
  Description of Artificial Sequence: Synthetic oligonucleotide
aataataccaccaaaaggcagtttgttatttggaccacctg

SEQ ID NO: 282306 - DNA, 40 bp, Artificial Sequence
  Description of Artificial Sequence: Synthetic oligonucleotide
ataataccaccaaaaggcagtttgttatttggaccacctg

SEQ ID NO: 282307 - DNA, 39 bp, Artificial Sequence
  Description of Artificial Sequence: Synthetic oligonucleotide
taataccaccaaaaggcagtttgttatttggaccacctg

SEQ ID NO: 282308 - DNA, 38 bp, Artificial Sequence
  Description of Artificial Sequence: Synthetic oligonucleotide
aataccaccaaaaggcagtttgttatttggaccacctg

SEQ ID NO: 282309 - DNA, 37 bp, Artificial Sequence
  Description of Artificial Sequence: Synthetic oligonucleotide
ataccaccaaaaggcagtttgttatttggaccacctg

SEQ ID NO: 282310 - DNA, 36 bp, Artificial Sequence
  Description of Artificial Sequence: Synthetic oligonucleotide
taccaccaaaaggcagtttgttatttggaccacctg

SEQ ID NO: 282311 - DNA, 35 bp, Artificial Sequence
  Description of Artificial Sequence: Synthetic oligonucleotide
accaccaaaaggcagtttgttatttggaccacctg

SEQ ID NO: 282312 - DNA, 34 bp, Artificial Sequence
  Description of Artificial Sequence: Synthetic oligonucleotide
ccaccaaaaggcagtttgttatttggaccacctg

SEQ ID NO: 282313 - DNA, 34 bp, Artificial Sequence
  Description of Artificial Sequence: Synthetic oligonucleotide
caccaaaaggcagtttgttatttggaccacctgg

SEQ ID NO: 282314 - DNA, 36 bp, Artificial Sequence
  Description of Artificial Sequence: Synthetic oligonucleotide
accaaaaggcagtttgttatttggaccacctggtac

SEQ ID NO: 282315 - DNA, 35 bp, Artificial Sequence
  Description of Artificial Sequence: Synthetic oligonucleotide
ccaaaaggcagtttgttatttggaccacctggtac

SEQ ID NO: 282316 - DNA, 35 bp, Artificial Sequence
  Description of Artificial Sequence: Synthetic oligonucleotide
caaaaggcagtttgttatttggaccacctggtacg

SEQ ID NO: 282317 - DNA, 35 bp, Artificial Sequence
  Description of Artificial Sequence: Synthetic oligonucleotide
aaaaggcagtttgttatttggaccacctggtacgg

SEQ ID NO: 282318 - DNA, 34 bp, Artificial Sequence
  Description of Artificial Sequence: Synthetic oligonucleotide
aaaggcagtttgttatttggaccacctggtacgg

SEQ ID NO: 282319 - DNA, 33 bp, Artificial Sequence
  Description of Artificial Sequence: Synthetic oligonucleotide
aaggcagtttgttatttggaccacctggtacgg

SEQ ID NO: 282320 - DNA, 32 bp, Artificial Sequence
  Description of Artificial Sequence: Synthetic oligonucleotide
aggcagtttgttatttggaccacctggtacgg

SEQ ID NO: 282321 - DNA, 31 bp, Artificial Sequence
  Description of Artificial Sequence: Synthetic oligonucleotide
ggcagtttgttatttggaccacctggtacgg

SEQ ID NO: 282322 - DNA, 31 bp, Artificial Sequence
  Description of Artificial Sequence: Synthetic oligonucleotide
gcagtttgttatttggaccacctggtacggg

SEQ ID NO: 282323 - DNA, 36 bp, Artificial Sequence
  Description of Artificial Sequence: Synthetic oligonucleotide
cagtttgttatttggaccacctggtacgggataaac

SEQ ID NO: 282324 - DNA, 37 bp, Artificial Sequence
  Description of Artificial Sequence: Synthetic oligonucleotide
agtttgttatttggaccacctggtacgggataaacac

SEQ ID NO: 282325 - DNA, 36 bp, Artificial Sequence
  Description of Artificial Sequence: Synthetic oligonucleotide
gtttgttatttggaccacctggtacgggataaacac

SEQ ID NO: 282326 - DNA, 37 bp, Artificial Sequence
  Description of Artificial Sequence: Synthetic oligonucleotide
tttgttatttggaccacctggtacgggataaacactc

SEQ ID NO: 282327 - DNA, 36 bp, Artificial Sequence
  Description of Artificial Sequence: Synthetic oligonucleotide
ttgttatttggaccacctggtacgggataaacactc

SEQ ID NO: 282328 - DNA, 35 bp, Artificial Sequence
  Description of Artificial Sequence: Synthetic oligonucleotide
tgttatttggaccacctggtacgggataaacactc

SEQ ID NO: 282329 - DNA, 34 bp, Artificial Sequence
  Description of Artificial Sequence: Synthetic oligonucleotide
gttatttggaccacctggtacgggataaacactc

SEQ ID NO: 282330 - DNA, 36 bp, Artificial Sequence
  Description of Artificial Sequence: Synthetic oligonucleotide
ttatttggaccacctggtacgggataaacactctag

SEQ ID NO: 282331 - DNA, 35 bp, Artificial Sequence
  Description of Artificial Sequence: Synthetic oligonucleotide
tatttggaccacctggtacgggataaacactctag

SEQ ID NO: 282332 - DNA, 34 bp, Artificial Sequence
  Description of Artificial Sequence: Synthetic oligonucleotide
atttggaccacctggtacgggataaacactctag

SEQ ID NO: 282333 - DNA, 33 bp, Artificial Sequence
  Description of Artificial Sequence: Synthetic oligonucleotide
tttggaccacctggtacgggataaacactctag

SEQ ID NO: 282334 - DNA, 32 bp, Artificial Sequence
  Description of Artificial Sequence: Synthetic oligonucleotide
ttggaccacctggtacgggataaacactctag

SEQ ID NO: 282335 - DNA, 31 bp, Artificial Sequence
  Description of Artificial Sequence: Synthetic oligonucleotide
tggaccacctggtacgggataaacactctag

SEQ ID NO: 282336 - DNA, 30 bp, Artificial Sequence
  Description of Artificial Sequence: Synthetic oligonucleotide
ggaccacctggtacgggataaacactctag

SEQ ID NO: 282337 - DNA, 30 bp, Artificial Sequence
  Description of Artificial Sequence: Synthetic oligonucleotide
gaccacctggtacgggataaacactctagg

SEQ ID NO: 282338 - DNA, 30 bp, Artificial Sequence
  Description of Artificial Sequence: Synthetic oligonucleotide
accacctggtacgggataaacactctaggc

SEQ ID NO: 282339 - DNA, 29 bp, Artificial Sequence
  Description of Artificial Sequence: Synthetic oligonucleotide
ccacctggtacgggataaacactctaggc

SEQ ID NO: 282340 - DNA, 30 bp, Artificial Sequence
  Description of Artificial Sequence: Synthetic oligonucleotide
cacctggtacgggataaacactctaggcac

SEQ ID NO: 282341 - DNA, 30 bp, Artificial Sequence
  Description of Artificial Sequence: Synthetic oligonucleotide
acctggtacgggataaacactctaggcacg

SEQ ID NO: 282342 - DNA, 29 bp, Artificial Sequence
  Description of Artificial Sequence: Synthetic oligonucleotide
cctggtacgggataaacactctaggcacg

SEQ ID NO: 282343 - DNA, 30 bp, Artificial Sequence
  Description of Artificial Sequence: Synthetic oligonucleotide
ctggtacgggataaacactctaggcacgag

SEQ ID NO: 282344 - DNA, 30 bp, Artificial Sequence
  Description of Artificial Sequence: Synthetic oligonucleotide
tggtacgggataaacactctaggcacgagc

SEQ ID NO: 282345 - DNA, 29 bp, Artificial Sequence
  Description of Artificial Sequence: Synthetic oligonucleotide
ggtacgggataaacactctaggcacgagc

SEQ ID NO: 282346 - DNA, 29 bp, Artificial Sequence
  Description of Artificial Sequence: Synthetic oligonucleotide
gtacgggataaacactctaggcacgagcg

SEQ ID NO: 282347 - DNA, 29 bp, Artificial Sequence
  Description of Artificial Sequence: Synthetic oligonucleotide
tacgggataaacactctaggcacgagcgg

SEQ ID NO: 282348 - DNA, 28 bp, Artificial Sequence
  Description of Artificial Sequence: Synthetic oligonucleotide
acgggataaacactctaggcacgagcgg

SEQ ID NO: 282349 - DNA, 27 bp, Artificial Sequence
  Description of Artificial Sequence: Synthetic oligonucleotide
cgggataaacactctaggcacgagcgg

SEQ ID NO: 282350 - DNA, 29 bp, Artificial Sequence
  Description of Artificial Sequence: Synthetic oligonucleotide
gggataaacactctaggcacgagcggttg

SEQ ID NO: 282351 - DNA, 29 bp, Artificial Sequence
  Description of Artificial Sequence: Synthetic oligonucleotide
ggataaacactctaggcacgagcggttgc

SEQ ID NO: 282352 - DNA, 31 bp, Artificial Sequence
  Description of Artificial Sequence: Synthetic oligonucleotide
gataaacactctaggcacgagcggttgctag

SEQ ID NO: 282353 - DNA, 31 bp, Artificial Sequence
  Description of Artificial Sequence: Synthetic oligonucleotide
ataaacactctaggcacgagcggttgctagc

SEQ ID NO: 282354 - DNA, 30 bp, Artificial Sequence
  Description of Artificial Sequence: Synthetic oligonucleotide
taaacactctaggcacgagcggttgctagc

SEQ ID NO: 282355 - DNA, 29 bp, Artificial Sequence
  Description of Artificial Sequence: Synthetic oligonucleotide
aaacactctaggcacgagcggttgctagc

SEQ ID NO: 282356 - DNA, 28 bp, Artificial Sequence
  Description of Artificial Sequence: Synthetic oligonucleotide
aacactctaggcacgagcggttgctagc

SEQ ID NO: 282357 - DNA, 27 bp, Artificial Sequence
  Description of Artificial Sequence: Synthetic oligonucleotide
acactctaggcacgagcggttgctagc

SEQ ID NO: 282358 - DNA, 26 bp, Artificial Sequence
  Description of Artificial Sequence: Synthetic oligonucleotide
cactctaggcacgagcggttgctagc

SEQ ID NO: 282359 - DNA, 27 bp, Artificial Sequence
  Description of Artificial Sequence: Synthetic oligonucleotide
actctaggcacgagcggttgctagcga

SEQ ID NO: 282360 - DNA, 26 bp, Artificial Sequence
  Description of Artificial Sequence: Synthetic oligonucleotide
ctctaggcacgagcggttgctagcga

SEQ ID NO: 282361 - DNA, 26 bp, Artificial Sequence
  Description of Artificial Sequence: Synthetic oligonucleotide
tctaggcacgagcggttgctagcgag

SEQ ID NO: 282362 - DNA, 25 bp, Artificial Sequence
  Description of Artificial Sequence: Synthetic oligonucleotide
ctaggcacgagcggttgctagcgag

SEQ ID NO: 282363 - DNA, 26 bp, Artificial Sequence
  Description of Artificial Sequence: Synthetic oligonucleotide
taggcacgagcggttgctagcgagct

SEQ ID NO: 282364 - DNA, 25 bp, Artificial Sequence
  Description of Artificial Sequence: Synthetic oligonucleotide
aggcacgagcggttgctagcgagct

SEQ ID NO: 282365 - DNA, 24 bp, Artificial Sequence
  Description of Artificial Sequence: Synthetic oligonucleotide
ggcacgagcggttgctagcgagct

SEQ ID NO: 282366 - DNA, 24 bp, Artificial Sequence
  Description of Artificial Sequence: Synthetic oligonucleotide
gcacgagcggttgctagcgagctg

SEQ ID NO: 282367 - DNA, 25 bp, Artificial Sequence
  Description of Artificial Sequence: Synthetic oligonucleotide
cacgagcggttgctagcgagctgga

SEQ ID NO: 282368 - DNA, 26 bp, Artificial Sequence
  Description of Artificial Sequence: Synthetic oligonucleotide
acgagcggttgctagcgagctggact

SEQ ID NO: 282369 - DNA, 25 bp, Artificial Sequence
  Description of Artificial Sequence: Synthetic oligonucleotide
cgagcggttgctagcgagctggact

SEQ ID NO: 282370 - DNA, 25 bp, Artificial Sequence
  Description of Artificial Sequence: Synthetic oligonucleotide
gagcggttgctagcgagctggactc

SEQ ID NO: 282371 - DNA, 27 bp, Artificial Sequence
  Description of Artificial Sequence: Synthetic oligonucleotide
agcggttgctagcgagctggactccaa

SEQ ID NO: 282372 - DNA, 27 bp, Artificial Sequence
  Description of Artificial Sequence: Synthetic oligonucleotide
gcggttgctagcgagctggactccaat

SEQ ID NO: 282373 - DNA, 29 bp, Artificial Sequence
  Description of Artificial Sequence: Synthetic oligonucleotide
cggttgctagcgagctggactccaatttc

SEQ ID NO: 282374 - DNA, 34 bp, Artificial Sequence
  Description of Artificial Sequence: Synthetic oligonucleotide
ggttgctagcgagctggactccaatttctttaag

SEQ ID NO: 282375 - DNA, 34 bp, Artificial Sequence
  Description of Artificial Sequence: Synthetic oligonucleotide
gttgctagcgagctggactccaatttctttaagg

SEQ ID NO: 282376 - DNA, 36 bp, Artificial Sequence
  Description of Artificial Sequence: Synthetic oligonucleotide
ttgctagcgagctggactccaatttctttaaggttg

SEQ ID NO: 282377 - DNA, 35 bp, Artificial Sequence
  Description of Artificial Sequence: Synthetic oligonucleotide
tgctagcgagctggactccaatttctttaaggttg

SEQ ID NO: 282378 - DNA, 34 bp, Artificial Sequence
  Description of Artificial Sequence: Synthetic oligonucleotide
gctagcgagctggactccaatttctttaaggttg

SEQ ID NO: 282379 - DNA, 37 bp, Artificial Sequence
  Description of Artificial Sequence: Synthetic oligonucleotide
ctagcgagctggactccaatttctttaaggttgtaac

SEQ ID NO: 282380 - DNA, 39 bp, Artificial Sequence
  Description of Artificial Sequence: Synthetic oligonucleotide
tagcgagctggactccaatttctttaaggttgtaactag

SEQ ID NO: 282381 - DNA, 38 bp, Artificial Sequence
  Description of Artificial Sequence: Synthetic oligonucleotide
agcgagctggactccaatttctttaaggttgtaactag

SEQ ID NO: 282382 - DNA, 37 bp, Artificial Sequence
  Description of Artificial Sequence: Synthetic oligonucleotide
gcgagctggactccaatttctttaaggttgtaactag

SEQ ID NO: 282383 - DNA, 39 bp, Artificial Sequence
  Description of Artificial Sequence: Synthetic oligonucleotide
cgagctggactccaatttctttaaggttgtaactagttc

SEQ ID NO: 282384 - DNA, 43 bp, Artificial Sequence
  Description of Artificial Sequence: Synthetic oligonucleotide
gagctggactccaatttctttaaggttgtaactagttctaatg

SEQ ID NO: 282385 - DNA, 45 bp, Artificial Sequence
  Description of Artificial Sequence: Synthetic oligonucleotide
agctggactccaatttctttaaggttgtaactagttctaatgtag

SEQ ID NO: 282386 - DNA, 44 bp, Artificial Sequence
  Description of Artificial Sequence: Synthetic oligonucleotide
gctggactccaatttctttaaggttgtaactagttctaatgtag

SEQ ID NO: 282387 - DNA, 45 bp, Artificial Sequence
  Description of Artificial Sequence: Synthetic oligonucleotide
ctggactccaatttctttaaggttgtaactagttctaatgtagac

SEQ ID NO: 282388 - DNA, 47 bp, Artificial Sequence
  Description of Artificial Sequence: Synthetic oligonucleotide
tggactccaatttctttaaggttgtaactagttctaatgtagacaac

SEQ ID NO: 282389 - DNA, 46 bp, Artificial Sequence
  Description of Artificial Sequence: Synthetic oligonucleotide
ggactccaatttctttaaggttgtaactagttctaatgtagacaac

SEQ ID NO: 282390 - DNA, 48 bp, Artificial Sequence
  Description of Artificial Sequence: Synthetic oligonucleotide
gactccaatttctttaaggttgtaactagttctaatgtagacaactac

SEQ ID NO: 282391 - DNA, 51 bp, Artificial Sequence
  Description of Artificial Sequence: Synthetic oligonucleotide
actccaatttctttaaggttgtaactagttctaatgtagacaactacattg

SEQ ID NO: 282392 - DNA, 50 bp, Artificial Sequence
  Description of Artificial Sequence: Synthetic oligonucleotide
ctccaatttctttaaggttgtaactagttctaatgtagacaactacattg

SEQ ID NO: 282393 - DNA, 50 bp, Artificial Sequence
  Description of Artificial Sequence: Synthetic oligonucleotide
tccaatttctttaaggttgtaactagttctaatgtagacaactacattgg

SEQ ID NO: 282394 - DNA, 49 bp, Artificial Sequence
  Description of Artificial Sequence: Synthetic oligonucleotide
ccaatttctttaaggttgtaactagttctaatgtagacaactacattgg

SEQ ID NO: 282395 - DNA, 50 bp, Artificial Sequence
  Description of Artificial Sequence: Synthetic oligonucleotide
caatttctttaaggttgtaactagttctaatgtagacaactacattggtc

SEQ ID NO: 282396 - DNA, 53 bp, Artificial Sequence
  Description of Artificial Sequence: Synthetic oligonucleotide
aatttctttaaggttgtaactagttctaatgtagacaactacattggtcaaag

SEQ ID NO: 282397 - DNA, 52 bp, Artificial Sequence
  Description of Artificial Sequence: Synthetic oligonucleotide
atttctttaaggttgtaactagttctaatgtagacaactacattggtcaaag

SEQ ID NO: 282398 - DNA, 51 bp, Artificial Sequence
  Description of Artificial Sequence: Synthetic oligonucleotide
tttctttaaggttgtaactagttctaatgtagacaactacattggtcaaag

SEQ ID NO: 282399 - DNA, 50 bp, Artificial Sequence
  Description of Artificial Sequence: Synthetic oligonucleotide
ttctttaaggttgtaactagttctaatgtagacaactacattggtcaaag

SEQ ID NO: 282400 - DNA, 49 bp, Artificial Sequence
  Description of Artificial Sequence: Synthetic oligonucleotide
tctttaaggttgtaactagttctaatgtagacaactacattggtcaaag

SEQ ID NO: 282401 - DNA, 48 bp, Artificial Sequence
  Description of Artificial Sequence: Synthetic oligonucleotide
ctttaaggttgtaactagttctaatgtagacaactacattggtcaaag

SEQ ID NO: 282402 - DNA, 49 bp, Artificial Sequence
  Description of Artificial Sequence: Synthetic oligonucleotide
tttaaggttgtaactagttctaatgtagacaactacattggtcaaagtg

SEQ ID NO: 282403 - DNA, 48 bp, Artificial Sequence
  Description of Artificial Sequence: Synthetic oligonucleotide
ttaaggttgtaactagttctaatgtagacaactacattggtcaaagtg

SEQ ID NO: 282404 - DNA, 47 bp, Artificial Sequence
  Description of Artificial Sequence: Synthetic oligonucleotide
taaggttgtaactagttctaatgtagacaactacattggtcaaagtg

SEQ ID NO: 282405 - DNA, 46 bp, Artificial Sequence
  Description of Artificial Sequence: Synthetic oligonucleotide
aaggttgtaactagttctaatgtagacaactacattggtcaaagtg

SEQ ID NO: 282406 - DNA, 45 bp, Artificial Sequence
  Description of Artificial Sequence: Synthetic oligonucleotide
aggttgtaactagttctaatgtagacaactacattggtcaaagtg

SEQ ID NO: 282407 - DNA, 44 bp, Artificial Sequence
  Description of Artificial Sequence: Synthetic oligonucleotide
ggttgtaactagttctaatgtagacaactacattggtcaaagtg

SEQ ID NO: 282408 - DNA, 44 bp, Artificial Sequence
  Description of Artificial Sequence: Synthetic oligonucleotide
gttgtaactagttctaatgtagacaactacattggtcaaagtgc

SEQ ID NO: 282409 - DNA, 45 bp, Artificial Sequence
  Description of Artificial Sequence: Synthetic oligonucleotide
ttgtaactagttctaatgtagacaactacattggtcaaagtgctc

SEQ ID NO: 282410 - DNA, 44 bp, Artificial Sequence
  Description of Artificial Sequence: Synthetic oligonucleotide
tgtaactagttctaatgtagacaactacattggtcaaagtgctc

SEQ ID NO: 282411 - DNA, 43 bp, Artificial Sequence
  Description of Artificial Sequence: Synthetic oligonucleotide
gtaactagttctaatgtagacaactacattggtcaaagtgctc

SEQ ID NO: 282412 - DNA, 43 bp, Artificial Sequence
  Description of Artificial Sequence: Synthetic oligonucleotide
taactagttctaatgtagacaactacattggtcaaagtgctcc

SEQ ID NO: 282413 - DNA, 42 bp, Artificial Sequence
  Description of Artificial Sequence: Synthetic oligonucleotide
aactagttctaatgtagacaactacattggtcaaagtgctcc

SEQ ID NO: 282414 - DNA, 41 bp, Artificial Sequence
  Description of Artificial Sequence: Synthetic oligonucleotide
actagttctaatgtagacaactacattggtcaaagtgctcc

SEQ ID NO: 282415 - DNA, 40 bp, Artificial Sequence
  Description of Artificial Sequence: Synthetic oligonucleotide
ctagttctaatgtagacaactacattggtcaaagtgctcc

SEQ ID NO: 282416 - DNA, 43 bp, Artificial Sequence
  Description of Artificial Sequence: Synthetic oligonucleotide
tagttctaatgtagacaactacattggtcaaagtgctcctttg

SEQ ID NO: 282417 - DNA, 42 bp, Artificial Sequence
  Description of Artificial Sequence: Synthetic oligonucleotide
agttctaatgtagacaactacattggtcaaagtgctcctttg

SEQ ID NO: 282418 - DNA, 41 bp, Artificial Sequence
  Description of Artificial Sequence: Synthetic oligonucleotide
gttctaatgtagacaactacattggtcaaagtgctcctttg

SEQ ID NO: 282419 - DNA, 43 bp, Artificial Sequence
  Description of Artificial Sequence: Synthetic oligonucleotide
ttctaatgtagacaactacattggtcaaagtgctcctttgatc

SEQ ID NO: 282420 - DNA, 42 bp, Artificial Sequence
  Description of Artificial Sequence: Synthetic oligonucleotide
tctaatgtagacaactacattggtcaaagtgctcctttgatc

SEQ ID NO: 282421 - DNA, 41 bp, Artificial Sequence
  Description of Artificial Sequence: Synthetic oligonucleotide
ctaatgtagacaactacattggtcaaagtgctcctttgatc

SEQ ID NO: 282422 - DNA, 42 bp, Artificial Sequence
  Description of Artificial Sequence: Synthetic oligonucleotide
taatgtagacaactacattggtcaaagtgctcctttgatcag

SEQ ID NO: 282423 - DNA, 41 bp, Artificial Sequence
  Description of Artificial Sequence: Synthetic oligonucleotide
aatgtagacaactacattggtcaaagtgctcctttgatcag

SEQ ID NO: 282424 - DNA, 40 bp, Artificial Sequence
  Description of Artificial Sequence: Synthetic oligonucleotide
atgtagacaactacattggtcaaagtgctcctttgatcag

SEQ ID NO: 282425 - DNA, 39 bp, Artificial Sequence
  Description of Artificial Sequence: Synthetic oligonucleotide
tgtagacaactacattggtcaaagtgctcctttgatcag

SEQ ID NO: 282426 - DNA, 38 bp, Artificial Sequence
  Description of Artificial Sequence: Synthetic oligonucleotide
gtagacaactacattggtcaaagtgctcctttgatcag

SEQ ID NO: 282427 - DNA, 39 bp, Artificial Sequence
  Description of Artificial Sequence: Synthetic oligonucleotide
tagacaactacattggtcaaagtgctcctttgatcagtg

SEQ ID NO: 282428 - DNA, 38 bp, Artificial Sequence
  Description of Artificial Sequence: Synthetic oligonucleotide
agacaactacattggtcaaagtgctcctttgatcagtg

SEQ ID NO: 282429 - DNA, 37 bp, Artificial Sequence
  Description of Artificial Sequence: Synthetic oligonucleotide
gacaactacattggtcaaagtgctcctttgatcagtg

SEQ ID NO: 282430 - DNA, 41 bp, Artificial Sequence
  Description of Artificial Sequence: Synthetic oligonucleotide
acaactacattggtcaaagtgctcctttgatcagtgaaatg

SEQ ID NO: 282431 - DNA, 40 bp, Artificial Sequence
  Description of Artificial Sequence: Synthetic oligonucleotide
caactacattggtcaaagtgctcctttgatcagtgaaatg

SEQ ID NO: 282432 - DNA, 49 bp, Artificial Sequence
  Description of Artificial Sequence: Synthetic oligonucleotide
aactacattggtcaaagtgctcctttgatcagtgaaatgttttattatg

SEQ ID NO: 282433 - DNA, 48 bp, Artificial Sequence
  Description of Artificial Sequence: Synthetic oligonucleotide
actacattggtcaaagtgctcctttgatcagtgaaatgttttattatg

SEQ ID NO: 282434 - DNA, 47 bp, Artificial Sequence
  Description of Artificial Sequence: Synthetic oligonucleotide
ctacattggtcaaagtgctcctttgatcagtgaaatgttttattatg

SEQ ID NO: 282435 - DNA, 47 bp, Artificial Sequence
  Description of Artificial Sequence: Synthetic oligonucleotide
tacattggtcaaagtgctcctttgatcagtgaaatgttttattatgc

SEQ ID NO: 282436 - DNA, 46 bp, Artificial Sequence
  Description of Artificial Sequence: Synthetic oligonucleotide
acattggtcaaagtgctcctttgatcagtgaaatgttttattatgc

SEQ ID NO: 282437 - DNA, 45 bp, Artificial Sequence
  Description of Artificial Sequence: Synthetic oligonucleotide
cattggtcaaagtgctcctttgatcagtgaaatgttttattatgc

SEQ ID NO: 282438 - DNA, 47 bp, Artificial Sequence
  Description of Artificial Sequence: Synthetic oligonucleotide
attggtcaaagtgctcctttgatcagtgaaatgttttattatgctac

SEQ ID NO: 282439 - DNA, 46 bp, Artificial Sequence
  Description of Artificial Sequence: Synthetic oligonucleotide
ttggtcaaagtgctcctttgatcagtgaaatgttttattatgctac

SEQ ID NO: 282440 - DNA, 45 bp, Artificial Sequence
  Description of Artificial Sequence: Synthetic oligonucleotide
tggtcaaagtgctcctttgatcagtgaaatgttttattatgctac

SEQ ID NO: 282441 - DNA, 44 bp, Artificial Sequence
  Description of Artificial Sequence: Synthetic oligonucleotide
ggtcaaagtgctcctttgatcagtgaaatgttttattatgctac

SEQ ID NO: 282442 - DNA, 45 bp, Artificial Sequence
  Description of Artificial Sequence: Synthetic oligonucleotide
gtcaaagtgctcctttgatcagtgaaatgttttattatgctacag

SEQ ID NO: 282443 - DNA, 47 bp, Artificial Sequence
  Description of Artificial Sequence: Synthetic oligonucleotide
tcaaagtgctcctttgatcagtgaaatgttttattatgctacagatc

SEQ ID NO: 282444 - DNA, 46 bp, Artificial Sequence
  Description of Artificial Sequence: Synthetic oligonucleotide
caaagtgctcctttgatcagtgaaatgttttattatgctacagatc

SEQ ID NO: 282445 - DNA, 48 bp, Artificial Sequence
  Description of Artificial Sequence: Synthetic oligonucleotide
aaagtgctcctttgatcagtgaaatgttttattatgctacagatcatc

SEQ ID NO: 282446 - DNA, 47 bp, Artificial Sequence
  Description of Artificial Sequence: Synthetic oligonucleotide
aagtgctcctttgatcagtgaaatgttttattatgctacagatcatc

SEQ ID NO: 282447 - DNA, 46 bp, Artificial Sequence
  Description of Artificial Sequence: Synthetic oligonucleotide
agtgctcctttgatcagtgaaatgttttattatgctacagatcatc

SEQ ID NO: 282448 - DNA, 45 bp, Artificial Sequence
  Description of Artificial Sequence: Synthetic oligonucleotide
gtgctcctttgatcagtgaaatgttttattatgctacagatcatc

SEQ ID NO: 282449 - DNA, 47 bp, Artificial Sequence
  Description of Artificial Sequence: Synthetic oligonucleotide
tgctcctttgatcagtgaaatgttttattatgctacagatcatcatc

SEQ ID NO: 282450 - DNA, 46 bp, Artificial Sequence
  Description of Artificial Sequence: Synthetic oligonucleotide
gctcctttgatcagtgaaatgttttattatgctacagatcatcatc

SEQ ID NO: 282451 - DNA, 46 bp, Artificial Sequence
  Description of Artificial Sequence: Synthetic oligonucleotide
ctcctttgatcagtgaaatgttttattatgctacagatcatcatcc

SEQ ID NO: 282452 - DNA, 48 bp, Artificial Sequence
  Description of Artificial Sequence: Synthetic oligonucleotide
tcctttgatcagtgaaatgttttattatgctacagatcatcatccatg

SEQ ID NO: 282453 - DNA, 47 bp, Artificial Sequence
  Description of Artificial Sequence: Synthetic oligonucleotide
cctttgatcagtgaaatgttttattatgctacagatcatcatccatg

SEQ ID NO: 282454 - DNA, 47 bp, Artificial Sequence
  Description of Artificial Sequence: Synthetic oligonucleotide
ctttgatcagtgaaatgttttattatgctacagatcatcatccatgc

SEQ ID NO: 282455 - DNA, 49 bp, Artificial Sequence
  Description of Artificial Sequence: Synthetic oligonucleotide
tttgatcagtgaaatgttttattatgctacagatcatcatccatgcatc

SEQ ID NO: 282456 - DNA, 48 bp, Artificial Sequence
  Description of Artificial Sequence: Synthetic oligonucleotide
ttgatcagtgaaatgttttattatgctacagatcatcatccatgcatc

SEQ ID NO: 282457 - DNA, 47 bp, Artificial Sequence
  Description of Artificial Sequence: Synthetic oligonucleotide
tgatcagtgaaatgttttattatgctacagatcatcatccatgcatc

SEQ ID NO: 282458 - DNA, 46 bp, Artificial Sequence
  Description of Artificial Sequence: Synthetic oligonucleotide
gatcagtgaaatgttttattatgctacagatcatcatccatgcatc

SEQ ID NO: 282459 - DNA, 54 bp, Artificial Sequence
  Description of Artificial Sequence: Synthetic oligonucleotide
atcagtgaaatgttttattatgctacagatcatcatccatgcatcttttttatg

SEQ ID NO: 282460 - DNA, 53 bp, Artificial Sequence
  Description of Artificial Sequence: Synthetic oligonucleotide
tcagtgaaatgttttattatgctacagatcatcatccatgcatcttttttatg

SEQ ID NO: 282461 - DNA, 52 bp, Artificial Sequence
  Description of Artificial Sequence: Synthetic oligonucleotide
cagtgaaatgttttattatgctacagatcatcatccatgcatcttttttatg

SEQ ID NO: 282462 - DNA, 52 bp, Artificial Sequence
  Description of Artificial Sequence: Synthetic oligonucleotide
agtgaaatgttttattatgctacagatcatcatccatgcatcttttttatgg

SEQ ID NO: 282463 - DNA, 51 bp, Artificial Sequence
  Description of Artificial Sequence: Synthetic oligonucleotide
gtgaaatgttttattatgctacagatcatcatccatgcatcttttttatgg

SEQ ID NO: 282464 - DNA, 53 bp, Artificial Sequence
  Description of Artificial Sequence: Synthetic oligonucleotide
tgaaatgttttattatgctacagatcatcatccatgcatcttttttatggttg

SEQ ID NO: 282465 - DNA, 52 bp, Artificial Sequence
  Description of Artificial Sequence: Synthetic oligonucleotide
gaaatgttttattatgctacagatcatcatccatgcatcttttttatggttg

SEQ ID NO: 282466 - DNA, 57 bp, Artificial Sequence
  Description of Artificial Sequence: Synthetic oligonucleotide
aaatgttttattatgctacagatcatcatccatgcatcttttttatggttgaaatag

SEQ ID NO: 282467 - DNA, 56 bp, Artificial Sequence
  Description of Artificial Sequence: Synthetic oligonucleotide
aatgttttattatgctacagatcatcatccatgcatcttttttatggttgaaatag

SEQ ID NO: 282468 - DNA, 55 bp, Artificial Sequence
  Description of Artificial Sequence: Synthetic oligonucleotide
atgttttattatgctacagatcatcatccatgcatcttttttatggttgaaatag

SEQ ID NO: 282469 - DNA, 54 bp, Artificial Sequence
  Description of Artificial Sequence: Synthetic oligonucleotide
tgttttattatgctacagatcatcatccatgcatcttttttatggttgaaatag

SEQ ID NO: 282470 - DNA, 53 bp, Artificial Sequence
  Description of Artificial Sequence: Synthetic oligonucleotide
gttttattatgctacagatcatcatccatgcatcttttttatggttgaaatag

SEQ ID NO: 282471 - DNA, 55 bp, Artificial Sequence
  Description of Artificial Sequence: Synthetic oligonucleotide
ttttattatgctacagatcatcatccatgcatcttttttatggttgaaatagaag

SEQ ID NO: 282472 - DNA, 54 bp, Artificial Sequence
  Description of Artificial Sequence: Synthetic oligonucleotide
tttattatgctacagatcatcatccatgcatcttttttatggttgaaatagaag

SEQ ID NO: 282473 - DNA, 53 bp, Artificial Sequence
  Description of Artificial Sequence: Synthetic oligonucleotide
ttattatgctacagatcatcatccatgcatcttttttatggttgaaatagaag

SEQ ID NO: 282474 - DNA, 52 bp, Artificial Sequence
  Description of Artificial Sequence: Synthetic oligonucleotide
tattatgctacagatcatcatccatgcatcttttttatggttgaaatagaag

SEQ ID NO: 282475 - DNA, 51 bp, Artificial Sequence
  Description of Artificial Sequence: Synthetic oligonucleotide
attatgctacagatcatcatccatgcatcttttttatggttgaaatagaag

SEQ ID NO: 282476 - DNA, 50 bp, Artificial Sequence
  Description of Artificial Sequence: Synthetic oligonucleotide
ttatgctacagatcatcatccatgcatcttttttatggttgaaatagaag

SEQ ID NO: 282477 - DNA, 49 bp, Artificial Sequence
  Description of Artificial Sequence: Synthetic oligonucleotide
tatgctacagatcatcatccatgcatcttttttatggttgaaatagaag

SEQ ID NO: 282478 - DNA, 48 bp, Artificial Sequence
  Description of Artificial Sequence: Synthetic oligonucleotide
atgctacagatcatcatccatgcatcttttttatggttgaaatagaag

SEQ ID NO: 282479 - DNA, 47 bp, Artificial Sequence
  Description of Artificial Sequence: Synthetic oligonucleotide
tgctacagatcatcatccatgcatcttttttatggttgaaatagaag

SEQ ID NO: 282480 - DNA, 46 bp, Artificial Sequence
  Description of Artificial Sequence: Synthetic oligonucleotide
gctacagatcatcatccatgcatcttttttatggttgaaatagaag

SEQ ID NO: 282481 - DNA, 46 bp, Artificial Sequence
  Description of Artificial Sequence: Synthetic oligonucleotide
ctacagatcatcatccatgcatcttttttatggttgaaatagaagc

SEQ ID NO: 282482 - DNA, 50 bp, Artificial Sequence
  Description of Artificial Sequence: Synthetic oligonucleotide
tacagatcatcatccatgcatcttttttatggttgaaatagaagctattg

SEQ ID NO: 282483 - DNA, 49 bp, Artificial Sequence
  Description of Artificial Sequence: Synthetic oligonucleotide
acagatcatcatccatgcatcttttttatggttgaaatagaagctattg

SEQ ID NO: 282484 - DNA, 48 bp, Artificial Sequence
  Description of Artificial Sequence: Synthetic oligonucleotide
cagatcatcatccatgcatcttttttatggttgaaatagaagctattg

SEQ ID NO: 282485 - DNA, 48 bp, Artificial Sequence
  Description of Artificial Sequence: Synthetic oligonucleotide
agatcatcatccatgcatcttttttatggttgaaatagaagctattgg

SEQ ID NO: 282486 - DNA, 47 bp, Artificial Sequence
  Description of Artificial Sequence: Synthetic oligonucleotide
gatcatcatccatgcatcttttttatggttgaaatagaagctattgg

SEQ ID NO: 282487 - DNA, 48 bp, Artificial Sequence
  Description of Artificial Sequence: Synthetic oligonucleotide
atcatcatccatgcatcttttttatggttgaaatagaagctattggtc

SEQ ID NO: 282488 - DNA, 47 bp, Artificial Sequence
  Description of Artificial Sequence: Synthetic oligonucleotide
tcatcatccatgcatcttttttatggttgaaatagaagctattggtc

SEQ ID NO: 282489 - DNA, 46 bp, Artificial Sequence
  Description of Artificial Sequence: Synthetic oligonucleotide
catcatccatgcatcttttttatggttgaaatagaagctattggtc

SEQ ID NO: 282490 - DNA, 46 bp, Artificial Sequence
  Description of Artificial Sequence: Synthetic oligonucleotide
atcatccatgcatcttttttatggttgaaatagaagctattggtcg

SEQ ID NO: 282491 - DNA, 45 bp, Artificial Sequence
  Description of Artificial Sequence: Synthetic oligonucleotide
tcatccatgcatcttttttatggttgaaatagaagctattggtcg

SEQ ID NO: 282492 - DNA, 44 bp, Artificial Sequence
  Description of Artificial Sequence: Synthetic oligonucleotide
catccatgcatcttttttatggttgaaatagaagctattggtcg

SEQ ID NO: 282493 - DNA, 45 bp, Artificial Sequence
  Description of Artificial Sequence: Synthetic oligonucleotide
atccatgcatcttttttatggttgaaatagaagctattggtcgtc

SEQ ID NO: 282494 - DNA, 44 bp, Artificial Sequence
  Description of Artificial Sequence: Synthetic oligonucleotide
tccatgcatcttttttatggttgaaatagaagctattggtcgtc

SEQ ID NO: 282495 - DNA, 43 bp, Artificial Sequence
  Description of Artificial Sequence: Synthetic oligonucleotide
ccatgcatcttttttatggttgaaatagaagctattggtcgtc

SEQ ID NO: 282496 - DNA, 43 bp, Artificial Sequence
  Description of Artificial Sequence: Synthetic oligonucleotide
catgcatcttttttatggttgaaatagaagctattggtcgtcg

SEQ ID NO: 282497 - DNA, 44 bp, Artificial Sequence
  Description of Artificial Sequence: Synthetic oligonucleotide
atgcatcttttttatggttgaaatagaagctattggtcgtcgtc

SEQ ID NO: 282498 - DNA, 43 bp, Artificial Sequence
  Description of Artificial Sequence: Synthetic oligonucleotide
tgcatcttttttatggttgaaatagaagctattggtcgtcgtc

SEQ ID NO: 282499 - DNA, 42 bp, Artificial Sequence
  Description of Artificial Sequence: Synthetic oligonucleotide
gcatcttttttatggttgaaatagaagctattggtcgtcgtc

SEQ ID NO: 282500 - DNA, 42 bp, Artificial Sequence
  Description of Artificial Sequence: Synthetic oligonucleotide
catcttttttatggttgaaatagaagctattggtcgtcgtcg

SEQ ID NO: 282501 - DNA, 42 bp, Artificial Sequence
  Description of Artificial Sequence: Synthetic oligonucleotide
atcttttttatggttgaaatagaagctattggtcgtcgtcgg

SEQ ID NO: 282502 - DNA, 41 bp, Artificial Sequence
  Description of Artificial Sequence: Synthetic oligonucleotide
tcttttttatggttgaaatagaagctattggtcgtcgtcgg

SEQ ID NO: 282503 - DNA, 40 bp, Artificial Sequence
  Description of Artificial Sequence: Synthetic oligonucleotide
cttttttatggttgaaatagaagctattggtcgtcgtcgg

SEQ ID NO: 282504 - DNA, 44 bp, Artificial Sequence
  Description of Artificial Sequence: Synthetic oligonucleotide
ttttttatggttgaaatagaagctattggtcgtcgtcggtattc

SEQ ID NO: 282505 - DNA, 43 bp, Artificial Sequence
  Description of Artificial Sequence: Synthetic oligonucleotide
tttttatggttgaaatagaagctattggtcgtcgtcggtattc

SEQ ID NO: 282506 - DNA, 42 bp, Artificial Sequence
  Description of Artificial Sequence: Synthetic oligonucleotide
ttttatggttgaaatagaagctattggtcgtcgtcggtattc

SEQ ID NO: 282507 - DNA, 41 bp, Artificial Sequence
  Description of Artificial Sequence: Synthetic oligonucleotide
tttatggttgaaatagaagctattggtcgtcgtcggtattc

SEQ ID NO: 282508 - DNA, 40 bp, Artificial Sequence
  Description of Artificial Sequence: Synthetic oligonucleotide
ttatggttgaaatagaagctattggtcgtcgtcggtattc

SEQ ID NO: 282509 - DNA, 39 bp, Artificial Sequence
  Description of Artificial Sequence: Synthetic oligonucleotide
tatggttgaaatagaagctattggtcgtcgtcggtattc

SEQ ID NO: 282510 - DNA, 38 bp, Artificial Sequence
  Description of Artificial Sequence: Synthetic oligonucleotide
atggttgaaatagaagctattggtcgtcgtcggtattc

SEQ ID NO: 282511 - DNA, 37 bp, Artificial Sequence
  Description of Artificial Sequence: Synthetic oligonucleotide
tggttgaaatagaagctattggtcgtcgtcggtattc

SEQ ID NO: 282512 - DNA, 36 bp, Artificial Sequence
  Description of Artificial Sequence: Synthetic oligonucleotide
ggttgaaatagaagctattggtcgtcgtcggtattc

SEQ ID NO: 282513 - DNA, 37 bp, Artificial Sequence
  Description of Artificial Sequence: Synthetic oligonucleotide
gttgaaatagaagctattggtcgtcgtcggtattctg

SEQ ID NO: 282514 - DNA, 38 bp, Artificial Sequence
  Description of Artificial Sequence: Synthetic oligonucleotide
ttgaaatagaagctattggtcgtcgtcggtattctgag

SEQ ID NO: 282515 - DNA, 37 bp, Artificial Sequence
  Description of Artificial Sequence: Synthetic oligonucleotide
tgaaatagaagctattggtcgtcgtcggtattctgag

SEQ ID NO: 282516 - DNA, 36 bp, Artificial Sequence
  Description of Artificial Sequence: Synthetic oligonucleotide
gaaatagaagctattggtcgtcgtcggtattctgag

SEQ ID NO: 282517 - DNA, 36 bp, Artificial Sequence
  Description of Artificial Sequence: Synthetic oligonucleotide
aaatagaagctattggtcgtcgtcggtattctgagg

SEQ ID NO: 282518 - DNA, 35 bp, Artificial Sequence
  Description of Artificial Sequence: Synthetic oligonucleotide
aatagaagctattggtcgtcgtcggtattctgagg

SEQ ID NO: 282519 - DNA, 34 bp, Artificial Sequence
  Description of Artificial Sequence: Synthetic oligonucleotide
atagaagctattggtcgtcgtcggtattctgagg

SEQ ID NO: 282520 - DNA, 33 bp, Artificial Sequence
  Description of Artificial Sequence: Synthetic oligonucleotide
tagaagctattggtcgtcgtcggtattctgagg

SEQ ID NO: 282521 - DNA, 32 bp, Artificial Sequence
  Description of Artificial Sequence: Synthetic oligonucleotide
agaagctattggtcgtcgtcggtattctgagg

SEQ ID NO: 282522 - DNA, 31 bp, Artificial Sequence
  Description of Artificial Sequence: Synthetic oligonucleotide
gaagctattggtcgtcgtcggtattctgagg

SEQ ID NO: 282523 - DNA, 31 bp, Artificial Sequence
  Description of Artificial Sequence: Synthetic oligonucleotide
aagctattggtcgtcgtcggtattctgaggg

SEQ ID NO: 282524 - DNA, 30 bp, Artificial Sequence
  Description of Artificial Sequence: Synthetic oligonucleotide
agctattggtcgtcgtcggtattctgaggg

SEQ ID NO: 282525 - DNA, 29 bp, Artificial Sequence
  Description of Artificial Sequence: Synthetic oligonucleotide
gctattggtcgtcgtcggtattctgaggg

SEQ ID NO: 282526 - DNA, 31 bp, Artificial Sequence
  Description of Artificial Sequence: Synthetic oligonucleotide
ctattggtcgtcgtcggtattctgagggaac

SEQ ID NO: 282527 - DNA, 33 bp, Artificial Sequence
  Description of Artificial Sequence: Synthetic oligonucleotide
tattggtcgtcgtcggtattctgagggaacttc

SEQ ID NO: 282528 - DNA, 32 bp, Artificial Sequence
  Description of Artificial Sequence: Synthetic oligonucleotide
attggtcgtcgtcggtattctgagggaacttc

SEQ ID NO: 282529 - DNA, 31 bp, Artificial Sequence
  Description of Artificial Sequence: Synthetic oligonucleotide
ttggtcgtcgtcggtattctgagggaacttc

SEQ ID NO: 282530 - DNA, 30 bp, Artificial Sequence
  Description of Artificial Sequence: Synthetic oligonucleotide
tggtcgtcgtcggtattctgagggaacttc

SEQ ID NO: 282531 - DNA, 29 bp, Artificial Sequence
  Description of Artificial Sequence: Synthetic oligonucleotide
ggtcgtcgtcggtattctgagggaacttc

SEQ ID NO: 282532 - DNA, 30 bp, Artificial Sequence
  Description of Artificial Sequence: Synthetic oligonucleotide
gtcgtcgtcggtattctgagggaacttcag

SEQ ID NO: 282533 - DNA, 30 bp, Artificial Sequence
  Description of Artificial Sequence: Synthetic oligonucleotide
tcgtcgtcggtattctgagggaacttcagc

SEQ ID NO: 282534 - DNA, 29 bp, Artificial Sequence
  Description of Artificial Sequence: Synthetic oligonucleotide
cgtcgtcggtattctgagggaacttcagc

SEQ ID NO: 282535 - DNA, 30 bp, Artificial Sequence
  Description of Artificial Sequence: Synthetic oligonucleotide
gtcgtcggtattctgagggaacttcagctc

SEQ ID NO: 282536 - DNA, 31 bp, Artificial Sequence
  Description of Artificial Sequence: Synthetic oligonucleotide
tcgtcggtattctgagggaacttcagctcac

SEQ ID NO: 282537 - DNA, 30 bp, Artificial Sequence
  Description of Artificial Sequence: Synthetic oligonucleotide
cgtcggtattctgagggaacttcagctcac

SEQ ID NO: 282538 - DNA, 31 bp, Artificial Sequence
  Description of Artificial Sequence: Synthetic oligonucleotide
gtcggtattctgagggaacttcagctcacag

SEQ ID NO: 282539 - DNA, 32 bp, Artificial Sequence
  Description of Artificial Sequence: Synthetic oligonucleotide
tcggtattctgagggaacttcagctcacagag

SEQ ID NO: 282540 - DNA, 31 bp, Artificial Sequence
  Description of Artificial Sequence: Synthetic oligonucleotide
cggtattctgagggaacttcagctcacagag

SEQ ID NO: 282541 - DNA, 32 bp, Artificial Sequence
  Description of Artificial Sequence: Synthetic oligonucleotide
ggtattctgagggaacttcagctcacagagag

SEQ ID NO: 282542 - DNA, 35 bp, Artificial Sequence
  Description of Artificial Sequence: Synthetic oligonucleotide
gtattctgagggaacttcagctcacagagagaatc

SEQ ID NO: 282543 - DNA, 36 bp, Artificial Sequence
  Description of Artificial Sequence: Synthetic oligonucleotide
tattctgagggaacttcagctcacagagagaatcag

SEQ ID NO: 282544 - DNA, 35 bp, Artificial Sequence
  Description of Artificial Sequence: Synthetic oligonucleotide
attctgagggaacttcagctcacagagagaatcag

SEQ ID NO: 282545 - DNA, 34 bp, Artificial Sequence
  Description of Artificial Sequence: Synthetic oligonucleotide
ttctgagggaacttcagctcacagagagaatcag

SEQ ID NO: 282546 - DNA, 33 bp, Artificial Sequence
  Description of Artificial Sequence: Synthetic oligonucleotide
tctgagggaacttcagctcacagagagaatcag

SEQ ID NO: 282547 - DNA, 32 bp, Artificial Sequence
  Description of Artificial Sequence: Synthetic oligonucleotide
ctgagggaacttcagctcacagagagaatcag

SEQ ID NO: 282548 - DNA, 33 bp, Artificial Sequence
  Description of Artificial Sequence: Synthetic oligonucleotide
tgagggaacttcagctcacagagagaatcagag

SEQ ID NO: 282549 - DNA, 32 bp, Artificial Sequence
  Description of Artificial Sequence: Synthetic oligonucleotide
gagggaacttcagctcacagagagaatcagag

SEQ ID NO: 282550 - DNA, 34 bp, Artificial Sequence
  Description of Artificial Sequence: Synthetic oligonucleotide
agggaacttcagctcacagagagaatcagagaac

SEQ ID NO: 282551 - DNA, 33 bp, Artificial Sequence
  Description of Artificial Sequence: Synthetic oligonucleotide
gggaacttcagctcacagagagaatcagagaac

SEQ ID NO: 282552 - DNA, 33 bp, Artificial Sequence
  Description of Artificial Sequence: Synthetic oligonucleotide
ggaacttcagctcacagagagaatcagagaacc

SEQ ID NO: 282553 - DNA, 38 bp, Artificial Sequence
  Description of Artificial Sequence: Synthetic oligonucleotide
gaacttcagctcacagagagaatcagagaaccttaatg

SEQ ID NO: 282554 - DNA, 38 bp, Artificial Sequence
  Description of Artificial Sequence: Synthetic oligonucleotide
aacttcagctcacagagagaatcagagaaccttaatgg

SEQ ID NO: 282555 - DNA, 37 bp, Artificial Sequence
  Description of Artificial Sequence: Synthetic oligonucleotide
acttcagctcacagagagaatcagagaaccttaatgg

SEQ ID NO: 282556 - DNA, 36 bp, Artificial Sequence
  Description of Artificial Sequence: Synthetic oligonucleotide
cttcagctcacagagagaatcagagaaccttaatgg

SEQ ID NO: 282557 - DNA, 37 bp, Artificial Sequence
  Description of Artificial Sequence: Synthetic oligonucleotide
ttcagctcacagagagaatcagagaaccttaatggag

SEQ ID NO: 282558 - DNA, 36 bp, Artificial Sequence
  Description of Artificial Sequence: Synthetic oligonucleotide
tcagctcacagagagaatcagagaaccttaatggag

SEQ ID NO: 282559 - DNA, 35 bp, Artificial Sequence
  Description of Artificial Sequence: Synthetic oligonucleotide
cagctcacagagagaatcagagaaccttaatggag

SEQ ID NO: 282560 - DNA, 38 bp, Artificial Sequence
  Description of Artificial Sequence: Synthetic oligonucleotide
agctcacagagagaatcagagaaccttaatggagatac

SEQ ID NO: 282561 - DNA, 37 bp, Artificial Sequence
  Description of Artificial Sequence: Synthetic oligonucleotide
gctcacagagagaatcagagaaccttaatggagatac

SEQ ID NO: 282562 - DNA, 38 bp, Artificial Sequence
  Description of Artificial Sequence: Synthetic oligonucleotide
ctcacagagagaatcagagaaccttaatggagatactg

SEQ ID NO: 282563 - DNA, 41 bp, Artificial Sequence
  Description of Artificial Sequence: Synthetic oligonucleotide
tcacagagagaatcagagaaccttaatggagatactgaatc

SEQ ID NO: 282564 - DNA, 40 bp, Artificial Sequence
  Description of Artificial Sequence: Synthetic oligonucleotide
cacagagagaatcagagaaccttaatggagatactgaatc

SEQ ID NO: 282565 - DNA, 44 bp, Artificial Sequence
  Description of Artificial Sequence: Synthetic oligonucleotide
acagagagaatcagagaaccttaatggagatactgaatctaatg

SEQ ID NO: 282566 - DNA, 43 bp, Artificial Sequence
  Description of Artificial Sequence: Synthetic oligonucleotide
cagagagaatcagagaaccttaatggagatactgaatctaatg

SEQ ID NO: 282567 - DNA, 43 bp, Artificial Sequence
  Description of Artificial Sequence: Synthetic oligonucleotide
agagagaatcagagaaccttaatggagatactgaatctaatgg

SEQ ID NO: 282568 - DNA, 42 bp, Artificial Sequence
  Description of Artificial Sequence: Synthetic oligonucleotide
gagagaatcagagaaccttaatggagatactgaatctaatgg

SEQ ID NO: 282569 - DNA, 44 bp, Artificial Sequence
  Description of Artificial Sequence: Synthetic oligonucleotide
agagaatcagagaaccttaatggagatactgaatctaatggatg

SEQ ID NO: 282570 - DNA, 43 bp, Artificial Sequence
  Description of Artificial Sequence: Synthetic oligonucleotide
gagaatcagagaaccttaatggagatactgaatctaatggatg

SEQ ID NO: 282571 - DNA, 43 bp, Artificial Sequence
  Description of Artificial Sequence: Synthetic oligonucleotide
agaatcagagaaccttaatggagatactgaatctaatggatgg

SEQ ID NO: 282572 - DNA, 42 bp, Artificial Sequence
  Description of Artificial Sequence: Synthetic oligonucleotide
gaatcagagaaccttaatggagatactgaatctaatggatgg

SEQ ID NO: 282573 - DNA, 46 bp, Artificial Sequence
  Description of Artificial Sequence: Synthetic oligonucleotide
aatcagagaaccttaatggagatactgaatctaatggatggttttg

SEQ ID NO: 282574 - DNA, 45 bp, Artificial Sequence
  Description of Artificial Sequence: Synthetic oligonucleotide
atcagagaaccttaatggagatactgaatctaatggatggttttg

SEQ ID NO: 282575 - DNA, 44 bp, Artificial Sequence
  Description of Artificial Sequence: Synthetic oligonucleotide
tcagagaaccttaatggagatactgaatctaatggatggttttg

SEQ ID NO: 282576 - DNA, 43 bp, Artificial Sequence
  Description of Artificial Sequence: Synthetic oligonucleotide
cagagaaccttaatggagatactgaatctaatggatggttttg

SEQ ID NO: 282577 - DNA, 46 bp, Artificial Sequence
  Description of Artificial Sequence: Synthetic oligonucleotide
agagaaccttaatggagatactgaatctaatggatggttttgatac

SEQ ID NO: 282578 - DNA, 45 bp, Artificial Sequence
  Description of Artificial Sequence: Synthetic oligonucleotide
gagaaccttaatggagatactgaatctaatggatggttttgatac

SEQ ID NO: 282579 - DNA, 46 bp, Artificial Sequence
  Description of Artificial Sequence: Synthetic oligonucleotide
agaaccttaatggagatactgaatctaatggatggttttgatactg

SEQ ID NO: 282580 - DNA, 45 bp, Artificial Sequence
  Description of Artificial Sequence: Synthetic oligonucleotide
gaaccttaatggagatactgaatctaatggatggttttgatactg

SEQ ID NO: 282581 - DNA, 46 bp, Artificial Sequence
  Description of Artificial Sequence: Synthetic oligonucleotide
aaccttaatggagatactgaatctaatggatggttttgatactgtg

SEQ ID NO: 282582 - DNA, 45 bp, Artificial Sequence
  Description of Artificial Sequence: Synthetic oligonucleotide
accttaatggagatactgaatctaatggatggttttgatactgtg

SEQ ID NO: 282583 - DNA, 44 bp, Artificial Sequence
  Description of Artificial Sequence: Synthetic oligonucleotide
ccttaatggagatactgaatctaatggatggttttgatactgtg

SEQ ID NO: 282584 - DNA, 44 bp, Artificial Sequence
  Description of Artificial Sequence: Synthetic oligonucleotide
cttaatggagatactgaatctaatggatggttttgatactgtgc

SEQ ID NO: 282585 - DNA, 47 bp, Artificial Sequence
  Description of Artificial Sequence: Synthetic oligonucleotide
ttaatggagatactgaatctaatggatggttttgatactgtgcatag

SEQ ID NO: 282586 - DNA, 46 bp, Artificial Sequence
  Description of Artificial Sequence: Synthetic oligonucleotide
taatggagatactgaatctaatggatggttttgatactgtgcatag

SEQ ID NO: 282587 - DNA, 45 bp, Artificial Sequence
  Description of Artificial Sequence: Synthetic oligonucleotide
aatggagatactgaatctaatggatggttttgatactgtgcatag

SEQ ID NO: 282588 - DNA, 44 bp, Artificial Sequence
  Description of Artificial Sequence: Synthetic oligonucleotide
atggagatactgaatctaatggatggttttgatactgtgcatag

SEQ ID NO: 282589 - DNA, 43 bp, Artificial Sequence
  Description of Artificial Sequence: Synthetic oligonucleotide
tggagatactgaatctaatggatggttttgatactgtgcatag

SEQ ID NO: 282590 - DNA, 42 bp, Artificial Sequence
  Description of Artificial Sequence: Synthetic oligonucleotide
ggagatactgaatctaatggatggttttgatactgtgcatag

SEQ ID NO: 282591 - DNA, 43 bp, Artificial Sequence
  Description of Artificial Sequence: Synthetic oligonucleotide
gagatactgaatctaatggatggttttgatactgtgcatagag

SEQ ID NO: 282592 - DNA, 50 bp, Artificial Sequence
  Description of Artificial Sequence: Synthetic oligonucleotide
agatactgaatctaatggatggttttgatactgtgcatagagataaaatg

SEQ ID NO: 282593 - DNA, 49 bp, Artificial Sequence
  Description of Artificial Sequence: Synthetic oligonucleotide
gatactgaatctaatggatggttttgatactgtgcatagagataaaatg

SEQ ID NO: 282594 - DNA, 51 bp, Artificial Sequence
  Description of Artificial Sequence: Synthetic oligonucleotide
atactgaatctaatggatggttttgatactgtgcatagagataaaatgatg

SEQ ID NO: 282595 - DNA, 50 bp, Artificial Sequence
  Description of Artificial Sequence: Synthetic oligonucleotide
tactgaatctaatggatggttttgatactgtgcatagagataaaatgatg

SEQ ID NO: 282596 - DNA, 49 bp, Artificial Sequence
  Description of Artificial Sequence: Synthetic oligonucleotide
actgaatctaatggatggttttgatactgtgcatagagataaaatgatg

SEQ ID NO: 282597 - DNA, 48 bp, Artificial Sequence
  Description of Artificial Sequence: Synthetic oligonucleotide
ctgaatctaatggatggttttgatactgtgcatagagataaaatgatg

SEQ ID NO: 282598 - DNA, 50 bp, Artificial Sequence
  Description of Artificial Sequence: Synthetic oligonucleotide
tgaatctaatggatggttttgatactgtgcatagagataaaatgatgatg

SEQ ID NO: 282599 - DNA, 49 bp, Artificial Sequence
  Description of Artificial Sequence: Synthetic oligonucleotide
gaatctaatggatggttttgatactgtgcatagagataaaatgatgatg

SEQ ID NO: 282600 - DNA, 49 bp, Artificial Sequence
  Description of Artificial Sequence: Synthetic oligonucleotide
aatctaatggatggttttgatactgtgcatagagataaaatgatgatgg

SEQ ID NO: 282601 - DNA, 48 bp, Artificial Sequence
  Description of Artificial Sequence: Synthetic oligonucleotide
atctaatggatggttttgatactgtgcatagagataaaatgatgatgg

SEQ ID NO: 282602 - DNA, 47 bp, Artificial Sequence
  Description of Artificial Sequence: Synthetic oligonucleotide
tctaatggatggttttgatactgtgcatagagataaaatgatgatgg

SEQ ID NO: 282603 - DNA, 46 bp, Artificial Sequence
  Description of Artificial Sequence: Synthetic oligonucleotide
ctaatggatggttttgatactgtgcatagagataaaatgatgatgg

SEQ ID NO: 282604 - DNA, 46 bp, Artificial Sequence
  Description of Artificial Sequence: Synthetic oligonucleotide
taatggatggttttgatactgtgcatagagataaaatgatgatggc

SEQ ID NO: 282605 - DNA, 45 bp, Artificial Sequence
  Description of Artificial Sequence: Synthetic oligonucleotide
aatggatggttttgatactgtgcatagagataaaatgatgatggc

SEQ ID NO: 282606 - DNA, 44 bp, Artificial Sequence
  Description of Artificial Sequence: Synthetic oligonucleotide
atggatggttttgatactgtgcatagagataaaatgatgatggc

SEQ ID NO: 282607 - DNA, 43 bp, Artificial Sequence
  Description of Artificial Sequence: Synthetic oligonucleotide
tggatggttttgatactgtgcatagagataaaatgatgatggc

SEQ ID NO: 282608 - DNA, 42 bp, Artificial Sequence
  Description of Artificial Sequence: Synthetic oligonucleotide
ggatggttttgatactgtgcatagagataaaatgatgatggc

SEQ ID NO: 282609 - DNA, 44 bp, Artificial Sequence
  Description of Artificial Sequence: Synthetic oligonucleotide
gatggttttgatactgtgcatagagataaaatgatgatggctac

SEQ ID NO: 282610 - DNA, 47 bp, Artificial Sequence
  Description of Artificial Sequence: Synthetic oligonucleotide
atggttttgatactgtgcatagagataaaatgatgatggctacatac

SEQ ID NO: 282611 - DNA, 46 bp, Artificial Sequence
  Description of Artificial Sequence: Synthetic oligonucleotide
tggttttgatactgtgcatagagataaaatgatgatggctacatac

SEQ ID NO: 282612 - DNA, 45 bp, Artificial Sequence
  Description of Artificial Sequence: Synthetic oligonucleotide
ggttttgatactgtgcatagagataaaatgatgatggctacatac

SEQ ID NO: 282613 - DNA, 46 bp, Artificial Sequence
  Description of Artificial Sequence: Synthetic oligonucleotide
gttttgatactgtgcatagagataaaatgatgatggctacatacag

SEQ ID NO: 282614 - DNA, 47 bp, Artificial Sequence
  Description of Artificial Sequence: Synthetic oligonucleotide
ttttgatactgtgcatagagataaaatgatgatggctacatacagac

SEQ ID NO: 282615 - DNA, 46 bp, Artificial Sequence
  Description of Artificial Sequence: Synthetic oligonucleotide
tttgatactgtgcatagagataaaatgatgatggctacatacagac

SEQ ID NO: 282616 - DNA, 45 bp, Artificial Sequence
  Description of Artificial Sequence: Synthetic oligonucleotide
ttgatactgtgcatagagataaaatgatgatggctacatacagac

SEQ ID NO: 282617 - DNA, 44 bp, Artificial Sequence
  Description of Artificial Sequence: Synthetic oligonucleotide
tgatactgtgcatagagataaaatgatgatggctacatacagac

SEQ ID NO: 282618 - DNA, 43 bp, Artificial Sequence
  Description of Artificial Sequence: Synthetic oligonucleotide
gatactgtgcatagagataaaatgatgatggctacatacagac

SEQ ID NO: 282619 - DNA, 43 bp, Artificial Sequence
  Description of Artificial Sequence: Synthetic oligonucleotide
atactgtgcatagagataaaatgatgatggctacatacagacc

SEQ ID NO: 282620 - DNA, 42 bp, Artificial Sequence
  Description of Artificial Sequence: Synthetic oligonucleotide
tactgtgcatagagataaaatgatgatggctacatacagacc

SEQ ID NO: 282621 - DNA, 41 bp, Artificial Sequence
  Description of Artificial Sequence: Synthetic oligonucleotide
actgtgcatagagataaaatgatgatggctacatacagacc

SEQ ID NO: 282622 - DNA, 40 bp, Artificial Sequence
  Description of Artificial Sequence: Synthetic oligonucleotide
ctgtgcatagagataaaatgatgatggctacatacagacc

SEQ ID NO: 282623 - DNA, 41 bp, Artificial Sequence
  Description of Artificial Sequence: Synthetic oligonucleotide
tgtgcatagagataaaatgatgatggctacatacagaccag

SEQ ID NO: 282624 - DNA, 40 bp, Artificial Sequence
  Description of Artificial Sequence: Synthetic oligonucleotide
gtgcatagagataaaatgatgatggctacatacagaccag

SEQ ID NO: 282625 - DNA, 43 bp, Artificial Sequence
  Description of Artificial Sequence: Synthetic oligonucleotide
tgcatagagataaaatgatgatggctacatacagaccagttac

SEQ ID NO: 282626 - DNA, 42 bp, Artificial Sequence
  Description of Artificial Sequence: Synthetic oligonucleotide
gcatagagataaaatgatgatggctacatacagaccagttac

SEQ ID NO: 282627 - DNA, 43 bp, Artificial Sequence
  Description of Artificial Sequence: Synthetic oligonucleotide
catagagataaaatgatgatggctacatacagaccagttacac

SEQ ID NO: 282628 - DNA, 44 bp, Artificial Sequence
  Description of Artificial Sequence: Synthetic oligonucleotide
atagagataaaatgatgatggctacatacagaccagttacactg

SEQ ID NO: 282629 - DNA, 43 bp, Artificial Sequence
  Description of Artificial Sequence: Synthetic oligonucleotide
tagagataaaatgatgatggctacatacagaccagttacactg

SEQ ID NO: 282630 - DNA, 42 bp, Artificial Sequence
  Description of Artificial Sequence: Synthetic oligonucleotide
agagataaaatgatgatggctacatacagaccagttacactg

SEQ ID NO: 282631 - DNA, 41 bp, Artificial Sequence
  Description of Artificial Sequence: Synthetic oligonucleotide
gagataaaatgatgatggctacatacagaccagttacactg

SEQ ID NO: 282632 - DNA, 41 bp, Artificial Sequence
  Description of Artificial Sequence: Synthetic oligonucleotide
agataaaatgatgatggctacatacagaccagttacactgg

SEQ ID NO: 282633 - DNA, 40 bp, Artificial Sequence
  Description of Artificial Sequence: Synthetic oligonucleotide
gataaaatgatgatggctacatacagaccagttacactgg

SEQ ID NO: 282634 - DNA, 42 bp, Artificial Sequence
  Description of Artificial Sequence: Synthetic oligonucleotide
ataaaatgatgatggctacatacagaccagttacactggaac

SEQ ID NO: 282635 - DNA, 41 bp, Artificial Sequence
  Description of Artificial Sequence: Synthetic oligonucleotide
taaaatgatgatggctacatacagaccagttacactggaac

SEQ ID NO: 282636 - DNA, 40 bp, Artificial Sequence
  Description of Artificial Sequence: Synthetic oligonucleotide
aaaatgatgatggctacatacagaccagttacactggaac

SEQ ID NO: 282637 - DNA, 39 bp, Artificial Sequence
  Description of Artificial Sequence: Synthetic oligonucleotide
aaatgatgatggctacatacagaccagttacactggaac

SEQ ID NO: 282638 - DNA, 38 bp, Artificial Sequence
  Description of Artificial Sequence: Synthetic oligonucleotide
aatgatgatggctacatacagaccagttacactggaac

SEQ ID NO: 282639 - DNA, 37 bp, Artificial Sequence
  Description of Artificial Sequence: Synthetic oligonucleotide
atgatgatggctacatacagaccagttacactggaac

SEQ ID NO: 282640 - DNA, 36 bp, Artificial Sequence
  Description of Artificial Sequence: Synthetic oligonucleotide
tgatgatggctacatacagaccagttacactggaac

SEQ ID NO: 282641 - DNA, 35 bp, Artificial Sequence
  Description of Artificial Sequence: Synthetic oligonucleotide
gatgatggctacatacagaccagttacactggaac

SEQ ID NO: 282642 - DNA, 35 bp, Artificial Sequence
  Description of Artificial Sequence: Synthetic oligonucleotide
atgatggctacatacagaccagttacactggaacc

SEQ ID NO: 282643 - DNA, 34 bp, Artificial Sequence
  Description of Artificial Sequence: Synthetic oligonucleotide
tgatggctacatacagaccagttacactggaacc

SEQ ID NO: 282644 - DNA, 33 bp, Artificial Sequence
  Description of Artificial Sequence: Synthetic oligonucleotide
gatggctacatacagaccagttacactggaacc

SEQ ID NO: 282645 - DNA, 34 bp, Artificial Sequence
  Description of Artificial Sequence: Synthetic oligonucleotide
atggctacatacagaccagttacactggaacctg

SEQ ID NO: 282646 - DNA, 33 bp, Artificial Sequence
  Description of Artificial Sequence: Synthetic oligonucleotide
tggctacatacagaccagttacactggaacctg

SEQ ID NO: 282647 - DNA, 32 bp, Artificial Sequence
  Description of Artificial Sequence: Synthetic oligonucleotide
ggctacatacagaccagttacactggaacctg

SEQ ID NO: 282648 - DNA, 32 bp, Artificial Sequence
  Description of Artificial Sequence: Synthetic oligonucleotide
gctacatacagaccagttacactggaacctgc

SEQ ID NO: 282649 - DNA, 35 bp, Artificial Sequence
  Description of Artificial Sequence: Synthetic oligonucleotide
ctacatacagaccagttacactggaacctgctttg

SEQ ID NO: 282650 - DNA, 35 bp, Artificial Sequence
  Description of Artificial Sequence: Synthetic oligonucleotide
tacatacagaccagttacactggaacctgctttgg

SEQ ID NO: 282651 - DNA, 34 bp, Artificial Sequence
  Description of Artificial Sequence: Synthetic oligonucleotide
acatacagaccagttacactggaacctgctttgg

SEQ ID NO: 282652 - DNA, 33 bp, Artificial Sequence
  Description of Artificial Sequence: Synthetic oligonucleotide
catacagaccagttacactggaacctgctttgg

SEQ ID NO: 282653 - DNA, 34 bp, Artificial Sequence
  Description of Artificial Sequence: Synthetic oligonucleotide
atacagaccagttacactggaacctgctttggtg

SEQ ID NO: 282654 - DNA, 33 bp, Artificial Sequence
  Description of Artificial Sequence: Synthetic oligonucleotide
tacagaccagttacactggaacctgctttggtg

SEQ ID NO: 282655 - DNA, 32 bp, Artificial Sequence
  Description of Artificial Sequence: Synthetic oligonucleotide
acagaccagttacactggaacctgctttggtg

SEQ ID NO: 282656 - DNA, 31 bp, Artificial Sequence
  Description of Artificial Sequence: Synthetic oligonucleotide
cagaccagttacactggaacctgctttggtg

SEQ ID NO: 282657 - DNA, 31 bp, Artificial Sequence
  Description of Artificial Sequence: Synthetic oligonucleotide
agaccagttacactggaacctgctttggtgc

SEQ ID NO: 282658 - DNA, 30 bp, Artificial Sequence
  Description of Artificial Sequence: Synthetic oligonucleotide
gaccagttacactggaacctgctttggtgc

SEQ ID NO: 282659 - DNA, 30 bp, Artificial Sequence
  Description of Artificial Sequence: Synthetic oligonucleotide
accagttacactggaacctgctttggtgcg

SEQ ID NO: 282660 - DNA, 29 bp, Artificial Sequence
  Description of Artificial Sequence: Synthetic oligonucleotide
ccagttacactggaacctgctttggtgcg

SEQ ID NO: 282661 - DNA, 30 bp, Artificial Sequence
  Description of Artificial Sequence: Synthetic oligonucleotide
cagttacactggaacctgctttggtgcgtc

SEQ ID NO: 282662 - DNA, 30 bp, Artificial Sequence
  Description of Artificial Sequence: Synthetic oligonucleotide
agttacactggaacctgctttggtgcgtcc

SEQ ID NO: 282663 - DNA, 29 bp, Artificial Sequence
  Description of Artificial Sequence: Synthetic oligonucleotide
gttacactggaacctgctttggtgcgtcc

SEQ ID NO: 282664 - DNA, 30 bp, Artificial Sequence
  Description of Artificial Sequence: Synthetic oligonucleotide
ttacactggaacctgctttggtgcgtccag

SEQ ID NO: 282665 - DNA, 29 bp, Artificial Sequence
  Description of Artificial Sequence: Synthetic oligonucleotide
tacactggaacctgctttggtgcgtccag

SEQ ID NO: 282666 - DNA, 28 bp, Artificial Sequence
  Description of Artificial Sequence: Synthetic oligonucleotide
acactggaacctgctttggtgcgtccag

SEQ ID NO: 282667 - DNA, 27 bp, Artificial Sequence
  Description of Artificial Sequence: Synthetic oligonucleotide
cactggaacctgctttggtgcgtccag

SEQ ID NO: 282668 - DNA, 27 bp, Artificial Sequence
  Description of Artificial Sequence: Synthetic oligonucleotide
actggaacctgctttggtgcgtccagc

SEQ ID NO: 282669 - DNA, 27 bp, Artificial Sequence
  Description of Artificial Sequence: Synthetic oligonucleotide
ctggaacctgctttggtgcgtccagca

SEQ ID NO: 282670 - DNA, 28 bp, Artificial Sequence
  Description of Artificial Sequence: Synthetic oligonucleotide
tggaacctgctttggtgcgtccagcaag

SEQ ID NO: 282671 - DNA, 27 bp, Artificial Sequence
  Description of Artificial Sequence: Synthetic oligonucleotide
ggaacctgctttggtgcgtccagcaag

SEQ ID NO: 282672 - DNA, 31 bp, Artificial Sequence
  Description of Artificial Sequence: Synthetic oligonucleotide
gaacctgctttggtgcgtccagcaagattag

SEQ ID NO: 282673 - DNA, 34 bp, Artificial Sequence
  Description of Artificial Sequence: Synthetic oligonucleotide
aacctgctttggtgcgtccagcaagattagaaag

SEQ ID NO: 282674 - DNA, 33 bp, Artificial Sequence
  Description of Artificial Sequence: Synthetic oligonucleotide
acctgctttggtgcgtccagcaagattagaaag

SEQ ID NO: 282675 - DNA, 32 bp, Artificial Sequence
  Description of Artificial Sequence: Synthetic oligonucleotide
cctgctttggtgcgtccagcaagattagaaag

SEQ ID NO: 282676 - DNA, 39 bp, Artificial Sequence
  Description of Artificial Sequence: Synthetic oligonucleotide
ctgctttggtgcgtccagcaagattagaaagaaaaatag

SEQ ID NO: 282677 - DNA, 44 bp, Artificial Sequence
  Description of Artificial Sequence: Synthetic oligonucleotide
tgctttggtgcgtccagcaagattagaaagaaaaatagatattg

SEQ ID NO: 282678 - DNA, 43 bp, Artificial Sequence
  Description of Artificial Sequence: Synthetic oligonucleotide
gctttggtgcgtccagcaagattagaaagaaaaatagatattg

SEQ ID NO: 282679 - DNA, 47 bp, Artificial Sequence
  Description of Artificial Sequence: Synthetic oligonucleotide
ctttggtgcgtccagcaagattagaaagaaaaatagatattgattag

SEQ ID NO: 282680 - DNA, 47 bp, Artificial Sequence
  Description of Artificial Sequence: Synthetic oligonucleotide
tttggtgcgtccagcaagattagaaagaaaaatagatattgattagc

SEQ ID NO: 282681 - DNA, 46 bp, Artificial Sequence
  Description of Artificial Sequence: Synthetic oligonucleotide
ttggtgcgtccagcaagattagaaagaaaaatagatattgattagc

SEQ ID NO: 282682 - DNA, 45 bp, Artificial Sequence
  Description of Artificial Sequence: Synthetic oligonucleotide
tggtgcgtccagcaagattagaaagaaaaatagatattgattagc

SEQ ID NO: 282683 - DNA, 44 bp, Artificial Sequence
  Description of Artificial Sequence: Synthetic oligonucleotide
ggtgcgtccagcaagattagaaagaaaaatagatattgattagc

SEQ ID NO: 282684 - DNA, 44 bp, Artificial Sequence
  Description of Artificial Sequence: Synthetic oligonucleotide
gtgcgtccagcaagattagaaagaaaaatagatattgattagcc

SEQ ID NO: 282685 - DNA, 48 bp, Artificial Sequence
  Description of Artificial Sequence: Synthetic oligonucleotide
tgcgtccagcaagattagaaagaaaaatagatattgattagccaaatg

SEQ ID NO: 282686 - DNA, 47 bp, Artificial Sequence
  Description of Artificial Sequence: Synthetic oligonucleotide
gcgtccagcaagattagaaagaaaaatagatattgattagccaaatg

SEQ ID NO: 282687 - DNA, 49 bp, Artificial Sequence
  Description of Artificial Sequence: Synthetic oligonucleotide
cgtccagcaagattagaaagaaaaatagatattgattagccaaatgatc

SEQ ID NO: 282688 - DNA, 51 bp, Artificial Sequence
  Description of Artificial Sequence: Synthetic oligonucleotide
gtccagcaagattagaaagaaaaatagatattgattagccaaatgatcaag

SEQ ID NO: 282689 - DNA, 51 bp, Artificial Sequence
  Description of Artificial Sequence: Synthetic oligonucleotide
tccagcaagattagaaagaaaaatagatattgattagccaaatgatcaagc

SEQ ID NO: 282690 - DNA, 50 bp, Artificial Sequence
  Description of Artificial Sequence: Synthetic oligonucleotide
ccagcaagattagaaagaaaaatagatattgattagccaaatgatcaagc

SEQ ID NO: 282691 - DNA, 52 bp, Artificial Sequence
  Description of Artificial Sequence: Synthetic oligonucleotide
cagcaagattagaaagaaaaatagatattgattagccaaatgatcaagcaag

SEQ ID NO: 282692 - DNA, 56 bp, Artificial Sequence
  Description of Artificial Sequence: Synthetic oligonucleotide
agcaagattagaaagaaaaatagatattgattagccaaatgatcaagcaagaatag

SEQ ID NO: 282693 - DNA, 55 bp, Artificial Sequence
  Description of Artificial Sequence: Synthetic oligonucleotide
gcaagattagaaagaaaaatagatattgattagccaaatgatcaagcaagaatag

SEQ ID NO: 282694 - DNA, 56 bp, Artificial Sequence
  Description of Artificial Sequence: Synthetic oligonucleotide
caagattagaaagaaaaatagatattgattagccaaatgatcaagcaagaatagac

SEQ ID NO: 282695 - DNA, 59 bp, Artificial Sequence
  Description of Artificial Sequence: Synthetic oligonucleotide
aagattagaaagaaaaatagatattgattagccaaatgatcaagcaagaatagacatac

SEQ ID NO: 282696 - DNA, 58 bp, Artificial Sequence
  Description of Artificial Sequence: Synthetic oligonucleotide
agattagaaagaaaaatagatattgattagccaaatgatcaagcaagaatagacatac

SEQ ID NO: 282697 - DNA, 57 bp, Artificial Sequence
  Description of Artificial Sequence: Synthetic oligonucleotide
gattagaaagaaaaatagatattgattagccaaatgatcaagcaagaatagacatac

SEQ ID NO: 282698 - DNA, 58 bp, Artificial Sequence
  Description of Artificial Sequence: Synthetic oligonucleotide
attagaaagaaaaatagatattgattagccaaatgatcaagcaagaatagacatacag

SEQ ID NO: 282699 - DNA, 57 bp, Artificial Sequence
  Description of Artificial Sequence: Synthetic oligonucleotide
ttagaaagaaaaatagatattgattagccaaatgatcaagcaagaatagacatacag

SEQ ID NO: 282700 - DNA, 56 bp, Artificial Sequence
  Description of Artificial Sequence: Synthetic oligonucleotide
tagaaagaaaaatagatattgattagccaaatgatcaagcaagaatagacatacag

SEQ ID NO: 282701 - DNA, 55 bp, Artificial Sequence
  Description of Artificial Sequence: Synthetic oligonucleotide
agaaagaaaaatagatattgattagccaaatgatcaagcaagaatagacatacag

SEQ ID NO: 282702 - DNA, 54 bp, Artificial Sequence
  Description of Artificial Sequence: Synthetic oligonucleotide
gaaagaaaaatagatattgattagccaaatgatcaagcaagaatagacatacag

SEQ ID NO: 282703 - DNA, 59 bp, Artificial Sequence
  Description of Artificial Sequence: Synthetic oligonucleotide
aaagaaaaatagatattgattagccaaatgatcaagcaagaatagacatacagaaaatc

SEQ ID NO: 282704 - DNA, 58 bp, Artificial Sequence
  Description of Artificial Sequence: Synthetic oligonucleotide
aagaaaaatagatattgattagccaaatgatcaagcaagaatagacatacagaaaatc

SEQ ID NO: 282705 - DNA, 57 bp, Artificial Sequence
  Description of Artificial Sequence: Synthetic oligonucleotide
agaaaaatagatattgattagccaaatgatcaagcaagaatagacatacagaaaatc

SEQ ID NO: 282706 - DNA, 56 bp, Artificial Sequence
  Description of Artificial Sequence: Synthetic oligonucleotide
gaaaaatagatattgattagccaaatgatcaagcaagaatagacatacagaaaatc

SEQ ID NO: 282707 - DNA, 56 bp, Artificial Sequence
  Description of Artificial Sequence: Synthetic oligonucleotide
aaaaatagatattgattagccaaatgatcaagcaagaatagacatacagaaaatcc

SEQ ID NO: 282708 - DNA, 55 bp, Artificial Sequence
  Description of Artificial Sequence: Synthetic oligonucleotide
aaaatagatattgattagccaaatgatcaagcaagaatagacatacagaaaatcc

SEQ ID NO: 282709 - DNA, 54 bp, Artificial Sequence
  Description of Artificial Sequence: Synthetic oligonucleotide
aaatagatattgattagccaaatgatcaagcaagaatagacatacagaaaatcc

SEQ ID NO: 282710 - DNA, 53 bp, Artificial Sequence
  Description of Artificial Sequence: Synthetic oligonucleotide
aatagatattgattagccaaatgatcaagcaagaatagacatacagaaaatcc

SEQ ID NO: 282711 - DNA, 52 bp, Artificial Sequence
  Description of Artificial Sequence: Synthetic oligonucleotide
atagatattgattagccaaatgatcaagcaagaatagacatacagaaaatcc

SEQ ID NO: 282712 - DNA, 51 bp, Artificial Sequence
  Description of Artificial Sequence: Synthetic oligonucleotide
tagatattgattagccaaatgatcaagcaagaatagacatacagaaaatcc

SEQ ID NO: 282713 - DNA, 50 bp, Artificial Sequence
  Description of Artificial Sequence: Synthetic oligonucleotide
agatattgattagccaaatgatcaagcaagaatagacatacagaaaatcc

SEQ ID NO: 282714 - DNA, 49 bp, Artificial Sequence
  Description of Artificial Sequence: Synthetic oligonucleotide
gatattgattagccaaatgatcaagcaagaatagacatacagaaaatcc

SEQ ID NO: 282715 - DNA, 51 bp, Artificial Sequence
  Description of Artificial Sequence: Synthetic oligonucleotide
atattgattagccaaatgatcaagcaagaatagacatacagaaaatccaag

SEQ ID NO: 282716 - DNA, 50 bp, Artificial Sequence
  Description of Artificial Sequence: Synthetic oligonucleotide
tattgattagccaaatgatcaagcaagaatagacatacagaaaatccaag

SEQ ID NO: 282717 - DNA, 49 bp, Artificial Sequence
  Description of Artificial Sequence: Synthetic oligonucleotide
attgattagccaaatgatcaagcaagaatagacatacagaaaatccaag

SEQ ID NO: 282718 - DNA, 48 bp, Artificial Sequence
  Description of Artificial Sequence: Synthetic oligonucleotide
ttgattagccaaatgatcaagcaagaatagacatacagaaaatccaag

SEQ ID NO: 282719 - DNA, 47 bp, Artificial Sequence
  Description of Artificial Sequence: Synthetic oligonucleotide
tgattagccaaatgatcaagcaagaatagacatacagaaaatccaag

SEQ ID NO: 282720 - DNA, 46 bp, Artificial Sequence
  Description of Artificial Sequence: Synthetic oligonucleotide
gattagccaaatgatcaagcaagaatagacatacagaaaatccaag

SEQ ID NO: 282721 - DNA, 46 bp, Artificial Sequence
  Description of Artificial Sequence: Synthetic oligonucleotide
attagccaaatgatcaagcaagaatagacatacagaaaatccaagc

SEQ ID NO: 282722 - DNA, 45 bp, Artificial Sequence
  Description of Artificial Sequence: Synthetic oligonucleotide
ttagccaaatgatcaagcaagaatagacatacagaaaatccaagc

SEQ ID NO: 282723 - DNA, 44 bp, Artificial Sequence
  Description of Artificial Sequence: Synthetic oligonucleotide
tagccaaatgatcaagcaagaatagacatacagaaaatccaagc

SEQ ID NO: 282724 - DNA, 43 bp, Artificial Sequence
  Description of Artificial Sequence: Synthetic oligonucleotide
agccaaatgatcaagcaagaatagacatacagaaaatccaagc

SEQ ID NO: 282725 - DNA, 42 bp, Artificial Sequence
  Description of Artificial Sequence: Synthetic oligonucleotide
gccaaatgatcaagcaagaatagacatacagaaaatccaagc

SEQ ID NO: 282726 - DNA, 43 bp, Artificial Sequence
  Description of Artificial Sequence: Synthetic oligonucleotide
ccaaatgatcaagcaagaatagacatacagaaaatccaagcag

SEQ ID NO: 282727 - DNA, 43 bp, Artificial Sequence
  Description of Artificial Sequence: Synthetic oligonucleotide
caaatgatcaagcaagaatagacatacagaaaatccaagcagg

SEQ ID NO: 282728 - DNA, 44 bp, Artificial Sequence
  Description of Artificial Sequence: Synthetic oligonucleotide
aaatgatcaagcaagaatagacatacagaaaatccaagcaggtc

SEQ ID NO: 282729 - DNA, 43 bp, Artificial Sequence
  Description of Artificial Sequence: Synthetic oligonucleotide
aatgatcaagcaagaatagacatacagaaaatccaagcaggtc

SEQ ID NO: 282730 - DNA, 42 bp, Artificial Sequence
  Description of Artificial Sequence: Synthetic oligonucleotide
atgatcaagcaagaatagacatacagaaaatccaagcaggtc

SEQ ID NO: 282731 - DNA, 41 bp, Artificial Sequence
  Description of Artificial Sequence: Synthetic oligonucleotide
tgatcaagcaagaatagacatacagaaaatccaagcaggtc

SEQ ID NO: 282732 - DNA, 40 bp, Artificial Sequence
  Description of Artificial Sequence: Synthetic oligonucleotide
gatcaagcaagaatagacatacagaaaatccaagcaggtc

SEQ ID NO: 282733 - DNA, 40 bp, Artificial Sequence
  Description of Artificial Sequence: Synthetic oligonucleotide
atcaagcaagaatagacatacagaaaatccaagcaggtcc

SEQ ID NO: 282734 - DNA, 39 bp, Artificial Sequence
  Description of Artificial Sequence: Synthetic oligonucleotide
tcaagcaagaatagacatacagaaaatccaagcaggtcc

SEQ ID NO: 282735 - DNA, 38 bp, Artificial Sequence
  Description of Artificial Sequence: Synthetic oligonucleotide
caagcaagaatagacatacagaaaatccaagcaggtcc

SEQ ID NO: 282736 - DNA, 38 bp, Artificial Sequence
  Description of Artificial Sequence: Synthetic oligonucleotide
aagcaagaatagacatacagaaaatccaagcaggtccc

SEQ ID NO: 282737 - DNA, 37 bp, Artificial Sequence
  Description of Artificial Sequence: Synthetic oligonucleotide
agcaagaatagacatacagaaaatccaagcaggtccc

SEQ ID NO: 282738 - DNA, 36 bp, Artificial Sequence
  Description of Artificial Sequence: Synthetic oligonucleotide
gcaagaatagacatacagaaaatccaagcaggtccc

SEQ ID NO: 282739 - DNA, 40 bp, Artificial Sequence
  Description of Artificial Sequence: Synthetic oligonucleotide
caagaatagacatacagaaaatccaagcaggtccctttac

SEQ ID NO: 282740 - DNA, 43 bp, Artificial Sequence
  Description of Artificial Sequence: Synthetic oligonucleotide
aagaatagacatacagaaaatccaagcaggtccctttacaaag

SEQ ID NO: 282741 - DNA, 42 bp, Artificial Sequence
  Description of Artificial Sequence: Synthetic oligonucleotide
agaatagacatacagaaaatccaagcaggtccctttacaaag

SEQ ID NO: 282742 - DNA, 41 bp, Artificial Sequence
  Description of Artificial Sequence: Synthetic oligonucleotide
gaatagacatacagaaaatccaagcaggtccctttacaaag

SEQ ID NO: 282743 - DNA, 41 bp, Artificial Sequence
  Description of Artificial Sequence: Synthetic oligonucleotide
aatagacatacagaaaatccaagcaggtccctttacaaagc

SEQ ID NO: 282744 - DNA, 40 bp, Artificial Sequence
  Description of Artificial Sequence: Synthetic oligonucleotide
atagacatacagaaaatccaagcaggtccctttacaaagc

SEQ ID NO: 282745 - DNA, 39 bp, Artificial Sequence
  Description of Artificial Sequence: Synthetic oligonucleotide
tagacatacagaaaatccaagcaggtccctttacaaagc

SEQ ID NO: 282746 - DNA, 38 bp, Artificial Sequence
  Description of Artificial Sequence: Synthetic oligonucleotide
agacatacagaaaatccaagcaggtccctttacaaagc

SEQ ID NO: 282747 - DNA, 37 bp, Artificial Sequence
  Description of Artificial Sequence: Synthetic oligonucleotide
gacatacagaaaatccaagcaggtccctttacaaagc

SEQ ID NO: 282748 - DNA, 39 bp, Artificial Sequence
  Description of Artificial Sequence: Synthetic oligonucleotide
acatacagaaaatccaagcaggtccctttacaaagcttg

SEQ ID NO: 282749 - DNA, 38 bp, Artificial Sequence
  Description of Artificial Sequence: Synthetic oligonucleotide
catacagaaaatccaagcaggtccctttacaaagcttg

SEQ ID NO: 282750 - DNA, 38 bp, Artificial Sequence
  Description of Artificial Sequence: Synthetic oligonucleotide
atacagaaaatccaagcaggtccctttacaaagcttgg

SEQ ID NO: 282751 - DNA, 37 bp, Artificial Sequence
  Description of Artificial Sequence: Synthetic oligonucleotide
tacagaaaatccaagcaggtccctttacaaagcttgg

SEQ ID NO: 282752 - DNA, 36 bp, Artificial Sequence
  Description of Artificial Sequence: Synthetic oligonucleotide
acagaaaatccaagcaggtccctttacaaagcttgg

SEQ ID NO: 282753 - DNA, 35 bp, Artificial Sequence
  Description of Artificial Sequence: Synthetic oligonucleotide
cagaaaatccaagcaggtccctttacaaagcttgg

SEQ ID NO: 282754 - DNA, 36 bp, Artificial Sequence
  Description of Artificial Sequence: Synthetic oligonucleotide
agaaaatccaagcaggtccctttacaaagcttggtg

SEQ ID NO: 282755 - DNA, 35 bp, Artificial Sequence
  Description of Artificial Sequence: Synthetic oligonucleotide
gaaaatccaagcaggtccctttacaaagcttggtg

SEQ ID NO: 282756 - DNA, 40 bp, Artificial Sequence
  Description of Artificial Sequence: Synthetic oligonucleotide
aaaatccaagcaggtccctttacaaagcttggtgaaattg

SEQ ID NO: 282757 - DNA, 39 bp, Artificial Sequence
  Description of Artificial Sequence: Synthetic oligonucleotide
aaatccaagcaggtccctttacaaagcttggtgaaattg

SEQ ID NO: 282758 - DNA, 38 bp, Artificial Sequence
  Description of Artificial Sequence: Synthetic oligonucleotide
aatccaagcaggtccctttacaaagcttggtgaaattg

SEQ ID NO: 282759 - DNA, 37 bp, Artificial Sequence
  Description of Artificial Sequence: Synthetic oligonucleotide
atccaagcaggtccctttacaaagcttggtgaaattg

SEQ ID NO: 282760 - DNA, 36 bp, Artificial Sequence
  Description of Artificial Sequence: Synthetic oligonucleotide
tccaagcaggtccctttacaaagcttggtgaaattg

SEQ ID NO: 282761 - DNA, 35 bp, Artificial Sequence
  Description of Artificial Sequence: Synthetic oligonucleotide
ccaagcaggtccctttacaaagcttggtgaaattg

SEQ ID NO: 282762 - DNA, 40 bp, Artificial Sequence
  Description of Artificial Sequence: Synthetic oligonucleotide
caagcaggtccctttacaaagcttggtgaaattgattatg

SEQ ID NO: 282763 - DNA, 42 bp, Artificial Sequence
  Description of Artificial Sequence: Synthetic oligonucleotide
aagcaggtccctttacaaagcttggtgaaattgattatgaac

SEQ ID NO: 282764 - DNA, 41 bp, Artificial Sequence
  Description of Artificial Sequence: Synthetic oligonucleotide
agcaggtccctttacaaagcttggtgaaattgattatgaac

SEQ ID NO: 282765 - DNA, 40 bp, Artificial Sequence
  Description of Artificial Sequence: Synthetic oligonucleotide
gcaggtccctttacaaagcttggtgaaattgattatgaac

SEQ ID NO: 282766 - DNA, 40 bp, Artificial Sequence
  Description of Artificial Sequence: Synthetic oligonucleotide
caggtccctttacaaagcttggtgaaattgattatgaacc

SEQ ID NO: 282767 - DNA, 44 bp, Artificial Sequence
  Description of Artificial Sequence: Synthetic oligonucleotide
aggtccctttacaaagcttggtgaaattgattatgaaccaattg

SEQ ID NO: 282768 - DNA, 43 bp, Artificial Sequence
  Description of Artificial Sequence: Synthetic oligonucleotide
ggtccctttacaaagcttggtgaaattgattatgaaccaattg

SEQ ID NO: 282769 - DNA, 44 bp, Artificial Sequence
  Description of Artificial Sequence: Synthetic oligonucleotide
gtccctttacaaagcttggtgaaattgattatgaaccaattgtg

SEQ ID NO: 282770 - DNA, 46 bp, Artificial Sequence
  Description of Artificial Sequence: Synthetic oligonucleotide
tccctttacaaagcttggtgaaattgattatgaaccaattgtgatg

SEQ ID NO: 282771 - DNA, 45 bp, Artificial Sequence
  Description of Artificial Sequence: Synthetic oligonucleotide
ccctttacaaagcttggtgaaattgattatgaaccaattgtgatg

SEQ ID NO: 282772 - DNA, 45 bp, Artificial Sequence
  Description of Artificial Sequence: Synthetic oligonucleotide
cctttacaaagcttggtgaaattgattatgaaccaattgtgatgc

SEQ ID NO: 282773 - DNA, 48 bp, Artificial Sequence
  Description of Artificial Sequence: Synthetic oligonucleotide
ctttacaaagcttggtgaaattgattatgaaccaattgtgatgctttc

SEQ ID NO: 282774 - DNA, 48 bp, Artificial Sequence
  Description of Artificial Sequence: Synthetic oligonucleotide
tttacaaagcttggtgaaattgattatgaaccaattgtgatgctttcg

SEQ ID NO: 282775 - DNA, 47 bp, Artificial Sequence
  Description of Artificial Sequence: Synthetic oligonucleotide
ttacaaagcttggtgaaattgattatgaaccaattgtgatgctttcg

SEQ ID NO: 282776 - DNA, 46 bp, Artificial Sequence
  Description of Artificial Sequence: Synthetic oligonucleotide
tacaaagcttggtgaaattgattatgaaccaattgtgatgctttcg

SEQ ID NO: 282777 - DNA, 45 bp, Artificial Sequence
  Description of Artificial Sequence: Synthetic oligonucleotide
acaaagcttggtgaaattgattatgaaccaattgtgatgctttcg

SEQ ID NO: 282778 - DNA, 44 bp, Artificial Sequence
  Description of Artificial Sequence: Synthetic oligonucleotide
caaagcttggtgaaattgattatgaaccaattgtgatgctttcg

SEQ ID NO: 282779 - DNA, 44 bp, Artificial Sequence
  Description of Artificial Sequence: Synthetic oligonucleotide
aaagcttggtgaaattgattatgaaccaattgtgatgctttcgg

SEQ ID NO: 282780 - DNA, 43 bp, Artificial Sequence
  Description of Artificial Sequence: Synthetic oligonucleotide
aagcttggtgaaattgattatgaaccaattgtgatgctttcgg

SEQ ID NO: 282781 - DNA, 42 bp, Artificial Sequence
  Description of Artificial Sequence: Synthetic oligonucleotide
agcttggtgaaattgattatgaaccaattgtgatgctttcgg

SEQ ID NO: 282782 - DNA, 41 bp, Artificial Sequence
  Description of Artificial Sequence: Synthetic oligonucleotide
gcttggtgaaattgattatgaaccaattgtgatgctttcgg

SEQ ID NO: 282783 - DNA, 43 bp, Artificial Sequence
  Description of Artificial Sequence: Synthetic oligonucleotide
cttggtgaaattgattatgaaccaattgtgatgctttcggaag

SEQ ID NO: 282784 - DNA, 43 bp, Artificial Sequence
  Description of Artificial Sequence: Synthetic oligonucleotide
ttggtgaaattgattatgaaccaattgtgatgctttcggaagg

SEQ ID NO: 282785 - DNA, 42 bp, Artificial Sequence
  Description of Artificial Sequence: Synthetic oligonucleotide
tggtgaaattgattatgaaccaattgtgatgctttcggaagg

SEQ ID NO: 282786 - DNA, 41 bp, Artificial Sequence
  Description of Artificial Sequence: Synthetic oligonucleotide
ggtgaaattgattatgaaccaattgtgatgctttcggaagg

SEQ ID NO: 282787 - DNA, 41 bp, Artificial Sequence
  Description of Artificial Sequence: Synthetic oligonucleotide
gtgaaattgattatgaaccaattgtgatgctttcggaaggc

SEQ ID NO: 282788 - DNA, 47 bp, Artificial Sequence
  Description of Artificial Sequence: Synthetic oligonucleotide
tgaaattgattatgaaccaattgtgatgctttcggaaggctttaatc

SEQ ID NO: 282789 - DNA, 46 bp, Artificial Sequence
  Description of Artificial Sequence: Synthetic oligonucleotide
gaaattgattatgaaccaattgtgatgctttcggaaggctttaatc

SEQ ID NO: 282790 - DNA, 46 bp, Artificial Sequence
  Description of Artificial Sequence: Synthetic oligonucleotide
aaattgattatgaaccaattgtgatgctttcggaaggctttaatcg

SEQ ID NO: 282791 - DNA, 45 bp, Artificial Sequence
  Description of Artificial Sequence: Synthetic oligonucleotide
aattgattatgaaccaattgtgatgctttcggaaggctttaatcg

SEQ ID NO: 282792 - DNA, 44 bp, Artificial Sequence
  Description of Artificial Sequence: Synthetic oligonucleotide
attgattatgaaccaattgtgatgctttcggaaggctttaatcg

SEQ ID NO: 282793 - DNA, 43 bp, Artificial Sequence
  Description of Artificial Sequence: Synthetic oligonucleotide
ttgattatgaaccaattgtgatgctttcggaaggctttaatcg

SEQ ID NO: 282794 - DNA, 42 bp, Artificial Sequence
  Description of Artificial Sequence: Synthetic oligonucleotide
tgattatgaaccaattgtgatgctttcggaaggctttaatcg

SEQ ID NO: 282795 - DNA, 41 bp, Artificial Sequence
  Description of Artificial Sequence: Synthetic oligonucleotide
gattatgaaccaattgtgatgctttcggaaggctttaatcg

SEQ ID NO: 282796 - DNA, 42 bp, Artificial Sequence
  Description of Artificial Sequence: Synthetic oligonucleotide
attatgaaccaattgtgatgctttcggaaggctttaatcgag

SEQ ID NO: 282797 - DNA, 41 bp, Artificial Sequence
  Description of Artificial Sequence: Synthetic oligonucleotide
ttatgaaccaattgtgatgctttcggaaggctttaatcgag

SEQ ID NO: 282798 - DNA, 40 bp, Artificial Sequence
  Description of Artificial Sequence: Synthetic oligonucleotide
tatgaaccaattgtgatgctttcggaaggctttaatcgag

SEQ ID NO: 282799 - DNA, 39 bp, Artificial Sequence
  Description of Artificial Sequence: Synthetic oligonucleotide
atgaaccaattgtgatgctttcggaaggctttaatcgag

SEQ ID NO: 282800 - DNA, 38 bp, Artificial Sequence
  Description of Artificial Sequence: Synthetic oligonucleotide
tgaaccaattgtgatgctttcggaaggctttaatcgag

SEQ ID NO: 282801 - DNA, 37 bp, Artificial Sequence
  Description of Artificial Sequence: Synthetic oligonucleotide
gaaccaattgtgatgctttcggaaggctttaatcgag

SEQ ID NO: 282802 - DNA, 37 bp, Artificial Sequence
  Description of Artificial Sequence: Synthetic oligonucleotide
aaccaattgtgatgctttcggaaggctttaatcgagc

SEQ ID NO: 282803 - DNA, 36 bp, Artificial Sequence
  Description of Artificial Sequence: Synthetic oligonucleotide
accaattgtgatgctttcggaaggctttaatcgagc

SEQ ID NO: 282804 - DNA, 35 bp, Artificial Sequence
  Description of Artificial Sequence: Synthetic oligonucleotide
ccaattgtgatgctttcggaaggctttaatcgagc

SEQ ID NO: 282805 - DNA, 36 bp, Artificial Sequence
  Description of Artificial Sequence: Synthetic oligonucleotide
caattgtgatgctttcggaaggctttaatcgagcag

SEQ ID NO: 282806 - DNA, 38 bp, Artificial Sequence
  Description of Artificial Sequence: Synthetic oligonucleotide
aattgtgatgctttcggaaggctttaatcgagcagatc

SEQ ID NO: 282807 - DNA, 37 bp, Artificial Sequence
  Description of Artificial Sequence: Synthetic oligonucleotide
attgtgatgctttcggaaggctttaatcgagcagatc

SEQ ID NO: 282808 - DNA, 36 bp, Artificial Sequence
  Description of Artificial Sequence: Synthetic oligonucleotide
ttgtgatgctttcggaaggctttaatcgagcagatc

SEQ ID NO: 282809 - DNA, 35 bp, Artificial Sequence
  Description of Artificial Sequence: Synthetic oligonucleotide
tgtgatgctttcggaaggctttaatcgagcagatc

SEQ ID NO: 282810 - DNA, 34 bp, Artificial Sequence
  Description of Artificial Sequence: Synthetic oligonucleotide
gtgatgctttcggaaggctttaatcgagcagatc

SEQ ID NO: 282811 - DNA, 35 bp, Artificial Sequence
  Description of Artificial Sequence: Synthetic oligonucleotide
tgatgctttcggaaggctttaatcgagcagatcag

SEQ ID NO: 282812 - DNA, 34 bp, Artificial Sequence
  Description of Artificial Sequence: Synthetic oligonucleotide
gatgctttcggaaggctttaatcgagcagatcag

SEQ ID NO: 282813 - DNA, 35 bp, Artificial Sequence
  Description of Artificial Sequence: Synthetic oligonucleotide
atgctttcggaaggctttaatcgagcagatcagag

SEQ ID NO: 282814 - DNA, 34 bp, Artificial Sequence
  Description of Artificial Sequence: Synthetic oligonucleotide
tgctttcggaaggctttaatcgagcagatcagag

SEQ ID NO: 282815 - DNA, 33 bp, Artificial Sequence
  Description of Artificial Sequence: Synthetic oligonucleotide
gctttcggaaggctttaatcgagcagatcagag

SEQ ID NO: 282816 - DNA, 37 bp, Artificial Sequence
  Description of Artificial Sequence: Synthetic oligonucleotide
ctttcggaaggctttaatcgagcagatcagagaaatg

SEQ ID NO: 282817 - DNA, 40 bp, Artificial Sequence
  Description of Artificial Sequence: Synthetic oligonucleotide
tttcggaaggctttaatcgagcagatcagagaaatgtatg

SEQ ID NO: 282818 - DNA, 39 bp, Artificial Sequence
  Description of Artificial Sequence: Synthetic oligonucleotide
ttcggaaggctttaatcgagcagatcagagaaatgtatg

SEQ ID NO: 282819 - DNA, 38 bp, Artificial Sequence
  Description of Artificial Sequence: Synthetic oligonucleotide
tcggaaggctttaatcgagcagatcagagaaatgtatg

SEQ ID NO: 282820 - DNA, 37 bp, Artificial Sequence
  Description of Artificial Sequence: Synthetic oligonucleotide
cggaaggctttaatcgagcagatcagagaaatgtatg

SEQ ID NO: 282821 - DNA, 39 bp, Artificial Sequence
  Description of Artificial Sequence: Synthetic oligonucleotide
ggaaggctttaatcgagcagatcagagaaatgtatgtac

SEQ ID NO: 282822 - DNA, 40 bp, Artificial Sequence
  Description of Artificial Sequence: Synthetic oligonucleotide
gaaggctttaatcgagcagatcagagaaatgtatgtactg

SEQ ID NO: 282823 - DNA, 42 bp, Artificial Sequence
  Description of Artificial Sequence: Synthetic oligonucleotide
aaggctttaatcgagcagatcagagaaatgtatgtactgaac

SEQ ID NO: 282824 - DNA, 41 bp, Artificial Sequence
  Description of Artificial Sequence: Synthetic oligonucleotide
aggctttaatcgagcagatcagagaaatgtatgtactgaac

SEQ ID NO: 282825 - DNA, 40 bp, Artificial Sequence
  Description of Artificial Sequence: Synthetic oligonucleotide
ggctttaatcgagcagatcagagaaatgtatgtactgaac

SEQ ID NO: 282826 - DNA, 40 bp, Artificial Sequence
  Description of Artificial Sequence: Synthetic oligonucleotide
gctttaatcgagcagatcagagaaatgtatgtactgaacc

SEQ ID NO: 282827 - DNA, 41 bp, Artificial Sequence
  Description of Artificial Sequence: Synthetic oligonucleotide
ctttaatcgagcagatcagagaaatgtatgtactgaaccag

SEQ ID NO: 282828 - DNA, 41 bp, Artificial Sequence
  Description of Artificial Sequence: Synthetic oligonucleotide
tttaatcgagcagatcagagaaatgtatgtactgaaccagg

SEQ ID NO: 282829 - DNA, 40 bp, Artificial Sequence
  Description of Artificial Sequence: Synthetic oligonucleotide
ttaatcgagcagatcagagaaatgtatgtactgaaccagg

SEQ ID NO: 282830 - DNA, 39 bp, Artificial Sequence
  Description of Artificial Sequence: Synthetic oligonucleotide
taatcgagcagatcagagaaatgtatgtactgaaccagg

SEQ ID NO: 282831 - DNA, 38 bp, Artificial Sequence
  Description of Artificial Sequence: Synthetic oligonucleotide
aatcgagcagatcagagaaatgtatgtactgaaccagg

SEQ ID NO: 282832 - DNA, 37 bp, Artificial Sequence
  Description of Artificial Sequence: Synthetic oligonucleotide
atcgagcagatcagagaaatgtatgtactgaaccagg

SEQ ID NO: 282833 - DNA, 36 bp, Artificial Sequence
  Description of Artificial Sequence: Synthetic oligonucleotide
tcgagcagatcagagaaatgtatgtactgaaccagg

SEQ ID NO: 282834 - DNA, 35 bp, Artificial Sequence
  Description of Artificial Sequence: Synthetic oligonucleotide
cgagcagatcagagaaatgtatgtactgaaccagg

SEQ ID NO: 282835 - DNA, 38 bp, Artificial Sequence
  Description of Artificial Sequence: Synthetic oligonucleotide
gagcagatcagagaaatgtatgtactgaaccaggtatg

SEQ ID NO: 282836 - DNA, 40 bp, Artificial Sequence
  Description of Artificial Sequence: Synthetic oligonucleotide
agcagatcagagaaatgtatgtactgaaccaggtatgtac

SEQ ID NO: 282837 - DNA, 39 bp, Artificial Sequence
  Description of Artificial Sequence: Synthetic oligonucleotide
gcagatcagagaaatgtatgtactgaaccaggtatgtac

SEQ ID NO: 282838 - DNA, 39 bp, Artificial Sequence
  Description of Artificial Sequence: Synthetic oligonucleotide
cagatcagagaaatgtatgtactgaaccaggtatgtacg

SEQ ID NO: 282839 - DNA, 39 bp, Artificial Sequence
  Description of Artificial Sequence: Synthetic oligonucleotide
agatcagagaaatgtatgtactgaaccaggtatgtacgc

SEQ ID NO: 282840 - DNA, 38 bp, Artificial Sequence
  Description of Artificial Sequence: Synthetic oligonucleotide
gatcagagaaatgtatgtactgaaccaggtatgtacgc

SEQ ID NO: 282841 - DNA, 42 bp, Artificial Sequence
  Description of Artificial Sequence: Synthetic oligonucleotide
atcagagaaatgtatgtactgaaccaggtatgtacgcaattc

SEQ ID NO: 282842 - DNA, 41 bp, Artificial Sequence
  Description of Artificial Sequence: Synthetic oligonucleotide
tcagagaaatgtatgtactgaaccaggtatgtacgcaattc

SEQ ID NO: 282843 - DNA, 40 bp, Artificial Sequence
  Description of Artificial Sequence: Synthetic oligonucleotide
cagagaaatgtatgtactgaaccaggtatgtacgcaattc

SEQ ID NO: 282844 - DNA, 40 bp, Artificial Sequence
  Description of Artificial Sequence: Synthetic oligonucleotide
agagaaatgtatgtactgaaccaggtatgtacgcaattcg

SEQ ID NO: 282845 - DNA, 39 bp, Artificial Sequence
  Description of Artificial Sequence: Synthetic oligonucleotide
gagaaatgtatgtactgaaccaggtatgtacgcaattcg

SEQ ID NO: 282846 - DNA, 40 bp, Artificial Sequence
  Description of Artificial Sequence: Synthetic oligonucleotide
agaaatgtatgtactgaaccaggtatgtacgcaattcgag

SEQ ID NO: 282847 - DNA, 39 bp, Artificial Sequence
  Description of Artificial Sequence: Synthetic oligonucleotide
gaaatgtatgtactgaaccaggtatgtacgcaattcgag

SEQ ID NO: 282848 - DNA, 39 bp, Artificial Sequence
  Description of Artificial Sequence: Synthetic oligonucleotide
aaatgtatgtactgaaccaggtatgtacgcaattcgagc

SEQ ID NO: 282849 - DNA, 38 bp, Artificial Sequence
  Description of Artificial Sequence: Synthetic oligonucleotide
aatgtatgtactgaaccaggtatgtacgcaattcgagc

SEQ ID NO: 282850 - DNA, 37 bp, Artificial Sequence
  Description of Artificial Sequence: Synthetic oligonucleotide
atgtatgtactgaaccaggtatgtacgcaattcgagc

SEQ ID NO: 282851 - DNA, 36 bp, Artificial Sequence
  Description of Artificial Sequence: Synthetic oligonucleotide
tgtatgtactgaaccaggtatgtacgcaattcgagc

SEQ ID NO: 282852 - DNA, 35 bp, Artificial Sequence
  Description of Artificial Sequence: Synthetic oligonucleotide
gtatgtactgaaccaggtatgtacgcaattcgagc

SEQ ID NO: 282853 - DNA, 36 bp, Artificial Sequence
  Description of Artificial Sequence: Synthetic oligonucleotide
tatgtactgaaccaggtatgtacgcaattcgagctg

SEQ ID NO: 282854 - DNA, 35 bp, Artificial Sequence
  Description of Artificial Sequence: Synthetic oligonucleotide
atgtactgaaccaggtatgtacgcaattcgagctg

SEQ ID NO: 282855 - DNA, 34 bp, Artificial Sequence
  Description of Artificial Sequence: Synthetic oligonucleotide
tgtactgaaccaggtatgtacgcaattcgagctg

SEQ ID NO: 282856 - DNA, 33 bp, Artificial Sequence
  Description of Artificial Sequence: Synthetic oligonucleotide
gtactgaaccaggtatgtacgcaattcgagctg

SEQ ID NO: 282857 - DNA, 35 bp, Artificial Sequence
  Description of Artificial Sequence: Synthetic oligonucleotide
tactgaaccaggtatgtacgcaattcgagctgatc

SEQ ID NO: 282858 - DNA, 34 bp, Artificial Sequence
  Description of Artificial Sequence: Synthetic oligonucleotide
actgaaccaggtatgtacgcaattcgagctgatc

SEQ ID NO: 282859 - DNA, 33 bp, Artificial Sequence
  Description of Artificial Sequence: Synthetic oligonucleotide
ctgaaccaggtatgtacgcaattcgagctgatc

SEQ ID NO: 282860 - DNA, 35 bp, Artificial Sequence
  Description of Artificial Sequence: Synthetic oligonucleotide
tgaaccaggtatgtacgcaattcgagctgatcatc

SEQ ID NO: 282861 - DNA, 34 bp, Artificial Sequence
  Description of Artificial Sequence: Synthetic oligonucleotide
gaaccaggtatgtacgcaattcgagctgatcatc

SEQ ID NO: 282862 - DNA, 39 bp, Artificial Sequence
  Description of Artificial Sequence: Synthetic oligonucleotide
aaccaggtatgtacgcaattcgagctgatcatcattttg

SEQ ID NO: 282863 - DNA, 38 bp, Artificial Sequence
  Description of Artificial Sequence: Synthetic oligonucleotide
accaggtatgtacgcaattcgagctgatcatcattttg

SEQ ID NO: 282864 - DNA, 37 bp, Artificial Sequence
  Description of Artificial Sequence: Synthetic oligonucleotide
ccaggtatgtacgcaattcgagctgatcatcattttg

SEQ ID NO: 282865 - DNA, 39 bp, Artificial Sequence
  Description of Artificial Sequence: Synthetic oligonucleotide
caggtatgtacgcaattcgagctgatcatcattttgtag

SEQ ID NO: 282866 - DNA, 41 bp, Artificial Sequence
  Description of Artificial Sequence: Synthetic oligonucleotide
aggtatgtacgcaattcgagctgatcatcattttgtagaac

SEQ ID NO: 282867 - DNA, 40 bp, Artificial Sequence
  Description of Artificial Sequence: Synthetic oligonucleotide
ggtatgtacgcaattcgagctgatcatcattttgtagaac

SEQ ID NO: 282868 - DNA, 41 bp, Artificial Sequence
  Description of Artificial Sequence: Synthetic oligonucleotide
gtatgtacgcaattcgagctgatcatcattttgtagaacag

SEQ ID NO: 282869 - DNA, 41 bp, Artificial Sequence
  Description of Artificial Sequence: Synthetic oligonucleotide
tatgtacgcaattcgagctgatcatcattttgtagaacagg

SEQ ID NO: 282870 - DNA, 40 bp, Artificial Sequence
  Description of Artificial Sequence: Synthetic oligonucleotide
atgtacgcaattcgagctgatcatcattttgtagaacagg

SEQ ID NO: 282871 - DNA, 39 bp, Artificial Sequence
  Description of Artificial Sequence: Synthetic oligonucleotide
tgtacgcaattcgagctgatcatcattttgtagaacagg

SEQ ID NO: 282872 - DNA, 38 bp, Artificial Sequence
  Description of Artificial Sequence: Synthetic oligonucleotide
gtacgcaattcgagctgatcatcattttgtagaacagg

SEQ ID NO: 282873 - DNA, 40 bp, Artificial Sequence
  Description of Artificial Sequence: Synthetic oligonucleotide
tacgcaattcgagctgatcatcattttgtagaacaggaag

SEQ ID NO: 282874 - DNA, 39 bp, Artificial Sequence
  Description of Artificial Sequence: Synthetic oligonucleotide
acgcaattcgagctgatcatcattttgtagaacaggaag

SEQ ID NO: 282875 - DNA, 38 bp, Artificial Sequence
  Description of Artificial Sequence: Synthetic oligonucleotide
cgcaattcgagctgatcatcattttgtagaacaggaag

SEQ ID NO: 282876 - DNA, 39 bp, Artificial Sequence
  Description of Artificial Sequence: Synthetic oligonucleotide
gcaattcgagctgatcatcattttgtagaacaggaagag

SEQ ID NO: 282877 - DNA, 41 bp, Artificial Sequence
  Description of Artificial Sequence: Synthetic oligonucleotide
caattcgagctgatcatcattttgtagaacaggaagagttc

SEQ ID NO: 282878 - DNA, 43 bp, Artificial Sequence
  Description of Artificial Sequence: Synthetic oligonucleotide
aattcgagctgatcatcattttgtagaacaggaagagttcatg

SEQ ID NO: 282879 - DNA, 42 bp, Artificial Sequence
  Description of Artificial Sequence: Synthetic oligonucleotide
attcgagctgatcatcattttgtagaacaggaagagttcatg

SEQ ID NO: 282880 - DNA, 41 bp, Artificial Sequence
  Description of Artificial Sequence: Synthetic oligonucleotide
ttcgagctgatcatcattttgtagaacaggaagagttcatg

SEQ ID NO: 282881 - DNA, 40 bp, Artificial Sequence
  Description of Artificial Sequence: Synthetic oligonucleotide
tcgagctgatcatcattttgtagaacaggaagagttcatg

SEQ ID NO: 282882 - DNA, 39 bp, Artificial Sequence
  Description of Artificial Sequence: Synthetic oligonucleotide
cgagctgatcatcattttgtagaacaggaagagttcatg

SEQ ID NO: 282883 - DNA, 42 bp, Artificial Sequence
  Description of Artificial Sequence: Synthetic oligonucleotide
gagctgatcatcattttgtagaacaggaagagttcatgaaac

SEQ ID NO: 282884 - DNA, 42 bp, Artificial Sequence
  Description of Artificial Sequence: Synthetic oligonucleotide
agctgatcatcattttgtagaacaggaagagttcatgaaacc

SEQ ID NO: 282885 - DNA, 41 bp, Artificial Sequence
  Description of Artificial Sequence: Synthetic oligonucleotide
gctgatcatcattttgtagaacaggaagagttcatgaaacc

SEQ ID NO: 282886 - DNA, 42 bp, Artificial Sequence
  Description of Artificial Sequence: Synthetic oligonucleotide
ctgatcatcattttgtagaacaggaagagttcatgaaaccag

SEQ ID NO: 282887 - DNA, 43 bp, Artificial Sequence
  Description of Artificial Sequence: Synthetic oligonucleotide
tgatcatcattttgtagaacaggaagagttcatgaaaccagtc

SEQ ID NO: 282888 - DNA, 42 bp, Artificial Sequence
  Description of Artificial Sequence: Synthetic oligonucleotide
gatcatcattttgtagaacaggaagagttcatgaaaccagtc

SEQ ID NO: 282889 - DNA, 43 bp, Artificial Sequence
  Description of Artificial Sequence: Synthetic oligonucleotide
atcatcattttgtagaacaggaagagttcatgaaaccagtcag

SEQ ID NO: 282890 - DNA, 42 bp, Artificial Sequence
  Description of Artificial Sequence: Synthetic oligonucleotide
tcatcattttgtagaacaggaagagttcatgaaaccagtcag

SEQ ID NO: 282891 - DNA, 41 bp, Artificial Sequence
  Description of Artificial Sequence: Synthetic oligonucleotide
catcattttgtagaacaggaagagttcatgaaaccagtcag

SEQ ID NO: 282892 - DNA, 45 bp, Artificial Sequence
  Description of Artificial Sequence: Synthetic oligonucleotide
atcattttgtagaacaggaagagttcatgaaaccagtcagaatag

SEQ ID NO: 282893 - DNA, 44 bp, Artificial Sequence
  Description of Artificial Sequence: Synthetic oligonucleotide
tcattttgtagaacaggaagagttcatgaaaccagtcagaatag

SEQ ID NO: 282894 - DNA, 43 bp, Artificial Sequence
  Description of Artificial Sequence: Synthetic oligonucleotide
cattttgtagaacaggaagagttcatgaaaccagtcagaatag

SEQ ID NO: 282895 - DNA, 44 bp, Artificial Sequence
  Description of Artificial Sequence: Synthetic oligonucleotide
attttgtagaacaggaagagttcatgaaaccagtcagaatagtg

SEQ ID NO: 282896 - DNA, 43 bp, Artificial Sequence
  Description of Artificial Sequence: Synthetic oligonucleotide
ttttgtagaacaggaagagttcatgaaaccagtcagaatagtg

SEQ ID NO: 282897 - DNA, 42 bp, Artificial Sequence
  Description of Artificial Sequence: Synthetic oligonucleotide
tttgtagaacaggaagagttcatgaaaccagtcagaatagtg

SEQ ID NO: 282898 - DNA, 41 bp, Artificial Sequence
  Description of Artificial Sequence: Synthetic oligonucleotide
ttgtagaacaggaagagttcatgaaaccagtcagaatagtg

SEQ ID NO: 282899 - DNA, 40 bp, Artificial Sequence
  Description of Artificial Sequence: Synthetic oligonucleotide
tgtagaacaggaagagttcatgaaaccagtcagaatagtg

SEQ ID NO: 282900 - DNA, 39 bp, Artificial Sequence
  Description of Artificial Sequence: Synthetic oligonucleotide
gtagaacaggaagagttcatgaaaccagtcagaatagtg

SEQ ID NO: 282901 - DNA, 39 bp, Artificial Sequence
  Description of Artificial Sequence: Synthetic oligonucleotide
tagaacaggaagagttcatgaaaccagtcagaatagtgg

SEQ ID NO: 282902 - DNA, 38 bp, Artificial Sequence
  Description of Artificial Sequence: Synthetic oligonucleotide
agaacaggaagagttcatgaaaccagtcagaatagtgg

SEQ ID NO: 282903 - DNA, 37 bp, Artificial Sequence
  Description of Artificial Sequence: Synthetic oligonucleotide
gaacaggaagagttcatgaaaccagtcagaatagtgg

SEQ ID NO: 282904 - DNA, 37 bp, Artificial Sequence
  Description of Artificial Sequence: Synthetic oligonucleotide
aacaggaagagttcatgaaaccagtcagaatagtggc

SEQ ID NO: 282905 - DNA, 36 bp, Artificial Sequence
  Description of Artificial Sequence: Synthetic oligonucleotide
acaggaagagttcatgaaaccagtcagaatagtggc

SEQ ID NO: 282906 - DNA, 35 bp, Artificial Sequence
  Description of Artificial Sequence: Synthetic oligonucleotide
caggaagagttcatgaaaccagtcagaatagtggc

SEQ ID NO: 282907 - DNA, 36 bp, Artificial Sequence
  Description of Artificial Sequence: Synthetic oligonucleotide
aggaagagttcatgaaaccagtcagaatagtggctg

SEQ ID NO: 282908 - DNA, 35 bp, Artificial Sequence
  Description of Artificial Sequence: Synthetic oligonucleotide
ggaagagttcatgaaaccagtcagaatagtggctg

SEQ ID NO: 282909 - DNA, 38 bp, Artificial Sequence
  Description of Artificial Sequence: Synthetic oligonucleotide
gaagagttcatgaaaccagtcagaatagtggctgaatc

SEQ ID NO: 282910 - DNA, 41 bp, Artificial Sequence
  Description of Artificial Sequence: Synthetic oligonucleotide
aagagttcatgaaaccagtcagaatagtggctgaatctaag

SEQ ID NO: 282911 - DNA, 40 bp, Artificial Sequence
  Description of Artificial Sequence: Synthetic oligonucleotide
agagttcatgaaaccagtcagaatagtggctgaatctaag

SEQ ID NO: 282912 - DNA, 39 bp, Artificial Sequence
  Description of Artificial Sequence: Synthetic oligonucleotide
gagttcatgaaaccagtcagaatagtggctgaatctaag

SEQ ID NO: 282913 - DNA, 41 bp, Artificial Sequence
  Description of Artificial Sequence: Synthetic oligonucleotide
agttcatgaaaccagtcagaatagtggctgaatctaagaag

SEQ ID NO: 282914 - DNA, 40 bp, Artificial Sequence
  Description of Artificial Sequence: Synthetic oligonucleotide
gttcatgaaaccagtcagaatagtggctgaatctaagaag

SEQ ID NO: 282915 - DNA, 40 bp, Artificial Sequence
  Description of Artificial Sequence: Synthetic oligonucleotide
ttcatgaaaccagtcagaatagtggctgaatctaagaagg

SEQ ID NO: 282916 - DNA, 39 bp, Artificial Sequence
  Description of Artificial Sequence: Synthetic oligonucleotide
tcatgaaaccagtcagaatagtggctgaatctaagaagg

SEQ ID NO: 282917 - DNA, 38 bp, Artificial Sequence
  Description of Artificial Sequence: Synthetic oligonucleotide
catgaaaccagtcagaatagtggctgaatctaagaagg

SEQ ID NO: 282918 - DNA, 39 bp, Artificial Sequence
  Description of Artificial Sequence: Synthetic oligonucleotide
atgaaaccagtcagaatagtggctgaatctaagaaggtg

SEQ ID NO: 282919 - DNA, 38 bp, Artificial Sequence
  Description of Artificial Sequence: Synthetic oligonucleotide
tgaaaccagtcagaatagtggctgaatctaagaaggtg

SEQ ID NO: 282920 - DNA, 37 bp, Artificial Sequence
  Description of Artificial Sequence: Synthetic oligonucleotide
gaaaccagtcagaatagtggctgaatctaagaaggtg

SEQ ID NO: 282921 - DNA, 37 bp, Artificial Sequence
  Description of Artificial Sequence: Synthetic oligonucleotide
aaaccagtcagaatagtggctgaatctaagaaggtgg

SEQ ID NO: 282922 - DNA, 36 bp, Artificial Sequence
  Description of Artificial Sequence: Synthetic oligonucleotide
aaccagtcagaatagtggctgaatctaagaaggtgg

SEQ ID NO: 282923 - DNA, 35 bp, Artificial Sequence
  Description of Artificial Sequence: Synthetic oligonucleotide
accagtcagaatagtggctgaatctaagaaggtgg

SEQ ID NO: 282924 - DNA, 34 bp, Artificial Sequence
  Description of Artificial Sequence: Synthetic oligonucleotide
ccagtcagaatagtggctgaatctaagaaggtgg

SEQ ID NO: 282925 - DNA, 35 bp, Artificial Sequence
  Description of Artificial Sequence: Synthetic oligonucleotide
cagtcagaatagtggctgaatctaagaaggtggag

SEQ ID NO: 282926 - DNA, 36 bp, Artificial Sequence
  Description of Artificial Sequence: Synthetic oligonucleotide
agtcagaatagtggctgaatctaagaaggtggagtc

SEQ ID NO: 282927 - DNA, 35 bp, Artificial Sequence
  Description of Artificial Sequence: Synthetic oligonucleotide
gtcagaatagtggctgaatctaagaaggtggagtc

SEQ ID NO: 282928 - DNA, 41 bp, Artificial Sequence
  Description of Artificial Sequence: Synthetic oligonucleotide
tcagaatagtggctgaatctaagaaggtggagtctatattg

SEQ ID NO: 282929 - DNA, 40 bp, Artificial Sequence
  Description of Artificial Sequence: Synthetic oligonucleotide
cagaatagtggctgaatctaagaaggtggagtctatattg

SEQ ID NO: 282930 - DNA, 40 bp, Artificial Sequence
  Description of Artificial Sequence: Synthetic oligonucleotide
agaatagtggctgaatctaagaaggtggagtctatattgg

SEQ ID NO: 282931 - DNA, 39 bp, Artificial Sequence
  Description of Artificial Sequence: Synthetic oligonucleotide
gaatagtggctgaatctaagaaggtggagtctatattgg

SEQ ID NO: 282932 - DNA, 40 bp, Artificial Sequence
  Description of Artificial Sequence: Synthetic oligonucleotide
aatagtggctgaatctaagaaggtggagtctatattggac

SEQ ID NO: 282933 - DNA, 39 bp, Artificial Sequence
  Description of Artificial Sequence: Synthetic oligonucleotide
atagtggctgaatctaagaaggtggagtctatattggac

SEQ ID NO: 282934 - DNA, 38 bp, Artificial Sequence
  Description of Artificial Sequence: Synthetic oligonucleotide
tagtggctgaatctaagaaggtggagtctatattggac

SEQ ID NO: 282935 - DNA, 37 bp, Artificial Sequence
  Description of Artificial Sequence: Synthetic oligonucleotide
agtggctgaatctaagaaggtggagtctatattggac

SEQ ID NO: 282936 - DNA, 36 bp, Artificial Sequence
  Description of Artificial Sequence: Synthetic oligonucleotide
gtggctgaatctaagaaggtggagtctatattggac

SEQ ID NO: 282937 - DNA, 38 bp, Artificial Sequence
  Description of Artificial Sequence: Synthetic oligonucleotide
tggctgaatctaagaaggtggagtctatattggactag

SEQ ID NO: 282938 - DNA, 37 bp, Artificial Sequence
  Description of Artificial Sequence: Synthetic oligonucleotide
ggctgaatctaagaaggtggagtctatattggactag

SEQ ID NO: 282939 - DNA, 40 bp, Artificial Sequence
  Description of Artificial Sequence: Synthetic oligonucleotide
gctgaatctaagaaggtggagtctatattggactagaaac

SEQ ID NO: 282940 - DNA, 40 bp, Artificial Sequence
  Description of Artificial Sequence: Synthetic oligonucleotide
ctgaatctaagaaggtggagtctatattggactagaaacc

SEQ ID NO: 282941 - DNA, 41 bp, Artificial Sequence
  Description of Artificial Sequence: Synthetic oligonucleotide
tgaatctaagaaggtggagtctatattggactagaaacctg

SEQ ID NO: 282942 - DNA, 40 bp, Artificial Sequence
  Description of Artificial Sequence: Synthetic oligonucleotide
gaatctaagaaggtggagtctatattggactagaaacctg

SEQ ID NO: 282943 - DNA, 41 bp, Artificial Sequence
  Description of Artificial Sequence: Synthetic oligonucleotide
aatctaagaaggtggagtctatattggactagaaacctgtg

SEQ ID NO: 282944 - DNA, 40 bp, Artificial Sequence
  Description of Artificial Sequence: Synthetic oligonucleotide
atctaagaaggtggagtctatattggactagaaacctgtg

SEQ ID NO: 282945 - DNA, 39 bp, Artificial Sequence
  Description of Artificial Sequence: Synthetic oligonucleotide
tctaagaaggtggagtctatattggactagaaacctgtg

SEQ ID NO: 282946 - DNA, 38 bp, Artificial Sequence
  Description of Artificial Sequence: Synthetic oligonucleotide
ctaagaaggtggagtctatattggactagaaacctgtg

SEQ ID NO: 282947 - DNA, 34 bp, Artificial Sequence
  Description of Artificial Sequence: Synthetic oligonucleotide
atgatcagctcggccgcaggaattattactcttc

SEQ ID NO: 282948 - DNA, 33 bp, Artificial Sequence
  Description of Artificial Sequence: Synthetic oligonucleotide
tgatcagctcggccgcaggaattattactcttc

SEQ ID NO: 282949 - DNA, 32 bp, Artificial Sequence
  Description of Artificial Sequence: Synthetic oligonucleotide
gatcagctcggccgcaggaattattactcttc

SEQ ID NO: 282950 - DNA, 33 bp, Artificial Sequence
  Description of Artificial Sequence: Synthetic oligonucleotide
atcagctcggccgcaggaattattactcttctg

SEQ ID NO: 282951 - DNA, 32 bp, Artificial Sequence
  Description of Artificial Sequence: Synthetic oligonucleotide
tcagctcggccgcaggaattattactcttctg

SEQ ID NO: 282952 - DNA, 31 bp, Artificial Sequence
  Description of Artificial Sequence: Synthetic oligonucleotide
cagctcggccgcaggaattattactcttctg

SEQ ID NO: 282953 - DNA, 31 bp, Artificial Sequence
  Description of Artificial Sequence: Synthetic oligonucleotide
agctcggccgcaggaattattactcttctgg

SEQ ID NO: 282954 - DNA, 30 bp, Artificial Sequence
  Description of Artificial Sequence: Synthetic oligonucleotide
gctcggccgcaggaattattactcttctgg

SEQ ID NO: 282955 - DNA, 32 bp, Artificial Sequence
  Description of Artificial Sequence: Synthetic oligonucleotide
ctcggccgcaggaattattactcttctggttg

SEQ ID NO: 282956 - DNA, 34 bp, Artificial Sequence
  Description of Artificial Sequence: Synthetic oligonucleotide
tcggccgcaggaattattactcttctggttgaag

SEQ ID NO: 282957 - DNA, 33 bp, Artificial Sequence
  Description of Artificial Sequence: Synthetic oligonucleotide
cggccgcaggaattattactcttctggttgaag

SEQ ID NO: 282958 - DNA, 35 bp, Artificial Sequence
  Description of Artificial Sequence: Synthetic oligonucleotide
ggccgcaggaattattactcttctggttgaagatg

SEQ ID NO: 282959 - DNA, 37 bp, Artificial Sequence
  Description of Artificial Sequence: Synthetic oligonucleotide
gccgcaggaattattactcttctggttgaagatgatc

SEQ ID NO: 282960 - DNA, 37 bp, Artificial Sequence
  Description of Artificial Sequence: Synthetic oligonucleotide
ccgcaggaattattactcttctggttgaagatgatcc

SEQ ID NO: 282961 - DNA, 38 bp, Artificial Sequence
  Description of Artificial Sequence: Synthetic oligonucleotide
cgcaggaattattactcttctggttgaagatgatccac

SEQ ID NO: 282962 - DNA, 39 bp, Artificial Sequence
  Description of Artificial Sequence: Synthetic oligonucleotide
gcaggaattattactcttctggttgaagatgatccacag

SEQ ID NO: 282963 - DNA, 39 bp, Artificial Sequence
  Description of Artificial Sequence: Synthetic oligonucleotide
caggaattattactcttctggttgaagatgatccacagc

SEQ ID NO: 282964 - DNA, 43 bp, Artificial Sequence
  Description of Artificial Sequence: Synthetic oligonucleotide
aggaattattactcttctggttgaagatgatccacagctttag

SEQ ID NO: 282965 - DNA, 42 bp, Artificial Sequence
  Description of Artificial Sequence: Synthetic oligonucleotide
ggaattattactcttctggttgaagatgatccacagctttag

SEQ ID NO: 282966 - DNA, 42 bp, Artificial Sequence
  Description of Artificial Sequence: Synthetic oligonucleotide
gaattattactcttctggttgaagatgatccacagctttagg

SEQ ID NO: 282967 - DNA, 47 bp, Artificial Sequence
  Description of Artificial Sequence: Synthetic oligonucleotide
aattattactcttctggttgaagatgatccacagctttaggaatttg

SEQ ID NO: 282968 - DNA, 46 bp, Artificial Sequence
  Description of Artificial Sequence: Synthetic oligonucleotide
attattactcttctggttgaagatgatccacagctttaggaatttg

SEQ ID NO: 282969 - DNA, 45 bp, Artificial Sequence
  Description of Artificial Sequence: Synthetic oligonucleotide
ttattactcttctggttgaagatgatccacagctttaggaatttg

SEQ ID NO: 282970 - DNA, 44 bp, Artificial Sequence
  Description of Artificial Sequence: Synthetic oligonucleotide
tattactcttctggttgaagatgatccacagctttaggaatttg

SEQ ID NO: 282971 - DNA, 43 bp, Artificial Sequence
  Description of Artificial Sequence: Synthetic oligonucleotide
attactcttctggttgaagatgatccacagctttaggaatttg

SEQ ID NO: 282972 - DNA, 42 bp, Artificial Sequence
  Description of Artificial Sequence: Synthetic oligonucleotide
ttactcttctggttgaagatgatccacagctttaggaatttg

SEQ ID NO: 282973 - DNA, 41 bp, Artificial Sequence
  Description of Artificial Sequence: Synthetic oligonucleotide
tactcttctggttgaagatgatccacagctttaggaatttg

SEQ ID NO: 282974 - DNA, 40 bp, Artificial Sequence
  Description of Artificial Sequence: Synthetic oligonucleotide
actcttctggttgaagatgatccacagctttaggaatttg

SEQ ID NO: 282975 - DNA, 39 bp, Artificial Sequence
  Description of Artificial Sequence: Synthetic oligonucleotide
ctcttctggttgaagatgatccacagctttaggaatttg

SEQ ID NO: 282976 - DNA, 39 bp, Artificial Sequence
  Description of Artificial Sequence: Synthetic oligonucleotide
tcttctggttgaagatgatccacagctttaggaatttgg

SEQ ID NO: 282977 - DNA, 38 bp, Artificial Sequence
  Description of Artificial Sequence: Synthetic oligonucleotide
cttctggttgaagatgatccacagctttaggaatttgg

SEQ ID NO: 282978 - DNA, 39 bp, Artificial Sequence
  Description of Artificial Sequence: Synthetic oligonucleotide
ttctggttgaagatgatccacagctttaggaatttggac

SEQ ID NO: 282979 - DNA, 38 bp, Artificial Sequence
  Description of Artificial Sequence: Synthetic oligonucleotide
tctggttgaagatgatccacagctttaggaatttggac

SEQ ID NO: 282980 - DNA, 37 bp, Artificial Sequence
  Description of Artificial Sequence: Synthetic oligonucleotide
ctggttgaagatgatccacagctttaggaatttggac

SEQ ID NO: 282981 - DNA, 39 bp, Artificial Sequence
  Description of Artificial Sequence: Synthetic oligonucleotide
tggttgaagatgatccacagctttaggaatttggactac

SEQ ID NO: 282982 - DNA, 38 bp, Artificial Sequence
  Description of Artificial Sequence: Synthetic oligonucleotide
ggttgaagatgatccacagctttaggaatttggactac

SEQ ID NO: 282983 - DNA, 39 bp, Artificial Sequence
  Description of Artificial Sequence: Synthetic oligonucleotide
gttgaagatgatccacagctttaggaatttggactacac

SEQ ID NO: 282984 - DNA, 44 bp, Artificial Sequence
  Description of Artificial Sequence: Synthetic oligonucleotide
ttgaagatgatccacagctttaggaatttggactacacaatttg

SEQ ID NO: 282985 - DNA, 43 bp, Artificial Sequence
  Description of Artificial Sequence: Synthetic oligonucleotide
tgaagatgatccacagctttaggaatttggactacacaatttg

SEQ ID NO: 282986 - DNA, 42 bp, Artificial Sequence
  Description of Artificial Sequence: Synthetic oligonucleotide
gaagatgatccacagctttaggaatttggactacacaatttg

SEQ ID NO: 282987 - DNA, 45 bp, Artificial Sequence
  Description of Artificial Sequence: Synthetic oligonucleotide
aagatgatccacagctttaggaatttggactacacaatttgaatg

SEQ ID NO: 282988 - DNA, 44 bp, Artificial Sequence
  Description of Artificial Sequence: Synthetic oligonucleotide
agatgatccacagctttaggaatttggactacacaatttgaatg

SEQ ID NO: 282989 - DNA, 43 bp, Artificial Sequence
  Description of Artificial Sequence: Synthetic oligonucleotide
gatgatccacagctttaggaatttggactacacaatttgaatg

SEQ ID NO: 282990 - DNA, 43 bp, Artificial Sequence
  Description of Artificial Sequence: Synthetic oligonucleotide
atgatccacagctttaggaatttggactacacaatttgaatgc

SEQ ID NO: 282991 - DNA, 42 bp, Artificial Sequence
  Description of Artificial Sequence: Synthetic oligonucleotide
tgatccacagctttaggaatttggactacacaatttgaatgc

SEQ ID NO: 282992 - DNA, 41 bp, Artificial Sequence
  Description of Artificial Sequence: Synthetic oligonucleotide
gatccacagctttaggaatttggactacacaatttgaatgc

SEQ ID NO: 282993 - DNA, 42 bp, Artificial Sequence
  Description of Artificial Sequence: Synthetic oligonucleotide
atccacagctttaggaatttggactacacaatttgaatgcac

SEQ ID NO: 282994 - DNA, 41 bp, Artificial Sequence
  Description of Artificial Sequence: Synthetic oligonucleotide
tccacagctttaggaatttggactacacaatttgaatgcac

SEQ ID NO: 282995 - DNA, 40 bp, Artificial Sequence
  Description of Artificial Sequence: Synthetic oligonucleotide
ccacagctttaggaatttggactacacaatttgaatgcac

SEQ ID NO: 282996 - DNA, 42 bp, Artificial Sequence
  Description of Artificial Sequence: Synthetic oligonucleotide
cacagctttaggaatttggactacacaatttgaatgcacttg

SEQ ID NO: 282997 - DNA, 47 bp, Artificial Sequence
  Description of Artificial Sequence: Synthetic oligonucleotide
acagctttaggaatttggactacacaatttgaatgcacttgttaatg

SEQ ID NO: 282998 - DNA, 46 bp, Artificial Sequence
  Description of Artificial Sequence: Synthetic oligonucleotide
cagctttaggaatttggactacacaatttgaatgcacttgttaatg

SEQ ID NO: 282999 - DNA, 47 bp, Artificial Sequence
  Description of Artificial Sequence: Synthetic oligonucleotide
agctttaggaatttggactacacaatttgaatgcacttgttaatgtc

SEQ ID NO: 283000 - DNA, 46 bp, Artificial Sequence
  Description of Artificial Sequence: Synthetic oligonucleotide
gctttaggaatttggactacacaatttgaatgcacttgttaatgtc

SEQ ID NO: 283001 - DNA, 48 bp, Artificial Sequence
  Description of Artificial Sequence: Synthetic oligonucleotide
ctttaggaatttggactacacaatttgaatgcacttgttaatgtcttc

SEQ ID NO: 283002 - DNA, 49 bp, Artificial Sequence
  Description of Artificial Sequence: Synthetic oligonucleotide
tttaggaatttggactacacaatttgaatgcacttgttaatgtcttctg

SEQ ID NO: 283003 - DNA, 48 bp, Artificial Sequence
  Description of Artificial Sequence: Synthetic oligonucleotide
ttaggaatttggactacacaatttgaatgcacttgttaatgtcttctg

SEQ ID NO: 283004 - DNA, 47 bp, Artificial Sequence
  Description of Artificial Sequence: Synthetic oligonucleotide
taggaatttggactacacaatttgaatgcacttgttaatgtcttctg

SEQ ID NO: 283005 - DNA, 46 bp, Artificial Sequence
  Description of Artificial Sequence: Synthetic oligonucleotide
aggaatttggactacacaatttgaatgcacttgttaatgtcttctg

SEQ ID NO: 283006 - DNA, 45 bp, Artificial Sequence
  Description of Artificial Sequence: Synthetic oligonucleotide
ggaatttggactacacaatttgaatgcacttgttaatgtcttctg

SEQ ID NO: 283007 - DNA, 45 bp, Artificial Sequence
  Description of Artificial Sequence: Synthetic oligonucleotide
gaatttggactacacaatttgaatgcacttgttaatgtcttctgg

SEQ ID NO: 283008 - DNA, 45 bp, Artificial Sequence
  Description of Artificial Sequence: Synthetic oligonucleotide
aatttggactacacaatttgaatgcacttgttaatgtcttctggg

SEQ ID NO: 283009 - DNA, 44 bp, Artificial Sequence
  Description of Artificial Sequence: Synthetic oligonucleotide
atttggactacacaatttgaatgcacttgttaatgtcttctggg

SEQ ID NO: 283010 - DNA, 43 bp, Artificial Sequence
  Description of Artificial Sequence: Synthetic oligonucleotide
tttggactacacaatttgaatgcacttgttaatgtcttctggg

SEQ ID NO: 283011 - DNA, 42 bp, Artificial Sequence
  Description of Artificial Sequence: Synthetic oligonucleotide
ttggactacacaatttgaatgcacttgttaatgtcttctggg

SEQ ID NO: 283012 - DNA, 41 bp, Artificial Sequence
  Description of Artificial Sequence: Synthetic oligonucleotide
tggactacacaatttgaatgcacttgttaatgtcttctggg

SEQ ID NO: 283013 - DNA, 40 bp, Artificial Sequence
  Description of Artificial Sequence: Synthetic oligonucleotide
ggactacacaatttgaatgcacttgttaatgtcttctggg

SEQ ID NO: 283014 - DNA, 40 bp, Artificial Sequence
  Description of Artificial Sequence: Synthetic oligonucleotide
gactacacaatttgaatgcacttgttaatgtcttctgggc

SEQ ID NO: 283015 - DNA, 41 bp, Artificial Sequence
  Description of Artificial Sequence: Synthetic oligonucleotide
actacacaatttgaatgcacttgttaatgtcttctgggctg

SEQ ID NO: 283016 - DNA, 40 bp, Artificial Sequence
  Description of Artificial Sequence: Synthetic oligonucleotide
ctacacaatttgaatgcacttgttaatgtcttctgggctg

SEQ ID NO: 283017 - DNA, 46 bp, Artificial Sequence
  Description of Artificial Sequence: Synthetic oligonucleotide
tacacaatttgaatgcacttgttaatgtcttctgggctgaaatttc

SEQ ID NO: 283018 - DNA, 45 bp, Artificial Sequence
  Description of Artificial Sequence: Synthetic oligonucleotide
acacaatttgaatgcacttgttaatgtcttctgggctgaaatttc

SEQ ID NO: 283019 - DNA, 44 bp, Artificial Sequence
  Description of Artificial Sequence: Synthetic oligonucleotide
cacaatttgaatgcacttgttaatgtcttctgggctgaaatttc

SEQ ID NO: 283020 - DNA, 44 bp, Artificial Sequence
  Description of Artificial Sequence: Synthetic oligonucleotide
acaatttgaatgcacttgttaatgtcttctgggctgaaatttcc

SEQ ID NO: 283021 - DNA, 43 bp, Artificial Sequence
  Description of Artificial Sequence: Synthetic oligonucleotide
caatttgaatgcacttgttaatgtcttctgggctgaaatttcc

SEQ ID NO: 283022 - DNA, 43 bp, Artificial Sequence
  Description of Artificial Sequence: Synthetic oligonucleotide
aatttgaatgcacttgttaatgtcttctgggctgaaatttccc

SEQ ID NO: 283023 - DNA, 42 bp, Artificial Sequence
  Description of Artificial Sequence: Synthetic oligonucleotide
atttgaatgcacttgttaatgtcttctgggctgaaatttccc

SEQ ID NO: 283024 - DNA, 41 bp, Artificial Sequence
  Description of Artificial Sequence: Synthetic oligonucleotide
tttgaatgcacttgttaatgtcttctgggctgaaatttccc

SEQ ID NO: 283025 - DNA, 40 bp, Artificial Sequence
  Description of Artificial Sequence: Synthetic oligonucleotide
ttgaatgcacttgttaatgtcttctgggctgaaatttccc

SEQ ID NO: 283026 - DNA, 39 bp, Artificial Sequence
  Description of Artificial Sequence: Synthetic oligonucleotide
tgaatgcacttgttaatgtcttctgggctgaaatttccc

SEQ ID NO: 283027 - DNA, 38 bp, Artificial Sequence
  Description of Artificial Sequence: Synthetic oligonucleotide
gaatgcacttgttaatgtcttctgggctgaaatttccc

SEQ ID NO: 283028 - DNA, 39 bp, Artificial Sequence
  Description of Artificial Sequence: Synthetic oligonucleotide
aatgcacttgttaatgtcttctgggctgaaatttcccag

SEQ ID NO: 283029 - DNA, 38 bp, Artificial Sequence
  Description of Artificial Sequence: Synthetic oligonucleotide
atgcacttgttaatgtcttctgggctgaaatttcccag

SEQ ID NO: 283030 - DNA, 37 bp, Artificial Sequence
  Description of Artificial Sequence: Synthetic oligonucleotide
tgcacttgttaatgtcttctgggctgaaatttcccag

SEQ ID NO: 283031 - DNA, 36 bp, Artificial Sequence
  Description of Artificial Sequence: Synthetic oligonucleotide
gcacttgttaatgtcttctgggctgaaatttcccag

SEQ ID NO: 283032 - DNA, 37 bp, Artificial Sequence
  Description of Artificial Sequence: Synthetic oligonucleotide
cacttgttaatgtcttctgggctgaaatttcccagtc

SEQ ID NO: 283033 - DNA, 37 bp, Artificial Sequence
  Description of Artificial Sequence: Synthetic oligonucleotide
acttgttaatgtcttctgggctgaaatttcccagtcc

SEQ ID NO: 283034 - DNA, 36 bp, Artificial Sequence
  Description of Artificial Sequence: Synthetic oligonucleotide
cttgttaatgtcttctgggctgaaatttcccagtcc

SEQ ID NO: 283035 - DNA, 36 bp, Artificial Sequence
  Description of Artificial Sequence: Synthetic oligonucleotide
ttgttaatgtcttctgggctgaaatttcccagtccg

SEQ ID NO: 283036 - DNA, 35 bp, Artificial Sequence
  Description of Artificial Sequence: Synthetic oligonucleotide
tgttaatgtcttctgggctgaaatttcccagtccg

SEQ ID NO: 283037 - DNA, 34 bp, Artificial Sequence
  Description of Artificial Sequence: Synthetic oligonucleotide
gttaatgtcttctgggctgaaatttcccagtccg

SEQ ID NO: 283038 - DNA, 36 bp, Artificial Sequence
  Description of Artificial Sequence: Synthetic oligonucleotide
ttaatgtcttctgggctgaaatttcccagtccgtag

SEQ ID NO: 283039 - DNA, 35 bp, Artificial Sequence
  Description of Artificial Sequence: Synthetic oligonucleotide
taatgtcttctgggctgaaatttcccagtccgtag

SEQ ID NO: 283040 - DNA, 34 bp, Artificial Sequence
  Description of Artificial Sequence: Synthetic oligonucleotide
aatgtcttctgggctgaaatttcccagtccgtag

SEQ ID NO: 283041 - DNA, 33 bp, Artificial Sequence
  Description of Artificial Sequence: Synthetic oligonucleotide
atgtcttctgggctgaaatttcccagtccgtag

SEQ ID NO: 283042 - DNA, 32 bp, Artificial Sequence
  Description of Artificial Sequence: Synthetic oligonucleotide
tgtcttctgggctgaaatttcccagtccgtag

SEQ ID NO: 283043 - DNA, 31 bp, Artificial Sequence
  Description of Artificial Sequence: Synthetic oligonucleotide
gtcttctgggctgaaatttcccagtccgtag

SEQ ID NO: 283044 - DNA, 32 bp, Artificial Sequence
  Description of Artificial Sequence: Synthetic oligonucleotide
tcttctgggctgaaatttcccagtccgtagtc

SEQ ID NO: 283045 - DNA, 31 bp, Artificial Sequence
  Description of Artificial Sequence: Synthetic oligonucleotide
cttctgggctgaaatttcccagtccgtagtc

SEQ ID NO: 283046 - DNA, 37 bp, Artificial Sequence
  Description of Artificial Sequence: Synthetic oligonucleotide
ttctgggctgaaatttcccagtccgtagtcaaaatag

SEQ ID NO: 283047 - DNA, 36 bp, Artificial Sequence
  Description of Artificial Sequence: Synthetic oligonucleotide
tctgggctgaaatttcccagtccgtagtcaaaatag

SEQ ID NO: 283048 - DNA, 35 bp, Artificial Sequence
  Description of Artificial Sequence: Synthetic oligonucleotide
ctgggctgaaatttcccagtccgtagtcaaaatag

SEQ ID NO: 283049 - DNA, 36 bp, Artificial Sequence
  Description of Artificial Sequence: Synthetic oligonucleotide
tgggctgaaatttcccagtccgtagtcaaaatagac

SEQ ID NO: 283050 - DNA, 35 bp, Artificial Sequence
  Description of Artificial Sequence: Synthetic oligonucleotide
gggctgaaatttcccagtccgtagtcaaaatagac

SEQ ID NO: 283051 - DNA, 35 bp, Artificial Sequence
  Description of Artificial Sequence: Synthetic oligonucleotide
ggctgaaatttcccagtccgtagtcaaaatagacg

SEQ ID NO: 283052 - DNA, 42 bp, Artificial Sequence
  Description of Artificial Sequence: Synthetic oligonucleotide
gctgaaatttcccagtccgtagtcaaaatagacgttttatac

SEQ ID NO: 283053 - DNA, 42 bp, Artificial Sequence
  Description of Artificial Sequence: Synthetic oligonucleotide
ctgaaatttcccagtccgtagtcaaaatagacgttttatacc

SEQ ID NO: 283054 - DNA, 44 bp, Artificial Sequence
  Description of Artificial Sequence: Synthetic oligonucleotide
tgaaatttcccagtccgtagtcaaaatagacgttttataccaag

SEQ ID NO: 283055 - DNA, 43 bp, Artificial Sequence
  Description of Artificial Sequence: Synthetic oligonucleotide
gaaatttcccagtccgtagtcaaaatagacgttttataccaag

SEQ ID NO: 283056 - DNA, 45 bp, Artificial Sequence
  Description of Artificial Sequence: Synthetic oligonucleotide
aaatttcccagtccgtagtcaaaatagacgttttataccaagatg

SEQ ID NO: 283057 - DNA, 44 bp, Artificial Sequence
  Description of Artificial Sequence: Synthetic oligonucleotide
aatttcccagtccgtagtcaaaatagacgttttataccaagatg

SEQ ID NO: 283058 - DNA, 43 bp, Artificial Sequence
  Description of Artificial Sequence: Synthetic oligonucleotide
atttcccagtccgtagtcaaaatagacgttttataccaagatg

SEQ ID NO: 283059 - DNA, 42 bp, Artificial Sequence
  Description of Artificial Sequence: Synthetic oligonucleotide
tttcccagtccgtagtcaaaatagacgttttataccaagatg

SEQ ID NO: 283060 - DNA, 41 bp, Artificial Sequence
  Description of Artificial Sequence: Synthetic oligonucleotide
ttcccagtccgtagtcaaaatagacgttttataccaagatg

SEQ ID NO: 283061 - DNA, 40 bp, Artificial Sequence
  Description of Artificial Sequence: Synthetic oligonucleotide
tcccagtccgtagtcaaaatagacgttttataccaagatg

SEQ ID NO: 283062 - DNA, 39 bp, Artificial Sequence
  Description of Artificial Sequence: Synthetic oligonucleotide
cccagtccgtagtcaaaatagacgttttataccaagatg

SEQ ID NO: 283063 - DNA, 41 bp, Artificial Sequence
  Description of Artificial Sequence: Synthetic oligonucleotide
ccagtccgtagtcaaaatagacgttttataccaagatgaag

SEQ ID NO: 283064 - DNA, 41 bp, Artificial Sequence
  Description of Artificial Sequence: Synthetic oligonucleotide
cagtccgtagtcaaaatagacgttttataccaagatgaagc

SEQ ID NO: 283065 - DNA, 44 bp, Artificial Sequence
  Description of Artificial Sequence: Synthetic oligonucleotide
agtccgtagtcaaaatagacgttttataccaagatgaagctttc

SEQ ID NO: 283066 - DNA, 43 bp, Artificial Sequence
  Description of Artificial Sequence: Synthetic oligonucleotide
gtccgtagtcaaaatagacgttttataccaagatgaagctttc

SEQ ID NO: 283067 - DNA, 43 bp, Artificial Sequence
  Description of Artificial Sequence: Synthetic oligonucleotide
tccgtagtcaaaatagacgttttataccaagatgaagctttcc

SEQ ID NO: 283068 - DNA, 42 bp, Artificial Sequence
  Description of Artificial Sequence: Synthetic oligonucleotide
ccgtagtcaaaatagacgttttataccaagatgaagctttcc

SEQ ID NO: 283069 - DNA, 42 bp, Artificial Sequence
  Description of Artificial Sequence: Synthetic oligonucleotide
cgtagtcaaaatagacgttttataccaagatgaagctttccg

SEQ ID NO: 283070 - DNA, 42 bp, Artificial Sequence
  Description of Artificial Sequence: Synthetic oligonucleotide
gtagtcaaaatagacgttttataccaagatgaagctttccgg

SEQ ID NO: 283071 - DNA, 43 bp, Artificial Sequence
  Description of Artificial Sequence: Synthetic oligonucleotide
tagtcaaaatagacgttttataccaagatgaagctttccggag

SEQ ID NO: 283072 - DNA, 42 bp, Artificial Sequence
  Description of Artificial Sequence: Synthetic oligonucleotide
agtcaaaatagacgttttataccaagatgaagctttccggag

SEQ ID NO: 283073 - DNA, 41 bp, Artificial Sequence
  Description of Artificial Sequence: Synthetic oligonucleotide
gtcaaaatagacgttttataccaagatgaagctttccggag

SEQ ID NO: 283074 - DNA, 42 bp, Artificial Sequence
  Description of Artificial Sequence: Synthetic oligonucleotide
tcaaaatagacgttttataccaagatgaagctttccggagac

SEQ ID NO: 283075 - DNA, 41 bp, Artificial Sequence
  Description of Artificial Sequence: Synthetic oligonucleotide
caaaatagacgttttataccaagatgaagctttccggagac

SEQ ID NO: 283076 - DNA, 41 bp, Artificial Sequence
  Description of Artificial Sequence: Synthetic oligonucleotide
aaaatagacgttttataccaagatgaagctttccggagacg

SEQ ID NO: 283077 - DNA, 40 bp, Artificial Sequence
  Description of Artificial Sequence: Synthetic oligonucleotide
aaatagacgttttataccaagatgaagctttccggagacg

SEQ ID NO: 283078 - DNA, 39 bp, Artificial Sequence
  Description of Artificial Sequence: Synthetic oligonucleotide
aatagacgttttataccaagatgaagctttccggagacg

SEQ ID NO: 283079 - DNA, 38 bp, Artificial Sequence
  Description of Artificial Sequence: Synthetic oligonucleotide
atagacgttttataccaagatgaagctttccggagacg

SEQ ID NO: 283080 - DNA, 37 bp, Artificial Sequence
  Description of Artificial Sequence: Synthetic oligonucleotide
tagacgttttataccaagatgaagctttccggagacg

SEQ ID NO: 283081 - DNA, 36 bp, Artificial Sequence
  Description of Artificial Sequence: Synthetic oligonucleotide
agacgttttataccaagatgaagctttccggagacg

SEQ ID NO: 283082 - DNA, 35 bp, Artificial Sequence
  Description of Artificial Sequence: Synthetic oligonucleotide
gacgttttataccaagatgaagctttccggagacg

SEQ ID NO: 283083 - DNA, 35 bp, Artificial Sequence
  Description of Artificial Sequence: Synthetic oligonucleotide
acgttttataccaagatgaagctttccggagacgg

SEQ ID NO: 283084 - DNA, 34 bp, Artificial Sequence
  Description of Artificial Sequence: Synthetic oligonucleotide
cgttttataccaagatgaagctttccggagacgg

SEQ ID NO: 283085 - DNA, 34 bp, Artificial Sequence
  Description of Artificial Sequence: Synthetic oligonucleotide
gttttataccaagatgaagctttccggagacggc

SEQ ID NO: 283086 - DNA, 35 bp, Artificial Sequence
  Description of Artificial Sequence: Synthetic oligonucleotide
ttttataccaagatgaagctttccggagacggcag

SEQ ID NO: 283087 - DNA, 34 bp, Artificial Sequence
  Description of Artificial Sequence: Synthetic oligonucleotide
tttataccaagatgaagctttccggagacggcag

SEQ ID NO: 283088 - DNA, 33 bp, Artificial Sequence
  Description of Artificial Sequence: Synthetic oligonucleotide
ttataccaagatgaagctttccggagacggcag

SEQ ID NO: 283089 - DNA, 32 bp, Artificial Sequence
  Description of Artificial Sequence: Synthetic oligonucleotide
tataccaagatgaagctttccggagacggcag

SEQ ID NO: 283090 - DNA, 31 bp, Artificial Sequence
  Description of Artificial Sequence: Synthetic oligonucleotide
ataccaagatgaagctttccggagacggcag

SEQ ID NO: 283091 - DNA, 30 bp, Artificial Sequence
  Description of Artificial Sequence: Synthetic oligonucleotide
taccaagatgaagctttccggagacggcag

SEQ ID NO: 283092 - DNA, 29 bp, Artificial Sequence
  Description of Artificial Sequence: Synthetic oligonucleotide
accaagatgaagctttccggagacggcag

SEQ ID NO: 283093 - DNA, 28 bp, Artificial Sequence
  Description of Artificial Sequence: Synthetic oligonucleotide
ccaagatgaagctttccggagacggcag

SEQ ID NO: 283094 - DNA, 31 bp, Artificial Sequence
  Description of Artificial Sequence: Synthetic oligonucleotide
caagatgaagctttccggagacggcagtttc

SEQ ID NO: 283095 - DNA, 31 bp, Artificial Sequence
  Description of Artificial Sequence: Synthetic oligonucleotide
aagatgaagctttccggagacggcagtttcc

SEQ ID NO: 283096 - DNA, 30 bp, Artificial Sequence
  Description of Artificial Sequence: Synthetic oligonucleotide
agatgaagctttccggagacggcagtttcc

SEQ ID NO: 283097 - DNA, 29 bp, Artificial Sequence
  Description of Artificial Sequence: Synthetic oligonucleotide
gatgaagctttccggagacggcagtttcc

SEQ ID NO: 283098 - DNA, 30 bp, Artificial Sequence
  Description of Artificial Sequence: Synthetic oligonucleotide
atgaagctttccggagacggcagtttccag

SEQ ID NO: 283099 - DNA, 29 bp, Artificial Sequence
  Description of Artificial Sequence: Synthetic oligonucleotide
tgaagctttccggagacggcagtttccag

SEQ ID NO: 283100 - DNA, 28 bp, Artificial Sequence
  Description of Artificial Sequence: Synthetic oligonucleotide
gaagctttccggagacggcagtttccag

SEQ ID NO: 283101 - DNA, 28 bp, Artificial Sequence
  Description of Artificial Sequence: Synthetic oligonucleotide
aagctttccggagacggcagtttccagc

SEQ ID NO: 283102 - DNA, 27 bp, Artificial Sequence
  Description of Artificial Sequence: Synthetic oligonucleotide
agctttccggagacggcagtttccagc

SEQ ID NO: 283103 - DNA, 26 bp, Artificial Sequence
  Description of Artificial Sequence: Synthetic oligonucleotide
gctttccggagacggcagtttccagc

SEQ ID NO: 283104 - DNA, 27 bp, Artificial Sequence
  Description of Artificial Sequence: Synthetic oligonucleotide
ctttccggagacggcagtttccagcct

SEQ ID NO: 283105 - DNA, 29 bp, Artificial Sequence
  Description of Artificial Sequence: Synthetic oligonucleotide
tttccggagacggcagtttccagccttag

SEQ ID NO: 283106 - DNA, 28 bp, Artificial Sequence
  Description of Artificial Sequence: Synthetic oligonucleotide
ttccggagacggcagtttccagccttag

SEQ ID NO: 283107 - DNA, 27 bp, Artificial Sequence
  Description of Artificial Sequence: Synthetic oligonucleotide
tccggagacggcagtttccagccttag

SEQ ID NO: 283108 - DNA, 27 bp, Artificial Sequence
  Description of Artificial Sequence: Synthetic oligonucleotide
ccggagacggcagtttccagccttaga

SEQ ID NO: 283109 - DNA, 27 bp, Artificial Sequence
  Description of Artificial Sequence: Synthetic oligonucleotide
cggagacggcagtttccagccttagag

SEQ ID NO: 283110 - DNA, 27 bp, Artificial Sequence
  Description of Artificial Sequence: Synthetic oligonucleotide
ggagacggcagtttccagccttagagg

SEQ ID NO: 283111 - DNA, 27 bp, Artificial Sequence
  Description of Artificial Sequence: Synthetic oligonucleotide
gagacggcagtttccagccttagaggc

SEQ ID NO: 283112 - DNA, 29 bp, Artificial Sequence
  Description of Artificial Sequence: Synthetic oligonucleotide
agacggcagtttccagccttagaggcatc

SEQ ID NO: 283113 - DNA, 28 bp, Artificial Sequence
  Description of Artificial Sequence: Synthetic oligonucleotide
gacggcagtttccagccttagaggcatc

SEQ ID NO: 283114 - DNA, 32 bp, Artificial Sequence
  Description of Artificial Sequence: Synthetic oligonucleotide
acggcagtttccagccttagaggcatctaatg

SEQ ID NO: 283115 - DNA, 31 bp, Artificial Sequence
  Description of Artificial Sequence: Synthetic oligonucleotide
cggcagtttccagccttagaggcatctaatg

SEQ ID NO: 283116 - DNA, 39 bp, Artificial Sequence
  Description of Artificial Sequence: Synthetic oligonucleotide
ggcagtttccagccttagaggcatctaatgtattttatg

SEQ ID NO: 283117 - DNA, 40 bp, Artificial Sequence
  Description of Artificial Sequence: Synthetic oligonucleotide
gcagtttccagccttagaggcatctaatgtattttatgac

SEQ ID NO: 283118 - DNA, 40 bp, Artificial Sequence
  Description of Artificial Sequence: Synthetic oligonucleotide
cagtttccagccttagaggcatctaatgtattttatgacc

SEQ ID NO: 283119 - DNA, 41 bp, Artificial Sequence
  Description of Artificial Sequence: Synthetic oligonucleotide
agtttccagccttagaggcatctaatgtattttatgacctg

SEQ ID NO: 283120 - DNA, 40 bp, Artificial Sequence
  Description of Artificial Sequence: Synthetic oligonucleotide
gtttccagccttagaggcatctaatgtattttatgacctg

SEQ ID NO: 283121 - DNA, 40 bp, Artificial Sequence
  Description of Artificial Sequence: Synthetic oligonucleotide
tttccagccttagaggcatctaatgtattttatgacctgg

SEQ ID NO: 283122 - DNA, 39 bp, Artificial Sequence
  Description of Artificial Sequence: Synthetic oligonucleotide
ttccagccttagaggcatctaatgtattttatgacctgg

SEQ ID NO: 283123 - DNA, 38 bp, Artificial Sequence
  Description of Artificial Sequence: Synthetic oligonucleotide
tccagccttagaggcatctaatgtattttatgacctgg

SEQ ID NO: 283124 - DNA, 37 bp, Artificial Sequence
  Description of Artificial Sequence: Synthetic oligonucleotide
ccagccttagaggcatctaatgtattttatgacctgg

SEQ ID NO: 283125 - DNA, 37 bp, Artificial Sequence
  Description of Artificial Sequence: Synthetic oligonucleotide
cagccttagaggcatctaatgtattttatgacctggg

SEQ ID NO: 283126 - DNA, 37 bp, Artificial Sequence
  Description of Artificial Sequence: Synthetic oligonucleotide
agccttagaggcatctaatgtattttatgacctgggg

SEQ ID NO: 283127 - DNA, 36 bp, Artificial Sequence
  Description of Artificial Sequence: Synthetic oligonucleotide
gccttagaggcatctaatgtattttatgacctgggg

SEQ ID NO: 283128 - DNA, 36 bp, Artificial Sequence
  Description of Artificial Sequence: Synthetic oligonucleotide
ccttagaggcatctaatgtattttatgacctggggg

SEQ ID NO: 283129 - DNA, 36 bp, Artificial Sequence
  Description of Artificial Sequence: Synthetic oligonucleotide
cttagaggcatctaatgtattttatgacctgggggg

SEQ ID NO: 283130 - DNA, 40 bp, Artificial Sequence
  Description of Artificial Sequence: Synthetic oligonucleotide
ttagaggcatctaatgtattttatgacctggggggttttg

SEQ ID NO: 283131 - DNA, 39 bp, Artificial Sequence
  Description of Artificial Sequence: Synthetic oligonucleotide
tagaggcatctaatgtattttatgacctggggggttttg

SEQ ID NO: 283132 - DNA, 38 bp, Artificial Sequence
  Description of Artificial Sequence: Synthetic oligonucleotide
agaggcatctaatgtattttatgacctggggggttttg

SEQ ID NO: 283133 - DNA, 37 bp, Artificial Sequence
  Description of Artificial Sequence: Synthetic oligonucleotide
gaggcatctaatgtattttatgacctggggggttttg

SEQ ID NO: 283134 - DNA, 38 bp, Artificial Sequence
  Description of Artificial Sequence: Synthetic oligonucleotide
aggcatctaatgtattttatgacctggggggttttgag

SEQ ID NO: 283135 - DNA, 37 bp, Artificial Sequence
  Description of Artificial Sequence: Synthetic oligonucleotide
ggcatctaatgtattttatgacctggggggttttgag

SEQ ID NO: 283136 - DNA, 37 bp, Artificial Sequence
  Description of Artificial Sequence: Synthetic oligonucleotide
gcatctaatgtattttatgacctggggggttttgagg

SEQ ID NO: 283137 - DNA, 38 bp, Artificial Sequence
  Description of Artificial Sequence: Synthetic oligonucleotide
catctaatgtattttatgacctggggggttttgaggac

SEQ ID NO: 283138 - DNA, 39 bp, Artificial Sequence
  Description of Artificial Sequence: Synthetic oligonucleotide
atctaatgtattttatgacctggggggttttgaggactc

SEQ ID NO: 283139 - DNA, 38 bp, Artificial Sequence
  Description of Artificial Sequence: Synthetic oligonucleotide
tctaatgtattttatgacctggggggttttgaggactc

SEQ ID NO: 283140 - DNA, 37 bp, Artificial Sequence
  Description of Artificial Sequence: Synthetic oligonucleotide
ctaatgtattttatgacctggggggttttgaggactc

SEQ ID NO: 283141 - DNA, 38 bp, Artificial Sequence
  Description of Artificial Sequence: Synthetic oligonucleotide
taatgtattttatgacctggggggttttgaggactctc

SEQ ID NO: 283142 - DNA, 37 bp, Artificial Sequence
  Description of Artificial Sequence: Synthetic oligonucleotide
aatgtattttatgacctggggggttttgaggactctc

SEQ ID NO: 283143 - DNA, 36 bp, Artificial Sequence
  Description of Artificial Sequence: Synthetic oligonucleotide
atgtattttatgacctggggggttttgaggactctc

SEQ ID NO: 283144 - DNA, 35 bp, Artificial Sequence
  Description of Artificial Sequence: Synthetic oligonucleotide
tgtattttatgacctggggggttttgaggactctc

SEQ ID NO: 283145 - DNA, 34 bp, Artificial Sequence
  Description of Artificial Sequence: Synthetic oligonucleotide
gtattttatgacctggggggttttgaggactctc

SEQ ID NO: 283146 - DNA, 35 bp, Artificial Sequence
  Description of Artificial Sequence: Synthetic oligonucleotide
tattttatgacctggggggttttgaggactctctg

SEQ ID NO: 283147 - DNA, 34 bp, Artificial Sequence
  Description of Artificial Sequence: Synthetic oligonucleotide
attttatgacctggggggttttgaggactctctg

SEQ ID NO: 283148 - DNA, 33 bp, Artificial Sequence
  Description of Artificial Sequence: Synthetic oligonucleotide
ttttatgacctggggggttttgaggactctctg

SEQ ID NO: 283149 - DNA, 32 bp, Artificial Sequence
  Description of Artificial Sequence: Synthetic oligonucleotide
tttatgacctggggggttttgaggactctctg

SEQ ID NO: 283150 - DNA, 31 bp, Artificial Sequence
  Description of Artificial Sequence: Synthetic oligonucleotide
ttatgacctggggggttttgaggactctctg

SEQ ID NO: 283151 - DNA, 30 bp, Artificial Sequence
  Description of Artificial Sequence: Synthetic oligonucleotide
tatgacctggggggttttgaggactctctg

SEQ ID NO: 283152 - DNA, 29 bp, Artificial Sequence
  Description of Artificial Sequence: Synthetic oligonucleotide
atgacctggggggttttgaggactctctg

SEQ ID NO: 283153 - DNA, 28 bp, Artificial Sequence
  Description of Artificial Sequence: Synthetic oligonucleotide
tgacctggggggttttgaggactctctg

SEQ ID NO: 283154 - DNA, 27 bp, Artificial Sequence
  Description of Artificial Sequence: Synthetic oligonucleotide
gacctggggggttttgaggactctctg

SEQ ID NO: 283155 - DNA, 33 bp, Artificial Sequence
  Description of Artificial Sequence: Synthetic oligonucleotide
acctggggggttttgaggactctctgaataatg

SEQ ID NO: 283156 - DNA, 32 bp, Artificial Sequence
  Description of Artificial Sequence: Synthetic oligonucleotide
cctggggggttttgaggactctctgaataatg

SEQ ID NO: 283157 - DNA, 32 bp, Artificial Sequence
  Description of Artificial Sequence: Synthetic oligonucleotide
ctggggggttttgaggactctctgaataatgc

SEQ ID NO: 283158 - DNA, 33 bp, Artificial Sequence
  Description of Artificial Sequence: Synthetic oligonucleotide
tggggggttttgaggactctctgaataatgctc

SEQ ID NO: 283159 - DNA, 32 bp, Artificial Sequence
  Description of Artificial Sequence: Synthetic oligonucleotide
ggggggttttgaggactctctgaataatgctc

SEQ ID NO: 283160 - DNA, 34 bp, Artificial Sequence
  Description of Artificial Sequence: Synthetic oligonucleotide
gggggttttgaggactctctgaataatgctcttg

SEQ ID NO: 283161 - DNA, 34 bp, Artificial Sequence
  Description of Artificial Sequence: Synthetic oligonucleotide
ggggttttgaggactctctgaataatgctcttgc

SEQ ID NO: 283162 - DNA, 35 bp, Artificial Sequence
  Description of Artificial Sequence: Synthetic oligonucleotide
gggttttgaggactctctgaataatgctcttgcag

SEQ ID NO: 283163 - DNA, 35 bp, Artificial Sequence
  Description of Artificial Sequence: Synthetic oligonucleotide
ggttttgaggactctctgaataatgctcttgcagc

SEQ ID NO: 283164 - DNA, 36 bp, Artificial Sequence
  Description of Artificial Sequence: Synthetic oligonucleotide
gttttgaggactctctgaataatgctcttgcagcag

SEQ ID NO: 283165 - DNA, 36 bp, Artificial Sequence
  Description of Artificial Sequence: Synthetic oligonucleotide
ttttgaggactctctgaataatgctcttgcagcagg

SEQ ID NO: 283166 - DNA, 35 bp, Artificial Sequence
  Description of Artificial Sequence: Synthetic oligonucleotide
tttgaggactctctgaataatgctcttgcagcagg

SEQ ID NO: 283167 - DNA, 34 bp, Artificial Sequence
  Description of Artificial Sequence: Synthetic oligonucleotide
ttgaggactctctgaataatgctcttgcagcagg

SEQ ID NO: 283168 - DNA, 33 bp, Artificial Sequence
  Description of Artificial Sequence: Synthetic oligonucleotide
tgaggactctctgaataatgctcttgcagcagg

SEQ ID NO: 283169 - DNA, 32 bp, Artificial Sequence
  Description of Artificial Sequence: Synthetic oligonucleotide
gaggactctctgaataatgctcttgcagcagg

SEQ ID NO: 283170 - DNA, 32 bp, Artificial Sequence
  Description of Artificial Sequence: Synthetic oligonucleotide
aggactctctgaataatgctcttgcagcaggg

SEQ ID NO: 283171 - DNA, 31 bp, Artificial Sequence
  Description of Artificial Sequence: Synthetic oligonucleotide
ggactctctgaataatgctcttgcagcaggg

SEQ ID NO: 283172 - DNA, 31 bp, Artificial Sequence
  Description of Artificial Sequence: Synthetic oligonucleotide
gactctctgaataatgctcttgcagcagggg

SEQ ID NO: 283173 - DNA, 32 bp, Artificial Sequence
  Description of Artificial Sequence: Synthetic oligonucleotide
actctctgaataatgctcttgcagcaggggag

SEQ ID NO: 283174 - DNA, 31 bp, Artificial Sequence
  Description of Artificial Sequence: Synthetic oligonucleotide
ctctctgaataatgctcttgcagcaggggag

SEQ ID NO: 283175 - DNA, 31 bp, Artificial Sequence
  Description of Artificial Sequence: Synthetic oligonucleotide
tctctgaataatgctcttgcagcaggggagc

SEQ ID NO: 283176 - DNA, 30 bp, Artificial Sequence
  Description of Artificial Sequence: Synthetic oligonucleotide
ctctgaataatgctcttgcagcaggggagc

SEQ ID NO: 283177 - DNA, 31 bp, Artificial Sequence
  Description of Artificial Sequence: Synthetic oligonucleotide
tctgaataatgctcttgcagcaggggagctc

SEQ ID NO: 283178 - DNA, 30 bp, Artificial Sequence
  Description of Artificial Sequence: Synthetic oligonucleotide
ctgaataatgctcttgcagcaggggagctc

SEQ ID NO: 283179 - DNA, 32 bp, Artificial Sequence
  Description of Artificial Sequence: Synthetic oligonucleotide
tgaataatgctcttgcagcaggggagctcttc

SEQ ID NO: 283180 - DNA, 31 bp, Artificial Sequence
  Description of Artificial Sequence: Synthetic oligonucleotide
gaataatgctcttgcagcaggggagctcttc

SEQ ID NO: 283181 - DNA, 34 bp, Artificial Sequence
  Description of Artificial Sequence: Synthetic oligonucleotide
aataatgctcttgcagcaggggagctcttcaatc

SEQ ID NO: 283182 - DNA, 33 bp, Artificial Sequence
  Description of Artificial Sequence: Synthetic oligonucleotide
ataatgctcttgcagcaggggagctcttcaatc

SEQ ID NO: 283183 - DNA, 32 bp, Artificial Sequence
  Description of Artificial Sequence: Synthetic oligonucleotide
taatgctcttgcagcaggggagctcttcaatc

SEQ ID NO: 283184 - DNA, 31 bp, Artificial Sequence
  Description of Artificial Sequence: Synthetic oligonucleotide
aatgctcttgcagcaggggagctcttcaatc

SEQ ID NO: 283185 - DNA, 30 bp, Artificial Sequence
  Description of Artificial Sequence: Synthetic oligonucleotide
atgctcttgcagcaggggagctcttcaatc

SEQ ID NO: 283186 - DNA, 29 bp, Artificial Sequence
  Description of Artificial Sequence: Synthetic oligonucleotide
tgctcttgcagcaggggagctcttcaatc

SEQ ID NO: 283187 - DNA, 28 bp, Artificial Sequence
  Description of Artificial Sequence: Synthetic oligonucleotide
gctcttgcagcaggggagctcttcaatc

SEQ ID NO: 283188 - DNA, 29 bp, Artificial Sequence
  Description of Artificial Sequence: Synthetic oligonucleotide
ctcttgcagcaggggagctcttcaatctc

SEQ ID NO: 283189 - DNA, 32 bp, Artificial Sequence
  Description of Artificial Sequence: Synthetic oligonucleotide
tcttgcagcaggggagctcttcaatctcaatg

SEQ ID NO: 283190 - DNA, 31 bp, Artificial Sequence
  Description of Artificial Sequence: Synthetic oligonucleotide
cttgcagcaggggagctcttcaatctcaatg

SEQ ID NO: 283191 - DNA, 35 bp, Artificial Sequence
  Description of Artificial Sequence: Synthetic oligonucleotide
ttgcagcaggggagctcttcaatctcaatgatatc

SEQ ID NO: 283192 - DNA, 34 bp, Artificial Sequence
  Description of Artificial Sequence: Synthetic oligonucleotide
tgcagcaggggagctcttcaatctcaatgatatc

SEQ ID NO: 283193 - DNA, 33 bp, Artificial Sequence
  Description of Artificial Sequence: Synthetic oligonucleotide
gcagcaggggagctcttcaatctcaatgatatc

SEQ ID NO: 283194 - DNA, 34 bp, Artificial Sequence
  Description of Artificial Sequence: Synthetic oligonucleotide
cagcaggggagctcttcaatctcaatgatatctc

SEQ ID NO: 283195 - DNA, 35 bp, Artificial Sequence
  Description of Artificial Sequence: Synthetic oligonucleotide
agcaggggagctcttcaatctcaatgatatctctg

SEQ ID NO: 283196 - DNA, 34 bp, Artificial Sequence
  Description of Artificial Sequence: Synthetic oligonucleotide
gcaggggagctcttcaatctcaatgatatctctg

SEQ ID NO: 283197 - DNA, 39 bp, Artificial Sequence
  Description of Artificial Sequence: Synthetic oligonucleotide
caggggagctcttcaatctcaatgatatctctgaataag

SEQ ID NO: 283198 - DNA, 40 bp, Artificial Sequence
  Description of Artificial Sequence: Synthetic oligonucleotide
aggggagctcttcaatctcaatgatatctctgaataagtg

SEQ ID NO: 283199 - DNA, 39 bp, Artificial Sequence
  Description of Artificial Sequence: Synthetic oligonucleotide
ggggagctcttcaatctcaatgatatctctgaataagtg

SEQ ID NO: 283200 - DNA, 39 bp, Artificial Sequence
  Description of Artificial Sequence: Synthetic oligonucleotide
gggagctcttcaatctcaatgatatctctgaataagtgg

SEQ ID NO: 283201 - DNA, 42 bp, Artificial Sequence
  Description of Artificial Sequence: Synthetic oligonucleotide
ggagctcttcaatctcaatgatatctctgaataagtggaaac

SEQ ID NO: 283202 - DNA, 49 bp, Artificial Sequence
  Description of Artificial Sequence: Synthetic oligonucleotide
gagctcttcaatctcaatgatatctctgaataagtggaaacttttatag

SEQ ID NO: 283203 - DNA, 49 bp, Artificial Sequence
  Description of Artificial Sequence: Synthetic oligonucleotide
agctcttcaatctcaatgatatctctgaataagtggaaacttttatagc

SEQ ID NO: 283204 - DNA, 48 bp, Artificial Sequence
  Description of Artificial Sequence: Synthetic oligonucleotide
gctcttcaatctcaatgatatctctgaataagtggaaacttttatagc

SEQ ID NO: 283205 - DNA, 53 bp, Artificial Sequence
  Description of Artificial Sequence: Synthetic oligonucleotide
ctcttcaatctcaatgatatctctgaataagtggaaacttttatagcaatatg

SEQ ID NO: 283206 - DNA, 53 bp, Artificial Sequence
  Description of Artificial Sequence: Synthetic oligonucleotide
tcttcaatctcaatgatatctctgaataagtggaaacttttatagcaatatgc

SEQ ID NO: 283207 - DNA, 52 bp, Artificial Sequence
  Description of Artificial Sequence: Synthetic oligonucleotide
cttcaatctcaatgatatctctgaataagtggaaacttttatagcaatatgc

SEQ ID NO: 283208 - DNA, 55 bp, Artificial Sequence
  Description of Artificial Sequence: Synthetic oligonucleotide
ttcaatctcaatgatatctctgaataagtggaaacttttatagcaatatgcattg

SEQ ID NO: 283209 - DNA, 54 bp, Artificial Sequence
  Description of Artificial Sequence: Synthetic oligonucleotide
tcaatctcaatgatatctctgaataagtggaaacttttatagcaatatgcattg

SEQ ID NO: 283210 - DNA, 53 bp, Artificial Sequence
  Description of Artificial Sequence: Synthetic oligonucleotide
caatctcaatgatatctctgaataagtggaaacttttatagcaatatgcattg

SEQ ID NO: 283211 - DNA, 55 bp, Artificial Sequence
  Description of Artificial Sequence: Synthetic oligonucleotide
aatctcaatgatatctctgaataagtggaaacttttatagcaatatgcattgaac

SEQ ID NO: 283212 - DNA, 54 bp, Artificial Sequence
  Description of Artificial Sequence: Synthetic oligonucleotide
atctcaatgatatctctgaataagtggaaacttttatagcaatatgcattgaac

SEQ ID NO: 283213 - DNA, 53 bp, Artificial Sequence
  Description of Artificial Sequence: Synthetic oligonucleotide
tctcaatgatatctctgaataagtggaaacttttatagcaatatgcattgaac

SEQ ID NO: 283214 - DNA, 52 bp, Artificial Sequence
  Description of Artificial Sequence: Synthetic oligonucleotide
ctcaatgatatctctgaataagtggaaacttttatagcaatatgcattgaac

SEQ ID NO: 283215 - DNA, 53 bp, Artificial Sequence
  Description of Artificial Sequence: Synthetic oligonucleotide
tcaatgatatctctgaataagtggaaacttttatagcaatatgcattgaacac

SEQ ID NO: 283216 - DNA, 52 bp, Artificial Sequence
  Description of Artificial Sequence: Synthetic oligonucleotide
caatgatatctctgaataagtggaaacttttatagcaatatgcattgaacac

SEQ ID NO: 283217 - DNA, 54 bp, Artificial Sequence
  Description of Artificial Sequence: Synthetic oligonucleotide
aatgatatctctgaataagtggaaacttttatagcaatatgcattgaacactac

SEQ ID NO: 283218 - DNA, 53 bp, Artificial Sequence
  Description of Artificial Sequence: Synthetic oligonucleotide
atgatatctctgaataagtggaaacttttatagcaatatgcattgaacactac

SEQ ID NO: 283219 - DNA, 52 bp, Artificial Sequence
  Description of Artificial Sequence: Synthetic oligonucleotide
tgatatctctgaataagtggaaacttttatagcaatatgcattgaacactac

SEQ ID NO: 283220 - DNA, 51 bp, Artificial Sequence
  Description of Artificial Sequence: Synthetic oligonucleotide
gatatctctgaataagtggaaacttttatagcaatatgcattgaacactac

SEQ ID NO: 283221 - DNA, 52 bp, Artificial Sequence
  Description of Artificial Sequence: Synthetic oligonucleotide
atatctctgaataagtggaaacttttatagcaatatgcattgaacactacac

SEQ ID NO: 283222 - DNA, 51 bp, Artificial Sequence
  Description of Artificial Sequence: Synthetic oligonucleotide
tatctctgaataagtggaaacttttatagcaatatgcattgaacactacac

SEQ ID NO: 283223 - DNA, 50 bp, Artificial Sequence
  Description of Artificial Sequence: Synthetic oligonucleotide
atctctgaataagtggaaacttttatagcaatatgcattgaacactacac

SEQ ID NO: 283224 - DNA, 49 bp, Artificial Sequence
  Description of Artificial Sequence: Synthetic oligonucleotide
tctctgaataagtggaaacttttatagcaatatgcattgaacactacac

SEQ ID NO: 283225 - DNA, 48 bp, Artificial Sequence
  Description of Artificial Sequence: Synthetic oligonucleotide
ctctgaataagtggaaacttttatagcaatatgcattgaacactacac

SEQ ID NO: 283226 - DNA, 48 bp, Artificial Sequence
  Description of Artificial Sequence: Synthetic oligonucleotide
tctgaataagtggaaacttttatagcaatatgcattgaacactacacc

SEQ ID NO: 283227 - DNA, 47 bp, Artificial Sequence
  Description of Artificial Sequence: Synthetic oligonucleotide
ctgaataagtggaaacttttatagcaatatgcattgaacactacacc

SEQ ID NO: 283228 - DNA, 50 bp, Artificial Sequence
  Description of Artificial Sequence: Synthetic oligonucleotide
tgaataagtggaaacttttatagcaatatgcattgaacactacacctaac

SEQ ID NO: 283229 - DNA, 49 bp, Artificial Sequence
  Description of Artificial Sequence: Synthetic oligonucleotide
gaataagtggaaacttttatagcaatatgcattgaacactacacctaac

SEQ ID NO: 283230 - DNA, 52 bp, Artificial Sequence
  Description of Artificial Sequence: Synthetic oligonucleotide
aataagtggaaacttttatagcaatatgcattgaacactacacctaacaatg

SEQ ID NO: 283231 - DNA, 51 bp, Artificial Sequence
  Description of Artificial Sequence: Synthetic oligonucleotide
ataagtggaaacttttatagcaatatgcattgaacactacacctaacaatg

SEQ ID NO: 283232 - DNA, 50 bp, Artificial Sequence
  Description of Artificial Sequence: Synthetic oligonucleotide
taagtggaaacttttatagcaatatgcattgaacactacacctaacaatg

SEQ ID NO: 283233 - DNA, 49 bp, Artificial Sequence
  Description of Artificial Sequence: Synthetic oligonucleotide
aagtggaaacttttatagcaatatgcattgaacactacacctaacaatg

SEQ ID NO: 283234 - DNA, 48 bp, Artificial Sequence
  Description of Artificial Sequence: Synthetic oligonucleotide
agtggaaacttttatagcaatatgcattgaacactacacctaacaatg

SEQ ID NO: 283235 - DNA, 47 bp, Artificial Sequence
  Description of Artificial Sequence: Synthetic oligonucleotide
gtggaaacttttatagcaatatgcattgaacactacacctaacaatg

SEQ ID NO: 283236 - DNA, 48 bp, Artificial Sequence
  Description of Artificial Sequence: Synthetic oligonucleotide
tggaaacttttatagcaatatgcattgaacactacacctaacaatgtg

SEQ ID NO: 283237 - DNA, 47 bp, Artificial Sequence
  Description of Artificial Sequence: Synthetic oligonucleotide
ggaaacttttatagcaatatgcattgaacactacacctaacaatgtg

SEQ ID NO: 283238 - DNA, 48 bp, Artificial Sequence
  Description of Artificial Sequence: Synthetic oligonucleotide
gaaacttttatagcaatatgcattgaacactacacctaacaatgtgag

SEQ ID NO: 283239 - DNA, 48 bp, Artificial Sequence
  Description of Artificial Sequence: Synthetic oligonucleotide
aaacttttatagcaatatgcattgaacactacacctaacaatgtgagg

SEQ ID NO: 283240 - DNA, 47 bp, Artificial Sequence
  Description of Artificial Sequence: Synthetic oligonucleotide
aacttttatagcaatatgcattgaacactacacctaacaatgtgagg

SEQ ID NO: 283241 - DNA, 46 bp, Artificial Sequence
  Description of Artificial Sequence: Synthetic oligonucleotide
acttttatagcaatatgcattgaacactacacctaacaatgtgagg

SEQ ID NO: 283242 - DNA, 45 bp, Artificial Sequence
  Description of Artificial Sequence: Synthetic oligonucleotide
cttttatagcaatatgcattgaacactacacctaacaatgtgagg

SEQ ID NO: 283243 - DNA, 50 bp, Artificial Sequence
  Description of Artificial Sequence: Synthetic oligonucleotide
ttttatagcaatatgcattgaacactacacctaacaatgtgaggaaaatg

SEQ ID NO: 283244 - DNA, 49 bp, Artificial Sequence
  Description of Artificial Sequence: Synthetic oligonucleotide
tttatagcaatatgcattgaacactacacctaacaatgtgaggaaaatg

SEQ ID NO: 283245 - DNA, 48 bp, Artificial Sequence
  Description of Artificial Sequence: Synthetic oligonucleotide
ttatagcaatatgcattgaacactacacctaacaatgtgaggaaaatg

SEQ ID NO: 283246 - DNA, 47 bp, Artificial Sequence
  Description of Artificial Sequence: Synthetic oligonucleotide
tatagcaatatgcattgaacactacacctaacaatgtgaggaaaatg

SEQ ID NO: 283247 - DNA, 46 bp, Artificial Sequence
  Description of Artificial Sequence: Synthetic oligonucleotide
atagcaatatgcattgaacactacacctaacaatgtgaggaaaatg

SEQ ID NO: 283248 - DNA, 45 bp, Artificial Sequence
  Description of Artificial Sequence: Synthetic oligonucleotide
tagcaatatgcattgaacactacacctaacaatgtgaggaaaatg

SEQ ID NO: 283249 - DNA, 44 bp, Artificial Sequence
  Description of Artificial Sequence: Synthetic oligonucleotide
agcaatatgcattgaacactacacctaacaatgtgaggaaaatg

SEQ ID NO: 283250 - DNA, 43 bp, Artificial Sequence
  Description of Artificial Sequence: Synthetic oligonucleotide
gcaatatgcattgaacactacacctaacaatgtgaggaaaatg

SEQ ID NO: 283251 - DNA, 43 bp, Artificial Sequence
  Description of Artificial Sequence: Synthetic oligonucleotide
caatatgcattgaacactacacctaacaatgtgaggaaaatgc

SEQ ID NO: 283252 - DNA, 44 bp, Artificial Sequence
  Description of Artificial Sequence: Synthetic oligonucleotide
aatatgcattgaacactacacctaacaatgtgaggaaaatgctg

SEQ ID NO: 283253 - DNA, 43 bp, Artificial Sequence
  Description of Artificial Sequence: Synthetic oligonucleotide
atatgcattgaacactacacctaacaatgtgaggaaaatgctg

SEQ ID NO: 283254 - DNA, 42 bp, Artificial Sequence
  Description of Artificial Sequence: Synthetic oligonucleotide
tatgcattgaacactacacctaacaatgtgaggaaaatgctg

SEQ ID NO: 283255 - DNA, 41 bp, Artificial Sequence
  Description of Artificial Sequence: Synthetic oligonucleotide
atgcattgaacactacacctaacaatgtgaggaaaatgctg

SEQ ID NO: 283256 - DNA, 40 bp, Artificial Sequence
  Description of Artificial Sequence: Synthetic oligonucleotide
tgcattgaacactacacctaacaatgtgaggaaaatgctg

SEQ ID NO: 283257 - DNA, 39 bp, Artificial Sequence
  Description of Artificial Sequence: Synthetic oligonucleotide
gcattgaacactacacctaacaatgtgaggaaaatgctg

SEQ ID NO: 283258 - DNA, 43 bp, Artificial Sequence
  Description of Artificial Sequence: Synthetic oligonucleotide
cattgaacactacacctaacaatgtgaggaaaatgctgatttg

SEQ ID NO: 283259 - DNA, 43 bp, Artificial Sequence
  Description of Artificial Sequence: Synthetic oligonucleotide
attgaacactacacctaacaatgtgaggaaaatgctgatttgc

SEQ ID NO: 283260 - DNA, 42 bp, Artificial Sequence
  Description of Artificial Sequence: Synthetic oligonucleotide
ttgaacactacacctaacaatgtgaggaaaatgctgatttgc

SEQ ID NO: 283261 - DNA, 41 bp, Artificial Sequence
  Description of Artificial Sequence: Synthetic oligonucleotide
tgaacactacacctaacaatgtgaggaaaatgctgatttgc

SEQ ID NO: 283262 - DNA, 40 bp, Artificial Sequence
  Description of Artificial Sequence: Synthetic oligonucleotide
gaacactacacctaacaatgtgaggaaaatgctgatttgc

SEQ ID NO: 283263 - DNA, 40 bp, Artificial Sequence
  Description of Artificial Sequence: Synthetic oligonucleotide
aacactacacctaacaatgtgaggaaaatgctgatttgcc

SEQ ID NO: 283264 - DNA, 39 bp, Artificial Sequence
  Description of Artificial Sequence: Synthetic oligonucleotide
acactacacctaacaatgtgaggaaaatgctgatttgcc

SEQ ID NO: 283265 - DNA, 38 bp, Artificial Sequence
  Description of Artificial Sequence: Synthetic oligonucleotide
cactacacctaacaatgtgaggaaaatgctgatttgcc

SEQ ID NO: 283266 - DNA, 39 bp, Artificial Sequence
  Description of Artificial Sequence: Synthetic oligonucleotide
actacacctaacaatgtgaggaaaatgctgatttgcctc

SEQ ID NO: 283267 - DNA, 38 bp, Artificial Sequence
  Description of Artificial Sequence: Synthetic oligonucleotide
ctacacctaacaatgtgaggaaaatgctgatttgcctc

SEQ ID NO: 283268 - DNA, 40 bp, Artificial Sequence
  Description of Artificial Sequence: Synthetic oligonucleotide
tacacctaacaatgtgaggaaaatgctgatttgcctcaag

SEQ ID NO: 283269 - DNA, 39 bp, Artificial Sequence
  Description of Artificial Sequence: Synthetic oligonucleotide
acacctaacaatgtgaggaaaatgctgatttgcctcaag

SEQ ID NO: 283270 - DNA, 38 bp, Artificial Sequence
  Description of Artificial Sequence: Synthetic oligonucleotide
cacctaacaatgtgaggaaaatgctgatttgcctcaag

SEQ ID NO: 283271 - DNA, 38 bp, Artificial Sequence
  Description of Artificial Sequence: Synthetic oligonucleotide
acctaacaatgtgaggaaaatgctgatttgcctcaagg

SEQ ID NO: 283272 - DNA, 37 bp, Artificial Sequence
  Description of Artificial Sequence: Synthetic oligonucleotide
cctaacaatgtgaggaaaatgctgatttgcctcaagg

SEQ ID NO: 283273 - DNA, 38 bp, Artificial Sequence
  Description of Artificial Sequence: Synthetic oligonucleotide
ctaacaatgtgaggaaaatgctgatttgcctcaaggag

SEQ ID NO: 283274 - DNA, 46 bp, Artificial Sequence
  Description of Artificial Sequence: Synthetic oligonucleotide
taacaatgtgaggaaaatgctgatttgcctcaaggagaaataaaac

SEQ ID NO: 283275 - DNA, 45 bp, Artificial Sequence
  Description of Artificial Sequence: Synthetic oligonucleotide
aacaatgtgaggaaaatgctgatttgcctcaaggagaaataaaac

SEQ ID NO: 283276 - DNA, 44 bp, Artificial Sequence
  Description of Artificial Sequence: Synthetic oligonucleotide
acaatgtgaggaaaatgctgatttgcctcaaggagaaataaaac

SEQ ID NO: 283277 - DNA, 43 bp, Artificial Sequence
  Description of Artificial Sequence: Synthetic oligonucleotide
caatgtgaggaaaatgctgatttgcctcaaggagaaataaaac

SEQ ID NO: 283278 - DNA, 43 bp, Artificial Sequence
  Description of Artificial Sequence: Synthetic oligonucleotide
aatgtgaggaaaatgctgatttgcctcaaggagaaataaaacc

SEQ ID NO: 283279 - DNA, 42 bp, Artificial Sequence
  Description of Artificial Sequence: Synthetic oligonucleotide
atgtgaggaaaatgctgatttgcctcaaggagaaataaaacc

SEQ ID NO: 283280 - DNA, 41 bp, Artificial Sequence
  Description of Artificial Sequence: Synthetic oligonucleotide
tgtgaggaaaatgctgatttgcctcaaggagaaataaaacc

SEQ ID NO: 283281 - DNA, 40 bp, Artificial Sequence
  Description of Artificial Sequence: Synthetic oligonucleotide
gtgaggaaaatgctgatttgcctcaaggagaaataaaacc

SEQ ID NO: 283282 - DNA, 44 bp, Artificial Sequence
  Description of Artificial Sequence: Synthetic oligonucleotide
tgaggaaaatgctgatttgcctcaaggagaaataaaaccaatag

SEQ ID NO: 283283 - DNA, 43 bp, Artificial Sequence
  Description of Artificial Sequence: Synthetic oligonucleotide
gaggaaaatgctgatttgcctcaaggagaaataaaaccaatag

SEQ ID NO: 283284 - DNA, 44 bp, Artificial Sequence
  Description of Artificial Sequence: Synthetic oligonucleotide
aggaaaatgctgatttgcctcaaggagaaataaaaccaatagac

SEQ ID NO: 283285 - DNA, 43 bp, Artificial Sequence
  Description of Artificial Sequence: Synthetic oligonucleotide
ggaaaatgctgatttgcctcaaggagaaataaaaccaatagac

SEQ ID NO: 283286 - DNA, 43 bp, Artificial Sequence
  Description of Artificial Sequence: Synthetic oligonucleotide
gaaaatgctgatttgcctcaaggagaaataaaaccaatagacc

SEQ ID NO: 283287 - DNA, 44 bp, Artificial Sequence
  Description of Artificial Sequence: Synthetic oligonucleotide
aaaatgctgatttgcctcaaggagaaataaaaccaatagaccag

SEQ ID NO: 283288 - DNA, 43 bp, Artificial Sequence
  Description of Artificial Sequence: Synthetic oligonucleotide
aaatgctgatttgcctcaaggagaaataaaaccaatagaccag

SEQ ID NO: 283289 - DNA, 42 bp, Artificial Sequence
  Description of Artificial Sequence: Synthetic oligonucleotide
aatgctgatttgcctcaaggagaaataaaaccaatagaccag

SEQ ID NO: 283290 - DNA, 41 bp, Artificial Sequence
  Description of Artificial Sequence: Synthetic oligonucleotide
atgctgatttgcctcaaggagaaataaaaccaatagaccag

SEQ ID NO: 283291 - DNA, 40 bp, Artificial Sequence
  Description of Artificial Sequence: Synthetic oligonucleotide
tgctgatttgcctcaaggagaaataaaaccaatagaccag

SEQ ID NO: 283292 - DNA, 39 bp, Artificial Sequence
  Description of Artificial Sequence: Synthetic oligonucleotide
gctgatttgcctcaaggagaaataaaaccaatagaccag

SEQ ID NO: 283293 - DNA, 40 bp, Artificial Sequence
  Description of Artificial Sequence: Synthetic oligonucleotide
ctgatttgcctcaaggagaaataaaaccaatagaccagag

SEQ ID NO: 283294 - DNA, 43 bp, Artificial Sequence
  Description of Artificial Sequence: Synthetic oligonucleotide
tgatttgcctcaaggagaaataaaaccaatagaccagagaatg

SEQ ID NO: 283295 - DNA, 42 bp, Artificial Sequence
  Description of Artificial Sequence: Synthetic oligonucleotide
gatttgcctcaaggagaaataaaaccaatagaccagagaatg

SEQ ID NO: 283296 - DNA, 42 bp, Artificial Sequence
  Description of Artificial Sequence: Synthetic oligonucleotide
atttgcctcaaggagaaataaaaccaatagaccagagaatgg

SEQ ID NO: 283297 - DNA, 41 bp, Artificial Sequence
  Description of Artificial Sequence: Synthetic oligonucleotide
tttgcctcaaggagaaataaaaccaatagaccagagaatgg

SEQ ID NO: 283298 - DNA, 40 bp, Artificial Sequence
  Description of Artificial Sequence: Synthetic oligonucleotide
ttgcctcaaggagaaataaaaccaatagaccagagaatgg

SEQ ID NO: 283299 - DNA, 39 bp, Artificial Sequence
  Description of Artificial Sequence: Synthetic oligonucleotide
tgcctcaaggagaaataaaaccaatagaccagagaatgg

SEQ ID NO: 283300 - DNA, 38 bp, Artificial Sequence
  Description of Artificial Sequence: Synthetic oligonucleotide
gcctcaaggagaaataaaaccaatagaccagagaatgg

SEQ ID NO: 283301 - DNA, 40 bp, Artificial Sequence
  Description of Artificial Sequence: Synthetic oligonucleotide
cctcaaggagaaataaaaccaatagaccagagaatggaag

SEQ ID NO: 283302 - DNA, 40 bp, Artificial Sequence
  Description of Artificial Sequence: Synthetic oligonucleotide
ctcaaggagaaataaaaccaatagaccagagaatggaagg

SEQ ID NO: 283303 - DNA, 40 bp, Artificial Sequence
  Description of Artificial Sequence: Synthetic oligonucleotide
tcaaggagaaataaaaccaatagaccagagaatggaaggc

SEQ ID NO: 283304 - DNA, 39 bp, Artificial Sequence
  Description of Artificial Sequence: Synthetic oligonucleotide
caaggagaaataaaaccaatagaccagagaatggaaggc

SEQ ID NO: 283305 - DNA, 41 bp, Artificial Sequence
  Description of Artificial Sequence: Synthetic oligonucleotide
aaggagaaataaaaccaatagaccagagaatggaaggcaac

SEQ ID NO: 283306 - DNA, 40 bp, Artificial Sequence
  Description of Artificial Sequence: Synthetic oligonucleotide
aggagaaataaaaccaatagaccagagaatggaaggcaac

SEQ ID NO: 283307 - DNA, 39 bp, Artificial Sequence
  Description of Artificial Sequence: Synthetic oligonucleotide
ggagaaataaaaccaatagaccagagaatggaaggcaac

SEQ ID NO: 283308 - DNA, 39 bp, Artificial Sequence
  Description of Artificial Sequence: Synthetic oligonucleotide
gagaaataaaaccaatagaccagagaatggaaggcaacg

SEQ ID NO: 283309 - DNA, 49 bp, Artificial Sequence
  Description of Artificial Sequence: Synthetic oligonucleotide
agaaataaaaccaatagaccagagaatggaaggcaacgtaaataatatg

SEQ ID NO: 283310 - DNA, 48 bp, Artificial Sequence
  Description of Artificial Sequence: Synthetic oligonucleotide
gaaataaaaccaatagaccagagaatggaaggcaacgtaaataatatg

SEQ ID NO: 283311 - DNA, 50 bp, Artificial Sequence
  Description of Artificial Sequence: Synthetic oligonucleotide
aaataaaaccaatagaccagagaatggaaggcaacgtaaataatatgttc

SEQ ID NO: 283312 - DNA, 49 bp, Artificial Sequence
  Description of Artificial Sequence: Synthetic oligonucleotide
aataaaaccaatagaccagagaatggaaggcaacgtaaataatatgttc

SEQ ID NO: 283313 - DNA, 48 bp, Artificial Sequence
  Description of Artificial Sequence: Synthetic oligonucleotide
ataaaaccaatagaccagagaatggaaggcaacgtaaataatatgttc

SEQ ID NO: 283314 - DNA, 47 bp, Artificial Sequence
  Description of Artificial Sequence: Synthetic oligonucleotide
taaaaccaatagaccagagaatggaaggcaacgtaaataatatgttc

SEQ ID NO: 283315 - DNA, 46 bp, Artificial Sequence
  Description of Artificial Sequence: Synthetic oligonucleotide
aaaaccaatagaccagagaatggaaggcaacgtaaataatatgttc

SEQ ID NO: 283316 - DNA, 45 bp, Artificial Sequence
  Description of Artificial Sequence: Synthetic oligonucleotide
aaaccaatagaccagagaatggaaggcaacgtaaataatatgttc

SEQ ID NO: 283317 - DNA, 44 bp, Artificial Sequence
  Description of Artificial Sequence: Synthetic oligonucleotide
aaccaatagaccagagaatggaaggcaacgtaaataatatgttc

SEQ ID NO: 283318 - DNA, 43 bp, Artificial Sequence
  Description of Artificial Sequence: Synthetic oligonucleotide
accaatagaccagagaatggaaggcaacgtaaataatatgttc

SEQ ID NO: 283319 - DNA, 42 bp, Artificial Sequence
  Description of Artificial Sequence: Synthetic oligonucleotide
ccaatagaccagagaatggaaggcaacgtaaataatatgttc

SEQ ID NO: 283320 - DNA, 42 bp, Artificial Sequence
  Description of Artificial Sequence: Synthetic oligonucleotide
caatagaccagagaatggaaggcaacgtaaataatatgttcc

SEQ ID NO: 283321 - DNA, 43 bp, Artificial Sequence
  Description of Artificial Sequence: Synthetic oligonucleotide
aatagaccagagaatggaaggcaacgtaaataatatgttccag

SEQ ID NO: 283322 - DNA, 42 bp, Artificial Sequence
  Description of Artificial Sequence: Synthetic oligonucleotide
atagaccagagaatggaaggcaacgtaaataatatgttccag

SEQ ID NO: 283323 - DNA, 41 bp, Artificial Sequence
  Description of Artificial Sequence: Synthetic oligonucleotide
tagaccagagaatggaaggcaacgtaaataatatgttccag

SEQ ID NO: 283324 - DNA, 40 bp, Artificial Sequence
  Description of Artificial Sequence: Synthetic oligonucleotide
agaccagagaatggaaggcaacgtaaataatatgttccag

SEQ ID NO: 283325 - DNA, 39 bp, Artificial Sequence
  Description of Artificial Sequence: Synthetic oligonucleotide
gaccagagaatggaaggcaacgtaaataatatgttccag

SEQ ID NO: 283326 - DNA, 39 bp, Artificial Sequence
  Description of Artificial Sequence: Synthetic oligonucleotide
accagagaatggaaggcaacgtaaataatatgttccagg

SEQ ID NO: 283327 - DNA, 38 bp, Artificial Sequence
  Description of Artificial Sequence: Synthetic oligonucleotide
ccagagaatggaaggcaacgtaaataatatgttccagg

SEQ ID NO: 283328 - DNA, 38 bp, Artificial Sequence
  Description of Artificial Sequence: Synthetic oligonucleotide
cagagaatggaaggcaacgtaaataatatgttccaggg

SEQ ID NO: 283329 - DNA, 40 bp, Artificial Sequence
  Description of Artificial Sequence: Synthetic oligonucleotide
agagaatggaaggcaacgtaaataatatgttccagggatg

SEQ ID NO: 283330 - DNA, 39 bp, Artificial Sequence
  Description of Artificial Sequence: Synthetic oligonucleotide
gagaatggaaggcaacgtaaataatatgttccagggatg

SEQ ID NO: 283331 - DNA, 40 bp, Artificial Sequence
  Description of Artificial Sequence: Synthetic oligonucleotide
agaatggaaggcaacgtaaataatatgttccagggatgtc

SEQ ID NO: 283332 - DNA, 39 bp, Artificial Sequence
  Description of Artificial Sequence: Synthetic oligonucleotide
gaatggaaggcaacgtaaataatatgttccagggatgtc

SEQ ID NO: 283333 - DNA, 41 bp, Artificial Sequence
  Description of Artificial Sequence: Synthetic oligonucleotide
aatggaaggcaacgtaaataatatgttccagggatgtctag

SEQ ID NO: 283334 - DNA, 40 bp, Artificial Sequence
  Description of Artificial Sequence: Synthetic oligonucleotide
atggaaggcaacgtaaataatatgttccagggatgtctag

SEQ ID NO: 283335 - DNA, 39 bp, Artificial Sequence
  Description of Artificial Sequence: Synthetic oligonucleotide
tggaaggcaacgtaaataatatgttccagggatgtctag

SEQ ID NO: 283336 - DNA, 38 bp, Artificial Sequence
  Description of Artificial Sequence: Synthetic oligonucleotide
ggaaggcaacgtaaataatatgttccagggatgtctag

SEQ ID NO: 283337 - DNA, 40 bp, Artificial Sequence
  Description of Artificial Sequence: Synthetic oligonucleotide
gaaggcaacgtaaataatatgttccagggatgtctagttg

SEQ ID NO: 283338 - DNA, 42 bp, Artificial Sequence
  Description of Artificial Sequence: Synthetic oligonucleotide
aaggcaacgtaaataatatgttccagggatgtctagttgatc

SEQ ID NO: 283339 - DNA, 41 bp, Artificial Sequence
  Description of Artificial Sequence: Synthetic oligonucleotide
aggcaacgtaaataatatgttccagggatgtctagttgatc

SEQ ID NO: 283340 - DNA, 40 bp, Artificial Sequence
  Description of Artificial Sequence: Synthetic oligonucleotide
ggcaacgtaaataatatgttccagggatgtctagttgatc

SEQ ID NO: 283341 - DNA, 41 bp, Artificial Sequence
  Description of Artificial Sequence: Synthetic oligonucleotide
gcaacgtaaataatatgttccagggatgtctagttgatcac

SEQ ID NO: 283342 - DNA, 43 bp, Artificial Sequence
  Description of Artificial Sequence: Synthetic oligonucleotide
caacgtaaataatatgttccagggatgtctagttgatcacaac

SEQ ID NO: 283343 - DNA, 49 bp, Artificial Sequence
  Description of Artificial Sequence: Synthetic oligonucleotide
aacgtaaataatatgttccagggatgtctagttgatcacaactataaac

SEQ ID NO: 283344 - DNA, 48 bp, Artificial Sequence
  Description of Artificial Sequence: Synthetic oligonucleotide
acgtaaataatatgttccagggatgtctagttgatcacaactataaac

SEQ ID NO: 283345 - DNA, 47 bp, Artificial Sequence
  Description of Artificial Sequence: Synthetic oligonucleotide
cgtaaataatatgttccagggatgtctagttgatcacaactataaac

SEQ ID NO: 283346 - DNA, 48 bp, Artificial Sequence
  Description of Artificial Sequence: Synthetic oligonucleotide
gtaaataatatgttccagggatgtctagttgatcacaactataaacag

SEQ ID NO: 283347 - DNA, 48 bp, Artificial Sequence
  Description of Artificial Sequence: Synthetic oligonucleotide
taaataatatgttccagggatgtctagttgatcacaactataaacagc

SEQ ID NO: 283348 - DNA, 47 bp, Artificial Sequence
  Description of Artificial Sequence: Synthetic oligonucleotide
aaataatatgttccagggatgtctagttgatcacaactataaacagc

SEQ ID NO: 283349 - DNA, 46 bp, Artificial Sequence
  Description of Artificial Sequence: Synthetic oligonucleotide
aataatatgttccagggatgtctagttgatcacaactataaacagc

SEQ ID NO: 283350 - DNA, 45 bp, Artificial Sequence
  Description of Artificial Sequence: Synthetic oligonucleotide
ataatatgttccagggatgtctagttgatcacaactataaacagc

SEQ ID NO: 283351 - DNA, 44 bp, Artificial Sequence
  Description of Artificial Sequence: Synthetic oligonucleotide
taatatgttccagggatgtctagttgatcacaactataaacagc

SEQ ID NO: 283352 - DNA, 43 bp, Artificial Sequence
  Description of Artificial Sequence: Synthetic oligonucleotide
aatatgttccagggatgtctagttgatcacaactataaacagc

SEQ ID NO: 283353 - DNA, 42 bp, Artificial Sequence
  Description of Artificial Sequence: Synthetic oligonucleotide
atatgttccagggatgtctagttgatcacaactataaacagc

SEQ ID NO: 283354 - DNA, 41 bp, Artificial Sequence
  Description of Artificial Sequence: Synthetic oligonucleotide
tatgttccagggatgtctagttgatcacaactataaacagc

SEQ ID NO: 283355 - DNA, 40 bp, Artificial Sequence
  Description of Artificial Sequence: Synthetic oligonucleotide
atgttccagggatgtctagttgatcacaactataaacagc

SEQ ID NO: 283356 - DNA, 39 bp, Artificial Sequence
  Description of Artificial Sequence: Synthetic oligonucleotide
tgttccagggatgtctagttgatcacaactataaacagc

SEQ ID NO: 283357 - DNA, 38 bp, Artificial Sequence
  Description of Artificial Sequence: Synthetic oligonucleotide
gttccagggatgtctagttgatcacaactataaacagc

SEQ ID NO: 283358 - DNA, 38 bp, Artificial Sequence
  Description of Artificial Sequence: Synthetic oligonucleotide
ttccagggatgtctagttgatcacaactataaacagcc

SEQ ID NO: 283359 - DNA, 37 bp, Artificial Sequence
  Description of Artificial Sequence: Synthetic oligonucleotide
tccagggatgtctagttgatcacaactataaacagcc

SEQ ID NO: 283360 - DNA, 36 bp, Artificial Sequence
  Description of Artificial Sequence: Synthetic oligonucleotide
ccagggatgtctagttgatcacaactataaacagcc

SEQ ID NO: 283361 - DNA, 40 bp, Artificial Sequence
  Description of Artificial Sequence: Synthetic oligonucleotide
cagggatgtctagttgatcacaactataaacagcctattg

SEQ ID NO: 283362 - DNA, 40 bp, Artificial Sequence
  Description of Artificial Sequence: Synthetic oligonucleotide
agggatgtctagttgatcacaactataaacagcctattgg

SEQ ID NO: 283363 - DNA, 39 bp, Artificial Sequence
  Description of Artificial Sequence: Synthetic oligonucleotide
gggatgtctagttgatcacaactataaacagcctattgg

SEQ ID NO: 283364 - DNA, 39 bp, Artificial Sequence
  Description of Artificial Sequence: Synthetic oligonucleotide
ggatgtctagttgatcacaactataaacagcctattggc

SEQ ID NO: 283365 - DNA, 42 bp, Artificial Sequence
  Description of Artificial Sequence: Synthetic oligonucleotide
gatgtctagttgatcacaactataaacagcctattggcaatg

SEQ ID NO: 283366 - DNA, 42 bp, Artificial Sequence
  Description of Artificial Sequence: Synthetic oligonucleotide
atgtctagttgatcacaactataaacagcctattggcaatgc

SEQ ID NO: 283367 - DNA, 41 bp, Artificial Sequence
  Description of Artificial Sequence: Synthetic oligonucleotide
tgtctagttgatcacaactataaacagcctattggcaatgc

SEQ ID NO: 283368 - DNA, 40 bp, Artificial Sequence
  Description of Artificial Sequence: Synthetic oligonucleotide
gtctagttgatcacaactataaacagcctattggcaatgc

SEQ ID NO: 283369 - DNA, 41 bp, Artificial Sequence
  Description of Artificial Sequence: Synthetic oligonucleotide
tctagttgatcacaactataaacagcctattggcaatgctc

SEQ ID NO: 283370 - DNA, 40 bp, Artificial Sequence
  Description of Artificial Sequence: Synthetic oligonucleotide
ctagttgatcacaactataaacagcctattggcaatgctc

SEQ ID NO: 283371 - DNA, 41 bp, Artificial Sequence
  Description of Artificial Sequence: Synthetic oligonucleotide
tagttgatcacaactataaacagcctattggcaatgctctg

SEQ ID NO: 283372 - DNA, 40 bp, Artificial Sequence
  Description of Artificial Sequence: Synthetic oligonucleotide
agttgatcacaactataaacagcctattggcaatgctctg

SEQ ID NO: 283373 - DNA, 39 bp, Artificial Sequence
  Description of Artificial Sequence: Synthetic oligonucleotide
gttgatcacaactataaacagcctattggcaatgctctg

SEQ ID NO: 283374 - DNA, 39 bp, Artificial Sequence
  Description of Artificial Sequence: Synthetic oligonucleotide
ttgatcacaactataaacagcctattggcaatgctctgg

SEQ ID NO: 283375 - DNA, 38 bp, Artificial Sequence
  Description of Artificial Sequence: Synthetic oligonucleotide
tgatcacaactataaacagcctattggcaatgctctgg

SEQ ID NO: 283376 - DNA, 37 bp, Artificial Sequence
  Description of Artificial Sequence: Synthetic oligonucleotide
gatcacaactataaacagcctattggcaatgctctgg

SEQ ID NO: 283377 - DNA, 38 bp, Artificial Sequence
  Description of Artificial Sequence: Synthetic oligonucleotide
atcacaactataaacagcctattggcaatgctctggac

SEQ ID NO: 283378 - DNA, 37 bp, Artificial Sequence
  Description of Artificial Sequence: Synthetic oligonucleotide
tcacaactataaacagcctattggcaatgctctggac

SEQ ID NO: 283379 - DNA, 36 bp, Artificial Sequence
  Description of Artificial Sequence: Synthetic oligonucleotide
cacaactataaacagcctattggcaatgctctggac

SEQ ID NO: 283380 - DNA, 37 bp, Artificial Sequence
  Description of Artificial Sequence: Synthetic oligonucleotide
acaactataaacagcctattggcaatgctctggacac

SEQ ID NO: 283381 - DNA, 36 bp, Artificial Sequence
  Description of Artificial Sequence: Synthetic oligonucleotide
caactataaacagcctattggcaatgctctggacac

SEQ ID NO: 283382 - DNA, 37 bp, Artificial Sequence
  Description of Artificial Sequence: Synthetic oligonucleotide
aactataaacagcctattggcaatgctctggacacac

SEQ ID NO: 283383 - DNA, 36 bp, Artificial Sequence
  Description of Artificial Sequence: Synthetic oligonucleotide
actataaacagcctattggcaatgctctggacacac

SEQ ID NO: 283384 - DNA, 35 bp, Artificial Sequence
  Description of Artificial Sequence: Synthetic oligonucleotide
ctataaacagcctattggcaatgctctggacacac

SEQ ID NO: 283385 - DNA, 35 bp, Artificial Sequence
  Description of Artificial Sequence: Synthetic oligonucleotide
tataaacagcctattggcaatgctctggacacacg

SEQ ID NO: 283386 - DNA, 34 bp, Artificial Sequence
  Description of Artificial Sequence: Synthetic oligonucleotide
ataaacagcctattggcaatgctctggacacacg

SEQ ID NO: 283387 - DNA, 33 bp, Artificial Sequence
  Description of Artificial Sequence: Synthetic oligonucleotide
taaacagcctattggcaatgctctggacacacg

SEQ ID NO: 283388 - DNA, 32 bp, Artificial Sequence
  Description of Artificial Sequence: Synthetic oligonucleotide
aaacagcctattggcaatgctctggacacacg

SEQ ID NO: 283389 - DNA, 31 bp, Artificial Sequence
  Description of Artificial Sequence: Synthetic oligonucleotide
aacagcctattggcaatgctctggacacacg

SEQ ID NO: 283390 - DNA, 30 bp, Artificial Sequence
  Description of Artificial Sequence: Synthetic oligonucleotide
acagcctattggcaatgctctggacacacg

SEQ ID NO: 283391 - DNA, 29 bp, Artificial Sequence
  Description of Artificial Sequence: Synthetic oligonucleotide
cagcctattggcaatgctctggacacacg

SEQ ID NO: 283392 - DNA, 31 bp, Artificial Sequence
  Description of Artificial Sequence: Synthetic oligonucleotide
agcctattggcaatgctctggacacacgaag

SEQ ID NO: 283393 - DNA, 30 bp, Artificial Sequence
  Description of Artificial Sequence: Synthetic oligonucleotide
gcctattggcaatgctctggacacacgaag

SEQ ID NO: 283394 - DNA, 31 bp, Artificial Sequence
  Description of Artificial Sequence: Synthetic oligonucleotide
cctattggcaatgctctggacacacgaagag

SEQ ID NO: 283395 - DNA, 32 bp, Artificial Sequence
  Description of Artificial Sequence: Synthetic oligonucleotide
ctattggcaatgctctggacacacgaagagtg

SEQ ID NO: 283396 - DNA, 32 bp, Artificial Sequence
  Description of Artificial Sequence: Synthetic oligonucleotide
tattggcaatgctctggacacacgaagagtgg

SEQ ID NO: 283397 - DNA, 31 bp, Artificial Sequence
  Description of Artificial Sequence: Synthetic oligonucleotide
attggcaatgctctggacacacgaagagtgg

SEQ ID NO: 283398 - DNA, 30 bp, Artificial Sequence
  Description of Artificial Sequence: Synthetic oligonucleotide
ttggcaatgctctggacacacgaagagtgg

SEQ ID NO: 283399 - DNA, 29 bp, Artificial Sequence
  Description of Artificial Sequence: Synthetic oligonucleotide
tggcaatgctctggacacacgaagagtgg

SEQ ID NO: 283400 - DNA, 28 bp, Artificial Sequence
  Description of Artificial Sequence: Synthetic oligonucleotide
ggcaatgctctggacacacgaagagtgg

SEQ ID NO: 283401 - DNA, 29 bp, Artificial Sequence
  Description of Artificial Sequence: Synthetic oligonucleotide
gcaatgctctggacacacgaagagtggac

SEQ ID NO: 283402 - DNA, 29 bp, Artificial Sequence
  Description of Artificial Sequence: Synthetic oligonucleotide
caatgctctggacacacgaagagtggacg

SEQ ID NO: 283403 - DNA, 30 bp, Artificial Sequence
  Description of Artificial Sequence: Synthetic oligonucleotide
aatgctctggacacacgaagagtggacgtc

SEQ ID NO: 283404 - DNA, 29 bp, Artificial Sequence
  Description of Artificial Sequence: Synthetic oligonucleotide
atgctctggacacacgaagagtggacgtc

SEQ ID NO: 283405 - DNA, 28 bp, Artificial Sequence
  Description of Artificial Sequence: Synthetic oligonucleotide
tgctctggacacacgaagagtggacgtc

SEQ ID NO: 283406 - DNA, 27 bp, Artificial Sequence
  Description of Artificial Sequence: Synthetic oligonucleotide
gctctggacacacgaagagtggacgtc

SEQ ID NO: 283407 - DNA, 30 bp, Artificial Sequence
  Description of Artificial Sequence: Synthetic oligonucleotide
ctctggacacacgaagagtggacgtctatg

SEQ ID NO: 283408 - DNA, 34 bp, Artificial Sequence
  Description of Artificial Sequence: Synthetic oligonucleotide
tctggacacacgaagagtggacgtctatgaaaag

SEQ ID NO: 283409 - DNA, 33 bp, Artificial Sequence
  Description of Artificial Sequence: Synthetic oligonucleotide
ctggacacacgaagagtggacgtctatgaaaag

SEQ ID NO: 283410 - DNA, 34 bp, Artificial Sequence
  Description of Artificial Sequence: Synthetic oligonucleotide
tggacacacgaagagtggacgtctatgaaaagac

SEQ ID NO: 283411 - DNA, 33 bp, Artificial Sequence
  Description of Artificial Sequence: Synthetic oligonucleotide
ggacacacgaagagtggacgtctatgaaaagac

SEQ ID NO: 283412 - DNA, 33 bp, Artificial Sequence
  Description of Artificial Sequence: Synthetic oligonucleotide
gacacacgaagagtggacgtctatgaaaagacg

SEQ ID NO: 283413 - DNA, 36 bp, Artificial Sequence
  Description of Artificial Sequence: Synthetic oligonucleotide
acacacgaagagtggacgtctatgaaaagacgatac

SEQ ID NO: 283414 - DNA, 35 bp, Artificial Sequence
  Description of Artificial Sequence: Synthetic oligonucleotide
cacacgaagagtggacgtctatgaaaagacgatac

SEQ ID NO: 283415 - DNA, 36 bp, Artificial Sequence
  Description of Artificial Sequence: Synthetic oligonucleotide
acacgaagagtggacgtctatgaaaagacgatactg

SEQ ID NO: 283416 - DNA, 35 bp, Artificial Sequence
  Description of Artificial Sequence: Synthetic oligonucleotide
cacgaagagtggacgtctatgaaaagacgatactg

SEQ ID NO: 283417 - DNA, 35 bp, Artificial Sequence
  Description of Artificial Sequence: Synthetic oligonucleotide
acgaagagtggacgtctatgaaaagacgatactgg

SEQ ID NO: 283418 - DNA, 34 bp, Artificial Sequence
  Description of Artificial Sequence: Synthetic oligonucleotide
cgaagagtggacgtctatgaaaagacgatactgg

SEQ ID NO: 283419 - DNA, 35 bp, Artificial Sequence
  Description of Artificial Sequence: Synthetic oligonucleotide
gaagagtggacgtctatgaaaagacgatactggag

SEQ ID NO: 283420 - DNA, 36 bp, Artificial Sequence
  Description of Artificial Sequence: Synthetic oligonucleotide
aagagtggacgtctatgaaaagacgatactggagac

SEQ ID NO: 283421 - DNA, 35 bp, Artificial Sequence
  Description of Artificial Sequence: Synthetic oligonucleotide
agagtggacgtctatgaaaagacgatactggagac

SEQ ID NO: 283422 - DNA, 34 bp, Artificial Sequence
  Description of Artificial Sequence: Synthetic oligonucleotide
gagtggacgtctatgaaaagacgatactggagac

SEQ ID NO: 283423 - DNA, 34 bp, Artificial Sequence
  Description of Artificial Sequence: Synthetic oligonucleotide
agtggacgtctatgaaaagacgatactggagacg

SEQ ID NO: 283424 - DNA, 33 bp, Artificial Sequence
  Description of Artificial Sequence: Synthetic oligonucleotide
gtggacgtctatgaaaagacgatactggagacg

SEQ ID NO: 283425 - DNA, 36 bp, Artificial Sequence
  Description of Artificial Sequence: Synthetic oligonucleotide
tggacgtctatgaaaagacgatactggagacgaatg

SEQ ID NO: 283426 - DNA, 35 bp, Artificial Sequence
  Description of Artificial Sequence: Synthetic oligonucleotide
ggacgtctatgaaaagacgatactggagacgaatg

SEQ ID NO: 283427 - DNA, 37 bp, Artificial Sequence
  Description of Artificial Sequence: Synthetic oligonucleotide
gacgtctatgaaaagacgatactggagacgaatgatg

SEQ ID NO: 283428 - DNA, 38 bp, Artificial Sequence
  Description of Artificial Sequence: Synthetic oligonucleotide
acgtctatgaaaagacgatactggagacgaatgatgac

SEQ ID NO: 283429 - DNA, 37 bp, Artificial Sequence
  Description of Artificial Sequence: Synthetic oligonucleotide
cgtctatgaaaagacgatactggagacgaatgatgac

SEQ ID NO: 283430 - DNA, 37 bp, Artificial Sequence
  Description of Artificial Sequence: Synthetic oligonucleotide
gtctatgaaaagacgatactggagacgaatgatgacc

SEQ ID NO: 283431 - DNA, 37 bp, Artificial Sequence
  Description of Artificial Sequence: Synthetic oligonucleotide
tctatgaaaagacgatactggagacgaatgatgaccc

SEQ ID NO: 283432 - DNA, 36 bp, Artificial Sequence
  Description of Artificial Sequence: Synthetic oligonucleotide
ctatgaaaagacgatactggagacgaatgatgaccc

SEQ ID NO: 283433 - DNA, 37 bp, Artificial Sequence
  Description of Artificial Sequence: Synthetic oligonucleotide
tatgaaaagacgatactggagacgaatgatgacccag

SEQ ID NO: 283434 - DNA, 36 bp, Artificial Sequence
  Description of Artificial Sequence: Synthetic oligonucleotide
atgaaaagacgatactggagacgaatgatgacccag

SEQ ID NO: 283435 - DNA, 35 bp, Artificial Sequence
  Description of Artificial Sequence: Synthetic oligonucleotide
tgaaaagacgatactggagacgaatgatgacccag

SEQ ID NO: 283436 - DNA, 34 bp, Artificial Sequence
  Description of Artificial Sequence: Synthetic oligonucleotide
gaaaagacgatactggagacgaatgatgacccag

SEQ ID NO: 283437 - DNA, 34 bp, Artificial Sequence
  Description of Artificial Sequence: Synthetic oligonucleotide
aaaagacgatactggagacgaatgatgacccagg

SEQ ID NO: 283438 - DNA, 33 bp, Artificial Sequence
  Description of Artificial Sequence: Synthetic oligonucleotide
aaagacgatactggagacgaatgatgacccagg

SEQ ID NO: 283439 - DNA, 32 bp, Artificial Sequence
  Description of Artificial Sequence: Synthetic oligonucleotide
aagacgatactggagacgaatgatgacccagg

SEQ ID NO: 283440 - DNA, 31 bp, Artificial Sequence
  Description of Artificial Sequence: Synthetic oligonucleotide
agacgatactggagacgaatgatgacccagg

SEQ ID NO: 283441 - DNA, 30 bp, Artificial Sequence
  Description of Artificial Sequence: Synthetic oligonucleotide
gacgatactggagacgaatgatgacccagg

SEQ ID NO: 283442 - DNA, 33 bp, Artificial Sequence
  Description of Artificial Sequence: Synthetic oligonucleotide
acgatactggagacgaatgatgacccaggaatc

SEQ ID NO: 283443 - DNA, 32 bp, Artificial Sequence
  Description of Artificial Sequence: Synthetic oligonucleotide
cgatactggagacgaatgatgacccaggaatc

SEQ ID NO: 283444 - DNA, 35 bp, Artificial Sequence
  Description of Artificial Sequence: Synthetic oligonucleotide
gatactggagacgaatgatgacccaggaatcttag

SEQ ID NO: 283445 - DNA, 35 bp, Artificial Sequence
  Description of Artificial Sequence: Synthetic oligonucleotide
atactggagacgaatgatgacccaggaatcttagc

SEQ ID NO: 283446 - DNA, 34 bp, Artificial Sequence
  Description of Artificial Sequence: Synthetic oligonucleotide
tactggagacgaatgatgacccaggaatcttagc

SEQ ID NO: 283447 - DNA, 33 bp, Artificial Sequence
  Description of Artificial Sequence: Synthetic oligonucleotide
actggagacgaatgatgacccaggaatcttagc

SEQ ID NO: 283448 - DNA, 32 bp, Artificial Sequence
  Description of Artificial Sequence: Synthetic oligonucleotide
ctggagacgaatgatgacccaggaatcttagc

SEQ ID NO: 283449 - DNA, 37 bp, Artificial Sequence
  Description of Artificial Sequence: Synthetic oligonucleotide
tggagacgaatgatgacccaggaatcttagcttattg

SEQ ID NO: 283450 - DNA, 36 bp, Artificial Sequence
  Description of Artificial Sequence: Synthetic oligonucleotide
ggagacgaatgatgacccaggaatcttagcttattg

SEQ ID NO: 283451 - DNA, 36 bp, Artificial Sequence
  Description of Artificial Sequence: Synthetic oligonucleotide
gagacgaatgatgacccaggaatcttagcttattgc

SEQ ID NO: 283452 - DNA, 36 bp, Artificial Sequence
  Description of Artificial Sequence: Synthetic oligonucleotide
agacgaatgatgacccaggaatcttagcttattgcc

SEQ ID NO: 283453 - DNA, 35 bp, Artificial Sequence
  Description of Artificial Sequence: Synthetic oligonucleotide
gacgaatgatgacccaggaatcttagcttattgcc

SEQ ID NO: 283454 - DNA, 39 bp, Artificial Sequence
  Description of Artificial Sequence: Synthetic oligonucleotide
acgaatgatgacccaggaatcttagcttattgccttaag

SEQ ID NO: 283455 - DNA, 38 bp, Artificial Sequence
  Description of Artificial Sequence: Synthetic oligonucleotide
cgaatgatgacccaggaatcttagcttattgccttaag

SEQ ID NO: 283456 - DNA, 38 bp, Artificial Sequence
  Description of Artificial Sequence: Synthetic oligonucleotide
gaatgatgacccaggaatcttagcttattgccttaagc

SEQ ID NO: 283457 - DNA, 39 bp, Artificial Sequence
  Description of Artificial Sequence: Synthetic oligonucleotide
aatgatgacccaggaatcttagcttattgccttaagcac

SEQ ID NO: 283458 - DNA, 38 bp, Artificial Sequence
  Description of Artificial Sequence: Synthetic oligonucleotide
atgatgacccaggaatcttagcttattgccttaagcac

SEQ ID NO: 283459 - DNA, 37 bp, Artificial Sequence
  Description of Artificial Sequence: Synthetic oligonucleotide
tgatgacccaggaatcttagcttattgccttaagcac

SEQ ID NO: 283460 - DNA, 36 bp, Artificial Sequence
  Description of Artificial Sequence: Synthetic oligonucleotide
gatgacccaggaatcttagcttattgccttaagcac

SEQ ID NO: 283461 - DNA, 37 bp, Artificial Sequence
  Description of Artificial Sequence: Synthetic oligonucleotide
atgacccaggaatcttagcttattgccttaagcactg

SEQ ID NO: 283462 - DNA, 36 bp, Artificial Sequence
  Description of Artificial Sequence: Synthetic oligonucleotide
tgacccaggaatcttagcttattgccttaagcactg

SEQ ID NO: 283463 - DNA, 35 bp, Artificial Sequence
  Description of Artificial Sequence: Synthetic oligonucleotide
gacccaggaatcttagcttattgccttaagcactg

SEQ ID NO: 283464 - DNA, 35 bp, Artificial Sequence
  Description of Artificial Sequence: Synthetic oligonucleotide
acccaggaatcttagcttattgccttaagcactgc

SEQ ID NO: 283465 - DNA, 34 bp, Artificial Sequence
  Description of Artificial Sequence: Synthetic oligonucleotide
cccaggaatcttagcttattgccttaagcactgc

SEQ ID NO: 283466 - DNA, 36 bp, Artificial Sequence
  Description of Artificial Sequence: Synthetic oligonucleotide
ccaggaatcttagcttattgccttaagcactgcatg

SEQ ID NO: 283467 - DNA, 37 bp, Artificial Sequence
  Description of Artificial Sequence: Synthetic oligonucleotide
caggaatcttagcttattgccttaagcactgcatgtc

SEQ ID NO: 283468 - DNA, 43 bp, Artificial Sequence
  Description of Artificial Sequence: Synthetic oligonucleotide
aggaatcttagcttattgccttaagcactgcatgtcattaatg

SEQ ID NO: 283469 - DNA, 42 bp, Artificial Sequence
  Description of Artificial Sequence: Synthetic oligonucleotide
ggaatcttagcttattgccttaagcactgcatgtcattaatg

SEQ ID NO: 283470 - DNA, 42 bp, Artificial Sequence
  Description of Artificial Sequence: Synthetic oligonucleotide
gaatcttagcttattgccttaagcactgcatgtcattaatgc

SEQ ID NO: 283471 - DNA, 43 bp, Artificial Sequence
  Description of Artificial Sequence: Synthetic oligonucleotide
aatcttagcttattgccttaagcactgcatgtcattaatgcag

SEQ ID NO: 283472 - DNA, 42 bp, Artificial Sequence
  Description of Artificial Sequence: Synthetic oligonucleotide
atcttagcttattgccttaagcactgcatgtcattaatgcag

SEQ ID NO: 283473 - DNA, 41 bp, Artificial Sequence
  Description of Artificial Sequence: Synthetic oligonucleotide
tcttagcttattgccttaagcactgcatgtcattaatgcag

SEQ ID NO: 283474 - DNA, 40 bp, Artificial Sequence
  Description of Artificial Sequence: Synthetic oligonucleotide
cttagcttattgccttaagcactgcatgtcattaatgcag

SEQ ID NO: 283475 - DNA, 46 bp, Artificial Sequence
  Description of Artificial Sequence: Synthetic oligonucleotide
ttagcttattgccttaagcactgcatgtcattaatgcagtataaac

SEQ ID NO: 283476 - DNA, 45 bp, Artificial Sequence
  Description of Artificial Sequence: Synthetic oligonucleotide
tagcttattgccttaagcactgcatgtcattaatgcagtataaac

SEQ ID NO: 283477 - DNA, 44 bp, Artificial Sequence
  Description of Artificial Sequence: Synthetic oligonucleotide
agcttattgccttaagcactgcatgtcattaatgcagtataaac

SEQ ID NO: 283478 - DNA, 43 bp, Artificial Sequence
  Description of Artificial Sequence: Synthetic oligonucleotide
gcttattgccttaagcactgcatgtcattaatgcagtataaac

SEQ ID NO: 283479 - DNA, 44 bp, Artificial Sequence
  Description of Artificial Sequence: Synthetic oligonucleotide
cttattgccttaagcactgcatgtcattaatgcagtataaacag

SEQ ID NO: 283480 - DNA, 47 bp, Artificial Sequence
  Description of Artificial Sequence: Synthetic oligonucleotide
ttattgccttaagcactgcatgtcattaatgcagtataaacagtatc

SEQ ID NO: 283481 - DNA, 46 bp, Artificial Sequence
  Description of Artificial Sequence: Synthetic oligonucleotide
tattgccttaagcactgcatgtcattaatgcagtataaacagtatc

SEQ ID NO: 283482 - DNA, 45 bp, Artificial Sequence
  Description of Artificial Sequence: Synthetic oligonucleotide
attgccttaagcactgcatgtcattaatgcagtataaacagtatc

SEQ ID NO: 283483 - DNA, 44 bp, Artificial Sequence
  Description of Artificial Sequence: Synthetic oligonucleotide
ttgccttaagcactgcatgtcattaatgcagtataaacagtatc

SEQ ID NO: 283484 - DNA, 43 bp, Artificial Sequence
  Description of Artificial Sequence: Synthetic oligonucleotide
tgccttaagcactgcatgtcattaatgcagtataaacagtatc

SEQ ID NO: 283485 - DNA, 42 bp, Artificial Sequence
  Description of Artificial Sequence: Synthetic oligonucleotide
gccttaagcactgcatgtcattaatgcagtataaacagtatc

SEQ ID NO: 283486 - DNA, 42 bp, Artificial Sequence
  Description of Artificial Sequence: Synthetic oligonucleotide
ccttaagcactgcatgtcattaatgcagtataaacagtatcg

SEQ ID NO: 283487 - DNA, 42 bp, Artificial Sequence
  Description of Artificial Sequence: Synthetic oligonucleotide
cttaagcactgcatgtcattaatgcagtataaacagtatcgg

SEQ ID NO: 283488 - DNA, 48 bp, Artificial Sequence
  Description of Artificial Sequence: Synthetic oligonucleotide
ttaagcactgcatgtcattaatgcagtataaacagtatcggaataatg

SEQ ID NO: 283489 - DNA, 47 bp, Artificial Sequence
  Description of Artificial Sequence: Synthetic oligonucleotide
taagcactgcatgtcattaatgcagtataaacagtatcggaataatg

SEQ ID NO: 283490 - DNA, 46 bp, Artificial Sequence
  Description of Artificial Sequence: Synthetic oligonucleotide
aagcactgcatgtcattaatgcagtataaacagtatcggaataatg

SEQ ID NO: 283491 - DNA, 45 bp, Artificial Sequence
  Description of Artificial Sequence: Synthetic oligonucleotide
agcactgcatgtcattaatgcagtataaacagtatcggaataatg

SEQ ID NO: 283492 - DNA, 44 bp, Artificial Sequence
  Description of Artificial Sequence: Synthetic oligonucleotide
gcactgcatgtcattaatgcagtataaacagtatcggaataatg

SEQ ID NO: 283493 - DNA, 46 bp, Artificial Sequence
  Description of Artificial Sequence: Synthetic oligonucleotide
cactgcatgtcattaatgcagtataaacagtatcggaataatgtac

SEQ ID NO: 283494 - DNA, 49 bp, Artificial Sequence
  Description of Artificial Sequence: Synthetic oligonucleotide
actgcatgtcattaatgcagtataaacagtatcggaataatgtactaag

SEQ ID NO: 283495 - DNA, 48 bp, Artificial Sequence
  Description of Artificial Sequence: Synthetic oligonucleotide
ctgcatgtcattaatgcagtataaacagtatcggaataatgtactaag

SEQ ID NO: 283496 - DNA, 49 bp, Artificial Sequence
  Description of Artificial Sequence: Synthetic oligonucleotide
tgcatgtcattaatgcagtataaacagtatcggaataatgtactaagac

SEQ ID NO: 283497 - DNA, 48 bp, Artificial Sequence
  Description of Artificial Sequence: Synthetic oligonucleotide
gcatgtcattaatgcagtataaacagtatcggaataatgtactaagac

SEQ ID NO: 283498 - DNA, 50 bp, Artificial Sequence
  Description of Artificial Sequence: Synthetic oligonucleotide
catgtcattaatgcagtataaacagtatcggaataatgtactaagacttc

SEQ ID NO: 283499 - DNA, 52 bp, Artificial Sequence
  Description of Artificial Sequence: Synthetic oligonucleotide
atgtcattaatgcagtataaacagtatcggaataatgtactaagacttctag

SEQ ID NO: 283500 - DNA, 51 bp, Artificial Sequence
  Description of Artificial Sequence: Synthetic oligonucleotide
tgtcattaatgcagtataaacagtatcggaataatgtactaagacttctag

SEQ ID NO: 283501 - DNA, 50 bp, Artificial Sequence
  Description of Artificial Sequence: Synthetic oligonucleotide
gtcattaatgcagtataaacagtatcggaataatgtactaagacttctag

SEQ ID NO: 283502 - DNA, 57 bp, Artificial Sequence
  Description of Artificial Sequence: Synthetic oligonucleotide
tcattaatgcagtataaacagtatcggaataatgtactaagacttctagttataatc

SEQ ID NO: 283503 - DNA, 56 bp, Artificial Sequence
  Description of Artificial Sequence: Synthetic oligonucleotide
cattaatgcagtataaacagtatcggaataatgtactaagacttctagttataatc

SEQ ID NO: 283504 - DNA, 58 bp, Artificial Sequence
  Description of Artificial Sequence: Synthetic oligonucleotide
attaatgcagtataaacagtatcggaataatgtactaagacttctagttataatctac

SEQ ID NO: 283505 - DNA, 57 bp, Artificial Sequence
  Description of Artificial Sequence: Synthetic oligonucleotide
ttaatgcagtataaacagtatcggaataatgtactaagacttctagttataatctac

SEQ ID NO: 283506 - DNA, 56 bp, Artificial Sequence
  Description of Artificial Sequence: Synthetic oligonucleotide
taatgcagtataaacagtatcggaataatgtactaagacttctagttataatctac

SEQ ID NO: 283507 - DNA, 55 bp, Artificial Sequence
  Description of Artificial Sequence: Synthetic oligonucleotide
aatgcagtataaacagtatcggaataatgtactaagacttctagttataatctac

SEQ ID NO: 283508 - DNA, 54 bp, Artificial Sequence
  Description of Artificial Sequence: Synthetic oligonucleotide
atgcagtataaacagtatcggaataatgtactaagacttctagttataatctac

SEQ ID NO: 283509 - DNA, 53 bp, Artificial Sequence
  Description of Artificial Sequence: Synthetic oligonucleotide
tgcagtataaacagtatcggaataatgtactaagacttctagttataatctac

SEQ ID NO: 283510 - DNA, 52 bp, Artificial Sequence
  Description of Artificial Sequence: Synthetic oligonucleotide
gcagtataaacagtatcggaataatgtactaagacttctagttataatctac

SEQ ID NO: 283511 - DNA, 54 bp, Artificial Sequence
  Description of Artificial Sequence: Synthetic oligonucleotide
cagtataaacagtatcggaataatgtactaagacttctagttataatctacatc

SEQ ID NO: 283512 - DNA, 56 bp, Artificial Sequence
  Description of Artificial Sequence: Synthetic oligonucleotide
agtataaacagtatcggaataatgtactaagacttctagttataatctacatcaac

SEQ ID NO: 283513 - DNA, 55 bp, Artificial Sequence
  Description of Artificial Sequence: Synthetic oligonucleotide
gtataaacagtatcggaataatgtactaagacttctagttataatctacatcaac

SEQ ID NO: 283514 - DNA, 57 bp, Artificial Sequence
  Description of Artificial Sequence: Synthetic oligonucleotide
tataaacagtatcggaataatgtactaagacttctagttataatctacatcaacttg

SEQ ID NO: 283515 - DNA, 56 bp, Artificial Sequence
  Description of Artificial Sequence: Synthetic oligonucleotide
ataaacagtatcggaataatgtactaagacttctagttataatctacatcaacttg

SEQ ID NO: 283516 - DNA, 55 bp, Artificial Sequence
  Description of Artificial Sequence: Synthetic oligonucleotide
taaacagtatcggaataatgtactaagacttctagttataatctacatcaacttg

SEQ ID NO: 283517 - DNA, 54 bp, Artificial Sequence
  Description of Artificial Sequence: Synthetic oligonucleotide
aaacagtatcggaataatgtactaagacttctagttataatctacatcaacttg

SEQ ID NO: 283518 - DNA, 53 bp, Artificial Sequence
  Description of Artificial Sequence: Synthetic oligonucleotide
aacagtatcggaataatgtactaagacttctagttataatctacatcaacttg

SEQ ID NO: 283519 - DNA, 52 bp, Artificial Sequence
  Description of Artificial Sequence: Synthetic oligonucleotide
acagtatcggaataatgtactaagacttctagttataatctacatcaacttg

SEQ ID NO: 283520 - DNA, 51 bp, Artificial Sequence
  Description of Artificial Sequence: Synthetic oligonucleotide
cagtatcggaataatgtactaagacttctagttataatctacatcaacttg

SEQ ID NO: 283521 - DNA, 51 bp, Artificial Sequence
  Description of Artificial Sequence: Synthetic oligonucleotide
agtatcggaataatgtactaagacttctagttataatctacatcaacttgg

SEQ ID NO: 283522 - DNA, 50 bp, Artificial Sequence
  Description of Artificial Sequence: Synthetic oligonucleotide
gtatcggaataatgtactaagacttctagttataatctacatcaacttgg

SEQ ID NO: 283523 - DNA, 51 bp, Artificial Sequence
  Description of Artificial Sequence: Synthetic oligonucleotide
tatcggaataatgtactaagacttctagttataatctacatcaacttggag

SEQ ID NO: 283524 - DNA, 50 bp, Artificial Sequence
  Description of Artificial Sequence: Synthetic oligonucleotide
atcggaataatgtactaagacttctagttataatctacatcaacttggag

SEQ ID NO: 283525 - DNA, 49 bp, Artificial Sequence
  Description of Artificial Sequence: Synthetic oligonucleotide
tcggaataatgtactaagacttctagttataatctacatcaacttggag

SEQ ID NO: 283526 - DNA, 48 bp, Artificial Sequence
  Description of Artificial Sequence: Synthetic oligonucleotide
cggaataatgtactaagacttctagttataatctacatcaacttggag

SEQ ID NO: 283527 - DNA, 51 bp, Artificial Sequence
  Description of Artificial Sequence: Synthetic oligonucleotide
ggaataatgtactaagacttctagttataatctacatcaacttggagtaac

SEQ ID NO: 283528 - DNA, 51 bp, Artificial Sequence
  Description of Artificial Sequence: Synthetic oligonucleotide
gaataatgtactaagacttctagttataatctacatcaacttggagtaacc

SEQ ID NO: 283529 - DNA, 52 bp, Artificial Sequence
  Description of Artificial Sequence: Synthetic oligonucleotide
aataatgtactaagacttctagttataatctacatcaacttggagtaacctg

SEQ ID NO: 283530 - DNA, 51 bp, Artificial Sequence
  Description of Artificial Sequence: Synthetic oligonucleotide
ataatgtactaagacttctagttataatctacatcaacttggagtaacctg

SEQ ID NO: 283531 - DNA, 50 bp, Artificial Sequence
  Description of Artificial Sequence: Synthetic oligonucleotide
taatgtactaagacttctagttataatctacatcaacttggagtaacctg

SEQ ID NO: 283532 - DNA, 49 bp, Artificial Sequence
  Description of Artificial Sequence: Synthetic oligonucleotide
aatgtactaagacttctagttataatctacatcaacttggagtaacctg

SEQ ID NO: 283533 - DNA, 48 bp, Artificial Sequence
  Description of Artificial Sequence: Synthetic oligonucleotide
atgtactaagacttctagttataatctacatcaacttggagtaacctg

SEQ ID NO: 283534 - DNA, 47 bp, Artificial Sequence
  Description of Artificial Sequence: Synthetic oligonucleotide
tgtactaagacttctagttataatctacatcaacttggagtaacctg

SEQ ID NO: 283535 - DNA, 46 bp, Artificial Sequence
  Description of Artificial Sequence: Synthetic oligonucleotide
gtactaagacttctagttataatctacatcaacttggagtaacctg

SEQ ID NO: 283536 - DNA, 50 bp, Artificial Sequence
  Description of Artificial Sequence: Synthetic oligonucleotide
tactaagacttctagttataatctacatcaacttggagtaacctgattac

SEQ ID NO: 283537 - DNA, 49 bp, Artificial Sequence
  Description of Artificial Sequence: Synthetic oligonucleotide
actaagacttctagttataatctacatcaacttggagtaacctgattac

SEQ ID NO: 283538 - DNA, 48 bp, Artificial Sequence
  Description of Artificial Sequence: Synthetic oligonucleotide
ctaagacttctagttataatctacatcaacttggagtaacctgattac

SEQ ID NO: 283539 - DNA, 50 bp, Artificial Sequence
  Description of Artificial Sequence: Synthetic oligonucleotide
taagacttctagttataatctacatcaacttggagtaacctgattacatc

SEQ ID NO: 283540 - DNA, 49 bp, Artificial Sequence
  Description of Artificial Sequence: Synthetic oligonucleotide
aagacttctagttataatctacatcaacttggagtaacctgattacatc

SEQ ID NO: 283541 - DNA, 48 bp, Artificial Sequence
  Description of Artificial Sequence: Synthetic oligonucleotide
agacttctagttataatctacatcaacttggagtaacctgattacatc

SEQ ID NO: 283542 - DNA, 47 bp, Artificial Sequence
  Description of Artificial Sequence: Synthetic oligonucleotide
gacttctagttataatctacatcaacttggagtaacctgattacatc

SEQ ID NO: 283543 - DNA, 50 bp, Artificial Sequence
  Description of Artificial Sequence: Synthetic oligonucleotide
acttctagttataatctacatcaacttggagtaacctgattacatcaatg

SEQ ID NO: 283544 - DNA, 49 bp, Artificial Sequence
  Description of Artificial Sequence: Synthetic oligonucleotide
cttctagttataatctacatcaacttggagtaacctgattacatcaatg

SEQ ID NO: 283545 - DNA, 52 bp, Artificial Sequence
  Description of Artificial Sequence: Synthetic oligonucleotide
ttctagttataatctacatcaacttggagtaacctgattacatcaatgtatg

SEQ ID NO: 283546 - DNA, 51 bp, Artificial Sequence
  Description of Artificial Sequence: Synthetic oligonucleotide
tctagttataatctacatcaacttggagtaacctgattacatcaatgtatg

SEQ ID NO: 283547 - DNA, 50 bp, Artificial Sequence
  Description of Artificial Sequence: Synthetic oligonucleotide
ctagttataatctacatcaacttggagtaacctgattacatcaatgtatg

SEQ ID NO: 283548 - DNA, 51 bp, Artificial Sequence
  Description of Artificial Sequence: Synthetic oligonucleotide
tagttataatctacatcaacttggagtaacctgattacatcaatgtatgtc

SEQ ID NO: 283549 - DNA, 50 bp, Artificial Sequence
  Description of Artificial Sequence: Synthetic oligonucleotide
agttataatctacatcaacttggagtaacctgattacatcaatgtatgtc

SEQ ID NO: 283550 - DNA, 49 bp, Artificial Sequence
  Description of Artificial Sequence: Synthetic oligonucleotide
gttataatctacatcaacttggagtaacctgattacatcaatgtatgtc

SEQ ID NO: 283551 - DNA, 50 bp, Artificial Sequence
  Description of Artificial Sequence: Synthetic oligonucleotide
ttataatctacatcaacttggagtaacctgattacatcaatgtatgtcag

SEQ ID NO: 283552 - DNA, 49 bp, Artificial Sequence
  Description of Artificial Sequence: Synthetic oligonucleotide
tataatctacatcaacttggagtaacctgattacatcaatgtatgtcag

SEQ ID NO: 283553 - DNA, 48 bp, Artificial Sequence
  Description of Artificial Sequence: Synthetic oligonucleotide
ataatctacatcaacttggagtaacctgattacatcaatgtatgtcag

SEQ ID NO: 283554 - DNA, 47 bp, Artificial Sequence
  Description of Artificial Sequence: Synthetic oligonucleotide
taatctacatcaacttggagtaacctgattacatcaatgtatgtcag

SEQ ID NO: 283555 - DNA, 46 bp, Artificial Sequence
  Description of Artificial Sequence: Synthetic oligonucleotide
aatctacatcaacttggagtaacctgattacatcaatgtatgtcag

SEQ ID NO: 283556 - DNA, 45 bp, Artificial Sequence
  Description of Artificial Sequence: Synthetic oligonucleotide
atctacatcaacttggagtaacctgattacatcaatgtatgtcag

SEQ ID NO: 283557 - DNA, 44 bp, Artificial Sequence
  Description of Artificial Sequence: Synthetic oligonucleotide
tctacatcaacttggagtaacctgattacatcaatgtatgtcag

SEQ ID NO: 283558 - DNA, 43 bp, Artificial Sequence
  Description of Artificial Sequence: Synthetic oligonucleotide
ctacatcaacttggagtaacctgattacatcaatgtatgtcag

SEQ ID NO: 283559 - DNA, 44 bp, Artificial Sequence
  Description of Artificial Sequence: Synthetic oligonucleotide
tacatcaacttggagtaacctgattacatcaatgtatgtcagtg

SEQ ID NO: 283560 - DNA, 43 bp, Artificial Sequence
  Description of Artificial Sequence: Synthetic oligonucleotide
acatcaacttggagtaacctgattacatcaatgtatgtcagtg

SEQ ID NO: 283561 - DNA, 42 bp, Artificial Sequence
  Description of Artificial Sequence: Synthetic oligonucleotide
catcaacttggagtaacctgattacatcaatgtatgtcagtg

SEQ ID NO: 283562 - DNA, 42 bp, Artificial Sequence
  Description of Artificial Sequence: Synthetic oligonucleotide
atcaacttggagtaacctgattacatcaatgtatgtcagtgc

SEQ ID NO: 283563 - DNA, 41 bp, Artificial Sequence
  Description of Artificial Sequence: Synthetic oligonucleotide
tcaacttggagtaacctgattacatcaatgtatgtcagtgc

SEQ ID NO: 283564 - DNA, 40 bp, Artificial Sequence
  Description of Artificial Sequence: Synthetic oligonucleotide
caacttggagtaacctgattacatcaatgtatgtcagtgc

SEQ ID NO: 283565 - DNA, 48 bp, Artificial Sequence
  Description of Artificial Sequence: Synthetic oligonucleotide
aacttggagtaacctgattacatcaatgtatgtcagtgcataattttc

SEQ ID NO: 283566 - DNA, 47 bp, Artificial Sequence
  Description of Artificial Sequence: Synthetic oligonucleotide
acttggagtaacctgattacatcaatgtatgtcagtgcataattttc

SEQ ID NO: 283567 - DNA, 46 bp, Artificial Sequence
  Description of Artificial Sequence: Synthetic oligonucleotide
cttggagtaacctgattacatcaatgtatgtcagtgcataattttc

SEQ ID NO: 283568 - DNA, 49 bp, Artificial Sequence
  Description of Artificial Sequence: Synthetic oligonucleotide
ttggagtaacctgattacatcaatgtatgtcagtgcataattttctaag

SEQ ID NO: 283569 - DNA, 48 bp, Artificial Sequence
  Description of Artificial Sequence: Synthetic oligonucleotide
tggagtaacctgattacatcaatgtatgtcagtgcataattttctaag

SEQ ID NO: 283570 - DNA, 47 bp, Artificial Sequence
  Description of Artificial Sequence: Synthetic oligonucleotide
ggagtaacctgattacatcaatgtatgtcagtgcataattttctaag

SEQ ID NO: 283571 - DNA, 49 bp, Artificial Sequence
  Description of Artificial Sequence: Synthetic oligonucleotide
gagtaacctgattacatcaatgtatgtcagtgcataattttctaagatg

SEQ ID NO: 283572 - DNA, 51 bp, Artificial Sequence
  Description of Artificial Sequence: Synthetic oligonucleotide
agtaacctgattacatcaatgtatgtcagtgcataattttctaagatgatc

SEQ ID NO: 283573 - DNA, 50 bp, Artificial Sequence
  Description of Artificial Sequence: Synthetic oligonucleotide
gtaacctgattacatcaatgtatgtcagtgcataattttctaagatgatc

SEQ ID NO: 283574 - DNA, 50 bp, Artificial Sequence
  Description of Artificial Sequence: Synthetic oligonucleotide
taacctgattacatcaatgtatgtcagtgcataattttctaagatgatcc

SEQ ID NO: 283575 - DNA, 49 bp, Artificial Sequence
  Description of Artificial Sequence: Synthetic oligonucleotide
aacctgattacatcaatgtatgtcagtgcataattttctaagatgatcc

SEQ ID NO: 283576 - DNA, 48 bp, Artificial Sequence
  Description of Artificial Sequence: Synthetic oligonucleotide
acctgattacatcaatgtatgtcagtgcataattttctaagatgatcc

SEQ ID NO: 283577 - DNA, 47 bp, Artificial Sequence
  Description of Artificial Sequence: Synthetic oligonucleotide
cctgattacatcaatgtatgtcagtgcataattttctaagatgatcc

SEQ ID NO: 283578 - DNA, 48 bp, Artificial Sequence
  Description of Artificial Sequence: Synthetic oligonucleotide
ctgattacatcaatgtatgtcagtgcataattttctaagatgatccac

SEQ ID NO: 283579 - DNA, 49 bp, Artificial Sequence
  Description of Artificial Sequence: Synthetic oligonucleotide
tgattacatcaatgtatgtcagtgcataattttctaagatgatccacag

SEQ ID NO: 283580 - DNA, 48 bp, Artificial Sequence
  Description of Artificial Sequence: Synthetic oligonucleotide
gattacatcaatgtatgtcagtgcataattttctaagatgatccacag

SEQ ID NO: 283581 - DNA, 48 bp, Artificial Sequence
  Description of Artificial Sequence: Synthetic oligonucleotide
attacatcaatgtatgtcagtgcataattttctaagatgatccacagg

SEQ ID NO: 283582 - DNA, 47 bp, Artificial Sequence
  Description of Artificial Sequence: Synthetic oligonucleotide
ttacatcaatgtatgtcagtgcataattttctaagatgatccacagg

SEQ ID NO: 283583 - DNA, 46 bp, Artificial Sequence
  Description of Artificial Sequence: Synthetic oligonucleotide
tacatcaatgtatgtcagtgcataattttctaagatgatccacagg

SEQ ID NO: 283584 - DNA, 45 bp, Artificial Sequence
  Description of Artificial Sequence: Synthetic oligonucleotide
acatcaatgtatgtcagtgcataattttctaagatgatccacagg

SEQ ID NO: 283585 - DNA, 44 bp, Artificial Sequence
  Description of Artificial Sequence: Synthetic oligonucleotide
catcaatgtatgtcagtgcataattttctaagatgatccacagg

SEQ ID NO: 283586 - DNA, 44 bp, Artificial Sequence
  Description of Artificial Sequence: Synthetic oligonucleotide
atcaatgtatgtcagtgcataattttctaagatgatccacaggc

SEQ ID NO: 283587 - DNA, 43 bp, Artificial Sequence
  Description of Artificial Sequence: Synthetic oligonucleotide
tcaatgtatgtcagtgcataattttctaagatgatccacaggc

SEQ ID NO: 283588 - DNA, 42 bp, Artificial Sequence
  Description of Artificial Sequence: Synthetic oligonucleotide
caatgtatgtcagtgcataattttctaagatgatccacaggc

SEQ ID NO: 283589 - DNA, 43 bp, Artificial Sequence
  Description of Artificial Sequence: Synthetic oligonucleotide
aatgtatgtcagtgcataattttctaagatgatccacaggctg

SEQ ID NO: 283590 - DNA, 42 bp, Artificial Sequence
  Description of Artificial Sequence: Synthetic oligonucleotide
atgtatgtcagtgcataattttctaagatgatccacaggctg

SEQ ID NO: 283591 - DNA, 41 bp, Artificial Sequence
  Description of Artificial Sequence: Synthetic oligonucleotide
tgtatgtcagtgcataattttctaagatgatccacaggctg

SEQ ID NO: 283592 - DNA, 40 bp, Artificial Sequence
  Description of Artificial Sequence: Synthetic oligonucleotide
gtatgtcagtgcataattttctaagatgatccacaggctg

SEQ ID NO: 283593 - DNA, 41 bp, Artificial Sequence
  Description of Artificial Sequence: Synthetic oligonucleotide
tatgtcagtgcataattttctaagatgatccacaggctgtg

SEQ ID NO: 283594 - DNA, 40 bp, Artificial Sequence
  Description of Artificial Sequence: Synthetic oligonucleotide
atgtcagtgcataattttctaagatgatccacaggctgtg

SEQ ID NO: 283595 - DNA, 39 bp, Artificial Sequence
  Description of Artificial Sequence: Synthetic oligonucleotide
tgtcagtgcataattttctaagatgatccacaggctgtg

SEQ ID NO: 283596 - DNA, 38 bp, Artificial Sequence
  Description of Artificial Sequence: Synthetic oligonucleotide
gtcagtgcataattttctaagatgatccacaggctgtg

SEQ ID NO: 283597 - DNA, 39 bp, Artificial Sequence
  Description of Artificial Sequence: Synthetic oligonucleotide
tcagtgcataattttctaagatgatccacaggctgtgtg

SEQ ID NO: 283598 - DNA, 38 bp, Artificial Sequence
  Description of Artificial Sequence: Synthetic oligonucleotide
cagtgcataattttctaagatgatccacaggctgtgtg

SEQ ID NO: 283599 - DNA, 39 bp, Artificial Sequence
  Description of Artificial Sequence: Synthetic oligonucleotide
agtgcataattttctaagatgatccacaggctgtgtgtg

SEQ ID NO: 283600 - DNA, 38 bp, Artificial Sequence
  Description of Artificial Sequence: Synthetic oligonucleotide
gtgcataattttctaagatgatccacaggctgtgtgtg

SEQ ID NO: 283601 - DNA, 42 bp, Artificial Sequence
  Description of Artificial Sequence: Synthetic oligonucleotide
tgcataattttctaagatgatccacaggctgtgtgtgatatc

SEQ ID NO: 283602 - DNA, 41 bp, Artificial Sequence
  Description of Artificial Sequence: Synthetic oligonucleotide
gcataattttctaagatgatccacaggctgtgtgtgatatc

SEQ ID NO: 283603 - DNA, 44 bp, Artificial Sequence
  Description of Artificial Sequence: Synthetic oligonucleotide
cataattttctaagatgatccacaggctgtgtgtgatatctaag

SEQ ID NO: 283604 - DNA, 45 bp, Artificial Sequence
  Description of Artificial Sequence: Synthetic oligonucleotide
ataattttctaagatgatccacaggctgtgtgtgatatctaagag

SEQ ID NO: 283605 - DNA, 44 bp, Artificial Sequence
  Description of Artificial Sequence: Synthetic oligonucleotide
taattttctaagatgatccacaggctgtgtgtgatatctaagag

SEQ ID NO: 283606 - DNA, 43 bp, Artificial Sequence
  Description of Artificial Sequence: Synthetic oligonucleotide
aattttctaagatgatccacaggctgtgtgtgatatctaagag

SEQ ID NO: 283607 - DNA, 42 bp, Artificial Sequence
  Description of Artificial Sequence: Synthetic oligonucleotide
attttctaagatgatccacaggctgtgtgtgatatctaagag

SEQ ID NO: 283608 - DNA, 41 bp, Artificial Sequence
  Description of Artificial Sequence: Synthetic oligonucleotide
ttttctaagatgatccacaggctgtgtgtgatatctaagag

SEQ ID NO: 283609 - DNA, 40 bp, Artificial Sequence
  Description of Artificial Sequence: Synthetic oligonucleotide
tttctaagatgatccacaggctgtgtgtgatatctaagag

SEQ ID NO: 283610 - DNA, 39 bp, Artificial Sequence
  Description of Artificial Sequence: Synthetic oligonucleotide
ttctaagatgatccacaggctgtgtgtgatatctaagag

SEQ ID NO: 283611 - DNA, 38 bp, Artificial Sequence
  Description of Artificial Sequence: Synthetic oligonucleotide
tctaagatgatccacaggctgtgtgtgatatctaagag

SEQ ID NO: 283612 - DNA, 37 bp, Artificial Sequence
  Description of Artificial Sequence: Synthetic oligonucleotide
ctaagatgatccacaggctgtgtgtgatatctaagag

SEQ ID NO: 283613 - DNA, 40 bp, Artificial Sequence
  Description of Artificial Sequence: Synthetic oligonucleotide
taagatgatccacaggctgtgtgtgatatctaagagaaac

SEQ ID NO: 283614 - DNA, 39 bp, Artificial Sequence
  Description of Artificial Sequence: Synthetic oligonucleotide
aagatgatccacaggctgtgtgtgatatctaagagaaac

SEQ ID NO: 283615 - DNA, 38 bp, Artificial Sequence
  Description of Artificial Sequence: Synthetic oligonucleotide
agatgatccacaggctgtgtgtgatatctaagagaaac

SEQ ID NO: 283616 - DNA, 37 bp, Artificial Sequence
  Description of Artificial Sequence: Synthetic oligonucleotide
gatgatccacaggctgtgtgtgatatctaagagaaac

SEQ ID NO: 283617 - DNA, 38 bp, Artificial Sequence
  Description of Artificial Sequence: Synthetic oligonucleotide
atgatccacaggctgtgtgtgatatctaagagaaactc

SEQ ID NO: 283618 - DNA, 37 bp, Artificial Sequence
  Description of Artificial Sequence: Synthetic oligonucleotide
tgatccacaggctgtgtgtgatatctaagagaaactc

SEQ ID NO: 283619 - DNA, 36 bp, Artificial Sequence
  Description of Artificial Sequence: Synthetic oligonucleotide
gatccacaggctgtgtgtgatatctaagagaaactc

SEQ ID NO: 283620 - DNA, 36 bp, Artificial Sequence
  Description of Artificial Sequence: Synthetic oligonucleotide
atccacaggctgtgtgtgatatctaagagaaactcg

SEQ ID NO: 283621 - DNA, 35 bp, Artificial Sequence
  Description of Artificial Sequence: Synthetic oligonucleotide
tccacaggctgtgtgtgatatctaagagaaactcg

SEQ ID NO: 283622 - DNA, 34 bp, Artificial Sequence
  Description of Artificial Sequence: Synthetic oligonucleotide
ccacaggctgtgtgtgatatctaagagaaactcg

SEQ ID NO: 283623 - DNA, 38 bp, Artificial Sequence
  Description of Artificial Sequence: Synthetic oligonucleotide
cacaggctgtgtgtgatatctaagagaaactcgtaaag

SEQ ID NO: 283624 - DNA, 38 bp, Artificial Sequence
  Description of Artificial Sequence: Synthetic oligonucleotide
acaggctgtgtgtgatatctaagagaaactcgtaaagg

SEQ ID NO: 283625 - DNA, 37 bp, Artificial Sequence
  Description of Artificial Sequence: Synthetic oligonucleotide
caggctgtgtgtgatatctaagagaaactcgtaaagg

SEQ ID NO: 283626 - DNA, 39 bp, Artificial Sequence
  Description of Artificial Sequence: Synthetic oligonucleotide
aggctgtgtgtgatatctaagagaaactcgtaaaggaac

SEQ ID NO: 283627 - DNA, 38 bp, Artificial Sequence
  Description of Artificial Sequence: Synthetic oligonucleotide
ggctgtgtgtgatatctaagagaaactcgtaaaggaac

SEQ ID NO: 283628 - DNA, 39 bp, Artificial Sequence
  Description of Artificial Sequence: Synthetic oligonucleotide
gctgtgtgtgatatctaagagaaactcgtaaaggaacac

SEQ ID NO: 283629 - DNA, 41 bp, Artificial Sequence
  Description of Artificial Sequence: Synthetic oligonucleotide
ctgtgtgtgatatctaagagaaactcgtaaaggaacacaac

SEQ ID NO: 283630 - DNA, 41 bp, Artificial Sequence
  Description of Artificial Sequence: Synthetic oligonucleotide
tgtgtgtgatatctaagagaaactcgtaaaggaacacaacc

SEQ ID NO: 283631 - DNA, 40 bp, Artificial Sequence
  Description of Artificial Sequence: Synthetic oligonucleotide
gtgtgtgatatctaagagaaactcgtaaaggaacacaacc

SEQ ID NO: 283632 - DNA, 41 bp, Artificial Sequence
  Description of Artificial Sequence: Synthetic oligonucleotide
tgtgtgatatctaagagaaactcgtaaaggaacacaacctc

SEQ ID NO: 283633 - DNA, 40 bp, Artificial Sequence
  Description of Artificial Sequence: Synthetic oligonucleotide
gtgtgatatctaagagaaactcgtaaaggaacacaacctc

SEQ ID NO: 283634 - DNA, 40 bp, Artificial Sequence
  Description of Artificial Sequence: Synthetic oligonucleotide
tgtgatatctaagagaaactcgtaaaggaacacaacctcc

SEQ ID NO: 283635 - DNA, 39 bp, Artificial Sequence
  Description of Artificial Sequence: Synthetic oligonucleotide
gtgatatctaagagaaactcgtaaaggaacacaacctcc

SEQ ID NO: 283636 - DNA, 40 bp, Artificial Sequence
  Description of Artificial Sequence: Synthetic oligonucleotide
tgatatctaagagaaactcgtaaaggaacacaacctccag

SEQ ID NO: 283637 - DNA, 39 bp, Artificial Sequence
  Description of Artificial Sequence: Synthetic oligonucleotide
gatatctaagagaaactcgtaaaggaacacaacctccag

SEQ ID NO: 283638 - DNA, 41 bp, Artificial Sequence
  Description of Artificial Sequence: Synthetic oligonucleotide
atatctaagagaaactcgtaaaggaacacaacctccagatg

SEQ ID NO: 283639 - DNA, 40 bp, Artificial Sequence
  Description of Artificial Sequence: Synthetic oligonucleotide
tatctaagagaaactcgtaaaggaacacaacctccagatg

SEQ ID NO: 283640 - DNA, 39 bp, Artificial Sequence
  Description of Artificial Sequence: Synthetic oligonucleotide
atctaagagaaactcgtaaaggaacacaacctccagatg

SEQ ID NO: 283641 - DNA, 38 bp, Artificial Sequence
  Description of Artificial Sequence: Synthetic oligonucleotide
tctaagagaaactcgtaaaggaacacaacctccagatg

SEQ ID NO: 283642 - DNA, 37 bp, Artificial Sequence
  Description of Artificial Sequence: Synthetic oligonucleotide
ctaagagaaactcgtaaaggaacacaacctccagatg

SEQ ID NO: 283643 - DNA, 37 bp, Artificial Sequence
  Description of Artificial Sequence: Synthetic oligonucleotide
taagagaaactcgtaaaggaacacaacctccagatgg

SEQ ID NO: 283644 - DNA, 36 bp, Artificial Sequence
  Description of Artificial Sequence: Synthetic oligonucleotide
aagagaaactcgtaaaggaacacaacctccagatgg

SEQ ID NO: 283645 - DNA, 35 bp, Artificial Sequence
  Description of Artificial Sequence: Synthetic oligonucleotide
agagaaactcgtaaaggaacacaacctccagatgg

SEQ ID NO: 283646 - DNA, 34 bp, Artificial Sequence
  Description of Artificial Sequence: Synthetic oligonucleotide
gagaaactcgtaaaggaacacaacctccagatgg

SEQ ID NO: 283647 - DNA, 34 bp, Artificial Sequence
  Description of Artificial Sequence: Synthetic oligonucleotide
agaaactcgtaaaggaacacaacctccagatggc

SEQ ID NO: 283648 - DNA, 33 bp, Artificial Sequence
  Description of Artificial Sequence: Synthetic oligonucleotide
gaaactcgtaaaggaacacaacctccagatggc

SEQ ID NO: 283649 - DNA, 37 bp, Artificial Sequence
  Description of Artificial Sequence: Synthetic oligonucleotide
aaactcgtaaaggaacacaacctccagatggcataac

SEQ ID NO: 283650 - DNA, 36 bp, Artificial Sequence
  Description of Artificial Sequence: Synthetic oligonucleotide
aactcgtaaaggaacacaacctccagatggcataac

SEQ ID NO: 283651 - DNA, 35 bp, Artificial Sequence
  Description of Artificial Sequence: Synthetic oligonucleotide
actcgtaaaggaacacaacctccagatggcataac

SEQ ID NO: 283652 - DNA, 34 bp, Artificial Sequence
  Description of Artificial Sequence: Synthetic oligonucleotide
ctcgtaaaggaacacaacctccagatggcataac

SEQ ID NO: 283653 - DNA, 35 bp, Artificial Sequence
  Description of Artificial Sequence: Synthetic oligonucleotide
tcgtaaaggaacacaacctccagatggcataacag

SEQ ID NO: 283654 - DNA, 34 bp, Artificial Sequence
  Description of Artificial Sequence: Synthetic oligonucleotide
cgtaaaggaacacaacctccagatggcataacag

SEQ ID NO: 283655 - DNA, 38 bp, Artificial Sequence
  Description of Artificial Sequence: Synthetic oligonucleotide
gtaaaggaacacaacctccagatggcataacagatttg

SEQ ID NO: 283656 - DNA, 42 bp, Artificial Sequence
  Description of Artificial Sequence: Synthetic oligonucleotide
taaaggaacacaacctccagatggcataacagatttgtattg

SEQ ID NO: 283657 - DNA, 41 bp, Artificial Sequence
  Description of Artificial Sequence: Synthetic oligonucleotide
aaaggaacacaacctccagatggcataacagatttgtattg

SEQ ID NO: 283658 - DNA, 40 bp, Artificial Sequence
  Description of Artificial Sequence: Synthetic oligonucleotide
aaggaacacaacctccagatggcataacagatttgtattg

SEQ ID NO: 283659 - DNA, 39 bp, Artificial Sequence
  Description of Artificial Sequence: Synthetic oligonucleotide
aggaacacaacctccagatggcataacagatttgtattg

SEQ ID NO: 283660 - DNA, 38 bp, Artificial Sequence
  Description of Artificial Sequence: Synthetic oligonucleotide
ggaacacaacctccagatggcataacagatttgtattg

SEQ ID NO: 283661 - DNA, 42 bp, Artificial Sequence
  Description of Artificial Sequence: Synthetic oligonucleotide
gaacacaacctccagatggcataacagatttgtattgatttg

SEQ ID NO: 283662 - DNA, 45 bp, Artificial Sequence
  Description of Artificial Sequence: Synthetic oligonucleotide
aacacaacctccagatggcataacagatttgtattgatttgtttg

SEQ ID NO: 283663 - DNA, 44 bp, Artificial Sequence
  Description of Artificial Sequence: Synthetic oligonucleotide
acacaacctccagatggcataacagatttgtattgatttgtttg

SEQ ID NO: 283664 - DNA, 43 bp, Artificial Sequence
  Description of Artificial Sequence: Synthetic oligonucleotide
cacaacctccagatggcataacagatttgtattgatttgtttg

SEQ ID NO: 283665 - DNA, 46 bp, Artificial Sequence
  Description of Artificial Sequence: Synthetic oligonucleotide
acaacctccagatggcataacagatttgtattgatttgtttgaaag

SEQ ID NO: 283666 - DNA, 45 bp, Artificial Sequence
  Description of Artificial Sequence: Synthetic oligonucleotide
caacctccagatggcataacagatttgtattgatttgtttgaaag

SEQ ID NO: 283667 - DNA, 46 bp, Artificial Sequence
  Description of Artificial Sequence: Synthetic oligonucleotide
aacctccagatggcataacagatttgtattgatttgtttgaaagtg

SEQ ID NO: 283668 - DNA, 45 bp, Artificial Sequence
  Description of Artificial Sequence: Synthetic oligonucleotide
acctccagatggcataacagatttgtattgatttgtttgaaagtg

SEQ ID NO: 283669 - DNA, 44 bp, Artificial Sequence
  Description of Artificial Sequence: Synthetic oligonucleotide
cctccagatggcataacagatttgtattgatttgtttgaaagtg

SEQ ID NO: 283670 - DNA, 44 bp, Artificial Sequence
  Description of Artificial Sequence: Synthetic oligonucleotide
ctccagatggcataacagatttgtattgatttgtttgaaagtgc

SEQ ID NO: 283671 - DNA, 46 bp, Artificial Sequence
  Description of Artificial Sequence: Synthetic oligonucleotide
tccagatggcataacagatttgtattgatttgtttgaaagtgcaag

SEQ ID NO: 283672 - DNA, 45 bp, Artificial Sequence
  Description of Artificial Sequence: Synthetic oligonucleotide
ccagatggcataacagatttgtattgatttgtttgaaagtgcaag

SEQ ID NO: 283673 - DNA, 45 bp, Artificial Sequence
  Description of Artificial Sequence: Synthetic oligonucleotide
cagatggcataacagatttgtattgatttgtttgaaagtgcaagc

SEQ ID NO: 283674 - DNA, 45 bp, Artificial Sequence
  Description of Artificial Sequence: Synthetic oligonucleotide
agatggcataacagatttgtattgatttgtttgaaagtgcaagcc

SEQ ID NO: 283675 - DNA, 44 bp, Artificial Sequence
  Description of Artificial Sequence: Synthetic oligonucleotide
gatggcataacagatttgtattgatttgtttgaaagtgcaagcc

SEQ ID NO: 283676 - DNA, 45 bp, Artificial Sequence
  Description of Artificial Sequence: Synthetic oligonucleotide
atggcataacagatttgtattgatttgtttgaaagtgcaagccag

SEQ ID NO: 283677 - DNA, 44 bp, Artificial Sequence
  Description of Artificial Sequence: Synthetic oligonucleotide
tggcataacagatttgtattgatttgtttgaaagtgcaagccag

SEQ ID NO: 283678 - DNA, 43 bp, Artificial Sequence
  Description of Artificial Sequence: Synthetic oligonucleotide
ggcataacagatttgtattgatttgtttgaaagtgcaagccag

SEQ ID NO: 283679 - DNA, 43 bp, Artificial Sequence
  Description of Artificial Sequence: Synthetic oligonucleotide
gcataacagatttgtattgatttgtttgaaagtgcaagccagc

SEQ ID NO: 283680 - DNA, 44 bp, Artificial Sequence
  Description of Artificial Sequence: Synthetic oligonucleotide
cataacagatttgtattgatttgtttgaaagtgcaagccagcag

SEQ ID NO: 283681 - DNA, 49 bp, Artificial Sequence
  Description of Artificial Sequence: Synthetic oligonucleotide
ataacagatttgtattgatttgtttgaaagtgcaagccagcagattttg

SEQ ID NO: 283682 - DNA, 48 bp, Artificial Sequence
  Description of Artificial Sequence: Synthetic oligonucleotide
taacagatttgtattgatttgtttgaaagtgcaagccagcagattttg

SEQ ID NO: 283683 - DNA, 47 bp, Artificial Sequence
  Description of Artificial Sequence: Synthetic oligonucleotide
aacagatttgtattgatttgtttgaaagtgcaagccagcagattttg

SEQ ID NO: 283684 - DNA, 46 bp, Artificial Sequence
  Description of Artificial Sequence: Synthetic oligonucleotide
acagatttgtattgatttgtttgaaagtgcaagccagcagattttg

SEQ ID NO: 283685 - DNA, 45 bp, Artificial Sequence
  Description of Artificial Sequence: Synthetic oligonucleotide
cagatttgtattgatttgtttgaaagtgcaagccagcagattttg

SEQ ID NO: 283686 - DNA, 46 bp, Artificial Sequence
  Description of Artificial Sequence: Synthetic oligonucleotide
agatttgtattgatttgtttgaaagtgcaagccagcagattttgtc

SEQ ID NO: 283687 - DNA, 45 bp, Artificial Sequence
  Description of Artificial Sequence: Synthetic oligonucleotide
gatttgtattgatttgtttgaaagtgcaagccagcagattttgtc

SEQ ID NO: 283688 - DNA, 47 bp, Artificial Sequence
  Description of Artificial Sequence: Synthetic oligonucleotide
atttgtattgatttgtttgaaagtgcaagccagcagattttgtcatg

SEQ ID NO: 283689 - DNA, 46 bp, Artificial Sequence
  Description of Artificial Sequence: Synthetic oligonucleotide
tttgtattgatttgtttgaaagtgcaagccagcagattttgtcatg

SEQ ID NO: 283690 - DNA, 45 bp, Artificial Sequence
  Description of Artificial Sequence: Synthetic oligonucleotide
ttgtattgatttgtttgaaagtgcaagccagcagattttgtcatg

SEQ ID NO: 283691 - DNA, 44 bp, Artificial Sequence
  Description of Artificial Sequence: Synthetic oligonucleotide
tgtattgatttgtttgaaagtgcaagccagcagattttgtcatg

SEQ ID NO: 283692 - DNA, 43 bp, Artificial Sequence
  Description of Artificial Sequence: Synthetic oligonucleotide
gtattgatttgtttgaaagtgcaagccagcagattttgtcatg

SEQ ID NO: 283693 - DNA, 44 bp, Artificial Sequence
  Description of Artificial Sequence: Synthetic oligonucleotide
tattgatttgtttgaaagtgcaagccagcagattttgtcatgtg

SEQ ID NO: 283694 - DNA, 43 bp, Artificial Sequence
  Description of Artificial Sequence: Synthetic oligonucleotide
attgatttgtttgaaagtgcaagccagcagattttgtcatgtg

SEQ ID NO: 283695 - DNA, 42 bp, Artificial Sequence
  Description of Artificial Sequence: Synthetic oligonucleotide
ttgatttgtttgaaagtgcaagccagcagattttgtcatgtg

SEQ ID NO: 283696 - DNA, 41 bp, Artificial Sequence
  Description of Artificial Sequence: Synthetic oligonucleotide
tgatttgtttgaaagtgcaagccagcagattttgtcatgtg

SEQ ID NO: 283697 - DNA, 40 bp, Artificial Sequence
  Description of Artificial Sequence: Synthetic oligonucleotide
gatttgtttgaaagtgcaagccagcagattttgtcatgtg

SEQ ID NO: 283698 - DNA, 44 bp, Artificial Sequence
  Description of Artificial Sequence: Synthetic oligonucleotide
atttgtttgaaagtgcaagccagcagattttgtcatgtgtaatc

SEQ ID NO: 283699 - DNA, 43 bp, Artificial Sequence
  Description of Artificial Sequence: Synthetic oligonucleotide
tttgtttgaaagtgcaagccagcagattttgtcatgtgtaatc

SEQ ID NO: 283700 - DNA, 42 bp, Artificial Sequence
  Description of Artificial Sequence: Synthetic oligonucleotide
ttgtttgaaagtgcaagccagcagattttgtcatgtgtaatc

SEQ ID NO: 283701 - DNA, 41 bp, Artificial Sequence
  Description of Artificial Sequence: Synthetic oligonucleotide
tgtttgaaagtgcaagccagcagattttgtcatgtgtaatc

SEQ ID NO: 283702 - DNA, 40 bp, Artificial Sequence
  Description of Artificial Sequence: Synthetic oligonucleotide
gtttgaaagtgcaagccagcagattttgtcatgtgtaatc

SEQ ID NO: 283703 - DNA, 40 bp, Artificial Sequence
  Description of Artificial Sequence: Synthetic oligonucleotide
tttgaaagtgcaagccagcagattttgtcatgtgtaatcc

SEQ ID NO: 283704 - DNA, 39 bp, Artificial Sequence
  Description of Artificial Sequence: Synthetic oligonucleotide
ttgaaagtgcaagccagcagattttgtcatgtgtaatcc

SEQ ID NO: 283705 - DNA, 38 bp, Artificial Sequence
  Description of Artificial Sequence: Synthetic oligonucleotide
tgaaagtgcaagccagcagattttgtcatgtgtaatcc

SEQ ID NO: 283706 - DNA, 37 bp, Artificial Sequence
  Description of Artificial Sequence: Synthetic oligonucleotide
gaaagtgcaagccagcagattttgtcatgtgtaatcc

SEQ ID NO: 283707 - DNA, 38 bp, Artificial Sequence
  Description of Artificial Sequence: Synthetic oligonucleotide
aaagtgcaagccagcagattttgtcatgtgtaatccac

SEQ ID NO: 283708 - DNA, 37 bp, Artificial Sequence
  Description of Artificial Sequence: Synthetic oligonucleotide
aagtgcaagccagcagattttgtcatgtgtaatccac

SEQ ID NO: 283709 - DNA, 36 bp, Artificial Sequence
  Description of Artificial Sequence: Synthetic oligonucleotide
agtgcaagccagcagattttgtcatgtgtaatccac

SEQ ID NO: 283710 - DNA, 35 bp, Artificial Sequence
  Description of Artificial Sequence: Synthetic oligonucleotide
gtgcaagccagcagattttgtcatgtgtaatccac

SEQ ID NO: 283711 - DNA, 38 bp, Artificial Sequence
  Description of Artificial Sequence: Synthetic oligonucleotide
tgcaagccagcagattttgtcatgtgtaatccacaatc

SEQ ID NO: 283712 - DNA, 37 bp, Artificial Sequence
  Description of Artificial Sequence: Synthetic oligonucleotide
gcaagccagcagattttgtcatgtgtaatccacaatc

SEQ ID NO: 283713 - DNA, 39 bp, Artificial Sequence
  Description of Artificial Sequence: Synthetic oligonucleotide
caagccagcagattttgtcatgtgtaatccacaatcttc

SEQ ID NO: 283714 - DNA, 39 bp, Artificial Sequence
  Description of Artificial Sequence: Synthetic oligonucleotide
aagccagcagattttgtcatgtgtaatccacaatcttcg

SEQ ID NO: 283715 - DNA, 38 bp, Artificial Sequence
  Description of Artificial Sequence: Synthetic oligonucleotide
agccagcagattttgtcatgtgtaatccacaatcttcg

SEQ ID NO: 283716 - DNA, 37 bp, Artificial Sequence
  Description of Artificial Sequence: Synthetic oligonucleotide
gccagcagattttgtcatgtgtaatccacaatcttcg

SEQ ID NO: 283717 - DNA, 39 bp, Artificial Sequence
  Description of Artificial Sequence: Synthetic oligonucleotide
ccagcagattttgtcatgtgtaatccacaatcttcgatc

SEQ ID NO: 283718 - DNA, 40 bp, Artificial Sequence
  Description of Artificial Sequence: Synthetic oligonucleotide
cagcagattttgtcatgtgtaatccacaatcttcgatctg

SEQ ID NO: 283719 - DNA, 42 bp, Artificial Sequence
  Description of Artificial Sequence: Synthetic oligonucleotide
agcagattttgtcatgtgtaatccacaatcttcgatctgttg

SEQ ID NO: 283720 - DNA, 41 bp, Artificial Sequence
  Description of Artificial Sequence: Synthetic oligonucleotide
gcagattttgtcatgtgtaatccacaatcttcgatctgttg

SEQ ID NO: 283721 - DNA, 41 bp, Artificial Sequence
  Description of Artificial Sequence: Synthetic oligonucleotide
cagattttgtcatgtgtaatccacaatcttcgatctgttgg

SEQ ID NO: 283722 - DNA, 41 bp, Artificial Sequence
  Description of Artificial Sequence: Synthetic oligonucleotide
agattttgtcatgtgtaatccacaatcttcgatctgttggc

SEQ ID NO: 283723 - DNA, 40 bp, Artificial Sequence
  Description of Artificial Sequence: Synthetic oligonucleotide
gattttgtcatgtgtaatccacaatcttcgatctgttggc

SEQ ID NO: 283724 - DNA, 41 bp, Artificial Sequence
  Description of Artificial Sequence: Synthetic oligonucleotide
attttgtcatgtgtaatccacaatcttcgatctgttggcag

SEQ ID NO: 283725 - DNA, 40 bp, Artificial Sequence
  Description of Artificial Sequence: Synthetic oligonucleotide
ttttgtcatgtgtaatccacaatcttcgatctgttggcag

SEQ ID NO: 283726 - DNA, 39 bp, Artificial Sequence
  Description of Artificial Sequence: Synthetic oligonucleotide
tttgtcatgtgtaatccacaatcttcgatctgttggcag

SEQ ID NO: 283727 - DNA, 38 bp, Artificial Sequence
  Description of Artificial Sequence: Synthetic oligonucleotide
ttgtcatgtgtaatccacaatcttcgatctgttggcag

SEQ ID NO: 283728 - DNA, 37 bp, Artificial Sequence
  Description of Artificial Sequence: Synthetic oligonucleotide
tgtcatgtgtaatccacaatcttcgatctgttggcag

SEQ ID NO: 283729 - DNA, 36 bp, Artificial Sequence
  Description of Artificial Sequence: Synthetic oligonucleotide
gtcatgtgtaatccacaatcttcgatctgttggcag

SEQ ID NO: 283730 - DNA, 36 bp, Artificial Sequence
  Description of Artificial Sequence: Synthetic oligonucleotide
tcatgtgtaatccacaatcttcgatctgttggcagc

SEQ ID NO: 283731 - DNA, 35 bp, Artificial Sequence
  Description of Artificial Sequence: Synthetic oligonucleotide
catgtgtaatccacaatcttcgatctgttggcagc

SEQ ID NO: 283732 - DNA, 35 bp, Artificial Sequence
  Description of Artificial Sequence: Synthetic oligonucleotide
atgtgtaatccacaatcttcgatctgttggcagcc

SEQ ID NO: 283733 - DNA, 34 bp, Artificial Sequence
  Description of Artificial Sequence: Synthetic oligonucleotide
tgtgtaatccacaatcttcgatctgttggcagcc

SEQ ID NO: 283734 - DNA, 33 bp, Artificial Sequence
  Description of Artificial Sequence: Synthetic oligonucleotide
gtgtaatccacaatcttcgatctgttggcagcc

SEQ ID NO: 283735 - DNA, 33 bp, Artificial Sequence
  Description of Artificial Sequence: Synthetic oligonucleotide
tgtaatccacaatcttcgatctgttggcagccc

SEQ ID NO: 283736 - DNA, 32 bp, Artificial Sequence
  Description of Artificial Sequence: Synthetic oligonucleotide
gtaatccacaatcttcgatctgttggcagccc

SEQ ID NO: 283737 - DNA, 36 bp, Artificial Sequence
  Description of Artificial Sequence: Synthetic oligonucleotide
taatccacaatcttcgatctgttggcagccctattg

SEQ ID NO: 283738 - DNA, 35 bp, Artificial Sequence
  Description of Artificial Sequence: Synthetic oligonucleotide
aatccacaatcttcgatctgttggcagccctattg

SEQ ID NO: 283739 - DNA, 34 bp, Artificial Sequence
  Description of Artificial Sequence: Synthetic oligonucleotide
atccacaatcttcgatctgttggcagccctattg

SEQ ID NO: 283740 - DNA, 33 bp, Artificial Sequence
  Description of Artificial Sequence: Synthetic oligonucleotide
tccacaatcttcgatctgttggcagccctattg

SEQ ID NO: 283741 - DNA, 32 bp, Artificial Sequence
  Description of Artificial Sequence: Synthetic oligonucleotide
ccacaatcttcgatctgttggcagccctattg

SEQ ID NO: 283742 - DNA, 32 bp, Artificial Sequence
  Description of Artificial Sequence: Synthetic oligonucleotide
cacaatcttcgatctgttggcagccctattgc

SEQ ID NO: 283743 - DNA, 34 bp, Artificial Sequence
  Description of Artificial Sequence: Synthetic oligonucleotide
acaatcttcgatctgttggcagccctattgcatc

SEQ ID NO: 283744 - DNA, 33 bp, Artificial Sequence
  Description of Artificial Sequence: Synthetic oligonucleotide
caatcttcgatctgttggcagccctattgcatc

SEQ ID NO: 283745 - DNA, 34 bp, Artificial Sequence
  Description of Artificial Sequence: Synthetic oligonucleotide
aatcttcgatctgttggcagccctattgcatctg

SEQ ID NO: 283746 - DNA, 33 bp, Artificial Sequence
  Description of Artificial Sequence: Synthetic oligonucleotide
atcttcgatctgttggcagccctattgcatctg

SEQ ID NO: 283747 - DNA, 32 bp, Artificial Sequence
  Description of Artificial Sequence: Synthetic oligonucleotide
tcttcgatctgttggcagccctattgcatctg

SEQ ID NO: 283748 - DNA, 31 bp, Artificial Sequence
  Description of Artificial Sequence: Synthetic oligonucleotide
cttcgatctgttggcagccctattgcatctg

SEQ ID NO: 283749 - DNA, 32 bp, Artificial Sequence
  Description of Artificial Sequence: Synthetic oligonucleotide
ttcgatctgttggcagccctattgcatctgtg

SEQ ID NO: 283750 - DNA, 31 bp, Artificial Sequence
  Description of Artificial Sequence: Synthetic oligonucleotide
tcgatctgttggcagccctattgcatctgtg

SEQ ID NO: 283751 - DNA, 30 bp, Artificial Sequence
  Description of Artificial Sequence: Synthetic oligonucleotide
cgatctgttggcagccctattgcatctgtg

SEQ ID NO: 283752 - DNA, 30 bp, Artificial Sequence
  Description of Artificial Sequence: Synthetic oligonucleotide
gatctgttggcagccctattgcatctgtgc

SEQ ID NO: 283753 - DNA, 30 bp, Artificial Sequence
  Description of Artificial Sequence: Synthetic oligonucleotide
atctgttggcagccctattgcatctgtgcc

SEQ ID NO: 283754 - DNA, 29 bp, Artificial Sequence
  Description of Artificial Sequence: Synthetic oligonucleotide
tctgttggcagccctattgcatctgtgcc

SEQ ID NO: 283755 - DNA, 28 bp, Artificial Sequence
  Description of Artificial Sequence: Synthetic oligonucleotide
ctgttggcagccctattgcatctgtgcc

SEQ ID NO: 283756 - DNA, 29 bp, Artificial Sequence
  Description of Artificial Sequence: Synthetic oligonucleotide
tgttggcagccctattgcatctgtgcctc

SEQ ID NO: 283757 - DNA, 28 bp, Artificial Sequence
  Description of Artificial Sequence: Synthetic oligonucleotide
gttggcagccctattgcatctgtgcctc

SEQ ID NO: 283758 - DNA, 28 bp, Artificial Sequence
  Description of Artificial Sequence: Synthetic oligonucleotide
ttggcagccctattgcatctgtgcctcg

SEQ ID NO: 283759 - DNA, 27 bp, Artificial Sequence
  Description of Artificial Sequence: Synthetic oligonucleotide
tggcagccctattgcatctgtgcctcg

SEQ ID NO: 283760 - DNA, 27 bp, Artificial Sequence
  Description of Artificial Sequence: Synthetic oligonucleotide
ggcagccctattgcatctgtgcctcga

SEQ ID NO: 283761 - DNA, 28 bp, Artificial Sequence
  Description of Artificial Sequence: Synthetic oligonucleotide
gcagccctattgcatctgtgcctcgatc

SEQ ID NO: 283762 - DNA, 28 bp, Artificial Sequence
  Description of Artificial Sequence: Synthetic oligonucleotide
cagccctattgcatctgtgcctcgatcc

SEQ ID NO: 283763 - DNA, 29 bp, Artificial Sequence
  Description of Artificial Sequence: Synthetic oligonucleotide
agccctattgcatctgtgcctcgatccac

SEQ ID NO: 283764 - DNA, 28 bp, Artificial Sequence
  Description of Artificial Sequence: Synthetic oligonucleotide
gccctattgcatctgtgcctcgatccac

SEQ ID NO: 283765 - DNA, 33 bp, Artificial Sequence
  Description of Artificial Sequence: Synthetic oligonucleotide
ccctattgcatctgtgcctcgatccactattac

SEQ ID NO: 283766 - DNA, 33 bp, Artificial Sequence
  Description of Artificial Sequence: Synthetic oligonucleotide
cctattgcatctgtgcctcgatccactattacg

SEQ ID NO: 283767 - DNA, 33 bp, Artificial Sequence
  Description of Artificial Sequence: Synthetic oligonucleotide
ctattgcatctgtgcctcgatccactattacgg

SEQ ID NO: 283768 - DNA, 33 bp, Artificial Sequence
  Description of Artificial Sequence: Synthetic oligonucleotide
tattgcatctgtgcctcgatccactattacggg

SEQ ID NO: 283769 - DNA, 32 bp, Artificial Sequence
  Description of Artificial Sequence: Synthetic oligonucleotide
attgcatctgtgcctcgatccactattacggg

SEQ ID NO: 283770 - DNA, 31 bp, Artificial Sequence
  Description of Artificial Sequence: Synthetic oligonucleotide
ttgcatctgtgcctcgatccactattacggg

SEQ ID NO: 283771 - DNA, 30 bp, Artificial Sequence
  Description of Artificial Sequence: Synthetic oligonucleotide
tgcatctgtgcctcgatccactattacggg

SEQ ID NO: 283772 - DNA, 29 bp, Artificial Sequence
  Description of Artificial Sequence: Synthetic oligonucleotide
gcatctgtgcctcgatccactattacggg

SEQ ID NO: 283773 - DNA, 31 bp, Artificial Sequence
  Description of Artificial Sequence: Synthetic oligonucleotide
catctgtgcctcgatccactattacgggtac

SEQ ID NO: 283774 - DNA, 32 bp, Artificial Sequence
  Description of Artificial Sequence: Synthetic oligonucleotide
atctgtgcctcgatccactattacgggtacag

SEQ ID NO: 283775 - DNA, 31 bp, Artificial Sequence
  Description of Artificial Sequence: Synthetic oligonucleotide
tctgtgcctcgatccactattacgggtacag

SEQ ID NO: 283776 - DNA, 30 bp, Artificial Sequence
  Description of Artificial Sequence: Synthetic oligonucleotide
ctgtgcctcgatccactattacgggtacag

SEQ ID NO: 283777 - DNA, 32 bp, Artificial Sequence
  Description of Artificial Sequence: Synthetic oligonucleotide
tgtgcctcgatccactattacgggtacagttc

SEQ ID NO: 283778 - DNA, 31 bp, Artificial Sequence
  Description of Artificial Sequence: Synthetic oligonucleotide
gtgcctcgatccactattacgggtacagttc

SEQ ID NO: 283779 - DNA, 31 bp, Artificial Sequence
  Description of Artificial Sequence: Synthetic oligonucleotide
tgcctcgatccactattacgggtacagttcc

SEQ ID NO: 283780 - DNA, 30 bp, Artificial Sequence
  Description of Artificial Sequence: Synthetic oligonucleotide
gcctcgatccactattacgggtacagttcc

SEQ ID NO: 283781 - DNA, 30 bp, Artificial Sequence
  Description of Artificial Sequence: Synthetic oligonucleotide
cctcgatccactattacgggtacagttccg

SEQ ID NO: 283782 - DNA, 30 bp, Artificial Sequence
  Description of Artificial Sequence: Synthetic oligonucleotide
ctcgatccactattacgggtacagttccgg

SEQ ID NO: 283783 - DNA, 30 bp, Artificial Sequence
  Description of Artificial Sequence: Synthetic oligonucleotide
tcgatccactattacgggtacagttccggg

SEQ ID NO: 283784 - DNA, 29 bp, Artificial Sequence
  Description of Artificial Sequence: Synthetic oligonucleotide
cgatccactattacgggtacagttccggg

SEQ ID NO: 283785 - DNA, 31 bp, Artificial Sequence
  Description of Artificial Sequence: Synthetic oligonucleotide
gatccactattacgggtacagttccgggaac

SEQ ID NO: 283786 - DNA, 32 bp, Artificial Sequence
  Description of Artificial Sequence: Synthetic oligonucleotide
atccactattacgggtacagttccgggaacag

SEQ ID NO: 283787 - DNA, 31 bp, Artificial Sequence
  Description of Artificial Sequence: Synthetic oligonucleotide
tccactattacgggtacagttccgggaacag

SEQ ID NO: 283788 - DNA, 30 bp, Artificial Sequence
  Description of Artificial Sequence: Synthetic oligonucleotide
ccactattacgggtacagttccgggaacag

SEQ ID NO: 283789 - DNA, 31 bp, Artificial Sequence
  Description of Artificial Sequence: Synthetic oligonucleotide
cactattacgggtacagttccgggaacagag

SEQ ID NO: 283790 - DNA, 34 bp, Artificial Sequence
  Description of Artificial Sequence: Synthetic oligonucleotide
actattacgggtacagttccgggaacagagaaag

SEQ ID NO: 283791 - DNA, 33 bp, Artificial Sequence
  Description of Artificial Sequence: Synthetic oligonucleotide
ctattacgggtacagttccgggaacagagaaag

SEQ ID NO: 283792 - DNA, 34 bp, Artificial Sequence
  Description of Artificial Sequence: Synthetic oligonucleotide
tattacgggtacagttccgggaacagagaaagtc

SEQ ID NO: 283793 - DNA, 33 bp, Artificial Sequence
  Description of Artificial Sequence: Synthetic oligonucleotide
attacgggtacagttccgggaacagagaaagtc

SEQ ID NO: 283794 - DNA, 32 bp, Artificial Sequence
  Description of Artificial Sequence: Synthetic oligonucleotide
ttacgggtacagttccgggaacagagaaagtc

SEQ ID NO: 283795 - DNA, 31 bp, Artificial Sequence
  Description of Artificial Sequence: Synthetic oligonucleotide
tacgggtacagttccgggaacagagaaagtc

SEQ ID NO: 283796 - DNA, 30 bp, Artificial Sequence
  Description of Artificial Sequence: Synthetic oligonucleotide
acgggtacagttccgggaacagagaaagtc

SEQ ID NO: 283797 - DNA, 29 bp, Artificial Sequence
  Description of Artificial Sequence: Synthetic oligonucleotide
cgggtacagttccgggaacagagaaagtc

SEQ ID NO: 283798 - DNA, 30 bp, Artificial Sequence
  Description of Artificial Sequence: Synthetic oligonucleotide
gggtacagttccgggaacagagaaagtcag

SEQ ID NO: 283799 - DNA, 31 bp, Artificial Sequence
  Description of Artificial Sequence: Synthetic oligonucleotide
ggtacagttccgggaacagagaaagtcagtg

SEQ ID NO: 283800 - DNA, 32 bp, Artificial Sequence
  Description of Artificial Sequence: Synthetic oligonucleotide
gtacagttccgggaacagagaaagtcagtgac

SEQ ID NO: 283801 - DNA, 33 bp, Artificial Sequence
  Description of Artificial Sequence: Synthetic oligonucleotide
tacagttccgggaacagagaaagtcagtgactc

SEQ ID NO: 283802 - DNA, 32 bp, Artificial Sequence
  Description of Artificial Sequence: Synthetic oligonucleotide
acagttccgggaacagagaaagtcagtgactc

SEQ ID NO: 283803 - DNA, 31 bp, Artificial Sequence
  Description of Artificial Sequence: Synthetic oligonucleotide
cagttccgggaacagagaaagtcagtgactc

SEQ ID NO: 283804 - DNA, 31 bp, Artificial Sequence
  Description of Artificial Sequence: Synthetic oligonucleotide
agttccgggaacagagaaagtcagtgactcc

SEQ ID NO: 283805 - DNA, 30 bp, Artificial Sequence
  Description of Artificial Sequence: Synthetic oligonucleotide
gttccgggaacagagaaagtcagtgactcc

SEQ ID NO: 283806 - DNA, 32 bp, Artificial Sequence
  Description of Artificial Sequence: Synthetic oligonucleotide
ttccgggaacagagaaagtcagtgactccatg

SEQ ID NO: 283807 - DNA, 31 bp, Artificial Sequence
  Description of Artificial Sequence: Synthetic oligonucleotide
tccgggaacagagaaagtcagtgactccatg

SEQ ID NO: 283808 - DNA, 30 bp, Artificial Sequence
  Description of Artificial Sequence: Synthetic oligonucleotide
ccgggaacagagaaagtcagtgactccatg

SEQ ID NO: 283809 - DNA, 30 bp, Artificial Sequence
  Description of Artificial Sequence: Synthetic oligonucleotide
cgggaacagagaaagtcagtgactccatgg

SEQ ID NO: 283810 - DNA, 33 bp, Artificial Sequence
  Description of Artificial Sequence: Synthetic oligonucleotide
gggaacagagaaagtcagtgactccatggaaac

SEQ ID NO: 283811 - DNA, 34 bp, Artificial Sequence
  Description of Artificial Sequence: Synthetic oligonucleotide
ggaacagagaaagtcagtgactccatggaaacac

SEQ ID NO: 283812 - DNA, 36 bp, Artificial Sequence
  Description of Artificial Sequence: Synthetic oligonucleotide
gaacagagaaagtcagtgactccatggaaacacaag

SEQ ID NO: 283813 - DNA, 40 bp, Artificial Sequence
  Description of Artificial Sequence: Synthetic oligonucleotide
aacagagaaagtcagtgactccatggaaacacaagaaaag

SEQ ID NO: 283814 - DNA, 39 bp, Artificial Sequence
  Description of Artificial Sequence: Synthetic oligonucleotide
acagagaaagtcagtgactccatggaaacacaagaaaag

SEQ ID NO: 283815 - DNA, 38 bp, Artificial Sequence
  Description of Artificial Sequence: Synthetic oligonucleotide
cagagaaagtcagtgactccatggaaacacaagaaaag

SEQ ID NO: 283816 - DNA, 39 bp, Artificial Sequence
  Description of Artificial Sequence: Synthetic oligonucleotide
agagaaagtcagtgactccatggaaacacaagaaaagag

SEQ ID NO: 283817 - DNA, 38 bp, Artificial Sequence
  Description of Artificial Sequence: Synthetic oligonucleotide
gagaaagtcagtgactccatggaaacacaagaaaagag

SEQ ID NO: 283818 - DNA, 40 bp, Artificial Sequence
  Description of Artificial Sequence: Synthetic oligonucleotide
agaaagtcagtgactccatggaaacacaagaaaagagaag

SEQ ID NO: 283819 - DNA, 39 bp, Artificial Sequence
  Description of Artificial Sequence: Synthetic oligonucleotide
gaaagtcagtgactccatggaaacacaagaaaagagaag

SEQ ID NO: 283820 - DNA, 39 bp, Artificial Sequence
  Description of Artificial Sequence: Synthetic oligonucleotide
aaagtcagtgactccatggaaacacaagaaaagagaagc

SEQ ID NO: 283821 - DNA, 38 bp, Artificial Sequence
  Description of Artificial Sequence: Synthetic oligonucleotide
aagtcagtgactccatggaaacacaagaaaagagaagc

SEQ ID NO: 283822 - DNA, 37 bp, Artificial Sequence
  Description of Artificial Sequence: Synthetic oligonucleotide
agtcagtgactccatggaaacacaagaaaagagaagc

SEQ ID NO: 283823 - DNA, 36 bp, Artificial Sequence
  Description of Artificial Sequence: Synthetic oligonucleotide
gtcagtgactccatggaaacacaagaaaagagaagc

SEQ ID NO: 283824 - DNA, 37 bp, Artificial Sequence
  Description of Artificial Sequence: Synthetic oligonucleotide
tcagtgactccatggaaacacaagaaaagagaagcag

SEQ ID NO: 283825 - DNA, 36 bp, Artificial Sequence
  Description of Artificial Sequence: Synthetic oligonucleotide
cagtgactccatggaaacacaagaaaagagaagcag

SEQ ID NO: 283826 - DNA, 37 bp, Artificial Sequence
  Description of Artificial Sequence: Synthetic oligonucleotide
agtgactccatggaaacacaagaaaagagaagcagtg

SEQ ID NO: 283827 - DNA, 36 bp, Artificial Sequence
  Description of Artificial Sequence: Synthetic oligonucleotide
gtgactccatggaaacacaagaaaagagaagcagtg

SEQ ID NO: 283828 - DNA, 36 bp, Artificial Sequence
  Description of Artificial Sequence: Synthetic oligonucleotide
tgactccatggaaacacaagaaaagagaagcagtgc

SEQ ID NO: 283829 - DNA, 35 bp, Artificial Sequence
  Description of Artificial Sequence: Synthetic oligonucleotide
gactccatggaaacacaagaaaagagaagcagtgc

SEQ ID NO: 283830 - DNA, 39 bp, Artificial Sequence
  Description of Artificial Sequence: Synthetic oligonucleotide
actccatggaaacacaagaaaagagaagcagtgcttttg

SEQ ID NO: 283831 - DNA, 38 bp, Artificial Sequence
  Description of Artificial Sequence: Synthetic oligonucleotide
ctccatggaaacacaagaaaagagaagcagtgcttttg

SEQ ID NO: 283832 - DNA, 40 bp, Artificial Sequence
  Description of Artificial Sequence: Synthetic oligonucleotide
tccatggaaacacaagaaaagagaagcagtgcttttgtag

SEQ ID NO: 283833 - DNA, 39 bp, Artificial Sequence
  Description of Artificial Sequence: Synthetic oligonucleotide
ccatggaaacacaagaaaagagaagcagtgcttttgtag

SEQ ID NO: 283834 - DNA, 39 bp, Artificial Sequence
  Description of Artificial Sequence: Synthetic oligonucleotide
catggaaacacaagaaaagagaagcagtgcttttgtagg

SEQ ID NO: 283835 - DNA, 42 bp, Artificial Sequence
  Description of Artificial Sequence: Synthetic oligonucleotide
atggaaacacaagaaaagagaagcagtgcttttgtaggatag

SEQ ID NO: 283836 - DNA, 41 bp, Artificial Sequence
  Description of Artificial Sequence: Synthetic oligonucleotide
tggaaacacaagaaaagagaagcagtgcttttgtaggatag

SEQ ID NO: 283837 - DNA, 40 bp, Artificial Sequence
  Description of Artificial Sequence: Synthetic oligonucleotide
ggaaacacaagaaaagagaagcagtgcttttgtaggatag

SEQ ID NO: 283838 - DNA, 41 bp, Artificial Sequence
  Description of Artificial Sequence: Synthetic oligonucleotide
gaaacacaagaaaagagaagcagtgcttttgtaggatagac

SEQ ID NO: 283839 - DNA, 42 bp, Artificial Sequence
  Description of Artificial Sequence: Synthetic oligonucleotide
aaacacaagaaaagagaagcagtgcttttgtaggatagacac

SEQ ID NO: 283840 - DNA, 41 bp, Artificial Sequence
  Description of Artificial Sequence: Synthetic oligonucleotide
aacacaagaaaagagaagcagtgcttttgtaggatagacac

SEQ ID NO: 283841 - DNA, 40 bp, Artificial Sequence
  Description of Artificial Sequence: Synthetic oligonucleotide
acacaagaaaagagaagcagtgcttttgtaggatagacac

SEQ ID NO: 283842 - DNA, 39 bp, Artificial Sequence
  Description of Artificial Sequence: Synthetic oligonucleotide
cacaagaaaagagaagcagtgcttttgtaggatagacac

SEQ ID NO: 283843 - DNA, 39 bp, Artificial Sequence
  Description of Artificial Sequence: Synthetic oligonucleotide
acaagaaaagagaagcagtgcttttgtaggatagacacc

SEQ ID NO: 283844 - DNA, 38 bp, Artificial Sequence
  Description of Artificial Sequence: Synthetic oligonucleotide
caagaaaagagaagcagtgcttttgtaggatagacacc

SEQ ID NO: 283845 - DNA, 39 bp, Artificial Sequence
  Description of Artificial Sequence: Synthetic oligonucleotide
aagaaaagagaagcagtgcttttgtaggatagacaccag

SEQ ID NO: 283846 - DNA, 38 bp, Artificial Sequence
  Description of Artificial Sequence: Synthetic oligonucleotide
agaaaagagaagcagtgcttttgtaggatagacaccag

SEQ ID NO: 283847 - DNA, 37 bp, Artificial Sequence
  Description of Artificial Sequence: Synthetic oligonucleotide
gaaaagagaagcagtgcttttgtaggatagacaccag

SEQ ID NO: 283848 - DNA, 39 bp, Artificial Sequence
  Description of Artificial Sequence: Synthetic oligonucleotide
aaaagagaagcagtgcttttgtaggatagacaccagtag

SEQ ID NO: 283849 - DNA, 38 bp, Artificial Sequence
  Description of Artificial Sequence: Synthetic oligonucleotide
aaagagaagcagtgcttttgtaggatagacaccagtag

SEQ ID NO: 283850 - DNA, 37 bp, Artificial Sequence
  Description of Artificial Sequence: Synthetic oligonucleotide
aagagaagcagtgcttttgtaggatagacaccagtag

SEQ ID NO: 283851 - DNA, 36 bp, Artificial Sequence
  Description of Artificial Sequence: Synthetic oligonucleotide
agagaagcagtgcttttgtaggatagacaccagtag

SEQ ID NO: 283852 - DNA, 35 bp, Artificial Sequence
  Description of Artificial Sequence: Synthetic oligonucleotide
gagaagcagtgcttttgtaggatagacaccagtag

SEQ ID NO: 283853 - DNA, 35 bp, Artificial Sequence
  Description of Artificial Sequence: Synthetic oligonucleotide
agaagcagtgcttttgtaggatagacaccagtagc

SEQ ID NO: 283854 - DNA, 34 bp, Artificial Sequence
  Description of Artificial Sequence: Synthetic oligonucleotide
gaagcagtgcttttgtaggatagacaccagtagc

SEQ ID NO: 283855 - DNA, 34 bp, Artificial Sequence
  Description of Artificial Sequence: Synthetic oligonucleotide
aagcagtgcttttgtaggatagacaccagtagcc

SEQ ID NO: 283856 - DNA, 33 bp, Artificial Sequence
  Description of Artificial Sequence: Synthetic oligonucleotide
agcagtgcttttgtaggatagacaccagtagcc

SEQ ID NO: 283857 - DNA, 32 bp, Artificial Sequence
  Description of Artificial Sequence: Synthetic oligonucleotide
gcagtgcttttgtaggatagacaccagtagcc

SEQ ID NO: 283858 - DNA, 33 bp, Artificial Sequence
  Description of Artificial Sequence: Synthetic oligonucleotide
cagtgcttttgtaggatagacaccagtagccag

SEQ ID NO: 283859 - DNA, 34 bp, Artificial Sequence
  Description of Artificial Sequence: Synthetic oligonucleotide
agtgcttttgtaggatagacaccagtagccagtc

SEQ ID NO: 283860 - DNA, 33 bp, Artificial Sequence
  Description of Artificial Sequence: Synthetic oligonucleotide
gtgcttttgtaggatagacaccagtagccagtc

SEQ ID NO: 283861 - DNA, 33 bp, Artificial Sequence
  Description of Artificial Sequence: Synthetic oligonucleotide
tgcttttgtaggatagacaccagtagccagtcc

SEQ ID NO: 283862 - DNA, 32 bp, Artificial Sequence
  Description of Artificial Sequence: Synthetic oligonucleotide
gcttttgtaggatagacaccagtagccagtcc

SEQ ID NO: 283863 - DNA, 33 bp, Artificial Sequence
  Description of Artificial Sequence: Synthetic oligonucleotide
cttttgtaggatagacaccagtagccagtcctg

SEQ ID NO: 283864 - DNA, 34 bp, Artificial Sequence
  Description of Artificial Sequence: Synthetic oligonucleotide
ttttgtaggatagacaccagtagccagtcctgag

SEQ ID NO: 283865 - DNA, 33 bp, Artificial Sequence
  Description of Artificial Sequence: Synthetic oligonucleotide
tttgtaggatagacaccagtagccagtcctgag

SEQ ID NO: 283866 - DNA, 32 bp, Artificial Sequence
  Description of Artificial Sequence: Synthetic oligonucleotide
ttgtaggatagacaccagtagccagtcctgag

SEQ ID NO: 283867 - DNA, 31 bp, Artificial Sequence
  Description of Artificial Sequence: Synthetic oligonucleotide
tgtaggatagacaccagtagccagtcctgag

SEQ ID NO: 283868 - DNA, 30 bp, Artificial Sequence
  Description of Artificial Sequence: Synthetic oligonucleotide
gtaggatagacaccagtagccagtcctgag

SEQ ID NO: 283869 - DNA, 30 bp, Artificial Sequence
  Description of Artificial Sequence: Synthetic oligonucleotide
taggatagacaccagtagccagtcctgagc

SEQ ID NO: 283870 - DNA, 29 bp, Artificial Sequence
  Description of Artificial Sequence: Synthetic oligonucleotide
aggatagacaccagtagccagtcctgagc

SEQ ID NO: 283871 - DNA, 28 bp, Artificial Sequence
  Description of Artificial Sequence: Synthetic oligonucleotide
ggatagacaccagtagccagtcctgagc

SEQ ID NO: 283872 - DNA, 28 bp, Artificial Sequence
  Description of Artificial Sequence: Synthetic oligonucleotide
gatagacaccagtagccagtcctgagcc

SEQ ID NO: 283873 - DNA, 31 bp, Artificial Sequence
  Description of Artificial Sequence: Synthetic oligonucleotide
atagacaccagtagccagtcctgagcctaag

SEQ ID NO: 283874 - DNA, 30 bp, Artificial Sequence
  Description of Artificial Sequence: Synthetic oligonucleotide
tagacaccagtagccagtcctgagcctaag

SEQ ID NO: 283875 - DNA, 29 bp, Artificial Sequence
  Description of Artificial Sequence: Synthetic oligonucleotide
agacaccagtagccagtcctgagcctaag

SEQ ID NO: 283876 - DNA, 28 bp, Artificial Sequence
  Description of Artificial Sequence: Synthetic oligonucleotide
gacaccagtagccagtcctgagcctaag

SEQ ID NO: 283877 - DNA, 28 bp, Artificial Sequence
  Description of Artificial Sequence: Synthetic oligonucleotide
acaccagtagccagtcctgagcctaagc

SEQ ID NO: 283878 - DNA, 27 bp, Artificial Sequence
  Description of Artificial Sequence: Synthetic oligonucleotide
caccagtagccagtcctgagcctaagc

SEQ ID NO: 283879 - DNA, 28 bp, Artificial Sequence
  Description of Artificial Sequence: Synthetic oligonucleotide
accagtagccagtcctgagcctaagcac

SEQ ID NO: 283880 - DNA, 27 bp, Artificial Sequence
  Description of Artificial Sequence: Synthetic oligonucleotide
ccagtagccagtcctgagcctaagcac

SEQ ID NO: 283881 - DNA, 27 bp, Artificial Sequence
  Description of Artificial Sequence: Synthetic oligonucleotide
cagtagccagtcctgagcctaagcacc

SEQ ID NO: 283882 - DNA, 28 bp, Artificial Sequence
  Description of Artificial Sequence: Synthetic oligonucleotide
agtagccagtcctgagcctaagcaccag

SEQ ID NO: 283883 - DNA, 27 bp, Artificial Sequence
  Description of Artificial Sequence: Synthetic oligonucleotide
gtagccagtcctgagcctaagcaccag

SEQ ID NO: 283884 - DNA, 28 bp, Artificial Sequence
  Description of Artificial Sequence: Synthetic oligonucleotide
tagccagtcctgagcctaagcaccagac

SEQ ID NO: 283885 - DNA, 27 bp, Artificial Sequence
  Description of Artificial Sequence: Synthetic oligonucleotide
agccagtcctgagcctaagcaccagac

SEQ ID NO: 283886 - DNA, 27 bp, Artificial Sequence
  Description of Artificial Sequence: Synthetic oligonucleotide
gccagtcctgagcctaagcaccagact

SEQ ID NO: 283887 - DNA, 29 bp, Artificial Sequence
  Description of Artificial Sequence: Synthetic oligonucleotide
ccagtcctgagcctaagcaccagacttag

SEQ ID NO: 283888 - DNA, 34 bp, Artificial Sequence
  Description of Artificial Sequence: Synthetic oligonucleotide
cagtcctgagcctaagcaccagacttagaaaatg

SEQ ID NO: 283889 - DNA, 47 bp, Artificial Sequence
  Description of Artificial Sequence: Synthetic oligonucleotide
agtcctgagcctaagcaccagacttagaaaatgataaaaattttatg

SEQ ID NO: 283890 - DNA, 46 bp, Artificial Sequence
  Description of Artificial Sequence: Synthetic oligonucleotide
gtcctgagcctaagcaccagacttagaaaatgataaaaattttatg

SEQ ID NO: 283891 - DNA, 47 bp, Artificial Sequence
  Description of Artificial Sequence: Synthetic oligonucleotide
tcctgagcctaagcaccagacttagaaaatgataaaaattttatgtg

SEQ ID NO: 283892 - DNA, 46 bp, Artificial Sequence
  Description of Artificial Sequence: Synthetic oligonucleotide
cctgagcctaagcaccagacttagaaaatgataaaaattttatgtg

SEQ ID NO: 283893 - DNA, 46 bp, Artificial Sequence
  Description of Artificial Sequence: Synthetic oligonucleotide
ctgagcctaagcaccagacttagaaaatgataaaaattttatgtgg

SEQ ID NO: 283894 - DNA, 47 bp, Artificial Sequence
  Description of Artificial Sequence: Synthetic oligonucleotide
tgagcctaagcaccagacttagaaaatgataaaaattttatgtggtg

SEQ ID NO: 283895 - DNA, 46 bp, Artificial Sequence
  Description of Artificial Sequence: Synthetic oligonucleotide
gagcctaagcaccagacttagaaaatgataaaaattttatgtggtg

SEQ ID NO: 283896 - DNA, 50 bp, Artificial Sequence
  Description of Artificial Sequence: Synthetic oligonucleotide
agcctaagcaccagacttagaaaatgataaaaattttatgtggtgaaaag

SEQ ID NO: 283897 - DNA, 49 bp, Artificial Sequence
  Description of Artificial Sequence: Synthetic oligonucleotide
gcctaagcaccagacttagaaaatgataaaaattttatgtggtgaaaag

SEQ ID NO: 283898 - DNA, 49 bp, Artificial Sequence
  Description of Artificial Sequence: Synthetic oligonucleotide
cctaagcaccagacttagaaaatgataaaaattttatgtggtgaaaagg

SEQ ID NO: 283899 - DNA, 49 bp, Artificial Sequence
  Description of Artificial Sequence: Synthetic oligonucleotide
ctaagcaccagacttagaaaatgataaaaattttatgtggtgaaaaggc

SEQ ID NO: 283900 - DNA, 53 bp, Artificial Sequence
  Description of Artificial Sequence: Synthetic oligonucleotide
taagcaccagacttagaaaatgataaaaattttatgtggtgaaaaggctattg

SEQ ID NO: 283901 - DNA, 52 bp, Artificial Sequence
  Description of Artificial Sequence: Synthetic oligonucleotide
aagcaccagacttagaaaatgataaaaattttatgtggtgaaaaggctattg

SEQ ID NO: 283902 - DNA, 51 bp, Artificial Sequence
  Description of Artificial Sequence: Synthetic oligonucleotide
agcaccagacttagaaaatgataaaaattttatgtggtgaaaaggctattg

SEQ ID NO: 283903 - DNA, 50 bp, Artificial Sequence
  Description of Artificial Sequence: Synthetic oligonucleotide
gcaccagacttagaaaatgataaaaattttatgtggtgaaaaggctattg

SEQ ID NO: 283904 - DNA, 51 bp, Artificial Sequence
  Description of Artificial Sequence: Synthetic oligonucleotide
caccagacttagaaaatgataaaaattttatgtggtgaaaaggctattgac

SEQ ID NO: 283905 - DNA, 54 bp, Artificial Sequence
  Description of Artificial Sequence: Synthetic oligonucleotide
accagacttagaaaatgataaaaattttatgtggtgaaaaggctattgacttac

SEQ ID NO: 283906 - DNA, 53 bp, Artificial Sequence
  Description of Artificial Sequence: Synthetic oligonucleotide
ccagacttagaaaatgataaaaattttatgtggtgaaaaggctattgacttac

SEQ ID NO: 283907 - DNA, 55 bp, Artificial Sequence
  Description of Artificial Sequence: Synthetic oligonucleotide
cagacttagaaaatgataaaaattttatgtggtgaaaaggctattgacttacatc

SEQ ID NO: 283908 - DNA, 56 bp, Artificial Sequence
  Description of Artificial Sequence: Synthetic oligonucleotide
agacttagaaaatgataaaaattttatgtggtgaaaaggctattgacttacatctg

SEQ ID NO: 283909 - DNA, 55 bp, Artificial Sequence
  Description of Artificial Sequence: Synthetic oligonucleotide
gacttagaaaatgataaaaattttatgtggtgaaaaggctattgacttacatctg

SEQ ID NO: 283910 - DNA, 55 bp, Artificial Sequence
  Description of Artificial Sequence: Synthetic oligonucleotide
acttagaaaatgataaaaattttatgtggtgaaaaggctattgacttacatctgg

SEQ ID NO: 283911 - DNA, 54 bp, Artificial Sequence
  Description of Artificial Sequence: Synthetic oligonucleotide
cttagaaaatgataaaaattttatgtggtgaaaaggctattgacttacatctgg

SEQ ID NO: 283912 - DNA, 55 bp, Artificial Sequence
  Description of Artificial Sequence: Synthetic oligonucleotide
ttagaaaatgataaaaattttatgtggtgaaaaggctattgacttacatctggag

SEQ ID NO: 283913 - DNA, 54 bp, Artificial Sequence
  Description of Artificial Sequence: Synthetic oligonucleotide
tagaaaatgataaaaattttatgtggtgaaaaggctattgacttacatctggag

SEQ ID NO: 283914 - DNA, 53 bp, Artificial Sequence
  Description of Artificial Sequence: Synthetic oligonucleotide
agaaaatgataaaaattttatgtggtgaaaaggctattgacttacatctggag

SEQ ID NO: 283915 - DNA, 52 bp, Artificial Sequence
  Description of Artificial Sequence: Synthetic oligonucleotide
gaaaatgataaaaattttatgtggtgaaaaggctattgacttacatctggag

SEQ ID NO: 283916 - DNA, 54 bp, Artificial Sequence
  Description of Artificial Sequence: Synthetic oligonucleotide
aaaatgataaaaattttatgtggtgaaaaggctattgacttacatctggagttc

SEQ ID NO: 283917 - DNA, 53 bp, Artificial Sequence
  Description of Artificial Sequence: Synthetic oligonucleotide
aaatgataaaaattttatgtggtgaaaaggctattgacttacatctggagttc

SEQ ID NO: 283918 - DNA, 52 bp, Artificial Sequence
  Description of Artificial Sequence: Synthetic oligonucleotide
aatgataaaaattttatgtggtgaaaaggctattgacttacatctggagttc

SEQ ID NO: 283919 - DNA, 51 bp, Artificial Sequence
  Description of Artificial Sequence: Synthetic oligonucleotide
atgataaaaattttatgtggtgaaaaggctattgacttacatctggagttc

SEQ ID NO: 283920 - DNA, 50 bp, Artificial Sequence
  Description of Artificial Sequence: Synthetic oligonucleotide
tgataaaaattttatgtggtgaaaaggctattgacttacatctggagttc

SEQ ID NO: 283921 - DNA, 49 bp, Artificial Sequence
  Description of Artificial Sequence: Synthetic oligonucleotide
gataaaaattttatgtggtgaaaaggctattgacttacatctggagttc

SEQ ID NO: 283922 - DNA, 55 bp, Artificial Sequence
  Description of Artificial Sequence: Synthetic oligonucleotide
ataaaaattttatgtggtgaaaaggctattgacttacatctggagttcttaaaac

SEQ ID NO: 283923 - DNA, 54 bp, Artificial Sequence
  Description of Artificial Sequence: Synthetic oligonucleotide
taaaaattttatgtggtgaaaaggctattgacttacatctggagttcttaaaac

SEQ ID NO: 283924 - DNA, 53 bp, Artificial Sequence
  Description of Artificial Sequence: Synthetic oligonucleotide
aaaaattttatgtggtgaaaaggctattgacttacatctggagttcttaaaac

SEQ ID NO: 283925 - DNA, 52 bp, Artificial Sequence
  Description of Artificial Sequence: Synthetic oligonucleotide
aaaattttatgtggtgaaaaggctattgacttacatctggagttcttaaaac

SEQ ID NO: 283926 - DNA, 51 bp, Artificial Sequence
  Description of Artificial Sequence: Synthetic oligonucleotide
aaattttatgtggtgaaaaggctattgacttacatctggagttcttaaaac

SEQ ID NO: 283927 - DNA, 50 bp, Artificial Sequence
  Description of Artificial Sequence: Synthetic oligonucleotide
aattttatgtggtgaaaaggctattgacttacatctggagttcttaaaac

SEQ ID NO: 283928 - DNA, 49 bp, Artificial Sequence
  Description of Artificial Sequence: Synthetic oligonucleotide
attttatgtggtgaaaaggctattgacttacatctggagttcttaaaac

SEQ ID NO: 283929 - DNA, 48 bp, Artificial Sequence
  Description of Artificial Sequence: Synthetic oligonucleotide
ttttatgtggtgaaaaggctattgacttacatctggagttcttaaaac

SEQ ID NO: 283930 - DNA, 47 bp, Artificial Sequence
  Description of Artificial Sequence: Synthetic oligonucleotide
tttatgtggtgaaaaggctattgacttacatctggagttcttaaaac

SEQ ID NO: 283931 - DNA, 46 bp, Artificial Sequence
  Description of Artificial Sequence: Synthetic oligonucleotide
ttatgtggtgaaaaggctattgacttacatctggagttcttaaaac

SEQ ID NO: 283932 - DNA, 45 bp, Artificial Sequence
  Description of Artificial Sequence: Synthetic oligonucleotide
tatgtggtgaaaaggctattgacttacatctggagttcttaaaac

SEQ ID NO: 283933 - DNA, 44 bp, Artificial Sequence
  Description of Artificial Sequence: Synthetic oligonucleotide
atgtggtgaaaaggctattgacttacatctggagttcttaaaac

SEQ ID NO: 283934 - DNA, 43 bp, Artificial Sequence
  Description of Artificial Sequence: Synthetic oligonucleotide
tgtggtgaaaaggctattgacttacatctggagttcttaaaac

SEQ ID NO: 283935 - DNA, 42 bp, Artificial Sequence
  Description of Artificial Sequence: Synthetic oligonucleotide
gtggtgaaaaggctattgacttacatctggagttcttaaaac

SEQ ID NO: 283936 - DNA, 42 bp, Artificial Sequence
  Description of Artificial Sequence: Synthetic oligonucleotide
tggtgaaaaggctattgacttacatctggagttcttaaaacg

SEQ ID NO: 283937 - DNA, 41 bp, Artificial Sequence
  Description of Artificial Sequence: Synthetic oligonucleotide
ggtgaaaaggctattgacttacatctggagttcttaaaacg

SEQ ID NO: 283938 - DNA, 44 bp, Artificial Sequence
  Description of Artificial Sequence: Synthetic oligonucleotide
gtgaaaaggctattgacttacatctggagttcttaaaacgaaac

SEQ ID NO: 283939 - DNA, 51 bp, Artificial Sequence
  Description of Artificial Sequence: Synthetic oligonucleotide
tgaaaaggctattgacttacatctggagttcttaaaacgaaacaaaaatac

SEQ ID NO: 283940 - DNA, 50 bp, Artificial Sequence
  Description of Artificial Sequence: Synthetic oligonucleotide
gaaaaggctattgacttacatctggagttcttaaaacgaaacaaaaatac

SEQ ID NO: 283941 - DNA, 51 bp, Artificial Sequence
  Description of Artificial Sequence: Synthetic oligonucleotide
aaaaggctattgacttacatctggagttcttaaaacgaaacaaaaatacag

SEQ ID NO: 283942 - DNA, 50 bp, Artificial Sequence
  Description of Artificial Sequence: Synthetic oligonucleotide
aaaggctattgacttacatctggagttcttaaaacgaaacaaaaatacag

SEQ ID NO: 283943 - DNA, 49 bp, Artificial Sequence
  Description of Artificial Sequence: Synthetic oligonucleotide
aaggctattgacttacatctggagttcttaaaacgaaacaaaaatacag

SEQ ID NO: 283944 - DNA, 48 bp, Artificial Sequence
  Description of Artificial Sequence: Synthetic oligonucleotide
aggctattgacttacatctggagttcttaaaacgaaacaaaaatacag

SEQ ID NO: 283945 - DNA, 47 bp, Artificial Sequence
  Description of Artificial Sequence: Synthetic oligonucleotide
ggctattgacttacatctggagttcttaaaacgaaacaaaaatacag

SEQ ID NO: 283946 - DNA, 48 bp, Artificial Sequence
  Description of Artificial Sequence: Synthetic oligonucleotide
gctattgacttacatctggagttcttaaaacgaaacaaaaatacagac

SEQ ID NO: 283947 - DNA, 48 bp, Artificial Sequence
  Description of Artificial Sequence: Synthetic oligonucleotide
ctattgacttacatctggagttcttaaaacgaaacaaaaatacagacg

SEQ ID NO: 283948 - DNA, 49 bp, Artificial Sequence
  Description of Artificial Sequence: Synthetic oligonucleotide
tattgacttacatctggagttcttaaaacgaaacaaaaatacagacgtc

SEQ ID NO: 283949 - DNA, 48 bp, Artificial Sequence
  Description of Artificial Sequence: Synthetic oligonucleotide
attgacttacatctggagttcttaaaacgaaacaaaaatacagacgtc

SEQ ID NO: 283950 - DNA, 47 bp, Artificial Sequence
  Description of Artificial Sequence: Synthetic oligonucleotide
ttgacttacatctggagttcttaaaacgaaacaaaaatacagacgtc

SEQ ID NO: 283951 - DNA, 46 bp, Artificial Sequence
  Description of Artificial Sequence: Synthetic oligonucleotide
tgacttacatctggagttcttaaaacgaaacaaaaatacagacgtc

SEQ ID NO: 283952 - DNA, 45 bp, Artificial Sequence
  Description of Artificial Sequence: Synthetic oligonucleotide
gacttacatctggagttcttaaaacgaaacaaaaatacagacgtc

SEQ ID NO: 283953 - DNA, 47 bp, Artificial Sequence
  Description of Artificial Sequence: Synthetic oligonucleotide
acttacatctggagttcttaaaacgaaacaaaaatacagacgtcatg

SEQ ID NO: 283954 - DNA, 46 bp, Artificial Sequence
  Description of Artificial Sequence: Synthetic oligonucleotide
cttacatctggagttcttaaaacgaaacaaaaatacagacgtcatg

SEQ ID NO: 283955 - DNA, 49 bp, Artificial Sequence
  Description of Artificial Sequence: Synthetic oligonucleotide
ttacatctggagttcttaaaacgaaacaaaaatacagacgtcatgattc

SEQ ID NO: 283956 - DNA, 48 bp, Artificial Sequence
  Description of Artificial Sequence: Synthetic oligonucleotide
tacatctggagttcttaaaacgaaacaaaaatacagacgtcatgattc

SEQ ID NO: 283957 - DNA, 47 bp, Artificial Sequence
  Description of Artificial Sequence: Synthetic oligonucleotide
acatctggagttcttaaaacgaaacaaaaatacagacgtcatgattc

SEQ ID NO: 283958 - DNA, 46 bp, Artificial Sequence
  Description of Artificial Sequence: Synthetic oligonucleotide
catctggagttcttaaaacgaaacaaaaatacagacgtcatgattc

SEQ ID NO: 283959 - DNA, 53 bp, Artificial Sequence
  Description of Artificial Sequence: Synthetic oligonucleotide
atctggagttcttaaaacgaaacaaaaatacagacgtcatgattcaaaaaaac

SEQ ID NO: 283960 - DNA, 52 bp, Artificial Sequence
  Description of Artificial Sequence: Synthetic oligonucleotide
tctggagttcttaaaacgaaacaaaaatacagacgtcatgattcaaaaaaac

SEQ ID NO: 283961 - DNA, 51 bp, Artificial Sequence
  Description of Artificial Sequence: Synthetic oligonucleotide
ctggagttcttaaaacgaaacaaaaatacagacgtcatgattcaaaaaaac

SEQ ID NO: 283962 - DNA, 52 bp, Artificial Sequence
  Description of Artificial Sequence: Synthetic oligonucleotide
tggagttcttaaaacgaaacaaaaatacagacgtcatgattcaaaaaaacac

SEQ ID NO: 283963 - DNA, 51 bp, Artificial Sequence
  Description of Artificial Sequence: Synthetic oligonucleotide
ggagttcttaaaacgaaacaaaaatacagacgtcatgattcaaaaaaacac

SEQ ID NO: 283964 - DNA, 54 bp, Artificial Sequence
  Description of Artificial Sequence: Synthetic oligonucleotide
gagttcttaaaacgaaacaaaaatacagacgtcatgattcaaaaaaacactaag

SEQ ID NO: 283965 - DNA, 54 bp, Artificial Sequence
  Description of Artificial Sequence: Synthetic oligonucleotide
agttcttaaaacgaaacaaaaatacagacgtcatgattcaaaaaaacactaagg

SEQ ID NO: 283966 - DNA, 53 bp, Artificial Sequence
  Description of Artificial Sequence: Synthetic oligonucleotide
gttcttaaaacgaaacaaaaatacagacgtcatgattcaaaaaaacactaagg

SEQ ID NO: 283967 - DNA, 55 bp, Artificial Sequence
  Description of Artificial Sequence: Synthetic oligonucleotide
ttcttaaaacgaaacaaaaatacagacgtcatgattcaaaaaaacactaaggatg

SEQ ID NO: 283968 - DNA, 54 bp, Artificial Sequence
  Description of Artificial Sequence: Synthetic oligonucleotide
tcttaaaacgaaacaaaaatacagacgtcatgattcaaaaaaacactaaggatg

SEQ ID NO: 283969 - DNA, 53 bp, Artificial Sequence
  Description of Artificial Sequence: Synthetic oligonucleotide
cttaaaacgaaacaaaaatacagacgtcatgattcaaaaaaacactaaggatg

SEQ ID NO: 283970 - DNA, 53 bp, Artificial Sequence
  Description of Artificial Sequence: Synthetic oligonucleotide
ttaaaacgaaacaaaaatacagacgtcatgattcaaaaaaacactaaggatgc

SEQ ID NO: 283971 - DNA, 52 bp, Artificial Sequence
  Description of Artificial Sequence: Synthetic oligonucleotide
taaaacgaaacaaaaatacagacgtcatgattcaaaaaaacactaaggatgc

SEQ ID NO: 283972 - DNA, 51 bp, Artificial Sequence
  Description of Artificial Sequence: Synthetic oligonucleotide
aaaacgaaacaaaaatacagacgtcatgattcaaaaaaacactaaggatgc

SEQ ID NO: 283973 - DNA, 50 bp, Artificial Sequence
  Description of Artificial Sequence: Synthetic oligonucleotide
aaacgaaacaaaaatacagacgtcatgattcaaaaaaacactaaggatgc

SEQ ID NO: 283974 - DNA, 49 bp, Artificial Sequence
  Description of Artificial Sequence: Synthetic oligonucleotide
aacgaaacaaaaatacagacgtcatgattcaaaaaaacactaaggatgc

SEQ ID NO: 283975 - DNA, 48 bp, Artificial Sequence
  Description of Artificial Sequence: Synthetic oligonucleotide
acgaaacaaaaatacagacgtcatgattcaaaaaaacactaaggatgc

SEQ ID NO: 283976 - DNA, 47 bp, Artificial Sequence
  Description of Artificial Sequence: Synthetic oligonucleotide
cgaaacaaaaatacagacgtcatgattcaaaaaaacactaaggatgc

SEQ ID NO: 283977 - DNA, 48 bp, Artificial Sequence
  Description of Artificial Sequence: Synthetic oligonucleotide
gaaacaaaaatacagacgtcatgattcaaaaaaacactaaggatgcac

SEQ ID NO: 283978 - DNA, 50 bp, Artificial Sequence
  Description of Artificial Sequence: Synthetic oligonucleotide
aaacaaaaatacagacgtcatgattcaaaaaaacactaaggatgcactac

SEQ ID NO: 283979 - DNA, 49 bp, Artificial Sequence
  Description of Artificial Sequence: Synthetic oligonucleotide
aacaaaaatacagacgtcatgattcaaaaaaacactaaggatgcactac

SEQ ID NO: 283980 - DNA, 48 bp, Artificial Sequence
  Description of Artificial Sequence: Synthetic oligonucleotide
acaaaaatacagacgtcatgattcaaaaaaacactaaggatgcactac

SEQ ID NO: 283981 - DNA, 47 bp, Artificial Sequence
  Description of Artificial Sequence: Synthetic oligonucleotide
caaaaatacagacgtcatgattcaaaaaaacactaaggatgcactac

SEQ ID NO: 283982 - DNA, 47 bp, Artificial Sequence
  Description of Artificial Sequence: Synthetic oligonucleotide
aaaaatacagacgtcatgattcaaaaaaacactaaggatgcactacg

SEQ ID NO: 283983 - DNA, 46 bp, Artificial Sequence
  Description of Artificial Sequence: Synthetic oligonucleotide
aaaatacagacgtcatgattcaaaaaaacactaaggatgcactacg

SEQ ID NO: 283984 - DNA, 45 bp, Artificial Sequence
  Description of Artificial Sequence: Synthetic oligonucleotide
aaatacagacgtcatgattcaaaaaaacactaaggatgcactacg

SEQ ID NO: 283985 - DNA, 44 bp, Artificial Sequence
  Description of Artificial Sequence: Synthetic oligonucleotide
aatacagacgtcatgattcaaaaaaacactaaggatgcactacg

SEQ ID NO: 283986 - DNA, 43 bp, Artificial Sequence
  Description of Artificial Sequence: Synthetic oligonucleotide
atacagacgtcatgattcaaaaaaacactaaggatgcactacg

SEQ ID NO: 283987 - DNA, 42 bp, Artificial Sequence
  Description of Artificial Sequence: Synthetic oligonucleotide
tacagacgtcatgattcaaaaaaacactaaggatgcactacg

SEQ ID NO: 283988 - DNA, 41 bp, Artificial Sequence
  Description of Artificial Sequence: Synthetic oligonucleotide
acagacgtcatgattcaaaaaaacactaaggatgcactacg

SEQ ID NO: 283989 - DNA, 40 bp, Artificial Sequence
  Description of Artificial Sequence: Synthetic oligonucleotide
cagacgtcatgattcaaaaaaacactaaggatgcactacg

SEQ ID NO: 283990 - DNA, 40 bp, Artificial Sequence
  Description of Artificial Sequence: Synthetic oligonucleotide
agacgtcatgattcaaaaaaacactaaggatgcactacgg

SEQ ID NO: 283991 - DNA, 39 bp, Artificial Sequence
  Description of Artificial Sequence: Synthetic oligonucleotide
gacgtcatgattcaaaaaaacactaaggatgcactacgg

SEQ ID NO: 283992 - DNA, 43 bp, Artificial Sequence
  Description of Artificial Sequence: Synthetic oligonucleotide
acgtcatgattcaaaaaaacactaaggatgcactacggaattg

SEQ ID NO: 283993 - DNA, 42 bp, Artificial Sequence
  Description of Artificial Sequence: Synthetic oligonucleotide
cgtcatgattcaaaaaaacactaaggatgcactacggaattg

SEQ ID NO: 283994 - DNA, 43 bp, Artificial Sequence
  Description of Artificial Sequence: Synthetic oligonucleotide
gtcatgattcaaaaaaacactaaggatgcactacggaattgtg

SEQ ID NO: 283995 - DNA, 46 bp, Artificial Sequence
  Description of Artificial Sequence: Synthetic oligonucleotide
tcatgattcaaaaaaacactaaggatgcactacggaattgtgtatg

SEQ ID NO: 283996 - DNA, 45 bp, Artificial Sequence
  Description of Artificial Sequence: Synthetic oligonucleotide
catgattcaaaaaaacactaaggatgcactacggaattgtgtatg

SEQ ID NO: 283997 - DNA, 46 bp, Artificial Sequence
  Description of Artificial Sequence: Synthetic oligonucleotide
atgattcaaaaaaacactaaggatgcactacggaattgtgtatgtc

SEQ ID NO: 283998 - DNA, 45 bp, Artificial Sequence
  Description of Artificial Sequence: Synthetic oligonucleotide
tgattcaaaaaaacactaaggatgcactacggaattgtgtatgtc

SEQ ID NO: 283999 - DNA, 44 bp, Artificial Sequence
  Description of Artificial Sequence: Synthetic oligonucleotide
gattcaaaaaaacactaaggatgcactacggaattgtgtatgtc

SEQ ID NO: 284000 - DNA, 47 bp, Artificial Sequence
  Description of Artificial Sequence: Synthetic oligonucleotide
attcaaaaaaacactaaggatgcactacggaattgtgtatgtcaaac

SEQ ID NO: 284001 - DNA, 46 bp, Artificial Sequence
  Description of Artificial Sequence: Synthetic oligonucleotide
ttcaaaaaaacactaaggatgcactacggaattgtgtatgtcaaac

SEQ ID NO: 284002 - DNA, 45 bp, Artificial Sequence
  Description of Artificial Sequence: Synthetic oligonucleotide
tcaaaaaaacactaaggatgcactacggaattgtgtatgtcaaac

SEQ ID NO: 284003 - DNA, 44 bp, Artificial Sequence
  Description of Artificial Sequence: Synthetic oligonucleotide
caaaaaaacactaaggatgcactacggaattgtgtatgtcaaac

SEQ ID NO: 284004 - DNA, 45 bp, Artificial Sequence
  Description of Artificial Sequence: Synthetic oligonucleotide
aaaaaaacactaaggatgcactacggaattgtgtatgtcaaactg

SEQ ID NO: 284005 - DNA, 44 bp, Artificial Sequence
  Description of Artificial Sequence: Synthetic oligonucleotide
aaaaaacactaaggatgcactacggaattgtgtatgtcaaactg

SEQ ID NO: 284006 - DNA, 43 bp, Artificial Sequence
  Description of Artificial Sequence: Synthetic oligonucleotide
aaaaacactaaggatgcactacggaattgtgtatgtcaaactg

SEQ ID NO: 284007 - DNA, 42 bp, Artificial Sequence
  Description of Artificial Sequence: Synthetic oligonucleotide
aaaacactaaggatgcactacggaattgtgtatgtcaaactg

SEQ ID NO: 284008 - DNA, 41 bp, Artificial Sequence
  Description of Artificial Sequence: Synthetic oligonucleotide
aaacactaaggatgcactacggaattgtgtatgtcaaactg

SEQ ID NO: 284009 - DNA, 40 bp, Artificial Sequence
  Description of Artificial Sequence: Synthetic oligonucleotide
aacactaaggatgcactacggaattgtgtatgtcaaactg

SEQ ID NO: 284010 - DNA, 39 bp, Artificial Sequence
  Description of Artificial Sequence: Synthetic oligonucleotide
acactaaggatgcactacggaattgtgtatgtcaaactg

SEQ ID NO: 284011 - DNA, 38 bp, Artificial Sequence
  Description of Artificial Sequence: Synthetic oligonucleotide
cactaaggatgcactacggaattgtgtatgtcaaactg

SEQ ID NO: 284012 - DNA, 38 bp, Artificial Sequence
  Description of Artificial Sequence: Synthetic oligonucleotide
actaaggatgcactacggaattgtgtatgtcaaactgc

SEQ ID NO: 284013 - DNA, 37 bp, Artificial Sequence
  Description of Artificial Sequence: Synthetic oligonucleotide
ctaaggatgcactacggaattgtgtatgtcaaactgc

SEQ ID NO: 284014 - DNA, 39 bp, Artificial Sequence
  Description of Artificial Sequence: Synthetic oligonucleotide
taaggatgcactacggaattgtgtatgtcaaactgcaac

SEQ ID NO: 284015 - DNA, 38 bp, Artificial Sequence
  Description of Artificial Sequence: Synthetic oligonucleotide
aaggatgcactacggaattgtgtatgtcaaactgcaac

SEQ ID NO: 284016 - DNA, 37 bp, Artificial Sequence
  Description of Artificial Sequence: Synthetic oligonucleotide
aggatgcactacggaattgtgtatgtcaaactgcaac

SEQ ID NO: 284017 - DNA, 36 bp, Artificial Sequence
  Description of Artificial Sequence: Synthetic oligonucleotide
ggatgcactacggaattgtgtatgtcaaactgcaac

SEQ ID NO: 284018 - DNA, 36 bp, Artificial Sequence
  Description of Artificial Sequence: Synthetic oligonucleotide
gatgcactacggaattgtgtatgtcaaactgcaacc

SEQ ID NO: 284019 - DNA, 36 bp, Artificial Sequence
  Description of Artificial Sequence: Synthetic oligonucleotide
atgcactacggaattgtgtatgtcaaactgcaaccc

SEQ ID NO: 284020 - DNA, 35 bp, Artificial Sequence
  Description of Artificial Sequence: Synthetic oligonucleotide
tgcactacggaattgtgtatgtcaaactgcaaccc

SEQ ID NO: 284021 - DNA, 34 bp, Artificial Sequence
  Description of Artificial Sequence: Synthetic oligonucleotide
gcactacggaattgtgtatgtcaaactgcaaccc

SEQ ID NO: 284022 - DNA, 39 bp, Artificial Sequence
  Description of Artificial Sequence: Synthetic oligonucleotide
cactacggaattgtgtatgtcaaactgcaacccttatag

SEQ ID NO: 284023 - DNA, 39 bp, Artificial Sequence
  Description of Artificial Sequence: Synthetic oligonucleotide
actacggaattgtgtatgtcaaactgcaacccttatagc

SEQ ID NO: 284024 - DNA, 38 bp, Artificial Sequence
  Description of Artificial Sequence: Synthetic oligonucleotide
ctacggaattgtgtatgtcaaactgcaacccttatagc

SEQ ID NO: 284025 - DNA, 41 bp, Artificial Sequence
  Description of Artificial Sequence: Synthetic oligonucleotide
tacggaattgtgtatgtcaaactgcaacccttatagcaatc

SEQ ID NO: 284026 - DNA, 40 bp, Artificial Sequence
  Description of Artificial Sequence: Synthetic oligonucleotide
acggaattgtgtatgtcaaactgcaacccttatagcaatc

SEQ ID NO: 284027 - DNA, 39 bp, Artificial Sequence
  Description of Artificial Sequence: Synthetic oligonucleotide
cggaattgtgtatgtcaaactgcaacccttatagcaatc

SEQ ID NO: 284028 - DNA, 40 bp, Artificial Sequence
  Description of Artificial Sequence: Synthetic oligonucleotide
ggaattgtgtatgtcaaactgcaacccttatagcaatctc

SEQ ID NO: 284029 - DNA, 46 bp, Artificial Sequence
  Description of Artificial Sequence: Synthetic oligonucleotide
gaattgtgtatgtcaaactgcaacccttatagcaatctcttttatc

SEQ ID NO: 284030 - DNA, 46 bp, Artificial Sequence
  Description of Artificial Sequence: Synthetic oligonucleotide
aattgtgtatgtcaaactgcaacccttatagcaatctcttttatcc

SEQ ID NO: 284031 - DNA, 45 bp, Artificial Sequence
  Description of Artificial Sequence: Synthetic oligonucleotide
attgtgtatgtcaaactgcaacccttatagcaatctcttttatcc

SEQ ID NO: 284032 - DNA, 44 bp, Artificial Sequence
  Description of Artificial Sequence: Synthetic oligonucleotide
ttgtgtatgtcaaactgcaacccttatagcaatctcttttatcc

SEQ ID NO: 284033 - DNA, 43 bp, Artificial Sequence
  Description of Artificial Sequence: Synthetic oligonucleotide
tgtgtatgtcaaactgcaacccttatagcaatctcttttatcc

SEQ ID NO: 284034 - DNA, 42 bp, Artificial Sequence
  Description of Artificial Sequence: Synthetic oligonucleotide
gtgtatgtcaaactgcaacccttatagcaatctcttttatcc

SEQ ID NO: 284035 - DNA, 43 bp, Artificial Sequence
  Description of Artificial Sequence: Synthetic oligonucleotide
tgtatgtcaaactgcaacccttatagcaatctcttttatccac

SEQ ID NO: 284036 - DNA, 42 bp, Artificial Sequence
  Description of Artificial Sequence: Synthetic oligonucleotide
gtatgtcaaactgcaacccttatagcaatctcttttatccac

SEQ ID NO: 284037 - DNA, 43 bp, Artificial Sequence
  Description of Artificial Sequence: Synthetic oligonucleotide
tatgtcaaactgcaacccttatagcaatctcttttatccactg

SEQ ID NO: 284038 - DNA, 42 bp, Artificial Sequence
  Description of Artificial Sequence: Synthetic oligonucleotide
atgtcaaactgcaacccttatagcaatctcttttatccactg

SEQ ID NO: 284039 - DNA, 41 bp, Artificial Sequence
  Description of Artificial Sequence: Synthetic oligonucleotide
tgtcaaactgcaacccttatagcaatctcttttatccactg

SEQ ID NO: 284040 - DNA, 40 bp, Artificial Sequence
  Description of Artificial Sequence: Synthetic oligonucleotide
gtcaaactgcaacccttatagcaatctcttttatccactg

SEQ ID NO: 284041 - DNA, 41 bp, Artificial Sequence
  Description of Artificial Sequence: Synthetic oligonucleotide
tcaaactgcaacccttatagcaatctcttttatccactgtg

SEQ ID NO: 284042 - DNA, 40 bp, Artificial Sequence
  Description of Artificial Sequence: Synthetic oligonucleotide
caaactgcaacccttatagcaatctcttttatccactgtg

SEQ ID NO: 284043 - DNA, 40 bp, Artificial Sequence
  Description of Artificial Sequence: Synthetic oligonucleotide
aaactgcaacccttatagcaatctcttttatccactgtgg

SEQ ID NO: 284044 - DNA, 39 bp, Artificial Sequence
  Description of Artificial Sequence: Synthetic oligonucleotide
aactgcaacccttatagcaatctcttttatccactgtgg

SEQ ID NO: 284045 - DNA, 38 bp, Artificial Sequence
  Description of Artificial Sequence: Synthetic oligonucleotide
actgcaacccttatagcaatctcttttatccactgtgg

SEQ ID NO: 284046 - DNA, 37 bp, Artificial Sequence
  Description of Artificial Sequence: Synthetic oligonucleotide
ctgcaacccttatagcaatctcttttatccactgtgg

SEQ ID NO: 284047 - DNA, 37 bp, Artificial Sequence
  Description of Artificial Sequence: Synthetic oligonucleotide
tgcaacccttatagcaatctcttttatccactgtggg

SEQ ID NO: 284048 - DNA, 36 bp, Artificial Sequence
  Description of Artificial Sequence: Synthetic oligonucleotide
gcaacccttatagcaatctcttttatccactgtggg

SEQ ID NO: 284049 - DNA, 37 bp, Artificial Sequence
  Description of Artificial Sequence: Synthetic oligonucleotide
caacccttatagcaatctcttttatccactgtgggtc

SEQ ID NO: 284050 - DNA, 39 bp, Artificial Sequence
  Description of Artificial Sequence: Synthetic oligonucleotide
aacccttatagcaatctcttttatccactgtgggtcaac

SEQ ID NO: 284051 - DNA, 38 bp, Artificial Sequence
  Description of Artificial Sequence: Synthetic oligonucleotide
acccttatagcaatctcttttatccactgtgggtcaac

SEQ ID NO: 284052 - DNA, 37 bp, Artificial Sequence
  Description of Artificial Sequence: Synthetic oligonucleotide
cccttatagcaatctcttttatccactgtgggtcaac

SEQ ID NO: 284053 - DNA, 37 bp, Artificial Sequence
  Description of Artificial Sequence: Synthetic oligonucleotide
ccttatagcaatctcttttatccactgtgggtcaacc

SEQ ID NO: 284054 - DNA, 38 bp, Artificial Sequence
  Description of Artificial Sequence: Synthetic oligonucleotide
cttatagcaatctcttttatccactgtgggtcaaccag

SEQ ID NO: 284055 - DNA, 39 bp, Artificial Sequence
  Description of Artificial Sequence: Synthetic oligonucleotide
ttatagcaatctcttttatccactgtgggtcaaccagtg

SEQ ID NO: 284056 - DNA, 38 bp, Artificial Sequence
  Description of Artificial Sequence: Synthetic oligonucleotide
tatagcaatctcttttatccactgtgggtcaaccagtg

SEQ ID NO: 284057 - DNA, 37 bp, Artificial Sequence
  Description of Artificial Sequence: Synthetic oligonucleotide
atagcaatctcttttatccactgtgggtcaaccagtg

SEQ ID NO: 284058 - DNA, 36 bp, Artificial Sequence
  Description of Artificial Sequence: Synthetic oligonucleotide
tagcaatctcttttatccactgtgggtcaaccagtg

SEQ ID NO: 284059 - DNA, 35 bp, Artificial Sequence
  Description of Artificial Sequence: Synthetic oligonucleotide
agcaatctcttttatccactgtgggtcaaccagtg

SEQ ID NO: 284060 - DNA, 34 bp, Artificial Sequence
  Description of Artificial Sequence: Synthetic oligonucleotide
gcaatctcttttatccactgtgggtcaaccagtg

SEQ ID NO: 284061 - DNA, 35 bp, Artificial Sequence
  Description of Artificial Sequence: Synthetic oligonucleotide
caatctcttttatccactgtgggtcaaccagtgtc

SEQ ID NO: 284062 - DNA, 35 bp, Artificial Sequence
  Description of Artificial Sequence: Synthetic oligonucleotide
aatctcttttatccactgtgggtcaaccagtgtcc

SEQ ID NO: 284063 - DNA, 34 bp, Artificial Sequence
  Description of Artificial Sequence: Synthetic oligonucleotide
atctcttttatccactgtgggtcaaccagtgtcc

SEQ ID NO: 284064 - DNA, 33 bp, Artificial Sequence
  Description of Artificial Sequence: Synthetic oligonucleotide
tctcttttatccactgtgggtcaaccagtgtcc

SEQ ID NO: 284065 - DNA, 32 bp, Artificial Sequence
  Description of Artificial Sequence: Synthetic oligonucleotide
ctcttttatccactgtgggtcaaccagtgtcc

SEQ ID NO: 284066 - DNA, 33 bp, Artificial Sequence
  Description of Artificial Sequence: Synthetic oligonucleotide
tcttttatccactgtgggtcaaccagtgtccag

SEQ ID NO: 284067 - DNA, 32 bp, Artificial Sequence
  Description of Artificial Sequence: Synthetic oligonucleotide
cttttatccactgtgggtcaaccagtgtccag

SEQ ID NO: 284068 - DNA, 35 bp, Artificial Sequence
  Description of Artificial Sequence: Synthetic oligonucleotide
ttttatccactgtgggtcaaccagtgtccagtttc

SEQ ID NO: 284069 - DNA, 34 bp, Artificial Sequence
  Description of Artificial Sequence: Synthetic oligonucleotide
tttatccactgtgggtcaaccagtgtccagtttc

SEQ ID NO: 284070 - DNA, 33 bp, Artificial Sequence
  Description of Artificial Sequence: Synthetic oligonucleotide
ttatccactgtgggtcaaccagtgtccagtttc

SEQ ID NO: 284071 - DNA, 32 bp, Artificial Sequence
  Description of Artificial Sequence: Synthetic oligonucleotide
tatccactgtgggtcaaccagtgtccagtttc

SEQ ID NO: 284072 - DNA, 31 bp, Artificial Sequence
  Description of Artificial Sequence: Synthetic oligonucleotide
atccactgtgggtcaaccagtgtccagtttc

SEQ ID NO: 284073 - DNA, 30 bp, Artificial Sequence
  Description of Artificial Sequence: Synthetic oligonucleotide
tccactgtgggtcaaccagtgtccagtttc

SEQ ID NO: 284074 - DNA, 29 bp, Artificial Sequence
  Description of Artificial Sequence: Synthetic oligonucleotide
ccactgtgggtcaaccagtgtccagtttc

SEQ ID NO: 284075 - DNA, 32 bp, Artificial Sequence
  Description of Artificial Sequence: Synthetic oligonucleotide
cactgtgggtcaaccagtgtccagtttctaag

SEQ ID NO: 284076 - DNA, 33 bp, Artificial Sequence
  Description of Artificial Sequence: Synthetic oligonucleotide
actgtgggtcaaccagtgtccagtttctaagag

SEQ ID NO: 284077 - DNA, 32 bp, Artificial Sequence
  Description of Artificial Sequence: Synthetic oligonucleotide
ctgtgggtcaaccagtgtccagtttctaagag

SEQ ID NO: 284078 - DNA, 39 bp, Artificial Sequence
  Description of Artificial Sequence: Synthetic oligonucleotide
tgtgggtcaaccagtgtccagtttctaagagataatatg

SEQ ID NO: 284079 - DNA, 38 bp, Artificial Sequence
  Description of Artificial Sequence: Synthetic oligonucleotide
gtgggtcaaccagtgtccagtttctaagagataatatg

SEQ ID NO: 284080 - DNA, 38 bp, Artificial Sequence
  Description of Artificial Sequence: Synthetic oligonucleotide
tgggtcaaccagtgtccagtttctaagagataatatgg

SEQ ID NO: 284081 - DNA, 37 bp, Artificial Sequence
  Description of Artificial Sequence: Synthetic oligonucleotide
gggtcaaccagtgtccagtttctaagagataatatgg

SEQ ID NO: 284082 - DNA, 40 bp, Artificial Sequence
  Description of Artificial Sequence: Synthetic oligonucleotide
ggtcaaccagtgtccagtttctaagagataatatggaatg

SEQ ID NO: 284083 - DNA, 40 bp, Artificial Sequence
  Description of Artificial Sequence: Synthetic oligonucleotide
gtcaaccagtgtccagtttctaagagataatatggaatgg

SEQ ID NO: 284084 - DNA, 43 bp, Artificial Sequence
  Description of Artificial Sequence: Synthetic oligonucleotide
tcaaccagtgtccagtttctaagagataatatggaatggtaag

SEQ ID NO: 284085 - DNA, 42 bp, Artificial Sequence
  Description of Artificial Sequence: Synthetic oligonucleotide
caaccagtgtccagtttctaagagataatatggaatggtaag

SEQ ID NO: 284086 - DNA, 42 bp, Artificial Sequence
  Description of Artificial Sequence: Synthetic oligonucleotide
aaccagtgtccagtttctaagagataatatggaatggtaagc

SEQ ID NO: 284087 - DNA, 41 bp, Artificial Sequence
  Description of Artificial Sequence: Synthetic oligonucleotide
accagtgtccagtttctaagagataatatggaatggtaagc

SEQ ID NO: 284088 - DNA, 40 bp, Artificial Sequence
  Description of Artificial Sequence: Synthetic oligonucleotide
ccagtgtccagtttctaagagataatatggaatggtaagc

SEQ ID NO: 284089 - DNA, 40 bp, Artificial Sequence
  Description of Artificial Sequence: Synthetic oligonucleotide
cagtgtccagtttctaagagataatatggaatggtaagcc

SEQ ID NO: 284090 - DNA, 41 bp, Artificial Sequence
  Description of Artificial Sequence: Synthetic oligonucleotide
agtgtccagtttctaagagataatatggaatggtaagccag

SEQ ID NO: 284091 - DNA, 40 bp, Artificial Sequence
  Description of Artificial Sequence: Synthetic oligonucleotide
gtgtccagtttctaagagataatatggaatggtaagccag

SEQ ID NO: 284092 - DNA, 41 bp, Artificial Sequence
  Description of Artificial Sequence: Synthetic oligonucleotide
tgtccagtttctaagagataatatggaatggtaagccagag

SEQ ID NO: 284093 - DNA, 40 bp, Artificial Sequence
  Description of Artificial Sequence: Synthetic oligonucleotide
gtccagtttctaagagataatatggaatggtaagccagag

SEQ ID NO: 284094 - DNA, 40 bp, Artificial Sequence
  Description of Artificial Sequence: Synthetic oligonucleotide
tccagtttctaagagataatatggaatggtaagccagagc

SEQ ID NO: 284095 - DNA, 39 bp, Artificial Sequence
  Description of Artificial Sequence: Synthetic oligonucleotide
ccagtttctaagagataatatggaatggtaagccagagc

SEQ ID NO: 284096 - DNA, 39 bp, Artificial Sequence
  Description of Artificial Sequence: Synthetic oligonucleotide
cagtttctaagagataatatggaatggtaagccagagcg

SEQ ID NO: 284097 - DNA, 40 bp, Artificial Sequence
  Description of Artificial Sequence: Synthetic oligonucleotide
agtttctaagagataatatggaatggtaagccagagcgac

SEQ ID NO: 284098 - DNA, 39 bp, Artificial Sequence
  Description of Artificial Sequence: Synthetic oligonucleotide
gtttctaagagataatatggaatggtaagccagagcgac

SEQ ID NO: 284099 - DNA, 42 bp, Artificial Sequence
  Description of Artificial Sequence: Synthetic oligonucleotide
tttctaagagataatatggaatggtaagccagagcgactaac

SEQ ID NO: 284100 - DNA, 41 bp, Artificial Sequence
  Description of Artificial Sequence: Synthetic oligonucleotide
ttctaagagataatatggaatggtaagccagagcgactaac

SEQ ID NO: 284101 - DNA, 40 bp, Artificial Sequence
  Description of Artificial Sequence: Synthetic oligonucleotide
tctaagagataatatggaatggtaagccagagcgactaac

SEQ ID NO: 284102 - DNA, 39 bp, Artificial Sequence
  Description of Artificial Sequence: Synthetic oligonucleotide
ctaagagataatatggaatggtaagccagagcgactaac

SEQ ID NO: 284103 - DNA, 40 bp, Artificial Sequence
  Description of Artificial Sequence: Synthetic oligonucleotide
taagagataatatggaatggtaagccagagcgactaactg

SEQ ID NO: 284104 - DNA, 39 bp, Artificial Sequence
  Description of Artificial Sequence: Synthetic oligonucleotide
aagagataatatggaatggtaagccagagcgactaactg

SEQ ID NO: 284105 - DNA, 38 bp, Artificial Sequence
  Description of Artificial Sequence: Synthetic oligonucleotide
agagataatatggaatggtaagccagagcgactaactg

SEQ ID NO: 284106 - DNA, 37 bp, Artificial Sequence
  Description of Artificial Sequence: Synthetic oligonucleotide
gagataatatggaatggtaagccagagcgactaactg

SEQ ID NO: 284107 - DNA, 37 bp, Artificial Sequence
  Description of Artificial Sequence: Synthetic oligonucleotide
agataatatggaatggtaagccagagcgactaactgg

SEQ ID NO: 284108 - DNA, 36 bp, Artificial Sequence
  Description of Artificial Sequence: Synthetic oligonucleotide
gataatatggaatggtaagccagagcgactaactgg

SEQ ID NO: 284109 - DNA, 36 bp, Artificial Sequence
  Description of Artificial Sequence: Synthetic oligonucleotide
ataatatggaatggtaagccagagcgactaactggc

SEQ ID NO: 284110 - DNA, 35 bp, Artificial Sequence
  Description of Artificial Sequence: Synthetic oligonucleotide
taatatggaatggtaagccagagcgactaactggc

SEQ ID NO: 284111 - DNA, 34 bp, Artificial Sequence
  Description of Artificial Sequence: Synthetic oligonucleotide
aatatggaatggtaagccagagcgactaactggc

SEQ ID NO: 284112 - DNA, 33 bp, Artificial Sequence
  Description of Artificial Sequence: Synthetic oligonucleotide
atatggaatggtaagccagagcgactaactggc

SEQ ID NO: 284113 - DNA, 32 bp, Artificial Sequence
  Description of Artificial Sequence: Synthetic oligonucleotide
tatggaatggtaagccagagcgactaactggc

SEQ ID NO: 284114 - DNA, 31 bp, Artificial Sequence
  Description of Artificial Sequence: Synthetic oligonucleotide
atggaatggtaagccagagcgactaactggc

SEQ ID NO: 284115 - DNA, 30 bp, Artificial Sequence
  Description of Artificial Sequence: Synthetic oligonucleotide
tggaatggtaagccagagcgactaactggc

SEQ ID NO: 284116 - DNA, 29 bp, Artificial Sequence
  Description of Artificial Sequence: Synthetic oligonucleotide
ggaatggtaagccagagcgactaactggc

SEQ ID NO: 284117 - DNA, 29 bp, Artificial Sequence
  Description of Artificial Sequence: Synthetic oligonucleotide
gaatggtaagccagagcgactaactggcc

SEQ ID NO: 284118 - DNA, 37 bp, Artificial Sequence
  Description of Artificial Sequence: Synthetic oligonucleotide
aatggtaagccagagcgactaactggccaaaatttag

SEQ ID NO: 284119 - DNA, 36 bp, Artificial Sequence
  Description of Artificial Sequence: Synthetic oligonucleotide
atggtaagccagagcgactaactggccaaaatttag

SEQ ID NO: 284120 - DNA, 35 bp, Artificial Sequence
  Description of Artificial Sequence: Synthetic oligonucleotide
tggtaagccagagcgactaactggccaaaatttag

SEQ ID NO: 284121 - DNA, 34 bp, Artificial Sequence
  Description of Artificial Sequence: Synthetic oligonucleotide
ggtaagccagagcgactaactggccaaaatttag

SEQ ID NO: 284122 - DNA, 35 bp, Artificial Sequence
  Description of Artificial Sequence: Synthetic oligonucleotide
gtaagccagagcgactaactggccaaaatttagtg

SEQ ID NO: 284123 - DNA, 35 bp, Artificial Sequence
  Description of Artificial Sequence: Synthetic oligonucleotide
taagccagagcgactaactggccaaaatttagtgc

SEQ ID NO: 284124 - DNA, 34 bp, Artificial Sequence
  Description of Artificial Sequence: Synthetic oligonucleotide
aagccagagcgactaactggccaaaatttagtgc

SEQ ID NO: 284125 - DNA, 33 bp, Artificial Sequence
  Description of Artificial Sequence: Synthetic oligonucleotide
agccagagcgactaactggccaaaatttagtgc

SEQ ID NO: 284126 - DNA, 32 bp, Artificial Sequence
  Description of Artificial Sequence: Synthetic oligonucleotide
gccagagcgactaactggccaaaatttagtgc

SEQ ID NO: 284127 - DNA, 34 bp, Artificial Sequence
  Description of Artificial Sequence: Synthetic oligonucleotide
ccagagcgactaactggccaaaatttagtgctac

SEQ ID NO: 284128 - DNA, 35 bp, Artificial Sequence
  Description of Artificial Sequence: Synthetic oligonucleotide
cagagcgactaactggccaaaatttagtgctacag

SEQ ID NO: 284129 - DNA, 35 bp, Artificial Sequence
  Description of Artificial Sequence: Synthetic oligonucleotide
agagcgactaactggccaaaatttagtgctacagc

SEQ ID NO: 284130 - DNA, 34 bp, Artificial Sequence
  Description of Artificial Sequence: Synthetic oligonucleotide
gagcgactaactggccaaaatttagtgctacagc

SEQ ID NO: 284131 - DNA, 34 bp, Artificial Sequence
  Description of Artificial Sequence: Synthetic oligonucleotide
agcgactaactggccaaaatttagtgctacagcg

SEQ ID NO: 284132 - DNA, 33 bp, Artificial Sequence
  Description of Artificial Sequence: Synthetic oligonucleotide
gcgactaactggccaaaatttagtgctacagcg

SEQ ID NO: 284133 - DNA, 34 bp, Artificial Sequence
  Description of Artificial Sequence: Synthetic oligonucleotide
cgactaactggccaaaatttagtgctacagcgag

SEQ ID NO: 284134 - DNA, 37 bp, Artificial Sequence
  Description of Artificial Sequence: Synthetic oligonucleotide
gactaactggccaaaatttagtgctacagcgagtttg

SEQ ID NO: 284135 - DNA, 37 bp, Artificial Sequence
  Description of Artificial Sequence: Synthetic oligonucleotide
actaactggccaaaatttagtgctacagcgagtttgg

SEQ ID NO: 284136 - DNA, 36 bp, Artificial Sequence
  Description of Artificial Sequence: Synthetic oligonucleotide
ctaactggccaaaatttagtgctacagcgagtttgg

SEQ ID NO: 284137 - DNA, 36 bp, Artificial Sequence
  Description of Artificial Sequence: Synthetic oligonucleotide
taactggccaaaatttagtgctacagcgagtttggg

SEQ ID NO: 284138 - DNA, 35 bp, Artificial Sequence
  Description of Artificial Sequence: Synthetic oligonucleotide
aactggccaaaatttagtgctacagcgagtttggg

SEQ ID NO: 284139 - DNA, 34 bp, Artificial Sequence
  Description of Artificial Sequence: Synthetic oligonucleotide
actggccaaaatttagtgctacagcgagtttggg

SEQ ID NO: 284140 - DNA, 33 bp, Artificial Sequence
  Description of Artificial Sequence: Synthetic oligonucleotide
ctggccaaaatttagtgctacagcgagtttggg

SEQ ID NO: 284141 - DNA, 34 bp, Artificial Sequence
  Description of Artificial Sequence: Synthetic oligonucleotide
tggccaaaatttagtgctacagcgagtttgggtc

SEQ ID NO: 284142 - DNA, 33 bp, Artificial Sequence
  Description of Artificial Sequence: Synthetic oligonucleotide
ggccaaaatttagtgctacagcgagtttgggtc

SEQ ID NO: 284143 - DNA, 38 bp, Artificial Sequence
  Description of Artificial Sequence: Synthetic oligonucleotide
gccaaaatttagtgctacagcgagtttgggtctaattc

SEQ ID NO: 284144 - DNA, 42 bp, Artificial Sequence
  Description of Artificial Sequence: Synthetic oligonucleotide
ccaaaatttagtgctacagcgagtttgggtctaattcatatg

SEQ ID NO: 284145 - DNA, 42 bp, Artificial Sequence
  Description of Artificial Sequence: Synthetic oligonucleotide
caaaatttagtgctacagcgagtttgggtctaattcatatgg

SEQ ID NO: 284146 - DNA, 42 bp, Artificial Sequence
  Description of Artificial Sequence: Synthetic oligonucleotide
aaaatttagtgctacagcgagtttgggtctaattcatatggg

SEQ ID NO: 284147 - DNA, 41 bp, Artificial Sequence
  Description of Artificial Sequence: Synthetic oligonucleotide
aaatttagtgctacagcgagtttgggtctaattcatatggg

SEQ ID NO: 284148 - DNA, 40 bp, Artificial Sequence
  Description of Artificial Sequence: Synthetic oligonucleotide
aatttagtgctacagcgagtttgggtctaattcatatggg

SEQ ID NO: 284149 - DNA, 39 bp, Artificial Sequence
  Description of Artificial Sequence: Synthetic oligonucleotide
atttagtgctacagcgagtttgggtctaattcatatggg

SEQ ID NO: 284150 - DNA, 38 bp, Artificial Sequence
  Description of Artificial Sequence: Synthetic oligonucleotide
tttagtgctacagcgagtttgggtctaattcatatggg

SEQ ID NO: 284151 - DNA, 37 bp, Artificial Sequence
  Description of Artificial Sequence: Synthetic oligonucleotide
ttagtgctacagcgagtttgggtctaattcatatggg

SEQ ID NO: 284152 - DNA, 36 bp, Artificial Sequence
  Description of Artificial Sequence: Synthetic oligonucleotide
tagtgctacagcgagtttgggtctaattcatatggg

SEQ ID NO: 284153 - DNA, 35 bp, Artificial Sequence
  Description of Artificial Sequence: Synthetic oligonucleotide
agtgctacagcgagtttgggtctaattcatatggg

SEQ ID NO: 284154 - DNA, 34 bp, Artificial Sequence
  Description of Artificial Sequence: Synthetic oligonucleotide
gtgctacagcgagtttgggtctaattcatatggg

SEQ ID NO: 284155 - DNA, 35 bp, Artificial Sequence
  Description of Artificial Sequence: Synthetic oligonucleotide
tgctacagcgagtttgggtctaattcatatgggtc

SEQ ID NO: 284156 - DNA, 34 bp, Artificial Sequence
  Description of Artificial Sequence: Synthetic oligonucleotide
gctacagcgagtttgggtctaattcatatgggtc

SEQ ID NO: 284157 - DNA, 36 bp, Artificial Sequence
  Description of Artificial Sequence: Synthetic oligonucleotide
ctacagcgagtttgggtctaattcatatgggtcatg

SEQ ID NO: 284158 - DNA, 41 bp, Artificial Sequence
  Description of Artificial Sequence: Synthetic oligonucleotide
tacagcgagtttgggtctaattcatatgggtcatgataaag

SEQ ID NO: 284159 - DNA, 40 bp, Artificial Sequence
  Description of Artificial Sequence: Synthetic oligonucleotide
acagcgagtttgggtctaattcatatgggtcatgataaag

SEQ ID NO: 284160 - DNA, 39 bp, Artificial Sequence
  Description of Artificial Sequence: Synthetic oligonucleotide
cagcgagtttgggtctaattcatatgggtcatgataaag

SEQ ID NO: 284161 - DNA, 41 bp, Artificial Sequence
  Description of Artificial Sequence: Synthetic oligonucleotide
agcgagtttgggtctaattcatatgggtcatgataaagaag

SEQ ID NO: 284162 - DNA, 40 bp, Artificial Sequence
  Description of Artificial Sequence: Synthetic oligonucleotide
gcgagtttgggtctaattcatatgggtcatgataaagaag

SEQ ID NO: 284163 - DNA, 40 bp, Artificial Sequence
  Description of Artificial Sequence: Synthetic oligonucleotide
cgagtttgggtctaattcatatgggtcatgataaagaagc

SEQ ID NO: 284164 - DNA, 44 bp, Artificial Sequence
  Description of Artificial Sequence: Synthetic oligonucleotide
gagtttgggtctaattcatatgggtcatgataaagaagcaatac

SEQ ID NO: 284165 - DNA, 45 bp, Artificial Sequence
  Description of Artificial Sequence: Synthetic oligonucleotide
agtttgggtctaattcatatgggtcatgataaagaagcaatacag

SEQ ID NO: 284166 - DNA, 44 bp, Artificial Sequence
  Description of Artificial Sequence: Synthetic oligonucleotide
gtttgggtctaattcatatgggtcatgataaagaagcaatacag

SEQ ID NO: 284167 - DNA, 49 bp, Artificial Sequence
  Description of Artificial Sequence: Synthetic oligonucleotide
tttgggtctaattcatatgggtcatgataaagaagcaatacagttaaag

SEQ ID NO: 284168 - DNA, 48 bp, Artificial Sequence
  Description of Artificial Sequence: Synthetic oligonucleotide
ttgggtctaattcatatgggtcatgataaagaagcaatacagttaaag

SEQ ID NO: 284169 - DNA, 47 bp, Artificial Sequence
  Description of Artificial Sequence: Synthetic oligonucleotide
tgggtctaattcatatgggtcatgataaagaagcaatacagttaaag

SEQ ID NO: 284170 - DNA, 46 bp, Artificial Sequence
  Description of Artificial Sequence: Synthetic oligonucleotide
gggtctaattcatatgggtcatgataaagaagcaatacagttaaag

SEQ ID NO: 284171 - DNA, 46 bp, Artificial Sequence
  Description of Artificial Sequence: Synthetic oligonucleotide
ggtctaattcatatgggtcatgataaagaagcaatacagttaaagg

SEQ ID NO: 284172 - DNA, 46 bp, Artificial Sequence
  Description of Artificial Sequence: Synthetic oligonucleotide
gtctaattcatatgggtcatgataaagaagcaatacagttaaaggc

SEQ ID NO: 284173 - DNA, 48 bp, Artificial Sequence
  Description of Artificial Sequence: Synthetic oligonucleotide
tctaattcatatgggtcatgataaagaagcaatacagttaaaggcaac

SEQ ID NO: 284174 - DNA, 47 bp, Artificial Sequence
  Description of Artificial Sequence: Synthetic oligonucleotide
ctaattcatatgggtcatgataaagaagcaatacagttaaaggcaac

SEQ ID NO: 284175 - DNA, 50 bp, Artificial Sequence
  Description of Artificial Sequence: Synthetic oligonucleotide
taattcatatgggtcatgataaagaagcaatacagttaaaggcaacatag

SEQ ID NO: 284176 - DNA, 49 bp, Artificial Sequence
  Description of Artificial Sequence: Synthetic oligonucleotide
aattcatatgggtcatgataaagaagcaatacagttaaaggcaacatag

SEQ ID NO: 284177 - DNA, 48 bp, Artificial Sequence
  Description of Artificial Sequence: Synthetic oligonucleotide
attcatatgggtcatgataaagaagcaatacagttaaaggcaacatag

SEQ ID NO: 284178 - DNA, 47 bp, Artificial Sequence
  Description of Artificial Sequence: Synthetic oligonucleotide
ttcatatgggtcatgataaagaagcaatacagttaaaggcaacatag

SEQ ID NO: 284179 - DNA, 46 bp, Artificial Sequence
  Description of Artificial Sequence: Synthetic oligonucleotide
tcatatgggtcatgataaagaagcaatacagttaaaggcaacatag

SEQ ID NO: 284180 - DNA, 45 bp, Artificial Sequence
  Description of Artificial Sequence: Synthetic oligonucleotide
catatgggtcatgataaagaagcaatacagttaaaggcaacatag

SEQ ID NO: 284181 - DNA, 45 bp, Artificial Sequence
  Description of Artificial Sequence: Synthetic oligonucleotide
atatgggtcatgataaagaagcaatacagttaaaggcaacatagc

SEQ ID NO: 284182 - DNA, 44 bp, Artificial Sequence
  Description of Artificial Sequence: Synthetic oligonucleotide
tatgggtcatgataaagaagcaatacagttaaaggcaacatagc

SEQ ID NO: 284183 - DNA, 43 bp, Artificial Sequence
  Description of Artificial Sequence: Synthetic oligonucleotide
atgggtcatgataaagaagcaatacagttaaaggcaacatagc

SEQ ID NO: 284184 - DNA, 42 bp, Artificial Sequence
  Description of Artificial Sequence: Synthetic oligonucleotide
tgggtcatgataaagaagcaatacagttaaaggcaacatagc

SEQ ID NO: 284185 - DNA, 41 bp, Artificial Sequence
  Description of Artificial Sequence: Synthetic oligonucleotide
gggtcatgataaagaagcaatacagttaaaggcaacatagc

SEQ ID NO: 284186 - DNA, 43 bp, Artificial Sequence
  Description of Artificial Sequence: Synthetic oligonucleotide
ggtcatgataaagaagcaatacagttaaaggcaacatagcttc

SEQ ID NO: 284187 - DNA, 43 bp, Artificial Sequence
  Description of Artificial Sequence: Synthetic oligonucleotide
gtcatgataaagaagcaatacagttaaaggcaacatagcttcc

SEQ ID NO: 284188 - DNA, 43 bp, Artificial Sequence
  Description of Artificial Sequence: Synthetic oligonucleotide
tcatgataaagaagcaatacagttaaaggcaacatagcttccc

SEQ ID NO: 284189 - DNA, 42 bp, Artificial Sequence
  Description of Artificial Sequence: Synthetic oligonucleotide
catgataaagaagcaatacagttaaaggcaacatagcttccc

SEQ ID NO: 284190 - DNA, 44 bp, Artificial Sequence
  Description of Artificial Sequence: Synthetic oligonucleotide
atgataaagaagcaatacagttaaaggcaacatagcttcccaag

SEQ ID NO: 284191 - DNA, 43 bp, Artificial Sequence
  Description of Artificial Sequence: Synthetic oligonucleotide
tgataaagaagcaatacagttaaaggcaacatagcttcccaag

SEQ ID NO: 284192 - DNA, 42 bp, Artificial Sequence
  Description of Artificial Sequence: Synthetic oligonucleotide
gataaagaagcaatacagttaaaggcaacatagcttcccaag

SEQ ID NO: 284193 - DNA, 42 bp, Artificial Sequence
  Description of Artificial Sequence: Synthetic oligonucleotide
ataaagaagcaatacagttaaaggcaacatagcttcccaagc

SEQ ID NO: 284194 - DNA, 41 bp, Artificial Sequence
  Description of Artificial Sequence: Synthetic oligonucleotide
taaagaagcaatacagttaaaggcaacatagcttcccaagc

SEQ ID NO: 284195 - DNA, 40 bp, Artificial Sequence
  Description of Artificial Sequence: Synthetic oligonucleotide
aaagaagcaatacagttaaaggcaacatagcttcccaagc

SEQ ID NO: 284196 - DNA, 39 bp, Artificial Sequence
  Description of Artificial Sequence: Synthetic oligonucleotide
aagaagcaatacagttaaaggcaacatagcttcccaagc

SEQ ID NO: 284197 - DNA, 38 bp, Artificial Sequence
  Description of Artificial Sequence: Synthetic oligonucleotide
agaagcaatacagttaaaggcaacatagcttcccaagc

SEQ ID NO: 284198 - DNA, 37 bp, Artificial Sequence
  Description of Artificial Sequence: Synthetic oligonucleotide
gaagcaatacagttaaaggcaacatagcttcccaagc

SEQ ID NO: 284199 - DNA, 40 bp, Artificial Sequence
  Description of Artificial Sequence: Synthetic oligonucleotide
aagcaatacagttaaaggcaacatagcttcccaagcatac

SEQ ID NO: 284200 - DNA, 39 bp, Artificial Sequence
  Description of Artificial Sequence: Synthetic oligonucleotide
agcaatacagttaaaggcaacatagcttcccaagcatac

SEQ ID NO: 284201 - DNA, 38 bp, Artificial Sequence
  Description of Artificial Sequence: Synthetic oligonucleotide
gcaatacagttaaaggcaacatagcttcccaagcatac

SEQ ID NO: 284202 - DNA, 40 bp, Artificial Sequence
  Description of Artificial Sequence: Synthetic oligonucleotide
caatacagttaaaggcaacatagcttcccaagcatacttc

SEQ ID NO: 284203 - DNA, 41 bp, Artificial Sequence
  Description of Artificial Sequence: Synthetic oligonucleotide
aatacagttaaaggcaacatagcttcccaagcatacttctc

SEQ ID NO: 284204 - DNA, 40 bp, Artificial Sequence
  Description of Artificial Sequence: Synthetic oligonucleotide
atacagttaaaggcaacatagcttcccaagcatacttctc

SEQ ID NO: 284205 - DNA, 39 bp, Artificial Sequence
  Description of Artificial Sequence: Synthetic oligonucleotide
tacagttaaaggcaacatagcttcccaagcatacttctc

SEQ ID NO: 284206 - DNA, 38 bp, Artificial Sequence
  Description of Artificial Sequence: Synthetic oligonucleotide
acagttaaaggcaacatagcttcccaagcatacttctc

SEQ ID NO: 284207 - DNA, 37 bp, Artificial Sequence
  Description of Artificial Sequence: Synthetic oligonucleotide
cagttaaaggcaacatagcttcccaagcatacttctc

SEQ ID NO: 284208 - DNA, 37 bp, Artificial Sequence
  Description of Artificial Sequence: Synthetic oligonucleotide
agttaaaggcaacatagcttcccaagcatacttctcg

SEQ ID NO: 284209 - DNA, 36 bp, Artificial Sequence
  Description of Artificial Sequence: Synthetic oligonucleotide
gttaaaggcaacatagcttcccaagcatacttctcg

SEQ ID NO: 284210 - DNA, 37 bp, Artificial Sequence
  Description of Artificial Sequence: Synthetic oligonucleotide
ttaaaggcaacatagcttcccaagcatacttctcgag

SEQ ID NO: 284211 - DNA, 36 bp, Artificial Sequence
  Description of Artificial Sequence: Synthetic oligonucleotide
taaaggcaacatagcttcccaagcatacttctcgag

SEQ ID NO: 284212 - DNA, 35 bp, Artificial Sequence
  Description of Artificial Sequence: Synthetic oligonucleotide
aaaggcaacatagcttcccaagcatacttctcgag

SEQ ID NO: 284213 - DNA, 34 bp, Artificial Sequence
  Description of Artificial Sequence: Synthetic oligonucleotide
aaggcaacatagcttcccaagcatacttctcgag

SEQ ID NO: 284214 - DNA, 33 bp, Artificial Sequence
  Description of Artificial Sequence: Synthetic oligonucleotide
aggcaacatagcttcccaagcatacttctcgag

SEQ ID NO: 284215 - DNA, 32 bp, Artificial Sequence
  Description of Artificial Sequence: Synthetic oligonucleotide
ggcaacatagcttcccaagcatacttctcgag

SEQ ID NO: 284216 - DNA, 32 bp, Artificial Sequence
  Description of Artificial Sequence: Synthetic oligonucleotide
gcaacatagcttcccaagcatacttctcgagg

SEQ ID NO: 284217 - DNA, 34 bp, Artificial Sequence
  Description of Artificial Sequence: Synthetic oligonucleotide
caacatagcttcccaagcatacttctcgaggatc

SEQ ID NO: 284218 - DNA, 35 bp, Artificial Sequence
  Description of Artificial Sequence: Synthetic oligonucleotide
aacatagcttcccaagcatacttctcgaggatcag

SEQ ID NO: 284219 - DNA, 34 bp, Artificial Sequence
  Description of Artificial Sequence: Synthetic oligonucleotide
acatagcttcccaagcatacttctcgaggatcag

SEQ ID NO: 284220 - DNA, 33 bp, Artificial Sequence
  Description of Artificial Sequence: Synthetic oligonucleotide
catagcttcccaagcatacttctcgaggatcag

SEQ ID NO: 284221 - DNA, 33 bp, Artificial Sequence
  Description of Artificial Sequence: Synthetic oligonucleotide
atagcttcccaagcatacttctcgaggatcagc

SEQ ID NO: 284222 - DNA, 32 bp, Artificial Sequence
  Description of Artificial Sequence: Synthetic oligonucleotide
tagcttcccaagcatacttctcgaggatcagc

SEQ ID NO: 284223 - DNA, 31 bp, Artificial Sequence
  Description of Artificial Sequence: Synthetic oligonucleotide
agcttcccaagcatacttctcgaggatcagc

SEQ ID NO: 284224 - DNA, 30 bp, Artificial Sequence
  Description of Artificial Sequence: Synthetic oligonucleotide
gcttcccaagcatacttctcgaggatcagc

SEQ ID NO: 284225 - DNA, 30 bp, Artificial Sequence
  Description of Artificial Sequence: Synthetic oligonucleotide
cttcccaagcatacttctcgaggatcagcg

SEQ ID NO: 284226 - DNA, 33 bp, Artificial Sequence
  Description of Artificial Sequence: Synthetic oligonucleotide
ttcccaagcatacttctcgaggatcagcgtatc

SEQ ID NO: 284227 - DNA, 32 bp, Artificial Sequence
  Description of Artificial Sequence: Synthetic oligonucleotide
tcccaagcatacttctcgaggatcagcgtatc

SEQ ID NO: 284228 - DNA, 31 bp, Artificial Sequence
  Description of Artificial Sequence: Synthetic oligonucleotide
cccaagcatacttctcgaggatcagcgtatc

SEQ ID NO: 284229 - DNA, 32 bp, Artificial Sequence
  Description of Artificial Sequence: Synthetic oligonucleotide
ccaagcatacttctcgaggatcagcgtatcag

SEQ ID NO: 284230 - DNA, 32 bp, Artificial Sequence
  Description of Artificial Sequence: Synthetic oligonucleotide
caagcatacttctcgaggatcagcgtatcagg

SEQ ID NO: 284231 - DNA, 34 bp, Artificial Sequence
  Description of Artificial Sequence: Synthetic oligonucleotide
aagcatacttctcgaggatcagcgtatcaggaac

SEQ ID NO: 284232 - DNA, 33 bp, Artificial Sequence
  Description of Artificial Sequence: Synthetic oligonucleotide
agcatacttctcgaggatcagcgtatcaggaac

SEQ ID NO: 284233 - DNA, 32 bp, Artificial Sequence
  Description of Artificial Sequence: Synthetic oligonucleotide
gcatacttctcgaggatcagcgtatcaggaac

SEQ ID NO: 284234 - DNA, 32 bp, Artificial Sequence
  Description of Artificial Sequence: Synthetic oligonucleotide
catacttctcgaggatcagcgtatcaggaacg

SEQ ID NO: 284235 - DNA, 33 bp, Artificial Sequence
  Description of Artificial Sequence: Synthetic oligonucleotide
atacttctcgaggatcagcgtatcaggaacgtg

SEQ ID NO: 284236 - DNA, 32 bp, Artificial Sequence
  Description of Artificial Sequence: Synthetic oligonucleotide
tacttctcgaggatcagcgtatcaggaacgtg

SEQ ID NO: 284237 - DNA, 31 bp, Artificial Sequence
  Description of Artificial Sequence: Synthetic oligonucleotide
acttctcgaggatcagcgtatcaggaacgtg

SEQ ID NO: 284238 - DNA, 30 bp, Artificial Sequence
  Description of Artificial Sequence: Synthetic oligonucleotide
cttctcgaggatcagcgtatcaggaacgtg

SEQ ID NO: 284239 - DNA, 30 bp, Artificial Sequence
  Description of Artificial Sequence: Synthetic oligonucleotide
ttctcgaggatcagcgtatcaggaacgtgg

SEQ ID NO: 284240 - DNA, 29 bp, Artificial Sequence
  Description of Artificial Sequence: Synthetic oligonucleotide
tctcgaggatcagcgtatcaggaacgtgg

SEQ ID NO: 284241 - DNA, 28 bp, Artificial Sequence
  Description of Artificial Sequence: Synthetic oligonucleotide
ctcgaggatcagcgtatcaggaacgtgg

SEQ ID NO: 284242 - DNA, 29 bp, Artificial Sequence
  Description of Artificial Sequence: Synthetic oligonucleotide
tcgaggatcagcgtatcaggaacgtggag

SEQ ID NO: 284243 - DNA, 28 bp, Artificial Sequence
  Description of Artificial Sequence: Synthetic oligonucleotide
cgaggatcagcgtatcaggaacgtggag

SEQ ID NO: 284244 - DNA, 28 bp, Artificial Sequence
  Description of Artificial Sequence: Synthetic oligonucleotide
gaggatcagcgtatcaggaacgtggagg

SEQ ID NO: 284245 - DNA, 29 bp, Artificial Sequence
  Description of Artificial Sequence: Synthetic oligonucleotide
aggatcagcgtatcaggaacgtggaggtc

SEQ ID NO: 284246 - DNA, 28 bp, Artificial Sequence
  Description of Artificial Sequence: Synthetic oligonucleotide
ggatcagcgtatcaggaacgtggaggtc

SEQ ID NO: 284247 - DNA, 29 bp, Artificial Sequence
  Description of Artificial Sequence: Synthetic oligonucleotide
gatcagcgtatcaggaacgtggaggtcac

SEQ ID NO: 284248 - DNA, 32 bp, Artificial Sequence
  Description of Artificial Sequence: Synthetic oligonucleotide
atcagcgtatcaggaacgtggaggtcactatg

SEQ ID NO: 284249 - DNA, 31 bp, Artificial Sequence
  Description of Artificial Sequence: Synthetic oligonucleotide
tcagcgtatcaggaacgtggaggtcactatg

SEQ ID NO: 284250 - DNA, 30 bp, Artificial Sequence
  Description of Artificial Sequence: Synthetic oligonucleotide
cagcgtatcaggaacgtggaggtcactatg

SEQ ID NO: 284251 - DNA, 30 bp, Artificial Sequence
  Description of Artificial Sequence: Synthetic oligonucleotide
agcgtatcaggaacgtggaggtcactatgc

SEQ ID NO: 284252 - DNA, 29 bp, Artificial Sequence
  Description of Artificial Sequence: Synthetic oligonucleotide
gcgtatcaggaacgtggaggtcactatgc

SEQ ID NO: 284253 - DNA, 30 bp, Artificial Sequence
  Description of Artificial Sequence: Synthetic oligonucleotide
cgtatcaggaacgtggaggtcactatgcac

SEQ ID NO: 284254 - DNA, 32 bp, Artificial Sequence
  Description of Artificial Sequence: Synthetic oligonucleotide
gtatcaggaacgtggaggtcactatgcacttg

SEQ ID NO: 284255 - DNA, 32 bp, Artificial Sequence
  Description of Artificial Sequence: Synthetic oligonucleotide
tatcaggaacgtggaggtcactatgcacttgg

SEQ ID NO: 284256 - DNA, 31 bp, Artificial Sequence
  Description of Artificial Sequence: Synthetic oligonucleotide
atcaggaacgtggaggtcactatgcacttgg

SEQ ID NO: 284257 - DNA, 30 bp, Artificial Sequence
  Description of Artificial Sequence: Synthetic oligonucleotide
tcaggaacgtggaggtcactatgcacttgg

SEQ ID NO: 284258 - DNA, 29 bp, Artificial Sequence
  Description of Artificial Sequence: Synthetic oligonucleotide
caggaacgtggaggtcactatgcacttgg

SEQ ID NO: 284259 - DNA, 30 bp, Artificial Sequence
  Description of Artificial Sequence: Synthetic oligonucleotide
aggaacgtggaggtcactatgcacttggtc

SEQ ID NO: 284260 - DNA, 29 bp, Artificial Sequence
  Description of Artificial Sequence: Synthetic oligonucleotide
ggaacgtggaggtcactatgcacttggtc

SEQ ID NO: 284261 - DNA, 34 bp, Artificial Sequence
  Description of Artificial Sequence: Synthetic oligonucleotide
gaacgtggaggtcactatgcacttggtcttattg

SEQ ID NO: 284262 - DNA, 36 bp, Artificial Sequence
  Description of Artificial Sequence: Synthetic oligonucleotide
aacgtggaggtcactatgcacttggtcttattgatg

SEQ ID NO: 284263 - DNA, 35 bp, Artificial Sequence
  Description of Artificial Sequence: Synthetic oligonucleotide
acgtggaggtcactatgcacttggtcttattgatg

SEQ ID NO: 284264 - DNA, 34 bp, Artificial Sequence
  Description of Artificial Sequence: Synthetic oligonucleotide
cgtggaggtcactatgcacttggtcttattgatg

SEQ ID NO: 284265 - DNA, 34 bp, Artificial Sequence
  Description of Artificial Sequence: Synthetic oligonucleotide
gtggaggtcactatgcacttggtcttattgatgc

SEQ ID NO: 284266 - DNA, 34 bp, Artificial Sequence
  Description of Artificial Sequence: Synthetic oligonucleotide
tggaggtcactatgcacttggtcttattgatgcc

SEQ ID NO: 284267 - DNA, 33 bp, Artificial Sequence
  Description of Artificial Sequence: Synthetic oligonucleotide
ggaggtcactatgcacttggtcttattgatgcc

SEQ ID NO: 284268 - DNA, 36 bp, Artificial Sequence
  Description of Artificial Sequence: Synthetic oligonucleotide
gaggtcactatgcacttggtcttattgatgccaatc

SEQ ID NO: 284269 - DNA, 38 bp, Artificial Sequence
  Description of Artificial Sequence: Synthetic oligonucleotide
aggtcactatgcacttggtcttattgatgccaatcttg

SEQ ID NO: 284270 - DNA, 37 bp, Artificial Sequence
  Description of Artificial Sequence: Synthetic oligonucleotide
ggtcactatgcacttggtcttattgatgccaatcttg

SEQ ID NO: 284271 - DNA, 37 bp, Artificial Sequence
  Description of Artificial Sequence: Synthetic oligonucleotide
gtcactatgcacttggtcttattgatgccaatcttgg

SEQ ID NO: 284272 - DNA, 38 bp, Artificial Sequence
  Description of Artificial Sequence: Synthetic oligonucleotide
tcactatgcacttggtcttattgatgccaatcttggtg

SEQ ID NO: 284273 - DNA, 37 bp, Artificial Sequence
  Description of Artificial Sequence: Synthetic oligonucleotide
cactatgcacttggtcttattgatgccaatcttggtg

SEQ ID NO: 284274 - DNA, 37 bp, Artificial Sequence
  Description of Artificial Sequence: Synthetic oligonucleotide
actatgcacttggtcttattgatgccaatcttggtgg

SEQ ID NO: 284275 - DNA, 36 bp, Artificial Sequence
  Description of Artificial Sequence: Synthetic oligonucleotide
ctatgcacttggtcttattgatgccaatcttggtgg

SEQ ID NO: 284276 - DNA, 37 bp, Artificial Sequence
  Description of Artificial Sequence: Synthetic oligonucleotide
tatgcacttggtcttattgatgccaatcttggtggtg

SEQ ID NO: 284277 - DNA, 36 bp, Artificial Sequence
  Description of Artificial Sequence: Synthetic oligonucleotide
atgcacttggtcttattgatgccaatcttggtggtg

SEQ ID NO: 284278 - DNA, 35 bp, Artificial Sequence
  Description of Artificial Sequence: Synthetic oligonucleotide
tgcacttggtcttattgatgccaatcttggtggtg

SEQ ID NO: 284279 - DNA, 34 bp, Artificial Sequence
  Description of Artificial Sequence: Synthetic oligonucleotide
gcacttggtcttattgatgccaatcttggtggtg

SEQ ID NO: 284280 - DNA, 42 bp, Artificial Sequence
  Description of Artificial Sequence: Synthetic oligonucleotide
cacttggtcttattgatgccaatcttggtggtgaaataattg

SEQ ID NO: 284281 - DNA, 43 bp, Artificial Sequence
  Description of Artificial Sequence: Synthetic oligonucleotide
acttggtcttattgatgccaatcttggtggtgaaataattgac

SEQ ID NO: 284282 - DNA, 42 bp, Artificial Sequence
  Description of Artificial Sequence: Synthetic oligonucleotide
cttggtcttattgatgccaatcttggtggtgaaataattgac

SEQ ID NO: 284283 - DNA, 45 bp, Artificial Sequence
  Description of Artificial Sequence: Synthetic oligonucleotide
ttggtcttattgatgccaatcttggtggtgaaataattgacaatc

SEQ ID NO: 284284 - DNA, 44 bp, Artificial Sequence
  Description of Artificial Sequence: Synthetic oligonucleotide
tggtcttattgatgccaatcttggtggtgaaataattgacaatc

SEQ ID NO: 284285 - DNA, 43 bp, Artificial Sequence
  Description of Artificial Sequence: Synthetic oligonucleotide
ggtcttattgatgccaatcttggtggtgaaataattgacaatc

SEQ ID NO: 284286 - DNA, 44 bp, Artificial Sequence
  Description of Artificial Sequence: Synthetic oligonucleotide
gtcttattgatgccaatcttggtggtgaaataattgacaatctg

SEQ ID NO: 284287 - DNA, 44 bp, Artificial Sequence
  Description of Artificial Sequence: Synthetic oligonucleotide
tcttattgatgccaatcttggtggtgaaataattgacaatctgc

SEQ ID NO: 284288 - DNA, 43 bp, Artificial Sequence
  Description of Artificial Sequence: Synthetic oligonucleotide
cttattgatgccaatcttggtggtgaaataattgacaatctgc

SEQ ID NO: 284289 - DNA, 48 bp, Artificial Sequence
  Description of Artificial Sequence: Synthetic oligonucleotide
ttattgatgccaatcttggtggtgaaataattgacaatctgcttattc

SEQ ID NO: 284290 - DNA, 47 bp, Artificial Sequence
  Description of Artificial Sequence: Synthetic oligonucleotide
tattgatgccaatcttggtggtgaaataattgacaatctgcttattc

SEQ ID NO: 284291 - DNA, 46 bp, Artificial Sequence
  Description of Artificial Sequence: Synthetic oligonucleotide
attgatgccaatcttggtggtgaaataattgacaatctgcttattc

SEQ ID NO: 284292 - DNA, 45 bp, Artificial Sequence
  Description of Artificial Sequence: Synthetic oligonucleotide
ttgatgccaatcttggtggtgaaataattgacaatctgcttattc

SEQ ID NO: 284293 - DNA, 44 bp, Artificial Sequence
  Description of Artificial Sequence: Synthetic oligonucleotide
tgatgccaatcttggtggtgaaataattgacaatctgcttattc

SEQ ID NO: 284294 - DNA, 43 bp, Artificial Sequence
  Description of Artificial Sequence: Synthetic oligonucleotide
gatgccaatcttggtggtgaaataattgacaatctgcttattc

SEQ ID NO: 284295 - DNA, 44 bp, Artificial Sequence
  Description of Artificial Sequence: Synthetic oligonucleotide
atgccaatcttggtggtgaaataattgacaatctgcttattcag

SEQ ID NO: 284296 - DNA, 43 bp, Artificial Sequence
  Description of Artificial Sequence: Synthetic oligonucleotide
tgccaatcttggtggtgaaataattgacaatctgcttattcag

SEQ ID NO: 284297 - DNA, 42 bp, Artificial Sequence
  Description of Artificial Sequence: Synthetic oligonucleotide
gccaatcttggtggtgaaataattgacaatctgcttattcag

SEQ ID NO: 284298 - DNA, 42 bp, Artificial Sequence
  Description of Artificial Sequence: Synthetic oligonucleotide
ccaatcttggtggtgaaataattgacaatctgcttattcagc

SEQ ID NO: 284299 - DNA, 46 bp, Artificial Sequence
  Description of Artificial Sequence: Synthetic oligonucleotide
caatcttggtggtgaaataattgacaatctgcttattcagcttaac

SEQ ID NO: 284300 - DNA, 48 bp, Artificial Sequence
  Description of Artificial Sequence: Synthetic oligonucleotide
aatcttggtggtgaaataattgacaatctgcttattcagcttaacaac

SEQ ID NO: 284301 - DNA, 47 bp, Artificial Sequence
  Description of Artificial Sequence: Synthetic oligonucleotide
atcttggtggtgaaataattgacaatctgcttattcagcttaacaac

SEQ ID NO: 284302 - DNA, 46 bp, Artificial Sequence
  Description of Artificial Sequence: Synthetic oligonucleotide
tcttggtggtgaaataattgacaatctgcttattcagcttaacaac

SEQ ID NO: 284303 - DNA, 45 bp, Artificial Sequence
  Description of Artificial Sequence: Synthetic oligonucleotide
cttggtggtgaaataattgacaatctgcttattcagcttaacaac

SEQ ID NO: 284304 - DNA, 45 bp, Artificial Sequence
  Description of Artificial Sequence: Synthetic oligonucleotide
ttggtggtgaaataattgacaatctgcttattcagcttaacaacg

SEQ ID NO: 284305 - DNA, 44 bp, Artificial Sequence
  Description of Artificial Sequence: Synthetic oligonucleotide
tggtggtgaaataattgacaatctgcttattcagcttaacaacg

SEQ ID NO: 284306 - DNA, 43 bp, Artificial Sequence
  Description of Artificial Sequence: Synthetic oligonucleotide
ggtggtgaaataattgacaatctgcttattcagcttaacaacg

SEQ ID NO: 284307 - DNA, 43 bp, Artificial Sequence
  Description of Artificial Sequence: Synthetic oligonucleotide
gtggtgaaataattgacaatctgcttattcagcttaacaacgc

SEQ ID NO: 284308 - DNA, 43 bp, Artificial Sequence
  Description of Artificial Sequence: Synthetic oligonucleotide
tggtgaaataattgacaatctgcttattcagcttaacaacgcc

SEQ ID NO: 284309 - DNA, 42 bp, Artificial Sequence
  Description of Artificial Sequence: Synthetic oligonucleotide
ggtgaaataattgacaatctgcttattcagcttaacaacgcc

SEQ ID NO: 284310 - DNA, 43 bp, Artificial Sequence
  Description of Artificial Sequence: Synthetic oligonucleotide
gtgaaataattgacaatctgcttattcagcttaacaacgccag

SEQ ID NO: 284311 - DNA, 43 bp, Artificial Sequence
  Description of Artificial Sequence: Synthetic oligonucleotide
tgaaataattgacaatctgcttattcagcttaacaacgccagc

SEQ ID NO: 284312 - DNA, 42 bp, Artificial Sequence
  Description of Artificial Sequence: Synthetic oligonucleotide
gaaataattgacaatctgcttattcagcttaacaacgccagc

SEQ ID NO: 284313 - DNA, 45 bp, Artificial Sequence
  Description of Artificial Sequence: Synthetic oligonucleotide
aaataattgacaatctgcttattcagcttaacaacgccagctatg

SEQ ID NO: 284314 - DNA, 44 bp, Artificial Sequence
  Description of Artificial Sequence: Synthetic oligonucleotide
aataattgacaatctgcttattcagcttaacaacgccagctatg

SEQ ID NO: 284315 - DNA, 43 bp, Artificial Sequence
  Description of Artificial Sequence: Synthetic oligonucleotide
ataattgacaatctgcttattcagcttaacaacgccagctatg

SEQ ID NO: 284316 - DNA, 42 bp, Artificial Sequence
  Description of Artificial Sequence: Synthetic oligonucleotide
taattgacaatctgcttattcagcttaacaacgccagctatg

SEQ ID NO: 284317 - DNA, 41 bp, Artificial Sequence
  Description of Artificial Sequence: Synthetic oligonucleotide
aattgacaatctgcttattcagcttaacaacgccagctatg

SEQ ID NO: 284318 - DNA, 40 bp, Artificial Sequence
  Description of Artificial Sequence: Synthetic oligonucleotide
attgacaatctgcttattcagcttaacaacgccagctatg

SEQ ID NO: 284319 - DNA, 39 bp, Artificial Sequence
  Description of Artificial Sequence: Synthetic oligonucleotide
ttgacaatctgcttattcagcttaacaacgccagctatg

SEQ ID NO: 284320 - DNA, 38 bp, Artificial Sequence
  Description of Artificial Sequence: Synthetic oligonucleotide
tgacaatctgcttattcagcttaacaacgccagctatg

SEQ ID NO: 284321 - DNA, 37 bp, Artificial Sequence
  Description of Artificial Sequence: Synthetic oligonucleotide
gacaatctgcttattcagcttaacaacgccagctatg

SEQ ID NO: 284322 - DNA, 41 bp, Artificial Sequence
  Description of Artificial Sequence: Synthetic oligonucleotide
acaatctgcttattcagcttaacaacgccagctatgatatc

SEQ ID NO: 284323 - DNA, 40 bp, Artificial Sequence
  Description of Artificial Sequence: Synthetic oligonucleotide
caatctgcttattcagcttaacaacgccagctatgatatc

SEQ ID NO: 284324 - DNA, 40 bp, Artificial Sequence
  Description of Artificial Sequence: Synthetic oligonucleotide
aatctgcttattcagcttaacaacgccagctatgatatcg

SEQ ID NO: 284325 - DNA, 39 bp, Artificial Sequence
  Description of Artificial Sequence: Synthetic oligonucleotide
atctgcttattcagcttaacaacgccagctatgatatcg

SEQ ID NO: 284326 - DNA, 38 bp, Artificial Sequence
  Description of Artificial Sequence: Synthetic oligonucleotide
tctgcttattcagcttaacaacgccagctatgatatcg

SEQ ID NO: 284327 - DNA, 37 bp, Artificial Sequence
  Description of Artificial Sequence: Synthetic oligonucleotide
ctgcttattcagcttaacaacgccagctatgatatcg

SEQ ID NO: 284328 - DNA, 40 bp, Artificial Sequence
  Description of Artificial Sequence: Synthetic oligonucleotide
tgcttattcagcttaacaacgccagctatgatatcgatag

SEQ ID NO: 284329 - DNA, 39 bp, Artificial Sequence
  Description of Artificial Sequence: Synthetic oligonucleotide
gcttattcagcttaacaacgccagctatgatatcgatag

SEQ ID NO: 284330 - DNA, 40 bp, Artificial Sequence
  Description of Artificial Sequence: Synthetic oligonucleotide
cttattcagcttaacaacgccagctatgatatcgatagac

SEQ ID NO: 284331 - DNA, 41 bp, Artificial Sequence
  Description of Artificial Sequence: Synthetic oligonucleotide
ttattcagcttaacaacgccagctatgatatcgatagacac

SEQ ID NO: 284332 - DNA, 40 bp, Artificial Sequence
  Description of Artificial Sequence: Synthetic oligonucleotide
tattcagcttaacaacgccagctatgatatcgatagacac

SEQ ID NO: 284333 - DNA, 39 bp, Artificial Sequence
  Description of Artificial Sequence: Synthetic oligonucleotide
attcagcttaacaacgccagctatgatatcgatagacac

SEQ ID NO: 284334 - DNA, 38 bp, Artificial Sequence
  Description of Artificial Sequence: Synthetic oligonucleotide
ttcagcttaacaacgccagctatgatatcgatagacac

SEQ ID NO: 284335 - DNA, 37 bp, Artificial Sequence
  Description of Artificial Sequence: Synthetic oligonucleotide
tcagcttaacaacgccagctatgatatcgatagacac

SEQ ID NO: 284336 - DNA, 36 bp, Artificial Sequence
  Description of Artificial Sequence: Synthetic oligonucleotide
cagcttaacaacgccagctatgatatcgatagacac

SEQ ID NO: 284337 - DNA, 36 bp, Artificial Sequence
  Description of Artificial Sequence: Synthetic oligonucleotide
agcttaacaacgccagctatgatatcgatagacacg

SEQ ID NO: 284338 - DNA, 35 bp, Artificial Sequence
  Description of Artificial Sequence: Synthetic oligonucleotide
gcttaacaacgccagctatgatatcgatagacacg

SEQ ID NO: 284339 - DNA, 35 bp, Artificial Sequence
  Description of Artificial Sequence: Synthetic oligonucleotide
cttaacaacgccagctatgatatcgatagacacgg

SEQ ID NO: 284340 - DNA, 36 bp, Artificial Sequence
  Description of Artificial Sequence: Synthetic oligonucleotide
ttaacaacgccagctatgatatcgatagacacggag

SEQ ID NO: 284341 - DNA, 35 bp, Artificial Sequence
  Description of Artificial Sequence: Synthetic oligonucleotide
taacaacgccagctatgatatcgatagacacggag

SEQ ID NO: 284342 - DNA, 34 bp, Artificial Sequence
  Description of Artificial Sequence: Synthetic oligonucleotide
aacaacgccagctatgatatcgatagacacggag

SEQ ID NO: 284343 - DNA, 33 bp, Artificial Sequence
  Description of Artificial Sequence: Synthetic oligonucleotide
acaacgccagctatgatatcgatagacacggag

SEQ ID NO: 284344 - DNA, 32 bp, Artificial Sequence
  Description of Artificial Sequence: Synthetic oligonucleotide
caacgccagctatgatatcgatagacacggag

SEQ ID NO: 284345 - DNA, 32 bp, Artificial Sequence
  Description of Artificial Sequence: Synthetic oligonucleotide
aacgccagctatgatatcgatagacacggagg

SEQ ID NO: 284346 - DNA, 31 bp, Artificial Sequence
  Description of Artificial Sequence: Synthetic oligonucleotide
acgccagctatgatatcgatagacacggagg

SEQ ID NO: 284347 - DNA, 30 bp, Artificial Sequence
  Description of Artificial Sequence: Synthetic oligonucleotide
cgccagctatgatatcgatagacacggagg

SEQ ID NO: 284348 - DNA, 30 bp, Artificial Sequence
  Description of Artificial Sequence: Synthetic oligonucleotide
gccagctatgatatcgatagacacggaggc

SEQ ID NO: 284349 - DNA, 31 bp, Artificial Sequence
  Description of Artificial Sequence: Synthetic oligonucleotide
ccagctatgatatcgatagacacggaggcag

SEQ ID NO: 284350 - DNA, 32 bp, Artificial Sequence
  Description of Artificial Sequence: Synthetic oligonucleotide
cagctatgatatcgatagacacggaggcagtc

SEQ ID NO: 284351 - DNA, 33 bp, Artificial Sequence
  Description of Artificial Sequence: Synthetic oligonucleotide
agctatgatatcgatagacacggaggcagtctg

SEQ ID NO: 284352 - DNA, 32 bp, Artificial Sequence
  Description of Artificial Sequence: Synthetic oligonucleotide
gctatgatatcgatagacacggaggcagtctg

SEQ ID NO: 284353 - DNA, 32 bp, Artificial Sequence
  Description of Artificial Sequence: Synthetic oligonucleotide
ctatgatatcgatagacacggaggcagtctgc

SEQ ID NO: 284354 - DNA, 32 bp, Artificial Sequence
  Description of Artificial Sequence: Synthetic oligonucleotide
tatgatatcgatagacacggaggcagtctgcg

SEQ ID NO: 284355 - DNA, 31 bp, Artificial Sequence
  Description of Artificial Sequence: Synthetic oligonucleotide
atgatatcgatagacacggaggcagtctgcg

SEQ ID NO: 284356 - DNA, 30 bp, Artificial Sequence
  Description of Artificial Sequence: Synthetic oligonucleotide
tgatatcgatagacacggaggcagtctgcg

SEQ ID NO: 284357 - DNA, 29 bp, Artificial Sequence
  Description of Artificial Sequence: Synthetic oligonucleotide
gatatcgatagacacggaggcagtctgcg

SEQ ID NO: 284358 - DNA, 29 bp, Artificial Sequence
  Description of Artificial Sequence: Synthetic oligonucleotide
atatcgatagacacggaggcagtctgcgc

SEQ ID NO: 284359 - DNA, 28 bp, Artificial Sequence
  Description of Artificial Sequence: Synthetic oligonucleotide
tatcgatagacacggaggcagtctgcgc

SEQ ID NO: 284360 - DNA, 27 bp, Artificial Sequence
  Description of Artificial Sequence: Synthetic oligonucleotide
atcgatagacacggaggcagtctgcgc

SEQ ID NO: 284361 - DNA, 26 bp, Artificial Sequence
  Description of Artificial Sequence: Synthetic oligonucleotide
tcgatagacacggaggcagtctgcgc

SEQ ID NO: 284362 - DNA, 25 bp, Artificial Sequence
  Description of Artificial Sequence: Synthetic oligonucleotide
cgatagacacggaggcagtctgcgc

SEQ ID NO: 284363 - DNA, 27 bp, Artificial Sequence
  Description of Artificial Sequence: Synthetic oligonucleotide
gatagacacggaggcagtctgcgcctt

SEQ ID NO: 284364 - DNA, 27 bp, Artificial Sequence
  Description of Artificial Sequence: Synthetic oligonucleotide
atagacacggaggcagtctgcgccttg

SEQ ID NO: 284365 - DNA, 26 bp, Artificial Sequence
  Description of Artificial Sequence: Synthetic oligonucleotide
tagacacggaggcagtctgcgccttg

SEQ ID NO: 284366 - DNA, 25 bp, Artificial Sequence
  Description of Artificial Sequence: Synthetic oligonucleotide
agacacggaggcagtctgcgccttg

SEQ ID NO: 284367 - DNA, 24 bp, Artificial Sequence
  Description of Artificial Sequence: Synthetic oligonucleotide
gacacggaggcagtctgcgccttg

SEQ ID NO: 284368 - DNA, 27 bp, Artificial Sequence
  Description of Artificial Sequence: Synthetic oligonucleotide
acacggaggcagtctgcgccttggtta

SEQ ID NO: 284369 - DNA, 26 bp, Artificial Sequence
  Description of Artificial Sequence: Synthetic oligonucleotide
cacggaggcagtctgcgccttggtta

SEQ ID NO: 284370 - DNA, 26 bp, Artificial Sequence
  Description of Artificial Sequence: Synthetic oligonucleotide
acggaggcagtctgcgccttggttag

SEQ ID NO: 284371 - DNA, 25 bp, Artificial Sequence
  Description of Artificial Sequence: Synthetic oligonucleotide
cggaggcagtctgcgccttggttag

SEQ ID NO: 284372 - DNA, 25 bp, Artificial Sequence
  Description of Artificial Sequence: Synthetic oligonucleotide
ggaggcagtctgcgccttggttagg

SEQ ID NO: 284373 - DNA, 26 bp, Artificial Sequence
  Description of Artificial Sequence: Synthetic oligonucleotide
gaggcagtctgcgccttggttaggca

SEQ ID NO: 284374 - DNA, 26 bp, Artificial Sequence
  Description of Artificial Sequence: Synthetic oligonucleotide
aggcagtctgcgccttggttaggcag

SEQ ID NO: 284375 - DNA, 25 bp, Artificial Sequence
  Description of Artificial Sequence: Synthetic oligonucleotide
ggcagtctgcgccttggttaggcag

SEQ ID NO: 284376 - DNA, 25 bp, Artificial Sequence
  Description of Artificial Sequence: Synthetic oligonucleotide
gcagtctgcgccttggttaggcagc

SEQ ID NO: 284377 - DNA, 27 bp, Artificial Sequence
  Description of Artificial Sequence: Synthetic oligonucleotide
cagtctgcgccttggttaggcagccat

SEQ ID NO: 284378 - DNA, 27 bp, Artificial Sequence
  Description of Artificial Sequence: Synthetic oligonucleotide
agtctgcgccttggttaggcagccatc

SEQ ID NO: 284379 - DNA, 26 bp, Artificial Sequence
  Description of Artificial Sequence: Synthetic oligonucleotide
gtctgcgccttggttaggcagccatc

SEQ ID NO: 284380 - DNA, 26 bp, Artificial Sequence
  Description of Artificial Sequence: Synthetic oligonucleotide
tctgcgccttggttaggcagccatcg

SEQ ID NO: 284381 - DNA, 25 bp, Artificial Sequence
  Description of Artificial Sequence: Synthetic oligonucleotide
ctgcgccttggttaggcagccatcg

SEQ ID NO: 284382 - DNA, 27 bp, Artificial Sequence
  Description of Artificial Sequence: Synthetic oligonucleotide
tgcgccttggttaggcagccatcggaa

SEQ ID NO: 284383 - DNA, 26 bp, Artificial Sequence
  Description of Artificial Sequence: Synthetic oligonucleotide
gcgccttggttaggcagccatcggaa

SEQ ID NO: 284384 - DNA, 27 bp, Artificial Sequence
  Description of Artificial Sequence: Synthetic oligonucleotide
cgccttggttaggcagccatcggaact

SEQ ID NO: 284385 - DNA, 27 bp, Artificial Sequence
  Description of Artificial Sequence: Synthetic oligonucleotide
gccttggttaggcagccatcggaactg

SEQ ID NO: 284386 - DNA, 27 bp, Artificial Sequence
  Description of Artificial Sequence: Synthetic oligonucleotide
ccttggttaggcagccatcggaactgc

SEQ ID NO: 284387 - DNA, 28 bp, Artificial Sequence
  Description of Artificial Sequence: Synthetic oligonucleotide
cttggttaggcagccatcggaactgcag

SEQ ID NO: 284388 - DNA, 28 bp, Artificial Sequence
  Description of Artificial Sequence: Synthetic oligonucleotide
ttggttaggcagccatcggaactgcagg

SEQ ID NO: 284389 - DNA, 27 bp, Artificial Sequence
  Description of Artificial Sequence: Synthetic oligonucleotide
tggttaggcagccatcggaactgcagg

SEQ ID NO: 284390 - DNA, 27 bp, Artificial Sequence
  Description of Artificial Sequence: Synthetic oligonucleotide
ggttaggcagccatcggaactgcaggt

SEQ ID NO: 284391 - DNA, 27 bp, Artificial Sequence
  Description of Artificial Sequence: Synthetic oligonucleotide
gttaggcagccatcggaactgcaggtc

SEQ ID NO: 284392 - DNA, 29 bp, Artificial Sequence
  Description of Artificial Sequence: Synthetic oligonucleotide
ttaggcagccatcggaactgcaggtcaag

SEQ ID NO: 284393 - DNA, 28 bp, Artificial Sequence
  Description of Artificial Sequence: Synthetic oligonucleotide
taggcagccatcggaactgcaggtcaag

SEQ ID NO: 284394 - DNA, 27 bp, Artificial Sequence
  Description of Artificial Sequence: Synthetic oligonucleotide
aggcagccatcggaactgcaggtcaag

SEQ ID NO: 284395 - DNA, 27 bp, Artificial Sequence
  Description of Artificial Sequence: Synthetic oligonucleotide
ggcagccatcggaactgcaggtcaaga

SEQ ID NO: 284396 - DNA, 28 bp, Artificial Sequence
  Description of Artificial Sequence: Synthetic oligonucleotide
gcagccatcggaactgcaggtcaagatg

SEQ ID NO: 284397 - DNA, 33 bp, Artificial Sequence
  Description of Artificial Sequence: Synthetic oligonucleotide
cagccatcggaactgcaggtcaagatgattatg

SEQ ID NO: 284398 - DNA, 37 bp, Artificial Sequence
  Description of Artificial Sequence: Synthetic oligonucleotide
agccatcggaactgcaggtcaagatgattatgatttc

SEQ ID NO: 284399 - DNA, 36 bp, Artificial Sequence
  Description of Artificial Sequence: Synthetic oligonucleotide
gccatcggaactgcaggtcaagatgattatgatttc

SEQ ID NO: 284400 - DNA, 36 bp, Artificial Sequence
  Description of Artificial Sequence: Synthetic oligonucleotide
ccatcggaactgcaggtcaagatgattatgatttcc

SEQ ID NO: 284401 - DNA, 42 bp, Artificial Sequence
  Description of Artificial Sequence: Synthetic oligonucleotide
catcggaactgcaggtcaagatgattatgatttcctaaaaac

SEQ ID NO: 284402 - DNA, 45 bp, Artificial Sequence
  Description of Artificial Sequence: Synthetic oligonucleotide
atcggaactgcaggtcaagatgattatgatttcctaaaaacatac

SEQ ID NO: 284403 - DNA, 44 bp, Artificial Sequence
  Description of Artificial Sequence: Synthetic oligonucleotide
tcggaactgcaggtcaagatgattatgatttcctaaaaacatac

SEQ ID NO: 284404 - DNA, 43 bp, Artificial Sequence
  Description of Artificial Sequence: Synthetic oligonucleotide
cggaactgcaggtcaagatgattatgatttcctaaaaacatac

SEQ ID NO: 284405 - DNA, 43 bp, Artificial Sequence
  Description of Artificial Sequence: Synthetic oligonucleotide
ggaactgcaggtcaagatgattatgatttcctaaaaacatacc

SEQ ID NO: 284406 - DNA, 48 bp, Artificial Sequence
  Description of Artificial Sequence: Synthetic oligonucleotide
gaactgcaggtcaagatgattatgatttcctaaaaacatacctttatc

SEQ ID NO: 284407 - DNA, 49 bp, Artificial Sequence
  Description of Artificial Sequence: Synthetic oligonucleotide
aactgcaggtcaagatgattatgatttcctaaaaacatacctttatctg

SEQ ID NO: 284408 - DNA, 48 bp, Artificial Sequence
  Description of Artificial Sequence: Synthetic oligonucleotide
actgcaggtcaagatgattatgatttcctaaaaacatacctttatctg

SEQ ID NO: 284409 - DNA, 47 bp, Artificial Sequence
  Description of Artificial Sequence: Synthetic oligonucleotide
ctgcaggtcaagatgattatgatttcctaaaaacatacctttatctg

SEQ ID NO: 284410 - DNA, 47 bp, Artificial Sequence
  Description of Artificial Sequence: Synthetic oligonucleotide
tgcaggtcaagatgattatgatttcctaaaaacatacctttatctgg

SEQ ID NO: 284411 - DNA, 46 bp, Artificial Sequence
  Description of Artificial Sequence: Synthetic oligonucleotide
gcaggtcaagatgattatgatttcctaaaaacatacctttatctgg

SEQ ID NO: 284412 - DNA, 48 bp, Artificial Sequence
  Description of Artificial Sequence: Synthetic oligonucleotide
caggtcaagatgattatgatttcctaaaaacatacctttatctggatg

SEQ ID NO: 284413 - DNA, 50 bp, Artificial Sequence
  Description of Artificial Sequence: Synthetic oligonucleotide
aggtcaagatgattatgatttcctaaaaacatacctttatctggatgatg

SEQ ID NO: 284414 - DNA, 49 bp, Artificial Sequence
  Description of Artificial Sequence: Synthetic oligonucleotide
ggtcaagatgattatgatttcctaaaaacatacctttatctggatgatg

SEQ ID NO: 284415 - DNA, 49 bp, Artificial Sequence
  Description of Artificial Sequence: Synthetic oligonucleotide
gtcaagatgattatgatttcctaaaaacatacctttatctggatgatgc

SEQ ID NO: 284416 - DNA, 50 bp, Artificial Sequence
  Description of Artificial Sequence: Synthetic oligonucleotide
tcaagatgattatgatttcctaaaaacatacctttatctggatgatgctg

SEQ ID NO: 284417 - DNA, 49 bp, Artificial Sequence
  Description of Artificial Sequence: Synthetic oligonucleotide
caagatgattatgatttcctaaaaacatacctttatctggatgatgctg

SEQ ID NO: 284418 - DNA, 52 bp, Artificial Sequence
  Description of Artificial Sequence: Synthetic oligonucleotide
aagatgattatgatttcctaaaaacatacctttatctggatgatgctgtaac

SEQ ID NO: 284419 - DNA, 51 bp, Artificial Sequence
  Description of Artificial Sequence: Synthetic oligonucleotide
agatgattatgatttcctaaaaacatacctttatctggatgatgctgtaac

SEQ ID NO: 284420 - DNA, 50 bp, Artificial Sequence
  Description of Artificial Sequence: Synthetic oligonucleotide
gatgattatgatttcctaaaaacatacctttatctggatgatgctgtaac

SEQ ID NO: 284421 - DNA, 51 bp, Artificial Sequence
  Description of Artificial Sequence: Synthetic oligonucleotide
atgattatgatttcctaaaaacatacctttatctggatgatgctgtaacag

SEQ ID NO: 284422 - DNA, 50 bp, Artificial Sequence
  Description of Artificial Sequence: Synthetic oligonucleotide
tgattatgatttcctaaaaacatacctttatctggatgatgctgtaacag

SEQ ID NO: 284423 - DNA, 49 bp, Artificial Sequence
  Description of Artificial Sequence: Synthetic oligonucleotide
gattatgatttcctaaaaacatacctttatctggatgatgctgtaacag

SEQ ID NO: 284424 - DNA, 49 bp, Artificial Sequence
  Description of Artificial Sequence: Synthetic oligonucleotide
attatgatttcctaaaaacatacctttatctggatgatgctgtaacagg

SEQ ID NO: 284425 - DNA, 48 bp, Artificial Sequence
  Description of Artificial Sequence: Synthetic oligonucleotide
ttatgatttcctaaaaacatacctttatctggatgatgctgtaacagg

SEQ ID NO: 284426 - DNA, 47 bp, Artificial Sequence
  Description of Artificial Sequence: Synthetic oligonucleotide
tatgatttcctaaaaacatacctttatctggatgatgctgtaacagg

SEQ ID NO: 284427 - DNA, 46 bp, Artificial Sequence
  Description of Artificial Sequence: Synthetic oligonucleotide
atgatttcctaaaaacatacctttatctggatgatgctgtaacagg

SEQ ID NO: 284428 - DNA, 45 bp, Artificial Sequence
  Description of Artificial Sequence: Synthetic oligonucleotide
tgatttcctaaaaacatacctttatctggatgatgctgtaacagg

SEQ ID NO: 284429 - DNA, 44 bp, Artificial Sequence
  Description of Artificial Sequence: Synthetic oligonucleotide
gatttcctaaaaacatacctttatctggatgatgctgtaacagg

SEQ ID NO: 284430 - DNA, 44 bp, Artificial Sequence
  Description of Artificial Sequence: Synthetic oligonucleotide
atttcctaaaaacatacctttatctggatgatgctgtaacaggg

SEQ ID NO: 284431 - DNA, 43 bp, Artificial Sequence
  Description of Artificial Sequence: Synthetic oligonucleotide
tttcctaaaaacatacctttatctggatgatgctgtaacaggg

SEQ ID NO: 284432 - DNA, 42 bp, Artificial Sequence
  Description of Artificial Sequence: Synthetic oligonucleotide
ttcctaaaaacatacctttatctggatgatgctgtaacaggg

SEQ ID NO: 284433 - DNA, 41 bp, Artificial Sequence
  Description of Artificial Sequence: Synthetic oligonucleotide
tcctaaaaacatacctttatctggatgatgctgtaacaggg

SEQ ID NO: 284434 - DNA, 40 bp, Artificial Sequence
  Description of Artificial Sequence: Synthetic oligonucleotide
cctaaaaacatacctttatctggatgatgctgtaacaggg

SEQ ID NO: 284435 - DNA, 40 bp, Artificial Sequence
  Description of Artificial Sequence: Synthetic oligonucleotide
ctaaaaacatacctttatctggatgatgctgtaacagggc

SEQ ID NO: 284436 - DNA, 42 bp, Artificial Sequence
  Description of Artificial Sequence: Synthetic oligonucleotide
taaaaacatacctttatctggatgatgctgtaacagggcaag

SEQ ID NO: 284437 - DNA, 41 bp, Artificial Sequence
  Description of Artificial Sequence: Synthetic oligonucleotide
aaaaacatacctttatctggatgatgctgtaacagggcaag

SEQ ID NO: 284438 - DNA, 40 bp, Artificial Sequence
  Description of Artificial Sequence: Synthetic oligonucleotide
aaaacatacctttatctggatgatgctgtaacagggcaag

SEQ ID NO: 284439 - DNA, 39 bp, Artificial Sequence
  Description of Artificial Sequence: Synthetic oligonucleotide
aaacatacctttatctggatgatgctgtaacagggcaag

SEQ ID NO: 284440 - DNA, 38 bp, Artificial Sequence
  Description of Artificial Sequence: Synthetic oligonucleotide
aacatacctttatctggatgatgctgtaacagggcaag

SEQ ID NO: 284441 - DNA, 37 bp, Artificial Sequence
  Description of Artificial Sequence: Synthetic oligonucleotide
acatacctttatctggatgatgctgtaacagggcaag

SEQ ID NO: 284442 - DNA, 36 bp, Artificial Sequence
  Description of Artificial Sequence: Synthetic oligonucleotide
catacctttatctggatgatgctgtaacagggcaag

SEQ ID NO: 284443 - DNA, 36 bp, Artificial Sequence
  Description of Artificial Sequence: Synthetic oligonucleotide
atacctttatctggatgatgctgtaacagggcaagc

SEQ ID NO: 284444 - DNA, 35 bp, Artificial Sequence
  Description of Artificial Sequence: Synthetic oligonucleotide
tacctttatctggatgatgctgtaacagggcaagc

SEQ ID NO: 284445 - DNA, 34 bp, Artificial Sequence
  Description of Artificial Sequence: Synthetic oligonucleotide
acctttatctggatgatgctgtaacagggcaagc

SEQ ID NO: 284446 - DNA, 33 bp, Artificial Sequence
  Description of Artificial Sequence: Synthetic oligonucleotide
cctttatctggatgatgctgtaacagggcaagc

SEQ ID NO: 284447 - DNA, 34 bp, Artificial Sequence
  Description of Artificial Sequence: Synthetic oligonucleotide
ctttatctggatgatgctgtaacagggcaagcag

SEQ ID NO: 284448 - DNA, 34 bp, Artificial Sequence
  Description of Artificial Sequence: Synthetic oligonucleotide
tttatctggatgatgctgtaacagggcaagcagc

SEQ ID NO: 284449 - DNA, 33 bp, Artificial Sequence
  Description of Artificial Sequence: Synthetic oligonucleotide
ttatctggatgatgctgtaacagggcaagcagc

SEQ ID NO: 284450 - DNA, 32 bp, Artificial Sequence
  Description of Artificial Sequence: Synthetic oligonucleotide
tatctggatgatgctgtaacagggcaagcagc

SEQ ID NO: 284451 - DNA, 31 bp, Artificial Sequence
  Description of Artificial Sequence: Synthetic oligonucleotide
atctggatgatgctgtaacagggcaagcagc

SEQ ID NO: 284452 - DNA, 30 bp, Artificial Sequence
  Description of Artificial Sequence: Synthetic oligonucleotide
tctggatgatgctgtaacagggcaagcagc

SEQ ID NO: 284453 - DNA, 29 bp, Artificial Sequence
  Description of Artificial Sequence: Synthetic oligonucleotide
ctggatgatgctgtaacagggcaagcagc

SEQ ID NO: 284454 - DNA, 30 bp, Artificial Sequence
  Description of Artificial Sequence: Synthetic oligonucleotide
tggatgatgctgtaacagggcaagcagctg

SEQ ID NO: 284455 - DNA, 29 bp, Artificial Sequence
  Description of Artificial Sequence: Synthetic oligonucleotide
ggatgatgctgtaacagggcaagcagctg

SEQ ID NO: 284456 - DNA, 29 bp, Artificial Sequence
  Description of Artificial Sequence: Synthetic oligonucleotide
gatgatgctgtaacagggcaagcagctgc

SEQ ID NO: 284457 - DNA, 29 bp, Artificial Sequence
  Description of Artificial Sequence: Synthetic oligonucleotide
atgatgctgtaacagggcaagcagctgcc

SEQ ID NO: 284458 - DNA, 28 bp, Artificial Sequence
  Description of Artificial Sequence: Synthetic oligonucleotide
tgatgctgtaacagggcaagcagctgcc

SEQ ID NO: 284459 - DNA, 27 bp, Artificial Sequence
  Description of Artificial Sequence: Synthetic oligonucleotide
gatgctgtaacagggcaagcagctgcc

SEQ ID NO: 284460 - DNA, 27 bp, Artificial Sequence
  Description of Artificial Sequence: Synthetic oligonucleotide
atgctgtaacagggcaagcagctgccc

SEQ ID NO: 284461 - DNA, 27 bp, Artificial Sequence
  Description of Artificial Sequence: Synthetic oligonucleotide
tgctgtaacagggcaagcagctgccct

SEQ ID NO: 284462 - DNA, 26 bp, Artificial Sequence
  Description of Artificial Sequence: Synthetic oligonucleotide
gctgtaacagggcaagcagctgccct

SEQ ID NO: 284463 - DNA, 26 bp, Artificial Sequence
  Description of Artificial Sequence: Synthetic oligonucleotide
ctgtaacagggcaagcagctgccctg

SEQ ID NO: 284464 - DNA, 26 bp, Artificial Sequence
  Description of Artificial Sequence: Synthetic oligonucleotide
tgtaacagggcaagcagctgccctgg

SEQ ID NO: 284465 - DNA, 25 bp, Artificial Sequence
  Description of Artificial Sequence: Synthetic oligonucleotide
gtaacagggcaagcagctgccctgg

SEQ ID NO: 284466 - DNA, 25 bp, Artificial Sequence
  Description of Artificial Sequence: Synthetic oligonucleotide
taacagggcaagcagctgccctggc

SEQ ID NO: 284467 - DNA, 24 bp, Artificial Sequence
  Description of Artificial Sequence: Synthetic oligonucleotide
aacagggcaagcagctgccctggc

SEQ ID NO: 284468 - DNA, 23 bp, Artificial Sequence
  Description of Artificial Sequence: Synthetic oligonucleotide
acagggcaagcagctgccctggc

SEQ ID NO: 284469 - DNA, 22 bp, Artificial Sequence
  Description of Artificial Sequence: Synthetic oligonucleotide
cagggcaagcagctgccctggc

SEQ ID NO: 284470 - DNA, 22 bp, Artificial Sequence
  Description of Artificial Sequence: Synthetic oligonucleotide
agggcaagcagctgccctggcc

SEQ ID NO: 284471 - DNA, 21 bp, Artificial Sequence
  Description of Artificial Sequence: Synthetic oligonucleotide
gggcaagcagctgccctggcc

SEQ ID NO: 284472 - DNA, 23 bp, Artificial Sequence
  Description of Artificial Sequence: Synthetic oligonucleotide
ggcaagcagctgccctggccctt

SEQ ID NO: 284473 - DNA, 23 bp, Artificial Sequence
  Description of Artificial Sequence: Synthetic oligonucleotide
gcaagcagctgccctggcccttg

SEQ ID NO: 284474 - DNA, 26 bp, Artificial Sequence
  Description of Artificial Sequence: Synthetic oligonucleotide
caagcagctgccctggcccttggttt

SEQ ID NO: 284475 - DNA, 26 bp, Artificial Sequence
  Description of Artificial Sequence: Synthetic oligonucleotide
aagcagctgccctggcccttggtttg

SEQ ID NO: 284476 - DNA, 25 bp, Artificial Sequence
  Description of Artificial Sequence: Synthetic oligonucleotide
agcagctgccctggcccttggtttg

SEQ ID NO: 284477 - DNA, 24 bp, Artificial Sequence
  Description of Artificial Sequence: Synthetic oligonucleotide
gcagctgccctggcccttggtttg

SEQ ID NO: 284478 - DNA, 27 bp, Artificial Sequence
  Description of Artificial Sequence: Synthetic oligonucleotide
cagctgccctggcccttggtttggttt

SEQ ID NO: 284479 - DNA, 28 bp, Artificial Sequence
  Description of Artificial Sequence: Synthetic oligonucleotide
agctgccctggcccttggtttggttttg

SEQ ID NO: 284480 - DNA, 27 bp, Artificial Sequence
  Description of Artificial Sequence: Synthetic oligonucleotide
gctgccctggcccttggtttggttttg

SEQ ID NO: 284481 - DNA, 29 bp, Artificial Sequence
  Description of Artificial Sequence: Synthetic oligonucleotide
ctgccctggcccttggtttggttttgttg

SEQ ID NO: 284482 - DNA, 29 bp, Artificial Sequence
  Description of Artificial Sequence: Synthetic oligonucleotide
tgccctggcccttggtttggttttgttgg

SEQ ID NO: 284483 - DNA, 28 bp, Artificial Sequence
  Description of Artificial Sequence: Synthetic oligonucleotide
gccctggcccttggtttggttttgttgg

SEQ ID NO: 284484 - DNA, 28 bp, Artificial Sequence
  Description of Artificial Sequence: Synthetic oligonucleotide
ccctggcccttggtttggttttgttggg

SEQ ID NO: 284485 - DNA, 28 bp, Artificial Sequence
  Description of Artificial Sequence: Synthetic oligonucleotide
cctggcccttggtttggttttgttgggc

SEQ ID NO: 284486 - DNA, 29 bp, Artificial Sequence
  Description of Artificial Sequence: Synthetic oligonucleotide
ctggcccttggtttggttttgttgggctg

SEQ ID NO: 284487 - DNA, 36 bp, Artificial Sequence
  Description of Artificial Sequence: Synthetic oligonucleotide
tggcccttggtttggttttgttgggctgtaaaaatg

SEQ ID NO: 284488 - DNA, 35 bp, Artificial Sequence
  Description of Artificial Sequence: Synthetic oligonucleotide
ggcccttggtttggttttgttgggctgtaaaaatg

SEQ ID NO: 284489 - DNA, 35 bp, Artificial Sequence
  Description of Artificial Sequence: Synthetic oligonucleotide
gcccttggtttggttttgttgggctgtaaaaatgc

SEQ ID NO: 284490 - DNA, 36 bp, Artificial Sequence
  Description of Artificial Sequence: Synthetic oligonucleotide
cccttggtttggttttgttgggctgtaaaaatgcac

SEQ ID NO: 284491 - DNA, 37 bp, Artificial Sequence
  Description of Artificial Sequence: Synthetic oligonucleotide
ccttggtttggttttgttgggctgtaaaaatgcacag

SEQ ID NO: 284492 - DNA, 37 bp, Artificial Sequence
  Description of Artificial Sequence: Synthetic oligonucleotide
cttggtttggttttgttgggctgtaaaaatgcacagg

SEQ ID NO: 284493 - DNA, 37 bp, Artificial Sequence
  Description of Artificial Sequence: Synthetic oligonucleotide
ttggtttggttttgttgggctgtaaaaatgcacaggc

SEQ ID NO: 284494 - DNA, 36 bp, Artificial Sequence
  Description of Artificial Sequence: Synthetic oligonucleotide
tggtttggttttgttgggctgtaaaaatgcacaggc

SEQ ID NO: 284495 - DNA, 35 bp, Artificial Sequence
  Description of Artificial Sequence: Synthetic oligonucleotide
ggtttggttttgttgggctgtaaaaatgcacaggc

SEQ ID NO: 284496 - DNA, 39 bp, Artificial Sequence
  Description of Artificial Sequence: Synthetic oligonucleotide
gtttggttttgttgggctgtaaaaatgcacaggctattc

SEQ ID NO: 284497 - DNA, 40 bp, Artificial Sequence
  Description of Artificial Sequence: Synthetic oligonucleotide
tttggttttgttgggctgtaaaaatgcacaggctattcag

SEQ ID NO: 284498 - DNA, 39 bp, Artificial Sequence
  Description of Artificial Sequence: Synthetic oligonucleotide
ttggttttgttgggctgtaaaaatgcacaggctattcag

SEQ ID NO: 284499 - DNA, 38 bp, Artificial Sequence
  Description of Artificial Sequence: Synthetic oligonucleotide
tggttttgttgggctgtaaaaatgcacaggctattcag

SEQ ID NO: 284500 - DNA, 37 bp, Artificial Sequence
  Description of Artificial Sequence: Synthetic oligonucleotide
ggttttgttgggctgtaaaaatgcacaggctattcag

SEQ ID NO: 284501 - DNA, 37 bp, Artificial Sequence
  Description of Artificial Sequence: Synthetic oligonucleotide
gttttgttgggctgtaaaaatgcacaggctattcagg

SEQ ID NO: 284502 - DNA, 38 bp, Artificial Sequence
  Description of Artificial Sequence: Synthetic oligonucleotide
ttttgttgggctgtaaaaatgcacaggctattcaggac

SEQ ID NO: 284503 - DNA, 37 bp, Artificial Sequence
  Description of Artificial Sequence: Synthetic oligonucleotide
tttgttgggctgtaaaaatgcacaggctattcaggac

SEQ ID NO: 284504 - DNA, 36 bp, Artificial Sequence
  Description of Artificial Sequence: Synthetic oligonucleotide
ttgttgggctgtaaaaatgcacaggctattcaggac

SEQ ID NO: 284505 - DNA, 35 bp, Artificial Sequence
  Description of Artificial Sequence: Synthetic oligonucleotide
tgttgggctgtaaaaatgcacaggctattcaggac

SEQ ID NO: 284506 - DNA, 34 bp, Artificial Sequence
  Description of Artificial Sequence: Synthetic oligonucleotide
gttgggctgtaaaaatgcacaggctattcaggac

SEQ ID NO: 284507 - DNA, 36 bp, Artificial Sequence
  Description of Artificial Sequence: Synthetic oligonucleotide
ttgggctgtaaaaatgcacaggctattcaggacatg

SEQ ID NO: 284508 - DNA, 35 bp, Artificial Sequence
  Description of Artificial Sequence: Synthetic oligonucleotide
tgggctgtaaaaatgcacaggctattcaggacatg

SEQ ID NO: 284509 - DNA, 34 bp, Artificial Sequence
  Description of Artificial Sequence: Synthetic oligonucleotide
gggctgtaaaaatgcacaggctattcaggacatg

SEQ ID NO: 284510 - DNA, 34 bp, Artificial Sequence
  Description of Artificial Sequence: Synthetic oligonucleotide
ggctgtaaaaatgcacaggctattcaggacatgg

SEQ ID NO: 284511 - DNA, 36 bp, Artificial Sequence
  Description of Artificial Sequence: Synthetic oligonucleotide
gctgtaaaaatgcacaggctattcaggacatggatg

SEQ ID NO: 284512 - DNA, 36 bp, Artificial Sequence
  Description of Artificial Sequence: Synthetic oligonucleotide
ctgtaaaaatgcacaggctattcaggacatggatgg

SEQ ID NO: 284513 - DNA, 40 bp, Artificial Sequence
  Description of Artificial Sequence: Synthetic oligonucleotide
tgtaaaaatgcacaggctattcaggacatggatggttatg

SEQ ID NO: 284514 - DNA, 39 bp, Artificial Sequence
  Description of Artificial Sequence: Synthetic oligonucleotide
gtaaaaatgcacaggctattcaggacatggatggttatg

SEQ ID NO: 284515 - DNA, 39 bp, Artificial Sequence
  Description of Artificial Sequence: Synthetic oligonucleotide
taaaaatgcacaggctattcaggacatggatggttatgc

SEQ ID NO: 284516 - DNA, 38 bp, Artificial Sequence
  Description of Artificial Sequence: Synthetic oligonucleotide
aaaaatgcacaggctattcaggacatggatggttatgc

SEQ ID NO: 284517 - DNA, 37 bp, Artificial Sequence
  Description of Artificial Sequence: Synthetic oligonucleotide
aaaatgcacaggctattcaggacatggatggttatgc

SEQ ID NO: 284518 - DNA, 36 bp, Artificial Sequence
  Description of Artificial Sequence: Synthetic oligonucleotide
aaatgcacaggctattcaggacatggatggttatgc

SEQ ID NO: 284519 - DNA, 35 bp, Artificial Sequence
  Description of Artificial Sequence: Synthetic oligonucleotide
aatgcacaggctattcaggacatggatggttatgc

SEQ ID NO: 284520 - DNA, 34 bp, Artificial Sequence
  Description of Artificial Sequence: Synthetic oligonucleotide
atgcacaggctattcaggacatggatggttatgc

SEQ ID NO: 284521 - DNA, 33 bp, Artificial Sequence
  Description of Artificial Sequence: Synthetic oligonucleotide
tgcacaggctattcaggacatggatggttatgc

SEQ ID NO: 284522 - DNA, 32 bp, Artificial Sequence
  Description of Artificial Sequence: Synthetic oligonucleotide
gcacaggctattcaggacatggatggttatgc

SEQ ID NO: 284523 - DNA, 33 bp, Artificial Sequence
  Description of Artificial Sequence: Synthetic oligonucleotide
cacaggctattcaggacatggatggttatgctc

SEQ ID NO: 284524 - DNA, 35 bp, Artificial Sequence
  Description of Artificial Sequence: Synthetic oligonucleotide
acaggctattcaggacatggatggttatgctcaag

SEQ ID NO: 284525 - DNA, 34 bp, Artificial Sequence
  Description of Artificial Sequence: Synthetic oligonucleotide
caggctattcaggacatggatggttatgctcaag

SEQ ID NO: 284526 - DNA, 37 bp, Artificial Sequence
  Description of Artificial Sequence: Synthetic oligonucleotide
aggctattcaggacatggatggttatgctcaagaaac

SEQ ID NO: 284527 - DNA, 36 bp, Artificial Sequence
  Description of Artificial Sequence: Synthetic oligonucleotide
ggctattcaggacatggatggttatgctcaagaaac

SEQ ID NO: 284528 - DNA, 37 bp, Artificial Sequence
  Description of Artificial Sequence: Synthetic oligonucleotide
gctattcaggacatggatggttatgctcaagaaactg

SEQ ID NO: 284529 - DNA, 39 bp, Artificial Sequence
  Description of Artificial Sequence: Synthetic oligonucleotide
ctattcaggacatggatggttatgctcaagaaactgaac

SEQ ID NO: 284530 - DNA, 41 bp, Artificial Sequence
  Description of Artificial Sequence: Synthetic oligonucleotide
tattcaggacatggatggttatgctcaagaaactgaacatg

SEQ ID NO: 284531 - DNA, 40 bp, Artificial Sequence
  Description of Artificial Sequence: Synthetic oligonucleotide
attcaggacatggatggttatgctcaagaaactgaacatg

SEQ ID NO: 284532 - DNA, 39 bp, Artificial Sequence
  Description of Artificial Sequence: Synthetic oligonucleotide
ttcaggacatggatggttatgctcaagaaactgaacatg

SEQ ID NO: 284533 - DNA, 38 bp, Artificial Sequence
  Description of Artificial Sequence: Synthetic oligonucleotide
tcaggacatggatggttatgctcaagaaactgaacatg

SEQ ID NO: 284534 - DNA, 37 bp, Artificial Sequence
  Description of Artificial Sequence: Synthetic oligonucleotide
caggacatggatggttatgctcaagaaactgaacatg

SEQ ID NO: 284535 - DNA, 38 bp, Artificial Sequence
  Description of Artificial Sequence: Synthetic oligonucleotide
aggacatggatggttatgctcaagaaactgaacatgag

SEQ ID NO: 284536 - DNA, 37 bp, Artificial Sequence
  Description of Artificial Sequence: Synthetic oligonucleotide
ggacatggatggttatgctcaagaaactgaacatgag

SEQ ID NO: 284537 - DNA, 39 bp, Artificial Sequence
  Description of Artificial Sequence: Synthetic oligonucleotide
gacatggatggttatgctcaagaaactgaacatgagatg

SEQ ID NO: 284538 - DNA, 42 bp, Artificial Sequence
  Description of Artificial Sequence: Synthetic oligonucleotide
acatggatggttatgctcaagaaactgaacatgagatgattc

SEQ ID NO: 284539 - DNA, 41 bp, Artificial Sequence
  Description of Artificial Sequence: Synthetic oligonucleotide
catggatggttatgctcaagaaactgaacatgagatgattc

SEQ ID NO: 284540 - DNA, 42 bp, Artificial Sequence
  Description of Artificial Sequence: Synthetic oligonucleotide
atggatggttatgctcaagaaactgaacatgagatgattctg

SEQ ID NO: 284541 - DNA, 41 bp, Artificial Sequence
  Description of Artificial Sequence: Synthetic oligonucleotide
tggatggttatgctcaagaaactgaacatgagatgattctg

SEQ ID NO: 284542 - DNA, 40 bp, Artificial Sequence
  Description of Artificial Sequence: Synthetic oligonucleotide
ggatggttatgctcaagaaactgaacatgagatgattctg

SEQ ID NO: 284543 - DNA, 40 bp, Artificial Sequence
  Description of Artificial Sequence: Synthetic oligonucleotide
gatggttatgctcaagaaactgaacatgagatgattctgc

SEQ ID NO: 284544 - DNA, 40 bp, Artificial Sequence
  Description of Artificial Sequence: Synthetic oligonucleotide
atggttatgctcaagaaactgaacatgagatgattctgcg

SEQ ID NO: 284545 - DNA, 39 bp, Artificial Sequence
  Description of Artificial Sequence: Synthetic oligonucleotide
tggttatgctcaagaaactgaacatgagatgattctgcg

SEQ ID NO: 284546 - DNA, 38 bp, Artificial Sequence
  Description of Artificial Sequence: Synthetic oligonucleotide
ggttatgctcaagaaactgaacatgagatgattctgcg

SEQ ID NO: 284547 - DNA, 39 bp, Artificial Sequence
  Description of Artificial Sequence: Synthetic oligonucleotide
gttatgctcaagaaactgaacatgagatgattctgcgag

SEQ ID NO: 284548 - DNA, 39 bp, Artificial Sequence
  Description of Artificial Sequence: Synthetic oligonucleotide
ttatgctcaagaaactgaacatgagatgattctgcgagg

SEQ ID NO: 284549 - DNA, 38 bp, Artificial Sequence
  Description of Artificial Sequence: Synthetic oligonucleotide
tatgctcaagaaactgaacatgagatgattctgcgagg

SEQ ID NO: 284550 - DNA, 37 bp, Artificial Sequence
  Description of Artificial Sequence: Synthetic oligonucleotide
atgctcaagaaactgaacatgagatgattctgcgagg

SEQ ID NO: 284551 - DNA, 36 bp, Artificial Sequence
  Description of Artificial Sequence: Synthetic oligonucleotide
tgctcaagaaactgaacatgagatgattctgcgagg

SEQ ID NO: 284552 - DNA, 35 bp, Artificial Sequence
  Description of Artificial Sequence: Synthetic oligonucleotide
gctcaagaaactgaacatgagatgattctgcgagg

SEQ ID NO: 284553 - DNA, 36 bp, Artificial Sequence
  Description of Artificial Sequence: Synthetic oligonucleotide
ctcaagaaactgaacatgagatgattctgcgaggtc

SEQ ID NO: 284554 - DNA, 38 bp, Artificial Sequence
  Description of Artificial Sequence: Synthetic oligonucleotide
tcaagaaactgaacatgagatgattctgcgaggtcttg

SEQ ID NO: 284555 - DNA, 37 bp, Artificial Sequence
  Description of Artificial Sequence: Synthetic oligonucleotide
caagaaactgaacatgagatgattctgcgaggtcttg

SEQ ID NO: 284556 - DNA, 37 bp, Artificial Sequence
  Description of Artificial Sequence: Synthetic oligonucleotide
aagaaactgaacatgagatgattctgcgaggtcttgc

SEQ ID NO: 284557 - DNA, 36 bp, Artificial Sequence
  Description of Artificial Sequence: Synthetic oligonucleotide
agaaactgaacatgagatgattctgcgaggtcttgc

SEQ ID NO: 284558 - DNA, 35 bp, Artificial Sequence
  Description of Artificial Sequence: Synthetic oligonucleotide
gaaactgaacatgagatgattctgcgaggtcttgc

SEQ ID NO: 284559 - DNA, 36 bp, Artificial Sequence
  Description of Artificial Sequence: Synthetic oligonucleotide
aaactgaacatgagatgattctgcgaggtcttgcac

SEQ ID NO: 284560 - DNA, 35 bp, Artificial Sequence
  Description of Artificial Sequence: Synthetic oligonucleotide
aactgaacatgagatgattctgcgaggtcttgcac

SEQ ID NO: 284561 - DNA, 34 bp, Artificial Sequence
  Description of Artificial Sequence: Synthetic oligonucleotide
actgaacatgagatgattctgcgaggtcttgcac

SEQ ID NO: 284562 - DNA, 33 bp, Artificial Sequence
  Description of Artificial Sequence: Synthetic oligonucleotide
ctgaacatgagatgattctgcgaggtcttgcac

SEQ ID NO: 284563 - DNA, 35 bp, Artificial Sequence
  Description of Artificial Sequence: Synthetic oligonucleotide
tgaacatgagatgattctgcgaggtcttgcacttg

SEQ ID NO: 284564 - DNA, 34 bp, Artificial Sequence
  Description of Artificial Sequence: Synthetic oligonucleotide
gaacatgagatgattctgcgaggtcttgcacttg

SEQ ID NO: 284565 - DNA, 34 bp, Artificial Sequence
  Description of Artificial Sequence: Synthetic oligonucleotide
aacatgagatgattctgcgaggtcttgcacttgg

SEQ ID NO: 284566 - DNA, 33 bp, Artificial Sequence
  Description of Artificial Sequence: Synthetic oligonucleotide
acatgagatgattctgcgaggtcttgcacttgg

SEQ ID NO: 284567 - DNA, 32 bp, Artificial Sequence
  Description of Artificial Sequence: Synthetic oligonucleotide
catgagatgattctgcgaggtcttgcacttgg

SEQ ID NO: 284568 - DNA, 32 bp, Artificial Sequence
  Description of Artificial Sequence: Synthetic oligonucleotide
atgagatgattctgcgaggtcttgcacttggc

SEQ ID NO: 284569 - DNA, 31 bp, Artificial Sequence
  Description of Artificial Sequence: Synthetic oligonucleotide
tgagatgattctgcgaggtcttgcacttggc

SEQ ID NO: 284570 - DNA, 30 bp, Artificial Sequence
  Description of Artificial Sequence: Synthetic oligonucleotide
gagatgattctgcgaggtcttgcacttggc

SEQ ID NO: 284571 - DNA, 33 bp, Artificial Sequence
  Description of Artificial Sequence: Synthetic oligonucleotide
agatgattctgcgaggtcttgcacttggcatag

SEQ ID NO: 284572 - DNA, 32 bp, Artificial Sequence
  Description of Artificial Sequence: Synthetic oligonucleotide
gatgattctgcgaggtcttgcacttggcatag

SEQ ID NO: 284573 - DNA, 32 bp, Artificial Sequence
  Description of Artificial Sequence: Synthetic oligonucleotide
atgattctgcgaggtcttgcacttggcatagg

SEQ ID NO: 284574 - DNA, 31 bp, Artificial Sequence
  Description of Artificial Sequence: Synthetic oligonucleotide
tgattctgcgaggtcttgcacttggcatagg

SEQ ID NO: 284575 - DNA, 30 bp, Artificial Sequence
  Description of Artificial Sequence: Synthetic oligonucleotide
gattctgcgaggtcttgcacttggcatagg

SEQ ID NO: 284576 - DNA, 34 bp, Artificial Sequence
  Description of Artificial Sequence: Synthetic oligonucleotide
attctgcgaggtcttgcacttggcataggtttag

SEQ ID NO: 284577 - DNA, 33 bp, Artificial Sequence
  Description of Artificial Sequence: Synthetic oligonucleotide
ttctgcgaggtcttgcacttggcataggtttag

SEQ ID NO: 284578 - DNA, 32 bp, Artificial Sequence
  Description of Artificial Sequence: Synthetic oligonucleotide
tctgcgaggtcttgcacttggcataggtttag

SEQ ID NO: 284579 - DNA, 31 bp, Artificial Sequence
  Description of Artificial Sequence: Synthetic oligonucleotide
ctgcgaggtcttgcacttggcataggtttag

SEQ ID NO: 284580 - DNA, 35 bp, Artificial Sequence
  Description of Artificial Sequence: Synthetic oligonucleotide
tgcgaggtcttgcacttggcataggtttagtaatc

SEQ ID NO: 284581 - DNA, 34 bp, Artificial Sequence
  Description of Artificial Sequence: Synthetic oligonucleotide
gcgaggtcttgcacttggcataggtttagtaatc

SEQ ID NO: 284582 - DNA, 37 bp, Artificial Sequence
  Description of Artificial Sequence: Synthetic oligonucleotide
cgaggtcttgcacttggcataggtttagtaatctatg

SEQ ID NO: 284583 - DNA, 37 bp, Artificial Sequence
  Description of Artificial Sequence: Synthetic oligonucleotide
gaggtcttgcacttggcataggtttagtaatctatgg

SEQ ID NO: 284584 - DNA, 37 bp, Artificial Sequence
  Description of Artificial Sequence: Synthetic oligonucleotide
aggtcttgcacttggcataggtttagtaatctatggg

SEQ ID NO: 284585 - DNA, 36 bp, Artificial Sequence
  Description of Artificial Sequence: Synthetic oligonucleotide
ggtcttgcacttggcataggtttagtaatctatggg

SEQ ID NO: 284586 - DNA, 37 bp, Artificial Sequence
  Description of Artificial Sequence: Synthetic oligonucleotide
gtcttgcacttggcataggtttagtaatctatgggag

SEQ ID NO: 284587 - DNA, 37 bp, Artificial Sequence
  Description of Artificial Sequence: Synthetic oligonucleotide
tcttgcacttggcataggtttagtaatctatgggagg

SEQ ID NO: 284588 - DNA, 36 bp, Artificial Sequence
  Description of Artificial Sequence: Synthetic oligonucleotide
cttgcacttggcataggtttagtaatctatgggagg

SEQ ID NO: 284589 - DNA, 38 bp, Artificial Sequence
  Description of Artificial Sequence: Synthetic oligonucleotide
ttgcacttggcataggtttagtaatctatgggaggttg

SEQ ID NO: 284590 - DNA, 37 bp, Artificial Sequence
  Description of Artificial Sequence: Synthetic oligonucleotide
tgcacttggcataggtttagtaatctatgggaggttg

SEQ ID NO: 284591 - DNA, 36 bp, Artificial Sequence
  Description of Artificial Sequence: Synthetic oligonucleotide
gcacttggcataggtttagtaatctatgggaggttg

SEQ ID NO: 284592 - DNA, 36 bp, Artificial Sequence
  Description of Artificial Sequence: Synthetic oligonucleotide
cacttggcataggtttagtaatctatgggaggttgg

SEQ ID NO: 284593 - DNA, 38 bp, Artificial Sequence
  Description of Artificial Sequence: Synthetic oligonucleotide
acttggcataggtttagtaatctatgggaggttggaag

SEQ ID NO: 284594 - DNA, 37 bp, Artificial Sequence
  Description of Artificial Sequence: Synthetic oligonucleotide
cttggcataggtttagtaatctatgggaggttggaag

SEQ ID NO: 284595 - DNA, 38 bp, Artificial Sequence
  Description of Artificial Sequence: Synthetic oligonucleotide
ttggcataggtttagtaatctatgggaggttggaagag

SEQ ID NO: 284596 - DNA, 37 bp, Artificial Sequence
  Description of Artificial Sequence: Synthetic oligonucleotide
tggcataggtttagtaatctatgggaggttggaagag

SEQ ID NO: 284597 - DNA, 36 bp, Artificial Sequence
  Description of Artificial Sequence: Synthetic oligonucleotide
ggcataggtttagtaatctatgggaggttggaagag

SEQ ID NO: 284598 - DNA, 36 bp, Artificial Sequence
  Description of Artificial Sequence: Synthetic oligonucleotide
gcataggtttagtaatctatgggaggttggaagagg

SEQ ID NO: 284599 - DNA, 36 bp, Artificial Sequence
  Description of Artificial Sequence: Synthetic oligonucleotide
cataggtttagtaatctatgggaggttggaagaggg

SEQ ID NO: 284600 - DNA, 37 bp, Artificial Sequence
  Description of Artificial Sequence: Synthetic oligonucleotide
ataggtttagtaatctatgggaggttggaagagggtg

SEQ ID NO: 284601 - DNA, 36 bp, Artificial Sequence
  Description of Artificial Sequence: Synthetic oligonucleotide
taggtttagtaatctatgggaggttggaagagggtg

SEQ ID NO: 284602 - DNA, 35 bp, Artificial Sequence
  Description of Artificial Sequence: Synthetic oligonucleotide
aggtttagtaatctatgggaggttggaagagggtg

SEQ ID NO: 284603 - DNA, 34 bp, Artificial Sequence
  Description of Artificial Sequence: Synthetic oligonucleotide
ggtttagtaatctatgggaggttggaagagggtg

SEQ ID NO: 284604 - DNA, 36 bp, Artificial Sequence
  Description of Artificial Sequence: Synthetic oligonucleotide
gtttagtaatctatgggaggttggaagagggtgatg

SEQ ID NO: 284605 - DNA, 36 bp, Artificial Sequence
  Description of Artificial Sequence: Synthetic oligonucleotide
tttagtaatctatgggaggttggaagagggtgatgc

SEQ ID NO: 284606 - DNA, 35 bp, Artificial Sequence
  Description of Artificial Sequence: Synthetic oligonucleotide
ttagtaatctatgggaggttggaagagggtgatgc

SEQ ID NO: 284607 - DNA, 34 bp, Artificial Sequence
  Description of Artificial Sequence: Synthetic oligonucleotide
tagtaatctatgggaggttggaagagggtgatgc

SEQ ID NO: 284608 - DNA, 33 bp, Artificial Sequence
  Description of Artificial Sequence: Synthetic oligonucleotide
agtaatctatgggaggttggaagagggtgatgc

SEQ ID NO: 284609 - DNA, 32 bp, Artificial Sequence
  Description of Artificial Sequence: Synthetic oligonucleotide
gtaatctatgggaggttggaagagggtgatgc

SEQ ID NO: 284610 - DNA, 33 bp, Artificial Sequence
  Description of Artificial Sequence: Synthetic oligonucleotide
taatctatgggaggttggaagagggtgatgctc

SEQ ID NO: 284611 - DNA, 32 bp, Artificial Sequence
  Description of Artificial Sequence: Synthetic oligonucleotide
aatctatgggaggttggaagagggtgatgctc

SEQ ID NO: 284612 - DNA, 31 bp, Artificial Sequence
  Description of Artificial Sequence: Synthetic oligonucleotide
atctatgggaggttggaagagggtgatgctc

SEQ ID NO: 284613 - DNA, 30 bp, Artificial Sequence
  Description of Artificial Sequence: Synthetic oligonucleotide
tctatgggaggttggaagagggtgatgctc

SEQ ID NO: 284614 - DNA, 29 bp, Artificial Sequence
  Description of Artificial Sequence: Synthetic oligonucleotide
ctatgggaggttggaagagggtgatgctc

SEQ ID NO: 284615 - DNA, 30 bp, Artificial Sequence
  Description of Artificial Sequence: Synthetic oligonucleotide
tatgggaggttggaagagggtgatgctctg

SEQ ID NO: 284616 - DNA, 29 bp, Artificial Sequence
  Description of Artificial Sequence: Synthetic oligonucleotide
atgggaggttggaagagggtgatgctctg

SEQ ID NO: 284617 - DNA, 28 bp, Artificial Sequence
  Description of Artificial Sequence: Synthetic oligonucleotide
tgggaggttggaagagggtgatgctctg

SEQ ID NO: 284618 - DNA, 27 bp, Artificial Sequence
  Description of Artificial Sequence: Synthetic oligonucleotide
gggaggttggaagagggtgatgctctg

SEQ ID NO: 284619 - DNA, 30 bp, Artificial Sequence
  Description of Artificial Sequence: Synthetic oligonucleotide
ggaggttggaagagggtgatgctctgattg

SEQ ID NO: 284620 - DNA, 33 bp, Artificial Sequence
  Description of Artificial Sequence: Synthetic oligonucleotide
gaggttggaagagggtgatgctctgattgaatc

SEQ ID NO: 284621 - DNA, 34 bp, Artificial Sequence
  Description of Artificial Sequence: Synthetic oligonucleotide
aggttggaagagggtgatgctctgattgaatctg

SEQ ID NO: 284622 - DNA, 33 bp, Artificial Sequence
  Description of Artificial Sequence: Synthetic oligonucleotide
ggttggaagagggtgatgctctgattgaatctg

SEQ ID NO: 284623 - DNA, 34 bp, Artificial Sequence
  Description of Artificial Sequence: Synthetic oligonucleotide
gttggaagagggtgatgctctgattgaatctgtc

SEQ ID NO: 284624 - DNA, 35 bp, Artificial Sequence
  Description of Artificial Sequence: Synthetic oligonucleotide
ttggaagagggtgatgctctgattgaatctgtctg

SEQ ID NO: 284625 - DNA, 34 bp, Artificial Sequence
  Description of Artificial Sequence: Synthetic oligonucleotide
tggaagagggtgatgctctgattgaatctgtctg

SEQ ID NO: 284626 - DNA, 33 bp, Artificial Sequence
  Description of Artificial Sequence: Synthetic oligonucleotide
ggaagagggtgatgctctgattgaatctgtctg

SEQ ID NO: 284627 - DNA, 34 bp, Artificial Sequence
  Description of Artificial Sequence: Synthetic oligonucleotide
gaagagggtgatgctctgattgaatctgtctgtc

SEQ ID NO: 284628 - DNA, 34 bp, Artificial Sequence
  Description of Artificial Sequence: Synthetic oligonucleotide
aagagggtgatgctctgattgaatctgtctgtcg

SEQ ID NO: 284629 - DNA, 33 bp, Artificial Sequence
  Description of Artificial Sequence: Synthetic oligonucleotide
agagggtgatgctctgattgaatctgtctgtcg

SEQ ID NO: 284630 - DNA, 32 bp, Artificial Sequence
  Description of Artificial Sequence: Synthetic oligonucleotide
gagggtgatgctctgattgaatctgtctgtcg

SEQ ID NO: 284631 - DNA, 33 bp, Artificial Sequence
  Description of Artificial Sequence: Synthetic oligonucleotide
agggtgatgctctgattgaatctgtctgtcgtg

SEQ ID NO: 284632 - DNA, 32 bp, Artificial Sequence
  Description of Artificial Sequence: Synthetic oligonucleotide
gggtgatgctctgattgaatctgtctgtcgtg

SEQ ID NO: 284633 - DNA, 33 bp, Artificial Sequence
  Description of Artificial Sequence: Synthetic oligonucleotide
ggtgatgctctgattgaatctgtctgtcgtgtc

SEQ ID NO: 284634 - DNA, 35 bp, Artificial Sequence
  Description of Artificial Sequence: Synthetic oligonucleotide
gtgatgctctgattgaatctgtctgtcgtgtcaag

SEQ ID NO: 284635 - DNA, 35 bp, Artificial Sequence
  Description of Artificial Sequence: Synthetic oligonucleotide
tgatgctctgattgaatctgtctgtcgtgtcaagg

SEQ ID NO: 284636 - DNA, 34 bp, Artificial Sequence
  Description of Artificial Sequence: Synthetic oligonucleotide
gatgctctgattgaatctgtctgtcgtgtcaagg

SEQ ID NO: 284637 - DNA, 35 bp, Artificial Sequence
  Description of Artificial Sequence: Synthetic oligonucleotide
atgctctgattgaatctgtctgtcgtgtcaaggac

SEQ ID NO: 284638 - DNA, 34 bp, Artificial Sequence
  Description of Artificial Sequence: Synthetic oligonucleotide
tgctctgattgaatctgtctgtcgtgtcaaggac

SEQ ID NO: 284639 - DNA, 33 bp, Artificial Sequence
  Description of Artificial Sequence: Synthetic oligonucleotide
gctctgattgaatctgtctgtcgtgtcaaggac

SEQ ID NO: 284640 - DNA, 33 bp, Artificial Sequence
  Description of Artificial Sequence: Synthetic oligonucleotide
ctctgattgaatctgtctgtcgtgtcaaggacc

SEQ ID NO: 284641 - DNA, 33 bp, Artificial Sequence
  Description of Artificial Sequence: Synthetic oligonucleotide
tctgattgaatctgtctgtcgtgtcaaggaccc

SEQ ID NO: 284642 - DNA, 32 bp, Artificial Sequence
  Description of Artificial Sequence: Synthetic oligonucleotide
ctgattgaatctgtctgtcgtgtcaaggaccc

SEQ ID NO: 284643 - DNA, 36 bp, Artificial Sequence
  Description of Artificial Sequence: Synthetic oligonucleotide
tgattgaatctgtctgtcgtgtcaaggaccctattc

SEQ ID NO: 284644 - DNA, 35 bp, Artificial Sequence
  Description of Artificial Sequence: Synthetic oligonucleotide
gattgaatctgtctgtcgtgtcaaggaccctattc

SEQ ID NO: 284645 - DNA, 37 bp, Artificial Sequence
  Description of Artificial Sequence: Synthetic oligonucleotide
attgaatctgtctgtcgtgtcaaggaccctattcttc

SEQ ID NO: 284646 - DNA, 36 bp, Artificial Sequence
  Description of Artificial Sequence: Synthetic oligonucleotide
ttgaatctgtctgtcgtgtcaaggaccctattcttc

SEQ ID NO: 284647 - DNA, 35 bp, Artificial Sequence
  Description of Artificial Sequence: Synthetic oligonucleotide
tgaatctgtctgtcgtgtcaaggaccctattcttc

SEQ ID NO: 284648 - DNA, 34 bp, Artificial Sequence
  Description of Artificial Sequence: Synthetic oligonucleotide
gaatctgtctgtcgtgtcaaggaccctattcttc

SEQ ID NO: 284649 - DNA, 34 bp, Artificial Sequence
  Description of Artificial Sequence: Synthetic oligonucleotide
aatctgtctgtcgtgtcaaggaccctattcttcg

SEQ ID NO: 284650 - DNA, 33 bp, Artificial Sequence
  Description of Artificial Sequence: Synthetic oligonucleotide
atctgtctgtcgtgtcaaggaccctattcttcg

SEQ ID NO: 284651 - DNA, 32 bp, Artificial Sequence
  Description of Artificial Sequence: Synthetic oligonucleotide
tctgtctgtcgtgtcaaggaccctattcttcg

SEQ ID NO: 284652 - DNA, 31 bp, Artificial Sequence
  Description of Artificial Sequence: Synthetic oligonucleotide
ctgtctgtcgtgtcaaggaccctattcttcg

SEQ ID NO: 284653 - DNA, 33 bp, Artificial Sequence
  Description of Artificial Sequence: Synthetic oligonucleotide
tgtctgtcgtgtcaaggaccctattcttcgatg

SEQ ID NO: 284654 - DNA, 32 bp, Artificial Sequence
  Description of Artificial Sequence: Synthetic oligonucleotide
gtctgtcgtgtcaaggaccctattcttcgatg

SEQ ID NO: 284655 - DNA, 32 bp, Artificial Sequence
  Description of Artificial Sequence: Synthetic oligonucleotide
tctgtcgtgtcaaggaccctattcttcgatgg

SEQ ID NO: 284656 - DNA, 31 bp, Artificial Sequence
  Description of Artificial Sequence: Synthetic oligonucleotide
ctgtcgtgtcaaggaccctattcttcgatgg

SEQ ID NO: 284657 - DNA, 32 bp, Artificial Sequence
  Description of Artificial Sequence: Synthetic oligonucleotide
tgtcgtgtcaaggaccctattcttcgatggtc

SEQ ID NO: 284658 - DNA, 31 bp, Artificial Sequence
  Description of Artificial Sequence: Synthetic oligonucleotide
gtcgtgtcaaggaccctattcttcgatggtc

SEQ ID NO: 284659 - DNA, 32 bp, Artificial Sequence
  Description of Artificial Sequence: Synthetic oligonucleotide
tcgtgtcaaggaccctattcttcgatggtctg

SEQ ID NO: 284660 - DNA, 31 bp, Artificial Sequence
  Description of Artificial Sequence: Synthetic oligonucleotide
cgtgtcaaggaccctattcttcgatggtctg

SEQ ID NO: 284661 - DNA, 31 bp, Artificial Sequence
  Description of Artificial Sequence: Synthetic oligonucleotide
gtgtcaaggaccctattcttcgatggtctgg

SEQ ID NO: 284662 - DNA, 34 bp, Artificial Sequence
  Description of Artificial Sequence: Synthetic oligonucleotide
tgtcaaggaccctattcttcgatggtctggaaag

SEQ ID NO: 284663 - DNA, 33 bp, Artificial Sequence
  Description of Artificial Sequence: Synthetic oligonucleotide
gtcaaggaccctattcttcgatggtctggaaag

SEQ ID NO: 284664 - DNA, 37 bp, Artificial Sequence
  Description of Artificial Sequence: Synthetic oligonucleotide
tcaaggaccctattcttcgatggtctggaaagtatac

SEQ ID NO: 284665 - DNA, 36 bp, Artificial Sequence
  Description of Artificial Sequence: Synthetic oligonucleotide
caaggaccctattcttcgatggtctggaaagtatac

SEQ ID NO: 284666 - DNA, 37 bp, Artificial Sequence
  Description of Artificial Sequence: Synthetic oligonucleotide
aaggaccctattcttcgatggtctggaaagtatactg

SEQ ID NO: 284667 - DNA, 36 bp, Artificial Sequence
  Description of Artificial Sequence: Synthetic oligonucleotide
aggaccctattcttcgatggtctggaaagtatactg

SEQ ID NO: 284668 - DNA, 35 bp, Artificial Sequence
  Description of Artificial Sequence: Synthetic oligonucleotide
ggaccctattcttcgatggtctggaaagtatactg

SEQ ID NO: 284669 - DNA, 37 bp, Artificial Sequence
  Description of Artificial Sequence: Synthetic oligonucleotide
gaccctattcttcgatggtctggaaagtatactgttg

SEQ ID NO: 284670 - DNA, 37 bp, Artificial Sequence
  Description of Artificial Sequence: Synthetic oligonucleotide
accctattcttcgatggtctggaaagtatactgttgc

SEQ ID NO: 284671 - DNA, 36 bp, Artificial Sequence
  Description of Artificial Sequence: Synthetic oligonucleotide
ccctattcttcgatggtctggaaagtatactgttgc

SEQ ID NO: 284672 - DNA, 36 bp, Artificial Sequence
  Description of Artificial Sequence: Synthetic oligonucleotide
cctattcttcgatggtctggaaagtatactgttgcc

SEQ ID NO: 284673 - DNA, 38 bp, Artificial Sequence
  Description of Artificial Sequence: Synthetic oligonucleotide
ctattcttcgatggtctggaaagtatactgttgccatg

SEQ ID NO: 284674 - DNA, 38 bp, Artificial Sequence
  Description of Artificial Sequence: Synthetic oligonucleotide
tattcttcgatggtctggaaagtatactgttgccatgg

SEQ ID NO: 284675 - DNA, 37 bp, Artificial Sequence
  Description of Artificial Sequence: Synthetic oligonucleotide
attcttcgatggtctggaaagtatactgttgccatgg

SEQ ID NO: 284676 - DNA, 36 bp, Artificial Sequence
  Description of Artificial Sequence: Synthetic oligonucleotide
ttcttcgatggtctggaaagtatactgttgccatgg

SEQ ID NO: 284677 - DNA, 35 bp, Artificial Sequence
  Description of Artificial Sequence: Synthetic oligonucleotide
tcttcgatggtctggaaagtatactgttgccatgg

SEQ ID NO: 284678 - DNA, 34 bp, Artificial Sequence
  Description of Artificial Sequence: Synthetic oligonucleotide
cttcgatggtctggaaagtatactgttgccatgg

SEQ ID NO: 284679 - DNA, 34 bp, Artificial Sequence
  Description of Artificial Sequence: Synthetic oligonucleotide
ttcgatggtctggaaagtatactgttgccatggc

SEQ ID NO: 284680 - DNA, 33 bp, Artificial Sequence
  Description of Artificial Sequence: Synthetic oligonucleotide
tcgatggtctggaaagtatactgttgccatggc

SEQ ID NO: 284681 - DNA, 32 bp, Artificial Sequence
  Description of Artificial Sequence: Synthetic oligonucleotide
cgatggtctggaaagtatactgttgccatggc

SEQ ID NO: 284682 - DNA, 37 bp, Artificial Sequence
  Description of Artificial Sequence: Synthetic oligonucleotide
gatggtctggaaagtatactgttgccatggctaattg

SEQ ID NO: 284683 - DNA, 38 bp, Artificial Sequence
  Description of Artificial Sequence: Synthetic oligonucleotide
atggtctggaaagtatactgttgccatggctaattgtg

SEQ ID NO: 284684 - DNA, 37 bp, Artificial Sequence
  Description of Artificial Sequence: Synthetic oligonucleotide
tggtctggaaagtatactgttgccatggctaattgtg

SEQ ID NO: 284685 - DNA, 36 bp, Artificial Sequence
  Description of Artificial Sequence: Synthetic oligonucleotide
ggtctggaaagtatactgttgccatggctaattgtg

SEQ ID NO: 284686 - DNA, 36 bp, Artificial Sequence
  Description of Artificial Sequence: Synthetic oligonucleotide
gtctggaaagtatactgttgccatggctaattgtgg

SEQ ID NO: 284687 - DNA, 36 bp, Artificial Sequence
  Description of Artificial Sequence: Synthetic oligonucleotide
tctggaaagtatactgttgccatggctaattgtggc

SEQ ID NO: 284688 - DNA, 35 bp, Artificial Sequence
  Description of Artificial Sequence: Synthetic oligonucleotide
ctggaaagtatactgttgccatggctaattgtggc

SEQ ID NO: 284689 - DNA, 36 bp, Artificial Sequence
  Description of Artificial Sequence: Synthetic oligonucleotide
tggaaagtatactgttgccatggctaattgtggctg

SEQ ID NO: 284690 - DNA, 35 bp, Artificial Sequence
  Description of Artificial Sequence: Synthetic oligonucleotide
ggaaagtatactgttgccatggctaattgtggctg

SEQ ID NO: 284691 - DNA, 36 bp, Artificial Sequence
  Description of Artificial Sequence: Synthetic oligonucleotide
gaaagtatactgttgccatggctaattgtggctgtg

SEQ ID NO: 284692 - DNA, 36 bp, Artificial Sequence
  Description of Artificial Sequence: Synthetic oligonucleotide
aaagtatactgttgccatggctaattgtggctgtgg

SEQ ID NO: 284693 - DNA, 35 bp, Artificial Sequence
  Description of Artificial Sequence: Synthetic oligonucleotide
aagtatactgttgccatggctaattgtggctgtgg

SEQ ID NO: 284694 - DNA, 34 bp, Artificial Sequence
  Description of Artificial Sequence: Synthetic oligonucleotide
agtatactgttgccatggctaattgtggctgtgg

SEQ ID NO: 284695 - DNA, 33 bp, Artificial Sequence
  Description of Artificial Sequence: Synthetic oligonucleotide
gtatactgttgccatggctaattgtggctgtgg

SEQ ID NO: 284696 - DNA, 36 bp, Artificial Sequence
  Description of Artificial Sequence: Synthetic oligonucleotide
tatactgttgccatggctaattgtggctgtggtaac

SEQ ID NO: 284697 - DNA, 35 bp, Artificial Sequence
  Description of Artificial Sequence: Synthetic oligonucleotide
atactgttgccatggctaattgtggctgtggtaac

SEQ ID NO: 284698 - DNA, 34 bp, Artificial Sequence
  Description of Artificial Sequence: Synthetic oligonucleotide
tactgttgccatggctaattgtggctgtggtaac

SEQ ID NO: 284699 - DNA, 33 bp, Artificial Sequence
  Description of Artificial Sequence: Synthetic oligonucleotide
actgttgccatggctaattgtggctgtggtaac

SEQ ID NO: 284700 - DNA, 32 bp, Artificial Sequence
  Description of Artificial Sequence: Synthetic oligonucleotide
ctgttgccatggctaattgtggctgtggtaac

SEQ ID NO: 284701 - DNA, 34 bp, Artificial Sequence
  Description of Artificial Sequence: Synthetic oligonucleotide
tgttgccatggctaattgtggctgtggtaacaag

SEQ ID NO: 284702 - DNA, 33 bp, Artificial Sequence
  Description of Artificial Sequence: Synthetic oligonucleotide
gttgccatggctaattgtggctgtggtaacaag

SEQ ID NO: 284703 - DNA, 36 bp, Artificial Sequence
  Description of Artificial Sequence: Synthetic oligonucleotide
ttgccatggctaattgtggctgtggtaacaagaaag

SEQ ID NO: 284704 - DNA, 35 bp, Artificial Sequence
  Description of Artificial Sequence: Synthetic oligonucleotide
tgccatggctaattgtggctgtggtaacaagaaag

SEQ ID NO: 284705 - DNA, 34 bp, Artificial Sequence
  Description of Artificial Sequence: Synthetic oligonucleotide
gccatggctaattgtggctgtggtaacaagaaag

SEQ ID NO: 284706 - DNA, 34 bp, Artificial Sequence
  Description of Artificial Sequence: Synthetic oligonucleotide
ccatggctaattgtggctgtggtaacaagaaagc

SEQ ID NO: 284707 - DNA, 38 bp, Artificial Sequence
  Description of Artificial Sequence: Synthetic oligonucleotide
catggctaattgtggctgtggtaacaagaaagcaattg

SEQ ID NO: 284708 - DNA, 38 bp, Artificial Sequence
  Description of Artificial Sequence: Synthetic oligonucleotide
atggctaattgtggctgtggtaacaagaaagcaattgg

SEQ ID NO: 284709 - DNA, 37 bp, Artificial Sequence
  Description of Artificial Sequence: Synthetic oligonucleotide
tggctaattgtggctgtggtaacaagaaagcaattgg

SEQ ID NO: 284710 - DNA, 36 bp, Artificial Sequence
  Description of Artificial Sequence: Synthetic oligonucleotide
ggctaattgtggctgtggtaacaagaaagcaattgg

SEQ ID NO: 284711 - DNA, 37 bp, Artificial Sequence
  Description of Artificial Sequence: Synthetic oligonucleotide
gctaattgtggctgtggtaacaagaaagcaattggac

SEQ ID NO: 284712 - DNA, 37 bp, Artificial Sequence
  Description of Artificial Sequence: Synthetic oligonucleotide
ctaattgtggctgtggtaacaagaaagcaattggacg

SEQ ID NO: 284713 - DNA, 37 bp, Artificial Sequence
  Description of Artificial Sequence: Synthetic oligonucleotide
taattgtggctgtggtaacaagaaagcaattggacgc

SEQ ID NO: 284714 - DNA, 36 bp, Artificial Sequence
  Description of Artificial Sequence: Synthetic oligonucleotide
aattgtggctgtggtaacaagaaagcaattggacgc

SEQ ID NO: 284715 - DNA, 35 bp, Artificial Sequence
  Description of Artificial Sequence: Synthetic oligonucleotide
attgtggctgtggtaacaagaaagcaattggacgc

SEQ ID NO: 284716 - DNA, 34 bp, Artificial Sequence
  Description of Artificial Sequence: Synthetic oligonucleotide
ttgtggctgtggtaacaagaaagcaattggacgc

SEQ ID NO: 284717 - DNA, 33 bp, Artificial Sequence
  Description of Artificial Sequence: Synthetic oligonucleotide
tgtggctgtggtaacaagaaagcaattggacgc

SEQ ID NO: 284718 - DNA, 32 bp, Artificial Sequence
  Description of Artificial Sequence: Synthetic oligonucleotide
gtggctgtggtaacaagaaagcaattggacgc

SEQ ID NO: 284719 - DNA, 32 bp, Artificial Sequence
  Description of Artificial Sequence: Synthetic oligonucleotide
tggctgtggtaacaagaaagcaattggacgcc

SEQ ID NO: 284720 - DNA, 31 bp, Artificial Sequence
  Description of Artificial Sequence: Synthetic oligonucleotide
ggctgtggtaacaagaaagcaattggacgcc

SEQ ID NO: 284721 - DNA, 32 bp, Artificial Sequence
  Description of Artificial Sequence: Synthetic oligonucleotide
gctgtggtaacaagaaagcaattggacgcctg

SEQ ID NO: 284722 - DNA, 32 bp, Artificial Sequence
  Description of Artificial Sequence: Synthetic oligonucleotide
ctgtggtaacaagaaagcaattggacgcctgc

SEQ ID NO: 284723 - DNA, 34 bp, Artificial Sequence
  Description of Artificial Sequence: Synthetic oligonucleotide
tgtggtaacaagaaagcaattggacgcctgcaac

SEQ ID NO: 284724 - DNA, 33 bp, Artificial Sequence
  Description of Artificial Sequence: Synthetic oligonucleotide
gtggtaacaagaaagcaattggacgcctgcaac

SEQ ID NO: 284725 - DNA, 35 bp, Artificial Sequence
  Description of Artificial Sequence: Synthetic oligonucleotide
tggtaacaagaaagcaattggacgcctgcaacatg

SEQ ID NO: 284726 - DNA, 34 bp, Artificial Sequence
  Description of Artificial Sequence: Synthetic oligonucleotide
ggtaacaagaaagcaattggacgcctgcaacatg

SEQ ID NO: 284727 - DNA, 36 bp, Artificial Sequence
  Description of Artificial Sequence: Synthetic oligonucleotide
gtaacaagaaagcaattggacgcctgcaacatgttg

SEQ ID NO: 284728 - DNA, 36 bp, Artificial Sequence
  Description of Artificial Sequence: Synthetic oligonucleotide
taacaagaaagcaattggacgcctgcaacatgttgc

SEQ ID NO: 284729 - DNA, 35 bp, Artificial Sequence
  Description of Artificial Sequence: Synthetic oligonucleotide
aacaagaaagcaattggacgcctgcaacatgttgc

SEQ ID NO: 284730 - DNA, 34 bp, Artificial Sequence
  Description of Artificial Sequence: Synthetic oligonucleotide
acaagaaagcaattggacgcctgcaacatgttgc

SEQ ID NO: 284731 - DNA, 33 bp, Artificial Sequence
  Description of Artificial Sequence: Synthetic oligonucleotide
caagaaagcaattggacgcctgcaacatgttgc

SEQ ID NO: 284732 - DNA, 34 bp, Artificial Sequence
  Description of Artificial Sequence: Synthetic oligonucleotide
aagaaagcaattggacgcctgcaacatgttgcag

SEQ ID NO: 284733 - DNA, 33 bp, Artificial Sequence
  Description of Artificial Sequence: Synthetic oligonucleotide
agaaagcaattggacgcctgcaacatgttgcag

SEQ ID NO: 284734 - DNA, 32 bp, Artificial Sequence
  Description of Artificial Sequence: Synthetic oligonucleotide
gaaagcaattggacgcctgcaacatgttgcag

SEQ ID NO: 284735 - DNA, 35 bp, Artificial Sequence
  Description of Artificial Sequence: Synthetic oligonucleotide
aaagcaattggacgcctgcaacatgttgcagtaag

SEQ ID NO: 284736 - DNA, 34 bp, Artificial Sequence
  Description of Artificial Sequence: Synthetic oligonucleotide
aagcaattggacgcctgcaacatgttgcagtaag

SEQ ID NO: 284737 - DNA, 33 bp, Artificial Sequence
  Description of Artificial Sequence: Synthetic oligonucleotide
agcaattggacgcctgcaacatgttgcagtaag

SEQ ID NO: 284738 - DNA, 32 bp, Artificial Sequence
  Description of Artificial Sequence: Synthetic oligonucleotide
gcaattggacgcctgcaacatgttgcagtaag

SEQ ID NO: 284739 - DNA, 33 bp, Artificial Sequence
  Description of Artificial Sequence: Synthetic oligonucleotide
caattggacgcctgcaacatgttgcagtaagtg

SEQ ID NO: 284740 - DNA, 35 bp, Artificial Sequence
  Description of Artificial Sequence: Synthetic oligonucleotide
aattggacgcctgcaacatgttgcagtaagtgatc

SEQ ID NO: 284741 - DNA, 34 bp, Artificial Sequence
  Description of Artificial Sequence: Synthetic oligonucleotide
attggacgcctgcaacatgttgcagtaagtgatc

SEQ ID NO: 284742 - DNA, 33 bp, Artificial Sequence
  Description of Artificial Sequence: Synthetic oligonucleotide
ttggacgcctgcaacatgttgcagtaagtgatc

SEQ ID NO: 284743 - DNA, 32 bp, Artificial Sequence
  Description of Artificial Sequence: Synthetic oligonucleotide
tggacgcctgcaacatgttgcagtaagtgatc

SEQ ID NO: 284744 - DNA, 31 bp, Artificial Sequence
  Description of Artificial Sequence: Synthetic oligonucleotide
ggacgcctgcaacatgttgcagtaagtgatc

SEQ ID NO: 284745 - DNA, 36 bp, Artificial Sequence
  Description of Artificial Sequence: Synthetic oligonucleotide
gacgcctgcaacatgttgcagtaagtgatcttaatg

SEQ ID NO: 284746 - DNA, 38 bp, Artificial Sequence
  Description of Artificial Sequence: Synthetic oligonucleotide
acgcctgcaacatgttgcagtaagtgatcttaatgatg

SEQ ID NO: 284747 - DNA, 37 bp, Artificial Sequence
  Description of Artificial Sequence: Synthetic oligonucleotide
cgcctgcaacatgttgcagtaagtgatcttaatgatg

SEQ ID NO: 284748 - DNA, 39 bp, Artificial Sequence
  Description of Artificial Sequence: Synthetic oligonucleotide
gcctgcaacatgttgcagtaagtgatcttaatgatgttg

SEQ ID NO: 284749 - DNA, 40 bp, Artificial Sequence
  Description of Artificial Sequence: Synthetic oligonucleotide
cctgcaacatgttgcagtaagtgatcttaatgatgttgtc

SEQ ID NO: 284750 - DNA, 41 bp, Artificial Sequence
  Description of Artificial Sequence: Synthetic oligonucleotide
ctgcaacatgttgcagtaagtgatcttaatgatgttgtcag

SEQ ID NO: 284751 - DNA, 41 bp, Artificial Sequence
  Description of Artificial Sequence: Synthetic oligonucleotide
tgcaacatgttgcagtaagtgatcttaatgatgttgtcagg

SEQ ID NO: 284752 - DNA, 40 bp, Artificial Sequence
  Description of Artificial Sequence: Synthetic oligonucleotide
gcaacatgttgcagtaagtgatcttaatgatgttgtcagg

SEQ ID NO: 284753 - DNA, 41 bp, Artificial Sequence
  Description of Artificial Sequence: Synthetic oligonucleotide
caacatgttgcagtaagtgatcttaatgatgttgtcaggag

SEQ ID NO: 284754 - DNA, 41 bp, Artificial Sequence
  Description of Artificial Sequence: Synthetic oligonucleotide
aacatgttgcagtaagtgatcttaatgatgttgtcaggagc

SEQ ID NO: 284755 - DNA, 40 bp, Artificial Sequence
  Description of Artificial Sequence: Synthetic oligonucleotide
acatgttgcagtaagtgatcttaatgatgttgtcaggagc

SEQ ID NO: 284756 - DNA, 39 bp, Artificial Sequence
  Description of Artificial Sequence: Synthetic oligonucleotide
catgttgcagtaagtgatcttaatgatgttgtcaggagc

SEQ ID NO: 284757 - DNA, 39 bp, Artificial Sequence
  Description of Artificial Sequence: Synthetic oligonucleotide
atgttgcagtaagtgatcttaatgatgttgtcaggagcg

SEQ ID NO: 284758 - DNA, 38 bp, Artificial Sequence
  Description of Artificial Sequence: Synthetic oligonucleotide
tgttgcagtaagtgatcttaatgatgttgtcaggagcg

SEQ ID NO: 284759 - DNA, 37 bp, Artificial Sequence
  Description of Artificial Sequence: Synthetic oligonucleotide
gttgcagtaagtgatcttaatgatgttgtcaggagcg

SEQ ID NO: 284760 - DNA, 37 bp, Artificial Sequence
  Description of Artificial Sequence: Synthetic oligonucleotide
ttgcagtaagtgatcttaatgatgttgtcaggagcgc

SEQ ID NO: 284761 - DNA, 36 bp, Artificial Sequence
  Description of Artificial Sequence: Synthetic oligonucleotide
tgcagtaagtgatcttaatgatgttgtcaggagcgc

SEQ ID NO: 284762 - DNA, 35 bp, Artificial Sequence
  Description of Artificial Sequence: Synthetic oligonucleotide
gcagtaagtgatcttaatgatgttgtcaggagcgc

SEQ ID NO: 284763 - DNA, 36 bp, Artificial Sequence
  Description of Artificial Sequence: Synthetic oligonucleotide
cagtaagtgatcttaatgatgttgtcaggagcgcag

SEQ ID NO: 284764 - DNA, 36 bp, Artificial Sequence
  Description of Artificial Sequence: Synthetic oligonucleotide
agtaagtgatcttaatgatgttgtcaggagcgcagc

SEQ ID NO: 284765 - DNA, 35 bp, Artificial Sequence
  Description of Artificial Sequence: Synthetic oligonucleotide
gtaagtgatcttaatgatgttgtcaggagcgcagc

SEQ ID NO: 284766 - DNA, 36 bp, Artificial Sequence
  Description of Artificial Sequence: Synthetic oligonucleotide
taagtgatcttaatgatgttgtcaggagcgcagcag

SEQ ID NO: 284767 - DNA, 35 bp, Artificial Sequence
  Description of Artificial Sequence: Synthetic oligonucleotide
aagtgatcttaatgatgttgtcaggagcgcagcag

SEQ ID NO: 284768 - DNA, 34 bp, Artificial Sequence
  Description of Artificial Sequence: Synthetic oligonucleotide
agtgatcttaatgatgttgtcaggagcgcagcag

SEQ ID NO: 284769 - DNA, 33 bp, Artificial Sequence
  Description of Artificial Sequence: Synthetic oligonucleotide
gtgatcttaatgatgttgtcaggagcgcagcag

SEQ ID NO: 284770 - DNA, 35 bp, Artificial Sequence
  Description of Artificial Sequence: Synthetic oligonucleotide
tgatcttaatgatgttgtcaggagcgcagcagtac

SEQ ID NO: 284771 - DNA, 34 bp, Artificial Sequence
  Description of Artificial Sequence: Synthetic oligonucleotide
gatcttaatgatgttgtcaggagcgcagcagtac

SEQ ID NO: 284772 - DNA, 37 bp, Artificial Sequence
  Description of Artificial Sequence: Synthetic oligonucleotide
atcttaatgatgttgtcaggagcgcagcagtacaatc

SEQ ID NO: 284773 - DNA, 36 bp, Artificial Sequence
  Description of Artificial Sequence: Synthetic oligonucleotide
tcttaatgatgttgtcaggagcgcagcagtacaatc

SEQ ID NO: 284774 - DNA, 35 bp, Artificial Sequence
  Description of Artificial Sequence: Synthetic oligonucleotide
cttaatgatgttgtcaggagcgcagcagtacaatc

SEQ ID NO: 284775 - DNA, 36 bp, Artificial Sequence
  Description of Artificial Sequence: Synthetic oligonucleotide
ttaatgatgttgtcaggagcgcagcagtacaatcac

SEQ ID NO: 284776 - DNA, 35 bp, Artificial Sequence
  Description of Artificial Sequence: Synthetic oligonucleotide
taatgatgttgtcaggagcgcagcagtacaatcac

SEQ ID NO: 284777 - DNA, 34 bp, Artificial Sequence
  Description of Artificial Sequence: Synthetic oligonucleotide
aatgatgttgtcaggagcgcagcagtacaatcac

SEQ ID NO: 284778 - DNA, 33 bp, Artificial Sequence
  Description of Artificial Sequence: Synthetic oligonucleotide
atgatgttgtcaggagcgcagcagtacaatcac

SEQ ID NO: 284779 - DNA, 32 bp, Artificial Sequence
  Description of Artificial Sequence: Synthetic oligonucleotide
tgatgttgtcaggagcgcagcagtacaatcac

SEQ ID NO: 284780 - DNA, 31 bp, Artificial Sequence
  Description of Artificial Sequence: Synthetic oligonucleotide
gatgttgtcaggagcgcagcagtacaatcac

SEQ ID NO: 284781 - DNA, 33 bp, Artificial Sequence
  Description of Artificial Sequence: Synthetic oligonucleotide
atgttgtcaggagcgcagcagtacaatcacttg

SEQ ID NO: 284782 - DNA, 32 bp, Artificial Sequence
  Description of Artificial Sequence: Synthetic oligonucleotide
tgttgtcaggagcgcagcagtacaatcacttg

SEQ ID NO: 284783 - DNA, 31 bp, Artificial Sequence
  Description of Artificial Sequence: Synthetic oligonucleotide
gttgtcaggagcgcagcagtacaatcacttg

SEQ ID NO: 284784 - DNA, 31 bp, Artificial Sequence
  Description of Artificial Sequence: Synthetic oligonucleotide
ttgtcaggagcgcagcagtacaatcacttgc

SEQ ID NO: 284785 - DNA, 30 bp, Artificial Sequence
  Description of Artificial Sequence: Synthetic oligonucleotide
tgtcaggagcgcagcagtacaatcacttgc

SEQ ID NO: 284786 - DNA, 29 bp, Artificial Sequence
  Description of Artificial Sequence: Synthetic oligonucleotide
gtcaggagcgcagcagtacaatcacttgc

SEQ ID NO: 284787 - DNA, 29 bp, Artificial Sequence
  Description of Artificial Sequence: Synthetic oligonucleotide
tcaggagcgcagcagtacaatcacttgcg

SEQ ID NO: 284788 - DNA, 28 bp, Artificial Sequence
  Description of Artificial Sequence: Synthetic oligonucleotide
caggagcgcagcagtacaatcacttgcg

SEQ ID NO: 284789 - DNA, 30 bp, Artificial Sequence
  Description of Artificial Sequence: Synthetic oligonucleotide
aggagcgcagcagtacaatcacttgcgttc

SEQ ID NO: 284790 - DNA, 29 bp, Artificial Sequence
  Description of Artificial Sequence: Synthetic oligonucleotide
ggagcgcagcagtacaatcacttgcgttc

SEQ ID NO: 284791 - DNA, 32 bp, Artificial Sequence
  Description of Artificial Sequence: Synthetic oligonucleotide
gagcgcagcagtacaatcacttgcgttcattc

SEQ ID NO: 284792 - DNA, 36 bp, Artificial Sequence
  Description of Artificial Sequence: Synthetic oligonucleotide
agcgcagcagtacaatcacttgcgttcattcttttc

SEQ ID NO: 284793 - DNA, 35 bp, Artificial Sequence
  Description of Artificial Sequence: Synthetic oligonucleotide
gcgcagcagtacaatcacttgcgttcattcttttc

SEQ ID NO: 284794 - DNA, 36 bp, Artificial Sequence
  Description of Artificial Sequence: Synthetic oligonucleotide
cgcagcagtacaatcacttgcgttcattcttttcag

SEQ ID NO: 284795 - DNA, 38 bp, Artificial Sequence
  Description of Artificial Sequence: Synthetic oligonucleotide
gcagcagtacaatcacttgcgttcattcttttcagaac

SEQ ID NO: 284796 - DNA, 38 bp, Artificial Sequence
  Description of Artificial Sequence: Synthetic oligonucleotide
cagcagtacaatcacttgcgttcattcttttcagaacc

SEQ ID NO: 284797 - DNA, 38 bp, Artificial Sequence
  Description of Artificial Sequence: Synthetic oligonucleotide
agcagtacaatcacttgcgttcattcttttcagaaccg

SEQ ID NO: 284798 - DNA, 37 bp, Artificial Sequence
  Description of Artificial Sequence: Synthetic oligonucleotide
gcagtacaatcacttgcgttcattcttttcagaaccg

SEQ ID NO: 284799 - DNA, 37 bp, Artificial Sequence
  Description of Artificial Sequence: Synthetic oligonucleotide
cagtacaatcacttgcgttcattcttttcagaaccgc

SEQ ID NO: 284800 - DNA, 38 bp, Artificial Sequence
  Description of Artificial Sequence: Synthetic oligonucleotide
agtacaatcacttgcgttcattcttttcagaaccgctg

SEQ ID NO: 284801 - DNA, 37 bp, Artificial Sequence
  Description of Artificial Sequence: Synthetic oligonucleotide
gtacaatcacttgcgttcattcttttcagaaccgctg

SEQ ID NO: 284802 - DNA, 39 bp, Artificial Sequence
  Description of Artificial Sequence: Synthetic oligonucleotide
tacaatcacttgcgttcattcttttcagaaccgctgaac

SEQ ID NO: 284803 - DNA, 38 bp, Artificial Sequence
  Description of Artificial Sequence: Synthetic oligonucleotide
acaatcacttgcgttcattcttttcagaaccgctgaac

SEQ ID NO: 284804 - DNA, 37 bp, Artificial Sequence
  Description of Artificial Sequence: Synthetic oligonucleotide
caatcacttgcgttcattcttttcagaaccgctgaac

SEQ ID NO: 284805 - DNA, 38 bp, Artificial Sequence
  Description of Artificial Sequence: Synthetic oligonucleotide
aatcacttgcgttcattcttttcagaaccgctgaacag

SEQ ID NO: 284806 - DNA, 37 bp, Artificial Sequence
  Description of Artificial Sequence: Synthetic oligonucleotide
atcacttgcgttcattcttttcagaaccgctgaacag

SEQ ID NO: 284807 - DNA, 36 bp, Artificial Sequence
  Description of Artificial Sequence: Synthetic oligonucleotide
tcacttgcgttcattcttttcagaaccgctgaacag

SEQ ID NO: 284808 - DNA, 35 bp, Artificial Sequence
  Description of Artificial Sequence: Synthetic oligonucleotide
cacttgcgttcattcttttcagaaccgctgaacag

SEQ ID NO: 284809 - DNA, 36 bp, Artificial Sequence
  Description of Artificial Sequence: Synthetic oligonucleotide
acttgcgttcattcttttcagaaccgctgaacagtc

SEQ ID NO: 284810 - DNA, 35 bp, Artificial Sequence
  Description of Artificial Sequence: Synthetic oligonucleotide
cttgcgttcattcttttcagaaccgctgaacagtc

SEQ ID NO: 284811 - DNA, 35 bp, Artificial Sequence
  Description of Artificial Sequence: Synthetic oligonucleotide
ttgcgttcattcttttcagaaccgctgaacagtcc

SEQ ID NO: 284812 - DNA, 34 bp, Artificial Sequence
  Description of Artificial Sequence: Synthetic oligonucleotide
tgcgttcattcttttcagaaccgctgaacagtcc

SEQ ID NO: 284813 - DNA, 33 bp, Artificial Sequence
  Description of Artificial Sequence: Synthetic oligonucleotide
gcgttcattcttttcagaaccgctgaacagtcc

SEQ ID NO: 284814 - DNA, 33 bp, Artificial Sequence
  Description of Artificial Sequence: Synthetic oligonucleotide
cgttcattcttttcagaaccgctgaacagtccc

SEQ ID NO: 284815 - DNA, 33 bp, Artificial Sequence
  Description of Artificial Sequence: Synthetic oligonucleotide
gttcattcttttcagaaccgctgaacagtcccc

SEQ ID NO: 284816 - DNA, 35 bp, Artificial Sequence
  Description of Artificial Sequence: Synthetic oligonucleotide
ttcattcttttcagaaccgctgaacagtccccaag

SEQ ID NO: 284817 - DNA, 34 bp, Artificial Sequence
  Description of Artificial Sequence: Synthetic oligonucleotide
tcattcttttcagaaccgctgaacagtccccaag

SEQ ID NO: 284818 - DNA, 33 bp, Artificial Sequence
  Description of Artificial Sequence: Synthetic oligonucleotide
cattcttttcagaaccgctgaacagtccccaag

SEQ ID NO: 284819 - DNA, 34 bp, Artificial Sequence
  Description of Artificial Sequence: Synthetic oligonucleotide
attcttttcagaaccgctgaacagtccccaagtg

SEQ ID NO: 284820 - DNA, 33 bp, Artificial Sequence
  Description of Artificial Sequence: Synthetic oligonucleotide
ttcttttcagaaccgctgaacagtccccaagtg

SEQ ID NO: 284821 - DNA, 32 bp, Artificial Sequence
  Description of Artificial Sequence: Synthetic oligonucleotide
tcttttcagaaccgctgaacagtccccaagtg

SEQ ID NO: 284822 - DNA, 31 bp, Artificial Sequence
  Description of Artificial Sequence: Synthetic oligonucleotide
cttttcagaaccgctgaacagtccccaagtg

SEQ ID NO: 284823 - DNA, 33 bp, Artificial Sequence
  Description of Artificial Sequence: Synthetic oligonucleotide
ttttcagaaccgctgaacagtccccaagtgtag

SEQ ID NO: 284824 - DNA, 32 bp, Artificial Sequence
  Description of Artificial Sequence: Synthetic oligonucleotide
tttcagaaccgctgaacagtccccaagtgtag

SEQ ID NO: 284825 - DNA, 31 bp, Artificial Sequence
  Description of Artificial Sequence: Synthetic oligonucleotide
ttcagaaccgctgaacagtccccaagtgtag

SEQ ID NO: 284826 - DNA, 30 bp, Artificial Sequence
  Description of Artificial Sequence: Synthetic oligonucleotide
tcagaaccgctgaacagtccccaagtgtag

SEQ ID NO: 284827 - DNA, 29 bp, Artificial Sequence
  Description of Artificial Sequence: Synthetic oligonucleotide
cagaaccgctgaacagtccccaagtgtag

SEQ ID NO: 284828 - DNA, 30 bp, Artificial Sequence
  Description of Artificial Sequence: Synthetic oligonucleotide
agaaccgctgaacagtccccaagtgtagtc

SEQ ID NO: 284829 - DNA, 29 bp, Artificial Sequence
  Description of Artificial Sequence: Synthetic oligonucleotide
gaaccgctgaacagtccccaagtgtagtc

SEQ ID NO: 284830 - DNA, 30 bp, Artificial Sequence
  Description of Artificial Sequence: Synthetic oligonucleotide
aaccgctgaacagtccccaagtgtagtctc

SEQ ID NO: 284831 - DNA, 29 bp, Artificial Sequence
  Description of Artificial Sequence: Synthetic oligonucleotide
accgctgaacagtccccaagtgtagtctc

SEQ ID NO: 284832 - DNA, 28 bp, Artificial Sequence
  Description of Artificial Sequence: Synthetic oligonucleotide
ccgctgaacagtccccaagtgtagtctc

SEQ ID NO: 284833 - DNA, 31 bp, Artificial Sequence
  Description of Artificial Sequence: Synthetic oligonucleotide
cgctgaacagtccccaagtgtagtctctttg

SEQ ID NO: 284834 - DNA, 33 bp, Artificial Sequence
  Description of Artificial Sequence: Synthetic oligonucleotide
gctgaacagtccccaagtgtagtctctttgatg

SEQ ID NO: 284835 - DNA, 34 bp, Artificial Sequence
  Description of Artificial Sequence: Synthetic oligonucleotide
ctgaacagtccccaagtgtagtctctttgatgtc

SEQ ID NO: 284836 - DNA, 35 bp, Artificial Sequence
  Description of Artificial Sequence: Synthetic oligonucleotide
tgaacagtccccaagtgtagtctctttgatgtcag

SEQ ID NO: 284837 - DNA, 34 bp, Artificial Sequence
  Description of Artificial Sequence: Synthetic oligonucleotide
gaacagtccccaagtgtagtctctttgatgtcag

SEQ ID NO: 284838 - DNA, 35 bp, Artificial Sequence
  Description of Artificial Sequence: Synthetic oligonucleotide
aacagtccccaagtgtagtctctttgatgtcagag

SEQ ID NO: 284839 - DNA, 34 bp, Artificial Sequence
  Description of Artificial Sequence: Synthetic oligonucleotide
acagtccccaagtgtagtctctttgatgtcagag

SEQ ID NO: 284840 - DNA, 33 bp, Artificial Sequence
  Description of Artificial Sequence: Synthetic oligonucleotide
cagtccccaagtgtagtctctttgatgtcagag

SEQ ID NO: 284841 - DNA, 34 bp, Artificial Sequence
  Description of Artificial Sequence: Synthetic oligonucleotide
agtccccaagtgtagtctctttgatgtcagagac

SEQ ID NO: 284842 - DNA, 33 bp, Artificial Sequence
  Description of Artificial Sequence: Synthetic oligonucleotide
gtccccaagtgtagtctctttgatgtcagagac

SEQ ID NO: 284843 - DNA, 36 bp, Artificial Sequence
  Description of Artificial Sequence: Synthetic oligonucleotide
tccccaagtgtagtctctttgatgtcagagacttac

SEQ ID NO: 284844 - DNA, 35 bp, Artificial Sequence
  Description of Artificial Sequence: Synthetic oligonucleotide
ccccaagtgtagtctctttgatgtcagagacttac

SEQ ID NO: 284845 - DNA, 37 bp, Artificial Sequence
  Description of Artificial Sequence: Synthetic oligonucleotide
cccaagtgtagtctctttgatgtcagagacttacaac

SEQ ID NO: 284846 - DNA, 37 bp, Artificial Sequence
  Description of Artificial Sequence: Synthetic oligonucleotide
ccaagtgtagtctctttgatgtcagagacttacaacc

SEQ ID NO: 284847 - DNA, 37 bp, Artificial Sequence
  Description of Artificial Sequence: Synthetic oligonucleotide
caagtgtagtctctttgatgtcagagacttacaaccc

SEQ ID NO: 284848 - DNA, 38 bp, Artificial Sequence
  Description of Artificial Sequence: Synthetic oligonucleotide
aagtgtagtctctttgatgtcagagacttacaacccac

SEQ ID NO: 284849 - DNA, 37 bp, Artificial Sequence
  Description of Artificial Sequence: Synthetic oligonucleotide
agtgtagtctctttgatgtcagagacttacaacccac

SEQ ID NO: 284850 - DNA, 36 bp, Artificial Sequence
  Description of Artificial Sequence: Synthetic oligonucleotide
gtgtagtctctttgatgtcagagacttacaacccac

SEQ ID NO: 284851 - DNA, 38 bp, Artificial Sequence
  Description of Artificial Sequence: Synthetic oligonucleotide
tgtagtctctttgatgtcagagacttacaacccacatg

SEQ ID NO: 284852 - DNA, 37 bp, Artificial Sequence
  Description of Artificial Sequence: Synthetic oligonucleotide
gtagtctctttgatgtcagagacttacaacccacatg

SEQ ID NO: 284853 - DNA, 38 bp, Artificial Sequence
  Description of Artificial Sequence: Synthetic oligonucleotide
tagtctctttgatgtcagagacttacaacccacatgtg

SEQ ID NO: 284854 - DNA, 37 bp, Artificial Sequence
  Description of Artificial Sequence: Synthetic oligonucleotide
agtctctttgatgtcagagacttacaacccacatgtg

SEQ ID NO: 284855 - DNA, 36 bp, Artificial Sequence
  Description of Artificial Sequence: Synthetic oligonucleotide
gtctctttgatgtcagagacttacaacccacatgtg

SEQ ID NO: 284856 - DNA, 36 bp, Artificial Sequence
  Description of Artificial Sequence: Synthetic oligonucleotide
tctctttgatgtcagagacttacaacccacatgtgc

SEQ ID NO: 284857 - DNA, 35 bp, Artificial Sequence
  Description of Artificial Sequence: Synthetic oligonucleotide
ctctttgatgtcagagacttacaacccacatgtgc

SEQ ID NO: 284858 - DNA, 35 bp, Artificial Sequence
  Description of Artificial Sequence: Synthetic oligonucleotide
tctttgatgtcagagacttacaacccacatgtgcg

SEQ ID NO: 284859 - DNA, 34 bp, Artificial Sequence
  Description of Artificial Sequence: Synthetic oligonucleotide
ctttgatgtcagagacttacaacccacatgtgcg

SEQ ID NO: 284860 - DNA, 34 bp, Artificial Sequence
  Description of Artificial Sequence: Synthetic oligonucleotide
tttgatgtcagagacttacaacccacatgtgcgc

SEQ ID NO: 284861 - DNA, 33 bp, Artificial Sequence
  Description of Artificial Sequence: Synthetic oligonucleotide
ttgatgtcagagacttacaacccacatgtgcgc

SEQ ID NO: 284862 - DNA, 32 bp, Artificial Sequence
  Description of Artificial Sequence: Synthetic oligonucleotide
tgatgtcagagacttacaacccacatgtgcgc

SEQ ID NO: 284863 - DNA, 31 bp, Artificial Sequence
  Description of Artificial Sequence: Synthetic oligonucleotide
gatgtcagagacttacaacccacatgtgcgc

SEQ ID NO: 284864 - DNA, 33 bp, Artificial Sequence
  Description of Artificial Sequence: Synthetic oligonucleotide
atgtcagagacttacaacccacatgtgcgcaac

SEQ ID NO: 284865 - DNA, 32 bp, Artificial Sequence
  Description of Artificial Sequence: Synthetic oligonucleotide
tgtcagagacttacaacccacatgtgcgcaac

SEQ ID NO: 284866 - DNA, 31 bp, Artificial Sequence
  Description of Artificial Sequence: Synthetic oligonucleotide
gtcagagacttacaacccacatgtgcgcaac

SEQ ID NO: 284867 - DNA, 31 bp, Artificial Sequence
  Description of Artificial Sequence: Synthetic oligonucleotide
tcagagacttacaacccacatgtgcgcaacg

SEQ ID NO: 284868 - DNA, 30 bp, Artificial Sequence
  Description of Artificial Sequence: Synthetic oligonucleotide
cagagacttacaacccacatgtgcgcaacg

SEQ ID NO: 284869 - DNA, 30 bp, Artificial Sequence
  Description of Artificial Sequence: Synthetic oligonucleotide
agagacttacaacccacatgtgcgcaacgg

SEQ ID NO: 284870 - DNA, 29 bp, Artificial Sequence
  Description of Artificial Sequence: Synthetic oligonucleotide
gagacttacaacccacatgtgcgcaacgg

SEQ ID NO: 284871 - DNA, 30 bp, Artificial Sequence
  Description of Artificial Sequence: Synthetic oligonucleotide
agacttacaacccacatgtgcgcaacggag

SEQ ID NO: 284872 - DNA, 29 bp, Artificial Sequence
  Description of Artificial Sequence: Synthetic oligonucleotide
gacttacaacccacatgtgcgcaacggag

SEQ ID NO: 284873 - DNA, 29 bp, Artificial Sequence
  Description of Artificial Sequence: Synthetic oligonucleotide
acttacaacccacatgtgcgcaacggagc

SEQ ID NO: 284874 - DNA, 28 bp, Artificial Sequence
  Description of Artificial Sequence: Synthetic oligonucleotide
cttacaacccacatgtgcgcaacggagc

SEQ ID NO: 284875 - DNA, 29 bp, Artificial Sequence
  Description of Artificial Sequence: Synthetic oligonucleotide
ttacaacccacatgtgcgcaacggagctg

SEQ ID NO: 284876 - DNA, 28 bp, Artificial Sequence
  Description of Artificial Sequence: Synthetic oligonucleotide
tacaacccacatgtgcgcaacggagctg

SEQ ID NO: 284877 - DNA, 27 bp, Artificial Sequence
  Description of Artificial Sequence: Synthetic oligonucleotide
acaacccacatgtgcgcaacggagctg

SEQ ID NO: 284878 - DNA, 26 bp, Artificial Sequence
  Description of Artificial Sequence: Synthetic oligonucleotide
caacccacatgtgcgcaacggagctg

SEQ ID NO: 284879 - DNA, 27 bp, Artificial Sequence
  Description of Artificial Sequence: Synthetic oligonucleotide
aacccacatgtgcgcaacggagctgga

SEQ ID NO: 284880 - DNA, 27 bp, Artificial Sequence
  Description of Artificial Sequence: Synthetic oligonucleotide
acccacatgtgcgcaacggagctggaa

SEQ ID NO: 284881 - DNA, 27 bp, Artificial Sequence
  Description of Artificial Sequence: Synthetic oligonucleotide
cccacatgtgcgcaacggagctggaat

SEQ ID NO: 284882 - DNA, 27 bp, Artificial Sequence
  Description of Artificial Sequence: Synthetic oligonucleotide
ccacatgtgcgcaacggagctggaatg

SEQ ID NO: 284883 - DNA, 27 bp, Artificial Sequence
  Description of Artificial Sequence: Synthetic oligonucleotide
cacatgtgcgcaacggagctggaatgg

SEQ ID NO: 284884 - DNA, 27 bp, Artificial Sequence
  Description of Artificial Sequence: Synthetic oligonucleotide
acatgtgcgcaacggagctggaatggc

SEQ ID NO: 284885 - DNA, 26 bp, Artificial Sequence
  Description of Artificial Sequence: Synthetic oligonucleotide
catgtgcgcaacggagctggaatggc

SEQ ID NO: 284886 - DNA, 27 bp, Artificial Sequence
  Description of Artificial Sequence: Synthetic oligonucleotide
atgtgcgcaacggagctggaatggcct

SEQ ID NO: 284887 - DNA, 27 bp, Artificial Sequence
  Description of Artificial Sequence: Synthetic oligonucleotide
tgtgcgcaacggagctggaatggcctt

SEQ ID NO: 284888 - DNA, 26 bp, Artificial Sequence
  Description of Artificial Sequence: Synthetic oligonucleotide
gtgcgcaacggagctggaatggcctt

SEQ ID NO: 284889 - DNA, 26 bp, Artificial Sequence
  Description of Artificial Sequence: Synthetic oligonucleotide
tgcgcaacggagctggaatggccttc

SEQ ID NO: 284890 - DNA, 25 bp, Artificial Sequence
  Description of Artificial Sequence: Synthetic oligonucleotide
gcgcaacggagctggaatggccttc

SEQ ID NO: 284891 - DNA, 25 bp, Artificial Sequence
  Description of Artificial Sequence: Synthetic oligonucleotide
cgcaacggagctggaatggccttcg

SEQ ID NO: 284892 - DNA, 25 bp, Artificial Sequence
  Description of Artificial Sequence: Synthetic oligonucleotide
gcaacggagctggaatggccttcgg

SEQ ID NO: 284893 - DNA, 27 bp, Artificial Sequence
  Description of Artificial Sequence: Synthetic oligonucleotide
caacggagctggaatggccttcgggat

SEQ ID NO: 284894 - DNA, 29 bp, Artificial Sequence
  Description of Artificial Sequence: Synthetic oligonucleotide
aacggagctggaatggccttcgggatatg

SEQ ID NO: 284895 - DNA, 28 bp, Artificial Sequence
  Description of Artificial Sequence: Synthetic oligonucleotide
acggagctggaatggccttcgggatatg

SEQ ID NO: 284896 - DNA, 27 bp, Artificial Sequence
  Description of Artificial Sequence: Synthetic oligonucleotide
cggagctggaatggccttcgggatatg

SEQ ID NO: 284897 - DNA, 27 bp, Artificial Sequence
  Description of Artificial Sequence: Synthetic oligonucleotide
ggagctggaatggccttcgggatatgc

SEQ ID NO: 284898 - DNA, 28 bp, Artificial Sequence
  Description of Artificial Sequence: Synthetic oligonucleotide
gagctggaatggccttcgggatatgcag

SEQ ID NO: 284899 - DNA, 29 bp, Artificial Sequence
  Description of Artificial Sequence: Synthetic oligonucleotide
agctggaatggccttcgggatatgcagtg

SEQ ID NO: 284900 - DNA, 28 bp, Artificial Sequence
  Description of Artificial Sequence: Synthetic oligonucleotide
gctggaatggccttcgggatatgcagtg

SEQ ID NO: 284901 - DNA, 28 bp, Artificial Sequence
  Description of Artificial Sequence: Synthetic oligonucleotide
ctggaatggccttcgggatatgcagtgc

SEQ ID NO: 284902 - DNA, 29 bp, Artificial Sequence
  Description of Artificial Sequence: Synthetic oligonucleotide
tggaatggccttcgggatatgcagtgctg

SEQ ID NO: 284903 - DNA, 28 bp, Artificial Sequence
  Description of Artificial Sequence: Synthetic oligonucleotide
ggaatggccttcgggatatgcagtgctg

SEQ ID NO: 284904 - DNA, 28 bp, Artificial Sequence
  Description of Artificial Sequence: Synthetic oligonucleotide
gaatggccttcgggatatgcagtgctgg

SEQ ID NO: 284905 - DNA, 30 bp, Artificial Sequence
  Description of Artificial Sequence: Synthetic oligonucleotide
aatggccttcgggatatgcagtgctggtag

SEQ ID NO: 284906 - DNA, 29 bp, Artificial Sequence
  Description of Artificial Sequence: Synthetic oligonucleotide
atggccttcgggatatgcagtgctggtag

SEQ ID NO: 284907 - DNA, 28 bp, Artificial Sequence
  Description of Artificial Sequence: Synthetic oligonucleotide
tggccttcgggatatgcagtgctggtag

SEQ ID NO: 284908 - DNA, 27 bp, Artificial Sequence
  Description of Artificial Sequence: Synthetic oligonucleotide
ggccttcgggatatgcagtgctggtag

SEQ ID NO: 284909 - DNA, 28 bp, Artificial Sequence
  Description of Artificial Sequence: Synthetic oligonucleotide
gccttcgggatatgcagtgctggtagag

SEQ ID NO: 284910 - DNA, 28 bp, Artificial Sequence
  Description of Artificial Sequence: Synthetic oligonucleotide
ccttcgggatatgcagtgctggtagagg

SEQ ID NO: 284911 - DNA, 31 bp, Artificial Sequence
  Description of Artificial Sequence: Synthetic oligonucleotide
cttcgggatatgcagtgctggtagaggaaac

SEQ ID NO: 284912 - DNA, 33 bp, Artificial Sequence
  Description of Artificial Sequence: Synthetic oligonucleotide
ttcgggatatgcagtgctggtagaggaaacaac

SEQ ID NO: 284913 - DNA, 32 bp, Artificial Sequence
  Description of Artificial Sequence: Synthetic oligonucleotide
tcgggatatgcagtgctggtagaggaaacaac

SEQ ID NO: 284914 - DNA, 31 bp, Artificial Sequence
  Description of Artificial Sequence: Synthetic oligonucleotide
cgggatatgcagtgctggtagaggaaacaac

SEQ ID NO: 284915 - DNA, 31 bp, Artificial Sequence
  Description of Artificial Sequence: Synthetic oligonucleotide
gggatatgcagtgctggtagaggaaacaacg

SEQ ID NO: 284916 - DNA, 33 bp, Artificial Sequence
  Description of Artificial Sequence: Synthetic oligonucleotide
ggatatgcagtgctggtagaggaaacaacgaag

SEQ ID NO: 284917 - DNA, 33 bp, Artificial Sequence
  Description of Artificial Sequence: Synthetic oligonucleotide
gatatgcagtgctggtagaggaaacaacgaagc

SEQ ID NO: 284918 - DNA, 33 bp, Artificial Sequence
  Description of Artificial Sequence: Synthetic oligonucleotide
atatgcagtgctggtagaggaaacaacgaagcc

SEQ ID NO: 284919 - DNA, 32 bp, Artificial Sequence
  Description of Artificial Sequence: Synthetic oligonucleotide
tatgcagtgctggtagaggaaacaacgaagcc

SEQ ID NO: 284920 - DNA, 31 bp, Artificial Sequence
  Description of Artificial Sequence: Synthetic oligonucleotide
atgcagtgctggtagaggaaacaacgaagcc

SEQ ID NO: 284921 - DNA, 30 bp, Artificial Sequence
  Description of Artificial Sequence: Synthetic oligonucleotide
tgcagtgctggtagaggaaacaacgaagcc

SEQ ID NO: 284922 - DNA, 29 bp, Artificial Sequence
  Description of Artificial Sequence: Synthetic oligonucleotide
gcagtgctggtagaggaaacaacgaagcc

SEQ ID NO: 284923 - DNA, 37 bp, Artificial Sequence
  Description of Artificial Sequence: Synthetic oligonucleotide
cagtgctggtagaggaaacaacgaagccatttatttg

SEQ ID NO: 284924 - DNA, 37 bp, Artificial Sequence
  Description of Artificial Sequence: Synthetic oligonucleotide
agtgctggtagaggaaacaacgaagccatttatttgc

SEQ ID NO: 284925 - DNA, 36 bp, Artificial Sequence
  Description of Artificial Sequence: Synthetic oligonucleotide
gtgctggtagaggaaacaacgaagccatttatttgc

SEQ ID NO: 284926 - DNA, 38 bp, Artificial Sequence
  Description of Artificial Sequence: Synthetic oligonucleotide
tgctggtagaggaaacaacgaagccatttatttgctag

SEQ ID NO: 284927 - DNA, 37 bp, Artificial Sequence
  Description of Artificial Sequence: Synthetic oligonucleotide
gctggtagaggaaacaacgaagccatttatttgctag

SEQ ID NO: 284928 - DNA, 39 bp, Artificial Sequence
  Description of Artificial Sequence: Synthetic oligonucleotide
ctggtagaggaaacaacgaagccatttatttgctagtac

SEQ ID NO: 284929 - DNA, 39 bp, Artificial Sequence
  Description of Artificial Sequence: Synthetic oligonucleotide
tggtagaggaaacaacgaagccatttatttgctagtacc

SEQ ID NO: 284930 - DNA, 38 bp, Artificial Sequence
  Description of Artificial Sequence: Synthetic oligonucleotide
ggtagaggaaacaacgaagccatttatttgctagtacc

SEQ ID NO: 284931 - DNA, 41 bp, Artificial Sequence
  Description of Artificial Sequence: Synthetic oligonucleotide
gtagaggaaacaacgaagccatttatttgctagtaccaatg

SEQ ID NO: 284932 - DNA, 42 bp, Artificial Sequence
  Description of Artificial Sequence: Synthetic oligonucleotide
tagaggaaacaacgaagccatttatttgctagtaccaatgac

SEQ ID NO: 284933 - DNA, 41 bp, Artificial Sequence
  Description of Artificial Sequence: Synthetic oligonucleotide
agaggaaacaacgaagccatttatttgctagtaccaatgac

SEQ ID NO: 284934 - DNA, 40 bp, Artificial Sequence
  Description of Artificial Sequence: Synthetic oligonucleotide
gaggaaacaacgaagccatttatttgctagtaccaatgac

SEQ ID NO: 284935 - DNA, 43 bp, Artificial Sequence
  Description of Artificial Sequence: Synthetic oligonucleotide
aggaaacaacgaagccatttatttgctagtaccaatgactaac

SEQ ID NO: 284936 - DNA, 42 bp, Artificial Sequence
  Description of Artificial Sequence: Synthetic oligonucleotide
ggaaacaacgaagccatttatttgctagtaccaatgactaac

SEQ ID NO: 284937 - DNA, 42 bp, Artificial Sequence
  Description of Artificial Sequence: Synthetic oligonucleotide
gaaacaacgaagccatttatttgctagtaccaatgactaacg

SEQ ID NO: 284938 - DNA, 43 bp, Artificial Sequence
  Description of Artificial Sequence: Synthetic oligonucleotide
aaacaacgaagccatttatttgctagtaccaatgactaacgac

SEQ ID NO: 284939 - DNA, 42 bp, Artificial Sequence
  Description of Artificial Sequence: Synthetic oligonucleotide
aacaacgaagccatttatttgctagtaccaatgactaacgac

SEQ ID NO: 284940 - DNA, 41 bp, Artificial Sequence
  Description of Artificial Sequence: Synthetic oligonucleotide
acaacgaagccatttatttgctagtaccaatgactaacgac

SEQ ID NO: 284941 - DNA, 40 bp, Artificial Sequence
  Description of Artificial Sequence: Synthetic oligonucleotide
caacgaagccatttatttgctagtaccaatgactaacgac

SEQ ID NO: 284942 - DNA, 40 bp, Artificial Sequence
  Description of Artificial Sequence: Synthetic oligonucleotide
aacgaagccatttatttgctagtaccaatgactaacgacc

SEQ ID NO: 284943 - DNA, 39 bp, Artificial Sequence
  Description of Artificial Sequence: Synthetic oligonucleotide
acgaagccatttatttgctagtaccaatgactaacgacc

SEQ ID NO: 284944 - DNA, 38 bp, Artificial Sequence
  Description of Artificial Sequence: Synthetic oligonucleotide
cgaagccatttatttgctagtaccaatgactaacgacc

SEQ ID NO: 284945 - DNA, 38 bp, Artificial Sequence
  Description of Artificial Sequence: Synthetic oligonucleotide
gaagccatttatttgctagtaccaatgactaacgaccc

SEQ ID NO: 284946 - DNA, 38 bp, Artificial Sequence
  Description of Artificial Sequence: Synthetic oligonucleotide
aagccatttatttgctagtaccaatgactaacgacccc

SEQ ID NO: 284947 - DNA, 37 bp, Artificial Sequence
  Description of Artificial Sequence: Synthetic oligonucleotide
agccatttatttgctagtaccaatgactaacgacccc

SEQ ID NO: 284948 - DNA, 36 bp, Artificial Sequence
  Description of Artificial Sequence: Synthetic oligonucleotide
gccatttatttgctagtaccaatgactaacgacccc

SEQ ID NO: 284949 - DNA, 36 bp, Artificial Sequence
  Description of Artificial Sequence: Synthetic oligonucleotide
ccatttatttgctagtaccaatgactaacgaccccc

SEQ ID NO: 284950 - DNA, 37 bp, Artificial Sequence
  Description of Artificial Sequence: Synthetic oligonucleotide
catttatttgctagtaccaatgactaacgaccccctg

SEQ ID NO: 284951 - DNA, 39 bp, Artificial Sequence
  Description of Artificial Sequence: Synthetic oligonucleotide
atttatttgctagtaccaatgactaacgaccccctgaac

SEQ ID NO: 284952 - DNA, 38 bp, Artificial Sequence
  Description of Artificial Sequence: Synthetic oligonucleotide
tttatttgctagtaccaatgactaacgaccccctgaac

SEQ ID NO: 284953 - DNA, 37 bp, Artificial Sequence
  Description of Artificial Sequence: Synthetic oligonucleotide
ttatttgctagtaccaatgactaacgaccccctgaac

SEQ ID NO: 284954 - DNA, 36 bp, Artificial Sequence
  Description of Artificial Sequence: Synthetic oligonucleotide
tatttgctagtaccaatgactaacgaccccctgaac

SEQ ID NO: 284955 - DNA, 35 bp, Artificial Sequence
  Description of Artificial Sequence: Synthetic oligonucleotide
atttgctagtaccaatgactaacgaccccctgaac

SEQ ID NO: 284956 - DNA, 34 bp, Artificial Sequence
  Description of Artificial Sequence: Synthetic oligonucleotide
tttgctagtaccaatgactaacgaccccctgaac

SEQ ID NO: 284957 - DNA, 33 bp, Artificial Sequence
  Description of Artificial Sequence: Synthetic oligonucleotide
ttgctagtaccaatgactaacgaccccctgaac

SEQ ID NO: 284958 - DNA, 32 bp, Artificial Sequence
  Description of Artificial Sequence: Synthetic oligonucleotide
tgctagtaccaatgactaacgaccccctgaac

SEQ ID NO: 284959 - DNA, 31 bp, Artificial Sequence
  Description of Artificial Sequence: Synthetic oligonucleotide
gctagtaccaatgactaacgaccccctgaac

SEQ ID NO: 284960 - DNA, 33 bp, Artificial Sequence
  Description of Artificial Sequence: Synthetic oligonucleotide
ctagtaccaatgactaacgaccccctgaactac

SEQ ID NO: 284961 - DNA, 33 bp, Artificial Sequence
  Description of Artificial Sequence: Synthetic oligonucleotide
tagtaccaatgactaacgaccccctgaactacg

SEQ ID NO: 284962 - DNA, 32 bp, Artificial Sequence
  Description of Artificial Sequence: Synthetic oligonucleotide
agtaccaatgactaacgaccccctgaactacg

SEQ ID NO: 284963 - DNA, 31 bp, Artificial Sequence
  Description of Artificial Sequence: Synthetic oligonucleotide
gtaccaatgactaacgaccccctgaactacg

SEQ ID NO: 284964 - DNA, 32 bp, Artificial Sequence
  Description of Artificial Sequence: Synthetic oligonucleotide
taccaatgactaacgaccccctgaactacgag

SEQ ID NO: 284965 - DNA, 31 bp, Artificial Sequence
  Description of Artificial Sequence: Synthetic oligonucleotide
accaatgactaacgaccccctgaactacgag

SEQ ID NO: 284966 - DNA, 30 bp, Artificial Sequence
  Description of Artificial Sequence: Synthetic oligonucleotide
ccaatgactaacgaccccctgaactacgag

SEQ ID NO: 284967 - DNA, 31 bp, Artificial Sequence
  Description of Artificial Sequence: Synthetic oligonucleotide
caatgactaacgaccccctgaactacgagag

SEQ ID NO: 284968 - DNA, 31 bp, Artificial Sequence
  Description of Artificial Sequence: Synthetic oligonucleotide
aatgactaacgaccccctgaactacgagagg

SEQ ID NO: 284969 - DNA, 30 bp, Artificial Sequence
  Description of Artificial Sequence: Synthetic oligonucleotide
atgactaacgaccccctgaactacgagagg

SEQ ID NO: 284970 - DNA, 29 bp, Artificial Sequence
  Description of Artificial Sequence: Synthetic oligonucleotide
tgactaacgaccccctgaactacgagagg

SEQ ID NO: 284971 - DNA, 28 bp, Artificial Sequence
  Description of Artificial Sequence: Synthetic oligonucleotide
gactaacgaccccctgaactacgagagg

SEQ ID NO: 284972 - DNA, 28 bp, Artificial Sequence
  Description of Artificial Sequence: Synthetic oligonucleotide
actaacgaccccctgaactacgagaggc

SEQ ID NO: 284973 - DNA, 27 bp, Artificial Sequence
  Description of Artificial Sequence: Synthetic oligonucleotide
ctaacgaccccctgaactacgagaggc

SEQ ID NO: 284974 - DNA, 29 bp, Artificial Sequence
  Description of Artificial Sequence: Synthetic oligonucleotide
taacgaccccctgaactacgagaggcaag

SEQ ID NO: 284975 - DNA, 28 bp, Artificial Sequence
  Description of Artificial Sequence: Synthetic oligonucleotide
aacgaccccctgaactacgagaggcaag

SEQ ID NO: 284976 - DNA, 27 bp, Artificial Sequence
  Description of Artificial Sequence: Synthetic oligonucleotide
acgaccccctgaactacgagaggcaag

SEQ ID NO: 284977 - DNA, 26 bp, Artificial Sequence
  Description of Artificial Sequence: Synthetic oligonucleotide
cgaccccctgaactacgagaggcaag

SEQ ID NO: 284978 - DNA, 26 bp, Artificial Sequence
  Description of Artificial Sequence: Synthetic oligonucleotide
gaccccctgaactacgagaggcaagg

SEQ ID NO: 284979 - DNA, 26 bp, Artificial Sequence
  Description of Artificial Sequence: Synthetic oligonucleotide
accccctgaactacgagaggcaaggc

SEQ ID NO: 284980 - DNA, 25 bp, Artificial Sequence
  Description of Artificial Sequence: Synthetic oligonucleotide
ccccctgaactacgagaggcaaggc

SEQ ID NO: 284981 - DNA, 25 bp, Artificial Sequence
  Description of Artificial Sequence: Synthetic oligonucleotide
cccctgaactacgagaggcaaggcg

SEQ ID NO: 284982 - DNA, 26 bp, Artificial Sequence
  Description of Artificial Sequence: Synthetic oligonucleotide
ccctgaactacgagaggcaaggcgca

SEQ ID NO: 284983 - DNA, 27 bp, Artificial Sequence
  Description of Artificial Sequence: Synthetic oligonucleotide
cctgaactacgagaggcaaggcgcact

SEQ ID NO: 284984 - DNA, 27 bp, Artificial Sequence
  Description of Artificial Sequence: Synthetic oligonucleotide
ctgaactacgagaggcaaggcgcactc

SEQ ID NO: 284985 - DNA, 30 bp, Artificial Sequence
  Description of Artificial Sequence: Synthetic oligonucleotide
tgaactacgagaggcaaggcgcactcatac

SEQ ID NO: 284986 - DNA, 29 bp, Artificial Sequence
  Description of Artificial Sequence: Synthetic oligonucleotide
gaactacgagaggcaaggcgcactcatac

SEQ ID NO: 284987 - DNA, 29 bp, Artificial Sequence
  Description of Artificial Sequence: Synthetic oligonucleotide
aactacgagaggcaaggcgcactcatacc

SEQ ID NO: 284988 - DNA, 28 bp, Artificial Sequence
  Description of Artificial Sequence: Synthetic oligonucleotide
actacgagaggcaaggcgcactcatacc

SEQ ID NO: 284989 - DNA, 27 bp, Artificial Sequence
  Description of Artificial Sequence: Synthetic oligonucleotide
ctacgagaggcaaggcgcactcatacc

SEQ ID NO: 284990 - DNA, 29 bp, Artificial Sequence
  Description of Artificial Sequence: Synthetic oligonucleotide
tacgagaggcaaggcgcactcataccttc

SEQ ID NO: 284991 - DNA, 28 bp, Artificial Sequence
  Description of Artificial Sequence: Synthetic oligonucleotide
acgagaggcaaggcgcactcataccttc

SEQ ID NO: 284992 - DNA, 27 bp, Artificial Sequence
  Description of Artificial Sequence: Synthetic oligonucleotide
cgagaggcaaggcgcactcataccttc

SEQ ID NO: 284993 - DNA, 28 bp, Artificial Sequence
  Description of Artificial Sequence: Synthetic oligonucleotide
gagaggcaaggcgcactcataccttcag

SEQ ID NO: 284994 - DNA, 28 bp, Artificial Sequence
  Description of Artificial Sequence: Synthetic oligonucleotide
agaggcaaggcgcactcataccttcagc

SEQ ID NO: 284995 - DNA, 27 bp, Artificial Sequence
  Description of Artificial Sequence: Synthetic oligonucleotide
gaggcaaggcgcactcataccttcagc

SEQ ID NO: 284996 - DNA, 28 bp, Artificial Sequence
  Description of Artificial Sequence: Synthetic oligonucleotide
aggcaaggcgcactcataccttcagctc

SEQ ID NO: 284997 - DNA, 27 bp, Artificial Sequence
  Description of Artificial Sequence: Synthetic oligonucleotide
ggcaaggcgcactcataccttcagctc

SEQ ID NO: 284998 - DNA, 28 bp, Artificial Sequence
  Description of Artificial Sequence: Synthetic oligonucleotide
gcaaggcgcactcataccttcagctcac

SEQ ID NO: 284999 - DNA, 30 bp, Artificial Sequence
  Description of Artificial Sequence: Synthetic oligonucleotide
caaggcgcactcataccttcagctcacatc

SEQ ID NO: 285000 - DNA, 32 bp, Artificial Sequence
  Description of Artificial Sequence: Synthetic oligonucleotide
aaggcgcactcataccttcagctcacatcatg

SEQ ID NO: 285001 - DNA, 31 bp, Artificial Sequence
  Description of Artificial Sequence: Synthetic oligonucleotide
aggcgcactcataccttcagctcacatcatg

SEQ ID NO: 285002 - DNA, 30 bp, Artificial Sequence
  Description of Artificial Sequence: Synthetic oligonucleotide
ggcgcactcataccttcagctcacatcatg

SEQ ID NO: 285003 - DNA, 32 bp, Artificial Sequence
  Description of Artificial Sequence: Synthetic oligonucleotide
gcgcactcataccttcagctcacatcatgatg

SEQ ID NO: 285004 - DNA, 32 bp, Artificial Sequence
  Description of Artificial Sequence: Synthetic oligonucleotide
cgcactcataccttcagctcacatcatgatgc

SEQ ID NO: 285005 - DNA, 33 bp, Artificial Sequence
  Description of Artificial Sequence: Synthetic oligonucleotide
gcactcataccttcagctcacatcatgatgcag

SEQ ID NO: 285006 - DNA, 33 bp, Artificial Sequence
  Description of Artificial Sequence: Synthetic oligonucleotide
cactcataccttcagctcacatcatgatgcagc

SEQ ID NO: 285007 - DNA, 34 bp, Artificial Sequence
  Description of Artificial Sequence: Synthetic oligonucleotide
actcataccttcagctcacatcatgatgcagcag

SEQ ID NO: 285008 - DNA, 33 bp, Artificial Sequence
  Description of Artificial Sequence: Synthetic oligonucleotide
ctcataccttcagctcacatcatgatgcagcag

SEQ ID NO: 285009 - DNA, 34 bp, Artificial Sequence
  Description of Artificial Sequence: Synthetic oligonucleotide
tcataccttcagctcacatcatgatgcagcagac

SEQ ID NO: 285010 - DNA, 33 bp, Artificial Sequence
  Description of Artificial Sequence: Synthetic oligonucleotide
cataccttcagctcacatcatgatgcagcagac

SEQ ID NO: 285011 - DNA, 34 bp, Artificial Sequence
  Description of Artificial Sequence: Synthetic oligonucleotide
ataccttcagctcacatcatgatgcagcagactc

SEQ ID NO: 285012 - DNA, 33 bp, Artificial Sequence
  Description of Artificial Sequence: Synthetic oligonucleotide
taccttcagctcacatcatgatgcagcagactc

SEQ ID NO: 285013 - DNA, 32 bp, Artificial Sequence
  Description of Artificial Sequence: Synthetic oligonucleotide
accttcagctcacatcatgatgcagcagactc

SEQ ID NO: 285014 - DNA, 31 bp, Artificial Sequence
  Description of Artificial Sequence: Synthetic oligonucleotide
ccttcagctcacatcatgatgcagcagactc

SEQ ID NO: 285015 - DNA, 35 bp, Artificial Sequence
  Description of Artificial Sequence: Synthetic oligonucleotide
cttcagctcacatcatgatgcagcagactcaaatc

SEQ ID NO: 285016 - DNA, 36 bp, Artificial Sequence
  Description of Artificial Sequence: Synthetic oligonucleotide
ttcagctcacatcatgatgcagcagactcaaatcac

SEQ ID NO: 285017 - DNA, 35 bp, Artificial Sequence
  Description of Artificial Sequence: Synthetic oligonucleotide
tcagctcacatcatgatgcagcagactcaaatcac

SEQ ID NO: 285018 - DNA, 34 bp, Artificial Sequence
  Description of Artificial Sequence: Synthetic oligonucleotide
cagctcacatcatgatgcagcagactcaaatcac

SEQ ID NO: 285019 - DNA, 36 bp, Artificial Sequence
  Description of Artificial Sequence: Synthetic oligonucleotide
agctcacatcatgatgcagcagactcaaatcacttc

SEQ ID NO: 285020 - DNA, 35 bp, Artificial Sequence
  Description of Artificial Sequence: Synthetic oligonucleotide
gctcacatcatgatgcagcagactcaaatcacttc

SEQ ID NO: 285021 - DNA, 36 bp, Artificial Sequence
  Description of Artificial Sequence: Synthetic oligonucleotide
ctcacatcatgatgcagcagactcaaatcacttctc

SEQ ID NO: 285022 - DNA, 36 bp, Artificial Sequence
  Description of Artificial Sequence: Synthetic oligonucleotide
tcacatcatgatgcagcagactcaaatcacttctcc

SEQ ID NO: 285023 - DNA, 35 bp, Artificial Sequence
  Description of Artificial Sequence: Synthetic oligonucleotide
cacatcatgatgcagcagactcaaatcacttctcc

SEQ ID NO: 285024 - DNA, 38 bp, Artificial Sequence
  Description of Artificial Sequence: Synthetic oligonucleotide
acatcatgatgcagcagactcaaatcacttctccaaag

SEQ ID NO: 285025 - DNA, 37 bp, Artificial Sequence
  Description of Artificial Sequence: Synthetic oligonucleotide
catcatgatgcagcagactcaaatcacttctccaaag

SEQ ID NO: 285026 - DNA, 37 bp, Artificial Sequence
  Description of Artificial Sequence: Synthetic oligonucleotide
atcatgatgcagcagactcaaatcacttctccaaagg

SEQ ID NO: 285027 - DNA, 36 bp, Artificial Sequence
  Description of Artificial Sequence: Synthetic oligonucleotide
tcatgatgcagcagactcaaatcacttctccaaagg

SEQ ID NO: 285028 - DNA, 35 bp, Artificial Sequence
  Description of Artificial Sequence: Synthetic oligonucleotide
catgatgcagcagactcaaatcacttctccaaagg

SEQ ID NO: 285029 - DNA, 36 bp, Artificial Sequence
  Description of Artificial Sequence: Synthetic oligonucleotide
atgatgcagcagactcaaatcacttctccaaaggtc

SEQ ID NO: 285030 - DNA, 35 bp, Artificial Sequence
  Description of Artificial Sequence: Synthetic oligonucleotide
tgatgcagcagactcaaatcacttctccaaaggtc

SEQ ID NO: 285031 - DNA, 34 bp, Artificial Sequence
  Description of Artificial Sequence: Synthetic oligonucleotide
gatgcagcagactcaaatcacttctccaaaggtc

SEQ ID NO: 285032 - DNA, 37 bp, Artificial Sequence
  Description of Artificial Sequence: Synthetic oligonucleotide
atgcagcagactcaaatcacttctccaaaggtcaatc

SEQ ID NO: 285033 - DNA, 36 bp, Artificial Sequence
  Description of Artificial Sequence: Synthetic oligonucleotide
tgcagcagactcaaatcacttctccaaaggtcaatc

SEQ ID NO: 285034 - DNA, 35 bp, Artificial Sequence
  Description of Artificial Sequence: Synthetic oligonucleotide
gcagcagactcaaatcacttctccaaaggtcaatc

SEQ ID NO: 285035 - DNA, 36 bp, Artificial Sequence
  Description of Artificial Sequence: Synthetic oligonucleotide
cagcagactcaaatcacttctccaaaggtcaatcag

SEQ ID NO: 285036 - DNA, 38 bp, Artificial Sequence
  Description of Artificial Sequence: Synthetic oligonucleotide
agcagactcaaatcacttctccaaaggtcaatcagttc

SEQ ID NO: 285037 - DNA, 37 bp, Artificial Sequence
  Description of Artificial Sequence: Synthetic oligonucleotide
gcagactcaaatcacttctccaaaggtcaatcagttc

SEQ ID NO: 285038 - DNA, 38 bp, Artificial Sequence
  Description of Artificial Sequence: Synthetic oligonucleotide
cagactcaaatcacttctccaaaggtcaatcagttctg

SEQ ID NO: 285039 - DNA, 39 bp, Artificial Sequence
  Description of Artificial Sequence: Synthetic oligonucleotide
agactcaaatcacttctccaaaggtcaatcagttctgac

SEQ ID NO: 285040 - DNA, 38 bp, Artificial Sequence
  Description of Artificial Sequence: Synthetic oligonucleotide
gactcaaatcacttctccaaaggtcaatcagttctgac

SEQ ID NO: 285041 - DNA, 39 bp, Artificial Sequence
  Description of Artificial Sequence: Synthetic oligonucleotide
actcaaatcacttctccaaaggtcaatcagttctgacag

SEQ ID NO: 285042 - DNA, 38 bp, Artificial Sequence
  Description of Artificial Sequence: Synthetic oligonucleotide
ctcaaatcacttctccaaaggtcaatcagttctgacag

SEQ ID NO: 285043 - DNA, 38 bp, Artificial Sequence
  Description of Artificial Sequence: Synthetic oligonucleotide
tcaaatcacttctccaaaggtcaatcagttctgacagc

SEQ ID NO: 285044 - DNA, 37 bp, Artificial Sequence
  Description of Artificial Sequence: Synthetic oligonucleotide
caaatcacttctccaaaggtcaatcagttctgacagc

SEQ ID NO: 285045 - DNA, 38 bp, Artificial Sequence
  Description of Artificial Sequence: Synthetic oligonucleotide
aaatcacttctccaaaggtcaatcagttctgacagctg

SEQ ID NO: 285046 - DNA, 37 bp, Artificial Sequence
  Description of Artificial Sequence: Synthetic oligonucleotide
aatcacttctccaaaggtcaatcagttctgacagctg

SEQ ID NO: 285047 - DNA, 36 bp, Artificial Sequence
  Description of Artificial Sequence: Synthetic oligonucleotide
atcacttctccaaaggtcaatcagttctgacagctg

SEQ ID NO: 285048 - DNA, 35 bp, Artificial Sequence
  Description of Artificial Sequence: Synthetic oligonucleotide
tcacttctccaaaggtcaatcagttctgacagctg

SEQ ID NO: 285049 - DNA, 34 bp, Artificial Sequence
  Description of Artificial Sequence: Synthetic oligonucleotide
cacttctccaaaggtcaatcagttctgacagctg

SEQ ID NO: 285050 - DNA, 38 bp, Artificial Sequence
  Description of Artificial Sequence: Synthetic oligonucleotide
acttctccaaaggtcaatcagttctgacagctgttttc

SEQ ID NO: 285051 - DNA, 37 bp, Artificial Sequence
  Description of Artificial Sequence: Synthetic oligonucleotide
cttctccaaaggtcaatcagttctgacagctgttttc

SEQ ID NO: 285052 - DNA, 37 bp, Artificial Sequence
  Description of Artificial Sequence: Synthetic oligonucleotide
ttctccaaaggtcaatcagttctgacagctgttttcc

SEQ ID NO: 285053 - DNA, 36 bp, Artificial Sequence
  Description of Artificial Sequence: Synthetic oligonucleotide
tctccaaaggtcaatcagttctgacagctgttttcc

SEQ ID NO: 285054 - DNA, 35 bp, Artificial Sequence
  Description of Artificial Sequence: Synthetic oligonucleotide
ctccaaaggtcaatcagttctgacagctgttttcc

SEQ ID NO: 285055 - DNA, 38 bp, Artificial Sequence
  Description of Artificial Sequence: Synthetic oligonucleotide
tccaaaggtcaatcagttctgacagctgttttccaaag

SEQ ID NO: 285056 - DNA, 37 bp, Artificial Sequence
  Description of Artificial Sequence: Synthetic oligonucleotide
ccaaaggtcaatcagttctgacagctgttttccaaag

SEQ ID NO: 285057 - DNA, 38 bp, Artificial Sequence
  Description of Artificial Sequence: Synthetic oligonucleotide
caaaggtcaatcagttctgacagctgttttccaaagtg

SEQ ID NO: 285058 - DNA, 40 bp, Artificial Sequence
  Description of Artificial Sequence: Synthetic oligonucleotide
aaaggtcaatcagttctgacagctgttttccaaagtgatc

SEQ ID NO: 285059 - DNA, 39 bp, Artificial Sequence
  Description of Artificial Sequence: Synthetic oligonucleotide
aaggtcaatcagttctgacagctgttttccaaagtgatc

SEQ ID NO: 285060 - DNA, 38 bp, Artificial Sequence
  Description of Artificial Sequence: Synthetic oligonucleotide
aggtcaatcagttctgacagctgttttccaaagtgatc

SEQ ID NO: 285061 - DNA, 37 bp, Artificial Sequence
  Description of Artificial Sequence: Synthetic oligonucleotide
ggtcaatcagttctgacagctgttttccaaagtgatc

SEQ ID NO: 285062 - DNA, 40 bp, Artificial Sequence
  Description of Artificial Sequence: Synthetic oligonucleotide
gtcaatcagttctgacagctgttttccaaagtgatcaatg

SEQ ID NO: 285063 - DNA, 44 bp, Artificial Sequence
  Description of Artificial Sequence: Synthetic oligonucleotide
tcaatcagttctgacagctgttttccaaagtgatcaatgattag

SEQ ID NO: 285064 - DNA, 43 bp, Artificial Sequence
  Description of Artificial Sequence: Synthetic oligonucleotide
caatcagttctgacagctgttttccaaagtgatcaatgattag

SEQ ID NO: 285065 - DNA, 43 bp, Artificial Sequence
  Description of Artificial Sequence: Synthetic oligonucleotide
aatcagttctgacagctgttttccaaagtgatcaatgattagc

SEQ ID NO: 285066 - DNA, 42 bp, Artificial Sequence
  Description of Artificial Sequence: Synthetic oligonucleotide
atcagttctgacagctgttttccaaagtgatcaatgattagc

SEQ ID NO: 285067 - DNA, 41 bp, Artificial Sequence
  Description of Artificial Sequence: Synthetic oligonucleotide
tcagttctgacagctgttttccaaagtgatcaatgattagc

SEQ ID NO: 285068 - DNA, 40 bp, Artificial Sequence
  Description of Artificial Sequence: Synthetic oligonucleotide
cagttctgacagctgttttccaaagtgatcaatgattagc

SEQ ID NO: 285069 - DNA, 42 bp, Artificial Sequence
  Description of Artificial Sequence: Synthetic oligonucleotide
agttctgacagctgttttccaaagtgatcaatgattagcatg

SEQ ID NO: 285070 - DNA, 41 bp, Artificial Sequence
  Description of Artificial Sequence: Synthetic oligonucleotide
gttctgacagctgttttccaaagtgatcaatgattagcatg

SEQ ID NO: 285071 - DNA, 43 bp, Artificial Sequence
  Description of Artificial Sequence: Synthetic oligonucleotide
ttctgacagctgttttccaaagtgatcaatgattagcatgatg

SEQ ID NO: 285072 - DNA, 42 bp, Artificial Sequence
  Description of Artificial Sequence: Synthetic oligonucleotide
tctgacagctgttttccaaagtgatcaatgattagcatgatg

SEQ ID NO: 285073 - DNA, 41 bp, Artificial Sequence
  Description of Artificial Sequence: Synthetic oligonucleotide
ctgacagctgttttccaaagtgatcaatgattagcatgatg

SEQ ID NO: 285074 - DNA, 43 bp, Artificial Sequence
  Description of Artificial Sequence: Synthetic oligonucleotide
tgacagctgttttccaaagtgatcaatgattagcatgatgttg

SEQ ID NO: 285075 - DNA, 42 bp, Artificial Sequence
  Description of Artificial Sequence: Synthetic oligonucleotide
gacagctgttttccaaagtgatcaatgattagcatgatgttg

SEQ ID NO: 285076 - DNA, 43 bp, Artificial Sequence
  Description of Artificial Sequence: Synthetic oligonucleotide
acagctgttttccaaagtgatcaatgattagcatgatgttgtc

SEQ ID NO: 285077 - DNA, 42 bp, Artificial Sequence
  Description of Artificial Sequence: Synthetic oligonucleotide
cagctgttttccaaagtgatcaatgattagcatgatgttgtc

SEQ ID NO: 285078 - DNA, 44 bp, Artificial Sequence
  Description of Artificial Sequence: Synthetic oligonucleotide
agctgttttccaaagtgatcaatgattagcatgatgttgtcatg

SEQ ID NO: 285079 - DNA, 43 bp, Artificial Sequence
  Description of Artificial Sequence: Synthetic oligonucleotide
gctgttttccaaagtgatcaatgattagcatgatgttgtcatg

SEQ ID NO: 285080 - DNA, 43 bp, Artificial Sequence
  Description of Artificial Sequence: Synthetic oligonucleotide
ctgttttccaaagtgatcaatgattagcatgatgttgtcatgg

SEQ ID NO: 285081 - DNA, 43 bp, Artificial Sequence
  Description of Artificial Sequence: Synthetic oligonucleotide
tgttttccaaagtgatcaatgattagcatgatgttgtcatggc

SEQ ID NO: 285082 - DNA, 42 bp, Artificial Sequence
  Description of Artificial Sequence: Synthetic oligonucleotide
gttttccaaagtgatcaatgattagcatgatgttgtcatggc

SEQ ID NO: 285083 - DNA, 42 bp, Artificial Sequence
  Description of Artificial Sequence: Synthetic oligonucleotide
ttttccaaagtgatcaatgattagcatgatgttgtcatggcg

SEQ ID NO: 285084 - DNA, 41 bp, Artificial Sequence
  Description of Artificial Sequence: Synthetic oligonucleotide
tttccaaagtgatcaatgattagcatgatgttgtcatggcg

SEQ ID NO: 285085 - DNA, 40 bp, Artificial Sequence
  Description of Artificial Sequence: Synthetic oligonucleotide
ttccaaagtgatcaatgattagcatgatgttgtcatggcg

SEQ ID NO: 285086 - DNA, 39 bp, Artificial Sequence
  Description of Artificial Sequence: Synthetic oligonucleotide
tccaaagtgatcaatgattagcatgatgttgtcatggcg

SEQ ID NO: 285087 - DNA, 38 bp, Artificial Sequence
  Description of Artificial Sequence: Synthetic oligonucleotide
ccaaagtgatcaatgattagcatgatgttgtcatggcg

SEQ ID NO: 285088 - DNA, 40 bp, Artificial Sequence
  Description of Artificial Sequence: Synthetic oligonucleotide
caaagtgatcaatgattagcatgatgttgtcatggcgaag

SEQ ID NO: 285089 - DNA, 43 bp, Artificial Sequence
  Description of Artificial Sequence: Synthetic oligonucleotide
aaagtgatcaatgattagcatgatgttgtcatggcgaagtttg

SEQ ID NO: 285090 - DNA, 42 bp, Artificial Sequence
  Description of Artificial Sequence: Synthetic oligonucleotide
aagtgatcaatgattagcatgatgttgtcatggcgaagtttg

SEQ ID NO: 285091 - DNA, 41 bp, Artificial Sequence
  Description of Artificial Sequence: Synthetic oligonucleotide
agtgatcaatgattagcatgatgttgtcatggcgaagtttg

SEQ ID NO: 285092 - DNA, 40 bp, Artificial Sequence
  Description of Artificial Sequence: Synthetic oligonucleotide
gtgatcaatgattagcatgatgttgtcatggcgaagtttg

SEQ ID NO: 285093 - DNA, 40 bp, Artificial Sequence
  Description of Artificial Sequence: Synthetic oligonucleotide
tgatcaatgattagcatgatgttgtcatggcgaagtttgg

SEQ ID NO: 285094 - DNA, 39 bp, Artificial Sequence
  Description of Artificial Sequence: Synthetic oligonucleotide
gatcaatgattagcatgatgttgtcatggcgaagtttgg

SEQ ID NO: 285095 - DNA, 39 bp, Artificial Sequence
  Description of Artificial Sequence: Synthetic oligonucleotide
atcaatgattagcatgatgttgtcatggcgaagtttggc

SEQ ID NO: 285096 - DNA, 38 bp, Artificial Sequence
  Description of Artificial Sequence: Synthetic oligonucleotide
tcaatgattagcatgatgttgtcatggcgaagtttggc

SEQ ID NO: 285097 - DNA, 37 bp, Artificial Sequence
  Description of Artificial Sequence: Synthetic oligonucleotide
caatgattagcatgatgttgtcatggcgaagtttggc

SEQ ID NO: 285098 - DNA, 37 bp, Artificial Sequence
  Description of Artificial Sequence: Synthetic oligonucleotide
aatgattagcatgatgttgtcatggcgaagtttggcc

SEQ ID NO: 285099 - DNA, 36 bp, Artificial Sequence
  Description of Artificial Sequence: Synthetic oligonucleotide
atgattagcatgatgttgtcatggcgaagtttggcc

SEQ ID NO: 285100 - DNA, 35 bp, Artificial Sequence
  Description of Artificial Sequence: Synthetic oligonucleotide
tgattagcatgatgttgtcatggcgaagtttggcc

SEQ ID NO: 285101 - DNA, 34 bp, Artificial Sequence
  Description of Artificial Sequence: Synthetic oligonucleotide
gattagcatgatgttgtcatggcgaagtttggcc

SEQ ID NO: 285102 - DNA, 34 bp, Artificial Sequence
  Description of Artificial Sequence: Synthetic oligonucleotide
attagcatgatgttgtcatggcgaagtttggccc

SEQ ID NO: 285103 - DNA, 33 bp, Artificial Sequence
  Description of Artificial Sequence: Synthetic oligonucleotide
ttagcatgatgttgtcatggcgaagtttggccc

SEQ ID NO: 285104 - DNA, 32 bp, Artificial Sequence
  Description of Artificial Sequence: Synthetic oligonucleotide
tagcatgatgttgtcatggcgaagtttggccc

SEQ ID NO: 285105 - DNA, 31 bp, Artificial Sequence
  Description of Artificial Sequence: Synthetic oligonucleotide
agcatgatgttgtcatggcgaagtttggccc

SEQ ID NO: 285106 - DNA, 30 bp, Artificial Sequence
  Description of Artificial Sequence: Synthetic oligonucleotide
gcatgatgttgtcatggcgaagtttggccc

SEQ ID NO: 285107 - DNA, 34 bp, Artificial Sequence
  Description of Artificial Sequence: Synthetic oligonucleotide
catgatgttgtcatggcgaagtttggccctattc

SEQ ID NO: 285108 - DNA, 35 bp, Artificial Sequence
  Description of Artificial Sequence: Synthetic oligonucleotide
atgatgttgtcatggcgaagtttggccctattctg

SEQ ID NO: 285109 - DNA, 34 bp, Artificial Sequence
  Description of Artificial Sequence: Synthetic oligonucleotide
tgatgttgtcatggcgaagtttggccctattctg

SEQ ID NO: 285110 - DNA, 33 bp, Artificial Sequence
  Description of Artificial Sequence: Synthetic oligonucleotide
gatgttgtcatggcgaagtttggccctattctg

SEQ ID NO: 285111 - DNA, 33 bp, Artificial Sequence
  Description of Artificial Sequence: Synthetic oligonucleotide
atgttgtcatggcgaagtttggccctattctgg

SEQ ID NO: 285112 - DNA, 32 bp, Artificial Sequence
  Description of Artificial Sequence: Synthetic oligonucleotide
tgttgtcatggcgaagtttggccctattctgg

SEQ ID NO: 285113 - DNA, 31 bp, Artificial Sequence
  Description of Artificial Sequence: Synthetic oligonucleotide
gttgtcatggcgaagtttggccctattctgg

SEQ ID NO: 285114 - DNA, 31 bp, Artificial Sequence
  Description of Artificial Sequence: Synthetic oligonucleotide
ttgtcatggcgaagtttggccctattctggg

SEQ ID NO: 285115 - DNA, 30 bp, Artificial Sequence
  Description of Artificial Sequence: Synthetic oligonucleotide
tgtcatggcgaagtttggccctattctggg

SEQ ID NO: 285116 - DNA, 29 bp, Artificial Sequence
  Description of Artificial Sequence: Synthetic oligonucleotide
gtcatggcgaagtttggccctattctggg

SEQ ID NO: 285117 - DNA, 29 bp, Artificial Sequence
  Description of Artificial Sequence: Synthetic oligonucleotide
tcatggcgaagtttggccctattctgggc

SEQ ID NO: 285118 - DNA, 28 bp, Artificial Sequence
  Description of Artificial Sequence: Synthetic oligonucleotide
catggcgaagtttggccctattctgggc

SEQ ID NO: 285119 - DNA, 28 bp, Artificial Sequence
  Description of Artificial Sequence: Synthetic oligonucleotide
atggcgaagtttggccctattctgggcc

SEQ ID NO: 285120 - DNA, 27 bp, Artificial Sequence
  Description of Artificial Sequence: Synthetic oligonucleotide
tggcgaagtttggccctattctgggcc

SEQ ID NO: 285121 - DNA, 27 bp, Artificial Sequence
  Description of Artificial Sequence: Synthetic oligonucleotide
ggcgaagtttggccctattctgggcca

SEQ ID NO: 285122 - DNA, 27 bp, Artificial Sequence
  Description of Artificial Sequence: Synthetic oligonucleotide
gcgaagtttggccctattctgggccag

SEQ ID NO: 285123 - DNA, 27 bp, Artificial Sequence
  Description of Artificial Sequence: Synthetic oligonucleotide
cgaagtttggccctattctgggccagg

SEQ ID NO: 285124 - DNA, 27 bp, Artificial Sequence
  Description of Artificial Sequence: Synthetic oligonucleotide
gaagtttggccctattctgggccaggg

SEQ ID NO: 285125 - DNA, 27 bp, Artificial Sequence
  Description of Artificial Sequence: Synthetic oligonucleotide
aagtttggccctattctgggccagggc

SEQ ID NO: 285126 - DNA, 27 bp, Artificial Sequence
  Description of Artificial Sequence: Synthetic oligonucleotide
agtttggccctattctgggccagggca

SEQ ID NO: 285127 - DNA, 27 bp, Artificial Sequence
  Description of Artificial Sequence: Synthetic oligonucleotide
gtttggccctattctgggccagggcat

SEQ ID NO: 285128 - DNA, 28 bp, Artificial Sequence
  Description of Artificial Sequence: Synthetic oligonucleotide
tttggccctattctgggccagggcattc

SEQ ID NO: 285129 - DNA, 27 bp, Artificial Sequence
  Description of Artificial Sequence: Synthetic oligonucleotide
ttggccctattctgggccagggcattc

SEQ ID NO: 285130 - DNA, 27 bp, Artificial Sequence
  Description of Artificial Sequence: Synthetic oligonucleotide
tggccctattctgggccagggcattct

SEQ ID NO: 285131 - DNA, 26 bp, Artificial Sequence
  Description of Artificial Sequence: Synthetic oligonucleotide
ggccctattctgggccagggcattct

SEQ ID NO: 285132 - DNA, 26 bp, Artificial Sequence
  Description of Artificial Sequence: Synthetic oligonucleotide
gccctattctgggccagggcattctg

SEQ ID NO: 285133 - DNA, 27 bp, Artificial Sequence
  Description of Artificial Sequence: Synthetic oligonucleotide
ccctattctgggccagggcattctgga

SEQ ID NO: 285134 - DNA, 28 bp, Artificial Sequence
  Description of Artificial Sequence: Synthetic oligonucleotide
cctattctgggccagggcattctggatg

SEQ ID NO: 285135 - DNA, 28 bp, Artificial Sequence
  Description of Artificial Sequence: Synthetic oligonucleotide
ctattctgggccagggcattctggatgc

SEQ ID NO: 285136 - DNA, 29 bp, Artificial Sequence
  Description of Artificial Sequence: Synthetic oligonucleotide
tattctgggccagggcattctggatgcac

SEQ ID NO: 285137 - DNA, 28 bp, Artificial Sequence
  Description of Artificial Sequence: Synthetic oligonucleotide
attctgggccagggcattctggatgcac

SEQ ID NO: 285138 - DNA, 27 bp, Artificial Sequence
  Description of Artificial Sequence: Synthetic oligonucleotide
ttctgggccagggcattctggatgcac

SEQ ID NO: 285139 - DNA, 26 bp, Artificial Sequence
  Description of Artificial Sequence: Synthetic oligonucleotide
tctgggccagggcattctggatgcac

SEQ ID NO: 285140 - DNA, 25 bp, Artificial Sequence
  Description of Artificial Sequence: Synthetic oligonucleotide
ctgggccagggcattctggatgcac

SEQ ID NO: 285141 - DNA, 26 bp, Artificial Sequence
  Description of Artificial Sequence: Synthetic oligonucleotide
tgggccagggcattctggatgcacgt

SEQ ID NO: 285142 - DNA, 25 bp, Artificial Sequence
  Description of Artificial Sequence: Synthetic oligonucleotide
gggccagggcattctggatgcacgt

SEQ ID NO: 285143 - DNA, 25 bp, Artificial Sequence
  Description of Artificial Sequence: Synthetic oligonucleotide
ggccagggcattctggatgcacgtg

SEQ ID NO: 285144 - DNA, 26 bp, Artificial Sequence
  Description of Artificial Sequence: Synthetic oligonucleotide
gccagggcattctggatgcacgtggt

SEQ ID NO: 285145 - DNA, 27 bp, Artificial Sequence
  Description of Artificial Sequence: Synthetic oligonucleotide
ccagggcattctggatgcacgtggtca

SEQ ID NO: 285146 - DNA, 31 bp, Artificial Sequence
  Description of Artificial Sequence: Synthetic oligonucleotide
cagggcattctggatgcacgtggtcatattg

SEQ ID NO: 285147 - DNA, 32 bp, Artificial Sequence
  Description of Artificial Sequence: Synthetic oligonucleotide
agggcattctggatgcacgtggtcatattgtc

SEQ ID NO: 285148 - DNA, 31 bp, Artificial Sequence
  Description of Artificial Sequence: Synthetic oligonucleotide
gggcattctggatgcacgtggtcatattgtc

SEQ ID NO: 285149 - DNA, 32 bp, Artificial Sequence
  Description of Artificial Sequence: Synthetic oligonucleotide
ggcattctggatgcacgtggtcatattgtcac

SEQ ID NO: 285150 - DNA, 35 bp, Artificial Sequence
  Description of Artificial Sequence: Synthetic oligonucleotide
gcattctggatgcacgtggtcatattgtcacaatg

SEQ ID NO: 285151 - DNA, 36 bp, Artificial Sequence
  Description of Artificial Sequence: Synthetic oligonucleotide
cattctggatgcacgtggtcatattgtcacaatgtc

SEQ ID NO: 285152 - DNA, 36 bp, Artificial Sequence
  Description of Artificial Sequence: Synthetic oligonucleotide
attctggatgcacgtggtcatattgtcacaatgtcc

SEQ ID NO: 285153 - DNA, 35 bp, Artificial Sequence
  Description of Artificial Sequence: Synthetic oligonucleotide
ttctggatgcacgtggtcatattgtcacaatgtcc

SEQ ID NO: 285154 - DNA, 34 bp, Artificial Sequence
  Description of Artificial Sequence: Synthetic oligonucleotide
tctggatgcacgtggtcatattgtcacaatgtcc

SEQ ID NO: 285155 - DNA, 33 bp, Artificial Sequence
  Description of Artificial Sequence: Synthetic oligonucleotide
ctggatgcacgtggtcatattgtcacaatgtcc

SEQ ID NO: 285156 - DNA, 35 bp, Artificial Sequence
  Description of Artificial Sequence: Synthetic oligonucleotide
tggatgcacgtggtcatattgtcacaatgtccttg

SEQ ID NO: 285157 - DNA, 34 bp, Artificial Sequence
  Description of Artificial Sequence: Synthetic oligonucleotide
ggatgcacgtggtcatattgtcacaatgtccttg

SEQ ID NO: 285158 - DNA, 34 bp, Artificial Sequence
  Description of Artificial Sequence: Synthetic oligonucleotide
gatgcacgtggtcatattgtcacaatgtccttgc

SEQ ID NO: 285159 - DNA, 35 bp, Artificial Sequence
  Description of Artificial Sequence: Synthetic oligonucleotide
atgcacgtggtcatattgtcacaatgtccttgcag

SEQ ID NO: 285160 - DNA, 34 bp, Artificial Sequence
  Description of Artificial Sequence: Synthetic oligonucleotide
tgcacgtggtcatattgtcacaatgtccttgcag

SEQ ID NO: 285161 - DNA, 33 bp, Artificial Sequence
  Description of Artificial Sequence: Synthetic oligonucleotide
gcacgtggtcatattgtcacaatgtccttgcag

SEQ ID NO: 285162 - DNA, 34 bp, Artificial Sequence
  Description of Artificial Sequence: Synthetic oligonucleotide
cacgtggtcatattgtcacaatgtccttgcagac

SEQ ID NO: 285163 - DNA, 34 bp, Artificial Sequence
  Description of Artificial Sequence: Synthetic oligonucleotide
acgtggtcatattgtcacaatgtccttgcagacc

SEQ ID NO: 285164 - DNA, 33 bp, Artificial Sequence
  Description of Artificial Sequence: Synthetic oligonucleotide
cgtggtcatattgtcacaatgtccttgcagacc

SEQ ID NO: 285165 - DNA, 34 bp, Artificial Sequence
  Description of Artificial Sequence: Synthetic oligonucleotide
gtggtcatattgtcacaatgtccttgcagaccag

SEQ ID NO: 285166 - DNA, 34 bp, Artificial Sequence
  Description of Artificial Sequence: Synthetic oligonucleotide
tggtcatattgtcacaatgtccttgcagaccagg

SEQ ID NO: 285167 - DNA, 33 bp, Artificial Sequence
  Description of Artificial Sequence: Synthetic oligonucleotide
ggtcatattgtcacaatgtccttgcagaccagg

SEQ ID NO: 285168 - DNA, 34 bp, Artificial Sequence
  Description of Artificial Sequence: Synthetic oligonucleotide
gtcatattgtcacaatgtccttgcagaccaggac

SEQ ID NO: 285169 - DNA, 35 bp, Artificial Sequence
  Description of Artificial Sequence: Synthetic oligonucleotide
tcatattgtcacaatgtccttgcagaccaggactg

SEQ ID NO: 285170 - DNA, 34 bp, Artificial Sequence
  Description of Artificial Sequence: Synthetic oligonucleotide
catattgtcacaatgtccttgcagaccaggactg

SEQ ID NO: 285171 - DNA, 34 bp, Artificial Sequence
  Description of Artificial Sequence: Synthetic oligonucleotide
atattgtcacaatgtccttgcagaccaggactgc

SEQ ID NO: 285172 - DNA, 33 bp, Artificial Sequence
  Description of Artificial Sequence: Synthetic oligonucleotide
tattgtcacaatgtccttgcagaccaggactgc

SEQ ID NO: 285173 - DNA, 32 bp, Artificial Sequence
  Description of Artificial Sequence: Synthetic oligonucleotide
attgtcacaatgtccttgcagaccaggactgc

SEQ ID NO: 285174 - DNA, 31 bp, Artificial Sequence
  Description of Artificial Sequence: Synthetic oligonucleotide
ttgtcacaatgtccttgcagaccaggactgc

SEQ ID NO: 285175 - DNA, 30 bp, Artificial Sequence
  Description of Artificial Sequence: Synthetic oligonucleotide
tgtcacaatgtccttgcagaccaggactgc

SEQ ID NO: 285176 - DNA, 29 bp, Artificial Sequence
  Description of Artificial Sequence: Synthetic oligonucleotide
gtcacaatgtccttgcagaccaggactgc

SEQ ID NO: 285177 - DNA, 29 bp, Artificial Sequence
  Description of Artificial Sequence: Synthetic oligonucleotide
tcacaatgtccttgcagaccaggactgcg

SEQ ID NO: 285178 - DNA, 28 bp, Artificial Sequence
  Description of Artificial Sequence: Synthetic oligonucleotide
cacaatgtccttgcagaccaggactgcg

SEQ ID NO: 285179 - DNA, 28 bp, Artificial Sequence
  Description of Artificial Sequence: Synthetic oligonucleotide
acaatgtccttgcagaccaggactgcgc

SEQ ID NO: 285180 - DNA, 27 bp, Artificial Sequence
  Description of Artificial Sequence: Synthetic oligonucleotide
caatgtccttgcagaccaggactgcgc

SEQ ID NO: 285181 - DNA, 30 bp, Artificial Sequence
  Description of Artificial Sequence: Synthetic oligonucleotide
aatgtccttgcagaccaggactgcgcatac

SEQ ID NO: 285182 - DNA, 29 bp, Artificial Sequence
  Description of Artificial Sequence: Synthetic oligonucleotide
atgtccttgcagaccaggactgcgcatac

SEQ ID NO: 285183 - DNA, 28 bp, Artificial Sequence
  Description of Artificial Sequence: Synthetic oligonucleotide
tgtccttgcagaccaggactgcgcatac

SEQ ID NO: 285184 - DNA, 27 bp, Artificial Sequence
  Description of Artificial Sequence: Synthetic oligonucleotide
gtccttgcagaccaggactgcgcatac

SEQ ID NO: 285185 - DNA, 28 bp, Artificial Sequence
  Description of Artificial Sequence: Synthetic oligonucleotide
tccttgcagaccaggactgcgcatactc

SEQ ID NO: 285186 - DNA, 27 bp, Artificial Sequence
  Description of Artificial Sequence: Synthetic oligonucleotide
ccttgcagaccaggactgcgcatactc

SEQ ID NO: 285187 - DNA, 31 bp, Artificial Sequence
  Description of Artificial Sequence: Synthetic oligonucleotide
cttgcagaccaggactgcgcatactcaaatg

SEQ ID NO: 285188 - DNA, 31 bp, Artificial Sequence
  Description of Artificial Sequence: Synthetic oligonucleotide
ttgcagaccaggactgcgcatactcaaatgc

SEQ ID NO: 285189 - DNA, 30 bp, Artificial Sequence
  Description of Artificial Sequence: Synthetic oligonucleotide
tgcagaccaggactgcgcatactcaaatgc

SEQ ID NO: 285190 - DNA, 29 bp, Artificial Sequence
  Description of Artificial Sequence: Synthetic oligonucleotide
gcagaccaggactgcgcatactcaaatgc

SEQ ID NO: 285191 - DNA, 29 bp, Artificial Sequence
  Description of Artificial Sequence: Synthetic oligonucleotide
cagaccaggactgcgcatactcaaatgcc

SEQ ID NO: 285192 - DNA, 31 bp, Artificial Sequence
  Description of Artificial Sequence: Synthetic oligonucleotide
agaccaggactgcgcatactcaaatgccttc

SEQ ID NO: 285193 - DNA, 30 bp, Artificial Sequence
  Description of Artificial Sequence: Synthetic oligonucleotide
gaccaggactgcgcatactcaaatgccttc

SEQ ID NO: 285194 - DNA, 31 bp, Artificial Sequence
  Description of Artificial Sequence: Synthetic oligonucleotide
accaggactgcgcatactcaaatgccttctc

SEQ ID NO: 285195 - DNA, 30 bp, Artificial Sequence
  Description of Artificial Sequence: Synthetic oligonucleotide
ccaggactgcgcatactcaaatgccttctc

SEQ ID NO: 285196 - DNA, 31 bp, Artificial Sequence
  Description of Artificial Sequence: Synthetic oligonucleotide
caggactgcgcatactcaaatgccttctctg

SEQ ID NO: 285197 - DNA, 31 bp, Artificial Sequence
  Description of Artificial Sequence: Synthetic oligonucleotide
aggactgcgcatactcaaatgccttctctgg

SEQ ID NO: 285198 - DNA, 30 bp, Artificial Sequence
  Description of Artificial Sequence: Synthetic oligonucleotide
ggactgcgcatactcaaatgccttctctgg

SEQ ID NO: 285199 - DNA, 32 bp, Artificial Sequence
  Description of Artificial Sequence: Synthetic oligonucleotide
gactgcgcatactcaaatgccttctctggttg

SEQ ID NO: 285200 - DNA, 32 bp, Artificial Sequence
  Description of Artificial Sequence: Synthetic oligonucleotide
actgcgcatactcaaatgccttctctggttgg

SEQ ID NO: 285201 - DNA, 31 bp, Artificial Sequence
  Description of Artificial Sequence: Synthetic oligonucleotide
ctgcgcatactcaaatgccttctctggttgg

SEQ ID NO: 285202 - DNA, 31 bp, Artificial Sequence
  Description of Artificial Sequence: Synthetic oligonucleotide
tgcgcatactcaaatgccttctctggttggc

SEQ ID NO: 285203 - DNA, 30 bp, Artificial Sequence
  Description of Artificial Sequence: Synthetic oligonucleotide
gcgcatactcaaatgccttctctggttggc

SEQ ID NO: 285204 - DNA, 30 bp, Artificial Sequence
  Description of Artificial Sequence: Synthetic oligonucleotide
cgcatactcaaatgccttctctggttggcg

SEQ ID NO: 285205 - DNA, 31 bp, Artificial Sequence
  Description of Artificial Sequence: Synthetic oligonucleotide
gcatactcaaatgccttctctggttggcgac

SEQ ID NO: 285206 - DNA, 31 bp, Artificial Sequence
  Description of Artificial Sequence: Synthetic oligonucleotide
catactcaaatgccttctctggttggcgacc

SEQ ID NO: 285207 - DNA, 33 bp, Artificial Sequence
  Description of Artificial Sequence: Synthetic oligonucleotide
atactcaaatgccttctctggttggcgaccttg

SEQ ID NO: 285208 - DNA, 32 bp, Artificial Sequence
  Description of Artificial Sequence: Synthetic oligonucleotide
tactcaaatgccttctctggttggcgaccttg

SEQ ID NO: 285209 - DNA, 31 bp, Artificial Sequence
  Description of Artificial Sequence: Synthetic oligonucleotide
actcaaatgccttctctggttggcgaccttg

SEQ ID NO: 285210 - DNA, 30 bp, Artificial Sequence
  Description of Artificial Sequence: Synthetic oligonucleotide
ctcaaatgccttctctggttggcgaccttg

SEQ ID NO: 285211 - DNA, 36 bp, Artificial Sequence
  Description of Artificial Sequence: Synthetic oligonucleotide
tcaaatgccttctctggttggcgaccttgtattaac

SEQ ID NO: 285212 - DNA, 35 bp, Artificial Sequence
  Description of Artificial Sequence: Synthetic oligonucleotide
caaatgccttctctggttggcgaccttgtattaac

SEQ ID NO: 285213 - DNA, 35 bp, Artificial Sequence
  Description of Artificial Sequence: Synthetic oligonucleotide
aaatgccttctctggttggcgaccttgtattaacc

SEQ ID NO: 285214 - DNA, 34 bp, Artificial Sequence
  Description of Artificial Sequence: Synthetic oligonucleotide
aatgccttctctggttggcgaccttgtattaacc

SEQ ID NO: 285215 - DNA, 33 bp, Artificial Sequence
  Description of Artificial Sequence: Synthetic oligonucleotide
atgccttctctggttggcgaccttgtattaacc

SEQ ID NO: 285216 - DNA, 32 bp, Artificial Sequence
  Description of Artificial Sequence: Synthetic oligonucleotide
tgccttctctggttggcgaccttgtattaacc

SEQ ID NO: 285217 - DNA, 31 bp, Artificial Sequence
  Description of Artificial Sequence: Synthetic oligonucleotide
gccttctctggttggcgaccttgtattaacc

SEQ ID NO: 285218 - DNA, 31 bp, Artificial Sequence
  Description of Artificial Sequence: Synthetic oligonucleotide
ccttctctggttggcgaccttgtattaaccc

SEQ ID NO: 285219 - DNA, 32 bp, Artificial Sequence
  Description of Artificial Sequence: Synthetic oligonucleotide
cttctctggttggcgaccttgtattaacccag

SEQ ID NO: 285220 - DNA, 36 bp, Artificial Sequence
  Description of Artificial Sequence: Synthetic oligonucleotide
ttctctggttggcgaccttgtattaacccagtttag

SEQ ID NO: 285221 - DNA, 35 bp, Artificial Sequence
  Description of Artificial Sequence: Synthetic oligonucleotide
tctctggttggcgaccttgtattaacccagtttag

SEQ ID NO: 285222 - DNA, 34 bp, Artificial Sequence
  Description of Artificial Sequence: Synthetic oligonucleotide
ctctggttggcgaccttgtattaacccagtttag

SEQ ID NO: 285223 - DNA, 34 bp, Artificial Sequence
  Description of Artificial Sequence: Synthetic oligonucleotide
tctggttggcgaccttgtattaacccagtttagg

SEQ ID NO: 285224 - DNA, 33 bp, Artificial Sequence
  Description of Artificial Sequence: Synthetic oligonucleotide
ctggttggcgaccttgtattaacccagtttagg

SEQ ID NO: 285225 - DNA, 35 bp, Artificial Sequence
  Description of Artificial Sequence: Synthetic oligonucleotide
tggttggcgaccttgtattaacccagtttaggttc

SEQ ID NO: 285226 - DNA, 34 bp, Artificial Sequence
  Description of Artificial Sequence: Synthetic oligonucleotide
ggttggcgaccttgtattaacccagtttaggttc

SEQ ID NO: 285227 - DNA, 35 bp, Artificial Sequence
  Description of Artificial Sequence: Synthetic oligonucleotide
gttggcgaccttgtattaacccagtttaggttctg

SEQ ID NO: 285228 - DNA, 35 bp, Artificial Sequence
  Description of Artificial Sequence: Synthetic oligonucleotide
ttggcgaccttgtattaacccagtttaggttctgg

SEQ ID NO: 285229 - DNA, 34 bp, Artificial Sequence
  Description of Artificial Sequence: Synthetic oligonucleotide
tggcgaccttgtattaacccagtttaggttctgg

SEQ ID NO: 285230 - DNA, 33 bp, Artificial Sequence
  Description of Artificial Sequence: Synthetic oligonucleotide
ggcgaccttgtattaacccagtttaggttctgg

SEQ ID NO: 285231 - DNA, 36 bp, Artificial Sequence
  Description of Artificial Sequence: Synthetic oligonucleotide
gcgaccttgtattaacccagtttaggttctggtatc

SEQ ID NO: 285232 - DNA, 36 bp, Artificial Sequence
  Description of Artificial Sequence: Synthetic oligonucleotide
cgaccttgtattaacccagtttaggttctggtatcc

SEQ ID NO: 285233 - DNA, 37 bp, Artificial Sequence
  Description of Artificial Sequence: Synthetic oligonucleotide
gaccttgtattaacccagtttaggttctggtatcctc

SEQ ID NO: 285234 - DNA, 40 bp, Artificial Sequence
  Description of Artificial Sequence: Synthetic oligonucleotide
accttgtattaacccagtttaggttctggtatcctctttc

SEQ ID NO: 285235 - DNA, 39 bp, Artificial Sequence
  Description of Artificial Sequence: Synthetic oligonucleotide
ccttgtattaacccagtttaggttctggtatcctctttc

SEQ ID NO: 285236 - DNA, 40 bp, Artificial Sequence
  Description of Artificial Sequence: Synthetic oligonucleotide
cttgtattaacccagtttaggttctggtatcctctttctc

SEQ ID NO: 285237 - DNA, 41 bp, Artificial Sequence
  Description of Artificial Sequence: Synthetic oligonucleotide
ttgtattaacccagtttaggttctggtatcctctttctcac

SEQ ID NO: 285238 - DNA, 40 bp, Artificial Sequence
  Description of Artificial Sequence: Synthetic oligonucleotide
tgtattaacccagtttaggttctggtatcctctttctcac

SEQ ID NO: 285239 - DNA, 39 bp, Artificial Sequence
  Description of Artificial Sequence: Synthetic oligonucleotide
gtattaacccagtttaggttctggtatcctctttctcac

SEQ ID NO: 285240 - DNA, 41 bp, Artificial Sequence
  Description of Artificial Sequence: Synthetic oligonucleotide
tattaacccagtttaggttctggtatcctctttctcacttc

SEQ ID NO: 285241 - DNA, 40 bp, Artificial Sequence
  Description of Artificial Sequence: Synthetic oligonucleotide
attaacccagtttaggttctggtatcctctttctcacttc

SEQ ID NO: 285242 - DNA, 39 bp, Artificial Sequence
  Description of Artificial Sequence: Synthetic oligonucleotide
ttaacccagtttaggttctggtatcctctttctcacttc

SEQ ID NO: 285243 - DNA, 38 bp, Artificial Sequence
  Description of Artificial Sequence: Synthetic oligonucleotide
taacccagtttaggttctggtatcctctttctcacttc

SEQ ID NO: 285244 - DNA, 37 bp, Artificial Sequence
  Description of Artificial Sequence: Synthetic oligonucleotide
aacccagtttaggttctggtatcctctttctcacttc

SEQ ID NO: 285245 - DNA, 36 bp, Artificial Sequence
  Description of Artificial Sequence: Synthetic oligonucleotide
acccagtttaggttctggtatcctctttctcacttc

SEQ ID NO: 285246 - DNA, 35 bp, Artificial Sequence
  Description of Artificial Sequence: Synthetic oligonucleotide
cccagtttaggttctggtatcctctttctcacttc

SEQ ID NO: 285247 - DNA, 35 bp, Artificial Sequence
  Description of Artificial Sequence: Synthetic oligonucleotide
ccagtttaggttctggtatcctctttctcacttcc

SEQ ID NO: 285248 - DNA, 36 bp, Artificial Sequence
  Description of Artificial Sequence: Synthetic oligonucleotide
cagtttaggttctggtatcctctttctcacttcctg

SEQ ID NO: 285249 - DNA, 37 bp, Artificial Sequence
  Description of Artificial Sequence: Synthetic oligonucleotide
agtttaggttctggtatcctctttctcacttcctgac

SEQ ID NO: 285250 - DNA, 36 bp, Artificial Sequence
  Description of Artificial Sequence: Synthetic oligonucleotide
gtttaggttctggtatcctctttctcacttcctgac

SEQ ID NO: 285251 - DNA, 39 bp, Artificial Sequence
  Description of Artificial Sequence: Synthetic oligonucleotide
tttaggttctggtatcctctttctcacttcctgacattg

SEQ ID NO: 285252 - DNA, 38 bp, Artificial Sequence
  Description of Artificial Sequence: Synthetic oligonucleotide
ttaggttctggtatcctctttctcacttcctgacattg

SEQ ID NO: 285253 - DNA, 37 bp, Artificial Sequence
  Description of Artificial Sequence: Synthetic oligonucleotide
taggttctggtatcctctttctcacttcctgacattg

SEQ ID NO: 285254 - DNA, 36 bp, Artificial Sequence
  Description of Artificial Sequence: Synthetic oligonucleotide
aggttctggtatcctctttctcacttcctgacattg

SEQ ID NO: 285255 - DNA, 35 bp, Artificial Sequence
  Description of Artificial Sequence: Synthetic oligonucleotide
ggttctggtatcctctttctcacttcctgacattg

SEQ ID NO: 285256 - DNA, 35 bp, Artificial Sequence
  Description of Artificial Sequence: Synthetic oligonucleotide
gttctggtatcctctttctcacttcctgacattgg

SEQ ID NO: 285257 - DNA, 35 bp, Artificial Sequence
  Description of Artificial Sequence: Synthetic oligonucleotide
ttctggtatcctctttctcacttcctgacattggc

SEQ ID NO: 285258 - DNA, 34 bp, Artificial Sequence
  Description of Artificial Sequence: Synthetic oligonucleotide
tctggtatcctctttctcacttcctgacattggc

SEQ ID NO: 285259 - DNA, 33 bp, Artificial Sequence
  Description of Artificial Sequence: Synthetic oligonucleotide
ctggtatcctctttctcacttcctgacattggc

SEQ ID NO: 285260 - DNA, 38 bp, Artificial Sequence
  Description of Artificial Sequence: Synthetic oligonucleotide
tggtatcctctttctcacttcctgacattggcttttac

SEQ ID NO: 285261 - DNA, 37 bp, Artificial Sequence
  Description of Artificial Sequence: Synthetic oligonucleotide
ggtatcctctttctcacttcctgacattggcttttac

SEQ ID NO: 285262 - DNA, 37 bp, Artificial Sequence
  Description of Artificial Sequence: Synthetic oligonucleotide
gtatcctctttctcacttcctgacattggcttttacc

SEQ ID NO: 285263 - DNA, 37 bp, Artificial Sequence
  Description of Artificial Sequence: Synthetic oligonucleotide
tatcctctttctcacttcctgacattggcttttaccc

SEQ ID NO: 285264 - DNA, 36 bp, Artificial Sequence
  Description of Artificial Sequence: Synthetic oligonucleotide
atcctctttctcacttcctgacattggcttttaccc

SEQ ID NO: 285265 - DNA, 35 bp, Artificial Sequence
  Description of Artificial Sequence: Synthetic oligonucleotide
tcctctttctcacttcctgacattggcttttaccc

SEQ ID NO: 285266 - DNA, 34 bp, Artificial Sequence
  Description of Artificial Sequence: Synthetic oligonucleotide
cctctttctcacttcctgacattggcttttaccc

SEQ ID NO: 285267 - DNA, 34 bp, Artificial Sequence
  Description of Artificial Sequence: Synthetic oligonucleotide
ctctttctcacttcctgacattggcttttacccc

SEQ ID NO: 285268 - DNA, 36 bp, Artificial Sequence
  Description of Artificial Sequence: Synthetic oligonucleotide
tctttctcacttcctgacattggcttttacccctac

SEQ ID NO: 285269 - DNA, 35 bp, Artificial Sequence
  Description of Artificial Sequence: Synthetic oligonucleotide
ctttctcacttcctgacattggcttttacccctac

SEQ ID NO: 285270 - DNA, 35 bp, Artificial Sequence
  Description of Artificial Sequence: Synthetic oligonucleotide
tttctcacttcctgacattggcttttacccctacg

SEQ ID NO: 285271 - DNA, 34 bp, Artificial Sequence
  Description of Artificial Sequence: Synthetic oligonucleotide
ttctcacttcctgacattggcttttacccctacg

SEQ ID NO: 285272 - DNA, 33 bp, Artificial Sequence
  Description of Artificial Sequence: Synthetic oligonucleotide
tctcacttcctgacattggcttttacccctacg

SEQ ID NO: 285273 - DNA, 32 bp, Artificial Sequence
  Description of Artificial Sequence: Synthetic oligonucleotide
ctcacttcctgacattggcttttacccctacg

SEQ ID NO: 285274 - DNA, 33 bp, Artificial Sequence
  Description of Artificial Sequence: Synthetic oligonucleotide
tcacttcctgacattggcttttacccctacgtg

SEQ ID NO: 285275 - DNA, 32 bp, Artificial Sequence
  Description of Artificial Sequence: Synthetic oligonucleotide
cacttcctgacattggcttttacccctacgtg

SEQ ID NO: 285276 - DNA, 33 bp, Artificial Sequence
  Description of Artificial Sequence: Synthetic oligonucleotide
acttcctgacattggcttttacccctacgtgtg

SEQ ID NO: 285277 - DNA, 32 bp, Artificial Sequence
  Description of Artificial Sequence: Synthetic oligonucleotide
cttcctgacattggcttttacccctacgtgtg

SEQ ID NO: 285278 - DNA, 33 bp, Artificial Sequence
  Description of Artificial Sequence: Synthetic oligonucleotide
ttcctgacattggcttttacccctacgtgtgtc

SEQ ID NO: 285279 - DNA, 32 bp, Artificial Sequence
  Description of Artificial Sequence: Synthetic oligonucleotide
tcctgacattggcttttacccctacgtgtgtc

SEQ ID NO: 285280 - DNA, 31 bp, Artificial Sequence
  Description of Artificial Sequence: Synthetic oligonucleotide
cctgacattggcttttacccctacgtgtgtc

SEQ ID NO: 285281 - DNA, 34 bp, Artificial Sequence
  Description of Artificial Sequence: Synthetic oligonucleotide
ctgacattggcttttacccctacgtgtgtcattc

SEQ ID NO: 285282 - DNA, 34 bp, Artificial Sequence
  Description of Artificial Sequence: Synthetic oligonucleotide
tgacattggcttttacccctacgtgtgtcattcg

SEQ ID NO: 285283 - DNA, 33 bp, Artificial Sequence
  Description of Artificial Sequence: Synthetic oligonucleotide
gacattggcttttacccctacgtgtgtcattcg

SEQ ID NO: 285284 - DNA, 33 bp, Artificial Sequence
  Description of Artificial Sequence: Synthetic oligonucleotide
acattggcttttacccctacgtgtgtcattcgc

SEQ ID NO: 285285 - DNA, 32 bp, Artificial Sequence
  Description of Artificial Sequence: Synthetic oligonucleotide
cattggcttttacccctacgtgtgtcattcgc

SEQ ID NO: 285286 - DNA, 32 bp, Artificial Sequence
  Description of Artificial Sequence: Synthetic oligonucleotide
attggcttttacccctacgtgtgtcattcgcc

SEQ ID NO: 285287 - DNA, 31 bp, Artificial Sequence
  Description of Artificial Sequence: Synthetic oligonucleotide
ttggcttttacccctacgtgtgtcattcgcc

SEQ ID NO: 285288 - DNA, 30 bp, Artificial Sequence
  Description of Artificial Sequence: Synthetic oligonucleotide
tggcttttacccctacgtgtgtcattcgcc

SEQ ID NO: 285289 - DNA, 29 bp, Artificial Sequence
  Description of Artificial Sequence: Synthetic oligonucleotide
ggcttttacccctacgtgtgtcattcgcc

SEQ ID NO: 285290 - DNA, 33 bp, Artificial Sequence
  Description of Artificial Sequence: Synthetic oligonucleotide
gcttttacccctacgtgtgtcattcgccttaac

SEQ ID NO: 285291 - DNA, 35 bp, Artificial Sequence
  Description of Artificial Sequence: Synthetic oligonucleotide
cttttacccctacgtgtgtcattcgccttaacatg

SEQ ID NO: 285292 - DNA, 35 bp, Artificial Sequence
  Description of Artificial Sequence: Synthetic oligonucleotide
ttttacccctacgtgtgtcattcgccttaacatgg

SEQ ID NO: 285293 - DNA, 34 bp, Artificial Sequence
  Description of Artificial Sequence: Synthetic oligonucleotide
tttacccctacgtgtgtcattcgccttaacatgg

SEQ ID NO: 285294 - DNA, 33 bp, Artificial Sequence
  Description of Artificial Sequence: Synthetic oligonucleotide
ttacccctacgtgtgtcattcgccttaacatgg

SEQ ID NO: 285295 - DNA, 32 bp, Artificial Sequence
  Description of Artificial Sequence: Synthetic oligonucleotide
tacccctacgtgtgtcattcgccttaacatgg

SEQ ID NO: 285296 - DNA, 31 bp, Artificial Sequence
  Description of Artificial Sequence: Synthetic oligonucleotide
acccctacgtgtgtcattcgccttaacatgg

SEQ ID NO: 285297 - DNA, 30 bp, Artificial Sequence
  Description of Artificial Sequence: Synthetic oligonucleotide
cccctacgtgtgtcattcgccttaacatgg

SEQ ID NO: 285298 - DNA, 31 bp, Artificial Sequence
  Description of Artificial Sequence: Synthetic oligonucleotide
ccctacgtgtgtcattcgccttaacatggac

SEQ ID NO: 285299 - DNA, 36 bp, Artificial Sequence
  Description of Artificial Sequence: Synthetic oligonucleotide
cctacgtgtgtcattcgccttaacatggacttaaac

SEQ ID NO: 285300 - DNA, 38 bp, Artificial Sequence
  Description of Artificial Sequence: Synthetic oligonucleotide
ctacgtgtgtcattcgccttaacatggacttaaacatg

SEQ ID NO: 285301 - DNA, 38 bp, Artificial Sequence
  Description of Artificial Sequence: Synthetic oligonucleotide
tacgtgtgtcattcgccttaacatggacttaaacatgc

SEQ ID NO: 285302 - DNA, 37 bp, Artificial Sequence
  Description of Artificial Sequence: Synthetic oligonucleotide
acgtgtgtcattcgccttaacatggacttaaacatgc

SEQ ID NO: 285303 - DNA, 36 bp, Artificial Sequence
  Description of Artificial Sequence: Synthetic oligonucleotide
cgtgtgtcattcgccttaacatggacttaaacatgc

SEQ ID NO: 285304 - DNA, 36 bp, Artificial Sequence
  Description of Artificial Sequence: Synthetic oligonucleotide
gtgtgtcattcgccttaacatggacttaaacatgcc

SEQ ID NO: 285305 - DNA, 36 bp, Artificial Sequence
  Description of Artificial Sequence: Synthetic oligonucleotide
tgtgtcattcgccttaacatggacttaaacatgccg

SEQ ID NO: 285306 - DNA, 35 bp, Artificial Sequence
  Description of Artificial Sequence: Synthetic oligonucleotide
gtgtcattcgccttaacatggacttaaacatgccg

SEQ ID NO: 285307 - DNA, 38 bp, Artificial Sequence
  Description of Artificial Sequence: Synthetic oligonucleotide
tgtcattcgccttaacatggacttaaacatgccgaaac

SEQ ID NO: 285308 - DNA, 37 bp, Artificial Sequence
  Description of Artificial Sequence: Synthetic oligonucleotide
gtcattcgccttaacatggacttaaacatgccgaaac

SEQ ID NO: 285309 - DNA, 39 bp, Artificial Sequence
  Description of Artificial Sequence: Synthetic oligonucleotide
tcattcgccttaacatggacttaaacatgccgaaacttc

SEQ ID NO: 285310 - DNA, 38 bp, Artificial Sequence
  Description of Artificial Sequence: Synthetic oligonucleotide
cattcgccttaacatggacttaaacatgccgaaacttc

SEQ ID NO: 285311 - DNA, 39 bp, Artificial Sequence
  Description of Artificial Sequence: Synthetic oligonucleotide
attcgccttaacatggacttaaacatgccgaaacttcag

SEQ ID NO: 285312 - DNA, 38 bp, Artificial Sequence
  Description of Artificial Sequence: Synthetic oligonucleotide
ttcgccttaacatggacttaaacatgccgaaacttcag

SEQ ID NO: 285313 - DNA, 37 bp, Artificial Sequence
  Description of Artificial Sequence: Synthetic oligonucleotide
tcgccttaacatggacttaaacatgccgaaacttcag

SEQ ID NO: 285314 - DNA, 36 bp, Artificial Sequence
  Description of Artificial Sequence: Synthetic oligonucleotide
cgccttaacatggacttaaacatgccgaaacttcag

SEQ ID NO: 285315 - DNA, 43 bp, Artificial Sequence
  Description of Artificial Sequence: Synthetic oligonucleotide
gccttaacatggacttaaacatgccgaaacttcagtatatatc

SEQ ID NO: 285316 - DNA, 43 bp, Artificial Sequence
  Description of Artificial Sequence: Synthetic oligonucleotide
ccttaacatggacttaaacatgccgaaacttcagtatatatcg

SEQ ID NO: 285317 - DNA, 45 bp, Artificial Sequence
  Description of Artificial Sequence: Synthetic oligonucleotide
cttaacatggacttaaacatgccgaaacttcagtatatatcgaac

SEQ ID NO: 285318 - DNA, 46 bp, Artificial Sequence
  Description of Artificial Sequence: Synthetic oligonucleotide
ttaacatggacttaaacatgccgaaacttcagtatatatcgaactg

SEQ ID NO: 285319 - DNA, 45 bp, Artificial Sequence
  Description of Artificial Sequence: Synthetic oligonucleotide
taacatggacttaaacatgccgaaacttcagtatatatcgaactg

SEQ ID NO: 285320 - DNA, 44 bp, Artificial Sequence
  Description of Artificial Sequence: Synthetic oligonucleotide
aacatggacttaaacatgccgaaacttcagtatatatcgaactg

SEQ ID NO: 285321 - DNA, 43 bp, Artificial Sequence
  Description of Artificial Sequence: Synthetic oligonucleotide
acatggacttaaacatgccgaaacttcagtatatatcgaactg

SEQ ID NO: 285322 - DNA, 42 bp, Artificial Sequence
  Description of Artificial Sequence: Synthetic oligonucleotide
catggacttaaacatgccgaaacttcagtatatatcgaactg

SEQ ID NO: 285323 - DNA, 46 bp, Artificial Sequence
  Description of Artificial Sequence: Synthetic oligonucleotide
atggacttaaacatgccgaaacttcagtatatatcgaactgaaaac

SEQ ID NO: 285324 - DNA, 45 bp, Artificial Sequence
  Description of Artificial Sequence: Synthetic oligonucleotide
tggacttaaacatgccgaaacttcagtatatatcgaactgaaaac

SEQ ID NO: 285325 - DNA, 44 bp, Artificial Sequence
  Description of Artificial Sequence: Synthetic oligonucleotide
ggacttaaacatgccgaaacttcagtatatatcgaactgaaaac

SEQ ID NO: 285326 - DNA, 44 bp, Artificial Sequence
  Description of Artificial Sequence: Synthetic oligonucleotide
gacttaaacatgccgaaacttcagtatatatcgaactgaaaacc

SEQ ID NO: 285327 - DNA, 46 bp, Artificial Sequence
  Description of Artificial Sequence: Synthetic oligonucleotide
acttaaacatgccgaaacttcagtatatatcgaactgaaaaccatc

SEQ ID NO: 285328 - DNA, 45 bp, Artificial Sequence
  Description of Artificial Sequence: Synthetic oligonucleotide
cttaaacatgccgaaacttcagtatatatcgaactgaaaaccatc

SEQ ID NO: 285329 - DNA, 45 bp, Artificial Sequence
  Description of Artificial Sequence: Synthetic oligonucleotide
ttaaacatgccgaaacttcagtatatatcgaactgaaaaccatcc

SEQ ID NO: 285330 - DNA, 44 bp, Artificial Sequence
  Description of Artificial Sequence: Synthetic oligonucleotide
taaacatgccgaaacttcagtatatatcgaactgaaaaccatcc

SEQ ID NO: 285331 - DNA, 43 bp, Artificial Sequence
  Description of Artificial Sequence: Synthetic oligonucleotide
aaacatgccgaaacttcagtatatatcgaactgaaaaccatcc

SEQ ID NO: 285332 - DNA, 42 bp, Artificial Sequence
  Description of Artificial Sequence: Synthetic oligonucleotide
aacatgccgaaacttcagtatatatcgaactgaaaaccatcc

SEQ ID NO: 285333 - DNA, 41 bp, Artificial Sequence
  Description of Artificial Sequence: Synthetic oligonucleotide
acatgccgaaacttcagtatatatcgaactgaaaaccatcc

SEQ ID NO: 285334 - DNA, 40 bp, Artificial Sequence
  Description of Artificial Sequence: Synthetic oligonucleotide
catgccgaaacttcagtatatatcgaactgaaaaccatcc

SEQ ID NO: 285335 - DNA, 41 bp, Artificial Sequence
  Description of Artificial Sequence: Synthetic oligonucleotide
atgccgaaacttcagtatatatcgaactgaaaaccatcctc

SEQ ID NO: 285336 - DNA, 40 bp, Artificial Sequence
  Description of Artificial Sequence: Synthetic oligonucleotide
tgccgaaacttcagtatatatcgaactgaaaaccatcctc

SEQ ID NO: 285337 - DNA, 39 bp, Artificial Sequence
  Description of Artificial Sequence: Synthetic oligonucleotide
gccgaaacttcagtatatatcgaactgaaaaccatcctc

SEQ ID NO: 285338 - DNA, 43 bp, Artificial Sequence
  Description of Artificial Sequence: Synthetic oligonucleotide
ccgaaacttcagtatatatcgaactgaaaaccatcctcatttg

SEQ ID NO: 285339 - DNA, 43 bp, Artificial Sequence
  Description of Artificial Sequence: Synthetic oligonucleotide
cgaaacttcagtatatatcgaactgaaaaccatcctcatttgc

SEQ ID NO: 285340 - DNA, 47 bp, Artificial Sequence
  Description of Artificial Sequence: Synthetic oligonucleotide
gaaacttcagtatatatcgaactgaaaaccatcctcatttgcatttc

SEQ ID NO: 285341 - DNA, 47 bp, Artificial Sequence
  Description of Artificial Sequence: Synthetic oligonucleotide
aaacttcagtatatatcgaactgaaaaccatcctcatttgcatttcc

SEQ ID NO: 285342 - DNA, 46 bp, Artificial Sequence
  Description of Artificial Sequence: Synthetic oligonucleotide
aacttcagtatatatcgaactgaaaaccatcctcatttgcatttcc

SEQ ID NO: 285343 - DNA, 45 bp, Artificial Sequence
  Description of Artificial Sequence: Synthetic oligonucleotide
acttcagtatatatcgaactgaaaaccatcctcatttgcatttcc

SEQ ID NO: 285344 - DNA, 44 bp, Artificial Sequence
  Description of Artificial Sequence: Synthetic oligonucleotide
cttcagtatatatcgaactgaaaaccatcctcatttgcatttcc

SEQ ID NO: 285345 - DNA, 45 bp, Artificial Sequence
  Description of Artificial Sequence: Synthetic oligonucleotide
ttcagtatatatcgaactgaaaaccatcctcatttgcatttcctg

SEQ ID NO: 285346 - DNA, 44 bp, Artificial Sequence
  Description of Artificial Sequence: Synthetic oligonucleotide
tcagtatatatcgaactgaaaaccatcctcatttgcatttcctg

SEQ ID NO: 285347 - DNA, 43 bp, Artificial Sequence
  Description of Artificial Sequence: Synthetic oligonucleotide
cagtatatatcgaactgaaaaccatcctcatttgcatttcctg

SEQ ID NO: 285348 - DNA, 43 bp, Artificial Sequence
  Description of Artificial Sequence: Synthetic oligonucleotide
agtatatatcgaactgaaaaccatcctcatttgcatttcctgc

SEQ ID NO: 285349 - DNA, 42 bp, Artificial Sequence
  Description of Artificial Sequence: Synthetic oligonucleotide
gtatatatcgaactgaaaaccatcctcatttgcatttcctgc

SEQ ID NO: 285350 - DNA, 42 bp, Artificial Sequence
  Description of Artificial Sequence: Synthetic oligonucleotide
tatatatcgaactgaaaaccatcctcatttgcatttcctgcc

SEQ ID NO: 285351 - DNA, 41 bp, Artificial Sequence
  Description of Artificial Sequence: Synthetic oligonucleotide
atatatcgaactgaaaaccatcctcatttgcatttcctgcc

SEQ ID NO: 285352 - DNA, 40 bp, Artificial Sequence
  Description of Artificial Sequence: Synthetic oligonucleotide
tatatcgaactgaaaaccatcctcatttgcatttcctgcc

SEQ ID NO: 285353 - DNA, 39 bp, Artificial Sequence
  Description of Artificial Sequence: Synthetic oligonucleotide
atatcgaactgaaaaccatcctcatttgcatttcctgcc

SEQ ID NO: 285354 - DNA, 38 bp, Artificial Sequence
  Description of Artificial Sequence: Synthetic oligonucleotide
tatcgaactgaaaaccatcctcatttgcatttcctgcc

SEQ ID NO: 285355 - DNA, 37 bp, Artificial Sequence
  Description of Artificial Sequence: Synthetic oligonucleotide
atcgaactgaaaaccatcctcatttgcatttcctgcc

SEQ ID NO: 285356 - DNA, 36 bp, Artificial Sequence
  Description of Artificial Sequence: Synthetic oligonucleotide
tcgaactgaaaaccatcctcatttgcatttcctgcc

SEQ ID NO: 285357 - DNA, 35 bp, Artificial Sequence
  Description of Artificial Sequence: Synthetic oligonucleotide
cgaactgaaaaccatcctcatttgcatttcctgcc

SEQ ID NO: 285358 - DNA, 35 bp, Artificial Sequence
  Description of Artificial Sequence: Synthetic oligonucleotide
gaactgaaaaccatcctcatttgcatttcctgccc

SEQ ID NO: 285359 - DNA, 35 bp, Artificial Sequence
  Description of Artificial Sequence: Synthetic oligonucleotide
aactgaaaaccatcctcatttgcatttcctgcccc

SEQ ID NO: 285360 - DNA, 34 bp, Artificial Sequence
  Description of Artificial Sequence: Synthetic oligonucleotide
actgaaaaccatcctcatttgcatttcctgcccc

SEQ ID NO: 285361 - DNA, 33 bp, Artificial Sequence
  Description of Artificial Sequence: Synthetic oligonucleotide
ctgaaaaccatcctcatttgcatttcctgcccc

SEQ ID NO: 285362 - DNA, 34 bp, Artificial Sequence
  Description of Artificial Sequence: Synthetic oligonucleotide
tgaaaaccatcctcatttgcatttcctgccccac

SEQ ID NO: 285363 - DNA, 33 bp, Artificial Sequence
  Description of Artificial Sequence: Synthetic oligonucleotide
gaaaaccatcctcatttgcatttcctgccccac

SEQ ID NO: 285364 - DNA, 34 bp, Artificial Sequence
  Description of Artificial Sequence: Synthetic oligonucleotide
aaaaccatcctcatttgcatttcctgccccactg

SEQ ID NO: 285365 - DNA, 33 bp, Artificial Sequence
  Description of Artificial Sequence: Synthetic oligonucleotide
aaaccatcctcatttgcatttcctgccccactg

SEQ ID NO: 285366 - DNA, 32 bp, Artificial Sequence
  Description of Artificial Sequence: Synthetic oligonucleotide
aaccatcctcatttgcatttcctgccccactg

SEQ ID NO: 285367 - DNA, 31 bp, Artificial Sequence
  Description of Artificial Sequence: Synthetic oligonucleotide
accatcctcatttgcatttcctgccccactg

SEQ ID NO: 285368 - DNA, 30 bp, Artificial Sequence
  Description of Artificial Sequence: Synthetic oligonucleotide
ccatcctcatttgcatttcctgccccactg

SEQ ID NO: 285369 - DNA, 30 bp, Artificial Sequence
  Description of Artificial Sequence: Synthetic oligonucleotide
catcctcatttgcatttcctgccccactgg

SEQ ID NO: 285370 - DNA, 32 bp, Artificial Sequence
  Description of Artificial Sequence: Synthetic oligonucleotide
atcctcatttgcatttcctgccccactggaag

SEQ ID NO: 285371 - DNA, 31 bp, Artificial Sequence
  Description of Artificial Sequence: Synthetic oligonucleotide
tcctcatttgcatttcctgccccactggaag

SEQ ID NO: 285372 - DNA, 30 bp, Artificial Sequence
  Description of Artificial Sequence: Synthetic oligonucleotide
cctcatttgcatttcctgccccactggaag

SEQ ID NO: 285373 - DNA, 32 bp, Artificial Sequence
  Description of Artificial Sequence: Synthetic oligonucleotide
ctcatttgcatttcctgccccactggaagtag

SEQ ID NO: 285374 - DNA, 32 bp, Artificial Sequence
  Description of Artificial Sequence: Synthetic oligonucleotide
tcatttgcatttcctgccccactggaagtagc

SEQ ID NO: 285375 - DNA, 31 bp, Artificial Sequence
  Description of Artificial Sequence: Synthetic oligonucleotide
catttgcatttcctgccccactggaagtagc

SEQ ID NO: 285376 - DNA, 35 bp, Artificial Sequence
  Description of Artificial Sequence: Synthetic oligonucleotide
atttgcatttcctgccccactggaagtagcaaaag

SEQ ID NO: 285377 - DNA, 34 bp, Artificial Sequence
  Description of Artificial Sequence: Synthetic oligonucleotide
tttgcatttcctgccccactggaagtagcaaaag

SEQ ID NO: 285378 - DNA, 33 bp, Artificial Sequence
  Description of Artificial Sequence: Synthetic oligonucleotide
ttgcatttcctgccccactggaagtagcaaaag

SEQ ID NO: 285379 - DNA, 32 bp, Artificial Sequence
  Description of Artificial Sequence: Synthetic oligonucleotide
tgcatttcctgccccactggaagtagcaaaag

SEQ ID NO: 285380 - DNA, 31 bp, Artificial Sequence
  Description of Artificial Sequence: Synthetic oligonucleotide
gcatttcctgccccactggaagtagcaaaag

SEQ ID NO: 285381 - DNA, 36 bp, Artificial Sequence
  Description of Artificial Sequence: Synthetic oligonucleotide
catttcctgccccactggaagtagcaaaagaaatag

SEQ ID NO: 285382 - DNA, 40 bp, Artificial Sequence
  Description of Artificial Sequence: Synthetic oligonucleotide
atttcctgccccactggaagtagcaaaagaaatagaaaag

SEQ ID NO: 285383 - DNA, 39 bp, Artificial Sequence
  Description of Artificial Sequence: Synthetic oligonucleotide
tttcctgccccactggaagtagcaaaagaaatagaaaag

SEQ ID NO: 285384 - DNA, 38 bp, Artificial Sequence
  Description of Artificial Sequence: Synthetic oligonucleotide
ttcctgccccactggaagtagcaaaagaaatagaaaag

SEQ ID NO: 285385 - DNA, 37 bp, Artificial Sequence
  Description of Artificial Sequence: Synthetic oligonucleotide
tcctgccccactggaagtagcaaaagaaatagaaaag

SEQ ID NO: 285386 - DNA, 36 bp, Artificial Sequence
  Description of Artificial Sequence: Synthetic oligonucleotide
cctgccccactggaagtagcaaaagaaatagaaaag

SEQ ID NO: 285387 - DNA, 36 bp, Artificial Sequence
  Description of Artificial Sequence: Synthetic oligonucleotide
ctgccccactggaagtagcaaaagaaatagaaaagg

SEQ ID NO: 285388 - DNA, 40 bp, Artificial Sequence
  Description of Artificial Sequence: Synthetic oligonucleotide
tgccccactggaagtagcaaaagaaatagaaaaggataag

SEQ ID NO: 285389 - DNA, 39 bp, Artificial Sequence
  Description of Artificial Sequence: Synthetic oligonucleotide
gccccactggaagtagcaaaagaaatagaaaaggataag

SEQ ID NO: 285390 - DNA, 39 bp, Artificial Sequence
  Description of Artificial Sequence: Synthetic oligonucleotide
ccccactggaagtagcaaaagaaatagaaaaggataagg

SEQ ID NO: 285391 - DNA, 42 bp, Artificial Sequence
  Description of Artificial Sequence: Synthetic oligonucleotide
cccactggaagtagcaaaagaaatagaaaaggataaggtttc

SEQ ID NO: 285392 - DNA, 44 bp, Artificial Sequence
  Description of Artificial Sequence: Synthetic oligonucleotide
ccactggaagtagcaaaagaaatagaaaaggataaggtttcttc

SEQ ID NO: 285393 - DNA, 45 bp, Artificial Sequence
  Description of Artificial Sequence: Synthetic oligonucleotide
cactggaagtagcaaaagaaatagaaaaggataaggtttcttctg

SEQ ID NO: 285394 - DNA, 45 bp, Artificial Sequence
  Description of Artificial Sequence: Synthetic oligonucleotide
actggaagtagcaaaagaaatagaaaaggataaggtttcttctgc

SEQ ID NO: 285395 - DNA, 44 bp, Artificial Sequence
  Description of Artificial Sequence: Synthetic oligonucleotide
ctggaagtagcaaaagaaatagaaaaggataaggtttcttctgc

SEQ ID NO: 285396 - DNA, 45 bp, Artificial Sequence
  Description of Artificial Sequence: Synthetic oligonucleotide
tggaagtagcaaaagaaatagaaaaggataaggtttcttctgctg

SEQ ID NO: 285397 - DNA, 44 bp, Artificial Sequence
  Description of Artificial Sequence: Synthetic oligonucleotide
ggaagtagcaaaagaaatagaaaaggataaggtttcttctgctg

SEQ ID NO: 285398 - DNA, 50 bp, Artificial Sequence
  Description of Artificial Sequence: Synthetic oligonucleotide
gaagtagcaaaagaaatagaaaaggataaggtttcttctgctgtataatc

SEQ ID NO: 285399 - DNA, 55 bp, Artificial Sequence
  Description of Artificial Sequence: Synthetic oligonucleotide
aagtagcaaaagaaatagaaaaggataaggtttcttctgctgtataatctataac

SEQ ID NO: 285400 - DNA, 54 bp, Artificial Sequence
  Description of Artificial Sequence: Synthetic oligonucleotide
agtagcaaaagaaatagaaaaggataaggtttcttctgctgtataatctataac

SEQ ID NO: 285401 - DNA, 53 bp, Artificial Sequence
  Description of Artificial Sequence: Synthetic oligonucleotide
gtagcaaaagaaatagaaaaggataaggtttcttctgctgtataatctataac

SEQ ID NO: 285402 - DNA, 54 bp, Artificial Sequence
  Description of Artificial Sequence: Synthetic oligonucleotide
tagcaaaagaaatagaaaaggataaggtttcttctgctgtataatctataacag

SEQ ID NO: 285403 - DNA, 53 bp, Artificial Sequence
  Description of Artificial Sequence: Synthetic oligonucleotide
agcaaaagaaatagaaaaggataaggtttcttctgctgtataatctataacag

SEQ ID NO: 285404 - DNA, 52 bp, Artificial Sequence
  Description of Artificial Sequence: Synthetic oligonucleotide
gcaaaagaaatagaaaaggataaggtttcttctgctgtataatctataacag

SEQ ID NO: 285405 - DNA, 52 bp, Artificial Sequence
  Description of Artificial Sequence: Synthetic oligonucleotide
caaaagaaatagaaaaggataaggtttcttctgctgtataatctataacagc

SEQ ID NO: 285406 - DNA, 52 bp, Artificial Sequence
  Description of Artificial Sequence: Synthetic oligonucleotide
aaaagaaatagaaaaggataaggtttcttctgctgtataatctataacagcc

SEQ ID NO: 285407 - DNA, 51 bp, Artificial Sequence
  Description of Artificial Sequence: Synthetic oligonucleotide
aaagaaatagaaaaggataaggtttcttctgctgtataatctataacagcc

SEQ ID NO: 285408 - DNA, 50 bp, Artificial Sequence
  Description of Artificial Sequence: Synthetic oligonucleotide
aagaaatagaaaaggataaggtttcttctgctgtataatctataacagcc

SEQ ID NO: 285409 - DNA, 49 bp, Artificial Sequence
  Description of Artificial Sequence: Synthetic oligonucleotide
agaaatagaaaaggataaggtttcttctgctgtataatctataacagcc

SEQ ID NO: 285410 - DNA, 48 bp, Artificial Sequence
  Description of Artificial Sequence: Synthetic oligonucleotide
gaaatagaaaaggataaggtttcttctgctgtataatctataacagcc

SEQ ID NO: 285411 - DNA, 50 bp, Artificial Sequence
  Description of Artificial Sequence: Synthetic oligonucleotide
aaatagaaaaggataaggtttcttctgctgtataatctataacagccaag

SEQ ID NO: 285412 - DNA, 49 bp, Artificial Sequence
  Description of Artificial Sequence: Synthetic oligonucleotide
aatagaaaaggataaggtttcttctgctgtataatctataacagccaag

SEQ ID NO: 285413 - DNA, 48 bp, Artificial Sequence
  Description of Artificial Sequence: Synthetic oligonucleotide
atagaaaaggataaggtttcttctgctgtataatctataacagccaag

SEQ ID NO: 285414 - DNA, 47 bp, Artificial Sequence
  Description of Artificial Sequence: Synthetic oligonucleotide
tagaaaaggataaggtttcttctgctgtataatctataacagccaag

SEQ ID NO: 285415 - DNA, 46 bp, Artificial Sequence
  Description of Artificial Sequence: Synthetic oligonucleotide
agaaaaggataaggtttcttctgctgtataatctataacagccaag

SEQ ID NO: 285416 - DNA, 45 bp, Artificial Sequence
  Description of Artificial Sequence: Synthetic oligonucleotide
gaaaaggataaggtttcttctgctgtataatctataacagccaag

SEQ ID NO: 285417 - DNA, 45 bp, Artificial Sequence
  Description of Artificial Sequence: Synthetic oligonucleotide
aaaaggataaggtttcttctgctgtataatctataacagccaagg

SEQ ID NO: 285418 - DNA, 44 bp, Artificial Sequence
  Description of Artificial Sequence: Synthetic oligonucleotide
aaaggataaggtttcttctgctgtataatctataacagccaagg

SEQ ID NO: 285419 - DNA, 43 bp, Artificial Sequence
  Description of Artificial Sequence: Synthetic oligonucleotide
aaggataaggtttcttctgctgtataatctataacagccaagg

SEQ ID NO: 285420 - DNA, 42 bp, Artificial Sequence
  Description of Artificial Sequence: Synthetic oligonucleotide
aggataaggtttcttctgctgtataatctataacagccaagg

SEQ ID NO: 285421 - DNA, 41 bp, Artificial Sequence
  Description of Artificial Sequence: Synthetic oligonucleotide
ggataaggtttcttctgctgtataatctataacagccaagg

SEQ ID NO: 285422 - DNA, 41 bp, Artificial Sequence
  Description of Artificial Sequence: Synthetic oligonucleotide
gataaggtttcttctgctgtataatctataacagccaaggc

SEQ ID NO: 285423 - DNA, 47 bp, Artificial Sequence
  Description of Artificial Sequence: Synthetic oligonucleotide
ataaggtttcttctgctgtataatctataacagccaaggcttaaaag

SEQ ID NO: 285424 - DNA, 46 bp, Artificial Sequence
  Description of Artificial Sequence: Synthetic oligonucleotide
taaggtttcttctgctgtataatctataacagccaaggcttaaaag

SEQ ID NO: 285425 - DNA, 45 bp, Artificial Sequence
  Description of Artificial Sequence: Synthetic oligonucleotide
aaggtttcttctgctgtataatctataacagccaaggcttaaaag

SEQ ID NO: 285426 - DNA, 44 bp, Artificial Sequence
  Description of Artificial Sequence: Synthetic oligonucleotide
aggtttcttctgctgtataatctataacagccaaggcttaaaag

SEQ ID NO: 285427 - DNA, 43 bp, Artificial Sequence
  Description of Artificial Sequence: Synthetic oligonucleotide
ggtttcttctgctgtataatctataacagccaaggcttaaaag

SEQ ID NO: 285428 - DNA, 45 bp, Artificial Sequence
  Description of Artificial Sequence: Synthetic oligonucleotide
gtttcttctgctgtataatctataacagccaaggcttaaaagaag

SEQ ID NO: 285429 - DNA, 45 bp, Artificial Sequence
  Description of Artificial Sequence: Synthetic oligonucleotide
tttcttctgctgtataatctataacagccaaggcttaaaagaagg

SEQ ID NO: 285430 - DNA, 44 bp, Artificial Sequence
  Description of Artificial Sequence: Synthetic oligonucleotide
ttcttctgctgtataatctataacagccaaggcttaaaagaagg

SEQ ID NO: 285431 - DNA, 43 bp, Artificial Sequence
  Description of Artificial Sequence: Synthetic oligonucleotide
tcttctgctgtataatctataacagccaaggcttaaaagaagg

SEQ ID NO: 285432 - DNA, 42 bp, Artificial Sequence
  Description of Artificial Sequence: Synthetic oligonucleotide
cttctgctgtataatctataacagccaaggcttaaaagaagg

SEQ ID NO: 285433 - DNA, 47 bp, Artificial Sequence
  Description of Artificial Sequence: Synthetic oligonucleotide
ttctgctgtataatctataacagccaaggcttaaaagaaggtaaaag

SEQ ID NO: 285434 - DNA, 46 bp, Artificial Sequence
  Description of Artificial Sequence: Synthetic oligonucleotide
tctgctgtataatctataacagccaaggcttaaaagaaggtaaaag

SEQ ID NO: 285435 - DNA, 45 bp, Artificial Sequence
  Description of Artificial Sequence: Synthetic oligonucleotide
ctgctgtataatctataacagccaaggcttaaaagaaggtaaaag

SEQ ID NO: 285436 - DNA, 49 bp, Artificial Sequence
  Description of Artificial Sequence: Synthetic oligonucleotide
tgctgtataatctataacagccaaggcttaaaagaaggtaaaagaaaac

SEQ ID NO: 285437 - DNA, 48 bp, Artificial Sequence
  Description of Artificial Sequence: Synthetic oligonucleotide
gctgtataatctataacagccaaggcttaaaagaaggtaaaagaaaac

SEQ ID NO: 285438 - DNA, 48 bp, Artificial Sequence
  Description of Artificial Sequence: Synthetic oligonucleotide
ctgtataatctataacagccaaggcttaaaagaaggtaaaagaaaacg

SEQ ID NO: 285439 - DNA, 55 bp, Artificial Sequence
  Description of Artificial Sequence: Synthetic oligonucleotide
tgtataatctataacagccaaggcttaaaagaaggtaaaagaaaacgaaaaaaag

SEQ ID NO: 285440 - DNA, 54 bp, Artificial Sequence
  Description of Artificial Sequence: Synthetic oligonucleotide
gtataatctataacagccaaggcttaaaagaaggtaaaagaaaacgaaaaaaag

SEQ ID NO: 285441 - DNA, 54 bp, Artificial Sequence
  Description of Artificial Sequence: Synthetic oligonucleotide
tataatctataacagccaaggcttaaaagaaggtaaaagaaaacgaaaaaaagc

SEQ ID NO: 285442 - DNA, 53 bp, Artificial Sequence
  Description of Artificial Sequence: Synthetic oligonucleotide
ataatctataacagccaaggcttaaaagaaggtaaaagaaaacgaaaaaaagc

SEQ ID NO: 285443 - DNA, 52 bp, Artificial Sequence
  Description of Artificial Sequence: Synthetic oligonucleotide
taatctataacagccaaggcttaaaagaaggtaaaagaaaacgaaaaaaagc

SEQ ID NO: 285444 - DNA, 51 bp, Artificial Sequence
  Description of Artificial Sequence: Synthetic oligonucleotide
aatctataacagccaaggcttaaaagaaggtaaaagaaaacgaaaaaaagc

SEQ ID NO: 285445 - DNA, 50 bp, Artificial Sequence
  Description of Artificial Sequence: Synthetic oligonucleotide
atctataacagccaaggcttaaaagaaggtaaaagaaaacgaaaaaaagc

SEQ ID NO: 285446 - DNA, 49 bp, Artificial Sequence
  Description of Artificial Sequence: Synthetic oligonucleotide
tctataacagccaaggcttaaaagaaggtaaaagaaaacgaaaaaaagc

SEQ ID NO: 285447 - DNA, 48 bp, Artificial Sequence
  Description of Artificial Sequence: Synthetic oligonucleotide
ctataacagccaaggcttaaaagaaggtaaaagaaaacgaaaaaaagc

SEQ ID NO: 285448 - DNA, 49 bp, Artificial Sequence
  Description of Artificial Sequence: Synthetic oligonucleotide
tataacagccaaggcttaaaagaaggtaaaagaaaacgaaaaaaagcag

SEQ ID NO: 285449 - DNA, 48 bp, Artificial Sequence
  Description of Artificial Sequence: Synthetic oligonucleotide
ataacagccaaggcttaaaagaaggtaaaagaaaacgaaaaaaagcag

SEQ ID NO: 285450 - DNA, 47 bp, Artificial Sequence
  Description of Artificial Sequence: Synthetic oligonucleotide
taacagccaaggcttaaaagaaggtaaaagaaaacgaaaaaaagcag

SEQ ID NO: 285451 - DNA, 46 bp, Artificial Sequence
  Description of Artificial Sequence: Synthetic oligonucleotide
aacagccaaggcttaaaagaaggtaaaagaaaacgaaaaaaagcag

SEQ ID NO: 285452 - DNA, 45 bp, Artificial Sequence
  Description of Artificial Sequence: Synthetic oligonucleotide
acagccaaggcttaaaagaaggtaaaagaaaacgaaaaaaagcag

SEQ ID NO: 285453 - DNA, 44 bp, Artificial Sequence
  Description of Artificial Sequence: Synthetic oligonucleotide
cagccaaggcttaaaagaaggtaaaagaaaacgaaaaaaagcag

SEQ ID NO: 285454 - DNA, 44 bp, Artificial Sequence
  Description of Artificial Sequence: Synthetic oligonucleotide
agccaaggcttaaaagaaggtaaaagaaaacgaaaaaaagcagg

SEQ ID NO: 285455 - DNA, 43 bp, Artificial Sequence
  Description of Artificial Sequence: Synthetic oligonucleotide
gccaaggcttaaaagaaggtaaaagaaaacgaaaaaaagcagg

SEQ ID NO: 285456 - DNA, 44 bp, Artificial Sequence
  Description of Artificial Sequence: Synthetic oligonucleotide
ccaaggcttaaaagaaggtaaaagaaaacgaaaaaaagcaggag

SEQ ID NO: 285457 - DNA, 44 bp, Artificial Sequence
  Description of Artificial Sequence: Synthetic oligonucleotide
caaggcttaaaagaaggtaaaagaaaacgaaaaaaagcaggagg

SEQ ID NO: 285458 - DNA, 45 bp, Artificial Sequence
  Description of Artificial Sequence: Synthetic oligonucleotide
aaggcttaaaagaaggtaaaagaaaacgaaaaaaagcaggaggag

SEQ ID NO: 285459 - DNA, 44 bp, Artificial Sequence
  Description of Artificial Sequence: Synthetic oligonucleotide
aggcttaaaagaaggtaaaagaaaacgaaaaaaagcaggaggag

SEQ ID NO: 285460 - DNA, 43 bp, Artificial Sequence
  Description of Artificial Sequence: Synthetic oligonucleotide
ggcttaaaagaaggtaaaagaaaacgaaaaaaagcaggaggag

SEQ ID NO: 285461 - DNA, 48 bp, Artificial Sequence
  Description of Artificial Sequence: Synthetic oligonucleotide
gcttaaaagaaggtaaaagaaaacgaaaaaaagcaggaggagataatg

SEQ ID NO: 285462 - DNA, 48 bp, Artificial Sequence
  Description of Artificial Sequence: Synthetic oligonucleotide
cttaaaagaaggtaaaagaaaacgaaaaaaagcaggaggagataatgg

SEQ ID NO: 285463 - DNA, 50 bp, Artificial Sequence
  Description of Artificial Sequence: Synthetic oligonucleotide
ttaaaagaaggtaaaagaaaacgaaaaaaagcaggaggagataatggaag

SEQ ID NO: 285464 - DNA, 49 bp, Artificial Sequence
  Description of Artificial Sequence: Synthetic oligonucleotide
taaaagaaggtaaaagaaaacgaaaaaaagcaggaggagataatggaag

SEQ ID NO: 285465 - DNA, 48 bp, Artificial Sequence
  Description of Artificial Sequence: Synthetic oligonucleotide
aaaagaaggtaaaagaaaacgaaaaaaagcaggaggagataatggaag

SEQ ID NO: 285466 - DNA, 47 bp, Artificial Sequence
  Description of Artificial Sequence: Synthetic oligonucleotide
aaagaaggtaaaagaaaacgaaaaaaagcaggaggagataatggaag

SEQ ID NO: 285467 - DNA, 46 bp, Artificial Sequence
  Description of Artificial Sequence: Synthetic oligonucleotide
aagaaggtaaaagaaaacgaaaaaaagcaggaggagataatggaag

SEQ ID NO: 285468 - DNA, 45 bp, Artificial Sequence
  Description of Artificial Sequence: Synthetic oligonucleotide
agaaggtaaaagaaaacgaaaaaaagcaggaggagataatggaag

SEQ ID NO: 285469 - DNA, 44 bp, Artificial Sequence
  Description of Artificial Sequence: Synthetic oligonucleotide
gaaggtaaaagaaaacgaaaaaaagcaggaggagataatggaag

SEQ ID NO: 285470 - DNA, 45 bp, Artificial Sequence
  Description of Artificial Sequence: Synthetic oligonucleotide
aaggtaaaagaaaacgaaaaaaagcaggaggagataatggaagtc

SEQ ID NO: 285471 - DNA, 44 bp, Artificial Sequence
  Description of Artificial Sequence: Synthetic oligonucleotide
aggtaaaagaaaacgaaaaaaagcaggaggagataatggaagtc

SEQ ID NO: 285472 - DNA, 43 bp, Artificial Sequence
  Description of Artificial Sequence: Synthetic oligonucleotide
ggtaaaagaaaacgaaaaaaagcaggaggagataatggaagtc

SEQ ID NO: 285473 - DNA, 43 bp, Artificial Sequence
  Description of Artificial Sequence: Synthetic oligonucleotide
gtaaaagaaaacgaaaaaaagcaggaggagataatggaagtcg

SEQ ID NO: 285474 - DNA, 45 bp, Artificial Sequence
  Description of Artificial Sequence: Synthetic oligonucleotide
taaaagaaaacgaaaaaaagcaggaggagataatggaagtcgatg

SEQ ID NO: 285475 - DNA, 44 bp, Artificial Sequence
  Description of Artificial Sequence: Synthetic oligonucleotide
aaaagaaaacgaaaaaaagcaggaggagataatggaagtcgatg

SEQ ID NO: 285476 - DNA, 43 bp, Artificial Sequence
  Description of Artificial Sequence: Synthetic oligonucleotide
aaagaaaacgaaaaaaagcaggaggagataatggaagtcgatg

SEQ ID NO: 285477 - DNA, 42 bp, Artificial Sequence
  Description of Artificial Sequence: Synthetic oligonucleotide
aagaaaacgaaaaaaagcaggaggagataatggaagtcgatg

SEQ ID NO: 285478 - DNA, 41 bp, Artificial Sequence
  Description of Artificial Sequence: Synthetic oligonucleotide
agaaaacgaaaaaaagcaggaggagataatggaagtcgatg

SEQ ID NO: 285479 - DNA, 40 bp, Artificial Sequence
  Description of Artificial Sequence: Synthetic oligonucleotide
gaaaacgaaaaaaagcaggaggagataatggaagtcgatg

SEQ ID NO: 285480 - DNA, 41 bp, Artificial Sequence
  Description of Artificial Sequence: Synthetic oligonucleotide
aaaacgaaaaaaagcaggaggagataatggaagtcgatgag

SEQ ID NO: 285481 - DNA, 40 bp, Artificial Sequence
  Description of Artificial Sequence: Synthetic oligonucleotide
aaacgaaaaaaagcaggaggagataatggaagtcgatgag

SEQ ID NO: 285482 - DNA, 39 bp, Artificial Sequence
  Description of Artificial Sequence: Synthetic oligonucleotide
aacgaaaaaaagcaggaggagataatggaagtcgatgag

SEQ ID NO: 285483 - DNA, 38 bp, Artificial Sequence
  Description of Artificial Sequence: Synthetic oligonucleotide
acgaaaaaaagcaggaggagataatggaagtcgatgag

SEQ ID NO: 285484 - DNA, 37 bp, Artificial Sequence
  Description of Artificial Sequence: Synthetic oligonucleotide
cgaaaaaaagcaggaggagataatggaagtcgatgag

SEQ ID NO: 285485 - DNA, 37 bp, Artificial Sequence
  Description of Artificial Sequence: Synthetic oligonucleotide
gaaaaaaagcaggaggagataatggaagtcgatgagg

SEQ ID NO: 285486 - DNA, 37 bp, Artificial Sequence
  Description of Artificial Sequence: Synthetic oligonucleotide
aaaaaaagcaggaggagataatggaagtcgatgaggc

SEQ ID NO: 285487 - DNA, 36 bp, Artificial Sequence
  Description of Artificial Sequence: Synthetic oligonucleotide
aaaaaagcaggaggagataatggaagtcgatgaggc

SEQ ID NO: 285488 - DNA, 35 bp, Artificial Sequence
  Description of Artificial Sequence: Synthetic oligonucleotide
aaaaagcaggaggagataatggaagtcgatgaggc

SEQ ID NO: 285489 - DNA, 34 bp, Artificial Sequence
  Description of Artificial Sequence: Synthetic oligonucleotide
aaaagcaggaggagataatggaagtcgatgaggc

SEQ ID NO: 285490 - DNA, 33 bp, Artificial Sequence
  Description of Artificial Sequence: Synthetic oligonucleotide
aaagcaggaggagataatggaagtcgatgaggc

SEQ ID NO: 285491 - DNA, 32 bp, Artificial Sequence
  Description of Artificial Sequence: Synthetic oligonucleotide
aagcaggaggagataatggaagtcgatgaggc

SEQ ID NO: 285492 - DNA, 31 bp, Artificial Sequence
  Description of Artificial Sequence: Synthetic oligonucleotide
agcaggaggagataatggaagtcgatgaggc

SEQ ID NO: 285493 - DNA, 30 bp, Artificial Sequence
  Description of Artificial Sequence: Synthetic oligonucleotide
gcaggaggagataatggaagtcgatgaggc

SEQ ID NO: 285494 - DNA, 31 bp, Artificial Sequence
  Description of Artificial Sequence: Synthetic oligonucleotide
caggaggagataatggaagtcgatgaggcac

SEQ ID NO: 285495 - DNA, 32 bp, Artificial Sequence
  Description of Artificial Sequence: Synthetic oligonucleotide
aggaggagataatggaagtcgatgaggcacag

SEQ ID NO: 285496 - DNA, 31 bp, Artificial Sequence
  Description of Artificial Sequence: Synthetic oligonucleotide
ggaggagataatggaagtcgatgaggcacag

SEQ ID NO: 285497 - DNA, 36 bp, Artificial Sequence
  Description of Artificial Sequence: Synthetic oligonucleotide
gaggagataatggaagtcgatgaggcacagaaaaag

SEQ ID NO: 285498 - DNA, 36 bp, Artificial Sequence
  Description of Artificial Sequence: Synthetic oligonucleotide
aggagataatggaagtcgatgaggcacagaaaaagg

SEQ ID NO: 285499 - DNA, 35 bp, Artificial Sequence
  Description of Artificial Sequence: Synthetic oligonucleotide
ggagataatggaagtcgatgaggcacagaaaaagg

SEQ ID NO: 285500 - DNA, 36 bp, Artificial Sequence
  Description of Artificial Sequence: Synthetic oligonucleotide
gagataatggaagtcgatgaggcacagaaaaaggtg

SEQ ID NO: 285501 - DNA, 36 bp, Artificial Sequence
  Description of Artificial Sequence: Synthetic oligonucleotide
agataatggaagtcgatgaggcacagaaaaaggtgg

SEQ ID NO: 285502 - DNA, 35 bp, Artificial Sequence
  Description of Artificial Sequence: Synthetic oligonucleotide
gataatggaagtcgatgaggcacagaaaaaggtgg

SEQ ID NO: 285503 - DNA, 40 bp, Artificial Sequence
  Description of Artificial Sequence: Synthetic oligonucleotide
ataatggaagtcgatgaggcacagaaaaaggtggaaaaag

SEQ ID NO: 285504 - DNA, 39 bp, Artificial Sequence
  Description of Artificial Sequence: Synthetic oligonucleotide
taatggaagtcgatgaggcacagaaaaaggtggaaaaag

SEQ ID NO: 285505 - DNA, 38 bp, Artificial Sequence
  Description of Artificial Sequence: Synthetic oligonucleotide
aatggaagtcgatgaggcacagaaaaaggtggaaaaag

SEQ ID NO: 285506 - DNA, 37 bp, Artificial Sequence
  Description of Artificial Sequence: Synthetic oligonucleotide
atggaagtcgatgaggcacagaaaaaggtggaaaaag

SEQ ID NO: 285507 - DNA, 36 bp, Artificial Sequence
  Description of Artificial Sequence: Synthetic oligonucleotide
tggaagtcgatgaggcacagaaaaaggtggaaaaag

SEQ ID NO: 285508 - DNA, 35 bp, Artificial Sequence
  Description of Artificial Sequence: Synthetic oligonucleotide
ggaagtcgatgaggcacagaaaaaggtggaaaaag

SEQ ID NO: 285509 - DNA, 36 bp, Artificial Sequence
  Description of Artificial Sequence: Synthetic oligonucleotide
gaagtcgatgaggcacagaaaaaggtggaaaaagac

SEQ ID NO: 285510 - DNA, 38 bp, Artificial Sequence
  Description of Artificial Sequence: Synthetic oligonucleotide
aagtcgatgaggcacagaaaaaggtggaaaaagacaag

SEQ ID NO: 285511 - DNA, 37 bp, Artificial Sequence
  Description of Artificial Sequence: Synthetic oligonucleotide
agtcgatgaggcacagaaaaaggtggaaaaagacaag

SEQ ID NO: 285512 - DNA, 36 bp, Artificial Sequence
  Description of Artificial Sequence: Synthetic oligonucleotide
gtcgatgaggcacagaaaaaggtggaaaaagacaag

SEQ ID NO: 285513 - DNA, 42 bp, Artificial Sequence
  Description of Artificial Sequence: Synthetic oligonucleotide
tcgatgaggcacagaaaaaggtggaaaaagacaagaaaaaac

SEQ ID NO: 285514 - DNA, 41 bp, Artificial Sequence
  Description of Artificial Sequence: Synthetic oligonucleotide
cgatgaggcacagaaaaaggtggaaaaagacaagaaaaaac

SEQ ID NO: 285515 - DNA, 43 bp, Artificial Sequence
  Description of Artificial Sequence: Synthetic oligonucleotide
gatgaggcacagaaaaaggtggaaaaagacaagaaaaaacaac

SEQ ID NO: 285516 - DNA, 43 bp, Artificial Sequence
  Description of Artificial Sequence: Synthetic oligonucleotide
atgaggcacagaaaaaggtggaaaaagacaagaaaaaacaacc

SEQ ID NO: 285517 - DNA, 42 bp, Artificial Sequence
  Description of Artificial Sequence: Synthetic oligonucleotide
tgaggcacagaaaaaggtggaaaaagacaagaaaaaacaacc

SEQ ID NO: 285518 - DNA, 41 bp, Artificial Sequence
  Description of Artificial Sequence: Synthetic oligonucleotide
gaggcacagaaaaaggtggaaaaagacaagaaaaaacaacc

SEQ ID NO: 285519 - DNA, 42 bp, Artificial Sequence
  Description of Artificial Sequence: Synthetic oligonucleotide
aggcacagaaaaaggtggaaaaagacaagaaaaaacaacctg

SEQ ID NO: 285520 - DNA, 41 bp, Artificial Sequence
  Description of Artificial Sequence: Synthetic oligonucleotide
ggcacagaaaaaggtggaaaaagacaagaaaaaacaacctg

SEQ ID NO: 285521 - DNA, 42 bp, Artificial Sequence
  Description of Artificial Sequence: Synthetic oligonucleotide
gcacagaaaaaggtggaaaaagacaagaaaaaacaacctgag

SEQ ID NO: 285522 - DNA, 42 bp, Artificial Sequence
  Description of Artificial Sequence: Synthetic oligonucleotide
cacagaaaaaggtggaaaaagacaagaaaaaacaacctgagc

SEQ ID NO: 285523 - DNA, 42 bp, Artificial Sequence
  Description of Artificial Sequence: Synthetic oligonucleotide
acagaaaaaggtggaaaaagacaagaaaaaacaacctgagcg

SEQ ID NO: 285524 - DNA, 41 bp, Artificial Sequence
  Description of Artificial Sequence: Synthetic oligonucleotide
cagaaaaaggtggaaaaagacaagaaaaaacaacctgagcg

SEQ ID NO: 285525 - DNA, 44 bp, Artificial Sequence
  Description of Artificial Sequence: Synthetic oligonucleotide
agaaaaaggtggaaaaagacaagaaaaaacaacctgagcgaaac

SEQ ID NO: 285526 - DNA, 43 bp, Artificial Sequence
  Description of Artificial Sequence: Synthetic oligonucleotide
gaaaaaggtggaaaaagacaagaaaaaacaacctgagcgaaac

SEQ ID NO: 285527 - DNA, 45 bp, Artificial Sequence
  Description of Artificial Sequence: Synthetic oligonucleotide
aaaaaggtggaaaaagacaagaaaaaacaacctgagcgaaacttc

SEQ ID NO: 285528 - DNA, 44 bp, Artificial Sequence
  Description of Artificial Sequence: Synthetic oligonucleotide
aaaaggtggaaaaagacaagaaaaaacaacctgagcgaaacttc

SEQ ID NO: 285529 - DNA, 43 bp, Artificial Sequence
  Description of Artificial Sequence: Synthetic oligonucleotide
aaaggtggaaaaagacaagaaaaaacaacctgagcgaaacttc

SEQ ID NO: 285530 - DNA, 42 bp, Artificial Sequence
  Description of Artificial Sequence: Synthetic oligonucleotide
aaggtggaaaaagacaagaaaaaacaacctgagcgaaacttc

SEQ ID NO: 285531 - DNA, 41 bp, Artificial Sequence
  Description of Artificial Sequence: Synthetic oligonucleotide
aggtggaaaaagacaagaaaaaacaacctgagcgaaacttc

SEQ ID NO: 285532 - DNA, 40 bp, Artificial Sequence
  Description of Artificial Sequence: Synthetic oligonucleotide
ggtggaaaaagacaagaaaaaacaacctgagcgaaacttc

SEQ ID NO: 285533 - DNA, 40 bp, Artificial Sequence
  Description of Artificial Sequence: Synthetic oligonucleotide
gtggaaaaagacaagaaaaaacaacctgagcgaaacttcc

SEQ ID NO: 285534 - DNA, 41 bp, Artificial Sequence
  Description of Artificial Sequence: Synthetic oligonucleotide
tggaaaaagacaagaaaaaacaacctgagcgaaacttccac

SEQ ID NO: 285535 - DNA, 40 bp, Artificial Sequence
  Description of Artificial Sequence: Synthetic oligonucleotide
ggaaaaagacaagaaaaaacaacctgagcgaaacttccac

SEQ ID NO: 285536 - DNA, 45 bp, Artificial Sequence
  Description of Artificial Sequence: Synthetic oligonucleotide
gaaaaagacaagaaaaaacaacctgagcgaaacttccacttattg

SEQ ID NO: 285537 - DNA, 45 bp, Artificial Sequence
  Description of Artificial Sequence: Synthetic oligonucleotide
aaaaagacaagaaaaaacaacctgagcgaaacttccacttattgg

SEQ ID NO: 285538 - DNA, 44 bp, Artificial Sequence
  Description of Artificial Sequence: Synthetic oligonucleotide
aaaagacaagaaaaaacaacctgagcgaaacttccacttattgg

SEQ ID NO: 285539 - DNA, 43 bp, Artificial Sequence
  Description of Artificial Sequence: Synthetic oligonucleotide
aaagacaagaaaaaacaacctgagcgaaacttccacttattgg

SEQ ID NO: 285540 - DNA, 42 bp, Artificial Sequence
  Description of Artificial Sequence: Synthetic oligonucleotide
aagacaagaaaaaacaacctgagcgaaacttccacttattgg

SEQ ID NO: 285541 - DNA, 41 bp, Artificial Sequence
  Description of Artificial Sequence: Synthetic oligonucleotide
agacaagaaaaaacaacctgagcgaaacttccacttattgg

SEQ ID NO: 285542 - DNA, 40 bp, Artificial Sequence
  Description of Artificial Sequence: Synthetic oligonucleotide
gacaagaaaaaacaacctgagcgaaacttccacttattgg

SEQ ID NO: 285543 - DNA, 44 bp, Artificial Sequence
  Description of Artificial Sequence: Synthetic oligonucleotide
acaagaaaaaacaacctgagcgaaacttccacttattggattac

SEQ ID NO: 285544 - DNA, 43 bp, Artificial Sequence
  Description of Artificial Sequence: Synthetic oligonucleotide
caagaaaaaacaacctgagcgaaacttccacttattggattac

SEQ ID NO: 285545 - DNA, 43 bp, Artificial Sequence
  Description of Artificial Sequence: Synthetic oligonucleotide
aagaaaaaacaacctgagcgaaacttccacttattggattacc

SEQ ID NO: 285546 - DNA, 42 bp, Artificial Sequence
  Description of Artificial Sequence: Synthetic oligonucleotide
agaaaaaacaacctgagcgaaacttccacttattggattacc

SEQ ID NO: 285547 - DNA, 41 bp, Artificial Sequence
  Description of Artificial Sequence: Synthetic oligonucleotide
gaaaaaacaacctgagcgaaacttccacttattggattacc

SEQ ID NO: 285548 - DNA, 41 bp, Artificial Sequence
  Description of Artificial Sequence: Synthetic oligonucleotide
aaaaaacaacctgagcgaaacttccacttattggattaccc

SEQ ID NO: 285549 - DNA, 40 bp, Artificial Sequence
  Description of Artificial Sequence: Synthetic oligonucleotide
aaaaacaacctgagcgaaacttccacttattggattaccc

SEQ ID NO: 285550 - DNA, 39 bp, Artificial Sequence
  Description of Artificial Sequence: Synthetic oligonucleotide
aaaacaacctgagcgaaacttccacttattggattaccc

SEQ ID NO: 285551 - DNA, 38 bp, Artificial Sequence
  Description of Artificial Sequence: Synthetic oligonucleotide
aaacaacctgagcgaaacttccacttattggattaccc

SEQ ID NO: 285552 - DNA, 37 bp, Artificial Sequence
  Description of Artificial Sequence: Synthetic oligonucleotide
aacaacctgagcgaaacttccacttattggattaccc

SEQ ID NO: 285553 - DNA, 36 bp, Artificial Sequence
  Description of Artificial Sequence: Synthetic oligonucleotide
acaacctgagcgaaacttccacttattggattaccc

SEQ ID NO: 285554 - DNA, 35 bp, Artificial Sequence
  Description of Artificial Sequence: Synthetic oligonucleotide
caacctgagcgaaacttccacttattggattaccc

SEQ ID NO: 285555 - DNA, 36 bp, Artificial Sequence
  Description of Artificial Sequence: Synthetic oligonucleotide
aacctgagcgaaacttccacttattggattacccag

SEQ ID NO: 285556 - DNA, 35 bp, Artificial Sequence
  Description of Artificial Sequence: Synthetic oligonucleotide
acctgagcgaaacttccacttattggattacccag

SEQ ID NO: 285557 - DNA, 34 bp, Artificial Sequence
  Description of Artificial Sequence: Synthetic oligonucleotide
cctgagcgaaacttccacttattggattacccag

SEQ ID NO: 285558 - DNA, 34 bp, Artificial Sequence
  Description of Artificial Sequence: Synthetic oligonucleotide
ctgagcgaaacttccacttattggattacccagc

SEQ ID NO: 285559 - DNA, 34 bp, Artificial Sequence
  Description of Artificial Sequence: Synthetic oligonucleotide
tgagcgaaacttccacttattggattacccagcc

SEQ ID NO: 285560 - DNA, 33 bp, Artificial Sequence
  Description of Artificial Sequence: Synthetic oligonucleotide
gagcgaaacttccacttattggattacccagcc

SEQ ID NO: 285561 - DNA, 33 bp, Artificial Sequence
  Description of Artificial Sequence: Synthetic oligonucleotide
agcgaaacttccacttattggattacccagccc

SEQ ID NO: 285562 - DNA, 32 bp, Artificial Sequence
  Description of Artificial Sequence: Synthetic oligonucleotide
gcgaaacttccacttattggattacccagccc

SEQ ID NO: 285563 - DNA, 32 bp, Artificial Sequence
  Description of Artificial Sequence: Synthetic oligonucleotide
cgaaacttccacttattggattacccagcccc

SEQ ID NO: 285564 - DNA, 33 bp, Artificial Sequence
  Description of Artificial Sequence: Synthetic oligonucleotide
gaaacttccacttattggattacccagccccag

SEQ ID NO: 285565 - DNA, 37 bp, Artificial Sequence
  Description of Artificial Sequence: Synthetic oligonucleotide
aaacttccacttattggattacccagccccagttatg

SEQ ID NO: 285566 - DNA, 36 bp, Artificial Sequence
  Description of Artificial Sequence: Synthetic oligonucleotide
aacttccacttattggattacccagccccagttatg

SEQ ID NO: 285567 - DNA, 35 bp, Artificial Sequence
  Description of Artificial Sequence: Synthetic oligonucleotide
acttccacttattggattacccagccccagttatg

SEQ ID NO: 285568 - DNA, 34 bp, Artificial Sequence
  Description of Artificial Sequence: Synthetic oligonucleotide
cttccacttattggattacccagccccagttatg

SEQ ID NO: 285569 - DNA, 34 bp, Artificial Sequence
  Description of Artificial Sequence: Synthetic oligonucleotide
ttccacttattggattacccagccccagttatgc

SEQ ID NO: 285570 - DNA, 33 bp, Artificial Sequence
  Description of Artificial Sequence: Synthetic oligonucleotide
tccacttattggattacccagccccagttatgc

SEQ ID NO: 285571 - DNA, 32 bp, Artificial Sequence
  Description of Artificial Sequence: Synthetic oligonucleotide
ccacttattggattacccagccccagttatgc

SEQ ID NO: 285572 - DNA, 32 bp, Artificial Sequence
  Description of Artificial Sequence: Synthetic oligonucleotide
cacttattggattacccagccccagttatgcc

SEQ ID NO: 285573 - DNA, 33 bp, Artificial Sequence
  Description of Artificial Sequence: Synthetic oligonucleotide
acttattggattacccagccccagttatgccag

SEQ ID NO: 285574 - DNA, 32 bp, Artificial Sequence
  Description of Artificial Sequence: Synthetic oligonucleotide
cttattggattacccagccccagttatgccag

SEQ ID NO: 285575 - DNA, 32 bp, Artificial Sequence
  Description of Artificial Sequence: Synthetic oligonucleotide
ttattggattacccagccccagttatgccagc

SEQ ID NO: 285576 - DNA, 31 bp, Artificial Sequence
  Description of Artificial Sequence: Synthetic oligonucleotide
tattggattacccagccccagttatgccagc

SEQ ID NO: 285577 - DNA, 30 bp, Artificial Sequence
  Description of Artificial Sequence: Synthetic oligonucleotide
attggattacccagccccagttatgccagc

SEQ ID NO: 285578 - DNA, 29 bp, Artificial Sequence
  Description of Artificial Sequence: Synthetic oligonucleotide
ttggattacccagccccagttatgccagc

SEQ ID NO: 285579 - DNA, 28 bp, Artificial Sequence
  Description of Artificial Sequence: Synthetic oligonucleotide
tggattacccagccccagttatgccagc

SEQ ID NO: 285580 - DNA, 27 bp, Artificial Sequence
  Description of Artificial Sequence: Synthetic oligonucleotide
ggattacccagccccagttatgccagc

SEQ ID NO: 285581 - DNA, 27 bp, Artificial Sequence
  Description of Artificial Sequence: Synthetic oligonucleotide
gattacccagccccagttatgccagcc

SEQ ID NO: 285582 - DNA, 27 bp, Artificial Sequence
  Description of Artificial Sequence: Synthetic oligonucleotide
attacccagccccagttatgccagccc

SEQ ID NO: 285583 - DNA, 27 bp, Artificial Sequence
  Description of Artificial Sequence: Synthetic oligonucleotide
ttacccagccccagttatgccagccca

SEQ ID NO: 285584 - DNA, 26 bp, Artificial Sequence
  Description of Artificial Sequence: Synthetic oligonucleotide
tacccagccccagttatgccagccca

SEQ ID NO: 285585 - DNA, 25 bp, Artificial Sequence
  Description of Artificial Sequence: Synthetic oligonucleotide
acccagccccagttatgccagccca

SEQ ID NO: 285586 - DNA, 24 bp, Artificial Sequence
  Description of Artificial Sequence: Synthetic oligonucleotide
cccagccccagttatgccagccca

SEQ ID NO: 285587 - DNA, 24 bp, Artificial Sequence
  Description of Artificial Sequence: Synthetic oligonucleotide
ccagccccagttatgccagcccag

SEQ ID NO: 285588 - DNA, 27 bp, Artificial Sequence
  Description of Artificial Sequence: Synthetic oligonucleotide
cagccccagttatgccagcccagcttt

SEQ ID NO: 285589 - DNA, 28 bp, Artificial Sequence
  Description of Artificial Sequence: Synthetic oligonucleotide
agccccagttatgccagcccagctttag

SEQ ID NO: 285590 - DNA, 27 bp, Artificial Sequence
  Description of Artificial Sequence: Synthetic oligonucleotide
gccccagttatgccagcccagctttag

SEQ ID NO: 285591 - DNA, 27 bp, Artificial Sequence
  Description of Artificial Sequence: Synthetic oligonucleotide
ccccagttatgccagcccagctttagg

SEQ ID NO: 285592 - DNA, 28 bp, Artificial Sequence
  Description of Artificial Sequence: Synthetic oligonucleotide
cccagttatgccagcccagctttaggtc

SEQ ID NO: 285593 - DNA, 28 bp, Artificial Sequence
  Description of Artificial Sequence: Synthetic oligonucleotide
ccagttatgccagcccagctttaggtcc

SEQ ID NO: 285594 - DNA, 31 bp, Artificial Sequence
  Description of Artificial Sequence: Synthetic oligonucleotide
cagttatgccagcccagctttaggtcctaag

SEQ ID NO: 285595 - DNA, 31 bp, Artificial Sequence
  Description of Artificial Sequence: Synthetic oligonucleotide
agttatgccagcccagctttaggtcctaagc

SEQ ID NO: 285596 - DNA, 30 bp, Artificial Sequence
  Description of Artificial Sequence: Synthetic oligonucleotide
gttatgccagcccagctttaggtcctaagc

SEQ ID NO: 285597 - DNA, 32 bp, Artificial Sequence
  Description of Artificial Sequence: Synthetic oligonucleotide
ttatgccagcccagctttaggtcctaagcatg

SEQ ID NO: 285598 - DNA, 31 bp, Artificial Sequence
  Description of Artificial Sequence: Synthetic oligonucleotide
tatgccagcccagctttaggtcctaagcatg

SEQ ID NO: 285599 - DNA, 30 bp, Artificial Sequence
  Description of Artificial Sequence: Synthetic oligonucleotide
atgccagcccagctttaggtcctaagcatg

SEQ ID NO: 285600 - DNA, 29 bp, Artificial Sequence
  Description of Artificial Sequence: Synthetic oligonucleotide
tgccagcccagctttaggtcctaagcatg

SEQ ID NO: 285601 - DNA, 28 bp, Artificial Sequence
  Description of Artificial Sequence: Synthetic oligonucleotide
gccagcccagctttaggtcctaagcatg

SEQ ID NO: 285602 - DNA, 28 bp, Artificial Sequence
  Description of Artificial Sequence: Synthetic oligonucleotide
ccagcccagctttaggtcctaagcatgc

SEQ ID NO: 285603 - DNA, 28 bp, Artificial Sequence
  Description of Artificial Sequence: Synthetic oligonucleotide
cagcccagctttaggtcctaagcatgcc

SEQ ID NO: 285604 - DNA, 28 bp, Artificial Sequence
  Description of Artificial Sequence: Synthetic oligonucleotide
agcccagctttaggtcctaagcatgccg

SEQ ID NO: 285605 - DNA, 27 bp, Artificial Sequence
  Description of Artificial Sequence: Synthetic oligonucleotide
gcccagctttaggtcctaagcatgccg

SEQ ID NO: 285606 - DNA, 27 bp, Artificial Sequence
  Description of Artificial Sequence: Synthetic oligonucleotide
cccagctttaggtcctaagcatgccgg

SEQ ID NO: 285607 - DNA, 28 bp, Artificial Sequence
  Description of Artificial Sequence: Synthetic oligonucleotide
ccagctttaggtcctaagcatgccggac

SEQ ID NO: 285608 - DNA, 29 bp, Artificial Sequence
  Description of Artificial Sequence: Synthetic oligonucleotide
cagctttaggtcctaagcatgccggacac

SEQ ID NO: 285609 - DNA, 29 bp, Artificial Sequence
  Description of Artificial Sequence: Synthetic oligonucleotide
agctttaggtcctaagcatgccggacacc

SEQ ID NO: 285610 - DNA, 28 bp, Artificial Sequence
  Description of Artificial Sequence: Synthetic oligonucleotide
gctttaggtcctaagcatgccggacacc

SEQ ID NO: 285611 - DNA, 29 bp, Artificial Sequence
  Description of Artificial Sequence: Synthetic oligonucleotide
ctttaggtcctaagcatgccggacacctg

SEQ ID NO: 285612 - DNA, 31 bp, Artificial Sequence
  Description of Artificial Sequence: Synthetic oligonucleotide
tttaggtcctaagcatgccggacacctgtag

SEQ ID NO: 285613 - DNA, 30 bp, Artificial Sequence
  Description of Artificial Sequence: Synthetic oligonucleotide
ttaggtcctaagcatgccggacacctgtag

SEQ ID NO: 285614 - DNA, 29 bp, Artificial Sequence
  Description of Artificial Sequence: Synthetic oligonucleotide
taggtcctaagcatgccggacacctgtag

SEQ ID NO: 285615 - DNA, 28 bp, Artificial Sequence
  Description of Artificial Sequence: Synthetic oligonucleotide
aggtcctaagcatgccggacacctgtag

SEQ ID NO: 285616 - DNA, 27 bp, Artificial Sequence
  Description of Artificial Sequence: Synthetic oligonucleotide
ggtcctaagcatgccggacacctgtag

SEQ ID NO: 285617 - DNA, 30 bp, Artificial Sequence
  Description of Artificial Sequence: Synthetic oligonucleotide
gtcctaagcatgccggacacctgtagaaac

SEQ ID NO: 285618 - DNA, 30 bp, Artificial Sequence
  Description of Artificial Sequence: Synthetic oligonucleotide
tcctaagcatgccggacacctgtagaaacc

SEQ ID NO: 285619 - DNA, 29 bp, Artificial Sequence
  Description of Artificial Sequence: Synthetic oligonucleotide
cctaagcatgccggacacctgtagaaacc

SEQ ID NO: 285620 - DNA, 30 bp, Artificial Sequence
  Description of Artificial Sequence: Synthetic oligonucleotide
ctaagcatgccggacacctgtagaaaccag

SEQ ID NO: 285621 - DNA, 30 bp, Artificial Sequence
  Description of Artificial Sequence: Synthetic oligonucleotide
taagcatgccggacacctgtagaaaccagc

SEQ ID NO: 285622 - DNA, 29 bp, Artificial Sequence
  Description of Artificial Sequence: Synthetic oligonucleotide
aagcatgccggacacctgtagaaaccagc

SEQ ID NO: 285623 - DNA, 28 bp, Artificial Sequence
  Description of Artificial Sequence: Synthetic oligonucleotide
agcatgccggacacctgtagaaaccagc

SEQ ID NO: 285624 - DNA, 27 bp, Artificial Sequence
  Description of Artificial Sequence: Synthetic oligonucleotide
gcatgccggacacctgtagaaaccagc

SEQ ID NO: 285625 - DNA, 27 bp, Artificial Sequence
  Description of Artificial Sequence: Synthetic oligonucleotide
catgccggacacctgtagaaaccagcc

SEQ ID NO: 285626 - DNA, 30 bp, Artificial Sequence
  Description of Artificial Sequence: Synthetic oligonucleotide
atgccggacacctgtagaaaccagccttac

SEQ ID NO: 285627 - DNA, 29 bp, Artificial Sequence
  Description of Artificial Sequence: Synthetic oligonucleotide
tgccggacacctgtagaaaccagccttac

SEQ ID NO: 285628 - DNA, 28 bp, Artificial Sequence
  Description of Artificial Sequence: Synthetic oligonucleotide
gccggacacctgtagaaaccagccttac

SEQ ID NO: 285629 - DNA, 31 bp, Artificial Sequence
  Description of Artificial Sequence: Synthetic oligonucleotide
ccggacacctgtagaaaccagccttacaaac

SEQ ID NO: 285630 - DNA, 31 bp, Artificial Sequence
  Description of Artificial Sequence: Synthetic oligonucleotide
cggacacctgtagaaaccagccttacaaacc

SEQ ID NO: 285631 - DNA, 32 bp, Artificial Sequence
  Description of Artificial Sequence: Synthetic oligonucleotide
ggacacctgtagaaaccagccttacaaaccac

SEQ ID NO: 285632 - DNA, 33 bp, Artificial Sequence
  Description of Artificial Sequence: Synthetic oligonucleotide
gacacctgtagaaaccagccttacaaaccactg

SEQ ID NO: 285633 - DNA, 34 bp, Artificial Sequence
  Description of Artificial Sequence: Synthetic oligonucleotide
acacctgtagaaaccagccttacaaaccactgtc

SEQ ID NO: 285634 - DNA, 33 bp, Artificial Sequence
  Description of Artificial Sequence: Synthetic oligonucleotide
cacctgtagaaaccagccttacaaaccactgtc

SEQ ID NO: 285635 - DNA, 37 bp, Artificial Sequence
  Description of Artificial Sequence: Synthetic oligonucleotide
acctgtagaaaccagccttacaaaccactgtctattg

SEQ ID NO: 285636 - DNA, 36 bp, Artificial Sequence
  Description of Artificial Sequence: Synthetic oligonucleotide
cctgtagaaaccagccttacaaaccactgtctattg

SEQ ID NO: 285637 - DNA, 36 bp, Artificial Sequence
  Description of Artificial Sequence: Synthetic oligonucleotide
ctgtagaaaccagccttacaaaccactgtctattgg

SEQ ID NO: 285638 - DNA, 37 bp, Artificial Sequence
  Description of Artificial Sequence: Synthetic oligonucleotide
tgtagaaaccagccttacaaaccactgtctattggac

SEQ ID NO: 285639 - DNA, 36 bp, Artificial Sequence
  Description of Artificial Sequence: Synthetic oligonucleotide
gtagaaaccagccttacaaaccactgtctattggac

SEQ ID NO: 285640 - DNA, 36 bp, Artificial Sequence
  Description of Artificial Sequence: Synthetic oligonucleotide
tagaaaccagccttacaaaccactgtctattggacg

SEQ ID NO: 285641 - DNA, 35 bp, Artificial Sequence
  Description of Artificial Sequence: Synthetic oligonucleotide
agaaaccagccttacaaaccactgtctattggacg

SEQ ID NO: 285642 - DNA, 34 bp, Artificial Sequence
  Description of Artificial Sequence: Synthetic oligonucleotide
gaaaccagccttacaaaccactgtctattggacg

SEQ ID NO: 285643 - DNA, 34 bp, Artificial Sequence
  Description of Artificial Sequence: Synthetic oligonucleotide
aaaccagccttacaaaccactgtctattggacgc

SEQ ID NO: 285644 - DNA, 33 bp, Artificial Sequence
  Description of Artificial Sequence: Synthetic oligonucleotide
aaccagccttacaaaccactgtctattggacgc

SEQ ID NO: 285645 - DNA, 32 bp, Artificial Sequence
  Description of Artificial Sequence: Synthetic oligonucleotide
accagccttacaaaccactgtctattggacgc

SEQ ID NO: 285646 - DNA, 31 bp, Artificial Sequence
  Description of Artificial Sequence: Synthetic oligonucleotide
ccagccttacaaaccactgtctattggacgc

SEQ ID NO: 285647 - DNA, 33 bp, Artificial Sequence
  Description of Artificial Sequence: Synthetic oligonucleotide
cagccttacaaaccactgtctattggacgcatc

SEQ ID NO: 285648 - DNA, 35 bp, Artificial Sequence
  Description of Artificial Sequence: Synthetic oligonucleotide
agccttacaaaccactgtctattggacgcatcatc

SEQ ID NO: 285649 - DNA, 34 bp, Artificial Sequence
  Description of Artificial Sequence: Synthetic oligonucleotide
gccttacaaaccactgtctattggacgcatcatc

SEQ ID NO: 285650 - DNA, 37 bp, Artificial Sequence
  Description of Artificial Sequence: Synthetic oligonucleotide
ccttacaaaccactgtctattggacgcatcatcaatc

SEQ ID NO: 285651 - DNA, 38 bp, Artificial Sequence
  Description of Artificial Sequence: Synthetic oligonucleotide
cttacaaaccactgtctattggacgcatcatcaatctg

SEQ ID NO: 285652 - DNA, 40 bp, Artificial Sequence
  Description of Artificial Sequence: Synthetic oligonucleotide
ttacaaaccactgtctattggacgcatcatcaatctgaag

SEQ ID NO: 285653 - DNA, 39 bp, Artificial Sequence
  Description of Artificial Sequence: Synthetic oligonucleotide
tacaaaccactgtctattggacgcatcatcaatctgaag

SEQ ID NO: 285654 - DNA, 38 bp, Artificial Sequence
  Description of Artificial Sequence: Synthetic oligonucleotide
acaaaccactgtctattggacgcatcatcaatctgaag

SEQ ID NO: 285655 - DNA, 37 bp, Artificial Sequence
  Description of Artificial Sequence: Synthetic oligonucleotide
caaaccactgtctattggacgcatcatcaatctgaag

SEQ ID NO: 285656 - DNA, 37 bp, Artificial Sequence
  Description of Artificial Sequence: Synthetic oligonucleotide
aaaccactgtctattggacgcatcatcaatctgaagg

SEQ ID NO: 285657 - DNA, 36 bp, Artificial Sequence
  Description of Artificial Sequence: Synthetic oligonucleotide
aaccactgtctattggacgcatcatcaatctgaagg

SEQ ID NO: 285658 - DNA, 35 bp, Artificial Sequence
  Description of Artificial Sequence: Synthetic oligonucleotide
accactgtctattggacgcatcatcaatctgaagg

SEQ ID NO: 285659 - DNA, 34 bp, Artificial Sequence
  Description of Artificial Sequence: Synthetic oligonucleotide
ccactgtctattggacgcatcatcaatctgaagg

SEQ ID NO: 285660 - DNA, 37 bp, Artificial Sequence
  Description of Artificial Sequence: Synthetic oligonucleotide
cactgtctattggacgcatcatcaatctgaaggaaac

SEQ ID NO: 285661 - DNA, 37 bp, Artificial Sequence
  Description of Artificial Sequence: Synthetic oligonucleotide
actgtctattggacgcatcatcaatctgaaggaaacc

SEQ ID NO: 285662 - DNA, 36 bp, Artificial Sequence
  Description of Artificial Sequence: Synthetic oligonucleotide
ctgtctattggacgcatcatcaatctgaaggaaacc

SEQ ID NO: 285663 - DNA, 37 bp, Artificial Sequence
  Description of Artificial Sequence: Synthetic oligonucleotide
tgtctattggacgcatcatcaatctgaaggaaaccag

SEQ ID NO: 285664 - DNA, 36 bp, Artificial Sequence
  Description of Artificial Sequence: Synthetic oligonucleotide
gtctattggacgcatcatcaatctgaaggaaaccag

SEQ ID NO: 285665 - DNA, 37 bp, Artificial Sequence
  Description of Artificial Sequence: Synthetic oligonucleotide
tctattggacgcatcatcaatctgaaggaaaccagtg

SEQ ID NO: 285666 - DNA, 36 bp, Artificial Sequence
  Description of Artificial Sequence: Synthetic oligonucleotide
ctattggacgcatcatcaatctgaaggaaaccagtg

SEQ ID NO: 285667 - DNA, 38 bp, Artificial Sequence
  Description of Artificial Sequence: Synthetic oligonucleotide
tattggacgcatcatcaatctgaaggaaaccagtgaac

SEQ ID NO: 285668 - DNA, 37 bp, Artificial Sequence
  Description of Artificial Sequence: Synthetic oligonucleotide
attggacgcatcatcaatctgaaggaaaccagtgaac

SEQ ID NO: 285669 - DNA, 36 bp, Artificial Sequence
  Description of Artificial Sequence: Synthetic oligonucleotide
ttggacgcatcatcaatctgaaggaaaccagtgaac

SEQ ID NO: 285670 - DNA, 35 bp, Artificial Sequence
  Description of Artificial Sequence: Synthetic oligonucleotide
tggacgcatcatcaatctgaaggaaaccagtgaac

SEQ ID NO: 285671 - DNA, 34 bp, Artificial Sequence
  Description of Artificial Sequence: Synthetic oligonucleotide
ggacgcatcatcaatctgaaggaaaccagtgaac

SEQ ID NO: 285672 - DNA, 35 bp, Artificial Sequence
  Description of Artificial Sequence: Synthetic oligonucleotide
gacgcatcatcaatctgaaggaaaccagtgaacac

SEQ ID NO: 285673 - DNA, 38 bp, Artificial Sequence
  Description of Artificial Sequence: Synthetic oligonucleotide
acgcatcatcaatctgaaggaaaccagtgaacacattg

SEQ ID NO: 285674 - DNA, 37 bp, Artificial Sequence
  Description of Artificial Sequence: Synthetic oligonucleotide
cgcatcatcaatctgaaggaaaccagtgaacacattg

SEQ ID NO: 285675 - DNA, 38 bp, Artificial Sequence
  Description of Artificial Sequence: Synthetic oligonucleotide
gcatcatcaatctgaaggaaaccagtgaacacattgag

SEQ ID NO: 285676 - DNA, 38 bp, Artificial Sequence
  Description of Artificial Sequence: Synthetic oligonucleotide
catcatcaatctgaaggaaaccagtgaacacattgagg

SEQ ID NO: 285677 - DNA, 39 bp, Artificial Sequence
  Description of Artificial Sequence: Synthetic oligonucleotide
atcatcaatctgaaggaaaccagtgaacacattgaggtg

SEQ ID NO: 285678 - DNA, 38 bp, Artificial Sequence
  Description of Artificial Sequence: Synthetic oligonucleotide
tcatcaatctgaaggaaaccagtgaacacattgaggtg

SEQ ID NO: 285679 - DNA, 37 bp, Artificial Sequence
  Description of Artificial Sequence: Synthetic oligonucleotide
catcaatctgaaggaaaccagtgaacacattgaggtg

SEQ ID NO: 285680 - DNA, 37 bp, Artificial Sequence
  Description of Artificial Sequence: Synthetic oligonucleotide
atcaatctgaaggaaaccagtgaacacattgaggtgc

SEQ ID NO: 285681 - DNA, 36 bp, Artificial Sequence
  Description of Artificial Sequence: Synthetic oligonucleotide
tcaatctgaaggaaaccagtgaacacattgaggtgc

SEQ ID NO: 285682 - DNA, 35 bp, Artificial Sequence
  Description of Artificial Sequence: Synthetic oligonucleotide
caatctgaaggaaaccagtgaacacattgaggtgc

SEQ ID NO: 285683 - DNA, 36 bp, Artificial Sequence
  Description of Artificial Sequence: Synthetic oligonucleotide
aatctgaaggaaaccagtgaacacattgaggtgctg

SEQ ID NO: 285684 - DNA, 35 bp, Artificial Sequence
  Description of Artificial Sequence: Synthetic oligonucleotide
atctgaaggaaaccagtgaacacattgaggtgctg

SEQ ID NO: 285685 - DNA, 34 bp, Artificial Sequence
  Description of Artificial Sequence: Synthetic oligonucleotide
tctgaaggaaaccagtgaacacattgaggtgctg

SEQ ID NO: 285686 - DNA, 33 bp, Artificial Sequence
  Description of Artificial Sequence: Synthetic oligonucleotide
ctgaaggaaaccagtgaacacattgaggtgctg

SEQ ID NO: 285687 - DNA, 33 bp, Artificial Sequence
  Description of Artificial Sequence: Synthetic oligonucleotide
tgaaggaaaccagtgaacacattgaggtgctgg

SEQ ID NO: 285688 - DNA, 32 bp, Artificial Sequence
  Description of Artificial Sequence: Synthetic oligonucleotide
gaaggaaaccagtgaacacattgaggtgctgg

SEQ ID NO: 285689 - DNA, 33 bp, Artificial Sequence
  Description of Artificial Sequence: Synthetic oligonucleotide
aaggaaaccagtgaacacattgaggtgctggtg

SEQ ID NO: 285690 - DNA, 32 bp, Artificial Sequence
  Description of Artificial Sequence: Synthetic oligonucleotide
aggaaaccagtgaacacattgaggtgctggtg

SEQ ID NO: 285691 - DNA, 31 bp, Artificial Sequence
  Description of Artificial Sequence: Synthetic oligonucleotide
ggaaaccagtgaacacattgaggtgctggtg

SEQ ID NO: 285692 - DNA, 31 bp, Artificial Sequence
  Description of Artificial Sequence: Synthetic oligonucleotide
gaaaccagtgaacacattgaggtgctggtgg

SEQ ID NO: 285693 - DNA, 33 bp, Artificial Sequence
  Description of Artificial Sequence: Synthetic oligonucleotide
aaaccagtgaacacattgaggtgctggtggatc

SEQ ID NO: 285694 - DNA, 32 bp, Artificial Sequence
  Description of Artificial Sequence: Synthetic oligonucleotide
aaccagtgaacacattgaggtgctggtggatc

SEQ ID NO: 285695 - DNA, 31 bp, Artificial Sequence
  Description of Artificial Sequence: Synthetic oligonucleotide
accagtgaacacattgaggtgctggtggatc

SEQ ID NO: 285696 - DNA, 30 bp, Artificial Sequence
  Description of Artificial Sequence: Synthetic oligonucleotide
ccagtgaacacattgaggtgctggtggatc

SEQ ID NO: 285697 - DNA, 30 bp, Artificial Sequence
  Description of Artificial Sequence: Synthetic oligonucleotide
cagtgaacacattgaggtgctggtggatcc

SEQ ID NO: 285698 - DNA, 31 bp, Artificial Sequence
  Description of Artificial Sequence: Synthetic oligonucleotide
agtgaacacattgaggtgctggtggatcctg

SEQ ID NO: 285699 - DNA, 30 bp, Artificial Sequence
  Description of Artificial Sequence: Synthetic oligonucleotide
gtgaacacattgaggtgctggtggatcctg

SEQ ID NO: 285700 - DNA, 31 bp, Artificial Sequence
  Description of Artificial Sequence: Synthetic oligonucleotide
tgaacacattgaggtgctggtggatcctgtg

SEQ ID NO: 285701 - DNA, 30 bp, Artificial Sequence
  Description of Artificial Sequence: Synthetic oligonucleotide
gaacacattgaggtgctggtggatcctgtg

SEQ ID NO: 285702 - DNA, 30 bp, Artificial Sequence
  Description of Artificial Sequence: Synthetic oligonucleotide
aacacattgaggtgctggtggatcctgtgg

SEQ ID NO: 285703 - DNA, 29 bp, Artificial Sequence
  Description of Artificial Sequence: Synthetic oligonucleotide
acacattgaggtgctggtggatcctgtgg

SEQ ID NO: 285704 - DNA, 28 bp, Artificial Sequence
  Description of Artificial Sequence: Synthetic oligonucleotide
cacattgaggtgctggtggatcctgtgg

SEQ ID NO: 285705 - DNA, 28 bp, Artificial Sequence
  Description of Artificial Sequence: Synthetic oligonucleotide
acattgaggtgctggtggatcctgtggc

SEQ ID NO: 285706 - DNA, 27 bp, Artificial Sequence
  Description of Artificial Sequence: Synthetic oligonucleotide
cattgaggtgctggtggatcctgtggc

SEQ ID NO: 285707 - DNA, 28 bp, Artificial Sequence
  Description of Artificial Sequence: Synthetic oligonucleotide
attgaggtgctggtggatcctgtggcac

SEQ ID NO: 285708 - DNA, 27 bp, Artificial Sequence
  Description of Artificial Sequence: Synthetic oligonucleotide
ttgaggtgctggtggatcctgtggcac

SEQ ID NO: 285709 - DNA, 26 bp, Artificial Sequence
  Description of Artificial Sequence: Synthetic oligonucleotide
tgaggtgctggtggatcctgtggcac

SEQ ID NO: 285710 - DNA, 25 bp, Artificial Sequence
  Description of Artificial Sequence: Synthetic oligonucleotide
gaggtgctggtggatcctgtggcac

SEQ ID NO: 285711 - DNA, 26 bp, Artificial Sequence
  Description of Artificial Sequence: Synthetic oligonucleotide
aggtgctggtggatcctgtggcacca

SEQ ID NO: 285712 - DNA, 25 bp, Artificial Sequence
  Description of Artificial Sequence: Synthetic oligonucleotide
ggtgctggtggatcctgtggcacca

SEQ ID NO: 285713 - DNA, 27 bp, Artificial Sequence
  Description of Artificial Sequence: Synthetic oligonucleotide
gtgctggtggatcctgtggcaccacat

SEQ ID NO: 285714 - DNA, 27 bp, Artificial Sequence
  Description of Artificial Sequence: Synthetic oligonucleotide
tgctggtggatcctgtggcaccacatg

SEQ ID NO: 285715 - DNA, 26 bp, Artificial Sequence
  Description of Artificial Sequence: Synthetic oligonucleotide
gctggtggatcctgtggcaccacatg

SEQ ID NO: 285716 - DNA, 26 bp, Artificial Sequence
  Description of Artificial Sequence: Synthetic oligonucleotide
ctggtggatcctgtggcaccacatgg

SEQ ID NO: 285717 - DNA, 26 bp, Artificial Sequence
  Description of Artificial Sequence: Synthetic oligonucleotide
tggtggatcctgtggcaccacatggc

SEQ ID NO: 285718 - DNA, 25 bp, Artificial Sequence
  Description of Artificial Sequence: Synthetic oligonucleotide
ggtggatcctgtggcaccacatggc

SEQ ID NO: 285719 - DNA, 25 bp, Artificial Sequence
  Description of Artificial Sequence: Synthetic oligonucleotide
gtggatcctgtggcaccacatggcc

SEQ ID NO: 285720 - DNA, 27 bp, Artificial Sequence
  Description of Artificial Sequence: Synthetic oligonucleotide
tggatcctgtggcaccacatggccgaa

SEQ ID NO: 285721 - DNA, 27 bp, Artificial Sequence
  Description of Artificial Sequence: Synthetic oligonucleotide
ggatcctgtggcaccacatggccgaaa

SEQ ID NO: 285722 - DNA, 30 bp, Artificial Sequence
  Description of Artificial Sequence: Synthetic oligonucleotide
gatcctgtggcaccacatggccgaaaaatc

SEQ ID NO: 285723 - DNA, 30 bp, Artificial Sequence
  Description of Artificial Sequence: Synthetic oligonucleotide
atcctgtggcaccacatggccgaaaaatcg

SEQ ID NO: 285724 - DNA, 29 bp, Artificial Sequence
  Description of Artificial Sequence: Synthetic oligonucleotide
tcctgtggcaccacatggccgaaaaatcg

SEQ ID NO: 285725 - DNA, 28 bp, Artificial Sequence
  Description of Artificial Sequence: Synthetic oligonucleotide
cctgtggcaccacatggccgaaaaatcg

SEQ ID NO: 285726 - DNA, 29 bp, Artificial Sequence
  Description of Artificial Sequence: Synthetic oligonucleotide
ctgtggcaccacatggccgaaaaatcgac

SEQ ID NO: 285727 - DNA, 29 bp, Artificial Sequence
  Description of Artificial Sequence: Synthetic oligonucleotide
tgtggcaccacatggccgaaaaatcgacg

SEQ ID NO: 285728 - DNA, 28 bp, Artificial Sequence
  Description of Artificial Sequence: Synthetic oligonucleotide
gtggcaccacatggccgaaaaatcgacg

SEQ ID NO: 285729 - DNA, 29 bp, Artificial Sequence
  Description of Artificial Sequence: Synthetic oligonucleotide
tggcaccacatggccgaaaaatcgacgag

SEQ ID NO: 285730 - DNA, 28 bp, Artificial Sequence
  Description of Artificial Sequence: Synthetic oligonucleotide
ggcaccacatggccgaaaaatcgacgag

SEQ ID NO: 285731 - DNA, 28 bp, Artificial Sequence
  Description of Artificial Sequence: Synthetic oligonucleotide
gcaccacatggccgaaaaatcgacgagg

SEQ ID NO: 285732 - DNA, 29 bp, Artificial Sequence
  Description of Artificial Sequence: Synthetic oligonucleotide
caccacatggccgaaaaatcgacgaggag

SEQ ID NO: 285733 - DNA, 29 bp, Artificial Sequence
  Description of Artificial Sequence: Synthetic oligonucleotide
accacatggccgaaaaatcgacgaggagg

SEQ ID NO: 285734 - DNA, 28 bp, Artificial Sequence
  Description of Artificial Sequence: Synthetic oligonucleotide
ccacatggccgaaaaatcgacgaggagg

SEQ ID NO: 285735 - DNA, 30 bp, Artificial Sequence
  Description of Artificial Sequence: Synthetic oligonucleotide
cacatggccgaaaaatcgacgaggaggaag

SEQ ID NO: 285736 - DNA, 32 bp, Artificial Sequence
  Description of Artificial Sequence: Synthetic oligonucleotide
acatggccgaaaaatcgacgaggaggaagaag

SEQ ID NO: 285737 - DNA, 31 bp, Artificial Sequence
  Description of Artificial Sequence: Synthetic oligonucleotide
catggccgaaaaatcgacgaggaggaagaag

SEQ ID NO: 285738 - DNA, 32 bp, Artificial Sequence
  Description of Artificial Sequence: Synthetic oligonucleotide
atggccgaaaaatcgacgaggaggaagaagag

SEQ ID NO: 285739 - DNA, 31 bp, Artificial Sequence
  Description of Artificial Sequence: Synthetic oligonucleotide
tggccgaaaaatcgacgaggaggaagaagag

SEQ ID NO: 285740 - DNA, 30 bp, Artificial Sequence
  Description of Artificial Sequence: Synthetic oligonucleotide
ggccgaaaaatcgacgaggaggaagaagag

SEQ ID NO: 285741 - DNA, 30 bp, Artificial Sequence
  Description of Artificial Sequence: Synthetic oligonucleotide
gccgaaaaatcgacgaggaggaagaagagc

SEQ ID NO: 285742 - DNA, 30 bp, Artificial Sequence
  Description of Artificial Sequence: Synthetic oligonucleotide
ccgaaaaatcgacgaggaggaagaagagcc

SEQ ID NO: 285743 - DNA, 31 bp, Artificial Sequence
  Description of Artificial Sequence: Synthetic oligonucleotide
cgaaaaatcgacgaggaggaagaagagccag

SEQ ID NO: 285744 - DNA, 33 bp, Artificial Sequence
  Description of Artificial Sequence: Synthetic oligonucleotide
gaaaaatcgacgaggaggaagaagagccagtac

SEQ ID NO: 285745 - DNA, 33 bp, Artificial Sequence
  Description of Artificial Sequence: Synthetic oligonucleotide
aaaaatcgacgaggaggaagaagagccagtacc

SEQ ID NO: 285746 - DNA, 32 bp, Artificial Sequence
  Description of Artificial Sequence: Synthetic oligonucleotide
aaaatcgacgaggaggaagaagagccagtacc

SEQ ID NO: 285747 - DNA, 31 bp, Artificial Sequence
  Description of Artificial Sequence: Synthetic oligonucleotide
aaatcgacgaggaggaagaagagccagtacc

SEQ ID NO: 285748 - DNA, 30 bp, Artificial Sequence
  Description of Artificial Sequence: Synthetic oligonucleotide
aatcgacgaggaggaagaagagccagtacc

SEQ ID NO: 285749 - DNA, 29 bp, Artificial Sequence
  Description of Artificial Sequence: Synthetic oligonucleotide
atcgacgaggaggaagaagagccagtacc

SEQ ID NO: 285750 - DNA, 28 bp, Artificial Sequence
  Description of Artificial Sequence: Synthetic oligonucleotide
tcgacgaggaggaagaagagccagtacc

SEQ ID NO: 285751 - DNA, 27 bp, Artificial Sequence
  Description of Artificial Sequence: Synthetic oligonucleotide
cgacgaggaggaagaagagccagtacc

SEQ ID NO: 285752 - DNA, 27 bp, Artificial Sequence
  Description of Artificial Sequence: Synthetic oligonucleotide
gacgaggaggaagaagagccagtaccc

SEQ ID NO: 285753 - DNA, 27 bp, Artificial Sequence
  Description of Artificial Sequence: Synthetic oligonucleotide
acgaggaggaagaagagccagtacccc

SEQ ID NO: 285754 - DNA, 26 bp, Artificial Sequence
  Description of Artificial Sequence: Synthetic oligonucleotide
cgaggaggaagaagagccagtacccc

SEQ ID NO: 285755 - DNA, 27 bp, Artificial Sequence
  Description of Artificial Sequence: Synthetic oligonucleotide
gaggaggaagaagagccagtaccccca

SEQ ID NO: 285756 - DNA, 27 bp, Artificial Sequence
  Description of Artificial Sequence: Synthetic oligonucleotide
aggaggaagaagagccagtacccccag

SEQ ID NO: 285757 - DNA, 27 bp, Artificial Sequence
  Description of Artificial Sequence: Synthetic oligonucleotide
ggaggaagaagagccagtacccccaga

SEQ ID NO: 285758 - DNA, 28 bp, Artificial Sequence
  Description of Artificial Sequence: Synthetic oligonucleotide
gaggaagaagagccagtacccccagatc

SEQ ID NO: 285759 - DNA, 28 bp, Artificial Sequence
  Description of Artificial Sequence: Synthetic oligonucleotide
aggaagaagagccagtacccccagatcc

SEQ ID NO: 285760 - DNA, 27 bp, Artificial Sequence
  Description of Artificial Sequence: Synthetic oligonucleotide
ggaagaagagccagtacccccagatcc

SEQ ID NO: 285761 - DNA, 31 bp, Artificial Sequence
  Description of Artificial Sequence: Synthetic oligonucleotide
gaagaagagccagtacccccagatccatttg

SEQ ID NO: 285762 - DNA, 32 bp, Artificial Sequence
  Description of Artificial Sequence: Synthetic oligonucleotide
aagaagagccagtacccccagatccatttgag

SEQ ID NO: 285763 - DNA, 31 bp, Artificial Sequence
  Description of Artificial Sequence: Synthetic oligonucleotide
agaagagccagtacccccagatccatttgag

SEQ ID NO: 285764 - DNA, 30 bp, Artificial Sequence
  Description of Artificial Sequence: Synthetic oligonucleotide
gaagagccagtacccccagatccatttgag

SEQ ID NO: 285765 - DNA, 36 bp, Artificial Sequence
  Description of Artificial Sequence: Synthetic oligonucleotide
aagagccagtacccccagatccatttgagaatattg

SEQ ID NO: 285766 - DNA, 35 bp, Artificial Sequence
  Description of Artificial Sequence: Synthetic oligonucleotide
agagccagtacccccagatccatttgagaatattg

SEQ ID NO: 285767 - DNA, 34 bp, Artificial Sequence
  Description of Artificial Sequence: Synthetic oligonucleotide
gagccagtacccccagatccatttgagaatattg

SEQ ID NO: 285768 - DNA, 36 bp, Artificial Sequence
  Description of Artificial Sequence: Synthetic oligonucleotide
agccagtacccccagatccatttgagaatattgatg

SEQ ID NO: 285769 - DNA, 35 bp, Artificial Sequence
  Description of Artificial Sequence: Synthetic oligonucleotide
gccagtacccccagatccatttgagaatattgatg

SEQ ID NO: 285770 - DNA, 24 bp, Artificial Sequence
  Description of Artificial Sequence: Synthetic oligonucleotide
atggagcagggaggcccggacaag

SEQ ID NO: 285771 - DNA, 23 bp, Artificial Sequence
  Description of Artificial Sequence: Synthetic oligonucleotide
tggagcagggaggcccggacaag

SEQ ID NO: 285772 - DNA, 22 bp, Artificial Sequence
  Description of Artificial Sequence: Synthetic oligonucleotide
ggagcagggaggcccggacaag

SEQ ID NO: 285773 - DNA, 22 bp, Artificial Sequence
  Description of Artificial Sequence: Synthetic oligonucleotide
gagcagggaggcccggacaagg

SEQ ID NO: 285774 - DNA, 22 bp, Artificial Sequence
  Description of Artificial Sequence: Synthetic oligonucleotide
agcagggaggcccggacaaggc

SEQ ID NO: 285775 - DNA, 21 bp, Artificial Sequence
  Description of Artificial Sequence: Synthetic oligonucleotide
gcagggaggcccggacaaggc

SEQ ID NO: 285776 - DNA, 21 bp, Artificial Sequence
  Description of Artificial Sequence: Synthetic oligonucleotide
cagggaggcccggacaaggcc

SEQ ID NO: 285777 - DNA, 21 bp, Artificial Sequence
  Description of Artificial Sequence: Synthetic oligonucleotide
agggaggcccggacaaggccc

SEQ ID NO: 285778 - DNA, 20 bp, Artificial Sequence
  Description of Artificial Sequence: Synthetic oligonucleotide
gggaggcccggacaaggccc

SEQ ID NO: 285779 - DNA, 20 bp, Artificial Sequence
  Description of Artificial Sequence: Synthetic oligonucleotide
ggaggcccggacaaggcccc

SEQ ID NO: 285780 - DNA, 20 bp, Artificial Sequence
  Description of Artificial Sequence: Synthetic oligonucleotide
gaggcccggacaaggccccg

SEQ ID NO: 285781 - DNA, 21 bp, Artificial Sequence
  Description of Artificial Sequence: Synthetic oligonucleotide
aggcccggacaaggccccggt

SEQ ID NO: 285782 - DNA, 20 bp, Artificial Sequence
  Description of Artificial Sequence: Synthetic oligonucleotide
ggcccggacaaggccccggt

SEQ ID NO: 285783 - DNA, 20 bp, Artificial Sequence
  Description of Artificial Sequence: Synthetic oligonucleotide
gcccggacaaggccccggtg

SEQ ID NO: 285784 - DNA, 21 bp, Artificial Sequence
  Description of Artificial Sequence: Synthetic oligonucleotide
cccggacaaggccccggtgca

SEQ ID NO: 285785 - DNA, 21 bp, Artificial Sequence
  Description of Artificial Sequence: Synthetic oligonucleotide
ccggacaaggccccggtgcag

SEQ ID NO: 285786 - DNA, 21 bp, Artificial Sequence
  Description of Artificial Sequence: Synthetic oligonucleotide
cggacaaggccccggtgcagg

SEQ ID NO: 285787 - DNA, 21 bp, Artificial Sequence
  Description of Artificial Sequence: Synthetic oligonucleotide
ggacaaggccccggtgcaggc

SEQ ID NO: 285788 - DNA, 21 bp, Artificial Sequence
  Description of Artificial Sequence: Synthetic oligonucleotide
gacaaggccccggtgcaggcc

SEQ ID NO: 285789 - DNA, 22 bp, Artificial Sequence
  Description of Artificial Sequence: Synthetic oligonucleotide
acaaggccccggtgcaggccca

SEQ ID NO: 285790 - DNA, 21 bp, Artificial Sequence
  Description of Artificial Sequence: Synthetic oligonucleotide
caaggccccggtgcaggccca

SEQ ID NO: 285791 - DNA, 21 bp, Artificial Sequence
  Description of Artificial Sequence: Synthetic oligonucleotide
aaggccccggtgcaggcccag

SEQ ID NO: 285792 - DNA, 20 bp, Artificial Sequence
  Description of Artificial Sequence: Synthetic oligonucleotide
aggccccggtgcaggcccag

SEQ ID NO: 285793 - DNA, 20 bp, Artificial Sequence
  Description of Artificial Sequence: Synthetic oligonucleotide
ggccccggtgcaggcccagt

SEQ ID NO: 285794 - DNA, 20 bp, Artificial Sequence
  Description of Artificial Sequence: Synthetic oligonucleotide
gccccggtgcaggcccagca

SEQ ID NO: 285795 - DNA, 21 bp, Artificial Sequence
  Description of Artificial Sequence: Synthetic oligonucleotide
ccccggtgcaggcccagcagt

SEQ ID NO: 285796 - DNA, 22 bp, Artificial Sequence
  Description of Artificial Sequence: Synthetic oligonucleotide
cccggtgcaggcccagcagtgt

SEQ ID NO: 285797 - DNA, 22 bp, Artificial Sequence
  Description of Artificial Sequence: Synthetic oligonucleotide
ccggtgcaggcccagcagtgtc

SEQ ID NO: 285798 - DNA, 23 bp, Artificial Sequence
  Description of Artificial Sequence: Synthetic oligonucleotide
cggtgcaggcccagcagtgtcca

SEQ ID NO: 285799 - DNA, 23 bp, Artificial Sequence
  Description of Artificial Sequence: Synthetic oligonucleotide
ggtgcaggcccagcagtgtccag

SEQ ID NO: 285800 - DNA, 23 bp, Artificial Sequence
  Description of Artificial Sequence: Synthetic oligonucleotide
gtgcaggcccagcagtgtccagc

SEQ ID NO: 285801 - DNA, 23 bp, Artificial Sequence
  Description of Artificial Sequence: Synthetic oligonucleotide
tgcaggcccagcagtgtccagcg

SEQ ID NO: 285802 - DNA, 22 bp, Artificial Sequence
  Description of Artificial Sequence: Synthetic oligonucleotide
gcaggcccagcagtgtccagcg

SEQ ID NO: 285803 - DNA, 22 bp, Artificial Sequence
  Description of Artificial Sequence: Synthetic oligonucleotide
caggcccagcagtgtccagcgg

SEQ ID NO: 285804 - DNA, 22 bp, Artificial Sequence
  Description of Artificial Sequence: Synthetic oligonucleotide
aggcccagcagtgtccagcggc

SEQ ID NO: 285805 - DNA, 21 bp, Artificial Sequence
  Description of Artificial Sequence: Synthetic oligonucleotide
ggcccagcagtgtccagcggc

SEQ ID NO: 285806 - DNA, 21 bp, Artificial Sequence
  Description of Artificial Sequence: Synthetic oligonucleotide
gcccagcagtgtccagcggcc

SEQ ID NO: 285807 - DNA, 21 bp, Artificial Sequence
  Description of Artificial Sequence: Synthetic oligonucleotide
cccagcagtgtccagcggccg

SEQ ID NO: 285808 - DNA, 21 bp, Artificial Sequence
  Description of Artificial Sequence: Synthetic oligonucleotide
ccagcagtgtccagcggccgc

SEQ ID NO: 285809 - DNA, 21 bp, Artificial Sequence
  Description of Artificial Sequence: Synthetic oligonucleotide
cagcagtgtccagcggccgcc

SEQ ID NO: 285810 - DNA, 21 bp, Artificial Sequence
  Description of Artificial Sequence: Synthetic oligonucleotide
agcagtgtccagcggccgccc

SEQ ID NO: 285811 - DNA, 20 bp, Artificial Sequence
  Description of Artificial Sequence: Synthetic oligonucleotide
gcagtgtccagcggccgccc

SEQ ID NO: 285812 - DNA, 20 bp, Artificial Sequence
  Description of Artificial Sequence: Synthetic oligonucleotide
cagtgtccagcggccgcccc

SEQ ID NO: 285813 - DNA, 20 bp, Artificial Sequence
  Description of Artificial Sequence: Synthetic oligonucleotide
agtgtccagcggccgccccc

SEQ ID NO: 285814 - DNA, 20 bp, Artificial Sequence
  Description of Artificial Sequence: Synthetic oligonucleotide
gtgtccagcggccgccccct

SEQ ID NO: 285815 - DNA, 20 bp, Artificial Sequence
  Description of Artificial Sequence: Synthetic oligonucleotide
tgtccagcggccgcccccgt

SEQ ID NO: 285816 - DNA, 20 bp, Artificial Sequence
  Description of Artificial Sequence: Synthetic oligonucleotide
gtccagcggccgcccccgtt

SEQ ID NO: 285817 - DNA, 20 bp, Artificial Sequence
  Description of Artificial Sequence: Synthetic oligonucleotide
tccagcggccgcccccggtt

SEQ ID NO: 285818 - DNA, 20 bp, Artificial Sequence
  Description of Artificial Sequence: Synthetic oligonucleotide
ccagcggccgcccccggttt

SEQ ID NO: 285819 - DNA, 20 bp, Artificial Sequence
  Description of Artificial Sequence: Synthetic oligonucleotide
cagcggccgcccccggcttt

SEQ ID NO: 285820 - DNA, 20 bp, Artificial Sequence
  Description of Artificial Sequence: Synthetic oligonucleotide
agcggccgcccccggccttt

SEQ ID NO: 285821 - DNA, 20 bp, Artificial Sequence
  Description of Artificial Sequence: Synthetic oligonucleotide
gcggccgcccccggcctttt

SEQ ID NO: 285822 - DNA, 20 bp, Artificial Sequence
  Description of Artificial Sequence: Synthetic oligonucleotide
cggccgcccccggccgtttt

SEQ ID NO: 285823 - DNA, 20 bp, Artificial Sequence
  Description of Artificial Sequence: Synthetic oligonucleotide
ggccgcccccggccgcattt

SEQ ID NO: 285824 - DNA, 20 bp, Artificial Sequence
  Description of Artificial Sequence: Synthetic oligonucleotide
gccgcccccggccgcacttt

SEQ ID NO: 285825 - DNA, 20 bp, Artificial Sequence
  Description of Artificial Sequence: Synthetic oligonucleotide
ccgcccccggccgcacgttt

SEQ ID NO: 285826 - DNA, 20 bp, Artificial Sequence
  Description of Artificial Sequence: Synthetic oligonucleotide
cgcccccggccgcacggatt

SEQ ID NO: 285827 - DNA, 20 bp, Artificial Sequence
  Description of Artificial Sequence: Synthetic oligonucleotide
gcccccggccgcacggactt

SEQ ID NO: 285828 - DNA, 20 bp, Artificial Sequence
  Description of Artificial Sequence: Synthetic oligonucleotide
cccccggccgcacggacgtt

SEQ ID NO: 285829 - DNA, 21 bp, Artificial Sequence
  Description of Artificial Sequence: Synthetic oligonucleotide
ccccggccgcacggacgtgaa

SEQ ID NO: 285830 - DNA, 21 bp, Artificial Sequence
  Description of Artificial Sequence: Synthetic oligonucleotide
cccggccgcacggacgtgaag

SEQ ID NO: 285831 - DNA, 21 bp, Artificial Sequence
  Description of Artificial Sequence: Synthetic oligonucleotide
ccggccgcacggacgtgaagc

SEQ ID NO: 285832 - DNA, 21 bp, Artificial Sequence
  Description of Artificial Sequence: Synthetic oligonucleotide
cggccgcacggacgtgaagcc

SEQ ID NO: 285833 - DNA, 22 bp, Artificial Sequence
  Description of Artificial Sequence: Synthetic oligonucleotide
ggccgcacggacgtgaagccga

SEQ ID NO: 285834 - DNA, 22 bp, Artificial Sequence
  Description of Artificial Sequence: Synthetic oligonucleotide
gccgcacggacgtgaagccgag

SEQ ID NO: 285835 - DNA, 22 bp, Artificial Sequence
  Description of Artificial Sequence: Synthetic oligonucleotide
ccgcacggacgtgaagccgagg

SEQ ID NO: 285836 - DNA, 22 bp, Artificial Sequence
  Description of Artificial Sequence: Synthetic oligonucleotide
cgcacggacgtgaagccgaggg

SEQ ID NO: 285837 - DNA, 22 bp, Artificial Sequence
  Description of Artificial Sequence: Synthetic oligonucleotide
gcacggacgtgaagccgagggg

SEQ ID NO: 285838 - DNA, 24 bp, Artificial Sequence
  Description of Artificial Sequence: Synthetic oligonucleotide
cacggacgtgaagccgaggggcaa

SEQ ID NO: 285839 - DNA, 24 bp, Artificial Sequence
  Description of Artificial Sequence: Synthetic oligonucleotide
acggacgtgaagccgaggggcaag

SEQ ID NO: 285840 - DNA, 23 bp, Artificial Sequence
  Description of Artificial Sequence: Synthetic oligonucleotide
cggacgtgaagccgaggggcaag

SEQ ID NO: 285841 - DNA, 24 bp, Artificial Sequence
  Description of Artificial Sequence: Synthetic oligonucleotide
ggacgtgaagccgaggggcaagga

SEQ ID NO: 285842 - DNA, 24 bp, Artificial Sequence
  Description of Artificial Sequence: Synthetic oligonucleotide
gacgtgaagccgaggggcaaggag

SEQ ID NO: 285843 - DNA, 24 bp, Artificial Sequence
  Description of Artificial Sequence: Synthetic oligonucleotide
acgtgaagccgaggggcaaggagg

SEQ ID NO: 285844 - DNA, 23 bp, Artificial Sequence
  Description of Artificial Sequence: Synthetic oligonucleotide
cgtgaagccgaggggcaaggagg

SEQ ID NO: 285845 - DNA, 23 bp, Artificial Sequence
  Description of Artificial Sequence: Synthetic oligonucleotide
gtgaagccgaggggcaaggaggg

SEQ ID NO: 285846 - DNA, 23 bp, Artificial Sequence
  Description of Artificial Sequence: Synthetic oligonucleotide
tgaagccgaggggcaaggagggg

SEQ ID NO: 285847 - DNA, 22 bp, Artificial Sequence
  Description of Artificial Sequence: Synthetic oligonucleotide
gaagccgaggggcaaggagggg

SEQ ID NO: 285848 - DNA, 22 bp, Artificial Sequence
  Description of Artificial Sequence: Synthetic oligonucleotide
aagccgaggggcaaggaggggc

SEQ ID NO: 285849 - DNA, 21 bp, Artificial Sequence
  Description of Artificial Sequence: Synthetic oligonucleotide
agccgaggggcaaggaggggc

SEQ ID NO: 285850 - DNA, 20 bp, Artificial Sequence
  Description of Artificial Sequence: Synthetic oligonucleotide
gccgaggggcaaggaggggc

SEQ ID NO: 285851 - DNA, 20 bp, Artificial Sequence
  Description of Artificial Sequence: Synthetic oligonucleotide
ccgaggggcaaggaggggcg

SEQ ID NO: 285852 - DNA, 20 bp, Artificial Sequence
  Description of Artificial Sequence: Synthetic oligonucleotide
cgaggggcaaggaggggcgg

SEQ ID NO: 285853 - DNA, 22 bp, Artificial Sequence
  Description of Artificial Sequence: Synthetic oligonucleotide
gaggggcaaggaggggcgggat

SEQ ID NO: 285854 - DNA, 22 bp, Artificial Sequence
  Description of Artificial Sequence: Synthetic oligonucleotide
aggggcaaggaggggcgggatg

SEQ ID NO: 285855 - DNA, 21 bp, Artificial Sequence
  Description of Artificial Sequence: Synthetic oligonucleotide
ggggcaaggaggggcgggatg

SEQ ID NO: 285856 - DNA, 21 bp, Artificial Sequence
  Description of Artificial Sequence: Synthetic oligonucleotide
gggcaaggaggggcgggatgg

SEQ ID NO: 285857 - DNA, 21 bp, Artificial Sequence
  Description of Artificial Sequence: Synthetic oligonucleotide
ggcaaggaggggcgggatggc

SEQ ID NO: 285858 - DNA, 21 bp, Artificial Sequence
  Description of Artificial Sequence: Synthetic oligonucleotide
gcaaggaggggcgggatggcg

SEQ ID NO: 285859 - DNA, 21 bp, Artificial Sequence
  Description of Artificial Sequence: Synthetic oligonucleotide
caaggaggggcgggatggcgg

SEQ ID NO: 285860 - DNA, 21 bp, Artificial Sequence
  Description of Artificial Sequence: Synthetic oligonucleotide
aaggaggggcgggatggcggg

SEQ ID NO: 285861 - DNA, 20 bp, Artificial Sequence
  Description of Artificial Sequence: Synthetic oligonucleotide
aggaggggcgggatggcggg

SEQ ID NO: 285862 - DNA, 20 bp, Artificial Sequence
  Description of Artificial Sequence: Synthetic oligonucleotide
ggaggggcgggatggcgggt

SEQ ID NO: 285863 - DNA, 20 bp, Artificial Sequence
  Description of Artificial Sequence: Synthetic oligonucleotide
gaggggcgggatggcgggga

SEQ ID NO: 285864 - DNA, 22 bp, Artificial Sequence
  Description of Artificial Sequence: Synthetic oligonucleotide
aggggcgggatggcggggacaa

SEQ ID NO: 285865 - DNA, 21 bp, Artificial Sequence
  Description of Artificial Sequence: Synthetic oligonucleotide
ggggcgggatggcggggacaa

SEQ ID NO: 285866 - DNA, 21 bp, Artificial Sequence
  Description of Artificial Sequence: Synthetic oligonucleotide
gggcgggatggcggggacaac

SEQ ID NO: 285867 - DNA, 22 bp, Artificial Sequence
  Description of Artificial Sequence: Synthetic oligonucleotide
ggcgggatggcggggacaacga

SEQ ID NO: 285868 - DNA, 25 bp, Artificial Sequence
  Description of Artificial Sequence: Synthetic oligonucleotide
gcgggatggcggggacaacgacaaa

SEQ ID NO: 285869 - DNA, 27 bp, Artificial Sequence
  Description of Artificial Sequence: Synthetic oligonucleotide
cgggatggcggggacaacgacaaagaa

SEQ ID NO: 285870 - DNA, 27 bp, Artificial Sequence
  Description of Artificial Sequence: Synthetic oligonucleotide
gggatggcggggacaacgacaaagaag

SEQ ID NO: 285871 - DNA, 28 bp, Artificial Sequence
  Description of Artificial Sequence: Synthetic oligonucleotide
ggatggcggggacaacgacaaagaagag

SEQ ID NO: 285872 - DNA, 28 bp, Artificial Sequence
  Description of Artificial Sequence: Synthetic oligonucleotide
gatggcggggacaacgacaaagaagagg

SEQ ID NO: 285873 - DNA, 29 bp, Artificial Sequence
  Description of Artificial Sequence: Synthetic oligonucleotide
atggcggggacaacgacaaagaagaggag

SEQ ID NO: 285874 - DNA, 28 bp, Artificial Sequence
  Description of Artificial Sequence: Synthetic oligonucleotide
tggcggggacaacgacaaagaagaggag

SEQ ID NO: 285875 - DNA, 27 bp, Artificial Sequence
  Description of Artificial Sequence: Synthetic oligonucleotide
ggcggggacaacgacaaagaagaggag

SEQ ID NO: 285876 - DNA, 27 bp, Artificial Sequence
  Description of Artificial Sequence: Synthetic oligonucleotide
gcggggacaacgacaaagaagaggagc

SEQ ID NO: 285877 - DNA, 28 bp, Artificial Sequence
  Description of Artificial Sequence: Synthetic oligonucleotide
cggggacaacgacaaagaagaggagctg

SEQ ID NO: 285878 - DNA, 29 bp, Artificial Sequence
  Description of Artificial Sequence: Synthetic oligonucleotide
ggggacaacgacaaagaagaggagctgtg

SEQ ID NO: 285879 - DNA, 30 bp, Artificial Sequence
  Description of Artificial Sequence: Synthetic oligonucleotide
gggacaacgacaaagaagaggagctgtgtg

SEQ ID NO: 285880 - DNA, 32 bp, Artificial Sequence
  Description of Artificial Sequence: Synthetic oligonucleotide
ggacaacgacaaagaagaggagctgtgtgaag

SEQ ID NO: 285881 - DNA, 33 bp, Artificial Sequence
  Description of Artificial Sequence: Synthetic oligonucleotide
gacaacgacaaagaagaggagctgtgtgaagag

SEQ ID NO: 285882 - DNA, 33 bp, Artificial Sequence
  Description of Artificial Sequence: Synthetic oligonucleotide
acaacgacaaagaagaggagctgtgtgaagagg

SEQ ID NO: 285883 - DNA, 32 bp, Artificial Sequence
  Description of Artificial Sequence: Synthetic oligonucleotide
caacgacaaagaagaggagctgtgtgaagagg

SEQ ID NO: 285884 - DNA, 37 bp, Artificial Sequence
  Description of Artificial Sequence: Synthetic oligonucleotide
aacgacaaagaagaggagctgtgtgaagaggaaaaac

SEQ ID NO: 285885 - DNA, 36 bp, Artificial Sequence
  Description of Artificial Sequence: Synthetic oligonucleotide
acgacaaagaagaggagctgtgtgaagaggaaaaac

SEQ ID NO: 285886 - DNA, 35 bp, Artificial Sequence
  Description of Artificial Sequence: Synthetic oligonucleotide
cgacaaagaagaggagctgtgtgaagaggaaaaac

SEQ ID NO: 285887 - DNA, 36 bp, Artificial Sequence
  Description of Artificial Sequence: Synthetic oligonucleotide
gacaaagaagaggagctgtgtgaagaggaaaaacag

SEQ ID NO: 285888 - DNA, 36 bp, Artificial Sequence
  Description of Artificial Sequence: Synthetic oligonucleotide
acaaagaagaggagctgtgtgaagaggaaaaacagc

SEQ ID NO: 285889 - DNA, 35 bp, Artificial Sequence
  Description of Artificial Sequence: Synthetic oligonucleotide
caaagaagaggagctgtgtgaagaggaaaaacagc

SEQ ID NO: 285890 - DNA, 37 bp, Artificial Sequence
  Description of Artificial Sequence: Synthetic oligonucleotide
aaagaagaggagctgtgtgaagaggaaaaacagcttg

SEQ ID NO: 285891 - DNA, 36 bp, Artificial Sequence
  Description of Artificial Sequence: Synthetic oligonucleotide
aagaagaggagctgtgtgaagaggaaaaacagcttg

SEQ ID NO: 285892 - DNA, 35 bp, Artificial Sequence
  Description of Artificial Sequence: Synthetic oligonucleotide
agaagaggagctgtgtgaagaggaaaaacagcttg

SEQ ID NO: 285893 - DNA, 34 bp, Artificial Sequence
  Description of Artificial Sequence: Synthetic oligonucleotide
gaagaggagctgtgtgaagaggaaaaacagcttg

SEQ ID NO: 285894 - DNA, 36 bp, Artificial Sequence
  Description of Artificial Sequence: Synthetic oligonucleotide
aagaggagctgtgtgaagaggaaaaacagcttgaag

SEQ ID NO: 285895 - DNA, 35 bp, Artificial Sequence
  Description of Artificial Sequence: Synthetic oligonucleotide
agaggagctgtgtgaagaggaaaaacagcttgaag

SEQ ID NO: 285896 - DNA, 34 bp, Artificial Sequence
  Description of Artificial Sequence: Synthetic oligonucleotide
gaggagctgtgtgaagaggaaaaacagcttgaag

SEQ ID NO: 285897 - DNA, 36 bp, Artificial Sequence
  Description of Artificial Sequence: Synthetic oligonucleotide
aggagctgtgtgaagaggaaaaacagcttgaagatg

SEQ ID NO: 285898 - DNA, 35 bp, Artificial Sequence
  Description of Artificial Sequence: Synthetic oligonucleotide
ggagctgtgtgaagaggaaaaacagcttgaagatg

SEQ ID NO: 285899 - DNA, 37 bp, Artificial Sequence
  Description of Artificial Sequence: Synthetic oligonucleotide
gagctgtgtgaagaggaaaaacagcttgaagatgaac

SEQ ID NO: 285900 - DNA, 38 bp, Artificial Sequence
  Description of Artificial Sequence: Synthetic oligonucleotide
agctgtgtgaagaggaaaaacagcttgaagatgaacag

SEQ ID NO: 285901 - DNA, 37 bp, Artificial Sequence
  Description of Artificial Sequence: Synthetic oligonucleotide
gctgtgtgaagaggaaaaacagcttgaagatgaacag

SEQ ID NO: 285902 - DNA, 37 bp, Artificial Sequence
  Description of Artificial Sequence: Synthetic oligonucleotide
ctgtgtgaagaggaaaaacagcttgaagatgaacagg

SEQ ID NO: 285903 - DNA, 38 bp, Artificial Sequence
  Description of Artificial Sequence: Synthetic oligonucleotide
tgtgtgaagaggaaaaacagcttgaagatgaacaggag

SEQ ID NO: 285904 - DNA, 37 bp, Artificial Sequence
  Description of Artificial Sequence: Synthetic oligonucleotide
gtgtgaagaggaaaaacagcttgaagatgaacaggag

SEQ ID NO: 285905 - DNA, 39 bp, Artificial Sequence
  Description of Artificial Sequence: Synthetic oligonucleotide
tgtgaagaggaaaaacagcttgaagatgaacaggagatg

SEQ ID NO: 285906 - DNA, 38 bp, Artificial Sequence
  Description of Artificial Sequence: Synthetic oligonucleotide
gtgaagaggaaaaacagcttgaagatgaacaggagatg

SEQ ID NO: 285907 - DNA, 38 bp, Artificial Sequence
  Description of Artificial Sequence: Synthetic oligonucleotide
tgaagaggaaaaacagcttgaagatgaacaggagatgc

SEQ ID NO: 285908 - DNA, 37 bp, Artificial Sequence
  Description of Artificial Sequence: Synthetic oligonucleotide
gaagaggaaaaacagcttgaagatgaacaggagatgc

SEQ ID NO: 285909 - DNA, 38 bp, Artificial Sequence
  Description of Artificial Sequence: Synthetic oligonucleotide
aagaggaaaaacagcttgaagatgaacaggagatgctg

SEQ ID NO: 285910 - DNA, 37 bp, Artificial Sequence
  Description of Artificial Sequence: Synthetic oligonucleotide
agaggaaaaacagcttgaagatgaacaggagatgctg

SEQ ID NO: 285911 - DNA, 36 bp, Artificial Sequence
  Description of Artificial Sequence: Synthetic oligonucleotide
gaggaaaaacagcttgaagatgaacaggagatgctg

SEQ ID NO: 285912 - DNA, 36 bp, Artificial Sequence
  Description of Artificial Sequence: Synthetic oligonucleotide
aggaaaaacagcttgaagatgaacaggagatgctgg

SEQ ID NO: 285913 - DNA, 35 bp, Artificial Sequence
  Description of Artificial Sequence: Synthetic oligonucleotide
ggaaaaacagcttgaagatgaacaggagatgctgg

SEQ ID NO: 285914 - DNA, 36 bp, Artificial Sequence
  Description of Artificial Sequence: Synthetic oligonucleotide
gaaaaacagcttgaagatgaacaggagatgctggtg

SEQ ID NO: 285915 - DNA, 36 bp, Artificial Sequence
  Description of Artificial Sequence: Synthetic oligonucleotide
aaaaacagcttgaagatgaacaggagatgctggtgg

SEQ ID NO: 285916 - DNA, 35 bp, Artificial Sequence
  Description of Artificial Sequence: Synthetic oligonucleotide
aaaacagcttgaagatgaacaggagatgctggtgg

SEQ ID NO: 285917 - DNA, 34 bp, Artificial Sequence
  Description of Artificial Sequence: Synthetic oligonucleotide
aaacagcttgaagatgaacaggagatgctggtgg

SEQ ID NO: 285918 - DNA, 33 bp, Artificial Sequence
  Description of Artificial Sequence: Synthetic oligonucleotide
aacagcttgaagatgaacaggagatgctggtgg

SEQ ID NO: 285919 - DNA, 32 bp, Artificial Sequence
  Description of Artificial Sequence: Synthetic oligonucleotide
acagcttgaagatgaacaggagatgctggtgg

SEQ ID NO: 285920 - DNA, 31 bp, Artificial Sequence
  Description of Artificial Sequence: Synthetic oligonucleotide
cagcttgaagatgaacaggagatgctggtgg

SEQ ID NO: 285921 - DNA, 33 bp, Artificial Sequence
  Description of Artificial Sequence: Synthetic oligonucleotide
agcttgaagatgaacaggagatgctggtggaac

SEQ ID NO: 285922 - DNA, 32 bp, Artificial Sequence
  Description of Artificial Sequence: Synthetic oligonucleotide
gcttgaagatgaacaggagatgctggtggaac

SEQ ID NO: 285923 - DNA, 32 bp, Artificial Sequence
  Description of Artificial Sequence: Synthetic oligonucleotide
cttgaagatgaacaggagatgctggtggaacg

SEQ ID NO: 285924 - DNA, 33 bp, Artificial Sequence
  Description of Artificial Sequence: Synthetic oligonucleotide
ttgaagatgaacaggagatgctggtggaacgag

SEQ ID NO: 285925 - DNA, 32 bp, Artificial Sequence
  Description of Artificial Sequence: Synthetic oligonucleotide
tgaagatgaacaggagatgctggtggaacgag

SEQ ID NO: 285926 - DNA, 31 bp, Artificial Sequence
  Description of Artificial Sequence: Synthetic oligonucleotide
gaagatgaacaggagatgctggtggaacgag

SEQ ID NO: 285927 - DNA, 33 bp, Artificial Sequence
  Description of Artificial Sequence: Synthetic oligonucleotide
aagatgaacaggagatgctggtggaacgagtag

SEQ ID NO: 285928 - DNA, 32 bp, Artificial Sequence
  Description of Artificial Sequence: Synthetic oligonucleotide
agatgaacaggagatgctggtggaacgagtag

SEQ ID NO: 285929 - DNA, 31 bp, Artificial Sequence
  Description of Artificial Sequence: Synthetic oligonucleotide
gatgaacaggagatgctggtggaacgagtag

SEQ ID NO: 285930 - DNA, 31 bp, Artificial Sequence
  Description of Artificial Sequence: Synthetic oligonucleotide
atgaacaggagatgctggtggaacgagtagg

SEQ ID NO: 285931 - DNA, 30 bp, Artificial Sequence
  Description of Artificial Sequence: Synthetic oligonucleotide
tgaacaggagatgctggtggaacgagtagg

SEQ ID NO: 285932 - DNA, 29 bp, Artificial Sequence
  Description of Artificial Sequence: Synthetic oligonucleotide
gaacaggagatgctggtggaacgagtagg

SEQ ID NO: 285933 - DNA, 29 bp, Artificial Sequence
  Description of Artificial Sequence: Synthetic oligonucleotide
aacaggagatgctggtggaacgagtaggg

SEQ ID NO: 285934 - DNA, 28 bp, Artificial Sequence
  Description of Artificial Sequence: Synthetic oligonucleotide
acaggagatgctggtggaacgagtaggg

SEQ ID NO: 285935 - DNA, 27 bp, Artificial Sequence
  Description of Artificial Sequence: Synthetic oligonucleotide
caggagatgctggtggaacgagtaggg

SEQ ID NO: 285936 - DNA, 27 bp, Artificial Sequence
  Description of Artificial Sequence: Synthetic oligonucleotide
aggagatgctggtggaacgagtagggg

SEQ ID NO: 285937 - DNA, 27 bp, Artificial Sequence
  Description of Artificial Sequence: Synthetic oligonucleotide
ggagatgctggtggaacgagtagggga

SEQ ID NO: 285938 - DNA, 27 bp, Artificial Sequence
  Description of Artificial Sequence: Synthetic oligonucleotide
gagatgctggtggaacgagtaggggag

SEQ ID NO: 285939 - DNA, 29 bp, Artificial Sequence
  Description of Artificial Sequence: Synthetic oligonucleotide
agatgctggtggaacgagtaggggagatg

SEQ ID NO: 285940 - DNA, 28 bp, Artificial Sequence
  Description of Artificial Sequence: Synthetic oligonucleotide
gatgctggtggaacgagtaggggagatg

SEQ ID NO: 285941 - DNA, 28 bp, Artificial Sequence
  Description of Artificial Sequence: Synthetic oligonucleotide
atgctggtggaacgagtaggggagatgg

SEQ ID NO: 285942 - DNA, 27 bp, Artificial Sequence
  Description of Artificial Sequence: Synthetic oligonucleotide
tgctggtggaacgagtaggggagatgg

SEQ ID NO: 285943 - DNA, 27 bp, Artificial Sequence
  Description of Artificial Sequence: Synthetic oligonucleotide
gctggtggaacgagtaggggagatgga

SEQ ID NO: 285944 - DNA, 29 bp, Artificial Sequence
  Description of Artificial Sequence: Synthetic oligonucleotide
ctggtggaacgagtaggggagatggatac

SEQ ID NO: 285945 - DNA, 31 bp, Artificial Sequence
  Description of Artificial Sequence: Synthetic oligonucleotide
tggtggaacgagtaggggagatggatacatc

SEQ ID NO: 285946 - DNA, 30 bp, Artificial Sequence
  Description of Artificial Sequence: Synthetic oligonucleotide
ggtggaacgagtaggggagatggatacatc

SEQ ID NO: 285947 - DNA, 30 bp, Artificial Sequence
  Description of Artificial Sequence: Synthetic oligonucleotide
gtggaacgagtaggggagatggatacatcg

SEQ ID NO: 285948 - DNA, 30 bp, Artificial Sequence
  Description of Artificial Sequence: Synthetic oligonucleotide
tggaacgagtaggggagatggatacatcgc

SEQ ID NO: 285949 - DNA, 29 bp, Artificial Sequence
  Description of Artificial Sequence: Synthetic oligonucleotide
ggaacgagtaggggagatggatacatcgc

SEQ ID NO: 285950 - DNA, 30 bp, Artificial Sequence
  Description of Artificial Sequence: Synthetic oligonucleotide
gaacgagtaggggagatggatacatcgctg

SEQ ID NO: 285951 - DNA, 33 bp, Artificial Sequence
  Description of Artificial Sequence: Synthetic oligonucleotide
aacgagtaggggagatggatacatcgctgtatc

SEQ ID NO: 285952 - DNA, 32 bp, Artificial Sequence
  Description of Artificial Sequence: Synthetic oligonucleotide
acgagtaggggagatggatacatcgctgtatc

SEQ ID NO: 285953 - DNA, 31 bp, Artificial Sequence
  Description of Artificial Sequence: Synthetic oligonucleotide
cgagtaggggagatggatacatcgctgtatc

SEQ ID NO: 285954 - DNA, 31 bp, Artificial Sequence
  Description of Artificial Sequence: Synthetic oligonucleotide
gagtaggggagatggatacatcgctgtatcg

SEQ ID NO: 285955 - DNA, 32 bp, Artificial Sequence
  Description of Artificial Sequence: Synthetic oligonucleotide
agtaggggagatggatacatcgctgtatcgag

SEQ ID NO: 285956 - DNA, 31 bp, Artificial Sequence
  Description of Artificial Sequence: Synthetic oligonucleotide
gtaggggagatggatacatcgctgtatcgag

SEQ ID NO: 285957 - DNA, 31 bp, Artificial Sequence
  Description of Artificial Sequence: Synthetic oligonucleotide
taggggagatggatacatcgctgtatcgagc

SEQ ID NO: 285958 - DNA, 30 bp, Artificial Sequence
  Description of Artificial Sequence: Synthetic oligonucleotide
aggggagatggatacatcgctgtatcgagc

SEQ ID NO: 285959 - DNA, 29 bp, Artificial Sequence
  Description of Artificial Sequence: Synthetic oligonucleotide
ggggagatggatacatcgctgtatcgagc

SEQ ID NO: 285960 - DNA, 30 bp, Artificial Sequence
  Description of Artificial Sequence: Synthetic oligonucleotide
gggagatggatacatcgctgtatcgagcag

SEQ ID NO: 285961 - DNA, 30 bp, Artificial Sequence
  Description of Artificial Sequence: Synthetic oligonucleotide
ggagatggatacatcgctgtatcgagcagc

SEQ ID NO: 285962 - DNA, 30 bp, Artificial Sequence
  Description of Artificial Sequence: Synthetic oligonucleotide
gagatggatacatcgctgtatcgagcagcg

SEQ ID NO: 285963 - DNA, 30 bp, Artificial Sequence
  Description of Artificial Sequence: Synthetic oligonucleotide
agatggatacatcgctgtatcgagcagcgc

SEQ ID NO: 285964 - DNA, 29 bp, Artificial Sequence
  Description of Artificial Sequence: Synthetic oligonucleotide
gatggatacatcgctgtatcgagcagcgc

SEQ ID NO: 285965 - DNA, 30 bp, Artificial Sequence
  Description of Artificial Sequence: Synthetic oligonucleotide
atggatacatcgctgtatcgagcagcgctg

SEQ ID NO: 285966 - DNA, 29 bp, Artificial Sequence
  Description of Artificial Sequence: Synthetic oligonucleotide
tggatacatcgctgtatcgagcagcgctg

SEQ ID NO: 285967 - DNA, 28 bp, Artificial Sequence
  Description of Artificial Sequence: Synthetic oligonucleotide
ggatacatcgctgtatcgagcagcgctg

SEQ ID NO: 285968 - DNA, 28 bp, Artificial Sequence
  Description of Artificial Sequence: Synthetic oligonucleotide
gatacatcgctgtatcgagcagcgctgg

SEQ ID NO: 285969 - DNA, 29 bp, Artificial Sequence
  Description of Artificial Sequence: Synthetic oligonucleotide
atacatcgctgtatcgagcagcgctggtg

SEQ ID NO: 285970 - DNA, 28 bp, Artificial Sequence
  Description of Artificial Sequence: Synthetic oligonucleotide
tacatcgctgtatcgagcagcgctggtg

SEQ ID NO: 285971 - DNA, 27 bp, Artificial Sequence
  Description of Artificial Sequence: Synthetic oligonucleotide
acatcgctgtatcgagcagcgctggtg

SEQ ID NO: 285972 - DNA, 26 bp, Artificial Sequence
  Description of Artificial Sequence: Synthetic oligonucleotide
catcgctgtatcgagcagcgctggtg

SEQ ID NO: 285973 - DNA, 27 bp, Artificial Sequence
  Description of Artificial Sequence: Synthetic oligonucleotide
atcgctgtatcgagcagcgctggtgga

SEQ ID NO: 285974 - DNA, 27 bp, Artificial Sequence
  Description of Artificial Sequence: Synthetic oligonucleotide
tcgctgtatcgagcagcgctggtggaa

SEQ ID NO: 285975 - DNA, 27 bp, Artificial Sequence
  Description of Artificial Sequence: Synthetic oligonucleotide
cgctgtatcgagcagcgctggtggaat

SEQ ID NO: 285976 - DNA, 28 bp, Artificial Sequence
  Description of Artificial Sequence: Synthetic oligonucleotide
gctgtatcgagcagcgctggtggaattg

SEQ ID NO: 285977 - DNA, 28 bp, Artificial Sequence
  Description of Artificial Sequence: Synthetic oligonucleotide
ctgtatcgagcagcgctggtggaattgc

SEQ ID NO: 285978 - DNA, 28 bp, Artificial Sequence
  Description of Artificial Sequence: Synthetic oligonucleotide
tgtatcgagcagcgctggtggaattgcg

SEQ ID NO: 285979 - DNA, 27 bp, Artificial Sequence
  Description of Artificial Sequence: Synthetic oligonucleotide
gtatcgagcagcgctggtggaattgcg

SEQ ID NO: 285980 - DNA, 29 bp, Artificial Sequence
  Description of Artificial Sequence: Synthetic oligonucleotide
tatcgagcagcgctggtggaattgcgtag

SEQ ID NO: 285981 - DNA, 28 bp, Artificial Sequence
  Description of Artificial Sequence: Synthetic oligonucleotide
atcgagcagcgctggtggaattgcgtag

SEQ ID NO: 285982 - DNA, 27 bp, Artificial Sequence
  Description of Artificial Sequence: Synthetic oligonucleotide
tcgagcagcgctggtggaattgcgtag

SEQ ID NO: 285983 - DNA, 26 bp, Artificial Sequence
  Description of Artificial Sequence: Synthetic oligonucleotide
cgagcagcgctggtggaattgcgtag

SEQ ID NO: 285984 - DNA, 26 bp, Artificial Sequence
  Description of Artificial Sequence: Synthetic oligonucleotide
gagcagcgctggtggaattgcgtagg

SEQ ID NO: 285985 - DNA, 27 bp, Artificial Sequence
  Description of Artificial Sequence: Synthetic oligonucleotide
agcagcgctggtggaattgcgtaggca

SEQ ID NO: 285986 - DNA, 26 bp, Artificial Sequence
  Description of Artificial Sequence: Synthetic oligonucleotide
gcagcgctggtggaattgcgtaggca

SEQ ID NO: 285987 - DNA, 27 bp, Artificial Sequence
  Description of Artificial Sequence: Synthetic oligonucleotide
cagcgctggtggaattgcgtaggcaga

SEQ ID NO: 285988 - DNA, 29 bp, Artificial Sequence
  Description of Artificial Sequence: Synthetic oligonucleotide
agcgctggtggaattgcgtaggcagattg

SEQ ID NO: 285989 - DNA, 28 bp, Artificial Sequence
  Description of Artificial Sequence: Synthetic oligonucleotide
gcgctggtggaattgcgtaggcagattg

SEQ ID NO: 285990 - DNA, 28 bp, Artificial Sequence
  Description of Artificial Sequence: Synthetic oligonucleotide
cgctggtggaattgcgtaggcagattgg

SEQ ID NO: 285991 - DNA, 30 bp, Artificial Sequence
  Description of Artificial Sequence: Synthetic oligonucleotide
gctggtggaattgcgtaggcagattggttc

SEQ ID NO: 285992 - DNA, 32 bp, Artificial Sequence
  Description of Artificial Sequence: Synthetic oligonucleotide
ctggtggaattgcgtaggcagattggttcttc

SEQ ID NO: 285993 - DNA, 34 bp, Artificial Sequence
  Description of Artificial Sequence: Synthetic oligonucleotide
tggtggaattgcgtaggcagattggttcttctag

SEQ ID NO: 285994 - DNA, 33 bp, Artificial Sequence
  Description of Artificial Sequence: Synthetic oligonucleotide
ggtggaattgcgtaggcagattggttcttctag

SEQ ID NO: 285995 - DNA, 35 bp, Artificial Sequence
  Description of Artificial Sequence: Synthetic oligonucleotide
gtggaattgcgtaggcagattggttcttctagaac

SEQ ID NO: 285996 - DNA, 37 bp, Artificial Sequence
  Description of Artificial Sequence: Synthetic oligonucleotide
tggaattgcgtaggcagattggttcttctagaacttc

SEQ ID NO: 285997 - DNA, 36 bp, Artificial Sequence
  Description of Artificial Sequence: Synthetic oligonucleotide
ggaattgcgtaggcagattggttcttctagaacttc

SEQ ID NO: 285998 - DNA, 36 bp, Artificial Sequence
  Description of Artificial Sequence: Synthetic oligonucleotide
gaattgcgtaggcagattggttcttctagaacttcc

SEQ ID NO: 285999 - DNA, 38 bp, Artificial Sequence
  Description of Artificial Sequence: Synthetic oligonucleotide
aattgcgtaggcagattggttcttctagaacttccatc

SEQ ID NO: 286000 - DNA, 37 bp, Artificial Sequence
  Description of Artificial Sequence: Synthetic oligonucleotide
attgcgtaggcagattggttcttctagaacttccatc

SEQ ID NO: 286001 - DNA, 36 bp, Artificial Sequence
  Description of Artificial Sequence: Synthetic oligonucleotide
ttgcgtaggcagattggttcttctagaacttccatc

SEQ ID NO: 286002 - DNA, 35 bp, Artificial Sequence
  Description of Artificial Sequence: Synthetic oligonucleotide
tgcgtaggcagattggttcttctagaacttccatc

SEQ ID NO: 286003 - DNA, 34 bp, Artificial Sequence
  Description of Artificial Sequence: Synthetic oligonucleotide
gcgtaggcagattggttcttctagaacttccatc

SEQ ID NO: 286004 - DNA, 35 bp, Artificial Sequence
  Description of Artificial Sequence: Synthetic oligonucleotide
cgtaggcagattggttcttctagaacttccatcac

SEQ ID NO: 286005 - DNA, 37 bp, Artificial Sequence
  Description of Artificial Sequence: Synthetic oligonucleotide
gtaggcagattggttcttctagaacttccatcacttc

SEQ ID NO: 286006 - DNA, 38 bp, Artificial Sequence
  Description of Artificial Sequence: Synthetic oligonucleotide
taggcagattggttcttctagaacttccatcacttcag

SEQ ID NO: 286007 - DNA, 37 bp, Artificial Sequence
  Description of Artificial Sequence: Synthetic oligonucleotide
aggcagattggttcttctagaacttccatcacttcag

SEQ ID NO: 286008 - DNA, 36 bp, Artificial Sequence
  Description of Artificial Sequence: Synthetic oligonucleotide
ggcagattggttcttctagaacttccatcacttcag

SEQ ID NO: 286009 - DNA, 37 bp, Artificial Sequence
  Description of Artificial Sequence: Synthetic oligonucleotide
gcagattggttcttctagaacttccatcacttcagtg

SEQ ID NO: 286010 - DNA, 37 bp, Artificial Sequence
  Description of Artificial Sequence: Synthetic oligonucleotide
cagattggttcttctagaacttccatcacttcagtgg

SEQ ID NO: 286011 - DNA, 37 bp, Artificial Sequence
  Description of Artificial Sequence: Synthetic oligonucleotide
agattggttcttctagaacttccatcacttcagtggc

SEQ ID NO: 286012 - DNA, 36 bp, Artificial Sequence
  Description of Artificial Sequence: Synthetic oligonucleotide
gattggttcttctagaacttccatcacttcagtggc

SEQ ID NO: 286013 - DNA, 36 bp, Artificial Sequence
  Description of Artificial Sequence: Synthetic oligonucleotide
attggttcttctagaacttccatcacttcagtggcc

SEQ ID NO: 286014 - DNA, 35 bp, Artificial Sequence
  Description of Artificial Sequence: Synthetic oligonucleotide
ttggttcttctagaacttccatcacttcagtggcc

SEQ ID NO: 286015 - DNA, 34 bp, Artificial Sequence
  Description of Artificial Sequence: Synthetic oligonucleotide
tggttcttctagaacttccatcacttcagtggcc

SEQ ID NO: 286016 - DNA, 33 bp, Artificial Sequence
  Description of Artificial Sequence: Synthetic oligonucleotide
ggttcttctagaacttccatcacttcagtggcc

SEQ ID NO: 286017 - DNA, 35 bp, Artificial Sequence
  Description of Artificial Sequence: Synthetic oligonucleotide
gttcttctagaacttccatcacttcagtggccaag

SEQ ID NO: 286018 - DNA, 35 bp, Artificial Sequence
  Description of Artificial Sequence: Synthetic oligonucleotide
ttcttctagaacttccatcacttcagtggccaagc

SEQ ID NO: 286019 - DNA, 34 bp, Artificial Sequence
  Description of Artificial Sequence: Synthetic oligonucleotide
tcttctagaacttccatcacttcagtggccaagc

SEQ ID NO: 286020 - DNA, 33 bp, Artificial Sequence
  Description of Artificial Sequence: Synthetic oligonucleotide
cttctagaacttccatcacttcagtggccaagc

SEQ ID NO: 286021 - DNA, 33 bp, Artificial Sequence
  Description of Artificial Sequence: Synthetic oligonucleotide
ttctagaacttccatcacttcagtggccaagcc

SEQ ID NO: 286022 - DNA, 32 bp, Artificial Sequence
  Description of Artificial Sequence: Synthetic oligonucleotide
tctagaacttccatcacttcagtggccaagcc

SEQ ID NO: 286023 - DNA, 31 bp, Artificial Sequence
  Description of Artificial Sequence: Synthetic oligonucleotide
ctagaacttccatcacttcagtggccaagcc

SEQ ID NO: 286024 - DNA, 32 bp, Artificial Sequence
  Description of Artificial Sequence: Synthetic oligonucleotide
tagaacttccatcacttcagtggccaagcctc

SEQ ID NO: 286025 - DNA, 31 bp, Artificial Sequence
  Description of Artificial Sequence: Synthetic oligonucleotide
agaacttccatcacttcagtggccaagcctc

SEQ ID NO: 286026 - DNA, 30 bp, Artificial Sequence
  Description of Artificial Sequence: Synthetic oligonucleotide
gaacttccatcacttcagtggccaagcctc

SEQ ID NO: 286027 - DNA, 31 bp, Artificial Sequence
  Description of Artificial Sequence: Synthetic oligonucleotide
aacttccatcacttcagtggccaagcctcac

SEQ ID NO: 286028 - DNA, 30 bp, Artificial Sequence
  Description of Artificial Sequence: Synthetic oligonucleotide
acttccatcacttcagtggccaagcctcac

SEQ ID NO: 286029 - DNA, 29 bp, Artificial Sequence
  Description of Artificial Sequence: Synthetic oligonucleotide
cttccatcacttcagtggccaagcctcac

SEQ ID NO: 286030 - DNA, 35 bp, Artificial Sequence
  Description of Artificial Sequence: Synthetic oligonucleotide
ttccatcacttcagtggccaagcctcacaaatttc

SEQ ID NO: 286031 - DNA, 34 bp, Artificial Sequence
  Description of Artificial Sequence: Synthetic oligonucleotide
tccatcacttcagtggccaagcctcacaaatttc

SEQ ID NO: 286032 - DNA, 33 bp, Artificial Sequence
  Description of Artificial Sequence: Synthetic oligonucleotide
ccatcacttcagtggccaagcctcacaaatttc

SEQ ID NO: 286033 - DNA, 34 bp, Artificial Sequence
  Description of Artificial Sequence: Synthetic oligonucleotide
catcacttcagtggccaagcctcacaaatttctc

SEQ ID NO: 286034 - DNA, 34 bp, Artificial Sequence
  Description of Artificial Sequence: Synthetic oligonucleotide
atcacttcagtggccaagcctcacaaatttctcc

SEQ ID NO: 286035 - DNA, 33 bp, Artificial Sequence
  Description of Artificial Sequence: Synthetic oligonucleotide
tcacttcagtggccaagcctcacaaatttctcc

SEQ ID NO: 286036 - DNA, 32 bp, Artificial Sequence
  Description of Artificial Sequence: Synthetic oligonucleotide
cacttcagtggccaagcctcacaaatttctcc

SEQ ID NO: 286037 - DNA, 32 bp, Artificial Sequence
  Description of Artificial Sequence: Synthetic oligonucleotide
acttcagtggccaagcctcacaaatttctccg

SEQ ID NO: 286038 - DNA, 31 bp, Artificial Sequence
  Description of Artificial Sequence: Synthetic oligonucleotide
cttcagtggccaagcctcacaaatttctccg

SEQ ID NO: 286039 - DNA, 32 bp, Artificial Sequence
  Description of Artificial Sequence: Synthetic oligonucleotide
ttcagtggccaagcctcacaaatttctccgtc

SEQ ID NO: 286040 - DNA, 31 bp, Artificial Sequence
  Description of Artificial Sequence: Synthetic oligonucleotide
tcagtggccaagcctcacaaatttctccgtc

SEQ ID NO: 286041 - DNA, 30 bp, Artificial Sequence
  Description of Artificial Sequence: Synthetic oligonucleotide
cagtggccaagcctcacaaatttctccgtc

SEQ ID NO: 286042 - DNA, 30 bp, Artificial Sequence
  Description of Artificial Sequence: Synthetic oligonucleotide
agtggccaagcctcacaaatttctccgtcc

SEQ ID NO: 286043 - DNA, 29 bp, Artificial Sequence
  Description of Artificial Sequence: Synthetic oligonucleotide
gtggccaagcctcacaaatttctccgtcc

SEQ ID NO: 286044 - DNA, 30 bp, Artificial Sequence
  Description of Artificial Sequence: Synthetic oligonucleotide
tggccaagcctcacaaatttctccgtccac

SEQ ID NO: 286045 - DNA, 29 bp, Artificial Sequence
  Description of Artificial Sequence: Synthetic oligonucleotide
ggccaagcctcacaaatttctccgtccac

SEQ ID NO: 286046 - DNA, 30 bp, Artificial Sequence
  Description of Artificial Sequence: Synthetic oligonucleotide
gccaagcctcacaaatttctccgtccacac

SEQ ID NO: 286047 - DNA, 33 bp, Artificial Sequence
  Description of Artificial Sequence: Synthetic oligonucleotide
ccaagcctcacaaatttctccgtccacacaatg

SEQ ID NO: 286048 - DNA, 33 bp, Artificial Sequence
  Description of Artificial Sequence: Synthetic oligonucleotide
caagcctcacaaatttctccgtccacacaatgg

SEQ ID NO: 286049 - DNA, 33 bp, Artificial Sequence
  Description of Artificial Sequence: Synthetic oligonucleotide
aagcctcacaaatttctccgtccacacaatggc

SEQ ID NO: 286050 - DNA, 32 bp, Artificial Sequence
  Description of Artificial Sequence: Synthetic oligonucleotide
agcctcacaaatttctccgtccacacaatggc

SEQ ID NO: 286051 - DNA, 31 bp, Artificial Sequence
  Description of Artificial Sequence: Synthetic oligonucleotide
gcctcacaaatttctccgtccacacaatggc

SEQ ID NO: 286052 - DNA, 34 bp, Artificial Sequence
  Description of Artificial Sequence: Synthetic oligonucleotide
cctcacaaatttctccgtccacacaatggcaaac

SEQ ID NO: 286053 - DNA, 35 bp, Artificial Sequence
  Description of Artificial Sequence: Synthetic oligonucleotide
ctcacaaatttctccgtccacacaatggcaaacag

SEQ ID NO: 286054 - DNA, 37 bp, Artificial Sequence
  Description of Artificial Sequence: Synthetic oligonucleotide
tcacaaatttctccgtccacacaatggcaaacagaag

SEQ ID NO: 286055 - DNA, 36 bp, Artificial Sequence
  Description of Artificial Sequence: Synthetic oligonucleotide
cacaaatttctccgtccacacaatggcaaacagaag

SEQ ID NO: 286056 - DNA, 36 bp, Artificial Sequence
  Description of Artificial Sequence: Synthetic oligonucleotide
acaaatttctccgtccacacaatggcaaacagaagg

SEQ ID NO: 286057 - DNA, 35 bp, Artificial Sequence
  Description of Artificial Sequence: Synthetic oligonucleotide
caaatttctccgtccacacaatggcaaacagaagg

SEQ ID NO: 286058 - DNA, 39 bp, Artificial Sequence
  Description of Artificial Sequence: Synthetic oligonucleotide
aaatttctccgtccacacaatggcaaacagaaggaaatg

SEQ ID NO: 286059 - DNA, 38 bp, Artificial Sequence
  Description of Artificial Sequence: Synthetic oligonucleotide
aatttctccgtccacacaatggcaaacagaaggaaatg

SEQ ID NO: 286060 - DNA, 37 bp, Artificial Sequence
  Description of Artificial Sequence: Synthetic oligonucleotide
atttctccgtccacacaatggcaaacagaaggaaatg

SEQ ID NO: 286061 - DNA, 36 bp, Artificial Sequence
  Description of Artificial Sequence: Synthetic oligonucleotide
tttctccgtccacacaatggcaaacagaaggaaatg

SEQ ID NO: 286062 - DNA, 35 bp, Artificial Sequence
  Description of Artificial Sequence: Synthetic oligonucleotide
ttctccgtccacacaatggcaaacagaaggaaatg

SEQ ID NO: 286063 - DNA, 34 bp, Artificial Sequence
  Description of Artificial Sequence: Synthetic oligonucleotide
tctccgtccacacaatggcaaacagaaggaaatg

SEQ ID NO: 286064 - DNA, 33 bp, Artificial Sequence
  Description of Artificial Sequence: Synthetic oligonucleotide
ctccgtccacacaatggcaaacagaaggaaatg

SEQ ID NO: 286065 - DNA, 36 bp, Artificial Sequence
  Description of Artificial Sequence: Synthetic oligonucleotide
tccgtccacacaatggcaaacagaaggaaatgtatg

SEQ ID NO: 286066 - DNA, 35 bp, Artificial Sequence
  Description of Artificial Sequence: Synthetic oligonucleotide
ccgtccacacaatggcaaacagaaggaaatgtatg

SEQ ID NO: 286067 - DNA, 36 bp, Artificial Sequence
  Description of Artificial Sequence: Synthetic oligonucleotide
cgtccacacaatggcaaacagaaggaaatgtatgag

SEQ ID NO: 286068 - DNA, 38 bp, Artificial Sequence
  Description of Artificial Sequence: Synthetic oligonucleotide
gtccacacaatggcaaacagaaggaaatgtatgagaac

SEQ ID NO: 286069 - DNA, 40 bp, Artificial Sequence
  Description of Artificial Sequence: Synthetic oligonucleotide
tccacacaatggcaaacagaaggaaatgtatgagaacttg

SEQ ID NO: 286070 - DNA, 39 bp, Artificial Sequence
  Description of Artificial Sequence: Synthetic oligonucleotide
ccacacaatggcaaacagaaggaaatgtatgagaacttg

SEQ ID NO: 286071 - DNA, 39 bp, Artificial Sequence
  Description of Artificial Sequence: Synthetic oligonucleotide
cacacaatggcaaacagaaggaaatgtatgagaacttgg

SEQ ID NO: 286072 - DNA, 39 bp, Artificial Sequence
  Description of Artificial Sequence: Synthetic oligonucleotide
acacaatggcaaacagaaggaaatgtatgagaacttggc

SEQ ID NO: 286073 - DNA, 38 bp, Artificial Sequence
  Description of Artificial Sequence: Synthetic oligonucleotide
cacaatggcaaacagaaggaaatgtatgagaacttggc

SEQ ID NO: 286074 - DNA, 38 bp, Artificial Sequence
  Description of Artificial Sequence: Synthetic oligonucleotide
acaatggcaaacagaaggaaatgtatgagaacttggcc

SEQ ID NO: 286075 - DNA, 37 bp, Artificial Sequence
  Description of Artificial Sequence: Synthetic oligonucleotide
caatggcaaacagaaggaaatgtatgagaacttggcc

SEQ ID NO: 286076 - DNA, 37 bp, Artificial Sequence
  Description of Artificial Sequence: Synthetic oligonucleotide
aatggcaaacagaaggaaatgtatgagaacttggccc

SEQ ID NO: 286077 - DNA, 36 bp, Artificial Sequence
  Description of Artificial Sequence: Synthetic oligonucleotide
atggcaaacagaaggaaatgtatgagaacttggccc

SEQ ID NO: 286078 - DNA, 35 bp, Artificial Sequence
  Description of Artificial Sequence: Synthetic oligonucleotide
tggcaaacagaaggaaatgtatgagaacttggccc

SEQ ID NO: 286079 - DNA, 34 bp, Artificial Sequence
  Description of Artificial Sequence: Synthetic oligonucleotide
ggcaaacagaaggaaatgtatgagaacttggccc

SEQ ID NO: 286080 - DNA, 34 bp, Artificial Sequence
  Description of Artificial Sequence: Synthetic oligonucleotide
gcaaacagaaggaaatgtatgagaacttggcccc

SEQ ID NO: 286081 - DNA, 35 bp, Artificial Sequence
  Description of Artificial Sequence: Synthetic oligonucleotide
caaacagaaggaaatgtatgagaacttggcccctg

SEQ ID NO: 286082 - DNA, 35 bp, Artificial Sequence
  Description of Artificial Sequence: Synthetic oligonucleotide
aaacagaaggaaatgtatgagaacttggcccctgc

SEQ ID NO: 286083 - DNA, 34 bp, Artificial Sequence
  Description of Artificial Sequence: Synthetic oligonucleotide
aacagaaggaaatgtatgagaacttggcccctgc

SEQ ID NO: 286084 - DNA, 33 bp, Artificial Sequence
  Description of Artificial Sequence: Synthetic oligonucleotide
acagaaggaaatgtatgagaacttggcccctgc

SEQ ID NO: 286085 - DNA, 32 bp, Artificial Sequence
  Description of Artificial Sequence: Synthetic oligonucleotide
cagaaggaaatgtatgagaacttggcccctgc

SEQ ID NO: 286086 - DNA, 32 bp, Artificial Sequence
  Description of Artificial Sequence: Synthetic oligonucleotide
agaaggaaatgtatgagaacttggcccctgcg

SEQ ID NO: 286087 - DNA, 31 bp, Artificial Sequence
  Description of Artificial Sequence: Synthetic oligonucleotide
gaaggaaatgtatgagaacttggcccctgcg

SEQ ID NO: 286088 - DNA, 31 bp, Artificial Sequence
  Description of Artificial Sequence: Synthetic oligonucleotide
aaggaaatgtatgagaacttggcccctgcgg

SEQ ID NO: 286089 - DNA, 30 bp, Artificial Sequence
  Description of Artificial Sequence: Synthetic oligonucleotide
aggaaatgtatgagaacttggcccctgcgg

SEQ ID NO: 286090 - DNA, 29 bp, Artificial Sequence
  Description of Artificial Sequence: Synthetic oligonucleotide
ggaaatgtatgagaacttggcccctgcgg

SEQ ID NO: 286091 - DNA, 30 bp, Artificial Sequence
  Description of Artificial Sequence: Synthetic oligonucleotide
gaaatgtatgagaacttggcccctgcggag

SEQ ID NO: 286092 - DNA, 35 bp, Artificial Sequence
  Description of Artificial Sequence: Synthetic oligonucleotide
aaatgtatgagaacttggcccctgcggagaataac

SEQ ID NO: 286093 - DNA, 34 bp, Artificial Sequence
  Description of Artificial Sequence: Synthetic oligonucleotide
aatgtatgagaacttggcccctgcggagaataac

SEQ ID NO: 286094 - DNA, 33 bp, Artificial Sequence
  Description of Artificial Sequence: Synthetic oligonucleotide
atgtatgagaacttggcccctgcggagaataac

SEQ ID NO: 286095 - DNA, 32 bp, Artificial Sequence
  Description of Artificial Sequence: Synthetic oligonucleotide
tgtatgagaacttggcccctgcggagaataac

SEQ ID NO: 286096 - DNA, 31 bp, Artificial Sequence
  Description of Artificial Sequence: Synthetic oligonucleotide
gtatgagaacttggcccctgcggagaataac

SEQ ID NO: 286097 - DNA, 31 bp, Artificial Sequence
  Description of Artificial Sequence: Synthetic oligonucleotide
tatgagaacttggcccctgcggagaataacc

SEQ ID NO: 286098 - DNA, 30 bp, Artificial Sequence
  Description of Artificial Sequence: Synthetic oligonucleotide
atgagaacttggcccctgcggagaataacc

SEQ ID NO: 286099 - DNA, 29 bp, Artificial Sequence
  Description of Artificial Sequence: Synthetic oligonucleotide
tgagaacttggcccctgcggagaataacc

SEQ ID NO: 286100 - DNA, 28 bp, Artificial Sequence
  Description of Artificial Sequence: Synthetic oligonucleotide
gagaacttggcccctgcggagaataacc

SEQ ID NO: 286101 - DNA, 28 bp, Artificial Sequence
  Description of Artificial Sequence: Synthetic oligonucleotide
agaacttggcccctgcggagaataaccg

SEQ ID NO: 286102 - DNA, 27 bp, Artificial Sequence
  Description of Artificial Sequence: Synthetic oligonucleotide
gaacttggcccctgcggagaataaccg

SEQ ID NO: 286103 - DNA, 31 bp, Artificial Sequence
  Description of Artificial Sequence: Synthetic oligonucleotide
aacttggcccctgcggagaataaccgttttg

SEQ ID NO: 286104 - DNA, 30 bp, Artificial Sequence
  Description of Artificial Sequence: Synthetic oligonucleotide
acttggcccctgcggagaataaccgttttg

SEQ ID NO: 286105 - DNA, 29 bp, Artificial Sequence
  Description of Artificial Sequence: Synthetic oligonucleotide
cttggcccctgcggagaataaccgttttg

SEQ ID NO: 286106 - DNA, 29 bp, Artificial Sequence
  Description of Artificial Sequence: Synthetic oligonucleotide
ttggcccctgcggagaataaccgttttgc

SEQ ID NO: 286107 - DNA, 28 bp, Artificial Sequence
  Description of Artificial Sequence: Synthetic oligonucleotide
tggcccctgcggagaataaccgttttgc

SEQ ID NO: 286108 - DNA, 27 bp, Artificial Sequence
  Description of Artificial Sequence: Synthetic oligonucleotide
ggcccctgcggagaataaccgttttgc

SEQ ID NO: 286109 - DNA, 28 bp, Artificial Sequence
  Description of Artificial Sequence: Synthetic oligonucleotide
gcccctgcggagaataaccgttttgctc

SEQ ID NO: 286110 - DNA, 28 bp, Artificial Sequence
  Description of Artificial Sequence: Synthetic oligonucleotide
cccctgcggagaataaccgttttgctcc

SEQ ID NO: 286111 - DNA, 29 bp, Artificial Sequence
  Description of Artificial Sequence: Synthetic oligonucleotide
ccctgcggagaataaccgttttgctcctg

SEQ ID NO: 286112 - DNA, 30 bp, Artificial Sequence
  Description of Artificial Sequence: Synthetic oligonucleotide
cctgcggagaataaccgttttgctcctgac

SEQ ID NO: 286113 - DNA, 32 bp, Artificial Sequence
  Description of Artificial Sequence: Synthetic oligonucleotide
ctgcggagaataaccgttttgctcctgacatc

SEQ ID NO: 286114 - DNA, 34 bp, Artificial Sequence
  Description of Artificial Sequence: Synthetic oligonucleotide
tgcggagaataaccgttttgctcctgacatcaac

SEQ ID NO: 286115 - DNA, 33 bp, Artificial Sequence
  Description of Artificial Sequence: Synthetic oligonucleotide
gcggagaataaccgttttgctcctgacatcaac

SEQ ID NO: 286116 - DNA, 34 bp, Artificial Sequence
  Description of Artificial Sequence: Synthetic oligonucleotide
cggagaataaccgttttgctcctgacatcaactc

SEQ ID NO: 286117 - DNA, 34 bp, Artificial Sequence
  Description of Artificial Sequence: Synthetic oligonucleotide
ggagaataaccgttttgctcctgacatcaactcc

SEQ ID NO: 286118 - DNA, 34 bp, Artificial Sequence
  Description of Artificial Sequence: Synthetic oligonucleotide
gagaataaccgttttgctcctgacatcaactccg

SEQ ID NO: 286119 - DNA, 38 bp, Artificial Sequence
  Description of Artificial Sequence: Synthetic oligonucleotide
agaataaccgttttgctcctgacatcaactccgttttc

SEQ ID NO: 286120 - DNA, 37 bp, Artificial Sequence
  Description of Artificial Sequence: Synthetic oligonucleotide
gaataaccgttttgctcctgacatcaactccgttttc

SEQ ID NO: 286121 - DNA, 37 bp, Artificial Sequence
  Description of Artificial Sequence: Synthetic oligonucleotide
aataaccgttttgctcctgacatcaactccgttttcg

SEQ ID NO: 286122 - DNA, 36 bp, Artificial Sequence
  Description of Artificial Sequence: Synthetic oligonucleotide
ataaccgttttgctcctgacatcaactccgttttcg

SEQ ID NO: 286123 - DNA, 35 bp, Artificial Sequence
  Description of Artificial Sequence: Synthetic oligonucleotide
taaccgttttgctcctgacatcaactccgttttcg

SEQ ID NO: 286124 - DNA, 34 bp, Artificial Sequence
  Description of Artificial Sequence: Synthetic oligonucleotide
aaccgttttgctcctgacatcaactccgttttcg

SEQ ID NO: 286125 - DNA, 33 bp, Artificial Sequence
  Description of Artificial Sequence: Synthetic oligonucleotide
accgttttgctcctgacatcaactccgttttcg

SEQ ID NO: 286126 - DNA, 32 bp, Artificial Sequence
  Description of Artificial Sequence: Synthetic oligonucleotide
ccgttttgctcctgacatcaactccgttttcg

SEQ ID NO: 286127 - DNA, 32 bp, Artificial Sequence
  Description of Artificial Sequence: Synthetic oligonucleotide
cgttttgctcctgacatcaactccgttttcgc

SEQ ID NO: 286128 - DNA, 32 bp, Artificial Sequence
  Description of Artificial Sequence: Synthetic oligonucleotide
gttttgctcctgacatcaactccgttttcgcc

SEQ ID NO: 286129 - DNA, 34 bp, Artificial Sequence
  Description of Artificial Sequence: Synthetic oligonucleotide
ttttgctcctgacatcaactccgttttcgccatg

SEQ ID NO: 286130 - DNA, 33 bp, Artificial Sequence
  Description of Artificial Sequence: Synthetic oligonucleotide
tttgctcctgacatcaactccgttttcgccatg

SEQ ID NO: 286131 - DNA, 32 bp, Artificial Sequence
  Description of Artificial Sequence: Synthetic oligonucleotide
ttgctcctgacatcaactccgttttcgccatg

SEQ ID NO: 286132 - DNA, 31 bp, Artificial Sequence
  Description of Artificial Sequence: Synthetic oligonucleotide
tgctcctgacatcaactccgttttcgccatg

SEQ ID NO: 286133 - DNA, 30 bp, Artificial Sequence
  Description of Artificial Sequence: Synthetic oligonucleotide
gctcctgacatcaactccgttttcgccatg

SEQ ID NO: 286134 - DNA, 31 bp, Artificial Sequence
  Description of Artificial Sequence: Synthetic oligonucleotide
ctcctgacatcaactccgttttcgccatgac

SEQ ID NO: 286135 - DNA, 31 bp, Artificial Sequence
  Description of Artificial Sequence: Synthetic oligonucleotide
tcctgacatcaactccgttttcgccatgacc

SEQ ID NO: 286136 - DNA, 30 bp, Artificial Sequence
  Description of Artificial Sequence: Synthetic oligonucleotide
cctgacatcaactccgttttcgccatgacc

SEQ ID NO: 286137 - DNA, 32 bp, Artificial Sequence
  Description of Artificial Sequence: Synthetic oligonucleotide
ctgacatcaactccgttttcgccatgaccttg

SEQ ID NO: 286138 - DNA, 33 bp, Artificial Sequence
  Description of Artificial Sequence: Synthetic oligonucleotide
tgacatcaactccgttttcgccatgaccttgag

SEQ ID NO: 286139 - DNA, 32 bp, Artificial Sequence
  Description of Artificial Sequence: Synthetic oligonucleotide
gacatcaactccgttttcgccatgaccttgag

SEQ ID NO: 286140 - DNA, 33 bp, Artificial Sequence
  Description of Artificial Sequence: Synthetic oligonucleotide
acatcaactccgttttcgccatgaccttgagtg

SEQ ID NO: 286141 - DNA, 32 bp, Artificial Sequence
  Description of Artificial Sequence: Synthetic oligonucleotide
catcaactccgttttcgccatgaccttgagtg

SEQ ID NO: 286142 - DNA, 32 bp, Artificial Sequence
  Description of Artificial Sequence: Synthetic oligonucleotide
atcaactccgttttcgccatgaccttgagtgg

SEQ ID NO: 286143 - DNA, 31 bp, Artificial Sequence
  Description of Artificial Sequence: Synthetic oligonucleotide
tcaactccgttttcgccatgaccttgagtgg

SEQ ID NO: 286144 - DNA, 30 bp, Artificial Sequence
  Description of Artificial Sequence: Synthetic oligonucleotide
caactccgttttcgccatgaccttgagtgg

SEQ ID NO: 286145 - DNA, 30 bp, Artificial Sequence
  Description of Artificial Sequence: Synthetic oligonucleotide
aactccgttttcgccatgaccttgagtggg

SEQ ID NO: 286146 - DNA, 29 bp, Artificial Sequence
  Description of Artificial Sequence: Synthetic oligonucleotide
actccgttttcgccatgaccttgagtggg

SEQ ID NO: 286147 - DNA, 28 bp, Artificial Sequence
  Description of Artificial Sequence: Synthetic oligonucleotide
ctccgttttcgccatgaccttgagtggg

SEQ ID NO: 286148 - DNA, 28 bp, Artificial Sequence
  Description of Artificial Sequence: Synthetic oligonucleotide
tccgttttcgccatgaccttgagtgggg

SEQ ID NO: 286149 - DNA, 27 bp, Artificial Sequence
  Description of Artificial Sequence: Synthetic oligonucleotide
ccgttttcgccatgaccttgagtgggg

SEQ ID NO: 286150 - DNA, 28 bp, Artificial Sequence
  Description of Artificial Sequence: Synthetic oligonucleotide
cgttttcgccatgaccttgagtggggtg

SEQ ID NO: 286151 - DNA, 28 bp, Artificial Sequence
  Description of Artificial Sequence: Synthetic oligonucleotide
gttttcgccatgaccttgagtggggtgc

SEQ ID NO: 286152 - DNA, 28 bp, Artificial Sequence
  Description of Artificial Sequence: Synthetic oligonucleotide
ttttcgccatgaccttgagtggggtgcg

SEQ ID NO: 286153 - DNA, 27 bp, Artificial Sequence
  Description of Artificial Sequence: Synthetic oligonucleotide
tttcgccatgaccttgagtggggtgcg

SEQ ID NO: 286154 - DNA, 27 bp, Artificial Sequence
  Description of Artificial Sequence: Synthetic oligonucleotide
ttcgccatgaccttgagtggggtgcgt

SEQ ID NO: 286155 - DNA, 26 bp, Artificial Sequence
  Description of Artificial Sequence: Synthetic oligonucleotide
tcgccatgaccttgagtggggtgcgt

SEQ ID NO: 286156 - DNA, 25 bp, Artificial Sequence
  Description of Artificial Sequence: Synthetic oligonucleotide
cgccatgaccttgagtggggtgcgt

SEQ ID NO: 286157 - DNA, 26 bp, Artificial Sequence
  Description of Artificial Sequence: Synthetic oligonucleotide
gccatgaccttgagtggggtgcgtga

SEQ ID NO: 286158 - DNA, 27 bp, Artificial Sequence
  Description of Artificial Sequence: Synthetic oligonucleotide
ccatgaccttgagtggggtgcgtgagt

SEQ ID NO: 286159 - DNA, 27 bp, Artificial Sequence
  Description of Artificial Sequence: Synthetic oligonucleotide
catgaccttgagtggggtgcgtgagtg

SEQ ID NO: 286160 - DNA, 27 bp, Artificial Sequence
  Description of Artificial Sequence: Synthetic oligonucleotide
atgaccttgagtggggtgcgtgagtgg

SEQ ID NO: 286161 - DNA, 26 bp, Artificial Sequence
  Description of Artificial Sequence: Synthetic oligonucleotide
tgaccttgagtggggtgcgtgagtgg

SEQ ID NO: 286162 - DNA, 25 bp, Artificial Sequence
  Description of Artificial Sequence: Synthetic oligonucleotide
gaccttgagtggggtgcgtgagtgg

SEQ ID NO: 286163 - DNA, 26 bp, Artificial Sequence
  Description of Artificial Sequence: Synthetic oligonucleotide
accttgagtggggtgcgtgagtggct

SEQ ID NO: 286164 - DNA, 25 bp, Artificial Sequence
  Description of Artificial Sequence: Synthetic oligonucleotide
ccttgagtggggtgcgtgagtggct

SEQ ID NO: 286165 - DNA, 27 bp, Artificial Sequence
  Description of Artificial Sequence: Synthetic oligonucleotide
cttgagtggggtgcgtgagtggctcaa

SEQ ID NO: 286166 - DNA, 27 bp, Artificial Sequence
  Description of Artificial Sequence: Synthetic oligonucleotide
ttgagtggggtgcgtgagtggctcaag

SEQ ID NO: 286167 - DNA, 27 bp, Artificial Sequence
  Description of Artificial Sequence: Synthetic oligonucleotide
tgagtggggtgcgtgagtggctcaagt

SEQ ID NO: 286168 - DNA, 27 bp, Artificial Sequence
  Description of Artificial Sequence: Synthetic oligonucleotide
gagtggggtgcgtgagtggctcaagta

SEQ ID NO: 286169 - DNA, 28 bp, Artificial Sequence
  Description of Artificial Sequence: Synthetic oligonucleotide
agtggggtgcgtgagtggctcaagtatg

SEQ ID NO: 286170 - DNA, 27 bp, Artificial Sequence
  Description of Artificial Sequence: Synthetic oligonucleotide
gtggggtgcgtgagtggctcaagtatg

SEQ ID NO: 286171 - DNA, 27 bp, Artificial Sequence
  Description of Artificial Sequence: Synthetic oligonucleotide
tggggtgcgtgagtggctcaagtatgg

SEQ ID NO: 286172 - DNA, 26 bp, Artificial Sequence
  Description of Artificial Sequence: Synthetic oligonucleotide
ggggtgcgtgagtggctcaagtatgg

SEQ ID NO: 286173 - DNA, 26 bp, Artificial Sequence
  Description of Artificial Sequence: Synthetic oligonucleotide
gggtgcgtgagtggctcaagtatggg

SEQ ID NO: 286174 - DNA, 27 bp, Artificial Sequence
  Description of Artificial Sequence: Synthetic oligonucleotide
ggtgcgtgagtggctcaagtatgggct

SEQ ID NO: 286175 - DNA, 28 bp, Artificial Sequence
  Description of Artificial Sequence: Synthetic oligonucleotide
gtgcgtgagtggctcaagtatgggctag

SEQ ID NO: 286176 - DNA, 29 bp, Artificial Sequence
  Description of Artificial Sequence: Synthetic oligonucleotide
tgcgtgagtggctcaagtatgggctagtg

SEQ ID NO: 286177 - DNA, 28 bp, Artificial Sequence
  Description of Artificial Sequence: Synthetic oligonucleotide
gcgtgagtggctcaagtatgggctagtg

SEQ ID NO: 286178 - DNA, 28 bp, Artificial Sequence
  Description of Artificial Sequence: Synthetic oligonucleotide
cgtgagtggctcaagtatgggctagtgg

SEQ ID NO: 286179 - DNA, 28 bp, Artificial Sequence
  Description of Artificial Sequence: Synthetic oligonucleotide
gtgagtggctcaagtatgggctagtggc

SEQ ID NO: 286180 - DNA, 28 bp, Artificial Sequence
  Description of Artificial Sequence: Synthetic oligonucleotide
tgagtggctcaagtatgggctagtggcc

SEQ ID NO: 286181 - DNA, 27 bp, Artificial Sequence
  Description of Artificial Sequence: Synthetic oligonucleotide
gagtggctcaagtatgggctagtggcc

SEQ ID NO: 286182 - DNA, 28 bp, Artificial Sequence
  Description of Artificial Sequence: Synthetic oligonucleotide
agtggctcaagtatgggctagtggcctc

SEQ ID NO: 286183 - DNA, 27 bp, Artificial Sequence
  Description of Artificial Sequence: Synthetic oligonucleotide
gtggctcaagtatgggctagtggcctc

SEQ ID NO: 286184 - DNA, 27 bp, Artificial Sequence
  Description of Artificial Sequence: Synthetic oligonucleotide
tggctcaagtatgggctagtggcctcc

SEQ ID NO: 286185 - DNA, 26 bp, Artificial Sequence
  Description of Artificial Sequence: Synthetic oligonucleotide
ggctcaagtatgggctagtggcctcc

SEQ ID NO: 286186 - DNA, 27 bp, Artificial Sequence
  Description of Artificial Sequence: Synthetic oligonucleotide
gctcaagtatgggctagtggcctccca

SEQ ID NO: 286187 - DNA, 27 bp, Artificial Sequence
  Description of Artificial Sequence: Synthetic oligonucleotide
ctcaagtatgggctagtggcctcccag

SEQ ID NO: 286188 - DNA, 27 bp, Artificial Sequence
  Description of Artificial Sequence: Synthetic oligonucleotide
tcaagtatgggctagtggcctcccagg

SEQ ID NO: 286189 - DNA, 27 bp, Artificial Sequence
  Description of Artificial Sequence: Synthetic oligonucleotide
caagtatgggctagtggcctcccagga

SEQ ID NO: 286190 - DNA, 27 bp, Artificial Sequence
  Description of Artificial Sequence: Synthetic oligonucleotide
aagtatgggctagtggcctcccaggac

SEQ ID NO: 286191 - DNA, 26 bp, Artificial Sequence
  Description of Artificial Sequence: Synthetic oligonucleotide
agtatgggctagtggcctcccaggac

SEQ ID NO: 286192 - DNA, 25 bp, Artificial Sequence
  Description of Artificial Sequence: Synthetic oligonucleotide
gtatgggctagtggcctcccaggac

SEQ ID NO: 286193 - DNA, 27 bp, Artificial Sequence
  Description of Artificial Sequence: Synthetic oligonucleotide
tatgggctagtggcctcccaggacgaa

SEQ ID NO: 286194 - DNA, 27 bp, Artificial Sequence
  Description of Artificial Sequence: Synthetic oligonucleotide
atgggctagtggcctcccaggacgaat

SEQ ID NO: 286195 - DNA, 27 bp, Artificial Sequence
  Description of Artificial Sequence: Synthetic oligonucleotide
tgggctagtggcctcccaggacgaatt

SEQ ID NO: 286196 - DNA, 26 bp, Artificial Sequence
  Description of Artificial Sequence: Synthetic oligonucleotide
gggctagtggcctcccaggacgaatt

SEQ ID NO: 286197 - DNA, 26 bp, Artificial Sequence
  Description of Artificial Sequence: Synthetic oligonucleotide
ggctagtggcctcccaggacgaattg

SEQ ID NO: 286198 - DNA, 26 bp, Artificial Sequence
  Description of Artificial Sequence: Synthetic oligonucleotide
gctagtggcctcccaggacgaattgg

SEQ ID NO: 286199 - DNA, 27 bp, Artificial Sequence
  Description of Artificial Sequence: Synthetic oligonucleotide
ctagtggcctcccaggacgaattggca

SEQ ID NO: 286200 - DNA, 28 bp, Artificial Sequence
  Description of Artificial Sequence: Synthetic oligonucleotide
tagtggcctcccaggacgaattggcaac

SEQ ID NO: 286201 - DNA, 27 bp, Artificial Sequence
  Description of Artificial Sequence: Synthetic oligonucleotide
agtggcctcccaggacgaattggcaac

SEQ ID NO: 286202 - DNA, 27 bp, Artificial Sequence
  Description of Artificial Sequence: Synthetic oligonucleotide
gtggcctcccaggacgaattggcaaca

SEQ ID NO: 286203 - DNA, 28 bp, Artificial Sequence
  Description of Artificial Sequence: Synthetic oligonucleotide
tggcctcccaggacgaattggcaacatg

SEQ ID NO: 286204 - DNA, 27 bp, Artificial Sequence
  Description of Artificial Sequence: Synthetic oligonucleotide
ggcctcccaggacgaattggcaacatg

SEQ ID NO: 286205 - DNA, 27 bp, Artificial Sequence
  Description of Artificial Sequence: Synthetic oligonucleotide
gcctcccaggacgaattggcaacatgg

SEQ ID NO: 286206 - DNA, 27 bp, Artificial Sequence
  Description of Artificial Sequence: Synthetic oligonucleotide
cctcccaggacgaattggcaacatggg

SEQ ID NO: 286207 - DNA, 27 bp, Artificial Sequence
  Description of Artificial Sequence: Synthetic oligonucleotide
ctcccaggacgaattggcaacatgggg

SEQ ID NO: 286208 - DNA, 28 bp, Artificial Sequence
  Description of Artificial Sequence: Synthetic oligonucleotide
tcccaggacgaattggcaacatggggtc

SEQ ID NO: 286209 - DNA, 27 bp, Artificial Sequence
  Description of Artificial Sequence: Synthetic oligonucleotide
cccaggacgaattggcaacatggggtc

SEQ ID NO: 286210 - DNA, 29 bp, Artificial Sequence
  Description of Artificial Sequence: Synthetic oligonucleotide
ccaggacgaattggcaacatggggtcttg

SEQ ID NO: 286211 - DNA, 30 bp, Artificial Sequence
  Description of Artificial Sequence: Synthetic oligonucleotide
caggacgaattggcaacatggggtcttgag

SEQ ID NO: 286212 - DNA, 33 bp, Artificial Sequence
  Description of Artificial Sequence: Synthetic oligonucleotide
aggacgaattggcaacatggggtcttgagtatg

SEQ ID NO: 286213 - DNA, 32 bp, Artificial Sequence
  Description of Artificial Sequence: Synthetic oligonucleotide
ggacgaattggcaacatggggtcttgagtatg

SEQ ID NO: 286214 - DNA, 33 bp, Artificial Sequence
  Description of Artificial Sequence: Synthetic oligonucleotide
gacgaattggcaacatggggtcttgagtatgtg

SEQ ID NO: 286215 - DNA, 34 bp, Artificial Sequence
  Description of Artificial Sequence: Synthetic oligonucleotide
acgaattggcaacatggggtcttgagtatgtgag

SEQ ID NO: 286216 - DNA, 33 bp, Artificial Sequence
  Description of Artificial Sequence: Synthetic oligonucleotide
cgaattggcaacatggggtcttgagtatgtgag

SEQ ID NO: 286217 - DNA, 33 bp, Artificial Sequence
  Description of Artificial Sequence: Synthetic oligonucleotide
gaattggcaacatggggtcttgagtatgtgagg

SEQ ID NO: 286218 - DNA, 33 bp, Artificial Sequence
  Description of Artificial Sequence: Synthetic oligonucleotide
aattggcaacatggggtcttgagtatgtgaggc

SEQ ID NO: 286219 - DNA, 32 bp, Artificial Sequence
  Description of Artificial Sequence: Synthetic oligonucleotide
attggcaacatggggtcttgagtatgtgaggc

SEQ ID NO: 286220 - DNA, 31 bp, Artificial Sequence
  Description of Artificial Sequence: Synthetic oligonucleotide
ttggcaacatggggtcttgagtatgtgaggc

SEQ ID NO: 286221 - DNA, 30 bp, Artificial Sequence
  Description of Artificial Sequence: Synthetic oligonucleotide
tggcaacatggggtcttgagtatgtgaggc

SEQ ID NO: 286222 - DNA, 29 bp, Artificial Sequence
  Description of Artificial Sequence: Synthetic oligonucleotide
ggcaacatggggtcttgagtatgtgaggc

SEQ ID NO: 286223 - DNA, 31 bp, Artificial Sequence
  Description of Artificial Sequence: Synthetic oligonucleotide
gcaacatggggtcttgagtatgtgaggcatc

SEQ ID NO: 286224 - DNA, 32 bp, Artificial Sequence
  Description of Artificial Sequence: Synthetic oligonucleotide
caacatggggtcttgagtatgtgaggcatctg

SEQ ID NO: 286225 - DNA, 32 bp, Artificial Sequence
  Description of Artificial Sequence: Synthetic oligonucleotide
aacatggggtcttgagtatgtgaggcatctgc

SEQ ID NO: 286226 - DNA, 31 bp, Artificial Sequence
  Description of Artificial Sequence: Synthetic oligonucleotide
acatggggtcttgagtatgtgaggcatctgc

SEQ ID NO: 286227 - DNA, 30 bp, Artificial Sequence
  Description of Artificial Sequence: Synthetic oligonucleotide
catggggtcttgagtatgtgaggcatctgc

SEQ ID NO: 286228 - DNA, 30 bp, Artificial Sequence
  Description of Artificial Sequence: Synthetic oligonucleotide
atggggtcttgagtatgtgaggcatctgcc

SEQ ID NO: 286229 - DNA, 29 bp, Artificial Sequence
  Description of Artificial Sequence: Synthetic oligonucleotide
tggggtcttgagtatgtgaggcatctgcc

SEQ ID NO: 286230 - DNA, 28 bp, Artificial Sequence
  Description of Artificial Sequence: Synthetic oligonucleotide
ggggtcttgagtatgtgaggcatctgcc

SEQ ID NO: 286231 - DNA, 29 bp, Artificial Sequence
  Description of Artificial Sequence: Synthetic oligonucleotide
gggtcttgagtatgtgaggcatctgccag

SEQ ID NO: 286232 - DNA, 29 bp, Artificial Sequence
  Description of Artificial Sequence: Synthetic oligonucleotide
ggtcttgagtatgtgaggcatctgccagg

SEQ ID NO: 286233 - DNA, 30 bp, Artificial Sequence
  Description of Artificial Sequence: Synthetic oligonucleotide
gtcttgagtatgtgaggcatctgccaggag

SEQ ID NO: 286234 - DNA, 32 bp, Artificial Sequence
  Description of Artificial Sequence: Synthetic oligonucleotide
tcttgagtatgtgaggcatctgccaggagaag

SEQ ID NO: 286235 - DNA, 31 bp, Artificial Sequence
  Description of Artificial Sequence: Synthetic oligonucleotide
cttgagtatgtgaggcatctgccaggagaag

SEQ ID NO: 286236 - DNA, 32 bp, Artificial Sequence
  Description of Artificial Sequence: Synthetic oligonucleotide
ttgagtatgtgaggcatctgccaggagaagag

SEQ ID NO: 286237 - DNA, 31 bp, Artificial Sequence
  Description of Artificial Sequence: Synthetic oligonucleotide
tgagtatgtgaggcatctgccaggagaagag

SEQ ID NO: 286238 - DNA, 30 bp, Artificial Sequence
  Description of Artificial Sequence: Synthetic oligonucleotide
gagtatgtgaggcatctgccaggagaagag

SEQ ID NO: 286239 - DNA, 30 bp, Artificial Sequence
  Description of Artificial Sequence: Synthetic oligonucleotide
agtatgtgaggcatctgccaggagaagagg

SEQ ID NO: 286240 - DNA, 29 bp, Artificial Sequence
  Description of Artificial Sequence: Synthetic oligonucleotide
gtatgtgaggcatctgccaggagaagagg

SEQ ID NO: 286241 - DNA, 29 bp, Artificial Sequence
  Description of Artificial Sequence: Synthetic oligonucleotide
tatgtgaggcatctgccaggagaagaggc

SEQ ID NO: 286242 - DNA, 28 bp, Artificial Sequence
  Description of Artificial Sequence: Synthetic oligonucleotide
atgtgaggcatctgccaggagaagaggc

SEQ ID NO: 286243 - DNA, 27 bp, Artificial Sequence
  Description of Artificial Sequence: Synthetic oligonucleotide
tgtgaggcatctgccaggagaagaggc

SEQ ID NO: 286244 - DNA, 27 bp, Artificial Sequence
  Description of Artificial Sequence: Synthetic oligonucleotide
gtgaggcatctgccaggagaagaggct

SEQ ID NO: 286245 - DNA, 29 bp, Artificial Sequence
  Description of Artificial Sequence: Synthetic oligonucleotide
tgaggcatctgccaggagaagaggctaag

SEQ ID NO: 286246 - DNA, 28 bp, Artificial Sequence
  Description of Artificial Sequence: Synthetic oligonucleotide
gaggcatctgccaggagaagaggctaag

SEQ ID NO: 286247 - DNA, 28 bp, Artificial Sequence
  Description of Artificial Sequence: Synthetic oligonucleotide
aggcatctgccaggagaagaggctaagg

SEQ ID NO: 286248 - DNA, 27 bp, Artificial Sequence
  Description of Artificial Sequence: Synthetic oligonucleotide
ggcatctgccaggagaagaggctaagg

SEQ ID NO: 286249 - DNA, 28 bp, Artificial Sequence
  Description of Artificial Sequence: Synthetic oligonucleotide
gcatctgccaggagaagaggctaaggac

SEQ ID NO: 286250 - DNA, 29 bp, Artificial Sequence
  Description of Artificial Sequence: Synthetic oligonucleotide
catctgccaggagaagaggctaaggactg

SEQ ID NO: 286251 - DNA, 29 bp, Artificial Sequence
  Description of Artificial Sequence: Synthetic oligonucleotide
atctgccaggagaagaggctaaggactgg

SEQ ID NO: 286252 - DNA, 28 bp, Artificial Sequence
  Description of Artificial Sequence: Synthetic oligonucleotide
tctgccaggagaagaggctaaggactgg

SEQ ID NO: 286253 - DNA, 27 bp, Artificial Sequence
  Description of Artificial Sequence: Synthetic oligonucleotide
ctgccaggagaagaggctaaggactgg

SEQ ID NO: 286254 - DNA, 27 bp, Artificial Sequence
  Description of Artificial Sequence: Synthetic oligonucleotide
tgccaggagaagaggctaaggactggc

SEQ ID NO: 286255 - DNA, 27 bp, Artificial Sequence
  Description of Artificial Sequence: Synthetic oligonucleotide
gccaggagaagaggctaaggactggca

SEQ ID NO: 286256 - DNA, 27 bp, Artificial Sequence
  Description of Artificial Sequence: Synthetic oligonucleotide
ccaggagaagaggctaaggactggcag

SEQ ID NO: 286257 - DNA, 27 bp, Artificial Sequence
  Description of Artificial Sequence: Synthetic oligonucleotide
caggagaagaggctaaggactggcagg

SEQ ID NO: 286258 - DNA, 28 bp, Artificial Sequence
  Description of Artificial Sequence: Synthetic oligonucleotide
aggagaagaggctaaggactggcaggag

SEQ ID NO: 286259 - DNA, 27 bp, Artificial Sequence
  Description of Artificial Sequence: Synthetic oligonucleotide
ggagaagaggctaaggactggcaggag

SEQ ID NO: 286260 - DNA, 27 bp, Artificial Sequence
  Description of Artificial Sequence: Synthetic oligonucleotide
gagaagaggctaaggactggcaggagg

SEQ ID NO: 286261 - DNA, 28 bp, Artificial Sequence
  Description of Artificial Sequence: Synthetic oligonucleotide
agaagaggctaaggactggcaggaggtg

SEQ ID NO: 286262 - DNA, 27 bp, Artificial Sequence
  Description of Artificial Sequence: Synthetic oligonucleotide
gaagaggctaaggactggcaggaggtg

SEQ ID NO: 286263 - DNA, 27 bp, Artificial Sequence
  Description of Artificial Sequence: Synthetic oligonucleotide
aagaggctaaggactggcaggaggtgg

SEQ ID NO: 286264 - DNA, 27 bp, Artificial Sequence
  Description of Artificial Sequence: Synthetic oligonucleotide
agaggctaaggactggcaggaggtgga

SEQ ID NO: 286265 - DNA, 27 bp, Artificial Sequence
  Description of Artificial Sequence: Synthetic oligonucleotide
gaggctaaggactggcaggaggtggat

SEQ ID NO: 286266 - DNA, 27 bp, Artificial Sequence
  Description of Artificial Sequence: Synthetic oligonucleotide
aggctaaggactggcaggaggtggatg

SEQ ID NO: 286267 - DNA, 27 bp, Artificial Sequence
  Description of Artificial Sequence: Synthetic oligonucleotide
ggctaaggactggcaggaggtggatga

SEQ ID NO: 286268 - DNA, 27 bp, Artificial Sequence
  Description of Artificial Sequence: Synthetic oligonucleotide
gctaaggactggcaggaggtggatgac

SEQ ID NO: 286269 - DNA, 27 bp, Artificial Sequence
  Description of Artificial Sequence: Synthetic oligonucleotide
ctaaggactggcaggaggtggatgacg

SEQ ID NO: 286270 - DNA, 27 bp, Artificial Sequence
  Description of Artificial Sequence: Synthetic oligonucleotide
taaggactggcaggaggtggatgacgg

SEQ ID NO: 286271 - DNA, 27 bp, Artificial Sequence
  Description of Artificial Sequence: Synthetic oligonucleotide
aaggactggcaggaggtggatgacgga

SEQ ID NO: 286272 - DNA, 26 bp, Artificial Sequence
  Description of Artificial Sequence: Synthetic oligonucleotide
aggactggcaggaggtggatgacgga

SEQ ID NO: 286273 - DNA, 25 bp, Artificial Sequence
  Description of Artificial Sequence: Synthetic oligonucleotide
ggactggcaggaggtggatgacgga

SEQ ID NO: 286274 - DNA, 26 bp, Artificial Sequence
  Description of Artificial Sequence: Synthetic oligonucleotide
gactggcaggaggtggatgacggaga

SEQ ID NO: 286275 - DNA, 27 bp, Artificial Sequence
  Description of Artificial Sequence: Synthetic oligonucleotide
actggcaggaggtggatgacggagaga

SEQ ID NO: 286276 - DNA, 27 bp, Artificial Sequence
  Description of Artificial Sequence: Synthetic oligonucleotide
ctggcaggaggtggatgacggagagaa

SEQ ID NO: 286277 - DNA, 27 bp, Artificial Sequence
  Description of Artificial Sequence: Synthetic oligonucleotide
tggcaggaggtggatgacggagagaag

SEQ ID NO: 286278 - DNA, 26 bp, Artificial Sequence
  Description of Artificial Sequence: Synthetic oligonucleotide
ggcaggaggtggatgacggagagaag

SEQ ID NO: 286279 - DNA, 27 bp, Artificial Sequence
  Description of Artificial Sequence: Synthetic oligonucleotide
gcaggaggtggatgacggagagaaggt

SEQ ID NO: 286280 - DNA, 27 bp, Artificial Sequence
  Description of Artificial Sequence: Synthetic oligonucleotide
caggaggtggatgacggagagaaggtg

SEQ ID NO: 286281 - DNA, 27 bp, Artificial Sequence
  Description of Artificial Sequence: Synthetic oligonucleotide
aggaggtggatgacggagagaaggtgc

SEQ ID NO: 286282 - DNA, 27 bp, Artificial Sequence
  Description of Artificial Sequence: Synthetic oligonucleotide
ggaggtggatgacggagagaaggtgca

SEQ ID NO: 286283 - DNA, 27 bp, Artificial Sequence
  Description of Artificial Sequence: Synthetic oligonucleotide
gaggtggatgacggagagaaggtgcag

SEQ ID NO: 286284 - DNA, 27 bp, Artificial Sequence
  Description of Artificial Sequence: Synthetic oligonucleotide
aggtggatgacggagagaaggtgcagc

SEQ ID NO: 286285 - DNA, 26 bp, Artificial Sequence
  Description of Artificial Sequence: Synthetic oligonucleotide
ggtggatgacggagagaaggtgcagc

SEQ ID NO: 286286 - DNA, 26 bp, Artificial Sequence
  Description of Artificial Sequence: Synthetic oligonucleotide
gtggatgacggagagaaggtgcagcg

SEQ ID NO: 286287 - DNA, 26 bp, Artificial Sequence
  Description of Artificial Sequence: Synthetic oligonucleotide
tggatgacggagagaaggtgcagcgg

SEQ ID NO: 286288 - DNA, 25 bp, Artificial Sequence
  Description of Artificial Sequence: Synthetic oligonucleotide
ggatgacggagagaaggtgcagcgg

SEQ ID NO: 286289 - DNA, 26 bp, Artificial Sequence
  Description of Artificial Sequence: Synthetic oligonucleotide
gatgacggagagaaggtgcagcggga

SEQ ID NO: 286290 - DNA, 26 bp, Artificial Sequence
  Description of Artificial Sequence: Synthetic oligonucleotide
atgacggagagaaggtgcagcgggag

SEQ ID NO: 286291 - DNA, 25 bp, Artificial Sequence
  Description of Artificial Sequence: Synthetic oligonucleotide
tgacggagagaaggtgcagcgggag

SEQ ID NO: 286292 - DNA, 24 bp, Artificial Sequence
  Description of Artificial Sequence: Synthetic oligonucleotide
gacggagagaaggtgcagcgggag

SEQ ID NO: 286293 - DNA, 24 bp, Artificial Sequence
  Description of Artificial Sequence: Synthetic oligonucleotide
acggagagaaggtgcagcgggagg

SEQ ID NO: 286294 - DNA, 23 bp, Artificial Sequence
  Description of Artificial Sequence: Synthetic oligonucleotide
cggagagaaggtgcagcgggagg

SEQ ID NO: 286295 - DNA, 24 bp, Artificial Sequence
  Description of Artificial Sequence: Synthetic oligonucleotide
ggagagaaggtgcagcgggaggct

SEQ ID NO: 286296 - DNA, 25 bp, Artificial Sequence
  Description of Artificial Sequence: Synthetic oligonucleotide
gagagaaggtgcagcgggaggctct

SEQ ID NO: 286297 - DNA, 25 bp, Artificial Sequence
  Description of Artificial Sequence: Synthetic oligonucleotide
agagaaggtgcagcgggaggctctg

SEQ ID NO: 286298 - DNA, 24 bp, Artificial Sequence
  Description of Artificial Sequence: Synthetic oligonucleotide
gagaaggtgcagcgggaggctctg

SEQ ID NO: 286299 - DNA, 25 bp, Artificial Sequence
  Description of Artificial Sequence: Synthetic oligonucleotide
agaaggtgcagcgggaggctctgct

SEQ ID NO: 286300 - DNA, 24 bp, Artificial Sequence
  Description of Artificial Sequence: Synthetic oligonucleotide
gaaggtgcagcgggaggctctgct

SEQ ID NO: 286301 - DNA, 25 bp, Artificial Sequence
  Description of Artificial Sequence: Synthetic oligonucleotide
aaggtgcagcgggaggctctgctca

SEQ ID NO: 286302 - DNA, 24 bp, Artificial Sequence
  Description of Artificial Sequence: Synthetic oligonucleotide
aggtgcagcgggaggctctgctca

SEQ ID NO: 286303 - DNA, 23 bp, Artificial Sequence
  Description of Artificial Sequence: Synthetic oligonucleotide
ggtgcagcgggaggctctgctca

SEQ ID NO: 286304 - DNA, 24 bp, Artificial Sequence
  Description of Artificial Sequence: Synthetic oligonucleotide
gtgcagcgggaggctctgctcagt

SEQ ID NO: 286305 - DNA, 25 bp, Artificial Sequence
  Description of Artificial Sequence: Synthetic oligonucleotide
tgcagcgggaggctctgctcagtct

SEQ ID NO: 286306 - DNA, 24 bp, Artificial Sequence
  Description of Artificial Sequence: Synthetic oligonucleotide
gcagcgggaggctctgctcagtct

SEQ ID NO: 286307 - DNA, 24 bp, Artificial Sequence
  Description of Artificial Sequence: Synthetic oligonucleotide
cagcgggaggctctgctcagtctg

SEQ ID NO: 286308 - DNA, 25 bp, Artificial Sequence
  Description of Artificial Sequence: Synthetic oligonucleotide
agcgggaggctctgctcagtctggt

SEQ ID NO: 286309 - DNA, 24 bp, Artificial Sequence
  Description of Artificial Sequence: Synthetic oligonucleotide
gcgggaggctctgctcagtctggt

SEQ ID NO: 286310 - DNA, 26 bp, Artificial Sequence
  Description of Artificial Sequence: Synthetic oligonucleotide
cgggaggctctgctcagtctggtgaa

SEQ ID NO: 286311 - DNA, 26 bp, Artificial Sequence
  Description of Artificial Sequence: Synthetic oligonucleotide
gggaggctctgctcagtctggtgaac

SEQ ID NO: 286312 - DNA, 27 bp, Artificial Sequence
  Description of Artificial Sequence: Synthetic oligonucleotide
ggaggctctgctcagtctggtgaacga

SEQ ID NO: 286313 - DNA, 30 bp, Artificial Sequence
  Description of Artificial Sequence: Synthetic oligonucleotide
gaggctctgctcagtctggtgaacgaaatc

SEQ ID NO: 286314 - DNA, 30 bp, Artificial Sequence
  Description of Artificial Sequence: Synthetic oligonucleotide
aggctctgctcagtctggtgaacgaaatcg

SEQ ID NO: 286315 - DNA, 29 bp, Artificial Sequence
  Description of Artificial Sequence: Synthetic oligonucleotide
ggctctgctcagtctggtgaacgaaatcg

SEQ ID NO: 286316 - DNA, 30 bp, Artificial Sequence
  Description of Artificial Sequence: Synthetic oligonucleotide
gctctgctcagtctggtgaacgaaatcgtc

SEQ ID NO: 286317 - DNA, 30 bp, Artificial Sequence
  Description of Artificial Sequence: Synthetic oligonucleotide
ctctgctcagtctggtgaacgaaatcgtcg

SEQ ID NO: 286318 - DNA, 30 bp, Artificial Sequence
  Description of Artificial Sequence: Synthetic oligonucleotide
tctgctcagtctggtgaacgaaatcgtcgc

SEQ ID NO: 286319 - DNA, 29 bp, Artificial Sequence
  Description of Artificial Sequence: Synthetic oligonucleotide
ctgctcagtctggtgaacgaaatcgtcgc

SEQ ID NO: 286320 - DNA, 29 bp, Artificial Sequence
  Description of Artificial Sequence: Synthetic oligonucleotide
tgctcagtctggtgaacgaaatcgtcgcc

SEQ ID NO: 286321 - DNA, 28 bp, Artificial Sequence
  Description of Artificial Sequence: Synthetic oligonucleotide
gctcagtctggtgaacgaaatcgtcgcc

SEQ ID NO: 286322 - DNA, 33 bp, Artificial Sequence
  Description of Artificial Sequence: Synthetic oligonucleotide
ctcagtctggtgaacgaaatcgtcgcctataac

SEQ ID NO: 286323 - DNA, 35 bp, Artificial Sequence
  Description of Artificial Sequence: Synthetic oligonucleotide
tcagtctggtgaacgaaatcgtcgcctataacaag

SEQ ID NO: 286324 - DNA, 34 bp, Artificial Sequence
  Description of Artificial Sequence: Synthetic oligonucleotide
cagtctggtgaacgaaatcgtcgcctataacaag

SEQ ID NO: 286325 - DNA, 34 bp, Artificial Sequence
  Description of Artificial Sequence: Synthetic oligonucleotide
agtctggtgaacgaaatcgtcgcctataacaagg

SEQ ID NO: 286326 - DNA, 33 bp, Artificial Sequence
  Description of Artificial Sequence: Synthetic oligonucleotide
gtctggtgaacgaaatcgtcgcctataacaagg

SEQ ID NO: 286327 - DNA, 33 bp, Artificial Sequence
  Description of Artificial Sequence: Synthetic oligonucleotide
tctggtgaacgaaatcgtcgcctataacaaggc

SEQ ID NO: 286328 - DNA, 32 bp, Artificial Sequence
  Description of Artificial Sequence: Synthetic oligonucleotide
ctggtgaacgaaatcgtcgcctataacaaggc

SEQ ID NO: 286329 - DNA, 32 bp, Artificial Sequence
  Description of Artificial Sequence: Synthetic oligonucleotide
tggtgaacgaaatcgtcgcctataacaaggcc

SEQ ID NO: 286330 - DNA, 31 bp, Artificial Sequence
  Description of Artificial Sequence: Synthetic oligonucleotide
ggtgaacgaaatcgtcgcctataacaaggcc

SEQ ID NO: 286331 - DNA, 31 bp, Artificial Sequence
  Description of Artificial Sequence: Synthetic oligonucleotide
gtgaacgaaatcgtcgcctataacaaggccc

SEQ ID NO: 286332 - DNA, 32 bp, Artificial Sequence
  Description of Artificial Sequence: Synthetic oligonucleotide
tgaacgaaatcgtcgcctataacaaggcccac

SEQ ID NO: 286333 - DNA, 31 bp, Artificial Sequence
  Description of Artificial Sequence: Synthetic oligonucleotide
gaacgaaatcgtcgcctataacaaggcccac

SEQ ID NO: 286334 - DNA, 34 bp, Artificial Sequence
  Description of Artificial Sequence: Synthetic oligonucleotide
aacgaaatcgtcgcctataacaaggcccacaaag

SEQ ID NO: 286335 - DNA, 33 bp, Artificial Sequence
  Description of Artificial Sequence: Synthetic oligonucleotide
acgaaatcgtcgcctataacaaggcccacaaag

SEQ ID NO: 286336 - DNA, 32 bp, Artificial Sequence
  Description of Artificial Sequence: Synthetic oligonucleotide
cgaaatcgtcgcctataacaaggcccacaaag

SEQ ID NO: 286337 - DNA, 32 bp, Artificial Sequence
  Description of Artificial Sequence: Synthetic oligonucleotide
gaaatcgtcgcctataacaaggcccacaaagc

SEQ ID NO: 286338 - DNA, 33 bp, Artificial Sequence
  Description of Artificial Sequence: Synthetic oligonucleotide
aaatcgtcgcctataacaaggcccacaaagcag

SEQ ID NO: 286339 - DNA, 32 bp, Artificial Sequence
  Description of Artificial Sequence: Synthetic oligonucleotide
aatcgtcgcctataacaaggcccacaaagcag

SEQ ID NO: 286340 - DNA, 31 bp, Artificial Sequence
  Description of Artificial Sequence: Synthetic oligonucleotide
atcgtcgcctataacaaggcccacaaagcag

SEQ ID NO: 286341 - DNA, 30 bp, Artificial Sequence
  Description of Artificial Sequence: Synthetic oligonucleotide
tcgtcgcctataacaaggcccacaaagcag

SEQ ID NO: 286342 - DNA, 29 bp, Artificial Sequence
  Description of Artificial Sequence: Synthetic oligonucleotide
cgtcgcctataacaaggcccacaaagcag

SEQ ID NO: 286343 - DNA, 30 bp, Artificial Sequence
  Description of Artificial Sequence: Synthetic oligonucleotide
gtcgcctataacaaggcccacaaagcagag

SEQ ID NO: 286344 - DNA, 30 bp, Artificial Sequence
  Description of Artificial Sequence: Synthetic oligonucleotide
tcgcctataacaaggcccacaaagcagagc

SEQ ID NO: 286345 - DNA, 29 bp, Artificial Sequence
  Description of Artificial Sequence: Synthetic oligonucleotide
cgcctataacaaggcccacaaagcagagc

SEQ ID NO: 286346 - DNA, 31 bp, Artificial Sequence
  Description of Artificial Sequence: Synthetic oligonucleotide
gcctataacaaggcccacaaagcagagcatc

SEQ ID NO: 286347 - DNA, 32 bp, Artificial Sequence
  Description of Artificial Sequence: Synthetic oligonucleotide
cctataacaaggcccacaaagcagagcatcag

SEQ ID NO: 286348 - DNA, 32 bp, Artificial Sequence
  Description of Artificial Sequence: Synthetic oligonucleotide
ctataacaaggcccacaaagcagagcatcagg

SEQ ID NO: 286349 - DNA, 32 bp, Artificial Sequence
  Description of Artificial Sequence: Synthetic oligonucleotide
tataacaaggcccacaaagcagagcatcaggc

SEQ ID NO: 286350 - DNA, 31 bp, Artificial Sequence
  Description of Artificial Sequence: Synthetic oligonucleotide
ataacaaggcccacaaagcagagcatcaggc

SEQ ID NO: 286351 - DNA, 30 bp, Artificial Sequence
  Description of Artificial Sequence: Synthetic oligonucleotide
taacaaggcccacaaagcagagcatcaggc

SEQ ID NO: 286352 - DNA, 29 bp, Artificial Sequence
  Description of Artificial Sequence: Synthetic oligonucleotide
aacaaggcccacaaagcagagcatcaggc

SEQ ID NO: 286353 - DNA, 28 bp, Artificial Sequence
  Description of Artificial Sequence: Synthetic oligonucleotide
acaaggcccacaaagcagagcatcaggc

SEQ ID NO: 286354 - DNA, 27 bp, Artificial Sequence
  Description of Artificial Sequence: Synthetic oligonucleotide
caaggcccacaaagcagagcatcaggc

SEQ ID NO: 286355 - DNA, 29 bp, Artificial Sequence
  Description of Artificial Sequence: Synthetic oligonucleotide
aaggcccacaaagcagagcatcaggcttg

SEQ ID NO: 286356 - DNA, 28 bp, Artificial Sequence
  Description of Artificial Sequence: Synthetic oligonucleotide
aggcccacaaagcagagcatcaggcttg

SEQ ID NO: 286357 - DNA, 27 bp, Artificial Sequence
  Description of Artificial Sequence: Synthetic oligonucleotide
ggcccacaaagcagagcatcaggcttg

SEQ ID NO: 286358 - DNA, 27 bp, Artificial Sequence
  Description of Artificial Sequence: Synthetic oligonucleotide
gcccacaaagcagagcatcaggcttgc

SEQ ID NO: 286359 - DNA, 27 bp, Artificial Sequence
  Description of Artificial Sequence: Synthetic oligonucleotide
cccacaaagcagagcatcaggcttgcg

SEQ ID NO: 286360 - DNA, 28 bp, Artificial Sequence
  Description of Artificial Sequence: Synthetic oligonucleotide
ccacaaagcagagcatcaggcttgcgtc

SEQ ID NO: 286361 - DNA, 28 bp, Artificial Sequence
  Description of Artificial Sequence: Synthetic oligonucleotide
cacaaagcagagcatcaggcttgcgtcc

SEQ ID NO: 286362 - DNA, 29 bp, Artificial Sequence
  Description of Artificial Sequence: Synthetic oligonucleotide
acaaagcagagcatcaggcttgcgtcctg

SEQ ID NO: 286363 - DNA, 28 bp, Artificial Sequence
  Description of Artificial Sequence: Synthetic oligonucleotide
caaagcagagcatcaggcttgcgtcctg

SEQ ID NO: 286364 - DNA, 28 bp, Artificial Sequence
  Description of Artificial Sequence: Synthetic oligonucleotide
aaagcagagcatcaggcttgcgtcctgc

SEQ ID NO: 286365 - DNA, 27 bp, Artificial Sequence
  Description of Artificial Sequence: Synthetic oligonucleotide
aagcagagcatcaggcttgcgtcctgc

SEQ ID NO: 286366 - DNA, 27 bp, Artificial Sequence
  Description of Artificial Sequence: Synthetic oligonucleotide
agcagagcatcaggcttgcgtcctgct

SEQ ID NO: 286367 - DNA, 27 bp, Artificial Sequence
  Description of Artificial Sequence: Synthetic oligonucleotide
gcagagcatcaggcttgcgtcctgctt

SEQ ID NO: 286368 - DNA, 29 bp, Artificial Sequence
  Description of Artificial Sequence: Synthetic oligonucleotide
cagagcatcaggcttgcgtcctgcttatc

SEQ ID NO: 286369 - DNA, 29 bp, Artificial Sequence
  Description of Artificial Sequence: Synthetic oligonucleotide
agagcatcaggcttgcgtcctgcttatcg

SEQ ID NO: 286370 - DNA, 28 bp, Artificial Sequence
  Description of Artificial Sequence: Synthetic oligonucleotide
gagcatcaggcttgcgtcctgcttatcg

SEQ ID NO: 286371 - DNA, 33 bp, Artificial Sequence
  Description of Artificial Sequence: Synthetic oligonucleotide
agcatcaggcttgcgtcctgcttatcgaaattg

SEQ ID NO: 286372 - DNA, 32 bp, Artificial Sequence
  Description of Artificial Sequence: Synthetic oligonucleotide
gcatcaggcttgcgtcctgcttatcgaaattg

SEQ ID NO: 286373 - DNA, 33 bp, Artificial Sequence
  Description of Artificial Sequence: Synthetic oligonucleotide
catcaggcttgcgtcctgcttatcgaaattgag

SEQ ID NO: 286374 - DNA, 33 bp, Artificial Sequence
  Description of Artificial Sequence: Synthetic oligonucleotide
atcaggcttgcgtcctgcttatcgaaattgagg

SEQ ID NO: 286375 - DNA, 32 bp, Artificial Sequence
  Description of Artificial Sequence: Synthetic oligonucleotide
tcaggcttgcgtcctgcttatcgaaattgagg

SEQ ID NO: 286376 - DNA, 31 bp, Artificial Sequence
  Description of Artificial Sequence: Synthetic oligonucleotide
caggcttgcgtcctgcttatcgaaattgagg

SEQ ID NO: 286377 - DNA, 32 bp, Artificial Sequence
  Description of Artificial Sequence: Synthetic oligonucleotide
aggcttgcgtcctgcttatcgaaattgaggag

SEQ ID NO: 286378 - DNA, 31 bp, Artificial Sequence
  Description of Artificial Sequence: Synthetic oligonucleotide
ggcttgcgtcctgcttatcgaaattgaggag

SEQ ID NO: 286379 - DNA, 31 bp, Artificial Sequence
  Description of Artificial Sequence: Synthetic oligonucleotide
gcttgcgtcctgcttatcgaaattgaggagg

SEQ ID NO: 286380 - DNA, 32 bp, Artificial Sequence
  Description of Artificial Sequence: Synthetic oligonucleotide
cttgcgtcctgcttatcgaaattgaggaggtg

SEQ ID NO: 286381 - DNA, 32 bp, Artificial Sequence
  Description of Artificial Sequence: Synthetic oligonucleotide
ttgcgtcctgcttatcgaaattgaggaggtgg

SEQ ID NO: 286382 - DNA, 31 bp, Artificial Sequence
  Description of Artificial Sequence: Synthetic oligonucleotide
tgcgtcctgcttatcgaaattgaggaggtgg

SEQ ID NO: 286383 - DNA, 30 bp, Artificial Sequence
  Description of Artificial Sequence: Synthetic oligonucleotide
gcgtcctgcttatcgaaattgaggaggtgg

SEQ ID NO: 286384 - DNA, 31 bp, Artificial Sequence
  Description of Artificial Sequence: Synthetic oligonucleotide
cgtcctgcttatcgaaattgaggaggtggac

SEQ ID NO: 286385 - DNA, 33 bp, Artificial Sequence
  Description of Artificial Sequence: Synthetic oligonucleotide
gtcctgcttatcgaaattgaggaggtggacaag

SEQ ID NO: 286386 - DNA, 33 bp, Artificial Sequence
  Description of Artificial Sequence: Synthetic oligonucleotide
tcctgcttatcgaaattgaggaggtggacaagc

SEQ ID NO: 286387 - DNA, 32 bp, Artificial Sequence
  Description of Artificial Sequence: Synthetic oligonucleotide
cctgcttatcgaaattgaggaggtggacaagc

SEQ ID NO: 286388 - DNA, 33 bp, Artificial Sequence
  Description of Artificial Sequence: Synthetic oligonucleotide
ctgcttatcgaaattgaggaggtggacaagctg

SEQ ID NO: 286389 - DNA, 33 bp, Artificial Sequence
  Description of Artificial Sequence: Synthetic oligonucleotide
tgcttatcgaaattgaggaggtggacaagctgg

SEQ ID NO: 286390 - DNA, 32 bp, Artificial Sequence
  Description of Artificial Sequence: Synthetic oligonucleotide
gcttatcgaaattgaggaggtggacaagctgg

SEQ ID NO: 286391 - DNA, 33 bp, Artificial Sequence
  Description of Artificial Sequence: Synthetic oligonucleotide
cttatcgaaattgaggaggtggacaagctggag

SEQ ID NO: 286392 - DNA, 35 bp, Artificial Sequence
  Description of Artificial Sequence: Synthetic oligonucleotide
ttatcgaaattgaggaggtggacaagctggagaac

SEQ ID NO: 286393 - DNA, 34 bp, Artificial Sequence
  Description of Artificial Sequence: Synthetic oligonucleotide
tatcgaaattgaggaggtggacaagctggagaac

SEQ ID NO: 286394 - DNA, 33 bp, Artificial Sequence
  Description of Artificial Sequence: Synthetic oligonucleotide
atcgaaattgaggaggtggacaagctggagaac

SEQ ID NO: 286395 - DNA, 32 bp, Artificial Sequence
  Description of Artificial Sequence: Synthetic oligonucleotide
tcgaaattgaggaggtggacaagctggagaac

SEQ ID NO: 286396 - DNA, 31 bp, Artificial Sequence
  Description of Artificial Sequence: Synthetic oligonucleotide
cgaaattgaggaggtggacaagctggagaac

SEQ ID NO: 286397 - DNA, 31 bp, Artificial Sequence
  Description of Artificial Sequence: Synthetic oligonucleotide
gaaattgaggaggtggacaagctggagaacg

SEQ ID NO: 286398 - DNA, 32 bp, Artificial Sequence
  Description of Artificial Sequence: Synthetic oligonucleotide
aaattgaggaggtggacaagctggagaacgac

SEQ ID NO: 286399 - DNA, 31 bp, Artificial Sequence
  Description of Artificial Sequence: Synthetic oligonucleotide
aattgaggaggtggacaagctggagaacgac

SEQ ID NO: 286400 - DNA, 30 bp, Artificial Sequence
  Description of Artificial Sequence: Synthetic oligonucleotide
attgaggaggtggacaagctggagaacgac

SEQ ID NO: 286401 - DNA, 29 bp, Artificial Sequence
  Description of Artificial Sequence: Synthetic oligonucleotide
ttgaggaggtggacaagctggagaacgac

SEQ ID NO: 286402 - DNA, 28 bp, Artificial Sequence
  Description of Artificial Sequence: Synthetic oligonucleotide
tgaggaggtggacaagctggagaacgac

SEQ ID NO: 286403 - DNA, 27 bp, Artificial Sequence
  Description of Artificial Sequence: Synthetic oligonucleotide
gaggaggtggacaagctggagaacgac

SEQ ID NO: 286404 - DNA, 30 bp, Artificial Sequence
  Description of Artificial Sequence: Synthetic oligonucleotide
aggaggtggacaagctggagaacgacattg

SEQ ID NO: 286405 - DNA, 29 bp, Artificial Sequence
  Description of Artificial Sequence: Synthetic oligonucleotide
ggaggtggacaagctggagaacgacattg

SEQ ID NO: 286406 - DNA, 31 bp, Artificial Sequence
  Description of Artificial Sequence: Synthetic oligonucleotide
gaggtggacaagctggagaacgacattgatc

SEQ ID NO: 286407 - DNA, 36 bp, Artificial Sequence
  Description of Artificial Sequence: Synthetic oligonucleotide
aggtggacaagctggagaacgacattgatcaaaatg

SEQ ID NO: 286408 - DNA, 35 bp, Artificial Sequence
  Description of Artificial Sequence: Synthetic oligonucleotide
ggtggacaagctggagaacgacattgatcaaaatg

SEQ ID NO: 286409 - DNA, 35 bp, Artificial Sequence
  Description of Artificial Sequence: Synthetic oligonucleotide
gtggacaagctggagaacgacattgatcaaaatgc

SEQ ID NO: 286410 - DNA, 39 bp, Artificial Sequence
  Description of Artificial Sequence: Synthetic oligonucleotide
tggacaagctggagaacgacattgatcaaaatgcatttg

SEQ ID NO: 286411 - DNA, 38 bp, Artificial Sequence
  Description of Artificial Sequence: Synthetic oligonucleotide
ggacaagctggagaacgacattgatcaaaatgcatttg

SEQ ID NO: 286412 - DNA, 38 bp, Artificial Sequence
  Description of Artificial Sequence: Synthetic oligonucleotide
gacaagctggagaacgacattgatcaaaatgcatttgc

SEQ ID NO: 286413 - DNA, 41 bp, Artificial Sequence
  Description of Artificial Sequence: Synthetic oligonucleotide
acaagctggagaacgacattgatcaaaatgcatttgcaaag

SEQ ID NO: 286414 - DNA, 40 bp, Artificial Sequence
  Description of Artificial Sequence: Synthetic oligonucleotide
caagctggagaacgacattgatcaaaatgcatttgcaaag

SEQ ID NO: 286415 - DNA, 40 bp, Artificial Sequence
  Description of Artificial Sequence: Synthetic oligonucleotide
aagctggagaacgacattgatcaaaatgcatttgcaaagg

SEQ ID NO: 286416 - DNA, 39 bp, Artificial Sequence
  Description of Artificial Sequence: Synthetic oligonucleotide
agctggagaacgacattgatcaaaatgcatttgcaaagg

SEQ ID NO: 286417 - DNA, 38 bp, Artificial Sequence
  Description of Artificial Sequence: Synthetic oligonucleotide
gctggagaacgacattgatcaaaatgcatttgcaaagg

SEQ ID NO: 286418 - DNA, 39 bp, Artificial Sequence
  Description of Artificial Sequence: Synthetic oligonucleotide
ctggagaacgacattgatcaaaatgcatttgcaaaggtg

SEQ ID NO: 286419 - DNA, 40 bp, Artificial Sequence
  Description of Artificial Sequence: Synthetic oligonucleotide
tggagaacgacattgatcaaaatgcatttgcaaaggtgtg

SEQ ID NO: 286420 - DNA, 39 bp, Artificial Sequence
  Description of Artificial Sequence: Synthetic oligonucleotide
ggagaacgacattgatcaaaatgcatttgcaaaggtgtg

SEQ ID NO: 286421 - DNA, 39 bp, Artificial Sequence
  Description of Artificial Sequence: Synthetic oligonucleotide
gagaacgacattgatcaaaatgcatttgcaaaggtgtgc

SEQ ID NO: 286422 - DNA, 39 bp, Artificial Sequence
  Description of Artificial Sequence: Synthetic oligonucleotide
agaacgacattgatcaaaatgcatttgcaaaggtgtgcc

SEQ ID NO: 286423 - DNA, 38 bp, Artificial Sequence
  Description of Artificial Sequence: Synthetic oligonucleotide
gaacgacattgatcaaaatgcatttgcaaaggtgtgcc

SEQ ID NO: 286424 - DNA, 43 bp, Artificial Sequence
  Description of Artificial Sequence: Synthetic oligonucleotide
aacgacattgatcaaaatgcatttgcaaaggtgtgcctttatg

SEQ ID NO: 286425 - DNA, 42 bp, Artificial Sequence
  Description of Artificial Sequence: Synthetic oligonucleotide
acgacattgatcaaaatgcatttgcaaaggtgtgcctttatg

SEQ ID NO: 286426 - DNA, 41 bp, Artificial Sequence
  Description of Artificial Sequence: Synthetic oligonucleotide
cgacattgatcaaaatgcatttgcaaaggtgtgcctttatg

SEQ ID NO: 286427 - DNA, 42 bp, Artificial Sequence
  Description of Artificial Sequence: Synthetic oligonucleotide
gacattgatcaaaatgcatttgcaaaggtgtgcctttatgtc

SEQ ID NO: 286428 - DNA, 43 bp, Artificial Sequence
  Description of Artificial Sequence: Synthetic oligonucleotide
acattgatcaaaatgcatttgcaaaggtgtgcctttatgtcac

SEQ ID NO: 286429 - DNA, 42 bp, Artificial Sequence
  Description of Artificial Sequence: Synthetic oligonucleotide
cattgatcaaaatgcatttgcaaaggtgtgcctttatgtcac

SEQ ID NO: 286430 - DNA, 42 bp, Artificial Sequence
  Description of Artificial Sequence: Synthetic oligonucleotide
attgatcaaaatgcatttgcaaaggtgtgcctttatgtcacc

SEQ ID NO: 286431 - DNA, 41 bp, Artificial Sequence
  Description of Artificial Sequence: Synthetic oligonucleotide
ttgatcaaaatgcatttgcaaaggtgtgcctttatgtcacc

SEQ ID NO: 286432 - DNA, 40 bp, Artificial Sequence
  Description of Artificial Sequence: Synthetic oligonucleotide
tgatcaaaatgcatttgcaaaggtgtgcctttatgtcacc

SEQ ID NO: 286433 - DNA, 39 bp, Artificial Sequence
  Description of Artificial Sequence: Synthetic oligonucleotide
gatcaaaatgcatttgcaaaggtgtgcctttatgtcacc

SEQ ID NO: 286434 - DNA, 40 bp, Artificial Sequence
  Description of Artificial Sequence: Synthetic oligonucleotide
atcaaaatgcatttgcaaaggtgtgcctttatgtcaccag

SEQ ID NO: 286435 - DNA, 39 bp, Artificial Sequence
  Description of Artificial Sequence: Synthetic oligonucleotide
tcaaaatgcatttgcaaaggtgtgcctttatgtcaccag

SEQ ID NO: 286436 - DNA, 38 bp, Artificial Sequence
  Description of Artificial Sequence: Synthetic oligonucleotide
caaaatgcatttgcaaaggtgtgcctttatgtcaccag

SEQ ID NO: 286437 - DNA, 40 bp, Artificial Sequence
  Description of Artificial Sequence: Synthetic oligonucleotide
aaaatgcatttgcaaaggtgtgcctttatgtcaccagttc

SEQ ID NO: 286438 - DNA, 39 bp, Artificial Sequence
  Description of Artificial Sequence: Synthetic oligonucleotide
aaatgcatttgcaaaggtgtgcctttatgtcaccagttc

SEQ ID NO: 286439 - DNA, 38 bp, Artificial Sequence
  Description of Artificial Sequence: Synthetic oligonucleotide
aatgcatttgcaaaggtgtgcctttatgtcaccagttc

SEQ ID NO: 286440 - DNA, 37 bp, Artificial Sequence
  Description of Artificial Sequence: Synthetic oligonucleotide
atgcatttgcaaaggtgtgcctttatgtcaccagttc

SEQ ID NO: 286441 - DNA, 36 bp, Artificial Sequence
  Description of Artificial Sequence: Synthetic oligonucleotide
tgcatttgcaaaggtgtgcctttatgtcaccagttc

SEQ ID NO: 286442 - DNA, 35 bp, Artificial Sequence
  Description of Artificial Sequence: Synthetic oligonucleotide
gcatttgcaaaggtgtgcctttatgtcaccagttc

SEQ ID NO: 286443 - DNA, 36 bp, Artificial Sequence
  Description of Artificial Sequence: Synthetic oligonucleotide
catttgcaaaggtgtgcctttatgtcaccagttctg

SEQ ID NO: 286444 - DNA, 37 bp, Artificial Sequence
  Description of Artificial Sequence: Synthetic oligonucleotide
atttgcaaaggtgtgcctttatgtcaccagttctgtg

SEQ ID NO: 286445 - DNA, 36 bp, Artificial Sequence
  Description of Artificial Sequence: Synthetic oligonucleotide
tttgcaaaggtgtgcctttatgtcaccagttctgtg

SEQ ID NO: 286446 - DNA, 35 bp, Artificial Sequence
  Description of Artificial Sequence: Synthetic oligonucleotide
ttgcaaaggtgtgcctttatgtcaccagttctgtg

SEQ ID NO: 286447 - DNA, 34 bp, Artificial Sequence
  Description of Artificial Sequence: Synthetic oligonucleotide
tgcaaaggtgtgcctttatgtcaccagttctgtg

SEQ ID NO: 286448 - DNA, 33 bp, Artificial Sequence
  Description of Artificial Sequence: Synthetic oligonucleotide
gcaaaggtgtgcctttatgtcaccagttctgtg

SEQ ID NO: 286449 - DNA, 38 bp, Artificial Sequence
  Description of Artificial Sequence: Synthetic oligonucleotide
caaaggtgtgcctttatgtcaccagttctgtgaattag

SEQ ID NO: 286450 - DNA, 38 bp, Artificial Sequence
  Description of Artificial Sequence: Synthetic oligonucleotide
aaaggtgtgcctttatgtcaccagttctgtgaattagg

SEQ ID NO: 286451 - DNA, 37 bp, Artificial Sequence
  Description of Artificial Sequence: Synthetic oligonucleotide
aaggtgtgcctttatgtcaccagttctgtgaattagg

SEQ ID NO: 286452 - DNA, 36 bp, Artificial Sequence
  Description of Artificial Sequence: Synthetic oligonucleotide
aggtgtgcctttatgtcaccagttctgtgaattagg

SEQ ID NO: 286453 - DNA, 35 bp, Artificial Sequence
  Description of Artificial Sequence: Synthetic oligonucleotide
ggtgtgcctttatgtcaccagttctgtgaattagg

SEQ ID NO: 286454 - DNA, 36 bp, Artificial Sequence
  Description of Artificial Sequence: Synthetic oligonucleotide
gtgtgcctttatgtcaccagttctgtgaattaggtg

SEQ ID NO: 286455 - DNA, 36 bp, Artificial Sequence
  Description of Artificial Sequence: Synthetic oligonucleotide
tgtgcctttatgtcaccagttctgtgaattaggtgc

SEQ ID NO: 286456 - DNA, 35 bp, Artificial Sequence
  Description of Artificial Sequence: Synthetic oligonucleotide
gtgcctttatgtcaccagttctgtgaattaggtgc

SEQ ID NO: 286457 - DNA, 35 bp, Artificial Sequence
  Description of Artificial Sequence: Synthetic oligonucleotide
tgcctttatgtcaccagttctgtgaattaggtgcc

SEQ ID NO: 286458 - DNA, 34 bp, Artificial Sequence
  Description of Artificial Sequence: Synthetic oligonucleotide
gcctttatgtcaccagttctgtgaattaggtgcc

SEQ ID NO: 286459 - DNA, 35 bp, Artificial Sequence
  Description of Artificial Sequence: Synthetic oligonucleotide
cctttatgtcaccagttctgtgaattaggtgcctg

SEQ ID NO: 286460 - DNA, 36 bp, Artificial Sequence
  Description of Artificial Sequence: Synthetic oligonucleotide
ctttatgtcaccagttctgtgaattaggtgcctgag

SEQ ID NO: 286461 - DNA, 36 bp, Artificial Sequence
  Description of Artificial Sequence: Synthetic oligonucleotide
tttatgtcaccagttctgtgaattaggtgcctgagg

SEQ ID NO: 286462 - DNA, 35 bp, Artificial Sequence
  Description of Artificial Sequence: Synthetic oligonucleotide
ttatgtcaccagttctgtgaattaggtgcctgagg

SEQ ID NO: 286463 - DNA, 34 bp, Artificial Sequence
  Description of Artificial Sequence: Synthetic oligonucleotide
tatgtcaccagttctgtgaattaggtgcctgagg

SEQ ID NO: 286464 - DNA, 33 bp, Artificial Sequence
  Description of Artificial Sequence: Synthetic oligonucleotide
atgtcaccagttctgtgaattaggtgcctgagg

SEQ ID NO: 286465 - DNA, 32 bp, Artificial Sequence
  Description of Artificial Sequence: Synthetic oligonucleotide
tgtcaccagttctgtgaattaggtgcctgagg

SEQ ID NO: 286466 - DNA, 31 bp, Artificial Sequence
  Description of Artificial Sequence: Synthetic oligonucleotide
gtcaccagttctgtgaattaggtgcctgagg

SEQ ID NO: 286467 - DNA, 31 bp, Artificial Sequence
  Description of Artificial Sequence: Synthetic oligonucleotide
tcaccagttctgtgaattaggtgcctgaggc

SEQ ID NO: 286468 - DNA, 30 bp, Artificial Sequence
  Description of Artificial Sequence: Synthetic oligonucleotide
caccagttctgtgaattaggtgcctgaggc

SEQ ID NO: 286469 - DNA, 31 bp, Artificial Sequence
  Description of Artificial Sequence: Synthetic oligonucleotide
accagttctgtgaattaggtgcctgaggctg

SEQ ID NO: 286470 - DNA, 30 bp, Artificial Sequence
  Description of Artificial Sequence: Synthetic oligonucleotide
ccagttctgtgaattaggtgcctgaggctg

SEQ ID NO: 286471 - DNA, 31 bp, Artificial Sequence
  Description of Artificial Sequence: Synthetic oligonucleotide
cagttctgtgaattaggtgcctgaggctgag

SEQ ID NO: 286472 - DNA, 33 bp, Artificial Sequence
  Description of Artificial Sequence: Synthetic oligonucleotide
agttctgtgaattaggtgcctgaggctgagaac

SEQ ID NO: 286473 - DNA, 32 bp, Artificial Sequence
  Description of Artificial Sequence: Synthetic oligonucleotide
gttctgtgaattaggtgcctgaggctgagaac

SEQ ID NO: 286474 - DNA, 33 bp, Artificial Sequence
  Description of Artificial Sequence: Synthetic oligonucleotide
ttctgtgaattaggtgcctgaggctgagaactg

SEQ ID NO: 286475 - DNA, 32 bp, Artificial Sequence
  Description of Artificial Sequence: Synthetic oligonucleotide
tctgtgaattaggtgcctgaggctgagaactg

SEQ ID NO: 286476 - DNA, 31 bp, Artificial Sequence
  Description of Artificial Sequence: Synthetic oligonucleotide
ctgtgaattaggtgcctgaggctgagaactg

SEQ ID NO: 286477 - DNA, 32 bp, Artificial Sequence
  Description of Artificial Sequence: Synthetic oligonucleotide
tgtgaattaggtgcctgaggctgagaactgag

SEQ ID NO: 286478 - DNA, 31 bp, Artificial Sequence
  Description of Artificial Sequence: Synthetic oligonucleotide
gtgaattaggtgcctgaggctgagaactgag

SEQ ID NO: 286479 - DNA, 31 bp, Artificial Sequence
  Description of Artificial Sequence: Synthetic oligonucleotide
tgaattaggtgcctgaggctgagaactgagc

SEQ ID NO: 286480 - DNA, 30 bp, Artificial Sequence
  Description of Artificial Sequence: Synthetic oligonucleotide
gaattaggtgcctgaggctgagaactgagc

SEQ ID NO: 286481 - DNA, 30 bp, Artificial Sequence
  Description of Artificial Sequence: Synthetic oligonucleotide
aattaggtgcctgaggctgagaactgagcc

SEQ ID NO: 286482 - DNA, 29 bp, Artificial Sequence
  Description of Artificial Sequence: Synthetic oligonucleotide
attaggtgcctgaggctgagaactgagcc

SEQ ID NO: 286483 - DNA, 28 bp, Artificial Sequence
  Description of Artificial Sequence: Synthetic oligonucleotide
ttaggtgcctgaggctgagaactgagcc

SEQ ID NO: 286484 - DNA, 27 bp, Artificial Sequence
  Description of Artificial Sequence: Synthetic oligonucleotide
taggtgcctgaggctgagaactgagcc

SEQ ID NO: 286485 - DNA, 26 bp, Artificial Sequence
  Description of Artificial Sequence: Synthetic oligonucleotide
aggtgcctgaggctgagaactgagcc

SEQ ID NO: 286486 - DNA, 25 bp, Artificial Sequence
  Description of Artificial Sequence: Synthetic oligonucleotide
ggtgcctgaggctgagaactgagcc

SEQ ID NO: 286487 - DNA, 27 bp, Artificial Sequence
  Description of Artificial Sequence: Synthetic oligonucleotide
gtgcctgaggctgagaactgagcccta

SEQ ID NO: 286488 - DNA, 27 bp, Artificial Sequence
  Description of Artificial Sequence: Synthetic oligonucleotide
tgcctgaggctgagaactgagccctac

SEQ ID NO: 286489 - DNA, 27 bp, Artificial Sequence
  Description of Artificial Sequence: Synthetic oligonucleotide
gcctgaggctgagaactgagccctact

SEQ ID NO: 286490 - DNA, 27 bp, Artificial Sequence
  Description of Artificial Sequence: Synthetic oligonucleotide
cctgaggctgagaactgagccctactc

SEQ ID NO: 286491 - DNA, 27 bp, Artificial Sequence
  Description of Artificial Sequence: Synthetic oligonucleotide
ctgaggctgagaactgagccctactcc

SEQ ID NO: 286492 - DNA, 27 bp, Artificial Sequence
  Description of Artificial Sequence: Synthetic oligonucleotide
tgaggctgagaactgagccctactccg

SEQ ID NO: 286493 - DNA, 27 bp, Artificial Sequence
  Description of Artificial Sequence: Synthetic oligonucleotide
gaggctgagaactgagccctactccgt

SEQ ID NO: 286494 - DNA, 28 bp, Artificial Sequence
  Description of Artificial Sequence: Synthetic oligonucleotide
aggctgagaactgagccctactccgttg

SEQ ID NO: 286495 - DNA, 27 bp, Artificial Sequence
  Description of Artificial Sequence: Synthetic oligonucleotide
ggctgagaactgagccctactccgttg

SEQ ID NO: 286496 - DNA, 28 bp, Artificial Sequence
  Description of Artificial Sequence: Synthetic oligonucleotide
gctgagaactgagccctactccgttgtg

SEQ ID NO: 286497 - DNA, 28 bp, Artificial Sequence
  Description of Artificial Sequence: Synthetic oligonucleotide
ctgagaactgagccctactccgttgtgc

SEQ ID NO: 286498 - DNA, 28 bp, Artificial Sequence
  Description of Artificial Sequence: Synthetic oligonucleotide
tgagaactgagccctactccgttgtgcc

SEQ ID NO: 286499 - DNA, 27 bp, Artificial Sequence
  Description of Artificial Sequence: Synthetic oligonucleotide
gagaactgagccctactccgttgtgcc

SEQ ID NO: 286500 - DNA, 27 bp, Artificial Sequence
  Description of Artificial Sequence: Synthetic oligonucleotide
agaactgagccctactccgttgtgccg

SEQ ID NO: 286501 - DNA, 27 bp, Artificial Sequence
  Description of Artificial Sequence: Synthetic oligonucleotide
gaactgagccctactccgttgtgccgt

SEQ ID NO: 286502 - DNA, 27 bp, Artificial Sequence
  Description of Artificial Sequence: Synthetic oligonucleotide
aactgagccctactccgttgtgccgtg

SEQ ID NO: 286503 - DNA, 26 bp, Artificial Sequence
  Description of Artificial Sequence: Synthetic oligonucleotide
actgagccctactccgttgtgccgtg

SEQ ID NO: 286504 - DNA, 25 bp, Artificial Sequence
  Description of Artificial Sequence: Synthetic oligonucleotide
ctgagccctactccgttgtgccgtg

SEQ ID NO: 286505 - DNA, 25 bp, Artificial Sequence
  Description of Artificial Sequence: Synthetic oligonucleotide
tgagccctactccgttgtgccgtgg

SEQ ID NO: 286506 - DNA, 24 bp, Artificial Sequence
  Description of Artificial Sequence: Synthetic oligonucleotide
gagccctactccgttgtgccgtgg

SEQ ID NO: 286507 - DNA, 25 bp, Artificial Sequence
  Description of Artificial Sequence: Synthetic oligonucleotide
agccctactccgttgtgccgtgggt

SEQ ID NO: 286508 - DNA, 24 bp, Artificial Sequence
  Description of Artificial Sequence: Synthetic oligonucleotide
gccctactccgttgtgccgtgggt

SEQ ID NO: 286509 - DNA, 25 bp, Artificial Sequence
  Description of Artificial Sequence: Synthetic oligonucleotide
ccctactccgttgtgccgtgggtgt

SEQ ID NO: 286510 - DNA, 27 bp, Artificial Sequence
  Description of Artificial Sequence: Synthetic oligonucleotide
cctactccgttgtgccgtgggtgtgta

SEQ ID NO: 286511 - DNA, 27 bp, Artificial Sequence
  Description of Artificial Sequence: Synthetic oligonucleotide
ctactccgttgtgccgtgggtgtgtac

SEQ ID NO: 286512 - DNA, 27 bp, Artificial Sequence
  Description of Artificial Sequence: Synthetic oligonucleotide
tactccgttgtgccgtgggtgtgtacc

SEQ ID NO: 286513 - DNA, 26 bp, Artificial Sequence
  Description of Artificial Sequence: Synthetic oligonucleotide
actccgttgtgccgtgggtgtgtacc

SEQ ID NO: 286514 - DNA, 25 bp, Artificial Sequence
  Description of Artificial Sequence: Synthetic oligonucleotide
ctccgttgtgccgtgggtgtgtacc

SEQ ID NO: 286515 - DNA, 27 bp, Artificial Sequence
  Description of Artificial Sequence: Synthetic oligonucleotide
tccgttgtgccgtgggtgtgtaccgaa

SEQ ID NO: 286516 - DNA, 27 bp, Artificial Sequence
  Description of Artificial Sequence: Synthetic oligonucleotide
ccgttgtgccgtgggtgtgtaccgaaa

SEQ ID NO: 286517 - DNA, 27 bp, Artificial Sequence
  Description of Artificial Sequence: Synthetic oligonucleotide
cgttgtgccgtgggtgtgtaccgaaag

SEQ ID NO: 286518 - DNA, 31 bp, Artificial Sequence
  Description of Artificial Sequence: Synthetic oligonucleotide
gttgtgccgtgggtgtgtaccgaaagttaag

SEQ ID NO: 286519 - DNA, 31 bp, Artificial Sequence
  Description of Artificial Sequence: Synthetic oligonucleotide
ttgtgccgtgggtgtgtaccgaaagttaagc

SEQ ID NO: 286520 - DNA, 30 bp, Artificial Sequence
  Description of Artificial Sequence: Synthetic oligonucleotide
tgtgccgtgggtgtgtaccgaaagttaagc

SEQ ID NO: 286521 - DNA, 29 bp, Artificial Sequence
  Description of Artificial Sequence: Synthetic oligonucleotide
gtgccgtgggtgtgtaccgaaagttaagc

SEQ ID NO: 286522 - DNA, 29 bp, Artificial Sequence
  Description of Artificial Sequence: Synthetic oligonucleotide
tgccgtgggtgtgtaccgaaagttaagcc

SEQ ID NO: 286523 - DNA, 28 bp, Artificial Sequence
  Description of Artificial Sequence: Synthetic oligonucleotide
gccgtgggtgtgtaccgaaagttaagcc

SEQ ID NO: 286524 - DNA, 28 bp, Artificial Sequence
  Description of Artificial Sequence: Synthetic oligonucleotide
ccgtgggtgtgtaccgaaagttaagccg

SEQ ID NO: 286525 - DNA, 28 bp, Artificial Sequence
  Description of Artificial Sequence: Synthetic oligonucleotide
cgtgggtgtgtaccgaaagttaagccgc

SEQ ID NO: 286526 - DNA, 30 bp, Artificial Sequence
  Description of Artificial Sequence: Synthetic oligonucleotide
gtgggtgtgtaccgaaagttaagccgcttc

SEQ ID NO: 286527 - DNA, 30 bp, Artificial Sequence
  Description of Artificial Sequence: Synthetic oligonucleotide
tgggtgtgtaccgaaagttaagccgcttcg

SEQ ID NO: 286528 - DNA, 29 bp, Artificial Sequence
  Description of Artificial Sequence: Synthetic oligonucleotide
gggtgtgtaccgaaagttaagccgcttcg

SEQ ID NO: 286529 - DNA, 29 bp, Artificial Sequence
  Description of Artificial Sequence: Synthetic oligonucleotide
ggtgtgtaccgaaagttaagccgcttcgc

SEQ ID NO: 286530 - DNA, 30 bp, Artificial Sequence
  Description of Artificial Sequence: Synthetic oligonucleotide
gtgtgtaccgaaagttaagccgcttcgctg

SEQ ID NO: 286531 - DNA, 32 bp, Artificial Sequence
  Description of Artificial Sequence: Synthetic oligonucleotide
tgtgtaccgaaagttaagccgcttcgctgaag

SEQ ID NO: 286532 - DNA, 31 bp, Artificial Sequence
  Description of Artificial Sequence: Synthetic oligonucleotide
gtgtaccgaaagttaagccgcttcgctgaag

SEQ ID NO: 286533 - DNA, 31 bp, Artificial Sequence
  Description of Artificial Sequence: Synthetic oligonucleotide
tgtaccgaaagttaagccgcttcgctgaagc

SEQ ID NO: 286534 - DNA, 30 bp, Artificial Sequence
  Description of Artificial Sequence: Synthetic oligonucleotide
gtaccgaaagttaagccgcttcgctgaagc

SEQ ID NO: 286535 - DNA, 31 bp, Artificial Sequence
  Description of Artificial Sequence: Synthetic oligonucleotide
taccgaaagttaagccgcttcgctgaagctc

SEQ ID NO: 286536 - DNA, 30 bp, Artificial Sequence
  Description of Artificial Sequence: Synthetic oligonucleotide
accgaaagttaagccgcttcgctgaagctc

SEQ ID NO: 286537 - DNA, 29 bp, Artificial Sequence
  Description of Artificial Sequence: Synthetic oligonucleotide
ccgaaagttaagccgcttcgctgaagctc

SEQ ID NO: 286538 - DNA, 30 bp, Artificial Sequence
  Description of Artificial Sequence: Synthetic oligonucleotide
cgaaagttaagccgcttcgctgaagctcag

SEQ ID NO: 286539 - DNA, 31 bp, Artificial Sequence
  Description of Artificial Sequence: Synthetic oligonucleotide
gaaagttaagccgcttcgctgaagctcagag

SEQ ID NO: 286540 - DNA, 34 bp, Artificial Sequence
  Description of Artificial Sequence: Synthetic oligonucleotide
aaagttaagccgcttcgctgaagctcagagattg

SEQ ID NO: 286541 - DNA, 33 bp, Artificial Sequence
  Description of Artificial Sequence: Synthetic oligonucleotide
aagttaagccgcttcgctgaagctcagagattg

SEQ ID NO: 286542 - DNA, 32 bp, Artificial Sequence
  Description of Artificial Sequence: Synthetic oligonucleotide
agttaagccgcttcgctgaagctcagagattg

SEQ ID NO: 286543 - DNA, 31 bp, Artificial Sequence
  Description of Artificial Sequence: Synthetic oligonucleotide
gttaagccgcttcgctgaagctcagagattg

SEQ ID NO: 286544 - DNA, 31 bp, Artificial Sequence
  Description of Artificial Sequence: Synthetic oligonucleotide
ttaagccgcttcgctgaagctcagagattgg

SEQ ID NO: 286545 - DNA, 30 bp, Artificial Sequence
  Description of Artificial Sequence: Synthetic oligonucleotide
taagccgcttcgctgaagctcagagattgg

SEQ ID NO: 286546 - DNA, 29 bp, Artificial Sequence
  Description of Artificial Sequence: Synthetic oligonucleotide
aagccgcttcgctgaagctcagagattgg

SEQ ID NO: 286547 - DNA, 28 bp, Artificial Sequence
  Description of Artificial Sequence: Synthetic oligonucleotide
agccgcttcgctgaagctcagagattgg

SEQ ID NO: 286548 - DNA, 27 bp, Artificial Sequence
  Description of Artificial Sequence: Synthetic oligonucleotide
gccgcttcgctgaagctcagagattgg

SEQ ID NO: 286549 - DNA, 27 bp, Artificial Sequence
  Description of Artificial Sequence: Synthetic oligonucleotide
ccgcttcgctgaagctcagagattggc

SEQ ID NO: 286550 - DNA, 30 bp, Artificial Sequence
  Description of Artificial Sequence: Synthetic oligonucleotide
cgcttcgctgaagctcagagattggctttg

SEQ ID NO: 286551 - DNA, 32 bp, Artificial Sequence
  Description of Artificial Sequence: Synthetic oligonucleotide
gcttcgctgaagctcagagattggctttgatg

SEQ ID NO: 286552 - DNA, 32 bp, Artificial Sequence
  Description of Artificial Sequence: Synthetic oligonucleotide
cttcgctgaagctcagagattggctttgatgc

SEQ ID NO: 286553 - DNA, 33 bp, Artificial Sequence
  Description of Artificial Sequence: Synthetic oligonucleotide
ttcgctgaagctcagagattggctttgatgctc

SEQ ID NO: 286554 - DNA, 32 bp, Artificial Sequence
  Description of Artificial Sequence: Synthetic oligonucleotide
tcgctgaagctcagagattggctttgatgctc

SEQ ID NO: 286555 - DNA, 31 bp, Artificial Sequence
  Description of Artificial Sequence: Synthetic oligonucleotide
cgctgaagctcagagattggctttgatgctc

SEQ ID NO: 286556 - DNA, 34 bp, Artificial Sequence
  Description of Artificial Sequence: Synthetic oligonucleotide
gctgaagctcagagattggctttgatgctctatg

SEQ ID NO: 286557 - DNA, 35 bp, Artificial Sequence
  Description of Artificial Sequence: Synthetic oligonucleotide
ctgaagctcagagattggctttgatgctctatgac

SEQ ID NO: 286558 - DNA, 37 bp, Artificial Sequence
  Description of Artificial Sequence: Synthetic oligonucleotide
tgaagctcagagattggctttgatgctctatgacatg

SEQ ID NO: 286559 - DNA, 36 bp, Artificial Sequence
  Description of Artificial Sequence: Synthetic oligonucleotide
gaagctcagagattggctttgatgctctatgacatg

SEQ ID NO: 286560 - DNA, 36 bp, Artificial Sequence
  Description of Artificial Sequence: Synthetic oligonucleotide
aagctcagagattggctttgatgctctatgacatgg

SEQ ID NO: 286561 - DNA, 35 bp, Artificial Sequence
  Description of Artificial Sequence: Synthetic oligonucleotide
agctcagagattggctttgatgctctatgacatgg

SEQ ID NO: 286562 - DNA, 34 bp, Artificial Sequence
  Description of Artificial Sequence: Synthetic oligonucleotide
gctcagagattggctttgatgctctatgacatgg

SEQ ID NO: 286563 - DNA, 35 bp, Artificial Sequence
  Description of Artificial Sequence: Synthetic oligonucleotide
ctcagagattggctttgatgctctatgacatggtg

SEQ ID NO: 286564 - DNA, 37 bp, Artificial Sequence
  Description of Artificial Sequence: Synthetic oligonucleotide
tcagagattggctttgatgctctatgacatggtgttg

SEQ ID NO: 286565 - DNA, 36 bp, Artificial Sequence
  Description of Artificial Sequence: Synthetic oligonucleotide
cagagattggctttgatgctctatgacatggtgttg

SEQ ID NO: 286566 - DNA, 36 bp, Artificial Sequence
  Description of Artificial Sequence: Synthetic oligonucleotide
agagattggctttgatgctctatgacatggtgttgg

SEQ ID NO: 286567 - DNA, 35 bp, Artificial Sequence
  Description of Artificial Sequence: Synthetic oligonucleotide
gagattggctttgatgctctatgacatggtgttgg

SEQ ID NO: 286568 - DNA, 37 bp, Artificial Sequence
  Description of Artificial Sequence: Synthetic oligonucleotide
agattggctttgatgctctatgacatggtgttggtag

SEQ ID NO: 286569 - DNA, 36 bp, Artificial Sequence
  Description of Artificial Sequence: Synthetic oligonucleotide
gattggctttgatgctctatgacatggtgttggtag

SEQ ID NO: 286570 - DNA, 38 bp, Artificial Sequence
  Description of Artificial Sequence: Synthetic oligonucleotide
attggctttgatgctctatgacatggtgttggtagatg

SEQ ID NO: 286571 - DNA, 37 bp, Artificial Sequence
  Description of Artificial Sequence: Synthetic oligonucleotide
ttggctttgatgctctatgacatggtgttggtagatg

SEQ ID NO: 286572 - DNA, 36 bp, Artificial Sequence
  Description of Artificial Sequence: Synthetic oligonucleotide
tggctttgatgctctatgacatggtgttggtagatg

SEQ ID NO: 286573 - DNA, 35 bp, Artificial Sequence
  Description of Artificial Sequence: Synthetic oligonucleotide
ggctttgatgctctatgacatggtgttggtagatg

SEQ ID NO: 286574 - DNA, 36 bp, Artificial Sequence
  Description of Artificial Sequence: Synthetic oligonucleotide
gctttgatgctctatgacatggtgttggtagatgac

SEQ ID NO: 286575 - DNA, 38 bp, Artificial Sequence
  Description of Artificial Sequence: Synthetic oligonucleotide
ctttgatgctctatgacatggtgttggtagatgacatc

SEQ ID NO: 286576 - DNA, 40 bp, Artificial Sequence
  Description of Artificial Sequence: Synthetic oligonucleotide
tttgatgctctatgacatggtgttggtagatgacatcttc

SEQ ID NO: 286577 - DNA, 39 bp, Artificial Sequence
  Description of Artificial Sequence: Synthetic oligonucleotide
ttgatgctctatgacatggtgttggtagatgacatcttc

SEQ ID NO: 286578 - DNA, 38 bp, Artificial Sequence
  Description of Artificial Sequence: Synthetic oligonucleotide
tgatgctctatgacatggtgttggtagatgacatcttc

SEQ ID NO: 286579 - DNA, 37 bp, Artificial Sequence
  Description of Artificial Sequence: Synthetic oligonucleotide
gatgctctatgacatggtgttggtagatgacatcttc

SEQ ID NO: 286580 - DNA, 38 bp, Artificial Sequence
  Description of Artificial Sequence: Synthetic oligonucleotide
atgctctatgacatggtgttggtagatgacatcttctc

SEQ ID NO: 286581 - DNA, 37 bp, Artificial Sequence
  Description of Artificial Sequence: Synthetic oligonucleotide
tgctctatgacatggtgttggtagatgacatcttctc

SEQ ID NO: 286582 - DNA, 36 bp, Artificial Sequence
  Description of Artificial Sequence: Synthetic oligonucleotide
gctctatgacatggtgttggtagatgacatcttctc

SEQ ID NO: 286583 - DNA, 36 bp, Artificial Sequence
  Description of Artificial Sequence: Synthetic oligonucleotide
ctctatgacatggtgttggtagatgacatcttctcc

SEQ ID NO: 286584 - DNA, 37 bp, Artificial Sequence
  Description of Artificial Sequence: Synthetic oligonucleotide
tctatgacatggtgttggtagatgacatcttctcctc

SEQ ID NO: 286585 - DNA, 36 bp, Artificial Sequence
  Description of Artificial Sequence: Synthetic oligonucleotide
ctatgacatggtgttggtagatgacatcttctcctc

SEQ ID NO: 286586 - DNA, 36 bp, Artificial Sequence
  Description of Artificial Sequence: Synthetic oligonucleotide
tatgacatggtgttggtagatgacatcttctcctcc

SEQ ID NO: 286587 - DNA, 35 bp, Artificial Sequence
  Description of Artificial Sequence: Synthetic oligonucleotide
atgacatggtgttggtagatgacatcttctcctcc

SEQ ID NO: 286588 - DNA, 34 bp, Artificial Sequence
  Description of Artificial Sequence: Synthetic oligonucleotide
tgacatggtgttggtagatgacatcttctcctcc

SEQ ID NO: 286589 - DNA, 33 bp, Artificial Sequence
  Description of Artificial Sequence: Synthetic oligonucleotide
gacatggtgttggtagatgacatcttctcctcc

SEQ ID NO: 286590 - DNA, 34 bp, Artificial Sequence
  Description of Artificial Sequence: Synthetic oligonucleotide
acatggtgttggtagatgacatcttctcctcctg

SEQ ID NO: 286591 - DNA, 33 bp, Artificial Sequence
  Description of Artificial Sequence: Synthetic oligonucleotide
catggtgttggtagatgacatcttctcctcctg

SEQ ID NO: 286592 - DNA, 33 bp, Artificial Sequence
  Description of Artificial Sequence: Synthetic oligonucleotide
atggtgttggtagatgacatcttctcctcctgc

SEQ ID NO: 286593 - DNA, 32 bp, Artificial Sequence
  Description of Artificial Sequence: Synthetic oligonucleotide
tggtgttggtagatgacatcttctcctcctgc

SEQ ID NO: 286594 - DNA, 31 bp, Artificial Sequence
  Description of Artificial Sequence: Synthetic oligonucleotide
ggtgttggtagatgacatcttctcctcctgc

SEQ ID NO: 286595 - DNA, 33 bp, Artificial Sequence
  Description of Artificial Sequence: Synthetic oligonucleotide
gtgttggtagatgacatcttctcctcctgcatg

SEQ ID NO: 286596 - DNA, 33 bp, Artificial Sequence
  Description of Artificial Sequence: Synthetic oligonucleotide
tgttggtagatgacatcttctcctcctgcatgg

SEQ ID NO: 286597 - DNA, 32 bp, Artificial Sequence
  Description of Artificial Sequence: Synthetic oligonucleotide
gttggtagatgacatcttctcctcctgcatgg

SEQ ID NO: 286598 - DNA, 34 bp, Artificial Sequence
  Description of Artificial Sequence: Synthetic oligonucleotide
ttggtagatgacatcttctcctcctgcatggatg

SEQ ID NO: 286599 - DNA, 33 bp, Artificial Sequence
  Description of Artificial Sequence: Synthetic oligonucleotide
tggtagatgacatcttctcctcctgcatggatg

SEQ ID NO: 286600 - DNA, 32 bp, Artificial Sequence
  Description of Artificial Sequence: Synthetic oligonucleotide
ggtagatgacatcttctcctcctgcatggatg

SEQ ID NO: 286601 - DNA, 33 bp, Artificial Sequence
  Description of Artificial Sequence: Synthetic oligonucleotide
gtagatgacatcttctcctcctgcatggatgtg

SEQ ID NO: 286602 - DNA, 33 bp, Artificial Sequence
  Description of Artificial Sequence: Synthetic oligonucleotide
tagatgacatcttctcctcctgcatggatgtgg

SEQ ID NO: 286603 - DNA, 32 bp, Artificial Sequence
  Description of Artificial Sequence: Synthetic oligonucleotide
agatgacatcttctcctcctgcatggatgtgg

SEQ ID NO: 286604 - DNA, 31 bp, Artificial Sequence
  Description of Artificial Sequence: Synthetic oligonucleotide
gatgacatcttctcctcctgcatggatgtgg

SEQ ID NO: 286605 - DNA, 33 bp, Artificial Sequence
  Description of Artificial Sequence: Synthetic oligonucleotide
atgacatcttctcctcctgcatggatgtggttg

SEQ ID NO: 286606 - DNA, 32 bp, Artificial Sequence
  Description of Artificial Sequence: Synthetic oligonucleotide
tgacatcttctcctcctgcatggatgtggttg

SEQ ID NO: 286607 - DNA, 31 bp, Artificial Sequence
  Description of Artificial Sequence: Synthetic oligonucleotide
gacatcttctcctcctgcatggatgtggttg

SEQ ID NO: 286608 - DNA, 33 bp, Artificial Sequence
  Description of Artificial Sequence: Synthetic oligonucleotide
acatcttctcctcctgcatggatgtggttgtac

SEQ ID NO: 286609 - DNA, 32 bp, Artificial Sequence
  Description of Artificial Sequence: Synthetic oligonucleotide
catcttctcctcctgcatggatgtggttgtac

SEQ ID NO: 286610 - DNA, 33 bp, Artificial Sequence
  Description of Artificial Sequence: Synthetic oligonucleotide
atcttctcctcctgcatggatgtggttgtacag

SEQ ID NO: 286611 - DNA, 32 bp, Artificial Sequence
  Description of Artificial Sequence: Synthetic oligonucleotide
tcttctcctcctgcatggatgtggttgtacag

SEQ ID NO: 286612 - DNA, 31 bp, Artificial Sequence
  Description of Artificial Sequence: Synthetic oligonucleotide
cttctcctcctgcatggatgtggttgtacag

SEQ ID NO: 286613 - DNA, 34 bp, Artificial Sequence
  Description of Artificial Sequence: Synthetic oligonucleotide
ttctcctcctgcatggatgtggttgtacagaaag

SEQ ID NO: 286614 - DNA, 33 bp, Artificial Sequence
  Description of Artificial Sequence: Synthetic oligonucleotide
tctcctcctgcatggatgtggttgtacagaaag

SEQ ID NO: 286615 - DNA, 32 bp, Artificial Sequence
  Description of Artificial Sequence: Synthetic oligonucleotide
ctcctcctgcatggatgtggttgtacagaaag

SEQ ID NO: 286616 - DNA, 33 bp, Artificial Sequence
  Description of Artificial Sequence: Synthetic oligonucleotide
tcctcctgcatggatgtggttgtacagaaagag

SEQ ID NO: 286617 - DNA, 32 bp, Artificial Sequence
  Description of Artificial Sequence: Synthetic oligonucleotide
cctcctgcatggatgtggttgtacagaaagag

SEQ ID NO: 286618 - DNA, 34 bp, Artificial Sequence
  Description of Artificial Sequence: Synthetic oligonucleotide
ctcctgcatggatgtggttgtacagaaagagatg

SEQ ID NO: 286619 - DNA, 34 bp, Artificial Sequence
  Description of Artificial Sequence: Synthetic oligonucleotide
tcctgcatggatgtggttgtacagaaagagatgg

SEQ ID NO: 286620 - DNA, 33 bp, Artificial Sequence
  Description of Artificial Sequence: Synthetic oligonucleotide
cctgcatggatgtggttgtacagaaagagatgg

SEQ ID NO: 286621 - DNA, 33 bp, Artificial Sequence
  Description of Artificial Sequence: Synthetic oligonucleotide
ctgcatggatgtggttgtacagaaagagatggc

SEQ ID NO: 286622 - DNA, 36 bp, Artificial Sequence
  Description of Artificial Sequence: Synthetic oligonucleotide
tgcatggatgtggttgtacagaaagagatggcatac

SEQ ID NO: 286623 - DNA, 35 bp, Artificial Sequence
  Description of Artificial Sequence: Synthetic oligonucleotide
gcatggatgtggttgtacagaaagagatggcatac

SEQ ID NO: 286624 - DNA, 37 bp, Artificial Sequence
  Description of Artificial Sequence: Synthetic oligonucleotide
catggatgtggttgtacagaaagagatggcatacatg

SEQ ID NO: 286625 - DNA, 37 bp, Artificial Sequence
  Description of Artificial Sequence: Synthetic oligonucleotide
atggatgtggttgtacagaaagagatggcatacatgc

SEQ ID NO: 286626 - DNA, 36 bp, Artificial Sequence
  Description of Artificial Sequence: Synthetic oligonucleotide
tggatgtggttgtacagaaagagatggcatacatgc

SEQ ID NO: 286627 - DNA, 35 bp, Artificial Sequence
  Description of Artificial Sequence: Synthetic oligonucleotide
ggatgtggttgtacagaaagagatggcatacatgc

SEQ ID NO: 286628 - DNA, 37 bp, Artificial Sequence
  Description of Artificial Sequence: Synthetic oligonucleotide
gatgtggttgtacagaaagagatggcatacatgctag

SEQ ID NO: 286629 - DNA, 37 bp, Artificial Sequence
  Description of Artificial Sequence: Synthetic oligonucleotide
atgtggttgtacagaaagagatggcatacatgctagg

SEQ ID NO: 286630 - DNA, 36 bp, Artificial Sequence
  Description of Artificial Sequence: Synthetic oligonucleotide
tgtggttgtacagaaagagatggcatacatgctagg

SEQ ID NO: 286631 - DNA, 35 bp, Artificial Sequence
  Description of Artificial Sequence: Synthetic oligonucleotide
gtggttgtacagaaagagatggcatacatgctagg

SEQ ID NO: 286632 - DNA, 35 bp, Artificial Sequence
  Description of Artificial Sequence: Synthetic oligonucleotide
tggttgtacagaaagagatggcatacatgctaggg

SEQ ID NO: 286633 - DNA, 34 bp, Artificial Sequence
  Description of Artificial Sequence: Synthetic oligonucleotide
ggttgtacagaaagagatggcatacatgctaggg

SEQ ID NO: 286634 - DNA, 34 bp, Artificial Sequence
  Description of Artificial Sequence: Synthetic oligonucleotide
gttgtacagaaagagatggcatacatgctagggc

SEQ ID NO: 286635 - DNA, 34 bp, Artificial Sequence
  Description of Artificial Sequence: Synthetic oligonucleotide
ttgtacagaaagagatggcatacatgctagggcg

SEQ ID NO: 286636 - DNA, 33 bp, Artificial Sequence
  Description of Artificial Sequence: Synthetic oligonucleotide
tgtacagaaagagatggcatacatgctagggcg

SEQ ID NO: 286637 - DNA, 32 bp, Artificial Sequence
  Description of Artificial Sequence: Synthetic oligonucleotide
gtacagaaagagatggcatacatgctagggcg

SEQ ID NO: 286638 - DNA, 32 bp, Artificial Sequence
  Description of Artificial Sequence: Synthetic oligonucleotide
tacagaaagagatggcatacatgctagggcgg

SEQ ID NO: 286639 - DNA, 31 bp, Artificial Sequence
  Description of Artificial Sequence: Synthetic oligonucleotide
acagaaagagatggcatacatgctagggcgg

SEQ ID NO: 286640 - DNA, 30 bp, Artificial Sequence
  Description of Artificial Sequence: Synthetic oligonucleotide
cagaaagagatggcatacatgctagggcgg

SEQ ID NO: 286641 - DNA, 30 bp, Artificial Sequence
  Description of Artificial Sequence: Synthetic oligonucleotide
agaaagagatggcatacatgctagggcggc

SEQ ID NO: 286642 - DNA, 29 bp, Artificial Sequence
  Description of Artificial Sequence: Synthetic oligonucleotide
gaaagagatggcatacatgctagggcggc

SEQ ID NO: 286643 - DNA, 31 bp, Artificial Sequence
  Description of Artificial Sequence: Synthetic oligonucleotide
aaagagatggcatacatgctagggcggcatg

SEQ ID NO: 286644 - DNA, 30 bp, Artificial Sequence
  Description of Artificial Sequence: Synthetic oligonucleotide
aagagatggcatacatgctagggcggcatg

SEQ ID NO: 286645 - DNA, 29 bp, Artificial Sequence
  Description of Artificial Sequence: Synthetic oligonucleotide
agagatggcatacatgctagggcggcatg

SEQ ID NO: 286646 - DNA, 28 bp, Artificial Sequence
  Description of Artificial Sequence: Synthetic oligonucleotide
gagatggcatacatgctagggcggcatg

SEQ ID NO: 286647 - DNA, 28 bp, Artificial Sequence
  Description of Artificial Sequence: Synthetic oligonucleotide
agatggcatacatgctagggcggcatgg

SEQ ID NO: 286648 - DNA, 27 bp, Artificial Sequence
  Description of Artificial Sequence: Synthetic oligonucleotide
gatggcatacatgctagggcggcatgg

SEQ ID NO: 286649 - DNA, 27 bp, Artificial Sequence
  Description of Artificial Sequence: Synthetic oligonucleotide
atggcatacatgctagggcggcatggg

SEQ ID NO: 286650 - DNA, 26 bp, Artificial Sequence
  Description of Artificial Sequence: Synthetic oligonucleotide
tggcatacatgctagggcggcatggg

SEQ ID NO: 286651 - DNA, 25 bp, Artificial Sequence
  Description of Artificial Sequence: Synthetic oligonucleotide
ggcatacatgctagggcggcatggg

SEQ ID NO: 286652 - DNA, 26 bp, Artificial Sequence
  Description of Artificial Sequence: Synthetic oligonucleotide
gcatacatgctagggcggcatgggct

SEQ ID NO: 286653 - DNA, 27 bp, Artificial Sequence
  Description of Artificial Sequence: Synthetic oligonucleotide
catacatgctagggcggcatgggctgt

SEQ ID NO: 286654 - DNA, 28 bp, Artificial Sequence
  Description of Artificial Sequence: Synthetic oligonucleotide
atacatgctagggcggcatgggctgttc

SEQ ID NO: 286655 - DNA, 27 bp, Artificial Sequence
  Description of Artificial Sequence: Synthetic oligonucleotide
tacatgctagggcggcatgggctgttc

SEQ ID NO: 286656 - DNA, 26 bp, Artificial Sequence
  Description of Artificial Sequence: Synthetic oligonucleotide
acatgctagggcggcatgggctgttc

SEQ ID NO: 286657 - DNA, 25 bp, Artificial Sequence
  Description of Artificial Sequence: Synthetic oligonucleotide
catgctagggcggcatgggctgttc

SEQ ID NO: 286658 - DNA, 26 bp, Artificial Sequence
  Description of Artificial Sequence: Synthetic oligonucleotide
atgctagggcggcatgggctgttcct

SEQ ID NO: 286659 - DNA, 25 bp, Artificial Sequence
  Description of Artificial Sequence: Synthetic oligonucleotide
tgctagggcggcatgggctgttcct

SEQ ID NO: 286660 - DNA, 24 bp, Artificial Sequence
  Description of Artificial Sequence: Synthetic oligonucleotide
gctagggcggcatgggctgttcct

SEQ ID NO: 286661 - DNA, 24 bp, Artificial Sequence
  Description of Artificial Sequence: Synthetic oligonucleotide
ctagggcggcatgggctgttcctg

SEQ ID NO: 286662 - DNA, 25 bp, Artificial Sequence
  Description of Artificial Sequence: Synthetic oligonucleotide
tagggcggcatgggctgttcctggt

SEQ ID NO: 286663 - DNA, 24 bp, Artificial Sequence
  Description of Artificial Sequence: Synthetic oligonucleotide
agggcggcatgggctgttcctggt

SEQ ID NO: 286664 - DNA, 23 bp, Artificial Sequence
  Description of Artificial Sequence: Synthetic oligonucleotide
gggcggcatgggctgttcctggt

SEQ ID NO: 286665 - DNA, 23 bp, Artificial Sequence
  Description of Artificial Sequence: Synthetic oligonucleotide
ggcggcatgggctgttcctggtg

SEQ ID NO: 286666 - DNA, 24 bp, Artificial Sequence
  Description of Artificial Sequence: Synthetic oligonucleotide
gcggcatgggctgttcctggtgct

SEQ ID NO: 286667 - DNA, 25 bp, Artificial Sequence
  Description of Artificial Sequence: Synthetic oligonucleotide
cggcatgggctgttcctggtgctga

SEQ ID NO: 286668 - DNA, 26 bp, Artificial Sequence
  Description of Artificial Sequence: Synthetic oligonucleotide
ggcatgggctgttcctggtgctgagt

SEQ ID NO: 286669 - DNA, 27 bp, Artificial Sequence
  Description of Artificial Sequence: Synthetic oligonucleotide
gcatgggctgttcctggtgctgagtga

SEQ ID NO: 286670 - DNA, 28 bp, Artificial Sequence
  Description of Artificial Sequence: Synthetic oligonucleotide
catgggctgttcctggtgctgagtgatg

SEQ ID NO: 286671 - DNA, 30 bp, Artificial Sequence
  Description of Artificial Sequence: Synthetic oligonucleotide
atgggctgttcctggtgctgagtgatgatg

SEQ ID NO: 286672 - DNA, 29 bp, Artificial Sequence
  Description of Artificial Sequence: Synthetic oligonucleotide
tgggctgttcctggtgctgagtgatgatg

SEQ ID NO: 286673 - DNA, 28 bp, Artificial Sequence
  Description of Artificial Sequence: Synthetic oligonucleotide
gggctgttcctggtgctgagtgatgatg

SEQ ID NO: 286674 - DNA, 29 bp, Artificial Sequence
  Description of Artificial Sequence: Synthetic oligonucleotide
ggctgttcctggtgctgagtgatgatgtc

SEQ ID NO: 286675 - DNA, 29 bp, Artificial Sequence
  Description of Artificial Sequence: Synthetic oligonucleotide
gctgttcctggtgctgagtgatgatgtcg

SEQ ID NO: 286676 - DNA, 30 bp, Artificial Sequence
  Description of Artificial Sequence: Synthetic oligonucleotide
ctgttcctggtgctgagtgatgatgtcgag

SEQ ID NO: 286677 - DNA, 30 bp, Artificial Sequence
  Description of Artificial Sequence: Synthetic oligonucleotide
tgttcctggtgctgagtgatgatgtcgagc

SEQ ID NO: 286678 - DNA, 29 bp, Artificial Sequence
  Description of Artificial Sequence: Synthetic oligonucleotide
gttcctggtgctgagtgatgatgtcgagc

SEQ ID NO: 286679 - DNA, 30 bp, Artificial Sequence
  Description of Artificial Sequence: Synthetic oligonucleotide
ttcctggtgctgagtgatgatgtcgagcag

SEQ ID NO: 286680 - DNA, 29 bp, Artificial Sequence
  Description of Artificial Sequence: Synthetic oligonucleotide
tcctggtgctgagtgatgatgtcgagcag

SEQ ID NO: 286681 - DNA, 28 bp, Artificial Sequence
  Description of Artificial Sequence: Synthetic oligonucleotide
cctggtgctgagtgatgatgtcgagcag

SEQ ID NO: 286682 - DNA, 31 bp, Artificial Sequence
  Description of Artificial Sequence: Synthetic oligonucleotide
ctggtgctgagtgatgatgtcgagcagtatg

SEQ ID NO: 286683 - DNA, 32 bp, Artificial Sequence
  Description of Artificial Sequence: Synthetic oligonucleotide
tggtgctgagtgatgatgtcgagcagtatgag

SEQ ID NO: 286684 - DNA, 31 bp, Artificial Sequence
  Description of Artificial Sequence: Synthetic oligonucleotide
ggtgctgagtgatgatgtcgagcagtatgag

SEQ ID NO: 286685 - DNA, 31 bp, Artificial Sequence
  Description of Artificial Sequence: Synthetic oligonucleotide
gtgctgagtgatgatgtcgagcagtatgagg

SEQ ID NO: 286686 - DNA, 32 bp, Artificial Sequence
  Description of Artificial Sequence: Synthetic oligonucleotide
tgctgagtgatgatgtcgagcagtatgaggtc

SEQ ID NO: 286687 - DNA, 31 bp, Artificial Sequence
  Description of Artificial Sequence: Synthetic oligonucleotide
gctgagtgatgatgtcgagcagtatgaggtc

SEQ ID NO: 286688 - DNA, 31 bp, Artificial Sequence
  Description of Artificial Sequence: Synthetic oligonucleotide
ctgagtgatgatgtcgagcagtatgaggtcc

SEQ ID NO: 286689 - DNA, 32 bp, Artificial Sequence
  Description of Artificial Sequence: Synthetic oligonucleotide
tgagtgatgatgtcgagcagtatgaggtcctg

SEQ ID NO: 286690 - DNA, 31 bp, Artificial Sequence
  Description of Artificial Sequence: Synthetic oligonucleotide
gagtgatgatgtcgagcagtatgaggtcctg

SEQ ID NO: 286691 - DNA, 32 bp, Artificial Sequence
  Description of Artificial Sequence: Synthetic oligonucleotide
agtgatgatgtcgagcagtatgaggtcctgac

SEQ ID NO: 286692 - DNA, 31 bp, Artificial Sequence
  Description of Artificial Sequence: Synthetic oligonucleotide
gtgatgatgtcgagcagtatgaggtcctgac

SEQ ID NO: 286693 - DNA, 32 bp, Artificial Sequence
  Description of Artificial Sequence: Synthetic oligonucleotide
tgatgatgtcgagcagtatgaggtcctgacag

SEQ ID NO: 286694 - DNA, 31 bp, Artificial Sequence
  Description of Artificial Sequence: Synthetic oligonucleotide
gatgatgtcgagcagtatgaggtcctgacag

SEQ ID NO: 286695 - DNA, 32 bp, Artificial Sequence
  Description of Artificial Sequence: Synthetic oligonucleotide
atgatgtcgagcagtatgaggtcctgacagac

SEQ ID NO: 286696 - DNA, 31 bp, Artificial Sequence
  Description of Artificial Sequence: Synthetic oligonucleotide
tgatgtcgagcagtatgaggtcctgacagac

SEQ ID NO: 286697 - DNA, 30 bp, Artificial Sequence
  Description of Artificial Sequence: Synthetic oligonucleotide
gatgtcgagcagtatgaggtcctgacagac

SEQ ID NO: 286698 - DNA, 32 bp, Artificial Sequence
  Description of Artificial Sequence: Synthetic oligonucleotide
atgtcgagcagtatgaggtcctgacagacatc

SEQ ID NO: 286699 - DNA, 31 bp, Artificial Sequence
  Description of Artificial Sequence: Synthetic oligonucleotide
tgtcgagcagtatgaggtcctgacagacatc

SEQ ID NO: 286700 - DNA, 30 bp, Artificial Sequence
  Description of Artificial Sequence: Synthetic oligonucleotide
gtcgagcagtatgaggtcctgacagacatc

SEQ ID NO: 286701 - DNA, 32 bp, Artificial Sequence
  Description of Artificial Sequence: Synthetic oligonucleotide
tcgagcagtatgaggtcctgacagacatcatg

SEQ ID NO: 286702 - DNA, 31 bp, Artificial Sequence
  Description of Artificial Sequence: Synthetic oligonucleotide
cgagcagtatgaggtcctgacagacatcatg

SEQ ID NO: 286703 - DNA, 32 bp, Artificial Sequence
  Description of Artificial Sequence: Synthetic oligonucleotide
gagcagtatgaggtcctgacagacatcatgtc

SEQ ID NO: 286704 - DNA, 32 bp, Artificial Sequence
  Description of Artificial Sequence: Synthetic oligonucleotide
agcagtatgaggtcctgacagacatcatgtcc

SEQ ID NO: 286705 - DNA, 31 bp, Artificial Sequence
  Description of Artificial Sequence: Synthetic oligonucleotide
gcagtatgaggtcctgacagacatcatgtcc

SEQ ID NO: 286706 - DNA, 34 bp, Artificial Sequence
  Description of Artificial Sequence: Synthetic oligonucleotide
cagtatgaggtcctgacagacatcatgtcctatg

SEQ ID NO: 286707 - DNA, 36 bp, Artificial Sequence
  Description of Artificial Sequence: Synthetic oligonucleotide
agtatgaggtcctgacagacatcatgtcctatgtac

SEQ ID NO: 286708 - DNA, 35 bp, Artificial Sequence
  Description of Artificial Sequence: Synthetic oligonucleotide
gtatgaggtcctgacagacatcatgtcctatgtac

SEQ ID NO: 286709 - DNA, 36 bp, Artificial Sequence
  Description of Artificial Sequence: Synthetic oligonucleotide
tatgaggtcctgacagacatcatgtcctatgtacag

SEQ ID NO: 286710 - DNA, 35 bp, Artificial Sequence
  Description of Artificial Sequence: Synthetic oligonucleotide
atgaggtcctgacagacatcatgtcctatgtacag

SEQ ID NO: 286711 - DNA, 34 bp, Artificial Sequence
  Description of Artificial Sequence: Synthetic oligonucleotide
tgaggtcctgacagacatcatgtcctatgtacag

SEQ ID NO: 286712 - DNA, 33 bp, Artificial Sequence
  Description of Artificial Sequence: Synthetic oligonucleotide
gaggtcctgacagacatcatgtcctatgtacag

SEQ ID NO: 286713 - DNA, 33 bp, Artificial Sequence
  Description of Artificial Sequence: Synthetic oligonucleotide
aggtcctgacagacatcatgtcctatgtacagc

SEQ ID NO: 286714 - DNA, 32 bp, Artificial Sequence
  Description of Artificial Sequence: Synthetic oligonucleotide
ggtcctgacagacatcatgtcctatgtacagc

SEQ ID NO: 286715 - DNA, 33 bp, Artificial Sequence
  Description of Artificial Sequence: Synthetic oligonucleotide
gtcctgacagacatcatgtcctatgtacagcac

SEQ ID NO: 286716 - DNA, 35 bp, Artificial Sequence
  Description of Artificial Sequence: Synthetic oligonucleotide
tcctgacagacatcatgtcctatgtacagcacaac

SEQ ID NO: 286717 - DNA, 34 bp, Artificial Sequence
  Description of Artificial Sequence: Synthetic oligonucleotide
cctgacagacatcatgtcctatgtacagcacaac

SEQ ID NO: 286718 - DNA, 35 bp, Artificial Sequence
  Description of Artificial Sequence: Synthetic oligonucleotide
ctgacagacatcatgtcctatgtacagcacaacag

SEQ ID NO: 286719 - DNA, 35 bp, Artificial Sequence
  Description of Artificial Sequence: Synthetic oligonucleotide
tgacagacatcatgtcctatgtacagcacaacagc

SEQ ID NO: 286720 - DNA, 34 bp, Artificial Sequence
  Description of Artificial Sequence: Synthetic oligonucleotide
gacagacatcatgtcctatgtacagcacaacagc

SEQ ID NO: 286721 - DNA, 36 bp, Artificial Sequence
  Description of Artificial Sequence: Synthetic oligonucleotide
acagacatcatgtcctatgtacagcacaacagcaag

SEQ ID NO: 286722 - DNA, 35 bp, Artificial Sequence
  Description of Artificial Sequence: Synthetic oligonucleotide
cagacatcatgtcctatgtacagcacaacagcaag

SEQ ID NO: 286723 - DNA, 37 bp, Artificial Sequence
  Description of Artificial Sequence: Synthetic oligonucleotide
agacatcatgtcctatgtacagcacaacagcaagttc

SEQ ID NO: 286724 - DNA, 36 bp, Artificial Sequence
  Description of Artificial Sequence: Synthetic oligonucleotide
gacatcatgtcctatgtacagcacaacagcaagttc

SEQ ID NO: 286725 - DNA, 38 bp, Artificial Sequence
  Description of Artificial Sequence: Synthetic oligonucleotide
acatcatgtcctatgtacagcacaacagcaagttcttg

SEQ ID NO: 286726 - DNA, 37 bp, Artificial Sequence
  Description of Artificial Sequence: Synthetic oligonucleotide
catcatgtcctatgtacagcacaacagcaagttcttg

SEQ ID NO: 286727 - DNA, 37 bp, Artificial Sequence
  Description of Artificial Sequence: Synthetic oligonucleotide
atcatgtcctatgtacagcacaacagcaagttcttgg

SEQ ID NO: 286728 - DNA, 36 bp, Artificial Sequence
  Description of Artificial Sequence: Synthetic oligonucleotide
tcatgtcctatgtacagcacaacagcaagttcttgg

SEQ ID NO: 286729 - DNA, 35 bp, Artificial Sequence
  Description of Artificial Sequence: Synthetic oligonucleotide
catgtcctatgtacagcacaacagcaagttcttgg

SEQ ID NO: 286730 - DNA, 35 bp, Artificial Sequence
  Description of Artificial Sequence: Synthetic oligonucleotide
atgtcctatgtacagcacaacagcaagttcttggc

SEQ ID NO: 286731 - DNA, 34 bp, Artificial Sequence
  Description of Artificial Sequence: Synthetic oligonucleotide
tgtcctatgtacagcacaacagcaagttcttggc

SEQ ID NO: 286732 - DNA, 33 bp, Artificial Sequence
  Description of Artificial Sequence: Synthetic oligonucleotide
gtcctatgtacagcacaacagcaagttcttggc

SEQ ID NO: 286733 - DNA, 33 bp, Artificial Sequence
  Description of Artificial Sequence: Synthetic oligonucleotide
tcctatgtacagcacaacagcaagttcttggcc

SEQ ID NO: 286734 - DNA, 32 bp, Artificial Sequence
  Description of Artificial Sequence: Synthetic oligonucleotide
cctatgtacagcacaacagcaagttcttggcc

SEQ ID NO: 286735 - DNA, 35 bp, Artificial Sequence
  Description of Artificial Sequence: Synthetic oligonucleotide
ctatgtacagcacaacagcaagttcttggccatag

SEQ ID NO: 286736 - DNA, 35 bp, Artificial Sequence
  Description of Artificial Sequence: Synthetic oligonucleotide
tatgtacagcacaacagcaagttcttggccatagc

SEQ ID NO: 286737 - DNA, 34 bp, Artificial Sequence
  Description of Artificial Sequence: Synthetic oligonucleotide
atgtacagcacaacagcaagttcttggccatagc

SEQ ID NO: 286738 - DNA, 33 bp, Artificial Sequence
  Description of Artificial Sequence: Synthetic oligonucleotide
tgtacagcacaacagcaagttcttggccatagc

SEQ ID NO: 286739 - DNA, 32 bp, Artificial Sequence
  Description of Artificial Sequence: Synthetic oligonucleotide
gtacagcacaacagcaagttcttggccatagc

SEQ ID NO: 286740 - DNA, 33 bp, Artificial Sequence
  Description of Artificial Sequence: Synthetic oligonucleotide
tacagcacaacagcaagttcttggccatagctc

SEQ ID NO: 286741 - DNA, 32 bp, Artificial Sequence
  Description of Artificial Sequence: Synthetic oligonucleotide
acagcacaacagcaagttcttggccatagctc

SEQ ID NO: 286742 - DNA, 31 bp, Artificial Sequence
  Description of Artificial Sequence: Synthetic oligonucleotide
cagcacaacagcaagttcttggccatagctc

SEQ ID NO: 286743 - DNA, 31 bp, Artificial Sequence
  Description of Artificial Sequence: Synthetic oligonucleotide
agcacaacagcaagttcttggccatagctcg

SEQ ID NO: 286744 - DNA, 30 bp, Artificial Sequence
  Description of Artificial Sequence: Synthetic oligonucleotide
gcacaacagcaagttcttggccatagctcg

SEQ ID NO: 286745 - DNA, 30 bp, Artificial Sequence
  Description of Artificial Sequence: Synthetic oligonucleotide
cacaacagcaagttcttggccatagctcgg

SEQ ID NO: 286746 - DNA, 30 bp, Artificial Sequence
  Description of Artificial Sequence: Synthetic oligonucleotide
acaacagcaagttcttggccatagctcggg

SEQ ID NO: 286747 - DNA, 29 bp, Artificial Sequence
  Description of Artificial Sequence: Synthetic oligonucleotide
caacagcaagttcttggccatagctcggg

SEQ ID NO: 286748 - DNA, 30 bp, Artificial Sequence
  Description of Artificial Sequence: Synthetic oligonucleotide
aacagcaagttcttggccatagctcgggtg

SEQ ID NO: 286749 - DNA, 29 bp, Artificial Sequence
  Description of Artificial Sequence: Synthetic oligonucleotide
acagcaagttcttggccatagctcgggtg

SEQ ID NO: 286750 - DNA, 28 bp, Artificial Sequence
  Description of Artificial Sequence: Synthetic oligonucleotide
cagcaagttcttggccatagctcgggtg

SEQ ID NO: 286751 - DNA, 28 bp, Artificial Sequence
  Description of Artificial Sequence: Synthetic oligonucleotide
agcaagttcttggccatagctcgggtgc

SEQ ID NO: 286752 - DNA, 27 bp, Artificial Sequence
  Description of Artificial Sequence: Synthetic oligonucleotide
gcaagttcttggccatagctcgggtgc

SEQ ID NO: 286753 - DNA, 28 bp, Artificial Sequence
  Description of Artificial Sequence: Synthetic oligonucleotide
caagttcttggccatagctcgggtgctg

SEQ ID NO: 286754 - DNA, 28 bp, Artificial Sequence
  Description of Artificial Sequence: Synthetic oligonucleotide
aagttcttggccatagctcgggtgctgg

SEQ ID NO: 286755 - DNA, 27 bp, Artificial Sequence
  Description of Artificial Sequence: Synthetic oligonucleotide
agttcttggccatagctcgggtgctgg

SEQ ID NO: 286756 - DNA, 27 bp, Artificial Sequence
  Description of Artificial Sequence: Synthetic oligonucleotide
gttcttggccatagctcgggtgctgga

SEQ ID NO: 286757 - DNA, 27 bp, Artificial Sequence
  Description of Artificial Sequence: Synthetic oligonucleotide
ttcttggccatagctcgggtgctggac

SEQ ID NO: 286758 - DNA, 27 bp, Artificial Sequence
  Description of Artificial Sequence: Synthetic oligonucleotide
tcttggccatagctcgggtgctggaca

SEQ ID NO: 286759 - DNA, 27 bp, Artificial Sequence
  Description of Artificial Sequence: Synthetic oligonucleotide
cttggccatagctcgggtgctggacat

SEQ ID NO: 286760 - DNA, 27 bp, Artificial Sequence
  Description of Artificial Sequence: Synthetic oligonucleotide
ttggccatagctcgggtgctggacatg

SEQ ID NO: 286761 - DNA, 27 bp, Artificial Sequence
  Description of Artificial Sequence: Synthetic oligonucleotide
tggccatagctcgggtgctggacatga

SEQ ID NO: 286762 - DNA, 27 bp, Artificial Sequence
  Description of Artificial Sequence: Synthetic oligonucleotide
ggccatagctcgggtgctggacatgat

SEQ ID NO: 286763 - DNA, 27 bp, Artificial Sequence
  Description of Artificial Sequence: Synthetic oligonucleotide
gccatagctcgggtgctggacatgatg

SEQ ID NO: 286764 - DNA, 27 bp, Artificial Sequence
  Description of Artificial Sequence: Synthetic oligonucleotide
ccatagctcgggtgctggacatgatgg

SEQ ID NO: 286765 - DNA, 28 bp, Artificial Sequence
  Description of Artificial Sequence: Synthetic oligonucleotide
catagctcgggtgctggacatgatggag

SEQ ID NO: 286766 - DNA, 28 bp, Artificial Sequence
  Description of Artificial Sequence: Synthetic oligonucleotide
atagctcgggtgctggacatgatggagc

SEQ ID NO: 286767 - DNA, 27 bp, Artificial Sequence
  Description of Artificial Sequence: Synthetic oligonucleotide
tagctcgggtgctggacatgatggagc

SEQ ID NO: 286768 - DNA, 26 bp, Artificial Sequence
  Description of Artificial Sequence: Synthetic oligonucleotide
agctcgggtgctggacatgatggagc

SEQ ID NO: 286769 - DNA, 25 bp, Artificial Sequence
  Description of Artificial Sequence: Synthetic oligonucleotide
gctcgggtgctggacatgatggagc

SEQ ID NO: 286770 - DNA, 25 bp, Artificial Sequence
  Description of Artificial Sequence: Synthetic oligonucleotide
ctcgggtgctggacatgatggagcc

SEQ ID NO: 286771 - DNA, 27 bp, Artificial Sequence
  Description of Artificial Sequence: Synthetic oligonucleotide
tcgggtgctggacatgatggagcccta

SEQ ID NO: 286772 - DNA, 26 bp, Artificial Sequence
  Description of Artificial Sequence: Synthetic oligonucleotide
cgggtgctggacatgatggagcccta

SEQ ID NO: 286773 - DNA, 26 bp, Artificial Sequence
  Description of Artificial Sequence: Synthetic oligonucleotide
gggtgctggacatgatggagccctag

SEQ ID NO: 286774 - DNA, 27 bp, Artificial Sequence
  Description of Artificial Sequence: Synthetic oligonucleotide
ggtgctggacatgatggagccctaggt

SEQ ID NO: 286775 - DNA, 27 bp, Artificial Sequence
  Description of Artificial Sequence: Synthetic oligonucleotide
gtgctggacatgatggagccctaggtg

SEQ ID NO: 286776 - DNA, 27 bp, Artificial Sequence
  Description of Artificial Sequence: Synthetic oligonucleotide
tgctggacatgatggagccctaggtgc

SEQ ID NO: 286777 - DNA, 26 bp, Artificial Sequence
  Description of Artificial Sequence: Synthetic oligonucleotide
gctggacatgatggagccctaggtgc

SEQ ID NO: 286778 - DNA, 27 bp, Artificial Sequence
  Description of Artificial Sequence: Synthetic oligonucleotide
ctggacatgatggagccctaggtgcct

SEQ ID NO: 286779 - DNA, 27 bp, Artificial Sequence
  Description of Artificial Sequence: Synthetic oligonucleotide
tggacatgatggagccctaggtgcctg

SEQ ID NO: 286780 - DNA, 27 bp, Artificial Sequence
  Description of Artificial Sequence: Synthetic oligonucleotide
ggacatgatggagccctaggtgcctgt

SEQ ID NO: 286781 - DNA, 28 bp, Artificial Sequence
  Description of Artificial Sequence: Synthetic oligonucleotide
gacatgatggagccctaggtgcctgttg

SEQ ID NO: 286782 - DNA, 29 bp, Artificial Sequence
  Description of Artificial Sequence: Synthetic oligonucleotide
acatgatggagccctaggtgcctgttgac

SEQ ID NO: 286783 - DNA, 28 bp, Artificial Sequence
  Description of Artificial Sequence: Synthetic oligonucleotide
catgatggagccctaggtgcctgttgac

SEQ ID NO: 286784 - DNA, 30 bp, Artificial Sequence
  Description of Artificial Sequence: Synthetic oligonucleotide
atgatggagccctaggtgcctgttgacatc

SEQ ID NO: 286785 - DNA, 29 bp, Artificial Sequence
  Description of Artificial Sequence: Synthetic oligonucleotide
tgatggagccctaggtgcctgttgacatc

SEQ ID NO: 286786 - DNA, 28 bp, Artificial Sequence
  Description of Artificial Sequence: Synthetic oligonucleotide
gatggagccctaggtgcctgttgacatc

SEQ ID NO: 286787 - DNA, 30 bp, Artificial Sequence
  Description of Artificial Sequence: Synthetic oligonucleotide
atggagccctaggtgcctgttgacatctag

SEQ ID NO: 286788 - DNA, 29 bp, Artificial Sequence
  Description of Artificial Sequence: Synthetic oligonucleotide
tggagccctaggtgcctgttgacatctag

SEQ ID NO: 286789 - DNA, 28 bp, Artificial Sequence
  Description of Artificial Sequence: Synthetic oligonucleotide
ggagccctaggtgcctgttgacatctag

SEQ ID NO: 286790 - DNA, 32 bp, Artificial Sequence
  Description of Artificial Sequence: Synthetic oligonucleotide
gagccctaggtgcctgttgacatctagaaaac

SEQ ID NO: 286791 - DNA, 32 bp, Artificial Sequence
  Description of Artificial Sequence: Synthetic oligonucleotide
agccctaggtgcctgttgacatctagaaaacc

SEQ ID NO: 286792 - DNA, 31 bp, Artificial Sequence
  Description of Artificial Sequence: Synthetic oligonucleotide
gccctaggtgcctgttgacatctagaaaacc

SEQ ID NO: 286793 - DNA, 31 bp, Artificial Sequence
  Description of Artificial Sequence: Synthetic oligonucleotide
ccctaggtgcctgttgacatctagaaaaccc

SEQ ID NO: 286794 - DNA, 32 bp, Artificial Sequence
  Description of Artificial Sequence: Synthetic oligonucleotide
cctaggtgcctgttgacatctagaaaacccac

SEQ ID NO: 286795 - DNA, 32 bp, Artificial Sequence
  Description of Artificial Sequence: Synthetic oligonucleotide
ctaggtgcctgttgacatctagaaaacccacg

SEQ ID NO: 286796 - DNA, 34 bp, Artificial Sequence
  Description of Artificial Sequence: Synthetic oligonucleotide
taggtgcctgttgacatctagaaaacccacgtag

SEQ ID NO: 286797 - DNA, 33 bp, Artificial Sequence
  Description of Artificial Sequence: Synthetic oligonucleotide
aggtgcctgttgacatctagaaaacccacgtag

SEQ ID NO: 286798 - DNA, 32 bp, Artificial Sequence
  Description of Artificial Sequence: Synthetic oligonucleotide
ggtgcctgttgacatctagaaaacccacgtag

SEQ ID NO: 286799 - DNA, 33 bp, Artificial Sequence
  Description of Artificial Sequence: Synthetic oligonucleotide
gtgcctgttgacatctagaaaacccacgtagag

SEQ ID NO: 286800 - DNA, 35 bp, Artificial Sequence
  Description of Artificial Sequence: Synthetic oligonucleotide
tgcctgttgacatctagaaaacccacgtagagaac

SEQ ID NO: 286801 - DNA, 34 bp, Artificial Sequence
  Description of Artificial Sequence: Synthetic oligonucleotide
gcctgttgacatctagaaaacccacgtagagaac

SEQ ID NO: 286802 - DNA, 36 bp, Artificial Sequence
  Description of Artificial Sequence: Synthetic oligonucleotide
cctgttgacatctagaaaacccacgtagagaacatc

SEQ ID NO: 286803 - DNA, 37 bp, Artificial Sequence
  Description of Artificial Sequence: Synthetic oligonucleotide
ctgttgacatctagaaaacccacgtagagaacatcag

SEQ ID NO: 286804 - DNA, 37 bp, Artificial Sequence
  Description of Artificial Sequence: Synthetic oligonucleotide
tgttgacatctagaaaacccacgtagagaacatcagg

SEQ ID NO: 286805 - DNA, 36 bp, Artificial Sequence
  Description of Artificial Sequence: Synthetic oligonucleotide
gttgacatctagaaaacccacgtagagaacatcagg

SEQ ID NO: 286806 - DNA, 39 bp, Artificial Sequence
  Description of Artificial Sequence: Synthetic oligonucleotide
ttgacatctagaaaacccacgtagagaacatcaggtttg

SEQ ID NO: 286807 - DNA, 38 bp, Artificial Sequence
  Description of Artificial Sequence: Synthetic oligonucleotide
tgacatctagaaaacccacgtagagaacatcaggtttg

SEQ ID NO: 286808 - DNA, 37 bp, Artificial Sequence
  Description of Artificial Sequence: Synthetic oligonucleotide
gacatctagaaaacccacgtagagaacatcaggtttg

SEQ ID NO: 286809 - DNA, 37 bp, Artificial Sequence
  Description of Artificial Sequence: Synthetic oligonucleotide
acatctagaaaacccacgtagagaacatcaggtttgg

SEQ ID NO: 286810 - DNA, 36 bp, Artificial Sequence
  Description of Artificial Sequence: Synthetic oligonucleotide
catctagaaaacccacgtagagaacatcaggtttgg

SEQ ID NO: 286811 - DNA, 36 bp, Artificial Sequence
  Description of Artificial Sequence: Synthetic oligonucleotide
atctagaaaacccacgtagagaacatcaggtttggc

SEQ ID NO: 286812 - DNA, 35 bp, Artificial Sequence
  Description of Artificial Sequence: Synthetic oligonucleotide
tctagaaaacccacgtagagaacatcaggtttggc

SEQ ID NO: 286813 - DNA, 34 bp, Artificial Sequence
  Description of Artificial Sequence: Synthetic oligonucleotide
ctagaaaacccacgtagagaacatcaggtttggc

SEQ ID NO: 286814 - DNA, 34 bp, Artificial Sequence
  Description of Artificial Sequence: Synthetic oligonucleotide
tagaaaacccacgtagagaacatcaggtttggcg

SEQ ID NO: 286815 - DNA, 33 bp, Artificial Sequence
  Description of Artificial Sequence: Synthetic oligonucleotide
agaaaacccacgtagagaacatcaggtttggcg

SEQ ID NO: 286816 - DNA, 32 bp, Artificial Sequence
  Description of Artificial Sequence: Synthetic oligonucleotide
gaaaacccacgtagagaacatcaggtttggcg

SEQ ID NO: 286817 - DNA, 32 bp, Artificial Sequence
  Description of Artificial Sequence: Synthetic oligonucleotide
aaaacccacgtagagaacatcaggtttggcgg

SEQ ID NO: 286818 - DNA, 31 bp, Artificial Sequence
  Description of Artificial Sequence: Synthetic oligonucleotide
aaacccacgtagagaacatcaggtttggcgg

SEQ ID NO: 286819 - DNA, 30 bp, Artificial Sequence
  Description of Artificial Sequence: Synthetic oligonucleotide
aacccacgtagagaacatcaggtttggcgg

SEQ ID NO: 286820 - DNA, 29 bp, Artificial Sequence
  Description of Artificial Sequence: Synthetic oligonucleotide
acccacgtagagaacatcaggtttggcgg

SEQ ID NO: 286821 - DNA, 28 bp, Artificial Sequence
  Description of Artificial Sequence: Synthetic oligonucleotide
cccacgtagagaacatcaggtttggcgg

SEQ ID NO: 286822 - DNA, 28 bp, Artificial Sequence
  Description of Artificial Sequence: Synthetic oligonucleotide
ccacgtagagaacatcaggtttggcggc

SEQ ID NO: 286823 - DNA, 29 bp, Artificial Sequence
  Description of Artificial Sequence: Synthetic oligonucleotide
cacgtagagaacatcaggtttggcggcag

SEQ ID NO: 286824 - DNA, 30 bp, Artificial Sequence
  Description of Artificial Sequence: Synthetic oligonucleotide
acgtagagaacatcaggtttggcggcagtg

SEQ ID NO: 286825 - DNA, 29 bp, Artificial Sequence
  Description of Artificial Sequence: Synthetic oligonucleotide
cgtagagaacatcaggtttggcggcagtg

SEQ ID NO: 286826 - DNA, 29 bp, Artificial Sequence
  Description of Artificial Sequence: Synthetic oligonucleotide
gtagagaacatcaggtttggcggcagtgg

SEQ ID NO: 286827 - DNA, 29 bp, Artificial Sequence
  Description of Artificial Sequence: Synthetic oligonucleotide
tagagaacatcaggtttggcggcagtggc

SEQ ID NO: 286828 - DNA, 28 bp, Artificial Sequence
  Description of Artificial Sequence: Synthetic oligonucleotide
agagaacatcaggtttggcggcagtggc

SEQ ID NO: 286829 - DNA, 27 bp, Artificial Sequence
  Description of Artificial Sequence: Synthetic oligonucleotide
gagaacatcaggtttggcggcagtggc

SEQ ID NO: 286830 - DNA, 28 bp, Artificial Sequence
  Description of Artificial Sequence: Synthetic oligonucleotide
agaacatcaggtttggcggcagtggcac

SEQ ID NO: 286831 - DNA, 27 bp, Artificial Sequence
  Description of Artificial Sequence: Synthetic oligonucleotide
gaacatcaggtttggcggcagtggcac

SEQ ID NO: 286832 - DNA, 28 bp, Artificial Sequence
  Description of Artificial Sequence: Synthetic oligonucleotide
aacatcaggtttggcggcagtggcactc

SEQ ID NO: 286833 - DNA, 27 bp, Artificial Sequence
  Description of Artificial Sequence: Synthetic oligonucleotide
acatcaggtttggcggcagtggcactc

SEQ ID NO: 286834 - DNA, 27 bp, Artificial Sequence
  Description of Artificial Sequence: Synthetic oligonucleotide
catcaggtttggcggcagtggcactca

SEQ ID NO: 286835 - DNA, 27 bp, Artificial Sequence
  Description of Artificial Sequence: Synthetic oligonucleotide
atcaggtttggcggcagtggcactcag

SEQ ID NO: 286836 - DNA, 26 bp, Artificial Sequence
  Description of Artificial Sequence: Synthetic oligonucleotide
tcaggtttggcggcagtggcactcag

SEQ ID NO: 286837 - DNA, 25 bp, Artificial Sequence
  Description of Artificial Sequence: Synthetic oligonucleotide
caggtttggcggcagtggcactcag

SEQ ID NO: 286838 - DNA, 26 bp, Artificial Sequence
  Description of Artificial Sequence: Synthetic oligonucleotide
aggtttggcggcagtggcactcaggt

SEQ ID NO: 286839 - DNA, 25 bp, Artificial Sequence
  Description of Artificial Sequence: Synthetic oligonucleotide
ggtttggcggcagtggcactcaggt

SEQ ID NO: 286840 - DNA, 25 bp, Artificial Sequence
  Description of Artificial Sequence: Synthetic oligonucleotide
gtttggcggcagtggcactcaggtg

SEQ ID NO: 286841 - DNA, 26 bp, Artificial Sequence
  Description of Artificial Sequence: Synthetic oligonucleotide
tttggcggcagtggcactcaggtggt

SEQ ID NO: 286842 - DNA, 25 bp, Artificial Sequence
  Description of Artificial Sequence: Synthetic oligonucleotide
ttggcggcagtggcactcaggtggt

SEQ ID NO: 286843 - DNA, 24 bp, Artificial Sequence
  Description of Artificial Sequence: Synthetic oligonucleotide
tggcggcagtggcactcaggtggt

SEQ ID NO: 286844 - DNA, 23 bp, Artificial Sequence
  Description of Artificial Sequence: Synthetic oligonucleotide
ggcggcagtggcactcaggtggt

SEQ ID NO: 286845 - DNA, 24 bp, Artificial Sequence
  Description of Artificial Sequence: Synthetic oligonucleotide
gcggcagtggcactcaggtggtct

SEQ ID NO: 286846 - DNA, 25 bp, Artificial Sequence
  Description of Artificial Sequence: Synthetic oligonucleotide
cggcagtggcactcaggtggtctct

SEQ ID NO: 286847 - DNA, 25 bp, Artificial Sequence
  Description of Artificial Sequence: Synthetic oligonucleotide
ggcagtggcactcaggtggtctctg

SEQ ID NO: 286848 - DNA, 25 bp, Artificial Sequence
  Description of Artificial Sequence: Synthetic oligonucleotide
gcagtggcactcaggtggtctctgc

SEQ ID NO: 286849 - DNA, 25 bp, Artificial Sequence
  Description of Artificial Sequence: Synthetic oligonucleotide
cagtggcactcaggtggtctctgcc

SEQ ID NO: 286850 - DNA, 25 bp, Artificial Sequence
  Description of Artificial Sequence: Synthetic oligonucleotide
agtggcactcaggtggtctctgccc

SEQ ID NO: 286851 - DNA, 24 bp, Artificial Sequence
  Description of Artificial Sequence: Synthetic oligonucleotide
gtggcactcaggtggtctctgccc

SEQ ID NO: 286852 - DNA, 24 bp, Artificial Sequence
  Description of Artificial Sequence: Synthetic oligonucleotide
tggcactcaggtggtctctgcccg

SEQ ID NO: 286853 - DNA, 23 bp, Artificial Sequence
  Description of Artificial Sequence: Synthetic oligonucleotide
ggcactcaggtggtctctgcccg

SEQ ID NO: 286854 - DNA, 25 bp, Artificial Sequence
  Description of Artificial Sequence: Synthetic oligonucleotide
gcactcaggtggtctctgcccggat

SEQ ID NO: 286855 - DNA, 27 bp, Artificial Sequence
  Description of Artificial Sequence: Synthetic oligonucleotide
cactcaggtggtctctgcccggatgaa

SEQ ID NO: 286856 - DNA, 27 bp, Artificial Sequence
  Description of Artificial Sequence: Synthetic oligonucleotide
actcaggtggtctctgcccggatgaac

SEQ ID NO: 286857 - DNA, 26 bp, Artificial Sequence
  Description of Artificial Sequence: Synthetic oligonucleotide
ctcaggtggtctctgcccggatgaac

SEQ ID NO: 286858 - DNA, 27 bp, Artificial Sequence
  Description of Artificial Sequence: Synthetic oligonucleotide
tcaggtggtctctgcccggatgaacct

SEQ ID NO: 286859 - DNA, 26 bp, Artificial Sequence
  Description of Artificial Sequence: Synthetic oligonucleotide
caggtggtctctgcccggatgaacct

SEQ ID NO: 286860 - DNA, 26 bp, Artificial Sequence
  Description of Artificial Sequence: Synthetic oligonucleotide
aggtggtctctgcccggatgaacctg

SEQ ID NO: 286861 - DNA, 25 bp, Artificial Sequence
  Description of Artificial Sequence: Synthetic oligonucleotide
ggtggtctctgcccggatgaacctg

SEQ ID NO: 286862 - DNA, 25 bp, Artificial Sequence
  Description of Artificial Sequence: Synthetic oligonucleotide
gtggtctctgcccggatgaacctgc

SEQ ID NO: 286863 - DNA, 25 bp, Artificial Sequence
  Description of Artificial Sequence: Synthetic oligonucleotide
tggtctctgcccggatgaacctgcc

SEQ ID NO: 286864 - DNA, 24 bp, Artificial Sequence
  Description of Artificial Sequence: Synthetic oligonucleotide
ggtctctgcccggatgaacctgcc

SEQ ID NO: 286865 - DNA, 25 bp, Artificial Sequence
  Description of Artificial Sequence: Synthetic oligonucleotide
gtctctgcccggatgaacctgccct

SEQ ID NO: 286866 - DNA, 25 bp, Artificial Sequence
  Description of Artificial Sequence: Synthetic oligonucleotide
tctctgcccggatgaacctgccctc

SEQ ID NO: 286867 - DNA, 24 bp, Artificial Sequence
  Description of Artificial Sequence: Synthetic oligonucleotide
ctctgcccggatgaacctgccctc

SEQ ID NO: 286868 - DNA, 25 bp, Artificial Sequence
  Description of Artificial Sequence: Synthetic oligonucleotide
tctgcccggatgaacctgccctcct

SEQ ID NO: 286869 - DNA, 24 bp, Artificial Sequence
  Description of Artificial Sequence: Synthetic oligonucleotide
ctgcccggatgaacctgccctcct

SEQ ID NO: 286870 - DNA, 27 bp, Artificial Sequence
  Description of Artificial Sequence: Synthetic oligonucleotide
tgcccggatgaacctgccctcctctta

SEQ ID NO: 286871 - DNA, 27 bp, Artificial Sequence
  Description of Artificial Sequence: Synthetic oligonucleotide
gcccggatgaacctgccctcctcttat

SEQ ID NO: 286872 - DNA, 27 bp, Artificial Sequence
  Description of Artificial Sequence: Synthetic oligonucleotide
cccggatgaacctgccctcctcttatg

SEQ ID NO: 286873 - DNA, 28 bp, Artificial Sequence
  Description of Artificial Sequence: Synthetic oligonucleotide
ccggatgaacctgccctcctcttatgtg

SEQ ID NO: 286874 - DNA, 31 bp, Artificial Sequence
  Description of Artificial Sequence: Synthetic oligonucleotide
cggatgaacctgccctcctcttatgtgaatg

SEQ ID NO: 286875 - DNA, 31 bp, Artificial Sequence
  Description of Artificial Sequence: Synthetic oligonucleotide
ggatgaacctgccctcctcttatgtgaatgg

SEQ ID NO: 286876 - DNA, 31 bp, Artificial Sequence
  Description of Artificial Sequence: Synthetic oligonucleotide
gatgaacctgccctcctcttatgtgaatggg

SEQ ID NO: 286877 - DNA, 34 bp, Artificial Sequence
  Description of Artificial Sequence: Synthetic oligonucleotide
atgaacctgccctcctcttatgtgaatgggtttg

SEQ ID NO: 286878 - DNA, 33 bp, Artificial Sequence
  Description of Artificial Sequence: Synthetic oligonucleotide
tgaacctgccctcctcttatgtgaatgggtttg

SEQ ID NO: 286879 - DNA, 32 bp, Artificial Sequence
  Description of Artificial Sequence: Synthetic oligonucleotide
gaacctgccctcctcttatgtgaatgggtttg

SEQ ID NO: 286880 - DNA, 33 bp, Artificial Sequence
  Description of Artificial Sequence: Synthetic oligonucleotide
aacctgccctcctcttatgtgaatgggtttgtg

SEQ ID NO: 286881 - DNA, 32 bp, Artificial Sequence
  Description of Artificial Sequence: Synthetic oligonucleotide
acctgccctcctcttatgtgaatgggtttgtg

SEQ ID NO: 286882 - DNA, 31 bp, Artificial Sequence
  Description of Artificial Sequence: Synthetic oligonucleotide
cctgccctcctcttatgtgaatgggtttgtg

SEQ ID NO: 286883 - DNA, 34 bp, Artificial Sequence
  Description of Artificial Sequence: Synthetic oligonucleotide
ctgccctcctcttatgtgaatgggtttgtgaatc

SEQ ID NO: 286884 - DNA, 34 bp, Artificial Sequence
  Description of Artificial Sequence: Synthetic oligonucleotide
tgccctcctcttatgtgaatgggtttgtgaatcc

SEQ ID NO: 286885 - DNA, 33 bp, Artificial Sequence
  Description of Artificial Sequence: Synthetic oligonucleotide
gccctcctcttatgtgaatgggtttgtgaatcc

SEQ ID NO: 286886 - DNA, 34 bp, Artificial Sequence
  Description of Artificial Sequence: Synthetic oligonucleotide
ccctcctcttatgtgaatgggtttgtgaatccag

SEQ ID NO: 286887 - DNA, 34 bp, Artificial Sequence
  Description of Artificial Sequence: Synthetic oligonucleotide
cctcctcttatgtgaatgggtttgtgaatccagc

SEQ ID NO: 286888 - DNA, 38 bp, Artificial Sequence
  Description of Artificial Sequence: Synthetic oligonucleotide
ctcctcttatgtgaatgggtttgtgaatccagcttttg

SEQ ID NO: 286889 - DNA, 38 bp, Artificial Sequence
  Description of Artificial Sequence: Synthetic oligonucleotide
tcctcttatgtgaatgggtttgtgaatccagcttttgc

SEQ ID NO: 286890 - DNA, 37 bp, Artificial Sequence
  Description of Artificial Sequence: Synthetic oligonucleotide
cctcttatgtgaatgggtttgtgaatccagcttttgc

SEQ ID NO: 286891 - DNA, 37 bp, Artificial Sequence
  Description of Artificial Sequence: Synthetic oligonucleotide
ctcttatgtgaatgggtttgtgaatccagcttttgcc

SEQ ID NO: 286892 - DNA, 37 bp, Artificial Sequence
  Description of Artificial Sequence: Synthetic oligonucleotide
tcttatgtgaatgggtttgtgaatccagcttttgccc

SEQ ID NO: 286893 - DNA, 36 bp, Artificial Sequence
  Description of Artificial Sequence: Synthetic oligonucleotide
cttatgtgaatgggtttgtgaatccagcttttgccc

SEQ ID NO: 286894 - DNA, 38 bp, Artificial Sequence
  Description of Artificial Sequence: Synthetic oligonucleotide
ttatgtgaatgggtttgtgaatccagcttttgcccaag

SEQ ID NO: 286895 - DNA, 37 bp, Artificial Sequence
  Description of Artificial Sequence: Synthetic oligonucleotide
tatgtgaatgggtttgtgaatccagcttttgcccaag

SEQ ID NO: 286896 - DNA, 36 bp, Artificial Sequence
  Description of Artificial Sequence: Synthetic oligonucleotide
atgtgaatgggtttgtgaatccagcttttgcccaag

SEQ ID NO: 286897 - DNA, 35 bp, Artificial Sequence
  Description of Artificial Sequence: Synthetic oligonucleotide
tgtgaatgggtttgtgaatccagcttttgcccaag

SEQ ID NO: 286898 - DNA, 34 bp, Artificial Sequence
  Description of Artificial Sequence: Synthetic oligonucleotide
gtgaatgggtttgtgaatccagcttttgcccaag

SEQ ID NO: 286899 - DNA, 35 bp, Artificial Sequence
  Description of Artificial Sequence: Synthetic oligonucleotide
tgaatgggtttgtgaatccagcttttgcccaagac

SEQ ID NO: 286900 - DNA, 34 bp, Artificial Sequence
  Description of Artificial Sequence: Synthetic oligonucleotide
gaatgggtttgtgaatccagcttttgcccaagac

SEQ ID NO: 286901 - DNA, 36 bp, Artificial Sequence
  Description of Artificial Sequence: Synthetic oligonucleotide
aatgggtttgtgaatccagcttttgcccaagacaac

SEQ ID NO: 286902 - DNA, 35 bp, Artificial Sequence
  Description of Artificial Sequence: Synthetic oligonucleotide
atgggtttgtgaatccagcttttgcccaagacaac

SEQ ID NO: 286903 - DNA, 34 bp, Artificial Sequence
  Description of Artificial Sequence: Synthetic oligonucleotide
tgggtttgtgaatccagcttttgcccaagacaac

SEQ ID NO: 286904 - DNA, 33 bp, Artificial Sequence
  Description of Artificial Sequence: Synthetic oligonucleotide
gggtttgtgaatccagcttttgcccaagacaac

SEQ ID NO: 286905 - DNA, 33 bp, Artificial Sequence
  Description of Artificial Sequence: Synthetic oligonucleotide
ggtttgtgaatccagcttttgcccaagacaacc

SEQ ID NO: 286906 - DNA, 34 bp, Artificial Sequence
  Description of Artificial Sequence: Synthetic oligonucleotide
gtttgtgaatccagcttttgcccaagacaacctg

SEQ ID NO: 286907 - DNA, 34 bp, Artificial Sequence
  Description of Artificial Sequence: Synthetic oligonucleotide
tttgtgaatccagcttttgcccaagacaacctgc

SEQ ID NO: 286908 - DNA, 33 bp, Artificial Sequence
  Description of Artificial Sequence: Synthetic oligonucleotide
ttgtgaatccagcttttgcccaagacaacctgc

SEQ ID NO: 286909 - DNA, 32 bp, Artificial Sequence
  Description of Artificial Sequence: Synthetic oligonucleotide
tgtgaatccagcttttgcccaagacaacctgc

SEQ ID NO: 286910 - DNA, 31 bp, Artificial Sequence
  Description of Artificial Sequence: Synthetic oligonucleotide
gtgaatccagcttttgcccaagacaacctgc

SEQ ID NO: 286911 - DNA, 34 bp, Artificial Sequence
  Description of Artificial Sequence: Synthetic oligonucleotide
tgaatccagcttttgcccaagacaacctgctaac

SEQ ID NO: 286912 - DNA, 33 bp, Artificial Sequence
  Description of Artificial Sequence: Synthetic oligonucleotide
gaatccagcttttgcccaagacaacctgctaac

SEQ ID NO: 286913 - DNA, 34 bp, Artificial Sequence
  Description of Artificial Sequence: Synthetic oligonucleotide
aatccagcttttgcccaagacaacctgctaacac

SEQ ID NO: 286914 - DNA, 33 bp, Artificial Sequence
  Description of Artificial Sequence: Synthetic oligonucleotide
atccagcttttgcccaagacaacctgctaacac

SEQ ID NO: 286915 - DNA, 32 bp, Artificial Sequence
  Description of Artificial Sequence: Synthetic oligonucleotide
tccagcttttgcccaagacaacctgctaacac

SEQ ID NO: 286916 - DNA, 31 bp, Artificial Sequence
  Description of Artificial Sequence: Synthetic oligonucleotide
ccagcttttgcccaagacaacctgctaacac

SEQ ID NO: 286917 - DNA, 33 bp, Artificial Sequence
  Description of Artificial Sequence: Synthetic oligonucleotide
cagcttttgcccaagacaacctgctaacacatg

SEQ ID NO: 286918 - DNA, 35 bp, Artificial Sequence
  Description of Artificial Sequence: Synthetic oligonucleotide
agcttttgcccaagacaacctgctaacacatgatg

SEQ ID NO: 286919 - DNA, 34 bp, Artificial Sequence
  Description of Artificial Sequence: Synthetic oligonucleotide
gcttttgcccaagacaacctgctaacacatgatg

SEQ ID NO: 286920 - DNA, 34 bp, Artificial Sequence
  Description of Artificial Sequence: Synthetic oligonucleotide
cttttgcccaagacaacctgctaacacatgatgg

SEQ ID NO: 286921 - DNA, 34 bp, Artificial Sequence
  Description of Artificial Sequence: Synthetic oligonucleotide
ttttgcccaagacaacctgctaacacatgatggc

SEQ ID NO: 286922 - DNA, 33 bp, Artificial Sequence
  Description of Artificial Sequence: Synthetic oligonucleotide
tttgcccaagacaacctgctaacacatgatggc

SEQ ID NO: 286923 - DNA, 32 bp, Artificial Sequence
  Description of Artificial Sequence: Synthetic oligonucleotide
ttgcccaagacaacctgctaacacatgatggc

SEQ ID NO: 286924 - DNA, 31 bp, Artificial Sequence
  Description of Artificial Sequence: Synthetic oligonucleotide
tgcccaagacaacctgctaacacatgatggc

SEQ ID NO: 286925 - DNA, 30 bp, Artificial Sequence
  Description of Artificial Sequence: Synthetic oligonucleotide
gcccaagacaacctgctaacacatgatggc

SEQ ID NO: 286926 - DNA, 32 bp, Artificial Sequence
  Description of Artificial Sequence: Synthetic oligonucleotide
cccaagacaacctgctaacacatgatggcatc

SEQ ID NO: 286927 - DNA, 36 bp, Artificial Sequence
  Description of Artificial Sequence: Synthetic oligonucleotide
ccaagacaacctgctaacacatgatggcatcaaatg

SEQ ID NO: 286928 - DNA, 36 bp, Artificial Sequence
  Description of Artificial Sequence: Synthetic oligonucleotide
caagacaacctgctaacacatgatggcatcaaatgg

SEQ ID NO: 286929 - DNA, 36 bp, Artificial Sequence
  Description of Artificial Sequence: Synthetic oligonucleotide
aagacaacctgctaacacatgatggcatcaaatggc

SEQ ID NO: 286930 - DNA, 35 bp, Artificial Sequence
  Description of Artificial Sequence: Synthetic oligonucleotide
agacaacctgctaacacatgatggcatcaaatggc

SEQ ID NO: 286931 - DNA, 34 bp, Artificial Sequence
  Description of Artificial Sequence: Synthetic oligonucleotide
gacaacctgctaacacatgatggcatcaaatggc

SEQ ID NO: 286932 - DNA, 38 bp, Artificial Sequence
  Description of Artificial Sequence: Synthetic oligonucleotide
acaacctgctaacacatgatggcatcaaatggctatac

SEQ ID NO: 286933 - DNA, 37 bp, Artificial Sequence
  Description of Artificial Sequence: Synthetic oligonucleotide
caacctgctaacacatgatggcatcaaatggctatac

SEQ ID NO: 286934 - DNA, 39 bp, Artificial Sequence
  Description of Artificial Sequence: Synthetic oligonucleotide
aacctgctaacacatgatggcatcaaatggctatacaag

SEQ ID NO: 286935 - DNA, 38 bp, Artificial Sequence
  Description of Artificial Sequence: Synthetic oligonucleotide
acctgctaacacatgatggcatcaaatggctatacaag

SEQ ID NO: 286936 - DNA, 37 bp, Artificial Sequence
  Description of Artificial Sequence: Synthetic oligonucleotide
cctgctaacacatgatggcatcaaatggctatacaag

SEQ ID NO: 286937 - DNA, 39 bp, Artificial Sequence
  Description of Artificial Sequence: Synthetic oligonucleotide
ctgctaacacatgatggcatcaaatggctatacaagaac

SEQ ID NO: 286938 - DNA, 41 bp, Artificial Sequence
  Description of Artificial Sequence: Synthetic oligonucleotide
tgctaacacatgatggcatcaaatggctatacaagaactag

SEQ ID NO: 286939 - DNA, 40 bp, Artificial Sequence
  Description of Artificial Sequence: Synthetic oligonucleotide
gctaacacatgatggcatcaaatggctatacaagaactag

SEQ ID NO: 286940 - DNA, 40 bp, Artificial Sequence
  Description of Artificial Sequence: Synthetic oligonucleotide
ctaacacatgatggcatcaaatggctatacaagaactagg

SEQ ID NO: 286941 - DNA, 41 bp, Artificial Sequence
  Description of Artificial Sequence: Synthetic oligonucleotide
taacacatgatggcatcaaatggctatacaagaactaggac

SEQ ID NO: 286942 - DNA, 40 bp, Artificial Sequence
  Description of Artificial Sequence: Synthetic oligonucleotide
aacacatgatggcatcaaatggctatacaagaactaggac

SEQ ID NO: 286943 - DNA, 39 bp, Artificial Sequence
  Description of Artificial Sequence: Synthetic oligonucleotide
acacatgatggcatcaaatggctatacaagaactaggac

SEQ ID NO: 286944 - DNA, 38 bp, Artificial Sequence
  Description of Artificial Sequence: Synthetic oligonucleotide
cacatgatggcatcaaatggctatacaagaactaggac

SEQ ID NO: 286945 - DNA, 38 bp, Artificial Sequence
  Description of Artificial Sequence: Synthetic oligonucleotide
acatgatggcatcaaatggctatacaagaactaggacc

SEQ ID NO: 286946 - DNA, 37 bp, Artificial Sequence
  Description of Artificial Sequence: Synthetic oligonucleotide
catgatggcatcaaatggctatacaagaactaggacc

SEQ ID NO: 286947 - DNA, 38 bp, Artificial Sequence
  Description of Artificial Sequence: Synthetic oligonucleotide
atgatggcatcaaatggctatacaagaactaggaccac

SEQ ID NO: 286948 - DNA, 37 bp, Artificial Sequence
  Description of Artificial Sequence: Synthetic oligonucleotide
tgatggcatcaaatggctatacaagaactaggaccac

SEQ ID NO: 286949 - DNA, 36 bp, Artificial Sequence
  Description of Artificial Sequence: Synthetic oligonucleotide
gatggcatcaaatggctatacaagaactaggaccac

SEQ ID NO: 286950 - DNA, 36 bp, Artificial Sequence
  Description of Artificial Sequence: Synthetic oligonucleotide
atggcatcaaatggctatacaagaactaggaccacg

SEQ ID NO: 286951 - DNA, 35 bp, Artificial Sequence
  Description of Artificial Sequence: Synthetic oligonucleotide
tggcatcaaatggctatacaagaactaggaccacg

SEQ ID NO: 286952 - DNA, 34 bp, Artificial Sequence
  Description of Artificial Sequence: Synthetic oligonucleotide
ggcatcaaatggctatacaagaactaggaccacg

SEQ ID NO: 286953 - DNA, 34 bp, Artificial Sequence
  Description of Artificial Sequence: Synthetic oligonucleotide
gcatcaaatggctatacaagaactaggaccacgc

SEQ ID NO: 286954 - DNA, 37 bp, Artificial Sequence
  Description of Artificial Sequence: Synthetic oligonucleotide
catcaaatggctatacaagaactaggaccacgcaatg

SEQ ID NO: 286955 - DNA, 39 bp, Artificial Sequence
  Description of Artificial Sequence: Synthetic oligonucleotide
atcaaatggctatacaagaactaggaccacgcaatgttg

SEQ ID NO: 286956 - DNA, 38 bp, Artificial Sequence
  Description of Artificial Sequence: Synthetic oligonucleotide
tcaaatggctatacaagaactaggaccacgcaatgttg

SEQ ID NO: 286957 - DNA, 37 bp, Artificial Sequence
  Description of Artificial Sequence: Synthetic oligonucleotide
caaatggctatacaagaactaggaccacgcaatgttg

SEQ ID NO: 286958 - DNA, 38 bp, Artificial Sequence
  Description of Artificial Sequence: Synthetic oligonucleotide
aaatggctatacaagaactaggaccacgcaatgttgag

SEQ ID NO: 286959 - DNA, 37 bp, Artificial Sequence
  Description of Artificial Sequence: Synthetic oligonucleotide
aatggctatacaagaactaggaccacgcaatgttgag

SEQ ID NO: 286960 - DNA, 36 bp, Artificial Sequence
  Description of Artificial Sequence: Synthetic oligonucleotide
atggctatacaagaactaggaccacgcaatgttgag

SEQ ID NO: 286961 - DNA, 35 bp, Artificial Sequence
  Description of Artificial Sequence: Synthetic oligonucleotide
tggctatacaagaactaggaccacgcaatgttgag

SEQ ID NO: 286962 - DNA, 34 bp, Artificial Sequence
  Description of Artificial Sequence: Synthetic oligonucleotide
ggctatacaagaactaggaccacgcaatgttgag

SEQ ID NO: 286963 - DNA, 35 bp, Artificial Sequence
  Description of Artificial Sequence: Synthetic oligonucleotide
gctatacaagaactaggaccacgcaatgttgagag

SEQ ID NO: 286964 - DNA, 35 bp, Artificial Sequence
  Description of Artificial Sequence: Synthetic oligonucleotide
ctatacaagaactaggaccacgcaatgttgagagc

SEQ ID NO: 286965 - DNA, 36 bp, Artificial Sequence
  Description of Artificial Sequence: Synthetic oligonucleotide
tatacaagaactaggaccacgcaatgttgagagcag

SEQ ID NO: 286966 - DNA, 35 bp, Artificial Sequence
  Description of Artificial Sequence: Synthetic oligonucleotide
atacaagaactaggaccacgcaatgttgagagcag

SEQ ID NO: 286967 - DNA, 34 bp, Artificial Sequence
  Description of Artificial Sequence: Synthetic oligonucleotide
tacaagaactaggaccacgcaatgttgagagcag

SEQ ID NO: 286968 - DNA, 33 bp, Artificial Sequence
  Description of Artificial Sequence: Synthetic oligonucleotide
acaagaactaggaccacgcaatgttgagagcag

SEQ ID NO: 286969 - DNA, 32 bp, Artificial Sequence
  Description of Artificial Sequence: Synthetic oligonucleotide
caagaactaggaccacgcaatgttgagagcag

SEQ ID NO: 286970 - DNA, 32 bp, Artificial Sequence
  Description of Artificial Sequence: Synthetic oligonucleotide
aagaactaggaccacgcaatgttgagagcagc

SEQ ID NO: 286971 - DNA, 31 bp, Artificial Sequence
  Description of Artificial Sequence: Synthetic oligonucleotide
agaactaggaccacgcaatgttgagagcagc

SEQ ID NO: 286972 - DNA, 30 bp, Artificial Sequence
  Description of Artificial Sequence: Synthetic oligonucleotide
gaactaggaccacgcaatgttgagagcagc

SEQ ID NO: 286973 - DNA, 31 bp, Artificial Sequence
  Description of Artificial Sequence: Synthetic oligonucleotide
aactaggaccacgcaatgttgagagcagctg

SEQ ID NO: 286974 - DNA, 30 bp, Artificial Sequence
  Description of Artificial Sequence: Synthetic oligonucleotide
actaggaccacgcaatgttgagagcagctg

SEQ ID NO: 286975 - DNA, 29 bp, Artificial Sequence
  Description of Artificial Sequence: Synthetic oligonucleotide
ctaggaccacgcaatgttgagagcagctg

SEQ ID NO: 286976 - DNA, 29 bp, Artificial Sequence
  Description of Artificial Sequence: Synthetic oligonucleotide
taggaccacgcaatgttgagagcagctgc

SEQ ID NO: 286977 - DNA, 28 bp, Artificial Sequence
  Description of Artificial Sequence: Synthetic oligonucleotide
aggaccacgcaatgttgagagcagctgc

SEQ ID NO: 286978 - DNA, 27 bp, Artificial Sequence
  Description of Artificial Sequence: Synthetic oligonucleotide
ggaccacgcaatgttgagagcagctgc

SEQ ID NO: 286979 - DNA, 29 bp, Artificial Sequence
  Description of Artificial Sequence: Synthetic oligonucleotide
gaccacgcaatgttgagagcagctgcaac

SEQ ID NO: 286980 - DNA, 30 bp, Artificial Sequence
  Description of Artificial Sequence: Synthetic oligonucleotide
accacgcaatgttgagagcagctgcaactc

SEQ ID NO: 286981 - DNA, 29 bp, Artificial Sequence
  Description of Artificial Sequence: Synthetic oligonucleotide
ccacgcaatgttgagagcagctgcaactc

SEQ ID NO: 286982 - DNA, 31 bp, Artificial Sequence
  Description of Artificial Sequence: Synthetic oligonucleotide
cacgcaatgttgagagcagctgcaactcttg

SEQ ID NO: 286983 - DNA, 31 bp, Artificial Sequence
  Description of Artificial Sequence: Synthetic oligonucleotide
acgcaatgttgagagcagctgcaactcttgg

SEQ ID NO: 286984 - DNA, 30 bp, Artificial Sequence
  Description of Artificial Sequence: Synthetic oligonucleotide
cgcaatgttgagagcagctgcaactcttgg

SEQ ID NO: 286985 - DNA, 30 bp, Artificial Sequence
  Description of Artificial Sequence: Synthetic oligonucleotide
gcaatgttgagagcagctgcaactcttggg

SEQ ID NO: 286986 - DNA, 32 bp, Artificial Sequence
  Description of Artificial Sequence: Synthetic oligonucleotide
caatgttgagagcagctgcaactcttgggaag

SEQ ID NO: 286987 - DNA, 35 bp, Artificial Sequence
  Description of Artificial Sequence: Synthetic oligonucleotide
aatgttgagagcagctgcaactcttgggaagattc

SEQ ID NO: 286988 - DNA, 34 bp, Artificial Sequence
  Description of Artificial Sequence: Synthetic oligonucleotide
atgttgagagcagctgcaactcttgggaagattc

SEQ ID NO: 286989 - DNA, 33 bp, Artificial Sequence
  Description of Artificial Sequence: Synthetic oligonucleotide
tgttgagagcagctgcaactcttgggaagattc

SEQ ID NO: 286990 - DNA, 32 bp, Artificial Sequence
  Description of Artificial Sequence: Synthetic oligonucleotide
gttgagagcagctgcaactcttgggaagattc

SEQ ID NO: 286991 - DNA, 33 bp, Artificial Sequence
  Description of Artificial Sequence: Synthetic oligonucleotide
ttgagagcagctgcaactcttgggaagattctg

SEQ ID NO: 286992 - DNA, 32 bp, Artificial Sequence
  Description of Artificial Sequence: Synthetic oligonucleotide
tgagagcagctgcaactcttgggaagattctg

SEQ ID NO: 286993 - DNA, 31 bp, Artificial Sequence
  Description of Artificial Sequence: Synthetic oligonucleotide
gagagcagctgcaactcttgggaagattctg

SEQ ID NO: 286994 - DNA, 31 bp, Artificial Sequence
  Description of Artificial Sequence: Synthetic oligonucleotide
agagcagctgcaactcttgggaagattctgc

SEQ ID NO: 286995 - DNA, 30 bp, Artificial Sequence
  Description of Artificial Sequence: Synthetic oligonucleotide
gagcagctgcaactcttgggaagattctgc

SEQ ID NO: 286996 - DNA, 31 bp, Artificial Sequence
  Description of Artificial Sequence: Synthetic oligonucleotide
agcagctgcaactcttgggaagattctgctc

SEQ ID NO: 286997 - DNA, 30 bp, Artificial Sequence
  Description of Artificial Sequence: Synthetic oligonucleotide
gcagctgcaactcttgggaagattctgctc

SEQ ID NO: 286998 - DNA, 31 bp, Artificial Sequence
  Description of Artificial Sequence: Synthetic oligonucleotide
cagctgcaactcttgggaagattctgctctg

SEQ ID NO: 286999 - DNA, 31 bp, Artificial Sequence
  Description of Artificial Sequence: Synthetic oligonucleotide
agctgcaactcttgggaagattctgctctgg

SEQ ID NO: 287000 - DNA, 30 bp, Artificial Sequence
  Description of Artificial Sequence: Synthetic oligonucleotide
gctgcaactcttgggaagattctgctctgg

SEQ ID NO: 287001 - DNA, 30 bp, Artificial Sequence
  Description of Artificial Sequence: Synthetic oligonucleotide
ctgcaactcttgggaagattctgctctggg

SEQ ID NO: 287002 - DNA, 32 bp, Artificial Sequence
  Description of Artificial Sequence: Synthetic oligonucleotide
tgcaactcttgggaagattctgctctgggatg

SEQ ID NO: 287003 - DNA, 31 bp, Artificial Sequence
  Description of Artificial Sequence: Synthetic oligonucleotide
gcaactcttgggaagattctgctctgggatg

SEQ ID NO: 287004 - DNA, 32 bp, Artificial Sequence
  Description of Artificial Sequence: Synthetic oligonucleotide
caactcttgggaagattctgctctgggatgtg

SEQ ID NO: 287005 - DNA, 32 bp, Artificial Sequence
  Description of Artificial Sequence: Synthetic oligonucleotide
aactcttgggaagattctgctctgggatgtgc

SEQ ID NO: 287006 - DNA, 31 bp, Artificial Sequence
  Description of Artificial Sequence: Synthetic oligonucleotide
actcttgggaagattctgctctgggatgtgc

SEQ ID NO: 287007 - DNA, 30 bp, Artificial Sequence
  Description of Artificial Sequence: Synthetic oligonucleotide
ctcttgggaagattctgctctgggatgtgc

SEQ ID NO: 287008 - DNA, 32 bp, Artificial Sequence
  Description of Artificial Sequence: Synthetic oligonucleotide
tcttgggaagattctgctctgggatgtgcatg

SEQ ID NO: 287009 - DNA, 31 bp, Artificial Sequence
  Description of Artificial Sequence: Synthetic oligonucleotide
cttgggaagattctgctctgggatgtgcatg

SEQ ID NO: 287010 - DNA, 31 bp, Artificial Sequence
  Description of Artificial Sequence: Synthetic oligonucleotide
ttgggaagattctgctctgggatgtgcatgg

SEQ ID NO: 287011 - DNA, 30 bp, Artificial Sequence
  Description of Artificial Sequence: Synthetic oligonucleotide
tgggaagattctgctctgggatgtgcatgg

SEQ ID NO: 287012 - DNA, 29 bp, Artificial Sequence
  Description of Artificial Sequence: Synthetic oligonucleotide
gggaagattctgctctgggatgtgcatgg

SEQ ID NO: 287013 - DNA, 30 bp, Artificial Sequence
  Description of Artificial Sequence: Synthetic oligonucleotide
ggaagattctgctctgggatgtgcatggtg

SEQ ID NO: 287014 - DNA, 30 bp, Artificial Sequence
  Description of Artificial Sequence: Synthetic oligonucleotide
gaagattctgctctgggatgtgcatggtgg

SEQ ID NO: 287015 - DNA, 30 bp, Artificial Sequence
  Description of Artificial Sequence: Synthetic oligonucleotide
aagattctgctctgggatgtgcatggtggc

SEQ ID NO: 287016 - DNA, 29 bp, Artificial Sequence
  Description of Artificial Sequence: Synthetic oligonucleotide
agattctgctctgggatgtgcatggtggc

SEQ ID NO: 287017 - DNA, 28 bp, Artificial Sequence
  Description of Artificial Sequence: Synthetic oligonucleotide
gattctgctctgggatgtgcatggtggc

SEQ ID NO: 287018 - DNA, 28 bp, Artificial Sequence
  Description of Artificial Sequence: Synthetic oligonucleotide
attctgctctgggatgtgcatggtggcc

SEQ ID NO: 287019 - DNA, 27 bp, Artificial Sequence
  Description of Artificial Sequence: Synthetic oligonucleotide
ttctgctctgggatgtgcatggtggcc

SEQ ID NO: 287020 - DNA, 27 bp, Artificial Sequence
  Description of Artificial Sequence: Synthetic oligonucleotide
tctgctctgggatgtgcatggtggcca

SEQ ID NO: 287021 - DNA, 26 bp, Artificial Sequence
  Description of Artificial Sequence: Synthetic oligonucleotide
ctgctctgggatgtgcatggtggcca

SEQ ID NO: 287022 - DNA, 27 bp, Artificial Sequence
  Description of Artificial Sequence: Synthetic oligonucleotide
tgctctgggatgtgcatggtggccaca

SEQ ID NO: 287023 - DNA, 26 bp, Artificial Sequence
  Description of Artificial Sequence: Synthetic oligonucleotide
gctctgggatgtgcatggtggccaca

SEQ ID NO: 287024 - DNA, 26 bp, Artificial Sequence
  Description of Artificial Sequence: Synthetic oligonucleotide
ctctgggatgtgcatggtggccacac

SEQ ID NO: 287025 - DNA, 26 bp, Artificial Sequence
  Description of Artificial Sequence: Synthetic oligonucleotide
tctgggatgtgcatggtggccacacc

SEQ ID NO: 287026 - DNA, 25 bp, Artificial Sequence
  Description of Artificial Sequence: Synthetic oligonucleotide
ctgggatgtgcatggtggccacacc

SEQ ID NO: 287027 - DNA, 26 bp, Artificial Sequence
  Description of Artificial Sequence: Synthetic oligonucleotide
tgggatgtgcatggtggccacaccca

SEQ ID NO: 287028 - DNA, 25 bp, Artificial Sequence
  Description of Artificial Sequence: Synthetic oligonucleotide
gggatgtgcatggtggccacaccca

SEQ ID NO: 287029 - DNA, 27 bp, Artificial Sequence
  Description of Artificial Sequence: Synthetic oligonucleotide
ggatgtgcatggtggccacacccagat

SEQ ID NO: 287030 - DNA, 28 bp, Artificial Sequence
  Description of Artificial Sequence: Synthetic oligonucleotide
gatgtgcatggtggccacacccagatag

SEQ ID NO: 287031 - DNA, 29 bp, Artificial Sequence
  Description of Artificial Sequence: Synthetic oligonucleotide
atgtgcatggtggccacacccagatagac

SEQ ID NO: 287032 - DNA, 28 bp, Artificial Sequence
  Description of Artificial Sequence: Synthetic oligonucleotide
tgtgcatggtggccacacccagatagac

SEQ ID NO: 287033 - DNA, 27 bp, Artificial Sequence
  Description of Artificial Sequence: Synthetic oligonucleotide
gtgcatggtggccacacccagatagac

SEQ ID NO: 287034 - DNA, 29 bp, Artificial Sequence
  Description of Artificial Sequence: Synthetic oligonucleotide
tgcatggtggccacacccagatagacaag

SEQ ID NO: 287035 - DNA, 28 bp, Artificial Sequence
  Description of Artificial Sequence: Synthetic oligonucleotide
gcatggtggccacacccagatagacaag

SEQ ID NO: 287036 - DNA, 30 bp, Artificial Sequence
  Description of Artificial Sequence: Synthetic oligonucleotide
catggtggccacacccagatagacaagtac

SEQ ID NO: 287037 - DNA, 30 bp, Artificial Sequence
  Description of Artificial Sequence: Synthetic oligonucleotide
atggtggccacacccagatagacaagtacg

SEQ ID NO: 287038 - DNA, 29 bp, Artificial Sequence
  Description of Artificial Sequence: Synthetic oligonucleotide
tggtggccacacccagatagacaagtacg

SEQ ID NO: 287039 - DNA, 28 bp, Artificial Sequence
  Description of Artificial Sequence: Synthetic oligonucleotide
ggtggccacacccagatagacaagtacg

SEQ ID NO: 287040 - DNA, 29 bp, Artificial Sequence
  Description of Artificial Sequence: Synthetic oligonucleotide
gtggccacacccagatagacaagtacgtg

SEQ ID NO: 287041 - DNA, 31 bp, Artificial Sequence
  Description of Artificial Sequence: Synthetic oligonucleotide
tggccacacccagatagacaagtacgtgtac

SEQ ID NO: 287042 - DNA, 30 bp, Artificial Sequence
  Description of Artificial Sequence: Synthetic oligonucleotide
ggccacacccagatagacaagtacgtgtac

SEQ ID NO: 287043 - DNA, 31 bp, Artificial Sequence
  Description of Artificial Sequence: Synthetic oligonucleotide
gccacacccagatagacaagtacgtgtactc

SEQ ID NO: 287044 - DNA, 31 bp, Artificial Sequence
  Description of Artificial Sequence: Synthetic oligonucleotide
ccacacccagatagacaagtacgtgtactcc

SEQ ID NO: 287045 - DNA, 32 bp, Artificial Sequence
  Description of Artificial Sequence: Synthetic oligonucleotide
cacacccagatagacaagtacgtgtactcctg

SEQ ID NO: 287046 - DNA, 33 bp, Artificial Sequence
  Description of Artificial Sequence: Synthetic oligonucleotide
acacccagatagacaagtacgtgtactcctgtg

SEQ ID NO: 287047 - DNA, 32 bp, Artificial Sequence
  Description of Artificial Sequence: Synthetic oligonucleotide
cacccagatagacaagtacgtgtactcctgtg

SEQ ID NO: 287048 - DNA, 33 bp, Artificial Sequence
  Description of Artificial Sequence: Synthetic oligonucleotide
acccagatagacaagtacgtgtactcctgtgag

SEQ ID NO: 287049 - DNA, 32 bp, Artificial Sequence
  Description of Artificial Sequence: Synthetic oligonucleotide
cccagatagacaagtacgtgtactcctgtgag

SEQ ID NO: 287050 - DNA, 32 bp, Artificial Sequence
  Description of Artificial Sequence: Synthetic oligonucleotide
ccagatagacaagtacgtgtactcctgtgagg

SEQ ID NO: 287051 - DNA, 33 bp, Artificial Sequence
  Description of Artificial Sequence: Synthetic oligonucleotide
cagatagacaagtacgtgtactcctgtgaggac

SEQ ID NO: 287052 - DNA, 35 bp, Artificial Sequence
  Description of Artificial Sequence: Synthetic oligonucleotide
agatagacaagtacgtgtactcctgtgaggactag

SEQ ID NO: 287053 - DNA, 34 bp, Artificial Sequence
  Description of Artificial Sequence: Synthetic oligonucleotide
gatagacaagtacgtgtactcctgtgaggactag

SEQ ID NO: 287054 - DNA, 39 bp, Artificial Sequence
  Description of Artificial Sequence: Synthetic oligonucleotide
atagacaagtacgtgtactcctgtgaggactagattaag

SEQ ID NO: 287055 - DNA, 38 bp, Artificial Sequence
  Description of Artificial Sequence: Synthetic oligonucleotide
tagacaagtacgtgtactcctgtgaggactagattaag

SEQ ID NO: 287056 - DNA, 37 bp, Artificial Sequence
  Description of Artificial Sequence: Synthetic oligonucleotide
agacaagtacgtgtactcctgtgaggactagattaag

SEQ ID NO: 287057 - DNA, 36 bp, Artificial Sequence
  Description of Artificial Sequence: Synthetic oligonucleotide
gacaagtacgtgtactcctgtgaggactagattaag

SEQ ID NO: 287058 - DNA, 37 bp, Artificial Sequence
  Description of Artificial Sequence: Synthetic oligonucleotide
acaagtacgtgtactcctgtgaggactagattaagtc

SEQ ID NO: 287059 - DNA, 36 bp, Artificial Sequence
  Description of Artificial Sequence: Synthetic oligonucleotide
caagtacgtgtactcctgtgaggactagattaagtc

SEQ ID NO: 287060 - DNA, 37 bp, Artificial Sequence
  Description of Artificial Sequence: Synthetic oligonucleotide
aagtacgtgtactcctgtgaggactagattaagtcac

SEQ ID NO: 287061 - DNA, 36 bp, Artificial Sequence
  Description of Artificial Sequence: Synthetic oligonucleotide
agtacgtgtactcctgtgaggactagattaagtcac

SEQ ID NO: 287062 - DNA, 35 bp, Artificial Sequence
  Description of Artificial Sequence: Synthetic oligonucleotide
gtacgtgtactcctgtgaggactagattaagtcac

SEQ ID NO: 287063 - DNA, 35 bp, Artificial Sequence
  Description of Artificial Sequence: Synthetic oligonucleotide
tacgtgtactcctgtgaggactagattaagtcacg

SEQ ID NO: 287064 - DNA, 34 bp, Artificial Sequence
  Description of Artificial Sequence: Synthetic oligonucleotide
acgtgtactcctgtgaggactagattaagtcacg

SEQ ID NO: 287065 - DNA, 33 bp, Artificial Sequence
  Description of Artificial Sequence: Synthetic oligonucleotide
cgtgtactcctgtgaggactagattaagtcacg

SEQ ID NO: 287066 - DNA, 34 bp, Artificial Sequence
  Description of Artificial Sequence: Synthetic oligonucleotide
gtgtactcctgtgaggactagattaagtcacgag

SEQ ID NO: 287067 - DNA, 34 bp, Artificial Sequence
  Description of Artificial Sequence: Synthetic oligonucleotide
tgtactcctgtgaggactagattaagtcacgagc

SEQ ID NO: 287068 - DNA, 33 bp, Artificial Sequence
  Description of Artificial Sequence: Synthetic oligonucleotide
gtactcctgtgaggactagattaagtcacgagc

SEQ ID NO: 287069 - DNA, 34 bp, Artificial Sequence
  Description of Artificial Sequence: Synthetic oligonucleotide
tactcctgtgaggactagattaagtcacgagctc

SEQ ID NO: 287070 - DNA, 33 bp, Artificial Sequence
  Description of Artificial Sequence: Synthetic oligonucleotide
actcctgtgaggactagattaagtcacgagctc

SEQ ID NO: 287071 - DNA, 32 bp, Artificial Sequence
  Description of Artificial Sequence: Synthetic oligonucleotide
ctcctgtgaggactagattaagtcacgagctc

SEQ ID NO: 287072 - DNA, 34 bp, Artificial Sequence
  Description of Artificial Sequence: Synthetic oligonucleotide
tcctgtgaggactagattaagtcacgagctcttc

SEQ ID NO: 287073 - DNA, 33 bp, Artificial Sequence
  Description of Artificial Sequence: Synthetic oligonucleotide
cctgtgaggactagattaagtcacgagctcttc

SEQ ID NO: 287074 - DNA, 35 bp, Artificial Sequence
  Description of Artificial Sequence: Synthetic oligonucleotide
ctgtgaggactagattaagtcacgagctcttcatg

SEQ ID NO: 287075 - DNA, 35 bp, Artificial Sequence
  Description of Artificial Sequence: Synthetic oligonucleotide
tgtgaggactagattaagtcacgagctcttcatgc

SEQ ID NO: 287076 - DNA, 34 bp, Artificial Sequence
  Description of Artificial Sequence: Synthetic oligonucleotide
gtgaggactagattaagtcacgagctcttcatgc

SEQ ID NO: 287077 - DNA, 34 bp, Artificial Sequence
  Description of Artificial Sequence: Synthetic oligonucleotide
tgaggactagattaagtcacgagctcttcatgcc

SEQ ID NO: 287078 - DNA, 33 bp, Artificial Sequence
  Description of Artificial Sequence: Synthetic oligonucleotide
gaggactagattaagtcacgagctcttcatgcc

SEQ ID NO: 287079 - DNA, 34 bp, Artificial Sequence
  Description of Artificial Sequence: Synthetic oligonucleotide
aggactagattaagtcacgagctcttcatgcctg

SEQ ID NO: 287080 - DNA, 33 bp, Artificial Sequence
  Description of Artificial Sequence: Synthetic oligonucleotide
ggactagattaagtcacgagctcttcatgcctg

SEQ ID NO: 287081 - DNA, 34 bp, Artificial Sequence
  Description of Artificial Sequence: Synthetic oligonucleotide
gactagattaagtcacgagctcttcatgcctgtg

SEQ ID NO: 287082 - DNA, 34 bp, Artificial Sequence
  Description of Artificial Sequence: Synthetic oligonucleotide
actagattaagtcacgagctcttcatgcctgtgg

SEQ ID NO: 287083 - DNA, 33 bp, Artificial Sequence
  Description of Artificial Sequence: Synthetic oligonucleotide
ctagattaagtcacgagctcttcatgcctgtgg

SEQ ID NO: 287084 - DNA, 33 bp, Artificial Sequence
  Description of Artificial Sequence: Synthetic oligonucleotide
tagattaagtcacgagctcttcatgcctgtggg

SEQ ID NO: 287085 - DNA, 32 bp, Artificial Sequence
  Description of Artificial Sequence: Synthetic oligonucleotide
agattaagtcacgagctcttcatgcctgtggg

SEQ ID NO: 287086 - DNA, 31 bp, Artificial Sequence
  Description of Artificial Sequence: Synthetic oligonucleotide
gattaagtcacgagctcttcatgcctgtggg

SEQ ID NO: 287087 - DNA, 34 bp, Artificial Sequence
  Description of Artificial Sequence: Synthetic oligonucleotide
attaagtcacgagctcttcatgcctgtgggatag

SEQ ID NO: 287088 - DNA, 33 bp, Artificial Sequence
  Description of Artificial Sequence: Synthetic oligonucleotide
ttaagtcacgagctcttcatgcctgtgggatag

SEQ ID NO: 287089 - DNA, 32 bp, Artificial Sequence
  Description of Artificial Sequence: Synthetic oligonucleotide
taagtcacgagctcttcatgcctgtgggatag

SEQ ID NO: 287090 - DNA, 31 bp, Artificial Sequence
  Description of Artificial Sequence: Synthetic oligonucleotide
aagtcacgagctcttcatgcctgtgggatag

SEQ ID NO: 287091 - DNA, 30 bp, Artificial Sequence
  Description of Artificial Sequence: Synthetic oligonucleotide
agtcacgagctcttcatgcctgtgggatag

SEQ ID NO: 287092 - DNA, 29 bp, Artificial Sequence
  Description of Artificial Sequence: Synthetic oligonucleotide
gtcacgagctcttcatgcctgtgggatag

SEQ ID NO: 287093 - DNA, 30 bp, Artificial Sequence
  Description of Artificial Sequence: Synthetic oligonucleotide
tcacgagctcttcatgcctgtgggatagtg

SEQ ID NO: 287094 - DNA, 29 bp, Artificial Sequence
  Description of Artificial Sequence: Synthetic oligonucleotide
cacgagctcttcatgcctgtgggatagtg

SEQ ID NO: 287095 - DNA, 31 bp, Artificial Sequence
  Description of Artificial Sequence: Synthetic oligonucleotide
acgagctcttcatgcctgtgggatagtgaac

SEQ ID NO: 287096 - DNA, 30 bp, Artificial Sequence
  Description of Artificial Sequence: Synthetic oligonucleotide
cgagctcttcatgcctgtgggatagtgaac

SEQ ID NO: 287097 - DNA, 31 bp, Artificial Sequence
  Description of Artificial Sequence: Synthetic oligonucleotide
gagctcttcatgcctgtgggatagtgaacac

SEQ ID NO: 287098 - DNA, 32 bp, Artificial Sequence
  Description of Artificial Sequence: Synthetic oligonucleotide
agctcttcatgcctgtgggatagtgaacactg

SEQ ID NO: 287099 - DNA, 31 bp, Artificial Sequence
  Description of Artificial Sequence: Synthetic oligonucleotide
gctcttcatgcctgtgggatagtgaacactg

SEQ ID NO: 287100 - DNA, 31 bp, Artificial Sequence
  Description of Artificial Sequence: Synthetic oligonucleotide
ctcttcatgcctgtgggatagtgaacactgg

SEQ ID NO: 287101 - DNA, 31 bp, Artificial Sequence
  Description of Artificial Sequence: Synthetic oligonucleotide
tcttcatgcctgtgggatagtgaacactggg

SEQ ID NO: 287102 - DNA, 30 bp, Artificial Sequence
  Description of Artificial Sequence: Synthetic oligonucleotide
cttcatgcctgtgggatagtgaacactggg

SEQ ID NO: 287103 - DNA, 30 bp, Artificial Sequence
  Description of Artificial Sequence: Synthetic oligonucleotide
ttcatgcctgtgggatagtgaacactgggg

SEQ ID NO: 287104 - DNA, 29 bp, Artificial Sequence
  Description of Artificial Sequence: Synthetic oligonucleotide
tcatgcctgtgggatagtgaacactgggg

SEQ ID NO: 287105 - DNA, 28 bp, Artificial Sequence
  Description of Artificial Sequence: Synthetic oligonucleotide
catgcctgtgggatagtgaacactgggg

SEQ ID NO: 287106 - DNA, 29 bp, Artificial Sequence
  Description of Artificial Sequence: Synthetic oligonucleotide
atgcctgtgggatagtgaacactggggtc

SEQ ID NO: 287107 - DNA, 28 bp, Artificial Sequence
  Description of Artificial Sequence: Synthetic oligonucleotide
tgcctgtgggatagtgaacactggggtc

SEQ ID NO: 287108 - DNA, 27 bp, Artificial Sequence
  Description of Artificial Sequence: Synthetic oligonucleotide
gcctgtgggatagtgaacactggggtc

SEQ ID NO: 287109 - DNA, 27 bp, Artificial Sequence
  Description of Artificial Sequence: Synthetic oligonucleotide
cctgtgggatagtgaacactggggtcc

SEQ ID NO: 287110 - DNA, 27 bp, Artificial Sequence
  Description of Artificial Sequence: Synthetic oligonucleotide
ctgtgggatagtgaacactggggtccc

SEQ ID NO: 287111 - DNA, 27 bp, Artificial Sequence
  Description of Artificial Sequence: Synthetic oligonucleotide
tgtgggatagtgaacactggggtcccg

SEQ ID NO: 287112 - DNA, 27 bp, Artificial Sequence
  Description of Artificial Sequence: Synthetic oligonucleotide
gtgggatagtgaacactggggtcccga

SEQ ID NO: 287113 - DNA, 29 bp, Artificial Sequence
  Description of Artificial Sequence: Synthetic oligonucleotide
tgggatagtgaacactggggtcccgaatg

SEQ ID NO: 287114 - DNA, 28 bp, Artificial Sequence
  Description of Artificial Sequence: Synthetic oligonucleotide
gggatagtgaacactggggtcccgaatg

SEQ ID NO: 287115 - DNA, 29 bp, Artificial Sequence
  Description of Artificial Sequence: Synthetic oligonucleotide
ggatagtgaacactggggtcccgaatgag

SEQ ID NO: 287116 - DNA, 30 bp, Artificial Sequence
  Description of Artificial Sequence: Synthetic oligonucleotide
gatagtgaacactggggtcccgaatgagtg

SEQ ID NO: 287117 - DNA, 31 bp, Artificial Sequence
  Description of Artificial Sequence: Synthetic oligonucleotide
atagtgaacactggggtcccgaatgagtgag

SEQ ID NO: 287118 - DNA, 30 bp, Artificial Sequence
  Description of Artificial Sequence: Synthetic oligonucleotide
tagtgaacactggggtcccgaatgagtgag

SEQ ID NO: 287119 - DNA, 29 bp, Artificial Sequence
  Description of Artificial Sequence: Synthetic oligonucleotide
agtgaacactggggtcccgaatgagtgag

SEQ ID NO: 287120 - DNA, 28 bp, Artificial Sequence
  Description of Artificial Sequence: Synthetic oligonucleotide
gtgaacactggggtcccgaatgagtgag

SEQ ID NO: 287121 - DNA, 29 bp, Artificial Sequence
  Description of Artificial Sequence: Synthetic oligonucleotide
tgaacactggggtcccgaatgagtgagac

SEQ ID NO: 287122 - DNA, 28 bp, Artificial Sequence
  Description of Artificial Sequence: Synthetic oligonucleotide
gaacactggggtcccgaatgagtgagac

SEQ ID NO: 287123 - DNA, 28 bp, Artificial Sequence
  Description of Artificial Sequence: Synthetic oligonucleotide
aacactggggtcccgaatgagtgagacc

SEQ ID NO: 287124 - DNA, 27 bp, Artificial Sequence
  Description of Artificial Sequence: Synthetic oligonucleotide
acactggggtcccgaatgagtgagacc

SEQ ID NO: 287125 - DNA, 26 bp, Artificial Sequence
  Description of Artificial Sequence: Synthetic oligonucleotide
cactggggtcccgaatgagtgagacc

SEQ ID NO: 287126 - DNA, 27 bp, Artificial Sequence
  Description of Artificial Sequence: Synthetic oligonucleotide
actggggtcccgaatgagtgagaccct

SEQ ID NO: 287127 - DNA, 26 bp, Artificial Sequence
  Description of Artificial Sequence: Synthetic oligonucleotide
ctggggtcccgaatgagtgagaccct

SEQ ID NO: 287128 - DNA, 26 bp, Artificial Sequence
  Description of Artificial Sequence: Synthetic oligonucleotide
tggggtcccgaatgagtgagaccctg

SEQ ID NO: 287129 - DNA, 25 bp, Artificial Sequence
  Description of Artificial Sequence: Synthetic oligonucleotide
ggggtcccgaatgagtgagaccctg

SEQ ID NO: 287130 - DNA, 26 bp, Artificial Sequence
  Description of Artificial Sequence: Synthetic oligonucleotide
gggtcccgaatgagtgagaccctgct

SEQ ID NO: 287131 - DNA, 27 bp, Artificial Sequence
  Description of Artificial Sequence: Synthetic oligonucleotide
ggtcccgaatgagtgagaccctgctgt

SEQ ID NO: 287132 - DNA, 27 bp, Artificial Sequence
  Description of Artificial Sequence: Synthetic oligonucleotide
gtcccgaatgagtgagaccctgctgtg

SEQ ID NO: 287133 - DNA, 27 bp, Artificial Sequence
  Description of Artificial Sequence: Synthetic oligonucleotide
tcccgaatgagtgagaccctgctgtgg

SEQ ID NO: 287134 - DNA, 26 bp, Artificial Sequence
  Description of Artificial Sequence: Synthetic oligonucleotide
cccgaatgagtgagaccctgctgtgg

SEQ ID NO: 287135 - DNA, 27 bp, Artificial Sequence
  Description of Artificial Sequence: Synthetic oligonucleotide
ccgaatgagtgagaccctgctgtggca

SEQ ID NO: 287136 - DNA, 27 bp, Artificial Sequence
  Description of Artificial Sequence: Synthetic oligonucleotide
cgaatgagtgagaccctgctgtggcac

SEQ ID NO: 287137 - DNA, 28 bp, Artificial Sequence
  Description of Artificial Sequence: Synthetic oligonucleotide
gaatgagtgagaccctgctgtggcactg

SEQ ID NO: 287138 - DNA, 28 bp, Artificial Sequence
  Description of Artificial Sequence: Synthetic oligonucleotide
aatgagtgagaccctgctgtggcactgc

SEQ ID NO: 287139 - DNA, 27 bp, Artificial Sequence
  Description of Artificial Sequence: Synthetic oligonucleotide
atgagtgagaccctgctgtggcactgc

SEQ ID NO: 287140 - DNA, 27 bp, Artificial Sequence
  Description of Artificial Sequence: Synthetic oligonucleotide
tgagtgagaccctgctgtggcactgca

SEQ ID NO: 287141 - DNA, 26 bp, Artificial Sequence
  Description of Artificial Sequence: Synthetic oligonucleotide
gagtgagaccctgctgtggcactgca

SEQ ID NO: 287142 - DNA, 27 bp, Artificial Sequence
  Description of Artificial Sequence: Synthetic oligonucleotide
agtgagaccctgctgtggcactgcact

SEQ ID NO: 287143 - DNA, 26 bp, Artificial Sequence
  Description of Artificial Sequence: Synthetic oligonucleotide
gtgagaccctgctgtggcactgcact

SEQ ID NO: 287144 - DNA, 27 bp, Artificial Sequence
  Description of Artificial Sequence: Synthetic oligonucleotide
tgagaccctgctgtggcactgcactca

SEQ ID NO: 287145 - DNA, 26 bp, Artificial Sequence
  Description of Artificial Sequence: Synthetic oligonucleotide
gagaccctgctgtggcactgcactca

SEQ ID NO: 287146 - DNA, 27 bp, Artificial Sequence
  Description of Artificial Sequence: Synthetic oligonucleotide
agaccctgctgtggcactgcactcaga

SEQ ID NO: 287147 - DNA, 26 bp, Artificial Sequence
  Description of Artificial Sequence: Synthetic oligonucleotide
gaccctgctgtggcactgcactcaga

SEQ ID NO: 287148 - DNA, 27 bp, Artificial Sequence
  Description of Artificial Sequence: Synthetic oligonucleotide
accctgctgtggcactgcactcagact

SEQ ID NO: 287149 - DNA, 27 bp, Artificial Sequence
  Description of Artificial Sequence: Synthetic oligonucleotide
ccctgctgtggcactgcactcagacta

SEQ ID NO: 287150 - DNA, 28 bp, Artificial Sequence
  Description of Artificial Sequence: Synthetic oligonucleotide
cctgctgtggcactgcactcagactaag

SEQ ID NO: 287151 - DNA, 30 bp, Artificial Sequence
  Description of Artificial Sequence: Synthetic oligonucleotide
ctgctgtggcactgcactcagactaagttc

SEQ ID NO: 287152 - DNA, 31 bp, Artificial Sequence
  Description of Artificial Sequence: Synthetic oligonucleotide
tgctgtggcactgcactcagactaagttctc

SEQ ID NO: 287153 - DNA, 30 bp, Artificial Sequence
  Description of Artificial Sequence: Synthetic oligonucleotide
gctgtggcactgcactcagactaagttctc

SEQ ID NO: 287154 - DNA, 30 bp, Artificial Sequence
  Description of Artificial Sequence: Synthetic oligonucleotide
ctgtggcactgcactcagactaagttctcc

SEQ ID NO: 287155 - DNA, 31 bp, Artificial Sequence
  Description of Artificial Sequence: Synthetic oligonucleotide
tgtggcactgcactcagactaagttctccac

SEQ ID NO: 287156 - DNA, 30 bp, Artificial Sequence
  Description of Artificial Sequence: Synthetic oligonucleotide
gtggcactgcactcagactaagttctccac

SEQ ID NO: 287157 - DNA, 32 bp, Artificial Sequence
  Description of Artificial Sequence: Synthetic oligonucleotide
tggcactgcactcagactaagttctccactac

SEQ ID NO: 287158 - DNA, 31 bp, Artificial Sequence
  Description of Artificial Sequence: Synthetic oligonucleotide
ggcactgcactcagactaagttctccactac

SEQ ID NO: 287159 - DNA, 32 bp, Artificial Sequence
  Description of Artificial Sequence: Synthetic oligonucleotide
gcactgcactcagactaagttctccactacag

SEQ ID NO: 287160 - DNA, 32 bp, Artificial Sequence
  Description of Artificial Sequence: Synthetic oligonucleotide
cactgcactcagactaagttctccactacagc

SEQ ID NO: 287161 - DNA, 34 bp, Artificial Sequence
  Description of Artificial Sequence: Synthetic oligonucleotide
actgcactcagactaagttctccactacagcaac

SEQ ID NO: 287162 - DNA, 33 bp, Artificial Sequence
  Description of Artificial Sequence: Synthetic oligonucleotide
ctgcactcagactaagttctccactacagcaac

SEQ ID NO: 287163 - DNA, 34 bp, Artificial Sequence
  Description of Artificial Sequence: Synthetic oligonucleotide
tgcactcagactaagttctccactacagcaacag

SEQ ID NO: 287164 - DNA, 33 bp, Artificial Sequence
  Description of Artificial Sequence: Synthetic oligonucleotide
gcactcagactaagttctccactacagcaacag

SEQ ID NO: 287165 - DNA, 33 bp, Artificial Sequence
  Description of Artificial Sequence: Synthetic oligonucleotide
cactcagactaagttctccactacagcaacagc

SEQ ID NO: 287166 - DNA, 35 bp, Artificial Sequence
  Description of Artificial Sequence: Synthetic oligonucleotide
actcagactaagttctccactacagcaacagcatg

SEQ ID NO: 287167 - DNA, 34 bp, Artificial Sequence
  Description of Artificial Sequence: Synthetic oligonucleotide
ctcagactaagttctccactacagcaacagcatg

SEQ ID NO: 287168 - DNA, 35 bp, Artificial Sequence
  Description of Artificial Sequence: Synthetic oligonucleotide
tcagactaagttctccactacagcaacagcatgag

SEQ ID NO: 287169 - DNA, 34 bp, Artificial Sequence
  Description of Artificial Sequence: Synthetic oligonucleotide
cagactaagttctccactacagcaacagcatgag

SEQ ID NO: 287170 - DNA, 35 bp, Artificial Sequence
  Description of Artificial Sequence: Synthetic oligonucleotide
agactaagttctccactacagcaacagcatgagac

SEQ ID NO: 287171 - DNA, 34 bp, Artificial Sequence
  Description of Artificial Sequence: Synthetic oligonucleotide
gactaagttctccactacagcaacagcatgagac

SEQ ID NO: 287172 - DNA, 36 bp, Artificial Sequence
  Description of Artificial Sequence: Synthetic oligonucleotide
actaagttctccactacagcaacagcatgagactag

SEQ ID NO: 287173 - DNA, 35 bp, Artificial Sequence
  Description of Artificial Sequence: Synthetic oligonucleotide
ctaagttctccactacagcaacagcatgagactag

SEQ ID NO: 287174 - DNA, 35 bp, Artificial Sequence
  Description of Artificial Sequence: Synthetic oligonucleotide
taagttctccactacagcaacagcatgagactagg

SEQ ID NO: 287175 - DNA, 34 bp, Artificial Sequence
  Description of Artificial Sequence: Synthetic oligonucleotide
aagttctccactacagcaacagcatgagactagg

SEQ ID NO: 287176 - DNA, 33 bp, Artificial Sequence
  Description of Artificial Sequence: Synthetic oligonucleotide
agttctccactacagcaacagcatgagactagg

SEQ ID NO: 287177 - DNA, 32 bp, Artificial Sequence
  Description of Artificial Sequence: Synthetic oligonucleotide
gttctccactacagcaacagcatgagactagg

SEQ ID NO: 287178 - DNA, 34 bp, Artificial Sequence
  Description of Artificial Sequence: Synthetic oligonucleotide
ttctccactacagcaacagcatgagactaggttc

SEQ ID NO: 287179 - DNA, 33 bp, Artificial Sequence
  Description of Artificial Sequence: Synthetic oligonucleotide
tctccactacagcaacagcatgagactaggttc

SEQ ID NO: 287180 - DNA, 32 bp, Artificial Sequence
  Description of Artificial Sequence: Synthetic oligonucleotide
ctccactacagcaacagcatgagactaggttc

SEQ ID NO: 287181 - DNA, 32 bp, Artificial Sequence
  Description of Artificial Sequence: Synthetic oligonucleotide
tccactacagcaacagcatgagactaggttcc

SEQ ID NO: 287182 - DNA, 31 bp, Artificial Sequence
  Description of Artificial Sequence: Synthetic oligonucleotide
ccactacagcaacagcatgagactaggttcc

SEQ ID NO: 287183 - DNA, 33 bp, Artificial Sequence
  Description of Artificial Sequence: Synthetic oligonucleotide
cactacagcaacagcatgagactaggttccatc

SEQ ID NO: 287184 - DNA, 36 bp, Artificial Sequence
  Description of Artificial Sequence: Synthetic oligonucleotide
actacagcaacagcatgagactaggttccatcattg

SEQ ID NO: 287185 - DNA, 35 bp, Artificial Sequence
  Description of Artificial Sequence: Synthetic oligonucleotide
ctacagcaacagcatgagactaggttccatcattg

SEQ ID NO: 287186 - DNA, 35 bp, Artificial Sequence
  Description of Artificial Sequence: Synthetic oligonucleotide
tacagcaacagcatgagactaggttccatcattgg

SEQ ID NO: 287187 - DNA, 34 bp, Artificial Sequence
  Description of Artificial Sequence: Synthetic oligonucleotide
acagcaacagcatgagactaggttccatcattgg

SEQ ID NO: 287188 - DNA, 33 bp, Artificial Sequence
  Description of Artificial Sequence: Synthetic oligonucleotide
cagcaacagcatgagactaggttccatcattgg

SEQ ID NO: 287189 - DNA, 33 bp, Artificial Sequence
  Description of Artificial Sequence: Synthetic oligonucleotide
agcaacagcatgagactaggttccatcattggg

SEQ ID NO: 287190 - DNA, 32 bp, Artificial Sequence
  Description of Artificial Sequence: Synthetic oligonucleotide
gcaacagcatgagactaggttccatcattggg

SEQ ID NO: 287191 - DNA, 32 bp, Artificial Sequence
  Description of Artificial Sequence: Synthetic oligonucleotide
caacagcatgagactaggttccatcattgggc

SEQ ID NO: 287192 - DNA, 34 bp, Artificial Sequence
  Description of Artificial Sequence: Synthetic oligonucleotide
aacagcatgagactaggttccatcattgggctag

SEQ ID NO: 287193 - DNA, 33 bp, Artificial Sequence
  Description of Artificial Sequence: Synthetic oligonucleotide
acagcatgagactaggttccatcattgggctag

SEQ ID NO: 287194 - DNA, 32 bp, Artificial Sequence
  Description of Artificial Sequence: Synthetic oligonucleotide
cagcatgagactaggttccatcattgggctag

SEQ ID NO: 287195 - DNA, 32 bp, Artificial Sequence
  Description of Artificial Sequence: Synthetic oligonucleotide
agcatgagactaggttccatcattgggctagc

SEQ ID NO: 287196 - DNA, 31 bp, Artificial Sequence
  Description of Artificial Sequence: Synthetic oligonucleotide
gcatgagactaggttccatcattgggctagc

SEQ ID NO: 287197 - DNA, 31 bp, Artificial Sequence
  Description of Artificial Sequence: Synthetic oligonucleotide
catgagactaggttccatcattgggctagcc

SEQ ID NO: 287198 - DNA, 33 bp, Artificial Sequence
  Description of Artificial Sequence: Synthetic oligonucleotide
atgagactaggttccatcattgggctagccttg

SEQ ID NO: 287199 - DNA, 32 bp, Artificial Sequence
  Description of Artificial Sequence: Synthetic oligonucleotide
tgagactaggttccatcattgggctagccttg

SEQ ID NO: 287200 - DNA, 31 bp, Artificial Sequence
  Description of Artificial Sequence: Synthetic oligonucleotide
gagactaggttccatcattgggctagccttg

SEQ ID NO: 287201 - DNA, 31 bp, Artificial Sequence
  Description of Artificial Sequence: Synthetic oligonucleotide
agactaggttccatcattgggctagccttgg

SEQ ID NO: 287202 - DNA, 30 bp, Artificial Sequence
  Description of Artificial Sequence: Synthetic oligonucleotide
gactaggttccatcattgggctagccttgg

SEQ ID NO: 287203 - DNA, 30 bp, Artificial Sequence
  Description of Artificial Sequence: Synthetic oligonucleotide
actaggttccatcattgggctagccttggc

SEQ ID NO: 287204 - DNA, 29 bp, Artificial Sequence
  Description of Artificial Sequence: Synthetic oligonucleotide
ctaggttccatcattgggctagccttggc

SEQ ID NO: 287205 - DNA, 33 bp, Artificial Sequence
  Description of Artificial Sequence: Synthetic oligonucleotide
taggttccatcattgggctagccttggcttaag

SEQ ID NO: 287206 - DNA, 32 bp, Artificial Sequence
  Description of Artificial Sequence: Synthetic oligonucleotide
aggttccatcattgggctagccttggcttaag

SEQ ID NO: 287207 - DNA, 31 bp, Artificial Sequence
  Description of Artificial Sequence: Synthetic oligonucleotide
ggttccatcattgggctagccttggcttaag

SEQ ID NO: 287208 - DNA, 31 bp, Artificial Sequence
  Description of Artificial Sequence: Synthetic oligonucleotide
gttccatcattgggctagccttggcttaagc

SEQ ID NO: 287209 - DNA, 32 bp, Artificial Sequence
  Description of Artificial Sequence: Synthetic oligonucleotide
ttccatcattgggctagccttggcttaagctg

SEQ ID NO: 287210 - DNA, 31 bp, Artificial Sequence
  Description of Artificial Sequence: Synthetic oligonucleotide
tccatcattgggctagccttggcttaagctg

SEQ ID NO: 287211 - DNA, 30 bp, Artificial Sequence
  Description of Artificial Sequence: Synthetic oligonucleotide
ccatcattgggctagccttggcttaagctg

SEQ ID NO: 287212 - DNA, 30 bp, Artificial Sequence
  Description of Artificial Sequence: Synthetic oligonucleotide
catcattgggctagccttggcttaagctgg

SEQ ID NO: 287213 - DNA, 30 bp, Artificial Sequence
  Description of Artificial Sequence: Synthetic oligonucleotide
atcattgggctagccttggcttaagctggc

SEQ ID NO: 287214 - DNA, 29 bp, Artificial Sequence
  Description of Artificial Sequence: Synthetic oligonucleotide
tcattgggctagccttggcttaagctggc

SEQ ID NO: 287215 - DNA, 28 bp, Artificial Sequence
  Description of Artificial Sequence: Synthetic oligonucleotide
cattgggctagccttggcttaagctggc

SEQ ID NO: 287216 - DNA, 29 bp, Artificial Sequence
  Description of Artificial Sequence: Synthetic oligonucleotide
attgggctagccttggcttaagctggctc

SEQ ID NO: 287217 - DNA, 28 bp, Artificial Sequence
  Description of Artificial Sequence: Synthetic oligonucleotide
ttgggctagccttggcttaagctggctc

SEQ ID NO: 287218 - DNA, 27 bp, Artificial Sequence
  Description of Artificial Sequence: Synthetic oligonucleotide
tgggctagccttggcttaagctggctc

SEQ ID NO: 287219 - DNA, 27 bp, Artificial Sequence
  Description of Artificial Sequence: Synthetic oligonucleotide
gggctagccttggcttaagctggctca

SEQ ID NO: 287220 - DNA, 30 bp, Artificial Sequence
  Description of Artificial Sequence: Synthetic oligonucleotide
ggctagccttggcttaagctggctcatatc

SEQ ID NO: 287221 - DNA, 30 bp, Artificial Sequence
  Description of Artificial Sequence: Synthetic oligonucleotide
gctagccttggcttaagctggctcatatcg

SEQ ID NO: 287222 - DNA, 31 bp, Artificial Sequence
  Description of Artificial Sequence: Synthetic oligonucleotide
ctagccttggcttaagctggctcatatcgtg

SEQ ID NO: 287223 - DNA, 33 bp, Artificial Sequence
  Description of Artificial Sequence: Synthetic oligonucleotide
tagccttggcttaagctggctcatatcgtgaag

SEQ ID NO: 287224 - DNA, 32 bp, Artificial Sequence
  Description of Artificial Sequence: Synthetic oligonucleotide
agccttggcttaagctggctcatatcgtgaag

SEQ ID NO: 287225 - DNA, 31 bp, Artificial Sequence
  Description of Artificial Sequence: Synthetic oligonucleotide
gccttggcttaagctggctcatatcgtgaag

SEQ ID NO: 287226 - DNA, 33 bp, Artificial Sequence
  Description of Artificial Sequence: Synthetic oligonucleotide
ccttggcttaagctggctcatatcgtgaagttg

SEQ ID NO: 287227 - DNA, 34 bp, Artificial Sequence
  Description of Artificial Sequence: Synthetic oligonucleotide
cttggcttaagctggctcatatcgtgaagttgtc

SEQ ID NO: 287228 - DNA, 34 bp, Artificial Sequence
  Description of Artificial Sequence: Synthetic oligonucleotide
ttggcttaagctggctcatatcgtgaagttgtcc

SEQ ID NO: 287229 - DNA, 33 bp, Artificial Sequence
  Description of Artificial Sequence: Synthetic oligonucleotide
tggcttaagctggctcatatcgtgaagttgtcc

SEQ ID NO: 287230 - DNA, 32 bp, Artificial Sequence
  Description of Artificial Sequence: Synthetic oligonucleotide
ggcttaagctggctcatatcgtgaagttgtcc

SEQ ID NO: 287231 - DNA, 35 bp, Artificial Sequence
  Description of Artificial Sequence: Synthetic oligonucleotide
gcttaagctggctcatatcgtgaagttgtcctaac

SEQ ID NO: 287232 - DNA, 36 bp, Artificial Sequence
  Description of Artificial Sequence: Synthetic oligonucleotide
cttaagctggctcatatcgtgaagttgtcctaactc

SEQ ID NO: 287233 - DNA, 37 bp, Artificial Sequence
  Description of Artificial Sequence: Synthetic oligonucleotide
ttaagctggctcatatcgtgaagttgtcctaactctg

SEQ ID NO: 287234 - DNA, 36 bp, Artificial Sequence
  Description of Artificial Sequence: Synthetic oligonucleotide
taagctggctcatatcgtgaagttgtcctaactctg

SEQ ID NO: 287235 - DNA, 35 bp, Artificial Sequence
  Description of Artificial Sequence: Synthetic oligonucleotide
aagctggctcatatcgtgaagttgtcctaactctg

SEQ ID NO: 287236 - DNA, 34 bp, Artificial Sequence
  Description of Artificial Sequence: Synthetic oligonucleotide
agctggctcatatcgtgaagttgtcctaactctg

SEQ ID NO: 287237 - DNA, 33 bp, Artificial Sequence
  Description of Artificial Sequence: Synthetic oligonucleotide
gctggctcatatcgtgaagttgtcctaactctg

SEQ ID NO: 287238 - DNA, 33 bp, Artificial Sequence
  Description of Artificial Sequence: Synthetic oligonucleotide
ctggctcatatcgtgaagttgtcctaactctgc

SEQ ID NO: 287239 - DNA, 34 bp, Artificial Sequence
  Description of Artificial Sequence: Synthetic oligonucleotide
tggctcatatcgtgaagttgtcctaactctgctg

SEQ ID NO: 287240 - DNA, 33 bp, Artificial Sequence
  Description of Artificial Sequence: Synthetic oligonucleotide
ggctcatatcgtgaagttgtcctaactctgctg

SEQ ID NO: 287241 - DNA, 33 bp, Artificial Sequence
  Description of Artificial Sequence: Synthetic oligonucleotide
gctcatatcgtgaagttgtcctaactctgctgc

SEQ ID NO: 287242 - DNA, 34 bp, Artificial Sequence
  Description of Artificial Sequence: Synthetic oligonucleotide
ctcatatcgtgaagttgtcctaactctgctgctg

SEQ ID NO: 287243 - DNA, 34 bp, Artificial Sequence
  Description of Artificial Sequence: Synthetic oligonucleotide
tcatatcgtgaagttgtcctaactctgctgctgg

SEQ ID NO: 287244 - DNA, 33 bp, Artificial Sequence
  Description of Artificial Sequence: Synthetic oligonucleotide
catatcgtgaagttgtcctaactctgctgctgg

SEQ ID NO: 287245 - DNA, 33 bp, Artificial Sequence
  Description of Artificial Sequence: Synthetic oligonucleotide
atatcgtgaagttgtcctaactctgctgctggc

SEQ ID NO: 287246 - DNA, 32 bp, Artificial Sequence
  Description of Artificial Sequence: Synthetic oligonucleotide
tatcgtgaagttgtcctaactctgctgctggc

SEQ ID NO: 287247 - DNA, 31 bp, Artificial Sequence
  Description of Artificial Sequence: Synthetic oligonucleotide
atcgtgaagttgtcctaactctgctgctggc

SEQ ID NO: 287248 - DNA, 30 bp, Artificial Sequence
  Description of Artificial Sequence: Synthetic oligonucleotide
tcgtgaagttgtcctaactctgctgctggc

SEQ ID NO: 287249 - DNA, 29 bp, Artificial Sequence
  Description of Artificial Sequence: Synthetic oligonucleotide
cgtgaagttgtcctaactctgctgctggc

SEQ ID NO: 287250 - DNA, 30 bp, Artificial Sequence
  Description of Artificial Sequence: Synthetic oligonucleotide
gtgaagttgtcctaactctgctgctggctg

SEQ ID NO: 287251 - DNA, 31 bp, Artificial Sequence
  Description of Artificial Sequence: Synthetic oligonucleotide
tgaagttgtcctaactctgctgctggctgtg

SEQ ID NO: 287252 - DNA, 30 bp, Artificial Sequence
  Description of Artificial Sequence: Synthetic oligonucleotide
gaagttgtcctaactctgctgctggctgtg

SEQ ID NO: 287253 - DNA, 32 bp, Artificial Sequence
  Description of Artificial Sequence: Synthetic oligonucleotide
aagttgtcctaactctgctgctggctgtgatg

SEQ ID NO: 287254 - DNA, 31 bp, Artificial Sequence
  Description of Artificial Sequence: Synthetic oligonucleotide
agttgtcctaactctgctgctggctgtgatg

SEQ ID NO: 287255 - DNA, 30 bp, Artificial Sequence
  Description of Artificial Sequence: Synthetic oligonucleotide
gttgtcctaactctgctgctggctgtgatg

SEQ ID NO: 287256 - DNA, 30 bp, Artificial Sequence
  Description of Artificial Sequence: Synthetic oligonucleotide
ttgtcctaactctgctgctggctgtgatgg

SEQ ID NO: 287257 - DNA, 29 bp, Artificial Sequence
  Description of Artificial Sequence: Synthetic oligonucleotide
tgtcctaactctgctgctggctgtgatgg

SEQ ID NO: 287258 - DNA, 28 bp, Artificial Sequence
  Description of Artificial Sequence: Synthetic oligonucleotide
gtcctaactctgctgctggctgtgatgg

SEQ ID NO: 287259 - DNA, 28 bp, Artificial Sequence
  Description of Artificial Sequence: Synthetic oligonucleotide
tcctaactctgctgctggctgtgatggc

SEQ ID NO: 287260 - DNA, 27 bp, Artificial Sequence
  Description of Artificial Sequence: Synthetic oligonucleotide
cctaactctgctgctggctgtgatggc

SEQ ID NO: 287261 - DNA, 28 bp, Artificial Sequence
  Description of Artificial Sequence: Synthetic oligonucleotide
ctaactctgctgctggctgtgatggcag

SEQ ID NO: 287262 - DNA, 31 bp, Artificial Sequence
  Description of Artificial Sequence: Synthetic oligonucleotide
taactctgctgctggctgtgatggcagattc

SEQ ID NO: 287263 - DNA, 30 bp, Artificial Sequence
  Description of Artificial Sequence: Synthetic oligonucleotide
aactctgctgctggctgtgatggcagattc

SEQ ID NO: 287264 - DNA, 29 bp, Artificial Sequence
  Description of Artificial Sequence: Synthetic oligonucleotide
actctgctgctggctgtgatggcagattc

SEQ ID NO: 287265 - DNA, 28 bp, Artificial Sequence
  Description of Artificial Sequence: Synthetic oligonucleotide
ctctgctgctggctgtgatggcagattc

SEQ ID NO: 287266 - DNA, 31 bp, Artificial Sequence
  Description of Artificial Sequence: Synthetic oligonucleotide
tctgctgctggctgtgatggcagattcaaac

SEQ ID NO: 287267 - DNA, 30 bp, Artificial Sequence
  Description of Artificial Sequence: Synthetic oligonucleotide
ctgctgctggctgtgatggcagattcaaac

SEQ ID NO: 287268 - DNA, 31 bp, Artificial Sequence
  Description of Artificial Sequence: Synthetic oligonucleotide
tgctgctggctgtgatggcagattcaaactc

SEQ ID NO: 287269 - DNA, 30 bp, Artificial Sequence
  Description of Artificial Sequence: Synthetic oligonucleotide
gctgctggctgtgatggcagattcaaactc

SEQ ID NO: 287270 - DNA, 30 bp, Artificial Sequence
  Description of Artificial Sequence: Synthetic oligonucleotide
ctgctggctgtgatggcagattcaaactcc

SEQ ID NO: 287271 - DNA, 31 bp, Artificial Sequence
  Description of Artificial Sequence: Synthetic oligonucleotide
tgctggctgtgatggcagattcaaactccag

SEQ ID NO: 287272 - DNA, 30 bp, Artificial Sequence
  Description of Artificial Sequence: Synthetic oligonucleotide
gctggctgtgatggcagattcaaactccag

SEQ ID NO: 287273 - DNA, 30 bp, Artificial Sequence
  Description of Artificial Sequence: Synthetic oligonucleotide
ctggctgtgatggcagattcaaactccagc

SEQ ID NO: 287274 - DNA, 32 bp, Artificial Sequence
  Description of Artificial Sequence: Synthetic oligonucleotide
tggctgtgatggcagattcaaactccagcatg

SEQ ID NO: 287275 - DNA, 31 bp, Artificial Sequence
  Description of Artificial Sequence: Synthetic oligonucleotide
ggctgtgatggcagattcaaactccagcatg

SEQ ID NO: 287276 - DNA, 31 bp, Artificial Sequence
  Description of Artificial Sequence: Synthetic oligonucleotide
gctgtgatggcagattcaaactccagcatgc

SEQ ID NO: 287277 - DNA, 32 bp, Artificial Sequence
  Description of Artificial Sequence: Synthetic oligonucleotide
ctgtgatggcagattcaaactccagcatgcag

SEQ ID NO: 287278 - DNA, 32 bp, Artificial Sequence
  Description of Artificial Sequence: Synthetic oligonucleotide
tgtgatggcagattcaaactccagcatgcagg

SEQ ID NO: 287279 - DNA, 31 bp, Artificial Sequence
  Description of Artificial Sequence: Synthetic oligonucleotide
gtgatggcagattcaaactccagcatgcagg

SEQ ID NO: 287280 - DNA, 32 bp, Artificial Sequence
  Description of Artificial Sequence: Synthetic oligonucleotide
tgatggcagattcaaactccagcatgcaggtg

SEQ ID NO: 287281 - DNA, 31 bp, Artificial Sequence
  Description of Artificial Sequence: Synthetic oligonucleotide
gatggcagattcaaactccagcatgcaggtg

SEQ ID NO: 287282 - DNA, 31 bp, Artificial Sequence
  Description of Artificial Sequence: Synthetic oligonucleotide
atggcagattcaaactccagcatgcaggtgg

SEQ ID NO: 287283 - DNA, 30 bp, Artificial Sequence
  Description of Artificial Sequence: Synthetic oligonucleotide
tggcagattcaaactccagcatgcaggtgg

SEQ ID NO: 287284 - DNA, 29 bp, Artificial Sequence
  Description of Artificial Sequence: Synthetic oligonucleotide
ggcagattcaaactccagcatgcaggtgg

SEQ ID NO: 287285 - DNA, 29 bp, Artificial Sequence
  Description of Artificial Sequence: Synthetic oligonucleotide
gcagattcaaactccagcatgcaggtggc

SEQ ID NO: 287286 - DNA, 30 bp, Artificial Sequence
  Description of Artificial Sequence: Synthetic oligonucleotide
cagattcaaactccagcatgcaggtggcag

SEQ ID NO: 287287 - DNA, 30 bp, Artificial Sequence
  Description of Artificial Sequence: Synthetic oligonucleotide
agattcaaactccagcatgcaggtggcagc

SEQ ID NO: 287288 - DNA, 29 bp, Artificial Sequence
  Description of Artificial Sequence: Synthetic oligonucleotide
gattcaaactccagcatgcaggtggcagc

SEQ ID NO: 287289 - DNA, 30 bp, Artificial Sequence
  Description of Artificial Sequence: Synthetic oligonucleotide
attcaaactccagcatgcaggtggcagctg

SEQ ID NO: 287290 - DNA, 29 bp, Artificial Sequence
  Description of Artificial Sequence: Synthetic oligonucleotide
ttcaaactccagcatgcaggtggcagctg

SEQ ID NO: 287291 - DNA, 28 bp, Artificial Sequence
  Description of Artificial Sequence: Synthetic oligonucleotide
tcaaactccagcatgcaggtggcagctg

SEQ ID NO: 287292 - DNA, 27 bp, Artificial Sequence
  Description of Artificial Sequence: Synthetic oligonucleotide
caaactccagcatgcaggtggcagctg

SEQ ID NO: 287293 - DNA, 28 bp, Artificial Sequence
  Description of Artificial Sequence: Synthetic oligonucleotide
aaactccagcatgcaggtggcagctgtc

SEQ ID NO: 287294 - DNA, 27 bp, Artificial Sequence
  Description of Artificial Sequence: Synthetic oligonucleotide
aactccagcatgcaggtggcagctgtc

SEQ ID NO: 287295 - DNA, 27 bp, Artificial Sequence
  Description of Artificial Sequence: Synthetic oligonucleotide
actccagcatgcaggtggcagctgtca

SEQ ID NO: 287296 - DNA, 26 bp, Artificial Sequence
  Description of Artificial Sequence: Synthetic oligonucleotide
ctccagcatgcaggtggcagctgtca

SEQ ID NO: 287297 - DNA, 27 bp, Artificial Sequence
  Description of Artificial Sequence: Synthetic oligonucleotide
tccagcatgcaggtggcagctgtcaca

SEQ ID NO: 287298 - DNA, 26 bp, Artificial Sequence
  Description of Artificial Sequence: Synthetic oligonucleotide
ccagcatgcaggtggcagctgtcaca

SEQ ID NO: 287299 - DNA, 26 bp, Artificial Sequence
  Description of Artificial Sequence: Synthetic oligonucleotide
cagcatgcaggtggcagctgtcacag

SEQ ID NO: 287300 - DNA, 27 bp, Artificial Sequence
  Description of Artificial Sequence: Synthetic oligonucleotide
agcatgcaggtggcagctgtcacagca

SEQ ID NO: 287301 - DNA, 27 bp, Artificial Sequence
  Description of Artificial Sequence: Synthetic oligonucleotide
gcatgcaggtggcagctgtcacagcat

SEQ ID NO: 287302 - DNA, 29 bp, Artificial Sequence
  Description of Artificial Sequence: Synthetic oligonucleotide
catgcaggtggcagctgtcacagcattag

SEQ ID NO: 287303 - DNA, 29 bp, Artificial Sequence
  Description of Artificial Sequence: Synthetic oligonucleotide
atgcaggtggcagctgtcacagcattagc

SEQ ID NO: 287304 - DNA, 28 bp, Artificial Sequence
  Description of Artificial Sequence: Synthetic oligonucleotide
tgcaggtggcagctgtcacagcattagc

SEQ ID NO: 287305 - DNA, 27 bp, Artificial Sequence
  Description of Artificial Sequence: Synthetic oligonucleotide
gcaggtggcagctgtcacagcattagc

SEQ ID NO: 287306 - DNA, 27 bp, Artificial Sequence
  Description of Artificial Sequence: Synthetic oligonucleotide
caggtggcagctgtcacagcattagcc

SEQ ID NO: 287307 - DNA, 28 bp, Artificial Sequence
  Description of Artificial Sequence: Synthetic oligonucleotide
aggtggcagctgtcacagcattagcctg

SEQ ID NO: 287308 - DNA, 27 bp, Artificial Sequence
  Description of Artificial Sequence: Synthetic oligonucleotide
ggtggcagctgtcacagcattagcctg

SEQ ID NO: 287309 - DNA, 28 bp, Artificial Sequence
  Description of Artificial Sequence: Synthetic oligonucleotide
gtggcagctgtcacagcattagcctgtc

SEQ ID NO: 287310 - DNA, 28 bp, Artificial Sequence
  Description of Artificial Sequence: Synthetic oligonucleotide
tggcagctgtcacagcattagcctgtcg

SEQ ID NO: 287311 - DNA, 27 bp, Artificial Sequence
  Description of Artificial Sequence: Synthetic oligonucleotide
ggcagctgtcacagcattagcctgtcg

SEQ ID NO: 287312 - DNA, 30 bp, Artificial Sequence
  Description of Artificial Sequence: Synthetic oligonucleotide
gcagctgtcacagcattagcctgtcgaatg

SEQ ID NO: 287313 - DNA, 33 bp, Artificial Sequence
  Description of Artificial Sequence: Synthetic oligonucleotide
cagctgtcacagcattagcctgtcgaatgatag

SEQ ID NO: 287314 - DNA, 33 bp, Artificial Sequence
  Description of Artificial Sequence: Synthetic oligonucleotide
agctgtcacagcattagcctgtcgaatgatagg

SEQ ID NO: 287315 - DNA, 32 bp, Artificial Sequence
  Description of Artificial Sequence: Synthetic oligonucleotide
gctgtcacagcattagcctgtcgaatgatagg

SEQ ID NO: 287316 - DNA, 33 bp, Artificial Sequence
  Description of Artificial Sequence: Synthetic oligonucleotide
ctgtcacagcattagcctgtcgaatgataggag

SEQ ID NO: 287317 - DNA, 35 bp, Artificial Sequence
  Description of Artificial Sequence: Synthetic oligonucleotide
tgtcacagcattagcctgtcgaatgataggagtag

SEQ ID NO: 287318 - DNA, 34 bp, Artificial Sequence
  Description of Artificial Sequence: Synthetic oligonucleotide
gtcacagcattagcctgtcgaatgataggagtag

SEQ ID NO: 287319 - DNA, 34 bp, Artificial Sequence
  Description of Artificial Sequence: Synthetic oligonucleotide
tcacagcattagcctgtcgaatgataggagtagg

SEQ ID NO: 287320 - DNA, 33 bp, Artificial Sequence
  Description of Artificial Sequence: Synthetic oligonucleotide
cacagcattagcctgtcgaatgataggagtagg

SEQ ID NO: 287321 - DNA, 33 bp, Artificial Sequence
  Description of Artificial Sequence: Synthetic oligonucleotide
acagcattagcctgtcgaatgataggagtaggg

SEQ ID NO: 287322 - DNA, 32 bp, Artificial Sequence
  Description of Artificial Sequence: Synthetic oligonucleotide
cagcattagcctgtcgaatgataggagtaggg

SEQ ID NO: 287323 - DNA, 33 bp, Artificial Sequence
  Description of Artificial Sequence: Synthetic oligonucleotide
agcattagcctgtcgaatgataggagtagggtc

SEQ ID NO: 287324 - DNA, 32 bp, Artificial Sequence
  Description of Artificial Sequence: Synthetic oligonucleotide
gcattagcctgtcgaatgataggagtagggtc

SEQ ID NO: 287325 - DNA, 32 bp, Artificial Sequence
  Description of Artificial Sequence: Synthetic oligonucleotide
cattagcctgtcgaatgataggagtagggtcg

SEQ ID NO: 287326 - DNA, 33 bp, Artificial Sequence
  Description of Artificial Sequence: Synthetic oligonucleotide
attagcctgtcgaatgataggagtagggtcgtg

SEQ ID NO: 287327 - DNA, 32 bp, Artificial Sequence
  Description of Artificial Sequence: Synthetic oligonucleotide
ttagcctgtcgaatgataggagtagggtcgtg

SEQ ID NO: 287328 - DNA, 31 bp, Artificial Sequence
  Description of Artificial Sequence: Synthetic oligonucleotide
tagcctgtcgaatgataggagtagggtcgtg

SEQ ID NO: 287329 - DNA, 30 bp, Artificial Sequence
  Description of Artificial Sequence: Synthetic oligonucleotide
agcctgtcgaatgataggagtagggtcgtg

SEQ ID NO: 287330 - DNA, 29 bp, Artificial Sequence
  Description of Artificial Sequence: Synthetic oligonucleotide
gcctgtcgaatgataggagtagggtcgtg

SEQ ID NO: 287331 - DNA, 29 bp, Artificial Sequence
  Description of Artificial Sequence: Synthetic oligonucleotide
cctgtcgaatgataggagtagggtcgtgc

SEQ ID NO: 287332 - DNA, 32 bp, Artificial Sequence
  Description of Artificial Sequence: Synthetic oligonucleotide
ctgtcgaatgataggagtagggtcgtgcaatg

SEQ ID NO: 287333 - DNA, 32 bp, Artificial Sequence
  Description of Artificial Sequence: Synthetic oligonucleotide
tgtcgaatgataggagtagggtcgtgcaatgg

SEQ ID NO: 287334 - DNA, 31 bp, Artificial Sequence
  Description of Artificial Sequence: Synthetic oligonucleotide
gtcgaatgataggagtagggtcgtgcaatgg

SEQ ID NO: 287335 - DNA, 32 bp, Artificial Sequence
  Description of Artificial Sequence: Synthetic oligonucleotide
tcgaatgataggagtagggtcgtgcaatggac

SEQ ID NO: 287336 - DNA, 31 bp, Artificial Sequence
  Description of Artificial Sequence: Synthetic oligonucleotide
cgaatgataggagtagggtcgtgcaatggac

SEQ ID NO: 287337 - DNA, 33 bp, Artificial Sequence
  Description of Artificial Sequence: Synthetic oligonucleotide
gaatgataggagtagggtcgtgcaatggacatg

SEQ ID NO: 287338 - DNA, 36 bp, Artificial Sequence
  Description of Artificial Sequence: Synthetic oligonucleotide
aatgataggagtagggtcgtgcaatggacatgtaac

SEQ ID NO: 287339 - DNA, 35 bp, Artificial Sequence
  Description of Artificial Sequence: Synthetic oligonucleotide
atgataggagtagggtcgtgcaatggacatgtaac

SEQ ID NO: 287340 - DNA, 34 bp, Artificial Sequence
  Description of Artificial Sequence: Synthetic oligonucleotide
tgataggagtagggtcgtgcaatggacatgtaac

SEQ ID NO: 287341 - DNA, 33 bp, Artificial Sequence
  Description of Artificial Sequence: Synthetic oligonucleotide
gataggagtagggtcgtgcaatggacatgtaac

SEQ ID NO: 287342 - DNA, 35 bp, Artificial Sequence
  Description of Artificial Sequence: Synthetic oligonucleotide
ataggagtagggtcgtgcaatggacatgtaacttg

SEQ ID NO: 287343 - DNA, 34 bp, Artificial Sequence
  Description of Artificial Sequence: Synthetic oligonucleotide
taggagtagggtcgtgcaatggacatgtaacttg

SEQ ID NO: 287344 - DNA, 33 bp, Artificial Sequence
  Description of Artificial Sequence: Synthetic oligonucleotide
aggagtagggtcgtgcaatggacatgtaacttg

SEQ ID NO: 287345 - DNA, 32 bp, Artificial Sequence
  Description of Artificial Sequence: Synthetic oligonucleotide
ggagtagggtcgtgcaatggacatgtaacttg

SEQ ID NO: 287346 - DNA, 32 bp, Artificial Sequence
  Description of Artificial Sequence: Synthetic oligonucleotide
gagtagggtcgtgcaatggacatgtaacttgc

SEQ ID NO: 287347 - DNA, 33 bp, Artificial Sequence
  Description of Artificial Sequence: Synthetic oligonucleotide
agtagggtcgtgcaatggacatgtaacttgcac

SEQ ID NO: 287348 - DNA, 32 bp, Artificial Sequence
  Description of Artificial Sequence: Synthetic oligonucleotide
gtagggtcgtgcaatggacatgtaacttgcac

SEQ ID NO: 287349 - DNA, 35 bp, Artificial Sequence
  Description of Artificial Sequence: Synthetic oligonucleotide
tagggtcgtgcaatggacatgtaacttgcactatc

SEQ ID NO: 287350 - DNA, 34 bp, Artificial Sequence
  Description of Artificial Sequence: Synthetic oligonucleotide
agggtcgtgcaatggacatgtaacttgcactatc

SEQ ID NO: 287351 - DNA, 33 bp, Artificial Sequence
  Description of Artificial Sequence: Synthetic oligonucleotide
gggtcgtgcaatggacatgtaacttgcactatc

SEQ ID NO: 287352 - DNA, 33 bp, Artificial Sequence
  Description of Artificial Sequence: Synthetic oligonucleotide
ggtcgtgcaatggacatgtaacttgcactatcc

SEQ ID NO: 287353 - DNA, 35 bp, Artificial Sequence
  Description of Artificial Sequence: Synthetic oligonucleotide
gtcgtgcaatggacatgtaacttgcactatcctac

SEQ ID NO: 287354 - DNA, 36 bp, Artificial Sequence
  Description of Artificial Sequence: Synthetic oligonucleotide
tcgtgcaatggacatgtaacttgcactatcctacag

SEQ ID NO: 287355 - DNA, 35 bp, Artificial Sequence
  Description of Artificial Sequence: Synthetic oligonucleotide
cgtgcaatggacatgtaacttgcactatcctacag

SEQ ID NO: 287356 - DNA, 36 bp, Artificial Sequence
  Description of Artificial Sequence: Synthetic oligonucleotide
gtgcaatggacatgtaacttgcactatcctacagac

SEQ ID NO: 287357 - DNA, 36 bp, Artificial Sequence
  Description of Artificial Sequence: Synthetic oligonucleotide
tgcaatggacatgtaacttgcactatcctacagacc

SEQ ID NO: 287358 - DNA, 35 bp, Artificial Sequence
  Description of Artificial Sequence: Synthetic oligonucleotide
gcaatggacatgtaacttgcactatcctacagacc

SEQ ID NO: 287359 - DNA, 37 bp, Artificial Sequence
  Description of Artificial Sequence: Synthetic oligonucleotide
caatggacatgtaacttgcactatcctacagaccatc

SEQ ID NO: 287360 - DNA, 39 bp, Artificial Sequence
  Description of Artificial Sequence: Synthetic oligonucleotide
aatggacatgtaacttgcactatcctacagaccatcttg

SEQ ID NO: 287361 - DNA, 38 bp, Artificial Sequence
  Description of Artificial Sequence: Synthetic oligonucleotide
atggacatgtaacttgcactatcctacagaccatcttg

SEQ ID NO: 287362 - DNA, 37 bp, Artificial Sequence
  Description of Artificial Sequence: Synthetic oligonucleotide
tggacatgtaacttgcactatcctacagaccatcttg

SEQ ID NO: 287363 - DNA, 36 bp, Artificial Sequence
  Description of Artificial Sequence: Synthetic oligonucleotide
ggacatgtaacttgcactatcctacagaccatcttg

SEQ ID NO: 287364 - DNA, 36 bp, Artificial Sequence
  Description of Artificial Sequence: Synthetic oligonucleotide
gacatgtaacttgcactatcctacagaccatcttgg

SEQ ID NO: 287365 - DNA, 37 bp, Artificial Sequence
  Description of Artificial Sequence: Synthetic oligonucleotide
acatgtaacttgcactatcctacagaccatcttggag

SEQ ID NO: 287366 - DNA, 36 bp, Artificial Sequence
  Description of Artificial Sequence: Synthetic oligonucleotide
catgtaacttgcactatcctacagaccatcttggag

SEQ ID NO: 287367 - DNA, 38 bp, Artificial Sequence
  Description of Artificial Sequence: Synthetic oligonucleotide
atgtaacttgcactatcctacagaccatcttggagaag

SEQ ID NO: 287368 - DNA, 37 bp, Artificial Sequence
  Description of Artificial Sequence: Synthetic oligonucleotide
tgtaacttgcactatcctacagaccatcttggagaag

SEQ ID NO: 287369 - DNA, 36 bp, Artificial Sequence
  Description of Artificial Sequence: Synthetic oligonucleotide
gtaacttgcactatcctacagaccatcttggagaag

SEQ ID NO: 287370 - DNA, 37 bp, Artificial Sequence
  Description of Artificial Sequence: Synthetic oligonucleotide
taacttgcactatcctacagaccatcttggagaagtg

SEQ ID NO: 287371 - DNA, 36 bp, Artificial Sequence
  Description of Artificial Sequence: Synthetic oligonucleotide
aacttgcactatcctacagaccatcttggagaagtg

SEQ ID NO: 287372 - DNA, 35 bp, Artificial Sequence
  Description of Artificial Sequence: Synthetic oligonucleotide
acttgcactatcctacagaccatcttggagaagtg

SEQ ID NO: 287373 - DNA, 34 bp, Artificial Sequence
  Description of Artificial Sequence: Synthetic oligonucleotide
cttgcactatcctacagaccatcttggagaagtg

SEQ ID NO: 287374 - DNA, 35 bp, Artificial Sequence
  Description of Artificial Sequence: Synthetic oligonucleotide
ttgcactatcctacagaccatcttggagaagtgag

SEQ ID NO: 287375 - DNA, 34 bp, Artificial Sequence
  Description of Artificial Sequence: Synthetic oligonucleotide
tgcactatcctacagaccatcttggagaagtgag

SEQ ID NO: 287376 - DNA, 33 bp, Artificial Sequence
  Description of Artificial Sequence: Synthetic oligonucleotide
gcactatcctacagaccatcttggagaagtgag

SEQ ID NO: 287377 - DNA, 34 bp, Artificial Sequence
  Description of Artificial Sequence: Synthetic oligonucleotide
cactatcctacagaccatcttggagaagtgagag

SEQ ID NO: 287378 - DNA, 35 bp, Artificial Sequence
  Description of Artificial Sequence: Synthetic oligonucleotide
actatcctacagaccatcttggagaagtgagagac

SEQ ID NO: 287379 - DNA, 34 bp, Artificial Sequence
  Description of Artificial Sequence: Synthetic oligonucleotide
ctatcctacagaccatcttggagaagtgagagac

SEQ ID NO: 287380 - DNA, 35 bp, Artificial Sequence
  Description of Artificial Sequence: Synthetic oligonucleotide
tatcctacagaccatcttggagaagtgagagactg

SEQ ID NO: 287381 - DNA, 34 bp, Artificial Sequence
  Description of Artificial Sequence: Synthetic oligonucleotide
atcctacagaccatcttggagaagtgagagactg

SEQ ID NO: 287382 - DNA, 33 bp, Artificial Sequence
  Description of Artificial Sequence: Synthetic oligonucleotide
tcctacagaccatcttggagaagtgagagactg

SEQ ID NO: 287383 - DNA, 32 bp, Artificial Sequence
  Description of Artificial Sequence: Synthetic oligonucleotide
cctacagaccatcttggagaagtgagagactg

SEQ ID NO: 287384 - DNA, 33 bp, Artificial Sequence
  Description of Artificial Sequence: Synthetic oligonucleotide
ctacagaccatcttggagaagtgagagactgac

SEQ ID NO: 287385 - DNA, 33 bp, Artificial Sequence
  Description of Artificial Sequence: Synthetic oligonucleotide
tacagaccatcttggagaagtgagagactgacc

SEQ ID NO: 287386 - DNA, 32 bp, Artificial Sequence
  Description of Artificial Sequence: Synthetic oligonucleotide
acagaccatcttggagaagtgagagactgacc

SEQ ID NO: 287387 - DNA, 31 bp, Artificial Sequence
  Description of Artificial Sequence: Synthetic oligonucleotide
cagaccatcttggagaagtgagagactgacc

SEQ ID NO: 287388 - DNA, 32 bp, Artificial Sequence
  Description of Artificial Sequence: Synthetic oligonucleotide
agaccatcttggagaagtgagagactgacctc

SEQ ID NO: 287389 - DNA, 31 bp, Artificial Sequence
  Description of Artificial Sequence: Synthetic oligonucleotide
gaccatcttggagaagtgagagactgacctc

SEQ ID NO: 287390 - DNA, 33 bp, Artificial Sequence
  Description of Artificial Sequence: Synthetic oligonucleotide
accatcttggagaagtgagagactgacctcaag

SEQ ID NO: 287391 - DNA, 32 bp, Artificial Sequence
  Description of Artificial Sequence: Synthetic oligonucleotide
ccatcttggagaagtgagagactgacctcaag

SEQ ID NO: 287392 - DNA, 32 bp, Artificial Sequence
  Description of Artificial Sequence: Synthetic oligonucleotide
catcttggagaagtgagagactgacctcaagg

SEQ ID NO: 287393 - DNA, 35 bp, Artificial Sequence
  Description of Artificial Sequence: Synthetic oligonucleotide
atcttggagaagtgagagactgacctcaaggattc

SEQ ID NO: 287394 - DNA, 34 bp, Artificial Sequence
  Description of Artificial Sequence: Synthetic oligonucleotide
tcttggagaagtgagagactgacctcaaggattc

SEQ ID NO: 287395 - DNA, 33 bp, Artificial Sequence
  Description of Artificial Sequence: Synthetic oligonucleotide
cttggagaagtgagagactgacctcaaggattc

SEQ ID NO: 287396 - DNA, 37 bp, Artificial Sequence
  Description of Artificial Sequence: Synthetic oligonucleotide
ttggagaagtgagagactgacctcaaggattcttatg

SEQ ID NO: 287397 - DNA, 36 bp, Artificial Sequence
  Description of Artificial Sequence: Synthetic oligonucleotide
tggagaagtgagagactgacctcaaggattcttatg

SEQ ID NO: 287398 - DNA, 35 bp, Artificial Sequence
  Description of Artificial Sequence: Synthetic oligonucleotide
ggagaagtgagagactgacctcaaggattcttatg

SEQ ID NO: 287399 - DNA, 35 bp, Artificial Sequence
  Description of Artificial Sequence: Synthetic oligonucleotide
gagaagtgagagactgacctcaaggattcttatgc

SEQ ID NO: 287400 - DNA, 36 bp, Artificial Sequence
  Description of Artificial Sequence: Synthetic oligonucleotide
agaagtgagagactgacctcaaggattcttatgctc

SEQ ID NO: 287401 - DNA, 35 bp, Artificial Sequence
  Description of Artificial Sequence: Synthetic oligonucleotide
gaagtgagagactgacctcaaggattcttatgctc

SEQ ID NO: 287402 - DNA, 35 bp, Artificial Sequence
  Description of Artificial Sequence: Synthetic oligonucleotide
aagtgagagactgacctcaaggattcttatgctcc

SEQ ID NO: 287403 - DNA, 34 bp, Artificial Sequence
  Description of Artificial Sequence: Synthetic oligonucleotide
agtgagagactgacctcaaggattcttatgctcc

SEQ ID NO: 287404 - DNA, 33 bp, Artificial Sequence
  Description of Artificial Sequence: Synthetic oligonucleotide
gtgagagactgacctcaaggattcttatgctcc

SEQ ID NO: 287405 - DNA, 35 bp, Artificial Sequence
  Description of Artificial Sequence: Synthetic oligonucleotide
tgagagactgacctcaaggattcttatgctccttg

SEQ ID NO: 287406 - DNA, 34 bp, Artificial Sequence
  Description of Artificial Sequence: Synthetic oligonucleotide
gagagactgacctcaaggattcttatgctccttg

SEQ ID NO: 287407 - DNA, 34 bp, Artificial Sequence
  Description of Artificial Sequence: Synthetic oligonucleotide
agagactgacctcaaggattcttatgctccttgg

SEQ ID NO: 287408 - DNA, 33 bp, Artificial Sequence
  Description of Artificial Sequence: Synthetic oligonucleotide
gagactgacctcaaggattcttatgctccttgg

SEQ ID NO: 287409 - DNA, 33 bp, Artificial Sequence
  Description of Artificial Sequence: Synthetic oligonucleotide
agactgacctcaaggattcttatgctccttggc

SEQ ID NO: 287410 - DNA, 32 bp, Artificial Sequence
  Description of Artificial Sequence: Synthetic oligonucleotide
gactgacctcaaggattcttatgctccttggc

SEQ ID NO: 287411 - DNA, 34 bp, Artificial Sequence
  Description of Artificial Sequence: Synthetic oligonucleotide
actgacctcaaggattcttatgctccttggcttc

SEQ ID NO: 287412 - DNA, 33 bp, Artificial Sequence
  Description of Artificial Sequence: Synthetic oligonucleotide
ctgacctcaaggattcttatgctccttggcttc

SEQ ID NO: 287413 - DNA, 33 bp, Artificial Sequence
  Description of Artificial Sequence: Synthetic oligonucleotide
tgacctcaaggattcttatgctccttggcttcc

SEQ ID NO: 287414 - DNA, 32 bp, Artificial Sequence
  Description of Artificial Sequence: Synthetic oligonucleotide
gacctcaaggattcttatgctccttggcttcc

SEQ ID NO: 287415 - DNA, 33 bp, Artificial Sequence
  Description of Artificial Sequence: Synthetic oligonucleotide
acctcaaggattcttatgctccttggcttccac

SEQ ID NO: 287416 - DNA, 32 bp, Artificial Sequence
  Description of Artificial Sequence: Synthetic oligonucleotide
cctcaaggattcttatgctccttggcttccac

SEQ ID NO: 287417 - DNA, 34 bp, Artificial Sequence
  Description of Artificial Sequence: Synthetic oligonucleotide
ctcaaggattcttatgctccttggcttccacttg

SEQ ID NO: 287418 - DNA, 34 bp, Artificial Sequence
  Description of Artificial Sequence: Synthetic oligonucleotide
tcaaggattcttatgctccttggcttccacttgg

SEQ ID NO: 287419 - DNA, 33 bp, Artificial Sequence
  Description of Artificial Sequence: Synthetic oligonucleotide
caaggattcttatgctccttggcttccacttgg

SEQ ID NO: 287420 - DNA, 34 bp, Artificial Sequence
  Description of Artificial Sequence: Synthetic oligonucleotide
aaggattcttatgctccttggcttccacttggac

SEQ ID NO: 287421 - DNA, 33 bp, Artificial Sequence
  Description of Artificial Sequence: Synthetic oligonucleotide
aggattcttatgctccttggcttccacttggac

SEQ ID NO: 287422 - DNA, 32 bp, Artificial Sequence
  Description of Artificial Sequence: Synthetic oligonucleotide
ggattcttatgctccttggcttccacttggac

SEQ ID NO: 287423 - DNA, 33 bp, Artificial Sequence
  Description of Artificial Sequence: Synthetic oligonucleotide
gattcttatgctccttggcttccacttggactg

SEQ ID NO: 287424 - DNA, 33 bp, Artificial Sequence
  Description of Artificial Sequence: Synthetic oligonucleotide
attcttatgctccttggcttccacttggactgc

SEQ ID NO: 287425 - DNA, 32 bp, Artificial Sequence
  Description of Artificial Sequence: Synthetic oligonucleotide
ttcttatgctccttggcttccacttggactgc

SEQ ID NO: 287426 - DNA, 31 bp, Artificial Sequence
  Description of Artificial Sequence: Synthetic oligonucleotide
tcttatgctccttggcttccacttggactgc

SEQ ID NO: 287427 - DNA, 30 bp, Artificial Sequence
  Description of Artificial Sequence: Synthetic oligonucleotide
cttatgctccttggcttccacttggactgc

SEQ ID NO: 287428 - DNA, 30 bp, Artificial Sequence
  Description of Artificial Sequence: Synthetic oligonucleotide
ttatgctccttggcttccacttggactgcg

SEQ ID NO: 287429 - DNA, 29 bp, Artificial Sequence
  Description of Artificial Sequence: Synthetic oligonucleotide
tatgctccttggcttccacttggactgcg

SEQ ID NO: 287430 - DNA, 28 bp, Artificial Sequence
  Description of Artificial Sequence: Synthetic oligonucleotide
atgctccttggcttccacttggactgcg

SEQ ID NO: 287431 - DNA, 27 bp, Artificial Sequence
  Description of Artificial Sequence: Synthetic oligonucleotide
tgctccttggcttccacttggactgcg

SEQ ID NO: 287432 - DNA, 27 bp, Artificial Sequence
  Description of Artificial Sequence: Synthetic oligonucleotide
gctccttggcttccacttggactgcgt

SEQ ID NO: 287433 - DNA, 27 bp, Artificial Sequence
  Description of Artificial Sequence: Synthetic oligonucleotide
ctccttggcttccacttggactgcgtc

SEQ ID NO: 287434 - DNA, 28 bp, Artificial Sequence
  Description of Artificial Sequence: Synthetic oligonucleotide
tccttggcttccacttggactgcgtctc

SEQ ID NO: 287435 - DNA, 27 bp, Artificial Sequence
  Description of Artificial Sequence: Synthetic oligonucleotide
ccttggcttccacttggactgcgtctc

SEQ ID NO: 287436 - DNA, 29 bp, Artificial Sequence
  Description of Artificial Sequence: Synthetic oligonucleotide
cttggcttccacttggactgcgtctcaac

SEQ ID NO: 287437 - DNA, 29 bp, Artificial Sequence
  Description of Artificial Sequence: Synthetic oligonucleotide
ttggcttccacttggactgcgtctcaacc

SEQ ID NO: 287438 - DNA, 28 bp, Artificial Sequence
  Description of Artificial Sequence: Synthetic oligonucleotide
tggcttccacttggactgcgtctcaacc

SEQ ID NO: 287439 - DNA, 27 bp, Artificial Sequence
  Description of Artificial Sequence: Synthetic oligonucleotide
ggcttccacttggactgcgtctcaacc

SEQ ID NO: 287440 - DNA, 28 bp, Artificial Sequence
  Description of Artificial Sequence: Synthetic oligonucleotide
gcttccacttggactgcgtctcaacctc

SEQ ID NO: 287441 - DNA, 28 bp, Artificial Sequence
  Description of Artificial Sequence: Synthetic oligonucleotide
cttccacttggactgcgtctcaacctcc

SEQ ID NO: 287442 - DNA, 29 bp, Artificial Sequence
  Description of Artificial Sequence: Synthetic oligonucleotide
ttccacttggactgcgtctcaacctcctg

SEQ ID NO: 287443 - DNA, 28 bp, Artificial Sequence
  Description of Artificial Sequence: Synthetic oligonucleotide
tccacttggactgcgtctcaacctcctg

SEQ ID NO: 287444 - DNA, 27 bp, Artificial Sequence
  Description of Artificial Sequence: Synthetic oligonucleotide
ccacttggactgcgtctcaacctcctg

SEQ ID NO: 287445 - DNA, 27 bp, Artificial Sequence
  Description of Artificial Sequence: Synthetic oligonucleotide
cacttggactgcgtctcaacctcctgg

SEQ ID NO: 287446 - DNA, 27 bp, Artificial Sequence
  Description of Artificial Sequence: Synthetic oligonucleotide
acttggactgcgtctcaacctcctggg

SEQ ID NO: 287447 - DNA, 26 bp, Artificial Sequence
  Description of Artificial Sequence: Synthetic oligonucleotide
cttggactgcgtctcaacctcctggg

SEQ ID NO: 287448 - DNA, 27 bp, Artificial Sequence
  Description of Artificial Sequence: Synthetic oligonucleotide
ttggactgcgtctcaacctcctgggga

SEQ ID NO: 287449 - DNA, 27 bp, Artificial Sequence
  Description of Artificial Sequence: Synthetic oligonucleotide
tggactgcgtctcaacctcctggggaa

SEQ ID NO: 287450 - DNA, 26 bp, Artificial Sequence
  Description of Artificial Sequence: Synthetic oligonucleotide
ggactgcgtctcaacctcctggggaa

SEQ ID NO: 287451 - DNA, 26 bp, Artificial Sequence
  Description of Artificial Sequence: Synthetic oligonucleotide
gactgcgtctcaacctcctggggaac

SEQ ID NO: 287452 - DNA, 26 bp, Artificial Sequence
  Description of Artificial Sequence: Synthetic oligonucleotide
actgcgtctcaacctcctggggaacg

SEQ ID NO: 287453 - DNA, 25 bp, Artificial Sequence
  Description of Artificial Sequence: Synthetic oligonucleotide
ctgcgtctcaacctcctggggaacg

SEQ ID NO: 287454 - DNA, 26 bp, Artificial Sequence
  Description of Artificial Sequence: Synthetic oligonucleotide
tgcgtctcaacctcctggggaacggt

SEQ ID NO: 287455 - DNA, 25 bp, Artificial Sequence
  Description of Artificial Sequence: Synthetic oligonucleotide
gcgtctcaacctcctggggaacggt

SEQ ID NO: 287456 - DNA, 26 bp, Artificial Sequence
  Description of Artificial Sequence: Synthetic oligonucleotide
cgtctcaacctcctggggaacggtga

SEQ ID NO: 287457 - DNA, 26 bp, Artificial Sequence
  Description of Artificial Sequence: Synthetic oligonucleotide
gtctcaacctcctggggaacggtgag

SEQ ID NO: 287458 - DNA, 26 bp, Artificial Sequence
  Description of Artificial Sequence: Synthetic oligonucleotide
tctcaacctcctggggaacggtgagg

SEQ ID NO: 287459 - DNA, 25 bp, Artificial Sequence
  Description of Artificial Sequence: Synthetic oligonucleotide
ctcaacctcctggggaacggtgagg

SEQ ID NO: 287460 - DNA, 25 bp, Artificial Sequence
  Description of Artificial Sequence: Synthetic oligonucleotide
tcaacctcctggggaacggtgaggc

SEQ ID NO: 287461 - DNA, 24 bp, Artificial Sequence
  Description of Artificial Sequence: Synthetic oligonucleotide
caacctcctggggaacggtgaggc

SEQ ID NO: 287462 - DNA, 26 bp, Artificial Sequence
  Description of Artificial Sequence: Synthetic oligonucleotide
aacctcctggggaacggtgaggcctt

SEQ ID NO: 287463 - DNA, 25 bp, Artificial Sequence
  Description of Artificial Sequence: Synthetic oligonucleotide
acctcctggggaacggtgaggcctt

SEQ ID NO: 287464 - DNA, 24 bp, Artificial Sequence
  Description of Artificial Sequence: Synthetic oligonucleotide
cctcctggggaacggtgaggcctt

SEQ ID NO: 287465 - DNA, 24 bp, Artificial Sequence
  Description of Artificial Sequence: Synthetic oligonucleotide
ctcctggggaacggtgaggccttc

SEQ ID NO: 287466 - DNA, 25 bp, Artificial Sequence
  Description of Artificial Sequence: Synthetic oligonucleotide
tcctggggaacggtgaggccttcga

SEQ ID NO: 287467 - DNA, 24 bp, Artificial Sequence
  Description of Artificial Sequence: Synthetic oligonucleotide
cctggggaacggtgaggccttcga

SEQ ID NO: 287468 - DNA, 24 bp, Artificial Sequence
  Description of Artificial Sequence: Synthetic oligonucleotide
ctggggaacggtgaggccttcgag

SEQ ID NO: 287469 - DNA, 24 bp, Artificial Sequence
  Description of Artificial Sequence: Synthetic oligonucleotide
tggggaacggtgaggccttcgagg

SEQ ID NO: 287470 - DNA, 23 bp, Artificial Sequence
  Description of Artificial Sequence: Synthetic oligonucleotide
ggggaacggtgaggccttcgagg

SEQ ID NO: 287471 - DNA, 26 bp, Artificial Sequence
  Description of Artificial Sequence: Synthetic oligonucleotide
gggaacggtgaggccttcgaggcaaa

SEQ ID NO: 287472 - DNA, 26 bp, Artificial Sequence
  Description of Artificial Sequence: Synthetic oligonucleotide
ggaacggtgaggccttcgaggcaaac

SEQ ID NO: 287473 - DNA, 27 bp, Artificial Sequence
  Description of Artificial Sequence: Synthetic oligonucleotide
gaacggtgaggccttcgaggcaaacct

SEQ ID NO: 287474 - DNA, 27 bp, Artificial Sequence
  Description of Artificial Sequence: Synthetic oligonucleotide
aacggtgaggccttcgaggcaaacctg

SEQ ID NO: 287475 - DNA, 26 bp, Artificial Sequence
  Description of Artificial Sequence: Synthetic oligonucleotide
acggtgaggccttcgaggcaaacctg

SEQ ID NO: 287476 - DNA, 25 bp, Artificial Sequence
  Description of Artificial Sequence: Synthetic oligonucleotide
cggtgaggccttcgaggcaaacctg

SEQ ID NO: 287477 - DNA, 25 bp, Artificial Sequence
  Description of Artificial Sequence: Synthetic oligonucleotide
ggtgaggccttcgaggcaaacctgg

SEQ ID NO: 287478 - DNA, 26 bp, Artificial Sequence
  Description of Artificial Sequence: Synthetic oligonucleotide
gtgaggccttcgaggcaaacctggct

SEQ ID NO: 287479 - DNA, 26 bp, Artificial Sequence
  Description of Artificial Sequence: Synthetic oligonucleotide
tgaggccttcgaggcaaacctggctg

SEQ ID NO: 287480 - DNA, 25 bp, Artificial Sequence
  Description of Artificial Sequence: Synthetic oligonucleotide
gaggccttcgaggcaaacctggctg

SEQ ID NO: 287481 - DNA, 26 bp, Artificial Sequence
  Description of Artificial Sequence: Synthetic oligonucleotide
aggccttcgaggcaaacctggctgct

SEQ ID NO: 287482 - DNA, 25 bp, Artificial Sequence
  Description of Artificial Sequence: Synthetic oligonucleotide
ggccttcgaggcaaacctggctgct

SEQ ID NO: 287483 - DNA, 26 bp, Artificial Sequence
  Description of Artificial Sequence: Synthetic oligonucleotide
gccttcgaggcaaacctggctgctct

SEQ ID NO: 287484 - DNA, 26 bp, Artificial Sequence
  Description of Artificial Sequence: Synthetic oligonucleotide
ccttcgaggcaaacctggctgctctg

SEQ ID NO: 287485 - DNA, 27 bp, Artificial Sequence
  Description of Artificial Sequence: Synthetic oligonucleotide
cttcgaggcaaacctggctgctctgga

SEQ ID NO: 287486 - DNA, 27 bp, Artificial Sequence
  Description of Artificial Sequence: Synthetic oligonucleotide
ttcgaggcaaacctggctgctctggag

SEQ ID NO: 287487 - DNA, 26 bp, Artificial Sequence
  Description of Artificial Sequence: Synthetic oligonucleotide
tcgaggcaaacctggctgctctggag

SEQ ID NO: 287488 - DNA, 25 bp, Artificial Sequence
  Description of Artificial Sequence: Synthetic oligonucleotide
cgaggcaaacctggctgctctggag

SEQ ID NO: 287489 - DNA, 27 bp, Artificial Sequence
  Description of Artificial Sequence: Synthetic oligonucleotide
gaggcaaacctggctgctctggaggtt

SEQ ID NO: 287490 - DNA, 27 bp, Artificial Sequence
  Description of Artificial Sequence: Synthetic oligonucleotide
aggcaaacctggctgctctggaggttc

SEQ ID NO: 287491 - DNA, 27 bp, Artificial Sequence
  Description of Artificial Sequence: Synthetic oligonucleotide
ggcaaacctggctgctctggaggttct

SEQ ID NO: 287492 - DNA, 27 bp, Artificial Sequence
  Description of Artificial Sequence: Synthetic oligonucleotide
gcaaacctggctgctctggaggttctg

SEQ ID NO: 287493 - DNA, 28 bp, Artificial Sequence
  Description of Artificial Sequence: Synthetic oligonucleotide
caaacctggctgctctggaggttctgtc

SEQ ID NO: 287494 - DNA, 29 bp, Artificial Sequence
  Description of Artificial Sequence: Synthetic oligonucleotide
aaacctggctgctctggaggttctgtcag

SEQ ID NO: 287495 - DNA, 28 bp, Artificial Sequence
  Description of Artificial Sequence: Synthetic oligonucleotide
aacctggctgctctggaggttctgtcag

SEQ ID NO: 287496 - DNA, 27 bp, Artificial Sequence
  Description of Artificial Sequence: Synthetic oligonucleotide
acctggctgctctggaggttctgtcag

SEQ ID NO: 287497 - DNA, 27 bp, Artificial Sequence
  Description of Artificial Sequence: Synthetic oligonucleotide
cctggctgctctggaggttctgtcaga

SEQ ID NO: 287498 - DNA, 27 bp, Artificial Sequence
  Description of Artificial Sequence: Synthetic oligonucleotide
ctggctgctctggaggttctgtcagag

SEQ ID NO: 287499 - DNA, 27 bp, Artificial Sequence
  Description of Artificial Sequence: Synthetic oligonucleotide
tggctgctctggaggttctgtcagagc

SEQ ID NO: 287500 - DNA, 26 bp, Artificial Sequence
  Description of Artificial Sequence: Synthetic oligonucleotide
ggctgctctggaggttctgtcagagc

SEQ ID NO: 287501 - DNA, 27 bp, Artificial Sequence
  Description of Artificial Sequence: Synthetic oligonucleotide
gctgctctggaggttctgtcagagcga

SEQ ID NO: 287502 - DNA, 29 bp, Artificial Sequence
  Description of Artificial Sequence: Synthetic oligonucleotide
ctgctctggaggttctgtcagagcgattc

SEQ ID NO: 287503 - DNA, 29 bp, Artificial Sequence
  Description of Artificial Sequence: Synthetic oligonucleotide
tgctctggaggttctgtcagagcgattcc

SEQ ID NO: 287504 - DNA, 28 bp, Artificial Sequence
  Description of Artificial Sequence: Synthetic oligonucleotide
gctctggaggttctgtcagagcgattcc

SEQ ID NO: 287505 - DNA, 28 bp, Artificial Sequence
  Description of Artificial Sequence: Synthetic oligonucleotide
ctctggaggttctgtcagagcgattccg

SEQ ID NO: 287506 - DNA, 28 bp, Artificial Sequence
  Description of Artificial Sequence: Synthetic oligonucleotide
tctggaggttctgtcagagcgattccgc

SEQ ID NO: 287507 - DNA, 27 bp, Artificial Sequence
  Description of Artificial Sequence: Synthetic oligonucleotide
ctggaggttctgtcagagcgattccgc

SEQ ID NO: 287508 - DNA, 28 bp, Artificial Sequence
  Description of Artificial Sequence: Synthetic oligonucleotide
tggaggttctgtcagagcgattccgcag

SEQ ID NO: 287509 - DNA, 27 bp, Artificial Sequence
  Description of Artificial Sequence: Synthetic oligonucleotide
ggaggttctgtcagagcgattccgcag

SEQ ID NO: 287510 - DNA, 31 bp, Artificial Sequence
  Description of Artificial Sequence: Synthetic oligonucleotide
gaggttctgtcagagcgattccgcagatttg

SEQ ID NO: 287511 - DNA, 31 bp, Artificial Sequence
  Description of Artificial Sequence: Synthetic oligonucleotide
aggttctgtcagagcgattccgcagatttgc

SEQ ID NO: 287512 - DNA, 30 bp, Artificial Sequence
  Description of Artificial Sequence: Synthetic oligonucleotide
ggttctgtcagagcgattccgcagatttgc

SEQ ID NO: 287513 - DNA, 30 bp, Artificial Sequence
  Description of Artificial Sequence: Synthetic oligonucleotide
gttctgtcagagcgattccgcagatttgcc

SEQ ID NO: 287514 - DNA, 32 bp, Artificial Sequence
  Description of Artificial Sequence: Synthetic oligonucleotide
ttctgtcagagcgattccgcagatttgccaac

SEQ ID NO: 287515 - DNA, 31 bp, Artificial Sequence
  Description of Artificial Sequence: Synthetic oligonucleotide
tctgtcagagcgattccgcagatttgccaac

SEQ ID NO: 287516 - DNA, 30 bp, Artificial Sequence
  Description of Artificial Sequence: Synthetic oligonucleotide
ctgtcagagcgattccgcagatttgccaac

SEQ ID NO: 287517 - DNA, 31 bp, Artificial Sequence
  Description of Artificial Sequence: Synthetic oligonucleotide
tgtcagagcgattccgcagatttgccaactc

SEQ ID NO: 287518 - DNA, 30 bp, Artificial Sequence
  Description of Artificial Sequence: Synthetic oligonucleotide
gtcagagcgattccgcagatttgccaactc

SEQ ID NO: 287519 - DNA, 31 bp, Artificial Sequence
  Description of Artificial Sequence: Synthetic oligonucleotide
tcagagcgattccgcagatttgccaactcac

SEQ ID NO: 287520 - DNA, 30 bp, Artificial Sequence
  Description of Artificial Sequence: Synthetic oligonucleotide
cagagcgattccgcagatttgccaactcac

SEQ ID NO: 287521 - DNA, 31 bp, Artificial Sequence
  Description of Artificial Sequence: Synthetic oligonucleotide
agagcgattccgcagatttgccaactcactg

SEQ ID NO: 287522 - DNA, 30 bp, Artificial Sequence
  Description of Artificial Sequence: Synthetic oligonucleotide
gagcgattccgcagatttgccaactcactg

SEQ ID NO: 287523 - DNA, 30 bp, Artificial Sequence
  Description of Artificial Sequence: Synthetic oligonucleotide
agcgattccgcagatttgccaactcactgg

SEQ ID NO: 287524 - DNA, 29 bp, Artificial Sequence
  Description of Artificial Sequence: Synthetic oligonucleotide
gcgattccgcagatttgccaactcactgg

SEQ ID NO: 287525 - DNA, 30 bp, Artificial Sequence
  Description of Artificial Sequence: Synthetic oligonucleotide
cgattccgcagatttgccaactcactggtg

SEQ ID NO: 287526 - DNA, 30 bp, Artificial Sequence
  Description of Artificial Sequence: Synthetic oligonucleotide
gattccgcagatttgccaactcactggtgg

SEQ ID NO: 287527 - DNA, 32 bp, Artificial Sequence
  Description of Artificial Sequence: Synthetic oligonucleotide
attccgcagatttgccaactcactggtggttg

SEQ ID NO: 287528 - DNA, 31 bp, Artificial Sequence
  Description of Artificial Sequence: Synthetic oligonucleotide
ttccgcagatttgccaactcactggtggttg

SEQ ID NO: 287529 - DNA, 30 bp, Artificial Sequence
  Description of Artificial Sequence: Synthetic oligonucleotide
tccgcagatttgccaactcactggtggttg

SEQ ID NO: 287530 - DNA, 29 bp, Artificial Sequence
  Description of Artificial Sequence: Synthetic oligonucleotide
ccgcagatttgccaactcactggtggttg

SEQ ID NO: 287531 - DNA, 30 bp, Artificial Sequence
  Description of Artificial Sequence: Synthetic oligonucleotide
cgcagatttgccaactcactggtggttgtg

SEQ ID NO: 287532 - DNA, 31 bp, Artificial Sequence
  Description of Artificial Sequence: Synthetic oligonucleotide
gcagatttgccaactcactggtggttgtgtg

SEQ ID NO: 287533 - DNA, 32 bp, Artificial Sequence
  Description of Artificial Sequence: Synthetic oligonucleotide
cagatttgccaactcactggtggttgtgtgtg

SEQ ID NO: 287534 - DNA, 32 bp, Artificial Sequence
  Description of Artificial Sequence: Synthetic oligonucleotide
agatttgccaactcactggtggttgtgtgtgc

SEQ ID NO: 287535 - DNA, 31 bp, Artificial Sequence
  Description of Artificial Sequence: Synthetic oligonucleotide
gatttgccaactcactggtggttgtgtgtgc

SEQ ID NO: 287536 - DNA, 35 bp, Artificial Sequence
  Description of Artificial Sequence: Synthetic oligonucleotide
atttgccaactcactggtggttgtgtgtgcttatg

SEQ ID NO: 287537 - DNA, 34 bp, Artificial Sequence
  Description of Artificial Sequence: Synthetic oligonucleotide
tttgccaactcactggtggttgtgtgtgcttatg

SEQ ID NO: 287538 - DNA, 33 bp, Artificial Sequence
  Description of Artificial Sequence: Synthetic oligonucleotide
ttgccaactcactggtggttgtgtgtgcttatg

SEQ ID NO: 287539 - DNA, 32 bp, Artificial Sequence
  Description of Artificial Sequence: Synthetic oligonucleotide
tgccaactcactggtggttgtgtgtgcttatg

SEQ ID NO: 287540 - DNA, 31 bp, Artificial Sequence
  Description of Artificial Sequence: Synthetic oligonucleotide
gccaactcactggtggttgtgtgtgcttatg

SEQ ID NO: 287541 - DNA, 31 bp, Artificial Sequence
  Description of Artificial Sequence: Synthetic oligonucleotide
ccaactcactggtggttgtgtgtgcttatgc

SEQ ID NO: 287542 - DNA, 32 bp, Artificial Sequence
  Description of Artificial Sequence: Synthetic oligonucleotide
caactcactggtggttgtgtgtgcttatgcag

SEQ ID NO: 287543 - DNA, 32 bp, Artificial Sequence
  Description of Artificial Sequence: Synthetic oligonucleotide
aactcactggtggttgtgtgtgcttatgcagg

SEQ ID NO: 287544 - DNA, 31 bp, Artificial Sequence
  Description of Artificial Sequence: Synthetic oligonucleotide
actcactggtggttgtgtgtgcttatgcagg

SEQ ID NO: 287545 - DNA, 30 bp, Artificial Sequence
  Description of Artificial Sequence: Synthetic oligonucleotide
ctcactggtggttgtgtgtgcttatgcagg

SEQ ID NO: 287546 - DNA, 30 bp, Artificial Sequence
  Description of Artificial Sequence: Synthetic oligonucleotide
tcactggtggttgtgtgtgcttatgcaggc

SEQ ID NO: 287547 - DNA, 29 bp, Artificial Sequence
  Description of Artificial Sequence: Synthetic oligonucleotide
cactggtggttgtgtgtgcttatgcaggc

SEQ ID NO: 287548 - DNA, 30 bp, Artificial Sequence
  Description of Artificial Sequence: Synthetic oligonucleotide
actggtggttgtgtgtgcttatgcaggcac

SEQ ID NO: 287549 - DNA, 29 bp, Artificial Sequence
  Description of Artificial Sequence: Synthetic oligonucleotide
ctggtggttgtgtgtgcttatgcaggcac

SEQ ID NO: 287550 - DNA, 30 bp, Artificial Sequence
  Description of Artificial Sequence: Synthetic oligonucleotide
tggtggttgtgtgtgcttatgcaggcactg

SEQ ID NO: 287551 - DNA, 29 bp, Artificial Sequence
  Description of Artificial Sequence: Synthetic oligonucleotide
ggtggttgtgtgtgcttatgcaggcactg

SEQ ID NO: 287552 - DNA, 29 bp, Artificial Sequence
  Description of Artificial Sequence: Synthetic oligonucleotide
gtggttgtgtgtgcttatgcaggcactgg

SEQ ID NO: 287553 - DNA, 29 bp, Artificial Sequence
  Description of Artificial Sequence: Synthetic oligonucleotide
tggttgtgtgtgcttatgcaggcactggg

SEQ ID NO: 287554 - DNA, 28 bp, Artificial Sequence
  Description of Artificial Sequence: Synthetic oligonucleotide
ggttgtgtgtgcttatgcaggcactggg

SEQ ID NO: 287555 - DNA, 31 bp, Artificial Sequence
  Description of Artificial Sequence: Synthetic oligonucleotide
gttgtgtgtgcttatgcaggcactgggaatg

SEQ ID NO: 287556 - DNA, 32 bp, Artificial Sequence
  Description of Artificial Sequence: Synthetic oligonucleotide
ttgtgtgtgcttatgcaggcactgggaatgag

SEQ ID NO: 287557 - DNA, 31 bp, Artificial Sequence
  Description of Artificial Sequence: Synthetic oligonucleotide
tgtgtgtgcttatgcaggcactgggaatgag

SEQ ID NO: 287558 - DNA, 30 bp, Artificial Sequence
  Description of Artificial Sequence: Synthetic oligonucleotide
gtgtgtgcttatgcaggcactgggaatgag

SEQ ID NO: 287559 - DNA, 30 bp, Artificial Sequence
  Description of Artificial Sequence: Synthetic oligonucleotide
tgtgtgcttatgcaggcactgggaatgagc

SEQ ID NO: 287560 - DNA, 29 bp, Artificial Sequence
  Description of Artificial Sequence: Synthetic oligonucleotide
gtgtgcttatgcaggcactgggaatgagc

SEQ ID NO: 287561 - DNA, 30 bp, Artificial Sequence
  Description of Artificial Sequence: Synthetic oligonucleotide
tgtgcttatgcaggcactgggaatgagctg

SEQ ID NO: 287562 - DNA, 29 bp, Artificial Sequence
  Description of Artificial Sequence: Synthetic oligonucleotide
gtgcttatgcaggcactgggaatgagctg

SEQ ID NO: 287563 - DNA, 31 bp, Artificial Sequence
  Description of Artificial Sequence: Synthetic oligonucleotide
tgcttatgcaggcactgggaatgagctgaag

SEQ ID NO: 287564 - DNA, 30 bp, Artificial Sequence
  Description of Artificial Sequence: Synthetic oligonucleotide
gcttatgcaggcactgggaatgagctgaag

SEQ ID NO: 287565 - DNA, 30 bp, Artificial Sequence
  Description of Artificial Sequence: Synthetic oligonucleotide
cttatgcaggcactgggaatgagctgaagg

SEQ ID NO: 287566 - DNA, 31 bp, Artificial Sequence
  Description of Artificial Sequence: Synthetic oligonucleotide
ttatgcaggcactgggaatgagctgaaggtc

SEQ ID NO: 287567 - DNA, 30 bp, Artificial Sequence
  Description of Artificial Sequence: Synthetic oligonucleotide
tatgcaggcactgggaatgagctgaaggtc

SEQ ID NO: 287568 - DNA, 29 bp, Artificial Sequence
  Description of Artificial Sequence: Synthetic oligonucleotide
atgcaggcactgggaatgagctgaaggtc

SEQ ID NO: 287569 - DNA, 28 bp, Artificial Sequence
  Description of Artificial Sequence: Synthetic oligonucleotide
tgcaggcactgggaatgagctgaaggtc

SEQ ID NO: 287570 - DNA, 27 bp, Artificial Sequence
  Description of Artificial Sequence: Synthetic oligonucleotide
gcaggcactgggaatgagctgaaggtc

SEQ ID NO: 287571 - DNA, 27 bp, Artificial Sequence
  Description of Artificial Sequence: Synthetic oligonucleotide
caggcactgggaatgagctgaaggtcc

SEQ ID NO: 287572 - DNA, 28 bp, Artificial Sequence
  Description of Artificial Sequence: Synthetic oligonucleotide
aggcactgggaatgagctgaaggtccag

SEQ ID NO: 287573 - DNA, 27 bp, Artificial Sequence
  Description of Artificial Sequence: Synthetic oligonucleotide
ggcactgggaatgagctgaaggtccag

SEQ ID NO: 287574 - DNA, 27 bp, Artificial Sequence
  Description of Artificial Sequence: Synthetic oligonucleotide
gcactgggaatgagctgaaggtccagc

SEQ ID NO: 287575 - DNA, 28 bp, Artificial Sequence
  Description of Artificial Sequence: Synthetic oligonucleotide
cactgggaatgagctgaaggtccagcag

SEQ ID NO: 287576 - DNA, 28 bp, Artificial Sequence
  Description of Artificial Sequence: Synthetic oligonucleotide
actgggaatgagctgaaggtccagcagc

SEQ ID NO: 287577 - DNA, 27 bp, Artificial Sequence
  Description of Artificial Sequence: Synthetic oligonucleotide
ctgggaatgagctgaaggtccagcagc

SEQ ID NO: 287578 - DNA, 28 bp, Artificial Sequence
  Description of Artificial Sequence: Synthetic oligonucleotide
tgggaatgagctgaaggtccagcagctg

SEQ ID NO: 287579 - DNA, 27 bp, Artificial Sequence
  Description of Artificial Sequence: Synthetic oligonucleotide
gggaatgagctgaaggtccagcagctg

SEQ ID NO: 287580 - DNA, 27 bp, Artificial Sequence
  Description of Artificial Sequence: Synthetic oligonucleotide
ggaatgagctgaaggtccagcagctgg

SEQ ID NO: 287581 - DNA, 28 bp, Artificial Sequence
  Description of Artificial Sequence: Synthetic oligonucleotide
gaatgagctgaaggtccagcagctggtc

SEQ ID NO: 287582 - DNA, 28 bp, Artificial Sequence
  Description of Artificial Sequence: Synthetic oligonucleotide
aatgagctgaaggtccagcagctggtcc

SEQ ID NO: 287583 - DNA, 27 bp, Artificial Sequence
  Description of Artificial Sequence: Synthetic oligonucleotide
atgagctgaaggtccagcagctggtcc

SEQ ID NO: 287584 - DNA, 27 bp, Artificial Sequence
  Description of Artificial Sequence: Synthetic oligonucleotide
tgagctgaaggtccagcagctggtcca

SEQ ID NO: 287585 - DNA, 26 bp, Artificial Sequence
  Description of Artificial Sequence: Synthetic oligonucleotide
gagctgaaggtccagcagctggtcca

SEQ ID NO: 287586 - DNA, 27 bp, Artificial Sequence
  Description of Artificial Sequence: Synthetic oligonucleotide
agctgaaggtccagcagctggtccaca

SEQ ID NO: 287587 - DNA, 27 bp, Artificial Sequence
  Description of Artificial Sequence: Synthetic oligonucleotide
gctgaaggtccagcagctggtccacat

SEQ ID NO: 287588 - DNA, 29 bp, Artificial Sequence
  Description of Artificial Sequence: Synthetic oligonucleotide
ctgaaggtccagcagctggtccacatttc

SEQ ID NO: 287589 - DNA, 31 bp, Artificial Sequence
  Description of Artificial Sequence: Synthetic oligonucleotide
tgaaggtccagcagctggtccacatttctag

SEQ ID NO: 287590 - DNA, 30 bp, Artificial Sequence
  Description of Artificial Sequence: Synthetic oligonucleotide
gaaggtccagcagctggtccacatttctag

SEQ ID NO: 287591 - DNA, 30 bp, Artificial Sequence
  Description of Artificial Sequence: Synthetic oligonucleotide
aaggtccagcagctggtccacatttctagc

SEQ ID NO: 287592 - DNA, 29 bp, Artificial Sequence
  Description of Artificial Sequence: Synthetic oligonucleotide
aggtccagcagctggtccacatttctagc

SEQ ID NO: 287593 - DNA, 28 bp, Artificial Sequence
  Description of Artificial Sequence: Synthetic oligonucleotide
ggtccagcagctggtccacatttctagc

SEQ ID NO: 287594 - DNA, 28 bp, Artificial Sequence
  Description of Artificial Sequence: Synthetic oligonucleotide
gtccagcagctggtccacatttctagcg

SEQ ID NO: 287595 - DNA, 30 bp, Artificial Sequence
  Description of Artificial Sequence: Synthetic oligonucleotide
tccagcagctggtccacatttctagcgaac

SEQ ID NO: 287596 - DNA, 29 bp, Artificial Sequence
  Description of Artificial Sequence: Synthetic oligonucleotide
ccagcagctggtccacatttctagcgaac

SEQ ID NO: 287597 - DNA, 30 bp, Artificial Sequence
  Description of Artificial Sequence: Synthetic oligonucleotide
cagcagctggtccacatttctagcgaacag

SEQ ID NO: 287598 - DNA, 33 bp, Artificial Sequence
  Description of Artificial Sequence: Synthetic oligonucleotide
agcagctggtccacatttctagcgaacagtttg

SEQ ID NO: 287599 - DNA, 32 bp, Artificial Sequence
  Description of Artificial Sequence: Synthetic oligonucleotide
gcagctggtccacatttctagcgaacagtttg

SEQ ID NO: 287600 - DNA, 33 bp, Artificial Sequence
  Description of Artificial Sequence: Synthetic oligonucleotide
cagctggtccacatttctagcgaacagtttgac

SEQ ID NO: 287601 - DNA, 34 bp, Artificial Sequence
  Description of Artificial Sequence: Synthetic oligonucleotide
agctggtccacatttctagcgaacagtttgactc

SEQ ID NO: 287602 - DNA, 33 bp, Artificial Sequence
  Description of Artificial Sequence: Synthetic oligonucleotide
gctggtccacatttctagcgaacagtttgactc

SEQ ID NO: 287603 - DNA, 33 bp, Artificial Sequence
  Description of Artificial Sequence: Synthetic oligonucleotide
ctggtccacatttctagcgaacagtttgactcc

SEQ ID NO: 287604 - DNA, 36 bp, Artificial Sequence
  Description of Artificial Sequence: Synthetic oligonucleotide
tggtccacatttctagcgaacagtttgactcctaag

SEQ ID NO: 287605 - DNA, 35 bp, Artificial Sequence
  Description of Artificial Sequence: Synthetic oligonucleotide
ggtccacatttctagcgaacagtttgactcctaag

SEQ ID NO: 287606 - DNA, 36 bp, Artificial Sequence
  Description of Artificial Sequence: Synthetic oligonucleotide
gtccacatttctagcgaacagtttgactcctaagag

SEQ ID NO: 287607 - DNA, 38 bp, Artificial Sequence
  Description of Artificial Sequence: Synthetic oligonucleotide
tccacatttctagcgaacagtttgactcctaagagaag

SEQ ID NO: 287608 - DNA, 37 bp, Artificial Sequence
  Description of Artificial Sequence: Synthetic oligonucleotide
ccacatttctagcgaacagtttgactcctaagagaag

SEQ ID NO: 287609 - DNA, 37 bp, Artificial Sequence
  Description of Artificial Sequence: Synthetic oligonucleotide
cacatttctagcgaacagtttgactcctaagagaagg

SEQ ID NO: 287610 - DNA, 38 bp, Artificial Sequence
  Description of Artificial Sequence: Synthetic oligonucleotide
acatttctagcgaacagtttgactcctaagagaaggtg

SEQ ID NO: 287611 - DNA, 37 bp, Artificial Sequence
  Description of Artificial Sequence: Synthetic oligonucleotide
catttctagcgaacagtttgactcctaagagaaggtg

SEQ ID NO: 287612 - DNA, 37 bp, Artificial Sequence
  Description of Artificial Sequence: Synthetic oligonucleotide
atttctagcgaacagtttgactcctaagagaaggtgg

SEQ ID NO: 287613 - DNA, 36 bp, Artificial Sequence
  Description of Artificial Sequence: Synthetic oligonucleotide
tttctagcgaacagtttgactcctaagagaaggtgg

SEQ ID NO: 287614 - DNA, 35 bp, Artificial Sequence
  Description of Artificial Sequence: Synthetic oligonucleotide
ttctagcgaacagtttgactcctaagagaaggtgg

SEQ ID NO: 287615 - DNA, 34 bp, Artificial Sequence
  Description of Artificial Sequence: Synthetic oligonucleotide
tctagcgaacagtttgactcctaagagaaggtgg

SEQ ID NO: 287616 - DNA, 33 bp, Artificial Sequence
  Description of Artificial Sequence: Synthetic oligonucleotide
ctagcgaacagtttgactcctaagagaaggtgg

SEQ ID NO: 287617 - DNA, 35 bp, Artificial Sequence
  Description of Artificial Sequence: Synthetic oligonucleotide
tagcgaacagtttgactcctaagagaaggtggaag

SEQ ID NO: 287618 - DNA, 34 bp, Artificial Sequence
  Description of Artificial Sequence: Synthetic oligonucleotide
agcgaacagtttgactcctaagagaaggtggaag

SEQ ID NO: 287619 - DNA, 33 bp, Artificial Sequence
  Description of Artificial Sequence: Synthetic oligonucleotide
gcgaacagtttgactcctaagagaaggtggaag

SEQ ID NO: 287620 - DNA, 34 bp, Artificial Sequence
  Description of Artificial Sequence: Synthetic oligonucleotide
cgaacagtttgactcctaagagaaggtggaagac

SEQ ID NO: 287621 - DNA, 37 bp, Artificial Sequence
  Description of Artificial Sequence: Synthetic oligonucleotide
gaacagtttgactcctaagagaaggtggaagacaatg

SEQ ID NO: 287622 - DNA, 38 bp, Artificial Sequence
  Description of Artificial Sequence: Synthetic oligonucleotide
aacagtttgactcctaagagaaggtggaagacaatgac

SEQ ID NO: 287623 - DNA, 37 bp, Artificial Sequence
  Description of Artificial Sequence: Synthetic oligonucleotide
acagtttgactcctaagagaaggtggaagacaatgac

SEQ ID NO: 287624 - DNA, 36 bp, Artificial Sequence
  Description of Artificial Sequence: Synthetic oligonucleotide
cagtttgactcctaagagaaggtggaagacaatgac

SEQ ID NO: 287625 - DNA, 38 bp, Artificial Sequence
  Description of Artificial Sequence: Synthetic oligonucleotide
agtttgactcctaagagaaggtggaagacaatgacaag

SEQ ID NO: 287626 - DNA, 37 bp, Artificial Sequence
  Description of Artificial Sequence: Synthetic oligonucleotide
gtttgactcctaagagaaggtggaagacaatgacaag

SEQ ID NO: 287627 - DNA, 39 bp, Artificial Sequence
  Description of Artificial Sequence: Synthetic oligonucleotide
tttgactcctaagagaaggtggaagacaatgacaagaag

SEQ ID NO: 287628 - DNA, 38 bp, Artificial Sequence
  Description of Artificial Sequence: Synthetic oligonucleotide
ttgactcctaagagaaggtggaagacaatgacaagaag

SEQ ID NO: 287629 - DNA, 37 bp, Artificial Sequence
  Description of Artificial Sequence: Synthetic oligonucleotide
tgactcctaagagaaggtggaagacaatgacaagaag

SEQ ID NO: 287630 - DNA, 36 bp, Artificial Sequence
  Description of Artificial Sequence: Synthetic oligonucleotide
gactcctaagagaaggtggaagacaatgacaagaag

SEQ ID NO: 287631 - DNA, 36 bp, Artificial Sequence
  Description of Artificial Sequence: Synthetic oligonucleotide
actcctaagagaaggtggaagacaatgacaagaagc

SEQ ID NO: 287632 - DNA, 35 bp, Artificial Sequence
  Description of Artificial Sequence: Synthetic oligonucleotide
ctcctaagagaaggtggaagacaatgacaagaagc

SEQ ID NO: 287633 - DNA, 39 bp, Artificial Sequence
  Description of Artificial Sequence: Synthetic oligonucleotide
tcctaagagaaggtggaagacaatgacaagaagcaaaag

SEQ ID NO: 287634 - DNA, 38 bp, Artificial Sequence
  Description of Artificial Sequence: Synthetic oligonucleotide
cctaagagaaggtggaagacaatgacaagaagcaaaag

SEQ ID NO: 287635 - DNA, 41 bp, Artificial Sequence
  Description of Artificial Sequence: Synthetic oligonucleotide
ctaagagaaggtggaagacaatgacaagaagcaaaagaaag

SEQ ID NO: 287636 - DNA, 42 bp, Artificial Sequence
  Description of Artificial Sequence: Synthetic oligonucleotide
taagagaaggtggaagacaatgacaagaagcaaaagaaagtc

SEQ ID NO: 287637 - DNA, 41 bp, Artificial Sequence
  Description of Artificial Sequence: Synthetic oligonucleotide
aagagaaggtggaagacaatgacaagaagcaaaagaaagtc

SEQ ID NO: 287638 - DNA, 40 bp, Artificial Sequence
  Description of Artificial Sequence: Synthetic oligonucleotide
agagaaggtggaagacaatgacaagaagcaaaagaaagtc

SEQ ID NO: 287639 - DNA, 39 bp, Artificial Sequence
  Description of Artificial Sequence: Synthetic oligonucleotide
gagaaggtggaagacaatgacaagaagcaaaagaaagtc

SEQ ID NO: 287640 - DNA, 41 bp, Artificial Sequence
  Description of Artificial Sequence: Synthetic oligonucleotide
agaaggtggaagacaatgacaagaagcaaaagaaagtcaag

SEQ ID NO: 287641 - DNA, 40 bp, Artificial Sequence
  Description of Artificial Sequence: Synthetic oligonucleotide
gaaggtggaagacaatgacaagaagcaaaagaaagtcaag

SEQ ID NO: 287642 - DNA, 40 bp, Artificial Sequence
  Description of Artificial Sequence: Synthetic oligonucleotide
aaggtggaagacaatgacaagaagcaaaagaaagtcaagg

SEQ ID NO: 287643 - DNA, 39 bp, Artificial Sequence
  Description of Artificial Sequence: Synthetic oligonucleotide
aggtggaagacaatgacaagaagcaaaagaaagtcaagg

SEQ ID NO: 287644 - DNA, 38 bp, Artificial Sequence
  Description of Artificial Sequence: Synthetic oligonucleotide
ggtggaagacaatgacaagaagcaaaagaaagtcaagg

SEQ ID NO: 287645 - DNA, 39 bp, Artificial Sequence
  Description of Artificial Sequence: Synthetic oligonucleotide
gtggaagacaatgacaagaagcaaaagaaagtcaaggac

SEQ ID NO: 287646 - DNA, 41 bp, Artificial Sequence
  Description of Artificial Sequence: Synthetic oligonucleotide
tggaagacaatgacaagaagcaaaagaaagtcaaggacaac

SEQ ID NO: 287647 - DNA, 40 bp, Artificial Sequence
  Description of Artificial Sequence: Synthetic oligonucleotide
ggaagacaatgacaagaagcaaaagaaagtcaaggacaac

SEQ ID NO: 287648 - DNA, 42 bp, Artificial Sequence
  Description of Artificial Sequence: Synthetic oligonucleotide
gaagacaatgacaagaagcaaaagaaagtcaaggacaacaag

SEQ ID NO: 287649 - DNA, 42 bp, Artificial Sequence
  Description of Artificial Sequence: Synthetic oligonucleotide
aagacaatgacaagaagcaaaagaaagtcaaggacaacaagg

SEQ ID NO: 287650 - DNA, 41 bp, Artificial Sequence
  Description of Artificial Sequence: Synthetic oligonucleotide
agacaatgacaagaagcaaaagaaagtcaaggacaacaagg

SEQ ID NO: 287651 - DNA, 40 bp, Artificial Sequence
  Description of Artificial Sequence: Synthetic oligonucleotide
gacaatgacaagaagcaaaagaaagtcaaggacaacaagg

SEQ ID NO: 287652 - DNA, 42 bp, Artificial Sequence
  Description of Artificial Sequence: Synthetic oligonucleotide
acaatgacaagaagcaaaagaaagtcaaggacaacaaggaag

SEQ ID NO: 287653 - DNA, 41 bp, Artificial Sequence
  Description of Artificial Sequence: Synthetic oligonucleotide
caatgacaagaagcaaaagaaagtcaaggacaacaaggaag

SEQ ID NO: 287654 - DNA, 41 bp, Artificial Sequence
  Description of Artificial Sequence: Synthetic oligonucleotide
aatgacaagaagcaaaagaaagtcaaggacaacaaggaagc

SEQ ID NO: 287655 - DNA, 40 bp, Artificial Sequence
  Description of Artificial Sequence: Synthetic oligonucleotide
atgacaagaagcaaaagaaagtcaaggacaacaaggaagc

SEQ ID NO: 287656 - DNA, 39 bp, Artificial Sequence
  Description of Artificial Sequence: Synthetic oligonucleotide
tgacaagaagcaaaagaaagtcaaggacaacaaggaagc

SEQ ID NO: 287657 - DNA, 38 bp, Artificial Sequence
  Description of Artificial Sequence: Synthetic oligonucleotide
gacaagaagcaaaagaaagtcaaggacaacaaggaagc

SEQ ID NO: 287658 - DNA, 38 bp, Artificial Sequence
  Description of Artificial Sequence: Synthetic oligonucleotide
acaagaagcaaaagaaagtcaaggacaacaaggaagcc

SEQ ID NO: 287659 - DNA, 37 bp, Artificial Sequence
  Description of Artificial Sequence: Synthetic oligonucleotide
caagaagcaaaagaaagtcaaggacaacaaggaagcc

SEQ ID NO: 287660 - DNA, 37 bp, Artificial Sequence
  Description of Artificial Sequence: Synthetic oligonucleotide
aagaagcaaaagaaagtcaaggacaacaaggaagccg

SEQ ID NO: 287661 - DNA, 36 bp, Artificial Sequence
  Description of Artificial Sequence: Synthetic oligonucleotide
agaagcaaaagaaagtcaaggacaacaaggaagccg

SEQ ID NO: 287662 - DNA, 35 bp, Artificial Sequence
  Description of Artificial Sequence: Synthetic oligonucleotide
gaagcaaaagaaagtcaaggacaacaaggaagccg

SEQ ID NO: 287663 - DNA, 35 bp, Artificial Sequence
  Description of Artificial Sequence: Synthetic oligonucleotide
aagcaaaagaaagtcaaggacaacaaggaagccgc

SEQ ID NO: 287664 - DNA, 34 bp, Artificial Sequence
  Description of Artificial Sequence: Synthetic oligonucleotide
agcaaaagaaagtcaaggacaacaaggaagccgc

SEQ ID NO: 287665 - DNA, 33 bp, Artificial Sequence
  Description of Artificial Sequence: Synthetic oligonucleotide
gcaaaagaaagtcaaggacaacaaggaagccgc

SEQ ID NO: 287666 - DNA, 34 bp, Artificial Sequence
  Description of Artificial Sequence: Synthetic oligonucleotide
caaaagaaagtcaaggacaacaaggaagccgctg

SEQ ID NO: 287667 - DNA, 34 bp, Artificial Sequence
  Description of Artificial Sequence: Synthetic oligonucleotide
aaaagaaagtcaaggacaacaaggaagccgctgc

SEQ ID NO: 287668 - DNA, 33 bp, Artificial Sequence
  Description of Artificial Sequence: Synthetic oligonucleotide
aaagaaagtcaaggacaacaaggaagccgctgc

SEQ ID NO: 287669 - DNA, 32 bp, Artificial Sequence
  Description of Artificial Sequence: Synthetic oligonucleotide
aagaaagtcaaggacaacaaggaagccgctgc

SEQ ID NO: 287670 - DNA, 31 bp, Artificial Sequence
  Description of Artificial Sequence: Synthetic oligonucleotide
agaaagtcaaggacaacaaggaagccgctgc

SEQ ID NO: 287671 - DNA, 30 bp, Artificial Sequence
  Description of Artificial Sequence: Synthetic oligonucleotide
gaaagtcaaggacaacaaggaagccgctgc

SEQ ID NO: 287672 - DNA, 31 bp, Artificial Sequence
  Description of Artificial Sequence: Synthetic oligonucleotide
aaagtcaaggacaacaaggaagccgctgctg

SEQ ID NO: 287673 - DNA, 30 bp, Artificial Sequence
  Description of Artificial Sequence: Synthetic oligonucleotide
aagtcaaggacaacaaggaagccgctgctg

SEQ ID NO: 287674 - DNA, 29 bp, Artificial Sequence
  Description of Artificial Sequence: Synthetic oligonucleotide
agtcaaggacaacaaggaagccgctgctg

SEQ ID NO: 287675 - DNA, 28 bp, Artificial Sequence
  Description of Artificial Sequence: Synthetic oligonucleotide
gtcaaggacaacaaggaagccgctgctg

SEQ ID NO: 287676 - DNA, 29 bp, Artificial Sequence
  Description of Artificial Sequence: Synthetic oligonucleotide
tcaaggacaacaaggaagccgctgctgac

SEQ ID NO: 287677 - DNA, 28 bp, Artificial Sequence
  Description of Artificial Sequence: Synthetic oligonucleotide
caaggacaacaaggaagccgctgctgac

SEQ ID NO: 287678 - DNA, 30 bp, Artificial Sequence
  Description of Artificial Sequence: Synthetic oligonucleotide
aaggacaacaaggaagccgctgctgacaag

SEQ ID NO: 287679 - DNA, 29 bp, Artificial Sequence
  Description of Artificial Sequence: Synthetic oligonucleotide
aggacaacaaggaagccgctgctgacaag

SEQ ID NO: 287680 - DNA, 28 bp, Artificial Sequence
  Description of Artificial Sequence: Synthetic oligonucleotide
ggacaacaaggaagccgctgctgacaag

SEQ ID NO: 287681 - DNA, 28 bp, Artificial Sequence
  Description of Artificial Sequence: Synthetic oligonucleotide
gacaacaaggaagccgctgctgacaagg

SEQ ID NO: 287682 - DNA, 28 bp, Artificial Sequence
  Description of Artificial Sequence: Synthetic oligonucleotide
acaacaaggaagccgctgctgacaaggg

SEQ ID NO: 287683 - DNA, 27 bp, Artificial Sequence
  Description of Artificial Sequence: Synthetic oligonucleotide
caacaaggaagccgctgctgacaaggg

SEQ ID NO: 287684 - DNA, 28 bp, Artificial Sequence
  Description of Artificial Sequence: Synthetic oligonucleotide
aacaaggaagccgctgctgacaagggag

SEQ ID NO: 287685 - DNA, 27 bp, Artificial Sequence
  Description of Artificial Sequence: Synthetic oligonucleotide
acaaggaagccgctgctgacaagggag

SEQ ID NO: 287686 - DNA, 26 bp, Artificial Sequence
  Description of Artificial Sequence: Synthetic oligonucleotide
caaggaagccgctgctgacaagggag

SEQ ID NO: 287687 - DNA, 27 bp, Artificial Sequence
  Description of Artificial Sequence: Synthetic oligonucleotide
aaggaagccgctgctgacaagggagca

SEQ ID NO: 287688 - DNA, 26 bp, Artificial Sequence
  Description of Artificial Sequence: Synthetic oligonucleotide
aggaagccgctgctgacaagggagca

SEQ ID NO: 287689 - DNA, 25 bp, Artificial Sequence
  Description of Artificial Sequence: Synthetic oligonucleotide
ggaagccgctgctgacaagggagca

SEQ ID NO: 287690 - DNA, 27 bp, Artificial Sequence
  Description of Artificial Sequence: Synthetic oligonucleotide
gaagccgctgctgacaagggagcacaa

SEQ ID NO: 287691 - DNA, 27 bp, Artificial Sequence
  Description of Artificial Sequence: Synthetic oligonucleotide
aagccgctgctgacaagggagcacaac

SEQ ID NO: 287692 - DNA, 27 bp, Artificial Sequence
  Description of Artificial Sequence: Synthetic oligonucleotide
agccgctgctgacaagggagcacaaca

SEQ ID NO: 287693 - DNA, 26 bp, Artificial Sequence
  Description of Artificial Sequence: Synthetic oligonucleotide
gccgctgctgacaagggagcacaaca

SEQ ID NO: 287694 - DNA, 26 bp, Artificial Sequence
  Description of Artificial Sequence: Synthetic oligonucleotide
ccgctgctgacaagggagcacaacag

SEQ ID NO: 287695 - DNA, 26 bp, Artificial Sequence
  Description of Artificial Sequence: Synthetic oligonucleotide
cgctgctgacaagggagcacaacagg

SEQ ID NO: 287696 - DNA, 27 bp, Artificial Sequence
  Description of Artificial Sequence: Synthetic oligonucleotide
gctgctgacaagggagcacaacaggga

SEQ ID NO: 287697 - DNA, 27 bp, Artificial Sequence
  Description of Artificial Sequence: Synthetic oligonucleotide
ctgctgacaagggagcacaacagggag

SEQ ID NO: 287698 - DNA, 28 bp, Artificial Sequence
  Description of Artificial Sequence: Synthetic oligonucleotide
tgctgacaagggagcacaacagggagtg

SEQ ID NO: 287699 - DNA, 27 bp, Artificial Sequence
  Description of Artificial Sequence: Synthetic oligonucleotide
gctgacaagggagcacaacagggagtg

SEQ ID NO: 287700 - DNA, 27 bp, Artificial Sequence
  Description of Artificial Sequence: Synthetic oligonucleotide
ctgacaagggagcacaacagggagtgc

SEQ ID NO: 287701 - DNA, 27 bp, Artificial Sequence
  Description of Artificial Sequence: Synthetic oligonucleotide
tgacaagggagcacaacagggagtgcc

SEQ ID NO: 287702 - DNA, 27 bp, Artificial Sequence
  Description of Artificial Sequence: Synthetic oligonucleotide
gacaagggagcacaacagggagtgcct

SEQ ID NO: 287703 - DNA, 27 bp, Artificial Sequence
  Description of Artificial Sequence: Synthetic oligonucleotide
acaagggagcacaacagggagtgcctg

SEQ ID NO: 287704 - DNA, 27 bp, Artificial Sequence
  Description of Artificial Sequence: Synthetic oligonucleotide
caagggagcacaacagggagtgcctgt

SEQ ID NO: 287705 - DNA, 28 bp, Artificial Sequence
  Description of Artificial Sequence: Synthetic oligonucleotide
aagggagcacaacagggagtgcctgttc

SEQ ID NO: 287706 - DNA, 27 bp, Artificial Sequence
  Description of Artificial Sequence: Synthetic oligonucleotide
agggagcacaacagggagtgcctgttc

SEQ ID NO: 287707 - DNA, 27 bp, Artificial Sequence
  Description of Artificial Sequence: Synthetic oligonucleotide
gggagcacaacagggagtgcctgttct

SEQ ID NO: 287708 - DNA, 27 bp, Artificial Sequence
  Description of Artificial Sequence: Synthetic oligonucleotide
ggagcacaacagggagtgcctgttctg

SEQ ID NO: 287709 - DNA, 27 bp, Artificial Sequence
  Description of Artificial Sequence: Synthetic oligonucleotide
gagcacaacagggagtgcctgttctgg

SEQ ID NO: 287710 - DNA, 27 bp, Artificial Sequence
  Description of Artificial Sequence: Synthetic oligonucleotide
agcacaacagggagtgcctgttctggc

SEQ ID NO: 287711 - DNA, 26 bp, Artificial Sequence
  Description of Artificial Sequence: Synthetic oligonucleotide
gcacaacagggagtgcctgttctggc

SEQ ID NO: 287712 - DNA, 27 bp, Artificial Sequence
  Description of Artificial Sequence: Synthetic oligonucleotide
cacaacagggagtgcctgttctggcga

SEQ ID NO: 287713 - DNA, 29 bp, Artificial Sequence
  Description of Artificial Sequence: Synthetic oligonucleotide
acaacagggagtgcctgttctggcgattg

SEQ ID NO: 287714 - DNA, 28 bp, Artificial Sequence
  Description of Artificial Sequence: Synthetic oligonucleotide
caacagggagtgcctgttctggcgattg

SEQ ID NO: 287715 - DNA, 28 bp, Artificial Sequence
  Description of Artificial Sequence: Synthetic oligonucleotide
aacagggagtgcctgttctggcgattgc

SEQ ID NO: 287716 - DNA, 27 bp, Artificial Sequence
  Description of Artificial Sequence: Synthetic oligonucleotide
acagggagtgcctgttctggcgattgc

SEQ ID NO: 287717 - DNA, 26 bp, Artificial Sequence
  Description of Artificial Sequence: Synthetic oligonucleotide
cagggagtgcctgttctggcgattgc

SEQ ID NO: 287718 - DNA, 26 bp, Artificial Sequence
  Description of Artificial Sequence: Synthetic oligonucleotide
agggagtgcctgttctggcgattgcc

SEQ ID NO: 287719 - DNA, 25 bp, Artificial Sequence
  Description of Artificial Sequence: Synthetic oligonucleotide
gggagtgcctgttctggcgattgcc

SEQ ID NO: 287720 - DNA, 27 bp, Artificial Sequence
  Description of Artificial Sequence: Synthetic oligonucleotide
ggagtgcctgttctggcgattgcccta

SEQ ID NO: 287721 - DNA, 30 bp, Artificial Sequence
  Description of Artificial Sequence: Synthetic oligonucleotide
gagtgcctgttctggcgattgccctaattg

SEQ ID NO: 287722 - DNA, 30 bp, Artificial Sequence
  Description of Artificial Sequence: Synthetic oligonucleotide
agtgcctgttctggcgattgccctaattgc

SEQ ID NO: 287723 - DNA, 29 bp, Artificial Sequence
  Description of Artificial Sequence: Synthetic oligonucleotide
gtgcctgttctggcgattgccctaattgc

SEQ ID NO: 287724 - DNA, 32 bp, Artificial Sequence
  Description of Artificial Sequence: Synthetic oligonucleotide
tgcctgttctggcgattgccctaattgctatg

SEQ ID NO: 287725 - DNA, 31 bp, Artificial Sequence
  Description of Artificial Sequence: Synthetic oligonucleotide
gcctgttctggcgattgccctaattgctatg

SEQ ID NO: 287726 - DNA, 31 bp, Artificial Sequence
  Description of Artificial Sequence: Synthetic oligonucleotide
cctgttctggcgattgccctaattgctatgc

SEQ ID NO: 287727 - DNA, 31 bp, Artificial Sequence
  Description of Artificial Sequence: Synthetic oligonucleotide
ctgttctggcgattgccctaattgctatgcg

SEQ ID NO: 287728 - DNA, 31 bp, Artificial Sequence
  Description of Artificial Sequence: Synthetic oligonucleotide
tgttctggcgattgccctaattgctatgcgg

SEQ ID NO: 287729 - DNA, 30 bp, Artificial Sequence
  Description of Artificial Sequence: Synthetic oligonucleotide
gttctggcgattgccctaattgctatgcgg

SEQ ID NO: 287730 - DNA, 30 bp, Artificial Sequence
  Description of Artificial Sequence: Synthetic oligonucleotide
ttctggcgattgccctaattgctatgcggg

SEQ ID NO: 287731 - DNA, 29 bp, Artificial Sequence
  Description of Artificial Sequence: Synthetic oligonucleotide
tctggcgattgccctaattgctatgcggg

SEQ ID NO: 287732 - DNA, 28 bp, Artificial Sequence
  Description of Artificial Sequence: Synthetic oligonucleotide
ctggcgattgccctaattgctatgcggg

SEQ ID NO: 287733 - DNA, 29 bp, Artificial Sequence
  Description of Artificial Sequence: Synthetic oligonucleotide
tggcgattgccctaattgctatgcgggag

SEQ ID NO: 287734 - DNA, 28 bp, Artificial Sequence
  Description of Artificial Sequence: Synthetic oligonucleotide
ggcgattgccctaattgctatgcgggag

SEQ ID NO: 287735 - DNA, 28 bp, Artificial Sequence
  Description of Artificial Sequence: Synthetic oligonucleotide
gcgattgccctaattgctatgcgggagg

SEQ ID NO: 287736 - DNA, 29 bp, Artificial Sequence
  Description of Artificial Sequence: Synthetic oligonucleotide
cgattgccctaattgctatgcgggaggag

SEQ ID NO: 287737 - DNA, 32 bp, Artificial Sequence
  Description of Artificial Sequence: Synthetic oligonucleotide
gattgccctaattgctatgcgggaggagaatg

SEQ ID NO: 287738 - DNA, 32 bp, Artificial Sequence
  Description of Artificial Sequence: Synthetic oligonucleotide
attgccctaattgctatgcgggaggagaatgg

SEQ ID NO: 287739 - DNA, 31 bp, Artificial Sequence
  Description of Artificial Sequence: Synthetic oligonucleotide
ttgccctaattgctatgcgggaggagaatgg

SEQ ID NO: 287740 - DNA, 30 bp, Artificial Sequence
  Description of Artificial Sequence: Synthetic oligonucleotide
tgccctaattgctatgcgggaggagaatgg

SEQ ID NO: 287741 - DNA, 29 bp, Artificial Sequence
  Description of Artificial Sequence: Synthetic oligonucleotide
gccctaattgctatgcgggaggagaatgg

SEQ ID NO: 287742 - DNA, 30 bp, Artificial Sequence
  Description of Artificial Sequence: Synthetic oligonucleotide
ccctaattgctatgcgggaggagaatggtg

SEQ ID NO: 287743 - DNA, 30 bp, Artificial Sequence
  Description of Artificial Sequence: Synthetic oligonucleotide
cctaattgctatgcgggaggagaatggtgc

SEQ ID NO: 287744 - DNA, 31 bp, Artificial Sequence
  Description of Artificial Sequence: Synthetic oligonucleotide
ctaattgctatgcgggaggagaatggtgcag

SEQ ID NO: 287745 - DNA, 32 bp, Artificial Sequence
  Description of Artificial Sequence: Synthetic oligonucleotide
taattgctatgcgggaggagaatggtgcagac

SEQ ID NO: 287746 - DNA, 31 bp, Artificial Sequence
  Description of Artificial Sequence: Synthetic oligonucleotide
aattgctatgcgggaggagaatggtgcagac

SEQ ID NO: 287747 - DNA, 30 bp, Artificial Sequence
  Description of Artificial Sequence: Synthetic oligonucleotide
attgctatgcgggaggagaatggtgcagac

SEQ ID NO: 287748 - DNA, 29 bp, Artificial Sequence
  Description of Artificial Sequence: Synthetic oligonucleotide
ttgctatgcgggaggagaatggtgcagac

SEQ ID NO: 287749 - DNA, 28 bp, Artificial Sequence
  Description of Artificial Sequence: Synthetic oligonucleotide
tgctatgcgggaggagaatggtgcagac

SEQ ID NO: 287750 - DNA, 27 bp, Artificial Sequence
  Description of Artificial Sequence: Synthetic oligonucleotide
gctatgcgggaggagaatggtgcagac

SEQ ID NO: 287751 - DNA, 29 bp, Artificial Sequence
  Description of Artificial Sequence: Synthetic oligonucleotide
ctatgcgggaggagaatggtgcagacatg

SEQ ID NO: 287752 - DNA, 29 bp, Artificial Sequence
  Description of Artificial Sequence: Synthetic oligonucleotide
tatgcgggaggagaatggtgcagacatgg

SEQ ID NO: 287753 - DNA, 28 bp, Artificial Sequence
  Description of Artificial Sequence: Synthetic oligonucleotide
atgcgggaggagaatggtgcagacatgg

SEQ ID NO: 287754 - DNA, 27 bp, Artificial Sequence
  Description of Artificial Sequence: Synthetic oligonucleotide
tgcgggaggagaatggtgcagacatgg

SEQ ID NO: 287755 - DNA, 26 bp, Artificial Sequence
  Description of Artificial Sequence: Synthetic oligonucleotide
gcgggaggagaatggtgcagacatgg

SEQ ID NO: 287756 - DNA, 27 bp, Artificial Sequence
  Description of Artificial Sequence: Synthetic oligonucleotide
cgggaggagaatggtgcagacatggca

SEQ ID NO: 287757 - DNA, 30 bp, Artificial Sequence
  Description of Artificial Sequence: Synthetic oligonucleotide
gggaggagaatggtgcagacatggcattag

SEQ ID NO: 287758 - DNA, 30 bp, Artificial Sequence
  Description of Artificial Sequence: Synthetic oligonucleotide
ggaggagaatggtgcagacatggcattagg

SEQ ID NO: 287759 - DNA, 32 bp, Artificial Sequence
  Description of Artificial Sequence: Synthetic oligonucleotide
gaggagaatggtgcagacatggcattaggaac

SEQ ID NO: 287760 - DNA, 32 bp, Artificial Sequence
  Description of Artificial Sequence: Synthetic oligonucleotide
aggagaatggtgcagacatggcattaggaacc

SEQ ID NO: 287761 - DNA, 31 bp, Artificial Sequence
  Description of Artificial Sequence: Synthetic oligonucleotide
ggagaatggtgcagacatggcattaggaacc

SEQ ID NO: 287762 - DNA, 34 bp, Artificial Sequence
  Description of Artificial Sequence: Synthetic oligonucleotide
gagaatggtgcagacatggcattaggaacctttg

SEQ ID NO: 287763 - DNA, 34 bp, Artificial Sequence
  Description of Artificial Sequence: Synthetic oligonucleotide
agaatggtgcagacatggcattaggaacctttgc

SEQ ID NO: 287764 - DNA, 33 bp, Artificial Sequence
  Description of Artificial Sequence: Synthetic oligonucleotide
gaatggtgcagacatggcattaggaacctttgc

SEQ ID NO: 287765 - DNA, 33 bp, Artificial Sequence
  Description of Artificial Sequence: Synthetic oligonucleotide
aatggtgcagacatggcattaggaacctttgcc

SEQ ID NO: 287766 - DNA, 32 bp, Artificial Sequence
  Description of Artificial Sequence: Synthetic oligonucleotide
atggtgcagacatggcattaggaacctttgcc

SEQ ID NO: 287767 - DNA, 31 bp, Artificial Sequence
  Description of Artificial Sequence: Synthetic oligonucleotide
tggtgcagacatggcattaggaacctttgcc

SEQ ID NO: 287768 - DNA, 30 bp, Artificial Sequence
  Description of Artificial Sequence: Synthetic oligonucleotide
ggtgcagacatggcattaggaacctttgcc

SEQ ID NO: 287769 - DNA, 30 bp, Artificial Sequence
  Description of Artificial Sequence: Synthetic oligonucleotide
gtgcagacatggcattaggaacctttgccc

SEQ ID NO: 287770 - DNA, 31 bp, Artificial Sequence
  Description of Artificial Sequence: Synthetic oligonucleotide
tgcagacatggcattaggaacctttgcccac

SEQ ID NO: 287771 - DNA, 30 bp, Artificial Sequence
  Description of Artificial Sequence: Synthetic oligonucleotide
gcagacatggcattaggaacctttgcccac

SEQ ID NO: 287772 - DNA, 32 bp, Artificial Sequence
  Description of Artificial Sequence: Synthetic oligonucleotide
cagacatggcattaggaacctttgcccacttg

SEQ ID NO: 287773 - DNA, 32 bp, Artificial Sequence
  Description of Artificial Sequence: Synthetic oligonucleotide
agacatggcattaggaacctttgcccacttgc

SEQ ID NO: 287774 - DNA, 31 bp, Artificial Sequence
  Description of Artificial Sequence: Synthetic oligonucleotide
gacatggcattaggaacctttgcccacttgc

SEQ ID NO: 287775 - DNA, 32 bp, Artificial Sequence
  Description of Artificial Sequence: Synthetic oligonucleotide
acatggcattaggaacctttgcccacttgctc

SEQ ID NO: 287776 - DNA, 31 bp, Artificial Sequence
  Description of Artificial Sequence: Synthetic oligonucleotide
catggcattaggaacctttgcccacttgctc

SEQ ID NO: 287777 - DNA, 32 bp, Artificial Sequence
  Description of Artificial Sequence: Synthetic oligonucleotide
atggcattaggaacctttgcccacttgctcag

SEQ ID NO: 287778 - DNA, 31 bp, Artificial Sequence
  Description of Artificial Sequence: Synthetic oligonucleotide
tggcattaggaacctttgcccacttgctcag

SEQ ID NO: 287779 - DNA, 30 bp, Artificial Sequence
  Description of Artificial Sequence: Synthetic oligonucleotide
ggcattaggaacctttgcccacttgctcag

SEQ ID NO: 287780 - DNA, 34 bp, Artificial Sequence
  Description of Artificial Sequence: Synthetic oligonucleotide
gcattaggaacctttgcccacttgctcagatatg

SEQ ID NO: 287781 - DNA, 34 bp, Artificial Sequence
  Description of Artificial Sequence: Synthetic oligonucleotide
cattaggaacctttgcccacttgctcagatatgg

SEQ ID NO: 287782 - DNA, 34 bp, Artificial Sequence
  Description of Artificial Sequence: Synthetic oligonucleotide
attaggaacctttgcccacttgctcagatatggg

SEQ ID NO: 287783 - DNA, 33 bp, Artificial Sequence
  Description of Artificial Sequence: Synthetic oligonucleotide
ttaggaacctttgcccacttgctcagatatggg

SEQ ID NO: 287784 - DNA, 32 bp, Artificial Sequence
  Description of Artificial Sequence: Synthetic oligonucleotide
taggaacctttgcccacttgctcagatatggg

SEQ ID NO: 287785 - DNA, 31 bp, Artificial Sequence
  Description of Artificial Sequence: Synthetic oligonucleotide
aggaacctttgcccacttgctcagatatggg

SEQ ID NO: 287786 - DNA, 30 bp, Artificial Sequence
  Description of Artificial Sequence: Synthetic oligonucleotide
ggaacctttgcccacttgctcagatatggg

SEQ ID NO: 287787 - DNA, 30 bp, Artificial Sequence
  Description of Artificial Sequence: Synthetic oligonucleotide
gaacctttgcccacttgctcagatatgggc

SEQ ID NO: 287788 - DNA, 31 bp, Artificial Sequence
  Description of Artificial Sequence: Synthetic oligonucleotide
aacctttgcccacttgctcagatatgggcag

SEQ ID NO: 287789 - DNA, 30 bp, Artificial Sequence
  Description of Artificial Sequence: Synthetic oligonucleotide
acctttgcccacttgctcagatatgggcag

SEQ ID NO: 287790 - DNA, 29 bp, Artificial Sequence
  Description of Artificial Sequence: Synthetic oligonucleotide
cctttgcccacttgctcagatatgggcag

SEQ ID NO: 287791 - DNA, 29 bp, Artificial Sequence
  Description of Artificial Sequence: Synthetic oligonucleotide
ctttgcccacttgctcagatatgggcagc

SEQ ID NO: 287792 - DNA, 29 bp, Artificial Sequence
  Description of Artificial Sequence: Synthetic oligonucleotide
tttgcccacttgctcagatatgggcagcc

SEQ ID NO: 287793 - DNA, 28 bp, Artificial Sequence
  Description of Artificial Sequence: Synthetic oligonucleotide
ttgcccacttgctcagatatgggcagcc

SEQ ID NO: 287794 - DNA, 27 bp, Artificial Sequence
  Description of Artificial Sequence: Synthetic oligonucleotide
tgcccacttgctcagatatgggcagcc

SEQ ID NO: 287795 - DNA, 27 bp, Artificial Sequence
  Description of Artificial Sequence: Synthetic oligonucleotide
gcccacttgctcagatatgggcagcct

SEQ ID NO: 287796 - DNA, 28 bp, Artificial Sequence
  Description of Artificial Sequence: Synthetic oligonucleotide
cccacttgctcagatatgggcagcctac

SEQ ID NO: 287797 - DNA, 29 bp, Artificial Sequence
  Description of Artificial Sequence: Synthetic oligonucleotide
ccacttgctcagatatgggcagcctacac

SEQ ID NO: 287798 - DNA, 30 bp, Artificial Sequence
  Description of Artificial Sequence: Synthetic oligonucleotide
cacttgctcagatatgggcagcctacacac

SEQ ID NO: 287799 - DNA, 30 bp, Artificial Sequence
  Description of Artificial Sequence: Synthetic oligonucleotide
acttgctcagatatgggcagcctacacacc

SEQ ID NO: 287800 - DNA, 29 bp, Artificial Sequence
  Description of Artificial Sequence: Synthetic oligonucleotide
cttgctcagatatgggcagcctacacacc

SEQ ID NO: 287801 - DNA, 29 bp, Artificial Sequence
  Description of Artificial Sequence: Synthetic oligonucleotide
ttgctcagatatgggcagcctacacaccg

SEQ ID NO: 287802 - DNA, 28 bp, Artificial Sequence
  Description of Artificial Sequence: Synthetic oligonucleotide
tgctcagatatgggcagcctacacaccg

SEQ ID NO: 287803 - DNA, 27 bp, Artificial Sequence
  Description of Artificial Sequence: Synthetic oligonucleotide
gctcagatatgggcagcctacacaccg

SEQ ID NO: 287804 - DNA, 27 bp, Artificial Sequence
  Description of Artificial Sequence: Synthetic oligonucleotide
ctcagatatgggcagcctacacaccgg

SEQ ID NO: 287805 - DNA, 28 bp, Artificial Sequence
  Description of Artificial Sequence: Synthetic oligonucleotide
tcagatatgggcagcctacacaccggag

SEQ ID NO: 287806 - DNA, 27 bp, Artificial Sequence
  Description of Artificial Sequence: Synthetic oligonucleotide
cagatatgggcagcctacacaccggag

SEQ ID NO: 287807 - DNA, 27 bp, Artificial Sequence
  Description of Artificial Sequence: Synthetic oligonucleotide
agatatgggcagcctacacaccggagg

SEQ ID NO: 287808 - DNA, 26 bp, Artificial Sequence
  Description of Artificial Sequence: Synthetic oligonucleotide
gatatgggcagcctacacaccggagg

SEQ ID NO: 287809 - DNA, 26 bp, Artificial Sequence
  Description of Artificial Sequence: Synthetic oligonucleotide
atatgggcagcctacacaccggaggg

SEQ ID NO: 287810 - DNA, 25 bp, Artificial Sequence
  Description of Artificial Sequence: Synthetic oligonucleotide
tatgggcagcctacacaccggaggg

SEQ ID NO: 287811 - DNA, 24 bp, Artificial Sequence
  Description of Artificial Sequence: Synthetic oligonucleotide
atgggcagcctacacaccggaggg

SEQ ID NO: 287812 - DNA, 23 bp, Artificial Sequence
  Description of Artificial Sequence: Synthetic oligonucleotide
tgggcagcctacacaccggaggg

SEQ ID NO: 287813 - DNA, 22 bp, Artificial Sequence
  Description of Artificial Sequence: Synthetic oligonucleotide
gggcagcctacacaccggaggg

SEQ ID NO: 287814 - DNA, 23 bp, Artificial Sequence
  Description of Artificial Sequence: Synthetic oligonucleotide
ggcagcctacacaccggagggca

SEQ ID NO: 287815 - DNA, 25 bp, Artificial Sequence
  Description of Artificial Sequence: Synthetic oligonucleotide
gcagcctacacaccggagggcagta

SEQ ID NO: 287816 - DNA, 25 bp, Artificial Sequence
  Description of Artificial Sequence: Synthetic oligonucleotide
cagcctacacaccggagggcagtac

SEQ ID NO: 287817 - DNA, 27 bp, Artificial Sequence
  Description of Artificial Sequence: Synthetic oligonucleotide
agcctacacaccggagggcagtacctt

SEQ ID NO: 287818 - DNA, 27 bp, Artificial Sequence
  Description of Artificial Sequence: Synthetic oligonucleotide
gcctacacaccggagggcagtaccttt

SEQ ID NO: 287819 - DNA, 28 bp, Artificial Sequence
  Description of Artificial Sequence: Synthetic oligonucleotide
cctacacaccggagggcagtacctttac

SEQ ID NO: 287820 - DNA, 28 bp, Artificial Sequence
  Description of Artificial Sequence: Synthetic oligonucleotide
ctacacaccggagggcagtacctttacc

SEQ ID NO: 287821 - DNA, 29 bp, Artificial Sequence
  Description of Artificial Sequence: Synthetic oligonucleotide
tacacaccggagggcagtacctttaccac

SEQ ID NO: 287822 - DNA, 28 bp, Artificial Sequence
  Description of Artificial Sequence: Synthetic oligonucleotide
acacaccggagggcagtacctttaccac

SEQ ID NO: 287823 - DNA, 27 bp, Artificial Sequence
  Description of Artificial Sequence: Synthetic oligonucleotide
cacaccggagggcagtacctttaccac

SEQ ID NO: 287824 - DNA, 28 bp, Artificial Sequence
  Description of Artificial Sequence: Synthetic oligonucleotide
acaccggagggcagtacctttaccactg

SEQ ID NO: 287825 - DNA, 27 bp, Artificial Sequence
  Description of Artificial Sequence: Synthetic oligonucleotide
caccggagggcagtacctttaccactg

SEQ ID NO: 287826 - DNA, 27 bp, Artificial Sequence
  Description of Artificial Sequence: Synthetic oligonucleotide
accggagggcagtacctttaccactgg

SEQ ID NO: 287827 - DNA, 26 bp, Artificial Sequence
  Description of Artificial Sequence: Synthetic oligonucleotide
ccggagggcagtacctttaccactgg

SEQ ID NO: 287828 - DNA, 26 bp, Artificial Sequence
  Description of Artificial Sequence: Synthetic oligonucleotide
cggagggcagtacctttaccactggc

SEQ ID NO: 287829 - DNA, 26 bp, Artificial Sequence
  Description of Artificial Sequence: Synthetic oligonucleotide
ggagggcagtacctttaccactggcc

SEQ ID NO: 287830 - DNA, 27 bp, Artificial Sequence
  Description of Artificial Sequence: Synthetic oligonucleotide
gagggcagtacctttaccactggccca

SEQ ID NO: 287831 - DNA, 27 bp, Artificial Sequence
  Description of Artificial Sequence: Synthetic oligonucleotide
agggcagtacctttaccactggcccac

SEQ ID NO: 287832 - DNA, 27 bp, Artificial Sequence
  Description of Artificial Sequence: Synthetic oligonucleotide
gggcagtacctttaccactggcccaca

SEQ ID NO: 287833 - DNA, 28 bp, Artificial Sequence
  Description of Artificial Sequence: Synthetic oligonucleotide
ggcagtacctttaccactggcccacatc

SEQ ID NO: 287834 - DNA, 29 bp, Artificial Sequence
  Description of Artificial Sequence: Synthetic oligonucleotide
gcagtacctttaccactggcccacatctc

SEQ ID NO: 287835 - DNA, 30 bp, Artificial Sequence
  Description of Artificial Sequence: Synthetic oligonucleotide
cagtacctttaccactggcccacatctctg

SEQ ID NO: 287836 - DNA, 33 bp, Artificial Sequence
  Description of Artificial Sequence: Synthetic oligonucleotide
agtacctttaccactggcccacatctctgtatc

SEQ ID NO: 287837 - DNA, 32 bp, Artificial Sequence
  Description of Artificial Sequence: Synthetic oligonucleotide
gtacctttaccactggcccacatctctgtatc

SEQ ID NO: 287838 - DNA, 36 bp, Artificial Sequence
  Description of Artificial Sequence: Synthetic oligonucleotide
tacctttaccactggcccacatctctgtatcaaatc

SEQ ID NO: 287839 - DNA, 35 bp, Artificial Sequence
  Description of Artificial Sequence: Synthetic oligonucleotide
acctttaccactggcccacatctctgtatcaaatc

SEQ ID NO: 287840 - DNA, 34 bp, Artificial Sequence
  Description of Artificial Sequence: Synthetic oligonucleotide
cctttaccactggcccacatctctgtatcaaatc

SEQ ID NO: 287841 - DNA, 34 bp, Artificial Sequence
  Description of Artificial Sequence: Synthetic oligonucleotide
ctttaccactggcccacatctctgtatcaaatcc

SEQ ID NO: 287842 - DNA, 35 bp, Artificial Sequence
  Description of Artificial Sequence: Synthetic oligonucleotide
tttaccactggcccacatctctgtatcaaatccag

SEQ ID NO: 287843 - DNA, 34 bp, Artificial Sequence
  Description of Artificial Sequence: Synthetic oligonucleotide
ttaccactggcccacatctctgtatcaaatccag

SEQ ID NO: 287844 - DNA, 33 bp, Artificial Sequence
  Description of Artificial Sequence: Synthetic oligonucleotide
taccactggcccacatctctgtatcaaatccag

SEQ ID NO: 287845 - DNA, 32 bp, Artificial Sequence
  Description of Artificial Sequence: Synthetic oligonucleotide
accactggcccacatctctgtatcaaatccag

SEQ ID NO: 287846 - DNA, 31 bp, Artificial Sequence
  Description of Artificial Sequence: Synthetic oligonucleotide
ccactggcccacatctctgtatcaaatccag

SEQ ID NO: 287847 - DNA, 31 bp, Artificial Sequence
  Description of Artificial Sequence: Synthetic oligonucleotide
cactggcccacatctctgtatcaaatccagg

SEQ ID NO: 287848 - DNA, 32 bp, Artificial Sequence
  Description of Artificial Sequence: Synthetic oligonucleotide
actggcccacatctctgtatcaaatccaggac

SEQ ID NO: 287849 - DNA, 31 bp, Artificial Sequence
  Description of Artificial Sequence: Synthetic oligonucleotide
ctggcccacatctctgtatcaaatccaggac

SEQ ID NO: 287850 - DNA, 32 bp, Artificial Sequence
  Description of Artificial Sequence: Synthetic oligonucleotide
tggcccacatctctgtatcaaatccaggactc

SEQ ID NO: 287851 - DNA, 31 bp, Artificial Sequence
  Description of Artificial Sequence: Synthetic oligonucleotide
ggcccacatctctgtatcaaatccaggactc

SEQ ID NO: 287852 - DNA, 33 bp, Artificial Sequence
  Description of Artificial Sequence: Synthetic oligonucleotide
gcccacatctctgtatcaaatccaggactcaac

SEQ ID NO: 287853 - DNA, 35 bp, Artificial Sequence
  Description of Artificial Sequence: Synthetic oligonucleotide
cccacatctctgtatcaaatccaggactcaacaac

SEQ ID NO: 287854 - DNA, 35 bp, Artificial Sequence
  Description of Artificial Sequence: Synthetic oligonucleotide
ccacatctctgtatcaaatccaggactcaacaacc

SEQ ID NO: 287855 - DNA, 36 bp, Artificial Sequence
  Description of Artificial Sequence: Synthetic oligonucleotide
cacatctctgtatcaaatccaggactcaacaacctg

SEQ ID NO: 287856 - DNA, 36 bp, Artificial Sequence
  Description of Artificial Sequence: Synthetic oligonucleotide
acatctctgtatcaaatccaggactcaacaacctgg

SEQ ID NO: 287857 - DNA, 35 bp, Artificial Sequence
  Description of Artificial Sequence: Synthetic oligonucleotide
catctctgtatcaaatccaggactcaacaacctgg

SEQ ID NO: 287858 - DNA, 38 bp, Artificial Sequence
  Description of Artificial Sequence: Synthetic oligonucleotide
atctctgtatcaaatccaggactcaacaacctggatac

SEQ ID NO: 287859 - DNA, 37 bp, Artificial Sequence
  Description of Artificial Sequence: Synthetic oligonucleotide
tctctgtatcaaatccaggactcaacaacctggatac

SEQ ID NO: 287860 - DNA, 36 bp, Artificial Sequence
  Description of Artificial Sequence: Synthetic oligonucleotide
ctctgtatcaaatccaggactcaacaacctggatac

SEQ ID NO: 287861 - DNA, 36 bp, Artificial Sequence
  Description of Artificial Sequence: Synthetic oligonucleotide
tctgtatcaaatccaggactcaacaacctggatacg

SEQ ID NO: 287862 - DNA, 35 bp, Artificial Sequence
  Description of Artificial Sequence: Synthetic oligonucleotide
ctgtatcaaatccaggactcaacaacctggatacg

SEQ ID NO: 287863 - DNA, 35 bp, Artificial Sequence
  Description of Artificial Sequence: Synthetic oligonucleotide
tgtatcaaatccaggactcaacaacctggatacgc

SEQ ID NO: 287864 - DNA, 34 bp, Artificial Sequence
  Description of Artificial Sequence: Synthetic oligonucleotide
gtatcaaatccaggactcaacaacctggatacgc

SEQ ID NO: 287865 - DNA, 37 bp, Artificial Sequence
  Description of Artificial Sequence: Synthetic oligonucleotide
tatcaaatccaggactcaacaacctggatacgctaag

SEQ ID NO: 287866 - DNA, 36 bp, Artificial Sequence
  Description of Artificial Sequence: Synthetic oligonucleotide
atcaaatccaggactcaacaacctggatacgctaag

SEQ ID NO: 287867 - DNA, 35 bp, Artificial Sequence
  Description of Artificial Sequence: Synthetic oligonucleotide
tcaaatccaggactcaacaacctggatacgctaag

SEQ ID NO: 287868 - DNA, 34 bp, Artificial Sequence
  Description of Artificial Sequence: Synthetic oligonucleotide
caaatccaggactcaacaacctggatacgctaag

SEQ ID NO: 287869 - DNA, 34 bp, Artificial Sequence
  Description of Artificial Sequence: Synthetic oligonucleotide
aaatccaggactcaacaacctggatacgctaagc

SEQ ID NO: 287870 - DNA, 33 bp, Artificial Sequence
  Description of Artificial Sequence: Synthetic oligonucleotide
aatccaggactcaacaacctggatacgctaagc

SEQ ID NO: 287871 - DNA, 32 bp, Artificial Sequence
  Description of Artificial Sequence: Synthetic oligonucleotide
atccaggactcaacaacctggatacgctaagc

SEQ ID NO: 287872 - DNA, 31 bp, Artificial Sequence
  Description of Artificial Sequence: Synthetic oligonucleotide
tccaggactcaacaacctggatacgctaagc

SEQ ID NO: 287873 - DNA, 30 bp, Artificial Sequence
  Description of Artificial Sequence: Synthetic oligonucleotide
ccaggactcaacaacctggatacgctaagc

SEQ ID NO: 287874 - DNA, 35 bp, Artificial Sequence
  Description of Artificial Sequence: Synthetic oligonucleotide
caggactcaacaacctggatacgctaagcaaaatc

SEQ ID NO: 287875 - DNA, 36 bp, Artificial Sequence
  Description of Artificial Sequence: Synthetic oligonucleotide
aggactcaacaacctggatacgctaagcaaaatctc

SEQ ID NO: 287876 - DNA, 35 bp, Artificial Sequence
  Description of Artificial Sequence: Synthetic oligonucleotide
ggactcaacaacctggatacgctaagcaaaatctc

SEQ ID NO: 287877 - DNA, 36 bp, Artificial Sequence
  Description of Artificial Sequence: Synthetic oligonucleotide
gactcaacaacctggatacgctaagcaaaatctctc

SEQ ID NO: 287878 - DNA, 38 bp, Artificial Sequence
  Description of Artificial Sequence: Synthetic oligonucleotide
actcaacaacctggatacgctaagcaaaatctctcatg

SEQ ID NO: 287879 - DNA, 37 bp, Artificial Sequence
  Description of Artificial Sequence: Synthetic oligonucleotide
ctcaacaacctggatacgctaagcaaaatctctcatg

SEQ ID NO: 287880 - DNA, 39 bp, Artificial Sequence
  Description of Artificial Sequence: Synthetic oligonucleotide
tcaacaacctggatacgctaagcaaaatctctcatgttg

SEQ ID NO: 287881 - DNA, 38 bp, Artificial Sequence
  Description of Artificial Sequence: Synthetic oligonucleotide
caacaacctggatacgctaagcaaaatctctcatgttg

SEQ ID NO: 287882 - DNA, 38 bp, Artificial Sequence
  Description of Artificial Sequence: Synthetic oligonucleotide
aacaacctggatacgctaagcaaaatctctcatgttgc

SEQ ID NO: 287883 - DNA, 37 bp, Artificial Sequence
  Description of Artificial Sequence: Synthetic oligonucleotide
acaacctggatacgctaagcaaaatctctcatgttgc

SEQ ID NO: 287884 - DNA, 36 bp, Artificial Sequence
  Description of Artificial Sequence: Synthetic oligonucleotide
caacctggatacgctaagcaaaatctctcatgttgc

SEQ ID NO: 287885 - DNA, 37 bp, Artificial Sequence
  Description of Artificial Sequence: Synthetic oligonucleotide
aacctggatacgctaagcaaaatctctcatgttgctg

SEQ ID NO: 287886 - DNA, 36 bp, Artificial Sequence
  Description of Artificial Sequence: Synthetic oligonucleotide
acctggatacgctaagcaaaatctctcatgttgctg

SEQ ID NO: 287887 - DNA, 35 bp, Artificial Sequence
  Description of Artificial Sequence: Synthetic oligonucleotide
cctggatacgctaagcaaaatctctcatgttgctg

SEQ ID NO: 287888 - DNA, 37 bp, Artificial Sequence
  Description of Artificial Sequence: Synthetic oligonucleotide
ctggatacgctaagcaaaatctctcatgttgctgatc

SEQ ID NO: 287889 - DNA, 37 bp, Artificial Sequence
  Description of Artificial Sequence: Synthetic oligonucleotide
tggatacgctaagcaaaatctctcatgttgctgatcc

SEQ ID NO: 287890 - DNA, 36 bp, Artificial Sequence
  Description of Artificial Sequence: Synthetic oligonucleotide
ggatacgctaagcaaaatctctcatgttgctgatcc

SEQ ID NO: 287891 - DNA, 37 bp, Artificial Sequence
  Description of Artificial Sequence: Synthetic oligonucleotide
gatacgctaagcaaaatctctcatgttgctgatcctg

SEQ ID NO: 287892 - DNA, 39 bp, Artificial Sequence
  Description of Artificial Sequence: Synthetic oligonucleotide
atacgctaagcaaaatctctcatgttgctgatcctgaag

SEQ ID NO: 287893 - DNA, 38 bp, Artificial Sequence
  Description of Artificial Sequence: Synthetic oligonucleotide
tacgctaagcaaaatctctcatgttgctgatcctgaag

SEQ ID NO: 287894 - DNA, 37 bp, Artificial Sequence
  Description of Artificial Sequence: Synthetic oligonucleotide
acgctaagcaaaatctctcatgttgctgatcctgaag

SEQ ID NO: 287895 - DNA, 36 bp, Artificial Sequence
  Description of Artificial Sequence: Synthetic oligonucleotide
cgctaagcaaaatctctcatgttgctgatcctgaag

SEQ ID NO: 287896 - DNA, 39 bp, Artificial Sequence
  Description of Artificial Sequence: Synthetic oligonucleotide
gctaagcaaaatctctcatgttgctgatcctgaagtttc

SEQ ID NO: 287897 - DNA, 39 bp, Artificial Sequence
  Description of Artificial Sequence: Synthetic oligonucleotide
ctaagcaaaatctctcatgttgctgatcctgaagtttcc

SEQ ID NO: 287898 - DNA, 44 bp, Artificial Sequence
  Description of Artificial Sequence: Synthetic oligonucleotide
taagcaaaatctctcatgttgctgatcctgaagtttccaataac

SEQ ID NO: 287899 - DNA, 43 bp, Artificial Sequence
  Description of Artificial Sequence: Synthetic oligonucleotide
aagcaaaatctctcatgttgctgatcctgaagtttccaataac

SEQ ID NO: 287900 - DNA, 42 bp, Artificial Sequence
  Description of Artificial Sequence: Synthetic oligonucleotide
agcaaaatctctcatgttgctgatcctgaagtttccaataac

SEQ ID NO: 287901 - DNA, 41 bp, Artificial Sequence
  Description of Artificial Sequence: Synthetic oligonucleotide
gcaaaatctctcatgttgctgatcctgaagtttccaataac

SEQ ID NO: 287902 - DNA, 42 bp, Artificial Sequence
  Description of Artificial Sequence: Synthetic oligonucleotide
caaaatctctcatgttgctgatcctgaagtttccaataactc

SEQ ID NO: 287903 - DNA, 42 bp, Artificial Sequence
  Description of Artificial Sequence: Synthetic oligonucleotide
aaaatctctcatgttgctgatcctgaagtttccaataactcc

SEQ ID NO: 287904 - DNA, 41 bp, Artificial Sequence
  Description of Artificial Sequence: Synthetic oligonucleotide
aaatctctcatgttgctgatcctgaagtttccaataactcc

SEQ ID NO: 287905 - DNA, 40 bp, Artificial Sequence
  Description of Artificial Sequence: Synthetic oligonucleotide
aatctctcatgttgctgatcctgaagtttccaataactcc

SEQ ID NO: 287906 - DNA, 39 bp, Artificial Sequence
  Description of Artificial Sequence: Synthetic oligonucleotide
atctctcatgttgctgatcctgaagtttccaataactcc

SEQ ID NO: 287907 - DNA, 38 bp, Artificial Sequence
  Description of Artificial Sequence: Synthetic oligonucleotide
tctctcatgttgctgatcctgaagtttccaataactcc

SEQ ID NO: 287908 - DNA, 37 bp, Artificial Sequence
  Description of Artificial Sequence: Synthetic oligonucleotide
ctctcatgttgctgatcctgaagtttccaataactcc

SEQ ID NO: 287909 - DNA, 43 bp, Artificial Sequence
  Description of Artificial Sequence: Synthetic oligonucleotide
tctcatgttgctgatcctgaagtttccaataactccaattttg

SEQ ID NO: 287910 - DNA, 42 bp, Artificial Sequence
  Description of Artificial Sequence: Synthetic oligonucleotide
ctcatgttgctgatcctgaagtttccaataactccaattttg

SEQ ID NO: 287911 - DNA, 42 bp, Artificial Sequence
  Description of Artificial Sequence: Synthetic oligonucleotide
tcatgttgctgatcctgaagtttccaataactccaattttgc

SEQ ID NO: 287912 - DNA, 41 bp, Artificial Sequence
  Description of Artificial Sequence: Synthetic oligonucleotide
catgttgctgatcctgaagtttccaataactccaattttgc

SEQ ID NO: 287913 - DNA, 41 bp, Artificial Sequence
  Description of Artificial Sequence: Synthetic oligonucleotide
atgttgctgatcctgaagtttccaataactccaattttgcc

SEQ ID NO: 287914 - DNA, 40 bp, Artificial Sequence
  Description of Artificial Sequence: Synthetic oligonucleotide
tgttgctgatcctgaagtttccaataactccaattttgcc

SEQ ID NO: 287915 - DNA, 39 bp, Artificial Sequence
  Description of Artificial Sequence: Synthetic oligonucleotide
gttgctgatcctgaagtttccaataactccaattttgcc

SEQ ID NO: 287916 - DNA, 41 bp, Artificial Sequence
  Description of Artificial Sequence: Synthetic oligonucleotide
ttgctgatcctgaagtttccaataactccaattttgccatc

SEQ ID NO: 287917 - DNA, 40 bp, Artificial Sequence
  Description of Artificial Sequence: Synthetic oligonucleotide
tgctgatcctgaagtttccaataactccaattttgccatc

SEQ ID NO: 287918 - DNA, 39 bp, Artificial Sequence
  Description of Artificial Sequence: Synthetic oligonucleotide
gctgatcctgaagtttccaataactccaattttgccatc

SEQ ID NO: 287919 - DNA, 39 bp, Artificial Sequence
  Description of Artificial Sequence: Synthetic oligonucleotide
ctgatcctgaagtttccaataactccaattttgccatcg

SEQ ID NO: 287920 - DNA, 39 bp, Artificial Sequence
  Description of Artificial Sequence: Synthetic oligonucleotide
tgatcctgaagtttccaataactccaattttgccatcgg

SEQ ID NO: 287921 - DNA, 38 bp, Artificial Sequence
  Description of Artificial Sequence: Synthetic oligonucleotide
gatcctgaagtttccaataactccaattttgccatcgg

SEQ ID NO: 287922 - DNA, 38 bp, Artificial Sequence
  Description of Artificial Sequence: Synthetic oligonucleotide
atcctgaagtttccaataactccaattttgccatcggc

SEQ ID NO: 287923 - DNA, 37 bp, Artificial Sequence
  Description of Artificial Sequence: Synthetic oligonucleotide
tcctgaagtttccaataactccaattttgccatcggc

SEQ ID NO: 287924 - DNA, 36 bp, Artificial Sequence
  Description of Artificial Sequence: Synthetic oligonucleotide
cctgaagtttccaataactccaattttgccatcggc

SEQ ID NO: 287925 - DNA, 38 bp, Artificial Sequence
  Description of Artificial Sequence: Synthetic oligonucleotide
ctgaagtttccaataactccaattttgccatcggcatg

SEQ ID NO: 287926 - DNA, 38 bp, Artificial Sequence
  Description of Artificial Sequence: Synthetic oligonucleotide
tgaagtttccaataactccaattttgccatcggcatgg

SEQ ID NO: 287927 - DNA, 37 bp, Artificial Sequence
  Description of Artificial Sequence: Synthetic oligonucleotide
gaagtttccaataactccaattttgccatcggcatgg

SEQ ID NO: 287928 - DNA, 38 bp, Artificial Sequence
  Description of Artificial Sequence: Synthetic oligonucleotide
aagtttccaataactccaattttgccatcggcatggtg

SEQ ID NO: 287929 - DNA, 37 bp, Artificial Sequence
  Description of Artificial Sequence: Synthetic oligonucleotide
agtttccaataactccaattttgccatcggcatggtg

SEQ ID NO: 287930 - DNA, 36 bp, Artificial Sequence
  Description of Artificial Sequence: Synthetic oligonucleotide
gtttccaataactccaattttgccatcggcatggtg

SEQ ID NO: 287931 - DNA, 36 bp, Artificial Sequence
  Description of Artificial Sequence: Synthetic oligonucleotide
tttccaataactccaattttgccatcggcatggtgc

SEQ ID NO: 287932 - DNA, 35 bp, Artificial Sequence
  Description of Artificial Sequence: Synthetic oligonucleotide
ttccaataactccaattttgccatcggcatggtgc

SEQ ID NO: 287933 - DNA, 34 bp, Artificial Sequence
  Description of Artificial Sequence: Synthetic oligonucleotide
tccaataactccaattttgccatcggcatggtgc

SEQ ID NO: 287934 - DNA, 33 bp, Artificial Sequence
  Description of Artificial Sequence: Synthetic oligonucleotide
ccaataactccaattttgccatcggcatggtgc

SEQ ID NO: 287935 - DNA, 33 bp, Artificial Sequence
  Description of Artificial Sequence: Synthetic oligonucleotide
caataactccaattttgccatcggcatggtgcg

SEQ ID NO: 287936 - DNA, 33 bp, Artificial Sequence
  Description of Artificial Sequence: Synthetic oligonucleotide
aataactccaattttgccatcggcatggtgcgc

SEQ ID NO: 287937 - DNA, 32 bp, Artificial Sequence
  Description of Artificial Sequence: Synthetic oligonucleotide
ataactccaattttgccatcggcatggtgcgc

SEQ ID NO: 287938 - DNA, 31 bp, Artificial Sequence
  Description of Artificial Sequence: Synthetic oligonucleotide
taactccaattttgccatcggcatggtgcgc

SEQ ID NO: 287939 - DNA, 30 bp, Artificial Sequence
  Description of Artificial Sequence: Synthetic oligonucleotide
aactccaattttgccatcggcatggtgcgc

SEQ ID NO: 287940 - DNA, 29 bp, Artificial Sequence
  Description of Artificial Sequence: Synthetic oligonucleotide
actccaattttgccatcggcatggtgcgc

SEQ ID NO: 287941 - DNA, 28 bp, Artificial Sequence
  Description of Artificial Sequence: Synthetic oligonucleotide
ctccaattttgccatcggcatggtgcgc

SEQ ID NO: 287942 - DNA, 29 bp, Artificial Sequence
  Description of Artificial Sequence: Synthetic oligonucleotide
tccaattttgccatcggcatggtgcgcag

SEQ ID NO: 287943 - DNA, 28 bp, Artificial Sequence
  Description of Artificial Sequence: Synthetic oligonucleotide
ccaattttgccatcggcatggtgcgcag

SEQ ID NO: 287944 - DNA, 29 bp, Artificial Sequence
  Description of Artificial Sequence: Synthetic oligonucleotide
caattttgccatcggcatggtgcgcagtg

SEQ ID NO: 287945 - DNA, 29 bp, Artificial Sequence
  Description of Artificial Sequence: Synthetic oligonucleotide
aattttgccatcggcatggtgcgcagtgg

SEQ ID NO: 287946 - DNA, 28 bp, Artificial Sequence
  Description of Artificial Sequence: Synthetic oligonucleotide
attttgccatcggcatggtgcgcagtgg

SEQ ID NO: 287947 - DNA, 27 bp, Artificial Sequence
  Description of Artificial Sequence: Synthetic oligonucleotide
ttttgccatcggcatggtgcgcagtgg

SEQ ID NO: 287948 - DNA, 27 bp, Artificial Sequence
  Description of Artificial Sequence: Synthetic oligonucleotide
tttgccatcggcatggtgcgcagtggt

SEQ ID NO: 287949 - DNA, 27 bp, Artificial Sequence
  Description of Artificial Sequence: Synthetic oligonucleotide
ttgccatcggcatggtgcgcagtggta

SEQ ID NO: 287950 - DNA, 26 bp, Artificial Sequence
  Description of Artificial Sequence: Synthetic oligonucleotide
tgccatcggcatggtgcgcagtggta

SEQ ID NO: 287951 - DNA, 25 bp, Artificial Sequence
  Description of Artificial Sequence: Synthetic oligonucleotide
gccatcggcatggtgcgcagtggta

SEQ ID NO: 287952 - DNA, 25 bp, Artificial Sequence
  Description of Artificial Sequence: Synthetic oligonucleotide
ccatcggcatggtgcgcagtggtag

SEQ ID NO: 287953 - DNA, 27 bp, Artificial Sequence
  Description of Artificial Sequence: Synthetic oligonucleotide
catcggcatggtgcgcagtggtagcaa

SEQ ID NO: 287954 - DNA, 31 bp, Artificial Sequence
  Description of Artificial Sequence: Synthetic oligonucleotide
atcggcatggtgcgcagtggtagcaataatg

SEQ ID NO: 287955 - DNA, 30 bp, Artificial Sequence
  Description of Artificial Sequence: Synthetic oligonucleotide
tcggcatggtgcgcagtggtagcaataatg

SEQ ID NO: 287956 - DNA, 29 bp, Artificial Sequence
  Description of Artificial Sequence: Synthetic oligonucleotide
cggcatggtgcgcagtggtagcaataatg

SEQ ID NO: 287957 - DNA, 29 bp, Artificial Sequence
  Description of Artificial Sequence: Synthetic oligonucleotide
ggcatggtgcgcagtggtagcaataatgc

SEQ ID NO: 287958 - DNA, 29 bp, Artificial Sequence
  Description of Artificial Sequence: Synthetic oligonucleotide
gcatggtgcgcagtggtagcaataatgcg

SEQ ID NO: 287959 - DNA, 29 bp, Artificial Sequence
  Description of Artificial Sequence: Synthetic oligonucleotide
catggtgcgcagtggtagcaataatgcgc

SEQ ID NO: 287960 - DNA, 29 bp, Artificial Sequence
  Description of Artificial Sequence: Synthetic oligonucleotide
atggtgcgcagtggtagcaataatgcgcg

SEQ ID NO: 287961 - DNA, 28 bp, Artificial Sequence
  Description of Artificial Sequence: Synthetic oligonucleotide
tggtgcgcagtggtagcaataatgcgcg

SEQ ID NO: 287962 - DNA, 27 bp, Artificial Sequence
  Description of Artificial Sequence: Synthetic oligonucleotide
ggtgcgcagtggtagcaataatgcgcg

SEQ ID NO: 287963 - DNA, 28 bp, Artificial Sequence
  Description of Artificial Sequence: Synthetic oligonucleotide
gtgcgcagtggtagcaataatgcgcgtc

SEQ ID NO: 287964 - DNA, 29 bp, Artificial Sequence
  Description of Artificial Sequence: Synthetic oligonucleotide
tgcgcagtggtagcaataatgcgcgtctg

SEQ ID NO: 287965 - DNA, 28 bp, Artificial Sequence
  Description of Artificial Sequence: Synthetic oligonucleotide
gcgcagtggtagcaataatgcgcgtctg

SEQ ID NO: 287966 - DNA, 28 bp, Artificial Sequence
  Description of Artificial Sequence: Synthetic oligonucleotide
cgcagtggtagcaataatgcgcgtctgg

SEQ ID NO: 287967 - DNA, 28 bp, Artificial Sequence
  Description of Artificial Sequence: Synthetic oligonucleotide
gcagtggtagcaataatgcgcgtctggc

SEQ ID NO: 287968 - DNA, 29 bp, Artificial Sequence
  Description of Artificial Sequence: Synthetic oligonucleotide
cagtggtagcaataatgcgcgtctggctc

SEQ ID NO: 287969 - DNA, 29 bp, Artificial Sequence
  Description of Artificial Sequence: Synthetic oligonucleotide
agtggtagcaataatgcgcgtctggctcc

SEQ ID NO: 287970 - DNA, 28 bp, Artificial Sequence
  Description of Artificial Sequence: Synthetic oligonucleotide
gtggtagcaataatgcgcgtctggctcc

SEQ ID NO: 287971 - DNA, 31 bp, Artificial Sequence
  Description of Artificial Sequence: Synthetic oligonucleotide
tggtagcaataatgcgcgtctggctccaatg

SEQ ID NO: 287972 - DNA, 30 bp, Artificial Sequence
  Description of Artificial Sequence: Synthetic oligonucleotide
ggtagcaataatgcgcgtctggctccaatg

SEQ ID NO: 287973 - DNA, 30 bp, Artificial Sequence
  Description of Artificial Sequence: Synthetic oligonucleotide
gtagcaataatgcgcgtctggctccaatgc

SEQ ID NO: 287974 - DNA, 31 bp, Artificial Sequence
  Description of Artificial Sequence: Synthetic oligonucleotide
tagcaataatgcgcgtctggctccaatgctg

SEQ ID NO: 287975 - DNA, 30 bp, Artificial Sequence
  Description of Artificial Sequence: Synthetic oligonucleotide
agcaataatgcgcgtctggctccaatgctg

SEQ ID NO: 287976 - DNA, 29 bp, Artificial Sequence
  Description of Artificial Sequence: Synthetic oligonucleotide
gcaataatgcgcgtctggctccaatgctg

SEQ ID NO: 287977 - DNA, 29 bp, Artificial Sequence
  Description of Artificial Sequence: Synthetic oligonucleotide
caataatgcgcgtctggctccaatgctgc

SEQ ID NO: 287978 - DNA, 29 bp, Artificial Sequence
  Description of Artificial Sequence: Synthetic oligonucleotide
aataatgcgcgtctggctccaatgctgcc

SEQ ID NO: 287979 - DNA, 28 bp, Artificial Sequence
  Description of Artificial Sequence: Synthetic oligonucleotide
ataatgcgcgtctggctccaatgctgcc

SEQ ID NO: 287980 - DNA, 27 bp, Artificial Sequence
  Description of Artificial Sequence: Synthetic oligonucleotide
taatgcgcgtctggctccaatgctgcc

SEQ ID NO: 287981 - DNA, 26 bp, Artificial Sequence
  Description of Artificial Sequence: Synthetic oligonucleotide
aatgcgcgtctggctccaatgctgcc

SEQ ID NO: 287982 - DNA, 25 bp, Artificial Sequence
  Description of Artificial Sequence: Synthetic oligonucleotide
atgcgcgtctggctccaatgctgcc

SEQ ID NO: 287983 - DNA, 24 bp, Artificial Sequence
  Description of Artificial Sequence: Synthetic oligonucleotide
tgcgcgtctggctccaatgctgcc

SEQ ID NO: 287984 - DNA, 23 bp, Artificial Sequence
  Description of Artificial Sequence: Synthetic oligonucleotide
gcgcgtctggctccaatgctgcc

SEQ ID NO: 287985 - DNA, 23 bp, Artificial Sequence
  Description of Artificial Sequence: Synthetic oligonucleotide
cgcgtctggctccaatgctgccc

SEQ ID NO: 287986 - DNA, 24 bp, Artificial Sequence
  Description of Artificial Sequence: Synthetic oligonucleotide
gcgtctggctccaatgctgcccca

SEQ ID NO: 287987 - DNA, 27 bp, Artificial Sequence
  Description of Artificial Sequence: Synthetic oligonucleotide
cgtctggctccaatgctgccccagtta

SEQ ID NO: 287988 - DNA, 27 bp, Artificial Sequence
  Description of Artificial Sequence: Synthetic oligonucleotide
gtctggctccaatgctgccccagttag

SEQ ID NO: 287989 - DNA, 27 bp, Artificial Sequence
  Description of Artificial Sequence: Synthetic oligonucleotide
tctggctccaatgctgccccagttagc

SEQ ID NO: 287990 - DNA, 27 bp, Artificial Sequence
  Description of Artificial Sequence: Synthetic oligonucleotide
ctggctccaatgctgccccagttagca

SEQ ID NO: 287991 - DNA, 27 bp, Artificial Sequence
  Description of Artificial Sequence: Synthetic oligonucleotide
tggctccaatgctgccccagttagcac

SEQ ID NO: 287992 - DNA, 27 bp, Artificial Sequence
  Description of Artificial Sequence: Synthetic oligonucleotide
ggctccaatgctgccccagttagcaca

SEQ ID NO: 287993 - DNA, 31 bp, Artificial Sequence
  Description of Artificial Sequence: Synthetic oligonucleotide
gctccaatgctgccccagttagcacaatatc

SEQ ID NO: 287994 - DNA, 33 bp, Artificial Sequence
  Description of Artificial Sequence: Synthetic oligonucleotide
ctccaatgctgccccagttagcacaatatcatc

SEQ ID NO: 287995 - DNA, 33 bp, Artificial Sequence
  Description of Artificial Sequence: Synthetic oligonucleotide
tccaatgctgccccagttagcacaatatcatcc

SEQ ID NO: 287996 - DNA, 32 bp, Artificial Sequence
  Description of Artificial Sequence: Synthetic oligonucleotide
ccaatgctgccccagttagcacaatatcatcc

SEQ ID NO: 287997 - DNA, 32 bp, Artificial Sequence
  Description of Artificial Sequence: Synthetic oligonucleotide
caatgctgccccagttagcacaatatcatccc

SEQ ID NO: 287998 - DNA, 34 bp, Artificial Sequence
  Description of Artificial Sequence: Synthetic oligonucleotide
aatgctgccccagttagcacaatatcatcccaag

SEQ ID NO: 287999 - DNA, 33 bp, Artificial Sequence
  Description of Artificial Sequence: Synthetic oligonucleotide
atgctgccccagttagcacaatatcatcccaag

SEQ ID NO: 288000 - DNA, 32 bp, Artificial Sequence
  Description of Artificial Sequence: Synthetic oligonucleotide
tgctgccccagttagcacaatatcatcccaag

SEQ ID NO: 288001 - DNA, 31 bp, Artificial Sequence
  Description of Artificial Sequence: Synthetic oligonucleotide
gctgccccagttagcacaatatcatcccaag

SEQ ID NO: 288002 - DNA, 31 bp, Artificial Sequence
  Description of Artificial Sequence: Synthetic oligonucleotide
ctgccccagttagcacaatatcatcccaagg

SEQ ID NO: 288003 - DNA, 32 bp, Artificial Sequence
  Description of Artificial Sequence: Synthetic oligonucleotide
tgccccagttagcacaatatcatcccaaggac

SEQ ID NO: 288004 - DNA, 31 bp, Artificial Sequence
  Description of Artificial Sequence: Synthetic oligonucleotide
gccccagttagcacaatatcatcccaaggac

SEQ ID NO: 288005 - DNA, 31 bp, Artificial Sequence
  Description of Artificial Sequence: Synthetic oligonucleotide
ccccagttagcacaatatcatcccaaggacc

SEQ ID NO: 288006 - DNA, 31 bp, Artificial Sequence
  Description of Artificial Sequence: Synthetic oligonucleotide
cccagttagcacaatatcatcccaaggaccg

SEQ ID NO: 288007 - DNA, 34 bp, Artificial Sequence
  Description of Artificial Sequence: Synthetic oligonucleotide
ccagttagcacaatatcatcccaaggaccgaaac

SEQ ID NO: 288008 - DNA, 36 bp, Artificial Sequence
  Description of Artificial Sequence: Synthetic oligonucleotide
cagttagcacaatatcatcccaaggaccgaaacaac

SEQ ID NO: 288009 - DNA, 36 bp, Artificial Sequence
  Description of Artificial Sequence: Synthetic oligonucleotide
agttagcacaatatcatcccaaggaccgaaacaacc

SEQ ID NO: 288010 - DNA, 35 bp, Artificial Sequence
  Description of Artificial Sequence: Synthetic oligonucleotide
gttagcacaatatcatcccaaggaccgaaacaacc

SEQ ID NO: 288011 - DNA, 36 bp, Artificial Sequence
  Description of Artificial Sequence: Synthetic oligonucleotide
ttagcacaatatcatcccaaggaccgaaacaacctg

SEQ ID NO: 288012 - DNA, 35 bp, Artificial Sequence
  Description of Artificial Sequence: Synthetic oligonucleotide
tagcacaatatcatcccaaggaccgaaacaacctg

SEQ ID NO: 288013 - DNA, 34 bp, Artificial Sequence
  Description of Artificial Sequence: Synthetic oligonucleotide
agcacaatatcatcccaaggaccgaaacaacctg

SEQ ID NO: 288014 - DNA, 33 bp, Artificial Sequence
  Description of Artificial Sequence: Synthetic oligonucleotide
gcacaatatcatcccaaggaccgaaacaacctg

SEQ ID NO: 288015 - DNA, 35 bp, Artificial Sequence
  Description of Artificial Sequence: Synthetic oligonucleotide
cacaatatcatcccaaggaccgaaacaacctgttc

SEQ ID NO: 288016 - DNA, 37 bp, Artificial Sequence
  Description of Artificial Sequence: Synthetic oligonucleotide
acaatatcatcccaaggaccgaaacaacctgttcatg

SEQ ID NO: 288017 - DNA, 36 bp, Artificial Sequence
  Description of Artificial Sequence: Synthetic oligonucleotide
caatatcatcccaaggaccgaaacaacctgttcatg

SEQ ID NO: 288018 - DNA, 36 bp, Artificial Sequence
  Description of Artificial Sequence: Synthetic oligonucleotide
aatatcatcccaaggaccgaaacaacctgttcatgg

SEQ ID NO: 288019 - DNA, 35 bp, Artificial Sequence
  Description of Artificial Sequence: Synthetic oligonucleotide
atatcatcccaaggaccgaaacaacctgttcatgg

SEQ ID NO: 288020 - DNA, 34 bp, Artificial Sequence
  Description of Artificial Sequence: Synthetic oligonucleotide
tatcatcccaaggaccgaaacaacctgttcatgg

SEQ ID NO: 288021 - DNA, 33 bp, Artificial Sequence
  Description of Artificial Sequence: Synthetic oligonucleotide
atcatcccaaggaccgaaacaacctgttcatgg

SEQ ID NO: 288022 - DNA, 32 bp, Artificial Sequence
  Description of Artificial Sequence: Synthetic oligonucleotide
tcatcccaaggaccgaaacaacctgttcatgg

SEQ ID NO: 288023 - DNA, 31 bp, Artificial Sequence
  Description of Artificial Sequence: Synthetic oligonucleotide
catcccaaggaccgaaacaacctgttcatgg

SEQ ID NO: 288024 - DNA, 32 bp, Artificial Sequence
  Description of Artificial Sequence: Synthetic oligonucleotide
atcccaaggaccgaaacaacctgttcatggtg

SEQ ID NO: 288025 - DNA, 31 bp, Artificial Sequence
  Description of Artificial Sequence: Synthetic oligonucleotide
tcccaaggaccgaaacaacctgttcatggtg

SEQ ID NO: 288026 - DNA, 30 bp, Artificial Sequence
  Description of Artificial Sequence: Synthetic oligonucleotide
cccaaggaccgaaacaacctgttcatggtg

SEQ ID NO: 288027 - DNA, 30 bp, Artificial Sequence
  Description of Artificial Sequence: Synthetic oligonucleotide
ccaaggaccgaaacaacctgttcatggtgg

SEQ ID NO: 288028 - DNA, 30 bp, Artificial Sequence
  Description of Artificial Sequence: Synthetic oligonucleotide
caaggaccgaaacaacctgttcatggtggg

SEQ ID NO: 288029 - DNA, 30 bp, Artificial Sequence
  Description of Artificial Sequence: Synthetic oligonucleotide
aaggaccgaaacaacctgttcatggtgggc

SEQ ID NO: 288030 - DNA, 29 bp, Artificial Sequence
  Description of Artificial Sequence: Synthetic oligonucleotide
aggaccgaaacaacctgttcatggtgggc

SEQ ID NO: 288031 - DNA, 28 bp, Artificial Sequence
  Description of Artificial Sequence: Synthetic oligonucleotide
ggaccgaaacaacctgttcatggtgggc

SEQ ID NO: 288032 - DNA, 30 bp, Artificial Sequence
  Description of Artificial Sequence: Synthetic oligonucleotide
gaccgaaacaacctgttcatggtgggcttg

SEQ ID NO: 288033 - DNA, 30 bp, Artificial Sequence
  Description of Artificial Sequence: Synthetic oligonucleotide
accgaaacaacctgttcatggtgggcttgg

SEQ ID NO: 288034 - DNA, 29 bp, Artificial Sequence
  Description of Artificial Sequence: Synthetic oligonucleotide
ccgaaacaacctgttcatggtgggcttgg

SEQ ID NO: 288035 - DNA, 29 bp, Artificial Sequence
  Description of Artificial Sequence: Synthetic oligonucleotide
cgaaacaacctgttcatggtgggcttggc

SEQ ID NO: 288036 - DNA, 30 bp, Artificial Sequence
  Description of Artificial Sequence: Synthetic oligonucleotide
gaaacaacctgttcatggtgggcttggcac

SEQ ID NO: 288037 - DNA, 31 bp, Artificial Sequence
  Description of Artificial Sequence: Synthetic oligonucleotide
aaacaacctgttcatggtgggcttggcactg

SEQ ID NO: 288038 - DNA, 30 bp, Artificial Sequence
  Description of Artificial Sequence: Synthetic oligonucleotide
aacaacctgttcatggtgggcttggcactg

SEQ ID NO: 288039 - DNA, 29 bp, Artificial Sequence
  Description of Artificial Sequence: Synthetic oligonucleotide
acaacctgttcatggtgggcttggcactg

SEQ ID NO: 288040 - DNA, 28 bp, Artificial Sequence
  Description of Artificial Sequence: Synthetic oligonucleotide
caacctgttcatggtgggcttggcactg

SEQ ID NO: 288041 - DNA, 28 bp, Artificial Sequence
  Description of Artificial Sequence: Synthetic oligonucleotide
aacctgttcatggtgggcttggcactgg

SEQ ID NO: 288042 - DNA, 27 bp, Artificial Sequence
  Description of Artificial Sequence: Synthetic oligonucleotide
acctgttcatggtgggcttggcactgg

SEQ ID NO: 288043 - DNA, 26 bp, Artificial Sequence
  Description of Artificial Sequence: Synthetic oligonucleotide
cctgttcatggtgggcttggcactgg

SEQ ID NO: 288044 - DNA, 26 bp, Artificial Sequence
  Description of Artificial Sequence: Synthetic oligonucleotide
ctgttcatggtgggcttggcactggg

SEQ ID NO: 288045 - DNA, 26 bp, Artificial Sequence
  Description of Artificial Sequence: Synthetic oligonucleotide
tgttcatggtgggcttggcactgggc

SEQ ID NO: 288046 - DNA, 25 bp, Artificial Sequence
  Description of Artificial Sequence: Synthetic oligonucleotide
gttcatggtgggcttggcactgggc

SEQ ID NO: 288047 - DNA, 26 bp, Artificial Sequence
  Description of Artificial Sequence: Synthetic oligonucleotide
ttcatggtgggcttggcactgggcct

SEQ ID NO: 288048 - DNA, 25 bp, Artificial Sequence
  Description of Artificial Sequence: Synthetic oligonucleotide
tcatggtgggcttggcactgggcct

SEQ ID NO: 288049 - DNA, 24 bp, Artificial Sequence
  Description of Artificial Sequence: Synthetic oligonucleotide
catggtgggcttggcactgggcct

SEQ ID NO: 288050 - DNA, 25 bp, Artificial Sequence
  Description of Artificial Sequence: Synthetic oligonucleotide
atggtgggcttggcactgggcctga

SEQ ID NO: 288051 - DNA, 24 bp, Artificial Sequence
  Description of Artificial Sequence: Synthetic oligonucleotide
tggtgggcttggcactgggcctga

SEQ ID NO: 288052 - DNA, 23 bp, Artificial Sequence
  Description of Artificial Sequence: Synthetic oligonucleotide
ggtgggcttggcactgggcctga

SEQ ID NO: 288053 - DNA, 24 bp, Artificial Sequence
  Description of Artificial Sequence: Synthetic oligonucleotide
gtgggcttggcactgggcctgact

SEQ ID NO: 288054 - DNA, 27 bp, Artificial Sequence
  Description of Artificial Sequence: Synthetic oligonucleotide
tgggcttggcactgggcctgactcatt

SEQ ID NO: 288055 - DNA, 27 bp, Artificial Sequence
  Description of Artificial Sequence: Synthetic oligonucleotide
gggcttggcactgggcctgactcattt

SEQ ID NO: 288056 - DNA, 28 bp, Artificial Sequence
  Description of Artificial Sequence: Synthetic oligonucleotide
ggcttggcactgggcctgactcatttag

SEQ ID NO: 288057 - DNA, 28 bp, Artificial Sequence
  Description of Artificial Sequence: Synthetic oligonucleotide
gcttggcactgggcctgactcatttagg

SEQ ID NO: 288058 - DNA, 28 bp, Artificial Sequence
  Description of Artificial Sequence: Synthetic oligonucleotide
cttggcactgggcctgactcatttaggg

SEQ ID NO: 288059 - DNA, 30 bp, Artificial Sequence
  Description of Artificial Sequence: Synthetic oligonucleotide
ttggcactgggcctgactcatttagggtag

SEQ ID NO: 288060 - DNA, 29 bp, Artificial Sequence
  Description of Artificial Sequence: Synthetic oligonucleotide
tggcactgggcctgactcatttagggtag

SEQ ID NO: 288061 - DNA, 28 bp, Artificial Sequence
  Description of Artificial Sequence: Synthetic oligonucleotide
ggcactgggcctgactcatttagggtag

SEQ ID NO: 288062 - DNA, 28 bp, Artificial Sequence
  Description of Artificial Sequence: Synthetic oligonucleotide
gcactgggcctgactcatttagggtagg

SEQ ID NO: 288063 - DNA, 28 bp, Artificial Sequence
  Description of Artificial Sequence: Synthetic oligonucleotide
cactgggcctgactcatttagggtaggg

SEQ ID NO: 288064 - DNA, 28 bp, Artificial Sequence
  Description of Artificial Sequence: Synthetic oligonucleotide
actgggcctgactcatttagggtagggc

SEQ ID NO: 288065 - DNA, 27 bp, Artificial Sequence
  Description of Artificial Sequence: Synthetic oligonucleotide
ctgggcctgactcatttagggtagggc

SEQ ID NO: 288066 - DNA, 28 bp, Artificial Sequence
  Description of Artificial Sequence: Synthetic oligonucleotide
tgggcctgactcatttagggtagggcac

SEQ ID NO: 288067 - DNA, 27 bp, Artificial Sequence
  Description of Artificial Sequence: Synthetic oligonucleotide
gggcctgactcatttagggtagggcac

SEQ ID NO: 288068 - DNA, 27 bp, Artificial Sequence
  Description of Artificial Sequence: Synthetic oligonucleotide
ggcctgactcatttagggtagggcacc

SEQ ID NO: 288069 - DNA, 27 bp, Artificial Sequence
  Description of Artificial Sequence: Synthetic oligonucleotide
gcctgactcatttagggtagggcaccc

SEQ ID NO: 288070 - DNA, 30 bp, Artificial Sequence
  Description of Artificial Sequence: Synthetic oligonucleotide
cctgactcatttagggtagggcacccatac

SEQ ID NO: 288071 - DNA, 30 bp, Artificial Sequence
  Description of Artificial Sequence: Synthetic oligonucleotide
ctgactcatttagggtagggcacccatacc

SEQ ID NO: 288072 - DNA, 30 bp, Artificial Sequence
  Description of Artificial Sequence: Synthetic oligonucleotide
tgactcatttagggtagggcacccataccc

SEQ ID NO: 288073 - DNA, 29 bp, Artificial Sequence
  Description of Artificial Sequence: Synthetic oligonucleotide
gactcatttagggtagggcacccataccc

SEQ ID NO: 288074 - DNA, 30 bp, Artificial Sequence
  Description of Artificial Sequence: Synthetic oligonucleotide
actcatttagggtagggcacccataccctc

SEQ ID NO: 288075 - DNA, 29 bp, Artificial Sequence
  Description of Artificial Sequence: Synthetic oligonucleotide
ctcatttagggtagggcacccataccctc

SEQ ID NO: 288076 - DNA, 30 bp, Artificial Sequence
  Description of Artificial Sequence: Synthetic oligonucleotide
tcatttagggtagggcacccataccctctg

SEQ ID NO: 288077 - DNA, 29 bp, Artificial Sequence
  Description of Artificial Sequence: Synthetic oligonucleotide
catttagggtagggcacccataccctctg

SEQ ID NO: 288078 - DNA, 29 bp, Artificial Sequence
  Description of Artificial Sequence: Synthetic oligonucleotide
atttagggtagggcacccataccctctgg

SEQ ID NO: 288079 - DNA, 28 bp, Artificial Sequence
  Description of Artificial Sequence: Synthetic oligonucleotide
tttagggtagggcacccataccctctgg

SEQ ID NO: 288080 - DNA, 27 bp, Artificial Sequence
  Description of Artificial Sequence: Synthetic oligonucleotide
ttagggtagggcacccataccctctgg

SEQ ID NO: 288081 - DNA, 26 bp, Artificial Sequence
  Description of Artificial Sequence: Synthetic oligonucleotide
tagggtagggcacccataccctctgg

SEQ ID NO: 288082 - DNA, 25 bp, Artificial Sequence
  Description of Artificial Sequence: Synthetic oligonucleotide
agggtagggcacccataccctctgg

SEQ ID NO: 288083 - DNA, 24 bp, Artificial Sequence
  Description of Artificial Sequence: Synthetic oligonucleotide
gggtagggcacccataccctctgg

SEQ ID NO: 288084 - DNA, 24 bp, Artificial Sequence
  Description of Artificial Sequence: Synthetic oligonucleotide
ggtagggcacccataccctctggc

SEQ ID NO: 288085 - DNA, 24 bp, Artificial Sequence
  Description of Artificial Sequence: Synthetic oligonucleotide
gtagggcacccataccctctggcc

SEQ ID NO: 288086 - DNA, 26 bp, Artificial Sequence
  Description of Artificial Sequence: Synthetic oligonucleotide
tagggcacccataccctctggcccta

SEQ ID NO: 288087 - DNA, 25 bp, Artificial Sequence
  Description of Artificial Sequence: Synthetic oligonucleotide
agggcacccataccctctggcccta

SEQ ID NO: 288088 - DNA, 24 bp, Artificial Sequence
  Description of Artificial Sequence: Synthetic oligonucleotide
gggcacccataccctctggcccta

SEQ ID NO: 288089 - DNA, 24 bp, Artificial Sequence
  Description of Artificial Sequence: Synthetic oligonucleotide
ggcacccataccctctggccctac

SEQ ID NO: 288090 - DNA, 25 bp, Artificial Sequence
  Description of Artificial Sequence: Synthetic oligonucleotide
gcacccataccctctggccctacca

SEQ ID NO: 288091 - DNA, 26 bp, Artificial Sequence
  Description of Artificial Sequence: Synthetic oligonucleotide
cacccataccctctggccctaccact

SEQ ID NO: 288092 - DNA, 26 bp, Artificial Sequence
  Description of Artificial Sequence: Synthetic oligonucleotide
acccataccctctggccctaccactg

SEQ ID NO: 288093 - DNA, 25 bp, Artificial Sequence
  Description of Artificial Sequence: Synthetic oligonucleotide
cccataccctctggccctaccactg

SEQ ID NO: 288094 - DNA, 25 bp, Artificial Sequence
  Description of Artificial Sequence: Synthetic oligonucleotide
ccataccctctggccctaccactgc

SEQ ID NO: 288095 - DNA, 26 bp, Artificial Sequence
  Description of Artificial Sequence: Synthetic oligonucleotide
cataccctctggccctaccactgcga

SEQ ID NO: 288096 - DNA, 26 bp, Artificial Sequence
  Description of Artificial Sequence: Synthetic oligonucleotide
ataccctctggccctaccactgcgac

SEQ ID NO: 288097 - DNA, 25 bp, Artificial Sequence
  Description of Artificial Sequence: Synthetic oligonucleotide
taccctctggccctaccactgcgac

SEQ ID NO: 288098 - DNA, 24 bp, Artificial Sequence
  Description of Artificial Sequence: Synthetic oligonucleotide
accctctggccctaccactgcgac

SEQ ID NO: 288099 - DNA, 23 bp, Artificial Sequence
  Description of Artificial Sequence: Synthetic oligonucleotide
ccctctggccctaccactgcgac

SEQ ID NO: 288100 - DNA, 23 bp, Artificial Sequence
  Description of Artificial Sequence: Synthetic oligonucleotide
cctctggccctaccactgcgacc

SEQ ID NO: 288101 - DNA, 23 bp, Artificial Sequence
  Description of Artificial Sequence: Synthetic oligonucleotide
ctctggccctaccactgcgaccg

SEQ ID NO: 288102 - DNA, 23 bp, Artificial Sequence
  Description of Artificial Sequence: Synthetic oligonucleotide
tctggccctaccactgcgaccgg

SEQ ID NO: 288103 - DNA, 22 bp, Artificial Sequence
  Description of Artificial Sequence: Synthetic oligonucleotide
ctggccctaccactgcgaccgg

SEQ ID NO: 288104 - DNA, 23 bp, Artificial Sequence
  Description of Artificial Sequence: Synthetic oligonucleotide
tggccctaccactgcgaccggct

SEQ ID NO: 288105 - DNA, 22 bp, Artificial Sequence
  Description of Artificial Sequence: Synthetic oligonucleotide
ggccctaccactgcgaccggct

SEQ ID NO: 288106 - DNA, 22 bp, Artificial Sequence
  Description of Artificial Sequence: Synthetic oligonucleotide
gccctaccactgcgaccggctg

SEQ ID NO: 288107 - DNA, 26 bp, Artificial Sequence
  Description of Artificial Sequence: Synthetic oligonucleotide
ccctaccactgcgaccggctgcttat

SEQ ID NO: 288108 - DNA, 27 bp, Artificial Sequence
  Description of Artificial Sequence: Synthetic oligonucleotide
cctaccactgcgaccggctgcttatga

SEQ ID NO: 288109 - DNA, 27 bp, Artificial Sequence
  Description of Artificial Sequence: Synthetic oligonucleotide
ctaccactgcgaccggctgcttatgag

SEQ ID NO: 288110 - DNA, 27 bp, Artificial Sequence
  Description of Artificial Sequence: Synthetic oligonucleotide
taccactgcgaccggctgcttatgagg

SEQ ID NO: 288111 - DNA, 26 bp, Artificial Sequence
  Description of Artificial Sequence: Synthetic oligonucleotide
accactgcgaccggctgcttatgagg

SEQ ID NO: 288112 - DNA, 25 bp, Artificial Sequence
  Description of Artificial Sequence: Synthetic oligonucleotide
ccactgcgaccggctgcttatgagg

SEQ ID NO: 288113 - DNA, 26 bp, Artificial Sequence
  Description of Artificial Sequence: Synthetic oligonucleotide
cactgcgaccggctgcttatgaggca

SEQ ID NO: 288114 - DNA, 26 bp, Artificial Sequence
  Description of Artificial Sequence: Synthetic oligonucleotide
actgcgaccggctgcttatgaggcag

SEQ ID NO: 288115 - DNA, 25 bp, Artificial Sequence
  Description of Artificial Sequence: Synthetic oligonucleotide
ctgcgaccggctgcttatgaggcag

SEQ ID NO: 288116 - DNA, 26 bp, Artificial Sequence
  Description of Artificial Sequence: Synthetic oligonucleotide
tgcgaccggctgcttatgaggcaggt

SEQ ID NO: 288117 - DNA, 25 bp, Artificial Sequence
  Description of Artificial Sequence: Synthetic oligonucleotide
gcgaccggctgcttatgaggcaggt

SEQ ID NO: 288118 - DNA, 25 bp, Artificial Sequence
  Description of Artificial Sequence: Synthetic oligonucleotide
cgaccggctgcttatgaggcaggtg

SEQ ID NO: 288119 - DNA, 25 bp, Artificial Sequence
  Description of Artificial Sequence: Synthetic oligonucleotide
gaccggctgcttatgaggcaggtgg

SEQ ID NO: 288120 - DNA, 25 bp, Artificial Sequence
  Description of Artificial Sequence: Synthetic oligonucleotide
accggctgcttatgaggcaggtggc

SEQ ID NO: 288121 - DNA, 24 bp, Artificial Sequence
  Description of Artificial Sequence: Synthetic oligonucleotide
ccggctgcttatgaggcaggtggc

SEQ ID NO: 288122 - DNA, 24 bp, Artificial Sequence
  Description of Artificial Sequence: Synthetic oligonucleotide
cggctgcttatgaggcaggtggcc

SEQ ID NO: 288123 - DNA, 25 bp, Artificial Sequence
  Description of Artificial Sequence: Synthetic oligonucleotide
ggctgcttatgaggcaggtggccct

SEQ ID NO: 288124 - DNA, 25 bp, Artificial Sequence
  Description of Artificial Sequence: Synthetic oligonucleotide
gctgcttatgaggcaggtggccctg

SEQ ID NO: 288125 - DNA, 25 bp, Artificial Sequence
  Description of Artificial Sequence: Synthetic oligonucleotide
ctgcttatgaggcaggtggccctgg

SEQ ID NO: 288126 - DNA, 26 bp, Artificial Sequence
  Description of Artificial Sequence: Synthetic oligonucleotide
tgcttatgaggcaggtggccctggct

SEQ ID NO: 288127 - DNA, 25 bp, Artificial Sequence
  Description of Artificial Sequence: Synthetic oligonucleotide
gcttatgaggcaggtggccctggct

SEQ ID NO: 288128 - DNA, 25 bp, Artificial Sequence
  Description of Artificial Sequence: Synthetic oligonucleotide
cttatgaggcaggtggccctggctg

SEQ ID NO: 288129 - DNA, 26 bp, Artificial Sequence
  Description of Artificial Sequence: Synthetic oligonucleotide
ttatgaggcaggtggccctggctgga

SEQ ID NO: 288130 - DNA, 25 bp, Artificial Sequence
  Description of Artificial Sequence: Synthetic oligonucleotide
tatgaggcaggtggccctggctgga

SEQ ID NO: 288131 - DNA, 24 bp, Artificial Sequence
  Description of Artificial Sequence: Synthetic oligonucleotide
atgaggcaggtggccctggctgga

SEQ ID NO: 288132 - DNA, 23 bp, Artificial Sequence
  Description of Artificial Sequence: Synthetic oligonucleotide
tgaggcaggtggccctggctgga

SEQ ID NO: 288133 - DNA, 22 bp, Artificial Sequence
  Description of Artificial Sequence: Synthetic oligonucleotide
gaggcaggtggccctggctgga

SEQ ID NO: 288134 - DNA, 23 bp, Artificial Sequence
  Description of Artificial Sequence: Synthetic oligonucleotide
aggcaggtggccctggctggaca

SEQ ID NO: 288135 - DNA, 22 bp, Artificial Sequence
  Description of Artificial Sequence: Synthetic oligonucleotide
ggcaggtggccctggctggaca

SEQ ID NO: 288136 - DNA, 22 bp, Artificial Sequence
  Description of Artificial Sequence: Synthetic oligonucleotide
gcaggtggccctggctggacag

SEQ ID NO: 288137 - DNA, 23 bp, Artificial Sequence
  Description of Artificial Sequence: Synthetic oligonucleotide
caggtggccctggctggacagct

SEQ ID NO: 288138 - DNA, 24 bp, Artificial Sequence
  Description of Artificial Sequence: Synthetic oligonucleotide
aggtggccctggctggacagctca

SEQ ID NO: 288139 - DNA, 23 bp, Artificial Sequence
  Description of Artificial Sequence: Synthetic oligonucleotide
ggtggccctggctggacagctca

SEQ ID NO: 288140 - DNA, 24 bp, Artificial Sequence
  Description of Artificial Sequence: Synthetic oligonucleotide
gtggccctggctggacagctcact

SEQ ID NO: 288141 - DNA, 25 bp, Artificial Sequence
  Description of Artificial Sequence: Synthetic oligonucleotide
tggccctggctggacagctcactgt

SEQ ID NO: 288142 - DNA, 24 bp, Artificial Sequence
  Description of Artificial Sequence: Synthetic oligonucleotide
ggccctggctggacagctcactgt

SEQ ID NO: 288143 - DNA, 24 bp, Artificial Sequence
  Description of Artificial Sequence: Synthetic oligonucleotide
gccctggctggacagctcactgtc

SEQ ID NO: 288144 - DNA, 26 bp, Artificial Sequence
  Description of Artificial Sequence: Synthetic oligonucleotide
ccctggctggacagctcactgtcctt

SEQ ID NO: 288145 - DNA, 27 bp, Artificial Sequence
  Description of Artificial Sequence: Synthetic oligonucleotide
cctggctggacagctcactgtccttgt

SEQ ID NO: 288146 - DNA, 27 bp, Artificial Sequence
  Description of Artificial Sequence: Synthetic oligonucleotide
ctggctggacagctcactgtccttgtc

SEQ ID NO: 288147 - DNA, 28 bp, Artificial Sequence
  Description of Artificial Sequence: Synthetic oligonucleotide
tggctggacagctcactgtccttgtctc

SEQ ID NO: 288148 - DNA, 27 bp, Artificial Sequence
  Description of Artificial Sequence: Synthetic oligonucleotide
ggctggacagctcactgtccttgtctc

SEQ ID NO: 288149 - DNA, 30 bp, Artificial Sequence
  Description of Artificial Sequence: Synthetic oligonucleotide
gctggacagctcactgtccttgtctctatc

SEQ ID NO: 288150 - DNA, 30 bp, Artificial Sequence
  Description of Artificial Sequence: Synthetic oligonucleotide
ctggacagctcactgtccttgtctctatcc

SEQ ID NO: 288151 - DNA, 31 bp, Artificial Sequence
  Description of Artificial Sequence: Synthetic oligonucleotide
tggacagctcactgtccttgtctctatcctg

SEQ ID NO: 288152 - DNA, 30 bp, Artificial Sequence
  Description of Artificial Sequence: Synthetic oligonucleotide
ggacagctcactgtccttgtctctatcctg

SEQ ID NO: 288153 - DNA, 30 bp, Artificial Sequence
  Description of Artificial Sequence: Synthetic oligonucleotide
gacagctcactgtccttgtctctatcctgg

SEQ ID NO: 288154 - DNA, 32 bp, Artificial Sequence
  Description of Artificial Sequence: Synthetic oligonucleotide
acagctcactgtccttgtctctatcctggatg

SEQ ID NO: 288155 - DNA, 31 bp, Artificial Sequence
  Description of Artificial Sequence: Synthetic oligonucleotide
cagctcactgtccttgtctctatcctggatg

SEQ ID NO: 288156 - DNA, 33 bp, Artificial Sequence
  Description of Artificial Sequence: Synthetic oligonucleotide
agctcactgtccttgtctctatcctggatgatc

SEQ ID NO: 288157 - DNA, 32 bp, Artificial Sequence
  Description of Artificial Sequence: Synthetic oligonucleotide
gctcactgtccttgtctctatcctggatgatc

SEQ ID NO: 288158 - DNA, 32 bp, Artificial Sequence
  Description of Artificial Sequence: Synthetic oligonucleotide
ctcactgtccttgtctctatcctggatgatcg

SEQ ID NO: 288159 - DNA, 35 bp, Artificial Sequence
  Description of Artificial Sequence: Synthetic oligonucleotide
tcactgtccttgtctctatcctggatgatcgaaac

SEQ ID NO: 288160 - DNA, 34 bp, Artificial Sequence
  Description of Artificial Sequence: Synthetic oligonucleotide
cactgtccttgtctctatcctggatgatcgaaac

SEQ ID NO: 288161 - DNA, 40 bp, Artificial Sequence
  Description of Artificial Sequence: Synthetic oligonucleotide
actgtccttgtctctatcctggatgatcgaaacataattc

SEQ ID NO: 288162 - DNA, 39 bp, Artificial Sequence
  Description of Artificial Sequence: Synthetic oligonucleotide
ctgtccttgtctctatcctggatgatcgaaacataattc

SEQ ID NO: 288163 - DNA, 41 bp, Artificial Sequence
  Description of Artificial Sequence: Synthetic oligonucleotide
tgtccttgtctctatcctggatgatcgaaacataattctag

SEQ ID NO: 288164 - DNA, 40 bp, Artificial Sequence
  Description of Artificial Sequence: Synthetic oligonucleotide
gtccttgtctctatcctggatgatcgaaacataattctag

SEQ ID NO: 288165 - DNA, 40 bp, Artificial Sequence
  Description of Artificial Sequence: Synthetic oligonucleotide
tccttgtctctatcctggatgatcgaaacataattctagg

SEQ ID NO: 288166 - DNA, 39 bp, Artificial Sequence
  Description of Artificial Sequence: Synthetic oligonucleotide
ccttgtctctatcctggatgatcgaaacataattctagg

SEQ ID NO: 288167 - DNA, 39 bp, Artificial Sequence
  Description of Artificial Sequence: Synthetic oligonucleotide
cttgtctctatcctggatgatcgaaacataattctaggc

SEQ ID NO: 288168 - DNA, 43 bp, Artificial Sequence
  Description of Artificial Sequence: Synthetic oligonucleotide
ttgtctctatcctggatgatcgaaacataattctaggctaatc

SEQ ID NO: 288169 - DNA, 42 bp, Artificial Sequence
  Description of Artificial Sequence: Synthetic oligonucleotide
tgtctctatcctggatgatcgaaacataattctaggctaatc

SEQ ID NO: 288170 - DNA, 41 bp, Artificial Sequence
  Description of Artificial Sequence: Synthetic oligonucleotide
gtctctatcctggatgatcgaaacataattctaggctaatc

SEQ ID NO: 288171 - DNA, 42 bp, Artificial Sequence
  Description of Artificial Sequence: Synthetic oligonucleotide
tctctatcctggatgatcgaaacataattctaggctaatcac

SEQ ID NO: 288172 - DNA, 41 bp, Artificial Sequence
  Description of Artificial Sequence: Synthetic oligonucleotide
ctctatcctggatgatcgaaacataattctaggctaatcac

SEQ ID NO: 288173 - DNA, 42 bp, Artificial Sequence
  Description of Artificial Sequence: Synthetic oligonucleotide
tctatcctggatgatcgaaacataattctaggctaatcacac

SEQ ID NO: 288174 - DNA, 41 bp, Artificial Sequence
  Description of Artificial Sequence: Synthetic oligonucleotide
ctatcctggatgatcgaaacataattctaggctaatcacac

SEQ ID NO: 288175 - DNA, 44 bp, Artificial Sequence
  Description of Artificial Sequence: Synthetic oligonucleotide
tatcctggatgatcgaaacataattctaggctaatcacactttg

SEQ ID NO: 288176 - DNA, 43 bp, Artificial Sequence
  Description of Artificial Sequence: Synthetic oligonucleotide
atcctggatgatcgaaacataattctaggctaatcacactttg

SEQ ID NO: 288177 - DNA, 42 bp, Artificial Sequence
  Description of Artificial Sequence: Synthetic oligonucleotide
tcctggatgatcgaaacataattctaggctaatcacactttg

SEQ ID NO: 288178 - DNA, 41 bp, Artificial Sequence
  Description of Artificial Sequence: Synthetic oligonucleotide
cctggatgatcgaaacataattctaggctaatcacactttg

SEQ ID NO: 288179 - DNA, 45 bp, Artificial Sequence
  Description of Artificial Sequence: Synthetic oligonucleotide
ctggatgatcgaaacataattctaggctaatcacactttgtattg

SEQ ID NO: 288180 - DNA, 48 bp, Artificial Sequence
  Description of Artificial Sequence: Synthetic oligonucleotide
tggatgatcgaaacataattctaggctaatcacactttgtattgtaag

SEQ ID NO: 288181 - DNA, 47 bp, Artificial Sequence
  Description of Artificial Sequence: Synthetic oligonucleotide
ggatgatcgaaacataattctaggctaatcacactttgtattgtaag

SEQ ID NO: 288182 - DNA, 47 bp, Artificial Sequence
  Description of Artificial Sequence: Synthetic oligonucleotide
gatgatcgaaacataattctaggctaatcacactttgtattgtaagg

SEQ ID NO: 288183 - DNA, 47 bp, Artificial Sequence
  Description of Artificial Sequence: Synthetic oligonucleotide
atgatcgaaacataattctaggctaatcacactttgtattgtaaggg

SEQ ID NO: 288184 - DNA, 46 bp, Artificial Sequence
  Description of Artificial Sequence: Synthetic oligonucleotide
tgatcgaaacataattctaggctaatcacactttgtattgtaaggg

SEQ ID NO: 288185 - DNA, 45 bp, Artificial Sequence
  Description of Artificial Sequence: Synthetic oligonucleotide
gatcgaaacataattctaggctaatcacactttgtattgtaaggg

SEQ ID NO: 288186 - DNA, 45 bp, Artificial Sequence
  Description of Artificial Sequence: Synthetic oligonucleotide
atcgaaacataattctaggctaatcacactttgtattgtaagggc

SEQ ID NO: 288187 - DNA, 44 bp, Artificial Sequence
  Description of Artificial Sequence: Synthetic oligonucleotide
tcgaaacataattctaggctaatcacactttgtattgtaagggc

SEQ ID NO: 288188 - DNA, 43 bp, Artificial Sequence
  Description of Artificial Sequence: Synthetic oligonucleotide
cgaaacataattctaggctaatcacactttgtattgtaagggc

SEQ ID NO: 288189 - DNA, 44 bp, Artificial Sequence
  Description of Artificial Sequence: Synthetic oligonucleotide
gaaacataattctaggctaatcacactttgtattgtaagggctg

SEQ ID NO: 288190 - DNA, 44 bp, Artificial Sequence
  Description of Artificial Sequence: Synthetic oligonucleotide
aaacataattctaggctaatcacactttgtattgtaagggctgg

SEQ ID NO: 288191 - DNA, 43 bp, Artificial Sequence
  Description of Artificial Sequence: Synthetic oligonucleotide
aacataattctaggctaatcacactttgtattgtaagggctgg

SEQ ID NO: 288192 - DNA, 42 bp, Artificial Sequence
  Description of Artificial Sequence: Synthetic oligonucleotide
acataattctaggctaatcacactttgtattgtaagggctgg

SEQ ID NO: 288193 - DNA, 41 bp, Artificial Sequence
  Description of Artificial Sequence: Synthetic oligonucleotide
cataattctaggctaatcacactttgtattgtaagggctgg

SEQ ID NO: 288194 - DNA, 42 bp, Artificial Sequence
  Description of Artificial Sequence: Synthetic oligonucleotide
ataattctaggctaatcacactttgtattgtaagggctggtg

SEQ ID NO: 288195 - DNA, 41 bp, Artificial Sequence
  Description of Artificial Sequence: Synthetic oligonucleotide
taattctaggctaatcacactttgtattgtaagggctggtg

SEQ ID NO: 288196 - DNA, 40 bp, Artificial Sequence
  Description of Artificial Sequence: Synthetic oligonucleotide
aattctaggctaatcacactttgtattgtaagggctggtg

SEQ ID NO: 288197 - DNA, 39 bp, Artificial Sequence
  Description of Artificial Sequence: Synthetic oligonucleotide
attctaggctaatcacactttgtattgtaagggctggtg

SEQ ID NO: 288198 - DNA, 38 bp, Artificial Sequence
  Description of Artificial Sequence: Synthetic oligonucleotide
ttctaggctaatcacactttgtattgtaagggctggtg

SEQ ID NO: 288199 - DNA, 37 bp, Artificial Sequence
  Description of Artificial Sequence: Synthetic oligonucleotide
tctaggctaatcacactttgtattgtaagggctggtg

SEQ ID NO: 288200 - DNA, 36 bp, Artificial Sequence
  Description of Artificial Sequence: Synthetic oligonucleotide
ctaggctaatcacactttgtattgtaagggctggtg

SEQ ID NO: 288201 - DNA, 36 bp, Artificial Sequence
  Description of Artificial Sequence: Synthetic oligonucleotide
taggctaatcacactttgtattgtaagggctggtgc

SEQ ID NO: 288202 - DNA, 35 bp, Artificial Sequence
  Description of Artificial Sequence: Synthetic oligonucleotide
aggctaatcacactttgtattgtaagggctggtgc

SEQ ID NO: 288203 - DNA, 34 bp, Artificial Sequence
  Description of Artificial Sequence: Synthetic oligonucleotide
ggctaatcacactttgtattgtaagggctggtgc

SEQ ID NO: 288204 - DNA, 34 bp, Artificial Sequence
  Description of Artificial Sequence: Synthetic oligonucleotide
gctaatcacactttgtattgtaagggctggtgcc

SEQ ID NO: 288205 - DNA, 35 bp, Artificial Sequence
  Description of Artificial Sequence: Synthetic oligonucleotide
ctaatcacactttgtattgtaagggctggtgcctg

SEQ ID NO: 288206 - DNA, 35 bp, Artificial Sequence
  Description of Artificial Sequence: Synthetic oligonucleotide
taatcacactttgtattgtaagggctggtgcctgc

SEQ ID NO: 288207 - DNA, 34 bp, Artificial Sequence
  Description of Artificial Sequence: Synthetic oligonucleotide
aatcacactttgtattgtaagggctggtgcctgc

SEQ ID NO: 288208 - DNA, 33 bp, Artificial Sequence
  Description of Artificial Sequence: Synthetic oligonucleotide
atcacactttgtattgtaagggctggtgcctgc

SEQ ID NO: 288209 - DNA, 32 bp, Artificial Sequence
  Description of Artificial Sequence: Synthetic oligonucleotide
tcacactttgtattgtaagggctggtgcctgc

SEQ ID NO: 288210 - DNA, 31 bp, Artificial Sequence
  Description of Artificial Sequence: Synthetic oligonucleotide
cacactttgtattgtaagggctggtgcctgc

SEQ ID NO: 288211 - DNA, 31 bp, Artificial Sequence
  Description of Artificial Sequence: Synthetic oligonucleotide
acactttgtattgtaagggctggtgcctgcc

SEQ ID NO: 288212 - DNA, 30 bp, Artificial Sequence
  Description of Artificial Sequence: Synthetic oligonucleotide
cactttgtattgtaagggctggtgcctgcc

SEQ ID NO: 288213 - DNA, 32 bp, Artificial Sequence
  Description of Artificial Sequence: Synthetic oligonucleotide
actttgtattgtaagggctggtgcctgccatg

SEQ ID NO: 288214 - DNA, 31 bp, Artificial Sequence
  Description of Artificial Sequence: Synthetic oligonucleotide
ctttgtattgtaagggctggtgcctgccatg

SEQ ID NO: 288215 - DNA, 31 bp, Artificial Sequence
  Description of Artificial Sequence: Synthetic oligonucleotide
tttgtattgtaagggctggtgcctgccatgc

SEQ ID NO: 288216 - DNA, 30 bp, Artificial Sequence
  Description of Artificial Sequence: Synthetic oligonucleotide
ttgtattgtaagggctggtgcctgccatgc

SEQ ID NO: 288217 - DNA, 29 bp, Artificial Sequence
  Description of Artificial Sequence: Synthetic oligonucleotide
tgtattgtaagggctggtgcctgccatgc

SEQ ID NO: 288218 - DNA, 28 bp, Artificial Sequence
  Description of Artificial Sequence: Synthetic oligonucleotide
gtattgtaagggctggtgcctgccatgc

SEQ ID NO: 288219 - DNA, 29 bp, Artificial Sequence
  Description of Artificial Sequence: Synthetic oligonucleotide
tattgtaagggctggtgcctgccatgctg

SEQ ID NO: 288220 - DNA, 28 bp, Artificial Sequence
  Description of Artificial Sequence: Synthetic oligonucleotide
attgtaagggctggtgcctgccatgctg

SEQ ID NO: 288221 - DNA, 27 bp, Artificial Sequence
  Description of Artificial Sequence: Synthetic oligonucleotide
ttgtaagggctggtgcctgccatgctg

SEQ ID NO: 288222 - DNA, 26 bp, Artificial Sequence
  Description of Artificial Sequence: Synthetic oligonucleotide
tgtaagggctggtgcctgccatgctg

SEQ ID NO: 288223 - DNA, 25 bp, Artificial Sequence
  Description of Artificial Sequence: Synthetic oligonucleotide
gtaagggctggtgcctgccatgctg

SEQ ID NO: 288224 - DNA, 25 bp, Artificial Sequence
  Description of Artificial Sequence: Synthetic oligonucleotide
taagggctggtgcctgccatgctgc

SEQ ID NO: 288225 - DNA, 24 bp, Artificial Sequence
  Description of Artificial Sequence: Synthetic oligonucleotide
aagggctggtgcctgccatgctgc

SEQ ID NO: 288226 - DNA, 23 bp, Artificial Sequence
  Description of Artificial Sequence: Synthetic oligonucleotide
agggctggtgcctgccatgctgc

SEQ ID NO: 288227 - DNA, 22 bp, Artificial Sequence
  Description of Artificial Sequence: Synthetic oligonucleotide
gggctggtgcctgccatgctgc

SEQ ID NO: 288228 - DNA, 22 bp, Artificial Sequence
  Description of Artificial Sequence: Synthetic oligonucleotide
ggctggtgcctgccatgctgcc

SEQ ID NO: 288229 - DNA, 22 bp, Artificial Sequence
  Description of Artificial Sequence: Synthetic oligonucleotide
gctggtgcctgccatgctgccc

SEQ ID NO: 288230 - DNA, 22 bp, Artificial Sequence
  Description of Artificial Sequence: Synthetic oligonucleotide
ctggtgcctgccatgctgcccc

SEQ ID NO: 288231 - DNA, 25 bp, Artificial Sequence
  Description of Artificial Sequence: Synthetic oligonucleotide
tggtgcctgccatgctgccccgaat

SEQ ID NO: 288232 - DNA, 24 bp, Artificial Sequence
  Description of Artificial Sequence: Synthetic oligonucleotide
ggtgcctgccatgctgccccgaat

SEQ ID NO: 288233 - DNA, 24 bp, Artificial Sequence
  Description of Artificial Sequence: Synthetic oligonucleotide
gtgcctgccatgctgccccgaatc

SEQ ID NO: 288234 - DNA, 25 bp, Artificial Sequence
  Description of Artificial Sequence: Synthetic oligonucleotide
tgcctgccatgctgccccgaatcct

SEQ ID NO: 288235 - DNA, 24 bp, Artificial Sequence
  Description of Artificial Sequence: Synthetic oligonucleotide
gcctgccatgctgccccgaatcct

SEQ ID NO: 288236 - DNA, 24 bp, Artificial Sequence
  Description of Artificial Sequence: Synthetic oligonucleotide
cctgccatgctgccccgaatcctg

SEQ ID NO: 288237 - DNA, 27 bp, Artificial Sequence
  Description of Artificial Sequence: Synthetic oligonucleotide
ctgccatgctgccccgaatcctggtta

SEQ ID NO: 288238 - DNA, 27 bp, Artificial Sequence
  Description of Artificial Sequence: Synthetic oligonucleotide
tgccatgctgccccgaatcctggttac

SEQ ID NO: 288239 - DNA, 26 bp, Artificial Sequence
  Description of Artificial Sequence: Synthetic oligonucleotide
gccatgctgccccgaatcctggttac

SEQ ID NO: 288240 - DNA, 27 bp, Artificial Sequence
  Description of Artificial Sequence: Synthetic oligonucleotide
ccatgctgccccgaatcctggttacga

SEQ ID NO: 288241 - DNA, 29 bp, Artificial Sequence
  Description of Artificial Sequence: Synthetic oligonucleotide
catgctgccccgaatcctggttacgattg

SEQ ID NO: 288242 - DNA, 31 bp, Artificial Sequence
  Description of Artificial Sequence: Synthetic oligonucleotide
atgctgccccgaatcctggttacgattgatg

SEQ ID NO: 288243 - DNA, 30 bp, Artificial Sequence
  Description of Artificial Sequence: Synthetic oligonucleotide
tgctgccccgaatcctggttacgattgatg

SEQ ID NO: 288244 - DNA, 29 bp, Artificial Sequence
  Description of Artificial Sequence: Synthetic oligonucleotide
gctgccccgaatcctggttacgattgatg

SEQ ID NO: 288245 - DNA, 30 bp, Artificial Sequence
  Description of Artificial Sequence: Synthetic oligonucleotide
ctgccccgaatcctggttacgattgatgag

SEQ ID NO: 288246 - DNA, 30 bp, Artificial Sequence
  Description of Artificial Sequence: Synthetic oligonucleotide
tgccccgaatcctggttacgattgatgagg

SEQ ID NO: 288247 - DNA, 29 bp, Artificial Sequence
  Description of Artificial Sequence: Synthetic oligonucleotide
gccccgaatcctggttacgattgatgagg

SEQ ID NO: 288248 - DNA, 30 bp, Artificial Sequence
  Description of Artificial Sequence: Synthetic oligonucleotide
ccccgaatcctggttacgattgatgaggtg

SEQ ID NO: 288249 - DNA, 30 bp, Artificial Sequence
  Description of Artificial Sequence: Synthetic oligonucleotide
cccgaatcctggttacgattgatgaggtgc

SEQ ID NO: 288250 - DNA, 31 bp, Artificial Sequence
  Description of Artificial Sequence: Synthetic oligonucleotide
ccgaatcctggttacgattgatgaggtgctg

SEQ ID NO: 288251 - DNA, 31 bp, Artificial Sequence
  Description of Artificial Sequence: Synthetic oligonucleotide
cgaatcctggttacgattgatgaggtgctgc

SEQ ID NO: 288252 - DNA, 31 bp, Artificial Sequence
  Description of Artificial Sequence: Synthetic oligonucleotide
gaatcctggttacgattgatgaggtgctgcg

SEQ ID NO: 288253 - DNA, 31 bp, Artificial Sequence
  Description of Artificial Sequence: Synthetic oligonucleotide
aatcctggttacgattgatgaggtgctgcgg

SEQ ID NO: 288254 - DNA, 30 bp, Artificial Sequence
  Description of Artificial Sequence: Synthetic oligonucleotide
atcctggttacgattgatgaggtgctgcgg

SEQ ID NO: 288255 - DNA, 29 bp, Artificial Sequence
  Description of Artificial Sequence: Synthetic oligonucleotide
tcctggttacgattgatgaggtgctgcgg

SEQ ID NO: 288256 - DNA, 28 bp, Artificial Sequence
  Description of Artificial Sequence: Synthetic oligonucleotide
cctggttacgattgatgaggtgctgcgg

SEQ ID NO: 288257 - DNA, 28 bp, Artificial Sequence
  Description of Artificial Sequence: Synthetic oligonucleotide
ctggttacgattgatgaggtgctgcggc

SEQ ID NO: 288258 - DNA, 28 bp, Artificial Sequence
  Description of Artificial Sequence: Synthetic oligonucleotide
tggttacgattgatgaggtgctgcggcc

SEQ ID NO: 288259 - DNA, 27 bp, Artificial Sequence
  Description of Artificial Sequence: Synthetic oligonucleotide
ggttacgattgatgaggtgctgcggcc

SEQ ID NO: 288260 - DNA, 30 bp, Artificial Sequence
  Description of Artificial Sequence: Synthetic oligonucleotide
gttacgattgatgaggtgctgcggcctttg

SEQ ID NO: 288261 - DNA, 30 bp, Artificial Sequence
  Description of Artificial Sequence: Synthetic oligonucleotide
ttacgattgatgaggtgctgcggcctttgc

SEQ ID NO: 288262 - DNA, 29 bp, Artificial Sequence
  Description of Artificial Sequence: Synthetic oligonucleotide
tacgattgatgaggtgctgcggcctttgc

SEQ ID NO: 288263 - DNA, 28 bp, Artificial Sequence
  Description of Artificial Sequence: Synthetic oligonucleotide
acgattgatgaggtgctgcggcctttgc

SEQ ID NO: 288264 - DNA, 27 bp, Artificial Sequence
  Description of Artificial Sequence: Synthetic oligonucleotide
cgattgatgaggtgctgcggcctttgc

SEQ ID NO: 288265 - DNA, 27 bp, Artificial Sequence
  Description of Artificial Sequence: Synthetic oligonucleotide
gattgatgaggtgctgcggcctttgcc

SEQ ID NO: 288266 - DNA, 28 bp, Artificial Sequence
  Description of Artificial Sequence: Synthetic oligonucleotide
attgatgaggtgctgcggcctttgccag

SEQ ID NO: 288267 - DNA, 27 bp, Artificial Sequence
  Description of Artificial Sequence: Synthetic oligonucleotide
ttgatgaggtgctgcggcctttgccag

SEQ ID NO: 288268 - DNA, 27 bp, Artificial Sequence
  Description of Artificial Sequence: Synthetic oligonucleotide
tgatgaggtgctgcggcctttgccagt

SEQ ID NO: 288269 - DNA, 26 bp, Artificial Sequence
  Description of Artificial Sequence: Synthetic oligonucleotide
gatgaggtgctgcggcctttgccagt

SEQ ID NO: 288270 - DNA, 27 bp, Artificial Sequence
  Description of Artificial Sequence: Synthetic oligonucleotide
atgaggtgctgcggcctttgccagtga

SEQ ID NO: 288271 - DNA, 26 bp, Artificial Sequence
  Description of Artificial Sequence: Synthetic oligonucleotide
tgaggtgctgcggcctttgccagtga

SEQ ID NO: 288272 - DNA, 25 bp, Artificial Sequence
  Description of Artificial Sequence: Synthetic oligonucleotide
gaggtgctgcggcctttgccagtga

SEQ ID NO: 288273 - DNA, 26 bp, Artificial Sequence
  Description of Artificial Sequence: Synthetic oligonucleotide
aggtgctgcggcctttgccagtgact

SEQ ID NO: 288274 - DNA, 25 bp, Artificial Sequence
  Description of Artificial Sequence: Synthetic oligonucleotide
ggtgctgcggcctttgccagtgact

SEQ ID NO: 288275 - DNA, 26 bp, Artificial Sequence
  Description of Artificial Sequence: Synthetic oligonucleotide
gtgctgcggcctttgccagtgactgt

SEQ ID NO: 288276 - DNA, 26 bp, Artificial Sequence
  Description of Artificial Sequence: Synthetic oligonucleotide
tgctgcggcctttgccagtgactgtc

SEQ ID NO: 288277 - DNA, 25 bp, Artificial Sequence
  Description of Artificial Sequence: Synthetic oligonucleotide
gctgcggcctttgccagtgactgtc

SEQ ID NO: 288278 - DNA, 25 bp, Artificial Sequence
  Description of Artificial Sequence: Synthetic oligonucleotide
ctgcggcctttgccagtgactgtcc

SEQ ID NO: 288279 - DNA, 26 bp, Artificial Sequence
  Description of Artificial Sequence: Synthetic oligonucleotide
tgcggcctttgccagtgactgtccgt

SEQ ID NO: 288280 - DNA, 25 bp, Artificial Sequence
  Description of Artificial Sequence: Synthetic oligonucleotide
gcggcctttgccagtgactgtccgt

SEQ ID NO: 288281 - DNA, 26 bp, Artificial Sequence
  Description of Artificial Sequence: Synthetic oligonucleotide
cggcctttgccagtgactgtccgtga

SEQ ID NO: 288282 - DNA, 26 bp, Artificial Sequence
  Description of Artificial Sequence: Synthetic oligonucleotide
ggcctttgccagtgactgtccgtgag

SEQ ID NO: 288283 - DNA, 26 bp, Artificial Sequence
  Description of Artificial Sequence: Synthetic oligonucleotide
gcctttgccagtgactgtccgtgagg

SEQ ID NO: 288284 - DNA, 26 bp, Artificial Sequence
  Description of Artificial Sequence: Synthetic oligonucleotide
cctttgccagtgactgtccgtgaggg

SEQ ID NO: 288285 - DNA, 26 bp, Artificial Sequence
  Description of Artificial Sequence: Synthetic oligonucleotide
ctttgccagtgactgtccgtgagggc

SEQ ID NO: 288286 - DNA, 27 bp, Artificial Sequence
  Description of Artificial Sequence: Synthetic oligonucleotide
tttgccagtgactgtccgtgagggcca

SEQ ID NO: 288287 - DNA, 26 bp, Artificial Sequence
  Description of Artificial Sequence: Synthetic oligonucleotide
ttgccagtgactgtccgtgagggcca

SEQ ID NO: 288288 - DNA, 25 bp, Artificial Sequence
  Description of Artificial Sequence: Synthetic oligonucleotide
tgccagtgactgtccgtgagggcca

SEQ ID NO: 288289 - DNA, 24 bp, Artificial Sequence
  Description of Artificial Sequence: Synthetic oligonucleotide
gccagtgactgtccgtgagggcca

SEQ ID NO: 288290 - DNA, 24 bp, Artificial Sequence
  Description of Artificial Sequence: Synthetic oligonucleotide
ccagtgactgtccgtgagggccag

SEQ ID NO: 288291 - DNA, 24 bp, Artificial Sequence
  Description of Artificial Sequence: Synthetic oligonucleotide
cagtgactgtccgtgagggccagg

SEQ ID NO: 288292 - DNA, 25 bp, Artificial Sequence
  Description of Artificial Sequence: Synthetic oligonucleotide
agtgactgtccgtgagggccaggct

SEQ ID NO: 288293 - DNA, 24 bp, Artificial Sequence
  Description of Artificial Sequence: Synthetic oligonucleotide
gtgactgtccgtgagggccaggct

SEQ ID NO: 288294 - DNA, 25 bp, Artificial Sequence
  Description of Artificial Sequence: Synthetic oligonucleotide
tgactgtccgtgagggccaggctgt

SEQ ID NO: 288295 - DNA, 24 bp, Artificial Sequence
  Description of Artificial Sequence: Synthetic oligonucleotide
gactgtccgtgagggccaggctgt

SEQ ID NO: 288296 - DNA, 24 bp, Artificial Sequence
  Description of Artificial Sequence: Synthetic oligonucleotide
actgtccgtgagggccaggctgtg

SEQ ID NO: 288297 - DNA, 23 bp, Artificial Sequence
  Description of Artificial Sequence: Synthetic oligonucleotide
ctgtccgtgagggccaggctgtg

SEQ ID NO: 288298 - DNA, 25 bp, Artificial Sequence
  Description of Artificial Sequence: Synthetic oligonucleotide
tgtccgtgagggccaggctgtggat

SEQ ID NO: 288299 - DNA, 24 bp, Artificial Sequence
  Description of Artificial Sequence: Synthetic oligonucleotide
gtccgtgagggccaggctgtggat

SEQ ID NO: 288300 - DNA, 25 bp, Artificial Sequence
  Description of Artificial Sequence: Synthetic oligonucleotide
tccgtgagggccaggctgtggatgt

SEQ ID NO: 288301 - DNA, 24 bp, Artificial Sequence
  Description of Artificial Sequence: Synthetic oligonucleotide
ccgtgagggccaggctgtggatgt

SEQ ID NO: 288302 - DNA, 24 bp, Artificial Sequence
  Description of Artificial Sequence: Synthetic oligonucleotide
cgtgagggccaggctgtggatgtg

SEQ ID NO: 288303 - DNA, 25 bp, Artificial Sequence
  Description of Artificial Sequence: Synthetic oligonucleotide
gtgagggccaggctgtggatgtgct

SEQ ID NO: 288304 - DNA, 25 bp, Artificial Sequence
  Description of Artificial Sequence: Synthetic oligonucleotide
tgagggccaggctgtggatgtgctg

SEQ ID NO: 288305 - DNA, 24 bp, Artificial Sequence
  Description of Artificial Sequence: Synthetic oligonucleotide
gagggccaggctgtggatgtgctg

SEQ ID NO: 288306 - DNA, 24 bp, Artificial Sequence
  Description of Artificial Sequence: Synthetic oligonucleotide
agggccaggctgtggatgtgctgg

SEQ ID NO: 288307 - DNA, 23 bp, Artificial Sequence
  Description of Artificial Sequence: Synthetic oligonucleotide
gggccaggctgtggatgtgctgg

SEQ ID NO: 288308 - DNA, 23 bp, Artificial Sequence
  Description of Artificial Sequence: Synthetic oligonucleotide
ggccaggctgtggatgtgctggg

SEQ ID NO: 288309 - DNA, 23 bp, Artificial Sequence
  Description of Artificial Sequence: Synthetic oligonucleotide
gccaggctgtggatgtgctgggc

SEQ ID NO: 288310 - DNA, 24 bp, Artificial Sequence
  Description of Artificial Sequence: Synthetic oligonucleotide
ccaggctgtggatgtgctgggcca

SEQ ID NO: 288311 - DNA, 24 bp, Artificial Sequence
  Description of Artificial Sequence: Synthetic oligonucleotide
caggctgtggatgtgctgggccag

SEQ ID NO: 288312 - DNA, 24 bp, Artificial Sequence
  Description of Artificial Sequence: Synthetic oligonucleotide
aggctgtggatgtgctgggccagg

SEQ ID NO: 288313 - DNA, 23 bp, Artificial Sequence
  Description of Artificial Sequence: Synthetic oligonucleotide
ggctgtggatgtgctgggccagg

SEQ ID NO: 288314 - DNA, 24 bp, Artificial Sequence
  Description of Artificial Sequence: Synthetic oligonucleotide
gctgtggatgtgctgggccagggt

SEQ ID NO: 288315 - DNA, 24 bp, Artificial Sequence
  Description of Artificial Sequence: Synthetic oligonucleotide
ctgtggatgtgctgggccagggtg

SEQ ID NO: 288316 - DNA, 24 bp, Artificial Sequence
  Description of Artificial Sequence: Synthetic oligonucleotide
tgtggatgtgctgggccagggtgg

SEQ ID NO: 288317 - DNA, 23 bp, Artificial Sequence
  Description of Artificial Sequence: Synthetic oligonucleotide
gtggatgtgctgggccagggtgg

SEQ ID NO: 288318 - DNA, 25 bp, Artificial Sequence
  Description of Artificial Sequence: Synthetic oligonucleotide
tggatgtgctgggccagggtggcaa

SEQ ID NO: 288319 - DNA, 24 bp, Artificial Sequence
  Description of Artificial Sequence: Synthetic oligonucleotide
ggatgtgctgggccagggtggcaa

SEQ ID NO: 288320 - DNA, 24 bp, Artificial Sequence
  Description of Artificial Sequence: Synthetic oligonucleotide
gatgtgctgggccagggtggcaag

SEQ ID NO: 288321 - DNA, 24 bp, Artificial Sequence
  Description of Artificial Sequence: Synthetic oligonucleotide
atgtgctgggccagggtggcaagc

SEQ ID NO: 288322 - DNA, 23 bp, Artificial Sequence
  Description of Artificial Sequence: Synthetic oligonucleotide
tgtgctgggccagggtggcaagc

SEQ ID NO: 288323 - DNA, 22 bp, Artificial Sequence
  Description of Artificial Sequence: Synthetic oligonucleotide
gtgctgggccagggtggcaagc

SEQ ID NO: 288324 - DNA, 22 bp, Artificial Sequence
  Description of Artificial Sequence: Synthetic oligonucleotide
tgctgggccagggtggcaagcc

SEQ ID NO: 288325 - DNA, 21 bp, Artificial Sequence
  Description of Artificial Sequence: Synthetic oligonucleotide
gctgggccagggtggcaagcc

SEQ ID NO: 288326 - DNA, 23 bp, Artificial Sequence
  Description of Artificial Sequence: Synthetic oligonucleotide
ctgggccagggtggcaagcccaa

SEQ ID NO: 288327 - DNA, 24 bp, Artificial Sequence
  Description of Artificial Sequence: Synthetic oligonucleotide
tgggccagggtggcaagcccaaga

SEQ ID NO: 288328 - DNA, 23 bp, Artificial Sequence
  Description of Artificial Sequence: Synthetic oligonucleotide
gggccagggtggcaagcccaaga

SEQ ID NO: 288329 - DNA, 26 bp, Artificial Sequence
  Description of Artificial Sequence: Synthetic oligonucleotide
ggccagggtggcaagcccaagactat

SEQ ID NO: 288330 - DNA, 27 bp, Artificial Sequence
  Description of Artificial Sequence: Synthetic oligonucleotide
gccagggtggcaagcccaagactatct

SEQ ID NO: 288331 - DNA, 27 bp, Artificial Sequence
  Description of Artificial Sequence: Synthetic oligonucleotide
ccagggtggcaagcccaagactatctc

SEQ ID NO: 288332 - DNA, 28 bp, Artificial Sequence
  Description of Artificial Sequence: Synthetic oligonucleotide
cagggtggcaagcccaagactatctcag

SEQ ID NO: 288333 - DNA, 28 bp, Artificial Sequence
  Description of Artificial Sequence: Synthetic oligonucleotide
agggtggcaagcccaagactatctcagg

SEQ ID NO: 288334 - DNA, 27 bp, Artificial Sequence
  Description of Artificial Sequence: Synthetic oligonucleotide
gggtggcaagcccaagactatctcagg

SEQ ID NO: 288335 - DNA, 27 bp, Artificial Sequence
  Description of Artificial Sequence: Synthetic oligonucleotide
ggtggcaagcccaagactatctcaggg

SEQ ID NO: 288336 - DNA, 29 bp, Artificial Sequence
  Description of Artificial Sequence: Synthetic oligonucleotide
gtggcaagcccaagactatctcagggttc

SEQ ID NO: 288337 - DNA, 29 bp, Artificial Sequence
  Description of Artificial Sequence: Synthetic oligonucleotide
tggcaagcccaagactatctcagggttcc

SEQ ID NO: 288338 - DNA, 28 bp, Artificial Sequence
  Description of Artificial Sequence: Synthetic oligonucleotide
ggcaagcccaagactatctcagggttcc

SEQ ID NO: 288339 - DNA, 29 bp, Artificial Sequence
  Description of Artificial Sequence: Synthetic oligonucleotide
gcaagcccaagactatctcagggttcctg

SEQ ID NO: 288340 - DNA, 30 bp, Artificial Sequence
  Description of Artificial Sequence: Synthetic oligonucleotide
caagcccaagactatctcagggttcctgac

SEQ ID NO: 288341 - DNA, 30 bp, Artificial Sequence
  Description of Artificial Sequence: Synthetic oligonucleotide
aagcccaagactatctcagggttcctgacg

SEQ ID NO: 288342 - DNA, 29 bp, Artificial Sequence
  Description of Artificial Sequence: Synthetic oligonucleotide
agcccaagactatctcagggttcctgacg

SEQ ID NO: 288343 - DNA, 28 bp, Artificial Sequence
  Description of Artificial Sequence: Synthetic oligonucleotide
gcccaagactatctcagggttcctgacg

SEQ ID NO: 288344 - DNA, 28 bp, Artificial Sequence
  Description of Artificial Sequence: Synthetic oligonucleotide
cccaagactatctcagggttcctgacgc

SEQ ID NO: 288345 - DNA, 31 bp, Artificial Sequence
  Description of Artificial Sequence: Synthetic oligonucleotide
ccaagactatctcagggttcctgacgcatac

SEQ ID NO: 288346 - DNA, 33 bp, Artificial Sequence
  Description of Artificial Sequence: Synthetic oligonucleotide
caagactatctcagggttcctgacgcatactac

SEQ ID NO: 288347 - DNA, 33 bp, Artificial Sequence
  Description of Artificial Sequence: Synthetic oligonucleotide
aagactatctcagggttcctgacgcatactacc

SEQ ID NO: 288348 - DNA, 32 bp, Artificial Sequence
  Description of Artificial Sequence: Synthetic oligonucleotide
agactatctcagggttcctgacgcatactacc

SEQ ID NO: 288349 - DNA, 31 bp, Artificial Sequence
  Description of Artificial Sequence: Synthetic oligonucleotide
gactatctcagggttcctgacgcatactacc

SEQ ID NO: 288350 - DNA, 31 bp, Artificial Sequence
  Description of Artificial Sequence: Synthetic oligonucleotide
actatctcagggttcctgacgcatactaccc

SEQ ID NO: 288351 - DNA, 30 bp, Artificial Sequence
  Description of Artificial Sequence: Synthetic oligonucleotide
ctatctcagggttcctgacgcatactaccc

SEQ ID NO: 288352 - DNA, 30 bp, Artificial Sequence
  Description of Artificial Sequence: Synthetic oligonucleotide
tatctcagggttcctgacgcatactacccc

SEQ ID NO: 288353 - DNA, 29 bp, Artificial Sequence
  Description of Artificial Sequence: Synthetic oligonucleotide
atctcagggttcctgacgcatactacccc

SEQ ID NO: 288354 - DNA, 28 bp, Artificial Sequence
  Description of Artificial Sequence: Synthetic oligonucleotide
tctcagggttcctgacgcatactacccc

SEQ ID NO: 288355 - DNA, 27 bp, Artificial Sequence
  Description of Artificial Sequence: Synthetic oligonucleotide
ctcagggttcctgacgcatactacccc

SEQ ID NO: 288356 - DNA, 28 bp, Artificial Sequence
  Description of Artificial Sequence: Synthetic oligonucleotide
tcagggttcctgacgcatactaccccag

SEQ ID NO: 288357 - DNA, 27 bp, Artificial Sequence
  Description of Artificial Sequence: Synthetic oligonucleotide
cagggttcctgacgcatactaccccag

SEQ ID NO: 288358 - DNA, 28 bp, Artificial Sequence
  Description of Artificial Sequence: Synthetic oligonucleotide
agggttcctgacgcatactaccccagtg

SEQ ID NO: 288359 - DNA, 27 bp, Artificial Sequence
  Description of Artificial Sequence: Synthetic oligonucleotide
gggttcctgacgcatactaccccagtg

SEQ ID NO: 288360 - DNA, 29 bp, Artificial Sequence
  Description of Artificial Sequence: Synthetic oligonucleotide
ggttcctgacgcatactaccccagtgatg

SEQ ID NO: 288361 - DNA, 31 bp, Artificial Sequence
  Description of Artificial Sequence: Synthetic oligonucleotide
gttcctgacgcatactaccccagtgatgttg

SEQ ID NO: 288362 - DNA, 31 bp, Artificial Sequence
  Description of Artificial Sequence: Synthetic oligonucleotide
ttcctgacgcatactaccccagtgatgttgg

SEQ ID NO: 288363 - DNA, 30 bp, Artificial Sequence
  Description of Artificial Sequence: Synthetic oligonucleotide
tcctgacgcatactaccccagtgatgttgg

SEQ ID NO: 288364 - DNA, 29 bp, Artificial Sequence
  Description of Artificial Sequence: Synthetic oligonucleotide
cctgacgcatactaccccagtgatgttgg

SEQ ID NO: 288365 - DNA, 29 bp, Artificial Sequence
  Description of Artificial Sequence: Synthetic oligonucleotide
ctgacgcatactaccccagtgatgttggc

SEQ ID NO: 288366 - DNA, 29 bp, Artificial Sequence
  Description of Artificial Sequence: Synthetic oligonucleotide
tgacgcatactaccccagtgatgttggcc

SEQ ID NO: 288367 - DNA, 28 bp, Artificial Sequence
  Description of Artificial Sequence: Synthetic oligonucleotide
gacgcatactaccccagtgatgttggcc

SEQ ID NO: 288368 - DNA, 28 bp, Artificial Sequence
  Description of Artificial Sequence: Synthetic oligonucleotide
acgcatactaccccagtgatgttggccc

SEQ ID NO: 288369 - DNA, 27 bp, Artificial Sequence
  Description of Artificial Sequence: Synthetic oligonucleotide
cgcatactaccccagtgatgttggccc

SEQ ID NO: 288370 - DNA, 28 bp, Artificial Sequence
  Description of Artificial Sequence: Synthetic oligonucleotide
gcatactaccccagtgatgttggccctc

SEQ ID NO: 288371 - DNA, 28 bp, Artificial Sequence
  Description of Artificial Sequence: Synthetic oligonucleotide
catactaccccagtgatgttggccctcg

SEQ ID NO: 288372 - DNA, 28 bp, Artificial Sequence
  Description of Artificial Sequence: Synthetic oligonucleotide
atactaccccagtgatgttggccctcgg

SEQ ID NO: 288373 - DNA, 27 bp, Artificial Sequence
  Description of Artificial Sequence: Synthetic oligonucleotide
tactaccccagtgatgttggccctcgg

SEQ ID NO: 288374 - DNA, 26 bp, Artificial Sequence
  Description of Artificial Sequence: Synthetic oligonucleotide
actaccccagtgatgttggccctcgg

SEQ ID NO: 288375 - DNA, 25 bp, Artificial Sequence
  Description of Artificial Sequence: Synthetic oligonucleotide
ctaccccagtgatgttggccctcgg

SEQ ID NO: 288376 - DNA, 25 bp, Artificial Sequence
  Description of Artificial Sequence: Synthetic oligonucleotide
taccccagtgatgttggccctcggg

SEQ ID NO: 288377 - DNA, 24 bp, Artificial Sequence
  Description of Artificial Sequence: Synthetic oligonucleotide
accccagtgatgttggccctcggg

SEQ ID NO: 288378 - DNA, 23 bp, Artificial Sequence
  Description of Artificial Sequence: Synthetic oligonucleotide
ccccagtgatgttggccctcggg

SEQ ID NO: 288379 - DNA, 25 bp, Artificial Sequence
  Description of Artificial Sequence: Synthetic oligonucleotide
cccagtgatgttggccctcggggaa

SEQ ID NO: 288380 - DNA, 25 bp, Artificial Sequence
  Description of Artificial Sequence: Synthetic oligonucleotide
ccagtgatgttggccctcggggaac

SEQ ID NO: 288381 - DNA, 25 bp, Artificial Sequence
  Description of Artificial Sequence: Synthetic oligonucleotide
cagtgatgttggccctcggggaacg

SEQ ID NO: 288382 - DNA, 25 bp, Artificial Sequence
  Description of Artificial Sequence: Synthetic oligonucleotide
agtgatgttggccctcggggaacgc

SEQ ID NO: 288383 - DNA, 24 bp, Artificial Sequence
  Description of Artificial Sequence: Synthetic oligonucleotide
gtgatgttggccctcggggaacgc

SEQ ID NO: 288384 - DNA, 24 bp, Artificial Sequence
  Description of Artificial Sequence: Synthetic oligonucleotide
tgatgttggccctcggggaacgcg

SEQ ID NO: 288385 - DNA, 23 bp, Artificial Sequence
  Description of Artificial Sequence: Synthetic oligonucleotide
gatgttggccctcggggaacgcg

SEQ ID NO: 288386 - DNA, 24 bp, Artificial Sequence
  Description of Artificial Sequence: Synthetic oligonucleotide
atgttggccctcggggaacgcgca

SEQ ID NO: 288387 - DNA, 23 bp, Artificial Sequence
  Description of Artificial Sequence: Synthetic oligonucleotide
tgttggccctcggggaacgcgca

SEQ ID NO: 288388 - DNA, 22 bp, Artificial Sequence
  Description of Artificial Sequence: Synthetic oligonucleotide
gttggccctcggggaacgcgca

SEQ ID NO: 288389 - DNA, 26 bp, Artificial Sequence
  Description of Artificial Sequence: Synthetic oligonucleotide
ttggccctcggggaacgcgcagaatt

SEQ ID NO: 288390 - DNA, 25 bp, Artificial Sequence
  Description of Artificial Sequence: Synthetic oligonucleotide
tggccctcggggaacgcgcagaatt

SEQ ID NO: 288391 - DNA, 24 bp, Artificial Sequence
  Description of Artificial Sequence: Synthetic oligonucleotide
ggccctcggggaacgcgcagaatt

SEQ ID NO: 288392 - DNA, 24 bp, Artificial Sequence
  Description of Artificial Sequence: Synthetic oligonucleotide
gccctcggggaacgcgcagaattg

SEQ ID NO: 288393 - DNA, 24 bp, Artificial Sequence
  Description of Artificial Sequence: Synthetic oligonucleotide
ccctcggggaacgcgcagaattgc

SEQ ID NO: 288394 - DNA, 24 bp, Artificial Sequence
  Description of Artificial Sequence: Synthetic oligonucleotide
cctcggggaacgcgcagaattgcc

SEQ ID NO: 288395 - DNA, 25 bp, Artificial Sequence
  Description of Artificial Sequence: Synthetic oligonucleotide
ctcggggaacgcgcagaattgccca

SEQ ID NO: 288396 - DNA, 26 bp, Artificial Sequence
  Description of Artificial Sequence: Synthetic oligonucleotide
tcggggaacgcgcagaattgcccact

SEQ ID NO: 288397 - DNA, 25 bp, Artificial Sequence
  Description of Artificial Sequence: Synthetic oligonucleotide
cggggaacgcgcagaattgcccact

SEQ ID NO: 288398 - DNA, 26 bp, Artificial Sequence
  Description of Artificial Sequence: Synthetic oligonucleotide
ggggaacgcgcagaattgcccactga

SEQ ID NO: 288399 - DNA, 26 bp, Artificial Sequence
  Description of Artificial Sequence: Synthetic oligonucleotide
gggaacgcgcagaattgcccactgag

SEQ ID NO: 288400 - DNA, 27 bp, Artificial Sequence
  Description of Artificial Sequence: Synthetic oligonucleotide
ggaacgcgcagaattgcccactgaggt

SEQ ID NO: 288401 - DNA, 27 bp, Artificial Sequence
  Description of Artificial Sequence: Synthetic oligonucleotide
gaacgcgcagaattgcccactgaggtg

SEQ ID NO: 288402 - DNA, 30 bp, Artificial Sequence
  Description of Artificial Sequence: Synthetic oligonucleotide
aacgcgcagaattgcccactgaggtgtttc

SEQ ID NO: 288403 - DNA, 29 bp, Artificial Sequence
  Description of Artificial Sequence: Synthetic oligonucleotide
acgcgcagaattgcccactgaggtgtttc

SEQ ID NO: 288404 - DNA, 28 bp, Artificial Sequence
  Description of Artificial Sequence: Synthetic oligonucleotide
cgcgcagaattgcccactgaggtgtttc

SEQ ID NO: 288405 - DNA, 30 bp, Artificial Sequence
  Description of Artificial Sequence: Synthetic oligonucleotide
gcgcagaattgcccactgaggtgtttcttc

SEQ ID NO: 288406 - DNA, 30 bp, Artificial Sequence
  Description of Artificial Sequence: Synthetic oligonucleotide
cgcagaattgcccactgaggtgtttcttcc

SEQ ID NO: 288407 - DNA, 31 bp, Artificial Sequence
  Description of Artificial Sequence: Synthetic oligonucleotide
gcagaattgcccactgaggtgtttcttccag

SEQ ID NO: 288408 - DNA, 34 bp, Artificial Sequence
  Description of Artificial Sequence: Synthetic oligonucleotide
cagaattgcccactgaggtgtttcttccagttac

SEQ ID NO: 288409 - DNA, 34 bp, Artificial Sequence
  Description of Artificial Sequence: Synthetic oligonucleotide
agaattgcccactgaggtgtttcttccagttacc

SEQ ID NO: 288410 - DNA, 33 bp, Artificial Sequence
  Description of Artificial Sequence: Synthetic oligonucleotide
gaattgcccactgaggtgtttcttccagttacc

SEQ ID NO: 288411 - DNA, 33 bp, Artificial Sequence
  Description of Artificial Sequence: Synthetic oligonucleotide
aattgcccactgaggtgtttcttccagttaccc

SEQ ID NO: 288412 - DNA, 32 bp, Artificial Sequence
  Description of Artificial Sequence: Synthetic oligonucleotide
attgcccactgaggtgtttcttccagttaccc

SEQ ID NO: 288413 - DNA, 31 bp, Artificial Sequence
  Description of Artificial Sequence: Synthetic oligonucleotide
ttgcccactgaggtgtttcttccagttaccc

SEQ ID NO: 288414 - DNA, 30 bp, Artificial Sequence
  Description of Artificial Sequence: Synthetic oligonucleotide
tgcccactgaggtgtttcttccagttaccc

SEQ ID NO: 288415 - DNA, 29 bp, Artificial Sequence
  Description of Artificial Sequence: Synthetic oligonucleotide
gcccactgaggtgtttcttccagttaccc

SEQ ID NO: 288416 - DNA, 29 bp, Artificial Sequence
  Description of Artificial Sequence: Synthetic oligonucleotide
cccactgaggtgtttcttccagttacccc

SEQ ID NO: 288417 - DNA, 29 bp, Artificial Sequence
  Description of Artificial Sequence: Synthetic oligonucleotide
ccactgaggtgtttcttccagttaccccc

SEQ ID NO: 288418 - DNA, 32 bp, Artificial Sequence
  Description of Artificial Sequence: Synthetic oligonucleotide
cactgaggtgtttcttccagttaccccctttc

SEQ ID NO: 288419 - DNA, 33 bp, Artificial Sequence
  Description of Artificial Sequence: Synthetic oligonucleotide
actgaggtgtttcttccagttaccccctttctg

SEQ ID NO: 288420 - DNA, 32 bp, Artificial Sequence
  Description of Artificial Sequence: Synthetic oligonucleotide
ctgaggtgtttcttccagttaccccctttctg

SEQ ID NO: 288421 - DNA, 32 bp, Artificial Sequence
  Description of Artificial Sequence: Synthetic oligonucleotide
tgaggtgtttcttccagttaccccctttctgg

SEQ ID NO: 288422 - DNA, 31 bp, Artificial Sequence
  Description of Artificial Sequence: Synthetic oligonucleotide
gaggtgtttcttccagttaccccctttctgg

SEQ ID NO: 288423 - DNA, 33 bp, Artificial Sequence
  Description of Artificial Sequence: Synthetic oligonucleotide
aggtgtttcttccagttaccccctttctggaag

SEQ ID NO: 288424 - DNA, 32 bp, Artificial Sequence
  Description of Artificial Sequence: Synthetic oligonucleotide
ggtgtttcttccagttaccccctttctggaag

SEQ ID NO: 288425 - DNA, 32 bp, Artificial Sequence
  Description of Artificial Sequence: Synthetic oligonucleotide
gtgtttcttccagttaccccctttctggaagc

SEQ ID NO: 288426 - DNA, 36 bp, Artificial Sequence
  Description of Artificial Sequence: Synthetic oligonucleotide
tgtttcttccagttaccccctttctggaagcttttg

SEQ ID NO: 288427 - DNA, 35 bp, Artificial Sequence
  Description of Artificial Sequence: Synthetic oligonucleotide
gtttcttccagttaccccctttctggaagcttttg

SEQ ID NO: 288428 - DNA, 39 bp, Artificial Sequence
  Description of Artificial Sequence: Synthetic oligonucleotide
tttcttccagttaccccctttctggaagcttttgttatg

SEQ ID NO: 288429 - DNA, 38 bp, Artificial Sequence
  Description of Artificial Sequence: Synthetic oligonucleotide
ttcttccagttaccccctttctggaagcttttgttatg

SEQ ID NO: 288430 - DNA, 37 bp, Artificial Sequence
  Description of Artificial Sequence: Synthetic oligonucleotide
tcttccagttaccccctttctggaagcttttgttatg

SEQ ID NO: 288431 - DNA, 36 bp, Artificial Sequence
  Description of Artificial Sequence: Synthetic oligonucleotide
cttccagttaccccctttctggaagcttttgttatg

SEQ ID NO: 288432 - DNA, 36 bp, Artificial Sequence
  Description of Artificial Sequence: Synthetic oligonucleotide
ttccagttaccccctttctggaagcttttgttatgc

SEQ ID NO: 288433 - DNA, 35 bp, Artificial Sequence
  Description of Artificial Sequence: Synthetic oligonucleotide
tccagttaccccctttctggaagcttttgttatgc

SEQ ID NO: 288434 - DNA, 34 bp, Artificial Sequence
  Description of Artificial Sequence: Synthetic oligonucleotide
ccagttaccccctttctggaagcttttgttatgc

SEQ ID NO: 288435 - DNA, 36 bp, Artificial Sequence
  Description of Artificial Sequence: Synthetic oligonucleotide
cagttaccccctttctggaagcttttgttatgcttc

SEQ ID NO: 288436 - DNA, 36 bp, Artificial Sequence
  Description of Artificial Sequence: Synthetic oligonucleotide
agttaccccctttctggaagcttttgttatgcttcg

SEQ ID NO: 288437 - DNA, 35 bp, Artificial Sequence
  Description of Artificial Sequence: Synthetic oligonucleotide
gttaccccctttctggaagcttttgttatgcttcg

SEQ ID NO: 288438 - DNA, 35 bp, Artificial Sequence
  Description of Artificial Sequence: Synthetic oligonucleotide
ttaccccctttctggaagcttttgttatgcttcgg

SEQ ID NO: 288439 - DNA, 34 bp, Artificial Sequence
  Description of Artificial Sequence: Synthetic oligonucleotide
taccccctttctggaagcttttgttatgcttcgg

SEQ ID NO: 288440 - DNA, 33 bp, Artificial Sequence
  Description of Artificial Sequence: Synthetic oligonucleotide
accccctttctggaagcttttgttatgcttcgg

SEQ ID NO: 288441 - DNA, 32 bp, Artificial Sequence
  Description of Artificial Sequence: Synthetic oligonucleotide
ccccctttctggaagcttttgttatgcttcgg

SEQ ID NO: 288442 - DNA, 34 bp, Artificial Sequence
  Description of Artificial Sequence: Synthetic oligonucleotide
cccctttctggaagcttttgttatgcttcggaag

SEQ ID NO: 288443 - DNA, 36 bp, Artificial Sequence
  Description of Artificial Sequence: Synthetic oligonucleotide
ccctttctggaagcttttgttatgcttcggaagtac

SEQ ID NO: 288444 - DNA, 36 bp, Artificial Sequence
  Description of Artificial Sequence: Synthetic oligonucleotide
cctttctggaagcttttgttatgcttcggaagtacc

SEQ ID NO: 288445 - DNA, 36 bp, Artificial Sequence
  Description of Artificial Sequence: Synthetic oligonucleotide
ctttctggaagcttttgttatgcttcggaagtaccc

SEQ ID NO: 288446 - DNA, 36 bp, Artificial Sequence
  Description of Artificial Sequence: Synthetic oligonucleotide
tttctggaagcttttgttatgcttcggaagtacccc

SEQ ID NO: 288447 - DNA, 35 bp, Artificial Sequence
  Description of Artificial Sequence: Synthetic oligonucleotide
ttctggaagcttttgttatgcttcggaagtacccc

SEQ ID NO: 288448 - DNA, 34 bp, Artificial Sequence
  Description of Artificial Sequence: Synthetic oligonucleotide
tctggaagcttttgttatgcttcggaagtacccc

SEQ ID NO: 288449 - DNA, 33 bp, Artificial Sequence
  Description of Artificial Sequence: Synthetic oligonucleotide
ctggaagcttttgttatgcttcggaagtacccc

SEQ ID NO: 288450 - DNA, 39 bp, Artificial Sequence
  Description of Artificial Sequence: Synthetic oligonucleotide
tggaagcttttgttatgcttcggaagtaccccaattttg

SEQ ID NO: 288451 - DNA, 38 bp, Artificial Sequence
  Description of Artificial Sequence: Synthetic oligonucleotide
ggaagcttttgttatgcttcggaagtaccccaattttg

SEQ ID NO: 288452 - DNA, 40 bp, Artificial Sequence
  Description of Artificial Sequence: Synthetic oligonucleotide
gaagcttttgttatgcttcggaagtaccccaattttgatc

SEQ ID NO: 288453 - DNA, 41 bp, Artificial Sequence
  Description of Artificial Sequence: Synthetic oligonucleotide
aagcttttgttatgcttcggaagtaccccaattttgatctc

SEQ ID NO: 288454 - DNA, 40 bp, Artificial Sequence
  Description of Artificial Sequence: Synthetic oligonucleotide
agcttttgttatgcttcggaagtaccccaattttgatctc

SEQ ID NO: 288455 - DNA, 39 bp, Artificial Sequence
  Description of Artificial Sequence: Synthetic oligonucleotide
gcttttgttatgcttcggaagtaccccaattttgatctc

SEQ ID NO: 288456 - DNA, 23 bp, Artificial Sequence
  Description of Artificial Sequence: Synthetic oligonucleotide
atgaaccaggagggcacggcgcg

SEQ ID NO: 288457 - DNA, 22 bp, Artificial Sequence
  Description of Artificial Sequence: Synthetic oligonucleotide
tgaaccaggagggcacggcgcg

SEQ ID NO: 288458 - DNA, 21 bp, Artificial Sequence
  Description of Artificial Sequence: Synthetic oligonucleotide
gaaccaggagggcacggcgcg

SEQ ID NO: 288459 - DNA, 21 bp, Artificial Sequence
  Description of Artificial Sequence: Synthetic oligonucleotide
aaccaggagggcacggcgcgg

SEQ ID NO: 288460 - DNA, 20 bp, Artificial Sequence
  Description of Artificial Sequence: Synthetic oligonucleotide
accaggagggcacggcgcgg

SEQ ID NO: 288461 - DNA, 20 bp, Artificial Sequence
  Description of Artificial Sequence: Synthetic oligonucleotide
ccaggagggcacggcgcggt

SEQ ID NO: 288462 - DNA, 20 bp, Artificial Sequence
  Description of Artificial Sequence: Synthetic oligonucleotide
caggagggcacggcgcggct

SEQ ID NO: 288463 - DNA, 20 bp, Artificial Sequence
  Description of Artificial Sequence: Synthetic oligonucleotide
aggagggcacggcgcggcct

SEQ ID NO: 288464 - DNA, 20 bp, Artificial Sequence
  Description of Artificial Sequence: Synthetic oligonucleotide
ggagggcacggcgcggcctt

SEQ ID NO: 288465 - DNA, 20 bp, Artificial Sequence
  Description of Artificial Sequence: Synthetic oligonucleotide
gagggcacggcgcggccctt

SEQ ID NO: 288466 - DNA, 20 bp, Artificial Sequence
  Description of Artificial Sequence: Synthetic oligonucleotide
agggcacggcgcggcccctt

SEQ ID NO: 288467 - DNA, 20 bp, Artificial Sequence
  Description of Artificial Sequence: Synthetic oligonucleotide
gggcacggcgcggccccttt

SEQ ID NO: 288468 - DNA, 20 bp, Artificial Sequence
  Description of Artificial Sequence: Synthetic oligonucleotide
ggcacggcgcggccccgttt

SEQ ID NO: 288469 - DNA, 20 bp, Artificial Sequence
  Description of Artificial Sequence: Synthetic oligonucleotide
gcacggcgcggccccgcttt

SEQ ID NO: 288470 - DNA, 20 bp, Artificial Sequence
  Description of Artificial Sequence: Synthetic oligonucleotide
cacggcgcggccccgcgttt

SEQ ID NO: 288471 - DNA, 20 bp, Artificial Sequence
  Description of Artificial Sequence: Synthetic oligonucleotide
acggcgcggccccgcggttt

SEQ ID NO: 288472 - DNA, 20 bp, Artificial Sequence
  Description of Artificial Sequence: Synthetic oligonucleotide
cggcgcggccccgcggtttt

SEQ ID NO: 288473 - DNA, 20 bp, Artificial Sequence
  Description of Artificial Sequence: Synthetic oligonucleotide
ggcgcggccccgcggctttt

SEQ ID NO: 288474 - DNA, 20 bp, Artificial Sequence
  Description of Artificial Sequence: Synthetic oligonucleotide
gcgcggccccgcggcgtttt

SEQ ID NO: 288475 - DNA, 20 bp, Artificial Sequence
  Description of Artificial Sequence: Synthetic oligonucleotide
cgcggccccgcggcgctttt

SEQ ID NO: 288476 - DNA, 20 bp, Artificial Sequence
  Description of Artificial Sequence: Synthetic oligonucleotide
gcggccccgcggcgcctttt

SEQ ID NO: 288477 - DNA, 20 bp, Artificial Sequence
  Description of Artificial Sequence: Synthetic oligonucleotide
cggccccgcggcgccgattt

SEQ ID NO: 288478 - DNA, 20 bp, Artificial Sequence
  Description of Artificial Sequence: Synthetic oligonucleotide
ggccccgcggcgccgacaat

SEQ ID NO: 288479 - DNA, 20 bp, Artificial Sequence
  Description of Artificial Sequence: Synthetic oligonucleotide
gccccgcggcgccgacaagt

SEQ ID NO: 288480 - DNA, 20 bp, Artificial Sequence
  Description of Artificial Sequence: Synthetic oligonucleotide
ccccgcggcgccgacaaggt

SEQ ID NO: 288481 - DNA, 20 bp, Artificial Sequence
  Description of Artificial Sequence: Synthetic oligonucleotide
cccgcggcgccgacaaggct

SEQ ID NO: 288482 - DNA, 22 bp, Artificial Sequence
  Description of Artificial Sequence: Synthetic oligonucleotide
ccgcggcgccgacaaggcgtaa

SEQ ID NO: 288483 - DNA, 22 bp, Artificial Sequence
  Description of Artificial Sequence: Synthetic oligonucleotide
cgcggcgccgacaaggcgtaac

SEQ ID NO: 288484 - DNA, 22 bp, Artificial Sequence
  Description of Artificial Sequence: Synthetic oligonucleotide
gcggcgccgacaaggcgtaacc

SEQ ID NO: 288485 - DNA, 22 bp, Artificial Sequence
  Description of Artificial Sequence: Synthetic oligonucleotide
cggcgccgacaaggcgtaaccg

SEQ ID NO: 288486 - DNA, 22 bp, Artificial Sequence
  Description of Artificial Sequence: Synthetic oligonucleotide
ggcgccgacaaggcgtaaccgc

SEQ ID NO: 288487 - DNA, 22 bp, Artificial Sequence
  Description of Artificial Sequence: Synthetic oligonucleotide
gcgccgacaaggcgtaaccgcc

SEQ ID NO: 288488 - DNA, 22 bp, Artificial Sequence
  Description of Artificial Sequence: Synthetic oligonucleotide
cgccgacaaggcgtaaccgccg

SEQ ID NO: 288489 - DNA, 22 bp, Artificial Sequence
  Description of Artificial Sequence: Synthetic oligonucleotide
gccgacaaggcgtaaccgccgc

SEQ ID NO: 288490 - DNA, 22 bp, Artificial Sequence
  Description of Artificial Sequence: Synthetic oligonucleotide
ccgacaaggcgtaaccgccgcg

SEQ ID NO: 288491 - DNA, 22 bp, Artificial Sequence
  Description of Artificial Sequence: Synthetic oligonucleotide
cgacaaggcgtaaccgccgcgc

SEQ ID NO: 288492 - DNA, 22 bp, Artificial Sequence
  Description of Artificial Sequence: Synthetic oligonucleotide
gacaaggcgtaaccgccgcgcg

SEQ ID NO: 288493 - DNA, 22 bp, Artificial Sequence
  Description of Artificial Sequence: Synthetic oligonucleotide
acaaggcgtaaccgccgcgcgg

SEQ ID NO: 288494 - DNA, 21 bp, Artificial Sequence
  Description of Artificial Sequence: Synthetic oligonucleotide
caaggcgtaaccgccgcgcgg

SEQ ID NO: 288495 - DNA, 21 bp, Artificial Sequence
  Description of Artificial Sequence: Synthetic oligonucleotide
aaggcgtaaccgccgcgcggc

SEQ ID NO: 288496 - DNA, 20 bp, Artificial Sequence
  Description of Artificial Sequence: Synthetic oligonucleotide
aggcgtaaccgccgcgcggc

SEQ ID NO: 288497 - DNA, 20 bp, Artificial Sequence
  Description of Artificial Sequence: Synthetic oligonucleotide
ggcgtaaccgccgcgcggct

SEQ ID NO: 288498 - DNA, 20 bp, Artificial Sequence
  Description of Artificial Sequence: Synthetic oligonucleotide
gcgtaaccgccgcgcggcgt

SEQ ID NO: 288499 - DNA, 20 bp, Artificial Sequence
  Description of Artificial Sequence: Synthetic oligonucleotide
cgtaaccgccgcgcggcgga

SEQ ID NO: 288500 - DNA, 20 bp, Artificial Sequence
  Description of Artificial Sequence: Synthetic oligonucleotide
gtaaccgccgcgcggcggag

SEQ ID NO: 288501 - DNA, 21 bp, Artificial Sequence
  Description of Artificial Sequence: Synthetic oligonucleotide
taaccgccgcgcggcggaggt

SEQ ID NO: 288502 - DNA, 20 bp, Artificial Sequence
  Description of Artificial Sequence: Synthetic oligonucleotide
aaccgccgcgcggcggaggt

SEQ ID NO: 288503 - DNA, 20 bp, Artificial Sequence
  Description of Artificial Sequence: Synthetic oligonucleotide
accgccgcgcggcggaggtt

SEQ ID NO: 288504 - DNA, 20 bp, Artificial Sequence
  Description of Artificial Sequence: Synthetic oligonucleotide
ccgccgcgcggcggaggttt

SEQ ID NO: 288505 - DNA, 20 bp, Artificial Sequence
  Description of Artificial Sequence: Synthetic oligonucleotide
cgccgcgcggcggaggtgaa

SEQ ID NO: 288506 - DNA, 22 bp, Artificial Sequence
  Description of Artificial Sequence: Synthetic oligonucleotide
gccgcgcggcggaggtgaacaa

SEQ ID NO: 288507 - DNA, 24 bp, Artificial Sequence
  Description of Artificial Sequence: Synthetic oligonucleotide
ccgcgcggcggaggtgaacaagaa

SEQ ID NO: 288508 - DNA, 24 bp, Artificial Sequence
  Description of Artificial Sequence: Synthetic oligonucleotide
cgcgcggcggaggtgaacaagaag

SEQ ID NO: 288509 - DNA, 24 bp, Artificial Sequence
  Description of Artificial Sequence: Synthetic oligonucleotide
gcgcggcggaggtgaacaagaagc

SEQ ID NO: 288510 - DNA, 24 bp, Artificial Sequence
  Description of Artificial Sequence: Synthetic oligonucleotide
cgcggcggaggtgaacaagaagcc

SEQ ID NO: 288511 - DNA, 24 bp, Artificial Sequence
  Description of Artificial Sequence: Synthetic oligonucleotide
gcggcggaggtgaacaagaagccc

SEQ ID NO: 288512 - DNA, 25 bp, Artificial Sequence
  Description of Artificial Sequence: Synthetic oligonucleotide
cggcggaggtgaacaagaagcccca

SEQ ID NO: 288513 - DNA, 25 bp, Artificial Sequence
  Description of Artificial Sequence: Synthetic oligonucleotide
ggcggaggtgaacaagaagccccac

SEQ ID NO: 288514 - DNA, 25 bp, Artificial Sequence
  Description of Artificial Sequence: Synthetic oligonucleotide
gcggaggtgaacaagaagccccacc

SEQ ID NO: 288515 - DNA, 25 bp, Artificial Sequence
  Description of Artificial Sequence: Synthetic oligonucleotide
cggaggtgaacaagaagccccaccg

SEQ ID NO: 288516 - DNA, 25 bp, Artificial Sequence
  Description of Artificial Sequence: Synthetic oligonucleotide
ggaggtgaacaagaagccccaccgc

SEQ ID NO: 288517 - DNA, 25 bp, Artificial Sequence
  Description of Artificial Sequence: Synthetic oligonucleotide
gaggtgaacaagaagccccaccgcg

SEQ ID NO: 288518 - DNA, 25 bp, Artificial Sequence
  Description of Artificial Sequence: Synthetic oligonucleotide
aggtgaacaagaagccccaccgcgg

SEQ ID NO: 288519 - DNA, 24 bp, Artificial Sequence
  Description of Artificial Sequence: Synthetic oligonucleotide
ggtgaacaagaagccccaccgcgg

SEQ ID NO: 288520 - DNA, 24 bp, Artificial Sequence
  Description of Artificial Sequence: Synthetic oligonucleotide
gtgaacaagaagccccaccgcggc

SEQ ID NO: 288521 - DNA, 24 bp, Artificial Sequence
  Description of Artificial Sequence: Synthetic oligonucleotide
tgaacaagaagccccaccgcggcc

SEQ ID NO: 288522 - DNA, 23 bp, Artificial Sequence
  Description of Artificial Sequence: Synthetic oligonucleotide
gaacaagaagccccaccgcggcc

SEQ ID NO: 288523 - DNA, 23 bp, Artificial Sequence
  Description of Artificial Sequence: Synthetic oligonucleotide
aacaagaagccccaccgcggccg

SEQ ID NO: 288524 - DNA, 22 bp, Artificial Sequence
  Description of Artificial Sequence: Synthetic oligonucleotide
acaagaagccccaccgcggccg

SEQ ID NO: 288525 - DNA, 21 bp, Artificial Sequence
  Description of Artificial Sequence: Synthetic oligonucleotide
caagaagccccaccgcggccg

SEQ ID NO: 288526 - DNA, 21 bp, Artificial Sequence
  Description of Artificial Sequence: Synthetic oligonucleotide
aagaagccccaccgcggccgg

SEQ ID NO: 288527 - DNA, 20 bp, Artificial Sequence
  Description of Artificial Sequence: Synthetic oligonucleotide
agaagccccaccgcggccgg

SEQ ID NO: 288528 - DNA, 20 bp, Artificial Sequence
  Description of Artificial Sequence: Synthetic oligonucleotide
gaagccccaccgcggccggt

SEQ ID NO: 288529 - DNA, 20 bp, Artificial Sequence
  Description of Artificial Sequence: Synthetic oligonucleotide
aagccccaccgcggccggct

SEQ ID NO: 288530 - DNA, 20 bp, Artificial Sequence
  Description of Artificial Sequence: Synthetic oligonucleotide
agccccaccgcggccggctt

SEQ ID NO: 288531 - DNA, 20 bp, Artificial Sequence
  Description of Artificial Sequence: Synthetic oligonucleotide
gccccaccgcggccggcttt

SEQ ID NO: 288532 - DNA, 20 bp, Artificial Sequence
  Description of Artificial Sequence: Synthetic oligonucleotide
ccccaccgcggccggccttt

SEQ ID NO: 288533 - DNA, 20 bp, Artificial Sequence
  Description of Artificial Sequence: Synthetic oligonucleotide
cccaccgcggccggcccttt

SEQ ID NO: 288534 - DNA, 20 bp, Artificial Sequence
  Description of Artificial Sequence: Synthetic oligonucleotide
ccaccgcggccggccccttt

SEQ ID NO: 288535 - DNA, 20 bp, Artificial Sequence
  Description of Artificial Sequence: Synthetic oligonucleotide
caccgcggccggccccgttt

SEQ ID NO: 288536 - DNA, 20 bp, Artificial Sequence
  Description of Artificial Sequence: Synthetic oligonucleotide
accgcggccggccccgcatt

SEQ ID NO: 288537 - DNA, 20 bp, Artificial Sequence
  Description of Artificial Sequence: Synthetic oligonucleotide
ccgcggccggccccgcattt

SEQ ID NO: 288538 - DNA, 20 bp, Artificial Sequence
  Description of Artificial Sequence: Synthetic oligonucleotide
cgcggccggccccgcagttt

SEQ ID NO: 288539 - DNA, 20 bp, Artificial Sequence
  Description of Artificial Sequence: Synthetic oligonucleotide
gcggccggccccgcaggatt

SEQ ID NO: 288540 - DNA, 20 bp, Artificial Sequence
  Description of Artificial Sequence: Synthetic oligonucleotide
cggccggccccgcaggatgt

SEQ ID NO: 288541 - DNA, 20 bp, Artificial Sequence
  Description of Artificial Sequence: Synthetic oligonucleotide
ggccggccccgcaggatgtg

SEQ ID NO: 288542 - DNA, 21 bp, Artificial Sequence
  Description of Artificial Sequence: Synthetic oligonucleotide
gccggccccgcaggatgtgca

SEQ ID NO: 288543 - DNA, 23 bp, Artificial Sequence
  Description of Artificial Sequence: Synthetic oligonucleotide
ccggccccgcaggatgtgcagat

SEQ ID NO: 288544 - DNA, 26 bp, Artificial Sequence
  Description of Artificial Sequence: Synthetic oligonucleotide
cggccccgcaggatgtgcagatgaaa

SEQ ID NO: 288545 - DNA, 27 bp, Artificial Sequence
  Description of Artificial Sequence: Synthetic oligonucleotide
ggccccgcaggatgtgcagatgaaagt

SEQ ID NO: 288546 - DNA, 27 bp, Artificial Sequence
  Description of Artificial Sequence: Synthetic oligonucleotide
gccccgcaggatgtgcagatgaaagtg

SEQ ID NO: 288547 - DNA, 27 bp, Artificial Sequence
  Description of Artificial Sequence: Synthetic oligonucleotide
ccccgcaggatgtgcagatgaaagtgg

SEQ ID NO: 288548 - DNA, 28 bp, Artificial Sequence
  Description of Artificial Sequence: Synthetic oligonucleotide
cccgcaggatgtgcagatgaaagtggag

SEQ ID NO: 288549 - DNA, 28 bp, Artificial Sequence
  Description of Artificial Sequence: Synthetic oligonucleotide
ccgcaggatgtgcagatgaaagtggagg

SEQ ID NO: 288550 - DNA, 28 bp, Artificial Sequence
  Description of Artificial Sequence: Synthetic oligonucleotide
cgcaggatgtgcagatgaaagtggaggc

SEQ ID NO: 288551 - DNA, 29 bp, Artificial Sequence
  Description of Artificial Sequence: Synthetic oligonucleotide
gcaggatgtgcagatgaaagtggaggcag

SEQ ID NO: 288552 - DNA, 29 bp, Artificial Sequence
  Description of Artificial Sequence: Synthetic oligonucleotide
caggatgtgcagatgaaagtggaggcagc

SEQ ID NO: 288553 - DNA, 29 bp, Artificial Sequence
  Description of Artificial Sequence: Synthetic oligonucleotide
aggatgtgcagatgaaagtggaggcagcc

SEQ ID NO: 288554 - DNA, 28 bp, Artificial Sequence
  Description of Artificial Sequence: Synthetic oligonucleotide
ggatgtgcagatgaaagtggaggcagcc

SEQ ID NO: 288555 - DNA, 29 bp, Artificial Sequence
  Description of Artificial Sequence: Synthetic oligonucleotide
gatgtgcagatgaaagtggaggcagccac

SEQ ID NO: 288556 - DNA, 29 bp, Artificial Sequence
  Description of Artificial Sequence: Synthetic oligonucleotide
atgtgcagatgaaagtggaggcagccacg

SEQ ID NO: 288557 - DNA, 28 bp, Artificial Sequence
  Description of Artificial Sequence: Synthetic oligonucleotide
tgtgcagatgaaagtggaggcagccacg

SEQ ID NO: 288558 - DNA, 27 bp, Artificial Sequence
  Description of Artificial Sequence: Synthetic oligonucleotide
gtgcagatgaaagtggaggcagccacg

SEQ ID NO: 288559 - DNA, 27 bp, Artificial Sequence
  Description of Artificial Sequence: Synthetic oligonucleotide
tgcagatgaaagtggaggcagccacgg

SEQ ID NO: 288560 - DNA, 26 bp, Artificial Sequence
  Description of Artificial Sequence: Synthetic oligonucleotide
gcagatgaaagtggaggcagccacgg

SEQ ID NO: 288561 - DNA, 27 bp, Artificial Sequence
  Description of Artificial Sequence: Synthetic oligonucleotide
cagatgaaagtggaggcagccacgggt

SEQ ID NO: 288562 - DNA, 27 bp, Artificial Sequence
  Description of Artificial Sequence: Synthetic oligonucleotide
agatgaaagtggaggcagccacgggtg

SEQ ID NO: 288563 - DNA, 26 bp, Artificial Sequence
  Description of Artificial Sequence: Synthetic oligonucleotide
gatgaaagtggaggcagccacgggtg

SEQ ID NO: 288564 - DNA, 26 bp, Artificial Sequence
  Description of Artificial Sequence: Synthetic oligonucleotide
atgaaagtggaggcagccacgggtgg

SEQ ID NO: 288565 - DNA, 25 bp, Artificial Sequence
  Description of Artificial Sequence: Synthetic oligonucleotide
tgaaagtggaggcagccacgggtgg

SEQ ID NO: 288566 - DNA, 24 bp, Artificial Sequence
  Description of Artificial Sequence: Synthetic oligonucleotide
gaaagtggaggcagccacgggtgg

SEQ ID NO: 288567 - DNA, 24 bp, Artificial Sequence
  Description of Artificial Sequence: Synthetic oligonucleotide
aaagtggaggcagccacgggtggc

SEQ ID NO: 288568 - DNA, 23 bp, Artificial Sequence
  Description of Artificial Sequence: Synthetic oligonucleotide
aagtggaggcagccacgggtggc

SEQ ID NO: 288569 - DNA, 22 bp, Artificial Sequence
  Description of Artificial Sequence: Synthetic oligonucleotide
agtggaggcagccacgggtggc

SEQ ID NO: 288570 - DNA, 21 bp, Artificial Sequence
  Description of Artificial Sequence: Synthetic oligonucleotide
gtggaggcagccacgggtggc

SEQ ID NO: 288571 - DNA, 21 bp, Artificial Sequence
  Description of Artificial Sequence: Synthetic oligonucleotide
tggaggcagccacgggtggcc

SEQ ID NO: 288572 - DNA, 20 bp, Artificial Sequence
  Description of Artificial Sequence: Synthetic oligonucleotide
ggaggcagccacgggtggcc

SEQ ID NO: 288573 - DNA, 20 bp, Artificial Sequence
  Description of Artificial Sequence: Synthetic oligonucleotide
gaggcagccacgggtggccg

SEQ ID NO: 288574 - DNA, 21 bp, Artificial Sequence
  Description of Artificial Sequence: Synthetic oligonucleotide
aggcagccacgggtggccggt

SEQ ID NO: 288575 - DNA, 20 bp, Artificial Sequence
  Description of Artificial Sequence: Synthetic oligonucleotide
ggcagccacgggtggccggt

SEQ ID NO: 288576 - DNA, 20 bp, Artificial Sequence
  Description of Artificial Sequence: Synthetic oligonucleotide
gcagccacgggtggccggtc

SEQ ID NO: 288577 - DNA, 21 bp, Artificial Sequence
  Description of Artificial Sequence: Synthetic oligonucleotide
cagccacgggtggccggtcga

SEQ ID NO: 288578 - DNA, 21 bp, Artificial Sequence
  Description of Artificial Sequence: Synthetic oligonucleotide
agccacgggtggccggtcgac

SEQ ID NO: 288579 - DNA, 20 bp, Artificial Sequence
  Description of Artificial Sequence: Synthetic oligonucleotide
gccacgggtggccggtcgac

SEQ ID NO: 288580 - DNA, 20 bp, Artificial Sequence
  Description of Artificial Sequence: Synthetic oligonucleotide
ccacgggtggccggtcgacg

SEQ ID NO: 288581 - DNA, 20 bp, Artificial Sequence
  Description of Artificial Sequence: Synthetic oligonucleotide
cacgggtggccggtcgacgg

SEQ ID NO: 288582 - DNA, 20 bp, Artificial Sequence
  Description of Artificial Sequence: Synthetic oligonucleotide
acgggtggccggtcgacggc

SEQ ID NO: 288583 - DNA, 20 bp, Artificial Sequence
  Description of Artificial Sequence: Synthetic oligonucleotide
cgggtggccggtcgacggct

SEQ ID NO: 288584 - DNA, 20 bp, Artificial Sequence
  Description of Artificial Sequence: Synthetic oligonucleotide
gggtggccggtcgacggcgt

SEQ ID NO: 288585 - DNA, 20 bp, Artificial Sequence
  Description of Artificial Sequence: Synthetic oligonucleotide
ggtggccggtcgacggcgga

SEQ ID NO: 288586 - DNA, 20 bp, Artificial Sequence
  Description of Artificial Sequence: Synthetic oligonucleotide
gtggccggtcgacggcggag

SEQ ID NO: 288587 - DNA, 20 bp, Artificial Sequence
  Description of Artificial Sequence: Synthetic oligonucleotide
tggccggtcgacggcggagg

SEQ ID NO: 288588 - DNA, 20 bp, Artificial Sequence
  Description of Artificial Sequence: Synthetic oligonucleotide
ggccggtcgacggcggaggt

SEQ ID NO: 288589 - DNA, 20 bp, Artificial Sequence
  Description of Artificial Sequence: Synthetic oligonucleotide
gccggtcgacggcggaggca

SEQ ID NO: 288590 - DNA, 21 bp, Artificial Sequence
  Description of Artificial Sequence: Synthetic oligonucleotide
ccggtcgacggcggaggcaga

SEQ ID NO: 288591 - DNA, 21 bp, Artificial Sequence
  Description of Artificial Sequence: Synthetic oligonucleotide
cggtcgacggcggaggcagag

SEQ ID NO: 288592 - DNA, 21 bp, Artificial Sequence
  Description of Artificial Sequence: Synthetic oligonucleotide
ggtcgacggcggaggcagagg

SEQ ID NO: 288593 - DNA, 21 bp, Artificial Sequence
  Description of Artificial Sequence: Synthetic oligonucleotide
gtcgacggcggaggcagaggg

SEQ ID NO: 288594 - DNA, 23 bp, Artificial Sequence
  Description of Artificial Sequence: Synthetic oligonucleotide
tcgacggcggaggcagagggcaa

SEQ ID NO: 288595 - DNA, 22 bp, Artificial Sequence
  Description of Artificial Sequence: Synthetic oligonucleotide
cgacggcggaggcagagggcaa

SEQ ID NO: 288596 - DNA, 23 bp, Artificial Sequence
  Description of Artificial Sequence: Synthetic oligonucleotide
gacggcggaggcagagggcaaga

SEQ ID NO: 288597 - DNA, 23 bp, Artificial Sequence
  Description of Artificial Sequence: Synthetic oligonucleotide
acggcggaggcagagggcaagac

SEQ ID NO: 288598 - DNA, 22 bp, Artificial Sequence
  Description of Artificial Sequence: Synthetic oligonucleotide
cggcggaggcagagggcaagac

SEQ ID NO: 288599 - DNA, 22 bp, Artificial Sequence
  Description of Artificial Sequence: Synthetic oligonucleotide
ggcggaggcagagggcaagacg

SEQ ID NO: 288600 - DNA, 22 bp, Artificial Sequence
  Description of Artificial Sequence: Synthetic oligonucleotide
gcggaggcagagggcaagacgc

SEQ ID NO: 288601 - DNA, 22 bp, Artificial Sequence
  Description of Artificial Sequence: Synthetic oligonucleotide
cggaggcagagggcaagacgcc

SEQ ID NO: 288602 - DNA, 22 bp, Artificial Sequence
  Description of Artificial Sequence: Synthetic oligonucleotide
ggaggcagagggcaagacgccg

SEQ ID NO: 288603 - DNA, 22 bp, Artificial Sequence
  Description of Artificial Sequence: Synthetic oligonucleotide
gaggcagagggcaagacgccgg

SEQ ID NO: 288604 - DNA, 22 bp, Artificial Sequence
  Description of Artificial Sequence: Synthetic oligonucleotide
aggcagagggcaagacgccggc

SEQ ID NO: 288605 - DNA, 21 bp, Artificial Sequence
  Description of Artificial Sequence: Synthetic oligonucleotide
ggcagagggcaagacgccggc

SEQ ID NO: 288606 - DNA, 21 bp, Artificial Sequence
  Description of Artificial Sequence: Synthetic oligonucleotide
gcagagggcaagacgccggcg

SEQ ID NO: 288607 - DNA, 21 bp, Artificial Sequence
  Description of Artificial Sequence: Synthetic oligonucleotide
cagagggcaagacgccggcgg

SEQ ID NO: 288608 - DNA, 22 bp, Artificial Sequence
  Description of Artificial Sequence: Synthetic oligonucleotide
agagggcaagacgccggcggca

SEQ ID NO: 288609 - DNA, 21 bp, Artificial Sequence
  Description of Artificial Sequence: Synthetic oligonucleotide
gagggcaagacgccggcggca

SEQ ID NO: 288610 - DNA, 21 bp, Artificial Sequence
  Description of Artificial Sequence: Synthetic oligonucleotide
agggcaagacgccggcggcag

SEQ ID NO: 288611 - DNA, 20 bp, Artificial Sequence
  Description of Artificial Sequence: Synthetic oligonucleotide
gggcaagacgccggcggcag

SEQ ID NO: 288612 - DNA, 20 bp, Artificial Sequence
  Description of Artificial Sequence: Synthetic oligonucleotide
ggcaagacgccggcggcagg

SEQ ID NO: 288613 - DNA, 20 bp, Artificial Sequence
  Description of Artificial Sequence: Synthetic oligonucleotide
gcaagacgccggcggcaggg

SEQ ID NO: 288614 - DNA, 20 bp, Artificial Sequence
  Description of Artificial Sequence: Synthetic oligonucleotide
caagacgccggcggcagggg

SEQ ID NO: 288615 - DNA, 21 bp, Artificial Sequence
  Description of Artificial Sequence: Synthetic oligonucleotide
aagacgccggcggcaggggct

SEQ ID NO: 288616 - DNA, 20 bp, Artificial Sequence
  Description of Artificial Sequence: Synthetic oligonucleotide
agacgccggcggcaggggct

SEQ ID NO: 288617 - DNA, 20 bp, Artificial Sequence
  Description of Artificial Sequence: Synthetic oligonucleotide
gacgccggcggcaggggctt

SEQ ID NO: 288618 - DNA, 20 bp, Artificial Sequence
  Description of Artificial Sequence: Synthetic oligonucleotide
acgccggcggcaggggctga

SEQ ID NO: 288619 - DNA, 20 bp, Artificial Sequence
  Description of Artificial Sequence: Synthetic oligonucleotide
cgccggcggcaggggctgat

SEQ ID NO: 288620 - DNA, 20 bp, Artificial Sequence
  Description of Artificial Sequence: Synthetic oligonucleotide
gccggcggcaggggctgagt

SEQ ID NO: 288621 - DNA, 20 bp, Artificial Sequence
  Description of Artificial Sequence: Synthetic oligonucleotide
ccggcggcaggggctgagca

SEQ ID NO: 288622 - DNA, 21 bp, Artificial Sequence
  Description of Artificial Sequence: Synthetic oligonucleotide
cggcggcaggggctgagcagt

SEQ ID NO: 288623 - DNA, 21 bp, Artificial Sequence
  Description of Artificial Sequence: Synthetic oligonucleotide
ggcggcaggggctgagcagtc

SEQ ID NO: 288624 - DNA, 21 bp, Artificial Sequence
  Description of Artificial Sequence: Synthetic oligonucleotide
gcggcaggggctgagcagtcc

SEQ ID NO: 288625 - DNA, 22 bp, Artificial Sequence
  Description of Artificial Sequence: Synthetic oligonucleotide
cggcaggggctgagcagtccca

SEQ ID NO: 288626 - DNA, 22 bp, Artificial Sequence
  Description of Artificial Sequence: Synthetic oligonucleotide
ggcaggggctgagcagtcccag

SEQ ID NO: 288627 - DNA, 22 bp, Artificial Sequence
  Description of Artificial Sequence: Synthetic oligonucleotide
gcaggggctgagcagtcccagc

SEQ ID NO: 288628 - DNA, 23 bp, Artificial Sequence
  Description of Artificial Sequence: Synthetic oligonucleotide
caggggctgagcagtcccagcga

SEQ ID NO: 288629 - DNA, 24 bp, Artificial Sequence
  Description of Artificial Sequence: Synthetic oligonucleotide
aggggctgagcagtcccagcgaca

SEQ ID NO: 288630 - DNA, 23 bp, Artificial Sequence
  Description of Artificial Sequence: Synthetic oligonucleotide
ggggctgagcagtcccagcgaca

SEQ ID NO: 288631 - DNA, 23 bp, Artificial Sequence
  Description of Artificial Sequence: Synthetic oligonucleotide
gggctgagcagtcccagcgacag

SEQ ID NO: 288632 - DNA, 24 bp, Artificial Sequence
  Description of Artificial Sequence: Synthetic oligonucleotide
ggctgagcagtcccagcgacagct

SEQ ID NO: 288633 - DNA, 24 bp, Artificial Sequence
  Description of Artificial Sequence: Synthetic oligonucleotide
gctgagcagtcccagcgacagctg

SEQ ID NO: 288634 - DNA, 25 bp, Artificial Sequence
  Description of Artificial Sequence: Synthetic oligonucleotide
ctgagcagtcccagcgacagctgga

SEQ ID NO: 288635 - DNA, 26 bp, Artificial Sequence
  Description of Artificial Sequence: Synthetic oligonucleotide
tgagcagtcccagcgacagctggaca

SEQ ID NO: 288636 - DNA, 25 bp, Artificial Sequence
  Description of Artificial Sequence: Synthetic oligonucleotide
gagcagtcccagcgacagctggaca

SEQ ID NO: 288637 - DNA, 26 bp, Artificial Sequence
  Description of Artificial Sequence: Synthetic oligonucleotide
agcagtcccagcgacagctggacaga

SEQ ID NO: 288638 - DNA, 25 bp, Artificial Sequence
  Description of Artificial Sequence: Synthetic oligonucleotide
gcagtcccagcgacagctggacaga

SEQ ID NO: 288639 - DNA, 26 bp, Artificial Sequence
  Description of Artificial Sequence: Synthetic oligonucleotide
cagtcccagcgacagctggacagagt

SEQ ID NO: 288640 - DNA, 27 bp, Artificial Sequence
  Description of Artificial Sequence: Synthetic oligonucleotide
agtcccagcgacagctggacagagtca

SEQ ID NO: 288641 - DNA, 26 bp, Artificial Sequence
  Description of Artificial Sequence: Synthetic oligonucleotide
gtcccagcgacagctggacagagtca

SEQ ID NO: 288642 - DNA, 26 bp, Artificial Sequence
  Description of Artificial Sequence: Synthetic oligonucleotide
tcccagcgacagctggacagagtcac

SEQ ID NO: 288643 - DNA, 25 bp, Artificial Sequence
  Description of Artificial Sequence: Synthetic oligonucleotide
cccagcgacagctggacagagtcac

SEQ ID NO: 288644 - DNA, 27 bp, Artificial Sequence
  Description of Artificial Sequence: Synthetic oligonucleotide
ccagcgacagctggacagagtcacctt

SEQ ID NO: 288645 - DNA, 27 bp, Artificial Sequence
  Description of Artificial Sequence: Synthetic oligonucleotide
cagcgacagctggacagagtcaccttc

SEQ ID NO: 288646 - DNA, 27 bp, Artificial Sequence
  Description of Artificial Sequence: Synthetic oligonucleotide
agcgacagctggacagagtcaccttcg

SEQ ID NO: 288647 - DNA, 27 bp, Artificial Sequence
  Description of Artificial Sequence: Synthetic oligonucleotide
gcgacagctggacagagtcaccttcga

SEQ ID NO: 288648 - DNA, 27 bp, Artificial Sequence
  Description of Artificial Sequence: Synthetic oligonucleotide
cgacagctggacagagtcaccttcgag

SEQ ID NO: 288649 - DNA, 27 bp, Artificial Sequence
  Description of Artificial Sequence: Synthetic oligonucleotide
gacagctggacagagtcaccttcgagg

SEQ ID NO: 288650 - DNA, 28 bp, Artificial Sequence
  Description of Artificial Sequence: Synthetic oligonucleotide
acagctggacagagtcaccttcgaggac

SEQ ID NO: 288651 - DNA, 27 bp, Artificial Sequence
  Description of Artificial Sequence: Synthetic oligonucleotide
cagctggacagagtcaccttcgaggac

SEQ ID NO: 288652 - DNA, 29 bp, Artificial Sequence
  Description of Artificial Sequence: Synthetic oligonucleotide
agctggacagagtcaccttcgaggacatc

SEQ ID NO: 288653 - DNA, 28 bp, Artificial Sequence
  Description of Artificial Sequence: Synthetic oligonucleotide
gctggacagagtcaccttcgaggacatc

SEQ ID NO: 288654 - DNA, 30 bp, Artificial Sequence
  Description of Artificial Sequence: Synthetic oligonucleotide
ctggacagagtcaccttcgaggacatctag

SEQ ID NO: 288655 - DNA, 30 bp, Artificial Sequence
  Description of Artificial Sequence: Synthetic oligonucleotide
tggacagagtcaccttcgaggacatctagg

SEQ ID NO: 288656 - DNA, 29 bp, Artificial Sequence
  Description of Artificial Sequence: Synthetic oligonucleotide
ggacagagtcaccttcgaggacatctagg

SEQ ID NO: 288657 - DNA, 30 bp, Artificial Sequence
  Description of Artificial Sequence: Synthetic oligonucleotide
gacagagtcaccttcgaggacatctaggag

SEQ ID NO: 288658 - DNA, 30 bp, Artificial Sequence
  Description of Artificial Sequence: Synthetic oligonucleotide
acagagtcaccttcgaggacatctaggagc

SEQ ID NO: 288659 - DNA, 29 bp, Artificial Sequence
  Description of Artificial Sequence: Synthetic oligonucleotide
cagagtcaccttcgaggacatctaggagc

SEQ ID NO: 288660 - DNA, 30 bp, Artificial Sequence
  Description of Artificial Sequence: Synthetic oligonucleotide
agagtcaccttcgaggacatctaggagcac

SEQ ID NO: 288661 - DNA, 29 bp, Artificial Sequence
  Description of Artificial Sequence: Synthetic oligonucleotide
gagtcaccttcgaggacatctaggagcac

SEQ ID NO: 288662 - DNA, 29 bp, Artificial Sequence
  Description of Artificial Sequence: Synthetic oligonucleotide
agtcaccttcgaggacatctaggagcacg

SEQ ID NO: 288663 - DNA, 28 bp, Artificial Sequence
  Description of Artificial Sequence: Synthetic oligonucleotide
gtcaccttcgaggacatctaggagcacg

SEQ ID NO: 288664 - DNA, 29 bp, Artificial Sequence
  Description of Artificial Sequence: Synthetic oligonucleotide
tcaccttcgaggacatctaggagcacgag

SEQ ID NO: 288665 - DNA, 28 bp, Artificial Sequence
  Description of Artificial Sequence: Synthetic oligonucleotide
caccttcgaggacatctaggagcacgag

SEQ ID NO: 288666 - DNA, 31 bp, Artificial Sequence
  Description of Artificial Sequence: Synthetic oligonucleotide
accttcgaggacatctaggagcacgagaaac

SEQ ID NO: 288667 - DNA, 30 bp, Artificial Sequence
  Description of Artificial Sequence: Synthetic oligonucleotide
ccttcgaggacatctaggagcacgagaaac

SEQ ID NO: 288668 - DNA, 31 bp, Artificial Sequence
  Description of Artificial Sequence: Synthetic oligonucleotide
cttcgaggacatctaggagcacgagaaacag

SEQ ID NO: 288669 - DNA, 31 bp, Artificial Sequence
  Description of Artificial Sequence: Synthetic oligonucleotide
ttcgaggacatctaggagcacgagaaacagc

SEQ ID NO: 288670 - DNA, 30 bp, Artificial Sequence
  Description of Artificial Sequence: Synthetic oligonucleotide
tcgaggacatctaggagcacgagaaacagc

SEQ ID NO: 288671 - DNA, 29 bp, Artificial Sequence
  Description of Artificial Sequence: Synthetic oligonucleotide
cgaggacatctaggagcacgagaaacagc

SEQ ID NO: 288672 - DNA, 31 bp, Artificial Sequence
  Description of Artificial Sequence: Synthetic oligonucleotide
gaggacatctaggagcacgagaaacagcttg

SEQ ID NO: 288673 - DNA, 32 bp, Artificial Sequence
  Description of Artificial Sequence: Synthetic oligonucleotide
aggacatctaggagcacgagaaacagcttgag

SEQ ID NO: 288674 - DNA, 31 bp, Artificial Sequence
  Description of Artificial Sequence: Synthetic oligonucleotide
ggacatctaggagcacgagaaacagcttgag

SEQ ID NO: 288675 - DNA, 34 bp, Artificial Sequence
  Description of Artificial Sequence: Synthetic oligonucleotide
gacatctaggagcacgagaaacagcttgagaaag

SEQ ID NO: 288676 - DNA, 34 bp, Artificial Sequence
  Description of Artificial Sequence: Synthetic oligonucleotide
acatctaggagcacgagaaacagcttgagaaagc

SEQ ID NO: 288677 - DNA, 33 bp, Artificial Sequence
  Description of Artificial Sequence: Synthetic oligonucleotide
catctaggagcacgagaaacagcttgagaaagc

SEQ ID NO: 288678 - DNA, 33 bp, Artificial Sequence
  Description of Artificial Sequence: Synthetic oligonucleotide
atctaggagcacgagaaacagcttgagaaagcg

SEQ ID NO: 288679 - DNA, 32 bp, Artificial Sequence
  Description of Artificial Sequence: Synthetic oligonucleotide
tctaggagcacgagaaacagcttgagaaagcg

SEQ ID NO: 288680 - DNA, 31 bp, Artificial Sequence
  Description of Artificial Sequence: Synthetic oligonucleotide
ctaggagcacgagaaacagcttgagaaagcg

SEQ ID NO: 288681 - DNA, 31 bp, Artificial Sequence
  Description of Artificial Sequence: Synthetic oligonucleotide
taggagcacgagaaacagcttgagaaagcgc

SEQ ID NO: 288682 - DNA, 30 bp, Artificial Sequence
  Description of Artificial Sequence: Synthetic oligonucleotide
aggagcacgagaaacagcttgagaaagcgc

SEQ ID NO: 288683 - DNA, 29 bp, Artificial Sequence
  Description of Artificial Sequence: Synthetic oligonucleotide
ggagcacgagaaacagcttgagaaagcgc

SEQ ID NO: 288684 - DNA, 32 bp, Artificial Sequence
  Description of Artificial Sequence: Synthetic oligonucleotide
gagcacgagaaacagcttgagaaagcgctttc

SEQ ID NO: 288685 - DNA, 33 bp, Artificial Sequence
  Description of Artificial Sequence: Synthetic oligonucleotide
agcacgagaaacagcttgagaaagcgctttcag

SEQ ID NO: 288686 - DNA, 32 bp, Artificial Sequence
  Description of Artificial Sequence: Synthetic oligonucleotide
gcacgagaaacagcttgagaaagcgctttcag

SEQ ID NO: 288687 - DNA, 32 bp, Artificial Sequence
  Description of Artificial Sequence: Synthetic oligonucleotide
cacgagaaacagcttgagaaagcgctttcagg

SEQ ID NO: 288688 - DNA, 32 bp, Artificial Sequence
  Description of Artificial Sequence: Synthetic oligonucleotide
acgagaaacagcttgagaaagcgctttcaggc

SEQ ID NO: 288689 - DNA, 31 bp, Artificial Sequence
  Description of Artificial Sequence: Synthetic oligonucleotide
cgagaaacagcttgagaaagcgctttcaggc

SEQ ID NO: 288690 - DNA, 33 bp, Artificial Sequence
  Description of Artificial Sequence: Synthetic oligonucleotide
gagaaacagcttgagaaagcgctttcaggcatg

SEQ ID NO: 288691 - DNA, 33 bp, Artificial Sequence
  Description of Artificial Sequence: Synthetic oligonucleotide
agaaacagcttgagaaagcgctttcaggcatgg

SEQ ID NO: 288692 - DNA, 32 bp, Artificial Sequence
  Description of Artificial Sequence: Synthetic oligonucleotide
gaaacagcttgagaaagcgctttcaggcatgg

SEQ ID NO: 288693 - DNA, 33 bp, Artificial Sequence
  Description of Artificial Sequence: Synthetic oligonucleotide
aaacagcttgagaaagcgctttcaggcatggag

SEQ ID NO: 288694 - DNA, 32 bp, Artificial Sequence
  Description of Artificial Sequence: Synthetic oligonucleotide
aacagcttgagaaagcgctttcaggcatggag

SEQ ID NO: 288695 - DNA, 31 bp, Artificial Sequence
  Description of Artificial Sequence: Synthetic oligonucleotide
acagcttgagaaagcgctttcaggcatggag

SEQ ID NO: 288696 - DNA, 30 bp, Artificial Sequence
  Description of Artificial Sequence: Synthetic oligonucleotide
cagcttgagaaagcgctttcaggcatggag

SEQ ID NO: 288697 - DNA, 30 bp, Artificial Sequence
  Description of Artificial Sequence: Synthetic oligonucleotide
agcttgagaaagcgctttcaggcatggagc

SEQ ID NO: 288698 - DNA, 29 bp, Artificial Sequence
  Description of Artificial Sequence: Synthetic oligonucleotide
gcttgagaaagcgctttcaggcatggagc

SEQ ID NO: 288699 - DNA, 29 bp, Artificial Sequence
  Description of Artificial Sequence: Synthetic oligonucleotide
cttgagaaagcgctttcaggcatggagcc

SEQ ID NO: 288700 - DNA, 29 bp, Artificial Sequence
  Description of Artificial Sequence: Synthetic oligonucleotide
ttgagaaagcgctttcaggcatggagccg

SEQ ID NO: 288701 - DNA, 28 bp, Artificial Sequence
  Description of Artificial Sequence: Synthetic oligonucleotide
tgagaaagcgctttcaggcatggagccg

SEQ ID NO: 288702 - DNA, 27 bp, Artificial Sequence
  Description of Artificial Sequence: Synthetic oligonucleotide
gagaaagcgctttcaggcatggagccg

SEQ ID NO: 288703 - DNA, 28 bp, Artificial Sequence
  Description of Artificial Sequence: Synthetic oligonucleotide
agaaagcgctttcaggcatggagccgag

SEQ ID NO: 288704 - DNA, 27 bp, Artificial Sequence
  Description of Artificial Sequence: Synthetic oligonucleotide
gaaagcgctttcaggcatggagccgag

SEQ ID NO: 288705 - DNA, 30 bp, Artificial Sequence
  Description of Artificial Sequence: Synthetic oligonucleotide
aaagcgctttcaggcatggagccgagtttc

SEQ ID NO: 288706 - DNA, 29 bp, Artificial Sequence
  Description of Artificial Sequence: Synthetic oligonucleotide
aagcgctttcaggcatggagccgagtttc

SEQ ID NO: 288707 - DNA, 28 bp, Artificial Sequence
  Description of Artificial Sequence: Synthetic oligonucleotide
agcgctttcaggcatggagccgagtttc

SEQ ID NO: 288708 - DNA, 27 bp, Artificial Sequence
  Description of Artificial Sequence: Synthetic oligonucleotide
gcgctttcaggcatggagccgagtttc

SEQ ID NO: 288709 - DNA, 27 bp, Artificial Sequence
  Description of Artificial Sequence: Synthetic oligonucleotide
cgctttcaggcatggagccgagtttcg

SEQ ID NO: 288710 - DNA, 28 bp, Artificial Sequence
  Description of Artificial Sequence: Synthetic oligonucleotide
gctttcaggcatggagccgagtttcgtg

SEQ ID NO: 288711 - DNA, 28 bp, Artificial Sequence
  Description of Artificial Sequence: Synthetic oligonucleotide
ctttcaggcatggagccgagtttcgtgc

SEQ ID NO: 288712 - DNA, 29 bp, Artificial Sequence
  Description of Artificial Sequence: Synthetic oligonucleotide
tttcaggcatggagccgagtttcgtgctg

SEQ ID NO: 288713 - DNA, 28 bp, Artificial Sequence
  Description of Artificial Sequence: Synthetic oligonucleotide
ttcaggcatggagccgagtttcgtgctg

SEQ ID NO: 288714 - DNA, 27 bp, Artificial Sequence
  Description of Artificial Sequence: Synthetic oligonucleotide
tcaggcatggagccgagtttcgtgctg

SEQ ID NO: 288715 - DNA, 26 bp, Artificial Sequence
  Description of Artificial Sequence: Synthetic oligonucleotide
caggcatggagccgagtttcgtgctg

SEQ ID NO: 288716 - DNA, 26 bp, Artificial Sequence
  Description of Artificial Sequence: Synthetic oligonucleotide
aggcatggagccgagtttcgtgctgg

SEQ ID NO: 288717 - DNA, 25 bp, Artificial Sequence
  Description of Artificial Sequence: Synthetic oligonucleotide
ggcatggagccgagtttcgtgctgg

SEQ ID NO: 288718 - DNA, 25 bp, Artificial Sequence
  Description of Artificial Sequence: Synthetic oligonucleotide
gcatggagccgagtttcgtgctggg

SEQ ID NO: 288719 - DNA, 25 bp, Artificial Sequence
  Description of Artificial Sequence: Synthetic oligonucleotide
catggagccgagtttcgtgctgggg

SEQ ID NO: 288720 - DNA, 25 bp, Artificial Sequence
  Description of Artificial Sequence: Synthetic oligonucleotide
atggagccgagtttcgtgctggggg

SEQ ID NO: 288721 - DNA, 24 bp, Artificial Sequence
  Description of Artificial Sequence: Synthetic oligonucleotide
tggagccgagtttcgtgctggggg

SEQ ID NO: 288722 - DNA, 23 bp, Artificial Sequence
  Description of Artificial Sequence: Synthetic oligonucleotide
ggagccgagtttcgtgctggggg

SEQ ID NO: 288723 - DNA, 23 bp, Artificial Sequence
  Description of Artificial Sequence: Synthetic oligonucleotide
gagccgagtttcgtgctgggggc

SEQ ID NO: 288724 - DNA, 23 bp, Artificial Sequence
  Description of Artificial Sequence: Synthetic oligonucleotide
agccgagtttcgtgctgggggcc

SEQ ID NO: 288725 - DNA, 22 bp, Artificial Sequence
  Description of Artificial Sequence: Synthetic oligonucleotide
gccgagtttcgtgctgggggcc

SEQ ID NO: 288726 - DNA, 23 bp, Artificial Sequence
  Description of Artificial Sequence: Synthetic oligonucleotide
ccgagtttcgtgctgggggccct

SEQ ID NO: 288727 - DNA, 23 bp, Artificial Sequence
  Description of Artificial Sequence: Synthetic oligonucleotide
cgagtttcgtgctgggggccctg

SEQ ID NO: 288728 - DNA, 23 bp, Artificial Sequence
  Description of Artificial Sequence: Synthetic oligonucleotide
gagtttcgtgctgggggccctgc

SEQ ID NO: 288729 - DNA, 23 bp, Artificial Sequence
  Description of Artificial Sequence: Synthetic oligonucleotide
agtttcgtgctgggggccctgcc

SEQ ID NO: 288730 - DNA, 22 bp, Artificial Sequence
  Description of Artificial Sequence: Synthetic oligonucleotide
gtttcgtgctgggggccctgcc

SEQ ID NO: 288731 - DNA, 24 bp, Artificial Sequence
  Description of Artificial Sequence: Synthetic oligonucleotide
tttcgtgctgggggccctgccgat

SEQ ID NO: 288732 - DNA, 23 bp, Artificial Sequence
  Description of Artificial Sequence: Synthetic oligonucleotide
ttcgtgctgggggccctgccgat

SEQ ID NO: 288733 - DNA, 22 bp, Artificial Sequence
  Description of Artificial Sequence: Synthetic oligonucleotide
tcgtgctgggggccctgccgat

SEQ ID NO: 288734 - DNA, 21 bp, Artificial Sequence
  Description of Artificial Sequence: Synthetic oligonucleotide
cgtgctgggggccctgccgat

SEQ ID NO: 288735 - DNA, 21 bp, Artificial Sequence
  Description of Artificial Sequence: Synthetic oligonucleotide
gtgctgggggccctgccgatg

SEQ ID NO: 288736 - DNA, 22 bp, Artificial Sequence
  Description of Artificial Sequence: Synthetic oligonucleotide
tgctgggggccctgccgatgct

SEQ ID NO: 288737 - DNA, 21 bp, Artificial Sequence
  Description of Artificial Sequence: Synthetic oligonucleotide
gctgggggccctgccgatgct

SEQ ID NO: 288738 - DNA, 21 bp, Artificial Sequence
  Description of Artificial Sequence: Synthetic oligonucleotide
ctgggggccctgccgatgctg

SEQ ID NO: 288739 - DNA, 21 bp, Artificial Sequence
  Description of Artificial Sequence: Synthetic oligonucleotide
tgggggccctgccgatgctgc

SEQ ID NO: 288740 - DNA, 20 bp, Artificial Sequence
  Description of Artificial Sequence: Synthetic oligonucleotide
gggggccctgccgatgctgc

SEQ ID NO: 288741 - DNA, 22 bp, Artificial Sequence
  Description of Artificial Sequence: Synthetic oligonucleotide
ggggccctgccgatgctgccat

SEQ ID NO: 288742 - DNA, 22 bp, Artificial Sequence
  Description of Artificial Sequence: Synthetic oligonucleotide
gggccctgccgatgctgccatc

SEQ ID NO: 288743 - DNA, 23 bp, Artificial Sequence
  Description of Artificial Sequence: Synthetic oligonucleotide
ggccctgccgatgctgccatcca

SEQ ID NO: 288744 - DNA, 25 bp, Artificial Sequence
  Description of Artificial Sequence: Synthetic oligonucleotide
gccctgccgatgctgccatccacat

SEQ ID NO: 288745 - DNA, 26 bp, Artificial Sequence
  Description of Artificial Sequence: Synthetic oligonucleotide
ccctgccgatgctgccatccacatca

SEQ ID NO: 288746 - DNA, 26 bp, Artificial Sequence
  Description of Artificial Sequence: Synthetic oligonucleotide
cctgccgatgctgccatccacatcag

SEQ ID NO: 288747 - DNA, 26 bp, Artificial Sequence
  Description of Artificial Sequence: Synthetic oligonucleotide
ctgccgatgctgccatccacatcagg

SEQ ID NO: 288748 - DNA, 26 bp, Artificial Sequence
  Description of Artificial Sequence: Synthetic oligonucleotide
tgccgatgctgccatccacatcaggc

SEQ ID NO: 288749 - DNA, 25 bp, Artificial Sequence
  Description of Artificial Sequence: Synthetic oligonucleotide
gccgatgctgccatccacatcaggc

SEQ ID NO: 288750 - DNA, 25 bp, Artificial Sequence
  Description of Artificial Sequence: Synthetic oligonucleotide
ccgatgctgccatccacatcaggcc

SEQ ID NO: 288751 - DNA, 25 bp, Artificial Sequence
  Description of Artificial Sequence: Synthetic oligonucleotide
cgatgctgccatccacatcaggccg

SEQ ID NO: 288752 - DNA, 25 bp, Artificial Sequence
  Description of Artificial Sequence: Synthetic oligonucleotide
gatgctgccatccacatcaggccgc

SEQ ID NO: 288753 - DNA, 26 bp, Artificial Sequence
  Description of Artificial Sequence: Synthetic oligonucleotide
atgctgccatccacatcaggccgcct

SEQ ID NO: 288754 - DNA, 25 bp, Artificial Sequence
  Description of Artificial Sequence: Synthetic oligonucleotide
tgctgccatccacatcaggccgcct

SEQ ID NO: 288755 - DNA, 24 bp, Artificial Sequence
  Description of Artificial Sequence: Synthetic oligonucleotide
gctgccatccacatcaggccgcct

SEQ ID NO: 288756 - DNA, 26 bp, Artificial Sequence
  Description of Artificial Sequence: Synthetic oligonucleotide
ctgccatccacatcaggccgcctcat

SEQ ID NO: 288757 - DNA, 26 bp, Artificial Sequence
  Description of Artificial Sequence: Synthetic oligonucleotide
tgccatccacatcaggccgcctcatc

SEQ ID NO: 288758 - DNA, 25 bp, Artificial Sequence
  Description of Artificial Sequence: Synthetic oligonucleotide
gccatccacatcaggccgcctcatc

SEQ ID NO: 288759 - DNA, 26 bp, Artificial Sequence
  Description of Artificial Sequence: Synthetic oligonucleotide
ccatccacatcaggccgcctcatcca

SEQ ID NO: 288760 - DNA, 27 bp, Artificial Sequence
  Description of Artificial Sequence: Synthetic oligonucleotide
catccacatcaggccgcctcatccact

SEQ ID NO: 288761 - DNA, 29 bp, Artificial Sequence
  Description of Artificial Sequence: Synthetic oligonucleotide
atccacatcaggccgcctcatccactatg

SEQ ID NO: 288762 - DNA, 28 bp, Artificial Sequence
  Description of Artificial Sequence: Synthetic oligonucleotide
tccacatcaggccgcctcatccactatg

SEQ ID NO: 288763 - DNA, 27 bp, Artificial Sequence
  Description of Artificial Sequence: Synthetic oligonucleotide
ccacatcaggccgcctcatccactatg

SEQ ID NO: 288764 - DNA, 29 bp, Artificial Sequence
  Description of Artificial Sequence: Synthetic oligonucleotide
cacatcaggccgcctcatccactatgtac

SEQ ID NO: 288765 - DNA, 30 bp, Artificial Sequence
  Description of Artificial Sequence: Synthetic oligonucleotide
acatcaggccgcctcatccactatgtactg

SEQ ID NO: 288766 - DNA, 29 bp, Artificial Sequence
  Description of Artificial Sequence: Synthetic oligonucleotide
catcaggccgcctcatccactatgtactg

SEQ ID NO: 288767 - DNA, 34 bp, Artificial Sequence
  Description of Artificial Sequence: Synthetic oligonucleotide
atcaggccgcctcatccactatgtactgtataag

SEQ ID NO: 288768 - DNA, 33 bp, Artificial Sequence
  Description of Artificial Sequence: Synthetic oligonucleotide
tcaggccgcctcatccactatgtactgtataag

SEQ ID NO: 288769 - DNA, 32 bp, Artificial Sequence
  Description of Artificial Sequence: Synthetic oligonucleotide
caggccgcctcatccactatgtactgtataag

SEQ ID NO: 288770 - DNA, 32 bp, Artificial Sequence
  Description of Artificial Sequence: Synthetic oligonucleotide
aggccgcctcatccactatgtactgtataagc

SEQ ID NO: 288771 - DNA, 31 bp, Artificial Sequence
  Description of Artificial Sequence: Synthetic oligonucleotide
ggccgcctcatccactatgtactgtataagc

SEQ ID NO: 288772 - DNA, 31 bp, Artificial Sequence
  Description of Artificial Sequence: Synthetic oligonucleotide
gccgcctcatccactatgtactgtataagcc

SEQ ID NO: 288773 - DNA, 32 bp, Artificial Sequence
  Description of Artificial Sequence: Synthetic oligonucleotide
ccgcctcatccactatgtactgtataagcctg

SEQ ID NO: 288774 - DNA, 33 bp, Artificial Sequence
  Description of Artificial Sequence: Synthetic oligonucleotide
cgcctcatccactatgtactgtataagcctgtg

SEQ ID NO: 288775 - DNA, 33 bp, Artificial Sequence
  Description of Artificial Sequence: Synthetic oligonucleotide
gcctcatccactatgtactgtataagcctgtgc

SEQ ID NO: 288776 - DNA, 34 bp, Artificial Sequence
  Description of Artificial Sequence: Synthetic oligonucleotide
cctcatccactatgtactgtataagcctgtgcag

SEQ ID NO: 288777 - DNA, 34 bp, Artificial Sequence
  Description of Artificial Sequence: Synthetic oligonucleotide
ctcatccactatgtactgtataagcctgtgcagg

SEQ ID NO: 288778 - DNA, 34 bp, Artificial Sequence
  Description of Artificial Sequence: Synthetic oligonucleotide
tcatccactatgtactgtataagcctgtgcaggc

SEQ ID NO: 288779 - DNA, 33 bp, Artificial Sequence
  Description of Artificial Sequence: Synthetic oligonucleotide
catccactatgtactgtataagcctgtgcaggc

SEQ ID NO: 288780 - DNA, 33 bp, Artificial Sequence
  Description of Artificial Sequence: Synthetic oligonucleotide
atccactatgtactgtataagcctgtgcaggcc

SEQ ID NO: 288781 - DNA, 32 bp, Artificial Sequence
  Description of Artificial Sequence: Synthetic oligonucleotide
tccactatgtactgtataagcctgtgcaggcc

SEQ ID NO: 288782 - DNA, 31 bp, Artificial Sequence
  Description of Artificial Sequence: Synthetic oligonucleotide
ccactatgtactgtataagcctgtgcaggcc

SEQ ID NO: 288783 - DNA, 33 bp, Artificial Sequence
  Description of Artificial Sequence: Synthetic oligonucleotide
cactatgtactgtataagcctgtgcaggccttc

SEQ ID NO: 288784 - DNA, 35 bp, Artificial Sequence
  Description of Artificial Sequence: Synthetic oligonucleotide
actatgtactgtataagcctgtgcaggccttcttc

SEQ ID NO: 288785 - DNA, 34 bp, Artificial Sequence
  Description of Artificial Sequence: Synthetic oligonucleotide
ctatgtactgtataagcctgtgcaggccttcttc

SEQ ID NO: 288786 - DNA, 35 bp, Artificial Sequence
  Description of Artificial Sequence: Synthetic oligonucleotide
tatgtactgtataagcctgtgcaggccttcttcac

SEQ ID NO: 288787 - DNA, 34 bp, Artificial Sequence
  Description of Artificial Sequence: Synthetic oligonucleotide
atgtactgtataagcctgtgcaggccttcttcac

SEQ ID NO: 288788 - DNA, 33 bp, Artificial Sequence
  Description of Artificial Sequence: Synthetic oligonucleotide
tgtactgtataagcctgtgcaggccttcttcac

SEQ ID NO: 288789 - DNA, 32 bp, Artificial Sequence
  Description of Artificial Sequence: Synthetic oligonucleotide
gtactgtataagcctgtgcaggccttcttcac

SEQ ID NO: 288790 - DNA, 34 bp, Artificial Sequence
  Description of Artificial Sequence: Synthetic oligonucleotide
tactgtataagcctgtgcaggccttcttcacatc

SEQ ID NO: 288791 - DNA, 33 bp, Artificial Sequence
  Description of Artificial Sequence: Synthetic oligonucleotide
actgtataagcctgtgcaggccttcttcacatc

SEQ ID NO: 288792 - DNA, 32 bp, Artificial Sequence
  Description of Artificial Sequence: Synthetic oligonucleotide
ctgtataagcctgtgcaggccttcttcacatc

SEQ ID NO: 288793 - DNA, 39 bp, Artificial Sequence
  Description of Artificial Sequence: Synthetic oligonucleotide
tgtataagcctgtgcaggccttcttcacatcaaataatc

SEQ ID NO: 288794 - DNA, 38 bp, Artificial Sequence
  Description of Artificial Sequence: Synthetic oligonucleotide
gtataagcctgtgcaggccttcttcacatcaaataatc

SEQ ID NO: 288795 - DNA, 38 bp, Artificial Sequence
  Description of Artificial Sequence: Synthetic oligonucleotide
tataagcctgtgcaggccttcttcacatcaaataatcc

SEQ ID NO: 288796 - DNA, 37 bp, Artificial Sequence
  Description of Artificial Sequence: Synthetic oligonucleotide
ataagcctgtgcaggccttcttcacatcaaataatcc

SEQ ID NO: 288797 - DNA, 36 bp, Artificial Sequence
  Description of Artificial Sequence: Synthetic oligonucleotide
taagcctgtgcaggccttcttcacatcaaataatcc

SEQ ID NO: 288798 - DNA, 35 bp, Artificial Sequence
  Description of Artificial Sequence: Synthetic oligonucleotide
aagcctgtgcaggccttcttcacatcaaataatcc

SEQ ID NO: 288799 - DNA, 34 bp, Artificial Sequence
  Description of Artificial Sequence: Synthetic oligonucleotide
agcctgtgcaggccttcttcacatcaaataatcc

SEQ ID NO: 288800 - DNA, 33 bp, Artificial Sequence
  Description of Artificial Sequence: Synthetic oligonucleotide
gcctgtgcaggccttcttcacatcaaataatcc

SEQ ID NO: 288801 - DNA, 33 bp, Artificial Sequence
  Description of Artificial Sequence: Synthetic oligonucleotide
cctgtgcaggccttcttcacatcaaataatccc

SEQ ID NO: 288802 - DNA, 34 bp, Artificial Sequence
  Description of Artificial Sequence: Synthetic oligonucleotide
ctgtgcaggccttcttcacatcaaataatcccac

SEQ ID NO: 288803 - DNA, 35 bp, Artificial Sequence
  Description of Artificial Sequence: Synthetic oligonucleotide
tgtgcaggccttcttcacatcaaataatcccactc

SEQ ID NO: 288804 - DNA, 34 bp, Artificial Sequence
  Description of Artificial Sequence: Synthetic oligonucleotide
gtgcaggccttcttcacatcaaataatcccactc

SEQ ID NO: 288805 - DNA, 34 bp, Artificial Sequence
  Description of Artificial Sequence: Synthetic oligonucleotide
tgcaggccttcttcacatcaaataatcccactcg

SEQ ID NO: 288806 - DNA, 33 bp, Artificial Sequence
  Description of Artificial Sequence: Synthetic oligonucleotide
gcaggccttcttcacatcaaataatcccactcg

SEQ ID NO: 288807 - DNA, 34 bp, Artificial Sequence
  Description of Artificial Sequence: Synthetic oligonucleotide
caggccttcttcacatcaaataatcccactcgag

SEQ ID NO: 288808 - DNA, 35 bp, Artificial Sequence
  Description of Artificial Sequence: Synthetic oligonucleotide
aggccttcttcacatcaaataatcccactcgagtc

SEQ ID NO: 288809 - DNA, 34 bp, Artificial Sequence
  Description of Artificial Sequence: Synthetic oligonucleotide
ggccttcttcacatcaaataatcccactcgagtc

SEQ ID NO: 288810 - DNA, 39 bp, Artificial Sequence
  Description of Artificial Sequence: Synthetic oligonucleotide
gccttcttcacatcaaataatcccactcgagtctttttg

SEQ ID NO: 288811 - DNA, 39 bp, Artificial Sequence
  Description of Artificial Sequence: Synthetic oligonucleotide
ccttcttcacatcaaataatcccactcgagtctttttgc

SEQ ID NO: 288812 - DNA, 40 bp, Artificial Sequence
  Description of Artificial Sequence: Synthetic oligonucleotide
cttcttcacatcaaataatcccactcgagtctttttgctg

SEQ ID NO: 288813 - DNA, 40 bp, Artificial Sequence
  Description of Artificial Sequence: Synthetic oligonucleotide
ttcttcacatcaaataatcccactcgagtctttttgctgc

SEQ ID NO: 288814 - DNA, 39 bp, Artificial Sequence
  Description of Artificial Sequence: Synthetic oligonucleotide
tcttcacatcaaataatcccactcgagtctttttgctgc

SEQ ID NO: 288815 - DNA, 38 bp, Artificial Sequence
  Description of Artificial Sequence: Synthetic oligonucleotide
cttcacatcaaataatcccactcgagtctttttgctgc

SEQ ID NO: 288816 - DNA, 38 bp, Artificial Sequence
  Description of Artificial Sequence: Synthetic oligonucleotide
ttcacatcaaataatcccactcgagtctttttgctgcc

SEQ ID NO: 288817 - DNA, 37 bp, Artificial Sequence
  Description of Artificial Sequence: Synthetic oligonucleotide
tcacatcaaataatcccactcgagtctttttgctgcc

SEQ ID NO: 288818 - DNA, 36 bp, Artificial Sequence
  Description of Artificial Sequence: Synthetic oligonucleotide
cacatcaaataatcccactcgagtctttttgctgcc

SEQ ID NO: 288819 - DNA, 36 bp, Artificial Sequence
  Description of Artificial Sequence: Synthetic oligonucleotide
acatcaaataatcccactcgagtctttttgctgccc

SEQ ID NO: 288820 - DNA, 35 bp, Artificial Sequence
  Description of Artificial Sequence: Synthetic oligonucleotide
catcaaataatcccactcgagtctttttgctgccc

SEQ ID NO: 288821 - DNA, 37 bp, Artificial Sequence
  Description of Artificial Sequence: Synthetic oligonucleotide
atcaaataatcccactcgagtctttttgctgcccttc

SEQ ID NO: 288822 - DNA, 36 bp, Artificial Sequence
  Description of Artificial Sequence: Synthetic oligonucleotide
tcaaataatcccactcgagtctttttgctgcccttc

SEQ ID NO: 288823 - DNA, 35 bp, Artificial Sequence
  Description of Artificial Sequence: Synthetic oligonucleotide
caaataatcccactcgagtctttttgctgcccttc

SEQ ID NO: 288824 - DNA, 35 bp, Artificial Sequence
  Description of Artificial Sequence: Synthetic oligonucleotide
aaataatcccactcgagtctttttgctgcccttcc

SEQ ID NO: 288825 - DNA, 34 bp, Artificial Sequence
  Description of Artificial Sequence: Synthetic oligonucleotide
aataatcccactcgagtctttttgctgcccttcc

SEQ ID NO: 288826 - DNA, 33 bp, Artificial Sequence
  Description of Artificial Sequence: Synthetic oligonucleotide
ataatcccactcgagtctttttgctgcccttcc

SEQ ID NO: 288827 - DNA, 32 bp, Artificial Sequence
  Description of Artificial Sequence: Synthetic oligonucleotide
taatcccactcgagtctttttgctgcccttcc

SEQ ID NO: 288828 - DNA, 31 bp, Artificial Sequence
  Description of Artificial Sequence: Synthetic oligonucleotide
aatcccactcgagtctttttgctgcccttcc

SEQ ID NO: 288829 - DNA, 30 bp, Artificial Sequence
  Description of Artificial Sequence: Synthetic oligonucleotide
atcccactcgagtctttttgctgcccttcc

SEQ ID NO: 288830 - DNA, 29 bp, Artificial Sequence
  Description of Artificial Sequence: Synthetic oligonucleotide
tcccactcgagtctttttgctgcccttcc

SEQ ID NO: 288831 - DNA, 28 bp, Artificial Sequence
  Description of Artificial Sequence: Synthetic oligonucleotide
cccactcgagtctttttgctgcccttcc

SEQ ID NO: 288832 - DNA, 29 bp, Artificial Sequence
  Description of Artificial Sequence: Synthetic oligonucleotide
ccactcgagtctttttgctgcccttcctg

SEQ ID NO: 288833 - DNA, 29 bp, Artificial Sequence
  Description of Artificial Sequence: Synthetic oligonucleotide
cactcgagtctttttgctgcccttcctgc

SEQ ID NO: 288834 - DNA, 31 bp, Artificial Sequence
  Description of Artificial Sequence: Synthetic oligonucleotide
actcgagtctttttgctgcccttcctgcaag

SEQ ID NO: 288835 - DNA, 30 bp, Artificial Sequence
  Description of Artificial Sequence: Synthetic oligonucleotide
ctcgagtctttttgctgcccttcctgcaag

SEQ ID NO: 288836 - DNA, 31 bp, Artificial Sequence
  Description of Artificial Sequence: Synthetic oligonucleotide
tcgagtctttttgctgcccttcctgcaagag

SEQ ID NO: 288837 - DNA, 30 bp, Artificial Sequence
  Description of Artificial Sequence: Synthetic oligonucleotide
cgagtctttttgctgcccttcctgcaagag

SEQ ID NO: 288838 - DNA, 30 bp, Artificial Sequence
  Description of Artificial Sequence: Synthetic oligonucleotide
gagtctttttgctgcccttcctgcaagagc

SEQ ID NO: 288839 - DNA, 30 bp, Artificial Sequence
  Description of Artificial Sequence: Synthetic oligonucleotide
agtctttttgctgcccttcctgcaagagcc

SEQ ID NO: 288840 - DNA, 29 bp, Artificial Sequence
  Description of Artificial Sequence: Synthetic oligonucleotide
gtctttttgctgcccttcctgcaagagcc

SEQ ID NO: 288841 - DNA, 29 bp, Artificial Sequence
  Description of Artificial Sequence: Synthetic oligonucleotide
tctttttgctgcccttcctgcaagagccc

SEQ ID NO: 288842 - DNA, 28 bp, Artificial Sequence
  Description of Artificial Sequence: Synthetic oligonucleotide
ctttttgctgcccttcctgcaagagccc

SEQ ID NO: 288843 - DNA, 30 bp, Artificial Sequence
  Description of Artificial Sequence: Synthetic oligonucleotide
tttttgctgcccttcctgcaagagcccaag

SEQ ID NO: 288844 - DNA, 29 bp, Artificial Sequence
  Description of Artificial Sequence: Synthetic oligonucleotide
ttttgctgcccttcctgcaagagcccaag

SEQ ID NO: 288845 - DNA, 28 bp, Artificial Sequence
  Description of Artificial Sequence: Synthetic oligonucleotide
tttgctgcccttcctgcaagagcccaag

SEQ ID NO: 288846 - DNA, 27 bp, Artificial Sequence
  Description of Artificial Sequence: Synthetic oligonucleotide
ttgctgcccttcctgcaagagcccaag

SEQ ID NO: 288847 - DNA, 26 bp, Artificial Sequence
  Description of Artificial Sequence: Synthetic oligonucleotide
tgctgcccttcctgcaagagcccaag

SEQ ID NO: 288848 - DNA, 25 bp, Artificial Sequence
  Description of Artificial Sequence: Synthetic oligonucleotide
gctgcccttcctgcaagagcccaag

SEQ ID NO: 288849 - DNA, 26 bp, Artificial Sequence
  Description of Artificial Sequence: Synthetic oligonucleotide
ctgcccttcctgcaagagcccaagga

SEQ ID NO: 288850 - DNA, 27 bp, Artificial Sequence
  Description of Artificial Sequence: Synthetic oligonucleotide
tgcccttcctgcaagagcccaaggaca

SEQ ID NO: 288851 - DNA, 26 bp, Artificial Sequence
  Description of Artificial Sequence: Synthetic oligonucleotide
gcccttcctgcaagagcccaaggaca

SEQ ID NO: 288852 - DNA, 27 bp, Artificial Sequence
  Description of Artificial Sequence: Synthetic oligonucleotide
cccttcctgcaagagcccaaggacaca

SEQ ID NO: 288853 - DNA, 27 bp, Artificial Sequence
  Description of Artificial Sequence: Synthetic oligonucleotide
ccttcctgcaagagcccaaggacacag

SEQ ID NO: 288854 - DNA, 28 bp, Artificial Sequence
  Description of Artificial Sequence: Synthetic oligonucleotide
cttcctgcaagagcccaaggacacagac

SEQ ID NO: 288855 - DNA, 28 bp, Artificial Sequence
  Description of Artificial Sequence: Synthetic oligonucleotide
ttcctgcaagagcccaaggacacagacg

SEQ ID NO: 288856 - DNA, 27 bp, Artificial Sequence
  Description of Artificial Sequence: Synthetic oligonucleotide
tcctgcaagagcccaaggacacagacg

SEQ ID NO: 288857 - DNA, 26 bp, Artificial Sequence
  Description of Artificial Sequence: Synthetic oligonucleotide
cctgcaagagcccaaggacacagacg

SEQ ID NO: 288858 - DNA, 27 bp, Artificial Sequence
  Description of Artificial Sequence: Synthetic oligonucleotide
ctgcaagagcccaaggacacagacgct

SEQ ID NO: 288859 - DNA, 27 bp, Artificial Sequence
  Description of Artificial Sequence: Synthetic oligonucleotide
tgcaagagcccaaggacacagacgctg

SEQ ID NO: 288860 - DNA, 27 bp, Artificial Sequence
  Description of Artificial Sequence: Synthetic oligonucleotide
gcaagagcccaaggacacagacgctga

SEQ ID NO: 288861 - DNA, 31 bp, Artificial Sequence
  Description of Artificial Sequence: Synthetic oligonucleotide
caagagcccaaggacacagacgctgatttag

SEQ ID NO: 288862 - DNA, 32 bp, Artificial Sequence
  Description of Artificial Sequence: Synthetic oligonucleotide
aagagcccaaggacacagacgctgatttagag

SEQ ID NO: 288863 - DNA, 31 bp, Artificial Sequence
  Description of Artificial Sequence: Synthetic oligonucleotide
agagcccaaggacacagacgctgatttagag

SEQ ID NO: 288864 - DNA, 30 bp, Artificial Sequence
  Description of Artificial Sequence: Synthetic oligonucleotide
gagcccaaggacacagacgctgatttagag

SEQ ID NO: 288865 - DNA, 32 bp, Artificial Sequence
  Description of Artificial Sequence: Synthetic oligonucleotide
agcccaaggacacagacgctgatttagagttc

SEQ ID NO: 288866 - DNA, 31 bp, Artificial Sequence
  Description of Artificial Sequence: Synthetic oligonucleotide
gcccaaggacacagacgctgatttagagttc

SEQ ID NO: 288867 - DNA, 31 bp, Artificial Sequence
  Description of Artificial Sequence: Synthetic oligonucleotide
cccaaggacacagacgctgatttagagttcc

SEQ ID NO: 288868 - DNA, 31 bp, Artificial Sequence
  Description of Artificial Sequence: Synthetic oligonucleotide
ccaaggacacagacgctgatttagagttccg

SEQ ID NO: 288869 - DNA, 32 bp, Artificial Sequence
  Description of Artificial Sequence: Synthetic oligonucleotide
caaggacacagacgctgatttagagttccgtc

SEQ ID NO: 288870 - DNA, 32 bp, Artificial Sequence
  Description of Artificial Sequence: Synthetic oligonucleotide
aaggacacagacgctgatttagagttccgtcg

SEQ ID NO: 288871 - DNA, 31 bp, Artificial Sequence
  Description of Artificial Sequence: Synthetic oligonucleotide
aggacacagacgctgatttagagttccgtcg

SEQ ID NO: 288872 - DNA, 30 bp, Artificial Sequence
  Description of Artificial Sequence: Synthetic oligonucleotide
ggacacagacgctgatttagagttccgtcg

SEQ ID NO: 288873 - DNA, 30 bp, Artificial Sequence
  Description of Artificial Sequence: Synthetic oligonucleotide
gacacagacgctgatttagagttccgtcgc

SEQ ID NO: 288874 - DNA, 30 bp, Artificial Sequence
  Description of Artificial Sequence: Synthetic oligonucleotide
acacagacgctgatttagagttccgtcgcc

SEQ ID NO: 288875 - DNA, 29 bp, Artificial Sequence
  Description of Artificial Sequence: Synthetic oligonucleotide
cacagacgctgatttagagttccgtcgcc

SEQ ID NO: 288876 - DNA, 29 bp, Artificial Sequence
  Description of Artificial Sequence: Synthetic oligonucleotide
acagacgctgatttagagttccgtcgccg

SEQ ID NO: 288877 - DNA, 28 bp, Artificial Sequence
  Description of Artificial Sequence: Synthetic oligonucleotide
cagacgctgatttagagttccgtcgccg

SEQ ID NO: 288878 - DNA, 28 bp, Artificial Sequence
  Description of Artificial Sequence: Synthetic oligonucleotide
agacgctgatttagagttccgtcgccgc

SEQ ID NO: 288879 - DNA, 27 bp, Artificial Sequence
  Description of Artificial Sequence: Synthetic oligonucleotide
gacgctgatttagagttccgtcgccgc

SEQ ID NO: 288880 - DNA, 28 bp, Artificial Sequence
  Description of Artificial Sequence: Synthetic oligonucleotide
acgctgatttagagttccgtcgccgcac

SEQ ID NO: 288881 - DNA, 27 bp, Artificial Sequence
  Description of Artificial Sequence: Synthetic oligonucleotide
cgctgatttagagttccgtcgccgcac

SEQ ID NO: 288882 - DNA, 27 bp, Artificial Sequence
  Description of Artificial Sequence: Synthetic oligonucleotide
gctgatttagagttccgtcgccgcacg

SEQ ID NO: 288883 - DNA, 27 bp, Artificial Sequence
  Description of Artificial Sequence: Synthetic oligonucleotide
ctgatttagagttccgtcgccgcacgg

SEQ ID NO: 288884 - DNA, 27 bp, Artificial Sequence
  Description of Artificial Sequence: Synthetic oligonucleotide
tgatttagagttccgtcgccgcacggg

SEQ ID NO: 288885 - DNA, 27 bp, Artificial Sequence
  Description of Artificial Sequence: Synthetic oligonucleotide
gatttagagttccgtcgccgcacgggt

SEQ ID NO: 288886 - DNA, 30 bp, Artificial Sequence
  Description of Artificial Sequence: Synthetic oligonucleotide
atttagagttccgtcgccgcacgggtaaag

SEQ ID NO: 288887 - DNA, 29 bp, Artificial Sequence
  Description of Artificial Sequence: Synthetic oligonucleotide
tttagagttccgtcgccgcacgggtaaag

SEQ ID NO: 288888 - DNA, 28 bp, Artificial Sequence
  Description of Artificial Sequence: Synthetic oligonucleotide
ttagagttccgtcgccgcacgggtaaag

SEQ ID NO: 288889 - DNA, 27 bp, Artificial Sequence
  Description of Artificial Sequence: Synthetic oligonucleotide
tagagttccgtcgccgcacgggtaaag

SEQ ID NO: 288890 - DNA, 26 bp, Artificial Sequence
  Description of Artificial Sequence: Synthetic oligonucleotide
agagttccgtcgccgcacgggtaaag

SEQ ID NO: 288891 - DNA, 25 bp, Artificial Sequence
  Description of Artificial Sequence: Synthetic oligonucleotide
gagttccgtcgccgcacgggtaaag

SEQ ID NO: 288892 - DNA, 26 bp, Artificial Sequence
  Description of Artificial Sequence: Synthetic oligonucleotide
agttccgtcgccgcacgggtaaagct

SEQ ID NO: 288893 - DNA, 25 bp, Artificial Sequence
  Description of Artificial Sequence: Synthetic oligonucleotide
gttccgtcgccgcacgggtaaagct

SEQ ID NO: 288894 - DNA, 25 bp, Artificial Sequence
  Description of Artificial Sequence: Synthetic oligonucleotide
ttccgtcgccgcacgggtaaagctg

SEQ ID NO: 288895 - DNA, 24 bp, Artificial Sequence
  Description of Artificial Sequence: Synthetic oligonucleotide
tccgtcgccgcacgggtaaagctg

SEQ ID NO: 288896 - DNA, 23 bp, Artificial Sequence
  Description of Artificial Sequence: Synthetic oligonucleotide
ccgtcgccgcacgggtaaagctg

SEQ ID NO: 288897 - DNA, 23 bp, Artificial Sequence
  Description of Artificial Sequence: Synthetic oligonucleotide
cgtcgccgcacgggtaaagctgc

SEQ ID NO: 288898 - DNA, 24 bp, Artificial Sequence
  Description of Artificial Sequence: Synthetic oligonucleotide
gtcgccgcacgggtaaagctgcga

SEQ ID NO: 288899 - DNA, 24 bp, Artificial Sequence
  Description of Artificial Sequence: Synthetic oligonucleotide
tcgccgcacgggtaaagctgcgac

SEQ ID NO: 288900 - DNA, 23 bp, Artificial Sequence
  Description of Artificial Sequence: Synthetic oligonucleotide
cgccgcacgggtaaagctgcgac

SEQ ID NO: 288901 - DNA, 24 bp, Artificial Sequence
  Description of Artificial Sequence: Synthetic oligonucleotide
gccgcacgggtaaagctgcgacga

SEQ ID NO: 288902 - DNA, 25 bp, Artificial Sequence
  Description of Artificial Sequence: Synthetic oligonucleotide
ccgcacgggtaaagctgcgacgaca

SEQ ID NO: 288903 - DNA, 25 bp, Artificial Sequence
  Description of Artificial Sequence: Synthetic oligonucleotide
cgcacgggtaaagctgcgacgacac

SEQ ID NO: 288904 - DNA, 25 bp, Artificial Sequence
  Description of Artificial Sequence: Synthetic oligonucleotide
gcacgggtaaagctgcgacgacacc

SEQ ID NO: 288905 - DNA, 25 bp, Artificial Sequence
  Description of Artificial Sequence: Synthetic oligonucleotide
cacgggtaaagctgcgacgacaccc

SEQ ID NO: 288906 - DNA, 26 bp, Artificial Sequence
  Description of Artificial Sequence: Synthetic oligonucleotide
acgggtaaagctgcgacgacacccca

SEQ ID NO: 288907 - DNA, 25 bp, Artificial Sequence
  Description of Artificial Sequence: Synthetic oligonucleotide
cgggtaaagctgcgacgacacccca

SEQ ID NO: 288908 - DNA, 25 bp, Artificial Sequence
  Description of Artificial Sequence: Synthetic oligonucleotide
gggtaaagctgcgacgacaccccac

SEQ ID NO: 288909 - DNA, 26 bp, Artificial Sequence
  Description of Artificial Sequence: Synthetic oligonucleotide
ggtaaagctgcgacgacaccccacct

SEQ ID NO: 288910 - DNA, 26 bp, Artificial Sequence
  Description of Artificial Sequence: Synthetic oligonucleotide
gtaaagctgcgacgacaccccacctg

SEQ ID NO: 288911 - DNA, 26 bp, Artificial Sequence
  Description of Artificial Sequence: Synthetic oligonucleotide
taaagctgcgacgacaccccacctgc

SEQ ID NO: 288912 - DNA, 25 bp, Artificial Sequence
  Description of Artificial Sequence: Synthetic oligonucleotide
aaagctgcgacgacaccccacctgc

SEQ ID NO: 288913 - DNA, 24 bp, Artificial Sequence
  Description of Artificial Sequence: Synthetic oligonucleotide
aagctgcgacgacaccccacctgc

SEQ ID NO: 288914 - DNA, 23 bp, Artificial Sequence
  Description of Artificial Sequence: Synthetic oligonucleotide
agctgcgacgacaccccacctgc

SEQ ID NO: 288915 - DNA, 22 bp, Artificial Sequence
  Description of Artificial Sequence: Synthetic oligonucleotide
gctgcgacgacaccccacctgc

SEQ ID NO: 288916 - DNA, 23 bp, Artificial Sequence
  Description of Artificial Sequence: Synthetic oligonucleotide
ctgcgacgacaccccacctgcct

SEQ ID NO: 288917 - DNA, 25 bp, Artificial Sequence
  Description of Artificial Sequence: Synthetic oligonucleotide
tgcgacgacaccccacctgcctgat

SEQ ID NO: 288918 - DNA, 24 bp, Artificial Sequence
  Description of Artificial Sequence: Synthetic oligonucleotide
gcgacgacaccccacctgcctgat

SEQ ID NO: 288919 - DNA, 25 bp, Artificial Sequence
  Description of Artificial Sequence: Synthetic oligonucleotide
cgacgacaccccacctgcctgatgt

SEQ ID NO: 288920 - DNA, 25 bp, Artificial Sequence
  Description of Artificial Sequence: Synthetic oligonucleotide
gacgacaccccacctgcctgatgtg

SEQ ID NO: 288921 - DNA, 27 bp, Artificial Sequence
  Description of Artificial Sequence: Synthetic oligonucleotide
acgacaccccacctgcctgatgtggaa

SEQ ID NO: 288922 - DNA, 26 bp, Artificial Sequence
  Description of Artificial Sequence: Synthetic oligonucleotide
cgacaccccacctgcctgatgtggaa

SEQ ID NO: 288923 - DNA, 26 bp, Artificial Sequence
  Description of Artificial Sequence: Synthetic oligonucleotide
gacaccccacctgcctgatgtggaag

SEQ ID NO: 288924 - DNA, 26 bp, Artificial Sequence
  Description of Artificial Sequence: Synthetic oligonucleotide
acaccccacctgcctgatgtggaagc

SEQ ID NO: 288925 - DNA, 25 bp, Artificial Sequence
  Description of Artificial Sequence: Synthetic oligonucleotide
caccccacctgcctgatgtggaagc

SEQ ID NO: 288926 - DNA, 27 bp, Artificial Sequence
  Description of Artificial Sequence: Synthetic oligonucleotide
accccacctgcctgatgtggaagccaa

SEQ ID NO: 288927 - DNA, 27 bp, Artificial Sequence
  Description of Artificial Sequence: Synthetic oligonucleotide
ccccacctgcctgatgtggaagccaat

SEQ ID NO: 288928 - DNA, 27 bp, Artificial Sequence
  Description of Artificial Sequence: Synthetic oligonucleotide
cccacctgcctgatgtggaagccaatc

SEQ ID NO: 288929 - DNA, 28 bp, Artificial Sequence
  Description of Artificial Sequence: Synthetic oligonucleotide
ccacctgcctgatgtggaagccaatctc

SEQ ID NO: 288930 - DNA, 28 bp, Artificial Sequence
  Description of Artificial Sequence: Synthetic oligonucleotide
cacctgcctgatgtggaagccaatctcc

SEQ ID NO: 288931 - DNA, 30 bp, Artificial Sequence
  Description of Artificial Sequence: Synthetic oligonucleotide
acctgcctgatgtggaagccaatctccaac

SEQ ID NO: 288932 - DNA, 29 bp, Artificial Sequence
  Description of Artificial Sequence: Synthetic oligonucleotide
cctgcctgatgtggaagccaatctccaac

SEQ ID NO: 288933 - DNA, 30 bp, Artificial Sequence
  Description of Artificial Sequence: Synthetic oligonucleotide
ctgcctgatgtggaagccaatctccaacac

SEQ ID NO: 288934 - DNA, 30 bp, Artificial Sequence
  Description of Artificial Sequence: Synthetic oligonucleotide
tgcctgatgtggaagccaatctccaacacc

SEQ ID NO: 288935 - DNA, 29 bp, Artificial Sequence
  Description of Artificial Sequence: Synthetic oligonucleotide
gcctgatgtggaagccaatctccaacacc

SEQ ID NO: 288936 - DNA, 30 bp, Artificial Sequence
  Description of Artificial Sequence: Synthetic oligonucleotide
cctgatgtggaagccaatctccaacacctc

SEQ ID NO: 288937 - DNA, 30 bp, Artificial Sequence
  Description of Artificial Sequence: Synthetic oligonucleotide
ctgatgtggaagccaatctccaacacctcg

SEQ ID NO: 288938 - DNA, 31 bp, Artificial Sequence
  Description of Artificial Sequence: Synthetic oligonucleotide
tgatgtggaagccaatctccaacacctcgtg

SEQ ID NO: 288939 - DNA, 30 bp, Artificial Sequence
  Description of Artificial Sequence: Synthetic oligonucleotide
gatgtggaagccaatctccaacacctcgtg

SEQ ID NO: 288940 - DNA, 30 bp, Artificial Sequence
  Description of Artificial Sequence: Synthetic oligonucleotide
atgtggaagccaatctccaacacctcgtgg

SEQ ID NO: 288941 - DNA, 29 bp, Artificial Sequence
  Description of Artificial Sequence: Synthetic oligonucleotide
tgtggaagccaatctccaacacctcgtgg

SEQ ID NO: 288942 - DNA, 28 bp, Artificial Sequence
  Description of Artificial Sequence: Synthetic oligonucleotide
gtggaagccaatctccaacacctcgtgg

SEQ ID NO: 288943 - DNA, 29 bp, Artificial Sequence
  Description of Artificial Sequence: Synthetic oligonucleotide
tggaagccaatctccaacacctcgtggtg

SEQ ID NO: 288944 - DNA, 28 bp, Artificial Sequence
  Description of Artificial Sequence: Synthetic oligonucleotide
ggaagccaatctccaacacctcgtggtg

SEQ ID NO: 288945 - DNA, 30 bp, Artificial Sequence
  Description of Artificial Sequence: Synthetic oligonucleotide
gaagccaatctccaacacctcgtggtgatc

SEQ ID NO: 288946 - DNA, 32 bp, Artificial Sequence
  Description of Artificial Sequence: Synthetic oligonucleotide
aagccaatctccaacacctcgtggtgatcttc

SEQ ID NO: 288947 - DNA, 31 bp, Artificial Sequence
  Description of Artificial Sequence: Synthetic oligonucleotide
agccaatctccaacacctcgtggtgatcttc

SEQ ID NO: 288948 - DNA, 30 bp, Artificial Sequence
  Description of Artificial Sequence: Synthetic oligonucleotide
gccaatctccaacacctcgtggtgatcttc

SEQ ID NO: 288949 - DNA, 32 bp, Artificial Sequence
  Description of Artificial Sequence: Synthetic oligonucleotide
ccaatctccaacacctcgtggtgatcttcatg

SEQ ID NO: 288950 - DNA, 34 bp, Artificial Sequence
  Description of Artificial Sequence: Synthetic oligonucleotide
caatctccaacacctcgtggtgatcttcatgttg

SEQ ID NO: 288951 - DNA, 36 bp, Artificial Sequence
  Description of Artificial Sequence: Synthetic oligonucleotide
aatctccaacacctcgtggtgatcttcatgttgaac

SEQ ID NO: 288952 - DNA, 35 bp, Artificial Sequence
  Description of Artificial Sequence: Synthetic oligonucleotide
atctccaacacctcgtggtgatcttcatgttgaac

SEQ ID NO: 288953 - DNA, 34 bp, Artificial Sequence
  Description of Artificial Sequence: Synthetic oligonucleotide
tctccaacacctcgtggtgatcttcatgttgaac

SEQ ID NO: 288954 - DNA, 33 bp, Artificial Sequence
  Description of Artificial Sequence: Synthetic oligonucleotide
ctccaacacctcgtggtgatcttcatgttgaac

SEQ ID NO: 288955 - DNA, 34 bp, Artificial Sequence
  Description of Artificial Sequence: Synthetic oligonucleotide
tccaacacctcgtggtgatcttcatgttgaacag

SEQ ID NO: 288956 - DNA, 33 bp, Artificial Sequence
  Description of Artificial Sequence: Synthetic oligonucleotide
ccaacacctcgtggtgatcttcatgttgaacag

SEQ ID NO: 288957 - DNA, 33 bp, Artificial Sequence
  Description of Artificial Sequence: Synthetic oligonucleotide
caacacctcgtggtgatcttcatgttgaacagc

SEQ ID NO: 288958 - DNA, 35 bp, Artificial Sequence
  Description of Artificial Sequence: Synthetic oligonucleotide
aacacctcgtggtgatcttcatgttgaacagcatg

SEQ ID NO: 288959 - DNA, 34 bp, Artificial Sequence
  Description of Artificial Sequence: Synthetic oligonucleotide
acacctcgtggtgatcttcatgttgaacagcatg

SEQ ID NO: 288960 - DNA, 33 bp, Artificial Sequence
  Description of Artificial Sequence: Synthetic oligonucleotide
cacctcgtggtgatcttcatgttgaacagcatg

SEQ ID NO: 288961 - DNA, 33 bp, Artificial Sequence
  Description of Artificial Sequence: Synthetic oligonucleotide
acctcgtggtgatcttcatgttgaacagcatgc

SEQ ID NO: 288962 - DNA, 32 bp, Artificial Sequence
  Description of Artificial Sequence: Synthetic oligonucleotide
cctcgtggtgatcttcatgttgaacagcatgc

SEQ ID NO: 288963 - DNA, 32 bp, Artificial Sequence
  Description of Artificial Sequence: Synthetic oligonucleotide
ctcgtggtgatcttcatgttgaacagcatgcg

SEQ ID NO: 288964 - DNA, 32 bp, Artificial Sequence
  Description of Artificial Sequence: Synthetic oligonucleotide
tcgtggtgatcttcatgttgaacagcatgcgc

SEQ ID NO: 288965 - DNA, 31 bp, Artificial Sequence
  Description of Artificial Sequence: Synthetic oligonucleotide
cgtggtgatcttcatgttgaacagcatgcgc

SEQ ID NO: 288966 - DNA, 33 bp, Artificial Sequence
  Description of Artificial Sequence: Synthetic oligonucleotide
gtggtgatcttcatgttgaacagcatgcgctac

SEQ ID NO: 288967 - DNA, 36 bp, Artificial Sequence
  Description of Artificial Sequence: Synthetic oligonucleotide
tggtgatcttcatgttgaacagcatgcgctacaatg

SEQ ID NO: 288968 - DNA, 35 bp, Artificial Sequence
  Description of Artificial Sequence: Synthetic oligonucleotide
ggtgatcttcatgttgaacagcatgcgctacaatg

SEQ ID NO: 288969 - DNA, 36 bp, Artificial Sequence
  Description of Artificial Sequence: Synthetic oligonucleotide
gtgatcttcatgttgaacagcatgcgctacaatgag

SEQ ID NO: 288970 - DNA, 36 bp, Artificial Sequence
  Description of Artificial Sequence: Synthetic oligonucleotide
tgatcttcatgttgaacagcatgcgctacaatgagg

SEQ ID NO: 288971 - DNA, 35 bp, Artificial Sequence
  Description of Artificial Sequence: Synthetic oligonucleotide
gatcttcatgttgaacagcatgcgctacaatgagg

SEQ ID NO: 288972 - DNA, 35 bp, Artificial Sequence
  Description of Artificial Sequence: Synthetic oligonucleotide
atcttcatgttgaacagcatgcgctacaatgaggc

SEQ ID NO: 288973 - DNA, 34 bp, Artificial Sequence
  Description of Artificial Sequence: Synthetic oligonucleotide
tcttcatgttgaacagcatgcgctacaatgaggc

SEQ ID NO: 288974 - DNA, 33 bp, Artificial Sequence
  Description of Artificial Sequence: Synthetic oligonucleotide
cttcatgttgaacagcatgcgctacaatgaggc

SEQ ID NO: 288975 - DNA, 34 bp, Artificial Sequence
  Description of Artificial Sequence: Synthetic oligonucleotide
ttcatgttgaacagcatgcgctacaatgaggcac

SEQ ID NO: 288976 - DNA, 33 bp, Artificial Sequence
  Description of Artificial Sequence: Synthetic oligonucleotide
tcatgttgaacagcatgcgctacaatgaggcac

SEQ ID NO: 288977 - DNA, 32 bp, Artificial Sequence
  Description of Artificial Sequence: Synthetic oligonucleotide
catgttgaacagcatgcgctacaatgaggcac

SEQ ID NO: 288978 - DNA, 33 bp, Artificial Sequence
  Description of Artificial Sequence: Synthetic oligonucleotide
atgttgaacagcatgcgctacaatgaggcacag

SEQ ID NO: 288979 - DNA, 32 bp, Artificial Sequence
  Description of Artificial Sequence: Synthetic oligonucleotide
tgttgaacagcatgcgctacaatgaggcacag

SEQ ID NO: 288980 - DNA, 31 bp, Artificial Sequence
  Description of Artificial Sequence: Synthetic oligonucleotide
gttgaacagcatgcgctacaatgaggcacag

SEQ ID NO: 288981 - DNA, 33 bp, Artificial Sequence
  Description of Artificial Sequence: Synthetic oligonucleotide
ttgaacagcatgcgctacaatgaggcacagtag

SEQ ID NO: 288982 - DNA, 32 bp, Artificial Sequence
  Description of Artificial Sequence: Synthetic oligonucleotide
tgaacagcatgcgctacaatgaggcacagtag

SEQ ID NO: 288983 - DNA, 31 bp, Artificial Sequence
  Description of Artificial Sequence: Synthetic oligonucleotide
gaacagcatgcgctacaatgaggcacagtag

SEQ ID NO: 288984 - DNA, 33 bp, Artificial Sequence
  Description of Artificial Sequence: Synthetic oligonucleotide
aacagcatgcgctacaatgaggcacagtagatc

SEQ ID NO: 288985 - DNA, 32 bp, Artificial Sequence
  Description of Artificial Sequence: Synthetic oligonucleotide
acagcatgcgctacaatgaggcacagtagatc

SEQ ID NO: 288986 - DNA, 31 bp, Artificial Sequence
  Description of Artificial Sequence: Synthetic oligonucleotide
cagcatgcgctacaatgaggcacagtagatc

SEQ ID NO: 288987 - DNA, 32 bp, Artificial Sequence
  Description of Artificial Sequence: Synthetic oligonucleotide
agcatgcgctacaatgaggcacagtagatctc

SEQ ID NO: 288988 - DNA, 31 bp, Artificial Sequence
  Description of Artificial Sequence: Synthetic oligonucleotide
gcatgcgctacaatgaggcacagtagatctc

SEQ ID NO: 288989 - DNA, 32 bp, Artificial Sequence
  Description of Artificial Sequence: Synthetic oligonucleotide
catgcgctacaatgaggcacagtagatctctg

SEQ ID NO: 288990 - DNA, 34 bp, Artificial Sequence
  Description of Artificial Sequence: Synthetic oligonucleotide
atgcgctacaatgaggcacagtagatctctgttg

SEQ ID NO: 288991 - DNA, 33 bp, Artificial Sequence
  Description of Artificial Sequence: Synthetic oligonucleotide
tgcgctacaatgaggcacagtagatctctgttg

SEQ ID NO: 288992 - DNA, 32 bp, Artificial Sequence
  Description of Artificial Sequence: Synthetic oligonucleotide
gcgctacaatgaggcacagtagatctctgttg

SEQ ID NO: 288993 - DNA, 34 bp, Artificial Sequence
  Description of Artificial Sequence: Synthetic oligonucleotide
cgctacaatgaggcacagtagatctctgttgatc

SEQ ID NO: 288994 - DNA, 35 bp, Artificial Sequence
  Description of Artificial Sequence: Synthetic oligonucleotide
gctacaatgaggcacagtagatctctgttgatctg

SEQ ID NO: 288995 - DNA, 37 bp, Artificial Sequence
  Description of Artificial Sequence: Synthetic oligonucleotide
ctacaatgaggcacagtagatctctgttgatctgatc

SEQ ID NO: 288996 - DNA, 37 bp, Artificial Sequence
  Description of Artificial Sequence: Synthetic oligonucleotide
tacaatgaggcacagtagatctctgttgatctgatcc

SEQ ID NO: 288997 - DNA, 36 bp, Artificial Sequence
  Description of Artificial Sequence: Synthetic oligonucleotide
acaatgaggcacagtagatctctgttgatctgatcc

SEQ ID NO: 288998 - DNA, 35 bp, Artificial Sequence
  Description of Artificial Sequence: Synthetic oligonucleotide
caatgaggcacagtagatctctgttgatctgatcc

SEQ ID NO: 288999 - DNA, 36 bp, Artificial Sequence
  Description of Artificial Sequence: Synthetic oligonucleotide
aatgaggcacagtagatctctgttgatctgatccag

SEQ ID NO: 289000 - DNA, 35 bp, Artificial Sequence
  Description of Artificial Sequence: Synthetic oligonucleotide
atgaggcacagtagatctctgttgatctgatccag

SEQ ID NO: 289001 - DNA, 34 bp, Artificial Sequence
  Description of Artificial Sequence: Synthetic oligonucleotide
tgaggcacagtagatctctgttgatctgatccag

SEQ ID NO: 289002 - DNA, 33 bp, Artificial Sequence
  Description of Artificial Sequence: Synthetic oligonucleotide
gaggcacagtagatctctgttgatctgatccag

SEQ ID NO: 289003 - DNA, 35 bp, Artificial Sequence
  Description of Artificial Sequence: Synthetic oligonucleotide
aggcacagtagatctctgttgatctgatccagaag

SEQ ID NO: 289004 - DNA, 34 bp, Artificial Sequence
  Description of Artificial Sequence: Synthetic oligonucleotide
ggcacagtagatctctgttgatctgatccagaag

SEQ ID NO: 289005 - DNA, 36 bp, Artificial Sequence
  Description of Artificial Sequence: Synthetic oligonucleotide
gcacagtagatctctgttgatctgatccagaagatc

SEQ ID NO: 289006 - DNA, 37 bp, Artificial Sequence
  Description of Artificial Sequence: Synthetic oligonucleotide
cacagtagatctctgttgatctgatccagaagatctg

SEQ ID NO: 289007 - DNA, 39 bp, Artificial Sequence
  Description of Artificial Sequence: Synthetic oligonucleotide
acagtagatctctgttgatctgatccagaagatctgtac

SEQ ID NO: 289008 - DNA, 38 bp, Artificial Sequence
  Description of Artificial Sequence: Synthetic oligonucleotide
cagtagatctctgttgatctgatccagaagatctgtac

SEQ ID NO: 289009 - DNA, 39 bp, Artificial Sequence
  Description of Artificial Sequence: Synthetic oligonucleotide
agtagatctctgttgatctgatccagaagatctgtactc

SEQ ID NO: 289010 - DNA, 38 bp, Artificial Sequence
  Description of Artificial Sequence: Synthetic oligonucleotide
gtagatctctgttgatctgatccagaagatctgtactc

SEQ ID NO: 289011 - DNA, 39 bp, Artificial Sequence
  Description of Artificial Sequence: Synthetic oligonucleotide
tagatctctgttgatctgatccagaagatctgtactcag

SEQ ID NO: 289012 - DNA, 38 bp, Artificial Sequence
  Description of Artificial Sequence: Synthetic oligonucleotide
agatctctgttgatctgatccagaagatctgtactcag

SEQ ID NO: 289013 - DNA, 37 bp, Artificial Sequence
  Description of Artificial Sequence: Synthetic oligonucleotide
gatctctgttgatctgatccagaagatctgtactcag

SEQ ID NO: 289014 - DNA, 39 bp, Artificial Sequence
  Description of Artificial Sequence: Synthetic oligonucleotide
atctctgttgatctgatccagaagatctgtactcagatc

SEQ ID NO: 289015 - DNA, 38 bp, Artificial Sequence
  Description of Artificial Sequence: Synthetic oligonucleotide
tctctgttgatctgatccagaagatctgtactcagatc

SEQ ID NO: 289016 - DNA, 37 bp, Artificial Sequence
  Description of Artificial Sequence: Synthetic oligonucleotide
ctctgttgatctgatccagaagatctgtactcagatc

SEQ ID NO: 289017 - DNA, 37 bp, Artificial Sequence
  Description of Artificial Sequence: Synthetic oligonucleotide
tctgttgatctgatccagaagatctgtactcagatcc

SEQ ID NO: 289018 - DNA, 36 bp, Artificial Sequence
  Description of Artificial Sequence: Synthetic oligonucleotide
ctgttgatctgatccagaagatctgtactcagatcc

SEQ ID NO: 289019 - DNA, 36 bp, Artificial Sequence
  Description of Artificial Sequence: Synthetic oligonucleotide
tgttgatctgatccagaagatctgtactcagatccg

SEQ ID NO: 289020 - DNA, 35 bp, Artificial Sequence
  Description of Artificial Sequence: Synthetic oligonucleotide
gttgatctgatccagaagatctgtactcagatccg

SEQ ID NO: 289021 - DNA, 35 bp, Artificial Sequence
  Description of Artificial Sequence: Synthetic oligonucleotide
ttgatctgatccagaagatctgtactcagatccgc

SEQ ID NO: 289022 - DNA, 34 bp, Artificial Sequence
  Description of Artificial Sequence: Synthetic oligonucleotide
tgatctgatccagaagatctgtactcagatccgc

SEQ ID NO: 289023 - DNA, 33 bp, Artificial Sequence
  Description of Artificial Sequence: Synthetic oligonucleotide
gatctgatccagaagatctgtactcagatccgc

SEQ ID NO: 289024 - DNA, 33 bp, Artificial Sequence
  Description of Artificial Sequence: Synthetic oligonucleotide
atctgatccagaagatctgtactcagatccgcc

SEQ ID NO: 289025 - DNA, 32 bp, Artificial Sequence
  Description of Artificial Sequence: Synthetic oligonucleotide
tctgatccagaagatctgtactcagatccgcc

SEQ ID NO: 289026 - DNA, 31 bp, Artificial Sequence
  Description of Artificial Sequence: Synthetic oligonucleotide
ctgatccagaagatctgtactcagatccgcc

SEQ ID NO: 289027 - DNA, 31 bp, Artificial Sequence
  Description of Artificial Sequence: Synthetic oligonucleotide
tgatccagaagatctgtactcagatccgccg

SEQ ID NO: 289028 - DNA, 30 bp, Artificial Sequence
  Description of Artificial Sequence: Synthetic oligonucleotide
gatccagaagatctgtactcagatccgccg

SEQ ID NO: 289029 - DNA, 30 bp, Artificial Sequence
  Description of Artificial Sequence: Synthetic oligonucleotide
atccagaagatctgtactcagatccgccgg

SEQ ID NO: 289030 - DNA, 29 bp, Artificial Sequence
  Description of Artificial Sequence: Synthetic oligonucleotide
tccagaagatctgtactcagatccgccgg

SEQ ID NO: 289031 - DNA, 28 bp, Artificial Sequence
  Description of Artificial Sequence: Synthetic oligonucleotide
ccagaagatctgtactcagatccgccgg

SEQ ID NO: 289032 - DNA, 28 bp, Artificial Sequence
  Description of Artificial Sequence: Synthetic oligonucleotide
cagaagatctgtactcagatccgccggg

SEQ ID NO: 289033 - DNA, 28 bp, Artificial Sequence
  Description of Artificial Sequence: Synthetic oligonucleotide
agaagatctgtactcagatccgccgggc

SEQ ID NO: 289034 - DNA, 27 bp, Artificial Sequence
  Description of Artificial Sequence: Synthetic oligonucleotide
gaagatctgtactcagatccgccgggc

SEQ ID NO: 289035 - DNA, 27 bp, Artificial Sequence
  Description of Artificial Sequence: Synthetic oligonucleotide
aagatctgtactcagatccgccgggcg

SEQ ID NO: 289036 - DNA, 26 bp, Artificial Sequence
  Description of Artificial Sequence: Synthetic oligonucleotide
agatctgtactcagatccgccgggcg

SEQ ID NO: 289037 - DNA, 25 bp, Artificial Sequence
  Description of Artificial Sequence: Synthetic oligonucleotide
gatctgtactcagatccgccgggcg

SEQ ID NO: 289038 - DNA, 27 bp, Artificial Sequence
  Description of Artificial Sequence: Synthetic oligonucleotide
atctgtactcagatccgccgggcgcta

SEQ ID NO: 289039 - DNA, 26 bp, Artificial Sequence
  Description of Artificial Sequence: Synthetic oligonucleotide
tctgtactcagatccgccgggcgcta

SEQ ID NO: 289040 - DNA, 25 bp, Artificial Sequence
  Description of Artificial Sequence: Synthetic oligonucleotide
ctgtactcagatccgccgggcgcta

SEQ ID NO: 289041 - DNA, 26 bp, Artificial Sequence
  Description of Artificial Sequence: Synthetic oligonucleotide
tgtactcagatccgccgggcgctaga

SEQ ID NO: 289042 - DNA, 25 bp, Artificial Sequence
  Description of Artificial Sequence: Synthetic oligonucleotide
gtactcagatccgccgggcgctaga

SEQ ID NO: 289043 - DNA, 25 bp, Artificial Sequence
  Description of Artificial Sequence: Synthetic oligonucleotide
tactcagatccgccgggcgctagac

SEQ ID NO: 289044 - DNA, 24 bp, Artificial Sequence
  Description of Artificial Sequence: Synthetic oligonucleotide
actcagatccgccgggcgctagac

SEQ ID NO: 289045 - DNA, 23 bp, Artificial Sequence
  Description of Artificial Sequence: Synthetic oligonucleotide
ctcagatccgccgggcgctagac

SEQ ID NO: 289046 - DNA, 25 bp, Artificial Sequence
  Description of Artificial Sequence: Synthetic oligonucleotide
tcagatccgccgggcgctagacctt

SEQ ID NO: 289047 - DNA, 24 bp, Artificial Sequence
  Description of Artificial Sequence: Synthetic oligonucleotide
cagatccgccgggcgctagacctt

SEQ ID NO: 289048 - DNA, 26 bp, Artificial Sequence
  Description of Artificial Sequence: Synthetic oligonucleotide
agatccgccgggcgctagaccttcta

SEQ ID NO: 289049 - DNA, 25 bp, Artificial Sequence
  Description of Artificial Sequence: Synthetic oligonucleotide
gatccgccgggcgctagaccttcta

SEQ ID NO: 289050 - DNA, 25 bp, Artificial Sequence
  Description of Artificial Sequence: Synthetic oligonucleotide
atccgccgggcgctagaccttctag

SEQ ID NO: 289051 - DNA, 24 bp, Artificial Sequence
  Description of Artificial Sequence: Synthetic oligonucleotide
tccgccgggcgctagaccttctag

SEQ ID NO: 289052 - DNA, 23 bp, Artificial Sequence
  Description of Artificial Sequence: Synthetic oligonucleotide
ccgccgggcgctagaccttctag

SEQ ID NO: 289053 - DNA, 23 bp, Artificial Sequence
  Description of Artificial Sequence: Synthetic oligonucleotide
cgccgggcgctagaccttctagc

SEQ ID NO: 289054 - DNA, 23 bp, Artificial Sequence
  Description of Artificial Sequence: Synthetic oligonucleotide
gccgggcgctagaccttctagcc

SEQ ID NO: 289055 - DNA, 23 bp, Artificial Sequence
  Description of Artificial Sequence: Synthetic oligonucleotide
ccgggcgctagaccttctagccg

SEQ ID NO: 289056 - DNA, 26 bp, Artificial Sequence
  Description of Artificial Sequence: Synthetic oligonucleotide
cgggcgctagaccttctagccgcaat

SEQ ID NO: 289057 - DNA, 27 bp, Artificial Sequence
  Description of Artificial Sequence: Synthetic oligonucleotide
gggcgctagaccttctagccgcaatgt

SEQ ID NO: 289058 - DNA, 27 bp, Artificial Sequence
  Description of Artificial Sequence: Synthetic oligonucleotide
ggcgctagaccttctagccgcaatgtg

SEQ ID NO: 289059 - DNA, 30 bp, Artificial Sequence
  Description of Artificial Sequence: Synthetic oligonucleotide
gcgctagaccttctagccgcaatgtgttac

SEQ ID NO: 289060 - DNA, 36 bp, Artificial Sequence
  Description of Artificial Sequence: Synthetic oligonucleotide
cgctagaccttctagccgcaatgtgttactaatatc

SEQ ID NO: 289061 - DNA, 37 bp, Artificial Sequence
  Description of Artificial Sequence: Synthetic oligonucleotide
gctagaccttctagccgcaatgtgttactaatatcac

SEQ ID NO: 289062 - DNA, 37 bp, Artificial Sequence
  Description of Artificial Sequence: Synthetic oligonucleotide
ctagaccttctagccgcaatgtgttactaatatcacg

SEQ ID NO: 289063 - DNA, 37 bp, Artificial Sequence
  Description of Artificial Sequence: Synthetic oligonucleotide
tagaccttctagccgcaatgtgttactaatatcacgc

SEQ ID NO: 289064 - DNA, 36 bp, Artificial Sequence
  Description of Artificial Sequence: Synthetic oligonucleotide
agaccttctagccgcaatgtgttactaatatcacgc

SEQ ID NO: 289065 - DNA, 35 bp, Artificial Sequence
  Description of Artificial Sequence: Synthetic oligonucleotide
gaccttctagccgcaatgtgttactaatatcacgc

SEQ ID NO: 289066 - DNA, 35 bp, Artificial Sequence
  Description of Artificial Sequence: Synthetic oligonucleotide
accttctagccgcaatgtgttactaatatcacgcc

SEQ ID NO: 289067 - DNA, 34 bp, Artificial Sequence
  Description of Artificial Sequence: Synthetic oligonucleotide
ccttctagccgcaatgtgttactaatatcacgcc

SEQ ID NO: 289068 - DNA, 34 bp, Artificial Sequence
  Description of Artificial Sequence: Synthetic oligonucleotide
cttctagccgcaatgtgttactaatatcacgccg

SEQ ID NO: 289069 - DNA, 34 bp, Artificial Sequence
  Description of Artificial Sequence: Synthetic oligonucleotide
ttctagccgcaatgtgttactaatatcacgccgg

SEQ ID NO: 289070 - DNA, 33 bp, Artificial Sequence
  Description of Artificial Sequence: Synthetic oligonucleotide
tctagccgcaatgtgttactaatatcacgccgg

SEQ ID NO: 289071 - DNA, 32 bp, Artificial Sequence
  Description of Artificial Sequence: Synthetic oligonucleotide
ctagccgcaatgtgttactaatatcacgccgg

SEQ ID NO: 289072 - DNA, 32 bp, Artificial Sequence
  Description of Artificial Sequence: Synthetic oligonucleotide
tagccgcaatgtgttactaatatcacgccggg

SEQ ID NO: 289073 - DNA, 31 bp, Artificial Sequence
  Description of Artificial Sequence: Synthetic oligonucleotide
agccgcaatgtgttactaatatcacgccggg

SEQ ID NO: 289074 - DNA, 30 bp, Artificial Sequence
  Description of Artificial Sequence: Synthetic oligonucleotide
gccgcaatgtgttactaatatcacgccggg

SEQ ID NO: 289075 - DNA, 30 bp, Artificial Sequence
  Description of Artificial Sequence: Synthetic oligonucleotide
ccgcaatgtgttactaatatcacgccgggg

SEQ ID NO: 289076 - DNA, 31 bp, Artificial Sequence
  Description of Artificial Sequence: Synthetic oligonucleotide
cgcaatgtgttactaatatcacgccggggtc

SEQ ID NO: 289077 - DNA, 34 bp, Artificial Sequence
  Description of Artificial Sequence: Synthetic oligonucleotide
gcaatgtgttactaatatcacgccggggtctatg

SEQ ID NO: 289078 - DNA, 35 bp, Artificial Sequence
  Description of Artificial Sequence: Synthetic oligonucleotide
caatgtgttactaatatcacgccggggtctatgtg

SEQ ID NO: 289079 - DNA, 37 bp, Artificial Sequence
  Description of Artificial Sequence: Synthetic oligonucleotide
aatgtgttactaatatcacgccggggtctatgtgttc

SEQ ID NO: 289080 - DNA, 36 bp, Artificial Sequence
  Description of Artificial Sequence: Synthetic oligonucleotide
atgtgttactaatatcacgccggggtctatgtgttc

SEQ ID NO: 289081 - DNA, 35 bp, Artificial Sequence
  Description of Artificial Sequence: Synthetic oligonucleotide
tgtgttactaatatcacgccggggtctatgtgttc

SEQ ID NO: 289082 - DNA, 34 bp, Artificial Sequence
  Description of Artificial Sequence: Synthetic oligonucleotide
gtgttactaatatcacgccggggtctatgtgttc

SEQ ID NO: 289083 - DNA, 34 bp, Artificial Sequence
  Description of Artificial Sequence: Synthetic oligonucleotide
tgttactaatatcacgccggggtctatgtgttcc

SEQ ID NO: 289084 - DNA, 33 bp, Artificial Sequence
  Description of Artificial Sequence: Synthetic oligonucleotide
gttactaatatcacgccggggtctatgtgttcc

SEQ ID NO: 289085 - DNA, 34 bp, Artificial Sequence
  Description of Artificial Sequence: Synthetic oligonucleotide
ttactaatatcacgccggggtctatgtgttcctg

SEQ ID NO: 289086 - DNA, 33 bp, Artificial Sequence
  Description of Artificial Sequence: Synthetic oligonucleotide
tactaatatcacgccggggtctatgtgttcctg

SEQ ID NO: 289087 - DNA, 32 bp, Artificial Sequence
  Description of Artificial Sequence: Synthetic oligonucleotide
actaatatcacgccggggtctatgtgttcctg

SEQ ID NO: 289088 - DNA, 31 bp, Artificial Sequence
  Description of Artificial Sequence: Synthetic oligonucleotide
ctaatatcacgccggggtctatgtgttcctg

SEQ ID NO: 289089 - DNA, 31 bp, Artificial Sequence
  Description of Artificial Sequence: Synthetic oligonucleotide
taatatcacgccggggtctatgtgttcctgg

SEQ ID NO: 289090 - DNA, 30 bp, Artificial Sequence
  Description of Artificial Sequence: Synthetic oligonucleotide
aatatcacgccggggtctatgtgttcctgg

SEQ ID NO: 289091 - DNA, 29 bp, Artificial Sequence
  Description of Artificial Sequence: Synthetic oligonucleotide
atatcacgccggggtctatgtgttcctgg

SEQ ID NO: 289092 - DNA, 28 bp, Artificial Sequence
  Description of Artificial Sequence: Synthetic oligonucleotide
tatcacgccggggtctatgtgttcctgg

SEQ ID NO: 289093 - DNA, 27 bp, Artificial Sequence
  Description of Artificial Sequence: Synthetic oligonucleotide
atcacgccggggtctatgtgttcctgg

SEQ ID NO: 289094 - DNA, 27 bp, Artificial Sequence
  Description of Artificial Sequence: Synthetic oligonucleotide
tcacgccggggtctatgtgttcctgga

SEQ ID NO: 289095 - DNA, 26 bp, Artificial Sequence
  Description of Artificial Sequence: Synthetic oligonucleotide
cacgccggggtctatgtgttcctgga

SEQ ID NO: 289096 - DNA, 27 bp, Artificial Sequence
  Description of Artificial Sequence: Synthetic oligonucleotide
acgccggggtctatgtgttcctggaga

SEQ ID NO: 289097 - DNA, 27 bp, Artificial Sequence
  Description of Artificial Sequence: Synthetic oligonucleotide
cgccggggtctatgtgttcctggagaa

SEQ ID NO: 289098 - DNA, 27 bp, Artificial Sequence
  Description of Artificial Sequence: Synthetic oligonucleotide
gccggggtctatgtgttcctggagaag

SEQ ID NO: 289099 - DNA, 27 bp, Artificial Sequence
  Description of Artificial Sequence: Synthetic oligonucleotide
ccggggtctatgtgttcctggagaagc

SEQ ID NO: 289100 - DNA, 28 bp, Artificial Sequence
  Description of Artificial Sequence: Synthetic oligonucleotide
cggggtctatgtgttcctggagaagctg

SEQ ID NO: 289101 - DNA, 28 bp, Artificial Sequence
  Description of Artificial Sequence: Synthetic oligonucleotide
ggggtctatgtgttcctggagaagctgg

SEQ ID NO: 289102 - DNA, 30 bp, Artificial Sequence
  Description of Artificial Sequence: Synthetic oligonucleotide
gggtctatgtgttcctggagaagctggatc

SEQ ID NO: 289103 - DNA, 31 bp, Artificial Sequence
  Description of Artificial Sequence: Synthetic oligonucleotide
ggtctatgtgttcctggagaagctggatctg

SEQ ID NO: 289104 - DNA, 31 bp, Artificial Sequence
  Description of Artificial Sequence: Synthetic oligonucleotide
gtctatgtgttcctggagaagctggatctgg

SEQ ID NO: 289105 - DNA, 32 bp, Artificial Sequence
  Description of Artificial Sequence: Synthetic oligonucleotide
tctatgtgttcctggagaagctggatctggtg

SEQ ID NO: 289106 - DNA, 31 bp, Artificial Sequence
  Description of Artificial Sequence: Synthetic oligonucleotide
ctatgtgttcctggagaagctggatctggtg

SEQ ID NO: 289107 - DNA, 31 bp, Artificial Sequence
  Description of Artificial Sequence: Synthetic oligonucleotide
tatgtgttcctggagaagctggatctggtgc

SEQ ID NO: 289108 - DNA, 30 bp, Artificial Sequence
  Description of Artificial Sequence: Synthetic oligonucleotide
atgtgttcctggagaagctggatctggtgc

SEQ ID NO: 289109 - DNA, 29 bp, Artificial Sequence
  Description of Artificial Sequence: Synthetic oligonucleotide
tgtgttcctggagaagctggatctggtgc

SEQ ID NO: 289110 - DNA, 28 bp, Artificial Sequence
  Description of Artificial Sequence: Synthetic oligonucleotide
gtgttcctggagaagctggatctggtgc
